United States Patent 12,394,502 (METHOD FOR PREDICTING HLA-BINDING PEPTIDES USING PROTEIN STRUCTURAL FEATURES) - sequence listing, part 2

SEQ ID NO: 37916 - protein, 11 aa, Homo Sapiens
GGFGGGSFRGS

SEQ ID NO: 37917 - protein, 11 aa, Homo Sapiens
GVFTGPGGHSY

SEQ ID NO: 37918 - protein, 11 aa, Homo Sapiens
HSFGGGTGSGF

SEQ ID NO: 37919 - protein, 11 aa, Homo Sapiens
HTIELEPNRQF

SEQ ID NO: 37920 - protein, 11 aa, Homo Sapiens
HTVGEKVIVDF

SEQ ID NO: 37921 - protein, 11 aa, Homo Sapiens
HVAPDSIRGSF

SEQ ID NO: 37922 - protein, 11 aa, Homo Sapiens
HVAPSDTVLMF

SEQ ID NO: 37923 - protein, 11 aa, Homo Sapiens
HVIDVDSGNSY

SEQ ID NO: 37924 - protein, 11 aa, Homo Sapiens
HVIEDHERIGY

SEQ ID NO: 37925 - protein, 11 aa, Homo Sapiens
HVIENLHAAAY

SEQ ID NO: 37926 - protein, 11 aa, Homo Sapiens
HVLIDVGTGYY

SEQ ID NO: 37927 - protein, 11 aa, Homo Sapiens
HVPDPVISIAM

SEQ ID NO: 37928 - protein, 11 aa, Homo Sapiens
HVPGADILNSY

SEQ ID NO: 37929 - protein, 11 aa, Homo Sapiens
HVVKREAILLY

SEQ ID NO: 37930 - protein, 11 aa, Homo Sapiens
HVYDGKFLARV

SEQ ID NO: 37931 - protein, 11 aa, Homo Sapiens
ITQIEHEVSSS

SEQ ID NO: 37932 - protein, 11 aa, Homo Sapiens
IVAEPGAVLLY

SEQ ID NO: 37933 - protein, 11 aa, Homo Sapiens
KKDVDNAYMIK

SEQ ID NO: 37934 - protein, 11 aa, Homo Sapiens
MPVGPDAILRY

SEQ ID NO: 37935 - protein, 11 aa, Homo Sapiens
NIPGSELMSSF

SEQ ID NO: 37936 - protein, 11 aa, Homo Sapiens
NLGGSKRISIS

SEQ ID NO: 37937 - protein, 11 aa, Homo Sapiens
NVIDVNKVVEY

SEQ ID NO: 37938 - protein, 11 aa, Homo Sapiens
NVIDYGHASKY

SEQ ID NO: 37939 - protein, 11 aa, Homo Sapiens
NVIESKAYVGR

SEQ ID NO: 37940 - protein, 11 aa, Homo Sapiens
QVIEAEGLKEM

SEQ ID NO: 37941 - protein, 11 aa, Homo Sapiens
RVVGSELIQKY

SEQ ID NO: 37942 - protein, 11 aa, Homo Sapiens
SILDRDDIFVY

SEQ ID NO: 37943 - protein, 11 aa, Homo Sapiens
SSTISSNVASK

SEQ ID NO: 37944 - protein, 11 aa, Homo Sapiens
STFKETENTAY

SEQ ID NO: 37945 - protein, 11 aa, Homo Sapiens
STIDDSQICRF

SEQ ID NO: 37946 - protein, 11 aa, Homo Sapiens
SVADKEAIANF

SEQ ID NO: 37947 - protein, 11 aa, Homo Sapiens
SVIDSAELQAY

SEQ ID NO: 37948 - protein, 11 aa, Homo Sapiens
SVINSKASLTY

SEQ ID NO: 37949 - protein, 11 aa, Homo Sapiens
SVISKIDLHKY

SEQ ID NO: 37950 - protein, 11 aa, Homo Sapiens
SVYGGGGIHEY

SEQ ID NO: 37951 - protein, 11 aa, Homo Sapiens
TVADQVLVGSY

SEQ ID NO: 37952 - protein, 11 aa, Homo Sapiens
TVAGLALIKKY

SEQ ID NO: 37953 - protein, 11 aa, Homo Sapiens
TVIDEVRTGTY

SEQ ID NO: 37954 - protein, 11 aa, Homo Sapiens
VPKTAENFRQF

SEQ ID NO: 37955 - protein, 11 aa, Homo Sapiens
VVYDGEHLGSF

SEQ ID NO: 37956 - protein, 11 aa, Homo Sapiens
YVADLENMVQY

SEQ ID NO: 37957 - protein, 11 aa, Homo Sapiens
YVFFEKDFGDM

SEQ ID NO: 37958 - protein, 8 aa, Homo Sapiens
HFDPTISL

SEQ ID NO: 37959 - protein, 8 aa, Homo Sapiens
PDVGNFHY

SEQ ID NO: 37960 - protein, 8 aa, Homo Sapiens
TILNTLIY

SEQ ID NO: 37961 - protein, 9 aa, Homo Sapiens
AAAAAALLY

SEQ ID NO: 37962 - protein, 9 aa, Homo Sapiens
AAFKIFLKY

SEQ ID NO: 37963 - protein, 9 aa, Homo Sapiens
AAIGLVIYY

SEQ ID NO: 37964 - protein, 9 aa, Homo Sapiens
AALQRYLFY

SEQ ID NO: 37965 - protein, 9 aa, Homo Sapiens
AASFINLLY

SEQ ID NO: 37966 - protein, 9 aa, Homo Sapiens
AAYQLAFRY

SEQ ID NO: 37967 - protein, 9 aa, Homo Sapiens
AFDIPRFVY

SEQ ID NO: 37968 - protein, 9 aa, Homo Sapiens
AFFAERLYY

SEQ ID NO: 37969 - protein, 9 aa, Homo Sapiens
AFGDLALFF

SEQ ID NO: 37970 - protein, 9 aa, Homo Sapiens
AFIEKHWTF

SEQ ID NO: 37971 - protein, 9 aa, Homo Sapiens
AFIHISTAY

SEQ ID NO: 37972 - protein, 9 aa, Homo Sapiens
AFISIGFSY

SEQ ID NO: 37973 - protein, 9 aa, Homo Sapiens
AFKEMFLDY

SEQ ID NO: 37974 - protein, 9 aa, Homo Sapiens
AFLNAIMRY

SEQ ID NO: 37975 - protein, 9 aa, Homo Sapiens
AFLSQELLY

SEQ ID NO: 37976 - protein, 9 aa, Homo Sapiens
AFNSKQLLY

SEQ ID NO: 37977 - protein, 9 aa, Homo Sapiens
AFQFLQLYY

SEQ ID NO: 37978 - protein, 9 aa, Homo Sapiens
AIAEIWPKY

SEQ ID NO: 37979 - protein, 9 aa, Homo Sapiens
AIDQLHLEY

SEQ ID NO: 37980 - protein, 9 aa, Homo Sapiens
AIFPSPMMY

SEQ ID NO: 37981 - protein, 9 aa, Homo Sapiens
AIIDILTHY

SEQ ID NO: 37982 - protein, 9 aa, Homo Sapiens
AIIPSHLAY

SEQ ID NO: 37983 - protein, 9 aa, Homo Sapiens
AIITTHLQY

SEQ ID NO: 37984 - protein, 9 aa, Homo Sapiens
AILHHLYFY

SEQ ID NO: 37985 - protein, 9 aa, Homo Sapiens
AILKMILMY

SEQ ID NO: 37986 - protein, 9 aa, Homo Sapiens
AILSKFLYY

SEQ ID NO: 37987 - protein, 9 aa, Homo Sapiens
ALAGTFHYY

SEQ ID NO: 37988 - protein, 9 aa, Homo Sapiens
ALAPAGFSY

SEQ ID NO: 37989 - protein, 9 aa, Homo Sapiens
ALAQARLLY

SEQ ID NO: 37990 - protein, 9 aa, Homo Sapiens
ALEKIDLKF

SEQ ID NO: 37991 - protein, 9 aa, Homo Sapiens
ALFMPPTYY

SEQ ID NO: 37992 - protein, 9 aa, Homo Sapiens
ALFTQGLGY

SEQ ID NO: 37993 - protein, 9 aa, Homo Sapiens
ALFTSVFLY

SEQ ID NO: 37994 - protein, 9 aa, Homo Sapiens
ALHMLFLLY

SEQ ID NO: 37995 - protein, 9 aa, Homo Sapiens
ALIEELLLY

SEQ ID NO: 37996 - protein, 9 aa, Homo Sapiens
ALINTVLKY

SEQ ID NO: 37997 - protein, 9 aa, Homo Sapiens
ALLDLSFAY

SEQ ID NO: 37998 - protein, 9 aa, Homo Sapiens
ALLDSQFSY

SEQ ID NO: 37999 - protein, 9 aa, Homo Sapiens
ALLEYHLSY

SEQ ID NO: 38000 - protein, 9 aa, Homo Sapiens
ALLNFVVKY

SEQ ID NO: 38001 - protein, 9 aa, Homo Sapiens
ALLQLGLKY

SEQ ID NO: 38002 - protein, 9 aa, Homo Sapiens
ALLSIFSRY

SEQ ID NO: 38003 - protein, 9 aa, Homo Sapiens
ALLSKIHLY

SEQ ID NO: 38004 - protein, 9 aa, Homo Sapiens
ALLSLHFLF

SEQ ID NO: 38005 - protein, 9 aa, Homo Sapiens
ALLTLLLVY

SEQ ID NO: 38006 - protein, 9 aa, Homo Sapiens
ALMATQTFY

SEQ ID NO: 38007 - protein, 9 aa, Homo Sapiens
ALNALILAY

SEQ ID NO: 38008 - protein, 9 aa, Homo Sapiens
ALNFSVFYY

SEQ ID NO: 38009 - protein, 9 aa, Homo Sapiens
ALPKAAFQY

SEQ ID NO: 38010 - protein, 9 aa, Homo Sapiens
ALSDLALHF

SEQ ID NO: 38011 - protein, 9 aa, Homo Sapiens
ALTDAYLLY

SEQ ID NO: 38012 - protein, 9 aa, Homo Sapiens
ALYKKILKY

SEQ ID NO: 38013 - protein, 9 aa, Homo Sapiens
AMMGLAQIY

SEQ ID NO: 38014 - protein, 9 aa, Homo Sapiens
AQVQVLLYY

SEQ ID NO: 38015 - protein, 9 aa, Homo Sapiens
ASNPAMLLY

SEQ ID NO: 38016 - protein, 9 aa, Homo Sapiens
ATADVVILY

SEQ ID NO: 38017 - protein, 9 aa, Homo Sapiens
ATALFSFLY

SEQ ID NO: 38018 - protein, 9 aa, Homo Sapiens
ATDIPCLLY

SEQ ID NO: 38019 - protein, 9 aa, Homo Sapiens
ATLPRNFHY

SEQ ID NO: 38020 - protein, 9 aa, Homo Sapiens
ATLSLFNTY

SEQ ID NO: 38021 - protein, 9 aa, Homo Sapiens
ATSKVALVY

SEQ ID NO: 38022 - protein, 9 aa, Homo Sapiens
ATSNVFAMF

SEQ ID NO: 38023 - protein, 9 aa, Homo Sapiens
AVALSLLLY

SEQ ID NO: 38024 - protein, 9 aa, Homo Sapiens
AVHDITVAY

SEQ ID NO: 38025 - protein, 9 aa, Homo Sapiens
AVIEDTWHY

SEQ ID NO: 38026 - protein, 9 aa, Homo Sapiens
AVISTILKY

SEQ ID NO: 38027 - protein, 9 aa, Homo Sapiens
AVITVPAYF

SEQ ID NO: 38028 - protein, 9 aa, Homo Sapiens
AVLLVFVRY

SEQ ID NO: 38029 - protein, 9 aa, Homo Sapiens
AVLRDLLRY

SEQ ID NO: 38030 - protein, 9 aa, Homo Sapiens
AVLRIPILY

SEQ ID NO: 38031 - protein, 9 aa, Homo Sapiens
AVNSLVNLY

SEQ ID NO: 38032 - protein, 9 aa, Homo Sapiens
AVQHFSLLY

SEQ ID NO: 38033 - protein, 9 aa, Homo Sapiens
AVSNLALQF

SEQ ID NO: 38034 - protein, 9 aa, Homo Sapiens
AVVGIGLVY

SEQ ID NO: 38035 - protein, 9 aa, Homo Sapiens
AVYPVFLFY

SEQ ID NO: 38036 - protein, 9 aa, Homo Sapiens
AVYTIALRY

SEQ ID NO: 38037 - protein, 9 aa, Homo Sapiens
AYFPYFITY

SEQ ID NO: 38038 - protein, 9 aa, Homo Sapiens
AYLDQYLWY

SEQ ID NO: 38039 - protein, 9 aa, Homo Sapiens
DFIYLHLSY

SEQ ID NO: 38040 - protein, 9 aa, Homo Sapiens
DFLDKLLRY

SEQ ID NO: 38041 - protein, 9 aa, Homo Sapiens
DIWPNPLQY

SEQ ID NO: 38042 - protein, 9 aa, Homo Sapiens
DQLKEYLFY

SEQ ID NO: 38043 - protein, 9 aa, Homo Sapiens
DVLPFALRY

SEQ ID NO: 38044 - protein, 9 aa, Homo Sapiens
DVYNHFLLY

SEQ ID NO: 38045 - protein, 9 aa, Homo Sapiens
DYLGIPLFY

SEQ ID NO: 38046 - protein, 9 aa, Homo Sapiens
EVLGLILRY

SEQ ID NO: 38047 - protein, 9 aa, Homo Sapiens
EVLNFLLRY

SEQ ID NO: 38048 - protein, 9 aa, Homo Sapiens
EVMDVFLRF

SEQ ID NO: 38049 - protein, 9 aa, Homo Sapiens
EYFLLKAKY

SEQ ID NO: 38050 - protein, 9 aa, Homo Sapiens
FALVFPLMY

SEQ ID NO: 38051 - protein, 9 aa, Homo Sapiens
FASPTQVFF

SEQ ID NO: 38052 - protein, 9 aa, Homo Sapiens
FFAAITNKY

SEQ ID NO: 38053 - protein, 9 aa, Homo Sapiens
FFAKIPYYY

SEQ ID NO: 38054 - protein, 9 aa, Homo Sapiens
FFEAVGVTY

SEQ ID NO: 38055 - protein, 9 aa, Homo Sapiens
FFFPLLQRF

SEQ ID NO: 38056 - protein, 9 aa, Homo Sapiens
FFGDFGFMF

SEQ ID NO: 38057 - protein, 9 aa, Homo Sapiens
FFGDVVLRF

SEQ ID NO: 38058 - protein, 9 aa, Homo Sapiens
FFGETSHNY

SEQ ID NO: 38059 - protein, 9 aa, Homo Sapiens
FFGMHVQEY

SEQ ID NO: 38060 - protein, 9 aa, Homo Sapiens
FFGPVGFNF

SEQ ID NO: 38061 - protein, 9 aa, Homo Sapiens
FFIAGRYEF

SEQ ID NO: 38062 - protein, 9 aa, Homo Sapiens
FFISLLESY

SEQ ID NO: 38063 - protein, 9 aa, Homo Sapiens
FFITYIPFY

SEQ ID NO: 38064 - protein, 9 aa, Homo Sapiens
FFLIVKTLY

SEQ ID NO: 38065 - protein, 9 aa, Homo Sapiens
FFNIPQIQY

SEQ ID NO: 38066 - protein, 9 aa, Homo Sapiens
FFNRINLIY

SEQ ID NO: 38067 - protein, 9 aa, Homo Sapiens
FFSLPHVGY

SEQ ID NO: 38068 - protein, 9 aa, Homo Sapiens
FFSQIGELY

SEQ ID NO: 38069 - protein, 9 aa, Homo Sapiens
FFTGDVFGY

SEQ ID NO: 38070 - protein, 9 aa, Homo Sapiens
FFYFEGTFY

SEQ ID NO: 38071 - protein, 9 aa, Homo Sapiens
FFYPLDFTF

SEQ ID NO: 38072 - protein, 9 aa, Homo Sapiens
FIALITDSY

SEQ ID NO: 38073 - protein, 9 aa, Homo Sapiens
FIANHPFLF

SEQ ID NO: 38074 - protein, 9 aa, Homo Sapiens
FIANLFNRY

SEQ ID NO: 38075 - protein, 9 aa, Homo Sapiens
FIDASRLVY

SEQ ID NO: 38076 - protein, 9 aa, Homo Sapiens
FIDSFRPLY

SEQ ID NO: 38077 - protein, 9 aa, Homo Sapiens
FIDSIIAKY

SEQ ID NO: 38078 - protein, 9 aa, Homo Sapiens
FIGEFAYTY

SEQ ID NO: 38079 - protein, 9 aa, Homo Sapiens
FIGYPITLY

SEQ ID NO: 38080 - protein, 9 aa, Homo Sapiens
FILDVITYY

SEQ ID NO: 38081 - protein, 9 aa, Homo Sapiens
FILSLILEY

SEQ ID NO: 38082 - protein, 9 aa, Homo Sapiens
FILWRHLEY

SEQ ID NO: 38083 - protein, 9 aa, Homo Sapiens
FIPFLPLEY

SEQ ID NO: 38084 - protein, 9 aa, Homo Sapiens
FIPPIVARY

SEQ ID NO: 38085 - protein, 9 aa, Homo Sapiens
FIPSAYPYY

SEQ ID NO: 38086 - protein, 9 aa, Homo Sapiens
FISGLFNFY

SEQ ID NO: 38087 - protein, 9 aa, Homo Sapiens
FISHVLAFF

SEQ ID NO: 38088 - protein, 9 aa, Homo Sapiens
FIYHLPQEF

SEQ ID NO: 38089 - protein, 9 aa, Homo Sapiens
FLDLVNYVY

SEQ ID NO: 38090 - protein, 9 aa, Homo Sapiens
FLFAPTLIY

SEQ ID NO: 38091 - protein, 9 aa, Homo Sapiens
FLIDLKTRY

SEQ ID NO: 38092 - protein, 9 aa, Homo Sapiens
FLLDRLLQY

SEQ ID NO: 38093 - protein, 9 aa, Homo Sapiens
FLLNHSLEY

SEQ ID NO: 38094 - protein, 9 aa, Homo Sapiens
FLLPIVVRY

SEQ ID NO: 38095 - protein, 9 aa, Homo Sapiens
FLNDSYLKY

SEQ ID NO: 38096 - protein, 9 aa, Homo Sapiens
FLPELIWCY

SEQ ID NO: 38097 - protein, 9 aa, Homo Sapiens
FLPFPLPLF

SEQ ID NO: 38098 - protein, 9 aa, Homo Sapiens
FLPGMAIGY

SEQ ID NO: 38099 - protein, 9 aa, Homo Sapiens
FLPGWNLIY

SEQ ID NO: 38100 - protein, 9 aa, Homo Sapiens
FLPLLNIEF

SEQ ID NO: 38101 - protein, 9 aa, Homo Sapiens
FLVHESFLY

SEQ ID NO: 38102 - protein, 9 aa, Homo Sapiens
FLWPEAFLY

SEQ ID NO: 38103 - protein, 9 aa, Homo Sapiens
FMFPVGLYY

SEQ ID NO: 38104 - protein, 9 aa, Homo Sapiens
FMITFPYGY

SEQ ID NO: 38105 - protein, 9 aa, Homo Sapiens
FMLHIWGKY

SEQ ID NO: 38106 - protein, 9 aa, Homo Sapiens
FMTHLILFF

SEQ ID NO: 38107 - protein, 9 aa, Homo Sapiens
FQLETNLLY

SEQ ID NO: 38108 - protein, 9 aa, Homo Sapiens
FQMAILLQY

SEQ ID NO: 38109 - protein, 9 aa, Homo Sapiens
FQNALIVRY

SEQ ID NO: 38110 - protein, 9 aa, Homo Sapiens
FSFGYALVY

SEQ ID NO: 38111 - protein, 9 aa, Homo Sapiens
FTLADILLY

SEQ ID NO: 38112 - protein, 9 aa, Homo Sapiens
FTSMTRLYY

SEQ ID NO: 38113 - protein, 9 aa, Homo Sapiens
FVADLHLNY

SEQ ID NO: 38114 - protein, 9 aa, Homo Sapiens
FVAGVVTFY

SEQ ID NO: 38115 - protein, 9 aa, Homo Sapiens
FVAKFMALY

SEQ ID NO: 38116 - protein, 9 aa, Homo Sapiens
FVANLFNKY

SEQ ID NO: 38117 - protein, 9 aa, Homo Sapiens
FVGGLPLAY

SEQ ID NO: 38118 - protein, 9 aa, Homo Sapiens
FVGHMDYKY

SEQ ID NO: 38119 - protein, 9 aa, Homo Sapiens
FVITKPDVY

SEQ ID NO: 38120 - protein, 9 aa, Homo Sapiens
FVKPSFDQY

SEQ ID NO: 38121 - protein, 9 aa, Homo Sapiens
FVNDYILYY

SEQ ID NO: 38122 - protein, 9 aa, Homo Sapiens
FVNKFNVLY

SEQ ID NO: 38123 - protein, 9 aa, Homo Sapiens
FVNPTSFVY

SEQ ID NO: 38124 - protein, 9 aa, Homo Sapiens
FVPFLPLEY

SEQ ID NO: 38125 - protein, 9 aa, Homo Sapiens
FVSGVKIFY

SEQ ID NO: 38126 - protein, 9 aa, Homo Sapiens
FVTDLLLHF

SEQ ID NO: 38127 - protein, 9 aa, Homo Sapiens
FVVAVGAEY

SEQ ID NO: 38128 - protein, 9 aa, Homo Sapiens
FVVSQPLNY

SEQ ID NO: 38129 - protein, 9 aa, Homo Sapiens
FYAPELLYY

SEQ ID NO: 38130 - protein, 9 aa, Homo Sapiens
FYEVFKVLY

SEQ ID NO: 38131 - protein, 9 aa, Homo Sapiens
FYNLIHPEY

SEQ ID NO: 38132 - protein, 9 aa, Homo Sapiens
FYPELKLAY

SEQ ID NO: 38133 - protein, 9 aa, Homo Sapiens
FYQGAAFPF

SEQ ID NO: 38134 - protein, 9 aa, Homo Sapiens
GAAAIILTY

SEQ ID NO: 38135 - protein, 9 aa, Homo Sapiens
GAAGILLRY

SEQ ID NO: 38136 - protein, 9 aa, Homo Sapiens
GAAGVHFIY

SEQ ID NO: 38137 - protein, 9 aa, Homo Sapiens
GALETLLRY

SEQ ID NO: 38138 - protein, 9 aa, Homo Sapiens
GAMGIMLVY

SEQ ID NO: 38139 - protein, 9 aa, Homo Sapiens
GFAALQLEY

SEQ ID NO: 38140 - protein, 9 aa, Homo Sapiens
GFTAIVLTY

SEQ ID NO: 38141 - protein, 9 aa, Homo Sapiens
GFYFAKLYY

SEQ ID NO: 38142 - protein, 9 aa, Homo Sapiens
GIADFVLKY

SEQ ID NO: 38143 - protein, 9 aa, Homo Sapiens
GIFASRLYY

SEQ ID NO: 38144 - protein, 9 aa, Homo Sapiens
GIVNILLKY

SEQ ID NO: 38145 - protein, 9 aa, Homo Sapiens
GLATQAFHY

SEQ ID NO: 38146 - protein, 9 aa, Homo Sapiens
GLDDKLLHY

SEQ ID NO: 38147 - protein, 9 aa, Homo Sapiens
GLHGVTFGY

SEQ ID NO: 38148 - protein, 9 aa, Homo Sapiens
GLIDLVFLY

SEQ ID NO: 38149 - protein, 9 aa, Homo Sapiens
GLIHLAIHY

SEQ ID NO: 38150 - protein, 9 aa, Homo Sapiens
GLLDVGLRY

SEQ ID NO: 38151 - protein, 9 aa, Homo Sapiens
GLLEEALFY

SEQ ID NO: 38152 - protein, 9 aa, Homo Sapiens
GLLEKLLDY

SEQ ID NO: 38153 - protein, 9 aa, Homo Sapiens
GLLNLSLLY

SEQ ID NO: 38154 - protein, 9 aa, Homo Sapiens
GLPDLVAKY

SEQ ID NO: 38155 - protein, 9 aa, Homo Sapiens
GLPGVFVLY

SEQ ID NO: 38156 - protein, 9 aa, Homo Sapiens
GLPSQAFEY

SEQ ID NO: 38157 - protein, 9 aa, Homo Sapiens
GLSALILRY

SEQ ID NO: 38158 - protein, 9 aa, Homo Sapiens
GMLEKAVFY

SEQ ID NO: 38159 - protein, 9 aa, Homo Sapiens
GQLVKMLLY

SEQ ID NO: 38160 - protein, 9 aa, Homo Sapiens
GSLALFLIY

SEQ ID NO: 38161 - protein, 9 aa, Homo Sapiens
GSWDKTLKF

SEQ ID NO: 38162 - protein, 9 aa, Homo Sapiens
GTADITLRF

SEQ ID NO: 38163 - protein, 9 aa, Homo Sapiens
GTDELRLLY

SEQ ID NO: 38164 - protein, 9 aa, Homo Sapiens
GTISEVWDY

SEQ ID NO: 38165 - protein, 9 aa, Homo Sapiens
GTLDSVLRY

SEQ ID NO: 38166 - protein, 9 aa, Homo Sapiens
GTVYEDLRY

SEQ ID NO: 38167 - protein, 9 aa, Homo Sapiens
GVFFPVFAY

SEQ ID NO: 38168 - protein, 9 aa, Homo Sapiens
GVLDTELRY

SEQ ID NO: 38169 - protein, 9 aa, Homo Sapiens
GVLKIQVHY

SEQ ID NO: 38170 - protein, 9 aa, Homo Sapiens
GVMDYYLKY

SEQ ID NO: 38171 - protein, 9 aa, Homo Sapiens
GVSGIFMKY

SEQ ID NO: 38172 - protein, 9 aa, Homo Sapiens
GVSQMPLRY

SEQ ID NO: 38173 - protein, 9 aa, Homo Sapiens
GWAIIPLMY

SEQ ID NO: 38174 - protein, 9 aa, Homo Sapiens
GWAPTFLGY

SEQ ID NO: 38175 - protein, 9 aa, Homo Sapiens
GYDIKLLRY

SEQ ID NO: 38176 - protein, 9 aa, Homo Sapiens
GYFAGKLSY

SEQ ID NO: 38177 - protein, 9 aa, Homo Sapiens
GYLHDFLKY

SEQ ID NO: 38178 - protein, 9 aa, Homo Sapiens
GYLRDFLRY

SEQ ID NO: 38179 - protein, 9 aa, Homo Sapiens
GYPEVALHF

SEQ ID NO: 38180 - protein, 9 aa, Homo Sapiens
HAIRLLLEY

SEQ ID NO: 38181 - protein, 9 aa, Homo Sapiens
HAISRYWYY

SEQ ID NO: 38182 - protein, 9 aa, Homo Sapiens
HFAFYAYHY

SEQ ID NO: 38183 - protein, 9 aa, Homo Sapiens
HFDSPYLLY

SEQ ID NO: 38184 - protein, 9 aa, Homo Sapiens
HFGIVEGLM

SEQ ID NO: 38185 - protein, 9 aa, Homo Sapiens
HFGLFPANY

SEQ ID NO: 38186 - protein, 9 aa, Homo Sapiens
HFLDRHLVF

SEQ ID NO: 38187 - protein, 9 aa, Homo Sapiens
HFLVTRLLY

SEQ ID NO: 38188 - protein, 9 aa, Homo Sapiens
HILGFELKY

SEQ ID NO: 38189 - protein, 9 aa, Homo Sapiens
HIMEIFSTY

SEQ ID NO: 38190 - protein, 9 aa, Homo Sapiens
HLSSLQLFY

SEQ ID NO: 38191 - protein, 9 aa, Homo Sapiens
HNLSANLFY

SEQ ID NO: 38192 - protein, 9 aa, Homo Sapiens
HTLPDSLVY

SEQ ID NO: 38193 - protein, 9 aa, Homo Sapiens
HTYQSPLLY

SEQ ID NO: 38194 - protein, 9 aa, Homo Sapiens
HVIDVKFLY

SEQ ID NO: 38195 - protein, 9 aa, Homo Sapiens
HVLFIKLLY

SEQ ID NO: 38196 - protein, 9 aa, Homo Sapiens
HVNDLFLQY

SEQ ID NO: 38197 - protein, 9 aa, Homo Sapiens
HWIDLIFGY

SEQ ID NO: 38198 - protein, 9 aa, Homo Sapiens
HWIDLTFGY

SEQ ID NO: 38199 - protein, 9 aa, Homo Sapiens
HYLNLNLFF

SEQ ID NO: 38200 - protein, 9 aa, Homo Sapiens
HYNNIMALY

SEQ ID NO: 38201 - protein, 9 aa, Homo Sapiens
HYSPIYLSF

SEQ ID NO: 38202 - protein, 9 aa, Homo Sapiens
HYYSITINY

SEQ ID NO: 38203 - protein, 9 aa, Homo Sapiens
IANQVQLFY

SEQ ID NO: 38204 - protein, 9 aa, Homo Sapiens
IAQAESLRY

SEQ ID NO: 38205 - protein, 9 aa, Homo Sapiens
IASNIWAAY

SEQ ID NO: 38206 - protein, 9 aa, Homo Sapiens
IAYGVIELY

SEQ ID NO: 38207 - protein, 9 aa, Homo Sapiens
IFAIPLQIY

SEQ ID NO: 38208 - protein, 9 aa, Homo Sapiens
IFHDISLRF

SEQ ID NO: 38209 - protein, 9 aa, Homo Sapiens
IFHEVPLKF

SEQ ID NO: 38210 - protein, 9 aa, Homo Sapiens
IFIEDAIKY

SEQ ID NO: 38211 - protein, 9 aa, Homo Sapiens
IFIEDYLKY

SEQ ID NO: 38212 - protein, 9 aa, Homo Sapiens
IFIHLNDIY

SEQ ID NO: 38213 - protein, 9 aa, Homo Sapiens
IFILPSIFY

SEQ ID NO: 38214 - protein, 9 aa, Homo Sapiens
IFKDFVNKY

SEQ ID NO: 38215 - protein, 9 aa, Homo Sapiens
IFLETELFY

SEQ ID NO: 38216 - protein, 9 aa, Homo Sapiens
IFLFLDRTY

SEQ ID NO: 38217 - protein, 9 aa, Homo Sapiens
IFMDVLFVY

SEQ ID NO: 38218 - protein, 9 aa, Homo Sapiens
IFSDLNATY

SEQ ID NO: 38219 - protein, 9 aa, Homo Sapiens
IFTDVALKF

SEQ ID NO: 38220 - protein, 9 aa, Homo Sapiens
IFWTLPHEY

SEQ ID NO: 38221 - protein, 9 aa, Homo Sapiens
IIAKVFLAY

SEQ ID NO: 38222 - protein, 9 aa, Homo Sapiens
IIFDRPLLY

SEQ ID NO: 38223 - protein, 9 aa, Homo Sapiens
IIHDFPQFY

SEQ ID NO: 38224 - protein, 9 aa, Homo Sapiens
IIIDKEYYY

SEQ ID NO: 38225 - protein, 9 aa, Homo Sapiens
IIIKPLPGY

SEQ ID NO: 38226 - protein, 9 aa, Homo Sapiens
IILPRGLEY

SEQ ID NO: 38227 - protein, 9 aa, Homo Sapiens
IIPAIWFRY

SEQ ID NO: 38228 - protein, 9 aa, Homo Sapiens
IISEFALEY

SEQ ID NO: 38229 - protein, 9 aa, Homo Sapiens
IIVPFGLLY

SEQ ID NO: 38230 - protein, 9 aa, Homo Sapiens
ILAEESYLY

SEQ ID NO: 38231 - protein, 9 aa, Homo Sapiens
ILAQLNAKY

SEQ ID NO: 38232 - protein, 9 aa, Homo Sapiens
ILFKGDLNY

SEQ ID NO: 38233 - protein, 9 aa, Homo Sapiens
ILFSGVHFY

SEQ ID NO: 38234 - protein, 9 aa, Homo Sapiens
ILLDLNISY

SEQ ID NO: 38235 - protein, 9 aa, Homo Sapiens
ILLGLIIAY

SEQ ID NO: 38236 - protein, 9 aa, Homo Sapiens
ILMSLVLSY

SEQ ID NO: 38237 - protein, 9 aa, Homo Sapiens
ILNDMVWKY

SEQ ID NO: 38238 - protein, 9 aa, Homo Sapiens
ILNSLSLCY

SEQ ID NO: 38239 - protein, 9 aa, Homo Sapiens
ILSDIGLEY

SEQ ID NO: 38240 - protein, 9 aa, Homo Sapiens
ILSPLLLLF

SEQ ID NO: 38241 - protein, 9 aa, Homo Sapiens
ILYNIKQEY

SEQ ID NO: 38242 - protein, 9 aa, Homo Sapiens
IMFGVPYVY

SEQ ID NO: 38243 - protein, 9 aa, Homo Sapiens
IMKFINDQY

SEQ ID NO: 38244 - protein, 9 aa, Homo Sapiens
IMLPFRFTY

SEQ ID NO: 38245 - protein, 9 aa, Homo Sapiens
IMLPGVLRY

SEQ ID NO: 38246 - protein, 9 aa, Homo Sapiens
IPLDPVAGY

SEQ ID NO: 38247 - protein, 9 aa, Homo Sapiens
IPLFVQLLY

SEQ ID NO: 38248 - protein, 9 aa, Homo Sapiens
ITNPKSLLY

SEQ ID NO: 38249 - protein, 9 aa, Homo Sapiens
ITSSNFLHY

SEQ ID NO: 38250 - protein, 9 aa, Homo Sapiens
IVGPDGLVY

SEQ ID NO: 38251 - protein, 9 aa, Homo Sapiens
IVLPGNFLY

SEQ ID NO: 38252 - protein, 9 aa, Homo Sapiens
IVSILYLKY

SEQ ID NO: 38253 - protein, 9 aa, Homo Sapiens
IVSSLRLAY

SEQ ID NO: 38254 - protein, 9 aa, Homo Sapiens
IWFEKRLAY

SEQ ID NO: 38255 - protein, 9 aa, Homo Sapiens
IYADLSLKY

SEQ ID NO: 38256 - protein, 9 aa, Homo Sapiens
IYFQPPSFY

SEQ ID NO: 38257 - protein, 9 aa, Homo Sapiens
IYLDIIHTY

SEQ ID NO: 38258 - protein, 9 aa, Homo Sapiens
IYSPLLFKY

SEQ ID NO: 38259 - protein, 9 aa, Homo Sapiens
KALEQILEY

SEQ ID NO: 38260 - protein, 9 aa, Homo Sapiens
KAVSLFLCY

SEQ ID NO: 38261 - protein, 9 aa, Homo Sapiens
KFFFIPLSY

SEQ ID NO: 38262 - protein, 9 aa, Homo Sapiens
KIADRFLLY

SEQ ID NO: 38263 - protein, 9 aa, Homo Sapiens
KIYPLPHMY

SEQ ID NO: 38264 - protein, 9 aa, Homo Sapiens
KLFDKLLEY

SEQ ID NO: 38265 - protein, 9 aa, Homo Sapiens
KLFGFLLEY

SEQ ID NO: 38266 - protein, 9 aa, Homo Sapiens
KLFPYALAF

SEQ ID NO: 38267 - protein, 9 aa, Homo Sapiens
KLLDAYLLY

SEQ ID NO: 38268 - protein, 9 aa, Homo Sapiens
KLWKVALHF

SEQ ID NO: 38269 - protein, 9 aa, Homo Sapiens
KLWNEELKY

SEQ ID NO: 38270 - protein, 9 aa, Homo Sapiens
KMDDLNLHY

SEQ ID NO: 38271 - protein, 9 aa, Homo Sapiens
KNFGIWLRY

SEQ ID NO: 38272 - protein, 9 aa, Homo Sapiens
KQLQVLLAY

SEQ ID NO: 38273 - protein, 9 aa, Homo Sapiens
KQSQILLVY

SEQ ID NO: 38274 - protein, 9 aa, Homo Sapiens
KSLEAFFLY

SEQ ID NO: 38275 - protein, 9 aa, Homo Sapiens
KSTAISLFY

SEQ ID NO: 38276 - protein, 9 aa, Homo Sapiens
KTPEIYLAY

SEQ ID NO: 38277 - protein, 9 aa, Homo Sapiens
KVADMALHY

SEQ ID NO: 38278 - protein, 9 aa, Homo Sapiens
KVLPQTILY

SEQ ID NO: 38279 - protein, 9 aa, Homo Sapiens
KVLPVGVLY

SEQ ID NO: 38280 - protein, 9 aa, Homo Sapiens
KVLQKFLTY

SEQ ID NO: 38281 - protein, 9 aa, Homo Sapiens
KWTDLALQY

SEQ ID NO: 38282 - protein, 9 aa, Homo Sapiens
KYFDEHYEY

SEQ ID NO: 38283 - protein, 9 aa, Homo Sapiens
LAFGVPFLY

SEQ ID NO: 38284 - protein, 9 aa, Homo Sapiens
LALHYLLTY

SEQ ID NO: 38285 - protein, 9 aa, Homo Sapiens
LALNFSVFY

SEQ ID NO: 38286 - protein, 9 aa, Homo Sapiens
LALSHPYLY

SEQ ID NO: 38287 - protein, 9 aa, Homo Sapiens
LDILVPILF

SEQ ID NO: 38288 - protein, 9 aa, Homo Sapiens
LFAPFIVYY

SEQ ID NO: 38289 - protein, 9 aa, Homo Sapiens
LFGDVAMHY

SEQ ID NO: 38290 - protein, 9 aa, Homo Sapiens
LFGTVILKY

SEQ ID NO: 38291 - protein, 9 aa, Homo Sapiens
LFIDIFHEY

SEQ ID NO: 38292 - protein, 9 aa, Homo Sapiens
LFIHFANVY

SEQ ID NO: 38293 - protein, 9 aa, Homo Sapiens
LFKPFVESY

SEQ ID NO: 38294 - protein, 9 aa, Homo Sapiens
LFLDLLQSY

SEQ ID NO: 38295 - protein, 9 aa, Homo Sapiens
LFLLVFPAY

SEQ ID NO: 38296 - protein, 9 aa, Homo Sapiens
LFMSSFQSY

SEQ ID NO: 38297 - protein, 9 aa, Homo Sapiens
LFPLLATAY

SEQ ID NO: 38298 - protein, 9 aa, Homo Sapiens
LFQHFLDSY

SEQ ID NO: 38299 - protein, 9 aa, Homo Sapiens
LFSIAPLIY

SEQ ID NO: 38300 - protein, 9 aa, Homo Sapiens
LFSRVIPEY

SEQ ID NO: 38301 - protein, 9 aa, Homo Sapiens
LFVDEFLTY

SEQ ID NO: 38302 - protein, 9 aa, Homo Sapiens
LFWFGDLNY

SEQ ID NO: 38303 - protein, 9 aa, Homo Sapiens
LFWGGVMFY

SEQ ID NO: 38304 - protein, 9 aa, Homo Sapiens
LGLAVRLEY

SEQ ID NO: 38305 - protein, 9 aa, Homo Sapiens
LIFSVPIVY

SEQ ID NO: 38306 - protein, 9 aa, Homo Sapiens
LILEEILAY

SEQ ID NO: 38307 - protein, 9 aa, Homo Sapiens
LIMGLILRY

SEQ ID NO: 38308 - protein, 9 aa, Homo Sapiens
LLAALGYRY

SEQ ID NO: 38309 - protein, 9 aa, Homo Sapiens
LLANMVYQY

SEQ ID NO: 38310 - protein, 9 aa, Homo Sapiens
LLDTNRYLY

SEQ ID NO: 38311 - protein, 9 aa, Homo Sapiens
LLHDRSFSY

SEQ ID NO: 38312 - protein, 9 aa, Homo Sapiens
LLNQMILTY

SEQ ID NO: 38313 - protein, 9 aa, Homo Sapiens
LLPFLDAQY

SEQ ID NO: 38314 - protein, 9 aa, Homo Sapiens
LLSPILARY

SEQ ID NO: 38315 - protein, 9 aa, Homo Sapiens
LLTAVQLLY

SEQ ID NO: 38316 - protein, 9 aa, Homo Sapiens
LLTDIIAAY

SEQ ID NO: 38317 - protein, 9 aa, Homo Sapiens
LLWDRILGY

SEQ ID NO: 38318 - protein, 9 aa, Homo Sapiens
LNFHVFLEY

SEQ ID NO: 38319 - protein, 9 aa, Homo Sapiens
LNLPYFLRY

SEQ ID NO: 38320 - protein, 9 aa, Homo Sapiens
LPLDIQIFY

SEQ ID NO: 38321 - protein, 9 aa, Homo Sapiens
LSFPTTKTY

SEQ ID NO: 38322 - protein, 9 aa, Homo Sapiens
LSHILEVLY

SEQ ID NO: 38323 - protein, 9 aa, Homo Sapiens
LSLGLVLSY

SEQ ID NO: 38324 - protein, 9 aa, Homo Sapiens
LSLGVAALY

SEQ ID NO: 38325 - protein, 9 aa, Homo Sapiens
LSTALSLLY

SEQ ID NO: 38326 - protein, 9 aa, Homo Sapiens
LTFPHPVYY

SEQ ID NO: 38327 - protein, 9 aa, Homo Sapiens
LTHSLVLHY

SEQ ID NO: 38328 - protein, 9 aa, Homo Sapiens
LVAACLLLY

SEQ ID NO: 38329 - protein, 9 aa, Homo Sapiens
LVAFIRAEY

SEQ ID NO: 38330 - protein, 9 aa, Homo Sapiens
LVFHLPVNY

SEQ ID NO: 38331 - protein, 9 aa, Homo Sapiens
LVFPFRTFY

SEQ ID NO: 38332 - protein, 9 aa, Homo Sapiens
LVPDLWIRY

SEQ ID NO: 38333 - protein, 9 aa, Homo Sapiens
LVSPLVYLY

SEQ ID NO: 38334 - protein, 9 aa, Homo Sapiens
LVYNGVYQY

SEQ ID NO: 38335 - protein, 9 aa, Homo Sapiens
LWGIDPVSY

SEQ ID NO: 38336 - protein, 9 aa, Homo Sapiens
LWIDRQWQY

SEQ ID NO: 38337 - protein, 9 aa, Homo Sapiens
LYIDRPLPY

SEQ ID NO: 38338 - protein, 9 aa, Homo Sapiens
LYINFRHLY

SEQ ID NO: 38339 - protein, 9 aa, Homo Sapiens
LYLPSFFTY

SEQ ID NO: 38340 - protein, 9 aa, Homo Sapiens
LYSHLVPVY

SEQ ID NO: 38341 - protein, 9 aa, Homo Sapiens
LYTSVVVKY

SEQ ID NO: 38342 - protein, 9 aa, Homo Sapiens
LYYQPGLLY

SEQ ID NO: 38343 - protein, 9 aa, Homo Sapiens
MALGLALRY

SEQ ID NO: 38344 - protein, 9 aa, Homo Sapiens
MANIPLPEY

SEQ ID NO: 38345 - protein, 9 aa, Homo Sapiens
MFFGLTPLY

SEQ ID NO: 38346 - protein, 9 aa, Homo Sapiens
MFTELAILY

SEQ ID NO: 38347 - protein, 9 aa, Homo Sapiens
MLYPLSHGF

SEQ ID NO: 38348 - protein, 9 aa, Homo Sapiens
MPLSVFPYY

SEQ ID NO: 38349 - protein, 9 aa, Homo Sapiens
MSMVANLLY

SEQ ID NO: 38350 - protein, 9 aa, Homo Sapiens
MTHNLLLNY

SEQ ID NO: 38351 - protein, 9 aa, Homo Sapiens
MVLDLRAFY

SEQ ID NO: 38352 - protein, 9 aa, Homo Sapiens
MVLNSHDLY

SEQ ID NO: 38353 - protein, 9 aa, Homo Sapiens
MVLTIFIKY

SEQ ID NO: 38354 - protein, 9 aa, Homo Sapiens
MVPAISLAY

SEQ ID NO: 38355 - protein, 9 aa, Homo Sapiens
MVSSVVGFY

SEQ ID NO: 38356 - protein, 9 aa, Homo Sapiens
MVTEIRLKY

SEQ ID NO: 38357 - protein, 9 aa, Homo Sapiens
MWSIGVITY

SEQ ID NO: 38358 - protein, 9 aa, Homo Sapiens
MYVHAYTLY

SEQ ID NO: 38359 - protein, 9 aa, Homo Sapiens
NAFDVFAAY

SEQ ID NO: 38360 - protein, 9 aa, Homo Sapiens
NFEELNFFF

SEQ ID NO: 38361 - protein, 9 aa, Homo Sapiens
NFEHFLLQY

SEQ ID NO: 38362 - protein, 9 aa, Homo Sapiens
NFFPGVFEY

SEQ ID NO: 38363 - protein, 9 aa, Homo Sapiens
NFLPLHYDY

SEQ ID NO: 38364 - protein, 9 aa, Homo Sapiens
NFVRLLMLY

SEQ ID NO: 38365 - protein, 9 aa, Homo Sapiens
NFYDETYDY

SEQ ID NO: 38366 - protein, 9 aa, Homo Sapiens
NFYLVPLHY

SEQ ID NO: 38367 - protein, 9 aa, Homo Sapiens
NIFAITFRY

SEQ ID NO: 38368 - protein, 9 aa, Homo Sapiens
NILPKVFHY

SEQ ID NO: 38369 - protein, 9 aa, Homo Sapiens
NIQYLFLEY

SEQ ID NO: 38370 - protein, 9 aa, Homo Sapiens
NKTQTILFY

SEQ ID NO: 38371 - protein, 9 aa, Homo Sapiens
NLLEKQLEY

SEQ ID NO: 38372 - protein, 9 aa, Homo Sapiens
NLLPYSLRY

SEQ ID NO: 38373 - protein, 9 aa, Homo Sapiens
NLPLFAFEY

SEQ ID NO: 38374 - protein, 9 aa, Homo Sapiens
NNMSKFFQY

SEQ ID NO: 38375 - protein, 9 aa, Homo Sapiens
NPSPYHLYY

SEQ ID NO: 38376 - protein, 9 aa, Homo Sapiens
NSLPGNFFY

SEQ ID NO: 38377 - protein, 9 aa, Homo Sapiens
NTYPIKLFY

SEQ ID NO: 38378 - protein, 9 aa, Homo Sapiens
NVFIQGFLY

SEQ ID NO: 38379 - protein, 9 aa, Homo Sapiens
NVLLVTQHY

SEQ ID NO: 38380 - protein, 9 aa, Homo Sapiens
NVMGEQFSY

SEQ ID NO: 38381 - protein, 9 aa, Homo Sapiens
NVTQVRAFY

SEQ ID NO: 38382 - protein, 9 aa, Homo Sapiens
NWKVPAILY

SEQ ID NO: 38383 - protein, 9 aa, Homo Sapiens
NWSKILLHY

SEQ ID NO: 38384 - protein, 9 aa, Homo Sapiens
NYGMQPLMY

SEQ ID NO: 38385 - protein, 9 aa, Homo Sapiens
NYLHDFLKY

SEQ ID NO: 38386 - protein, 9 aa, Homo Sapiens
PFLGIGLLY

SEQ ID NO: 38387 - protein, 9 aa, Homo Sapiens
QALDIRLSY

SEQ ID NO: 38388 - protein, 9 aa, Homo Sapiens
QHITLFLKY

SEQ ID NO: 38389 - protein, 9 aa, Homo Sapiens
QIFIGPTYY

SEQ ID NO: 38390 - protein, 9 aa, Homo Sapiens
QLDDLKVEL

SEQ ID NO: 38391 - protein, 9 aa, Homo Sapiens
QLLPFLVRY

SEQ ID NO: 38392 - protein, 9 aa, Homo Sapiens
QMLEFAFRY

SEQ ID NO: 38393 - protein, 9 aa, Homo Sapiens
QQFPEGLFY

SEQ ID NO: 38394 - protein, 9 aa, Homo Sapiens
QVHNLLLTY

SEQ ID NO: 38395 - protein, 9 aa, Homo Sapiens
QVLEPQLTY

SEQ ID NO: 38396 - protein, 9 aa, Homo Sapiens
QVLGRFFLY

SEQ ID NO: 38397 - protein, 9 aa, Homo Sapiens
QVMPQLLNY

SEQ ID NO: 38398 - protein, 9 aa, Homo Sapiens
QYHLQQLFY

SEQ ID NO: 38399 - protein, 9 aa, Homo Sapiens
QYLLVTALY

SEQ ID NO: 38400 - protein, 9 aa, Homo Sapiens
RIAEFAFEY

SEQ ID NO: 38401 - protein, 9 aa, Homo Sapiens
RLFGISLSY

SEQ ID NO: 38402 - protein, 9 aa, Homo Sapiens
RLLEIQADY

SEQ ID NO: 38403 - protein, 9 aa, Homo Sapiens
RLLLLLLRY

SEQ ID NO: 38404 - protein, 9 aa, Homo Sapiens
RLMELHFKY

SEQ ID NO: 38405 - protein, 9 aa, Homo Sapiens
RMFDMGFEY

SEQ ID NO: 38406 - protein, 9 aa, Homo Sapiens
RMVEMFLEY

SEQ ID NO: 38407 - protein, 9 aa, Homo Sapiens
RNADVFLKY

SEQ ID NO: 38408 - protein, 9 aa, Homo Sapiens
RNFHVFLEY

SEQ ID NO: 38409 - protein, 9 aa, Homo Sapiens
RQIDFVLSY

SEQ ID NO: 38410 - protein, 9 aa, Homo Sapiens
RVFPYSVFY

SEQ ID NO: 38411 - protein, 9 aa, Homo Sapiens
RVFQECLTY

SEQ ID NO: 38412 - protein, 9 aa, Homo Sapiens
RYLEMLLEY

SEQ ID NO: 38413 - protein, 9 aa, Homo Sapiens
RYVEFNLLY

SEQ ID NO: 38414 - protein, 9 aa, Homo Sapiens
SAALIIQKY

SEQ ID NO: 38415 - protein, 9 aa, Homo Sapiens
SAITVFLLF

SEQ ID NO: 38416 - protein, 9 aa, Homo Sapiens
SALPLYNLY

SEQ ID NO: 38417 - protein, 9 aa, Homo Sapiens
SFAARSFYY

SEQ ID NO: 38418 - protein, 9 aa, Homo Sapiens
SFAEIIMGY

SEQ ID NO: 38419 - protein, 9 aa, Homo Sapiens
SFAGSFLEY

SEQ ID NO: 38420 - protein, 9 aa, Homo Sapiens
SFARLSLTY

SEQ ID NO: 38421 - protein, 9 aa, Homo Sapiens
SFATLFPKY

SEQ ID NO: 38422 - protein, 9 aa, Homo Sapiens
SFDFLELNY

SEQ ID NO: 38423 - protein, 9 aa, Homo Sapiens
SFEGNVFMY

SEQ ID NO: 38424 - protein, 9 aa, Homo Sapiens
SFEQFHLFY

SEQ ID NO: 38425 - protein, 9 aa, Homo Sapiens
SFFEIYNEY

SEQ ID NO: 38426 - protein, 9 aa, Homo Sapiens
SFFTPLLLF

SEQ ID NO: 38427 - protein, 9 aa, Homo Sapiens
SFGELALIY

SEQ ID NO: 38428 - protein, 9 aa, Homo Sapiens
SFGINSILY

SEQ ID NO: 38429 - protein, 9 aa, Homo Sapiens
SFGLYGLLY

SEQ ID NO: 38430 - protein, 9 aa, Homo Sapiens
SFHVIFVLY

SEQ ID NO: 38431 - protein, 9 aa, Homo Sapiens
SFIGAFLTF

SEQ ID NO: 38432 - protein, 9 aa, Homo Sapiens
SFIRLLLNY

SEQ ID NO: 38433 - protein, 9 aa, Homo Sapiens
SFLPVHLGF

SEQ ID NO: 38434 - protein, 9 aa, Homo Sapiens
SFLSIGARY

SEQ ID NO: 38435 - protein, 9 aa, Homo Sapiens
SFLTEFINY

SEQ ID NO: 38436 - protein, 9 aa, Homo Sapiens
SFTDVIGHY

SEQ ID NO: 38437 - protein, 9 aa, Homo Sapiens
SFTTVWLIY

SEQ ID NO: 38438 - protein, 9 aa, Homo Sapiens
SFVWHALDY

SEQ ID NO: 38439 - protein, 9 aa, Homo Sapiens
SFWAYKIYY

SEQ ID NO: 38440 - protein, 9 aa, Homo Sapiens
SGLPLILHY

SEQ ID NO: 38441 - protein, 9 aa, Homo Sapiens
SIADLVFTY

SEQ ID NO: 38442 - protein, 9 aa, Homo Sapiens
SIAPFHICY

SEQ ID NO: 38443 - protein, 9 aa, Homo Sapiens
SIAWFTVFY

SEQ ID NO: 38444 - protein, 9 aa, Homo Sapiens
SIFGLGLAY

SEQ ID NO: 38445 - protein, 9 aa, Homo Sapiens
SIFHMSDSY

SEQ ID NO: 38446 - protein, 9 aa, Homo Sapiens
SIGDIFLKY

SEQ ID NO: 38447 - protein, 9 aa, Homo Sapiens
SILGLLLLY

SEQ ID NO: 38448 - protein, 9 aa, Homo Sapiens
SIMDEFQEY

SEQ ID NO: 38449 - protein, 9 aa, Homo Sapiens
SISAVVMSY

SEQ ID NO: 38450 - protein, 9 aa, Homo Sapiens
SISNLVFTY

SEQ ID NO: 38451 - protein, 9 aa, Homo Sapiens
SLFFVPLSY

SEQ ID NO: 38452 - protein, 9 aa, Homo Sapiens
SLFGIPLWY

SEQ ID NO: 38453 - protein, 9 aa, Homo Sapiens
SLIDILLAY

SEQ ID NO: 38454 - protein, 9 aa, Homo Sapiens
SLISQVFYY

SEQ ID NO: 38455 - protein, 9 aa, Homo Sapiens
SLLALIMAY

SEQ ID NO: 38456 - protein, 9 aa, Homo Sapiens
SLLERLLTY

SEQ ID NO: 38457 - protein, 9 aa, Homo Sapiens
SLLGKPLSY

SEQ ID NO: 38458 - protein, 9 aa, Homo Sapiens
SLLHLGALY

SEQ ID NO: 38459 - protein, 9 aa, Homo Sapiens
SLLSQMLHY

SEQ ID NO: 38460 - protein, 9 aa, Homo Sapiens
SLLVSVLEY

SEQ ID NO: 38461 - protein, 9 aa, Homo Sapiens
SLPHVGYLY

SEQ ID NO: 38462 - protein, 9 aa, Homo Sapiens
SLSEYVLLF

SEQ ID NO: 38463 - protein, 9 aa, Homo Sapiens
SMFNGQLLF

SEQ ID NO: 38464 - protein, 9 aa, Homo Sapiens
SMLACFLVY

SEQ ID NO: 38465 - protein, 9 aa, Homo Sapiens
SMLDILMDY

SEQ ID NO: 38466 - protein, 9 aa, Homo Sapiens
SSLVKSYLY

SEQ ID NO: 38467 - protein, 9 aa, Homo Sapiens
STFFPFHEY

SEQ ID NO: 38468 - protein, 9 aa, Homo Sapiens
STVSRFFLY

SEQ ID NO: 38469 - protein, 9 aa, Homo Sapiens
STYLVAFAY

SEQ ID NO: 38470 - protein, 9 aa, Homo Sapiens
SVAGIFNYY

SEQ ID NO: 38471 - protein, 9 aa, Homo Sapiens
SVFEKYFQF

SEQ ID NO: 38472 - protein, 9 aa, Homo Sapiens
SVFEVFVLY

SEQ ID NO: 38473 - protein, 9 aa, Homo Sapiens
SVFGMQARY

SEQ ID NO: 38474 - protein, 9 aa, Homo Sapiens
SVGNFYLLY

SEQ ID NO: 38475 - protein, 9 aa, Homo Sapiens
SVIEQILHY

SEQ ID NO: 38476 - protein, 9 aa, Homo Sapiens
SVLALVAYY

SEQ ID NO: 38477 - protein, 9 aa, Homo Sapiens
SVLDSFLKY

SEQ ID NO: 38478 - protein, 9 aa, Homo Sapiens
SVLGAFLTF

SEQ ID NO: 38479 - protein, 9 aa, Homo Sapiens
SVLGFFIQY

SEQ ID NO: 38480 - protein, 9 aa, Homo Sapiens
SVLMKALEY

SEQ ID NO: 38481 - protein, 9 aa, Homo Sapiens
SVLPAYLSY

SEQ ID NO: 38482 - protein, 9 aa, Homo Sapiens
SVLPFQIYY

SEQ ID NO: 38483 - protein, 9 aa, Homo Sapiens
SVLQFLGLY

SEQ ID NO: 38484 - protein, 9 aa, Homo Sapiens
SVLTASLSY

SEQ ID NO: 38485 - protein, 9 aa, Homo Sapiens
SVMRLTISY

SEQ ID NO: 38486 - protein, 9 aa, Homo Sapiens
SVSDQFYRY

SEQ ID NO: 38487 - protein, 9 aa, Homo Sapiens
SVSDVLLNF

SEQ ID NO: 38488 - protein, 9 aa, Homo Sapiens
SVTAITVLY

SEQ ID NO: 38489 - protein, 9 aa, Homo Sapiens
SVTEVQLRF

SEQ ID NO: 38490 - protein, 9 aa, Homo Sapiens
SVVGALLLY

SEQ ID NO: 38491 - protein, 9 aa, Homo Sapiens
SVVPHNFMY

SEQ ID NO: 38492 - protein, 9 aa, Homo Sapiens
SVYHPQLAY

SEQ ID NO: 38493 - protein, 9 aa, Homo Sapiens
SYEQLMQLY

SEQ ID NO: 38494 - protein, 9 aa, Homo Sapiens
SYFRTLLMY

SEQ ID NO: 38495 - protein, 9 aa, Homo Sapiens
SYINFELRY

SEQ ID NO: 38496 - protein, 9 aa, Homo Sapiens
SYPDIHFDM

SEQ ID NO: 38497 - protein, 9 aa, Homo Sapiens
SYPNVFLVF

SEQ ID NO: 38498 - protein, 9 aa, Homo Sapiens
SYPYFVIQY

SEQ ID NO: 38499 - protein, 9 aa, Homo Sapiens
SYSDLVLFF

SEQ ID NO: 38500 - protein, 9 aa, Homo Sapiens
TAFGGFLKY

SEQ ID NO: 38501 - protein, 9 aa, Homo Sapiens
TALAAALHY

SEQ ID NO: 38502 - protein, 9 aa, Homo Sapiens
TALAAFLSY

SEQ ID NO: 38503 - protein, 9 aa, Homo Sapiens
TALHIYANY

SEQ ID NO: 38504 - protein, 9 aa, Homo Sapiens
TFMDHVLRY

SEQ ID NO: 38505 - protein, 9 aa, Homo Sapiens
TFVSIFSLY

SEQ ID NO: 38506 - protein, 9 aa, Homo Sapiens
TIFTARLYY

SEQ ID NO: 38507 - protein, 9 aa, Homo Sapiens
TIIDRSFRY

SEQ ID NO: 38508 - protein, 9 aa, Homo Sapiens
TILSQPLMY

SEQ ID NO: 38509 - protein, 9 aa, Homo Sapiens
TIMEDYFAY

SEQ ID NO: 38510 - protein, 9 aa, Homo Sapiens
TINPILLYF

SEQ ID NO: 38511 - protein, 9 aa, Homo Sapiens
TISFLSYLF

SEQ ID NO: 38512 - protein, 9 aa, Homo Sapiens
TISPIILYF

SEQ ID NO: 38513 - protein, 9 aa, Homo Sapiens
TLADILLYY

SEQ ID NO: 38514 - protein, 9 aa, Homo Sapiens
TLAGLALKY

SEQ ID NO: 38515 - protein, 9 aa, Homo Sapiens
TLIEQQFTY

SEQ ID NO: 38516 - protein, 9 aa, Homo Sapiens
TLITQFLVY

SEQ ID NO: 38517 - protein, 9 aa, Homo Sapiens
TLLEKQLEY

SEQ ID NO: 38518 - protein, 9 aa, Homo Sapiens
TLNNLAVLY

SEQ ID NO: 38519 - protein, 9 aa, Homo Sapiens
TLSDIFLLF

SEQ ID NO: 38520 - protein, 9 aa, Homo Sapiens
TLTKIALRY

SEQ ID NO: 38521 - protein, 9 aa, Homo Sapiens
TMCPHILRY

SEQ ID NO: 38522 - protein, 9 aa, Homo Sapiens
TMLDLFFHY

SEQ ID NO: 38523 - protein, 9 aa, Homo Sapiens
TMVGKTFTY

SEQ ID NO: 38524 - protein, 9 aa, Homo Sapiens
TSSDILLCY

SEQ ID NO: 38525 - protein, 9 aa, Homo Sapiens
TTIDIGVKY

SEQ ID NO: 38526 - protein, 9 aa, Homo Sapiens
TTLDIITRY

SEQ ID NO: 38527 - protein, 9 aa, Homo Sapiens
TTLHNLLLY

SEQ ID NO: 38528 - protein, 9 aa, Homo Sapiens
TTLYIVMEY

SEQ ID NO: 38529 - protein, 9 aa, Homo Sapiens
TTNFIKAEY

SEQ ID NO: 38530 - protein, 9 aa, Homo Sapiens
TTTGQVLLY

SEQ ID NO: 38531 - protein, 9 aa, Homo Sapiens
TVFSQAIHY

SEQ ID NO: 38532 - protein, 9 aa, Homo Sapiens
TVLGEPLIY

SEQ ID NO: 38533 - protein, 9 aa, Homo Sapiens
TVSDAILRY

SEQ ID NO: 38534 - protein, 9 aa, Homo Sapiens
TVTEVLLKY

SEQ ID NO: 38535 - protein, 9 aa, Homo Sapiens
TWNPLKLHY

SEQ ID NO: 38536 - protein, 9 aa, Homo Sapiens
TYAPVAFRY

SEQ ID NO: 38537 - protein, 9 aa, Homo Sapiens
TYFAVNANY

SEQ ID NO: 38538 - protein, 9 aa, Homo Sapiens
TYLNDFFSY

SEQ ID NO: 38539 - protein, 9 aa, Homo Sapiens
VAFKKTFSY

SEQ ID NO: 38540 - protein, 9 aa, Homo Sapiens
VAYPCAILY

SEQ ID NO: 38541 - protein, 9 aa, Homo Sapiens
VFFFYPLDF

SEQ ID NO: 38542 - protein, 9 aa, Homo Sapiens
VFIYPSLIY

SEQ ID NO: 38543 - protein, 9 aa, Homo Sapiens
VFLIIKLLY

SEQ ID NO: 38544 - protein, 9 aa, Homo Sapiens
VFLPIHITY

SEQ ID NO: 38545 - protein, 9 aa, Homo Sapiens
VFMFPVGLY

SEQ ID NO: 38546 - protein, 9 aa, Homo Sapiens
VFNEKGWNY

SEQ ID NO: 38547 - protein, 9 aa, Homo Sapiens
VFSEVSPLY

SEQ ID NO: 38548 - protein, 9 aa, Homo Sapiens
VFVATFLRY

SEQ ID NO: 38549 - protein, 9 aa, Homo Sapiens
VFVESVLRY

SEQ ID NO: 38550 - protein, 9 aa, Homo Sapiens
VFYPYPQYF

SEQ ID NO: 38551 - protein, 9 aa, Homo Sapiens
VGLPVHLLF

SEQ ID NO: 38552 - protein, 9 aa, Homo Sapiens
VILDIPLLF

SEQ ID NO: 38553 - protein, 9 aa, Homo Sapiens
VILKLLLKY

SEQ ID NO: 38554 - protein, 9 aa, Homo Sapiens
VILPPLSPY

SEQ ID NO: 38555 - protein, 9 aa, Homo Sapiens
VINDGLFYY

SEQ ID NO: 38556 - protein, 9 aa, Homo Sapiens
VLAFIILNY

SEQ ID NO: 38557 - protein, 9 aa, Homo Sapiens
VLAGTQLLY

SEQ ID NO: 38558 - protein, 9 aa, Homo Sapiens
VLFEHAVGY

SEQ ID NO: 38559 - protein, 9 aa, Homo Sapiens
VLFLKFLEY

SEQ ID NO: 38560 - protein, 9 aa, Homo Sapiens
VLLDVAYAY

SEQ ID NO: 38561 - protein, 9 aa, Homo Sapiens
VLLDYHLNY

SEQ ID NO: 38562 - protein, 9 aa, Homo Sapiens
VLLEYHIAY

SEQ ID NO: 38563 - protein, 9 aa, Homo Sapiens
VLLGFLYRY

SEQ ID NO: 38564 - protein, 9 aa, Homo Sapiens
VLLPFIAYY

SEQ ID NO: 38565 - protein, 9 aa, Homo Sapiens
VLLPVALEF

SEQ ID NO: 38566 - protein, 9 aa, Homo Sapiens
VLLQLVLRY

SEQ ID NO: 38567 - protein, 9 aa, Homo Sapiens
VLREIAEEY

SEQ ID NO: 38568 - protein, 9 aa, Homo Sapiens
VLYDRVLKY

SEQ ID NO: 38569 - protein, 9 aa, Homo Sapiens
VLYNIAFMY

SEQ ID NO: 38570 - protein, 9 aa, Homo Sapiens
VMLGTQLLY

SEQ ID NO: 38571 - protein, 9 aa, Homo Sapiens
VQLTFALRY

SEQ ID NO: 38572 - protein, 9 aa, Homo Sapiens
VTFEKQWFY

SEQ ID NO: 38573 - protein, 9 aa, Homo Sapiens
VTFPEFLRY

SEQ ID NO: 38574 - protein, 9 aa, Homo Sapiens
VTVAIPLKY

SEQ ID NO: 38575 - protein, 9 aa, Homo Sapiens
VTYNYPVHY

SEQ ID NO: 38576 - protein, 9 aa, Homo Sapiens
VVFVTKFLY

SEQ ID NO: 38577 - protein, 9 aa, Homo Sapiens
VVISPPQFY

SEQ ID NO: 38578 - protein, 9 aa, Homo Sapiens
VVKEIFFHY

SEQ ID NO: 38579 - protein, 9 aa, Homo Sapiens
VVLAMYPKY

SEQ ID NO: 38580 - protein, 9 aa, Homo Sapiens
VVLQDLLAY

SEQ ID NO: 38581 - protein, 9 aa, Homo Sapiens
VVNIARYLY

SEQ ID NO: 38582 - protein, 9 aa, Homo Sapiens
VVNPFIYAY

SEQ ID NO: 38583 - protein, 9 aa, Homo Sapiens
VVPQFVVFY

SEQ ID NO: 38584 - protein, 9 aa, Homo Sapiens
VVSNILLAY

SEQ ID NO: 38585 - protein, 9 aa, Homo Sapiens
VVYPWTQRF

SEQ ID NO: 38586 - protein, 9 aa, Homo Sapiens
VWKIPAILY

SEQ ID NO: 38587 - protein, 9 aa, Homo Sapiens
VYLPMSYCY

SEQ ID NO: 38588 - protein, 9 aa, Homo Sapiens
VYNHFLLYY

SEQ ID NO: 38589 - protein, 9 aa, Homo Sapiens
VYQAVQALY

SEQ ID NO: 38590 - protein, 9 aa, Homo Sapiens
VYSDLHAFY

SEQ ID NO: 38591 - protein, 9 aa, Homo Sapiens
WIGDKSFEY

SEQ ID NO: 38592 - protein, 9 aa, Homo Sapiens
WLDKIDRRY

SEQ ID NO: 38593 - protein, 9 aa, Homo Sapiens
WLESVRLEY

SEQ ID NO: 38594 - protein, 9 aa, Homo Sapiens
WLHDIILGY

SEQ ID NO: 38595 - protein, 9 aa, Homo Sapiens
WLTDNTYKY

SEQ ID NO: 38596 - protein, 9 aa, Homo Sapiens
WVILQPLFY

SEQ ID NO: 38597 - protein, 9 aa, Homo Sapiens
WYPDLESKY

SEQ ID NO: 38598 - protein, 9 aa, Homo Sapiens
YAFLMVDRY

SEQ ID NO: 38599 - protein, 9 aa, Homo Sapiens
YAIDNPLHY

SEQ ID NO: 38600 - protein, 9 aa, Homo Sapiens
YATFIVTNY

SEQ ID NO: 38601 - protein, 9 aa, Homo Sapiens
YAYPYSYYY

SEQ ID NO: 38602 - protein, 9 aa, Homo Sapiens
YFEDQPLLY

SEQ ID NO: 38603 - protein, 9 aa, Homo Sapiens
YFEEIALKF

SEQ ID NO: 38604 - protein, 9 aa, Homo Sapiens
YFEEIKQFY

SEQ ID NO: 38605 - protein, 9 aa, Homo Sapiens
YFFGEGYTY

SEQ ID NO: 38606 - protein, 9 aa, Homo Sapiens
YFGEIALLL

SEQ ID NO: 38607 - protein, 9 aa, Homo Sapiens
YFGEIALLM

SEQ ID NO: 38608 - protein, 9 aa, Homo Sapiens
YFGNYFTYY

SEQ ID NO: 38609 - protein, 9 aa, Homo Sapiens
YFIGRIYLY

SEQ ID NO: 38610 - protein, 9 aa, Homo Sapiens
YFLPITPHY

SEQ ID NO: 38611 - protein, 9 aa, Homo Sapiens
YFPELIANF

SEQ ID NO: 38612 - protein, 9 aa, Homo Sapiens
YFPFMDLKL

SEQ ID NO: 38613 - protein, 9 aa, Homo Sapiens
YFSDPFLKY

SEQ ID NO: 38614 - protein, 9 aa, Homo Sapiens
YFVKFLDAY

SEQ ID NO: 38615 - protein, 9 aa, Homo Sapiens
YFYEAFEGY

SEQ ID NO: 38616 - protein, 9 aa, Homo Sapiens
YGIPFYLQY

SEQ ID NO: 38617 - protein, 9 aa, Homo Sapiens
YHIGIPLTY

SEQ ID NO: 38618 - protein, 9 aa, Homo Sapiens
YIYIRGEFY

SEQ ID NO: 38619 - protein, 9 aa, Homo Sapiens
YLDQISRYY

SEQ ID NO: 38620 - protein, 9 aa, Homo Sapiens
YLEQLHQLY

SEQ ID NO: 38621 - protein, 9 aa, Homo Sapiens
YLEQLILKY

SEQ ID NO: 38622 - protein, 9 aa, Homo Sapiens
YLFTEAYYY

SEQ ID NO: 38623 - protein, 9 aa, Homo Sapiens
YLGEFSITY

SEQ ID NO: 38624 - protein, 9 aa, Homo Sapiens
YLHDQFWSY

SEQ ID NO: 38625 - protein, 9 aa, Homo Sapiens
YLHYLPSYY

SEQ ID NO: 38626 - protein, 9 aa, Homo Sapiens
YLLPHILVY

SEQ ID NO: 38627 - protein, 9 aa, Homo Sapiens
YLPALKVEY

SEQ ID NO: 38628 - protein, 9 aa, Homo Sapiens
YLPKEQYLY

SEQ ID NO: 38629 - protein, 9 aa, Homo Sapiens
YLPPLFWRF

SEQ ID NO: 38630 - protein, 9 aa, Homo Sapiens
YLPVLPGDY

SEQ ID NO: 38631 - protein, 9 aa, Homo Sapiens
YLTKFIARY

SEQ ID NO: 38632 - protein, 9 aa, Homo Sapiens
YLWHIPLSY

SEQ ID NO: 38633 - protein, 9 aa, Homo Sapiens
YLWHIPLTY

SEQ ID NO: 38634 - protein, 9 aa, Homo Sapiens
YMGDFVVVY

SEQ ID NO: 38635 - protein, 9 aa, Homo Sapiens
YMIEPIDEY

SEQ ID NO: 38636 - protein, 9 aa, Homo Sapiens
YMTEPIDEY

SEQ ID NO: 38637 - protein, 9 aa, Homo Sapiens
YMWYNIIQY

SEQ ID NO: 38638 - protein, 9 aa, Homo Sapiens
YQTFLQLLY

SEQ ID NO: 38639 - protein, 9 aa, Homo Sapiens
YTAVVPLVY

SEQ ID NO: 38640 - protein, 9 aa, Homo Sapiens
YTMKEVLFY

SEQ ID NO: 38641 - protein, 9 aa, Homo Sapiens
YTSDYFISY

SEQ ID NO: 38642 - protein, 9 aa, Homo Sapiens
YVAEILPKY

SEQ ID NO: 38643 - protein, 9 aa, Homo Sapiens
YVFLYYYEY

SEQ ID NO: 38644 - protein, 9 aa, Homo Sapiens
YVIPAFLVY

SEQ ID NO: 38645 - protein, 9 aa, Homo Sapiens
YVIQKFFEF

SEQ ID NO: 38646 - protein, 9 aa, Homo Sapiens
YVLYPLDLY

SEQ ID NO: 38647 - protein, 9 aa, Homo Sapiens
YVPEHWEYY

SEQ ID NO: 38648 - protein, 9 aa, Homo Sapiens
YVYPKYLKY

SEQ ID NO: 38649 - protein, 9 aa, Homo Sapiens
YVYPLQLKY

SEQ ID NO: 38650 - protein, 9 aa, Homo Sapiens
YVYSHFLQF

SEQ ID NO: 38651 - protein, 9 aa, Homo Sapiens
YWKEVLLRY

SEQ ID NO: 38652 - protein, 9 aa, Homo Sapiens
YYFFTPYVY

SEQ ID NO: 38653 - protein, 9 aa, Homo Sapiens
YYIFIPSKF

SEQ ID NO: 38654 - protein, 9 aa, Homo Sapiens
YYIRFFITY

SEQ ID NO: 38655 - protein, 9 aa, Homo Sapiens
YYKNIGLGF

SEQ ID NO: 38656 - protein, 9 aa, Homo Sapiens
YYLPKLLSY

SEQ ID NO: 38657 - protein, 9 aa, Homo Sapiens
YYPEYKLLF

SEQ ID NO: 38658 - protein, 9 aa, Homo Sapiens
YYRAWQEYY

SEQ ID NO: 38659 - protein, 9 aa, Homo Sapiens
YYSGLIYTY

SEQ ID NO: 38660 - protein, 10 aa, Homo Sapiens
AAAAAAALLY

SEQ ID NO: 38661 - protein, 10 aa, Homo Sapiens
AFDEIVALGY

SEQ ID NO: 38662 - protein, 10 aa, Homo Sapiens
AFFEGPPFKF

SEQ ID NO: 38663 - protein, 10 aa, Homo Sapiens
AFFYFEGTFY

SEQ ID NO: 38664 - protein, 10 aa, Homo Sapiens
AFLEPLGLAY

SEQ ID NO: 38665 - protein, 10 aa, Homo Sapiens
AFLNDSYLKY

SEQ ID NO: 38666 - protein, 10 aa, Homo Sapiens
AFQKIVVLFY

SEQ ID NO: 38667 - protein, 10 aa, Homo Sapiens
AFVVAVGAEY

SEQ ID NO: 38668 - protein, 10 aa, Homo Sapiens
AFYKISTLYY

SEQ ID NO: 38669 - protein, 10 aa, Homo Sapiens
AVAALQDLRY

SEQ ID NO: 38670 - protein, 10 aa, Homo Sapiens
AVADKVHLMY

SEQ ID NO: 38671 - protein, 10 aa, Homo Sapiens
AVDPTSGQLY

SEQ ID NO: 38672 - protein, 10 aa, Homo Sapiens
AVIEDTWHYF

SEQ ID NO: 38673 - protein, 10 aa, Homo Sapiens
AVPTELALLY

SEQ ID NO: 38674 - protein, 10 aa, Homo Sapiens
AVTEYPTLKF

SEQ ID NO: 38675 - protein, 10 aa, Homo Sapiens
AYIDPIAMEY

SEQ ID NO: 38676 - protein, 10 aa, Homo Sapiens
AYIRDLALEY

SEQ ID NO: 38677 - protein, 10 aa, Homo Sapiens
AYWRQAGLSY

SEQ ID NO: 38678 - protein, 10 aa, Homo Sapiens
FFDKVIEKRY

SEQ ID NO: 38679 - protein, 10 aa, Homo Sapiens
FFEIYNELLY

SEQ ID NO: 38680 - protein, 10 aa, Homo Sapiens
FFEVPATTIY

SEQ ID NO: 38681 - protein, 10 aa, Homo Sapiens
FFHDILHTKY

SEQ ID NO: 38682 - protein, 10 aa, Homo Sapiens
FFLLSEMNIF

SEQ ID NO: 38683 - protein, 10 aa, Homo Sapiens
FFLPKGAYIY

SEQ ID NO: 38684 - protein, 10 aa, Homo Sapiens
FFNYIEKLKY

SEQ ID NO: 38685 - protein, 10 aa, Homo Sapiens
FFPDKPITQY

SEQ ID NO: 38686 - protein, 10 aa, Homo Sapiens
FFPLLDFAYM

SEQ ID NO: 38687 - protein, 10 aa, Homo Sapiens
FFPSIYDVKY

SEQ ID NO: 38688 - protein, 10 aa, Homo Sapiens
FFPVIYDVKY

SEQ ID NO: 38689 - protein, 10 aa, Homo Sapiens
FLIVPFGLLY

SEQ ID NO: 38690 - protein, 10 aa, Homo Sapiens
FLLPTTALYY

SEQ ID NO: 38691 - protein, 10 aa, Homo Sapiens
FLPLLKAQEY

SEQ ID NO: 38692 - protein, 10 aa, Homo Sapiens
FLPPNLGRHY

SEQ ID NO: 38693 - protein, 10 aa, Homo Sapiens
FLSFPTTKTY

SEQ ID NO: 38694 - protein, 10 aa, Homo Sapiens
FMGLFKSSRY

SEQ ID NO: 38695 - protein, 10 aa, Homo Sapiens
FTDVNSILRY

SEQ ID NO: 38696 - protein, 10 aa, Homo Sapiens
FTPDIPTMLY

SEQ ID NO: 38697 - protein, 10 aa, Homo Sapiens
FVPDWAEILY

SEQ ID NO: 38698 - protein, 10 aa, Homo Sapiens
FVYPGNPLRH

SEQ ID NO: 38699 - protein, 10 aa, Homo Sapiens
FYAGGFAIVY

SEQ ID NO: 38700 - protein, 10 aa, Homo Sapiens
FYEFFNEQKY

SEQ ID NO: 38701 - protein, 10 aa, Homo Sapiens
FYLFDLKAFF

SEQ ID NO: 38702 - protein, 10 aa, Homo Sapiens
FYLPIAAAMY

SEQ ID NO: 38703 - protein, 10 aa, Homo Sapiens
FYVEDLKARY

SEQ ID NO: 38704 - protein, 10 aa, Homo Sapiens
FYVHNDIFRY

SEQ ID NO: 38705 - protein, 10 aa, Homo Sapiens
FYVPFAKALY

SEQ ID NO: 38706 - protein, 10 aa, Homo Sapiens
GFASFSDYYY

SEQ ID NO: 38707 - protein, 10 aa, Homo Sapiens
GFIDSFRPLY

SEQ ID NO: 38708 - protein, 10 aa, Homo Sapiens
GFYEVFKVLY

SEQ ID NO: 38709 - protein, 10 aa, Homo Sapiens
GIKNFFTDVY

SEQ ID NO: 38710 - protein, 10 aa, Homo Sapiens
GIMTGPFFRY

SEQ ID NO: 38711 - protein, 10 aa, Homo Sapiens
GLLTTPQLHY

SEQ ID NO: 38712 - protein, 10 aa, Homo Sapiens
GSNPFTGFFY

SEQ ID NO: 38713 - protein, 10 aa, Homo Sapiens
GTVTEVLLKY

SEQ ID NO: 38714 - protein, 10 aa, Homo Sapiens
GVDVTGPHLY

SEQ ID NO: 38715 - protein, 10 aa, Homo Sapiens
HFEVPFIAFY

SEQ ID NO: 38716 - protein, 10 aa, Homo Sapiens
HFPATPLLDY

SEQ ID NO: 38717 - protein, 10 aa, Homo Sapiens
HLDEAQRLLY

SEQ ID NO: 38718 - protein, 10 aa, Homo Sapiens
HNLLLNYGLY

SEQ ID NO: 38719 - protein, 10 aa, Homo Sapiens
HVLPDPGLRY

SEQ ID NO: 38720 - protein, 10 aa, Homo Sapiens
HYFSDPFLKY

SEQ ID NO: 38721 - protein, 10 aa, Homo Sapiens
HYPPPVPFGY

SEQ ID NO: 38722 - protein, 10 aa, Homo Sapiens
HYSQELSLLY

SEQ ID NO: 38723 - protein, 10 aa, Homo Sapiens
IFLDSKGLEY

SEQ ID NO: 38724 - protein, 10 aa, Homo Sapiens
IFSEQVAMGY

SEQ ID NO: 38725 - protein, 10 aa, Homo Sapiens
ILAHLTGTEF

SEQ ID NO: 38726 - protein, 10 aa, Homo Sapiens
ILSSLEPLHR

SEQ ID NO: 38727 - protein, 10 aa, Homo Sapiens
IPFLGIGLLY

SEQ ID NO: 38728 - protein, 10 aa, Homo Sapiens
IVVKLNSGDY

SEQ ID NO: 38729 - protein, 10 aa, Homo Sapiens
KLADQIFAYY

SEQ ID NO: 38730 - protein, 10 aa, Homo Sapiens
KLIENPLLRY

SEQ ID NO: 38731 - protein, 10 aa, Homo Sapiens
KVFDGIPPPY

SEQ ID NO: 38732 - protein, 10 aa, Homo Sapiens
LFFYPLDFTF

SEQ ID NO: 38733 - protein, 10 aa, Homo Sapiens
LFIALITDSY

SEQ ID NO: 38734 - protein, 10 aa, Homo Sapiens
LFLWPEAFLY

SEQ ID NO: 38735 - protein, 10 aa, Homo Sapiens
LFPLFAQLDY

SEQ ID NO: 38736 - protein, 10 aa, Homo Sapiens
LGDLFSISAY

SEQ ID NO: 38737 - protein, 10 aa, Homo Sapiens
LLSPFSLLLY

SEQ ID NO: 38738 - protein, 10 aa, Homo Sapiens
LMKAIDFEYY

SEQ ID NO: 38739 - protein, 10 aa, Homo Sapiens
LVIFPEGTRY

SEQ ID NO: 38740 - protein, 10 aa, Homo Sapiens
LVYPGDPLRF

SEQ ID NO: 38741 - protein, 10 aa, Homo Sapiens
MFPFFDIAHY

SEQ ID NO: 38742 - protein, 10 aa, Homo Sapiens
MIPLIMSVLY

SEQ ID NO: 38743 - protein, 10 aa, Homo Sapiens
MYYYNGKAVY

SEQ ID NO: 38744 - protein, 10 aa, Homo Sapiens
NFEVFTETTY

SEQ ID NO: 38745 - protein, 10 aa, Homo Sapiens
NFLHPVIYYY

SEQ ID NO: 38746 - protein, 10 aa, Homo Sapiens
NFPPPLPALY

SEQ ID NO: 38747 - protein, 10 aa, Homo Sapiens
NTDPWAGYRY

SEQ ID NO: 38748 - protein, 10 aa, Homo Sapiens
NTLGSLALLY

SEQ ID NO: 38749 - protein, 10 aa, Homo Sapiens
NVADLHLYLY

SEQ ID NO: 38750 - protein, 10 aa, Homo Sapiens
NWGRVVALFY

SEQ ID NO: 38751 - protein, 10 aa, Homo Sapiens
NWNEVVTQQY

SEQ ID NO: 38752 - protein, 10 aa, Homo Sapiens
NYNHLMPTRY

SEQ ID NO: 38753 - protein, 10 aa, Homo Sapiens
NYSHLVSVGY

SEQ ID NO: 38754 - protein, 10 aa, Homo Sapiens
QFIQDYGMRY

SEQ ID NO: 38755 - protein, 10 aa, Homo Sapiens
QVDPLSALKY

SEQ ID NO: 38756 - protein, 10 aa, Homo Sapiens
RFQFLPHAYY

SEQ ID NO: 38757 - protein, 10 aa, Homo Sapiens
SFEGNVFMYY

SEQ ID NO: 38758 - protein, 10 aa, Homo Sapiens
SFELIVVQNY

SEQ ID NO: 38759 - protein, 10 aa, Homo Sapiens
SFISGLFNFY

SEQ ID NO: 38760 - protein, 10 aa, Homo Sapiens
SFMDPASALY

SEQ ID NO: 38761 - protein, 10 aa, Homo Sapiens
SFPALAPLTY

SEQ ID NO: 38762 - protein, 10 aa, Homo Sapiens
SFTAFANSHY

SEQ ID NO: 38763 - protein, 10 aa, Homo Sapiens
SFVDPLVTNY

SEQ ID NO: 38764 - protein, 10 aa, Homo Sapiens
SLSLENVLYY

SEQ ID NO: 38765 - protein, 10 aa, Homo Sapiens
SMESFPPLAY

SEQ ID NO: 38766 - protein, 10 aa, Homo Sapiens
STLEVTSLKY

SEQ ID NO: 38767 - protein, 10 aa, Homo Sapiens
SVFVATFLRY

SEQ ID NO: 38768 - protein, 10 aa, Homo Sapiens
SYLPVLPGDY

SEQ ID NO: 38769 - protein, 10 aa, Homo Sapiens
SYWKEVLLRY

SEQ ID NO: 38770 - protein, 10 aa, Homo Sapiens
TFADFDGVLY

SEQ ID NO: 38771 - protein, 10 aa, Homo Sapiens
TFEGWPALLY

SEQ ID NO: 38772 - protein, 10 aa, Homo Sapiens
TFHFLLGSIY

SEQ ID NO: 38773 - protein, 10 aa, Homo Sapiens
TFLIPGFYSY

SEQ ID NO: 38774 - protein, 10 aa, Homo Sapiens
TFVWPAHFKY

SEQ ID NO: 38775 - protein, 10 aa, Homo Sapiens
TLFDSRHLLY

SEQ ID NO: 38776 - protein, 10 aa, Homo Sapiens
TTSHLMGMFY

SEQ ID NO: 38777 - protein, 10 aa, Homo Sapiens
TVLPFAGLLY

SEQ ID NO: 38778 - protein, 10 aa, Homo Sapiens
TVLSIPELLY

SEQ ID NO: 38779 - protein, 10 aa, Homo Sapiens
VALPPGYYLY

SEQ ID NO: 38780 - protein, 10 aa, Homo Sapiens
VFEYINNTDF

SEQ ID NO: 38781 - protein, 10 aa, Homo Sapiens
VFFNIPQIQY

SEQ ID NO: 38782 - protein, 10 aa, Homo Sapiens
VFLSIKGIYY

SEQ ID NO: 38783 - protein, 10 aa, Homo Sapiens
VFMFPVGLYY

SEQ ID NO: 38784 - protein, 10 aa, Homo Sapiens
VFTFIPGVLY

SEQ ID NO: 38785 - protein, 10 aa, Homo Sapiens
VILDNSPGAY

SEQ ID NO: 38786 - protein, 10 aa, Homo Sapiens
VVFEGNHYFY

SEQ ID NO: 38787 - protein, 10 aa, Homo Sapiens
VVPLTAEPFL

SEQ ID NO: 38788 - protein, 10 aa, Homo Sapiens
VYIDIDPLLY

SEQ ID NO: 38789 - protein, 10 aa, Homo Sapiens
VYIVLDKAEY

SEQ ID NO: 38790 - protein, 10 aa, Homo Sapiens
VYLHYLPSYY

SEQ ID NO: 38791 - protein, 10 aa, Homo Sapiens
VYLPPEAFTF

SEQ ID NO: 38792 - protein, 10 aa, Homo Sapiens
VYSDLHAFYY

SEQ ID NO: 38793 - protein, 10 aa, Homo Sapiens
WLEEGIHWQY

SEQ ID NO: 38794 - protein, 10 aa, Homo Sapiens
WLPALFTDLY

SEQ ID NO: 38795 - protein, 10 aa, Homo Sapiens
WVPPLIGELY

SEQ ID NO: 38796 - protein, 10 aa, Homo Sapiens
WYPLWGGIMY

SEQ ID NO: 38797 - protein, 10 aa, Homo Sapiens
WYPTSVPVLY

SEQ ID NO: 38798 - protein, 10 aa, Homo Sapiens
WYVDDPYQKY

SEQ ID NO: 38799 - protein, 10 aa, Homo Sapiens
YAFQDDRYLY

SEQ ID NO: 38800 - protein, 10 aa, Homo Sapiens
YALPPPPQFY

SEQ ID NO: 38801 - protein, 10 aa, Homo Sapiens
YFDEEMAVKY

SEQ ID NO: 38802 - protein, 10 aa, Homo Sapiens
YFEEIKQFYY

SEQ ID NO: 38803 - protein, 10 aa, Homo Sapiens
YFEYIEENKY

SEQ ID NO: 38804 - protein, 10 aa, Homo Sapiens
YFFPGTGDMY

SEQ ID NO: 38805 - protein, 10 aa, Homo Sapiens
YFGSAFATPF

SEQ ID NO: 38806 - protein, 10 aa, Homo Sapiens
YFGSNIAHMY

SEQ ID NO: 38807 - protein, 10 aa, Homo Sapiens
YFIPFLPLEY

SEQ ID NO: 38808 - protein, 10 aa, Homo Sapiens
YFLGIKSLVY

SEQ ID NO: 38809 - protein, 10 aa, Homo Sapiens
YFLTSFYTKY

SEQ ID NO: 38810 - protein, 10 aa, Homo Sapiens
YFVKVVPTVY

SEQ ID NO: 38811 - protein, 10 aa, Homo Sapiens
YFVTFPYPYM

SEQ ID NO: 38812 - protein, 10 aa, Homo Sapiens
YIIRLENAFY

SEQ ID NO: 38813 - protein, 10 aa, Homo Sapiens
YIPLKVALFY

SEQ ID NO: 38814 - protein, 10 aa, Homo Sapiens
YIWDVTILEY

SEQ ID NO: 38815 - protein, 10 aa, Homo Sapiens
YLPFPIIQQY

SEQ ID NO: 38816 - protein, 10 aa, Homo Sapiens
YMGHFDLLNY

SEQ ID NO: 38817 - protein, 10 aa, Homo Sapiens
YMIDPSGVSY

SEQ ID NO: 38818 - protein, 10 aa, Homo Sapiens
YTTDFIYQLY

SEQ ID NO: 38819 - protein, 10 aa, Homo Sapiens
YVPAEPKLAF

SEQ ID NO: 38820 - protein, 10 aa, Homo Sapiens
YWGEIISQQY

SEQ ID NO: 38821 - protein, 10 aa, Homo Sapiens
YYDPNSQYYY

SEQ ID NO: 38822 - protein, 10 aa, Homo Sapiens
YYDTDPFLFY

SEQ ID NO: 38823 - protein, 10 aa, Homo Sapiens
YYLEQLILKY

SEQ ID NO: 38824 - protein, 10 aa, Homo Sapiens
YYSHLEGARF

SEQ ID NO: 38825 - protein, 10 aa, Homo Sapiens
YYYDGDIGNY

SEQ ID NO: 38826 - protein, 10 aa, Homo Sapiens
YYYDPLAGTY

SEQ ID NO: 38827 - protein, 10 aa, Homo Sapiens
YYYDPQTGLY

SEQ ID NO: 38828 - protein, 11 aa, Homo Sapiens
AFLGPKDIFPY

SEQ ID NO: 38829 - protein, 11 aa, Homo Sapiens
ALFPHPHIHEY

SEQ ID NO: 38830 - protein, 11 aa, Homo Sapiens
ALLDTTEKYLY

SEQ ID NO: 38831 - protein, 11 aa, Homo Sapiens
ALVSGKLALRY

SEQ ID NO: 38832 - protein, 11 aa, Homo Sapiens
AVAFGSFFQGY

SEQ ID NO: 38833 - protein, 11 aa, Homo Sapiens
AVASEDSVLLY

SEQ ID NO: 38834 - protein, 11 aa, Homo Sapiens
AVIENPEMLKY

SEQ ID NO: 38835 - protein, 11 aa, Homo Sapiens
AVLAPLIALVY

SEQ ID NO: 38836 - protein, 11 aa, Homo Sapiens
AVLGETLIPHY

SEQ ID NO: 38837 - protein, 11 aa, Homo Sapiens
FAVTEYPTLKF

SEQ ID NO: 38838 - protein, 11 aa, Homo Sapiens
FFASGGGKFNY

SEQ ID NO: 38839 - protein, 11 aa, Homo Sapiens
FFPLPLTPTLY

SEQ ID NO: 38840 - protein, 11 aa, Homo Sapiens
FFVYEVTSTKY

SEQ ID NO: 38841 - protein, 11 aa, Homo Sapiens
FILDGKLATMY

SEQ ID NO: 38842 - protein, 11 aa, Homo Sapiens
FLPFPLPLFAY

SEQ ID NO: 38843 - protein, 11 aa, Homo Sapiens
FTWPDGHVTKY

SEQ ID NO: 38844 - protein, 11 aa, Homo Sapiens
FVLPNGQMFVF

SEQ ID NO: 38845 - protein, 11 aa, Homo Sapiens
FVLSLGVAALY

SEQ ID NO: 38846 - protein, 11 aa, Homo Sapiens
FYAFQDDRYLY

SEQ ID NO: 38847 - protein, 11 aa, Homo Sapiens
FYDPDVGNFHY

SEQ ID NO: 38848 - protein, 11 aa, Homo Sapiens
FYPFPVPPLLY

SEQ ID NO: 38849 - protein, 11 aa, Homo Sapiens
FYPNIGGIIRY

SEQ ID NO: 38850 - protein, 11 aa, Homo Sapiens
FYYLEQLILKY

SEQ ID NO: 38851 - protein, 11 aa, Homo Sapiens
GAVPTELALLY

SEQ ID NO: 38852 - protein, 11 aa, Homo Sapiens
GLLGVDKLFSY

SEQ ID NO: 38853 - protein, 11 aa, Homo Sapiens
GLMGKPSILTY

SEQ ID NO: 38854 - protein, 11 aa, Homo Sapiens
GTAPPTLALHY

SEQ ID NO: 38855 - protein, 11 aa, Homo Sapiens
GTISQPRILLY

SEQ ID NO: 38856 - protein, 11 aa, Homo Sapiens
GVFGQNEYLRY

SEQ ID NO: 38857 - protein, 11 aa, Homo Sapiens
GVFLLPQLFLF

SEQ ID NO: 38858 - protein, 11 aa, Homo Sapiens
GVLEMVKIFRY

SEQ ID NO: 38859 - protein, 11 aa, Homo Sapiens
GYFDEEMAVKY

SEQ ID NO: 38860 - protein, 11 aa, Homo Sapiens
HVGMEPLQFDY

SEQ ID NO: 38861 - protein, 11 aa, Homo Sapiens
HVLIDVGTGYY

SEQ ID NO: 38862 - protein, 11 aa, Homo Sapiens
IALEPEQILRY

SEQ ID NO: 38863 - protein, 11 aa, Homo Sapiens
IALNPTGTFLY

SEQ ID NO: 38864 - protein, 11 aa, Homo Sapiens
IFLILTTTGHY

SEQ ID NO: 38865 - protein, 11 aa, Homo Sapiens
IFTDVNSILRY

SEQ ID NO: 38866 - protein, 11 aa, Homo Sapiens
ILLPVSSLLLY

SEQ ID NO: 38867 - protein, 11 aa, Homo Sapiens
IYIKHPHLFKY

SEQ ID NO: 38868 - protein, 11 aa, Homo Sapiens
KFYVHNDIFRY

SEQ ID NO: 38869 - protein, 11 aa, Homo Sapiens
KLLGLPEDYLY

SEQ ID NO: 38870 - protein, 11 aa, Homo Sapiens
LFLDSNGLFLF

SEQ ID NO: 38871 - protein, 11 aa, Homo Sapiens
LFPDPVVQWLY

SEQ ID NO: 38872 - protein, 11 aa, Homo Sapiens
LFWDQTQQHSY

SEQ ID NO: 38873 - protein, 11 aa, Homo Sapiens
LMLDKNNLVKY

SEQ ID NO: 38874 - protein, 11 aa, Homo Sapiens
LMLPEKLRPLY

SEQ ID NO: 38875 - protein, 11 aa, Homo Sapiens
LVIPGHLIFLY

SEQ ID NO: 38876 - protein, 11 aa, Homo Sapiens
LYYDPNSQYYY

SEQ ID NO: 38877 - protein, 11 aa, Homo Sapiens
MLLPEKLISKY

SEQ ID NO: 38878 - protein, 11 aa, Homo Sapiens
MLLRGANAVGY

SEQ ID NO: 38879 - protein, 11 aa, Homo Sapiens
MPVGPDAILRY

SEQ ID NO: 38880 - protein, 11 aa, Homo Sapiens
MVQPINLIFRY

SEQ ID NO: 38881 - protein, 11 aa, Homo Sapiens
NAFEHGGEFTY

SEQ ID NO: 38882 - protein, 11 aa, Homo Sapiens
NLFQEAEEFLY

SEQ ID NO: 38883 - protein, 11 aa, Homo Sapiens
NTIPLFVQLLY

SEQ ID NO: 38884 - protein, 11 aa, Homo Sapiens
PFLDNPDAFYY

SEQ ID NO: 38885 - protein, 11 aa, Homo Sapiens
QDPYIRELGLY

SEQ ID NO: 38886 - protein, 11 aa, Homo Sapiens
RVFSIVIPFLY

SEQ ID NO: 38887 - protein, 11 aa, Homo Sapiens
RVIGSELVQKY

SEQ ID NO: 38888 - protein, 11 aa, Homo Sapiens
RVLDLSENFLY

SEQ ID NO: 38889 - protein, 11 aa, Homo Sapiens
RVNDVPEEFLY

SEQ ID NO: 38890 - protein, 11 aa, Homo Sapiens
RVNDVPEEFMY

SEQ ID NO: 38891 - protein, 11 aa, Homo Sapiens
RVYDIPPKFFY

SEQ ID NO: 38892 - protein, 11 aa, Homo Sapiens
RVYSDLHAFYY

SEQ ID NO: 38893 - protein, 11 aa, Homo Sapiens
SFVEFILEPLY

SEQ ID NO: 38894 - protein, 11 aa, Homo Sapiens
SLEHLPANLFY

SEQ ID NO: 38895 - protein, 11 aa, Homo Sapiens
SLFPHPHIHEY

SEQ ID NO: 38896 - protein, 11 aa, Homo Sapiens
SMLPSDVSILY

SEQ ID NO: 38897 - protein, 11 aa, Homo Sapiens
SVYLLTGLELY

SEQ ID NO: 38898 - protein, 11 aa, Homo Sapiens
SYLDKEDTFFY

SEQ ID NO: 38899 - protein, 11 aa, Homo Sapiens
TAQVIILNHPG

SEQ ID NO: 38900 - protein, 11 aa, Homo Sapiens
TILDIPNQLYY

SEQ ID NO: 38901 - protein, 11 aa, Homo Sapiens
VAISEELVQKY

SEQ ID NO: 38902 - protein, 11 aa, Homo Sapiens
VAYWRQAGLSY

SEQ ID NO: 38903 - protein, 11 aa, Homo Sapiens
VFIVNSEDYMY

SEQ ID NO: 38904 - protein, 11 aa, Homo Sapiens
VMLGTQLLYKF

SEQ ID NO: 38905 - protein, 11 aa, Homo Sapiens
VMWSPTHPALF

SEQ ID NO: 38906 - protein, 11 aa, Homo Sapiens
VVFDKSDLAKY

SEQ ID NO: 38907 - protein, 11 aa, Homo Sapiens
VVLDDKDYFLF

SEQ ID NO: 38908 - protein, 11 aa, Homo Sapiens
VYLRTLAPGLF

SEQ ID NO: 38909 - protein, 11 aa, Homo Sapiens
YFEYFGPDFKL

SEQ ID NO: 38910 - protein, 11 aa, Homo Sapiens
YFINSKGIPRY

SEQ ID NO: 38911 - protein, 11 aa, Homo Sapiens
YLVIFPEGTRY

SEQ ID NO: 38912 - protein, 11 aa, Homo Sapiens
YLWKSEKPLYY

SEQ ID NO: 38913 - protein, 11 aa, Homo Sapiens
YNFTLADILLY

SEQ ID NO: 38914 - protein, 11 aa, Homo Sapiens
YTLDVPDAFYY

SEQ ID NO: 38915 - protein, 11 aa, Homo Sapiens
YVGDLMGSLAY

SEQ ID NO: 38916 - protein, 11 aa, Homo Sapiens
YYDGDVGNYYY

SEQ ID NO: 38917 - protein, 11 aa, Homo Sapiens
YYDPSTGIYYY

SEQ ID NO: 38918 - protein, 11 aa, Homo Sapiens
YYINKISSTLY

SEQ ID NO: 38919 - protein, 11 aa, Homo Sapiens
YYMNQVEETRY

SEQ ID NO: 38920 - protein, 11 aa, Homo Sapiens
YYYDPLAGTYY

SEQ ID NO: 38921 - protein, 11 aa, Homo Sapiens
YYYDPTTGLYY

SEQ ID NO: 38922 - protein, 8 aa, Homo Sapiens
GSNVKIVK

SEQ ID NO: 38923 - protein, 8 aa, Homo Sapiens
HEVKKVTL

SEQ ID NO: 38924 - protein, 8 aa, Homo Sapiens
KIHPFIRK

SEQ ID NO: 38925 - protein, 8 aa, Homo Sapiens
KTITHPRL

SEQ ID NO: 38926 - protein, 8 aa, Homo Sapiens
KVLKTLNV

SEQ ID NO: 38927 - protein, 8 aa, Homo Sapiens
KVWVPKQK

SEQ ID NO: 38928 - protein, 8 aa, Homo Sapiens
LDISRPKM

SEQ ID NO: 38929 - protein, 8 aa, Homo Sapiens
LYWSHPRK

SEQ ID NO: 38930 - protein, 8 aa, Homo Sapiens
NVPVGKVL

SEQ ID NO: 38931 - protein, 8 aa, Homo Sapiens
RTFLRPPK

SEQ ID NO: 38932 - protein, 8 aa, Homo Sapiens
SFSVKPLK

SEQ ID NO: 38933 - protein, 8 aa, Homo Sapiens
SRLIKVHL

SEQ ID NO: 38934 - protein, 8 aa, Homo Sapiens
TEELAYLK

SEQ ID NO: 38935 - protein, 8 aa, Homo Sapiens
TRIPKIQK

SEQ ID NO: 38936 - protein, 8 aa, Homo Sapiens
VSLTACKV

SEQ ID NO: 38937 - protein, 8 aa, Homo Sapiens
YRPPPKVK

SEQ ID NO: 38938 - protein, 9 aa, Homo Sapiens
AAKCIVNNV

SEQ ID NO: 38939 - protein, 9 aa, Homo Sapiens
AAPAYSRAL

SEQ ID NO: 38940 - protein, 9 aa, Homo Sapiens
AAPTSAAAL

SEQ ID NO: 38941 - protein, 9 aa, Homo Sapiens
AARAIAVQK

SEQ ID NO: 38942 - protein, 9 aa, Homo Sapiens
AFFTRPFYK

SEQ ID NO: 38943 - protein, 9 aa, Homo Sapiens
AFKELLKEK

SEQ ID NO: 38944 - protein, 9 aa, Homo Sapiens
AFKISKIYK

SEQ ID NO: 38945 - protein, 9 aa, Homo Sapiens
AFKNHVFNV

SEQ ID NO: 38946 - protein, 9 aa, Homo Sapiens
AFRSTPPGM

SEQ ID NO: 38947 - protein, 9 aa, Homo Sapiens
AFRVPTANV

SEQ ID NO: 38948 - protein, 9 aa, Homo Sapiens
AGISKRWPK

SEQ ID NO: 38949 - protein, 9 aa, Homo Sapiens
AGKTTWVTK

SEQ ID NO: 38950 - protein, 9 aa, Homo Sapiens
AGQSVRICK

SEQ ID NO: 38951 - protein, 9 aa, Homo Sapiens
AIKAKIMAK

SEQ ID NO: 38952 - protein, 9 aa, Homo Sapiens
AIKGMHIRK

SEQ ID NO: 38953 - protein, 9 aa, Homo Sapiens
AIRNDYIVK

SEQ ID NO: 38954 - protein, 9 aa, Homo Sapiens
AIRVTNPNA

SEQ ID NO: 38955 - protein, 9 aa, Homo Sapiens
ALKENSYVK

SEQ ID NO: 38956 - protein, 9 aa, Homo Sapiens
ALKKLILSK

SEQ ID NO: 38957 - protein, 9 aa, Homo Sapiens
ALKTGIVAK

SEQ ID NO: 38958 - protein, 9 aa, Homo Sapiens
ALRAVYRLK

SEQ ID NO: 38959 - protein, 9 aa, Homo Sapiens
ALRESWKTK

SEQ ID NO: 38960 - protein, 9 aa, Homo Sapiens
ALRPLVKPK

SEQ ID NO: 38961 - protein, 9 aa, Homo Sapiens
AMKEFAYMK

SEQ ID NO: 38962 - protein, 9 aa, Homo Sapiens
AMKISFAKK

SEQ ID NO: 38963 - protein, 9 aa, Homo Sapiens
AMKKVFRVY

SEQ ID NO: 38964 - protein, 9 aa, Homo Sapiens
AMRECFRTK

SEQ ID NO: 38965 - protein, 9 aa, Homo Sapiens
AQKSDFCLK

SEQ ID NO: 38966 - protein, 9 aa, Homo Sapiens
AQQKVTLPK

SEQ ID NO: 38967 - protein, 9 aa, Homo Sapiens
AQRDPIIAK

SEQ ID NO: 38968 - protein, 9 aa, Homo Sapiens
AQRGLAVLK

SEQ ID NO: 38969 - protein, 9 aa, Homo Sapiens
AQRPSSPAL

SEQ ID NO: 38970 - protein, 9 aa, Homo Sapiens
AQSIYRPSK

SEQ ID NO: 38971 - protein, 9 aa, Homo Sapiens
AQYWKRNNK

SEQ ID NO: 38972 - protein, 9 aa, Homo Sapiens
ASFDKAKLK

SEQ ID NO: 38973 - protein, 9 aa, Homo Sapiens
ASFSKRIQK

SEQ ID NO: 38974 - protein, 9 aa, Homo Sapiens
ASHISKLPK

SEQ ID NO: 38975 - protein, 9 aa, Homo Sapiens
ASKPPPISK

SEQ ID NO: 38976 - protein, 9 aa, Homo Sapiens
ASKTQYFHV

SEQ ID NO: 38977 - protein, 9 aa, Homo Sapiens
ASRATVLQK

SEQ ID NO: 38978 - protein, 9 aa, Homo Sapiens
ASRGPGPSL

SEQ ID NO: 38979 - protein, 9 aa, Homo Sapiens
ASRPNSPQL

SEQ ID NO: 38980 - protein, 9 aa, Homo Sapiens
ASRQAPPHI

SEQ ID NO: 38981 - protein, 9 aa, Homo Sapiens
ASRVVQVVK

SEQ ID NO: 38982 - protein, 9 aa, Homo Sapiens
ASSPPAIPK

SEQ ID NO: 38983 - protein, 9 aa, Homo Sapiens
ATAPPAPAY

SEQ ID NO: 38984 - protein, 9 aa, Homo Sapiens
ATAPPSPLK

SEQ ID NO: 38985 - protein, 9 aa, Homo Sapiens
ATFARIWYL

SEQ ID NO: 38986 - protein, 9 aa, Homo Sapiens
ATFLKKVAK

SEQ ID NO: 38987 - protein, 9 aa, Homo Sapiens
ATILREILK

SEQ ID NO: 38988 - protein, 9 aa, Homo Sapiens
ATKAVCVLK

SEQ ID NO: 38989 - protein, 9 aa, Homo Sapiens
ATKEILAQK

SEQ ID NO: 38990 - protein, 9 aa, Homo Sapiens
ATKGITRCL

SEQ ID NO: 38991 - protein, 9 aa, Homo Sapiens
ATKIKNYYK

SEQ ID NO: 38992 - protein, 9 aa, Homo Sapiens
ATKKITESV

SEQ ID NO: 38993 - protein, 9 aa, Homo Sapiens
ATKPLYVAL

SEQ ID NO: 38994 - protein, 9 aa, Homo Sapiens
ATKPMTYVV

SEQ ID NO: 38995 - protein, 9 aa, Homo Sapiens
ATKQMHFRV

SEQ ID NO: 38996 - protein, 9 aa, Homo Sapiens
ATKSSYLNI

SEQ ID NO: 38997 - protein, 9 aa, Homo Sapiens
ATLSICSPK

SEQ ID NO: 38998 - protein, 9 aa, Homo Sapiens
ATNYITRNK

SEQ ID NO: 38999 - protein, 9 aa, Homo Sapiens
ATQPSWLGK

SEQ ID NO: 39000 - protein, 9 aa, Homo Sapiens
ATRFDQVMK

SEQ ID NO: 39001 - protein, 9 aa, Homo Sapiens
ATRKLALQK

SEQ ID NO: 39002 - protein, 9 aa, Homo Sapiens
ATRPAGQNL

SEQ ID NO: 39003 - protein, 9 aa, Homo Sapiens
ATRPVTPPR

SEQ ID NO: 39004 - protein, 9 aa, Homo Sapiens
ATRRVHPAL

SEQ ID NO: 39005 - protein, 9 aa, Homo Sapiens
ATRSITNNV

SEQ ID NO: 39006 - protein, 9 aa, Homo Sapiens
ATRSSAVRL

SEQ ID NO: 39007 - protein, 9 aa, Homo Sapiens
ATYERVVYK

SEQ ID NO: 39008 - protein, 9 aa, Homo Sapiens
AVHPPGVSK

SEQ ID NO: 39009 - protein, 9 aa, Homo Sapiens
AVKAIIYQY

SEQ ID NO: 39010 - protein, 9 aa, Homo Sapiens
AVKDIAINL

SEQ ID NO: 39011 - protein, 9 aa, Homo Sapiens
AVKDTILQL

SEQ ID NO: 39012 - protein, 9 aa, Homo Sapiens
AVKEKAIQV

SEQ ID NO: 39013 - protein, 9 aa, Homo Sapiens
AVKEKYAKY

SEQ ID NO: 39014 - protein, 9 aa, Homo Sapiens
AVKERYSYV

SEQ ID NO: 39015 - protein, 9 aa, Homo Sapiens
AVKESTITL

SEQ ID NO: 39016 - protein, 9 aa, Homo Sapiens
AVKGKYKFL

SEQ ID NO: 39017 - protein, 9 aa, Homo Sapiens
AVKKELIPK

SEQ ID NO: 39018 - protein, 9 aa, Homo Sapiens
AVKLGAVPK

SEQ ID NO: 39019 - protein, 9 aa, Homo Sapiens
AVKNLYRNV

SEQ ID NO: 39020 - protein, 9 aa, Homo Sapiens
AVKPFGLKV

SEQ ID NO: 39021 - protein, 9 aa, Homo Sapiens
AVKPSVTCV

SEQ ID NO: 39022 - protein, 9 aa, Homo Sapiens
AVKQSILAK

SEQ ID NO: 39023 - protein, 9 aa, Homo Sapiens
AVKTKILIK

SEQ ID NO: 39024 - protein, 9 aa, Homo Sapiens
AVLDFVKQK

SEQ ID NO: 39025 - protein, 9 aa, Homo Sapiens
AVLGTHKLK

SEQ ID NO: 39026 - protein, 9 aa, Homo Sapiens
AVLHHLVNK

SEQ ID NO: 39027 - protein, 9 aa, Homo Sapiens
AVLKDRVNK

SEQ ID NO: 39028 - protein, 9 aa, Homo Sapiens
AVNNIRLIK

SEQ ID NO: 39029 - protein, 9 aa, Homo Sapiens
AVQRTLLEK

SEQ ID NO: 39030 - protein, 9 aa, Homo Sapiens
AVRGSNPHL

SEQ ID NO: 39031 - protein, 9 aa, Homo Sapiens
AVRIPGGPA

SEQ ID NO: 39032 - protein, 9 aa, Homo Sapiens
AVRIRAPQI

SEQ ID NO: 39033 - protein, 9 aa, Homo Sapiens
AVRKPIVLK

SEQ ID NO: 39034 - protein, 9 aa, Homo Sapiens
AVRPASLNL

SEQ ID NO: 39035 - protein, 9 aa, Homo Sapiens
AVRPQSVFV

SEQ ID NO: 39036 - protein, 9 aa, Homo Sapiens
AVRTSIVEK

SEQ ID NO: 39037 - protein, 9 aa, Homo Sapiens
AVRVPAPSI

SEQ ID NO: 39038 - protein, 9 aa, Homo Sapiens
AVSSLIRNK

SEQ ID NO: 39039 - protein, 9 aa, Homo Sapiens
AWRPPPPCL

SEQ ID NO: 39040 - protein, 9 aa, Homo Sapiens
AYAPPPPAK

SEQ ID NO: 39041 - protein, 9 aa, Homo Sapiens
AYKEYISNK

SEQ ID NO: 39042 - protein, 9 aa, Homo Sapiens
AYKKQFSQY

SEQ ID NO: 39043 - protein, 9 aa, Homo Sapiens
AYKSHFRNV

SEQ ID NO: 39044 - protein, 9 aa, Homo Sapiens
AYRPISASV

SEQ ID NO: 39045 - protein, 9 aa, Homo Sapiens
AYYALTKFK

SEQ ID NO: 39046 - protein, 9 aa, Homo Sapiens
AYYPSSFPK

SEQ ID NO: 39047 - protein, 9 aa, Homo Sapiens
DGRPAPPMK

SEQ ID NO: 39048 - protein, 9 aa, Homo Sapiens
EITTERPKK

SEQ ID NO: 39049 - protein, 9 aa, Homo Sapiens
FPRKPSAPK

SEQ ID NO: 39050 - protein, 9 aa, Homo Sapiens
FRVPTANVS

SEQ ID NO: 39051 - protein, 9 aa, Homo Sapiens
FVKRQFMNK

SEQ ID NO: 39052 - protein, 9 aa, Homo Sapiens
GFKNKTVLK

SEQ ID NO: 39053 - protein, 9 aa, Homo Sapiens
GGPGGVGGL

SEQ ID NO: 39054 - protein, 9 aa, Homo Sapiens
GLKKFYITK

SEQ ID NO: 39055 - protein, 9 aa, Homo Sapiens
GLLDKKSLK

SEQ ID NO: 39056 - protein, 9 aa, Homo Sapiens
GMRPPHPGM

SEQ ID NO: 39057 - protein, 9 aa, Homo Sapiens
GMRSYYYGK

SEQ ID NO: 39058 - protein, 9 aa, Homo Sapiens
GNFFCIRKK

SEQ ID NO: 39059 - protein, 9 aa, Homo Sapiens
GQRPTQPVY

SEQ ID NO: 39060 - protein, 9 aa, Homo Sapiens
GQYGNPLNK

SEQ ID NO: 39061 - protein, 9 aa, Homo Sapiens
GRTGPRAPL

SEQ ID NO: 39062 - protein, 9 aa, Homo Sapiens
GSFSVKPLK

SEQ ID NO: 39063 - protein, 9 aa, Homo Sapiens
GSHFPGPFM

SEQ ID NO: 39064 - protein, 9 aa, Homo Sapiens
GSKDICIKV

SEQ ID NO: 39065 - protein, 9 aa, Homo Sapiens
GSKNRTIGV

SEQ ID NO: 39066 - protein, 9 aa, Homo Sapiens
GSLFLRTPK

SEQ ID NO: 39067 - protein, 9 aa, Homo Sapiens
GSLGSRPPL

SEQ ID NO: 39068 - protein, 9 aa, Homo Sapiens
GSRDKTIKL

SEQ ID NO: 39069 - protein, 9 aa, Homo Sapiens
GSRFYFWTK

SEQ ID NO: 39070 - protein, 9 aa, Homo Sapiens
GSRLIKVHL

SEQ ID NO: 39071 - protein, 9 aa, Homo Sapiens
GSRPPGLSK

SEQ ID NO: 39072 - protein, 9 aa, Homo Sapiens
GSVFRAHVK

SEQ ID NO: 39073 - protein, 9 aa, Homo Sapiens
GTIPKRPWL

SEQ ID NO: 39074 - protein, 9 aa, Homo Sapiens
GTKDLIREV

SEQ ID NO: 39075 - protein, 9 aa, Homo Sapiens
GTKDVVVSV

SEQ ID NO: 39076 - protein, 9 aa, Homo Sapiens
GTKEGYLTK

SEQ ID NO: 39077 - protein, 9 aa, Homo Sapiens
GTKGTVIKV

SEQ ID NO: 39078 - protein, 9 aa, Homo Sapiens
GTKKRVITL

SEQ ID NO: 39079 - protein, 9 aa, Homo Sapiens
GTKLPGLLK

SEQ ID NO: 39080 - protein, 9 aa, Homo Sapiens
GTKMTVNNL

SEQ ID NO: 39081 - protein, 9 aa, Homo Sapiens
GTKSTWPQK

SEQ ID NO: 39082 - protein, 9 aa, Homo Sapiens
GTLERGILK

SEQ ID NO: 39083 - protein, 9 aa, Homo Sapiens
GTNPGIITK

SEQ ID NO: 39084 - protein, 9 aa, Homo Sapiens
GTQILRPPK

SEQ ID NO: 39085 - protein, 9 aa, Homo Sapiens
GTREAFFSK

SEQ ID NO: 39086 - protein, 9 aa, Homo Sapiens
GTRESAINV

SEQ ID NO: 39087 - protein, 9 aa, Homo Sapiens
GTRPPHVFA

SEQ ID NO: 39088 - protein, 9 aa, Homo Sapiens
GVHPPAPGV

SEQ ID NO: 39089 - protein, 9 aa, Homo Sapiens
GVKAWTPTK

SEQ ID NO: 39090 - protein, 9 aa, Homo Sapiens
GVRPPAPSL

SEQ ID NO: 39091 - protein, 9 aa, Homo Sapiens
GWKPLGKEK

SEQ ID NO: 39092 - protein, 9 aa, Homo Sapiens
HAKGIVLEK

SEQ ID NO: 39093 - protein, 9 aa, Homo Sapiens
HARLAPPSL

SEQ ID NO: 39094 - protein, 9 aa, Homo Sapiens
HLKDVIVGK

SEQ ID NO: 39095 - protein, 9 aa, Homo Sapiens
HSFYPTPAL

SEQ ID NO: 39096 - protein, 9 aa, Homo Sapiens
HSKVKVIYK

SEQ ID NO: 39097 - protein, 9 aa, Homo Sapiens
HSRDSSFRL

SEQ ID NO: 39098 - protein, 9 aa, Homo Sapiens
HSRIEYMIK

SEQ ID NO: 39099 - protein, 9 aa, Homo Sapiens
HTKPDIIFK

SEQ ID NO: 39100 - protein, 9 aa, Homo Sapiens
HTKSFQLAK

SEQ ID NO: 39101 - protein, 9 aa, Homo Sapiens
HTQPSYRFK

SEQ ID NO: 39102 - protein, 9 aa, Homo Sapiens
HVHEPNPLR

SEQ ID NO: 39103 - protein, 9 aa, Homo Sapiens
HVYKERFPK

SEQ ID NO: 39104 - protein, 9 aa, Homo Sapiens
HVYRERFPK

SEQ ID NO: 39105 - protein, 9 aa, Homo Sapiens
HYKYTVVMK

SEQ ID NO: 39106 - protein, 9 aa, Homo Sapiens
IAKAKFIVK

SEQ ID NO: 39107 - protein, 9 aa, Homo Sapiens
IAPGVTHEL

SEQ ID NO: 39108 - protein, 9 aa, Homo Sapiens
IARIPEAFK

SEQ ID NO: 39109 - protein, 9 aa, Homo Sapiens
IARPTPPQA

SEQ ID NO: 39110 - protein, 9 aa, Homo Sapiens
IFQPPSPPK

SEQ ID NO: 39111 - protein, 9 aa, Homo Sapiens
IGRPPGPEM

SEQ ID NO: 39112 - protein, 9 aa, Homo Sapiens
IHIKIRVPK

SEQ ID NO: 39113 - protein, 9 aa, Homo Sapiens
IIKDFTKQK

SEQ ID NO: 39114 - protein, 9 aa, Homo Sapiens
IIKLAPPPK

SEQ ID NO: 39115 - protein, 9 aa, Homo Sapiens
IIKQGCLLK

SEQ ID NO: 39116 - protein, 9 aa, Homo Sapiens
IIQSIRMGM

SEQ ID NO: 39117 - protein, 9 aa, Homo Sapiens
ILIQNRAGK

SEQ ID NO: 39118 - protein, 9 aa, Homo Sapiens
ILKDMVKVK

SEQ ID NO: 39119 - protein, 9 aa, Homo Sapiens
ILKGIPIKK

SEQ ID NO: 39120 - protein, 9 aa, Homo Sapiens
ILKPTSSVK

SEQ ID NO: 39121 - protein, 9 aa, Homo Sapiens
ILLPKRPPK

SEQ ID NO: 39122 - protein, 9 aa, Homo Sapiens
ILLYIQRTK

SEQ ID NO: 39123 - protein, 9 aa, Homo Sapiens
ILQEYRKIK

SEQ ID NO: 39124 - protein, 9 aa, Homo Sapiens
ILRPSGPGA

SEQ ID NO: 39125 - protein, 9 aa, Homo Sapiens
IQFLHKEKK

SEQ ID NO: 39126 - protein, 9 aa, Homo Sapiens
IQKNVQLYK

SEQ ID NO: 39127 - protein, 9 aa, Homo Sapiens
ISRPVGVSK

SEQ ID NO: 39128 - protein, 9 aa, Homo Sapiens
ITKEDLIQK

SEQ ID NO: 39129 - protein, 9 aa, Homo Sapiens
ITKPKVISK

SEQ ID NO: 39130 - protein, 9 aa, Homo Sapiens
ITREAQVNV

SEQ ID NO: 39131 - protein, 9 aa, Homo Sapiens
IVHQAGMLK

SEQ ID NO: 39132 - protein, 9 aa, Homo Sapiens
IVRDHWVHV

SEQ ID NO: 39133 - protein, 9 aa, Homo Sapiens
IVRGAVVEK

SEQ ID NO: 39134 - protein, 9 aa, Homo Sapiens
KAKIKFIIK

SEQ ID NO: 39135 - protein, 9 aa, Homo Sapiens
KAKPVTTNL

SEQ ID NO: 39136 - protein, 9 aa, Homo Sapiens
KAKSPAPGL

SEQ ID NO: 39137 - protein, 9 aa, Homo Sapiens
KAPVTKVAA

SEQ ID NO: 39138 - protein, 9 aa, Homo Sapiens
KARIPAPLL

SEQ ID NO: 39139 - protein, 9 aa, Homo Sapiens
KAWAIFKGK

SEQ ID NO: 39140 - protein, 9 aa, Homo Sapiens
KERDFYFGK

SEQ ID NO: 39141 - protein, 9 aa, Homo Sapiens
KERDVFLVK

SEQ ID NO: 39142 - protein, 9 aa, Homo Sapiens
KFKDKFCVY

SEQ ID NO: 39143 - protein, 9 aa, Homo Sapiens
KFKEEVNHY

SEQ ID NO: 39144 - protein, 9 aa, Homo Sapiens
KFKESFAEM

SEQ ID NO: 39145 - protein, 9 aa, Homo Sapiens
KFKFPGRQK

SEQ ID NO: 39146 - protein, 9 aa, Homo Sapiens
KFREIQQEL

SEQ ID NO: 39147 - protein, 9 aa, Homo Sapiens
KFRSNLPAK

SEQ ID NO: 39148 - protein, 9 aa, Homo Sapiens
KFYGNRHLI

SEQ ID NO: 39149 - protein, 9 aa, Homo Sapiens
KGFDQTINL

SEQ ID NO: 39150 - protein, 9 aa, Homo Sapiens
KGKYKFLQK

SEQ ID NO: 39151 - protein, 9 aa, Homo Sapiens
KIKEINVQK

SEQ ID NO: 39152 - protein, 9 aa, Homo Sapiens
KIKELHQQY

SEQ ID NO: 39153 - protein, 9 aa, Homo Sapiens
KIKSFVKVY

SEQ ID NO: 39154 - protein, 9 aa, Homo Sapiens
KILAKRINV

SEQ ID NO: 39155 - protein, 9 aa, Homo Sapiens
KIRDTFCSY

SEQ ID NO: 39156 - protein, 9 aa, Homo Sapiens
KIRDVTKCL

SEQ ID NO: 39157 - protein, 9 aa, Homo Sapiens
KIREYFQKY

SEQ ID NO: 39158 - protein, 9 aa, Homo Sapiens
KIRIEDPPR

SEQ ID NO: 39159 - protein, 9 aa, Homo Sapiens
KIRLFQPNL

SEQ ID NO: 39160 - protein, 9 aa, Homo Sapiens
KIRPYWKNY

SEQ ID NO: 39161 - protein, 9 aa, Homo Sapiens
KISPYYRTK

SEQ ID NO: 39162 - protein, 9 aa, Homo Sapiens
KITDTFKVK

SEQ ID NO: 39163 - protein, 9 aa, Homo Sapiens
KLFNKFIGK

SEQ ID NO: 39164 - protein, 9 aa, Homo Sapiens
KLHFIFRHK

SEQ ID NO: 39165 - protein, 9 aa, Homo Sapiens
KLHGVNINV

SEQ ID NO: 39166 - protein, 9 aa, Homo Sapiens
KLKAIVASK

SEQ ID NO: 39167 - protein, 9 aa, Homo Sapiens
KLKDAFSHV

SEQ ID NO: 39168 - protein, 9 aa, Homo Sapiens
KLKDYLRSK

SEQ ID NO: 39169 - protein, 9 aa, Homo Sapiens
KLKEEVINK

SEQ ID NO: 39170 - protein, 9 aa, Homo Sapiens
KLKEKFQHY

SEQ ID NO: 39171 - protein, 9 aa, Homo Sapiens
KLKEYLKNK

SEQ ID NO: 39172 - protein, 9 aa, Homo Sapiens
KLKPYVSYL

SEQ ID NO: 39173 - protein, 9 aa, Homo Sapiens
KLKSFFKEY

SEQ ID NO: 39174 - protein, 9 aa, Homo Sapiens
KLKSFTYEY

SEQ ID NO: 39175 - protein, 9 aa, Homo Sapiens
KLNDLLKEK

SEQ ID NO: 39176 - protein, 9 aa, Homo Sapiens
KLRGIVSEK

SEQ ID NO: 39177 - protein, 9 aa, Homo Sapiens
KLRHSAPGL

SEQ ID NO: 39178 - protein, 9 aa, Homo Sapiens
KLRPPGAEK

SEQ ID NO: 39179 - protein, 9 aa, Homo Sapiens
KLRQPFFQK

SEQ ID NO: 39180 - protein, 9 aa, Homo Sapiens
KLVDVVKKK

SEQ ID NO: 39181 - protein, 9 aa, Homo Sapiens
KMHVPAPKL

SEQ ID NO: 39182 - protein, 9 aa, Homo Sapiens
KMKETLQNV

SEQ ID NO: 39183 - protein, 9 aa, Homo Sapiens
KMKGDYYRY

SEQ ID NO: 39184 - protein, 9 aa, Homo Sapiens
KMKSFCQRV

SEQ ID NO: 39185 - protein, 9 aa, Homo Sapiens
KMPKIKMPK

SEQ ID NO: 39186 - protein, 9 aa, Homo Sapiens
KNKPEWFFK

SEQ ID NO: 39187 - protein, 9 aa, Homo Sapiens
KNKQKFVLK

SEQ ID NO: 39188 - protein, 9 aa, Homo Sapiens
KQKSLYREV

SEQ ID NO: 39189 - protein, 9 aa, Homo Sapiens
KQLTSHPWK

SEQ ID NO: 39190 - protein, 9 aa, Homo Sapiens
KQRLQQLFK

SEQ ID NO: 39191 - protein, 9 aa, Homo Sapiens
KSFGELVHK

SEQ ID NO: 39192 - protein, 9 aa, Homo Sapiens
KSKDFVQVM

SEQ ID NO: 39193 - protein, 9 aa, Homo Sapiens
KSKEFVQKV

SEQ ID NO: 39194 - protein, 9 aa, Homo Sapiens
KSKITHPVY

SEQ ID NO: 39195 - protein, 9 aa, Homo Sapiens
KSKPFCEKL

SEQ ID NO: 39196 - protein, 9 aa, Homo Sapiens
KSKPIFWNL

SEQ ID NO: 39197 - protein, 9 aa, Homo Sapiens
KSKPVAFAV

SEQ ID NO: 39198 - protein, 9 aa, Homo Sapiens
KSKSIFWNL

SEQ ID NO: 39199 - protein, 9 aa, Homo Sapiens
KSNGTIIHV

SEQ ID NO: 39200 - protein, 9 aa, Homo Sapiens
KSQEIFLNL

SEQ ID NO: 39201 - protein, 9 aa, Homo Sapiens
KSRDSFLKR

SEQ ID NO: 39202 - protein, 9 aa, Homo Sapiens
KSRPPAPEL

SEQ ID NO: 39203 - protein, 9 aa, Homo Sapiens
KSRQTPPLA

SEQ ID NO: 39204 - protein, 9 aa, Homo Sapiens
KSRVSPPFK

SEQ ID NO: 39205 - protein, 9 aa, Homo Sapiens
KTAMSTPHV

SEQ ID NO: 39206 - protein, 9 aa, Homo Sapiens
KTHLPPPAL

SEQ ID NO: 39207 - protein, 9 aa, Homo Sapiens
KTIDGHINL

SEQ ID NO: 39208 - protein, 9 aa, Homo Sapiens
KTKDIVNGL

SEQ ID NO: 39209 - protein, 9 aa, Homo Sapiens
KTKDLFPSL

SEQ ID NO: 39210 - protein, 9 aa, Homo Sapiens
KTKDLLNNV

SEQ ID NO: 39211 - protein, 9 aa, Homo Sapiens
KTKDLYRDL

SEQ ID NO: 39212 - protein, 9 aa, Homo Sapiens
KTKEGYYYR

SEQ ID NO: 39213 - protein, 9 aa, Homo Sapiens
KTKESSEYL

SEQ ID NO: 39214 - protein, 9 aa, Homo Sapiens
KTKEVYELL

SEQ ID NO: 39215 - protein, 9 aa, Homo Sapiens
KTKFTIENV

SEQ ID NO: 39216 - protein, 9 aa, Homo Sapiens
KTKGDFILV

SEQ ID NO: 39217 - protein, 9 aa, Homo Sapiens
KTKGFHTTI

SEQ ID NO: 39218 - protein, 9 aa, Homo Sapiens
KTKPFQLQL

SEQ ID NO: 39219 - protein, 9 aa, Homo Sapiens
KTKPVAFAV

SEQ ID NO: 39220 - protein, 9 aa, Homo Sapiens
KTKQAWNFL

SEQ ID NO: 39221 - protein, 9 aa, Homo Sapiens
KTKQVIQGL

SEQ ID NO: 39222 - protein, 9 aa, Homo Sapiens
KTKSFFDNI

SEQ ID NO: 39223 - protein, 9 aa, Homo Sapiens
KTKSVVLQL

SEQ ID NO: 39224 - protein, 9 aa, Homo Sapiens
KTKVPEVTK

SEQ ID NO: 39225 - protein, 9 aa, Homo Sapiens
KTKWGTIEV

SEQ ID NO: 39226 - protein, 9 aa, Homo Sapiens
KTNLTSVTK

SEQ ID NO: 39227 - protein, 9 aa, Homo Sapiens
KTRDEYLSL

SEQ ID NO: 39228 - protein, 9 aa, Homo Sapiens
KTREWAEQL

SEQ ID NO: 39229 - protein, 9 aa, Homo Sapiens
KTRGIFETK

SEQ ID NO: 39230 - protein, 9 aa, Homo Sapiens
KTRIIDVVY

SEQ ID NO: 39231 - protein, 9 aa, Homo Sapiens
KTRIPPRTY

SEQ ID NO: 39232 - protein, 9 aa, Homo Sapiens
KTRLDAPRL

SEQ ID NO: 39233 - protein, 9 aa, Homo Sapiens
KTRLINQVL

SEQ ID NO: 39234 - protein, 9 aa, Homo Sapiens
KTRNVPVRL

SEQ ID NO: 39235 - protein, 9 aa, Homo Sapiens
KTRPPVRLV

SEQ ID NO: 39236 - protein, 9 aa, Homo Sapiens
KTTILYKLK

SEQ ID NO: 39237 - protein, 9 aa, Homo Sapiens
KTYVIKRVK

SEQ ID NO: 39238 - protein, 9 aa, Homo Sapiens
KVFNQPKAK

SEQ ID NO: 39239 - protein, 9 aa, Homo Sapiens
KVKAEISFV

SEQ ID NO: 39240 - protein, 9 aa, Homo Sapiens
KVKAEVQNL

SEQ ID NO: 39241 - protein, 9 aa, Homo Sapiens
KVKAFIVTL

SEQ ID NO: 39242 - protein, 9 aa, Homo Sapiens
KVKDGQLTV

SEQ ID NO: 39243 - protein, 9 aa, Homo Sapiens
KVKDILSKV

SEQ ID NO: 39244 - protein, 9 aa, Homo Sapiens
KVKDLRQYL

SEQ ID NO: 39245 - protein, 9 aa, Homo Sapiens
KVKDLVARI

SEQ ID NO: 39246 - protein, 9 aa, Homo Sapiens
KVKDYISAK

SEQ ID NO: 39247 - protein, 9 aa, Homo Sapiens
KVKEFCENL

SEQ ID NO: 39248 - protein, 9 aa, Homo Sapiens
KVKEFFEKL

SEQ ID NO: 39249 - protein, 9 aa, Homo Sapiens
KVKEFLSTL

SEQ ID NO: 39250 - protein, 9 aa, Homo Sapiens
KVKEKFQQL

SEQ ID NO: 39251 - protein, 9 aa, Homo Sapiens
KVKFEERYK

SEQ ID NO: 39252 - protein, 9 aa, Homo Sapiens
KVKFTVHTK

SEQ ID NO: 39253 - protein, 9 aa, Homo Sapiens
KVKITTENV

SEQ ID NO: 39254 - protein, 9 aa, Homo Sapiens
KVKKLVVKV

SEQ ID NO: 39255 - protein, 9 aa, Homo Sapiens
KVKSSVIGA

SEQ ID NO: 39256 - protein, 9 aa, Homo Sapiens
KVKSYIHEV

SEQ ID NO: 39257 - protein, 9 aa, Homo Sapiens
KVKTKVIEL

SEQ ID NO: 39258 - protein, 9 aa, Homo Sapiens
KVKWFYNEY

SEQ ID NO: 39259 - protein, 9 aa, Homo Sapiens
KVLDHFRRK

SEQ ID NO: 39260 - protein, 9 aa, Homo Sapiens
KVQPPGPVK

SEQ ID NO: 39261 - protein, 9 aa, Homo Sapiens
KVRAGGPGL

SEQ ID NO: 39262 - protein, 9 aa, Homo Sapiens
KVRAYIQMK

SEQ ID NO: 39263 - protein, 9 aa, Homo Sapiens
KVRCSRYLY

SEQ ID NO: 39264 - protein, 9 aa, Homo Sapiens
KVRDKLNNL

SEQ ID NO: 39265 - protein, 9 aa, Homo Sapiens
KVREEFKEL

SEQ ID NO: 39266 - protein, 9 aa, Homo Sapiens
KVRIMGPNY

SEQ ID NO: 39267 - protein, 9 aa, Homo Sapiens
KVRITLVTK

SEQ ID NO: 39268 - protein, 9 aa, Homo Sapiens
KVRQRAVAL

SEQ ID NO: 39269 - protein, 9 aa, Homo Sapiens
KVSDLTIPK

SEQ ID NO: 39270 - protein, 9 aa, Homo Sapiens
KVSQVIMEK

SEQ ID NO: 39271 - protein, 9 aa, Homo Sapiens
KYIDKTIRV

SEQ ID NO: 39272 - protein, 9 aa, Homo Sapiens
KYIDVVINK

SEQ ID NO: 39273 - protein, 9 aa, Homo Sapiens
KYKDAIHFY

SEQ ID NO: 39274 - protein, 9 aa, Homo Sapiens
KYKDKIKTL

SEQ ID NO: 39275 - protein, 9 aa, Homo Sapiens
KYKERFLVY

SEQ ID NO: 39276 - protein, 9 aa, Homo Sapiens
KYKSVYKNV

SEQ ID NO: 39277 - protein, 9 aa, Homo Sapiens
KYLTKKYLK

SEQ ID NO: 39278 - protein, 9 aa, Homo Sapiens
KYMPHAVLK

SEQ ID NO: 39279 - protein, 9 aa, Homo Sapiens
KYVDTNLQK

SEQ ID NO: 39280 - protein, 9 aa, Homo Sapiens
KYVGSRPIK

SEQ ID NO: 39281 - protein, 9 aa, Homo Sapiens
KYWAPHIKK

SEQ ID NO: 39282 - protein, 9 aa, Homo Sapiens
KYWQLPKEK

SEQ ID NO: 39283 - protein, 9 aa, Homo Sapiens
LFKPPQPPA

SEQ ID NO: 39284 - protein, 9 aa, Homo Sapiens
LGRGASTFK

SEQ ID NO: 39285 - protein, 9 aa, Homo Sapiens
LGSPERPPK

SEQ ID NO: 39286 - protein, 9 aa, Homo Sapiens
LIRSPSLAK

SEQ ID NO: 39287 - protein, 9 aa, Homo Sapiens
LQIDNARLA

SEQ ID NO: 39288 - protein, 9 aa, Homo Sapiens
LQRPPVVSK

SEQ ID NO: 39289 - protein, 9 aa, Homo Sapiens
LSKAFSRLK

SEQ ID NO: 39290 - protein, 9 aa, Homo Sapiens
LSREPAPCA

SEQ ID NO: 39291 - protein, 9 aa, Homo Sapiens
LVKPKIVKK

SEQ ID NO: 39292 - protein, 9 aa, Homo Sapiens
LVKPVTINV

SEQ ID NO: 39293 - protein, 9 aa, Homo Sapiens
LVRTKTLVK

SEQ ID NO: 39294 - protein, 9 aa, Homo Sapiens
MAPLKMLAL

SEQ ID NO: 39295 - protein, 9 aa, Homo Sapiens
MIRAAPPPL

SEQ ID NO: 39296 - protein, 9 aa, Homo Sapiens
MLKQLSILK

SEQ ID NO: 39297 - protein, 9 aa, Homo Sapiens
MQKSVVITL

SEQ ID NO: 39298 - protein, 9 aa, Homo Sapiens
NIRPLFINK

SEQ ID NO: 39299 - protein, 9 aa, Homo Sapiens
NSRFGSLPK

SEQ ID NO: 39300 - protein, 9 aa, Homo Sapiens
NSSRKFLQR

SEQ ID NO: 39301 - protein, 9 aa, Homo Sapiens
PIRLLAAAA

SEQ ID NO: 39302 - protein, 9 aa, Homo Sapiens
QAPPPRPPK

SEQ ID NO: 39303 - protein, 9 aa, Homo Sapiens
QARPPGIYK

SEQ ID NO: 39304 - protein, 9 aa, Homo Sapiens
QIGPAPPLK

SEQ ID NO: 39305 - protein, 9 aa, Homo Sapiens
QIKPFYTVK

SEQ ID NO: 39306 - protein, 9 aa, Homo Sapiens
QIPEIKQTL

SEQ ID NO: 39307 - protein, 9 aa, Homo Sapiens
QIRPNTELK

SEQ ID NO: 39308 - protein, 9 aa, Homo Sapiens
QQKPPPPPK

SEQ ID NO: 39309 - protein, 9 aa, Homo Sapiens
QQKQEWLSK

SEQ ID NO: 39310 - protein, 9 aa, Homo Sapiens
QTQELRHLK

SEQ ID NO: 39311 - protein, 9 aa, Homo Sapiens
QTQPIYLAK

SEQ ID NO: 39312 - protein, 9 aa, Homo Sapiens
QTRPPASLK

SEQ ID NO: 39313 - protein, 9 aa, Homo Sapiens
QVKSLTQKV

SEQ ID NO: 39314 - protein, 9 aa, Homo Sapiens
RAKNWVKEL

SEQ ID NO: 39315 - protein, 9 aa, Homo Sapiens
RAKTVVLHI

SEQ ID NO: 39316 - protein, 9 aa, Homo Sapiens
RAYPHVFTK

SEQ ID NO: 39317 - protein, 9 aa, Homo Sapiens
REKPAPPQK

SEQ ID NO: 39318 - protein, 9 aa, Homo Sapiens
RFFDKVIEK

SEQ ID NO: 39319 - protein, 9 aa, Homo Sapiens
RFKDIFQEI

SEQ ID NO: 39320 - protein, 9 aa, Homo Sapiens
RFKDRFSKL

SEQ ID NO: 39321 - protein, 9 aa, Homo Sapiens
RFKEEFQRL

SEQ ID NO: 39322 - protein, 9 aa, Homo Sapiens
RFKNKITVV

SEQ ID NO: 39323 - protein, 9 aa, Homo Sapiens
RFSPYYRTK

SEQ ID NO: 39324 - protein, 9 aa, Homo Sapiens
RFVSVSKLK

SEQ ID NO: 39325 - protein, 9 aa, Homo Sapiens
RFYDRRFLK

SEQ ID NO: 39326 - protein, 9 aa, Homo Sapiens
RGYYRYYNK

SEQ ID NO: 39327 - protein, 9 aa, Homo Sapiens
RIFEPPPPK

SEQ ID NO: 39328 - protein, 9 aa, Homo Sapiens
RIKATVMDV

SEQ ID NO: 39329 - protein, 9 aa, Homo Sapiens
RIKDEFQFL

SEQ ID NO: 39330 - protein, 9 aa, Homo Sapiens
RIKDEFQLL

SEQ ID NO: 39331 - protein, 9 aa, Homo Sapiens
RIKDTVQKL

SEQ ID NO: 39332 - protein, 9 aa, Homo Sapiens
RIKEIFCPK

SEQ ID NO: 39333 - protein, 9 aa, Homo Sapiens
RIKPNAITY

SEQ ID NO: 39334 - protein, 9 aa, Homo Sapiens
RIKPPWVVK

SEQ ID NO: 39335 - protein, 9 aa, Homo Sapiens
RILSGVVTK

SEQ ID NO: 39336 - protein, 9 aa, Homo Sapiens
RIREFYRGR

SEQ ID NO: 39337 - protein, 9 aa, Homo Sapiens
RIRKEPPVY

SEQ ID NO: 39338 - protein, 9 aa, Homo Sapiens
RKLAYRPPK

SEQ ID NO: 39339 - protein, 9 aa, Homo Sapiens
RLFVGSIPK

SEQ ID NO: 39340 - protein, 9 aa, Homo Sapiens
RLIQMRPFL

SEQ ID NO: 39341 - protein, 9 aa, Homo Sapiens
RLKDELIAK

SEQ ID NO: 39342 - protein, 9 aa, Homo Sapiens
RLKDIIFDV

SEQ ID NO: 39343 - protein, 9 aa, Homo Sapiens
RLKDKIPNV

SEQ ID NO: 39344 - protein, 9 aa, Homo Sapiens
RLKDVVRAY

SEQ ID NO: 39345 - protein, 9 aa, Homo Sapiens
RLKELLRAK

SEQ ID NO: 39346 - protein, 9 aa, Homo Sapiens
RLKENQISV

SEQ ID NO: 39347 - protein, 9 aa, Homo Sapiens
RLKEVFQTK

SEQ ID NO: 39348 - protein, 9 aa, Homo Sapiens
RLKPLAIGK

SEQ ID NO: 39349 - protein, 9 aa, Homo Sapiens
RLKPTFISK

SEQ ID NO: 39350 - protein, 9 aa, Homo Sapiens
RLKQEILEK

SEQ ID NO: 39351 - protein, 9 aa, Homo Sapiens
RLKVLYSQK

SEQ ID NO: 39352 - protein, 9 aa, Homo Sapiens
RLRDPAQQV

SEQ ID NO: 39353 - protein, 9 aa, Homo Sapiens
RLREFWMRY

SEQ ID NO: 39354 - protein, 9 aa, Homo Sapiens
RLRPPSQGY

SEQ ID NO: 39355 - protein, 9 aa, Homo Sapiens
RLRQPPPCY

SEQ ID NO: 39356 - protein, 9 aa, Homo Sapiens
RLSDVLKRK

SEQ ID NO: 39357 - protein, 9 aa, Homo Sapiens
RLVDIKKEK

SEQ ID NO: 39358 - protein, 9 aa, Homo Sapiens
RMHQAIERF

SEQ ID NO: 39359 - protein, 9 aa, Homo Sapiens
RMMKNRPFM

SEQ ID NO: 39360 - protein, 9 aa, Homo Sapiens
RNRVCPPHL

SEQ ID NO: 39361 - protein, 9 aa, Homo Sapiens
RQFWTRTKK

SEQ ID NO: 39362 - protein, 9 aa, Homo Sapiens
RQIPYTMMK

SEQ ID NO: 39363 - protein, 9 aa, Homo Sapiens
RQKIVVIAK

SEQ ID NO: 39364 - protein, 9 aa, Homo Sapiens
RQPPPRPFL

SEQ ID NO: 39365 - protein, 9 aa, Homo Sapiens
RQRGIAVEV

SEQ ID NO: 39366 - protein, 9 aa, Homo Sapiens
RQRGINMRY

SEQ ID NO: 39367 - protein, 9 aa, Homo Sapiens
RSFFHQHYL

SEQ ID NO: 39368 - protein, 9 aa, Homo Sapiens
RSIVRIIGK

SEQ ID NO: 39369 - protein, 9 aa, Homo Sapiens
RSKTVILVK

SEQ ID NO: 39370 - protein, 9 aa, Homo Sapiens
RSLGIRVVK

SEQ ID NO: 39371 - protein, 9 aa, Homo Sapiens
RSLGSSPVK

SEQ ID NO: 39372 - protein, 9 aa, Homo Sapiens
RSNYRVFLK

SEQ ID NO: 39373 - protein, 9 aa, Homo Sapiens
RSQFYFLTK

SEQ ID NO: 39374 - protein, 9 aa, Homo Sapiens
RSYSDPPLK

SEQ ID NO: 39375 - protein, 9 aa, Homo Sapiens
RTHLPGRTY

SEQ ID NO: 39376 - protein, 9 aa, Homo Sapiens
RTIAKRLVL

SEQ ID NO: 39377 - protein, 9 aa, Homo Sapiens
RTIDKKFYK

SEQ ID NO: 39378 - protein, 9 aa, Homo Sapiens
RTIDRSVFK

SEQ ID NO: 39379 - protein, 9 aa, Homo Sapiens
RTIQRPVTM

SEQ ID NO: 39380 - protein, 9 aa, Homo Sapiens
RTKALIEKL

SEQ ID NO: 39381 - protein, 9 aa, Homo Sapiens
RTKASVHTL

SEQ ID NO: 39382 - protein, 9 aa, Homo Sapiens
RTKDTPLSL

SEQ ID NO: 39383 - protein, 9 aa, Homo Sapiens
RTKMVYCKI

SEQ ID NO: 39384 - protein, 9 aa, Homo Sapiens
RTKPQSFQV

SEQ ID NO: 39385 - protein, 9 aa, Homo Sapiens
RTKQIRESL

SEQ ID NO: 39386 - protein, 9 aa, Homo Sapiens
RTKSAFSNL

SEQ ID NO: 39387 - protein, 9 aa, Homo Sapiens
RTLLKKVWK

SEQ ID NO: 39388 - protein, 9 aa, Homo Sapiens
RTMPLLSLH

SEQ ID NO: 39389 - protein, 9 aa, Homo Sapiens
RTNNLFKQV

SEQ ID NO: 39390 - protein, 9 aa, Homo Sapiens
RTPGPRPPR

SEQ ID NO: 39391 - protein, 9 aa, Homo Sapiens
RTQNVLGEK

SEQ ID NO: 39392 - protein, 9 aa, Homo Sapiens
RTRPALWNK

SEQ ID NO: 39393 - protein, 9 aa, Homo Sapiens
RTRPPSVQV

SEQ ID NO: 39394 - protein, 9 aa, Homo Sapiens
RTRQLFVRL

SEQ ID NO: 39395 - protein, 9 aa, Homo Sapiens
RTRVQKVQV

SEQ ID NO: 39396 - protein, 9 aa, Homo Sapiens
RTSEIYVHR

SEQ ID NO: 39397 - protein, 9 aa, Homo Sapiens
RVFLRAINK

SEQ ID NO: 39398 - protein, 9 aa, Homo Sapiens
RVGLHKVFK

SEQ ID NO: 39399 - protein, 9 aa, Homo Sapiens
RVIQVKKMK

SEQ ID NO: 39400 - protein, 9 aa, Homo Sapiens
RVKAVRILA

SEQ ID NO: 39401 - protein, 9 aa, Homo Sapiens
RVKDFFKNA

SEQ ID NO: 39402 - protein, 9 aa, Homo Sapiens
RVKDQPLSL

SEQ ID NO: 39403 - protein, 9 aa, Homo Sapiens
RVKEEVRKL

SEQ ID NO: 39404 - protein, 9 aa, Homo Sapiens
RVKEIYNTY

SEQ ID NO: 39405 - protein, 9 aa, Homo Sapiens
RVKELEVRK

SEQ ID NO: 39406 - protein, 9 aa, Homo Sapiens
RVKEYFVFR

SEQ ID NO: 39407 - protein, 9 aa, Homo Sapiens
RVKGVTIVK

SEQ ID NO: 39408 - protein, 9 aa, Homo Sapiens
RVKLPSGSK

SEQ ID NO: 39409 - protein, 9 aa, Homo Sapiens
RVKNAVKYL

SEQ ID NO: 39410 - protein, 9 aa, Homo Sapiens
RVKPYIIDL

SEQ ID NO: 39411 - protein, 9 aa, Homo Sapiens
RVKQMFASR

SEQ ID NO: 39412 - protein, 9 aa, Homo Sapiens
RVKSEYMRL

SEQ ID NO: 39413 - protein, 9 aa, Homo Sapiens
RVKSFALKY

SEQ ID NO: 39414 - protein, 9 aa, Homo Sapiens
RVKTFQENL

SEQ ID NO: 39415 - protein, 9 aa, Homo Sapiens
RVLEDRALK

SEQ ID NO: 39416 - protein, 9 aa, Homo Sapiens
RVLPEFKKK

SEQ ID NO: 39417 - protein, 9 aa, Homo Sapiens
RVMGIRVLR

SEQ ID NO: 39418 - protein, 9 aa, Homo Sapiens
RVNKPPYPK

SEQ ID NO: 39419 - protein, 9 aa, Homo Sapiens
RVQEVPKLK

SEQ ID NO: 39420 - protein, 9 aa, Homo Sapiens
RVQLKYAAK

SEQ ID NO: 39421 - protein, 9 aa, Homo Sapiens
RVRDDVAEY

SEQ ID NO: 39422 - protein, 9 aa, Homo Sapiens
RVRDIQKQV

SEQ ID NO: 39423 - protein, 9 aa, Homo Sapiens
RVRDVFEAK

SEQ ID NO: 39424 - protein, 9 aa, Homo Sapiens
RVREIIINA

SEQ ID NO: 39425 - protein, 9 aa, Homo Sapiens
RVREITENL

SEQ ID NO: 39426 - protein, 9 aa, Homo Sapiens
RVREKPPWR

SEQ ID NO: 39427 - protein, 9 aa, Homo Sapiens
RVRFFPYNY

SEQ ID NO: 39428 - protein, 9 aa, Homo Sapiens
RVRNRVNFR

SEQ ID NO: 39429 - protein, 9 aa, Homo Sapiens
RVRQPPPRP

SEQ ID NO: 39430 - protein, 9 aa, Homo Sapiens
RVVWKRPRL

SEQ ID NO: 39431 - protein, 9 aa, Homo Sapiens
RWKLSQIRK

SEQ ID NO: 39432 - protein, 9 aa, Homo Sapiens
RWKPFQQDV

SEQ ID NO: 39433 - protein, 9 aa, Homo Sapiens
RYFQVEVEK

SEQ ID NO: 39434 - protein, 9 aa, Homo Sapiens
RYIEVFREK

SEQ ID NO: 39435 - protein, 9 aa, Homo Sapiens
RYIPFTHGK

SEQ ID NO: 39436 - protein, 9 aa, Homo Sapiens
RYMFSRPFR

SEQ ID NO: 39437 - protein, 9 aa, Homo Sapiens
RYNDLMKKK

SEQ ID NO: 39438 - protein, 9 aa, Homo Sapiens
RYNGLIHRK

SEQ ID NO: 39439 - protein, 9 aa, Homo Sapiens
RYRAITSAY

SEQ ID NO: 39440 - protein, 9 aa, Homo Sapiens
RYRPGTVAL

SEQ ID NO: 39441 - protein, 9 aa, Homo Sapiens
RYVSVRDFK

SEQ ID NO: 39442 - protein, 9 aa, Homo Sapiens
SAGPPSLRK

SEQ ID NO: 39443 - protein, 9 aa, Homo Sapiens
SAPDKSLEL

SEQ ID NO: 39444 - protein, 9 aa, Homo Sapiens
SAPSSDKPL

SEQ ID NO: 39445 - protein, 9 aa, Homo Sapiens
SAPTETHSL

SEQ ID NO: 39446 - protein, 9 aa, Homo Sapiens
SFKDFAKSK

SEQ ID NO: 39447 - protein, 9 aa, Homo Sapiens
SFKEKFVRK

SEQ ID NO: 39448 - protein, 9 aa, Homo Sapiens
SFKNVQQQL

SEQ ID NO: 39449 - protein, 9 aa, Homo Sapiens
SFKTVIKKK

SEQ ID NO: 39450 - protein, 9 aa, Homo Sapiens
SGPGPAAAL

SEQ ID NO: 39451 - protein, 9 aa, Homo Sapiens
SGSPATPLK

SEQ ID NO: 39452 - protein, 9 aa, Homo Sapiens
SIKKIFYMK

SEQ ID NO: 39453 - protein, 9 aa, Homo Sapiens
SIKQVIVRK

SEQ ID NO: 39454 - protein, 9 aa, Homo Sapiens
SISPYPKVK

SEQ ID NO: 39455 - protein, 9 aa, Homo Sapiens
SLKADSINK

SEQ ID NO: 39456 - protein, 9 aa, Homo Sapiens
SLKDLVKEK

SEQ ID NO: 39457 - protein, 9 aa, Homo Sapiens
SLKEIVINV

SEQ ID NO: 39458 - protein, 9 aa, Homo Sapiens
SLKEKFNGK

SEQ ID NO: 39459 - protein, 9 aa, Homo Sapiens
SLKHLCRLK

SEQ ID NO: 39460 - protein, 9 aa, Homo Sapiens
SLKQKLVNK

SEQ ID NO: 39461 - protein, 9 aa, Homo Sapiens
SLKTTLKPK

SEQ ID NO: 39462 - protein, 9 aa, Homo Sapiens
SSFLIKRNK

SEQ ID NO: 39463 - protein, 9 aa, Homo Sapiens
SSGVPNPPK

SEQ ID NO: 39464 - protein, 9 aa, Homo Sapiens
SSHLPPPPK

SEQ ID NO: 39465 - protein, 9 aa, Homo Sapiens
SSHNSSPYL

SEQ ID NO: 39466 - protein, 9 aa, Homo Sapiens
SSKPVTITV

SEQ ID NO: 39467 - protein, 9 aa, Homo Sapiens
SSPQAGSSL

SEQ ID NO: 39468 - protein, 9 aa, Homo Sapiens
SSRGPLPVK

SEQ ID NO: 39469 - protein, 9 aa, Homo Sapiens
SSRPASLGY

SEQ ID NO: 39470 - protein, 9 aa, Homo Sapiens
SSRQKWIVK

SEQ ID NO: 39471 - protein, 9 aa, Homo Sapiens
STFFYPKLK

SEQ ID NO: 39472 - protein, 9 aa, Homo Sapiens
STHGTFLNK

SEQ ID NO: 39473 - protein, 9 aa, Homo Sapiens
STKFWIKQK

SEQ ID NO: 39474 - protein, 9 aa, Homo Sapiens
STKGQSINV

SEQ ID NO: 39475 - protein, 9 aa, Homo Sapiens
STLPRISLK

SEQ ID NO: 39476 - protein, 9 aa, Homo Sapiens
STLSGRPVK

SEQ ID NO: 39477 - protein, 9 aa, Homo Sapiens
STNPFRPQK

SEQ ID NO: 39478 - protein, 9 aa, Homo Sapiens
STREWAIKK

SEQ ID NO: 39479 - protein, 9 aa, Homo Sapiens
STRIPKIQK

SEQ ID NO: 39480 - protein, 9 aa, Homo Sapiens
STRLKYAVK

SEQ ID NO: 39481 - protein, 9 aa, Homo Sapiens
STRPVVYQV

SEQ ID NO: 39482 - protein, 9 aa, Homo Sapiens
STRPVYLKK

SEQ ID NO: 39483 - protein, 9 aa, Homo Sapiens
STSRDFKIK

SEQ ID NO: 39484 - protein, 9 aa, Homo Sapiens
SVITIVKSK

SEQ ID NO: 39485 - protein, 9 aa, Homo Sapiens
SVKDPSPLY

SEQ ID NO: 39486 - protein, 9 aa, Homo Sapiens
SVKEDVHLK

SEQ ID NO: 39487 - protein, 9 aa, Homo Sapiens
SVKEIYNEK

SEQ ID NO: 39488 - protein, 9 aa, Homo Sapiens
SVKEWTITY

SEQ ID NO: 39489 - protein, 9 aa, Homo Sapiens
SVKGLLTEK

SEQ ID NO: 39490 - protein, 9 aa, Homo Sapiens
SVKKIQVEK

SEQ ID NO: 39491 - protein, 9 aa, Homo Sapiens
SVKPFICHV

SEQ ID NO: 39492 - protein, 9 aa, Homo Sapiens
SVKPSTVVK

SEQ ID NO: 39493 - protein, 9 aa, Homo Sapiens
SVNGKVLSK

SEQ ID NO: 39494 - protein, 9 aa, Homo Sapiens
SVPGRAVRP

SEQ ID NO: 39495 - protein, 9 aa, Homo Sapiens
SVQEGIKFK

SEQ ID NO: 39496 - protein, 9 aa, Homo Sapiens
SVQKPKFPK

SEQ ID NO: 39497 - protein, 9 aa, Homo Sapiens
SVRAETVPK

SEQ ID NO: 39498 - protein, 9 aa, Homo Sapiens
SVRDKLLVK

SEQ ID NO: 39499 - protein, 9 aa, Homo Sapiens
SVRDPSPEA

SEQ ID NO: 39500 - protein, 9 aa, Homo Sapiens
SVRGTSFDA

SEQ ID NO: 39501 - protein, 9 aa, Homo Sapiens
SVRGVSISK

SEQ ID NO: 39502 - protein, 9 aa, Homo Sapiens
SVRKFICHV

SEQ ID NO: 39503 - protein, 9 aa, Homo Sapiens
SVRLPPITK

SEQ ID NO: 39504 - protein, 9 aa, Homo Sapiens
SVRPAVLQV

SEQ ID NO: 39505 - protein, 9 aa, Homo Sapiens
SVRQPSLHM

SEQ ID NO: 39506 - protein, 9 aa, Homo Sapiens
SVSPASTLK

SEQ ID NO: 39507 - protein, 9 aa, Homo Sapiens
SYFKIFKTK

SEQ ID NO: 39508 - protein, 9 aa, Homo Sapiens
SYRSLTLGY

SEQ ID NO: 39509 - protein, 9 aa, Homo Sapiens
TAPQGNVDL

SEQ ID NO: 39510 - protein, 9 aa, Homo Sapiens
TFRVKNPDK

SEQ ID NO: 39511 - protein, 9 aa, Homo Sapiens
TIKEGSQLK

SEQ ID NO: 39512 - protein, 9 aa, Homo Sapiens
TLKGKLVQK

SEQ ID NO: 39513 - protein, 9 aa, Homo Sapiens
TLRAASPPR

SEQ ID NO: 39514 - protein, 9 aa, Homo Sapiens
TLRPASPLM

SEQ ID NO: 39515 - protein, 9 aa, Homo Sapiens
TQMVRMILK

SEQ ID NO: 39516 - protein, 9 aa, Homo Sapiens
TSRMAPPAS

SEQ ID NO: 39517 - protein, 9 aa, Homo Sapiens
TSRPPSMHV

SEQ ID NO: 39518 - protein, 9 aa, Homo Sapiens
TSRSIIRNV

SEQ ID NO: 39519 - protein, 9 aa, Homo Sapiens
TTFGSRVNV

SEQ ID NO: 39520 - protein, 9 aa, Homo Sapiens
TTKKIVLRL

SEQ ID NO: 39521 - protein, 9 aa, Homo Sapiens
TTKNLFLIK

SEQ ID NO: 39522 - protein, 9 aa, Homo Sapiens
TTKNVQQTV

SEQ ID NO: 39523 - protein, 9 aa, Homo Sapiens
TTKPVNWLK

SEQ ID NO: 39524 - protein, 9 aa, Homo Sapiens
TTRNTSPSL

SEQ ID NO: 39525 - protein, 9 aa, Homo Sapiens
TVKKPGPNL

SEQ ID NO: 39526 - protein, 9 aa, Homo Sapiens
TVRDPAWQK

SEQ ID NO: 39527 - protein, 9 aa, Homo Sapiens
TYIYFKRLK

SEQ ID NO: 39528 - protein, 9 aa, Homo Sapiens
TYKYEMINK

SEQ ID NO: 39529 - protein, 9 aa, Homo Sapiens
VAPAAASSL

SEQ ID NO: 39530 - protein, 9 aa, Homo Sapiens
VARPAPVAV

SEQ ID NO: 39531 - protein, 9 aa, Homo Sapiens
VARPPPIGA

SEQ ID NO: 39532 - protein, 9 aa, Homo Sapiens
VASRVGSLK

SEQ ID NO: 39533 - protein, 9 aa, Homo Sapiens
VFRGPVLPK

SEQ ID NO: 39534 - protein, 9 aa, Homo Sapiens
VGKSSFINK

SEQ ID NO: 39535 - protein, 9 aa, Homo Sapiens
VIHPPQPPK

SEQ ID NO: 39536 - protein, 9 aa, Homo Sapiens
VIKDKFIRR

SEQ ID NO: 39537 - protein, 9 aa, Homo Sapiens
VILPPRPPK

SEQ ID NO: 39538 - protein, 9 aa, Homo Sapiens
VISPPTVPK

SEQ ID NO: 39539 - protein, 9 aa, Homo Sapiens
VLKIMPVQK

SEQ ID NO: 39540 - protein, 9 aa, Homo Sapiens
VLRGVMINK

SEQ ID NO: 39541 - protein, 9 aa, Homo Sapiens
VQFIGRESK

SEQ ID NO: 39542 - protein, 9 aa, Homo Sapiens
VQFVGREAK

SEQ ID NO: 39543 - protein, 9 aa, Homo Sapiens
VQKAIPMYK

SEQ ID NO: 39544 - protein, 9 aa, Homo Sapiens
VQRNVNIFK

SEQ ID NO: 39545 - protein, 9 aa, Homo Sapiens
VQRNVNVFK

SEQ ID NO: 39546 - protein, 9 aa, Homo Sapiens
VQRTQAPAV

SEQ ID NO: 39547 - protein, 9 aa, Homo Sapiens
VSVAARMLK

SEQ ID NO: 39548 - protein, 9 aa, Homo Sapiens
VTKGLYIAK

SEQ ID NO: 39549 - protein, 9 aa, Homo Sapiens
VTNNVIRLK

SEQ ID NO: 39550 - protein, 9 aa, Homo Sapiens
VTRISSPQV

SEQ ID NO: 39551 - protein, 9 aa, Homo Sapiens
VVKPDQLIK

SEQ ID NO: 39552 - protein, 9 aa, Homo Sapiens
VVKSSFPEK

SEQ ID NO: 39553 - protein, 9 aa, Homo Sapiens
VVLKGRPCK

SEQ ID NO: 39554 - protein, 9 aa, Homo Sapiens
VVRNPIIEK

SEQ ID NO: 39555 - protein, 9 aa, Homo Sapiens
VVVDGRTLK

SEQ ID NO: 39556 - protein, 9 aa, Homo Sapiens
VYKNVILQV

SEQ ID NO: 39557 - protein, 9 aa, Homo Sapiens
VYKPPALKK

SEQ ID NO: 39558 - protein, 9 aa, Homo Sapiens
VYRPPPKVK

SEQ ID NO: 39559 - protein, 9 aa, Homo Sapiens
YARLHPRAV

SEQ ID NO: 39560 - protein, 9 aa, Homo Sapiens
YFRDLFIEK

SEQ ID NO: 39561 - protein, 9 aa, Homo Sapiens
YVKLSVGKK

SEQ ID NO: 39562 - protein, 10 aa, Homo Sapiens
ADGRPAPPMK

SEQ ID NO: 39563 - protein, 10 aa, Homo Sapiens
AFKDIKLWRK

SEQ ID NO: 39564 - protein, 10 aa, Homo Sapiens
AFKELQSTFK

SEQ ID NO: 39565 - protein, 10 aa, Homo Sapiens
AILGTGRLLK

SEQ ID NO: 39566 - protein, 10 aa, Homo Sapiens
ALKNPPINTK

SEQ ID NO: 39567 - protein, 10 aa, Homo Sapiens
ALLGVPHCRK

SEQ ID NO: 39568 - protein, 10 aa, Homo Sapiens
AMYLISKRLK

SEQ ID NO: 39569 - protein, 10 aa, Homo Sapiens
AMYSRKAMYK

SEQ ID NO: 39570 - protein, 10 aa, Homo Sapiens
AQQLVQRVPK

SEQ ID NO: 39571 - protein, 10 aa, Homo Sapiens
ASFDKAKLKK

SEQ ID NO: 39572 - protein, 10 aa, Homo Sapiens
ASKRPPLRGV

SEQ ID NO: 39573 - protein, 10 aa, Homo Sapiens
ASRPFASVNV

SEQ ID NO: 39574 - protein, 10 aa, Homo Sapiens
ASRPPIQNAC

SEQ ID NO: 39575 - protein, 10 aa, Homo Sapiens
ASRPPPPNSV

SEQ ID NO: 39576 - protein, 10 aa, Homo Sapiens
ASSGVPNPPK

SEQ ID NO: 39577 - protein, 10 aa, Homo Sapiens
ATLPKNPPPK

SEQ ID NO: 39578 - protein, 10 aa, Homo Sapiens
ATRATTPCRL

SEQ ID NO: 39579 - protein, 10 aa, Homo Sapiens
ATRIFASNLK

SEQ ID NO: 39580 - protein, 10 aa, Homo Sapiens
ATRRPPPARV

SEQ ID NO: 39581 - protein, 10 aa, Homo Sapiens
AVIFINTRRK

SEQ ID NO: 39582 - protein, 10 aa, Homo Sapiens
AVIKGRPSKL

SEQ ID NO: 39583 - protein, 10 aa, Homo Sapiens
AVLHEERFLK

SEQ ID NO: 39584 - protein, 10 aa, Homo Sapiens
AVQKAIPMYK

SEQ ID NO: 39585 - protein, 10 aa, Homo Sapiens
AVRPHSAPEY

SEQ ID NO: 39586 - protein, 10 aa, Homo Sapiens
AWIDKCRPNL

SEQ ID NO: 39587 - protein, 10 aa, Homo Sapiens
AYKNVKFVLK

SEQ ID NO: 39588 - protein, 10 aa, Homo Sapiens
AYRQGHFTYK

SEQ ID NO: 39589 - protein, 10 aa, Homo Sapiens
AYVDLDRQLK

SEQ ID NO: 39590 - protein, 10 aa, Homo Sapiens
DGSFSVKPLK

SEQ ID NO: 39591 - protein, 10 aa, Homo Sapiens
EVLKVIRTGK

SEQ ID NO: 39592 - protein, 10 aa, Homo Sapiens
GFWDPIGRYK

SEQ ID NO: 39593 - protein, 10 aa, Homo Sapiens
GSTRIPKIQK

SEQ ID NO: 39594 - protein, 10 aa, Homo Sapiens
GSTRIPKVQK

SEQ ID NO: 39595 - protein, 10 aa, Homo Sapiens
GSYVINGRTK

SEQ ID NO: 39596 - protein, 10 aa, Homo Sapiens
GTIKKINILK

SEQ ID NO: 39597 - protein, 10 aa, Homo Sapiens
GTKGPSNVFK

SEQ ID NO: 39598 - protein, 10 aa, Homo Sapiens
GTLKIIDRKK

SEQ ID NO: 39599 - protein, 10 aa, Homo Sapiens
GTRCQFQTKF

SEQ ID NO: 39600 - protein, 10 aa, Homo Sapiens
GTRPPPTPNA

SEQ ID NO: 39601 - protein, 10 aa, Homo Sapiens
GTYHFLRTQK

SEQ ID NO: 39602 - protein, 10 aa, Homo Sapiens
GVLQGIRPGK

SEQ ID NO: 39603 - protein, 10 aa, Homo Sapiens
GVMFGDRPLK

SEQ ID NO: 39604 - protein, 10 aa, Homo Sapiens
GVYSALRALK

SEQ ID NO: 39605 - protein, 10 aa, Homo Sapiens
GYIATPRVWK

SEQ ID NO: 39606 - protein, 10 aa, Homo Sapiens
HFLQQPRPLM

SEQ ID NO: 39607 - protein, 10 aa, Homo Sapiens
HLATRKFLEK

SEQ ID NO: 39608 - protein, 10 aa, Homo Sapiens
HLGDFHRTYK

SEQ ID NO: 39609 - protein, 10 aa, Homo Sapiens
HQFPAKRPRL

SEQ ID NO: 39610 - protein, 10 aa, Homo Sapiens
HSFALLGKKK

SEQ ID NO: 39611 - protein, 10 aa, Homo Sapiens
HSLEASRVPK

SEQ ID NO: 39612 - protein, 10 aa, Homo Sapiens
HTKDLPFRCK

SEQ ID NO: 39613 - protein, 10 aa, Homo Sapiens
HTYLLIVRTK

SEQ ID NO: 39614 - protein, 10 aa, Homo Sapiens
HVVNEPRIFK

SEQ ID NO: 39615 - protein, 10 aa, Homo Sapiens
HYALPLGRKK

SEQ ID NO: 39616 - protein, 10 aa, Homo Sapiens
HYKSNVEIFK

SEQ ID NO: 39617 - protein, 10 aa, Homo Sapiens
HYLPDLQRSK

SEQ ID NO: 39618 - protein, 10 aa, Homo Sapiens
IEITTERPKK

SEQ ID NO: 39619 - protein, 10 aa, Homo Sapiens
IGVSPGRPGK

SEQ ID NO: 39620 - protein, 10 aa, Homo Sapiens
IIYTGEKPCK

SEQ ID NO: 39621 - protein, 10 aa, Homo Sapiens
IMNYIIGKNK

SEQ ID NO: 39622 - protein, 10 aa, Homo Sapiens
ISRYYITRAK

SEQ ID NO: 39623 - protein, 10 aa, Homo Sapiens
ITKPLRPLGK

SEQ ID NO: 39624 - protein, 10 aa, Homo Sapiens
ITQENLGRVK

SEQ ID NO: 39625 - protein, 10 aa, Homo Sapiens
IVLPLKKPPK

SEQ ID NO: 39626 - protein, 10 aa, Homo Sapiens
IVREIENIEK

SEQ ID NO: 39627 - protein, 10 aa, Homo Sapiens
IVRMIESRQK

SEQ ID NO: 39628 - protein, 10 aa, Homo Sapiens
IWKNREPLVK

SEQ ID NO: 39629 - protein, 10 aa, Homo Sapiens
IYKTPPGIQK

SEQ ID NO: 39630 - protein, 10 aa, Homo Sapiens
KAFNQGKIFK

SEQ ID NO: 39631 - protein, 10 aa, Homo Sapiens
KAKEPPFVRK

SEQ ID NO: 39632 - protein, 10 aa, Homo Sapiens
KALSDLGRYK

SEQ ID NO: 39633 - protein, 10 aa, Homo Sapiens
KFIEIAARKK

SEQ ID NO: 39634 - protein, 10 aa, Homo Sapiens
KFKAQVQLNK

SEQ ID NO: 39635 - protein, 10 aa, Homo Sapiens
KFLPFKVVEK

SEQ ID NO: 39636 - protein, 10 aa, Homo Sapiens
KFYGVKFRNK

SEQ ID NO: 39637 - protein, 10 aa, Homo Sapiens
KGKNIKIISK

SEQ ID NO: 39638 - protein, 10 aa, Homo Sapiens
KGKPFRQPCY

SEQ ID NO: 39639 - protein, 10 aa, Homo Sapiens
KGLLIRERLK

SEQ ID NO: 39640 - protein, 10 aa, Homo Sapiens
KGVTLGFRYK

SEQ ID NO: 39641 - protein, 10 aa, Homo Sapiens
KIKEIAVTVK

SEQ ID NO: 39642 - protein, 10 aa, Homo Sapiens
KILDKQKVVK

SEQ ID NO: 39643 - protein, 10 aa, Homo Sapiens
KILQLYARKK

SEQ ID NO: 39644 - protein, 10 aa, Homo Sapiens
KINEIKKLLK

SEQ ID NO: 39645 - protein, 10 aa, Homo Sapiens
KINNEIRSVK

SEQ ID NO: 39646 - protein, 10 aa, Homo Sapiens
KKERQILPVL

SEQ ID NO: 39647 - protein, 10 aa, Homo Sapiens
KKFPGIRPYL

SEQ ID NO: 39648 - protein, 10 aa, Homo Sapiens
KLFPGRPPVK

SEQ ID NO: 39649 - protein, 10 aa, Homo Sapiens
KLFSEKRVEL

SEQ ID NO: 39650 - protein, 10 aa, Homo Sapiens
KLIDVLKRQK

SEQ ID NO: 39651 - protein, 10 aa, Homo Sapiens
KLKEGGLIDK

SEQ ID NO: 39652 - protein, 10 aa, Homo Sapiens
KLLDVVHPAA

SEQ ID NO: 39653 - protein, 10 aa, Homo Sapiens
KLLEIPRPSM

SEQ ID NO: 39654 - protein, 10 aa, Homo Sapiens
KLQTPNTFPK

SEQ ID NO: 39655 - protein, 10 aa, Homo Sapiens
KLTFISGRTK

SEQ ID NO: 39656 - protein, 10 aa, Homo Sapiens
KNYIQIERQK

SEQ ID NO: 39657 - protein, 10 aa, Homo Sapiens
KQIGIIKTNK

SEQ ID NO: 39658 - protein, 10 aa, Homo Sapiens
KQKEVEQLIK

SEQ ID NO: 39659 - protein, 10 aa, Homo Sapiens
KQKFVLKVQK

SEQ ID NO: 39660 - protein, 10 aa, Homo Sapiens
KQLIEKRIGK

SEQ ID NO: 39661 - protein, 10 aa, Homo Sapiens
KQQNPRLVYV

SEQ ID NO: 39662 - protein, 10 aa, Homo Sapiens
KSFSEDRLIK

SEQ ID NO: 39663 - protein, 10 aa, Homo Sapiens
KSILQERVKK

SEQ ID NO: 39664 - protein, 10 aa, Homo Sapiens
KSKAITPKRL

SEQ ID NO: 39665 - protein, 10 aa, Homo Sapiens
KSQIPLSKIK

SEQ ID NO: 39666 - protein, 10 aa, Homo Sapiens
KSRDSFLKRV

SEQ ID NO: 39667 - protein, 10 aa, Homo Sapiens
KSRGPTPPAM

SEQ ID NO: 39668 - protein, 10 aa, Homo Sapiens
KSYSFIARMK

SEQ ID NO: 39669 - protein, 10 aa, Homo Sapiens
KTALRAQVKK

SEQ ID NO: 39670 - protein, 10 aa, Homo Sapiens
KTFEGNLTTK

SEQ ID NO: 39671 - protein, 10 aa, Homo Sapiens
KTFTGHREWV

SEQ ID NO: 39672 - protein, 10 aa, Homo Sapiens
KTIDKKTFYK

SEQ ID NO: 39673 - protein, 10 aa, Homo Sapiens
KTIGVKHPEL

SEQ ID NO: 39674 - protein, 10 aa, Homo Sapiens
KTKDVEILHL

SEQ ID NO: 39675 - protein, 10 aa, Homo Sapiens
KTKFPAEQYY

SEQ ID NO: 39676 - protein, 10 aa, Homo Sapiens
KTKSLNKLLY

SEQ ID NO: 39677 - protein, 10 aa, Homo Sapiens
KTLDKAREKL

SEQ ID NO: 39678 - protein, 10 aa, Homo Sapiens
KTLERSYLLK

SEQ ID NO: 39679 - protein, 10 aa, Homo Sapiens
KTLGVQRPKL

SEQ ID NO: 39680 - protein, 10 aa, Homo Sapiens
KTLPFSRSYY

SEQ ID NO: 39681 - protein, 10 aa, Homo Sapiens
KTRGIFETKF

SEQ ID NO: 39682 - protein, 10 aa, Homo Sapiens
KTRGPGYTQY

SEQ ID NO: 39683 - protein, 10 aa, Homo Sapiens
KTTKLYSRFK

SEQ ID NO: 39684 - protein, 10 aa, Homo Sapiens
KTYEVSLREK

SEQ ID NO: 39685 - protein, 10 aa, Homo Sapiens
KVISGIAREK

SEQ ID NO: 39686 - protein, 10 aa, Homo Sapiens
KVKEPPILRV

SEQ ID NO: 39687 - protein, 10 aa, Homo Sapiens
KVKNFAQLTV

SEQ ID NO: 39688 - protein, 10 aa, Homo Sapiens
KVKPPHGFQK

SEQ ID NO: 39689 - protein, 10 aa, Homo Sapiens
KVKYLPQQQK

SEQ ID NO: 39690 - protein, 10 aa, Homo Sapiens
KVLDAIIQEK

SEQ ID NO: 39691 - protein, 10 aa, Homo Sapiens
KVLEFERVYL

SEQ ID NO: 39692 - protein, 10 aa, Homo Sapiens
KVLELQSPPK

SEQ ID NO: 39693 - protein, 10 aa, Homo Sapiens
KVLGVQRPLL

SEQ ID NO: 39694 - protein, 10 aa, Homo Sapiens
KVPVEKRVFK

SEQ ID NO: 39695 - protein, 10 aa, Homo Sapiens
KVRIQTQPGY

SEQ ID NO: 39696 - protein, 10 aa, Homo Sapiens
KWKDIELEKM

SEQ ID NO: 39697 - protein, 10 aa, Homo Sapiens
KYFSQNRQLK

SEQ ID NO: 39698 - protein, 10 aa, Homo Sapiens
KYIDKTIRVK

SEQ ID NO: 39699 - protein, 10 aa, Homo Sapiens
KYIQDFQREK

SEQ ID NO: 39700 - protein, 10 aa, Homo Sapiens
KYIQELWRKK

SEQ ID NO: 39701 - protein, 10 aa, Homo Sapiens
KYKEAEPLCK

SEQ ID NO: 39702 - protein, 10 aa, Homo Sapiens
KYKEETIEKM

SEQ ID NO: 39703 - protein, 10 aa, Homo Sapiens
KYMAEVKKYK

SEQ ID NO: 39704 - protein, 10 aa, Homo Sapiens
KYVGSRPIKL

SEQ ID NO: 39705 - protein, 10 aa, Homo Sapiens
LGLDIKRQEK

SEQ ID NO: 39706 - protein, 10 aa, Homo Sapiens
LGLDVERVNK

SEQ ID NO: 39707 - protein, 10 aa, Homo Sapiens
LHVQLNRPNK

SEQ ID NO: 39708 - protein, 10 aa, Homo Sapiens
LMNELRRVPK

SEQ ID NO: 39709 - protein, 10 aa, Homo Sapiens
LSLTLMSNLK

SEQ ID NO: 39710 - protein, 10 aa, Homo Sapiens
LSTLSGRPVK

SEQ ID NO: 39711 - protein, 10 aa, Homo Sapiens
LVLPSPRPYV

SEQ ID NO: 39712 - protein, 10 aa, Homo Sapiens
LWKDVGERQK

SEQ ID NO: 39713 - protein, 10 aa, Homo Sapiens
LYKYFPKSEK

SEQ ID NO: 39714 - protein, 10 aa, Homo Sapiens
LYLHLCHKIL

SEQ ID NO: 39715 - protein, 10 aa, Homo Sapiens
LYQQQGRLDK

SEQ ID NO: 39716 - protein, 10 aa, Homo Sapiens
MIRAAPPPLF

SEQ ID NO: 39717 - protein, 10 aa, Homo Sapiens
MVKSLMHLGK

SEQ ID NO: 39718 - protein, 10 aa, Homo Sapiens
MWKQLSHIKK

SEQ ID NO: 39719 - protein, 10 aa, Homo Sapiens
NYIEFTRILK

SEQ ID NO: 39720 - protein, 10 aa, Homo Sapiens
NYLDFHRCQK

SEQ ID NO: 39721 - protein, 10 aa, Homo Sapiens
QFIPYMKKYK

SEQ ID NO: 39722 - protein, 10 aa, Homo Sapiens
QLAFLEGRKK

SEQ ID NO: 39723 - protein, 10 aa, Homo Sapiens
QLLEVKRRMK

SEQ ID NO: 39724 - protein, 10 aa, Homo Sapiens
QQLYWSHPRK

SEQ ID NO: 39725 - protein, 10 aa, Homo Sapiens
QSVQVFGRKK

SEQ ID NO: 39726 - protein, 10 aa, Homo Sapiens
QTIQEIRHLK

SEQ ID NO: 39727 - protein, 10 aa, Homo Sapiens
QVLFLAGKTK

SEQ ID NO: 39728 - protein, 10 aa, Homo Sapiens
QVQKGPLKLK

SEQ ID NO: 39729 - protein, 10 aa, Homo Sapiens
RAAFTAGRMK

SEQ ID NO: 39730 - protein, 10 aa, Homo Sapiens
RAFSFSKTPK

SEQ ID NO: 39731 - protein, 10 aa, Homo Sapiens
RAFYSWGRRK

SEQ ID NO: 39732 - protein, 10 aa, Homo Sapiens
RAMIIAERQK

SEQ ID NO: 39733 - protein, 10 aa, Homo Sapiens
RFKDELDIMK

SEQ ID NO: 39734 - protein, 10 aa, Homo Sapiens
RFKDVRNPEA

SEQ ID NO: 39735 - protein, 10 aa, Homo Sapiens
RFRDASLVFK

SEQ ID NO: 39736 - protein, 10 aa, Homo Sapiens
RFYDLSSKYY

SEQ ID NO: 39737 - protein, 10 aa, Homo Sapiens
RHLNVPRPYA

SEQ ID NO: 39738 - protein, 10 aa, Homo Sapiens
RIFQGTRIVK

SEQ ID NO: 39739 - protein, 10 aa, Homo Sapiens
RIHPEGPPLK

SEQ ID NO: 39740 - protein, 10 aa, Homo Sapiens
RIKFPDNPEK

SEQ ID NO: 39741 - protein, 10 aa, Homo Sapiens
RIKSNQISKL

SEQ ID NO: 39742 - protein, 10 aa, Homo Sapiens
RIKYVGAIEK

SEQ ID NO: 39743 - protein, 10 aa, Homo Sapiens
RINFYKKTYK

SEQ ID NO: 39744 - protein, 10 aa, Homo Sapiens
RIREPALLSK

SEQ ID NO: 39745 - protein, 10 aa, Homo Sapiens
RLFDTPHTPK

SEQ ID NO: 39746 - protein, 10 aa, Homo Sapiens
RLFPGFRPAV

SEQ ID NO: 39747 - protein, 10 aa, Homo Sapiens
RLFTSEKMVK

SEQ ID NO: 39748 - protein, 10 aa, Homo Sapiens
RLGPPKRPPR

SEQ ID NO: 39749 - protein, 10 aa, Homo Sapiens
RLIQIAARKK

SEQ ID NO: 39750 - protein, 10 aa, Homo Sapiens
RLKGDAWVYK

SEQ ID NO: 39751 - protein, 10 aa, Homo Sapiens
RLKPFYLVPK

SEQ ID NO: 39752 - protein, 10 aa, Homo Sapiens
RLKQIEEQTK

SEQ ID NO: 39753 - protein, 10 aa, Homo Sapiens
RLKQQTIPLK

SEQ ID NO: 39754 - protein, 10 aa, Homo Sapiens
RLKYPPFAKK

SEQ ID NO: 39755 - protein, 10 aa, Homo Sapiens
RLLGRSRPQL

SEQ ID NO: 39756 - protein, 10 aa, Homo Sapiens
RLLHHKRIYK

SEQ ID NO: 39757 - protein, 10 aa, Homo Sapiens
RLQEKRFIQK

SEQ ID NO: 39758 - protein, 10 aa, Homo Sapiens
RLQELLERRK

SEQ ID NO: 39759 - protein, 10 aa, Homo Sapiens
RLQGVERIMK

SEQ ID NO: 39760 - protein, 10 aa, Homo Sapiens
RLRAEPPNKL

SEQ ID NO: 39761 - protein, 10 aa, Homo Sapiens
RLYFGERNVK

SEQ ID NO: 39762 - protein, 10 aa, Homo Sapiens
RMFLSFPTTK

SEQ ID NO: 39763 - protein, 10 aa, Homo Sapiens
RMKDPTFLGK

SEQ ID NO: 39764 - protein, 10 aa, Homo Sapiens
RNLDIERPTY

SEQ ID NO: 39765 - protein, 10 aa, Homo Sapiens
RQFFDERWSK

SEQ ID NO: 39766 - protein, 10 aa, Homo Sapiens
RQFGPYRLNY

SEQ ID NO: 39767 - protein, 10 aa, Homo Sapiens
RQIEIPKVSK

SEQ ID NO: 39768 - protein, 10 aa, Homo Sapiens
RSHYFEGVLK

SEQ ID NO: 39769 - protein, 10 aa, Homo Sapiens
RSIFIKYKSK

SEQ ID NO: 39770 - protein, 10 aa, Homo Sapiens
RSLFLLGKHK

SEQ ID NO: 39771 - protein, 10 aa, Homo Sapiens
RSRDFLVVNK

SEQ ID NO: 39772 - protein, 10 aa, Homo Sapiens
RSRDFSAMTK

SEQ ID NO: 39773 - protein, 10 aa, Homo Sapiens
RSRENFLSKL

SEQ ID NO: 39774 - protein, 10 aa, Homo Sapiens
RSRSEYLNRL

SEQ ID NO: 39775 - protein, 10 aa, Homo Sapiens
RSRSLPQPKL

SEQ ID NO: 39776 - protein, 10 aa, Homo Sapiens
RSSALLARTK

SEQ ID NO: 39777 - protein, 10 aa, Homo Sapiens
RTHTGERPYY

SEQ ID NO: 39778 - protein, 10 aa, Homo Sapiens
RTKELGYTVK

SEQ ID NO: 39779 - protein, 10 aa, Homo Sapiens
RTKNFIFRTK

SEQ ID NO: 39780 - protein, 10 aa, Homo Sapiens
RTKRDWLVKQ

SEQ ID NO: 39781 - protein, 10 aa, Homo Sapiens
RTKYIDDTVK

SEQ ID NO: 39782 - protein, 10 aa, Homo Sapiens
RTKYTITPVK

SEQ ID NO: 39783 - protein, 10 aa, Homo Sapiens
RTLDAKMPRK

SEQ ID NO: 39784 - protein, 10 aa, Homo Sapiens
RTLEFNRRQK

SEQ ID NO: 39785 - protein, 10 aa, Homo Sapiens
RTLGAIVRQK

SEQ ID NO: 39786 - protein, 10 aa, Homo Sapiens
RTPSFLKKNK

SEQ ID NO: 39787 - protein, 10 aa, Homo Sapiens
RTPSFLKKSK

SEQ ID NO: 39788 - protein, 10 aa, Homo Sapiens
RTQSIFTRHK

SEQ ID NO: 39789 - protein, 10 aa, Homo Sapiens
RTRSAIILHL

SEQ ID NO: 39790 - protein, 10 aa, Homo Sapiens
RTVDLPKSPK

SEQ ID NO: 39791 - protein, 10 aa, Homo Sapiens
RTVTGAKPLK

SEQ ID NO: 39792 - protein, 10 aa, Homo Sapiens
RVFSILKKHK

SEQ ID NO: 39793 - protein, 10 aa, Homo Sapiens
RVFTGQAKVK

SEQ ID NO: 39794 - protein, 10 aa, Homo Sapiens
RVKEKIIKKF

SEQ ID NO: 39795 - protein, 10 aa, Homo Sapiens
RVKEPVKELL

SEQ ID NO: 39796 - protein, 10 aa, Homo Sapiens
RVKEVEEMCK

SEQ ID NO: 39797 - protein, 10 aa, Homo Sapiens
RVKGPGISKF

SEQ ID NO: 39798 - protein, 10 aa, Homo Sapiens
RVKTNLPIFK

SEQ ID NO: 39799 - protein, 10 aa, Homo Sapiens
RVREITENLM

SEQ ID NO: 39800 - protein, 10 aa, Homo Sapiens
RVVLVEKRTK

SEQ ID NO: 39801 - protein, 10 aa, Homo Sapiens
RVWDAEHPGL

SEQ ID NO: 39802 - protein, 10 aa, Homo Sapiens
RVYPESIPRK

SEQ ID NO: 39803 - protein, 10 aa, Homo Sapiens
RWKALIEMEK

SEQ ID NO: 39804 - protein, 10 aa, Homo Sapiens
RWKPASQPTI

SEQ ID NO: 39805 - protein, 10 aa, Homo Sapiens
RWLVIDRKVY

SEQ ID NO: 39806 - protein, 10 aa, Homo Sapiens
RWVELEKPLK

SEQ ID NO: 39807 - protein, 10 aa, Homo Sapiens
RYFALVERRL

SEQ ID NO: 39808 - protein, 10 aa, Homo Sapiens
RYLGSRPVKL

SEQ ID NO: 39809 - protein, 10 aa, Homo Sapiens
RYLYYTGRIK

SEQ ID NO: 39810 - protein, 10 aa, Homo Sapiens
RYQTLYARFK

SEQ ID NO: 39811 - protein, 10 aa, Homo Sapiens
RYRLPLRVVK

SEQ ID NO: 39812 - protein, 10 aa, Homo Sapiens
RYRPGTVALR

SEQ ID NO: 39813 - protein, 10 aa, Homo Sapiens
RYTDVSTRYK

SEQ ID NO: 39814 - protein, 10 aa, Homo Sapiens
RYYNKYINVK

SEQ ID NO: 39815 - protein, 10 aa, Homo Sapiens
SFLDISRPKM

SEQ ID NO: 39816 - protein, 10 aa, Homo Sapiens
SFRYNGLIHR

SEQ ID NO: 39817 - protein, 10 aa, Homo Sapiens
SGLDVIRIRK

SEQ ID NO: 39818 - protein, 10 aa, Homo Sapiens
SIFDGRVVAK

SEQ ID NO: 39819 - protein, 10 aa, Homo Sapiens
SIKIKTDSAK

SEQ ID NO: 39820 - protein, 10 aa, Homo Sapiens
SIPEKNRPLK

SEQ ID NO: 39821 - protein, 10 aa, Homo Sapiens
SQIQEQRIMK

SEQ ID NO: 39822 - protein, 10 aa, Homo Sapiens
SSHLPPPPKL

SEQ ID NO: 39823 - protein, 10 aa, Homo Sapiens
SSPLVGRPAK

SEQ ID NO: 39824 - protein, 10 aa, Homo Sapiens
SSRPTSPEKF

SEQ ID NO: 39825 - protein, 10 aa, Homo Sapiens
SSTNPFRPQK

SEQ ID NO: 39826 - protein, 10 aa, Homo Sapiens
STFSGGRIPK

SEQ ID NO: 39827 - protein, 10 aa, Homo Sapiens
STKKFWIQKL

SEQ ID NO: 39828 - protein, 10 aa, Homo Sapiens
STLTNPRQSP

SEQ ID NO: 39829 - protein, 10 aa, Homo Sapiens
STRFITRPAK

SEQ ID NO: 39830 - protein, 10 aa, Homo Sapiens
STRIPKIQKL

SEQ ID NO: 39831 - protein, 10 aa, Homo Sapiens
STRPVYLKKL

SEQ ID NO: 39832 - protein, 10 aa, Homo Sapiens
STSFLEKKVK

SEQ ID NO: 39833 - protein, 10 aa, Homo Sapiens
SVASLVGRSK

SEQ ID NO: 39834 - protein, 10 aa, Homo Sapiens
SVFAEERNLK

SEQ ID NO: 39835 - protein, 10 aa, Homo Sapiens
SVFDFQKAYK

SEQ ID NO: 39836 - protein, 10 aa, Homo Sapiens
SVFVIVNKEK

SEQ ID NO: 39837 - protein, 10 aa, Homo Sapiens
SVKNFQIVHK

SEQ ID NO: 39838 - protein, 10 aa, Homo Sapiens
SVKSITNPRY

SEQ ID NO: 39839 - protein, 10 aa, Homo Sapiens
SVLNLVIVKK

SEQ ID NO: 39840 - protein, 10 aa, Homo Sapiens
SVLPTIRVPK

SEQ ID NO: 39841 - protein, 10 aa, Homo Sapiens
SVRLPPITKF

SEQ ID NO: 39842 - protein, 10 aa, Homo Sapiens
SVRPPKKSWK

SEQ ID NO: 39843 - protein, 10 aa, Homo Sapiens
SWLDVRHIEK

SEQ ID NO: 39844 - protein, 10 aa, Homo Sapiens
SYINLNPRLK

SEQ ID NO: 39845 - protein, 10 aa, Homo Sapiens
TILLPKRPPK

SEQ ID NO: 39846 - protein, 10 aa, Homo Sapiens
TIQSGEQPYK

SEQ ID NO: 39847 - protein, 10 aa, Homo Sapiens
TTKAVVSPPK

SEQ ID NO: 39848 - protein, 10 aa, Homo Sapiens
TTSAIQNRFK

SEQ ID NO: 39849 - protein, 10 aa, Homo Sapiens
TTSYLIGRQK

SEQ ID NO: 39850 - protein, 10 aa, Homo Sapiens
TTVPRRLGPK

SEQ ID NO: 39851 - protein, 10 aa, Homo Sapiens
TVFPKAKQVK

SEQ ID NO: 39852 - protein, 10 aa, Homo Sapiens
TYLEAHRIVK

SEQ ID NO: 39853 - protein, 10 aa, Homo Sapiens
VTHRPPLSPK

SEQ ID NO: 39854 - protein, 10 aa, Homo Sapiens
VVLKGRPCKI

SEQ ID NO: 39855 - protein, 10 aa, Homo Sapiens
VVSSVTTKVK

SEQ ID NO: 39856 - protein, 10 aa, Homo Sapiens
VYVKNFGRRK

SEQ ID NO: 39857 - protein, 10 aa, Homo Sapiens
YAKDIGFIKK

SEQ ID NO: 39858 - protein, 10 aa, Homo Sapiens
YILTHKRILK

SEQ ID NO: 39859 - protein, 10 aa, Homo Sapiens
YIYDGELVSK

SEQ ID NO: 39860 - protein, 10 aa, Homo Sapiens
YTKDAMPINK

SEQ ID NO: 39861 - protein, 11 aa, Homo Sapiens
AFQQKPPPPPK

SEQ ID NO: 39862 - protein, 11 aa, Homo Sapiens
AQICSSIRTHK

SEQ ID NO: 39863 - protein, 11 aa, Homo Sapiens
AQNGQLFGRFK

SEQ ID NO: 39864 - protein, 11 aa, Homo Sapiens
ASDPNVSKKLK

SEQ ID NO: 39865 - protein, 11 aa, Homo Sapiens
ASKTTTTIIPK

SEQ ID NO: 39866 - protein, 11 aa, Homo Sapiens
ASNPLLLKRRK

SEQ ID NO: 39867 - protein, 11 aa, Homo Sapiens
ATKDAGTIAGL

SEQ ID NO: 39868 - protein, 11 aa, Homo Sapiens
ATLEETLVKKK

SEQ ID NO: 39869 - protein, 11 aa, Homo Sapiens
ATLKDITRRLK

SEQ ID NO: 39870 - protein, 11 aa, Homo Sapiens
ATNPSFDGRLK

SEQ ID NO: 39871 - protein, 11 aa, Homo Sapiens
ATRTQNVLGEK

SEQ ID NO: 39872 - protein, 11 aa, Homo Sapiens
ATSPDFDGKLK

SEQ ID NO: 39873 - protein, 11 aa, Homo Sapiens
AVHEAWAGMLK

SEQ ID NO: 39874 - protein, 11 aa, Homo Sapiens
AVIKGRPSKLR

SEQ ID NO: 39875 - protein, 11 aa, Homo Sapiens
AVKNGDYITVK

SEQ ID NO: 39876 - protein, 11 aa, Homo Sapiens
AVKSESQSLPK

SEQ ID NO: 39877 - protein, 11 aa, Homo Sapiens
AVNLLDRFLSK

SEQ ID NO: 39878 - protein, 11 aa, Homo Sapiens
AYKDKDISFFK

SEQ ID NO: 39879 - protein, 11 aa, Homo Sapiens
AYKSILQERVK

SEQ ID NO: 39880 - protein, 11 aa, Homo Sapiens
EGSYLAHTQGK

SEQ ID NO: 39881 - protein, 11 aa, Homo Sapiens
FSIPEKNRPLK

SEQ ID NO: 39882 - protein, 11 aa, Homo Sapiens
GGSTRIPKIQK

SEQ ID NO: 39883 - protein, 11 aa, Homo Sapiens
GHYADSYLKRK

SEQ ID NO: 39884 - protein, 11 aa, Homo Sapiens
HLKDAQIFIQK

SEQ ID NO: 39885 - protein, 11 aa, Homo Sapiens
HQQLYWSHPRK

SEQ ID NO: 39886 - protein, 11 aa, Homo Sapiens
HTFEQIPSRQK

SEQ ID NO: 39887 - protein, 11 aa, Homo Sapiens
HYLPAEILQKK

SEQ ID NO: 39888 - protein, 11 aa, Homo Sapiens
IGKPAHLIVSL

SEQ ID NO: 39889 - protein, 11 aa, Homo Sapiens
IQKPADLARHL

SEQ ID NO: 39890 - protein, 11 aa, Homo Sapiens
ITKGVDYIHSK

SEQ ID NO: 39891 - protein, 11 aa, Homo Sapiens
IVKDASIIHRL

SEQ ID NO: 39892 - protein, 11 aa, Homo Sapiens
IVKQDSLVINL

SEQ ID NO: 39893 - protein, 11 aa, Homo Sapiens
KFLNILEKPKK

SEQ ID NO: 39894 - protein, 11 aa, Homo Sapiens
KGFESPRPYKL

SEQ ID NO: 39895 - protein, 11 aa, Homo Sapiens
KGLEGERPARL

SEQ ID NO: 39896 - protein, 11 aa, Homo Sapiens
KIIDRKKHIFK

SEQ ID NO: 39897 - protein, 11 aa, Homo Sapiens
KIKEAADIIQK

SEQ ID NO: 39898 - protein, 11 aa, Homo Sapiens
KIKEIAVTVKK

SEQ ID NO: 39899 - protein, 11 aa, Homo Sapiens
KIKELDHNISK

SEQ ID NO: 39900 - protein, 11 aa, Homo Sapiens
KILERDQQICK

SEQ ID NO: 39901 - protein, 11 aa, Homo Sapiens
KLKDDEVAQLK

SEQ ID NO: 39902 - protein, 11 aa, Homo Sapiens
KLKFIDPKKIK

SEQ ID NO: 39903 - protein, 11 aa, Homo Sapiens
KLKGDDLQAIK

SEQ ID NO: 39904 - protein, 11 aa, Homo Sapiens
KLKPEGLHQLL

SEQ ID NO: 39905 - protein, 11 aa, Homo Sapiens
KQKEVEQLIKK

SEQ ID NO: 39906 - protein, 11 aa, Homo Sapiens
KQLGEGLRPAL

SEQ ID NO: 39907 - protein, 11 aa, Homo Sapiens
KSFLTVPQRKK

SEQ ID NO: 39908 - protein, 11 aa, Homo Sapiens
KSKSMDAIRSL

SEQ ID NO: 39909 - protein, 11 aa, Homo Sapiens
KSLPAEINRMK

SEQ ID NO: 39910 - protein, 11 aa, Homo Sapiens
KSRPAHLAVFL

SEQ ID NO: 39911 - protein, 11 aa, Homo Sapiens
KSRVSPPFKQA

SEQ ID NO: 39912 - protein, 11 aa, Homo Sapiens
KTAVAPIERVK

SEQ ID NO: 39913 - protein, 11 aa, Homo Sapiens
KTFANRVNNLK

SEQ ID NO: 39914 - protein, 11 aa, Homo Sapiens
KTIDMELVKRK

SEQ ID NO: 39915 - protein, 11 aa, Homo Sapiens
KTKDRDYIDFL

SEQ ID NO: 39916 - protein, 11 aa, Homo Sapiens
KTKGPENIICS

SEQ ID NO: 39917 - protein, 11 aa, Homo Sapiens
KTKHEEILQNL

SEQ ID NO: 39918 - protein, 11 aa, Homo Sapiens
KTKQQIEEQRV

SEQ ID NO: 39919 - protein, 11 aa, Homo Sapiens
KTLAYRGFIFK

SEQ ID NO: 39920 - protein, 11 aa, Homo Sapiens
KTLDEILQEKK

SEQ ID NO: 39921 - protein, 11 aa, Homo Sapiens
KTLDQAKAVLK

SEQ ID NO: 39922 - protein, 11 aa, Homo Sapiens
KTLEGVITRTK

SEQ ID NO: 39923 - protein, 11 aa, Homo Sapiens
KTLLHTLCKLK

SEQ ID NO: 39924 - protein, 11 aa, Homo Sapiens
KTLPKIVGRTK

SEQ ID NO: 39925 - protein, 11 aa, Homo Sapiens
KTMDVSKVKLK

SEQ ID NO: 39926 - protein, 11 aa, Homo Sapiens
KTQEPFSVRNK

SEQ ID NO: 39927 - protein, 11 aa, Homo Sapiens
KTRAPGDHQFY

SEQ ID NO: 39928 - protein, 11 aa, Homo Sapiens
KTRPGLLNSKL

SEQ ID NO: 39929 - protein, 11 aa, Homo Sapiens
KTWTTADFRTK

SEQ ID NO: 39930 - protein, 11 aa, Homo Sapiens
KVFEVHVRPKK

SEQ ID NO: 39931 - protein, 11 aa, Homo Sapiens
KVFHAERIVRK

SEQ ID NO: 39932 - protein, 11 aa, Homo Sapiens
KVKDEYMVAEY

SEQ ID NO: 39933 - protein, 11 aa, Homo Sapiens
KVKDGQLTVGL

SEQ ID NO: 39934 - protein, 11 aa, Homo Sapiens
KVKDILSKVQK

SEQ ID NO: 39935 - protein, 11 aa, Homo Sapiens
KVKSAFLLQNL

SEQ ID NO: 39936 - protein, 11 aa, Homo Sapiens
KVKSLNDITAK

SEQ ID NO: 39937 - protein, 11 aa, Homo Sapiens
KVKTPEMIIQK

SEQ ID NO: 39938 - protein, 11 aa, Homo Sapiens
KVKYLPQQQKK

SEQ ID NO: 39939 - protein, 11 aa, Homo Sapiens
KVLDHKDRVLK

SEQ ID NO: 39940 - protein, 11 aa, Homo Sapiens
KVRKIGELVRY

SEQ ID NO: 39941 - protein, 11 aa, Homo Sapiens
KYKGDSTIREL

SEQ ID NO: 39942 - protein, 11 aa, Homo Sapiens
KYKSGEQILRL

SEQ ID NO: 39943 - protein, 11 aa, Homo Sapiens
KYLDIHERMGK

SEQ ID NO: 39944 - protein, 11 aa, Homo Sapiens
LDKPELGPVIL

SEQ ID NO: 39945 - protein, 11 aa, Homo Sapiens
MDGSFSVKPLK

SEQ ID NO: 39946 - protein, 11 aa, Homo Sapiens
MQMQVEAERRK

SEQ ID NO: 39947 - protein, 11 aa, Homo Sapiens
NLKSVNELIYK

SEQ ID NO: 39948 - protein, 11 aa, Homo Sapiens
NLKSVRELILK

SEQ ID NO: 39949 - protein, 11 aa, Homo Sapiens
PMFIVNTNVPR

SEQ ID NO: 39950 - protein, 11 aa, Homo Sapiens
QFIPKGRPPKL

SEQ ID NO: 39951 - protein, 11 aa, Homo Sapiens
QIIPTEEKPYK

SEQ ID NO: 39952 - protein, 11 aa, Homo Sapiens
QSTFSGGRIPK

SEQ ID NO: 39953 - protein, 11 aa, Homo Sapiens
QVFEKSPLRVK

SEQ ID NO: 39954 - protein, 11 aa, Homo Sapiens
RAKAQALIQNL

SEQ ID NO: 39955 - protein, 11 aa, Homo Sapiens
RAKDMHLVKKL

SEQ ID NO: 39956 - protein, 11 aa, Homo Sapiens
RFKGTESISKV

SEQ ID NO: 39957 - protein, 11 aa, Homo Sapiens
RFRDASLVFKV

SEQ ID NO: 39958 - protein, 11 aa, Homo Sapiens
RIFDLGRKKAK

SEQ ID NO: 39959 - protein, 11 aa, Homo Sapiens
RIIKEVQKRYK

SEQ ID NO: 39960 - protein, 11 aa, Homo Sapiens
RIKEIAQDALK

SEQ ID NO: 39961 - protein, 11 aa, Homo Sapiens
RIKGQEFIRQV

SEQ ID NO: 39962 - protein, 11 aa, Homo Sapiens
RIKRALDLNLK

SEQ ID NO: 39963 - protein, 11 aa, Homo Sapiens
RIRDGDFVVLK

SEQ ID NO: 39964 - protein, 11 aa, Homo Sapiens
RIRKLEKLIKK

SEQ ID NO: 39965 - protein, 11 aa, Homo Sapiens
RIRNISNTVMK

SEQ ID NO: 39966 - protein, 11 aa, Homo Sapiens
RLIDQKWQRKK

SEQ ID NO: 39967 - protein, 11 aa, Homo Sapiens
RLKEAEEERLK

SEQ ID NO: 39968 - protein, 11 aa, Homo Sapiens
RLKEKKLVKEV

SEQ ID NO: 39969 - protein, 11 aa, Homo Sapiens
RLKPTNPAAQK

SEQ ID NO: 39970 - protein, 11 aa, Homo Sapiens
RNKAENLLRGK

SEQ ID NO: 39971 - protein, 11 aa, Homo Sapiens
RQKQQLVERLK

SEQ ID NO: 39972 - protein, 11 aa, Homo Sapiens
RQKSAALIIQK

SEQ ID NO: 39973 - protein, 11 aa, Homo Sapiens
RQKTELQQIGK

SEQ ID NO: 39974 - protein, 11 aa, Homo Sapiens
RQLEEKDRVLK

SEQ ID NO: 39975 - protein, 11 aa, Homo Sapiens
RQQIKELEKLK

SEQ ID NO: 39976 - protein, 11 aa, Homo Sapiens
RQYAKDIGFIK

SEQ ID NO: 39977 - protein, 11 aa, Homo Sapiens
RSKDEKILHIK

SEQ ID NO: 39978 - protein, 11 aa, Homo Sapiens
RSKSYELIRKI

SEQ ID NO: 39979 - protein, 11 aa, Homo Sapiens
RSYPVTEQRVK

SEQ ID NO: 39980 - protein, 11 aa, Homo Sapiens
RTAAPSVRPEK

SEQ ID NO: 39981 - protein, 11 aa, Homo Sapiens
RTFLRPPKVKM

SEQ ID NO: 39982 - protein, 11 aa, Homo Sapiens
RTIAPIIGRTA

SEQ ID NO: 39983 - protein, 11 aa, Homo Sapiens
RTIELDGKKIK

SEQ ID NO: 39984 - protein, 11 aa, Homo Sapiens
RTIELDGKRIK

SEQ ID NO: 39985 - protein, 11 aa, Homo Sapiens
RTKAATIIQKY

SEQ ID NO: 39986 - protein, 11 aa, Homo Sapiens
RTKTEDMVSQL

SEQ ID NO: 39987 - protein, 11 aa, Homo Sapiens
RTLSKDDVNYK

SEQ ID NO: 39988 - protein, 11 aa, Homo Sapiens
RTLYIQGERRL

SEQ ID NO: 39989 - protein, 11 aa, Homo Sapiens
RTMPLLSLHSR

SEQ ID NO: 39990 - protein, 11 aa, Homo Sapiens
RTQMPDPKTFK

SEQ ID NO: 39991 - protein, 11 aa, Homo Sapiens
RTRDYASLPPK

SEQ ID NO: 39992 - protein, 11 aa, Homo Sapiens
RTRELPDGTFY

SEQ ID NO: 39993 - protein, 11 aa, Homo Sapiens
RTRPAANPIQF

SEQ ID NO: 39994 - protein, 11 aa, Homo Sapiens
RVAPRSGLAAK

SEQ ID NO: 39995 - protein, 11 aa, Homo Sapiens
RVKEGSKIRNL

SEQ ID NO: 39996 - protein, 11 aa, Homo Sapiens
RVKPLHYISWL

SEQ ID NO: 39997 - protein, 11 aa, Homo Sapiens
RVKTEALIRYL

SEQ ID NO: 39998 - protein, 11 aa, Homo Sapiens
RVLDALVAREK

SEQ ID NO: 39999 - protein, 11 aa, Homo Sapiens
RVLSKAFSRLK

SEQ ID NO: 40000 - protein, 11 aa, Homo Sapiens
RVQEAVESMVK

SEQ ID NO: 40001 - protein, 11 aa, Homo Sapiens
RVQQHIESKLL

SEQ ID NO: 40002 - protein, 11 aa, Homo Sapiens
RVRDGSKIRNL

SEQ ID NO: 40003 - protein, 11 aa, Homo Sapiens
RVRQPPPRPFL

SEQ ID NO: 40004 - protein, 11 aa, Homo Sapiens
RVWDISGLRKK

SEQ ID NO: 40005 - protein, 11 aa, Homo Sapiens
RVYNTDPLKEK

SEQ ID NO: 40006 - protein, 11 aa, Homo Sapiens
RYAQTQLDKLK

SEQ ID NO: 40007 - protein, 11 aa, Homo Sapiens
RYLDSSVRNSK

SEQ ID NO: 40008 - protein, 11 aa, Homo Sapiens
SFKPGDVIHYV

SEQ ID NO: 40009 - protein, 11 aa, Homo Sapiens
SFKPLENAVFK

SEQ ID NO: 40010 - protein, 11 aa, Homo Sapiens
SFRYNGLIHRK

SEQ ID NO: 40011 - protein, 11 aa, Homo Sapiens
SSNPALALRRK

SEQ ID NO: 40012 - protein, 11 aa, Homo Sapiens
SSSPVNVKKLK

SEQ ID NO: 40013 - protein, 11 aa, Homo Sapiens
SSSTNPFRPQK

SEQ ID NO: 40014 - protein, 11 aa, Homo Sapiens
STIPPELVKQK

SEQ ID NO: 40015 - protein, 11 aa, Homo Sapiens
STKPSSIISTK

SEQ ID NO: 40016 - protein, 11 aa, Homo Sapiens
SVILKPENIKK

SEQ ID NO: 40017 - protein, 11 aa, Homo Sapiens
SVKGPELINMY

SEQ ID NO: 40018 - protein, 11 aa, Homo Sapiens
SVKSVPENLLK

SEQ ID NO: 40019 - protein, 11 aa, Homo Sapiens
SWRDGQKLVKK

SEQ ID NO: 40020 - protein, 11 aa, Homo Sapiens
SYKDSTLIMQL

SEQ ID NO: 40021 - protein, 11 aa, Homo Sapiens
TSKKPNLILNV

SEQ ID NO: 40022 - protein, 11 aa, Homo Sapiens
TYFQAKIRALK

SEQ ID NO: 40023 - protein, 11 aa, Homo Sapiens
VFLPQAIRHLK

SEQ ID NO: 40024 - protein, 11 aa, Homo Sapiens
VLSTLSGRPVK

SEQ ID NO: 40025 - protein, 11 aa, Homo Sapiens
VLVGGSTRIPK

SEQ ID NO: 40026 - protein, 11 aa, Homo Sapiens
VTLTGGFRRGK

SEQ ID NO: 40027 - protein, 11 aa, Homo Sapiens
VTNPDIAAKKK

SEQ ID NO: 40028 - protein, 11 aa, Homo Sapiens
VVKPDQLIKRR

SEQ ID NO: 40029 - protein, 11 aa, Homo Sapiens
VVKSVELMSVY

SEQ ID NO: 40030 - protein, 8 aa, Homo Sapiens
ADYPDYKY

SEQ ID NO: 40031 - protein, 8 aa, Homo Sapiens
APVISAEK

SEQ ID NO: 40032 - protein, 8 aa, Homo Sapiens
EEQLQQIR

SEQ ID NO: 40033 - protein, 8 aa, Homo Sapiens
EGEFSEAR

SEQ ID NO: 40034 - protein, 8 aa, Homo Sapiens
FPHIKHNY

SEQ ID NO: 40035 - protein, 8 aa, Homo Sapiens
GAEVVHRY

SEQ ID NO: 40036 - protein, 8 aa, Homo Sapiens
HIAGILAR

SEQ ID NO: 40037 - protein, 8 aa, Homo Sapiens
HTNLIAFY

SEQ ID NO: 40038 - protein, 8 aa, Homo Sapiens
KSITNPRY

SEQ ID NO: 40039 - protein, 8 aa, Homo Sapiens
KTAAPELQ

SEQ ID NO: 40040 - protein, 8 aa, Homo Sapiens
KVGIVGKY

SEQ ID NO: 40041 - protein, 8 aa, Homo Sapiens
KYFKAGKY

SEQ ID NO: 40042 - protein, 8 aa, Homo Sapiens
LKAAAHHY

SEQ ID NO: 40043 - protein, 8 aa, Homo Sapiens
LSESTHKY

SEQ ID NO: 40044 - protein, 8 aa, Homo Sapiens
NGLPKHSY

SEQ ID NO: 40045 - protein, 8 aa, Homo Sapiens
NPHVNHLY

SEQ ID NO: 40046 - protein, 8 aa, Homo Sapiens
NPRVNHLY

SEQ ID NO: 40047 - protein, 8 aa, Homo Sapiens
QAPKPRKQ

SEQ ID NO: 40048 - protein, 8 aa, Homo Sapiens
QNAVRLHY

SEQ ID NO: 40049 - protein, 8 aa, Homo Sapiens
RVDSKQRY

SEQ ID NO: 40050 - protein, 8 aa, Homo Sapiens
RVQNMALY

SEQ ID NO: 40051 - protein, 8 aa, Homo Sapiens
RVQVVGTY

SEQ ID NO: 40052 - protein, 8 aa, Homo Sapiens
SGLDRSKY

SEQ ID NO: 40053 - protein, 8 aa, Homo Sapiens
SHLPSHHY

SEQ ID NO: 40054 - protein, 8 aa, Homo Sapiens
THTVSVKY

SEQ ID NO: 40055 - protein, 8 aa, Homo Sapiens
VKEKYAKY

SEQ ID NO: 40056 - protein, 8 aa, Homo Sapiens
VQELQNLL

SEQ ID NO: 40057 - protein, 8 aa, Homo Sapiens
VQKAIAHY

SEQ ID NO: 40058 - protein, 8 aa, Homo Sapiens
VSLTACKV

SEQ ID NO: 40059 - protein, 8 aa, Homo Sapiens
VTFVPGLY

SEQ ID NO: 40060 - protein, 8 aa, Homo Sapiens
YPGHGRRY

SEQ ID NO: 40061 - protein, 9 aa, Homo Sapiens
AAAAGLHRY

SEQ ID NO: 40062 - protein, 9 aa, Homo Sapiens
AAHTVTAAY

SEQ ID NO: 40063 - protein, 9 aa, Homo Sapiens
AAKGFGGKY

SEQ ID NO: 40064 - protein, 9 aa, Homo Sapiens
AANPAYGRY

SEQ ID NO: 40065 - protein, 9 aa, Homo Sapiens
AANPISGHY

SEQ ID NO: 40066 - protein, 9 aa, Homo Sapiens
AANPVYGRY

SEQ ID NO: 40067 - protein, 9 aa, Homo Sapiens
AAPAYSRAL

SEQ ID NO: 40068 - protein, 9 aa, Homo Sapiens
AASPVVAEY

SEQ ID NO: 40069 - protein, 9 aa, Homo Sapiens
AFISIVHMY

SEQ ID NO: 40070 - protein, 9 aa, Homo Sapiens
AFKDAVPEY

SEQ ID NO: 40071 - protein, 9 aa, Homo Sapiens
AFLEILHTY

SEQ ID NO: 40072 - protein, 9 aa, Homo Sapiens
AFPHIKHNY

SEQ ID NO: 40073 - protein, 9 aa, Homo Sapiens
AFRALQHSY

SEQ ID NO: 40074 - protein, 9 aa, Homo Sapiens
AFRYLAQYY

SEQ ID NO: 40075 - protein, 9 aa, Homo Sapiens
AFYKISTLY

SEQ ID NO: 40076 - protein, 9 aa, Homo Sapiens
AGAEVVHRY

SEQ ID NO: 40077 - protein, 9 aa, Homo Sapiens
AGHAIITNY

SEQ ID NO: 40078 - protein, 9 aa, Homo Sapiens
AGHQISRDY

SEQ ID NO: 40079 - protein, 9 aa, Homo Sapiens
AGILLKHKY

SEQ ID NO: 40080 - protein, 9 aa, Homo Sapiens
AGKTVCAEY

SEQ ID NO: 40081 - protein, 9 aa, Homo Sapiens
AGKTVVAEY

SEQ ID NO: 40082 - protein, 9 aa, Homo Sapiens
AGKVLAHFY

SEQ ID NO: 40083 - protein, 9 aa, Homo Sapiens
AGNWKFAAY

SEQ ID NO: 40084 - protein, 9 aa, Homo Sapiens
AIANLQRAY

SEQ ID NO: 40085 - protein, 9 aa, Homo Sapiens
AIATLAACY

SEQ ID NO: 40086 - protein, 9 aa, Homo Sapiens
AIGGIARTY

SEQ ID NO: 40087 - protein, 9 aa, Homo Sapiens
AIHDVFSQY

SEQ ID NO: 40088 - protein, 9 aa, Homo Sapiens
AIHPIPGEY

SEQ ID NO: 40089 - protein, 9 aa, Homo Sapiens
AIHPVPGHY

SEQ ID NO: 40090 - protein, 9 aa, Homo Sapiens
AIHSLAHMY

SEQ ID NO: 40091 - protein, 9 aa, Homo Sapiens
AIIQERLRY

SEQ ID NO: 40092 - protein, 9 aa, Homo Sapiens
AIKDFVLKY

SEQ ID NO: 40093 - protein, 9 aa, Homo Sapiens
AIKEQLHKY

SEQ ID NO: 40094 - protein, 9 aa, Homo Sapiens
AILKKYGKY

SEQ ID NO: 40095 - protein, 9 aa, Homo Sapiens
AINASTGNY

SEQ ID NO: 40096 - protein, 9 aa, Homo Sapiens
AIQAVLSLY

SEQ ID NO: 40097 - protein, 9 aa, Homo Sapiens
AIQEVMESY

SEQ ID NO: 40098 - protein, 9 aa, Homo Sapiens
AIQPDAGYY

SEQ ID NO: 40099 - protein, 9 aa, Homo Sapiens
AIQPGSINY

SEQ ID NO: 40100 - protein, 9 aa, Homo Sapiens
AIQQILGKY

SEQ ID NO: 40101 - protein, 9 aa, Homo Sapiens
AIWADPGKY

SEQ ID NO: 40102 - protein, 9 aa, Homo Sapiens
ALAGTFHYY

SEQ ID NO: 40103 - protein, 9 aa, Homo Sapiens
ALAPAGFSY

SEQ ID NO: 40104 - protein, 9 aa, Homo Sapiens
ALCDIKQAY

SEQ ID NO: 40105 - protein, 9 aa, Homo Sapiens
ALGQVLRSY

SEQ ID NO: 40106 - protein, 9 aa, Homo Sapiens
ALNIATHVL

SEQ ID NO: 40107 - protein, 9 aa, Homo Sapiens
ALQDLLSEY

SEQ ID NO: 40108 - protein, 9 aa, Homo Sapiens
ALQDTLALY

SEQ ID NO: 40109 - protein, 9 aa, Homo Sapiens
ALQKLDQEK

SEQ ID NO: 40110 - protein, 9 aa, Homo Sapiens
ALSPVRGCY

SEQ ID NO: 40111 - protein, 9 aa, Homo Sapiens
ALSRIMGKY

SEQ ID NO: 40112 - protein, 9 aa, Homo Sapiens
ALVDIIHGY

SEQ ID NO: 40113 - protein, 9 aa, Homo Sapiens
AMMGSTHIY

SEQ ID NO: 40114 - protein, 9 aa, Homo Sapiens
ANGLPKHSY

SEQ ID NO: 40115 - protein, 9 aa, Homo Sapiens
AQAALSHEY

SEQ ID NO: 40116 - protein, 9 aa, Homo Sapiens
AQAELESRY

SEQ ID NO: 40117 - protein, 9 aa, Homo Sapiens
AQHRIAPGY

SEQ ID NO: 40118 - protein, 9 aa, Homo Sapiens
AQKIDLPEY

SEQ ID NO: 40119 - protein, 9 aa, Homo Sapiens
AQKSISQHY

SEQ ID NO: 40120 - protein, 9 aa, Homo Sapiens
AQLGLGHSY

SEQ ID NO: 40121 - protein, 9 aa, Homo Sapiens
AQNAVRLHY

SEQ ID NO: 40122 - protein, 9 aa, Homo Sapiens
AQNRWLHIY

SEQ ID NO: 40123 - protein, 9 aa, Homo Sapiens
AQQKNLEGY

SEQ ID NO: 40124 - protein, 9 aa, Homo Sapiens
AQQPCYLLY

SEQ ID NO: 40125 - protein, 9 aa, Homo Sapiens
AQQPMLPQY

SEQ ID NO: 40126 - protein, 9 aa, Homo Sapiens
AQQSIREKY

SEQ ID NO: 40127 - protein, 9 aa, Homo Sapiens
AQQVVLSSY

SEQ ID NO: 40128 - protein, 9 aa, Homo Sapiens
AQTEVAKKY

SEQ ID NO: 40129 - protein, 9 aa, Homo Sapiens
ASAIVEYAY

SEQ ID NO: 40130 - protein, 9 aa, Homo Sapiens
ASKSLLNRY

SEQ ID NO: 40131 - protein, 9 aa, Homo Sapiens
ASNPAMLLY

SEQ ID NO: 40132 - protein, 9 aa, Homo Sapiens
ASNPRQAAY

SEQ ID NO: 40133 - protein, 9 aa, Homo Sapiens
ASQALIEAY

SEQ ID NO: 40134 - protein, 9 aa, Homo Sapiens
ASQLKLDHY

SEQ ID NO: 40135 - protein, 9 aa, Homo Sapiens
ASYAVQAKY

SEQ ID NO: 40136 - protein, 9 aa, Homo Sapiens
ASYAVQSKY

SEQ ID NO: 40137 - protein, 9 aa, Homo Sapiens
ASYSLIRKY

SEQ ID NO: 40138 - protein, 9 aa, Homo Sapiens
ATFPVAPRY

SEQ ID NO: 40139 - protein, 9 aa, Homo Sapiens
ATFSSSHRY

SEQ ID NO: 40140 - protein, 9 aa, Homo Sapiens
ATILTDHQY

SEQ ID NO: 40141 - protein, 9 aa, Homo Sapiens
ATQERTDLY

SEQ ID NO: 40142 - protein, 9 aa, Homo Sapiens
ATQVFREQY

SEQ ID NO: 40143 - protein, 9 aa, Homo Sapiens
ATSIPNFSY

SEQ ID NO: 40144 - protein, 9 aa, Homo Sapiens
ATSKSLHSY

SEQ ID NO: 40145 - protein, 9 aa, Homo Sapiens
ATSSVGRVY

SEQ ID NO: 40146 - protein, 9 aa, Homo Sapiens
ATSTIKRMY

SEQ ID NO: 40147 - protein, 9 aa, Homo Sapiens
ATTVIPRVY

SEQ ID NO: 40148 - protein, 9 aa, Homo Sapiens
ATVTISHRY

SEQ ID NO: 40149 - protein, 9 aa, Homo Sapiens
AVAPFFKSY

SEQ ID NO: 40150 - protein, 9 aa, Homo Sapiens
AVASVPIMY

SEQ ID NO: 40151 - protein, 9 aa, Homo Sapiens
AVDLMTHNY

SEQ ID NO: 40152 - protein, 9 aa, Homo Sapiens
AVGEGFHNY

SEQ ID NO: 40153 - protein, 9 aa, Homo Sapiens
AVGFPTHLY

SEQ ID NO: 40154 - protein, 9 aa, Homo Sapiens
AVHDITVAY

SEQ ID NO: 40155 - protein, 9 aa, Homo Sapiens
AVHLVDSHY

SEQ ID NO: 40156 - protein, 9 aa, Homo Sapiens
AVIAFRSSY

SEQ ID NO: 40157 - protein, 9 aa, Homo Sapiens
AVIEDTWHY

SEQ ID NO: 40158 - protein, 9 aa, Homo Sapiens
AVIKSNHSY

SEQ ID NO: 40159 - protein, 9 aa, Homo Sapiens
AVISSVAHY

SEQ ID NO: 40160 - protein, 9 aa, Homo Sapiens
AVKEKYAKY

SEQ ID NO: 40161 - protein, 9 aa, Homo Sapiens
AVKYDYHKY

SEQ ID NO: 40162 - protein, 9 aa, Homo Sapiens
AVLGKGHQY

SEQ ID NO: 40163 - protein, 9 aa, Homo Sapiens
AVNKVIKSY

SEQ ID NO: 40164 - protein, 9 aa, Homo Sapiens
AVNMVPFPR

SEQ ID NO: 40165 - protein, 9 aa, Homo Sapiens
AVNSIAKRY

SEQ ID NO: 40166 - protein, 9 aa, Homo Sapiens
AVNSLISKY

SEQ ID NO: 40167 - protein, 9 aa, Homo Sapiens
AVQAALAKY

SEQ ID NO: 40168 - protein, 9 aa, Homo Sapiens
AVQAKFGDY

SEQ ID NO: 40169 - protein, 9 aa, Homo Sapiens
AVQAKYGDY

SEQ ID NO: 40170 - protein, 9 aa, Homo Sapiens
AVQELLPQY

SEQ ID NO: 40171 - protein, 9 aa, Homo Sapiens
AVQKAIAHY

SEQ ID NO: 40172 - protein, 9 aa, Homo Sapiens
AVQKAIPMY

SEQ ID NO: 40173 - protein, 9 aa, Homo Sapiens
AVQKERYDY

SEQ ID NO: 40174 - protein, 9 aa, Homo Sapiens
AVQSLIRAY

SEQ ID NO: 40175 - protein, 9 aa, Homo Sapiens
AVRPLELAY

SEQ ID NO: 40176 - protein, 9 aa, Homo Sapiens
AVSAVVHEY

SEQ ID NO: 40177 - protein, 9 aa, Homo Sapiens
AVSPAVPVY

SEQ ID NO: 40178 - protein, 9 aa, Homo Sapiens
AVSPLARSY

SEQ ID NO: 40179 - protein, 9 aa, Homo Sapiens
AVTASIHVY

SEQ ID NO: 40180 - protein, 9 aa, Homo Sapiens
AVTHIGRVY

SEQ ID NO: 40181 - protein, 9 aa, Homo Sapiens
AVVSSMPRY

SEQ ID NO: 40182 - protein, 9 aa, Homo Sapiens
AVYPVRSAY

SEQ ID NO: 40183 - protein, 9 aa, Homo Sapiens
AVYTLTSLY

SEQ ID NO: 40184 - protein, 9 aa, Homo Sapiens
AWKGIAHKY

SEQ ID NO: 40185 - protein, 9 aa, Homo Sapiens
AWNTVSRAY

SEQ ID NO: 40186 - protein, 9 aa, Homo Sapiens
AWSPVFRNY

SEQ ID NO: 40187 - protein, 9 aa, Homo Sapiens
AYAHELPKY

SEQ ID NO: 40188 - protein, 9 aa, Homo Sapiens
AYFPYFITY

SEQ ID NO: 40189 - protein, 9 aa, Homo Sapiens
AYHQLFQEY

SEQ ID NO: 40190 - protein, 9 aa, Homo Sapiens
AYKKQFSQY

SEQ ID NO: 40191 - protein, 9 aa, Homo Sapiens
AYLQRIALY

SEQ ID NO: 40192 - protein, 9 aa, Homo Sapiens
AYPEIVAVY

SEQ ID NO: 40193 - protein, 9 aa, Homo Sapiens
AYQELLQHY

SEQ ID NO: 40194 - protein, 9 aa, Homo Sapiens
AYSHIYSSY

SEQ ID NO: 40195 - protein, 9 aa, Homo Sapiens
AYSSIYGSY

SEQ ID NO: 40196 - protein, 9 aa, Homo Sapiens
AYTDKIDRY

SEQ ID NO: 40197 - protein, 9 aa, Homo Sapiens
CVKPDVHVY

SEQ ID NO: 40198 - protein, 9 aa, Homo Sapiens
EGEFSEARE

SEQ ID NO: 40199 - protein, 9 aa, Homo Sapiens
EMYDIFGKY

SEQ ID NO: 40200 - protein, 9 aa, Homo Sapiens
EQGPSSHYY

SEQ ID NO: 40201 - protein, 9 aa, Homo Sapiens
EVLWPLPAY

SEQ ID NO: 40202 - protein, 9 aa, Homo Sapiens
FQAILDHTY

SEQ ID NO: 40203 - protein, 9 aa, Homo Sapiens
FQVAERALY

SEQ ID NO: 40204 - protein, 9 aa, Homo Sapiens
FSGMSDHRY

SEQ ID NO: 40205 - protein, 9 aa, Homo Sapiens
FTGPGGHSY

SEQ ID NO: 40206 - protein, 9 aa, Homo Sapiens
GFSDVDHTY

SEQ ID NO: 40207 - protein, 9 aa, Homo Sapiens
GGKDFSFRY

SEQ ID NO: 40208 - protein, 9 aa, Homo Sapiens
GGMVEYGKY

SEQ ID NO: 40209 - protein, 9 aa, Homo Sapiens
GGQRVIGHY

SEQ ID NO: 40210 - protein, 9 aa, Homo Sapiens
GIHIIKGEY

SEQ ID NO: 40211 - protein, 9 aa, Homo Sapiens
GLMKGKHYY

SEQ ID NO: 40212 - protein, 9 aa, Homo Sapiens
GLSTAFHHY

SEQ ID NO: 40213 - protein, 9 aa, Homo Sapiens
GLTDSIHRY

SEQ ID NO: 40214 - protein, 9 aa, Homo Sapiens
GMKYIQHTY

SEQ ID NO: 40215 - protein, 9 aa, Homo Sapiens
GMNDPDFGY

SEQ ID NO: 40216 - protein, 9 aa, Homo Sapiens
GQASGGHYY

SEQ ID NO: 40217 - protein, 9 aa, Homo Sapiens
GQKINIHEY

SEQ ID NO: 40218 - protein, 9 aa, Homo Sapiens
GQKPWSQHY

SEQ ID NO: 40219 - protein, 9 aa, Homo Sapiens
GQKRVVNVY

SEQ ID NO: 40220 - protein, 9 aa, Homo Sapiens
GQLGLLARY

SEQ ID NO: 40221 - protein, 9 aa, Homo Sapiens
GQMPHSHQY

SEQ ID NO: 40222 - protein, 9 aa, Homo Sapiens
GQNAQTMAY

SEQ ID NO: 40223 - protein, 9 aa, Homo Sapiens
GQQRCIATY

SEQ ID NO: 40224 - protein, 9 aa, Homo Sapiens
GQQSSYPGY

SEQ ID NO: 40225 - protein, 9 aa, Homo Sapiens
GSAAGGHYY

SEQ ID NO: 40226 - protein, 9 aa, Homo Sapiens
GSAHSMPKY

SEQ ID NO: 40227 - protein, 9 aa, Homo Sapiens
GSFHIRASY

SEQ ID NO: 40228 - protein, 9 aa, Homo Sapiens
GSGFHFHLY

SEQ ID NO: 40229 - protein, 9 aa, Homo Sapiens
GSHFVEATY

SEQ ID NO: 40230 - protein, 9 aa, Homo Sapiens
GSHTIQIMY

SEQ ID NO: 40231 - protein, 9 aa, Homo Sapiens
GSSFIQHYY

SEQ ID NO: 40232 - protein, 9 aa, Homo Sapiens
GSTMVEHNY

SEQ ID NO: 40233 - protein, 9 aa, Homo Sapiens
GTFSKPGGY

SEQ ID NO: 40234 - protein, 9 aa, Homo Sapiens
GTHENPGLY

SEQ ID NO: 40235 - protein, 9 aa, Homo Sapiens
GTHGVIVVY

SEQ ID NO: 40236 - protein, 9 aa, Homo Sapiens
GTHTVSVKY

SEQ ID NO: 40237 - protein, 9 aa, Homo Sapiens
GTLPIGARY

SEQ ID NO: 40238 - protein, 9 aa, Homo Sapiens
GTMYPMSVY

SEQ ID NO: 40239 - protein, 9 aa, Homo Sapiens
GTNHVEYRY

SEQ ID NO: 40240 - protein, 9 aa, Homo Sapiens
GTQFLSAAY

SEQ ID NO: 40241 - protein, 9 aa, Homo Sapiens
GTQPAYPAY

SEQ ID NO: 40242 - protein, 9 aa, Homo Sapiens
GTQRFLERY

SEQ ID NO: 40243 - protein, 9 aa, Homo Sapiens
GTSAGVHVY

SEQ ID NO: 40244 - protein, 9 aa, Homo Sapiens
GTWKHARRY

SEQ ID NO: 40245 - protein, 9 aa, Homo Sapiens
GVHAVMYSY

SEQ ID NO: 40246 - protein, 9 aa, Homo Sapiens
GVHTVSVKY

SEQ ID NO: 40247 - protein, 9 aa, Homo Sapiens
GVNDKMAEY

SEQ ID NO: 40248 - protein, 9 aa, Homo Sapiens
GVYKVHGNY

SEQ ID NO: 40249 - protein, 9 aa, Homo Sapiens
GYYGQSARY

SEQ ID NO: 40250 - protein, 9 aa, Homo Sapiens
HFEETQHTY

SEQ ID NO: 40251 - protein, 9 aa, Homo Sapiens
HGCVTIHRY

SEQ ID NO: 40252 - protein, 9 aa, Homo Sapiens
HGGIPPHKY

SEQ ID NO: 40253 - protein, 9 aa, Homo Sapiens
HGIDPTGTY

SEQ ID NO: 40254 - protein, 9 aa, Homo Sapiens
HIKNPDWRY

SEQ ID NO: 40255 - protein, 9 aa, Homo Sapiens
HIQESRFLY

SEQ ID NO: 40256 - protein, 9 aa, Homo Sapiens
HLIQTTHHY

SEQ ID NO: 40257 - protein, 9 aa, Homo Sapiens
HQGPVPLSY

SEQ ID NO: 40258 - protein, 9 aa, Homo Sapiens
HQITVLHVY

SEQ ID NO: 40259 - protein, 9 aa, Homo Sapiens
HQKKEFVKY

SEQ ID NO: 40260 - protein, 9 aa, Homo Sapiens
HQQPPSQQY

SEQ ID NO: 40261 - protein, 9 aa, Homo Sapiens
HSLLQTKNY

SEQ ID NO: 40262 - protein, 9 aa, Homo Sapiens
HSQGLGGHY

SEQ ID NO: 40263 - protein, 9 aa, Homo Sapiens
HSSAVAATY

SEQ ID NO: 40264 - protein, 9 aa, Homo Sapiens
HSSTVAAHY

SEQ ID NO: 40265 - protein, 9 aa, Homo Sapiens
HSTYPSHQY

SEQ ID NO: 40266 - protein, 9 aa, Homo Sapiens
HTAPNVPHY

SEQ ID NO: 40267 - protein, 9 aa, Homo Sapiens
HTHVELPYY

SEQ ID NO: 40268 - protein, 9 aa, Homo Sapiens
HVGSGDHDY

SEQ ID NO: 40269 - protein, 9 aa, Homo Sapiens
HVIDVKFLY

SEQ ID NO: 40270 - protein, 9 aa, Homo Sapiens
HVSRVRALY

SEQ ID NO: 40271 - protein, 9 aa, Homo Sapiens
HYKTDWHRY

SEQ ID NO: 40272 - protein, 9 aa, Homo Sapiens
HYNNIMALY

SEQ ID NO: 40273 - protein, 9 aa, Homo Sapiens
HYYDSDRRY

SEQ ID NO: 40274 - protein, 9 aa, Homo Sapiens
HYYSITINY

SEQ ID NO: 40275 - protein, 9 aa, Homo Sapiens
IAVKVNHSY

SEQ ID NO: 40276 - protein, 9 aa, Homo Sapiens
IENLGAIQV

SEQ ID NO: 40277 - protein, 9 aa, Homo Sapiens
IFWTLPHEY

SEQ ID NO: 40278 - protein, 9 aa, Homo Sapiens
IGWITGHSY

SEQ ID NO: 40279 - protein, 9 aa, Homo Sapiens
IHHIIKHDY

SEQ ID NO: 40280 - protein, 9 aa, Homo Sapiens
IIAPPERKY

SEQ ID NO: 40281 - protein, 9 aa, Homo Sapiens
IIIDKEYYY

SEQ ID NO: 40282 - protein, 9 aa, Homo Sapiens
IIQSIRMGM

SEQ ID NO: 40283 - protein, 9 aa, Homo Sapiens
ILAKIRWKY

SEQ ID NO: 40284 - protein, 9 aa, Homo Sapiens
ILAQLNAKY

SEQ ID NO: 40285 - protein, 9 aa, Homo Sapiens
ILFSGVHFY

SEQ ID NO: 40286 - protein, 9 aa, Homo Sapiens
ILHSIFSSY

SEQ ID NO: 40287 - protein, 9 aa, Homo Sapiens
ILYNIKQEY

SEQ ID NO: 40288 - protein, 9 aa, Homo Sapiens
IQKQISYNY

SEQ ID NO: 40289 - protein, 9 aa, Homo Sapiens
IQNPDPAVY

SEQ ID NO: 40290 - protein, 9 aa, Homo Sapiens
IQQDTKGDY

SEQ ID NO: 40291 - protein, 9 aa, Homo Sapiens
IQQNLILHY

SEQ ID NO: 40292 - protein, 9 aa, Homo Sapiens
IQSHVIRGY

SEQ ID NO: 40293 - protein, 9 aa, Homo Sapiens
ISKALVAYY

SEQ ID NO: 40294 - protein, 9 aa, Homo Sapiens
ISNPTRHVY

SEQ ID NO: 40295 - protein, 9 aa, Homo Sapiens
ISNTAKHFY

SEQ ID NO: 40296 - protein, 9 aa, Homo Sapiens
ITLEIIHRY

SEQ ID NO: 40297 - protein, 9 aa, Homo Sapiens
ITNKLIGCY

SEQ ID NO: 40298 - protein, 9 aa, Homo Sapiens
IVAAIQHNY

SEQ ID NO: 40299 - protein, 9 aa, Homo Sapiens
IVKDSFLLY

SEQ ID NO: 40300 - protein, 9 aa, Homo Sapiens
IVLSSSHSY

SEQ ID NO: 40301 - protein, 9 aa, Homo Sapiens
KAALLNQHY

SEQ ID NO: 40302 - protein, 9 aa, Homo Sapiens
KAANAFHVY

SEQ ID NO: 40303 - protein, 9 aa, Homo Sapiens
KAASLKSNY

SEQ ID NO: 40304 - protein, 9 aa, Homo Sapiens
KAIAIDSKY

SEQ ID NO: 40305 - protein, 9 aa, Homo Sapiens
KAKDTQGFY

SEQ ID NO: 40306 - protein, 9 aa, Homo Sapiens
KALELKAKY

SEQ ID NO: 40307 - protein, 9 aa, Homo Sapiens
KANDHQGFY

SEQ ID NO: 40308 - protein, 9 aa, Homo Sapiens
KANILTNRY

SEQ ID NO: 40309 - protein, 9 aa, Homo Sapiens
KAPVTKVAA

SEQ ID NO: 40310 - protein, 9 aa, Homo Sapiens
KASGIIHSY

SEQ ID NO: 40311 - protein, 9 aa, Homo Sapiens
KASGTLREY

SEQ ID NO: 40312 - protein, 9 aa, Homo Sapiens
KAVKERYSY

SEQ ID NO: 40313 - protein, 9 aa, Homo Sapiens
KAYPKRPLL

SEQ ID NO: 40314 - protein, 9 aa, Homo Sapiens
KFIAIKNKY

SEQ ID NO: 40315 - protein, 9 aa, Homo Sapiens
KFKEEVNHY

SEQ ID NO: 40316 - protein, 9 aa, Homo Sapiens
KFSENPHVY

SEQ ID NO: 40317 - protein, 9 aa, Homo Sapiens
KFVDFCGKY

SEQ ID NO: 40318 - protein, 9 aa, Homo Sapiens
KFYATLVRY

SEQ ID NO: 40319 - protein, 9 aa, Homo Sapiens
KFYSVNVDY

SEQ ID NO: 40320 - protein, 9 aa, Homo Sapiens
KGHEIFNTY

SEQ ID NO: 40321 - protein, 9 aa, Homo Sapiens
KGHETYSYY

SEQ ID NO: 40322 - protein, 9 aa, Homo Sapiens
KGKGLILHY

SEQ ID NO: 40323 - protein, 9 aa, Homo Sapiens
KGQEILHCY

SEQ ID NO: 40324 - protein, 9 aa, Homo Sapiens
KGQVTTGQY

SEQ ID NO: 40325 - protein, 9 aa, Homo Sapiens
KGSSAVRVY

SEQ ID NO: 40326 - protein, 9 aa, Homo Sapiens
KIADRFLLY

SEQ ID NO: 40327 - protein, 9 aa, Homo Sapiens
KIFALRHGY

SEQ ID NO: 40328 - protein, 9 aa, Homo Sapiens
KIFFENHPY

SEQ ID NO: 40329 - protein, 9 aa, Homo Sapiens
KIFPSVIKY

SEQ ID NO: 40330 - protein, 9 aa, Homo Sapiens
KIFYDRAEY

SEQ ID NO: 40331 - protein, 9 aa, Homo Sapiens
KIHGVQQKY

SEQ ID NO: 40332 - protein, 9 aa, Homo Sapiens
KIHTTMSGY

SEQ ID NO: 40333 - protein, 9 aa, Homo Sapiens
KIHTVDKPY

SEQ ID NO: 40334 - protein, 9 aa, Homo Sapiens
KIHTVERCY

SEQ ID NO: 40335 - protein, 9 aa, Homo Sapiens
KIIRNVGKY

SEQ ID NO: 40336 - protein, 9 aa, Homo Sapiens
KIKDAIGRY

SEQ ID NO: 40337 - protein, 9 aa, Homo Sapiens
KIKSFVKVY

SEQ ID NO: 40338 - protein, 9 aa, Homo Sapiens
KILEVVGRY

SEQ ID NO: 40339 - protein, 9 aa, Homo Sapiens
KINEARENY

SEQ ID NO: 40340 - protein, 9 aa, Homo Sapiens
KINELMPKY

SEQ ID NO: 40341 - protein, 9 aa, Homo Sapiens
KINPRPAKF

SEQ ID NO: 40342 - protein, 9 aa, Homo Sapiens
KIQEVFSSY

SEQ ID NO: 40343 - protein, 9 aa, Homo Sapiens
KIQGIIAEY

SEQ ID NO: 40344 - protein, 9 aa, Homo Sapiens
KIQKFENQY

SEQ ID NO: 40345 - protein, 9 aa, Homo Sapiens
KIQQVQKKY

SEQ ID NO: 40346 - protein, 9 aa, Homo Sapiens
KIQSAFRGY

SEQ ID NO: 40347 - protein, 9 aa, Homo Sapiens
KIREQIKKY

SEQ ID NO: 40348 - protein, 9 aa, Homo Sapiens
KISNIIKQF

SEQ ID NO: 40349 - protein, 9 aa, Homo Sapiens
KISSIHIRY

SEQ ID NO: 40350 - protein, 9 aa, Homo Sapiens
KITDIVNKY

SEQ ID NO: 40351 - protein, 9 aa, Homo Sapiens
KIVDAVIKY

SEQ ID NO: 40352 - protein, 9 aa, Homo Sapiens
KIYPLPHMY

SEQ ID NO: 40353 - protein, 9 aa, Homo Sapiens
KIYPSREEY

SEQ ID NO: 40354 - protein, 9 aa, Homo Sapiens
KKWFSDHRY

SEQ ID NO: 40355 - protein, 9 aa, Homo Sapiens
KLAALCKKY

SEQ ID NO: 40356 - protein, 9 aa, Homo Sapiens
KLAQIRHIY

SEQ ID NO: 40357 - protein, 9 aa, Homo Sapiens
KLEAIKARY

SEQ ID NO: 40358 - protein, 9 aa, Homo Sapiens
KLIDSLHSY

SEQ ID NO: 40359 - protein, 9 aa, Homo Sapiens
KLISINKRY

SEQ ID NO: 40360 - protein, 9 aa, Homo Sapiens
KLKEKFQHY

SEQ ID NO: 40361 - protein, 9 aa, Homo Sapiens
KLKELGTKY

SEQ ID NO: 40362 - protein, 9 aa, Homo Sapiens
KLKEVFSRY

SEQ ID NO: 40363 - protein, 9 aa, Homo Sapiens
KLKGSGLRY

SEQ ID NO: 40364 - protein, 9 aa, Homo Sapiens
KLKKERPDF

SEQ ID NO: 40365 - protein, 9 aa, Homo Sapiens
KLLDATHVY

SEQ ID NO: 40366 - protein, 9 aa, Homo Sapiens
KLLEQRAQY

SEQ ID NO: 40367 - protein, 9 aa, Homo Sapiens
KLLQALAQY

SEQ ID NO: 40368 - protein, 9 aa, Homo Sapiens
KLLQAVAKY

SEQ ID NO: 40369 - protein, 9 aa, Homo Sapiens
KLNDNVSAY

SEQ ID NO: 40370 - protein, 9 aa, Homo Sapiens
KLNPVPGSY

SEQ ID NO: 40371 - protein, 9 aa, Homo Sapiens
KLNSIGNYY

SEQ ID NO: 40372 - protein, 9 aa, Homo Sapiens
KLPDFESRY

SEQ ID NO: 40373 - protein, 9 aa, Homo Sapiens
KLPDIFSVY

SEQ ID NO: 40374 - protein, 9 aa, Homo Sapiens
KLQEALMHY

SEQ ID NO: 40375 - protein, 9 aa, Homo Sapiens
KLQEDRFLY

SEQ ID NO: 40376 - protein, 9 aa, Homo Sapiens
KLQGEVEKY

SEQ ID NO: 40377 - protein, 9 aa, Homo Sapiens
KLQLITHAY

SEQ ID NO: 40378 - protein, 9 aa, Homo Sapiens
KLQSFFSQY

SEQ ID NO: 40379 - protein, 9 aa, Homo Sapiens
KLQSPKHAY

SEQ ID NO: 40380 - protein, 9 aa, Homo Sapiens
KLQVQIQAY

SEQ ID NO: 40381 - protein, 9 aa, Homo Sapiens
KLQVTLKKY

SEQ ID NO: 40382 - protein, 9 aa, Homo Sapiens
KLREIFGLY

SEQ ID NO: 40383 - protein, 9 aa, Homo Sapiens
KLRPEIAVY

SEQ ID NO: 40384 - protein, 9 aa, Homo Sapiens
KLSCSTWNY

SEQ ID NO: 40385 - protein, 9 aa, Homo Sapiens
KLSELLRYY

SEQ ID NO: 40386 - protein, 9 aa, Homo Sapiens
KLTELLRYY

SEQ ID NO: 40387 - protein, 9 aa, Homo Sapiens
KLVSKIAKY

SEQ ID NO: 40388 - protein, 9 aa, Homo Sapiens
KLVTEMGTY

SEQ ID NO: 40389 - protein, 9 aa, Homo Sapiens
KLYDVETKY

SEQ ID NO: 40390 - protein, 9 aa, Homo Sapiens
KLYYDKRWY

SEQ ID NO: 40391 - protein, 9 aa, Homo Sapiens
KMHQSRISY

SEQ ID NO: 40392 - protein, 9 aa, Homo Sapiens
KMIISPGRY

SEQ ID NO: 40393 - protein, 9 aa, Homo Sapiens
KMKEDCFRY

SEQ ID NO: 40394 - protein, 9 aa, Homo Sapiens
KMKEIAEAY

SEQ ID NO: 40395 - protein, 9 aa, Homo Sapiens
KMKELATTY

SEQ ID NO: 40396 - protein, 9 aa, Homo Sapiens
KMKETVSRF

SEQ ID NO: 40397 - protein, 9 aa, Homo Sapiens
KMKGDYFRY

SEQ ID NO: 40398 - protein, 9 aa, Homo Sapiens
KMKGDYHRY

SEQ ID NO: 40399 - protein, 9 aa, Homo Sapiens
KMKGDYYRY

SEQ ID NO: 40400 - protein, 9 aa, Homo Sapiens
KMKTCVDTY

SEQ ID NO: 40401 - protein, 9 aa, Homo Sapiens
KMNTERILY

SEQ ID NO: 40402 - protein, 9 aa, Homo Sapiens
KMPQSMPEY

SEQ ID NO: 40403 - protein, 9 aa, Homo Sapiens
KMWEVQTGY

SEQ ID NO: 40404 - protein, 9 aa, Homo Sapiens
KNFGIWLRY

SEQ ID NO: 40405 - protein, 9 aa, Homo Sapiens
KQCVPFRRY

SEQ ID NO: 40406 - protein, 9 aa, Homo Sapiens
KQFPEVIKY

SEQ ID NO: 40407 - protein, 9 aa, Homo Sapiens
KQIKTIERY

SEQ ID NO: 40408 - protein, 9 aa, Homo Sapiens
KQITADKQY

SEQ ID NO: 40409 - protein, 9 aa, Homo Sapiens
KQIVDRVSY

SEQ ID NO: 40410 - protein, 9 aa, Homo Sapiens
KQKALNAGY

SEQ ID NO: 40411 - protein, 9 aa, Homo Sapiens
KQKEVIEGY

SEQ ID NO: 40412 - protein, 9 aa, Homo Sapiens
KQKNTVVRY

SEQ ID NO: 40413 - protein, 9 aa, Homo Sapiens
KQLRALRKY

SEQ ID NO: 40414 - protein, 9 aa, Homo Sapiens
KQQASHYLY

SEQ ID NO: 40415 - protein, 9 aa, Homo Sapiens
KQQNPRLVY

SEQ ID NO: 40416 - protein, 9 aa, Homo Sapiens
KQQSTLKKY

SEQ ID NO: 40417 - protein, 9 aa, Homo Sapiens
KQSDVMRFL

SEQ ID NO: 40418 - protein, 9 aa, Homo Sapiens
KQSFLTRKY

SEQ ID NO: 40419 - protein, 9 aa, Homo Sapiens
KQSQELSQY

SEQ ID NO: 40420 - protein, 9 aa, Homo Sapiens
KQSQILLVY

SEQ ID NO: 40421 - protein, 9 aa, Homo Sapiens
KQVKYFIHY

SEQ ID NO: 40422 - protein, 9 aa, Homo Sapiens
KSFEDIHHY

SEQ ID NO: 40423 - protein, 9 aa, Homo Sapiens
KSFSDHGFY

SEQ ID NO: 40424 - protein, 9 aa, Homo Sapiens
KSKAIMAKY

SEQ ID NO: 40425 - protein, 9 aa, Homo Sapiens
KSKITHPVY

SEQ ID NO: 40426 - protein, 9 aa, Homo Sapiens
KSLGKRDLY

SEQ ID NO: 40427 - protein, 9 aa, Homo Sapiens
KSLTGTARY

SEQ ID NO: 40428 - protein, 9 aa, Homo Sapiens
KSNPHRDFY

SEQ ID NO: 40429 - protein, 9 aa, Homo Sapiens
KSQLDHGTY

SEQ ID NO: 40430 - protein, 9 aa, Homo Sapiens
KSSDIAKTF

SEQ ID NO: 40431 - protein, 9 aa, Homo Sapiens
KSSDLVGSY

SEQ ID NO: 40432 - protein, 9 aa, Homo Sapiens
KSSDVYVSY

SEQ ID NO: 40433 - protein, 9 aa, Homo Sapiens
KSTDVAKTF

SEQ ID NO: 40434 - protein, 9 aa, Homo Sapiens
KSTFDAHIY

SEQ ID NO: 40435 - protein, 9 aa, Homo Sapiens
KSVYSTHNY

SEQ ID NO: 40436 - protein, 9 aa, Homo Sapiens
KTAIGKAGY

SEQ ID NO: 40437 - protein, 9 aa, Homo Sapiens
KTEGGKVLY

SEQ ID NO: 40438 - protein, 9 aa, Homo Sapiens
KTFDHYCEY

SEQ ID NO: 40439 - protein, 9 aa, Homo Sapiens
KTFPYQHRY

SEQ ID NO: 40440 - protein, 9 aa, Homo Sapiens
KTGFVPSNY

SEQ ID NO: 40441 - protein, 9 aa, Homo Sapiens
KTIDKKTFY

SEQ ID NO: 40442 - protein, 9 aa, Homo Sapiens
KTKEIEQVY

SEQ ID NO: 40443 - protein, 9 aa, Homo Sapiens
KTKMDNLKY

SEQ ID NO: 40444 - protein, 9 aa, Homo Sapiens
KTLDVDATY

SEQ ID NO: 40445 - protein, 9 aa, Homo Sapiens
KTMLLIAHY

SEQ ID NO: 40446 - protein, 9 aa, Homo Sapiens
KTNQLHRMY

SEQ ID NO: 40447 - protein, 9 aa, Homo Sapiens
KTNQVKMKY

SEQ ID NO: 40448 - protein, 9 aa, Homo Sapiens
KTQIPTQRY

SEQ ID NO: 40449 - protein, 9 aa, Homo Sapiens
KTQRAFSKY

SEQ ID NO: 40450 - protein, 9 aa, Homo Sapiens
KTTNVRQTY

SEQ ID NO: 40451 - protein, 9 aa, Homo Sapiens
KVARVKALY

SEQ ID NO: 40452 - protein, 9 aa, Homo Sapiens
KVCNNPGLY

SEQ ID NO: 40453 - protein, 9 aa, Homo Sapiens
KVDAGKLHY

SEQ ID NO: 40454 - protein, 9 aa, Homo Sapiens
KVDKEKWLY

SEQ ID NO: 40455 - protein, 9 aa, Homo Sapiens
KVGEARALY

SEQ ID NO: 40456 - protein, 9 aa, Homo Sapiens
KVGSFLRIY

SEQ ID NO: 40457 - protein, 9 aa, Homo Sapiens
KVHAVIGVL

SEQ ID NO: 40458 - protein, 9 aa, Homo Sapiens
KVHAYIISY

SEQ ID NO: 40459 - protein, 9 aa, Homo Sapiens
KVINNRAKL

SEQ ID NO: 40460 - protein, 9 aa, Homo Sapiens
KVIPCPPFY

SEQ ID NO: 40461 - protein, 9 aa, Homo Sapiens
KVIQSVANY

SEQ ID NO: 40462 - protein, 9 aa, Homo Sapiens
KVKAIANLY

SEQ ID NO: 40463 - protein, 9 aa, Homo Sapiens
KVKDILSKV

SEQ ID NO: 40464 - protein, 9 aa, Homo Sapiens
KVKIPTSKY

SEQ ID NO: 40465 - protein, 9 aa, Homo Sapiens
KVKLAVLKY

SEQ ID NO: 40466 - protein, 9 aa, Homo Sapiens
KVKLLIGAY

SEQ ID NO: 40467 - protein, 9 aa, Homo Sapiens
KVKWFYNEY

SEQ ID NO: 40468 - protein, 9 aa, Homo Sapiens
KVLAQQGEY

SEQ ID NO: 40469 - protein, 9 aa, Homo Sapiens
KVLDIPSKY

SEQ ID NO: 40470 - protein, 9 aa, Homo Sapiens
KVLPGDHEY

SEQ ID NO: 40471 - protein, 9 aa, Homo Sapiens
KVLPQTILY

SEQ ID NO: 40472 - protein, 9 aa, Homo Sapiens
KVLQERENY

SEQ ID NO: 40473 - protein, 9 aa, Homo Sapiens
KVMELHKSY

SEQ ID NO: 40474 - protein, 9 aa, Homo Sapiens
KVMKNYGRY

SEQ ID NO: 40475 - protein, 9 aa, Homo Sapiens
KVNDILELY

SEQ ID NO: 40476 - protein, 9 aa, Homo Sapiens
KVNQELAGY

SEQ ID NO: 40477 - protein, 9 aa, Homo Sapiens
KVNVAKLRY

SEQ ID NO: 40478 - protein, 9 aa, Homo Sapiens
KVPTTLAEY

SEQ ID NO: 40479 - protein, 9 aa, Homo Sapiens
KVQDAFISY

SEQ ID NO: 40480 - protein, 9 aa, Homo Sapiens
KVQGLMKEY

SEQ ID NO: 40481 - protein, 9 aa, Homo Sapiens
KVQYVIQGY

SEQ ID NO: 40482 - protein, 9 aa, Homo Sapiens
KVRCSRYLY

SEQ ID NO: 40483 - protein, 9 aa, Homo Sapiens
KVREEIAEY

SEQ ID NO: 40484 - protein, 9 aa, Homo Sapiens
KVSRVVNTY

SEQ ID NO: 40485 - protein, 9 aa, Homo Sapiens
KVTDAPHFY

SEQ ID NO: 40486 - protein, 9 aa, Homo Sapiens
KVTTFEHQY

SEQ ID NO: 40487 - protein, 9 aa, Homo Sapiens
KVWDTCTTY

SEQ ID NO: 40488 - protein, 9 aa, Homo Sapiens
KVYDLVKAY

SEQ ID NO: 40489 - protein, 9 aa, Homo Sapiens
KVYENYPTY

SEQ ID NO: 40490 - protein, 9 aa, Homo Sapiens
KVYNIQIRY

SEQ ID NO: 40491 - protein, 9 aa, Homo Sapiens
KYFDEHYEY

SEQ ID NO: 40492 - protein, 9 aa, Homo Sapiens
KYIDFTSDY

SEQ ID NO: 40493 - protein, 9 aa, Homo Sapiens
KYIDKTIRV

SEQ ID NO: 40494 - protein, 9 aa, Homo Sapiens
KYIPELAYY

SEQ ID NO: 40495 - protein, 9 aa, Homo Sapiens
KYKDAIHFY

SEQ ID NO: 40496 - protein, 9 aa, Homo Sapiens
KYKERFLVY

SEQ ID NO: 40497 - protein, 9 aa, Homo Sapiens
KYLDVKFEY

SEQ ID NO: 40498 - protein, 9 aa, Homo Sapiens
KYLHPPPHL

SEQ ID NO: 40499 - protein, 9 aa, Homo Sapiens
KYLYGFEEY

SEQ ID NO: 40500 - protein, 9 aa, Homo Sapiens
KYMAEVKKY

SEQ ID NO: 40501 - protein, 9 aa, Homo Sapiens
KYNACILEY

SEQ ID NO: 40502 - protein, 9 aa, Homo Sapiens
KYNKILNKY

SEQ ID NO: 40503 - protein, 9 aa, Homo Sapiens
KYPPVNRKY

SEQ ID NO: 40504 - protein, 9 aa, Homo Sapiens
KYRDAVSRY

SEQ ID NO: 40505 - protein, 9 aa, Homo Sapiens
KYSELIILY

SEQ ID NO: 40506 - protein, 9 aa, Homo Sapiens
KYSNRLYKY

SEQ ID NO: 40507 - protein, 9 aa, Homo Sapiens
KYSVLLPTY

SEQ ID NO: 40508 - protein, 9 aa, Homo Sapiens
KYTDKIMTY

SEQ ID NO: 40509 - protein, 9 aa, Homo Sapiens
KYTKVKCGY

SEQ ID NO: 40510 - protein, 9 aa, Homo Sapiens
KYVKVFHKY

SEQ ID NO: 40511 - protein, 9 aa, Homo Sapiens
KYYDAIACL

SEQ ID NO: 40512 - protein, 9 aa, Homo Sapiens
LAHEVGWKY

SEQ ID NO: 40513 - protein, 9 aa, Homo Sapiens
LAKTGVHHY

SEQ ID NO: 40514 - protein, 9 aa, Homo Sapiens
LILCVPHLY

SEQ ID NO: 40515 - protein, 9 aa, Homo Sapiens
LIQPEIPKY

SEQ ID NO: 40516 - protein, 9 aa, Homo Sapiens
LLNKLIGRY

SEQ ID NO: 40517 - protein, 9 aa, Homo Sapiens
LMHSIVGSY

SEQ ID NO: 40518 - protein, 9 aa, Homo Sapiens
LMNVPLFKY

SEQ ID NO: 40519 - protein, 9 aa, Homo Sapiens
LQHPDVAAY

SEQ ID NO: 40520 - protein, 9 aa, Homo Sapiens
LQHRVQLKY

SEQ ID NO: 40521 - protein, 9 aa, Homo Sapiens
LQIGVIRVY

SEQ ID NO: 40522 - protein, 9 aa, Homo Sapiens
LQKKEIHLY

SEQ ID NO: 40523 - protein, 9 aa, Homo Sapiens
LQKLLPGYY

SEQ ID NO: 40524 - protein, 9 aa, Homo Sapiens
LQKVVLPSY

SEQ ID NO: 40525 - protein, 9 aa, Homo Sapiens
LQSEVIRHY

SEQ ID NO: 40526 - protein, 9 aa, Homo Sapiens
LQTLVLHQY

SEQ ID NO: 40527 - protein, 9 aa, Homo Sapiens
LSGMYDHRY

SEQ ID NO: 40528 - protein, 9 aa, Homo Sapiens
LSHLPSHHY

SEQ ID NO: 40529 - protein, 9 aa, Homo Sapiens
LVANATHIY

SEQ ID NO: 40530 - protein, 9 aa, Homo Sapiens
LVKLVQHTY

SEQ ID NO: 40531 - protein, 9 aa, Homo Sapiens
LVNKRIGLY

SEQ ID NO: 40532 - protein, 9 aa, Homo Sapiens
LVSGTPGAY

SEQ ID NO: 40533 - protein, 9 aa, Homo Sapiens
LVWRPDFAY

SEQ ID NO: 40534 - protein, 9 aa, Homo Sapiens
LWKHIKHKY

SEQ ID NO: 40535 - protein, 9 aa, Homo Sapiens
LYERPPHLY

SEQ ID NO: 40536 - protein, 9 aa, Homo Sapiens
LYSHLVPVY

SEQ ID NO: 40537 - protein, 9 aa, Homo Sapiens
MAWLVDHVY

SEQ ID NO: 40538 - protein, 9 aa, Homo Sapiens
MIAEPAHFY

SEQ ID NO: 40539 - protein, 9 aa, Homo Sapiens
MQQIQKGSY

SEQ ID NO: 40540 - protein, 9 aa, Homo Sapiens
MSTSVTRGY

SEQ ID NO: 40541 - protein, 9 aa, Homo Sapiens
MTHKLLSRY

SEQ ID NO: 40542 - protein, 9 aa, Homo Sapiens
MTHNLLLNY

SEQ ID NO: 40543 - protein, 9 aa, Homo Sapiens
MTNPHNHLY

SEQ ID NO: 40544 - protein, 9 aa, Homo Sapiens
MVVEERCVY

SEQ ID NO: 40545 - protein, 9 aa, Homo Sapiens
NEAIYDICR

SEQ ID NO: 40546 - protein, 9 aa, Homo Sapiens
NISNVSHNY

SEQ ID NO: 40547 - protein, 9 aa, Homo Sapiens
NLFCGLHRY

SEQ ID NO: 40548 - protein, 9 aa, Homo Sapiens
NQHGIILKY

SEQ ID NO: 40549 - protein, 9 aa, Homo Sapiens
NVAVPSHLY

SEQ ID NO: 40550 - protein, 9 aa, Homo Sapiens
PPPPPPHIY

SEQ ID NO: 40551 - protein, 9 aa, Homo Sapiens
PVQPNPIVY

SEQ ID NO: 40552 - protein, 9 aa, Homo Sapiens
QAGWLQHDY

SEQ ID NO: 40553 - protein, 9 aa, Homo Sapiens
QFHPNLDYY

SEQ ID NO: 40554 - protein, 9 aa, Homo Sapiens
QIHRIRHFY

SEQ ID NO: 40555 - protein, 9 aa, Homo Sapiens
QIKDAIGRY

SEQ ID NO: 40556 - protein, 9 aa, Homo Sapiens
QLHTLLGLY

SEQ ID NO: 40557 - protein, 9 aa, Homo Sapiens
QLKGGIHKY

SEQ ID NO: 40558 - protein, 9 aa, Homo Sapiens
QLLKLAHKY

SEQ ID NO: 40559 - protein, 9 aa, Homo Sapiens
QLSRLLHDY

SEQ ID NO: 40560 - protein, 9 aa, Homo Sapiens
QMAIVEHLY

SEQ ID NO: 40561 - protein, 9 aa, Homo Sapiens
QMKNIVHNY

SEQ ID NO: 40562 - protein, 9 aa, Homo Sapiens
QMNSFLSRY

SEQ ID NO: 40563 - protein, 9 aa, Homo Sapiens
QQFPYGASY

SEQ ID NO: 40564 - protein, 9 aa, Homo Sapiens
QQHRVGFQY

SEQ ID NO: 40565 - protein, 9 aa, Homo Sapiens
QQNNVEHKV

SEQ ID NO: 40566 - protein, 9 aa, Homo Sapiens
QQNQYQASY

SEQ ID NO: 40567 - protein, 9 aa, Homo Sapiens
QQQPALVNY

SEQ ID NO: 40568 - protein, 9 aa, Homo Sapiens
QQTNSIRNY

SEQ ID NO: 40569 - protein, 9 aa, Homo Sapiens
QQVLLEHSY

SEQ ID NO: 40570 - protein, 9 aa, Homo Sapiens
QQVPVPHVY

SEQ ID NO: 40571 - protein, 9 aa, Homo Sapiens
QTGIVLHKY

SEQ ID NO: 40572 - protein, 9 aa, Homo Sapiens
QTLRFLGLY

SEQ ID NO: 40573 - protein, 9 aa, Homo Sapiens
QTNLVPYPR

SEQ ID NO: 40574 - protein, 9 aa, Homo Sapiens
QTWLLLHMY

SEQ ID NO: 40575 - protein, 9 aa, Homo Sapiens
QVADIDGQY

SEQ ID NO: 40576 - protein, 9 aa, Homo Sapiens
QVELNAAIV

SEQ ID NO: 40577 - protein, 9 aa, Homo Sapiens
QVHNLLLTY

SEQ ID NO: 40578 - protein, 9 aa, Homo Sapiens
QVQQVAAEY

SEQ ID NO: 40579 - protein, 9 aa, Homo Sapiens
QWKELKATY

SEQ ID NO: 40580 - protein, 9 aa, Homo Sapiens
QWYEIYDKY

SEQ ID NO: 40581 - protein, 9 aa, Homo Sapiens
QYSPFLSQY

SEQ ID NO: 40582 - protein, 9 aa, Homo Sapiens
RAKDFAAKY

SEQ ID NO: 40583 - protein, 9 aa, Homo Sapiens
RALQIIARY

SEQ ID NO: 40584 - protein, 9 aa, Homo Sapiens
RAMKENGRY

SEQ ID NO: 40585 - protein, 9 aa, Homo Sapiens
RANPQLGAY

SEQ ID NO: 40586 - protein, 9 aa, Homo Sapiens
RAQAVLQQY

SEQ ID NO: 40587 - protein, 9 aa, Homo Sapiens
RAQDKVHYY

SEQ ID NO: 40588 - protein, 9 aa, Homo Sapiens
RAQIAGYLY

SEQ ID NO: 40589 - protein, 9 aa, Homo Sapiens
RAQILRIQY

SEQ ID NO: 40590 - protein, 9 aa, Homo Sapiens
RAQMKRELY

SEQ ID NO: 40591 - protein, 9 aa, Homo Sapiens
RAQPRGAVY

SEQ ID NO: 40592 - protein, 9 aa, Homo Sapiens
RAQRKFRPY

SEQ ID NO: 40593 - protein, 9 aa, Homo Sapiens
RAYLVRWEY

SEQ ID NO: 40594 - protein, 9 aa, Homo Sapiens
RDYFGAHTY

SEQ ID NO: 40595 - protein, 9 aa, Homo Sapiens
REKELQHRY

SEQ ID NO: 40596 - protein, 9 aa, Homo Sapiens
RFADSTHRY

SEQ ID NO: 40597 - protein, 9 aa, Homo Sapiens
RFAELAQIY

SEQ ID NO: 40598 - protein, 9 aa, Homo Sapiens
RFCDEIHLY

SEQ ID NO: 40599 - protein, 9 aa, Homo Sapiens
RFHTITTSY

SEQ ID NO: 40600 - protein, 9 aa, Homo Sapiens
RFKEPLPEY

SEQ ID NO: 40601 - protein, 9 aa, Homo Sapiens
RFNGQFKTY

SEQ ID NO: 40602 - protein, 9 aa, Homo Sapiens
RFQFLPHAY

SEQ ID NO: 40603 - protein, 9 aa, Homo Sapiens
RFSINGHFY

SEQ ID NO: 40604 - protein, 9 aa, Homo Sapiens
RFWDIKSKY

SEQ ID NO: 40605 - protein, 9 aa, Homo Sapiens
RFYDLSSKY

SEQ ID NO: 40606 - protein, 9 aa, Homo Sapiens
RFYGKNSSY

SEQ ID NO: 40607 - protein, 9 aa, Homo Sapiens
RFYTDNKKY

SEQ ID NO: 40608 - protein, 9 aa, Homo Sapiens
RGSAVVGQY

SEQ ID NO: 40609 - protein, 9 aa, Homo Sapiens
RGTHMQHAY

SEQ ID NO: 40610 - protein, 9 aa, Homo Sapiens
RGVEFVHVY

SEQ ID NO: 40611 - protein, 9 aa, Homo Sapiens
RHIDCAHVY

SEQ ID NO: 40612 - protein, 9 aa, Homo Sapiens
RHPTVPHLY

SEQ ID NO: 40613 - protein, 9 aa, Homo Sapiens
RIADISQVY

SEQ ID NO: 40614 - protein, 9 aa, Homo Sapiens
RIADRGAEY

SEQ ID NO: 40615 - protein, 9 aa, Homo Sapiens
RIFANAHTY

SEQ ID NO: 40616 - protein, 9 aa, Homo Sapiens
RIHRLARYY

SEQ ID NO: 40617 - protein, 9 aa, Homo Sapiens
RIHSLMEKY

SEQ ID NO: 40618 - protein, 9 aa, Homo Sapiens
RIKDIRMMY

SEQ ID NO: 40619 - protein, 9 aa, Homo Sapiens
RIKDLGQFY

SEQ ID NO: 40620 - protein, 9 aa, Homo Sapiens
RIKFFVSHY

SEQ ID NO: 40621 - protein, 9 aa, Homo Sapiens
RIKPIYNLY

SEQ ID NO: 40622 - protein, 9 aa, Homo Sapiens
RILHNVHLY

SEQ ID NO: 40623 - protein, 9 aa, Homo Sapiens
RILKARLEY

SEQ ID NO: 40624 - protein, 9 aa, Homo Sapiens
RILPHTVLY

SEQ ID NO: 40625 - protein, 9 aa, Homo Sapiens
RILPVAASY

SEQ ID NO: 40626 - protein, 9 aa, Homo Sapiens
RIMGESGKY

SEQ ID NO: 40627 - protein, 9 aa, Homo Sapiens
RIMKKTSLY

SEQ ID NO: 40628 - protein, 9 aa, Homo Sapiens
RIQDQGVRY

SEQ ID NO: 40629 - protein, 9 aa, Homo Sapiens
RIQDVLFLY

SEQ ID NO: 40630 - protein, 9 aa, Homo Sapiens
RIQEKLECY

SEQ ID NO: 40631 - protein, 9 aa, Homo Sapiens
RIQGFQVHY

SEQ ID NO: 40632 - protein, 9 aa, Homo Sapiens
RIQQQTHTY

SEQ ID NO: 40633 - protein, 9 aa, Homo Sapiens
RIREDIAKY

SEQ ID NO: 40634 - protein, 9 aa, Homo Sapiens
RIRKEPPVY

SEQ ID NO: 40635 - protein, 9 aa, Homo Sapiens
RISGVDRYY

SEQ ID NO: 40636 - protein, 9 aa, Homo Sapiens
RITAVRRVY

SEQ ID NO: 40637 - protein, 9 aa, Homo Sapiens
RIVAPPGGR

SEQ ID NO: 40638 - protein, 9 aa, Homo Sapiens
RIYSIGKSY

SEQ ID NO: 40639 - protein, 9 aa, Homo Sapiens
RLAELYHGY

SEQ ID NO: 40640 - protein, 9 aa, Homo Sapiens
RLAQTLRHY

SEQ ID NO: 40641 - protein, 9 aa, Homo Sapiens
RLCDSKGAY

SEQ ID NO: 40642 - protein, 9 aa, Homo Sapiens
RLDDKKFLY

SEQ ID NO: 40643 - protein, 9 aa, Homo Sapiens
RLEADKAKY

SEQ ID NO: 40644 - protein, 9 aa, Homo Sapiens
RLEEAKACY

SEQ ID NO: 40645 - protein, 9 aa, Homo Sapiens
RLFFHCSQY

SEQ ID NO: 40646 - protein, 9 aa, Homo Sapiens
RLFVGARIY

SEQ ID NO: 40647 - protein, 9 aa, Homo Sapiens
RLGKVPHRY

SEQ ID NO: 40648 - protein, 9 aa, Homo Sapiens
RLIGIYKTY

SEQ ID NO: 40649 - protein, 9 aa, Homo Sapiens
RLKDFRDAY

SEQ ID NO: 40650 - protein, 9 aa, Homo Sapiens
RLKNDQANY

SEQ ID NO: 40651 - protein, 9 aa, Homo Sapiens
RLKTMTDTY

SEQ ID NO: 40652 - protein, 9 aa, Homo Sapiens
RLLALNSLY

SEQ ID NO: 40653 - protein, 9 aa, Homo Sapiens
RLNSVVGEY

SEQ ID NO: 40654 - protein, 9 aa, Homo Sapiens
RLPKDKPRY

SEQ ID NO: 40655 - protein, 9 aa, Homo Sapiens
RLPLISGFY

SEQ ID NO: 40656 - protein, 9 aa, Homo Sapiens
RLPLVPSKY

SEQ ID NO: 40657 - protein, 9 aa, Homo Sapiens
RLQDAIAKV

SEQ ID NO: 40658 - protein, 9 aa, Homo Sapiens
RLQDLLLHY

SEQ ID NO: 40659 - protein, 9 aa, Homo Sapiens
RLQDQHMFY

SEQ ID NO: 40660 - protein, 9 aa, Homo Sapiens
RLQEFLTAY

SEQ ID NO: 40661 - protein, 9 aa, Homo Sapiens
RLQEVLNDY

SEQ ID NO: 40662 - protein, 9 aa, Homo Sapiens
RLQKQFAGY

SEQ ID NO: 40663 - protein, 9 aa, Homo Sapiens
RLQLPVWEY

SEQ ID NO: 40664 - protein, 9 aa, Homo Sapiens
RLQPEVQRY

SEQ ID NO: 40665 - protein, 9 aa, Homo Sapiens
RLQPFLQRY

SEQ ID NO: 40666 - protein, 9 aa, Homo Sapiens
RLQTALSLY

SEQ ID NO: 40667 - protein, 9 aa, Homo Sapiens
RLQTLKHQY

SEQ ID NO: 40668 - protein, 9 aa, Homo Sapiens
RLREFWMRY

SEQ ID NO: 40669 - protein, 9 aa, Homo Sapiens
RLSDSFSLY

SEQ ID NO: 40670 - protein, 9 aa, Homo Sapiens
RLTGIPAGY

SEQ ID NO: 40671 - protein, 9 aa, Homo Sapiens
RLWAVAASY

SEQ ID NO: 40672 - protein, 9 aa, Homo Sapiens
RLWISVARY

SEQ ID NO: 40673 - protein, 9 aa, Homo Sapiens
RMCFQPYTY

SEQ ID NO: 40674 - protein, 9 aa, Homo Sapiens
RMHHIQPHY

SEQ ID NO: 40675 - protein, 9 aa, Homo Sapiens
RMIKEKLCY

SEQ ID NO: 40676 - protein, 9 aa, Homo Sapiens
RMNCVLATY

SEQ ID NO: 40677 - protein, 9 aa, Homo Sapiens
RMNSKMQVY

SEQ ID NO: 40678 - protein, 9 aa, Homo Sapiens
RMQEMIARM

SEQ ID NO: 40679 - protein, 9 aa, Homo Sapiens
RMQPRGSFY

SEQ ID NO: 40680 - protein, 9 aa, Homo Sapiens
RMQQQLDEY

SEQ ID NO: 40681 - protein, 9 aa, Homo Sapiens
RMQVDPQKY

SEQ ID NO: 40682 - protein, 9 aa, Homo Sapiens
RMSGMIRLY

SEQ ID NO: 40683 - protein, 9 aa, Homo Sapiens
RNFNQQGLY

SEQ ID NO: 40684 - protein, 9 aa, Homo Sapiens
RNKELIGKY

SEQ ID NO: 40685 - protein, 9 aa, Homo Sapiens
RNTLQLHRY

SEQ ID NO: 40686 - protein, 9 aa, Homo Sapiens
RQAHLTNQY

SEQ ID NO: 40687 - protein, 9 aa, Homo Sapiens
RQALLTQHY

SEQ ID NO: 40688 - protein, 9 aa, Homo Sapiens
RQAVFTAKY

SEQ ID NO: 40689 - protein, 9 aa, Homo Sapiens
RQFDLAWQY

SEQ ID NO: 40690 - protein, 9 aa, Homo Sapiens
RQFEGLQGY

SEQ ID NO: 40691 - protein, 9 aa, Homo Sapiens
RQGFVPAAY

SEQ ID NO: 40692 - protein, 9 aa, Homo Sapiens
RQHEIVLKV

SEQ ID NO: 40693 - protein, 9 aa, Homo Sapiens
RQHLFYGQY

SEQ ID NO: 40694 - protein, 9 aa, Homo Sapiens
RQHRMMILY

SEQ ID NO: 40695 - protein, 9 aa, Homo Sapiens
RQIKHMIKY

SEQ ID NO: 40696 - protein, 9 aa, Homo Sapiens
RQKDNLNNY

SEQ ID NO: 40697 - protein, 9 aa, Homo Sapiens
RQKELESNY

SEQ ID NO: 40698 - protein, 9 aa, Homo Sapiens
RQKKLFCRY

SEQ ID NO: 40699 - protein, 9 aa, Homo Sapiens
RQKLVRNIY

SEQ ID NO: 40700 - protein, 9 aa, Homo Sapiens
RQLAHIYHY

SEQ ID NO: 40701 - protein, 9 aa, Homo Sapiens
RQLGSLSKY

SEQ ID NO: 40702 - protein, 9 aa, Homo Sapiens
RQMTVIRKV

SEQ ID NO: 40703 - protein, 9 aa, Homo Sapiens
RQQKTDMQY

SEQ ID NO: 40704 - protein, 9 aa, Homo Sapiens
RQQSHFAMM

SEQ ID NO: 40705 - protein, 9 aa, Homo Sapiens
RQRGINMRY

SEQ ID NO: 40706 - protein, 9 aa, Homo Sapiens
RQSKVDKLY

SEQ ID NO: 40707 - protein, 9 aa, Homo Sapiens
RQTFVIHKL

SEQ ID NO: 40708 - protein, 9 aa, Homo Sapiens
RQVHPFHVY

SEQ ID NO: 40709 - protein, 9 aa, Homo Sapiens
RQVYLPMSY

SEQ ID NO: 40710 - protein, 9 aa, Homo Sapiens
RQWLIDTLY

SEQ ID NO: 40711 - protein, 9 aa, Homo Sapiens
RSAFLSQRY

SEQ ID NO: 40712 - protein, 9 aa, Homo Sapiens
RSHPFIKEY

SEQ ID NO: 40713 - protein, 9 aa, Homo Sapiens
RSHPPLHEY

SEQ ID NO: 40714 - protein, 9 aa, Homo Sapiens
RSHYLMHNY

SEQ ID NO: 40715 - protein, 9 aa, Homo Sapiens
RSIAEMGAY

SEQ ID NO: 40716 - protein, 9 aa, Homo Sapiens
RSKPQLARY

SEQ ID NO: 40717 - protein, 9 aa, Homo Sapiens
RSMGFIGHY

SEQ ID NO: 40718 - protein, 9 aa, Homo Sapiens
RSMPPSFGY

SEQ ID NO: 40719 - protein, 9 aa, Homo Sapiens
RSQIHLHKY

SEQ ID NO: 40720 - protein, 9 aa, Homo Sapiens
RSQPVYIQY

SEQ ID NO: 40721 - protein, 9 aa, Homo Sapiens
RSQVQRARY

SEQ ID NO: 40722 - protein, 9 aa, Homo Sapiens
RSSNVSYKY

SEQ ID NO: 40723 - protein, 9 aa, Homo Sapiens
RSSPPGHYY

SEQ ID NO: 40724 - protein, 9 aa, Homo Sapiens
RSSYVARQY

SEQ ID NO: 40725 - protein, 9 aa, Homo Sapiens
RSTLVEHVY

SEQ ID NO: 40726 - protein, 9 aa, Homo Sapiens
RTAHVILRY

SEQ ID NO: 40727 - protein, 9 aa, Homo Sapiens
RTAPRFGLY

SEQ ID NO: 40728 - protein, 9 aa, Homo Sapiens
RTFGHLLRY

SEQ ID NO: 40729 - protein, 9 aa, Homo Sapiens
RTGDGKILY

SEQ ID NO: 40730 - protein, 9 aa, Homo Sapiens
RTGPMGHTY

SEQ ID NO: 40731 - protein, 9 aa, Homo Sapiens
RTGPVSGRY

SEQ ID NO: 40732 - protein, 9 aa, Homo Sapiens
RTHPVEIFY

SEQ ID NO: 40733 - protein, 9 aa, Homo Sapiens
RTIVIRRDY

SEQ ID NO: 40734 - protein, 9 aa, Homo Sapiens
RTKEEPAHY

SEQ ID NO: 40735 - protein, 9 aa, Homo Sapiens
RTKNNIQRY

SEQ ID NO: 40736 - protein, 9 aa, Homo Sapiens
RTLGEIPTY

SEQ ID NO: 40737 - protein, 9 aa, Homo Sapiens
RTLHHNWRY

SEQ ID NO: 40738 - protein, 9 aa, Homo Sapiens
RTLKEILRY

SEQ ID NO: 40739 - protein, 9 aa, Homo Sapiens
RTLPVLLLY

SEQ ID NO: 40740 - protein, 9 aa, Homo Sapiens
RTLSGMESY

SEQ ID NO: 40741 - protein, 9 aa, Homo Sapiens
RTMPIYPTY

SEQ ID NO: 40742 - protein, 9 aa, Homo Sapiens
RTMQEIERY

SEQ ID NO: 40743 - protein, 9 aa, Homo Sapiens
RTNNIELHY

SEQ ID NO: 40744 - protein, 9 aa, Homo Sapiens
RTPQTVAGY

SEQ ID NO: 40745 - protein, 9 aa, Homo Sapiens
RTQEIINKY

SEQ ID NO: 40746 - protein, 9 aa, Homo Sapiens
RTQNVLGEK

SEQ ID NO: 40747 - protein, 9 aa, Homo Sapiens
RTQYMKYLY

SEQ ID NO: 40748 - protein, 9 aa, Homo Sapiens
RTSIIEAQY

SEQ ID NO: 40749 - protein, 9 aa, Homo Sapiens
RTSIVEKRF

SEQ ID NO: 40750 - protein, 9 aa, Homo Sapiens
RTSPFFSVY

SEQ ID NO: 40751 - protein, 9 aa, Homo Sapiens
RTSSLKASY

SEQ ID NO: 40752 - protein, 9 aa, Homo Sapiens
RTTEILHHL

SEQ ID NO: 40753 - protein, 9 aa, Homo Sapiens
RTTFFHHEY

SEQ ID NO: 40754 - protein, 9 aa, Homo Sapiens
RTVRIWRQY

SEQ ID NO: 40755 - protein, 9 aa, Homo Sapiens
RTYDLYITY

SEQ ID NO: 40756 - protein, 9 aa, Homo Sapiens
RTYGVVAQY

SEQ ID NO: 40757 - protein, 9 aa, Homo Sapiens
RVADTFQDY

SEQ ID NO: 40758 - protein, 9 aa, Homo Sapiens
RVAHMEFCY

SEQ ID NO: 40759 - protein, 9 aa, Homo Sapiens
RVAMYVHAY

SEQ ID NO: 40760 - protein, 9 aa, Homo Sapiens
RVAPYRILY

SEQ ID NO: 40761 - protein, 9 aa, Homo Sapiens
RVAQLEQVY

SEQ ID NO: 40762 - protein, 9 aa, Homo Sapiens
RVASVMQEY

SEQ ID NO: 40763 - protein, 9 aa, Homo Sapiens
RVFNVFCLY

SEQ ID NO: 40764 - protein, 9 aa, Homo Sapiens
RVFPYSVFY

SEQ ID NO: 40765 - protein, 9 aa, Homo Sapiens
RVGFFPRSY

SEQ ID NO: 40766 - protein, 9 aa, Homo Sapiens
RVIELAVKY

SEQ ID NO: 40767 - protein, 9 aa, Homo Sapiens
RVIELVQKY

SEQ ID NO: 40768 - protein, 9 aa, Homo Sapiens
RVILERALV

SEQ ID NO: 40769 - protein, 9 aa, Homo Sapiens
RVIMERDTY

SEQ ID NO: 40770 - protein, 9 aa, Homo Sapiens
RVIQCYIQY

SEQ ID NO: 40771 - protein, 9 aa, Homo Sapiens
RVKAWTSRY

SEQ ID NO: 40772 - protein, 9 aa, Homo Sapiens
RVKDEPAYY

SEQ ID NO: 40773 - protein, 9 aa, Homo Sapiens
RVKEIYNTY

SEQ ID NO: 40774 - protein, 9 aa, Homo Sapiens
RVKPNIFSY

SEQ ID NO: 40775 - protein, 9 aa, Homo Sapiens
RVKQEEQRY

SEQ ID NO: 40776 - protein, 9 aa, Homo Sapiens
RVKSFALKY

SEQ ID NO: 40777 - protein, 9 aa, Homo Sapiens
RVLPCAHAY

SEQ ID NO: 40778 - protein, 9 aa, Homo Sapiens
RVLPPNWKY

SEQ ID NO: 40779 - protein, 9 aa, Homo Sapiens
RVMLETPEY

SEQ ID NO: 40780 - protein, 9 aa, Homo Sapiens
RVNAQAAAY

SEQ ID NO: 40781 - protein, 9 aa, Homo Sapiens
RVNKEMARY

SEQ ID NO: 40782 - protein, 9 aa, Homo Sapiens
RVNKLLQHY

SEQ ID NO: 40783 - protein, 9 aa, Homo Sapiens
RVNTTQKRY

SEQ ID NO: 40784 - protein, 9 aa, Homo Sapiens
RVQDLMAQM

SEQ ID NO: 40785 - protein, 9 aa, Homo Sapiens
RVQEAIAEV

SEQ ID NO: 40786 - protein, 9 aa, Homo Sapiens
RVQEGNESY

SEQ ID NO: 40787 - protein, 9 aa, Homo Sapiens
RVQGFQVEY

SEQ ID NO: 40788 - protein, 9 aa, Homo Sapiens
RVQKIRPSI

SEQ ID NO: 40789 - protein, 9 aa, Homo Sapiens
RVQKLVRRY

SEQ ID NO: 40790 - protein, 9 aa, Homo Sapiens
RVQLKYAAK

SEQ ID NO: 40791 - protein, 9 aa, Homo Sapiens
RVQYWIENY

SEQ ID NO: 40792 - protein, 9 aa, Homo Sapiens
RVRDDVAEY

SEQ ID NO: 40793 - protein, 9 aa, Homo Sapiens
RVRDVVTKY

SEQ ID NO: 40794 - protein, 9 aa, Homo Sapiens
RVSEVKPSY

SEQ ID NO: 40795 - protein, 9 aa, Homo Sapiens
RVSEVKPTY

SEQ ID NO: 40796 - protein, 9 aa, Homo Sapiens
RVSGVKPKY

SEQ ID NO: 40797 - protein, 9 aa, Homo Sapiens
RVSHINSNY

SEQ ID NO: 40798 - protein, 9 aa, Homo Sapiens
RVSNVKSVY

SEQ ID NO: 40799 - protein, 9 aa, Homo Sapiens
RVTPAAANY

SEQ ID NO: 40800 - protein, 9 aa, Homo Sapiens
RVVHDFPKY

SEQ ID NO: 40801 - protein, 9 aa, Homo Sapiens
RVVSYQIRY

SEQ ID NO: 40802 - protein, 9 aa, Homo Sapiens
RVVVEHGTY

SEQ ID NO: 40803 - protein, 9 aa, Homo Sapiens
RVWDIRNTY

SEQ ID NO: 40804 - protein, 9 aa, Homo Sapiens
RVWDIVRHY

SEQ ID NO: 40805 - protein, 9 aa, Homo Sapiens
RVYDIPPKF

SEQ ID NO: 40806 - protein, 9 aa, Homo Sapiens
RVYDVTRFL

SEQ ID NO: 40807 - protein, 9 aa, Homo Sapiens
RVYEIGRQF

SEQ ID NO: 40808 - protein, 9 aa, Homo Sapiens
RVYESIGQY

SEQ ID NO: 40809 - protein, 9 aa, Homo Sapiens
RVYEVATFY

SEQ ID NO: 40810 - protein, 9 aa, Homo Sapiens
RVYIGRLSY

SEQ ID NO: 40811 - protein, 9 aa, Homo Sapiens
RVYNNTARY

SEQ ID NO: 40812 - protein, 9 aa, Homo Sapiens
RVYVGSIYY

SEQ ID NO: 40813 - protein, 9 aa, Homo Sapiens
RWYVVQTNY

SEQ ID NO: 40814 - protein, 9 aa, Homo Sapiens
RYAESLGQY

SEQ ID NO: 40815 - protein, 9 aa, Homo Sapiens
RYGEQPASY

SEQ ID NO: 40816 - protein, 9 aa, Homo Sapiens
RYGEVMPVY

SEQ ID NO: 40817 - protein, 9 aa, Homo Sapiens
RYHELITKY

SEQ ID NO: 40818 - protein, 9 aa, Homo Sapiens
RYIGKTMDY

SEQ ID NO: 40819 - protein, 9 aa, Homo Sapiens
RYIKTSAHY

SEQ ID NO: 40820 - protein, 9 aa, Homo Sapiens
RYKAVLQEY

SEQ ID NO: 40821 - protein, 9 aa, Homo Sapiens
RYKPSPERY

SEQ ID NO: 40822 - protein, 9 aa, Homo Sapiens
RYLDLFTNY

SEQ ID NO: 40823 - protein, 9 aa, Homo Sapiens
RYLDLHDCY

SEQ ID NO: 40824 - protein, 9 aa, Homo Sapiens
RYLVEKPKY

SEQ ID NO: 40825 - protein, 9 aa, Homo Sapiens
RYMDLLWRY

SEQ ID NO: 40826 - protein, 9 aa, Homo Sapiens
RYMELEQRY

SEQ ID NO: 40827 - protein, 9 aa, Homo Sapiens
RYNDITKVY

SEQ ID NO: 40828 - protein, 9 aa, Homo Sapiens
RYNENLSKY

SEQ ID NO: 40829 - protein, 9 aa, Homo Sapiens
RYPDIQASY

SEQ ID NO: 40830 - protein, 9 aa, Homo Sapiens
RYPHLSPKY

SEQ ID NO: 40831 - protein, 9 aa, Homo Sapiens
RYSEAVFYY

SEQ ID NO: 40832 - protein, 9 aa, Homo Sapiens
RYSPVLSRF

SEQ ID NO: 40833 - protein, 9 aa, Homo Sapiens
RYTDVSTRY

SEQ ID NO: 40834 - protein, 9 aa, Homo Sapiens
RYVELLDKY

SEQ ID NO: 40835 - protein, 9 aa, Homo Sapiens
RYYSSEYHY

SEQ ID NO: 40836 - protein, 9 aa, Homo Sapiens
RYYYYHRQY

SEQ ID NO: 40837 - protein, 9 aa, Homo Sapiens
SAIQNRFKY

SEQ ID NO: 40838 - protein, 9 aa, Homo Sapiens
SAKPPTHKY

SEQ ID NO: 40839 - protein, 9 aa, Homo Sapiens
SFLEILHTY

SEQ ID NO: 40840 - protein, 9 aa, Homo Sapiens
SFTDVIGHY

SEQ ID NO: 40841 - protein, 9 aa, Homo Sapiens
SGHAIIAYY

SEQ ID NO: 40842 - protein, 9 aa, Homo Sapiens
SGHSQPGLY

SEQ ID NO: 40843 - protein, 9 aa, Homo Sapiens
SGNFIDHEY

SEQ ID NO: 40844 - protein, 9 aa, Homo Sapiens
SGSGLSHDY

SEQ ID NO: 40845 - protein, 9 aa, Homo Sapiens
SIHSLAAYY

SEQ ID NO: 40846 - protein, 9 aa, Homo Sapiens
SILTLSHLY

SEQ ID NO: 40847 - protein, 9 aa, Homo Sapiens
SINRIYGFY

SEQ ID NO: 40848 - protein, 9 aa, Homo Sapiens
SISGVTAAY

SEQ ID NO: 40849 - protein, 9 aa, Homo Sapiens
SIWEILHRY

SEQ ID NO: 40850 - protein, 9 aa, Homo Sapiens
SLASVLAQY

SEQ ID NO: 40851 - protein, 9 aa, Homo Sapiens
SLFVSNHAY

SEQ ID NO: 40852 - protein, 9 aa, Homo Sapiens
SLKFLGHLY

SEQ ID NO: 40853 - protein, 9 aa, Homo Sapiens
SLYIANHAY

SEQ ID NO: 40854 - protein, 9 aa, Homo Sapiens
SMHSFLHQY

SEQ ID NO: 40855 - protein, 9 aa, Homo Sapiens
SMRKTFARY

SEQ ID NO: 40856 - protein, 9 aa, Homo Sapiens
SMSSLTGAY

SEQ ID NO: 40857 - protein, 9 aa, Homo Sapiens
SNFLLSHEY

SEQ ID NO: 40858 - protein, 9 aa, Homo Sapiens
SQFIFEHSY

SEQ ID NO: 40859 - protein, 9 aa, Homo Sapiens
SQHAVQPKY

SEQ ID NO: 40860 - protein, 9 aa, Homo Sapiens
SQHYHQGYY

SEQ ID NO: 40861 - protein, 9 aa, Homo Sapiens
SQIGNCALY

SEQ ID NO: 40862 - protein, 9 aa, Homo Sapiens
SQVPVKHVY

SEQ ID NO: 40863 - protein, 9 aa, Homo Sapiens
SSIALHHQY

SEQ ID NO: 40864 - protein, 9 aa, Homo Sapiens
SSPAPRTAL

SEQ ID NO: 40865 - protein, 9 aa, Homo Sapiens
SSVSVEHSY

SEQ ID NO: 40866 - protein, 9 aa, Homo Sapiens
STEKIKAKY

SEQ ID NO: 40867 - protein, 9 aa, Homo Sapiens
STFFPFHEY

SEQ ID NO: 40868 - protein, 9 aa, Homo Sapiens
STKNIFGRY

SEQ ID NO: 40869 - protein, 9 aa, Homo Sapiens
STMLVTHDY

SEQ ID NO: 40870 - protein, 9 aa, Homo Sapiens
STQPEMHKY

SEQ ID NO: 40871 - protein, 9 aa, Homo Sapiens
STQSKWLKY

SEQ ID NO: 40872 - protein, 9 aa, Homo Sapiens
STQTIREMY

SEQ ID NO: 40873 - protein, 9 aa, Homo Sapiens
STSDVVRQY

SEQ ID NO: 40874 - protein, 9 aa, Homo Sapiens
STTAVSARY

SEQ ID NO: 40875 - protein, 9 aa, Homo Sapiens
STTEELHKY

SEQ ID NO: 40876 - protein, 9 aa, Homo Sapiens
STYQGERAY

SEQ ID NO: 40877 - protein, 9 aa, Homo Sapiens
SVGRPPGPY

SEQ ID NO: 40878 - protein, 9 aa, Homo Sapiens
SVHGFQMLY

SEQ ID NO: 40879 - protein, 9 aa, Homo Sapiens
SVHLVRHFY

SEQ ID NO: 40880 - protein, 9 aa, Homo Sapiens
SVHNLLPNY

SEQ ID NO: 40881 - protein, 9 aa, Homo Sapiens
SVHVIMYLY

SEQ ID NO: 40882 - protein, 9 aa, Homo Sapiens
SVKIWTAHY

SEQ ID NO: 40883 - protein, 9 aa, Homo Sapiens
SVKSMYLKY

SEQ ID NO: 40884 - protein, 9 aa, Homo Sapiens
SVLKTRFSY

SEQ ID NO: 40885 - protein, 9 aa, Homo Sapiens
SVLPFQIYY

SEQ ID NO: 40886 - protein, 9 aa, Homo Sapiens
SVQSIRPPY

SEQ ID NO: 40887 - protein, 9 aa, Homo Sapiens
SVSPLQRIY

SEQ ID NO: 40888 - protein, 9 aa, Homo Sapiens
SVTFLVHHY

SEQ ID NO: 40889 - protein, 9 aa, Homo Sapiens
SVWFLDHDY

SEQ ID NO: 40890 - protein, 9 aa, Homo Sapiens
SWTPYPPLY

SEQ ID NO: 40891 - protein, 9 aa, Homo Sapiens
SYIPYMHGY

SEQ ID NO: 40892 - protein, 9 aa, Homo Sapiens
SYLDQISRY

SEQ ID NO: 40893 - protein, 9 aa, Homo Sapiens
SYLPEAGQY

SEQ ID NO: 40894 - protein, 9 aa, Homo Sapiens
SYQKLLKYY

SEQ ID NO: 40895 - protein, 9 aa, Homo Sapiens
SYQRFTDCY

SEQ ID NO: 40896 - protein, 9 aa, Homo Sapiens
SYQRSMHAY

SEQ ID NO: 40897 - protein, 9 aa, Homo Sapiens
SYSPTSPSY

SEQ ID NO: 40898 - protein, 9 aa, Homo Sapiens
SYSRVLHGY

SEQ ID NO: 40899 - protein, 9 aa, Homo Sapiens
TAQYYQGLY

SEQ ID NO: 40900 - protein, 9 aa, Homo Sapiens
TASYVRAQY

SEQ ID NO: 40901 - protein, 9 aa, Homo Sapiens
TFHLPLHRY

SEQ ID NO: 40902 - protein, 9 aa, Homo Sapiens
TGWTHSAKY

SEQ ID NO: 40903 - protein, 9 aa, Homo Sapiens
TLARLPHLY

SEQ ID NO: 40904 - protein, 9 aa, Homo Sapiens
TLNKMPHDY

SEQ ID NO: 40905 - protein, 9 aa, Homo Sapiens
TLRDIETFY

SEQ ID NO: 40906 - protein, 9 aa, Homo Sapiens
TLSESTHKY

SEQ ID NO: 40907 - protein, 9 aa, Homo Sapiens
TLSSIRSKY

SEQ ID NO: 40908 - protein, 9 aa, Homo Sapiens
TLTDVAHEY

SEQ ID NO: 40909 - protein, 9 aa, Homo Sapiens
TLTIVPHGY

SEQ ID NO: 40910 - protein, 9 aa, Homo Sapiens
TMKDFNHSY

SEQ ID NO: 40911 - protein, 9 aa, Homo Sapiens
TQSGIAGGY

SEQ ID NO: 40912 - protein, 9 aa, Homo Sapiens
TQSGINGTY

SEQ ID NO: 40913 - protein, 9 aa, Homo Sapiens
TSLPTSHTY

SEQ ID NO: 40914 - protein, 9 aa, Homo Sapiens
TSQLYTVKY

SEQ ID NO: 40915 - protein, 9 aa, Homo Sapiens
TTNFIKAEY

SEQ ID NO: 40916 - protein, 9 aa, Homo Sapiens
TTQYIIHNY

SEQ ID NO: 40917 - protein, 9 aa, Homo Sapiens
TTSIVEHSY

SEQ ID NO: 40918 - protein, 9 aa, Homo Sapiens
TVHPVVHQY

SEQ ID NO: 40919 - protein, 9 aa, Homo Sapiens
TVIPNSHVY

SEQ ID NO: 40920 - protein, 9 aa, Homo Sapiens
TVKSILAEY

SEQ ID NO: 40921 - protein, 9 aa, Homo Sapiens
TVLYIEHRY

SEQ ID NO: 40922 - protein, 9 aa, Homo Sapiens
TVMKFVPRY

SEQ ID NO: 40923 - protein, 9 aa, Homo Sapiens
TVNPTFRGY

SEQ ID NO: 40924 - protein, 9 aa, Homo Sapiens
TVQTVRYKY

SEQ ID NO: 40925 - protein, 9 aa, Homo Sapiens
TVVKLAHTY

SEQ ID NO: 40926 - protein, 9 aa, Homo Sapiens
TVVSVSHIY

SEQ ID NO: 40927 - protein, 9 aa, Homo Sapiens
TYNILTHDY

SEQ ID NO: 40928 - protein, 9 aa, Homo Sapiens
TYQEFFSRY

SEQ ID NO: 40929 - protein, 9 aa, Homo Sapiens
TYQRLIASY

SEQ ID NO: 40930 - protein, 9 aa, Homo Sapiens
TYSTLLQRY

SEQ ID NO: 40931 - protein, 9 aa, Homo Sapiens
VANALAHRY

SEQ ID NO: 40932 - protein, 9 aa, Homo Sapiens
VAQSTRIIY

SEQ ID NO: 40933 - protein, 9 aa, Homo Sapiens
VASAIYAKY

SEQ ID NO: 40934 - protein, 9 aa, Homo Sapiens
VFYALSNKY

SEQ ID NO: 40935 - protein, 9 aa, Homo Sapiens
VGAGAPVYL

SEQ ID NO: 40936 - protein, 9 aa, Homo Sapiens
VGITIQHAY

SEQ ID NO: 40937 - protein, 9 aa, Homo Sapiens
VGSRVVAKY

SEQ ID NO: 40938 - protein, 9 aa, Homo Sapiens
VIGDVIRVY

SEQ ID NO: 40939 - protein, 9 aa, Homo Sapiens
VINPALDKY

SEQ ID NO: 40940 - protein, 9 aa, Homo Sapiens
VLAGHGHLY

SEQ ID NO: 40941 - protein, 9 aa, Homo Sapiens
VLHNLKERY

SEQ ID NO: 40942 - protein, 9 aa, Homo Sapiens
VLKAAAHHY

SEQ ID NO: 40943 - protein, 9 aa, Homo Sapiens
VLKEKIAKY

SEQ ID NO: 40944 - protein, 9 aa, Homo Sapiens
VLLVINHKY

SEQ ID NO: 40945 - protein, 9 aa, Homo Sapiens
VLSLYASGR

SEQ ID NO: 40946 - protein, 9 aa, Homo Sapiens
VMHQIISKY

SEQ ID NO: 40947 - protein, 9 aa, Homo Sapiens
VMQKIIPHY

SEQ ID NO: 40948 - protein, 9 aa, Homo Sapiens
VQKPDAANY

SEQ ID NO: 40949 - protein, 9 aa, Homo Sapiens
VQQVHVATY

SEQ ID NO: 40950 - protein, 9 aa, Homo Sapiens
VQSDLLHKY

SEQ ID NO: 40951 - protein, 9 aa, Homo Sapiens
VSFQHPHKY

SEQ ID NO: 40952 - protein, 9 aa, Homo Sapiens
VSTVLTSKY

SEQ ID NO: 40953 - protein, 9 aa, Homo Sapiens
VTKPVGGNY

SEQ ID NO: 40954 - protein, 9 aa, Homo Sapiens
VTSPAIGAY

SEQ ID NO: 40955 - protein, 9 aa, Homo Sapiens
VTSPIRASY

SEQ ID NO: 40956 - protein, 9 aa, Homo Sapiens
VVAVGRALY

SEQ ID NO: 40957 - protein, 9 aa, Homo Sapiens
VVGNVWRQY

SEQ ID NO: 40958 - protein, 9 aa, Homo Sapiens
VVHEIAYQY

SEQ ID NO: 40959 - protein, 9 aa, Homo Sapiens
VVKEIFFHY

SEQ ID NO: 40960 - protein, 9 aa, Homo Sapiens
VVKITGHFY

SEQ ID NO: 40961 - protein, 9 aa, Homo Sapiens
VVNIARYLY

SEQ ID NO: 40962 - protein, 9 aa, Homo Sapiens
VVNIGTHCY

SEQ ID NO: 40963 - protein, 9 aa, Homo Sapiens
VVQEELQCY

SEQ ID NO: 40964 - protein, 9 aa, Homo Sapiens
VVQKMIENY

SEQ ID NO: 40965 - protein, 9 aa, Homo Sapiens
VVQQVKGHY

SEQ ID NO: 40966 - protein, 9 aa, Homo Sapiens
VVQSVVHLY

SEQ ID NO: 40967 - protein, 9 aa, Homo Sapiens
VVQTVKASY

SEQ ID NO: 40968 - protein, 9 aa, Homo Sapiens
VVQVYRKKY

SEQ ID NO: 40969 - protein, 9 aa, Homo Sapiens
VVRNISYKY

SEQ ID NO: 40970 - protein, 9 aa, Homo Sapiens
VVSHLICQY

SEQ ID NO: 40971 - protein, 9 aa, Homo Sapiens
VVSPYLGTY

SEQ ID NO: 40972 - protein, 9 aa, Homo Sapiens
VYQDTWMKY

SEQ ID NO: 40973 - protein, 9 aa, Homo Sapiens
YLPDLHHLR

SEQ ID NO: 40974 - protein, 9 aa, Homo Sapiens
YQADIERMY

SEQ ID NO: 40975 - protein, 9 aa, Homo Sapiens
YQFTGIKKY

SEQ ID NO: 40976 - protein, 9 aa, Homo Sapiens
YQIKVHRKY

SEQ ID NO: 40977 - protein, 9 aa, Homo Sapiens
YQSNLPHNY

SEQ ID NO: 40978 - protein, 9 aa, Homo Sapiens
YSFGGCHRY

SEQ ID NO: 40979 - protein, 9 aa, Homo Sapiens
YVTTSTRTY

SEQ ID NO: 40980 - protein, 10 aa, Homo Sapiens
AASPRPNHSY

SEQ ID NO: 40981 - protein, 10 aa, Homo Sapiens
AAVGFPTHLY

SEQ ID NO: 40982 - protein, 10 aa, Homo Sapiens
AFHPFIAGPY

SEQ ID NO: 40983 - protein, 10 aa, Homo Sapiens
AFKALIAAQY

SEQ ID NO: 40984 - protein, 10 aa, Homo Sapiens
AFQRGYYRYY

SEQ ID NO: 40985 - protein, 10 aa, Homo Sapiens
AGFHLNEHLY

SEQ ID NO: 40986 - protein, 10 aa, Homo Sapiens
AGLPPVFGLY

SEQ ID NO: 40987 - protein, 10 aa, Homo Sapiens
AIGMPVEKRY

SEQ ID NO: 40988 - protein, 10 aa, Homo Sapiens
AIRNDEELNK

SEQ ID NO: 40989 - protein, 10 aa, Homo Sapiens
AIRTNYNDRY

SEQ ID NO: 40990 - protein, 10 aa, Homo Sapiens
ALIARSLGKY

SEQ ID NO: 40991 - protein, 10 aa, Homo Sapiens
ALKEKLEHQY

SEQ ID NO: 40992 - protein, 10 aa, Homo Sapiens
ALMGYATHKY

SEQ ID NO: 40993 - protein, 10 aa, Homo Sapiens
ALNPTGTFLY

SEQ ID NO: 40994 - protein, 10 aa, Homo Sapiens
ALRAYVKDHY

SEQ ID NO: 40995 - protein, 10 aa, Homo Sapiens
AMIENFNAKY

SEQ ID NO: 40996 - protein, 10 aa, Homo Sapiens
AMLAGATAVY

SEQ ID NO: 40997 - protein, 10 aa, Homo Sapiens
AMQSLKSRGY

SEQ ID NO: 40998 - protein, 10 aa, Homo Sapiens
AQAFIHNSLY

SEQ ID NO: 40999 - protein, 10 aa, Homo Sapiens
AQAGWLQHDY

SEQ ID NO: 41000 - protein, 10 aa, Homo Sapiens
AQAHFNNGEY

SEQ ID NO: 41001 - protein, 10 aa, Homo Sapiens
AQAPCGQAAY

SEQ ID NO: 41002 - protein, 10 aa, Homo Sapiens
AQFRDPCRSY

SEQ ID NO: 41003 - protein, 10 aa, Homo Sapiens
AQNPANMSKY

SEQ ID NO: 41004 - protein, 10 aa, Homo Sapiens
AQNQLVIWKY

SEQ ID NO: 41005 - protein, 10 aa, Homo Sapiens
AQNSPSTFHY

SEQ ID NO: 41006 - protein, 10 aa, Homo Sapiens
AQRAPGGLSY

SEQ ID NO: 41007 - protein, 10 aa, Homo Sapiens
AQRPGLALNY

SEQ ID NO: 41008 - protein, 10 aa, Homo Sapiens
AQYENPPHIY

SEQ ID NO: 41009 - protein, 10 aa, Homo Sapiens
ARYSGSYNDY

SEQ ID NO: 41010 - protein, 10 aa, Homo Sapiens
ASHPPVEGSY

SEQ ID NO: 41011 - protein, 10 aa, Homo Sapiens
ASINRIYGFY

SEQ ID NO: 41012 - protein, 10 aa, Homo Sapiens
ASKEPDNHVY

SEQ ID NO: 41013 - protein, 10 aa, Homo Sapiens
ASYLDQISRY

SEQ ID NO: 41014 - protein, 10 aa, Homo Sapiens
ATKDYKDHGY

SEQ ID NO: 41015 - protein, 10 aa, Homo Sapiens
ATKLIQNNHY

SEQ ID NO: 41016 - protein, 10 aa, Homo Sapiens
ATLKGPDSHY

SEQ ID NO: 41017 - protein, 10 aa, Homo Sapiens
ATLNVSTTRY

SEQ ID NO: 41018 - protein, 10 aa, Homo Sapiens
ATLTGGPARY

SEQ ID NO: 41019 - protein, 10 aa, Homo Sapiens
ATNPESKVFY

SEQ ID NO: 41020 - protein, 10 aa, Homo Sapiens
ATNPPYSLFY

SEQ ID NO: 41021 - protein, 10 aa, Homo Sapiens
ATTGHVIDIY

SEQ ID NO: 41022 - protein, 10 aa, Homo Sapiens
AVAALDGAKY

SEQ ID NO: 41023 - protein, 10 aa, Homo Sapiens
AVASKIGHSY

SEQ ID NO: 41024 - protein, 10 aa, Homo Sapiens
AVIGDVIRVY

SEQ ID NO: 41025 - protein, 10 aa, Homo Sapiens
AVLKAAAHHY

SEQ ID NO: 41026 - protein, 10 aa, Homo Sapiens
AVLKGVASDY

SEQ ID NO: 41027 - protein, 10 aa, Homo Sapiens
AVQKMDQAEY

SEQ ID NO: 41028 - protein, 10 aa, Homo Sapiens
AVRPHSAPEY

SEQ ID NO: 41029 - protein, 10 aa, Homo Sapiens
AVVRNVYHKY

SEQ ID NO: 41030 - protein, 10 aa, Homo Sapiens
AVVSVCGHLY

SEQ ID NO: 41031 - protein, 10 aa, Homo Sapiens
AVYNNIMRHY

SEQ ID NO: 41032 - protein, 10 aa, Homo Sapiens
AWLDKIDRRY

SEQ ID NO: 41033 - protein, 10 aa, Homo Sapiens
AYREHPYGRY

SEQ ID NO: 41034 - protein, 10 aa, Homo Sapiens
AYWRQAGLSY

SEQ ID NO: 41035 - protein, 10 aa, Homo Sapiens
AYYEIRYQFY

SEQ ID NO: 41036 - protein, 10 aa, Homo Sapiens
CFSGMSDHRY

SEQ ID NO: 41037 - protein, 10 aa, Homo Sapiens
ELYERPPHLY

SEQ ID NO: 41038 - protein, 10 aa, Homo Sapiens
FGAGHLICLY

SEQ ID NO: 41039 - protein, 10 aa, Homo Sapiens
FQFIPYMKKY

SEQ ID NO: 41040 - protein, 10 aa, Homo Sapiens
FQKEKIQGEY

SEQ ID NO: 41041 - protein, 10 aa, Homo Sapiens
FQRCLDDHKY

SEQ ID NO: 41042 - protein, 10 aa, Homo Sapiens
GANGLPKHSY

SEQ ID NO: 41043 - protein, 10 aa, Homo Sapiens
GFKEQIYDVY

SEQ ID NO: 41044 - protein, 10 aa, Homo Sapiens
GLTEKANHYY

SEQ ID NO: 41045 - protein, 10 aa, Homo Sapiens
GMRGLIPHKY

SEQ ID NO: 41046 - protein, 10 aa, Homo Sapiens
GQCGNQIGAK

SEQ ID NO: 41047 - protein, 10 aa, Homo Sapiens
GQFAEAAGKY

SEQ ID NO: 41048 - protein, 10 aa, Homo Sapiens
GQHDLVPHYY

SEQ ID NO: 41049 - protein, 10 aa, Homo Sapiens
GQIEEAGWSY

SEQ ID NO: 41050 - protein, 10 aa, Homo Sapiens
GQISDPSRSY

SEQ ID NO: 41051 - protein, 10 aa, Homo Sapiens
GQKCEFQDAY

SEQ ID NO: 41052 - protein, 10 aa, Homo Sapiens
GQKLIDVNHY

SEQ ID NO: 41053 - protein, 10 aa, Homo Sapiens
GQNVADYMRY

SEQ ID NO: 41054 - protein, 10 aa, Homo Sapiens
GQYGNPLNKY

SEQ ID NO: 41055 - protein, 10 aa, Homo Sapiens
GSNLTPAHHY

SEQ ID NO: 41056 - protein, 10 aa, Homo Sapiens
GSNPFTGFFY

SEQ ID NO: 41057 - protein, 10 aa, Homo Sapiens
GTIKDIVTRY

SEQ ID NO: 41058 - protein, 10 aa, Homo Sapiens
GTKKDFEDLY

SEQ ID NO: 41059 - protein, 10 aa, Homo Sapiens
GTKQWVHARY

SEQ ID NO: 41060 - protein, 10 aa, Homo Sapiens
GTLSESTHKY

SEQ ID NO: 41061 - protein, 10 aa, Homo Sapiens
GTQPPGKMEY

SEQ ID NO: 41062 - protein, 10 aa, Homo Sapiens
GTREHWDAVY

SEQ ID NO: 41063 - protein, 10 aa, Homo Sapiens
GVANALAHRY

SEQ ID NO: 41064 - protein, 10 aa, Homo Sapiens
GVHAVMYSYY

SEQ ID NO: 41065 - protein, 10 aa, Homo Sapiens
GVHSGLNHNY

SEQ ID NO: 41066 - protein, 10 aa, Homo Sapiens
GVNPHVNHLY

SEQ ID NO: 41067 - protein, 10 aa, Homo Sapiens
GVNPRVNHLY

SEQ ID NO: 41068 - protein, 10 aa, Homo Sapiens
GVNPYINHLY

SEQ ID NO: 41069 - protein, 10 aa, Homo Sapiens
GYFHDATRVY

SEQ ID NO: 41070 - protein, 10 aa, Homo Sapiens
GYYQGGGGRY

SEQ ID NO: 41071 - protein, 10 aa, Homo Sapiens
HGKDVFEAFY

SEQ ID NO: 41072 - protein, 10 aa, Homo Sapiens
HGRPPPQHFY

SEQ ID NO: 41073 - protein, 10 aa, Homo Sapiens
HISNTAKHFY

SEQ ID NO: 41074 - protein, 10 aa, Homo Sapiens
HLSERADWQY

SEQ ID NO: 41075 - protein, 10 aa, Homo Sapiens
HMADYPDYKY

SEQ ID NO: 41076 - protein, 10 aa, Homo Sapiens
HMQNTPGFMY

SEQ ID NO: 41077 - protein, 10 aa, Homo Sapiens
HQITVLHVYH

SEQ ID NO: 41078 - protein, 10 aa, Homo Sapiens
HQNGDYTHFY

SEQ ID NO: 41079 - protein, 10 aa, Homo Sapiens
HTFQNDIHVY

SEQ ID NO: 41080 - protein, 10 aa, Homo Sapiens
HTGLVDAHLY

SEQ ID NO: 41081 - protein, 10 aa, Homo Sapiens
HTVVKLAHTY

SEQ ID NO: 41082 - protein, 10 aa, Homo Sapiens
HVNTCYKHFY

SEQ ID NO: 41083 - protein, 10 aa, Homo Sapiens
IGLPYADHNY

SEQ ID NO: 41084 - protein, 10 aa, Homo Sapiens
IIVPPNFDKY

SEQ ID NO: 41085 - protein, 10 aa, Homo Sapiens
ILHEPGEDKY

SEQ ID NO: 41086 - protein, 10 aa, Homo Sapiens
ILNSPYAKLY

SEQ ID NO: 41087 - protein, 10 aa, Homo Sapiens
ILSNLTCNNY

SEQ ID NO: 41088 - protein, 10 aa, Homo Sapiens
IMNDYPKFKY

SEQ ID NO: 41089 - protein, 10 aa, Homo Sapiens
IQFEIAHAYY

SEQ ID NO: 41090 - protein, 10 aa, Homo Sapiens
IQNPDLWNSY

SEQ ID NO: 41091 - protein, 10 aa, Homo Sapiens
ITAVGPAHFY

SEQ ID NO: 41092 - protein, 10 aa, Homo Sapiens
IVKQLEEDLY

SEQ ID NO: 41093 - protein, 10 aa, Homo Sapiens
IVQEPKGQKY

SEQ ID NO: 41094 - protein, 10 aa, Homo Sapiens
IVQNITFGKY

SEQ ID NO: 41095 - protein, 10 aa, Homo Sapiens
IVQPIISKLY

SEQ ID NO: 41096 - protein, 10 aa, Homo Sapiens
IVQPVSGAVY

SEQ ID NO: 41097 - protein, 10 aa, Homo Sapiens
KAFSQSSHLY

SEQ ID NO: 41098 - protein, 10 aa, Homo Sapiens
KALEAVFGKY

SEQ ID NO: 41099 - protein, 10 aa, Homo Sapiens
KALELDSNLY

SEQ ID NO: 41100 - protein, 10 aa, Homo Sapiens
KALGKVLSKY

SEQ ID NO: 41101 - protein, 10 aa, Homo Sapiens
KAQAAFFGSY

SEQ ID NO: 41102 - protein, 10 aa, Homo Sapiens
KAQLGLGHSY

SEQ ID NO: 41103 - protein, 10 aa, Homo Sapiens
KAQTIDRAKY

SEQ ID NO: 41104 - protein, 10 aa, Homo Sapiens
KAYADFYRNY

SEQ ID NO: 41105 - protein, 10 aa, Homo Sapiens
KEKEPLESQY

SEQ ID NO: 41106 - protein, 10 aa, Homo Sapiens
KFADDMYSLY

SEQ ID NO: 41107 - protein, 10 aa, Homo Sapiens
KFASSEKHSY

SEQ ID NO: 41108 - protein, 10 aa, Homo Sapiens
KFLEETNCLY

SEQ ID NO: 41109 - protein, 10 aa, Homo Sapiens
KFRDLSPPRY

SEQ ID NO: 41110 - protein, 10 aa, Homo Sapiens
KFSPVATASY

SEQ ID NO: 41111 - protein, 10 aa, Homo Sapiens
KGISDLAQHY

SEQ ID NO: 41112 - protein, 10 aa, Homo Sapiens
KGKGLILHYY

SEQ ID NO: 41113 - protein, 10 aa, Homo Sapiens
KGLTDSIHRY

SEQ ID NO: 41114 - protein, 10 aa, Homo Sapiens
KIADFGFARY

SEQ ID NO: 41115 - protein, 10 aa, Homo Sapiens
KIADMGHLKY

SEQ ID NO: 41116 - protein, 10 aa, Homo Sapiens
KIIAPPERKY

SEQ ID NO: 41117 - protein, 10 aa, Homo Sapiens
KIIEARLKMY

SEQ ID NO: 41118 - protein, 10 aa, Homo Sapiens
KIISEPGSYY

SEQ ID NO: 41119 - protein, 10 aa, Homo Sapiens
KINREVLHSY

SEQ ID NO: 41120 - protein, 10 aa, Homo Sapiens
KIQDAQDKLY

SEQ ID NO: 41121 - protein, 10 aa, Homo Sapiens
KIQDFNDTFY

SEQ ID NO: 41122 - protein, 10 aa, Homo Sapiens
KIQEESLRTY

SEQ ID NO: 41123 - protein, 10 aa, Homo Sapiens
KIREDHKSYY

SEQ ID NO: 41124 - protein, 10 aa, Homo Sapiens
KIRSLDNGGY

SEQ ID NO: 41125 - protein, 10 aa, Homo Sapiens
KISPWTGRFY

SEQ ID NO: 41126 - protein, 10 aa, Homo Sapiens
KITIPYGRKY

SEQ ID NO: 41127 - protein, 10 aa, Homo Sapiens
KIYPGHGRRY

SEQ ID NO: 41128 - protein, 10 aa, Homo Sapiens
KLADQIFAYY

SEQ ID NO: 41129 - protein, 10 aa, Homo Sapiens
KLFDNTVGAY

SEQ ID NO: 41130 - protein, 10 aa, Homo Sapiens
KLFNAIIHKY

SEQ ID NO: 41131 - protein, 10 aa, Homo Sapiens
KLFPGSPAIY

SEQ ID NO: 41132 - protein, 10 aa, Homo Sapiens
KLGPYVDHYY

SEQ ID NO: 41133 - protein, 10 aa, Homo Sapiens
KLILLPSHMY

SEQ ID NO: 41134 - protein, 10 aa, Homo Sapiens
KLITAIYADY

SEQ ID NO: 41135 - protein, 10 aa, Homo Sapiens
KLKDPANFQY

SEQ ID NO: 41136 - protein, 10 aa, Homo Sapiens
KLKDWQEGGY

SEQ ID NO: 41137 - protein, 10 aa, Homo Sapiens
KLKEMGFDRY

SEQ ID NO: 41138 - protein, 10 aa, Homo Sapiens
KLKKVFQQHY

SEQ ID NO: 41139 - protein, 10 aa, Homo Sapiens
KLKPDFPDAY

SEQ ID NO: 41140 - protein, 10 aa, Homo Sapiens
KLLTKNGHVY

SEQ ID NO: 41141 - protein, 10 aa, Homo Sapiens
KLLTNTHHKY

SEQ ID NO: 41142 - protein, 10 aa, Homo Sapiens
KLMEEFVKQY

SEQ ID NO: 41143 - protein, 10 aa, Homo Sapiens
KLNPAANHRL

SEQ ID NO: 41144 - protein, 10 aa, Homo Sapiens
KLNPQQAPLY

SEQ ID NO: 41145 - protein, 10 aa, Homo Sapiens
KLNPRLAILY

SEQ ID NO: 41146 - protein, 10 aa, Homo Sapiens
KLNQENEHIY

SEQ ID NO: 41147 - protein, 10 aa, Homo Sapiens
KLPGSIQHVY

SEQ ID NO: 41148 - protein, 10 aa, Homo Sapiens
KLQDVFEFRY

SEQ ID NO: 41149 - protein, 10 aa, Homo Sapiens
KLQSKEYSQY

SEQ ID NO: 41150 - protein, 10 aa, Homo Sapiens
KLVEAIRTNY

SEQ ID NO: 41151 - protein, 10 aa, Homo Sapiens
KLVQLILHEY

SEQ ID NO: 41152 - protein, 10 aa, Homo Sapiens
KLWDGRTGKY

SEQ ID NO: 41153 - protein, 10 aa, Homo Sapiens
KLWKHIKHKY

SEQ ID NO: 41154 - protein, 10 aa, Homo Sapiens
KMFNALIHRY

SEQ ID NO: 41155 - protein, 10 aa, Homo Sapiens
KMIEDRSRDY

SEQ ID NO: 41156 - protein, 10 aa, Homo Sapiens
KMKGDYHRYL

SEQ ID NO: 41157 - protein, 10 aa, Homo Sapiens
KMLPDKDCRY

SEQ ID NO: 41158 - protein, 10 aa, Homo Sapiens
KMMNGGHYTY

SEQ ID NO: 41159 - protein, 10 aa, Homo Sapiens
KNIPEGSHQY

SEQ ID NO: 41160 - protein, 10 aa, Homo Sapiens
KNKPGEIAKY

SEQ ID NO: 41161 - protein, 10 aa, Homo Sapiens
KQFDRKHHTY

SEQ ID NO: 41162 - protein, 10 aa, Homo Sapiens
KQFRPPMGGY

SEQ ID NO: 41163 - protein, 10 aa, Homo Sapiens
KQFSKRYLKY

SEQ ID NO: 41164 - protein, 10 aa, Homo Sapiens
KQHGREDLLY

SEQ ID NO: 41165 - protein, 10 aa, Homo Sapiens
KQIANSQDGY

SEQ ID NO: 41166 - protein, 10 aa, Homo Sapiens
KQIEERASHY

SEQ ID NO: 41167 - protein, 10 aa, Homo Sapiens
KQISVGFIGY

SEQ ID NO: 41168 - protein, 10 aa, Homo Sapiens
KQKDIVSIHY

SEQ ID NO: 41169 - protein, 10 aa, Homo Sapiens
KQKDLSGFYR

SEQ ID NO: 41170 - protein, 10 aa, Homo Sapiens
KQKVDFIDAY

SEQ ID NO: 41171 - protein, 10 aa, Homo Sapiens
KQLAGLVANY

SEQ ID NO: 41172 - protein, 10 aa, Homo Sapiens
KQLSILVNCY

SEQ ID NO: 41173 - protein, 10 aa, Homo Sapiens
KQMEERYKKY

SEQ ID NO: 41174 - protein, 10 aa, Homo Sapiens
KQNELKNVKY

SEQ ID NO: 41175 - protein, 10 aa, Homo Sapiens
KQNQVKFGSY

SEQ ID NO: 41176 - protein, 10 aa, Homo Sapiens
KQNYKILHKY

SEQ ID NO: 41177 - protein, 10 aa, Homo Sapiens
KQQNQYQASY

SEQ ID NO: 41178 - protein, 10 aa, Homo Sapiens
KQVEMLERKY

SEQ ID NO: 41179 - protein, 10 aa, Homo Sapiens
KQYEEFAMSY

SEQ ID NO: 41180 - protein, 10 aa, Homo Sapiens
KQYEVEIQTY

SEQ ID NO: 41181 - protein, 10 aa, Homo Sapiens
KRFADSTHRY

SEQ ID NO: 41182 - protein, 10 aa, Homo Sapiens
KSFPARLRQY

SEQ ID NO: 41183 - protein, 10 aa, Homo Sapiens
KSFSDTLKTY

SEQ ID NO: 41184 - protein, 10 aa, Homo Sapiens
KSIGDIFLKY

SEQ ID NO: 41185 - protein, 10 aa, Homo Sapiens
KSKEDCIARY

SEQ ID NO: 41186 - protein, 10 aa, Homo Sapiens
KSKSFTGGGY

SEQ ID NO: 41187 - protein, 10 aa, Homo Sapiens
KSLEDLCSQY

SEQ ID NO: 41188 - protein, 10 aa, Homo Sapiens
KSLQNAQKHY

SEQ ID NO: 41189 - protein, 10 aa, Homo Sapiens
KSNFPARAAY

SEQ ID NO: 41190 - protein, 10 aa, Homo Sapiens
KSVGVFEAFY

SEQ ID NO: 41191 - protein, 10 aa, Homo Sapiens
KSYIGLGHIY

SEQ ID NO: 41192 - protein, 10 aa, Homo Sapiens
KTAVIDHHNY

SEQ ID NO: 41193 - protein, 10 aa, Homo Sapiens
KTFCPAHKSY

SEQ ID NO: 41194 - protein, 10 aa, Homo Sapiens
KTFEIIVHQY

SEQ ID NO: 41195 - protein, 10 aa, Homo Sapiens
KTIILPQHLY

SEQ ID NO: 41196 - protein, 10 aa, Homo Sapiens
KTKEVIGTGY

SEQ ID NO: 41197 - protein, 10 aa, Homo Sapiens
KTKFPAEQYY

SEQ ID NO: 41198 - protein, 10 aa, Homo Sapiens
KTKGYIFLEY

SEQ ID NO: 41199 - protein, 10 aa, Homo Sapiens
KTKQLVESKY

SEQ ID NO: 41200 - protein, 10 aa, Homo Sapiens
KTLDDMISYY

SEQ ID NO: 41201 - protein, 10 aa, Homo Sapiens
KTLDTKPGLY

SEQ ID NO: 41202 - protein, 10 aa, Homo Sapiens
KTLGDFAAEY

SEQ ID NO: 41203 - protein, 10 aa, Homo Sapiens
KTLPFSRSYY

SEQ ID NO: 41204 - protein, 10 aa, Homo Sapiens
KTLQETNMMY

SEQ ID NO: 41205 - protein, 10 aa, Homo Sapiens
KTLSNVKSFY

SEQ ID NO: 41206 - protein, 10 aa, Homo Sapiens
KTLTPIIQEY

SEQ ID NO: 41207 - protein, 10 aa, Homo Sapiens
KTLTPISAAY

SEQ ID NO: 41208 - protein, 10 aa, Homo Sapiens
KTNDQMVVVY

SEQ ID NO: 41209 - protein, 10 aa, Homo Sapiens
KTNHIGHTGY

SEQ ID NO: 41210 - protein, 10 aa, Homo Sapiens
KTPPGLQHEY

SEQ ID NO: 41211 - protein, 10 aa, Homo Sapiens
KTVAGGAWTY

SEQ ID NO: 41212 - protein, 10 aa, Homo Sapiens
KTVGEPGWLY

SEQ ID NO: 41213 - protein, 10 aa, Homo Sapiens
KTVHPVVHQY

SEQ ID NO: 41214 - protein, 10 aa, Homo Sapiens
KTWNAVLLRY

SEQ ID NO: 41215 - protein, 10 aa, Homo Sapiens
KTYNDALFRY

SEQ ID NO: 41216 - protein, 10 aa, Homo Sapiens
KVADWTGATY

SEQ ID NO: 41217 - protein, 10 aa, Homo Sapiens
KVAIKVGGRY

SEQ ID NO: 41218 - protein, 10 aa, Homo Sapiens
KVCPDLLNKY

SEQ ID NO: 41219 - protein, 10 aa, Homo Sapiens
KVFDGIPPPY

SEQ ID NO: 41220 - protein, 10 aa, Homo Sapiens
KVFPEDMAKY

SEQ ID NO: 41221 - protein, 10 aa, Homo Sapiens
KVIDQQNGLY

SEQ ID NO: 41222 - protein, 10 aa, Homo Sapiens
KVINDGLFYY

SEQ ID NO: 41223 - protein, 10 aa, Homo Sapiens
KVIPVLEDNY

SEQ ID NO: 41224 - protein, 10 aa, Homo Sapiens
KVKTSEFYRY

SEQ ID NO: 41225 - protein, 10 aa, Homo Sapiens
KVLDILLEQY

SEQ ID NO: 41226 - protein, 10 aa, Homo Sapiens
KVLRDGAGKY

SEQ ID NO: 41227 - protein, 10 aa, Homo Sapiens
KVMLPGQCQY

SEQ ID NO: 41228 - protein, 10 aa, Homo Sapiens
KVQAGNSSLY

SEQ ID NO: 41229 - protein, 10 aa, Homo Sapiens
KVQDITMQWY

SEQ ID NO: 41230 - protein, 10 aa, Homo Sapiens
KVQEKSTWKM

SEQ ID NO: 41231 - protein, 10 aa, Homo Sapiens
KVQEQIFNLY

SEQ ID NO: 41232 - protein, 10 aa, Homo Sapiens
KVQSKVNLKY

SEQ ID NO: 41233 - protein, 10 aa, Homo Sapiens
KVRAVIGSTY

SEQ ID NO: 41234 - protein, 10 aa, Homo Sapiens
KVRSPGQDKL

SEQ ID NO: 41235 - protein, 10 aa, Homo Sapiens
KVRVDLPDKY

SEQ ID NO: 41236 - protein, 10 aa, Homo Sapiens
KVVDRIFSLY

SEQ ID NO: 41237 - protein, 10 aa, Homo Sapiens
KVVDRIYSLY

SEQ ID NO: 41238 - protein, 10 aa, Homo Sapiens
KVVIVDESHY

SEQ ID NO: 41239 - protein, 10 aa, Homo Sapiens
KVVQVYRKKY

SEQ ID NO: 41240 - protein, 10 aa, Homo Sapiens
KVYDDMAFRY

SEQ ID NO: 41241 - protein, 10 aa, Homo Sapiens
KYAPAEGNRY

SEQ ID NO: 41242 - protein, 10 aa, Homo Sapiens
KYISLIYTNY

SEQ ID NO: 41243 - protein, 10 aa, Homo Sapiens
KYKPFKGVKY

SEQ ID NO: 41244 - protein, 10 aa, Homo Sapiens
KYLEPLYNDY

SEQ ID NO: 41245 - protein, 10 aa, Homo Sapiens
KYLGSVDSKY

SEQ ID NO: 41246 - protein, 10 aa, Homo Sapiens
KYLPHSAGRY

SEQ ID NO: 41247 - protein, 10 aa, Homo Sapiens
KYMPDLTPQY

SEQ ID NO: 41248 - protein, 10 aa, Homo Sapiens
KYNPWWTDKY

SEQ ID NO: 41249 - protein, 10 aa, Homo Sapiens
KYYTGNYDQY

SEQ ID NO: 41250 - protein, 10 aa, Homo Sapiens
LEPGTMDSVR

SEQ ID NO: 41251 - protein, 10 aa, Homo Sapiens
LFRDYVESHY

SEQ ID NO: 41252 - protein, 10 aa, Homo Sapiens
LQEFGVPHQY

SEQ ID NO: 41253 - protein, 10 aa, Homo Sapiens
LQFVGLSHQY

SEQ ID NO: 41254 - protein, 10 aa, Homo Sapiens
LQHDNIIAYY

SEQ ID NO: 41255 - protein, 10 aa, Homo Sapiens
LQHEPDRAFY

SEQ ID NO: 41256 - protein, 10 aa, Homo Sapiens
LQKGTFDSKY

SEQ ID NO: 41257 - protein, 10 aa, Homo Sapiens
LSLENGAHAY

SEQ ID NO: 41258 - protein, 10 aa, Homo Sapiens
LTKVVQNDAY

SEQ ID NO: 41259 - protein, 10 aa, Homo Sapiens
LTRELAEDGY

SEQ ID NO: 41260 - protein, 10 aa, Homo Sapiens
LVQALGAHLY

SEQ ID NO: 41261 - protein, 10 aa, Homo Sapiens
MIKKIADDKY

SEQ ID NO: 41262 - protein, 10 aa, Homo Sapiens
MLAKTGVHHY

SEQ ID NO: 41263 - protein, 10 aa, Homo Sapiens
MMKKLWGDRY

SEQ ID NO: 41264 - protein, 10 aa, Homo Sapiens
MPGFAPLTSR

SEQ ID NO: 41265 - protein, 10 aa, Homo Sapiens
MSKPQTSGAY

SEQ ID NO: 41266 - protein, 10 aa, Homo Sapiens
NILLPPIIFY

SEQ ID NO: 41267 - protein, 10 aa, Homo Sapiens
NLNPDASYVY

SEQ ID NO: 41268 - protein, 10 aa, Homo Sapiens
NVQSDLLHKY

SEQ ID NO: 41269 - protein, 10 aa, Homo Sapiens
NVSTVLTSKY

SEQ ID NO: 41270 - protein, 10 aa, Homo Sapiens
NYKPVANHQY

SEQ ID NO: 41271 - protein, 10 aa, Homo Sapiens
PIRDVLHHIY

SEQ ID NO: 41272 - protein, 10 aa, Homo Sapiens
PTMKDFNHSY

SEQ ID NO: 41273 - protein, 10 aa, Homo Sapiens
QAWPPMKSEY

SEQ ID NO: 41274 - protein, 10 aa, Homo Sapiens
QIYDRQGATY

SEQ ID NO: 41275 - protein, 10 aa, Homo Sapiens
QQMNSFLSRY

SEQ ID NO: 41276 - protein, 10 aa, Homo Sapiens
QQVQQVAAEY

SEQ ID NO: 41277 - protein, 10 aa, Homo Sapiens
QSLEQVFSKY

SEQ ID NO: 41278 - protein, 10 aa, Homo Sapiens
QSLYIANHAY

SEQ ID NO: 41279 - protein, 10 aa, Homo Sapiens
QVNDAFTHVY

SEQ ID NO: 41280 - protein, 10 aa, Homo Sapiens
RAADLVEALY

SEQ ID NO: 41281 - protein, 10 aa, Homo Sapiens
RAASTARHLY

SEQ ID NO: 41282 - protein, 10 aa, Homo Sapiens
RAFGVPVRTY

SEQ ID NO: 41283 - protein, 10 aa, Homo Sapiens
RAIQPDAGYY

SEQ ID NO: 41284 - protein, 10 aa, Homo Sapiens
RAITETHAFY

SEQ ID NO: 41285 - protein, 10 aa, Homo Sapiens
RAKIPLGFYY

SEQ ID NO: 41286 - protein, 10 aa, Homo Sapiens
RAKSVPSHTY

SEQ ID NO: 41287 - protein, 10 aa, Homo Sapiens
RAQPVPAHVY

SEQ ID NO: 41288 - protein, 10 aa, Homo Sapiens
RATGHPFVQY

SEQ ID NO: 41289 - protein, 10 aa, Homo Sapiens
RAVDLMTHNY

SEQ ID NO: 41290 - protein, 10 aa, Homo Sapiens
RAWKGIAHKY

SEQ ID NO: 41291 - protein, 10 aa, Homo Sapiens
REWAIKKHLY

SEQ ID NO: 41292 - protein, 10 aa, Homo Sapiens
RFIPSAYPYY

SEQ ID NO: 41293 - protein, 10 aa, Homo Sapiens
RFKEPHAVFY

SEQ ID NO: 41294 - protein, 10 aa, Homo Sapiens
RFMEQVIFKY

SEQ ID NO: 41295 - protein, 10 aa, Homo Sapiens
RFPHLLAHTY

SEQ ID NO: 41296 - protein, 10 aa, Homo Sapiens
RFQFLPHAYY

SEQ ID NO: 41297 - protein, 10 aa, Homo Sapiens
RFSEPHARFY

SEQ ID NO: 41298 - protein, 10 aa, Homo Sapiens
RFWDIKSKYF

SEQ ID NO: 41299 - protein, 10 aa, Homo Sapiens
RFYDLSSKYY

SEQ ID NO: 41300 - protein, 10 aa, Homo Sapiens
RGLSSLDRKY

SEQ ID NO: 41301 - protein, 10 aa, Homo Sapiens
RGWGEGDFVY

SEQ ID NO: 41302 - protein, 10 aa, Homo Sapiens
RGYDRGYDRY

SEQ ID NO: 41303 - protein, 10 aa, Homo Sapiens
RHKFPDEDSY

SEQ ID NO: 41304 - protein, 10 aa, Homo Sapiens
RIFDRAVAAY

SEQ ID NO: 41305 - protein, 10 aa, Homo Sapiens
RIIAEPGRYY

SEQ ID NO: 41306 - protein, 10 aa, Homo Sapiens
RIIETPPHRY

SEQ ID NO: 41307 - protein, 10 aa, Homo Sapiens
RIISDLCKLY

SEQ ID NO: 41308 - protein, 10 aa, Homo Sapiens
RIKGDWIGLY

SEQ ID NO: 41309 - protein, 10 aa, Homo Sapiens
RIKLGDYHFY

SEQ ID NO: 41310 - protein, 10 aa, Homo Sapiens
RIKNPEGGLY

SEQ ID NO: 41311 - protein, 10 aa, Homo Sapiens
RIKPVEEVKY

SEQ ID NO: 41312 - protein, 10 aa, Homo Sapiens
RIKQFLQSRY

SEQ ID NO: 41313 - protein, 10 aa, Homo Sapiens
RILGGLLSAY

SEQ ID NO: 41314 - protein, 10 aa, Homo Sapiens
RILPKCRTSY

SEQ ID NO: 41315 - protein, 10 aa, Homo Sapiens
RILPNFNASY

SEQ ID NO: 41316 - protein, 10 aa, Homo Sapiens
RILTVEDHYY

SEQ ID NO: 41317 - protein, 10 aa, Homo Sapiens
RIMDPYKASY

SEQ ID NO: 41318 - protein, 10 aa, Homo Sapiens
RIMDSSQNAY

SEQ ID NO: 41319 - protein, 10 aa, Homo Sapiens
RIRDLLYEQY

SEQ ID NO: 41320 - protein, 10 aa, Homo Sapiens
RISPTFADAY

SEQ ID NO: 41321 - protein, 10 aa, Homo Sapiens
RITEYMEHVY

SEQ ID NO: 41322 - protein, 10 aa, Homo Sapiens
RIVTYHRHLY

SEQ ID NO: 41323 - protein, 10 aa, Homo Sapiens
RLAAKLLAKY

SEQ ID NO: 41324 - protein, 10 aa, Homo Sapiens
RLAHEVGWKY

SEQ ID NO: 41325 - protein, 10 aa, Homo Sapiens
RLCDKTGWSY

SEQ ID NO: 41326 - protein, 10 aa, Homo Sapiens
RLCEPKEASY

SEQ ID NO: 41327 - protein, 10 aa, Homo Sapiens
RLHKATLRHY

SEQ ID NO: 41328 - protein, 10 aa, Homo Sapiens
RLKPDFIDGY

SEQ ID NO: 41329 - protein, 10 aa, Homo Sapiens
RLMKYGGHGY

SEQ ID NO: 41330 - protein, 10 aa, Homo Sapiens
RLPNVHGRSY

SEQ ID NO: 41331 - protein, 10 aa, Homo Sapiens
RLQDLVSPVY

SEQ ID NO: 41332 - protein, 10 aa, Homo Sapiens
RLQDQGLILY

SEQ ID NO: 41333 - protein, 10 aa, Homo Sapiens
RLQEGYDHSY

SEQ ID NO: 41334 - protein, 10 aa, Homo Sapiens
RLQETSSQSY

SEQ ID NO: 41335 - protein, 10 aa, Homo Sapiens
RLQEVLNDYY

SEQ ID NO: 41336 - protein, 10 aa, Homo Sapiens
RLQGISFGMY

SEQ ID NO: 41337 - protein, 10 aa, Homo Sapiens
RLQPLTQAAY

SEQ ID NO: 41338 - protein, 10 aa, Homo Sapiens
RLSDLLDWKY

SEQ ID NO: 41339 - protein, 10 aa, Homo Sapiens
RLVNEVYHMY

SEQ ID NO: 41340 - protein, 10 aa, Homo Sapiens
RLVPYGNHSY

SEQ ID NO: 41341 - protein, 10 aa, Homo Sapiens
RLYHEADKTY

SEQ ID NO: 41342 - protein, 10 aa, Homo Sapiens
RMADDLNAQY

SEQ ID NO: 41343 - protein, 10 aa, Homo Sapiens
RMHQAIERFY

SEQ ID NO: 41344 - protein, 10 aa, Homo Sapiens
RMKENQKHIY

SEQ ID NO: 41345 - protein, 10 aa, Homo Sapiens
RMKETQKSIY

SEQ ID NO: 41346 - protein, 10 aa, Homo Sapiens
RMKNIGVMNY

SEQ ID NO: 41347 - protein, 10 aa, Homo Sapiens
RMKTGNKIRY

SEQ ID NO: 41348 - protein, 10 aa, Homo Sapiens
RMMEAFAQRY

SEQ ID NO: 41349 - protein, 10 aa, Homo Sapiens
RMNSDCWYLY

SEQ ID NO: 41350 - protein, 10 aa, Homo Sapiens
RMPVSSQHRY

SEQ ID NO: 41351 - protein, 10 aa, Homo Sapiens
RMQGLEAHKY

SEQ ID NO: 41352 - protein, 10 aa, Homo Sapiens
RMSDVVKGVY

SEQ ID NO: 41353 - protein, 10 aa, Homo Sapiens
RNQDFMNVYY

SEQ ID NO: 41354 - protein, 10 aa, Homo Sapiens
RNQPMALSLY

SEQ ID NO: 41355 - protein, 10 aa, Homo Sapiens
RQALPQVRLY

SEQ ID NO: 41356 - protein, 10 aa, Homo Sapiens
RQAPVLLQTY

SEQ ID NO: 41357 - protein, 10 aa, Homo Sapiens
RQASRAFSLY

SEQ ID NO: 41358 - protein, 10 aa, Homo Sapiens
RQEEGVFGFY

SEQ ID NO: 41359 - protein, 10 aa, Homo Sapiens
RQFGPYRLNY

SEQ ID NO: 41360 - protein, 10 aa, Homo Sapiens
RQFWFQGNRY

SEQ ID NO: 41361 - protein, 10 aa, Homo Sapiens
RQHMDHRHWY

SEQ ID NO: 41362 - protein, 10 aa, Homo Sapiens
RQHSIYKNGY

SEQ ID NO: 41363 - protein, 10 aa, Homo Sapiens
RQHVFLVSEY

SEQ ID NO: 41364 - protein, 10 aa, Homo Sapiens
RQITQVYGFY

SEQ ID NO: 41365 - protein, 10 aa, Homo Sapiens
RQKHEIESLY

SEQ ID NO: 41366 - protein, 10 aa, Homo Sapiens
RQKPVDLLKY

SEQ ID NO: 41367 - protein, 10 aa, Homo Sapiens
RQKQGVVLKY

SEQ ID NO: 41368 - protein, 10 aa, Homo Sapiens
RQLAHIYHYY

SEQ ID NO: 41369 - protein, 10 aa, Homo Sapiens
RQLDIKKSSY

SEQ ID NO: 41370 - protein, 10 aa, Homo Sapiens
RQLEDILSTY

SEQ ID NO: 41371 - protein, 10 aa, Homo Sapiens
RQMKNIVHNY

SEQ ID NO: 41372 - protein, 10 aa, Homo Sapiens
RQMVEHGGFY

SEQ ID NO: 41373 - protein, 10 aa, Homo Sapiens
RQNALGHVRY

SEQ ID NO: 41374 - protein, 10 aa, Homo Sapiens
RQPDKGEHSY

SEQ ID NO: 41375 - protein, 10 aa, Homo Sapiens
RQPDNAKALY

SEQ ID NO: 41376 - protein, 10 aa, Homo Sapiens
RQPDSPTALY

SEQ ID NO: 41377 - protein, 10 aa, Homo Sapiens
RQQASILSQY

SEQ ID NO: 41378 - protein, 10 aa, Homo Sapiens
RQQEGFKPNY

SEQ ID NO: 41379 - protein, 10 aa, Homo Sapiens
RQQFPYGASY

SEQ ID NO: 41380 - protein, 10 aa, Homo Sapiens
RQQGRYAPSY

SEQ ID NO: 41381 - protein, 10 aa, Homo Sapiens
RQQVPTRKDY

SEQ ID NO: 41382 - protein, 10 aa, Homo Sapiens
RQRICEEAAY

SEQ ID NO: 41383 - protein, 10 aa, Homo Sapiens
RQYEGHVNEY

SEQ ID NO: 41384 - protein, 10 aa, Homo Sapiens
RQYEGPLHHY

SEQ ID NO: 41385 - protein, 10 aa, Homo Sapiens
RQYGQTVATY

SEQ ID NO: 41386 - protein, 10 aa, Homo Sapiens
RQYPDLETKY

SEQ ID NO: 41387 - protein, 10 aa, Homo Sapiens
RSARHFLHHY

SEQ ID NO: 41388 - protein, 10 aa, Homo Sapiens
RSFAGNLNTY

SEQ ID NO: 41389 - protein, 10 aa, Homo Sapiens
RSGDFTTSSY

SEQ ID NO: 41390 - protein, 10 aa, Homo Sapiens
RSIALTQARY

SEQ ID NO: 41391 - protein, 10 aa, Homo Sapiens
RSLSDLFRRY

SEQ ID NO: 41392 - protein, 10 aa, Homo Sapiens
RSMHPELMKY

SEQ ID NO: 41393 - protein, 10 aa, Homo Sapiens
RSNTQPGFSY

SEQ ID NO: 41394 - protein, 10 aa, Homo Sapiens
RSRPDLMDNY

SEQ ID NO: 41395 - protein, 10 aa, Homo Sapiens
RSWAIHTGRY

SEQ ID NO: 41396 - protein, 10 aa, Homo Sapiens
RTAQNLHNSY

SEQ ID NO: 41397 - protein, 10 aa, Homo Sapiens
RTFAADHNYL

SEQ ID NO: 41398 - protein, 10 aa, Homo Sapiens
RTGFFGNALY

SEQ ID NO: 41399 - protein, 10 aa, Homo Sapiens
RTGGMAFHSY

SEQ ID NO: 41400 - protein, 10 aa, Homo Sapiens
RTIQTAFRQY

SEQ ID NO: 41401 - protein, 10 aa, Homo Sapiens
RTKDAGLGVY

SEQ ID NO: 41402 - protein, 10 aa, Homo Sapiens
RTKDIEDVFY

SEQ ID NO: 41403 - protein, 10 aa, Homo Sapiens
RTKEVVFNCY

SEQ ID NO: 41404 - protein, 10 aa, Homo Sapiens
RTKQPIPAAY

SEQ ID NO: 41405 - protein, 10 aa, Homo Sapiens
RTKSAGLDLY

SEQ ID NO: 41406 - protein, 10 aa, Homo Sapiens
RTKYNLYLNY

SEQ ID NO: 41407 - protein, 10 aa, Homo Sapiens
RTLRDIETFY

SEQ ID NO: 41408 - protein, 10 aa, Homo Sapiens
RTRIPYKPNY

SEQ ID NO: 41409 - protein, 10 aa, Homo Sapiens
RTVGEIMWGY

SEQ ID NO: 41410 - protein, 10 aa, Homo Sapiens
RTWQALAHEY

SEQ ID NO: 41411 - protein, 10 aa, Homo Sapiens
RTYSQGDCSY

SEQ ID NO: 41412 - protein, 10 aa, Homo Sapiens
RVAAILQGVY

SEQ ID NO: 41413 - protein, 10 aa, Homo Sapiens
RVADRLYGVY

SEQ ID NO: 41414 - protein, 10 aa, Homo Sapiens
RVAEVWMDEY

SEQ ID NO: 41415 - protein, 10 aa, Homo Sapiens
RVANILINLY

SEQ ID NO: 41416 - protein, 10 aa, Homo Sapiens
RVEELERWVY

SEQ ID NO: 41417 - protein, 10 aa, Homo Sapiens
RVFDHKQGTY

SEQ ID NO: 41418 - protein, 10 aa, Homo Sapiens
RVFDKDGNGY

SEQ ID NO: 41419 - protein, 10 aa, Homo Sapiens
RVFEGPYKEY

SEQ ID NO: 41420 - protein, 10 aa, Homo Sapiens
RVFYALSNKY

SEQ ID NO: 41421 - protein, 10 aa, Homo Sapiens
RVIGAKKDQY

SEQ ID NO: 41422 - protein, 10 aa, Homo Sapiens
RVITISKSEY

SEQ ID NO: 41423 - protein, 10 aa, Homo Sapiens
RVIVGGSSEY

SEQ ID NO: 41424 - protein, 10 aa, Homo Sapiens
RVKELLVDCY

SEQ ID NO: 41425 - protein, 10 aa, Homo Sapiens
RVKEPSQDTV

SEQ ID NO: 41426 - protein, 10 aa, Homo Sapiens
RVKPAVFDLL

SEQ ID NO: 41427 - protein, 10 aa, Homo Sapiens
RVKTPTSQSY

SEQ ID NO: 41428 - protein, 10 aa, Homo Sapiens
RVLCYLIHHY

SEQ ID NO: 41429 - protein, 10 aa, Homo Sapiens
RVLDELKHYY

SEQ ID NO: 41430 - protein, 10 aa, Homo Sapiens
RVLKKQDAFY

SEQ ID NO: 41431 - protein, 10 aa, Homo Sapiens
RVLPRSNMVY

SEQ ID NO: 41432 - protein, 10 aa, Homo Sapiens
RVLYNLFTKY

SEQ ID NO: 41433 - protein, 10 aa, Homo Sapiens
RVMDVPGLYC

SEQ ID NO: 41434 - protein, 10 aa, Homo Sapiens
RVMEHFIKLY

SEQ ID NO: 41435 - protein, 10 aa, Homo Sapiens
RVMGDRSVLY

SEQ ID NO: 41436 - protein, 10 aa, Homo Sapiens
RVMHQIISKY

SEQ ID NO: 41437 - protein, 10 aa, Homo Sapiens
RVMTVSFHKY

SEQ ID NO: 41438 - protein, 10 aa, Homo Sapiens
RVNAAFAARY

SEQ ID NO: 41439 - protein, 10 aa, Homo Sapiens
RVNNSLDHEY

SEQ ID NO: 41440 - protein, 10 aa, Homo Sapiens
RVPFIYGHKY

SEQ ID NO: 41441 - protein, 10 aa, Homo Sapiens
RVQKSKLSLY

SEQ ID NO: 41442 - protein, 10 aa, Homo Sapiens
RVQNLLGHYL

SEQ ID NO: 41443 - protein, 10 aa, Homo Sapiens
RVRELYRAWY

SEQ ID NO: 41444 - protein, 10 aa, Homo Sapiens
RVRLKGFEKY

SEQ ID NO: 41445 - protein, 10 aa, Homo Sapiens
RVSNFKPGVY

SEQ ID NO: 41446 - protein, 10 aa, Homo Sapiens
RVVEDLINHY

SEQ ID NO: 41447 - protein, 10 aa, Homo Sapiens
RVVEGNHMVY

SEQ ID NO: 41448 - protein, 10 aa, Homo Sapiens
RVVEGNHTVY

SEQ ID NO: 41449 - protein, 10 aa, Homo Sapiens
RVWDYAGDNY

SEQ ID NO: 41450 - protein, 10 aa, Homo Sapiens
RVYIFDYGQY

SEQ ID NO: 41451 - protein, 10 aa, Homo Sapiens
RVYLATERRY

SEQ ID NO: 41452 - protein, 10 aa, Homo Sapiens
RVYNIYIRRY

SEQ ID NO: 41453 - protein, 10 aa, Homo Sapiens
RVYSDLHAFY

SEQ ID NO: 41454 - protein, 10 aa, Homo Sapiens
RWMEKELGLY

SEQ ID NO: 41455 - protein, 10 aa, Homo Sapiens
RWYPDLESKY

SEQ ID NO: 41456 - protein, 10 aa, Homo Sapiens
RYHRKENLEY

SEQ ID NO: 41457 - protein, 10 aa, Homo Sapiens
RYIDEYRNDY

SEQ ID NO: 41458 - protein, 10 aa, Homo Sapiens
RYIDISKCHY

SEQ ID NO: 41459 - protein, 10 aa, Homo Sapiens
RYISWTEQNY

SEQ ID NO: 41460 - protein, 10 aa, Homo Sapiens
RYKDILPYDY

SEQ ID NO: 41461 - protein, 10 aa, Homo Sapiens
RYLAVVHAVY

SEQ ID NO: 41462 - protein, 10 aa, Homo Sapiens
RYLEQLHQLY

SEQ ID NO: 41463 - protein, 10 aa, Homo Sapiens
RYMDDYIFTY

SEQ ID NO: 41464 - protein, 10 aa, Homo Sapiens
RYMELYTHVY

SEQ ID NO: 41465 - protein, 10 aa, Homo Sapiens
RYNVPNSAIY

SEQ ID NO: 41466 - protein, 10 aa, Homo Sapiens
RYPDNLKHLY

SEQ ID NO: 41467 - protein, 10 aa, Homo Sapiens
RYQTFVNFNY

SEQ ID NO: 41468 - protein, 10 aa, Homo Sapiens
RYRDGYRDGY

SEQ ID NO: 41469 - protein, 10 aa, Homo Sapiens
RYSDVHNCSY

SEQ ID NO: 41470 - protein, 10 aa, Homo Sapiens
RYTDVSTRYK

SEQ ID NO: 41471 - protein, 10 aa, Homo Sapiens
RYYDSRPGGY

SEQ ID NO: 41472 - protein, 10 aa, Homo Sapiens
SAAEAIQAVR

SEQ ID NO: 41473 - protein, 10 aa, Homo Sapiens
SARAAGYDLY

SEQ ID NO: 41474 - protein, 10 aa, Homo Sapiens
SASDHPIASY

SEQ ID NO: 41475 - protein, 10 aa, Homo Sapiens
SASPIFTHVY

SEQ ID NO: 41476 - protein, 10 aa, Homo Sapiens
SEDIPLNLSR

SEQ ID NO: 41477 - protein, 10 aa, Homo Sapiens
SFFGETSHNY

SEQ ID NO: 41478 - protein, 10 aa, Homo Sapiens
SFLPGNFHFY

SEQ ID NO: 41479 - protein, 10 aa, Homo Sapiens
SFQAILDHTY

SEQ ID NO: 41480 - protein, 10 aa, Homo Sapiens
SFRPLYTHEY

SEQ ID NO: 41481 - protein, 10 aa, Homo Sapiens
SGKNVGYAKY

SEQ ID NO: 41482 - protein, 10 aa, Homo Sapiens
SGQAHAGHYY

SEQ ID NO: 41483 - protein, 10 aa, Homo Sapiens
SGQASGGHYY

SEQ ID NO: 41484 - protein, 10 aa, Homo Sapiens
SHGGIPPHKY

SEQ ID NO: 41485 - protein, 10 aa, Homo Sapiens
SIERLPLHLY

SEQ ID NO: 41486 - protein, 10 aa, Homo Sapiens
SIFQSHCHYY

SEQ ID NO: 41487 - protein, 10 aa, Homo Sapiens
SIMTRGNAKY

SEQ ID NO: 41488 - protein, 10 aa, Homo Sapiens
SIRPDNMSEY

SEQ ID NO: 41489 - protein, 10 aa, Homo Sapiens
SIYRGPSHTY

SEQ ID NO: 41490 - protein, 10 aa, Homo Sapiens
SLSGKTPHLY

SEQ ID NO: 41491 - protein, 10 aa, Homo Sapiens
SMHALLVNHY

SEQ ID NO: 41492 - protein, 10 aa, Homo Sapiens
SQGGHILAFY

SEQ ID NO: 41493 - protein, 10 aa, Homo Sapiens
SQKLGLFHHY

SEQ ID NO: 41494 - protein, 10 aa, Homo Sapiens
SQKVIAHSEY

SEQ ID NO: 41495 - protein, 10 aa, Homo Sapiens
SQSPAYNSQY

SEQ ID NO: 41496 - protein, 10 aa, Homo Sapiens
SSIPVPTHYY

SEQ ID NO: 41497 - protein, 10 aa, Homo Sapiens
SSKSGERHLY

SEQ ID NO: 41498 - protein, 10 aa, Homo Sapiens
SSLENVDSRY

SEQ ID NO: 41499 - protein, 10 aa, Homo Sapiens
SSNPYPNFNF

SEQ ID NO: 41500 - protein, 10 aa, Homo Sapiens
SSNRQVLHFY

SEQ ID NO: 41501 - protein, 10 aa, Homo Sapiens
SSQGRPSSMY

SEQ ID NO: 41502 - protein, 10 aa, Homo Sapiens
SSSALCSHLY

SEQ ID NO: 41503 - protein, 10 aa, Homo Sapiens
SSSGYPEPKY

SEQ ID NO: 41504 - protein, 10 aa, Homo Sapiens
SSSGYSNSRY

SEQ ID NO: 41505 - protein, 10 aa, Homo Sapiens
SSSSLSSHRY

SEQ ID NO: 41506 - protein, 10 aa, Homo Sapiens
STAKSATWTY

SEQ ID NO: 41507 - protein, 10 aa, Homo Sapiens
STIDMSCAKY

SEQ ID NO: 41508 - protein, 10 aa, Homo Sapiens
STLARLPHLY

SEQ ID NO: 41509 - protein, 10 aa, Homo Sapiens
STMGKPQRLY

SEQ ID NO: 41510 - protein, 10 aa, Homo Sapiens
STVIPNSHVY

SEQ ID NO: 41511 - protein, 10 aa, Homo Sapiens
SVKAEMLHMY

SEQ ID NO: 41512 - protein, 10 aa, Homo Sapiens
SVNGERLGTY

SEQ ID NO: 41513 - protein, 10 aa, Homo Sapiens
SVRPCFMDEY

SEQ ID NO: 41514 - protein, 10 aa, Homo Sapiens
SVSTVLTSKY

SEQ ID NO: 41515 - protein, 10 aa, Homo Sapiens
SYIPFRDAAY

SEQ ID NO: 41516 - protein, 10 aa, Homo Sapiens
SYLQPGQDGY

SEQ ID NO: 41517 - protein, 10 aa, Homo Sapiens
SYVGDEAQSK

SEQ ID NO: 41518 - protein, 10 aa, Homo Sapiens
TAASSSSLEK

SEQ ID NO: 41519 - protein, 10 aa, Homo Sapiens
TFIAIKPDGV

SEQ ID NO: 41520 - protein, 10 aa, Homo Sapiens
TFKEQGNAYY

SEQ ID NO: 41521 - protein, 10 aa, Homo Sapiens
TGIESSSHKY

SEQ ID NO: 41522 - protein, 10 aa, Homo Sapiens
TIFSPEGRLY

SEQ ID NO: 41523 - protein, 10 aa, Homo Sapiens
TLNEAIMHQY

SEQ ID NO: 41524 - protein, 10 aa, Homo Sapiens
TLQVNGRHEY

SEQ ID NO: 41525 - protein, 10 aa, Homo Sapiens
TLRSEGFDTY

SEQ ID NO: 41526 - protein, 10 aa, Homo Sapiens
TMSGVTTSLR

SEQ ID NO: 41527 - protein, 10 aa, Homo Sapiens
TQKIPDQDFY

SEQ ID NO: 41528 - protein, 10 aa, Homo Sapiens
TQLLKLAHKY

SEQ ID NO: 41529 - protein, 10 aa, Homo Sapiens
TQQMAGMNFY

SEQ ID NO: 41530 - protein, 10 aa, Homo Sapiens
TQRVSCAHIY

SEQ ID NO: 41531 - protein, 10 aa, Homo Sapiens
TSKDYYFDSY

SEQ ID NO: 41532 - protein, 10 aa, Homo Sapiens
TSNPLASHDY

SEQ ID NO: 41533 - protein, 10 aa, Homo Sapiens
TTKVGPNATY

SEQ ID NO: 41534 - protein, 10 aa, Homo Sapiens
TVFDKLNHEY

SEQ ID NO: 41535 - protein, 10 aa, Homo Sapiens
TVKALISHLY

SEQ ID NO: 41536 - protein, 10 aa, Homo Sapiens
TVLKALKSGY

SEQ ID NO: 41537 - protein, 10 aa, Homo Sapiens
TVNDLSMMKY

SEQ ID NO: 41538 - protein, 10 aa, Homo Sapiens
TVWNVEEHRY

SEQ ID NO: 41539 - protein, 10 aa, Homo Sapiens
TYQGDKVAAY

SEQ ID NO: 41540 - protein, 10 aa, Homo Sapiens
VAPEEHPVLL

SEQ ID NO: 41541 - protein, 10 aa, Homo Sapiens
VFTEPNRHFY

SEQ ID NO: 41542 - protein, 10 aa, Homo Sapiens
VGLPFSSHTY

SEQ ID NO: 41543 - protein, 10 aa, Homo Sapiens
VIFAGGQDRY

SEQ ID NO: 41544 - protein, 10 aa, Homo Sapiens
VLIAQPDHSY

SEQ ID NO: 41545 - protein, 10 aa, Homo Sapiens
VLKPNIISYY

SEQ ID NO: 41546 - protein, 10 aa, Homo Sapiens
VLNKLGGVKY

SEQ ID NO: 41547 - protein, 10 aa, Homo Sapiens
VMADPKGKAY

SEQ ID NO: 41548 - protein, 10 aa, Homo Sapiens
VNDPRPQHKY

SEQ ID NO: 41549 - protein, 10 aa, Homo Sapiens
VQFIGRESKY

SEQ ID NO: 41550 - protein, 10 aa, Homo Sapiens
VQFQDVSFAY

SEQ ID NO: 41551 - protein, 10 aa, Homo Sapiens
VQFVGREAKY

SEQ ID NO: 41552 - protein, 10 aa, Homo Sapiens
VQHGVEGLTY

SEQ ID NO: 41553 - protein, 10 aa, Homo Sapiens
VQITEARCFY

SEQ ID NO: 41554 - protein, 10 aa, Homo Sapiens
VQKKDTGHIY

SEQ ID NO: 41555 - protein, 10 aa, Homo Sapiens
VQKKDTGHVY

SEQ ID NO: 41556 - protein, 10 aa, Homo Sapiens
VQKPDAANYY

SEQ ID NO: 41557 - protein, 10 aa, Homo Sapiens
VQQPGQTNFY

SEQ ID NO: 41558 - protein, 10 aa, Homo Sapiens
VQVTPLSSGY

SEQ ID NO: 41559 - protein, 10 aa, Homo Sapiens
VTRPDSGHLY

SEQ ID NO: 41560 - protein, 10 aa, Homo Sapiens
VTYNKVLHFY

SEQ ID NO: 41561 - protein, 10 aa, Homo Sapiens
VVHDIPSGSY

SEQ ID NO: 41562 - protein, 10 aa, Homo Sapiens
VVIKDIFRKY

SEQ ID NO: 41563 - protein, 10 aa, Homo Sapiens
VVLLVINHKY

SEQ ID NO: 41564 - protein, 10 aa, Homo Sapiens
VVNILAQALY

SEQ ID NO: 41565 - protein, 10 aa, Homo Sapiens
VVVAVGRALY

SEQ ID NO: 41566 - protein, 10 aa, Homo Sapiens
VVVGGLNTHY

SEQ ID NO: 41567 - protein, 10 aa, Homo Sapiens
VVVKITGHFY

SEQ ID NO: 41568 - protein, 10 aa, Homo Sapiens
VYKSPASDTY

SEQ ID NO: 41569 - protein, 10 aa, Homo Sapiens
YQFYGPSGQY

SEQ ID NO: 41570 - protein, 10 aa, Homo Sapiens
YQKPIIQSEY

SEQ ID NO: 41571 - protein, 10 aa, Homo Sapiens
YYYDPTTGLY

SEQ ID NO: 41572 - protein, 11 aa, Homo Sapiens
AAKPWTKDHHY

SEQ ID NO: 41573 - protein, 11 aa, Homo Sapiens
AAQLHTLLGLY

SEQ ID NO: 41574 - protein, 11 aa, Homo Sapiens
AGFGESRCEAY

SEQ ID NO: 41575 - protein, 11 aa, Homo Sapiens
AIKGPELMNKY

SEQ ID NO: 41576 - protein, 11 aa, Homo Sapiens
AIKKPSGDDRY

SEQ ID NO: 41577 - protein, 11 aa, Homo Sapiens
ALDPKSTGRKY

SEQ ID NO: 41578 - protein, 11 aa, Homo Sapiens
ALKVPVPEDKY

SEQ ID NO: 41579 - protein, 11 aa, Homo Sapiens
ALLDPSQKNLY

SEQ ID NO: 41580 - protein, 11 aa, Homo Sapiens
ALNPHCKFHIY

SEQ ID NO: 41581 - protein, 11 aa, Homo Sapiens
ALRPSTSRSLY

SEQ ID NO: 41582 - protein, 11 aa, Homo Sapiens
ALRSDDSEHKY

SEQ ID NO: 41583 - protein, 11 aa, Homo Sapiens
AMIIPQCSHNY

SEQ ID NO: 41584 - protein, 11 aa, Homo Sapiens
AMLAKTGVHHY

SEQ ID NO: 41585 - protein, 11 aa, Homo Sapiens
AMRAADQFDIY

SEQ ID NO: 41586 - protein, 11 aa, Homo Sapiens
AQCPGFGAARY

SEQ ID NO: 41587 - protein, 11 aa, Homo Sapiens
AQFPGACGLRY

SEQ ID NO: 41588 - protein, 11 aa, Homo Sapiens
AQKTPSRLENY

SEQ ID NO: 41589 - protein, 11 aa, Homo Sapiens
AQQISDEASRY

SEQ ID NO: 41590 - protein, 11 aa, Homo Sapiens
AQQVQQVAAEY

SEQ ID NO: 41591 - protein, 11 aa, Homo Sapiens
AQYPPATYDQY

SEQ ID NO: 41592 - protein, 11 aa, Homo Sapiens
AQYQFTGIKKY

SEQ ID NO: 41593 - protein, 11 aa, Homo Sapiens
ASCSAALRAVY

SEQ ID NO: 41594 - protein, 11 aa, Homo Sapiens
ASISSGTHGQY

SEQ ID NO: 41595 - protein, 11 aa, Homo Sapiens
ASKYGRDWERY

SEQ ID NO: 41596 - protein, 11 aa, Homo Sapiens
ASLTVRNLPQY

SEQ ID NO: 41597 - protein, 11 aa, Homo Sapiens
ASMPRDIYQDY

SEQ ID NO: 41598 - protein, 11 aa, Homo Sapiens
ASQGGHILAFY

SEQ ID NO: 41599 - protein, 11 aa, Homo Sapiens
ASVPHSIINGY

SEQ ID NO: 41600 - protein, 11 aa, Homo Sapiens
ASYPGASVDNY

SEQ ID NO: 41601 - protein, 11 aa, Homo Sapiens
ATAAALTYGLY

SEQ ID NO: 41602 - protein, 11 aa, Homo Sapiens
ATKGPSYEDLY

SEQ ID NO: 41603 - protein, 11 aa, Homo Sapiens
ATLDAVKFSQY

SEQ ID NO: 41604 - protein, 11 aa, Homo Sapiens
ATQAQIKAAYY

SEQ ID NO: 41605 - protein, 11 aa, Homo Sapiens
ATQLLKLAHKY

SEQ ID NO: 41606 - protein, 11 aa, Homo Sapiens
ATQPGTTILQY

SEQ ID NO: 41607 - protein, 11 aa, Homo Sapiens
AVALPQLLAKY

SEQ ID NO: 41608 - protein, 11 aa, Homo Sapiens
AVIAKENYPLY

SEQ ID NO: 41609 - protein, 11 aa, Homo Sapiens
AVKDLDIIDNY

SEQ ID NO: 41610 - protein, 11 aa, Homo Sapiens
AVKELELAHRY

SEQ ID NO: 41611 - protein, 11 aa, Homo Sapiens
AVKIVKNVDRY

SEQ ID NO: 41612 - protein, 11 aa, Homo Sapiens
AVLGETLIPHY

SEQ ID NO: 41613 - protein, 11 aa, Homo Sapiens
AVMESINPHKY

SEQ ID NO: 41614 - protein, 11 aa, Homo Sapiens
AVPDRMCRHNY

SEQ ID NO: 41615 - protein, 11 aa, Homo Sapiens
AVTPAGVVNKY

SEQ ID NO: 41616 - protein, 11 aa, Homo Sapiens
AWLPAYATPHF

SEQ ID NO: 41617 - protein, 11 aa, Homo Sapiens
AYGRDIVEAHY

SEQ ID NO: 41618 - protein, 11 aa, Homo Sapiens
CPEAIFQPSFL

SEQ ID NO: 41619 - protein, 11 aa, Homo Sapiens
DDDRRWKAGLY

SEQ ID NO: 41620 - protein, 11 aa, Homo Sapiens
DLEPGTMDSVR

SEQ ID NO: 41621 - protein, 11 aa, Homo Sapiens
DLEPTVIDEVR

SEQ ID NO: 41622 - protein, 11 aa, Homo Sapiens
EGYPRSDVDLY

SEQ ID NO: 41623 - protein, 11 aa, Homo Sapiens
EMNPHFGSHRY

SEQ ID NO: 41624 - protein, 11 aa, Homo Sapiens
ESWFLVEKHWY

SEQ ID NO: 41625 - protein, 11 aa, Homo Sapiens
FQAPYLLHGKY

SEQ ID NO: 41626 - protein, 11 aa, Homo Sapiens
FQHPPWGSSRY

SEQ ID NO: 41627 - protein, 11 aa, Homo Sapiens
FSKPSDLVGVF

SEQ ID NO: 41628 - protein, 11 aa, Homo Sapiens
GAKPDSTLHTY

SEQ ID NO: 41629 - protein, 11 aa, Homo Sapiens
GFKPEEIQTVY

SEQ ID NO: 41630 - protein, 11 aa, Homo Sapiens
GGYFRDQKDGY

SEQ ID NO: 41631 - protein, 11 aa, Homo Sapiens
GHYTEGAELVD

SEQ ID NO: 41632 - protein, 11 aa, Homo Sapiens
GLKHPGLILKY

SEQ ID NO: 41633 - protein, 11 aa, Homo Sapiens
GLLKPSCLPVY

SEQ ID NO: 41634 - protein, 11 aa, Homo Sapiens
GMYDSSLAAKY

SEQ ID NO: 41635 - protein, 11 aa, Homo Sapiens
GQHSQGLGGHY

SEQ ID NO: 41636 - protein, 11 aa, Homo Sapiens
GQSPLHILGQY

SEQ ID NO: 41637 - protein, 11 aa, Homo Sapiens
GSRGSSLNDTY

SEQ ID NO: 41638 - protein, 11 aa, Homo Sapiens
GTAPKENRHLY

SEQ ID NO: 41639 - protein, 11 aa, Homo Sapiens
GTGIESSSHKY

SEQ ID NO: 41640 - protein, 11 aa, Homo Sapiens
GTITPDGADVY

SEQ ID NO: 41641 - protein, 11 aa, Homo Sapiens
GTKGLSVNDFY

SEQ ID NO: 41642 - protein, 11 aa, Homo Sapiens
GTQDQIQNAQY

SEQ ID NO: 41643 - protein, 11 aa, Homo Sapiens
GTSPLHLAAQY

SEQ ID NO: 41644 - protein, 11 aa, Homo Sapiens
GTYTFPNGAKY

SEQ ID NO: 41645 - protein, 11 aa, Homo Sapiens
GVAFPHIKHNY

SEQ ID NO: 41646 - protein, 11 aa, Homo Sapiens
GVKDPDQAASY

SEQ ID NO: 41647 - protein, 11 aa, Homo Sapiens
GVKPPQNLWEY

SEQ ID NO: 41648 - protein, 11 aa, Homo Sapiens
GVNPAYPESRY

SEQ ID NO: 41649 - protein, 11 aa, Homo Sapiens
GVNPHVNHLYA

SEQ ID NO: 41650 - protein, 11 aa, Homo Sapiens
GYRHIDCAHVY

SEQ ID NO: 41651 - protein, 11 aa, Homo Sapiens
HFKEMESIDQY

SEQ ID NO: 41652 - protein, 11 aa, Homo Sapiens
HGADELLKRVY

SEQ ID NO: 41653 - protein, 11 aa, Homo Sapiens
HLFPTMPRHNY

SEQ ID NO: 41654 - protein, 11 aa, Homo Sapiens
HLNPDTELKRY

SEQ ID NO: 41655 - protein, 11 aa, Homo Sapiens
HLRQLLQEDRY

SEQ ID NO: 41656 - protein, 11 aa, Homo Sapiens
HQINPCVKKEY

SEQ ID NO: 41657 - protein, 11 aa, Homo Sapiens
HQYSSQLLPFY

SEQ ID NO: 41658 - protein, 11 aa, Homo Sapiens
HSLDDFYIGKY

SEQ ID NO: 41659 - protein, 11 aa, Homo Sapiens
HSLPGHFSSHY

SEQ ID NO: 41660 - protein, 11 aa, Homo Sapiens
HSQLEHLQSKY

SEQ ID NO: 41661 - protein, 11 aa, Homo Sapiens
HSRAPSLSASY

SEQ ID NO: 41662 - protein, 11 aa, Homo Sapiens
HSRFYDLSSKY

SEQ ID NO: 41663 - protein, 11 aa, Homo Sapiens
HTWTKESAHNY

SEQ ID NO: 41664 - protein, 11 aa, Homo Sapiens
HVRPVTQGDVY

SEQ ID NO: 41665 - protein, 11 aa, Homo Sapiens
HYFEDWGVVTY

SEQ ID NO: 41666 - protein, 11 aa, Homo Sapiens
IFKSDGLRGLY

SEQ ID NO: 41667 - protein, 11 aa, Homo Sapiens
IGYGDMVPHTY

SEQ ID NO: 41668 - protein, 11 aa, Homo Sapiens
IIRPSETAGRY

SEQ ID NO: 41669 - protein, 11 aa, Homo Sapiens
ILNVDPVQHTY

SEQ ID NO: 41670 - protein, 11 aa, Homo Sapiens
ILQADGLRGFY

SEQ ID NO: 41671 - protein, 11 aa, Homo Sapiens
IQKTEELKAKY

SEQ ID NO: 41672 - protein, 11 aa, Homo Sapiens
IQNPDITSSRY

SEQ ID NO: 41673 - protein, 11 aa, Homo Sapiens
IQQRGGEERLY

SEQ ID NO: 41674 - protein, 11 aa, Homo Sapiens
ITKPQNLNDAY

SEQ ID NO: 41675 - protein, 11 aa, Homo Sapiens
ITKSDGIRGLY

SEQ ID NO: 41676 - protein, 11 aa, Homo Sapiens
IVKNPQAYLNY

SEQ ID NO: 41677 - protein, 11 aa, Homo Sapiens
IWKLDGLRGLY

SEQ ID NO: 41678 - protein, 11 aa, Homo Sapiens
IYKSDGIKGLY

SEQ ID NO: 41679 - protein, 11 aa, Homo Sapiens
IYKYEGVRGLY

SEQ ID NO: 41680 - protein, 11 aa, Homo Sapiens
KAAEAAASAYY

SEQ ID NO: 41681 - protein, 11 aa, Homo Sapiens
KALTEPEARYY

SEQ ID NO: 41682 - protein, 11 aa, Homo Sapiens
KFKDDVMPATY

SEQ ID NO: 41683 - protein, 11 aa, Homo Sapiens
KFNPDFAEAHY

SEQ ID NO: 41684 - protein, 11 aa, Homo Sapiens
KFWVVDQTHFY

SEQ ID NO: 41685 - protein, 11 aa, Homo Sapiens
KFYGPRIGALY

SEQ ID NO: 41686 - protein, 11 aa, Homo Sapiens
KFYHLAKETGY

SEQ ID NO: 41687 - protein, 11 aa, Homo Sapiens
KFYVEDLKARY

SEQ ID NO: 41688 - protein, 11 aa, Homo Sapiens
KGIPEHLMGKL

SEQ ID NO: 41689 - protein, 11 aa, Homo Sapiens
KGKEPYSSSKY

SEQ ID NO: 41690 - protein, 11 aa, Homo Sapiens
KGKIPTLIDRM

SEQ ID NO: 41691 - protein, 11 aa, Homo Sapiens
KGNPEIDNKKY

SEQ ID NO: 41692 - protein, 11 aa, Homo Sapiens
KGWGGEDVHLY

SEQ ID NO: 41693 - protein, 11 aa, Homo Sapiens
KIADMGHLKYY

SEQ ID NO: 41694 - protein, 11 aa, Homo Sapiens
KIIDGICGRAY

SEQ ID NO: 41695 - protein, 11 aa, Homo Sapiens
KIKEAGGIDLF

SEQ ID NO: 41696 - protein, 11 aa, Homo Sapiens
KIKSELGLNFY

SEQ ID NO: 41697 - protein, 11 aa, Homo Sapiens
KIMDSGELDFY

SEQ ID NO: 41698 - protein, 11 aa, Homo Sapiens
KIRADIEVACY

SEQ ID NO: 41699 - protein, 11 aa, Homo Sapiens
KIVADQLCAKY

SEQ ID NO: 41700 - protein, 11 aa, Homo Sapiens
KLCEWMGNMNY

SEQ ID NO: 41701 - protein, 11 aa, Homo Sapiens
KLFEDGEMAKY

SEQ ID NO: 41702 - protein, 11 aa, Homo Sapiens
KLFESIQEGKY

SEQ ID NO: 41703 - protein, 11 aa, Homo Sapiens
KLKDDQTLDFY

SEQ ID NO: 41704 - protein, 11 aa, Homo Sapiens
KLLSAGATRVY

SEQ ID NO: 41705 - protein, 11 aa, Homo Sapiens
KLLSEDVKSYY

SEQ ID NO: 41706 - protein, 11 aa, Homo Sapiens
KLPDKTLIDLY

SEQ ID NO: 41707 - protein, 11 aa, Homo Sapiens
KLPGPTLWASY

SEQ ID NO: 41708 - protein, 11 aa, Homo Sapiens
KLRIQTDGDKY

SEQ ID NO: 41709 - protein, 11 aa, Homo Sapiens
KLWDGRTGKYL

SEQ ID NO: 41710 - protein, 11 aa, Homo Sapiens
KLYTKHGTLKY

SEQ ID NO: 41711 - protein, 11 aa, Homo Sapiens
KMAANIPAKRY

SEQ ID NO: 41712 - protein, 11 aa, Homo Sapiens
KMKQDAQVVLY

SEQ ID NO: 41713 - protein, 11 aa, Homo Sapiens
KMMDSGQIDFY

SEQ ID NO: 41714 - protein, 11 aa, Homo Sapiens
KMNGYISNANY

SEQ ID NO: 41715 - protein, 11 aa, Homo Sapiens
KQAEFFEPWVY

SEQ ID NO: 41716 - protein, 11 aa, Homo Sapiens
KQAEWSSKTSY

SEQ ID NO: 41717 - protein, 11 aa, Homo Sapiens
KQALQDTLALY

SEQ ID NO: 41718 - protein, 11 aa, Homo Sapiens
KQFAEMYVAKF

SEQ ID NO: 41719 - protein, 11 aa, Homo Sapiens
KQFFQDKARFY

SEQ ID NO: 41720 - protein, 11 aa, Homo Sapiens
KQIDNTGSSTY

SEQ ID NO: 41721 - protein, 11 aa, Homo Sapiens
KQKYPEQQGRF

SEQ ID NO: 41722 - protein, 11 aa, Homo Sapiens
KQLDMQSSWVY

SEQ ID NO: 41723 - protein, 11 aa, Homo Sapiens
KQNHESVQWCY

SEQ ID NO: 41724 - protein, 11 aa, Homo Sapiens
KQRESAATDVL

SEQ ID NO: 41725 - protein, 11 aa, Homo Sapiens
KQRETHSVDRL

SEQ ID NO: 41726 - protein, 11 aa, Homo Sapiens
KQRPIFIITEY

SEQ ID NO: 41727 - protein, 11 aa, Homo Sapiens
KQSANDFFSYY

SEQ ID NO: 41728 - protein, 11 aa, Homo Sapiens
KQVEELFERKY

SEQ ID NO: 41729 - protein, 11 aa, Homo Sapiens
KQYPPNTSKVY

SEQ ID NO: 41730 - protein, 11 aa, Homo Sapiens
KSFEGNVFMYY

SEQ ID NO: 41731 - protein, 11 aa, Homo Sapiens
KSHGLVEVASY

SEQ ID NO: 41732 - protein, 11 aa, Homo Sapiens
KSIGPPEMHKY

SEQ ID NO: 41733 - protein, 11 aa, Homo Sapiens
KSLEELQIGTY

SEQ ID NO: 41734 - protein, 11 aa, Homo Sapiens
KSLSPQDRAAY

SEQ ID NO: 41735 - protein, 11 aa, Homo Sapiens
KSLYRGDIARY

SEQ ID NO: 41736 - protein, 11 aa, Homo Sapiens
KSQDTVLMNLY

SEQ ID NO: 41737 - protein, 11 aa, Homo Sapiens
KSQICDNAALY

SEQ ID NO: 41738 - protein, 11 aa, Homo Sapiens
KSQTEKLAKVY

SEQ ID NO: 41739 - protein, 11 aa, Homo Sapiens
KSQVFSYPHRY

SEQ ID NO: 41740 - protein, 11 aa, Homo Sapiens
KSYSPEALWRY

SEQ ID NO: 41741 - protein, 11 aa, Homo Sapiens
KTEDPDLPAFY

SEQ ID NO: 41742 - protein, 11 aa, Homo Sapiens
KTFEFNKELRY

SEQ ID NO: 41743 - protein, 11 aa, Homo Sapiens
KTIDPELLGKM

SEQ ID NO: 41744 - protein, 11 aa, Homo Sapiens
KTKAADLRAAY

SEQ ID NO: 41745 - protein, 11 aa, Homo Sapiens
KTKPEVLEAHY

SEQ ID NO: 41746 - protein, 11 aa, Homo Sapiens
KTKPTHGIGKY

SEQ ID NO: 41747 - protein, 11 aa, Homo Sapiens
KTLLRTWSELY

SEQ ID NO: 41748 - protein, 11 aa, Homo Sapiens
KTLPADVQNYY

SEQ ID NO: 41749 - protein, 11 aa, Homo Sapiens
KTLPETSLPNY

SEQ ID NO: 41750 - protein, 11 aa, Homo Sapiens
KTLQKPVLPLY

SEQ ID NO: 41751 - protein, 11 aa, Homo Sapiens
KTMSAKEKGKF

SEQ ID NO: 41752 - protein, 11 aa, Homo Sapiens
KTPDFESTGLY

SEQ ID NO: 41753 - protein, 11 aa, Homo Sapiens
KTPGAEIDFKY

SEQ ID NO: 41754 - protein, 11 aa, Homo Sapiens
KTQDQISNIKY

SEQ ID NO: 41755 - protein, 11 aa, Homo Sapiens
KTQEPDNLLFY

SEQ ID NO: 41756 - protein, 11 aa, Homo Sapiens
KTRIISDGLKY

SEQ ID NO: 41757 - protein, 11 aa, Homo Sapiens
KTRPGLLNSKL

SEQ ID NO: 41758 - protein, 11 aa, Homo Sapiens
KTRTLMEKDSY

SEQ ID NO: 41759 - protein, 11 aa, Homo Sapiens
KTSQVPVKHVY

SEQ ID NO: 41760 - protein, 11 aa, Homo Sapiens
KTSSWNLDCRY

SEQ ID NO: 41761 - protein, 11 aa, Homo Sapiens
KVADYWLDVLY

SEQ ID NO: 41762 - protein, 11 aa, Homo Sapiens
KVANVSLLALY

SEQ ID NO: 41763 - protein, 11 aa, Homo Sapiens
KVEPCSLTPGY

SEQ ID NO: 41764 - protein, 11 aa, Homo Sapiens
KVFPGSTTEDY

SEQ ID NO: 41765 - protein, 11 aa, Homo Sapiens
KVHDLALRADY

SEQ ID NO: 41766 - protein, 11 aa, Homo Sapiens
KVIKAVVPAKY

SEQ ID NO: 41767 - protein, 11 aa, Homo Sapiens
KVKDSIAVEVY

SEQ ID NO: 41768 - protein, 11 aa, Homo Sapiens
KVKEAGRDFTY

SEQ ID NO: 41769 - protein, 11 aa, Homo Sapiens
KVKKFENRDQY

SEQ ID NO: 41770 - protein, 11 aa, Homo Sapiens
KVLECDIIKNY

SEQ ID NO: 41771 - protein, 11 aa, Homo Sapiens
KVLTMPETCRY

SEQ ID NO: 41772 - protein, 11 aa, Homo Sapiens
KVNEMIVTGQY

SEQ ID NO: 41773 - protein, 11 aa, Homo Sapiens
KVQSVSQNKSY

SEQ ID NO: 41774 - protein, 11 aa, Homo Sapiens
KVRELISDNQY

SEQ ID NO: 41775 - protein, 11 aa, Homo Sapiens
KVSDPLIGGTY

SEQ ID NO: 41776 - protein, 11 aa, Homo Sapiens
KVTRPDSGHLY

SEQ ID NO: 41777 - protein, 11 aa, Homo Sapiens
KVVSSSIVDKY

SEQ ID NO: 41778 - protein, 11 aa, Homo Sapiens
KVWDDISPQFY

SEQ ID NO: 41779 - protein, 11 aa, Homo Sapiens
KVYSSVLRQCY

SEQ ID NO: 41780 - protein, 11 aa, Homo Sapiens
KWFESKVGNKY

SEQ ID NO: 41781 - protein, 11 aa, Homo Sapiens
KWKDQNIKDHY

SEQ ID NO: 41782 - protein, 11 aa, Homo Sapiens
KWYEDLIPSAY

SEQ ID NO: 41783 - protein, 11 aa, Homo Sapiens
KYFDKASYRVY

SEQ ID NO: 41784 - protein, 11 aa, Homo Sapiens
KYFGSNIAHMY

SEQ ID NO: 41785 - protein, 11 aa, Homo Sapiens
KYHGFGNVHAY

SEQ ID NO: 41786 - protein, 11 aa, Homo Sapiens
KYKDGNQVWLY

SEQ ID NO: 41787 - protein, 11 aa, Homo Sapiens
KYLDKELAGRV

SEQ ID NO: 41788 - protein, 11 aa, Homo Sapiens
KYLPYNHQHEY

SEQ ID NO: 41789 - protein, 11 aa, Homo Sapiens
KYMNSLLIGEL

SEQ ID NO: 41790 - protein, 11 aa, Homo Sapiens
KYMPYNHQHKY

SEQ ID NO: 41791 - protein, 11 aa, Homo Sapiens
KYSPSDVFIGY

SEQ ID NO: 41792 - protein, 11 aa, Homo Sapiens
KYTDRALRASY

SEQ ID NO: 41793 - protein, 11 aa, Homo Sapiens
KYVERKFVDKY

SEQ ID NO: 41794 - protein, 11 aa, Homo Sapiens
KYWGEIISQQY

SEQ ID NO: 41795 - protein, 11 aa, Homo Sapiens
LFWDQTQQHSY

SEQ ID NO: 41796 - protein, 11 aa, Homo Sapiens
LIKPPDNNEFY

SEQ ID NO: 41797 - protein, 11 aa, Homo Sapiens
LINYIEMHGLY

SEQ ID NO: 41798 - protein, 11 aa, Homo Sapiens
LLKSSDLVGSY

SEQ ID NO: 41799 - protein, 11 aa, Homo Sapiens
LLRGVSGVDLY

SEQ ID NO: 41800 - protein, 11 aa, Homo Sapiens
LMAEALGIPVT

SEQ ID NO: 41801 - protein, 11 aa, Homo Sapiens
LMLPEKLRPLY

SEQ ID NO: 41802 - protein, 11 aa, Homo Sapiens
LQPGNTEEAAK

SEQ ID NO: 41803 - protein, 11 aa, Homo Sapiens
LSTVIPNSHVY

SEQ ID NO: 41804 - protein, 11 aa, Homo Sapiens
MLLPEKLISKY

SEQ ID NO: 41805 - protein, 11 aa, Homo Sapiens
MQKLPDIFSVY

SEQ ID NO: 41806 - protein, 11 aa, Homo Sapiens
MVKPDGPYDFY

SEQ ID NO: 41807 - protein, 11 aa, Homo Sapiens
MVQPINLIFRY

SEQ ID NO: 41808 - protein, 11 aa, Homo Sapiens
NTKSFEDIHHY

SEQ ID NO: 41809 - protein, 11 aa, Homo Sapiens
NTPAMYVAIQA

SEQ ID NO: 41810 - protein, 11 aa, Homo Sapiens
PGTTILQYAQT

SEQ ID NO: 41811 - protein, 11 aa, Homo Sapiens
PMFIVNTNVPR

SEQ ID NO: 41812 - protein, 11 aa, Homo Sapiens
PYYDSRVVGKY

SEQ ID NO: 41813 - protein, 11 aa, Homo Sapiens
QAQAGWLQHDY

SEQ ID NO: 41814 - protein, 11 aa, Homo Sapiens
QFKEMSDLNKY

SEQ ID NO: 41815 - protein, 11 aa, Homo Sapiens
QGRPREIINTY

SEQ ID NO: 41816 - protein, 11 aa, Homo Sapiens
QLLPVEKLPKY

SEQ ID NO: 41817 - protein, 11 aa, Homo Sapiens
QLQNIAEKGSY

SEQ ID NO: 41818 - protein, 11 aa, Homo Sapiens
QQIEPGEDDKY

SEQ ID NO: 41819 - protein, 11 aa, Homo Sapiens
QQKGEFAIDGY

SEQ ID NO: 41820 - protein, 11 aa, Homo Sapiens
QSAEEALRGLY

SEQ ID NO: 41821 - protein, 11 aa, Homo Sapiens
QSASPIFTHVY

SEQ ID NO: 41822 - protein, 11 aa, Homo Sapiens
QSISKALVAYY

SEQ ID NO: 41823 - protein, 11 aa, Homo Sapiens
QSKDKVIYSKY

SEQ ID NO: 41824 - protein, 11 aa, Homo Sapiens
QSMDSKLSGRY

SEQ ID NO: 41825 - protein, 11 aa, Homo Sapiens
QTAGKVLAHFY

SEQ ID NO: 41826 - protein, 11 aa, Homo Sapiens
QTLNEAIMHQY

SEQ ID NO: 41827 - protein, 11 aa, Homo Sapiens
QVIEPDKNRKY

SEQ ID NO: 41828 - protein, 11 aa, Homo Sapiens
QVLNAVNKGLY

SEQ ID NO: 41829 - protein, 11 aa, Homo Sapiens
QVQQPGQTNFY

SEQ ID NO: 41830 - protein, 11 aa, Homo Sapiens
QVTPGDIVSTY

SEQ ID NO: 41831 - protein, 11 aa, Homo Sapiens
QVYEQVLRSAY

SEQ ID NO: 41832 - protein, 11 aa, Homo Sapiens
QYYDISAKSNY

SEQ ID NO: 41833 - protein, 11 aa, Homo Sapiens
RAFDQGADAIY

SEQ ID NO: 41834 - protein, 11 aa, Homo Sapiens
RAFKALIAAQY

SEQ ID NO: 41835 - protein, 11 aa, Homo Sapiens
RAIFVTDRHLY

SEQ ID NO: 41836 - protein, 11 aa, Homo Sapiens
RAKDKITCDLY

SEQ ID NO: 41837 - protein, 11 aa, Homo Sapiens
RALLLTDQHLY

SEQ ID NO: 41838 - protein, 11 aa, Homo Sapiens
RAMESTESRHY

SEQ ID NO: 41839 - protein, 11 aa, Homo Sapiens
RAREGSFESRY

SEQ ID NO: 41840 - protein, 11 aa, Homo Sapiens
RASGEMASAQY

SEQ ID NO: 41841 - protein, 11 aa, Homo Sapiens
RAVDFAERHGY

SEQ ID NO: 41842 - protein, 11 aa, Homo Sapiens
RAYPAQITPKM

SEQ ID NO: 41843 - protein, 11 aa, Homo Sapiens
RELYERPPHLY

SEQ ID NO: 41844 - protein, 11 aa, Homo Sapiens
RFFDKVIEKRY

SEQ ID NO: 41845 - protein, 11 aa, Homo Sapiens
RFFFDVGCNKY

SEQ ID NO: 41846 - protein, 11 aa, Homo Sapiens
RFIDSKLIYTY

SEQ ID NO: 41847 - protein, 11 aa, Homo Sapiens
RFKAFVAIGDY

SEQ ID NO: 41848 - protein, 11 aa, Homo Sapiens
RFMDPEMETRY

SEQ ID NO: 41849 - protein, 11 aa, Homo Sapiens
RFQVKNPPHTY

SEQ ID NO: 41850 - protein, 11 aa, Homo Sapiens
RFYPWTIDNKY

SEQ ID NO: 41851 - protein, 11 aa, Homo Sapiens
RGASQAGMTGY

SEQ ID NO: 41852 - protein, 11 aa, Homo Sapiens
RGFGGGGYGGF

SEQ ID NO: 41853 - protein, 11 aa, Homo Sapiens
RGKEAGPAHSY

SEQ ID NO: 41854 - protein, 11 aa, Homo Sapiens
RGYSSLLKRDF

SEQ ID NO: 41855 - protein, 11 aa, Homo Sapiens
RIADQFLGAMY

SEQ ID NO: 41856 - protein, 11 aa, Homo Sapiens
RIFPSHISSRY

SEQ ID NO: 41857 - protein, 11 aa, Homo Sapiens
RIFTYTDSDRY

SEQ ID NO: 41858 - protein, 11 aa, Homo Sapiens
RIHQESELHSY

SEQ ID NO: 41859 - protein, 11 aa, Homo Sapiens
RIIDAGPKGNY

SEQ ID NO: 41860 - protein, 11 aa, Homo Sapiens
RIKGEKDWQKY

SEQ ID NO: 41861 - protein, 11 aa, Homo Sapiens
RIKLGDSSNYY

SEQ ID NO: 41862 - protein, 11 aa, Homo Sapiens
RIKNPEGGLYL

SEQ ID NO: 41863 - protein, 11 aa, Homo Sapiens
RIKTGSPLDHL

SEQ ID NO: 41864 - protein, 11 aa, Homo Sapiens
RILDYTLTGCY

SEQ ID NO: 41865 - protein, 11 aa, Homo Sapiens
RILGLGDLGVY

SEQ ID NO: 41866 - protein, 11 aa, Homo Sapiens
RILPSDACKIY

SEQ ID NO: 41867 - protein, 11 aa, Homo Sapiens
RIMDPDVITGY

SEQ ID NO: 41868 - protein, 11 aa, Homo Sapiens
RINNPELLGQY

SEQ ID NO: 41869 - protein, 11 aa, Homo Sapiens
RINSSLAVAAY

SEQ ID NO: 41870 - protein, 11 aa, Homo Sapiens
RIPAIFSPAFY

SEQ ID NO: 41871 - protein, 11 aa, Homo Sapiens
RIQAGDPVARY

SEQ ID NO: 41872 - protein, 11 aa, Homo Sapiens
RIQEFVRGHFY

SEQ ID NO: 41873 - protein, 11 aa, Homo Sapiens
RIQNPDLWNSY

SEQ ID NO: 41874 - protein, 11 aa, Homo Sapiens
RIQSKTERGSY

SEQ ID NO: 41875 - protein, 11 aa, Homo Sapiens
RIVEPYIAWGY

SEQ ID NO: 41876 - protein, 11 aa, Homo Sapiens
RLFSTAEAAVY

SEQ ID NO: 41877 - protein, 11 aa, Homo Sapiens
RLGNLGEAKKY

SEQ ID NO: 41878 - protein, 11 aa, Homo Sapiens
RLIAQRYLLQY

SEQ ID NO: 41879 - protein, 11 aa, Homo Sapiens
RLIHPKSGRSY

SEQ ID NO: 41880 - protein, 11 aa, Homo Sapiens
RLKEYEKALKY

SEQ ID NO: 41881 - protein, 11 aa, Homo Sapiens
RLKPQLLQGVY

SEQ ID NO: 41882 - protein, 11 aa, Homo Sapiens
RLLDMADVAVY

SEQ ID NO: 41883 - protein, 11 aa, Homo Sapiens
RLLEDSALSKY

SEQ ID NO: 41884 - protein, 11 aa, Homo Sapiens
RLMGDYLLRGY

SEQ ID NO: 41885 - protein, 11 aa, Homo Sapiens
RLNFSHGTHEY

SEQ ID NO: 41886 - protein, 11 aa, Homo Sapiens
RLPAFLDNHNY

SEQ ID NO: 41887 - protein, 11 aa, Homo Sapiens
RLPLRVVKHFY

SEQ ID NO: 41888 - protein, 11 aa, Homo Sapiens
RLQEESLRQDY

SEQ ID NO: 41889 - protein, 11 aa, Homo Sapiens
RLQEGRGEAVY

SEQ ID NO: 41890 - protein, 11 aa, Homo Sapiens
RLQELGARHFY

SEQ ID NO: 41891 - protein, 11 aa, Homo Sapiens
RLQNIIDNQKY

SEQ ID NO: 41892 - protein, 11 aa, Homo Sapiens
RLQPPKQGMQY

SEQ ID NO: 41893 - protein, 11 aa, Homo Sapiens
RLQSKTIKVSY

SEQ ID NO: 41894 - protein, 11 aa, Homo Sapiens
RLYEFDLIDGY

SEQ ID NO: 41895 - protein, 11 aa, Homo Sapiens
RLYHKKVVDHY

SEQ ID NO: 41896 - protein, 11 aa, Homo Sapiens
RLYIWSGRDGY

SEQ ID NO: 41897 - protein, 11 aa, Homo Sapiens
RMIDIEGKGHL

SEQ ID NO: 41898 - protein, 11 aa, Homo Sapiens
RMIGDDLVNSY

SEQ ID NO: 41899 - protein, 11 aa, Homo Sapiens
RMLDPSIKGTF

SEQ ID NO: 41900 - protein, 11 aa, Homo Sapiens
RMNPNSPSITY

SEQ ID NO: 41901 - protein, 11 aa, Homo Sapiens
RMQDTSVSFGY

SEQ ID NO: 41902 - protein, 11 aa, Homo Sapiens
RMQEESLRQEY

SEQ ID NO: 41903 - protein, 11 aa, Homo Sapiens
RMQTNQTPPTY

SEQ ID NO: 41904 - protein, 11 aa, Homo Sapiens
RMRPGAYSTGY

SEQ ID NO: 41905 - protein, 11 aa, Homo Sapiens
RNLNGHSIGQY

SEQ ID NO: 41906 - protein, 11 aa, Homo Sapiens
RNQPQANSHVY

SEQ ID NO: 41907 - protein, 11 aa, Homo Sapiens
RQADCHINNLY

SEQ ID NO: 41908 - protein, 11 aa, Homo Sapiens
RQAGDDFSRRY

SEQ ID NO: 41909 - protein, 11 aa, Homo Sapiens
RQDLPSPSDFY

SEQ ID NO: 41910 - protein, 11 aa, Homo Sapiens
RQHMENEMAHY

SEQ ID NO: 41911 - protein, 11 aa, Homo Sapiens
RQIEDTVLYGY

SEQ ID NO: 41912 - protein, 11 aa, Homo Sapiens
RQIPQNFIADY

SEQ ID NO: 41913 - protein, 11 aa, Homo Sapiens
RQIQFEIAHAY

SEQ ID NO: 41914 - protein, 11 aa, Homo Sapiens
RQISREVTYKY

SEQ ID NO: 41915 - protein, 11 aa, Homo Sapiens
RQITPILPHDY

SEQ ID NO: 41916 - protein, 11 aa, Homo Sapiens
RQKAVSLFLCY

SEQ ID NO: 41917 - protein, 11 aa, Homo Sapiens
RQKDEEDKARF

SEQ ID NO: 41918 - protein, 11 aa, Homo Sapiens
RQKKQDGALYL

SEQ ID NO: 41919 - protein, 11 aa, Homo Sapiens
RQKTPYEGNYY

SEQ ID NO: 41920 - protein, 11 aa, Homo Sapiens
RQLDLAKNRLY

SEQ ID NO: 41921 - protein, 11 aa, Homo Sapiens
RQLEVVKSSSY

SEQ ID NO: 41922 - protein, 11 aa, Homo Sapiens
RQLGQDLLNSY

SEQ ID NO: 41923 - protein, 11 aa, Homo Sapiens
RQLSEEERGRL

SEQ ID NO: 41924 - protein, 11 aa, Homo Sapiens
RQMDESEQYLY

SEQ ID NO: 41925 - protein, 11 aa, Homo Sapiens
RQNLLSQSHAY

SEQ ID NO: 41926 - protein, 11 aa, Homo Sapiens
RQQDGLLRGGY

SEQ ID NO: 41927 - protein, 11 aa, Homo Sapiens
RQRQKELESNY

SEQ ID NO: 41928 - protein, 11 aa, Homo Sapiens
RQYEHDQWRRY

SEQ ID NO: 41929 - protein, 11 aa, Homo Sapiens
RQYNRDWQSYY

SEQ ID NO: 41930 - protein, 11 aa, Homo Sapiens
RSARHFLHHYY

SEQ ID NO: 41931 - protein, 11 aa, Homo Sapiens
RSIGMDPSDIY

SEQ ID NO: 41932 - protein, 11 aa, Homo Sapiens
RSISQSSTDSY

SEQ ID NO: 41933 - protein, 11 aa, Homo Sapiens
RSKLAQIRHIY

SEQ ID NO: 41934 - protein, 11 aa, Homo Sapiens
RSKPSDLASTY

SEQ ID NO: 41935 - protein, 11 aa, Homo Sapiens
RSLDPSQTDFY

SEQ ID NO: 41936 - protein, 11 aa, Homo Sapiens
RSLEVLIGSGY

SEQ ID NO: 41937 - protein, 11 aa, Homo Sapiens
RSLSEDVRFYY

SEQ ID NO: 41938 - protein, 11 aa, Homo Sapiens
RSLVAHKTDRY

SEQ ID NO: 41939 - protein, 11 aa, Homo Sapiens
RSMDSYLNQSY

SEQ ID NO: 41940 - protein, 11 aa, Homo Sapiens
RSQDVNKQGLY

SEQ ID NO: 41941 - protein, 11 aa, Homo Sapiens
RSSQGTSYDSY

SEQ ID NO: 41942 - protein, 11 aa, Homo Sapiens
RSSSNLALALY

SEQ ID NO: 41943 - protein, 11 aa, Homo Sapiens
RSVSIPAPAYY

SEQ ID NO: 41944 - protein, 11 aa, Homo Sapiens
RSYGNSSDSRY

SEQ ID NO: 41945 - protein, 11 aa, Homo Sapiens
RTFRADGAATY

SEQ ID NO: 41946 - protein, 11 aa, Homo Sapiens
RTFSESGRCRY

SEQ ID NO: 41947 - protein, 11 aa, Homo Sapiens
RTFVWPAHFKY

SEQ ID NO: 41948 - protein, 11 aa, Homo Sapiens
RTIDGKVLHKY

SEQ ID NO: 41949 - protein, 11 aa, Homo Sapiens
RTKAATIIQKY

SEQ ID NO: 41950 - protein, 11 aa, Homo Sapiens
RTKADSVPGTY

SEQ ID NO: 41951 - protein, 11 aa, Homo Sapiens
RTKKVGIVGKY

SEQ ID NO: 41952 - protein, 11 aa, Homo Sapiens
RTLMEALVASY

SEQ ID NO: 41953 - protein, 11 aa, Homo Sapiens
RTLPHFIKDDY

SEQ ID NO: 41954 - protein, 11 aa, Homo Sapiens
RTLSFGSDLNY

SEQ ID NO: 41955 - protein, 11 aa, Homo Sapiens
RTNPNSGDFRF

SEQ ID NO: 41956 - protein, 11 aa, Homo Sapiens
RTQTEELHYKY

SEQ ID NO: 41957 - protein, 11 aa, Homo Sapiens
RTRVNKEMARY

SEQ ID NO: 41958 - protein, 11 aa, Homo Sapiens
RTVSLFSPAFY

SEQ ID NO: 41959 - protein, 11 aa, Homo Sapiens
RTYAGLAFHAY

SEQ ID NO: 41960 - protein, 11 aa, Homo Sapiens
RTYPSLLQGEY

SEQ ID NO: 41961 - protein, 11 aa, Homo Sapiens
RTYTETVNHHY

SEQ ID NO: 41962 - protein, 11 aa, Homo Sapiens
RVAGCSVHKGY

SEQ ID NO: 41963 - protein, 11 aa, Homo Sapiens
RVFLKNEKGQY

SEQ ID NO: 41964 - protein, 11 aa, Homo Sapiens
RVHVGSGDHDY

SEQ ID NO: 41965 - protein, 11 aa, Homo Sapiens
RVIGEDGQSVY

SEQ ID NO: 41966 - protein, 11 aa, Homo Sapiens
RVIGSELVQKY

SEQ ID NO: 41967 - protein, 11 aa, Homo Sapiens
RVILPVSVDEY

SEQ ID NO: 41968 - protein, 11 aa, Homo Sapiens
RVISKHDLGHF

SEQ ID NO: 41969 - protein, 11 aa, Homo Sapiens
RVIVLSSSHSY

SEQ ID NO: 41970 - protein, 11 aa, Homo Sapiens
RVKGGDGIRIY

SEQ ID NO: 41971 - protein, 11 aa, Homo Sapiens
RVKGWFLLDNY

SEQ ID NO: 41972 - protein, 11 aa, Homo Sapiens
RVLAPHLTRAY

SEQ ID NO: 41973 - protein, 11 aa, Homo Sapiens
RVLDFDVKRKY

SEQ ID NO: 41974 - protein, 11 aa, Homo Sapiens
RVLEAGKIGIF

SEQ ID NO: 41975 - protein, 11 aa, Homo Sapiens
RVLESTPNNGY

SEQ ID NO: 41976 - protein, 11 aa, Homo Sapiens
RVLHAISRYWY

SEQ ID NO: 41977 - protein, 11 aa, Homo Sapiens
RVLPLSVTHFY

SEQ ID NO: 41978 - protein, 11 aa, Homo Sapiens
RVLPPSALQSV

SEQ ID NO: 41979 - protein, 11 aa, Homo Sapiens
RVLPSWLTAQV

SEQ ID NO: 41980 - protein, 11 aa, Homo Sapiens
RVMPEEIARYY

SEQ ID NO: 41981 - protein, 11 aa, Homo Sapiens
RVNAQAAAYEY

SEQ ID NO: 41982 - protein, 11 aa, Homo Sapiens
RVNDVPEEFLY

SEQ ID NO: 41983 - protein, 11 aa, Homo Sapiens
RVNDVPEEFMY

SEQ ID NO: 41984 - protein, 11 aa, Homo Sapiens
RVNLDMGKAVY

SEQ ID NO: 41985 - protein, 11 aa, Homo Sapiens
RVNLFTDFDKY

SEQ ID NO: 41986 - protein, 11 aa, Homo Sapiens
RVQFGANKSQY

SEQ ID NO: 41987 - protein, 11 aa, Homo Sapiens
RVQPGHCYHLY

SEQ ID NO: 41988 - protein, 11 aa, Homo Sapiens
RVQPGLLQWVK

SEQ ID NO: 41989 - protein, 11 aa, Homo Sapiens
RVQQVELICEY

SEQ ID NO: 41990 - protein, 11 aa, Homo Sapiens
RVRKPAEAERY

SEQ ID NO: 41991 - protein, 11 aa, Homo Sapiens
RVTNGELLAQY

SEQ ID NO: 41992 - protein, 11 aa, Homo Sapiens
RVVGSEFVQKY

SEQ ID NO: 41993 - protein, 11 aa, Homo Sapiens
RVVGSELIQKY

SEQ ID NO: 41994 - protein, 11 aa, Homo Sapiens
RVVGSELVDTY

SEQ ID NO: 41995 - protein, 11 aa, Homo Sapiens
RVYDIPPKFFY

SEQ ID NO: 41996 - protein, 11 aa, Homo Sapiens
RVYGQPSTKHY

SEQ ID NO: 41997 - protein, 11 aa, Homo Sapiens
RVYPANERFWY

SEQ ID NO: 41998 - protein, 11 aa, Homo Sapiens
RVYPESIPRKF

SEQ ID NO: 41999 - protein, 11 aa, Homo Sapiens
RVYSDLHAFYY

SEQ ID NO: 42000 - protein, 11 aa, Homo Sapiens
RVYSLDDIRRY

SEQ ID NO: 42001 - protein, 11 aa, Homo Sapiens
RVYWNDGLDQY

SEQ ID NO: 42002 - protein, 11 aa, Homo Sapiens
RWAPGSVKPIY

SEQ ID NO: 42003 - protein, 11 aa, Homo Sapiens
RWLDRLGESKY

SEQ ID NO: 42004 - protein, 11 aa, Homo Sapiens
RWQDIQNDPRY

SEQ ID NO: 42005 - protein, 11 aa, Homo Sapiens
RWTDILSHGRY

SEQ ID NO: 42006 - protein, 11 aa, Homo Sapiens
RYAPLGWSKKY

SEQ ID NO: 42007 - protein, 11 aa, Homo Sapiens
RYCPEGVHKEY

SEQ ID NO: 42008 - protein, 11 aa, Homo Sapiens
RYCPNGNHKQY

SEQ ID NO: 42009 - protein, 11 aa, Homo Sapiens
RYFGVLQRSLY

SEQ ID NO: 42010 - protein, 11 aa, Homo Sapiens
RYGSDFYSMHY

SEQ ID NO: 42011 - protein, 11 aa, Homo Sapiens
RYIDQQIQGGL

SEQ ID NO: 42012 - protein, 11 aa, Homo Sapiens
RYLDVSILGKF

SEQ ID NO: 42013 - protein, 11 aa, Homo Sapiens
RYLKIIEKSGY

SEQ ID NO: 42014 - protein, 11 aa, Homo Sapiens
RYLNSGGFIGY

SEQ ID NO: 42015 - protein, 11 aa, Homo Sapiens
RYLQAHTQSVY

SEQ ID NO: 42016 - protein, 11 aa, Homo Sapiens
RYQNNIKNDKY

SEQ ID NO: 42017 - protein, 11 aa, Homo Sapiens
RYSALFLGVAY

SEQ ID NO: 42018 - protein, 11 aa, Homo Sapiens
RYTDHGSDHHY

SEQ ID NO: 42019 - protein, 11 aa, Homo Sapiens
RYVASYLLAAL

SEQ ID NO: 42020 - protein, 11 aa, Homo Sapiens
RYVQEGIGSSY

SEQ ID NO: 42021 - protein, 11 aa, Homo Sapiens
SAKEALETDLY

SEQ ID NO: 42022 - protein, 11 aa, Homo Sapiens
SFKGTSPSSKY

SEQ ID NO: 42023 - protein, 11 aa, Homo Sapiens
SFYTPEIPGRY

SEQ ID NO: 42024 - protein, 11 aa, Homo Sapiens
SGISSESGHYY

SEQ ID NO: 42025 - protein, 11 aa, Homo Sapiens
SGKPDVPCSLY

SEQ ID NO: 42026 - protein, 11 aa, Homo Sapiens
SGSHKDLAGKY

SEQ ID NO: 42027 - protein, 11 aa, Homo Sapiens
SLQPAFDFDRY

SEQ ID NO: 42028 - protein, 11 aa, Homo Sapiens
SMFPFFDIAHY

SEQ ID NO: 42029 - protein, 11 aa, Homo Sapiens
SMIGQFGVGFY

SEQ ID NO: 42030 - protein, 11 aa, Homo Sapiens
SMRGGYIGSTY

SEQ ID NO: 42031 - protein, 11 aa, Homo Sapiens
SMVQENGQRKY

SEQ ID NO: 42032 - protein, 11 aa, Homo Sapiens
SQDPSGDSKLY

SEQ ID NO: 42033 - protein, 11 aa, Homo Sapiens
SQHSPSKKALY

SEQ ID NO: 42034 - protein, 11 aa, Homo Sapiens
SQIPAAVKLTY

SEQ ID NO: 42035 - protein, 11 aa, Homo Sapiens
SQQADVRLMLY

SEQ ID NO: 42036 - protein, 11 aa, Homo Sapiens
SQRPGFVIDIY

SEQ ID NO: 42037 - protein, 11 aa, Homo Sapiens
SQTNCPLYVTK

SEQ ID NO: 42038 - protein, 11 aa, Homo Sapiens
SQYPELLVASY

SEQ ID NO: 42039 - protein, 11 aa, Homo Sapiens
SSKGLQIIGTY

SEQ ID NO: 42040 - protein, 11 aa, Homo Sapiens
SSKSPELLARY

SEQ ID NO: 42041 - protein, 11 aa, Homo Sapiens
SSKTFSDEDYY

SEQ ID NO: 42042 - protein, 11 aa, Homo Sapiens
SSLPPGVHISY

SEQ ID NO: 42043 - protein, 11 aa, Homo Sapiens
SSQNGSLSPHY

SEQ ID NO: 42044 - protein, 11 aa, Homo Sapiens
SSQSAALTAQY

SEQ ID NO: 42045 - protein, 11 aa, Homo Sapiens
STKGATSIEKY

SEQ ID NO: 42046 - protein, 11 aa, Homo Sapiens
STNSGIQNGQY

SEQ ID NO: 42047 - protein, 11 aa, Homo Sapiens
STYRDFQQALY

SEQ ID NO: 42048 - protein, 11 aa, Homo Sapiens
SVFSDQGGRKY

SEQ ID NO: 42049 - protein, 11 aa, Homo Sapiens
SVFTEPNRHFY

SEQ ID NO: 42050 - protein, 11 aa, Homo Sapiens
SVIPVLNSSSY

SEQ ID NO: 42051 - protein, 11 aa, Homo Sapiens
SVISKIDLHKY

SEQ ID NO: 42052 - protein, 11 aa, Homo Sapiens
SVKGPELINMY

SEQ ID NO: 42053 - protein, 11 aa, Homo Sapiens
SVKGPELLSKY

SEQ ID NO: 42054 - protein, 11 aa, Homo Sapiens
SVKQPDLVSYY

SEQ ID NO: 42055 - protein, 11 aa, Homo Sapiens
SVKSAAKESLY

SEQ ID NO: 42056 - protein, 11 aa, Homo Sapiens
SVLPGELMRGY

SEQ ID NO: 42057 - protein, 11 aa, Homo Sapiens
SVMPLAAVGYL

SEQ ID NO: 42058 - protein, 11 aa, Homo Sapiens
SVNQQWTTAHY

SEQ ID NO: 42059 - protein, 11 aa, Homo Sapiens
SVRIPQIGDKF

SEQ ID NO: 42060 - protein, 11 aa, Homo Sapiens
SVSSPRSVDSY

SEQ ID NO: 42061 - protein, 11 aa, Homo Sapiens
SVYGGGGIHEY

SEQ ID NO: 42062 - protein, 11 aa, Homo Sapiens
SVYPKALRDEY

SEQ ID NO: 42063 - protein, 11 aa, Homo Sapiens
SYFRASSTMRY

SEQ ID NO: 42064 - protein, 11 aa, Homo Sapiens
SYLDKEDTFFY

SEQ ID NO: 42065 - protein, 11 aa, Homo Sapiens
SYLPCPLLPSY

SEQ ID NO: 42066 - protein, 11 aa, Homo Sapiens
SYMGHFDLLNY

SEQ ID NO: 42067 - protein, 11 aa, Homo Sapiens
TFLPSSKSDQY

SEQ ID NO: 42068 - protein, 11 aa, Homo Sapiens
TGKSVKDVDRY

SEQ ID NO: 42069 - protein, 11 aa, Homo Sapiens
TGVANALAHRY

SEQ ID NO: 42070 - protein, 11 aa, Homo Sapiens
TLGPAVVPHQY

SEQ ID NO: 42071 - protein, 11 aa, Homo Sapiens
TLISEDIKSYY

SEQ ID NO: 42072 - protein, 11 aa, Homo Sapiens
TLQQEGLLSRY

SEQ ID NO: 42073 - protein, 11 aa, Homo Sapiens
TQKEIFQCDKY

SEQ ID NO: 42074 - protein, 11 aa, Homo Sapiens
TQRKIFQCDEY

SEQ ID NO: 42075 - protein, 11 aa, Homo Sapiens
TQYKKGKDSLY

SEQ ID NO: 42076 - protein, 11 aa, Homo Sapiens
TSKDPDIKAQY

SEQ ID NO: 42077 - protein, 11 aa, Homo Sapiens
TTNRDIAFGLY

SEQ ID NO: 42078 - protein, 11 aa, Homo Sapiens
TTQRVSCAHIY

SEQ ID NO: 42079 - protein, 11 aa, Homo Sapiens
TVIPEPATGFY

SEQ ID NO: 42080 - protein, 11 aa, Homo Sapiens
TVKGLKHPHRY

SEQ ID NO: 42081 - protein, 11 aa, Homo Sapiens
TVNTFDEKSYY

SEQ ID NO: 42082 - protein, 11 aa, Homo Sapiens
TVPSVDLAARY

SEQ ID NO: 42083 - protein, 11 aa, Homo Sapiens
TVQDMLSSHHY

SEQ ID NO: 42084 - protein, 11 aa, Homo Sapiens
TVQKPDAANYY

SEQ ID NO: 42085 - protein, 11 aa, Homo Sapiens
TVRKPAVIDAY

SEQ ID NO: 42086 - protein, 11 aa, Homo Sapiens
TVRSHGVLGLY

SEQ ID NO: 42087 - protein, 11 aa, Homo Sapiens
VCLSPRRIKLY

SEQ ID NO: 42088 - protein, 11 aa, Homo Sapiens
VGAGAPVYLAA

SEQ ID NO: 42089 - protein, 11 aa, Homo Sapiens
VGKPPFEANTY

SEQ ID NO: 42090 - protein, 11 aa, Homo Sapiens
VLVPVWIIHYY

SEQ ID NO: 42091 - protein, 11 aa, Homo Sapiens
VMKSGKYVLGY

SEQ ID NO: 42092 - protein, 11 aa, Homo Sapiens
VMNWVPCGHSY

SEQ ID NO: 42093 - protein, 11 aa, Homo Sapiens
VMYNSSDHDVY

SEQ ID NO: 42094 - protein, 11 aa, Homo Sapiens
VQKPDAANYYY

SEQ ID NO: 42095 - protein, 11 aa, Homo Sapiens
VSKPAEVQGKY

SEQ ID NO: 42096 - protein, 11 aa, Homo Sapiens
VTEKIPVRHLY

SEQ ID NO: 42097 - protein, 11 aa, Homo Sapiens
VTISNPTRHVY

SEQ ID NO: 42098 - protein, 11 aa, Homo Sapiens
VTRVEGGFDQY

SEQ ID NO: 42099 - protein, 11 aa, Homo Sapiens
VVFDKSDLAKY

SEQ ID NO: 42100 - protein, 11 aa, Homo Sapiens
VVHDDMECSHY

SEQ ID NO: 42101 - protein, 11 aa, Homo Sapiens
VVLERGPGAAY

SEQ ID NO: 42102 - protein, 11 aa, Homo Sapiens
VVLPHQPLATY

SEQ ID NO: 42103 - protein, 11 aa, Homo Sapiens
VVLRIGSAHSY

SEQ ID NO: 42104 - protein, 11 aa, Homo Sapiens
VVMADPKGKAY

SEQ ID NO: 42105 - protein, 11 aa, Homo Sapiens
VVMDPALAAQY

SEQ ID NO: 42106 - protein, 11 aa, Homo Sapiens
VVNNHLEVARY

SEQ ID NO: 42107 - protein, 11 aa, Homo Sapiens
VVNSELSCQLY

SEQ ID NO: 42108 - protein, 11 aa, Homo Sapiens
VVQDPNSFAEY

SEQ ID NO: 42109 - protein, 11 aa, Homo Sapiens
VVRNVFDFDSY

SEQ ID NO: 42110 - protein, 11 aa, Homo Sapiens
VVRTEPFQDGY

SEQ ID NO: 42111 - protein, 11 aa, Homo Sapiens
VVSGSEMSGKY

SEQ ID NO: 42112 - protein, 11 aa, Homo Sapiens
VVYKNPSEYHY

SEQ ID NO: 42113 - protein, 11 aa, Homo Sapiens
VWDAAIVLSTY

SEQ ID NO: 42114 - protein, 11 aa, Homo Sapiens
YGLPDDISHGY

SEQ ID NO: 42115 - protein, 8 aa, Homo Sapiens
ATLLIVNR

SEQ ID NO: 42116 - protein, 8 aa, Homo Sapiens
ATWLPQRR

SEQ ID NO: 42117 - protein, 8 aa, Homo Sapiens
FPVGRIHR

SEQ ID NO: 42118 - protein, 8 aa, Homo Sapiens
FPVGRVHR

SEQ ID NO: 42119 - protein, 8 aa, Homo Sapiens
HSFRPAYR

SEQ ID NO: 42120 - protein, 8 aa, Homo Sapiens
KAWSPVFR

SEQ ID NO: 42121 - protein, 8 aa, Homo Sapiens
KIRVPFLR

SEQ ID NO: 42122 - protein, 8 aa, Homo Sapiens
KVWVPKQK

SEQ ID NO: 42123 - protein, 8 aa, Homo Sapiens
LSRTARAW

SEQ ID NO: 42124 - protein, 8 aa, Homo Sapiens
LVFVPSLR

SEQ ID NO: 42125 - protein, 8 aa, Homo Sapiens
MVNVPKTR

SEQ ID NO: 42126 - protein, 8 aa, Homo Sapiens
PSIVGRPR

SEQ ID NO: 42127 - protein, 8 aa, Homo Sapiens
RLLLPHNR

SEQ ID NO: 42128 - protein, 8 aa, Homo Sapiens
RNLIPVSR

SEQ ID NO: 42129 - protein, 8 aa, Homo Sapiens
RNLVPVQR

SEQ ID NO: 42130 - protein, 8 aa, Homo Sapiens
SAWYPFFR

SEQ ID NO: 42131 - protein, 8 aa, Homo Sapiens
SLGLKFNK

SEQ ID NO: 42132 - protein, 8 aa, Homo Sapiens
TVKWFNVR

SEQ ID NO: 42133 - protein, 9 aa, Homo Sapiens
AAEYLYFFR

SEQ ID NO: 42134 - protein, 9 aa, Homo Sapiens
AALPGIVHR

SEQ ID NO: 42135 - protein, 9 aa, Homo Sapiens
AFHPQPVSR

SEQ ID NO: 42136 - protein, 9 aa, Homo Sapiens
AFKDIPVQR

SEQ ID NO: 42137 - protein, 9 aa, Homo Sapiens
AFKPILSTR

SEQ ID NO: 42138 - protein, 9 aa, Homo Sapiens
AFWIPFIYR

SEQ ID NO: 42139 - protein, 9 aa, Homo Sapiens
AGALFLHQR

SEQ ID NO: 42140 - protein, 9 aa, Homo Sapiens
AGGDWFTSR

SEQ ID NO: 42141 - protein, 9 aa, Homo Sapiens
AGKPAFMGR

SEQ ID NO: 42142 - protein, 9 aa, Homo Sapiens
AGNYAWVNR

SEQ ID NO: 42143 - protein, 9 aa, Homo Sapiens
AIFLWLITR

SEQ ID NO: 42144 - protein, 9 aa, Homo Sapiens
AIKIQSVYR

SEQ ID NO: 42145 - protein, 9 aa, Homo Sapiens
AIKSVKIYR

SEQ ID NO: 42146 - protein, 9 aa, Homo Sapiens
ALAALIFRR

SEQ ID NO: 42147 - protein, 9 aa, Homo Sapiens
ALDPAKMNR

SEQ ID NO: 42148 - protein, 9 aa, Homo Sapiens
ALFNTRIPR

SEQ ID NO: 42149 - protein, 9 aa, Homo Sapiens
ALGAFLNHR

SEQ ID NO: 42150 - protein, 9 aa, Homo Sapiens
ALNGKIYFR

SEQ ID NO: 42151 - protein, 9 aa, Homo Sapiens
ALNRITVWR

SEQ ID NO: 42152 - protein, 9 aa, Homo Sapiens
ALNVLLFYR

SEQ ID NO: 42153 - protein, 9 aa, Homo Sapiens
AQIFRVNLR

SEQ ID NO: 42154 - protein, 9 aa, Homo Sapiens
AQNPSLFVK

SEQ ID NO: 42155 - protein, 9 aa, Homo Sapiens
AQQLITICR

SEQ ID NO: 42156 - protein, 9 aa, Homo Sapiens
AQWQKVLPR

SEQ ID NO: 42157 - protein, 9 aa, Homo Sapiens
ASGDWFTSR

SEQ ID NO: 42158 - protein, 9 aa, Homo Sapiens
ASIDWLAQR

SEQ ID NO: 42159 - protein, 9 aa, Homo Sapiens
ASKEPFYVR

SEQ ID NO: 42160 - protein, 9 aa, Homo Sapiens
ASQGFRFLR

SEQ ID NO: 42161 - protein, 9 aa, Homo Sapiens
ASRPPVTLR

SEQ ID NO: 42162 - protein, 9 aa, Homo Sapiens
ASSYIAHLR

SEQ ID NO: 42163 - protein, 9 aa, Homo Sapiens
ATATVYFKR

SEQ ID NO: 42164 - protein, 9 aa, Homo Sapiens
ATFARIWYL

SEQ ID NO: 42165 - protein, 9 aa, Homo Sapiens
ATFKDLLTR

SEQ ID NO: 42166 - protein, 9 aa, Homo Sapiens
ATFQFTVER

SEQ ID NO: 42167 - protein, 9 aa, Homo Sapiens
ATIALMIQR

SEQ ID NO: 42168 - protein, 9 aa, Homo Sapiens
ATIVDLVER

SEQ ID NO: 42169 - protein, 9 aa, Homo Sapiens
ATKPLYVAL

SEQ ID NO: 42170 - protein, 9 aa, Homo Sapiens
ATLGAILNR

SEQ ID NO: 42171 - protein, 9 aa, Homo Sapiens
ATLYLGWNR

SEQ ID NO: 42172 - protein, 9 aa, Homo Sapiens
ATNILTATR

SEQ ID NO: 42173 - protein, 9 aa, Homo Sapiens
ATNWDLIGR

SEQ ID NO: 42174 - protein, 9 aa, Homo Sapiens
ATQTQFFHV

SEQ ID NO: 42175 - protein, 9 aa, Homo Sapiens
ATRLGYFGR

SEQ ID NO: 42176 - protein, 9 aa, Homo Sapiens
ATRWPLAVR

SEQ ID NO: 42177 - protein, 9 aa, Homo Sapiens
ATSPALFNR

SEQ ID NO: 42178 - protein, 9 aa, Homo Sapiens
ATSPIIIHR

SEQ ID NO: 42179 - protein, 9 aa, Homo Sapiens
ATYPYQVVR

SEQ ID NO: 42180 - protein, 9 aa, Homo Sapiens
AVANFIRQR

SEQ ID NO: 42181 - protein, 9 aa, Homo Sapiens
AVEDLRWFR

SEQ ID NO: 42182 - protein, 9 aa, Homo Sapiens
AVFAGFEGR

SEQ ID NO: 42183 - protein, 9 aa, Homo Sapiens
AVFYTFVFR

SEQ ID NO: 42184 - protein, 9 aa, Homo Sapiens
AVIDVGINR

SEQ ID NO: 42185 - protein, 9 aa, Homo Sapiens
AVTAFVTFR

SEQ ID NO: 42186 - protein, 9 aa, Homo Sapiens
AVYDFFIGR

SEQ ID NO: 42187 - protein, 9 aa, Homo Sapiens
AWKSWTALR

SEQ ID NO: 42188 - protein, 9 aa, Homo Sapiens
AYAEYVIYR

SEQ ID NO: 42189 - protein, 9 aa, Homo Sapiens
AYFVPLVKR

SEQ ID NO: 42190 - protein, 9 aa, Homo Sapiens
AYKSILQER

SEQ ID NO: 42191 - protein, 9 aa, Homo Sapiens
AYLAWRLAR

SEQ ID NO: 42192 - protein, 9 aa, Homo Sapiens
AYLTLPSYR

SEQ ID NO: 42193 - protein, 9 aa, Homo Sapiens
CVNQFIISR

SEQ ID NO: 42194 - protein, 9 aa, Homo Sapiens
EVVQITWNR

SEQ ID NO: 42195 - protein, 9 aa, Homo Sapiens
FDAKRLIGR

SEQ ID NO: 42196 - protein, 9 aa, Homo Sapiens
FLFVPPQFR

SEQ ID NO: 42197 - protein, 9 aa, Homo Sapiens
FPSIVGRPR

SEQ ID NO: 42198 - protein, 9 aa, Homo Sapiens
FSSVFQFLR

SEQ ID NO: 42199 - protein, 9 aa, Homo Sapiens
GINSILYQR

SEQ ID NO: 42200 - protein, 9 aa, Homo Sapiens
GIWLRYDSR

SEQ ID NO: 42201 - protein, 9 aa, Homo Sapiens
GLFSGLIPR

SEQ ID NO: 42202 - protein, 9 aa, Homo Sapiens
GLKQVIIPR

SEQ ID NO: 42203 - protein, 9 aa, Homo Sapiens
GLQLRIATR

SEQ ID NO: 42204 - protein, 9 aa, Homo Sapiens
GSHIPGWFR

SEQ ID NO: 42205 - protein, 9 aa, Homo Sapiens
GSRSFIINR

SEQ ID NO: 42206 - protein, 9 aa, Homo Sapiens
GSYHPGVFR

SEQ ID NO: 42207 - protein, 9 aa, Homo Sapiens
GSYVPPRRL

SEQ ID NO: 42208 - protein, 9 aa, Homo Sapiens
GTIHIFRVR

SEQ ID NO: 42209 - protein, 9 aa, Homo Sapiens
GTLDFYMAR

SEQ ID NO: 42210 - protein, 9 aa, Homo Sapiens
GTLDYILQR

SEQ ID NO: 42211 - protein, 9 aa, Homo Sapiens
GTLGGMLTR

SEQ ID NO: 42212 - protein, 9 aa, Homo Sapiens
GTQSFVFQR

SEQ ID NO: 42213 - protein, 9 aa, Homo Sapiens
GTRLPLVLR

SEQ ID NO: 42214 - protein, 9 aa, Homo Sapiens
GTSQLYVYR

SEQ ID NO: 42215 - protein, 9 aa, Homo Sapiens
GTVKWFNVR

SEQ ID NO: 42216 - protein, 9 aa, Homo Sapiens
GTWNWIWRR

SEQ ID NO: 42217 - protein, 9 aa, Homo Sapiens
GTYVSSVPR

SEQ ID NO: 42218 - protein, 9 aa, Homo Sapiens
GVFTKLINR

SEQ ID NO: 42219 - protein, 9 aa, Homo Sapiens
GVLGSFIHR

SEQ ID NO: 42220 - protein, 9 aa, Homo Sapiens
GVMPSHFSR

SEQ ID NO: 42221 - protein, 9 aa, Homo Sapiens
GVMTVLIKR

SEQ ID NO: 42222 - protein, 9 aa, Homo Sapiens
GVNQLKFAR

SEQ ID NO: 42223 - protein, 9 aa, Homo Sapiens
GVYTDFAFR

SEQ ID NO: 42224 - protein, 9 aa, Homo Sapiens
HANPRLWLR

SEQ ID NO: 42225 - protein, 9 aa, Homo Sapiens
HINTVFVLR

SEQ ID NO: 42226 - protein, 9 aa, Homo Sapiens
HSMALIHNR

SEQ ID NO: 42227 - protein, 9 aa, Homo Sapiens
HSMDFVAYR

SEQ ID NO: 42228 - protein, 9 aa, Homo Sapiens
HTLEPLIPR

SEQ ID NO: 42229 - protein, 9 aa, Homo Sapiens
IFYTAIVNR

SEQ ID NO: 42230 - protein, 9 aa, Homo Sapiens
IGLGIYIGR

SEQ ID NO: 42231 - protein, 9 aa, Homo Sapiens
ILKEILQKR

SEQ ID NO: 42232 - protein, 9 aa, Homo Sapiens
ILNLIPSTR

SEQ ID NO: 42233 - protein, 9 aa, Homo Sapiens
ILQILSLNR

SEQ ID NO: 42234 - protein, 9 aa, Homo Sapiens
ILRDFFELR

SEQ ID NO: 42235 - protein, 9 aa, Homo Sapiens
ILRTEQWPR

SEQ ID NO: 42236 - protein, 9 aa, Homo Sapiens
ISDPYKVYR

SEQ ID NO: 42237 - protein, 9 aa, Homo Sapiens
ISSIPINLR

SEQ ID NO: 42238 - protein, 9 aa, Homo Sapiens
ITFPAMVHR

SEQ ID NO: 42239 - protein, 9 aa, Homo Sapiens
ITTVPPNLR

SEQ ID NO: 42240 - protein, 9 aa, Homo Sapiens
IVEEFNFPR

SEQ ID NO: 42241 - protein, 9 aa, Homo Sapiens
IVIAFYEER

SEQ ID NO: 42242 - protein, 9 aa, Homo Sapiens
IVNENLVER

SEQ ID NO: 42243 - protein, 9 aa, Homo Sapiens
IYNFRIFER

SEQ ID NO: 42244 - protein, 9 aa, Homo Sapiens
IYSGYIRNR

SEQ ID NO: 42245 - protein, 9 aa, Homo Sapiens
KAFDRITTR

SEQ ID NO: 42246 - protein, 9 aa, Homo Sapiens
KFKFPGRQK

SEQ ID NO: 42247 - protein, 9 aa, Homo Sapiens
KGLDSFLNR

SEQ ID NO: 42248 - protein, 9 aa, Homo Sapiens
KGVDPKFLR

SEQ ID NO: 42249 - protein, 9 aa, Homo Sapiens
KIMLPPRNR

SEQ ID NO: 42250 - protein, 9 aa, Homo Sapiens
KINLIIHQR

SEQ ID NO: 42251 - protein, 9 aa, Homo Sapiens
KIPDWFLNR

SEQ ID NO: 42252 - protein, 9 aa, Homo Sapiens
KISGFPKNR

SEQ ID NO: 42253 - protein, 9 aa, Homo Sapiens
KISLIQIFR

SEQ ID NO: 42254 - protein, 9 aa, Homo Sapiens
KLFSVTRNR

SEQ ID NO: 42255 - protein, 9 aa, Homo Sapiens
KLFVGFLNR

SEQ ID NO: 42256 - protein, 9 aa, Homo Sapiens
KLHLRTNYL

SEQ ID NO: 42257 - protein, 9 aa, Homo Sapiens
KLKWIVSGR

SEQ ID NO: 42258 - protein, 9 aa, Homo Sapiens
KLLESIFHR

SEQ ID NO: 42259 - protein, 9 aa, Homo Sapiens
KLLEVWFSR

SEQ ID NO: 42260 - protein, 9 aa, Homo Sapiens
KLLGGLAVR

SEQ ID NO: 42261 - protein, 9 aa, Homo Sapiens
KLNIRPLLR

SEQ ID NO: 42262 - protein, 9 aa, Homo Sapiens
KLQPPPLGR

SEQ ID NO: 42263 - protein, 9 aa, Homo Sapiens
KLWEISTGR

SEQ ID NO: 42264 - protein, 9 aa, Homo Sapiens
KLYPLPSAR

SEQ ID NO: 42265 - protein, 9 aa, Homo Sapiens
KLYSLLFRR

SEQ ID NO: 42266 - protein, 9 aa, Homo Sapiens
KQFLPFLQR

SEQ ID NO: 42267 - protein, 9 aa, Homo Sapiens
KQQGVLALR

SEQ ID NO: 42268 - protein, 9 aa, Homo Sapiens
KSFLPLIRR

SEQ ID NO: 42269 - protein, 9 aa, Homo Sapiens
KSFQKIQVR

SEQ ID NO: 42270 - protein, 9 aa, Homo Sapiens
KSIANLIER

SEQ ID NO: 42271 - protein, 9 aa, Homo Sapiens
KSKVPAFVR

SEQ ID NO: 42272 - protein, 9 aa, Homo Sapiens
KSLPGVVTR

SEQ ID NO: 42273 - protein, 9 aa, Homo Sapiens
KTFSEILNR

SEQ ID NO: 42274 - protein, 9 aa, Homo Sapiens
KTILKRLFR

SEQ ID NO: 42275 - protein, 9 aa, Homo Sapiens
KTLEGVITR

SEQ ID NO: 42276 - protein, 9 aa, Homo Sapiens
KTLPKIVGR

SEQ ID NO: 42277 - protein, 9 aa, Homo Sapiens
KTNGKFLIR

SEQ ID NO: 42278 - protein, 9 aa, Homo Sapiens
KVIPPIRSR

SEQ ID NO: 42279 - protein, 9 aa, Homo Sapiens
KVLRPFLLR

SEQ ID NO: 42280 - protein, 9 aa, Homo Sapiens
KVMGILINR

SEQ ID NO: 42281 - protein, 9 aa, Homo Sapiens
KVWVKLIGR

SEQ ID NO: 42282 - protein, 9 aa, Homo Sapiens
KWYEKFFGR

SEQ ID NO: 42283 - protein, 9 aa, Homo Sapiens
KYIDYIFNV

SEQ ID NO: 42284 - protein, 9 aa, Homo Sapiens
KYIERIITR

SEQ ID NO: 42285 - protein, 9 aa, Homo Sapiens
KYLAFLRKR

SEQ ID NO: 42286 - protein, 9 aa, Homo Sapiens
KYLNPFFTR

SEQ ID NO: 42287 - protein, 9 aa, Homo Sapiens
KYPVWLWKR

SEQ ID NO: 42288 - protein, 9 aa, Homo Sapiens
LALNIIQNR

SEQ ID NO: 42289 - protein, 9 aa, Homo Sapiens
LAQFHFTNR

SEQ ID NO: 42290 - protein, 9 aa, Homo Sapiens
LIKPPTILR

SEQ ID NO: 42291 - protein, 9 aa, Homo Sapiens
LINNKIANR

SEQ ID NO: 42292 - protein, 9 aa, Homo Sapiens
LIRKLPFQR

SEQ ID NO: 42293 - protein, 9 aa, Homo Sapiens
LLNAVIVQR

SEQ ID NO: 42294 - protein, 9 aa, Homo Sapiens
LMLKLKWKS

SEQ ID NO: 42295 - protein, 9 aa, Homo Sapiens
LQNPDLALR

SEQ ID NO: 42296 - protein, 9 aa, Homo Sapiens
LQNVNITLR

SEQ ID NO: 42297 - protein, 9 aa, Homo Sapiens
LRIASRLAR

SEQ ID NO: 42298 - protein, 9 aa, Homo Sapiens
LSLGMVYLR

SEQ ID NO: 42299 - protein, 9 aa, Homo Sapiens
LSLPGITNR

SEQ ID NO: 42300 - protein, 9 aa, Homo Sapiens
LSRLPGEVR

SEQ ID NO: 42301 - protein, 9 aa, Homo Sapiens
LTGPVMPVR

SEQ ID NO: 42302 - protein, 9 aa, Homo Sapiens
LYFPDFIVR

SEQ ID NO: 42303 - protein, 9 aa, Homo Sapiens
LYRKMEIYR

SEQ ID NO: 42304 - protein, 9 aa, Homo Sapiens
MGLFNFRPS

SEQ ID NO: 42305 - protein, 9 aa, Homo Sapiens
MGLSSFISR

SEQ ID NO: 42306 - protein, 9 aa, Homo Sapiens
MLRLPTVFR

SEQ ID NO: 42307 - protein, 9 aa, Homo Sapiens
MLYGLIHAR

SEQ ID NO: 42308 - protein, 9 aa, Homo Sapiens
MPKDIQLAR

SEQ ID NO: 42309 - protein, 9 aa, Homo Sapiens
PIRLLAAAA

SEQ ID NO: 42310 - protein, 9 aa, Homo Sapiens
QAWSLPTQR

SEQ ID NO: 42311 - protein, 9 aa, Homo Sapiens
QEFGLARFK

SEQ ID NO: 42312 - protein, 9 aa, Homo Sapiens
QFFQRILER

SEQ ID NO: 42313 - protein, 9 aa, Homo Sapiens
QFFYVPVKR

SEQ ID NO: 42314 - protein, 9 aa, Homo Sapiens
QGYSDFINR

SEQ ID NO: 42315 - protein, 9 aa, Homo Sapiens
QLGQFLQHR

SEQ ID NO: 42316 - protein, 9 aa, Homo Sapiens
QLMPALVQR

SEQ ID NO: 42317 - protein, 9 aa, Homo Sapiens
QLYPRNFLR

SEQ ID NO: 42318 - protein, 9 aa, Homo Sapiens
QQLYWSHPR

SEQ ID NO: 42319 - protein, 9 aa, Homo Sapiens
QSWVPLLSR

SEQ ID NO: 42320 - protein, 9 aa, Homo Sapiens
QTQSIYIPR

SEQ ID NO: 42321 - protein, 9 aa, Homo Sapiens
QVAIKVIPR

SEQ ID NO: 42322 - protein, 9 aa, Homo Sapiens
QVKTWFQNR

SEQ ID NO: 42323 - protein, 9 aa, Homo Sapiens
QVLPRFQPR

SEQ ID NO: 42324 - protein, 9 aa, Homo Sapiens
RFLDRFVYR

SEQ ID NO: 42325 - protein, 9 aa, Homo Sapiens
RFVDFQKVR

SEQ ID NO: 42326 - protein, 9 aa, Homo Sapiens
RFVNLISER

SEQ ID NO: 42327 - protein, 9 aa, Homo Sapiens
RGLSYIHQR

SEQ ID NO: 42328 - protein, 9 aa, Homo Sapiens
RGMNVPFKR

SEQ ID NO: 42329 - protein, 9 aa, Homo Sapiens
RIFTSVPKR

SEQ ID NO: 42330 - protein, 9 aa, Homo Sapiens
RIIVPLNNR

SEQ ID NO: 42331 - protein, 9 aa, Homo Sapiens
RIWSPTIGR

SEQ ID NO: 42332 - protein, 9 aa, Homo Sapiens
RLAPIPRAR

SEQ ID NO: 42333 - protein, 9 aa, Homo Sapiens
RLAVRTVIR

SEQ ID NO: 42334 - protein, 9 aa, Homo Sapiens
RLFEWVVNR

SEQ ID NO: 42335 - protein, 9 aa, Homo Sapiens
RLFGALLER

SEQ ID NO: 42336 - protein, 9 aa, Homo Sapiens
RLFNAIIHR

SEQ ID NO: 42337 - protein, 9 aa, Homo Sapiens
RLFPPLRQR

SEQ ID NO: 42338 - protein, 9 aa, Homo Sapiens
RLFSIVRPR

SEQ ID NO: 42339 - protein, 9 aa, Homo Sapiens
RLIDVLENR

SEQ ID NO: 42340 - protein, 9 aa, Homo Sapiens
RLKDSWVER

SEQ ID NO: 42341 - protein, 9 aa, Homo Sapiens
RLKIGFILR

SEQ ID NO: 42342 - protein, 9 aa, Homo Sapiens
RLLDFLQKR

SEQ ID NO: 42343 - protein, 9 aa, Homo Sapiens
RLMKVFVTR

SEQ ID NO: 42344 - protein, 9 aa, Homo Sapiens
RLQQLRELR

SEQ ID NO: 42345 - protein, 9 aa, Homo Sapiens
RLWDFIENR

SEQ ID NO: 42346 - protein, 9 aa, Homo Sapiens
RLWDLQQLR

SEQ ID NO: 42347 - protein, 9 aa, Homo Sapiens
RLYTKFSAR

SEQ ID NO: 42348 - protein, 9 aa, Homo Sapiens
RMLERVIGR

SEQ ID NO: 42349 - protein, 9 aa, Homo Sapiens
RNTLFQLQR

SEQ ID NO: 42350 - protein, 9 aa, Homo Sapiens
RQAGLSYIR

SEQ ID NO: 42351 - protein, 9 aa, Homo Sapiens
RQKFQILGR

SEQ ID NO: 42352 - protein, 9 aa, Homo Sapiens
RQLFRILFR

SEQ ID NO: 42353 - protein, 9 aa, Homo Sapiens
RQLWRVIER

SEQ ID NO: 42354 - protein, 9 aa, Homo Sapiens
RQTGIVLNR

SEQ ID NO: 42355 - protein, 9 aa, Homo Sapiens
RSAALSWLR

SEQ ID NO: 42356 - protein, 9 aa, Homo Sapiens
RSFSLGVPR

SEQ ID NO: 42357 - protein, 9 aa, Homo Sapiens
RSHSIFSIR

SEQ ID NO: 42358 - protein, 9 aa, Homo Sapiens
RSLPFFSAR

SEQ ID NO: 42359 - protein, 9 aa, Homo Sapiens
RSMVQFIGR

SEQ ID NO: 42360 - protein, 9 aa, Homo Sapiens
RSNPKIWNV

SEQ ID NO: 42361 - protein, 9 aa, Homo Sapiens
RSQVFNILR

SEQ ID NO: 42362 - protein, 9 aa, Homo Sapiens
RSVAGLLPR

SEQ ID NO: 42363 - protein, 9 aa, Homo Sapiens
RSWKVFNER

SEQ ID NO: 42364 - protein, 9 aa, Homo Sapiens
RTAALPTFR

SEQ ID NO: 42365 - protein, 9 aa, Homo Sapiens
RTALILAVR

SEQ ID NO: 42366 - protein, 9 aa, Homo Sapiens
RTIALLIGR

SEQ ID NO: 42367 - protein, 9 aa, Homo Sapiens
RTIAPIIGR

SEQ ID NO: 42368 - protein, 9 aa, Homo Sapiens
RTKLSLIMR

SEQ ID NO: 42369 - protein, 9 aa, Homo Sapiens
RTLDPSWLR

SEQ ID NO: 42370 - protein, 9 aa, Homo Sapiens
RTLGLLVKR

SEQ ID NO: 42371 - protein, 9 aa, Homo Sapiens
RTLIPRYFR

SEQ ID NO: 42372 - protein, 9 aa, Homo Sapiens
RTLKLSVQR

SEQ ID NO: 42373 - protein, 9 aa, Homo Sapiens
RTLLVADPR

SEQ ID NO: 42374 - protein, 9 aa, Homo Sapiens
RTMALPVGR

SEQ ID NO: 42375 - protein, 9 aa, Homo Sapiens
RVGDVYIPR

SEQ ID NO: 42376 - protein, 9 aa, Homo Sapiens
RVHSIFVLR

SEQ ID NO: 42377 - protein, 9 aa, Homo Sapiens
RVITALVER

SEQ ID NO: 42378 - protein, 9 aa, Homo Sapiens
RVIWGKVTR

SEQ ID NO: 42379 - protein, 9 aa, Homo Sapiens
RVKEYFVFR

SEQ ID NO: 42380 - protein, 9 aa, Homo Sapiens
RVKVFGWVH

SEQ ID NO: 42381 - protein, 9 aa, Homo Sapiens
RVLDALVAR

SEQ ID NO: 42382 - protein, 9 aa, Homo Sapiens
RVLTAPTLR

SEQ ID NO: 42383 - protein, 9 aa, Homo Sapiens
RVMGIRVLR

SEQ ID NO: 42384 - protein, 9 aa, Homo Sapiens
RVNIPKVLR

SEQ ID NO: 42385 - protein, 9 aa, Homo Sapiens
RVNLKFLTR

SEQ ID NO: 42386 - protein, 9 aa, Homo Sapiens
RVNVTGIYR

SEQ ID NO: 42387 - protein, 9 aa, Homo Sapiens
RVPELFANR

SEQ ID NO: 42388 - protein, 9 aa, Homo Sapiens
RVQPIKLAR

SEQ ID NO: 42389 - protein, 9 aa, Homo Sapiens
RVQVVGTYR

SEQ ID NO: 42390 - protein, 9 aa, Homo Sapiens
RVSVVWVER

SEQ ID NO: 42391 - protein, 9 aa, Homo Sapiens
RVTVPLVRR

SEQ ID NO: 42392 - protein, 9 aa, Homo Sapiens
RVYHYFQWR

SEQ ID NO: 42393 - protein, 9 aa, Homo Sapiens
RVYNIYIRR

SEQ ID NO: 42394 - protein, 9 aa, Homo Sapiens
RVYNWDVKR

SEQ ID NO: 42395 - protein, 9 aa, Homo Sapiens
RYIEIFPSR

SEQ ID NO: 42396 - protein, 9 aa, Homo Sapiens
RYISKMFLR

SEQ ID NO: 42397 - protein, 9 aa, Homo Sapiens
RYMFSRPFR

SEQ ID NO: 42398 - protein, 9 aa, Homo Sapiens
RYQDILVFR

SEQ ID NO: 42399 - protein, 9 aa, Homo Sapiens
RYRLPVATR

SEQ ID NO: 42400 - protein, 9 aa, Homo Sapiens
RYYDILKKR

SEQ ID NO: 42401 - protein, 9 aa, Homo Sapiens
RYYTPTISR

SEQ ID NO: 42402 - protein, 9 aa, Homo Sapiens
SAFSILFNR

SEQ ID NO: 42403 - protein, 9 aa, Homo Sapiens
SAIHIRVFR

SEQ ID NO: 42404 - protein, 9 aa, Homo Sapiens
SFISFANSR

SEQ ID NO: 42405 - protein, 9 aa, Homo Sapiens
SFKDYIQER

SEQ ID NO: 42406 - protein, 9 aa, Homo Sapiens
SFMPYHIQR

SEQ ID NO: 42407 - protein, 9 aa, Homo Sapiens
SGKIIFVGR

SEQ ID NO: 42408 - protein, 9 aa, Homo Sapiens
SGLSIFIYR

SEQ ID NO: 42409 - protein, 9 aa, Homo Sapiens
SGYPPFVGR

SEQ ID NO: 42410 - protein, 9 aa, Homo Sapiens
SIMKWNRER

SEQ ID NO: 42411 - protein, 9 aa, Homo Sapiens
SINLLLAQR

SEQ ID NO: 42412 - protein, 9 aa, Homo Sapiens
SIPTFYFPR

SEQ ID NO: 42413 - protein, 9 aa, Homo Sapiens
SLKALIQSR

SEQ ID NO: 42414 - protein, 9 aa, Homo Sapiens
SLKIPNVER

SEQ ID NO: 42415 - protein, 9 aa, Homo Sapiens
SLMSALAAR

SEQ ID NO: 42416 - protein, 9 aa, Homo Sapiens
SLNLRTFLR

SEQ ID NO: 42417 - protein, 9 aa, Homo Sapiens
SLNPKTWGR

SEQ ID NO: 42418 - protein, 9 aa, Homo Sapiens
SLQQLVSQR

SEQ ID NO: 42419 - protein, 9 aa, Homo Sapiens
SLRLLTHQR

SEQ ID NO: 42420 - protein, 9 aa, Homo Sapiens
SLWHIQISR

SEQ ID NO: 42421 - protein, 9 aa, Homo Sapiens
SMFDVHVKR

SEQ ID NO: 42422 - protein, 9 aa, Homo Sapiens
SMLEYFINR

SEQ ID NO: 42423 - protein, 9 aa, Homo Sapiens
SMSSTFFSR

SEQ ID NO: 42424 - protein, 9 aa, Homo Sapiens
SQNSLFTFR

SEQ ID NO: 42425 - protein, 9 aa, Homo Sapiens
SSFRFWQAR

SEQ ID NO: 42426 - protein, 9 aa, Homo Sapiens
SSKPLYLAR

SEQ ID NO: 42427 - protein, 9 aa, Homo Sapiens
SSLLRTSIM

SEQ ID NO: 42428 - protein, 9 aa, Homo Sapiens
STARHLYLR

SEQ ID NO: 42429 - protein, 9 aa, Homo Sapiens
STFLFGSIR

SEQ ID NO: 42430 - protein, 9 aa, Homo Sapiens
STLNKLIKR

SEQ ID NO: 42431 - protein, 9 aa, Homo Sapiens
STNFKLIYR

SEQ ID NO: 42432 - protein, 9 aa, Homo Sapiens
STVPSILNR

SEQ ID NO: 42433 - protein, 9 aa, Homo Sapiens
STYIRLYGR

SEQ ID NO: 42434 - protein, 9 aa, Homo Sapiens
SVGQRIWQR

SEQ ID NO: 42435 - protein, 9 aa, Homo Sapiens
SVHLQPITR

SEQ ID NO: 42436 - protein, 9 aa, Homo Sapiens
SVITQVFHV

SEQ ID NO: 42437 - protein, 9 aa, Homo Sapiens
SVKFGATLR

SEQ ID NO: 42438 - protein, 9 aa, Homo Sapiens
SVLDYFSER

SEQ ID NO: 42439 - protein, 9 aa, Homo Sapiens
SVLENFVGR

SEQ ID NO: 42440 - protein, 9 aa, Homo Sapiens
SVLKELQNR

SEQ ID NO: 42441 - protein, 9 aa, Homo Sapiens
SVLNFATNR

SEQ ID NO: 42442 - protein, 9 aa, Homo Sapiens
SVLNMVVRR

SEQ ID NO: 42443 - protein, 9 aa, Homo Sapiens
SVLSRINQR

SEQ ID NO: 42444 - protein, 9 aa, Homo Sapiens
SVLTPLLLR

SEQ ID NO: 42445 - protein, 9 aa, Homo Sapiens
SVLWPWINR

SEQ ID NO: 42446 - protein, 9 aa, Homo Sapiens
SVQGIIIYR

SEQ ID NO: 42447 - protein, 9 aa, Homo Sapiens
SVSDIIRLR

SEQ ID NO: 42448 - protein, 9 aa, Homo Sapiens
SVSPFLLGR

SEQ ID NO: 42449 - protein, 9 aa, Homo Sapiens
SVVGFYSLR

SEQ ID NO: 42450 - protein, 9 aa, Homo Sapiens
SVVLLPAGR

SEQ ID NO: 42451 - protein, 9 aa, Homo Sapiens
SVVSVGWLR

SEQ ID NO: 42452 - protein, 9 aa, Homo Sapiens
SVWPFLVQR

SEQ ID NO: 42453 - protein, 9 aa, Homo Sapiens
SVYIPAHGR

SEQ ID NO: 42454 - protein, 9 aa, Homo Sapiens
SVYQIKVHR

SEQ ID NO: 42455 - protein, 9 aa, Homo Sapiens
SYFSFSRNR

SEQ ID NO: 42456 - protein, 9 aa, Homo Sapiens
SYLDKFFSR

SEQ ID NO: 42457 - protein, 9 aa, Homo Sapiens
SYNYEIVNR

SEQ ID NO: 42458 - protein, 9 aa, Homo Sapiens
SYPSLFIFR

SEQ ID NO: 42459 - protein, 9 aa, Homo Sapiens
SYRKFLNLR

SEQ ID NO: 42460 - protein, 9 aa, Homo Sapiens
SYSLFTALR

SEQ ID NO: 42461 - protein, 9 aa, Homo Sapiens
SYVELSQYR

SEQ ID NO: 42462 - protein, 9 aa, Homo Sapiens
TALVIMWQK

SEQ ID NO: 42463 - protein, 9 aa, Homo Sapiens
TAYRPPALR

SEQ ID NO: 42464 - protein, 9 aa, Homo Sapiens
TFYSISQER

SEQ ID NO: 42465 - protein, 9 aa, Homo Sapiens
TILIILTGR

SEQ ID NO: 42466 - protein, 9 aa, Homo Sapiens
TIRLLTSLR

SEQ ID NO: 42467 - protein, 9 aa, Homo Sapiens
TLNDLPVGR

SEQ ID NO: 42468 - protein, 9 aa, Homo Sapiens
TSISSLFER

SEQ ID NO: 42469 - protein, 9 aa, Homo Sapiens
TSNIIAWLR

SEQ ID NO: 42470 - protein, 9 aa, Homo Sapiens
TSWVPLVSR

SEQ ID NO: 42471 - protein, 9 aa, Homo Sapiens
TSYPFDTVR

SEQ ID NO: 42472 - protein, 9 aa, Homo Sapiens
TTFVPMLHR

SEQ ID NO: 42473 - protein, 9 aa, Homo Sapiens
TTKPAIIFR

SEQ ID NO: 42474 - protein, 9 aa, Homo Sapiens
TTLTKIALR

SEQ ID NO: 42475 - protein, 9 aa, Homo Sapiens
TVLGYFIGR

SEQ ID NO: 42476 - protein, 9 aa, Homo Sapiens
TVLIIKSLR

SEQ ID NO: 42477 - protein, 9 aa, Homo Sapiens
TVLQYVVGR

SEQ ID NO: 42478 - protein, 9 aa, Homo Sapiens
TVSRFFLYR

SEQ ID NO: 42479 - protein, 9 aa, Homo Sapiens
TYFPSFLSR

SEQ ID NO: 42480 - protein, 9 aa, Homo Sapiens
TYLTKFIAR

SEQ ID NO: 42481 - protein, 9 aa, Homo Sapiens
TYYGSFVTR

SEQ ID NO: 42482 - protein, 9 aa, Homo Sapiens
TYYPPPRLR

SEQ ID NO: 42483 - protein, 9 aa, Homo Sapiens
VFKEEGVLR

SEQ ID NO: 42484 - protein, 9 aa, Homo Sapiens
VFLLWKNWR

SEQ ID NO: 42485 - protein, 9 aa, Homo Sapiens
VGMNFKTPR

SEQ ID NO: 42486 - protein, 9 aa, Homo Sapiens
VGQYPRFLR

SEQ ID NO: 42487 - protein, 9 aa, Homo Sapiens
VIFVKSVQR

SEQ ID NO: 42488 - protein, 9 aa, Homo Sapiens
VLNPTPIKR

SEQ ID NO: 42489 - protein, 9 aa, Homo Sapiens
VLSPPRWPR

SEQ ID NO: 42490 - protein, 9 aa, Homo Sapiens
VMKDFEEMR

SEQ ID NO: 42491 - protein, 9 aa, Homo Sapiens
VMKPPQVVR

SEQ ID NO: 42492 - protein, 9 aa, Homo Sapiens
VMLPTPVLR

SEQ ID NO: 42493 - protein, 9 aa, Homo Sapiens
VQKLPMIGR

SEQ ID NO: 42494 - protein, 9 aa, Homo Sapiens
VQKPSYYVR

SEQ ID NO: 42495 - protein, 9 aa, Homo Sapiens
VSLPSFFER

SEQ ID NO: 42496 - protein, 9 aa, Homo Sapiens
VSNKWLHER

SEQ ID NO: 42497 - protein, 9 aa, Homo Sapiens
VSWKTGVFR

SEQ ID NO: 42498 - protein, 9 aa, Homo Sapiens
VSYPFDTVR

SEQ ID NO: 42499 - protein, 9 aa, Homo Sapiens
VTIQVSWER

SEQ ID NO: 42500 - protein, 9 aa, Homo Sapiens
VVIIVRAPR

SEQ ID NO: 42501 - protein, 9 aa, Homo Sapiens
VVYPKVIER

SEQ ID NO: 42502 - protein, 9 aa, Homo Sapiens
VYIAEIYFR

SEQ ID NO: 42503 - protein, 9 aa, Homo Sapiens
VYIEKFVRR

SEQ ID NO: 42504 - protein, 9 aa, Homo Sapiens
VYITNFHVR

SEQ ID NO: 42505 - protein, 9 aa, Homo Sapiens
WVSVVTPAR

SEQ ID NO: 42506 - protein, 9 aa, Homo Sapiens
YGIPQRALR

SEQ ID NO: 42507 - protein, 9 aa, Homo Sapiens
YSNKEIFLR

SEQ ID NO: 42508 - protein, 9 aa, Homo Sapiens
YVFPKPFNR

SEQ ID NO: 42509 - protein, 9 aa, Homo Sapiens
YVKEQFAWR

SEQ ID NO: 42510 - protein, 10 aa, Homo Sapiens
AARDFLQTFR

SEQ ID NO: 42511 - protein, 10 aa, Homo Sapiens
AFRNLVPVTR

SEQ ID NO: 42512 - protein, 10 aa, Homo Sapiens
ALAPKFPEYR

SEQ ID NO: 42513 - protein, 10 aa, Homo Sapiens
ALLEVMRMNR

SEQ ID NO: 42514 - protein, 10 aa, Homo Sapiens
ALMDRDLVHR

SEQ ID NO: 42515 - protein, 10 aa, Homo Sapiens
ALMDRGAIVR

SEQ ID NO: 42516 - protein, 10 aa, Homo Sapiens
ALRDFTRLFR

SEQ ID NO: 42517 - protein, 10 aa, Homo Sapiens
ATAGIIGVNR

SEQ ID NO: 42518 - protein, 10 aa, Homo Sapiens
ATATVYFKRF

SEQ ID NO: 42519 - protein, 10 aa, Homo Sapiens
ATCDFPLLNR

SEQ ID NO: 42520 - protein, 10 aa, Homo Sapiens
ATFQFTVERF

SEQ ID NO: 42521 - protein, 10 aa, Homo Sapiens
ATGSIPITVR

SEQ ID NO: 42522 - protein, 10 aa, Homo Sapiens
ATLGAILNRL

SEQ ID NO: 42523 - protein, 10 aa, Homo Sapiens
ATLKDITRRL

SEQ ID NO: 42524 - protein, 10 aa, Homo Sapiens
ATNAAVTVLR

SEQ ID NO: 42525 - protein, 10 aa, Homo Sapiens
ATQPWNRIQR

SEQ ID NO: 42526 - protein, 10 aa, Homo Sapiens
ATSPIIIHRL

SEQ ID NO: 42527 - protein, 10 aa, Homo Sapiens
AVFPFKPPQR

SEQ ID NO: 42528 - protein, 10 aa, Homo Sapiens
AVLKWNREMR

SEQ ID NO: 42529 - protein, 10 aa, Homo Sapiens
FQLYPRNFLR

SEQ ID NO: 42530 - protein, 10 aa, Homo Sapiens
GILGLGRIGR

SEQ ID NO: 42531 - protein, 10 aa, Homo Sapiens
GSRYFALVER

SEQ ID NO: 42532 - protein, 10 aa, Homo Sapiens
GTKQLQVLRF

SEQ ID NO: 42533 - protein, 10 aa, Homo Sapiens
GTLDFYMARL

SEQ ID NO: 42534 - protein, 10 aa, Homo Sapiens
GTLNLDRVTR

SEQ ID NO: 42535 - protein, 10 aa, Homo Sapiens
GTLQPPFTAR

SEQ ID NO: 42536 - protein, 10 aa, Homo Sapiens
GTLSPAFSTR

SEQ ID NO: 42537 - protein, 10 aa, Homo Sapiens
GTYYPPPRLR

SEQ ID NO: 42538 - protein, 10 aa, Homo Sapiens
GVNGFGRIGR

SEQ ID NO: 42539 - protein, 10 aa, Homo Sapiens
HQQLYWSHPR

SEQ ID NO: 42540 - protein, 10 aa, Homo Sapiens
HSQDLSGRLR

SEQ ID NO: 42541 - protein, 10 aa, Homo Sapiens
HTKAVNVVRF

SEQ ID NO: 42542 - protein, 10 aa, Homo Sapiens
HTRTPPIIHR

SEQ ID NO: 42543 - protein, 10 aa, Homo Sapiens
HVYDGKFLAR

SEQ ID NO: 42544 - protein, 10 aa, Homo Sapiens
IANPNVPAYR

SEQ ID NO: 42545 - protein, 10 aa, Homo Sapiens
IIKALKEPPR

SEQ ID NO: 42546 - protein, 10 aa, Homo Sapiens
IVKGPRGTLR

SEQ ID NO: 42547 - protein, 10 aa, Homo Sapiens
IVNENLVERF

SEQ ID NO: 42548 - protein, 10 aa, Homo Sapiens
IVRPFSIETK

SEQ ID NO: 42549 - protein, 10 aa, Homo Sapiens
KAKQGYVIYR

SEQ ID NO: 42550 - protein, 10 aa, Homo Sapiens
KAMENLFINR

SEQ ID NO: 42551 - protein, 10 aa, Homo Sapiens
KIRDLIAIER

SEQ ID NO: 42552 - protein, 10 aa, Homo Sapiens
KLNIDSIIQR

SEQ ID NO: 42553 - protein, 10 aa, Homo Sapiens
KLNPYAKTMR

SEQ ID NO: 42554 - protein, 10 aa, Homo Sapiens
KQRDDILINR

SEQ ID NO: 42555 - protein, 10 aa, Homo Sapiens
KSKDFVQVMR

SEQ ID NO: 42556 - protein, 10 aa, Homo Sapiens
KSLDQAISRF

SEQ ID NO: 42557 - protein, 10 aa, Homo Sapiens
KTIDMELVKR

SEQ ID NO: 42558 - protein, 10 aa, Homo Sapiens
KTKADGSFRL

SEQ ID NO: 42559 - protein, 10 aa, Homo Sapiens
KTKEYIFLRL

SEQ ID NO: 42560 - protein, 10 aa, Homo Sapiens
KTRDAILQLR

SEQ ID NO: 42561 - protein, 10 aa, Homo Sapiens
KVKAPPSVPR

SEQ ID NO: 42562 - protein, 10 aa, Homo Sapiens
KVQTFPFLGR

SEQ ID NO: 42563 - protein, 10 aa, Homo Sapiens
KYFDEHYEYR

SEQ ID NO: 42564 - protein, 10 aa, Homo Sapiens
KYFIRDEFLR

SEQ ID NO: 42565 - protein, 10 aa, Homo Sapiens
KYFLGQSVLR

SEQ ID NO: 42566 - protein, 10 aa, Homo Sapiens
KYIERIITRF

SEQ ID NO: 42567 - protein, 10 aa, Homo Sapiens
KYLDKELAGR

SEQ ID NO: 42568 - protein, 10 aa, Homo Sapiens
KYLNWDAVFR

SEQ ID NO: 42569 - protein, 10 aa, Homo Sapiens
LINPQGKAFR

SEQ ID NO: 42570 - protein, 10 aa, Homo Sapiens
LQFPDRSVQR

SEQ ID NO: 42571 - protein, 10 aa, Homo Sapiens
LQFPVGRIHR

SEQ ID NO: 42572 - protein, 10 aa, Homo Sapiens
LQFPVGRVHR

SEQ ID NO: 42573 - protein, 10 aa, Homo Sapiens
LQKPVLPLYR

SEQ ID NO: 42574 - protein, 10 aa, Homo Sapiens
LQNEPLPERL

SEQ ID NO: 42575 - protein, 10 aa, Homo Sapiens
LYISEGLHPR

SEQ ID NO: 42576 - protein, 10 aa, Homo Sapiens
LYQEVFGRLR

SEQ ID NO: 42577 - protein, 10 aa, Homo Sapiens
QYIRPVFVSR

SEQ ID NO: 42578 - protein, 10 aa, Homo Sapiens
QYKFPVVITR

SEQ ID NO: 42579 - protein, 10 aa, Homo Sapiens
RAGLQFPVGR

SEQ ID NO: 42580 - protein, 10 aa, Homo Sapiens
RAKVEVNIPR

SEQ ID NO: 42581 - protein, 10 aa, Homo Sapiens
RALAMLQRFS

SEQ ID NO: 42582 - protein, 10 aa, Homo Sapiens
RALPGLLEAR

SEQ ID NO: 42583 - protein, 10 aa, Homo Sapiens
RAVFPSIVGR

SEQ ID NO: 42584 - protein, 10 aa, Homo Sapiens
RFIKIDGKVR

SEQ ID NO: 42585 - protein, 10 aa, Homo Sapiens
RFINPLKNLR

SEQ ID NO: 42586 - protein, 10 aa, Homo Sapiens
RFKIDLGIFR

SEQ ID NO: 42587 - protein, 10 aa, Homo Sapiens
RFNDLRFVGR

SEQ ID NO: 42588 - protein, 10 aa, Homo Sapiens
RFTGSIFIGR

SEQ ID NO: 42589 - protein, 10 aa, Homo Sapiens
RIGVITNRER

SEQ ID NO: 42590 - protein, 10 aa, Homo Sapiens
RILKSPEIQR

SEQ ID NO: 42591 - protein, 10 aa, Homo Sapiens
RIMDRFNLPR

SEQ ID NO: 42592 - protein, 10 aa, Homo Sapiens
RLFEWVVNRI

SEQ ID NO: 42593 - protein, 10 aa, Homo Sapiens
RLIPDFPVAR

SEQ ID NO: 42594 - protein, 10 aa, Homo Sapiens
RLKFGFGFHR

SEQ ID NO: 42595 - protein, 10 aa, Homo Sapiens
RLKPFGVQRF

SEQ ID NO: 42596 - protein, 10 aa, Homo Sapiens
RLRAVDFAER

SEQ ID NO: 42597 - protein, 10 aa, Homo Sapiens
RMFAPTKTWR

SEQ ID NO: 42598 - protein, 10 aa, Homo Sapiens
RSFSLGVPRL

SEQ ID NO: 42599 - protein, 10 aa, Homo Sapiens
RSGPFGQIFR

SEQ ID NO: 42600 - protein, 10 aa, Homo Sapiens
RSIPPLFSGR

SEQ ID NO: 42601 - protein, 10 aa, Homo Sapiens
RSLDNFFAKR

SEQ ID NO: 42602 - protein, 10 aa, Homo Sapiens
RSLQLQEHRL

SEQ ID NO: 42603 - protein, 10 aa, Homo Sapiens
RSSYIRILPR

SEQ ID NO: 42604 - protein, 10 aa, Homo Sapiens
RSWQGLEPRL

SEQ ID NO: 42605 - protein, 10 aa, Homo Sapiens
RTHSLRYFRL

SEQ ID NO: 42606 - protein, 10 aa, Homo Sapiens
RTVLVIAHRL

SEQ ID NO: 42607 - protein, 10 aa, Homo Sapiens
RVFQGFFTGR

SEQ ID NO: 42608 - protein, 10 aa, Homo Sapiens
RVHLPSSIYR

SEQ ID NO: 42609 - protein, 10 aa, Homo Sapiens
RVHSIFVLRL

SEQ ID NO: 42610 - protein, 10 aa, Homo Sapiens
RVIIEKYYTR

SEQ ID NO: 42611 - protein, 10 aa, Homo Sapiens
RVKGPGISKF

SEQ ID NO: 42612 - protein, 10 aa, Homo Sapiens
RVKQLQENRL

SEQ ID NO: 42613 - protein, 10 aa, Homo Sapiens
RVKTVWLVGR

SEQ ID NO: 42614 - protein, 10 aa, Homo Sapiens
RVLDLGPITR

SEQ ID NO: 42615 - protein, 10 aa, Homo Sapiens
RVLDVGFVGR

SEQ ID NO: 42616 - protein, 10 aa, Homo Sapiens
RVLSKAFSRL

SEQ ID NO: 42617 - protein, 10 aa, Homo Sapiens
RVNKPPYPKL

SEQ ID NO: 42618 - protein, 10 aa, Homo Sapiens
RYFALVERRL

SEQ ID NO: 42619 - protein, 10 aa, Homo Sapiens
RYFYLFPNRL

SEQ ID NO: 42620 - protein, 10 aa, Homo Sapiens
RYIEIFKSSR

SEQ ID NO: 42621 - protein, 10 aa, Homo Sapiens
RYIEIFPSRR

SEQ ID NO: 42622 - protein, 10 aa, Homo Sapiens
RYIPPHLRNR

SEQ ID NO: 42623 - protein, 10 aa, Homo Sapiens
RYIPPIPVHR

SEQ ID NO: 42624 - protein, 10 aa, Homo Sapiens
RYLEVEPVSR

SEQ ID NO: 42625 - protein, 10 aa, Homo Sapiens
RYLTVAAVFR

SEQ ID NO: 42626 - protein, 10 aa, Homo Sapiens
RYQQFKDFQR

SEQ ID NO: 42627 - protein, 10 aa, Homo Sapiens
RYRPGTVALR

SEQ ID NO: 42628 - protein, 10 aa, Homo Sapiens
RYYPQILTNK

SEQ ID NO: 42629 - protein, 10 aa, Homo Sapiens
SFFGERRIPR

SEQ ID NO: 42630 - protein, 10 aa, Homo Sapiens
SFITKVFRSR

SEQ ID NO: 42631 - protein, 10 aa, Homo Sapiens
SFLNFGFANR

SEQ ID NO: 42632 - protein, 10 aa, Homo Sapiens
SFRYNGLIHR

SEQ ID NO: 42633 - protein, 10 aa, Homo Sapiens
SFSDYPPLGR

SEQ ID NO: 42634 - protein, 10 aa, Homo Sapiens
SIADRPLYLR

SEQ ID NO: 42635 - protein, 10 aa, Homo Sapiens
STYYGSFVTR

SEQ ID NO: 42636 - protein, 10 aa, Homo Sapiens
SVFDFQKAYK

SEQ ID NO: 42637 - protein, 10 aa, Homo Sapiens
SVINPGAIYR

SEQ ID NO: 42638 - protein, 10 aa, Homo Sapiens
SVNSLLKELR

SEQ ID NO: 42639 - protein, 10 aa, Homo Sapiens
SVQTALLNRL

SEQ ID NO: 42640 - protein, 10 aa, Homo Sapiens
SVSTITRIYR

SEQ ID NO: 42641 - protein, 10 aa, Homo Sapiens
SYVRWEGVFR

SEQ ID NO: 42642 - protein, 10 aa, Homo Sapiens
TMYPGLPSRL

SEQ ID NO: 42643 - protein, 10 aa, Homo Sapiens
TSYLDKFFSR

SEQ ID NO: 42644 - protein, 10 aa, Homo Sapiens
TVNTSLNVYR

SEQ ID NO: 42645 - protein, 10 aa, Homo Sapiens
TVQQLEGRWR

SEQ ID NO: 42646 - protein, 10 aa, Homo Sapiens
TYLNILLQTR

SEQ ID NO: 42647 - protein, 10 aa, Homo Sapiens
TYYGSFVTRA

SEQ ID NO: 42648 - protein, 10 aa, Homo Sapiens
VFDAKRLIGR

SEQ ID NO: 42649 - protein, 10 aa, Homo Sapiens
VFPSIVGRPR

SEQ ID NO: 42650 - protein, 10 aa, Homo Sapiens
VGRPPGPYTR

SEQ ID NO: 42651 - protein, 10 aa, Homo Sapiens
VLNEGMPIYR

SEQ ID NO: 42652 - protein, 10 aa, Homo Sapiens
VLYDRQGIGR

SEQ ID NO: 42653 - protein, 10 aa, Homo Sapiens
VQKDIQPYMR

SEQ ID NO: 42654 - protein, 10 aa, Homo Sapiens
VQKPGFGVGR

SEQ ID NO: 42655 - protein, 10 aa, Homo Sapiens
VQKPPLNIQR

SEQ ID NO: 42656 - protein, 10 aa, Homo Sapiens
VQKPSYYVRL

SEQ ID NO: 42657 - protein, 10 aa, Homo Sapiens
VTIVNILTNR

SEQ ID NO: 42658 - protein, 10 aa, Homo Sapiens
VTLPVYFRER

SEQ ID NO: 42659 - protein, 10 aa, Homo Sapiens
VVKPDQLIKR

SEQ ID NO: 42660 - protein, 10 aa, Homo Sapiens
VVYALKRQGR

SEQ ID NO: 42661 - protein, 10 aa, Homo Sapiens
WHHTFYNELR

SEQ ID NO: 42662 - protein, 10 aa, Homo Sapiens
YYLPYYKRER

SEQ ID NO: 42663 - protein, 11 aa, Homo Sapiens
AGFQRDLGSLR

SEQ ID NO: 42664 - protein, 11 aa, Homo Sapiens
AGMDASFKAFR

SEQ ID NO: 42665 - protein, 11 aa, Homo Sapiens
AIRDIDLKNRR

SEQ ID NO: 42666 - protein, 11 aa, Homo Sapiens
AIVPIGYHVPR

SEQ ID NO: 42667 - protein, 11 aa, Homo Sapiens
ALLGGRWLQPR

SEQ ID NO: 42668 - protein, 11 aa, Homo Sapiens
ALRALEGLVYR

SEQ ID NO: 42669 - protein, 11 aa, Homo Sapiens
ALVAGIDRYPR

SEQ ID NO: 42670 - protein, 11 aa, Homo Sapiens
ALWDRYMGTLR

SEQ ID NO: 42671 - protein, 11 aa, Homo Sapiens
AMFPKLNNQER

SEQ ID NO: 42672 - protein, 11 aa, Homo Sapiens
AMYPNIILTNR

SEQ ID NO: 42673 - protein, 11 aa, Homo Sapiens
AQKALDDIIYR

SEQ ID NO: 42674 - protein, 11 aa, Homo Sapiens
ASLDISRKWEK

SEQ ID NO: 42675 - protein, 11 aa, Homo Sapiens
ASMPVDIAKTR

SEQ ID NO: 42676 - protein, 11 aa, Homo Sapiens
ASMPWGDPNYR

SEQ ID NO: 42677 - protein, 11 aa, Homo Sapiens
ATIGHVEKFLR

SEQ ID NO: 42678 - protein, 11 aa, Homo Sapiens
ATLKDITRRLK

SEQ ID NO: 42679 - protein, 11 aa, Homo Sapiens
ATLTVEQLSSR

SEQ ID NO: 42680 - protein, 11 aa, Homo Sapiens
ATMVPSVLWPR

SEQ ID NO: 42681 - protein, 11 aa, Homo Sapiens
ATRPFQLVTGR

SEQ ID NO: 42682 - protein, 11 aa, Homo Sapiens
ATVQQLEGRWR

SEQ ID NO: 42683 - protein, 11 aa, Homo Sapiens
ATYPYQVVRAR

SEQ ID NO: 42684 - protein, 11 aa, Homo Sapiens
AVIPRPEPMLR

SEQ ID NO: 42685 - protein, 11 aa, Homo Sapiens
AVKLERMLTER

SEQ ID NO: 42686 - protein, 11 aa, Homo Sapiens
AVKVHSFPTLK

SEQ ID NO: 42687 - protein, 11 aa, Homo Sapiens
AVLSSGLTAAR

SEQ ID NO: 42688 - protein, 11 aa, Homo Sapiens
AVMAESAFSFK

SEQ ID NO: 42689 - protein, 11 aa, Homo Sapiens
AVMGAYVLLKR

SEQ ID NO: 42690 - protein, 11 aa, Homo Sapiens
AVRDILEGIQR

SEQ ID NO: 42691 - protein, 11 aa, Homo Sapiens
AVVDVRIGMTR

SEQ ID NO: 42692 - protein, 11 aa, Homo Sapiens
AVVGAVVFQKR

SEQ ID NO: 42693 - protein, 11 aa, Homo Sapiens
AVVPGTLLLFR

SEQ ID NO: 42694 - protein, 11 aa, Homo Sapiens
AVYPIDLVKTR

SEQ ID NO: 42695 - protein, 11 aa, Homo Sapiens
AYIAGFVLQER

SEQ ID NO: 42696 - protein, 11 aa, Homo Sapiens
AYRDAVFLAER

SEQ ID NO: 42697 - protein, 11 aa, Homo Sapiens
AYVPFGAGRHR

SEQ ID NO: 42698 - protein, 11 aa, Homo Sapiens
AYVPGFAHIPR

SEQ ID NO: 42699 - protein, 11 aa, Homo Sapiens
FSMGNEVLQNR

SEQ ID NO: 42700 - protein, 11 aa, Homo Sapiens
GAIRDIDLKNR

SEQ ID NO: 42701 - protein, 11 aa, Homo Sapiens
GALPGFLLKGR

SEQ ID NO: 42702 - protein, 11 aa, Homo Sapiens
GGYPYSFWIGR

SEQ ID NO: 42703 - protein, 11 aa, Homo Sapiens
GIKPEWMMIHR

SEQ ID NO: 42704 - protein, 11 aa, Homo Sapiens
GILVVGGVVWK

SEQ ID NO: 42705 - protein, 11 aa, Homo Sapiens
GLANGEVRIYR

SEQ ID NO: 42706 - protein, 11 aa, Homo Sapiens
GQKPGGSDFLR

SEQ ID NO: 42707 - protein, 11 aa, Homo Sapiens
GSLTRLLDSVR

SEQ ID NO: 42708 - protein, 11 aa, Homo Sapiens
GTATRWPLAVR

SEQ ID NO: 42709 - protein, 11 aa, Homo Sapiens
GTGWGENGYFR

SEQ ID NO: 42710 - protein, 11 aa, Homo Sapiens
GTLAAQALRAR

SEQ ID NO: 42711 - protein, 11 aa, Homo Sapiens
GTLGFGDKFKR

SEQ ID NO: 42712 - protein, 11 aa, Homo Sapiens
GTMNLGGSLTR

SEQ ID NO: 42713 - protein, 11 aa, Homo Sapiens
GTMSDVLRAER

SEQ ID NO: 42714 - protein, 11 aa, Homo Sapiens
GTQPTVLRTFR

SEQ ID NO: 42715 - protein, 11 aa, Homo Sapiens
GVVPAGVILER

SEQ ID NO: 42716 - protein, 11 aa, Homo Sapiens
HAMQFPAELTR

SEQ ID NO: 42717 - protein, 11 aa, Homo Sapiens
HYLPAEILQKK

SEQ ID NO: 42718 - protein, 11 aa, Homo Sapiens
ILIDPFHKAIR

SEQ ID NO: 42719 - protein, 11 aa, Homo Sapiens
ILKSPGSVVFR

SEQ ID NO: 42720 - protein, 11 aa, Homo Sapiens
ILRPEELGFLR

SEQ ID NO: 42721 - protein, 11 aa, Homo Sapiens
IQPGSTVHVLR

SEQ ID NO: 42722 - protein, 11 aa, Homo Sapiens
IQQEMDLLRFR

SEQ ID NO: 42723 - protein, 11 aa, Homo Sapiens
IYLPEVVKPPR

SEQ ID NO: 42724 - protein, 11 aa, Homo Sapiens
IYMDTLNIFMR

SEQ ID NO: 42725 - protein, 11 aa, Homo Sapiens
KAFPYSSHLIR

SEQ ID NO: 42726 - protein, 11 aa, Homo Sapiens
KAIDYYLKALR

SEQ ID NO: 42727 - protein, 11 aa, Homo Sapiens
KFFTESRLLQR

SEQ ID NO: 42728 - protein, 11 aa, Homo Sapiens
KFKESFAEMNR

SEQ ID NO: 42729 - protein, 11 aa, Homo Sapiens
KFLDPITGTFR

SEQ ID NO: 42730 - protein, 11 aa, Homo Sapiens
KGLEFVLIHQR

SEQ ID NO: 42731 - protein, 11 aa, Homo Sapiens
KGLEISGTFTR

SEQ ID NO: 42732 - protein, 11 aa, Homo Sapiens
KIWDPVHRVAL

SEQ ID NO: 42733 - protein, 11 aa, Homo Sapiens
KLIKEGDIVKR

SEQ ID NO: 42734 - protein, 11 aa, Homo Sapiens
KLKDIVSLVPR

SEQ ID NO: 42735 - protein, 11 aa, Homo Sapiens
KLKDLGNLVLR

SEQ ID NO: 42736 - protein, 11 aa, Homo Sapiens
KLKDQNIFVSR

SEQ ID NO: 42737 - protein, 11 aa, Homo Sapiens
KLMDVGLIAIR

SEQ ID NO: 42738 - protein, 11 aa, Homo Sapiens
KLQYELQYRNR

SEQ ID NO: 42739 - protein, 11 aa, Homo Sapiens
KLWDVREGMCR

SEQ ID NO: 42740 - protein, 11 aa, Homo Sapiens
KQPFKDLGNLR

SEQ ID NO: 42741 - protein, 11 aa, Homo Sapiens
KQRPYTFLLPR

SEQ ID NO: 42742 - protein, 11 aa, Homo Sapiens
KSLPSEVERLR

SEQ ID NO: 42743 - protein, 11 aa, Homo Sapiens
KTFTIKRFLAK

SEQ ID NO: 42744 - protein, 11 aa, Homo Sapiens
KTIDPKVAFPR

SEQ ID NO: 42745 - protein, 11 aa, Homo Sapiens
KTLAGDVHIVR

SEQ ID NO: 42746 - protein, 11 aa, Homo Sapiens
KTLLDKALTQR

SEQ ID NO: 42747 - protein, 11 aa, Homo Sapiens
KTRVIWGKVTR

SEQ ID NO: 42748 - protein, 11 aa, Homo Sapiens
KTSDFLKVLNR

SEQ ID NO: 42749 - protein, 11 aa, Homo Sapiens
KVDENGKISRL

SEQ ID NO: 42750 - protein, 11 aa, Homo Sapiens
KVFLKYPESLR

SEQ ID NO: 42751 - protein, 11 aa, Homo Sapiens
KVFPEDMAKYR

SEQ ID NO: 42752 - protein, 11 aa, Homo Sapiens
KVLSDDMKKLK

SEQ ID NO: 42753 - protein, 11 aa, Homo Sapiens
KVRGISEVLAR

SEQ ID NO: 42754 - protein, 11 aa, Homo Sapiens
KVVEDGILKLR

SEQ ID NO: 42755 - protein, 11 aa, Homo Sapiens
KVVEIVDEKVR

SEQ ID NO: 42756 - protein, 11 aa, Homo Sapiens
KVVNPYYLRVR

SEQ ID NO: 42757 - protein, 11 aa, Homo Sapiens
KYIHSADIIHR

SEQ ID NO: 42758 - protein, 11 aa, Homo Sapiens
KYITDWQNVFR

SEQ ID NO: 42759 - protein, 11 aa, Homo Sapiens
KYLDEDTIYHL

SEQ ID NO: 42760 - protein, 11 aa, Homo Sapiens
KYLEESNFVHR

SEQ ID NO: 42761 - protein, 11 aa, Homo Sapiens
KYLQEEVNINR

SEQ ID NO: 42762 - protein, 11 aa, Homo Sapiens
KYLSVQGQLFR

SEQ ID NO: 42763 - protein, 11 aa, Homo Sapiens
KYVDLGLGTHR

SEQ ID NO: 42764 - protein, 11 aa, Homo Sapiens
KYVDTNLQKQR

SEQ ID NO: 42765 - protein, 11 aa, Homo Sapiens
KYVTDVGVLQR

SEQ ID NO: 42766 - protein, 11 aa, Homo Sapiens
LALDESLFRGR

SEQ ID NO: 42767 - protein, 11 aa, Homo Sapiens
LFRPVASQLPR

SEQ ID NO: 42768 - protein, 11 aa, Homo Sapiens
LGLPSTLFTPR

SEQ ID NO: 42769 - protein, 11 aa, Homo Sapiens
LLLPAASRPPR

SEQ ID NO: 42770 - protein, 11 aa, Homo Sapiens
LVAVVRRLGSG

SEQ ID NO: 42771 - protein, 11 aa, Homo Sapiens
LVFPSEIVGKR

SEQ ID NO: 42772 - protein, 11 aa, Homo Sapiens
LVKPVTINVGR

SEQ ID NO: 42773 - protein, 11 aa, Homo Sapiens
LVKSTSQLLSR

SEQ ID NO: 42774 - protein, 11 aa, Homo Sapiens
MDAKSLTAWSR

SEQ ID NO: 42775 - protein, 11 aa, Homo Sapiens
MGLTISSLFSR

SEQ ID NO: 42776 - protein, 11 aa, Homo Sapiens
MQIAWSREFLK

SEQ ID NO: 42777 - protein, 11 aa, Homo Sapiens
MSIPVTMRAIR

SEQ ID NO: 42778 - protein, 11 aa, Homo Sapiens
MTIMEDYFAYR

SEQ ID NO: 42779 - protein, 11 aa, Homo Sapiens
MVKPTPGLTPR

SEQ ID NO: 42780 - protein, 11 aa, Homo Sapiens
MYRNEFTAWYR

SEQ ID NO: 42781 - protein, 11 aa, Homo Sapiens
NGRPLEMIEPR

SEQ ID NO: 42782 - protein, 11 aa, Homo Sapiens
NVGDWLRGVYR

SEQ ID NO: 42783 - protein, 11 aa, Homo Sapiens
NVRETHSLFFR

SEQ ID NO: 42784 - protein, 11 aa, Homo Sapiens
NYKPLDTIWNR

SEQ ID NO: 42785 - protein, 11 aa, Homo Sapiens
QALPSQAFIYR

SEQ ID NO: 42786 - protein, 11 aa, Homo Sapiens
QFLERFKSSAR

SEQ ID NO: 42787 - protein, 11 aa, Homo Sapiens
QIVSVAARMLK

SEQ ID NO: 42788 - protein, 11 aa, Homo Sapiens
QVIPRTPSSFR

SEQ ID NO: 42789 - protein, 11 aa, Homo Sapiens
QVRSIQQTMAR

SEQ ID NO: 42790 - protein, 11 aa, Homo Sapiens
QVVGEATFIAR

SEQ ID NO: 42791 - protein, 11 aa, Homo Sapiens
QYIQVNEPWKR

SEQ ID NO: 42792 - protein, 11 aa, Homo Sapiens
RALESELQQLR

SEQ ID NO: 42793 - protein, 11 aa, Homo Sapiens
RALGVRDLSYR

SEQ ID NO: 42794 - protein, 11 aa, Homo Sapiens
RARPSLTVTPR

SEQ ID NO: 42795 - protein, 11 aa, Homo Sapiens
RFKEPLPEYVR

SEQ ID NO: 42796 - protein, 11 aa, Homo Sapiens
RFWNKNIGSNR

SEQ ID NO: 42797 - protein, 11 aa, Homo Sapiens
RGFQRDLSSLR

SEQ ID NO: 42798 - protein, 11 aa, Homo Sapiens
RGQVVSLIRMR

SEQ ID NO: 42799 - protein, 11 aa, Homo Sapiens
RHSASFGRWGR

SEQ ID NO: 42800 - protein, 11 aa, Homo Sapiens
RIAPPDRRFSR

SEQ ID NO: 42801 - protein, 11 aa, Homo Sapiens
RIFPVDKSRSR

SEQ ID NO: 42802 - protein, 11 aa, Homo Sapiens
RINELPSTMQR

SEQ ID NO: 42803 - protein, 11 aa, Homo Sapiens
RIREDIAKYLR

SEQ ID NO: 42804 - protein, 11 aa, Homo Sapiens
RITVKLTIQNR

SEQ ID NO: 42805 - protein, 11 aa, Homo Sapiens
RLFDIKPEQQR

SEQ ID NO: 42806 - protein, 11 aa, Homo Sapiens
RLIGLPEGRAR

SEQ ID NO: 42807 - protein, 11 aa, Homo Sapiens
RLLPLAPGRLR

SEQ ID NO: 42808 - protein, 11 aa, Homo Sapiens
RLNDTIQLLVR

SEQ ID NO: 42809 - protein, 11 aa, Homo Sapiens
RLRELTSIVNR

SEQ ID NO: 42810 - protein, 11 aa, Homo Sapiens
RLYDVPANSMR

SEQ ID NO: 42811 - protein, 11 aa, Homo Sapiens
RMFAPTKTWRR

SEQ ID NO: 42812 - protein, 11 aa, Homo Sapiens
RMFHIRAVILR

SEQ ID NO: 42813 - protein, 11 aa, Homo Sapiens
RMLPPLTKNQR

SEQ ID NO: 42814 - protein, 11 aa, Homo Sapiens
RNKDPILHVLR

SEQ ID NO: 42815 - protein, 11 aa, Homo Sapiens
RNMEIPKGLIR

SEQ ID NO: 42816 - protein, 11 aa, Homo Sapiens
RQIDQFLVVAR

SEQ ID NO: 42817 - protein, 11 aa, Homo Sapiens
RQINWTVLYRR

SEQ ID NO: 42818 - protein, 11 aa, Homo Sapiens
RQYAKDIGFIK

SEQ ID NO: 42819 - protein, 11 aa, Homo Sapiens
RSINQGLDRLR

SEQ ID NO: 42820 - protein, 11 aa, Homo Sapiens
RSKYDYLMILR

SEQ ID NO: 42821 - protein, 11 aa, Homo Sapiens
RSLGELYFLPR

SEQ ID NO: 42822 - protein, 11 aa, Homo Sapiens
RSLNPPLTIVR

SEQ ID NO: 42823 - protein, 11 aa, Homo Sapiens
RTLKPEGNILR

SEQ ID NO: 42824 - protein, 11 aa, Homo Sapiens
RTLPAWIREGL

SEQ ID NO: 42825 - protein, 11 aa, Homo Sapiens
RTLTPISGGQR

SEQ ID NO: 42826 - protein, 11 aa, Homo Sapiens
RTMPLLSLHSR

SEQ ID NO: 42827 - protein, 11 aa, Homo Sapiens
RTMVDKLLSSR

SEQ ID NO: 42828 - protein, 11 aa, Homo Sapiens
RTMWFAGGFHR

SEQ ID NO: 42829 - protein, 11 aa, Homo Sapiens
RTPELTWERVR

SEQ ID NO: 42830 - protein, 11 aa, Homo Sapiens
RTQLYEYLQNR

SEQ ID NO: 42831 - protein, 11 aa, Homo Sapiens
RTVLKNLSLLK

SEQ ID NO: 42832 - protein, 11 aa, Homo Sapiens
RVFAAESIIKR

SEQ ID NO: 42833 - protein, 11 aa, Homo Sapiens
RVFEHHGQVRL

SEQ ID NO: 42834 - protein, 11 aa, Homo Sapiens
RVFNETPINPR

SEQ ID NO: 42835 - protein, 11 aa, Homo Sapiens
RVFSVAELQSR

SEQ ID NO: 42836 - protein, 11 aa, Homo Sapiens
RVKEPVKELLR

SEQ ID NO: 42837 - protein, 11 aa, Homo Sapiens
RVLDALVAREK

SEQ ID NO: 42838 - protein, 11 aa, Homo Sapiens
RVLDTNDRFLR

SEQ ID NO: 42839 - protein, 11 aa, Homo Sapiens
RVLEKLGVTVR

SEQ ID NO: 42840 - protein, 11 aa, Homo Sapiens
RVLIGVGKLLR

SEQ ID NO: 42841 - protein, 11 aa, Homo Sapiens
RVLPPSALQSV

SEQ ID NO: 42842 - protein, 11 aa, Homo Sapiens
RVLSIGLPVAR

SEQ ID NO: 42843 - protein, 11 aa, Homo Sapiens
RVMEVFLAQLR

SEQ ID NO: 42844 - protein, 11 aa, Homo Sapiens
RVQEAVESMVK

SEQ ID NO: 42845 - protein, 11 aa, Homo Sapiens
RVRPGETLLIH

SEQ ID NO: 42846 - protein, 11 aa, Homo Sapiens
RVVIKQIITSR

SEQ ID NO: 42847 - protein, 11 aa, Homo Sapiens
RVVQQEEGWFR

SEQ ID NO: 42848 - protein, 11 aa, Homo Sapiens
RVWDISGLRKK

SEQ ID NO: 42849 - protein, 11 aa, Homo Sapiens
RVYSPPEWISR

SEQ ID NO: 42850 - protein, 11 aa, Homo Sapiens
RYFNSKVPITR

SEQ ID NO: 42851 - protein, 11 aa, Homo Sapiens
RYIHLENLLAR

SEQ ID NO: 42852 - protein, 11 aa, Homo Sapiens
RYKLLGGLAVR

SEQ ID NO: 42853 - protein, 11 aa, Homo Sapiens
RYMDAWNTVSR

SEQ ID NO: 42854 - protein, 11 aa, Homo Sapiens
RYMTPEDFVQR

SEQ ID NO: 42855 - protein, 11 aa, Homo Sapiens
RYQQFKDFQRR

SEQ ID NO: 42856 - protein, 11 aa, Homo Sapiens
RYREDLDFVLR

SEQ ID NO: 42857 - protein, 11 aa, Homo Sapiens
RYVASYLLAAL

SEQ ID NO: 42858 - protein, 11 aa, Homo Sapiens
SFFSPSPARKR

SEQ ID NO: 42859 - protein, 11 aa, Homo Sapiens
SFLPRKFPSLR

SEQ ID NO: 42860 - protein, 11 aa, Homo Sapiens
SFMDPASALYR

SEQ ID NO: 42861 - protein, 11 aa, Homo Sapiens
SGAAEYLYFFR

SEQ ID NO: 42862 - protein, 11 aa, Homo Sapiens
SIIGGGVKAPR

SEQ ID NO: 42863 - protein, 11 aa, Homo Sapiens
SLKGIPTLVYR

SEQ ID NO: 42864 - protein, 11 aa, Homo Sapiens
SLKGVDPKFLR

SEQ ID NO: 42865 - protein, 11 aa, Homo Sapiens
SLLKKNWQNVR

SEQ ID NO: 42866 - protein, 11 aa, Homo Sapiens
SLLPLTEANLR

SEQ ID NO: 42867 - protein, 11 aa, Homo Sapiens
SLLPVDIRQYL

SEQ ID NO: 42868 - protein, 11 aa, Homo Sapiens
SLLQPLNVEID

SEQ ID NO: 42869 - protein, 11 aa, Homo Sapiens
SLMHSFILKAR

SEQ ID NO: 42870 - protein, 11 aa, Homo Sapiens
SLQNAESWINR

SEQ ID NO: 42871 - protein, 11 aa, Homo Sapiens
SMIRLSEAMAR

SEQ ID NO: 42872 - protein, 11 aa, Homo Sapiens
SMKSPLYLVSR

SEQ ID NO: 42873 - protein, 11 aa, Homo Sapiens
SSLLRTSIMSK

SEQ ID NO: 42874 - protein, 11 aa, Homo Sapiens
SSLPALLFKAR

SEQ ID NO: 42875 - protein, 11 aa, Homo Sapiens
STFIHAEDFAR

SEQ ID NO: 42876 - protein, 11 aa, Homo Sapiens
STFSGIKELAR

SEQ ID NO: 42877 - protein, 11 aa, Homo Sapiens
STKPGSYIFRL

SEQ ID NO: 42878 - protein, 11 aa, Homo Sapiens
STKPPGTFLLR

SEQ ID NO: 42879 - protein, 11 aa, Homo Sapiens
STLRSSHLPSR

SEQ ID NO: 42880 - protein, 11 aa, Homo Sapiens
STMYPGLPSRL

SEQ ID NO: 42881 - protein, 11 aa, Homo Sapiens
SVARLSQKFPK

SEQ ID NO: 42882 - protein, 11 aa, Homo Sapiens
SVIPHQKLFTR

SEQ ID NO: 42883 - protein, 11 aa, Homo Sapiens
SVKEISDIVQR

SEQ ID NO: 42884 - protein, 11 aa, Homo Sapiens
SVLGSLLYYSR

SEQ ID NO: 42885 - protein, 11 aa, Homo Sapiens
SVLPFDGDFAR

SEQ ID NO: 42886 - protein, 11 aa, Homo Sapiens
SVLRGAALVPR

SEQ ID NO: 42887 - protein, 11 aa, Homo Sapiens
SVPGGELFNPR

SEQ ID NO: 42888 - protein, 11 aa, Homo Sapiens
SVREGQGFAFR

SEQ ID NO: 42889 - protein, 11 aa, Homo Sapiens
SVREVRQLTLR

SEQ ID NO: 42890 - protein, 11 aa, Homo Sapiens
SVSVQGIIIYR

SEQ ID NO: 42891 - protein, 11 aa, Homo Sapiens
SVTPEGVIKQR

SEQ ID NO: 42892 - protein, 11 aa, Homo Sapiens
SYLHENQIIHR

SEQ ID NO: 42893 - protein, 11 aa, Homo Sapiens
TIMPKDIQLAR

SEQ ID NO: 42894 - protein, 11 aa, Homo Sapiens
TQQEMMDAQLR

SEQ ID NO: 42895 - protein, 11 aa, Homo Sapiens
TSKLYSLLFRR

SEQ ID NO: 42896 - protein, 11 aa, Homo Sapiens
TTFTWNINHAR

SEQ ID NO: 42897 - protein, 11 aa, Homo Sapiens
TTLPDDMITQR

SEQ ID NO: 42898 - protein, 11 aa, Homo Sapiens
TVFDAKRLIGR

SEQ ID NO: 42899 - protein, 11 aa, Homo Sapiens
TVIPATVVTSR

SEQ ID NO: 42900 - protein, 11 aa, Homo Sapiens
TVLDPDLRMTF

SEQ ID NO: 42901 - protein, 11 aa, Homo Sapiens
TVLPKDILQER

SEQ ID NO: 42902 - protein, 11 aa, Homo Sapiens
TVLPVPPLSVR

SEQ ID NO: 42903 - protein, 11 aa, Homo Sapiens
TVMGAEIRHVL

SEQ ID NO: 42904 - protein, 11 aa, Homo Sapiens
TVRTAMSLIER

SEQ ID NO: 42905 - protein, 11 aa, Homo Sapiens
TVRVWDISGLR

SEQ ID NO: 42906 - protein, 11 aa, Homo Sapiens
VAIPPDVLKSR

SEQ ID NO: 42907 - protein, 11 aa, Homo Sapiens
VFLPQAIRHLK

SEQ ID NO: 42908 - protein, 11 aa, Homo Sapiens
VLSAPGLRGFR

SEQ ID NO: 42909 - protein, 11 aa, Homo Sapiens
VQKDIQPYMRR

SEQ ID NO: 42910 - protein, 11 aa, Homo Sapiens
VQNPALRLVTR

SEQ ID NO: 42911 - protein, 11 aa, Homo Sapiens
VQVGPLPSRLR

SEQ ID NO: 42912 - protein, 11 aa, Homo Sapiens
VQVSPLIKLGR

SEQ ID NO: 42913 - protein, 11 aa, Homo Sapiens
VVAPPGVVVSR

SEQ ID NO: 42914 - protein, 11 aa, Homo Sapiens
VVINYTEQLLR

SEQ ID NO: 42915 - protein, 11 aa, Homo Sapiens
VVKLGDLGLGR

SEQ ID NO: 42916 - protein, 11 aa, Homo Sapiens
VVKPDQLIKRR

SEQ ID NO: 42917 - protein, 11 aa, Homo Sapiens
VVTDPAFLVTR

SEQ ID NO: 42918 - protein, 11 aa, Homo Sapiens
VYRNPESFKEK

SEQ ID NO: 42919 - protein, 11 aa, Homo Sapiens
VYVNYTILKPR

SEQ ID NO: 42920 - protein, 8 aa, Homo Sapiens
AIGPREQW

SEQ ID NO: 42921 - protein, 8 aa, Homo Sapiens
ATNIRYCY

SEQ ID NO: 42922 - protein, 8 aa, Homo Sapiens
FESWMHHW

SEQ ID NO: 42923 - protein, 8 aa, Homo Sapiens
FEVDTVAP

SEQ ID NO: 42924 - protein, 8 aa, Homo Sapiens
FNEKSKEL

SEQ ID NO: 42925 - protein, 8 aa, Homo Sapiens
KLGLRARW

SEQ ID NO: 42926 - protein, 8 aa, Homo Sapiens
KLLEKERL

SEQ ID NO: 42927 - protein, 8 aa, Homo Sapiens
KVWMRHRY

SEQ ID NO: 42928 - protein, 8 aa, Homo Sapiens
LAKIRWKY

SEQ ID NO: 42929 - protein, 8 aa, Homo Sapiens
LAQIRHIY

SEQ ID NO: 42930 - protein, 8 aa, Homo Sapiens
LLAQRWGW

SEQ ID NO: 42931 - protein, 8 aa, Homo Sapiens
MSLTACKV

SEQ ID NO: 42932 - protein, 8 aa, Homo Sapiens
QNAVRLHY

SEQ ID NO: 42933 - protein, 8 aa, Homo Sapiens
RLAPNFRW

SEQ ID NO: 42934 - protein, 8 aa, Homo Sapiens
RLAPRSQY

SEQ ID NO: 42935 - protein, 8 aa, Homo Sapiens
RLGPRAGF

SEQ ID NO: 42936 - protein, 8 aa, Homo Sapiens
RMFWREMY

SEQ ID NO: 42937 - protein, 8 aa, Homo Sapiens
SAGPRYEY

SEQ ID NO: 42938 - protein, 8 aa, Homo Sapiens
SLFQRTAW

SEQ ID NO: 42939 - protein, 8 aa, Homo Sapiens
SVFKKFNW

SEQ ID NO: 42940 - protein, 8 aa, Homo Sapiens
TFTGHREW

SEQ ID NO: 42941 - protein, 8 aa, Homo Sapiens
TRLGRNVY

SEQ ID NO: 42942 - protein, 8 aa, Homo Sapiens
TVYPDPRG

SEQ ID NO: 42943 - protein, 8 aa, Homo Sapiens
VLFQRFFY

SEQ ID NO: 42944 - protein, 8 aa, Homo Sapiens
VSLTACKV

SEQ ID NO: 42945 - protein, 9 aa, Homo Sapiens
AAWHYLVSW

SEQ ID NO: 42946 - protein, 9 aa, Homo Sapiens
AILKKVIQW

SEQ ID NO: 42947 - protein, 9 aa, Homo Sapiens
AIMISRPAW

SEQ ID NO: 42948 - protein, 9 aa, Homo Sapiens
AINSCRSEY

SEQ ID NO: 42949 - protein, 9 aa, Homo Sapiens
ALAGTRLVW

SEQ ID NO: 42950 - protein, 9 aa, Homo Sapiens
ALASWAYRW

SEQ ID NO: 42951 - protein, 9 aa, Homo Sapiens
ALFNGISKW

SEQ ID NO: 42952 - protein, 9 aa, Homo Sapiens
ALFRELISW

SEQ ID NO: 42953 - protein, 9 aa, Homo Sapiens
ALFRHEVGY

SEQ ID NO: 42954 - protein, 9 aa, Homo Sapiens
ALHLWTAVY

SEQ ID NO: 42955 - protein, 9 aa, Homo Sapiens
ALKSARDMW

SEQ ID NO: 42956 - protein, 9 aa, Homo Sapiens
ALLHWGALW

SEQ ID NO: 42957 - protein, 9 aa, Homo Sapiens
ALMPWRYAL

SEQ ID NO: 42958 - protein, 9 aa, Homo Sapiens
ALMSLHHCW

SEQ ID NO: 42959 - protein, 9 aa, Homo Sapiens
ALNANFVSW

SEQ ID NO: 42960 - protein, 9 aa, Homo Sapiens
ALNHLREIW

SEQ ID NO: 42961 - protein, 9 aa, Homo Sapiens
ALNPLRAVW

SEQ ID NO: 42962 - protein, 9 aa, Homo Sapiens
ALQKQYYKW

SEQ ID NO: 42963 - protein, 9 aa, Homo Sapiens
ALRDVRQQY

SEQ ID NO: 42964 - protein, 9 aa, Homo Sapiens
ALSGMRHVW

SEQ ID NO: 42965 - protein, 9 aa, Homo Sapiens
ALSPVRGCY

SEQ ID NO: 42966 - protein, 9 aa, Homo Sapiens
ALWKFIQQW

SEQ ID NO: 42967 - protein, 9 aa, Homo Sapiens
ALWKHQFAW

SEQ ID NO: 42968 - protein, 9 aa, Homo Sapiens
ALYARRRSY

SEQ ID NO: 42969 - protein, 9 aa, Homo Sapiens
ALYKYFISF

SEQ ID NO: 42970 - protein, 9 aa, Homo Sapiens
ALYYWNNEY

SEQ ID NO: 42971 - protein, 9 aa, Homo Sapiens
AMAPERTGW

SEQ ID NO: 42972 - protein, 9 aa, Homo Sapiens
AMHTLREKY

SEQ ID NO: 42973 - protein, 9 aa, Homo Sapiens
AMLKKGWKW

SEQ ID NO: 42974 - protein, 9 aa, Homo Sapiens
AMWKKLAEW

SEQ ID NO: 42975 - protein, 9 aa, Homo Sapiens
AMYPIRSAY

SEQ ID NO: 42976 - protein, 9 aa, Homo Sapiens
APKTTRVTY

SEQ ID NO: 42977 - protein, 9 aa, Homo Sapiens
AQAQIVQSW

SEQ ID NO: 42978 - protein, 9 aa, Homo Sapiens
AQARWWATF

SEQ ID NO: 42979 - protein, 9 aa, Homo Sapiens
AQGVPRYSY

SEQ ID NO: 42980 - protein, 9 aa, Homo Sapiens
AQKSFVDSW

SEQ ID NO: 42981 - protein, 9 aa, Homo Sapiens
AQLRFIQAW

SEQ ID NO: 42982 - protein, 9 aa, Homo Sapiens
AQNAVRLHY

SEQ ID NO: 42983 - protein, 9 aa, Homo Sapiens
AQWAIHPTF

SEQ ID NO: 42984 - protein, 9 aa, Homo Sapiens
ASLLHQVSW

SEQ ID NO: 42985 - protein, 9 aa, Homo Sapiens
ASNGDVYAW

SEQ ID NO: 42986 - protein, 9 aa, Homo Sapiens
ASNPQRPGY

SEQ ID NO: 42987 - protein, 9 aa, Homo Sapiens
ASNYFRAMF

SEQ ID NO: 42988 - protein, 9 aa, Homo Sapiens
ATADVEWRW

SEQ ID NO: 42989 - protein, 9 aa, Homo Sapiens
ATALHRASY

SEQ ID NO: 42990 - protein, 9 aa, Homo Sapiens
ATAQRVAAW

SEQ ID NO: 42991 - protein, 9 aa, Homo Sapiens
ATFGRPAEW

SEQ ID NO: 42992 - protein, 9 aa, Homo Sapiens
ATFSSIHSF

SEQ ID NO: 42993 - protein, 9 aa, Homo Sapiens
ATHHLYQAW

SEQ ID NO: 42994 - protein, 9 aa, Homo Sapiens
ATHSSSTSW

SEQ ID NO: 42995 - protein, 9 aa, Homo Sapiens
ATHVYMYVF

SEQ ID NO: 42996 - protein, 9 aa, Homo Sapiens
ATILWDNAF

SEQ ID NO: 42997 - protein, 9 aa, Homo Sapiens
ATKDAVAVW

SEQ ID NO: 42998 - protein, 9 aa, Homo Sapiens
ATLELTHNW

SEQ ID NO: 42999 - protein, 9 aa, Homo Sapiens
ATLKWKESL

SEQ ID NO: 43000 - protein, 9 aa, Homo Sapiens
ATMFPRREF

SEQ ID NO: 43001 - protein, 9 aa, Homo Sapiens
ATNAFIVAF

SEQ ID NO: 43002 - protein, 9 aa, Homo Sapiens
ATNGVVVTW

SEQ ID NO: 43003 - protein, 9 aa, Homo Sapiens
ATNLQRVSY

SEQ ID NO: 43004 - protein, 9 aa, Homo Sapiens
ATNRITVTW

SEQ ID NO: 43005 - protein, 9 aa, Homo Sapiens
ATNVNNWHW

SEQ ID NO: 43006 - protein, 9 aa, Homo Sapiens
ATQIKTYSW

SEQ ID NO: 43007 - protein, 9 aa, Homo Sapiens
ATRPDYISW

SEQ ID NO: 43008 - protein, 9 aa, Homo Sapiens
ATVLWDNAF

SEQ ID NO: 43009 - protein, 9 aa, Homo Sapiens
ATYMKPEMW

SEQ ID NO: 43010 - protein, 9 aa, Homo Sapiens
AVCRLRHWW

SEQ ID NO: 43011 - protein, 9 aa, Homo Sapiens
AVLAGRWNY

SEQ ID NO: 43012 - protein, 9 aa, Homo Sapiens
AVLKWLYHL

SEQ ID NO: 43013 - protein, 9 aa, Homo Sapiens
AVLMHRERY

SEQ ID NO: 43014 - protein, 9 aa, Homo Sapiens
AVNCHVITW

SEQ ID NO: 43015 - protein, 9 aa, Homo Sapiens
AVNFTREEW

SEQ ID NO: 43016 - protein, 9 aa, Homo Sapiens
AVNGHTNSF

SEQ ID NO: 43017 - protein, 9 aa, Homo Sapiens
AVNPIIYSF

SEQ ID NO: 43018 - protein, 9 aa, Homo Sapiens
AVQNVHSVW

SEQ ID NO: 43019 - protein, 9 aa, Homo Sapiens
AVQSEPRSW

SEQ ID NO: 43020 - protein, 9 aa, Homo Sapiens
AVSLIREEW

SEQ ID NO: 43021 - protein, 9 aa, Homo Sapiens
AVWTRAYGW

SEQ ID NO: 43022 - protein, 9 aa, Homo Sapiens
AVYSRTFTW

SEQ ID NO: 43023 - protein, 9 aa, Homo Sapiens
DFLTEGGGV

SEQ ID NO: 43024 - protein, 9 aa, Homo Sapiens
FDHPELVKL

SEQ ID NO: 43025 - protein, 9 aa, Homo Sapiens
FDRPQELKL

SEQ ID NO: 43026 - protein, 9 aa, Homo Sapiens
FQRPPISSW

SEQ ID NO: 43027 - protein, 9 aa, Homo Sapiens
GLNWLRFSW

SEQ ID NO: 43028 - protein, 9 aa, Homo Sapiens
GLRNKREVW

SEQ ID NO: 43029 - protein, 9 aa, Homo Sapiens
GMWKTTFAW

SEQ ID NO: 43030 - protein, 9 aa, Homo Sapiens
GQLPHTVSW

SEQ ID NO: 43031 - protein, 9 aa, Homo Sapiens
GSFHIRASY

SEQ ID NO: 43032 - protein, 9 aa, Homo Sapiens
GSHHWNWTF

SEQ ID NO: 43033 - protein, 9 aa, Homo Sapiens
GTDRNAYVW

SEQ ID NO: 43034 - protein, 9 aa, Homo Sapiens
GTIPERPGW

SEQ ID NO: 43035 - protein, 9 aa, Homo Sapiens
GTLKERVQW

SEQ ID NO: 43036 - protein, 9 aa, Homo Sapiens
GTLKKSTSW

SEQ ID NO: 43037 - protein, 9 aa, Homo Sapiens
GTLSGHASW

SEQ ID NO: 43038 - protein, 9 aa, Homo Sapiens
GTMDVHHHW

SEQ ID NO: 43039 - protein, 9 aa, Homo Sapiens
GTNAKVRTW

SEQ ID NO: 43040 - protein, 9 aa, Homo Sapiens
GTSGIRFIY

SEQ ID NO: 43041 - protein, 9 aa, Homo Sapiens
GTVLKTSSW

SEQ ID NO: 43042 - protein, 9 aa, Homo Sapiens
GTYGVRAAW

SEQ ID NO: 43043 - protein, 9 aa, Homo Sapiens
GVKPNPASW

SEQ ID NO: 43044 - protein, 9 aa, Homo Sapiens
GVSSVREKY

SEQ ID NO: 43045 - protein, 9 aa, Homo Sapiens
HIQESRFLY

SEQ ID NO: 43046 - protein, 9 aa, Homo Sapiens
HIWEYTYVL

SEQ ID NO: 43047 - protein, 9 aa, Homo Sapiens
HLLDHRSKW

SEQ ID NO: 43048 - protein, 9 aa, Homo Sapiens
HLMDVVYTW

SEQ ID NO: 43049 - protein, 9 aa, Homo Sapiens
HLWERTWGW

SEQ ID NO: 43050 - protein, 9 aa, Homo Sapiens
HMALERNSW

SEQ ID NO: 43051 - protein, 9 aa, Homo Sapiens
HQDPNSYSW

SEQ ID NO: 43052 - protein, 9 aa, Homo Sapiens
HQNWARFSY

SEQ ID NO: 43053 - protein, 9 aa, Homo Sapiens
HSCLFRHSW

SEQ ID NO: 43054 - protein, 9 aa, Homo Sapiens
HTSSTTSAW

SEQ ID NO: 43055 - protein, 9 aa, Homo Sapiens
HTVKWEGVW

SEQ ID NO: 43056 - protein, 9 aa, Homo Sapiens
HTYFGLPRW

SEQ ID NO: 43057 - protein, 9 aa, Homo Sapiens
HTYRGRLSY

SEQ ID NO: 43058 - protein, 9 aa, Homo Sapiens
IIFAVRQEY

SEQ ID NO: 43059 - protein, 9 aa, Homo Sapiens
IIFVPVPQL

SEQ ID NO: 43060 - protein, 9 aa, Homo Sapiens
IIHEISHSW

SEQ ID NO: 43061 - protein, 9 aa, Homo Sapiens
IILEHVSTW

SEQ ID NO: 43062 - protein, 9 aa, Homo Sapiens
IIMKDVPDW

SEQ ID NO: 43063 - protein, 9 aa, Homo Sapiens
IIRDFVLSW

SEQ ID NO: 43064 - protein, 9 aa, Homo Sapiens
IIRPQNVSW

SEQ ID NO: 43065 - protein, 9 aa, Homo Sapiens
IISEKRQKW

SEQ ID NO: 43066 - protein, 9 aa, Homo Sapiens
IISHQYRMQ

SEQ ID NO: 43067 - protein, 9 aa, Homo Sapiens
IIWDKKPRW

SEQ ID NO: 43068 - protein, 9 aa, Homo Sapiens
ILAKIRWKY

SEQ ID NO: 43069 - protein, 9 aa, Homo Sapiens
ILGEFRDTY

SEQ ID NO: 43070 - protein, 9 aa, Homo Sapiens
ILGPPPPSF

SEQ ID NO: 43071 - protein, 9 aa, Homo Sapiens
ILHKARFSY

SEQ ID NO: 43072 - protein, 9 aa, Homo Sapiens
ILKEMTHSW

SEQ ID NO: 43073 - protein, 9 aa, Homo Sapiens
ILKSMVVGW

SEQ ID NO: 43074 - protein, 9 aa, Homo Sapiens
ILLKWTKGF

SEQ ID NO: 43075 - protein, 9 aa, Homo Sapiens
ILNENSHSF

SEQ ID NO: 43076 - protein, 9 aa, Homo Sapiens
ILREPTFRW

SEQ ID NO: 43077 - protein, 9 aa, Homo Sapiens
IMFDGPEAW

SEQ ID NO: 43078 - protein, 9 aa, Homo Sapiens
IMKKIRESY

SEQ ID NO: 43079 - protein, 9 aa, Homo Sapiens
IMKSQQESW

SEQ ID NO: 43080 - protein, 9 aa, Homo Sapiens
IMLPFRFTY

SEQ ID NO: 43081 - protein, 9 aa, Homo Sapiens
IMWQKHYVY

SEQ ID NO: 43082 - protein, 9 aa, Homo Sapiens
IQFNLRNLY

SEQ ID NO: 43083 - protein, 9 aa, Homo Sapiens
IQYGKIVSW

SEQ ID NO: 43084 - protein, 9 aa, Homo Sapiens
ISNPTRHVY

SEQ ID NO: 43085 - protein, 9 aa, Homo Sapiens
ITNRNTVSW

SEQ ID NO: 43086 - protein, 9 aa, Homo Sapiens
ITTKAISRW

SEQ ID NO: 43087 - protein, 9 aa, Homo Sapiens
ITYTFHSTW

SEQ ID NO: 43088 - protein, 9 aa, Homo Sapiens
IVHSVRAKW

SEQ ID NO: 43089 - protein, 9 aa, Homo Sapiens
IVLKKWYTI

SEQ ID NO: 43090 - protein, 9 aa, Homo Sapiens
IVMRYSAEW

SEQ ID NO: 43091 - protein, 9 aa, Homo Sapiens
IVQSKINSF

SEQ ID NO: 43092 - protein, 9 aa, Homo Sapiens
IVSTTRELY

SEQ ID NO: 43093 - protein, 9 aa, Homo Sapiens
KAADLRAAY

SEQ ID NO: 43094 - protein, 9 aa, Homo Sapiens
KAFDQRLTF

SEQ ID NO: 43095 - protein, 9 aa, Homo Sapiens
KAFKWFSTL

SEQ ID NO: 43096 - protein, 9 aa, Homo Sapiens
KAFLKRFPW

SEQ ID NO: 43097 - protein, 9 aa, Homo Sapiens
KAFNLRISF

SEQ ID NO: 43098 - protein, 9 aa, Homo Sapiens
KAFNWFSTL

SEQ ID NO: 43099 - protein, 9 aa, Homo Sapiens
KAFNWSSTL

SEQ ID NO: 43100 - protein, 9 aa, Homo Sapiens
KAFRWKSNF

SEQ ID NO: 43101 - protein, 9 aa, Homo Sapiens
KAFSTRWNW

SEQ ID NO: 43102 - protein, 9 aa, Homo Sapiens
KAFSYHHSF

SEQ ID NO: 43103 - protein, 9 aa, Homo Sapiens
KAFTHRSTF

SEQ ID NO: 43104 - protein, 9 aa, Homo Sapiens
KAFTWSSTF

SEQ ID NO: 43105 - protein, 9 aa, Homo Sapiens
KALMIREKY

SEQ ID NO: 43106 - protein, 9 aa, Homo Sapiens
KALRWKDSW

SEQ ID NO: 43107 - protein, 9 aa, Homo Sapiens
KAWEAVPSL

SEQ ID NO: 43108 - protein, 9 aa, Homo Sapiens
KFNPVSFTW

SEQ ID NO: 43109 - protein, 9 aa, Homo Sapiens
KGFDERHAY

SEQ ID NO: 43110 - protein, 9 aa, Homo Sapiens
KIADFLNSF

SEQ ID NO: 43111 - protein, 9 aa, Homo Sapiens
KIADLCHTF

SEQ ID NO: 43112 - protein, 9 aa, Homo Sapiens
KIAEQVASF

SEQ ID NO: 43113 - protein, 9 aa, Homo Sapiens
KICASHIGW

SEQ ID NO: 43114 - protein, 9 aa, Homo Sapiens
KICDIAINW

SEQ ID NO: 43115 - protein, 9 aa, Homo Sapiens
KIFALRHGY

SEQ ID NO: 43116 - protein, 9 aa, Homo Sapiens
KIFDLRGTY

SEQ ID NO: 43117 - protein, 9 aa, Homo Sapiens
KIFEDIPTL

SEQ ID NO: 43118 - protein, 9 aa, Homo Sapiens
KIFEFKETL

SEQ ID NO: 43119 - protein, 9 aa, Homo Sapiens
KIFRYFATL

SEQ ID NO: 43120 - protein, 9 aa, Homo Sapiens
KIFSQKLGY

SEQ ID NO: 43121 - protein, 9 aa, Homo Sapiens
KIFYDRAEY

SEQ ID NO: 43122 - protein, 9 aa, Homo Sapiens
KIFYKTVSF

SEQ ID NO: 43123 - protein, 9 aa, Homo Sapiens
KIGSKYYNW

SEQ ID NO: 43124 - protein, 9 aa, Homo Sapiens
KIGTERACY

SEQ ID NO: 43125 - protein, 9 aa, Homo Sapiens
KIHNHTHIW

SEQ ID NO: 43126 - protein, 9 aa, Homo Sapiens
KIHWWENVY

SEQ ID NO: 43127 - protein, 9 aa, Homo Sapiens
KIIFIDSTW

SEQ ID NO: 43128 - protein, 9 aa, Homo Sapiens
KIIPKTLTW

SEQ ID NO: 43129 - protein, 9 aa, Homo Sapiens
KIISTLPSW

SEQ ID NO: 43130 - protein, 9 aa, Homo Sapiens
KIKDFANTI

SEQ ID NO: 43131 - protein, 9 aa, Homo Sapiens
KIKVWNYKL

SEQ ID NO: 43132 - protein, 9 aa, Homo Sapiens
KILAIEMRF

SEQ ID NO: 43133 - protein, 9 aa, Homo Sapiens
KILGKFYSW

SEQ ID NO: 43134 - protein, 9 aa, Homo Sapiens
KILIWSGRF

SEQ ID NO: 43135 - protein, 9 aa, Homo Sapiens
KILSKVEKF

SEQ ID NO: 43136 - protein, 9 aa, Homo Sapiens
KIMADNPSW

SEQ ID NO: 43137 - protein, 9 aa, Homo Sapiens
KIMDVVFQW

SEQ ID NO: 43138 - protein, 9 aa, Homo Sapiens
KIMSVIREW

SEQ ID NO: 43139 - protein, 9 aa, Homo Sapiens
KINEARENY

SEQ ID NO: 43140 - protein, 9 aa, Homo Sapiens
KINEKPQVI

SEQ ID NO: 43141 - protein, 9 aa, Homo Sapiens
KINKNCWRI

SEQ ID NO: 43142 - protein, 9 aa, Homo Sapiens
KIQAKIPGL

SEQ ID NO: 43143 - protein, 9 aa, Homo Sapiens
KIQDKSVSF

SEQ ID NO: 43144 - protein, 9 aa, Homo Sapiens
KIQSEKFRW

SEQ ID NO: 43145 - protein, 9 aa, Homo Sapiens
KIRDTFCSY

SEQ ID NO: 43146 - protein, 9 aa, Homo Sapiens
KIRGTLKSW

SEQ ID NO: 43147 - protein, 9 aa, Homo Sapiens
KIRQWEESW

SEQ ID NO: 43148 - protein, 9 aa, Homo Sapiens
KITDVIIGF

SEQ ID NO: 43149 - protein, 9 aa, Homo Sapiens
KITNFTTSW

SEQ ID NO: 43150 - protein, 9 aa, Homo Sapiens
KIWEDRNVY

SEQ ID NO: 43151 - protein, 9 aa, Homo Sapiens
KIWKKNTPF

SEQ ID NO: 43152 - protein, 9 aa, Homo Sapiens
KIWPLFPVF

SEQ ID NO: 43153 - protein, 9 aa, Homo Sapiens
KIWPYVYAF

SEQ ID NO: 43154 - protein, 9 aa, Homo Sapiens
KIWPYVYTL

SEQ ID NO: 43155 - protein, 9 aa, Homo Sapiens
KIWRPNRVF

SEQ ID NO: 43156 - protein, 9 aa, Homo Sapiens
KIWTSEHVF

SEQ ID NO: 43157 - protein, 9 aa, Homo Sapiens
KIWTSVPYL

SEQ ID NO: 43158 - protein, 9 aa, Homo Sapiens
KIYEISNRW

SEQ ID NO: 43159 - protein, 9 aa, Homo Sapiens
KIYEKTFTL

SEQ ID NO: 43160 - protein, 9 aa, Homo Sapiens
KIYGEKLQF

SEQ ID NO: 43161 - protein, 9 aa, Homo Sapiens
KIYPSRDEY

SEQ ID NO: 43162 - protein, 9 aa, Homo Sapiens
KIYPSREEY

SEQ ID NO: 43163 - protein, 9 aa, Homo Sapiens
KIYQWINEL

SEQ ID NO: 43164 - protein, 9 aa, Homo Sapiens
KLAEQYESF

SEQ ID NO: 43165 - protein, 9 aa, Homo Sapiens
KLAPFNEHW

SEQ ID NO: 43166 - protein, 9 aa, Homo Sapiens
KLAQIRHIY

SEQ ID NO: 43167 - protein, 9 aa, Homo Sapiens
KLASPQPSY

SEQ ID NO: 43168 - protein, 9 aa, Homo Sapiens
KLAVERYEW

SEQ ID NO: 43169 - protein, 9 aa, Homo Sapiens
KLAVGRHSF

SEQ ID NO: 43170 - protein, 9 aa, Homo Sapiens
KLAVIKNAW

SEQ ID NO: 43171 - protein, 9 aa, Homo Sapiens
KLAYMPHTF

SEQ ID NO: 43172 - protein, 9 aa, Homo Sapiens
KLCGKTFSF

SEQ ID NO: 43173 - protein, 9 aa, Homo Sapiens
KLDGGRQQW

SEQ ID NO: 43174 - protein, 9 aa, Homo Sapiens
KLDTITWTW

SEQ ID NO: 43175 - protein, 9 aa, Homo Sapiens
KLEDRQTSW

SEQ ID NO: 43176 - protein, 9 aa, Homo Sapiens
KLFDAPLSI

SEQ ID NO: 43177 - protein, 9 aa, Homo Sapiens
KLFDIRPIW

SEQ ID NO: 43178 - protein, 9 aa, Homo Sapiens
KLFDKLLEY

SEQ ID NO: 43179 - protein, 9 aa, Homo Sapiens
KLFDRPQEL

SEQ ID NO: 43180 - protein, 9 aa, Homo Sapiens
KLFGFTERY

SEQ ID NO: 43181 - protein, 9 aa, Homo Sapiens
KLFGMIITI

SEQ ID NO: 43182 - protein, 9 aa, Homo Sapiens
KLFGSTSSF

SEQ ID NO: 43183 - protein, 9 aa, Homo Sapiens
KLFIGGLSF

SEQ ID NO: 43184 - protein, 9 aa, Homo Sapiens
KLFKEVASL

SEQ ID NO: 43185 - protein, 9 aa, Homo Sapiens
KLFLFHTSL

SEQ ID NO: 43186 - protein, 9 aa, Homo Sapiens
KLFNVTSTL

SEQ ID NO: 43187 - protein, 9 aa, Homo Sapiens
KLFPFYFHI

SEQ ID NO: 43188 - protein, 9 aa, Homo Sapiens
KLFPYALAF

SEQ ID NO: 43189 - protein, 9 aa, Homo Sapiens
KLFQGQLVL

SEQ ID NO: 43190 - protein, 9 aa, Homo Sapiens
KLFRGPLVI

SEQ ID NO: 43191 - protein, 9 aa, Homo Sapiens
KLFSFTPAW

SEQ ID NO: 43192 - protein, 9 aa, Homo Sapiens
KLFVGGLDW

SEQ ID NO: 43193 - protein, 9 aa, Homo Sapiens
KLFVGGLNF

SEQ ID NO: 43194 - protein, 9 aa, Homo Sapiens
KLFVGGLSF

SEQ ID NO: 43195 - protein, 9 aa, Homo Sapiens
KLFWIRVKY

SEQ ID NO: 43196 - protein, 9 aa, Homo Sapiens
KLFWYQVHF

SEQ ID NO: 43197 - protein, 9 aa, Homo Sapiens
KLFYDVITW

SEQ ID NO: 43198 - protein, 9 aa, Homo Sapiens
KLGCVLMAW

SEQ ID NO: 43199 - protein, 9 aa, Homo Sapiens
KLHAVVETL

SEQ ID NO: 43200 - protein, 9 aa, Homo Sapiens
KLHDAFFKW

SEQ ID NO: 43201 - protein, 9 aa, Homo Sapiens
KLHLGFIEI

SEQ ID NO: 43202 - protein, 9 aa, Homo Sapiens
KLHRKIHLW

SEQ ID NO: 43203 - protein, 9 aa, Homo Sapiens
KLHSNPSAF

SEQ ID NO: 43204 - protein, 9 aa, Homo Sapiens
KLHYKHESW

SEQ ID NO: 43205 - protein, 9 aa, Homo Sapiens
KLIAWKVCL

SEQ ID NO: 43206 - protein, 9 aa, Homo Sapiens
KLIDFGLSF

SEQ ID NO: 43207 - protein, 9 aa, Homo Sapiens
KLIDRTESL

SEQ ID NO: 43208 - protein, 9 aa, Homo Sapiens
KLIEFMDTF

SEQ ID NO: 43209 - protein, 9 aa, Homo Sapiens
KLISEMHSF

SEQ ID NO: 43210 - protein, 9 aa, Homo Sapiens
KLKDFSGGW

SEQ ID NO: 43211 - protein, 9 aa, Homo Sapiens
KLKDIRNAW

SEQ ID NO: 43212 - protein, 9 aa, Homo Sapiens
KLKKIYFYW

SEQ ID NO: 43213 - protein, 9 aa, Homo Sapiens
KLKPLLEKW

SEQ ID NO: 43214 - protein, 9 aa, Homo Sapiens
KLKSFFKEY

SEQ ID NO: 43215 - protein, 9 aa, Homo Sapiens
KLKSFTYEY

SEQ ID NO: 43216 - protein, 9 aa, Homo Sapiens
KLKSLMVEW

SEQ ID NO: 43217 - protein, 9 aa, Homo Sapiens
KLKTVKENW

SEQ ID NO: 43218 - protein, 9 aa, Homo Sapiens
KLLAEMSSF

SEQ ID NO: 43219 - protein, 9 aa, Homo Sapiens
KLLAVIHEL

SEQ ID NO: 43220 - protein, 9 aa, Homo Sapiens
KLLAYVEGF

SEQ ID NO: 43221 - protein, 9 aa, Homo Sapiens
KLLDGWWVI

SEQ ID NO: 43222 - protein, 9 aa, Homo Sapiens
KLLEKAFSI

SEQ ID NO: 43223 - protein, 9 aa, Homo Sapiens
KLLEQRAQY

SEQ ID NO: 43224 - protein, 9 aa, Homo Sapiens
KLLERVSAI

SEQ ID NO: 43225 - protein, 9 aa, Homo Sapiens
KLLEYIEEI

SEQ ID NO: 43226 - protein, 9 aa, Homo Sapiens
KLLKLPTCW

SEQ ID NO: 43227 - protein, 9 aa, Homo Sapiens
KLLSHRSSF

SEQ ID NO: 43228 - protein, 9 aa, Homo Sapiens
KLLSRPEMW

SEQ ID NO: 43229 - protein, 9 aa, Homo Sapiens
KLMAIPLVF

SEQ ID NO: 43230 - protein, 9 aa, Homo Sapiens
KLMDHIYAV

SEQ ID NO: 43231 - protein, 9 aa, Homo Sapiens
KLMDLRNEY

SEQ ID NO: 43232 - protein, 9 aa, Homo Sapiens
KLMETSMGF

SEQ ID NO: 43233 - protein, 9 aa, Homo Sapiens
KLMHFVNSL

SEQ ID NO: 43234 - protein, 9 aa, Homo Sapiens
KLMKVHLKF

SEQ ID NO: 43235 - protein, 9 aa, Homo Sapiens
KLMSELESF

SEQ ID NO: 43236 - protein, 9 aa, Homo Sapiens
KLMSTSNTW

SEQ ID NO: 43237 - protein, 9 aa, Homo Sapiens
KLMVPLLKF

SEQ ID NO: 43238 - protein, 9 aa, Homo Sapiens
KLNEGVVEF

SEQ ID NO: 43239 - protein, 9 aa, Homo Sapiens
KLNEMSYEL

SEQ ID NO: 43240 - protein, 9 aa, Homo Sapiens
KLNESVMVF

SEQ ID NO: 43241 - protein, 9 aa, Homo Sapiens
KLNLQTFQW

SEQ ID NO: 43242 - protein, 9 aa, Homo Sapiens
KLNNLVKEW

SEQ ID NO: 43243 - protein, 9 aa, Homo Sapiens
KLNPKSHIL

SEQ ID NO: 43244 - protein, 9 aa, Homo Sapiens
KLNSKRVSF

SEQ ID NO: 43245 - protein, 9 aa, Homo Sapiens
KLNVRTTHY

SEQ ID NO: 43246 - protein, 9 aa, Homo Sapiens
KLPDFSYCI

SEQ ID NO: 43247 - protein, 9 aa, Homo Sapiens
KLQASVRCL

SEQ ID NO: 43248 - protein, 9 aa, Homo Sapiens
KLQDGVHII

SEQ ID NO: 43249 - protein, 9 aa, Homo Sapiens
KLQEDRFLY

SEQ ID NO: 43250 - protein, 9 aa, Homo Sapiens
KLQEEIPVL

SEQ ID NO: 43251 - protein, 9 aa, Homo Sapiens
KLQEKARKW

SEQ ID NO: 43252 - protein, 9 aa, Homo Sapiens
KLQEKIQEL

SEQ ID NO: 43253 - protein, 9 aa, Homo Sapiens
KLQEQIFHL

SEQ ID NO: 43254 - protein, 9 aa, Homo Sapiens
KLQKAVESF

SEQ ID NO: 43255 - protein, 9 aa, Homo Sapiens
KLQTDSNSW

SEQ ID NO: 43256 - protein, 9 aa, Homo Sapiens
KLQWAKQSW

SEQ ID NO: 43257 - protein, 9 aa, Homo Sapiens
KLRHFRECF

SEQ ID NO: 43258 - protein, 9 aa, Homo Sapiens
KLRQETQEW

SEQ ID NO: 43259 - protein, 9 aa, Homo Sapiens
KLRVDTEEW

SEQ ID NO: 43260 - protein, 9 aa, Homo Sapiens
KLSCVQLLL

SEQ ID NO: 43261 - protein, 9 aa, Homo Sapiens
KLSEIVREF

SEQ ID NO: 43262 - protein, 9 aa, Homo Sapiens
KLSEKIMHF

SEQ ID NO: 43263 - protein, 9 aa, Homo Sapiens
KLSKAVATW

SEQ ID NO: 43264 - protein, 9 aa, Homo Sapiens
KLSQAFNHW

SEQ ID NO: 43265 - protein, 9 aa, Homo Sapiens
KLSQIRQIY

SEQ ID NO: 43266 - protein, 9 aa, Homo Sapiens
KLSQKGYSW

SEQ ID NO: 43267 - protein, 9 aa, Homo Sapiens
KLSQRGYEW

SEQ ID NO: 43268 - protein, 9 aa, Homo Sapiens
KLSSALQKW

SEQ ID NO: 43269 - protein, 9 aa, Homo Sapiens
KLSTFRESF

SEQ ID NO: 43270 - protein, 9 aa, Homo Sapiens
KLTQIRQIY

SEQ ID NO: 43271 - protein, 9 aa, Homo Sapiens
KLVERLVEW

SEQ ID NO: 43272 - protein, 9 aa, Homo Sapiens
KLVPWSQCL

SEQ ID NO: 43273 - protein, 9 aa, Homo Sapiens
KLWACNFCF

SEQ ID NO: 43274 - protein, 9 aa, Homo Sapiens
KLWADRISL

SEQ ID NO: 43275 - protein, 9 aa, Homo Sapiens
KLWESPNVL

SEQ ID NO: 43276 - protein, 9 aa, Homo Sapiens
KLWGVCVSI

SEQ ID NO: 43277 - protein, 9 aa, Homo Sapiens
KLWKVALHF

SEQ ID NO: 43278 - protein, 9 aa, Homo Sapiens
KLWNKIWCI

SEQ ID NO: 43279 - protein, 9 aa, Homo Sapiens
KLWSRSLKL

SEQ ID NO: 43280 - protein, 9 aa, Homo Sapiens
KLYAWELAF

SEQ ID NO: 43281 - protein, 9 aa, Homo Sapiens
KLYDMVLQF

SEQ ID NO: 43282 - protein, 9 aa, Homo Sapiens
KLYEAVPQL

SEQ ID NO: 43283 - protein, 9 aa, Homo Sapiens
KLYEKFLEF

SEQ ID NO: 43284 - protein, 9 aa, Homo Sapiens
KLYGRPIKI

SEQ ID NO: 43285 - protein, 9 aa, Homo Sapiens
KLYGYYVSI

SEQ ID NO: 43286 - protein, 9 aa, Homo Sapiens
KLYKNRVEF

SEQ ID NO: 43287 - protein, 9 aa, Homo Sapiens
KLYLEREEY

SEQ ID NO: 43288 - protein, 9 aa, Homo Sapiens
KLYLKEYHY

SEQ ID NO: 43289 - protein, 9 aa, Homo Sapiens
KLYLSWVEW

SEQ ID NO: 43290 - protein, 9 aa, Homo Sapiens
KLYPWIHQF

SEQ ID NO: 43291 - protein, 9 aa, Homo Sapiens
KLYQEMFAW

SEQ ID NO: 43292 - protein, 9 aa, Homo Sapiens
KLYSKHFTL

SEQ ID NO: 43293 - protein, 9 aa, Homo Sapiens
KLYTKVINW

SEQ ID NO: 43294 - protein, 9 aa, Homo Sapiens
KMCSMVKKW

SEQ ID NO: 43295 - protein, 9 aa, Homo Sapiens
KMDINRRRY

SEQ ID NO: 43296 - protein, 9 aa, Homo Sapiens
KMFAKELKL

SEQ ID NO: 43297 - protein, 9 aa, Homo Sapiens
KMFDRHSSL

SEQ ID NO: 43298 - protein, 9 aa, Homo Sapiens
KMFIGGLSW

SEQ ID NO: 43299 - protein, 9 aa, Homo Sapiens
KMFPIILAI

SEQ ID NO: 43300 - protein, 9 aa, Homo Sapiens
KMFTDFLSF

SEQ ID NO: 43301 - protein, 9 aa, Homo Sapiens
KMFVGGLSW

SEQ ID NO: 43302 - protein, 9 aa, Homo Sapiens
KMHDKVFAY

SEQ ID NO: 43303 - protein, 9 aa, Homo Sapiens
KMHQSRISY

SEQ ID NO: 43304 - protein, 9 aa, Homo Sapiens
KMKEIAEAY

SEQ ID NO: 43305 - protein, 9 aa, Homo Sapiens
KMKEREEAW

SEQ ID NO: 43306 - protein, 9 aa, Homo Sapiens
KMKGDYYRY

SEQ ID NO: 43307 - protein, 9 aa, Homo Sapiens
KMLDESFQW

SEQ ID NO: 43308 - protein, 9 aa, Homo Sapiens
KMLDKIISI

SEQ ID NO: 43309 - protein, 9 aa, Homo Sapiens
KMLDNFYNF

SEQ ID NO: 43310 - protein, 9 aa, Homo Sapiens
KMLEVFHAI

SEQ ID NO: 43311 - protein, 9 aa, Homo Sapiens
KMMDVTVTI

SEQ ID NO: 43312 - protein, 9 aa, Homo Sapiens
KMNEKIASL

SEQ ID NO: 43313 - protein, 9 aa, Homo Sapiens
KMNNVNVVY

SEQ ID NO: 43314 - protein, 9 aa, Homo Sapiens
KMNTERILY

SEQ ID NO: 43315 - protein, 9 aa, Homo Sapiens
KMRSIQETL

SEQ ID NO: 43316 - protein, 9 aa, Homo Sapiens
KMSEIHTVL

SEQ ID NO: 43317 - protein, 9 aa, Homo Sapiens
KMSSVKLRL

SEQ ID NO: 43318 - protein, 9 aa, Homo Sapiens
KMSSVQMMF

SEQ ID NO: 43319 - protein, 9 aa, Homo Sapiens
KMVAWMIAL

SEQ ID NO: 43320 - protein, 9 aa, Homo Sapiens
KMWEEAISL

SEQ ID NO: 43321 - protein, 9 aa, Homo Sapiens
KMWENRQNL

SEQ ID NO: 43322 - protein, 9 aa, Homo Sapiens
KMWEVQTGY

SEQ ID NO: 43323 - protein, 9 aa, Homo Sapiens
KMYAWEKSF

SEQ ID NO: 43324 - protein, 9 aa, Homo Sapiens
KMYFGHSSF

SEQ ID NO: 43325 - protein, 9 aa, Homo Sapiens
KMYGYVDTL

SEQ ID NO: 43326 - protein, 9 aa, Homo Sapiens
KQALVNCNW

SEQ ID NO: 43327 - protein, 9 aa, Homo Sapiens
KQCGKSFTY

SEQ ID NO: 43328 - protein, 9 aa, Homo Sapiens
KQCGKTFSF

SEQ ID NO: 43329 - protein, 9 aa, Homo Sapiens
KQCGKTFSY

SEQ ID NO: 43330 - protein, 9 aa, Homo Sapiens
KQCGKVFTF

SEQ ID NO: 43331 - protein, 9 aa, Homo Sapiens
KQFAEILHF

SEQ ID NO: 43332 - protein, 9 aa, Homo Sapiens
KQFEGSTSF

SEQ ID NO: 43333 - protein, 9 aa, Homo Sapiens
KQFEGTVEI

SEQ ID NO: 43334 - protein, 9 aa, Homo Sapiens
KQFELALQL

SEQ ID NO: 43335 - protein, 9 aa, Homo Sapiens
KQFFGIVGF

SEQ ID NO: 43336 - protein, 9 aa, Homo Sapiens
KQFFGRHRW

SEQ ID NO: 43337 - protein, 9 aa, Homo Sapiens
KQFFLQFHF

SEQ ID NO: 43338 - protein, 9 aa, Homo Sapiens
KQFGPLVRW

SEQ ID NO: 43339 - protein, 9 aa, Homo Sapiens
KQFGVRQKW

SEQ ID NO: 43340 - protein, 9 aa, Homo Sapiens
KQFPCLFEF

SEQ ID NO: 43341 - protein, 9 aa, Homo Sapiens
KQFPTAFEF

SEQ ID NO: 43342 - protein, 9 aa, Homo Sapiens
KQFYYRDEF

SEQ ID NO: 43343 - protein, 9 aa, Homo Sapiens
KQGPKIYSF

SEQ ID NO: 43344 - protein, 9 aa, Homo Sapiens
KQHEGLATF

SEQ ID NO: 43345 - protein, 9 aa, Homo Sapiens
KQHGVNVSV

SEQ ID NO: 43346 - protein, 9 aa, Homo Sapiens
KQHYPCTTW

SEQ ID NO: 43347 - protein, 9 aa, Homo Sapiens
KQIMWFWQF

SEQ ID NO: 43348 - protein, 9 aa, Homo Sapiens
KQIRDTVSW

SEQ ID NO: 43349 - protein, 9 aa, Homo Sapiens
KQKSAFIRW

SEQ ID NO: 43350 - protein, 9 aa, Homo Sapiens
KQKVEHIEW

SEQ ID NO: 43351 - protein, 9 aa, Homo Sapiens
KQLDMQSSW

SEQ ID NO: 43352 - protein, 9 aa, Homo Sapiens
KQLEHVMHF

SEQ ID NO: 43353 - protein, 9 aa, Homo Sapiens
KQLEVVHTL

SEQ ID NO: 43354 - protein, 9 aa, Homo Sapiens
KQLTWFYTF

SEQ ID NO: 43355 - protein, 9 aa, Homo Sapiens
KQMEQISQF

SEQ ID NO: 43356 - protein, 9 aa, Homo Sapiens
KQNDVRVKF

SEQ ID NO: 43357 - protein, 9 aa, Homo Sapiens
KQNHESVQW

SEQ ID NO: 43358 - protein, 9 aa, Homo Sapiens
KQNKNRISW

SEQ ID NO: 43359 - protein, 9 aa, Homo Sapiens
KQNRPIPQW

SEQ ID NO: 43360 - protein, 9 aa, Homo Sapiens
KQQDTLIVW

SEQ ID NO: 43361 - protein, 9 aa, Homo Sapiens
KQRTVIEMF

SEQ ID NO: 43362 - protein, 9 aa, Homo Sapiens
KQVAVRYTF

SEQ ID NO: 43363 - protein, 9 aa, Homo Sapiens
KQVLWDRTF

SEQ ID NO: 43364 - protein, 9 aa, Homo Sapiens
KQWETQPGF

SEQ ID NO: 43365 - protein, 9 aa, Homo Sapiens
KQYADVEGF

SEQ ID NO: 43366 - protein, 9 aa, Homo Sapiens
KQYNYLHEF

SEQ ID NO: 43367 - protein, 9 aa, Homo Sapiens
KRISELEAL

SEQ ID NO: 43368 - protein, 9 aa, Homo Sapiens
KSAFVRTQW

SEQ ID NO: 43369 - protein, 9 aa, Homo Sapiens
KSASFREEY

SEQ ID NO: 43370 - protein, 9 aa, Homo Sapiens
KSAYNSYSW

SEQ ID NO: 43371 - protein, 9 aa, Homo Sapiens
KSCQSFISW

SEQ ID NO: 43372 - protein, 9 aa, Homo Sapiens
KSFDFHFGF

SEQ ID NO: 43373 - protein, 9 aa, Homo Sapiens
KSFDNIRNW

SEQ ID NO: 43374 - protein, 9 aa, Homo Sapiens
KSFEGLFYF

SEQ ID NO: 43375 - protein, 9 aa, Homo Sapiens
KSFENISKW

SEQ ID NO: 43376 - protein, 9 aa, Homo Sapiens
KSFFRRLSF

SEQ ID NO: 43377 - protein, 9 aa, Homo Sapiens
KSFKKKFFY

SEQ ID NO: 43378 - protein, 9 aa, Homo Sapiens
KSFKKRYTF

SEQ ID NO: 43379 - protein, 9 aa, Homo Sapiens
KSFQAIHQF

SEQ ID NO: 43380 - protein, 9 aa, Homo Sapiens
KSFTFSSSL

SEQ ID NO: 43381 - protein, 9 aa, Homo Sapiens
KSFVKVYNY

SEQ ID NO: 43382 - protein, 9 aa, Homo Sapiens
KSHTVVIGF

SEQ ID NO: 43383 - protein, 9 aa, Homo Sapiens
KSLAWHTAL

SEQ ID NO: 43384 - protein, 9 aa, Homo Sapiens
KSLGVHYVF

SEQ ID NO: 43385 - protein, 9 aa, Homo Sapiens
KSLLFVNTL

SEQ ID NO: 43386 - protein, 9 aa, Homo Sapiens
KSLLKIFAW

SEQ ID NO: 43387 - protein, 9 aa, Homo Sapiens
KSLLVVHFW

SEQ ID NO: 43388 - protein, 9 aa, Homo Sapiens
KSLLWTETF

SEQ ID NO: 43389 - protein, 9 aa, Homo Sapiens
KSQSQRFTY

SEQ ID NO: 43390 - protein, 9 aa, Homo Sapiens
KSRLSISGW

SEQ ID NO: 43391 - protein, 9 aa, Homo Sapiens
KSSLTQHSW

SEQ ID NO: 43392 - protein, 9 aa, Homo Sapiens
KSSTVLHTF

SEQ ID NO: 43393 - protein, 9 aa, Homo Sapiens
KSTQFEYAW

SEQ ID NO: 43394 - protein, 9 aa, Homo Sapiens
KSTSLTFHW

SEQ ID NO: 43395 - protein, 9 aa, Homo Sapiens
KSVYWENTL

SEQ ID NO: 43396 - protein, 9 aa, Homo Sapiens
KSWVFGVHF

SEQ ID NO: 43397 - protein, 9 aa, Homo Sapiens
KSYSKAFTL

SEQ ID NO: 43398 - protein, 9 aa, Homo Sapiens
KSYVQGVTW

SEQ ID NO: 43399 - protein, 9 aa, Homo Sapiens
KTADVTKVW

SEQ ID NO: 43400 - protein, 9 aa, Homo Sapiens
KTANITFSL

SEQ ID NO: 43401 - protein, 9 aa, Homo Sapiens
KTAPFDSRF

SEQ ID NO: 43402 - protein, 9 aa, Homo Sapiens
KTATFAISI

SEQ ID NO: 43403 - protein, 9 aa, Homo Sapiens
KTCKFVSSF

SEQ ID NO: 43404 - protein, 9 aa, Homo Sapiens
KTCSMKVHW

SEQ ID NO: 43405 - protein, 9 aa, Homo Sapiens
KTEDEHFEF

SEQ ID NO: 43406 - protein, 9 aa, Homo Sapiens
KTFARYLSF

SEQ ID NO: 43407 - protein, 9 aa, Homo Sapiens
KTFDAPPAL

SEQ ID NO: 43408 - protein, 9 aa, Homo Sapiens
KTFDHYCEY

SEQ ID NO: 43409 - protein, 9 aa, Homo Sapiens
KTFDYKIPY

SEQ ID NO: 43410 - protein, 9 aa, Homo Sapiens
KTFEFNKEL

SEQ ID NO: 43411 - protein, 9 aa, Homo Sapiens
KTFEGFCAL

SEQ ID NO: 43412 - protein, 9 aa, Homo Sapiens
KTFFSRENY

SEQ ID NO: 43413 - protein, 9 aa, Homo Sapiens
KTFGETHPF

SEQ ID NO: 43414 - protein, 9 aa, Homo Sapiens
KTFHPVPNL

SEQ ID NO: 43415 - protein, 9 aa, Homo Sapiens
KTFIFHSSI

SEQ ID NO: 43416 - protein, 9 aa, Homo Sapiens
KTFIYYQSF

SEQ ID NO: 43417 - protein, 9 aa, Homo Sapiens
KTFLFSATM

SEQ ID NO: 43418 - protein, 9 aa, Homo Sapiens
KTFNWSTNL

SEQ ID NO: 43419 - protein, 9 aa, Homo Sapiens
KTFNYPSCF

SEQ ID NO: 43420 - protein, 9 aa, Homo Sapiens
KTFNYSSNF

SEQ ID NO: 43421 - protein, 9 aa, Homo Sapiens
KTFPFHFMF

SEQ ID NO: 43422 - protein, 9 aa, Homo Sapiens
KTFPNHYSI

SEQ ID NO: 43423 - protein, 9 aa, Homo Sapiens
KTFPNRTGF

SEQ ID NO: 43424 - protein, 9 aa, Homo Sapiens
KTFPSIHLW

SEQ ID NO: 43425 - protein, 9 aa, Homo Sapiens
KTFPYQHRY

SEQ ID NO: 43426 - protein, 9 aa, Homo Sapiens
KTFQFLHQF

SEQ ID NO: 43427 - protein, 9 aa, Homo Sapiens
KTFRWRSNF

SEQ ID NO: 43428 - protein, 9 aa, Homo Sapiens
KTFSHPSSF

SEQ ID NO: 43429 - protein, 9 aa, Homo Sapiens
KTFSWSSTL

SEQ ID NO: 43430 - protein, 9 aa, Homo Sapiens
KTFSYHHCF

SEQ ID NO: 43431 - protein, 9 aa, Homo Sapiens
KTFSYSSSF

SEQ ID NO: 43432 - protein, 9 aa, Homo Sapiens
KTFTFDTVF

SEQ ID NO: 43433 - protein, 9 aa, Homo Sapiens
KTFTGHREW

SEQ ID NO: 43434 - protein, 9 aa, Homo Sapiens
KTFTVQTTW

SEQ ID NO: 43435 - protein, 9 aa, Homo Sapiens
KTFTWNSSF

SEQ ID NO: 43436 - protein, 9 aa, Homo Sapiens
KTFTWSSTF

SEQ ID NO: 43437 - protein, 9 aa, Homo Sapiens
KTFTWYSSL

SEQ ID NO: 43438 - protein, 9 aa, Homo Sapiens
KTFVGRAKL

SEQ ID NO: 43439 - protein, 9 aa, Homo Sapiens
KTFVGTPCW

SEQ ID NO: 43440 - protein, 9 aa, Homo Sapiens
KTFVQRNMF

SEQ ID NO: 43441 - protein, 9 aa, Homo Sapiens
KTFYHHTSF

SEQ ID NO: 43442 - protein, 9 aa, Homo Sapiens
KTFYWREHL

SEQ ID NO: 43443 - protein, 9 aa, Homo Sapiens
KTGLVSSTW

SEQ ID NO: 43444 - protein, 9 aa, Homo Sapiens
KTIGLREVW

SEQ ID NO: 43445 - protein, 9 aa, Homo Sapiens
KTIIITCSF

SEQ ID NO: 43446 - protein, 9 aa, Homo Sapiens
KTKEIEQVY

SEQ ID NO: 43447 - protein, 9 aa, Homo Sapiens
KTKETSVNW

SEQ ID NO: 43448 - protein, 9 aa, Homo Sapiens
KTKEVIQEW

SEQ ID NO: 43449 - protein, 9 aa, Homo Sapiens
KTKGFHTTI

SEQ ID NO: 43450 - protein, 9 aa, Homo Sapiens
KTKSVEFTF

SEQ ID NO: 43451 - protein, 9 aa, Homo Sapiens
KTLEEHSHW

SEQ ID NO: 43452 - protein, 9 aa, Homo Sapiens
KTLERSYLL

SEQ ID NO: 43453 - protein, 9 aa, Homo Sapiens
KTLLIIYSF

SEQ ID NO: 43454 - protein, 9 aa, Homo Sapiens
KTLNYTARF

SEQ ID NO: 43455 - protein, 9 aa, Homo Sapiens
KTLPSKPSW

SEQ ID NO: 43456 - protein, 9 aa, Homo Sapiens
KTLRQVEVI

SEQ ID NO: 43457 - protein, 9 aa, Homo Sapiens
KTLSPRELW

SEQ ID NO: 43458 - protein, 9 aa, Homo Sapiens
KTLTKIPSL

SEQ ID NO: 43459 - protein, 9 aa, Homo Sapiens
KTMKQQLQF

SEQ ID NO: 43460 - protein, 9 aa, Homo Sapiens
KTMTDTYLL

SEQ ID NO: 43461 - protein, 9 aa, Homo Sapiens
KTNKFIYAI

SEQ ID NO: 43462 - protein, 9 aa, Homo Sapiens
KTNPKIQSI

SEQ ID NO: 43463 - protein, 9 aa, Homo Sapiens
KTNPSVSSL

SEQ ID NO: 43464 - protein, 9 aa, Homo Sapiens
KTPPPVLIF

SEQ ID NO: 43465 - protein, 9 aa, Homo Sapiens
KTQDYVVGF

SEQ ID NO: 43466 - protein, 9 aa, Homo Sapiens
KTQEKIWEF

SEQ ID NO: 43467 - protein, 9 aa, Homo Sapiens
KTQGPRALW

SEQ ID NO: 43468 - protein, 9 aa, Homo Sapiens
KTQREKFAW

SEQ ID NO: 43469 - protein, 9 aa, Homo Sapiens
KTQSKISSF

SEQ ID NO: 43470 - protein, 9 aa, Homo Sapiens
KTRAMREMY

SEQ ID NO: 43471 - protein, 9 aa, Homo Sapiens
KTRLGRNVY

SEQ ID NO: 43472 - protein, 9 aa, Homo Sapiens
KTRLVREGF

SEQ ID NO: 43473 - protein, 9 aa, Homo Sapiens
KTRTNVPTF

SEQ ID NO: 43474 - protein, 9 aa, Homo Sapiens
KTSDRCLAW

SEQ ID NO: 43475 - protein, 9 aa, Homo Sapiens
KTSGIINKF

SEQ ID NO: 43476 - protein, 9 aa, Homo Sapiens
KTSKIELKF

SEQ ID NO: 43477 - protein, 9 aa, Homo Sapiens
KTSNIRANF

SEQ ID NO: 43478 - protein, 9 aa, Homo Sapiens
KTTECSNTF

SEQ ID NO: 43479 - protein, 9 aa, Homo Sapiens
KTTKFIKSF

SEQ ID NO: 43480 - protein, 9 aa, Homo Sapiens
KTTNVRQTY

SEQ ID NO: 43481 - protein, 9 aa, Homo Sapiens
KTVAIHTLW

SEQ ID NO: 43482 - protein, 9 aa, Homo Sapiens
KTVDKFNEW

SEQ ID NO: 43483 - protein, 9 aa, Homo Sapiens
KTVEWDWKL

SEQ ID NO: 43484 - protein, 9 aa, Homo Sapiens
KTVGLREVW

SEQ ID NO: 43485 - protein, 9 aa, Homo Sapiens
KTVPWGVAF

SEQ ID NO: 43486 - protein, 9 aa, Homo Sapiens
KTWDKVAVL

SEQ ID NO: 43487 - protein, 9 aa, Homo Sapiens
KTWKGSIGL

SEQ ID NO: 43488 - protein, 9 aa, Homo Sapiens
KTWKPFIGY

SEQ ID NO: 43489 - protein, 9 aa, Homo Sapiens
KTWNGGESL

SEQ ID NO: 43490 - protein, 9 aa, Homo Sapiens
KTYDKTVAL

SEQ ID NO: 43491 - protein, 9 aa, Homo Sapiens
KTYIPILAF

SEQ ID NO: 43492 - protein, 9 aa, Homo Sapiens
KTYKWQGLW

SEQ ID NO: 43493 - protein, 9 aa, Homo Sapiens
KTYPCKISY

SEQ ID NO: 43494 - protein, 9 aa, Homo Sapiens
KTYSLLHQW

SEQ ID NO: 43495 - protein, 9 aa, Homo Sapiens
KVADLVLML

SEQ ID NO: 43496 - protein, 9 aa, Homo Sapiens
KVAGERYVY

SEQ ID NO: 43497 - protein, 9 aa, Homo Sapiens
KVAQLRSLY

SEQ ID NO: 43498 - protein, 9 aa, Homo Sapiens
KVASALEKW

SEQ ID NO: 43499 - protein, 9 aa, Homo Sapiens
KVAVFRYLF

SEQ ID NO: 43500 - protein, 9 aa, Homo Sapiens
KVCDKAFAW

SEQ ID NO: 43501 - protein, 9 aa, Homo Sapiens
KVCDKAFVW

SEQ ID NO: 43502 - protein, 9 aa, Homo Sapiens
KVCGKAFKW

SEQ ID NO: 43503 - protein, 9 aa, Homo Sapiens
KVDQNRVRY

SEQ ID NO: 43504 - protein, 9 aa, Homo Sapiens
KVFDAIMNF

SEQ ID NO: 43505 - protein, 9 aa, Homo Sapiens
KVFELMTSL

SEQ ID NO: 43506 - protein, 9 aa, Homo Sapiens
KVFEYHNVL

SEQ ID NO: 43507 - protein, 9 aa, Homo Sapiens
KVFFPLEVF

SEQ ID NO: 43508 - protein, 9 aa, Homo Sapiens
KVFGWVHRL

SEQ ID NO: 43509 - protein, 9 aa, Homo Sapiens
KVFIFPSAL

SEQ ID NO: 43510 - protein, 9 aa, Homo Sapiens
KVFKFKHSL

SEQ ID NO: 43511 - protein, 9 aa, Homo Sapiens
KVFKLQTSL

SEQ ID NO: 43512 - protein, 9 aa, Homo Sapiens
KVFKLQTTL

SEQ ID NO: 43513 - protein, 9 aa, Homo Sapiens
KVFKNITVI

SEQ ID NO: 43514 - protein, 9 aa, Homo Sapiens
KVFKYFSSF

SEQ ID NO: 43515 - protein, 9 aa, Homo Sapiens
KVFLGRDTY

SEQ ID NO: 43516 - protein, 9 aa, Homo Sapiens
KVFNSSHSF

SEQ ID NO: 43517 - protein, 9 aa, Homo Sapiens
KVFNWFSTL

SEQ ID NO: 43518 - protein, 9 aa, Homo Sapiens
KVFPQSSSW

SEQ ID NO: 43519 - protein, 9 aa, Homo Sapiens
KVFRVENPF

SEQ ID NO: 43520 - protein, 9 aa, Homo Sapiens
KVFSDRSAF

SEQ ID NO: 43521 - protein, 9 aa, Homo Sapiens
KVFVVGESY

SEQ ID NO: 43522 - protein, 9 aa, Homo Sapiens
KVGEARALY

SEQ ID NO: 43523 - protein, 9 aa, Homo Sapiens
KVGNFKFIY

SEQ ID NO: 43524 - protein, 9 aa, Homo Sapiens
KVHNVSFAF

SEQ ID NO: 43525 - protein, 9 aa, Homo Sapiens
KVINAAHSF

SEQ ID NO: 43526 - protein, 9 aa, Homo Sapiens
KVINETWAW

SEQ ID NO: 43527 - protein, 9 aa, Homo Sapiens
KVINWQTSL

SEQ ID NO: 43528 - protein, 9 aa, Homo Sapiens
KVISNLSVW

SEQ ID NO: 43529 - protein, 9 aa, Homo Sapiens
KVKKTIPSW

SEQ ID NO: 43530 - protein, 9 aa, Homo Sapiens
KVKWFYNEY

SEQ ID NO: 43531 - protein, 9 aa, Homo Sapiens
KVLALVFGF

SEQ ID NO: 43532 - protein, 9 aa, Homo Sapiens
KVLDKMKSF

SEQ ID NO: 43533 - protein, 9 aa, Homo Sapiens
KVLDVSNSF

SEQ ID NO: 43534 - protein, 9 aa, Homo Sapiens
KVLGRSFFW

SEQ ID NO: 43535 - protein, 9 aa, Homo Sapiens
KVLNLIQSW

SEQ ID NO: 43536 - protein, 9 aa, Homo Sapiens
KVLPIIQRW

SEQ ID NO: 43537 - protein, 9 aa, Homo Sapiens
KVLQERENY

SEQ ID NO: 43538 - protein, 9 aa, Homo Sapiens
KVMNWKETL

SEQ ID NO: 43539 - protein, 9 aa, Homo Sapiens
KVMPQNHSF

SEQ ID NO: 43540 - protein, 9 aa, Homo Sapiens
KVMRWFQAM

SEQ ID NO: 43541 - protein, 9 aa, Homo Sapiens
KVMSQRHMI

SEQ ID NO: 43542 - protein, 9 aa, Homo Sapiens
KVMYYTEVI

SEQ ID NO: 43543 - protein, 9 aa, Homo Sapiens
KVNAMTFTF

SEQ ID NO: 43544 - protein, 9 aa, Homo Sapiens
KVNESSLNW

SEQ ID NO: 43545 - protein, 9 aa, Homo Sapiens
KVNKYGDTW

SEQ ID NO: 43546 - protein, 9 aa, Homo Sapiens
KVNLKYDSW

SEQ ID NO: 43547 - protein, 9 aa, Homo Sapiens
KVNQFRQLY

SEQ ID NO: 43548 - protein, 9 aa, Homo Sapiens
KVNTKPCSL

SEQ ID NO: 43549 - protein, 9 aa, Homo Sapiens
KVNVIDNTW

SEQ ID NO: 43550 - protein, 9 aa, Homo Sapiens
KVPPAINQF

SEQ ID NO: 43551 - protein, 9 aa, Homo Sapiens
KVQDITMQW

SEQ ID NO: 43552 - protein, 9 aa, Homo Sapiens
KVQEAINSL

SEQ ID NO: 43553 - protein, 9 aa, Homo Sapiens
KVQEAYNTW

SEQ ID NO: 43554 - protein, 9 aa, Homo Sapiens
KVQGKRFVY

SEQ ID NO: 43555 - protein, 9 aa, Homo Sapiens
KVQGTVHCF

SEQ ID NO: 43556 - protein, 9 aa, Homo Sapiens
KVQVLSFLW

SEQ ID NO: 43557 - protein, 9 aa, Homo Sapiens
KVRALREAF

SEQ ID NO: 43558 - protein, 9 aa, Homo Sapiens
KVSEARECF

SEQ ID NO: 43559 - protein, 9 aa, Homo Sapiens
KVSGVCKRW

SEQ ID NO: 43560 - protein, 9 aa, Homo Sapiens
KVSTSRQTW

SEQ ID NO: 43561 - protein, 9 aa, Homo Sapiens
KVVDRIYSL

SEQ ID NO: 43562 - protein, 9 aa, Homo Sapiens
KVVKFSYMW

SEQ ID NO: 43563 - protein, 9 aa, Homo Sapiens
KVWAPVQGL

SEQ ID NO: 43564 - protein, 9 aa, Homo Sapiens
KVWDDQAVW

SEQ ID NO: 43565 - protein, 9 aa, Homo Sapiens
KVWDLRKNY

SEQ ID NO: 43566 - protein, 9 aa, Homo Sapiens
KVWGEVGRW

SEQ ID NO: 43567 - protein, 9 aa, Homo Sapiens
KVWKAPSSW

SEQ ID NO: 43568 - protein, 9 aa, Homo Sapiens
KVWMSKYGW

SEQ ID NO: 43569 - protein, 9 aa, Homo Sapiens
KVWNNLIGF

SEQ ID NO: 43570 - protein, 9 aa, Homo Sapiens
KVWYNVENW

SEQ ID NO: 43571 - protein, 9 aa, Homo Sapiens
KVWYPMTGW

SEQ ID NO: 43572 - protein, 9 aa, Homo Sapiens
KVYEHTSRF

SEQ ID NO: 43573 - protein, 9 aa, Homo Sapiens
KVYEYDTVI

SEQ ID NO: 43574 - protein, 9 aa, Homo Sapiens
KVYMFKCVW

SEQ ID NO: 43575 - protein, 9 aa, Homo Sapiens
LEREKLLEF

SEQ ID NO: 43576 - protein, 9 aa, Homo Sapiens
LERLSKIAI

SEQ ID NO: 43577 - protein, 9 aa, Homo Sapiens
LISKIREEY

SEQ ID NO: 43578 - protein, 9 aa, Homo Sapiens
LIWKNQNSW

SEQ ID NO: 43579 - protein, 9 aa, Homo Sapiens
LKERQRSSL

SEQ ID NO: 43580 - protein, 9 aa, Homo Sapiens
LLAPERTRD

SEQ ID NO: 43581 - protein, 9 aa, Homo Sapiens
LLFPLRYSF

SEQ ID NO: 43582 - protein, 9 aa, Homo Sapiens
LLGPRVLSW

SEQ ID NO: 43583 - protein, 9 aa, Homo Sapiens
LLNKYRNQY

SEQ ID NO: 43584 - protein, 9 aa, Homo Sapiens
LLNPVIYTW

SEQ ID NO: 43585 - protein, 9 aa, Homo Sapiens
LMSCTRSVY

SEQ ID NO: 43586 - protein, 9 aa, Homo Sapiens
LPSLFLNSL

SEQ ID NO: 43587 - protein, 9 aa, Homo Sapiens
LQAKVRESY

SEQ ID NO: 43588 - protein, 9 aa, Homo Sapiens
LQHPYINVW

SEQ ID NO: 43589 - protein, 9 aa, Homo Sapiens
LQIDNARLA

SEQ ID NO: 43590 - protein, 9 aa, Homo Sapiens
LQNTHVYSW

SEQ ID NO: 43591 - protein, 9 aa, Homo Sapiens
LTLLWTHTL

SEQ ID NO: 43592 - protein, 9 aa, Homo Sapiens
LTNSIRKQW

SEQ ID NO: 43593 - protein, 9 aa, Homo Sapiens
LTYRRRLSY

SEQ ID NO: 43594 - protein, 9 aa, Homo Sapiens
LVNQHRDSY

SEQ ID NO: 43595 - protein, 9 aa, Homo Sapiens
MLFNNREKY

SEQ ID NO: 43596 - protein, 9 aa, Homo Sapiens
MLFPSRTTW

SEQ ID NO: 43597 - protein, 9 aa, Homo Sapiens
MLYPLSHGF

SEQ ID NO: 43598 - protein, 9 aa, Homo Sapiens
MMFAVHCTW

SEQ ID NO: 43599 - protein, 9 aa, Homo Sapiens
MMNGGHYTY

SEQ ID NO: 43600 - protein, 9 aa, Homo Sapiens
MMWNNHYIL

SEQ ID NO: 43601 - protein, 9 aa, Homo Sapiens
MMYEKPERW

SEQ ID NO: 43602 - protein, 9 aa, Homo Sapiens
MMYSGELKF

SEQ ID NO: 43603 - protein, 9 aa, Homo Sapiens
MQAPSIWQW

SEQ ID NO: 43604 - protein, 9 aa, Homo Sapiens
MQTPVRMEW

SEQ ID NO: 43605 - protein, 9 aa, Homo Sapiens
MQYDRTCEW

SEQ ID NO: 43606 - protein, 9 aa, Homo Sapiens
MSLKWMSVF

SEQ ID NO: 43607 - protein, 9 aa, Homo Sapiens
MSNKHGWTW

SEQ ID NO: 43608 - protein, 9 aa, Homo Sapiens
MTLKDIYTW

SEQ ID NO: 43609 - protein, 9 aa, Homo Sapiens
MTNGFHMTW

SEQ ID NO: 43610 - protein, 9 aa, Homo Sapiens
NICAKRFMW

SEQ ID NO: 43611 - protein, 9 aa, Homo Sapiens
NIFRWETTI

SEQ ID NO: 43612 - protein, 9 aa, Homo Sapiens
QIAEFKEAF

SEQ ID NO: 43613 - protein, 9 aa, Homo Sapiens
QIFHGLFAW

SEQ ID NO: 43614 - protein, 9 aa, Homo Sapiens
QIFTHRSNY

SEQ ID NO: 43615 - protein, 9 aa, Homo Sapiens
QIHKWSHTY

SEQ ID NO: 43616 - protein, 9 aa, Homo Sapiens
QILKWIEQW

SEQ ID NO: 43617 - protein, 9 aa, Homo Sapiens
QINAKVAEW

SEQ ID NO: 43618 - protein, 9 aa, Homo Sapiens
QIRKDINSW

SEQ ID NO: 43619 - protein, 9 aa, Homo Sapiens
QLFCWIDKW

SEQ ID NO: 43620 - protein, 9 aa, Homo Sapiens
QLFGGRFNF

SEQ ID NO: 43621 - protein, 9 aa, Homo Sapiens
QLFSPRCAY

SEQ ID NO: 43622 - protein, 9 aa, Homo Sapiens
QLMPWKSMF

SEQ ID NO: 43623 - protein, 9 aa, Homo Sapiens
QLNCERGTW

SEQ ID NO: 43624 - protein, 9 aa, Homo Sapiens
QLNKIRDSY

SEQ ID NO: 43625 - protein, 9 aa, Homo Sapiens
QLNSRIESW

SEQ ID NO: 43626 - protein, 9 aa, Homo Sapiens
QLQSHIEGW

SEQ ID NO: 43627 - protein, 9 aa, Homo Sapiens
QLYKMRNGY

SEQ ID NO: 43628 - protein, 9 aa, Homo Sapiens
QMAGLRDTY

SEQ ID NO: 43629 - protein, 9 aa, Homo Sapiens
QMNEKKPTW

SEQ ID NO: 43630 - protein, 9 aa, Homo Sapiens
QQFSSHYSF

SEQ ID NO: 43631 - protein, 9 aa, Homo Sapiens
QSIVWVHAF

SEQ ID NO: 43632 - protein, 9 aa, Homo Sapiens
QTYYRIFTW

SEQ ID NO: 43633 - protein, 9 aa, Homo Sapiens
QVAPKTLPW

SEQ ID NO: 43634 - protein, 9 aa, Homo Sapiens
QVLKKCWAF

SEQ ID NO: 43635 - protein, 9 aa, Homo Sapiens
QVNHARNIW

SEQ ID NO: 43636 - protein, 9 aa, Homo Sapiens
RAAFWNHVL

SEQ ID NO: 43637 - protein, 9 aa, Homo Sapiens
RAFNWSSTL

SEQ ID NO: 43638 - protein, 9 aa, Homo Sapiens
RAGAPRCTY

SEQ ID NO: 43639 - protein, 9 aa, Homo Sapiens
RALFIREKY

SEQ ID NO: 43640 - protein, 9 aa, Homo Sapiens
RALKFPWVW

SEQ ID NO: 43641 - protein, 9 aa, Homo Sapiens
RALVKRVTW

SEQ ID NO: 43642 - protein, 9 aa, Homo Sapiens
RAWDGMKEW

SEQ ID NO: 43643 - protein, 9 aa, Homo Sapiens
RAYPFHWAW

SEQ ID NO: 43644 - protein, 9 aa, Homo Sapiens
RAYPFYWAW

SEQ ID NO: 43645 - protein, 9 aa, Homo Sapiens
RGNIKRYGW

SEQ ID NO: 43646 - protein, 9 aa, Homo Sapiens
RGVPWNFTF

SEQ ID NO: 43647 - protein, 9 aa, Homo Sapiens
RGWDGFVEF

SEQ ID NO: 43648 - protein, 9 aa, Homo Sapiens
RIAAWMATY

SEQ ID NO: 43649 - protein, 9 aa, Homo Sapiens
RIADLISSF

SEQ ID NO: 43650 - protein, 9 aa, Homo Sapiens
RIAEFAFEY

SEQ ID NO: 43651 - protein, 9 aa, Homo Sapiens
RIAEYAFKL

SEQ ID NO: 43652 - protein, 9 aa, Homo Sapiens
RIAHIPLYF

SEQ ID NO: 43653 - protein, 9 aa, Homo Sapiens
RIAQLRFLL

SEQ ID NO: 43654 - protein, 9 aa, Homo Sapiens
RIASWLPSF

SEQ ID NO: 43655 - protein, 9 aa, Homo Sapiens
RICSKAHSW

SEQ ID NO: 43656 - protein, 9 aa, Homo Sapiens
RIDRKVNSW

SEQ ID NO: 43657 - protein, 9 aa, Homo Sapiens
RIFAHKQNY

SEQ ID NO: 43658 - protein, 9 aa, Homo Sapiens
RIFANTESY

SEQ ID NO: 43659 - protein, 9 aa, Homo Sapiens
RIFEKMFAM

SEQ ID NO: 43660 - protein, 9 aa, Homo Sapiens
RIGEGRACW

SEQ ID NO: 43661 - protein, 9 aa, Homo Sapiens
RIHCVAFVF

SEQ ID NO: 43662 - protein, 9 aa, Homo Sapiens
RIHCVAYVL

SEQ ID NO: 43663 - protein, 9 aa, Homo Sapiens
RIHENGYNF

SEQ ID NO: 43664 - protein, 9 aa, Homo Sapiens
RIHHKNWTL

SEQ ID NO: 43665 - protein, 9 aa, Homo Sapiens
RIHIRENSY

SEQ ID NO: 43666 - protein, 9 aa, Homo Sapiens
RIHKGWKEW

SEQ ID NO: 43667 - protein, 9 aa, Homo Sapiens
RIIAKLAAW

SEQ ID NO: 43668 - protein, 9 aa, Homo Sapiens
RIIPWIQQL

SEQ ID NO: 43669 - protein, 9 aa, Homo Sapiens
RIIYIREQW

SEQ ID NO: 43670 - protein, 9 aa, Homo Sapiens
RIKDIRMMY

SEQ ID NO: 43671 - protein, 9 aa, Homo Sapiens
RIKGKLFTW

SEQ ID NO: 43672 - protein, 9 aa, Homo Sapiens
RILAVREIY

SEQ ID NO: 43673 - protein, 9 aa, Homo Sapiens
RILEVRNVF

SEQ ID NO: 43674 - protein, 9 aa, Homo Sapiens
RILKARLEY

SEQ ID NO: 43675 - protein, 9 aa, Homo Sapiens
RILKFGYQF

SEQ ID NO: 43676 - protein, 9 aa, Homo Sapiens
RILKIVTGF

SEQ ID NO: 43677 - protein, 9 aa, Homo Sapiens
RILKVLWCF

SEQ ID NO: 43678 - protein, 9 aa, Homo Sapiens
RILNKLTKW

SEQ ID NO: 43679 - protein, 9 aa, Homo Sapiens
RILVEKRCW

SEQ ID NO: 43680 - protein, 9 aa, Homo Sapiens
RIMQFCHTL

SEQ ID NO: 43681 - protein, 9 aa, Homo Sapiens
RIMSETYML

SEQ ID NO: 43682 - protein, 9 aa, Homo Sapiens
RINPQTTEF

SEQ ID NO: 43683 - protein, 9 aa, Homo Sapiens
RIQEKVDSI

SEQ ID NO: 43684 - protein, 9 aa, Homo Sapiens
RISDFHETY

SEQ ID NO: 43685 - protein, 9 aa, Homo Sapiens
RISLPLPNF

SEQ ID NO: 43686 - protein, 9 aa, Homo Sapiens
RISRVCHRW

SEQ ID NO: 43687 - protein, 9 aa, Homo Sapiens
RITAVRRVY

SEQ ID NO: 43688 - protein, 9 aa, Homo Sapiens
RITEFCHRF

SEQ ID NO: 43689 - protein, 9 aa, Homo Sapiens
RITNFTTSW

SEQ ID NO: 43690 - protein, 9 aa, Homo Sapiens
RITVFLSTW

SEQ ID NO: 43691 - protein, 9 aa, Homo Sapiens
RIVEPYIAW

SEQ ID NO: 43692 - protein, 9 aa, Homo Sapiens
RIWNNVTRW

SEQ ID NO: 43693 - protein, 9 aa, Homo Sapiens
RIWRYNQEL

SEQ ID NO: 43694 - protein, 9 aa, Homo Sapiens
RIWTKKRSF

SEQ ID NO: 43695 - protein, 9 aa, Homo Sapiens
RIYKYIHKV

SEQ ID NO: 43696 - protein, 9 aa, Homo Sapiens
RIYNFAHRF

SEQ ID NO: 43697 - protein, 9 aa, Homo Sapiens
RLAEISDVW

SEQ ID NO: 43698 - protein, 9 aa, Homo Sapiens
RLAKKLLGW

SEQ ID NO: 43699 - protein, 9 aa, Homo Sapiens
RLAKWYMQF

SEQ ID NO: 43700 - protein, 9 aa, Homo Sapiens
RLALYQTAI

SEQ ID NO: 43701 - protein, 9 aa, Homo Sapiens
RLANTAPAW

SEQ ID NO: 43702 - protein, 9 aa, Homo Sapiens
RLAQERKAW

SEQ ID NO: 43703 - protein, 9 aa, Homo Sapiens
RLAQFVEHW

SEQ ID NO: 43704 - protein, 9 aa, Homo Sapiens
RLAQICSSI

SEQ ID NO: 43705 - protein, 9 aa, Homo Sapiens
RLASFHRVW

SEQ ID NO: 43706 - protein, 9 aa, Homo Sapiens
RLASLGLKF

SEQ ID NO: 43707 - protein, 9 aa, Homo Sapiens
RLAVVKFTM

SEQ ID NO: 43708 - protein, 9 aa, Homo Sapiens
RLCPIPISW

SEQ ID NO: 43709 - protein, 9 aa, Homo Sapiens
RLDVGNFSW

SEQ ID NO: 43710 - protein, 9 aa, Homo Sapiens
RLFAKLNAF

SEQ ID NO: 43711 - protein, 9 aa, Homo Sapiens
RLFATRHKF

SEQ ID NO: 43712 - protein, 9 aa, Homo Sapiens
RLFEKGMKF

SEQ ID NO: 43713 - protein, 9 aa, Homo Sapiens
RLFEKMQAY

SEQ ID NO: 43714 - protein, 9 aa, Homo Sapiens
RLFEVPHEL

SEQ ID NO: 43715 - protein, 9 aa, Homo Sapiens
RLFFHCSQY

SEQ ID NO: 43716 - protein, 9 aa, Homo Sapiens
RLFGATRTW

SEQ ID NO: 43717 - protein, 9 aa, Homo Sapiens
RLFGAVVRW

SEQ ID NO: 43718 - protein, 9 aa, Homo Sapiens
RLFHRIPSF

SEQ ID NO: 43719 - protein, 9 aa, Homo Sapiens
RLFKFPFLW

SEQ ID NO: 43720 - protein, 9 aa, Homo Sapiens
RLFLWNAVL

SEQ ID NO: 43721 - protein, 9 aa, Homo Sapiens
RLFLYYHTL

SEQ ID NO: 43722 - protein, 9 aa, Homo Sapiens
RLFMHHVSL

SEQ ID NO: 43723 - protein, 9 aa, Homo Sapiens
RLFNAVVRW

SEQ ID NO: 43724 - protein, 9 aa, Homo Sapiens
RLFNHTACL

SEQ ID NO: 43725 - protein, 9 aa, Homo Sapiens
RLFPNTMLF

SEQ ID NO: 43726 - protein, 9 aa, Homo Sapiens
RLFPWGNKL

SEQ ID NO: 43727 - protein, 9 aa, Homo Sapiens
RLFPWKLHI

SEQ ID NO: 43728 - protein, 9 aa, Homo Sapiens
RLFRFSSVI

SEQ ID NO: 43729 - protein, 9 aa, Homo Sapiens
RLFRGLDSW

SEQ ID NO: 43730 - protein, 9 aa, Homo Sapiens
RLFSRLYTY

SEQ ID NO: 43731 - protein, 9 aa, Homo Sapiens
RLFVGEPVW

SEQ ID NO: 43732 - protein, 9 aa, Homo Sapiens
RLGAVRSHY

SEQ ID NO: 43733 - protein, 9 aa, Homo Sapiens
RLGCFNLTI

SEQ ID NO: 43734 - protein, 9 aa, Homo Sapiens
RLGCNRQSW

SEQ ID NO: 43735 - protein, 9 aa, Homo Sapiens
RLGLRNTEW

SEQ ID NO: 43736 - protein, 9 aa, Homo Sapiens
RLGQIYQSW

SEQ ID NO: 43737 - protein, 9 aa, Homo Sapiens
RLHADVYTF

SEQ ID NO: 43738 - protein, 9 aa, Homo Sapiens
RLHCESESF

SEQ ID NO: 43739 - protein, 9 aa, Homo Sapiens
RLHDVLMEL

SEQ ID NO: 43740 - protein, 9 aa, Homo Sapiens
RLHEKVNII

SEQ ID NO: 43741 - protein, 9 aa, Homo Sapiens
RLHKPHHIW

SEQ ID NO: 43742 - protein, 9 aa, Homo Sapiens
RLHNDRVYY

SEQ ID NO: 43743 - protein, 9 aa, Homo Sapiens
RLHNTIVEI

SEQ ID NO: 43744 - protein, 9 aa, Homo Sapiens
RLHSPQTHW

SEQ ID NO: 43745 - protein, 9 aa, Homo Sapiens
RLIDKSFSI

SEQ ID NO: 43746 - protein, 9 aa, Homo Sapiens
RLIEETISI

SEQ ID NO: 43747 - protein, 9 aa, Homo Sapiens
RLIKFIYNI

SEQ ID NO: 43748 - protein, 9 aa, Homo Sapiens
RLIPERTVW

SEQ ID NO: 43749 - protein, 9 aa, Homo Sapiens
RLIRNIYIF

SEQ ID NO: 43750 - protein, 9 aa, Homo Sapiens
RLKAKEEEW

SEQ ID NO: 43751 - protein, 9 aa, Homo Sapiens
RLKALNATF

SEQ ID NO: 43752 - protein, 9 aa, Homo Sapiens
RLKDFRDAY

SEQ ID NO: 43753 - protein, 9 aa, Homo Sapiens
RLKDIKAQW

SEQ ID NO: 43754 - protein, 9 aa, Homo Sapiens
RLKEHIDSF

SEQ ID NO: 43755 - protein, 9 aa, Homo Sapiens
RLKELCHQW

SEQ ID NO: 43756 - protein, 9 aa, Homo Sapiens
RLKELLAEW

SEQ ID NO: 43757 - protein, 9 aa, Homo Sapiens
RLKENTFTI

SEQ ID NO: 43758 - protein, 9 aa, Homo Sapiens
RLKEQQFVI

SEQ ID NO: 43759 - protein, 9 aa, Homo Sapiens
RLKIYEEAW

SEQ ID NO: 43760 - protein, 9 aa, Homo Sapiens
RLKMKEEEW

SEQ ID NO: 43761 - protein, 9 aa, Homo Sapiens
RLKSEKPTW

SEQ ID NO: 43762 - protein, 9 aa, Homo Sapiens
RLKTMTDTY

SEQ ID NO: 43763 - protein, 9 aa, Homo Sapiens
RLKWFAICF

SEQ ID NO: 43764 - protein, 9 aa, Homo Sapiens
RLLDCVVRW

SEQ ID NO: 43765 - protein, 9 aa, Homo Sapiens
RLLDLHQSW

SEQ ID NO: 43766 - protein, 9 aa, Homo Sapiens
RLLDRLPSF

SEQ ID NO: 43767 - protein, 9 aa, Homo Sapiens
RLLDSVRAI

SEQ ID NO: 43768 - protein, 9 aa, Homo Sapiens
RLLDTTITF

SEQ ID NO: 43769 - protein, 9 aa, Homo Sapiens
RLLDWFRSL

SEQ ID NO: 43770 - protein, 9 aa, Homo Sapiens
RLLDYVVNI

SEQ ID NO: 43771 - protein, 9 aa, Homo Sapiens
RLLEFCSVF

SEQ ID NO: 43772 - protein, 9 aa, Homo Sapiens
RLLELIEGF

SEQ ID NO: 43773 - protein, 9 aa, Homo Sapiens
RLLEVTNTI

SEQ ID NO: 43774 - protein, 9 aa, Homo Sapiens
RLLGVVSSW

SEQ ID NO: 43775 - protein, 9 aa, Homo Sapiens
RLLGWWQVL

SEQ ID NO: 43776 - protein, 9 aa, Homo Sapiens
RLLGYVATL

SEQ ID NO: 43777 - protein, 9 aa, Homo Sapiens
RLLKSLPNW

SEQ ID NO: 43778 - protein, 9 aa, Homo Sapiens
RLLKYLFTL

SEQ ID NO: 43779 - protein, 9 aa, Homo Sapiens
RLLPESWGF

SEQ ID NO: 43780 - protein, 9 aa, Homo Sapiens
RLLSIKEAF

SEQ ID NO: 43781 - protein, 9 aa, Homo Sapiens
RLLSWSDNW

SEQ ID NO: 43782 - protein, 9 aa, Homo Sapiens
RLLTDRASY

SEQ ID NO: 43783 - protein, 9 aa, Homo Sapiens
RLMEICESL

SEQ ID NO: 43784 - protein, 9 aa, Homo Sapiens
RLMEQASCW

SEQ ID NO: 43785 - protein, 9 aa, Homo Sapiens
RLMGQHRAW

SEQ ID NO: 43786 - protein, 9 aa, Homo Sapiens
RLMKQISSF

SEQ ID NO: 43787 - protein, 9 aa, Homo Sapiens
RLMQCVSSF

SEQ ID NO: 43788 - protein, 9 aa, Homo Sapiens
RLMRAIFEI

SEQ ID NO: 43789 - protein, 9 aa, Homo Sapiens
RLMSARARY

SEQ ID NO: 43790 - protein, 9 aa, Homo Sapiens
RLMYPPHKF

SEQ ID NO: 43791 - protein, 9 aa, Homo Sapiens
RLNDRIEMW

SEQ ID NO: 43792 - protein, 9 aa, Homo Sapiens
RLNDYIFSF

SEQ ID NO: 43793 - protein, 9 aa, Homo Sapiens
RLNEFMAGF

SEQ ID NO: 43794 - protein, 9 aa, Homo Sapiens
RLNEKNYEL

SEQ ID NO: 43795 - protein, 9 aa, Homo Sapiens
RLNKVISEL

SEQ ID NO: 43796 - protein, 9 aa, Homo Sapiens
RLNNKINSY

SEQ ID NO: 43797 - protein, 9 aa, Homo Sapiens
RLNTQITQW

SEQ ID NO: 43798 - protein, 9 aa, Homo Sapiens
RLPEEWSQW

SEQ ID NO: 43799 - protein, 9 aa, Homo Sapiens
RLPEPLPSW

SEQ ID NO: 43800 - protein, 9 aa, Homo Sapiens
RLQDTTFSF

SEQ ID NO: 43801 - protein, 9 aa, Homo Sapiens
RLQDWKCLW

SEQ ID NO: 43802 - protein, 9 aa, Homo Sapiens
RLQEASQTI

SEQ ID NO: 43803 - protein, 9 aa, Homo Sapiens
RLQELCHGW

SEQ ID NO: 43804 - protein, 9 aa, Homo Sapiens
RLQELCYQW

SEQ ID NO: 43805 - protein, 9 aa, Homo Sapiens
RLQHLAESW

SEQ ID NO: 43806 - protein, 9 aa, Homo Sapiens
RLQKDISEW

SEQ ID NO: 43807 - protein, 9 aa, Homo Sapiens
RLQLEKAAW

SEQ ID NO: 43808 - protein, 9 aa, Homo Sapiens
RLQNNRKEW

SEQ ID NO: 43809 - protein, 9 aa, Homo Sapiens
RLQSWEETW

SEQ ID NO: 43810 - protein, 9 aa, Homo Sapiens
RLRDQIKTW

SEQ ID NO: 43811 - protein, 9 aa, Homo Sapiens
RLREESAEW

SEQ ID NO: 43812 - protein, 9 aa, Homo Sapiens
RLREFQESF

SEQ ID NO: 43813 - protein, 9 aa, Homo Sapiens
RLREFWMRY

SEQ ID NO: 43814 - protein, 9 aa, Homo Sapiens
RLRQERESL

SEQ ID NO: 43815 - protein, 9 aa, Homo Sapiens
RLSEVQASL

SEQ ID NO: 43816 - protein, 9 aa, Homo Sapiens
RLSIHVVTW

SEQ ID NO: 43817 - protein, 9 aa, Homo Sapiens
RLSSQHRQW

SEQ ID NO: 43818 - protein, 9 aa, Homo Sapiens
RLSSVSVTY

SEQ ID NO: 43819 - protein, 9 aa, Homo Sapiens
RLTATSASW

SEQ ID NO: 43820 - protein, 9 aa, Homo Sapiens
RLTATSTSW

SEQ ID NO: 43821 - protein, 9 aa, Homo Sapiens
RLTKPIVCW

SEQ ID NO: 43822 - protein, 9 aa, Homo Sapiens
RLTTSTSTF

SEQ ID NO: 43823 - protein, 9 aa, Homo Sapiens
RLVAIRTEY

SEQ ID NO: 43824 - protein, 9 aa, Homo Sapiens
RLVDDRWLW

SEQ ID NO: 43825 - protein, 9 aa, Homo Sapiens
RLVEERYSW

SEQ ID NO: 43826 - protein, 9 aa, Homo Sapiens
RLVNRIESW

SEQ ID NO: 43827 - protein, 9 aa, Homo Sapiens
RLVNWSCTL

SEQ ID NO: 43828 - protein, 9 aa, Homo Sapiens
RLVSWVNLI

SEQ ID NO: 43829 - protein, 9 aa, Homo Sapiens
RLWAGAGRW

SEQ ID NO: 43830 - protein, 9 aa, Homo Sapiens
RLWAVAASY

SEQ ID NO: 43831 - protein, 9 aa, Homo Sapiens
RLWEGAISI

SEQ ID NO: 43832 - protein, 9 aa, Homo Sapiens
RLWEQLVHF

SEQ ID NO: 43833 - protein, 9 aa, Homo Sapiens
RLWGEPVNL

SEQ ID NO: 43834 - protein, 9 aa, Homo Sapiens
RLWKFFWEM

SEQ ID NO: 43835 - protein, 9 aa, Homo Sapiens
RLYDVVAVF

SEQ ID NO: 43836 - protein, 9 aa, Homo Sapiens
RLYEAMCEF

SEQ ID NO: 43837 - protein, 9 aa, Homo Sapiens
RLYECVLEF

SEQ ID NO: 43838 - protein, 9 aa, Homo Sapiens
RLYGNPNTL

SEQ ID NO: 43839 - protein, 9 aa, Homo Sapiens
RLYKQTSLW

SEQ ID NO: 43840 - protein, 9 aa, Homo Sapiens
RLYKYDHNF

SEQ ID NO: 43841 - protein, 9 aa, Homo Sapiens
RLYPSREEF

SEQ ID NO: 43842 - protein, 9 aa, Homo Sapiens
RLYQVEYAF

SEQ ID NO: 43843 - protein, 9 aa, Homo Sapiens
RLYSKQITI

SEQ ID NO: 43844 - protein, 9 aa, Homo Sapiens
RLYSSRFWW

SEQ ID NO: 43845 - protein, 9 aa, Homo Sapiens
RMAFLRKVY

SEQ ID NO: 43846 - protein, 9 aa, Homo Sapiens
RMALDRRNY

SEQ ID NO: 43847 - protein, 9 aa, Homo Sapiens
RMAPPQNQW

SEQ ID NO: 43848 - protein, 9 aa, Homo Sapiens
RMEEEQHHW

SEQ ID NO: 43849 - protein, 9 aa, Homo Sapiens
RMFAPTKTW

SEQ ID NO: 43850 - protein, 9 aa, Homo Sapiens
RMFDMGFEY

SEQ ID NO: 43851 - protein, 9 aa, Homo Sapiens
RMFHIRAVI

SEQ ID NO: 43852 - protein, 9 aa, Homo Sapiens
RMFLENETW

SEQ ID NO: 43853 - protein, 9 aa, Homo Sapiens
RMFLVYVSY

SEQ ID NO: 43854 - protein, 9 aa, Homo Sapiens
RMFNRTYKL

SEQ ID NO: 43855 - protein, 9 aa, Homo Sapiens
RMFSDPSSF

SEQ ID NO: 43856 - protein, 9 aa, Homo Sapiens
RMHQAIERF

SEQ ID NO: 43857 - protein, 9 aa, Homo Sapiens
RMHQAIMRW

SEQ ID NO: 43858 - protein, 9 aa, Homo Sapiens
RMILSTISW

SEQ ID NO: 43859 - protein, 9 aa, Homo Sapiens
RMKVAWWRW

SEQ ID NO: 43860 - protein, 9 aa, Homo Sapiens
RMLEPLPCW

SEQ ID NO: 43861 - protein, 9 aa, Homo Sapiens
RMMQTILHF

SEQ ID NO: 43862 - protein, 9 aa, Homo Sapiens
RMNALFVQF

SEQ ID NO: 43863 - protein, 9 aa, Homo Sapiens
RMNCVLATY

SEQ ID NO: 43864 - protein, 9 aa, Homo Sapiens
RMNEVISLW

SEQ ID NO: 43865 - protein, 9 aa, Homo Sapiens
RMNPNSPSI

SEQ ID NO: 43866 - protein, 9 aa, Homo Sapiens
RMNSKIMSL

SEQ ID NO: 43867 - protein, 9 aa, Homo Sapiens
RMSMKTSSW

SEQ ID NO: 43868 - protein, 9 aa, Homo Sapiens
RMWAAIQSW

SEQ ID NO: 43869 - protein, 9 aa, Homo Sapiens
RMWKTLTFF

SEQ ID NO: 43870 - protein, 9 aa, Homo Sapiens
RMWSYKEQM

SEQ ID NO: 43871 - protein, 9 aa, Homo Sapiens
RMYEKALQI

SEQ ID NO: 43872 - protein, 9 aa, Homo Sapiens
RMYPLKPTW

SEQ ID NO: 43873 - protein, 9 aa, Homo Sapiens
RNLPWLFTF

SEQ ID NO: 43874 - protein, 9 aa, Homo Sapiens
RQADKVWRL

SEQ ID NO: 43875 - protein, 9 aa, Homo Sapiens
RQALASVSW

SEQ ID NO: 43876 - protein, 9 aa, Homo Sapiens
RQFEGLMRF

SEQ ID NO: 43877 - protein, 9 aa, Homo Sapiens
RQFLWSFRL

SEQ ID NO: 43878 - protein, 9 aa, Homo Sapiens
RQFPTAFEF

SEQ ID NO: 43879 - protein, 9 aa, Homo Sapiens
RQFPVTVHF

SEQ ID NO: 43880 - protein, 9 aa, Homo Sapiens
RQFQEHFQF

SEQ ID NO: 43881 - protein, 9 aa, Homo Sapiens
RQFVKRIGY

SEQ ID NO: 43882 - protein, 9 aa, Homo Sapiens
RQITQVYGF

SEQ ID NO: 43883 - protein, 9 aa, Homo Sapiens
RQKLVRNIY

SEQ ID NO: 43884 - protein, 9 aa, Homo Sapiens
RQLAKIHAI

SEQ ID NO: 43885 - protein, 9 aa, Homo Sapiens
RQLEKLFSF

SEQ ID NO: 43886 - protein, 9 aa, Homo Sapiens
RQLLYITAF

SEQ ID NO: 43887 - protein, 9 aa, Homo Sapiens
RQMAMQIAW

SEQ ID NO: 43888 - protein, 9 aa, Homo Sapiens
RQNPTMFAW

SEQ ID NO: 43889 - protein, 9 aa, Homo Sapiens
RQPSVIYSW

SEQ ID NO: 43890 - protein, 9 aa, Homo Sapiens
RQQKEVLSW

SEQ ID NO: 43891 - protein, 9 aa, Homo Sapiens
RQSTCHEAW

SEQ ID NO: 43892 - protein, 9 aa, Homo Sapiens
RQSTILKRW

SEQ ID NO: 43893 - protein, 9 aa, Homo Sapiens
RQWDYTEKL

SEQ ID NO: 43894 - protein, 9 aa, Homo Sapiens
RQWLLQTHW

SEQ ID NO: 43895 - protein, 9 aa, Homo Sapiens
RSAPRAFAW

SEQ ID NO: 43896 - protein, 9 aa, Homo Sapiens
RSEKWNHTL

SEQ ID NO: 43897 - protein, 9 aa, Homo Sapiens
RSFPGFQAF

SEQ ID NO: 43898 - protein, 9 aa, Homo Sapiens
RSFQNVHEW

SEQ ID NO: 43899 - protein, 9 aa, Homo Sapiens
RSHGFRTEY

SEQ ID NO: 43900 - protein, 9 aa, Homo Sapiens
RSILWLNQF

SEQ ID NO: 43901 - protein, 9 aa, Homo Sapiens
RSKAIRYTW

SEQ ID NO: 43902 - protein, 9 aa, Homo Sapiens
RSKEESAHW

SEQ ID NO: 43903 - protein, 9 aa, Homo Sapiens
RSLAYIHSF

SEQ ID NO: 43904 - protein, 9 aa, Homo Sapiens
RSLDTRQVY

SEQ ID NO: 43905 - protein, 9 aa, Homo Sapiens
RSLFKFYTY

SEQ ID NO: 43906 - protein, 9 aa, Homo Sapiens
RSLGVHLSF

SEQ ID NO: 43907 - protein, 9 aa, Homo Sapiens
RSLHFFVEW

SEQ ID NO: 43908 - protein, 9 aa, Homo Sapiens
RSLQTICSW

SEQ ID NO: 43909 - protein, 9 aa, Homo Sapiens
RSQLISQAW

SEQ ID NO: 43910 - protein, 9 aa, Homo Sapiens
RSWAYRDSL

SEQ ID NO: 43911 - protein, 9 aa, Homo Sapiens
RSWRHLVCY

SEQ ID NO: 43912 - protein, 9 aa, Homo Sapiens
RTAAVSCLW

SEQ ID NO: 43913 - protein, 9 aa, Homo Sapiens
RTADFVFMF

SEQ ID NO: 43914 - protein, 9 aa, Homo Sapiens
RTAHTFESW

SEQ ID NO: 43915 - protein, 9 aa, Homo Sapiens
RTAHVILRY

SEQ ID NO: 43916 - protein, 9 aa, Homo Sapiens
RTALHVSCW

SEQ ID NO: 43917 - protein, 9 aa, Homo Sapiens
RTAMGLRSW

SEQ ID NO: 43918 - protein, 9 aa, Homo Sapiens
RTASGTRPW

SEQ ID NO: 43919 - protein, 9 aa, Homo Sapiens
RTATRVASY

SEQ ID NO: 43920 - protein, 9 aa, Homo Sapiens
RTAVYNWAL

SEQ ID NO: 43921 - protein, 9 aa, Homo Sapiens
RTCDYKHHW

SEQ ID NO: 43922 - protein, 9 aa, Homo Sapiens
RTEGIRAAY

SEQ ID NO: 43923 - protein, 9 aa, Homo Sapiens
RTFAPLPEF

SEQ ID NO: 43924 - protein, 9 aa, Homo Sapiens
RTFKVEHEF

SEQ ID NO: 43925 - protein, 9 aa, Homo Sapiens
RTFLHTVCF

SEQ ID NO: 43926 - protein, 9 aa, Homo Sapiens
RTFLKENCF

SEQ ID NO: 43927 - protein, 9 aa, Homo Sapiens
RTFLKRTKY

SEQ ID NO: 43928 - protein, 9 aa, Homo Sapiens
RTFLLTYVL

SEQ ID NO: 43929 - protein, 9 aa, Homo Sapiens
RTFNNIMNF

SEQ ID NO: 43930 - protein, 9 aa, Homo Sapiens
RTFPDPTSW

SEQ ID NO: 43931 - protein, 9 aa, Homo Sapiens
RTFPWIIEV

SEQ ID NO: 43932 - protein, 9 aa, Homo Sapiens
RTFQYQDSL

SEQ ID NO: 43933 - protein, 9 aa, Homo Sapiens
RTFSESSVW

SEQ ID NO: 43934 - protein, 9 aa, Homo Sapiens
RTFTWDKKL

SEQ ID NO: 43935 - protein, 9 aa, Homo Sapiens
RTFVPIPVW

SEQ ID NO: 43936 - protein, 9 aa, Homo Sapiens
RTFVWPAHF

SEQ ID NO: 43937 - protein, 9 aa, Homo Sapiens
RTFWHKISY

SEQ ID NO: 43938 - protein, 9 aa, Homo Sapiens
RTHPVATSF

SEQ ID NO: 43939 - protein, 9 aa, Homo Sapiens
RTHSLAVSL

SEQ ID NO: 43940 - protein, 9 aa, Homo Sapiens
RTKEEVNEW

SEQ ID NO: 43941 - protein, 9 aa, Homo Sapiens
RTKQVLHTF

SEQ ID NO: 43942 - protein, 9 aa, Homo Sapiens
RTKSGFWGW

SEQ ID NO: 43943 - protein, 9 aa, Homo Sapiens
RTLDCIHVL

SEQ ID NO: 43944 - protein, 9 aa, Homo Sapiens
RTLDSVSQI

SEQ ID NO: 43945 - protein, 9 aa, Homo Sapiens
RTLGEIPTY

SEQ ID NO: 43946 - protein, 9 aa, Homo Sapiens
RTLGLRETW

SEQ ID NO: 43947 - protein, 9 aa, Homo Sapiens
RTLLWTELF

SEQ ID NO: 43948 - protein, 9 aa, Homo Sapiens
RTLPKLYSL

SEQ ID NO: 43949 - protein, 9 aa, Homo Sapiens
RTLPVDFHI

SEQ ID NO: 43950 - protein, 9 aa, Homo Sapiens
RTLPWASVL

SEQ ID NO: 43951 - protein, 9 aa, Homo Sapiens
RTLPWSSVL

SEQ ID NO: 43952 - protein, 9 aa, Homo Sapiens
RTLRDIETF

SEQ ID NO: 43953 - protein, 9 aa, Homo Sapiens
RTLSWKHTL

SEQ ID NO: 43954 - protein, 9 aa, Homo Sapiens
RTMEIESTF

SEQ ID NO: 43955 - protein, 9 aa, Homo Sapiens
RTMESTKEF

SEQ ID NO: 43956 - protein, 9 aa, Homo Sapiens
RTMEWVQTI

SEQ ID NO: 43957 - protein, 9 aa, Homo Sapiens
RTMPRIPTL

SEQ ID NO: 43958 - protein, 9 aa, Homo Sapiens
RTMQVALGL

SEQ ID NO: 43959 - protein, 9 aa, Homo Sapiens
RTNAIKQTF

SEQ ID NO: 43960 - protein, 9 aa, Homo Sapiens
RTNLYRKEY

SEQ ID NO: 43961 - protein, 9 aa, Homo Sapiens
RTNRPPLSL

SEQ ID NO: 43962 - protein, 9 aa, Homo Sapiens
RTNTAYQCF

SEQ ID NO: 43963 - protein, 9 aa, Homo Sapiens
RTQLWALTF

SEQ ID NO: 43964 - protein, 9 aa, Homo Sapiens
RTQSHISQW

SEQ ID NO: 43965 - protein, 9 aa, Homo Sapiens
RTQVITQTL

SEQ ID NO: 43966 - protein, 9 aa, Homo Sapiens
RTQVVTNCW

SEQ ID NO: 43967 - protein, 9 aa, Homo Sapiens
RTSSISFEI

SEQ ID NO: 43968 - protein, 9 aa, Homo Sapiens
RTTDIVIRI

SEQ ID NO: 43969 - protein, 9 aa, Homo Sapiens
RTTEILHHL

SEQ ID NO: 43970 - protein, 9 aa, Homo Sapiens
RTTPIAMSF

SEQ ID NO: 43971 - protein, 9 aa, Homo Sapiens
RTVAALASW

SEQ ID NO: 43972 - protein, 9 aa, Homo Sapiens
RTVEKTWKL

SEQ ID NO: 43973 - protein, 9 aa, Homo Sapiens
RTVIIEQSW

SEQ ID NO: 43974 - protein, 9 aa, Homo Sapiens
RTVLWRAGF

SEQ ID NO: 43975 - protein, 9 aa, Homo Sapiens
RTVYFSEQW

SEQ ID NO: 43976 - protein, 9 aa, Homo Sapiens
RTWLLKTHW

SEQ ID NO: 43977 - protein, 9 aa, Homo Sapiens
RTYEHEAMW

SEQ ID NO: 43978 - protein, 9 aa, Homo Sapiens
RTYFVANEW

SEQ ID NO: 43979 - protein, 9 aa, Homo Sapiens
RTYGGRGGW

SEQ ID NO: 43980 - protein, 9 aa, Homo Sapiens
RTYHYHCAL

SEQ ID NO: 43981 - protein, 9 aa, Homo Sapiens
RTYLWRCQF

SEQ ID NO: 43982 - protein, 9 aa, Homo Sapiens
RTYNNIFQF

SEQ ID NO: 43983 - protein, 9 aa, Homo Sapiens
RTYSSHVSW

SEQ ID NO: 43984 - protein, 9 aa, Homo Sapiens
RVAAVLLQF

SEQ ID NO: 43985 - protein, 9 aa, Homo Sapiens
RVAEFHTEL

SEQ ID NO: 43986 - protein, 9 aa, Homo Sapiens
RVAHFGYHW

SEQ ID NO: 43987 - protein, 9 aa, Homo Sapiens
RVAKNQYGW

SEQ ID NO: 43988 - protein, 9 aa, Homo Sapiens
RVAMYVHAY

SEQ ID NO: 43989 - protein, 9 aa, Homo Sapiens
RVAPYRILY

SEQ ID NO: 43990 - protein, 9 aa, Homo Sapiens
RVAQMKRTW

SEQ ID NO: 43991 - protein, 9 aa, Homo Sapiens
RVASVMQEY

SEQ ID NO: 43992 - protein, 9 aa, Homo Sapiens
RVATVTLML

SEQ ID NO: 43993 - protein, 9 aa, Homo Sapiens
RVAVILNEF

SEQ ID NO: 43994 - protein, 9 aa, Homo Sapiens
RVAVMGHSF

SEQ ID NO: 43995 - protein, 9 aa, Homo Sapiens
RVCGKAFRW

SEQ ID NO: 43996 - protein, 9 aa, Homo Sapiens
RVCKTWYKW

SEQ ID NO: 43997 - protein, 9 aa, Homo Sapiens
RVFDLPLTW

SEQ ID NO: 43998 - protein, 9 aa, Homo Sapiens
RVFENIVAV

SEQ ID NO: 43999 - protein, 9 aa, Homo Sapiens
RVFFVHEGY

SEQ ID NO: 44000 - protein, 9 aa, Homo Sapiens
RVFKNVAVI

SEQ ID NO: 44001 - protein, 9 aa, Homo Sapiens
RVFPHEVNW

SEQ ID NO: 44002 - protein, 9 aa, Homo Sapiens
RVFPSPMRI

SEQ ID NO: 44003 - protein, 9 aa, Homo Sapiens
RVFPWASSL

SEQ ID NO: 44004 - protein, 9 aa, Homo Sapiens
RVFRHLENY

SEQ ID NO: 44005 - protein, 9 aa, Homo Sapiens
RVFSLSSEF

SEQ ID NO: 44006 - protein, 9 aa, Homo Sapiens
RVFVHVYIH

SEQ ID NO: 44007 - protein, 9 aa, Homo Sapiens
RVFVHYTGW

SEQ ID NO: 44008 - protein, 9 aa, Homo Sapiens
RVHAFLEQW

SEQ ID NO: 44009 - protein, 9 aa, Homo Sapiens
RVHPETYEW

SEQ ID NO: 44010 - protein, 9 aa, Homo Sapiens
RVIDVGSEW

SEQ ID NO: 44011 - protein, 9 aa, Homo Sapiens
RVIEFAAKF

SEQ ID NO: 44012 - protein, 9 aa, Homo Sapiens
RVIKWLYGL

SEQ ID NO: 44013 - protein, 9 aa, Homo Sapiens
RVKEIYNTY

SEQ ID NO: 44014 - protein, 9 aa, Homo Sapiens
RVKVHFDGW

SEQ ID NO: 44015 - protein, 9 aa, Homo Sapiens
RVLKIPASW

SEQ ID NO: 44016 - protein, 9 aa, Homo Sapiens
RVLKVRPVY

SEQ ID NO: 44017 - protein, 9 aa, Homo Sapiens
RVLNVCRHW

SEQ ID NO: 44018 - protein, 9 aa, Homo Sapiens
RVLRFQVSF

SEQ ID NO: 44019 - protein, 9 aa, Homo Sapiens
RVMEYINRL

SEQ ID NO: 44020 - protein, 9 aa, Homo Sapiens
RVMSRVHSL

SEQ ID NO: 44021 - protein, 9 aa, Homo Sapiens
RVNEYRFAW

SEQ ID NO: 44022 - protein, 9 aa, Homo Sapiens
RVNLARAVY

SEQ ID NO: 44023 - protein, 9 aa, Homo Sapiens
RVNSFQVAF

SEQ ID NO: 44024 - protein, 9 aa, Homo Sapiens
RVQEAIIHF

SEQ ID NO: 44025 - protein, 9 aa, Homo Sapiens
RVQGYFASF

SEQ ID NO: 44026 - protein, 9 aa, Homo Sapiens
RVQKEVAGF

SEQ ID NO: 44027 - protein, 9 aa, Homo Sapiens
RVRELYRAW

SEQ ID NO: 44028 - protein, 9 aa, Homo Sapiens
RVRGDGRPW

SEQ ID NO: 44029 - protein, 9 aa, Homo Sapiens
RVRVKVETY

SEQ ID NO: 44030 - protein, 9 aa, Homo Sapiens
RVSDHRIAY

SEQ ID NO: 44031 - protein, 9 aa, Homo Sapiens
RVSDINFTL

SEQ ID NO: 44032 - protein, 9 aa, Homo Sapiens
RVSDYKHHW

SEQ ID NO: 44033 - protein, 9 aa, Homo Sapiens
RVSEIRDAF

SEQ ID NO: 44034 - protein, 9 aa, Homo Sapiens
RVSLARAVY

SEQ ID NO: 44035 - protein, 9 aa, Homo Sapiens
RVSNIRQVF

SEQ ID NO: 44036 - protein, 9 aa, Homo Sapiens
RVSNVKSVY

SEQ ID NO: 44037 - protein, 9 aa, Homo Sapiens
RVWDIRNTY

SEQ ID NO: 44038 - protein, 9 aa, Homo Sapiens
RVWDIVRHY

SEQ ID NO: 44039 - protein, 9 aa, Homo Sapiens
RVWNLNHLW

SEQ ID NO: 44040 - protein, 9 aa, Homo Sapiens
RVWQWDEKW

SEQ ID NO: 44041 - protein, 9 aa, Homo Sapiens
RVYIGRLSY

SEQ ID NO: 44042 - protein, 9 aa, Homo Sapiens
RVYKKMPSI

SEQ ID NO: 44043 - protein, 9 aa, Homo Sapiens
RVYKSLKVW

SEQ ID NO: 44044 - protein, 9 aa, Homo Sapiens
RVYNEVPTF

SEQ ID NO: 44045 - protein, 9 aa, Homo Sapiens
SAKVHSVAW

SEQ ID NO: 44046 - protein, 9 aa, Homo Sapiens
SAPSSSTPF

SEQ ID NO: 44047 - protein, 9 aa, Homo Sapiens
SIFTGIKEF

SEQ ID NO: 44048 - protein, 9 aa, Homo Sapiens
SINPNNHSW

SEQ ID NO: 44049 - protein, 9 aa, Homo Sapiens
SLFDNPRTF

SEQ ID NO: 44050 - protein, 9 aa, Homo Sapiens
SLFSLREKW

SEQ ID NO: 44051 - protein, 9 aa, Homo Sapiens
SLHGQRCLY

SEQ ID NO: 44052 - protein, 9 aa, Homo Sapiens
SLHSHQYSW

SEQ ID NO: 44053 - protein, 9 aa, Homo Sapiens
SLLGYRAVY

SEQ ID NO: 44054 - protein, 9 aa, Homo Sapiens
SLNCKSFKW

SEQ ID NO: 44055 - protein, 9 aa, Homo Sapiens
SLQKKLETW

SEQ ID NO: 44056 - protein, 9 aa, Homo Sapiens
SLRDITSSW

SEQ ID NO: 44057 - protein, 9 aa, Homo Sapiens
SLREHFEKW

SEQ ID NO: 44058 - protein, 9 aa, Homo Sapiens
SLRNRAEEW

SEQ ID NO: 44059 - protein, 9 aa, Homo Sapiens
SLRNYYEQW

SEQ ID NO: 44060 - protein, 9 aa, Homo Sapiens
SLRSHFEQW

SEQ ID NO: 44061 - protein, 9 aa, Homo Sapiens
SLYGGFVEW

SEQ ID NO: 44062 - protein, 9 aa, Homo Sapiens
SLYSIRKQY

SEQ ID NO: 44063 - protein, 9 aa, Homo Sapiens
SMADIPLGF

SEQ ID NO: 44064 - protein, 9 aa, Homo Sapiens
SMADVKFSF

SEQ ID NO: 44065 - protein, 9 aa, Homo Sapiens
SMFHNRHLF

SEQ ID NO: 44066 - protein, 9 aa, Homo Sapiens
SMFNGQLLF

SEQ ID NO: 44067 - protein, 9 aa, Homo Sapiens
SMSGNIYSW

SEQ ID NO: 44068 - protein, 9 aa, Homo Sapiens
SQCGKAFIW

SEQ ID NO: 44069 - protein, 9 aa, Homo Sapiens
SQCGKTFTW

SEQ ID NO: 44070 - protein, 9 aa, Homo Sapiens
SQFGHCFSW

SEQ ID NO: 44071 - protein, 9 aa, Homo Sapiens
SQFSIRYQY

SEQ ID NO: 44072 - protein, 9 aa, Homo Sapiens
SQNFITWAW

SEQ ID NO: 44073 - protein, 9 aa, Homo Sapiens
SQNPRVAAW

SEQ ID NO: 44074 - protein, 9 aa, Homo Sapiens
SQVEWKYIW

SEQ ID NO: 44075 - protein, 9 aa, Homo Sapiens
SSPAPRTAL

SEQ ID NO: 44076 - protein, 9 aa, Homo Sapiens
SSSRIRAAW

SEQ ID NO: 44077 - protein, 9 aa, Homo Sapiens
STAPGYYSW

SEQ ID NO: 44078 - protein, 9 aa, Homo Sapiens
STFPGFVSW

SEQ ID NO: 44079 - protein, 9 aa, Homo Sapiens
STGQIRFTY

SEQ ID NO: 44080 - protein, 9 aa, Homo Sapiens
STLRWMQNF

SEQ ID NO: 44081 - protein, 9 aa, Homo Sapiens
STNPNSHGF

SEQ ID NO: 44082 - protein, 9 aa, Homo Sapiens
STQIKTYSW

SEQ ID NO: 44083 - protein, 9 aa, Homo Sapiens
STRPQVSSW

SEQ ID NO: 44084 - protein, 9 aa, Homo Sapiens
STSQVRQNY

SEQ ID NO: 44085 - protein, 9 aa, Homo Sapiens
STWHVARTF

SEQ ID NO: 44086 - protein, 9 aa, Homo Sapiens
STYIKKIGY

SEQ ID NO: 44087 - protein, 9 aa, Homo Sapiens
STYNHLSSW

SEQ ID NO: 44088 - protein, 9 aa, Homo Sapiens
SVAALRFEW

SEQ ID NO: 44089 - protein, 9 aa, Homo Sapiens
SVADIRNAY

SEQ ID NO: 44090 - protein, 9 aa, Homo Sapiens
SVFVKNVGW

SEQ ID NO: 44091 - protein, 9 aa, Homo Sapiens
SVIRTMWAW

SEQ ID NO: 44092 - protein, 9 aa, Homo Sapiens
SVKRNQAVW

SEQ ID NO: 44093 - protein, 9 aa, Homo Sapiens
SVKTTTHSW

SEQ ID NO: 44094 - protein, 9 aa, Homo Sapiens
SVLKTRFSY

SEQ ID NO: 44095 - protein, 9 aa, Homo Sapiens
SVMRCIAVF

SEQ ID NO: 44096 - protein, 9 aa, Homo Sapiens
SVQGFSTVW

SEQ ID NO: 44097 - protein, 9 aa, Homo Sapiens
SVRANTENW

SEQ ID NO: 44098 - protein, 9 aa, Homo Sapiens
SVSSHFVGF

SEQ ID NO: 44099 - protein, 9 aa, Homo Sapiens
SVWFPTAGW

SEQ ID NO: 44100 - protein, 9 aa, Homo Sapiens
TLALSRCSL

SEQ ID NO: 44101 - protein, 9 aa, Homo Sapiens
TLFTHQSSW

SEQ ID NO: 44102 - protein, 9 aa, Homo Sapiens
TLKPSPQAW

SEQ ID NO: 44103 - protein, 9 aa, Homo Sapiens
TLSSIRSKY

SEQ ID NO: 44104 - protein, 9 aa, Homo Sapiens
TLVREYFSW

SEQ ID NO: 44105 - protein, 9 aa, Homo Sapiens
TLWKHQFAW

SEQ ID NO: 44106 - protein, 9 aa, Homo Sapiens
TMNIKSATW

SEQ ID NO: 44107 - protein, 9 aa, Homo Sapiens
TMRKNIDVW

SEQ ID NO: 44108 - protein, 9 aa, Homo Sapiens
TMRRHEETW

SEQ ID NO: 44109 - protein, 9 aa, Homo Sapiens
TQFTGRYHY

SEQ ID NO: 44110 - protein, 9 aa, Homo Sapiens
TSFQWVTKW

SEQ ID NO: 44111 - protein, 9 aa, Homo Sapiens
TSFRWVESL

SEQ ID NO: 44112 - protein, 9 aa, Homo Sapiens
TTNPCRIQY

SEQ ID NO: 44113 - protein, 9 aa, Homo Sapiens
TTVQWENSF

SEQ ID NO: 44114 - protein, 9 aa, Homo Sapiens
TVGPKTFSW

SEQ ID NO: 44115 - protein, 9 aa, Homo Sapiens
TVIEKTESW

SEQ ID NO: 44116 - protein, 9 aa, Homo Sapiens
TVLTTHHHW

SEQ ID NO: 44117 - protein, 9 aa, Homo Sapiens
TVNDVRNTY

SEQ ID NO: 44118 - protein, 9 aa, Homo Sapiens
TVQTVRYKY

SEQ ID NO: 44119 - protein, 9 aa, Homo Sapiens
TVSRAREVY

SEQ ID NO: 44120 - protein, 9 aa, Homo Sapiens
TVYDKPASF

SEQ ID NO: 44121 - protein, 9 aa, Homo Sapiens
TVYPKPEEW

SEQ ID NO: 44122 - protein, 9 aa, Homo Sapiens
VAWEYKWEL

SEQ ID NO: 44123 - protein, 9 aa, Homo Sapiens
VIFQKVKEW

SEQ ID NO: 44124 - protein, 9 aa, Homo Sapiens
VIQRKRELW

SEQ ID NO: 44125 - protein, 9 aa, Homo Sapiens
VIWPNPIVW

SEQ ID NO: 44126 - protein, 9 aa, Homo Sapiens
VIWPNPVIW

SEQ ID NO: 44127 - protein, 9 aa, Homo Sapiens
VIYKWLCVW

SEQ ID NO: 44128 - protein, 9 aa, Homo Sapiens
VLFPWQARL

SEQ ID NO: 44129 - protein, 9 aa, Homo Sapiens
VLHTLRQRY

SEQ ID NO: 44130 - protein, 9 aa, Homo Sapiens
VLLKKTFSW

SEQ ID NO: 44131 - protein, 9 aa, Homo Sapiens
VLMPWIHEL

SEQ ID NO: 44132 - protein, 9 aa, Homo Sapiens
VLMSAQESW

SEQ ID NO: 44133 - protein, 9 aa, Homo Sapiens
VLNAYRQLY

SEQ ID NO: 44134 - protein, 9 aa, Homo Sapiens
VLNNSKASW

SEQ ID NO: 44135 - protein, 9 aa, Homo Sapiens
VLNNVAHTF

SEQ ID NO: 44136 - protein, 9 aa, Homo Sapiens
VLNPETRTW

SEQ ID NO: 44137 - protein, 9 aa, Homo Sapiens
VLRDEIIAW

SEQ ID NO: 44138 - protein, 9 aa, Homo Sapiens
VLSSFRTTW

SEQ ID NO: 44139 - protein, 9 aa, Homo Sapiens
VLWDRTFSL

SEQ ID NO: 44140 - protein, 9 aa, Homo Sapiens
VLYKWTNYL

SEQ ID NO: 44141 - protein, 9 aa, Homo Sapiens
VMFKKIKSF

SEQ ID NO: 44142 - protein, 9 aa, Homo Sapiens
VMHDLRKMY

SEQ ID NO: 44143 - protein, 9 aa, Homo Sapiens
VMNPKPSSW

SEQ ID NO: 44144 - protein, 9 aa, Homo Sapiens
VMRSARELY

SEQ ID NO: 44145 - protein, 9 aa, Homo Sapiens
VQFPSHYTL

SEQ ID NO: 44146 - protein, 9 aa, Homo Sapiens
VQKKTFTKW

SEQ ID NO: 44147 - protein, 9 aa, Homo Sapiens
VTFLLPAGW

SEQ ID NO: 44148 - protein, 9 aa, Homo Sapiens
VTHSVRIGF

SEQ ID NO: 44149 - protein, 9 aa, Homo Sapiens
VTKKTYEIW

SEQ ID NO: 44150 - protein, 9 aa, Homo Sapiens
VTNKSVSVW

SEQ ID NO: 44151 - protein, 9 aa, Homo Sapiens
VTNPHSSQW

SEQ ID NO: 44152 - protein, 9 aa, Homo Sapiens
VTNPHTDAW

SEQ ID NO: 44153 - protein, 9 aa, Homo Sapiens
VTQNFKFVW

SEQ ID NO: 44154 - protein, 9 aa, Homo Sapiens
VTSPIRASY

SEQ ID NO: 44155 - protein, 9 aa, Homo Sapiens
VTWTGRFKY

SEQ ID NO: 44156 - protein, 9 aa, Homo Sapiens
VTYKNVPNW

SEQ ID NO: 44157 - protein, 9 aa, Homo Sapiens
VTYSFRQSF

SEQ ID NO: 44158 - protein, 9 aa, Homo Sapiens
VVAALRASY

SEQ ID NO: 44159 - protein, 9 aa, Homo Sapiens
VVAKSRFWY

SEQ ID NO: 44160 - protein, 9 aa, Homo Sapiens
VVAVGRALY

SEQ ID NO: 44161 - protein, 9 aa, Homo Sapiens
VVHKWHYKL

SEQ ID NO: 44162 - protein, 9 aa, Homo Sapiens
VVKNSVHSW

SEQ ID NO: 44163 - protein, 9 aa, Homo Sapiens
VVNIARYLY

SEQ ID NO: 44164 - protein, 9 aa, Homo Sapiens
VVRKPSSSW

SEQ ID NO: 44165 - protein, 9 aa, Homo Sapiens
VVRLHINSW

SEQ ID NO: 44166 - protein, 9 aa, Homo Sapiens
VVSSIHSSW

SEQ ID NO: 44167 - protein, 9 aa, Homo Sapiens
VVWPNPLAW

SEQ ID NO: 44168 - protein, 9 aa, Homo Sapiens
VVYPWTQRF

SEQ ID NO: 44169 - protein, 9 aa, Homo Sapiens
YLFPNRLEW

SEQ ID NO: 44170 - protein, 9 aa, Homo Sapiens
YLMHWPYAF

SEQ ID NO: 44171 - protein, 9 aa, Homo Sapiens
YLNRHLHTW

SEQ ID NO: 44172 - protein, 10 aa, Homo Sapiens
AHQKYVRQAW

SEQ ID NO: 44173 - protein, 10 aa, Homo Sapiens
ALAAIRHARW

SEQ ID NO: 44174 - protein, 10 aa, Homo Sapiens
ALAALRHAKW

SEQ ID NO: 44175 - protein, 10 aa, Homo Sapiens
ALAKIERFEF

SEQ ID NO: 44176 - protein, 10 aa, Homo Sapiens
ALNEQRLVSW

SEQ ID NO: 44177 - protein, 10 aa, Homo Sapiens
AMFNDYNFVF

SEQ ID NO: 44178 - protein, 10 aa, Homo Sapiens
ASYQDRRQSW

SEQ ID NO: 44179 - protein, 10 aa, Homo Sapiens
ATAGIIGWVY

SEQ ID NO: 44180 - protein, 10 aa, Homo Sapiens
ATAGLQRMGW

SEQ ID NO: 44181 - protein, 10 aa, Homo Sapiens
ATAPDVRISW

SEQ ID NO: 44182 - protein, 10 aa, Homo Sapiens
ATASGIVFQW

SEQ ID NO: 44183 - protein, 10 aa, Homo Sapiens
ATQQNWDYRW

SEQ ID NO: 44184 - protein, 10 aa, Homo Sapiens
ATRGAALLSW

SEQ ID NO: 44185 - protein, 10 aa, Homo Sapiens
ATRGFIRYGW

SEQ ID NO: 44186 - protein, 10 aa, Homo Sapiens
AVFNRAFYSW

SEQ ID NO: 44187 - protein, 10 aa, Homo Sapiens
AVNPRDPPSW

SEQ ID NO: 44188 - protein, 10 aa, Homo Sapiens
AVWDRMKVAW

SEQ ID NO: 44189 - protein, 10 aa, Homo Sapiens
GDFLTEGGGV

SEQ ID NO: 44190 - protein, 10 aa, Homo Sapiens
GTWLPSRAEW

SEQ ID NO: 44191 - protein, 10 aa, Homo Sapiens
HILPFTMPAF

SEQ ID NO: 44192 - protein, 10 aa, Homo Sapiens
HLAKIYAMHW

SEQ ID NO: 44193 - protein, 10 aa, Homo Sapiens
HLLSGQLPTI

SEQ ID NO: 44194 - protein, 10 aa, Homo Sapiens
HMKPLPYYSY

SEQ ID NO: 44195 - protein, 10 aa, Homo Sapiens
HQKEGYGLSW

SEQ ID NO: 44196 - protein, 10 aa, Homo Sapiens
HQVDYILETW

SEQ ID NO: 44197 - protein, 10 aa, Homo Sapiens
HTADVQLHAW

SEQ ID NO: 44198 - protein, 10 aa, Homo Sapiens
HTAEVNCLSF

SEQ ID NO: 44199 - protein, 10 aa, Homo Sapiens
HTAKISDFSW

SEQ ID NO: 44200 - protein, 10 aa, Homo Sapiens
HTKRVGIVAW

SEQ ID NO: 44201 - protein, 10 aa, Homo Sapiens
ILFDKEFCEW

SEQ ID NO: 44202 - protein, 10 aa, Homo Sapiens
ILQEKNRYSW

SEQ ID NO: 44203 - protein, 10 aa, Homo Sapiens
ILYPHEAPSW

SEQ ID NO: 44204 - protein, 10 aa, Homo Sapiens
ILYPKPKACW

SEQ ID NO: 44205 - protein, 10 aa, Homo Sapiens
IVSILNYVIY

SEQ ID NO: 44206 - protein, 10 aa, Homo Sapiens
KAFEEERASW

SEQ ID NO: 44207 - protein, 10 aa, Homo Sapiens
KAWAEYVVEW

SEQ ID NO: 44208 - protein, 10 aa, Homo Sapiens
KFIDPIYQVW

SEQ ID NO: 44209 - protein, 10 aa, Homo Sapiens
KIADLGNACW

SEQ ID NO: 44210 - protein, 10 aa, Homo Sapiens
KIADTSNMLL

SEQ ID NO: 44211 - protein, 10 aa, Homo Sapiens
KIFEGMPVTF

SEQ ID NO: 44212 - protein, 10 aa, Homo Sapiens
KIFFPGVSEF

SEQ ID NO: 44213 - protein, 10 aa, Homo Sapiens
KIFLETRKSW

SEQ ID NO: 44214 - protein, 10 aa, Homo Sapiens
KIFQGNVHNF

SEQ ID NO: 44215 - protein, 10 aa, Homo Sapiens
KIIAPPERKY

SEQ ID NO: 44216 - protein, 10 aa, Homo Sapiens
KIQKDKPETW

SEQ ID NO: 44217 - protein, 10 aa, Homo Sapiens
KISGIKDFSW

SEQ ID NO: 44218 - protein, 10 aa, Homo Sapiens
KIYVVGGYSW

SEQ ID NO: 44219 - protein, 10 aa, Homo Sapiens
KLADKVNSSW

SEQ ID NO: 44220 - protein, 10 aa, Homo Sapiens
KLAELHGNMF

SEQ ID NO: 44221 - protein, 10 aa, Homo Sapiens
KLATTILQHW

SEQ ID NO: 44222 - protein, 10 aa, Homo Sapiens
KLFDKHKTKF

SEQ ID NO: 44223 - protein, 10 aa, Homo Sapiens
KLFEDKELQW

SEQ ID NO: 44224 - protein, 10 aa, Homo Sapiens
KLFGEKSASF

SEQ ID NO: 44225 - protein, 10 aa, Homo Sapiens
KLFGQPPCAF

SEQ ID NO: 44226 - protein, 10 aa, Homo Sapiens
KLFKPPVLVF

SEQ ID NO: 44227 - protein, 10 aa, Homo Sapiens
KLFNGCPLRI

SEQ ID NO: 44228 - protein, 10 aa, Homo Sapiens
KLFPGSPAIY

SEQ ID NO: 44229 - protein, 10 aa, Homo Sapiens
KLFPKHFVEY

SEQ ID NO: 44230 - protein, 10 aa, Homo Sapiens
KLFSGKGLHF

SEQ ID NO: 44231 - protein, 10 aa, Homo Sapiens
KLFSQNTVHW

SEQ ID NO: 44232 - protein, 10 aa, Homo Sapiens
KLHNKKLAAF

SEQ ID NO: 44233 - protein, 10 aa, Homo Sapiens
KLISDINKAW

SEQ ID NO: 44234 - protein, 10 aa, Homo Sapiens
KLKKPEAVRW

SEQ ID NO: 44235 - protein, 10 aa, Homo Sapiens
KLKPGTMIEW

SEQ ID NO: 44236 - protein, 10 aa, Homo Sapiens
KLKSVGICTI

SEQ ID NO: 44237 - protein, 10 aa, Homo Sapiens
KLLANMVYQY

SEQ ID NO: 44238 - protein, 10 aa, Homo Sapiens
KLLDKMTTSF

SEQ ID NO: 44239 - protein, 10 aa, Homo Sapiens
KLLEDRIAEF

SEQ ID NO: 44240 - protein, 10 aa, Homo Sapiens
KLLFSFCLTI

SEQ ID NO: 44241 - protein, 10 aa, Homo Sapiens
KLLKCSRLVL

SEQ ID NO: 44242 - protein, 10 aa, Homo Sapiens
KLLSPVVPQI

SEQ ID NO: 44243 - protein, 10 aa, Homo Sapiens
KLMDVGLIAI

SEQ ID NO: 44244 - protein, 10 aa, Homo Sapiens
KLMKRLNTEW

SEQ ID NO: 44245 - protein, 10 aa, Homo Sapiens
KLMPGRIQLW

SEQ ID NO: 44246 - protein, 10 aa, Homo Sapiens
KLMPNFSDSF

SEQ ID NO: 44247 - protein, 10 aa, Homo Sapiens
KLMSPKLYVW

SEQ ID NO: 44248 - protein, 10 aa, Homo Sapiens
KLNPAANHRL

SEQ ID NO: 44249 - protein, 10 aa, Homo Sapiens
KLNPRYLGAW

SEQ ID NO: 44250 - protein, 10 aa, Homo Sapiens
KLPDDYRCSY

SEQ ID NO: 44251 - protein, 10 aa, Homo Sapiens
KLPNFGFVVF

SEQ ID NO: 44252 - protein, 10 aa, Homo Sapiens
KLQEALRRKY

SEQ ID NO: 44253 - protein, 10 aa, Homo Sapiens
KLQHPLGVTW

SEQ ID NO: 44254 - protein, 10 aa, Homo Sapiens
KLTDSVLRSF

SEQ ID NO: 44255 - protein, 10 aa, Homo Sapiens
KLVDGLATSW

SEQ ID NO: 44256 - protein, 10 aa, Homo Sapiens
KLWKGARSVY

SEQ ID NO: 44257 - protein, 10 aa, Homo Sapiens
KLWNEVTTSF

SEQ ID NO: 44258 - protein, 10 aa, Homo Sapiens
KLYEGVPLPF

SEQ ID NO: 44259 - protein, 10 aa, Homo Sapiens
KLYELHVFTF

SEQ ID NO: 44260 - protein, 10 aa, Homo Sapiens
KLYGADGLVF

SEQ ID NO: 44261 - protein, 10 aa, Homo Sapiens
KLYTGPGLAI

SEQ ID NO: 44262 - protein, 10 aa, Homo Sapiens
KMAGKNLVAV

SEQ ID NO: 44263 - protein, 10 aa, Homo Sapiens
KMAIKLRNEY

SEQ ID NO: 44264 - protein, 10 aa, Homo Sapiens
KMAPALRKVY

SEQ ID NO: 44265 - protein, 10 aa, Homo Sapiens
KMAPPDLPHW

SEQ ID NO: 44266 - protein, 10 aa, Homo Sapiens
KMATNTVYVF

SEQ ID NO: 44267 - protein, 10 aa, Homo Sapiens
KMAVLLGKVY

SEQ ID NO: 44268 - protein, 10 aa, Homo Sapiens
KMLEKARMSW

SEQ ID NO: 44269 - protein, 10 aa, Homo Sapiens
KMMNDSILRL

SEQ ID NO: 44270 - protein, 10 aa, Homo Sapiens
KMMNGGHYTY

SEQ ID NO: 44271 - protein, 10 aa, Homo Sapiens
KMPKFSMPGF

SEQ ID NO: 44272 - protein, 10 aa, Homo Sapiens
KMPKFSMPSL

SEQ ID NO: 44273 - protein, 10 aa, Homo Sapiens
KMPKMKMPTF

SEQ ID NO: 44274 - protein, 10 aa, Homo Sapiens
KMQEPSAHTF

SEQ ID NO: 44275 - protein, 10 aa, Homo Sapiens
KMRPTIKDHW

SEQ ID NO: 44276 - protein, 10 aa, Homo Sapiens
KMTQIMFETF

SEQ ID NO: 44277 - protein, 10 aa, Homo Sapiens
KMWSIENIAF

SEQ ID NO: 44278 - protein, 10 aa, Homo Sapiens
KMYDAAKLLY

SEQ ID NO: 44279 - protein, 10 aa, Homo Sapiens
KMYEHLFPEL

SEQ ID NO: 44280 - protein, 10 aa, Homo Sapiens
KQAPPQKVSF

SEQ ID NO: 44281 - protein, 10 aa, Homo Sapiens
KQKDYEESSW

SEQ ID NO: 44282 - protein, 10 aa, Homo Sapiens
KQLPSPGWSW

SEQ ID NO: 44283 - protein, 10 aa, Homo Sapiens
KQMPDVNVSW

SEQ ID NO: 44284 - protein, 10 aa, Homo Sapiens
KQTDVGITHF

SEQ ID NO: 44285 - protein, 10 aa, Homo Sapiens
KQVDDLASVW

SEQ ID NO: 44286 - protein, 10 aa, Homo Sapiens
KQVDSIVWTF

SEQ ID NO: 44287 - protein, 10 aa, Homo Sapiens
KQYEAARLEY

SEQ ID NO: 44288 - protein, 10 aa, Homo Sapiens
KQYQIKGLEW

SEQ ID NO: 44289 - protein, 10 aa, Homo Sapiens
KQYVFGGWAW

SEQ ID NO: 44290 - protein, 10 aa, Homo Sapiens
KSARVKGLSF

SEQ ID NO: 44291 - protein, 10 aa, Homo Sapiens
KSFEGNVFMY

SEQ ID NO: 44292 - protein, 10 aa, Homo Sapiens
KSFEKAKESW

SEQ ID NO: 44293 - protein, 10 aa, Homo Sapiens
KSVEFTWPEF

SEQ ID NO: 44294 - protein, 10 aa, Homo Sapiens
KSVLIMGRGY

SEQ ID NO: 44295 - protein, 10 aa, Homo Sapiens
KTAVIDHHNY

SEQ ID NO: 44296 - protein, 10 aa, Homo Sapiens
KTAWEVRAVY

SEQ ID NO: 44297 - protein, 10 aa, Homo Sapiens
KTFKGKYFNF

SEQ ID NO: 44298 - protein, 10 aa, Homo Sapiens
KTFQENLSAF

SEQ ID NO: 44299 - protein, 10 aa, Homo Sapiens
KTFREWDFDL

SEQ ID NO: 44300 - protein, 10 aa, Homo Sapiens
KTFSEHLTSY

SEQ ID NO: 44301 - protein, 10 aa, Homo Sapiens
KTFSFVMPSL

SEQ ID NO: 44302 - protein, 10 aa, Homo Sapiens
KTFTKWVNSH

SEQ ID NO: 44303 - protein, 10 aa, Homo Sapiens
KTGENFRLIY

SEQ ID NO: 44304 - protein, 10 aa, Homo Sapiens
KTKDGVREVF

SEQ ID NO: 44305 - protein, 10 aa, Homo Sapiens
KTKDWWTYEF

SEQ ID NO: 44306 - protein, 10 aa, Homo Sapiens
KTLAEINQKW

SEQ ID NO: 44307 - protein, 10 aa, Homo Sapiens
KTLDFELDTF

SEQ ID NO: 44308 - protein, 10 aa, Homo Sapiens
KTLDQAIMKF

SEQ ID NO: 44309 - protein, 10 aa, Homo Sapiens
KTLDSWRDEF

SEQ ID NO: 44310 - protein, 10 aa, Homo Sapiens
KTLEDALHCF

SEQ ID NO: 44311 - protein, 10 aa, Homo Sapiens
KTLQEVHFLL

SEQ ID NO: 44312 - protein, 10 aa, Homo Sapiens
KTLSDIFLLF

SEQ ID NO: 44313 - protein, 10 aa, Homo Sapiens
KTLSTFKESW

SEQ ID NO: 44314 - protein, 10 aa, Homo Sapiens
KTMDPSCLKW

SEQ ID NO: 44315 - protein, 10 aa, Homo Sapiens
KTMKMRGQAF

SEQ ID NO: 44316 - protein, 10 aa, Homo Sapiens
KTNEHGMKTF

SEQ ID NO: 44317 - protein, 10 aa, Homo Sapiens
KTQSFEKQGF

SEQ ID NO: 44318 - protein, 10 aa, Homo Sapiens
KTRDDWLVSW

SEQ ID NO: 44319 - protein, 10 aa, Homo Sapiens
KTVFIRNLSF

SEQ ID NO: 44320 - protein, 10 aa, Homo Sapiens
KTWGLRAAGW

SEQ ID NO: 44321 - protein, 10 aa, Homo Sapiens
KTYDSKRVCF

SEQ ID NO: 44322 - protein, 10 aa, Homo Sapiens
KTYEAALETI

SEQ ID NO: 44323 - protein, 10 aa, Homo Sapiens
KTYGIKHMKF

SEQ ID NO: 44324 - protein, 10 aa, Homo Sapiens
KVAAEWRSTF

SEQ ID NO: 44325 - protein, 10 aa, Homo Sapiens
KVADIGLAAW

SEQ ID NO: 44326 - protein, 10 aa, Homo Sapiens
KVADWTGATY

SEQ ID NO: 44327 - protein, 10 aa, Homo Sapiens
KVAELENSEF

SEQ ID NO: 44328 - protein, 10 aa, Homo Sapiens
KVAKLDTSQW

SEQ ID NO: 44329 - protein, 10 aa, Homo Sapiens
KVASLRGMEL

SEQ ID NO: 44330 - protein, 10 aa, Homo Sapiens
KVFDGCPLKI

SEQ ID NO: 44331 - protein, 10 aa, Homo Sapiens
KVFDGIPPPY

SEQ ID NO: 44332 - protein, 10 aa, Homo Sapiens
KVFDPKVFTF

SEQ ID NO: 44333 - protein, 10 aa, Homo Sapiens
KVFESWMHHW

SEQ ID NO: 44334 - protein, 10 aa, Homo Sapiens
KVFGRPISSW

SEQ ID NO: 44335 - protein, 10 aa, Homo Sapiens
KVFKPISSTW

SEQ ID NO: 44336 - protein, 10 aa, Homo Sapiens
KVFNGCPLRI

SEQ ID NO: 44337 - protein, 10 aa, Homo Sapiens
KVGDKCMAVW

SEQ ID NO: 44338 - protein, 10 aa, Homo Sapiens
KVIDKRLWGW

SEQ ID NO: 44339 - protein, 10 aa, Homo Sapiens
KVIHALGQSW

SEQ ID NO: 44340 - protein, 10 aa, Homo Sapiens
KVINTGIKVW

SEQ ID NO: 44341 - protein, 10 aa, Homo Sapiens
KVKEEIGSSW

SEQ ID NO: 44342 - protein, 10 aa, Homo Sapiens
KVLDAMPHHW

SEQ ID NO: 44343 - protein, 10 aa, Homo Sapiens
KVLGAPVPAF

SEQ ID NO: 44344 - protein, 10 aa, Homo Sapiens
KVLPPLEQVW

SEQ ID NO: 44345 - protein, 10 aa, Homo Sapiens
KVLRWERAWF

SEQ ID NO: 44346 - protein, 10 aa, Homo Sapiens
KVRAESFDTW

SEQ ID NO: 44347 - protein, 10 aa, Homo Sapiens
KVSSVRWISY

SEQ ID NO: 44348 - protein, 10 aa, Homo Sapiens
KVWPGGSRTW

SEQ ID NO: 44349 - protein, 10 aa, Homo Sapiens
LFDRPQELKL

SEQ ID NO: 44350 - protein, 10 aa, Homo Sapiens
LLFPGKAFSW

SEQ ID NO: 44351 - protein, 10 aa, Homo Sapiens
LRQQAKQICY

SEQ ID NO: 44352 - protein, 10 aa, Homo Sapiens
QIFRPDNFVF

SEQ ID NO: 44353 - protein, 10 aa, Homo Sapiens
QLAEGGRMVY

SEQ ID NO: 44354 - protein, 10 aa, Homo Sapiens
RIACIFGMQL

SEQ ID NO: 44355 - protein, 10 aa, Homo Sapiens
RIALLEGFNF

SEQ ID NO: 44356 - protein, 10 aa, Homo Sapiens
RIASCLLESW

SEQ ID NO: 44357 - protein, 10 aa, Homo Sapiens
RIFEDYTVSW

SEQ ID NO: 44358 - protein, 10 aa, Homo Sapiens
RIFIGTFKAF

SEQ ID NO: 44359 - protein, 10 aa, Homo Sapiens
RIFKGVGCVW

SEQ ID NO: 44360 - protein, 10 aa, Homo Sapiens
RIGKLLGFEW

SEQ ID NO: 44361 - protein, 10 aa, Homo Sapiens
RIIKDVVLQW

SEQ ID NO: 44362 - protein, 10 aa, Homo Sapiens
RILDGKRIQY

SEQ ID NO: 44363 - protein, 10 aa, Homo Sapiens
RILDIVPPTF

SEQ ID NO: 44364 - protein, 10 aa, Homo Sapiens
RILPKCRTSY

SEQ ID NO: 44365 - protein, 10 aa, Homo Sapiens
RIMGTGPPAF

SEQ ID NO: 44366 - protein, 10 aa, Homo Sapiens
RLADPVFIGF

SEQ ID NO: 44367 - protein, 10 aa, Homo Sapiens
RLAEAQSNSF

SEQ ID NO: 44368 - protein, 10 aa, Homo Sapiens
RLAEDLGNLW

SEQ ID NO: 44369 - protein, 10 aa, Homo Sapiens
RLAHSFRPAY

SEQ ID NO: 44370 - protein, 10 aa, Homo Sapiens
RLAPNFRWAI

SEQ ID NO: 44371 - protein, 10 aa, Homo Sapiens
RLAQEGIYTL

SEQ ID NO: 44372 - protein, 10 aa, Homo Sapiens
RLCAVPPPNF

SEQ ID NO: 44373 - protein, 10 aa, Homo Sapiens
RLCENYIKSW

SEQ ID NO: 44374 - protein, 10 aa, Homo Sapiens
RLCPAQRGLY

SEQ ID NO: 44375 - protein, 10 aa, Homo Sapiens
RLFDIHKQVL

SEQ ID NO: 44376 - protein, 10 aa, Homo Sapiens
RLFDPINLVF

SEQ ID NO: 44377 - protein, 10 aa, Homo Sapiens
RLFEDTFVNF

SEQ ID NO: 44378 - protein, 10 aa, Homo Sapiens
RLFHQAFISF

SEQ ID NO: 44379 - protein, 10 aa, Homo Sapiens
RLFPRPVVAF

SEQ ID NO: 44380 - protein, 10 aa, Homo Sapiens
RLFSWKGINF

SEQ ID NO: 44381 - protein, 10 aa, Homo Sapiens
RLFTRLRHEF

SEQ ID NO: 44382 - protein, 10 aa, Homo Sapiens
RLGLEIRKIY

SEQ ID NO: 44383 - protein, 10 aa, Homo Sapiens
RLIDWGLAEF

SEQ ID NO: 44384 - protein, 10 aa, Homo Sapiens
RLINPENMGF

SEQ ID NO: 44385 - protein, 10 aa, Homo Sapiens
RLIPQPAFQW

SEQ ID NO: 44386 - protein, 10 aa, Homo Sapiens
RLKVPVHHTW

SEQ ID NO: 44387 - protein, 10 aa, Homo Sapiens
RLLGDSTFEW

SEQ ID NO: 44388 - protein, 10 aa, Homo Sapiens
RLLHGRHFTY

SEQ ID NO: 44389 - protein, 10 aa, Homo Sapiens
RLLPQVLNSW

SEQ ID NO: 44390 - protein, 10 aa, Homo Sapiens
RLLPYALHKW

SEQ ID NO: 44391 - protein, 10 aa, Homo Sapiens
RLLSQGVIAF

SEQ ID NO: 44392 - protein, 10 aa, Homo Sapiens
RLLTEISSSW

SEQ ID NO: 44393 - protein, 10 aa, Homo Sapiens
RLLTTALTSF

SEQ ID NO: 44394 - protein, 10 aa, Homo Sapiens
RLMSGKVKVW

SEQ ID NO: 44395 - protein, 10 aa, Homo Sapiens
RLNQVELPHW

SEQ ID NO: 44396 - protein, 10 aa, Homo Sapiens
RLNWGEPMHW

SEQ ID NO: 44397 - protein, 10 aa, Homo Sapiens
RLSEFIPAVF

SEQ ID NO: 44398 - protein, 10 aa, Homo Sapiens
RLSYPACWEW

SEQ ID NO: 44399 - protein, 10 aa, Homo Sapiens
RLVERILTSW

SEQ ID NO: 44400 - protein, 10 aa, Homo Sapiens
RLYGKSLYSF

SEQ ID NO: 44401 - protein, 10 aa, Homo Sapiens
RLYGPSSVSF

SEQ ID NO: 44402 - protein, 10 aa, Homo Sapiens
RLYSGVLITL

SEQ ID NO: 44403 - protein, 10 aa, Homo Sapiens
RMAGIKVWVL

SEQ ID NO: 44404 - protein, 10 aa, Homo Sapiens
RMANLMGIEF

SEQ ID NO: 44405 - protein, 10 aa, Homo Sapiens
RMFHSVKSTW

SEQ ID NO: 44406 - protein, 10 aa, Homo Sapiens
RMFNSIAETW

SEQ ID NO: 44407 - protein, 10 aa, Homo Sapiens
RMIDFAHSTF

SEQ ID NO: 44408 - protein, 10 aa, Homo Sapiens
RMIDSMHQSW

SEQ ID NO: 44409 - protein, 10 aa, Homo Sapiens
RMIKEFRATL

SEQ ID NO: 44410 - protein, 10 aa, Homo Sapiens
RMKNTGNVKW

SEQ ID NO: 44411 - protein, 10 aa, Homo Sapiens
RMLEESNLSF

SEQ ID NO: 44412 - protein, 10 aa, Homo Sapiens
RMLGQCTQTW

SEQ ID NO: 44413 - protein, 10 aa, Homo Sapiens
RMLSFQQMTW

SEQ ID NO: 44414 - protein, 10 aa, Homo Sapiens
RMMNAIKESY

SEQ ID NO: 44415 - protein, 10 aa, Homo Sapiens
RMNQAPTVGF

SEQ ID NO: 44416 - protein, 10 aa, Homo Sapiens
RMSGLTRHQW

SEQ ID NO: 44417 - protein, 10 aa, Homo Sapiens
RMYFGEHLSF

SEQ ID NO: 44418 - protein, 10 aa, Homo Sapiens
RMYPFQIHSI

SEQ ID NO: 44419 - protein, 10 aa, Homo Sapiens
RMYPLKPTWW

SEQ ID NO: 44420 - protein, 10 aa, Homo Sapiens
RQADLKNWSL

SEQ ID NO: 44421 - protein, 10 aa, Homo Sapiens
RQKASIHEAW

SEQ ID NO: 44422 - protein, 10 aa, Homo Sapiens
RQLDDLNMRW

SEQ ID NO: 44423 - protein, 10 aa, Homo Sapiens
RQLEGILKSF

SEQ ID NO: 44424 - protein, 10 aa, Homo Sapiens
RQLPEPLISF

SEQ ID NO: 44425 - protein, 10 aa, Homo Sapiens
RQMDFEFAAW

SEQ ID NO: 44426 - protein, 10 aa, Homo Sapiens
RQMEHFLDSW

SEQ ID NO: 44427 - protein, 10 aa, Homo Sapiens
RQNPRIVNHW

SEQ ID NO: 44428 - protein, 10 aa, Homo Sapiens
RQRLPKYYSW

SEQ ID NO: 44429 - protein, 10 aa, Homo Sapiens
RQYDGIFYEF

SEQ ID NO: 44430 - protein, 10 aa, Homo Sapiens
RQYEGPLHHY

SEQ ID NO: 44431 - protein, 10 aa, Homo Sapiens
RQYKDYKIHW

SEQ ID NO: 44432 - protein, 10 aa, Homo Sapiens
RSGPRIFAVW

SEQ ID NO: 44433 - protein, 10 aa, Homo Sapiens
RSKPHIHPCW

SEQ ID NO: 44434 - protein, 10 aa, Homo Sapiens
RSMYPVWKSF

SEQ ID NO: 44435 - protein, 10 aa, Homo Sapiens
RSYLVQYMQF

SEQ ID NO: 44436 - protein, 10 aa, Homo Sapiens
RTAKALQAHW

SEQ ID NO: 44437 - protein, 10 aa, Homo Sapiens
RTATGCYIGW

SEQ ID NO: 44438 - protein, 10 aa, Homo Sapiens
RTCEWTGLKF

SEQ ID NO: 44439 - protein, 10 aa, Homo Sapiens
RTFGGNKLYW

SEQ ID NO: 44440 - protein, 10 aa, Homo Sapiens
RTFRNWMNSL

SEQ ID NO: 44441 - protein, 10 aa, Homo Sapiens
RTFSNTTLLF

SEQ ID NO: 44442 - protein, 10 aa, Homo Sapiens
RTGEGFLCVF

SEQ ID NO: 44443 - protein, 10 aa, Homo Sapiens
RTILVDNNTW

SEQ ID NO: 44444 - protein, 10 aa, Homo Sapiens
RTLDNQLFFF

SEQ ID NO: 44445 - protein, 10 aa, Homo Sapiens
RTLDTIQLAF

SEQ ID NO: 44446 - protein, 10 aa, Homo Sapiens
RTMNIKSATW

SEQ ID NO: 44447 - protein, 10 aa, Homo Sapiens
RTMTDGLVTF

SEQ ID NO: 44448 - protein, 10 aa, Homo Sapiens
RTNHQGTYVL

SEQ ID NO: 44449 - protein, 10 aa, Homo Sapiens
RTNPICSMTW

SEQ ID NO: 44450 - protein, 10 aa, Homo Sapiens
RTTLVDNNTW

SEQ ID NO: 44451 - protein, 10 aa, Homo Sapiens
RTTPYSRTAW

SEQ ID NO: 44452 - protein, 10 aa, Homo Sapiens
RTYEAKLLAF

SEQ ID NO: 44453 - protein, 10 aa, Homo Sapiens
RTYINPFVSF

SEQ ID NO: 44454 - protein, 10 aa, Homo Sapiens
RTYSLVGQAW

SEQ ID NO: 44455 - protein, 10 aa, Homo Sapiens
RTYSVPRLCW

SEQ ID NO: 44456 - protein, 10 aa, Homo Sapiens
RVAAVRAAAW

SEQ ID NO: 44457 - protein, 10 aa, Homo Sapiens
RVADFGSATF

SEQ ID NO: 44458 - protein, 10 aa, Homo Sapiens
RVAELINASY

SEQ ID NO: 44459 - protein, 10 aa, Homo Sapiens
RVANPPFSTW

SEQ ID NO: 44460 - protein, 10 aa, Homo Sapiens
RVFDTRTEAW

SEQ ID NO: 44461 - protein, 10 aa, Homo Sapiens
RVFEGPYKEY

SEQ ID NO: 44462 - protein, 10 aa, Homo Sapiens
RVFFGKNLAF

SEQ ID NO: 44463 - protein, 10 aa, Homo Sapiens
RVFIGNLNTL

SEQ ID NO: 44464 - protein, 10 aa, Homo Sapiens
RVFPDKGYSF

SEQ ID NO: 44465 - protein, 10 aa, Homo Sapiens
RVFPEKGYSF

SEQ ID NO: 44466 - protein, 10 aa, Homo Sapiens
RVFSQGSHAW

SEQ ID NO: 44467 - protein, 10 aa, Homo Sapiens
RVFTNSRERW

SEQ ID NO: 44468 - protein, 10 aa, Homo Sapiens
RVGAFLKNAW

SEQ ID NO: 44469 - protein, 10 aa, Homo Sapiens
RVGRHVVSVW

SEQ ID NO: 44470 - protein, 10 aa, Homo Sapiens
RVGVGIRSSY

SEQ ID NO: 44471 - protein, 10 aa, Homo Sapiens
RVIQISQFEW

SEQ ID NO: 44472 - protein, 10 aa, Homo Sapiens
RVIQKALESI

SEQ ID NO: 44473 - protein, 10 aa, Homo Sapiens
RVIQVSPFLL

SEQ ID NO: 44474 - protein, 10 aa, Homo Sapiens
RVKAEPFIKW

SEQ ID NO: 44475 - protein, 10 aa, Homo Sapiens
RVKPLHYISW

SEQ ID NO: 44476 - protein, 10 aa, Homo Sapiens
RVLDSRLVTF

SEQ ID NO: 44477 - protein, 10 aa, Homo Sapiens
RVLEGTLLEF

SEQ ID NO: 44478 - protein, 10 aa, Homo Sapiens
RVLGGVMSAF

SEQ ID NO: 44479 - protein, 10 aa, Homo Sapiens
RVNPRHYNAW

SEQ ID NO: 44480 - protein, 10 aa, Homo Sapiens
RVQAELQHCW

SEQ ID NO: 44481 - protein, 10 aa, Homo Sapiens
RVSPALGITW

SEQ ID NO: 44482 - protein, 10 aa, Homo Sapiens
RVYLHLRQTW

SEQ ID NO: 44483 - protein, 10 aa, Homo Sapiens
RVYPERSTSY

SEQ ID NO: 44484 - protein, 10 aa, Homo Sapiens
SFPALSLSSF

SEQ ID NO: 44485 - protein, 10 aa, Homo Sapiens
SFSFGSPNPW

SEQ ID NO: 44486 - protein, 10 aa, Homo Sapiens
SISGHHPETW

SEQ ID NO: 44487 - protein, 10 aa, Homo Sapiens
SLSPFRRHSW

SEQ ID NO: 44488 - protein, 10 aa, Homo Sapiens
SLWGPYKDIW

SEQ ID NO: 44489 - protein, 10 aa, Homo Sapiens
SSIRGKKWSW

SEQ ID NO: 44490 - protein, 10 aa, Homo Sapiens
STIGFKLPSY

SEQ ID NO: 44491 - protein, 10 aa, Homo Sapiens
STLGHSRSHW

SEQ ID NO: 44492 - protein, 10 aa, Homo Sapiens
STLPNWMAEF

SEQ ID NO: 44493 - protein, 10 aa, Homo Sapiens
STLVDGRYTY

SEQ ID NO: 44494 - protein, 10 aa, Homo Sapiens
STYQRWQFTL

SEQ ID NO: 44495 - protein, 10 aa, Homo Sapiens
SVAEITNACF

SEQ ID NO: 44496 - protein, 10 aa, Homo Sapiens
SVFRDHRATW

SEQ ID NO: 44497 - protein, 10 aa, Homo Sapiens
TLQVNGRHEY

SEQ ID NO: 44498 - protein, 10 aa, Homo Sapiens
TLWDGHAAVW

SEQ ID NO: 44499 - protein, 10 aa, Homo Sapiens
TMGRALRYYY

SEQ ID NO: 44500 - protein, 10 aa, Homo Sapiens
VDGAYMTKVD

SEQ ID NO: 44501 - protein, 10 aa, Homo Sapiens
VLFPFSLPHW

SEQ ID NO: 44502 - protein, 10 aa, Homo Sapiens
VLYQKHVHTY

SEQ ID NO: 44503 - protein, 10 aa, Homo Sapiens
VQFVPPLPEW

SEQ ID NO: 44504 - protein, 10 aa, Homo Sapiens
VQRPFIQMSW

SEQ ID NO: 44505 - protein, 10 aa, Homo Sapiens
VTAEAVRSVW

SEQ ID NO: 44506 - protein, 10 aa, Homo Sapiens
VTARLVGVLW

SEQ ID NO: 44507 - protein, 10 aa, Homo Sapiens
VTFPFKPESW

SEQ ID NO: 44508 - protein, 10 aa, Homo Sapiens
VVKEDAFYSW

SEQ ID NO: 44509 - protein, 10 aa, Homo Sapiens
VVWENKHITW

SEQ ID NO: 44510 - protein, 10 aa, Homo Sapiens
VVWGECNHSF

SEQ ID NO: 44511 - protein, 10 aa, Homo Sapiens
YIYNQPRQSW

SEQ ID NO: 44512 - protein, 11 aa, Homo Sapiens
AIFEAKKSFYW

SEQ ID NO: 44513 - protein, 11 aa, Homo Sapiens
AIWDNATSKTW

SEQ ID NO: 44514 - protein, 11 aa, Homo Sapiens
ALFARPDLLLL

SEQ ID NO: 44515 - protein, 11 aa, Homo Sapiens
ALLDGRVQLRF

SEQ ID NO: 44516 - protein, 11 aa, Homo Sapiens
ALLKNPKILLL

SEQ ID NO: 44517 - protein, 11 aa, Homo Sapiens
ALWNEGYIMGF

SEQ ID NO: 44518 - protein, 11 aa, Homo Sapiens
ALWRGSAYAGF

SEQ ID NO: 44519 - protein, 11 aa, Homo Sapiens
AMAPAAGYHVW

SEQ ID NO: 44520 - protein, 11 aa, Homo Sapiens
AMFDQSQIQEF

SEQ ID NO: 44521 - protein, 11 aa, Homo Sapiens
AQFPGACGLRY

SEQ ID NO: 44522 - protein, 11 aa, Homo Sapiens
ASFPNVSSFEW

SEQ ID NO: 44523 - protein, 11 aa, Homo Sapiens
ATAAAATAMLW

SEQ ID NO: 44524 - protein, 11 aa, Homo Sapiens
AVFGHPFSLGW

SEQ ID NO: 44525 - protein, 11 aa, Homo Sapiens
AVIENPEMLKY

SEQ ID NO: 44526 - protein, 11 aa, Homo Sapiens
AVQDKGSIHKF

SEQ ID NO: 44527 - protein, 11 aa, Homo Sapiens
FLTAAKKARAG

SEQ ID NO: 44528 - protein, 11 aa, Homo Sapiens
GLFAHPSLWQL

SEQ ID NO: 44529 - protein, 11 aa, Homo Sapiens
GLIENPALLRW

SEQ ID NO: 44530 - protein, 11 aa, Homo Sapiens
GSFGKGNLFVL

SEQ ID NO: 44531 - protein, 11 aa, Homo Sapiens
GTFKKSTVLQL

SEQ ID NO: 44532 - protein, 11 aa, Homo Sapiens
GVAYGATRYNY

SEQ ID NO: 44533 - protein, 11 aa, Homo Sapiens
HQFEKIEQFVY

SEQ ID NO: 44534 - protein, 11 aa, Homo Sapiens
HTWNGIRHLMW

SEQ ID NO: 44535 - protein, 11 aa, Homo Sapiens
ILLVNDHLLNF

SEQ ID NO: 44536 - protein, 11 aa, Homo Sapiens
ILRSMGMEDAF

SEQ ID NO: 44537 - protein, 11 aa, Homo Sapiens
IPLDPVAGYKE

SEQ ID NO: 44538 - protein, 11 aa, Homo Sapiens
IQFRLPDGSSF

SEQ ID NO: 44539 - protein, 11 aa, Homo Sapiens
ISERYGPVFTI

SEQ ID NO: 44540 - protein, 11 aa, Homo Sapiens
IVRPSIVGASW

SEQ ID NO: 44541 - protein, 11 aa, Homo Sapiens
KAFDRPSLFQI

SEQ ID NO: 44542 - protein, 11 aa, Homo Sapiens
KAFDRPSLFRI

SEQ ID NO: 44543 - protein, 11 aa, Homo Sapiens
KAFDYPSLFRI

SEQ ID NO: 44544 - protein, 11 aa, Homo Sapiens
KAFNSPNLFQI

SEQ ID NO: 44545 - protein, 11 aa, Homo Sapiens
KAFPHSSSLRY

SEQ ID NO: 44546 - protein, 11 aa, Homo Sapiens
KIFGQNSALVI

SEQ ID NO: 44547 - protein, 11 aa, Homo Sapiens
KIFKEEGLLGF

SEQ ID NO: 44548 - protein, 11 aa, Homo Sapiens
KIFSENDIFEI

SEQ ID NO: 44549 - protein, 11 aa, Homo Sapiens
KIFSESHKTVF

SEQ ID NO: 44550 - protein, 11 aa, Homo Sapiens
KIKSQDLFQSW

SEQ ID NO: 44551 - protein, 11 aa, Homo Sapiens
KILEEPHPLMF

SEQ ID NO: 44552 - protein, 11 aa, Homo Sapiens
KILGKEVKVNW

SEQ ID NO: 44553 - protein, 11 aa, Homo Sapiens
KILYPSTLFLL

SEQ ID NO: 44554 - protein, 11 aa, Homo Sapiens
KIMDYSLLMSI

SEQ ID NO: 44555 - protein, 11 aa, Homo Sapiens
KIMGKEVKVNW

SEQ ID NO: 44556 - protein, 11 aa, Homo Sapiens
KIQPDTIIQVW

SEQ ID NO: 44557 - protein, 11 aa, Homo Sapiens
KISEAGKDLLY

SEQ ID NO: 44558 - protein, 11 aa, Homo Sapiens
KIVDGACLNHF

SEQ ID NO: 44559 - protein, 11 aa, Homo Sapiens
KIWQCGGKLLF

SEQ ID NO: 44560 - protein, 11 aa, Homo Sapiens
KIYENEDQLLW

SEQ ID NO: 44561 - protein, 11 aa, Homo Sapiens
KKDVDNAYMIK

SEQ ID NO: 44562 - protein, 11 aa, Homo Sapiens
KLAAKGLRDPW

SEQ ID NO: 44563 - protein, 11 aa, Homo Sapiens
KLAALGSLLVL

SEQ ID NO: 44564 - protein, 11 aa, Homo Sapiens
KLADFGLARIY

SEQ ID NO: 44565 - protein, 11 aa, Homo Sapiens
KLCEYITQTTL

SEQ ID NO: 44566 - protein, 11 aa, Homo Sapiens
KLFADAGLVCI

SEQ ID NO: 44567 - protein, 11 aa, Homo Sapiens
KLFANERCLQL

SEQ ID NO: 44568 - protein, 11 aa, Homo Sapiens
KLFDRPQELKL

SEQ ID NO: 44569 - protein, 11 aa, Homo Sapiens
KLFDSICNNKW

SEQ ID NO: 44570 - protein, 11 aa, Homo Sapiens
KLFGAAEVQRF

SEQ ID NO: 44571 - protein, 11 aa, Homo Sapiens
KLFGPFTRNYY

SEQ ID NO: 44572 - protein, 11 aa, Homo Sapiens
KLFKNSSGLGF

SEQ ID NO: 44573 - protein, 11 aa, Homo Sapiens
KLFKSTSQLVL

SEQ ID NO: 44574 - protein, 11 aa, Homo Sapiens
KLFPKGTIFTA

SEQ ID NO: 44575 - protein, 11 aa, Homo Sapiens
KLFRHPHIIKL

SEQ ID NO: 44576 - protein, 11 aa, Homo Sapiens
KLFSYRDVNSW

SEQ ID NO: 44577 - protein, 11 aa, Homo Sapiens
KLFTEKQRMKY

SEQ ID NO: 44578 - protein, 11 aa, Homo Sapiens
KLGEFAKVLEL

SEQ ID NO: 44579 - protein, 11 aa, Homo Sapiens
KLIAGKIIPAI

SEQ ID NO: 44580 - protein, 11 aa, Homo Sapiens
KLIEPGFLTAF

SEQ ID NO: 44581 - protein, 11 aa, Homo Sapiens
KLISGDVLYIW

SEQ ID NO: 44582 - protein, 11 aa, Homo Sapiens
KLKEAETRAEF

SEQ ID NO: 44583 - protein, 11 aa, Homo Sapiens
KLKMKEREEAW

SEQ ID NO: 44584 - protein, 11 aa, Homo Sapiens
KLKPFIDREWW

SEQ ID NO: 44585 - protein, 11 aa, Homo Sapiens
KLLANKTPHTW

SEQ ID NO: 44586 - protein, 11 aa, Homo Sapiens
KLLAWSGVLEW

SEQ ID NO: 44587 - protein, 11 aa, Homo Sapiens
KLLDGFFIRPF

SEQ ID NO: 44588 - protein, 11 aa, Homo Sapiens
KLLDNGALTSF

SEQ ID NO: 44589 - protein, 11 aa, Homo Sapiens
KLLDRKSLQAI

SEQ ID NO: 44590 - protein, 11 aa, Homo Sapiens
KLLKPGGMLLF

SEQ ID NO: 44591 - protein, 11 aa, Homo Sapiens
KLLKQVDFLNW

SEQ ID NO: 44592 - protein, 11 aa, Homo Sapiens
KLLPGSAIQAL

SEQ ID NO: 44593 - protein, 11 aa, Homo Sapiens
KLPEILGKMSF

SEQ ID NO: 44594 - protein, 11 aa, Homo Sapiens
KLRFLQTEDSW

SEQ ID NO: 44595 - protein, 11 aa, Homo Sapiens
KLRSIGWGEEF

SEQ ID NO: 44596 - protein, 11 aa, Homo Sapiens
KLSDGRLRVGY

SEQ ID NO: 44597 - protein, 11 aa, Homo Sapiens
KLSLVAAMLLL

SEQ ID NO: 44598 - protein, 11 aa, Homo Sapiens
KLVQPIPFFTW

SEQ ID NO: 44599 - protein, 11 aa, Homo Sapiens
KLVTGTVLAVF

SEQ ID NO: 44600 - protein, 11 aa, Homo Sapiens
KLWEAESKLSF

SEQ ID NO: 44601 - protein, 11 aa, Homo Sapiens
KLYEEKTGNAW

SEQ ID NO: 44602 - protein, 11 aa, Homo Sapiens
KLYPEGKLPHW

SEQ ID NO: 44603 - protein, 11 aa, Homo Sapiens
KLYTKHGTLKY

SEQ ID NO: 44604 - protein, 11 aa, Homo Sapiens
KMEEGIDRHVW

SEQ ID NO: 44605 - protein, 11 aa, Homo Sapiens
KMFSNAGILKM

SEQ ID NO: 44606 - protein, 11 aa, Homo Sapiens
KMGDWKTCHSF

SEQ ID NO: 44607 - protein, 11 aa, Homo Sapiens
KMHDYDGNNLL

SEQ ID NO: 44608 - protein, 11 aa, Homo Sapiens
KMKPSDLSQVW

SEQ ID NO: 44609 - protein, 11 aa, Homo Sapiens
KMLDHPHIIKL

SEQ ID NO: 44610 - protein, 11 aa, Homo Sapiens
KMLNHENVVKF

SEQ ID NO: 44611 - protein, 11 aa, Homo Sapiens
KMLSGVGGFVL

SEQ ID NO: 44612 - protein, 11 aa, Homo Sapiens
KMNPLWNTMVI

SEQ ID NO: 44613 - protein, 11 aa, Homo Sapiens
KQAEKDNFLEW

SEQ ID NO: 44614 - protein, 11 aa, Homo Sapiens
KQASVVIQQQY

SEQ ID NO: 44615 - protein, 11 aa, Homo Sapiens
KQFAEGSTLKL

SEQ ID NO: 44616 - protein, 11 aa, Homo Sapiens
KQFAEMYVAKF

SEQ ID NO: 44617 - protein, 11 aa, Homo Sapiens
KQFSDASQLDF

SEQ ID NO: 44618 - protein, 11 aa, Homo Sapiens
KQIDPEMLNSF

SEQ ID NO: 44619 - protein, 11 aa, Homo Sapiens
KQIKNSSLLSF

SEQ ID NO: 44620 - protein, 11 aa, Homo Sapiens
KQLSKDSILSL

SEQ ID NO: 44621 - protein, 11 aa, Homo Sapiens
KQMGYQCFVSF

SEQ ID NO: 44622 - protein, 11 aa, Homo Sapiens
KQMVHEGNQRW

SEQ ID NO: 44623 - protein, 11 aa, Homo Sapiens
KQQEAPDLFQW

SEQ ID NO: 44624 - protein, 11 aa, Homo Sapiens
KQSPSAGVHTF

SEQ ID NO: 44625 - protein, 11 aa, Homo Sapiens
KQVQSYIIQNF

SEQ ID NO: 44626 - protein, 11 aa, Homo Sapiens
KQWNGKERSIY

SEQ ID NO: 44627 - protein, 11 aa, Homo Sapiens
KSFDASDTLAL

SEQ ID NO: 44628 - protein, 11 aa, Homo Sapiens
KSFEAPIKLVF

SEQ ID NO: 44629 - protein, 11 aa, Homo Sapiens
KSFEWLSQMRF

SEQ ID NO: 44630 - protein, 11 aa, Homo Sapiens
KSFGSAQEFAW

SEQ ID NO: 44631 - protein, 11 aa, Homo Sapiens
KSFGWPSFITY

SEQ ID NO: 44632 - protein, 11 aa, Homo Sapiens
KSFKGSSGLRY

SEQ ID NO: 44633 - protein, 11 aa, Homo Sapiens
KSFLGVKELSF

SEQ ID NO: 44634 - protein, 11 aa, Homo Sapiens
KSFSRGSILVM

SEQ ID NO: 44635 - protein, 11 aa, Homo Sapiens
KSKAMTGVEQW

SEQ ID NO: 44636 - protein, 11 aa, Homo Sapiens
KSNNVEMDWVL

SEQ ID NO: 44637 - protein, 11 aa, Homo Sapiens
KTAGYQAVKRW

SEQ ID NO: 44638 - protein, 11 aa, Homo Sapiens
KTASQVHLMKF

SEQ ID NO: 44639 - protein, 11 aa, Homo Sapiens
KTCEGEGRIEW

SEQ ID NO: 44640 - protein, 11 aa, Homo Sapiens
KTFEDSDLFHL

SEQ ID NO: 44641 - protein, 11 aa, Homo Sapiens
KTFEFNKELRY

SEQ ID NO: 44642 - protein, 11 aa, Homo Sapiens
KTFGRSSNLIL

SEQ ID NO: 44643 - protein, 11 aa, Homo Sapiens
KTFIVGDQISF

SEQ ID NO: 44644 - protein, 11 aa, Homo Sapiens
KTFQMAEYLKL

SEQ ID NO: 44645 - protein, 11 aa, Homo Sapiens
KTFSQTSHLVY

SEQ ID NO: 44646 - protein, 11 aa, Homo Sapiens
KTFSQTSSLVY

SEQ ID NO: 44647 - protein, 11 aa, Homo Sapiens
KTFSQTSYLVY

SEQ ID NO: 44648 - protein, 11 aa, Homo Sapiens
KTFSYKSSLVW

SEQ ID NO: 44649 - protein, 11 aa, Homo Sapiens
KTFSYPLDLLL

SEQ ID NO: 44650 - protein, 11 aa, Homo Sapiens
KTFVQRNMFEF

SEQ ID NO: 44651 - protein, 11 aa, Homo Sapiens
KTKQDEVNAAW

SEQ ID NO: 44652 - protein, 11 aa, Homo Sapiens
KTKRSIQFVDW

SEQ ID NO: 44653 - protein, 11 aa, Homo Sapiens
KTLDPTYILSY

SEQ ID NO: 44654 - protein, 11 aa, Homo Sapiens
KTLERSYLLKI

SEQ ID NO: 44655 - protein, 11 aa, Homo Sapiens
KTLSDIKLLQF

SEQ ID NO: 44656 - protein, 11 aa, Homo Sapiens
KTMSGTFLLRF

SEQ ID NO: 44657 - protein, 11 aa, Homo Sapiens
KTNGLSEDLIW

SEQ ID NO: 44658 - protein, 11 aa, Homo Sapiens
KTPLGGQKRSF

SEQ ID NO: 44659 - protein, 11 aa, Homo Sapiens
KTQVAGGQLSF

SEQ ID NO: 44660 - protein, 11 aa, Homo Sapiens
KTRDGSDYEGW

SEQ ID NO: 44661 - protein, 11 aa, Homo Sapiens
KTSHLRAHLRW

SEQ ID NO: 44662 - protein, 11 aa, Homo Sapiens
KTSNIGLSMEF

SEQ ID NO: 44663 - protein, 11 aa, Homo Sapiens
KTSVSVHLMEW

SEQ ID NO: 44664 - protein, 11 aa, Homo Sapiens
KTWAEIRQQRW

SEQ ID NO: 44665 - protein, 11 aa, Homo Sapiens
KTWKGSIGLLL

SEQ ID NO: 44666 - protein, 11 aa, Homo Sapiens
KTYAEVDRQVI

SEQ ID NO: 44667 - protein, 11 aa, Homo Sapiens
KTYNEPGSQVF

SEQ ID NO: 44668 - protein, 11 aa, Homo Sapiens
KVFPSPHILQI

SEQ ID NO: 44669 - protein, 11 aa, Homo Sapiens
KVFSSERLFSW

SEQ ID NO: 44670 - protein, 11 aa, Homo Sapiens
KVFTKHGLLKL

SEQ ID NO: 44671 - protein, 11 aa, Homo Sapiens
KVGDFGDAINW

SEQ ID NO: 44672 - protein, 11 aa, Homo Sapiens
KVHAIPLRSSW

SEQ ID NO: 44673 - protein, 11 aa, Homo Sapiens
KVHEKNRSYTW

SEQ ID NO: 44674 - protein, 11 aa, Homo Sapiens
KVIHEQVNHRW

SEQ ID NO: 44675 - protein, 11 aa, Homo Sapiens
KVKDEKIRQAF

SEQ ID NO: 44676 - protein, 11 aa, Homo Sapiens
KVKIPEELKPW

SEQ ID NO: 44677 - protein, 11 aa, Homo Sapiens
KVLADSERYTW

SEQ ID NO: 44678 - protein, 11 aa, Homo Sapiens
KVLDRGCLRTW

SEQ ID NO: 44679 - protein, 11 aa, Homo Sapiens
KVLPPNHRVVW

SEQ ID NO: 44680 - protein, 11 aa, Homo Sapiens
KVLPTNHRVTW

SEQ ID NO: 44681 - protein, 11 aa, Homo Sapiens
KVMELLPTHAF

SEQ ID NO: 44682 - protein, 11 aa, Homo Sapiens
KVMKIKVLRSW

SEQ ID NO: 44683 - protein, 11 aa, Homo Sapiens
KVMNWKETLVF

SEQ ID NO: 44684 - protein, 11 aa, Homo Sapiens
KVMPKELKLSY

SEQ ID NO: 44685 - protein, 11 aa, Homo Sapiens
KVMPQGLVISF

SEQ ID NO: 44686 - protein, 11 aa, Homo Sapiens
KVVDVVRNLVF

SEQ ID NO: 44687 - protein, 11 aa, Homo Sapiens
KVVLAEVIQAF

SEQ ID NO: 44688 - protein, 11 aa, Homo Sapiens
KVVSDDALMHW

SEQ ID NO: 44689 - protein, 11 aa, Homo Sapiens
KVWSEVNQAVL

SEQ ID NO: 44690 - protein, 11 aa, Homo Sapiens
KVYDSQGLLIF

SEQ ID NO: 44691 - protein, 11 aa, Homo Sapiens
KVYENDDQLLW

SEQ ID NO: 44692 - protein, 11 aa, Homo Sapiens
KVYSSVLRQCY

SEQ ID NO: 44693 - protein, 11 aa, Homo Sapiens
LLFHHPNILEL

SEQ ID NO: 44694 - protein, 11 aa, Homo Sapiens
LSFDAPGRLLW

SEQ ID NO: 44695 - protein, 11 aa, Homo Sapiens
MMFSGPQILKL

SEQ ID NO: 44696 - protein, 11 aa, Homo Sapiens
QIFGLSNHLVW

SEQ ID NO: 44697 - protein, 11 aa, Homo Sapiens
QILQEKNRYSW

SEQ ID NO: 44698 - protein, 11 aa, Homo Sapiens
QISDPDVRHTW

SEQ ID NO: 44699 - protein, 11 aa, Homo Sapiens
QLEPEELYQTF

SEQ ID NO: 44700 - protein, 11 aa, Homo Sapiens
QLFAPGGRLSW

SEQ ID NO: 44701 - protein, 11 aa, Homo Sapiens
QMLSSTEILKW

SEQ ID NO: 44702 - protein, 11 aa, Homo Sapiens
QQFAHPPLLVL

SEQ ID NO: 44703 - protein, 11 aa, Homo Sapiens
QTWAGSHSLKY

SEQ ID NO: 44704 - protein, 11 aa, Homo Sapiens
QVLPESCLLVW

SEQ ID NO: 44705 - protein, 11 aa, Homo Sapiens
RAFDCPSSFQI

SEQ ID NO: 44706 - protein, 11 aa, Homo Sapiens
RAFTCDDLFRF

SEQ ID NO: 44707 - protein, 11 aa, Homo Sapiens
RALEAEKRALW

SEQ ID NO: 44708 - protein, 11 aa, Homo Sapiens
RALQASALNAW

SEQ ID NO: 44709 - protein, 11 aa, Homo Sapiens
RALRGEARSSW

SEQ ID NO: 44710 - protein, 11 aa, Homo Sapiens
RIAFWDDVYGF

SEQ ID NO: 44711 - protein, 11 aa, Homo Sapiens
RIATPFQVYSW

SEQ ID NO: 44712 - protein, 11 aa, Homo Sapiens
RICEVINEAVW

SEQ ID NO: 44713 - protein, 11 aa, Homo Sapiens
RIFEKMFAMTL

SEQ ID NO: 44714 - protein, 11 aa, Homo Sapiens
RIIEETLALKF

SEQ ID NO: 44715 - protein, 11 aa, Homo Sapiens
RIKEGSSRPVW

SEQ ID NO: 44716 - protein, 11 aa, Homo Sapiens
RILHRTDRWTY

SEQ ID NO: 44717 - protein, 11 aa, Homo Sapiens
RILNGEVLESF

SEQ ID NO: 44718 - protein, 11 aa, Homo Sapiens
RILPQDVILKF

SEQ ID NO: 44719 - protein, 11 aa, Homo Sapiens
RIRPPPSSSSW

SEQ ID NO: 44720 - protein, 11 aa, Homo Sapiens
RIWEETGNYTF

SEQ ID NO: 44721 - protein, 11 aa, Homo Sapiens
RLAAASAFTSL

SEQ ID NO: 44722 - protein, 11 aa, Homo Sapiens
RLAAFADALEF

SEQ ID NO: 44723 - protein, 11 aa, Homo Sapiens
RLAAIVAKQVL

SEQ ID NO: 44724 - protein, 11 aa, Homo Sapiens
RLAGVGWRVDY

SEQ ID NO: 44725 - protein, 11 aa, Homo Sapiens
RLALFNPDVCW

SEQ ID NO: 44726 - protein, 11 aa, Homo Sapiens
RLAQQNAVTSL

SEQ ID NO: 44727 - protein, 11 aa, Homo Sapiens
RLAVREAIHAL

SEQ ID NO: 44728 - protein, 11 aa, Homo Sapiens
RLEEASLLHQF

SEQ ID NO: 44729 - protein, 11 aa, Homo Sapiens
RLFDEGTISKW

SEQ ID NO: 44730 - protein, 11 aa, Homo Sapiens
RLFKIDKEYLL

SEQ ID NO: 44731 - protein, 11 aa, Homo Sapiens
RLFNDPVAMVL

SEQ ID NO: 44732 - protein, 11 aa, Homo Sapiens
RLFNHPNILRL

SEQ ID NO: 44733 - protein, 11 aa, Homo Sapiens
RLFNHTACLVL

SEQ ID NO: 44734 - protein, 11 aa, Homo Sapiens
RLFPASGLRGF

SEQ ID NO: 44735 - protein, 11 aa, Homo Sapiens
RLFPLSGHLLL

SEQ ID NO: 44736 - protein, 11 aa, Homo Sapiens
RLFPNAKFLLM

SEQ ID NO: 44737 - protein, 11 aa, Homo Sapiens
RLFPNSKFLLM

SEQ ID NO: 44738 - protein, 11 aa, Homo Sapiens
RLFPSAAQVTF

SEQ ID NO: 44739 - protein, 11 aa, Homo Sapiens
RLFPYSQYYRW

SEQ ID NO: 44740 - protein, 11 aa, Homo Sapiens
RLGMAARGHSW

SEQ ID NO: 44741 - protein, 11 aa, Homo Sapiens
RLHGLPEQFLY

SEQ ID NO: 44742 - protein, 11 aa, Homo Sapiens
RLKEPGEKTGW

SEQ ID NO: 44743 - protein, 11 aa, Homo Sapiens
RLKPKVLLNHF

SEQ ID NO: 44744 - protein, 11 aa, Homo Sapiens
RLKSQDLELSW

SEQ ID NO: 44745 - protein, 11 aa, Homo Sapiens
RLLDDAQRLLY

SEQ ID NO: 44746 - protein, 11 aa, Homo Sapiens
RLLEEGVLRQI

SEQ ID NO: 44747 - protein, 11 aa, Homo Sapiens
RLLNEALILKF

SEQ ID NO: 44748 - protein, 11 aa, Homo Sapiens
RLLTKNNRWTW

SEQ ID NO: 44749 - protein, 11 aa, Homo Sapiens
RLMEEDELPSW

SEQ ID NO: 44750 - protein, 11 aa, Homo Sapiens
RLMTAQNLVSY

SEQ ID NO: 44751 - protein, 11 aa, Homo Sapiens
RLNCERGRQTW

SEQ ID NO: 44752 - protein, 11 aa, Homo Sapiens
RLQELGARHFY

SEQ ID NO: 44753 - protein, 11 aa, Homo Sapiens
RLQSKTIKVSY

SEQ ID NO: 44754 - protein, 11 aa, Homo Sapiens
RLRELDRNELF

SEQ ID NO: 44755 - protein, 11 aa, Homo Sapiens
RLRVRDINEAF

SEQ ID NO: 44756 - protein, 11 aa, Homo Sapiens
RLSPAGAALLW

SEQ ID NO: 44757 - protein, 11 aa, Homo Sapiens
RLSSESSCKSW

SEQ ID NO: 44758 - protein, 11 aa, Homo Sapiens
RLWLLDDSKSW

SEQ ID NO: 44759 - protein, 11 aa, Homo Sapiens
RLWTQARQMGW

SEQ ID NO: 44760 - protein, 11 aa, Homo Sapiens
RLYGNPNTLRL

SEQ ID NO: 44761 - protein, 11 aa, Homo Sapiens
RLYHDIAQQAF

SEQ ID NO: 44762 - protein, 11 aa, Homo Sapiens
RLYMGTATLVW

SEQ ID NO: 44763 - protein, 11 aa, Homo Sapiens
RLYSGISGLEL

SEQ ID NO: 44764 - protein, 11 aa, Homo Sapiens
RMGGFGSIIQL

SEQ ID NO: 44765 - protein, 11 aa, Homo Sapiens
RMGTYGVRAAW

SEQ ID NO: 44766 - protein, 11 aa, Homo Sapiens
RMLDPSIKGTF

SEQ ID NO: 44767 - protein, 11 aa, Homo Sapiens
RMLLADQGQSW

SEQ ID NO: 44768 - protein, 11 aa, Homo Sapiens
RMLPAGGILVF

SEQ ID NO: 44769 - protein, 11 aa, Homo Sapiens
RMNPNSPSITY

SEQ ID NO: 44770 - protein, 11 aa, Homo Sapiens
RMQEESLRQEY

SEQ ID NO: 44771 - protein, 11 aa, Homo Sapiens
RMYPGLQVYTF

SEQ ID NO: 44772 - protein, 11 aa, Homo Sapiens
RQADTKAIQHL

SEQ ID NO: 44773 - protein, 11 aa, Homo Sapiens
RQFDHPHIVKL

SEQ ID NO: 44774 - protein, 11 aa, Homo Sapiens
RQIKYSKDKMW

SEQ ID NO: 44775 - protein, 11 aa, Homo Sapiens
RQKKESEAVEW

SEQ ID NO: 44776 - protein, 11 aa, Homo Sapiens
RQLENSLRETW

SEQ ID NO: 44777 - protein, 11 aa, Homo Sapiens
RQLHLEGMLCW

SEQ ID NO: 44778 - protein, 11 aa, Homo Sapiens
RQQEVTSINSF

SEQ ID NO: 44779 - protein, 11 aa, Homo Sapiens
RQVDAEVAQQW

SEQ ID NO: 44780 - protein, 11 aa, Homo Sapiens
RQYGSEGRFTF

SEQ ID NO: 44781 - protein, 11 aa, Homo Sapiens
RSFDKGPFATF

SEQ ID NO: 44782 - protein, 11 aa, Homo Sapiens
RSFDLGRQFLF

SEQ ID NO: 44783 - protein, 11 aa, Homo Sapiens
RSFIPDQHMVF

SEQ ID NO: 44784 - protein, 11 aa, Homo Sapiens
RSFYAESCFLF

SEQ ID NO: 44785 - protein, 11 aa, Homo Sapiens
RSLDHPNVLKF

SEQ ID NO: 44786 - protein, 11 aa, Homo Sapiens
RSLEGGFKISY

SEQ ID NO: 44787 - protein, 11 aa, Homo Sapiens
RTAGTICLETF

SEQ ID NO: 44788 - protein, 11 aa, Homo Sapiens
RTFAVTDELVF

SEQ ID NO: 44789 - protein, 11 aa, Homo Sapiens
RTFCDSSSLLF

SEQ ID NO: 44790 - protein, 11 aa, Homo Sapiens
RTFSESGRCRY

SEQ ID NO: 44791 - protein, 11 aa, Homo Sapiens
RTFSHSSHLAY

SEQ ID NO: 44792 - protein, 11 aa, Homo Sapiens
RTFTHPSRLTY

SEQ ID NO: 44793 - protein, 11 aa, Homo Sapiens
RTFVWPAHFKY

SEQ ID NO: 44794 - protein, 11 aa, Homo Sapiens
RTIQTPIGSTW

SEQ ID NO: 44795 - protein, 11 aa, Homo Sapiens
RTLGEIPTLVF

SEQ ID NO: 44796 - protein, 11 aa, Homo Sapiens
RTLPATVPLLL

SEQ ID NO: 44797 - protein, 11 aa, Homo Sapiens
RTLPTNTLMGF

SEQ ID NO: 44798 - protein, 11 aa, Homo Sapiens
RTLPVDSSHGF

SEQ ID NO: 44799 - protein, 11 aa, Homo Sapiens
RTMQPLAVLAF

SEQ ID NO: 44800 - protein, 11 aa, Homo Sapiens
RTMVQLGICAF

SEQ ID NO: 44801 - protein, 11 aa, Homo Sapiens
RTNPNSGDFRF

SEQ ID NO: 44802 - protein, 11 aa, Homo Sapiens
RTRNEELAQTW

SEQ ID NO: 44803 - protein, 11 aa, Homo Sapiens
RTSAVASGLQF

SEQ ID NO: 44804 - protein, 11 aa, Homo Sapiens
RTTVVARKLGF

SEQ ID NO: 44805 - protein, 11 aa, Homo Sapiens
RTWAEAAKTVL

SEQ ID NO: 44806 - protein, 11 aa, Homo Sapiens
RTWAEAARLVL

SEQ ID NO: 44807 - protein, 11 aa, Homo Sapiens
RTWKGTAFGGW

SEQ ID NO: 44808 - protein, 11 aa, Homo Sapiens
RTYPSIQIMNY

SEQ ID NO: 44809 - protein, 11 aa, Homo Sapiens
RTYQEIQELQW

SEQ ID NO: 44810 - protein, 11 aa, Homo Sapiens
RVADEGSFTCF

SEQ ID NO: 44811 - protein, 11 aa, Homo Sapiens
RVAEITKEQRL

SEQ ID NO: 44812 - protein, 11 aa, Homo Sapiens
RVAFPDTRKTY

SEQ ID NO: 44813 - protein, 11 aa, Homo Sapiens
RVAGIFPRLSF

SEQ ID NO: 44814 - protein, 11 aa, Homo Sapiens
RVFPQPGSLYL

SEQ ID NO: 44815 - protein, 11 aa, Homo Sapiens
RVFPSKARFYY

SEQ ID NO: 44816 - protein, 11 aa, Homo Sapiens
RVFRLITSQVF

SEQ ID NO: 44817 - protein, 11 aa, Homo Sapiens
RVFSNVSIILF

SEQ ID NO: 44818 - protein, 11 aa, Homo Sapiens
RVHPGETNASW

SEQ ID NO: 44819 - protein, 11 aa, Homo Sapiens
RVIDREGVYEI

SEQ ID NO: 44820 - protein, 11 aa, Homo Sapiens
RVIEGDVVSAL

SEQ ID NO: 44821 - protein, 11 aa, Homo Sapiens
RVIPHDVLPDW

SEQ ID NO: 44822 - protein, 11 aa, Homo Sapiens
RVISELQEACW

SEQ ID NO: 44823 - protein, 11 aa, Homo Sapiens
RVKAVDGDEQW

SEQ ID NO: 44824 - protein, 11 aa, Homo Sapiens
RVLEAANLFQF

SEQ ID NO: 44825 - protein, 11 aa, Homo Sapiens
RVLEAGKIGIF

SEQ ID NO: 44826 - protein, 11 aa, Homo Sapiens
RVLEKPESLLL

SEQ ID NO: 44827 - protein, 11 aa, Homo Sapiens
RVLGEVYLHTW

SEQ ID NO: 44828 - protein, 11 aa, Homo Sapiens
RVLGVSDVITW

SEQ ID NO: 44829 - protein, 11 aa, Homo Sapiens
RVLPPSALQSV

SEQ ID NO: 44830 - protein, 11 aa, Homo Sapiens
RVLPPSHRVTW

SEQ ID NO: 44831 - protein, 11 aa, Homo Sapiens
RVLPYPFTHHW

SEQ ID NO: 44832 - protein, 11 aa, Homo Sapiens
RVLSTEERKVW

SEQ ID NO: 44833 - protein, 11 aa, Homo Sapiens
RVMAKIMRECW

SEQ ID NO: 44834 - protein, 11 aa, Homo Sapiens
RVMDASAFEIF

SEQ ID NO: 44835 - protein, 11 aa, Homo Sapiens
RVMEEFNLTTF

SEQ ID NO: 44836 - protein, 11 aa, Homo Sapiens
RVMPSLAYCTF

SEQ ID NO: 44837 - protein, 11 aa, Homo Sapiens
RVQDEYSRRSY

SEQ ID NO: 44838 - protein, 11 aa, Homo Sapiens
RVQDLIGLICW

SEQ ID NO: 44839 - protein, 11 aa, Homo Sapiens
RVRTLQEEERW

SEQ ID NO: 44840 - protein, 11 aa, Homo Sapiens
RVTNKSQIRTW

SEQ ID NO: 44841 - protein, 11 aa, Homo Sapiens
RVVGSELIQKY

SEQ ID NO: 44842 - protein, 11 aa, Homo Sapiens
RVYAHIYHQHF

SEQ ID NO: 44843 - protein, 11 aa, Homo Sapiens
RVYQSLCPTSW

SEQ ID NO: 44844 - protein, 11 aa, Homo Sapiens
SIAPKTTRVTY

SEQ ID NO: 44845 - protein, 11 aa, Homo Sapiens
SIFSFPHKFEI

SEQ ID NO: 44846 - protein, 11 aa, Homo Sapiens
SIFSGAASLGY

SEQ ID NO: 44847 - protein, 11 aa, Homo Sapiens
SIKGPELLTMW

SEQ ID NO: 44848 - protein, 11 aa, Homo Sapiens
SILKKNSDWIW

SEQ ID NO: 44849 - protein, 11 aa, Homo Sapiens
SILQQPEKLQW

SEQ ID NO: 44850 - protein, 11 aa, Homo Sapiens
SLFERTTNSSW

SEQ ID NO: 44851 - protein, 11 aa, Homo Sapiens
SLFQRPPISSW

SEQ ID NO: 44852 - protein, 11 aa, Homo Sapiens
SLFTRPEIVVF

SEQ ID NO: 44853 - protein, 11 aa, Homo Sapiens
SLIRAGSRVAY

SEQ ID NO: 44854 - protein, 11 aa, Homo Sapiens
SLQNWLNRHSW

SEQ ID NO: 44855 - protein, 11 aa, Homo Sapiens
SLVPSSARLHY

SEQ ID NO: 44856 - protein, 11 aa, Homo Sapiens
SMFDQSQIQEF

SEQ ID NO: 44857 - protein, 11 aa, Homo Sapiens
SQFNRENLPGW

SEQ ID NO: 44858 - protein, 11 aa, Homo Sapiens
STFDHPELVKL

SEQ ID NO: 44859 - protein, 11 aa, Homo Sapiens
STFEDVKILAF

SEQ ID NO: 44860 - protein, 11 aa, Homo Sapiens
SVFPGARLLTI

SEQ ID NO: 44861 - protein, 11 aa, Homo Sapiens
SVFPLSHLQYF

SEQ ID NO: 44862 - protein, 11 aa, Homo Sapiens
SVIRNPEILAI

SEQ ID NO: 44863 - protein, 11 aa, Homo Sapiens
SVKPSTVVKCW

SEQ ID NO: 44864 - protein, 11 aa, Homo Sapiens
TDYDEGQDDRP

SEQ ID NO: 44865 - protein, 11 aa, Homo Sapiens
TLFHDPWKLLI

SEQ ID NO: 44866 - protein, 11 aa, Homo Sapiens
TVFSRSQVFQL

SEQ ID NO: 44867 - protein, 11 aa, Homo Sapiens
TVLDPDLRMTF

SEQ ID NO: 44868 - protein, 11 aa, Homo Sapiens
TVRHEALLYTW

SEQ ID NO: 44869 - protein, 11 aa, Homo Sapiens
VAVYGHDAEWV

SEQ ID NO: 44870 - protein, 11 aa, Homo Sapiens
VIFHPTQPWVF

SEQ ID NO: 44871 - protein, 11 aa, Homo Sapiens
VIRERKEREEW

SEQ ID NO: 44872 - protein, 11 aa, Homo Sapiens
VSLPAPGVPAW

SEQ ID NO: 44873 - protein, 11 aa, Homo Sapiens
VVFHPSQDLVF

SEQ ID NO: 44874 - protein, 11 aa, Homo Sapiens
YQFDKVGILTL

SEQ ID NO: 44875 - protein, 8 aa, Homo Sapiens
AAEPKVNR

SEQ ID NO: 44876 - protein, 8 aa, Homo Sapiens
ATIHGMNR

SEQ ID NO: 44877 - protein, 8 aa, Homo Sapiens
DAFRPASR

SEQ ID NO: 44878 - protein, 8 aa, Homo Sapiens
DAIELFNR

SEQ ID NO: 44879 - protein, 8 aa, Homo Sapiens
DARIVINR

SEQ ID NO: 44880 - protein, 8 aa, Homo Sapiens
DARVPFTR

SEQ ID NO: 44881 - protein, 8 aa, Homo Sapiens
DAWNTVSR

SEQ ID NO: 44882 - protein, 8 aa, Homo Sapiens
DGIILPGK

SEQ ID NO: 44883 - protein, 8 aa, Homo Sapiens
DGKIPVSR

SEQ ID NO: 44884 - protein, 8 aa, Homo Sapiens
DILKIHSR

SEQ ID NO: 44885 - protein, 8 aa, Homo Sapiens
DLFVFPYR

SEQ ID NO: 44886 - protein, 8 aa, Homo Sapiens
DLFVNTNR

SEQ ID NO: 44887 - protein, 8 aa, Homo Sapiens
DLHFKISR

SEQ ID NO: 44888 - protein, 8 aa, Homo Sapiens
DLNIRDLR

SEQ ID NO: 44889 - protein, 8 aa, Homo Sapiens
DLNKTRLR

SEQ ID NO: 44890 - protein, 8 aa, Homo Sapiens
DMKPPISR

SEQ ID NO: 44891 - protein, 8 aa, Homo Sapiens
DMNYIIQR

SEQ ID NO: 44892 - protein, 8 aa, Homo Sapiens
DMQRIHLR

SEQ ID NO: 44893 - protein, 8 aa, Homo Sapiens
DNFCAIAR

SEQ ID NO: 44894 - protein, 8 aa, Homo Sapiens
DNFLAFER

SEQ ID NO: 44895 - protein, 8 aa, Homo Sapiens
DNHVHVAR

SEQ ID NO: 44896 - protein, 8 aa, Homo Sapiens
DNLEPKFR

SEQ ID NO: 44897 - protein, 8 aa, Homo Sapiens
DNSIITKR

SEQ ID NO: 44898 - protein, 8 aa, Homo Sapiens
DNVKVVVR

SEQ ID NO: 44899 - protein, 8 aa, Homo Sapiens
DNYRVFER

SEQ ID NO: 44900 - protein, 8 aa, Homo Sapiens
DRALESLR

SEQ ID NO: 44901 - protein, 8 aa, Homo Sapiens
DSFKPPQR

SEQ ID NO: 44902 - protein, 8 aa, Homo Sapiens
DSFLPICR

SEQ ID NO: 44903 - protein, 8 aa, Homo Sapiens
DSIKIWNR

SEQ ID NO: 44904 - protein, 8 aa, Homo Sapiens
DSLVPIGR

SEQ ID NO: 44905 - protein, 8 aa, Homo Sapiens
DSTLPMNR

SEQ ID NO: 44906 - protein, 8 aa, Homo Sapiens
DSWKITGR

SEQ ID NO: 44907 - protein, 8 aa, Homo Sapiens
DTFLPRHR

SEQ ID NO: 44908 - protein, 8 aa, Homo Sapiens
DTFRPTAR

SEQ ID NO: 44909 - protein, 8 aa, Homo Sapiens
DTISPYSR

SEQ ID NO: 44910 - protein, 8 aa, Homo Sapiens
DTNLPANR

SEQ ID NO: 44911 - protein, 8 aa, Homo Sapiens
DTVATLPR

SEQ ID NO: 44912 - protein, 8 aa, Homo Sapiens
DVLVPWHL

SEQ ID NO: 44913 - protein, 8 aa, Homo Sapiens
DVNIIVFR

SEQ ID NO: 44914 - protein, 8 aa, Homo Sapiens
DVRFPEKR

SEQ ID NO: 44915 - protein, 8 aa, Homo Sapiens
DVRIGMTR

SEQ ID NO: 44916 - protein, 8 aa, Homo Sapiens
DVSVISSR

SEQ ID NO: 44917 - protein, 8 aa, Homo Sapiens
DVTRPHFR

SEQ ID NO: 44918 - protein, 8 aa, Homo Sapiens
DVWTPPAR

SEQ ID NO: 44919 - protein, 8 aa, Homo Sapiens
DVWVPQER

SEQ ID NO: 44920 - protein, 8 aa, Homo Sapiens
DVYIPRDR

SEQ ID NO: 44921 - protein, 8 aa, Homo Sapiens
DVYLGRYR

SEQ ID NO: 44922 - protein, 8 aa, Homo Sapiens
DYKRNLPR

SEQ ID NO: 44923 - protein, 8 aa, Homo Sapiens
DYLHMVHR

SEQ ID NO: 44924 - protein, 8 aa, Homo Sapiens
DYRTPTLR

SEQ ID NO: 44925 - protein, 8 aa, Homo Sapiens
EAIKITNR

SEQ ID NO: 44926 - protein, 8 aa, Homo Sapiens
EANVPVYR

SEQ ID NO: 44927 - protein, 8 aa, Homo Sapiens
EIFRPFYR

SEQ ID NO: 44928 - protein, 8 aa, Homo Sapiens
ELMVPFTR

SEQ ID NO: 44929 - protein, 8 aa, Homo Sapiens
ENYSPVSR

SEQ ID NO: 44930 - protein, 8 aa, Homo Sapiens
EPLLPWNR

SEQ ID NO: 44931 - protein, 8 aa, Homo Sapiens
ESLVPTAR

SEQ ID NO: 44932 - protein, 8 aa, Homo Sapiens
ETVRIINR

SEQ ID NO: 44933 - protein, 8 aa, Homo Sapiens
EVAIPHNR

SEQ ID NO: 44934 - protein, 8 aa, Homo Sapiens
EVFRPYAK

SEQ ID NO: 44935 - protein, 8 aa, Homo Sapiens
EVKIPKPR

SEQ ID NO: 44936 - protein, 8 aa, Homo Sapiens
EVNIPNRR

SEQ ID NO: 44937 - protein, 8 aa, Homo Sapiens
EVNIPRKR

SEQ ID NO: 44938 - protein, 8 aa, Homo Sapiens
EVRVPVPK

SEQ ID NO: 44939 - protein, 8 aa, Homo Sapiens
FEVDTVAP

SEQ ID NO: 44940 - protein, 8 aa, Homo Sapiens
FHSTQWLR

SEQ ID NO: 44941 - protein, 8 aa, Homo Sapiens
FKEEGVLR

SEQ ID NO: 44942 - protein, 8 aa, Homo Sapiens
GEVPLTPT

SEQ ID NO: 44943 - protein, 8 aa, Homo Sapiens
GLGLVLER

SEQ ID NO: 44944 - protein, 8 aa, Homo Sapiens
HANCIVHR

SEQ ID NO: 44945 - protein, 8 aa, Homo Sapiens
HNTIICAR

SEQ ID NO: 44946 - protein, 8 aa, Homo Sapiens
HSFRPAYR

SEQ ID NO: 44947 - protein, 8 aa, Homo Sapiens
IAGRDITR

SEQ ID NO: 44948 - protein, 8 aa, Homo Sapiens
IYFHDRVG

SEQ ID NO: 44949 - protein, 8 aa, Homo Sapiens
LAWEHERF

SEQ ID NO: 44950 - protein, 8 aa, Homo Sapiens
LKKPIYQR

SEQ ID NO: 44951 - protein, 8 aa, Homo Sapiens
LNSHCFAR

SEQ ID NO: 44952 - protein, 8 aa, Homo Sapiens
LPISRENL

SEQ ID NO: 44953 - protein, 8 aa, Homo Sapiens
LPYTPNNR

SEQ ID NO: 44954 - protein, 8 aa, Homo Sapiens
LSNIPWRR

SEQ ID NO: 44955 - protein, 8 aa, Homo Sapiens
MAYVPVSR

SEQ ID NO: 44956 - protein, 8 aa, Homo Sapiens
MVNVPKTR

SEQ ID NO: 44957 - protein, 8 aa, Homo Sapiens
NAESRVNR

SEQ ID NO: 44958 - protein, 8 aa, Homo Sapiens
NAFKTWNR

SEQ ID NO: 44959 - protein, 8 aa, Homo Sapiens
NANVPQIR

SEQ ID NO: 44960 - protein, 8 aa, Homo Sapiens
NARITDLR

SEQ ID NO: 44961 - protein, 8 aa, Homo Sapiens
NLWVPSRR

SEQ ID NO: 44962 - protein, 8 aa, Homo Sapiens
NPNVPAYR

SEQ ID NO: 44963 - protein, 8 aa, Homo Sapiens
PKDIQLAR

SEQ ID NO: 44964 - protein, 8 aa, Homo Sapiens
PQGHFQER

SEQ ID NO: 44965 - protein, 8 aa, Homo Sapiens
PRIRIETR

SEQ ID NO: 44966 - protein, 8 aa, Homo Sapiens
PTSPLTPT

SEQ ID NO: 44967 - protein, 8 aa, Homo Sapiens
PVGIFQKR

SEQ ID NO: 44968 - protein, 8 aa, Homo Sapiens
QTLQPQNR

SEQ ID NO: 44969 - protein, 8 aa, Homo Sapiens
SAWVPSHR

SEQ ID NO: 44970 - protein, 8 aa, Homo Sapiens
SAWYPFFR

SEQ ID NO: 44971 - protein, 8 aa, Homo Sapiens
SMALIHNR

SEQ ID NO: 44972 - protein, 8 aa, Homo Sapiens
TGNPTVVR

SEQ ID NO: 44973 - protein, 8 aa, Homo Sapiens
TNLVPYPR

SEQ ID NO: 44974 - protein, 8 aa, Homo Sapiens
TRAEFAER

SEQ ID NO: 44975 - protein, 8 aa, Homo Sapiens
TVRIPSQR

SEQ ID NO: 44976 - protein, 8 aa, Homo Sapiens
VANIPVAR

SEQ ID NO: 44977 - protein, 8 aa, Homo Sapiens
VATLPRGR

SEQ ID NO: 44978 - protein, 8 aa, Homo Sapiens
VNMVPFPR

SEQ ID NO: 44979 - protein, 8 aa, Homo Sapiens
WNLSPVGR

SEQ ID NO: 44980 - protein, 8 aa, Homo Sapiens
YCAHHLIR

SEQ ID NO: 44981 - protein, 8 aa, Homo Sapiens
YDRQGIGR

SEQ ID NO: 44982 - protein, 8 aa, Homo Sapiens
YFKEPSLR

SEQ ID NO: 44983 - protein, 8 aa, Homo Sapiens
YLEKIKQR

SEQ ID NO: 44984 - protein, 8 aa, Homo Sapiens
YNFTPLAR

SEQ ID NO: 44985 - protein, 8 aa, Homo Sapiens
YTINIHKR

SEQ ID NO: 44986 - protein, 8 aa, Homo Sapiens
YYGSFVTR

SEQ ID NO: 44987 - protein, 9 aa, Homo Sapiens
AANGKLFSR

SEQ ID NO: 44988 - protein, 9 aa, Homo Sapiens
ADRLIDTCR

SEQ ID NO: 44989 - protein, 9 aa, Homo Sapiens
ADRQVLAQR

SEQ ID NO: 44990 - protein, 9 aa, Homo Sapiens
AYKSILQER

SEQ ID NO: 44991 - protein, 9 aa, Homo Sapiens
AYMQYIHHR

SEQ ID NO: 44992 - protein, 9 aa, Homo Sapiens
CVKSFVTKR

SEQ ID NO: 44993 - protein, 9 aa, Homo Sapiens
CVNGHFFHR

SEQ ID NO: 44994 - protein, 9 aa, Homo Sapiens
CVNPYHYER

SEQ ID NO: 44995 - protein, 9 aa, Homo Sapiens
CVNQFIISR

SEQ ID NO: 44996 - protein, 9 aa, Homo Sapiens
DAAALVAGR

SEQ ID NO: 44997 - protein, 9 aa, Homo Sapiens
DAACRVIAR

SEQ ID NO: 44998 - protein, 9 aa, Homo Sapiens
DAAGVFCIR

SEQ ID NO: 44999 - protein, 9 aa, Homo Sapiens
DAAMFYTNR

SEQ ID NO: 45000 - protein, 9 aa, Homo Sapiens
DAAMYYCVR

SEQ ID NO: 45001 - protein, 9 aa, Homo Sapiens
DACRIIRER

SEQ ID NO: 45002 - protein, 9 aa, Homo Sapiens
DADEFGYSR

SEQ ID NO: 45003 - protein, 9 aa, Homo Sapiens
DADKPQWLR

SEQ ID NO: 45004 - protein, 9 aa, Homo Sapiens
DAEAIYVTR

SEQ ID NO: 45005 - protein, 9 aa, Homo Sapiens
DAFAPVAYL

SEQ ID NO: 45006 - protein, 9 aa, Homo Sapiens
DAFDGHAAR

SEQ ID NO: 45007 - protein, 9 aa, Homo Sapiens
DAFGHRKLR

SEQ ID NO: 45008 - protein, 9 aa, Homo Sapiens
DAFPKRILR

SEQ ID NO: 45009 - protein, 9 aa, Homo Sapiens
DAFSYGYVR

SEQ ID NO: 45010 - protein, 9 aa, Homo Sapiens
DAFTAPFHR

SEQ ID NO: 45011 - protein, 9 aa, Homo Sapiens
DAGFPFVSR

SEQ ID NO: 45012 - protein, 9 aa, Homo Sapiens
DAHDPKYWR

SEQ ID NO: 45013 - protein, 9 aa, Homo Sapiens
DAHDWNQNR

SEQ ID NO: 45014 - protein, 9 aa, Homo Sapiens
DAHQYLRLR

SEQ ID NO: 45015 - protein, 9 aa, Homo Sapiens
DAIAVHVVR

SEQ ID NO: 45016 - protein, 9 aa, Homo Sapiens
DAICKVWDR

SEQ ID NO: 45017 - protein, 9 aa, Homo Sapiens
DAIEKAVSR

SEQ ID NO: 45018 - protein, 9 aa, Homo Sapiens
DAISYRFPR

SEQ ID NO: 45019 - protein, 9 aa, Homo Sapiens
DAKAIFTGH

SEQ ID NO: 45020 - protein, 9 aa, Homo Sapiens
DAKDDFPLR

SEQ ID NO: 45021 - protein, 9 aa, Homo Sapiens
DAKDFFKRK

SEQ ID NO: 45022 - protein, 9 aa, Homo Sapiens
DAKGGSFYR

SEQ ID NO: 45023 - protein, 9 aa, Homo Sapiens
DAKMRVFER

SEQ ID NO: 45024 - protein, 9 aa, Homo Sapiens
DAKTIFTGH

SEQ ID NO: 45025 - protein, 9 aa, Homo Sapiens
DALDLFRGR

SEQ ID NO: 45026 - protein, 9 aa, Homo Sapiens
DALESLVAR

SEQ ID NO: 45027 - protein, 9 aa, Homo Sapiens
DALGGLLNR

SEQ ID NO: 45028 - protein, 9 aa, Homo Sapiens
DALLKNQRR

SEQ ID NO: 45029 - protein, 9 aa, Homo Sapiens
DALNLSVPR

SEQ ID NO: 45030 - protein, 9 aa, Homo Sapiens
DALSSIISR

SEQ ID NO: 45031 - protein, 9 aa, Homo Sapiens
DALVTIRNR

SEQ ID NO: 45032 - protein, 9 aa, Homo Sapiens
DAMEEFLNR

SEQ ID NO: 45033 - protein, 9 aa, Homo Sapiens
DAMKRIVGM

SEQ ID NO: 45034 - protein, 9 aa, Homo Sapiens
DAMQFSKKR

SEQ ID NO: 45035 - protein, 9 aa, Homo Sapiens
DANAKFYCR

SEQ ID NO: 45036 - protein, 9 aa, Homo Sapiens
DANDVILER

SEQ ID NO: 45037 - protein, 9 aa, Homo Sapiens
DANPFLSKR

SEQ ID NO: 45038 - protein, 9 aa, Homo Sapiens
DANPVRYGR

SEQ ID NO: 45039 - protein, 9 aa, Homo Sapiens
DAQEIIRPR

SEQ ID NO: 45040 - protein, 9 aa, Homo Sapiens
DAQEILHSR

SEQ ID NO: 45041 - protein, 9 aa, Homo Sapiens
DAQEILQAR

SEQ ID NO: 45042 - protein, 9 aa, Homo Sapiens
DAQKPSLTR

SEQ ID NO: 45043 - protein, 9 aa, Homo Sapiens
DAQLRLQLR

SEQ ID NO: 45044 - protein, 9 aa, Homo Sapiens
DAQNPQIKR

SEQ ID NO: 45045 - protein, 9 aa, Homo Sapiens
DAQRLHYYR

SEQ ID NO: 45046 - protein, 9 aa, Homo Sapiens
DAQRLISER

SEQ ID NO: 45047 - protein, 9 aa, Homo Sapiens
DAQVALTLR

SEQ ID NO: 45048 - protein, 9 aa, Homo Sapiens
DARARFLER

SEQ ID NO: 45049 - protein, 9 aa, Homo Sapiens
DARAYCAWR

SEQ ID NO: 45050 - protein, 9 aa, Homo Sapiens
DARDPLGCR

SEQ ID NO: 45051 - protein, 9 aa, Homo Sapiens
DAREMLNSR

SEQ ID NO: 45052 - protein, 9 aa, Homo Sapiens
DARGTVVLR

SEQ ID NO: 45053 - protein, 9 aa, Homo Sapiens
DARIPLSGR

SEQ ID NO: 45054 - protein, 9 aa, Homo Sapiens
DASLGVINR

SEQ ID NO: 45055 - protein, 9 aa, Homo Sapiens
DASLLIVNR

SEQ ID NO: 45056 - protein, 9 aa, Homo Sapiens
DASLQRIER

SEQ ID NO: 45057 - protein, 9 aa, Homo Sapiens
DASRNVFSR

SEQ ID NO: 45058 - protein, 9 aa, Homo Sapiens
DATLLIVNR

SEQ ID NO: 45059 - protein, 9 aa, Homo Sapiens
DATPLHVAR

SEQ ID NO: 45060 - protein, 9 aa, Homo Sapiens
DATVTISHR

SEQ ID NO: 45061 - protein, 9 aa, Homo Sapiens
DAVARLVAR

SEQ ID NO: 45062 - protein, 9 aa, Homo Sapiens
DAVDVFETR

SEQ ID NO: 45063 - protein, 9 aa, Homo Sapiens
DAVNLAFGR

SEQ ID NO: 45064 - protein, 9 aa, Homo Sapiens
DAVRRYLTR

SEQ ID NO: 45065 - protein, 9 aa, Homo Sapiens
DAVSKEVTR

SEQ ID NO: 45066 - protein, 9 aa, Homo Sapiens
DAWEPKVLR

SEQ ID NO: 45067 - protein, 9 aa, Homo Sapiens
DAWESLFSR

SEQ ID NO: 45068 - protein, 9 aa, Homo Sapiens
DAWGIKVER

SEQ ID NO: 45069 - protein, 9 aa, Homo Sapiens
DAWPGQRER

SEQ ID NO: 45070 - protein, 9 aa, Homo Sapiens
DAWRFWHKR

SEQ ID NO: 45071 - protein, 9 aa, Homo Sapiens
DAYEPEISR

SEQ ID NO: 45072 - protein, 9 aa, Homo Sapiens
DAYGIGTYR

SEQ ID NO: 45073 - protein, 9 aa, Homo Sapiens
DAYWPEAKR

SEQ ID NO: 45074 - protein, 9 aa, Homo Sapiens
DDRSPEVFR

SEQ ID NO: 45075 - protein, 9 aa, Homo Sapiens
DFALIHKER

SEQ ID NO: 45076 - protein, 9 aa, Homo Sapiens
DFANFGVLR

SEQ ID NO: 45077 - protein, 9 aa, Homo Sapiens
DFARRLGLR

SEQ ID NO: 45078 - protein, 9 aa, Homo Sapiens
DFEAHNILR

SEQ ID NO: 45079 - protein, 9 aa, Homo Sapiens
DFETVRMIK

SEQ ID NO: 45080 - protein, 9 aa, Homo Sapiens
DFHFRTDER

SEQ ID NO: 45081 - protein, 9 aa, Homo Sapiens
DFHSVSKLR

SEQ ID NO: 45082 - protein, 9 aa, Homo Sapiens
DFIAHLLGR

SEQ ID NO: 45083 - protein, 9 aa, Homo Sapiens
DFIAKVVQR

SEQ ID NO: 45084 - protein, 9 aa, Homo Sapiens
DFKDPPTAK

SEQ ID NO: 45085 - protein, 9 aa, Homo Sapiens
DFKEISSVK

SEQ ID NO: 45086 - protein, 9 aa, Homo Sapiens
DFKGRFKAR

SEQ ID NO: 45087 - protein, 9 aa, Homo Sapiens
DFKKYVENR

SEQ ID NO: 45088 - protein, 9 aa, Homo Sapiens
DFKNVLSNR

SEQ ID NO: 45089 - protein, 9 aa, Homo Sapiens
DFKRVVGKK

SEQ ID NO: 45090 - protein, 9 aa, Homo Sapiens
DFKRYVTDR

SEQ ID NO: 45091 - protein, 9 aa, Homo Sapiens
DFKTGQIDR

SEQ ID NO: 45092 - protein, 9 aa, Homo Sapiens
DFLAFILHR

SEQ ID NO: 45093 - protein, 9 aa, Homo Sapiens
DFLDKQMSR

SEQ ID NO: 45094 - protein, 9 aa, Homo Sapiens
DFLDLGYNR

SEQ ID NO: 45095 - protein, 9 aa, Homo Sapiens
DFLEKLAFR

SEQ ID NO: 45096 - protein, 9 aa, Homo Sapiens
DFLKQIIGR

SEQ ID NO: 45097 - protein, 9 aa, Homo Sapiens
DFLLHIIQR

SEQ ID NO: 45098 - protein, 9 aa, Homo Sapiens
DFLQKRKER

SEQ ID NO: 45099 - protein, 9 aa, Homo Sapiens
DFLRDRHVR

SEQ ID NO: 45100 - protein, 9 aa, Homo Sapiens
DFNGVAAVR

SEQ ID NO: 45101 - protein, 9 aa, Homo Sapiens
DFNLRTHVR

SEQ ID NO: 45102 - protein, 9 aa, Homo Sapiens
DFNRGVNYR

SEQ ID NO: 45103 - protein, 9 aa, Homo Sapiens
DFPEKFFPK

SEQ ID NO: 45104 - protein, 9 aa, Homo Sapiens
DFRARFWYR

SEQ ID NO: 45105 - protein, 9 aa, Homo Sapiens
DFRDKMMGR

SEQ ID NO: 45106 - protein, 9 aa, Homo Sapiens
DFSAGVANR

SEQ ID NO: 45107 - protein, 9 aa, Homo Sapiens
DFSCNRVSR

SEQ ID NO: 45108 - protein, 9 aa, Homo Sapiens
DFSGNPLSR

SEQ ID NO: 45109 - protein, 9 aa, Homo Sapiens
DFSGVTPQR

SEQ ID NO: 45110 - protein, 9 aa, Homo Sapiens
DFSKISIVR

SEQ ID NO: 45111 - protein, 9 aa, Homo Sapiens
DFSTRFITR

SEQ ID NO: 45112 - protein, 9 aa, Homo Sapiens
DFSVPDVPK

SEQ ID NO: 45113 - protein, 9 aa, Homo Sapiens
DFVGVHQER

SEQ ID NO: 45114 - protein, 9 aa, Homo Sapiens
DFYALVAQR

SEQ ID NO: 45115 - protein, 9 aa, Homo Sapiens
DFYDCRVEH

SEQ ID NO: 45116 - protein, 9 aa, Homo Sapiens
DFYGEVRTR

SEQ ID NO: 45117 - protein, 9 aa, Homo Sapiens
DFYHNVAER

SEQ ID NO: 45118 - protein, 9 aa, Homo Sapiens
DFYLQSVER

SEQ ID NO: 45119 - protein, 9 aa, Homo Sapiens
DFYVRVFVR

SEQ ID NO: 45120 - protein, 9 aa, Homo Sapiens
DGFLFVVNR

SEQ ID NO: 45121 - protein, 9 aa, Homo Sapiens
DGHEFIVKR

SEQ ID NO: 45122 - protein, 9 aa, Homo Sapiens
DGIRKVWQR

SEQ ID NO: 45123 - protein, 9 aa, Homo Sapiens
DGKWHLVYR

SEQ ID NO: 45124 - protein, 9 aa, Homo Sapiens
DGLDRIVER

SEQ ID NO: 45125 - protein, 9 aa, Homo Sapiens
DGNPFRVPR

SEQ ID NO: 45126 - protein, 9 aa, Homo Sapiens
DGQKRYTFR

SEQ ID NO: 45127 - protein, 9 aa, Homo Sapiens
DGQTPISQR

SEQ ID NO: 45128 - protein, 9 aa, Homo Sapiens
DGRGHLLGR

SEQ ID NO: 45129 - protein, 9 aa, Homo Sapiens
DGYEFFAKR

SEQ ID NO: 45130 - protein, 9 aa, Homo Sapiens
DGYWVVSNR

SEQ ID NO: 45131 - protein, 9 aa, Homo Sapiens
DIAFKIVNR

SEQ ID NO: 45132 - protein, 9 aa, Homo Sapiens
DIAGRDITR

SEQ ID NO: 45133 - protein, 9 aa, Homo Sapiens
DIAGRDVSR

SEQ ID NO: 45134 - protein, 9 aa, Homo Sapiens
DICGKAFKR

SEQ ID NO: 45135 - protein, 9 aa, Homo Sapiens
DICGKLFTR

SEQ ID NO: 45136 - protein, 9 aa, Homo Sapiens
DICPFEVNR

SEQ ID NO: 45137 - protein, 9 aa, Homo Sapiens
DICVREIAR

SEQ ID NO: 45138 - protein, 9 aa, Homo Sapiens
DIEQLPSYR

SEQ ID NO: 45139 - protein, 9 aa, Homo Sapiens
DIERINHER

SEQ ID NO: 45140 - protein, 9 aa, Homo Sapiens
DIFKDKPIK

SEQ ID NO: 45141 - protein, 9 aa, Homo Sapiens
DIFKKSKPR

SEQ ID NO: 45142 - protein, 9 aa, Homo Sapiens
DIFNQVVPR

SEQ ID NO: 45143 - protein, 9 aa, Homo Sapiens
DIFPKVTCR

SEQ ID NO: 45144 - protein, 9 aa, Homo Sapiens
DIFSEVVGR

SEQ ID NO: 45145 - protein, 9 aa, Homo Sapiens
DIGAYGEPR

SEQ ID NO: 45146 - protein, 9 aa, Homo Sapiens
DIGCPQTYR

SEQ ID NO: 45147 - protein, 9 aa, Homo Sapiens
DIHNIHVMR

SEQ ID NO: 45148 - protein, 9 aa, Homo Sapiens
DIIPNPQER

SEQ ID NO: 45149 - protein, 9 aa, Homo Sapiens
DIIQPSSTR

SEQ ID NO: 45150 - protein, 9 aa, Homo Sapiens
DIKHFVSER

SEQ ID NO: 45151 - protein, 9 aa, Homo Sapiens
DIKLNTAVR

SEQ ID NO: 45152 - protein, 9 aa, Homo Sapiens
DIKNLVVKR

SEQ ID NO: 45153 - protein, 9 aa, Homo Sapiens
DIKPLTSFR

SEQ ID NO: 45154 - protein, 9 aa, Homo Sapiens
DIKRIIKAR

SEQ ID NO: 45155 - protein, 9 aa, Homo Sapiens
DIKSHYAFR

SEQ ID NO: 45156 - protein, 9 aa, Homo Sapiens
DIKSYYTVR

SEQ ID NO: 45157 - protein, 9 aa, Homo Sapiens
DILARAFSR

SEQ ID NO: 45158 - protein, 9 aa, Homo Sapiens
DILCPKAKR

SEQ ID NO: 45159 - protein, 9 aa, Homo Sapiens
DILDHERKR

SEQ ID NO: 45160 - protein, 9 aa, Homo Sapiens
DILDKVIER

SEQ ID NO: 45161 - protein, 9 aa, Homo Sapiens
DILEKTWNM

SEQ ID NO: 45162 - protein, 9 aa, Homo Sapiens
DILELLEKR

SEQ ID NO: 45163 - protein, 9 aa, Homo Sapiens
DILESITNR

SEQ ID NO: 45164 - protein, 9 aa, Homo Sapiens
DILFPKMPK

SEQ ID NO: 45165 - protein, 9 aa, Homo Sapiens
DILHSIVKR

SEQ ID NO: 45166 - protein, 9 aa, Homo Sapiens
DILKVVEKR

SEQ ID NO: 45167 - protein, 9 aa, Homo Sapiens
DILSALVTR

SEQ ID NO: 45168 - protein, 9 aa, Homo Sapiens
DILSVASVR

SEQ ID NO: 45169 - protein, 9 aa, Homo Sapiens
DIMAAVSGR

SEQ ID NO: 45170 - protein, 9 aa, Homo Sapiens
DIMNKVWNK

SEQ ID NO: 45171 - protein, 9 aa, Homo Sapiens
DINAHITCR

SEQ ID NO: 45172 - protein, 9 aa, Homo Sapiens
DINDVKRLK

SEQ ID NO: 45173 - protein, 9 aa, Homo Sapiens
DINGFTTGR

SEQ ID NO: 45174 - protein, 9 aa, Homo Sapiens
DINGKMWLR

SEQ ID NO: 45175 - protein, 9 aa, Homo Sapiens
DINKEIEQR

SEQ ID NO: 45176 - protein, 9 aa, Homo Sapiens
DINSRNMIR

SEQ ID NO: 45177 - protein, 9 aa, Homo Sapiens
DIQDIWVVR

SEQ ID NO: 45178 - protein, 9 aa, Homo Sapiens
DIQDPGVPR

SEQ ID NO: 45179 - protein, 9 aa, Homo Sapiens
DIQFRLVTR

SEQ ID NO: 45180 - protein, 9 aa, Homo Sapiens
DIQGHPFFR

SEQ ID NO: 45181 - protein, 9 aa, Homo Sapiens
DIQIVSTTR

SEQ ID NO: 45182 - protein, 9 aa, Homo Sapiens
DIQLLKRTV

SEQ ID NO: 45183 - protein, 9 aa, Homo Sapiens
DIQQVGVIR

SEQ ID NO: 45184 - protein, 9 aa, Homo Sapiens
DIQRGLVLR

SEQ ID NO: 45185 - protein, 9 aa, Homo Sapiens
DIQTRMAGR

SEQ ID NO: 45186 - protein, 9 aa, Homo Sapiens
DIRCPFEKR

SEQ ID NO: 45187 - protein, 9 aa, Homo Sapiens
DIRDFIHQR

SEQ ID NO: 45188 - protein, 9 aa, Homo Sapiens
DIRKGFQLR

SEQ ID NO: 45189 - protein, 9 aa, Homo Sapiens
DISDTIYPR

SEQ ID NO: 45190 - protein, 9 aa, Homo Sapiens
DISKRYSGR

SEQ ID NO: 45191 - protein, 9 aa, Homo Sapiens
DISNVKIPK

SEQ ID NO: 45192 - protein, 9 aa, Homo Sapiens
DITTPKAAR

SEQ ID NO: 45193 - protein, 9 aa, Homo Sapiens
DIWHKVGNA

SEQ ID NO: 45194 - protein, 9 aa, Homo Sapiens
DIWTTTANR

SEQ ID NO: 45195 - protein, 9 aa, Homo Sapiens
DIYDHCQSR

SEQ ID NO: 45196 - protein, 9 aa, Homo Sapiens
DIYFNPKTR

SEQ ID NO: 45197 - protein, 9 aa, Homo Sapiens
DIYKKFLTR

SEQ ID NO: 45198 - protein, 9 aa, Homo Sapiens
DIYLPTHVR

SEQ ID NO: 45199 - protein, 9 aa, Homo Sapiens
DIYLRMTGR

SEQ ID NO: 45200 - protein, 9 aa, Homo Sapiens
DIYNHRFHR

SEQ ID NO: 45201 - protein, 9 aa, Homo Sapiens
DIYRPTIHK

SEQ ID NO: 45202 - protein, 9 aa, Homo Sapiens
DIYSKTWTK

SEQ ID NO: 45203 - protein, 9 aa, Homo Sapiens
DLAKIIFKR

SEQ ID NO: 45204 - protein, 9 aa, Homo Sapiens
DLANVRVGR

SEQ ID NO: 45205 - protein, 9 aa, Homo Sapiens
DLARSIVTR

SEQ ID NO: 45206 - protein, 9 aa, Homo Sapiens
DLASRLVTR

SEQ ID NO: 45207 - protein, 9 aa, Homo Sapiens
DLCGPSIPR

SEQ ID NO: 45208 - protein, 9 aa, Homo Sapiens
DLCKIGSER

SEQ ID NO: 45209 - protein, 9 aa, Homo Sapiens
DLFDFITER

SEQ ID NO: 45210 - protein, 9 aa, Homo Sapiens
DLFEKRTNR

SEQ ID NO: 45211 - protein, 9 aa, Homo Sapiens
DLFNKLVMR

SEQ ID NO: 45212 - protein, 9 aa, Homo Sapiens
DLFRYFVHR

SEQ ID NO: 45213 - protein, 9 aa, Homo Sapiens
DLFSFMQKR

SEQ ID NO: 45214 - protein, 9 aa, Homo Sapiens
DLFVNTNRR

SEQ ID NO: 45215 - protein, 9 aa, Homo Sapiens
DLFYNIATR

SEQ ID NO: 45216 - protein, 9 aa, Homo Sapiens
DLFYSFWER

SEQ ID NO: 45217 - protein, 9 aa, Homo Sapiens
DLHFHFTAR

SEQ ID NO: 45218 - protein, 9 aa, Homo Sapiens
DLHKFCLGR

SEQ ID NO: 45219 - protein, 9 aa, Homo Sapiens
DLIAIVSNR

SEQ ID NO: 45220 - protein, 9 aa, Homo Sapiens
DLIDRGWRR

SEQ ID NO: 45221 - protein, 9 aa, Homo Sapiens
DLIGCIIGR

SEQ ID NO: 45222 - protein, 9 aa, Homo Sapiens
DLIKQIGKK

SEQ ID NO: 45223 - protein, 9 aa, Homo Sapiens
DLIKVTQVR

SEQ ID NO: 45224 - protein, 9 aa, Homo Sapiens
DLINIHFQR

SEQ ID NO: 45225 - protein, 9 aa, Homo Sapiens
DLKDRTIKR

SEQ ID NO: 45226 - protein, 9 aa, Homo Sapiens
DLKDVSSQR

SEQ ID NO: 45227 - protein, 9 aa, Homo Sapiens
DLKEVTDLR

SEQ ID NO: 45228 - protein, 9 aa, Homo Sapiens
DLKGSLRNR

SEQ ID NO: 45229 - protein, 9 aa, Homo Sapiens
DLKGSLVSR

SEQ ID NO: 45230 - protein, 9 aa, Homo Sapiens
DLKKEINER

SEQ ID NO: 45231 - protein, 9 aa, Homo Sapiens
DLKKIQFPK

SEQ ID NO: 45232 - protein, 9 aa, Homo Sapiens
DLKKPIYQR

SEQ ID NO: 45233 - protein, 9 aa, Homo Sapiens
DLKKQIMGR

SEQ ID NO: 45234 - protein, 9 aa, Homo Sapiens
DLKPLPTAR

SEQ ID NO: 45235 - protein, 9 aa, Homo Sapiens
DLKRPFLSR

SEQ ID NO: 45236 - protein, 9 aa, Homo Sapiens
DLKSRLDSR

SEQ ID NO: 45237 - protein, 9 aa, Homo Sapiens
DLKSTVISR

SEQ ID NO: 45238 - protein, 9 aa, Homo Sapiens
DLLELIDTR

SEQ ID NO: 45239 - protein, 9 aa, Homo Sapiens
DLLGTLHNL

SEQ ID NO: 45240 - protein, 9 aa, Homo Sapiens
DLLIPLTNR

SEQ ID NO: 45241 - protein, 9 aa, Homo Sapiens
DLLKRAFVR

SEQ ID NO: 45242 - protein, 9 aa, Homo Sapiens
DLLKSIVSR

SEQ ID NO: 45243 - protein, 9 aa, Homo Sapiens
DLLLIRKNR

SEQ ID NO: 45244 - protein, 9 aa, Homo Sapiens
DLLNIIREK

SEQ ID NO: 45245 - protein, 9 aa, Homo Sapiens
DLLRRPGAR

SEQ ID NO: 45246 - protein, 9 aa, Homo Sapiens
DLLVPTKAR

SEQ ID NO: 45247 - protein, 9 aa, Homo Sapiens
DLLVVPMQR

SEQ ID NO: 45248 - protein, 9 aa, Homo Sapiens
DLLWRRIAR

SEQ ID NO: 45249 - protein, 9 aa, Homo Sapiens
DLMNCLHER

SEQ ID NO: 45250 - protein, 9 aa, Homo Sapiens
DLNAQYERR

SEQ ID NO: 45251 - protein, 9 aa, Homo Sapiens
DLNDNICKR

SEQ ID NO: 45252 - protein, 9 aa, Homo Sapiens
DLNEKIAQR

SEQ ID NO: 45253 - protein, 9 aa, Homo Sapiens
DLNHKYWER

SEQ ID NO: 45254 - protein, 9 aa, Homo Sapiens
DLNIKVDGR

SEQ ID NO: 45255 - protein, 9 aa, Homo Sapiens
DLNLIQQER

SEQ ID NO: 45256 - protein, 9 aa, Homo Sapiens
DLNRLITQR

SEQ ID NO: 45257 - protein, 9 aa, Homo Sapiens
DLNSGPLHR

SEQ ID NO: 45258 - protein, 9 aa, Homo Sapiens
DLQAKIFQK

SEQ ID NO: 45259 - protein, 9 aa, Homo Sapiens
DLQKNHIFR

SEQ ID NO: 45260 - protein, 9 aa, Homo Sapiens
DLQKWREER

SEQ ID NO: 45261 - protein, 9 aa, Homo Sapiens
DLQLIKVTR

SEQ ID NO: 45262 - protein, 9 aa, Homo Sapiens
DLQLKNARL

SEQ ID NO: 45263 - protein, 9 aa, Homo Sapiens
DLQLPPSQR

SEQ ID NO: 45264 - protein, 9 aa, Homo Sapiens
DLQNLKRVR

SEQ ID NO: 45265 - protein, 9 aa, Homo Sapiens
DLQRNLPER

SEQ ID NO: 45266 - protein, 9 aa, Homo Sapiens
DLQSMEQIR

SEQ ID NO: 45267 - protein, 9 aa, Homo Sapiens
DLQSRILKR

SEQ ID NO: 45268 - protein, 9 aa, Homo Sapiens
DLQVRQDVR

SEQ ID NO: 45269 - protein, 9 aa, Homo Sapiens
DLQYIKITR

SEQ ID NO: 45270 - protein, 9 aa, Homo Sapiens
DLRAKFKER

SEQ ID NO: 45271 - protein, 9 aa, Homo Sapiens
DLRELFARR

SEQ ID NO: 45272 - protein, 9 aa, Homo Sapiens
DLREQTHSR

SEQ ID NO: 45273 - protein, 9 aa, Homo Sapiens
DLREQTHTR

SEQ ID NO: 45274 - protein, 9 aa, Homo Sapiens
DLRHDIDRR

SEQ ID NO: 45275 - protein, 9 aa, Homo Sapiens
DLRHKLNLR

SEQ ID NO: 45276 - protein, 9 aa, Homo Sapiens
DLRHLIVSR

SEQ ID NO: 45277 - protein, 9 aa, Homo Sapiens
DLRPGVIVR

SEQ ID NO: 45278 - protein, 9 aa, Homo Sapiens
DLRTRVVLR

SEQ ID NO: 45279 - protein, 9 aa, Homo Sapiens
DLSEKVVYR

SEQ ID NO: 45280 - protein, 9 aa, Homo Sapiens
DLSPWAVSR

SEQ ID NO: 45281 - protein, 9 aa, Homo Sapiens
DLSRFIHTR

SEQ ID NO: 45282 - protein, 9 aa, Homo Sapiens
DLYKFLTKR

SEQ ID NO: 45283 - protein, 9 aa, Homo Sapiens
DLYLCPRQR

SEQ ID NO: 45284 - protein, 9 aa, Homo Sapiens
DLYLKPIQR

SEQ ID NO: 45285 - protein, 9 aa, Homo Sapiens
DLYPFGTMR

SEQ ID NO: 45286 - protein, 9 aa, Homo Sapiens
DLYYHVFRR

SEQ ID NO: 45287 - protein, 9 aa, Homo Sapiens
DMAAQITQR

SEQ ID NO: 45288 - protein, 9 aa, Homo Sapiens
DMAHHPTFR

SEQ ID NO: 45289 - protein, 9 aa, Homo Sapiens
DMFATPQYR

SEQ ID NO: 45290 - protein, 9 aa, Homo Sapiens
DMFIYWIHR

SEQ ID NO: 45291 - protein, 9 aa, Homo Sapiens
DMFKDFAAR

SEQ ID NO: 45292 - protein, 9 aa, Homo Sapiens
DMFNIYIKR

SEQ ID NO: 45293 - protein, 9 aa, Homo Sapiens
DMFYRNWAL

SEQ ID NO: 45294 - protein, 9 aa, Homo Sapiens
DMHSLVRSR

SEQ ID NO: 45295 - protein, 9 aa, Homo Sapiens
DMIGVKELR

SEQ ID NO: 45296 - protein, 9 aa, Homo Sapiens
DMILKNIEK

SEQ ID NO: 45297 - protein, 9 aa, Homo Sapiens
DMISAVKSR

SEQ ID NO: 45298 - protein, 9 aa, Homo Sapiens
DMKEFTKRR

SEQ ID NO: 45299 - protein, 9 aa, Homo Sapiens
DMLFPKFLK

SEQ ID NO: 45300 - protein, 9 aa, Homo Sapiens
DMLHRFYGK

SEQ ID NO: 45301 - protein, 9 aa, Homo Sapiens
DMLPNSTER

SEQ ID NO: 45302 - protein, 9 aa, Homo Sapiens
DMMDLPRSR

SEQ ID NO: 45303 - protein, 9 aa, Homo Sapiens
DMMEGRVGR

SEQ ID NO: 45304 - protein, 9 aa, Homo Sapiens
DMNRLLKQR

SEQ ID NO: 45305 - protein, 9 aa, Homo Sapiens
DMQHQVLER

SEQ ID NO: 45306 - protein, 9 aa, Homo Sapiens
DMQTEIKLR

SEQ ID NO: 45307 - protein, 9 aa, Homo Sapiens
DMRKIGQAR

SEQ ID NO: 45308 - protein, 9 aa, Homo Sapiens
DMRKIGSSR

SEQ ID NO: 45309 - protein, 9 aa, Homo Sapiens
DMRRSLCYR

SEQ ID NO: 45310 - protein, 9 aa, Homo Sapiens
DMRVHPYQR

SEQ ID NO: 45311 - protein, 9 aa, Homo Sapiens
DMYLAPHVR

SEQ ID NO: 45312 - protein, 9 aa, Homo Sapiens
DMYSSPYLR

SEQ ID NO: 45313 - protein, 9 aa, Homo Sapiens
DNAEKLVLR

SEQ ID NO: 45314 - protein, 9 aa, Homo Sapiens
DNAPEHALR

SEQ ID NO: 45315 - protein, 9 aa, Homo Sapiens
DNCDSIIRR

SEQ ID NO: 45316 - protein, 9 aa, Homo Sapiens
DNFLMGIGR

SEQ ID NO: 45317 - protein, 9 aa, Homo Sapiens
DNFNWGVRR

SEQ ID NO: 45318 - protein, 9 aa, Homo Sapiens
DNHVVPVLR

SEQ ID NO: 45319 - protein, 9 aa, Homo Sapiens
DNIRKYWSR

SEQ ID NO: 45320 - protein, 9 aa, Homo Sapiens
DNKDFAILR

SEQ ID NO: 45321 - protein, 9 aa, Homo Sapiens
DNKIIIIHR

SEQ ID NO: 45322 - protein, 9 aa, Homo Sapiens
DNLRPFHDR

SEQ ID NO: 45323 - protein, 9 aa, Homo Sapiens
DNLTLTVAR

SEQ ID NO: 45324 - protein, 9 aa, Homo Sapiens
DNNPLAVNR

SEQ ID NO: 45325 - protein, 9 aa, Homo Sapiens
DNQASWIHR

SEQ ID NO: 45326 - protein, 9 aa, Homo Sapiens
DNQGVKFLR

SEQ ID NO: 45327 - protein, 9 aa, Homo Sapiens
DNRGFMVTR

SEQ ID NO: 45328 - protein, 9 aa, Homo Sapiens
DNRTLYHLR

SEQ ID NO: 45329 - protein, 9 aa, Homo Sapiens
DNTVPLASR

SEQ ID NO: 45330 - protein, 9 aa, Homo Sapiens
DNVKAYFKR

SEQ ID NO: 45331 - protein, 9 aa, Homo Sapiens
DNWMNINLR

SEQ ID NO: 45332 - protein, 9 aa, Homo Sapiens
DNYANIRFR

SEQ ID NO: 45333 - protein, 9 aa, Homo Sapiens
DNYRGPAVR

SEQ ID NO: 45334 - protein, 9 aa, Homo Sapiens
DPLGAIHLR

SEQ ID NO: 45335 - protein, 9 aa, Homo Sapiens
DPMFRGIYR

SEQ ID NO: 45336 - protein, 9 aa, Homo Sapiens
DPNNIFGNR

SEQ ID NO: 45337 - protein, 9 aa, Homo Sapiens
DPQFHLEHR

SEQ ID NO: 45338 - protein, 9 aa, Homo Sapiens
DSAEFHYTR

SEQ ID NO: 45339 - protein, 9 aa, Homo Sapiens
DSALLPAVR

SEQ ID NO: 45340 - protein, 9 aa, Homo Sapiens
DSAMHLALR

SEQ ID NO: 45341 - protein, 9 aa, Homo Sapiens
DSCGFFKKR

SEQ ID NO: 45342 - protein, 9 aa, Homo Sapiens
DSFNVVSTR

SEQ ID NO: 45343 - protein, 9 aa, Homo Sapiens
DSFQKVILR

SEQ ID NO: 45344 - protein, 9 aa, Homo Sapiens
DSFSAGEPR

SEQ ID NO: 45345 - protein, 9 aa, Homo Sapiens
DSFTGPRRR

SEQ ID NO: 45346 - protein, 9 aa, Homo Sapiens
DSHQPLWSR

SEQ ID NO: 45347 - protein, 9 aa, Homo Sapiens
DSIDQKWTR

SEQ ID NO: 45348 - protein, 9 aa, Homo Sapiens
DSITVPVAR

SEQ ID NO: 45349 - protein, 9 aa, Homo Sapiens
DSIVIQQGR

SEQ ID NO: 45350 - protein, 9 aa, Homo Sapiens
DSKLSGRYR

SEQ ID NO: 45351 - protein, 9 aa, Homo Sapiens
DSKPIDVSR

SEQ ID NO: 45352 - protein, 9 aa, Homo Sapiens
DSKQFNILR

SEQ ID NO: 45353 - protein, 9 aa, Homo Sapiens
DSKRVFGER

SEQ ID NO: 45354 - protein, 9 aa, Homo Sapiens
DSKVVFIER

SEQ ID NO: 45355 - protein, 9 aa, Homo Sapiens
DSLAKIPKR

SEQ ID NO: 45356 - protein, 9 aa, Homo Sapiens
DSLASKVTR

SEQ ID NO: 45357 - protein, 9 aa, Homo Sapiens
DSLDELVAR

SEQ ID NO: 45358 - protein, 9 aa, Homo Sapiens
DSLEKHIVR

SEQ ID NO: 45359 - protein, 9 aa, Homo Sapiens
DSLGVYQGR

SEQ ID NO: 45360 - protein, 9 aa, Homo Sapiens
DSLLFAHKR

SEQ ID NO: 45361 - protein, 9 aa, Homo Sapiens
DSLQRAWTV

SEQ ID NO: 45362 - protein, 9 aa, Homo Sapiens
DSLRYIYPK

SEQ ID NO: 45363 - protein, 9 aa, Homo Sapiens
DSLSRHRPR

SEQ ID NO: 45364 - protein, 9 aa, Homo Sapiens
DSLWPYKGR

SEQ ID NO: 45365 - protein, 9 aa, Homo Sapiens
DSMKSFFRR

SEQ ID NO: 45366 - protein, 9 aa, Homo Sapiens
DSMPEPASR

SEQ ID NO: 45367 - protein, 9 aa, Homo Sapiens
DSQICTVGR

SEQ ID NO: 45368 - protein, 9 aa, Homo Sapiens
DSQKDIMQR

SEQ ID NO: 45369 - protein, 9 aa, Homo Sapiens
DSQNVEALR

SEQ ID NO: 45370 - protein, 9 aa, Homo Sapiens
DSQYPPVQR

SEQ ID NO: 45371 - protein, 9 aa, Homo Sapiens
DSRPPFLSR

SEQ ID NO: 45372 - protein, 9 aa, Homo Sapiens
DSRRLSIQR

SEQ ID NO: 45373 - protein, 9 aa, Homo Sapiens
DSSGLTVHR

SEQ ID NO: 45374 - protein, 9 aa, Homo Sapiens
DSSQLIHCR

SEQ ID NO: 45375 - protein, 9 aa, Homo Sapiens
DSWTPFYQR

SEQ ID NO: 45376 - protein, 9 aa, Homo Sapiens
DSYGGLRNV

SEQ ID NO: 45377 - protein, 9 aa, Homo Sapiens
DSYIPCSER

SEQ ID NO: 45378 - protein, 9 aa, Homo Sapiens
DSYKKIFYR

SEQ ID NO: 45379 - protein, 9 aa, Homo Sapiens
DSYSPPHVR

SEQ ID NO: 45380 - protein, 9 aa, Homo Sapiens
DTAAQITQR

SEQ ID NO: 45381 - protein, 9 aa, Homo Sapiens
DTAHTFSLR

SEQ ID NO: 45382 - protein, 9 aa, Homo Sapiens
DTAQQIVYR

SEQ ID NO: 45383 - protein, 9 aa, Homo Sapiens
DTAQRALYR

SEQ ID NO: 45384 - protein, 9 aa, Homo Sapiens
DTASRFLHR

SEQ ID NO: 45385 - protein, 9 aa, Homo Sapiens
DTCRRFFDR

SEQ ID NO: 45386 - protein, 9 aa, Homo Sapiens
DTCTHAYWR

SEQ ID NO: 45387 - protein, 9 aa, Homo Sapiens
DTEEEFYLR

SEQ ID NO: 45388 - protein, 9 aa, Homo Sapiens
DTFDVFRQR

SEQ ID NO: 45389 - protein, 9 aa, Homo Sapiens
DTFIKIAQK

SEQ ID NO: 45390 - protein, 9 aa, Homo Sapiens
DTHGSFVVR

SEQ ID NO: 45391 - protein, 9 aa, Homo Sapiens
DTHKQLLER

SEQ ID NO: 45392 - protein, 9 aa, Homo Sapiens
DTIDSLRSR

SEQ ID NO: 45393 - protein, 9 aa, Homo Sapiens
DTIEIITDR

SEQ ID NO: 45394 - protein, 9 aa, Homo Sapiens
DTIGYLLTR

SEQ ID NO: 45395 - protein, 9 aa, Homo Sapiens
DTISDWNLR

SEQ ID NO: 45396 - protein, 9 aa, Homo Sapiens
DTISKIRLR

SEQ ID NO: 45397 - protein, 9 aa, Homo Sapiens
DTITLPQNR

SEQ ID NO: 45398 - protein, 9 aa, Homo Sapiens
DTKALYATK

SEQ ID NO: 45399 - protein, 9 aa, Homo Sapiens
DTKEDVFVH

SEQ ID NO: 45400 - protein, 9 aa, Homo Sapiens
DTKELVVAK

SEQ ID NO: 45401 - protein, 9 aa, Homo Sapiens
DTKEVFAGK

SEQ ID NO: 45402 - protein, 9 aa, Homo Sapiens
DTKIRVCTR

SEQ ID NO: 45403 - protein, 9 aa, Homo Sapiens
DTKNIAFER

SEQ ID NO: 45404 - protein, 9 aa, Homo Sapiens
DTKPTRIIR

SEQ ID NO: 45405 - protein, 9 aa, Homo Sapiens
DTKSPQFNR

SEQ ID NO: 45406 - protein, 9 aa, Homo Sapiens
DTLHNFVSR

SEQ ID NO: 45407 - protein, 9 aa, Homo Sapiens
DTLVPYGNR

SEQ ID NO: 45408 - protein, 9 aa, Homo Sapiens
DTMPPKGVR

SEQ ID NO: 45409 - protein, 9 aa, Homo Sapiens
DTNALRVPR

SEQ ID NO: 45410 - protein, 9 aa, Homo Sapiens
DTNTFFLCR

SEQ ID NO: 45411 - protein, 9 aa, Homo Sapiens
DTQKFSVMR

SEQ ID NO: 45412 - protein, 9 aa, Homo Sapiens
DTQLVLGNR

SEQ ID NO: 45413 - protein, 9 aa, Homo Sapiens
DTRPHYITR

SEQ ID NO: 45414 - protein, 9 aa, Homo Sapiens
DTRPQLLMR

SEQ ID NO: 45415 - protein, 9 aa, Homo Sapiens
DTRSEFYKH

SEQ ID NO: 45416 - protein, 9 aa, Homo Sapiens
DTRTGLVLR

SEQ ID NO: 45417 - protein, 9 aa, Homo Sapiens
DTSGICNLR

SEQ ID NO: 45418 - protein, 9 aa, Homo Sapiens
DTSLIRKTR

SEQ ID NO: 45419 - protein, 9 aa, Homo Sapiens
DTSQFILNR

SEQ ID NO: 45420 - protein, 9 aa, Homo Sapiens
DTSTWKILR

SEQ ID NO: 45421 - protein, 9 aa, Homo Sapiens
DTVATLSER

SEQ ID NO: 45422 - protein, 9 aa, Homo Sapiens
DTVSTLYNR

SEQ ID NO: 45423 - protein, 9 aa, Homo Sapiens
DTVTGLLER

SEQ ID NO: 45424 - protein, 9 aa, Homo Sapiens
DTWHYFLHR

SEQ ID NO: 45425 - protein, 9 aa, Homo Sapiens
DTWVLLNQR

SEQ ID NO: 45426 - protein, 9 aa, Homo Sapiens
DTYIKAYLR

SEQ ID NO: 45427 - protein, 9 aa, Homo Sapiens
DTYLHRVAR

SEQ ID NO: 45428 - protein, 9 aa, Homo Sapiens
DTYPRKWGL

SEQ ID NO: 45429 - protein, 9 aa, Homo Sapiens
DTYVEFPLR

SEQ ID NO: 45430 - protein, 9 aa, Homo Sapiens
DVAAQQSLR

SEQ ID NO: 45431 - protein, 9 aa, Homo Sapiens
DVAGIGWER

SEQ ID NO: 45432 - protein, 9 aa, Homo Sapiens
DVARISWYL

SEQ ID NO: 45433 - protein, 9 aa, Homo Sapiens
DVARLVVER

SEQ ID NO: 45434 - protein, 9 aa, Homo Sapiens
DVCDKVFIR

SEQ ID NO: 45435 - protein, 9 aa, Homo Sapiens
DVCGKIFRK

SEQ ID NO: 45436 - protein, 9 aa, Homo Sapiens
DVCGKVFSR

SEQ ID NO: 45437 - protein, 9 aa, Homo Sapiens
DVELREAQR

SEQ ID NO: 45438 - protein, 9 aa, Homo Sapiens
DVEPIHAFR

SEQ ID NO: 45439 - protein, 9 aa, Homo Sapiens
DVEVLKVGR

SEQ ID NO: 45440 - protein, 9 aa, Homo Sapiens
DVFIPKPFR

SEQ ID NO: 45441 - protein, 9 aa, Homo Sapiens
DVFMFLTNR

SEQ ID NO: 45442 - protein, 9 aa, Homo Sapiens
DVFNITIAR

SEQ ID NO: 45443 - protein, 9 aa, Homo Sapiens
DVFPGPSFR

SEQ ID NO: 45444 - protein, 9 aa, Homo Sapiens
DVFSHRFYK

SEQ ID NO: 45445 - protein, 9 aa, Homo Sapiens
DVFVVGTER

SEQ ID NO: 45446 - protein, 9 aa, Homo Sapiens
DVHRHLDVR

SEQ ID NO: 45447 - protein, 9 aa, Homo Sapiens
DVINPMALR

SEQ ID NO: 45448 - protein, 9 aa, Homo Sapiens
DVINVFHHL

SEQ ID NO: 45449 - protein, 9 aa, Homo Sapiens
DVKDAVVQH

SEQ ID NO: 45450 - protein, 9 aa, Homo Sapiens
DVKFSHSGR

SEQ ID NO: 45451 - protein, 9 aa, Homo Sapiens
DVKLPQGQR

SEQ ID NO: 45452 - protein, 9 aa, Homo Sapiens
DVKPSWTTR

SEQ ID NO: 45453 - protein, 9 aa, Homo Sapiens
DVLFVYAVR

SEQ ID NO: 45454 - protein, 9 aa, Homo Sapiens
DVLLEPFRR

SEQ ID NO: 45455 - protein, 9 aa, Homo Sapiens
DVLPTRPKK

SEQ ID NO: 45456 - protein, 9 aa, Homo Sapiens
DVLQTGTQR

SEQ ID NO: 45457 - protein, 9 aa, Homo Sapiens
DVLQWIVQR

SEQ ID NO: 45458 - protein, 9 aa, Homo Sapiens
DVLSHFAQR

SEQ ID NO: 45459 - protein, 9 aa, Homo Sapiens
DVNEELPAR

SEQ ID NO: 45460 - protein, 9 aa, Homo Sapiens
DVNIKSTER

SEQ ID NO: 45461 - protein, 9 aa, Homo Sapiens
DVNNIGKYR

SEQ ID NO: 45462 - protein, 9 aa, Homo Sapiens
DVNSFVRSR

SEQ ID NO: 45463 - protein, 9 aa, Homo Sapiens
DVNSGFAKR

SEQ ID NO: 45464 - protein, 9 aa, Homo Sapiens
DVNYKMHFR

SEQ ID NO: 45465 - protein, 9 aa, Homo Sapiens
DVQEMNAVR

SEQ ID NO: 45466 - protein, 9 aa, Homo Sapiens
DVQERLVYR

SEQ ID NO: 45467 - protein, 9 aa, Homo Sapiens
DVQHFKVLR

SEQ ID NO: 45468 - protein, 9 aa, Homo Sapiens
DVQPKLWAR

SEQ ID NO: 45469 - protein, 9 aa, Homo Sapiens
DVQRHPFFR

SEQ ID NO: 45470 - protein, 9 aa, Homo Sapiens
DVQRKVTYR

SEQ ID NO: 45471 - protein, 9 aa, Homo Sapiens
DVQSVQEKR

SEQ ID NO: 45472 - protein, 9 aa, Homo Sapiens
DVRDRMIHR

SEQ ID NO: 45473 - protein, 9 aa, Homo Sapiens
DVRERIIKR

SEQ ID NO: 45474 - protein, 9 aa, Homo Sapiens
DVRFPEKRR

SEQ ID NO: 45475 - protein, 9 aa, Homo Sapiens
DVRHYLQGR

SEQ ID NO: 45476 - protein, 9 aa, Homo Sapiens
DVRMGGSFR

SEQ ID NO: 45477 - protein, 9 aa, Homo Sapiens
DVRQKVLER

SEQ ID NO: 45478 - protein, 9 aa, Homo Sapiens
DVRQYVVRK

SEQ ID NO: 45479 - protein, 9 aa, Homo Sapiens
DVRSVTSVR

SEQ ID NO: 45480 - protein, 9 aa, Homo Sapiens
DVRVQEVPK

SEQ ID NO: 45481 - protein, 9 aa, Homo Sapiens
DVSHPIIYR

SEQ ID NO: 45482 - protein, 9 aa, Homo Sapiens
DVSHTFYPR

SEQ ID NO: 45483 - protein, 9 aa, Homo Sapiens
DVSLPFVSR

SEQ ID NO: 45484 - protein, 9 aa, Homo Sapiens
DVSTIKAPR

SEQ ID NO: 45485 - protein, 9 aa, Homo Sapiens
DVSTTIYNR

SEQ ID NO: 45486 - protein, 9 aa, Homo Sapiens
DVTDFISHL

SEQ ID NO: 45487 - protein, 9 aa, Homo Sapiens
DVTIRQSYR

SEQ ID NO: 45488 - protein, 9 aa, Homo Sapiens
DVTSCISYR

SEQ ID NO: 45489 - protein, 9 aa, Homo Sapiens
DVVGRFNER

SEQ ID NO: 45490 - protein, 9 aa, Homo Sapiens
DVVIVKNGR

SEQ ID NO: 45491 - protein, 9 aa, Homo Sapiens
DVVSKFLNR

SEQ ID NO: 45492 - protein, 9 aa, Homo Sapiens
DVVVSRWLR

SEQ ID NO: 45493 - protein, 9 aa, Homo Sapiens
DVVYNAVHR

SEQ ID NO: 45494 - protein, 9 aa, Homo Sapiens
DVWRKKYMR

SEQ ID NO: 45495 - protein, 9 aa, Homo Sapiens
DVWVNESER

SEQ ID NO: 45496 - protein, 9 aa, Homo Sapiens
DVYAKYVLR

SEQ ID NO: 45497 - protein, 9 aa, Homo Sapiens
DVYDYKIAR

SEQ ID NO: 45498 - protein, 9 aa, Homo Sapiens
DVYFPKDLR

SEQ ID NO: 45499 - protein, 9 aa, Homo Sapiens
DVYPEIIER

SEQ ID NO: 45500 - protein, 9 aa, Homo Sapiens
DVYRGLQER

SEQ ID NO: 45501 - protein, 9 aa, Homo Sapiens
DVYTPKSSR

SEQ ID NO: 45502 - protein, 9 aa, Homo Sapiens
DWDLITRQK

SEQ ID NO: 45503 - protein, 9 aa, Homo Sapiens
DWKEKYINR

SEQ ID NO: 45504 - protein, 9 aa, Homo Sapiens
DWKTISKER

SEQ ID NO: 45505 - protein, 9 aa, Homo Sapiens
DWQRHAIYR

SEQ ID NO: 45506 - protein, 9 aa, Homo Sapiens
DYERIINLR

SEQ ID NO: 45507 - protein, 9 aa, Homo Sapiens
DYFDALYKR

SEQ ID NO: 45508 - protein, 9 aa, Homo Sapiens
DYFKKPQSR

SEQ ID NO: 45509 - protein, 9 aa, Homo Sapiens
DYGHLSVYR

SEQ ID NO: 45510 - protein, 9 aa, Homo Sapiens
DYHTLPRAR

SEQ ID NO: 45511 - protein, 9 aa, Homo Sapiens
DYIIRNTDR

SEQ ID NO: 45512 - protein, 9 aa, Homo Sapiens
DYIKLYVRR

SEQ ID NO: 45513 - protein, 9 aa, Homo Sapiens
DYIKVFKPK

SEQ ID NO: 45514 - protein, 9 aa, Homo Sapiens
DYIVKIFDR

SEQ ID NO: 45515 - protein, 9 aa, Homo Sapiens
DYKGCLIRR

SEQ ID NO: 45516 - protein, 9 aa, Homo Sapiens
DYKGEEELR

SEQ ID NO: 45517 - protein, 9 aa, Homo Sapiens
DYKLHFIFR

SEQ ID NO: 45518 - protein, 9 aa, Homo Sapiens
DYKTIAKER

SEQ ID NO: 45519 - protein, 9 aa, Homo Sapiens
DYLEFQKNR

SEQ ID NO: 45520 - protein, 9 aa, Homo Sapiens
DYLENIFVK

SEQ ID NO: 45521 - protein, 9 aa, Homo Sapiens
DYLEQQVAR

SEQ ID NO: 45522 - protein, 9 aa, Homo Sapiens
DYLGTVAAR

SEQ ID NO: 45523 - protein, 9 aa, Homo Sapiens
DYLRFLQKR

SEQ ID NO: 45524 - protein, 9 aa, Homo Sapiens
DYLVFANNR

SEQ ID NO: 45525 - protein, 9 aa, Homo Sapiens
DYLVPPALR

SEQ ID NO: 45526 - protein, 9 aa, Homo Sapiens
DYNLIVIER

SEQ ID NO: 45527 - protein, 9 aa, Homo Sapiens
DYNPLYKER

SEQ ID NO: 45528 - protein, 9 aa, Homo Sapiens
DYNPSFAIR

SEQ ID NO: 45529 - protein, 9 aa, Homo Sapiens
DYQFCYSFR

SEQ ID NO: 45530 - protein, 9 aa, Homo Sapiens
DYQTHFRLR

SEQ ID NO: 45531 - protein, 9 aa, Homo Sapiens
DYRALVHER

SEQ ID NO: 45532 - protein, 9 aa, Homo Sapiens
DYRDTVVKR

SEQ ID NO: 45533 - protein, 9 aa, Homo Sapiens
DYRMKEWSR

SEQ ID NO: 45534 - protein, 9 aa, Homo Sapiens
DYSKFIQTR

SEQ ID NO: 45535 - protein, 9 aa, Homo Sapiens
DYSQSLHAR

SEQ ID NO: 45536 - protein, 9 aa, Homo Sapiens
DYTSHITCR

SEQ ID NO: 45537 - protein, 9 aa, Homo Sapiens
DYVDIVQGR

SEQ ID NO: 45538 - protein, 9 aa, Homo Sapiens
DYVPETVYR

SEQ ID NO: 45539 - protein, 9 aa, Homo Sapiens
DYVPYVPLR

SEQ ID NO: 45540 - protein, 9 aa, Homo Sapiens
DYYARVEGR

SEQ ID NO: 45541 - protein, 9 aa, Homo Sapiens
DYYSLLNVR

SEQ ID NO: 45542 - protein, 9 aa, Homo Sapiens
DYYSRLRGR

SEQ ID NO: 45543 - protein, 9 aa, Homo Sapiens
EAAAIIAQR

SEQ ID NO: 45544 - protein, 9 aa, Homo Sapiens
EAHARIHLR

SEQ ID NO: 45545 - protein, 9 aa, Homo Sapiens
EAKAPILKR

SEQ ID NO: 45546 - protein, 9 aa, Homo Sapiens
EAKFPTMNR

SEQ ID NO: 45547 - protein, 9 aa, Homo Sapiens
EAKLREELR

SEQ ID NO: 45548 - protein, 9 aa, Homo Sapiens
EALGALVCR

SEQ ID NO: 45549 - protein, 9 aa, Homo Sapiens
EALLPYTER

SEQ ID NO: 45550 - protein, 9 aa, Homo Sapiens
EALNQVTQR

SEQ ID NO: 45551 - protein, 9 aa, Homo Sapiens
EALNVLVNR

SEQ ID NO: 45552 - protein, 9 aa, Homo Sapiens
EALPGLQRR

SEQ ID NO: 45553 - protein, 9 aa, Homo Sapiens
EALRRLEER

SEQ ID NO: 45554 - protein, 9 aa, Homo Sapiens
EALTALMSR

SEQ ID NO: 45555 - protein, 9 aa, Homo Sapiens
EALVPVIHR

SEQ ID NO: 45556 - protein, 9 aa, Homo Sapiens
EALYDICFR

SEQ ID NO: 45557 - protein, 9 aa, Homo Sapiens
EAMALPLYR

SEQ ID NO: 45558 - protein, 9 aa, Homo Sapiens
EAMKHVYFR

SEQ ID NO: 45559 - protein, 9 aa, Homo Sapiens
EAMLWERHR

SEQ ID NO: 45560 - protein, 9 aa, Homo Sapiens
EAMRRLQER

SEQ ID NO: 45561 - protein, 9 aa, Homo Sapiens
EAMTIFQNR

SEQ ID NO: 45562 - protein, 9 aa, Homo Sapiens
EAQAWEQAR

SEQ ID NO: 45563 - protein, 9 aa, Homo Sapiens
EAQLPYVCR

SEQ ID NO: 45564 - protein, 9 aa, Homo Sapiens
EAQRITGLR

SEQ ID NO: 45565 - protein, 9 aa, Homo Sapiens
EAQVKIWRR

SEQ ID NO: 45566 - protein, 9 aa, Homo Sapiens
EARAFGVTR

SEQ ID NO: 45567 - protein, 9 aa, Homo Sapiens
EARAPHVCR

SEQ ID NO: 45568 - protein, 9 aa, Homo Sapiens
EARLLEEQR

SEQ ID NO: 45569 - protein, 9 aa, Homo Sapiens
EAVKLIIGR

SEQ ID NO: 45570 - protein, 9 aa, Homo Sapiens
EAVLWEALR

SEQ ID NO: 45571 - protein, 9 aa, Homo Sapiens
EAYLPETFR

SEQ ID NO: 45572 - protein, 9 aa, Homo Sapiens
EAYSVGTGR

SEQ ID NO: 45573 - protein, 9 aa, Homo Sapiens
EDTQIPTSR

SEQ ID NO: 45574 - protein, 9 aa, Homo Sapiens
EFFIPRVGR

SEQ ID NO: 45575 - protein, 9 aa, Homo Sapiens
EFFSINAQR

SEQ ID NO: 45576 - protein, 9 aa, Homo Sapiens
EFIEITTER

SEQ ID NO: 45577 - protein, 9 aa, Homo Sapiens
EFKDKTWTR

SEQ ID NO: 45578 - protein, 9 aa, Homo Sapiens
EFKEDIHNR

SEQ ID NO: 45579 - protein, 9 aa, Homo Sapiens
EFLKLDRER

SEQ ID NO: 45580 - protein, 9 aa, Homo Sapiens
EFNPNFVAR

SEQ ID NO: 45581 - protein, 9 aa, Homo Sapiens
EFQDFTVPR

SEQ ID NO: 45582 - protein, 9 aa, Homo Sapiens
EFQQLPYHR

SEQ ID NO: 45583 - protein, 9 aa, Homo Sapiens
EFRAGMSNR

SEQ ID NO: 45584 - protein, 9 aa, Homo Sapiens
EFRDCISSR

SEQ ID NO: 45585 - protein, 9 aa, Homo Sapiens
EFREPRPPR

SEQ ID NO: 45586 - protein, 9 aa, Homo Sapiens
EFRQRIILR

SEQ ID NO: 45587 - protein, 9 aa, Homo Sapiens
EFVDLYVPR

SEQ ID NO: 45588 - protein, 9 aa, Homo Sapiens
EFYNLVRFR

SEQ ID NO: 45589 - protein, 9 aa, Homo Sapiens
EFYSPEACR

SEQ ID NO: 45590 - protein, 9 aa, Homo Sapiens
EICGNYTYR

SEQ ID NO: 45591 - protein, 9 aa, Homo Sapiens
EIGHFLRER

SEQ ID NO: 45592 - protein, 9 aa, Homo Sapiens
EIKERIAKR

SEQ ID NO: 45593 - protein, 9 aa, Homo Sapiens
EIKHFVSER

SEQ ID NO: 45594 - protein, 9 aa, Homo Sapiens
EILEVATAR

SEQ ID NO: 45595 - protein, 9 aa, Homo Sapiens
EILHHLSER

SEQ ID NO: 45596 - protein, 9 aa, Homo Sapiens
EILKRNIQR

SEQ ID NO: 45597 - protein, 9 aa, Homo Sapiens
EILRGLTPR

SEQ ID NO: 45598 - protein, 9 aa, Homo Sapiens
EILRRLTGR

SEQ ID NO: 45599 - protein, 9 aa, Homo Sapiens
EILSVLSHR

SEQ ID NO: 45600 - protein, 9 aa, Homo Sapiens
EINKLLAHR

SEQ ID NO: 45601 - protein, 9 aa, Homo Sapiens
EINMWVSQR

SEQ ID NO: 45602 - protein, 9 aa, Homo Sapiens
EIRKPEVLR

SEQ ID NO: 45603 - protein, 9 aa, Homo Sapiens
EISGTFTHR

SEQ ID NO: 45604 - protein, 9 aa, Homo Sapiens
EIYEYIIFR

SEQ ID NO: 45605 - protein, 9 aa, Homo Sapiens
EIYGVTHTR

SEQ ID NO: 45606 - protein, 9 aa, Homo Sapiens
EIYRPPASR

SEQ ID NO: 45607 - protein, 9 aa, Homo Sapiens
ELFADKVPK

SEQ ID NO: 45608 - protein, 9 aa, Homo Sapiens
ELFGRVTSR

SEQ ID NO: 45609 - protein, 9 aa, Homo Sapiens
ELFNRIEKR

SEQ ID NO: 45610 - protein, 9 aa, Homo Sapiens
ELKGIYKDR

SEQ ID NO: 45611 - protein, 9 aa, Homo Sapiens
ELKRLYVER

SEQ ID NO: 45612 - protein, 9 aa, Homo Sapiens
ELNKIFALR

SEQ ID NO: 45613 - protein, 9 aa, Homo Sapiens
ELQREISNR

SEQ ID NO: 45614 - protein, 9 aa, Homo Sapiens
ELRGKLVAR

SEQ ID NO: 45615 - protein, 9 aa, Homo Sapiens
EMFTPILGR

SEQ ID NO: 45616 - protein, 9 aa, Homo Sapiens
EMKLQVTQR

SEQ ID NO: 45617 - protein, 9 aa, Homo Sapiens
EMLEILINR

SEQ ID NO: 45618 - protein, 9 aa, Homo Sapiens
EMLQQIANR

SEQ ID NO: 45619 - protein, 9 aa, Homo Sapiens
EMLRAAVKR

SEQ ID NO: 45620 - protein, 9 aa, Homo Sapiens
EMMADMYNR

SEQ ID NO: 45621 - protein, 9 aa, Homo Sapiens
EMQAKVAVR

SEQ ID NO: 45622 - protein, 9 aa, Homo Sapiens
EMQNLVHRR

SEQ ID NO: 45623 - protein, 9 aa, Homo Sapiens
EMREMLTHR

SEQ ID NO: 45624 - protein, 9 aa, Homo Sapiens
EMRQMFVQR

SEQ ID NO: 45625 - protein, 9 aa, Homo Sapiens
ENFAPGTTR

SEQ ID NO: 45626 - protein, 9 aa, Homo Sapiens
ENFGNTTPR

SEQ ID NO: 45627 - protein, 9 aa, Homo Sapiens
ENKPLYQMR

SEQ ID NO: 45628 - protein, 9 aa, Homo Sapiens
ENLPRTVIR

SEQ ID NO: 45629 - protein, 9 aa, Homo Sapiens
ENRKPVSFR

SEQ ID NO: 45630 - protein, 9 aa, Homo Sapiens
EPLLRENPR

SEQ ID NO: 45631 - protein, 9 aa, Homo Sapiens
ESKILHLQR

SEQ ID NO: 45632 - protein, 9 aa, Homo Sapiens
ESLEWLASR

SEQ ID NO: 45633 - protein, 9 aa, Homo Sapiens
ESLIPSANR

SEQ ID NO: 45634 - protein, 9 aa, Homo Sapiens
ESLNFLIGR

SEQ ID NO: 45635 - protein, 9 aa, Homo Sapiens
ESLPRVVKR

SEQ ID NO: 45636 - protein, 9 aa, Homo Sapiens
ESMEPKVFR

SEQ ID NO: 45637 - protein, 9 aa, Homo Sapiens
ESMQRFHNR

SEQ ID NO: 45638 - protein, 9 aa, Homo Sapiens
ESYRPPKSR

SEQ ID NO: 45639 - protein, 9 aa, Homo Sapiens
ETAFLSWFR

SEQ ID NO: 45640 - protein, 9 aa, Homo Sapiens
ETCDKVFSR

SEQ ID NO: 45641 - protein, 9 aa, Homo Sapiens
ETDLKTICR

SEQ ID NO: 45642 - protein, 9 aa, Homo Sapiens
ETEREYFNR

SEQ ID NO: 45643 - protein, 9 aa, Homo Sapiens
ETFNSITKR

SEQ ID NO: 45644 - protein, 9 aa, Homo Sapiens
ETIAPKIAR

SEQ ID NO: 45645 - protein, 9 aa, Homo Sapiens
ETIGKKFEK

SEQ ID NO: 45646 - protein, 9 aa, Homo Sapiens
ETILRTNKR

SEQ ID NO: 45647 - protein, 9 aa, Homo Sapiens
ETIPSFTGR

SEQ ID NO: 45648 - protein, 9 aa, Homo Sapiens
ETKRIFLDR

SEQ ID NO: 45649 - protein, 9 aa, Homo Sapiens
ETLETIINR

SEQ ID NO: 45650 - protein, 9 aa, Homo Sapiens
ETLLLQAER

SEQ ID NO: 45651 - protein, 9 aa, Homo Sapiens
ETLMETHER

SEQ ID NO: 45652 - protein, 9 aa, Homo Sapiens
ETLNQMIAR

SEQ ID NO: 45653 - protein, 9 aa, Homo Sapiens
ETMPSPYGR

SEQ ID NO: 45654 - protein, 9 aa, Homo Sapiens
ETNYGIPQR

SEQ ID NO: 45655 - protein, 9 aa, Homo Sapiens
ETQLPVSFR

SEQ ID NO: 45656 - protein, 9 aa, Homo Sapiens
ETRAEFAER

SEQ ID NO: 45657 - protein, 9 aa, Homo Sapiens
ETREVQNLR

SEQ ID NO: 45658 - protein, 9 aa, Homo Sapiens
ETRQITWSR

SEQ ID NO: 45659 - protein, 9 aa, Homo Sapiens
ETYKYLYGR

SEQ ID NO: 45660 - protein, 9 aa, Homo Sapiens
ETYLHRIGR

SEQ ID NO: 45661 - protein, 9 aa, Homo Sapiens
ETYLMKHMR

SEQ ID NO: 45662 - protein, 9 aa, Homo Sapiens
ETYLNENLR

SEQ ID NO: 45663 - protein, 9 aa, Homo Sapiens
EVAFPHHPR

SEQ ID NO: 45664 - protein, 9 aa, Homo Sapiens
EVAGIVAAR

SEQ ID NO: 45665 - protein, 9 aa, Homo Sapiens
EVAPPEYHR

SEQ ID NO: 45666 - protein, 9 aa, Homo Sapiens
EVAQFLTGR

SEQ ID NO: 45667 - protein, 9 aa, Homo Sapiens
EVASVWVER

SEQ ID NO: 45668 - protein, 9 aa, Homo Sapiens
EVFDHMMKR

SEQ ID NO: 45669 - protein, 9 aa, Homo Sapiens
EVFDKFSNK

SEQ ID NO: 45670 - protein, 9 aa, Homo Sapiens
EVFEYIIFR

SEQ ID NO: 45671 - protein, 9 aa, Homo Sapiens
EVFGQITER

SEQ ID NO: 45672 - protein, 9 aa, Homo Sapiens
EVFLHVVKR

SEQ ID NO: 45673 - protein, 9 aa, Homo Sapiens
EVFQNANFR

SEQ ID NO: 45674 - protein, 9 aa, Homo Sapiens
EVFSHILKR

SEQ ID NO: 45675 - protein, 9 aa, Homo Sapiens
EVFTPVFER

SEQ ID NO: 45676 - protein, 9 aa, Homo Sapiens
EVFTPVVQR

SEQ ID NO: 45677 - protein, 9 aa, Homo Sapiens
EVFVGKIPR

SEQ ID NO: 45678 - protein, 9 aa, Homo Sapiens
EVFYFEVTR

SEQ ID NO: 45679 - protein, 9 aa, Homo Sapiens
EVHAVVTVR

SEQ ID NO: 45680 - protein, 9 aa, Homo Sapiens
EVHMLLEHR

SEQ ID NO: 45681 - protein, 9 aa, Homo Sapiens
EVINDYHFR

SEQ ID NO: 45682 - protein, 9 aa, Homo Sapiens
EVISLINTR

SEQ ID NO: 45683 - protein, 9 aa, Homo Sapiens
EVKKICMQR

SEQ ID NO: 45684 - protein, 9 aa, Homo Sapiens
EVKPSIRAR

SEQ ID NO: 45685 - protein, 9 aa, Homo Sapiens
EVKSITKER

SEQ ID NO: 45686 - protein, 9 aa, Homo Sapiens
EVLAEFERR

SEQ ID NO: 45687 - protein, 9 aa, Homo Sapiens
EVLDHKEFK

SEQ ID NO: 45688 - protein, 9 aa, Homo Sapiens
EVLDRVFER

SEQ ID NO: 45689 - protein, 9 aa, Homo Sapiens
EVLGPHLER

SEQ ID NO: 45690 - protein, 9 aa, Homo Sapiens
EVLHGLIGR

SEQ ID NO: 45691 - protein, 9 aa, Homo Sapiens
EVLKHLKER

SEQ ID NO: 45692 - protein, 9 aa, Homo Sapiens
EVLKLLVAR

SEQ ID NO: 45693 - protein, 9 aa, Homo Sapiens
EVLLVSSSR

SEQ ID NO: 45694 - protein, 9 aa, Homo Sapiens
EVLNEVNRR

SEQ ID NO: 45695 - protein, 9 aa, Homo Sapiens
EVLPKPRMR

SEQ ID NO: 45696 - protein, 9 aa, Homo Sapiens
EVLQPLQQR

SEQ ID NO: 45697 - protein, 9 aa, Homo Sapiens
EVLSCLYNR

SEQ ID NO: 45698 - protein, 9 aa, Homo Sapiens
EVMRILISR

SEQ ID NO: 45699 - protein, 9 aa, Homo Sapiens
EVNAWLVHR

SEQ ID NO: 45700 - protein, 9 aa, Homo Sapiens
EVNCPFQKR

SEQ ID NO: 45701 - protein, 9 aa, Homo Sapiens
EVNDKRYLR

SEQ ID NO: 45702 - protein, 9 aa, Homo Sapiens
EVNDRPVRR

SEQ ID NO: 45703 - protein, 9 aa, Homo Sapiens
EVNNELANR

SEQ ID NO: 45704 - protein, 9 aa, Homo Sapiens
EVPELYHQR

SEQ ID NO: 45705 - protein, 9 aa, Homo Sapiens
EVPKHLVGR

SEQ ID NO: 45706 - protein, 9 aa, Homo Sapiens
EVQAHPFFR

SEQ ID NO: 45707 - protein, 9 aa, Homo Sapiens
EVQGEIHLR

SEQ ID NO: 45708 - protein, 9 aa, Homo Sapiens
EVQPPRVDR

SEQ ID NO: 45709 - protein, 9 aa, Homo Sapiens
EVQRILHQR

SEQ ID NO: 45710 - protein, 9 aa, Homo Sapiens
EVQVVNTER

SEQ ID NO: 45711 - protein, 9 aa, Homo Sapiens
EVRGGGLTR

SEQ ID NO: 45712 - protein, 9 aa, Homo Sapiens
EVRKLIIRR

SEQ ID NO: 45713 - protein, 9 aa, Homo Sapiens
EVRKLMHVR

SEQ ID NO: 45714 - protein, 9 aa, Homo Sapiens
EVRLGGSLR

SEQ ID NO: 45715 - protein, 9 aa, Homo Sapiens
EVRPVETLR

SEQ ID NO: 45716 - protein, 9 aa, Homo Sapiens
EVRRLVIGR

SEQ ID NO: 45717 - protein, 9 aa, Homo Sapiens
EVRSQLKLR

SEQ ID NO: 45718 - protein, 9 aa, Homo Sapiens
EVSTVNVRR

SEQ ID NO: 45719 - protein, 9 aa, Homo Sapiens
EVTAALRER

SEQ ID NO: 45720 - protein, 9 aa, Homo Sapiens
EVVNKRFVR

SEQ ID NO: 45721 - protein, 9 aa, Homo Sapiens
EVVPEPVAR

SEQ ID NO: 45722 - protein, 9 aa, Homo Sapiens
EVVQITWNR

SEQ ID NO: 45723 - protein, 9 aa, Homo Sapiens
EVVYRFTAR

SEQ ID NO: 45724 - protein, 9 aa, Homo Sapiens
EVWKGIKKR

SEQ ID NO: 45725 - protein, 9 aa, Homo Sapiens
EVWPHSTER

SEQ ID NO: 45726 - protein, 9 aa, Homo Sapiens
EVYKELRLR

SEQ ID NO: 45727 - protein, 9 aa, Homo Sapiens
EVYTRLKSR

SEQ ID NO: 45728 - protein, 9 aa, Homo Sapiens
EYAEFQYRR

SEQ ID NO: 45729 - protein, 9 aa, Homo Sapiens
EYAEYIYQR

SEQ ID NO: 45730 - protein, 9 aa, Homo Sapiens
EYAGLKVAR

SEQ ID NO: 45731 - protein, 9 aa, Homo Sapiens
EYAHTRYFR

SEQ ID NO: 45732 - protein, 9 aa, Homo Sapiens
EYAKLLAKR

SEQ ID NO: 45733 - protein, 9 aa, Homo Sapiens
EYFSDLPPR

SEQ ID NO: 45734 - protein, 9 aa, Homo Sapiens
EYHKFLIGK

SEQ ID NO: 45735 - protein, 9 aa, Homo Sapiens
EYHWRKHLR

SEQ ID NO: 45736 - protein, 9 aa, Homo Sapiens
EYIEARVTK

SEQ ID NO: 45737 - protein, 9 aa, Homo Sapiens
EYIELHRKR

SEQ ID NO: 45738 - protein, 9 aa, Homo Sapiens
EYIFLAVGR

SEQ ID NO: 45739 - protein, 9 aa, Homo Sapiens
EYIHDFNRR

SEQ ID NO: 45740 - protein, 9 aa, Homo Sapiens
EYIKNWRPR

SEQ ID NO: 45741 - protein, 9 aa, Homo Sapiens
EYIKTWRPR

SEQ ID NO: 45742 - protein, 9 aa, Homo Sapiens
EYISTEFNR

SEQ ID NO: 45743 - protein, 9 aa, Homo Sapiens
EYKDIFIRH

SEQ ID NO: 45744 - protein, 9 aa, Homo Sapiens
EYKMILVVR

SEQ ID NO: 45745 - protein, 9 aa, Homo Sapiens
EYLDMKNTR

SEQ ID NO: 45746 - protein, 9 aa, Homo Sapiens
EYLDTYNNR

SEQ ID NO: 45747 - protein, 9 aa, Homo Sapiens
EYLEKIKQR

SEQ ID NO: 45748 - protein, 9 aa, Homo Sapiens
EYLHKAVFR

SEQ ID NO: 45749 - protein, 9 aa, Homo Sapiens
EYLHRFYGR

SEQ ID NO: 45750 - protein, 9 aa, Homo Sapiens
EYLKNIIYR

SEQ ID NO: 45751 - protein, 9 aa, Homo Sapiens
EYLQKMVQR

SEQ ID NO: 45752 - protein, 9 aa, Homo Sapiens
EYLRWKQER

SEQ ID NO: 45753 - protein, 9 aa, Homo Sapiens
EYLSLETTR

SEQ ID NO: 45754 - protein, 9 aa, Homo Sapiens
EYLTSTACR

SEQ ID NO: 45755 - protein, 9 aa, Homo Sapiens
EYMEKIKQR

SEQ ID NO: 45756 - protein, 9 aa, Homo Sapiens
EYMRVISQR

SEQ ID NO: 45757 - protein, 9 aa, Homo Sapiens
EYNVRVASR

SEQ ID NO: 45758 - protein, 9 aa, Homo Sapiens
EYQILVVTR

SEQ ID NO: 45759 - protein, 9 aa, Homo Sapiens
EYRASLQQR

SEQ ID NO: 45760 - protein, 9 aa, Homo Sapiens
EYRKYIHSR

SEQ ID NO: 45761 - protein, 9 aa, Homo Sapiens
EYSHRMWGR

SEQ ID NO: 45762 - protein, 9 aa, Homo Sapiens
EYTEGISQR

SEQ ID NO: 45763 - protein, 9 aa, Homo Sapiens
EYVDRLSKR

SEQ ID NO: 45764 - protein, 9 aa, Homo Sapiens
EYVETVTSR

SEQ ID NO: 45765 - protein, 9 aa, Homo Sapiens
EYVGPRLSR

SEQ ID NO: 45766 - protein, 9 aa, Homo Sapiens
EYVPETVYR

SEQ ID NO: 45767 - protein, 9 aa, Homo Sapiens
EYWDRQRNR

SEQ ID NO: 45768 - protein, 9 aa, Homo Sapiens
EYYKHPISR

SEQ ID NO: 45769 - protein, 9 aa, Homo Sapiens
FAFGGLCER

SEQ ID NO: 45770 - protein, 9 aa, Homo Sapiens
FFGERRIPR

SEQ ID NO: 45771 - protein, 9 aa, Homo Sapiens
FFNDRPWRR

SEQ ID NO: 45772 - protein, 9 aa, Homo Sapiens
FLFVPPQFR

SEQ ID NO: 45773 - protein, 9 aa, Homo Sapiens
FTNKPTTFR

SEQ ID NO: 45774 - protein, 9 aa, Homo Sapiens
FVVGTERGR

SEQ ID NO: 45775 - protein, 9 aa, Homo Sapiens
FYKAIQKRR

SEQ ID NO: 45776 - protein, 9 aa, Homo Sapiens
GVMSPPLSR

SEQ ID NO: 45777 - protein, 9 aa, Homo Sapiens
HAKAVVSLR

SEQ ID NO: 45778 - protein, 9 aa, Homo Sapiens
HALELVVSR

SEQ ID NO: 45779 - protein, 9 aa, Homo Sapiens
HANPRLWLR

SEQ ID NO: 45780 - protein, 9 aa, Homo Sapiens
HAQLLEQHR

SEQ ID NO: 45781 - protein, 9 aa, Homo Sapiens
HAQSIGMNR

SEQ ID NO: 45782 - protein, 9 aa, Homo Sapiens
HAREIFDSR

SEQ ID NO: 45783 - protein, 9 aa, Homo Sapiens
HARYILTNR

SEQ ID NO: 45784 - protein, 9 aa, Homo Sapiens
HAWEPTGTR

SEQ ID NO: 45785 - protein, 9 aa, Homo Sapiens
HIFRPQIER

SEQ ID NO: 45786 - protein, 9 aa, Homo Sapiens
HINTVFVLR

SEQ ID NO: 45787 - protein, 9 aa, Homo Sapiens
HIQEIRTLR

SEQ ID NO: 45788 - protein, 9 aa, Homo Sapiens
HLFDHVVNR

SEQ ID NO: 45789 - protein, 9 aa, Homo Sapiens
HLRDFNFSR

SEQ ID NO: 45790 - protein, 9 aa, Homo Sapiens
HMINNHVPR

SEQ ID NO: 45791 - protein, 9 aa, Homo Sapiens
HNQGPVIKR

SEQ ID NO: 45792 - protein, 9 aa, Homo Sapiens
HNTMPSQFR

SEQ ID NO: 45793 - protein, 9 aa, Homo Sapiens
HNYQPCVQR

SEQ ID NO: 45794 - protein, 9 aa, Homo Sapiens
HSKGFGFVR

SEQ ID NO: 45795 - protein, 9 aa, Homo Sapiens
HSLAPMYYR

SEQ ID NO: 45796 - protein, 9 aa, Homo Sapiens
HSLAVFIKR

SEQ ID NO: 45797 - protein, 9 aa, Homo Sapiens
HSLPPIARR

SEQ ID NO: 45798 - protein, 9 aa, Homo Sapiens
HSMALIHNR

SEQ ID NO: 45799 - protein, 9 aa, Homo Sapiens
HSMDFVAYR

SEQ ID NO: 45800 - protein, 9 aa, Homo Sapiens
HSRVILQGR

SEQ ID NO: 45801 - protein, 9 aa, Homo Sapiens
HTFDHINKR

SEQ ID NO: 45802 - protein, 9 aa, Homo Sapiens
HTLEPLIPR

SEQ ID NO: 45803 - protein, 9 aa, Homo Sapiens
HTLKRDVLR

SEQ ID NO: 45804 - protein, 9 aa, Homo Sapiens
HVFLRTTGR

SEQ ID NO: 45805 - protein, 9 aa, Homo Sapiens
HVHEPNPLR

SEQ ID NO: 45806 - protein, 9 aa, Homo Sapiens
HYVPKIYCR

SEQ ID NO: 45807 - protein, 9 aa, Homo Sapiens
IAAVPPQYR

SEQ ID NO: 45808 - protein, 9 aa, Homo Sapiens
IAFAPNLGR

SEQ ID NO: 45809 - protein, 9 aa, Homo Sapiens
IAQARIFPR

SEQ ID NO: 45810 - protein, 9 aa, Homo Sapiens
IFETIVNNR

SEQ ID NO: 45811 - protein, 9 aa, Homo Sapiens
IFKGVFVHR

SEQ ID NO: 45812 - protein, 9 aa, Homo Sapiens
IFKPRFAMR

SEQ ID NO: 45813 - protein, 9 aa, Homo Sapiens
IFQSISFNR

SEQ ID NO: 45814 - protein, 9 aa, Homo Sapiens
IFYTAIVNR

SEQ ID NO: 45815 - protein, 9 aa, Homo Sapiens
IIRDRQEVR

SEQ ID NO: 45816 - protein, 9 aa, Homo Sapiens
ILQILSLNR

SEQ ID NO: 45817 - protein, 9 aa, Homo Sapiens
IMAELLTGR

SEQ ID NO: 45818 - protein, 9 aa, Homo Sapiens
INKDVTHPR

SEQ ID NO: 45819 - protein, 9 aa, Homo Sapiens
INRPIIVFR

SEQ ID NO: 45820 - protein, 9 aa, Homo Sapiens
INYDLPTNR

SEQ ID NO: 45821 - protein, 9 aa, Homo Sapiens
IPLAPNTGR

SEQ ID NO: 45822 - protein, 9 aa, Homo Sapiens
IPRTPSSFR

SEQ ID NO: 45823 - protein, 9 aa, Homo Sapiens
IPYTPAMQR

SEQ ID NO: 45824 - protein, 9 aa, Homo Sapiens
ITYLMEHKR

SEQ ID NO: 45825 - protein, 9 aa, Homo Sapiens
IVKPPASAR

SEQ ID NO: 45826 - protein, 9 aa, Homo Sapiens
IVNENLVER

SEQ ID NO: 45827 - protein, 9 aa, Homo Sapiens
IVNHPKVGR

SEQ ID NO: 45828 - protein, 9 aa, Homo Sapiens
IYKAISSNR

SEQ ID NO: 45829 - protein, 9 aa, Homo Sapiens
IYQDSFEQR

SEQ ID NO: 45830 - protein, 9 aa, Homo Sapiens
IYSGYIRNR

SEQ ID NO: 45831 - protein, 9 aa, Homo Sapiens
KPSNIFISR

SEQ ID NO: 45832 - protein, 9 aa, Homo Sapiens
LAAEPKVNR

SEQ ID NO: 45833 - protein, 9 aa, Homo Sapiens
LAAVREAER

SEQ ID NO: 45834 - protein, 9 aa, Homo Sapiens
LALLGNHLK

SEQ ID NO: 45835 - protein, 9 aa, Homo Sapiens
LALNIIQNR

SEQ ID NO: 45836 - protein, 9 aa, Homo Sapiens
LAQAWIAQR

SEQ ID NO: 45837 - protein, 9 aa, Homo Sapiens
LAQFHFTNR

SEQ ID NO: 45838 - protein, 9 aa, Homo Sapiens
LARDVYVGR

SEQ ID NO: 45839 - protein, 9 aa, Homo Sapiens
LAWHPTCGR

SEQ ID NO: 45840 - protein, 9 aa, Homo Sapiens
LDTNLPANR

SEQ ID NO: 45841 - protein, 9 aa, Homo Sapiens
LFKSKAYER

SEQ ID NO: 45842 - protein, 9 aa, Homo Sapiens
LFRGRISER

SEQ ID NO: 45843 - protein, 9 aa, Homo Sapiens
LHIGSAHNR

SEQ ID NO: 45844 - protein, 9 aa, Homo Sapiens
LINNKIANR

SEQ ID NO: 45845 - protein, 9 aa, Homo Sapiens
LLQEKRFLR

SEQ ID NO: 45846 - protein, 9 aa, Homo Sapiens
LMFDKTTNR

SEQ ID NO: 45847 - protein, 9 aa, Homo Sapiens
LMNIHVTPR

SEQ ID NO: 45848 - protein, 9 aa, Homo Sapiens
LNAESRVNR

SEQ ID NO: 45849 - protein, 9 aa, Homo Sapiens
LNYVPFAER

SEQ ID NO: 45850 - protein, 9 aa, Homo Sapiens
LPLSPASTR

SEQ ID NO: 45851 - protein, 9 aa, Homo Sapiens
LPQGHFQER

SEQ ID NO: 45852 - protein, 9 aa, Homo Sapiens
LPWVPPHLR

SEQ ID NO: 45853 - protein, 9 aa, Homo Sapiens
LSNRPIMFR

SEQ ID NO: 45854 - protein, 9 aa, Homo Sapiens
LSYQPVAQR

SEQ ID NO: 45855 - protein, 9 aa, Homo Sapiens
LTQYRVSLR

SEQ ID NO: 45856 - protein, 9 aa, Homo Sapiens
LVATHDYYR

SEQ ID NO: 45857 - protein, 9 aa, Homo Sapiens
LVREIRQYR

SEQ ID NO: 45858 - protein, 9 aa, Homo Sapiens
LVVTKIFQK

SEQ ID NO: 45859 - protein, 9 aa, Homo Sapiens
LYQIITVER

SEQ ID NO: 45860 - protein, 9 aa, Homo Sapiens
LYRKMEIYR

SEQ ID NO: 45861 - protein, 9 aa, Homo Sapiens
MALLLSVLR

SEQ ID NO: 45862 - protein, 9 aa, Homo Sapiens
MFAERLAKR

SEQ ID NO: 45863 - protein, 9 aa, Homo Sapiens
MFEYLAPPR

SEQ ID NO: 45864 - protein, 9 aa, Homo Sapiens
MLKPALEPR

SEQ ID NO: 45865 - protein, 9 aa, Homo Sapiens
MLRLPTVFR

SEQ ID NO: 45866 - protein, 9 aa, Homo Sapiens
MLYGLIHAR

SEQ ID NO: 45867 - protein, 9 aa, Homo Sapiens
MNFNPIISR

SEQ ID NO: 45868 - protein, 9 aa, Homo Sapiens
MPKDIQLAR

SEQ ID NO: 45869 - protein, 9 aa, Homo Sapiens
MTNLPAVGR

SEQ ID NO: 45870 - protein, 9 aa, Homo Sapiens
MTNTPVVVR

SEQ ID NO: 45871 - protein, 9 aa, Homo Sapiens
MTSVPVKER

SEQ ID NO: 45872 - protein, 9 aa, Homo Sapiens
MVLAHVTNR

SEQ ID NO: 45873 - protein, 9 aa, Homo Sapiens
MVMDKKHFK

SEQ ID NO: 45874 - protein, 9 aa, Homo Sapiens
MVNVPKTRR

SEQ ID NO: 45875 - protein, 9 aa, Homo Sapiens
MVQNRVFLR

SEQ ID NO: 45876 - protein, 9 aa, Homo Sapiens
MYCDKMFHR

SEQ ID NO: 45877 - protein, 9 aa, Homo Sapiens
MYPDYFAKR

SEQ ID NO: 45878 - protein, 9 aa, Homo Sapiens
MYREYIRNR

SEQ ID NO: 45879 - protein, 9 aa, Homo Sapiens
NAGRLFHYR

SEQ ID NO: 45880 - protein, 9 aa, Homo Sapiens
NAIKWNFTK

SEQ ID NO: 45881 - protein, 9 aa, Homo Sapiens
NAIVWKIKR

SEQ ID NO: 45882 - protein, 9 aa, Homo Sapiens
NAKALSTLR

SEQ ID NO: 45883 - protein, 9 aa, Homo Sapiens
NALLVVKHR

SEQ ID NO: 45884 - protein, 9 aa, Homo Sapiens
NALQQVVAR

SEQ ID NO: 45885 - protein, 9 aa, Homo Sapiens
NAMLPFHHR

SEQ ID NO: 45886 - protein, 9 aa, Homo Sapiens
NANLPSSLR

SEQ ID NO: 45887 - protein, 9 aa, Homo Sapiens
NANPLIYQR

SEQ ID NO: 45888 - protein, 9 aa, Homo Sapiens
NAQAPCWGR

SEQ ID NO: 45889 - protein, 9 aa, Homo Sapiens
NAQNWGMQR

SEQ ID NO: 45890 - protein, 9 aa, Homo Sapiens
NARDTVFYR

SEQ ID NO: 45891 - protein, 9 aa, Homo Sapiens
NATVPLLGR

SEQ ID NO: 45892 - protein, 9 aa, Homo Sapiens
NDFVPPAPR

SEQ ID NO: 45893 - protein, 9 aa, Homo Sapiens
NFIDVIITR

SEQ ID NO: 45894 - protein, 9 aa, Homo Sapiens
NFMLIITHR

SEQ ID NO: 45895 - protein, 9 aa, Homo Sapiens
NFNYIEFTR

SEQ ID NO: 45896 - protein, 9 aa, Homo Sapiens
NFRGMYNQR

SEQ ID NO: 45897 - protein, 9 aa, Homo Sapiens
NGKQIYVGR

SEQ ID NO: 45898 - protein, 9 aa, Homo Sapiens
NIKNSSVPR

SEQ ID NO: 45899 - protein, 9 aa, Homo Sapiens
NILKLVVSR

SEQ ID NO: 45900 - protein, 9 aa, Homo Sapiens
NILNKVVTR

SEQ ID NO: 45901 - protein, 9 aa, Homo Sapiens
NLCAIHAKR

SEQ ID NO: 45902 - protein, 9 aa, Homo Sapiens
NLKEIISQR

SEQ ID NO: 45903 - protein, 9 aa, Homo Sapiens
NLKPKSWVR

SEQ ID NO: 45904 - protein, 9 aa, Homo Sapiens
NLKPPQAKR

SEQ ID NO: 45905 - protein, 9 aa, Homo Sapiens
NLKPVWASR

SEQ ID NO: 45906 - protein, 9 aa, Homo Sapiens
NLKSPAVKR

SEQ ID NO: 45907 - protein, 9 aa, Homo Sapiens
NLRRLENNR

SEQ ID NO: 45908 - protein, 9 aa, Homo Sapiens
NLSAPIMSR

SEQ ID NO: 45909 - protein, 9 aa, Homo Sapiens
NLYELKEGR

SEQ ID NO: 45910 - protein, 9 aa, Homo Sapiens
NLYFHDVGR

SEQ ID NO: 45911 - protein, 9 aa, Homo Sapiens
NMFDHPIPR

SEQ ID NO: 45912 - protein, 9 aa, Homo Sapiens
NMLNLLIHR

SEQ ID NO: 45913 - protein, 9 aa, Homo Sapiens
NMNVIDVGR

SEQ ID NO: 45914 - protein, 9 aa, Homo Sapiens
NNANVTWWR

SEQ ID NO: 45915 - protein, 9 aa, Homo Sapiens
NNIGKFLNR

SEQ ID NO: 45916 - protein, 9 aa, Homo Sapiens
NNKDLYVLR

SEQ ID NO: 45917 - protein, 9 aa, Homo Sapiens
NNKRWYFTR

SEQ ID NO: 45918 - protein, 9 aa, Homo Sapiens
NNLGNFINR

SEQ ID NO: 45919 - protein, 9 aa, Homo Sapiens
NNLNTLIQR

SEQ ID NO: 45920 - protein, 9 aa, Homo Sapiens
NNQSFYSNR

SEQ ID NO: 45921 - protein, 9 aa, Homo Sapiens
NNRELYIHR

SEQ ID NO: 45922 - protein, 9 aa, Homo Sapiens
NPFEVKVNR

SEQ ID NO: 45923 - protein, 9 aa, Homo Sapiens
NPWQRLVKR

SEQ ID NO: 45924 - protein, 9 aa, Homo Sapiens
NSFTPPCQR

SEQ ID NO: 45925 - protein, 9 aa, Homo Sapiens
NSKESYELR

SEQ ID NO: 45926 - protein, 9 aa, Homo Sapiens
NSLDSLCNR

SEQ ID NO: 45927 - protein, 9 aa, Homo Sapiens
NSLDTVLNR

SEQ ID NO: 45928 - protein, 9 aa, Homo Sapiens
NSNLITWNR

SEQ ID NO: 45929 - protein, 9 aa, Homo Sapiens
NSNLIVHQR

SEQ ID NO: 45930 - protein, 9 aa, Homo Sapiens
NSNLVIHQR

SEQ ID NO: 45931 - protein, 9 aa, Homo Sapiens
NSQKKYFGR

SEQ ID NO: 45932 - protein, 9 aa, Homo Sapiens
NSQLIVHQR

SEQ ID NO: 45933 - protein, 9 aa, Homo Sapiens
NSREKIYNR

SEQ ID NO: 45934 - protein, 9 aa, Homo Sapiens
NTFGSFQCR

SEQ ID NO: 45935 - protein, 9 aa, Homo Sapiens
NTGNWMHIR

SEQ ID NO: 45936 - protein, 9 aa, Homo Sapiens
NTIKHYVHR

SEQ ID NO: 45937 - protein, 9 aa, Homo Sapiens
NTIKLIVGR

SEQ ID NO: 45938 - protein, 9 aa, Homo Sapiens
NTILRHLGR

SEQ ID NO: 45939 - protein, 9 aa, Homo Sapiens
NTNDFVTLR

SEQ ID NO: 45940 - protein, 9 aa, Homo Sapiens
NTQVLINCR

SEQ ID NO: 45941 - protein, 9 aa, Homo Sapiens
NTREPKLFR

SEQ ID NO: 45942 - protein, 9 aa, Homo Sapiens
NTRIPEQRF

SEQ ID NO: 45943 - protein, 9 aa, Homo Sapiens
NTSTSIVNR

SEQ ID NO: 45944 - protein, 9 aa, Homo Sapiens
NTVHDIVNR

SEQ ID NO: 45945 - protein, 9 aa, Homo Sapiens
NVARRIEFR

SEQ ID NO: 45946 - protein, 9 aa, Homo Sapiens
NVKELFSVR

SEQ ID NO: 45947 - protein, 9 aa, Homo Sapiens
NVKGPGLQR

SEQ ID NO: 45948 - protein, 9 aa, Homo Sapiens
NVKVVVRCR

SEQ ID NO: 45949 - protein, 9 aa, Homo Sapiens
NVLEKTEQR

SEQ ID NO: 45950 - protein, 9 aa, Homo Sapiens
NVLGRVKGR

SEQ ID NO: 45951 - protein, 9 aa, Homo Sapiens
NVNEVISNR

SEQ ID NO: 45952 - protein, 9 aa, Homo Sapiens
NVQVHFTER

SEQ ID NO: 45953 - protein, 9 aa, Homo Sapiens
NVRLIEVER

SEQ ID NO: 45954 - protein, 9 aa, Homo Sapiens
NYAAPPSTR

SEQ ID NO: 45955 - protein, 9 aa, Homo Sapiens
NYCEKMFHR

SEQ ID NO: 45956 - protein, 9 aa, Homo Sapiens
NYFEPPIPR

SEQ ID NO: 45957 - protein, 9 aa, Homo Sapiens
NYGPGPSLR

SEQ ID NO: 45958 - protein, 9 aa, Homo Sapiens
NYIGSFLAR

SEQ ID NO: 45959 - protein, 9 aa, Homo Sapiens
NYVNKIKNR

SEQ ID NO: 45960 - protein, 9 aa, Homo Sapiens
PEEAVGHAR

SEQ ID NO: 45961 - protein, 9 aa, Homo Sapiens
PFDITVMIR

SEQ ID NO: 45962 - protein, 9 aa, Homo Sapiens
QAFEREVGR

SEQ ID NO: 45963 - protein, 9 aa, Homo Sapiens
QAQKPSVPR

SEQ ID NO: 45964 - protein, 9 aa, Homo Sapiens
QEQNQEQPI

SEQ ID NO: 45965 - protein, 9 aa, Homo Sapiens
QIPEIKQTL

SEQ ID NO: 45966 - protein, 9 aa, Homo Sapiens
QNLQLENLR

SEQ ID NO: 45967 - protein, 9 aa, Homo Sapiens
QPFLKKWYR

SEQ ID NO: 45968 - protein, 9 aa, Homo Sapiens
QQKPPPPPK

SEQ ID NO: 45969 - protein, 9 aa, Homo Sapiens
QQLYWSHPR

SEQ ID NO: 45970 - protein, 9 aa, Homo Sapiens
QSNLIVHQR

SEQ ID NO: 45971 - protein, 9 aa, Homo Sapiens
QSYDNFSYR

SEQ ID NO: 45972 - protein, 9 aa, Homo Sapiens
QTKPVVVYR

SEQ ID NO: 45973 - protein, 9 aa, Homo Sapiens
QTKPVYVYR

SEQ ID NO: 45974 - protein, 9 aa, Homo Sapiens
QTKTVRVFR

SEQ ID NO: 45975 - protein, 9 aa, Homo Sapiens
QTQSIYIPR

SEQ ID NO: 45976 - protein, 9 aa, Homo Sapiens
QVMFRNYQR

SEQ ID NO: 45977 - protein, 9 aa, Homo Sapiens
QVQVWFKNR

SEQ ID NO: 45978 - protein, 9 aa, Homo Sapiens
QVREICISR

SEQ ID NO: 45979 - protein, 9 aa, Homo Sapiens
QYMEEIYHR

SEQ ID NO: 45980 - protein, 9 aa, Homo Sapiens
RMLERVIGR

SEQ ID NO: 45981 - protein, 9 aa, Homo Sapiens
RNLDHVYNR

SEQ ID NO: 45982 - protein, 9 aa, Homo Sapiens
SAALRAVYR

SEQ ID NO: 45983 - protein, 9 aa, Homo Sapiens
SAGGSFTVR

SEQ ID NO: 45984 - protein, 9 aa, Homo Sapiens
SAIHIRVFR

SEQ ID NO: 45985 - protein, 9 aa, Homo Sapiens
SAKEVLSAR

SEQ ID NO: 45986 - protein, 9 aa, Homo Sapiens
SALRPSTSR

SEQ ID NO: 45987 - protein, 9 aa, Homo Sapiens
SANDYFSER

SEQ ID NO: 45988 - protein, 9 aa, Homo Sapiens
SANLIVHQR

SEQ ID NO: 45989 - protein, 9 aa, Homo Sapiens
SFFRREIKR

SEQ ID NO: 45990 - protein, 9 aa, Homo Sapiens
SFLKRLICR

SEQ ID NO: 45991 - protein, 9 aa, Homo Sapiens
SFQRRWITR

SEQ ID NO: 45992 - protein, 9 aa, Homo Sapiens
SFRKKYELR

SEQ ID NO: 45993 - protein, 9 aa, Homo Sapiens
SGYPPFVGR

SEQ ID NO: 45994 - protein, 9 aa, Homo Sapiens
SILLWATQR

SEQ ID NO: 45995 - protein, 9 aa, Homo Sapiens
SILSHIHKR

SEQ ID NO: 45996 - protein, 9 aa, Homo Sapiens
SIMKWNRER

SEQ ID NO: 45997 - protein, 9 aa, Homo Sapiens
SIRDPVHNR

SEQ ID NO: 45998 - protein, 9 aa, Homo Sapiens
SIREPIANR

SEQ ID NO: 45999 - protein, 9 aa, Homo Sapiens
SLWKKTVYR

SEQ ID NO: 46000 - protein, 9 aa, Homo Sapiens
SMLEYFINR

SEQ ID NO: 46001 - protein, 9 aa, Homo Sapiens
SMRDHIDYR

SEQ ID NO: 46002 - protein, 9 aa, Homo Sapiens
SNDIPHVVR

SEQ ID NO: 46003 - protein, 9 aa, Homo Sapiens
SNKELAIER

SEQ ID NO: 46004 - protein, 9 aa, Homo Sapiens
SNNTPQLNR

SEQ ID NO: 46005 - protein, 9 aa, Homo Sapiens
SSYFRIHER

SEQ ID NO: 46006 - protein, 9 aa, Homo Sapiens
STARHLYLR

SEQ ID NO: 46007 - protein, 9 aa, Homo Sapiens
STFDTPYCR

SEQ ID NO: 46008 - protein, 9 aa, Homo Sapiens
STKGLNLPR

SEQ ID NO: 46009 - protein, 9 aa, Homo Sapiens
STLSPIAPR

SEQ ID NO: 46010 - protein, 9 aa, Homo Sapiens
STQLTIHQR

SEQ ID NO: 46011 - protein, 9 aa, Homo Sapiens
STRPPSVTR

SEQ ID NO: 46012 - protein, 9 aa, Homo Sapiens
STYIRLYGR

SEQ ID NO: 46013 - protein, 9 aa, Homo Sapiens
SVDRPIIDR

SEQ ID NO: 46014 - protein, 9 aa, Homo Sapiens
SVKDYCFAR

SEQ ID NO: 46015 - protein, 9 aa, Homo Sapiens
SVKEIYNEK

SEQ ID NO: 46016 - protein, 9 aa, Homo Sapiens
SVKEVALGR

SEQ ID NO: 46017 - protein, 9 aa, Homo Sapiens
SVKSITNPR

SEQ ID NO: 46018 - protein, 9 aa, Homo Sapiens
SVLDYFSER

SEQ ID NO: 46019 - protein, 9 aa, Homo Sapiens
SVLENFVGR

SEQ ID NO: 46020 - protein, 9 aa, Homo Sapiens
SVLNFATNR

SEQ ID NO: 46021 - protein, 9 aa, Homo Sapiens
SVQGIIIYR

SEQ ID NO: 46022 - protein, 9 aa, Homo Sapiens
SVYIPAHGR

SEQ ID NO: 46023 - protein, 9 aa, Homo Sapiens
SYFSFSRNR

SEQ ID NO: 46024 - protein, 9 aa, Homo Sapiens
SYGPGPSLR

SEQ ID NO: 46025 - protein, 9 aa, Homo Sapiens
SYIDRLAPR

SEQ ID NO: 46026 - protein, 9 aa, Homo Sapiens
SYKDFSESR

SEQ ID NO: 46027 - protein, 9 aa, Homo Sapiens
SYKGSISYR

SEQ ID NO: 46028 - protein, 9 aa, Homo Sapiens
SYKGTPAMR

SEQ ID NO: 46029 - protein, 9 aa, Homo Sapiens
SYLDKFFSR

SEQ ID NO: 46030 - protein, 9 aa, Homo Sapiens
SYQEVTVQR

SEQ ID NO: 46031 - protein, 9 aa, Homo Sapiens
SYREQWSQR

SEQ ID NO: 46032 - protein, 9 aa, Homo Sapiens
SYRKFLNLR

SEQ ID NO: 46033 - protein, 9 aa, Homo Sapiens
SYVELSQYR

SEQ ID NO: 46034 - protein, 9 aa, Homo Sapiens
TAIRPIALR

SEQ ID NO: 46035 - protein, 9 aa, Homo Sapiens
TALKVASTR

SEQ ID NO: 46036 - protein, 9 aa, Homo Sapiens
TAYRPDWNR

SEQ ID NO: 46037 - protein, 9 aa, Homo Sapiens
TAYRPPALR

SEQ ID NO: 46038 - protein, 9 aa, Homo Sapiens
TFEHPNVVR

SEQ ID NO: 46039 - protein, 9 aa, Homo Sapiens
TFVAILIAR

SEQ ID NO: 46040 - protein, 9 aa, Homo Sapiens
TFYSISQER

SEQ ID NO: 46041 - protein, 9 aa, Homo Sapiens
TIDQKIVER

SEQ ID NO: 46042 - protein, 9 aa, Homo Sapiens
TILIILTGR

SEQ ID NO: 46043 - protein, 9 aa, Homo Sapiens
TILIPPHAR

SEQ ID NO: 46044 - protein, 9 aa, Homo Sapiens
TLLDKYWTK

SEQ ID NO: 46045 - protein, 9 aa, Homo Sapiens
TNTVPKLYR

SEQ ID NO: 46046 - protein, 9 aa, Homo Sapiens
TSNMPVAAR

SEQ ID NO: 46047 - protein, 9 aa, Homo Sapiens
TSRNITEAR

SEQ ID NO: 46048 - protein, 9 aa, Homo Sapiens
TSWVPLVSR

SEQ ID NO: 46049 - protein, 9 aa, Homo Sapiens
TTKPAIIFR

SEQ ID NO: 46050 - protein, 9 aa, Homo Sapiens
TTSIPKCYR

SEQ ID NO: 46051 - protein, 9 aa, Homo Sapiens
TVATLPRGR

SEQ ID NO: 46052 - protein, 9 aa, Homo Sapiens
TVRDHLVGR

SEQ ID NO: 46053 - protein, 9 aa, Homo Sapiens
TYKFCFSNR

SEQ ID NO: 46054 - protein, 9 aa, Homo Sapiens
TYLATFHQR

SEQ ID NO: 46055 - protein, 9 aa, Homo Sapiens
TYLGEFSLR

SEQ ID NO: 46056 - protein, 9 aa, Homo Sapiens
TYLTKFIAR

SEQ ID NO: 46057 - protein, 9 aa, Homo Sapiens
TYNEHITKR

SEQ ID NO: 46058 - protein, 9 aa, Homo Sapiens
TYYDAWSLR

SEQ ID NO: 46059 - protein, 9 aa, Homo Sapiens
TYYESISNR

SEQ ID NO: 46060 - protein, 9 aa, Homo Sapiens
TYYGSFVTR

SEQ ID NO: 46061 - protein, 9 aa, Homo Sapiens
TYYPPPRLR

SEQ ID NO: 46062 - protein, 9 aa, Homo Sapiens
VAFKPTSNR

SEQ ID NO: 46063 - protein, 9 aa, Homo Sapiens
VAMEPVSTR

SEQ ID NO: 46064 - protein, 9 aa, Homo Sapiens
VANSAFVER

SEQ ID NO: 46065 - protein, 9 aa, Homo Sapiens
VASTPISQR

SEQ ID NO: 46066 - protein, 9 aa, Homo Sapiens
VAVTPFSLR

SEQ ID NO: 46067 - protein, 9 aa, Homo Sapiens
VAWLVAHVR

SEQ ID NO: 46068 - protein, 9 aa, Homo Sapiens
VEELKPTPE

SEQ ID NO: 46069 - protein, 9 aa, Homo Sapiens
VEKSKIPGR

SEQ ID NO: 46070 - protein, 9 aa, Homo Sapiens
VFKDEATVR

SEQ ID NO: 46071 - protein, 9 aa, Homo Sapiens
VFKEEGVLR

SEQ ID NO: 46072 - protein, 9 aa, Homo Sapiens
VFLLWKNWR

SEQ ID NO: 46073 - protein, 9 aa, Homo Sapiens
VFQERNYPR

SEQ ID NO: 46074 - protein, 9 aa, Homo Sapiens
VMIHPVTNR

SEQ ID NO: 46075 - protein, 9 aa, Homo Sapiens
VMKDFEEMR

SEQ ID NO: 46076 - protein, 9 aa, Homo Sapiens
VMKPPQVVR

SEQ ID NO: 46077 - protein, 9 aa, Homo Sapiens
VMQKRISFR

SEQ ID NO: 46078 - protein, 9 aa, Homo Sapiens
VNMVPFPRL

SEQ ID NO: 46079 - protein, 9 aa, Homo Sapiens
VNTSLNVYR

SEQ ID NO: 46080 - protein, 9 aa, Homo Sapiens
VPFGAGRHR

SEQ ID NO: 46081 - protein, 9 aa, Homo Sapiens
VPIGYHVPR

SEQ ID NO: 46082 - protein, 9 aa, Homo Sapiens
VPSTPIAHR

SEQ ID NO: 46083 - protein, 9 aa, Homo Sapiens
VPYVPLRQR

SEQ ID NO: 46084 - protein, 9 aa, Homo Sapiens
VSNKWLHER

SEQ ID NO: 46085 - protein, 9 aa, Homo Sapiens
VSYVPITGR

SEQ ID NO: 46086 - protein, 9 aa, Homo Sapiens
VTQAPISAR

SEQ ID NO: 46087 - protein, 9 aa, Homo Sapiens
VVAPRLNSR

SEQ ID NO: 46088 - protein, 9 aa, Homo Sapiens
VVMTPPRNR

SEQ ID NO: 46089 - protein, 9 aa, Homo Sapiens
VYFKRFYAR

SEQ ID NO: 46090 - protein, 9 aa, Homo Sapiens
VYIERLRHR

SEQ ID NO: 46091 - protein, 9 aa, Homo Sapiens
VYNEFVRKR

SEQ ID NO: 46092 - protein, 9 aa, Homo Sapiens
VYNEYISHR

SEQ ID NO: 46093 - protein, 9 aa, Homo Sapiens
VYTDTIQQR

SEQ ID NO: 46094 - protein, 9 aa, Homo Sapiens
VYYRVYYTR

SEQ ID NO: 46095 - protein, 9 aa, Homo Sapiens
WFKGWKVTR

SEQ ID NO: 46096 - protein, 9 aa, Homo Sapiens
WVKPIIIGR

SEQ ID NO: 46097 - protein, 9 aa, Homo Sapiens
WYLGTIKKR

SEQ ID NO: 46098 - protein, 9 aa, Homo Sapiens
YDENWFYTR

SEQ ID NO: 46099 - protein, 9 aa, Homo Sapiens
YIRPVFVSR

SEQ ID NO: 46100 - protein, 9 aa, Homo Sapiens
YLKEREEFR

SEQ ID NO: 46101 - protein, 9 aa, Homo Sapiens
YMLDKINRR

SEQ ID NO: 46102 - protein, 9 aa, Homo Sapiens
YPDYKYRPR

SEQ ID NO: 46103 - protein, 9 aa, Homo Sapiens
YPNKPPTVR

SEQ ID NO: 46104 - protein, 9 aa, Homo Sapiens
YPYSFWIGR

SEQ ID NO: 46105 - protein, 9 aa, Homo Sapiens
YPYSPPAFR

SEQ ID NO: 46106 - protein, 9 aa, Homo Sapiens
YPYSPPTFR

SEQ ID NO: 46107 - protein, 9 aa, Homo Sapiens
YSNKEIFLR

SEQ ID NO: 46108 - protein, 9 aa, Homo Sapiens
YSWDIVVQR

SEQ ID NO: 46109 - protein, 9 aa, Homo Sapiens
YTQPGPGYR

SEQ ID NO: 46110 - protein, 9 aa, Homo Sapiens
YVAYIKWHR

SEQ ID NO: 46111 - protein, 9 aa, Homo Sapiens
YVKDLVVQR

SEQ ID NO: 46112 - protein, 9 aa, Homo Sapiens
YVKEQFAWR

SEQ ID NO: 46113 - protein, 9 aa, Homo Sapiens
YVQRFHYSR

SEQ ID NO: 46114 - protein, 9 aa, Homo Sapiens
YWKEVAEKR

SEQ ID NO: 46115 - protein, 9 aa, Homo Sapiens
YYIVLITKR

SEQ ID NO: 46116 - protein, 9 aa, Homo Sapiens
YYNGCIFHR

SEQ ID NO: 46117 - protein, 10 aa, Homo Sapiens
ADFKNVLSNR

SEQ ID NO: 46118 - protein, 10 aa, Homo Sapiens
ADTLAVRQKR

SEQ ID NO: 46119 - protein, 10 aa, Homo Sapiens
ADYLEFQKNR

SEQ ID NO: 46120 - protein, 10 aa, Homo Sapiens
CAAPGPASYR

SEQ ID NO: 46121 - protein, 10 aa, Homo Sapiens
DAACRVIARL

SEQ ID NO: 46122 - protein, 10 aa, Homo Sapiens
DAADFIRAGR

SEQ ID NO: 46123 - protein, 10 aa, Homo Sapiens
DAAELPGVSR

SEQ ID NO: 46124 - protein, 10 aa, Homo Sapiens
DAAFIIGSGR

SEQ ID NO: 46125 - protein, 10 aa, Homo Sapiens
DAAGTSLYVR

SEQ ID NO: 46126 - protein, 10 aa, Homo Sapiens
DAAKDSILRR

SEQ ID NO: 46127 - protein, 10 aa, Homo Sapiens
DAAKPLPIYR

SEQ ID NO: 46128 - protein, 10 aa, Homo Sapiens
DAFGLLESRL

SEQ ID NO: 46129 - protein, 10 aa, Homo Sapiens
DAFNMQMRQR

SEQ ID NO: 46130 - protein, 10 aa, Homo Sapiens
DAGSVPHVNR

SEQ ID NO: 46131 - protein, 10 aa, Homo Sapiens
DALGAAFATR

SEQ ID NO: 46132 - protein, 10 aa, Homo Sapiens
DALGSLTHSR

SEQ ID NO: 46133 - protein, 10 aa, Homo Sapiens
DANAKFYCRL

SEQ ID NO: 46134 - protein, 10 aa, Homo Sapiens
DAQEILHSRF

SEQ ID NO: 46135 - protein, 10 aa, Homo Sapiens
DARRQQLVYR

SEQ ID NO: 46136 - protein, 10 aa, Homo Sapiens
DASLGNLFAR

SEQ ID NO: 46137 - protein, 10 aa, Homo Sapiens
DASSGPIQVR

SEQ ID NO: 46138 - protein, 10 aa, Homo Sapiens
DAVGFTFPNR

SEQ ID NO: 46139 - protein, 10 aa, Homo Sapiens
DAVKPGVRYR

SEQ ID NO: 46140 - protein, 10 aa, Homo Sapiens
DAWEPKVLRA

SEQ ID NO: 46141 - protein, 10 aa, Homo Sapiens
DAWLPGEATR

SEQ ID NO: 46142 - protein, 10 aa, Homo Sapiens
DAYEPEISRL

SEQ ID NO: 46143 - protein, 10 aa, Homo Sapiens
DAYGSELVER

SEQ ID NO: 46144 - protein, 10 aa, Homo Sapiens
DDFLRRSSSR

SEQ ID NO: 46145 - protein, 10 aa, Homo Sapiens
DDFRARFWYR

SEQ ID NO: 46146 - protein, 10 aa, Homo Sapiens
DESGPSIVHR

SEQ ID NO: 46147 - protein, 10 aa, Homo Sapiens
DFCHWGQRFR

SEQ ID NO: 46148 - protein, 10 aa, Homo Sapiens
DFFNGKELNK

SEQ ID NO: 46149 - protein, 10 aa, Homo Sapiens
DFFNYAGLQR

SEQ ID NO: 46150 - protein, 10 aa, Homo Sapiens
DFHLLDHRGR

SEQ ID NO: 46151 - protein, 10 aa, Homo Sapiens
DFHVINGVLR

SEQ ID NO: 46152 - protein, 10 aa, Homo Sapiens
DFISCDRTGR

SEQ ID NO: 46153 - protein, 10 aa, Homo Sapiens
DFLELQRRYR

SEQ ID NO: 46154 - protein, 10 aa, Homo Sapiens
DFLKVLNRAR

SEQ ID NO: 46155 - protein, 10 aa, Homo Sapiens
DFLSLEHIGR

SEQ ID NO: 46156 - protein, 10 aa, Homo Sapiens
DFQIEKKIGR

SEQ ID NO: 46157 - protein, 10 aa, Homo Sapiens
DFREPTEEER

SEQ ID NO: 46158 - protein, 10 aa, Homo Sapiens
DFRRAPFAGR

SEQ ID NO: 46159 - protein, 10 aa, Homo Sapiens
DGKNVKAFYR

SEQ ID NO: 46160 - protein, 10 aa, Homo Sapiens
DIEFPPPFGR

SEQ ID NO: 46161 - protein, 10 aa, Homo Sapiens
DIFQQTPLGR

SEQ ID NO: 46162 - protein, 10 aa, Homo Sapiens
DIHLGPTVGR

SEQ ID NO: 46163 - protein, 10 aa, Homo Sapiens
DILNGGPSKR

SEQ ID NO: 46164 - protein, 10 aa, Homo Sapiens
DIRPGLPMLR

SEQ ID NO: 46165 - protein, 10 aa, Homo Sapiens
DISDPYKVYR

SEQ ID NO: 46166 - protein, 10 aa, Homo Sapiens
DISIIKGRYR

SEQ ID NO: 46167 - protein, 10 aa, Homo Sapiens
DISSFKNIYR

SEQ ID NO: 46168 - protein, 10 aa, Homo Sapiens
DIYDRKNMPR

SEQ ID NO: 46169 - protein, 10 aa, Homo Sapiens
DIYRPTIHKL

SEQ ID NO: 46170 - protein, 10 aa, Homo Sapiens
DLATIHGMNR

SEQ ID NO: 46171 - protein, 10 aa, Homo Sapiens
DLGPMRKSYR

SEQ ID NO: 46172 - protein, 10 aa, Homo Sapiens
DLMRRQEELR

SEQ ID NO: 46173 - protein, 10 aa, Homo Sapiens
DLQHGSLFLR

SEQ ID NO: 46174 - protein, 10 aa, Homo Sapiens
DLQLIKVTRL

SEQ ID NO: 46175 - protein, 10 aa, Homo Sapiens
DLQSMEQIRR

SEQ ID NO: 46176 - protein, 10 aa, Homo Sapiens
DLRGSNWVPR

SEQ ID NO: 46177 - protein, 10 aa, Homo Sapiens
DMADHSNLIR

SEQ ID NO: 46178 - protein, 10 aa, Homo Sapiens
DMAEIEKFDK

SEQ ID NO: 46179 - protein, 10 aa, Homo Sapiens
DMKFITPVRR

SEQ ID NO: 46180 - protein, 10 aa, Homo Sapiens
DMLDIREIFR

SEQ ID NO: 46181 - protein, 10 aa, Homo Sapiens
DMNHCYSRLR

SEQ ID NO: 46182 - protein, 10 aa, Homo Sapiens
DMRRPSSVLR

SEQ ID NO: 46183 - protein, 10 aa, Homo Sapiens
DMWAGLWQKR

SEQ ID NO: 46184 - protein, 10 aa, Homo Sapiens
DNFFDGQRKR

SEQ ID NO: 46185 - protein, 10 aa, Homo Sapiens
DNGGYYITTR

SEQ ID NO: 46186 - protein, 10 aa, Homo Sapiens
DNSMGFGAER

SEQ ID NO: 46187 - protein, 10 aa, Homo Sapiens
DNSPGTLTLR

SEQ ID NO: 46188 - protein, 10 aa, Homo Sapiens
DSFPERRAPR

SEQ ID NO: 46189 - protein, 10 aa, Homo Sapiens
DSKGQHLIYR

SEQ ID NO: 46190 - protein, 10 aa, Homo Sapiens
DSLQAFLQDR

SEQ ID NO: 46191 - protein, 10 aa, Homo Sapiens
DSMKSFFRRL

SEQ ID NO: 46192 - protein, 10 aa, Homo Sapiens
DSQDIQGRNR

SEQ ID NO: 46193 - protein, 10 aa, Homo Sapiens
DSQGLNLGCR

SEQ ID NO: 46194 - protein, 10 aa, Homo Sapiens
DSRDGKFIHR

SEQ ID NO: 46195 - protein, 10 aa, Homo Sapiens
DTIDVSNLNR

SEQ ID NO: 46196 - protein, 10 aa, Homo Sapiens
DTIIDIITHR

SEQ ID NO: 46197 - protein, 10 aa, Homo Sapiens
DTKGRFAVHR

SEQ ID NO: 46198 - protein, 10 aa, Homo Sapiens
DTKNYVEVTR

SEQ ID NO: 46199 - protein, 10 aa, Homo Sapiens
DTKRVEAPRL

SEQ ID NO: 46200 - protein, 10 aa, Homo Sapiens
DTLEKLISHR

SEQ ID NO: 46201 - protein, 10 aa, Homo Sapiens
DTLTLKERER

SEQ ID NO: 46202 - protein, 10 aa, Homo Sapiens
DTMKVLGVQR

SEQ ID NO: 46203 - protein, 10 aa, Homo Sapiens
DTQERIKAER

SEQ ID NO: 46204 - protein, 10 aa, Homo Sapiens
DTQNALKNYR

SEQ ID NO: 46205 - protein, 10 aa, Homo Sapiens
DTRDKGLVNR

SEQ ID NO: 46206 - protein, 10 aa, Homo Sapiens
DTRMGPLINR

SEQ ID NO: 46207 - protein, 10 aa, Homo Sapiens
DTRSVHETRF

SEQ ID NO: 46208 - protein, 10 aa, Homo Sapiens
DTSSRSHIFR

SEQ ID NO: 46209 - protein, 10 aa, Homo Sapiens
DTVATLPRGR

SEQ ID NO: 46210 - protein, 10 aa, Homo Sapiens
DVASVIVTKL

SEQ ID NO: 46211 - protein, 10 aa, Homo Sapiens
DVGRRFLVNR

SEQ ID NO: 46212 - protein, 10 aa, Homo Sapiens
DVIGSRRQPR

SEQ ID NO: 46213 - protein, 10 aa, Homo Sapiens
DVINFKKIYK

SEQ ID NO: 46214 - protein, 10 aa, Homo Sapiens
DVISNINITR

SEQ ID NO: 46215 - protein, 10 aa, Homo Sapiens
DVLAWEHERF

SEQ ID NO: 46216 - protein, 10 aa, Homo Sapiens
DVLNIQGVQR

SEQ ID NO: 46217 - protein, 10 aa, Homo Sapiens
DVLNPSGTQR

SEQ ID NO: 46218 - protein, 10 aa, Homo Sapiens
DVLPLAFTRL

SEQ ID NO: 46219 - protein, 10 aa, Homo Sapiens
DVLSHFAQRL

SEQ ID NO: 46220 - protein, 10 aa, Homo Sapiens
DVLTLLESER

SEQ ID NO: 46221 - protein, 10 aa, Homo Sapiens
DVNNPGLRVR

SEQ ID NO: 46222 - protein, 10 aa, Homo Sapiens
DVQPFLPVLR

SEQ ID NO: 46223 - protein, 10 aa, Homo Sapiens
DVQSIIGLQR

SEQ ID NO: 46224 - protein, 10 aa, Homo Sapiens
DVRNFDYTAR

SEQ ID NO: 46225 - protein, 10 aa, Homo Sapiens
DVRPFAPKER

SEQ ID NO: 46226 - protein, 10 aa, Homo Sapiens
DVRSVTSVRR

SEQ ID NO: 46227 - protein, 10 aa, Homo Sapiens
DVSEGPLIPR

SEQ ID NO: 46228 - protein, 10 aa, Homo Sapiens
DVVRRPPIHR

SEQ ID NO: 46229 - protein, 10 aa, Homo Sapiens
DVYDRKNIPR

SEQ ID NO: 46230 - protein, 10 aa, Homo Sapiens
DYFTPQGEFR

SEQ ID NO: 46231 - protein, 10 aa, Homo Sapiens
DYGFPERKER

SEQ ID NO: 46232 - protein, 10 aa, Homo Sapiens
DYIHIRIQQR

SEQ ID NO: 46233 - protein, 10 aa, Homo Sapiens
DYKALGILKR

SEQ ID NO: 46234 - protein, 10 aa, Homo Sapiens
DYKVVSPALR

SEQ ID NO: 46235 - protein, 10 aa, Homo Sapiens
DYLIKTGSER

SEQ ID NO: 46236 - protein, 10 aa, Homo Sapiens
DYLMKILTER

SEQ ID NO: 46237 - protein, 10 aa, Homo Sapiens
DYLVPILAPR

SEQ ID NO: 46238 - protein, 10 aa, Homo Sapiens
DYPDYKYRPR

SEQ ID NO: 46239 - protein, 10 aa, Homo Sapiens
DYQLVRKLGR

SEQ ID NO: 46240 - protein, 10 aa, Homo Sapiens
DYQQTIKKYR

SEQ ID NO: 46241 - protein, 10 aa, Homo Sapiens
DYYDDFLQRL

SEQ ID NO: 46242 - protein, 10 aa, Homo Sapiens
DYYEVLGVQR

SEQ ID NO: 46243 - protein, 10 aa, Homo Sapiens
DYYTPTGEFR

SEQ ID NO: 46244 - protein, 10 aa, Homo Sapiens
EALGEVMVSR

SEQ ID NO: 46245 - protein, 10 aa, Homo Sapiens
EALGSGLVSR

SEQ ID NO: 46246 - protein, 10 aa, Homo Sapiens
EALHLAGMDR

SEQ ID NO: 46247 - protein, 10 aa, Homo Sapiens
EAWLLPAVGR

SEQ ID NO: 46248 - protein, 10 aa, Homo Sapiens
EDYKLHFIFR

SEQ ID NO: 46249 - protein, 10 aa, Homo Sapiens
EDYNLIVIER

SEQ ID NO: 46250 - protein, 10 aa, Homo Sapiens
EDYRDTVVKR

SEQ ID NO: 46251 - protein, 10 aa, Homo Sapiens
EDYYARVEGR

SEQ ID NO: 46252 - protein, 10 aa, Homo Sapiens
EEIGSHIKHR

SEQ ID NO: 46253 - protein, 10 aa, Homo Sapiens
EFDDRRGVLR

SEQ ID NO: 46254 - protein, 10 aa, Homo Sapiens
EFKAVQQVQR

SEQ ID NO: 46255 - protein, 10 aa, Homo Sapiens
EFLDIMKRNR

SEQ ID NO: 46256 - protein, 10 aa, Homo Sapiens
EFQVIMGRKR

SEQ ID NO: 46257 - protein, 10 aa, Homo Sapiens
EFRNFKIIYR

SEQ ID NO: 46258 - protein, 10 aa, Homo Sapiens
EIASVAYRYR

SEQ ID NO: 46259 - protein, 10 aa, Homo Sapiens
EIKDFLLTAR

SEQ ID NO: 46260 - protein, 10 aa, Homo Sapiens
EIKKPPVSER

SEQ ID NO: 46261 - protein, 10 aa, Homo Sapiens
EIRQQIPVFR

SEQ ID NO: 46262 - protein, 10 aa, Homo Sapiens
EIYDRREYSR

SEQ ID NO: 46263 - protein, 10 aa, Homo Sapiens
EKGVYVHTVR

SEQ ID NO: 46264 - protein, 10 aa, Homo Sapiens
ETLETIINRL

SEQ ID NO: 46265 - protein, 10 aa, Homo Sapiens
ETLKHSGIGR

SEQ ID NO: 46266 - protein, 10 aa, Homo Sapiens
ETLPPFPTRL

SEQ ID NO: 46267 - protein, 10 aa, Homo Sapiens
ETLPPVGVNR

SEQ ID NO: 46268 - protein, 10 aa, Homo Sapiens
EVAERLGVTR

SEQ ID NO: 46269 - protein, 10 aa, Homo Sapiens
EVFNKFFKER

SEQ ID NO: 46270 - protein, 10 aa, Homo Sapiens
EVKRPGESLR

SEQ ID NO: 46271 - protein, 10 aa, Homo Sapiens
EVKTPEFVSR

SEQ ID NO: 46272 - protein, 10 aa, Homo Sapiens
EVLLRAGVSR

SEQ ID NO: 46273 - protein, 10 aa, Homo Sapiens
EVLSKALSQR

SEQ ID NO: 46274 - protein, 10 aa, Homo Sapiens
EVLYAPRRLR

SEQ ID NO: 46275 - protein, 10 aa, Homo Sapiens
EVNPQTRIPR

SEQ ID NO: 46276 - protein, 10 aa, Homo Sapiens
EVQEQYTERL

SEQ ID NO: 46277 - protein, 10 aa, Homo Sapiens
EVQGDRMHLR

SEQ ID NO: 46278 - protein, 10 aa, Homo Sapiens
EVYDGPKNVR

SEQ ID NO: 46279 - protein, 10 aa, Homo Sapiens
EYAADIFYSR

SEQ ID NO: 46280 - protein, 10 aa, Homo Sapiens
EYAERPEVAR

SEQ ID NO: 46281 - protein, 10 aa, Homo Sapiens
EYFPTKNRQR

SEQ ID NO: 46282 - protein, 10 aa, Homo Sapiens
EYFSPVGYNR

SEQ ID NO: 46283 - protein, 10 aa, Homo Sapiens
EYILPGSRER

SEQ ID NO: 46284 - protein, 10 aa, Homo Sapiens
EYKDPGKMIR

SEQ ID NO: 46285 - protein, 10 aa, Homo Sapiens
EYKEPESTLR

SEQ ID NO: 46286 - protein, 10 aa, Homo Sapiens
EYLKLGYVSR

SEQ ID NO: 46287 - protein, 10 aa, Homo Sapiens
EYLQIPPVSR

SEQ ID NO: 46288 - protein, 10 aa, Homo Sapiens
EYRDMRDGFR

SEQ ID NO: 46289 - protein, 10 aa, Homo Sapiens
EYVDVVFANR

SEQ ID NO: 46290 - protein, 10 aa, Homo Sapiens
FDFSTRFITR

SEQ ID NO: 46291 - protein, 10 aa, Homo Sapiens
FERIAGEASR

SEQ ID NO: 46292 - protein, 10 aa, Homo Sapiens
GASLLSNMSR

SEQ ID NO: 46293 - protein, 10 aa, Homo Sapiens
GDAKSVFHTR

SEQ ID NO: 46294 - protein, 10 aa, Homo Sapiens
GDYKTIAKER

SEQ ID NO: 46295 - protein, 10 aa, Homo Sapiens
HAKGLHIPRL

SEQ ID NO: 46296 - protein, 10 aa, Homo Sapiens
HFKKPGLTGR

SEQ ID NO: 46297 - protein, 10 aa, Homo Sapiens
HSQDLSGRLR

SEQ ID NO: 46298 - protein, 10 aa, Homo Sapiens
HTKAVNVVRF

SEQ ID NO: 46299 - protein, 10 aa, Homo Sapiens
HTRTPPIIHR

SEQ ID NO: 46300 - protein, 10 aa, Homo Sapiens
HVYDGKFLAR

SEQ ID NO: 46301 - protein, 10 aa, Homo Sapiens
HYIQLGTVYR

SEQ ID NO: 46302 - protein, 10 aa, Homo Sapiens
IARDRALEGR

SEQ ID NO: 46303 - protein, 10 aa, Homo Sapiens
IDEVRTGTYR

SEQ ID NO: 46304 - protein, 10 aa, Homo Sapiens
IDRTIDQIRG

SEQ ID NO: 46305 - protein, 10 aa, Homo Sapiens
IFKEREEDLR

SEQ ID NO: 46306 - protein, 10 aa, Homo Sapiens
ILKTGGGFQR

SEQ ID NO: 46307 - protein, 10 aa, Homo Sapiens
IPYDQSPGPK

SEQ ID NO: 46308 - protein, 10 aa, Homo Sapiens
IVKGPRGTLR

SEQ ID NO: 46309 - protein, 10 aa, Homo Sapiens
IVNENLVERF

SEQ ID NO: 46310 - protein, 10 aa, Homo Sapiens
LAQGDSLAAR

SEQ ID NO: 46311 - protein, 10 aa, Homo Sapiens
LFKEPNAEGR

SEQ ID NO: 46312 - protein, 10 aa, Homo Sapiens
LPEEAVGHAR

SEQ ID NO: 46313 - protein, 10 aa, Homo Sapiens
LPWVPPDTKL

SEQ ID NO: 46314 - protein, 10 aa, Homo Sapiens
MTKSGYQPPR

SEQ ID NO: 46315 - protein, 10 aa, Homo Sapiens
NAQGPLYEQR

SEQ ID NO: 46316 - protein, 10 aa, Homo Sapiens
NFKSPVKTIR

SEQ ID NO: 46317 - protein, 10 aa, Homo Sapiens
NFMLRIGMNK

SEQ ID NO: 46318 - protein, 10 aa, Homo Sapiens
NFRGSLNTYR

SEQ ID NO: 46319 - protein, 10 aa, Homo Sapiens
NLESGWGSGR

SEQ ID NO: 46320 - protein, 10 aa, Homo Sapiens
NLKPKSWVRL

SEQ ID NO: 46321 - protein, 10 aa, Homo Sapiens
NSAGPYFNPR

SEQ ID NO: 46322 - protein, 10 aa, Homo Sapiens
NSLLRENSFR

SEQ ID NO: 46323 - protein, 10 aa, Homo Sapiens
NTQEMPWNVR

SEQ ID NO: 46324 - protein, 10 aa, Homo Sapiens
NVKDKPTVER

SEQ ID NO: 46325 - protein, 10 aa, Homo Sapiens
PDYLVPPALR

SEQ ID NO: 46326 - protein, 10 aa, Homo Sapiens
QDTLVPYGNR

SEQ ID NO: 46327 - protein, 10 aa, Homo Sapiens
QEFKEDIHNR

SEQ ID NO: 46328 - protein, 10 aa, Homo Sapiens
QYIRPVFVSR

SEQ ID NO: 46329 - protein, 10 aa, Homo Sapiens
RFYYTTPNSY

SEQ ID NO: 46330 - protein, 10 aa, Homo Sapiens
RYRPGTVALR

SEQ ID NO: 46331 - protein, 10 aa, Homo Sapiens
SDNKIIIIHR

SEQ ID NO: 46332 - protein, 10 aa, Homo Sapiens
SDTYLHRVAR

SEQ ID NO: 46333 - protein, 10 aa, Homo Sapiens
SFFGERRIPR

SEQ ID NO: 46334 - protein, 10 aa, Homo Sapiens
SFRYNGLIHR

SEQ ID NO: 46335 - protein, 10 aa, Homo Sapiens
SGYKQVQVPR

SEQ ID NO: 46336 - protein, 10 aa, Homo Sapiens
SSQQFSGIGR

SEQ ID NO: 46337 - protein, 10 aa, Homo Sapiens
STKNIHFSRL

SEQ ID NO: 46338 - protein, 10 aa, Homo Sapiens
STKPGSYIFR

SEQ ID NO: 46339 - protein, 10 aa, Homo Sapiens
SVLKMLQAAR

SEQ ID NO: 46340 - protein, 10 aa, Homo Sapiens
TAYGEFLSRL

SEQ ID NO: 46341 - protein, 10 aa, Homo Sapiens
TFEVLRKVGK

SEQ ID NO: 46342 - protein, 10 aa, Homo Sapiens
TFTVGLVFLK

SEQ ID NO: 46343 - protein, 10 aa, Homo Sapiens
TLRKPPAVGR

SEQ ID NO: 46344 - protein, 10 aa, Homo Sapiens
TMYPGLPSRL

SEQ ID NO: 46345 - protein, 10 aa, Homo Sapiens
TTLDESLTNR

SEQ ID NO: 46346 - protein, 10 aa, Homo Sapiens
TVQKETIHPR

SEQ ID NO: 46347 - protein, 10 aa, Homo Sapiens
TVQQLEGRWR

SEQ ID NO: 46348 - protein, 10 aa, Homo Sapiens
TYRNSMFHNR

SEQ ID NO: 46349 - protein, 10 aa, Homo Sapiens
TYYGSFVTRA

SEQ ID NO: 46350 - protein, 10 aa, Homo Sapiens
VAIKPSKGQR

SEQ ID NO: 46351 - protein, 10 aa, Homo Sapiens
VETDIPLKTR

SEQ ID NO: 46352 - protein, 10 aa, Homo Sapiens
VFDAKRLIGR

SEQ ID NO: 46353 - protein, 10 aa, Homo Sapiens
VFGKWHSVPR

SEQ ID NO: 46354 - protein, 10 aa, Homo Sapiens
VGKDPGLAGR

SEQ ID NO: 46355 - protein, 10 aa, Homo Sapiens
VIIGGDGRRN

SEQ ID NO: 46356 - protein, 10 aa, Homo Sapiens
VKPDQLIKRR

SEQ ID NO: 46357 - protein, 10 aa, Homo Sapiens
VLYDRQGIGR

SEQ ID NO: 46358 - protein, 10 aa, Homo Sapiens
YLNAESRVNR

SEQ ID NO: 46359 - protein, 10 aa, Homo Sapiens
YYLPYYKRER

SEQ ID NO: 46360 - protein, 11 aa, Homo Sapiens
ADFQIEKKIGR

SEQ ID NO: 46361 - protein, 11 aa, Homo Sapiens
AYKDPEKNWNR

SEQ ID NO: 46362 - protein, 11 aa, Homo Sapiens
AYKQVDPSITR

SEQ ID NO: 46363 - protein, 11 aa, Homo Sapiens
AYVPFGAGRHR

SEQ ID NO: 46364 - protein, 11 aa, Homo Sapiens
CPKGAETLVTR

SEQ ID NO: 46365 - protein, 11 aa, Homo Sapiens
CVETDIPLKTR

SEQ ID NO: 46366 - protein, 11 aa, Homo Sapiens
CVKDNALLTRR

SEQ ID NO: 46367 - protein, 11 aa, Homo Sapiens
CVVMRDPASKR

SEQ ID NO: 46368 - protein, 11 aa, Homo Sapiens
DAAHPTNVQRL

SEQ ID NO: 46369 - protein, 11 aa, Homo Sapiens
DAFNLPSSHLR

SEQ ID NO: 46370 - protein, 11 aa, Homo Sapiens
DAGLLDESFLR

SEQ ID NO: 46371 - protein, 11 aa, Homo Sapiens
DAHARPFGTIR

SEQ ID NO: 46372 - protein, 11 aa, Homo Sapiens
DAIHSMGLIHR

SEQ ID NO: 46373 - protein, 11 aa, Homo Sapiens
DAILHSEDSLR

SEQ ID NO: 46374 - protein, 11 aa, Homo Sapiens
DAKEKKLLEMR

SEQ ID NO: 46375 - protein, 11 aa, Homo Sapiens
DAKKRDIYDKY

SEQ ID NO: 46376 - protein, 11 aa, Homo Sapiens
DAKLDKTCISR

SEQ ID NO: 46377 - protein, 11 aa, Homo Sapiens
DALAKWEECQR

SEQ ID NO: 46378 - protein, 11 aa, Homo Sapiens
DALEKNQQWLV

SEQ ID NO: 46379 - protein, 11 aa, Homo Sapiens
DALGAGILHHL

SEQ ID NO: 46380 - protein, 11 aa, Homo Sapiens
DALMDRDLVHR

SEQ ID NO: 46381 - protein, 11 aa, Homo Sapiens
DALRVEDMMKR

SEQ ID NO: 46382 - protein, 11 aa, Homo Sapiens
DAMEYDEKLAR

SEQ ID NO: 46383 - protein, 11 aa, Homo Sapiens
DAMNREVSSLK

SEQ ID NO: 46384 - protein, 11 aa, Homo Sapiens
DANGNSFATRI

SEQ ID NO: 46385 - protein, 11 aa, Homo Sapiens
DANLHKDRFLR

SEQ ID NO: 46386 - protein, 11 aa, Homo Sapiens
DAQAFEREVGR

SEQ ID NO: 46387 - protein, 11 aa, Homo Sapiens
DAQTLDAIRHR

SEQ ID NO: 46388 - protein, 11 aa, Homo Sapiens
DARGRSIAIAR

SEQ ID NO: 46389 - protein, 11 aa, Homo Sapiens
DARGTVVLRVR

SEQ ID NO: 46390 - protein, 11 aa, Homo Sapiens
DARLFTEKILR

SEQ ID NO: 46391 - protein, 11 aa, Homo Sapiens
DATSRNITEAR

SEQ ID NO: 46392 - protein, 11 aa, Homo Sapiens
DAVGFTFPNRL

SEQ ID NO: 46393 - protein, 11 aa, Homo Sapiens
DAWSTTAARKR

SEQ ID NO: 46394 - protein, 11 aa, Homo Sapiens
DAYDMRKALSR

SEQ ID NO: 46395 - protein, 11 aa, Homo Sapiens
DFAGEEVRVTK

SEQ ID NO: 46396 - protein, 11 aa, Homo Sapiens
DFAPEVAWVTR

SEQ ID NO: 46397 - protein, 11 aa, Homo Sapiens
DFASIDWLAQR

SEQ ID NO: 46398 - protein, 11 aa, Homo Sapiens
DFDYLRFLQKR

SEQ ID NO: 46399 - protein, 11 aa, Homo Sapiens
DFFPGSDRFAR

SEQ ID NO: 46400 - protein, 11 aa, Homo Sapiens
DFIDPQEGWKK

SEQ ID NO: 46401 - protein, 11 aa, Homo Sapiens
DFIQEEFQHLK

SEQ ID NO: 46402 - protein, 11 aa, Homo Sapiens
DFKEIEHLVER

SEQ ID NO: 46403 - protein, 11 aa, Homo Sapiens
DFLHNKGIAHR

SEQ ID NO: 46404 - protein, 11 aa, Homo Sapiens
DFLTSREIVNR

SEQ ID NO: 46405 - protein, 11 aa, Homo Sapiens
DFLVVPPSRYR

SEQ ID NO: 46406 - protein, 11 aa, Homo Sapiens
DFNKPGANCQR

SEQ ID NO: 46407 - protein, 11 aa, Homo Sapiens
DFQAPYLLHGK

SEQ ID NO: 46408 - protein, 11 aa, Homo Sapiens
DFRDISKWNNR

SEQ ID NO: 46409 - protein, 11 aa, Homo Sapiens
DFRLPTEEEIR

SEQ ID NO: 46410 - protein, 11 aa, Homo Sapiens
DFRNPGPGRHR

SEQ ID NO: 46411 - protein, 11 aa, Homo Sapiens
DFRQPPEEDLR

SEQ ID NO: 46412 - protein, 11 aa, Homo Sapiens
DFRRPPEEDFR

SEQ ID NO: 46413 - protein, 11 aa, Homo Sapiens
DFSDRIGKTKR

SEQ ID NO: 46414 - protein, 11 aa, Homo Sapiens
DGKGVVVVIKR

SEQ ID NO: 46415 - protein, 11 aa, Homo Sapiens
DGLGPAQIVGR

SEQ ID NO: 46416 - protein, 11 aa, Homo Sapiens
DGLSAAARKQR

SEQ ID NO: 46417 - protein, 11 aa, Homo Sapiens
DGRKRSLEELR

SEQ ID NO: 46418 - protein, 11 aa, Homo Sapiens
DIAKVSIGRLR

SEQ ID NO: 46419 - protein, 11 aa, Homo Sapiens
DIEERPKELVR

SEQ ID NO: 46420 - protein, 11 aa, Homo Sapiens
DIESLRGALGR

SEQ ID NO: 46421 - protein, 11 aa, Homo Sapiens
DIFNQPPNRER

SEQ ID NO: 46422 - protein, 11 aa, Homo Sapiens
DIGAKSLTQVR

SEQ ID NO: 46423 - protein, 11 aa, Homo Sapiens
DIIQPSSTRAR

SEQ ID NO: 46424 - protein, 11 aa, Homo Sapiens
DIKASQILASR

SEQ ID NO: 46425 - protein, 11 aa, Homo Sapiens
DIKASTEMRLR

SEQ ID NO: 46426 - protein, 11 aa, Homo Sapiens
DIKDTDVIMKR

SEQ ID NO: 46427 - protein, 11 aa, Homo Sapiens
DIKPLTSFRQR

SEQ ID NO: 46428 - protein, 11 aa, Homo Sapiens
DIKPSNIFISR

SEQ ID NO: 46429 - protein, 11 aa, Homo Sapiens
DIKSSETGAFR

SEQ ID NO: 46430 - protein, 11 aa, Homo Sapiens
DILHKDGIINR

SEQ ID NO: 46431 - protein, 11 aa, Homo Sapiens
DIMHLTDSVVR

SEQ ID NO: 46432 - protein, 11 aa, Homo Sapiens
DINSRRNINYR

SEQ ID NO: 46433 - protein, 11 aa, Homo Sapiens
DIQNPDITSSR

SEQ ID NO: 46434 - protein, 11 aa, Homo Sapiens
DIREDARLFYR

SEQ ID NO: 46435 - protein, 11 aa, Homo Sapiens
DIRGPLESCLR

SEQ ID NO: 46436 - protein, 11 aa, Homo Sapiens
DIRPEIHENYR

SEQ ID NO: 46437 - protein, 11 aa, Homo Sapiens
DIRRMEEETKR

SEQ ID NO: 46438 - protein, 11 aa, Homo Sapiens
DIWAKTPPITR

SEQ ID NO: 46439 - protein, 11 aa, Homo Sapiens
DIWEKKLAQTK

SEQ ID NO: 46440 - protein, 11 aa, Homo Sapiens
DLADLSCLVYR

SEQ ID NO: 46441 - protein, 11 aa, Homo Sapiens
DLFHRDFQFGH

SEQ ID NO: 46442 - protein, 11 aa, Homo Sapiens
DLFKLGEPHHR

SEQ ID NO: 46443 - protein, 11 aa, Homo Sapiens
DLFRYNPYLKR

SEQ ID NO: 46444 - protein, 11 aa, Homo Sapiens
DLFYKRKAISR

SEQ ID NO: 46445 - protein, 11 aa, Homo Sapiens
DLGGPLPADPM

SEQ ID NO: 46446 - protein, 11 aa, Homo Sapiens
DLIEITDAKKR

SEQ ID NO: 46447 - protein, 11 aa, Homo Sapiens
DLKAQAQLQKR

SEQ ID NO: 46448 - protein, 11 aa, Homo Sapiens
DLKDSSLLKTK

SEQ ID NO: 46449 - protein, 11 aa, Homo Sapiens
DLKEVAIKQFR

SEQ ID NO: 46450 - protein, 11 aa, Homo Sapiens
DLKKPDPASLR

SEQ ID NO: 46451 - protein, 11 aa, Homo Sapiens
DLKPENILCEH

SEQ ID NO: 46452 - protein, 11 aa, Homo Sapiens
DLKSESENIQR

SEQ ID NO: 46453 - protein, 11 aa, Homo Sapiens
DLLAASQVVNR

SEQ ID NO: 46454 - protein, 11 aa, Homo Sapiens
DLLAKEKDNSR

SEQ ID NO: 46455 - protein, 11 aa, Homo Sapiens
DLLEGQKKSSR

SEQ ID NO: 46456 - protein, 11 aa, Homo Sapiens
DLLPKEKRHVL

SEQ ID NO: 46457 - protein, 11 aa, Homo Sapiens
DLLVVTKIFQK

SEQ ID NO: 46458 - protein, 11 aa, Homo Sapiens
DLMKKYDKSLR

SEQ ID NO: 46459 - protein, 11 aa, Homo Sapiens
DLMQKISTQNR

SEQ ID NO: 46460 - protein, 11 aa, Homo Sapiens
DLQPPEALVER

SEQ ID NO: 46461 - protein, 11 aa, Homo Sapiens
DLQQVGGASAR

SEQ ID NO: 46462 - protein, 11 aa, Homo Sapiens
DLQYREKEVKR

SEQ ID NO: 46463 - protein, 11 aa, Homo Sapiens
DLRILPEAHQR

SEQ ID NO: 46464 - protein, 11 aa, Homo Sapiens
DLWKRWKTSEV

SEQ ID NO: 46465 - protein, 11 aa, Homo Sapiens
DLYTVEPNNAR

SEQ ID NO: 46466 - protein, 11 aa, Homo Sapiens
DMKLRGMYIAR

SEQ ID NO: 46467 - protein, 11 aa, Homo Sapiens
DMKPKHLLSGK

SEQ ID NO: 46468 - protein, 11 aa, Homo Sapiens
DMKRRIHLELR

SEQ ID NO: 46469 - protein, 11 aa, Homo Sapiens
DMKSVTDRAAR

SEQ ID NO: 46470 - protein, 11 aa, Homo Sapiens
DMLKIRSEFKR

SEQ ID NO: 46471 - protein, 11 aa, Homo Sapiens
DMMLRNACERL

SEQ ID NO: 46472 - protein, 11 aa, Homo Sapiens
DMMPEGIKQNK

SEQ ID NO: 46473 - protein, 11 aa, Homo Sapiens
DMTARDLLQQR

SEQ ID NO: 46474 - protein, 11 aa, Homo Sapiens
DNFDNISLAQR

SEQ ID NO: 46475 - protein, 11 aa, Homo Sapiens
DNFNGIKIKGR

SEQ ID NO: 46476 - protein, 11 aa, Homo Sapiens
DNFRFTPRIQR

SEQ ID NO: 46477 - protein, 11 aa, Homo Sapiens
DNIDWVKIRER

SEQ ID NO: 46478 - protein, 11 aa, Homo Sapiens
DNISKENCVFR

SEQ ID NO: 46479 - protein, 11 aa, Homo Sapiens
DNKGTAVAICR

SEQ ID NO: 46480 - protein, 11 aa, Homo Sapiens
DNLERDFFLRR

SEQ ID NO: 46481 - protein, 11 aa, Homo Sapiens
DNLLHEKRYLR

SEQ ID NO: 46482 - protein, 11 aa, Homo Sapiens
DNLPSASMYER

SEQ ID NO: 46483 - protein, 11 aa, Homo Sapiens
DNLSSEEIQQR

SEQ ID NO: 46484 - protein, 11 aa, Homo Sapiens
DNLYPESITSR

SEQ ID NO: 46485 - protein, 11 aa, Homo Sapiens
DNMNESELFGR

SEQ ID NO: 46486 - protein, 11 aa, Homo Sapiens
DNMPLRGKQLR

SEQ ID NO: 46487 - protein, 11 aa, Homo Sapiens
DNQLLEERNRR

SEQ ID NO: 46488 - protein, 11 aa, Homo Sapiens
DNRPSVEFHER

SEQ ID NO: 46489 - protein, 11 aa, Homo Sapiens
DNSSTVSIVGR

SEQ ID NO: 46490 - protein, 11 aa, Homo Sapiens
DPWARGSYSYV

SEQ ID NO: 46491 - protein, 11 aa, Homo Sapiens
DSIDPASIEAR

SEQ ID NO: 46492 - protein, 11 aa, Homo Sapiens
DSKTEELRFLR

SEQ ID NO: 46493 - protein, 11 aa, Homo Sapiens
DSLGQDLRRLR

SEQ ID NO: 46494 - protein, 11 aa, Homo Sapiens
DSLMPEEEFLR

SEQ ID NO: 46495 - protein, 11 aa, Homo Sapiens
DSMASGTLHLR

SEQ ID NO: 46496 - protein, 11 aa, Homo Sapiens
DSMLVDPKHHR

SEQ ID NO: 46497 - protein, 11 aa, Homo Sapiens
DSNNEKGLFRR

SEQ ID NO: 46498 - protein, 11 aa, Homo Sapiens
DSQAYDQKNIR

SEQ ID NO: 46499 - protein, 11 aa, Homo Sapiens
DSRFPNQNQTR

SEQ ID NO: 46500 - protein, 11 aa, Homo Sapiens
DSRGQEAISKR

SEQ ID NO: 46501 - protein, 11 aa, Homo Sapiens
DSRSECITATR

SEQ ID NO: 46502 - protein, 11 aa, Homo Sapiens
DSSNPSWWTGR

SEQ ID NO: 46503 - protein, 11 aa, Homo Sapiens
DSVVIVDERRR

SEQ ID NO: 46504 - protein, 11 aa, Homo Sapiens
DTAALSHARLR

SEQ ID NO: 46505 - protein, 11 aa, Homo Sapiens
DTANKKVFLGR

SEQ ID NO: 46506 - protein, 11 aa, Homo Sapiens
DTFLKGKSGLR

SEQ ID NO: 46507 - protein, 11 aa, Homo Sapiens
DTIDERTINKK

SEQ ID NO: 46508 - protein, 11 aa, Homo Sapiens
DTIVSGTLPQR

SEQ ID NO: 46509 - protein, 11 aa, Homo Sapiens
DTKELEKMTNR

SEQ ID NO: 46510 - protein, 11 aa, Homo Sapiens
DTKENLEGTLR

SEQ ID NO: 46511 - protein, 11 aa, Homo Sapiens
DTKGHSLSVQR

SEQ ID NO: 46512 - protein, 11 aa, Homo Sapiens
DTKLSKLDTLR

SEQ ID NO: 46513 - protein, 11 aa, Homo Sapiens
DTKRSQIYGSR

SEQ ID NO: 46514 - protein, 11 aa, Homo Sapiens
DTLLYDSLYTR

SEQ ID NO: 46515 - protein, 11 aa, Homo Sapiens
DTQDSMSLLFR

SEQ ID NO: 46516 - protein, 11 aa, Homo Sapiens
DTQSIGPKVQR

SEQ ID NO: 46517 - protein, 11 aa, Homo Sapiens
DTRARELKEQL

SEQ ID NO: 46518 - protein, 11 aa, Homo Sapiens
DTRKEQETALR

SEQ ID NO: 46519 - protein, 11 aa, Homo Sapiens
DTRQLGLVVCR

SEQ ID NO: 46520 - protein, 11 aa, Homo Sapiens
DTRRESLFSAR

SEQ ID NO: 46521 - protein, 11 aa, Homo Sapiens
DTVTYSALHKR

SEQ ID NO: 46522 - protein, 11 aa, Homo Sapiens
DVAQWNIGSLR

SEQ ID NO: 46523 - protein, 11 aa, Homo Sapiens
DVCDIPESFQR

SEQ ID NO: 46524 - protein, 11 aa, Homo Sapiens
DVFGEGLPTRL

SEQ ID NO: 46525 - protein, 11 aa, Homo Sapiens
DVFPDRDHFGR

SEQ ID NO: 46526 - protein, 11 aa, Homo Sapiens
DVFVVGTERGR

SEQ ID NO: 46527 - protein, 11 aa, Homo Sapiens
DVGGKQFPVTR

SEQ ID NO: 46528 - protein, 11 aa, Homo Sapiens
DVIKEQNRELR

SEQ ID NO: 46529 - protein, 11 aa, Homo Sapiens
DVISRNEIQGR

SEQ ID NO: 46530 - protein, 11 aa, Homo Sapiens
DVKAPAMFNIR

SEQ ID NO: 46531 - protein, 11 aa, Homo Sapiens
DVKDPVSIEER

SEQ ID NO: 46532 - protein, 11 aa, Homo Sapiens
DVKLEDTYFDR

SEQ ID NO: 46533 - protein, 11 aa, Homo Sapiens
DVKLQDAGVYR

SEQ ID NO: 46534 - protein, 11 aa, Homo Sapiens
DVKPSNILVNS

SEQ ID NO: 46535 - protein, 11 aa, Homo Sapiens
DVKQLSEIVVR

SEQ ID NO: 46536 - protein, 11 aa, Homo Sapiens
DVKSMEMLVEH

SEQ ID NO: 46537 - protein, 11 aa, Homo Sapiens
DVKTTDGYLLR

SEQ ID NO: 46538 - protein, 11 aa, Homo Sapiens
DVLEVTKKFMR

SEQ ID NO: 46539 - protein, 11 aa, Homo Sapiens
DVLLFPDKKQR

SEQ ID NO: 46540 - protein, 11 aa, Homo Sapiens
DVLRSAAKFYR

SEQ ID NO: 46541 - protein, 11 aa, Homo Sapiens
DVNSNNNMSYR

SEQ ID NO: 46542 - protein, 11 aa, Homo Sapiens
DVQGDDKRYFR

SEQ ID NO: 46543 - protein, 11 aa, Homo Sapiens
DVRKEEVLILR

SEQ ID NO: 46544 - protein, 11 aa, Homo Sapiens
DVRPTLVLVEK

SEQ ID NO: 46545 - protein, 11 aa, Homo Sapiens
DVSARDWLTRR

SEQ ID NO: 46546 - protein, 11 aa, Homo Sapiens
DVVPKTAENFR

SEQ ID NO: 46547 - protein, 11 aa, Homo Sapiens
DVVPVDSKRYR

SEQ ID NO: 46548 - protein, 11 aa, Homo Sapiens
DVVYALKRQGR

SEQ ID NO: 46549 - protein, 11 aa, Homo Sapiens
DVYNMQSGIHR

SEQ ID NO: 46550 - protein, 11 aa, Homo Sapiens
DVYSLYEPRYR

SEQ ID NO: 46551 - protein, 11 aa, Homo Sapiens
DWDEKRPEFVR

SEQ ID NO: 46552 - protein, 11 aa, Homo Sapiens
DWVPYINGKFK

SEQ ID NO: 46553 - protein, 11 aa, Homo Sapiens
DYCHSMGIMHR

SEQ ID NO: 46554 - protein, 11 aa, Homo Sapiens
DYFAKREQWKK

SEQ ID NO: 46555 - protein, 11 aa, Homo Sapiens
DYFKQWINLKK

SEQ ID NO: 46556 - protein, 11 aa, Homo Sapiens
DYFSPDNLKER

SEQ ID NO: 46557 - protein, 11 aa, Homo Sapiens
DYIHHMGYVHR

SEQ ID NO: 46558 - protein, 11 aa, Homo Sapiens
DYIHRIGRTAR

SEQ ID NO: 46559 - protein, 11 aa, Homo Sapiens
DYIHSKKLIHR

SEQ ID NO: 46560 - protein, 11 aa, Homo Sapiens
DYILLSLVRTR

SEQ ID NO: 46561 - protein, 11 aa, Homo Sapiens
DYINGDSKYMR

SEQ ID NO: 46562 - protein, 11 aa, Homo Sapiens
DYISRAESQSR

SEQ ID NO: 46563 - protein, 11 aa, Homo Sapiens
DYIYHGTVKLR

SEQ ID NO: 46564 - protein, 11 aa, Homo Sapiens
DYKDQLKTGER

SEQ ID NO: 46565 - protein, 11 aa, Homo Sapiens
DYLEFTDARGR

SEQ ID NO: 46566 - protein, 11 aa, Homo Sapiens
DYLHAKNIIHR

SEQ ID NO: 46567 - protein, 11 aa, Homo Sapiens
DYLHAKSIIHR

SEQ ID NO: 46568 - protein, 11 aa, Homo Sapiens
DYLHRHGIIHR

SEQ ID NO: 46569 - protein, 11 aa, Homo Sapiens
DYLHSGKIVYR

SEQ ID NO: 46570 - protein, 11 aa, Homo Sapiens
DYLNAESRVNR

SEQ ID NO: 46571 - protein, 11 aa, Homo Sapiens
DYLPPEMIEGR

SEQ ID NO: 46572 - protein, 11 aa, Homo Sapiens
DYMTPEQRRSR

SEQ ID NO: 46573 - protein, 11 aa, Homo Sapiens
DYQRYREERFR

SEQ ID NO: 46574 - protein, 11 aa, Homo Sapiens
DYRGFLAEMKR

SEQ ID NO: 46575 - protein, 11 aa, Homo Sapiens
DYRYFDPKMLR

SEQ ID NO: 46576 - protein, 11 aa, Homo Sapiens
DYVPSTTKTPR

SEQ ID NO: 46577 - protein, 11 aa, Homo Sapiens
DYVPYVPLRQR

SEQ ID NO: 46578 - protein, 11 aa, Homo Sapiens
DYYDSHNVNTR

SEQ ID NO: 46579 - protein, 11 aa, Homo Sapiens
DYYEESYFTTR

SEQ ID NO: 46580 - protein, 11 aa, Homo Sapiens
DYYGYDYHNYR

SEQ ID NO: 46581 - protein, 11 aa, Homo Sapiens
EAAFATKDRLR

SEQ ID NO: 46582 - protein, 11 aa, Homo Sapiens
EAKPPTVTMPR

SEQ ID NO: 46583 - protein, 11 aa, Homo Sapiens
EALAMGSRALR

SEQ ID NO: 46584 - protein, 11 aa, Homo Sapiens
EALHQKNIVHR

SEQ ID NO: 46585 - protein, 11 aa, Homo Sapiens
EALPEKSLAGR

SEQ ID NO: 46586 - protein, 11 aa, Homo Sapiens
EARPFRGSVGR

SEQ ID NO: 46587 - protein, 11 aa, Homo Sapiens
EDTRDKGLVNR

SEQ ID NO: 46588 - protein, 11 aa, Homo Sapiens
EFKTLEGVITR

SEQ ID NO: 46589 - protein, 11 aa, Homo Sapiens
EFLHANQVIHR

SEQ ID NO: 46590 - protein, 11 aa, Homo Sapiens
EFMQRALQDLR

SEQ ID NO: 46591 - protein, 11 aa, Homo Sapiens
EGDYKTIAKER

SEQ ID NO: 46592 - protein, 11 aa, Homo Sapiens
EIASFDKAKLK

SEQ ID NO: 46593 - protein, 11 aa, Homo Sapiens
EIEKFDKSKLK

SEQ ID NO: 46594 - protein, 11 aa, Homo Sapiens
EIIEKNFDYLR

SEQ ID NO: 46595 - protein, 11 aa, Homo Sapiens
EIKDKDQLVLR

SEQ ID NO: 46596 - protein, 11 aa, Homo Sapiens
EIMEVAKERSR

SEQ ID NO: 46597 - protein, 11 aa, Homo Sapiens
EIMSMGYERER

SEQ ID NO: 46598 - protein, 11 aa, Homo Sapiens
EIRNLTVKDFR

SEQ ID NO: 46599 - protein, 11 aa, Homo Sapiens
ELLIRKLPFQR

SEQ ID NO: 46600 - protein, 11 aa, Homo Sapiens
ELLPKEKFVSR

SEQ ID NO: 46601 - protein, 11 aa, Homo Sapiens
ELREYNLEQQR

SEQ ID NO: 46602 - protein, 11 aa, Homo Sapiens
EMATRAALQAR

SEQ ID NO: 46603 - protein, 11 aa, Homo Sapiens
EMLSSVALINR

SEQ ID NO: 46604 - protein, 11 aa, Homo Sapiens
EMTSLSEYVSR

SEQ ID NO: 46605 - protein, 11 aa, Homo Sapiens
ESLGQSELASR

SEQ ID NO: 46606 - protein, 11 aa, Homo Sapiens
ESLQGQDLFNR

SEQ ID NO: 46607 - protein, 11 aa, Homo Sapiens
ESSGGKLLPCT

SEQ ID NO: 46608 - protein, 11 aa, Homo Sapiens
ETISSKNIISR

SEQ ID NO: 46609 - protein, 11 aa, Homo Sapiens
ETKDSGSFLLR

SEQ ID NO: 46610 - protein, 11 aa, Homo Sapiens
ETLTRPFSGRR

SEQ ID NO: 46611 - protein, 11 aa, Homo Sapiens
ETRPEGSYFSK

SEQ ID NO: 46612 - protein, 11 aa, Homo Sapiens
ETVPKDLRHLR

SEQ ID NO: 46613 - protein, 11 aa, Homo Sapiens
ETVQKETIHPR

SEQ ID NO: 46614 - protein, 11 aa, Homo Sapiens
ETVSEEKRIYR

SEQ ID NO: 46615 - protein, 11 aa, Homo Sapiens
EVAPPKAHEVR

SEQ ID NO: 46616 - protein, 11 aa, Homo Sapiens
EVAQREAETLR

SEQ ID NO: 46617 - protein, 11 aa, Homo Sapiens
EVEPQGVIVTR

SEQ ID NO: 46618 - protein, 11 aa, Homo Sapiens
EVIDQRLIEAR

SEQ ID NO: 46619 - protein, 11 aa, Homo Sapiens
EVIEGYEIACR

SEQ ID NO: 46620 - protein, 11 aa, Homo Sapiens
EVIPYTPAMQR

SEQ ID NO: 46621 - protein, 11 aa, Homo Sapiens
EVKQVESGTLR

SEQ ID NO: 46622 - protein, 11 aa, Homo Sapiens
EVKRLKVTELR

SEQ ID NO: 46623 - protein, 11 aa, Homo Sapiens
EVLAEFERRKR

SEQ ID NO: 46624 - protein, 11 aa, Homo Sapiens
EVLHIGSAHNR

SEQ ID NO: 46625 - protein, 11 aa, Homo Sapiens
EVLREGELEKR

SEQ ID NO: 46626 - protein, 11 aa, Homo Sapiens
EVLRHPRDWVR

SEQ ID NO: 46627 - protein, 11 aa, Homo Sapiens
EVNRLTESTYR

SEQ ID NO: 46628 - protein, 11 aa, Homo Sapiens
EVQDRVMLTGR

SEQ ID NO: 46629 - protein, 11 aa, Homo Sapiens
EVQQARDLQNR

SEQ ID NO: 46630 - protein, 11 aa, Homo Sapiens
EVQVLDDKNVR

SEQ ID NO: 46631 - protein, 11 aa, Homo Sapiens
EVRAVGQGVLR

SEQ ID NO: 46632 - protein, 11 aa, Homo Sapiens
EVRQIASIVQR

SEQ ID NO: 46633 - protein, 11 aa, Homo Sapiens
EVRVANELNAR

SEQ ID NO: 46634 - protein, 11 aa, Homo Sapiens
EVTDHNLHELR

SEQ ID NO: 46635 - protein, 11 aa, Homo Sapiens
EYAERPEVARR

SEQ ID NO: 46636 - protein, 11 aa, Homo Sapiens
EYIHSKNFIHR

SEQ ID NO: 46637 - protein, 11 aa, Homo Sapiens
EYIQMSGRAGR

SEQ ID NO: 46638 - protein, 11 aa, Homo Sapiens
EYISSDGSYAR

SEQ ID NO: 46639 - protein, 11 aa, Homo Sapiens
EYKDPENILHR

SEQ ID NO: 46640 - protein, 11 aa, Homo Sapiens
EYLCHLEEAKR

SEQ ID NO: 46641 - protein, 11 aa, Homo Sapiens
EYLEGNNFVHR

SEQ ID NO: 46642 - protein, 11 aa, Homo Sapiens
EYLEKKNFIHR

SEQ ID NO: 46643 - protein, 11 aa, Homo Sapiens
EYLESKQFLHR

SEQ ID NO: 46644 - protein, 11 aa, Homo Sapiens
EYLHGKGIIHR

SEQ ID NO: 46645 - protein, 11 aa, Homo Sapiens
EYLHNYGIVHR

SEQ ID NO: 46646 - protein, 11 aa, Homo Sapiens
EYLHSQGVVHR

SEQ ID NO: 46647 - protein, 11 aa, Homo Sapiens
EYLHSRDVVYR

SEQ ID NO: 46648 - protein, 11 aa, Homo Sapiens
EYLQRYHIIHR

SEQ ID NO: 46649 - protein, 11 aa, Homo Sapiens
EYLQSSGLAQR

SEQ ID NO: 46650 - protein, 11 aa, Homo Sapiens
EYMEHVYLIHR

SEQ ID NO: 46651 - protein, 11 aa, Homo Sapiens
EYMEVRERIHR

SEQ ID NO: 46652 - protein, 11 aa, Homo Sapiens
EYMGNAGRKER

SEQ ID NO: 46653 - protein, 11 aa, Homo Sapiens
EYNAIGGKYNR

SEQ ID NO: 46654 - protein, 11 aa, Homo Sapiens
EYRQSLHTYLR

SEQ ID NO: 46655 - protein, 11 aa, Homo Sapiens
EYRSEQSVKLR

SEQ ID NO: 46656 - protein, 11 aa, Homo Sapiens
EYVDATNLTPR

SEQ ID NO: 46657 - protein, 11 aa, Homo Sapiens
EYVDNTNLVPR

SEQ ID NO: 46658 - protein, 11 aa, Homo Sapiens
FELDLVTLRSE

SEQ ID NO: 46659 - protein, 11 aa, Homo Sapiens
FSMGNEVLQNR

SEQ ID NO: 46660 - protein, 11 aa, Homo Sapiens
FTLDINTAYAR

SEQ ID NO: 46661 - protein, 11 aa, Homo Sapiens
FYKDGRIVQSR

SEQ ID NO: 46662 - protein, 11 aa, Homo Sapiens
GDDFLRRSSSR

SEQ ID NO: 46663 - protein, 11 aa, Homo Sapiens
GFLYRKTDFYR

SEQ ID NO: 46664 - protein, 11 aa, Homo Sapiens
HFIELDENRQR

SEQ ID NO: 46665 - protein, 11 aa, Homo Sapiens
HIIEKDKITTR

SEQ ID NO: 46666 - protein, 11 aa, Homo Sapiens
HLLDPSSFTGR

SEQ ID NO: 46667 - protein, 11 aa, Homo Sapiens
HLLEKSNIYSK

SEQ ID NO: 46668 - protein, 11 aa, Homo Sapiens
HNLDRKWICGR

SEQ ID NO: 46669 - protein, 11 aa, Homo Sapiens
HVKDAGFYVCR

SEQ ID NO: 46670 - protein, 11 aa, Homo Sapiens
IAKFVDGEWYR

SEQ ID NO: 46671 - protein, 11 aa, Homo Sapiens
IAKPGWKNSIR

SEQ ID NO: 46672 - protein, 11 aa, Homo Sapiens
ILAFREKEWQR

SEQ ID NO: 46673 - protein, 11 aa, Homo Sapiens
INKPDGTFLLR

SEQ ID NO: 46674 - protein, 11 aa, Homo Sapiens
INRPADVIQAR

SEQ ID NO: 46675 - protein, 11 aa, Homo Sapiens
IVNDRQLACAR

SEQ ID NO: 46676 - protein, 11 aa, Homo Sapiens
IVRPPESGLGR

SEQ ID NO: 46677 - protein, 11 aa, Homo Sapiens
IYQYMEEIYHR

SEQ ID NO: 46678 - protein, 11 aa, Homo Sapiens
KSDFKKYVENR

SEQ ID NO: 46679 - protein, 11 aa, Homo Sapiens
LFRPVASQLPR

SEQ ID NO: 46680 - protein, 11 aa, Homo Sapiens
LNQGEGTIRSR

SEQ ID NO: 46681 - protein, 11 aa, Homo Sapiens
LPKAVDDKQLR

SEQ ID NO: 46682 - protein, 11 aa, Homo Sapiens
LTKEEDLAALR

SEQ ID NO: 46683 - protein, 11 aa, Homo Sapiens
LVKPVTINVGR

SEQ ID NO: 46684 - protein, 11 aa, Homo Sapiens
LYRHFDETVNR

SEQ ID NO: 46685 - protein, 11 aa, Homo Sapiens
MDAKSLTAWSR

SEQ ID NO: 46686 - protein, 11 aa, Homo Sapiens
MFRAAAPGQLR

SEQ ID NO: 46687 - protein, 11 aa, Homo Sapiens
MIKGKTPEEIR

SEQ ID NO: 46688 - protein, 11 aa, Homo Sapiens
MLWERLSSTKR

SEQ ID NO: 46689 - protein, 11 aa, Homo Sapiens
MTIMEDYFAYR

SEQ ID NO: 46690 - protein, 11 aa, Homo Sapiens
MVKPTPGLTPR

SEQ ID NO: 46691 - protein, 11 aa, Homo Sapiens
MVLPSRLHWIR

SEQ ID NO: 46692 - protein, 11 aa, Homo Sapiens
MYKDGDSVLQR

SEQ ID NO: 46693 - protein, 11 aa, Homo Sapiens
MYRNEFTAWYR

SEQ ID NO: 46694 - protein, 11 aa, Homo Sapiens
NALEGSTFVSR

SEQ ID NO: 46695 - protein, 11 aa, Homo Sapiens
NALQPSIKFVR

SEQ ID NO: 46696 - protein, 11 aa, Homo Sapiens
NFLKRMSGMIR

SEQ ID NO: 46697 - protein, 11 aa, Homo Sapiens
NFYNRPILSRR

SEQ ID NO: 46698 - protein, 11 aa, Homo Sapiens
NGRPLEMIEPR

SEQ ID NO: 46699 - protein, 11 aa, Homo Sapiens
NGWNRDAYSLR

SEQ ID NO: 46700 - protein, 11 aa, Homo Sapiens
NIHLRSTLCSR

SEQ ID NO: 46701 - protein, 11 aa, Homo Sapiens
NINDRSMLGKR

SEQ ID NO: 46702 - protein, 11 aa, Homo Sapiens
NIRDIDKIYVR

SEQ ID NO: 46703 - protein, 11 aa, Homo Sapiens
NLAEKSTVHMR

SEQ ID NO: 46704 - protein, 11 aa, Homo Sapiens
NLAGAEELFAR

SEQ ID NO: 46705 - protein, 11 aa, Homo Sapiens
NLKDRDFLVQR

SEQ ID NO: 46706 - protein, 11 aa, Homo Sapiens
NLKPGECLRVR

SEQ ID NO: 46707 - protein, 11 aa, Homo Sapiens
NLLDLKNPFFR

SEQ ID NO: 46708 - protein, 11 aa, Homo Sapiens
NLMELTQIYQR

SEQ ID NO: 46709 - protein, 11 aa, Homo Sapiens
NLQELKDLNQR

SEQ ID NO: 46710 - protein, 11 aa, Homo Sapiens
NNIDYTVHSVR

SEQ ID NO: 46711 - protein, 11 aa, Homo Sapiens
NPTLSSLDVKR

SEQ ID NO: 46712 - protein, 11 aa, Homo Sapiens
NQDTLVPYGNR

SEQ ID NO: 46713 - protein, 11 aa, Homo Sapiens
NTIGKEEIQQR

SEQ ID NO: 46714 - protein, 11 aa, Homo Sapiens
NTMDADSLVSR

SEQ ID NO: 46715 - protein, 11 aa, Homo Sapiens
NVKNVSVKDVR

SEQ ID NO: 46716 - protein, 11 aa, Homo Sapiens
NVLEFTSARKR

SEQ ID NO: 46717 - protein, 11 aa, Homo Sapiens
NVLQAPLPPMR

SEQ ID NO: 46718 - protein, 11 aa, Homo Sapiens
NVRETHSLFFR

SEQ ID NO: 46719 - protein, 11 aa, Homo Sapiens
NVRNGYGFINR

SEQ ID NO: 46720 - protein, 11 aa, Homo Sapiens
NWINVDPSRAR

SEQ ID NO: 46721 - protein, 11 aa, Homo Sapiens
NYFFYNKRLKR

SEQ ID NO: 46722 - protein, 11 aa, Homo Sapiens
QAQLRGQDAAR

SEQ ID NO: 46723 - protein, 11 aa, Homo Sapiens
QARLRDDTELR

SEQ ID NO: 46724 - protein, 11 aa, Homo Sapiens
QFLERFKSSAR

SEQ ID NO: 46725 - protein, 11 aa, Homo Sapiens
QPLSPIRNRTP

SEQ ID NO: 46726 - protein, 11 aa, Homo Sapiens
SFFSPSPARKR

SEQ ID NO: 46727 - protein, 11 aa, Homo Sapiens
SFKDVDQMFQR

SEQ ID NO: 46728 - protein, 11 aa, Homo Sapiens
SLDFNLRTHVR

SEQ ID NO: 46729 - protein, 11 aa, Homo Sapiens
SLKGVDPKFLR

SEQ ID NO: 46730 - protein, 11 aa, Homo Sapiens
SLQNAESWINR

SEQ ID NO: 46731 - protein, 11 aa, Homo Sapiens
SMASEEVLKNR

SEQ ID NO: 46732 - protein, 11 aa, Homo Sapiens
STIDWNKLYRR

SEQ ID NO: 46733 - protein, 11 aa, Homo Sapiens
STKDILSQHER

SEQ ID NO: 46734 - protein, 11 aa, Homo Sapiens
STKPPGTFLLR

SEQ ID NO: 46735 - protein, 11 aa, Homo Sapiens
SVKEISDIVQR

SEQ ID NO: 46736 - protein, 11 aa, Homo Sapiens
SVMDQEMRVKR

SEQ ID NO: 46737 - protein, 11 aa, Homo Sapiens
SVQPSSSLSAR

SEQ ID NO: 46738 - protein, 11 aa, Homo Sapiens
SVREGQGFAFR

SEQ ID NO: 46739 - protein, 11 aa, Homo Sapiens
SVREVRQLTLR

SEQ ID NO: 46740 - protein, 11 aa, Homo Sapiens
SVTPEGVIKQR

SEQ ID NO: 46741 - protein, 11 aa, Homo Sapiens
SYRDVNSWCRR

SEQ ID NO: 46742 - protein, 11 aa, Homo Sapiens
TAASRPPVTLR

SEQ ID NO: 46743 - protein, 11 aa, Homo Sapiens
TAFDRDRAMQR

SEQ ID NO: 46744 - protein, 11 aa, Homo Sapiens
TELSVRAKPSA

SEQ ID NO: 46745 - protein, 11 aa, Homo Sapiens
TIIEVNGKRVR

SEQ ID NO: 46746 - protein, 11 aa, Homo Sapiens
TIMPKDIQLAR

SEQ ID NO: 46747 - protein, 11 aa, Homo Sapiens
TMKSANICIGR

SEQ ID NO: 46748 - protein, 11 aa, Homo Sapiens
TTFTWNINHAR

SEQ ID NO: 46749 - protein, 11 aa, Homo Sapiens
TTLGATQLSER

SEQ ID NO: 46750 - protein, 11 aa, Homo Sapiens
TVFDAKRLIGR

SEQ ID NO: 46751 - protein, 11 aa, Homo Sapiens
TVIEKTESWPR

SEQ ID NO: 46752 - protein, 11 aa, Homo Sapiens
TVKDLRLVTNR

SEQ ID NO: 46753 - protein, 11 aa, Homo Sapiens
TYKRFEGLTQR

SEQ ID NO: 46754 - protein, 11 aa, Homo Sapiens
TYLSESQIQSR

SEQ ID NO: 46755 - protein, 11 aa, Homo Sapiens
VMADPKGKAYR

SEQ ID NO: 46756 - protein, 11 aa, Homo Sapiens
VNLPPELRRQR

SEQ ID NO: 46757 - protein, 11 aa, Homo Sapiens
VPMRPGILVQR

SEQ ID NO: 46758 - protein, 11 aa, Homo Sapiens
VTNTRTPSSVR

SEQ ID NO: 46759 - protein, 11 aa, Homo Sapiens
VVKPDQLIKRR

SEQ ID NO: 46760 - protein, 11 aa, Homo Sapiens
VYRNPESFKEK

SEQ ID NO: 46761 - protein, 11 aa, Homo Sapiens
YFLHRLLHHKR

SEQ ID NO: 46762 - protein, 8 aa, Homo Sapiens
AHARIHLR

SEQ ID NO: 46763 - protein, 8 aa, Homo Sapiens
DLFVFPYR

SEQ ID NO: 46764 - protein, 8 aa, Homo Sapiens
DMQRIHLR

SEQ ID NO: 46765 - protein, 8 aa, Homo Sapiens
DTFRPTAR

SEQ ID NO: 46766 - protein, 8 aa, Homo Sapiens
DTNLPANR

SEQ ID NO: 46767 - protein, 8 aa, Homo Sapiens
DTQIPTSR

SEQ ID NO: 46768 - protein, 8 aa, Homo Sapiens
DYRTPTLR

SEQ ID NO: 46769 - protein, 8 aa, Homo Sapiens
EAIKITNR

SEQ ID NO: 46770 - protein, 8 aa, Homo Sapiens
EALLPQNR

SEQ ID NO: 46771 - protein, 8 aa, Homo Sapiens
EALLPTRR

SEQ ID NO: 46772 - protein, 8 aa, Homo Sapiens
EANVPVYR

SEQ ID NO: 46773 - protein, 8 aa, Homo Sapiens
EAQIIQRR

SEQ ID NO: 46774 - protein, 8 aa, Homo Sapiens
EAYKVFSR

SEQ ID NO: 46775 - protein, 8 aa, Homo Sapiens
EEQLQQIR

SEQ ID NO: 46776 - protein, 8 aa, Homo Sapiens
EIFRPFYR

SEQ ID NO: 46777 - protein, 8 aa, Homo Sapiens
ELMVPFTR

SEQ ID NO: 46778 - protein, 8 aa, Homo Sapiens
ENYSPVSR

SEQ ID NO: 46779 - protein, 8 aa, Homo Sapiens
ESLVPTAR

SEQ ID NO: 46780 - protein, 8 aa, Homo Sapiens
ETLVIQQR

SEQ ID NO: 46781 - protein, 8 aa, Homo Sapiens
ETMEPALR

SEQ ID NO: 46782 - protein, 8 aa, Homo Sapiens
ETVRIINR

SEQ ID NO: 46783 - protein, 8 aa, Homo Sapiens
ETYSPFFR

SEQ ID NO: 46784 - protein, 8 aa, Homo Sapiens
EVAIPHNR

SEQ ID NO: 46785 - protein, 8 aa, Homo Sapiens
EVKIPKPR

SEQ ID NO: 46786 - protein, 8 aa, Homo Sapiens
EVNIPNRR

SEQ ID NO: 46787 - protein, 8 aa, Homo Sapiens
EVNIPRKR

SEQ ID NO: 46788 - protein, 8 aa, Homo Sapiens
EYMTPSSR

SEQ ID NO: 46789 - protein, 8 aa, Homo Sapiens
FTLKPKKR

SEQ ID NO: 46790 - protein, 8 aa, Homo Sapiens
HANCIVHR

SEQ ID NO: 46791 - protein, 8 aa, Homo Sapiens
HNMGIVHR

SEQ ID NO: 46792 - protein, 8 aa, Homo Sapiens
HNTIICAR

SEQ ID NO: 46793 - protein, 8 aa, Homo Sapiens
HSFRPAYR

SEQ ID NO: 46794 - protein, 8 aa, Homo Sapiens
HTTKPILR

SEQ ID NO: 46795 - protein, 8 aa, Homo Sapiens
MAHHPTFR

SEQ ID NO: 46796 - protein, 8 aa, Homo Sapiens
MAYEPVQR

SEQ ID NO: 46797 - protein, 8 aa, Homo Sapiens
MAYVPVSR

SEQ ID NO: 46798 - protein, 8 aa, Homo Sapiens
MSLTACKV

SEQ ID NO: 46799 - protein, 8 aa, Homo Sapiens
MTGLPHNR

SEQ ID NO: 46800 - protein, 8 aa, Homo Sapiens
MVNVPKTR

SEQ ID NO: 46801 - protein, 8 aa, Homo Sapiens
NLWVPSRR

SEQ ID NO: 46802 - protein, 8 aa, Homo Sapiens
NPNVPAYR

SEQ ID NO: 46803 - protein, 8 aa, Homo Sapiens
PKDIQLAR

SEQ ID NO: 46804 - protein, 8 aa, Homo Sapiens
QNYLPRHR

SEQ ID NO: 46805 - protein, 8 aa, Homo Sapiens
SGPSIVHR

SEQ ID NO: 46806 - protein, 8 aa, Homo Sapiens
TEELAYLK

SEQ ID NO: 46807 - protein, 8 aa, Homo Sapiens
TGNPTVVR

SEQ ID NO: 46808 - protein, 8 aa, Homo Sapiens
VNMVPFPR

SEQ ID NO: 46809 - protein, 8 aa, Homo Sapiens
YAYIPLNR

SEQ ID NO: 46810 - protein, 8 aa, Homo Sapiens
YEDIAQKS

SEQ ID NO: 46811 - protein, 8 aa, Homo Sapiens
YEEIAQRS

SEQ ID NO: 46812 - protein, 8 aa, Homo Sapiens
YFKEPSLR

SEQ ID NO: 46813 - protein, 8 aa, Homo Sapiens
YTKVPIKR

SEQ ID NO: 46814 - protein, 8 aa, Homo Sapiens
YYGSFVTR

SEQ ID NO: 46815 - protein, 9 aa, Homo Sapiens
AANGKLFSR

SEQ ID NO: 46816 - protein, 9 aa, Homo Sapiens
ADRQVLAQR

SEQ ID NO: 46817 - protein, 9 aa, Homo Sapiens
AEAALGLAR

SEQ ID NO: 46818 - protein, 9 aa, Homo Sapiens
AGKSVHVLR

SEQ ID NO: 46819 - protein, 9 aa, Homo Sapiens
ALNGKIYFR

SEQ ID NO: 46820 - protein, 9 aa, Homo Sapiens
ATLNVSTTR

SEQ ID NO: 46821 - protein, 9 aa, Homo Sapiens
ATLYLGWNR

SEQ ID NO: 46822 - protein, 9 aa, Homo Sapiens
ATNILTATR

SEQ ID NO: 46823 - protein, 9 aa, Homo Sapiens
ATQSFSTFR

SEQ ID NO: 46824 - protein, 9 aa, Homo Sapiens
ATSPALFNR

SEQ ID NO: 46825 - protein, 9 aa, Homo Sapiens
AYKNVIGAR

SEQ ID NO: 46826 - protein, 9 aa, Homo Sapiens
AYKNVVGAR

SEQ ID NO: 46827 - protein, 9 aa, Homo Sapiens
AYKSILQER

SEQ ID NO: 46828 - protein, 9 aa, Homo Sapiens
AYMQYIHHR

SEQ ID NO: 46829 - protein, 9 aa, Homo Sapiens
AYNETFSNR

SEQ ID NO: 46830 - protein, 9 aa, Homo Sapiens
CTKEFQARR

SEQ ID NO: 46831 - protein, 9 aa, Homo Sapiens
CVKSFVTKR

SEQ ID NO: 46832 - protein, 9 aa, Homo Sapiens
CVNGHFFHR

SEQ ID NO: 46833 - protein, 9 aa, Homo Sapiens
CVNPYHYER

SEQ ID NO: 46834 - protein, 9 aa, Homo Sapiens
CVNPYHYQR

SEQ ID NO: 46835 - protein, 9 aa, Homo Sapiens
CVNQFIISR

SEQ ID NO: 46836 - protein, 9 aa, Homo Sapiens
DAACRVIAR

SEQ ID NO: 46837 - protein, 9 aa, Homo Sapiens
DAISYRFPR

SEQ ID NO: 46838 - protein, 9 aa, Homo Sapiens
DAKGGSFYR

SEQ ID NO: 46839 - protein, 9 aa, Homo Sapiens
DAKSVFHTR

SEQ ID NO: 46840 - protein, 9 aa, Homo Sapiens
DALGGLLNR

SEQ ID NO: 46841 - protein, 9 aa, Homo Sapiens
DANAKFYCR

SEQ ID NO: 46842 - protein, 9 aa, Homo Sapiens
DANPFLSKR

SEQ ID NO: 46843 - protein, 9 aa, Homo Sapiens
DANPVRYGR

SEQ ID NO: 46844 - protein, 9 aa, Homo Sapiens
DAQEIIRPR

SEQ ID NO: 46845 - protein, 9 aa, Homo Sapiens
DAQEILHSR

SEQ ID NO: 46846 - protein, 9 aa, Homo Sapiens
DAQKPSLTR

SEQ ID NO: 46847 - protein, 9 aa, Homo Sapiens
DAQRLHYYR

SEQ ID NO: 46848 - protein, 9 aa, Homo Sapiens
DAQRLISER

SEQ ID NO: 46849 - protein, 9 aa, Homo Sapiens
DARGTVVLR

SEQ ID NO: 46850 - protein, 9 aa, Homo Sapiens
DARIPLSGR

SEQ ID NO: 46851 - protein, 9 aa, Homo Sapiens
DASLLIVNR

SEQ ID NO: 46852 - protein, 9 aa, Homo Sapiens
DAVARLVAR

SEQ ID NO: 46853 - protein, 9 aa, Homo Sapiens
DAWEPKVLR

SEQ ID NO: 46854 - protein, 9 aa, Homo Sapiens
DAWRFWHKR

SEQ ID NO: 46855 - protein, 9 aa, Homo Sapiens
DFALIHKER

SEQ ID NO: 46856 - protein, 9 aa, Homo Sapiens
DFARRLGLR

SEQ ID NO: 46857 - protein, 9 aa, Homo Sapiens
DFDDRRVGR

SEQ ID NO: 46858 - protein, 9 aa, Homo Sapiens
DFHFRTDER

SEQ ID NO: 46859 - protein, 9 aa, Homo Sapiens
DFHSVSKLR

SEQ ID NO: 46860 - protein, 9 aa, Homo Sapiens
DFIAKVVQR

SEQ ID NO: 46861 - protein, 9 aa, Homo Sapiens
DFKDPPTAK

SEQ ID NO: 46862 - protein, 9 aa, Homo Sapiens
DFKKYVENR

SEQ ID NO: 46863 - protein, 9 aa, Homo Sapiens
DFKNVLSNR

SEQ ID NO: 46864 - protein, 9 aa, Homo Sapiens
DFKRVVGKK

SEQ ID NO: 46865 - protein, 9 aa, Homo Sapiens
DFKRYVTDR

SEQ ID NO: 46866 - protein, 9 aa, Homo Sapiens
DFLQKRKER

SEQ ID NO: 46867 - protein, 9 aa, Homo Sapiens
DFLRRSSSR

SEQ ID NO: 46868 - protein, 9 aa, Homo Sapiens
DFNNRLNNR

SEQ ID NO: 46869 - protein, 9 aa, Homo Sapiens
DFPRPVHHR

SEQ ID NO: 46870 - protein, 9 aa, Homo Sapiens
DFREKGGYR

SEQ ID NO: 46871 - protein, 9 aa, Homo Sapiens
DFSAGVANR

SEQ ID NO: 46872 - protein, 9 aa, Homo Sapiens
DFSTRFITR

SEQ ID NO: 46873 - protein, 9 aa, Homo Sapiens
DFVGVHQER

SEQ ID NO: 46874 - protein, 9 aa, Homo Sapiens
DFYHNVAER

SEQ ID NO: 46875 - protein, 9 aa, Homo Sapiens
DFYLQSVER

SEQ ID NO: 46876 - protein, 9 aa, Homo Sapiens
DFYVRVFVR

SEQ ID NO: 46877 - protein, 9 aa, Homo Sapiens
DIAGRDITR

SEQ ID NO: 46878 - protein, 9 aa, Homo Sapiens
DICPFEVNR

SEQ ID NO: 46879 - protein, 9 aa, Homo Sapiens
DIHNIHVMR

SEQ ID NO: 46880 - protein, 9 aa, Homo Sapiens
DIKHFVSER

SEQ ID NO: 46881 - protein, 9 aa, Homo Sapiens
DIKNLVVKR

SEQ ID NO: 46882 - protein, 9 aa, Homo Sapiens
DIKSHYAFR

SEQ ID NO: 46883 - protein, 9 aa, Homo Sapiens
DIKSYYTVR

SEQ ID NO: 46884 - protein, 9 aa, Homo Sapiens
DILARAFSR

SEQ ID NO: 46885 - protein, 9 aa, Homo Sapiens
DISNVKIPK

SEQ ID NO: 46886 - protein, 9 aa, Homo Sapiens
DIYLRMTGR

SEQ ID NO: 46887 - protein, 9 aa, Homo Sapiens
DIYNHRFHR

SEQ ID NO: 46888 - protein, 9 aa, Homo Sapiens
DLFEKRTNR

SEQ ID NO: 46889 - protein, 9 aa, Homo Sapiens
DLIDRGWRR

SEQ ID NO: 46890 - protein, 9 aa, Homo Sapiens
DLKGPCSER

SEQ ID NO: 46891 - protein, 9 aa, Homo Sapiens
DLKKPIYQR

SEQ ID NO: 46892 - protein, 9 aa, Homo Sapiens
DLKRPFLSR

SEQ ID NO: 46893 - protein, 9 aa, Homo Sapiens
DLNEKIAQR

SEQ ID NO: 46894 - protein, 9 aa, Homo Sapiens
DLNHKYWER

SEQ ID NO: 46895 - protein, 9 aa, Homo Sapiens
DLNRLITQR

SEQ ID NO: 46896 - protein, 9 aa, Homo Sapiens
DLREQTHTR

SEQ ID NO: 46897 - protein, 9 aa, Homo Sapiens
DMFATPQYR

SEQ ID NO: 46898 - protein, 9 aa, Homo Sapiens
DMHSLVRSR

SEQ ID NO: 46899 - protein, 9 aa, Homo Sapiens
DMNEPSVFR

SEQ ID NO: 46900 - protein, 9 aa, Homo Sapiens
DMRKIGSSR

SEQ ID NO: 46901 - protein, 9 aa, Homo Sapiens
DMRVHPYQR

SEQ ID NO: 46902 - protein, 9 aa, Homo Sapiens
DMYSSPYLR

SEQ ID NO: 46903 - protein, 9 aa, Homo Sapiens
DNRTLYHLR

SEQ ID NO: 46904 - protein, 9 aa, Homo Sapiens
DSFTGPRRR

SEQ ID NO: 46905 - protein, 9 aa, Homo Sapiens
DSMPEPASR

SEQ ID NO: 46906 - protein, 9 aa, Homo Sapiens
DSRPPFLSR

SEQ ID NO: 46907 - protein, 9 aa, Homo Sapiens
DSYSPPHVR

SEQ ID NO: 46908 - protein, 9 aa, Homo Sapiens
DTHGSFVVR

SEQ ID NO: 46909 - protein, 9 aa, Homo Sapiens
DTKNIAFER

SEQ ID NO: 46910 - protein, 9 aa, Homo Sapiens
DTKSPQFNR

SEQ ID NO: 46911 - protein, 9 aa, Homo Sapiens
DTLVPYGNR

SEQ ID NO: 46912 - protein, 9 aa, Homo Sapiens
DTRPHYITR

SEQ ID NO: 46913 - protein, 9 aa, Homo Sapiens
DTRSEFYKH

SEQ ID NO: 46914 - protein, 9 aa, Homo Sapiens
DTYLHRVAR

SEQ ID NO: 46915 - protein, 9 aa, Homo Sapiens
DVFPGPSFR

SEQ ID NO: 46916 - protein, 9 aa, Homo Sapiens
DVFVVGTER

SEQ ID NO: 46917 - protein, 9 aa, Homo Sapiens
DVKPSWTTR

SEQ ID NO: 46918 - protein, 9 aa, Homo Sapiens
DVLQWIVQR

SEQ ID NO: 46919 - protein, 9 aa, Homo Sapiens
DVLSHFAQR

SEQ ID NO: 46920 - protein, 9 aa, Homo Sapiens
DVNIRHSGR

SEQ ID NO: 46921 - protein, 9 aa, Homo Sapiens
DVNNIGKYR

SEQ ID NO: 46922 - protein, 9 aa, Homo Sapiens
DVNSFVRSR

SEQ ID NO: 46923 - protein, 9 aa, Homo Sapiens
DVNSGFAKR

SEQ ID NO: 46924 - protein, 9 aa, Homo Sapiens
DVNVISWSR

SEQ ID NO: 46925 - protein, 9 aa, Homo Sapiens
DVNYKMHFR

SEQ ID NO: 46926 - protein, 9 aa, Homo Sapiens
DVQERLVYR

SEQ ID NO: 46927 - protein, 9 aa, Homo Sapiens
DVQHFKVLR

SEQ ID NO: 46928 - protein, 9 aa, Homo Sapiens
DVQPKLWAR

SEQ ID NO: 46929 - protein, 9 aa, Homo Sapiens
DVRMGGSFR

SEQ ID NO: 46930 - protein, 9 aa, Homo Sapiens
DVRSDFQRR

SEQ ID NO: 46931 - protein, 9 aa, Homo Sapiens
DVRSVTSVR

SEQ ID NO: 46932 - protein, 9 aa, Homo Sapiens
DVSHPIIYR

SEQ ID NO: 46933 - protein, 9 aa, Homo Sapiens
DVYTPKSSR

SEQ ID NO: 46934 - protein, 9 aa, Homo Sapiens
DWKTISKER

SEQ ID NO: 46935 - protein, 9 aa, Homo Sapiens
DYARLVKGR

SEQ ID NO: 46936 - protein, 9 aa, Homo Sapiens
DYFDALYKR

SEQ ID NO: 46937 - protein, 9 aa, Homo Sapiens
DYFHNGNPR

SEQ ID NO: 46938 - protein, 9 aa, Homo Sapiens
DYFKKPQSR

SEQ ID NO: 46939 - protein, 9 aa, Homo Sapiens
DYGHLSVYR

SEQ ID NO: 46940 - protein, 9 aa, Homo Sapiens
DYIKLYVRR

SEQ ID NO: 46941 - protein, 9 aa, Homo Sapiens
DYIKVFKPK

SEQ ID NO: 46942 - protein, 9 aa, Homo Sapiens
DYISLAKTR

SEQ ID NO: 46943 - protein, 9 aa, Homo Sapiens
DYIVKHTKR

SEQ ID NO: 46944 - protein, 9 aa, Homo Sapiens
DYIVKIFDR

SEQ ID NO: 46945 - protein, 9 aa, Homo Sapiens
DYKDIEHLK

SEQ ID NO: 46946 - protein, 9 aa, Homo Sapiens
DYKRNLPRR

SEQ ID NO: 46947 - protein, 9 aa, Homo Sapiens
DYKTIAKER

SEQ ID NO: 46948 - protein, 9 aa, Homo Sapiens
DYLAHESRR

SEQ ID NO: 46949 - protein, 9 aa, Homo Sapiens
DYLEFQKNR

SEQ ID NO: 46950 - protein, 9 aa, Homo Sapiens
DYLENIFVK

SEQ ID NO: 46951 - protein, 9 aa, Homo Sapiens
DYLEQQVAR

SEQ ID NO: 46952 - protein, 9 aa, Homo Sapiens
DYLQFAYYR

SEQ ID NO: 46953 - protein, 9 aa, Homo Sapiens
DYLVFANNR

SEQ ID NO: 46954 - protein, 9 aa, Homo Sapiens
DYLVPPALR

SEQ ID NO: 46955 - protein, 9 aa, Homo Sapiens
DYMASTIGR

SEQ ID NO: 46956 - protein, 9 aa, Homo Sapiens
DYNLIVIER

SEQ ID NO: 46957 - protein, 9 aa, Homo Sapiens
DYNPLYKER

SEQ ID NO: 46958 - protein, 9 aa, Homo Sapiens
DYNPSFAIR

SEQ ID NO: 46959 - protein, 9 aa, Homo Sapiens
DYPPEFHQR

SEQ ID NO: 46960 - protein, 9 aa, Homo Sapiens
DYQTHFRLR

SEQ ID NO: 46961 - protein, 9 aa, Homo Sapiens
DYRALVHER

SEQ ID NO: 46962 - protein, 9 aa, Homo Sapiens
DYRDTVVKR

SEQ ID NO: 46963 - protein, 9 aa, Homo Sapiens
DYRGSGFDR

SEQ ID NO: 46964 - protein, 9 aa, Homo Sapiens
DYRMKEWSR

SEQ ID NO: 46965 - protein, 9 aa, Homo Sapiens
DYSKPSAKR

SEQ ID NO: 46966 - protein, 9 aa, Homo Sapiens
DYSQNVAVR

SEQ ID NO: 46967 - protein, 9 aa, Homo Sapiens
DYSQSLHAR

SEQ ID NO: 46968 - protein, 9 aa, Homo Sapiens
DYTDFYSSR

SEQ ID NO: 46969 - protein, 9 aa, Homo Sapiens
DYTNERALR

SEQ ID NO: 46970 - protein, 9 aa, Homo Sapiens
DYTSHITCR

SEQ ID NO: 46971 - protein, 9 aa, Homo Sapiens
DYTTCFSSR

SEQ ID NO: 46972 - protein, 9 aa, Homo Sapiens
DYVDIVQGR

SEQ ID NO: 46973 - protein, 9 aa, Homo Sapiens
DYVPETVYR

SEQ ID NO: 46974 - protein, 9 aa, Homo Sapiens
DYVPYVPLR

SEQ ID NO: 46975 - protein, 9 aa, Homo Sapiens
DYYARVEGR

SEQ ID NO: 46976 - protein, 9 aa, Homo Sapiens
DYYSLLNVR

SEQ ID NO: 46977 - protein, 9 aa, Homo Sapiens
EAAAIIAQR

SEQ ID NO: 46978 - protein, 9 aa, Homo Sapiens
EAAAPLRVR

SEQ ID NO: 46979 - protein, 9 aa, Homo Sapiens
EAAAVLMAR

SEQ ID NO: 46980 - protein, 9 aa, Homo Sapiens
EAAESIAFR

SEQ ID NO: 46981 - protein, 9 aa, Homo Sapiens
EAAKDLLYR

SEQ ID NO: 46982 - protein, 9 aa, Homo Sapiens
EAAQKFLER

SEQ ID NO: 46983 - protein, 9 aa, Homo Sapiens
EAAYIGSMR

SEQ ID NO: 46984 - protein, 9 aa, Homo Sapiens
EACDIMVKR

SEQ ID NO: 46985 - protein, 9 aa, Homo Sapiens
EACIVLSER

SEQ ID NO: 46986 - protein, 9 aa, Homo Sapiens
EAECYFHSR

SEQ ID NO: 46987 - protein, 9 aa, Homo Sapiens
EAFEFVKQR

SEQ ID NO: 46988 - protein, 9 aa, Homo Sapiens
EAFKPKIGK

SEQ ID NO: 46989 - protein, 9 aa, Homo Sapiens
EAFLHQQKR

SEQ ID NO: 46990 - protein, 9 aa, Homo Sapiens
EAFSRPLSR

SEQ ID NO: 46991 - protein, 9 aa, Homo Sapiens
EAFVIDAVR

SEQ ID NO: 46992 - protein, 9 aa, Homo Sapiens
EAGGPLTPR

SEQ ID NO: 46993 - protein, 9 aa, Homo Sapiens
EAGPSIVHR

SEQ ID NO: 46994 - protein, 9 aa, Homo Sapiens
EAHARIHLR

SEQ ID NO: 46995 - protein, 9 aa, Homo Sapiens
EAHNILSKR

SEQ ID NO: 46996 - protein, 9 aa, Homo Sapiens
EAIARYQGR

SEQ ID NO: 46997 - protein, 9 aa, Homo Sapiens
EAIGIDKDR

SEQ ID NO: 46998 - protein, 9 aa, Homo Sapiens
EAIPGLAAR

SEQ ID NO: 46999 - protein, 9 aa, Homo Sapiens
EAKAPILKR

SEQ ID NO: 47000 - protein, 9 aa, Homo Sapiens
EAKFFTESR

SEQ ID NO: 47001 - protein, 9 aa, Homo Sapiens
EAKFPTMNR

SEQ ID NO: 47002 - protein, 9 aa, Homo Sapiens
EAKLREELR

SEQ ID NO: 47003 - protein, 9 aa, Homo Sapiens
EALDGVVKR

SEQ ID NO: 47004 - protein, 9 aa, Homo Sapiens
EALEMSRNR

SEQ ID NO: 47005 - protein, 9 aa, Homo Sapiens
EALESLVNR

SEQ ID NO: 47006 - protein, 9 aa, Homo Sapiens
EALGALVCR

SEQ ID NO: 47007 - protein, 9 aa, Homo Sapiens
EALGLRKKR

SEQ ID NO: 47008 - protein, 9 aa, Homo Sapiens
EALKDFEKR

SEQ ID NO: 47009 - protein, 9 aa, Homo Sapiens
EALKLARQI

SEQ ID NO: 47010 - protein, 9 aa, Homo Sapiens
EALLPYTER

SEQ ID NO: 47011 - protein, 9 aa, Homo Sapiens
EALNQVTQR

SEQ ID NO: 47012 - protein, 9 aa, Homo Sapiens
EALNVLVNR

SEQ ID NO: 47013 - protein, 9 aa, Homo Sapiens
EALPGLQRR

SEQ ID NO: 47014 - protein, 9 aa, Homo Sapiens
EALQKKFNK

SEQ ID NO: 47015 - protein, 9 aa, Homo Sapiens
EALREISGR

SEQ ID NO: 47016 - protein, 9 aa, Homo Sapiens
EALRGLYGR

SEQ ID NO: 47017 - protein, 9 aa, Homo Sapiens
EALSALTAR

SEQ ID NO: 47018 - protein, 9 aa, Homo Sapiens
EALTALMSR

SEQ ID NO: 47019 - protein, 9 aa, Homo Sapiens
EALTQAFRR

SEQ ID NO: 47020 - protein, 9 aa, Homo Sapiens
EALVMPTLR

SEQ ID NO: 47021 - protein, 9 aa, Homo Sapiens
EALVPVIHR

SEQ ID NO: 47022 - protein, 9 aa, Homo Sapiens
EALYDICFR

SEQ ID NO: 47023 - protein, 9 aa, Homo Sapiens
EAMALPLYR

SEQ ID NO: 47024 - protein, 9 aa, Homo Sapiens
EAMASIINR

SEQ ID NO: 47025 - protein, 9 aa, Homo Sapiens
EAMEILTAR

SEQ ID NO: 47026 - protein, 9 aa, Homo Sapiens
EAMKHVYFR

SEQ ID NO: 47027 - protein, 9 aa, Homo Sapiens
EAMRRLQER

SEQ ID NO: 47028 - protein, 9 aa, Homo Sapiens
EAMRWFQQK

SEQ ID NO: 47029 - protein, 9 aa, Homo Sapiens
EAMTIFQNR

SEQ ID NO: 47030 - protein, 9 aa, Homo Sapiens
EAMTVAIRR

SEQ ID NO: 47031 - protein, 9 aa, Homo Sapiens
EANEEFALR

SEQ ID NO: 47032 - protein, 9 aa, Homo Sapiens
EANIFTKQR

SEQ ID NO: 47033 - protein, 9 aa, Homo Sapiens
EANSQYFHL

SEQ ID NO: 47034 - protein, 9 aa, Homo Sapiens
EAQAIETAR

SEQ ID NO: 47035 - protein, 9 aa, Homo Sapiens
EAQEVTIAR

SEQ ID NO: 47036 - protein, 9 aa, Homo Sapiens
EAQFQKNVR

SEQ ID NO: 47037 - protein, 9 aa, Homo Sapiens
EAQGIHISR

SEQ ID NO: 47038 - protein, 9 aa, Homo Sapiens
EAQLPYVCR

SEQ ID NO: 47039 - protein, 9 aa, Homo Sapiens
EAQRITGLR

SEQ ID NO: 47040 - protein, 9 aa, Homo Sapiens
EAQVKIWRR

SEQ ID NO: 47041 - protein, 9 aa, Homo Sapiens
EAQVVRVTR

SEQ ID NO: 47042 - protein, 9 aa, Homo Sapiens
EARAFGVTR

SEQ ID NO: 47043 - protein, 9 aa, Homo Sapiens
EARGRLLER

SEQ ID NO: 47044 - protein, 9 aa, Homo Sapiens
EARLLEEQR

SEQ ID NO: 47045 - protein, 9 aa, Homo Sapiens
EARLNAALR

SEQ ID NO: 47046 - protein, 9 aa, Homo Sapiens
EARPSIMKR

SEQ ID NO: 47047 - protein, 9 aa, Homo Sapiens
EATAMAMGR

SEQ ID NO: 47048 - protein, 9 aa, Homo Sapiens
EATKYFRER

SEQ ID NO: 47049 - protein, 9 aa, Homo Sapiens
EAVFIAHKR

SEQ ID NO: 47050 - protein, 9 aa, Homo Sapiens
EAVKLIIGR

SEQ ID NO: 47051 - protein, 9 aa, Homo Sapiens
EAVLWEALR

SEQ ID NO: 47052 - protein, 9 aa, Homo Sapiens
EAVQALRER

SEQ ID NO: 47053 - protein, 9 aa, Homo Sapiens
EAWEKKVER

SEQ ID NO: 47054 - protein, 9 aa, Homo Sapiens
EAWRRVWSR

SEQ ID NO: 47055 - protein, 9 aa, Homo Sapiens
EAYLPETFR

SEQ ID NO: 47056 - protein, 9 aa, Homo Sapiens
EAYNPKIKR

SEQ ID NO: 47057 - protein, 9 aa, Homo Sapiens
EAYSVGTGR

SEQ ID NO: 47058 - protein, 9 aa, Homo Sapiens
EDKGINVFR

SEQ ID NO: 47059 - protein, 9 aa, Homo Sapiens
EFALIHKER

SEQ ID NO: 47060 - protein, 9 aa, Homo Sapiens
EFDPWFNYR

SEQ ID NO: 47061 - protein, 9 aa, Homo Sapiens
EFDPYFNYR

SEQ ID NO: 47062 - protein, 9 aa, Homo Sapiens
EFFGEGKTR

SEQ ID NO: 47063 - protein, 9 aa, Homo Sapiens
EFFIPRVGR

SEQ ID NO: 47064 - protein, 9 aa, Homo Sapiens
EFFSINAQR

SEQ ID NO: 47065 - protein, 9 aa, Homo Sapiens
EFFTVLAQR

SEQ ID NO: 47066 - protein, 9 aa, Homo Sapiens
EFGEPLPKR

SEQ ID NO: 47067 - protein, 9 aa, Homo Sapiens
EFISGTRMR

SEQ ID NO: 47068 - protein, 9 aa, Homo Sapiens
EFISSTTVR

SEQ ID NO: 47069 - protein, 9 aa, Homo Sapiens
EFKDKTWTR

SEQ ID NO: 47070 - protein, 9 aa, Homo Sapiens
EFKEDIHNR

SEQ ID NO: 47071 - protein, 9 aa, Homo Sapiens
EFKELTRKR

SEQ ID NO: 47072 - protein, 9 aa, Homo Sapiens
EFKERLRKR

SEQ ID NO: 47073 - protein, 9 aa, Homo Sapiens
EFKPTYQDR

SEQ ID NO: 47074 - protein, 9 aa, Homo Sapiens
EFLAHARGR

SEQ ID NO: 47075 - protein, 9 aa, Homo Sapiens
EFLDPLCQR

SEQ ID NO: 47076 - protein, 9 aa, Homo Sapiens
EFLEQHYDR

SEQ ID NO: 47077 - protein, 9 aa, Homo Sapiens
EFLIKKKAN

SEQ ID NO: 47078 - protein, 9 aa, Homo Sapiens
EFLKLDRER

SEQ ID NO: 47079 - protein, 9 aa, Homo Sapiens
EFLVKSKHR

SEQ ID NO: 47080 - protein, 9 aa, Homo Sapiens
EFNPNFVAR

SEQ ID NO: 47081 - protein, 9 aa, Homo Sapiens
EFQDFTVPR

SEQ ID NO: 47082 - protein, 9 aa, Homo Sapiens
EFQIPGRTR

SEQ ID NO: 47083 - protein, 9 aa, Homo Sapiens
EFQQLPYHR

SEQ ID NO: 47084 - protein, 9 aa, Homo Sapiens
EFQQVLSNR

SEQ ID NO: 47085 - protein, 9 aa, Homo Sapiens
EFRAGMSNR

SEQ ID NO: 47086 - protein, 9 aa, Homo Sapiens
EFREKHNIR

SEQ ID NO: 47087 - protein, 9 aa, Homo Sapiens
EFREPRPPR

SEQ ID NO: 47088 - protein, 9 aa, Homo Sapiens
EFRKDFISR

SEQ ID NO: 47089 - protein, 9 aa, Homo Sapiens
EFRKIKCVR

SEQ ID NO: 47090 - protein, 9 aa, Homo Sapiens
EFRPDGKLR

SEQ ID NO: 47091 - protein, 9 aa, Homo Sapiens
EFRQRIILR

SEQ ID NO: 47092 - protein, 9 aa, Homo Sapiens
EFSALKTQR

SEQ ID NO: 47093 - protein, 9 aa, Homo Sapiens
EFSPTFSER

SEQ ID NO: 47094 - protein, 9 aa, Homo Sapiens
EFSTLIVQR

SEQ ID NO: 47095 - protein, 9 aa, Homo Sapiens
EFSVILNQR

SEQ ID NO: 47096 - protein, 9 aa, Homo Sapiens
EFVCNLSAR

SEQ ID NO: 47097 - protein, 9 aa, Homo Sapiens
EFVDLYVPR

SEQ ID NO: 47098 - protein, 9 aa, Homo Sapiens
EFVEHLISR

SEQ ID NO: 47099 - protein, 9 aa, Homo Sapiens
EFVTTVQQR

SEQ ID NO: 47100 - protein, 9 aa, Homo Sapiens
EFWQGQTNR

SEQ ID NO: 47101 - protein, 9 aa, Homo Sapiens
EFYINYVTR

SEQ ID NO: 47102 - protein, 9 aa, Homo Sapiens
EFYNLVRFR

SEQ ID NO: 47103 - protein, 9 aa, Homo Sapiens
EFYSPEACR

SEQ ID NO: 47104 - protein, 9 aa, Homo Sapiens
EGIGQFHCR

SEQ ID NO: 47105 - protein, 9 aa, Homo Sapiens
EGKDFSIHR

SEQ ID NO: 47106 - protein, 9 aa, Homo Sapiens
EGKDLFTQR

SEQ ID NO: 47107 - protein, 9 aa, Homo Sapiens
EGKGVFDCR

SEQ ID NO: 47108 - protein, 9 aa, Homo Sapiens
EGKYIFKER

SEQ ID NO: 47109 - protein, 9 aa, Homo Sapiens
EGLNILLNR

SEQ ID NO: 47110 - protein, 9 aa, Homo Sapiens
EGLSGRVLR

SEQ ID NO: 47111 - protein, 9 aa, Homo Sapiens
EGNQIFNNR

SEQ ID NO: 47112 - protein, 9 aa, Homo Sapiens
EGNSFNSPR

SEQ ID NO: 47113 - protein, 9 aa, Homo Sapiens
EIAPSPCFR

SEQ ID NO: 47114 - protein, 9 aa, Homo Sapiens
EICGNYTYR

SEQ ID NO: 47115 - protein, 9 aa, Homo Sapiens
EIFDGIQPK

SEQ ID NO: 47116 - protein, 9 aa, Homo Sapiens
EIFGTIGMR

SEQ ID NO: 47117 - protein, 9 aa, Homo Sapiens
EIFRHILQR

SEQ ID NO: 47118 - protein, 9 aa, Homo Sapiens
EIGHFLRER

SEQ ID NO: 47119 - protein, 9 aa, Homo Sapiens
EIGNRVTTR

SEQ ID NO: 47120 - protein, 9 aa, Homo Sapiens
EIGWFPCNR

SEQ ID NO: 47121 - protein, 9 aa, Homo Sapiens
EIIDKRRER

SEQ ID NO: 47122 - protein, 9 aa, Homo Sapiens
EIKERIAKR

SEQ ID NO: 47123 - protein, 9 aa, Homo Sapiens
EIKEVHIEK

SEQ ID NO: 47124 - protein, 9 aa, Homo Sapiens
EIKHFVSER

SEQ ID NO: 47125 - protein, 9 aa, Homo Sapiens
EIKSLLEER

SEQ ID NO: 47126 - protein, 9 aa, Homo Sapiens
EIKSLTKER

SEQ ID NO: 47127 - protein, 9 aa, Homo Sapiens
EIKSQFRTR

SEQ ID NO: 47128 - protein, 9 aa, Homo Sapiens
EILELLNQR

SEQ ID NO: 47129 - protein, 9 aa, Homo Sapiens
EILEVATAR

SEQ ID NO: 47130 - protein, 9 aa, Homo Sapiens
EILGIANNR

SEQ ID NO: 47131 - protein, 9 aa, Homo Sapiens
EILGVLVPR

SEQ ID NO: 47132 - protein, 9 aa, Homo Sapiens
EILHHLSER

SEQ ID NO: 47133 - protein, 9 aa, Homo Sapiens
EILKRNIQR

SEQ ID NO: 47134 - protein, 9 aa, Homo Sapiens
EILRDIICR

SEQ ID NO: 47135 - protein, 9 aa, Homo Sapiens
EILRRLTGR

SEQ ID NO: 47136 - protein, 9 aa, Homo Sapiens
EILRVPFRR

SEQ ID NO: 47137 - protein, 9 aa, Homo Sapiens
EILSDVASR

SEQ ID NO: 47138 - protein, 9 aa, Homo Sapiens
EILSVLSHR

SEQ ID NO: 47139 - protein, 9 aa, Homo Sapiens
EIMEVAKER

SEQ ID NO: 47140 - protein, 9 aa, Homo Sapiens
EIMPPPPKP

SEQ ID NO: 47141 - protein, 9 aa, Homo Sapiens
EINAILQKR

SEQ ID NO: 47142 - protein, 9 aa, Homo Sapiens
EINKLLAHR

SEQ ID NO: 47143 - protein, 9 aa, Homo Sapiens
EINQITRSR

SEQ ID NO: 47144 - protein, 9 aa, Homo Sapiens
EIPKRFGQR

SEQ ID NO: 47145 - protein, 9 aa, Homo Sapiens
EIQHTTALR

SEQ ID NO: 47146 - protein, 9 aa, Homo Sapiens
EIRKPEVLR

SEQ ID NO: 47147 - protein, 9 aa, Homo Sapiens
EISAPSQQR

SEQ ID NO: 47148 - protein, 9 aa, Homo Sapiens
EISAPVSER

SEQ ID NO: 47149 - protein, 9 aa, Homo Sapiens
EISGTFTHR

SEQ ID NO: 47150 - protein, 9 aa, Homo Sapiens
EISSPAVER

SEQ ID NO: 47151 - protein, 9 aa, Homo Sapiens
EIVSRVSKR

SEQ ID NO: 47152 - protein, 9 aa, Homo Sapiens
EIYEYIIFR

SEQ ID NO: 47153 - protein, 9 aa, Homo Sapiens
EIYFRAWKK

SEQ ID NO: 47154 - protein, 9 aa, Homo Sapiens
EIYGVTHTR

SEQ ID NO: 47155 - protein, 9 aa, Homo Sapiens
EIYKPGLSR

SEQ ID NO: 47156 - protein, 9 aa, Homo Sapiens
EIYRPPASR

SEQ ID NO: 47157 - protein, 9 aa, Homo Sapiens
EIYVHRSGR

SEQ ID NO: 47158 - protein, 9 aa, Homo Sapiens
ELADHLVKR

SEQ ID NO: 47159 - protein, 9 aa, Homo Sapiens
ELAERLGLR

SEQ ID NO: 47160 - protein, 9 aa, Homo Sapiens
ELAKIMRTR

SEQ ID NO: 47161 - protein, 9 aa, Homo Sapiens
ELAQVIVSR

SEQ ID NO: 47162 - protein, 9 aa, Homo Sapiens
ELAQWLIQR

SEQ ID NO: 47163 - protein, 9 aa, Homo Sapiens
ELARLKVHR

SEQ ID NO: 47164 - protein, 9 aa, Homo Sapiens
ELARSLFNR

SEQ ID NO: 47165 - protein, 9 aa, Homo Sapiens
ELAVVREQR

SEQ ID NO: 47166 - protein, 9 aa, Homo Sapiens
ELFADKVPK

SEQ ID NO: 47167 - protein, 9 aa, Homo Sapiens
ELFGRVTSR

SEQ ID NO: 47168 - protein, 9 aa, Homo Sapiens
ELFNRIEKR

SEQ ID NO: 47169 - protein, 9 aa, Homo Sapiens
ELFRRKHVR

SEQ ID NO: 47170 - protein, 9 aa, Homo Sapiens
ELFSNIVPR

SEQ ID NO: 47171 - protein, 9 aa, Homo Sapiens
ELFSRIQER

SEQ ID NO: 47172 - protein, 9 aa, Homo Sapiens
ELHKMWENR

SEQ ID NO: 47173 - protein, 9 aa, Homo Sapiens
ELKGIYKDR

SEQ ID NO: 47174 - protein, 9 aa, Homo Sapiens
ELKKVVTGR

SEQ ID NO: 47175 - protein, 9 aa, Homo Sapiens
ELKQEGSLR

SEQ ID NO: 47176 - protein, 9 aa, Homo Sapiens
ELKRLYVER

SEQ ID NO: 47177 - protein, 9 aa, Homo Sapiens
ELLEKIASR

SEQ ID NO: 47178 - protein, 9 aa, Homo Sapiens
ELLEPLNER

SEQ ID NO: 47179 - protein, 9 aa, Homo Sapiens
ELLIRPVQR

SEQ ID NO: 47180 - protein, 9 aa, Homo Sapiens
ELLPRLQAR

SEQ ID NO: 47181 - protein, 9 aa, Homo Sapiens
ELMPPPPPK

SEQ ID NO: 47182 - protein, 9 aa, Homo Sapiens
ELNKIFALR

SEQ ID NO: 47183 - protein, 9 aa, Homo Sapiens
ELNKIPTVR

SEQ ID NO: 47184 - protein, 9 aa, Homo Sapiens
ELNPEIVAR

SEQ ID NO: 47185 - protein, 9 aa, Homo Sapiens
ELNRIPSSR

SEQ ID NO: 47186 - protein, 9 aa, Homo Sapiens
ELNSPLVRR

SEQ ID NO: 47187 - protein, 9 aa, Homo Sapiens
ELQALTTSR

SEQ ID NO: 47188 - protein, 9 aa, Homo Sapiens
ELQEIMRRR

SEQ ID NO: 47189 - protein, 9 aa, Homo Sapiens
ELQLIIAQR

SEQ ID NO: 47190 - protein, 9 aa, Homo Sapiens
ELQREISNR

SEQ ID NO: 47191 - protein, 9 aa, Homo Sapiens
ELQRIKWHR

SEQ ID NO: 47192 - protein, 9 aa, Homo Sapiens
ELQTFVANR

SEQ ID NO: 47193 - protein, 9 aa, Homo Sapiens
ELRGKLVAR

SEQ ID NO: 47194 - protein, 9 aa, Homo Sapiens
ELRRLEELR

SEQ ID NO: 47195 - protein, 9 aa, Homo Sapiens
ELSAVLIHR

SEQ ID NO: 47196 - protein, 9 aa, Homo Sapiens
ELSCQLYQR

SEQ ID NO: 47197 - protein, 9 aa, Homo Sapiens
ELSQSLPPR

SEQ ID NO: 47198 - protein, 9 aa, Homo Sapiens
ELYEKVFSR

SEQ ID NO: 47199 - protein, 9 aa, Homo Sapiens
ELYRRLEAR

SEQ ID NO: 47200 - protein, 9 aa, Homo Sapiens
ELYSKVTPR

SEQ ID NO: 47201 - protein, 9 aa, Homo Sapiens
EMFTPILGR

SEQ ID NO: 47202 - protein, 9 aa, Homo Sapiens
EMGLRPLPR

SEQ ID NO: 47203 - protein, 9 aa, Homo Sapiens
EMKLQVTQR

SEQ ID NO: 47204 - protein, 9 aa, Homo Sapiens
EMKPVLKQR

SEQ ID NO: 47205 - protein, 9 aa, Homo Sapiens
EMLQQIANR

SEQ ID NO: 47206 - protein, 9 aa, Homo Sapiens
EMMADMYNR

SEQ ID NO: 47207 - protein, 9 aa, Homo Sapiens
EMNRYLKNR

SEQ ID NO: 47208 - protein, 9 aa, Homo Sapiens
EMQAKVAVR

SEQ ID NO: 47209 - protein, 9 aa, Homo Sapiens
EMQNLVHRR

SEQ ID NO: 47210 - protein, 9 aa, Homo Sapiens
EMREMLTHR

SEQ ID NO: 47211 - protein, 9 aa, Homo Sapiens
EMRQMFVQR

SEQ ID NO: 47212 - protein, 9 aa, Homo Sapiens
EMVDKHIRR

SEQ ID NO: 47213 - protein, 9 aa, Homo Sapiens
ENDRPYNLR

SEQ ID NO: 47214 - protein, 9 aa, Homo Sapiens
ENFAPGTTR

SEQ ID NO: 47215 - protein, 9 aa, Homo Sapiens
ENFDRFFTR

SEQ ID NO: 47216 - protein, 9 aa, Homo Sapiens
ENFFRIYKR

SEQ ID NO: 47217 - protein, 9 aa, Homo Sapiens
ENFGNTTPR

SEQ ID NO: 47218 - protein, 9 aa, Homo Sapiens
ENKISPYYR

SEQ ID NO: 47219 - protein, 9 aa, Homo Sapiens
ENLPRTVIR

SEQ ID NO: 47220 - protein, 9 aa, Homo Sapiens
ENNRPLLTR

SEQ ID NO: 47221 - protein, 9 aa, Homo Sapiens
ENQRITAVR

SEQ ID NO: 47222 - protein, 9 aa, Homo Sapiens
ENRKPVSFR

SEQ ID NO: 47223 - protein, 9 aa, Homo Sapiens
ENSAYICSR

SEQ ID NO: 47224 - protein, 9 aa, Homo Sapiens
ENTAITIGR

SEQ ID NO: 47225 - protein, 9 aa, Homo Sapiens
ENTTPITSR

SEQ ID NO: 47226 - protein, 9 aa, Homo Sapiens
ENYAGIAAR

SEQ ID NO: 47227 - protein, 9 aa, Homo Sapiens
EQFDRKYTR

SEQ ID NO: 47228 - protein, 9 aa, Homo Sapiens
EQNHLVVAR

SEQ ID NO: 47229 - protein, 9 aa, Homo Sapiens
ESAQDFASR

SEQ ID NO: 47230 - protein, 9 aa, Homo Sapiens
ESAYNAFNR

SEQ ID NO: 47231 - protein, 9 aa, Homo Sapiens
ESCMVGVAR

SEQ ID NO: 47232 - protein, 9 aa, Homo Sapiens
ESEEVRQFR

SEQ ID NO: 47233 - protein, 9 aa, Homo Sapiens
ESFEGFIAR

SEQ ID NO: 47234 - protein, 9 aa, Homo Sapiens
ESFLPPEFR

SEQ ID NO: 47235 - protein, 9 aa, Homo Sapiens
ESFPRGGTR

SEQ ID NO: 47236 - protein, 9 aa, Homo Sapiens
ESFPSVNSR

SEQ ID NO: 47237 - protein, 9 aa, Homo Sapiens
ESFSNLRNR

SEQ ID NO: 47238 - protein, 9 aa, Homo Sapiens
ESIAAFIQR

SEQ ID NO: 47239 - protein, 9 aa, Homo Sapiens
ESIDQYIER

SEQ ID NO: 47240 - protein, 9 aa, Homo Sapiens
ESIRAAVNR

SEQ ID NO: 47241 - protein, 9 aa, Homo Sapiens
ESKGLGYVR

SEQ ID NO: 47242 - protein, 9 aa, Homo Sapiens
ESKLVLFGR

SEQ ID NO: 47243 - protein, 9 aa, Homo Sapiens
ESKMAFLTR

SEQ ID NO: 47244 - protein, 9 aa, Homo Sapiens
ESLAPLQER

SEQ ID NO: 47245 - protein, 9 aa, Homo Sapiens
ESLEWLASR

SEQ ID NO: 47246 - protein, 9 aa, Homo Sapiens
ESLGCIRKR

SEQ ID NO: 47247 - protein, 9 aa, Homo Sapiens
ESLIKQIPR

SEQ ID NO: 47248 - protein, 9 aa, Homo Sapiens
ESLIPSANR

SEQ ID NO: 47249 - protein, 9 aa, Homo Sapiens
ESLNFLIGR

SEQ ID NO: 47250 - protein, 9 aa, Homo Sapiens
ESLPATHIR

SEQ ID NO: 47251 - protein, 9 aa, Homo Sapiens
ESLPGATTR

SEQ ID NO: 47252 - protein, 9 aa, Homo Sapiens
ESLPPPTLR

SEQ ID NO: 47253 - protein, 9 aa, Homo Sapiens
ESLPRVVKR

SEQ ID NO: 47254 - protein, 9 aa, Homo Sapiens
ESLQAILNR

SEQ ID NO: 47255 - protein, 9 aa, Homo Sapiens
ESLTKVFER

SEQ ID NO: 47256 - protein, 9 aa, Homo Sapiens
ESLVIPSTR

SEQ ID NO: 47257 - protein, 9 aa, Homo Sapiens
ESMEKWQTR

SEQ ID NO: 47258 - protein, 9 aa, Homo Sapiens
ESMEPKVFR

SEQ ID NO: 47259 - protein, 9 aa, Homo Sapiens
ESMMPNKVR

SEQ ID NO: 47260 - protein, 9 aa, Homo Sapiens
ESMQRFHNR

SEQ ID NO: 47261 - protein, 9 aa, Homo Sapiens
ESNLNMYTR

SEQ ID NO: 47262 - protein, 9 aa, Homo Sapiens
ESNPPSLMR

SEQ ID NO: 47263 - protein, 9 aa, Homo Sapiens
ESQKEFVRR

SEQ ID NO: 47264 - protein, 9 aa, Homo Sapiens
ESQSNPVFR

SEQ ID NO: 47265 - protein, 9 aa, Homo Sapiens
ESRAPQILR

SEQ ID NO: 47266 - protein, 9 aa, Homo Sapiens
ESRAVFLQR

SEQ ID NO: 47267 - protein, 9 aa, Homo Sapiens
ESRLNLVQR

SEQ ID NO: 47268 - protein, 9 aa, Homo Sapiens
ESRTLAIAR

SEQ ID NO: 47269 - protein, 9 aa, Homo Sapiens
ESSKPPILR

SEQ ID NO: 47270 - protein, 9 aa, Homo Sapiens
ESSPSIVHR

SEQ ID NO: 47271 - protein, 9 aa, Homo Sapiens
ESVLRTQIR

SEQ ID NO: 47272 - protein, 9 aa, Homo Sapiens
ESWPRIIMR

SEQ ID NO: 47273 - protein, 9 aa, Homo Sapiens
ESWPVLVGR

SEQ ID NO: 47274 - protein, 9 aa, Homo Sapiens
ESYRPPKSR

SEQ ID NO: 47275 - protein, 9 aa, Homo Sapiens
ETAAYKIMR

SEQ ID NO: 47276 - protein, 9 aa, Homo Sapiens
ETAFAFHLR

SEQ ID NO: 47277 - protein, 9 aa, Homo Sapiens
ETAFLSWFR

SEQ ID NO: 47278 - protein, 9 aa, Homo Sapiens
ETAIPFRSR

SEQ ID NO: 47279 - protein, 9 aa, Homo Sapiens
ETAIPSSTR

SEQ ID NO: 47280 - protein, 9 aa, Homo Sapiens
ETAKPIPAR

SEQ ID NO: 47281 - protein, 9 aa, Homo Sapiens
ETARMLAQR

SEQ ID NO: 47282 - protein, 9 aa, Homo Sapiens
ETDLKTICR

SEQ ID NO: 47283 - protein, 9 aa, Homo Sapiens
ETEAYIAQR

SEQ ID NO: 47284 - protein, 9 aa, Homo Sapiens
ETEDYRQFR

SEQ ID NO: 47285 - protein, 9 aa, Homo Sapiens
ETEPTIIER

SEQ ID NO: 47286 - protein, 9 aa, Homo Sapiens
ETEREYFNR

SEQ ID NO: 47287 - protein, 9 aa, Homo Sapiens
ETESLLVGR

SEQ ID NO: 47288 - protein, 9 aa, Homo Sapiens
ETFADGVPR

SEQ ID NO: 47289 - protein, 9 aa, Homo Sapiens
ETFLAQRQR

SEQ ID NO: 47290 - protein, 9 aa, Homo Sapiens
ETFNREKFR

SEQ ID NO: 47291 - protein, 9 aa, Homo Sapiens
ETFNSITKR

SEQ ID NO: 47292 - protein, 9 aa, Homo Sapiens
ETFQQKMLR

SEQ ID NO: 47293 - protein, 9 aa, Homo Sapiens
ETFSGVYKK

SEQ ID NO: 47294 - protein, 9 aa, Homo Sapiens
ETHLPAQAR

SEQ ID NO: 47295 - protein, 9 aa, Homo Sapiens
ETIAPKIAR

SEQ ID NO: 47296 - protein, 9 aa, Homo Sapiens
ETIGKKFEK

SEQ ID NO: 47297 - protein, 9 aa, Homo Sapiens
ETIIRIFKR

SEQ ID NO: 47298 - protein, 9 aa, Homo Sapiens
ETIKLLKGR

SEQ ID NO: 47299 - protein, 9 aa, Homo Sapiens
ETIKQLQER

SEQ ID NO: 47300 - protein, 9 aa, Homo Sapiens
ETIKVWKQR

SEQ ID NO: 47301 - protein, 9 aa, Homo Sapiens
ETILKHWTR

SEQ ID NO: 47302 - protein, 9 aa, Homo Sapiens
ETILRTNKR

SEQ ID NO: 47303 - protein, 9 aa, Homo Sapiens
ETIPSFTGR

SEQ ID NO: 47304 - protein, 9 aa, Homo Sapiens
ETIYQNYQR

SEQ ID NO: 47305 - protein, 9 aa, Homo Sapiens
ETKEWLKNR

SEQ ID NO: 47306 - protein, 9 aa, Homo Sapiens
ETKRIFLDR

SEQ ID NO: 47307 - protein, 9 aa, Homo Sapiens
ETLCPPKGR

SEQ ID NO: 47308 - protein, 9 aa, Homo Sapiens
ETLETIINR

SEQ ID NO: 47309 - protein, 9 aa, Homo Sapiens
ETLGQVVRR

SEQ ID NO: 47310 - protein, 9 aa, Homo Sapiens
ETLKDRLSR

SEQ ID NO: 47311 - protein, 9 aa, Homo Sapiens
ETLLLQAER

SEQ ID NO: 47312 - protein, 9 aa, Homo Sapiens
ETLMETHER

SEQ ID NO: 47313 - protein, 9 aa, Homo Sapiens
ETLNQMIAR

SEQ ID NO: 47314 - protein, 9 aa, Homo Sapiens
ETLPKAVKR

SEQ ID NO: 47315 - protein, 9 aa, Homo Sapiens
ETLPPGKVR

SEQ ID NO: 47316 - protein, 9 aa, Homo Sapiens
ETLQNVKER

SEQ ID NO: 47317 - protein, 9 aa, Homo Sapiens
ETLVMPTLR

SEQ ID NO: 47318 - protein, 9 aa, Homo Sapiens
ETMEKGFSK

SEQ ID NO: 47319 - protein, 9 aa, Homo Sapiens
ETMNYAQIR

SEQ ID NO: 47320 - protein, 9 aa, Homo Sapiens
ETMPCVKKK

SEQ ID NO: 47321 - protein, 9 aa, Homo Sapiens
ETMPSPYGR

SEQ ID NO: 47322 - protein, 9 aa, Homo Sapiens
ETMVIGNYR

SEQ ID NO: 47323 - protein, 9 aa, Homo Sapiens
ETNGFISAH

SEQ ID NO: 47324 - protein, 9 aa, Homo Sapiens
ETNIVAVER

SEQ ID NO: 47325 - protein, 9 aa, Homo Sapiens
ETNTGEVYR

SEQ ID NO: 47326 - protein, 9 aa, Homo Sapiens
ETNVFFYPR

SEQ ID NO: 47327 - protein, 9 aa, Homo Sapiens
ETNYGIPQR

SEQ ID NO: 47328 - protein, 9 aa, Homo Sapiens
ETQHEKILR

SEQ ID NO: 47329 - protein, 9 aa, Homo Sapiens
ETQIATILR

SEQ ID NO: 47330 - protein, 9 aa, Homo Sapiens
ETQLPVSFR

SEQ ID NO: 47331 - protein, 9 aa, Homo Sapiens
ETQLVQEVR

SEQ ID NO: 47332 - protein, 9 aa, Homo Sapiens
ETQPPVALK

SEQ ID NO: 47333 - protein, 9 aa, Homo Sapiens
ETRAEFAER

SEQ ID NO: 47334 - protein, 9 aa, Homo Sapiens
ETREVQNLR

SEQ ID NO: 47335 - protein, 9 aa, Homo Sapiens
ETRLHITGR

SEQ ID NO: 47336 - protein, 9 aa, Homo Sapiens
ETRQITWSR

SEQ ID NO: 47337 - protein, 9 aa, Homo Sapiens
ETRSSFMSR

SEQ ID NO: 47338 - protein, 9 aa, Homo Sapiens
ETSALPRPR

SEQ ID NO: 47339 - protein, 9 aa, Homo Sapiens
ETSAPFKER

SEQ ID NO: 47340 - protein, 9 aa, Homo Sapiens
ETSNLIIMR

SEQ ID NO: 47341 - protein, 9 aa, Homo Sapiens
ETSPFGAPR

SEQ ID NO: 47342 - protein, 9 aa, Homo Sapiens
ETSSMASFR

SEQ ID NO: 47343 - protein, 9 aa, Homo Sapiens
ETTSIATAR

SEQ ID NO: 47344 - protein, 9 aa, Homo Sapiens
ETVGSIFSR

SEQ ID NO: 47345 - protein, 9 aa, Homo Sapiens
ETVKDFVAR

SEQ ID NO: 47346 - protein, 9 aa, Homo Sapiens
ETVPAFSER

SEQ ID NO: 47347 - protein, 9 aa, Homo Sapiens
ETVQDIVYR

SEQ ID NO: 47348 - protein, 9 aa, Homo Sapiens
ETYGPFQIR

SEQ ID NO: 47349 - protein, 9 aa, Homo Sapiens
ETYKYLYGR

SEQ ID NO: 47350 - protein, 9 aa, Homo Sapiens
ETYLHRIGR

SEQ ID NO: 47351 - protein, 9 aa, Homo Sapiens
ETYLLEKSR

SEQ ID NO: 47352 - protein, 9 aa, Homo Sapiens
ETYLNENLR

SEQ ID NO: 47353 - protein, 9 aa, Homo Sapiens
ETYMHRIGR

SEQ ID NO: 47354 - protein, 9 aa, Homo Sapiens
EVADLKIKR

SEQ ID NO: 47355 - protein, 9 aa, Homo Sapiens
EVAFPHHPR

SEQ ID NO: 47356 - protein, 9 aa, Homo Sapiens
EVAGIVAAR

SEQ ID NO: 47357 - protein, 9 aa, Homo Sapiens
EVAGLQVGR

SEQ ID NO: 47358 - protein, 9 aa, Homo Sapiens
EVAIPHNRR

SEQ ID NO: 47359 - protein, 9 aa, Homo Sapiens
EVAIPLPAR

SEQ ID NO: 47360 - protein, 9 aa, Homo Sapiens
EVANIPVAR

SEQ ID NO: 47361 - protein, 9 aa, Homo Sapiens
EVAPAKPPR

SEQ ID NO: 47362 - protein, 9 aa, Homo Sapiens
EVAPPEYHR

SEQ ID NO: 47363 - protein, 9 aa, Homo Sapiens
EVAQFLTGR

SEQ ID NO: 47364 - protein, 9 aa, Homo Sapiens
EVARELVGR

SEQ ID NO: 47365 - protein, 9 aa, Homo Sapiens
EVARYMVQR

SEQ ID NO: 47366 - protein, 9 aa, Homo Sapiens
EVASAVCLR

SEQ ID NO: 47367 - protein, 9 aa, Homo Sapiens
EVASVWVER

SEQ ID NO: 47368 - protein, 9 aa, Homo Sapiens
EVCRIYLLR

SEQ ID NO: 47369 - protein, 9 aa, Homo Sapiens
EVDAAMAAR

SEQ ID NO: 47370 - protein, 9 aa, Homo Sapiens
EVDYKKKYR

SEQ ID NO: 47371 - protein, 9 aa, Homo Sapiens
EVEGKMVSR

SEQ ID NO: 47372 - protein, 9 aa, Homo Sapiens
EVEKRFEGR

SEQ ID NO: 47373 - protein, 9 aa, Homo Sapiens
EVESLTAAR

SEQ ID NO: 47374 - protein, 9 aa, Homo Sapiens
EVFEYIIFR

SEQ ID NO: 47375 - protein, 9 aa, Homo Sapiens
EVFGQITER

SEQ ID NO: 47376 - protein, 9 aa, Homo Sapiens
EVFHVPEGR

SEQ ID NO: 47377 - protein, 9 aa, Homo Sapiens
EVFKGIDNR

SEQ ID NO: 47378 - protein, 9 aa, Homo Sapiens
EVFLHVVKR

SEQ ID NO: 47379 - protein, 9 aa, Homo Sapiens
EVFQNANFR

SEQ ID NO: 47380 - protein, 9 aa, Homo Sapiens
EVFSHILKR

SEQ ID NO: 47381 - protein, 9 aa, Homo Sapiens
EVFTPVVQR

SEQ ID NO: 47382 - protein, 9 aa, Homo Sapiens
EVFVGKIPR

SEQ ID NO: 47383 - protein, 9 aa, Homo Sapiens
EVFYFEVTR

SEQ ID NO: 47384 - protein, 9 aa, Homo Sapiens
EVGDIVVGR

SEQ ID NO: 47385 - protein, 9 aa, Homo Sapiens
EVGLLFTNR

SEQ ID NO: 47386 - protein, 9 aa, Homo Sapiens
EVGVIPSKR

SEQ ID NO: 47387 - protein, 9 aa, Homo Sapiens
EVHAVVTVR

SEQ ID NO: 47388 - protein, 9 aa, Homo Sapiens
EVHMLLEHR

SEQ ID NO: 47389 - protein, 9 aa, Homo Sapiens
EVHPSPVSR

SEQ ID NO: 47390 - protein, 9 aa, Homo Sapiens
EVHTKINTR

SEQ ID NO: 47391 - protein, 9 aa, Homo Sapiens
EVIKNRFHR

SEQ ID NO: 47392 - protein, 9 aa, Homo Sapiens
EVIKSMKPK

SEQ ID NO: 47393 - protein, 9 aa, Homo Sapiens
EVINDYHFR

SEQ ID NO: 47394 - protein, 9 aa, Homo Sapiens
EVINKLGPR

SEQ ID NO: 47395 - protein, 9 aa, Homo Sapiens
EVINVLINK

SEQ ID NO: 47396 - protein, 9 aa, Homo Sapiens
EVISKLYAV

SEQ ID NO: 47397 - protein, 9 aa, Homo Sapiens
EVISLINTR

SEQ ID NO: 47398 - protein, 9 aa, Homo Sapiens
EVKESPFFR

SEQ ID NO: 47399 - protein, 9 aa, Homo Sapiens
EVKKICMQR

SEQ ID NO: 47400 - protein, 9 aa, Homo Sapiens
EVKPNLTER

SEQ ID NO: 47401 - protein, 9 aa, Homo Sapiens
EVKPSIRAR

SEQ ID NO: 47402 - protein, 9 aa, Homo Sapiens
EVKRHPFFR

SEQ ID NO: 47403 - protein, 9 aa, Homo Sapiens
EVKSITKER

SEQ ID NO: 47404 - protein, 9 aa, Homo Sapiens
EVKYALGER

SEQ ID NO: 47405 - protein, 9 aa, Homo Sapiens
EVLAELRKR

SEQ ID NO: 47406 - protein, 9 aa, Homo Sapiens
EVLAEPSSR

SEQ ID NO: 47407 - protein, 9 aa, Homo Sapiens
EVLALPFKR

SEQ ID NO: 47408 - protein, 9 aa, Homo Sapiens
EVLDHKEFK

SEQ ID NO: 47409 - protein, 9 aa, Homo Sapiens
EVLDKRYNV

SEQ ID NO: 47410 - protein, 9 aa, Homo Sapiens
EVLDRVFER

SEQ ID NO: 47411 - protein, 9 aa, Homo Sapiens
EVLDVQKRR

SEQ ID NO: 47412 - protein, 9 aa, Homo Sapiens
EVLDYFLRR

SEQ ID NO: 47413 - protein, 9 aa, Homo Sapiens
EVLGPHLER

SEQ ID NO: 47414 - protein, 9 aa, Homo Sapiens
EVLHGLIGR

SEQ ID NO: 47415 - protein, 9 aa, Homo Sapiens
EVLKHLKER

SEQ ID NO: 47416 - protein, 9 aa, Homo Sapiens
EVLKLLVAR

SEQ ID NO: 47417 - protein, 9 aa, Homo Sapiens
EVLKQLSSR

SEQ ID NO: 47418 - protein, 9 aa, Homo Sapiens
EVLLPSGQR

SEQ ID NO: 47419 - protein, 9 aa, Homo Sapiens
EVLLVSSSR

SEQ ID NO: 47420 - protein, 9 aa, Homo Sapiens
EVLNEVNRR

SEQ ID NO: 47421 - protein, 9 aa, Homo Sapiens
EVLNRIQFR

SEQ ID NO: 47422 - protein, 9 aa, Homo Sapiens
EVLPKNIQR

SEQ ID NO: 47423 - protein, 9 aa, Homo Sapiens
EVLPKPRMR

SEQ ID NO: 47424 - protein, 9 aa, Homo Sapiens
EVLPQVYNV

SEQ ID NO: 47425 - protein, 9 aa, Homo Sapiens
EVLQGGSQR

SEQ ID NO: 47426 - protein, 9 aa, Homo Sapiens
EVLQPLQQR

SEQ ID NO: 47427 - protein, 9 aa, Homo Sapiens
EVLSCLYNR

SEQ ID NO: 47428 - protein, 9 aa, Homo Sapiens
EVLVAGFGR

SEQ ID NO: 47429 - protein, 9 aa, Homo Sapiens
EVLVDPRSR

SEQ ID NO: 47430 - protein, 9 aa, Homo Sapiens
EVMFPKNVR

SEQ ID NO: 47431 - protein, 9 aa, Homo Sapiens
EVMGTGAVR

SEQ ID NO: 47432 - protein, 9 aa, Homo Sapiens
EVMRILISR

SEQ ID NO: 47433 - protein, 9 aa, Homo Sapiens
EVNAWLVHR

SEQ ID NO: 47434 - protein, 9 aa, Homo Sapiens
EVNDKRYLR

SEQ ID NO: 47435 - protein, 9 aa, Homo Sapiens
EVNDRPVRR

SEQ ID NO: 47436 - protein, 9 aa, Homo Sapiens
EVNGLKASR

SEQ ID NO: 47437 - protein, 9 aa, Homo Sapiens
EVNLWGTVR

SEQ ID NO: 47438 - protein, 9 aa, Homo Sapiens
EVNNELANR

SEQ ID NO: 47439 - protein, 9 aa, Homo Sapiens
EVNQETIQR

SEQ ID NO: 47440 - protein, 9 aa, Homo Sapiens
EVNSGFFYK

SEQ ID NO: 47441 - protein, 9 aa, Homo Sapiens
EVNSRPTYR

SEQ ID NO: 47442 - protein, 9 aa, Homo Sapiens
EVPELYHQR

SEQ ID NO: 47443 - protein, 9 aa, Homo Sapiens
EVPKHLVGR

SEQ ID NO: 47444 - protein, 9 aa, Homo Sapiens
EVPNKIINR

SEQ ID NO: 47445 - protein, 9 aa, Homo Sapiens
EVPPPPNLR

SEQ ID NO: 47446 - protein, 9 aa, Homo Sapiens
EVPSFLVER

SEQ ID NO: 47447 - protein, 9 aa, Homo Sapiens
EVQEDFSVR

SEQ ID NO: 47448 - protein, 9 aa, Homo Sapiens
EVQFLGRYK

SEQ ID NO: 47449 - protein, 9 aa, Homo Sapiens
EVQGEIHLR

SEQ ID NO: 47450 - protein, 9 aa, Homo Sapiens
EVQKLKRYK

SEQ ID NO: 47451 - protein, 9 aa, Homo Sapiens
EVQPAYATR

SEQ ID NO: 47452 - protein, 9 aa, Homo Sapiens
EVQPPRVDR

SEQ ID NO: 47453 - protein, 9 aa, Homo Sapiens
EVQRILHQR

SEQ ID NO: 47454 - protein, 9 aa, Homo Sapiens
EVQSYIRKR

SEQ ID NO: 47455 - protein, 9 aa, Homo Sapiens
EVQVPPGTR

SEQ ID NO: 47456 - protein, 9 aa, Homo Sapiens
EVQVVNTER

SEQ ID NO: 47457 - protein, 9 aa, Homo Sapiens
EVQYYNIKR

SEQ ID NO: 47458 - protein, 9 aa, Homo Sapiens
EVRDQGYLR

SEQ ID NO: 47459 - protein, 9 aa, Homo Sapiens
EVRGGGLTR

SEQ ID NO: 47460 - protein, 9 aa, Homo Sapiens
EVRKLIIRR

SEQ ID NO: 47461 - protein, 9 aa, Homo Sapiens
EVRKLMHVR

SEQ ID NO: 47462 - protein, 9 aa, Homo Sapiens
EVRLGGSLR

SEQ ID NO: 47463 - protein, 9 aa, Homo Sapiens
EVRPGIVSK

SEQ ID NO: 47464 - protein, 9 aa, Homo Sapiens
EVRPTYFEM

SEQ ID NO: 47465 - protein, 9 aa, Homo Sapiens
EVRPVETLR

SEQ ID NO: 47466 - protein, 9 aa, Homo Sapiens
EVRPVVVPK

SEQ ID NO: 47467 - protein, 9 aa, Homo Sapiens
EVRRLVIGR

SEQ ID NO: 47468 - protein, 9 aa, Homo Sapiens
EVRSQLKLR

SEQ ID NO: 47469 - protein, 9 aa, Homo Sapiens
EVSAAIIQR

SEQ ID NO: 47470 - protein, 9 aa, Homo Sapiens
EVSAALQSR

SEQ ID NO: 47471 - protein, 9 aa, Homo Sapiens
EVSAEVRER

SEQ ID NO: 47472 - protein, 9 aa, Homo Sapiens
EVSGCGSLR

SEQ ID NO: 47473 - protein, 9 aa, Homo Sapiens
EVSLPKRGR

SEQ ID NO: 47474 - protein, 9 aa, Homo Sapiens
EVSTVNVRR

SEQ ID NO: 47475 - protein, 9 aa, Homo Sapiens
EVTDYAIAR

SEQ ID NO: 47476 - protein, 9 aa, Homo Sapiens
EVTETICKR

SEQ ID NO: 47477 - protein, 9 aa, Homo Sapiens
EVTGFGVTR

SEQ ID NO: 47478 - protein, 9 aa, Homo Sapiens
EVTKLVHGR

SEQ ID NO: 47479 - protein, 9 aa, Homo Sapiens
EVTRVKAVR

SEQ ID NO: 47480 - protein, 9 aa, Homo Sapiens
EVVCGLIFR

SEQ ID NO: 47481 - protein, 9 aa, Homo Sapiens
EVVGIIESR

SEQ ID NO: 47482 - protein, 9 aa, Homo Sapiens
EVVNKRFVR

SEQ ID NO: 47483 - protein, 9 aa, Homo Sapiens
EVVPEPVAR

SEQ ID NO: 47484 - protein, 9 aa, Homo Sapiens
EVVQITWNR

SEQ ID NO: 47485 - protein, 9 aa, Homo Sapiens
EVVRLLVTR

SEQ ID NO: 47486 - protein, 9 aa, Homo Sapiens
EVVRTIKER

SEQ ID NO: 47487 - protein, 9 aa, Homo Sapiens
EVVYRFTAR

SEQ ID NO: 47488 - protein, 9 aa, Homo Sapiens
EVWKGIKKR

SEQ ID NO: 47489 - protein, 9 aa, Homo Sapiens
EVWPHSTER

SEQ ID NO: 47490 - protein, 9 aa, Homo Sapiens
EVYIIAVQR

SEQ ID NO: 47491 - protein, 9 aa, Homo Sapiens
EVYKELRLR

SEQ ID NO: 47492 - protein, 9 aa, Homo Sapiens
EVYRHFTGH

SEQ ID NO: 47493 - protein, 9 aa, Homo Sapiens
EVYTLAEHR

SEQ ID NO: 47494 - protein, 9 aa, Homo Sapiens
EVYTRLKSR

SEQ ID NO: 47495 - protein, 9 aa, Homo Sapiens
EWQKRYASR

SEQ ID NO: 47496 - protein, 9 aa, Homo Sapiens
EYAEFQYRR

SEQ ID NO: 47497 - protein, 9 aa, Homo Sapiens
EYAEYIYQR

SEQ ID NO: 47498 - protein, 9 aa, Homo Sapiens
EYAGLKVAR

SEQ ID NO: 47499 - protein, 9 aa, Homo Sapiens
EYAHTRYFR

SEQ ID NO: 47500 - protein, 9 aa, Homo Sapiens
EYAKLLAKR

SEQ ID NO: 47501 - protein, 9 aa, Homo Sapiens
EYAPVFKEK

SEQ ID NO: 47502 - protein, 9 aa, Homo Sapiens
EYAQVFREH

SEQ ID NO: 47503 - protein, 9 aa, Homo Sapiens
EYCPVLRSL

SEQ ID NO: 47504 - protein, 9 aa, Homo Sapiens
EYEEIPKRR

SEQ ID NO: 47505 - protein, 9 aa, Homo Sapiens
EYENIKLER

SEQ ID NO: 47506 - protein, 9 aa, Homo Sapiens
EYEQIQAKR

SEQ ID NO: 47507 - protein, 9 aa, Homo Sapiens
EYEQRVVKR

SEQ ID NO: 47508 - protein, 9 aa, Homo Sapiens
EYGAEALER

SEQ ID NO: 47509 - protein, 9 aa, Homo Sapiens
EYHKFLIGK

SEQ ID NO: 47510 - protein, 9 aa, Homo Sapiens
EYHWRKHLR

SEQ ID NO: 47511 - protein, 9 aa, Homo Sapiens
EYIDFEKIR

SEQ ID NO: 47512 - protein, 9 aa, Homo Sapiens
EYIEEVRAK

SEQ ID NO: 47513 - protein, 9 aa, Homo Sapiens
EYIELHRKR

SEQ ID NO: 47514 - protein, 9 aa, Homo Sapiens
EYIFLAVGR

SEQ ID NO: 47515 - protein, 9 aa, Homo Sapiens
EYIHDFNRR

SEQ ID NO: 47516 - protein, 9 aa, Homo Sapiens
EYIKGGTLR

SEQ ID NO: 47517 - protein, 9 aa, Homo Sapiens
EYIKNWRPR

SEQ ID NO: 47518 - protein, 9 aa, Homo Sapiens
EYIKTWRPR

SEQ ID NO: 47519 - protein, 9 aa, Homo Sapiens
EYIPDLYNH

SEQ ID NO: 47520 - protein, 9 aa, Homo Sapiens
EYIPLRHYY

SEQ ID NO: 47521 - protein, 9 aa, Homo Sapiens
EYIQFVPLL

SEQ ID NO: 47522 - protein, 9 aa, Homo Sapiens
EYISTEFNR

SEQ ID NO: 47523 - protein, 9 aa, Homo Sapiens
EYITLNEPK

SEQ ID NO: 47524 - protein, 9 aa, Homo Sapiens
EYKDIFIRH

SEQ ID NO: 47525 - protein, 9 aa, Homo Sapiens
EYKTVHEEL

SEQ ID NO: 47526 - protein, 9 aa, Homo Sapiens
EYLDMKNTR

SEQ ID NO: 47527 - protein, 9 aa, Homo Sapiens
EYLEKIKQR

SEQ ID NO: 47528 - protein, 9 aa, Homo Sapiens
EYLEKQRNR

SEQ ID NO: 47529 - protein, 9 aa, Homo Sapiens
EYLHHVNKR

SEQ ID NO: 47530 - protein, 9 aa, Homo Sapiens
EYLHKAVFR

SEQ ID NO: 47531 - protein, 9 aa, Homo Sapiens
EYLHRFYGR

SEQ ID NO: 47532 - protein, 9 aa, Homo Sapiens
EYLIKPLNK

SEQ ID NO: 47533 - protein, 9 aa, Homo Sapiens
EYLKALRKK

SEQ ID NO: 47534 - protein, 9 aa, Homo Sapiens
EYLKKVRGK

SEQ ID NO: 47535 - protein, 9 aa, Homo Sapiens
EYLKNIIYR

SEQ ID NO: 47536 - protein, 9 aa, Homo Sapiens
EYLNFIRGV

SEQ ID NO: 47537 - protein, 9 aa, Homo Sapiens
EYLNHVSKR

SEQ ID NO: 47538 - protein, 9 aa, Homo Sapiens
EYLNSILQH

SEQ ID NO: 47539 - protein, 9 aa, Homo Sapiens
EYLPSGCLR

SEQ ID NO: 47540 - protein, 9 aa, Homo Sapiens
EYLPTLWVK

SEQ ID NO: 47541 - protein, 9 aa, Homo Sapiens
EYLQKMVQR

SEQ ID NO: 47542 - protein, 9 aa, Homo Sapiens
EYLQNVEQK

SEQ ID NO: 47543 - protein, 9 aa, Homo Sapiens
EYLREKLQR

SEQ ID NO: 47544 - protein, 9 aa, Homo Sapiens
EYLRLSRVK

SEQ ID NO: 47545 - protein, 9 aa, Homo Sapiens
EYLSLETTR

SEQ ID NO: 47546 - protein, 9 aa, Homo Sapiens
EYLTSTACR

SEQ ID NO: 47547 - protein, 9 aa, Homo Sapiens
EYMDKNNVR

SEQ ID NO: 47548 - protein, 9 aa, Homo Sapiens
EYMEKIKQR

SEQ ID NO: 47549 - protein, 9 aa, Homo Sapiens
EYMRVISQR

SEQ ID NO: 47550 - protein, 9 aa, Homo Sapiens
EYNAPWKER

SEQ ID NO: 47551 - protein, 9 aa, Homo Sapiens
EYNARLFGL

SEQ ID NO: 47552 - protein, 9 aa, Homo Sapiens
EYNEGLVKR

SEQ ID NO: 47553 - protein, 9 aa, Homo Sapiens
EYNISPETR

SEQ ID NO: 47554 - protein, 9 aa, Homo Sapiens
EYNPEHVSR

SEQ ID NO: 47555 - protein, 9 aa, Homo Sapiens
EYNTQFQEK

SEQ ID NO: 47556 - protein, 9 aa, Homo Sapiens
EYNVRVASR

SEQ ID NO: 47557 - protein, 9 aa, Homo Sapiens
EYPAVKFCK

SEQ ID NO: 47558 - protein, 9 aa, Homo Sapiens
EYQEKPLLR

SEQ ID NO: 47559 - protein, 9 aa, Homo Sapiens
EYQILVVTR

SEQ ID NO: 47560 - protein, 9 aa, Homo Sapiens
EYQPSNIKR

SEQ ID NO: 47561 - protein, 9 aa, Homo Sapiens
EYRASLQQR

SEQ ID NO: 47562 - protein, 9 aa, Homo Sapiens
EYRKYIHSR

SEQ ID NO: 47563 - protein, 9 aa, Homo Sapiens
EYSEYMNNK

SEQ ID NO: 47564 - protein, 9 aa, Homo Sapiens
EYSHRMWGR

SEQ ID NO: 47565 - protein, 9 aa, Homo Sapiens
EYSPQLTRR

SEQ ID NO: 47566 - protein, 9 aa, Homo Sapiens
EYSRYQRWR

SEQ ID NO: 47567 - protein, 9 aa, Homo Sapiens
EYSYVKSTK

SEQ ID NO: 47568 - protein, 9 aa, Homo Sapiens
EYTEGISQR

SEQ ID NO: 47569 - protein, 9 aa, Homo Sapiens
EYTKRTLMR

SEQ ID NO: 47570 - protein, 9 aa, Homo Sapiens
EYTTKEIFR

SEQ ID NO: 47571 - protein, 9 aa, Homo Sapiens
EYVADPVYR

SEQ ID NO: 47572 - protein, 9 aa, Homo Sapiens
EYVAEILPK

SEQ ID NO: 47573 - protein, 9 aa, Homo Sapiens
EYVANLTNL

SEQ ID NO: 47574 - protein, 9 aa, Homo Sapiens
EYVDRLSKR

SEQ ID NO: 47575 - protein, 9 aa, Homo Sapiens
EYVEFEVKR

SEQ ID NO: 47576 - protein, 9 aa, Homo Sapiens
EYVETIIAK

SEQ ID NO: 47577 - protein, 9 aa, Homo Sapiens
EYVETVTSR

SEQ ID NO: 47578 - protein, 9 aa, Homo Sapiens
EYVFKFIVR

SEQ ID NO: 47579 - protein, 9 aa, Homo Sapiens
EYVGPRLSR

SEQ ID NO: 47580 - protein, 9 aa, Homo Sapiens
EYVPEKVKK

SEQ ID NO: 47581 - protein, 9 aa, Homo Sapiens
EYVPETVYR

SEQ ID NO: 47582 - protein, 9 aa, Homo Sapiens
EYVSSLSKK

SEQ ID NO: 47583 - protein, 9 aa, Homo Sapiens
EYWDRQRNR

SEQ ID NO: 47584 - protein, 9 aa, Homo Sapiens
EYWMALRNR

SEQ ID NO: 47585 - protein, 9 aa, Homo Sapiens
EYYDKAFDR

SEQ ID NO: 47586 - protein, 9 aa, Homo Sapiens
EYYENVPCK

SEQ ID NO: 47587 - protein, 9 aa, Homo Sapiens
EYYKHPISR

SEQ ID NO: 47588 - protein, 9 aa, Homo Sapiens
FAFGGLCER

SEQ ID NO: 47589 - protein, 9 aa, Homo Sapiens
FAMNVGKAR

SEQ ID NO: 47590 - protein, 9 aa, Homo Sapiens
FATPFLVVR

SEQ ID NO: 47591 - protein, 9 aa, Homo Sapiens
FFGERRIPR

SEQ ID NO: 47592 - protein, 9 aa, Homo Sapiens
FFLTPPCAR

SEQ ID NO: 47593 - protein, 9 aa, Homo Sapiens
FFNDRPWRR

SEQ ID NO: 47594 - protein, 9 aa, Homo Sapiens
FLFVPPQFR

SEQ ID NO: 47595 - protein, 9 aa, Homo Sapiens
FLNAPEANR

SEQ ID NO: 47596 - protein, 9 aa, Homo Sapiens
FLQEYIVNR

SEQ ID NO: 47597 - protein, 9 aa, Homo Sapiens
FMNDPAMNR

SEQ ID NO: 47598 - protein, 9 aa, Homo Sapiens
FPLMPVVGR

SEQ ID NO: 47599 - protein, 9 aa, Homo Sapiens
FSAPNYCYR

SEQ ID NO: 47600 - protein, 9 aa, Homo Sapiens
FSDYPPLGR

SEQ ID NO: 47601 - protein, 9 aa, Homo Sapiens
FSKARYTVR

SEQ ID NO: 47602 - protein, 9 aa, Homo Sapiens
FSKLPEAER

SEQ ID NO: 47603 - protein, 9 aa, Homo Sapiens
FSKNVHSTR

SEQ ID NO: 47604 - protein, 9 aa, Homo Sapiens
FSKVTLIGR

SEQ ID NO: 47605 - protein, 9 aa, Homo Sapiens
FSNDVIRKR

SEQ ID NO: 47606 - protein, 9 aa, Homo Sapiens
FSNLPPEQR

SEQ ID NO: 47607 - protein, 9 aa, Homo Sapiens
FSQGIFSSR

SEQ ID NO: 47608 - protein, 9 aa, Homo Sapiens
FSVHRIIGR

SEQ ID NO: 47609 - protein, 9 aa, Homo Sapiens
FSYTHMVCR

SEQ ID NO: 47610 - protein, 9 aa, Homo Sapiens
FTDLKHAAR

SEQ ID NO: 47611 - protein, 9 aa, Homo Sapiens
FTLSALYAR

SEQ ID NO: 47612 - protein, 9 aa, Homo Sapiens
FTNERFPLR

SEQ ID NO: 47613 - protein, 9 aa, Homo Sapiens
FTNKPTTFR

SEQ ID NO: 47614 - protein, 9 aa, Homo Sapiens
FTQQGPRLR

SEQ ID NO: 47615 - protein, 9 aa, Homo Sapiens
FTSGYIPAR

SEQ ID NO: 47616 - protein, 9 aa, Homo Sapiens
FTWNINHAR

SEQ ID NO: 47617 - protein, 9 aa, Homo Sapiens
FTYMNPAQR

SEQ ID NO: 47618 - protein, 9 aa, Homo Sapiens
FVFDRPVHR

SEQ ID NO: 47619 - protein, 9 aa, Homo Sapiens
FVKDNVTKR

SEQ ID NO: 47620 - protein, 9 aa, Homo Sapiens
FVQATPHNR

SEQ ID NO: 47621 - protein, 9 aa, Homo Sapiens
FVQNPNNNR

SEQ ID NO: 47622 - protein, 9 aa, Homo Sapiens
FVRDKFTRR

SEQ ID NO: 47623 - protein, 9 aa, Homo Sapiens
FVRLKSETR

SEQ ID NO: 47624 - protein, 9 aa, Homo Sapiens
FVYGSGVYR

SEQ ID NO: 47625 - protein, 9 aa, Homo Sapiens
FWRSFHTER

SEQ ID NO: 47626 - protein, 9 aa, Homo Sapiens
FYETGEIPR

SEQ ID NO: 47627 - protein, 9 aa, Homo Sapiens
FYFKEPSLR

SEQ ID NO: 47628 - protein, 9 aa, Homo Sapiens
FYFKIGACR

SEQ ID NO: 47629 - protein, 9 aa, Homo Sapiens
FYKAIQKRR

SEQ ID NO: 47630 - protein, 9 aa, Homo Sapiens
FYNAIKSYK

SEQ ID NO: 47631 - protein, 9 aa, Homo Sapiens
FYNLMPLSR

SEQ ID NO: 47632 - protein, 9 aa, Homo Sapiens
FYNRPILSR

SEQ ID NO: 47633 - protein, 9 aa, Homo Sapiens
FYQEEFYIR

SEQ ID NO: 47634 - protein, 9 aa, Homo Sapiens
FYRPETQHR

SEQ ID NO: 47635 - protein, 9 aa, Homo Sapiens
FYRYYQVAR

SEQ ID NO: 47636 - protein, 9 aa, Homo Sapiens
FYSQEWYAR

SEQ ID NO: 47637 - protein, 9 aa, Homo Sapiens
FYSQHFSGR

SEQ ID NO: 47638 - protein, 9 aa, Homo Sapiens
GGPGGVGGL

SEQ ID NO: 47639 - protein, 9 aa, Homo Sapiens
GNYCPPVKR

SEQ ID NO: 47640 - protein, 9 aa, Homo Sapiens
GYKPKAYLR

SEQ ID NO: 47641 - protein, 9 aa, Homo Sapiens
GYKQVQVPR

SEQ ID NO: 47642 - protein, 9 aa, Homo Sapiens
HAADPIITR

SEQ ID NO: 47643 - protein, 9 aa, Homo Sapiens
HAHGKLFTR

SEQ ID NO: 47644 - protein, 9 aa, Homo Sapiens
HAKAVVSLR

SEQ ID NO: 47645 - protein, 9 aa, Homo Sapiens
HAKDGIFRR

SEQ ID NO: 47646 - protein, 9 aa, Homo Sapiens
HANPRLWLR

SEQ ID NO: 47647 - protein, 9 aa, Homo Sapiens
HAQLLEQHR

SEQ ID NO: 47648 - protein, 9 aa, Homo Sapiens
HAQSIGMNR

SEQ ID NO: 47649 - protein, 9 aa, Homo Sapiens
HAREIFDSR

SEQ ID NO: 47650 - protein, 9 aa, Homo Sapiens
HARYILTNR

SEQ ID NO: 47651 - protein, 9 aa, Homo Sapiens
HAVVVGVYR

SEQ ID NO: 47652 - protein, 9 aa, Homo Sapiens
HAWEPTGTR

SEQ ID NO: 47653 - protein, 9 aa, Homo Sapiens
HLKEIISYR

SEQ ID NO: 47654 - protein, 9 aa, Homo Sapiens
HNKYMVTER

SEQ ID NO: 47655 - protein, 9 aa, Homo Sapiens
HNMNKNVFR

SEQ ID NO: 47656 - protein, 9 aa, Homo Sapiens
HNQGPVIKR

SEQ ID NO: 47657 - protein, 9 aa, Homo Sapiens
HNRSPVSFR

SEQ ID NO: 47658 - protein, 9 aa, Homo Sapiens
HNTMPSQFR

SEQ ID NO: 47659 - protein, 9 aa, Homo Sapiens
HNYQPCVQR

SEQ ID NO: 47660 - protein, 9 aa, Homo Sapiens
HSLPPIARR

SEQ ID NO: 47661 - protein, 9 aa, Homo Sapiens
HSMALIHNR

SEQ ID NO: 47662 - protein, 9 aa, Homo Sapiens
HSMDFVAYR

SEQ ID NO: 47663 - protein, 9 aa, Homo Sapiens
HSQLVIHQR

SEQ ID NO: 47664 - protein, 9 aa, Homo Sapiens
HSRVILQGR

SEQ ID NO: 47665 - protein, 9 aa, Homo Sapiens
HSTPYYYAR

SEQ ID NO: 47666 - protein, 9 aa, Homo Sapiens
HTGRLPAGR

SEQ ID NO: 47667 - protein, 9 aa, Homo Sapiens
HTGYPGGFR

SEQ ID NO: 47668 - protein, 9 aa, Homo Sapiens
HTIAPMGTR

SEQ ID NO: 47669 - protein, 9 aa, Homo Sapiens
HTLEPLIPR

SEQ ID NO: 47670 - protein, 9 aa, Homo Sapiens
HTNSYGIIR

SEQ ID NO: 47671 - protein, 9 aa, Homo Sapiens
HVFLRTTGR

SEQ ID NO: 47672 - protein, 9 aa, Homo Sapiens
HVHEPNPLR

SEQ ID NO: 47673 - protein, 9 aa, Homo Sapiens
HVKPLLQKR

SEQ ID NO: 47674 - protein, 9 aa, Homo Sapiens
HVKPSIMKR

SEQ ID NO: 47675 - protein, 9 aa, Homo Sapiens
HYMKFTKGR

SEQ ID NO: 47676 - protein, 9 aa, Homo Sapiens
HYVKDRFLR

SEQ ID NO: 47677 - protein, 9 aa, Homo Sapiens
HYVPKIYCR

SEQ ID NO: 47678 - protein, 9 aa, Homo Sapiens
HYYSYIIQR

SEQ ID NO: 47679 - protein, 9 aa, Homo Sapiens
IAFCGPHSR

SEQ ID NO: 47680 - protein, 9 aa, Homo Sapiens
IFETIVNNR

SEQ ID NO: 47681 - protein, 9 aa, Homo Sapiens
IFKGVFVHR

SEQ ID NO: 47682 - protein, 9 aa, Homo Sapiens
IFPSRICHR

SEQ ID NO: 47683 - protein, 9 aa, Homo Sapiens
IFYTAIVNR

SEQ ID NO: 47684 - protein, 9 aa, Homo Sapiens
IGYAPYVNR

SEQ ID NO: 47685 - protein, 9 aa, Homo Sapiens
IPRTPSSFR

SEQ ID NO: 47686 - protein, 9 aa, Homo Sapiens
ISRDNWHKR

SEQ ID NO: 47687 - protein, 9 aa, Homo Sapiens
ISSGAVVHR

SEQ ID NO: 47688 - protein, 9 aa, Homo Sapiens
ITQIEHEVS

SEQ ID NO: 47689 - protein, 9 aa, Homo Sapiens
ITQRELVSR

SEQ ID NO: 47690 - protein, 9 aa, Homo Sapiens
ITTVPPNLR

SEQ ID NO: 47691 - protein, 9 aa, Homo Sapiens
ITYLMEHKR

SEQ ID NO: 47692 - protein, 9 aa, Homo Sapiens
IVKPPASAR

SEQ ID NO: 47693 - protein, 9 aa, Homo Sapiens
IVNENLVER

SEQ ID NO: 47694 - protein, 9 aa, Homo Sapiens
IVNHPKVGR

SEQ ID NO: 47695 - protein, 9 aa, Homo Sapiens
IVQAVSAHR

SEQ ID NO: 47696 - protein, 9 aa, Homo Sapiens
IYKAISSNR

SEQ ID NO: 47697 - protein, 9 aa, Homo Sapiens
IYQDSFEQR

SEQ ID NO: 47698 - protein, 9 aa, Homo Sapiens
IYQLIEISR

SEQ ID NO: 47699 - protein, 9 aa, Homo Sapiens
IYSGYIRNR

SEQ ID NO: 47700 - protein, 9 aa, Homo Sapiens
KADPPLPAR

SEQ ID NO: 47701 - protein, 9 aa, Homo Sapiens
KTKEGYYYR

SEQ ID NO: 47702 - protein, 9 aa, Homo Sapiens
LAAEPKVNR

SEQ ID NO: 47703 - protein, 9 aa, Homo Sapiens
LAKLNQVAR

SEQ ID NO: 47704 - protein, 9 aa, Homo Sapiens
LAQFHFTNR

SEQ ID NO: 47705 - protein, 9 aa, Homo Sapiens
LARDVYVGR

SEQ ID NO: 47706 - protein, 9 aa, Homo Sapiens
LAWHPTCGR

SEQ ID NO: 47707 - protein, 9 aa, Homo Sapiens
LFKELHTGR

SEQ ID NO: 47708 - protein, 9 aa, Homo Sapiens
LINNKIANR

SEQ ID NO: 47709 - protein, 9 aa, Homo Sapiens
LLSQLKGPR

SEQ ID NO: 47710 - protein, 9 aa, Homo Sapiens
LMQQQKSFR

SEQ ID NO: 47711 - protein, 9 aa, Homo Sapiens
LNAESRVNR

SEQ ID NO: 47712 - protein, 9 aa, Homo Sapiens
LNYVPFAER

SEQ ID NO: 47713 - protein, 9 aa, Homo Sapiens
LPQGHFQER

SEQ ID NO: 47714 - protein, 9 aa, Homo Sapiens
LQIDNARLA

SEQ ID NO: 47715 - protein, 9 aa, Homo Sapiens
LSNRPIMFR

SEQ ID NO: 47716 - protein, 9 aa, Homo Sapiens
LVATHDYYR

SEQ ID NO: 47717 - protein, 9 aa, Homo Sapiens
LVQEKIQKR

SEQ ID NO: 47718 - protein, 9 aa, Homo Sapiens
LVREIRQYR

SEQ ID NO: 47719 - protein, 9 aa, Homo Sapiens
LYKTPCTKR

SEQ ID NO: 47720 - protein, 9 aa, Homo Sapiens
LYQIITVER

SEQ ID NO: 47721 - protein, 9 aa, Homo Sapiens
LYRKMEIYR

SEQ ID NO: 47722 - protein, 9 aa, Homo Sapiens
MAFQGISER

SEQ ID NO: 47723 - protein, 9 aa, Homo Sapiens
MALGFAWKR

SEQ ID NO: 47724 - protein, 9 aa, Homo Sapiens
MAMLVTQAR

SEQ ID NO: 47725 - protein, 9 aa, Homo Sapiens
MANSFVGTR

SEQ ID NO: 47726 - protein, 9 aa, Homo Sapiens
MASKPLHVR

SEQ ID NO: 47727 - protein, 9 aa, Homo Sapiens
MASNSIFDS

SEQ ID NO: 47728 - protein, 9 aa, Homo Sapiens
MATFPVAPR

SEQ ID NO: 47729 - protein, 9 aa, Homo Sapiens
MATGFIWSR

SEQ ID NO: 47730 - protein, 9 aa, Homo Sapiens
MATKPLHVR

SEQ ID NO: 47731 - protein, 9 aa, Homo Sapiens
MFEYLAPPR

SEQ ID NO: 47732 - protein, 9 aa, Homo Sapiens
MFSGTHVER

SEQ ID NO: 47733 - protein, 9 aa, Homo Sapiens
MMMSYAAER

SEQ ID NO: 47734 - protein, 9 aa, Homo Sapiens
MNFNPIISR

SEQ ID NO: 47735 - protein, 9 aa, Homo Sapiens
MPKDIQLAR

SEQ ID NO: 47736 - protein, 9 aa, Homo Sapiens
MPWGDPNYR

SEQ ID NO: 47737 - protein, 9 aa, Homo Sapiens
MSASKIVCR

SEQ ID NO: 47738 - protein, 9 aa, Homo Sapiens
MSKPSIAKR

SEQ ID NO: 47739 - protein, 9 aa, Homo Sapiens
MSQPIMVQR

SEQ ID NO: 47740 - protein, 9 aa, Homo Sapiens
MSQPQLHRR

SEQ ID NO: 47741 - protein, 9 aa, Homo Sapiens
MTHEVPVYR

SEQ ID NO: 47742 - protein, 9 aa, Homo Sapiens
MTLNPSTKR

SEQ ID NO: 47743 - protein, 9 aa, Homo Sapiens
MTNLPAVGR

SEQ ID NO: 47744 - protein, 9 aa, Homo Sapiens
MTNPPVEVR

SEQ ID NO: 47745 - protein, 9 aa, Homo Sapiens
MTNTPVVVR

SEQ ID NO: 47746 - protein, 9 aa, Homo Sapiens
MTSVPVKER

SEQ ID NO: 47747 - protein, 9 aa, Homo Sapiens
MVADVFSHR

SEQ ID NO: 47748 - protein, 9 aa, Homo Sapiens
MVEYITHNR

SEQ ID NO: 47749 - protein, 9 aa, Homo Sapiens
MVKFGGSGR

SEQ ID NO: 47750 - protein, 9 aa, Homo Sapiens
MVLAHVTNR

SEQ ID NO: 47751 - protein, 9 aa, Homo Sapiens
MVMDKKHFK

SEQ ID NO: 47752 - protein, 9 aa, Homo Sapiens
MVNLLQIVR

SEQ ID NO: 47753 - protein, 9 aa, Homo Sapiens
MVNVPKTRR

SEQ ID NO: 47754 - protein, 9 aa, Homo Sapiens
MVQNRVFLR

SEQ ID NO: 47755 - protein, 9 aa, Homo Sapiens
MYCDKMFHR

SEQ ID NO: 47756 - protein, 9 aa, Homo Sapiens
MYCGKRFTR

SEQ ID NO: 47757 - protein, 9 aa, Homo Sapiens
MYFSAVMVR

SEQ ID NO: 47758 - protein, 9 aa, Homo Sapiens
MYKALLKQR

SEQ ID NO: 47759 - protein, 9 aa, Homo Sapiens
MYPDYFAKR

SEQ ID NO: 47760 - protein, 9 aa, Homo Sapiens
MYREVITQR

SEQ ID NO: 47761 - protein, 9 aa, Homo Sapiens
MYTCTLISR

SEQ ID NO: 47762 - protein, 9 aa, Homo Sapiens
NAKALSTLR

SEQ ID NO: 47763 - protein, 9 aa, Homo Sapiens
NAKDTIFHR

SEQ ID NO: 47764 - protein, 9 aa, Homo Sapiens
NAKDVLRKR

SEQ ID NO: 47765 - protein, 9 aa, Homo Sapiens
NANPLIYQR

SEQ ID NO: 47766 - protein, 9 aa, Homo Sapiens
NAQAPCWGR

SEQ ID NO: 47767 - protein, 9 aa, Homo Sapiens
NFMLIITHR

SEQ ID NO: 47768 - protein, 9 aa, Homo Sapiens
NFVGRLIGK

SEQ ID NO: 47769 - protein, 9 aa, Homo Sapiens
NGKQIYVGR

SEQ ID NO: 47770 - protein, 9 aa, Homo Sapiens
NIKNSSVPR

SEQ ID NO: 47771 - protein, 9 aa, Homo Sapiens
NLERDFFLR

SEQ ID NO: 47772 - protein, 9 aa, Homo Sapiens
NLHELRVLR

SEQ ID NO: 47773 - protein, 9 aa, Homo Sapiens
NLKPKSWVR

SEQ ID NO: 47774 - protein, 9 aa, Homo Sapiens
NLKPPQAKR

SEQ ID NO: 47775 - protein, 9 aa, Homo Sapiens
NLYFHDVGR

SEQ ID NO: 47776 - protein, 9 aa, Homo Sapiens
NMFDHPIPR

SEQ ID NO: 47777 - protein, 9 aa, Homo Sapiens
NMKHIQIHR

SEQ ID NO: 47778 - protein, 9 aa, Homo Sapiens
NMKSPPVER

SEQ ID NO: 47779 - protein, 9 aa, Homo Sapiens
NNKDLYVLR

SEQ ID NO: 47780 - protein, 9 aa, Homo Sapiens
NNKRWYFTR

SEQ ID NO: 47781 - protein, 9 aa, Homo Sapiens
NNLGNFINR

SEQ ID NO: 47782 - protein, 9 aa, Homo Sapiens
NNQSFYSNR

SEQ ID NO: 47783 - protein, 9 aa, Homo Sapiens
NNRELYIHR

SEQ ID NO: 47784 - protein, 9 aa, Homo Sapiens
NSFTPPCQR

SEQ ID NO: 47785 - protein, 9 aa, Homo Sapiens
NSKESYELR

SEQ ID NO: 47786 - protein, 9 aa, Homo Sapiens
NSNLIVHQR

SEQ ID NO: 47787 - protein, 9 aa, Homo Sapiens
NSNLVIHQR

SEQ ID NO: 47788 - protein, 9 aa, Homo Sapiens
NSQKKYFGR

SEQ ID NO: 47789 - protein, 9 aa, Homo Sapiens
NSQLIVHQR

SEQ ID NO: 47790 - protein, 9 aa, Homo Sapiens
NSREKIYNR

SEQ ID NO: 47791 - protein, 9 aa, Homo Sapiens
NTFGSFQCR

SEQ ID NO: 47792 - protein, 9 aa, Homo Sapiens
NTGNWMHIR

SEQ ID NO: 47793 - protein, 9 aa, Homo Sapiens
NTIKLIVGR

SEQ ID NO: 47794 - protein, 9 aa, Homo Sapiens
NTILRHLGR

SEQ ID NO: 47795 - protein, 9 aa, Homo Sapiens
NTNDFVTLR

SEQ ID NO: 47796 - protein, 9 aa, Homo Sapiens
NTQRSFFLR

SEQ ID NO: 47797 - protein, 9 aa, Homo Sapiens
NTQVLINCR

SEQ ID NO: 47798 - protein, 9 aa, Homo Sapiens
NTREPKLFR

SEQ ID NO: 47799 - protein, 9 aa, Homo Sapiens
NTSTSIVNR

SEQ ID NO: 47800 - protein, 9 aa, Homo Sapiens
NVARRIEFR

SEQ ID NO: 47801 - protein, 9 aa, Homo Sapiens
NVKELFSVR

SEQ ID NO: 47802 - protein, 9 aa, Homo Sapiens
NVKGPGLQR

SEQ ID NO: 47803 - protein, 9 aa, Homo Sapiens
NVKPLVTHR

SEQ ID NO: 47804 - protein, 9 aa, Homo Sapiens
NVNEVISNR

SEQ ID NO: 47805 - protein, 9 aa, Homo Sapiens
NVQRLKEYR

SEQ ID NO: 47806 - protein, 9 aa, Homo Sapiens
NVQVHFTER

SEQ ID NO: 47807 - protein, 9 aa, Homo Sapiens
NYAAPPSTR

SEQ ID NO: 47808 - protein, 9 aa, Homo Sapiens
NYGIPPVNR

SEQ ID NO: 47809 - protein, 9 aa, Homo Sapiens
NYGPGPSLR

SEQ ID NO: 47810 - protein, 9 aa, Homo Sapiens
NYIASVYVR

SEQ ID NO: 47811 - protein, 9 aa, Homo Sapiens
NYIGSFLAR

SEQ ID NO: 47812 - protein, 9 aa, Homo Sapiens
NYLNQHVNR

SEQ ID NO: 47813 - protein, 9 aa, Homo Sapiens
NYNQNFRGR

SEQ ID NO: 47814 - protein, 9 aa, Homo Sapiens
NYSQHVYYR

SEQ ID NO: 47815 - protein, 9 aa, Homo Sapiens
NYTEYVATR

SEQ ID NO: 47816 - protein, 9 aa, Homo Sapiens
NYTFTVQAR

SEQ ID NO: 47817 - protein, 9 aa, Homo Sapiens
NYVNKIKNR

SEQ ID NO: 47818 - protein, 9 aa, Homo Sapiens
QAFEREVGR

SEQ ID NO: 47819 - protein, 9 aa, Homo Sapiens
QAHAITVTR

SEQ ID NO: 47820 - protein, 9 aa, Homo Sapiens
QALERVFER

SEQ ID NO: 47821 - protein, 9 aa, Homo Sapiens
QAQKPSVPR

SEQ ID NO: 47822 - protein, 9 aa, Homo Sapiens
QAQLLFENR

SEQ ID NO: 47823 - protein, 9 aa, Homo Sapiens
QAWSLPTQR

SEQ ID NO: 47824 - protein, 9 aa, Homo Sapiens
QGYSDFINR

SEQ ID NO: 47825 - protein, 9 aa, Homo Sapiens
QLKAPHANR

SEQ ID NO: 47826 - protein, 9 aa, Homo Sapiens
QLYPRNFLR

SEQ ID NO: 47827 - protein, 9 aa, Homo Sapiens
QNFGPEVTR

SEQ ID NO: 47828 - protein, 9 aa, Homo Sapiens
QNIVPASQR

SEQ ID NO: 47829 - protein, 9 aa, Homo Sapiens
QNMGLPQNR

SEQ ID NO: 47830 - protein, 9 aa, Homo Sapiens
QNSPIYISR

SEQ ID NO: 47831 - protein, 9 aa, Homo Sapiens
QNSSIRVPR

SEQ ID NO: 47832 - protein, 9 aa, Homo Sapiens
QNTIPCLGR

SEQ ID NO: 47833 - protein, 9 aa, Homo Sapiens
QPFLKKWYR

SEQ ID NO: 47834 - protein, 9 aa, Homo Sapiens
QQLYWSHPR

SEQ ID NO: 47835 - protein, 9 aa, Homo Sapiens
QSLQSFWPR

SEQ ID NO: 47836 - protein, 9 aa, Homo Sapiens
QSNLIVHQR

SEQ ID NO: 47837 - protein, 9 aa, Homo Sapiens
QSNSLFNNR

SEQ ID NO: 47838 - protein, 9 aa, Homo Sapiens
QSSNLIQHR

SEQ ID NO: 47839 - protein, 9 aa, Homo Sapiens
QSYDNFSYR

SEQ ID NO: 47840 - protein, 9 aa, Homo Sapiens
QTADHRFLR

SEQ ID NO: 47841 - protein, 9 aa, Homo Sapiens
QTCGKQFLR

SEQ ID NO: 47842 - protein, 9 aa, Homo Sapiens
QTKFAATVR

SEQ ID NO: 47843 - protein, 9 aa, Homo Sapiens
QTKPVVVYR

SEQ ID NO: 47844 - protein, 9 aa, Homo Sapiens
QTKPVYVYR

SEQ ID NO: 47845 - protein, 9 aa, Homo Sapiens
QTLDAIRHR

SEQ ID NO: 47846 - protein, 9 aa, Homo Sapiens
QTMFHHFQR

SEQ ID NO: 47847 - protein, 9 aa, Homo Sapiens
QTNLVPYPR

SEQ ID NO: 47848 - protein, 9 aa, Homo Sapiens
QTQDNITVR

SEQ ID NO: 47849 - protein, 9 aa, Homo Sapiens
QTQSIYIPR

SEQ ID NO: 47850 - protein, 9 aa, Homo Sapiens
QTQSLHSLR

SEQ ID NO: 47851 - protein, 9 aa, Homo Sapiens
QVADVVVSR

SEQ ID NO: 47852 - protein, 9 aa, Homo Sapiens
QVKALGTER

SEQ ID NO: 47853 - protein, 9 aa, Homo Sapiens
QVKDVQKLR

SEQ ID NO: 47854 - protein, 9 aa, Homo Sapiens
QVKTWFQNR

SEQ ID NO: 47855 - protein, 9 aa, Homo Sapiens
QVLNRVVTR

SEQ ID NO: 47856 - protein, 9 aa, Homo Sapiens
QVMFRNYQR

SEQ ID NO: 47857 - protein, 9 aa, Homo Sapiens
QVNKAPKMR

SEQ ID NO: 47858 - protein, 9 aa, Homo Sapiens
QVQEWNRQR

SEQ ID NO: 47859 - protein, 9 aa, Homo Sapiens
QVQQILTSR

SEQ ID NO: 47860 - protein, 9 aa, Homo Sapiens
QYQNITVHR

SEQ ID NO: 47861 - protein, 9 aa, Homo Sapiens
RNLDHVYNR

SEQ ID NO: 47862 - protein, 9 aa, Homo Sapiens
RYSSAFTNR

SEQ ID NO: 47863 - protein, 9 aa, Homo Sapiens
SAALRAVYR

SEQ ID NO: 47864 - protein, 9 aa, Homo Sapiens
SADKIHITR

SEQ ID NO: 47865 - protein, 9 aa, Homo Sapiens
SAFVPSSGR

SEQ ID NO: 47866 - protein, 9 aa, Homo Sapiens
SAGGSFTVR

SEQ ID NO: 47867 - protein, 9 aa, Homo Sapiens
SAIHIRVFR

SEQ ID NO: 47868 - protein, 9 aa, Homo Sapiens
SAKEVLSAR

SEQ ID NO: 47869 - protein, 9 aa, Homo Sapiens
SALRPSTSR

SEQ ID NO: 47870 - protein, 9 aa, Homo Sapiens
SANDYFSER

SEQ ID NO: 47871 - protein, 9 aa, Homo Sapiens
SANLIVHQR

SEQ ID NO: 47872 - protein, 9 aa, Homo Sapiens
SANLVVHQR

SEQ ID NO: 47873 - protein, 9 aa, Homo Sapiens
SARELFAAR

SEQ ID NO: 47874 - protein, 9 aa, Homo Sapiens
SATLPVTFR

SEQ ID NO: 47875 - protein, 9 aa, Homo Sapiens
SFDIPKEKR

SEQ ID NO: 47876 - protein, 9 aa, Homo Sapiens
SFEKVPVGR

SEQ ID NO: 47877 - protein, 9 aa, Homo Sapiens
SFELKIVRR

SEQ ID NO: 47878 - protein, 9 aa, Homo Sapiens
SFETFINKR

SEQ ID NO: 47879 - protein, 9 aa, Homo Sapiens
SFFRREIKR

SEQ ID NO: 47880 - protein, 9 aa, Homo Sapiens
SFKDFAKSK

SEQ ID NO: 47881 - protein, 9 aa, Homo Sapiens
SFKDYIQER

SEQ ID NO: 47882 - protein, 9 aa, Homo Sapiens
SFKKPPLRR

SEQ ID NO: 47883 - protein, 9 aa, Homo Sapiens
SFQKVISRR

SEQ ID NO: 47884 - protein, 9 aa, Homo Sapiens
SFRKKYELR

SEQ ID NO: 47885 - protein, 9 aa, Homo Sapiens
SFTLKPRTI

SEQ ID NO: 47886 - protein, 9 aa, Homo Sapiens
SGYPPFVGR

SEQ ID NO: 47887 - protein, 9 aa, Homo Sapiens
SIMKWNRER

SEQ ID NO: 47888 - protein, 9 aa, Homo Sapiens
SINKPTSER

SEQ ID NO: 47889 - protein, 9 aa, Homo Sapiens
SIRDPVHNR

SEQ ID NO: 47890 - protein, 9 aa, Homo Sapiens
SIREPIANR

SEQ ID NO: 47891 - protein, 9 aa, Homo Sapiens
SLWKKTVYR

SEQ ID NO: 47892 - protein, 9 aa, Homo Sapiens
SMLEYFINR

SEQ ID NO: 47893 - protein, 9 aa, Homo Sapiens
SMRDHIDYR

SEQ ID NO: 47894 - protein, 9 aa, Homo Sapiens
SNDIPHVVR

SEQ ID NO: 47895 - protein, 9 aa, Homo Sapiens
SNFGPEVTR

SEQ ID NO: 47896 - protein, 9 aa, Homo Sapiens
SNFKRFHGR

SEQ ID NO: 47897 - protein, 9 aa, Homo Sapiens
SNKELAIER

SEQ ID NO: 47898 - protein, 9 aa, Homo Sapiens
SNNTPQLNR

SEQ ID NO: 47899 - protein, 9 aa, Homo Sapiens
SNTIPVKTR

SEQ ID NO: 47900 - protein, 9 aa, Homo Sapiens
SSGPGPSLR

SEQ ID NO: 47901 - protein, 9 aa, Homo Sapiens
SSIRPISER

SEQ ID NO: 47902 - protein, 9 aa, Homo Sapiens
SSKNIFTER

SEQ ID NO: 47903 - protein, 9 aa, Homo Sapiens
SSKPLYLAR

SEQ ID NO: 47904 - protein, 9 aa, Homo Sapiens
SSLDRLYSR

SEQ ID NO: 47905 - protein, 9 aa, Homo Sapiens
SSLRIAATR

SEQ ID NO: 47906 - protein, 9 aa, Homo Sapiens
SSYFRIHER

SEQ ID NO: 47907 - protein, 9 aa, Homo Sapiens
STARHLYLR

SEQ ID NO: 47908 - protein, 9 aa, Homo Sapiens
STFLPQCNR

SEQ ID NO: 47909 - protein, 9 aa, Homo Sapiens
STHFRIHER

SEQ ID NO: 47910 - protein, 9 aa, Homo Sapiens
STIPFHYKR

SEQ ID NO: 47911 - protein, 9 aa, Homo Sapiens
STKFPAYER

SEQ ID NO: 47912 - protein, 9 aa, Homo Sapiens
STKGLNLPR

SEQ ID NO: 47913 - protein, 9 aa, Homo Sapiens
STKSISFTR

SEQ ID NO: 47914 - protein, 9 aa, Homo Sapiens
STLAQLKQR

SEQ ID NO: 47915 - protein, 9 aa, Homo Sapiens
STLESIYQR

SEQ ID NO: 47916 - protein, 9 aa, Homo Sapiens
STLSPIAPR

SEQ ID NO: 47917 - protein, 9 aa, Homo Sapiens
STNPFRPQK

SEQ ID NO: 47918 - protein, 9 aa, Homo Sapiens
STQLFCSTR

SEQ ID NO: 47919 - protein, 9 aa, Homo Sapiens
STQLTIHQR

SEQ ID NO: 47920 - protein, 9 aa, Homo Sapiens
STRPPSVTR

SEQ ID NO: 47921 - protein, 9 aa, Homo Sapiens
STSKRHWLR

SEQ ID NO: 47922 - protein, 9 aa, Homo Sapiens
STWQRNAMR

SEQ ID NO: 47923 - protein, 9 aa, Homo Sapiens
STYIRLYGR

SEQ ID NO: 47924 - protein, 9 aa, Homo Sapiens
STYLLSVYR

SEQ ID NO: 47925 - protein, 9 aa, Homo Sapiens
SVDRPIIDR

SEQ ID NO: 47926 - protein, 9 aa, Homo Sapiens
SVKDYCFAR

SEQ ID NO: 47927 - protein, 9 aa, Homo Sapiens
SVKEIYNEK

SEQ ID NO: 47928 - protein, 9 aa, Homo Sapiens
SVKEVALGR

SEQ ID NO: 47929 - protein, 9 aa, Homo Sapiens
SVKFGATLR

SEQ ID NO: 47930 - protein, 9 aa, Homo Sapiens
SVKSITNPR

SEQ ID NO: 47931 - protein, 9 aa, Homo Sapiens
SVLDYFSER

SEQ ID NO: 47932 - protein, 9 aa, Homo Sapiens
SVLENFVGR

SEQ ID NO: 47933 - protein, 9 aa, Homo Sapiens
SVLNFATNR

SEQ ID NO: 47934 - protein, 9 aa, Homo Sapiens
SVNSHIYQR

SEQ ID NO: 47935 - protein, 9 aa, Homo Sapiens
SVQGIIIYR

SEQ ID NO: 47936 - protein, 9 aa, Homo Sapiens
SVYQIKVHR

SEQ ID NO: 47937 - protein, 9 aa, Homo Sapiens
SYAELLTHR

SEQ ID NO: 47938 - protein, 9 aa, Homo Sapiens
SYAEYIASR

SEQ ID NO: 47939 - protein, 9 aa, Homo Sapiens
SYAEYLAHR

SEQ ID NO: 47940 - protein, 9 aa, Homo Sapiens
SYCEPPSYR

SEQ ID NO: 47941 - protein, 9 aa, Homo Sapiens
SYDLVIHQR

SEQ ID NO: 47942 - protein, 9 aa, Homo Sapiens
SYFGGVCSR

SEQ ID NO: 47943 - protein, 9 aa, Homo Sapiens
SYFSFSRNR

SEQ ID NO: 47944 - protein, 9 aa, Homo Sapiens
SYGEVFKVR

SEQ ID NO: 47945 - protein, 9 aa, Homo Sapiens
SYGPGPSLR

SEQ ID NO: 47946 - protein, 9 aa, Homo Sapiens
SYGSLARFR

SEQ ID NO: 47947 - protein, 9 aa, Homo Sapiens
SYIDEQFER

SEQ ID NO: 47948 - protein, 9 aa, Homo Sapiens
SYIDRLAPR

SEQ ID NO: 47949 - protein, 9 aa, Homo Sapiens
SYIKLQTNR

SEQ ID NO: 47950 - protein, 9 aa, Homo Sapiens
SYKDFSESR

SEQ ID NO: 47951 - protein, 9 aa, Homo Sapiens
SYKGSISYR

SEQ ID NO: 47952 - protein, 9 aa, Homo Sapiens
SYKGTPAMR

SEQ ID NO: 47953 - protein, 9 aa, Homo Sapiens
SYLDKFFSR

SEQ ID NO: 47954 - protein, 9 aa, Homo Sapiens
SYLGVAHQR

SEQ ID NO: 47955 - protein, 9 aa, Homo Sapiens
SYNYEIVNR

SEQ ID NO: 47956 - protein, 9 aa, Homo Sapiens
SYNYLGFAR

SEQ ID NO: 47957 - protein, 9 aa, Homo Sapiens
SYREQWSQR

SEQ ID NO: 47958 - protein, 9 aa, Homo Sapiens
SYRKFLNLR

SEQ ID NO: 47959 - protein, 9 aa, Homo Sapiens
SYSLFTALR

SEQ ID NO: 47960 - protein, 9 aa, Homo Sapiens
SYSPTICTR

SEQ ID NO: 47961 - protein, 9 aa, Homo Sapiens
SYVELSQYR

SEQ ID NO: 47962 - protein, 9 aa, Homo Sapiens
TAAQFIYSR

SEQ ID NO: 47963 - protein, 9 aa, Homo Sapiens
TAICPLKER

SEQ ID NO: 47964 - protein, 9 aa, Homo Sapiens
TALKVASTR

SEQ ID NO: 47965 - protein, 9 aa, Homo Sapiens
TAMLPSSQR

SEQ ID NO: 47966 - protein, 9 aa, Homo Sapiens
TAMPPGTAR

SEQ ID NO: 47967 - protein, 9 aa, Homo Sapiens
TAYRPDWNR

SEQ ID NO: 47968 - protein, 9 aa, Homo Sapiens
TAYRPPALR

SEQ ID NO: 47969 - protein, 9 aa, Homo Sapiens
TFEALKRNR

SEQ ID NO: 47970 - protein, 9 aa, Homo Sapiens
TFEHPNVVR

SEQ ID NO: 47971 - protein, 9 aa, Homo Sapiens
TFGKVKVGK

SEQ ID NO: 47972 - protein, 9 aa, Homo Sapiens
TFKDYVRDR

SEQ ID NO: 47973 - protein, 9 aa, Homo Sapiens
TFVAPMKHR

SEQ ID NO: 47974 - protein, 9 aa, Homo Sapiens
TFYSISQER

SEQ ID NO: 47975 - protein, 9 aa, Homo Sapiens
TIFKPQSKR

SEQ ID NO: 47976 - protein, 9 aa, Homo Sapiens
TLCKPLVPR

SEQ ID NO: 47977 - protein, 9 aa, Homo Sapiens
TLRDLIFKR

SEQ ID NO: 47978 - protein, 9 aa, Homo Sapiens
TNRTPEFLR

SEQ ID NO: 47979 - protein, 9 aa, Homo Sapiens
TNTVPKLYR

SEQ ID NO: 47980 - protein, 9 aa, Homo Sapiens
TSIRWSLGR

SEQ ID NO: 47981 - protein, 9 aa, Homo Sapiens
TSKPPVQYR

SEQ ID NO: 47982 - protein, 9 aa, Homo Sapiens
TSKPPVTLR

SEQ ID NO: 47983 - protein, 9 aa, Homo Sapiens
TSKTYVISR

SEQ ID NO: 47984 - protein, 9 aa, Homo Sapiens
TSNMPVAAR

SEQ ID NO: 47985 - protein, 9 aa, Homo Sapiens
TSRNITEAR

SEQ ID NO: 47986 - protein, 9 aa, Homo Sapiens
TSTVPLVGR

SEQ ID NO: 47987 - protein, 9 aa, Homo Sapiens
TSWVPLVSR

SEQ ID NO: 47988 - protein, 9 aa, Homo Sapiens
TTEVPPPPR

SEQ ID NO: 47989 - protein, 9 aa, Homo Sapiens
TTFGPKSQR

SEQ ID NO: 47990 - protein, 9 aa, Homo Sapiens
TTITAPPSR

SEQ ID NO: 47991 - protein, 9 aa, Homo Sapiens
TTKMSLNER

SEQ ID NO: 47992 - protein, 9 aa, Homo Sapiens
TTKPAIIFR

SEQ ID NO: 47993 - protein, 9 aa, Homo Sapiens
TTKPVNWLK

SEQ ID NO: 47994 - protein, 9 aa, Homo Sapiens
TTKSLFVGH

SEQ ID NO: 47995 - protein, 9 aa, Homo Sapiens
TTLTKIALR

SEQ ID NO: 47996 - protein, 9 aa, Homo Sapiens
TTRDSPVLR

SEQ ID NO: 47997 - protein, 9 aa, Homo Sapiens
TTRPTWMPR

SEQ ID NO: 47998 - protein, 9 aa, Homo Sapiens
TTSIPKCYR

SEQ ID NO: 47999 - protein, 9 aa, Homo Sapiens
TTTEHRFFR

SEQ ID NO: 48000 - protein, 9 aa, Homo Sapiens
TTVEGLITR

SEQ ID NO: 48001 - protein, 9 aa, Homo Sapiens
TVAAVFRGR

SEQ ID NO: 48002 - protein, 9 aa, Homo Sapiens
TVATLPRGR

SEQ ID NO: 48003 - protein, 9 aa, Homo Sapiens
TVGGWVSTR

SEQ ID NO: 48004 - protein, 9 aa, Homo Sapiens
TVISRVIGR

SEQ ID NO: 48005 - protein, 9 aa, Homo Sapiens
TVKVQIHSR

SEQ ID NO: 48006 - protein, 9 aa, Homo Sapiens
TVLGYFIGR

SEQ ID NO: 48007 - protein, 9 aa, Homo Sapiens
TVLIIKSLR

SEQ ID NO: 48008 - protein, 9 aa, Homo Sapiens
TVLQQQYNR

SEQ ID NO: 48009 - protein, 9 aa, Homo Sapiens
TVLQYVVGR

SEQ ID NO: 48010 - protein, 9 aa, Homo Sapiens
TVMRLIEKR

SEQ ID NO: 48011 - protein, 9 aa, Homo Sapiens
TVRDAVVGR

SEQ ID NO: 48012 - protein, 9 aa, Homo Sapiens
TVRDHLVGR

SEQ ID NO: 48013 - protein, 9 aa, Homo Sapiens
TYANIAMVR

SEQ ID NO: 48014 - protein, 9 aa, Homo Sapiens
TYCGKAFTR

SEQ ID NO: 48015 - protein, 9 aa, Homo Sapiens
TYFPSFLSR

SEQ ID NO: 48016 - protein, 9 aa, Homo Sapiens
TYGEVFKAR

SEQ ID NO: 48017 - protein, 9 aa, Homo Sapiens
TYISAIRER

SEQ ID NO: 48018 - protein, 9 aa, Homo Sapiens
TYIYFKRLK

SEQ ID NO: 48019 - protein, 9 aa, Homo Sapiens
TYKFCFSNR

SEQ ID NO: 48020 - protein, 9 aa, Homo Sapiens
TYKQGILAR

SEQ ID NO: 48021 - protein, 9 aa, Homo Sapiens
TYLATFHQR

SEQ ID NO: 48022 - protein, 9 aa, Homo Sapiens
TYLEPGIGR

SEQ ID NO: 48023 - protein, 9 aa, Homo Sapiens
TYLGEFSLR

SEQ ID NO: 48024 - protein, 9 aa, Homo Sapiens
TYLTKFIAR

SEQ ID NO: 48025 - protein, 9 aa, Homo Sapiens
TYNEHITKR

SEQ ID NO: 48026 - protein, 9 aa, Homo Sapiens
TYRLGMAAR

SEQ ID NO: 48027 - protein, 9 aa, Homo Sapiens
TYSGHFTMR

SEQ ID NO: 48028 - protein, 9 aa, Homo Sapiens
TYYGSFVTR

SEQ ID NO: 48029 - protein, 9 aa, Homo Sapiens
TYYPPPRLR

SEQ ID NO: 48030 - protein, 9 aa, Homo Sapiens
VAFKPTSNR

SEQ ID NO: 48031 - protein, 9 aa, Homo Sapiens
VAMEPVSTR

SEQ ID NO: 48032 - protein, 9 aa, Homo Sapiens
VANSAFVER

SEQ ID NO: 48033 - protein, 9 aa, Homo Sapiens
VASTPISQR

SEQ ID NO: 48034 - protein, 9 aa, Homo Sapiens
VFKEEGVLR

SEQ ID NO: 48035 - protein, 9 aa, Homo Sapiens
VPFGAGRHR

SEQ ID NO: 48036 - protein, 9 aa, Homo Sapiens
VPIGYHVPR

SEQ ID NO: 48037 - protein, 9 aa, Homo Sapiens
VSNKWLHER

SEQ ID NO: 48038 - protein, 9 aa, Homo Sapiens
VTQAPISAR

SEQ ID NO: 48039 - protein, 9 aa, Homo Sapiens
VVAPRLNSR

SEQ ID NO: 48040 - protein, 9 aa, Homo Sapiens
VVMTPPRNR

SEQ ID NO: 48041 - protein, 9 aa, Homo Sapiens
VYIEKFVRR

SEQ ID NO: 48042 - protein, 9 aa, Homo Sapiens
VYIERLRHR

SEQ ID NO: 48043 - protein, 9 aa, Homo Sapiens
VYNEYISHR

SEQ ID NO: 48044 - protein, 9 aa, Homo Sapiens
WAQTVVVGR

SEQ ID NO: 48045 - protein, 9 aa, Homo Sapiens
WYLGTIKKR

SEQ ID NO: 48046 - protein, 9 aa, Homo Sapiens
WYSGVNRPR

SEQ ID NO: 48047 - protein, 9 aa, Homo Sapiens
YAAFVQTHR

SEQ ID NO: 48048 - protein, 9 aa, Homo Sapiens
YAKDIGFIK

SEQ ID NO: 48049 - protein, 9 aa, Homo Sapiens
YALAVSKQR

SEQ ID NO: 48050 - protein, 9 aa, Homo Sapiens
YALDPSFPR

SEQ ID NO: 48051 - protein, 9 aa, Homo Sapiens
YALPHAILR

SEQ ID NO: 48052 - protein, 9 aa, Homo Sapiens
YARLIDYAR

SEQ ID NO: 48053 - protein, 9 aa, Homo Sapiens
YFDNLLSQR

SEQ ID NO: 48054 - protein, 9 aa, Homo Sapiens
YFFYNKRLK

SEQ ID NO: 48055 - protein, 9 aa, Homo Sapiens
YFIDKLALR

SEQ ID NO: 48056 - protein, 9 aa, Homo Sapiens
YFKKKFAER

SEQ ID NO: 48057 - protein, 9 aa, Homo Sapiens
YFKPPDKKR

SEQ ID NO: 48058 - protein, 9 aa, Homo Sapiens
YFLGYMVHR

SEQ ID NO: 48059 - protein, 9 aa, Homo Sapiens
YIHIRIQQR

SEQ ID NO: 48060 - protein, 9 aa, Homo Sapiens
YIRAKYVER

SEQ ID NO: 48061 - protein, 9 aa, Homo Sapiens
YLKEREEFR

SEQ ID NO: 48062 - protein, 9 aa, Homo Sapiens
YMLDKINRR

SEQ ID NO: 48063 - protein, 9 aa, Homo Sapiens
YNKYINVKK

SEQ ID NO: 48064 - protein, 9 aa, Homo Sapiens
YPNKPPTVR

SEQ ID NO: 48065 - protein, 9 aa, Homo Sapiens
YPYSPPAFR

SEQ ID NO: 48066 - protein, 9 aa, Homo Sapiens
YPYSPPTFR

SEQ ID NO: 48067 - protein, 9 aa, Homo Sapiens
YSHESLYHR

SEQ ID NO: 48068 - protein, 9 aa, Homo Sapiens
YSLGSIYTR

SEQ ID NO: 48069 - protein, 9 aa, Homo Sapiens
YSLSPFEQR

SEQ ID NO: 48070 - protein, 9 aa, Homo Sapiens
YSNKEIFLR

SEQ ID NO: 48071 - protein, 9 aa, Homo Sapiens
YSNSPEALR

SEQ ID NO: 48072 - protein, 9 aa, Homo Sapiens
YSSDVIQHR

SEQ ID NO: 48073 - protein, 9 aa, Homo Sapiens
YSTYVLHER

SEQ ID NO: 48074 - protein, 9 aa, Homo Sapiens
YSWDIVVQR

SEQ ID NO: 48075 - protein, 9 aa, Homo Sapiens
YTDKIKYPR

SEQ ID NO: 48076 - protein, 9 aa, Homo Sapiens
YTLDFPESR

SEQ ID NO: 48077 - protein, 9 aa, Homo Sapiens
YTMKVFAKR

SEQ ID NO: 48078 - protein, 9 aa, Homo Sapiens
YTQPGPGYR

SEQ ID NO: 48079 - protein, 9 aa, Homo Sapiens
YVANVGTNR

SEQ ID NO: 48080 - protein, 9 aa, Homo Sapiens
YVFPKPFNR

SEQ ID NO: 48081 - protein, 9 aa, Homo Sapiens
YVKDLVVQR

SEQ ID NO: 48082 - protein, 9 aa, Homo Sapiens
YVKEQFAWR

SEQ ID NO: 48083 - protein, 9 aa, Homo Sapiens
YVKLSVGKK

SEQ ID NO: 48084 - protein, 9 aa, Homo Sapiens
YVQRFHYSR

SEQ ID NO: 48085 - protein, 9 aa, Homo Sapiens
YVQRYRYFR

SEQ ID NO: 48086 - protein, 9 aa, Homo Sapiens
YVRPSPAKR

SEQ ID NO: 48087 - protein, 9 aa, Homo Sapiens
YYALVVRGR

SEQ ID NO: 48088 - protein, 9 aa, Homo Sapiens
YYFLPLKKR

SEQ ID NO: 48089 - protein, 9 aa, Homo Sapiens
YYIVLITKR

SEQ ID NO: 48090 - protein, 9 aa, Homo Sapiens
YYIYELQKR

SEQ ID NO: 48091 - protein, 9 aa, Homo Sapiens
YYKPWFFKH

SEQ ID NO: 48092 - protein, 9 aa, Homo Sapiens
YYMRRPYGR

SEQ ID NO: 48093 - protein, 9 aa, Homo Sapiens
YYNGCIFHR

SEQ ID NO: 48094 - protein, 9 aa, Homo Sapiens
YYNGIGVKR

SEQ ID NO: 48095 - protein, 9 aa, Homo Sapiens
YYPSIVANR

SEQ ID NO: 48096 - protein, 9 aa, Homo Sapiens
YYRPPRPPK

SEQ ID NO: 48097 - protein, 9 aa, Homo Sapiens
YYSLLTAPR

SEQ ID NO: 48098 - protein, 9 aa, Homo Sapiens
YYTDYVATR

SEQ ID NO: 48099 - protein, 9 aa, Homo Sapiens
YYYHNVKCR

SEQ ID NO: 48100 - protein, 10 aa, Homo Sapiens
ATCDFPLLNR

SEQ ID NO: 48101 - protein, 10 aa, Homo Sapiens
AVLDLQLRSA

SEQ ID NO: 48102 - protein, 10 aa, Homo Sapiens
CAAPGPASYR

SEQ ID NO: 48103 - protein, 10 aa, Homo Sapiens
CTADWLPAGR

SEQ ID NO: 48104 - protein, 10 aa, Homo Sapiens
DAGSVPHVNR

SEQ ID NO: 48105 - protein, 10 aa, Homo Sapiens
DAVKPGVRYR

SEQ ID NO: 48106 - protein, 10 aa, Homo Sapiens
DFIASGRTGR

SEQ ID NO: 48107 - protein, 10 aa, Homo Sapiens
DFISCDRTGR

SEQ ID NO: 48108 - protein, 10 aa, Homo Sapiens
DFLELQRRYR

SEQ ID NO: 48109 - protein, 10 aa, Homo Sapiens
DFLKVLNRAR

SEQ ID NO: 48110 - protein, 10 aa, Homo Sapiens
DFQIEKKIGR

SEQ ID NO: 48111 - protein, 10 aa, Homo Sapiens
DFRRAPFAGR

SEQ ID NO: 48112 - protein, 10 aa, Homo Sapiens
DFSCGGRVNR

SEQ ID NO: 48113 - protein, 10 aa, Homo Sapiens
DFSQNTRVPR

SEQ ID NO: 48114 - protein, 10 aa, Homo Sapiens
DIYDRKNMPR

SEQ ID NO: 48115 - protein, 10 aa, Homo Sapiens
DSFPERRAPR

SEQ ID NO: 48116 - protein, 10 aa, Homo Sapiens
DSRDGKFIHR

SEQ ID NO: 48117 - protein, 10 aa, Homo Sapiens
DTMRLQPIGR

SEQ ID NO: 48118 - protein, 10 aa, Homo Sapiens
DTRDKGLVNR

SEQ ID NO: 48119 - protein, 10 aa, Homo Sapiens
DVRPFAPKER

SEQ ID NO: 48120 - protein, 10 aa, Homo Sapiens
DYFEGATSQR

SEQ ID NO: 48121 - protein, 10 aa, Homo Sapiens
DYFTPQGEFR

SEQ ID NO: 48122 - protein, 10 aa, Homo Sapiens
DYGFPERKER

SEQ ID NO: 48123 - protein, 10 aa, Homo Sapiens
DYIHIRIQQR

SEQ ID NO: 48124 - protein, 10 aa, Homo Sapiens
DYKVASPALR

SEQ ID NO: 48125 - protein, 10 aa, Homo Sapiens
DYKVVSPALR

SEQ ID NO: 48126 - protein, 10 aa, Homo Sapiens
DYLMKILTER

SEQ ID NO: 48127 - protein, 10 aa, Homo Sapiens
DYLVPILAPR

SEQ ID NO: 48128 - protein, 10 aa, Homo Sapiens
DYPDYKYRPR

SEQ ID NO: 48129 - protein, 10 aa, Homo Sapiens
DYQLVRKLGR

SEQ ID NO: 48130 - protein, 10 aa, Homo Sapiens
DYQQTIKKYR

SEQ ID NO: 48131 - protein, 10 aa, Homo Sapiens
DYVVGARTFR

SEQ ID NO: 48132 - protein, 10 aa, Homo Sapiens
DYYEVLGVQR

SEQ ID NO: 48133 - protein, 10 aa, Homo Sapiens
DYYTPTGEFR

SEQ ID NO: 48134 - protein, 10 aa, Homo Sapiens
EAAAPGKRIR

SEQ ID NO: 48135 - protein, 10 aa, Homo Sapiens
EACDRLLAHR

SEQ ID NO: 48136 - protein, 10 aa, Homo Sapiens
EAFAIGARAR

SEQ ID NO: 48137 - protein, 10 aa, Homo Sapiens
EAFEHPNVVR

SEQ ID NO: 48138 - protein, 10 aa, Homo Sapiens
EAFPSQGTKR

SEQ ID NO: 48139 - protein, 10 aa, Homo Sapiens
EAIGPVHQNR

SEQ ID NO: 48140 - protein, 10 aa, Homo Sapiens
EAISLLNSER

SEQ ID NO: 48141 - protein, 10 aa, Homo Sapiens
EAKRPPGFDR

SEQ ID NO: 48142 - protein, 10 aa, Homo Sapiens
EALDSSWVSR

SEQ ID NO: 48143 - protein, 10 aa, Homo Sapiens
EALGEVMVSR

SEQ ID NO: 48144 - protein, 10 aa, Homo Sapiens
EALGSGLVSR

SEQ ID NO: 48145 - protein, 10 aa, Homo Sapiens
EALNFLHSKR

SEQ ID NO: 48146 - protein, 10 aa, Homo Sapiens
EALPENRLSR

SEQ ID NO: 48147 - protein, 10 aa, Homo Sapiens
EALSALTARL

SEQ ID NO: 48148 - protein, 10 aa, Homo Sapiens
EAMASIINRL

SEQ ID NO: 48149 - protein, 10 aa, Homo Sapiens
EAMCFDGVKR

SEQ ID NO: 48150 - protein, 10 aa, Homo Sapiens
EAMKLGAVKR

SEQ ID NO: 48151 - protein, 10 aa, Homo Sapiens
EANSNAVRFR

SEQ ID NO: 48152 - protein, 10 aa, Homo Sapiens
EAQAKVDVFR

SEQ ID NO: 48153 - protein, 10 aa, Homo Sapiens
EAQAWEQARL

SEQ ID NO: 48154 - protein, 10 aa, Homo Sapiens
EAQKPYLVQR

SEQ ID NO: 48155 - protein, 10 aa, Homo Sapiens
EAQQRRLLGR

SEQ ID NO: 48156 - protein, 10 aa, Homo Sapiens
EARAGVLAER

SEQ ID NO: 48157 - protein, 10 aa, Homo Sapiens
EARKQVEVFR

SEQ ID NO: 48158 - protein, 10 aa, Homo Sapiens
EATAGFTIGR

SEQ ID NO: 48159 - protein, 10 aa, Homo Sapiens
EATGGKYVPR

SEQ ID NO: 48160 - protein, 10 aa, Homo Sapiens
EATLGSGNLR

SEQ ID NO: 48161 - protein, 10 aa, Homo Sapiens
EAVHDLLRPR

SEQ ID NO: 48162 - protein, 10 aa, Homo Sapiens
EAWKLLKVGR

SEQ ID NO: 48163 - protein, 10 aa, Homo Sapiens
EAWLLPAVGR

SEQ ID NO: 48164 - protein, 10 aa, Homo Sapiens
EAYNETFSNR

SEQ ID NO: 48165 - protein, 10 aa, Homo Sapiens
EEQLQQIRAE

SEQ ID NO: 48166 - protein, 10 aa, Homo Sapiens
EFDDRRGVLR

SEQ ID NO: 48167 - protein, 10 aa, Homo Sapiens
EFEEIMNRNR

SEQ ID NO: 48168 - protein, 10 aa, Homo Sapiens
EFFDEERRAR

SEQ ID NO: 48169 - protein, 10 aa, Homo Sapiens
EFGEPLPKRL

SEQ ID NO: 48170 - protein, 10 aa, Homo Sapiens
EFIDVIVGNR

SEQ ID NO: 48171 - protein, 10 aa, Homo Sapiens
EFIHINNKLR

SEQ ID NO: 48172 - protein, 10 aa, Homo Sapiens
EFINEKGVKR

SEQ ID NO: 48173 - protein, 10 aa, Homo Sapiens
EFKAVQQVQR

SEQ ID NO: 48174 - protein, 10 aa, Homo Sapiens
EFKEVPERGR

SEQ ID NO: 48175 - protein, 10 aa, Homo Sapiens
EFLAKGKRFR

SEQ ID NO: 48176 - protein, 10 aa, Homo Sapiens
EFLDIMKRNR

SEQ ID NO: 48177 - protein, 10 aa, Homo Sapiens
EFLQVPAVTR

SEQ ID NO: 48178 - protein, 10 aa, Homo Sapiens
EFLTKPEVAR

SEQ ID NO: 48179 - protein, 10 aa, Homo Sapiens
EFPHPPKRLR

SEQ ID NO: 48180 - protein, 10 aa, Homo Sapiens
EFPQPPGAAR

SEQ ID NO: 48181 - protein, 10 aa, Homo Sapiens
EFQFRGGFGR

SEQ ID NO: 48182 - protein, 10 aa, Homo Sapiens
EFQVIMGRKR

SEQ ID NO: 48183 - protein, 10 aa, Homo Sapiens
EFRDKRIAKR

SEQ ID NO: 48184 - protein, 10 aa, Homo Sapiens
EFRDYPPVLR

SEQ ID NO: 48185 - protein, 10 aa, Homo Sapiens
EFREEAYHSR

SEQ ID NO: 48186 - protein, 10 aa, Homo Sapiens
EFREGIVVDR

SEQ ID NO: 48187 - protein, 10 aa, Homo Sapiens
EFRKLCDNLR

SEQ ID NO: 48188 - protein, 10 aa, Homo Sapiens
EFRNFKIIYR

SEQ ID NO: 48189 - protein, 10 aa, Homo Sapiens
EFRSGKVAFR

SEQ ID NO: 48190 - protein, 10 aa, Homo Sapiens
EFTNAIRREK

SEQ ID NO: 48191 - protein, 10 aa, Homo Sapiens
EGGGRLQALR

SEQ ID NO: 48192 - protein, 10 aa, Homo Sapiens
EGRDIPIVHR

SEQ ID NO: 48193 - protein, 10 aa, Homo Sapiens
EGRPTIEVRR

SEQ ID NO: 48194 - protein, 10 aa, Homo Sapiens
EIASVAYRYR

SEQ ID NO: 48195 - protein, 10 aa, Homo Sapiens
EIKDFLLTAR

SEQ ID NO: 48196 - protein, 10 aa, Homo Sapiens
EIKDIHVPPR

SEQ ID NO: 48197 - protein, 10 aa, Homo Sapiens
EIKGFYDPPR

SEQ ID NO: 48198 - protein, 10 aa, Homo Sapiens
EIKKPPVSER

SEQ ID NO: 48199 - protein, 10 aa, Homo Sapiens
EILEVLRHPR

SEQ ID NO: 48200 - protein, 10 aa, Homo Sapiens
EILHKIVKYR

SEQ ID NO: 48201 - protein, 10 aa, Homo Sapiens
EILSRSIVKR

SEQ ID NO: 48202 - protein, 10 aa, Homo Sapiens
EINDVPLTCR

SEQ ID NO: 48203 - protein, 10 aa, Homo Sapiens
EIQQAGERLR

SEQ ID NO: 48204 - protein, 10 aa, Homo Sapiens
EIRQQIPVFR

SEQ ID NO: 48205 - protein, 10 aa, Homo Sapiens
EIRTITVVQR

SEQ ID NO: 48206 - protein, 10 aa, Homo Sapiens
EIYDRREYSR

SEQ ID NO: 48207 - protein, 10 aa, Homo Sapiens
ELADPTERFR

SEQ ID NO: 48208 - protein, 10 aa, Homo Sapiens
ELASIKNRQR

SEQ ID NO: 48209 - protein, 10 aa, Homo Sapiens
ELAYLERRER

SEQ ID NO: 48210 - protein, 10 aa, Homo Sapiens
ELISKAQSNR

SEQ ID NO: 48211 - protein, 10 aa, Homo Sapiens
ELMAGHLRNR

SEQ ID NO: 48212 - protein, 10 aa, Homo Sapiens
ELMDKPLTFR

SEQ ID NO: 48213 - protein, 10 aa, Homo Sapiens
ELMDLGKVRR

SEQ ID NO: 48214 - protein, 10 aa, Homo Sapiens
ELNVDSLITR

SEQ ID NO: 48215 - protein, 10 aa, Homo Sapiens
ELQAFAHHGR

SEQ ID NO: 48216 - protein, 10 aa, Homo Sapiens
ELQPGYIRSR

SEQ ID NO: 48217 - protein, 10 aa, Homo Sapiens
ELRERPFYGR

SEQ ID NO: 48218 - protein, 10 aa, Homo Sapiens
EMAIPFFTGR

SEQ ID NO: 48219 - protein, 10 aa, Homo Sapiens
EMFVGVGASR

SEQ ID NO: 48220 - protein, 10 aa, Homo Sapiens
EMRGPVPSSR

SEQ ID NO: 48221 - protein, 10 aa, Homo Sapiens
EMRNAQSIGR

SEQ ID NO: 48222 - protein, 10 aa, Homo Sapiens
ENNRPLLTRF

SEQ ID NO: 48223 - protein, 10 aa, Homo Sapiens
ENTRPKFLSR

SEQ ID NO: 48224 - protein, 10 aa, Homo Sapiens
ESFGPQPISR

SEQ ID NO: 48225 - protein, 10 aa, Homo Sapiens
ESFPGSFRGR

SEQ ID NO: 48226 - protein, 10 aa, Homo Sapiens
ESIGRVLAQR

SEQ ID NO: 48227 - protein, 10 aa, Homo Sapiens
ESLDPVIQCR

SEQ ID NO: 48228 - protein, 10 aa, Homo Sapiens
ESLKEIQRAR

SEQ ID NO: 48229 - protein, 10 aa, Homo Sapiens
ESLNFLIGRL

SEQ ID NO: 48230 - protein, 10 aa, Homo Sapiens
ESLPANQQPR

SEQ ID NO: 48231 - protein, 10 aa, Homo Sapiens
ESLPDQLVNR

SEQ ID NO: 48232 - protein, 10 aa, Homo Sapiens
ESLQQPLINR

SEQ ID NO: 48233 - protein, 10 aa, Homo Sapiens
ESLTALLKNR

SEQ ID NO: 48234 - protein, 10 aa, Homo Sapiens
ESMKRQIVSR

SEQ ID NO: 48235 - protein, 10 aa, Homo Sapiens
ESQERIKAER

SEQ ID NO: 48236 - protein, 10 aa, Homo Sapiens
ESRDMDLNYR

SEQ ID NO: 48237 - protein, 10 aa, Homo Sapiens
ESRPGEWLVR

SEQ ID NO: 48238 - protein, 10 aa, Homo Sapiens
ETAGRYITYR

SEQ ID NO: 48239 - protein, 10 aa, Homo Sapiens
ETALIDRTGR

SEQ ID NO: 48240 - protein, 10 aa, Homo Sapiens
ETASNEVVYR

SEQ ID NO: 48241 - protein, 10 aa, Homo Sapiens
ETFDFQAMGR

SEQ ID NO: 48242 - protein, 10 aa, Homo Sapiens
ETFEHPNVVR

SEQ ID NO: 48243 - protein, 10 aa, Homo Sapiens
ETHGNLMTER

SEQ ID NO: 48244 - protein, 10 aa, Homo Sapiens
ETHSHFLARL

SEQ ID NO: 48245 - protein, 10 aa, Homo Sapiens
ETIGKKFEKR

SEQ ID NO: 48246 - protein, 10 aa, Homo Sapiens
ETIHHLKNLR

SEQ ID NO: 48247 - protein, 10 aa, Homo Sapiens
ETIKQENTRL

SEQ ID NO: 48248 - protein, 10 aa, Homo Sapiens
ETIKSLLIRR

SEQ ID NO: 48249 - protein, 10 aa, Homo Sapiens
ETKGQDIFQR

SEQ ID NO: 48250 - protein, 10 aa, Homo Sapiens
ETLETIINRL

SEQ ID NO: 48251 - protein, 10 aa, Homo Sapiens
ETLFRMGVAR

SEQ ID NO: 48252 - protein, 10 aa, Homo Sapiens
ETLGPKPAAR

SEQ ID NO: 48253 - protein, 10 aa, Homo Sapiens
ETLIPHYSGR

SEQ ID NO: 48254 - protein, 10 aa, Homo Sapiens
ETLKHSGIGR

SEQ ID NO: 48255 - protein, 10 aa, Homo Sapiens
ETLPPFPTRL

SEQ ID NO: 48256 - protein, 10 aa, Homo Sapiens
ETLPPVGVNR

SEQ ID NO: 48257 - protein, 10 aa, Homo Sapiens
ETLTRPFSGR

SEQ ID NO: 48258 - protein, 10 aa, Homo Sapiens
ETNMYEGVGR

SEQ ID NO: 48259 - protein, 10 aa, Homo Sapiens
ETPGHTPSLR

SEQ ID NO: 48260 - protein, 10 aa, Homo Sapiens
ETPTFAKVQR

SEQ ID NO: 48261 - protein, 10 aa, Homo Sapiens
ETQANNLICR

SEQ ID NO: 48262 - protein, 10 aa, Homo Sapiens
ETQPGRLLGR

SEQ ID NO: 48263 - protein, 10 aa, Homo Sapiens
ETRDGQVLGR

SEQ ID NO: 48264 - protein, 10 aa, Homo Sapiens
ETRPDYCMKR

SEQ ID NO: 48265 - protein, 10 aa, Homo Sapiens
ETVGTGIMGR

SEQ ID NO: 48266 - protein, 10 aa, Homo Sapiens
EVAAMENVHR

SEQ ID NO: 48267 - protein, 10 aa, Homo Sapiens
EVAERLGVTR

SEQ ID NO: 48268 - protein, 10 aa, Homo Sapiens
EVAPPASGTR

SEQ ID NO: 48269 - protein, 10 aa, Homo Sapiens
EVAPPEYHRK

SEQ ID NO: 48270 - protein, 10 aa, Homo Sapiens
EVAQLIQGGR

SEQ ID NO: 48271 - protein, 10 aa, Homo Sapiens
EVEPGVHLGR

SEQ ID NO: 48272 - protein, 10 aa, Homo Sapiens
EVFNKFFKER

SEQ ID NO: 48273 - protein, 10 aa, Homo Sapiens
EVGEKLFHAR

SEQ ID NO: 48274 - protein, 10 aa, Homo Sapiens
EVGKVIQQGR

SEQ ID NO: 48275 - protein, 10 aa, Homo Sapiens
EVIKPWITKR

SEQ ID NO: 48276 - protein, 10 aa, Homo Sapiens
EVKDHKFIAR

SEQ ID NO: 48277 - protein, 10 aa, Homo Sapiens
EVKETWHERL

SEQ ID NO: 48278 - protein, 10 aa, Homo Sapiens
EVKKFVKIGR

SEQ ID NO: 48279 - protein, 10 aa, Homo Sapiens
EVKNYDAALR

SEQ ID NO: 48280 - protein, 10 aa, Homo Sapiens
EVKPFITNPR

SEQ ID NO: 48281 - protein, 10 aa, Homo Sapiens
EVKQELAASR

SEQ ID NO: 48282 - protein, 10 aa, Homo Sapiens
EVKRPGESLR

SEQ ID NO: 48283 - protein, 10 aa, Homo Sapiens
EVLAEFERRK

SEQ ID NO: 48284 - protein, 10 aa, Homo Sapiens
EVLAGPLAQR

SEQ ID NO: 48285 - protein, 10 aa, Homo Sapiens
EVLDPTAANR

SEQ ID NO: 48286 - protein, 10 aa, Homo Sapiens
EVLLRAGVSR

SEQ ID NO: 48287 - protein, 10 aa, Homo Sapiens
EVLPSPRGQR

SEQ ID NO: 48288 - protein, 10 aa, Homo Sapiens
EVLSKALSQR

SEQ ID NO: 48289 - protein, 10 aa, Homo Sapiens
EVLSQKKMHR

SEQ ID NO: 48290 - protein, 10 aa, Homo Sapiens
EVLSQKRMYR

SEQ ID NO: 48291 - protein, 10 aa, Homo Sapiens
EVLYAPRRLR

SEQ ID NO: 48292 - protein, 10 aa, Homo Sapiens
EVLYNGFTGR

SEQ ID NO: 48293 - protein, 10 aa, Homo Sapiens
EVMQRMEVQR

SEQ ID NO: 48294 - protein, 10 aa, Homo Sapiens
EVNERHQILR

SEQ ID NO: 48295 - protein, 10 aa, Homo Sapiens
EVNQPKFNQR

SEQ ID NO: 48296 - protein, 10 aa, Homo Sapiens
EVQDLHLAQR

SEQ ID NO: 48297 - protein, 10 aa, Homo Sapiens
EVQEQYTERL

SEQ ID NO: 48298 - protein, 10 aa, Homo Sapiens
EVQGDRMHLR

SEQ ID NO: 48299 - protein, 10 aa, Homo Sapiens
EVQRKLGHVR

SEQ ID NO: 48300 - protein, 10 aa, Homo Sapiens
EVQRQLAIQR

SEQ ID NO: 48301 - protein, 10 aa, Homo Sapiens
EVQSQPPRVR

SEQ ID NO: 48302 - protein, 10 aa, Homo Sapiens
EVREIPPQSR

SEQ ID NO: 48303 - protein, 10 aa, Homo Sapiens
EVRGLCIKSR

SEQ ID NO: 48304 - protein, 10 aa, Homo Sapiens
EVRNLRKINR

SEQ ID NO: 48305 - protein, 10 aa, Homo Sapiens
EVRQPPPRVR

SEQ ID NO: 48306 - protein, 10 aa, Homo Sapiens
EVRTGGMAFH

SEQ ID NO: 48307 - protein, 10 aa, Homo Sapiens
EVRTHYDPPR

SEQ ID NO: 48308 - protein, 10 aa, Homo Sapiens
EVTPAMQIPR

SEQ ID NO: 48309 - protein, 10 aa, Homo Sapiens
EVVTGVIGQR

SEQ ID NO: 48310 - protein, 10 aa, Homo Sapiens
EVYDGPKNVR

SEQ ID NO: 48311 - protein, 10 aa, Homo Sapiens
EVYDQLFKSR

SEQ ID NO: 48312 - protein, 10 aa, Homo Sapiens
EWIEPPKRER

SEQ ID NO: 48313 - protein, 10 aa, Homo Sapiens
EYAADIFYSR

SEQ ID NO: 48314 - protein, 10 aa, Homo Sapiens
EYAEFQYRRR

SEQ ID NO: 48315 - protein, 10 aa, Homo Sapiens
EYAERPEVAR

SEQ ID NO: 48316 - protein, 10 aa, Homo Sapiens
EYAKLLAKRM

SEQ ID NO: 48317 - protein, 10 aa, Homo Sapiens
EYAKVDLAKR

SEQ ID NO: 48318 - protein, 10 aa, Homo Sapiens
EYAPLGTVYR

SEQ ID NO: 48319 - protein, 10 aa, Homo Sapiens
EYDEKLARFR

SEQ ID NO: 48320 - protein, 10 aa, Homo Sapiens
EYDPALSQPR

SEQ ID NO: 48321 - protein, 10 aa, Homo Sapiens
EYEDKQKVLR

SEQ ID NO: 48322 - protein, 10 aa, Homo Sapiens
EYEEFKELTR

SEQ ID NO: 48323 - protein, 10 aa, Homo Sapiens
EYFPTKNRQR

SEQ ID NO: 48324 - protein, 10 aa, Homo Sapiens
EYFSDLPPRL

SEQ ID NO: 48325 - protein, 10 aa, Homo Sapiens
EYFSPVGYNR

SEQ ID NO: 48326 - protein, 10 aa, Homo Sapiens
EYFTLQIRGR

SEQ ID NO: 48327 - protein, 10 aa, Homo Sapiens
EYIDFEKIRK

SEQ ID NO: 48328 - protein, 10 aa, Homo Sapiens
EYIDGALSGH

SEQ ID NO: 48329 - protein, 10 aa, Homo Sapiens
EYIDNRSSQR

SEQ ID NO: 48330 - protein, 10 aa, Homo Sapiens
EYIEENKYSR

SEQ ID NO: 48331 - protein, 10 aa, Homo Sapiens
EYIEEVRAKK

SEQ ID NO: 48332 - protein, 10 aa, Homo Sapiens
EYIHDFNRRH

SEQ ID NO: 48333 - protein, 10 aa, Homo Sapiens
EYIIGLLQQR

SEQ ID NO: 48334 - protein, 10 aa, Homo Sapiens
EYIKPRLRFK

SEQ ID NO: 48335 - protein, 10 aa, Homo Sapiens
EYILPGSRER

SEQ ID NO: 48336 - protein, 10 aa, Homo Sapiens
EYINQIAASR

SEQ ID NO: 48337 - protein, 10 aa, Homo Sapiens
EYITKLQQER

SEQ ID NO: 48338 - protein, 10 aa, Homo Sapiens
EYKDPGKMIR

SEQ ID NO: 48339 - protein, 10 aa, Homo Sapiens
EYKEPESTLR

SEQ ID NO: 48340 - protein, 10 aa, Homo Sapiens
EYKKEQAINR

SEQ ID NO: 48341 - protein, 10 aa, Homo Sapiens
EYLDSMKKNK

SEQ ID NO: 48342 - protein, 10 aa, Homo Sapiens
EYLEKIKQRL

SEQ ID NO: 48343 - protein, 10 aa, Homo Sapiens
EYLIKTGSER

SEQ ID NO: 48344 - protein, 10 aa, Homo Sapiens
EYLILSDVQR

SEQ ID NO: 48345 - protein, 10 aa, Homo Sapiens
EYLKLGYVSR

SEQ ID NO: 48346 - protein, 10 aa, Homo Sapiens
EYLLTHPKNR

SEQ ID NO: 48347 - protein, 10 aa, Homo Sapiens
EYLNHVSKRL

SEQ ID NO: 48348 - protein, 10 aa, Homo Sapiens
EYLQGLEARL

SEQ ID NO: 48349 - protein, 10 aa, Homo Sapiens
EYLQIPPVSR

SEQ ID NO: 48350 - protein, 10 aa, Homo Sapiens
EYLQPNPASR

SEQ ID NO: 48351 - protein, 10 aa, Homo Sapiens
EYLSSLQPRL

SEQ ID NO: 48352 - protein, 10 aa, Homo Sapiens
EYLTSTACRR

SEQ ID NO: 48353 - protein, 10 aa, Homo Sapiens
EYMAPEVVNR

SEQ ID NO: 48354 - protein, 10 aa, Homo Sapiens
EYMDKNNVRR

SEQ ID NO: 48355 - protein, 10 aa, Homo Sapiens
EYMEKIKQRL

SEQ ID NO: 48356 - protein, 10 aa, Homo Sapiens
EYNEGLVKRL

SEQ ID NO: 48357 - protein, 10 aa, Homo Sapiens
EYNGKIPRFR

SEQ ID NO: 48358 - protein, 10 aa, Homo Sapiens
EYNNFIDVHR

SEQ ID NO: 48359 - protein, 10 aa, Homo Sapiens
EYNWATVGGR

SEQ ID NO: 48360 - protein, 10 aa, Homo Sapiens
EYQDLTFLTK

SEQ ID NO: 48361 - protein, 10 aa, Homo Sapiens
EYRDMRDGFR

SEQ ID NO: 48362 - protein, 10 aa, Homo Sapiens
EYRGEWKEGR

SEQ ID NO: 48363 - protein, 10 aa, Homo Sapiens
EYSEAIPILR

SEQ ID NO: 48364 - protein, 10 aa, Homo Sapiens
EYTGYAETYR

SEQ ID NO: 48365 - protein, 10 aa, Homo Sapiens
EYVDVVFANR

SEQ ID NO: 48366 - protein, 10 aa, Homo Sapiens
EYVEILGEQR

SEQ ID NO: 48367 - protein, 10 aa, Homo Sapiens
EYVGPRLSRR

SEQ ID NO: 48368 - protein, 10 aa, Homo Sapiens
EYVIESARQR

SEQ ID NO: 48369 - protein, 10 aa, Homo Sapiens
EYVPVKKDLR

SEQ ID NO: 48370 - protein, 10 aa, Homo Sapiens
FANLPNQVYR

SEQ ID NO: 48371 - protein, 10 aa, Homo Sapiens
FEINPLDETV

SEQ ID NO: 48372 - protein, 10 aa, Homo Sapiens
FPQGKPRQCG

SEQ ID NO: 48373 - protein, 10 aa, Homo Sapiens
FSKNVHSTRF

SEQ ID NO: 48374 - protein, 10 aa, Homo Sapiens
FTKFPTKTGR

SEQ ID NO: 48375 - protein, 10 aa, Homo Sapiens
FTSQRDNIFR

SEQ ID NO: 48376 - protein, 10 aa, Homo Sapiens
FYVGEIIGKR

SEQ ID NO: 48377 - protein, 10 aa, Homo Sapiens
HANGLTLVSR

SEQ ID NO: 48378 - protein, 10 aa, Homo Sapiens
HFKKPGLTGR

SEQ ID NO: 48379 - protein, 10 aa, Homo Sapiens
HNADQPLRVR

SEQ ID NO: 48380 - protein, 10 aa, Homo Sapiens
HNMDVPNIKR

SEQ ID NO: 48381 - protein, 10 aa, Homo Sapiens
HNYAAPPSTR

SEQ ID NO: 48382 - protein, 10 aa, Homo Sapiens
HSQDLSGRLR

SEQ ID NO: 48383 - protein, 10 aa, Homo Sapiens
HTFIITGRKR

SEQ ID NO: 48384 - protein, 10 aa, Homo Sapiens
HTIAPMGTRR

SEQ ID NO: 48385 - protein, 10 aa, Homo Sapiens
HTKAVNVVRF

SEQ ID NO: 48386 - protein, 10 aa, Homo Sapiens
HTKPSMLTQR

SEQ ID NO: 48387 - protein, 10 aa, Homo Sapiens
HTNDTIGSVR

SEQ ID NO: 48388 - protein, 10 aa, Homo Sapiens
HTRTPPIIHR

SEQ ID NO: 48389 - protein, 10 aa, Homo Sapiens
HVKDVATVCR

SEQ ID NO: 48390 - protein, 10 aa, Homo Sapiens
HVKEQLETLR

SEQ ID NO: 48391 - protein, 10 aa, Homo Sapiens
HVYDGKFLAR

SEQ ID NO: 48392 - protein, 10 aa, Homo Sapiens
HYIQLGTVYR

SEQ ID NO: 48393 - protein, 10 aa, Homo Sapiens
IARDRALEGR

SEQ ID NO: 48394 - protein, 10 aa, Homo Sapiens
IDISDIAEKR

SEQ ID NO: 48395 - protein, 10 aa, Homo Sapiens
IFKKHSGTLR

SEQ ID NO: 48396 - protein, 10 aa, Homo Sapiens
ITNNIDPVGR

SEQ ID NO: 48397 - protein, 10 aa, Homo Sapiens
LAQGDSLAAR

SEQ ID NO: 48398 - protein, 10 aa, Homo Sapiens
LDLLSQSQRR

SEQ ID NO: 48399 - protein, 10 aa, Homo Sapiens
LYISEGLHPR

SEQ ID NO: 48400 - protein, 10 aa, Homo Sapiens
LYQEVFGRLR

SEQ ID NO: 48401 - protein, 10 aa, Homo Sapiens
MAAAVPKRMR

SEQ ID NO: 48402 - protein, 10 aa, Homo Sapiens
MFKGKGIEER

SEQ ID NO: 48403 - protein, 10 aa, Homo Sapiens
MFKTANKVTR

SEQ ID NO: 48404 - protein, 10 aa, Homo Sapiens
MFMEPAKRMK

SEQ ID NO: 48405 - protein, 10 aa, Homo Sapiens
MFRIEGLAPK

SEQ ID NO: 48406 - protein, 10 aa, Homo Sapiens
MNYEGPGMAR

SEQ ID NO: 48407 - protein, 10 aa, Homo Sapiens
MPLTPNPVGR

SEQ ID NO: 48408 - protein, 10 aa, Homo Sapiens
MTFTRPANHR

SEQ ID NO: 48409 - protein, 10 aa, Homo Sapiens
MTHATKAIYR

SEQ ID NO: 48410 - protein, 10 aa, Homo Sapiens
MTKDNNLLGR

SEQ ID NO: 48411 - protein, 10 aa, Homo Sapiens
MTKSGYQPPR

SEQ ID NO: 48412 - protein, 10 aa, Homo Sapiens
MTQDAQNALR

SEQ ID NO: 48413 - protein, 10 aa, Homo Sapiens
MVQGPVITTR

SEQ ID NO: 48414 - protein, 10 aa, Homo Sapiens
MVQPINLIFR

SEQ ID NO: 48415 - protein, 10 aa, Homo Sapiens
MYRLPNVHGR

SEQ ID NO: 48416 - protein, 10 aa, Homo Sapiens
MYYNGIGVKR

SEQ ID NO: 48417 - protein, 10 aa, Homo Sapiens
NALNVPLHNR

SEQ ID NO: 48418 - protein, 10 aa, Homo Sapiens
NFKSPVKTIR

SEQ ID NO: 48419 - protein, 10 aa, Homo Sapiens
NFRGSLNTYR

SEQ ID NO: 48420 - protein, 10 aa, Homo Sapiens
NSADKIHITR

SEQ ID NO: 48421 - protein, 10 aa, Homo Sapiens
NSLLRENSFR

SEQ ID NO: 48422 - protein, 10 aa, Homo Sapiens
NTQEMPWNVR

SEQ ID NO: 48423 - protein, 10 aa, Homo Sapiens
NTSNMPVAAR

SEQ ID NO: 48424 - protein, 10 aa, Homo Sapiens
NVKDKPTVER

SEQ ID NO: 48425 - protein, 10 aa, Homo Sapiens
NVKEKIYAVR

SEQ ID NO: 48426 - protein, 10 aa, Homo Sapiens
NYIEFTRILK

SEQ ID NO: 48427 - protein, 10 aa, Homo Sapiens
NYIEREGKCR

SEQ ID NO: 48428 - protein, 10 aa, Homo Sapiens
NYLDFHRCQK

SEQ ID NO: 48429 - protein, 10 aa, Homo Sapiens
NYTDRIQVLR

SEQ ID NO: 48430 - protein, 10 aa, Homo Sapiens
NYYNGCIFHR

SEQ ID NO: 48431 - protein, 10 aa, Homo Sapiens
QLQEKNHTLQ

SEQ ID NO: 48432 - protein, 10 aa, Homo Sapiens
QYGPQGNYSR

SEQ ID NO: 48433 - protein, 10 aa, Homo Sapiens
QYIRPVFVSR

SEQ ID NO: 48434 - protein, 10 aa, Homo Sapiens
QYKFPVVITR

SEQ ID NO: 48435 - protein, 10 aa, Homo Sapiens
QYNPEPPPPR

SEQ ID NO: 48436 - protein, 10 aa, Homo Sapiens
RYRPGTVALR

SEQ ID NO: 48437 - protein, 10 aa, Homo Sapiens
SAASGWPSAR

SEQ ID NO: 48438 - protein, 10 aa, Homo Sapiens
SFFGERRIPR

SEQ ID NO: 48439 - protein, 10 aa, Homo Sapiens
SFRYNGLIHR

SEQ ID NO: 48440 - protein, 10 aa, Homo Sapiens
SSQQFSGIGR

SEQ ID NO: 48441 - protein, 10 aa, Homo Sapiens
STGDVNVEMN

SEQ ID NO: 48442 - protein, 10 aa, Homo Sapiens
STKNIHFSRL

SEQ ID NO: 48443 - protein, 10 aa, Homo Sapiens
STKPGSYIFR

SEQ ID NO: 48444 - protein, 10 aa, Homo Sapiens
STTGHCVHMR

SEQ ID NO: 48445 - protein, 10 aa, Homo Sapiens
STYYGSFVTR

SEQ ID NO: 48446 - protein, 10 aa, Homo Sapiens
SVEYIHRIGR

SEQ ID NO: 48447 - protein, 10 aa, Homo Sapiens
SVLEATRVNR

SEQ ID NO: 48448 - protein, 10 aa, Homo Sapiens
SVSNGWTVYR

SEQ ID NO: 48449 - protein, 10 aa, Homo Sapiens
SYIDIEARTR

SEQ ID NO: 48450 - protein, 10 aa, Homo Sapiens
SYQEQIIVGR

SEQ ID NO: 48451 - protein, 10 aa, Homo Sapiens
SYSSDVIQHR

SEQ ID NO: 48452 - protein, 10 aa, Homo Sapiens
TAYGEFLSRL

SEQ ID NO: 48453 - protein, 10 aa, Homo Sapiens
TFEVLRKVGK

SEQ ID NO: 48454 - protein, 10 aa, Homo Sapiens
TFKRPEGMHR

SEQ ID NO: 48455 - protein, 10 aa, Homo Sapiens
TFRNPDDVFR

SEQ ID NO: 48456 - protein, 10 aa, Homo Sapiens
TFRSPHGQTR

SEQ ID NO: 48457 - protein, 10 aa, Homo Sapiens
TFTVGLVFLK

SEQ ID NO: 48458 - protein, 10 aa, Homo Sapiens
TLLESEREAR

SEQ ID NO: 48459 - protein, 10 aa, Homo Sapiens
TLREYKVVGR

SEQ ID NO: 48460 - protein, 10 aa, Homo Sapiens
TLRKPPAVGR

SEQ ID NO: 48461 - protein, 10 aa, Homo Sapiens
TMLAYSLTYR

SEQ ID NO: 48462 - protein, 10 aa, Homo Sapiens
TTLDESLTNR

SEQ ID NO: 48463 - protein, 10 aa, Homo Sapiens
TTLEHQKTFR

SEQ ID NO: 48464 - protein, 10 aa, Homo Sapiens
TVKATGPALR

SEQ ID NO: 48465 - protein, 10 aa, Homo Sapiens
TVNTSLNVYR

SEQ ID NO: 48466 - protein, 10 aa, Homo Sapiens
TVQKETIHPR

SEQ ID NO: 48467 - protein, 10 aa, Homo Sapiens
TVQQLEGRWR

SEQ ID NO: 48468 - protein, 10 aa, Homo Sapiens
TYAAFVQTHR

SEQ ID NO: 48469 - protein, 10 aa, Homo Sapiens
TYFDLPQSSR

SEQ ID NO: 48470 - protein, 10 aa, Homo Sapiens
TYFDSEVVPR

SEQ ID NO: 48471 - protein, 10 aa, Homo Sapiens
TYLDIPLVIR

SEQ ID NO: 48472 - protein, 10 aa, Homo Sapiens
TYLRPPHTSR

SEQ ID NO: 48473 - protein, 10 aa, Homo Sapiens
TYMDPTGKTR

SEQ ID NO: 48474 - protein, 10 aa, Homo Sapiens
TYRNSMFHNR

SEQ ID NO: 48475 - protein, 10 aa, Homo Sapiens
TYRVFKTVNR

SEQ ID NO: 48476 - protein, 10 aa, Homo Sapiens
TYYGSFVTRA

SEQ ID NO: 48477 - protein, 10 aa, Homo Sapiens
VFGKWHSVPR

SEQ ID NO: 48478 - protein, 10 aa, Homo Sapiens
VGKDPGLAGR

SEQ ID NO: 48479 - protein, 10 aa, Homo Sapiens
VLYDRQGIGR

SEQ ID NO: 48480 - protein, 10 aa, Homo Sapiens
YAQPPLGRLR

SEQ ID NO: 48481 - protein, 10 aa, Homo Sapiens
YNHSGFGQGR

SEQ ID NO: 48482 - protein, 10 aa, Homo Sapiens
YSFHRGNSQR

SEQ ID NO: 48483 - protein, 10 aa, Homo Sapiens
YTAMPLPIGR

SEQ ID NO: 48484 - protein, 10 aa, Homo Sapiens
YTLLITGLCR

SEQ ID NO: 48485 - protein, 10 aa, Homo Sapiens
YVSPRAPFYR

SEQ ID NO: 48486 - protein, 10 aa, Homo Sapiens
YYKFSGFTQK

SEQ ID NO: 48487 - protein, 10 aa, Homo Sapiens
YYLDPSSQKR

SEQ ID NO: 48488 - protein, 10 aa, Homo Sapiens
YYLPYYKRER

SEQ ID NO: 48489 - protein, 10 aa, Homo Sapiens
YYMGDLIQHR

SEQ ID NO: 48490 - protein, 10 aa, Homo Sapiens
YYQDTPKQIR

SEQ ID NO: 48491 - protein, 10 aa, Homo Sapiens
YYTPITPHLR

SEQ ID NO: 48492 - protein, 11 aa, Homo Sapiens
AFFVRKKSSLR

SEQ ID NO: 48493 - protein, 11 aa, Homo Sapiens
AVREVLHGNQR

SEQ ID NO: 48494 - protein, 11 aa, Homo Sapiens
AVVPGTLLLFR

SEQ ID NO: 48495 - protein, 11 aa, Homo Sapiens
AYIERKNYIHR

SEQ ID NO: 48496 - protein, 11 aa, Homo Sapiens
AYIHEKGMIHR

SEQ ID NO: 48497 - protein, 11 aa, Homo Sapiens
AYKDPEKNWNR

SEQ ID NO: 48498 - protein, 11 aa, Homo Sapiens
AYKQVDPSITR

SEQ ID NO: 48499 - protein, 11 aa, Homo Sapiens
AYVPFGAGRHR

SEQ ID NO: 48500 - protein, 11 aa, Homo Sapiens
AYVSFKPCMTR

SEQ ID NO: 48501 - protein, 11 aa, Homo Sapiens
CPKGAETLVTR

SEQ ID NO: 48502 - protein, 11 aa, Homo Sapiens
CTKAGKAIVSR

SEQ ID NO: 48503 - protein, 11 aa, Homo Sapiens
CVKSGLIFHER

SEQ ID NO: 48504 - protein, 11 aa, Homo Sapiens
CVVMRDPASKR

SEQ ID NO: 48505 - protein, 11 aa, Homo Sapiens
DALRVEDMMKR

SEQ ID NO: 48506 - protein, 11 aa, Homo Sapiens
DANGNSFATRI

SEQ ID NO: 48507 - protein, 11 aa, Homo Sapiens
DAQTLDAIRHR

SEQ ID NO: 48508 - protein, 11 aa, Homo Sapiens
DATSRNITEAR

SEQ ID NO: 48509 - protein, 11 aa, Homo Sapiens
DFAGEEVRVTK

SEQ ID NO: 48510 - protein, 11 aa, Homo Sapiens
DFAPEVAWVTR

SEQ ID NO: 48511 - protein, 11 aa, Homo Sapiens
DFFPGSDRFAR

SEQ ID NO: 48512 - protein, 11 aa, Homo Sapiens
DFIQEEFQHLK

SEQ ID NO: 48513 - protein, 11 aa, Homo Sapiens
DFKDPPTAKYR

SEQ ID NO: 48514 - protein, 11 aa, Homo Sapiens
DFLDRNTPVFR

SEQ ID NO: 48515 - protein, 11 aa, Homo Sapiens
DFLHNKGIAHR

SEQ ID NO: 48516 - protein, 11 aa, Homo Sapiens
DFRNPGPGRHR

SEQ ID NO: 48517 - protein, 11 aa, Homo Sapiens
DFTVADTRRYR

SEQ ID NO: 48518 - protein, 11 aa, Homo Sapiens
DIEERPKELVR

SEQ ID NO: 48519 - protein, 11 aa, Homo Sapiens
DIFQNLSKRQR

SEQ ID NO: 48520 - protein, 11 aa, Homo Sapiens
DIKASQILASR

SEQ ID NO: 48521 - protein, 11 aa, Homo Sapiens
DIKPLTSFRQR

SEQ ID NO: 48522 - protein, 11 aa, Homo Sapiens
DIKPSNIFISR

SEQ ID NO: 48523 - protein, 11 aa, Homo Sapiens
DIKSSETGAFR

SEQ ID NO: 48524 - protein, 11 aa, Homo Sapiens
DIRPEIHENYR

SEQ ID NO: 48525 - protein, 11 aa, Homo Sapiens
DLKPENILCEH

SEQ ID NO: 48526 - protein, 11 aa, Homo Sapiens
DMKPKHLLSGK

SEQ ID NO: 48527 - protein, 11 aa, Homo Sapiens
DMKRRIHLELR

SEQ ID NO: 48528 - protein, 11 aa, Homo Sapiens
DSKPQDRHFVR

SEQ ID NO: 48529 - protein, 11 aa, Homo Sapiens
DSLGQDLRRLR

SEQ ID NO: 48530 - protein, 11 aa, Homo Sapiens
DSMASGTLHLR

SEQ ID NO: 48531 - protein, 11 aa, Homo Sapiens
DSMLVDPKHHR

SEQ ID NO: 48532 - protein, 11 aa, Homo Sapiens
DSRFPNQNQTR

SEQ ID NO: 48533 - protein, 11 aa, Homo Sapiens
DSRGQEAISKR

SEQ ID NO: 48534 - protein, 11 aa, Homo Sapiens
DTKELEKMTNR

SEQ ID NO: 48535 - protein, 11 aa, Homo Sapiens
DTKGHSLSVQR

SEQ ID NO: 48536 - protein, 11 aa, Homo Sapiens
DTRRESLFSAR

SEQ ID NO: 48537 - protein, 11 aa, Homo Sapiens
DVKDPVSIEER

SEQ ID NO: 48538 - protein, 11 aa, Homo Sapiens
DVKTTDGYLLR

SEQ ID NO: 48539 - protein, 11 aa, Homo Sapiens
DVQGDDKRYFR

SEQ ID NO: 48540 - protein, 11 aa, Homo Sapiens
DWVPYINGKFK

SEQ ID NO: 48541 - protein, 11 aa, Homo Sapiens
DYCEHRDYVMR

SEQ ID NO: 48542 - protein, 11 aa, Homo Sapiens
DYCHSKGIMHR

SEQ ID NO: 48543 - protein, 11 aa, Homo Sapiens
DYCHSMGIMHR

SEQ ID NO: 48544 - protein, 11 aa, Homo Sapiens
DYFAKREQWKK

SEQ ID NO: 48545 - protein, 11 aa, Homo Sapiens
DYFSPDNLKER

SEQ ID NO: 48546 - protein, 11 aa, Homo Sapiens
DYIDSPSLKDR

SEQ ID NO: 48547 - protein, 11 aa, Homo Sapiens
DYIHHMGYVHR

SEQ ID NO: 48548 - protein, 11 aa, Homo Sapiens
DYIHSKKLIHR

SEQ ID NO: 48549 - protein, 11 aa, Homo Sapiens
DYINGDSKYMR

SEQ ID NO: 48550 - protein, 11 aa, Homo Sapiens
DYISRAESQSR

SEQ ID NO: 48551 - protein, 11 aa, Homo Sapiens
DYIYHGTVKLR

SEQ ID NO: 48552 - protein, 11 aa, Homo Sapiens
DYKDQLKTGER

SEQ ID NO: 48553 - protein, 11 aa, Homo Sapiens
DYKSALRFHKR

SEQ ID NO: 48554 - protein, 11 aa, Homo Sapiens
DYKVASAEYHR

SEQ ID NO: 48555 - protein, 11 aa, Homo Sapiens
DYLEFTDARGR

SEQ ID NO: 48556 - protein, 11 aa, Homo Sapiens
DYLHAKNIIHR

SEQ ID NO: 48557 - protein, 11 aa, Homo Sapiens
DYLHAKSIIHR

SEQ ID NO: 48558 - protein, 11 aa, Homo Sapiens
DYLHRHGIIHR

SEQ ID NO: 48559 - protein, 11 aa, Homo Sapiens
DYLHSEKKIHR

SEQ ID NO: 48560 - protein, 11 aa, Homo Sapiens
DYLHSGKIVYR

SEQ ID NO: 48561 - protein, 11 aa, Homo Sapiens
DYLNAESRVNR

SEQ ID NO: 48562 - protein, 11 aa, Homo Sapiens
DYLPPEMIEGR

SEQ ID NO: 48563 - protein, 11 aa, Homo Sapiens
DYMTPEQRRSR

SEQ ID NO: 48564 - protein, 11 aa, Homo Sapiens
DYRDPPDGSGR

SEQ ID NO: 48565 - protein, 11 aa, Homo Sapiens
DYRYFDPKMLR

SEQ ID NO: 48566 - protein, 11 aa, Homo Sapiens
DYVPSKSKIGK

SEQ ID NO: 48567 - protein, 11 aa, Homo Sapiens
DYVPSTTKTPR

SEQ ID NO: 48568 - protein, 11 aa, Homo Sapiens
DYVPYVPLRQR

SEQ ID NO: 48569 - protein, 11 aa, Homo Sapiens
DYYDSHNVNTR

SEQ ID NO: 48570 - protein, 11 aa, Homo Sapiens
DYYEESYFTTR

SEQ ID NO: 48571 - protein, 11 aa, Homo Sapiens
EAAAQNVYCLR

SEQ ID NO: 48572 - protein, 11 aa, Homo Sapiens
EAAFATKDRLR

SEQ ID NO: 48573 - protein, 11 aa, Homo Sapiens
EAANRNNDALR

SEQ ID NO: 48574 - protein, 11 aa, Homo Sapiens
EAASYLDQISR

SEQ ID NO: 48575 - protein, 11 aa, Homo Sapiens
EACGARVFVQR

SEQ ID NO: 48576 - protein, 11 aa, Homo Sapiens
EAFPRARLSER

SEQ ID NO: 48577 - protein, 11 aa, Homo Sapiens
EAIKKPLTQKR

SEQ ID NO: 48578 - protein, 11 aa, Homo Sapiens
EAIPILPAQQR

SEQ ID NO: 48579 - protein, 11 aa, Homo Sapiens
EAISSLDGKNR

SEQ ID NO: 48580 - protein, 11 aa, Homo Sapiens
EAKARAEIRAR

SEQ ID NO: 48581 - protein, 11 aa, Homo Sapiens
EAKGLDRINER

SEQ ID NO: 48582 - protein, 11 aa, Homo Sapiens
EAKPPTVTMPR

SEQ ID NO: 48583 - protein, 11 aa, Homo Sapiens
EAKQAFKELLK

SEQ ID NO: 48584 - protein, 11 aa, Homo Sapiens
EALAMGSRALR

SEQ ID NO: 48585 - protein, 11 aa, Homo Sapiens
EALGEQALRRR

SEQ ID NO: 48586 - protein, 11 aa, Homo Sapiens
EALHQKNIVHR

SEQ ID NO: 48587 - protein, 11 aa, Homo Sapiens
EALKLDGKNVK

SEQ ID NO: 48588 - protein, 11 aa, Homo Sapiens
EALPHVVPTLR

SEQ ID NO: 48589 - protein, 11 aa, Homo Sapiens
EALQKTRIELR

SEQ ID NO: 48590 - protein, 11 aa, Homo Sapiens
EALSSVIKELR

SEQ ID NO: 48591 - protein, 11 aa, Homo Sapiens
EALVGTLKAAK

SEQ ID NO: 48592 - protein, 11 aa, Homo Sapiens
EALYIADRKAR

SEQ ID NO: 48593 - protein, 11 aa, Homo Sapiens
EAMDQYSIALR

SEQ ID NO: 48594 - protein, 11 aa, Homo Sapiens
EAQDAGYRMYR

SEQ ID NO: 48595 - protein, 11 aa, Homo Sapiens
EAQGGDSILQR

SEQ ID NO: 48596 - protein, 11 aa, Homo Sapiens
EAQNLGNFIVR

SEQ ID NO: 48597 - protein, 11 aa, Homo Sapiens
EAQRLPGVSGR

SEQ ID NO: 48598 - protein, 11 aa, Homo Sapiens
EARDIPVLRPR

SEQ ID NO: 48599 - protein, 11 aa, Homo Sapiens
EARGLDRINER

SEQ ID NO: 48600 - protein, 11 aa, Homo Sapiens
EARPFRGSVGR

SEQ ID NO: 48601 - protein, 11 aa, Homo Sapiens
EARRTMTNALR

SEQ ID NO: 48602 - protein, 11 aa, Homo Sapiens
EAVAEKMLQYR

SEQ ID NO: 48603 - protein, 11 aa, Homo Sapiens
EAVKPTVGMKR

SEQ ID NO: 48604 - protein, 11 aa, Homo Sapiens
EAVLKEKRSLR

SEQ ID NO: 48605 - protein, 11 aa, Homo Sapiens
EAVTQSLLSSR

SEQ ID NO: 48606 - protein, 11 aa, Homo Sapiens
EFAKKQPWWRK

SEQ ID NO: 48607 - protein, 11 aa, Homo Sapiens
EFAPETGKREK

SEQ ID NO: 48608 - protein, 11 aa, Homo Sapiens
EFASIPANSSR

SEQ ID NO: 48609 - protein, 11 aa, Homo Sapiens
EFIIFNREKLR

SEQ ID NO: 48610 - protein, 11 aa, Homo Sapiens
EFKQKEECTIR

SEQ ID NO: 48611 - protein, 11 aa, Homo Sapiens
EFKTLEGVITR

SEQ ID NO: 48612 - protein, 11 aa, Homo Sapiens
EFLHANQVIHR

SEQ ID NO: 48613 - protein, 11 aa, Homo Sapiens
EFLHSNQVIHR

SEQ ID NO: 48614 - protein, 11 aa, Homo Sapiens
EFLKLDRERAK

SEQ ID NO: 48615 - protein, 11 aa, Homo Sapiens
EFLNRFEEAKR

SEQ ID NO: 48616 - protein, 11 aa, Homo Sapiens
EFLSTAPRSLR

SEQ ID NO: 48617 - protein, 11 aa, Homo Sapiens
EFMQRALQDLR

SEQ ID NO: 48618 - protein, 11 aa, Homo Sapiens
EFQDFTVPRKR

SEQ ID NO: 48619 - protein, 11 aa, Homo Sapiens
EFRDHKLIRTK

SEQ ID NO: 48620 - protein, 11 aa, Homo Sapiens
EFRDSSLPRSR

SEQ ID NO: 48621 - protein, 11 aa, Homo Sapiens
EFSEDKVRIPR

SEQ ID NO: 48622 - protein, 11 aa, Homo Sapiens
EFVDPSSLTAR

SEQ ID NO: 48623 - protein, 11 aa, Homo Sapiens
EFVGKLDERCR

SEQ ID NO: 48624 - protein, 11 aa, Homo Sapiens
EGAPPGSLALR

SEQ ID NO: 48625 - protein, 11 aa, Homo Sapiens
EGINISGNFYR

SEQ ID NO: 48626 - protein, 11 aa, Homo Sapiens
EGLPEGIPFRR

SEQ ID NO: 48627 - protein, 11 aa, Homo Sapiens
EGLPEGVPFRR

SEQ ID NO: 48628 - protein, 11 aa, Homo Sapiens
EIAIIPSKKLR

SEQ ID NO: 48629 - protein, 11 aa, Homo Sapiens
EIAPGIIRKYR

SEQ ID NO: 48630 - protein, 11 aa, Homo Sapiens
EIASFDKAKLK

SEQ ID NO: 48631 - protein, 11 aa, Homo Sapiens
EIEKFDKSKLK

SEQ ID NO: 48632 - protein, 11 aa, Homo Sapiens
EIIAPSPQRSR

SEQ ID NO: 48633 - protein, 11 aa, Homo Sapiens
EIIDKDSKTRR

SEQ ID NO: 48634 - protein, 11 aa, Homo Sapiens
EIIEKNFDYLR

SEQ ID NO: 48635 - protein, 11 aa, Homo Sapiens
EIKDFLLTARR

SEQ ID NO: 48636 - protein, 11 aa, Homo Sapiens
EIKDKDQLVLR

SEQ ID NO: 48637 - protein, 11 aa, Homo Sapiens
EIKEKFKVETR

SEQ ID NO: 48638 - protein, 11 aa, Homo Sapiens
EIKEKTGLSIR

SEQ ID NO: 48639 - protein, 11 aa, Homo Sapiens
EIKGTNGQVTR

SEQ ID NO: 48640 - protein, 11 aa, Homo Sapiens
EIKPDELAKKR

SEQ ID NO: 48641 - protein, 11 aa, Homo Sapiens
EILDLSNDYAR

SEQ ID NO: 48642 - protein, 11 aa, Homo Sapiens
EILDSQNLNSR

SEQ ID NO: 48643 - protein, 11 aa, Homo Sapiens
EILELAGNAAR

SEQ ID NO: 48644 - protein, 11 aa, Homo Sapiens
EILPDGLPSAR

SEQ ID NO: 48645 - protein, 11 aa, Homo Sapiens
EIMERDAERKR

SEQ ID NO: 48646 - protein, 11 aa, Homo Sapiens
EIMEVAKERSR

SEQ ID NO: 48647 - protein, 11 aa, Homo Sapiens
EIMNRKEPVKR

SEQ ID NO: 48648 - protein, 11 aa, Homo Sapiens
EIMRKDLNDAR

SEQ ID NO: 48649 - protein, 11 aa, Homo Sapiens
EIMSMGYERER

SEQ ID NO: 48650 - protein, 11 aa, Homo Sapiens
EINNRSAANIR

SEQ ID NO: 48651 - protein, 11 aa, Homo Sapiens
EIRDDHTLKIR

SEQ ID NO: 48652 - protein, 11 aa, Homo Sapiens
EIRDKKTGLGR

SEQ ID NO: 48653 - protein, 11 aa, Homo Sapiens
EIRNLTVKDFR

SEQ ID NO: 48654 - protein, 11 aa, Homo Sapiens
EIYEKDEKIQK

SEQ ID NO: 48655 - protein, 11 aa, Homo Sapiens
EIYSESHRVHR

SEQ ID NO: 48656 - protein, 11 aa, Homo Sapiens
ELGTACGKYYR

SEQ ID NO: 48657 - protein, 11 aa, Homo Sapiens
ELIDYKQKATR

SEQ ID NO: 48658 - protein, 11 aa, Homo Sapiens
ELKAPGISYQR

SEQ ID NO: 48659 - protein, 11 aa, Homo Sapiens
ELLHFLFGPLQ

SEQ ID NO: 48660 - protein, 11 aa, Homo Sapiens
ELLIRKLPFQR

SEQ ID NO: 48661 - protein, 11 aa, Homo Sapiens
ELLKKEKINIR

SEQ ID NO: 48662 - protein, 11 aa, Homo Sapiens
ELLLKSESQCR

SEQ ID NO: 48663 - protein, 11 aa, Homo Sapiens
ELLPKEKFVSR

SEQ ID NO: 48664 - protein, 11 aa, Homo Sapiens
ELNDKMKGFYR

SEQ ID NO: 48665 - protein, 11 aa, Homo Sapiens
ELQLLNTDYLR

SEQ ID NO: 48666 - protein, 11 aa, Homo Sapiens
ELREYNLEQQR

SEQ ID NO: 48667 - protein, 11 aa, Homo Sapiens
ELSSADEKRYR

SEQ ID NO: 48668 - protein, 11 aa, Homo Sapiens
ELYKRLKEFLK

SEQ ID NO: 48669 - protein, 11 aa, Homo Sapiens
EMATRAALQAR

SEQ ID NO: 48670 - protein, 11 aa, Homo Sapiens
EMIREGKIAGR

SEQ ID NO: 48671 - protein, 11 aa, Homo Sapiens
EMKKKINLELR

SEQ ID NO: 48672 - protein, 11 aa, Homo Sapiens
EMKRDLDSIFR

SEQ ID NO: 48673 - protein, 11 aa, Homo Sapiens
EMKTSQESLLR

SEQ ID NO: 48674 - protein, 11 aa, Homo Sapiens
EMLSSVALINR

SEQ ID NO: 48675 - protein, 11 aa, Homo Sapiens
EMQRVKGMTER

SEQ ID NO: 48676 - protein, 11 aa, Homo Sapiens
ENISDDVIVGR

SEQ ID NO: 48677 - protein, 11 aa, Homo Sapiens
ENKEESLLEKR

SEQ ID NO: 48678 - protein, 11 aa, Homo Sapiens
ENREAVTHIGR

SEQ ID NO: 48679 - protein, 11 aa, Homo Sapiens
ENRKPVSFRQR

SEQ ID NO: 48680 - protein, 11 aa, Homo Sapiens
ESDEGKLHVLR

SEQ ID NO: 48681 - protein, 11 aa, Homo Sapiens
ESFFGERRIPR

SEQ ID NO: 48682 - protein, 11 aa, Homo Sapiens
ESIPGGYNALR

SEQ ID NO: 48683 - protein, 11 aa, Homo Sapiens
ESISLAAIKNR

SEQ ID NO: 48684 - protein, 11 aa, Homo Sapiens
ESKAQECFQER

SEQ ID NO: 48685 - protein, 11 aa, Homo Sapiens
ESKDTSLETRR

SEQ ID NO: 48686 - protein, 11 aa, Homo Sapiens
ESKEFNAEVHR

SEQ ID NO: 48687 - protein, 11 aa, Homo Sapiens
ESKKFGGPGAR

SEQ ID NO: 48688 - protein, 11 aa, Homo Sapiens
ESKQAGQSVFR

SEQ ID NO: 48689 - protein, 11 aa, Homo Sapiens
ESLDFTDYASR

SEQ ID NO: 48690 - protein, 11 aa, Homo Sapiens
ESLGQSELASR

SEQ ID NO: 48691 - protein, 11 aa, Homo Sapiens
ESLPATHIRGK

SEQ ID NO: 48692 - protein, 11 aa, Homo Sapiens
ESLVAEGLATR

SEQ ID NO: 48693 - protein, 11 aa, Homo Sapiens
ESMKETLRIRR

SEQ ID NO: 48694 - protein, 11 aa, Homo Sapiens
ESMQRFHNRVR

SEQ ID NO: 48695 - protein, 11 aa, Homo Sapiens
ESQDLHGLVSR

SEQ ID NO: 48696 - protein, 11 aa, Homo Sapiens
ESRFQLGGSAR

SEQ ID NO: 48697 - protein, 11 aa, Homo Sapiens
ESRSSFSQHAR

SEQ ID NO: 48698 - protein, 11 aa, Homo Sapiens
ESSAGGSFTVR

SEQ ID NO: 48699 - protein, 11 aa, Homo Sapiens
ESVPPGTTISR

SEQ ID NO: 48700 - protein, 11 aa, Homo Sapiens
ETAGRTPKLAR

SEQ ID NO: 48701 - protein, 11 aa, Homo Sapiens
ETALPGAFKTR

SEQ ID NO: 48702 - protein, 11 aa, Homo Sapiens
ETATTPIFANR

SEQ ID NO: 48703 - protein, 11 aa, Homo Sapiens
ETDRRTLQMLR

SEQ ID NO: 48704 - protein, 11 aa, Homo Sapiens
ETEARPSIMKR

SEQ ID NO: 48705 - protein, 11 aa, Homo Sapiens
ETFGHFGSLGR

SEQ ID NO: 48706 - protein, 11 aa, Homo Sapiens
ETFQRPYQYLR

SEQ ID NO: 48707 - protein, 11 aa, Homo Sapiens
ETIGNELFNCR

SEQ ID NO: 48708 - protein, 11 aa, Homo Sapiens
ETIHADSVAKR

SEQ ID NO: 48709 - protein, 11 aa, Homo Sapiens
ETILGDIDRAR

SEQ ID NO: 48710 - protein, 11 aa, Homo Sapiens
ETIPLGDLQAR

SEQ ID NO: 48711 - protein, 11 aa, Homo Sapiens
ETISKAQAFER

SEQ ID NO: 48712 - protein, 11 aa, Homo Sapiens
ETISSKNIISR

SEQ ID NO: 48713 - protein, 11 aa, Homo Sapiens
ETKADSIIRQK

SEQ ID NO: 48714 - protein, 11 aa, Homo Sapiens
ETKDIKEIAKK

SEQ ID NO: 48715 - protein, 11 aa, Homo Sapiens
ETKDSGSFLLR

SEQ ID NO: 48716 - protein, 11 aa, Homo Sapiens
ETKKLLDIVAR

SEQ ID NO: 48717 - protein, 11 aa, Homo Sapiens
ETKSQFEKFVR

SEQ ID NO: 48718 - protein, 11 aa, Homo Sapiens
ETLAKEKGMNR

SEQ ID NO: 48719 - protein, 11 aa, Homo Sapiens
ETLEEAAMRSR

SEQ ID NO: 48720 - protein, 11 aa, Homo Sapiens
ETLGDKDHSIR

SEQ ID NO: 48721 - protein, 11 aa, Homo Sapiens
ETLLEISKRFR

SEQ ID NO: 48722 - protein, 11 aa, Homo Sapiens
ETLNSSVQSIR

SEQ ID NO: 48723 - protein, 11 aa, Homo Sapiens
ETLPDGTKRSR

SEQ ID NO: 48724 - protein, 11 aa, Homo Sapiens
ETLPEQLLAEK

SEQ ID NO: 48725 - protein, 11 aa, Homo Sapiens
ETLQKTSVLQR

SEQ ID NO: 48726 - protein, 11 aa, Homo Sapiens
ETLSRHIGVTR

SEQ ID NO: 48727 - protein, 11 aa, Homo Sapiens
ETNEIANANSR

SEQ ID NO: 48728 - protein, 11 aa, Homo Sapiens
ETPEMMEARCR

SEQ ID NO: 48729 - protein, 11 aa, Homo Sapiens
ETQSRTITVTR

SEQ ID NO: 48730 - protein, 11 aa, Homo Sapiens
ETQVKTWFQNR

SEQ ID NO: 48731 - protein, 11 aa, Homo Sapiens
ETRPEGSYFSK

SEQ ID NO: 48732 - protein, 11 aa, Homo Sapiens
ETVPKDLRHLR

SEQ ID NO: 48733 - protein, 11 aa, Homo Sapiens
ETVQKETIHPR

SEQ ID NO: 48734 - protein, 11 aa, Homo Sapiens
ETVSEEKRIYR

SEQ ID NO: 48735 - protein, 11 aa, Homo Sapiens
ETYLHRIGRSG

SEQ ID NO: 48736 - protein, 11 aa, Homo Sapiens
EVAKQALNRLR

SEQ ID NO: 48737 - protein, 11 aa, Homo Sapiens
EVAPPKAHEVR

SEQ ID NO: 48738 - protein, 11 aa, Homo Sapiens
EVAQREAETLR

SEQ ID NO: 48739 - protein, 11 aa, Homo Sapiens
EVAQVESLRYR

SEQ ID NO: 48740 - protein, 11 aa, Homo Sapiens
EVEPQGVIVTR

SEQ ID NO: 48741 - protein, 11 aa, Homo Sapiens
EVGPGPGGITR

SEQ ID NO: 48742 - protein, 11 aa, Homo Sapiens
EVGPRKGDFTR

SEQ ID NO: 48743 - protein, 11 aa, Homo Sapiens
EVHGEAQRVLR

SEQ ID NO: 48744 - protein, 11 aa, Homo Sapiens
EVIDQRLIEAR

SEQ ID NO: 48745 - protein, 11 aa, Homo Sapiens
EVIEGYEIACR

SEQ ID NO: 48746 - protein, 11 aa, Homo Sapiens
EVINFGDCLVR

SEQ ID NO: 48747 - protein, 11 aa, Homo Sapiens
EVIPYTPAMQR

SEQ ID NO: 48748 - protein, 11 aa, Homo Sapiens
EVISTPGVVAR

SEQ ID NO: 48749 - protein, 11 aa, Homo Sapiens
EVITEAEKIAK

SEQ ID NO: 48750 - protein, 11 aa, Homo Sapiens
EVKDRHLVAKR

SEQ ID NO: 48751 - protein, 11 aa, Homo Sapiens
EVKNIIDKASR

SEQ ID NO: 48752 - protein, 11 aa, Homo Sapiens
EVKPEVKISEK

SEQ ID NO: 48753 - protein, 11 aa, Homo Sapiens
EVKQVESGTLR

SEQ ID NO: 48754 - protein, 11 aa, Homo Sapiens
EVKRLKVTELR

SEQ ID NO: 48755 - protein, 11 aa, Homo Sapiens
EVLAEFERRKR

SEQ ID NO: 48756 - protein, 11 aa, Homo Sapiens
EVLDHKEFKAR

SEQ ID NO: 48757 - protein, 11 aa, Homo Sapiens
EVLEQSAQTLR

SEQ ID NO: 48758 - protein, 11 aa, Homo Sapiens
EVLERGGRFTR

SEQ ID NO: 48759 - protein, 11 aa, Homo Sapiens
EVLGRGGLAER

SEQ ID NO: 48760 - protein, 11 aa, Homo Sapiens
EVLHIGSAHNR

SEQ ID NO: 48761 - protein, 11 aa, Homo Sapiens
EVLNKHSLSGR

SEQ ID NO: 48762 - protein, 11 aa, Homo Sapiens
EVLPDRVATSR

SEQ ID NO: 48763 - protein, 11 aa, Homo Sapiens
EVLREGELEKR

SEQ ID NO: 48764 - protein, 11 aa, Homo Sapiens
EVLRHPRDWVR

SEQ ID NO: 48765 - protein, 11 aa, Homo Sapiens
EVLRLPKQQLR

SEQ ID NO: 48766 - protein, 11 aa, Homo Sapiens
EVLTDTRGLYR

SEQ ID NO: 48767 - protein, 11 aa, Homo Sapiens
EVLTPEYMGQR

SEQ ID NO: 48768 - protein, 11 aa, Homo Sapiens
EVMPGPIGLPR

SEQ ID NO: 48769 - protein, 11 aa, Homo Sapiens
EVMQWSQSLEK

SEQ ID NO: 48770 - protein, 11 aa, Homo Sapiens
EVMRQRGINMR

SEQ ID NO: 48771 - protein, 11 aa, Homo Sapiens
EVNGKLRMLMR

SEQ ID NO: 48772 - protein, 11 aa, Homo Sapiens
EVNLLVEEIHR

SEQ ID NO: 48773 - protein, 11 aa, Homo Sapiens
EVNRLTESTYR

SEQ ID NO: 48774 - protein, 11 aa, Homo Sapiens
EVPGSPIFVMR

SEQ ID NO: 48775 - protein, 11 aa, Homo Sapiens
EVQDRVMLTGR

SEQ ID NO: 48776 - protein, 11 aa, Homo Sapiens
EVQGSLALVSR

SEQ ID NO: 48777 - protein, 11 aa, Homo Sapiens
EVQKRKQLELR

SEQ ID NO: 48778 - protein, 11 aa, Homo Sapiens
EVQLKQHISSR

SEQ ID NO: 48779 - protein, 11 aa, Homo Sapiens
EVQQARDLQNR

SEQ ID NO: 48780 - protein, 11 aa, Homo Sapiens
EVQVLDDKNVR

SEQ ID NO: 48781 - protein, 11 aa, Homo Sapiens
EVRADTGGLGR

SEQ ID NO: 48782 - protein, 11 aa, Homo Sapiens
EVRAVGQGVLR

SEQ ID NO: 48783 - protein, 11 aa, Homo Sapiens
EVREPPFHLTR

SEQ ID NO: 48784 - protein, 11 aa, Homo Sapiens
EVRFGGKKTQR

SEQ ID NO: 48785 - protein, 11 aa, Homo Sapiens
EVRGSNGAFYK

SEQ ID NO: 48786 - protein, 11 aa, Homo Sapiens
EVRQIASIVQR

SEQ ID NO: 48787 - protein, 11 aa, Homo Sapiens
EVRVANELNAR

SEQ ID NO: 48788 - protein, 11 aa, Homo Sapiens
EVTDHNLHELR

SEQ ID NO: 48789 - protein, 11 aa, Homo Sapiens
EVTPVTGASLR

SEQ ID NO: 48790 - protein, 11 aa, Homo Sapiens
EVVDMQKRLHR

SEQ ID NO: 48791 - protein, 11 aa, Homo Sapiens
EVVGIIESRAR

SEQ ID NO: 48792 - protein, 11 aa, Homo Sapiens
EVVPEENWHTR

SEQ ID NO: 48793 - protein, 11 aa, Homo Sapiens
EVVTPNIFNSR

SEQ ID NO: 48794 - protein, 11 aa, Homo Sapiens
EYAAAQKTSLR

SEQ ID NO: 48795 - protein, 11 aa, Homo Sapiens
EYAALLTKHTR

SEQ ID NO: 48796 - protein, 11 aa, Homo Sapiens
EYAAQDQKFQR

SEQ ID NO: 48797 - protein, 11 aa, Homo Sapiens
EYAERPEVARR

SEQ ID NO: 48798 - protein, 11 aa, Homo Sapiens
EYAKLLAKRMK

SEQ ID NO: 48799 - protein, 11 aa, Homo Sapiens
EYFELPELVRR

SEQ ID NO: 48800 - protein, 11 aa, Homo Sapiens
EYIEEVRAKKK

SEQ ID NO: 48801 - protein, 11 aa, Homo Sapiens
EYIGLDSGRIR

SEQ ID NO: 48802 - protein, 11 aa, Homo Sapiens
EYIHSKNFIHR

SEQ ID NO: 48803 - protein, 11 aa, Homo Sapiens
EYIIKTDENVR

SEQ ID NO: 48804 - protein, 11 aa, Homo Sapiens
EYIKDEQKNLK

SEQ ID NO: 48805 - protein, 11 aa, Homo Sapiens
EYIPEDILKNL

SEQ ID NO: 48806 - protein, 11 aa, Homo Sapiens
EYIQKNVQLYK

SEQ ID NO: 48807 - protein, 11 aa, Homo Sapiens
EYIQMSGRAGR

SEQ ID NO: 48808 - protein, 11 aa, Homo Sapiens
EYISSDGSYAR

SEQ ID NO: 48809 - protein, 11 aa, Homo Sapiens
EYITKQGFTIR

SEQ ID NO: 48810 - protein, 11 aa, Homo Sapiens
EYIWENSSSER

SEQ ID NO: 48811 - protein, 11 aa, Homo Sapiens
EYKDPENILHR

SEQ ID NO: 48812 - protein, 11 aa, Homo Sapiens
EYKIADMGHLK

SEQ ID NO: 48813 - protein, 11 aa, Homo Sapiens
EYLCHLEEAKR

SEQ ID NO: 48814 - protein, 11 aa, Homo Sapiens
EYLDYDDTRYH

SEQ ID NO: 48815 - protein, 11 aa, Homo Sapiens
EYLEGNNFVHR

SEQ ID NO: 48816 - protein, 11 aa, Homo Sapiens
EYLEKKNFIHR

SEQ ID NO: 48817 - protein, 11 aa, Homo Sapiens
EYLESKQFLHR

SEQ ID NO: 48818 - protein, 11 aa, Homo Sapiens
EYLHAQGVVHR

SEQ ID NO: 48819 - protein, 11 aa, Homo Sapiens
EYLHGKGIIHR

SEQ ID NO: 48820 - protein, 11 aa, Homo Sapiens
EYLHNYGIVHR

SEQ ID NO: 48821 - protein, 11 aa, Homo Sapiens
EYLHSQGVVHR

SEQ ID NO: 48822 - protein, 11 aa, Homo Sapiens
EYLHSRDVVYR

SEQ ID NO: 48823 - protein, 11 aa, Homo Sapiens
EYLIYQESQCR

SEQ ID NO: 48824 - protein, 11 aa, Homo Sapiens
EYLQADEANKR

SEQ ID NO: 48825 - protein, 11 aa, Homo Sapiens
EYLQNVEQKKR

SEQ ID NO: 48826 - protein, 11 aa, Homo Sapiens
EYLQRYHIIHR

SEQ ID NO: 48827 - protein, 11 aa, Homo Sapiens
EYLQSSGLAQR

SEQ ID NO: 48828 - protein, 11 aa, Homo Sapiens
EYLSNADERLR

SEQ ID NO: 48829 - protein, 11 aa, Homo Sapiens
EYMEHVYLIHR

SEQ ID NO: 48830 - protein, 11 aa, Homo Sapiens
EYMEVRERIHR

SEQ ID NO: 48831 - protein, 11 aa, Homo Sapiens
EYMGNAGRKER

SEQ ID NO: 48832 - protein, 11 aa, Homo Sapiens
EYMNNKEALPK

SEQ ID NO: 48833 - protein, 11 aa, Homo Sapiens
EYNAIGGKYNR

SEQ ID NO: 48834 - protein, 11 aa, Homo Sapiens
EYNDRNKLNTR

SEQ ID NO: 48835 - protein, 11 aa, Homo Sapiens
EYNRYTWVTGR

SEQ ID NO: 48836 - protein, 11 aa, Homo Sapiens
EYQAREQLRAR

SEQ ID NO: 48837 - protein, 11 aa, Homo Sapiens
EYQESNALLLR

SEQ ID NO: 48838 - protein, 11 aa, Homo Sapiens
EYQNQISRQNK

SEQ ID NO: 48839 - protein, 11 aa, Homo Sapiens
EYQPSKNMFEK

SEQ ID NO: 48840 - protein, 11 aa, Homo Sapiens
EYRIQGEVETR

SEQ ID NO: 48841 - protein, 11 aa, Homo Sapiens
EYRQSLHTYLR

SEQ ID NO: 48842 - protein, 11 aa, Homo Sapiens
EYRSEQSVKLR

SEQ ID NO: 48843 - protein, 11 aa, Homo Sapiens
EYSEYLKHNVR

SEQ ID NO: 48844 - protein, 11 aa, Homo Sapiens
EYSSEEIMRER

SEQ ID NO: 48845 - protein, 11 aa, Homo Sapiens
EYVDATNLTPR

SEQ ID NO: 48846 - protein, 11 aa, Homo Sapiens
EYVDNTNLVPR

SEQ ID NO: 48847 - protein, 11 aa, Homo Sapiens
EYVHQIGRVGR

SEQ ID NO: 48848 - protein, 11 aa, Homo Sapiens
EYVHRIGRTGR

SEQ ID NO: 48849 - protein, 11 aa, Homo Sapiens
EYVHSKNLIYR

SEQ ID NO: 48850 - protein, 11 aa, Homo Sapiens
EYVHTKNFIHR

SEQ ID NO: 48851 - protein, 11 aa, Homo Sapiens
EYVHTKSLIYR

SEQ ID NO: 48852 - protein, 11 aa, Homo Sapiens
EYVKAGKRIPR

SEQ ID NO: 48853 - protein, 11 aa, Homo Sapiens
EYVSRMKETQK

SEQ ID NO: 48854 - protein, 11 aa, Homo Sapiens
EYWDRNTRNVK

SEQ ID NO: 48855 - protein, 11 aa, Homo Sapiens
EYWDRQRNRHR

SEQ ID NO: 48856 - protein, 11 aa, Homo Sapiens
EYWRRREEEER

SEQ ID NO: 48857 - protein, 11 aa, Homo Sapiens
EYYSFYDDRQK

SEQ ID NO: 48858 - protein, 11 aa, Homo Sapiens
FELDLVTLRSE

SEQ ID NO: 48859 - protein, 11 aa, Homo Sapiens
FFFDGTKLSGR

SEQ ID NO: 48860 - protein, 11 aa, Homo Sapiens
FSKDNESLISR

SEQ ID NO: 48861 - protein, 11 aa, Homo Sapiens
FSKDNNSIITR

SEQ ID NO: 48862 - protein, 11 aa, Homo Sapiens
FSKMHTSQDFR

SEQ ID NO: 48863 - protein, 11 aa, Homo Sapiens
FSMGNEVLQNR

SEQ ID NO: 48864 - protein, 11 aa, Homo Sapiens
FTARRLLSQVR

SEQ ID NO: 48865 - protein, 11 aa, Homo Sapiens
FTLDINTAYAR

SEQ ID NO: 48866 - protein, 11 aa, Homo Sapiens
FTNEVLTKTYR

SEQ ID NO: 48867 - protein, 11 aa, Homo Sapiens
FTNKITSVHSR

SEQ ID NO: 48868 - protein, 11 aa, Homo Sapiens
FTNSKKSVTLR

SEQ ID NO: 48869 - protein, 11 aa, Homo Sapiens
FTRPFYKALLR

SEQ ID NO: 48870 - protein, 11 aa, Homo Sapiens
FVATKDTRALR

SEQ ID NO: 48871 - protein, 11 aa, Homo Sapiens
FVIDSDHLGHR

SEQ ID NO: 48872 - protein, 11 aa, Homo Sapiens
FVKDSIRLVKR

SEQ ID NO: 48873 - protein, 11 aa, Homo Sapiens
FVQYVNERNAR

SEQ ID NO: 48874 - protein, 11 aa, Homo Sapiens
FYDTISKIRLR

SEQ ID NO: 48875 - protein, 11 aa, Homo Sapiens
FYKDGRIVQSR

SEQ ID NO: 48876 - protein, 11 aa, Homo Sapiens
FYQEHPDLARR

SEQ ID NO: 48877 - protein, 11 aa, Homo Sapiens
HAMQFPAELTR

SEQ ID NO: 48878 - protein, 11 aa, Homo Sapiens
HFIELDENRQR

SEQ ID NO: 48879 - protein, 11 aa, Homo Sapiens
HIIEKDKITTR

SEQ ID NO: 48880 - protein, 11 aa, Homo Sapiens
HIKSFDKNLYR

SEQ ID NO: 48881 - protein, 11 aa, Homo Sapiens
HLVSRPSTSSR

SEQ ID NO: 48882 - protein, 11 aa, Homo Sapiens
HNLDRKWICGR

SEQ ID NO: 48883 - protein, 11 aa, Homo Sapiens
HNLHPDYIHGR

SEQ ID NO: 48884 - protein, 11 aa, Homo Sapiens
HSKESKPTFSR

SEQ ID NO: 48885 - protein, 11 aa, Homo Sapiens
HSKIFTDASSR

SEQ ID NO: 48886 - protein, 11 aa, Homo Sapiens
HSMQPKALIHR

SEQ ID NO: 48887 - protein, 11 aa, Homo Sapiens
HTAPQVLFSHR

SEQ ID NO: 48888 - protein, 11 aa, Homo Sapiens
HTKDNLQSVTR

SEQ ID NO: 48889 - protein, 11 aa, Homo Sapiens
HTLEDQALYNR

SEQ ID NO: 48890 - protein, 11 aa, Homo Sapiens
HTNDTIGSVRR

SEQ ID NO: 48891 - protein, 11 aa, Homo Sapiens
HTQDFLEWRRR

SEQ ID NO: 48892 - protein, 11 aa, Homo Sapiens
HTRQWLKGLVR

SEQ ID NO: 48893 - protein, 11 aa, Homo Sapiens
HVAESSLSRLR

SEQ ID NO: 48894 - protein, 11 aa, Homo Sapiens
HVKFKSKADLR

SEQ ID NO: 48895 - protein, 11 aa, Homo Sapiens
HVKTGGKISLR

SEQ ID NO: 48896 - protein, 11 aa, Homo Sapiens
HVRDADLLKKR

SEQ ID NO: 48897 - protein, 11 aa, Homo Sapiens
HYLGEFSITYK

SEQ ID NO: 48898 - protein, 11 aa, Homo Sapiens
HYLPAEILQKK

SEQ ID NO: 48899 - protein, 11 aa, Homo Sapiens
ITKEPSFISKR

SEQ ID NO: 48900 - protein, 11 aa, Homo Sapiens
ITKNNDLVRKR

SEQ ID NO: 48901 - protein, 11 aa, Homo Sapiens
IVKEVCTVVAR

SEQ ID NO: 48902 - protein, 11 aa, Homo Sapiens
IVQAVSAHRHR

SEQ ID NO: 48903 - protein, 11 aa, Homo Sapiens
IVRPPESGLGR

SEQ ID NO: 48904 - protein, 11 aa, Homo Sapiens
IYQYMEEIYHR

SEQ ID NO: 48905 - protein, 11 aa, Homo Sapiens
LFRPVASQLPR

SEQ ID NO: 48906 - protein, 11 aa, Homo Sapiens
LTKEEDLAALR

SEQ ID NO: 48907 - protein, 11 aa, Homo Sapiens
LTMNEELKRAR

SEQ ID NO: 48908 - protein, 11 aa, Homo Sapiens
LTREHGRAYLR

SEQ ID NO: 48909 - protein, 11 aa, Homo Sapiens
LVKDSTGMLGR

SEQ ID NO: 48910 - protein, 11 aa, Homo Sapiens
LVKPVTINVGR

SEQ ID NO: 48911 - protein, 11 aa, Homo Sapiens
LVRKIQEESLR

SEQ ID NO: 48912 - protein, 11 aa, Homo Sapiens
LYKESVDTHQR

SEQ ID NO: 48913 - protein, 11 aa, Homo Sapiens
LYRHFDETVNR

SEQ ID NO: 48914 - protein, 11 aa, Homo Sapiens
LYYHRRQEELK

SEQ ID NO: 48915 - protein, 11 aa, Homo Sapiens
MAISSGAVVHR

SEQ ID NO: 48916 - protein, 11 aa, Homo Sapiens
MDAKSLTAWSR

SEQ ID NO: 48917 - protein, 11 aa, Homo Sapiens
MFRAAAPGQLR

SEQ ID NO: 48918 - protein, 11 aa, Homo Sapiens
MIKGKTPEEIR

SEQ ID NO: 48919 - protein, 11 aa, Homo Sapiens
MIRHREQEELR

SEQ ID NO: 48920 - protein, 11 aa, Homo Sapiens
MLWERLSSTKR

SEQ ID NO: 48921 - protein, 11 aa, Homo Sapiens
MSKDPTTQKLR

SEQ ID NO: 48922 - protein, 11 aa, Homo Sapiens
MTIMEDYFAYR

SEQ ID NO: 48923 - protein, 11 aa, Homo Sapiens
MTKSGYQPPRL

SEQ ID NO: 48924 - protein, 11 aa, Homo Sapiens
MTLEKNVSVQR

SEQ ID NO: 48925 - protein, 11 aa, Homo Sapiens
MTMDEDYQQKR

SEQ ID NO: 48926 - protein, 11 aa, Homo Sapiens
MTMDKSELVQK

SEQ ID NO: 48927 - protein, 11 aa, Homo Sapiens
MTPPERLFLPR

SEQ ID NO: 48928 - protein, 11 aa, Homo Sapiens
MTRGNQRELAR

SEQ ID NO: 48929 - protein, 11 aa, Homo Sapiens
MVKPTPGLTPR

SEQ ID NO: 48930 - protein, 11 aa, Homo Sapiens
MVLPSRLHWIR

SEQ ID NO: 48931 - protein, 11 aa, Homo Sapiens
MVQKPGFGVGR

SEQ ID NO: 48932 - protein, 11 aa, Homo Sapiens
MYKDGDSVLQR

SEQ ID NO: 48933 - protein, 11 aa, Homo Sapiens
MYKSLDQAISR

SEQ ID NO: 48934 - protein, 11 aa, Homo Sapiens
MYQDECDRRLR

SEQ ID NO: 48935 - protein, 11 aa, Homo Sapiens
MYRNEFTAWYR

SEQ ID NO: 48936 - protein, 11 aa, Homo Sapiens
MYYKFSGFTQK

SEQ ID NO: 48937 - protein, 11 aa, Homo Sapiens
NALEGSTFVSR

SEQ ID NO: 48938 - protein, 11 aa, Homo Sapiens
NFKEENMDTSR

SEQ ID NO: 48939 - protein, 11 aa, Homo Sapiens
NGRPLEMIEPR

SEQ ID NO: 48940 - protein, 11 aa, Homo Sapiens
NIMDPQHRAKL

SEQ ID NO: 48941 - protein, 11 aa, Homo Sapiens
NLAEKSTVHMR

SEQ ID NO: 48942 - protein, 11 aa, Homo Sapiens
NLKDRDFLVQR

SEQ ID NO: 48943 - protein, 11 aa, Homo Sapiens
NLKPGECLRVR

SEQ ID NO: 48944 - protein, 11 aa, Homo Sapiens
NSKSHLLVHQR

SEQ ID NO: 48945 - protein, 11 aa, Homo Sapiens
NTMDADSLVSR

SEQ ID NO: 48946 - protein, 11 aa, Homo Sapiens
NVIESKAYVGR

SEQ ID NO: 48947 - protein, 11 aa, Homo Sapiens
NVKNVSVKDVR

SEQ ID NO: 48948 - protein, 11 aa, Homo Sapiens
NVLEFTSARKR

SEQ ID NO: 48949 - protein, 11 aa, Homo Sapiens
NVRETHSLFFR

SEQ ID NO: 48950 - protein, 11 aa, Homo Sapiens
NVRNGYGFINR

SEQ ID NO: 48951 - protein, 11 aa, Homo Sapiens
NWINVDPSRAR

SEQ ID NO: 48952 - protein, 11 aa, Homo Sapiens
NYFFYNKRLKR

SEQ ID NO: 48953 - protein, 11 aa, Homo Sapiens
NYIVPDKQIFR

SEQ ID NO: 48954 - protein, 11 aa, Homo Sapiens
NYKSEVNSKPR

SEQ ID NO: 48955 - protein, 11 aa, Homo Sapiens
NYLHERGIIYR

SEQ ID NO: 48956 - protein, 11 aa, Homo Sapiens
NYLPYPIHQVR

SEQ ID NO: 48957 - protein, 11 aa, Homo Sapiens
NYNFRGMYNQR

SEQ ID NO: 48958 - protein, 11 aa, Homo Sapiens
NYRDDEKSFSR

SEQ ID NO: 48959 - protein, 11 aa, Homo Sapiens
PMKVVTPGASR

SEQ ID NO: 48960 - protein, 11 aa, Homo Sapiens
QALPSQAFIYR

SEQ ID NO: 48961 - protein, 11 aa, Homo Sapiens
QARLRDDTELR

SEQ ID NO: 48962 - protein, 11 aa, Homo Sapiens
QAYPEELIRQR

SEQ ID NO: 48963 - protein, 11 aa, Homo Sapiens
QFLERFKSSAR

SEQ ID NO: 48964 - protein, 11 aa, Homo Sapiens
QNPDITSSRYR

SEQ ID NO: 48965 - protein, 11 aa, Homo Sapiens
QPLSPIRNRTP

SEQ ID NO: 48966 - protein, 11 aa, Homo Sapiens
QTALRNFQHRR

SEQ ID NO: 48967 - protein, 11 aa, Homo Sapiens
QTKEMDLSVVR

SEQ ID NO: 48968 - protein, 11 aa, Homo Sapiens
QTLTKQDTMLK

SEQ ID NO: 48969 - protein, 11 aa, Homo Sapiens
QVRSIQQTMAR

SEQ ID NO: 48970 - protein, 11 aa, Homo Sapiens
QYKGQAGALER

SEQ ID NO: 48971 - protein, 11 aa, Homo Sapiens
QYLGLDGFVER

SEQ ID NO: 48972 - protein, 11 aa, Homo Sapiens
QYLHENGIIHR

SEQ ID NO: 48973 - protein, 11 aa, Homo Sapiens
QYLVGDKRQPR

SEQ ID NO: 48974 - protein, 11 aa, Homo Sapiens
SFASKNKKDLR

SEQ ID NO: 48975 - protein, 11 aa, Homo Sapiens
SFFSPSPARKR

SEQ ID NO: 48976 - protein, 11 aa, Homo Sapiens
SLKGVDPKFLR

SEQ ID NO: 48977 - protein, 11 aa, Homo Sapiens
SLRELGETQRR

SEQ ID NO: 48978 - protein, 11 aa, Homo Sapiens
STIDWNKLYRR

SEQ ID NO: 48979 - protein, 11 aa, Homo Sapiens
STKGHLLIHSR

SEQ ID NO: 48980 - protein, 11 aa, Homo Sapiens
STKPPGTFLLR

SEQ ID NO: 48981 - protein, 11 aa, Homo Sapiens
STLTASEIRQR

SEQ ID NO: 48982 - protein, 11 aa, Homo Sapiens
STYLRPPHTSR

SEQ ID NO: 48983 - protein, 11 aa, Homo Sapiens
SVIPHQKLFTR

SEQ ID NO: 48984 - protein, 11 aa, Homo Sapiens
SVKEISDIVQR

SEQ ID NO: 48985 - protein, 11 aa, Homo Sapiens
SVKELDSKTIR

SEQ ID NO: 48986 - protein, 11 aa, Homo Sapiens
SVMDQEMRVKR

SEQ ID NO: 48987 - protein, 11 aa, Homo Sapiens
SVQPSSSLSAR

SEQ ID NO: 48988 - protein, 11 aa, Homo Sapiens
SVREGQGFAFR

SEQ ID NO: 48989 - protein, 11 aa, Homo Sapiens
SVREVRQLTLR

SEQ ID NO: 48990 - protein, 11 aa, Homo Sapiens
SVRSGYSHLPR

SEQ ID NO: 48991 - protein, 11 aa, Homo Sapiens
SVTPEGVIKQR

SEQ ID NO: 48992 - protein, 11 aa, Homo Sapiens
SYLHENQIIHR

SEQ ID NO: 48993 - protein, 11 aa, Homo Sapiens
SYQDFYCKKER

SEQ ID NO: 48994 - protein, 11 aa, Homo Sapiens
TAASEEARSLR

SEQ ID NO: 48995 - protein, 11 aa, Homo Sapiens
TAASRPPVTLR

SEQ ID NO: 48996 - protein, 11 aa, Homo Sapiens
TAFDRDRAMQR

SEQ ID NO: 48997 - protein, 11 aa, Homo Sapiens
TAISKKFGDMR

SEQ ID NO: 48998 - protein, 11 aa, Homo Sapiens
TELSVRAKPSA

SEQ ID NO: 48999 - protein, 11 aa, Homo Sapiens
TFKDPRTAEER

SEQ ID NO: 49000 - protein, 11 aa, Homo Sapiens
TIIEVNGKRVR

SEQ ID NO: 49001 - protein, 11 aa, Homo Sapiens
TIMPKDIQLAR

SEQ ID NO: 49002 - protein, 11 aa, Homo Sapiens
TLQEYPAIRYR

SEQ ID NO: 49003 - protein, 11 aa, Homo Sapiens
TMKSANICIGR

SEQ ID NO: 49004 - protein, 11 aa, Homo Sapiens
TNYGIPQRALR

SEQ ID NO: 49005 - protein, 11 aa, Homo Sapiens
TSKLYSLLFRR

SEQ ID NO: 49006 - protein, 11 aa, Homo Sapiens
TSKSYLTVHER

SEQ ID NO: 49007 - protein, 11 aa, Homo Sapiens
TSRQFREDDFR

SEQ ID NO: 49008 - protein, 11 aa, Homo Sapiens
TTFTWNINHAR

SEQ ID NO: 49009 - protein, 11 aa, Homo Sapiens
TTKSYPSKLAR

SEQ ID NO: 49010 - protein, 11 aa, Homo Sapiens
TTLGATQLSER

SEQ ID NO: 49011 - protein, 11 aa, Homo Sapiens
TTLGERAFMNR

SEQ ID NO: 49012 - protein, 11 aa, Homo Sapiens
TTLPDDMITQR

SEQ ID NO: 49013 - protein, 11 aa, Homo Sapiens
TVFDAKRLIGR

SEQ ID NO: 49014 - protein, 11 aa, Homo Sapiens
TVIEKTESWPR

SEQ ID NO: 49015 - protein, 11 aa, Homo Sapiens
TVIPATVVTSR

SEQ ID NO: 49016 - protein, 11 aa, Homo Sapiens
TVKDLRLVTNR

SEQ ID NO: 49017 - protein, 11 aa, Homo Sapiens
TVMSVKIIRNR

SEQ ID NO: 49018 - protein, 11 aa, Homo Sapiens
TVNGCPEFRAR

SEQ ID NO: 49019 - protein, 11 aa, Homo Sapiens
TVREGQTICVR

SEQ ID NO: 49020 - protein, 11 aa, Homo Sapiens
TYFQAKIRALK

SEQ ID NO: 49021 - protein, 11 aa, Homo Sapiens
TYIAEEYSRLR

SEQ ID NO: 49022 - protein, 11 aa, Homo Sapiens
TYICPFTGAVR

SEQ ID NO: 49023 - protein, 11 aa, Homo Sapiens
TYILRPVFQQR

SEQ ID NO: 49024 - protein, 11 aa, Homo Sapiens
TYKGEVLGITR

SEQ ID NO: 49025 - protein, 11 aa, Homo Sapiens
TYKRFEGLTAR

SEQ ID NO: 49026 - protein, 11 aa, Homo Sapiens
TYKRFEGLTQR

SEQ ID NO: 49027 - protein, 11 aa, Homo Sapiens
TYLSESQIQSR

SEQ ID NO: 49028 - protein, 11 aa, Homo Sapiens
TYMPSSSGSAR

SEQ ID NO: 49029 - protein, 11 aa, Homo Sapiens
TYQNYKNFNSR

SEQ ID NO: 49030 - protein, 11 aa, Homo Sapiens
TYRDPLYEIVR

SEQ ID NO: 49031 - protein, 11 aa, Homo Sapiens
TYTDLESLRNR

SEQ ID NO: 49032 - protein, 11 aa, Homo Sapiens
TYYDNFCAIAR

SEQ ID NO: 49033 - protein, 11 aa, Homo Sapiens
TYYEGGYFKAR

SEQ ID NO: 49034 - protein, 11 aa, Homo Sapiens
TYYGSFVTRAL

SEQ ID NO: 49035 - protein, 11 aa, Homo Sapiens
VPMRPGILVQR

SEQ ID NO: 49036 - protein, 11 aa, Homo Sapiens
VVAPPGVVVSR

SEQ ID NO: 49037 - protein, 11 aa, Homo Sapiens
VVKPDQLIKRR

SEQ ID NO: 49038 - protein, 11 aa, Homo Sapiens
VYKNVRPAEVR

SEQ ID NO: 49039 - protein, 11 aa, Homo Sapiens
VYRNPESFKEK

SEQ ID NO: 49040 - protein, 11 aa, Homo Sapiens
WTLDPTSLSTR

SEQ ID NO: 49041 - protein, 11 aa, Homo Sapiens
YAKSEEFAVCR

SEQ ID NO: 49042 - protein, 11 aa, Homo Sapiens
YFIPATGHSLR

SEQ ID NO: 49043 - protein, 11 aa, Homo Sapiens
YTKIVVKGMTR

SEQ ID NO: 49044 - protein, 11 aa, Homo Sapiens
YTLQLDGHRTR

SEQ ID NO: 49045 - protein, 11 aa, Homo Sapiens
YTRQTGIVLNR

SEQ ID NO: 49046 - protein, 11 aa, Homo Sapiens
YVKEISEKTER

SEQ ID NO: 49047 - protein, 11 aa, Homo Sapiens
YVRNQQTIGAR

SEQ ID NO: 49048 - protein, 11 aa, Homo Sapiens
YYADNWKDHLR

SEQ ID NO: 49049 - protein, 11 aa, Homo Sapiens
YYFEGGLRKVR

SEQ ID NO: 49050 - protein, 11 aa, Homo Sapiens
YYIEDHNGRQR

SEQ ID NO: 49051 - protein, 11 aa, Homo Sapiens
YYIHRNKILHR

SEQ ID NO: 49052 - protein, 11 aa, Homo Sapiens
YYIIKTERDRK

SEQ ID NO: 49053 - protein, 11 aa, Homo Sapiens
YYKFDYKAHQR

SEQ ID NO: 49054 - protein, 8 aa, Homo Sapiens
AEGPEIPR

SEQ ID NO: 49055 - protein, 8 aa, Homo Sapiens
AGPSIVHR

SEQ ID NO: 49056 - protein, 8 aa, Homo Sapiens
AIKGMHIR

SEQ ID NO: 49057 - protein, 8 aa, Homo Sapiens
DIAVGTKR

SEQ ID NO: 49058 - protein, 8 aa, Homo Sapiens
DLAHITAR

SEQ ID NO: 49059 - protein, 8 aa, Homo Sapiens
DLFVFPYR

SEQ ID NO: 49060 - protein, 8 aa, Homo Sapiens
DLNTGRMR

SEQ ID NO: 49061 - protein, 8 aa, Homo Sapiens
DLREGIER

SEQ ID NO: 49062 - protein, 8 aa, Homo Sapiens
DLYNGATR

SEQ ID NO: 49063 - protein, 8 aa, Homo Sapiens
DMFTGRLR

SEQ ID NO: 49064 - protein, 8 aa, Homo Sapiens
DPFTGAGR

SEQ ID NO: 49065 - protein, 8 aa, Homo Sapiens
DSYSGLGR

SEQ ID NO: 49066 - protein, 8 aa, Homo Sapiens
DVKEGLQR

SEQ ID NO: 49067 - protein, 8 aa, Homo Sapiens
DVRIGMTR

SEQ ID NO: 49068 - protein, 8 aa, Homo Sapiens
DVYLGRYR

SEQ ID NO: 49069 - protein, 8 aa, Homo Sapiens
EAALGLER

SEQ ID NO: 49070 - protein, 8 aa, Homo Sapiens
EAAYGELR

SEQ ID NO: 49071 - protein, 8 aa, Homo Sapiens
EAFEAIPR

SEQ ID NO: 49072 - protein, 8 aa, Homo Sapiens
EAFLAQAR

SEQ ID NO: 49073 - protein, 8 aa, Homo Sapiens
EAFRELGR

SEQ ID NO: 49074 - protein, 8 aa, Homo Sapiens
EAFVGAER

SEQ ID NO: 49075 - protein, 8 aa, Homo Sapiens
EAFVSHYR

SEQ ID NO: 49076 - protein, 8 aa, Homo Sapiens
EATISVCR

SEQ ID NO: 49077 - protein, 8 aa, Homo Sapiens
EAVFGTPR

SEQ ID NO: 49078 - protein, 8 aa, Homo Sapiens
EAWVGRDR

SEQ ID NO: 49079 - protein, 8 aa, Homo Sapiens
EAYIGKMR

SEQ ID NO: 49080 - protein, 8 aa, Homo Sapiens
EAYLASLR

SEQ ID NO: 49081 - protein, 8 aa, Homo Sapiens
EGFFGLYR

SEQ ID NO: 49082 - protein, 8 aa, Homo Sapiens
EIFFGKTR

SEQ ID NO: 49083 - protein, 8 aa, Homo Sapiens
EIFRPFYR

SEQ ID NO: 49084 - protein, 8 aa, Homo Sapiens
EIYKALSR

SEQ ID NO: 49085 - protein, 8 aa, Homo Sapiens
ELFLAGRR

SEQ ID NO: 49086 - protein, 8 aa, Homo Sapiens
ELFQSSFR

SEQ ID NO: 49087 - protein, 8 aa, Homo Sapiens
ELGPASPR

SEQ ID NO: 49088 - protein, 8 aa, Homo Sapiens
ELHLSTER

SEQ ID NO: 49089 - protein, 8 aa, Homo Sapiens
ELSTGMPR

SEQ ID NO: 49090 - protein, 8 aa, Homo Sapiens
ENFLSRKR

SEQ ID NO: 49091 - protein, 8 aa, Homo Sapiens
EQFTAMFR

SEQ ID NO: 49092 - protein, 8 aa, Homo Sapiens
ESHTGILR

SEQ ID NO: 49093 - protein, 8 aa, Homo Sapiens
ESYVGKLR

SEQ ID NO: 49094 - protein, 8 aa, Homo Sapiens
ETFLAKSR

SEQ ID NO: 49095 - protein, 8 aa, Homo Sapiens
ETFVSLHR

SEQ ID NO: 49096 - protein, 8 aa, Homo Sapiens
ETGQVLGR

SEQ ID NO: 49097 - protein, 8 aa, Homo Sapiens
ETMEPALR

SEQ ID NO: 49098 - protein, 8 aa, Homo Sapiens
ETVVGLAR

SEQ ID NO: 49099 - protein, 8 aa, Homo Sapiens
EVAEFLAR

SEQ ID NO: 49100 - protein, 8 aa, Homo Sapiens
EVAVGVCR

SEQ ID NO: 49101 - protein, 8 aa, Homo Sapiens
EVFPGRNR

SEQ ID NO: 49102 - protein, 8 aa, Homo Sapiens
EVFRFAYY

SEQ ID NO: 49103 - protein, 8 aa, Homo Sapiens
EVGPVLSK

SEQ ID NO: 49104 - protein, 8 aa, Homo Sapiens
EVGPVVSF

SEQ ID NO: 49105 - protein, 8 aa, Homo Sapiens
EVIAVNTR

SEQ ID NO: 49106 - protein, 8 aa, Homo Sapiens
EVKVTIKR

SEQ ID NO: 49107 - protein, 8 aa, Homo Sapiens
EVLLGSAR

SEQ ID NO: 49108 - protein, 8 aa, Homo Sapiens
EVLVTASR

SEQ ID NO: 49109 - protein, 8 aa, Homo Sapiens
EVMQAVAR

SEQ ID NO: 49110 - protein, 8 aa, Homo Sapiens
EVMQAVQR

SEQ ID NO: 49111 - protein, 8 aa, Homo Sapiens
EVMQSVCR

SEQ ID NO: 49112 - protein, 8 aa, Homo Sapiens
EVSPITGR

SEQ ID NO: 49113 - protein, 8 aa, Homo Sapiens
EVSTGINR

SEQ ID NO: 49114 - protein, 8 aa, Homo Sapiens
EVVVGTTR

SEQ ID NO: 49115 - protein, 8 aa, Homo Sapiens
FTYVGGPR

SEQ ID NO: 49116 - protein, 8 aa, Homo Sapiens
GPREAGLR

SEQ ID NO: 49117 - protein, 8 aa, Homo Sapiens
LADPTERF

SEQ ID NO: 49118 - protein, 8 aa, Homo Sapiens
LQQAKDEI

SEQ ID NO: 49119 - protein, 8 aa, Homo Sapiens
LQQAKEDL

SEQ ID NO: 49120 - protein, 8 aa, Homo Sapiens
LTAVVQKR

SEQ ID NO: 49121 - protein, 8 aa, Homo Sapiens
MSLTACKV

SEQ ID NO: 49122 - protein, 8 aa, Homo Sapiens
MVQQLGKA

SEQ ID NO: 49123 - protein, 8 aa, Homo Sapiens
NVFVSANR

SEQ ID NO: 49124 - protein, 8 aa, Homo Sapiens
NVYCGVHR

SEQ ID NO: 49125 - protein, 8 aa, Homo Sapiens
PDAVGKCR

SEQ ID NO: 49126 - protein, 8 aa, Homo Sapiens
PFGAGRHR

SEQ ID NO: 49127 - protein, 8 aa, Homo Sapiens
PFHKAIRR

SEQ ID NO: 49128 - protein, 8 aa, Homo Sapiens
PGPRPLAR

SEQ ID NO: 49129 - protein, 8 aa, Homo Sapiens
PRRASVTR

SEQ ID NO: 49130 - protein, 8 aa, Homo Sapiens
QAPKPRKQ

SEQ ID NO: 49131 - protein, 8 aa, Homo Sapiens
QLYWSHPR

SEQ ID NO: 49132 - protein, 8 aa, Homo Sapiens
SGPSIVHR

SEQ ID NO: 49133 - protein, 8 aa, Homo Sapiens
SPFAGALR

SEQ ID NO: 49134 - protein, 8 aa, Homo Sapiens
SVLGPNAR

SEQ ID NO: 49135 - protein, 8 aa, Homo Sapiens
SVVERNAR

SEQ ID NO: 49136 - protein, 8 aa, Homo Sapiens
TGNPTVVR

SEQ ID NO: 49137 - protein, 8 aa, Homo Sapiens
VAAVAARR

SEQ ID NO: 49138 - protein, 8 aa, Homo Sapiens
VEADPGLR

SEQ ID NO: 49139 - protein, 8 aa, Homo Sapiens
VHAPSLRR

SEQ ID NO: 49140 - protein, 8 aa, Homo Sapiens
VKGPGLQR

SEQ ID NO: 49141 - protein, 8 aa, Homo Sapiens
VVVSGKLR

SEQ ID NO: 49142 - protein, 9 aa, Homo Sapiens
AAADVGLTR

SEQ ID NO: 49143 - protein, 9 aa, Homo Sapiens
AAAEGTVGR

SEQ ID NO: 49144 - protein, 9 aa, Homo Sapiens
AAAGAFAGR

SEQ ID NO: 49145 - protein, 9 aa, Homo Sapiens
AAAGLAGPR

SEQ ID NO: 49146 - protein, 9 aa, Homo Sapiens
AAAGPARPR

SEQ ID NO: 49147 - protein, 9 aa, Homo Sapiens
AAANPTLAF

SEQ ID NO: 49148 - protein, 9 aa, Homo Sapiens
AAAPGAHYR

SEQ ID NO: 49149 - protein, 9 aa, Homo Sapiens
AAAPGLGPR

SEQ ID NO: 49150 - protein, 9 aa, Homo Sapiens
AAGPVAAPR

SEQ ID NO: 49151 - protein, 9 aa, Homo Sapiens
AAIGPTTAR

SEQ ID NO: 49152 - protein, 9 aa, Homo Sapiens
AAVAAVAAR

SEQ ID NO: 49153 - protein, 9 aa, Homo Sapiens
AAVDSSVPR

SEQ ID NO: 49154 - protein, 9 aa, Homo Sapiens
AEAALGLAR

SEQ ID NO: 49155 - protein, 9 aa, Homo Sapiens
AEVLGLILR

SEQ ID NO: 49156 - protein, 9 aa, Homo Sapiens
APAAPAAPR

SEQ ID NO: 49157 - protein, 9 aa, Homo Sapiens
APRAPGLAR

SEQ ID NO: 49158 - protein, 9 aa, Homo Sapiens
AVAAVAARR

SEQ ID NO: 49159 - protein, 9 aa, Homo Sapiens
AVAFSASAR

SEQ ID NO: 49160 - protein, 9 aa, Homo Sapiens
AVAPPAGPR

SEQ ID NO: 49161 - protein, 9 aa, Homo Sapiens
AVIDAGVCR

SEQ ID NO: 49162 - protein, 9 aa, Homo Sapiens
AVIDVGINR

SEQ ID NO: 49163 - protein, 9 aa, Homo Sapiens
AVIFINTRR

SEQ ID NO: 49164 - protein, 9 aa, Homo Sapiens
AVIGIATKR

SEQ ID NO: 49165 - protein, 9 aa, Homo Sapiens
AVIGYLSTR

SEQ ID NO: 49166 - protein, 9 aa, Homo Sapiens
AVISGVGTR

SEQ ID NO: 49167 - protein, 9 aa, Homo Sapiens
AVTPPGLAR

SEQ ID NO: 49168 - protein, 9 aa, Homo Sapiens
AVVAGGLGR

SEQ ID NO: 49169 - protein, 9 aa, Homo Sapiens
AVVPNTSSR

SEQ ID NO: 49170 - protein, 9 aa, Homo Sapiens
CIISLVTQR

SEQ ID NO: 49171 - protein, 9 aa, Homo Sapiens
CPAPPGYLR

SEQ ID NO: 49172 - protein, 9 aa, Homo Sapiens
CVNKSTHEF

SEQ ID NO: 49173 - protein, 9 aa, Homo Sapiens
CVSPTVNQR

SEQ ID NO: 49174 - protein, 9 aa, Homo Sapiens
DAAGVFCIR

SEQ ID NO: 49175 - protein, 9 aa, Homo Sapiens
DAAIPSKSR

SEQ ID NO: 49176 - protein, 9 aa, Homo Sapiens
DAAIVGAVR

SEQ ID NO: 49177 - protein, 9 aa, Homo Sapiens
DAAKDSILR

SEQ ID NO: 49178 - protein, 9 aa, Homo Sapiens
DAAPQLGKR

SEQ ID NO: 49179 - protein, 9 aa, Homo Sapiens
DAGPPTHAF

SEQ ID NO: 49180 - protein, 9 aa, Homo Sapiens
DAILASSAR

SEQ ID NO: 49181 - protein, 9 aa, Homo Sapiens
DAIRGGLPK

SEQ ID NO: 49182 - protein, 9 aa, Homo Sapiens
DAISYRFPR

SEQ ID NO: 49183 - protein, 9 aa, Homo Sapiens
DALGGLLNR

SEQ ID NO: 49184 - protein, 9 aa, Homo Sapiens
DAQKPSLTR

SEQ ID NO: 49185 - protein, 9 aa, Homo Sapiens
DAVDVFETR

SEQ ID NO: 49186 - protein, 9 aa, Homo Sapiens
DAVEDRLDR

SEQ ID NO: 49187 - protein, 9 aa, Homo Sapiens
DAYWPEAKR

SEQ ID NO: 49188 - protein, 9 aa, Homo Sapiens
DIFKKSKPR

SEQ ID NO: 49189 - protein, 9 aa, Homo Sapiens
DIFNQVVPR

SEQ ID NO: 49190 - protein, 9 aa, Homo Sapiens
DIFSEVVGR

SEQ ID NO: 49191 - protein, 9 aa, Homo Sapiens
DIIAKVTRR

SEQ ID NO: 49192 - protein, 9 aa, Homo Sapiens
DIIDPAILR

SEQ ID NO: 49193 - protein, 9 aa, Homo Sapiens
DIIEKVMAR

SEQ ID NO: 49194 - protein, 9 aa, Homo Sapiens
DIIPNPQER

SEQ ID NO: 49195 - protein, 9 aa, Homo Sapiens
DIIQPSSTR

SEQ ID NO: 49196 - protein, 9 aa, Homo Sapiens
DIITNLRCR

SEQ ID NO: 49197 - protein, 9 aa, Homo Sapiens
DIKEKSKFR

SEQ ID NO: 49198 - protein, 9 aa, Homo Sapiens
DILFTEQER

SEQ ID NO: 49199 - protein, 9 aa, Homo Sapiens
DIMAAVSGR

SEQ ID NO: 49200 - protein, 9 aa, Homo Sapiens
DIMDSSLTR

SEQ ID NO: 49201 - protein, 9 aa, Homo Sapiens
DIQDPGVPR

SEQ ID NO: 49202 - protein, 9 aa, Homo Sapiens
DITEPSIGR

SEQ ID NO: 49203 - protein, 9 aa, Homo Sapiens
DITTPKAAR

SEQ ID NO: 49204 - protein, 9 aa, Homo Sapiens
DIVKPGMRR

SEQ ID NO: 49205 - protein, 9 aa, Homo Sapiens
DIVTVGECR

SEQ ID NO: 49206 - protein, 9 aa, Homo Sapiens
DIWTTTANR

SEQ ID NO: 49207 - protein, 9 aa, Homo Sapiens
DIYFNPKTR

SEQ ID NO: 49208 - protein, 9 aa, Homo Sapiens
DIYLTQILR

SEQ ID NO: 49209 - protein, 9 aa, Homo Sapiens
DLANVRVGR

SEQ ID NO: 49210 - protein, 9 aa, Homo Sapiens
DLFYNIATR

SEQ ID NO: 49211 - protein, 9 aa, Homo Sapiens
DLHEHPLYR

SEQ ID NO: 49212 - protein, 9 aa, Homo Sapiens
DLIAAVSTR

SEQ ID NO: 49213 - protein, 9 aa, Homo Sapiens
DLIAIVSNR

SEQ ID NO: 49214 - protein, 9 aa, Homo Sapiens
DLIFKTGGR

SEQ ID NO: 49215 - protein, 9 aa, Homo Sapiens
DLIGCIIGR

SEQ ID NO: 49216 - protein, 9 aa, Homo Sapiens
DLKGSTVAR

SEQ ID NO: 49217 - protein, 9 aa, Homo Sapiens
DLREQTHSR

SEQ ID NO: 49218 - protein, 9 aa, Homo Sapiens
DLREQTHTR

SEQ ID NO: 49219 - protein, 9 aa, Homo Sapiens
DLSSSSSLR

SEQ ID NO: 49220 - protein, 9 aa, Homo Sapiens
DLYLCPRQR

SEQ ID NO: 49221 - protein, 9 aa, Homo Sapiens
DLYLKPIQR

SEQ ID NO: 49222 - protein, 9 aa, Homo Sapiens
DMAAQITQR

SEQ ID NO: 49223 - protein, 9 aa, Homo Sapiens
DMFATPQYR

SEQ ID NO: 49224 - protein, 9 aa, Homo Sapiens
DMNEPSVFR

SEQ ID NO: 49225 - protein, 9 aa, Homo Sapiens
DNFFTGRKR

SEQ ID NO: 49226 - protein, 9 aa, Homo Sapiens
DPAFGSSGR

SEQ ID NO: 49227 - protein, 9 aa, Homo Sapiens
DPAGVHPPR

SEQ ID NO: 49228 - protein, 9 aa, Homo Sapiens
DPFHKAIRR

SEQ ID NO: 49229 - protein, 9 aa, Homo Sapiens
DPGGGGLFR

SEQ ID NO: 49230 - protein, 9 aa, Homo Sapiens
DPHSPSRFR

SEQ ID NO: 49231 - protein, 9 aa, Homo Sapiens
DPIEVVGQR

SEQ ID NO: 49232 - protein, 9 aa, Homo Sapiens
DPLGAAANR

SEQ ID NO: 49233 - protein, 9 aa, Homo Sapiens
DPNKPSGFR

SEQ ID NO: 49234 - protein, 9 aa, Homo Sapiens
DPQGNTIYR

SEQ ID NO: 49235 - protein, 9 aa, Homo Sapiens
DPSGWWTGR

SEQ ID NO: 49236 - protein, 9 aa, Homo Sapiens
DPVTSVGKR

SEQ ID NO: 49237 - protein, 9 aa, Homo Sapiens
DQGPTTKNL

SEQ ID NO: 49238 - protein, 9 aa, Homo Sapiens
DQNPDAALR

SEQ ID NO: 49239 - protein, 9 aa, Homo Sapiens
DSAPVETPR

SEQ ID NO: 49240 - protein, 9 aa, Homo Sapiens
DSAQQGLYR

SEQ ID NO: 49241 - protein, 9 aa, Homo Sapiens
DSFSAGEPR

SEQ ID NO: 49242 - protein, 9 aa, Homo Sapiens
DSIDPALRR

SEQ ID NO: 49243 - protein, 9 aa, Homo Sapiens
DSIEDRYPR

SEQ ID NO: 49244 - protein, 9 aa, Homo Sapiens
DTAAQITQR

SEQ ID NO: 49245 - protein, 9 aa, Homo Sapiens
DTAGNDAFR

SEQ ID NO: 49246 - protein, 9 aa, Homo Sapiens
DTAHTFSLR

SEQ ID NO: 49247 - protein, 9 aa, Homo Sapiens
DTANDGFVR

SEQ ID NO: 49248 - protein, 9 aa, Homo Sapiens
DTHGSFVVR

SEQ ID NO: 49249 - protein, 9 aa, Homo Sapiens
DTIDSLRSR

SEQ ID NO: 49250 - protein, 9 aa, Homo Sapiens
DTIEIITDR

SEQ ID NO: 49251 - protein, 9 aa, Homo Sapiens
DTIGYLLTR

SEQ ID NO: 49252 - protein, 9 aa, Homo Sapiens
DTITETDLR

SEQ ID NO: 49253 - protein, 9 aa, Homo Sapiens
DTMPPKGVR

SEQ ID NO: 49254 - protein, 9 aa, Homo Sapiens
DTSGICNLR

SEQ ID NO: 49255 - protein, 9 aa, Homo Sapiens
DTVAQITQR

SEQ ID NO: 49256 - protein, 9 aa, Homo Sapiens
DTVATLSER

SEQ ID NO: 49257 - protein, 9 aa, Homo Sapiens
DVAAQQSLR

SEQ ID NO: 49258 - protein, 9 aa, Homo Sapiens
DVAGIGWER

SEQ ID NO: 49259 - protein, 9 aa, Homo Sapiens
DVAHVNTVM

SEQ ID NO: 49260 - protein, 9 aa, Homo Sapiens
DVAQSTHVL

SEQ ID NO: 49261 - protein, 9 aa, Homo Sapiens
DVFEGSIIR

SEQ ID NO: 49262 - protein, 9 aa, Homo Sapiens
DVFGTGASK

SEQ ID NO: 49263 - protein, 9 aa, Homo Sapiens
DVFPGPSFR

SEQ ID NO: 49264 - protein, 9 aa, Homo Sapiens
DVFVVGTER

SEQ ID NO: 49265 - protein, 9 aa, Homo Sapiens
DVGKSTFNR

SEQ ID NO: 49266 - protein, 9 aa, Homo Sapiens
DVGPTSHNR

SEQ ID NO: 49267 - protein, 9 aa, Homo Sapiens
DVHVAVVVR

SEQ ID NO: 49268 - protein, 9 aa, Homo Sapiens
DVIDDASSR

SEQ ID NO: 49269 - protein, 9 aa, Homo Sapiens
DVIGVTKGK

SEQ ID NO: 49270 - protein, 9 aa, Homo Sapiens
DVIKPGTVK

SEQ ID NO: 49271 - protein, 9 aa, Homo Sapiens
DVINPMALR

SEQ ID NO: 49272 - protein, 9 aa, Homo Sapiens
DVINSARTR

SEQ ID NO: 49273 - protein, 9 aa, Homo Sapiens
DVLQTGTQR

SEQ ID NO: 49274 - protein, 9 aa, Homo Sapiens
DVMPSGRSR

SEQ ID NO: 49275 - protein, 9 aa, Homo Sapiens
DVNIKSTER

SEQ ID NO: 49276 - protein, 9 aa, Homo Sapiens
DVNLSHSER

SEQ ID NO: 49277 - protein, 9 aa, Homo Sapiens
DVNNIGKYR

SEQ ID NO: 49278 - protein, 9 aa, Homo Sapiens
DVNSGFAKR

SEQ ID NO: 49279 - protein, 9 aa, Homo Sapiens
DVPSPFNHR

SEQ ID NO: 49280 - protein, 9 aa, Homo Sapiens
DVQPSGAQR

SEQ ID NO: 49281 - protein, 9 aa, Homo Sapiens
DVRMGGSFR

SEQ ID NO: 49282 - protein, 9 aa, Homo Sapiens
DVRQKVLER

SEQ ID NO: 49283 - protein, 9 aa, Homo Sapiens
DVRSVTSVR

SEQ ID NO: 49284 - protein, 9 aa, Homo Sapiens
DVSHPIIYR

SEQ ID NO: 49285 - protein, 9 aa, Homo Sapiens
DVVGRFNER

SEQ ID NO: 49286 - protein, 9 aa, Homo Sapiens
DVVSKFLNR

SEQ ID NO: 49287 - protein, 9 aa, Homo Sapiens
DVVWETKPK

SEQ ID NO: 49288 - protein, 9 aa, Homo Sapiens
DVYGGTNRY

SEQ ID NO: 49289 - protein, 9 aa, Homo Sapiens
DVYPEIIER

SEQ ID NO: 49290 - protein, 9 aa, Homo Sapiens
DVYQAVSKR

SEQ ID NO: 49291 - protein, 9 aa, Homo Sapiens
DVYRGLQER

SEQ ID NO: 49292 - protein, 9 aa, Homo Sapiens
DVYSGTPTK

SEQ ID NO: 49293 - protein, 9 aa, Homo Sapiens
DVYTPKSSR

SEQ ID NO: 49294 - protein, 9 aa, Homo Sapiens
EAAAALTRM

SEQ ID NO: 49295 - protein, 9 aa, Homo Sapiens
EAAAASAFL

SEQ ID NO: 49296 - protein, 9 aa, Homo Sapiens
EAAAIGALR

SEQ ID NO: 49297 - protein, 9 aa, Homo Sapiens
EAAAIIAQR

SEQ ID NO: 49298 - protein, 9 aa, Homo Sapiens
EAAAPLRVR

SEQ ID NO: 49299 - protein, 9 aa, Homo Sapiens
EAAAVLMAR

SEQ ID NO: 49300 - protein, 9 aa, Homo Sapiens
EAADAMSRL

SEQ ID NO: 49301 - protein, 9 aa, Homo Sapiens
EAADIIQKL

SEQ ID NO: 49302 - protein, 9 aa, Homo Sapiens
EAAEKLKNR

SEQ ID NO: 49303 - protein, 9 aa, Homo Sapiens
EAAESIAFR

SEQ ID NO: 49304 - protein, 9 aa, Homo Sapiens
EAAFANGKL

SEQ ID NO: 49305 - protein, 9 aa, Homo Sapiens
EAAFATKDR

SEQ ID NO: 49306 - protein, 9 aa, Homo Sapiens
EAAGASKAL

SEQ ID NO: 49307 - protein, 9 aa, Homo Sapiens
EAAIGVTKR

SEQ ID NO: 49308 - protein, 9 aa, Homo Sapiens
EAAKDLLYR

SEQ ID NO: 49309 - protein, 9 aa, Homo Sapiens
EAAKVFGLR

SEQ ID NO: 49310 - protein, 9 aa, Homo Sapiens
EAALCALRR

SEQ ID NO: 49311 - protein, 9 aa, Homo Sapiens
EAALGVAMR

SEQ ID NO: 49312 - protein, 9 aa, Homo Sapiens
EAALSPTFR

SEQ ID NO: 49313 - protein, 9 aa, Homo Sapiens
EAAMAFAYL

SEQ ID NO: 49314 - protein, 9 aa, Homo Sapiens
EAAPEYFRR

SEQ ID NO: 49315 - protein, 9 aa, Homo Sapiens
EAAPGKSEL

SEQ ID NO: 49316 - protein, 9 aa, Homo Sapiens
EAAPPGELY

SEQ ID NO: 49317 - protein, 9 aa, Homo Sapiens
EAAPVSGYR

SEQ ID NO: 49318 - protein, 9 aa, Homo Sapiens
EAAPVVVGH

SEQ ID NO: 49319 - protein, 9 aa, Homo Sapiens
EAAQKFLER

SEQ ID NO: 49320 - protein, 9 aa, Homo Sapiens
EAASPPALF

SEQ ID NO: 49321 - protein, 9 aa, Homo Sapiens
EAATVTSYL

SEQ ID NO: 49322 - protein, 9 aa, Homo Sapiens
EAAVAFLFR

SEQ ID NO: 49323 - protein, 9 aa, Homo Sapiens
EAAVAIKAM

SEQ ID NO: 49324 - protein, 9 aa, Homo Sapiens
EAAWAISNL

SEQ ID NO: 49325 - protein, 9 aa, Homo Sapiens
EAAWPHLQL

SEQ ID NO: 49326 - protein, 9 aa, Homo Sapiens
EAAYIGSMR

SEQ ID NO: 49327 - protein, 9 aa, Homo Sapiens
EAELGTFPR

SEQ ID NO: 49328 - protein, 9 aa, Homo Sapiens
EAEVASLNR

SEQ ID NO: 49329 - protein, 9 aa, Homo Sapiens
EAFDFVKQR

SEQ ID NO: 49330 - protein, 9 aa, Homo Sapiens
EAFDSTSRF

SEQ ID NO: 49331 - protein, 9 aa, Homo Sapiens
EAFEFVKQR

SEQ ID NO: 49332 - protein, 9 aa, Homo Sapiens
EAFENLGKR

SEQ ID NO: 49333 - protein, 9 aa, Homo Sapiens
EAFLHQQKR

SEQ ID NO: 49334 - protein, 9 aa, Homo Sapiens
EAFLTAQTK

SEQ ID NO: 49335 - protein, 9 aa, Homo Sapiens
EAFQTTISK

SEQ ID NO: 49336 - protein, 9 aa, Homo Sapiens
EAFSELSKR

SEQ ID NO: 49337 - protein, 9 aa, Homo Sapiens
EAFSRPLSR

SEQ ID NO: 49338 - protein, 9 aa, Homo Sapiens
EAFVIDAVR

SEQ ID NO: 49339 - protein, 9 aa, Homo Sapiens
EAGAIISTR

SEQ ID NO: 49340 - protein, 9 aa, Homo Sapiens
EAGCGGLLR

SEQ ID NO: 49341 - protein, 9 aa, Homo Sapiens
EAGEPTTLL

SEQ ID NO: 49342 - protein, 9 aa, Homo Sapiens
EAGGPLTPR

SEQ ID NO: 49343 - protein, 9 aa, Homo Sapiens
EAGGRTLFR

SEQ ID NO: 49344 - protein, 9 aa, Homo Sapiens
EAGGSEIQR

SEQ ID NO: 49345 - protein, 9 aa, Homo Sapiens
EAGPGTCTF

SEQ ID NO: 49346 - protein, 9 aa, Homo Sapiens
EAGPSIVHR

SEQ ID NO: 49347 - protein, 9 aa, Homo Sapiens
EAGPYGANM

SEQ ID NO: 49348 - protein, 9 aa, Homo Sapiens
EAGVGGRFR

SEQ ID NO: 49349 - protein, 9 aa, Homo Sapiens
EAHAQSIGM

SEQ ID NO: 49350 - protein, 9 aa, Homo Sapiens
EAHARIHLR

SEQ ID NO: 49351 - protein, 9 aa, Homo Sapiens
EAHESTGIF

SEQ ID NO: 49352 - protein, 9 aa, Homo Sapiens
EAHFVPLVK

SEQ ID NO: 49353 - protein, 9 aa, Homo Sapiens
EAHNILSKR

SEQ ID NO: 49354 - protein, 9 aa, Homo Sapiens
EAHQNVAQM

SEQ ID NO: 49355 - protein, 9 aa, Homo Sapiens
EAIAKGIRR

SEQ ID NO: 49356 - protein, 9 aa, Homo Sapiens
EAIEKLSKR

SEQ ID NO: 49357 - protein, 9 aa, Homo Sapiens
EAIESYYQR

SEQ ID NO: 49358 - protein, 9 aa, Homo Sapiens
EAIGNEVTR

SEQ ID NO: 49359 - protein, 9 aa, Homo Sapiens
EAIGPSTIR

SEQ ID NO: 49360 - protein, 9 aa, Homo Sapiens
EAIGTLTAR

SEQ ID NO: 49361 - protein, 9 aa, Homo Sapiens
EAIISGKQR

SEQ ID NO: 49362 - protein, 9 aa, Homo Sapiens
EAIKALEVR

SEQ ID NO: 49363 - protein, 9 aa, Homo Sapiens
EAIKITNRR

SEQ ID NO: 49364 - protein, 9 aa, Homo Sapiens
EAIPGLAAR

SEQ ID NO: 49365 - protein, 9 aa, Homo Sapiens
EAIQKKLSR

SEQ ID NO: 49366 - protein, 9 aa, Homo Sapiens
EAIRAMKVR

SEQ ID NO: 49367 - protein, 9 aa, Homo Sapiens
EAIYDICRR

SEQ ID NO: 49368 - protein, 9 aa, Homo Sapiens
EAKAPILKR

SEQ ID NO: 49369 - protein, 9 aa, Homo Sapiens
EAKAPSRGF

SEQ ID NO: 49370 - protein, 9 aa, Homo Sapiens
EAKFPTMNR

SEQ ID NO: 49371 - protein, 9 aa, Homo Sapiens
EALKLARQI

SEQ ID NO: 49372 - protein, 9 aa, Homo Sapiens
EALNQVTQR

SEQ ID NO: 49373 - protein, 9 aa, Homo Sapiens
EALNVLVNR

SEQ ID NO: 49374 - protein, 9 aa, Homo Sapiens
EALRKMGLR

SEQ ID NO: 49375 - protein, 9 aa, Homo Sapiens
EALTALMSR

SEQ ID NO: 49376 - protein, 9 aa, Homo Sapiens
EALYDICFR

SEQ ID NO: 49377 - protein, 9 aa, Homo Sapiens
EAMALPLYR

SEQ ID NO: 49378 - protein, 9 aa, Homo Sapiens
EAMASIINR

SEQ ID NO: 49379 - protein, 9 aa, Homo Sapiens
EAMDDFMKR

SEQ ID NO: 49380 - protein, 9 aa, Homo Sapiens
EAMDVKLKR

SEQ ID NO: 49381 - protein, 9 aa, Homo Sapiens
EAMGQLGSR

SEQ ID NO: 49382 - protein, 9 aa, Homo Sapiens
EAMKHVYFR

SEQ ID NO: 49383 - protein, 9 aa, Homo Sapiens
EAMTIFQNR

SEQ ID NO: 49384 - protein, 9 aa, Homo Sapiens
EAMTVAIRR

SEQ ID NO: 49385 - protein, 9 aa, Homo Sapiens
EANATQLLR

SEQ ID NO: 49386 - protein, 9 aa, Homo Sapiens
EANEEFALR

SEQ ID NO: 49387 - protein, 9 aa, Homo Sapiens
EANFPANVM

SEQ ID NO: 49388 - protein, 9 aa, Homo Sapiens
EANFTVSSM

SEQ ID NO: 49389 - protein, 9 aa, Homo Sapiens
EANIFTKQR

SEQ ID NO: 49390 - protein, 9 aa, Homo Sapiens
EAPKGMLAR

SEQ ID NO: 49391 - protein, 9 aa, Homo Sapiens
EAPPATQNF

SEQ ID NO: 49392 - protein, 9 aa, Homo Sapiens
EAQELFSVR

SEQ ID NO: 49393 - protein, 9 aa, Homo Sapiens
EAQEVTIAR

SEQ ID NO: 49394 - protein, 9 aa, Homo Sapiens
EAQGIHISR

SEQ ID NO: 49395 - protein, 9 aa, Homo Sapiens
EAQIAAVCR

SEQ ID NO: 49396 - protein, 9 aa, Homo Sapiens
EAQNLTRGR

SEQ ID NO: 49397 - protein, 9 aa, Homo Sapiens
EAQRITGLR

SEQ ID NO: 49398 - protein, 9 aa, Homo Sapiens
EAQVVRVTR

SEQ ID NO: 49399 - protein, 9 aa, Homo Sapiens
EARAFGVTR

SEQ ID NO: 49400 - protein, 9 aa, Homo Sapiens
EASAAGLIR

SEQ ID NO: 49401 - protein, 9 aa, Homo Sapiens
EASDPRIIR

SEQ ID NO: 49402 - protein, 9 aa, Homo Sapiens
EASEATLFY

SEQ ID NO: 49403 - protein, 9 aa, Homo Sapiens
EASGPGNFF

SEQ ID NO: 49404 - protein, 9 aa, Homo Sapiens
EASKDGLFR

SEQ ID NO: 49405 - protein, 9 aa, Homo Sapiens
EASNASSYL

SEQ ID NO: 49406 - protein, 9 aa, Homo Sapiens
EASPGGLDR

SEQ ID NO: 49407 - protein, 9 aa, Homo Sapiens
EASPRILKK

SEQ ID NO: 49408 - protein, 9 aa, Homo Sapiens
EASPSSLHF

SEQ ID NO: 49409 - protein, 9 aa, Homo Sapiens
EASPVKASR

SEQ ID NO: 49410 - protein, 9 aa, Homo Sapiens
EASQGFRFL

SEQ ID NO: 49411 - protein, 9 aa, Homo Sapiens
EASRAILQR

SEQ ID NO: 49412 - protein, 9 aa, Homo Sapiens
EASWPHIQL

SEQ ID NO: 49413 - protein, 9 aa, Homo Sapiens
EATAAILSR

SEQ ID NO: 49414 - protein, 9 aa, Homo Sapiens
EATAMAMGR

SEQ ID NO: 49415 - protein, 9 aa, Homo Sapiens
EATFCVVLR

SEQ ID NO: 49416 - protein, 9 aa, Homo Sapiens
EATGEKVLR

SEQ ID NO: 49417 - protein, 9 aa, Homo Sapiens
EATLSVARR

SEQ ID NO: 49418 - protein, 9 aa, Homo Sapiens
EATSCSLHR

SEQ ID NO: 49419 - protein, 9 aa, Homo Sapiens
EATVLGQRR

SEQ ID NO: 49420 - protein, 9 aa, Homo Sapiens
EAVAALGNK

SEQ ID NO: 49421 - protein, 9 aa, Homo Sapiens
EAVAGIVGR

SEQ ID NO: 49422 - protein, 9 aa, Homo Sapiens
EAVDISSKR

SEQ ID NO: 49423 - protein, 9 aa, Homo Sapiens
EAVEAAINR

SEQ ID NO: 49424 - protein, 9 aa, Homo Sapiens
EAVFASEVK

SEQ ID NO: 49425 - protein, 9 aa, Homo Sapiens
EAVFIAHKR

SEQ ID NO: 49426 - protein, 9 aa, Homo Sapiens
EAVFNPQSR

SEQ ID NO: 49427 - protein, 9 aa, Homo Sapiens
EAVGVTSQR

SEQ ID NO: 49428 - protein, 9 aa, Homo Sapiens
EAVKLIIGR

SEQ ID NO: 49429 - protein, 9 aa, Homo Sapiens
EAVKPFGLK

SEQ ID NO: 49430 - protein, 9 aa, Homo Sapiens
EAVKPTVGM

SEQ ID NO: 49431 - protein, 9 aa, Homo Sapiens
EAVKSGIHR

SEQ ID NO: 49432 - protein, 9 aa, Homo Sapiens
EAVLAAYWR

SEQ ID NO: 49433 - protein, 9 aa, Homo Sapiens
EAVLAMSSR

SEQ ID NO: 49434 - protein, 9 aa, Homo Sapiens
EAVLLLMQR

SEQ ID NO: 49435 - protein, 9 aa, Homo Sapiens
EAVLNVALR

SEQ ID NO: 49436 - protein, 9 aa, Homo Sapiens
EAVLWEALR

SEQ ID NO: 49437 - protein, 9 aa, Homo Sapiens
EAVMILRSR

SEQ ID NO: 49438 - protein, 9 aa, Homo Sapiens
EAVNPTRFR

SEQ ID NO: 49439 - protein, 9 aa, Homo Sapiens
EAVPKFEEM

SEQ ID NO: 49440 - protein, 9 aa, Homo Sapiens
EAVQAKVLR

SEQ ID NO: 49441 - protein, 9 aa, Homo Sapiens
EAVQALRER

SEQ ID NO: 49442 - protein, 9 aa, Homo Sapiens
EAVRKLTAR

SEQ ID NO: 49443 - protein, 9 aa, Homo Sapiens
EAVTGVVGR

SEQ ID NO: 49444 - protein, 9 aa, Homo Sapiens
EAVVGTACR

SEQ ID NO: 49445 - protein, 9 aa, Homo Sapiens
EAYLPETFR

SEQ ID NO: 49446 - protein, 9 aa, Homo Sapiens
EAYSVGTGR

SEQ ID NO: 49447 - protein, 9 aa, Homo Sapiens
EDFYTATER

SEQ ID NO: 49448 - protein, 9 aa, Homo Sapiens
EEIGPSICR

SEQ ID NO: 49449 - protein, 9 aa, Homo Sapiens
EFFGEGKTR

SEQ ID NO: 49450 - protein, 9 aa, Homo Sapiens
EFFLAGIGR

SEQ ID NO: 49451 - protein, 9 aa, Homo Sapiens
EFIEITTER

SEQ ID NO: 49452 - protein, 9 aa, Homo Sapiens
EFSPTFSER

SEQ ID NO: 49453 - protein, 9 aa, Homo Sapiens
EFVDLYVPR

SEQ ID NO: 49454 - protein, 9 aa, Homo Sapiens
EGAFPNLAR

SEQ ID NO: 49455 - protein, 9 aa, Homo Sapiens
EGAGILLTR

SEQ ID NO: 49456 - protein, 9 aa, Homo Sapiens
EGASPLSER

SEQ ID NO: 49457 - protein, 9 aa, Homo Sapiens
EGGPTSVGR

SEQ ID NO: 49458 - protein, 9 aa, Homo Sapiens
EGIGSTVFR

SEQ ID NO: 49459 - protein, 9 aa, Homo Sapiens
EGIKVGHER

SEQ ID NO: 49460 - protein, 9 aa, Homo Sapiens
EGTVVVTER

SEQ ID NO: 49461 - protein, 9 aa, Homo Sapiens
EGVAGGLNR

SEQ ID NO: 49462 - protein, 9 aa, Homo Sapiens
EGVGILLTR

SEQ ID NO: 49463 - protein, 9 aa, Homo Sapiens
EGVNPSVGR

SEQ ID NO: 49464 - protein, 9 aa, Homo Sapiens
EGVPVRGAR

SEQ ID NO: 49465 - protein, 9 aa, Homo Sapiens
EIADPTRFF

SEQ ID NO: 49466 - protein, 9 aa, Homo Sapiens
EIADSSMTR

SEQ ID NO: 49467 - protein, 9 aa, Homo Sapiens
EIADVSTGL

SEQ ID NO: 49468 - protein, 9 aa, Homo Sapiens
EIAGVKLLY

SEQ ID NO: 49469 - protein, 9 aa, Homo Sapiens
EIAVTGAGR

SEQ ID NO: 49470 - protein, 9 aa, Homo Sapiens
EICGNYTYR

SEQ ID NO: 49471 - protein, 9 aa, Homo Sapiens
EIDVVSVEK

SEQ ID NO: 49472 - protein, 9 aa, Homo Sapiens
EIFGTELTR

SEQ ID NO: 49473 - protein, 9 aa, Homo Sapiens
EIFGTIGMR

SEQ ID NO: 49474 - protein, 9 aa, Homo Sapiens
EIFHETGKR

SEQ ID NO: 49475 - protein, 9 aa, Homo Sapiens
EIFQNEVAR

SEQ ID NO: 49476 - protein, 9 aa, Homo Sapiens
EIFSSLLQR

SEQ ID NO: 49477 - protein, 9 aa, Homo Sapiens
EIFVGKIPR

SEQ ID NO: 49478 - protein, 9 aa, Homo Sapiens
EIFYFEVTR

SEQ ID NO: 49479 - protein, 9 aa, Homo Sapiens
EIGDASRVR

SEQ ID NO: 49480 - protein, 9 aa, Homo Sapiens
EIGHIFGLR

SEQ ID NO: 49481 - protein, 9 aa, Homo Sapiens
EIGNMITSR

SEQ ID NO: 49482 - protein, 9 aa, Homo Sapiens
EIGPVSSSR

SEQ ID NO: 49483 - protein, 9 aa, Homo Sapiens
EIGQAGSQR

SEQ ID NO: 49484 - protein, 9 aa, Homo Sapiens
EIGWFPCNR

SEQ ID NO: 49485 - protein, 9 aa, Homo Sapiens
EIIDGTSEM

SEQ ID NO: 49486 - protein, 9 aa, Homo Sapiens
EIIDKRRER

SEQ ID NO: 49487 - protein, 9 aa, Homo Sapiens
EIIEQPKQR

SEQ ID NO: 49488 - protein, 9 aa, Homo Sapiens
EIIEQPRQR

SEQ ID NO: 49489 - protein, 9 aa, Homo Sapiens
EIINATTGR

SEQ ID NO: 49490 - protein, 9 aa, Homo Sapiens
EIINIMQDR

SEQ ID NO: 49491 - protein, 9 aa, Homo Sapiens
EIISKLQGR

SEQ ID NO: 49492 - protein, 9 aa, Homo Sapiens
EIIYAINQR

SEQ ID NO: 49493 - protein, 9 aa, Homo Sapiens
EIKERIAKR

SEQ ID NO: 49494 - protein, 9 aa, Homo Sapiens
EIKHFVSER

SEQ ID NO: 49495 - protein, 9 aa, Homo Sapiens
EIKPPSCLF

SEQ ID NO: 49496 - protein, 9 aa, Homo Sapiens
EIKSLTKER

SEQ ID NO: 49497 - protein, 9 aa, Homo Sapiens
EILEVATAR

SEQ ID NO: 49498 - protein, 9 aa, Homo Sapiens
EILGIANNR

SEQ ID NO: 49499 - protein, 9 aa, Homo Sapiens
EILHHLSER

SEQ ID NO: 49500 - protein, 9 aa, Homo Sapiens
EILSDVASR

SEQ ID NO: 49501 - protein, 9 aa, Homo Sapiens
EIMELWSTR

SEQ ID NO: 49502 - protein, 9 aa, Homo Sapiens
EIMEVAKER

SEQ ID NO: 49503 - protein, 9 aa, Homo Sapiens
EIMPPPPKP

SEQ ID NO: 49504 - protein, 9 aa, Homo Sapiens
EIMQETGTR

SEQ ID NO: 49505 - protein, 9 aa, Homo Sapiens
EINEISYPK

SEQ ID NO: 49506 - protein, 9 aa, Homo Sapiens
EINKLLAHR

SEQ ID NO: 49507 - protein, 9 aa, Homo Sapiens
EIPENFTTR

SEQ ID NO: 49508 - protein, 9 aa, Homo Sapiens
EIPKRFGQR

SEQ ID NO: 49509 - protein, 9 aa, Homo Sapiens
EIQAPTSSK

SEQ ID NO: 49510 - protein, 9 aa, Homo Sapiens
EIQHTTALR

SEQ ID NO: 49511 - protein, 9 aa, Homo Sapiens
EIRSQPVPR

SEQ ID NO: 49512 - protein, 9 aa, Homo Sapiens
EISAPSQQR

SEQ ID NO: 49513 - protein, 9 aa, Homo Sapiens
EISAPVSER

SEQ ID NO: 49514 - protein, 9 aa, Homo Sapiens
EISGTFTHR

SEQ ID NO: 49515 - protein, 9 aa, Homo Sapiens
EISHPDVGR

SEQ ID NO: 49516 - protein, 9 aa, Homo Sapiens
EISKVAAER

SEQ ID NO: 49517 - protein, 9 aa, Homo Sapiens
EISQVCATK

SEQ ID NO: 49518 - protein, 9 aa, Homo Sapiens
EISRAAAER

SEQ ID NO: 49519 - protein, 9 aa, Homo Sapiens
EISSATKLR

SEQ ID NO: 49520 - protein, 9 aa, Homo Sapiens
EISSNSLER

SEQ ID NO: 49521 - protein, 9 aa, Homo Sapiens
EISSPAVER

SEQ ID NO: 49522 - protein, 9 aa, Homo Sapiens
EITIPMRSR

SEQ ID NO: 49523 - protein, 9 aa, Homo Sapiens
EITKAFHVR

SEQ ID NO: 49524 - protein, 9 aa, Homo Sapiens
EIVANVGKR

SEQ ID NO: 49525 - protein, 9 aa, Homo Sapiens
EIVDEKVRR

SEQ ID NO: 49526 - protein, 9 aa, Homo Sapiens
EIVDQIKTR

SEQ ID NO: 49527 - protein, 9 aa, Homo Sapiens
EIVECILKR

SEQ ID NO: 49528 - protein, 9 aa, Homo Sapiens
EIVGSIKMR

SEQ ID NO: 49529 - protein, 9 aa, Homo Sapiens
EIVITGQHR

SEQ ID NO: 49530 - protein, 9 aa, Homo Sapiens
EIVKAIKER

SEQ ID NO: 49531 - protein, 9 aa, Homo Sapiens
EIVMETRQR

SEQ ID NO: 49532 - protein, 9 aa, Homo Sapiens
EIVSRVSKR

SEQ ID NO: 49533 - protein, 9 aa, Homo Sapiens
EIYEYIIFR

SEQ ID NO: 49534 - protein, 9 aa, Homo Sapiens
EIYGVTHTR

SEQ ID NO: 49535 - protein, 9 aa, Homo Sapiens
EIYKPGLSR

SEQ ID NO: 49536 - protein, 9 aa, Homo Sapiens
EIYRPPASR

SEQ ID NO: 49537 - protein, 9 aa, Homo Sapiens
ELAAVINGR

SEQ ID NO: 49538 - protein, 9 aa, Homo Sapiens
ELADHLVKR

SEQ ID NO: 49539 - protein, 9 aa, Homo Sapiens
ELADPTERF

SEQ ID NO: 49540 - protein, 9 aa, Homo Sapiens
ELADVTAKY

SEQ ID NO: 49541 - protein, 9 aa, Homo Sapiens
ELAEKALGK

SEQ ID NO: 49542 - protein, 9 aa, Homo Sapiens
ELAERLGLR

SEQ ID NO: 49543 - protein, 9 aa, Homo Sapiens
ELAGHTGYL

SEQ ID NO: 49544 - protein, 9 aa, Homo Sapiens
ELAIGGVLR

SEQ ID NO: 49545 - protein, 9 aa, Homo Sapiens
ELAKIMRTR

SEQ ID NO: 49546 - protein, 9 aa, Homo Sapiens
ELAMVCSQR

SEQ ID NO: 49547 - protein, 9 aa, Homo Sapiens
ELAPVFLLR

SEQ ID NO: 49548 - protein, 9 aa, Homo Sapiens
ELAQIYAQR

SEQ ID NO: 49549 - protein, 9 aa, Homo Sapiens
ELAQRLSNR

SEQ ID NO: 49550 - protein, 9 aa, Homo Sapiens
ELAQVIVSR

SEQ ID NO: 49551 - protein, 9 aa, Homo Sapiens
ELAQWLIQR

SEQ ID NO: 49552 - protein, 9 aa, Homo Sapiens
ELARLKVHR

SEQ ID NO: 49553 - protein, 9 aa, Homo Sapiens
ELATAVKAR

SEQ ID NO: 49554 - protein, 9 aa, Homo Sapiens
ELAVASFPK

SEQ ID NO: 49555 - protein, 9 aa, Homo Sapiens
ELAVTFIER

SEQ ID NO: 49556 - protein, 9 aa, Homo Sapiens
ELAVVREQR

SEQ ID NO: 49557 - protein, 9 aa, Homo Sapiens
ELCDFVRSR

SEQ ID NO: 49558 - protein, 9 aa, Homo Sapiens
ELEHSGIGR

SEQ ID NO: 49559 - protein, 9 aa, Homo Sapiens
ELFDICLAR

SEQ ID NO: 49560 - protein, 9 aa, Homo Sapiens
ELFGRVTSR

SEQ ID NO: 49561 - protein, 9 aa, Homo Sapiens
ELFKNVCER

SEQ ID NO: 49562 - protein, 9 aa, Homo Sapiens
ELFPAPILR

SEQ ID NO: 49563 - protein, 9 aa, Homo Sapiens
ELFPGLIYR

SEQ ID NO: 49564 - protein, 9 aa, Homo Sapiens
ELFSHPVER

SEQ ID NO: 49565 - protein, 9 aa, Homo Sapiens
ELFSNIVPR

SEQ ID NO: 49566 - protein, 9 aa, Homo Sapiens
ELFSYSCPK

SEQ ID NO: 49567 - protein, 9 aa, Homo Sapiens
ELGFSKVFR

SEQ ID NO: 49568 - protein, 9 aa, Homo Sapiens
ELIAASTQK

SEQ ID NO: 49569 - protein, 9 aa, Homo Sapiens
ELIAKIPNF

SEQ ID NO: 49570 - protein, 9 aa, Homo Sapiens
ELIDFKTRR

SEQ ID NO: 49571 - protein, 9 aa, Homo Sapiens
ELIKESEVK

SEQ ID NO: 49572 - protein, 9 aa, Homo Sapiens
ELIKNPAFK

SEQ ID NO: 49573 - protein, 9 aa, Homo Sapiens
ELIKTVASR

SEQ ID NO: 49574 - protein, 9 aa, Homo Sapiens
ELINFKRKR

SEQ ID NO: 49575 - protein, 9 aa, Homo Sapiens
ELIPGAEFR

SEQ ID NO: 49576 - protein, 9 aa, Homo Sapiens
ELIQDAAAR

SEQ ID NO: 49577 - protein, 9 aa, Homo Sapiens
ELIQDITQR

SEQ ID NO: 49578 - protein, 9 aa, Homo Sapiens
ELIQEITQR

SEQ ID NO: 49579 - protein, 9 aa, Homo Sapiens
ELIRDPKGR

SEQ ID NO: 49580 - protein, 9 aa, Homo Sapiens
ELIRKLQQR

SEQ ID NO: 49581 - protein, 9 aa, Homo Sapiens
ELKAPGISY

SEQ ID NO: 49582 - protein, 9 aa, Homo Sapiens
ELKDPTDHY

SEQ ID NO: 49583 - protein, 9 aa, Homo Sapiens
ELKFKTGLR

SEQ ID NO: 49584 - protein, 9 aa, Homo Sapiens
ELKLGSGNR

SEQ ID NO: 49585 - protein, 9 aa, Homo Sapiens
ELKQEGSLR

SEQ ID NO: 49586 - protein, 9 aa, Homo Sapiens
ELLEPLNER

SEQ ID NO: 49587 - protein, 9 aa, Homo Sapiens
ELLQGGTSR

SEQ ID NO: 49588 - protein, 9 aa, Homo Sapiens
ELLTSSKDR

SEQ ID NO: 49589 - protein, 9 aa, Homo Sapiens
ELMGYIMGK

SEQ ID NO: 49590 - protein, 9 aa, Homo Sapiens
ELMPPPPPK

SEQ ID NO: 49591 - protein, 9 aa, Homo Sapiens
ELNDPMRQR

SEQ ID NO: 49592 - protein, 9 aa, Homo Sapiens
ELNKIFALR

SEQ ID NO: 49593 - protein, 9 aa, Homo Sapiens
ELNPSTGNR

SEQ ID NO: 49594 - protein, 9 aa, Homo Sapiens
ELNVQISER

SEQ ID NO: 49595 - protein, 9 aa, Homo Sapiens
ELPEASAPK

SEQ ID NO: 49596 - protein, 9 aa, Homo Sapiens
ELPGSSAVR

SEQ ID NO: 49597 - protein, 9 aa, Homo Sapiens
ELPPGSTKR

SEQ ID NO: 49598 - protein, 9 aa, Homo Sapiens
ELPPSSCQR

SEQ ID NO: 49599 - protein, 9 aa, Homo Sapiens
ELPRGSIPR

SEQ ID NO: 49600 - protein, 9 aa, Homo Sapiens
ELPSWILMR

SEQ ID NO: 49601 - protein, 9 aa, Homo Sapiens
ELPVPTHRR

SEQ ID NO: 49602 - protein, 9 aa, Homo Sapiens
ELQGHLGRR

SEQ ID NO: 49603 - protein, 9 aa, Homo Sapiens
ELQSALLLR

SEQ ID NO: 49604 - protein, 9 aa, Homo Sapiens
ELRELGAAR

SEQ ID NO: 49605 - protein, 9 aa, Homo Sapiens
ELRELSGHR

SEQ ID NO: 49606 - protein, 9 aa, Homo Sapiens
ELRNASAVM

SEQ ID NO: 49607 - protein, 9 aa, Homo Sapiens
ELRNATAAM

SEQ ID NO: 49608 - protein, 9 aa, Homo Sapiens
ELRPPSRSR

SEQ ID NO: 49609 - protein, 9 aa, Homo Sapiens
ELRQATVAM

SEQ ID NO: 49610 - protein, 9 aa, Homo Sapiens
ELRQPPVKR

SEQ ID NO: 49611 - protein, 9 aa, Homo Sapiens
ELSAGLSKR

SEQ ID NO: 49612 - protein, 9 aa, Homo Sapiens
ELSDLHAHK

SEQ ID NO: 49613 - protein, 9 aa, Homo Sapiens
ELSESLRNR

SEQ ID NO: 49614 - protein, 9 aa, Homo Sapiens
ELSEVLKAR

SEQ ID NO: 49615 - protein, 9 aa, Homo Sapiens
ELSFHSKGR

SEQ ID NO: 49616 - protein, 9 aa, Homo Sapiens
ELSNGSMVR

SEQ ID NO: 49617 - protein, 9 aa, Homo Sapiens
ELSPGGQPR

SEQ ID NO: 49618 - protein, 9 aa, Homo Sapiens
ELSPKVSER

SEQ ID NO: 49619 - protein, 9 aa, Homo Sapiens
ELSPTGRPK

SEQ ID NO: 49620 - protein, 9 aa, Homo Sapiens
ELSQNISAR

SEQ ID NO: 49621 - protein, 9 aa, Homo Sapiens
ELSRLVSER

SEQ ID NO: 49622 - protein, 9 aa, Homo Sapiens
ELSVVTSER

SEQ ID NO: 49623 - protein, 9 aa, Homo Sapiens
ELTDLHGLR

SEQ ID NO: 49624 - protein, 9 aa, Homo Sapiens
ELTKMCTIR

SEQ ID NO: 49625 - protein, 9 aa, Homo Sapiens
ELVDRVFNR

SEQ ID NO: 49626 - protein, 9 aa, Homo Sapiens
ELVDRVLER

SEQ ID NO: 49627 - protein, 9 aa, Homo Sapiens
ELVGPLYAR

SEQ ID NO: 49628 - protein, 9 aa, Homo Sapiens
ELVNAARLR

SEQ ID NO: 49629 - protein, 9 aa, Homo Sapiens
ELVNPHRAR

SEQ ID NO: 49630 - protein, 9 aa, Homo Sapiens
ELVNSGRLR

SEQ ID NO: 49631 - protein, 9 aa, Homo Sapiens
ELVNVLQER

SEQ ID NO: 49632 - protein, 9 aa, Homo Sapiens
ELVPFESPR

SEQ ID NO: 49633 - protein, 9 aa, Homo Sapiens
ELVQTLLER

SEQ ID NO: 49634 - protein, 9 aa, Homo Sapiens
ELVSPKLNR

SEQ ID NO: 49635 - protein, 9 aa, Homo Sapiens
ELVTKAGFR

SEQ ID NO: 49636 - protein, 9 aa, Homo Sapiens
ELYEKVFSR

SEQ ID NO: 49637 - protein, 9 aa, Homo Sapiens
ELYNAPEGR

SEQ ID NO: 49638 - protein, 9 aa, Homo Sapiens
ELYNRMLKR

SEQ ID NO: 49639 - protein, 9 aa, Homo Sapiens
ELYRATREF

SEQ ID NO: 49640 - protein, 9 aa, Homo Sapiens
ELYRVTREY

SEQ ID NO: 49641 - protein, 9 aa, Homo Sapiens
EMFTPILGR

SEQ ID NO: 49642 - protein, 9 aa, Homo Sapiens
EMIGALKER

SEQ ID NO: 49643 - protein, 9 aa, Homo Sapiens
EMIITKQGR

SEQ ID NO: 49644 - protein, 9 aa, Homo Sapiens
EMKGKVLTR

SEQ ID NO: 49645 - protein, 9 aa, Homo Sapiens
EMKLQVTQR

SEQ ID NO: 49646 - protein, 9 aa, Homo Sapiens
EMRDPALGR

SEQ ID NO: 49647 - protein, 9 aa, Homo Sapiens
EMREMLTHR

SEQ ID NO: 49648 - protein, 9 aa, Homo Sapiens
EMSGLPAAR

SEQ ID NO: 49649 - protein, 9 aa, Homo Sapiens
EMTGYVATR

SEQ ID NO: 49650 - protein, 9 aa, Homo Sapiens
EMTPAVRQR

SEQ ID NO: 49651 - protein, 9 aa, Homo Sapiens
EMVEFLCER

SEQ ID NO: 49652 - protein, 9 aa, Homo Sapiens
ENFGNTTPR

SEQ ID NO: 49653 - protein, 9 aa, Homo Sapiens
EPADSHFVR

SEQ ID NO: 49654 - protein, 9 aa, Homo Sapiens
EPAEPLLVR

SEQ ID NO: 49655 - protein, 9 aa, Homo Sapiens
EPAPALSSR

SEQ ID NO: 49656 - protein, 9 aa, Homo Sapiens
EPASPISQR

SEQ ID NO: 49657 - protein, 9 aa, Homo Sapiens
EPFKGEMNR

SEQ ID NO: 49658 - protein, 9 aa, Homo Sapiens
EPFNDPALR

SEQ ID NO: 49659 - protein, 9 aa, Homo Sapiens
EPFSATDPK

SEQ ID NO: 49660 - protein, 9 aa, Homo Sapiens
EPHVSGVKR

SEQ ID NO: 49661 - protein, 9 aa, Homo Sapiens
EPIAEPMRR

SEQ ID NO: 49662 - protein, 9 aa, Homo Sapiens
EPIAMTVPR

SEQ ID NO: 49663 - protein, 9 aa, Homo Sapiens
EPISPPRDR

SEQ ID NO: 49664 - protein, 9 aa, Homo Sapiens
EPLPPTIGR

SEQ ID NO: 49665 - protein, 9 aa, Homo Sapiens
EPSDPMLWR

SEQ ID NO: 49666 - protein, 9 aa, Homo Sapiens
EPSEVFINR

SEQ ID NO: 49667 - protein, 9 aa, Homo Sapiens
EPVEVVAPR

SEQ ID NO: 49668 - protein, 9 aa, Homo Sapiens
EPVSLGSLR

SEQ ID NO: 49669 - protein, 9 aa, Homo Sapiens
EPVSPSRER

SEQ ID NO: 49670 - protein, 9 aa, Homo Sapiens
EPWDGAVFR

SEQ ID NO: 49671 - protein, 9 aa, Homo Sapiens
EPYANPTKR

SEQ ID NO: 49672 - protein, 9 aa, Homo Sapiens
EQAAPSGLR

SEQ ID NO: 49673 - protein, 9 aa, Homo Sapiens
EQAFEVAER

SEQ ID NO: 49674 - protein, 9 aa, Homo Sapiens
EQAFQTIAR

SEQ ID NO: 49675 - protein, 9 aa, Homo Sapiens
EQIDFSAAR

SEQ ID NO: 49676 - protein, 9 aa, Homo Sapiens
EQILPTLVR

SEQ ID NO: 49677 - protein, 9 aa, Homo Sapiens
EQISNLISR

SEQ ID NO: 49678 - protein, 9 aa, Homo Sapiens
EQLSGAGYR

SEQ ID NO: 49679 - protein, 9 aa, Homo Sapiens
EQPEIHTGR

SEQ ID NO: 49680 - protein, 9 aa, Homo Sapiens
EQPYKMAGR

SEQ ID NO: 49681 - protein, 9 aa, Homo Sapiens
EQSPCVLSR

SEQ ID NO: 49682 - protein, 9 aa, Homo Sapiens
EQVDGVSYR

SEQ ID NO: 49683 - protein, 9 aa, Homo Sapiens
EQVLPRDER

SEQ ID NO: 49684 - protein, 9 aa, Homo Sapiens
EQVPQALRR

SEQ ID NO: 49685 - protein, 9 aa, Homo Sapiens
EQYDLATKR

SEQ ID NO: 49686 - protein, 9 aa, Homo Sapiens
ESAAELARR

SEQ ID NO: 49687 - protein, 9 aa, Homo Sapiens
ESAEVPVAR

SEQ ID NO: 49688 - protein, 9 aa, Homo Sapiens
ESAGAYAYK

SEQ ID NO: 49689 - protein, 9 aa, Homo Sapiens
ESAPAWRLR

SEQ ID NO: 49690 - protein, 9 aa, Homo Sapiens
ESAPKASLR

SEQ ID NO: 49691 - protein, 9 aa, Homo Sapiens
ESAPMFSAK

SEQ ID NO: 49692 - protein, 9 aa, Homo Sapiens
ESAPSALEK

SEQ ID NO: 49693 - protein, 9 aa, Homo Sapiens
ESAQDFASR

SEQ ID NO: 49694 - protein, 9 aa, Homo Sapiens
ESAWNLENR

SEQ ID NO: 49695 - protein, 9 aa, Homo Sapiens
ESAYNAFNR

SEQ ID NO: 49696 - protein, 9 aa, Homo Sapiens
ESDFASTFR

SEQ ID NO: 49697 - protein, 9 aa, Homo Sapiens
ESEEVRQFR

SEQ ID NO: 49698 - protein, 9 aa, Homo Sapiens
ESFEGFIAR

SEQ ID NO: 49699 - protein, 9 aa, Homo Sapiens
ESFGVPKGR

SEQ ID NO: 49700 - protein, 9 aa, Homo Sapiens
ESFLAWKKR

SEQ ID NO: 49701 - protein, 9 aa, Homo Sapiens
ESFPRGGTR

SEQ ID NO: 49702 - protein, 9 aa, Homo Sapiens
ESFPSVNSR

SEQ ID NO: 49703 - protein, 9 aa, Homo Sapiens
ESGWRSALR

SEQ ID NO: 49704 - protein, 9 aa, Homo Sapiens
ESHPGTLLR

SEQ ID NO: 49705 - protein, 9 aa, Homo Sapiens
ESHVSGISR

SEQ ID NO: 49706 - protein, 9 aa, Homo Sapiens
ESIAAFIQR

SEQ ID NO: 49707 - protein, 9 aa, Homo Sapiens
ESIDALSNK

SEQ ID NO: 49708 - protein, 9 aa, Homo Sapiens
ESIDKKISR

SEQ ID NO: 49709 - protein, 9 aa, Homo Sapiens
ESIDQYIER

SEQ ID NO: 49710 - protein, 9 aa, Homo Sapiens
ESIEHPLAR

SEQ ID NO: 49711 - protein, 9 aa, Homo Sapiens
ESIKGLCER

SEQ ID NO: 49712 - protein, 9 aa, Homo Sapiens
ESIRAAVNR

SEQ ID NO: 49713 - protein, 9 aa, Homo Sapiens
ESLPATHIR

SEQ ID NO: 49714 - protein, 9 aa, Homo Sapiens
ESMEPKVFR

SEQ ID NO: 49715 - protein, 9 aa, Homo Sapiens
ESNPPSLMR

SEQ ID NO: 49716 - protein, 9 aa, Homo Sapiens
ESSDALLKR

SEQ ID NO: 49717 - protein, 9 aa, Homo Sapiens
ESSFCKRQR

SEQ ID NO: 49718 - protein, 9 aa, Homo Sapiens
ESSLPTGDR

SEQ ID NO: 49719 - protein, 9 aa, Homo Sapiens
ESSPQYRLR

SEQ ID NO: 49720 - protein, 9 aa, Homo Sapiens
ESTNFATLR

SEQ ID NO: 49721 - protein, 9 aa, Homo Sapiens
ESTPITAVK

SEQ ID NO: 49722 - protein, 9 aa, Homo Sapiens
ESTWPSRSR

SEQ ID NO: 49723 - protein, 9 aa, Homo Sapiens
ESVGDRELR

SEQ ID NO: 49724 - protein, 9 aa, Homo Sapiens
ESYYQEIGR

SEQ ID NO: 49725 - protein, 9 aa, Homo Sapiens
ETADITHAL

SEQ ID NO: 49726 - protein, 9 aa, Homo Sapiens
ETAFAFHLR

SEQ ID NO: 49727 - protein, 9 aa, Homo Sapiens
ETAFLSWFR

SEQ ID NO: 49728 - protein, 9 aa, Homo Sapiens
ETAFQGMLR

SEQ ID NO: 49729 - protein, 9 aa, Homo Sapiens
ETAFVSRNR

SEQ ID NO: 49730 - protein, 9 aa, Homo Sapiens
ETAIPFRSR

SEQ ID NO: 49731 - protein, 9 aa, Homo Sapiens
ETAIPSSTR

SEQ ID NO: 49732 - protein, 9 aa, Homo Sapiens
ETAKATPRL

SEQ ID NO: 49733 - protein, 9 aa, Homo Sapiens
ETALNSKAY

SEQ ID NO: 49734 - protein, 9 aa, Homo Sapiens
ETALPSTKA

SEQ ID NO: 49735 - protein, 9 aa, Homo Sapiens
ETAPKSEEF

SEQ ID NO: 49736 - protein, 9 aa, Homo Sapiens
ETAPVGTVL

SEQ ID NO: 49737 - protein, 9 aa, Homo Sapiens
ETAQAIKGM

SEQ ID NO: 49738 - protein, 9 aa, Homo Sapiens
ETAQAMAQL

SEQ ID NO: 49739 - protein, 9 aa, Homo Sapiens
ETASAVATR

SEQ ID NO: 49740 - protein, 9 aa, Homo Sapiens
ETCDKVFSR

SEQ ID NO: 49741 - protein, 9 aa, Homo Sapiens
ETFIKGKER

SEQ ID NO: 49742 - protein, 9 aa, Homo Sapiens
ETFLAQRQR

SEQ ID NO: 49743 - protein, 9 aa, Homo Sapiens
ETFNSITKR

SEQ ID NO: 49744 - protein, 9 aa, Homo Sapiens
ETFQFILGK

SEQ ID NO: 49745 - protein, 9 aa, Homo Sapiens
ETGDSSIFR

SEQ ID NO: 49746 - protein, 9 aa, Homo Sapiens
ETGKITDFI

SEQ ID NO: 49747 - protein, 9 aa, Homo Sapiens
ETGLVTDAF

SEQ ID NO: 49748 - protein, 9 aa, Homo Sapiens
ETHAWFTSR

SEQ ID NO: 49749 - protein, 9 aa, Homo Sapiens
ETHFTGNEV

SEQ ID NO: 49750 - protein, 9 aa, Homo Sapiens
ETHLPAQAR

SEQ ID NO: 49751 - protein, 9 aa, Homo Sapiens
ETIAPKIAR

SEQ ID NO: 49752 - protein, 9 aa, Homo Sapiens
ETIDVHSGY

SEQ ID NO: 49753 - protein, 9 aa, Homo Sapiens
ETIEGALCK

SEQ ID NO: 49754 - protein, 9 aa, Homo Sapiens
ETIEGMLLR

SEQ ID NO: 49755 - protein, 9 aa, Homo Sapiens
ETIEVMEDR

SEQ ID NO: 49756 - protein, 9 aa, Homo Sapiens
ETIGEILKK

SEQ ID NO: 49757 - protein, 9 aa, Homo Sapiens
ETIGKKFEK

SEQ ID NO: 49758 - protein, 9 aa, Homo Sapiens
ETIIITGKR

SEQ ID NO: 49759 - protein, 9 aa, Homo Sapiens
ETIKGHSVR

SEQ ID NO: 49760 - protein, 9 aa, Homo Sapiens
ETIKQLQER

SEQ ID NO: 49761 - protein, 9 aa, Homo Sapiens
ETIKSLLIR

SEQ ID NO: 49762 - protein, 9 aa, Homo Sapiens
ETILRTNKR

SEQ ID NO: 49763 - protein, 9 aa, Homo Sapiens
ETIPSFTGR

SEQ ID NO: 49764 - protein, 9 aa, Homo Sapiens
ETISTATGR

SEQ ID NO: 49765 - protein, 9 aa, Homo Sapiens
ETIYQNYQR

SEQ ID NO: 49766 - protein, 9 aa, Homo Sapiens
ETLMETHER

SEQ ID NO: 49767 - protein, 9 aa, Homo Sapiens
ETMDPFVDR

SEQ ID NO: 49768 - protein, 9 aa, Homo Sapiens
ETNGEFGKR

SEQ ID NO: 49769 - protein, 9 aa, Homo Sapiens
ETNTGEVYR

SEQ ID NO: 49770 - protein, 9 aa, Homo Sapiens
ETNYGIPQR

SEQ ID NO: 49771 - protein, 9 aa, Homo Sapiens
ETQIATILR

SEQ ID NO: 49772 - protein, 9 aa, Homo Sapiens
ETQLPVSFR

SEQ ID NO: 49773 - protein, 9 aa, Homo Sapiens
ETREPPPAY

SEQ ID NO: 49774 - protein, 9 aa, Homo Sapiens
ETRLHITGR

SEQ ID NO: 49775 - protein, 9 aa, Homo Sapiens
ETSALPRPR

SEQ ID NO: 49776 - protein, 9 aa, Homo Sapiens
ETSAPFKER

SEQ ID NO: 49777 - protein, 9 aa, Homo Sapiens
ETSEPLSCR

SEQ ID NO: 49778 - protein, 9 aa, Homo Sapiens
ETSFVPTNM

SEQ ID NO: 49779 - protein, 9 aa, Homo Sapiens
ETSGFPSQR

SEQ ID NO: 49780 - protein, 9 aa, Homo Sapiens
ETSGPTYIK

SEQ ID NO: 49781 - protein, 9 aa, Homo Sapiens
ETSHVTMVV

SEQ ID NO: 49782 - protein, 9 aa, Homo Sapiens
ETSNLIIMR

SEQ ID NO: 49783 - protein, 9 aa, Homo Sapiens
ETSPFGAPR

SEQ ID NO: 49784 - protein, 9 aa, Homo Sapiens
ETSQAGLFR

SEQ ID NO: 49785 - protein, 9 aa, Homo Sapiens
ETSSMASFR

SEQ ID NO: 49786 - protein, 9 aa, Homo Sapiens
ETTGTVTFR

SEQ ID NO: 49787 - protein, 9 aa, Homo Sapiens
ETTSIATAR

SEQ ID NO: 49788 - protein, 9 aa, Homo Sapiens
ETTSNITSR

SEQ ID NO: 49789 - protein, 9 aa, Homo Sapiens
ETTVGNMVR

SEQ ID NO: 49790 - protein, 9 aa, Homo Sapiens
ETVAIGGKR

SEQ ID NO: 49791 - protein, 9 aa, Homo Sapiens
ETVALDAKR

SEQ ID NO: 49792 - protein, 9 aa, Homo Sapiens
ETVDALRSR

SEQ ID NO: 49793 - protein, 9 aa, Homo Sapiens
ETVDMTLRR

SEQ ID NO: 49794 - protein, 9 aa, Homo Sapiens
ETVEDIAAR

SEQ ID NO: 49795 - protein, 9 aa, Homo Sapiens
ETVEGLRKR

SEQ ID NO: 49796 - protein, 9 aa, Homo Sapiens
ETVEKFRQR

SEQ ID NO: 49797 - protein, 9 aa, Homo Sapiens
ETVEKWLKR

SEQ ID NO: 49798 - protein, 9 aa, Homo Sapiens
ETVGSIFSR

SEQ ID NO: 49799 - protein, 9 aa, Homo Sapiens
ETVNQMIAR

SEQ ID NO: 49800 - protein, 9 aa, Homo Sapiens
ETVPAFSER

SEQ ID NO: 49801 - protein, 9 aa, Homo Sapiens
ETVSPTRAR

SEQ ID NO: 49802 - protein, 9 aa, Homo Sapiens
ETVTSFRKR

SEQ ID NO: 49803 - protein, 9 aa, Homo Sapiens
ETYKPHLER

SEQ ID NO: 49804 - protein, 9 aa, Homo Sapiens
ETYLHRIGR

SEQ ID NO: 49805 - protein, 9 aa, Homo Sapiens
ETYLMKHMR

SEQ ID NO: 49806 - protein, 9 aa, Homo Sapiens
ETYLNENLR

SEQ ID NO: 49807 - protein, 9 aa, Homo Sapiens
ETYPVSSPK

SEQ ID NO: 49808 - protein, 9 aa, Homo Sapiens
EVAAAVIQR

SEQ ID NO: 49809 - protein, 9 aa, Homo Sapiens
EVAASGSHL

SEQ ID NO: 49810 - protein, 9 aa, Homo Sapiens
EVAASVIMR

SEQ ID NO: 49811 - protein, 9 aa, Homo Sapiens
EVAAVLLHF

SEQ ID NO: 49812 - protein, 9 aa, Homo Sapiens
EVADLKIKR

SEQ ID NO: 49813 - protein, 9 aa, Homo Sapiens
EVAEESGRL

SEQ ID NO: 49814 - protein, 9 aa, Homo Sapiens
EVAEHVQYM

SEQ ID NO: 49815 - protein, 9 aa, Homo Sapiens
EVAELGRGR

SEQ ID NO: 49816 - protein, 9 aa, Homo Sapiens
EVAELLLER

SEQ ID NO: 49817 - protein, 9 aa, Homo Sapiens
EVAEPSVLF

SEQ ID NO: 49818 - protein, 9 aa, Homo Sapiens
EVAFPHHPR

SEQ ID NO: 49819 - protein, 9 aa, Homo Sapiens
EVAGFGESR

SEQ ID NO: 49820 - protein, 9 aa, Homo Sapiens
EVAGIVAAR

SEQ ID NO: 49821 - protein, 9 aa, Homo Sapiens
EVAGLQVGR

SEQ ID NO: 49822 - protein, 9 aa, Homo Sapiens
EVAGQFVIK

SEQ ID NO: 49823 - protein, 9 aa, Homo Sapiens
EVAIPHNRR

SEQ ID NO: 49824 - protein, 9 aa, Homo Sapiens
EVAIPLPAR

SEQ ID NO: 49825 - protein, 9 aa, Homo Sapiens
EVAKATSHI

SEQ ID NO: 49826 - protein, 9 aa, Homo Sapiens
EVALATGQF

SEQ ID NO: 49827 - protein, 9 aa, Homo Sapiens
EVANIPVAR

SEQ ID NO: 49828 - protein, 9 aa, Homo Sapiens
EVANSTANL

SEQ ID NO: 49829 - protein, 9 aa, Homo Sapiens
EVAPAGASY

SEQ ID NO: 49830 - protein, 9 aa, Homo Sapiens
EVAPCMGDR

SEQ ID NO: 49831 - protein, 9 aa, Homo Sapiens
EVAPDVRLR

SEQ ID NO: 49832 - protein, 9 aa, Homo Sapiens
EVAPPEYHR

SEQ ID NO: 49833 - protein, 9 aa, Homo Sapiens
EVAPPRLVM

SEQ ID NO: 49834 - protein, 9 aa, Homo Sapiens
EVAPTSTAV

SEQ ID NO: 49835 - protein, 9 aa, Homo Sapiens
EVAQAGKAV

SEQ ID NO: 49836 - protein, 9 aa, Homo Sapiens
EVAQETDGF

SEQ ID NO: 49837 - protein, 9 aa, Homo Sapiens
EVAQFLTGR

SEQ ID NO: 49838 - protein, 9 aa, Homo Sapiens
EVAQPSEVL

SEQ ID NO: 49839 - protein, 9 aa, Homo Sapiens
EVAQPSREF

SEQ ID NO: 49840 - protein, 9 aa, Homo Sapiens
EVAQVESLR

SEQ ID NO: 49841 - protein, 9 aa, Homo Sapiens
EVARAQAAL

SEQ ID NO: 49842 - protein, 9 aa, Homo Sapiens
EVARLWGVR

SEQ ID NO: 49843 - protein, 9 aa, Homo Sapiens
EVARYMVQR

SEQ ID NO: 49844 - protein, 9 aa, Homo Sapiens
EVASAVCLR

SEQ ID NO: 49845 - protein, 9 aa, Homo Sapiens
EVASFVTKR

SEQ ID NO: 49846 - protein, 9 aa, Homo Sapiens
EVASGAVLR

SEQ ID NO: 49847 - protein, 9 aa, Homo Sapiens
EVASVWVER

SEQ ID NO: 49848 - protein, 9 aa, Homo Sapiens
EVAVAGTEL

SEQ ID NO: 49849 - protein, 9 aa, Homo Sapiens
EVAVVTTER

SEQ ID NO: 49850 - protein, 9 aa, Homo Sapiens
EVAYDWSER

SEQ ID NO: 49851 - protein, 9 aa, Homo Sapiens
EVDAAMAAR

SEQ ID NO: 49852 - protein, 9 aa, Homo Sapiens
EVECATQLR

SEQ ID NO: 49853 - protein, 9 aa, Homo Sapiens
EVEDTTLNR

SEQ ID NO: 49854 - protein, 9 aa, Homo Sapiens
EVENFSCSR

SEQ ID NO: 49855 - protein, 9 aa, Homo Sapiens
EVFAGVTTH

SEQ ID NO: 49856 - protein, 9 aa, Homo Sapiens
EVFCSVQRL

SEQ ID NO: 49857 - protein, 9 aa, Homo Sapiens
EVFDHMMKR

SEQ ID NO: 49858 - protein, 9 aa, Homo Sapiens
EVFDKTYQF

SEQ ID NO: 49859 - protein, 9 aa, Homo Sapiens
EVFDNSMKR

SEQ ID NO: 49860 - protein, 9 aa, Homo Sapiens
EVFEYIIFR

SEQ ID NO: 49861 - protein, 9 aa, Homo Sapiens
EVFFLKATR

SEQ ID NO: 49862 - protein, 9 aa, Homo Sapiens
EVFFSEKIY

SEQ ID NO: 49863 - protein, 9 aa, Homo Sapiens
EVFGQITER

SEQ ID NO: 49864 - protein, 9 aa, Homo Sapiens
EVFHSGHSR

SEQ ID NO: 49865 - protein, 9 aa, Homo Sapiens
EVFPPTPVR

SEQ ID NO: 49866 - protein, 9 aa, Homo Sapiens
EVFQNANFR

SEQ ID NO: 49867 - protein, 9 aa, Homo Sapiens
EVFRDTVHM

SEQ ID NO: 49868 - protein, 9 aa, Homo Sapiens
EVFRSYVFY

SEQ ID NO: 49869 - protein, 9 aa, Homo Sapiens
EVFSHILKR

SEQ ID NO: 49870 - protein, 9 aa, Homo Sapiens
EVFTPVFER

SEQ ID NO: 49871 - protein, 9 aa, Homo Sapiens
EVFTPVVQR

SEQ ID NO: 49872 - protein, 9 aa, Homo Sapiens
EVFVGKIPR

SEQ ID NO: 49873 - protein, 9 aa, Homo Sapiens
EVFYFEVTR

SEQ ID NO: 49874 - protein, 9 aa, Homo Sapiens
EVGDIVVGR

SEQ ID NO: 49875 - protein, 9 aa, Homo Sapiens
EVGGEALGR

SEQ ID NO: 49876 - protein, 9 aa, Homo Sapiens
EVGGNTLGF

SEQ ID NO: 49877 - protein, 9 aa, Homo Sapiens
EVGKAGHIM

SEQ ID NO: 49878 - protein, 9 aa, Homo Sapiens
EVGKKFSAR

SEQ ID NO: 49879 - protein, 9 aa, Homo Sapiens
EVGLLFTNR

SEQ ID NO: 49880 - protein, 9 aa, Homo Sapiens
EVGNSGVFR

SEQ ID NO: 49881 - protein, 9 aa, Homo Sapiens
EVGPAGSQF

SEQ ID NO: 49882 - protein, 9 aa, Homo Sapiens
EVGPKFRGV

SEQ ID NO: 49883 - protein, 9 aa, Homo Sapiens
EVGPKSTMV

SEQ ID NO: 49884 - protein, 9 aa, Homo Sapiens
EVGPKTYIR

SEQ ID NO: 49885 - protein, 9 aa, Homo Sapiens
EVGPPAFRI

SEQ ID NO: 49886 - protein, 9 aa, Homo Sapiens
EVGPVLSKS

SEQ ID NO: 49887 - protein, 9 aa, Homo Sapiens
EVGSVVSFR

SEQ ID NO: 49888 - protein, 9 aa, Homo Sapiens
EVGVIPSKR

SEQ ID NO: 49889 - protein, 9 aa, Homo Sapiens
EVHAVVTVR

SEQ ID NO: 49890 - protein, 9 aa, Homo Sapiens
EVHGFSMGK

SEQ ID NO: 49891 - protein, 9 aa, Homo Sapiens
EVHRPSHFL

SEQ ID NO: 49892 - protein, 9 aa, Homo Sapiens
EVHTGTTIM

SEQ ID NO: 49893 - protein, 9 aa, Homo Sapiens
EVHWATHQL

SEQ ID NO: 49894 - protein, 9 aa, Homo Sapiens
EVIEALLKK

SEQ ID NO: 49895 - protein, 9 aa, Homo Sapiens
EVIEIMTDR

SEQ ID NO: 49896 - protein, 9 aa, Homo Sapiens
EVIESTNLK

SEQ ID NO: 49897 - protein, 9 aa, Homo Sapiens
EVIFHVSTR

SEQ ID NO: 49898 - protein, 9 aa, Homo Sapiens
EVIGLLGGR

SEQ ID NO: 49899 - protein, 9 aa, Homo Sapiens
EVIKPWITK

SEQ ID NO: 49900 - protein, 9 aa, Homo Sapiens
EVIKQLKEK

SEQ ID NO: 49901 - protein, 9 aa, Homo Sapiens
EVIKSMKPK

SEQ ID NO: 49902 - protein, 9 aa, Homo Sapiens
EVIKVIHGK

SEQ ID NO: 49903 - protein, 9 aa, Homo Sapiens
EVINDYHFR

SEQ ID NO: 49904 - protein, 9 aa, Homo Sapiens
EVIPPMKEF

SEQ ID NO: 49905 - protein, 9 aa, Homo Sapiens
EVIQGLLKK

SEQ ID NO: 49906 - protein, 9 aa, Homo Sapiens
EVIRVTKKK

SEQ ID NO: 49907 - protein, 9 aa, Homo Sapiens
EVISKEILE

SEQ ID NO: 49908 - protein, 9 aa, Homo Sapiens
EVISLINTR

SEQ ID NO: 49909 - protein, 9 aa, Homo Sapiens
EVISRGGPR

SEQ ID NO: 49910 - protein, 9 aa, Homo Sapiens
EVIYNYVQR

SEQ ID NO: 49911 - protein, 9 aa, Homo Sapiens
EVKESPFFR

SEQ ID NO: 49912 - protein, 9 aa, Homo Sapiens
EVKEVAGIK

SEQ ID NO: 49913 - protein, 9 aa, Homo Sapiens
EVKGPGVGL

SEQ ID NO: 49914 - protein, 9 aa, Homo Sapiens
EVKGYWAGL

SEQ ID NO: 49915 - protein, 9 aa, Homo Sapiens
EVKILGKER

SEQ ID NO: 49916 - protein, 9 aa, Homo Sapiens
EVKKICMQR

SEQ ID NO: 49917 - protein, 9 aa, Homo Sapiens
EVKPSIRAR

SEQ ID NO: 49918 - protein, 9 aa, Homo Sapiens
EVKRPGESL

SEQ ID NO: 49919 - protein, 9 aa, Homo Sapiens
EVKSITKER

SEQ ID NO: 49920 - protein, 9 aa, Homo Sapiens
EVLDRVFER

SEQ ID NO: 49921 - protein, 9 aa, Homo Sapiens
EVLGPHLER

SEQ ID NO: 49922 - protein, 9 aa, Homo Sapiens
EVLHGLIGR

SEQ ID NO: 49923 - protein, 9 aa, Homo Sapiens
EVLKHLKER

SEQ ID NO: 49924 - protein, 9 aa, Homo Sapiens
EVLLAEIGR

SEQ ID NO: 49925 - protein, 9 aa, Homo Sapiens
EVLLPSGQR

SEQ ID NO: 49926 - protein, 9 aa, Homo Sapiens
EVLLVSSSR

SEQ ID NO: 49927 - protein, 9 aa, Homo Sapiens
EVLPKPRMR

SEQ ID NO: 49928 - protein, 9 aa, Homo Sapiens
EVLQGGSQR

SEQ ID NO: 49929 - protein, 9 aa, Homo Sapiens
EVLQPLQQR

SEQ ID NO: 49930 - protein, 9 aa, Homo Sapiens
EVLSDPQTR

SEQ ID NO: 49931 - protein, 9 aa, Homo Sapiens
EVLTDAAAR

SEQ ID NO: 49932 - protein, 9 aa, Homo Sapiens
EVLVAGFGR

SEQ ID NO: 49933 - protein, 9 aa, Homo Sapiens
EVLVTGAGR

SEQ ID NO: 49934 - protein, 9 aa, Homo Sapiens
EVLWNVWLE

SEQ ID NO: 49935 - protein, 9 aa, Homo Sapiens
EVMENPSCR

SEQ ID NO: 49936 - protein, 9 aa, Homo Sapiens
EVMFPKNVR

SEQ ID NO: 49937 - protein, 9 aa, Homo Sapiens
EVMGTGAVR

SEQ ID NO: 49938 - protein, 9 aa, Homo Sapiens
EVMQAVARL

SEQ ID NO: 49939 - protein, 9 aa, Homo Sapiens
EVNAATLLL

SEQ ID NO: 49940 - protein, 9 aa, Homo Sapiens
EVNATGVAM

SEQ ID NO: 49941 - protein, 9 aa, Homo Sapiens
EVNAWLVHR

SEQ ID NO: 49942 - protein, 9 aa, Homo Sapiens
EVNCPFQKR

SEQ ID NO: 49943 - protein, 9 aa, Homo Sapiens
EVNDDILAR

SEQ ID NO: 49944 - protein, 9 aa, Homo Sapiens
EVNDKRYLR

SEQ ID NO: 49945 - protein, 9 aa, Homo Sapiens
EVNDRPVRR

SEQ ID NO: 49946 - protein, 9 aa, Homo Sapiens
EVNEQTHFA

SEQ ID NO: 49947 - protein, 9 aa, Homo Sapiens
EVNEVSQNF

SEQ ID NO: 49948 - protein, 9 aa, Homo Sapiens
EVNEWFTKY

SEQ ID NO: 49949 - protein, 9 aa, Homo Sapiens
EVNIPTDLR

SEQ ID NO: 49950 - protein, 9 aa, Homo Sapiens
EVNNELANR

SEQ ID NO: 49951 - protein, 9 aa, Homo Sapiens
EVNQETIQR

SEQ ID NO: 49952 - protein, 9 aa, Homo Sapiens
EVNRVSQSM

SEQ ID NO: 49953 - protein, 9 aa, Homo Sapiens
EVNYINTFR

SEQ ID NO: 49954 - protein, 9 aa, Homo Sapiens
EVPELYHQR

SEQ ID NO: 49955 - protein, 9 aa, Homo Sapiens
EVPEVTRSR

SEQ ID NO: 49956 - protein, 9 aa, Homo Sapiens
EVPPPGPAR

SEQ ID NO: 49957 - protein, 9 aa, Homo Sapiens
EVPPPPNLR

SEQ ID NO: 49958 - protein, 9 aa, Homo Sapiens
EVPSFLVER

SEQ ID NO: 49959 - protein, 9 aa, Homo Sapiens
EVPSFTMGR

SEQ ID NO: 49960 - protein, 9 aa, Homo Sapiens
EVQGPPAKK

SEQ ID NO: 49961 - protein, 9 aa, Homo Sapiens
EVQLESKVR

SEQ ID NO: 49962 - protein, 9 aa, Homo Sapiens
EVQRILHQR

SEQ ID NO: 49963 - protein, 9 aa, Homo Sapiens
EVQVVNTER

SEQ ID NO: 49964 - protein, 9 aa, Homo Sapiens
EVQWHCRAR

SEQ ID NO: 49965 - protein, 9 aa, Homo Sapiens
EVRDPLVTY

SEQ ID NO: 49966 - protein, 9 aa, Homo Sapiens
EVRGGGLTR

SEQ ID NO: 49967 - protein, 9 aa, Homo Sapiens
EVRKLIIRR

SEQ ID NO: 49968 - protein, 9 aa, Homo Sapiens
EVRLGGSLR

SEQ ID NO: 49969 - protein, 9 aa, Homo Sapiens
EVRYQTEGF

SEQ ID NO: 49970 - protein, 9 aa, Homo Sapiens
EVSAATGRF

SEQ ID NO: 49971 - protein, 9 aa, Homo Sapiens
EVSAEVRER

SEQ ID NO: 49972 - protein, 9 aa, Homo Sapiens
EVSCETVKM

SEQ ID NO: 49973 - protein, 9 aa, Homo Sapiens
EVSFSVGGR

SEQ ID NO: 49974 - protein, 9 aa, Homo Sapiens
EVSFVIHNL

SEQ ID NO: 49975 - protein, 9 aa, Homo Sapiens
EVSGCGSLR

SEQ ID NO: 49976 - protein, 9 aa, Homo Sapiens
EVSGIKAAY

SEQ ID NO: 49977 - protein, 9 aa, Homo Sapiens
EVSKDTVMK

SEQ ID NO: 49978 - protein, 9 aa, Homo Sapiens
EVSLPKRGR

SEQ ID NO: 49979 - protein, 9 aa, Homo Sapiens
EVSLPKTSR

SEQ ID NO: 49980 - protein, 9 aa, Homo Sapiens
EVSPIFTQF

SEQ ID NO: 49981 - protein, 9 aa, Homo Sapiens
EVSPPVTVR

SEQ ID NO: 49982 - protein, 9 aa, Homo Sapiens
EVSSIIKKK

SEQ ID NO: 49983 - protein, 9 aa, Homo Sapiens
EVSSLISEK

SEQ ID NO: 49984 - protein, 9 aa, Homo Sapiens
EVSSMVLTK

SEQ ID NO: 49985 - protein, 9 aa, Homo Sapiens
EVSSSLILR

SEQ ID NO: 49986 - protein, 9 aa, Homo Sapiens
EVSSVSPLK

SEQ ID NO: 49987 - protein, 9 aa, Homo Sapiens
EVSTVNVRR

SEQ ID NO: 49988 - protein, 9 aa, Homo Sapiens
EVTAALRER

SEQ ID NO: 49989 - protein, 9 aa, Homo Sapiens
EVTDLLASF

SEQ ID NO: 49990 - protein, 9 aa, Homo Sapiens
EVTDYAIAR

SEQ ID NO: 49991 - protein, 9 aa, Homo Sapiens
EVTDYTTGR

SEQ ID NO: 49992 - protein, 9 aa, Homo Sapiens
EVTEIISQF

SEQ ID NO: 49993 - protein, 9 aa, Homo Sapiens
EVTGEAALR

SEQ ID NO: 49994 - protein, 9 aa, Homo Sapiens
EVTGFGVTR

SEQ ID NO: 49995 - protein, 9 aa, Homo Sapiens
EVTGTGLGR

SEQ ID NO: 49996 - protein, 9 aa, Homo Sapiens
EVTGVLEGR

SEQ ID NO: 49997 - protein, 9 aa, Homo Sapiens
EVTKLVHGR

SEQ ID NO: 49998 - protein, 9 aa, Homo Sapiens
EVTNIITSK

SEQ ID NO: 49999 - protein, 9 aa, Homo Sapiens
EVTQIACGR

SEQ ID NO: 50000 - protein, 9 aa, Homo Sapiens
EVTRVKAVR

SEQ ID NO: 50001 - protein, 9 aa, Homo Sapiens
EVTTTVLVR

SEQ ID NO: 50002 - protein, 9 aa, Homo Sapiens
EVVASAALR

SEQ ID NO: 50003 - protein, 9 aa, Homo Sapiens
EVVCGLIFR

SEQ ID NO: 50004 - protein, 9 aa, Homo Sapiens
EVVDFSSHY

SEQ ID NO: 50005 - protein, 9 aa, Homo Sapiens
EVVDKDSIR

SEQ ID NO: 50006 - protein, 9 aa, Homo Sapiens
EVVDKRNPM

SEQ ID NO: 50007 - protein, 9 aa, Homo Sapiens
EVVDLLLAR

SEQ ID NO: 50008 - protein, 9 aa, Homo Sapiens
EVVDPLGKR

SEQ ID NO: 50009 - protein, 9 aa, Homo Sapiens
EVVDRGAIR

SEQ ID NO: 50010 - protein, 9 aa, Homo Sapiens
EVVDSLVGK

SEQ ID NO: 50011 - protein, 9 aa, Homo Sapiens
EVVEIQIDR

SEQ ID NO: 50012 - protein, 9 aa, Homo Sapiens
EVVELLLAR

SEQ ID NO: 50013 - protein, 9 aa, Homo Sapiens
EVVELSSTR

SEQ ID NO: 50014 - protein, 9 aa, Homo Sapiens
EVVEQGITR

SEQ ID NO: 50015 - protein, 9 aa, Homo Sapiens
EVVGIIESR

SEQ ID NO: 50016 - protein, 9 aa, Homo Sapiens
EVVGSVQGK

SEQ ID NO: 50017 - protein, 9 aa, Homo Sapiens
EVVHINRER

SEQ ID NO: 50018 - protein, 9 aa, Homo Sapiens
EVVKAHPRF

SEQ ID NO: 50019 - protein, 9 aa, Homo Sapiens
EVVLYSGAR

SEQ ID NO: 50020 - protein, 9 aa, Homo Sapiens
EVVNKRFVR

SEQ ID NO: 50021 - protein, 9 aa, Homo Sapiens
EVVPEPVAR

SEQ ID NO: 50022 - protein, 9 aa, Homo Sapiens
EVVPRVTKK

SEQ ID NO: 50023 - protein, 9 aa, Homo Sapiens
EVVQITWNR

SEQ ID NO: 50024 - protein, 9 aa, Homo Sapiens
EVVRTIKER

SEQ ID NO: 50025 - protein, 9 aa, Homo Sapiens
EVVSGVVSK

SEQ ID NO: 50026 - protein, 9 aa, Homo Sapiens
EVVSLLLDR

SEQ ID NO: 50027 - protein, 9 aa, Homo Sapiens
EVVVSGKLR

SEQ ID NO: 50028 - protein, 9 aa, Homo Sapiens
EVVYDLSIR

SEQ ID NO: 50029 - protein, 9 aa, Homo Sapiens
EVVYRFTAR

SEQ ID NO: 50030 - protein, 9 aa, Homo Sapiens
EVWPHSTER

SEQ ID NO: 50031 - protein, 9 aa, Homo Sapiens
EVYAGSHQY

SEQ ID NO: 50032 - protein, 9 aa, Homo Sapiens
EVYDPLSKR

SEQ ID NO: 50033 - protein, 9 aa, Homo Sapiens
EVYKATCLL

SEQ ID NO: 50034 - protein, 9 aa, Homo Sapiens
EVYKELRLR

SEQ ID NO: 50035 - protein, 9 aa, Homo Sapiens
EVYRSTKRL

SEQ ID NO: 50036 - protein, 9 aa, Homo Sapiens
EVYTLAEHR

SEQ ID NO: 50037 - protein, 9 aa, Homo Sapiens
EVYVGAVNR

SEQ ID NO: 50038 - protein, 9 aa, Homo Sapiens
EYVGPRLSR

SEQ ID NO: 50039 - protein, 9 aa, Homo Sapiens
FAMNVGKAR

SEQ ID NO: 50040 - protein, 9 aa, Homo Sapiens
FASQGGLAR

SEQ ID NO: 50041 - protein, 9 aa, Homo Sapiens
FIFEHIIKR

SEQ ID NO: 50042 - protein, 9 aa, Homo Sapiens
FIRDPSTSR

SEQ ID NO: 50043 - protein, 9 aa, Homo Sapiens
FPRKPSAPK

SEQ ID NO: 50044 - protein, 9 aa, Homo Sapiens
FPVRPGSGR

SEQ ID NO: 50045 - protein, 9 aa, Homo Sapiens
FTNKPTTFR

SEQ ID NO: 50046 - protein, 9 aa, Homo Sapiens
FVAELAAER

SEQ ID NO: 50047 - protein, 9 aa, Homo Sapiens
FVAGLGKVR

SEQ ID NO: 50048 - protein, 9 aa, Homo Sapiens
FVAPPTAAV

SEQ ID NO: 50049 - protein, 9 aa, Homo Sapiens
FVAQPGLSR

SEQ ID NO: 50050 - protein, 9 aa, Homo Sapiens
FVFGLPLER

SEQ ID NO: 50051 - protein, 9 aa, Homo Sapiens
FVHVAITNR

SEQ ID NO: 50052 - protein, 9 aa, Homo Sapiens
FVIGCYLDR

SEQ ID NO: 50053 - protein, 9 aa, Homo Sapiens
FVIKPKIQR

SEQ ID NO: 50054 - protein, 9 aa, Homo Sapiens
FVISPPALR

SEQ ID NO: 50055 - protein, 9 aa, Homo Sapiens
FVNQSSKCR

SEQ ID NO: 50056 - protein, 9 aa, Homo Sapiens
FVSPPTHGR

SEQ ID NO: 50057 - protein, 9 aa, Homo Sapiens
FVTPVTNQR

SEQ ID NO: 50058 - protein, 9 aa, Homo Sapiens
FVTSMMTGR

SEQ ID NO: 50059 - protein, 9 aa, Homo Sapiens
FVVGTERGR

SEQ ID NO: 50060 - protein, 9 aa, Homo Sapiens
FVYGEPVTR

SEQ ID NO: 50061 - protein, 9 aa, Homo Sapiens
FVYGSGVYR

SEQ ID NO: 50062 - protein, 9 aa, Homo Sapiens
GAVDPSVQR

SEQ ID NO: 50063 - protein, 9 aa, Homo Sapiens
GGPGGVGGL

SEQ ID NO: 50064 - protein, 9 aa, Homo Sapiens
GPGPRPLAR

SEQ ID NO: 50065 - protein, 9 aa, Homo Sapiens
GPIGPAGAR

SEQ ID NO: 50066 - protein, 9 aa, Homo Sapiens
GTYVSSVPR

SEQ ID NO: 50067 - protein, 9 aa, Homo Sapiens
GVADALLYR

SEQ ID NO: 50068 - protein, 9 aa, Homo Sapiens
GVAPVFKKR

SEQ ID NO: 50069 - protein, 9 aa, Homo Sapiens
GVIGQRMPR

SEQ ID NO: 50070 - protein, 9 aa, Homo Sapiens
GVKVPGEYR

SEQ ID NO: 50071 - protein, 9 aa, Homo Sapiens
GVSPVITVR

SEQ ID NO: 50072 - protein, 9 aa, Homo Sapiens
HAGPPSTSR

SEQ ID NO: 50073 - protein, 9 aa, Homo Sapiens
HIDVITAEM

SEQ ID NO: 50074 - protein, 9 aa, Homo Sapiens
HIGKPSTIR

SEQ ID NO: 50075 - protein, 9 aa, Homo Sapiens
HIMGEAMER

SEQ ID NO: 50076 - protein, 9 aa, Homo Sapiens
HISCVIKER

SEQ ID NO: 50077 - protein, 9 aa, Homo Sapiens
HLPSGVKSL

SEQ ID NO: 50078 - protein, 9 aa, Homo Sapiens
HSPGAVSSL

SEQ ID NO: 50079 - protein, 9 aa, Homo Sapiens
HTIAPMGTR

SEQ ID NO: 50080 - protein, 9 aa, Homo Sapiens
HVAKIVTQR

SEQ ID NO: 50081 - protein, 9 aa, Homo Sapiens
HVAQIYAIR

SEQ ID NO: 50082 - protein, 9 aa, Homo Sapiens
HVASVLCQR

SEQ ID NO: 50083 - protein, 9 aa, Homo Sapiens
HVAVPTHFF

SEQ ID NO: 50084 - protein, 9 aa, Homo Sapiens
HVFGRSLLR

SEQ ID NO: 50085 - protein, 9 aa, Homo Sapiens
HVFLRTTGR

SEQ ID NO: 50086 - protein, 9 aa, Homo Sapiens
HVIQPRADR

SEQ ID NO: 50087 - protein, 9 aa, Homo Sapiens
HVRDGSVVR

SEQ ID NO: 50088 - protein, 9 aa, Homo Sapiens
HVSGIGTRR

SEQ ID NO: 50089 - protein, 9 aa, Homo Sapiens
HVVDIVALK

SEQ ID NO: 50090 - protein, 9 aa, Homo Sapiens
HVVSEGVPR

SEQ ID NO: 50091 - protein, 9 aa, Homo Sapiens
IAGDGSVFR

SEQ ID NO: 50092 - protein, 9 aa, Homo Sapiens
IIADSSTFR

SEQ ID NO: 50093 - protein, 9 aa, Homo Sapiens
IILGPTKDR

SEQ ID NO: 50094 - protein, 9 aa, Homo Sapiens
IIVDIATKR

SEQ ID NO: 50095 - protein, 9 aa, Homo Sapiens
ILADATAKM

SEQ ID NO: 50096 - protein, 9 aa, Homo Sapiens
IPGEESSLR

SEQ ID NO: 50097 - protein, 9 aa, Homo Sapiens
IPRTPSSFR

SEQ ID NO: 50098 - protein, 9 aa, Homo Sapiens
IPSGVSGRR

SEQ ID NO: 50099 - protein, 9 aa, Homo Sapiens
ITQIEHEVS

SEQ ID NO: 50100 - protein, 9 aa, Homo Sapiens
IVAPGGALR

SEQ ID NO: 50101 - protein, 9 aa, Homo Sapiens
IVGDPSTAK

SEQ ID NO: 50102 - protein, 9 aa, Homo Sapiens
IVIKGTSER

SEQ ID NO: 50103 - protein, 9 aa, Homo Sapiens
IVKPPASAR

SEQ ID NO: 50104 - protein, 9 aa, Homo Sapiens
IVKQAGLER

SEQ ID NO: 50105 - protein, 9 aa, Homo Sapiens
IVNRTIANM

SEQ ID NO: 50106 - protein, 9 aa, Homo Sapiens
IVQAPSGNR

SEQ ID NO: 50107 - protein, 9 aa, Homo Sapiens
IVQAVSAHR

SEQ ID NO: 50108 - protein, 9 aa, Homo Sapiens
IVRDQTELR

SEQ ID NO: 50109 - protein, 9 aa, Homo Sapiens
IVVDPFDPR

SEQ ID NO: 50110 - protein, 9 aa, Homo Sapiens
IVVPRTMVR

SEQ ID NO: 50111 - protein, 9 aa, Homo Sapiens
IVYGQPRTR

SEQ ID NO: 50112 - protein, 9 aa, Homo Sapiens
KAPVTKVAA

SEQ ID NO: 50113 - protein, 9 aa, Homo Sapiens
LAAPASLRP

SEQ ID NO: 50114 - protein, 9 aa, Homo Sapiens
LAAPSGLER

SEQ ID NO: 50115 - protein, 9 aa, Homo Sapiens
LAINGSANR

SEQ ID NO: 50116 - protein, 9 aa, Homo Sapiens
LANDPTSLR

SEQ ID NO: 50117 - protein, 9 aa, Homo Sapiens
LASQPSIPR

SEQ ID NO: 50118 - protein, 9 aa, Homo Sapiens
LIIGPSKER

SEQ ID NO: 50119 - protein, 9 aa, Homo Sapiens
LPAEQGSPR

SEQ ID NO: 50120 - protein, 9 aa, Homo Sapiens
LPFGSSPHR

SEQ ID NO: 50121 - protein, 9 aa, Homo Sapiens
LPHGNVSAR

SEQ ID NO: 50122 - protein, 9 aa, Homo Sapiens
LPSPISTNR

SEQ ID NO: 50123 - protein, 9 aa, Homo Sapiens
LPTAPRAAR

SEQ ID NO: 50124 - protein, 9 aa, Homo Sapiens
LSDPSIPGR

SEQ ID NO: 50125 - protein, 9 aa, Homo Sapiens
LSSKSGLSR

SEQ ID NO: 50126 - protein, 9 aa, Homo Sapiens
LTAPSTSAR

SEQ ID NO: 50127 - protein, 9 aa, Homo Sapiens
LVAQATATR

SEQ ID NO: 50128 - protein, 9 aa, Homo Sapiens
LVGPVPAGR

SEQ ID NO: 50129 - protein, 9 aa, Homo Sapiens
LVHKPSEER

SEQ ID NO: 50130 - protein, 9 aa, Homo Sapiens
LVIGGSSER

SEQ ID NO: 50131 - protein, 9 aa, Homo Sapiens
LVIKNSTSR

SEQ ID NO: 50132 - protein, 9 aa, Homo Sapiens
LVSQPGLNR

SEQ ID NO: 50133 - protein, 9 aa, Homo Sapiens
LVVENSAQR

SEQ ID NO: 50134 - protein, 9 aa, Homo Sapiens
LVVHPGTAR

SEQ ID NO: 50135 - protein, 9 aa, Homo Sapiens
LVVPPSRYR

SEQ ID NO: 50136 - protein, 9 aa, Homo Sapiens
MAAAAFAEK

SEQ ID NO: 50137 - protein, 9 aa, Homo Sapiens
MAAPSWRGA

SEQ ID NO: 50138 - protein, 9 aa, Homo Sapiens
MAGPGGLAR

SEQ ID NO: 50139 - protein, 9 aa, Homo Sapiens
MAIDGVAPR

SEQ ID NO: 50140 - protein, 9 aa, Homo Sapiens
MAVEAGQSR

SEQ ID NO: 50141 - protein, 9 aa, Homo Sapiens
MAVSSDTCR

SEQ ID NO: 50142 - protein, 9 aa, Homo Sapiens
MAVTALAAR

SEQ ID NO: 50143 - protein, 9 aa, Homo Sapiens
MIVRPSQPR

SEQ ID NO: 50144 - protein, 9 aa, Homo Sapiens
MLHPSSRPR

SEQ ID NO: 50145 - protein, 9 aa, Homo Sapiens
MLVDPKHHR

SEQ ID NO: 50146 - protein, 9 aa, Homo Sapiens
MPHTSGMNR

SEQ ID NO: 50147 - protein, 9 aa, Homo Sapiens
MSISGSSAR

SEQ ID NO: 50148 - protein, 9 aa, Homo Sapiens
MSSPPSAAR

SEQ ID NO: 50149 - protein, 9 aa, Homo Sapiens
MVADVFSHR

SEQ ID NO: 50150 - protein, 9 aa, Homo Sapiens
MVAHELSNR

SEQ ID NO: 50151 - protein, 9 aa, Homo Sapiens
MVGPPGTGK

SEQ ID NO: 50152 - protein, 9 aa, Homo Sapiens
MVKFGGSGR

SEQ ID NO: 50153 - protein, 9 aa, Homo Sapiens
MVLAHVTNR

SEQ ID NO: 50154 - protein, 9 aa, Homo Sapiens
MVTGQTVCK

SEQ ID NO: 50155 - protein, 9 aa, Homo Sapiens
MVYDSPLCR

SEQ ID NO: 50156 - protein, 9 aa, Homo Sapiens
MVYQKAAMR

SEQ ID NO: 50157 - protein, 9 aa, Homo Sapiens
NAIGGKYNR

SEQ ID NO: 50158 - protein, 9 aa, Homo Sapiens
NIINETTTR

SEQ ID NO: 50159 - protein, 9 aa, Homo Sapiens
NIKNSSVPR

SEQ ID NO: 50160 - protein, 9 aa, Homo Sapiens
NIQKITKSM

SEQ ID NO: 50161 - protein, 9 aa, Homo Sapiens
NLCAIHAKR

SEQ ID NO: 50162 - protein, 9 aa, Homo Sapiens
NLMGKTSER

SEQ ID NO: 50163 - protein, 9 aa, Homo Sapiens
NPIGQGAGR

SEQ ID NO: 50164 - protein, 9 aa, Homo Sapiens
NVADLTSLR

SEQ ID NO: 50165 - protein, 9 aa, Homo Sapiens
NVAGSTLSR

SEQ ID NO: 50166 - protein, 9 aa, Homo Sapiens
NVHGGTILK

SEQ ID NO: 50167 - protein, 9 aa, Homo Sapiens
NVKGPGLQR

SEQ ID NO: 50168 - protein, 9 aa, Homo Sapiens
NVNEVISNR

SEQ ID NO: 50169 - protein, 9 aa, Homo Sapiens
NVTGIAHRR

SEQ ID NO: 50170 - protein, 9 aa, Homo Sapiens
NVVSVDTAR

SEQ ID NO: 50171 - protein, 9 aa, Homo Sapiens
NVYGQITVR

SEQ ID NO: 50172 - protein, 9 aa, Homo Sapiens
PFDITVMIR

SEQ ID NO: 50173 - protein, 9 aa, Homo Sapiens
QAAFFGSYR

SEQ ID NO: 50174 - protein, 9 aa, Homo Sapiens
QAAQPTRWV

SEQ ID NO: 50175 - protein, 9 aa, Homo Sapiens
QAGPSGLQR

SEQ ID NO: 50176 - protein, 9 aa, Homo Sapiens
QAIKGMHIR

SEQ ID NO: 50177 - protein, 9 aa, Homo Sapiens
QAISPGMKR

SEQ ID NO: 50178 - protein, 9 aa, Homo Sapiens
QAKIPGLKR

SEQ ID NO: 50179 - protein, 9 aa, Homo Sapiens
QAPQPQSSL

SEQ ID NO: 50180 - protein, 9 aa, Homo Sapiens
QAQKPSVPR

SEQ ID NO: 50181 - protein, 9 aa, Homo Sapiens
QDVDLSPIT

SEQ ID NO: 50182 - protein, 9 aa, Homo Sapiens
QGFFTGRGR

SEQ ID NO: 50183 - protein, 9 aa, Homo Sapiens
QIAEPSTSR

SEQ ID NO: 50184 - protein, 9 aa, Homo Sapiens
QIFSGTSKR

SEQ ID NO: 50185 - protein, 9 aa, Homo Sapiens
QIGPVSSSR

SEQ ID NO: 50186 - protein, 9 aa, Homo Sapiens
QILEQPKQR

SEQ ID NO: 50187 - protein, 9 aa, Homo Sapiens
QIVPPGRQR

SEQ ID NO: 50188 - protein, 9 aa, Homo Sapiens
QPAAPSLTR

SEQ ID NO: 50189 - protein, 9 aa, Homo Sapiens
QPAPPGSER

SEQ ID NO: 50190 - protein, 9 aa, Homo Sapiens
QPAPRSIFR

SEQ ID NO: 50191 - protein, 9 aa, Homo Sapiens
QPFGRGAMR

SEQ ID NO: 50192 - protein, 9 aa, Homo Sapiens
QPSDPSLGR

SEQ ID NO: 50193 - protein, 9 aa, Homo Sapiens
QPSQPLGCR

SEQ ID NO: 50194 - protein, 9 aa, Homo Sapiens
QSLQSFWPR

SEQ ID NO: 50195 - protein, 9 aa, Homo Sapiens
QTHFQLAYR

SEQ ID NO: 50196 - protein, 9 aa, Homo Sapiens
QTVGPSHAR

SEQ ID NO: 50197 - protein, 9 aa, Homo Sapiens
QVADVVVSR

SEQ ID NO: 50198 - protein, 9 aa, Homo Sapiens
QVAGITGAR

SEQ ID NO: 50199 - protein, 9 aa, Homo Sapiens
QVAPEATVR

SEQ ID NO: 50200 - protein, 9 aa, Homo Sapiens
QVAPPVLKR

SEQ ID NO: 50201 - protein, 9 aa, Homo Sapiens
QVAQFSTVR

SEQ ID NO: 50202 - protein, 9 aa, Homo Sapiens
QVATVIQSR

SEQ ID NO: 50203 - protein, 9 aa, Homo Sapiens
QVFEKSPLR

SEQ ID NO: 50204 - protein, 9 aa, Homo Sapiens
QVFLGGRNR

SEQ ID NO: 50205 - protein, 9 aa, Homo Sapiens
QVFPGLLER

SEQ ID NO: 50206 - protein, 9 aa, Homo Sapiens
QVGGVTAYF

SEQ ID NO: 50207 - protein, 9 aa, Homo Sapiens
QVIKGVLFR

SEQ ID NO: 50208 - protein, 9 aa, Homo Sapiens
QVSESGVHR

SEQ ID NO: 50209 - protein, 9 aa, Homo Sapiens
QVSTHKQSE

SEQ ID NO: 50210 - protein, 9 aa, Homo Sapiens
QVVDKVTQR

SEQ ID NO: 50211 - protein, 9 aa, Homo Sapiens
QVVKPTAER

SEQ ID NO: 50212 - protein, 9 aa, Homo Sapiens
QVYPIIAER

SEQ ID NO: 50213 - protein, 9 aa, Homo Sapiens
RPFRGSVGR

SEQ ID NO: 50214 - protein, 9 aa, Homo Sapiens
SAAEVGFVR

SEQ ID NO: 50215 - protein, 9 aa, Homo Sapiens
SAAPAITCR

SEQ ID NO: 50216 - protein, 9 aa, Homo Sapiens
SAAPPTVGR

SEQ ID NO: 50217 - protein, 9 aa, Homo Sapiens
SAGGSFTVR

SEQ ID NO: 50218 - protein, 9 aa, Homo Sapiens
SAGPSTAKL

SEQ ID NO: 50219 - protein, 9 aa, Homo Sapiens
SAHFSPVLR

SEQ ID NO: 50220 - protein, 9 aa, Homo Sapiens
SAPTETHSL

SEQ ID NO: 50221 - protein, 9 aa, Homo Sapiens
SASHVSSFR

SEQ ID NO: 50222 - protein, 9 aa, Homo Sapiens
SASLPSSGR

SEQ ID NO: 50223 - protein, 9 aa, Homo Sapiens
SAVAGRLER

SEQ ID NO: 50224 - protein, 9 aa, Homo Sapiens
SAVGKLSSR

SEQ ID NO: 50225 - protein, 9 aa, Homo Sapiens
SIIEHTRER

SEQ ID NO: 50226 - protein, 9 aa, Homo Sapiens
SIIGKGGQR

SEQ ID NO: 50227 - protein, 9 aa, Homo Sapiens
SIIGVTEPR

SEQ ID NO: 50228 - protein, 9 aa, Homo Sapiens
SINKPTSER

SEQ ID NO: 50229 - protein, 9 aa, Homo Sapiens
SISGPFGSR

SEQ ID NO: 50230 - protein, 9 aa, Homo Sapiens
SLADIMAKR

SEQ ID NO: 50231 - protein, 9 aa, Homo Sapiens
SLNTPGSFR

SEQ ID NO: 50232 - protein, 9 aa, Homo Sapiens
SLRFSPTGR

SEQ ID NO: 50233 - protein, 9 aa, Homo Sapiens
SLVSPLSPR

SEQ ID NO: 50234 - protein, 9 aa, Homo Sapiens
SLYGPGTNR

SEQ ID NO: 50235 - protein, 9 aa, Homo Sapiens
SPASIGQPR

SEQ ID NO: 50236 - protein, 9 aa, Homo Sapiens
SPIDMTSKR

SEQ ID NO: 50237 - protein, 9 aa, Homo Sapiens
SPIVSGARR

SEQ ID NO: 50238 - protein, 9 aa, Homo Sapiens
SSALPTTGR

SEQ ID NO: 50239 - protein, 9 aa, Homo Sapiens
SSMFGTLPR

SEQ ID NO: 50240 - protein, 9 aa, Homo Sapiens
SSPAPRTAL

SEQ ID NO: 50241 - protein, 9 aa, Homo Sapiens
SVAALTSKR

SEQ ID NO: 50242 - protein, 9 aa, Homo Sapiens
SVAEERAGR

SEQ ID NO: 50243 - protein, 9 aa, Homo Sapiens
SVAEISSHM

SEQ ID NO: 50244 - protein, 9 aa, Homo Sapiens
SVAFSSDNR

SEQ ID NO: 50245 - protein, 9 aa, Homo Sapiens
SVAKTILKR

SEQ ID NO: 50246 - protein, 9 aa, Homo Sapiens
SVAPPGGSR

SEQ ID NO: 50247 - protein, 9 aa, Homo Sapiens
SVARITCVR

SEQ ID NO: 50248 - protein, 9 aa, Homo Sapiens
SVASASTTR

SEQ ID NO: 50249 - protein, 9 aa, Homo Sapiens
SVELVTQQM

SEQ ID NO: 50250 - protein, 9 aa, Homo Sapiens
SVFLYQSLR

SEQ ID NO: 50251 - protein, 9 aa, Homo Sapiens
SVHAPSLRR

SEQ ID NO: 50252 - protein, 9 aa, Homo Sapiens
SVHLSPCFR

SEQ ID NO: 50253 - protein, 9 aa, Homo Sapiens
SVHSPSTSM

SEQ ID NO: 50254 - protein, 9 aa, Homo Sapiens
SVHVPGMNR

SEQ ID NO: 50255 - protein, 9 aa, Homo Sapiens
SVIGAREER

SEQ ID NO: 50256 - protein, 9 aa, Homo Sapiens
SVIPNCQFR

SEQ ID NO: 50257 - protein, 9 aa, Homo Sapiens
SVIQDMAVR

SEQ ID NO: 50258 - protein, 9 aa, Homo Sapiens
SVIQTAGYR

SEQ ID NO: 50259 - protein, 9 aa, Homo Sapiens
SVISGISSR

SEQ ID NO: 50260 - protein, 9 aa, Homo Sapiens
SVISPVGNR

SEQ ID NO: 50261 - protein, 9 aa, Homo Sapiens
SVKEVALGR

SEQ ID NO: 50262 - protein, 9 aa, Homo Sapiens
SVLEGMGFR

SEQ ID NO: 50263 - protein, 9 aa, Homo Sapiens
SVLNFATNR

SEQ ID NO: 50264 - protein, 9 aa, Homo Sapiens
SVMGVTVSR

SEQ ID NO: 50265 - protein, 9 aa, Homo Sapiens
SVQRPGLAR

SEQ ID NO: 50266 - protein, 9 aa, Homo Sapiens
SVSDIIRLR

SEQ ID NO: 50267 - protein, 9 aa, Homo Sapiens
SVSEVVVNR

SEQ ID NO: 50268 - protein, 9 aa, Homo Sapiens
SVSPSASFR

SEQ ID NO: 50269 - protein, 9 aa, Homo Sapiens
SVSPVVHVR

SEQ ID NO: 50270 - protein, 9 aa, Homo Sapiens
SVTDAVALR

SEQ ID NO: 50271 - protein, 9 aa, Homo Sapiens
SVVEIASLR

SEQ ID NO: 50272 - protein, 9 aa, Homo Sapiens
SVVEPGRRR

SEQ ID NO: 50273 - protein, 9 aa, Homo Sapiens
SVVEVICER

SEQ ID NO: 50274 - protein, 9 aa, Homo Sapiens
TAAAPTLRR

SEQ ID NO: 50275 - protein, 9 aa, Homo Sapiens
TAAFGHVQR

SEQ ID NO: 50276 - protein, 9 aa, Homo Sapiens
TAAGGFQQR

SEQ ID NO: 50277 - protein, 9 aa, Homo Sapiens
TAAPPSVCR

SEQ ID NO: 50278 - protein, 9 aa, Homo Sapiens
TAGIIGVNR

SEQ ID NO: 50279 - protein, 9 aa, Homo Sapiens
TAGPHTQFV

SEQ ID NO: 50280 - protein, 9 aa, Homo Sapiens
TAIKGVGRR

SEQ ID NO: 50281 - protein, 9 aa, Homo Sapiens
TAMLPSSQR

SEQ ID NO: 50282 - protein, 9 aa, Homo Sapiens
TAMPPGTAR

SEQ ID NO: 50283 - protein, 9 aa, Homo Sapiens
TASGIANLR

SEQ ID NO: 50284 - protein, 9 aa, Homo Sapiens
TAVAALSGR

SEQ ID NO: 50285 - protein, 9 aa, Homo Sapiens
TIFEEPRER

SEQ ID NO: 50286 - protein, 9 aa, Homo Sapiens
TIIDAPGHR

SEQ ID NO: 50287 - protein, 9 aa, Homo Sapiens
TIIDIITHR

SEQ ID NO: 50288 - protein, 9 aa, Homo Sapiens
TIIEVNGKR

SEQ ID NO: 50289 - protein, 9 aa, Homo Sapiens
TIVNILTNR

SEQ ID NO: 50290 - protein, 9 aa, Homo Sapiens
TLAEVMRQR

SEQ ID NO: 50291 - protein, 9 aa, Homo Sapiens
TLSPAFSTR

SEQ ID NO: 50292 - protein, 9 aa, Homo Sapiens
TLSSVTSAR

SEQ ID NO: 50293 - protein, 9 aa, Homo Sapiens
TPAGGGFPR

SEQ ID NO: 50294 - protein, 9 aa, Homo Sapiens
TPASATLGR

SEQ ID NO: 50295 - protein, 9 aa, Homo Sapiens
TPFHGHVGR

SEQ ID NO: 50296 - protein, 9 aa, Homo Sapiens
TPKKPGLRR

SEQ ID NO: 50297 - protein, 9 aa, Homo Sapiens
TPMSVTSQR

SEQ ID NO: 50298 - protein, 9 aa, Homo Sapiens
TPSDINSPR

SEQ ID NO: 50299 - protein, 9 aa, Homo Sapiens
TPYAGGLFR

SEQ ID NO: 50300 - protein, 9 aa, Homo Sapiens
TSGLPSSVR

SEQ ID NO: 50301 - protein, 9 aa, Homo Sapiens
TSGPIGGLR

SEQ ID NO: 50302 - protein, 9 aa, Homo Sapiens
TSSPSSIPR

SEQ ID NO: 50303 - protein, 9 aa, Homo Sapiens
TTAPVVSTR

SEQ ID NO: 50304 - protein, 9 aa, Homo Sapiens
TTVGTLSQR

SEQ ID NO: 50305 - protein, 9 aa, Homo Sapiens
TVAAVCATR

SEQ ID NO: 50306 - protein, 9 aa, Homo Sapiens
TVAAVFRGR

SEQ ID NO: 50307 - protein, 9 aa, Homo Sapiens
TVAHAISER

SEQ ID NO: 50308 - protein, 9 aa, Homo Sapiens
TVAQITQRF

SEQ ID NO: 50309 - protein, 9 aa, Homo Sapiens
TVASKTQYF

SEQ ID NO: 50310 - protein, 9 aa, Homo Sapiens
TVASSTQKF

SEQ ID NO: 50311 - protein, 9 aa, Homo Sapiens
TVATQTQFF

SEQ ID NO: 50312 - protein, 9 aa, Homo Sapiens
TVFESRNLR

SEQ ID NO: 50313 - protein, 9 aa, Homo Sapiens
TVFGPTLLR

SEQ ID NO: 50314 - protein, 9 aa, Homo Sapiens
TVFHSLASR

SEQ ID NO: 50315 - protein, 9 aa, Homo Sapiens
TVFITGASR

SEQ ID NO: 50316 - protein, 9 aa, Homo Sapiens
TVFRSTDFF

SEQ ID NO: 50317 - protein, 9 aa, Homo Sapiens
TVGGGEMAR

SEQ ID NO: 50318 - protein, 9 aa, Homo Sapiens
TVGGWVSTR

SEQ ID NO: 50319 - protein, 9 aa, Homo Sapiens
TVGKATGFL

SEQ ID NO: 50320 - protein, 9 aa, Homo Sapiens
TVIADICRR

SEQ ID NO: 50321 - protein, 9 aa, Homo Sapiens
TVIDIHTLR

SEQ ID NO: 50322 - protein, 9 aa, Homo Sapiens
TVIKQTMER

SEQ ID NO: 50323 - protein, 9 aa, Homo Sapiens
TVIKVMTTR

SEQ ID NO: 50324 - protein, 9 aa, Homo Sapiens
TVIPPGLTR

SEQ ID NO: 50325 - protein, 9 aa, Homo Sapiens
TVISRVIGR

SEQ ID NO: 50326 - protein, 9 aa, Homo Sapiens
TVLFTGVRR

SEQ ID NO: 50327 - protein, 9 aa, Homo Sapiens
TVRDAVVGR

SEQ ID NO: 50328 - protein, 9 aa, Homo Sapiens
TVSAAVAER

SEQ ID NO: 50329 - protein, 9 aa, Homo Sapiens
TVSGPGVAR

SEQ ID NO: 50330 - protein, 9 aa, Homo Sapiens
TVSSATHYV

SEQ ID NO: 50331 - protein, 9 aa, Homo Sapiens
TVTMQVTAR

SEQ ID NO: 50332 - protein, 9 aa, Homo Sapiens
TVVDAASLR

SEQ ID NO: 50333 - protein, 9 aa, Homo Sapiens
TVVGDVGGR

SEQ ID NO: 50334 - protein, 9 aa, Homo Sapiens
TVVGSSKFR

SEQ ID NO: 50335 - protein, 9 aa, Homo Sapiens
TVVGTSRLR

SEQ ID NO: 50336 - protein, 9 aa, Homo Sapiens
TVVQNLMER

SEQ ID NO: 50337 - protein, 9 aa, Homo Sapiens
TVVTGTLER

SEQ ID NO: 50338 - protein, 9 aa, Homo Sapiens
TVYHSPVSR

SEQ ID NO: 50339 - protein, 9 aa, Homo Sapiens
VAPPGCSHL

SEQ ID NO: 50340 - protein, 9 aa, Homo Sapiens
VAQHPPARR

SEQ ID NO: 50341 - protein, 9 aa, Homo Sapiens
VATDITSTR

SEQ ID NO: 50342 - protein, 9 aa, Homo Sapiens
VAVTPFSLR

SEQ ID NO: 50343 - protein, 9 aa, Homo Sapiens
VEHGPAAIR

SEQ ID NO: 50344 - protein, 9 aa, Homo Sapiens
VPAQPLGPR

SEQ ID NO: 50345 - protein, 9 aa, Homo Sapiens
VPDTIATLR

SEQ ID NO: 50346 - protein, 9 aa, Homo Sapiens
VPFGAGRHR

SEQ ID NO: 50347 - protein, 9 aa, Homo Sapiens
VPGPPGSSR

SEQ ID NO: 50348 - protein, 9 aa, Homo Sapiens
VPTSLELQR

SEQ ID NO: 50349 - protein, 9 aa, Homo Sapiens
VVAPPGAPK

SEQ ID NO: 50350 - protein, 9 aa, Homo Sapiens
VVAPRLNSR

SEQ ID NO: 50351 - protein, 9 aa, Homo Sapiens
VVFGGGEAR

SEQ ID NO: 50352 - protein, 9 aa, Homo Sapiens
VVGPPGATR

SEQ ID NO: 50353 - protein, 9 aa, Homo Sapiens
VVGPVSLPR

SEQ ID NO: 50354 - protein, 9 aa, Homo Sapiens
VVIQASKSR

SEQ ID NO: 50355 - protein, 9 aa, Homo Sapiens
VVMPPTRAR

SEQ ID NO: 50356 - protein, 9 aa, Homo Sapiens
VVMTPPRNR

SEQ ID NO: 50357 - protein, 9 aa, Homo Sapiens
WVIGSVVAR

SEQ ID NO: 50358 - protein, 9 aa, Homo Sapiens
WVSADGFLR

SEQ ID NO: 50359 - protein, 9 aa, Homo Sapiens
WVSENFQER

SEQ ID NO: 50360 - protein, 9 aa, Homo Sapiens
YAAFVQTHR

SEQ ID NO: 50361 - protein, 9 aa, Homo Sapiens
YIMPKPARR

SEQ ID NO: 50362 - protein, 9 aa, Homo Sapiens
YLADPMKAR

SEQ ID NO: 50363 - protein, 9 aa, Homo Sapiens
YPYSPPAFR

SEQ ID NO: 50364 - protein, 9 aa, Homo Sapiens
YPYSPPTFR

SEQ ID NO: 50365 - protein, 9 aa, Homo Sapiens
YSGPTSVSR

SEQ ID NO: 50366 - protein, 9 aa, Homo Sapiens
YVANVGTNR

SEQ ID NO: 50367 - protein, 9 aa, Homo Sapiens
YVAPELLKR

SEQ ID NO: 50368 - protein, 9 aa, Homo Sapiens
YVFGGVRSR

SEQ ID NO: 50369 - protein, 9 aa, Homo Sapiens
YVFPVSQKR

SEQ ID NO: 50370 - protein, 9 aa, Homo Sapiens
YVGEIIGKR

SEQ ID NO: 50371 - protein, 9 aa, Homo Sapiens
YVGRPSLNR

SEQ ID NO: 50372 - protein, 9 aa, Homo Sapiens
YVHTTVNEM

SEQ ID NO: 50373 - protein, 9 aa, Homo Sapiens
YVIESARQR

SEQ ID NO: 50374 - protein, 9 aa, Homo Sapiens
YVIKPGNTK

SEQ ID NO: 50375 - protein, 9 aa, Homo Sapiens
YVMPSSSAR

SEQ ID NO: 50376 - protein, 9 aa, Homo Sapiens
YVTTSTRTY

SEQ ID NO: 50377 - protein, 9 aa, Homo Sapiens
YVVGGSIPR

SEQ ID NO: 50378 - protein, 10 aa, Homo Sapiens
AAGPPISEGK

SEQ ID NO: 50379 - protein, 10 aa, Homo Sapiens
ADAPVTQIGF

SEQ ID NO: 50380 - protein, 10 aa, Homo Sapiens
AGSLLGSGQM

SEQ ID NO: 50381 - protein, 10 aa, Homo Sapiens
AIIMFDVTSR

SEQ ID NO: 50382 - protein, 10 aa, Homo Sapiens
AVAPGGATRL

SEQ ID NO: 50383 - protein, 10 aa, Homo Sapiens
AVFDRDINCR

SEQ ID NO: 50384 - protein, 10 aa, Homo Sapiens
AVIDVDVMAR

SEQ ID NO: 50385 - protein, 10 aa, Homo Sapiens
AVPDAVGKCR

SEQ ID NO: 50386 - protein, 10 aa, Homo Sapiens
AVPEAIPTPR

SEQ ID NO: 50387 - protein, 10 aa, Homo Sapiens
AVVPFLPLQR

SEQ ID NO: 50388 - protein, 10 aa, Homo Sapiens
CVIDDRAARL

SEQ ID NO: 50389 - protein, 10 aa, Homo Sapiens
DAAFIIGSGR

SEQ ID NO: 50390 - protein, 10 aa, Homo Sapiens
DAYGSELVER

SEQ ID NO: 50391 - protein, 10 aa, Homo Sapiens
DIFKSIDGNR

SEQ ID NO: 50392 - protein, 10 aa, Homo Sapiens
DIFLVRGGMR

SEQ ID NO: 50393 - protein, 10 aa, Homo Sapiens
DIMDSSLTRR

SEQ ID NO: 50394 - protein, 10 aa, Homo Sapiens
DIVLVGGSTR

SEQ ID NO: 50395 - protein, 10 aa, Homo Sapiens
DIYDRKNMPR

SEQ ID NO: 50396 - protein, 10 aa, Homo Sapiens
DIYEFLPSKR

SEQ ID NO: 50397 - protein, 10 aa, Homo Sapiens
DLFTSKGLFR

SEQ ID NO: 50398 - protein, 10 aa, Homo Sapiens
DLISPRQPRL

SEQ ID NO: 50399 - protein, 10 aa, Homo Sapiens
DLYKTPCTKR

SEQ ID NO: 50400 - protein, 10 aa, Homo Sapiens
DSAPPSSVAR

SEQ ID NO: 50401 - protein, 10 aa, Homo Sapiens
DTCHTPFGKR

SEQ ID NO: 50402 - protein, 10 aa, Homo Sapiens
DTIDVSNLNR

SEQ ID NO: 50403 - protein, 10 aa, Homo Sapiens
DVAQSTHVLL

SEQ ID NO: 50404 - protein, 10 aa, Homo Sapiens
DVFWLRFSNR

SEQ ID NO: 50405 - protein, 10 aa, Homo Sapiens
DVIDGPISQR

SEQ ID NO: 50406 - protein, 10 aa, Homo Sapiens
DVIKPGTVKR

SEQ ID NO: 50407 - protein, 10 aa, Homo Sapiens
DVISDLLCNR

SEQ ID NO: 50408 - protein, 10 aa, Homo Sapiens
DVISNINITR

SEQ ID NO: 50409 - protein, 10 aa, Homo Sapiens
DVLGEGAHAR

SEQ ID NO: 50410 - protein, 10 aa, Homo Sapiens
DVLNPSGTQR

SEQ ID NO: 50411 - protein, 10 aa, Homo Sapiens
DVMASGTVKR

SEQ ID NO: 50412 - protein, 10 aa, Homo Sapiens
DVQGALVNLR

SEQ ID NO: 50413 - protein, 10 aa, Homo Sapiens
DVYENLYAGR

SEQ ID NO: 50414 - protein, 10 aa, Homo Sapiens
DVYTSLGQLR

SEQ ID NO: 50415 - protein, 10 aa, Homo Sapiens
EAAAAALSVR

SEQ ID NO: 50416 - protein, 10 aa, Homo Sapiens
EAAACITGLR

SEQ ID NO: 50417 - protein, 10 aa, Homo Sapiens
EAAAILMARL

SEQ ID NO: 50418 - protein, 10 aa, Homo Sapiens
EAAAPPPGPR

SEQ ID NO: 50419 - protein, 10 aa, Homo Sapiens
EAAAVHGARF

SEQ ID NO: 50420 - protein, 10 aa, Homo Sapiens
EAAAVLMARL

SEQ ID NO: 50421 - protein, 10 aa, Homo Sapiens
EAADTIGQMR

SEQ ID NO: 50422 - protein, 10 aa, Homo Sapiens
EAAERAIEKM

SEQ ID NO: 50423 - protein, 10 aa, Homo Sapiens
EAAFATKDRL

SEQ ID NO: 50424 - protein, 10 aa, Homo Sapiens
EAAFFEGHFL

SEQ ID NO: 50425 - protein, 10 aa, Homo Sapiens
EAAFIENLRR

SEQ ID NO: 50426 - protein, 10 aa, Homo Sapiens
EAAFSVAVCR

SEQ ID NO: 50427 - protein, 10 aa, Homo Sapiens
EAAGAAPCRL

SEQ ID NO: 50428 - protein, 10 aa, Homo Sapiens
EAAGPQEALR

SEQ ID NO: 50429 - protein, 10 aa, Homo Sapiens
EAALRSHRRL

SEQ ID NO: 50430 - protein, 10 aa, Homo Sapiens
EAAPEYFRRK

SEQ ID NO: 50431 - protein, 10 aa, Homo Sapiens
EAAPPAEVHR

SEQ ID NO: 50432 - protein, 10 aa, Homo Sapiens
EAAPPGELYR

SEQ ID NO: 50433 - protein, 10 aa, Homo Sapiens
EAAPVSGYRA

SEQ ID NO: 50434 - protein, 10 aa, Homo Sapiens
EAARQKLALR

SEQ ID NO: 50435 - protein, 10 aa, Homo Sapiens
EAASDSMKRL

SEQ ID NO: 50436 - protein, 10 aa, Homo Sapiens
EAASLRVLER

SEQ ID NO: 50437 - protein, 10 aa, Homo Sapiens
EAASMSQKRL

SEQ ID NO: 50438 - protein, 10 aa, Homo Sapiens
EAFAIGARAR

SEQ ID NO: 50439 - protein, 10 aa, Homo Sapiens
EAFEHPNVVR

SEQ ID NO: 50440 - protein, 10 aa, Homo Sapiens
EAFENRLKGR

SEQ ID NO: 50441 - protein, 10 aa, Homo Sapiens
EAFFSKTKRF

SEQ ID NO: 50442 - protein, 10 aa, Homo Sapiens
EAFGKIVAER

SEQ ID NO: 50443 - protein, 10 aa, Homo Sapiens
EAFGLEGVFR

SEQ ID NO: 50444 - protein, 10 aa, Homo Sapiens
EAFKERVRGR

SEQ ID NO: 50445 - protein, 10 aa, Homo Sapiens
EAFKPILSTR

SEQ ID NO: 50446 - protein, 10 aa, Homo Sapiens
EAFLASLSNR

SEQ ID NO: 50447 - protein, 10 aa, Homo Sapiens
EAFPSQGTKR

SEQ ID NO: 50448 - protein, 10 aa, Homo Sapiens
EAFSLDSSLR

SEQ ID NO: 50449 - protein, 10 aa, Homo Sapiens
EAGLMALRER

SEQ ID NO: 50450 - protein, 10 aa, Homo Sapiens
EAGLPQGEAR

SEQ ID NO: 50451 - protein, 10 aa, Homo Sapiens
EAGPDAVLGR

SEQ ID NO: 50452 - protein, 10 aa, Homo Sapiens
EAGPGGALHR

SEQ ID NO: 50453 - protein, 10 aa, Homo Sapiens
EAHFVPLVKR

SEQ ID NO: 50454 - protein, 10 aa, Homo Sapiens
EAHYSTKNPR

SEQ ID NO: 50455 - protein, 10 aa, Homo Sapiens
EAIDSAENRF

SEQ ID NO: 50456 - protein, 10 aa, Homo Sapiens
EAIGADSARF

SEQ ID NO: 50457 - protein, 10 aa, Homo Sapiens
EAIGLLGGQK

SEQ ID NO: 50458 - protein, 10 aa, Homo Sapiens
EAIGPVHQNR

SEQ ID NO: 50459 - protein, 10 aa, Homo Sapiens
EAIHQSQLRL

SEQ ID NO: 50460 - protein, 10 aa, Homo Sapiens
EAILPKGSAR

SEQ ID NO: 50461 - protein, 10 aa, Homo Sapiens
EAINITNNER

SEQ ID NO: 50462 - protein, 10 aa, Homo Sapiens
EAIQTRSRTR

SEQ ID NO: 50463 - protein, 10 aa, Homo Sapiens
EAIRTNYNDR

SEQ ID NO: 50464 - protein, 10 aa, Homo Sapiens
EAISLLNSER

SEQ ID NO: 50465 - protein, 10 aa, Homo Sapiens
EAISVVAQRL

SEQ ID NO: 50466 - protein, 10 aa, Homo Sapiens
EALGSGLVSR

SEQ ID NO: 50467 - protein, 10 aa, Homo Sapiens
EAMASIINRL

SEQ ID NO: 50468 - protein, 10 aa, Homo Sapiens
EANQQGTYRL

SEQ ID NO: 50469 - protein, 10 aa, Homo Sapiens
EANSNAVRFR

SEQ ID NO: 50470 - protein, 10 aa, Homo Sapiens
EANYPETLGR

SEQ ID NO: 50471 - protein, 10 aa, Homo Sapiens
EAQINTAKRL

SEQ ID NO: 50472 - protein, 10 aa, Homo Sapiens
EAQKAQALRL

SEQ ID NO: 50473 - protein, 10 aa, Homo Sapiens
EAQNPRPTRL

SEQ ID NO: 50474 - protein, 10 aa, Homo Sapiens
EASPVKRPRL

SEQ ID NO: 50475 - protein, 10 aa, Homo Sapiens
EATAGFTIGR

SEQ ID NO: 50476 - protein, 10 aa, Homo Sapiens
EATGGKYVPR

SEQ ID NO: 50477 - protein, 10 aa, Homo Sapiens
EATLGSGNLR

SEQ ID NO: 50478 - protein, 10 aa, Homo Sapiens
EAVAPEFTNR

SEQ ID NO: 50479 - protein, 10 aa, Homo Sapiens
EAVASLATRI

SEQ ID NO: 50480 - protein, 10 aa, Homo Sapiens
EAVDISSKRM

SEQ ID NO: 50481 - protein, 10 aa, Homo Sapiens
EAVDLMEPRL

SEQ ID NO: 50482 - protein, 10 aa, Homo Sapiens
EAVEQNNPRL

SEQ ID NO: 50483 - protein, 10 aa, Homo Sapiens
EAVGVDISGR

SEQ ID NO: 50484 - protein, 10 aa, Homo Sapiens
EAVHDLLRPR

SEQ ID NO: 50485 - protein, 10 aa, Homo Sapiens
EAVQALRERL

SEQ ID NO: 50486 - protein, 10 aa, Homo Sapiens
EAVRTTLGPR

SEQ ID NO: 50487 - protein, 10 aa, Homo Sapiens
EAYNETFSNR

SEQ ID NO: 50488 - protein, 10 aa, Homo Sapiens
EGAGAGSGFR

SEQ ID NO: 50489 - protein, 10 aa, Homo Sapiens
EGRDIPIVHR

SEQ ID NO: 50490 - protein, 10 aa, Homo Sapiens
EIAPMMERRM

SEQ ID NO: 50491 - protein, 10 aa, Homo Sapiens
EIASVAYRYR

SEQ ID NO: 50492 - protein, 10 aa, Homo Sapiens
EIFYTAIVNR

SEQ ID NO: 50493 - protein, 10 aa, Homo Sapiens
EIGPVSSSRF

SEQ ID NO: 50494 - protein, 10 aa, Homo Sapiens
EIIAWHKKTQ

SEQ ID NO: 50495 - protein, 10 aa, Homo Sapiens
EIIEAPMAWR

SEQ ID NO: 50496 - protein, 10 aa, Homo Sapiens
EIIEEHLANR

SEQ ID NO: 50497 - protein, 10 aa, Homo Sapiens
EIIIVDTSGR

SEQ ID NO: 50498 - protein, 10 aa, Homo Sapiens
EIINEDIAKR

SEQ ID NO: 50499 - protein, 10 aa, Homo Sapiens
EIIPFPSTKM

SEQ ID NO: 50500 - protein, 10 aa, Homo Sapiens
EIIQAQLVNR

SEQ ID NO: 50501 - protein, 10 aa, Homo Sapiens
EIIQSTPYGR

SEQ ID NO: 50502 - protein, 10 aa, Homo Sapiens
EIISERTKPR

SEQ ID NO: 50503 - protein, 10 aa, Homo Sapiens
EIKDPSGLFY

SEQ ID NO: 50504 - protein, 10 aa, Homo Sapiens
EIKKPPVSER

SEQ ID NO: 50505 - protein, 10 aa, Homo Sapiens
EILKAKPGLR

SEQ ID NO: 50506 - protein, 10 aa, Homo Sapiens
EILNIRTKGR

SEQ ID NO: 50507 - protein, 10 aa, Homo Sapiens
EIMQETGTRI

SEQ ID NO: 50508 - protein, 10 aa, Homo Sapiens
EIPEHFGAVR

SEQ ID NO: 50509 - protein, 10 aa, Homo Sapiens
EIQTPENTPR

SEQ ID NO: 50510 - protein, 10 aa, Homo Sapiens
EISESGMTVR

SEQ ID NO: 50511 - protein, 10 aa, Homo Sapiens
EIVDKSGVVR

SEQ ID NO: 50512 - protein, 10 aa, Homo Sapiens
EIVHGDLSPR

SEQ ID NO: 50513 - protein, 10 aa, Homo Sapiens
EIVLVGGSTR

SEQ ID NO: 50514 - protein, 10 aa, Homo Sapiens
EIYDRREYSR

SEQ ID NO: 50515 - protein, 10 aa, Homo Sapiens
EIYEFAATQR

SEQ ID NO: 50516 - protein, 10 aa, Homo Sapiens
EIYGGSDSRF

SEQ ID NO: 50517 - protein, 10 aa, Homo Sapiens
EIYSFSESLR

SEQ ID NO: 50518 - protein, 10 aa, Homo Sapiens
EIYTGTSVAR

SEQ ID NO: 50519 - protein, 10 aa, Homo Sapiens
ELADPTERFR

SEQ ID NO: 50520 - protein, 10 aa, Homo Sapiens
ELAFYTPKLR

SEQ ID NO: 50521 - protein, 10 aa, Homo Sapiens
ELALIYGTPR

SEQ ID NO: 50522 - protein, 10 aa, Homo Sapiens
ELASGAPRPR

SEQ ID NO: 50523 - protein, 10 aa, Homo Sapiens
ELCDERVSSR

SEQ ID NO: 50524 - protein, 10 aa, Homo Sapiens
ELFHQQGTPR

SEQ ID NO: 50525 - protein, 10 aa, Homo Sapiens
ELFKELHTGR

SEQ ID NO: 50526 - protein, 10 aa, Homo Sapiens
ELGLLDPAQR

SEQ ID NO: 50527 - protein, 10 aa, Homo Sapiens
ELHFGEGVHR

SEQ ID NO: 50528 - protein, 10 aa, Homo Sapiens
ELIAIATGGR

SEQ ID NO: 50529 - protein, 10 aa, Homo Sapiens
ELISTTANYR

SEQ ID NO: 50530 - protein, 10 aa, Homo Sapiens
ELLDRPGAER

SEQ ID NO: 50531 - protein, 10 aa, Homo Sapiens
ELLNPTGTVR

SEQ ID NO: 50532 - protein, 10 aa, Homo Sapiens
ELMAGHLRNR

SEQ ID NO: 50533 - protein, 10 aa, Homo Sapiens
ELMDKPLTFR

SEQ ID NO: 50534 - protein, 10 aa, Homo Sapiens
ELPIVTPALR

SEQ ID NO: 50535 - protein, 10 aa, Homo Sapiens
ELPTHPSKKR

SEQ ID NO: 50536 - protein, 10 aa, Homo Sapiens
ELSNVLAAMR

SEQ ID NO: 50537 - protein, 10 aa, Homo Sapiens
ELVDPLTTVR

SEQ ID NO: 50538 - protein, 10 aa, Homo Sapiens
ELYAEKVATR

SEQ ID NO: 50539 - protein, 10 aa, Homo Sapiens
EMFVGVGASR

SEQ ID NO: 50540 - protein, 10 aa, Homo Sapiens
EMIITKQGRR

SEQ ID NO: 50541 - protein, 10 aa, Homo Sapiens
EMLTFNPHKR

SEQ ID NO: 50542 - protein, 10 aa, Homo Sapiens
EMRDGQVLGR

SEQ ID NO: 50543 - protein, 10 aa, Homo Sapiens
EPADSGLERL

SEQ ID NO: 50544 - protein, 10 aa, Homo Sapiens
EPAGGLVGER

SEQ ID NO: 50545 - protein, 10 aa, Homo Sapiens
EPALTRKGAR

SEQ ID NO: 50546 - protein, 10 aa, Homo Sapiens
EPGPIRPSHR

SEQ ID NO: 50547 - protein, 10 aa, Homo Sapiens
EPIASRASRL

SEQ ID NO: 50548 - protein, 10 aa, Homo Sapiens
EPIATFYGLR

SEQ ID NO: 50549 - protein, 10 aa, Homo Sapiens
EPPPAPGAQR

SEQ ID NO: 50550 - protein, 10 aa, Homo Sapiens
EPVQLTFALR

SEQ ID NO: 50551 - protein, 10 aa, Homo Sapiens
EPVSDVVSTR

SEQ ID NO: 50552 - protein, 10 aa, Homo Sapiens
EPYPVSGAKR

SEQ ID NO: 50553 - protein, 10 aa, Homo Sapiens
EQALIQYALR

SEQ ID NO: 50554 - protein, 10 aa, Homo Sapiens
EQAPIQSEPR

SEQ ID NO: 50555 - protein, 10 aa, Homo Sapiens
EQFLTELTRL

SEQ ID NO: 50556 - protein, 10 aa, Homo Sapiens
EQIELHNSIR

SEQ ID NO: 50557 - protein, 10 aa, Homo Sapiens
EQIRTLAAER

SEQ ID NO: 50558 - protein, 10 aa, Homo Sapiens
EQSGPPHEPR

SEQ ID NO: 50559 - protein, 10 aa, Homo Sapiens
ESALPRAGPR

SEQ ID NO: 50560 - protein, 10 aa, Homo Sapiens
ESFGPQPISR

SEQ ID NO: 50561 - protein, 10 aa, Homo Sapiens
ESFPGSFRGR

SEQ ID NO: 50562 - protein, 10 aa, Homo Sapiens
ESIDDALNCR

SEQ ID NO: 50563 - protein, 10 aa, Homo Sapiens
ESIGRVLAQR

SEQ ID NO: 50564 - protein, 10 aa, Homo Sapiens
ESTTVATRRL

SEQ ID NO: 50565 - protein, 10 aa, Homo Sapiens
ESVGGRVAER

SEQ ID NO: 50566 - protein, 10 aa, Homo Sapiens
ESVGSMAKRL

SEQ ID NO: 50567 - protein, 10 aa, Homo Sapiens
ETAEEGSARL

SEQ ID NO: 50568 - protein, 10 aa, Homo Sapiens
ETAEQGLLNR

SEQ ID NO: 50569 - protein, 10 aa, Homo Sapiens
ETAGSTKYRL

SEQ ID NO: 50570 - protein, 10 aa, Homo Sapiens
ETAGSTSIPK

SEQ ID NO: 50571 - protein, 10 aa, Homo Sapiens
ETALIDRTGR

SEQ ID NO: 50572 - protein, 10 aa, Homo Sapiens
ETALNSKAYK

SEQ ID NO: 50573 - protein, 10 aa, Homo Sapiens
ETASKTLSRF

SEQ ID NO: 50574 - protein, 10 aa, Homo Sapiens
ETASNEVVYR

SEQ ID NO: 50575 - protein, 10 aa, Homo Sapiens
ETFDFQAMGR

SEQ ID NO: 50576 - protein, 10 aa, Homo Sapiens
ETFDYIGSSR

SEQ ID NO: 50577 - protein, 10 aa, Homo Sapiens
ETFEHPNVVR

SEQ ID NO: 50578 - protein, 10 aa, Homo Sapiens
ETFISLVSIR

SEQ ID NO: 50579 - protein, 10 aa, Homo Sapiens
ETFSSATKRL

SEQ ID NO: 50580 - protein, 10 aa, Homo Sapiens
ETHEALARRL

SEQ ID NO: 50581 - protein, 10 aa, Homo Sapiens
ETHGNLMTER

SEQ ID NO: 50582 - protein, 10 aa, Homo Sapiens
ETIEGMLLRL

SEQ ID NO: 50583 - protein, 10 aa, Homo Sapiens
ETIGKKFEKR

SEQ ID NO: 50584 - protein, 10 aa, Homo Sapiens
ETIVTKNGQK

SEQ ID NO: 50585 - protein, 10 aa, Homo Sapiens
ETLKHSGIGR

SEQ ID NO: 50586 - protein, 10 aa, Homo Sapiens
ETMGHSADRL

SEQ ID NO: 50587 - protein, 10 aa, Homo Sapiens
ETNHTSRPRL

SEQ ID NO: 50588 - protein, 10 aa, Homo Sapiens
ETNMYEGVGR

SEQ ID NO: 50589 - protein, 10 aa, Homo Sapiens
ETPGHTPSLR

SEQ ID NO: 50590 - protein, 10 aa, Homo Sapiens
ETQYSVDTRR

SEQ ID NO: 50591 - protein, 10 aa, Homo Sapiens
ETRDGQVLGR

SEQ ID NO: 50592 - protein, 10 aa, Homo Sapiens
ETSDFLGGLR

SEQ ID NO: 50593 - protein, 10 aa, Homo Sapiens
ETSGISIYRL

SEQ ID NO: 50594 - protein, 10 aa, Homo Sapiens
ETSPLTAEKL

SEQ ID NO: 50595 - protein, 10 aa, Homo Sapiens
ETSQAGLFRL

SEQ ID NO: 50596 - protein, 10 aa, Homo Sapiens
ETVGTGIMGR

SEQ ID NO: 50597 - protein, 10 aa, Homo Sapiens
ETVNFSGVKR

SEQ ID NO: 50598 - protein, 10 aa, Homo Sapiens
ETVPAPSANK

SEQ ID NO: 50599 - protein, 10 aa, Homo Sapiens
ETVQLRNPPR

SEQ ID NO: 50600 - protein, 10 aa, Homo Sapiens
EVAAMENVHR

SEQ ID NO: 50601 - protein, 10 aa, Homo Sapiens
EVAAPDVGRM

SEQ ID NO: 50602 - protein, 10 aa, Homo Sapiens
EVAEGGLPRA

SEQ ID NO: 50603 - protein, 10 aa, Homo Sapiens
EVAELTVLER

SEQ ID NO: 50604 - protein, 10 aa, Homo Sapiens
EVAERLGVTR

SEQ ID NO: 50605 - protein, 10 aa, Homo Sapiens
EVAETVFRDR

SEQ ID NO: 50606 - protein, 10 aa, Homo Sapiens
EVAGFGESRC

SEQ ID NO: 50607 - protein, 10 aa, Homo Sapiens
EVAGFVLNRL

SEQ ID NO: 50608 - protein, 10 aa, Homo Sapiens
EVAGIINDAK

SEQ ID NO: 50609 - protein, 10 aa, Homo Sapiens
EVAKQALNRL

SEQ ID NO: 50610 - protein, 10 aa, Homo Sapiens
EVAPCMGDRF

SEQ ID NO: 50611 - protein, 10 aa, Homo Sapiens
EVAPPEYHRK

SEQ ID NO: 50612 - protein, 10 aa, Homo Sapiens
EVAPVISSAY

SEQ ID NO: 50613 - protein, 10 aa, Homo Sapiens
EVAPVVTTEH

SEQ ID NO: 50614 - protein, 10 aa, Homo Sapiens
EVAQLIQGGR

SEQ ID NO: 50615 - protein, 10 aa, Homo Sapiens
EVAQPSEVLR

SEQ ID NO: 50616 - protein, 10 aa, Homo Sapiens
EVAQTADARL

SEQ ID NO: 50617 - protein, 10 aa, Homo Sapiens
EVASAVCLRL

SEQ ID NO: 50618 - protein, 10 aa, Homo Sapiens
EVASDLASSR

SEQ ID NO: 50619 - protein, 10 aa, Homo Sapiens
EVAVESQRRL

SEQ ID NO: 50620 - protein, 10 aa, Homo Sapiens
EVAVETTTPK

SEQ ID NO: 50621 - protein, 10 aa, Homo Sapiens
EVCPLSESRF

SEQ ID NO: 50622 - protein, 10 aa, Homo Sapiens
EVEPGVHLGR

SEQ ID NO: 50623 - protein, 10 aa, Homo Sapiens
EVFESSVPQR

SEQ ID NO: 50624 - protein, 10 aa, Homo Sapiens
EVFEYSSSTR

SEQ ID NO: 50625 - protein, 10 aa, Homo Sapiens
EVFFSEKIYK

SEQ ID NO: 50626 - protein, 10 aa, Homo Sapiens
EVFGTADLYR

SEQ ID NO: 50627 - protein, 10 aa, Homo Sapiens
EVFGVTDNPR

SEQ ID NO: 50628 - protein, 10 aa, Homo Sapiens
EVFLAQGTLR

SEQ ID NO: 50629 - protein, 10 aa, Homo Sapiens
EVFNKFFKER

SEQ ID NO: 50630 - protein, 10 aa, Homo Sapiens
EVFPLAMNYL

SEQ ID NO: 50631 - protein, 10 aa, Homo Sapiens
EVGDIVKVTR

SEQ ID NO: 50632 - protein, 10 aa, Homo Sapiens
EVGGEALGRL

SEQ ID NO: 50633 - protein, 10 aa, Homo Sapiens
EVGGGSGHRL

SEQ ID NO: 50634 - protein, 10 aa, Homo Sapiens
EVGPDAASLR

SEQ ID NO: 50635 - protein, 10 aa, Homo Sapiens
EVGPEGALGK

SEQ ID NO: 50636 - protein, 10 aa, Homo Sapiens
EVGPGAVGER

SEQ ID NO: 50637 - protein, 10 aa, Homo Sapiens
EVGPPLPPLL

SEQ ID NO: 50638 - protein, 10 aa, Homo Sapiens
EVGPREAGLR

SEQ ID NO: 50639 - protein, 10 aa, Homo Sapiens
EVGTASPMAR

SEQ ID NO: 50640 - protein, 10 aa, Homo Sapiens
EVHYHLPVAR

SEQ ID NO: 50641 - protein, 10 aa, Homo Sapiens
EVHYINDVER

SEQ ID NO: 50642 - protein, 10 aa, Homo Sapiens
EVIALFDQTR

SEQ ID NO: 50643 - protein, 10 aa, Homo Sapiens
EVIDDFMTRL

SEQ ID NO: 50644 - protein, 10 aa, Homo Sapiens
EVIEGPQNAR

SEQ ID NO: 50645 - protein, 10 aa, Homo Sapiens
EVIGLLGGRY

SEQ ID NO: 50646 - protein, 10 aa, Homo Sapiens
EVIKPWITKR

SEQ ID NO: 50647 - protein, 10 aa, Homo Sapiens
EVIKQRLTAR

SEQ ID NO: 50648 - protein, 10 aa, Homo Sapiens
EVILATPYGR

SEQ ID NO: 50649 - protein, 10 aa, Homo Sapiens
EVIQESGTKL

SEQ ID NO: 50650 - protein, 10 aa, Homo Sapiens
EVIQLQGDQR

SEQ ID NO: 50651 - protein, 10 aa, Homo Sapiens
EVKRPGESLR

SEQ ID NO: 50652 - protein, 10 aa, Homo Sapiens
EVKTPEFVSR

SEQ ID NO: 50653 - protein, 10 aa, Homo Sapiens
EVLDPTAANR

SEQ ID NO: 50654 - protein, 10 aa, Homo Sapiens
EVLKETVSQR

SEQ ID NO: 50655 - protein, 10 aa, Homo Sapiens
EVLKTRMALR

SEQ ID NO: 50656 - protein, 10 aa, Homo Sapiens
EVLPSPRGQR

SEQ ID NO: 50657 - protein, 10 aa, Homo Sapiens
EVMEYTTILR

SEQ ID NO: 50658 - protein, 10 aa, Homo Sapiens
EVMGNPGTFK

SEQ ID NO: 50659 - protein, 10 aa, Homo Sapiens
EVMIAEPSCR

SEQ ID NO: 50660 - protein, 10 aa, Homo Sapiens
EVNERHQILR

SEQ ID NO: 50661 - protein, 10 aa, Homo Sapiens
EVNQETIQRL

SEQ ID NO: 50662 - protein, 10 aa, Homo Sapiens
EVNQPKFNQR

SEQ ID NO: 50663 - protein, 10 aa, Homo Sapiens
EVNTASLCRI

SEQ ID NO: 50664 - protein, 10 aa, Homo Sapiens
EVPETFLNRL

SEQ ID NO: 50665 - protein, 10 aa, Homo Sapiens
EVPREKLASR

SEQ ID NO: 50666 - protein, 10 aa, Homo Sapiens
EVPSFLVERM

SEQ ID NO: 50667 - protein, 10 aa, Homo Sapiens
EVQDLHLAQR

SEQ ID NO: 50668 - protein, 10 aa, Homo Sapiens
EVQGDRMHLR

SEQ ID NO: 50669 - protein, 10 aa, Homo Sapiens
EVQGLGDGKR

SEQ ID NO: 50670 - protein, 10 aa, Homo Sapiens
EVSDVEIITR

SEQ ID NO: 50671 - protein, 10 aa, Homo Sapiens
EVSFYNVTER

SEQ ID NO: 50672 - protein, 10 aa, Homo Sapiens
EVSNGSVVHR

SEQ ID NO: 50673 - protein, 10 aa, Homo Sapiens
EVSPPNLRGR

SEQ ID NO: 50674 - protein, 10 aa, Homo Sapiens
EVSPVALQRL

SEQ ID NO: 50675 - protein, 10 aa, Homo Sapiens
EVTEEGVRFR

SEQ ID NO: 50676 - protein, 10 aa, Homo Sapiens
EVTETICKRL

SEQ ID NO: 50677 - protein, 10 aa, Homo Sapiens
EVTGRSSVLR

SEQ ID NO: 50678 - protein, 10 aa, Homo Sapiens
EVTPAMQIPR

SEQ ID NO: 50679 - protein, 10 aa, Homo Sapiens
EVVAGEFGSR

SEQ ID NO: 50680 - protein, 10 aa, Homo Sapiens
EVVDFIQSKI

SEQ ID NO: 50681 - protein, 10 aa, Homo Sapiens
EVVDKSQVSR

SEQ ID NO: 50682 - protein, 10 aa, Homo Sapiens
EVVDSNPYSR

SEQ ID NO: 50683 - protein, 10 aa, Homo Sapiens
EVVDVMVIGR

SEQ ID NO: 50684 - protein, 10 aa, Homo Sapiens
EVVEDSLRQR

SEQ ID NO: 50685 - protein, 10 aa, Homo Sapiens
EVVEKKRARL

SEQ ID NO: 50686 - protein, 10 aa, Homo Sapiens
EVVELPVTER

SEQ ID NO: 50687 - protein, 10 aa, Homo Sapiens
EVVGNMAVSR

SEQ ID NO: 50688 - protein, 10 aa, Homo Sapiens
EVVQSSPVER

SEQ ID NO: 50689 - protein, 10 aa, Homo Sapiens
EVVSGSGLTR

SEQ ID NO: 50690 - protein, 10 aa, Homo Sapiens
EVVTGVIGQR

SEQ ID NO: 50691 - protein, 10 aa, Homo Sapiens
EVVTSMGTQR

SEQ ID NO: 50692 - protein, 10 aa, Homo Sapiens
EVWIPKNGTR

SEQ ID NO: 50693 - protein, 10 aa, Homo Sapiens
EVYDGPKNVR

SEQ ID NO: 50694 - protein, 10 aa, Homo Sapiens
EVYNEFVRKR

SEQ ID NO: 50695 - protein, 10 aa, Homo Sapiens
EVYPFGIVGM

SEQ ID NO: 50696 - protein, 10 aa, Homo Sapiens
EVYVEVAYPR

SEQ ID NO: 50697 - protein, 10 aa, Homo Sapiens
EVYVWDVNSR

SEQ ID NO: 50698 - protein, 10 aa, Homo Sapiens
FVFDRPVHRR

SEQ ID NO: 50699 - protein, 10 aa, Homo Sapiens
FVGTAGTVGR

SEQ ID NO: 50700 - protein, 10 aa, Homo Sapiens
FVQEAESRPR

SEQ ID NO: 50701 - protein, 10 aa, Homo Sapiens
FVSLSTSGGK

SEQ ID NO: 50702 - protein, 10 aa, Homo Sapiens
FVSSILPGNR

SEQ ID NO: 50703 - protein, 10 aa, Homo Sapiens
GVFEGIPTYR

SEQ ID NO: 50704 - protein, 10 aa, Homo Sapiens
HVAESSLSRL

SEQ ID NO: 50705 - protein, 10 aa, Homo Sapiens
HVHTMDFSPR

SEQ ID NO: 50706 - protein, 10 aa, Homo Sapiens
HVIRGYVGNR

SEQ ID NO: 50707 - protein, 10 aa, Homo Sapiens
HVIVDEIHER

SEQ ID NO: 50708 - protein, 10 aa, Homo Sapiens
HVIVDEVHER

SEQ ID NO: 50709 - protein, 10 aa, Homo Sapiens
HVKEQLETLR

SEQ ID NO: 50710 - protein, 10 aa, Homo Sapiens
HVLDLVSHPR

SEQ ID NO: 50711 - protein, 10 aa, Homo Sapiens
HVMGFSVTGR

SEQ ID NO: 50712 - protein, 10 aa, Homo Sapiens
HVPCADSLPR

SEQ ID NO: 50713 - protein, 10 aa, Homo Sapiens
HVPGSPFTAR

SEQ ID NO: 50714 - protein, 10 aa, Homo Sapiens
HVPVKEFNFR

SEQ ID NO: 50715 - protein, 10 aa, Homo Sapiens
HVSLITPTKR

SEQ ID NO: 50716 - protein, 10 aa, Homo Sapiens
HVYDGKFLAR

SEQ ID NO: 50717 - protein, 10 aa, Homo Sapiens
HVYPQPGMQR

SEQ ID NO: 50718 - protein, 10 aa, Homo Sapiens
IDISDIAEKR

SEQ ID NO: 50719 - protein, 10 aa, Homo Sapiens
IVFPETSQPR

SEQ ID NO: 50720 - protein, 10 aa, Homo Sapiens
IVKGPRGTLR

SEQ ID NO: 50721 - protein, 10 aa, Homo Sapiens
LEAGGTGPVR

SEQ ID NO: 50722 - protein, 10 aa, Homo Sapiens
LVAQHPPARR

SEQ ID NO: 50723 - protein, 10 aa, Homo Sapiens
LVFCYTIIER

SEQ ID NO: 50724 - protein, 10 aa, Homo Sapiens
LVVPVLGRMS

SEQ ID NO: 50725 - protein, 10 aa, Homo Sapiens
MPHTSGMNRL

SEQ ID NO: 50726 - protein, 10 aa, Homo Sapiens
MPIKLKIGLR

SEQ ID NO: 50727 - protein, 10 aa, Homo Sapiens
MVADVFSHRF

SEQ ID NO: 50728 - protein, 10 aa, Homo Sapiens
MVAPGSVTSR

SEQ ID NO: 50729 - protein, 10 aa, Homo Sapiens
MVLQVSAAPR

SEQ ID NO: 50730 - protein, 10 aa, Homo Sapiens
MVSSQTKTVR

SEQ ID NO: 50731 - protein, 10 aa, Homo Sapiens
NTFFAKNGYR

SEQ ID NO: 50732 - protein, 10 aa, Homo Sapiens
NVIEKMLTDR

SEQ ID NO: 50733 - protein, 10 aa, Homo Sapiens
NVKGPGLQRM

SEQ ID NO: 50734 - protein, 10 aa, Homo Sapiens
NVVTTPSTNR

SEQ ID NO: 50735 - protein, 10 aa, Homo Sapiens
NVYPAECRGR

SEQ ID NO: 50736 - protein, 10 aa, Homo Sapiens
QALKLVEGPD

SEQ ID NO: 50737 - protein, 10 aa, Homo Sapiens
QLAQFHFTNR

SEQ ID NO: 50738 - protein, 10 aa, Homo Sapiens
QVEPGVHLGR

SEQ ID NO: 50739 - protein, 10 aa, Homo Sapiens
QVHLGAAAQR

SEQ ID NO: 50740 - protein, 10 aa, Homo Sapiens
QVYFGTSHPR

SEQ ID NO: 50741 - protein, 10 aa, Homo Sapiens
QVYTQNAEMR

SEQ ID NO: 50742 - protein, 10 aa, Homo Sapiens
SAFLSKRNPR

SEQ ID NO: 50743 - protein, 10 aa, Homo Sapiens
SIENTSTLQR

SEQ ID NO: 50744 - protein, 10 aa, Homo Sapiens
SIVEFQPTLR

SEQ ID NO: 50745 - protein, 10 aa, Homo Sapiens
SIWDGSEVLR

SEQ ID NO: 50746 - protein, 10 aa, Homo Sapiens
SLHNTPMGAR

SEQ ID NO: 50747 - protein, 10 aa, Homo Sapiens
SLSDFSWSQR

SEQ ID NO: 50748 - protein, 10 aa, Homo Sapiens
SLVNFEPAAR

SEQ ID NO: 50749 - protein, 10 aa, Homo Sapiens
STWGSPGWVR

SEQ ID NO: 50750 - protein, 10 aa, Homo Sapiens
SVASTPISQR

SEQ ID NO: 50751 - protein, 10 aa, Homo Sapiens
SVFGSGNTGR

SEQ ID NO: 50752 - protein, 10 aa, Homo Sapiens
SVFPQNGAAR

SEQ ID NO: 50753 - protein, 10 aa, Homo Sapiens
SVFTVEGGHR

SEQ ID NO: 50754 - protein, 10 aa, Homo Sapiens
SVGGTSVTPR

SEQ ID NO: 50755 - protein, 10 aa, Homo Sapiens
SVGRQSSAPA

SEQ ID NO: 50756 - protein, 10 aa, Homo Sapiens
SVIAKHLKGR

SEQ ID NO: 50757 - protein, 10 aa, Homo Sapiens
SVIKEMLNRL

SEQ ID NO: 50758 - protein, 10 aa, Homo Sapiens
SVINSVSTSR

SEQ ID NO: 50759 - protein, 10 aa, Homo Sapiens
SVMGVTVSRL

SEQ ID NO: 50760 - protein, 10 aa, Homo Sapiens
SVNASKPSER

SEQ ID NO: 50761 - protein, 10 aa, Homo Sapiens
SVQGAGTSYR

SEQ ID NO: 50762 - protein, 10 aa, Homo Sapiens
SVVEHRLRAR

SEQ ID NO: 50763 - protein, 10 aa, Homo Sapiens
SVVEIASLRF

SEQ ID NO: 50764 - protein, 10 aa, Homo Sapiens
TADGVPVSSR

SEQ ID NO: 50765 - protein, 10 aa, Homo Sapiens
TAFASHIRAR

SEQ ID NO: 50766 - protein, 10 aa, Homo Sapiens
TIIEKPPAER

SEQ ID NO: 50767 - protein, 10 aa, Homo Sapiens
TIIFITGTTR

SEQ ID NO: 50768 - protein, 10 aa, Homo Sapiens
TLWNSPSRNR

SEQ ID NO: 50769 - protein, 10 aa, Homo Sapiens
TVALTAARGR

SEQ ID NO: 50770 - protein, 10 aa, Homo Sapiens
TVCLTLTAKR

SEQ ID NO: 50771 - protein, 10 aa, Homo Sapiens
TVFFPLDTAR

SEQ ID NO: 50772 - protein, 10 aa, Homo Sapiens
TVIDVSTADR

SEQ ID NO: 50773 - protein, 10 aa, Homo Sapiens
TVKATGPALR

SEQ ID NO: 50774 - protein, 10 aa, Homo Sapiens
TVLTHTPAPR

SEQ ID NO: 50775 - protein, 10 aa, Homo Sapiens
TVTPFTAQQR

SEQ ID NO: 50776 - protein, 10 aa, Homo Sapiens
TVVEDVTVGR

SEQ ID NO: 50777 - protein, 10 aa, Homo Sapiens
TVVYFPVRGR

SEQ ID NO: 50778 - protein, 10 aa, Homo Sapiens
VELGSVWQRL

SEQ ID NO: 50779 - protein, 10 aa, Homo Sapiens
VFDAKRLIGR

SEQ ID NO: 50780 - protein, 10 aa, Homo Sapiens
VGKDPGLAGR

SEQ ID NO: 50781 - protein, 10 aa, Homo Sapiens
YDAEISQIHQ

SEQ ID NO: 50782 - protein, 10 aa, Homo Sapiens
YLITFNPVGR

SEQ ID NO: 50783 - protein, 10 aa, Homo Sapiens
YSFFSPSPAR

SEQ ID NO: 50784 - protein, 10 aa, Homo Sapiens
YTFYSISQER

SEQ ID NO: 50785 - protein, 10 aa, Homo Sapiens
YVFSADPIAR

SEQ ID NO: 50786 - protein, 10 aa, Homo Sapiens
YVISQMLSAR

SEQ ID NO: 50787 - protein, 10 aa, Homo Sapiens
YVYDKNVLQR

SEQ ID NO: 50788 - protein, 10 aa, Homo Sapiens
YVYPDKTRPR

SEQ ID NO: 50789 - protein, 11 aa, Homo Sapiens
AEQRGEHALKD

SEQ ID NO: 50790 - protein, 11 aa, Homo Sapiens
DAAHPTNVQRL

SEQ ID NO: 50791 - protein, 11 aa, Homo Sapiens
DIKSSETGAFR

SEQ ID NO: 50792 - protein, 11 aa, Homo Sapiens
DIQNPDITSSR

SEQ ID NO: 50793 - protein, 11 aa, Homo Sapiens
DIYNSDPLICR

SEQ ID NO: 50794 - protein, 11 aa, Homo Sapiens
DLFFPGYSKGR

SEQ ID NO: 50795 - protein, 11 aa, Homo Sapiens
DLGAGSKKSPR

SEQ ID NO: 50796 - protein, 11 aa, Homo Sapiens
DPKAPGLGAFR

SEQ ID NO: 50797 - protein, 11 aa, Homo Sapiens
DVAQWNIGSLR

SEQ ID NO: 50798 - protein, 11 aa, Homo Sapiens
DVFGQATAVLR

SEQ ID NO: 50799 - protein, 11 aa, Homo Sapiens
DVFKSNKEVGR

SEQ ID NO: 50800 - protein, 11 aa, Homo Sapiens
DVFVVGTERGR

SEQ ID NO: 50801 - protein, 11 aa, Homo Sapiens
DVSDVGLGKGR

SEQ ID NO: 50802 - protein, 11 aa, Homo Sapiens
DVVDSEALQVY

SEQ ID NO: 50803 - protein, 11 aa, Homo Sapiens
DVVKLTKNSKR

SEQ ID NO: 50804 - protein, 11 aa, Homo Sapiens
DVYFPQISSVK

SEQ ID NO: 50805 - protein, 11 aa, Homo Sapiens
EAAEAGAEARL

SEQ ID NO: 50806 - protein, 11 aa, Homo Sapiens
EAAFATKDRLR

SEQ ID NO: 50807 - protein, 11 aa, Homo Sapiens
EAALTYEASKR

SEQ ID NO: 50808 - protein, 11 aa, Homo Sapiens
EAAPEKDTVVR

SEQ ID NO: 50809 - protein, 11 aa, Homo Sapiens
EAAPLDGVLAN

SEQ ID NO: 50810 - protein, 11 aa, Homo Sapiens
EAARMAKLIAQ

SEQ ID NO: 50811 - protein, 11 aa, Homo Sapiens
EAARSLPLGAR

SEQ ID NO: 50812 - protein, 11 aa, Homo Sapiens
EAASDSMKRLQ

SEQ ID NO: 50813 - protein, 11 aa, Homo Sapiens
EAFFHTQSSVR

SEQ ID NO: 50814 - protein, 11 aa, Homo Sapiens
EAFSVFGQVER

SEQ ID NO: 50815 - protein, 11 aa, Homo Sapiens
EAFYKKDLAKR

SEQ ID NO: 50816 - protein, 11 aa, Homo Sapiens
EAGPGPRPLAR

SEQ ID NO: 50817 - protein, 11 aa, Homo Sapiens
EAHAPHYIAHR

SEQ ID NO: 50818 - protein, 11 aa, Homo Sapiens
EAIDSEGHSYM

SEQ ID NO: 50819 - protein, 11 aa, Homo Sapiens
EAIDSLRKSKR

SEQ ID NO: 50820 - protein, 11 aa, Homo Sapiens
EAIPILPAQQR

SEQ ID NO: 50821 - protein, 11 aa, Homo Sapiens
EAIQTSHFQGR

SEQ ID NO: 50822 - protein, 11 aa, Homo Sapiens
EAKGLDRINER

SEQ ID NO: 50823 - protein, 11 aa, Homo Sapiens
EAKPPTVTMPR

SEQ ID NO: 50824 - protein, 11 aa, Homo Sapiens
EAMDQYSIALR

SEQ ID NO: 50825 - protein, 11 aa, Homo Sapiens
EAMDVTTTSTR

SEQ ID NO: 50826 - protein, 11 aa, Homo Sapiens
EAMQSLVTSSR

SEQ ID NO: 50827 - protein, 11 aa, Homo Sapiens
EASPSPCITER

SEQ ID NO: 50828 - protein, 11 aa, Homo Sapiens
EAVEAAINRHR

SEQ ID NO: 50829 - protein, 11 aa, Homo Sapiens
EAVKPTVGMKR

SEQ ID NO: 50830 - protein, 11 aa, Homo Sapiens
EAVTQSLLSSR

SEQ ID NO: 50831 - protein, 11 aa, Homo Sapiens
EAWFPGSGAFR

SEQ ID NO: 50832 - protein, 11 aa, Homo Sapiens
EAYETLSDANR

SEQ ID NO: 50833 - protein, 11 aa, Homo Sapiens
EAYNIDETCGR

SEQ ID NO: 50834 - protein, 11 aa, Homo Sapiens
EFVDPSSLTAR

SEQ ID NO: 50835 - protein, 11 aa, Homo Sapiens
EGAPATMTPKL

SEQ ID NO: 50836 - protein, 11 aa, Homo Sapiens
EGIDPKKTTMR

SEQ ID NO: 50837 - protein, 11 aa, Homo Sapiens
EIASSLPAAQR

SEQ ID NO: 50838 - protein, 11 aa, Homo Sapiens
EIFDHLVAHGR

SEQ ID NO: 50839 - protein, 11 aa, Homo Sapiens
EIIAPSPQRSR

SEQ ID NO: 50840 - protein, 11 aa, Homo Sapiens
EIKGTNGQVTR

SEQ ID NO: 50841 - protein, 11 aa, Homo Sapiens
EILDSQNLNSR

SEQ ID NO: 50842 - protein, 11 aa, Homo Sapiens
EILELAGNAAR

SEQ ID NO: 50843 - protein, 11 aa, Homo Sapiens
EIMEVAKERSR

SEQ ID NO: 50844 - protein, 11 aa, Homo Sapiens
EIPDNVGDWLR

SEQ ID NO: 50845 - protein, 11 aa, Homo Sapiens
EIVGNLPSAMR

SEQ ID NO: 50846 - protein, 11 aa, Homo Sapiens
ELFHVEPGLQR

SEQ ID NO: 50847 - protein, 11 aa, Homo Sapiens
ELFRPKDPQGR

SEQ ID NO: 50848 - protein, 11 aa, Homo Sapiens
ELFYSQHFSGR

SEQ ID NO: 50849 - protein, 11 aa, Homo Sapiens
ELHGNLSQTQR

SEQ ID NO: 50850 - protein, 11 aa, Homo Sapiens
ELKLIGEYGLR

SEQ ID NO: 50851 - protein, 11 aa, Homo Sapiens
ELPDVSEFMTR

SEQ ID NO: 50852 - protein, 11 aa, Homo Sapiens
ELQGGFNGVSR

SEQ ID NO: 50853 - protein, 11 aa, Homo Sapiens
ELQGNLIVVGR

SEQ ID NO: 50854 - protein, 11 aa, Homo Sapiens
ELVEPSSVALR

SEQ ID NO: 50855 - protein, 11 aa, Homo Sapiens
EMVTISDASQR

SEQ ID NO: 50856 - protein, 11 aa, Homo Sapiens
EPHLPHGVSQR

SEQ ID NO: 50857 - protein, 11 aa, Homo Sapiens
EQAELEKLKQR

SEQ ID NO: 50858 - protein, 11 aa, Homo Sapiens
EQIGCVELHQR

SEQ ID NO: 50859 - protein, 11 aa, Homo Sapiens
EQMVLAHVTNR

SEQ ID NO: 50860 - protein, 11 aa, Homo Sapiens
EQVDTSVVSQR

SEQ ID NO: 50861 - protein, 11 aa, Homo Sapiens
EQYGALGGTAR

SEQ ID NO: 50862 - protein, 11 aa, Homo Sapiens
ESAACGFLVGR

SEQ ID NO: 50863 - protein, 11 aa, Homo Sapiens
ESAGGLIQTAR

SEQ ID NO: 50864 - protein, 11 aa, Homo Sapiens
ESFASDPILYR

SEQ ID NO: 50865 - protein, 11 aa, Homo Sapiens
ESFFPYQVTER

SEQ ID NO: 50866 - protein, 11 aa, Homo Sapiens
ESIDPQFTIRR

SEQ ID NO: 50867 - protein, 11 aa, Homo Sapiens
ESIGNCPFSQR

SEQ ID NO: 50868 - protein, 11 aa, Homo Sapiens
ESSAGGSFTVR

SEQ ID NO: 50869 - protein, 11 aa, Homo Sapiens
ESYTPSKISVR

SEQ ID NO: 50870 - protein, 11 aa, Homo Sapiens
ETAIPSSTRQA

SEQ ID NO: 50871 - protein, 11 aa, Homo Sapiens
ETFRSSDPATR

SEQ ID NO: 50872 - protein, 11 aa, Homo Sapiens
ETIDNGFGHSR

SEQ ID NO: 50873 - protein, 11 aa, Homo Sapiens
ETIDTSRVSLR

SEQ ID NO: 50874 - protein, 11 aa, Homo Sapiens
ETIHADSVAKR

SEQ ID NO: 50875 - protein, 11 aa, Homo Sapiens
ETIMSSSMGKR

SEQ ID NO: 50876 - protein, 11 aa, Homo Sapiens
ETQGQQPPQRR

SEQ ID NO: 50877 - protein, 11 aa, Homo Sapiens
ETQVSDFLSGR

SEQ ID NO: 50878 - protein, 11 aa, Homo Sapiens
ETSQAGLFRLW

SEQ ID NO: 50879 - protein, 11 aa, Homo Sapiens
EVAGTVTGQKR

SEQ ID NO: 50880 - protein, 11 aa, Homo Sapiens
EVANPDGDFRL

SEQ ID NO: 50881 - protein, 11 aa, Homo Sapiens
EVAPEIKASER

SEQ ID NO: 50882 - protein, 11 aa, Homo Sapiens
EVAPHHLFLSH

SEQ ID NO: 50883 - protein, 11 aa, Homo Sapiens
EVAVAGTELFR

SEQ ID NO: 50884 - protein, 11 aa, Homo Sapiens
EVFEVGVTSHR

SEQ ID NO: 50885 - protein, 11 aa, Homo Sapiens
EVFFSEKIYKL

SEQ ID NO: 50886 - protein, 11 aa, Homo Sapiens
EVFIGESLSSR

SEQ ID NO: 50887 - protein, 11 aa, Homo Sapiens
EVFTTLSVTKR

SEQ ID NO: 50888 - protein, 11 aa, Homo Sapiens
EVFTTTEGRTR

SEQ ID NO: 50889 - protein, 11 aa, Homo Sapiens
EVGGGVGGSSR

SEQ ID NO: 50890 - protein, 11 aa, Homo Sapiens
EVGICNEAGFR

SEQ ID NO: 50891 - protein, 11 aa, Homo Sapiens
EVGPGPGGITR

SEQ ID NO: 50892 - protein, 11 aa, Homo Sapiens
EVGPREAGLRR

SEQ ID NO: 50893 - protein, 11 aa, Homo Sapiens
EVHAVGLYGAR

SEQ ID NO: 50894 - protein, 11 aa, Homo Sapiens
EVHSPPNVGLR

SEQ ID NO: 50895 - protein, 11 aa, Homo Sapiens
EVIAVKSAQNR

SEQ ID NO: 50896 - protein, 11 aa, Homo Sapiens
EVIDQRLIEAR

SEQ ID NO: 50897 - protein, 11 aa, Homo Sapiens
EVIEGYEIACR

SEQ ID NO: 50898 - protein, 11 aa, Homo Sapiens
EVIGSKLNISR

SEQ ID NO: 50899 - protein, 11 aa, Homo Sapiens
EVIKTRLQSSR

SEQ ID NO: 50900 - protein, 11 aa, Homo Sapiens
EVIPYTPAMQR

SEQ ID NO: 50901 - protein, 11 aa, Homo Sapiens
EVISLSQVTPK

SEQ ID NO: 50902 - protein, 11 aa, Homo Sapiens
EVISTPGVVAR

SEQ ID NO: 50903 - protein, 11 aa, Homo Sapiens
EVIVVVGGCER

SEQ ID NO: 50904 - protein, 11 aa, Homo Sapiens
EVKQVESGTLR

SEQ ID NO: 50905 - protein, 11 aa, Homo Sapiens
EVLDHKEFKAR

SEQ ID NO: 50906 - protein, 11 aa, Homo Sapiens
EVQDRVMLTGR

SEQ ID NO: 50907 - protein, 11 aa, Homo Sapiens
EVQQARDLQNR

SEQ ID NO: 50908 - protein, 11 aa, Homo Sapiens
EVQVASQSSQR

SEQ ID NO: 50909 - protein, 11 aa, Homo Sapiens
EVRADTGGLGR

SEQ ID NO: 50910 - protein, 11 aa, Homo Sapiens
EVRAVGQGVLR

SEQ ID NO: 50911 - protein, 11 aa, Homo Sapiens
EVRFGGKKTQR

SEQ ID NO: 50912 - protein, 11 aa, Homo Sapiens
EVTDHNLHELR

SEQ ID NO: 50913 - protein, 11 aa, Homo Sapiens
EVTPVTGASLR

SEQ ID NO: 50914 - protein, 11 aa, Homo Sapiens
EVVDTTASTKR

SEQ ID NO: 50915 - protein, 11 aa, Homo Sapiens
EVVEGMDISTR

SEQ ID NO: 50916 - protein, 11 aa, Homo Sapiens
EVVTGVIGQRM

SEQ ID NO: 50917 - protein, 11 aa, Homo Sapiens
EVVTPNIFNSR

SEQ ID NO: 50918 - protein, 11 aa, Homo Sapiens
EVWIPKNGTRR

SEQ ID NO: 50919 - protein, 11 aa, Homo Sapiens
EVYQGCGTELR

SEQ ID NO: 50920 - protein, 11 aa, Homo Sapiens
FVIDSDHLGHR

SEQ ID NO: 50921 - protein, 11 aa, Homo Sapiens
HIYAITDTAYR

SEQ ID NO: 50922 - protein, 11 aa, Homo Sapiens
HVAESSLSRLR

SEQ ID NO: 50923 - protein, 11 aa, Homo Sapiens
HVKTGGKISLR

SEQ ID NO: 50924 - protein, 11 aa, Homo Sapiens
IDAKLEKTSLN

SEQ ID NO: 50925 - protein, 11 aa, Homo Sapiens
LPYHTTDASLR

SEQ ID NO: 50926 - protein, 11 aa, Homo Sapiens
LVFPSEIVGKR

SEQ ID NO: 50927 - protein, 11 aa, Homo Sapiens
LVGPDGVPLRR

SEQ ID NO: 50928 - protein, 11 aa, Homo Sapiens
LVWKPRPASAR

SEQ ID NO: 50929 - protein, 11 aa, Homo Sapiens
MAAAGAAVARS

SEQ ID NO: 50930 - protein, 11 aa, Homo Sapiens
MVVDSSNTALR

SEQ ID NO: 50931 - protein, 11 aa, Homo Sapiens
QGYTQPGPGYR

SEQ ID NO: 50932 - protein, 11 aa, Homo Sapiens
QVIGPLTEGQR

SEQ ID NO: 50933 - protein, 11 aa, Homo Sapiens
QVPLVAGTVNR

SEQ ID NO: 50934 - protein, 11 aa, Homo Sapiens
SPISAQDLLSR

SEQ ID NO: 50935 - protein, 11 aa, Homo Sapiens
SVAGLTAAAYR

SEQ ID NO: 50936 - protein, 11 aa, Homo Sapiens
SVAPHETQTQR

SEQ ID NO: 50937 - protein, 11 aa, Homo Sapiens
SVISSRNTGQR

SEQ ID NO: 50938 - protein, 11 aa, Homo Sapiens
SVYYNEATGGK

SEQ ID NO: 50939 - protein, 11 aa, Homo Sapiens
TAFYASRHSGR

SEQ ID NO: 50940 - protein, 11 aa, Homo Sapiens
TAIEAQHLLKR

SEQ ID NO: 50941 - protein, 11 aa, Homo Sapiens
TLIDPETLLPR

SEQ ID NO: 50942 - protein, 11 aa, Homo Sapiens
TRLAAGSAVQR

SEQ ID NO: 50943 - protein, 11 aa, Homo Sapiens
TSFFPTAGGFR

SEQ ID NO: 50944 - protein, 11 aa, Homo Sapiens
TVFDAKRLIGR

SEQ ID NO: 50945 - protein, 11 aa, Homo Sapiens
TVFGATGFLGR

SEQ ID NO: 50946 - protein, 11 aa, Homo Sapiens
TVYGGYLCSVR

SEQ ID NO: 50947 - protein, 11 aa, Homo Sapiens
VPADAEALSER

SEQ ID NO: 50948 - protein, 11 aa, Homo Sapiens
VPADYPAQSPL

SEQ ID NO: 50949 - protein, 8 aa, Homo Sapiens
AAAAFAEK

SEQ ID NO: 50950 - protein, 8 aa, Homo Sapiens
AAQKFLER

SEQ ID NO: 50951 - protein, 8 aa, Homo Sapiens
AGGAWTYK

SEQ ID NO: 50952 - protein, 8 aa, Homo Sapiens
AKDIGFIK

SEQ ID NO: 50953 - protein, 8 aa, Homo Sapiens
APPEYHRK

SEQ ID NO: 50954 - protein, 8 aa, Homo Sapiens
AVKPFGLK

SEQ ID NO: 50955 - protein, 8 aa, Homo Sapiens
CGQDITTK

SEQ ID NO: 50956 - protein, 8 aa, Homo Sapiens
DELRDEGK

SEQ ID NO: 50957 - protein, 8 aa, Homo Sapiens
DERAINKK

SEQ ID NO: 50958 - protein, 8 aa, Homo Sapiens
DERTINKK

SEQ ID NO: 50959 - protein, 8 aa, Homo Sapiens
DPRNPVNK

SEQ ID NO: 50960 - protein, 8 aa, Homo Sapiens
DTNADKQL

SEQ ID NO: 50961 - protein, 8 aa, Homo Sapiens
DVYLGRYR

SEQ ID NO: 50962 - protein, 8 aa, Homo Sapiens
EAVAFRKS

SEQ ID NO: 50963 - protein, 8 aa, Homo Sapiens
EAYRPIRK

SEQ ID NO: 50964 - protein, 8 aa, Homo Sapiens
EIAKPLKH

SEQ ID NO: 50965 - protein, 8 aa, Homo Sapiens
ESTSFLEK

SEQ ID NO: 50966 - protein, 8 aa, Homo Sapiens
ESYAFNMK

SEQ ID NO: 50967 - protein, 8 aa, Homo Sapiens
ETFISSPK

SEQ ID NO: 50968 - protein, 8 aa, Homo Sapiens
ETTVTSLK

SEQ ID NO: 50969 - protein, 8 aa, Homo Sapiens
ETYKFCER

SEQ ID NO: 50970 - protein, 8 aa, Homo Sapiens
EVFTVGPK

SEQ ID NO: 50971 - protein, 8 aa, Homo Sapiens
EVGPVLSK

SEQ ID NO: 50972 - protein, 8 aa, Homo Sapiens
FDGRVVAK

SEQ ID NO: 50973 - protein, 8 aa, Homo Sapiens
FSGVYKKL

SEQ ID NO: 50974 - protein, 8 aa, Homo Sapiens
IDWSDVRK

SEQ ID NO: 50975 - protein, 8 aa, Homo Sapiens
LLFMSLIK

SEQ ID NO: 50976 - protein, 8 aa, Homo Sapiens
LVNEVTEF

SEQ ID NO: 50977 - protein, 8 aa, Homo Sapiens
MAVSMEKK

SEQ ID NO: 50978 - protein, 8 aa, Homo Sapiens
MSLTACKV

SEQ ID NO: 50979 - protein, 8 aa, Homo Sapiens
MTALTWNK

SEQ ID NO: 50980 - protein, 8 aa, Homo Sapiens
MVGPVIAK

SEQ ID NO: 50981 - protein, 8 aa, Homo Sapiens
MVQQLGKA

SEQ ID NO: 50982 - protein, 8 aa, Homo Sapiens
MVYVGIPK

SEQ ID NO: 50983 - protein, 8 aa, Homo Sapiens
PANTPLRK

SEQ ID NO: 50984 - protein, 8 aa, Homo Sapiens
PASPFRVK

SEQ ID NO: 50985 - protein, 8 aa, Homo Sapiens
PATHIRGK

SEQ ID NO: 50986 - protein, 8 aa, Homo Sapiens
PDIAVGTK

SEQ ID NO: 50987 - protein, 8 aa, Homo Sapiens
PGHTPSLR

SEQ ID NO: 50988 - protein, 8 aa, Homo Sapiens
PPPSVVTR

SEQ ID NO: 50989 - protein, 8 aa, Homo Sapiens
PTLVEVSR

SEQ ID NO: 50990 - protein, 8 aa, Homo Sapiens
QEAFDISK

SEQ ID NO: 50991 - protein, 8 aa, Homo Sapiens
QILVGVNK

SEQ ID NO: 50992 - protein, 8 aa, Homo Sapiens
QLYWSHPR

SEQ ID NO: 50993 - protein, 8 aa, Homo Sapiens
RAKFKQLL

SEQ ID NO: 50994 - protein, 8 aa, Homo Sapiens
SGPSIVHR

SEQ ID NO: 50995 - protein, 8 aa, Homo Sapiens
SIRGIGPK

SEQ ID NO: 50996 - protein, 8 aa, Homo Sapiens
SLGLVLVH

SEQ ID NO: 50997 - protein, 8 aa, Homo Sapiens
SPLTAEKL

SEQ ID NO: 50998 - protein, 8 aa, Homo Sapiens
TAFAFHLR

SEQ ID NO: 50999 - protein, 8 aa, Homo Sapiens
TEAPLNPK

SEQ ID NO: 51000 - protein, 8 aa, Homo Sapiens
TFSGVYKK

SEQ ID NO: 51001 - protein, 8 aa, Homo Sapiens
TIGEILKK

SEQ ID NO: 51002 - protein, 8 aa, Homo Sapiens
TIGKKFEK

SEQ ID NO: 51003 - protein, 8 aa, Homo Sapiens
TKSWIREK

SEQ ID NO: 51004 - protein, 8 aa, Homo Sapiens
TMPCVKKK

SEQ ID NO: 51005 - protein, 8 aa, Homo Sapiens
TRAEFAER

SEQ ID NO: 51006 - protein, 8 aa, Homo Sapiens
TRPTPVQK

SEQ ID NO: 51007 - protein, 8 aa, Homo Sapiens
TVAPTECS

SEQ ID NO: 51008 - protein, 8 aa, Homo Sapiens
TVDIFHKK

SEQ ID NO: 51009 - protein, 8 aa, Homo Sapiens
VAGTLTNK

SEQ ID NO: 51010 - protein, 8 aa, Homo Sapiens
VAPPEYHR

SEQ ID NO: 51011 - protein, 8 aa, Homo Sapiens
VFRDPALK

SEQ ID NO: 51012 - protein, 8 aa, Homo Sapiens
VFSHILKR

SEQ ID NO: 51013 - protein, 8 aa, Homo Sapiens
VTAPPARN

SEQ ID NO: 51014 - protein, 8 aa, Homo Sapiens
YDHQGIFK

SEQ ID NO: 51015 - protein, 9 aa, Homo Sapiens
AAAKVILKK

SEQ ID NO: 51016 - protein, 9 aa, Homo Sapiens
AAAPGLGPR

SEQ ID NO: 51017 - protein, 9 aa, Homo Sapiens
AAFGGTFKK

SEQ ID NO: 51018 - protein, 9 aa, Homo Sapiens
AFPSQGTKR

SEQ ID NO: 51019 - protein, 9 aa, Homo Sapiens
AFRQTYEKF

SEQ ID NO: 51020 - protein, 9 aa, Homo Sapiens
AGKTTILYK

SEQ ID NO: 51021 - protein, 9 aa, Homo Sapiens
AIYEPKTFK

SEQ ID NO: 51022 - protein, 9 aa, Homo Sapiens
APARPLIFK

SEQ ID NO: 51023 - protein, 9 aa, Homo Sapiens
ASSPPAIPK

SEQ ID NO: 51024 - protein, 9 aa, Homo Sapiens
ATAAPLTPR

SEQ ID NO: 51025 - protein, 9 aa, Homo Sapiens
ATEQPLTAK

SEQ ID NO: 51026 - protein, 9 aa, Homo Sapiens
ATFTVMGLK

SEQ ID NO: 51027 - protein, 9 aa, Homo Sapiens
ATKVEGPGW

SEQ ID NO: 51028 - protein, 9 aa, Homo Sapiens
ATLSICSPK

SEQ ID NO: 51029 - protein, 9 aa, Homo Sapiens
ATTLPIRNK

SEQ ID NO: 51030 - protein, 9 aa, Homo Sapiens
ATYSVGMQK

SEQ ID NO: 51031 - protein, 9 aa, Homo Sapiens
ATYTPQAPK

SEQ ID NO: 51032 - protein, 9 aa, Homo Sapiens
AVAAFVLYK

SEQ ID NO: 51033 - protein, 9 aa, Homo Sapiens
AVALPLQTK

SEQ ID NO: 51034 - protein, 9 aa, Homo Sapiens
AVKDPLVKK

SEQ ID NO: 51035 - protein, 9 aa, Homo Sapiens
AVLLVFANK

SEQ ID NO: 51036 - protein, 9 aa, Homo Sapiens
AVLSWKLAK

SEQ ID NO: 51037 - protein, 9 aa, Homo Sapiens
AVRKPIVLK

SEQ ID NO: 51038 - protein, 9 aa, Homo Sapiens
AVSTPNTPR

SEQ ID NO: 51039 - protein, 9 aa, Homo Sapiens
CTIIPLMKK

SEQ ID NO: 51040 - protein, 9 aa, Homo Sapiens
CTYDKVQSY

SEQ ID NO: 51041 - protein, 9 aa, Homo Sapiens
CVKEIGLLK

SEQ ID NO: 51042 - protein, 9 aa, Homo Sapiens
DAAFLAREK

SEQ ID NO: 51043 - protein, 9 aa, Homo Sapiens
DAAGVFCIR

SEQ ID NO: 51044 - protein, 9 aa, Homo Sapiens
DAAIFEAKK

SEQ ID NO: 51045 - protein, 9 aa, Homo Sapiens
DAAKDSILR

SEQ ID NO: 51046 - protein, 9 aa, Homo Sapiens
DAAKPLLRK

SEQ ID NO: 51047 - protein, 9 aa, Homo Sapiens
DAARFQIGK

SEQ ID NO: 51048 - protein, 9 aa, Homo Sapiens
DAFEAQFQK

SEQ ID NO: 51049 - protein, 9 aa, Homo Sapiens
DAFTIKTVK

SEQ ID NO: 51050 - protein, 9 aa, Homo Sapiens
DAIPVFLEK

SEQ ID NO: 51051 - protein, 9 aa, Homo Sapiens
DAIRGGLPK

SEQ ID NO: 51052 - protein, 9 aa, Homo Sapiens
DAIRTATEK

SEQ ID NO: 51053 - protein, 9 aa, Homo Sapiens
DAKGGSFYR

SEQ ID NO: 51054 - protein, 9 aa, Homo Sapiens
DALAKVIQH

SEQ ID NO: 51055 - protein, 9 aa, Homo Sapiens
DALDALGLK

SEQ ID NO: 51056 - protein, 9 aa, Homo Sapiens
DALEKCLKK

SEQ ID NO: 51057 - protein, 9 aa, Homo Sapiens
DALGHFFQY

SEQ ID NO: 51058 - protein, 9 aa, Homo Sapiens
DALKIQLKY

SEQ ID NO: 51059 - protein, 9 aa, Homo Sapiens
DALNAITKK

SEQ ID NO: 51060 - protein, 9 aa, Homo Sapiens
DAMAKVLNK

SEQ ID NO: 51061 - protein, 9 aa, Homo Sapiens
DANLPSLQK

SEQ ID NO: 51062 - protein, 9 aa, Homo Sapiens
DASESALLK

SEQ ID NO: 51063 - protein, 9 aa, Homo Sapiens
DASLSTYFK

SEQ ID NO: 51064 - protein, 9 aa, Homo Sapiens
DASNPLLLK

SEQ ID NO: 51065 - protein, 9 aa, Homo Sapiens
DAWMGTHPK

SEQ ID NO: 51066 - protein, 9 aa, Homo Sapiens
DIAIPCNNK

SEQ ID NO: 51067 - protein, 9 aa, Homo Sapiens
DIASHFSNK

SEQ ID NO: 51068 - protein, 9 aa, Homo Sapiens
DICSLLLQH

SEQ ID NO: 51069 - protein, 9 aa, Homo Sapiens
DIFKGVVTK

SEQ ID NO: 51070 - protein, 9 aa, Homo Sapiens
DIFPPKSEK

SEQ ID NO: 51071 - protein, 9 aa, Homo Sapiens
DIFQASGAK

SEQ ID NO: 51072 - protein, 9 aa, Homo Sapiens
DIHNKTLYH

SEQ ID NO: 51073 - protein, 9 aa, Homo Sapiens
DIHVTVQPK

SEQ ID NO: 51074 - protein, 9 aa, Homo Sapiens
DIIGPMPAK

SEQ ID NO: 51075 - protein, 9 aa, Homo Sapiens
DIMWPIIAK

SEQ ID NO: 51076 - protein, 9 aa, Homo Sapiens
DINQESAPK

SEQ ID NO: 51077 - protein, 9 aa, Homo Sapiens
DIPHALREK

SEQ ID NO: 51078 - protein, 9 aa, Homo Sapiens
DIQKPPLSH

SEQ ID NO: 51079 - protein, 9 aa, Homo Sapiens
DISHLVRKK

SEQ ID NO: 51080 - protein, 9 aa, Homo Sapiens
DIVTTTTHK

SEQ ID NO: 51081 - protein, 9 aa, Homo Sapiens
DIYAMKVMK

SEQ ID NO: 51082 - protein, 9 aa, Homo Sapiens
DIYRPTIHK

SEQ ID NO: 51083 - protein, 9 aa, Homo Sapiens
DIYSKTWTK

SEQ ID NO: 51084 - protein, 9 aa, Homo Sapiens
DIYSNSNLK

SEQ ID NO: 51085 - protein, 9 aa, Homo Sapiens
DLAKVIQTK

SEQ ID NO: 51086 - protein, 9 aa, Homo Sapiens
DLCDKIFQK

SEQ ID NO: 51087 - protein, 9 aa, Homo Sapiens
DLDGHPVPK

SEQ ID NO: 51088 - protein, 9 aa, Homo Sapiens
DLGQPVKNK

SEQ ID NO: 51089 - protein, 9 aa, Homo Sapiens
DLKESLRTK

SEQ ID NO: 51090 - protein, 9 aa, Homo Sapiens
DLLDKLLRY

SEQ ID NO: 51091 - protein, 9 aa, Homo Sapiens
DLLIPLTNR

SEQ ID NO: 51092 - protein, 9 aa, Homo Sapiens
DLLNIIREK

SEQ ID NO: 51093 - protein, 9 aa, Homo Sapiens
DLPDIQIKH

SEQ ID NO: 51094 - protein, 9 aa, Homo Sapiens
DLPPPSALK

SEQ ID NO: 51095 - protein, 9 aa, Homo Sapiens
DLVRPLLPK

SEQ ID NO: 51096 - protein, 9 aa, Homo Sapiens
DLYDNQIKK

SEQ ID NO: 51097 - protein, 9 aa, Homo Sapiens
DLYKTPCTK

SEQ ID NO: 51098 - protein, 9 aa, Homo Sapiens
DLYNGATRK

SEQ ID NO: 51099 - protein, 9 aa, Homo Sapiens
DLYNGKTTK

SEQ ID NO: 51100 - protein, 9 aa, Homo Sapiens
DMSVPAVAK

SEQ ID NO: 51101 - protein, 9 aa, Homo Sapiens
DPYNPLNFK

SEQ ID NO: 51102 - protein, 9 aa, Homo Sapiens
DQNSPVLPK

SEQ ID NO: 51103 - protein, 9 aa, Homo Sapiens
DSACVIGLK

SEQ ID NO: 51104 - protein, 9 aa, Homo Sapiens
DSAPLALLH

SEQ ID NO: 51105 - protein, 9 aa, Homo Sapiens
DSCPNPIQR

SEQ ID NO: 51106 - protein, 9 aa, Homo Sapiens
DSCTKLLQK

SEQ ID NO: 51107 - protein, 9 aa, Homo Sapiens
DSFGKSFKH

SEQ ID NO: 51108 - protein, 9 aa, Homo Sapiens
DSLRYIYPK

SEQ ID NO: 51109 - protein, 9 aa, Homo Sapiens
DSMGIQIVK

SEQ ID NO: 51110 - protein, 9 aa, Homo Sapiens
DSSPWSAGK

SEQ ID NO: 51111 - protein, 9 aa, Homo Sapiens
DSSRPVWLK

SEQ ID NO: 51112 - protein, 9 aa, Homo Sapiens
DSSYFKIFK

SEQ ID NO: 51113 - protein, 9 aa, Homo Sapiens
DSYFGGRLR

SEQ ID NO: 51114 - protein, 9 aa, Homo Sapiens
DSYKVTHYK

SEQ ID NO: 51115 - protein, 9 aa, Homo Sapiens
DTAEKFYQK

SEQ ID NO: 51116 - protein, 9 aa, Homo Sapiens
DTCRLALVY

SEQ ID NO: 51117 - protein, 9 aa, Homo Sapiens
DTCRVKLKY

SEQ ID NO: 51118 - protein, 9 aa, Homo Sapiens
DTCVIPLRH

SEQ ID NO: 51119 - protein, 9 aa, Homo Sapiens
DTFFFILRK

SEQ ID NO: 51120 - protein, 9 aa, Homo Sapiens
DTFFGVKNK

SEQ ID NO: 51121 - protein, 9 aa, Homo Sapiens
DTFNKSPPK

SEQ ID NO: 51122 - protein, 9 aa, Homo Sapiens
DTFPQVLKK

SEQ ID NO: 51123 - protein, 9 aa, Homo Sapiens
DTFSVAFIK

SEQ ID NO: 51124 - protein, 9 aa, Homo Sapiens
DTHSLDSLK

SEQ ID NO: 51125 - protein, 9 aa, Homo Sapiens
DTIEEMALK

SEQ ID NO: 51126 - protein, 9 aa, Homo Sapiens
DTIEIITDR

SEQ ID NO: 51127 - protein, 9 aa, Homo Sapiens
DTIENVKAK

SEQ ID NO: 51128 - protein, 9 aa, Homo Sapiens
DTIFIILRK

SEQ ID NO: 51129 - protein, 9 aa, Homo Sapiens
DTIGYLLTR

SEQ ID NO: 51130 - protein, 9 aa, Homo Sapiens
DTIKPDVQK

SEQ ID NO: 51131 - protein, 9 aa, Homo Sapiens
DTLAHVLYY

SEQ ID NO: 51132 - protein, 9 aa, Homo Sapiens
DTLDKVFTY

SEQ ID NO: 51133 - protein, 9 aa, Homo Sapiens
DTLDRVVKP

SEQ ID NO: 51134 - protein, 9 aa, Homo Sapiens
DTLFPSSKK

SEQ ID NO: 51135 - protein, 9 aa, Homo Sapiens
DTLGIPKST

SEQ ID NO: 51136 - protein, 9 aa, Homo Sapiens
DTLPRTPSY

SEQ ID NO: 51137 - protein, 9 aa, Homo Sapiens
DTLQGIALK

SEQ ID NO: 51138 - protein, 9 aa, Homo Sapiens
DTLTPLIKK

SEQ ID NO: 51139 - protein, 9 aa, Homo Sapiens
DTLVMQLEK

SEQ ID NO: 51140 - protein, 9 aa, Homo Sapiens
DTNDRFLRK

SEQ ID NO: 51141 - protein, 9 aa, Homo Sapiens
DTPRPLVGR

SEQ ID NO: 51142 - protein, 9 aa, Homo Sapiens
DTSHYILIK

SEQ ID NO: 51143 - protein, 9 aa, Homo Sapiens
DTVIVGTVK

SEQ ID NO: 51144 - protein, 9 aa, Homo Sapiens
DTVLLKGKK

SEQ ID NO: 51145 - protein, 9 aa, Homo Sapiens
DTVTGLLER

SEQ ID NO: 51146 - protein, 9 aa, Homo Sapiens
DTWHYFLHR

SEQ ID NO: 51147 - protein, 9 aa, Homo Sapiens
DTYAPFPGK

SEQ ID NO: 51148 - protein, 9 aa, Homo Sapiens
DTYVEFPLR

SEQ ID NO: 51149 - protein, 9 aa, Homo Sapiens
DVAIPLHLK

SEQ ID NO: 51150 - protein, 9 aa, Homo Sapiens
DVAPPGVRK

SEQ ID NO: 51151 - protein, 9 aa, Homo Sapiens
DVAPTHILY

SEQ ID NO: 51152 - protein, 9 aa, Homo Sapiens
DVARAINQK

SEQ ID NO: 51153 - protein, 9 aa, Homo Sapiens
DVASVIVTK

SEQ ID NO: 51154 - protein, 9 aa, Homo Sapiens
DVCDKPLLY

SEQ ID NO: 51155 - protein, 9 aa, Homo Sapiens
DVCDVPTAK

SEQ ID NO: 51156 - protein, 9 aa, Homo Sapiens
DVCGKIFRK

SEQ ID NO: 51157 - protein, 9 aa, Homo Sapiens
DVCKTILNH

SEQ ID NO: 51158 - protein, 9 aa, Homo Sapiens
DVDAPRLLK

SEQ ID NO: 51159 - protein, 9 aa, Homo Sapiens
DVEKSLPPK

SEQ ID NO: 51160 - protein, 9 aa, Homo Sapiens
DVFIPLYPK

SEQ ID NO: 51161 - protein, 9 aa, Homo Sapiens
DVFKNMPSK

SEQ ID NO: 51162 - protein, 9 aa, Homo Sapiens
DVFQITLKK

SEQ ID NO: 51163 - protein, 9 aa, Homo Sapiens
DVFVVGTER

SEQ ID NO: 51164 - protein, 9 aa, Homo Sapiens
DVFYANMKK

SEQ ID NO: 51165 - protein, 9 aa, Homo Sapiens
DVIAKVAFK

SEQ ID NO: 51166 - protein, 9 aa, Homo Sapiens
DVIAQGIGK

SEQ ID NO: 51167 - protein, 9 aa, Homo Sapiens
DVIKPGTVK

SEQ ID NO: 51168 - protein, 9 aa, Homo Sapiens
DVIYPTRTK

SEQ ID NO: 51169 - protein, 9 aa, Homo Sapiens
DVKTGTCLK

SEQ ID NO: 51170 - protein, 9 aa, Homo Sapiens
DVLDVYIEH

SEQ ID NO: 51171 - protein, 9 aa, Homo Sapiens
DVLEQFLTY

SEQ ID NO: 51172 - protein, 9 aa, Homo Sapiens
DVLKKMQSK

SEQ ID NO: 51173 - protein, 9 aa, Homo Sapiens
DVLKPLGHK

SEQ ID NO: 51174 - protein, 9 aa, Homo Sapiens
DVLPTRPKK

SEQ ID NO: 51175 - protein, 9 aa, Homo Sapiens
DVLQWIVQR

SEQ ID NO: 51176 - protein, 9 aa, Homo Sapiens
DVLRLLLQH

SEQ ID NO: 51177 - protein, 9 aa, Homo Sapiens
DVLSHFAQR

SEQ ID NO: 51178 - protein, 9 aa, Homo Sapiens
DVMDVNTQK

SEQ ID NO: 51179 - protein, 9 aa, Homo Sapiens
DVMPSGRSR

SEQ ID NO: 51180 - protein, 9 aa, Homo Sapiens
DVPKPQKPK

SEQ ID NO: 51181 - protein, 9 aa, Homo Sapiens
DVRMGGSFR

SEQ ID NO: 51182 - protein, 9 aa, Homo Sapiens
DVRVQEVPK

SEQ ID NO: 51183 - protein, 9 aa, Homo Sapiens
DVSDSSFPK

SEQ ID NO: 51184 - protein, 9 aa, Homo Sapiens
DVSVALPNK

SEQ ID NO: 51185 - protein, 9 aa, Homo Sapiens
DVTAPNTFK

SEQ ID NO: 51186 - protein, 9 aa, Homo Sapiens
DVTDVTFGK

SEQ ID NO: 51187 - protein, 9 aa, Homo Sapiens
DVVSKFLNR

SEQ ID NO: 51188 - protein, 9 aa, Homo Sapiens
DVYENLHTK

SEQ ID NO: 51189 - protein, 9 aa, Homo Sapiens
DVYNHFLLY

SEQ ID NO: 51190 - protein, 9 aa, Homo Sapiens
DVYPEIIER

SEQ ID NO: 51191 - protein, 9 aa, Homo Sapiens
DVYSGTPTK

SEQ ID NO: 51192 - protein, 9 aa, Homo Sapiens
DVYSQILRK

SEQ ID NO: 51193 - protein, 9 aa, Homo Sapiens
DVYTPKSSR

SEQ ID NO: 51194 - protein, 9 aa, Homo Sapiens
EAAAFGSEK

SEQ ID NO: 51195 - protein, 9 aa, Homo Sapiens
EAAAIGALR

SEQ ID NO: 51196 - protein, 9 aa, Homo Sapiens
EAAAIIAQR

SEQ ID NO: 51197 - protein, 9 aa, Homo Sapiens
EAAAMGAVY

SEQ ID NO: 51198 - protein, 9 aa, Homo Sapiens
EAAAPLRVR

SEQ ID NO: 51199 - protein, 9 aa, Homo Sapiens
EAAAVLMAR

SEQ ID NO: 51200 - protein, 9 aa, Homo Sapiens
EAAESIAFR

SEQ ID NO: 51201 - protein, 9 aa, Homo Sapiens
EAAEVILRV

SEQ ID NO: 51202 - protein, 9 aa, Homo Sapiens
EAAFATKDR

SEQ ID NO: 51203 - protein, 9 aa, Homo Sapiens
EAAGQVMSH

SEQ ID NO: 51204 - protein, 9 aa, Homo Sapiens
EAAILSGWK

SEQ ID NO: 51205 - protein, 9 aa, Homo Sapiens
EAAKALVLK

SEQ ID NO: 51206 - protein, 9 aa, Homo Sapiens
EAAKDLLYR

SEQ ID NO: 51207 - protein, 9 aa, Homo Sapiens
EAAKEVFVK

SEQ ID NO: 51208 - protein, 9 aa, Homo Sapiens
EAAKILAEK

SEQ ID NO: 51209 - protein, 9 aa, Homo Sapiens
EAAKVFGLR

SEQ ID NO: 51210 - protein, 9 aa, Homo Sapiens
EAANFKLKY

SEQ ID NO: 51211 - protein, 9 aa, Homo Sapiens
EAAPPGELY

SEQ ID NO: 51212 - protein, 9 aa, Homo Sapiens
EAAPVVVGH

SEQ ID NO: 51213 - protein, 9 aa, Homo Sapiens
EAAQKFLER

SEQ ID NO: 51214 - protein, 9 aa, Homo Sapiens
EAASSFRTH

SEQ ID NO: 51215 - protein, 9 aa, Homo Sapiens
EAAVAFLFR

SEQ ID NO: 51216 - protein, 9 aa, Homo Sapiens
EAAVHFYGK

SEQ ID NO: 51217 - protein, 9 aa, Homo Sapiens
EAAYIGSMR

SEQ ID NO: 51218 - protein, 9 aa, Homo Sapiens
EAAYTLLLH

SEQ ID NO: 51219 - protein, 9 aa, Homo Sapiens
EACDIMVKR

SEQ ID NO: 51220 - protein, 9 aa, Homo Sapiens
EACDKVFSR

SEQ ID NO: 51221 - protein, 9 aa, Homo Sapiens
EACDRLLAH

SEQ ID NO: 51222 - protein, 9 aa, Homo Sapiens
EACGKSFKY

SEQ ID NO: 51223 - protein, 9 aa, Homo Sapiens
EACIYRLLK

SEQ ID NO: 51224 - protein, 9 aa, Homo Sapiens
EACRILLQY

SEQ ID NO: 51225 - protein, 9 aa, Homo Sapiens
EADGAWVVK

SEQ ID NO: 51226 - protein, 9 aa, Homo Sapiens
EADMNRLLK

SEQ ID NO: 51227 - protein, 9 aa, Homo Sapiens
EAFLTAQTK

SEQ ID NO: 51228 - protein, 9 aa, Homo Sapiens
EAFQTTISK

SEQ ID NO: 51229 - protein, 9 aa, Homo Sapiens
EAFSRPLSR

SEQ ID NO: 51230 - protein, 9 aa, Homo Sapiens
EAFVRAFLK

SEQ ID NO: 51231 - protein, 9 aa, Homo Sapiens
EAFWTPLKK

SEQ ID NO: 51232 - protein, 9 aa, Homo Sapiens
EAGGPLTPR

SEQ ID NO: 51233 - protein, 9 aa, Homo Sapiens
EAGPSIVHR

SEQ ID NO: 51234 - protein, 9 aa, Homo Sapiens
EAHFVPLVK

SEQ ID NO: 51235 - protein, 9 aa, Homo Sapiens
EAHLNTSFK

SEQ ID NO: 51236 - protein, 9 aa, Homo Sapiens
EAHNPLTDK

SEQ ID NO: 51237 - protein, 9 aa, Homo Sapiens
EAIAVFMEH

SEQ ID NO: 51238 - protein, 9 aa, Homo Sapiens
EAIEKLSKR

SEQ ID NO: 51239 - protein, 9 aa, Homo Sapiens
EAIEQILKY

SEQ ID NO: 51240 - protein, 9 aa, Homo Sapiens
EAIGAVIHY

SEQ ID NO: 51241 - protein, 9 aa, Homo Sapiens
EAIGPSTIR

SEQ ID NO: 51242 - protein, 9 aa, Homo Sapiens
EAIGVIFTH

SEQ ID NO: 51243 - protein, 9 aa, Homo Sapiens
EAIKEITEK

SEQ ID NO: 51244 - protein, 9 aa, Homo Sapiens
EAIKIGLTK

SEQ ID NO: 51245 - protein, 9 aa, Homo Sapiens
EAIPFVIEK

SEQ ID NO: 51246 - protein, 9 aa, Homo Sapiens
EAIPGLAAR

SEQ ID NO: 51247 - protein, 9 aa, Homo Sapiens
EAITQSVLK

SEQ ID NO: 51248 - protein, 9 aa, Homo Sapiens
EAIYPSVDK

SEQ ID NO: 51249 - protein, 9 aa, Homo Sapiens
EAKFPTMNR

SEQ ID NO: 51250 - protein, 9 aa, Homo Sapiens
EAKGLVTLK

SEQ ID NO: 51251 - protein, 9 aa, Homo Sapiens
EAKKIGLVK

SEQ ID NO: 51252 - protein, 9 aa, Homo Sapiens
EALAAARLK

SEQ ID NO: 51253 - protein, 9 aa, Homo Sapiens
EALAAVLTY

SEQ ID NO: 51254 - protein, 9 aa, Homo Sapiens
EALDHMVEY

SEQ ID NO: 51255 - protein, 9 aa, Homo Sapiens
EALDVIRGK

SEQ ID NO: 51256 - protein, 9 aa, Homo Sapiens
EALEEAAAK

SEQ ID NO: 51257 - protein, 9 aa, Homo Sapiens
EALESIKQK

SEQ ID NO: 51258 - protein, 9 aa, Homo Sapiens
EALGIAQPK

SEQ ID NO: 51259 - protein, 9 aa, Homo Sapiens
EALGLPTVK

SEQ ID NO: 51260 - protein, 9 aa, Homo Sapiens
EALGQFVMK

SEQ ID NO: 51261 - protein, 9 aa, Homo Sapiens
EALGSFIYH

SEQ ID NO: 51262 - protein, 9 aa, Homo Sapiens
EALIHAAGK

SEQ ID NO: 51263 - protein, 9 aa, Homo Sapiens
EALKHFRVK

SEQ ID NO: 51264 - protein, 9 aa, Homo Sapiens
EALKKYLFY

SEQ ID NO: 51265 - protein, 9 aa, Homo Sapiens
EALKLARQI

SEQ ID NO: 51266 - protein, 9 aa, Homo Sapiens
EALNQVTQR

SEQ ID NO: 51267 - protein, 9 aa, Homo Sapiens
EALNVLVNR

SEQ ID NO: 51268 - protein, 9 aa, Homo Sapiens
EALPACLLR

SEQ ID NO: 51269 - protein, 9 aa, Homo Sapiens
EALPQIAAK

SEQ ID NO: 51270 - protein, 9 aa, Homo Sapiens
EALPSAPER

SEQ ID NO: 51271 - protein, 9 aa, Homo Sapiens
EALPWASTH

SEQ ID NO: 51272 - protein, 9 aa, Homo Sapiens
EALQFALTR

SEQ ID NO: 51273 - protein, 9 aa, Homo Sapiens
EALQKIRQK

SEQ ID NO: 51274 - protein, 9 aa, Homo Sapiens
EALSEPLTK

SEQ ID NO: 51275 - protein, 9 aa, Homo Sapiens
EALSKFTLK

SEQ ID NO: 51276 - protein, 9 aa, Homo Sapiens
EALSLLLKR

SEQ ID NO: 51277 - protein, 9 aa, Homo Sapiens
EALSQAVAR

SEQ ID NO: 51278 - protein, 9 aa, Homo Sapiens
EALTALMSR

SEQ ID NO: 51279 - protein, 9 aa, Homo Sapiens
EALTILSKK

SEQ ID NO: 51280 - protein, 9 aa, Homo Sapiens
EALYDICFR

SEQ ID NO: 51281 - protein, 9 aa, Homo Sapiens
EALYIADRK

SEQ ID NO: 51282 - protein, 9 aa, Homo Sapiens
EAMALPLYR

SEQ ID NO: 51283 - protein, 9 aa, Homo Sapiens
EAMASIINR

SEQ ID NO: 51284 - protein, 9 aa, Homo Sapiens
EAMDVKLKR

SEQ ID NO: 51285 - protein, 9 aa, Homo Sapiens
EAMELIIAH

SEQ ID NO: 51286 - protein, 9 aa, Homo Sapiens
EAMERFGSR

SEQ ID NO: 51287 - protein, 9 aa, Homo Sapiens
EAMETTPAK

SEQ ID NO: 51288 - protein, 9 aa, Homo Sapiens
EAMKHVYFR

SEQ ID NO: 51289 - protein, 9 aa, Homo Sapiens
EAMLPTLGK

SEQ ID NO: 51290 - protein, 9 aa, Homo Sapiens
EAMPPPLLK

SEQ ID NO: 51291 - protein, 9 aa, Homo Sapiens
EAMPSLRSK

SEQ ID NO: 51292 - protein, 9 aa, Homo Sapiens
EAMRWFQQK

SEQ ID NO: 51293 - protein, 9 aa, Homo Sapiens
EAMTIFQNR

SEQ ID NO: 51294 - protein, 9 aa, Homo Sapiens
EAMTVAIRR

SEQ ID NO: 51295 - protein, 9 aa, Homo Sapiens
EANAIALKY

SEQ ID NO: 51296 - protein, 9 aa, Homo Sapiens
EANATQLLR

SEQ ID NO: 51297 - protein, 9 aa, Homo Sapiens
EANFGGSPR

SEQ ID NO: 51298 - protein, 9 aa, Homo Sapiens
EASCAALVK

SEQ ID NO: 51299 - protein, 9 aa, Homo Sapiens
EASDLLLNK

SEQ ID NO: 51300 - protein, 9 aa, Homo Sapiens
EASEATLFY

SEQ ID NO: 51301 - protein, 9 aa, Homo Sapiens
EASNQLINH

SEQ ID NO: 51302 - protein, 9 aa, Homo Sapiens
EASPGGLDR

SEQ ID NO: 51303 - protein, 9 aa, Homo Sapiens
EASPRILKK

SEQ ID NO: 51304 - protein, 9 aa, Homo Sapiens
EASRAILQR

SEQ ID NO: 51305 - protein, 9 aa, Homo Sapiens
EATAAILSR

SEQ ID NO: 51306 - protein, 9 aa, Homo Sapiens
EATASNLVK

SEQ ID NO: 51307 - protein, 9 aa, Homo Sapiens
EATESFLSK

SEQ ID NO: 51308 - protein, 9 aa, Homo Sapiens
EAVEAAINR

SEQ ID NO: 51309 - protein, 9 aa, Homo Sapiens
EAVFASEVK

SEQ ID NO: 51310 - protein, 9 aa, Homo Sapiens
EAVGVTSQR

SEQ ID NO: 51311 - protein, 9 aa, Homo Sapiens
EAVKPFGLK

SEQ ID NO: 51312 - protein, 9 aa, Homo Sapiens
EAVLWEALR

SEQ ID NO: 51313 - protein, 9 aa, Homo Sapiens
EAVQALRER

SEQ ID NO: 51314 - protein, 9 aa, Homo Sapiens
EAVRKLTAR

SEQ ID NO: 51315 - protein, 9 aa, Homo Sapiens
EAVSRVLNK

SEQ ID NO: 51316 - protein, 9 aa, Homo Sapiens
EAVSVYPEK

SEQ ID NO: 51317 - protein, 9 aa, Homo Sapiens
EAYDRRLAH

SEQ ID NO: 51318 - protein, 9 aa, Homo Sapiens
EAYEVLSDK

SEQ ID NO: 51319 - protein, 9 aa, Homo Sapiens
EAYFVPLVK

SEQ ID NO: 51320 - protein, 9 aa, Homo Sapiens
EAYIGADIK

SEQ ID NO: 51321 - protein, 9 aa, Homo Sapiens
EAYRFVKEK

SEQ ID NO: 51322 - protein, 9 aa, Homo Sapiens
EAYSGLTKK

SEQ ID NO: 51323 - protein, 9 aa, Homo Sapiens
EAYSKLLSH

SEQ ID NO: 51324 - protein, 9 aa, Homo Sapiens
EAYSVGTGR

SEQ ID NO: 51325 - protein, 9 aa, Homo Sapiens
EFCSYILSH

SEQ ID NO: 51326 - protein, 9 aa, Homo Sapiens
EGAGGFTAK

SEQ ID NO: 51327 - protein, 9 aa, Homo Sapiens
EGASPLSER

SEQ ID NO: 51328 - protein, 9 aa, Homo Sapiens
EGGPILPKK

SEQ ID NO: 51329 - protein, 9 aa, Homo Sapiens
EIAEKALKK

SEQ ID NO: 51330 - protein, 9 aa, Homo Sapiens
EIAGVKLLY

SEQ ID NO: 51331 - protein, 9 aa, Homo Sapiens
EIAPGIIRK

SEQ ID NO: 51332 - protein, 9 aa, Homo Sapiens
EIASFDKAK

SEQ ID NO: 51333 - protein, 9 aa, Homo Sapiens
EIASFPIYK

SEQ ID NO: 51334 - protein, 9 aa, Homo Sapiens
EICDAYTKK

SEQ ID NO: 51335 - protein, 9 aa, Homo Sapiens
EICEFSQQK

SEQ ID NO: 51336 - protein, 9 aa, Homo Sapiens
EICKQILTK

SEQ ID NO: 51337 - protein, 9 aa, Homo Sapiens
EIDEEPVSK

SEQ ID NO: 51338 - protein, 9 aa, Homo Sapiens
EIDVVSVEK

SEQ ID NO: 51339 - protein, 9 aa, Homo Sapiens
EIFASINQK

SEQ ID NO: 51340 - protein, 9 aa, Homo Sapiens
EIFDGIQPK

SEQ ID NO: 51341 - protein, 9 aa, Homo Sapiens
EIFDHLVAH

SEQ ID NO: 51342 - protein, 9 aa, Homo Sapiens
EIFERDLKK

SEQ ID NO: 51343 - protein, 9 aa, Homo Sapiens
EIFGTIGMR

SEQ ID NO: 51344 - protein, 9 aa, Homo Sapiens
EIFHDVAYK

SEQ ID NO: 51345 - protein, 9 aa, Homo Sapiens
EIFKKIGSK

SEQ ID NO: 51346 - protein, 9 aa, Homo Sapiens
EIFKQATMK

SEQ ID NO: 51347 - protein, 9 aa, Homo Sapiens
EIFQHLMAY

SEQ ID NO: 51348 - protein, 9 aa, Homo Sapiens
EIGKTLAEK

SEQ ID NO: 51349 - protein, 9 aa, Homo Sapiens
EIGPVSSSR

SEQ ID NO: 51350 - protein, 9 aa, Homo Sapiens
EIIKNVPLK

SEQ ID NO: 51351 - protein, 9 aa, Homo Sapiens
EIIKRFEQK

SEQ ID NO: 51352 - protein, 9 aa, Homo Sapiens
EIIKTLPQK

SEQ ID NO: 51353 - protein, 9 aa, Homo Sapiens
EIISKLQGR

SEQ ID NO: 51354 - protein, 9 aa, Homo Sapiens
EIITNQIPK

SEQ ID NO: 51355 - protein, 9 aa, Homo Sapiens
EIITSSIKK

SEQ ID NO: 51356 - protein, 9 aa, Homo Sapiens
EILDEMSHK

SEQ ID NO: 51357 - protein, 9 aa, Homo Sapiens
EILDFALSK

SEQ ID NO: 51358 - protein, 9 aa, Homo Sapiens
EILESIRAK

SEQ ID NO: 51359 - protein, 9 aa, Homo Sapiens
EILEVATAR

SEQ ID NO: 51360 - protein, 9 aa, Homo Sapiens
EILGIANNR

SEQ ID NO: 51361 - protein, 9 aa, Homo Sapiens
EILGKFVGK

SEQ ID NO: 51362 - protein, 9 aa, Homo Sapiens
EILHHLSER

SEQ ID NO: 51363 - protein, 9 aa, Homo Sapiens
EILKSQTPK

SEQ ID NO: 51364 - protein, 9 aa, Homo Sapiens
EILKWYLNK

SEQ ID NO: 51365 - protein, 9 aa, Homo Sapiens
EILKYMQKK

SEQ ID NO: 51366 - protein, 9 aa, Homo Sapiens
EILNDVITK

SEQ ID NO: 51367 - protein, 9 aa, Homo Sapiens
EILNYVLVR

SEQ ID NO: 51368 - protein, 9 aa, Homo Sapiens
EILPKYFKH

SEQ ID NO: 51369 - protein, 9 aa, Homo Sapiens
EILSRSIVK

SEQ ID NO: 51370 - protein, 9 aa, Homo Sapiens
EILSVLSHR

SEQ ID NO: 51371 - protein, 9 aa, Homo Sapiens
EILTPEVNK

SEQ ID NO: 51372 - protein, 9 aa, Homo Sapiens
EIMKAHGVK

SEQ ID NO: 51373 - protein, 9 aa, Homo Sapiens
EIMPPPPKP

SEQ ID NO: 51374 - protein, 9 aa, Homo Sapiens
EIMVEIPAK

SEQ ID NO: 51375 - protein, 9 aa, Homo Sapiens
EINEISYPK

SEQ ID NO: 51376 - protein, 9 aa, Homo Sapiens
EINERVVQH

SEQ ID NO: 51377 - protein, 9 aa, Homo Sapiens
EINPLVVTK

SEQ ID NO: 51378 - protein, 9 aa, Homo Sapiens
EIPEVAFMK

SEQ ID NO: 51379 - protein, 9 aa, Homo Sapiens
EIPLPIRNK

SEQ ID NO: 51380 - protein, 9 aa, Homo Sapiens
EIPRPLKRR

SEQ ID NO: 51381 - protein, 9 aa, Homo Sapiens
EIQAPTSSK

SEQ ID NO: 51382 - protein, 9 aa, Homo Sapiens
EIQKVLKEK

SEQ ID NO: 51383 - protein, 9 aa, Homo Sapiens
EIRSSLSEK

SEQ ID NO: 51384 - protein, 9 aa, Homo Sapiens
EISAPSQQR

SEQ ID NO: 51385 - protein, 9 aa, Homo Sapiens
EISAPVSER

SEQ ID NO: 51386 - protein, 9 aa, Homo Sapiens
EISGTFTHR

SEQ ID NO: 51387 - protein, 9 aa, Homo Sapiens
EISQVCATK

SEQ ID NO: 51388 - protein, 9 aa, Homo Sapiens
EISSKLSEK

SEQ ID NO: 51389 - protein, 9 aa, Homo Sapiens
EITDVKPLK

SEQ ID NO: 51390 - protein, 9 aa, Homo Sapiens
EITPPSSEK

SEQ ID NO: 51391 - protein, 9 aa, Homo Sapiens
EIVAIKILK

SEQ ID NO: 51392 - protein, 9 aa, Homo Sapiens
EIVDKIMGK

SEQ ID NO: 51393 - protein, 9 aa, Homo Sapiens
EIVDQFVCK

SEQ ID NO: 51394 - protein, 9 aa, Homo Sapiens
EIVIHIRNK

SEQ ID NO: 51395 - protein, 9 aa, Homo Sapiens
EIVKPSPKR

SEQ ID NO: 51396 - protein, 9 aa, Homo Sapiens
EIVQPIISK

SEQ ID NO: 51397 - protein, 9 aa, Homo Sapiens
EIVREIGQK

SEQ ID NO: 51398 - protein, 9 aa, Homo Sapiens
EIWHRFLSK

SEQ ID NO: 51399 - protein, 9 aa, Homo Sapiens
EIYEYIIFR

SEQ ID NO: 51400 - protein, 9 aa, Homo Sapiens
EIYFRAWKK

SEQ ID NO: 51401 - protein, 9 aa, Homo Sapiens
EIYGSYLEH

SEQ ID NO: 51402 - protein, 9 aa, Homo Sapiens
EIYGVTHTR

SEQ ID NO: 51403 - protein, 9 aa, Homo Sapiens
EIYLPEVVK

SEQ ID NO: 51404 - protein, 9 aa, Homo Sapiens
EIYNIKVEK

SEQ ID NO: 51405 - protein, 9 aa, Homo Sapiens
EIYPQTIQH

SEQ ID NO: 51406 - protein, 9 aa, Homo Sapiens
EIYRIVSQK

SEQ ID NO: 51407 - protein, 9 aa, Homo Sapiens
EIYRPPASR

SEQ ID NO: 51408 - protein, 9 aa, Homo Sapiens
EIYSDFALK

SEQ ID NO: 51409 - protein, 9 aa, Homo Sapiens
EIYSGCTKK

SEQ ID NO: 51410 - protein, 9 aa, Homo Sapiens
EIYSGCTKR

SEQ ID NO: 51411 - protein, 9 aa, Homo Sapiens
EIYSKTTRF

SEQ ID NO: 51412 - protein, 9 aa, Homo Sapiens
ELAEKALGK

SEQ ID NO: 51413 - protein, 9 aa, Homo Sapiens
ELAHTCISK

SEQ ID NO: 51414 - protein, 9 aa, Homo Sapiens
ELAKTPVNK

SEQ ID NO: 51415 - protein, 9 aa, Homo Sapiens
ELAPVFLLR

SEQ ID NO: 51416 - protein, 9 aa, Homo Sapiens
ELAVASFPK

SEQ ID NO: 51417 - protein, 9 aa, Homo Sapiens
ELAVILKAK

SEQ ID NO: 51418 - protein, 9 aa, Homo Sapiens
ELCDIILRV

SEQ ID NO: 51419 - protein, 9 aa, Homo Sapiens
ELCEEFLAH

SEQ ID NO: 51420 - protein, 9 aa, Homo Sapiens
ELCETFLEK

SEQ ID NO: 51421 - protein, 9 aa, Homo Sapiens
ELCSFSGYK

SEQ ID NO: 51422 - protein, 9 aa, Homo Sapiens
ELCYTLINH

SEQ ID NO: 51423 - protein, 9 aa, Homo Sapiens
ELEAAVRKK

SEQ ID NO: 51424 - protein, 9 aa, Homo Sapiens
ELFADKVPK

SEQ ID NO: 51425 - protein, 9 aa, Homo Sapiens
ELFADVVPK

SEQ ID NO: 51426 - protein, 9 aa, Homo Sapiens
ELFDRIVEK

SEQ ID NO: 51427 - protein, 9 aa, Homo Sapiens
ELFERFLLY

SEQ ID NO: 51428 - protein, 9 aa, Homo Sapiens
ELFKGATLK

SEQ ID NO: 51429 - protein, 9 aa, Homo Sapiens
ELFNFFLKK

SEQ ID NO: 51430 - protein, 9 aa, Homo Sapiens
ELFPAPILR

SEQ ID NO: 51431 - protein, 9 aa, Homo Sapiens
ELFQATIVK

SEQ ID NO: 51432 - protein, 9 aa, Homo Sapiens
ELFSDFCSK

SEQ ID NO: 51433 - protein, 9 aa, Homo Sapiens
ELFSYSCPK

SEQ ID NO: 51434 - protein, 9 aa, Homo Sapiens
ELFVETIAK

SEQ ID NO: 51435 - protein, 9 aa, Homo Sapiens
ELGIPLKEK

SEQ ID NO: 51436 - protein, 9 aa, Homo Sapiens
ELGPGVKAK

SEQ ID NO: 51437 - protein, 9 aa, Homo Sapiens
ELGPLLEEK

SEQ ID NO: 51438 - protein, 9 aa, Homo Sapiens
ELHGHFMLH

SEQ ID NO: 51439 - protein, 9 aa, Homo Sapiens
ELIERVSGK

SEQ ID NO: 51440 - protein, 9 aa, Homo Sapiens
ELIGRLAPR

SEQ ID NO: 51441 - protein, 9 aa, Homo Sapiens
ELIKVVSPK

SEQ ID NO: 51442 - protein, 9 aa, Homo Sapiens
ELKAPGISY

SEQ ID NO: 51443 - protein, 9 aa, Homo Sapiens
ELLDRPLLR

SEQ ID NO: 51444 - protein, 9 aa, Homo Sapiens
ELLEHIRKK

SEQ ID NO: 51445 - protein, 9 aa, Homo Sapiens
ELLEKASNP

SEQ ID NO: 51446 - protein, 9 aa, Homo Sapiens
ELLEPLNER

SEQ ID NO: 51447 - protein, 9 aa, Homo Sapiens
ELLGKAYGK

SEQ ID NO: 51448 - protein, 9 aa, Homo Sapiens
ELLGPYGMK

SEQ ID NO: 51449 - protein, 9 aa, Homo Sapiens
ELLHTQLKY

SEQ ID NO: 51450 - protein, 9 aa, Homo Sapiens
ELLIPVKKK

SEQ ID NO: 51451 - protein, 9 aa, Homo Sapiens
ELLKTAIGK

SEQ ID NO: 51452 - protein, 9 aa, Homo Sapiens
ELLQGGTSR

SEQ ID NO: 51453 - protein, 9 aa, Homo Sapiens
ELLQRMTDK

SEQ ID NO: 51454 - protein, 9 aa, Homo Sapiens
ELLRDILQK

SEQ ID NO: 51455 - protein, 9 aa, Homo Sapiens
ELLSFILDH

SEQ ID NO: 51456 - protein, 9 aa, Homo Sapiens
ELLSKGLIK

SEQ ID NO: 51457 - protein, 9 aa, Homo Sapiens
ELMGYIMGK

SEQ ID NO: 51458 - protein, 9 aa, Homo Sapiens
ELMPPPPPK

SEQ ID NO: 51459 - protein, 9 aa, Homo Sapiens
ELNAPFILK

SEQ ID NO: 51460 - protein, 9 aa, Homo Sapiens
ELPEASAPK

SEQ ID NO: 51461 - protein, 9 aa, Homo Sapiens
ELPEFNLIH

SEQ ID NO: 51462 - protein, 9 aa, Homo Sapiens
ELSDLHAHK

SEQ ID NO: 51463 - protein, 9 aa, Homo Sapiens
ELSPTGRPK

SEQ ID NO: 51464 - protein, 9 aa, Homo Sapiens
ELSSVKLEY

SEQ ID NO: 51465 - protein, 9 aa, Homo Sapiens
ELTVLRLSH

SEQ ID NO: 51466 - protein, 9 aa, Homo Sapiens
ELYDRDLKH

SEQ ID NO: 51467 - protein, 9 aa, Homo Sapiens
ELYGETKAK

SEQ ID NO: 51468 - protein, 9 aa, Homo Sapiens
ELYNRMLKR

SEQ ID NO: 51469 - protein, 9 aa, Homo Sapiens
ELYPPQLKK

SEQ ID NO: 51470 - protein, 9 aa, Homo Sapiens
ELYWKHAPK

SEQ ID NO: 51471 - protein, 9 aa, Homo Sapiens
EMFDGSLYH

SEQ ID NO: 51472 - protein, 9 aa, Homo Sapiens
EMFDPLTNK

SEQ ID NO: 51473 - protein, 9 aa, Homo Sapiens
EMYQPLLEK

SEQ ID NO: 51474 - protein, 9 aa, Homo Sapiens
ENIFLPLFK

SEQ ID NO: 51475 - protein, 9 aa, Homo Sapiens
ENLGIQPPK

SEQ ID NO: 51476 - protein, 9 aa, Homo Sapiens
EQSAVSMLK

SEQ ID NO: 51477 - protein, 9 aa, Homo Sapiens
ESAGAYAYK

SEQ ID NO: 51478 - protein, 9 aa, Homo Sapiens
ESAPAWRLR

SEQ ID NO: 51479 - protein, 9 aa, Homo Sapiens
ESAPKASLR

SEQ ID NO: 51480 - protein, 9 aa, Homo Sapiens
ESAPMFSAK

SEQ ID NO: 51481 - protein, 9 aa, Homo Sapiens
ESAPPSPQY

SEQ ID NO: 51482 - protein, 9 aa, Homo Sapiens
ESAPSALEK

SEQ ID NO: 51483 - protein, 9 aa, Homo Sapiens
ESAQDFASR

SEQ ID NO: 51484 - protein, 9 aa, Homo Sapiens
ESASFLIRK

SEQ ID NO: 51485 - protein, 9 aa, Homo Sapiens
ESCDVQLYI

SEQ ID NO: 51486 - protein, 9 aa, Homo Sapiens
ESCNEFRLK

SEQ ID NO: 51487 - protein, 9 aa, Homo Sapiens
ESFEGFIAR

SEQ ID NO: 51488 - protein, 9 aa, Homo Sapiens
ESFFKPLTH

SEQ ID NO: 51489 - protein, 9 aa, Homo Sapiens
ESFGAVKKK

SEQ ID NO: 51490 - protein, 9 aa, Homo Sapiens
ESFGTLSDK

SEQ ID NO: 51491 - protein, 9 aa, Homo Sapiens
ESFLYKREK

SEQ ID NO: 51492 - protein, 9 aa, Homo Sapiens
ESFLYRREK

SEQ ID NO: 51493 - protein, 9 aa, Homo Sapiens
ESFQKALEK

SEQ ID NO: 51494 - protein, 9 aa, Homo Sapiens
ESFSRIALK

SEQ ID NO: 51495 - protein, 9 aa, Homo Sapiens
ESGITTPPK

SEQ ID NO: 51496 - protein, 9 aa, Homo Sapiens
ESGKSTFIK

SEQ ID NO: 51497 - protein, 9 aa, Homo Sapiens
ESIAAFIQR

SEQ ID NO: 51498 - protein, 9 aa, Homo Sapiens
ESIDALSNK

SEQ ID NO: 51499 - protein, 9 aa, Homo Sapiens
ESIEHPLAR

SEQ ID NO: 51500 - protein, 9 aa, Homo Sapiens
ESIGVPLEK

SEQ ID NO: 51501 - protein, 9 aa, Homo Sapiens
ESIKGLCER

SEQ ID NO: 51502 - protein, 9 aa, Homo Sapiens
ESIRAAVNR

SEQ ID NO: 51503 - protein, 9 aa, Homo Sapiens
ESIRGIGPK

SEQ ID NO: 51504 - protein, 9 aa, Homo Sapiens
ESISLKNLK

SEQ ID NO: 51505 - protein, 9 aa, Homo Sapiens
ESITHALKH

SEQ ID NO: 51506 - protein, 9 aa, Homo Sapiens
ESLAKIKSK

SEQ ID NO: 51507 - protein, 9 aa, Homo Sapiens
ESLAPLQER

SEQ ID NO: 51508 - protein, 9 aa, Homo Sapiens
ESLDITIVR

SEQ ID NO: 51509 - protein, 9 aa, Homo Sapiens
ESLEAALTH

SEQ ID NO: 51510 - protein, 9 aa, Homo Sapiens
ESLEKALKY

SEQ ID NO: 51511 - protein, 9 aa, Homo Sapiens
ESLEKLLVH

SEQ ID NO: 51512 - protein, 9 aa, Homo Sapiens
ESLESWLNK

SEQ ID NO: 51513 - protein, 9 aa, Homo Sapiens
ESLEWLASR

SEQ ID NO: 51514 - protein, 9 aa, Homo Sapiens
ESLGYHCEY

SEQ ID NO: 51515 - protein, 9 aa, Homo Sapiens
ESLGYVLMY

SEQ ID NO: 51516 - protein, 9 aa, Homo Sapiens
ESLHKTIVK

SEQ ID NO: 51517 - protein, 9 aa, Homo Sapiens
ESLIPSANR

SEQ ID NO: 51518 - protein, 9 aa, Homo Sapiens
ESLKERLIK

SEQ ID NO: 51519 - protein, 9 aa, Homo Sapiens
ESLKGVDPK

SEQ ID NO: 51520 - protein, 9 aa, Homo Sapiens
ESLLTSPPK

SEQ ID NO: 51521 - protein, 9 aa, Homo Sapiens
ESLMTSAPK

SEQ ID NO: 51522 - protein, 9 aa, Homo Sapiens
ESLNRSIEK

SEQ ID NO: 51523 - protein, 9 aa, Homo Sapiens
ESLPATHIR

SEQ ID NO: 51524 - protein, 9 aa, Homo Sapiens
ESLPFQFAH

SEQ ID NO: 51525 - protein, 9 aa, Homo Sapiens
ESLPGATTR

SEQ ID NO: 51526 - protein, 9 aa, Homo Sapiens
ESLPKPKEK

SEQ ID NO: 51527 - protein, 9 aa, Homo Sapiens
ESLPNLLQY

SEQ ID NO: 51528 - protein, 9 aa, Homo Sapiens
ESLPRVVKR

SEQ ID NO: 51529 - protein, 9 aa, Homo Sapiens
ESLPTTPFY

SEQ ID NO: 51530 - protein, 9 aa, Homo Sapiens
ESLQFNLEK

SEQ ID NO: 51531 - protein, 9 aa, Homo Sapiens
ESLQLNLTK

SEQ ID NO: 51532 - protein, 9 aa, Homo Sapiens
ESLSSGLCK

SEQ ID NO: 51533 - protein, 9 aa, Homo Sapiens
ESLSSMPGK

SEQ ID NO: 51534 - protein, 9 aa, Homo Sapiens
ESLTLQLVK

SEQ ID NO: 51535 - protein, 9 aa, Homo Sapiens
ESMDQLLNK

SEQ ID NO: 51536 - protein, 9 aa, Homo Sapiens
ESMKVAIVK

SEQ ID NO: 51537 - protein, 9 aa, Homo Sapiens
ESMNIVLQH

SEQ ID NO: 51538 - protein, 9 aa, Homo Sapiens
ESNFPRGFK

SEQ ID NO: 51539 - protein, 9 aa, Homo Sapiens
ESNSGPLMK

SEQ ID NO: 51540 - protein, 9 aa, Homo Sapiens
ESSDALLKR

SEQ ID NO: 51541 - protein, 9 aa, Homo Sapiens
ESSGINITK

SEQ ID NO: 51542 - protein, 9 aa, Homo Sapiens
ESSLPAVEK

SEQ ID NO: 51543 - protein, 9 aa, Homo Sapiens
ESSLPTGDR

SEQ ID NO: 51544 - protein, 9 aa, Homo Sapiens
ESSQNVLLK

SEQ ID NO: 51545 - protein, 9 aa, Homo Sapiens
ESSSVVLRY

SEQ ID NO: 51546 - protein, 9 aa, Homo Sapiens
ESSSWDGRY

SEQ ID NO: 51547 - protein, 9 aa, Homo Sapiens
ESTGESTFK

SEQ ID NO: 51548 - protein, 9 aa, Homo Sapiens
ESTGVSFEK

SEQ ID NO: 51549 - protein, 9 aa, Homo Sapiens
ESTIPFSNK

SEQ ID NO: 51550 - protein, 9 aa, Homo Sapiens
ESTPITAVK

SEQ ID NO: 51551 - protein, 9 aa, Homo Sapiens
ESTPPSIKK

SEQ ID NO: 51552 - protein, 9 aa, Homo Sapiens
ESVKEFLAK

SEQ ID NO: 51553 - protein, 9 aa, Homo Sapiens
ESVSIFSLK

SEQ ID NO: 51554 - protein, 9 aa, Homo Sapiens
ESYLGSPQH

SEQ ID NO: 51555 - protein, 9 aa, Homo Sapiens
ESYSSPFVK

SEQ ID NO: 51556 - protein, 9 aa, Homo Sapiens
ESYYQEIGR

SEQ ID NO: 51557 - protein, 9 aa, Homo Sapiens
ETAAAMLRK

SEQ ID NO: 51558 - protein, 9 aa, Homo Sapiens
ETAAPFVSH

SEQ ID NO: 51559 - protein, 9 aa, Homo Sapiens
ETAATLTTK

SEQ ID NO: 51560 - protein, 9 aa, Homo Sapiens
ETAFAFHLR

SEQ ID NO: 51561 - protein, 9 aa, Homo Sapiens
ETAFLSWFR

SEQ ID NO: 51562 - protein, 9 aa, Homo Sapiens
ETAFQGMLR

SEQ ID NO: 51563 - protein, 9 aa, Homo Sapiens
ETAFVSRNR

SEQ ID NO: 51564 - protein, 9 aa, Homo Sapiens
ETAIPFRSR

SEQ ID NO: 51565 - protein, 9 aa, Homo Sapiens
ETAIPSSTR

SEQ ID NO: 51566 - protein, 9 aa, Homo Sapiens
ETAKDLVSK

SEQ ID NO: 51567 - protein, 9 aa, Homo Sapiens
ETAKPIPAR

SEQ ID NO: 51568 - protein, 9 aa, Homo Sapiens
ETALPGAFK

SEQ ID NO: 51569 - protein, 9 aa, Homo Sapiens
ETAPRHMMR

SEQ ID NO: 51570 - protein, 9 aa, Homo Sapiens
ETAPVGTVL

SEQ ID NO: 51571 - protein, 9 aa, Homo Sapiens
ETARKFLYY

SEQ ID NO: 51572 - protein, 9 aa, Homo Sapiens
ETATPMLKK

SEQ ID NO: 51573 - protein, 9 aa, Homo Sapiens
ETAVPSVLK

SEQ ID NO: 51574 - protein, 9 aa, Homo Sapiens
ETCDKVFSR

SEQ ID NO: 51575 - protein, 9 aa, Homo Sapiens
ETCGRFLFR

SEQ ID NO: 51576 - protein, 9 aa, Homo Sapiens
ETCPGLEQY

SEQ ID NO: 51577 - protein, 9 aa, Homo Sapiens
ETCPYDIAV

SEQ ID NO: 51578 - protein, 9 aa, Homo Sapiens
ETCQLAVRR

SEQ ID NO: 51579 - protein, 9 aa, Homo Sapiens
ETCVATVGR

SEQ ID NO: 51580 - protein, 9 aa, Homo Sapiens
ETDESVLMR

SEQ ID NO: 51581 - protein, 9 aa, Homo Sapiens
ETDIPKITK

SEQ ID NO: 51582 - protein, 9 aa, Homo Sapiens
ETDLYKLLK

SEQ ID NO: 51583 - protein, 9 aa, Homo Sapiens
ETDSSLVVK

SEQ ID NO: 51584 - protein, 9 aa, Homo Sapiens
ETDVPLVMK

SEQ ID NO: 51585 - protein, 9 aa, Homo Sapiens
ETFDKTILR

SEQ ID NO: 51586 - protein, 9 aa, Homo Sapiens
ETFGSNIPK

SEQ ID NO: 51587 - protein, 9 aa, Homo Sapiens
ETFKSIMKK

SEQ ID NO: 51588 - protein, 9 aa, Homo Sapiens
ETFLEPWFK

SEQ ID NO: 51589 - protein, 9 aa, Homo Sapiens
ETFLTERDK

SEQ ID NO: 51590 - protein, 9 aa, Homo Sapiens
ETFNEWFKH

SEQ ID NO: 51591 - protein, 9 aa, Homo Sapiens
ETFNIIMRR

SEQ ID NO: 51592 - protein, 9 aa, Homo Sapiens
ETFNSFLRR

SEQ ID NO: 51593 - protein, 9 aa, Homo Sapiens
ETFNSITKR

SEQ ID NO: 51594 - protein, 9 aa, Homo Sapiens
ETFNTPAMY

SEQ ID NO: 51595 - protein, 9 aa, Homo Sapiens
ETFPAVAEK

SEQ ID NO: 51596 - protein, 9 aa, Homo Sapiens
ETFQFILGK

SEQ ID NO: 51597 - protein, 9 aa, Homo Sapiens
ETFQQKMLR

SEQ ID NO: 51598 - protein, 9 aa, Homo Sapiens
ETFSGVYKK

SEQ ID NO: 51599 - protein, 9 aa, Homo Sapiens
ETGLRLCEK

SEQ ID NO: 51600 - protein, 9 aa, Homo Sapiens
ETGTLMVLK

SEQ ID NO: 51601 - protein, 9 aa, Homo Sapiens
ETHAWFTSR

SEQ ID NO: 51602 - protein, 9 aa, Homo Sapiens
ETHSHFLAR

SEQ ID NO: 51603 - protein, 9 aa, Homo Sapiens
ETHYEKVLK

SEQ ID NO: 51604 - protein, 9 aa, Homo Sapiens
ETIAVWRQK

SEQ ID NO: 51605 - protein, 9 aa, Homo Sapiens
ETIDVHSGY

SEQ ID NO: 51606 - protein, 9 aa, Homo Sapiens
ETIGEILKK

SEQ ID NO: 51607 - protein, 9 aa, Homo Sapiens
ETIGKKFEK

SEQ ID NO: 51608 - protein, 9 aa, Homo Sapiens
ETIGSVRWK

SEQ ID NO: 51609 - protein, 9 aa, Homo Sapiens
ETIKEHLCK

SEQ ID NO: 51610 - protein, 9 aa, Homo Sapiens
ETIKIGLTK

SEQ ID NO: 51611 - protein, 9 aa, Homo Sapiens
ETIKQLQER

SEQ ID NO: 51612 - protein, 9 aa, Homo Sapiens
ETIKVWKQR

SEQ ID NO: 51613 - protein, 9 aa, Homo Sapiens
ETILRTNKR

SEQ ID NO: 51614 - protein, 9 aa, Homo Sapiens
ETIMKYAEK

SEQ ID NO: 51615 - protein, 9 aa, Homo Sapiens
ETINRCLTK

SEQ ID NO: 51616 - protein, 9 aa, Homo Sapiens
ETIPSFTGR

SEQ ID NO: 51617 - protein, 9 aa, Homo Sapiens
ETIREVCTK

SEQ ID NO: 51618 - protein, 9 aa, Homo Sapiens
ETISTATGR

SEQ ID NO: 51619 - protein, 9 aa, Homo Sapiens
ETITNIREK

SEQ ID NO: 51620 - protein, 9 aa, Homo Sapiens
ETIYDLGTK

SEQ ID NO: 51621 - protein, 9 aa, Homo Sapiens
ETIYQNYQR

SEQ ID NO: 51622 - protein, 9 aa, Homo Sapiens
ETKDVFQLK

SEQ ID NO: 51623 - protein, 9 aa, Homo Sapiens
ETKEKVSFK

SEQ ID NO: 51624 - protein, 9 aa, Homo Sapiens
ETKGTVLIK

SEQ ID NO: 51625 - protein, 9 aa, Homo Sapiens
ETKSWIREK

SEQ ID NO: 51626 - protein, 9 aa, Homo Sapiens
ETLDRYMVK

SEQ ID NO: 51627 - protein, 9 aa, Homo Sapiens
ETLETIINR

SEQ ID NO: 51628 - protein, 9 aa, Homo Sapiens
ETLGQVVRR

SEQ ID NO: 51629 - protein, 9 aa, Homo Sapiens
ETLHLAVNY

SEQ ID NO: 51630 - protein, 9 aa, Homo Sapiens
ETLIKPLEK

SEQ ID NO: 51631 - protein, 9 aa, Homo Sapiens
ETLKDRLSR

SEQ ID NO: 51632 - protein, 9 aa, Homo Sapiens
ETLKRFAGK

SEQ ID NO: 51633 - protein, 9 aa, Homo Sapiens
ETLLDQSFK

SEQ ID NO: 51634 - protein, 9 aa, Homo Sapiens
ETLLGISKK

SEQ ID NO: 51635 - protein, 9 aa, Homo Sapiens
ETLLLQAER

SEQ ID NO: 51636 - protein, 9 aa, Homo Sapiens
ETLMETHER

SEQ ID NO: 51637 - protein, 9 aa, Homo Sapiens
ETLNIPITY

SEQ ID NO: 51638 - protein, 9 aa, Homo Sapiens
ETLNIVEEK

SEQ ID NO: 51639 - protein, 9 aa, Homo Sapiens
ETLNQMIAR

SEQ ID NO: 51640 - protein, 9 aa, Homo Sapiens
ETLPAEMRK

SEQ ID NO: 51641 - protein, 9 aa, Homo Sapiens
ETLPDGTKR

SEQ ID NO: 51642 - protein, 9 aa, Homo Sapiens
ETLPEGPSH

SEQ ID NO: 51643 - protein, 9 aa, Homo Sapiens
ETLPKAVKR

SEQ ID NO: 51644 - protein, 9 aa, Homo Sapiens
ETLPPGKVR

SEQ ID NO: 51645 - protein, 9 aa, Homo Sapiens
ETLPTILQV

SEQ ID NO: 51646 - protein, 9 aa, Homo Sapiens
ETLQEVFEK

SEQ ID NO: 51647 - protein, 9 aa, Homo Sapiens
ETLQNVKER

SEQ ID NO: 51648 - protein, 9 aa, Homo Sapiens
ETLQSINKK

SEQ ID NO: 51649 - protein, 9 aa, Homo Sapiens
ETLSEVLTK

SEQ ID NO: 51650 - protein, 9 aa, Homo Sapiens
ETLSQSPPK

SEQ ID NO: 51651 - protein, 9 aa, Homo Sapiens
ETLTPLIHR

SEQ ID NO: 51652 - protein, 9 aa, Homo Sapiens
ETMADYLLY

SEQ ID NO: 51653 - protein, 9 aa, Homo Sapiens
ETMDPFVDR

SEQ ID NO: 51654 - protein, 9 aa, Homo Sapiens
ETMEKGFSK

SEQ ID NO: 51655 - protein, 9 aa, Homo Sapiens
ETMGRALRY

SEQ ID NO: 51656 - protein, 9 aa, Homo Sapiens
ETMHTLLDY

SEQ ID NO: 51657 - protein, 9 aa, Homo Sapiens
ETMNIFLEK

SEQ ID NO: 51658 - protein, 9 aa, Homo Sapiens
ETMNYAQIR

SEQ ID NO: 51659 - protein, 9 aa, Homo Sapiens
ETMPCVKKK

SEQ ID NO: 51660 - protein, 9 aa, Homo Sapiens
ETMPSPYGR

SEQ ID NO: 51661 - protein, 9 aa, Homo Sapiens
ETMPYVKKK

SEQ ID NO: 51662 - protein, 9 aa, Homo Sapiens
ETMVIGNYR

SEQ ID NO: 51663 - protein, 9 aa, Homo Sapiens
ETNADVYYY

SEQ ID NO: 51664 - protein, 9 aa, Homo Sapiens
ETNDFELLK

SEQ ID NO: 51665 - protein, 9 aa, Homo Sapiens
ETNFKSLVH

SEQ ID NO: 51666 - protein, 9 aa, Homo Sapiens
ETNGFISAH

SEQ ID NO: 51667 - protein, 9 aa, Homo Sapiens
ETNTGEVYR

SEQ ID NO: 51668 - protein, 9 aa, Homo Sapiens
ETNYGIPQR

SEQ ID NO: 51669 - protein, 9 aa, Homo Sapiens
ETPAISPSK

SEQ ID NO: 51670 - protein, 9 aa, Homo Sapiens
ETPAVFIRK

SEQ ID NO: 51671 - protein, 9 aa, Homo Sapiens
ETPDYLLKY

SEQ ID NO: 51672 - protein, 9 aa, Homo Sapiens
ETQFTSGEK

SEQ ID NO: 51673 - protein, 9 aa, Homo Sapiens
ETQLLVSRK

SEQ ID NO: 51674 - protein, 9 aa, Homo Sapiens
ETQLPVSFR

SEQ ID NO: 51675 - protein, 9 aa, Homo Sapiens
ETQPPVALK

SEQ ID NO: 51676 - protein, 9 aa, Homo Sapiens
ETRAEFAER

SEQ ID NO: 51677 - protein, 9 aa, Homo Sapiens
ETRAGLTLK

SEQ ID NO: 51678 - protein, 9 aa, Homo Sapiens
ETREVQNLR

SEQ ID NO: 51679 - protein, 9 aa, Homo Sapiens
ETSAPFKER

SEQ ID NO: 51680 - protein, 9 aa, Homo Sapiens
ETSEPLSCR

SEQ ID NO: 51681 - protein, 9 aa, Homo Sapiens
ETSGPTYIK

SEQ ID NO: 51682 - protein, 9 aa, Homo Sapiens
ETSLNLTTK

SEQ ID NO: 51683 - protein, 9 aa, Homo Sapiens
ETSNLIIMR

SEQ ID NO: 51684 - protein, 9 aa, Homo Sapiens
ETSPELPRR

SEQ ID NO: 51685 - protein, 9 aa, Homo Sapiens
ETSPFGAPR

SEQ ID NO: 51686 - protein, 9 aa, Homo Sapiens
ETSPIVLRY

SEQ ID NO: 51687 - protein, 9 aa, Homo Sapiens
ETSQAGLFR

SEQ ID NO: 51688 - protein, 9 aa, Homo Sapiens
ETSRLFVKK

SEQ ID NO: 51689 - protein, 9 aa, Homo Sapiens
ETSSMASFR

SEQ ID NO: 51690 - protein, 9 aa, Homo Sapiens
ETSTSVMQK

SEQ ID NO: 51691 - protein, 9 aa, Homo Sapiens
ETTAQILVR

SEQ ID NO: 51692 - protein, 9 aa, Homo Sapiens
ETTAVALAY

SEQ ID NO: 51693 - protein, 9 aa, Homo Sapiens
ETTEHLVTK

SEQ ID NO: 51694 - protein, 9 aa, Homo Sapiens
ETTFNSIMK

SEQ ID NO: 51695 - protein, 9 aa, Homo Sapiens
ETTGQIMHR

SEQ ID NO: 51696 - protein, 9 aa, Homo Sapiens
ETTGVDITK

SEQ ID NO: 51697 - protein, 9 aa, Homo Sapiens
ETTPSVIQH

SEQ ID NO: 51698 - protein, 9 aa, Homo Sapiens
ETTQEMLNY

SEQ ID NO: 51699 - protein, 9 aa, Homo Sapiens
ETTSIATAR

SEQ ID NO: 51700 - protein, 9 aa, Homo Sapiens
ETTSNITSR

SEQ ID NO: 51701 - protein, 9 aa, Homo Sapiens
ETTWTILRR

SEQ ID NO: 51702 - protein, 9 aa, Homo Sapiens
ETVADFTPK

SEQ ID NO: 51703 - protein, 9 aa, Homo Sapiens
ETVAEFIKR

SEQ ID NO: 51704 - protein, 9 aa, Homo Sapiens
ETVALFKNK

SEQ ID NO: 51705 - protein, 9 aa, Homo Sapiens
ETVEGLRKR

SEQ ID NO: 51706 - protein, 9 aa, Homo Sapiens
ETVEKFRQR

SEQ ID NO: 51707 - protein, 9 aa, Homo Sapiens
ETVELFRAK

SEQ ID NO: 51708 - protein, 9 aa, Homo Sapiens
ETVEVPVLK

SEQ ID NO: 51709 - protein, 9 aa, Homo Sapiens
ETVGKFIQY

SEQ ID NO: 51710 - protein, 9 aa, Homo Sapiens
ETVGSIFSR

SEQ ID NO: 51711 - protein, 9 aa, Homo Sapiens
ETVKDFVAK

SEQ ID NO: 51712 - protein, 9 aa, Homo Sapiens
ETVPAFSER

SEQ ID NO: 51713 - protein, 9 aa, Homo Sapiens
ETVPKDLRH

SEQ ID NO: 51714 - protein, 9 aa, Homo Sapiens
ETVPLERKK

SEQ ID NO: 51715 - protein, 9 aa, Homo Sapiens
ETVQTVRYK

SEQ ID NO: 51716 - protein, 9 aa, Homo Sapiens
ETVQVPLSK

SEQ ID NO: 51717 - protein, 9 aa, Homo Sapiens
ETVRMIKEK

SEQ ID NO: 51718 - protein, 9 aa, Homo Sapiens
ETVSGLKGY

SEQ ID NO: 51719 - protein, 9 aa, Homo Sapiens
ETVTSFRKR

SEQ ID NO: 51720 - protein, 9 aa, Homo Sapiens
ETVYTLCEK

SEQ ID NO: 51721 - protein, 9 aa, Homo Sapiens
ETWAESLRY

SEQ ID NO: 51722 - protein, 9 aa, Homo Sapiens
ETWHGSCFR

SEQ ID NO: 51723 - protein, 9 aa, Homo Sapiens
ETWQEGSLK

SEQ ID NO: 51724 - protein, 9 aa, Homo Sapiens
ETYALPATK

SEQ ID NO: 51725 - protein, 9 aa, Homo Sapiens
ETYANFIKH

SEQ ID NO: 51726 - protein, 9 aa, Homo Sapiens
ETYERLREK

SEQ ID NO: 51727 - protein, 9 aa, Homo Sapiens
ETYGHKTPY

SEQ ID NO: 51728 - protein, 9 aa, Homo Sapiens
ETYGKIMNH

SEQ ID NO: 51729 - protein, 9 aa, Homo Sapiens
ETYGPFQIR

SEQ ID NO: 51730 - protein, 9 aa, Homo Sapiens
ETYIATILR

SEQ ID NO: 51731 - protein, 9 aa, Homo Sapiens
ETYIKPISK

SEQ ID NO: 51732 - protein, 9 aa, Homo Sapiens
ETYKPHLER

SEQ ID NO: 51733 - protein, 9 aa, Homo Sapiens
ETYKSLMQK

SEQ ID NO: 51734 - protein, 9 aa, Homo Sapiens
ETYLHRIGR

SEQ ID NO: 51735 - protein, 9 aa, Homo Sapiens
ETYLNENLR

SEQ ID NO: 51736 - protein, 9 aa, Homo Sapiens
ETYMHRIGR

SEQ ID NO: 51737 - protein, 9 aa, Homo Sapiens
ETYNIVWGH

SEQ ID NO: 51738 - protein, 9 aa, Homo Sapiens
ETYNQLLDK

SEQ ID NO: 51739 - protein, 9 aa, Homo Sapiens
ETYNYLLAK

SEQ ID NO: 51740 - protein, 9 aa, Homo Sapiens
ETYPFNPPK

SEQ ID NO: 51741 - protein, 9 aa, Homo Sapiens
ETYPHPLVR

SEQ ID NO: 51742 - protein, 9 aa, Homo Sapiens
ETYPVSSPK

SEQ ID NO: 51743 - protein, 9 aa, Homo Sapiens
ETYSRMRLK

SEQ ID NO: 51744 - protein, 9 aa, Homo Sapiens
ETYTPEVTK

SEQ ID NO: 51745 - protein, 9 aa, Homo Sapiens
ETYVRWSPK

SEQ ID NO: 51746 - protein, 9 aa, Homo Sapiens
ETYYHHIYH

SEQ ID NO: 51747 - protein, 9 aa, Homo Sapiens
EVADGFKSK

SEQ ID NO: 51748 - protein, 9 aa, Homo Sapiens
EVADLKIKR

SEQ ID NO: 51749 - protein, 9 aa, Homo Sapiens
EVAEFLARH

SEQ ID NO: 51750 - protein, 9 aa, Homo Sapiens
EVAELGRGR

SEQ ID NO: 51751 - protein, 9 aa, Homo Sapiens
EVAEYLLEH

SEQ ID NO: 51752 - protein, 9 aa, Homo Sapiens
EVAEYLLQH

SEQ ID NO: 51753 - protein, 9 aa, Homo Sapiens
EVAFKMAVK

SEQ ID NO: 51754 - protein, 9 aa, Homo Sapiens
EVAFPHHPR

SEQ ID NO: 51755 - protein, 9 aa, Homo Sapiens
EVAGIVAAR

SEQ ID NO: 51756 - protein, 9 aa, Homo Sapiens
EVAGQFVIK

SEQ ID NO: 51757 - protein, 9 aa, Homo Sapiens
EVAGQLIHK

SEQ ID NO: 51758 - protein, 9 aa, Homo Sapiens
EVAIPHNRR

SEQ ID NO: 51759 - protein, 9 aa, Homo Sapiens
EVAIPLPAR

SEQ ID NO: 51760 - protein, 9 aa, Homo Sapiens
EVAKLLKLK

SEQ ID NO: 51761 - protein, 9 aa, Homo Sapiens
EVANSILQK

SEQ ID NO: 51762 - protein, 9 aa, Homo Sapiens
EVAPAGASY

SEQ ID NO: 51763 - protein, 9 aa, Homo Sapiens
EVAPAGPLL

SEQ ID NO: 51764 - protein, 9 aa, Homo Sapiens
EVAPHPVYY

SEQ ID NO: 51765 - protein, 9 aa, Homo Sapiens
EVAPPEYHR

SEQ ID NO: 51766 - protein, 9 aa, Homo Sapiens
EVAQFLTGR

SEQ ID NO: 51767 - protein, 9 aa, Homo Sapiens
EVARELVGR

SEQ ID NO: 51768 - protein, 9 aa, Homo Sapiens
EVASAVCLR

SEQ ID NO: 51769 - protein, 9 aa, Homo Sapiens
EVASFLLSK

SEQ ID NO: 51770 - protein, 9 aa, Homo Sapiens
EVASVWVER

SEQ ID NO: 51771 - protein, 9 aa, Homo Sapiens
EVASYGLQH

SEQ ID NO: 51772 - protein, 9 aa, Homo Sapiens
EVAVKCINK

SEQ ID NO: 51773 - protein, 9 aa, Homo Sapiens
EVCDDFLVY

SEQ ID NO: 51774 - protein, 9 aa, Homo Sapiens
EVCDELMSR

SEQ ID NO: 51775 - protein, 9 aa, Homo Sapiens
EVCEVTRVK

SEQ ID NO: 51776 - protein, 9 aa, Homo Sapiens
EVCGNALMK

SEQ ID NO: 51777 - protein, 9 aa, Homo Sapiens
EVCPLSESR

SEQ ID NO: 51778 - protein, 9 aa, Homo Sapiens
EVCQKFFRH

SEQ ID NO: 51779 - protein, 9 aa, Homo Sapiens
EVCRIYLLR

SEQ ID NO: 51780 - protein, 9 aa, Homo Sapiens
EVCSAIFSK

SEQ ID NO: 51781 - protein, 9 aa, Homo Sapiens
EVCSLLLSY

SEQ ID NO: 51782 - protein, 9 aa, Homo Sapiens
EVDAAMAAR

SEQ ID NO: 51783 - protein, 9 aa, Homo Sapiens
EVDDRGLYK

SEQ ID NO: 51784 - protein, 9 aa, Homo Sapiens
EVDPDTILK

SEQ ID NO: 51785 - protein, 9 aa, Homo Sapiens
EVDPTHFEK

SEQ ID NO: 51786 - protein, 9 aa, Homo Sapiens
EVDPTQVHK

SEQ ID NO: 51787 - protein, 9 aa, Homo Sapiens
EVDSRLIAK

SEQ ID NO: 51788 - protein, 9 aa, Homo Sapiens
EVEAAISRK

SEQ ID NO: 51789 - protein, 9 aa, Homo Sapiens
EVEDSIFKK

SEQ ID NO: 51790 - protein, 9 aa, Homo Sapiens
EVFAGVTTH

SEQ ID NO: 51791 - protein, 9 aa, Homo Sapiens
EVFALPLAH

SEQ ID NO: 51792 - protein, 9 aa, Homo Sapiens
EVFDHMMKR

SEQ ID NO: 51793 - protein, 9 aa, Homo Sapiens
EVFDKFSNK

SEQ ID NO: 51794 - protein, 9 aa, Homo Sapiens
EVFEHTVLY

SEQ ID NO: 51795 - protein, 9 aa, Homo Sapiens
EVFEYIIFR

SEQ ID NO: 51796 - protein, 9 aa, Homo Sapiens
EVFFHRYYK

SEQ ID NO: 51797 - protein, 9 aa, Homo Sapiens
EVFFLKATR

SEQ ID NO: 51798 - protein, 9 aa, Homo Sapiens
EVFGQITER

SEQ ID NO: 51799 - protein, 9 aa, Homo Sapiens
EVFKYVISH

SEQ ID NO: 51800 - protein, 9 aa, Homo Sapiens
EVFMKTLNY

SEQ ID NO: 51801 - protein, 9 aa, Homo Sapiens
EVFNELVGK

SEQ ID NO: 51802 - protein, 9 aa, Homo Sapiens
EVFPLAMNY

SEQ ID NO: 51803 - protein, 9 aa, Homo Sapiens
EVFQNANFR

SEQ ID NO: 51804 - protein, 9 aa, Homo Sapiens
EVFSHILKR

SEQ ID NO: 51805 - protein, 9 aa, Homo Sapiens
EVFTGHMGK

SEQ ID NO: 51806 - protein, 9 aa, Homo Sapiens
EVFVGKIPR

SEQ ID NO: 51807 - protein, 9 aa, Homo Sapiens
EVFWRGQKK

SEQ ID NO: 51808 - protein, 9 aa, Homo Sapiens
EVFYFEVTR

SEQ ID NO: 51809 - protein, 9 aa, Homo Sapiens
EVGAGWIGK

SEQ ID NO: 51810 - protein, 9 aa, Homo Sapiens
EVGETLLYY

SEQ ID NO: 51811 - protein, 9 aa, Homo Sapiens
EVGGEALGR

SEQ ID NO: 51812 - protein, 9 aa, Homo Sapiens
EVGKLRIAK

SEQ ID NO: 51813 - protein, 9 aa, Homo Sapiens
EVGPTMTEK

SEQ ID NO: 51814 - protein, 9 aa, Homo Sapiens
EVGPVVSFR

SEQ ID NO: 51815 - protein, 9 aa, Homo Sapiens
EVGQKLINK

SEQ ID NO: 51816 - protein, 9 aa, Homo Sapiens
EVHAVVTVR

SEQ ID NO: 51817 - protein, 9 aa, Homo Sapiens
EVHGFSMGK

SEQ ID NO: 51818 - protein, 9 aa, Homo Sapiens
EVIEALLKK

SEQ ID NO: 51819 - protein, 9 aa, Homo Sapiens
EVIEIMTDR

SEQ ID NO: 51820 - protein, 9 aa, Homo Sapiens
EVIISWSEK

SEQ ID NO: 51821 - protein, 9 aa, Homo Sapiens
EVIKLLQSK

SEQ ID NO: 51822 - protein, 9 aa, Homo Sapiens
EVIKNRFHR

SEQ ID NO: 51823 - protein, 9 aa, Homo Sapiens
EVIKPWITK

SEQ ID NO: 51824 - protein, 9 aa, Homo Sapiens
EVIKQLKEK

SEQ ID NO: 51825 - protein, 9 aa, Homo Sapiens
EVIKSMKPK

SEQ ID NO: 51826 - protein, 9 aa, Homo Sapiens
EVIKVIHGK

SEQ ID NO: 51827 - protein, 9 aa, Homo Sapiens
EVINKLGPR

SEQ ID NO: 51828 - protein, 9 aa, Homo Sapiens
EVINVLINK

SEQ ID NO: 51829 - protein, 9 aa, Homo Sapiens
EVIQGLLKK

SEQ ID NO: 51830 - protein, 9 aa, Homo Sapiens
EVISDLQSK

SEQ ID NO: 51831 - protein, 9 aa, Homo Sapiens
EVISLINTR

SEQ ID NO: 51832 - protein, 9 aa, Homo Sapiens
EVISRGGPR

SEQ ID NO: 51833 - protein, 9 aa, Homo Sapiens
EVKEFLSTK

SEQ ID NO: 51834 - protein, 9 aa, Homo Sapiens
EVKEVAGIK

SEQ ID NO: 51835 - protein, 9 aa, Homo Sapiens
EVKQIGINK

SEQ ID NO: 51836 - protein, 9 aa, Homo Sapiens
EVLAHYSHR

SEQ ID NO: 51837 - protein, 9 aa, Homo Sapiens
EVLAKVREK

SEQ ID NO: 51838 - protein, 9 aa, Homo Sapiens
EVLALILTH

SEQ ID NO: 51839 - protein, 9 aa, Homo Sapiens
EVLALPFKR

SEQ ID NO: 51840 - protein, 9 aa, Homo Sapiens
EVLAWMILH

SEQ ID NO: 51841 - protein, 9 aa, Homo Sapiens
EVLCHIFRY

SEQ ID NO: 51842 - protein, 9 aa, Homo Sapiens
EVLCVLTQK

SEQ ID NO: 51843 - protein, 9 aa, Homo Sapiens
EVLDHKEFK

SEQ ID NO: 51844 - protein, 9 aa, Homo Sapiens
EVLDHVLRI

SEQ ID NO: 51845 - protein, 9 aa, Homo Sapiens
EVLDMLFPK

SEQ ID NO: 51846 - protein, 9 aa, Homo Sapiens
EVLDRVFER

SEQ ID NO: 51847 - protein, 9 aa, Homo Sapiens
EVLDSLQSK

SEQ ID NO: 51848 - protein, 9 aa, Homo Sapiens
EVLDVVITK

SEQ ID NO: 51849 - protein, 9 aa, Homo Sapiens
EVLDYFLRR

SEQ ID NO: 51850 - protein, 9 aa, Homo Sapiens
EVLEEIVTK

SEQ ID NO: 51851 - protein, 9 aa, Homo Sapiens
EVLEPEVTK

SEQ ID NO: 51852 - protein, 9 aa, Homo Sapiens
EVLERVNSK

SEQ ID NO: 51853 - protein, 9 aa, Homo Sapiens
EVLFNLGSK

SEQ ID NO: 51854 - protein, 9 aa, Homo Sapiens
EVLGILRYI

SEQ ID NO: 51855 - protein, 9 aa, Homo Sapiens
EVLGLILRY

SEQ ID NO: 51856 - protein, 9 aa, Homo Sapiens
EVLGPHLER

SEQ ID NO: 51857 - protein, 9 aa, Homo Sapiens
EVLISRVYR

SEQ ID NO: 51858 - protein, 9 aa, Homo Sapiens
EVLKAAENK

SEQ ID NO: 51859 - protein, 9 aa, Homo Sapiens
EVLKKYLQK

SEQ ID NO: 51860 - protein, 9 aa, Homo Sapiens
EVLKNRAIK

SEQ ID NO: 51861 - protein, 9 aa, Homo Sapiens
EVLKQLAEK

SEQ ID NO: 51862 - protein, 9 aa, Homo Sapiens
EVLKSVVAK

SEQ ID NO: 51863 - protein, 9 aa, Homo Sapiens
EVLKYLRSK

SEQ ID NO: 51864 - protein, 9 aa, Homo Sapiens
EVLNFLLRY

SEQ ID NO: 51865 - protein, 9 aa, Homo Sapiens
EVLNLLTNK

SEQ ID NO: 51866 - protein, 9 aa, Homo Sapiens
EVLNRIQFR

SEQ ID NO: 51867 - protein, 9 aa, Homo Sapiens
EVLNTLIHH

SEQ ID NO: 51868 - protein, 9 aa, Homo Sapiens
EVLPKPRMR

SEQ ID NO: 51869 - protein, 9 aa, Homo Sapiens
EVLPKYFKH

SEQ ID NO: 51870 - protein, 9 aa, Homo Sapiens
EVLPPIHAY

SEQ ID NO: 51871 - protein, 9 aa, Homo Sapiens
EVLPTKMSY

SEQ ID NO: 51872 - protein, 9 aa, Homo Sapiens
EVLQDPVLK

SEQ ID NO: 51873 - protein, 9 aa, Homo Sapiens
EVLQGGSQR

SEQ ID NO: 51874 - protein, 9 aa, Homo Sapiens
EVLQPLQQR

SEQ ID NO: 51875 - protein, 9 aa, Homo Sapiens
EVLQYQLQH

SEQ ID NO: 51876 - protein, 9 aa, Homo Sapiens
EVLRLILTH

SEQ ID NO: 51877 - protein, 9 aa, Homo Sapiens
EVLSDPQTR

SEQ ID NO: 51878 - protein, 9 aa, Homo Sapiens
EVLTQLPPK

SEQ ID NO: 51879 - protein, 9 aa, Homo Sapiens
EVLVAILRH

SEQ ID NO: 51880 - protein, 9 aa, Homo Sapiens
EVLVSKVSK

SEQ ID NO: 51881 - protein, 9 aa, Homo Sapiens
EVLYSIAEK

SEQ ID NO: 51882 - protein, 9 aa, Homo Sapiens
EVLYYTVEK

SEQ ID NO: 51883 - protein, 9 aa, Homo Sapiens
EVMARFAAR

SEQ ID NO: 51884 - protein, 9 aa, Homo Sapiens
EVMEAMGIK

SEQ ID NO: 51885 - protein, 9 aa, Homo Sapiens
EVMENPSCR

SEQ ID NO: 51886 - protein, 9 aa, Homo Sapiens
EVMGTGAVR

SEQ ID NO: 51887 - protein, 9 aa, Homo Sapiens
EVMNQNLAY

SEQ ID NO: 51888 - protein, 9 aa, Homo Sapiens
EVMPLLLAY

SEQ ID NO: 51889 - protein, 9 aa, Homo Sapiens
EVMPVLEEK

SEQ ID NO: 51890 - protein, 9 aa, Homo Sapiens
EVMQAVARL

SEQ ID NO: 51891 - protein, 9 aa, Homo Sapiens
EVNASPLKH

SEQ ID NO: 51892 - protein, 9 aa, Homo Sapiens
EVNAWLVHR

SEQ ID NO: 51893 - protein, 9 aa, Homo Sapiens
EVNENILHK

SEQ ID NO: 51894 - protein, 9 aa, Homo Sapiens
EVNIPTDLR

SEQ ID NO: 51895 - protein, 9 aa, Homo Sapiens
EVNKFQMAY

SEQ ID NO: 51896 - protein, 9 aa, Homo Sapiens
EVNQETIQR

SEQ ID NO: 51897 - protein, 9 aa, Homo Sapiens
EVNRPQIHK

SEQ ID NO: 51898 - protein, 9 aa, Homo Sapiens
EVNSGFFYK

SEQ ID NO: 51899 - protein, 9 aa, Homo Sapiens
EVNSHLLDK

SEQ ID NO: 51900 - protein, 9 aa, Homo Sapiens
EVNTETLNK

SEQ ID NO: 51901 - protein, 9 aa, Homo Sapiens
EVPGLFIEK

SEQ ID NO: 51902 - protein, 9 aa, Homo Sapiens
EVPSFTMGR

SEQ ID NO: 51903 - protein, 9 aa, Homo Sapiens
EVQALFLRH

SEQ ID NO: 51904 - protein, 9 aa, Homo Sapiens
EVRDLFQMK

SEQ ID NO: 51905 - protein, 9 aa, Homo Sapiens
EVRGGGLTR

SEQ ID NO: 51906 - protein, 9 aa, Homo Sapiens
EVRLGGSLR

SEQ ID NO: 51907 - protein, 9 aa, Homo Sapiens
EVRPGIVSK

SEQ ID NO: 51908 - protein, 9 aa, Homo Sapiens
EVRPVVVPK

SEQ ID NO: 51909 - protein, 9 aa, Homo Sapiens
EVSAAIIQR

SEQ ID NO: 51910 - protein, 9 aa, Homo Sapiens
EVSAEVRER

SEQ ID NO: 51911 - protein, 9 aa, Homo Sapiens
EVSEMLLQH

SEQ ID NO: 51912 - protein, 9 aa, Homo Sapiens
EVSGCGSLR

SEQ ID NO: 51913 - protein, 9 aa, Homo Sapiens
EVSKDTVMK

SEQ ID NO: 51914 - protein, 9 aa, Homo Sapiens
EVSLTLTNK

SEQ ID NO: 51915 - protein, 9 aa, Homo Sapiens
EVSPETMVK

SEQ ID NO: 51916 - protein, 9 aa, Homo Sapiens
EVSPMQLIK

SEQ ID NO: 51917 - protein, 9 aa, Homo Sapiens
EVSSIIKKK

SEQ ID NO: 51918 - protein, 9 aa, Homo Sapiens
EVSSLISEK

SEQ ID NO: 51919 - protein, 9 aa, Homo Sapiens
EVSSMPACK

SEQ ID NO: 51920 - protein, 9 aa, Homo Sapiens
EVSSMVLTK

SEQ ID NO: 51921 - protein, 9 aa, Homo Sapiens
EVSSVSPLK

SEQ ID NO: 51922 - protein, 9 aa, Homo Sapiens
EVSTVIFKK

SEQ ID NO: 51923 - protein, 9 aa, Homo Sapiens
EVSTVNVRR

SEQ ID NO: 51924 - protein, 9 aa, Homo Sapiens
EVSWKVLER

SEQ ID NO: 51925 - protein, 9 aa, Homo Sapiens
EVTDYAIAR

SEQ ID NO: 51926 - protein, 9 aa, Homo Sapiens
EVTDYTTGR

SEQ ID NO: 51927 - protein, 9 aa, Homo Sapiens
EVTELLLKH

SEQ ID NO: 51928 - protein, 9 aa, Homo Sapiens
EVTESPLVK

SEQ ID NO: 51929 - protein, 9 aa, Homo Sapiens
EVTNIITSK

SEQ ID NO: 51930 - protein, 9 aa, Homo Sapiens
EVTTAVTEK

SEQ ID NO: 51931 - protein, 9 aa, Homo Sapiens
EVTTTVLVR

SEQ ID NO: 51932 - protein, 9 aa, Homo Sapiens
EVVAKFLHK

SEQ ID NO: 51933 - protein, 9 aa, Homo Sapiens
EVVASAALR

SEQ ID NO: 51934 - protein, 9 aa, Homo Sapiens
EVVDLLLAR

SEQ ID NO: 51935 - protein, 9 aa, Homo Sapiens
EVVDSLVGK

SEQ ID NO: 51936 - protein, 9 aa, Homo Sapiens
EVVDVTWRY

SEQ ID NO: 51937 - protein, 9 aa, Homo Sapiens
EVVETPLLH

SEQ ID NO: 51938 - protein, 9 aa, Homo Sapiens
EVVGRVTAK

SEQ ID NO: 51939 - protein, 9 aa, Homo Sapiens
EVVGSVQGK

SEQ ID NO: 51940 - protein, 9 aa, Homo Sapiens
EVVHLILFY

SEQ ID NO: 51941 - protein, 9 aa, Homo Sapiens
EVVHPGDLK

SEQ ID NO: 51942 - protein, 9 aa, Homo Sapiens
EVVNKIRLK

SEQ ID NO: 51943 - protein, 9 aa, Homo Sapiens
EVVNLLLRH

SEQ ID NO: 51944 - protein, 9 aa, Homo Sapiens
EVVPRVTKK

SEQ ID NO: 51945 - protein, 9 aa, Homo Sapiens
EVVPVLSEK

SEQ ID NO: 51946 - protein, 9 aa, Homo Sapiens
EVVQITWNR

SEQ ID NO: 51947 - protein, 9 aa, Homo Sapiens
EVVSGVVSK

SEQ ID NO: 51948 - protein, 9 aa, Homo Sapiens
EVVVSGKLR

SEQ ID NO: 51949 - protein, 9 aa, Homo Sapiens
EVVYRFTAR

SEQ ID NO: 51950 - protein, 9 aa, Homo Sapiens
EVWDVKNYK

SEQ ID NO: 51951 - protein, 9 aa, Homo Sapiens
EVWNFTTGK

SEQ ID NO: 51952 - protein, 9 aa, Homo Sapiens
EVWPHSTER

SEQ ID NO: 51953 - protein, 9 aa, Homo Sapiens
EVYAGSHQY

SEQ ID NO: 51954 - protein, 9 aa, Homo Sapiens
EVYCDVAPK

SEQ ID NO: 51955 - protein, 9 aa, Homo Sapiens
EVYDDFLHY

SEQ ID NO: 51956 - protein, 9 aa, Homo Sapiens
EVYEGALLY

SEQ ID NO: 51957 - protein, 9 aa, Homo Sapiens
EVYEKPVQV

SEQ ID NO: 51958 - protein, 9 aa, Homo Sapiens
EVYKMLQEK

SEQ ID NO: 51959 - protein, 9 aa, Homo Sapiens
EVYLASLEK

SEQ ID NO: 51960 - protein, 9 aa, Homo Sapiens
EVYNEFVRK

SEQ ID NO: 51961 - protein, 9 aa, Homo Sapiens
EVYPTSLTK

SEQ ID NO: 51962 - protein, 9 aa, Homo Sapiens
EVYRHFTGH

SEQ ID NO: 51963 - protein, 9 aa, Homo Sapiens
EVYSTEIKK

SEQ ID NO: 51964 - protein, 9 aa, Homo Sapiens
EVYVGAVNR

SEQ ID NO: 51965 - protein, 9 aa, Homo Sapiens
EVYVPHTVY

SEQ ID NO: 51966 - protein, 9 aa, Homo Sapiens
EVYYGHTNY

SEQ ID NO: 51967 - protein, 9 aa, Homo Sapiens
FAAGVWLAR

SEQ ID NO: 51968 - protein, 9 aa, Homo Sapiens
FAFEGILIK

SEQ ID NO: 51969 - protein, 9 aa, Homo Sapiens
FAFGGLCER

SEQ ID NO: 51970 - protein, 9 aa, Homo Sapiens
FAGKLSYVK

SEQ ID NO: 51971 - protein, 9 aa, Homo Sapiens
FAIGSQTTK

SEQ ID NO: 51972 - protein, 9 aa, Homo Sapiens
FALWPMLQK

SEQ ID NO: 51973 - protein, 9 aa, Homo Sapiens
FALYAVIEK

SEQ ID NO: 51974 - protein, 9 aa, Homo Sapiens
FASDPILYR

SEQ ID NO: 51975 - protein, 9 aa, Homo Sapiens
FASQEIAEK

SEQ ID NO: 51976 - protein, 9 aa, Homo Sapiens
FASQGGLAR

SEQ ID NO: 51977 - protein, 9 aa, Homo Sapiens
FATPVFITK

SEQ ID NO: 51978 - protein, 9 aa, Homo Sapiens
FAVGPIIEK

SEQ ID NO: 51979 - protein, 9 aa, Homo Sapiens
FAWHPHTNK

SEQ ID NO: 51980 - protein, 9 aa, Homo Sapiens
FAYTVSTQR

SEQ ID NO: 51981 - protein, 9 aa, Homo Sapiens
FDAPPALPK

SEQ ID NO: 51982 - protein, 9 aa, Homo Sapiens
FIASVFMLH

SEQ ID NO: 51983 - protein, 9 aa, Homo Sapiens
FICPALIYK

SEQ ID NO: 51984 - protein, 9 aa, Homo Sapiens
FILPTGANK

SEQ ID NO: 51985 - protein, 9 aa, Homo Sapiens
FINMPSVAK

SEQ ID NO: 51986 - protein, 9 aa, Homo Sapiens
FISKVSTHK

SEQ ID NO: 51987 - protein, 9 aa, Homo Sapiens
FIYLGEVFK

SEQ ID NO: 51988 - protein, 9 aa, Homo Sapiens
FIYRPIRQR

SEQ ID NO: 51989 - protein, 9 aa, Homo Sapiens
FNYKPILTK

SEQ ID NO: 51990 - protein, 9 aa, Homo Sapiens
FPRKPSAPK

SEQ ID NO: 51991 - protein, 9 aa, Homo Sapiens
FSAPLFLSH

SEQ ID NO: 51992 - protein, 9 aa, Homo Sapiens
FSAPNYCYR

SEQ ID NO: 51993 - protein, 9 aa, Homo Sapiens
FSATLAYKK

SEQ ID NO: 51994 - protein, 9 aa, Homo Sapiens
FSCDMAVPK

SEQ ID NO: 51995 - protein, 9 aa, Homo Sapiens
FSLGIGASK

SEQ ID NO: 51996 - protein, 9 aa, Homo Sapiens
FSTSVVHTK

SEQ ID NO: 51997 - protein, 9 aa, Homo Sapiens
FSVGETTAK

SEQ ID NO: 51998 - protein, 9 aa, Homo Sapiens
FSVKPLKQK

SEQ ID NO: 51999 - protein, 9 aa, Homo Sapiens
FTAKTSCVR

SEQ ID NO: 52000 - protein, 9 aa, Homo Sapiens
FTAPPVLGK

SEQ ID NO: 52001 - protein, 9 aa, Homo Sapiens
FTAPSTVGK

SEQ ID NO: 52002 - protein, 9 aa, Homo Sapiens
FTDPPVKTK

SEQ ID NO: 52003 - protein, 9 aa, Homo Sapiens
FTFFIHNPK

SEQ ID NO: 52004 - protein, 9 aa, Homo Sapiens
FTFLPGHQK

SEQ ID NO: 52005 - protein, 9 aa, Homo Sapiens
FTFNRQPLR

SEQ ID NO: 52006 - protein, 9 aa, Homo Sapiens
FTGPPTFPK

SEQ ID NO: 52007 - protein, 9 aa, Homo Sapiens
FTIDSRLQR

SEQ ID NO: 52008 - protein, 9 aa, Homo Sapiens
FTIKRFLAK

SEQ ID NO: 52009 - protein, 9 aa, Homo Sapiens
FTLDNILSH

SEQ ID NO: 52010 - protein, 9 aa, Homo Sapiens
FTMKTSCVR

SEQ ID NO: 52011 - protein, 9 aa, Homo Sapiens
FTMLSIRNK

SEQ ID NO: 52012 - protein, 9 aa, Homo Sapiens
FTMPNTIKH

SEQ ID NO: 52013 - protein, 9 aa, Homo Sapiens
FTNERFPLR

SEQ ID NO: 52014 - protein, 9 aa, Homo Sapiens
FTNKPTTFR

SEQ ID NO: 52015 - protein, 9 aa, Homo Sapiens
FTQKPGFPK

SEQ ID NO: 52016 - protein, 9 aa, Homo Sapiens
FTRGKGPLK

SEQ ID NO: 52017 - protein, 9 aa, Homo Sapiens
FTSGYIPAR

SEQ ID NO: 52018 - protein, 9 aa, Homo Sapiens
FTSMTRLYY

SEQ ID NO: 52019 - protein, 9 aa, Homo Sapiens
FTSPISVTK

SEQ ID NO: 52020 - protein, 9 aa, Homo Sapiens
FTSPPSLFK

SEQ ID NO: 52021 - protein, 9 aa, Homo Sapiens
FTSSTTLTK

SEQ ID NO: 52022 - protein, 9 aa, Homo Sapiens
FTSVDLTNK

SEQ ID NO: 52023 - protein, 9 aa, Homo Sapiens
FTTGFHTKK

SEQ ID NO: 52024 - protein, 9 aa, Homo Sapiens
FTTGMAAVK

SEQ ID NO: 52025 - protein, 9 aa, Homo Sapiens
FTTVGSAEK

SEQ ID NO: 52026 - protein, 9 aa, Homo Sapiens
FTVGRYLAK

SEQ ID NO: 52027 - protein, 9 aa, Homo Sapiens
FTVTVGNNR

SEQ ID NO: 52028 - protein, 9 aa, Homo Sapiens
FTYDPWIGK

SEQ ID NO: 52029 - protein, 9 aa, Homo Sapiens
FTYMNPAQR

SEQ ID NO: 52030 - protein, 9 aa, Homo Sapiens
FVAQPGLSR

SEQ ID NO: 52031 - protein, 9 aa, Homo Sapiens
FVAQVLVGK

SEQ ID NO: 52032 - protein, 9 aa, Homo Sapiens
FVCERTLKY

SEQ ID NO: 52033 - protein, 9 aa, Homo Sapiens
FVDKIREYK

SEQ ID NO: 52034 - protein, 9 aa, Homo Sapiens
FVFDHALMK

SEQ ID NO: 52035 - protein, 9 aa, Homo Sapiens
FVFDRPVHR

SEQ ID NO: 52036 - protein, 9 aa, Homo Sapiens
FVFKITTTK

SEQ ID NO: 52037 - protein, 9 aa, Homo Sapiens
FVFKPNSKK

SEQ ID NO: 52038 - protein, 9 aa, Homo Sapiens
FVGPPGVGK

SEQ ID NO: 52039 - protein, 9 aa, Homo Sapiens
FVHGGVTMK

SEQ ID NO: 52040 - protein, 9 aa, Homo Sapiens
FVIDAVRTK

SEQ ID NO: 52041 - protein, 9 aa, Homo Sapiens
FVIDPGFAK

SEQ ID NO: 52042 - protein, 9 aa, Homo Sapiens
FVKRQFMNK

SEQ ID NO: 52043 - protein, 9 aa, Homo Sapiens
FVMGVNHEK

SEQ ID NO: 52044 - protein, 9 aa, Homo Sapiens
FVPKPGSLK

SEQ ID NO: 52045 - protein, 9 aa, Homo Sapiens
FVSAKITNK

SEQ ID NO: 52046 - protein, 9 aa, Homo Sapiens
FVYEPKEQK

SEQ ID NO: 52047 - protein, 9 aa, Homo Sapiens
FVYEVTSTK

SEQ ID NO: 52048 - protein, 9 aa, Homo Sapiens
FVYGSGVYR

SEQ ID NO: 52049 - protein, 9 aa, Homo Sapiens
GFQNALIVR

SEQ ID NO: 52050 - protein, 9 aa, Homo Sapiens
GKYLYEIAR

SEQ ID NO: 52051 - protein, 9 aa, Homo Sapiens
GTCGVLLRK

SEQ ID NO: 52052 - protein, 9 aa, Homo Sapiens
GTFPRAFKK

SEQ ID NO: 52053 - protein, 9 aa, Homo Sapiens
GTLDYILQR

SEQ ID NO: 52054 - protein, 9 aa, Homo Sapiens
GTMPVSLLK

SEQ ID NO: 52055 - protein, 9 aa, Homo Sapiens
GTMTGMLYK

SEQ ID NO: 52056 - protein, 9 aa, Homo Sapiens
GTYHGMTLK

SEQ ID NO: 52057 - protein, 9 aa, Homo Sapiens
GTYVSSVPR

SEQ ID NO: 52058 - protein, 9 aa, Homo Sapiens
GVADKILKK

SEQ ID NO: 52059 - protein, 9 aa, Homo Sapiens
GVLAWVKEK

SEQ ID NO: 52060 - protein, 9 aa, Homo Sapiens
GVMVGMGQK

SEQ ID NO: 52061 - protein, 9 aa, Homo Sapiens
GVSAAFAVK

SEQ ID NO: 52062 - protein, 9 aa, Homo Sapiens
HAADPIITR

SEQ ID NO: 52063 - protein, 9 aa, Homo Sapiens
HAKGIVLEK

SEQ ID NO: 52064 - protein, 9 aa, Homo Sapiens
HAVGIVVNK

SEQ ID NO: 52065 - protein, 9 aa, Homo Sapiens
HAVPPLVPK

SEQ ID NO: 52066 - protein, 9 aa, Homo Sapiens
HIAEPNYGK

SEQ ID NO: 52067 - protein, 9 aa, Homo Sapiens
HIFMKVFPK

SEQ ID NO: 52068 - protein, 9 aa, Homo Sapiens
HIHKSLIGK

SEQ ID NO: 52069 - protein, 9 aa, Homo Sapiens
HILDGSPEK

SEQ ID NO: 52070 - protein, 9 aa, Homo Sapiens
HILTALREK

SEQ ID NO: 52071 - protein, 9 aa, Homo Sapiens
HISGVFATK

SEQ ID NO: 52072 - protein, 9 aa, Homo Sapiens
HLISPLIQK

SEQ ID NO: 52073 - protein, 9 aa, Homo Sapiens
HNCDTILKH

SEQ ID NO: 52074 - protein, 9 aa, Homo Sapiens
HSAPGGPSY

SEQ ID NO: 52075 - protein, 9 aa, Homo Sapiens
HSLLPLAEK

SEQ ID NO: 52076 - protein, 9 aa, Homo Sapiens
HSLSPGPSK

SEQ ID NO: 52077 - protein, 9 aa, Homo Sapiens
HSMDFVAYR

SEQ ID NO: 52078 - protein, 9 aa, Homo Sapiens
HSNIASLVK

SEQ ID NO: 52079 - protein, 9 aa, Homo Sapiens
HSNIPCLSK

SEQ ID NO: 52080 - protein, 9 aa, Homo Sapiens
HSSRFIPLK

SEQ ID NO: 52081 - protein, 9 aa, Homo Sapiens
HTANIFSVK

SEQ ID NO: 52082 - protein, 9 aa, Homo Sapiens
HTAPNVPHY

SEQ ID NO: 52083 - protein, 9 aa, Homo Sapiens
HTASDFVAK

SEQ ID NO: 52084 - protein, 9 aa, Homo Sapiens
HTAVVYTEK

SEQ ID NO: 52085 - protein, 9 aa, Homo Sapiens
HTAWLVMEY

SEQ ID NO: 52086 - protein, 9 aa, Homo Sapiens
HTDKGSFLK

SEQ ID NO: 52087 - protein, 9 aa, Homo Sapiens
HTFGGPLLK

SEQ ID NO: 52088 - protein, 9 aa, Homo Sapiens
HTGYPGGFR

SEQ ID NO: 52089 - protein, 9 aa, Homo Sapiens
HTIAPMGTR

SEQ ID NO: 52090 - protein, 9 aa, Homo Sapiens
HTIDWVREK

SEQ ID NO: 52091 - protein, 9 aa, Homo Sapiens
HTIGKTVEY

SEQ ID NO: 52092 - protein, 9 aa, Homo Sapiens
HTISKVTVK

SEQ ID NO: 52093 - protein, 9 aa, Homo Sapiens
HTISPFMNK

SEQ ID NO: 52094 - protein, 9 aa, Homo Sapiens
HTLDVFKRK

SEQ ID NO: 52095 - protein, 9 aa, Homo Sapiens
HTLEPLIPR

SEQ ID NO: 52096 - protein, 9 aa, Homo Sapiens
HTLFEFVFK

SEQ ID NO: 52097 - protein, 9 aa, Homo Sapiens
HTMGFWLTK

SEQ ID NO: 52098 - protein, 9 aa, Homo Sapiens
HTNFHIPKK

SEQ ID NO: 52099 - protein, 9 aa, Homo Sapiens
HTNPGAFGK

SEQ ID NO: 52100 - protein, 9 aa, Homo Sapiens
HTPPPGFEK

SEQ ID NO: 52101 - protein, 9 aa, Homo Sapiens
HTSQVLVDK

SEQ ID NO: 52102 - protein, 9 aa, Homo Sapiens
HTSVPLLLR

SEQ ID NO: 52103 - protein, 9 aa, Homo Sapiens
HTTLVVTTK

SEQ ID NO: 52104 - protein, 9 aa, Homo Sapiens
HTTPVLLAH

SEQ ID NO: 52105 - protein, 9 aa, Homo Sapiens
HTVVPSISK

SEQ ID NO: 52106 - protein, 9 aa, Homo Sapiens
HTWSPHLNK

SEQ ID NO: 52107 - protein, 9 aa, Homo Sapiens
HTYQSPLLY

SEQ ID NO: 52108 - protein, 9 aa, Homo Sapiens
HTYYKFDYK

SEQ ID NO: 52109 - protein, 9 aa, Homo Sapiens
HVAAPYIAK

SEQ ID NO: 52110 - protein, 9 aa, Homo Sapiens
HVAYSWSEK

SEQ ID NO: 52111 - protein, 9 aa, Homo Sapiens
HVDDPMRFK

SEQ ID NO: 52112 - protein, 9 aa, Homo Sapiens
HVDFPVGNK

SEQ ID NO: 52113 - protein, 9 aa, Homo Sapiens
HVFGRSLLR

SEQ ID NO: 52114 - protein, 9 aa, Homo Sapiens
HVGISFVPK

SEQ ID NO: 52115 - protein, 9 aa, Homo Sapiens
HVGYTLSYK

SEQ ID NO: 52116 - protein, 9 aa, Homo Sapiens
HVHEPNPLR

SEQ ID NO: 52117 - protein, 9 aa, Homo Sapiens
HVIETLIGK

SEQ ID NO: 52118 - protein, 9 aa, Homo Sapiens
HVLPSTIKK

SEQ ID NO: 52119 - protein, 9 aa, Homo Sapiens
HVMEVYSWK

SEQ ID NO: 52120 - protein, 9 aa, Homo Sapiens
HVPGFCLPK

SEQ ID NO: 52121 - protein, 9 aa, Homo Sapiens
HVPSPAVPK

SEQ ID NO: 52122 - protein, 9 aa, Homo Sapiens
HVTDKIIMK

SEQ ID NO: 52123 - protein, 9 aa, Homo Sapiens
HVTDPFIRR

SEQ ID NO: 52124 - protein, 9 aa, Homo Sapiens
HVTKFFNYK

SEQ ID NO: 52125 - protein, 9 aa, Homo Sapiens
HVTPPPIPK

SEQ ID NO: 52126 - protein, 9 aa, Homo Sapiens
HVVDIVALK

SEQ ID NO: 52127 - protein, 9 aa, Homo Sapiens
HVVLPVKPK

SEQ ID NO: 52128 - protein, 9 aa, Homo Sapiens
HVVSEGVPR

SEQ ID NO: 52129 - protein, 9 aa, Homo Sapiens
HVYSWPKNK

SEQ ID NO: 52130 - protein, 9 aa, Homo Sapiens
HVYVGNISK

SEQ ID NO: 52131 - protein, 9 aa, Homo Sapiens
IAASSIAAK

SEQ ID NO: 52132 - protein, 9 aa, Homo Sapiens
IDERAINKK

SEQ ID NO: 52133 - protein, 9 aa, Homo Sapiens
IDERTINKK

SEQ ID NO: 52134 - protein, 9 aa, Homo Sapiens
IINRPNTPK

SEQ ID NO: 52135 - protein, 9 aa, Homo Sapiens
IIYRMTNQK

SEQ ID NO: 52136 - protein, 9 aa, Homo Sapiens
ILGPNLGDK

SEQ ID NO: 52137 - protein, 9 aa, Homo Sapiens
IPAQPSVAK

SEQ ID NO: 52138 - protein, 9 aa, Homo Sapiens
IPTSFSPLK

SEQ ID NO: 52139 - protein, 9 aa, Homo Sapiens
IPYAGETLK

SEQ ID NO: 52140 - protein, 9 aa, Homo Sapiens
ITAGDFQNK

SEQ ID NO: 52141 - protein, 9 aa, Homo Sapiens
ITGDFALVK

SEQ ID NO: 52142 - protein, 9 aa, Homo Sapiens
ITGPNMGGK

SEQ ID NO: 52143 - protein, 9 aa, Homo Sapiens
ITLPAGTEK

SEQ ID NO: 52144 - protein, 9 aa, Homo Sapiens
ITNEVLQTK

SEQ ID NO: 52145 - protein, 9 aa, Homo Sapiens
ITSPVVTQK

SEQ ID NO: 52146 - protein, 9 aa, Homo Sapiens
ITSSNFLHY

SEQ ID NO: 52147 - protein, 9 aa, Homo Sapiens
ITSTPGVPK

SEQ ID NO: 52148 - protein, 9 aa, Homo Sapiens
ITTGNSPPR

SEQ ID NO: 52149 - protein, 9 aa, Homo Sapiens
ITVGDIGPK

SEQ ID NO: 52150 - protein, 9 aa, Homo Sapiens
ITWERIISH

SEQ ID NO: 52151 - protein, 9 aa, Homo Sapiens
IVAGSLITK

SEQ ID NO: 52152 - protein, 9 aa, Homo Sapiens
IVAGTLTNK

SEQ ID NO: 52153 - protein, 9 aa, Homo Sapiens
IVGDPSTAK

SEQ ID NO: 52154 - protein, 9 aa, Homo Sapiens
IVIPPATEK

SEQ ID NO: 52155 - protein, 9 aa, Homo Sapiens
IVKPPASAR

SEQ ID NO: 52156 - protein, 9 aa, Homo Sapiens
IVMETGNTK

SEQ ID NO: 52157 - protein, 9 aa, Homo Sapiens
IVNRGITPK

SEQ ID NO: 52158 - protein, 9 aa, Homo Sapiens
IVPVPLAEK

SEQ ID NO: 52159 - protein, 9 aa, Homo Sapiens
IVSGPPSHK

SEQ ID NO: 52160 - protein, 9 aa, Homo Sapiens
IVSSGFSSK

SEQ ID NO: 52161 - protein, 9 aa, Homo Sapiens
IVTDFSVIK

SEQ ID NO: 52162 - protein, 9 aa, Homo Sapiens
IVYEKIMEH

SEQ ID NO: 52163 - protein, 9 aa, Homo Sapiens
IVYPPPPAK

SEQ ID NO: 52164 - protein, 9 aa, Homo Sapiens
KADPPLPAR

SEQ ID NO: 52165 - protein, 9 aa, Homo Sapiens
KTLYPIIGK

SEQ ID NO: 52166 - protein, 9 aa, Homo Sapiens
LAAEPVRAK

SEQ ID NO: 52167 - protein, 9 aa, Homo Sapiens
LAAPASLRP

SEQ ID NO: 52168 - protein, 9 aa, Homo Sapiens
LAAPPALEK

SEQ ID NO: 52169 - protein, 9 aa, Homo Sapiens
LALGVTLLK

SEQ ID NO: 52170 - protein, 9 aa, Homo Sapiens
LASQPSIPR

SEQ ID NO: 52171 - protein, 9 aa, Homo Sapiens
LAVRPFLPK

SEQ ID NO: 52172 - protein, 9 aa, Homo Sapiens
LAYRGFIFK

SEQ ID NO: 52173 - protein, 9 aa, Homo Sapiens
LDKLLLCLK

SEQ ID NO: 52174 - protein, 9 aa, Homo Sapiens
LDLLSRIPQ

SEQ ID NO: 52175 - protein, 9 aa, Homo Sapiens
LIPPPLSNR

SEQ ID NO: 52176 - protein, 9 aa, Homo Sapiens
LLAPRASVP

SEQ ID NO: 52177 - protein, 9 aa, Homo Sapiens
LPAKAIGHR

SEQ ID NO: 52178 - protein, 9 aa, Homo Sapiens
LPATHIRGK

SEQ ID NO: 52179 - protein, 9 aa, Homo Sapiens
LPPPGRSLK

SEQ ID NO: 52180 - protein, 9 aa, Homo Sapiens
LPSPVTAQK

SEQ ID NO: 52181 - protein, 9 aa, Homo Sapiens
LSRIKFTGK

SEQ ID NO: 52182 - protein, 9 aa, Homo Sapiens
LSSGAVLYK

SEQ ID NO: 52183 - protein, 9 aa, Homo Sapiens
LTAEAFGFK

SEQ ID NO: 52184 - protein, 9 aa, Homo Sapiens
LTAEQILQH

SEQ ID NO: 52185 - protein, 9 aa, Homo Sapiens
LTAPSTSAR

SEQ ID NO: 52186 - protein, 9 aa, Homo Sapiens
LTEAPLNPK

SEQ ID NO: 52187 - protein, 9 aa, Homo Sapiens
LTFMRFAYK

SEQ ID NO: 52188 - protein, 9 aa, Homo Sapiens
LTGKPVMVK

SEQ ID NO: 52189 - protein, 9 aa, Homo Sapiens
LTGPPGTGK

SEQ ID NO: 52190 - protein, 9 aa, Homo Sapiens
LTGPPGVGK

SEQ ID NO: 52191 - protein, 9 aa, Homo Sapiens
LTGPVMPVR

SEQ ID NO: 52192 - protein, 9 aa, Homo Sapiens
LTGTPLQNK

SEQ ID NO: 52193 - protein, 9 aa, Homo Sapiens
LTHSGFPAK

SEQ ID NO: 52194 - protein, 9 aa, Homo Sapiens
LTMDSSGPK

SEQ ID NO: 52195 - protein, 9 aa, Homo Sapiens
LTMPGGVAK

SEQ ID NO: 52196 - protein, 9 aa, Homo Sapiens
LTTAVITNK

SEQ ID NO: 52197 - protein, 9 aa, Homo Sapiens
LTTESIMKK

SEQ ID NO: 52198 - protein, 9 aa, Homo Sapiens
LTYEFVKQK

SEQ ID NO: 52199 - protein, 9 aa, Homo Sapiens
LTYNDFINK

SEQ ID NO: 52200 - protein, 9 aa, Homo Sapiens
LVAETFAQK

SEQ ID NO: 52201 - protein, 9 aa, Homo Sapiens
LVAGVAFKK

SEQ ID NO: 52202 - protein, 9 aa, Homo Sapiens
LVGPPGTGK

SEQ ID NO: 52203 - protein, 9 aa, Homo Sapiens
LVIPFTIKK

SEQ ID NO: 52204 - protein, 9 aa, Homo Sapiens
LVMEGHLFK

SEQ ID NO: 52205 - protein, 9 aa, Homo Sapiens
LVSPITGEK

SEQ ID NO: 52206 - protein, 9 aa, Homo Sapiens
LVSTPVRTK

SEQ ID NO: 52207 - protein, 9 aa, Homo Sapiens
MAAAAFAEK

SEQ ID NO: 52208 - protein, 9 aa, Homo Sapiens
MAAATLTSK

SEQ ID NO: 52209 - protein, 9 aa, Homo Sapiens
MAFNALIHK

SEQ ID NO: 52210 - protein, 9 aa, Homo Sapiens
MAFSQKNPK

SEQ ID NO: 52211 - protein, 9 aa, Homo Sapiens
MAGPAWISK

SEQ ID NO: 52212 - protein, 9 aa, Homo Sapiens
MAGPGGLAR

SEQ ID NO: 52213 - protein, 9 aa, Homo Sapiens
MASLMPLQK

SEQ ID NO: 52214 - protein, 9 aa, Homo Sapiens
MAYLGTITK

SEQ ID NO: 52215 - protein, 9 aa, Homo Sapiens
MGYYNNSTK

SEQ ID NO: 52216 - protein, 9 aa, Homo Sapiens
MNNKEALPK

SEQ ID NO: 52217 - protein, 9 aa, Homo Sapiens
MNYEGSPIK

SEQ ID NO: 52218 - protein, 9 aa, Homo Sapiens
MPASPVLTK

SEQ ID NO: 52219 - protein, 9 aa, Homo Sapiens
MPFGTGTSK

SEQ ID NO: 52220 - protein, 9 aa, Homo Sapiens
MPWNKRQPK

SEQ ID NO: 52221 - protein, 9 aa, Homo Sapiens
MSASKFTFK

SEQ ID NO: 52222 - protein, 9 aa, Homo Sapiens
MSASTTTLR

SEQ ID NO: 52223 - protein, 9 aa, Homo Sapiens
MSFPKAPLK

SEQ ID NO: 52224 - protein, 9 aa, Homo Sapiens
MSFWTGTAK

SEQ ID NO: 52225 - protein, 9 aa, Homo Sapiens
MSIDKAVTK

SEQ ID NO: 52226 - protein, 9 aa, Homo Sapiens
MSISGSSAR

SEQ ID NO: 52227 - protein, 9 aa, Homo Sapiens
MSLDIVLKK

SEQ ID NO: 52228 - protein, 9 aa, Homo Sapiens
MSLEHLTQK

SEQ ID NO: 52229 - protein, 9 aa, Homo Sapiens
MSLGLVLVH

SEQ ID NO: 52230 - protein, 9 aa, Homo Sapiens
MSLGTTREK

SEQ ID NO: 52231 - protein, 9 aa, Homo Sapiens
MSSPPSAAR

SEQ ID NO: 52232 - protein, 9 aa, Homo Sapiens
MSTATAFYR

SEQ ID NO: 52233 - protein, 9 aa, Homo Sapiens
MSVAKTILK

SEQ ID NO: 52234 - protein, 9 aa, Homo Sapiens
MSYKGSTLK

SEQ ID NO: 52235 - protein, 9 aa, Homo Sapiens
MSYVVTKTK

SEQ ID NO: 52236 - protein, 9 aa, Homo Sapiens
MTAENLAVK

SEQ ID NO: 52237 - protein, 9 aa, Homo Sapiens
MTCRGFREY

SEQ ID NO: 52238 - protein, 9 aa, Homo Sapiens
MTFDSAKSK

SEQ ID NO: 52239 - protein, 9 aa, Homo Sapiens
MTFGIEPFK

SEQ ID NO: 52240 - protein, 9 aa, Homo Sapiens
MTFLEVTGK

SEQ ID NO: 52241 - protein, 9 aa, Homo Sapiens
MTHNLLLNY

SEQ ID NO: 52242 - protein, 9 aa, Homo Sapiens
MTIAQSLEH

SEQ ID NO: 52243 - protein, 9 aa, Homo Sapiens
MTLCQTQMK

SEQ ID NO: 52244 - protein, 9 aa, Homo Sapiens
MTLHERFTK

SEQ ID NO: 52245 - protein, 9 aa, Homo Sapiens
MTLNPSTKR

SEQ ID NO: 52246 - protein, 9 aa, Homo Sapiens
MTLPLWIGK

SEQ ID NO: 52247 - protein, 9 aa, Homo Sapiens
MTMAAEIKK

SEQ ID NO: 52248 - protein, 9 aa, Homo Sapiens
MTNLPAVGR

SEQ ID NO: 52249 - protein, 9 aa, Homo Sapiens
MTNQNTPEY

SEQ ID NO: 52250 - protein, 9 aa, Homo Sapiens
MTNTPVVVR

SEQ ID NO: 52251 - protein, 9 aa, Homo Sapiens
MTPDQALKH

SEQ ID NO: 52252 - protein, 9 aa, Homo Sapiens
MTSLGSYNK

SEQ ID NO: 52253 - protein, 9 aa, Homo Sapiens
MTSVPVKER

SEQ ID NO: 52254 - protein, 9 aa, Homo Sapiens
MTTNSNISR

SEQ ID NO: 52255 - protein, 9 aa, Homo Sapiens
MTWEKRLAK

SEQ ID NO: 52256 - protein, 9 aa, Homo Sapiens
MVADVFSHR

SEQ ID NO: 52257 - protein, 9 aa, Homo Sapiens
MVAHELSNR

SEQ ID NO: 52258 - protein, 9 aa, Homo Sapiens
MVAPAVQEK

SEQ ID NO: 52259 - protein, 9 aa, Homo Sapiens
MVESPLICK

SEQ ID NO: 52260 - protein, 9 aa, Homo Sapiens
MVFGAPVPK

SEQ ID NO: 52261 - protein, 9 aa, Homo Sapiens
MVGPPGTGK

SEQ ID NO: 52262 - protein, 9 aa, Homo Sapiens
MVISIPIKK

SEQ ID NO: 52263 - protein, 9 aa, Homo Sapiens
MVLAHVTNR

SEQ ID NO: 52264 - protein, 9 aa, Homo Sapiens
MVLCPVIGK

SEQ ID NO: 52265 - protein, 9 aa, Homo Sapiens
MVLKPHFHK

SEQ ID NO: 52266 - protein, 9 aa, Homo Sapiens
MVMVKGVNK

SEQ ID NO: 52267 - protein, 9 aa, Homo Sapiens
MVSDKFQVR

SEQ ID NO: 52268 - protein, 9 aa, Homo Sapiens
MVSGPLALR

SEQ ID NO: 52269 - protein, 9 aa, Homo Sapiens
MVSKGFLGR

SEQ ID NO: 52270 - protein, 9 aa, Homo Sapiens
MVTEIRLKY

SEQ ID NO: 52271 - protein, 9 aa, Homo Sapiens
MVTGQTVCK

SEQ ID NO: 52272 - protein, 9 aa, Homo Sapiens
MVVAKLLEK

SEQ ID NO: 52273 - protein, 9 aa, Homo Sapiens
MVVNSPTNK

SEQ ID NO: 52274 - protein, 9 aa, Homo Sapiens
MVYQKAAMR

SEQ ID NO: 52275 - protein, 9 aa, Homo Sapiens
NAAGDFKLK

SEQ ID NO: 52276 - protein, 9 aa, Homo Sapiens
NAAKNFITK

SEQ ID NO: 52277 - protein, 9 aa, Homo Sapiens
NACHSLITK

SEQ ID NO: 52278 - protein, 9 aa, Homo Sapiens
NACKIQLIK

SEQ ID NO: 52279 - protein, 9 aa, Homo Sapiens
NAFEEQLLK

SEQ ID NO: 52280 - protein, 9 aa, Homo Sapiens
NAGAVLNFK

SEQ ID NO: 52281 - protein, 9 aa, Homo Sapiens
NAGKTTILK

SEQ ID NO: 52282 - protein, 9 aa, Homo Sapiens
NAGVPLAAK

SEQ ID NO: 52283 - protein, 9 aa, Homo Sapiens
NALDVAAEK

SEQ ID NO: 52284 - protein, 9 aa, Homo Sapiens
NAMDSPLLK

SEQ ID NO: 52285 - protein, 9 aa, Homo Sapiens
NGYENPTYK

SEQ ID NO: 52286 - protein, 9 aa, Homo Sapiens
NIAEALVSK

SEQ ID NO: 52287 - protein, 9 aa, Homo Sapiens
NIIKAAPRK

SEQ ID NO: 52288 - protein, 9 aa, Homo Sapiens
NIKNSSVPR

SEQ ID NO: 52289 - protein, 9 aa, Homo Sapiens
NINNPFVFK

SEQ ID NO: 52290 - protein, 9 aa, Homo Sapiens
NINRPLTMK

SEQ ID NO: 52291 - protein, 9 aa, Homo Sapiens
NLFGGTAAK

SEQ ID NO: 52292 - protein, 9 aa, Homo Sapiens
NLLDRFLSK

SEQ ID NO: 52293 - protein, 9 aa, Homo Sapiens
NLLGHYLIH

SEQ ID NO: 52294 - protein, 9 aa, Homo Sapiens
NLLKSLIGK

SEQ ID NO: 52295 - protein, 9 aa, Homo Sapiens
NLVPMVATV

SEQ ID NO: 52296 - protein, 9 aa, Homo Sapiens
NPLSPLSAK

SEQ ID NO: 52297 - protein, 9 aa, Homo Sapiens
NSDSPLLPK

SEQ ID NO: 52298 - protein, 9 aa, Homo Sapiens
NSHIALVGK

SEQ ID NO: 52299 - protein, 9 aa, Homo Sapiens
NSKFGSIPK

SEQ ID NO: 52300 - protein, 9 aa, Homo Sapiens
NSMGLFLQK

SEQ ID NO: 52301 - protein, 9 aa, Homo Sapiens
NSSNVKLFK

SEQ ID NO: 52302 - protein, 9 aa, Homo Sapiens
NSSSVALLH

SEQ ID NO: 52303 - protein, 9 aa, Homo Sapiens
NTALLLSKK

SEQ ID NO: 52304 - protein, 9 aa, Homo Sapiens
NTALPLALR

SEQ ID NO: 52305 - protein, 9 aa, Homo Sapiens
NTATPFCNR

SEQ ID NO: 52306 - protein, 9 aa, Homo Sapiens
NTAVSQLTK

SEQ ID NO: 52307 - protein, 9 aa, Homo Sapiens
NTCNIILIY

SEQ ID NO: 52308 - protein, 9 aa, Homo Sapiens
NTDDPLIFK

SEQ ID NO: 52309 - protein, 9 aa, Homo Sapiens
NTDLSRILK

SEQ ID NO: 52310 - protein, 9 aa, Homo Sapiens
NTFGSFQCR

SEQ ID NO: 52311 - protein, 9 aa, Homo Sapiens
NTIDWVREK

SEQ ID NO: 52312 - protein, 9 aa, Homo Sapiens
NTIEKPILR

SEQ ID NO: 52313 - protein, 9 aa, Homo Sapiens
NTIGGFTCK

SEQ ID NO: 52314 - protein, 9 aa, Homo Sapiens
NTITNFSEK

SEQ ID NO: 52315 - protein, 9 aa, Homo Sapiens
NTITPVVGK

SEQ ID NO: 52316 - protein, 9 aa, Homo Sapiens
NTLNKVLKH

SEQ ID NO: 52317 - protein, 9 aa, Homo Sapiens
NTLRDAAPK

SEQ ID NO: 52318 - protein, 9 aa, Homo Sapiens
NTLTSICEK

SEQ ID NO: 52319 - protein, 9 aa, Homo Sapiens
NTMNITISK

SEQ ID NO: 52320 - protein, 9 aa, Homo Sapiens
NTMNQFVNK

SEQ ID NO: 52321 - protein, 9 aa, Homo Sapiens
NTMQQFLQK

SEQ ID NO: 52322 - protein, 9 aa, Homo Sapiens
NTNGFIIAK

SEQ ID NO: 52323 - protein, 9 aa, Homo Sapiens
NTNIPIGNK

SEQ ID NO: 52324 - protein, 9 aa, Homo Sapiens
NTNTAIELK

SEQ ID NO: 52325 - protein, 9 aa, Homo Sapiens
NTTSAVTVK

SEQ ID NO: 52326 - protein, 9 aa, Homo Sapiens
NTVSNIHPK

SEQ ID NO: 52327 - protein, 9 aa, Homo Sapiens
NTYVYAVEK

SEQ ID NO: 52328 - protein, 9 aa, Homo Sapiens
NVAGSIITK

SEQ ID NO: 52329 - protein, 9 aa, Homo Sapiens
NVALTFLEK

SEQ ID NO: 52330 - protein, 9 aa, Homo Sapiens
NVARYFGKK

SEQ ID NO: 52331 - protein, 9 aa, Homo Sapiens
NVDFTRILK

SEQ ID NO: 52332 - protein, 9 aa, Homo Sapiens
NVGPLIIKK

SEQ ID NO: 52333 - protein, 9 aa, Homo Sapiens
NVHGGTILK

SEQ ID NO: 52334 - protein, 9 aa, Homo Sapiens
NVKGPGLQR

SEQ ID NO: 52335 - protein, 9 aa, Homo Sapiens
NVLDIMVTK

SEQ ID NO: 52336 - protein, 9 aa, Homo Sapiens
NVLEKGFLK

SEQ ID NO: 52337 - protein, 9 aa, Homo Sapiens
NVLELTRTK

SEQ ID NO: 52338 - protein, 9 aa, Homo Sapiens
NVLPAFPPK

SEQ ID NO: 52339 - protein, 9 aa, Homo Sapiens
NVNAAILKK

SEQ ID NO: 52340 - protein, 9 aa, Homo Sapiens
NVTDSVINK

SEQ ID NO: 52341 - protein, 9 aa, Homo Sapiens
NVVDIILAH

SEQ ID NO: 52342 - protein, 9 aa, Homo Sapiens
NVVPTFGKK

SEQ ID NO: 52343 - protein, 9 aa, Homo Sapiens
NVVRNISYK

SEQ ID NO: 52344 - protein, 9 aa, Homo Sapiens
NVYCGVHRY

SEQ ID NO: 52345 - protein, 9 aa, Homo Sapiens
NVYEVVNPK

SEQ ID NO: 52346 - protein, 9 aa, Homo Sapiens
NVYIHPTAK

SEQ ID NO: 52347 - protein, 9 aa, Homo Sapiens
NVYYHITSK

SEQ ID NO: 52348 - protein, 9 aa, Homo Sapiens
PDLTTPLKK

SEQ ID NO: 52349 - protein, 9 aa, Homo Sapiens
PDSPITLQS

SEQ ID NO: 52350 - protein, 9 aa, Homo Sapiens
PEFPLSPPK

SEQ ID NO: 52351 - protein, 9 aa, Homo Sapiens
PRSPGPVLR

SEQ ID NO: 52352 - protein, 9 aa, Homo Sapiens
PTEYDSRVK

SEQ ID NO: 52353 - protein, 9 aa, Homo Sapiens
QAADILLYK

SEQ ID NO: 52354 - protein, 9 aa, Homo Sapiens
QAALASQYR

SEQ ID NO: 52355 - protein, 9 aa, Homo Sapiens
QAKLPGIAK

SEQ ID NO: 52356 - protein, 9 aa, Homo Sapiens
QARPPGIYK

SEQ ID NO: 52357 - protein, 9 aa, Homo Sapiens
QILKPSEKK

SEQ ID NO: 52358 - protein, 9 aa, Homo Sapiens
QIYTYFVYK

SEQ ID NO: 52359 - protein, 9 aa, Homo Sapiens
QLGPVVMCK

SEQ ID NO: 52360 - protein, 9 aa, Homo Sapiens
QLYWSHPRK

SEQ ID NO: 52361 - protein, 9 aa, Homo Sapiens
QNAFSLTQK

SEQ ID NO: 52362 - protein, 9 aa, Homo Sapiens
QPTSLAPEK

SEQ ID NO: 52363 - protein, 9 aa, Homo Sapiens
QSIFPTIPK

SEQ ID NO: 52364 - protein, 9 aa, Homo Sapiens
QSSPSFAEK

SEQ ID NO: 52365 - protein, 9 aa, Homo Sapiens
QTAADAFYK

SEQ ID NO: 52366 - protein, 9 aa, Homo Sapiens
QTAGNVFLK

SEQ ID NO: 52367 - protein, 9 aa, Homo Sapiens
QTAGQFQTR

SEQ ID NO: 52368 - protein, 9 aa, Homo Sapiens
QTAQIFFTK

SEQ ID NO: 52369 - protein, 9 aa, Homo Sapiens
QTASFALKK

SEQ ID NO: 52370 - protein, 9 aa, Homo Sapiens
QTCRLLLSY

SEQ ID NO: 52371 - protein, 9 aa, Homo Sapiens
QTFKGLKTK

SEQ ID NO: 52372 - protein, 9 aa, Homo Sapiens
QTFQPLTQR

SEQ ID NO: 52373 - protein, 9 aa, Homo Sapiens
QTFYKFMKR

SEQ ID NO: 52374 - protein, 9 aa, Homo Sapiens
QTHFQLAYR

SEQ ID NO: 52375 - protein, 9 aa, Homo Sapiens
QTIGNVVYH

SEQ ID NO: 52376 - protein, 9 aa, Homo Sapiens
QTIQGILER

SEQ ID NO: 52377 - protein, 9 aa, Homo Sapiens
QTIQSFTLR

SEQ ID NO: 52378 - protein, 9 aa, Homo Sapiens
QTLDISTNR

SEQ ID NO: 52379 - protein, 9 aa, Homo Sapiens
QTLGSTIDK

SEQ ID NO: 52380 - protein, 9 aa, Homo Sapiens
QTLGVVLKH

SEQ ID NO: 52381 - protein, 9 aa, Homo Sapiens
QTLRPSYWK

SEQ ID NO: 52382 - protein, 9 aa, Homo Sapiens
QTLSPQMWK

SEQ ID NO: 52383 - protein, 9 aa, Homo Sapiens
QTLSTQLWK

SEQ ID NO: 52384 - protein, 9 aa, Homo Sapiens
QTLVRILSH

SEQ ID NO: 52385 - protein, 9 aa, Homo Sapiens
QTMSDTTFK

SEQ ID NO: 52386 - protein, 9 aa, Homo Sapiens
QTMSNSGIK

SEQ ID NO: 52387 - protein, 9 aa, Homo Sapiens
QTNPTYLAK

SEQ ID NO: 52388 - protein, 9 aa, Homo Sapiens
QTRPPASLK

SEQ ID NO: 52389 - protein, 9 aa, Homo Sapiens
QTSEKALLR

SEQ ID NO: 52390 - protein, 9 aa, Homo Sapiens
QTSGSLVSK

SEQ ID NO: 52391 - protein, 9 aa, Homo Sapiens
QTTDALIKK

SEQ ID NO: 52392 - protein, 9 aa, Homo Sapiens
QTYGQQLQK

SEQ ID NO: 52393 - protein, 9 aa, Homo Sapiens
QTYSSILKH

SEQ ID NO: 52394 - protein, 9 aa, Homo Sapiens
QTYVGITEK

SEQ ID NO: 52395 - protein, 9 aa, Homo Sapiens
QTYVSGTLR

SEQ ID NO: 52396 - protein, 9 aa, Homo Sapiens
QVADAFLSK

SEQ ID NO: 52397 - protein, 9 aa, Homo Sapiens
QVADVVVSR

SEQ ID NO: 52398 - protein, 9 aa, Homo Sapiens
QVAERALYY

SEQ ID NO: 52399 - protein, 9 aa, Homo Sapiens
QVAPPVLKR

SEQ ID NO: 52400 - protein, 9 aa, Homo Sapiens
QVFEFTEPK

SEQ ID NO: 52401 - protein, 9 aa, Homo Sapiens
QVFEKSPLR

SEQ ID NO: 52402 - protein, 9 aa, Homo Sapiens
QVFQKSLPK

SEQ ID NO: 52403 - protein, 9 aa, Homo Sapiens
QVFSHLKRL

SEQ ID NO: 52404 - protein, 9 aa, Homo Sapiens
QVIPASEPK

SEQ ID NO: 52405 - protein, 9 aa, Homo Sapiens
QVLEHQVKY

SEQ ID NO: 52406 - protein, 9 aa, Homo Sapiens
QVLKQLAEK

SEQ ID NO: 52407 - protein, 9 aa, Homo Sapiens
QVLQLCLRY

SEQ ID NO: 52408 - protein, 9 aa, Homo Sapiens
QVMFPVNSK

SEQ ID NO: 52409 - protein, 9 aa, Homo Sapiens
QVSNWFGNK

SEQ ID NO: 52410 - protein, 9 aa, Homo Sapiens
QVSNWFKNR

SEQ ID NO: 52411 - protein, 9 aa, Homo Sapiens
QVTSQILQK

SEQ ID NO: 52412 - protein, 9 aa, Homo Sapiens
QVVMPPIPK

SEQ ID NO: 52413 - protein, 9 aa, Homo Sapiens
RPPIFIRRL

SEQ ID NO: 52414 - protein, 9 aa, Homo Sapiens
RPSSAFAPK

SEQ ID NO: 52415 - protein, 9 aa, Homo Sapiens
RTLEPLAKK

SEQ ID NO: 52416 - protein, 9 aa, Homo Sapiens
RTYYSPVYR

SEQ ID NO: 52417 - protein, 9 aa, Homo Sapiens
RVKLPSGSK

SEQ ID NO: 52418 - protein, 9 aa, Homo Sapiens
SAAAALVLK

SEQ ID NO: 52419 - protein, 9 aa, Homo Sapiens
SAAGVSMAK

SEQ ID NO: 52420 - protein, 9 aa, Homo Sapiens
SAAKEFFTK

SEQ ID NO: 52421 - protein, 9 aa, Homo Sapiens
SAALPQSQR

SEQ ID NO: 52422 - protein, 9 aa, Homo Sapiens
SAAPAITCR

SEQ ID NO: 52423 - protein, 9 aa, Homo Sapiens
SAAPPTVGR

SEQ ID NO: 52424 - protein, 9 aa, Homo Sapiens
SAFGQAFSK

SEQ ID NO: 52425 - protein, 9 aa, Homo Sapiens
SAFGVIIEK

SEQ ID NO: 52426 - protein, 9 aa, Homo Sapiens
SAGPPSLRK

SEQ ID NO: 52427 - protein, 9 aa, Homo Sapiens
SALGSSSYK

SEQ ID NO: 52428 - protein, 9 aa, Homo Sapiens
SALHIAIEK

SEQ ID NO: 52429 - protein, 9 aa, Homo Sapiens
SALRPSTSR

SEQ ID NO: 52430 - protein, 9 aa, Homo Sapiens
SALSVAPSK

SEQ ID NO: 52431 - protein, 9 aa, Homo Sapiens
SAMERICEK

SEQ ID NO: 52432 - protein, 9 aa, Homo Sapiens
SANECISVK

SEQ ID NO: 52433 - protein, 9 aa, Homo Sapiens
SAPSSSTPF

SEQ ID NO: 52434 - protein, 9 aa, Homo Sapiens
SATDITLRR

SEQ ID NO: 52435 - protein, 9 aa, Homo Sapiens
SAVRPVIEK

SEQ ID NO: 52436 - protein, 9 aa, Homo Sapiens
SIAAAVAPK

SEQ ID NO: 52437 - protein, 9 aa, Homo Sapiens
SILNWVKFK

SEQ ID NO: 52438 - protein, 9 aa, Homo Sapiens
SILSGGTPK

SEQ ID NO: 52439 - protein, 9 aa, Homo Sapiens
SISGPFGSR

SEQ ID NO: 52440 - protein, 9 aa, Homo Sapiens
SLSPVIAPK

SEQ ID NO: 52441 - protein, 9 aa, Homo Sapiens
SLSSPLNPK

SEQ ID NO: 52442 - protein, 9 aa, Homo Sapiens
SPATPLKAK

SEQ ID NO: 52443 - protein, 9 aa, Homo Sapiens
SSALPTTGR

SEQ ID NO: 52444 - protein, 9 aa, Homo Sapiens
SSAPPLTGK

SEQ ID NO: 52445 - protein, 9 aa, Homo Sapiens
SSFLIKRNK

SEQ ID NO: 52446 - protein, 9 aa, Homo Sapiens
SSFSGLLRK

SEQ ID NO: 52447 - protein, 9 aa, Homo Sapiens
SSGPSTPLK

SEQ ID NO: 52448 - protein, 9 aa, Homo Sapiens
SSLPTQLFK

SEQ ID NO: 52449 - protein, 9 aa, Homo Sapiens
SSLSLFFRK

SEQ ID NO: 52450 - protein, 9 aa, Homo Sapiens
SSLYIILKK

SEQ ID NO: 52451 - protein, 9 aa, Homo Sapiens
SSSGLHPPK

SEQ ID NO: 52452 - protein, 9 aa, Homo Sapiens
SSSPRFLPR

SEQ ID NO: 52453 - protein, 9 aa, Homo Sapiens
SSSSPFKFK

SEQ ID NO: 52454 - protein, 9 aa, Homo Sapiens
SSSSPFSNR

SEQ ID NO: 52455 - protein, 9 aa, Homo Sapiens
SSSSPTFPK

SEQ ID NO: 52456 - protein, 9 aa, Homo Sapiens
SSYPVCVSK

SEQ ID NO: 52457 - protein, 9 aa, Homo Sapiens
STAANFLSR

SEQ ID NO: 52458 - protein, 9 aa, Homo Sapiens
STAAYQPIK

SEQ ID NO: 52459 - protein, 9 aa, Homo Sapiens
STASELSPK

SEQ ID NO: 52460 - protein, 9 aa, Homo Sapiens
STASFSAVK

SEQ ID NO: 52461 - protein, 9 aa, Homo Sapiens
STCLTSGLK

SEQ ID NO: 52462 - protein, 9 aa, Homo Sapiens
STCSPIISK

SEQ ID NO: 52463 - protein, 9 aa, Homo Sapiens
STEPPYSQK

SEQ ID NO: 52464 - protein, 9 aa, Homo Sapiens
STFDTQITK

SEQ ID NO: 52465 - protein, 9 aa, Homo Sapiens
STFFYPKLK

SEQ ID NO: 52466 - protein, 9 aa, Homo Sapiens
STFNQVVLK

SEQ ID NO: 52467 - protein, 9 aa, Homo Sapiens
STFRESFKK

SEQ ID NO: 52468 - protein, 9 aa, Homo Sapiens
STFSAPLNK

SEQ ID NO: 52469 - protein, 9 aa, Homo Sapiens
STFSEIFKK

SEQ ID NO: 52470 - protein, 9 aa, Homo Sapiens
STGPITKPK

SEQ ID NO: 52471 - protein, 9 aa, Homo Sapiens
STHGTFLNK

SEQ ID NO: 52472 - protein, 9 aa, Homo Sapiens
STIEYVIQR

SEQ ID NO: 52473 - protein, 9 aa, Homo Sapiens
STIHGKLQE

SEQ ID NO: 52474 - protein, 9 aa, Homo Sapiens
STLDGVSRK

SEQ ID NO: 52475 - protein, 9 aa, Homo Sapiens
STLGHCVLK

SEQ ID NO: 52476 - protein, 9 aa, Homo Sapiens
STLHHVLQR

SEQ ID NO: 52477 - protein, 9 aa, Homo Sapiens
STLNKLIKR

SEQ ID NO: 52478 - protein, 9 aa, Homo Sapiens
STLNVGVNK

SEQ ID NO: 52479 - protein, 9 aa, Homo Sapiens
STLNVMSGK

SEQ ID NO: 52480 - protein, 9 aa, Homo Sapiens
STLPKPVQK

SEQ ID NO: 52481 - protein, 9 aa, Homo Sapiens
STLPKSLLK

SEQ ID NO: 52482 - protein, 9 aa, Homo Sapiens
STLPPVKSK

SEQ ID NO: 52483 - protein, 9 aa, Homo Sapiens
STLPVTVKK

SEQ ID NO: 52484 - protein, 9 aa, Homo Sapiens
STLSPIAPR

SEQ ID NO: 52485 - protein, 9 aa, Homo Sapiens
STLSTVISK

SEQ ID NO: 52486 - protein, 9 aa, Homo Sapiens
STLTPKIQK

SEQ ID NO: 52487 - protein, 9 aa, Homo Sapiens
STMAIIVNK

SEQ ID NO: 52488 - protein, 9 aa, Homo Sapiens
STMGYMAAK

SEQ ID NO: 52489 - protein, 9 aa, Homo Sapiens
STMGYMMAK

SEQ ID NO: 52490 - protein, 9 aa, Homo Sapiens
STNPFRPQK

SEQ ID NO: 52491 - protein, 9 aa, Homo Sapiens
STRPPSVTR

SEQ ID NO: 52492 - protein, 9 aa, Homo Sapiens
STSCPVVQK

SEQ ID NO: 52493 - protein, 9 aa, Homo Sapiens
STSDSVRLK

SEQ ID NO: 52494 - protein, 9 aa, Homo Sapiens
STSERTLLK

SEQ ID NO: 52495 - protein, 9 aa, Homo Sapiens
STSNSFNLK

SEQ ID NO: 52496 - protein, 9 aa, Homo Sapiens
STSRVRLFY

SEQ ID NO: 52497 - protein, 9 aa, Homo Sapiens
STSVPLGDK

SEQ ID NO: 52498 - protein, 9 aa, Homo Sapiens
STTRLYLRK

SEQ ID NO: 52499 - protein, 9 aa, Homo Sapiens
STVEAFFKK

SEQ ID NO: 52500 - protein, 9 aa, Homo Sapiens
STVEKIAMK

SEQ ID NO: 52501 - protein, 9 aa, Homo Sapiens
STVFGSSGK

SEQ ID NO: 52502 - protein, 9 aa, Homo Sapiens
STVGWASQK

SEQ ID NO: 52503 - protein, 9 aa, Homo Sapiens
STVPPSLRK

SEQ ID NO: 52504 - protein, 9 aa, Homo Sapiens
STWGGALRY

SEQ ID NO: 52505 - protein, 9 aa, Homo Sapiens
STYEKALGY

SEQ ID NO: 52506 - protein, 9 aa, Homo Sapiens
STYFERCLK

SEQ ID NO: 52507 - protein, 9 aa, Homo Sapiens
STYFKKLFK

SEQ ID NO: 52508 - protein, 9 aa, Homo Sapiens
STYKEAFRK

SEQ ID NO: 52509 - protein, 9 aa, Homo Sapiens
SVAKTILKR

SEQ ID NO: 52510 - protein, 9 aa, Homo Sapiens
SVASPFTSK

SEQ ID NO: 52511 - protein, 9 aa, Homo Sapiens
SVDPNQYYK

SEQ ID NO: 52512 - protein, 9 aa, Homo Sapiens
SVDRPIIDR

SEQ ID NO: 52513 - protein, 9 aa, Homo Sapiens
SVEIVPICK

SEQ ID NO: 52514 - protein, 9 aa, Homo Sapiens
SVESIISPK

SEQ ID NO: 52515 - protein, 9 aa, Homo Sapiens
SVETGFAKK

SEQ ID NO: 52516 - protein, 9 aa, Homo Sapiens
SVFGTMPLK

SEQ ID NO: 52517 - protein, 9 aa, Homo Sapiens
SVFNHAIRH

SEQ ID NO: 52518 - protein, 9 aa, Homo Sapiens
SVFQTTDTK

SEQ ID NO: 52519 - protein, 9 aa, Homo Sapiens
SVHWFPVQK

SEQ ID NO: 52520 - protein, 9 aa, Homo Sapiens
SVIDSVTKK

SEQ ID NO: 52521 - protein, 9 aa, Homo Sapiens
SVIPEHPKK

SEQ ID NO: 52522 - protein, 9 aa, Homo Sapiens
SVLDKSLTK

SEQ ID NO: 52523 - protein, 9 aa, Homo Sapiens
SVLDSFLKY

SEQ ID NO: 52524 - protein, 9 aa, Homo Sapiens
SVLDYFSER

SEQ ID NO: 52525 - protein, 9 aa, Homo Sapiens
SVLEIHSQK

SEQ ID NO: 52526 - protein, 9 aa, Homo Sapiens
SVLEKLGER

SEQ ID NO: 52527 - protein, 9 aa, Homo Sapiens
SVLEPGTAK

SEQ ID NO: 52528 - protein, 9 aa, Homo Sapiens
SVLEVVSEK

SEQ ID NO: 52529 - protein, 9 aa, Homo Sapiens
SVLGISTPK

SEQ ID NO: 52530 - protein, 9 aa, Homo Sapiens
SVLGQAMEK

SEQ ID NO: 52531 - protein, 9 aa, Homo Sapiens
SVLLFVTKK

SEQ ID NO: 52532 - protein, 9 aa, Homo Sapiens
SVLNFATNR

SEQ ID NO: 52533 - protein, 9 aa, Homo Sapiens
SVLNLVIVK

SEQ ID NO: 52534 - protein, 9 aa, Homo Sapiens
SVLPFQIYY

SEQ ID NO: 52535 - protein, 9 aa, Homo Sapiens
SVLPWIILH

SEQ ID NO: 52536 - protein, 9 aa, Homo Sapiens
SVLSPLLNK

SEQ ID NO: 52537 - protein, 9 aa, Homo Sapiens
SVMELARLK

SEQ ID NO: 52538 - protein, 9 aa, Homo Sapiens
SVNGKVLSK

SEQ ID NO: 52539 - protein, 9 aa, Homo Sapiens
SVPLPISHK

SEQ ID NO: 52540 - protein, 9 aa, Homo Sapiens
SVSDLAPPR

SEQ ID NO: 52541 - protein, 9 aa, Homo Sapiens
SVSLPSVKK

SEQ ID NO: 52542 - protein, 9 aa, Homo Sapiens
SVSLPVRKK

SEQ ID NO: 52543 - protein, 9 aa, Homo Sapiens
SVSNVVITK

SEQ ID NO: 52544 - protein, 9 aa, Homo Sapiens
SVSTPLIIK

SEQ ID NO: 52545 - protein, 9 aa, Homo Sapiens
SVVGLFLRH

SEQ ID NO: 52546 - protein, 9 aa, Homo Sapiens
SVWDCVIFH

SEQ ID NO: 52547 - protein, 9 aa, Homo Sapiens
SVWHGTLSK

SEQ ID NO: 52548 - protein, 9 aa, Homo Sapiens
SVYGYGVQK

SEQ ID NO: 52549 - protein, 9 aa, Homo Sapiens
SVYSGIRHK

SEQ ID NO: 52550 - protein, 9 aa, Homo Sapiens
SVYVYKVLK

SEQ ID NO: 52551 - protein, 9 aa, Homo Sapiens
TAAADFTAK

SEQ ID NO: 52552 - protein, 9 aa, Homo Sapiens
TAADSFEFK

SEQ ID NO: 52553 - protein, 9 aa, Homo Sapiens
TAAGTLIAK

SEQ ID NO: 52554 - protein, 9 aa, Homo Sapiens
TAAGVGRFK

SEQ ID NO: 52555 - protein, 9 aa, Homo Sapiens
TAAPPSVCR

SEQ ID NO: 52556 - protein, 9 aa, Homo Sapiens
TAASLVCRK

SEQ ID NO: 52557 - protein, 9 aa, Homo Sapiens
TAFGGFLKY

SEQ ID NO: 52558 - protein, 9 aa, Homo Sapiens
TAGSTSIPK

SEQ ID NO: 52559 - protein, 9 aa, Homo Sapiens
TAHHLGLLK

SEQ ID NO: 52560 - protein, 9 aa, Homo Sapiens
TALAPSTMK

SEQ ID NO: 52561 - protein, 9 aa, Homo Sapiens
TAMLPSSQR

SEQ ID NO: 52562 - protein, 9 aa, Homo Sapiens
TAMPPGTAR

SEQ ID NO: 52563 - protein, 9 aa, Homo Sapiens
TASSSILAK

SEQ ID NO: 52564 - protein, 9 aa, Homo Sapiens
TIFGKIIRK

SEQ ID NO: 52565 - protein, 9 aa, Homo Sapiens
TIKEGSQLK

SEQ ID NO: 52566 - protein, 9 aa, Homo Sapiens
TIPKSLSEK

SEQ ID NO: 52567 - protein, 9 aa, Homo Sapiens
TISPPLQPK

SEQ ID NO: 52568 - protein, 9 aa, Homo Sapiens
TIVDPFSSK

SEQ ID NO: 52569 - protein, 9 aa, Homo Sapiens
TLCKPLVPR

SEQ ID NO: 52570 - protein, 9 aa, Homo Sapiens
TLSPSEGVR

SEQ ID NO: 52571 - protein, 9 aa, Homo Sapiens
TMCPHILRY

SEQ ID NO: 52572 - protein, 9 aa, Homo Sapiens
TNFEGFLAK

SEQ ID NO: 52573 - protein, 9 aa, Homo Sapiens
TNFYGDLRK

SEQ ID NO: 52574 - protein, 9 aa, Homo Sapiens
TPLATLKST

SEQ ID NO: 52575 - protein, 9 aa, Homo Sapiens
TPLTTTAKV

SEQ ID NO: 52576 - protein, 9 aa, Homo Sapiens
TQYEKSLYY

SEQ ID NO: 52577 - protein, 9 aa, Homo Sapiens
TSAIAFLHK

SEQ ID NO: 52578 - protein, 9 aa, Homo Sapiens
TSALPIIQK

SEQ ID NO: 52579 - protein, 9 aa, Homo Sapiens
TSCNVVLNH

SEQ ID NO: 52580 - protein, 9 aa, Homo Sapiens
TSCPVVQKR

SEQ ID NO: 52581 - protein, 9 aa, Homo Sapiens
TSFLTISPK

SEQ ID NO: 52582 - protein, 9 aa, Homo Sapiens
TSFSGITKK

SEQ ID NO: 52583 - protein, 9 aa, Homo Sapiens
TSGLPSSVR

SEQ ID NO: 52584 - protein, 9 aa, Homo Sapiens
TSIQPGAPK

SEQ ID NO: 52585 - protein, 9 aa, Homo Sapiens
TSLPPLPFK

SEQ ID NO: 52586 - protein, 9 aa, Homo Sapiens
TSLPSAICK

SEQ ID NO: 52587 - protein, 9 aa, Homo Sapiens
TSSDILLCY

SEQ ID NO: 52588 - protein, 9 aa, Homo Sapiens
TSSPSSIPR

SEQ ID NO: 52589 - protein, 9 aa, Homo Sapiens
TSSQPVIAK

SEQ ID NO: 52590 - protein, 9 aa, Homo Sapiens
TSTASTFVK

SEQ ID NO: 52591 - protein, 9 aa, Homo Sapiens
TSTIPFHYK

SEQ ID NO: 52592 - protein, 9 aa, Homo Sapiens
TSYDNVLIK

SEQ ID NO: 52593 - protein, 9 aa, Homo Sapiens
TSYGGTLRR

SEQ ID NO: 52594 - protein, 9 aa, Homo Sapiens
TTAEQQLRH

SEQ ID NO: 52595 - protein, 9 aa, Homo Sapiens
TTAERVLMK

SEQ ID NO: 52596 - protein, 9 aa, Homo Sapiens
TTAPSLSGK

SEQ ID NO: 52597 - protein, 9 aa, Homo Sapiens
TTAPVVSTR

SEQ ID NO: 52598 - protein, 9 aa, Homo Sapiens
TTASVVIIR

SEQ ID NO: 52599 - protein, 9 aa, Homo Sapiens
TTATEFHQR

SEQ ID NO: 52600 - protein, 9 aa, Homo Sapiens
TTCDDILIK

SEQ ID NO: 52601 - protein, 9 aa, Homo Sapiens
TTCPVCLQY

SEQ ID NO: 52602 - protein, 9 aa, Homo Sapiens
TTDCPVPPK

SEQ ID NO: 52603 - protein, 9 aa, Homo Sapiens
TTDDPVIRK

SEQ ID NO: 52604 - protein, 9 aa, Homo Sapiens
TTDKETVLK

SEQ ID NO: 52605 - protein, 9 aa, Homo Sapiens
TTFELSSRK

SEQ ID NO: 52606 - protein, 9 aa, Homo Sapiens
TTFSPNTGK

SEQ ID NO: 52607 - protein, 9 aa, Homo Sapiens
TTFSPSISK

SEQ ID NO: 52608 - protein, 9 aa, Homo Sapiens
TTFTKIVNK

SEQ ID NO: 52609 - protein, 9 aa, Homo Sapiens
TTFVGKAAK

SEQ ID NO: 52610 - protein, 9 aa, Homo Sapiens
TTGEPATPK

SEQ ID NO: 52611 - protein, 9 aa, Homo Sapiens
TTGFALNLK

SEQ ID NO: 52612 - protein, 9 aa, Homo Sapiens
TTHEIMGPK

SEQ ID NO: 52613 - protein, 9 aa, Homo Sapiens
TTISSLSEK

SEQ ID NO: 52614 - protein, 9 aa, Homo Sapiens
TTLDEVELH

SEQ ID NO: 52615 - protein, 9 aa, Homo Sapiens
TTLGHAVLK

SEQ ID NO: 52616 - protein, 9 aa, Homo Sapiens
TTLSSIRSK

SEQ ID NO: 52617 - protein, 9 aa, Homo Sapiens
TTLTKIALR

SEQ ID NO: 52618 - protein, 9 aa, Homo Sapiens
TTLTKLASR

SEQ ID NO: 52619 - protein, 9 aa, Homo Sapiens
TTLVNTNSK

SEQ ID NO: 52620 - protein, 9 aa, Homo Sapiens
TTMQALAEK

SEQ ID NO: 52621 - protein, 9 aa, Homo Sapiens
TTNDIVISK

SEQ ID NO: 52622 - protein, 9 aa, Homo Sapiens
TTPKCFLEK

SEQ ID NO: 52623 - protein, 9 aa, Homo Sapiens
TTQDPLSNK

SEQ ID NO: 52624 - protein, 9 aa, Homo Sapiens
TTSGTVLER

SEQ ID NO: 52625 - protein, 9 aa, Homo Sapiens
TTSNFTFSK

SEQ ID NO: 52626 - protein, 9 aa, Homo Sapiens
TTSNGILSH

SEQ ID NO: 52627 - protein, 9 aa, Homo Sapiens
TTSPMFMEK

SEQ ID NO: 52628 - protein, 9 aa, Homo Sapiens
TTSRRILYK

SEQ ID NO: 52629 - protein, 9 aa, Homo Sapiens
TTSTSFKPR

SEQ ID NO: 52630 - protein, 9 aa, Homo Sapiens
TTSVITIVK

SEQ ID NO: 52631 - protein, 9 aa, Homo Sapiens
TTTATVLAR

SEQ ID NO: 52632 - protein, 9 aa, Homo Sapiens
TTTEHRFFR

SEQ ID NO: 52633 - protein, 9 aa, Homo Sapiens
TTTERILYY

SEQ ID NO: 52634 - protein, 9 aa, Homo Sapiens
TTTEVNMAR

SEQ ID NO: 52635 - protein, 9 aa, Homo Sapiens
TTTGHLIYK

SEQ ID NO: 52636 - protein, 9 aa, Homo Sapiens
TTTGKILLH

SEQ ID NO: 52637 - protein, 9 aa, Homo Sapiens
TTTSLVLER

SEQ ID NO: 52638 - protein, 9 aa, Homo Sapiens
TTVDIFHKK

SEQ ID NO: 52639 - protein, 9 aa, Homo Sapiens
TTVEDLGSK

SEQ ID NO: 52640 - protein, 9 aa, Homo Sapiens
TTVGTLSQR

SEQ ID NO: 52641 - protein, 9 aa, Homo Sapiens
TTVLIKTAK

SEQ ID NO: 52642 - protein, 9 aa, Homo Sapiens
TTVPHVFSK

SEQ ID NO: 52643 - protein, 9 aa, Homo Sapiens
TTVPLVCNK

SEQ ID NO: 52644 - protein, 9 aa, Homo Sapiens
TVAAVFRGR

SEQ ID NO: 52645 - protein, 9 aa, Homo Sapiens
TVAECVLYY

SEQ ID NO: 52646 - protein, 9 aa, Homo Sapiens
TVAHAISER

SEQ ID NO: 52647 - protein, 9 aa, Homo Sapiens
TVAKSIDLK

SEQ ID NO: 52648 - protein, 9 aa, Homo Sapiens
TVAVPLVGK

SEQ ID NO: 52649 - protein, 9 aa, Homo Sapiens
TVCDFRLSY

SEQ ID NO: 52650 - protein, 9 aa, Homo Sapiens
TVCLTLTAK

SEQ ID NO: 52651 - protein, 9 aa, Homo Sapiens
TVCNVKLLH

SEQ ID NO: 52652 - protein, 9 aa, Homo Sapiens
TVDGPREPR

SEQ ID NO: 52653 - protein, 9 aa, Homo Sapiens
TVDLVIGPK

SEQ ID NO: 52654 - protein, 9 aa, Homo Sapiens
TVEEGQRLK

SEQ ID NO: 52655 - protein, 9 aa, Homo Sapiens
TVFENLINK

SEQ ID NO: 52656 - protein, 9 aa, Homo Sapiens
TVHPKFHYK

SEQ ID NO: 52657 - protein, 9 aa, Homo Sapiens
TVIEKLRER

SEQ ID NO: 52658 - protein, 9 aa, Homo Sapiens
TVIFVASQK

SEQ ID NO: 52659 - protein, 9 aa, Homo Sapiens
TVIHFNNPK

SEQ ID NO: 52660 - protein, 9 aa, Homo Sapiens
TVILPIKKK

SEQ ID NO: 52661 - protein, 9 aa, Homo Sapiens
TVISRVIGR

SEQ ID NO: 52662 - protein, 9 aa, Homo Sapiens
TVKEVGLLK

SEQ ID NO: 52663 - protein, 9 aa, Homo Sapiens
TVLAAVLRH

SEQ ID NO: 52664 - protein, 9 aa, Homo Sapiens
TVLEMCMNH

SEQ ID NO: 52665 - protein, 9 aa, Homo Sapiens
TVLPGSPSK

SEQ ID NO: 52666 - protein, 9 aa, Homo Sapiens
TVLRPSLGK

SEQ ID NO: 52667 - protein, 9 aa, Homo Sapiens
TVLSKLTRK

SEQ ID NO: 52668 - protein, 9 aa, Homo Sapiens
TVNSPAIYK

SEQ ID NO: 52669 - protein, 9 aa, Homo Sapiens
TVPRRLGPK

SEQ ID NO: 52670 - protein, 9 aa, Homo Sapiens
TVSDAILRY

SEQ ID NO: 52671 - protein, 9 aa, Homo Sapiens
TVSEPAVIK

SEQ ID NO: 52672 - protein, 9 aa, Homo Sapiens
TVSETFMSK

SEQ ID NO: 52673 - protein, 9 aa, Homo Sapiens
TVSEVKMVK

SEQ ID NO: 52674 - protein, 9 aa, Homo Sapiens
TVTAQILLK

SEQ ID NO: 52675 - protein, 9 aa, Homo Sapiens
TVTELILQH

SEQ ID NO: 52676 - protein, 9 aa, Homo Sapiens
TVTEVLLKY

SEQ ID NO: 52677 - protein, 9 aa, Homo Sapiens
TVTGGFGAK

SEQ ID NO: 52678 - protein, 9 aa, Homo Sapiens
TVVYPATEK

SEQ ID NO: 52679 - protein, 9 aa, Homo Sapiens
TVYECVVEK

SEQ ID NO: 52680 - protein, 9 aa, Homo Sapiens
TVYEEMMAK

SEQ ID NO: 52681 - protein, 9 aa, Homo Sapiens
VAAPSWLHR

SEQ ID NO: 52682 - protein, 9 aa, Homo Sapiens
VISPPTVPK

SEQ ID NO: 52683 - protein, 9 aa, Homo Sapiens
VLGAPVKGK

SEQ ID NO: 52684 - protein, 9 aa, Homo Sapiens
VLSLYASGR

SEQ ID NO: 52685 - protein, 9 aa, Homo Sapiens
VPAQPLGPR

SEQ ID NO: 52686 - protein, 9 aa, Homo Sapiens
VTAPPARNR

SEQ ID NO: 52687 - protein, 9 aa, Homo Sapiens
VTDSPRILK

SEQ ID NO: 52688 - protein, 9 aa, Homo Sapiens
VTLQRAALK

SEQ ID NO: 52689 - protein, 9 aa, Homo Sapiens
VTNQPVTPK

SEQ ID NO: 52690 - protein, 9 aa, Homo Sapiens
VTVSGGTPK

SEQ ID NO: 52691 - protein, 9 aa, Homo Sapiens
VVAPPGAPK

SEQ ID NO: 52692 - protein, 9 aa, Homo Sapiens
VVCEYIVKK

SEQ ID NO: 52693 - protein, 9 aa, Homo Sapiens
VVDYPNSAK

SEQ ID NO: 52694 - protein, 9 aa, Homo Sapiens
VVLYPLVAK

SEQ ID NO: 52695 - protein, 9 aa, Homo Sapiens
VVYAPLSKK

SEQ ID NO: 52696 - protein, 9 aa, Homo Sapiens
WATTPSSQK

SEQ ID NO: 52697 - protein, 9 aa, Homo Sapiens
WIAEPVRQK

SEQ ID NO: 52698 - protein, 9 aa, Homo Sapiens
WPDQPRITK

SEQ ID NO: 52699 - protein, 9 aa, Homo Sapiens
WSDQPRITK

SEQ ID NO: 52700 - protein, 9 aa, Homo Sapiens
WTAEALPAK

SEQ ID NO: 52701 - protein, 9 aa, Homo Sapiens
WTAPPVPPR

SEQ ID NO: 52702 - protein, 9 aa, Homo Sapiens
WTLPGGRQR

SEQ ID NO: 52703 - protein, 9 aa, Homo Sapiens
WTMSSWTMK

SEQ ID NO: 52704 - protein, 9 aa, Homo Sapiens
WTQGRWPKK

SEQ ID NO: 52705 - protein, 9 aa, Homo Sapiens
WVLEKTSKK

SEQ ID NO: 52706 - protein, 9 aa, Homo Sapiens
WVSSQFYNK

SEQ ID NO: 52707 - protein, 9 aa, Homo Sapiens
WVYDEPLLK

SEQ ID NO: 52708 - protein, 9 aa, Homo Sapiens
YAAPPSTRK

SEQ ID NO: 52709 - protein, 9 aa, Homo Sapiens
YAFDEAFVR

SEQ ID NO: 52710 - protein, 9 aa, Homo Sapiens
YAFVTFCTK

SEQ ID NO: 52711 - protein, 9 aa, Homo Sapiens
YAKDIGFIK

SEQ ID NO: 52712 - protein, 9 aa, Homo Sapiens
YALDPSFPR

SEQ ID NO: 52713 - protein, 9 aa, Homo Sapiens
YALETVLNK

SEQ ID NO: 52714 - protein, 9 aa, Homo Sapiens
YALGLVPTR

SEQ ID NO: 52715 - protein, 9 aa, Homo Sapiens
YALPHAILR

SEQ ID NO: 52716 - protein, 9 aa, Homo Sapiens
YALPVGKQK

SEQ ID NO: 52717 - protein, 9 aa, Homo Sapiens
YAYVTERQK

SEQ ID NO: 52718 - protein, 9 aa, Homo Sapiens
YDPRNPVNK

SEQ ID NO: 52719 - protein, 9 aa, Homo Sapiens
YIADPNIAK

SEQ ID NO: 52720 - protein, 9 aa, Homo Sapiens
YIATPRVWK

SEQ ID NO: 52721 - protein, 9 aa, Homo Sapiens
YILSPLSYK

SEQ ID NO: 52722 - protein, 9 aa, Homo Sapiens
YIVPPAPEK

SEQ ID NO: 52723 - protein, 9 aa, Homo Sapiens
YIYEGRLEK

SEQ ID NO: 52724 - protein, 9 aa, Homo Sapiens
YLYITKVLK

SEQ ID NO: 52725 - protein, 9 aa, Homo Sapiens
YNYGFVVEK

SEQ ID NO: 52726 - protein, 9 aa, Homo Sapiens
YNYKTIVKK

SEQ ID NO: 52727 - protein, 9 aa, Homo Sapiens
YPNFRPTPK

SEQ ID NO: 52728 - protein, 9 aa, Homo Sapiens
YPYEQAQYK

SEQ ID NO: 52729 - protein, 9 aa, Homo Sapiens
YSAYLVAEK

SEQ ID NO: 52730 - protein, 9 aa, Homo Sapiens
YSCEFGSAK

SEQ ID NO: 52731 - protein, 9 aa, Homo Sapiens
YSDAPMTPK

SEQ ID NO: 52732 - protein, 9 aa, Homo Sapiens
YSFTTTAER

SEQ ID NO: 52733 - protein, 9 aa, Homo Sapiens
YSLPITVKK

SEQ ID NO: 52734 - protein, 9 aa, Homo Sapiens
YSTEPNNLK

SEQ ID NO: 52735 - protein, 9 aa, Homo Sapiens
YSVFGFSFK

SEQ ID NO: 52736 - protein, 9 aa, Homo Sapiens
YTAEQILKH

SEQ ID NO: 52737 - protein, 9 aa, Homo Sapiens
YTAPPLQSK

SEQ ID NO: 52738 - protein, 9 aa, Homo Sapiens
YTAQPTQGY

SEQ ID NO: 52739 - protein, 9 aa, Homo Sapiens
YTFDWTMLK

SEQ ID NO: 52740 - protein, 9 aa, Homo Sapiens
YTIFIVATK

SEQ ID NO: 52741 - protein, 9 aa, Homo Sapiens
YTITKGPSK

SEQ ID NO: 52742 - protein, 9 aa, Homo Sapiens
YTMKEVLFY

SEQ ID NO: 52743 - protein, 9 aa, Homo Sapiens
YTMKVFAKR

SEQ ID NO: 52744 - protein, 9 aa, Homo Sapiens
YTMPEYLSK

SEQ ID NO: 52745 - protein, 9 aa, Homo Sapiens
YTQPGPGYR

SEQ ID NO: 52746 - protein, 9 aa, Homo Sapiens
YTSDYFISY

SEQ ID NO: 52747 - protein, 9 aa, Homo Sapiens
YTSETYLMK

SEQ ID NO: 52748 - protein, 9 aa, Homo Sapiens
YTSGSFQTR

SEQ ID NO: 52749 - protein, 9 aa, Homo Sapiens
YTSKALITK

SEQ ID NO: 52750 - protein, 9 aa, Homo Sapiens
YTSQIEITK

SEQ ID NO: 52751 - protein, 9 aa, Homo Sapiens
YTTKEIFRK

SEQ ID NO: 52752 - protein, 9 aa, Homo Sapiens
YTTKQVITK

SEQ ID NO: 52753 - protein, 9 aa, Homo Sapiens
YTVEKCIQH

SEQ ID NO: 52754 - protein, 9 aa, Homo Sapiens
YTYDKMKLK

SEQ ID NO: 52755 - protein, 9 aa, Homo Sapiens
YVANVGTNR

SEQ ID NO: 52756 - protein, 9 aa, Homo Sapiens
YVDVVFANR

SEQ ID NO: 52757 - protein, 9 aa, Homo Sapiens
YVFGGQRSK

SEQ ID NO: 52758 - protein, 9 aa, Homo Sapiens
YVIGSCIKH

SEQ ID NO: 52759 - protein, 9 aa, Homo Sapiens
YVIKPGNTK

SEQ ID NO: 52760 - protein, 9 aa, Homo Sapiens
YVIQHVLEH

SEQ ID NO: 52761 - protein, 9 aa, Homo Sapiens
YVKLSVGKK

SEQ ID NO: 52762 - protein, 9 aa, Homo Sapiens
YVMPSSSAR

SEQ ID NO: 52763 - protein, 9 aa, Homo Sapiens
YVNSSDMLK

SEQ ID NO: 52764 - protein, 9 aa, Homo Sapiens
YVPPHALLH

SEQ ID NO: 52765 - protein, 9 aa, Homo Sapiens
YVSPCTHLR

SEQ ID NO: 52766 - protein, 9 aa, Homo Sapiens
YVSVPGSKK

SEQ ID NO: 52767 - protein, 9 aa, Homo Sapiens
YVYCKTHPR

SEQ ID NO: 52768 - protein, 9 aa, Homo Sapiens
YVYFTNELK

SEQ ID NO: 52769 - protein, 10 aa, Homo Sapiens
AIIDHIFASK

SEQ ID NO: 52770 - protein, 10 aa, Homo Sapiens
APAGITLKEA

SEQ ID NO: 52771 - protein, 10 aa, Homo Sapiens
ATALPTGTSK

SEQ ID NO: 52772 - protein, 10 aa, Homo Sapiens
ATGDMSGLLK

SEQ ID NO: 52773 - protein, 10 aa, Homo Sapiens
ATIDGSVNPK

SEQ ID NO: 52774 - protein, 10 aa, Homo Sapiens
AVFPKPFVEK

SEQ ID NO: 52775 - protein, 10 aa, Homo Sapiens
AVISPPTVPK

SEQ ID NO: 52776 - protein, 10 aa, Homo Sapiens
CSAPATLTPR

SEQ ID NO: 52777 - protein, 10 aa, Homo Sapiens
CTADWLPIGR

SEQ ID NO: 52778 - protein, 10 aa, Homo Sapiens
DAAPGGSEKL

SEQ ID NO: 52779 - protein, 10 aa, Homo Sapiens
DAFFTRPFYK

SEQ ID NO: 52780 - protein, 10 aa, Homo Sapiens
DAGDLSQMIK

SEQ ID NO: 52781 - protein, 10 aa, Homo Sapiens
DAITPLISTK

SEQ ID NO: 52782 - protein, 10 aa, Homo Sapiens
DAMEVTSTFK

SEQ ID NO: 52783 - protein, 10 aa, Homo Sapiens
DAVAVTMGPK

SEQ ID NO: 52784 - protein, 10 aa, Homo Sapiens
DIYRPTIHKL

SEQ ID NO: 52785 - protein, 10 aa, Homo Sapiens
DSLPDQLVNK

SEQ ID NO: 52786 - protein, 10 aa, Homo Sapiens
DSTEPPYSQK

SEQ ID NO: 52787 - protein, 10 aa, Homo Sapiens
DSYRSPWSNK

SEQ ID NO: 52788 - protein, 10 aa, Homo Sapiens
DTAGMILGWK

SEQ ID NO: 52789 - protein, 10 aa, Homo Sapiens
DTFFGVKNKK

SEQ ID NO: 52790 - protein, 10 aa, Homo Sapiens
DTFRSTFHSK

SEQ ID NO: 52791 - protein, 10 aa, Homo Sapiens
DTFSGIGKKF

SEQ ID NO: 52792 - protein, 10 aa, Homo Sapiens
DTFSVAFIKK

SEQ ID NO: 52793 - protein, 10 aa, Homo Sapiens
DTFWKNFKSK

SEQ ID NO: 52794 - protein, 10 aa, Homo Sapiens
DTIDERTINK

SEQ ID NO: 52795 - protein, 10 aa, Homo Sapiens
DTIFVPNTGK

SEQ ID NO: 52796 - protein, 10 aa, Homo Sapiens
DTLGQVGAVK

SEQ ID NO: 52797 - protein, 10 aa, Homo Sapiens
DTMRPDSLLK

SEQ ID NO: 52798 - protein, 10 aa, Homo Sapiens
DTNADKQLSF

SEQ ID NO: 52799 - protein, 10 aa, Homo Sapiens
DTNAVIFSQK

SEQ ID NO: 52800 - protein, 10 aa, Homo Sapiens
DTTPFASLLK

SEQ ID NO: 52801 - protein, 10 aa, Homo Sapiens
DTVAQITQRF

SEQ ID NO: 52802 - protein, 10 aa, Homo Sapiens
DTVATLPRGR

SEQ ID NO: 52803 - protein, 10 aa, Homo Sapiens
DTWAGSHSLR

SEQ ID NO: 52804 - protein, 10 aa, Homo Sapiens
DVAEMHNILK

SEQ ID NO: 52805 - protein, 10 aa, Homo Sapiens
DVASVIVTKL

SEQ ID NO: 52806 - protein, 10 aa, Homo Sapiens
DVCGKTFTQK

SEQ ID NO: 52807 - protein, 10 aa, Homo Sapiens
DVFIGGTTGK

SEQ ID NO: 52808 - protein, 10 aa, Homo Sapiens
DVGTLQRLPK

SEQ ID NO: 52809 - protein, 10 aa, Homo Sapiens
DVHNCSYNYK

SEQ ID NO: 52810 - protein, 10 aa, Homo Sapiens
DVIQHETIGK

SEQ ID NO: 52811 - protein, 10 aa, Homo Sapiens
DVLHQIFSKF

SEQ ID NO: 52812 - protein, 10 aa, Homo Sapiens
DVLNPSGTQR

SEQ ID NO: 52813 - protein, 10 aa, Homo Sapiens
DVLSHFAQRL

SEQ ID NO: 52814 - protein, 10 aa, Homo Sapiens
DVMNPSEILK

SEQ ID NO: 52815 - protein, 10 aa, Homo Sapiens
DVMRRLLQPK

SEQ ID NO: 52816 - protein, 10 aa, Homo Sapiens
DVSKPVLTTK

SEQ ID NO: 52817 - protein, 10 aa, Homo Sapiens
DVYPLFLLAP

SEQ ID NO: 52818 - protein, 10 aa, Homo Sapiens
DVYTGMCLQK

SEQ ID NO: 52819 - protein, 10 aa, Homo Sapiens
EAAAALTRMK

SEQ ID NO: 52820 - protein, 10 aa, Homo Sapiens
EAAAISGLQK

SEQ ID NO: 52821 - protein, 10 aa, Homo Sapiens
EAAAVHGARF

SEQ ID NO: 52822 - protein, 10 aa, Homo Sapiens
EAAAVLMARL

SEQ ID NO: 52823 - protein, 10 aa, Homo Sapiens
EAACPGITDK

SEQ ID NO: 52824 - protein, 10 aa, Homo Sapiens
EAADPLASKL

SEQ ID NO: 52825 - protein, 10 aa, Homo Sapiens
EAAERAIEKM

SEQ ID NO: 52826 - protein, 10 aa, Homo Sapiens
EAAGAAPCRL

SEQ ID NO: 52827 - protein, 10 aa, Homo Sapiens
EAAGLIGWLK

SEQ ID NO: 52828 - protein, 10 aa, Homo Sapiens
EAAPPAEVHR

SEQ ID NO: 52829 - protein, 10 aa, Homo Sapiens
EAAVVAVAEK

SEQ ID NO: 52830 - protein, 10 aa, Homo Sapiens
EACGQEITTK

SEQ ID NO: 52831 - protein, 10 aa, Homo Sapiens
EACSIPGIGK

SEQ ID NO: 52832 - protein, 10 aa, Homo Sapiens
EAFKPILSTR

SEQ ID NO: 52833 - protein, 10 aa, Homo Sapiens
EAFPSQGTKR

SEQ ID NO: 52834 - protein, 10 aa, Homo Sapiens
EAFYKKDLAK

SEQ ID NO: 52835 - protein, 10 aa, Homo Sapiens
EAIEGGALQK

SEQ ID NO: 52836 - protein, 10 aa, Homo Sapiens
EAIKKPLTQK

SEQ ID NO: 52837 - protein, 10 aa, Homo Sapiens
EAINITNNEK

SEQ ID NO: 52838 - protein, 10 aa, Homo Sapiens
EALEKLFLQK

SEQ ID NO: 52839 - protein, 10 aa, Homo Sapiens
EALGIVPLQY

SEQ ID NO: 52840 - protein, 10 aa, Homo Sapiens
EALGSCLNNK

SEQ ID NO: 52841 - protein, 10 aa, Homo Sapiens
EALGSGLVSR

SEQ ID NO: 52842 - protein, 10 aa, Homo Sapiens
EALKGGPLMK

SEQ ID NO: 52843 - protein, 10 aa, Homo Sapiens
EALNFLHSKR

SEQ ID NO: 52844 - protein, 10 aa, Homo Sapiens
EALPSAPERL

SEQ ID NO: 52845 - protein, 10 aa, Homo Sapiens
EALRKPFGSK

SEQ ID NO: 52846 - protein, 10 aa, Homo Sapiens
EALSHLMRRF

SEQ ID NO: 52847 - protein, 10 aa, Homo Sapiens
EALYGYCNLK

SEQ ID NO: 52848 - protein, 10 aa, Homo Sapiens
EAMASIINRL

SEQ ID NO: 52849 - protein, 10 aa, Homo Sapiens
EAMEWMNNKL

SEQ ID NO: 52850 - protein, 10 aa, Homo Sapiens
EAMGIKETRK

SEQ ID NO: 52851 - protein, 10 aa, Homo Sapiens
EAMNEIRAKK

SEQ ID NO: 52852 - protein, 10 aa, Homo Sapiens
EAMPPPLLKK

SEQ ID NO: 52853 - protein, 10 aa, Homo Sapiens
EANQAINPKL

SEQ ID NO: 52854 - protein, 10 aa, Homo Sapiens
EAPPPSVVTR

SEQ ID NO: 52855 - protein, 10 aa, Homo Sapiens
EASLPLAVTK

SEQ ID NO: 52856 - protein, 10 aa, Homo Sapiens
EASSVTSMTH

SEQ ID NO: 52857 - protein, 10 aa, Homo Sapiens
EAVFASEVKK

SEQ ID NO: 52858 - protein, 10 aa, Homo Sapiens
EAVKPTVGMK

SEQ ID NO: 52859 - protein, 10 aa, Homo Sapiens
EAYNETFSNR

SEQ ID NO: 52860 - protein, 10 aa, Homo Sapiens
EENLLDFVRF

SEQ ID NO: 52861 - protein, 10 aa, Homo Sapiens
EFNAETFTFH

SEQ ID NO: 52862 - protein, 10 aa, Homo Sapiens
EGCPATLPSK

SEQ ID NO: 52863 - protein, 10 aa, Homo Sapiens
EIAGGTITSK

SEQ ID NO: 52864 - protein, 10 aa, Homo Sapiens
EICGAPGVGK

SEQ ID NO: 52865 - protein, 10 aa, Homo Sapiens
EICGKSFTAK

SEQ ID NO: 52866 - protein, 10 aa, Homo Sapiens
EIEEFKERLR

SEQ ID NO: 52867 - protein, 10 aa, Homo Sapiens
EIFASRQTGK

SEQ ID NO: 52868 - protein, 10 aa, Homo Sapiens
EIFPVSFHVK

SEQ ID NO: 52869 - protein, 10 aa, Homo Sapiens
EIGRPLGKGK

SEQ ID NO: 52870 - protein, 10 aa, Homo Sapiens
EIINRPNTPK

SEQ ID NO: 52871 - protein, 10 aa, Homo Sapiens
EIKKPPVSER

SEQ ID NO: 52872 - protein, 10 aa, Homo Sapiens
EILDYCPSTR

SEQ ID NO: 52873 - protein, 10 aa, Homo Sapiens
EILFSEGLIK

SEQ ID NO: 52874 - protein, 10 aa, Homo Sapiens
EILQKGQIGK

SEQ ID NO: 52875 - protein, 10 aa, Homo Sapiens
EILTRIGSGK

SEQ ID NO: 52876 - protein, 10 aa, Homo Sapiens
EINHRPLLEK

SEQ ID NO: 52877 - protein, 10 aa, Homo Sapiens
EIPASPFRVK

SEQ ID NO: 52878 - protein, 10 aa, Homo Sapiens
EIPQLVPIGK

SEQ ID NO: 52879 - protein, 10 aa, Homo Sapiens
EIPTFQPLLK

SEQ ID NO: 52880 - protein, 10 aa, Homo Sapiens
EISDLNELLK

SEQ ID NO: 52881 - protein, 10 aa, Homo Sapiens
EITSILLKQK

SEQ ID NO: 52882 - protein, 10 aa, Homo Sapiens
EIWKGMSKEK

SEQ ID NO: 52883 - protein, 10 aa, Homo Sapiens
EIYDRREYSR

SEQ ID NO: 52884 - protein, 10 aa, Homo Sapiens
EIYEFHKTLK

SEQ ID NO: 52885 - protein, 10 aa, Homo Sapiens
EIYGGSDSRF

SEQ ID NO: 52886 - protein, 10 aa, Homo Sapiens
EIYNDLPALK

SEQ ID NO: 52887 - protein, 10 aa, Homo Sapiens
EIYSGCTKKM

SEQ ID NO: 52888 - protein, 10 aa, Homo Sapiens
EIYTVGKRFK

SEQ ID NO: 52889 - protein, 10 aa, Homo Sapiens
ELFDKVVGNK

SEQ ID NO: 52890 - protein, 10 aa, Homo Sapiens
ELFQKTGSFK

SEQ ID NO: 52891 - protein, 10 aa, Homo Sapiens
ELFSKLLKTG

SEQ ID NO: 52892 - protein, 10 aa, Homo Sapiens
ELIDYTGGLK

SEQ ID NO: 52893 - protein, 10 aa, Homo Sapiens
ELLDKILRQK

SEQ ID NO: 52894 - protein, 10 aa, Homo Sapiens
ELLDRPLLRK

SEQ ID NO: 52895 - protein, 10 aa, Homo Sapiens
ELLETTETPK

SEQ ID NO: 52896 - protein, 10 aa, Homo Sapiens
ELMDKPLTFR

SEQ ID NO: 52897 - protein, 10 aa, Homo Sapiens
ELMRHQPTLK

SEQ ID NO: 52898 - protein, 10 aa, Homo Sapiens
ELVLPVVLQL

SEQ ID NO: 52899 - protein, 10 aa, Homo Sapiens
EMYVAKFAAK

SEQ ID NO: 52900 - protein, 10 aa, Homo Sapiens
ENWDPTGTKK

SEQ ID NO: 52901 - protein, 10 aa, Homo Sapiens
ESAIAIATGK

SEQ ID NO: 52902 - protein, 10 aa, Homo Sapiens
ESAKRFLEKF

SEQ ID NO: 52903 - protein, 10 aa, Homo Sapiens
ESAQNTKFFK

SEQ ID NO: 52904 - protein, 10 aa, Homo Sapiens
ESARIEDMRK

SEQ ID NO: 52905 - protein, 10 aa, Homo Sapiens
ESCNLPSTTK

SEQ ID NO: 52906 - protein, 10 aa, Homo Sapiens
ESFGPQPISR

SEQ ID NO: 52907 - protein, 10 aa, Homo Sapiens
ESFPGSFRGR

SEQ ID NO: 52908 - protein, 10 aa, Homo Sapiens
ESFSSKYVPK

SEQ ID NO: 52909 - protein, 10 aa, Homo Sapiens
ESIYQRDPLK

SEQ ID NO: 52910 - protein, 10 aa, Homo Sapiens
ESLDLAEFAK

SEQ ID NO: 52911 - protein, 10 aa, Homo Sapiens
ESLENISSVK

SEQ ID NO: 52912 - protein, 10 aa, Homo Sapiens
ESLGTFQSTK

SEQ ID NO: 52913 - protein, 10 aa, Homo Sapiens
ESLMPSQVVK

SEQ ID NO: 52914 - protein, 10 aa, Homo Sapiens
ESLPANQQPR

SEQ ID NO: 52915 - protein, 10 aa, Homo Sapiens
ESLRKLCVFK

SEQ ID NO: 52916 - protein, 10 aa, Homo Sapiens
ESSEQTFMYY

SEQ ID NO: 52917 - protein, 10 aa, Homo Sapiens
ESTPFTAVLK

SEQ ID NO: 52918 - protein, 10 aa, Homo Sapiens
ESYDRTALKL

SEQ ID NO: 52919 - protein, 10 aa, Homo Sapiens
ESYRGTSDWK

SEQ ID NO: 52920 - protein, 10 aa, Homo Sapiens
ESYTQSFQSR

SEQ ID NO: 52921 - protein, 10 aa, Homo Sapiens
ETAAAMLRKH

SEQ ID NO: 52922 - protein, 10 aa, Homo Sapiens
ETAATLTTKH

SEQ ID NO: 52923 - protein, 10 aa, Homo Sapiens
ETADKVLQNK

SEQ ID NO: 52924 - protein, 10 aa, Homo Sapiens
ETADLKSLAK

SEQ ID NO: 52925 - protein, 10 aa, Homo Sapiens
ETAFGYKGLK

SEQ ID NO: 52926 - protein, 10 aa, Homo Sapiens
ETAGSTKYRL

SEQ ID NO: 52927 - protein, 10 aa, Homo Sapiens
ETAGSTSIPK

SEQ ID NO: 52928 - protein, 10 aa, Homo Sapiens
ETAKKLGLRC

SEQ ID NO: 52929 - protein, 10 aa, Homo Sapiens
ETAKSATVKL

SEQ ID NO: 52930 - protein, 10 aa, Homo Sapiens
ETAKTGKFLK

SEQ ID NO: 52931 - protein, 10 aa, Homo Sapiens
ETALNAKAYK

SEQ ID NO: 52932 - protein, 10 aa, Homo Sapiens
ETALNSKAYK

SEQ ID NO: 52933 - protein, 10 aa, Homo Sapiens
ETASKTLSRF

SEQ ID NO: 52934 - protein, 10 aa, Homo Sapiens
ETATPAPVEK

SEQ ID NO: 52935 - protein, 10 aa, Homo Sapiens
ETAWNTGTLR

SEQ ID NO: 52936 - protein, 10 aa, Homo Sapiens
ETCDVHIRKQ

SEQ ID NO: 52937 - protein, 10 aa, Homo Sapiens
ETCLKTQQIK

SEQ ID NO: 52938 - protein, 10 aa, Homo Sapiens
ETCQLAVRRL

SEQ ID NO: 52939 - protein, 10 aa, Homo Sapiens
ETCVPLPWFR

SEQ ID NO: 52940 - protein, 10 aa, Homo Sapiens
ETDDAGNRLR

SEQ ID NO: 52941 - protein, 10 aa, Homo Sapiens
ETDFSTPTPR

SEQ ID NO: 52942 - protein, 10 aa, Homo Sapiens
ETDPAIVINR

SEQ ID NO: 52943 - protein, 10 aa, Homo Sapiens
ETENAGLRLR

SEQ ID NO: 52944 - protein, 10 aa, Homo Sapiens
ETFDFQAMGR

SEQ ID NO: 52945 - protein, 10 aa, Homo Sapiens
ETFDKTILRA

SEQ ID NO: 52946 - protein, 10 aa, Homo Sapiens
ETFDLQLGRF

SEQ ID NO: 52947 - protein, 10 aa, Homo Sapiens
ETFHLATRKF

SEQ ID NO: 52948 - protein, 10 aa, Homo Sapiens
ETFQQKMLRF

SEQ ID NO: 52949 - protein, 10 aa, Homo Sapiens
ETFSGVYKKL

SEQ ID NO: 52950 - protein, 10 aa, Homo Sapiens
ETFSSATKRL

SEQ ID NO: 52951 - protein, 10 aa, Homo Sapiens
ETFSYPDFLR

SEQ ID NO: 52952 - protein, 10 aa, Homo Sapiens
ETFTHHLQRL

SEQ ID NO: 52953 - protein, 10 aa, Homo Sapiens
ETFTPNRVEK

SEQ ID NO: 52954 - protein, 10 aa, Homo Sapiens
ETGDFERTLK

SEQ ID NO: 52955 - protein, 10 aa, Homo Sapiens
ETGYPLAVKL

SEQ ID NO: 52956 - protein, 10 aa, Homo Sapiens
ETHYEKVLKK

SEQ ID NO: 52957 - protein, 10 aa, Homo Sapiens
ETHYQLGLAY

SEQ ID NO: 52958 - protein, 10 aa, Homo Sapiens
ETIAAKQIEK

SEQ ID NO: 52959 - protein, 10 aa, Homo Sapiens
ETIEGMLLRL

SEQ ID NO: 52960 - protein, 10 aa, Homo Sapiens
ETIFTPSSVK

SEQ ID NO: 52961 - protein, 10 aa, Homo Sapiens
ETIGKKFEKR

SEQ ID NO: 52962 - protein, 10 aa, Homo Sapiens
ETIGTGGFAK

SEQ ID NO: 52963 - protein, 10 aa, Homo Sapiens
ETIIPSERKK

SEQ ID NO: 52964 - protein, 10 aa, Homo Sapiens
ETIKDGVSRF

SEQ ID NO: 52965 - protein, 10 aa, Homo Sapiens
ETIMSSSMGK

SEQ ID NO: 52966 - protein, 10 aa, Homo Sapiens
ETIPLTAEKL

SEQ ID NO: 52967 - protein, 10 aa, Homo Sapiens
ETLDHLIKGR

SEQ ID NO: 52968 - protein, 10 aa, Homo Sapiens
ETLDSIALQK

SEQ ID NO: 52969 - protein, 10 aa, Homo Sapiens
ETLEKHLRPK

SEQ ID NO: 52970 - protein, 10 aa, Homo Sapiens
ETLELMLQRW

SEQ ID NO: 52971 - protein, 10 aa, Homo Sapiens
ETLETIINRL

SEQ ID NO: 52972 - protein, 10 aa, Homo Sapiens
ETLFPGINSK

SEQ ID NO: 52973 - protein, 10 aa, Homo Sapiens
ETLFPSKIGV

SEQ ID NO: 52974 - protein, 10 aa, Homo Sapiens
ETLGHCLAHL

SEQ ID NO: 52975 - protein, 10 aa, Homo Sapiens
ETLGPKPAAR

SEQ ID NO: 52976 - protein, 10 aa, Homo Sapiens
ETLGQVVRRL

SEQ ID NO: 52977 - protein, 10 aa, Homo Sapiens
ETLKHSGIGR

SEQ ID NO: 52978 - protein, 10 aa, Homo Sapiens
ETLKRLQSQK

SEQ ID NO: 52979 - protein, 10 aa, Homo Sapiens
ETLLEISKRF

SEQ ID NO: 52980 - protein, 10 aa, Homo Sapiens
ETLNGTMILK

SEQ ID NO: 52981 - protein, 10 aa, Homo Sapiens
ETLPPFPTRL

SEQ ID NO: 52982 - protein, 10 aa, Homo Sapiens
ETLPPVGVNR

SEQ ID NO: 52983 - protein, 10 aa, Homo Sapiens
ETLQEEFSRF

SEQ ID NO: 52984 - protein, 10 aa, Homo Sapiens
ETLQESLARL

SEQ ID NO: 52985 - protein, 10 aa, Homo Sapiens
ETLSSVASKL

SEQ ID NO: 52986 - protein, 10 aa, Homo Sapiens
ETLTRPFSGR

SEQ ID NO: 52987 - protein, 10 aa, Homo Sapiens
ETMASLQSRL

SEQ ID NO: 52988 - protein, 10 aa, Homo Sapiens
ETMGPMGWMK

SEQ ID NO: 52989 - protein, 10 aa, Homo Sapiens
ETNGGQVTYR

SEQ ID NO: 52990 - protein, 10 aa, Homo Sapiens
ETNHTSRPRL

SEQ ID NO: 52991 - protein, 10 aa, Homo Sapiens
ETNPSILEVK

SEQ ID NO: 52992 - protein, 10 aa, Homo Sapiens
ETPDIKLFGK

SEQ ID NO: 52993 - protein, 10 aa, Homo Sapiens
ETPGHTPSLR

SEQ ID NO: 52994 - protein, 10 aa, Homo Sapiens
ETQPGRLLGR

SEQ ID NO: 52995 - protein, 10 aa, Homo Sapiens
ETRGVKDVLK

SEQ ID NO: 52996 - protein, 10 aa, Homo Sapiens
ETSDFLGGLR

SEQ ID NO: 52997 - protein, 10 aa, Homo Sapiens
ETSESLKTKM

SEQ ID NO: 52998 - protein, 10 aa, Homo Sapiens
ETSGISIYRL

SEQ ID NO: 52999 - protein, 10 aa, Homo Sapiens
ETSKMKVLRF

SEQ ID NO: 53000 - protein, 10 aa, Homo Sapiens
ETSLPSFVTK

SEQ ID NO: 53001 - protein, 10 aa, Homo Sapiens
ETSPLTAEKL

SEQ ID NO: 53002 - protein, 10 aa, Homo Sapiens
ETSQAGLFRL

SEQ ID NO: 53003 - protein, 10 aa, Homo Sapiens
ETSQGLVPEK

SEQ ID NO: 53004 - protein, 10 aa, Homo Sapiens
ETSVGYAIFK

SEQ ID NO: 53005 - protein, 10 aa, Homo Sapiens
ETTDSILSHF

SEQ ID NO: 53006 - protein, 10 aa, Homo Sapiens
ETTNLSIQQK

SEQ ID NO: 53007 - protein, 10 aa, Homo Sapiens
ETTPLTIEKL

SEQ ID NO: 53008 - protein, 10 aa, Homo Sapiens
ETTPPLSTER

SEQ ID NO: 53009 - protein, 10 aa, Homo Sapiens
ETTYVSNLTR

SEQ ID NO: 53010 - protein, 10 aa, Homo Sapiens
ETVGILHKVK

SEQ ID NO: 53011 - protein, 10 aa, Homo Sapiens
ETVGSIFSRT

SEQ ID NO: 53012 - protein, 10 aa, Homo Sapiens
ETVGTGIMGK

SEQ ID NO: 53013 - protein, 10 aa, Homo Sapiens
ETVGTGIMGR

SEQ ID NO: 53014 - protein, 10 aa, Homo Sapiens
ETVGVFEVPK

SEQ ID NO: 53015 - protein, 10 aa, Homo Sapiens
ETVGVKINEK

SEQ ID NO: 53016 - protein, 10 aa, Homo Sapiens
ETVKDLAPKC

SEQ ID NO: 53017 - protein, 10 aa, Homo Sapiens
ETVMLHARKL

SEQ ID NO: 53018 - protein, 10 aa, Homo Sapiens
ETVNFSGVKR

SEQ ID NO: 53019 - protein, 10 aa, Homo Sapiens
ETVNVEPLTK

SEQ ID NO: 53020 - protein, 10 aa, Homo Sapiens
ETVPAPSANK

SEQ ID NO: 53021 - protein, 10 aa, Homo Sapiens
ETVQELAIYK

SEQ ID NO: 53022 - protein, 10 aa, Homo Sapiens
ETVRTSEVLR

SEQ ID NO: 53023 - protein, 10 aa, Homo Sapiens
ETVSEASQRL

SEQ ID NO: 53024 - protein, 10 aa, Homo Sapiens
ETVTGGFGAK

SEQ ID NO: 53025 - protein, 10 aa, Homo Sapiens
ETWEERLLRF

SEQ ID NO: 53026 - protein, 10 aa, Homo Sapiens
ETWLSENQRL

SEQ ID NO: 53027 - protein, 10 aa, Homo Sapiens
ETYEALLARF

SEQ ID NO: 53028 - protein, 10 aa, Homo Sapiens
ETYEGSPVSK

SEQ ID NO: 53029 - protein, 10 aa, Homo Sapiens
ETYGAFLQKF

SEQ ID NO: 53030 - protein, 10 aa, Homo Sapiens
ETYHPGAVIR

SEQ ID NO: 53031 - protein, 10 aa, Homo Sapiens
ETYLNENLRK

SEQ ID NO: 53032 - protein, 10 aa, Homo Sapiens
ETYPFNPPKV

SEQ ID NO: 53033 - protein, 10 aa, Homo Sapiens
ETYSQTKPKM

SEQ ID NO: 53034 - protein, 10 aa, Homo Sapiens
EVAAMENVHR

SEQ ID NO: 53035 - protein, 10 aa, Homo Sapiens
EVAASLQQKL

SEQ ID NO: 53036 - protein, 10 aa, Homo Sapiens
EVAEAIQTVK

SEQ ID NO: 53037 - protein, 10 aa, Homo Sapiens
EVAEVVRITK

SEQ ID NO: 53038 - protein, 10 aa, Homo Sapiens
EVAGFVLNRL

SEQ ID NO: 53039 - protein, 10 aa, Homo Sapiens
EVAGIINDAK

SEQ ID NO: 53040 - protein, 10 aa, Homo Sapiens
EVAGRMLGGK

SEQ ID NO: 53041 - protein, 10 aa, Homo Sapiens
EVAGTVTGQK

SEQ ID NO: 53042 - protein, 10 aa, Homo Sapiens
EVAPCMGDRF

SEQ ID NO: 53043 - protein, 10 aa, Homo Sapiens
EVAPPEYHRK

SEQ ID NO: 53044 - protein, 10 aa, Homo Sapiens
EVAPVISSAY

SEQ ID NO: 53045 - protein, 10 aa, Homo Sapiens
EVAQPALEGK

SEQ ID NO: 53046 - protein, 10 aa, Homo Sapiens
EVAQPSEVLR

SEQ ID NO: 53047 - protein, 10 aa, Homo Sapiens
EVAQVESLRY

SEQ ID NO: 53048 - protein, 10 aa, Homo Sapiens
EVARLWGIRK

SEQ ID NO: 53049 - protein, 10 aa, Homo Sapiens
EVAVETTTPK

SEQ ID NO: 53050 - protein, 10 aa, Homo Sapiens
EVAVKLESQK

SEQ ID NO: 53051 - protein, 10 aa, Homo Sapiens
EVCGKGFTQR

SEQ ID NO: 53052 - protein, 10 aa, Homo Sapiens
EVCGQDITTK

SEQ ID NO: 53053 - protein, 10 aa, Homo Sapiens
EVCPLSESRF

SEQ ID NO: 53054 - protein, 10 aa, Homo Sapiens
EVDGASFLLK

SEQ ID NO: 53055 - protein, 10 aa, Homo Sapiens
EVDLNVAAPK

SEQ ID NO: 53056 - protein, 10 aa, Homo Sapiens
EVDNRSPQKF

SEQ ID NO: 53057 - protein, 10 aa, Homo Sapiens
EVDPNTQNPK

SEQ ID NO: 53058 - protein, 10 aa, Homo Sapiens
EVEERFGRFK

SEQ ID NO: 53059 - protein, 10 aa, Homo Sapiens
EVELSARRLR

SEQ ID NO: 53060 - protein, 10 aa, Homo Sapiens
EVEPGVHLGR

SEQ ID NO: 53061 - protein, 10 aa, Homo Sapiens
EVFFGPFGHK

SEQ ID NO: 53062 - protein, 10 aa, Homo Sapiens
EVFFSEKIYK

SEQ ID NO: 53063 - protein, 10 aa, Homo Sapiens
EVFGTADLYR

SEQ ID NO: 53064 - protein, 10 aa, Homo Sapiens
EVFKAFYLGK

SEQ ID NO: 53065 - protein, 10 aa, Homo Sapiens
EVFLAQGTLR

SEQ ID NO: 53066 - protein, 10 aa, Homo Sapiens
EVFNDPKVLK

SEQ ID NO: 53067 - protein, 10 aa, Homo Sapiens
EVFNKFFKER

SEQ ID NO: 53068 - protein, 10 aa, Homo Sapiens
EVFQKPFVEK

SEQ ID NO: 53069 - protein, 10 aa, Homo Sapiens
EVFRTKIVEK

SEQ ID NO: 53070 - protein, 10 aa, Homo Sapiens
EVFSYHQGLK

SEQ ID NO: 53071 - protein, 10 aa, Homo Sapiens
EVFTTLSVTK

SEQ ID NO: 53072 - protein, 10 aa, Homo Sapiens
EVGPEGALGK

SEQ ID NO: 53073 - protein, 10 aa, Homo Sapiens
EVIAEAVGVK

SEQ ID NO: 53074 - protein, 10 aa, Homo Sapiens
EVIEGPQNAR

SEQ ID NO: 53075 - protein, 10 aa, Homo Sapiens
EVIKPWITKR

SEQ ID NO: 53076 - protein, 10 aa, Homo Sapiens
EVILIDPFHK

SEQ ID NO: 53077 - protein, 10 aa, Homo Sapiens
EVININLKNK

SEQ ID NO: 53078 - protein, 10 aa, Homo Sapiens
EVINKLGPRY

SEQ ID NO: 53079 - protein, 10 aa, Homo Sapiens
EVINKNVTEK

SEQ ID NO: 53080 - protein, 10 aa, Homo Sapiens
EVIPKRLQEK

SEQ ID NO: 53081 - protein, 10 aa, Homo Sapiens
EVIQGLLKKF

SEQ ID NO: 53082 - protein, 10 aa, Homo Sapiens
EVIRAYDTTK

SEQ ID NO: 53083 - protein, 10 aa, Homo Sapiens
EVISDLQSKL

SEQ ID NO: 53084 - protein, 10 aa, Homo Sapiens
EVKISSAVLK

SEQ ID NO: 53085 - protein, 10 aa, Homo Sapiens
EVKNAEILRM

SEQ ID NO: 53086 - protein, 10 aa, Homo Sapiens
EVKRPGESLR

SEQ ID NO: 53087 - protein, 10 aa, Homo Sapiens
EVLAEFERRK

SEQ ID NO: 53088 - protein, 10 aa, Homo Sapiens
EVLAGPLAQR

SEQ ID NO: 53089 - protein, 10 aa, Homo Sapiens
EVLDKAQAKF

SEQ ID NO: 53090 - protein, 10 aa, Homo Sapiens
EVLDLKPNGK

SEQ ID NO: 53091 - protein, 10 aa, Homo Sapiens
EVLDPTAANR

SEQ ID NO: 53092 - protein, 10 aa, Homo Sapiens
EVLDYFLRRL

SEQ ID NO: 53093 - protein, 10 aa, Homo Sapiens
EVLEFPMVVK

SEQ ID NO: 53094 - protein, 10 aa, Homo Sapiens
EVLEGFNMAK

SEQ ID NO: 53095 - protein, 10 aa, Homo Sapiens
EVLENLTQGK

SEQ ID NO: 53096 - protein, 10 aa, Homo Sapiens
EVLESFFVQK

SEQ ID NO: 53097 - protein, 10 aa, Homo Sapiens
EVLESTTQTK

SEQ ID NO: 53098 - protein, 10 aa, Homo Sapiens
EVLGAPVKGK

SEQ ID NO: 53099 - protein, 10 aa, Homo Sapiens
EVLGGEFLKY

SEQ ID NO: 53100 - protein, 10 aa, Homo Sapiens
EVLGGINCVK

SEQ ID NO: 53101 - protein, 10 aa, Homo Sapiens
EVLHGPSIMK

SEQ ID NO: 53102 - protein, 10 aa, Homo Sapiens
EVLIDTHLFK

SEQ ID NO: 53103 - protein, 10 aa, Homo Sapiens
EVLKAVDIVK

SEQ ID NO: 53104 - protein, 10 aa, Homo Sapiens
EVLKHLKERF

SEQ ID NO: 53105 - protein, 10 aa, Homo Sapiens
EVLKIMPVQK

SEQ ID NO: 53106 - protein, 10 aa, Homo Sapiens
EVLKNRAIKK

SEQ ID NO: 53107 - protein, 10 aa, Homo Sapiens
EVLKVIRTGK

SEQ ID NO: 53108 - protein, 10 aa, Homo Sapiens
EVLKVLGNPK

SEQ ID NO: 53109 - protein, 10 aa, Homo Sapiens
EVLLKVMDAK

SEQ ID NO: 53110 - protein, 10 aa, Homo Sapiens
EVLNVMDKNK

SEQ ID NO: 53111 - protein, 10 aa, Homo Sapiens
EVLPDHMTMK

SEQ ID NO: 53112 - protein, 10 aa, Homo Sapiens
EVLPSPRGQR

SEQ ID NO: 53113 - protein, 10 aa, Homo Sapiens
EVLQYQLQHL

SEQ ID NO: 53114 - protein, 10 aa, Homo Sapiens
EVLRYVDSSK

SEQ ID NO: 53115 - protein, 10 aa, Homo Sapiens
EVLSEEPILK

SEQ ID NO: 53116 - protein, 10 aa, Homo Sapiens
EVLSKALSQR

SEQ ID NO: 53117 - protein, 10 aa, Homo Sapiens
EVLSQKRMYR

SEQ ID NO: 53118 - protein, 10 aa, Homo Sapiens
EVMGNPGTFK

SEQ ID NO: 53119 - protein, 10 aa, Homo Sapiens
EVNGVCMEGK

SEQ ID NO: 53120 - protein, 10 aa, Homo Sapiens
EVNQETIQRL

SEQ ID NO: 53121 - protein, 10 aa, Homo Sapiens
EVNRPQIHKL

SEQ ID NO: 53122 - protein, 10 aa, Homo Sapiens
EVPAAYQTPK

SEQ ID NO: 53123 - protein, 10 aa, Homo Sapiens
EVPDFLGAPK

SEQ ID NO: 53124 - protein, 10 aa, Homo Sapiens
EVPDHDNWPK

SEQ ID NO: 53125 - protein, 10 aa, Homo Sapiens
EVPEGGLVPK

SEQ ID NO: 53126 - protein, 10 aa, Homo Sapiens
EVPPNQIVGR

SEQ ID NO: 53127 - protein, 10 aa, Homo Sapiens
EVPRSPFKVK

SEQ ID NO: 53128 - protein, 10 aa, Homo Sapiens
EVPTSVFGEK

SEQ ID NO: 53129 - protein, 10 aa, Homo Sapiens
EVRDQKQLLK

SEQ ID NO: 53130 - protein, 10 aa, Homo Sapiens
EVSPITGRSK

SEQ ID NO: 53131 - protein, 10 aa, Homo Sapiens
EVSPMYGVQK

SEQ ID NO: 53132 - protein, 10 aa, Homo Sapiens
EVSPPNLRGR

SEQ ID NO: 53133 - protein, 10 aa, Homo Sapiens
EVSSMVLTKM

SEQ ID NO: 53134 - protein, 10 aa, Homo Sapiens
EVTAGNRLFY

SEQ ID NO: 53135 - protein, 10 aa, Homo Sapiens
EVTGQAFLYH

SEQ ID NO: 53136 - protein, 10 aa, Homo Sapiens
EVTSTFKLMK

SEQ ID NO: 53137 - protein, 10 aa, Homo Sapiens
EVVDVSTMHR

SEQ ID NO: 53138 - protein, 10 aa, Homo Sapiens
EVVGPEGMEK

SEQ ID NO: 53139 - protein, 10 aa, Homo Sapiens
EVVIPQKKGK

SEQ ID NO: 53140 - protein, 10 aa, Homo Sapiens
EVVPSKFKEK

SEQ ID NO: 53141 - protein, 10 aa, Homo Sapiens
EVVSGSGLTR

SEQ ID NO: 53142 - protein, 10 aa, Homo Sapiens
EVVTSMGTQR

SEQ ID NO: 53143 - protein, 10 aa, Homo Sapiens
EVWEGHYTAK

SEQ ID NO: 53144 - protein, 10 aa, Homo Sapiens
EVWERSLKEK

SEQ ID NO: 53145 - protein, 10 aa, Homo Sapiens
EVWNNLGTTK

SEQ ID NO: 53146 - protein, 10 aa, Homo Sapiens
EVWNSEACNK

SEQ ID NO: 53147 - protein, 10 aa, Homo Sapiens
EVWPHSTERK

SEQ ID NO: 53148 - protein, 10 aa, Homo Sapiens
EVYDDFLHYK

SEQ ID NO: 53149 - protein, 10 aa, Homo Sapiens
EVYDGPKNVR

SEQ ID NO: 53150 - protein, 10 aa, Homo Sapiens
EVYDQLFKSR

SEQ ID NO: 53151 - protein, 10 aa, Homo Sapiens
EVYEGVYTNH

SEQ ID NO: 53152 - protein, 10 aa, Homo Sapiens
EVYELRSRGK

SEQ ID NO: 53153 - protein, 10 aa, Homo Sapiens
EVYGARLAAK

SEQ ID NO: 53154 - protein, 10 aa, Homo Sapiens
EVYPGAKLFY

SEQ ID NO: 53155 - protein, 10 aa, Homo Sapiens
EVYRQSLEKL

SEQ ID NO: 53156 - protein, 10 aa, Homo Sapiens
EVYRTQVVEK

SEQ ID NO: 53157 - protein, 10 aa, Homo Sapiens
EVYTCGLNTK

SEQ ID NO: 53158 - protein, 10 aa, Homo Sapiens
FAIQPNTTGK

SEQ ID NO: 53159 - protein, 10 aa, Homo Sapiens
FALGPTISFK

SEQ ID NO: 53160 - protein, 10 aa, Homo Sapiens
FAYGQTASGK

SEQ ID NO: 53161 - protein, 10 aa, Homo Sapiens
FAYGQTGSGK

SEQ ID NO: 53162 - protein, 10 aa, Homo Sapiens
FAYGQTGTGK

SEQ ID NO: 53163 - protein, 10 aa, Homo Sapiens
FIILRASLAQ

SEQ ID NO: 53164 - protein, 10 aa, Homo Sapiens
FSCDGEGVLK

SEQ ID NO: 53165 - protein, 10 aa, Homo Sapiens
FSNVGTAISK

SEQ ID NO: 53166 - protein, 10 aa, Homo Sapiens
FTCGKIVGNK

SEQ ID NO: 53167 - protein, 10 aa, Homo Sapiens
FTETPSPVLK

SEQ ID NO: 53168 - protein, 10 aa, Homo Sapiens
FTFDNVLPGK

SEQ ID NO: 53169 - protein, 10 aa, Homo Sapiens
FTFTAGNALK

SEQ ID NO: 53170 - protein, 10 aa, Homo Sapiens
FTHDQSISQK

SEQ ID NO: 53171 - protein, 10 aa, Homo Sapiens
FTKFPTKTGR

SEQ ID NO: 53172 - protein, 10 aa, Homo Sapiens
FTRNGKIIGK

SEQ ID NO: 53173 - protein, 10 aa, Homo Sapiens
FTSFLDGLKK

SEQ ID NO: 53174 - protein, 10 aa, Homo Sapiens
FTSPFCLQVK

SEQ ID NO: 53175 - protein, 10 aa, Homo Sapiens
FVAPPPKTQR

SEQ ID NO: 53176 - protein, 10 aa, Homo Sapiens
FVDWCPTGFK

SEQ ID NO: 53177 - protein, 10 aa, Homo Sapiens
FVKPPAGVTK

SEQ ID NO: 53178 - protein, 10 aa, Homo Sapiens
FVQENPLSQK

SEQ ID NO: 53179 - protein, 10 aa, Homo Sapiens
FVSPPVLSPK

SEQ ID NO: 53180 - protein, 10 aa, Homo Sapiens
FVYDHVFAEK

SEQ ID NO: 53181 - protein, 10 aa, Homo Sapiens
FVYEPKEQKK

SEQ ID NO: 53182 - protein, 10 aa, Homo Sapiens
FVYKGGKIYK

SEQ ID NO: 53183 - protein, 10 aa, Homo Sapiens
FVYPGNPLRH

SEQ ID NO: 53184 - protein, 10 aa, Homo Sapiens
GPAAAFAGTV

SEQ ID NO: 53185 - protein, 10 aa, Homo Sapiens
GSYNKVFLAK

SEQ ID NO: 53186 - protein, 10 aa, Homo Sapiens
GTYVKPLSNK

SEQ ID NO: 53187 - protein, 10 aa, Homo Sapiens
HAAKTLGIGK

SEQ ID NO: 53188 - protein, 10 aa, Homo Sapiens
HADICTLSEK

SEQ ID NO: 53189 - protein, 10 aa, Homo Sapiens
HILDFSPSLK

SEQ ID NO: 53190 - protein, 10 aa, Homo Sapiens
HIRGPPYAHK

SEQ ID NO: 53191 - protein, 10 aa, Homo Sapiens
HSLQPSISQK

SEQ ID NO: 53192 - protein, 10 aa, Homo Sapiens
HTASPTGMMK

SEQ ID NO: 53193 - protein, 10 aa, Homo Sapiens
HTCSPTNQKL

SEQ ID NO: 53194 - protein, 10 aa, Homo Sapiens
HTDSPCLRVK

SEQ ID NO: 53195 - protein, 10 aa, Homo Sapiens
HTGESLTTKL

SEQ ID NO: 53196 - protein, 10 aa, Homo Sapiens
HTGQFVYCGK

SEQ ID NO: 53197 - protein, 10 aa, Homo Sapiens
HTIAPMGTRR

SEQ ID NO: 53198 - protein, 10 aa, Homo Sapiens
HTISPFMNKF

SEQ ID NO: 53199 - protein, 10 aa, Homo Sapiens
HTISPLDLAK

SEQ ID NO: 53200 - protein, 10 aa, Homo Sapiens
HTKDLPFRCK

SEQ ID NO: 53201 - protein, 10 aa, Homo Sapiens
HTLEPLIPRH

SEQ ID NO: 53202 - protein, 10 aa, Homo Sapiens
HTMGGDFSGK

SEQ ID NO: 53203 - protein, 10 aa, Homo Sapiens
HTMGGDLSGK

SEQ ID NO: 53204 - protein, 10 aa, Homo Sapiens
HTMSSSHLFY

SEQ ID NO: 53205 - protein, 10 aa, Homo Sapiens
HTNVVVPRSK

SEQ ID NO: 53206 - protein, 10 aa, Homo Sapiens
HTRTPPIIHR

SEQ ID NO: 53207 - protein, 10 aa, Homo Sapiens
HTSGSLSSRF

SEQ ID NO: 53208 - protein, 10 aa, Homo Sapiens
HTSSAIPVPK

SEQ ID NO: 53209 - protein, 10 aa, Homo Sapiens
HTVLSKLTRK

SEQ ID NO: 53210 - protein, 10 aa, Homo Sapiens
HTVVPSISKL

SEQ ID NO: 53211 - protein, 10 aa, Homo Sapiens
HTWCSWRSLK

SEQ ID NO: 53212 - protein, 10 aa, Homo Sapiens
HVAESSLSRL

SEQ ID NO: 53213 - protein, 10 aa, Homo Sapiens
HVAHVTITTK

SEQ ID NO: 53214 - protein, 10 aa, Homo Sapiens
HVAQAFPTKL

SEQ ID NO: 53215 - protein, 10 aa, Homo Sapiens
HVCGVHLNRL

SEQ ID NO: 53216 - protein, 10 aa, Homo Sapiens
HVIETLIGKK

SEQ ID NO: 53217 - protein, 10 aa, Homo Sapiens
HVIIGLKTAK

SEQ ID NO: 53218 - protein, 10 aa, Homo Sapiens
HVKEGMDVVK

SEQ ID NO: 53219 - protein, 10 aa, Homo Sapiens
HVLDLVSHPR

SEQ ID NO: 53220 - protein, 10 aa, Homo Sapiens
HVLGTITTDK

SEQ ID NO: 53221 - protein, 10 aa, Homo Sapiens
HVMGFSVTGR

SEQ ID NO: 53222 - protein, 10 aa, Homo Sapiens
HVPGSPFSVK

SEQ ID NO: 53223 - protein, 10 aa, Homo Sapiens
HVTVSGGTPK

SEQ ID NO: 53224 - protein, 10 aa, Homo Sapiens
HVVPGSGVVK

SEQ ID NO: 53225 - protein, 10 aa, Homo Sapiens
HVVTFTFTQK

SEQ ID NO: 53226 - protein, 10 aa, Homo Sapiens
HVYDGKFLAR

SEQ ID NO: 53227 - protein, 10 aa, Homo Sapiens
HVYVGNISKK

SEQ ID NO: 53228 - protein, 10 aa, Homo Sapiens
IAIDTIINQK

SEQ ID NO: 53229 - protein, 10 aa, Homo Sapiens
IALWPPVREK

SEQ ID NO: 53230 - protein, 10 aa, Homo Sapiens
IDISDIAEKR

SEQ ID NO: 53231 - protein, 10 aa, Homo Sapiens
ILYGPPGTGK

SEQ ID NO: 53232 - protein, 10 aa, Homo Sapiens
IPLDPVAGYK

SEQ ID NO: 53233 - protein, 10 aa, Homo Sapiens
IPYDQSPGPK

SEQ ID NO: 53234 - protein, 10 aa, Homo Sapiens
ISFPATGCQK

SEQ ID NO: 53235 - protein, 10 aa, Homo Sapiens
ITALAPSTMK

SEQ ID NO: 53236 - protein, 10 aa, Homo Sapiens
ITFDVAPSRL

SEQ ID NO: 53237 - protein, 10 aa, Homo Sapiens
ITWERIISHF

SEQ ID NO: 53238 - protein, 10 aa, Homo Sapiens
ITYDDRFNLK

SEQ ID NO: 53239 - protein, 10 aa, Homo Sapiens
IVPDIAVGTK

SEQ ID NO: 53240 - protein, 10 aa, Homo Sapiens
LAYGPTGAGK

SEQ ID NO: 53241 - protein, 10 aa, Homo Sapiens
LLYYSRTMAK

SEQ ID NO: 53242 - protein, 10 aa, Homo Sapiens
LPYVAPELLK

SEQ ID NO: 53243 - protein, 10 aa, Homo Sapiens
LSLGVAALYK

SEQ ID NO: 53244 - protein, 10 aa, Homo Sapiens
LTAPSTSARL

SEQ ID NO: 53245 - protein, 10 aa, Homo Sapiens
LTLTPSAVNK

SEQ ID NO: 53246 - protein, 10 aa, Homo Sapiens
LTSSVPTTKK

SEQ ID NO: 53247 - protein, 10 aa, Homo Sapiens
LVAASQAALG

SEQ ID NO: 53248 - protein, 10 aa, Homo Sapiens
LVAEPQKVNK

SEQ ID NO: 53249 - protein, 10 aa, Homo Sapiens
LVIEHIQVNK

SEQ ID NO: 53250 - protein, 10 aa, Homo Sapiens
LVYEYVVERF

SEQ ID NO: 53251 - protein, 10 aa, Homo Sapiens
MAAAAVSSAK

SEQ ID NO: 53252 - protein, 10 aa, Homo Sapiens
MIFDPTMSKK

SEQ ID NO: 53253 - protein, 10 aa, Homo Sapiens
MILTNPVAAK

SEQ ID NO: 53254 - protein, 10 aa, Homo Sapiens
MTAEKFLNRL

SEQ ID NO: 53255 - protein, 10 aa, Homo Sapiens
MTAPSNFLHR

SEQ ID NO: 53256 - protein, 10 aa, Homo Sapiens
MTCGNTKVLR

SEQ ID NO: 53257 - protein, 10 aa, Homo Sapiens
MTDGAQQALR

SEQ ID NO: 53258 - protein, 10 aa, Homo Sapiens
MTEEAAVAIK

SEQ ID NO: 53259 - protein, 10 aa, Homo Sapiens
MTEEAQRLCK

SEQ ID NO: 53260 - protein, 10 aa, Homo Sapiens
MTFGSGGHTK

SEQ ID NO: 53261 - protein, 10 aa, Homo Sapiens
MTGSWDKTLK

SEQ ID NO: 53262 - protein, 10 aa, Homo Sapiens
MTHATKAIYR

SEQ ID NO: 53263 - protein, 10 aa, Homo Sapiens
MTHKAMSIGR

SEQ ID NO: 53264 - protein, 10 aa, Homo Sapiens
MTIEELLTRY

SEQ ID NO: 53265 - protein, 10 aa, Homo Sapiens
MTKDNNLLGK

SEQ ID NO: 53266 - protein, 10 aa, Homo Sapiens
MTKGTSSFGK

SEQ ID NO: 53267 - protein, 10 aa, Homo Sapiens
MTKSGYQPPR

SEQ ID NO: 53268 - protein, 10 aa, Homo Sapiens
MTLNPSTKRK

SEQ ID NO: 53269 - protein, 10 aa, Homo Sapiens
MTMQPYLTTK

SEQ ID NO: 53270 - protein, 10 aa, Homo Sapiens
MTQDAQNALR

SEQ ID NO: 53271 - protein, 10 aa, Homo Sapiens
MTSALPIIQK

SEQ ID NO: 53272 - protein, 10 aa, Homo Sapiens
MTWEKRLAKK

SEQ ID NO: 53273 - protein, 10 aa, Homo Sapiens
MVADVFSHRF

SEQ ID NO: 53274 - protein, 10 aa, Homo Sapiens
MVIKEKSVFK

SEQ ID NO: 53275 - protein, 10 aa, Homo Sapiens
MVVDYPNSAK

SEQ ID NO: 53276 - protein, 10 aa, Homo Sapiens
MVWEGLNVVK

SEQ ID NO: 53277 - protein, 10 aa, Homo Sapiens
NAAIATIKTK

SEQ ID NO: 53278 - protein, 10 aa, Homo Sapiens
NAGEDPGLAR

SEQ ID NO: 53279 - protein, 10 aa, Homo Sapiens
NALWGRTTLK

SEQ ID NO: 53280 - protein, 10 aa, Homo Sapiens
NQMEKIIKEK

SEQ ID NO: 53281 - protein, 10 aa, Homo Sapiens
NSMPHPATGK

SEQ ID NO: 53282 - protein, 10 aa, Homo Sapiens
NSYENVLICK

SEQ ID NO: 53283 - protein, 10 aa, Homo Sapiens
NTADWVLPGK

SEQ ID NO: 53284 - protein, 10 aa, Homo Sapiens
NTFLGTPVQK

SEQ ID NO: 53285 - protein, 10 aa, Homo Sapiens
NTFSVVPSPK

SEQ ID NO: 53286 - protein, 10 aa, Homo Sapiens
NTLQGPVSFK

SEQ ID NO: 53287 - protein, 10 aa, Homo Sapiens
NTVTQVLSRF

SEQ ID NO: 53288 - protein, 10 aa, Homo Sapiens
NVAEFVCKYK

SEQ ID NO: 53289 - protein, 10 aa, Homo Sapiens
NVDDPTGNFR

SEQ ID NO: 53290 - protein, 10 aa, Homo Sapiens
NVGKPLIAKL

SEQ ID NO: 53291 - protein, 10 aa, Homo Sapiens
NVIDWSDVRK

SEQ ID NO: 53292 - protein, 10 aa, Homo Sapiens
NVINYSFPAK

SEQ ID NO: 53293 - protein, 10 aa, Homo Sapiens
NVYPSKPLTK

SEQ ID NO: 53294 - protein, 10 aa, Homo Sapiens
QAAELGGLLK

SEQ ID NO: 53295 - protein, 10 aa, Homo Sapiens
QALEGKYTDL

SEQ ID NO: 53296 - protein, 10 aa, Homo Sapiens
QIFVKTLTGK

SEQ ID NO: 53297 - protein, 10 aa, Homo Sapiens
QIPQLPAPPK

SEQ ID NO: 53298 - protein, 10 aa, Homo Sapiens
QTAAPSPLRL

SEQ ID NO: 53299 - protein, 10 aa, Homo Sapiens
QTCSAHPARF

SEQ ID NO: 53300 - protein, 10 aa, Homo Sapiens
QTFLLQTTKL

SEQ ID NO: 53301 - protein, 10 aa, Homo Sapiens
QTIESINLLK

SEQ ID NO: 53302 - protein, 10 aa, Homo Sapiens
QTINLSFNRF

SEQ ID NO: 53303 - protein, 10 aa, Homo Sapiens
QTISGTGALR

SEQ ID NO: 53304 - protein, 10 aa, Homo Sapiens
QTKPAEAPRL

SEQ ID NO: 53305 - protein, 10 aa, Homo Sapiens
QTLDISTNRL

SEQ ID NO: 53306 - protein, 10 aa, Homo Sapiens
QTLSGAGLLK

SEQ ID NO: 53307 - protein, 10 aa, Homo Sapiens
QTMDMIISKK

SEQ ID NO: 53308 - protein, 10 aa, Homo Sapiens
QTPHRPLILK

SEQ ID NO: 53309 - protein, 10 aa, Homo Sapiens
QTSQPFQVLK

SEQ ID NO: 53310 - protein, 10 aa, Homo Sapiens
QTWAGSHSLK

SEQ ID NO: 53311 - protein, 10 aa, Homo Sapiens
QTWAGSHSMR

SEQ ID NO: 53312 - protein, 10 aa, Homo Sapiens
QTYVGITEKK

SEQ ID NO: 53313 - protein, 10 aa, Homo Sapiens
QVADAFLSKF

SEQ ID NO: 53314 - protein, 10 aa, Homo Sapiens
QVLEGFITRK

SEQ ID NO: 53315 - protein, 10 aa, Homo Sapiens
QVLEHQVKYK

SEQ ID NO: 53316 - protein, 10 aa, Homo Sapiens
QVQEGTKVLK

SEQ ID NO: 53317 - protein, 10 aa, Homo Sapiens
RDLAEQNSGK

SEQ ID NO: 53318 - protein, 10 aa, Homo Sapiens
SAAEEVKTYK

SEQ ID NO: 53319 - protein, 10 aa, Homo Sapiens
SAFDRILSSK

SEQ ID NO: 53320 - protein, 10 aa, Homo Sapiens
SAFGNILSCK

SEQ ID NO: 53321 - protein, 10 aa, Homo Sapiens
SAVGGGYTAK

SEQ ID NO: 53322 - protein, 10 aa, Homo Sapiens
SAVGWAPQRL

SEQ ID NO: 53323 - protein, 10 aa, Homo Sapiens
SIFDGRVVAK

SEQ ID NO: 53324 - protein, 10 aa, Homo Sapiens
SIFGGTDMKK

SEQ ID NO: 53325 - protein, 10 aa, Homo Sapiens
SISGPISTSK

SEQ ID NO: 53326 - protein, 10 aa, Homo Sapiens
SLIFVQCVGF

SEQ ID NO: 53327 - protein, 10 aa, Homo Sapiens
SLPATHIRGK

SEQ ID NO: 53328 - protein, 10 aa, Homo Sapiens
SLPDFPAAAK

SEQ ID NO: 53329 - protein, 10 aa, Homo Sapiens
SSLECIAIPK

SEQ ID NO: 53330 - protein, 10 aa, Homo Sapiens
SSVESIISPK

SEQ ID NO: 53331 - protein, 10 aa, Homo Sapiens
STCDHGIVAK

SEQ ID NO: 53332 - protein, 10 aa, Homo Sapiens
STFDTQITKK

SEQ ID NO: 53333 - protein, 10 aa, Homo Sapiens
STFQQMWISK

SEQ ID NO: 53334 - protein, 10 aa, Homo Sapiens
STFSGGRIPK

SEQ ID NO: 53335 - protein, 10 aa, Homo Sapiens
STGEKGFGYK

SEQ ID NO: 53336 - protein, 10 aa, Homo Sapiens
STIDDTISKF

SEQ ID NO: 53337 - protein, 10 aa, Homo Sapiens
STIEKLAKNK

SEQ ID NO: 53338 - protein, 10 aa, Homo Sapiens
STINTIMGNK

SEQ ID NO: 53339 - protein, 10 aa, Homo Sapiens
STLEHGTSLK

SEQ ID NO: 53340 - protein, 10 aa, Homo Sapiens
STLEVTSLKY

SEQ ID NO: 53341 - protein, 10 aa, Homo Sapiens
STLGLKGSLK

SEQ ID NO: 53342 - protein, 10 aa, Homo Sapiens
STLTKNTPRF

SEQ ID NO: 53343 - protein, 10 aa, Homo Sapiens
STMEGGTLKY

SEQ ID NO: 53344 - protein, 10 aa, Homo Sapiens
STMGYMMAKK

SEQ ID NO: 53345 - protein, 10 aa, Homo Sapiens
STMRPLATAY

SEQ ID NO: 53346 - protein, 10 aa, Homo Sapiens
STNTSLLTSK

SEQ ID NO: 53347 - protein, 10 aa, Homo Sapiens
STWEGIQAGK

SEQ ID NO: 53348 - protein, 10 aa, Homo Sapiens
STWTGPPAMK

SEQ ID NO: 53349 - protein, 10 aa, Homo Sapiens
STYEKALGYF

SEQ ID NO: 53350 - protein, 10 aa, Homo Sapiens
STYISILNQK

SEQ ID NO: 53351 - protein, 10 aa, Homo Sapiens
STYYGSFVTR

SEQ ID NO: 53352 - protein, 10 aa, Homo Sapiens
SVCGKRFSLK

SEQ ID NO: 53353 - protein, 10 aa, Homo Sapiens
SVFDFQKAYK

SEQ ID NO: 53354 - protein, 10 aa, Homo Sapiens
SVHWFPVQKL

SEQ ID NO: 53355 - protein, 10 aa, Homo Sapiens
SVLEATRVNR

SEQ ID NO: 53356 - protein, 10 aa, Homo Sapiens
SVTDVKFAPK

SEQ ID NO: 53357 - protein, 10 aa, Homo Sapiens
SVYDHQGIFK

SEQ ID NO: 53358 - protein, 10 aa, Homo Sapiens
TAAPAYGLPK

SEQ ID NO: 53359 - protein, 10 aa, Homo Sapiens
TAMDVVYALK

SEQ ID NO: 53360 - protein, 10 aa, Homo Sapiens
TATEWSQPRF

SEQ ID NO: 53361 - protein, 10 aa, Homo Sapiens
TAYGGKYSVK

SEQ ID NO: 53362 - protein, 10 aa, Homo Sapiens
TFGIEPFKTK

SEQ ID NO: 53363 - protein, 10 aa, Homo Sapiens
TSFDGSLIQK

SEQ ID NO: 53364 - protein, 10 aa, Homo Sapiens
TSLDSILGSK

SEQ ID NO: 53365 - protein, 10 aa, Homo Sapiens
TSLTASVTNK

SEQ ID NO: 53366 - protein, 10 aa, Homo Sapiens
TSVATYLSSK

SEQ ID NO: 53367 - protein, 10 aa, Homo Sapiens
TTASFAATKF

SEQ ID NO: 53368 - protein, 10 aa, Homo Sapiens
TTISSFPQLK

SEQ ID NO: 53369 - protein, 10 aa, Homo Sapiens
TTKAVVSPPK

SEQ ID NO: 53370 - protein, 10 aa, Homo Sapiens
TTLAFKPIKK

SEQ ID NO: 53371 - protein, 10 aa, Homo Sapiens
TTLCKPLVPR

SEQ ID NO: 53372 - protein, 10 aa, Homo Sapiens
TTLEHQKTFR

SEQ ID NO: 53373 - protein, 10 aa, Homo Sapiens
TTLETALNSK

SEQ ID NO: 53374 - protein, 10 aa, Homo Sapiens
TTNDIVISKL

SEQ ID NO: 53375 - protein, 10 aa, Homo Sapiens
TTSDPPNICK

SEQ ID NO: 53376 - protein, 10 aa, Homo Sapiens
TTTEMMMGRF

SEQ ID NO: 53377 - protein, 10 aa, Homo Sapiens
TTTEVNMARV

SEQ ID NO: 53378 - protein, 10 aa, Homo Sapiens
TTTQITKTVK

SEQ ID NO: 53379 - protein, 10 aa, Homo Sapiens
TTVAVSAVSK

SEQ ID NO: 53380 - protein, 10 aa, Homo Sapiens
TTVGTLSQRI

SEQ ID NO: 53381 - protein, 10 aa, Homo Sapiens
TTVPRRLGPK

SEQ ID NO: 53382 - protein, 10 aa, Homo Sapiens
TTYEYIIKDK

SEQ ID NO: 53383 - protein, 10 aa, Homo Sapiens
TVAEISQFLK

SEQ ID NO: 53384 - protein, 10 aa, Homo Sapiens
TVATPSSGLK

SEQ ID NO: 53385 - protein, 10 aa, Homo Sapiens
TVAVPLVGKL

SEQ ID NO: 53386 - protein, 10 aa, Homo Sapiens
TVFEHTFHVR

SEQ ID NO: 53387 - protein, 10 aa, Homo Sapiens
TVISGPGTGK

SEQ ID NO: 53388 - protein, 10 aa, Homo Sapiens
TVLCQPTGGK

SEQ ID NO: 53389 - protein, 10 aa, Homo Sapiens
TVLGGVLGQK

SEQ ID NO: 53390 - protein, 10 aa, Homo Sapiens
TVLTHTPAPR

SEQ ID NO: 53391 - protein, 10 aa, Homo Sapiens
TVSAPTTTLK

SEQ ID NO: 53392 - protein, 10 aa, Homo Sapiens
TVSPALISRF

SEQ ID NO: 53393 - protein, 10 aa, Homo Sapiens
TVYRNPESFK

SEQ ID NO: 53394 - protein, 10 aa, Homo Sapiens
VEDNEKDLVK

SEQ ID NO: 53395 - protein, 10 aa, Homo Sapiens
VGKDPGLAGR

SEQ ID NO: 53396 - protein, 10 aa, Homo Sapiens
VTFGSIFGYK

SEQ ID NO: 53397 - protein, 10 aa, Homo Sapiens
VTHRPPLSPK

SEQ ID NO: 53398 - protein, 10 aa, Homo Sapiens
VTYNGVDNNK

SEQ ID NO: 53399 - protein, 10 aa, Homo Sapiens
VYPNFRPTPK

SEQ ID NO: 53400 - protein, 10 aa, Homo Sapiens
WTANMERIMK

SEQ ID NO: 53401 - protein, 10 aa, Homo Sapiens
WTHDGKGMFY

SEQ ID NO: 53402 - protein, 10 aa, Homo Sapiens
WTLSNLCRNK

SEQ ID NO: 53403 - protein, 10 aa, Homo Sapiens
WTYDPKIRLK

SEQ ID NO: 53404 - protein, 10 aa, Homo Sapiens
YAFGSVGKEK

SEQ ID NO: 53405 - protein, 10 aa, Homo Sapiens
YAFMGTPVQK

SEQ ID NO: 53406 - protein, 10 aa, Homo Sapiens
YALPHAILRL

SEQ ID NO: 53407 - protein, 10 aa, Homo Sapiens
YIYDGELVSK

SEQ ID NO: 53408 - protein, 10 aa, Homo Sapiens
YSAPRTETAK

SEQ ID NO: 53409 - protein, 10 aa, Homo Sapiens
YSCNISGSLK

SEQ ID NO: 53410 - protein, 10 aa, Homo Sapiens
YSHAGLSNRL

SEQ ID NO: 53411 - protein, 10 aa, Homo Sapiens
YTAATNNPRF

SEQ ID NO: 53412 - protein, 10 aa, Homo Sapiens
YTAEGKYIFK

SEQ ID NO: 53413 - protein, 10 aa, Homo Sapiens
YTAEQVAAVK

SEQ ID NO: 53414 - protein, 10 aa, Homo Sapiens
YTFYSISQER

SEQ ID NO: 53415 - protein, 10 aa, Homo Sapiens
YTKDAMPINK

SEQ ID NO: 53416 - protein, 10 aa, Homo Sapiens
YTLDPDTLRK

SEQ ID NO: 53417 - protein, 10 aa, Homo Sapiens
YTLDVTTGQR

SEQ ID NO: 53418 - protein, 10 aa, Homo Sapiens
YTPDVAFGSK

SEQ ID NO: 53419 - protein, 10 aa, Homo Sapiens
YVADLGDILK

SEQ ID NO: 53420 - protein, 10 aa, Homo Sapiens
YVCSHPPSLK

SEQ ID NO: 53421 - protein, 10 aa, Homo Sapiens
YVKSTKLVLK

SEQ ID NO: 53422 - protein, 10 aa, Homo Sapiens
YVYPDKTRPR

SEQ ID NO: 53423 - protein, 11 aa, Homo Sapiens
AVADKVHLMYK

SEQ ID NO: 53424 - protein, 11 aa, Homo Sapiens
AVFPSLLTNPK

SEQ ID NO: 53425 - protein, 11 aa, Homo Sapiens
AVVDVRIGMTR

SEQ ID NO: 53426 - protein, 11 aa, Homo Sapiens
AVYGQKEIHRK

SEQ ID NO: 53427 - protein, 11 aa, Homo Sapiens
CVYEPDRNALR

SEQ ID NO: 53428 - protein, 11 aa, Homo Sapiens
DAAGKTTILYK

SEQ ID NO: 53429 - protein, 11 aa, Homo Sapiens
DAAHPTNVQRL

SEQ ID NO: 53430 - protein, 11 aa, Homo Sapiens
DAIRGGLPKLK

SEQ ID NO: 53431 - protein, 11 aa, Homo Sapiens
DANGNSFATRI

SEQ ID NO: 53432 - protein, 11 aa, Homo Sapiens
DAYRQGHFTYK

SEQ ID NO: 53433 - protein, 11 aa, Homo Sapiens
DIFDPSRNMAK

SEQ ID NO: 53434 - protein, 11 aa, Homo Sapiens
DSYASGEGLKR

SEQ ID NO: 53435 - protein, 11 aa, Homo Sapiens
DTAGKTTILYK

SEQ ID NO: 53436 - protein, 11 aa, Homo Sapiens
DTIDERAINKK

SEQ ID NO: 53437 - protein, 11 aa, Homo Sapiens
DTIDERTINKK

SEQ ID NO: 53438 - protein, 11 aa, Homo Sapiens
DTISNKKVLPK

SEQ ID NO: 53439 - protein, 11 aa, Homo Sapiens
DTWAGSHSLRY

SEQ ID NO: 53440 - protein, 11 aa, Homo Sapiens
DTYEPNYGTVK

SEQ ID NO: 53441 - protein, 11 aa, Homo Sapiens
DVYFPQISSVK

SEQ ID NO: 53442 - protein, 11 aa, Homo Sapiens
DVYIPREPHTK

SEQ ID NO: 53443 - protein, 11 aa, Homo Sapiens
EAAFFEGHFLK

SEQ ID NO: 53444 - protein, 11 aa, Homo Sapiens
EAAGEAVKTLK

SEQ ID NO: 53445 - protein, 11 aa, Homo Sapiens
EAAPGALGQVK

SEQ ID NO: 53446 - protein, 11 aa, Homo Sapiens
EAAPHDIGYVK

SEQ ID NO: 53447 - protein, 11 aa, Homo Sapiens
EAAVAIKAMAK

SEQ ID NO: 53448 - protein, 11 aa, Homo Sapiens
EACWGTSSQKL

SEQ ID NO: 53449 - protein, 11 aa, Homo Sapiens
EAFENIYPILK

SEQ ID NO: 53450 - protein, 11 aa, Homo Sapiens
EAFNQKHALQK

SEQ ID NO: 53451 - protein, 11 aa, Homo Sapiens
EAFSTPQQLEK

SEQ ID NO: 53452 - protein, 11 aa, Homo Sapiens
EAICSSTKLLK

SEQ ID NO: 53453 - protein, 11 aa, Homo Sapiens
EALCKKIIKEK

SEQ ID NO: 53454 - protein, 11 aa, Homo Sapiens
EALHQKNIVHR

SEQ ID NO: 53455 - protein, 11 aa, Homo Sapiens
EALPNSQKAVK

SEQ ID NO: 53456 - protein, 11 aa, Homo Sapiens
EALQPALQCLK

SEQ ID NO: 53457 - protein, 11 aa, Homo Sapiens
EALSELATAVK

SEQ ID NO: 53458 - protein, 11 aa, Homo Sapiens
EALSNERICQK

SEQ ID NO: 53459 - protein, 11 aa, Homo Sapiens
EAMDQYSIALR

SEQ ID NO: 53460 - protein, 11 aa, Homo Sapiens
EAMYNQGFIRK

SEQ ID NO: 53461 - protein, 11 aa, Homo Sapiens
EASPALPGLKL

SEQ ID NO: 53462 - protein, 11 aa, Homo Sapiens
EAVKPTVGMKR

SEQ ID NO: 53463 - protein, 11 aa, Homo Sapiens
EAWRYMGGFAK

SEQ ID NO: 53464 - protein, 11 aa, Homo Sapiens
EAYEVLSDAKK

SEQ ID NO: 53465 - protein, 11 aa, Homo Sapiens
EAYEVLSDKHK

SEQ ID NO: 53466 - protein, 11 aa, Homo Sapiens
EAYRAIISDLK

SEQ ID NO: 53467 - protein, 11 aa, Homo Sapiens
EGAPATMTPKL

SEQ ID NO: 53468 - protein, 11 aa, Homo Sapiens
EIAAAVSFISK

SEQ ID NO: 53469 - protein, 11 aa, Homo Sapiens
EIADTMVQIFK

SEQ ID NO: 53470 - protein, 11 aa, Homo Sapiens
EIASFDKAKLK

SEQ ID NO: 53471 - protein, 11 aa, Homo Sapiens
EIFEVDVEIAK

SEQ ID NO: 53472 - protein, 11 aa, Homo Sapiens
EILSASKMLSK

SEQ ID NO: 53473 - protein, 11 aa, Homo Sapiens
EIMRAGMSSLK

SEQ ID NO: 53474 - protein, 11 aa, Homo Sapiens
EISAAVERARK

SEQ ID NO: 53475 - protein, 11 aa, Homo Sapiens
EISDRLIGIYK

SEQ ID NO: 53476 - protein, 11 aa, Homo Sapiens
EIYADLKKKYK

SEQ ID NO: 53477 - protein, 11 aa, Homo Sapiens
EIYDPRNPVNK

SEQ ID NO: 53478 - protein, 11 aa, Homo Sapiens
EIYEKDEKIQK

SEQ ID NO: 53479 - protein, 11 aa, Homo Sapiens
EIYFVGPNAKK

SEQ ID NO: 53480 - protein, 11 aa, Homo Sapiens
EIYSFSESLRK

SEQ ID NO: 53481 - protein, 11 aa, Homo Sapiens
EIYSGDGSVFK

SEQ ID NO: 53482 - protein, 11 aa, Homo Sapiens
ELDPDAPIRQK

SEQ ID NO: 53483 - protein, 11 aa, Homo Sapiens
ELFPAEAQRQK

SEQ ID NO: 53484 - protein, 11 aa, Homo Sapiens
ELINEKLIRTK

SEQ ID NO: 53485 - protein, 11 aa, Homo Sapiens
ELLPTDGMIRK

SEQ ID NO: 53486 - protein, 11 aa, Homo Sapiens
ELYSVDQELLK

SEQ ID NO: 53487 - protein, 11 aa, Homo Sapiens
ESFASDPILYR

SEQ ID NO: 53488 - protein, 11 aa, Homo Sapiens
ESFPELMTAAK

SEQ ID NO: 53489 - protein, 11 aa, Homo Sapiens
ESIESGKTVNK

SEQ ID NO: 53490 - protein, 11 aa, Homo Sapiens
ESLDFTDYASR

SEQ ID NO: 53491 - protein, 11 aa, Homo Sapiens
ESLIADKSGSK

SEQ ID NO: 53492 - protein, 11 aa, Homo Sapiens
ESLPANTPLRK

SEQ ID NO: 53493 - protein, 11 aa, Homo Sapiens
ESLPATHIRGK

SEQ ID NO: 53494 - protein, 11 aa, Homo Sapiens
ESLQQVRQQLK

SEQ ID NO: 53495 - protein, 11 aa, Homo Sapiens
ESQPGNAVIDK

SEQ ID NO: 53496 - protein, 11 aa, Homo Sapiens
ESRPGEWLVRK

SEQ ID NO: 53497 - protein, 11 aa, Homo Sapiens
ESYGEGCIALR

SEQ ID NO: 53498 - protein, 11 aa, Homo Sapiens
ESYTPSKISVR

SEQ ID NO: 53499 - protein, 11 aa, Homo Sapiens
ETADKVLQNKL

SEQ ID NO: 53500 - protein, 11 aa, Homo Sapiens
ETDAHGSFCFK

SEQ ID NO: 53501 - protein, 11 aa, Homo Sapiens
ETDASSAVKVK

SEQ ID NO: 53502 - protein, 11 aa, Homo Sapiens
ETDPSLVFSRK

SEQ ID NO: 53503 - protein, 11 aa, Homo Sapiens
ETFGSSQLPDK

SEQ ID NO: 53504 - protein, 11 aa, Homo Sapiens
ETFGVSGRFLR

SEQ ID NO: 53505 - protein, 11 aa, Homo Sapiens
ETFLPNDCLLY

SEQ ID NO: 53506 - protein, 11 aa, Homo Sapiens
ETFMSKPSIAK

SEQ ID NO: 53507 - protein, 11 aa, Homo Sapiens
ETFRSSDPATR

SEQ ID NO: 53508 - protein, 11 aa, Homo Sapiens
ETIFTPSSVKK

SEQ ID NO: 53509 - protein, 11 aa, Homo Sapiens
ETIHADSVAKR

SEQ ID NO: 53510 - protein, 11 aa, Homo Sapiens
ETIHLENEGLK

SEQ ID NO: 53511 - protein, 11 aa, Homo Sapiens
ETILIIRRLHK

SEQ ID NO: 53512 - protein, 11 aa, Homo Sapiens
ETIPDGIGKLK

SEQ ID NO: 53513 - protein, 11 aa, Homo Sapiens
ETISSKNIISR

SEQ ID NO: 53514 - protein, 11 aa, Homo Sapiens
ETKSGVAPQKM

SEQ ID NO: 53515 - protein, 11 aa, Homo Sapiens
ETLGERLAKQK

SEQ ID NO: 53516 - protein, 11 aa, Homo Sapiens
ETLKSLGALKK

SEQ ID NO: 53517 - protein, 11 aa, Homo Sapiens
ETLLEISKRFR

SEQ ID NO: 53518 - protein, 11 aa, Homo Sapiens
ETLNSKMLKEK

SEQ ID NO: 53519 - protein, 11 aa, Homo Sapiens
ETLNSSVQSIR

SEQ ID NO: 53520 - protein, 11 aa, Homo Sapiens
ETLPEQLLAEK

SEQ ID NO: 53521 - protein, 11 aa, Homo Sapiens
ETLSRIVNQPS

SEQ ID NO: 53522 - protein, 11 aa, Homo Sapiens
ETLSTLEYAHR

SEQ ID NO: 53523 - protein, 11 aa, Homo Sapiens
ETMLGGPQYVK

SEQ ID NO: 53524 - protein, 11 aa, Homo Sapiens
ETMPTKETTKL

SEQ ID NO: 53525 - protein, 11 aa, Homo Sapiens
ETNDSYHIILK

SEQ ID NO: 53526 - protein, 11 aa, Homo Sapiens
ETPSSSSVVKK

SEQ ID NO: 53527 - protein, 11 aa, Homo Sapiens
ETQGSSSPVLK

SEQ ID NO: 53528 - protein, 11 aa, Homo Sapiens
ETRGVKDVLKK

SEQ ID NO: 53529 - protein, 11 aa, Homo Sapiens
ETSYENSLLVK

SEQ ID NO: 53530 - protein, 11 aa, Homo Sapiens
ETTPSLACANK

SEQ ID NO: 53531 - protein, 11 aa, Homo Sapiens
ETVATVMPMKI

SEQ ID NO: 53532 - protein, 11 aa, Homo Sapiens
ETVAVSPTICR

SEQ ID NO: 53533 - protein, 11 aa, Homo Sapiens
ETVESKEKTLK

SEQ ID NO: 53534 - protein, 11 aa, Homo Sapiens
ETVFPKAKQVK

SEQ ID NO: 53535 - protein, 11 aa, Homo Sapiens
ETVQKETIHPR

SEQ ID NO: 53536 - protein, 11 aa, Homo Sapiens
ETVRYSICTSK

SEQ ID NO: 53537 - protein, 11 aa, Homo Sapiens
ETVTGGFGAKK

SEQ ID NO: 53538 - protein, 11 aa, Homo Sapiens
ETYEEIYKSTK

SEQ ID NO: 53539 - protein, 11 aa, Homo Sapiens
ETYLEAHRIVK

SEQ ID NO: 53540 - protein, 11 aa, Homo Sapiens
ETYRGGMAINR

SEQ ID NO: 53541 - protein, 11 aa, Homo Sapiens
ETYSQAKDLAK

SEQ ID NO: 53542 - protein, 11 aa, Homo Sapiens
EVAKAFMPRGL

SEQ ID NO: 53543 - protein, 11 aa, Homo Sapiens
EVCDASAIVAK

SEQ ID NO: 53544 - protein, 11 aa, Homo Sapiens
EVCSENISTLK

SEQ ID NO: 53545 - protein, 11 aa, Homo Sapiens
EVDDGTSVLLK

SEQ ID NO: 53546 - protein, 11 aa, Homo Sapiens
EVDPGSAELQK

SEQ ID NO: 53547 - protein, 11 aa, Homo Sapiens
EVFFSEKIYKL

SEQ ID NO: 53548 - protein, 11 aa, Homo Sapiens
EVFGAEGFHEK

SEQ ID NO: 53549 - protein, 11 aa, Homo Sapiens
EVGPVLSKSSP

SEQ ID NO: 53550 - protein, 11 aa, Homo Sapiens
EVIAEAVGVKK

SEQ ID NO: 53551 - protein, 11 aa, Homo Sapiens
EVIALDKIFNK

SEQ ID NO: 53552 - protein, 11 aa, Homo Sapiens
EVIAQLENAAK

SEQ ID NO: 53553 - protein, 11 aa, Homo Sapiens
EVIDQRLIEAR

SEQ ID NO: 53554 - protein, 11 aa, Homo Sapiens
EVIGILKAEKM

SEQ ID NO: 53555 - protein, 11 aa, Homo Sapiens
EVIPPYYSYLK

SEQ ID NO: 53556 - protein, 11 aa, Homo Sapiens
EVIPVTSTTNK

SEQ ID NO: 53557 - protein, 11 aa, Homo Sapiens
EVIQESGTKLK

SEQ ID NO: 53558 - protein, 11 aa, Homo Sapiens
EVIQLQGDQRK

SEQ ID NO: 53559 - protein, 11 aa, Homo Sapiens
EVISLSQVTPK

SEQ ID NO: 53560 - protein, 11 aa, Homo Sapiens
EVISTPGVVAR

SEQ ID NO: 53561 - protein, 11 aa, Homo Sapiens
EVKPPDRPSSK

SEQ ID NO: 53562 - protein, 11 aa, Homo Sapiens
EVLEQSAQTLR

SEQ ID NO: 53563 - protein, 11 aa, Homo Sapiens
EVLESFFVQKL

SEQ ID NO: 53564 - protein, 11 aa, Homo Sapiens
EVLHGPSIMKK

SEQ ID NO: 53565 - protein, 11 aa, Homo Sapiens
EVLHIGSAHNR

SEQ ID NO: 53566 - protein, 11 aa, Homo Sapiens
EVLNDPENMEK

SEQ ID NO: 53567 - protein, 11 aa, Homo Sapiens
EVLTAEQILQH

SEQ ID NO: 53568 - protein, 11 aa, Homo Sapiens
EVLTSKCLHGK

SEQ ID NO: 53569 - protein, 11 aa, Homo Sapiens
EVMNLDDILKK

SEQ ID NO: 53570 - protein, 11 aa, Homo Sapiens
EVMPGPIGLPR

SEQ ID NO: 53571 - protein, 11 aa, Homo Sapiens
EVMQWSQSLEK

SEQ ID NO: 53572 - protein, 11 aa, Homo Sapiens
EVPAKTTHVLK

SEQ ID NO: 53573 - protein, 11 aa, Homo Sapiens
EVPHISQPCQK

SEQ ID NO: 53574 - protein, 11 aa, Homo Sapiens
EVPTAYMISPK

SEQ ID NO: 53575 - protein, 11 aa, Homo Sapiens
EVQDSGQTIPK

SEQ ID NO: 53576 - protein, 11 aa, Homo Sapiens
EVQPNGKIFKK

SEQ ID NO: 53577 - protein, 11 aa, Homo Sapiens
EVRSYSDPPLK

SEQ ID NO: 53578 - protein, 11 aa, Homo Sapiens
EVVDHVFPLLK

SEQ ID NO: 53579 - protein, 11 aa, Homo Sapiens
EVVEFLKNPQK

SEQ ID NO: 53580 - protein, 11 aa, Homo Sapiens
EVVKNTENFLK

SEQ ID NO: 53581 - protein, 11 aa, Homo Sapiens
EVWTDWNNMSK

SEQ ID NO: 53582 - protein, 11 aa, Homo Sapiens
EVYDPTTNAWR

SEQ ID NO: 53583 - protein, 11 aa, Homo Sapiens
EVYHNLKNVIK

SEQ ID NO: 53584 - protein, 11 aa, Homo Sapiens
EVYNDSGYLSK

SEQ ID NO: 53585 - protein, 11 aa, Homo Sapiens
FSFSPGAGAFR

SEQ ID NO: 53586 - protein, 11 aa, Homo Sapiens
FSYSFSYKHLK

SEQ ID NO: 53587 - protein, 11 aa, Homo Sapiens
FTLEASEGCYR

SEQ ID NO: 53588 - protein, 11 aa, Homo Sapiens
FVIDSDHLGHR

SEQ ID NO: 53589 - protein, 11 aa, Homo Sapiens
FVIDSGKVKEK

SEQ ID NO: 53590 - protein, 11 aa, Homo Sapiens
GLDENQAKGSL

SEQ ID NO: 53591 - protein, 11 aa, Homo Sapiens
GTPGPSITGVP

SEQ ID NO: 53592 - protein, 11 aa, Homo Sapiens
HSIDGRVVEPK

SEQ ID NO: 53593 - protein, 11 aa, Homo Sapiens
HSMDTLLATLK

SEQ ID NO: 53594 - protein, 11 aa, Homo Sapiens
HTAVVPLDLVK

SEQ ID NO: 53595 - protein, 11 aa, Homo Sapiens
HTEEDFKGRFK

SEQ ID NO: 53596 - protein, 11 aa, Homo Sapiens
HTFSHPPSSTK

SEQ ID NO: 53597 - protein, 11 aa, Homo Sapiens
HTLDSYRILQK

SEQ ID NO: 53598 - protein, 11 aa, Homo Sapiens
HTVDSLSRLTK

SEQ ID NO: 53599 - protein, 11 aa, Homo Sapiens
HVDSHGHNVFK

SEQ ID NO: 53600 - protein, 11 aa, Homo Sapiens
HVYDGKFLARV

SEQ ID NO: 53601 - protein, 11 aa, Homo Sapiens
IIYDPKLQTPK

SEQ ID NO: 53602 - protein, 11 aa, Homo Sapiens
IPYGDQRLKPK

SEQ ID NO: 53603 - protein, 11 aa, Homo Sapiens
ITDGPRKDLVK

SEQ ID NO: 53604 - protein, 11 aa, Homo Sapiens
ITVDGNICTGK

SEQ ID NO: 53605 - protein, 11 aa, Homo Sapiens
ITYDTPFKREK

SEQ ID NO: 53606 - protein, 11 aa, Homo Sapiens
KLVAASQAALG

SEQ ID NO: 53607 - protein, 11 aa, Homo Sapiens
LAYEQVAKALK

SEQ ID NO: 53608 - protein, 11 aa, Homo Sapiens
LAYFPYFITYK

SEQ ID NO: 53609 - protein, 11 aa, Homo Sapiens
LQQCPFEDHVK

SEQ ID NO: 53610 - protein, 11 aa, Homo Sapiens
LSESSVTLSPV

SEQ ID NO: 53611 - protein, 11 aa, Homo Sapiens
LTIQSGEQPYK

SEQ ID NO: 53612 - protein, 11 aa, Homo Sapiens
MAAAGAAVARS

SEQ ID NO: 53613 - protein, 11 aa, Homo Sapiens
MALTGGIGFIH

SEQ ID NO: 53614 - protein, 11 aa, Homo Sapiens
MPVGPDAILRY

SEQ ID NO: 53615 - protein, 11 aa, Homo Sapiens
MSGAQIKIANP

SEQ ID NO: 53616 - protein, 11 aa, Homo Sapiens
MTAAATATVLK

SEQ ID NO: 53617 - protein, 11 aa, Homo Sapiens
MTADSRSQVQR

SEQ ID NO: 53618 - protein, 11 aa, Homo Sapiens
MTFGIEPFKTK

SEQ ID NO: 53619 - protein, 11 aa, Homo Sapiens
MTIGTDSALHR

SEQ ID NO: 53620 - protein, 11 aa, Homo Sapiens
MTINDDSATCK

SEQ ID NO: 53621 - protein, 11 aa, Homo Sapiens
MTMDKSELVQK

SEQ ID NO: 53622 - protein, 11 aa, Homo Sapiens
MTMSGERECLK

SEQ ID NO: 53623 - protein, 11 aa, Homo Sapiens
MTRFSAENIFK

SEQ ID NO: 53624 - protein, 11 aa, Homo Sapiens
MTVEPGFGGQK

SEQ ID NO: 53625 - protein, 11 aa, Homo Sapiens
MTYGGLASPKL

SEQ ID NO: 53626 - protein, 11 aa, Homo Sapiens
MVADVFSHRFY

SEQ ID NO: 53627 - protein, 11 aa, Homo Sapiens
MVASGSELGKK

SEQ ID NO: 53628 - protein, 11 aa, Homo Sapiens
MVTGDHPITAK

SEQ ID NO: 53629 - protein, 11 aa, Homo Sapiens
NSFDPSKITRK

SEQ ID NO: 53630 - protein, 11 aa, Homo Sapiens
NTFFSETGAGK

SEQ ID NO: 53631 - protein, 11 aa, Homo Sapiens
NVIESKAYVGR

SEQ ID NO: 53632 - protein, 11 aa, Homo Sapiens
NVLPGEFYITR

SEQ ID NO: 53633 - protein, 11 aa, Homo Sapiens
NVYPNFRPTPK

SEQ ID NO: 53634 - protein, 11 aa, Homo Sapiens
QAYEVLSDAKK

SEQ ID NO: 53635 - protein, 11 aa, Homo Sapiens
QTIAEDLVVTK

SEQ ID NO: 53636 - protein, 11 aa, Homo Sapiens
QVLNADAIVVK

SEQ ID NO: 53637 - protein, 11 aa, Homo Sapiens
QVPSVEKLSMN

SEQ ID NO: 53638 - protein, 11 aa, Homo Sapiens
RWAAAAAAFEK

SEQ ID NO: 53639 - protein, 11 aa, Homo Sapiens
SAIDSVNATSK

SEQ ID NO: 53640 - protein, 11 aa, Homo Sapiens
SALTDKAIVKK

SEQ ID NO: 53641 - protein, 11 aa, Homo Sapiens
SSADAILGNPK

SEQ ID NO: 53642 - protein, 11 aa, Homo Sapiens
SSLPKKLALLK

SEQ ID NO: 53643 - protein, 11 aa, Homo Sapiens
SSVSFADDFVR

SEQ ID NO: 53644 - protein, 11 aa, Homo Sapiens
STDISAVLGTK

SEQ ID NO: 53645 - protein, 11 aa, Homo Sapiens
STIAILNSVKK

SEQ ID NO: 53646 - protein, 11 aa, Homo Sapiens
STIPPELVKQK

SEQ ID NO: 53647 - protein, 11 aa, Homo Sapiens
STLESVSTSKK

SEQ ID NO: 53648 - protein, 11 aa, Homo Sapiens
STSEPLSSKMY

SEQ ID NO: 53649 - protein, 11 aa, Homo Sapiens
STVGAGAYAYK

SEQ ID NO: 53650 - protein, 11 aa, Homo Sapiens
STYPPEIVVPK

SEQ ID NO: 53651 - protein, 11 aa, Homo Sapiens
STYRKGEGVFK

SEQ ID NO: 53652 - protein, 11 aa, Homo Sapiens
SVMPKKSILKK

SEQ ID NO: 53653 - protein, 11 aa, Homo Sapiens
SVPEFPLSPPK

SEQ ID NO: 53654 - protein, 11 aa, Homo Sapiens
SVREPMQTGIK

SEQ ID NO: 53655 - protein, 11 aa, Homo Sapiens
SVYSPESNVRK

SEQ ID NO: 53656 - protein, 11 aa, Homo Sapiens
SVYSPESSVRK

SEQ ID NO: 53657 - protein, 11 aa, Homo Sapiens
SVYYNEATGGK

SEQ ID NO: 53658 - protein, 11 aa, Homo Sapiens
TELSVRAKPSA

SEQ ID NO: 53659 - protein, 11 aa, Homo Sapiens
TTAASELMSQK

SEQ ID NO: 53660 - protein, 11 aa, Homo Sapiens
TTAGAVTQCYR

SEQ ID NO: 53661 - protein, 11 aa, Homo Sapiens
TTTEVNMARVY

SEQ ID NO: 53662 - protein, 11 aa, Homo Sapiens
TTYDHVTREKL

SEQ ID NO: 53663 - protein, 11 aa, Homo Sapiens
TVFDAKRLIGR

SEQ ID NO: 53664 - protein, 11 aa, Homo Sapiens
TVKDELTESPK

SEQ ID NO: 53665 - protein, 11 aa, Homo Sapiens
TVMELVKIIYK

SEQ ID NO: 53666 - protein, 11 aa, Homo Sapiens
TVYGDVDLSNK

SEQ ID NO: 53667 - protein, 11 aa, Homo Sapiens
VAVAGVVLAKG

SEQ ID NO: 53668 - protein, 11 aa, Homo Sapiens
VAVSSLSAVIK

SEQ ID NO: 53669 - protein, 11 aa, Homo Sapiens
WTLDPTSLSTR

SEQ ID NO: 53670 - protein, 11 aa, Homo Sapiens
YASVEVSKLKR

SEQ ID NO: 53671 - protein, 11 aa, Homo Sapiens
YTINLDLPPYK

SEQ ID NO: 53672 - protein, 11 aa, Homo Sapiens
YTLDPDTLRKK

SEQ ID NO: 53673 - protein, 11 aa, Homo Sapiens
YTLDVTTGQRK

SEQ ID NO: 53674 - protein, 11 aa, Homo Sapiens
YTLGVHVNQAK

SEQ ID NO: 53675 - protein, 11 aa, Homo Sapiens
YTYDHLGDSPK

SEQ ID NO: 53676 - protein, 11 aa, Homo Sapiens
YTYTSKALITK

SEQ ID NO: 53677 - protein, 11 aa, Homo Sapiens
YVIDSGKMKEK

SEQ ID NO: 53678 - protein, 8 aa, Homo Sapiens
ADKVHLMY

SEQ ID NO: 53679 - protein, 8 aa, Homo Sapiens
ADMGHLKY

SEQ ID NO: 53680 - protein, 8 aa, Homo Sapiens
AIDNPLHY

SEQ ID NO: 53681 - protein, 8 aa, Homo Sapiens
AIYGVDTR

SEQ ID NO: 53682 - protein, 8 aa, Homo Sapiens
ASDAAMYY

SEQ ID NO: 53683 - protein, 8 aa, Homo Sapiens
ASLHVEEK

SEQ ID NO: 53684 - protein, 8 aa, Homo Sapiens
ATGYPLAF

SEQ ID NO: 53685 - protein, 8 aa, Homo Sapiens
ATQEAFMK

SEQ ID NO: 53686 - protein, 8 aa, Homo Sapiens
AVVTADLR

SEQ ID NO: 53687 - protein, 8 aa, Homo Sapiens
DGIVSHLK

SEQ ID NO: 53688 - protein, 8 aa, Homo Sapiens
DHGSVPII

SEQ ID NO: 53689 - protein, 8 aa, Homo Sapiens
DHNIIPGL

SEQ ID NO: 53690 - protein, 8 aa, Homo Sapiens
DPHGFISY

SEQ ID NO: 53691 - protein, 8 aa, Homo Sapiens
DPSVLGKY

SEQ ID NO: 53692 - protein, 8 aa, Homo Sapiens
DPTSGQLY

SEQ ID NO: 53693 - protein, 8 aa, Homo Sapiens
DTNADKQL

SEQ ID NO: 53694 - protein, 8 aa, Homo Sapiens
EGSISSHL

SEQ ID NO: 53695 - protein, 8 aa, Homo Sapiens
FNEKSKEL

SEQ ID NO: 53696 - protein, 8 aa, Homo Sapiens
FQIGSPWR

SEQ ID NO: 53697 - protein, 8 aa, Homo Sapiens
GLDQPLLK

SEQ ID NO: 53698 - protein, 8 aa, Homo Sapiens
HSDIAQRY

SEQ ID NO: 53699 - protein, 8 aa, Homo Sapiens
HTDLAIEY

SEQ ID NO: 53700 - protein, 8 aa, Homo Sapiens
IAVEQLAY

SEQ ID NO: 53701 - protein, 8 aa, Homo Sapiens
IDGKTLKY

SEQ ID NO: 53702 - protein, 8 aa, Homo Sapiens
IDRHVSRY

SEQ ID NO: 53703 - protein, 8 aa, Homo Sapiens
IINTFHQY

SEQ ID NO: 53704 - protein, 8 aa, Homo Sapiens
ISDEASRY

SEQ ID NO: 53705 - protein, 8 aa, Homo Sapiens
ISDLAQHY

SEQ ID NO: 53706 - protein, 8 aa, Homo Sapiens
ITDIHIKY

SEQ ID NO: 53707 - protein, 8 aa, Homo Sapiens
ITDIVNKY

SEQ ID NO: 53708 - protein, 8 aa, Homo Sapiens
ITDKELLK

SEQ ID NO: 53709 - protein, 8 aa, Homo Sapiens
IVDEAIYY

SEQ ID NO: 53710 - protein, 8 aa, Homo Sapiens
IVLEDGTK

SEQ ID NO: 53711 - protein, 8 aa, Homo Sapiens
KADIPAKY

SEQ ID NO: 53712 - protein, 8 aa, Homo Sapiens
KADKSLSY

SEQ ID NO: 53713 - protein, 8 aa, Homo Sapiens
KADVILKY

SEQ ID NO: 53714 - protein, 8 aa, Homo Sapiens
KMDIAVSY

SEQ ID NO: 53715 - protein, 8 aa, Homo Sapiens
KMDVPSKY

SEQ ID NO: 53716 - protein, 8 aa, Homo Sapiens
KSDVEINY

SEQ ID NO: 53717 - protein, 8 aa, Homo Sapiens
KSDVMMKY

SEQ ID NO: 53718 - protein, 8 aa, Homo Sapiens
KTDDPQLK

SEQ ID NO: 53719 - protein, 8 aa, Homo Sapiens
KTDEGIAY

SEQ ID NO: 53720 - protein, 8 aa, Homo Sapiens
KVDLSEKY

SEQ ID NO: 53721 - protein, 8 aa, Homo Sapiens
LLDEPFLQ

SEQ ID NO: 53722 - protein, 8 aa, Homo Sapiens
LNNMRSQY

SEQ ID NO: 53723 - protein, 8 aa, Homo Sapiens
LSDIGLEY

SEQ ID NO: 53724 - protein, 8 aa, Homo Sapiens
LTDEGLLY

SEQ ID NO: 53725 - protein, 8 aa, Homo Sapiens
LTDEQLLY

SEQ ID NO: 53726 - protein, 8 aa, Homo Sapiens
LTDFIQKY

SEQ ID NO: 53727 - protein, 8 aa, Homo Sapiens
LTDQAIFY

SEQ ID NO: 53728 - protein, 8 aa, Homo Sapiens
LVDDPLEY

SEQ ID NO: 53729 - protein, 8 aa, Homo Sapiens
LVSLEMGK

SEQ ID NO: 53730 - protein, 8 aa, Homo Sapiens
MSDVNLKY

SEQ ID NO: 53731 - protein, 8 aa, Homo Sapiens
NTDSPLRY

SEQ ID NO: 53732 - protein, 8 aa, Homo Sapiens
PEAGLLLY

SEQ ID NO: 53733 - protein, 8 aa, Homo Sapiens
PEFAKLLY

SEQ ID NO: 53734 - protein, 8 aa, Homo Sapiens
PILTELKN

SEQ ID NO: 53735 - protein, 8 aa, Homo Sapiens
PLRQPLLK

SEQ ID NO: 53736 - protein, 8 aa, Homo Sapiens
QILVGVNK

SEQ ID NO: 53737 - protein, 8 aa, Homo Sapiens
QTDINLPY

SEQ ID NO: 53738 - protein, 8 aa, Homo Sapiens
RAKFKQLL

SEQ ID NO: 53739 - protein, 8 aa, Homo Sapiens
RIDGNLDY

SEQ ID NO: 53740 - protein, 8 aa, Homo Sapiens
RIDKPILK

SEQ ID NO: 53741 - protein, 8 aa, Homo Sapiens
RLDGSMSY

SEQ ID NO: 53742 - protein, 8 aa, Homo Sapiens
RLDQPQMY

SEQ ID NO: 53743 - protein, 8 aa, Homo Sapiens
RSDKPLLV

SEQ ID NO: 53744 - protein, 8 aa, Homo Sapiens
RSDTPLIY

SEQ ID NO: 53745 - protein, 8 aa, Homo Sapiens
RTDHPALY

SEQ ID NO: 53746 - protein, 8 aa, Homo Sapiens
RTDLCLLY

SEQ ID NO: 53747 - protein, 8 aa, Homo Sapiens
RTDTNVLY

SEQ ID NO: 53748 - protein, 8 aa, Homo Sapiens
RVDSPMAY

SEQ ID NO: 53749 - protein, 8 aa, Homo Sapiens
SAVLDELK

SEQ ID NO: 53750 - protein, 8 aa, Homo Sapiens
SDVVTAVR

SEQ ID NO: 53751 - protein, 8 aa, Homo Sapiens
SLDLDVNV

SEQ ID NO: 53752 - protein, 8 aa, Homo Sapiens
STDKQMGY

SEQ ID NO: 53753 - protein, 8 aa, Homo Sapiens
STGDVNVE

SEQ ID NO: 53754 - protein, 8 aa, Homo Sapiens
TDGHVHLY

SEQ ID NO: 53755 - protein, 8 aa, Homo Sapiens
TEVHPAKY

SEQ ID NO: 53756 - protein, 8 aa, Homo Sapiens
TIDIGVKY

SEQ ID NO: 53757 - protein, 8 aa, Homo Sapiens
TITLYGKS

SEQ ID NO: 53758 - protein, 8 aa, Homo Sapiens
TSDKPLMY

SEQ ID NO: 53759 - protein, 8 aa, Homo Sapiens
TTDNANIL

SEQ ID NO: 53760 - protein, 8 aa, Homo Sapiens
VADMALHY

SEQ ID NO: 53761 - protein, 8 aa, Homo Sapiens
VCDKPLLY

SEQ ID NO: 53762 - protein, 8 aa, Homo Sapiens
VDAGKLHY

SEQ ID NO: 53763 - protein, 8 aa, Homo Sapiens
VGPETLGR

SEQ ID NO: 53764 - protein, 8 aa, Homo Sapiens
VGVHFLPK

SEQ ID NO: 53765 - protein, 8 aa, Homo Sapiens
VIDTSLLY

SEQ ID NO: 53766 - protein, 8 aa, Homo Sapiens
VLDGTIEY

SEQ ID NO: 53767 - protein, 8 aa, Homo Sapiens
VLKDSLRY

SEQ ID NO: 53768 - protein, 8 aa, Homo Sapiens
VNMVPFPR

SEQ ID NO: 53769 - protein, 8 aa, Homo Sapiens
VSLTACKV

SEQ ID NO: 53770 - protein, 8 aa, Homo Sapiens
VTDEPLLK

SEQ ID NO: 53771 - protein, 8 aa, Homo Sapiens
VTDSSLEY

SEQ ID NO: 53772 - protein, 8 aa, Homo Sapiens
VTDTNVIL

SEQ ID NO: 53773 - protein, 8 aa, Homo Sapiens
VTLELGGK

SEQ ID NO: 53774 - protein, 8 aa, Homo Sapiens
VVDKIDYY

SEQ ID NO: 53775 - protein, 8 aa, Homo Sapiens
WEVDSGRR

SEQ ID NO: 53776 - protein, 8 aa, Homo Sapiens
YEDIAQKS

SEQ ID NO: 53777 - protein, 8 aa, Homo Sapiens
YQVAALPK

SEQ ID NO: 53778 - protein, 8 aa, Homo Sapiens
YTDKIDRY

SEQ ID NO: 53779 - protein, 8 aa, Homo Sapiens
YTDVSTRY

SEQ ID NO: 53780 - protein, 9 aa, Homo Sapiens
AADLVEALY

SEQ ID NO: 53781 - protein, 9 aa, Homo Sapiens
AADSYTDSY

SEQ ID NO: 53782 - protein, 9 aa, Homo Sapiens
AIDEDVLRY

SEQ ID NO: 53783 - protein, 9 aa, Homo Sapiens
AIDHEKKAY

SEQ ID NO: 53784 - protein, 9 aa, Homo Sapiens
AIDQLHLEY

SEQ ID NO: 53785 - protein, 9 aa, Homo Sapiens
AIDRLVNIY

SEQ ID NO: 53786 - protein, 9 aa, Homo Sapiens
AIINYVSKV

SEQ ID NO: 53787 - protein, 9 aa, Homo Sapiens
ALDAAVLAY

SEQ ID NO: 53788 - protein, 9 aa, Homo Sapiens
ALDQFQEKY

SEQ ID NO: 53789 - protein, 9 aa, Homo Sapiens
ALDSHILDY

SEQ ID NO: 53790 - protein, 9 aa, Homo Sapiens
ALDTKIGRY

SEQ ID NO: 53791 - protein, 9 aa, Homo Sapiens
ALDVVNLVY

SEQ ID NO: 53792 - protein, 9 aa, Homo Sapiens
ALEAQTSRY

SEQ ID NO: 53793 - protein, 9 aa, Homo Sapiens
AMDATKLEY

SEQ ID NO: 53794 - protein, 9 aa, Homo Sapiens
AMDVYKNLY

SEQ ID NO: 53795 - protein, 9 aa, Homo Sapiens
ARDFILKLY

SEQ ID NO: 53796 - protein, 9 aa, Homo Sapiens
ASCRIVHEY

SEQ ID NO: 53797 - protein, 9 aa, Homo Sapiens
ASDAAPLQY

SEQ ID NO: 53798 - protein, 9 aa, Homo Sapiens
ASDHPIASY

SEQ ID NO: 53799 - protein, 9 aa, Homo Sapiens
ASDIAKHVY

SEQ ID NO: 53800 - protein, 9 aa, Homo Sapiens
ASDMLQLEY

SEQ ID NO: 53801 - protein, 9 aa, Homo Sapiens
ASDPFFRHY

SEQ ID NO: 53802 - protein, 9 aa, Homo Sapiens
ASDPYQVHV

SEQ ID NO: 53803 - protein, 9 aa, Homo Sapiens
ASDRNIVLY

SEQ ID NO: 53804 - protein, 9 aa, Homo Sapiens
ASDSAEFHY

SEQ ID NO: 53805 - protein, 9 aa, Homo Sapiens
ASDSIVLFY

SEQ ID NO: 53806 - protein, 9 aa, Homo Sapiens
ASDSMDSLY

SEQ ID NO: 53807 - protein, 9 aa, Homo Sapiens
ASDYFDQLY

SEQ ID NO: 53808 - protein, 9 aa, Homo Sapiens
ASEDSVLLY

SEQ ID NO: 53809 - protein, 9 aa, Homo Sapiens
ASETGFLTY

SEQ ID NO: 53810 - protein, 9 aa, Homo Sapiens
ASNPAMLLY

SEQ ID NO: 53811 - protein, 9 aa, Homo Sapiens
ASQEHGLKY

SEQ ID NO: 53812 - protein, 9 aa, Homo Sapiens
ASSQDALMY

SEQ ID NO: 53813 - protein, 9 aa, Homo Sapiens
ATAAGDVIK

SEQ ID NO: 53814 - protein, 9 aa, Homo Sapiens
ATDDITELY

SEQ ID NO: 53815 - protein, 9 aa, Homo Sapiens
ATDFDVLSY

SEQ ID NO: 53816 - protein, 9 aa, Homo Sapiens
ATDFKFAMY

SEQ ID NO: 53817 - protein, 9 aa, Homo Sapiens
ATDGRVYVV

SEQ ID NO: 53818 - protein, 9 aa, Homo Sapiens
ATDIPCLLY

SEQ ID NO: 53819 - protein, 9 aa, Homo Sapiens
ATDLAQHLY

SEQ ID NO: 53820 - protein, 9 aa, Homo Sapiens
ATDLLKRLY

SEQ ID NO: 53821 - protein, 9 aa, Homo Sapiens
ATDLTREVY

SEQ ID NO: 53822 - protein, 9 aa, Homo Sapiens
ATDPRPCEV

SEQ ID NO: 53823 - protein, 9 aa, Homo Sapiens
ATDRFRSLY

SEQ ID NO: 53824 - protein, 9 aa, Homo Sapiens
ATDRWYDEY

SEQ ID NO: 53825 - protein, 9 aa, Homo Sapiens
ATDYHFHFY

SEQ ID NO: 53826 - protein, 9 aa, Homo Sapiens
ATDYHVRVY

SEQ ID NO: 53827 - protein, 9 aa, Homo Sapiens
ATDYTFAMY

SEQ ID NO: 53828 - protein, 9 aa, Homo Sapiens
ATEKEKVWY

SEQ ID NO: 53829 - protein, 9 aa, Homo Sapiens
ATELPCHHY

SEQ ID NO: 53830 - protein, 9 aa, Homo Sapiens
ATELQSMMY

SEQ ID NO: 53831 - protein, 9 aa, Homo Sapiens
ATEMTLQRY

SEQ ID NO: 53832 - protein, 9 aa, Homo Sapiens
ATETQPIVY

SEQ ID NO: 53833 - protein, 9 aa, Homo Sapiens
ATEVHPAKY

SEQ ID NO: 53834 - protein, 9 aa, Homo Sapiens
ATEYKNEEY

SEQ ID NO: 53835 - protein, 9 aa, Homo Sapiens
ATMYNLLAY

SEQ ID NO: 53836 - protein, 9 aa, Homo Sapiens
ATQAHSLSY

SEQ ID NO: 53837 - protein, 9 aa, Homo Sapiens
ATQERTDLY

SEQ ID NO: 53838 - protein, 9 aa, Homo Sapiens
ATSKVALVY

SEQ ID NO: 53839 - protein, 9 aa, Homo Sapiens
AVDAARLHY

SEQ ID NO: 53840 - protein, 9 aa, Homo Sapiens
AVDPGLLGY

SEQ ID NO: 53841 - protein, 9 aa, Homo Sapiens
AVDPQHNGY

SEQ ID NO: 53842 - protein, 9 aa, Homo Sapiens
AVDPRFLAY

SEQ ID NO: 53843 - protein, 9 aa, Homo Sapiens
AVDSKVASY

SEQ ID NO: 53844 - protein, 9 aa, Homo Sapiens
CLDAFPNLK

SEQ ID NO: 53845 - protein, 9 aa, Homo Sapiens
DKETYELRY

SEQ ID NO: 53846 - protein, 9 aa, Homo Sapiens
EDALKILQY

SEQ ID NO: 53847 - protein, 9 aa, Homo Sapiens
EEEVNNLVK

SEQ ID NO: 53848 - protein, 9 aa, Homo Sapiens
EFAEEQLRA

SEQ ID NO: 53849 - protein, 9 aa, Homo Sapiens
ETVWRLEEF

SEQ ID NO: 53850 - protein, 9 aa, Homo Sapiens
EVTELLARY

SEQ ID NO: 53851 - protein, 9 aa, Homo Sapiens
FGAYGGLLK

SEQ ID NO: 53852 - protein, 9 aa, Homo Sapiens
FSDGRVLCY

SEQ ID NO: 53853 - protein, 9 aa, Homo Sapiens
FSDIHDFEY

SEQ ID NO: 53854 - protein, 9 aa, Homo Sapiens
FSDKLHSKY

SEQ ID NO: 53855 - protein, 9 aa, Homo Sapiens
FSDVNMQEY

SEQ ID NO: 53856 - protein, 9 aa, Homo Sapiens
FSGRFEDVY

SEQ ID NO: 53857 - protein, 9 aa, Homo Sapiens
FTDKKTHLY

SEQ ID NO: 53858 - protein, 9 aa, Homo Sapiens
GADRFYLGY

SEQ ID NO: 53859 - protein, 9 aa, Homo Sapiens
GADVNRVTY

SEQ ID NO: 53860 - protein, 9 aa, Homo Sapiens
GCDFTNVVK

SEQ ID NO: 53861 - protein, 9 aa, Homo Sapiens
GIAPYSYAG

SEQ ID NO: 53862 - protein, 9 aa, Homo Sapiens
GIDDMCLKY

SEQ ID NO: 53863 - protein, 9 aa, Homo Sapiens
GIGTVPVGR

SEQ ID NO: 53864 - protein, 9 aa, Homo Sapiens
GLDQQDLRY

SEQ ID NO: 53865 - protein, 9 aa, Homo Sapiens
GMDNDFHHY

SEQ ID NO: 53866 - protein, 9 aa, Homo Sapiens
GSDCTTIHY

SEQ ID NO: 53867 - protein, 9 aa, Homo Sapiens
GSDDTELRY

SEQ ID NO: 53868 - protein, 9 aa, Homo Sapiens
GSDFCHTSY

SEQ ID NO: 53869 - protein, 9 aa, Homo Sapiens
GSDFYSMHY

SEQ ID NO: 53870 - protein, 9 aa, Homo Sapiens
GSDKINYTY

SEQ ID NO: 53871 - protein, 9 aa, Homo Sapiens
GSDPVFRFY

SEQ ID NO: 53872 - protein, 9 aa, Homo Sapiens
GSDPYVRMY

SEQ ID NO: 53873 - protein, 9 aa, Homo Sapiens
GSDRIKDGY

SEQ ID NO: 53874 - protein, 9 aa, Homo Sapiens
GSDSRFAGY

SEQ ID NO: 53875 - protein, 9 aa, Homo Sapiens
GSDVVDWLY

SEQ ID NO: 53876 - protein, 9 aa, Homo Sapiens
GSDYINANY

SEQ ID NO: 53877 - protein, 9 aa, Homo Sapiens
GSEPASLSY

SEQ ID NO: 53878 - protein, 9 aa, Homo Sapiens
GSEYLKLGY

SEQ ID NO: 53879 - protein, 9 aa, Homo Sapiens
GSSFIQHYY

SEQ ID NO: 53880 - protein, 9 aa, Homo Sapiens
GTATKHLTY

SEQ ID NO: 53881 - protein, 9 aa, Homo Sapiens
GTDCWTYHY

SEQ ID NO: 53882 - protein, 9 aa, Homo Sapiens
GTDELRLLY

SEQ ID NO: 53883 - protein, 9 aa, Homo Sapiens
GTDGHVHLY

SEQ ID NO: 53884 - protein, 9 aa, Homo Sapiens
GTDLSIFKY

SEQ ID NO: 53885 - protein, 9 aa, Homo Sapiens
GTDMEPSLY

SEQ ID NO: 53886 - protein, 9 aa, Homo Sapiens
GTDPTPQHY

SEQ ID NO: 53887 - protein, 9 aa, Homo Sapiens
GTDSQYNAY

SEQ ID NO: 53888 - protein, 9 aa, Homo Sapiens
GTEFGGSIY

SEQ ID NO: 53889 - protein, 9 aa, Homo Sapiens
GTEIANTLY

SEQ ID NO: 53890 - protein, 9 aa, Homo Sapiens
GTQVEQLLY

SEQ ID NO: 53891 - protein, 9 aa, Homo Sapiens
GTVYEDLRY

SEQ ID NO: 53892 - protein, 9 aa, Homo Sapiens
HADVSNQLY

SEQ ID NO: 53893 - protein, 9 aa, Homo Sapiens
HIDSANALY

SEQ ID NO: 53894 - protein, 9 aa, Homo Sapiens
HIDTCLHAY

SEQ ID NO: 53895 - protein, 9 aa, Homo Sapiens
HIDVGGHMY

SEQ ID NO: 53896 - protein, 9 aa, Homo Sapiens
HLDFHCNEY

SEQ ID NO: 53897 - protein, 9 aa, Homo Sapiens
HLDLGILYY

SEQ ID NO: 53898 - protein, 9 aa, Homo Sapiens
HLDTLTEHY

SEQ ID NO: 53899 - protein, 9 aa, Homo Sapiens
HSDPESDFY

SEQ ID NO: 53900 - protein, 9 aa, Homo Sapiens
HSDPMFSSY

SEQ ID NO: 53901 - protein, 9 aa, Homo Sapiens
HSDPSILGY

SEQ ID NO: 53902 - protein, 9 aa, Homo Sapiens
HSDQQVFEY

SEQ ID NO: 53903 - protein, 9 aa, Homo Sapiens
HSDTDALGY

SEQ ID NO: 53904 - protein, 9 aa, Homo Sapiens
HSDTIQWLY

SEQ ID NO: 53905 - protein, 9 aa, Homo Sapiens
HSEAHTLLY

SEQ ID NO: 53906 - protein, 9 aa, Homo Sapiens
HSEFTTLLY

SEQ ID NO: 53907 - protein, 9 aa, Homo Sapiens
HSELLEDYY

SEQ ID NO: 53908 - protein, 9 aa, Homo Sapiens
HSEYHTLLY

SEQ ID NO: 53909 - protein, 9 aa, Homo Sapiens
HTDCTFIRV

SEQ ID NO: 53910 - protein, 9 aa, Homo Sapiens
HTDILKEKY

SEQ ID NO: 53911 - protein, 9 aa, Homo Sapiens
HTDSLHLLI

SEQ ID NO: 53912 - protein, 9 aa, Homo Sapiens
HTDVGLLEY

SEQ ID NO: 53913 - protein, 9 aa, Homo Sapiens
HTDWLLDLY

SEQ ID NO: 53914 - protein, 9 aa, Homo Sapiens
HTEARELMY

SEQ ID NO: 53915 - protein, 9 aa, Homo Sapiens
HTEERLLRY

SEQ ID NO: 53916 - protein, 9 aa, Homo Sapiens
HTETKTITY

SEQ ID NO: 53917 - protein, 9 aa, Homo Sapiens
HVDEQVFLY

SEQ ID NO: 53918 - protein, 9 aa, Homo Sapiens
IADMGHLKY

SEQ ID NO: 53919 - protein, 9 aa, Homo Sapiens
IAEKETLEY

SEQ ID NO: 53920 - protein, 9 aa, Homo Sapiens
IAQAESLRY

SEQ ID NO: 53921 - protein, 9 aa, Homo Sapiens
IIDGKTLKY

SEQ ID NO: 53922 - protein, 9 aa, Homo Sapiens
IIDHHDNTY

SEQ ID NO: 53923 - protein, 9 aa, Homo Sapiens
IIDNSQGFY

SEQ ID NO: 53924 - protein, 9 aa, Homo Sapiens
IIDRHVSRY

SEQ ID NO: 53925 - protein, 9 aa, Homo Sapiens
IIDYLTDHY

SEQ ID NO: 53926 - protein, 9 aa, Homo Sapiens
IIEANSQHY

SEQ ID NO: 53927 - protein, 9 aa, Homo Sapiens
IIEAQYLRY

SEQ ID NO: 53928 - protein, 9 aa, Homo Sapiens
IIEKETKEY

SEQ ID NO: 53929 - protein, 9 aa, Homo Sapiens
ILDEVIMGY

SEQ ID NO: 53930 - protein, 9 aa, Homo Sapiens
ILDIPNQLY

SEQ ID NO: 53931 - protein, 9 aa, Homo Sapiens
ILDTYLGKY

SEQ ID NO: 53932 - protein, 9 aa, Homo Sapiens
IMDCKGNLY

SEQ ID NO: 53933 - protein, 9 aa, Homo Sapiens
IMDPYKASY

SEQ ID NO: 53934 - protein, 9 aa, Homo Sapiens
IMEKSTMLY

SEQ ID NO: 53935 - protein, 9 aa, Homo Sapiens
ISDAPAPAY

SEQ ID NO: 53936 - protein, 9 aa, Homo Sapiens
ISDGKMQLY

SEQ ID NO: 53937 - protein, 9 aa, Homo Sapiens
ISDHGTVTY

SEQ ID NO: 53938 - protein, 9 aa, Homo Sapiens
ISDLIRDSY

SEQ ID NO: 53939 - protein, 9 aa, Homo Sapiens
ISDRLIGIY

SEQ ID NO: 53940 - protein, 9 aa, Homo Sapiens
ISDSYFPRY

SEQ ID NO: 53941 - protein, 9 aa, Homo Sapiens
ISEELVQKY

SEQ ID NO: 53942 - protein, 9 aa, Homo Sapiens
ISENKFLKY

SEQ ID NO: 53943 - protein, 9 aa, Homo Sapiens
ITAADILDR

SEQ ID NO: 53944 - protein, 9 aa, Homo Sapiens
ITDAYLDQY

SEQ ID NO: 53945 - protein, 9 aa, Homo Sapiens
ITDDLHFYV

SEQ ID NO: 53946 - protein, 9 aa, Homo Sapiens
ITDEQRQYY

SEQ ID NO: 53947 - protein, 9 aa, Homo Sapiens
ITDHGSLIY

SEQ ID NO: 53948 - protein, 9 aa, Homo Sapiens
ITDHLDTQY

SEQ ID NO: 53949 - protein, 9 aa, Homo Sapiens
ITDKDDLVK

SEQ ID NO: 53950 - protein, 9 aa, Homo Sapiens
ITDKNSLAY

SEQ ID NO: 53951 - protein, 9 aa, Homo Sapiens
ITDQGIEFY

SEQ ID NO: 53952 - protein, 9 aa, Homo Sapiens
ITDTTRDVY

SEQ ID NO: 53953 - protein, 9 aa, Homo Sapiens
ITDVDNGYY

SEQ ID NO: 53954 - protein, 9 aa, Homo Sapiens
ITEDKTELY

SEQ ID NO: 53955 - protein, 9 aa, Homo Sapiens
ITNPKSLLY

SEQ ID NO: 53956 - protein, 9 aa, Homo Sapiens
ITQGTPLKY

SEQ ID NO: 53957 - protein, 9 aa, Homo Sapiens
ITQIEHEVS

SEQ ID NO: 53958 - protein, 9 aa, Homo Sapiens
IVDEFAMRY

SEQ ID NO: 53959 - protein, 9 aa, Homo Sapiens
IVDHIHFQY

SEQ ID NO: 53960 - protein, 9 aa, Homo Sapiens
IVDQSQQAY

SEQ ID NO: 53961 - protein, 9 aa, Homo Sapiens
IVDRFTSKY

SEQ ID NO: 53962 - protein, 9 aa, Homo Sapiens
IVDSATALY

SEQ ID NO: 53963 - protein, 9 aa, Homo Sapiens
IVDSLTEMY

SEQ ID NO: 53964 - protein, 9 aa, Homo Sapiens
IVEAEAMNY

SEQ ID NO: 53965 - protein, 9 aa, Homo Sapiens
KAAITTLKY

SEQ ID NO: 53966 - protein, 9 aa, Homo Sapiens
KADELFTEY

SEQ ID NO: 53967 - protein, 9 aa, Homo Sapiens
KADEPIADY

SEQ ID NO: 53968 - protein, 9 aa, Homo Sapiens
KADFCIIHY

SEQ ID NO: 53969 - protein, 9 aa, Homo Sapiens
KADKLDFEY

SEQ ID NO: 53970 - protein, 9 aa, Homo Sapiens
KADKVTQLY

SEQ ID NO: 53971 - protein, 9 aa, Homo Sapiens
KADTLKERY

SEQ ID NO: 53972 - protein, 9 aa, Homo Sapiens
KAEAVALKY

SEQ ID NO: 53973 - protein, 9 aa, Homo Sapiens
KDLVTILFY

SEQ ID NO: 53974 - protein, 9 aa, Homo Sapiens
KEADIHFLI

SEQ ID NO: 53975 - protein, 9 aa, Homo Sapiens
KGDFYVIEY

SEQ ID NO: 53976 - protein, 9 aa, Homo Sapiens
KIADRFLLY

SEQ ID NO: 53977 - protein, 9 aa, Homo Sapiens
KIAQDLEMY

SEQ ID NO: 53978 - protein, 9 aa, Homo Sapiens
KIDALQLEY

SEQ ID NO: 53979 - protein, 9 aa, Homo Sapiens
KIDELYEAY

SEQ ID NO: 53980 - protein, 9 aa, Homo Sapiens
KIDENQLMY

SEQ ID NO: 53981 - protein, 9 aa, Homo Sapiens
KIDEPSTPY

SEQ ID NO: 53982 - protein, 9 aa, Homo Sapiens
KIDHYVLEY

SEQ ID NO: 53983 - protein, 9 aa, Homo Sapiens
KIDPKILAY

SEQ ID NO: 53984 - protein, 9 aa, Homo Sapiens
KIDQWLEQY

SEQ ID NO: 53985 - protein, 9 aa, Homo Sapiens
KIDSFNSLY

SEQ ID NO: 53986 - protein, 9 aa, Homo Sapiens
KIDSIEDRY

SEQ ID NO: 53987 - protein, 9 aa, Homo Sapiens
KIDSLQARY

SEQ ID NO: 53988 - protein, 9 aa, Homo Sapiens
KIDVPANRY

SEQ ID NO: 53989 - protein, 9 aa, Homo Sapiens
KLAGDHIEY

SEQ ID NO: 53990 - protein, 9 aa, Homo Sapiens
KLDDLHTLY

SEQ ID NO: 53991 - protein, 9 aa, Homo Sapiens
KLDEALAQY

SEQ ID NO: 53992 - protein, 9 aa, Homo Sapiens
KLDELKLKY

SEQ ID NO: 53993 - protein, 9 aa, Homo Sapiens
KLDEMTASY

SEQ ID NO: 53994 - protein, 9 aa, Homo Sapiens
KLDEQGLNY

SEQ ID NO: 53995 - protein, 9 aa, Homo Sapiens
KLDEQYQKY

SEQ ID NO: 53996 - protein, 9 aa, Homo Sapiens
KLDIDGYEY

SEQ ID NO: 53997 - protein, 9 aa, Homo Sapiens
KLDIWNIKY

SEQ ID NO: 53998 - protein, 9 aa, Homo Sapiens
KLDKDNLSY

SEQ ID NO: 53999 - protein, 9 aa, Homo Sapiens
KLDLLEQEY

SEQ ID NO: 54000 - protein, 9 aa, Homo Sapiens
KLDPFLTPY

SEQ ID NO: 54001 - protein, 9 aa, Homo Sapiens
KLDPLRGHY

SEQ ID NO: 54002 - protein, 9 aa, Homo Sapiens
KLDQLIEFY

SEQ ID NO: 54003 - protein, 9 aa, Homo Sapiens
KLDSLLLFY

SEQ ID NO: 54004 - protein, 9 aa, Homo Sapiens
KLDTDLKNY

SEQ ID NO: 54005 - protein, 9 aa, Homo Sapiens
KLDTLCDLY

SEQ ID NO: 54006 - protein, 9 aa, Homo Sapiens
KLEKDLDRY

SEQ ID NO: 54007 - protein, 9 aa, Homo Sapiens
KLEKETTMY

SEQ ID NO: 54008 - protein, 9 aa, Homo Sapiens
KMDDKALLV

SEQ ID NO: 54009 - protein, 9 aa, Homo Sapiens
KMDDLNLHY

SEQ ID NO: 54010 - protein, 9 aa, Homo Sapiens
KMDEIGNHY

SEQ ID NO: 54011 - protein, 9 aa, Homo Sapiens
KMDLDNNFY

SEQ ID NO: 54012 - protein, 9 aa, Homo Sapiens
KMDPTDAKY

SEQ ID NO: 54013 - protein, 9 aa, Homo Sapiens
KMDPVAYRV

SEQ ID NO: 54014 - protein, 9 aa, Homo Sapiens
KMDQIISKY

SEQ ID NO: 54015 - protein, 9 aa, Homo Sapiens
KMEQAFARY

SEQ ID NO: 54016 - protein, 9 aa, Homo Sapiens
KQDSNPLYK

SEQ ID NO: 54017 - protein, 9 aa, Homo Sapiens
KQDVLLLYY

SEQ ID NO: 54018 - protein, 9 aa, Homo Sapiens
KSARLDLLY

SEQ ID NO: 54019 - protein, 9 aa, Homo Sapiens
KSDEMELLY

SEQ ID NO: 54020 - protein, 9 aa, Homo Sapiens
KSDESLEKY

SEQ ID NO: 54021 - protein, 9 aa, Homo Sapiens
KSDGIKGLY

SEQ ID NO: 54022 - protein, 9 aa, Homo Sapiens
KSDGSFIGY

SEQ ID NO: 54023 - protein, 9 aa, Homo Sapiens
KSDHSFFKI

SEQ ID NO: 54024 - protein, 9 aa, Homo Sapiens
KSDLFFHDY

SEQ ID NO: 54025 - protein, 9 aa, Homo Sapiens
KSDLRPMLY

SEQ ID NO: 54026 - protein, 9 aa, Homo Sapiens
KSDPFLEFF

SEQ ID NO: 54027 - protein, 9 aa, Homo Sapiens
KSDPFLELY

SEQ ID NO: 54028 - protein, 9 aa, Homo Sapiens
KSDPFLVFY

SEQ ID NO: 54029 - protein, 9 aa, Homo Sapiens
KSDPICVLY

SEQ ID NO: 54030 - protein, 9 aa, Homo Sapiens
KSDPIMLLK

SEQ ID NO: 54031 - protein, 9 aa, Homo Sapiens
KSDPSIVRL

SEQ ID NO: 54032 - protein, 9 aa, Homo Sapiens
KSDQGWRRY

SEQ ID NO: 54033 - protein, 9 aa, Homo Sapiens
KSDSGKPYY

SEQ ID NO: 54034 - protein, 9 aa, Homo Sapiens
KSDVHLNFY

SEQ ID NO: 54035 - protein, 9 aa, Homo Sapiens
KSDVNKEYY

SEQ ID NO: 54036 - protein, 9 aa, Homo Sapiens
KSDYIKLYV

SEQ ID NO: 54037 - protein, 9 aa, Homo Sapiens
KSEASGFCY

SEQ ID NO: 54038 - protein, 9 aa, Homo Sapiens
KSEATQEQY

SEQ ID NO: 54039 - protein, 9 aa, Homo Sapiens
KSEDGRLIY

SEQ ID NO: 54040 - protein, 9 aa, Homo Sapiens
KSEFLNFFY

SEQ ID NO: 54041 - protein, 9 aa, Homo Sapiens
KSELGLNFY

SEQ ID NO: 54042 - protein, 9 aa, Homo Sapiens
KSELLVEQY

SEQ ID NO: 54043 - protein, 9 aa, Homo Sapiens
KSESFMQKY

SEQ ID NO: 54044 - protein, 9 aa, Homo Sapiens
KSGAHVDFY

SEQ ID NO: 54045 - protein, 9 aa, Homo Sapiens
KSGYRIDFY

SEQ ID NO: 54046 - protein, 9 aa, Homo Sapiens
KSIDLKDKY

SEQ ID NO: 54047 - protein, 9 aa, Homo Sapiens
KSNPHRDFY

SEQ ID NO: 54048 - protein, 9 aa, Homo Sapiens
KSSAISLHY

SEQ ID NO: 54049 - protein, 9 aa, Homo Sapiens
KSSATRLLY

SEQ ID NO: 54050 - protein, 9 aa, Homo Sapiens
KSSDVYVSY

SEQ ID NO: 54051 - protein, 9 aa, Homo Sapiens
KSSEVTDAY

SEQ ID NO: 54052 - protein, 9 aa, Homo Sapiens
KSSIDLYFY

SEQ ID NO: 54053 - protein, 9 aa, Homo Sapiens
KSTAISLFY

SEQ ID NO: 54054 - protein, 9 aa, Homo Sapiens
KSVENQMRY

SEQ ID NO: 54055 - protein, 9 aa, Homo Sapiens
KSYCDNLGY

SEQ ID NO: 54056 - protein, 9 aa, Homo Sapiens
KTAEAQLAY

SEQ ID NO: 54057 - protein, 9 aa, Homo Sapiens
KTAGLSDLY

SEQ ID NO: 54058 - protein, 9 aa, Homo Sapiens
KTCATTIAY

SEQ ID NO: 54059 - protein, 9 aa, Homo Sapiens
KTCEEILNY

SEQ ID NO: 54060 - protein, 9 aa, Homo Sapiens
KTDAFICKY

SEQ ID NO: 54061 - protein, 9 aa, Homo Sapiens
KTDDLITRF

SEQ ID NO: 54062 - protein, 9 aa, Homo Sapiens
KTDDSLEKY

SEQ ID NO: 54063 - protein, 9 aa, Homo Sapiens
KTDEMHTAL

SEQ ID NO: 54064 - protein, 9 aa, Homo Sapiens
KTDESLTKY

SEQ ID NO: 54065 - protein, 9 aa, Homo Sapiens
KTDFEVLTK

SEQ ID NO: 54066 - protein, 9 aa, Homo Sapiens
KTDGKIVQY

SEQ ID NO: 54067 - protein, 9 aa, Homo Sapiens
KTDGSFIGY

SEQ ID NO: 54068 - protein, 9 aa, Homo Sapiens
KTDGSFLVH

SEQ ID NO: 54069 - protein, 9 aa, Homo Sapiens
KTDHFIFTY

SEQ ID NO: 54070 - protein, 9 aa, Homo Sapiens
KTDIIDHSF

SEQ ID NO: 54071 - protein, 9 aa, Homo Sapiens
KTDLDLDGY

SEQ ID NO: 54072 - protein, 9 aa, Homo Sapiens
KTDLDLQQY

SEQ ID NO: 54073 - protein, 9 aa, Homo Sapiens
KTDLHNEGY

SEQ ID NO: 54074 - protein, 9 aa, Homo Sapiens
KTDLLEEKV

SEQ ID NO: 54075 - protein, 9 aa, Homo Sapiens
KTDLLLEPY

SEQ ID NO: 54076 - protein, 9 aa, Homo Sapiens
KTDLNNLEM

SEQ ID NO: 54077 - protein, 9 aa, Homo Sapiens
KTDPCTLQF

SEQ ID NO: 54078 - protein, 9 aa, Homo Sapiens
KTDPENTDY

SEQ ID NO: 54079 - protein, 9 aa, Homo Sapiens
KTDPKMLSK

SEQ ID NO: 54080 - protein, 9 aa, Homo Sapiens
KTDQFPLFL

SEQ ID NO: 54081 - protein, 9 aa, Homo Sapiens
KTDREYQEY

SEQ ID NO: 54082 - protein, 9 aa, Homo Sapiens
KTDSPSCEY

SEQ ID NO: 54083 - protein, 9 aa, Homo Sapiens
KTDTHLKEY

SEQ ID NO: 54084 - protein, 9 aa, Homo Sapiens
KTDVTMLLY

SEQ ID NO: 54085 - protein, 9 aa, Homo Sapiens
KTDVVVNSV

SEQ ID NO: 54086 - protein, 9 aa, Homo Sapiens
KTDYDTREY

SEQ ID NO: 54087 - protein, 9 aa, Homo Sapiens
KTDYFFLEV

SEQ ID NO: 54088 - protein, 9 aa, Homo Sapiens
KTEALRLQY

SEQ ID NO: 54089 - protein, 9 aa, Homo Sapiens
KTEDLGCMY

SEQ ID NO: 54090 - protein, 9 aa, Homo Sapiens
KTEGGKVLY

SEQ ID NO: 54091 - protein, 9 aa, Homo Sapiens
KTEIMSPLY

SEQ ID NO: 54092 - protein, 9 aa, Homo Sapiens
KTELQFSDY

SEQ ID NO: 54093 - protein, 9 aa, Homo Sapiens
KTEPSIAEY

SEQ ID NO: 54094 - protein, 9 aa, Homo Sapiens
KTEQEALEY

SEQ ID NO: 54095 - protein, 9 aa, Homo Sapiens
KTERLEVSY

SEQ ID NO: 54096 - protein, 9 aa, Homo Sapiens
KTERSDLEY

SEQ ID NO: 54097 - protein, 9 aa, Homo Sapiens
KTFLEYLEY

SEQ ID NO: 54098 - protein, 9 aa, Homo Sapiens
KTFLYNELY

SEQ ID NO: 54099 - protein, 9 aa, Homo Sapiens
KTFPYQHRY

SEQ ID NO: 54100 - protein, 9 aa, Homo Sapiens
KTHIDVIHY

SEQ ID NO: 54101 - protein, 9 aa, Homo Sapiens
KTQEHGLFY

SEQ ID NO: 54102 - protein, 9 aa, Homo Sapiens
KTQQQHMLY

SEQ ID NO: 54103 - protein, 9 aa, Homo Sapiens
KTQSAMLRY

SEQ ID NO: 54104 - protein, 9 aa, Homo Sapiens
KTSDKPLMY

SEQ ID NO: 54105 - protein, 9 aa, Homo Sapiens
KTSHYNILY

SEQ ID NO: 54106 - protein, 9 aa, Homo Sapiens
KTSRDFDRY

SEQ ID NO: 54107 - protein, 9 aa, Homo Sapiens
KTWDQLEYY

SEQ ID NO: 54108 - protein, 9 aa, Homo Sapiens
KVADMALHY

SEQ ID NO: 54109 - protein, 9 aa, Homo Sapiens
KVASDTQFY

SEQ ID NO: 54110 - protein, 9 aa, Homo Sapiens
KVDAGKLHY

SEQ ID NO: 54111 - protein, 9 aa, Homo Sapiens
KVDDLLESY

SEQ ID NO: 54112 - protein, 9 aa, Homo Sapiens
KVDEEQMKY

SEQ ID NO: 54113 - protein, 9 aa, Homo Sapiens
KVDELYEAY

SEQ ID NO: 54114 - protein, 9 aa, Homo Sapiens
KVDGSVNAY

SEQ ID NO: 54115 - protein, 9 aa, Homo Sapiens
KVDKEKWLY

SEQ ID NO: 54116 - protein, 9 aa, Homo Sapiens
KVDLTNPQY

SEQ ID NO: 54117 - protein, 9 aa, Homo Sapiens
KVDNEILDY

SEQ ID NO: 54118 - protein, 9 aa, Homo Sapiens
KVDQNRVRY

SEQ ID NO: 54119 - protein, 9 aa, Homo Sapiens
KVDTDGNGY

SEQ ID NO: 54120 - protein, 9 aa, Homo Sapiens
KVDYNRLGY

SEQ ID NO: 54121 - protein, 9 aa, Homo Sapiens
KVEAKFINY

SEQ ID NO: 54122 - protein, 9 aa, Homo Sapiens
KVEKHYLFY

SEQ ID NO: 54123 - protein, 9 aa, Homo Sapiens
KVENFFTLY

SEQ ID NO: 54124 - protein, 9 aa, Homo Sapiens
KVEQHVELY

SEQ ID NO: 54125 - protein, 9 aa, Homo Sapiens
LADLSCLVY

SEQ ID NO: 54126 - protein, 9 aa, Homo Sapiens
LADSFRHLY

SEQ ID NO: 54127 - protein, 9 aa, Homo Sapiens
LAGQGELNR

SEQ ID NO: 54128 - protein, 9 aa, Homo Sapiens
LDQVLKEAK

SEQ ID NO: 54129 - protein, 9 aa, Homo Sapiens
LDTNADKQL

SEQ ID NO: 54130 - protein, 9 aa, Homo Sapiens
LGIPLPEIK

SEQ ID NO: 54131 - protein, 9 aa, Homo Sapiens
LGLTEAQTR

SEQ ID NO: 54132 - protein, 9 aa, Homo Sapiens
LIDVGTGYY

SEQ ID NO: 54133 - protein, 9 aa, Homo Sapiens
LIIYDDLSK

SEQ ID NO: 54134 - protein, 9 aa, Homo Sapiens
LLSYVLTVG

SEQ ID NO: 54135 - protein, 9 aa, Homo Sapiens
LNLQEYQSK

SEQ ID NO: 54136 - protein, 9 aa, Homo Sapiens
LSDKNIEQY

SEQ ID NO: 54137 - protein, 9 aa, Homo Sapiens
LSDLGKLSY

SEQ ID NO: 54138 - protein, 9 aa, Homo Sapiens
LSDLGLISY

SEQ ID NO: 54139 - protein, 9 aa, Homo Sapiens
LSDLGRLSY

SEQ ID NO: 54140 - protein, 9 aa, Homo Sapiens
LSDLKHMRY

SEQ ID NO: 54141 - protein, 9 aa, Homo Sapiens
LSDPCPGLY

SEQ ID NO: 54142 - protein, 9 aa, Homo Sapiens
LSDPGSGLY

SEQ ID NO: 54143 - protein, 9 aa, Homo Sapiens
LSDREHPLY

SEQ ID NO: 54144 - protein, 9 aa, Homo Sapiens
LSDSFSDLY

SEQ ID NO: 54145 - protein, 9 aa, Homo Sapiens
LSEAFHEEY

SEQ ID NO: 54146 - protein, 9 aa, Homo Sapiens
LSEPSSLQY

SEQ ID NO: 54147 - protein, 9 aa, Homo Sapiens
LTDADAMKY

SEQ ID NO: 54148 - protein, 9 aa, Homo Sapiens
LTDDDLLRY

SEQ ID NO: 54149 - protein, 9 aa, Homo Sapiens
LTDDKLSQY

SEQ ID NO: 54150 - protein, 9 aa, Homo Sapiens
LTDDLHKQY

SEQ ID NO: 54151 - protein, 9 aa, Homo Sapiens
LTDFIREEY

SEQ ID NO: 54152 - protein, 9 aa, Homo Sapiens
LTDPEAAKY

SEQ ID NO: 54153 - protein, 9 aa, Homo Sapiens
LTDRGVMSY

SEQ ID NO: 54154 - protein, 9 aa, Homo Sapiens
LTDRLASLY

SEQ ID NO: 54155 - protein, 9 aa, Homo Sapiens
LTDTFTAYY

SEQ ID NO: 54156 - protein, 9 aa, Homo Sapiens
LTDTFYYRL

SEQ ID NO: 54157 - protein, 9 aa, Homo Sapiens
LTEKANHYY

SEQ ID NO: 54158 - protein, 9 aa, Homo Sapiens
LTELPDWSY

SEQ ID NO: 54159 - protein, 9 aa, Homo Sapiens
LTEPTGLLY

SEQ ID NO: 54160 - protein, 9 aa, Homo Sapiens
LTEQRALLY

SEQ ID NO: 54161 - protein, 9 aa, Homo Sapiens
LTHSLVLHY

SEQ ID NO: 54162 - protein, 9 aa, Homo Sapiens
LTSRGSQQY

SEQ ID NO: 54163 - protein, 9 aa, Homo Sapiens
LVDGDTLSY

SEQ ID NO: 54164 - protein, 9 aa, Homo Sapiens
LVDGYNVHY

SEQ ID NO: 54165 - protein, 9 aa, Homo Sapiens
LVDPSVYGY

SEQ ID NO: 54166 - protein, 9 aa, Homo Sapiens
LVDRYNLYY

SEQ ID NO: 54167 - protein, 9 aa, Homo Sapiens
LVLEGAGLR

SEQ ID NO: 54168 - protein, 9 aa, Homo Sapiens
LVSDSALYF

SEQ ID NO: 54169 - protein, 9 aa, Homo Sapiens
LVVYPWTQR

SEQ ID NO: 54170 - protein, 9 aa, Homo Sapiens
MGDAPDYDR

SEQ ID NO: 54171 - protein, 9 aa, Homo Sapiens
MIEPRTLQY

SEQ ID NO: 54172 - protein, 9 aa, Homo Sapiens
MLDSHEELY

SEQ ID NO: 54173 - protein, 9 aa, Homo Sapiens
MSDSYLPSY

SEQ ID NO: 54174 - protein, 9 aa, Homo Sapiens
MSEDKPQDY

SEQ ID NO: 54175 - protein, 9 aa, Homo Sapiens
MSEGKAETY

SEQ ID NO: 54176 - protein, 9 aa, Homo Sapiens
MSEGLGMRY

SEQ ID NO: 54177 - protein, 9 aa, Homo Sapiens
MSMVANLLY

SEQ ID NO: 54178 - protein, 9 aa, Homo Sapiens
MSQNFHTSY

SEQ ID NO: 54179 - protein, 9 aa, Homo Sapiens
MSSRSWLSY

SEQ ID NO: 54180 - protein, 9 aa, Homo Sapiens
MTDPIRILV

SEQ ID NO: 54181 - protein, 9 aa, Homo Sapiens
MTEKQLNLY

SEQ ID NO: 54182 - protein, 9 aa, Homo Sapiens
MTERQALSY

SEQ ID NO: 54183 - protein, 9 aa, Homo Sapiens
MTERQDLVY

SEQ ID NO: 54184 - protein, 9 aa, Homo Sapiens
MTESKFSKY

SEQ ID NO: 54185 - protein, 9 aa, Homo Sapiens
MTHNLLLNY

SEQ ID NO: 54186 - protein, 9 aa, Homo Sapiens
MVDPLLTKY

SEQ ID NO: 54187 - protein, 9 aa, Homo Sapiens
NTDFYQTSY

SEQ ID NO: 54188 - protein, 9 aa, Homo Sapiens
NTDPHSQEY

SEQ ID NO: 54189 - protein, 9 aa, Homo Sapiens
NTDVGAKNY

SEQ ID NO: 54190 - protein, 9 aa, Homo Sapiens
PTDPKVVVY

SEQ ID NO: 54191 - protein, 9 aa, Homo Sapiens
QADIARMLY

SEQ ID NO: 54192 - protein, 9 aa, Homo Sapiens
QADNQRLKY

SEQ ID NO: 54193 - protein, 9 aa, Homo Sapiens
QAESTALKY

SEQ ID NO: 54194 - protein, 9 aa, Homo Sapiens
QEDPDYGIR

SEQ ID NO: 54195 - protein, 9 aa, Homo Sapiens
QGEYIAPEK

SEQ ID NO: 54196 - protein, 9 aa, Homo Sapiens
QLDRISVYY

SEQ ID NO: 54197 - protein, 9 aa, Homo Sapiens
QMETFMLHY

SEQ ID NO: 54198 - protein, 9 aa, Homo Sapiens
QSDPKTSLY

SEQ ID NO: 54199 - protein, 9 aa, Homo Sapiens
QSDYFRALY

SEQ ID NO: 54200 - protein, 9 aa, Homo Sapiens
QSDYYASYY

SEQ ID NO: 54201 - protein, 9 aa, Homo Sapiens
QSERNLCKY

SEQ ID NO: 54202 - protein, 9 aa, Homo Sapiens
QTCRLLLSY

SEQ ID NO: 54203 - protein, 9 aa, Homo Sapiens
QTDHLFFKY

SEQ ID NO: 54204 - protein, 9 aa, Homo Sapiens
QTDKLKELY

SEQ ID NO: 54205 - protein, 9 aa, Homo Sapiens
QTDNIIYVY

SEQ ID NO: 54206 - protein, 9 aa, Homo Sapiens
QTDPANCDY

SEQ ID NO: 54207 - protein, 9 aa, Homo Sapiens
QTDPVTLQY

SEQ ID NO: 54208 - protein, 9 aa, Homo Sapiens
QTEASALLY

SEQ ID NO: 54209 - protein, 9 aa, Homo Sapiens
QTEDNMLFY

SEQ ID NO: 54210 - protein, 9 aa, Homo Sapiens
QTESQQIRY

SEQ ID NO: 54211 - protein, 9 aa, Homo Sapiens
RAAASTDYY

SEQ ID NO: 54212 - protein, 9 aa, Homo Sapiens
RAAPFSLEY

SEQ ID NO: 54213 - protein, 9 aa, Homo Sapiens
RADENIDKY

SEQ ID NO: 54214 - protein, 9 aa, Homo Sapiens
RADFNAVEY

SEQ ID NO: 54215 - protein, 9 aa, Homo Sapiens
RADGITGLY

SEQ ID NO: 54216 - protein, 9 aa, Homo Sapiens
RADGNFLLY

SEQ ID NO: 54217 - protein, 9 aa, Homo Sapiens
RADPKTVGY

SEQ ID NO: 54218 - protein, 9 aa, Homo Sapiens
RADQELLMY

SEQ ID NO: 54219 - protein, 9 aa, Homo Sapiens
RADQELMTY

SEQ ID NO: 54220 - protein, 9 aa, Homo Sapiens
RADREVAIY

SEQ ID NO: 54221 - protein, 9 aa, Homo Sapiens
RGDKVDILY

SEQ ID NO: 54222 - protein, 9 aa, Homo Sapiens
RIAIQNLLY

SEQ ID NO: 54223 - protein, 9 aa, Homo Sapiens
RIDLDELMK

SEQ ID NO: 54224 - protein, 9 aa, Homo Sapiens
RIDLIPSLY

SEQ ID NO: 54225 - protein, 9 aa, Homo Sapiens
RIDQASLDY

SEQ ID NO: 54226 - protein, 9 aa, Homo Sapiens
RIEDNSLLY

SEQ ID NO: 54227 - protein, 9 aa, Homo Sapiens
RIEEDNLTY

SEQ ID NO: 54228 - protein, 9 aa, Homo Sapiens
RIEGATLLY

SEQ ID NO: 54229 - protein, 9 aa, Homo Sapiens
RIEKQFLLY

SEQ ID NO: 54230 - protein, 9 aa, Homo Sapiens
RLATHHYLY

SEQ ID NO: 54231 - protein, 9 aa, Homo Sapiens
RLDAVTLLY

SEQ ID NO: 54232 - protein, 9 aa, Homo Sapiens
RLDCLIEVY

SEQ ID NO: 54233 - protein, 9 aa, Homo Sapiens
RLDDECAFY

SEQ ID NO: 54234 - protein, 9 aa, Homo Sapiens
RLDDKKFLY

SEQ ID NO: 54235 - protein, 9 aa, Homo Sapiens
RLDEDLAAY

SEQ ID NO: 54236 - protein, 9 aa, Homo Sapiens
RLDEVISKY

SEQ ID NO: 54237 - protein, 9 aa, Homo Sapiens
RLDFNPDRY

SEQ ID NO: 54238 - protein, 9 aa, Homo Sapiens
RLDHKFDLM

SEQ ID NO: 54239 - protein, 9 aa, Homo Sapiens
RLDHWIHSY

SEQ ID NO: 54240 - protein, 9 aa, Homo Sapiens
RLDINTNTY

SEQ ID NO: 54241 - protein, 9 aa, Homo Sapiens
RLDIVRSLY

SEQ ID NO: 54242 - protein, 9 aa, Homo Sapiens
RLDKVLDEY

SEQ ID NO: 54243 - protein, 9 aa, Homo Sapiens
RLDLAVQAY

SEQ ID NO: 54244 - protein, 9 aa, Homo Sapiens
RLDLQPDLY

SEQ ID NO: 54245 - protein, 9 aa, Homo Sapiens
RLDMYGEKY

SEQ ID NO: 54246 - protein, 9 aa, Homo Sapiens
RLDPNFLLK

SEQ ID NO: 54247 - protein, 9 aa, Homo Sapiens
RLDSLTTLY

SEQ ID NO: 54248 - protein, 9 aa, Homo Sapiens
RLDSNNHLY

SEQ ID NO: 54249 - protein, 9 aa, Homo Sapiens
RLDTDHLRY

SEQ ID NO: 54250 - protein, 9 aa, Homo Sapiens
RLEGQVLRY

SEQ ID NO: 54251 - protein, 9 aa, Homo Sapiens
RLEKLQLEY

SEQ ID NO: 54252 - protein, 9 aa, Homo Sapiens
RLETCFLRY

SEQ ID NO: 54253 - protein, 9 aa, Homo Sapiens
RMDNIYFEY

SEQ ID NO: 54254 - protein, 9 aa, Homo Sapiens
RSAEEAPLY

SEQ ID NO: 54255 - protein, 9 aa, Homo Sapiens
RSAKASLVY

SEQ ID NO: 54256 - protein, 9 aa, Homo Sapiens
RSAVYPLLY

SEQ ID NO: 54257 - protein, 9 aa, Homo Sapiens
RSCATVDSY

SEQ ID NO: 54258 - protein, 9 aa, Homo Sapiens
RSDELARHY

SEQ ID NO: 54259 - protein, 9 aa, Homo Sapiens
RSDELTRHY

SEQ ID NO: 54260 - protein, 9 aa, Homo Sapiens
RSDFFTSFY

SEQ ID NO: 54261 - protein, 9 aa, Homo Sapiens
RSDFNEIVY

SEQ ID NO: 54262 - protein, 9 aa, Homo Sapiens
RSDGAGPLY

SEQ ID NO: 54263 - protein, 9 aa, Homo Sapiens
RSDIHTEAV

SEQ ID NO: 54264 - protein, 9 aa, Homo Sapiens
RSDLQSLGY

SEQ ID NO: 54265 - protein, 9 aa, Homo Sapiens
RSDPCYADY

SEQ ID NO: 54266 - protein, 9 aa, Homo Sapiens
RSDPGHYSF

SEQ ID NO: 54267 - protein, 9 aa, Homo Sapiens
RSDPSIMNW

SEQ ID NO: 54268 - protein, 9 aa, Homo Sapiens
RSDRREDYY

SEQ ID NO: 54269 - protein, 9 aa, Homo Sapiens
RSDSEIIGY

SEQ ID NO: 54270 - protein, 9 aa, Homo Sapiens
RSDSRAPVY

SEQ ID NO: 54271 - protein, 9 aa, Homo Sapiens
RSDVEILGY

SEQ ID NO: 54272 - protein, 9 aa, Homo Sapiens
RSEEGRLYY

SEQ ID NO: 54273 - protein, 9 aa, Homo Sapiens
RSEIQRLTY

SEQ ID NO: 54274 - protein, 9 aa, Homo Sapiens
RSEKMTLSY

SEQ ID NO: 54275 - protein, 9 aa, Homo Sapiens
RSEKPNWDY

SEQ ID NO: 54276 - protein, 9 aa, Homo Sapiens
RSENNCFLY

SEQ ID NO: 54277 - protein, 9 aa, Homo Sapiens
RSESSPEAY

SEQ ID NO: 54278 - protein, 9 aa, Homo Sapiens
RSHYLMHNY

SEQ ID NO: 54279 - protein, 9 aa, Homo Sapiens
RSMGFIGHY

SEQ ID NO: 54280 - protein, 9 aa, Homo Sapiens
RSNILTLMY

SEQ ID NO: 54281 - protein, 9 aa, Homo Sapiens
RSSNEFMRY

SEQ ID NO: 54282 - protein, 9 aa, Homo Sapiens
RSSNVSYKY

SEQ ID NO: 54283 - protein, 9 aa, Homo Sapiens
RSSPPGHYY

SEQ ID NO: 54284 - protein, 9 aa, Homo Sapiens
RTAHVILRY

SEQ ID NO: 54285 - protein, 9 aa, Homo Sapiens
RTAQEVETY

SEQ ID NO: 54286 - protein, 9 aa, Homo Sapiens
RTDACFIRV

SEQ ID NO: 54287 - protein, 9 aa, Homo Sapiens
RTDDITSGY

SEQ ID NO: 54288 - protein, 9 aa, Homo Sapiens
RTDELVREY

SEQ ID NO: 54289 - protein, 9 aa, Homo Sapiens
RTDFHGSGY

SEQ ID NO: 54290 - protein, 9 aa, Homo Sapiens
RTDGILALY

SEQ ID NO: 54291 - protein, 9 aa, Homo Sapiens
RTDGKVFQF

SEQ ID NO: 54292 - protein, 9 aa, Homo Sapiens
RTDGTVEIY

SEQ ID NO: 54293 - protein, 9 aa, Homo Sapiens
RTDHELGKY

SEQ ID NO: 54294 - protein, 9 aa, Homo Sapiens
RTDIARTEY

SEQ ID NO: 54295 - protein, 9 aa, Homo Sapiens
RTDPALLRH

SEQ ID NO: 54296 - protein, 9 aa, Homo Sapiens
RTDPLENNY

SEQ ID NO: 54297 - protein, 9 aa, Homo Sapiens
RTDRAHPYY

SEQ ID NO: 54298 - protein, 9 aa, Homo Sapiens
RTDVAVLRY

SEQ ID NO: 54299 - protein, 9 aa, Homo Sapiens
RTDVHNVLV

SEQ ID NO: 54300 - protein, 9 aa, Homo Sapiens
RTEAAFSYY

SEQ ID NO: 54301 - protein, 9 aa, Homo Sapiens
RTEDELSKY

SEQ ID NO: 54302 - protein, 9 aa, Homo Sapiens
RTEDNLQIY

SEQ ID NO: 54303 - protein, 9 aa, Homo Sapiens
RTEEALQLY

SEQ ID NO: 54304 - protein, 9 aa, Homo Sapiens
RTEELAQAY

SEQ ID NO: 54305 - protein, 9 aa, Homo Sapiens
RTEPFQDGY

SEQ ID NO: 54306 - protein, 9 aa, Homo Sapiens
RTEPINTTY

SEQ ID NO: 54307 - protein, 9 aa, Homo Sapiens
RTERNVAVY

SEQ ID NO: 54308 - protein, 9 aa, Homo Sapiens
RTEYTITMY

SEQ ID NO: 54309 - protein, 9 aa, Homo Sapiens
RTFGHLLRY

SEQ ID NO: 54310 - protein, 9 aa, Homo Sapiens
RTFGMAEEY

SEQ ID NO: 54311 - protein, 9 aa, Homo Sapiens
RTFPFSLQY

SEQ ID NO: 54312 - protein, 9 aa, Homo Sapiens
RTIATALEY

SEQ ID NO: 54313 - protein, 9 aa, Homo Sapiens
RTLKEILRY

SEQ ID NO: 54314 - protein, 9 aa, Homo Sapiens
RTMQEIERY

SEQ ID NO: 54315 - protein, 9 aa, Homo Sapiens
RTMVKTLEY

SEQ ID NO: 54316 - protein, 9 aa, Homo Sapiens
RTPDFHDKY

SEQ ID NO: 54317 - protein, 9 aa, Homo Sapiens
RTQTEELHY

SEQ ID NO: 54318 - protein, 9 aa, Homo Sapiens
RTSLDIEEY

SEQ ID NO: 54319 - protein, 9 aa, Homo Sapiens
RTTAHALKY

SEQ ID NO: 54320 - protein, 9 aa, Homo Sapiens
RTTFFHHEY

SEQ ID NO: 54321 - protein, 9 aa, Homo Sapiens
RTTSHLLRY

SEQ ID NO: 54322 - protein, 9 aa, Homo Sapiens
RVADFTEQY

SEQ ID NO: 54323 - protein, 9 aa, Homo Sapiens
RVADTFQDY

SEQ ID NO: 54324 - protein, 9 aa, Homo Sapiens
RVASVMQEY

SEQ ID NO: 54325 - protein, 9 aa, Homo Sapiens
RVDELLEKY

SEQ ID NO: 54326 - protein, 9 aa, Homo Sapiens
RVDENNPEY

SEQ ID NO: 54327 - protein, 9 aa, Homo Sapiens
RVDFQGMEY

SEQ ID NO: 54328 - protein, 9 aa, Homo Sapiens
RVDFTEALY

SEQ ID NO: 54329 - protein, 9 aa, Homo Sapiens
RVDGRMLHY

SEQ ID NO: 54330 - protein, 9 aa, Homo Sapiens
RVDGRMLQY

SEQ ID NO: 54331 - protein, 9 aa, Homo Sapiens
RVDPNGSRY

SEQ ID NO: 54332 - protein, 9 aa, Homo Sapiens
RVDQSLLLY

SEQ ID NO: 54333 - protein, 9 aa, Homo Sapiens
RVDSCASMY

SEQ ID NO: 54334 - protein, 9 aa, Homo Sapiens
RVDSWTPFY

SEQ ID NO: 54335 - protein, 9 aa, Homo Sapiens
RVEEINPEY

SEQ ID NO: 54336 - protein, 9 aa, Homo Sapiens
RVEGMTELY

SEQ ID NO: 54337 - protein, 9 aa, Homo Sapiens
RVEIQNLTY

SEQ ID NO: 54338 - protein, 9 aa, Homo Sapiens
RVEKHLLVY

SEQ ID NO: 54339 - protein, 9 aa, Homo Sapiens
RVEKNLLVY

SEQ ID NO: 54340 - protein, 9 aa, Homo Sapiens
RVEKSDLKY

SEQ ID NO: 54341 - protein, 9 aa, Homo Sapiens
RVEPKVTVY

SEQ ID NO: 54342 - protein, 9 aa, Homo Sapiens
RVQDSNLEY

SEQ ID NO: 54343 - protein, 9 aa, Homo Sapiens
SADPDNLKY

SEQ ID NO: 54344 - protein, 9 aa, Homo Sapiens
SADQVALVY

SEQ ID NO: 54345 - protein, 9 aa, Homo Sapiens
SADSFQSFY

SEQ ID NO: 54346 - protein, 9 aa, Homo Sapiens
SDRSSFSHY

SEQ ID NO: 54347 - protein, 9 aa, Homo Sapiens
SLDALQTHY

SEQ ID NO: 54348 - protein, 9 aa, Homo Sapiens
SLDAPHSTY

SEQ ID NO: 54349 - protein, 9 aa, Homo Sapiens
SLDCHISQY

SEQ ID NO: 54350 - protein, 9 aa, Homo Sapiens
SLDPENPTK

SEQ ID NO: 54351 - protein, 9 aa, Homo Sapiens
SLERLQLEY

SEQ ID NO: 54352 - protein, 9 aa, Homo Sapiens
SLPGHSKPL

SEQ ID NO: 54353 - protein, 9 aa, Homo Sapiens
SMDAHPNRY

SEQ ID NO: 54354 - protein, 9 aa, Homo Sapiens
SMDAHPSRY

SEQ ID NO: 54355 - protein, 9 aa, Homo Sapiens
SSAKTILKY

SEQ ID NO: 54356 - protein, 9 aa, Homo Sapiens
SSDAHTSYY

SEQ ID NO: 54357 - protein, 9 aa, Homo Sapiens
SSDANPVRY

SEQ ID NO: 54358 - protein, 9 aa, Homo Sapiens
SSDDSKLEY

SEQ ID NO: 54359 - protein, 9 aa, Homo Sapiens
SSDGKPFEY

SEQ ID NO: 54360 - protein, 9 aa, Homo Sapiens
SSDKGRLCY

SEQ ID NO: 54361 - protein, 9 aa, Homo Sapiens
SSDKITTGY

SEQ ID NO: 54362 - protein, 9 aa, Homo Sapiens
SSDNIMVQY

SEQ ID NO: 54363 - protein, 9 aa, Homo Sapiens
SSDPQAQKY

SEQ ID NO: 54364 - protein, 9 aa, Homo Sapiens
SSDPYHSGY

SEQ ID NO: 54365 - protein, 9 aa, Homo Sapiens
SSDRHLTQY

SEQ ID NO: 54366 - protein, 9 aa, Homo Sapiens
SSDRTITEY

SEQ ID NO: 54367 - protein, 9 aa, Homo Sapiens
SSDVGHDEY

SEQ ID NO: 54368 - protein, 9 aa, Homo Sapiens
SSDVSHQEY

SEQ ID NO: 54369 - protein, 9 aa, Homo Sapiens
SSEHQTQLY

SEQ ID NO: 54370 - protein, 9 aa, Homo Sapiens
SSELFTLTY

SEQ ID NO: 54371 - protein, 9 aa, Homo Sapiens
SSEQTFMYY

SEQ ID NO: 54372 - protein, 9 aa, Homo Sapiens
SSSPTHSLY

SEQ ID NO: 54373 - protein, 9 aa, Homo Sapiens
STCRVTQTY

SEQ ID NO: 54374 - protein, 9 aa, Homo Sapiens
STDHIPILY

SEQ ID NO: 54375 - protein, 9 aa, Homo Sapiens
STDNFNCKY

SEQ ID NO: 54376 - protein, 9 aa, Homo Sapiens
STDPRPASY

SEQ ID NO: 54377 - protein, 9 aa, Homo Sapiens
STDWHVVNY

SEQ ID NO: 54378 - protein, 9 aa, Homo Sapiens
STEAFCVFY

SEQ ID NO: 54379 - protein, 9 aa, Homo Sapiens
STELNHLGY

SEQ ID NO: 54380 - protein, 9 aa, Homo Sapiens
STEQFQEYY

SEQ ID NO: 54381 - protein, 9 aa, Homo Sapiens
STQKQVLNY

SEQ ID NO: 54382 - protein, 9 aa, Homo Sapiens
STTTGHLIY

SEQ ID NO: 54383 - protein, 9 aa, Homo Sapiens
SVDPTQTEY

SEQ ID NO: 54384 - protein, 9 aa, Homo Sapiens
SVDSQILYY

SEQ ID NO: 54385 - protein, 9 aa, Homo Sapiens
SVDSVFVLY

SEQ ID NO: 54386 - protein, 9 aa, Homo Sapiens
TADGKTYYY

SEQ ID NO: 54387 - protein, 9 aa, Homo Sapiens
TADHNLLLY

SEQ ID NO: 54388 - protein, 9 aa, Homo Sapiens
TAGAQVLLR

SEQ ID NO: 54389 - protein, 9 aa, Homo Sapiens
TDKSMVDKY

SEQ ID NO: 54390 - protein, 9 aa, Homo Sapiens
TLDTKPGLY

SEQ ID NO: 54391 - protein, 9 aa, Homo Sapiens
TMDPKPLAY

SEQ ID NO: 54392 - protein, 9 aa, Homo Sapiens
TMEGGTLKY

SEQ ID NO: 54393 - protein, 9 aa, Homo Sapiens
TSCADTLRY

SEQ ID NO: 54394 - protein, 9 aa, Homo Sapiens
TSDKFRETS

SEQ ID NO: 54395 - protein, 9 aa, Homo Sapiens
TSDKPGSPY

SEQ ID NO: 54396 - protein, 9 aa, Homo Sapiens
TSDQQRQLY

SEQ ID NO: 54397 - protein, 9 aa, Homo Sapiens
TSDSTVYDY

SEQ ID NO: 54398 - protein, 9 aa, Homo Sapiens
TSERTVLRY

SEQ ID NO: 54399 - protein, 9 aa, Homo Sapiens
TSSSHTLTY

SEQ ID NO: 54400 - protein, 9 aa, Homo Sapiens
TTDFIYQLY

SEQ ID NO: 54401 - protein, 9 aa, Homo Sapiens
TTDKKSLAY

SEQ ID NO: 54402 - protein, 9 aa, Homo Sapiens
TTDKRTSFY

SEQ ID NO: 54403 - protein, 9 aa, Homo Sapiens
TTDVDSLSY

SEQ ID NO: 54404 - protein, 9 aa, Homo Sapiens
TTEVHPELY

SEQ ID NO: 54405 - protein, 9 aa, Homo Sapiens
TVDARVYSY

SEQ ID NO: 54406 - protein, 9 aa, Homo Sapiens
TVDEHVWFY

SEQ ID NO: 54407 - protein, 9 aa, Homo Sapiens
TVDRVVLLY

SEQ ID NO: 54408 - protein, 9 aa, Homo Sapiens
TVGPPPDTY

SEQ ID NO: 54409 - protein, 9 aa, Homo Sapiens
VADHRFYRY

SEQ ID NO: 54410 - protein, 9 aa, Homo Sapiens
VADKVHLMY

SEQ ID NO: 54411 - protein, 9 aa, Homo Sapiens
VADLHLYLY

SEQ ID NO: 54412 - protein, 9 aa, Homo Sapiens
VADVHQYFY

SEQ ID NO: 54413 - protein, 9 aa, Homo Sapiens
VIDKESEVY

SEQ ID NO: 54414 - protein, 9 aa, Homo Sapiens
VIDPVAPRY

SEQ ID NO: 54415 - protein, 9 aa, Homo Sapiens
VIDQQNGLY

SEQ ID NO: 54416 - protein, 9 aa, Homo Sapiens
VIDWHNYGY

SEQ ID NO: 54417 - protein, 9 aa, Homo Sapiens
VLDEAFQRY

SEQ ID NO: 54418 - protein, 9 aa, Homo Sapiens
VLDIQNNLY

SEQ ID NO: 54419 - protein, 9 aa, Homo Sapiens
VLDNPSPFY

SEQ ID NO: 54420 - protein, 9 aa, Homo Sapiens
VLDPYLLKY

SEQ ID NO: 54421 - protein, 9 aa, Homo Sapiens
VMDKMQLTY

SEQ ID NO: 54422 - protein, 9 aa, Homo Sapiens
VMEKSFLEY

SEQ ID NO: 54423 - protein, 9 aa, Homo Sapiens
VSCRITDLY

SEQ ID NO: 54424 - protein, 9 aa, Homo Sapiens
VSDKGNLMY

SEQ ID NO: 54425 - protein, 9 aa, Homo Sapiens
VSDKTLSFY

SEQ ID NO: 54426 - protein, 9 aa, Homo Sapiens
VSDPSSPQY

SEQ ID NO: 54427 - protein, 9 aa, Homo Sapiens
VSDPVGVLY

SEQ ID NO: 54428 - protein, 9 aa, Homo Sapiens
VSDRVTVLY

SEQ ID NO: 54429 - protein, 9 aa, Homo Sapiens
VSDRYRFLY

SEQ ID NO: 54430 - protein, 9 aa, Homo Sapiens
VSDSKQFTY

SEQ ID NO: 54431 - protein, 9 aa, Homo Sapiens
VSDTVVEPY

SEQ ID NO: 54432 - protein, 9 aa, Homo Sapiens
VTDGAFFDY

SEQ ID NO: 54433 - protein, 9 aa, Homo Sapiens
VTDSIRDEY

SEQ ID NO: 54434 - protein, 9 aa, Homo Sapiens
VTDTNVILS

SEQ ID NO: 54435 - protein, 9 aa, Homo Sapiens
VTEIDQDKY

SEQ ID NO: 54436 - protein, 9 aa, Homo Sapiens
VTEKDLLLY

SEQ ID NO: 54437 - protein, 9 aa, Homo Sapiens
VTELHVISY

SEQ ID NO: 54438 - protein, 9 aa, Homo Sapiens
VVDEHTGQY

SEQ ID NO: 54439 - protein, 9 aa, Homo Sapiens
VVDEIFNEY

SEQ ID NO: 54440 - protein, 9 aa, Homo Sapiens
VVDGFNVLY

SEQ ID NO: 54441 - protein, 9 aa, Homo Sapiens
VVDNLQHLY

SEQ ID NO: 54442 - protein, 9 aa, Homo Sapiens
YFGIYDTAK

SEQ ID NO: 54443 - protein, 9 aa, Homo Sapiens
YSDVHNCSY

SEQ ID NO: 54444 - protein, 9 aa, Homo Sapiens
YTDENQHQY

SEQ ID NO: 54445 - protein, 9 aa, Homo Sapiens
YTDSYTDTY

SEQ ID NO: 54446 - protein, 9 aa, Homo Sapiens
YVDPQFLTY

SEQ ID NO: 54447 - protein, 10 aa, Homo Sapiens
AIDHNQMFQY

SEQ ID NO: 54448 - protein, 10 aa, Homo Sapiens
AIDIHNKTLY

SEQ ID NO: 54449 - protein, 10 aa, Homo Sapiens
AINVNDSVTK

SEQ ID NO: 54450 - protein, 10 aa, Homo Sapiens
ALDDRLYCVY

SEQ ID NO: 54451 - protein, 10 aa, Homo Sapiens
ALDENGNLWY

SEQ ID NO: 54452 - protein, 10 aa, Homo Sapiens
ALDGGFQMHY

SEQ ID NO: 54453 - protein, 10 aa, Homo Sapiens
ALDKDAPLRY

SEQ ID NO: 54454 - protein, 10 aa, Homo Sapiens
ALDSHILDYY

SEQ ID NO: 54455 - protein, 10 aa, Homo Sapiens
ASDALDKIRY

SEQ ID NO: 54456 - protein, 10 aa, Homo Sapiens
ASDKGNLPKY

SEQ ID NO: 54457 - protein, 10 aa, Homo Sapiens
ASDNTGRYAY

SEQ ID NO: 54458 - protein, 10 aa, Homo Sapiens
ASDSGKYLCY

SEQ ID NO: 54459 - protein, 10 aa, Homo Sapiens
ASEAEMRLFY

SEQ ID NO: 54460 - protein, 10 aa, Homo Sapiens
ASEASRLAHY

SEQ ID NO: 54461 - protein, 10 aa, Homo Sapiens
ASEFGNHYLY

SEQ ID NO: 54462 - protein, 10 aa, Homo Sapiens
ASEFPGAQHY

SEQ ID NO: 54463 - protein, 10 aa, Homo Sapiens
ASEPRPFWGY

SEQ ID NO: 54464 - protein, 10 aa, Homo Sapiens
ASEPSAQLSY

SEQ ID NO: 54465 - protein, 10 aa, Homo Sapiens
ASEVCPPPGY

SEQ ID NO: 54466 - protein, 10 aa, Homo Sapiens
ASMVRSGDYY

SEQ ID NO: 54467 - protein, 10 aa, Homo Sapiens
ASSPTPPHGY

SEQ ID NO: 54468 - protein, 10 aa, Homo Sapiens
ATCHFALGEY

SEQ ID NO: 54469 - protein, 10 aa, Homo Sapiens
ATDISRQNEY

SEQ ID NO: 54470 - protein, 10 aa, Homo Sapiens
ATDLDVANFY

SEQ ID NO: 54471 - protein, 10 aa, Homo Sapiens
ATDLVVLDRY

SEQ ID NO: 54472 - protein, 10 aa, Homo Sapiens
ATDMPVKNQY

SEQ ID NO: 54473 - protein, 10 aa, Homo Sapiens
ATDPVTGDLY

SEQ ID NO: 54474 - protein, 10 aa, Homo Sapiens
ATDRFLPEGY

SEQ ID NO: 54475 - protein, 10 aa, Homo Sapiens
ATDSYKVTHY

SEQ ID NO: 54476 - protein, 10 aa, Homo Sapiens
ATDVAKGMHY

SEQ ID NO: 54477 - protein, 10 aa, Homo Sapiens
ATDWGDTQAY

SEQ ID NO: 54478 - protein, 10 aa, Homo Sapiens
ATECLPLDKY

SEQ ID NO: 54479 - protein, 10 aa, Homo Sapiens
ATEDPVLERY

SEQ ID NO: 54480 - protein, 10 aa, Homo Sapiens
ATEDPWKTNY

SEQ ID NO: 54481 - protein, 10 aa, Homo Sapiens
ATEEAPYWTY

SEQ ID NO: 54482 - protein, 10 aa, Homo Sapiens
ATENKLRLHY

SEQ ID NO: 54483 - protein, 10 aa, Homo Sapiens
ATEQAPLWAY

SEQ ID NO: 54484 - protein, 10 aa, Homo Sapiens
ATEQVSWGHY

SEQ ID NO: 54485 - protein, 10 aa, Homo Sapiens
ATNPESKVFY

SEQ ID NO: 54486 - protein, 10 aa, Homo Sapiens
AVDFAERHGY

SEQ ID NO: 54487 - protein, 10 aa, Homo Sapiens
AVDPTSGQLY

SEQ ID NO: 54488 - protein, 10 aa, Homo Sapiens
AVDTYCRHNY

SEQ ID NO: 54489 - protein, 10 aa, Homo Sapiens
AVECLNYQHY

SEQ ID NO: 54490 - protein, 10 aa, Homo Sapiens
DTIGYPVMIR

SEQ ID NO: 54491 - protein, 10 aa, Homo Sapiens
DTNADKQLSF

SEQ ID NO: 54492 - protein, 10 aa, Homo Sapiens
EENLLDFVRF

SEQ ID NO: 54493 - protein, 10 aa, Homo Sapiens
EEQLQQIRAE

SEQ ID NO: 54494 - protein, 10 aa, Homo Sapiens
EVFPLKVFGY

SEQ ID NO: 54495 - protein, 10 aa, Homo Sapiens
EYVAELGTVP

SEQ ID NO: 54496 - protein, 10 aa, Homo Sapiens
FGGETDEATR

SEQ ID NO: 54497 - protein, 10 aa, Homo Sapiens
FSGGFGARDY

SEQ ID NO: 54498 - protein, 10 aa, Homo Sapiens
FTDPRAYLKY

SEQ ID NO: 54499 - protein, 10 aa, Homo Sapiens
FTDVNSILRY

SEQ ID NO: 54500 - protein, 10 aa, Homo Sapiens
GPPPPPGKPQ

SEQ ID NO: 54501 - protein, 10 aa, Homo Sapiens
GSDAGWTLGY

SEQ ID NO: 54502 - protein, 10 aa, Homo Sapiens
GSDEPAFMYY

SEQ ID NO: 54503 - protein, 10 aa, Homo Sapiens
GSDGKLVLHY

SEQ ID NO: 54504 - protein, 10 aa, Homo Sapiens
GSDKINYTYM

SEQ ID NO: 54505 - protein, 10 aa, Homo Sapiens
GSDRSSFSHY

SEQ ID NO: 54506 - protein, 10 aa, Homo Sapiens
GSEAHVNTCY

SEQ ID NO: 54507 - protein, 10 aa, Homo Sapiens
GSSSVRPGLY

SEQ ID NO: 54508 - protein, 10 aa, Homo Sapiens
GTDDGKVGLY

SEQ ID NO: 54509 - protein, 10 aa, Homo Sapiens
GTDDGRLLEY

SEQ ID NO: 54510 - protein, 10 aa, Homo Sapiens
GTDRTENVKY

SEQ ID NO: 54511 - protein, 10 aa, Homo Sapiens
GTDSASGMDY

SEQ ID NO: 54512 - protein, 10 aa, Homo Sapiens
GTELGNELFY

SEQ ID NO: 54513 - protein, 10 aa, Homo Sapiens
GVDLTGPQLY

SEQ ID NO: 54514 - protein, 10 aa, Homo Sapiens
GVDVTGPHLY

SEQ ID NO: 54515 - protein, 10 aa, Homo Sapiens
HADSPVLMVY

SEQ ID NO: 54516 - protein, 10 aa, Homo Sapiens
HLDEAQRLLY

SEQ ID NO: 54517 - protein, 10 aa, Homo Sapiens
HLDHAQKTLY

SEQ ID NO: 54518 - protein, 10 aa, Homo Sapiens
HLDQSQKSLY

SEQ ID NO: 54519 - protein, 10 aa, Homo Sapiens
HLDSDQKLLY

SEQ ID NO: 54520 - protein, 10 aa, Homo Sapiens
HLSERADWQY

SEQ ID NO: 54521 - protein, 10 aa, Homo Sapiens
HMDTCKYVHY

SEQ ID NO: 54522 - protein, 10 aa, Homo Sapiens
HSAVNMNLHY

SEQ ID NO: 54523 - protein, 10 aa, Homo Sapiens
HSDIFPARHY

SEQ ID NO: 54524 - protein, 10 aa, Homo Sapiens
HSDLLEDSKY

SEQ ID NO: 54525 - protein, 10 aa, Homo Sapiens
HSDPRQTFLY

SEQ ID NO: 54526 - protein, 10 aa, Homo Sapiens
HSDVTEAMLY

SEQ ID NO: 54527 - protein, 10 aa, Homo Sapiens
HTDAICSVNY

SEQ ID NO: 54528 - protein, 10 aa, Homo Sapiens
HTDAVWGLAY

SEQ ID NO: 54529 - protein, 10 aa, Homo Sapiens
HTDCPGHADY

SEQ ID NO: 54530 - protein, 10 aa, Homo Sapiens
HTDDPLTWDY

SEQ ID NO: 54531 - protein, 10 aa, Homo Sapiens
HTDHHMFFDY

SEQ ID NO: 54532 - protein, 10 aa, Homo Sapiens
HTDIDAAKVY

SEQ ID NO: 54533 - protein, 10 aa, Homo Sapiens
HTDIRSQLRY

SEQ ID NO: 54534 - protein, 10 aa, Homo Sapiens
HTDPDYSAAY

SEQ ID NO: 54535 - protein, 10 aa, Homo Sapiens
HTEENSHFEY

SEQ ID NO: 54536 - protein, 10 aa, Homo Sapiens
HTELPRGDHY

SEQ ID NO: 54537 - protein, 10 aa, Homo Sapiens
HTMSSSHLFY

SEQ ID NO: 54538 - protein, 10 aa, Homo Sapiens
IADSNYNWFY

SEQ ID NO: 54539 - protein, 10 aa, Homo Sapiens
IIDAGPKGNY

SEQ ID NO: 54540 - protein, 10 aa, Homo Sapiens
IIDNIKGTEY

SEQ ID NO: 54541 - protein, 10 aa, Homo Sapiens
IIDSAGPLYY

SEQ ID NO: 54542 - protein, 10 aa, Homo Sapiens
IISMFYGVMT

SEQ ID NO: 54543 - protein, 10 aa, Homo Sapiens
ILDIPNQLYY

SEQ ID NO: 54544 - protein, 10 aa, Homo Sapiens
ILQTDVPEEK

SEQ ID NO: 54545 - protein, 10 aa, Homo Sapiens
IMDDPAGNSY

SEQ ID NO: 54546 - protein, 10 aa, Homo Sapiens
IMDPDVITGY

SEQ ID NO: 54547 - protein, 10 aa, Homo Sapiens
ISDGKEYLFY

SEQ ID NO: 54548 - protein, 10 aa, Homo Sapiens
ISDHIYGGIS

SEQ ID NO: 54549 - protein, 10 aa, Homo Sapiens
ISDPSNCSQY

SEQ ID NO: 54550 - protein, 10 aa, Homo Sapiens
ISDRYYTALY

SEQ ID NO: 54551 - protein, 10 aa, Homo Sapiens
ISDSSGVMVY

SEQ ID NO: 54552 - protein, 10 aa, Homo Sapiens
ISEAGKDLLY

SEQ ID NO: 54553 - protein, 10 aa, Homo Sapiens
ISNAQDHLLY

SEQ ID NO: 54554 - protein, 10 aa, Homo Sapiens
ISSSPTHSLY

SEQ ID NO: 54555 - protein, 10 aa, Homo Sapiens
ITDIQIPLDY

SEQ ID NO: 54556 - protein, 10 aa, Homo Sapiens
ITDPDPDIRY

SEQ ID NO: 54557 - protein, 10 aa, Homo Sapiens
ITDSAGHILY

SEQ ID NO: 54558 - protein, 10 aa, Homo Sapiens
ITDTMKFFLY

SEQ ID NO: 54559 - protein, 10 aa, Homo Sapiens
ITDVSWRLEY

SEQ ID NO: 54560 - protein, 10 aa, Homo Sapiens
ITEKVKSMQY

SEQ ID NO: 54561 - protein, 10 aa, Homo Sapiens
ITERSVLNLY

SEQ ID NO: 54562 - protein, 10 aa, Homo Sapiens
ITESNMKSRY

SEQ ID NO: 54563 - protein, 10 aa, Homo Sapiens
ITSEAPFLHY

SEQ ID NO: 54564 - protein, 10 aa, Homo Sapiens
IVDGHLQLSY

SEQ ID NO: 54565 - protein, 10 aa, Homo Sapiens
IVDKNGRLVY

SEQ ID NO: 54566 - protein, 10 aa, Homo Sapiens
KADFSTKDIY

SEQ ID NO: 54567 - protein, 10 aa, Homo Sapiens
KADIPLVVLY

SEQ ID NO: 54568 - protein, 10 aa, Homo Sapiens
KADSAVSSFY

SEQ ID NO: 54569 - protein, 10 aa, Homo Sapiens
KADVDAIHEY

SEQ ID NO: 54570 - protein, 10 aa, Homo Sapiens
KAEDFQIEGY

SEQ ID NO: 54571 - protein, 10 aa, Homo Sapiens
KGDTPSLQEY

SEQ ID NO: 54572 - protein, 10 aa, Homo Sapiens
KIADMGHLKY

SEQ ID NO: 54573 - protein, 10 aa, Homo Sapiens
KIDVPWAGQY

SEQ ID NO: 54574 - protein, 10 aa, Homo Sapiens
KLADQIFAYY

SEQ ID NO: 54575 - protein, 10 aa, Homo Sapiens
KLDDIVQHIY

SEQ ID NO: 54576 - protein, 10 aa, Homo Sapiens
KLDEDLHVKY

SEQ ID NO: 54577 - protein, 10 aa, Homo Sapiens
KLDETGNSLK

SEQ ID NO: 54578 - protein, 10 aa, Homo Sapiens
KLDGTGYGDY

SEQ ID NO: 54579 - protein, 10 aa, Homo Sapiens
KLDGTTPVRY

SEQ ID NO: 54580 - protein, 10 aa, Homo Sapiens
KLDIPTAAKY

SEQ ID NO: 54581 - protein, 10 aa, Homo Sapiens
KLDKSRLERY

SEQ ID NO: 54582 - protein, 10 aa, Homo Sapiens
KLDPHNHVLY

SEQ ID NO: 54583 - protein, 10 aa, Homo Sapiens
KLDPPGGQFY

SEQ ID NO: 54584 - protein, 10 aa, Homo Sapiens
KLDPSPQTIY

SEQ ID NO: 54585 - protein, 10 aa, Homo Sapiens
KLDRSVFTAY

SEQ ID NO: 54586 - protein, 10 aa, Homo Sapiens
KLDRTFHLSY

SEQ ID NO: 54587 - protein, 10 aa, Homo Sapiens
KLDSKELGKY

SEQ ID NO: 54588 - protein, 10 aa, Homo Sapiens
KLDSSAQFGY

SEQ ID NO: 54589 - protein, 10 aa, Homo Sapiens
KLDVTSVEDY

SEQ ID NO: 54590 - protein, 10 aa, Homo Sapiens
KLEDTENWLY

SEQ ID NO: 54591 - protein, 10 aa, Homo Sapiens
KLPEFTKSEY

SEQ ID NO: 54592 - protein, 10 aa, Homo Sapiens
KMDVSKITRY

SEQ ID NO: 54593 - protein, 10 aa, Homo Sapiens
KMMNGGHYTY

SEQ ID NO: 54594 - protein, 10 aa, Homo Sapiens
KSAPSDSLTY

SEQ ID NO: 54595 - protein, 10 aa, Homo Sapiens
KSDDHPDVVY

SEQ ID NO: 54596 - protein, 10 aa, Homo Sapiens
KSDHTDVLYY

SEQ ID NO: 54597 - protein, 10 aa, Homo Sapiens
KSDKHLYEEY

SEQ ID NO: 54598 - protein, 10 aa, Homo Sapiens
KSDLFQDDLY

SEQ ID NO: 54599 - protein, 10 aa, Homo Sapiens
KSDLFQEDLY

SEQ ID NO: 54600 - protein, 10 aa, Homo Sapiens
KSDLLQCLQY

SEQ ID NO: 54601 - protein, 10 aa, Homo Sapiens
KSDPICVLYV

SEQ ID NO: 54602 - protein, 10 aa, Homo Sapiens
KSDSGKPYYY

SEQ ID NO: 54603 - protein, 10 aa, Homo Sapiens
KSDTGKPYYY

SEQ ID NO: 54604 - protein, 10 aa, Homo Sapiens
KSDVNAIIHY

SEQ ID NO: 54605 - protein, 10 aa, Homo Sapiens
KSEAQCKNFY

SEQ ID NO: 54606 - protein, 10 aa, Homo Sapiens
KSEDFSLPAY

SEQ ID NO: 54607 - protein, 10 aa, Homo Sapiens
KSEDKVIAVY

SEQ ID NO: 54608 - protein, 10 aa, Homo Sapiens
KSEFLGFTSY

SEQ ID NO: 54609 - protein, 10 aa, Homo Sapiens
KSELSHYTFY

SEQ ID NO: 54610 - protein, 10 aa, Homo Sapiens
KSEMEMAHLY

SEQ ID NO: 54611 - protein, 10 aa, Homo Sapiens
KSENPAKRLY

SEQ ID NO: 54612 - protein, 10 aa, Homo Sapiens
KSENQVLGQY

SEQ ID NO: 54613 - protein, 10 aa, Homo Sapiens
KSETEKLLEY

SEQ ID NO: 54614 - protein, 10 aa, Homo Sapiens
KSETELKDTY

SEQ ID NO: 54615 - protein, 10 aa, Homo Sapiens
KSSESEFTQY

SEQ ID NO: 54616 - protein, 10 aa, Homo Sapiens
KSSPDMLYQY

SEQ ID NO: 54617 - protein, 10 aa, Homo Sapiens
KSSQEEVRSY

SEQ ID NO: 54618 - protein, 10 aa, Homo Sapiens
KTADGKTYYY

SEQ ID NO: 54619 - protein, 10 aa, Homo Sapiens
KTAEGDVGDY

SEQ ID NO: 54620 - protein, 10 aa, Homo Sapiens
KTAVIDHHNY

SEQ ID NO: 54621 - protein, 10 aa, Homo Sapiens
KTDDLGSLRL

SEQ ID NO: 54622 - protein, 10 aa, Homo Sapiens
KTDDLTMVLY

SEQ ID NO: 54623 - protein, 10 aa, Homo Sapiens
KTDLHNEGYI

SEQ ID NO: 54624 - protein, 10 aa, Homo Sapiens
KTDLPQSVVY

SEQ ID NO: 54625 - protein, 10 aa, Homo Sapiens
KTDMEKLTFY

SEQ ID NO: 54626 - protein, 10 aa, Homo Sapiens
KTDPGTVFVM

SEQ ID NO: 54627 - protein, 10 aa, Homo Sapiens
KTDPKDPANY

SEQ ID NO: 54628 - protein, 10 aa, Homo Sapiens
KTDRLWHDKY

SEQ ID NO: 54629 - protein, 10 aa, Homo Sapiens
KTDSEATNIY

SEQ ID NO: 54630 - protein, 10 aa, Homo Sapiens
KTDVHSPLKY

SEQ ID NO: 54631 - protein, 10 aa, Homo Sapiens
KTDVLRLVLY

SEQ ID NO: 54632 - protein, 10 aa, Homo Sapiens
KTEDDKAYAY

SEQ ID NO: 54633 - protein, 10 aa, Homo Sapiens
KTEEAIIYSY

SEQ ID NO: 54634 - protein, 10 aa, Homo Sapiens
KTEEMPQLNF

SEQ ID NO: 54635 - protein, 10 aa, Homo Sapiens
KTEETLRFLY

SEQ ID NO: 54636 - protein, 10 aa, Homo Sapiens
KTEEYVLDFY

SEQ ID NO: 54637 - protein, 10 aa, Homo Sapiens
KTEIAHSVLY

SEQ ID NO: 54638 - protein, 10 aa, Homo Sapiens
KTELQFSDYY

SEQ ID NO: 54639 - protein, 10 aa, Homo Sapiens
KTEPDNAQEY

SEQ ID NO: 54640 - protein, 10 aa, Homo Sapiens
KTEQEALEYF

SEQ ID NO: 54641 - protein, 10 aa, Homo Sapiens
KTERGSYSSY

SEQ ID NO: 54642 - protein, 10 aa, Homo Sapiens
KTEVNSGFFY

SEQ ID NO: 54643 - protein, 10 aa, Homo Sapiens
KTGKPMINLY

SEQ ID NO: 54644 - protein, 10 aa, Homo Sapiens
KTGQPMINLY

SEQ ID NO: 54645 - protein, 10 aa, Homo Sapiens
KTLGDFAAEY

SEQ ID NO: 54646 - protein, 10 aa, Homo Sapiens
KTLLDQHGQY

SEQ ID NO: 54647 - protein, 10 aa, Homo Sapiens
KTSILEQLLY

SEQ ID NO: 54648 - protein, 10 aa, Homo Sapiens
KTSMFPSLKY

SEQ ID NO: 54649 - protein, 10 aa, Homo Sapiens
KTVGEPGWLY

SEQ ID NO: 54650 - protein, 10 aa, Homo Sapiens
KVDENQKAYY

SEQ ID NO: 54651 - protein, 10 aa, Homo Sapiens
KVDEYGAKDY

SEQ ID NO: 54652 - protein, 10 aa, Homo Sapiens
KVDNQAMLHY

SEQ ID NO: 54653 - protein, 10 aa, Homo Sapiens
KVDVEQVVMY

SEQ ID NO: 54654 - protein, 10 aa, Homo Sapiens
KVEKAPQETY

SEQ ID NO: 54655 - protein, 10 aa, Homo Sapiens
KVEPFLPGHY

SEQ ID NO: 54656 - protein, 10 aa, Homo Sapiens
LDTNADKQLS

SEQ ID NO: 54657 - protein, 10 aa, Homo Sapiens
LEGLKGGHTY

SEQ ID NO: 54658 - protein, 10 aa, Homo Sapiens
LGGVAHTLQK

SEQ ID NO: 54659 - protein, 10 aa, Homo Sapiens
LIDAANGAIR

SEQ ID NO: 54660 - protein, 10 aa, Homo Sapiens
LLCGMAVGLI

SEQ ID NO: 54661 - protein, 10 aa, Homo Sapiens
LLDDAQRLLY

SEQ ID NO: 54662 - protein, 10 aa, Homo Sapiens
LLDLDEELRY

SEQ ID NO: 54663 - protein, 10 aa, Homo Sapiens
LLDNVVNCLY

SEQ ID NO: 54664 - protein, 10 aa, Homo Sapiens
LLDPSQKNLY

SEQ ID NO: 54665 - protein, 10 aa, Homo Sapiens
LLDQGQLNKY

SEQ ID NO: 54666 - protein, 10 aa, Homo Sapiens
LLDSSQKNLY

SEQ ID NO: 54667 - protein, 10 aa, Homo Sapiens
LLDTPVKTQY

SEQ ID NO: 54668 - protein, 10 aa, Homo Sapiens
LSDAKKRELY

SEQ ID NO: 54669 - protein, 10 aa, Homo Sapiens
LSDFESGLKY

SEQ ID NO: 54670 - protein, 10 aa, Homo Sapiens
LSDHLINQGY

SEQ ID NO: 54671 - protein, 10 aa, Homo Sapiens
LSDIASALRY

SEQ ID NO: 54672 - protein, 10 aa, Homo Sapiens
LSDIGSGIRY

SEQ ID NO: 54673 - protein, 10 aa, Homo Sapiens
LSDMPLKSFY

SEQ ID NO: 54674 - protein, 10 aa, Homo Sapiens
LSDPAGAIIY

SEQ ID NO: 54675 - protein, 10 aa, Homo Sapiens
LSDPSGPKSY

SEQ ID NO: 54676 - protein, 10 aa, Homo Sapiens
LSDSGVTQRY

SEQ ID NO: 54677 - protein, 10 aa, Homo Sapiens
LTAHEPPLLY

SEQ ID NO: 54678 - protein, 10 aa, Homo Sapiens
LTDARRSEDY

SEQ ID NO: 54679 - protein, 10 aa, Homo Sapiens
LTDDGNKWLY

SEQ ID NO: 54680 - protein, 10 aa, Homo Sapiens
LTDEGYEHFY

SEQ ID NO: 54681 - protein, 10 aa, Homo Sapiens
LTDEQIRFLY

SEQ ID NO: 54682 - protein, 10 aa, Homo Sapiens
LTDITKGVQY

SEQ ID NO: 54683 - protein, 10 aa, Homo Sapiens
LTDNGRHITY

SEQ ID NO: 54684 - protein, 10 aa, Homo Sapiens
LTDPDGALAK

SEQ ID NO: 54685 - protein, 10 aa, Homo Sapiens
LTDPIQGTEY

SEQ ID NO: 54686 - protein, 10 aa, Homo Sapiens
LTDYFLKDEY

SEQ ID NO: 54687 - protein, 10 aa, Homo Sapiens
LTEITKGWLY

SEQ ID NO: 54688 - protein, 10 aa, Homo Sapiens
LTEVDNYHFY

SEQ ID NO: 54689 - protein, 10 aa, Homo Sapiens
LVCNNGTHYL

SEQ ID NO: 54690 - protein, 10 aa, Homo Sapiens
LVDAFVEHRY

SEQ ID NO: 54691 - protein, 10 aa, Homo Sapiens
LVDPWTPHLY

SEQ ID NO: 54692 - protein, 10 aa, Homo Sapiens
LVDSKGFDEY

SEQ ID NO: 54693 - protein, 10 aa, Homo Sapiens
MADPGNPDLY

SEQ ID NO: 54694 - protein, 10 aa, Homo Sapiens
MGTSPLQIDR

SEQ ID NO: 54695 - protein, 10 aa, Homo Sapiens
MMDPNSTQRY

SEQ ID NO: 54696 - protein, 10 aa, Homo Sapiens
MSDHRPAMGY

SEQ ID NO: 54697 - protein, 10 aa, Homo Sapiens
MSDLLSPILY

SEQ ID NO: 54698 - protein, 10 aa, Homo Sapiens
MSDPYMPSYY

SEQ ID NO: 54699 - protein, 10 aa, Homo Sapiens
MSDSYLPSYY

SEQ ID NO: 54700 - protein, 10 aa, Homo Sapiens
MSEKLGVMTY

SEQ ID NO: 54701 - protein, 10 aa, Homo Sapiens
MSGERECLKY

SEQ ID NO: 54702 - protein, 10 aa, Homo Sapiens
MTVSSDQMAK

SEQ ID NO: 54703 - protein, 10 aa, Homo Sapiens
NAVIIPHSGW

SEQ ID NO: 54704 - protein, 10 aa, Homo Sapiens
NEHEVGEAIR

SEQ ID NO: 54705 - protein, 10 aa, Homo Sapiens
PMTLGYWDIR

SEQ ID NO: 54706 - protein, 10 aa, Homo Sapiens
PTCFQLSLIY

SEQ ID NO: 54707 - protein, 10 aa, Homo Sapiens
QGTIVLATVK

SEQ ID NO: 54708 - protein, 10 aa, Homo Sapiens
QLDSAQKNLY

SEQ ID NO: 54709 - protein, 10 aa, Homo Sapiens
QLTSENLQSK

SEQ ID NO: 54710 - protein, 10 aa, Homo Sapiens
QSDPTQSGMY

SEQ ID NO: 54711 - protein, 10 aa, Homo Sapiens
QSDPWQQELY

SEQ ID NO: 54712 - protein, 10 aa, Homo Sapiens
QTALPGNDRY

SEQ ID NO: 54713 - protein, 10 aa, Homo Sapiens
QTDCAPNNGY

SEQ ID NO: 54714 - protein, 10 aa, Homo Sapiens
QTDGCNGLRY

SEQ ID NO: 54715 - protein, 10 aa, Homo Sapiens
QTDRANRFEY

SEQ ID NO: 54716 - protein, 10 aa, Homo Sapiens
QTEICSQNKY

SEQ ID NO: 54717 - protein, 10 aa, Homo Sapiens
QTEKPTHYRY

SEQ ID NO: 54718 - protein, 10 aa, Homo Sapiens
QTETAADCRY

SEQ ID NO: 54719 - protein, 10 aa, Homo Sapiens
QTMRCLFEAY

SEQ ID NO: 54720 - protein, 10 aa, Homo Sapiens
QTVAWFPLYY

SEQ ID NO: 54721 - protein, 10 aa, Homo Sapiens
QVDPLSALKY

SEQ ID NO: 54722 - protein, 10 aa, Homo Sapiens
RADAENAMRY

SEQ ID NO: 54723 - protein, 10 aa, Homo Sapiens
RADDADEFGY

SEQ ID NO: 54724 - protein, 10 aa, Homo Sapiens
RADGNFLLYA

SEQ ID NO: 54725 - protein, 10 aa, Homo Sapiens
RADKIPPSLY

SEQ ID NO: 54726 - protein, 10 aa, Homo Sapiens
RADKSTLSTY

SEQ ID NO: 54727 - protein, 10 aa, Homo Sapiens
RADNSVFGLY

SEQ ID NO: 54728 - protein, 10 aa, Homo Sapiens
RADTQTYQPY

SEQ ID NO: 54729 - protein, 10 aa, Homo Sapiens
RAEDAMRLYY

SEQ ID NO: 54730 - protein, 10 aa, Homo Sapiens
RIASPEGQDY

SEQ ID NO: 54731 - protein, 10 aa, Homo Sapiens
RIDVSINECY

SEQ ID NO: 54732 - protein, 10 aa, Homo Sapiens
RIEDDSRCLY

SEQ ID NO: 54733 - protein, 10 aa, Homo Sapiens
RLAHEVGWKY

SEQ ID NO: 54734 - protein, 10 aa, Homo Sapiens
RLDAPVDYFY

SEQ ID NO: 54735 - protein, 10 aa, Homo Sapiens
RLDASRLLLY

SEQ ID NO: 54736 - protein, 10 aa, Homo Sapiens
RLDDVAVHYY

SEQ ID NO: 54737 - protein, 10 aa, Homo Sapiens
RLDHKFDLMY

SEQ ID NO: 54738 - protein, 10 aa, Homo Sapiens
RLDNGQVGLY

SEQ ID NO: 54739 - protein, 10 aa, Homo Sapiens
RLDPFADGFY

SEQ ID NO: 54740 - protein, 10 aa, Homo Sapiens
RLDPGESKSY

SEQ ID NO: 54741 - protein, 10 aa, Homo Sapiens
RLDPQSGALY

SEQ ID NO: 54742 - protein, 10 aa, Homo Sapiens
RLDQLEADYY

SEQ ID NO: 54743 - protein, 10 aa, Homo Sapiens
RLDSPLSNRY

SEQ ID NO: 54744 - protein, 10 aa, Homo Sapiens
RLDTPLYFSY

SEQ ID NO: 54745 - protein, 10 aa, Homo Sapiens
RLDVLVNNAY

SEQ ID NO: 54746 - protein, 10 aa, Homo Sapiens
RLEERSSEFY

SEQ ID NO: 54747 - protein, 10 aa, Homo Sapiens
RLEETARALY

SEQ ID NO: 54748 - protein, 10 aa, Homo Sapiens
RLEIEPEWAY

SEQ ID NO: 54749 - protein, 10 aa, Homo Sapiens
RLEPPSSSHY

SEQ ID NO: 54750 - protein, 10 aa, Homo Sapiens
RMDENSPLMY

SEQ ID NO: 54751 - protein, 10 aa, Homo Sapiens
RMDGTYACSY

SEQ ID NO: 54752 - protein, 10 aa, Homo Sapiens
RMDTLAHVLY

SEQ ID NO: 54753 - protein, 10 aa, Homo Sapiens
RMDVTSCISY

SEQ ID NO: 54754 - protein, 10 aa, Homo Sapiens
RQDTDSCLVY

SEQ ID NO: 54755 - protein, 10 aa, Homo Sapiens
RSAGLAFSLY

SEQ ID NO: 54756 - protein, 10 aa, Homo Sapiens
RSAGVEQLMY

SEQ ID NO: 54757 - protein, 10 aa, Homo Sapiens
RSDAEKQLLY

SEQ ID NO: 54758 - protein, 10 aa, Homo Sapiens
RSDCLGEHLY

SEQ ID NO: 54759 - protein, 10 aa, Homo Sapiens
RSDEFRPQNY

SEQ ID NO: 54760 - protein, 10 aa, Homo Sapiens
RSDGCGGSFY

SEQ ID NO: 54761 - protein, 10 aa, Homo Sapiens
RSDHEFLFHY

SEQ ID NO: 54762 - protein, 10 aa, Homo Sapiens
RSDHVKFCKY

SEQ ID NO: 54763 - protein, 10 aa, Homo Sapiens
RSDPNSESLY

SEQ ID NO: 54764 - protein, 10 aa, Homo Sapiens
RSDPTSYAGY

SEQ ID NO: 54765 - protein, 10 aa, Homo Sapiens
RSDQLLFDQY

SEQ ID NO: 54766 - protein, 10 aa, Homo Sapiens
RSDYEDPAFY

SEQ ID NO: 54767 - protein, 10 aa, Homo Sapiens
RSEAVIAQFY

SEQ ID NO: 54768 - protein, 10 aa, Homo Sapiens
RSEFASGNTY

SEQ ID NO: 54769 - protein, 10 aa, Homo Sapiens
RSESTENQSY

SEQ ID NO: 54770 - protein, 10 aa, Homo Sapiens
RSFAGNLNTY

SEQ ID NO: 54771 - protein, 10 aa, Homo Sapiens
RSMGGTLDLY

SEQ ID NO: 54772 - protein, 10 aa, Homo Sapiens
RSNPEDQILY

SEQ ID NO: 54773 - protein, 10 aa, Homo Sapiens
RSSLGGRDLY

SEQ ID NO: 54774 - protein, 10 aa, Homo Sapiens
RSSVLKDSEY

SEQ ID NO: 54775 - protein, 10 aa, Homo Sapiens
RTAQNLHNSY

SEQ ID NO: 54776 - protein, 10 aa, Homo Sapiens
RTDAILLGHY

SEQ ID NO: 54777 - protein, 10 aa, Homo Sapiens
RTDGKVFQFL

SEQ ID NO: 54778 - protein, 10 aa, Homo Sapiens
RTDGLSSCSY

SEQ ID NO: 54779 - protein, 10 aa, Homo Sapiens
RTDKSFPNAY

SEQ ID NO: 54780 - protein, 10 aa, Homo Sapiens
RTDRSGFPRY

SEQ ID NO: 54781 - protein, 10 aa, Homo Sapiens
RTDSSHQAWY

SEQ ID NO: 54782 - protein, 10 aa, Homo Sapiens
RTDTGEITSY

SEQ ID NO: 54783 - protein, 10 aa, Homo Sapiens
RTDYNASVSV

SEQ ID NO: 54784 - protein, 10 aa, Homo Sapiens
RTECGLYYSY

SEQ ID NO: 54785 - protein, 10 aa, Homo Sapiens
RTEEGPTLSY

SEQ ID NO: 54786 - protein, 10 aa, Homo Sapiens
RTEELALSHY

SEQ ID NO: 54787 - protein, 10 aa, Homo Sapiens
RTEESSAVQY

SEQ ID NO: 54788 - protein, 10 aa, Homo Sapiens
RTEEWYGTQY

SEQ ID NO: 54789 - protein, 10 aa, Homo Sapiens
RTELPQFVSY

SEQ ID NO: 54790 - protein, 10 aa, Homo Sapiens
RTEMGLYYSY

SEQ ID NO: 54791 - protein, 10 aa, Homo Sapiens
RTENGGQVMY

SEQ ID NO: 54792 - protein, 10 aa, Homo Sapiens
RTEPEQGTLY

SEQ ID NO: 54793 - protein, 10 aa, Homo Sapiens
RTHGVDHLSY

SEQ ID NO: 54794 - protein, 10 aa, Homo Sapiens
RTHLASDDLY

SEQ ID NO: 54795 - protein, 10 aa, Homo Sapiens
RTHLYGSLLY

SEQ ID NO: 54796 - protein, 10 aa, Homo Sapiens
RTMNSLKQLY

SEQ ID NO: 54797 - protein, 10 aa, Homo Sapiens
RTMSVSDFNY

SEQ ID NO: 54798 - protein, 10 aa, Homo Sapiens
RTPDLPEEEY

SEQ ID NO: 54799 - protein, 10 aa, Homo Sapiens
RTSIWDETLY

SEQ ID NO: 54800 - protein, 10 aa, Homo Sapiens
RVAEVWMDEY

SEQ ID NO: 54801 - protein, 10 aa, Homo Sapiens
RVDASSMWLY

SEQ ID NO: 54802 - protein, 10 aa, Homo Sapiens
RVDDIFSDLY

SEQ ID NO: 54803 - protein, 10 aa, Homo Sapiens
RVDEPLSCSY

SEQ ID NO: 54804 - protein, 10 aa, Homo Sapiens
RVDGRGCEDY

SEQ ID NO: 54805 - protein, 10 aa, Homo Sapiens
RVDHGLMLTY

SEQ ID NO: 54806 - protein, 10 aa, Homo Sapiens
RVDHSMMLKY

SEQ ID NO: 54807 - protein, 10 aa, Homo Sapiens
RVDPAKGLFY

SEQ ID NO: 54808 - protein, 10 aa, Homo Sapiens
RVDPIGPLSY

SEQ ID NO: 54809 - protein, 10 aa, Homo Sapiens
RVDPNGFFLY

SEQ ID NO: 54810 - protein, 10 aa, Homo Sapiens
RVDPVGPLSF

SEQ ID NO: 54811 - protein, 10 aa, Homo Sapiens
RVDQHGRVYY

SEQ ID NO: 54812 - protein, 10 aa, Homo Sapiens
RVDSAATSGY

SEQ ID NO: 54813 - protein, 10 aa, Homo Sapiens
RVDSHSKILY

SEQ ID NO: 54814 - protein, 10 aa, Homo Sapiens
RVDTQDQGMY

SEQ ID NO: 54815 - protein, 10 aa, Homo Sapiens
RVDVFTNLGY

SEQ ID NO: 54816 - protein, 10 aa, Homo Sapiens
RVSNFKPGVY

SEQ ID NO: 54817 - protein, 10 aa, Homo Sapiens
SADVPLVVEY

SEQ ID NO: 54818 - protein, 10 aa, Homo Sapiens
SDKETYELRY

SEQ ID NO: 54819 - protein, 10 aa, Homo Sapiens
SFGGSYGGSF

SEQ ID NO: 54820 - protein, 10 aa, Homo Sapiens
SKDYTFSWYK

SEQ ID NO: 54821 - protein, 10 aa, Homo Sapiens
SLDNSYKMDY

SEQ ID NO: 54822 - protein, 10 aa, Homo Sapiens
SLDVGGPLRY

SEQ ID NO: 54823 - protein, 10 aa, Homo Sapiens
SLERSSKPLA

SEQ ID NO: 54824 - protein, 10 aa, Homo Sapiens
SMESFPPLAY

SEQ ID NO: 54825 - protein, 10 aa, Homo Sapiens
SQEHPVVLTK

SEQ ID NO: 54826 - protein, 10 aa, Homo Sapiens
SSDKGRLCYY

SEQ ID NO: 54827 - protein, 10 aa, Homo Sapiens
SSDKYGDTSY

SEQ ID NO: 54828 - protein, 10 aa, Homo Sapiens
SSDNATLTHY

SEQ ID NO: 54829 - protein, 10 aa, Homo Sapiens
SSDPASQLSY

SEQ ID NO: 54830 - protein, 10 aa, Homo Sapiens
SSDSVGGFRY

SEQ ID NO: 54831 - protein, 10 aa, Homo Sapiens
STDKAEYTFY

SEQ ID NO: 54832 - protein, 10 aa, Homo Sapiens
STDKFKTDFY

SEQ ID NO: 54833 - protein, 10 aa, Homo Sapiens
STDLQDYTYY

SEQ ID NO: 54834 - protein, 10 aa, Homo Sapiens
STDPREALQY

SEQ ID NO: 54835 - protein, 10 aa, Homo Sapiens
STDPSVLGKY

SEQ ID NO: 54836 - protein, 10 aa, Homo Sapiens
STDVKGCSMY

SEQ ID NO: 54837 - protein, 10 aa, Homo Sapiens
STESMDFLKY

SEQ ID NO: 54838 - protein, 10 aa, Homo Sapiens
STETHEELLY

SEQ ID NO: 54839 - protein, 10 aa, Homo Sapiens
STGDVNVEMN

SEQ ID NO: 54840 - protein, 10 aa, Homo Sapiens
SVDPHGFISY

SEQ ID NO: 54841 - protein, 10 aa, Homo Sapiens
SVDSNLLSDY

SEQ ID NO: 54842 - protein, 10 aa, Homo Sapiens
TDRSDARLQY

SEQ ID NO: 54843 - protein, 10 aa, Homo Sapiens
TEAELLQLEK

SEQ ID NO: 54844 - protein, 10 aa, Homo Sapiens
TISSNVASKA

SEQ ID NO: 54845 - protein, 10 aa, Homo Sapiens
TLDAGKFQIY

SEQ ID NO: 54846 - protein, 10 aa, Homo Sapiens
TLDPQTGLFY

SEQ ID NO: 54847 - protein, 10 aa, Homo Sapiens
TMDNPTTTQY

SEQ ID NO: 54848 - protein, 10 aa, Homo Sapiens
TSEPKPFLYY

SEQ ID NO: 54849 - protein, 10 aa, Homo Sapiens
TTDDWKDFLY

SEQ ID NO: 54850 - protein, 10 aa, Homo Sapiens
TTDRCLLNNY

SEQ ID NO: 54851 - protein, 10 aa, Homo Sapiens
TTDSSYGQNY

SEQ ID NO: 54852 - protein, 10 aa, Homo Sapiens
TTSHLMGMFY

SEQ ID NO: 54853 - protein, 10 aa, Homo Sapiens
TVDPASLWEY

SEQ ID NO: 54854 - protein, 10 aa, Homo Sapiens
VDLSCKIEQY

SEQ ID NO: 54855 - protein, 10 aa, Homo Sapiens
VIDEVRTGTY

SEQ ID NO: 54856 - protein, 10 aa, Homo Sapiens
VIDSAELQAY

SEQ ID NO: 54857 - protein, 10 aa, Homo Sapiens
VLDVETGNEY

SEQ ID NO: 54858 - protein, 10 aa, Homo Sapiens
VMEKSFLEYY

SEQ ID NO: 54859 - protein, 10 aa, Homo Sapiens
VMLGAETEEK

SEQ ID NO: 54860 - protein, 10 aa, Homo Sapiens
VNEAACDIAR

SEQ ID NO: 54861 - protein, 10 aa, Homo Sapiens
VSDNGPCLGY

SEQ ID NO: 54862 - protein, 10 aa, Homo Sapiens
VSDSKQFTYY

SEQ ID NO: 54863 - protein, 10 aa, Homo Sapiens
VSERDVYLTY

SEQ ID NO: 54864 - protein, 10 aa, Homo Sapiens
VSNPCRPLQY

SEQ ID NO: 54865 - protein, 10 aa, Homo Sapiens
VTDDLVCLVY

SEQ ID NO: 54866 - protein, 10 aa, Homo Sapiens
VTDDSPKYNY

SEQ ID NO: 54867 - protein, 10 aa, Homo Sapiens
VTDHLGVVYY

SEQ ID NO: 54868 - protein, 10 aa, Homo Sapiens
VTDKFTESVY

SEQ ID NO: 54869 - protein, 10 aa, Homo Sapiens
VTDKSMVDKY

SEQ ID NO: 54870 - protein, 10 aa, Homo Sapiens
VTDPEKLNNY

SEQ ID NO: 54871 - protein, 10 aa, Homo Sapiens
VTDPSTLEQY

SEQ ID NO: 54872 - protein, 10 aa, Homo Sapiens
VTDQNKIVTY

SEQ ID NO: 54873 - protein, 10 aa, Homo Sapiens
VTDTGALYLY

SEQ ID NO: 54874 - protein, 10 aa, Homo Sapiens
VTDTNVILSM

SEQ ID NO: 54875 - protein, 10 aa, Homo Sapiens
VTEDGNQHVY

SEQ ID NO: 54876 - protein, 10 aa, Homo Sapiens
VVAGYGDVGK

SEQ ID NO: 54877 - protein, 10 aa, Homo Sapiens
VVDEDHELIY

SEQ ID NO: 54878 - protein, 10 aa, Homo Sapiens
VVDVPFGGAK

SEQ ID NO: 54879 - protein, 10 aa, Homo Sapiens
VVEQLKDWLY

SEQ ID NO: 54880 - protein, 10 aa, Homo Sapiens
YADPYRQLQY

SEQ ID NO: 54881 - protein, 10 aa, Homo Sapiens
YGLAAAVFTK

SEQ ID NO: 54882 - protein, 11 aa, Homo Sapiens
AATGATPIAGR

SEQ ID NO: 54883 - protein, 11 aa, Homo Sapiens
AELHLVHWNPK

SEQ ID NO: 54884 - protein, 11 aa, Homo Sapiens
ALDRTSQNDAY

SEQ ID NO: 54885 - protein, 11 aa, Homo Sapiens
ALETLGFLNHY

SEQ ID NO: 54886 - protein, 11 aa, Homo Sapiens
ALNEANLSNLK

SEQ ID NO: 54887 - protein, 11 aa, Homo Sapiens
AMDCVRAEDAY

SEQ ID NO: 54888 - protein, 11 aa, Homo Sapiens
ASDASGFSPGY

SEQ ID NO: 54889 - protein, 11 aa, Homo Sapiens
ASDKETYELRY

SEQ ID NO: 54890 - protein, 11 aa, Homo Sapiens
ASDPYVKLSLY

SEQ ID NO: 54891 - protein, 11 aa, Homo Sapiens
ASDRNIVLYDM

SEQ ID NO: 54892 - protein, 11 aa, Homo Sapiens
ASETAGSGFLY

SEQ ID NO: 54893 - protein, 11 aa, Homo Sapiens
ASQQPGHQDFY

SEQ ID NO: 54894 - protein, 11 aa, Homo Sapiens
ASYPGASVDNY

SEQ ID NO: 54895 - protein, 11 aa, Homo Sapiens
ATDTASGTGLY

SEQ ID NO: 54896 - protein, 11 aa, Homo Sapiens
ATDVAKGMHYL

SEQ ID NO: 54897 - protein, 11 aa, Homo Sapiens
ATEESDLAQQY

SEQ ID NO: 54898 - protein, 11 aa, Homo Sapiens
ATEVDSRWQEY

SEQ ID NO: 54899 - protein, 11 aa, Homo Sapiens
ATTKVGPNATY

SEQ ID NO: 54900 - protein, 11 aa, Homo Sapiens
ATVFRTVLDYY

SEQ ID NO: 54901 - protein, 11 aa, Homo Sapiens
AVDVNNMLHLY

SEQ ID NO: 54902 - protein, 11 aa, Homo Sapiens
DGWLHTGDIGK

SEQ ID NO: 54903 - protein, 11 aa, Homo Sapiens
EIIGKRGIIGY

SEQ ID NO: 54904 - protein, 11 aa, Homo Sapiens
FTERSKLIDHY

SEQ ID NO: 54905 - protein, 11 aa, Homo Sapiens
FVAVTSTNAAK

SEQ ID NO: 54906 - protein, 11 aa, Homo Sapiens
GHQQLYWSHPR

SEQ ID NO: 54907 - protein, 11 aa, Homo Sapiens
GLDKAGSTALY

SEQ ID NO: 54908 - protein, 11 aa, Homo Sapiens
GLDSANEKGLY

SEQ ID NO: 54909 - protein, 11 aa, Homo Sapiens
GSDEQLGKLVY

SEQ ID NO: 54910 - protein, 11 aa, Homo Sapiens
GSDITSITERY

SEQ ID NO: 54911 - protein, 11 aa, Homo Sapiens
GSDRFGRDLNY

SEQ ID NO: 54912 - protein, 11 aa, Homo Sapiens
GSENNSLYLYY

SEQ ID NO: 54913 - protein, 11 aa, Homo Sapiens
GSLLLTAIDRY

SEQ ID NO: 54914 - protein, 11 aa, Homo Sapiens
GTDGQGGTFRY

SEQ ID NO: 54915 - protein, 11 aa, Homo Sapiens
GTDRTGFTFKY

SEQ ID NO: 54916 - protein, 11 aa, Homo Sapiens
GTEHPNTIQEY

SEQ ID NO: 54917 - protein, 11 aa, Homo Sapiens
HLDDQMTLLQY

SEQ ID NO: 54918 - protein, 11 aa, Homo Sapiens
HLDFNLDKTLY

SEQ ID NO: 54919 - protein, 11 aa, Homo Sapiens
HLDIEAFTMDR

SEQ ID NO: 54920 - protein, 11 aa, Homo Sapiens
HLDPNSGRCFY

SEQ ID NO: 54921 - protein, 11 aa, Homo Sapiens
HLQSGSESLLY

SEQ ID NO: 54922 - protein, 11 aa, Homo Sapiens
HSDELTSLLGY

SEQ ID NO: 54923 - protein, 11 aa, Homo Sapiens
HSDSCYKLGAY

SEQ ID NO: 54924 - protein, 11 aa, Homo Sapiens
HSDVAPTHILY

SEQ ID NO: 54925 - protein, 11 aa, Homo Sapiens
HSEDYSKVPKY

SEQ ID NO: 54926 - protein, 11 aa, Homo Sapiens
HTDFGNINGCY

SEQ ID NO: 54927 - protein, 11 aa, Homo Sapiens
HTDIDAAKVYM

SEQ ID NO: 54928 - protein, 11 aa, Homo Sapiens
HTDIQEYIGCY

SEQ ID NO: 54929 - protein, 11 aa, Homo Sapiens
HTDYYAKYDRY

SEQ ID NO: 54930 - protein, 11 aa, Homo Sapiens
HTGDGMGSLIY

SEQ ID NO: 54931 - protein, 11 aa, Homo Sapiens
HTMDIPGCLLY

SEQ ID NO: 54932 - protein, 11 aa, Homo Sapiens
IIDLAGDTVRY

SEQ ID NO: 54933 - protein, 11 aa, Homo Sapiens
ILDQKASGVKY

SEQ ID NO: 54934 - protein, 11 aa, Homo Sapiens
IMDSTEAQLRY

SEQ ID NO: 54935 - protein, 11 aa, Homo Sapiens
ISDAAQLPHDY

SEQ ID NO: 54936 - protein, 11 aa, Homo Sapiens
ISDHSSVKQEY

SEQ ID NO: 54937 - protein, 11 aa, Homo Sapiens
ISEKIKEPLYY

SEQ ID NO: 54938 - protein, 11 aa, Homo Sapiens
ISEQTGKELLY

SEQ ID NO: 54939 - protein, 11 aa, Homo Sapiens
ISERNQDATVY

SEQ ID NO: 54940 - protein, 11 aa, Homo Sapiens
ISESIKELQFY

SEQ ID NO: 54941 - protein, 11 aa, Homo Sapiens
ISESLLDKCLY

SEQ ID NO: 54942 - protein, 11 aa, Homo Sapiens
ISPRDFIDLVY

SEQ ID NO: 54943 - protein, 11 aa, Homo Sapiens
ISYGPDWKDFY

SEQ ID NO: 54944 - protein, 11 aa, Homo Sapiens
ITDEEATKSSY

SEQ ID NO: 54945 - protein, 11 aa, Homo Sapiens
ITDLPDHLLSY

SEQ ID NO: 54946 - protein, 11 aa, Homo Sapiens
ITDRGGGSQHY

SEQ ID NO: 54947 - protein, 11 aa, Homo Sapiens
ITDSAGHILYS

SEQ ID NO: 54948 - protein, 11 aa, Homo Sapiens
ITGKEDAANNY

SEQ ID NO: 54949 - protein, 11 aa, Homo Sapiens
ITQIEHEVSSS

SEQ ID NO: 54950 - protein, 11 aa, Homo Sapiens
ITSPTTLYDRY

SEQ ID NO: 54951 - protein, 11 aa, Homo Sapiens
IVDGDVVHGFY

SEQ ID NO: 54952 - protein, 11 aa, Homo Sapiens
KAEDSARTLLY

SEQ ID NO: 54953 - protein, 11 aa, Homo Sapiens
KIDDLFSGKLY

SEQ ID NO: 54954 - protein, 11 aa, Homo Sapiens
KIDRHMYHSLY

SEQ ID NO: 54955 - protein, 11 aa, Homo Sapiens
KIEEGHIGVYY

SEQ ID NO: 54956 - protein, 11 aa, Homo Sapiens
KIEFYQDPLLY

SEQ ID NO: 54957 - protein, 11 aa, Homo Sapiens
KIEPPDTGLYY

SEQ ID NO: 54958 - protein, 11 aa, Homo Sapiens
KIMDSGELDFY

SEQ ID NO: 54959 - protein, 11 aa, Homo Sapiens
KISEAGKDLLY

SEQ ID NO: 54960 - protein, 11 aa, Homo Sapiens
KLDEKEQALYY

SEQ ID NO: 54961 - protein, 11 aa, Homo Sapiens
KLDGKNVKAFY

SEQ ID NO: 54962 - protein, 11 aa, Homo Sapiens
KLDKLYEACRY

SEQ ID NO: 54963 - protein, 11 aa, Homo Sapiens
KLDSSAQFGYY

SEQ ID NO: 54964 - protein, 11 aa, Homo Sapiens
KLDVDAPRLLK

SEQ ID NO: 54965 - protein, 11 aa, Homo Sapiens
KLFDLIQSELY

SEQ ID NO: 54966 - protein, 11 aa, Homo Sapiens
KLPDKTLIDLY

SEQ ID NO: 54967 - protein, 11 aa, Homo Sapiens
KMDKTGASFKY

SEQ ID NO: 54968 - protein, 11 aa, Homo Sapiens
KMDPSCTIGFY

SEQ ID NO: 54969 - protein, 11 aa, Homo Sapiens
KMDPSCTVGFY

SEQ ID NO: 54970 - protein, 11 aa, Homo Sapiens
KMMDSGQIDFY

SEQ ID NO: 54971 - protein, 11 aa, Homo Sapiens
KSDALLSKDRY

SEQ ID NO: 54972 - protein, 11 aa, Homo Sapiens
KSDDNSYDEKY

SEQ ID NO: 54973 - protein, 11 aa, Homo Sapiens
KSDEGHPFRAY

SEQ ID NO: 54974 - protein, 11 aa, Homo Sapiens
KSDHSFFKISY

SEQ ID NO: 54975 - protein, 11 aa, Homo Sapiens
KSDLHEVKQEY

SEQ ID NO: 54976 - protein, 11 aa, Homo Sapiens
KSDNAVLNQRY

SEQ ID NO: 54977 - protein, 11 aa, Homo Sapiens
KSDVEAIFSKY

SEQ ID NO: 54978 - protein, 11 aa, Homo Sapiens
KSDVETIFSKY

SEQ ID NO: 54979 - protein, 11 aa, Homo Sapiens
KSEGYNDLSLY

SEQ ID NO: 54980 - protein, 11 aa, Homo Sapiens
KSEILDETDLY

SEQ ID NO: 54981 - protein, 11 aa, Homo Sapiens
KSELKDFFQSY

SEQ ID NO: 54982 - protein, 11 aa, Homo Sapiens
KSELRAAIDRY

SEQ ID NO: 54983 - protein, 11 aa, Homo Sapiens
KSELTNLAGLY

SEQ ID NO: 54984 - protein, 11 aa, Homo Sapiens
KSEMQRHYVMY

SEQ ID NO: 54985 - protein, 11 aa, Homo Sapiens
KSEPAVVSLEY

SEQ ID NO: 54986 - protein, 11 aa, Homo Sapiens
KSESSHKGFHY

SEQ ID NO: 54987 - protein, 11 aa, Homo Sapiens
KSETGALGENY

SEQ ID NO: 54988 - protein, 11 aa, Homo Sapiens
KSFEGNVFMYY

SEQ ID NO: 54989 - protein, 11 aa, Homo Sapiens
KSMGLDETQCY

SEQ ID NO: 54990 - protein, 11 aa, Homo Sapiens
KSQICDNAALY

SEQ ID NO: 54991 - protein, 11 aa, Homo Sapiens
KSSTIYGTESY

SEQ ID NO: 54992 - protein, 11 aa, Homo Sapiens
KSWKPNHKDYY

SEQ ID NO: 54993 - protein, 11 aa, Homo Sapiens
KTDDSLEKYLY

SEQ ID NO: 54994 - protein, 11 aa, Homo Sapiens
KTDIEGTLFVY

SEQ ID NO: 54995 - protein, 11 aa, Homo Sapiens
KTDMELEVLRY

SEQ ID NO: 54996 - protein, 11 aa, Homo Sapiens
KTDMVEKALLY

SEQ ID NO: 54997 - protein, 11 aa, Homo Sapiens
KTDNRVSGKYF

SEQ ID NO: 54998 - protein, 11 aa, Homo Sapiens
KTDPVRLTQLY

SEQ ID NO: 54999 - protein, 11 aa, Homo Sapiens
KTDRDDKYFSY

SEQ ID NO: 55000 - protein, 11 aa, Homo Sapiens
KTDRVARYFEY

SEQ ID NO: 55001 - protein, 11 aa, Homo Sapiens
KTDSDSDLQLY

SEQ ID NO: 55002 - protein, 11 aa, Homo Sapiens
KTDSEATNIYL

SEQ ID NO: 55003 - protein, 11 aa, Homo Sapiens
KTDSFVPRNSY

SEQ ID NO: 55004 - protein, 11 aa, Homo Sapiens
KTDSTGTHSLY

SEQ ID NO: 55005 - protein, 11 aa, Homo Sapiens
KTDVEGTLFVY

SEQ ID NO: 55006 - protein, 11 aa, Homo Sapiens
KTEAAKGTLTY

SEQ ID NO: 55007 - protein, 11 aa, Homo Sapiens
KTEDPDLPAFY

SEQ ID NO: 55008 - protein, 11 aa, Homo Sapiens
KTEESSELGNY

SEQ ID NO: 55009 - protein, 11 aa, Homo Sapiens
KTELERAFGYY

SEQ ID NO: 55010 - protein, 11 aa, Homo Sapiens
KTELGSFFTEY

SEQ ID NO: 55011 - protein, 11 aa, Homo Sapiens
KTEMAVPGTLY

SEQ ID NO: 55012 - protein, 11 aa, Homo Sapiens
KTENEKVLTGY

SEQ ID NO: 55013 - protein, 11 aa, Homo Sapiens
KTENTKFVLRY

SEQ ID NO: 55014 - protein, 11 aa, Homo Sapiens
KTETEPVFWYY

SEQ ID NO: 55015 - protein, 11 aa, Homo Sapiens
KTETPAQSFGY

SEQ ID NO: 55016 - protein, 11 aa, Homo Sapiens
KTEVPGSVTEY

SEQ ID NO: 55017 - protein, 11 aa, Homo Sapiens
KTLLRTWSELY

SEQ ID NO: 55018 - protein, 11 aa, Homo Sapiens
KTLPADVQNYY

SEQ ID NO: 55019 - protein, 11 aa, Homo Sapiens
KTQEPDNLLFY

SEQ ID NO: 55020 - protein, 11 aa, Homo Sapiens
KTSARDAALAY

SEQ ID NO: 55021 - protein, 11 aa, Homo Sapiens
KTSSWNLDCRY

SEQ ID NO: 55022 - protein, 11 aa, Homo Sapiens
KTTSAEIRSLY

SEQ ID NO: 55023 - protein, 11 aa, Homo Sapiens
KTWNIGKCELY

SEQ ID NO: 55024 - protein, 11 aa, Homo Sapiens
KVDDDFTAQDY

SEQ ID NO: 55025 - protein, 11 aa, Homo Sapiens
KVDDYEHAAKY

SEQ ID NO: 55026 - protein, 11 aa, Homo Sapiens
KVDGEIILHLY

SEQ ID NO: 55027 - protein, 11 aa, Homo Sapiens
KVDKATRDLLY

SEQ ID NO: 55028 - protein, 11 aa, Homo Sapiens
KVDSDDQWGEY

SEQ ID NO: 55029 - protein, 11 aa, Homo Sapiens
LEVDPNIQAVR

SEQ ID NO: 55030 - protein, 11 aa, Homo Sapiens
LIIFADCDLNK

SEQ ID NO: 55031 - protein, 11 aa, Homo Sapiens
LLDPKYGMFRY

SEQ ID NO: 55032 - protein, 11 aa, Homo Sapiens
LSDDHGASWRY

SEQ ID NO: 55033 - protein, 11 aa, Homo Sapiens
LSEPEEAAALY

SEQ ID NO: 55034 - protein, 11 aa, Homo Sapiens
LSEVNRTGTQY

SEQ ID NO: 55035 - protein, 11 aa, Homo Sapiens
LTDDHVQFLIY

SEQ ID NO: 55036 - protein, 11 aa, Homo Sapiens
LTDHTVTFLQY

SEQ ID NO: 55037 - protein, 11 aa, Homo Sapiens
LTDIHGNVLQY

SEQ ID NO: 55038 - protein, 11 aa, Homo Sapiens
LTDKDTGVTRY

SEQ ID NO: 55039 - protein, 11 aa, Homo Sapiens
LTDLVDDNYFY

SEQ ID NO: 55040 - protein, 11 aa, Homo Sapiens
LTDNLKVGSFY

SEQ ID NO: 55041 - protein, 11 aa, Homo Sapiens
LTGLTVAEYFR

SEQ ID NO: 55042 - protein, 11 aa, Homo Sapiens
LTSQGAGTYWY

SEQ ID NO: 55043 - protein, 11 aa, Homo Sapiens
MEAEATALLSD

SEQ ID NO: 55044 - protein, 11 aa, Homo Sapiens
MSDSDKVGVFY

SEQ ID NO: 55045 - protein, 11 aa, Homo Sapiens
MTDRVGKAFKY

SEQ ID NO: 55046 - protein, 11 aa, Homo Sapiens
NSGKEEGFELY

SEQ ID NO: 55047 - protein, 11 aa, Homo Sapiens
PMFIVNTNVPR

SEQ ID NO: 55048 - protein, 11 aa, Homo Sapiens
QLDVAGRVMQY

SEQ ID NO: 55049 - protein, 11 aa, Homo Sapiens
QLEDGRTLSDY

SEQ ID NO: 55050 - protein, 11 aa, Homo Sapiens
QTDIQGALSAY

SEQ ID NO: 55051 - protein, 11 aa, Homo Sapiens
QTETGTPYMLY

SEQ ID NO: 55052 - protein, 11 aa, Homo Sapiens
RADITDVMDAY

SEQ ID NO: 55053 - protein, 11 aa, Homo Sapiens
RADKSAVGFDY

SEQ ID NO: 55054 - protein, 11 aa, Homo Sapiens
RADPEAGLLLY

SEQ ID NO: 55055 - protein, 11 aa, Homo Sapiens
RAEGYPVDLYY

SEQ ID NO: 55056 - protein, 11 aa, Homo Sapiens
RAFDQGADAIY

SEQ ID NO: 55057 - protein, 11 aa, Homo Sapiens
RASAALLDKLY

SEQ ID NO: 55058 - protein, 11 aa, Homo Sapiens
RASLSDRTNLY

SEQ ID NO: 55059 - protein, 11 aa, Homo Sapiens
RIDDNGWGCAY

SEQ ID NO: 55060 - protein, 11 aa, Homo Sapiens
RIDPFVRTFLK

SEQ ID NO: 55061 - protein, 11 aa, Homo Sapiens
RIDTRNELESY

SEQ ID NO: 55062 - protein, 11 aa, Homo Sapiens
RIEEGTYGVVY

SEQ ID NO: 55063 - protein, 11 aa, Homo Sapiens
RIEPPDRRWQY

SEQ ID NO: 55064 - protein, 11 aa, Homo Sapiens
RLAQEGIYTLY

SEQ ID NO: 55065 - protein, 11 aa, Homo Sapiens
RLDHKFDLMYA

SEQ ID NO: 55066 - protein, 11 aa, Homo Sapiens
RLDLEDVKNMY

SEQ ID NO: 55067 - protein, 11 aa, Homo Sapiens
RLEDPDGKVLY

SEQ ID NO: 55068 - protein, 11 aa, Homo Sapiens
RLEPNAQAQMY

SEQ ID NO: 55069 - protein, 11 aa, Homo Sapiens
RLEPNLQAQMY

SEQ ID NO: 55070 - protein, 11 aa, Homo Sapiens
RLETELDGLRY

SEQ ID NO: 55071 - protein, 11 aa, Homo Sapiens
RLIAQRYLLQY

SEQ ID NO: 55072 - protein, 11 aa, Homo Sapiens
RLYEHIKNDKY

SEQ ID NO: 55073 - protein, 11 aa, Homo Sapiens
RMDKSAVGHEY

SEQ ID NO: 55074 - protein, 11 aa, Homo Sapiens
RMDPLTKPMQY

SEQ ID NO: 55075 - protein, 11 aa, Homo Sapiens
RMDSTNADALY

SEQ ID NO: 55076 - protein, 11 aa, Homo Sapiens
RMDTLAHVLYY

SEQ ID NO: 55077 - protein, 11 aa, Homo Sapiens
RMDYYNALNLY

SEQ ID NO: 55078 - protein, 11 aa, Homo Sapiens
RQDLPSPSDFY

SEQ ID NO: 55079 - protein, 11 aa, Homo Sapiens
RSADEGQTVFY

SEQ ID NO: 55080 - protein, 11 aa, Homo Sapiens
RSDDGQIFAKY

SEQ ID NO: 55081 - protein, 11 aa, Homo Sapiens
RSDGKSVDLKY

SEQ ID NO: 55082 - protein, 11 aa, Homo Sapiens
RSDIEDEQLAY

SEQ ID NO: 55083 - protein, 11 aa, Homo Sapiens
RSDPGGGGLAY

SEQ ID NO: 55084 - protein, 11 aa, Homo Sapiens
RSDPGTSGEAY

SEQ ID NO: 55085 - protein, 11 aa, Homo Sapiens
RSDPNSESLYF

SEQ ID NO: 55086 - protein, 11 aa, Homo Sapiens
RSDSLYPAPGY

SEQ ID NO: 55087 - protein, 11 aa, Homo Sapiens
RSDSTGSSSVY

SEQ ID NO: 55088 - protein, 11 aa, Homo Sapiens
RSDSYVELSQY

SEQ ID NO: 55089 - protein, 11 aa, Homo Sapiens
RSDTEQEGKYY

SEQ ID NO: 55090 - protein, 11 aa, Homo Sapiens
RSEDFDIYTLY

SEQ ID NO: 55091 - protein, 11 aa, Homo Sapiens
RSEDSPDILTY

SEQ ID NO: 55092 - protein, 11 aa, Homo Sapiens
RSEGTPEKPLY

SEQ ID NO: 55093 - protein, 11 aa, Homo Sapiens
RSESYIGGNCY

SEQ ID NO: 55094 - protein, 11 aa, Homo Sapiens
RSETPSRYYCY

SEQ ID NO: 55095 - protein, 11 aa, Homo Sapiens
RSEWTDELNTY

SEQ ID NO: 55096 - protein, 11 aa, Homo Sapiens
RSGGHLMNLKY

SEQ ID NO: 55097 - protein, 11 aa, Homo Sapiens
RSMDSYLNQSY

SEQ ID NO: 55098 - protein, 11 aa, Homo Sapiens
RTAADNFSTQY

SEQ ID NO: 55099 - protein, 11 aa, Homo Sapiens
RTAPRFGLYRY

SEQ ID NO: 55100 - protein, 11 aa, Homo Sapiens
RTDDYLDQPCY

SEQ ID NO: 55101 - protein, 11 aa, Homo Sapiens
RTDFQKDFAKY

SEQ ID NO: 55102 - protein, 11 aa, Homo Sapiens
RTDILCNLPSY

SEQ ID NO: 55103 - protein, 11 aa, Homo Sapiens
RTDKAEVVNGY

SEQ ID NO: 55104 - protein, 11 aa, Homo Sapiens
RTDRLEVCREY

SEQ ID NO: 55105 - protein, 11 aa, Homo Sapiens
RTDSREAFEAY

SEQ ID NO: 55106 - protein, 11 aa, Homo Sapiens
RTDYSFHKFHY

SEQ ID NO: 55107 - protein, 11 aa, Homo Sapiens
RTECGLYYSYY

SEQ ID NO: 55108 - protein, 11 aa, Homo Sapiens
RTEEVKHVDFY

SEQ ID NO: 55109 - protein, 11 aa, Homo Sapiens
RTEIIEDLAFY

SEQ ID NO: 55110 - protein, 11 aa, Homo Sapiens
RTELAIKLLEY

SEQ ID NO: 55111 - protein, 11 aa, Homo Sapiens
RTELFDLKTKY

SEQ ID NO: 55112 - protein, 11 aa, Homo Sapiens
RTEPGWSFCEY

SEQ ID NO: 55113 - protein, 11 aa, Homo Sapiens
RTEPINTTYSY

SEQ ID NO: 55114 - protein, 11 aa, Homo Sapiens
RTERQQRDLAY

SEQ ID NO: 55115 - protein, 11 aa, Homo Sapiens
RTESELNSYNY

SEQ ID NO: 55116 - protein, 11 aa, Homo Sapiens
RTETNGGQVTY

SEQ ID NO: 55117 - protein, 11 aa, Homo Sapiens
RTFGCDDELMY

SEQ ID NO: 55118 - protein, 11 aa, Homo Sapiens
RTSVDFKDTDY

SEQ ID NO: 55119 - protein, 11 aa, Homo Sapiens
RVDDIFSDLYY

SEQ ID NO: 55120 - protein, 11 aa, Homo Sapiens
RVDGNDVFAVY

SEQ ID NO: 55121 - protein, 11 aa, Homo Sapiens
RVDGSKPIWKY

SEQ ID NO: 55122 - protein, 11 aa, Homo Sapiens
RVDKSAVGFDY

SEQ ID NO: 55123 - protein, 11 aa, Homo Sapiens
RVDPAKGLFYF

SEQ ID NO: 55124 - protein, 11 aa, Homo Sapiens
RVDQSAVGFEY

SEQ ID NO: 55125 - protein, 11 aa, Homo Sapiens
RVESSEFGTYY

SEQ ID NO: 55126 - protein, 11 aa, Homo Sapiens
RVETEYSFLDY

SEQ ID NO: 55127 - protein, 11 aa, Homo Sapiens
RVETQNHWFTY

SEQ ID NO: 55128 - protein, 11 aa, Homo Sapiens
SAEKTDSSYFY

SEQ ID NO: 55129 - protein, 11 aa, Homo Sapiens
SAELNKEVSTN

SEQ ID NO: 55130 - protein, 11 aa, Homo Sapiens
SLDGDLAGRYY

SEQ ID NO: 55131 - protein, 11 aa, Homo Sapiens
SSDGAISLLTY

SEQ ID NO: 55132 - protein, 11 aa, Homo Sapiens
SSDPEEESVLY

SEQ ID NO: 55133 - protein, 11 aa, Homo Sapiens
SSDTADFRDLY

SEQ ID NO: 55134 - protein, 11 aa, Homo Sapiens
SSKASNSKQDY

SEQ ID NO: 55135 - protein, 11 aa, Homo Sapiens
STDVSDLLHQY

SEQ ID NO: 55136 - protein, 11 aa, Homo Sapiens
STDVSQPPHVY

SEQ ID NO: 55137 - protein, 11 aa, Homo Sapiens
SWGSGLDMHTK

SEQ ID NO: 55138 - protein, 11 aa, Homo Sapiens
TIDKATGILLY

SEQ ID NO: 55139 - protein, 11 aa, Homo Sapiens
TSDNGKDGLAY

SEQ ID NO: 55140 - protein, 11 aa, Homo Sapiens
TSETPDYLLKY

SEQ ID NO: 55141 - protein, 11 aa, Homo Sapiens
TSSEITTKDLK

SEQ ID NO: 55142 - protein, 11 aa, Homo Sapiens
TTDLFGRDLSY

SEQ ID NO: 55143 - protein, 11 aa, Homo Sapiens
TVERIHVGKKY

SEQ ID NO: 55144 - protein, 11 aa, Homo Sapiens
VADRLGSLMQY

SEQ ID NO: 55145 - protein, 11 aa, Homo Sapiens
VIDPESGNTLY

SEQ ID NO: 55146 - protein, 11 aa, Homo Sapiens
VLDLSENQLQK

SEQ ID NO: 55147 - protein, 11 aa, Homo Sapiens
VSDRDRNLMVY

SEQ ID NO: 55148 - protein, 11 aa, Homo Sapiens
VSEGTKAVTKY

SEQ ID NO: 55149 - protein, 11 aa, Homo Sapiens
VSSSDDKDAFY

SEQ ID NO: 55150 - protein, 11 aa, Homo Sapiens
VSSSDVGHDEY

SEQ ID NO: 55151 - protein, 11 aa, Homo Sapiens
VTAQVVGTERY

SEQ ID NO: 55152 - protein, 11 aa, Homo Sapiens
VTDGAILGKLY

SEQ ID NO: 55153 - protein, 11 aa, Homo Sapiens
VTDRKCSELLY

SEQ ID NO: 55154 - protein, 11 aa, Homo Sapiens
VTDRSDARLQY

SEQ ID NO: 55155 - protein, 11 aa, Homo Sapiens
VTDSGPTFNYL

SEQ ID NO: 55156 - protein, 11 aa, Homo Sapiens
VTECEKYAQLY

SEQ ID NO: 55157 - protein, 11 aa, Homo Sapiens
VTEFEDIKSGY

SEQ ID NO: 55158 - protein, 11 aa, Homo Sapiens
VTEITDDLHFY

SEQ ID NO: 55159 - protein, 11 aa, Homo Sapiens
VTEKIPVRHLY

SEQ ID NO: 55160 - protein, 11 aa, Homo Sapiens
VTESPAKFALY

SEQ ID NO: 55161 - protein, 11 aa, Homo Sapiens
VVDIQGVGDLY

SEQ ID NO: 55162 - protein, 11 aa, Homo Sapiens
VVDPFSKKDWY

SEQ ID NO: 55163 - protein, 11 aa, Homo Sapiens
YLLGTSLARPC

SEQ ID NO: 55164 - protein, 11 aa, Homo Sapiens
YSGLLLPDAQY

SEQ ID NO: 55165 - protein, 11 aa, Homo Sapiens
YTDHQNSSSYY

SEQ ID NO: 55166 - protein, 8 aa, Homo Sapiens
AAFVQTHR

SEQ ID NO: 55167 - protein, 8 aa, Homo Sapiens
AAKDLVTR

SEQ ID NO: 55168 - protein, 8 aa, Homo Sapiens
AFNSGKVD

SEQ ID NO: 55169 - protein, 8 aa, Homo Sapiens
AIKGMHIR

SEQ ID NO: 55170 - protein, 8 aa, Homo Sapiens
DAKRLIGR

SEQ ID NO: 55171 - protein, 8 aa, Homo Sapiens
DLKNELQR

SEQ ID NO: 55172 - protein, 8 aa, Homo Sapiens
DSYSGLGR

SEQ ID NO: 55173 - protein, 8 aa, Homo Sapiens
DTVATLPR

SEQ ID NO: 55174 - protein, 8 aa, Homo Sapiens
DVRIGMTR

SEQ ID NO: 55175 - protein, 8 aa, Homo Sapiens
DVYLGRYR

SEQ ID NO: 55176 - protein, 8 aa, Homo Sapiens
EAFVGAER

SEQ ID NO: 55177 - protein, 8 aa, Homo Sapiens
ELFLAGRR

SEQ ID NO: 55178 - protein, 8 aa, Homo Sapiens
EPGVHLGR

SEQ ID NO: 55179 - protein, 8 aa, Homo Sapiens
ETFVSLHR

SEQ ID NO: 55180 - protein, 8 aa, Homo Sapiens
ETVVGLAR

SEQ ID NO: 55181 - protein, 8 aa, Homo Sapiens
EVFPGRNR

SEQ ID NO: 55182 - protein, 8 aa, Homo Sapiens
FEVDTVAP

SEQ ID NO: 55183 - protein, 8 aa, Homo Sapiens
FNEKSKEL

SEQ ID NO: 55184 - protein, 8 aa, Homo Sapiens
FTYVGGPR

SEQ ID NO: 55185 - protein, 8 aa, Homo Sapiens
GPREAGLR

SEQ ID NO: 55186 - protein, 8 aa, Homo Sapiens
IEEHLANR

SEQ ID NO: 55187 - protein, 8 aa, Homo Sapiens
IEKPPAER

SEQ ID NO: 55188 - protein, 8 aa, Homo Sapiens
LNNMRSQY

SEQ ID NO: 55189 - protein, 8 aa, Homo Sapiens
MDSSLTRR

SEQ ID NO: 55190 - protein, 8 aa, Homo Sapiens
MSLTACKV

SEQ ID NO: 55191 - protein, 8 aa, Homo Sapiens
PAISPSKR

SEQ ID NO: 55192 - protein, 8 aa, Homo Sapiens
PDAVGKCR

SEQ ID NO: 55193 - protein, 8 aa, Homo Sapiens
PGPRPLAR

SEQ ID NO: 55194 - protein, 8 aa, Homo Sapiens
PINGNGKQ

SEQ ID NO: 55195 - protein, 8 aa, Homo Sapiens
PIVTPALR

SEQ ID NO: 55196 - protein, 8 aa, Homo Sapiens
PLFIGKVR

SEQ ID NO: 55197 - protein, 8 aa, Homo Sapiens
PQVGNGFR

SEQ ID NO: 55198 - protein, 8 aa, Homo Sapiens
PRRASVTR

SEQ ID NO: 55199 - protein, 8 aa, Homo Sapiens
QEKAIEAS

SEQ ID NO: 55200 - protein, 8 aa, Homo Sapiens
SAQTLTGR

SEQ ID NO: 55201 - protein, 8 aa, Homo Sapiens
SFSKAFGQ

SEQ ID NO: 55202 - protein, 8 aa, Homo Sapiens
SPLTAEKL

SEQ ID NO: 55203 - protein, 8 aa, Homo Sapiens
STFNGFQR

SEQ ID NO: 55204 - protein, 8 aa, Homo Sapiens
SVLGPNAR

SEQ ID NO: 55205 - protein, 8 aa, Homo Sapiens
TFSGVYKK

SEQ ID NO: 55206 - protein, 8 aa, Homo Sapiens
TLNQGEFK

SEQ ID NO: 55207 - protein, 8 aa, Homo Sapiens
TSLYRQPR

SEQ ID NO: 55208 - protein, 8 aa, Homo Sapiens
TVTGKLER

SEQ ID NO: 55209 - protein, 8 aa, Homo Sapiens
VAAVAARR

SEQ ID NO: 55210 - protein, 8 aa, Homo Sapiens
VATLPRGR

SEQ ID NO: 55211 - protein, 8 aa, Homo Sapiens
VFSHILKR

SEQ ID NO: 55212 - protein, 8 aa, Homo Sapiens
VHAVVTVR

SEQ ID NO: 55213 - protein, 8 aa, Homo Sapiens
VKGPGLQR

SEQ ID NO: 55214 - protein, 8 aa, Homo Sapiens
VLPKPRMR

SEQ ID NO: 55215 - protein, 8 aa, Homo Sapiens
VSHPIIYR

SEQ ID NO: 55216 - protein, 8 aa, Homo Sapiens
VTAPPARN

SEQ ID NO: 55217 - protein, 8 aa, Homo Sapiens
VVVSGKLR

SEQ ID NO: 55218 - protein, 9 aa, Homo Sapiens
AAAAPSLAR

SEQ ID NO: 55219 - protein, 9 aa, Homo Sapiens
AAADVGLTR

SEQ ID NO: 55220 - protein, 9 aa, Homo Sapiens
AAAGAFAGR

SEQ ID NO: 55221 - protein, 9 aa, Homo Sapiens
AAAGLAGPR

SEQ ID NO: 55222 - protein, 9 aa, Homo Sapiens
AAANPTLAF

SEQ ID NO: 55223 - protein, 9 aa, Homo Sapiens
AAAVPTTPR

SEQ ID NO: 55224 - protein, 9 aa, Homo Sapiens
AAIGPTTAR

SEQ ID NO: 55225 - protein, 9 aa, Homo Sapiens
AALTRPEEL

SEQ ID NO: 55226 - protein, 9 aa, Homo Sapiens
ACIGGTNVR

SEQ ID NO: 55227 - protein, 9 aa, Homo Sapiens
AEVLGLILR

SEQ ID NO: 55228 - protein, 9 aa, Homo Sapiens
AIIGPRSTR

SEQ ID NO: 55229 - protein, 9 aa, Homo Sapiens
ALYEYARRR

SEQ ID NO: 55230 - protein, 9 aa, Homo Sapiens
APAAPAAPR

SEQ ID NO: 55231 - protein, 9 aa, Homo Sapiens
ATAELIMSR

SEQ ID NO: 55232 - protein, 9 aa, Homo Sapiens
ATAEVGYNR

SEQ ID NO: 55233 - protein, 9 aa, Homo Sapiens
ATAGFTIGR

SEQ ID NO: 55234 - protein, 9 aa, Homo Sapiens
ATIDSLASR

SEQ ID NO: 55235 - protein, 9 aa, Homo Sapiens
ATIQGAYAR

SEQ ID NO: 55236 - protein, 9 aa, Homo Sapiens
ATIVPRTER

SEQ ID NO: 55237 - protein, 9 aa, Homo Sapiens
ATSGVVAVR

SEQ ID NO: 55238 - protein, 9 aa, Homo Sapiens
ATSPGRLFR

SEQ ID NO: 55239 - protein, 9 aa, Homo Sapiens
ATSPVVYTR

SEQ ID NO: 55240 - protein, 9 aa, Homo Sapiens
ATTPIFANR

SEQ ID NO: 55241 - protein, 9 aa, Homo Sapiens
AVAAVAARR

SEQ ID NO: 55242 - protein, 9 aa, Homo Sapiens
AVAGRWGCR

SEQ ID NO: 55243 - protein, 9 aa, Homo Sapiens
AVAPPAGPR

SEQ ID NO: 55244 - protein, 9 aa, Homo Sapiens
AVIDAGVCR

SEQ ID NO: 55245 - protein, 9 aa, Homo Sapiens
AVIDVGINR

SEQ ID NO: 55246 - protein, 9 aa, Homo Sapiens
AVIFINTRR

SEQ ID NO: 55247 - protein, 9 aa, Homo Sapiens
AVIGIATKR

SEQ ID NO: 55248 - protein, 9 aa, Homo Sapiens
AVIGYLSTR

SEQ ID NO: 55249 - protein, 9 aa, Homo Sapiens
AVISGVGTR

SEQ ID NO: 55250 - protein, 9 aa, Homo Sapiens
AVISQCIYR

SEQ ID NO: 55251 - protein, 9 aa, Homo Sapiens
AVKPGVRYR

SEQ ID NO: 55252 - protein, 9 aa, Homo Sapiens
AVPGTSSPR

SEQ ID NO: 55253 - protein, 9 aa, Homo Sapiens
AVRPGDRVL

SEQ ID NO: 55254 - protein, 9 aa, Homo Sapiens
AVTAFVTFR

SEQ ID NO: 55255 - protein, 9 aa, Homo Sapiens
AVTPPGLAR

SEQ ID NO: 55256 - protein, 9 aa, Homo Sapiens
AVVAGGLGR

SEQ ID NO: 55257 - protein, 9 aa, Homo Sapiens
AVVPNTSSR

SEQ ID NO: 55258 - protein, 9 aa, Homo Sapiens
AVYDFFIGR

SEQ ID NO: 55259 - protein, 9 aa, Homo Sapiens
CAISYTSYR

SEQ ID NO: 55260 - protein, 9 aa, Homo Sapiens
CPAPPGYLR

SEQ ID NO: 55261 - protein, 9 aa, Homo Sapiens
CTFGFSARR

SEQ ID NO: 55262 - protein, 9 aa, Homo Sapiens
CTTSAIQNR

SEQ ID NO: 55263 - protein, 9 aa, Homo Sapiens
CVNKSTHEF

SEQ ID NO: 55264 - protein, 9 aa, Homo Sapiens
CVSPTVNQR

SEQ ID NO: 55265 - protein, 9 aa, Homo Sapiens
DAAALVAGR

SEQ ID NO: 55266 - protein, 9 aa, Homo Sapiens
DAACRVIAR

SEQ ID NO: 55267 - protein, 9 aa, Homo Sapiens
DAAGVFCIR

SEQ ID NO: 55268 - protein, 9 aa, Homo Sapiens
DAAIVGAVR

SEQ ID NO: 55269 - protein, 9 aa, Homo Sapiens
DAAKDSILR

SEQ ID NO: 55270 - protein, 9 aa, Homo Sapiens
DAASPTLLL

SEQ ID NO: 55271 - protein, 9 aa, Homo Sapiens
DAGPPTHAF

SEQ ID NO: 55272 - protein, 9 aa, Homo Sapiens
DAIAVHVVR

SEQ ID NO: 55273 - protein, 9 aa, Homo Sapiens
DAIEKAVSR

SEQ ID NO: 55274 - protein, 9 aa, Homo Sapiens
DAIEQTFQR

SEQ ID NO: 55275 - protein, 9 aa, Homo Sapiens
DAILASSAR

SEQ ID NO: 55276 - protein, 9 aa, Homo Sapiens
DAIRGGLPK

SEQ ID NO: 55277 - protein, 9 aa, Homo Sapiens
DAISYRFPR

SEQ ID NO: 55278 - protein, 9 aa, Homo Sapiens
DAKGGSFYR

SEQ ID NO: 55279 - protein, 9 aa, Homo Sapiens
DALGGLLNR

SEQ ID NO: 55280 - protein, 9 aa, Homo Sapiens
DAQKPSLTR

SEQ ID NO: 55281 - protein, 9 aa, Homo Sapiens
DARGTVVLR

SEQ ID NO: 55282 - protein, 9 aa, Homo Sapiens
DATPLHVAR

SEQ ID NO: 55283 - protein, 9 aa, Homo Sapiens
DAVDVFETR

SEQ ID NO: 55284 - protein, 9 aa, Homo Sapiens
DAVEDRLDR

SEQ ID NO: 55285 - protein, 9 aa, Homo Sapiens
DAVNLAFGR

SEQ ID NO: 55286 - protein, 9 aa, Homo Sapiens
DAWPGQRER

SEQ ID NO: 55287 - protein, 9 aa, Homo Sapiens
DFGKVTMQF

SEQ ID NO: 55288 - protein, 9 aa, Homo Sapiens
DIFKKSKPR

SEQ ID NO: 55289 - protein, 9 aa, Homo Sapiens
DIFNQVVPR

SEQ ID NO: 55290 - protein, 9 aa, Homo Sapiens
DIFPKVTCR

SEQ ID NO: 55291 - protein, 9 aa, Homo Sapiens
DIIAKVTRR

SEQ ID NO: 55292 - protein, 9 aa, Homo Sapiens
DIIATPGPR

SEQ ID NO: 55293 - protein, 9 aa, Homo Sapiens
DIIEKVMAR

SEQ ID NO: 55294 - protein, 9 aa, Homo Sapiens
DIIPNPQER

SEQ ID NO: 55295 - protein, 9 aa, Homo Sapiens
DIIQPSSTR

SEQ ID NO: 55296 - protein, 9 aa, Homo Sapiens
DIMAAVSGR

SEQ ID NO: 55297 - protein, 9 aa, Homo Sapiens
DIMDSSLTR

SEQ ID NO: 55298 - protein, 9 aa, Homo Sapiens
DIMPSGRSR

SEQ ID NO: 55299 - protein, 9 aa, Homo Sapiens
DIPDALSER

SEQ ID NO: 55300 - protein, 9 aa, Homo Sapiens
DIQDPGVPR

SEQ ID NO: 55301 - protein, 9 aa, Homo Sapiens
DIQIVSTTR

SEQ ID NO: 55302 - protein, 9 aa, Homo Sapiens
DIQPPITPR

SEQ ID NO: 55303 - protein, 9 aa, Homo Sapiens
DISILTTGM

SEQ ID NO: 55304 - protein, 9 aa, Homo Sapiens
DISTAMSER

SEQ ID NO: 55305 - protein, 9 aa, Homo Sapiens
DITEPSIGR

SEQ ID NO: 55306 - protein, 9 aa, Homo Sapiens
DITTPKAAR

SEQ ID NO: 55307 - protein, 9 aa, Homo Sapiens
DIVKPGMRR

SEQ ID NO: 55308 - protein, 9 aa, Homo Sapiens
DIVTVGECR

SEQ ID NO: 55309 - protein, 9 aa, Homo Sapiens
DIYDHCQSR

SEQ ID NO: 55310 - protein, 9 aa, Homo Sapiens
DIYFNPKTR

SEQ ID NO: 55311 - protein, 9 aa, Homo Sapiens
DLIAIVSNR

SEQ ID NO: 55312 - protein, 9 aa, Homo Sapiens
DLIFKTGGR

SEQ ID NO: 55313 - protein, 9 aa, Homo Sapiens
DLIGCIIGR

SEQ ID NO: 55314 - protein, 9 aa, Homo Sapiens
DLIPPPVCR

SEQ ID NO: 55315 - protein, 9 aa, Homo Sapiens
DMFATPQYR

SEQ ID NO: 55316 - protein, 9 aa, Homo Sapiens
DPFHKAIRR

SEQ ID NO: 55317 - protein, 9 aa, Homo Sapiens
DPNKPSGFR

SEQ ID NO: 55318 - protein, 9 aa, Homo Sapiens
DSALHTSVM

SEQ ID NO: 55319 - protein, 9 aa, Homo Sapiens
DSANDGFVR

SEQ ID NO: 55320 - protein, 9 aa, Homo Sapiens
DSAPVETPR

SEQ ID NO: 55321 - protein, 9 aa, Homo Sapiens
DSAQQGLYR

SEQ ID NO: 55322 - protein, 9 aa, Homo Sapiens
DSCPNPIQR

SEQ ID NO: 55323 - protein, 9 aa, Homo Sapiens
DSFNVVSTR

SEQ ID NO: 55324 - protein, 9 aa, Homo Sapiens
DSFQKVILR

SEQ ID NO: 55325 - protein, 9 aa, Homo Sapiens
DSFSAGEPR

SEQ ID NO: 55326 - protein, 9 aa, Homo Sapiens
DSFSGSISR

SEQ ID NO: 55327 - protein, 9 aa, Homo Sapiens
DSFTGPRRR

SEQ ID NO: 55328 - protein, 9 aa, Homo Sapiens
DSIDPALRR

SEQ ID NO: 55329 - protein, 9 aa, Homo Sapiens
DSIEDRYPR

SEQ ID NO: 55330 - protein, 9 aa, Homo Sapiens
DSIPPGQYM

SEQ ID NO: 55331 - protein, 9 aa, Homo Sapiens
DSITVGMVR

SEQ ID NO: 55332 - protein, 9 aa, Homo Sapiens
DSMPEPASR

SEQ ID NO: 55333 - protein, 9 aa, Homo Sapiens
DSQICTVGR

SEQ ID NO: 55334 - protein, 9 aa, Homo Sapiens
DSRGKSSFF

SEQ ID NO: 55335 - protein, 9 aa, Homo Sapiens
DSSGLTVHR

SEQ ID NO: 55336 - protein, 9 aa, Homo Sapiens
DSSLGGLSR

SEQ ID NO: 55337 - protein, 9 aa, Homo Sapiens
DSSPPMTVR

SEQ ID NO: 55338 - protein, 9 aa, Homo Sapiens
DSSPVSTPF

SEQ ID NO: 55339 - protein, 9 aa, Homo Sapiens
DSSQLIHCR

SEQ ID NO: 55340 - protein, 9 aa, Homo Sapiens
DSSQPMLLR

SEQ ID NO: 55341 - protein, 9 aa, Homo Sapiens
DSSTVGLQR

SEQ ID NO: 55342 - protein, 9 aa, Homo Sapiens
DSVLTTHER

SEQ ID NO: 55343 - protein, 9 aa, Homo Sapiens
DSVNIGRKR

SEQ ID NO: 55344 - protein, 9 aa, Homo Sapiens
DSYFGGRLR

SEQ ID NO: 55345 - protein, 9 aa, Homo Sapiens
DTAAQITQR

SEQ ID NO: 55346 - protein, 9 aa, Homo Sapiens
DTAFETSKF

SEQ ID NO: 55347 - protein, 9 aa, Homo Sapiens
DTAGNDAFR

SEQ ID NO: 55348 - protein, 9 aa, Homo Sapiens
DTAHTFSLR

SEQ ID NO: 55349 - protein, 9 aa, Homo Sapiens
DTAIGMMTR

SEQ ID NO: 55350 - protein, 9 aa, Homo Sapiens
DTALDMRGR

SEQ ID NO: 55351 - protein, 9 aa, Homo Sapiens
DTAPPSSAL

SEQ ID NO: 55352 - protein, 9 aa, Homo Sapiens
DTAQRALYR

SEQ ID NO: 55353 - protein, 9 aa, Homo Sapiens
DTAQRNLYR

SEQ ID NO: 55354 - protein, 9 aa, Homo Sapiens
DTAWVEATR

SEQ ID NO: 55355 - protein, 9 aa, Homo Sapiens
DTCTHAYWR

SEQ ID NO: 55356 - protein, 9 aa, Homo Sapiens
DTFASGGER

SEQ ID NO: 55357 - protein, 9 aa, Homo Sapiens
DTFDVFRQR

SEQ ID NO: 55358 - protein, 9 aa, Homo Sapiens
DTHEQAILR

SEQ ID NO: 55359 - protein, 9 aa, Homo Sapiens
DTHGSFVVR

SEQ ID NO: 55360 - protein, 9 aa, Homo Sapiens
DTHIPGSPF

SEQ ID NO: 55361 - protein, 9 aa, Homo Sapiens
DTHKQLLER

SEQ ID NO: 55362 - protein, 9 aa, Homo Sapiens
DTHTNTYYL

SEQ ID NO: 55363 - protein, 9 aa, Homo Sapiens
DTIDSLRSR

SEQ ID NO: 55364 - protein, 9 aa, Homo Sapiens
DTIEIITDR

SEQ ID NO: 55365 - protein, 9 aa, Homo Sapiens
DTIENVKAK

SEQ ID NO: 55366 - protein, 9 aa, Homo Sapiens
DTIGYLLTR

SEQ ID NO: 55367 - protein, 9 aa, Homo Sapiens
DTISDWNLR

SEQ ID NO: 55368 - protein, 9 aa, Homo Sapiens
DTISKIRLR

SEQ ID NO: 55369 - protein, 9 aa, Homo Sapiens
DTISPTLGF

SEQ ID NO: 55370 - protein, 9 aa, Homo Sapiens
DTITETDLR

SEQ ID NO: 55371 - protein, 9 aa, Homo Sapiens
DTIYSGADR

SEQ ID NO: 55372 - protein, 9 aa, Homo Sapiens
DTKSPQFNR

SEQ ID NO: 55373 - protein, 9 aa, Homo Sapiens
DTLYVGTTR

SEQ ID NO: 55374 - protein, 9 aa, Homo Sapiens
DTMKTGLKR

SEQ ID NO: 55375 - protein, 9 aa, Homo Sapiens
DTMPPKGVR

SEQ ID NO: 55376 - protein, 9 aa, Homo Sapiens
DTMSSTTTL

SEQ ID NO: 55377 - protein, 9 aa, Homo Sapiens
DTQKDKEQR

SEQ ID NO: 55378 - protein, 9 aa, Homo Sapiens
DTQKFSVMR

SEQ ID NO: 55379 - protein, 9 aa, Homo Sapiens
DTQLVLGNR

SEQ ID NO: 55380 - protein, 9 aa, Homo Sapiens
DTRQEPMVR

SEQ ID NO: 55381 - protein, 9 aa, Homo Sapiens
DTSGICNLR

SEQ ID NO: 55382 - protein, 9 aa, Homo Sapiens
DTSLNNMQR

SEQ ID NO: 55383 - protein, 9 aa, Homo Sapiens
DTSPDLSSR

SEQ ID NO: 55384 - protein, 9 aa, Homo Sapiens
DTSSLAGTR

SEQ ID NO: 55385 - protein, 9 aa, Homo Sapiens
DTSYGGTLR

SEQ ID NO: 55386 - protein, 9 aa, Homo Sapiens
DTTHPISYY

SEQ ID NO: 55387 - protein, 9 aa, Homo Sapiens
DTTSLDRPR

SEQ ID NO: 55388 - protein, 9 aa, Homo Sapiens
DTVAQITQR

SEQ ID NO: 55389 - protein, 9 aa, Homo Sapiens
DTVATLSER

SEQ ID NO: 55390 - protein, 9 aa, Homo Sapiens
DTVGGKRFR

SEQ ID NO: 55391 - protein, 9 aa, Homo Sapiens
DTVIGGRLR

SEQ ID NO: 55392 - protein, 9 aa, Homo Sapiens
DTVRSFLKR

SEQ ID NO: 55393 - protein, 9 aa, Homo Sapiens
DTVTGLLER

SEQ ID NO: 55394 - protein, 9 aa, Homo Sapiens
DTYAVVQKR

SEQ ID NO: 55395 - protein, 9 aa, Homo Sapiens
DTYLHRVAR

SEQ ID NO: 55396 - protein, 9 aa, Homo Sapiens
DVAAQQSLR

SEQ ID NO: 55397 - protein, 9 aa, Homo Sapiens
DVAGIGWER

SEQ ID NO: 55398 - protein, 9 aa, Homo Sapiens
DVAISTSAL

SEQ ID NO: 55399 - protein, 9 aa, Homo Sapiens
DVAQSTHVL

SEQ ID NO: 55400 - protein, 9 aa, Homo Sapiens
DVASFFGKR

SEQ ID NO: 55401 - protein, 9 aa, Homo Sapiens
DVFEGSIIR

SEQ ID NO: 55402 - protein, 9 aa, Homo Sapiens
DVFNITIAR

SEQ ID NO: 55403 - protein, 9 aa, Homo Sapiens
DVFPGPSFR

SEQ ID NO: 55404 - protein, 9 aa, Homo Sapiens
DVFTEAELR

SEQ ID NO: 55405 - protein, 9 aa, Homo Sapiens
DVFVVGTER

SEQ ID NO: 55406 - protein, 9 aa, Homo Sapiens
DVGKSTFNR

SEQ ID NO: 55407 - protein, 9 aa, Homo Sapiens
DVGLPGVSR

SEQ ID NO: 55408 - protein, 9 aa, Homo Sapiens
DVIDDASSR

SEQ ID NO: 55409 - protein, 9 aa, Homo Sapiens
DVIGVTKGK

SEQ ID NO: 55410 - protein, 9 aa, Homo Sapiens
DVIKPGTVK

SEQ ID NO: 55411 - protein, 9 aa, Homo Sapiens
DVINPMALR

SEQ ID NO: 55412 - protein, 9 aa, Homo Sapiens
DVINSARTR

SEQ ID NO: 55413 - protein, 9 aa, Homo Sapiens
DVIQRFERR

SEQ ID NO: 55414 - protein, 9 aa, Homo Sapiens
DVIYPTRTK

SEQ ID NO: 55415 - protein, 9 aa, Homo Sapiens
DVKPSWTTR

SEQ ID NO: 55416 - protein, 9 aa, Homo Sapiens
DVLQTGTQR

SEQ ID NO: 55417 - protein, 9 aa, Homo Sapiens
DVLSHFAQR

SEQ ID NO: 55418 - protein, 9 aa, Homo Sapiens
DVMPSGRSR

SEQ ID NO: 55419 - protein, 9 aa, Homo Sapiens
DVNIKSTER

SEQ ID NO: 55420 - protein, 9 aa, Homo Sapiens
DVNNIGKYR

SEQ ID NO: 55421 - protein, 9 aa, Homo Sapiens
DVNSFVRSR

SEQ ID NO: 55422 - protein, 9 aa, Homo Sapiens
DVNSGFAKR

SEQ ID NO: 55423 - protein, 9 aa, Homo Sapiens
DVPSPFNHR

SEQ ID NO: 55424 - protein, 9 aa, Homo Sapiens
DVQVITHHM

SEQ ID NO: 55425 - protein, 9 aa, Homo Sapiens
DVRMGGSFR

SEQ ID NO: 55426 - protein, 9 aa, Homo Sapiens
DVRQKVLER

SEQ ID NO: 55427 - protein, 9 aa, Homo Sapiens
DVRSVTSVR

SEQ ID NO: 55428 - protein, 9 aa, Homo Sapiens
DVSASMNQR

SEQ ID NO: 55429 - protein, 9 aa, Homo Sapiens
DVSDSSFPK

SEQ ID NO: 55430 - protein, 9 aa, Homo Sapiens
DVSHPIIYR

SEQ ID NO: 55431 - protein, 9 aa, Homo Sapiens
DVSPVVSTY

SEQ ID NO: 55432 - protein, 9 aa, Homo Sapiens
DVTKITKLR

SEQ ID NO: 55433 - protein, 9 aa, Homo Sapiens
DVTSCISYR

SEQ ID NO: 55434 - protein, 9 aa, Homo Sapiens
DVVGRFNER

SEQ ID NO: 55435 - protein, 9 aa, Homo Sapiens
DVVPNATIR

SEQ ID NO: 55436 - protein, 9 aa, Homo Sapiens
DVVSKFLNR

SEQ ID NO: 55437 - protein, 9 aa, Homo Sapiens
DVVVSRWLR

SEQ ID NO: 55438 - protein, 9 aa, Homo Sapiens
DVVWETKPK

SEQ ID NO: 55439 - protein, 9 aa, Homo Sapiens
DVYLVTHLM

SEQ ID NO: 55440 - protein, 9 aa, Homo Sapiens
DVYPEIIER

SEQ ID NO: 55441 - protein, 9 aa, Homo Sapiens
DVYQAVSKR

SEQ ID NO: 55442 - protein, 9 aa, Homo Sapiens
DVYRGLQER

SEQ ID NO: 55443 - protein, 9 aa, Homo Sapiens
DVYSGTPTK

SEQ ID NO: 55444 - protein, 9 aa, Homo Sapiens
DVYTPKSSR

SEQ ID NO: 55445 - protein, 9 aa, Homo Sapiens
EAAAALTRM

SEQ ID NO: 55446 - protein, 9 aa, Homo Sapiens
EAAAFGSEK

SEQ ID NO: 55447 - protein, 9 aa, Homo Sapiens
EAAAIGALR

SEQ ID NO: 55448 - protein, 9 aa, Homo Sapiens
EAAAIIAQR

SEQ ID NO: 55449 - protein, 9 aa, Homo Sapiens
EAAAVLMAR

SEQ ID NO: 55450 - protein, 9 aa, Homo Sapiens
EAAESIAFR

SEQ ID NO: 55451 - protein, 9 aa, Homo Sapiens
EAAFATKDR

SEQ ID NO: 55452 - protein, 9 aa, Homo Sapiens
EAAIGVTKR

SEQ ID NO: 55453 - protein, 9 aa, Homo Sapiens
EAAKDLLYR

SEQ ID NO: 55454 - protein, 9 aa, Homo Sapiens
EAAKVFGLR

SEQ ID NO: 55455 - protein, 9 aa, Homo Sapiens
EAALGTHYR

SEQ ID NO: 55456 - protein, 9 aa, Homo Sapiens
EAAPRLRAL

SEQ ID NO: 55457 - protein, 9 aa, Homo Sapiens
EAAQKFLER

SEQ ID NO: 55458 - protein, 9 aa, Homo Sapiens
EAAVAFLFR

SEQ ID NO: 55459 - protein, 9 aa, Homo Sapiens
EAAYIGSMR

SEQ ID NO: 55460 - protein, 9 aa, Homo Sapiens
EACDIMVKR

SEQ ID NO: 55461 - protein, 9 aa, Homo Sapiens
EAEVASLNR

SEQ ID NO: 55462 - protein, 9 aa, Homo Sapiens
EAFDFVKQR

SEQ ID NO: 55463 - protein, 9 aa, Homo Sapiens
EAFEFVKQR

SEQ ID NO: 55464 - protein, 9 aa, Homo Sapiens
EAFQTTISK

SEQ ID NO: 55465 - protein, 9 aa, Homo Sapiens
EAFSRPLSR

SEQ ID NO: 55466 - protein, 9 aa, Homo Sapiens
EAGAIISTR

SEQ ID NO: 55467 - protein, 9 aa, Homo Sapiens
EAHARIHLR

SEQ ID NO: 55468 - protein, 9 aa, Homo Sapiens
EAHNILSKR

SEQ ID NO: 55469 - protein, 9 aa, Homo Sapiens
EAIAKGIRR

SEQ ID NO: 55470 - protein, 9 aa, Homo Sapiens
EAIGNEVTR

SEQ ID NO: 55471 - protein, 9 aa, Homo Sapiens
EAIGPSTIR

SEQ ID NO: 55472 - protein, 9 aa, Homo Sapiens
EAIGTLTAR

SEQ ID NO: 55473 - protein, 9 aa, Homo Sapiens
EAIISGKQR

SEQ ID NO: 55474 - protein, 9 aa, Homo Sapiens
EAIQKKLSR

SEQ ID NO: 55475 - protein, 9 aa, Homo Sapiens
EAIYDICRR

SEQ ID NO: 55476 - protein, 9 aa, Homo Sapiens
EAKFPTMNR

SEQ ID NO: 55477 - protein, 9 aa, Homo Sapiens
EALNQVTQR

SEQ ID NO: 55478 - protein, 9 aa, Homo Sapiens
EALTALMSR

SEQ ID NO: 55479 - protein, 9 aa, Homo Sapiens
EALYDICFR

SEQ ID NO: 55480 - protein, 9 aa, Homo Sapiens
EAMALPLYR

SEQ ID NO: 55481 - protein, 9 aa, Homo Sapiens
EAMGQLGSR

SEQ ID NO: 55482 - protein, 9 aa, Homo Sapiens
EAMKHVYFR

SEQ ID NO: 55483 - protein, 9 aa, Homo Sapiens
EAMLPTLGK

SEQ ID NO: 55484 - protein, 9 aa, Homo Sapiens
EAMTVAIRR

SEQ ID NO: 55485 - protein, 9 aa, Homo Sapiens
EANFTVSSM

SEQ ID NO: 55486 - protein, 9 aa, Homo Sapiens
EANISTLLR

SEQ ID NO: 55487 - protein, 9 aa, Homo Sapiens
EAPKGMLAR

SEQ ID NO: 55488 - protein, 9 aa, Homo Sapiens
EAQEVTIAR

SEQ ID NO: 55489 - protein, 9 aa, Homo Sapiens
EAQIAAVCR

SEQ ID NO: 55490 - protein, 9 aa, Homo Sapiens
EAQRITGLR

SEQ ID NO: 55491 - protein, 9 aa, Homo Sapiens
EASAAGLIR

SEQ ID NO: 55492 - protein, 9 aa, Homo Sapiens
EASAIAGVR

SEQ ID NO: 55493 - protein, 9 aa, Homo Sapiens
EASDPRIIR

SEQ ID NO: 55494 - protein, 9 aa, Homo Sapiens
EASKDGLFR

SEQ ID NO: 55495 - protein, 9 aa, Homo Sapiens
EASPGGLDR

SEQ ID NO: 55496 - protein, 9 aa, Homo Sapiens
EASPVVVEK

SEQ ID NO: 55497 - protein, 9 aa, Homo Sapiens
EATAMAMGR

SEQ ID NO: 55498 - protein, 9 aa, Homo Sapiens
EATFCVVLR

SEQ ID NO: 55499 - protein, 9 aa, Homo Sapiens
EAVDISSKR

SEQ ID NO: 55500 - protein, 9 aa, Homo Sapiens
EAVDRFMPR

SEQ ID NO: 55501 - protein, 9 aa, Homo Sapiens
EAVEAAINR

SEQ ID NO: 55502 - protein, 9 aa, Homo Sapiens
EAVGVTSQR

SEQ ID NO: 55503 - protein, 9 aa, Homo Sapiens
EAVKPFGLK

SEQ ID NO: 55504 - protein, 9 aa, Homo Sapiens
EAVKPTVGM

SEQ ID NO: 55505 - protein, 9 aa, Homo Sapiens
EAVLAMSSR

SEQ ID NO: 55506 - protein, 9 aa, Homo Sapiens
EAVLNVALR

SEQ ID NO: 55507 - protein, 9 aa, Homo Sapiens
EAVLWEALR

SEQ ID NO: 55508 - protein, 9 aa, Homo Sapiens
EAVQALRER

SEQ ID NO: 55509 - protein, 9 aa, Homo Sapiens
EAVVGTACR

SEQ ID NO: 55510 - protein, 9 aa, Homo Sapiens
EAYHLSFER

SEQ ID NO: 55511 - protein, 9 aa, Homo Sapiens
EAYLPETFR

SEQ ID NO: 55512 - protein, 9 aa, Homo Sapiens
EAYSVGTGR

SEQ ID NO: 55513 - protein, 9 aa, Homo Sapiens
EDFYTATER

SEQ ID NO: 55514 - protein, 9 aa, Homo Sapiens
EDIEPTSSR

SEQ ID NO: 55515 - protein, 9 aa, Homo Sapiens
EGIGSTVFR

SEQ ID NO: 55516 - protein, 9 aa, Homo Sapiens
EGIKVGHER

SEQ ID NO: 55517 - protein, 9 aa, Homo Sapiens
EIADPTRFF

SEQ ID NO: 55518 - protein, 9 aa, Homo Sapiens
EIADSSMTR

SEQ ID NO: 55519 - protein, 9 aa, Homo Sapiens
EICGNYTYR

SEQ ID NO: 55520 - protein, 9 aa, Homo Sapiens
EIFGTIGMR

SEQ ID NO: 55521 - protein, 9 aa, Homo Sapiens
EIFVGKIPR

SEQ ID NO: 55522 - protein, 9 aa, Homo Sapiens
EIGPVSSSR

SEQ ID NO: 55523 - protein, 9 aa, Homo Sapiens
EIIEQPKQR

SEQ ID NO: 55524 - protein, 9 aa, Homo Sapiens
EIIEQPRQR

SEQ ID NO: 55525 - protein, 9 aa, Homo Sapiens
EIINATTGR

SEQ ID NO: 55526 - protein, 9 aa, Homo Sapiens
EIISKLQGR

SEQ ID NO: 55527 - protein, 9 aa, Homo Sapiens
EIKHFVSER

SEQ ID NO: 55528 - protein, 9 aa, Homo Sapiens
EILEVATAR

SEQ ID NO: 55529 - protein, 9 aa, Homo Sapiens
EIMEVAKER

SEQ ID NO: 55530 - protein, 9 aa, Homo Sapiens
EIMQETGTR

SEQ ID NO: 55531 - protein, 9 aa, Homo Sapiens
EIPENFTTR

SEQ ID NO: 55532 - protein, 9 aa, Homo Sapiens
EIPKRFGQR

SEQ ID NO: 55533 - protein, 9 aa, Homo Sapiens
EIPTFVTGR

SEQ ID NO: 55534 - protein, 9 aa, Homo Sapiens
EIQHTTALR

SEQ ID NO: 55535 - protein, 9 aa, Homo Sapiens
EISAPSQQR

SEQ ID NO: 55536 - protein, 9 aa, Homo Sapiens
EISAPVSER

SEQ ID NO: 55537 - protein, 9 aa, Homo Sapiens
EISGTFTHR

SEQ ID NO: 55538 - protein, 9 aa, Homo Sapiens
EISSNSLER

SEQ ID NO: 55539 - protein, 9 aa, Homo Sapiens
EIVANVGKR

SEQ ID NO: 55540 - protein, 9 aa, Homo Sapiens
EIVEQTMRR

SEQ ID NO: 55541 - protein, 9 aa, Homo Sapiens
EIVSRVSKR

SEQ ID NO: 55542 - protein, 9 aa, Homo Sapiens
EIYEYIIFR

SEQ ID NO: 55543 - protein, 9 aa, Homo Sapiens
EIYGVTHTR

SEQ ID NO: 55544 - protein, 9 aa, Homo Sapiens
EIYRPPASR

SEQ ID NO: 55545 - protein, 9 aa, Homo Sapiens
ELAAVINGR

SEQ ID NO: 55546 - protein, 9 aa, Homo Sapiens
ELADPTERF

SEQ ID NO: 55547 - protein, 9 aa, Homo Sapiens
ELAMVCSQR

SEQ ID NO: 55548 - protein, 9 aa, Homo Sapiens
ELAQIYAQR

SEQ ID NO: 55549 - protein, 9 aa, Homo Sapiens
ELAQVIVSR

SEQ ID NO: 55550 - protein, 9 aa, Homo Sapiens
ELAVASFPK

SEQ ID NO: 55551 - protein, 9 aa, Homo Sapiens
ELFGRVTSR

SEQ ID NO: 55552 - protein, 9 aa, Homo Sapiens
ELFPAPILR

SEQ ID NO: 55553 - protein, 9 aa, Homo Sapiens
ELFSHPVER

SEQ ID NO: 55554 - protein, 9 aa, Homo Sapiens
ELFSNIVPR

SEQ ID NO: 55555 - protein, 9 aa, Homo Sapiens
ELIPGAEFR

SEQ ID NO: 55556 - protein, 9 aa, Homo Sapiens
ELIQDITQR

SEQ ID NO: 55557 - protein, 9 aa, Homo Sapiens
ELLEPLNER

SEQ ID NO: 55558 - protein, 9 aa, Homo Sapiens
ELNPSTGNR

SEQ ID NO: 55559 - protein, 9 aa, Homo Sapiens
ELRPPSRSR

SEQ ID NO: 55560 - protein, 9 aa, Homo Sapiens
ELSDLHAHK

SEQ ID NO: 55561 - protein, 9 aa, Homo Sapiens
ELSPGGQPR

SEQ ID NO: 55562 - protein, 9 aa, Homo Sapiens
ELTDLHGLR

SEQ ID NO: 55563 - protein, 9 aa, Homo Sapiens
ELVPFESPR

SEQ ID NO: 55564 - protein, 9 aa, Homo Sapiens
ELVSPKLNR

SEQ ID NO: 55565 - protein, 9 aa, Homo Sapiens
ELYEKVFSR

SEQ ID NO: 55566 - protein, 9 aa, Homo Sapiens
ELYNAPEGR

SEQ ID NO: 55567 - protein, 9 aa, Homo Sapiens
ELYNRMLKR

SEQ ID NO: 55568 - protein, 9 aa, Homo Sapiens
ENFGNTTPR

SEQ ID NO: 55569 - protein, 9 aa, Homo Sapiens
EPAPALSSR

SEQ ID NO: 55570 - protein, 9 aa, Homo Sapiens
EPIAMTVPR

SEQ ID NO: 55571 - protein, 9 aa, Homo Sapiens
EPVEVVAPR

SEQ ID NO: 55572 - protein, 9 aa, Homo Sapiens
EPYANPTKR

SEQ ID NO: 55573 - protein, 9 aa, Homo Sapiens
EQVGPRWSR

SEQ ID NO: 55574 - protein, 9 aa, Homo Sapiens
ESAPAWRLR

SEQ ID NO: 55575 - protein, 9 aa, Homo Sapiens
ESAPKASLR

SEQ ID NO: 55576 - protein, 9 aa, Homo Sapiens
ESAPSALEK

SEQ ID NO: 55577 - protein, 9 aa, Homo Sapiens
ESAQDFASR

SEQ ID NO: 55578 - protein, 9 aa, Homo Sapiens
ESAYNAFNR

SEQ ID NO: 55579 - protein, 9 aa, Homo Sapiens
ESDFASTFR

SEQ ID NO: 55580 - protein, 9 aa, Homo Sapiens
ESEEVRQFR

SEQ ID NO: 55581 - protein, 9 aa, Homo Sapiens
ESFEGFIAR

SEQ ID NO: 55582 - protein, 9 aa, Homo Sapiens
ESFGVPKGR

SEQ ID NO: 55583 - protein, 9 aa, Homo Sapiens
ESFPRGGTR

SEQ ID NO: 55584 - protein, 9 aa, Homo Sapiens
ESFPSVNSR

SEQ ID NO: 55585 - protein, 9 aa, Homo Sapiens
ESFQVGILR

SEQ ID NO: 55586 - protein, 9 aa, Homo Sapiens
ESHPGTLLR

SEQ ID NO: 55587 - protein, 9 aa, Homo Sapiens
ESHSTTLYV

SEQ ID NO: 55588 - protein, 9 aa, Homo Sapiens
ESHVSGISR

SEQ ID NO: 55589 - protein, 9 aa, Homo Sapiens
ESIAAFIQR

SEQ ID NO: 55590 - protein, 9 aa, Homo Sapiens
ESIDALSNK

SEQ ID NO: 55591 - protein, 9 aa, Homo Sapiens
ESIDKKISR

SEQ ID NO: 55592 - protein, 9 aa, Homo Sapiens
ESIDQYIER

SEQ ID NO: 55593 - protein, 9 aa, Homo Sapiens
ESIEHPLAR

SEQ ID NO: 55594 - protein, 9 aa, Homo Sapiens
ESIFKNAER

SEQ ID NO: 55595 - protein, 9 aa, Homo Sapiens
ESIKGLCER

SEQ ID NO: 55596 - protein, 9 aa, Homo Sapiens
ESIQGEARR

SEQ ID NO: 55597 - protein, 9 aa, Homo Sapiens
ESIRAAVNR

SEQ ID NO: 55598 - protein, 9 aa, Homo Sapiens
ESKGLGYVR

SEQ ID NO: 55599 - protein, 9 aa, Homo Sapiens
ESLPATHIR

SEQ ID NO: 55600 - protein, 9 aa, Homo Sapiens
ESNPPSLMR

SEQ ID NO: 55601 - protein, 9 aa, Homo Sapiens
ESQSNPVFR

SEQ ID NO: 55602 - protein, 9 aa, Homo Sapiens
ESSDFTSER

SEQ ID NO: 55603 - protein, 9 aa, Homo Sapiens
ESSLPTGDR

SEQ ID NO: 55604 - protein, 9 aa, Homo Sapiens
ESSPQYRLR

SEQ ID NO: 55605 - protein, 9 aa, Homo Sapiens
ESSPSIVHR

SEQ ID NO: 55606 - protein, 9 aa, Homo Sapiens
ESTGESTFK

SEQ ID NO: 55607 - protein, 9 aa, Homo Sapiens
ESTKLKMFR

SEQ ID NO: 55608 - protein, 9 aa, Homo Sapiens
ESTNFATLR

SEQ ID NO: 55609 - protein, 9 aa, Homo Sapiens
ESTNFATRR

SEQ ID NO: 55610 - protein, 9 aa, Homo Sapiens
ESTNFATVR

SEQ ID NO: 55611 - protein, 9 aa, Homo Sapiens
ESTPITAVK

SEQ ID NO: 55612 - protein, 9 aa, Homo Sapiens
ESTWPSRSR

SEQ ID NO: 55613 - protein, 9 aa, Homo Sapiens
ESVFNQAIR

SEQ ID NO: 55614 - protein, 9 aa, Homo Sapiens
ESYYQEIGR

SEQ ID NO: 55615 - protein, 9 aa, Homo Sapiens
ETADILCPK

SEQ ID NO: 55616 - protein, 9 aa, Homo Sapiens
ETADITHAL

SEQ ID NO: 55617 - protein, 9 aa, Homo Sapiens
ETADVIAKV

SEQ ID NO: 55618 - protein, 9 aa, Homo Sapiens
ETAFAFHLR

SEQ ID NO: 55619 - protein, 9 aa, Homo Sapiens
ETAFQGMLR

SEQ ID NO: 55620 - protein, 9 aa, Homo Sapiens
ETAFVSRNR

SEQ ID NO: 55621 - protein, 9 aa, Homo Sapiens
ETAIPFRSR

SEQ ID NO: 55622 - protein, 9 aa, Homo Sapiens
ETAIPSSTR

SEQ ID NO: 55623 - protein, 9 aa, Homo Sapiens
ETAKATPRL

SEQ ID NO: 55624 - protein, 9 aa, Homo Sapiens
ETALPGAFK

SEQ ID NO: 55625 - protein, 9 aa, Homo Sapiens
ETAPKSEEF

SEQ ID NO: 55626 - protein, 9 aa, Homo Sapiens
ETAPRHMMR

SEQ ID NO: 55627 - protein, 9 aa, Homo Sapiens
ETCDKVFSR

SEQ ID NO: 55628 - protein, 9 aa, Homo Sapiens
ETCQLAVRR

SEQ ID NO: 55629 - protein, 9 aa, Homo Sapiens
ETEGIRGLR

SEQ ID NO: 55630 - protein, 9 aa, Homo Sapiens
ETFIKGKER

SEQ ID NO: 55631 - protein, 9 aa, Homo Sapiens
ETFKSIMKK

SEQ ID NO: 55632 - protein, 9 aa, Homo Sapiens
ETFLAQRQR

SEQ ID NO: 55633 - protein, 9 aa, Homo Sapiens
ETFNREKFR

SEQ ID NO: 55634 - protein, 9 aa, Homo Sapiens
ETFNSFLRR

SEQ ID NO: 55635 - protein, 9 aa, Homo Sapiens
ETFNSITKR

SEQ ID NO: 55636 - protein, 9 aa, Homo Sapiens
ETFNTPAMY

SEQ ID NO: 55637 - protein, 9 aa, Homo Sapiens
ETFQQKMLR

SEQ ID NO: 55638 - protein, 9 aa, Homo Sapiens
ETFSGVYKK

SEQ ID NO: 55639 - protein, 9 aa, Homo Sapiens
ETFVSSTRF

SEQ ID NO: 55640 - protein, 9 aa, Homo Sapiens
ETGDSSIFR

SEQ ID NO: 55641 - protein, 9 aa, Homo Sapiens
ETHAWFTSR

SEQ ID NO: 55642 - protein, 9 aa, Homo Sapiens
ETHFTGNEV

SEQ ID NO: 55643 - protein, 9 aa, Homo Sapiens
ETHLETCRF

SEQ ID NO: 55644 - protein, 9 aa, Homo Sapiens
ETHLPAQAR

SEQ ID NO: 55645 - protein, 9 aa, Homo Sapiens
ETHSHFLAR

SEQ ID NO: 55646 - protein, 9 aa, Homo Sapiens
ETIAPKIAR

SEQ ID NO: 55647 - protein, 9 aa, Homo Sapiens
ETIDVHSGY

SEQ ID NO: 55648 - protein, 9 aa, Homo Sapiens
ETIELTEDR

SEQ ID NO: 55649 - protein, 9 aa, Homo Sapiens
ETIEVMEDR

SEQ ID NO: 55650 - protein, 9 aa, Homo Sapiens
ETIGEILKK

SEQ ID NO: 55651 - protein, 9 aa, Homo Sapiens
ETIGKKFEK

SEQ ID NO: 55652 - protein, 9 aa, Homo Sapiens
ETIIITGKR

SEQ ID NO: 55653 - protein, 9 aa, Homo Sapiens
ETIKQLQER

SEQ ID NO: 55654 - protein, 9 aa, Homo Sapiens
ETIKSLLIR

SEQ ID NO: 55655 - protein, 9 aa, Homo Sapiens
ETIKVWKQR

SEQ ID NO: 55656 - protein, 9 aa, Homo Sapiens
ETILRTNKR

SEQ ID NO: 55657 - protein, 9 aa, Homo Sapiens
ETIPSFTGR

SEQ ID NO: 55658 - protein, 9 aa, Homo Sapiens
ETISTATGR

SEQ ID NO: 55659 - protein, 9 aa, Homo Sapiens
ETIYDLGTK

SEQ ID NO: 55660 - protein, 9 aa, Homo Sapiens
ETIYQNYQR

SEQ ID NO: 55661 - protein, 9 aa, Homo Sapiens
ETLETIINR

SEQ ID NO: 55662 - protein, 9 aa, Homo Sapiens
ETLGQVVRR

SEQ ID NO: 55663 - protein, 9 aa, Homo Sapiens
ETLLLQAER

SEQ ID NO: 55664 - protein, 9 aa, Homo Sapiens
ETLMETHER

SEQ ID NO: 55665 - protein, 9 aa, Homo Sapiens
ETLPPGKVR

SEQ ID NO: 55666 - protein, 9 aa, Homo Sapiens
ETLQNVKER

SEQ ID NO: 55667 - protein, 9 aa, Homo Sapiens
ETMDPFVDR

SEQ ID NO: 55668 - protein, 9 aa, Homo Sapiens
ETMNYAQIR

SEQ ID NO: 55669 - protein, 9 aa, Homo Sapiens
ETMPCVKKK

SEQ ID NO: 55670 - protein, 9 aa, Homo Sapiens
ETMPSPYGR

SEQ ID NO: 55671 - protein, 9 aa, Homo Sapiens
ETMPYVKKK

SEQ ID NO: 55672 - protein, 9 aa, Homo Sapiens
ETNIVAVER

SEQ ID NO: 55673 - protein, 9 aa, Homo Sapiens
ETNTGEVYR

SEQ ID NO: 55674 - protein, 9 aa, Homo Sapiens
ETNYGIPQR

SEQ ID NO: 55675 - protein, 9 aa, Homo Sapiens
ETPITSVPR

SEQ ID NO: 55676 - protein, 9 aa, Homo Sapiens
ETQIATILR

SEQ ID NO: 55677 - protein, 9 aa, Homo Sapiens
ETQLPVSFR

SEQ ID NO: 55678 - protein, 9 aa, Homo Sapiens
ETQVPLLFR

SEQ ID NO: 55679 - protein, 9 aa, Homo Sapiens
ETRAEFAER

SEQ ID NO: 55680 - protein, 9 aa, Homo Sapiens
ETREPPPAY

SEQ ID NO: 55681 - protein, 9 aa, Homo Sapiens
ETRLHITGR

SEQ ID NO: 55682 - protein, 9 aa, Homo Sapiens
ETRQITWSR

SEQ ID NO: 55683 - protein, 9 aa, Homo Sapiens
ETSALPRPR

SEQ ID NO: 55684 - protein, 9 aa, Homo Sapiens
ETSAPFKER

SEQ ID NO: 55685 - protein, 9 aa, Homo Sapiens
ETSEPLSCR

SEQ ID NO: 55686 - protein, 9 aa, Homo Sapiens
ETSGFPSQR

SEQ ID NO: 55687 - protein, 9 aa, Homo Sapiens
ETSGPTYIK

SEQ ID NO: 55688 - protein, 9 aa, Homo Sapiens
ETSNLIIMR

SEQ ID NO: 55689 - protein, 9 aa, Homo Sapiens
ETSPFGAPR

SEQ ID NO: 55690 - protein, 9 aa, Homo Sapiens
ETSPHVIQA

SEQ ID NO: 55691 - protein, 9 aa, Homo Sapiens
ETSQAGLFR

SEQ ID NO: 55692 - protein, 9 aa, Homo Sapiens
ETSSMASFR

SEQ ID NO: 55693 - protein, 9 aa, Homo Sapiens
ETTIQKMER

SEQ ID NO: 55694 - protein, 9 aa, Homo Sapiens
ETTSIATAR

SEQ ID NO: 55695 - protein, 9 aa, Homo Sapiens
ETTSNITSR

SEQ ID NO: 55696 - protein, 9 aa, Homo Sapiens
ETTVGNMVR

SEQ ID NO: 55697 - protein, 9 aa, Homo Sapiens
ETTWTILRR

SEQ ID NO: 55698 - protein, 9 aa, Homo Sapiens
ETVAEFIKR

SEQ ID NO: 55699 - protein, 9 aa, Homo Sapiens
ETVALDAKR

SEQ ID NO: 55700 - protein, 9 aa, Homo Sapiens
ETVDAVQER

SEQ ID NO: 55701 - protein, 9 aa, Homo Sapiens
ETVEDIAAR

SEQ ID NO: 55702 - protein, 9 aa, Homo Sapiens
ETVEGLRKR

SEQ ID NO: 55703 - protein, 9 aa, Homo Sapiens
ETVEKFRQR

SEQ ID NO: 55704 - protein, 9 aa, Homo Sapiens
ETVEKWLKR

SEQ ID NO: 55705 - protein, 9 aa, Homo Sapiens
ETVELFRAK

SEQ ID NO: 55706 - protein, 9 aa, Homo Sapiens
ETVELHKLK

SEQ ID NO: 55707 - protein, 9 aa, Homo Sapiens
ETVGSIFSR

SEQ ID NO: 55708 - protein, 9 aa, Homo Sapiens
ETVMKGLDR

SEQ ID NO: 55709 - protein, 9 aa, Homo Sapiens
ETVNQMIAR

SEQ ID NO: 55710 - protein, 9 aa, Homo Sapiens
ETVPAFSER

SEQ ID NO: 55711 - protein, 9 aa, Homo Sapiens
ETVQDIVYR

SEQ ID NO: 55712 - protein, 9 aa, Homo Sapiens
ETVTSFRKR

SEQ ID NO: 55713 - protein, 9 aa, Homo Sapiens
ETVYTLCEK

SEQ ID NO: 55714 - protein, 9 aa, Homo Sapiens
ETYDITTVR

SEQ ID NO: 55715 - protein, 9 aa, Homo Sapiens
ETYLHRIGR

SEQ ID NO: 55716 - protein, 9 aa, Homo Sapiens
ETYLNENLR

SEQ ID NO: 55717 - protein, 9 aa, Homo Sapiens
ETYMHRIGR

SEQ ID NO: 55718 - protein, 9 aa, Homo Sapiens
ETYPFNPPK

SEQ ID NO: 55719 - protein, 9 aa, Homo Sapiens
ETYPHPLVR

SEQ ID NO: 55720 - protein, 9 aa, Homo Sapiens
ETYPVSSPK

SEQ ID NO: 55721 - protein, 9 aa, Homo Sapiens
ETYSNLIKL

SEQ ID NO: 55722 - protein, 9 aa, Homo Sapiens
EVADLKIKR

SEQ ID NO: 55723 - protein, 9 aa, Homo Sapiens
EVAEHVQYM

SEQ ID NO: 55724 - protein, 9 aa, Homo Sapiens
EVAFPHHPR

SEQ ID NO: 55725 - protein, 9 aa, Homo Sapiens
EVAGFGESR

SEQ ID NO: 55726 - protein, 9 aa, Homo Sapiens
EVAGIVAAR

SEQ ID NO: 55727 - protein, 9 aa, Homo Sapiens
EVAGLQVGR

SEQ ID NO: 55728 - protein, 9 aa, Homo Sapiens
EVAIPHNRR

SEQ ID NO: 55729 - protein, 9 aa, Homo Sapiens
EVALATGQF

SEQ ID NO: 55730 - protein, 9 aa, Homo Sapiens
EVANIPVAR

SEQ ID NO: 55731 - protein, 9 aa, Homo Sapiens
EVANSTANL

SEQ ID NO: 55732 - protein, 9 aa, Homo Sapiens
EVAPAGASY

SEQ ID NO: 55733 - protein, 9 aa, Homo Sapiens
EVAPDPSVR

SEQ ID NO: 55734 - protein, 9 aa, Homo Sapiens
EVAPDVRLR

SEQ ID NO: 55735 - protein, 9 aa, Homo Sapiens
EVAPPEYHR

SEQ ID NO: 55736 - protein, 9 aa, Homo Sapiens
EVAPTSTAV

SEQ ID NO: 55737 - protein, 9 aa, Homo Sapiens
EVAQFLTGR

SEQ ID NO: 55738 - protein, 9 aa, Homo Sapiens
EVAQPSREF

SEQ ID NO: 55739 - protein, 9 aa, Homo Sapiens
EVAQVESLR

SEQ ID NO: 55740 - protein, 9 aa, Homo Sapiens
EVARLWGVR

SEQ ID NO: 55741 - protein, 9 aa, Homo Sapiens
EVASAVCLR

SEQ ID NO: 55742 - protein, 9 aa, Homo Sapiens
EVASFVADR

SEQ ID NO: 55743 - protein, 9 aa, Homo Sapiens
EVASFVTKR

SEQ ID NO: 55744 - protein, 9 aa, Homo Sapiens
EVASGAVLR

SEQ ID NO: 55745 - protein, 9 aa, Homo Sapiens
EVASVWVER

SEQ ID NO: 55746 - protein, 9 aa, Homo Sapiens
EVDAAMAAR

SEQ ID NO: 55747 - protein, 9 aa, Homo Sapiens
EVECATQLR

SEQ ID NO: 55748 - protein, 9 aa, Homo Sapiens
EVENFSCSR

SEQ ID NO: 55749 - protein, 9 aa, Homo Sapiens
EVFDHMMKR

SEQ ID NO: 55750 - protein, 9 aa, Homo Sapiens
EVFDKFSNK

SEQ ID NO: 55751 - protein, 9 aa, Homo Sapiens
EVFECTHNM

SEQ ID NO: 55752 - protein, 9 aa, Homo Sapiens
EVFEYIIFR

SEQ ID NO: 55753 - protein, 9 aa, Homo Sapiens
EVFFLKATR

SEQ ID NO: 55754 - protein, 9 aa, Homo Sapiens
EVFGQITER

SEQ ID NO: 55755 - protein, 9 aa, Homo Sapiens
EVFLHVVKR

SEQ ID NO: 55756 - protein, 9 aa, Homo Sapiens
EVFQNANFR

SEQ ID NO: 55757 - protein, 9 aa, Homo Sapiens
EVFRDTVHM

SEQ ID NO: 55758 - protein, 9 aa, Homo Sapiens
EVFSHILKR

SEQ ID NO: 55759 - protein, 9 aa, Homo Sapiens
EVFTPVFER

SEQ ID NO: 55760 - protein, 9 aa, Homo Sapiens
EVFTPVVQR

SEQ ID NO: 55761 - protein, 9 aa, Homo Sapiens
EVFVGKIPR

SEQ ID NO: 55762 - protein, 9 aa, Homo Sapiens
EVFYFEVTR

SEQ ID NO: 55763 - protein, 9 aa, Homo Sapiens
EVGDIVVGR

SEQ ID NO: 55764 - protein, 9 aa, Homo Sapiens
EVGGEALGR

SEQ ID NO: 55765 - protein, 9 aa, Homo Sapiens
EVGPGTGNM

SEQ ID NO: 55766 - protein, 9 aa, Homo Sapiens
EVGSVVSFR

SEQ ID NO: 55767 - protein, 9 aa, Homo Sapiens
EVHAVVTVR

SEQ ID NO: 55768 - protein, 9 aa, Homo Sapiens
EVHNLIQLR

SEQ ID NO: 55769 - protein, 9 aa, Homo Sapiens
EVHPSPVSR

SEQ ID NO: 55770 - protein, 9 aa, Homo Sapiens
EVHTGTTIM

SEQ ID NO: 55771 - protein, 9 aa, Homo Sapiens
EVIEALLKK

SEQ ID NO: 55772 - protein, 9 aa, Homo Sapiens
EVIEIMTDR

SEQ ID NO: 55773 - protein, 9 aa, Homo Sapiens
EVIGLLGGR

SEQ ID NO: 55774 - protein, 9 aa, Homo Sapiens
EVIKNRFHR

SEQ ID NO: 55775 - protein, 9 aa, Homo Sapiens
EVIKSMKPK

SEQ ID NO: 55776 - protein, 9 aa, Homo Sapiens
EVINDYHFR

SEQ ID NO: 55777 - protein, 9 aa, Homo Sapiens
EVIPPMKEF

SEQ ID NO: 55778 - protein, 9 aa, Homo Sapiens
EVISLINTR

SEQ ID NO: 55779 - protein, 9 aa, Homo Sapiens
EVISRGGPR

SEQ ID NO: 55780 - protein, 9 aa, Homo Sapiens
EVKESPFFR

SEQ ID NO: 55781 - protein, 9 aa, Homo Sapiens
EVKKICMQR

SEQ ID NO: 55782 - protein, 9 aa, Homo Sapiens
EVKPSIRAR

SEQ ID NO: 55783 - protein, 9 aa, Homo Sapiens
EVKRHPFFR

SEQ ID NO: 55784 - protein, 9 aa, Homo Sapiens
EVLDRVFER

SEQ ID NO: 55785 - protein, 9 aa, Homo Sapiens
EVLPKPRMR

SEQ ID NO: 55786 - protein, 9 aa, Homo Sapiens
EVLQGGSQR

SEQ ID NO: 55787 - protein, 9 aa, Homo Sapiens
EVLQPLQQR

SEQ ID NO: 55788 - protein, 9 aa, Homo Sapiens
EVLSDPQTR

SEQ ID NO: 55789 - protein, 9 aa, Homo Sapiens
EVLTDAAAR

SEQ ID NO: 55790 - protein, 9 aa, Homo Sapiens
EVMGTGAVR

SEQ ID NO: 55791 - protein, 9 aa, Homo Sapiens
EVNAWLVHR

SEQ ID NO: 55792 - protein, 9 aa, Homo Sapiens
EVNDKRYLR

SEQ ID NO: 55793 - protein, 9 aa, Homo Sapiens
EVNIPTDLR

SEQ ID NO: 55794 - protein, 9 aa, Homo Sapiens
EVNKSTVYI

SEQ ID NO: 55795 - protein, 9 aa, Homo Sapiens
EVNNELANR

SEQ ID NO: 55796 - protein, 9 aa, Homo Sapiens
EVNQETIQR

SEQ ID NO: 55797 - protein, 9 aa, Homo Sapiens
EVNSRPTYR

SEQ ID NO: 55798 - protein, 9 aa, Homo Sapiens
EVPAVQSPR

SEQ ID NO: 55799 - protein, 9 aa, Homo Sapiens
EVPELYHQR

SEQ ID NO: 55800 - protein, 9 aa, Homo Sapiens
EVPEVTRSR

SEQ ID NO: 55801 - protein, 9 aa, Homo Sapiens
EVPPPPNLR

SEQ ID NO: 55802 - protein, 9 aa, Homo Sapiens
EVPSELSER

SEQ ID NO: 55803 - protein, 9 aa, Homo Sapiens
EVPSFTMGR

SEQ ID NO: 55804 - protein, 9 aa, Homo Sapiens
EVPTPKRPR

SEQ ID NO: 55805 - protein, 9 aa, Homo Sapiens
EVQRILHQR

SEQ ID NO: 55806 - protein, 9 aa, Homo Sapiens
EVQVVNTER

SEQ ID NO: 55807 - protein, 9 aa, Homo Sapiens
EVRGGGLTR

SEQ ID NO: 55808 - protein, 9 aa, Homo Sapiens
EVRLGGSLR

SEQ ID NO: 55809 - protein, 9 aa, Homo Sapiens
EVSAAIIQR

SEQ ID NO: 55810 - protein, 9 aa, Homo Sapiens
EVSAEVRER

SEQ ID NO: 55811 - protein, 9 aa, Homo Sapiens
EVSFSVGGR

SEQ ID NO: 55812 - protein, 9 aa, Homo Sapiens
EVSGCGSLR

SEQ ID NO: 55813 - protein, 9 aa, Homo Sapiens
EVSLPKRGR

SEQ ID NO: 55814 - protein, 9 aa, Homo Sapiens
EVSLPKTSR

SEQ ID NO: 55815 - protein, 9 aa, Homo Sapiens
EVSSVSPLK

SEQ ID NO: 55816 - protein, 9 aa, Homo Sapiens
EVSTVNVRR

SEQ ID NO: 55817 - protein, 9 aa, Homo Sapiens
EVTDYAIAR

SEQ ID NO: 55818 - protein, 9 aa, Homo Sapiens
EVTDYTTGR

SEQ ID NO: 55819 - protein, 9 aa, Homo Sapiens
EVTETICKR

SEQ ID NO: 55820 - protein, 9 aa, Homo Sapiens
EVTGEAALR

SEQ ID NO: 55821 - protein, 9 aa, Homo Sapiens
EVTGFGVTR

SEQ ID NO: 55822 - protein, 9 aa, Homo Sapiens
EVTGTGLGR

SEQ ID NO: 55823 - protein, 9 aa, Homo Sapiens
EVTNIITSK

SEQ ID NO: 55824 - protein, 9 aa, Homo Sapiens
EVTQIACGR

SEQ ID NO: 55825 - protein, 9 aa, Homo Sapiens
EVTTTVLVR

SEQ ID NO: 55826 - protein, 9 aa, Homo Sapiens
EVVDFSSHY

SEQ ID NO: 55827 - protein, 9 aa, Homo Sapiens
EVVDLLLAR

SEQ ID NO: 55828 - protein, 9 aa, Homo Sapiens
EVVEIQIDR

SEQ ID NO: 55829 - protein, 9 aa, Homo Sapiens
EVVEQGITR

SEQ ID NO: 55830 - protein, 9 aa, Homo Sapiens
EVVGIIESR

SEQ ID NO: 55831 - protein, 9 aa, Homo Sapiens
EVVLYSGAR

SEQ ID NO: 55832 - protein, 9 aa, Homo Sapiens
EVVNKRFVR

SEQ ID NO: 55833 - protein, 9 aa, Homo Sapiens
EVVPEPVAR

SEQ ID NO: 55834 - protein, 9 aa, Homo Sapiens
EVVQITWNR

SEQ ID NO: 55835 - protein, 9 aa, Homo Sapiens
EVVSGVVSK

SEQ ID NO: 55836 - protein, 9 aa, Homo Sapiens
EVVSLLLDR

SEQ ID NO: 55837 - protein, 9 aa, Homo Sapiens
EVVVSGKLR

SEQ ID NO: 55838 - protein, 9 aa, Homo Sapiens
EVVYDLSIR

SEQ ID NO: 55839 - protein, 9 aa, Homo Sapiens
EVVYRFTAR

SEQ ID NO: 55840 - protein, 9 aa, Homo Sapiens
EVWPHSTER

SEQ ID NO: 55841 - protein, 9 aa, Homo Sapiens
EVYDPLSKR

SEQ ID NO: 55842 - protein, 9 aa, Homo Sapiens
EVYKATCLL

SEQ ID NO: 55843 - protein, 9 aa, Homo Sapiens
EVYNEFVRK

SEQ ID NO: 55844 - protein, 9 aa, Homo Sapiens
EVYSPSQQR

SEQ ID NO: 55845 - protein, 9 aa, Homo Sapiens
EVYTLAEHR

SEQ ID NO: 55846 - protein, 9 aa, Homo Sapiens
FAAGVWLAR

SEQ ID NO: 55847 - protein, 9 aa, Homo Sapiens
FAFGGLCER

SEQ ID NO: 55848 - protein, 9 aa, Homo Sapiens
FAIFNTEQR

SEQ ID NO: 55849 - protein, 9 aa, Homo Sapiens
FAMNVGKAR

SEQ ID NO: 55850 - protein, 9 aa, Homo Sapiens
FASPLGAGR

SEQ ID NO: 55851 - protein, 9 aa, Homo Sapiens
FASQGGLAR

SEQ ID NO: 55852 - protein, 9 aa, Homo Sapiens
FDAKRLIGR

SEQ ID NO: 55853 - protein, 9 aa, Homo Sapiens
FIRDPSTSR

SEQ ID NO: 55854 - protein, 9 aa, Homo Sapiens
FLYPGSSTR

SEQ ID NO: 55855 - protein, 9 aa, Homo Sapiens
FPSEIVGKR

SEQ ID NO: 55856 - protein, 9 aa, Homo Sapiens
FPSIVGRPR

SEQ ID NO: 55857 - protein, 9 aa, Homo Sapiens
FPVRPGSGR

SEQ ID NO: 55858 - protein, 9 aa, Homo Sapiens
FSAPNYCYR

SEQ ID NO: 55859 - protein, 9 aa, Homo Sapiens
FSASGGWGR

SEQ ID NO: 55860 - protein, 9 aa, Homo Sapiens
FSASSTVEK

SEQ ID NO: 55861 - protein, 9 aa, Homo Sapiens
FSIAGTVKR

SEQ ID NO: 55862 - protein, 9 aa, Homo Sapiens
FSIDVGYER

SEQ ID NO: 55863 - protein, 9 aa, Homo Sapiens
FSIPGSSSR

SEQ ID NO: 55864 - protein, 9 aa, Homo Sapiens
FSQPGTISR

SEQ ID NO: 55865 - protein, 9 aa, Homo Sapiens
FSTPGGASR

SEQ ID NO: 55866 - protein, 9 aa, Homo Sapiens
FTAERSSYY

SEQ ID NO: 55867 - protein, 9 aa, Homo Sapiens
FTAPATVSL

SEQ ID NO: 55868 - protein, 9 aa, Homo Sapiens
FTAPSTVGK

SEQ ID NO: 55869 - protein, 9 aa, Homo Sapiens
FTDEEGYGR

SEQ ID NO: 55870 - protein, 9 aa, Homo Sapiens
FTELQQKFF

SEQ ID NO: 55871 - protein, 9 aa, Homo Sapiens
FTFTASFNR

SEQ ID NO: 55872 - protein, 9 aa, Homo Sapiens
FTHRSTFVL

SEQ ID NO: 55873 - protein, 9 aa, Homo Sapiens
FTIDSRLQR

SEQ ID NO: 55874 - protein, 9 aa, Homo Sapiens
FTIESTRVR

SEQ ID NO: 55875 - protein, 9 aa, Homo Sapiens
FTKIKTADR

SEQ ID NO: 55876 - protein, 9 aa, Homo Sapiens
FTMLSSLAR

SEQ ID NO: 55877 - protein, 9 aa, Homo Sapiens
FTNKSTSSL

SEQ ID NO: 55878 - protein, 9 aa, Homo Sapiens
FTNVFGKKR

SEQ ID NO: 55879 - protein, 9 aa, Homo Sapiens
FTQGWGSRR

SEQ ID NO: 55880 - protein, 9 aa, Homo Sapiens
FTQKPGFPK

SEQ ID NO: 55881 - protein, 9 aa, Homo Sapiens
FTQSGTMKM

SEQ ID NO: 55882 - protein, 9 aa, Homo Sapiens
FTSPPSLFK

SEQ ID NO: 55883 - protein, 9 aa, Homo Sapiens
FTTNGSLTR

SEQ ID NO: 55884 - protein, 9 aa, Homo Sapiens
FTTSASLTR

SEQ ID NO: 55885 - protein, 9 aa, Homo Sapiens
FTTVGSAEK

SEQ ID NO: 55886 - protein, 9 aa, Homo Sapiens
FTTYINRKR

SEQ ID NO: 55887 - protein, 9 aa, Homo Sapiens
FTVEGIKRR

SEQ ID NO: 55888 - protein, 9 aa, Homo Sapiens
FTVTVGNNR

SEQ ID NO: 55889 - protein, 9 aa, Homo Sapiens
FTWPGQRER

SEQ ID NO: 55890 - protein, 9 aa, Homo Sapiens
FTYMNPAQR

SEQ ID NO: 55891 - protein, 9 aa, Homo Sapiens
FVAPPTAAV

SEQ ID NO: 55892 - protein, 9 aa, Homo Sapiens
FVAQPGLSR

SEQ ID NO: 55893 - protein, 9 aa, Homo Sapiens
FVFDRPVHR

SEQ ID NO: 55894 - protein, 9 aa, Homo Sapiens
FVIDPGFAK

SEQ ID NO: 55895 - protein, 9 aa, Homo Sapiens
FVIKPKIQR

SEQ ID NO: 55896 - protein, 9 aa, Homo Sapiens
FVISPPALR

SEQ ID NO: 55897 - protein, 9 aa, Homo Sapiens
FVMGVNHEK

SEQ ID NO: 55898 - protein, 9 aa, Homo Sapiens
FVQNPNNNR

SEQ ID NO: 55899 - protein, 9 aa, Homo Sapiens
FVSDNSLNR

SEQ ID NO: 55900 - protein, 9 aa, Homo Sapiens
FVTPVTNQR

SEQ ID NO: 55901 - protein, 9 aa, Homo Sapiens
FVTSMMTGR

SEQ ID NO: 55902 - protein, 9 aa, Homo Sapiens
FVVEKVLDR

SEQ ID NO: 55903 - protein, 9 aa, Homo Sapiens
FVVQKISPR

SEQ ID NO: 55904 - protein, 9 aa, Homo Sapiens
FVYGEPVTR

SEQ ID NO: 55905 - protein, 9 aa, Homo Sapiens
FVYGSGVYR

SEQ ID NO: 55906 - protein, 9 aa, Homo Sapiens
GAAFPSSLR

SEQ ID NO: 55907 - protein, 9 aa, Homo Sapiens
GPGPRPLAR

SEQ ID NO: 55908 - protein, 9 aa, Homo Sapiens
GSIGSSFPR

SEQ ID NO: 55909 - protein, 9 aa, Homo Sapiens
GSVSIWTGR

SEQ ID NO: 55910 - protein, 9 aa, Homo Sapiens
GTADVHFER

SEQ ID NO: 55911 - protein, 9 aa, Homo Sapiens
GTIGKKFAR

SEQ ID NO: 55912 - protein, 9 aa, Homo Sapiens
GTLGGMLTR

SEQ ID NO: 55913 - protein, 9 aa, Homo Sapiens
GTSSVIVSR

SEQ ID NO: 55914 - protein, 9 aa, Homo Sapiens
GTTVPFTSR

SEQ ID NO: 55915 - protein, 9 aa, Homo Sapiens
GTYVSSVPR

SEQ ID NO: 55916 - protein, 9 aa, Homo Sapiens
GVANALAHR

SEQ ID NO: 55917 - protein, 9 aa, Homo Sapiens
GVAPVFKKR

SEQ ID NO: 55918 - protein, 9 aa, Homo Sapiens
GVIGQRMPR

SEQ ID NO: 55919 - protein, 9 aa, Homo Sapiens
GVKVPGEYR

SEQ ID NO: 55920 - protein, 9 aa, Homo Sapiens
GVMVGMGQK

SEQ ID NO: 55921 - protein, 9 aa, Homo Sapiens
GVSLPTSSR

SEQ ID NO: 55922 - protein, 9 aa, Homo Sapiens
GVSPVITVR

SEQ ID NO: 55923 - protein, 9 aa, Homo Sapiens
GVVEKMQQR

SEQ ID NO: 55924 - protein, 9 aa, Homo Sapiens
HAFVSTLTR

SEQ ID NO: 55925 - protein, 9 aa, Homo Sapiens
HAQSIGMNR

SEQ ID NO: 55926 - protein, 9 aa, Homo Sapiens
HIDVITAEM

SEQ ID NO: 55927 - protein, 9 aa, Homo Sapiens
HISCVIKER

SEQ ID NO: 55928 - protein, 9 aa, Homo Sapiens
HLAWINTPR

SEQ ID NO: 55929 - protein, 9 aa, Homo Sapiens
HLITAGVPR

SEQ ID NO: 55930 - protein, 9 aa, Homo Sapiens
HSAPIYEFR

SEQ ID NO: 55931 - protein, 9 aa, Homo Sapiens
HSMDFVAYR

SEQ ID NO: 55932 - protein, 9 aa, Homo Sapiens
HSSLPGLSR

SEQ ID NO: 55933 - protein, 9 aa, Homo Sapiens
HSVFSASAR

SEQ ID NO: 55934 - protein, 9 aa, Homo Sapiens
HTAAVSTAM

SEQ ID NO: 55935 - protein, 9 aa, Homo Sapiens
HTADISSHF

SEQ ID NO: 55936 - protein, 9 aa, Homo Sapiens
HTAGATSSL

SEQ ID NO: 55937 - protein, 9 aa, Homo Sapiens
HTANIFSVK

SEQ ID NO: 55938 - protein, 9 aa, Homo Sapiens
HTFDHINKR

SEQ ID NO: 55939 - protein, 9 aa, Homo Sapiens
HTGNIFSSR

SEQ ID NO: 55940 - protein, 9 aa, Homo Sapiens
HTIAPMGTR

SEQ ID NO: 55941 - protein, 9 aa, Homo Sapiens
HTIDWVREK

SEQ ID NO: 55942 - protein, 9 aa, Homo Sapiens
HTIPAKMFR

SEQ ID NO: 55943 - protein, 9 aa, Homo Sapiens
HTIRGLIAR

SEQ ID NO: 55944 - protein, 9 aa, Homo Sapiens
HTLEDLSAR

SEQ ID NO: 55945 - protein, 9 aa, Homo Sapiens
HTLEPLIPR

SEQ ID NO: 55946 - protein, 9 aa, Homo Sapiens
HTNFSTKAM

SEQ ID NO: 55947 - protein, 9 aa, Homo Sapiens
HTNREGVPM

SEQ ID NO: 55948 - protein, 9 aa, Homo Sapiens
HTNVATAVL

SEQ ID NO: 55949 - protein, 9 aa, Homo Sapiens
HTTEISVSR

SEQ ID NO: 55950 - protein, 9 aa, Homo Sapiens
HTVGLKLHR

SEQ ID NO: 55951 - protein, 9 aa, Homo Sapiens
HTVLSKLTR

SEQ ID NO: 55952 - protein, 9 aa, Homo Sapiens
HVAQIYAIR

SEQ ID NO: 55953 - protein, 9 aa, Homo Sapiens
HVASVLCQR

SEQ ID NO: 55954 - protein, 9 aa, Homo Sapiens
HVAVPTHFF

SEQ ID NO: 55955 - protein, 9 aa, Homo Sapiens
HVFGRSLLR

SEQ ID NO: 55956 - protein, 9 aa, Homo Sapiens
HVIQPRADR

SEQ ID NO: 55957 - protein, 9 aa, Homo Sapiens
HVLESGGFR

SEQ ID NO: 55958 - protein, 9 aa, Homo Sapiens
HVTDPFIRR

SEQ ID NO: 55959 - protein, 9 aa, Homo Sapiens
HVVAIGRTR

SEQ ID NO: 55960 - protein, 9 aa, Homo Sapiens
HVVDIVALK

SEQ ID NO: 55961 - protein, 9 aa, Homo Sapiens
HVVSEGVPR

SEQ ID NO: 55962 - protein, 9 aa, Homo Sapiens
IILGPTKDR

SEQ ID NO: 55963 - protein, 9 aa, Homo Sapiens
IIVDIATKR

SEQ ID NO: 55964 - protein, 9 aa, Homo Sapiens
ISSRNTGQR

SEQ ID NO: 55965 - protein, 9 aa, Homo Sapiens
ISTASLNLR

SEQ ID NO: 55966 - protein, 9 aa, Homo Sapiens
ITIPRRSKR

SEQ ID NO: 55967 - protein, 9 aa, Homo Sapiens
ITSENVAER

SEQ ID NO: 55968 - protein, 9 aa, Homo Sapiens
ITSPVVTQK

SEQ ID NO: 55969 - protein, 9 aa, Homo Sapiens
ITTGNSPPR

SEQ ID NO: 55970 - protein, 9 aa, Homo Sapiens
IVAEVVSAR

SEQ ID NO: 55971 - protein, 9 aa, Homo Sapiens
IVAPGGALR

SEQ ID NO: 55972 - protein, 9 aa, Homo Sapiens
IVGDPSTAK

SEQ ID NO: 55973 - protein, 9 aa, Homo Sapiens
IVKPPASAR

SEQ ID NO: 55974 - protein, 9 aa, Homo Sapiens
IVNRTIANM

SEQ ID NO: 55975 - protein, 9 aa, Homo Sapiens
IVTEIACGR

SEQ ID NO: 55976 - protein, 9 aa, Homo Sapiens
IVTGTSIQR

SEQ ID NO: 55977 - protein, 9 aa, Homo Sapiens
IVVDPFDPR

SEQ ID NO: 55978 - protein, 9 aa, Homo Sapiens
LAAPASLRP

SEQ ID NO: 55979 - protein, 9 aa, Homo Sapiens
LAAPSGLER

SEQ ID NO: 55980 - protein, 9 aa, Homo Sapiens
LAIGLTGQR

SEQ ID NO: 55981 - protein, 9 aa, Homo Sapiens
LAINGSANR

SEQ ID NO: 55982 - protein, 9 aa, Homo Sapiens
LANDPTSLR

SEQ ID NO: 55983 - protein, 9 aa, Homo Sapiens
LAQTGSLGR

SEQ ID NO: 55984 - protein, 9 aa, Homo Sapiens
LASQPSIPR

SEQ ID NO: 55985 - protein, 9 aa, Homo Sapiens
LAVEAGATR

SEQ ID NO: 55986 - protein, 9 aa, Homo Sapiens
LAVNISAAR

SEQ ID NO: 55987 - protein, 9 aa, Homo Sapiens
LGHPDTLNQ

SEQ ID NO: 55988 - protein, 9 aa, Homo Sapiens
LIIGPSKER

SEQ ID NO: 55989 - protein, 9 aa, Homo Sapiens
LPAEQGSPR

SEQ ID NO: 55990 - protein, 9 aa, Homo Sapiens
LPFGSSPHR

SEQ ID NO: 55991 - protein, 9 aa, Homo Sapiens
LSFEGATKR

SEQ ID NO: 55992 - protein, 9 aa, Homo Sapiens
LTAEAFGFK

SEQ ID NO: 55993 - protein, 9 aa, Homo Sapiens
LTAGVSAGR

SEQ ID NO: 55994 - protein, 9 aa, Homo Sapiens
LTAPSTSAR

SEQ ID NO: 55995 - protein, 9 aa, Homo Sapiens
LTFDGKRMR

SEQ ID NO: 55996 - protein, 9 aa, Homo Sapiens
LTFEQAVAR

SEQ ID NO: 55997 - protein, 9 aa, Homo Sapiens
LTMDSSGPK

SEQ ID NO: 55998 - protein, 9 aa, Homo Sapiens
LTSDISEER

SEQ ID NO: 55999 - protein, 9 aa, Homo Sapiens
LTSEVHSVR

SEQ ID NO: 56000 - protein, 9 aa, Homo Sapiens
LTVGFGLAR

SEQ ID NO: 56001 - protein, 9 aa, Homo Sapiens
LVAQATATR

SEQ ID NO: 56002 - protein, 9 aa, Homo Sapiens
LVAQTVGSR

SEQ ID NO: 56003 - protein, 9 aa, Homo Sapiens
LVCPSRSVP

SEQ ID NO: 56004 - protein, 9 aa, Homo Sapiens
LVIGGSSER

SEQ ID NO: 56005 - protein, 9 aa, Homo Sapiens
LVSQPGLNR

SEQ ID NO: 56006 - protein, 9 aa, Homo Sapiens
LVVENSAQR

SEQ ID NO: 56007 - protein, 9 aa, Homo Sapiens
LVVPPSRYR

SEQ ID NO: 56008 - protein, 9 aa, Homo Sapiens
LVVYPWTQR

SEQ ID NO: 56009 - protein, 9 aa, Homo Sapiens
MAAAAFAEK

SEQ ID NO: 56010 - protein, 9 aa, Homo Sapiens
MAAAVGVRG

SEQ ID NO: 56011 - protein, 9 aa, Homo Sapiens
MAGPGGLAR

SEQ ID NO: 56012 - protein, 9 aa, Homo Sapiens
MAIDGVAPR

SEQ ID NO: 56013 - protein, 9 aa, Homo Sapiens
MAVEAGQSR

SEQ ID NO: 56014 - protein, 9 aa, Homo Sapiens
MAVNVIGQR

SEQ ID NO: 56015 - protein, 9 aa, Homo Sapiens
MAVTALAAR

SEQ ID NO: 56016 - protein, 9 aa, Homo Sapiens
MIVRPSQPR

SEQ ID NO: 56017 - protein, 9 aa, Homo Sapiens
MPASVVGQR

SEQ ID NO: 56018 - protein, 9 aa, Homo Sapiens
MPHTSGMNR

SEQ ID NO: 56019 - protein, 9 aa, Homo Sapiens
MPIPGGNQR

SEQ ID NO: 56020 - protein, 9 aa, Homo Sapiens
MSASTTTLR

SEQ ID NO: 56021 - protein, 9 aa, Homo Sapiens
MSCPGSSYR

SEQ ID NO: 56022 - protein, 9 aa, Homo Sapiens
MSISGSSAR

SEQ ID NO: 56023 - protein, 9 aa, Homo Sapiens
MSSPPSAAR

SEQ ID NO: 56024 - protein, 9 aa, Homo Sapiens
MSVNPGMAR

SEQ ID NO: 56025 - protein, 9 aa, Homo Sapiens
MTGPGTHQL

SEQ ID NO: 56026 - protein, 9 aa, Homo Sapiens
MTIEELLTR

SEQ ID NO: 56027 - protein, 9 aa, Homo Sapiens
MTKKPGMFF

SEQ ID NO: 56028 - protein, 9 aa, Homo Sapiens
MTNLPAVGR

SEQ ID NO: 56029 - protein, 9 aa, Homo Sapiens
MVADVFSHR

SEQ ID NO: 56030 - protein, 9 aa, Homo Sapiens
MVAGTTMAM

SEQ ID NO: 56031 - protein, 9 aa, Homo Sapiens
MVITPQNGR

SEQ ID NO: 56032 - protein, 9 aa, Homo Sapiens
MVKFGGSGR

SEQ ID NO: 56033 - protein, 9 aa, Homo Sapiens
MVYDSPLCR

SEQ ID NO: 56034 - protein, 9 aa, Homo Sapiens
NANLPSSLR

SEQ ID NO: 56035 - protein, 9 aa, Homo Sapiens
NAVDVKQYR

SEQ ID NO: 56036 - protein, 9 aa, Homo Sapiens
NIKNSSVPR

SEQ ID NO: 56037 - protein, 9 aa, Homo Sapiens
NIPPPSVNR

SEQ ID NO: 56038 - protein, 9 aa, Homo Sapiens
NLLPSRDIQ

SEQ ID NO: 56039 - protein, 9 aa, Homo Sapiens
NLMGKTSER

SEQ ID NO: 56040 - protein, 9 aa, Homo Sapiens
NSIKPLRER

SEQ ID NO: 56041 - protein, 9 aa, Homo Sapiens
NTASIAQAR

SEQ ID NO: 56042 - protein, 9 aa, Homo Sapiens
NTIDPSHPM

SEQ ID NO: 56043 - protein, 9 aa, Homo Sapiens
NTNDFVTLR

SEQ ID NO: 56044 - protein, 9 aa, Homo Sapiens
NTTDLYSYR

SEQ ID NO: 56045 - protein, 9 aa, Homo Sapiens
NTVGLVVER

SEQ ID NO: 56046 - protein, 9 aa, Homo Sapiens
NVADLTSLR

SEQ ID NO: 56047 - protein, 9 aa, Homo Sapiens
NVKGPGLQR

SEQ ID NO: 56048 - protein, 9 aa, Homo Sapiens
NVNEVISNR

SEQ ID NO: 56049 - protein, 9 aa, Homo Sapiens
NVVNIIVAR

SEQ ID NO: 56050 - protein, 9 aa, Homo Sapiens
PDSPITLQS

SEQ ID NO: 56051 - protein, 9 aa, Homo Sapiens
PFDITVMIR

SEQ ID NO: 56052 - protein, 9 aa, Homo Sapiens
QAALASQYR

SEQ ID NO: 56053 - protein, 9 aa, Homo Sapiens
QAIKGMHIR

SEQ ID NO: 56054 - protein, 9 aa, Homo Sapiens
QAQKPSVPR

SEQ ID NO: 56055 - protein, 9 aa, Homo Sapiens
QGFFTGRGR

SEQ ID NO: 56056 - protein, 9 aa, Homo Sapiens
QIGPVSSSR

SEQ ID NO: 56057 - protein, 9 aa, Homo Sapiens
QILEQPKQR

SEQ ID NO: 56058 - protein, 9 aa, Homo Sapiens
QLSELTVER

SEQ ID NO: 56059 - protein, 9 aa, Homo Sapiens
QSIFNIGSR

SEQ ID NO: 56060 - protein, 9 aa, Homo Sapiens
QSYDNFSYR

SEQ ID NO: 56061 - protein, 9 aa, Homo Sapiens
QTAGLSLQR

SEQ ID NO: 56062 - protein, 9 aa, Homo Sapiens
QTHFQLAYR

SEQ ID NO: 56063 - protein, 9 aa, Homo Sapiens
QTILTEIYR

SEQ ID NO: 56064 - protein, 9 aa, Homo Sapiens
QTIQGILER

SEQ ID NO: 56065 - protein, 9 aa, Homo Sapiens
QTIQSFTLR

SEQ ID NO: 56066 - protein, 9 aa, Homo Sapiens
QTLSPQMWK

SEQ ID NO: 56067 - protein, 9 aa, Homo Sapiens
QTMTEVRAR

SEQ ID NO: 56068 - protein, 9 aa, Homo Sapiens
QTYVSGTLR

SEQ ID NO: 56069 - protein, 9 aa, Homo Sapiens
QVADVVVSR

SEQ ID NO: 56070 - protein, 9 aa, Homo Sapiens
QVAGITGAR

SEQ ID NO: 56071 - protein, 9 aa, Homo Sapiens
QVFEKSPLR

SEQ ID NO: 56072 - protein, 9 aa, Homo Sapiens
QVFSHLKRL

SEQ ID NO: 56073 - protein, 9 aa, Homo Sapiens
QVIESAMER

SEQ ID NO: 56074 - protein, 9 aa, Homo Sapiens
QVIKGVLFR

SEQ ID NO: 56075 - protein, 9 aa, Homo Sapiens
QVIPGSQTR

SEQ ID NO: 56076 - protein, 9 aa, Homo Sapiens
QVITIGNER

SEQ ID NO: 56077 - protein, 9 aa, Homo Sapiens
QVLQAMRQR

SEQ ID NO: 56078 - protein, 9 aa, Homo Sapiens
QVVDKVTQR

SEQ ID NO: 56079 - protein, 9 aa, Homo Sapiens
QVVKPTAER

SEQ ID NO: 56080 - protein, 9 aa, Homo Sapiens
SAAEVGFVR

SEQ ID NO: 56081 - protein, 9 aa, Homo Sapiens
SAAHLFGYR

SEQ ID NO: 56082 - protein, 9 aa, Homo Sapiens
SAAKLHALR

SEQ ID NO: 56083 - protein, 9 aa, Homo Sapiens
SAAPPTVGR

SEQ ID NO: 56084 - protein, 9 aa, Homo Sapiens
SAGGSFTVR

SEQ ID NO: 56085 - protein, 9 aa, Homo Sapiens
SAHFSPVLR

SEQ ID NO: 56086 - protein, 9 aa, Homo Sapiens
SAIGYLTSR

SEQ ID NO: 56087 - protein, 9 aa, Homo Sapiens
SAIPAYSKR

SEQ ID NO: 56088 - protein, 9 aa, Homo Sapiens
SAIVMMKNR

SEQ ID NO: 56089 - protein, 9 aa, Homo Sapiens
SALRPSTSR

SEQ ID NO: 56090 - protein, 9 aa, Homo Sapiens
SASLPSSGR

SEQ ID NO: 56091 - protein, 9 aa, Homo Sapiens
SATDITLRR

SEQ ID NO: 56092 - protein, 9 aa, Homo Sapiens
SAVAGRLER

SEQ ID NO: 56093 - protein, 9 aa, Homo Sapiens
SAVGKLSSR

SEQ ID NO: 56094 - protein, 9 aa, Homo Sapiens
SFDGSVRAR

SEQ ID NO: 56095 - protein, 9 aa, Homo Sapiens
SIEKLPCHR

SEQ ID NO: 56096 - protein, 9 aa, Homo Sapiens
SIIEHTRER

SEQ ID NO: 56097 - protein, 9 aa, Homo Sapiens
SIIGKGGQR

SEQ ID NO: 56098 - protein, 9 aa, Homo Sapiens
SIIGVTEPR

SEQ ID NO: 56099 - protein, 9 aa, Homo Sapiens
SISVPSTPR

SEQ ID NO: 56100 - protein, 9 aa, Homo Sapiens
SLADIMAKR

SEQ ID NO: 56101 - protein, 9 aa, Homo Sapiens
SLAPPSGER

SEQ ID NO: 56102 - protein, 9 aa, Homo Sapiens
SLNTPGSFR

SEQ ID NO: 56103 - protein, 9 aa, Homo Sapiens
SLPGPGAAR

SEQ ID NO: 56104 - protein, 9 aa, Homo Sapiens
SLYGPGTNR

SEQ ID NO: 56105 - protein, 9 aa, Homo Sapiens
SSALPSGTR

SEQ ID NO: 56106 - protein, 9 aa, Homo Sapiens
SSALPTTGR

SEQ ID NO: 56107 - protein, 9 aa, Homo Sapiens
SSASVTSVR

SEQ ID NO: 56108 - protein, 9 aa, Homo Sapiens
SSAWSTVFR

SEQ ID NO: 56109 - protein, 9 aa, Homo Sapiens
SSIDINSSR

SEQ ID NO: 56110 - protein, 9 aa, Homo Sapiens
SSIRPISER

SEQ ID NO: 56111 - protein, 9 aa, Homo Sapiens
SSKPSSIPR

SEQ ID NO: 56112 - protein, 9 aa, Homo Sapiens
SSMFGTLPR

SEQ ID NO: 56113 - protein, 9 aa, Homo Sapiens
SSSPVFTFR

SEQ ID NO: 56114 - protein, 9 aa, Homo Sapiens
SSSSPFSNR

SEQ ID NO: 56115 - protein, 9 aa, Homo Sapiens
STAANFLSR

SEQ ID NO: 56116 - protein, 9 aa, Homo Sapiens
STASVIQAR

SEQ ID NO: 56117 - protein, 9 aa, Homo Sapiens
STCSLGSVR

SEQ ID NO: 56118 - protein, 9 aa, Homo Sapiens
STFDTPYCR

SEQ ID NO: 56119 - protein, 9 aa, Homo Sapiens
STFEWVARR

SEQ ID NO: 56120 - protein, 9 aa, Homo Sapiens
STFRESFKK

SEQ ID NO: 56121 - protein, 9 aa, Homo Sapiens
STFTNITYR

SEQ ID NO: 56122 - protein, 9 aa, Homo Sapiens
STIDCGLVR

SEQ ID NO: 56123 - protein, 9 aa, Homo Sapiens
STIDPSGTR

SEQ ID NO: 56124 - protein, 9 aa, Homo Sapiens
STIEYVIQR

SEQ ID NO: 56125 - protein, 9 aa, Homo Sapiens
STIQPPSER

SEQ ID NO: 56126 - protein, 9 aa, Homo Sapiens
STISEVLGR

SEQ ID NO: 56127 - protein, 9 aa, Homo Sapiens
STKFPAYER

SEQ ID NO: 56128 - protein, 9 aa, Homo Sapiens
STKPPGTFL

SEQ ID NO: 56129 - protein, 9 aa, Homo Sapiens
STLPATSTR

SEQ ID NO: 56130 - protein, 9 aa, Homo Sapiens
STNNPSELR

SEQ ID NO: 56131 - protein, 9 aa, Homo Sapiens
STPDLAANR

SEQ ID NO: 56132 - protein, 9 aa, Homo Sapiens
STPPPFQGR

SEQ ID NO: 56133 - protein, 9 aa, Homo Sapiens
STRPPSVTR

SEQ ID NO: 56134 - protein, 9 aa, Homo Sapiens
STSSVSEIR

SEQ ID NO: 56135 - protein, 9 aa, Homo Sapiens
STTLLVSYR

SEQ ID NO: 56136 - protein, 9 aa, Homo Sapiens
STVESLSKR

SEQ ID NO: 56137 - protein, 9 aa, Homo Sapiens
STVGSAISR

SEQ ID NO: 56138 - protein, 9 aa, Homo Sapiens
STVGWASQK

SEQ ID NO: 56139 - protein, 9 aa, Homo Sapiens
STVSPPAGR

SEQ ID NO: 56140 - protein, 9 aa, Homo Sapiens
STVTGKLER

SEQ ID NO: 56141 - protein, 9 aa, Homo Sapiens
SVAALTSKR

SEQ ID NO: 56142 - protein, 9 aa, Homo Sapiens
SVAFSSDNR

SEQ ID NO: 56143 - protein, 9 aa, Homo Sapiens
SVELVTQQM

SEQ ID NO: 56144 - protein, 9 aa, Homo Sapiens
SVFHVGAER

SEQ ID NO: 56145 - protein, 9 aa, Homo Sapiens
SVHAPSLRR

SEQ ID NO: 56146 - protein, 9 aa, Homo Sapiens
SVHLSPCFR

SEQ ID NO: 56147 - protein, 9 aa, Homo Sapiens
SVHVPGMNR

SEQ ID NO: 56148 - protein, 9 aa, Homo Sapiens
SVIGAREER

SEQ ID NO: 56149 - protein, 9 aa, Homo Sapiens
SVIKNLQSR

SEQ ID NO: 56150 - protein, 9 aa, Homo Sapiens
SVIPNCQFR

SEQ ID NO: 56151 - protein, 9 aa, Homo Sapiens
SVIQDMAVR

SEQ ID NO: 56152 - protein, 9 aa, Homo Sapiens
SVIQTAGYR

SEQ ID NO: 56153 - protein, 9 aa, Homo Sapiens
SVISGISSR

SEQ ID NO: 56154 - protein, 9 aa, Homo Sapiens
SVISPVGNR

SEQ ID NO: 56155 - protein, 9 aa, Homo Sapiens
SVKDYCFAR

SEQ ID NO: 56156 - protein, 9 aa, Homo Sapiens
SVKEVALGR

SEQ ID NO: 56157 - protein, 9 aa, Homo Sapiens
SVKEWTITY

SEQ ID NO: 56158 - protein, 9 aa, Homo Sapiens
SVKFGATLR

SEQ ID NO: 56159 - protein, 9 aa, Homo Sapiens
SVLEGMGFR

SEQ ID NO: 56160 - protein, 9 aa, Homo Sapiens
SVLEKLGER

SEQ ID NO: 56161 - protein, 9 aa, Homo Sapiens
SVLNFATNR

SEQ ID NO: 56162 - protein, 9 aa, Homo Sapiens
SVMGVTVSR

SEQ ID NO: 56163 - protein, 9 aa, Homo Sapiens
SVRENRSLF

SEQ ID NO: 56164 - protein, 9 aa, Homo Sapiens
SVSDIIRLR

SEQ ID NO: 56165 - protein, 9 aa, Homo Sapiens
SVSDLAPPR

SEQ ID NO: 56166 - protein, 9 aa, Homo Sapiens
SVSEVVVNR

SEQ ID NO: 56167 - protein, 9 aa, Homo Sapiens
SVSPVVHVR

SEQ ID NO: 56168 - protein, 9 aa, Homo Sapiens
SVTDAVALR

SEQ ID NO: 56169 - protein, 9 aa, Homo Sapiens
SVVEIASLR

SEQ ID NO: 56170 - protein, 9 aa, Homo Sapiens
TAAPPSVCR

SEQ ID NO: 56171 - protein, 9 aa, Homo Sapiens
TAMPPGTAR

SEQ ID NO: 56172 - protein, 9 aa, Homo Sapiens
TATEWSQPR

SEQ ID NO: 56173 - protein, 9 aa, Homo Sapiens
TAVAALSGR

SEQ ID NO: 56174 - protein, 9 aa, Homo Sapiens
TDLDTVPLR

SEQ ID NO: 56175 - protein, 9 aa, Homo Sapiens
TIGKKFEKR

SEQ ID NO: 56176 - protein, 9 aa, Homo Sapiens
TIIDIITHR

SEQ ID NO: 56177 - protein, 9 aa, Homo Sapiens
TIIEVNGKR

SEQ ID NO: 56178 - protein, 9 aa, Homo Sapiens
TIVNILTNR

SEQ ID NO: 56179 - protein, 9 aa, Homo Sapiens
TPAGGGFPR

SEQ ID NO: 56180 - protein, 9 aa, Homo Sapiens
TPYAGGLFR

SEQ ID NO: 56181 - protein, 9 aa, Homo Sapiens
TSAAIQAYR

SEQ ID NO: 56182 - protein, 9 aa, Homo Sapiens
TSGLPSSVR

SEQ ID NO: 56183 - protein, 9 aa, Homo Sapiens
TSSPSSIPR

SEQ ID NO: 56184 - protein, 9 aa, Homo Sapiens
TSYGGTLRR

SEQ ID NO: 56185 - protein, 9 aa, Homo Sapiens
TTAPVVSTR

SEQ ID NO: 56186 - protein, 9 aa, Homo Sapiens
TTFGPKSQR

SEQ ID NO: 56187 - protein, 9 aa, Homo Sapiens
TTFPESHLR

SEQ ID NO: 56188 - protein, 9 aa, Homo Sapiens
TTISLETAR

SEQ ID NO: 56189 - protein, 9 aa, Homo Sapiens
TTRDSPVLR

SEQ ID NO: 56190 - protein, 9 aa, Homo Sapiens
TTTATVLAR

SEQ ID NO: 56191 - protein, 9 aa, Homo Sapiens
TTTEHRFFR

SEQ ID NO: 56192 - protein, 9 aa, Homo Sapiens
TTTEIIKRR

SEQ ID NO: 56193 - protein, 9 aa, Homo Sapiens
TTTSLVLER

SEQ ID NO: 56194 - protein, 9 aa, Homo Sapiens
TTVDIFHKK

SEQ ID NO: 56195 - protein, 9 aa, Homo Sapiens
TTVEGLITR

SEQ ID NO: 56196 - protein, 9 aa, Homo Sapiens
TTVGTLSQR

SEQ ID NO: 56197 - protein, 9 aa, Homo Sapiens
TVAAVFRGR

SEQ ID NO: 56198 - protein, 9 aa, Homo Sapiens
TVDGPREPR

SEQ ID NO: 56199 - protein, 9 aa, Homo Sapiens
TVFESRNLR

SEQ ID NO: 56200 - protein, 9 aa, Homo Sapiens
TVFRSTDFF

SEQ ID NO: 56201 - protein, 9 aa, Homo Sapiens
TVIDIHTLR

SEQ ID NO: 56202 - protein, 9 aa, Homo Sapiens
TVIKQTMER

SEQ ID NO: 56203 - protein, 9 aa, Homo Sapiens
TVIKVMTTR

SEQ ID NO: 56204 - protein, 9 aa, Homo Sapiens
TVIPPGLTR

SEQ ID NO: 56205 - protein, 9 aa, Homo Sapiens
TVISRVIGR

SEQ ID NO: 56206 - protein, 9 aa, Homo Sapiens
TVLFTGVRR

SEQ ID NO: 56207 - protein, 9 aa, Homo Sapiens
TVMVPSLLR

SEQ ID NO: 56208 - protein, 9 aa, Homo Sapiens
TVQLRNPPR

SEQ ID NO: 56209 - protein, 9 aa, Homo Sapiens
TVVGDVGGR

SEQ ID NO: 56210 - protein, 9 aa, Homo Sapiens
TVVQNLMER

SEQ ID NO: 56211 - protein, 9 aa, Homo Sapiens
TVVTGTLER

SEQ ID NO: 56212 - protein, 9 aa, Homo Sapiens
TVYHSPVSR

SEQ ID NO: 56213 - protein, 9 aa, Homo Sapiens
VATDITSTR

SEQ ID NO: 56214 - protein, 9 aa, Homo Sapiens
VAVTPFSLR

SEQ ID NO: 56215 - protein, 9 aa, Homo Sapiens
VDVRIGMTR

SEQ ID NO: 56216 - protein, 9 aa, Homo Sapiens
VPDTIATLR

SEQ ID NO: 56217 - protein, 9 aa, Homo Sapiens
VPFGAGRHR

SEQ ID NO: 56218 - protein, 9 aa, Homo Sapiens
VPGPPGSSR

SEQ ID NO: 56219 - protein, 9 aa, Homo Sapiens
VSLGPGARG

SEQ ID NO: 56220 - protein, 9 aa, Homo Sapiens
VTIKKDVDG

SEQ ID NO: 56221 - protein, 9 aa, Homo Sapiens
VVAPPGAPK

SEQ ID NO: 56222 - protein, 9 aa, Homo Sapiens
VVAPRLNSR

SEQ ID NO: 56223 - protein, 9 aa, Homo Sapiens
VVFGGGEAR

SEQ ID NO: 56224 - protein, 9 aa, Homo Sapiens
VVGPPGATR

SEQ ID NO: 56225 - protein, 9 aa, Homo Sapiens
VVGPVSLPR

SEQ ID NO: 56226 - protein, 9 aa, Homo Sapiens
VVIIVRAPR

SEQ ID NO: 56227 - protein, 9 aa, Homo Sapiens
WAAAFSSQR

SEQ ID NO: 56228 - protein, 9 aa, Homo Sapiens
WSAPNYCYR

SEQ ID NO: 56229 - protein, 9 aa, Homo Sapiens
WSESVQLSR

SEQ ID NO: 56230 - protein, 9 aa, Homo Sapiens
WTQGKGLGR

SEQ ID NO: 56231 - protein, 9 aa, Homo Sapiens
WTYDPNEPR

SEQ ID NO: 56232 - protein, 9 aa, Homo Sapiens
WVIGSVVAR

SEQ ID NO: 56233 - protein, 9 aa, Homo Sapiens
WVRCPFEQR

SEQ ID NO: 56234 - protein, 9 aa, Homo Sapiens
WVSADGFLR

SEQ ID NO: 56235 - protein, 9 aa, Homo Sapiens
WVSENFQER

SEQ ID NO: 56236 - protein, 9 aa, Homo Sapiens
WVVGKKSDR

SEQ ID NO: 56237 - protein, 9 aa, Homo Sapiens
YAAFIFGGR

SEQ ID NO: 56238 - protein, 9 aa, Homo Sapiens
YAAFVQTHR

SEQ ID NO: 56239 - protein, 9 aa, Homo Sapiens
YAASIIIRR

SEQ ID NO: 56240 - protein, 9 aa, Homo Sapiens
YAINVSQKR

SEQ ID NO: 56241 - protein, 9 aa, Homo Sapiens
YALDPSFPR

SEQ ID NO: 56242 - protein, 9 aa, Homo Sapiens
YAVGLAALR

SEQ ID NO: 56243 - protein, 9 aa, Homo Sapiens
YLADPMKAR

SEQ ID NO: 56244 - protein, 9 aa, Homo Sapiens
YNIHWPIRR

SEQ ID NO: 56245 - protein, 9 aa, Homo Sapiens
YSCEFGSAK

SEQ ID NO: 56246 - protein, 9 aa, Homo Sapiens
YSFSATSSR

SEQ ID NO: 56247 - protein, 9 aa, Homo Sapiens
YSFTTTAER

SEQ ID NO: 56248 - protein, 9 aa, Homo Sapiens
YSGPTSVSR

SEQ ID NO: 56249 - protein, 9 aa, Homo Sapiens
YSQINGASR

SEQ ID NO: 56250 - protein, 9 aa, Homo Sapiens
YSSDVIQHR

SEQ ID NO: 56251 - protein, 9 aa, Homo Sapiens
YSSTQVSVR

SEQ ID NO: 56252 - protein, 9 aa, Homo Sapiens
YSTNIFTKR

SEQ ID NO: 56253 - protein, 9 aa, Homo Sapiens
YSVGAGHFR

SEQ ID NO: 56254 - protein, 9 aa, Homo Sapiens
YSVVPMTSR

SEQ ID NO: 56255 - protein, 9 aa, Homo Sapiens
YTAPPLQSK

SEQ ID NO: 56256 - protein, 9 aa, Homo Sapiens
YTAQPTQGY

SEQ ID NO: 56257 - protein, 9 aa, Homo Sapiens
YTASVVRSR

SEQ ID NO: 56258 - protein, 9 aa, Homo Sapiens
YTIIERNNR

SEQ ID NO: 56259 - protein, 9 aa, Homo Sapiens
YTISDTIAR

SEQ ID NO: 56260 - protein, 9 aa, Homo Sapiens
YTMVSPSGR

SEQ ID NO: 56261 - protein, 9 aa, Homo Sapiens
YTPTISRER

SEQ ID NO: 56262 - protein, 9 aa, Homo Sapiens
YTQPGPGYR

SEQ ID NO: 56263 - protein, 9 aa, Homo Sapiens
YTRESTEFL

SEQ ID NO: 56264 - protein, 9 aa, Homo Sapiens
YTSGSFQTR

SEQ ID NO: 56265 - protein, 9 aa, Homo Sapiens
YTSNIYTRR

SEQ ID NO: 56266 - protein, 9 aa, Homo Sapiens
YVANVGTNR

SEQ ID NO: 56267 - protein, 9 aa, Homo Sapiens
YVETPRGLR

SEQ ID NO: 56268 - protein, 9 aa, Homo Sapiens
YVFADSKKR

SEQ ID NO: 56269 - protein, 9 aa, Homo Sapiens
YVFGGVRSR

SEQ ID NO: 56270 - protein, 9 aa, Homo Sapiens
YVFPVSQKR

SEQ ID NO: 56271 - protein, 9 aa, Homo Sapiens
YVGEIIGKR

SEQ ID NO: 56272 - protein, 9 aa, Homo Sapiens
YVGRPSLNR

SEQ ID NO: 56273 - protein, 9 aa, Homo Sapiens
YVIESARQR

SEQ ID NO: 56274 - protein, 9 aa, Homo Sapiens
YVIKPGNTK

SEQ ID NO: 56275 - protein, 9 aa, Homo Sapiens
YVMPSSSAR

SEQ ID NO: 56276 - protein, 9 aa, Homo Sapiens
YVTTSTRTY

SEQ ID NO: 56277 - protein, 9 aa, Homo Sapiens
YVVEKVLDR

SEQ ID NO: 56278 - protein, 9 aa, Homo Sapiens
YVVGGSIPR

SEQ ID NO: 56279 - protein, 9 aa, Homo Sapiens
YVYCKTHPR

SEQ ID NO: 56280 - protein, 10 aa, Homo Sapiens
ALPTWKMAAR

SEQ ID NO: 56281 - protein, 10 aa, Homo Sapiens
ATIDDVLSAR

SEQ ID NO: 56282 - protein, 10 aa, Homo Sapiens
AVIDVDVMAR

SEQ ID NO: 56283 - protein, 10 aa, Homo Sapiens
AVIENLPKKR

SEQ ID NO: 56284 - protein, 10 aa, Homo Sapiens
AVIHLALKER

SEQ ID NO: 56285 - protein, 10 aa, Homo Sapiens
AVPDAVGKCR

SEQ ID NO: 56286 - protein, 10 aa, Homo Sapiens
AVPEAIPTPR

SEQ ID NO: 56287 - protein, 10 aa, Homo Sapiens
AVVPFLPLQR

SEQ ID NO: 56288 - protein, 10 aa, Homo Sapiens
CTADWLPAGR

SEQ ID NO: 56289 - protein, 10 aa, Homo Sapiens
CTADWLPIGR

SEQ ID NO: 56290 - protein, 10 aa, Homo Sapiens
CTVDWLPLGR

SEQ ID NO: 56291 - protein, 10 aa, Homo Sapiens
DAAEAGLLSR

SEQ ID NO: 56292 - protein, 10 aa, Homo Sapiens
DAAFIIGSGR

SEQ ID NO: 56293 - protein, 10 aa, Homo Sapiens
DAAGPREAFR

SEQ ID NO: 56294 - protein, 10 aa, Homo Sapiens
DAAIPSKSRL

SEQ ID NO: 56295 - protein, 10 aa, Homo Sapiens
DAAPGGSEKL

SEQ ID NO: 56296 - protein, 10 aa, Homo Sapiens
DAFYSKTKRF

SEQ ID NO: 56297 - protein, 10 aa, Homo Sapiens
DAIRGGLPKL

SEQ ID NO: 56298 - protein, 10 aa, Homo Sapiens
DAYGSELVER

SEQ ID NO: 56299 - protein, 10 aa, Homo Sapiens
DAYPKNPHLR

SEQ ID NO: 56300 - protein, 10 aa, Homo Sapiens
DIICGFLKER

SEQ ID NO: 56301 - protein, 10 aa, Homo Sapiens
DIIHLHSQRL

SEQ ID NO: 56302 - protein, 10 aa, Homo Sapiens
DIMDSSLTRR

SEQ ID NO: 56303 - protein, 10 aa, Homo Sapiens
DIYDRKNMPR

SEQ ID NO: 56304 - protein, 10 aa, Homo Sapiens
DIYEFLPSKR

SEQ ID NO: 56305 - protein, 10 aa, Homo Sapiens
DLFPTSDTPR

SEQ ID NO: 56306 - protein, 10 aa, Homo Sapiens
DLISPRQPRL

SEQ ID NO: 56307 - protein, 10 aa, Homo Sapiens
DSAGPWTMSR

SEQ ID NO: 56308 - protein, 10 aa, Homo Sapiens
DSAPPSSVAR

SEQ ID NO: 56309 - protein, 10 aa, Homo Sapiens
DSAPPTPVNR

SEQ ID NO: 56310 - protein, 10 aa, Homo Sapiens
DSATGLTATR

SEQ ID NO: 56311 - protein, 10 aa, Homo Sapiens
DSFPERRAPR

SEQ ID NO: 56312 - protein, 10 aa, Homo Sapiens
DSIEAELTRR

SEQ ID NO: 56313 - protein, 10 aa, Homo Sapiens
DSRDGKFIHR

SEQ ID NO: 56314 - protein, 10 aa, Homo Sapiens
DSVGKLVTVR

SEQ ID NO: 56315 - protein, 10 aa, Homo Sapiens
DSYTATGYGR

SEQ ID NO: 56316 - protein, 10 aa, Homo Sapiens
DTAAGGFQQR

SEQ ID NO: 56317 - protein, 10 aa, Homo Sapiens
DTAALSHARL

SEQ ID NO: 56318 - protein, 10 aa, Homo Sapiens
DTAAWTVGRI

SEQ ID NO: 56319 - protein, 10 aa, Homo Sapiens
DTACVGPTLR

SEQ ID NO: 56320 - protein, 10 aa, Homo Sapiens
DTAPSGVSRF

SEQ ID NO: 56321 - protein, 10 aa, Homo Sapiens
DTFEALKRNR

SEQ ID NO: 56322 - protein, 10 aa, Homo Sapiens
DTFPSGIIGR

SEQ ID NO: 56323 - protein, 10 aa, Homo Sapiens
DTIAKVNAAM

SEQ ID NO: 56324 - protein, 10 aa, Homo Sapiens
DTICGKSVER

SEQ ID NO: 56325 - protein, 10 aa, Homo Sapiens
DTICQINSER

SEQ ID NO: 56326 - protein, 10 aa, Homo Sapiens
DTIDERTINK

SEQ ID NO: 56327 - protein, 10 aa, Homo Sapiens
DTIDIAPNHR

SEQ ID NO: 56328 - protein, 10 aa, Homo Sapiens
DTIDSYMNRL

SEQ ID NO: 56329 - protein, 10 aa, Homo Sapiens
DTIDVSNLNR

SEQ ID NO: 56330 - protein, 10 aa, Homo Sapiens
DTIEKSNLNR

SEQ ID NO: 56331 - protein, 10 aa, Homo Sapiens
DTIIDIITHR

SEQ ID NO: 56332 - protein, 10 aa, Homo Sapiens
DTIRPEHVLR

SEQ ID NO: 56333 - protein, 10 aa, Homo Sapiens
DTIVGMLHNR

SEQ ID NO: 56334 - protein, 10 aa, Homo Sapiens
DTMKVLGVQR

SEQ ID NO: 56335 - protein, 10 aa, Homo Sapiens
DTPERGFSLR

SEQ ID NO: 56336 - protein, 10 aa, Homo Sapiens
DTPLFIGKVR

SEQ ID NO: 56337 - protein, 10 aa, Homo Sapiens
DTQHFISKER

SEQ ID NO: 56338 - protein, 10 aa, Homo Sapiens
DTRMGPLINR

SEQ ID NO: 56339 - protein, 10 aa, Homo Sapiens
DTSGGTTALR

SEQ ID NO: 56340 - protein, 10 aa, Homo Sapiens
DTSNIITVRV

SEQ ID NO: 56341 - protein, 10 aa, Homo Sapiens
DTSSRSHIFR

SEQ ID NO: 56342 - protein, 10 aa, Homo Sapiens
DTTSIPLRLC

SEQ ID NO: 56343 - protein, 10 aa, Homo Sapiens
DTTSTGLAQR

SEQ ID NO: 56344 - protein, 10 aa, Homo Sapiens
DTVAQITQRF

SEQ ID NO: 56345 - protein, 10 aa, Homo Sapiens
DTVATLPRGR

SEQ ID NO: 56346 - protein, 10 aa, Homo Sapiens
DTVDLTSVLR

SEQ ID NO: 56347 - protein, 10 aa, Homo Sapiens
DTVSVPYVFR

SEQ ID NO: 56348 - protein, 10 aa, Homo Sapiens
DTVTMQVTAR

SEQ ID NO: 56349 - protein, 10 aa, Homo Sapiens
DTWAGSHSLR

SEQ ID NO: 56350 - protein, 10 aa, Homo Sapiens
DTYPSISNAR

SEQ ID NO: 56351 - protein, 10 aa, Homo Sapiens
DTYTKKQVLR

SEQ ID NO: 56352 - protein, 10 aa, Homo Sapiens
DVAAVVDGRL

SEQ ID NO: 56353 - protein, 10 aa, Homo Sapiens
DVASFFGKRR

SEQ ID NO: 56354 - protein, 10 aa, Homo Sapiens
DVCQLVYVER

SEQ ID NO: 56355 - protein, 10 aa, Homo Sapiens
DVETVPQTHR

SEQ ID NO: 56356 - protein, 10 aa, Homo Sapiens
DVFEGSIIRC

SEQ ID NO: 56357 - protein, 10 aa, Homo Sapiens
DVFWLRFSNR

SEQ ID NO: 56358 - protein, 10 aa, Homo Sapiens
DVHNFPGTSR

SEQ ID NO: 56359 - protein, 10 aa, Homo Sapiens
DVIDDASSRR

SEQ ID NO: 56360 - protein, 10 aa, Homo Sapiens
DVIDEGKANR

SEQ ID NO: 56361 - protein, 10 aa, Homo Sapiens
DVIDGPISQR

SEQ ID NO: 56362 - protein, 10 aa, Homo Sapiens
DVIKPGTVKR

SEQ ID NO: 56363 - protein, 10 aa, Homo Sapiens
DVIKSGCSAR

SEQ ID NO: 56364 - protein, 10 aa, Homo Sapiens
DVISMTANRL

SEQ ID NO: 56365 - protein, 10 aa, Homo Sapiens
DVISNINITR

SEQ ID NO: 56366 - protein, 10 aa, Homo Sapiens
DVLNPSGTQR

SEQ ID NO: 56367 - protein, 10 aa, Homo Sapiens
DVMASGTVKR

SEQ ID NO: 56368 - protein, 10 aa, Homo Sapiens
DVMIHPVTNR

SEQ ID NO: 56369 - protein, 10 aa, Homo Sapiens
DVQEFKSSFK

SEQ ID NO: 56370 - protein, 10 aa, Homo Sapiens
DVSPFPPRKR

SEQ ID NO: 56371 - protein, 10 aa, Homo Sapiens
DVTSTTSSRV

SEQ ID NO: 56372 - protein, 10 aa, Homo Sapiens
DVVPYPISLR

SEQ ID NO: 56373 - protein, 10 aa, Homo Sapiens
DVYDAFPPLR

SEQ ID NO: 56374 - protein, 10 aa, Homo Sapiens
DVYENLYAGR

SEQ ID NO: 56375 - protein, 10 aa, Homo Sapiens
EAAAVHGARF

SEQ ID NO: 56376 - protein, 10 aa, Homo Sapiens
EAAFATKDRL

SEQ ID NO: 56377 - protein, 10 aa, Homo Sapiens
EAFEHPNVVR

SEQ ID NO: 56378 - protein, 10 aa, Homo Sapiens
EAFFSKTKRF

SEQ ID NO: 56379 - protein, 10 aa, Homo Sapiens
EAFGKIVAER

SEQ ID NO: 56380 - protein, 10 aa, Homo Sapiens
EAFKPILSTR

SEQ ID NO: 56381 - protein, 10 aa, Homo Sapiens
EAFPSQGTKR

SEQ ID NO: 56382 - protein, 10 aa, Homo Sapiens
EAFSCIPSMR

SEQ ID NO: 56383 - protein, 10 aa, Homo Sapiens
EAFSLDSSLR

SEQ ID NO: 56384 - protein, 10 aa, Homo Sapiens
EAIGPVHQNR

SEQ ID NO: 56385 - protein, 10 aa, Homo Sapiens
EAINITNNER

SEQ ID NO: 56386 - protein, 10 aa, Homo Sapiens
EAISLLNSER

SEQ ID NO: 56387 - protein, 10 aa, Homo Sapiens
EAISVVAQRL

SEQ ID NO: 56388 - protein, 10 aa, Homo Sapiens
EALGSGLVSR

SEQ ID NO: 56389 - protein, 10 aa, Homo Sapiens
EANSNAVRFR

SEQ ID NO: 56390 - protein, 10 aa, Homo Sapiens
EAVAPEFTNR

SEQ ID NO: 56391 - protein, 10 aa, Homo Sapiens
EAVDISSKRM

SEQ ID NO: 56392 - protein, 10 aa, Homo Sapiens
EAVGVDISGR

SEQ ID NO: 56393 - protein, 10 aa, Homo Sapiens
EAVHDLLRPR

SEQ ID NO: 56394 - protein, 10 aa, Homo Sapiens
EAYNETFSNR

SEQ ID NO: 56395 - protein, 10 aa, Homo Sapiens
EIASVAYRYR

SEQ ID NO: 56396 - protein, 10 aa, Homo Sapiens
EIGPVSSSRF

SEQ ID NO: 56397 - protein, 10 aa, Homo Sapiens
EIIEAPMAWR

SEQ ID NO: 56398 - protein, 10 aa, Homo Sapiens
EIIEEHLANR

SEQ ID NO: 56399 - protein, 10 aa, Homo Sapiens
EIIIVDTSGR

SEQ ID NO: 56400 - protein, 10 aa, Homo Sapiens
EIINEDIAKR

SEQ ID NO: 56401 - protein, 10 aa, Homo Sapiens
EIIQSTPYGR

SEQ ID NO: 56402 - protein, 10 aa, Homo Sapiens
EIKKPPVSER

SEQ ID NO: 56403 - protein, 10 aa, Homo Sapiens
EIVHGDLSPR

SEQ ID NO: 56404 - protein, 10 aa, Homo Sapiens
EIYEFAATQR

SEQ ID NO: 56405 - protein, 10 aa, Homo Sapiens
EIYGGSDSRF

SEQ ID NO: 56406 - protein, 10 aa, Homo Sapiens
EIYSFSESLR

SEQ ID NO: 56407 - protein, 10 aa, Homo Sapiens
EIYTGTSVAR

SEQ ID NO: 56408 - protein, 10 aa, Homo Sapiens
ELFHQQGTPR

SEQ ID NO: 56409 - protein, 10 aa, Homo Sapiens
ELISTTANYR

SEQ ID NO: 56410 - protein, 10 aa, Homo Sapiens
ELMDKPLTFR

SEQ ID NO: 56411 - protein, 10 aa, Homo Sapiens
ELPIVTPALR

SEQ ID NO: 56412 - protein, 10 aa, Homo Sapiens
ELRPLPVSVR

SEQ ID NO: 56413 - protein, 10 aa, Homo Sapiens
ELYAEKVATR

SEQ ID NO: 56414 - protein, 10 aa, Homo Sapiens
ESAAKLHALR

SEQ ID NO: 56415 - protein, 10 aa, Homo Sapiens
ESASASETLR

SEQ ID NO: 56416 - protein, 10 aa, Homo Sapiens
ESFGFTADLR

SEQ ID NO: 56417 - protein, 10 aa, Homo Sapiens
ESFGPQPISR

SEQ ID NO: 56418 - protein, 10 aa, Homo Sapiens
ESFPGSFRGR

SEQ ID NO: 56419 - protein, 10 aa, Homo Sapiens
ESFSPGDTPR

SEQ ID NO: 56420 - protein, 10 aa, Homo Sapiens
ESIDDALNCR

SEQ ID NO: 56421 - protein, 10 aa, Homo Sapiens
ESIGRVLAQR

SEQ ID NO: 56422 - protein, 10 aa, Homo Sapiens
ESIHQYLLQR

SEQ ID NO: 56423 - protein, 10 aa, Homo Sapiens
ESMDTPTSTR

SEQ ID NO: 56424 - protein, 10 aa, Homo Sapiens
ESTTVATRRL

SEQ ID NO: 56425 - protein, 10 aa, Homo Sapiens
ESVGGRVAER

SEQ ID NO: 56426 - protein, 10 aa, Homo Sapiens
ESVGSMAKRL

SEQ ID NO: 56427 - protein, 10 aa, Homo Sapiens
ESVSGLLMKR

SEQ ID NO: 56428 - protein, 10 aa, Homo Sapiens
ETAEQGLLNR

SEQ ID NO: 56429 - protein, 10 aa, Homo Sapiens
ETAETFDSMR

SEQ ID NO: 56430 - protein, 10 aa, Homo Sapiens
ETAGSTKYRL

SEQ ID NO: 56431 - protein, 10 aa, Homo Sapiens
ETAGSTSIPK

SEQ ID NO: 56432 - protein, 10 aa, Homo Sapiens
ETALNSKAYK

SEQ ID NO: 56433 - protein, 10 aa, Homo Sapiens
ETAPRHMMRL

SEQ ID NO: 56434 - protein, 10 aa, Homo Sapiens
ETASKTLSRF

SEQ ID NO: 56435 - protein, 10 aa, Homo Sapiens
ETASNEVVYR

SEQ ID NO: 56436 - protein, 10 aa, Homo Sapiens
ETAYHMAVAR

SEQ ID NO: 56437 - protein, 10 aa, Homo Sapiens
ETFDFQAMGR

SEQ ID NO: 56438 - protein, 10 aa, Homo Sapiens
ETFDKTILRA

SEQ ID NO: 56439 - protein, 10 aa, Homo Sapiens
ETFDYIGSSR

SEQ ID NO: 56440 - protein, 10 aa, Homo Sapiens
ETFEHPNVVR

SEQ ID NO: 56441 - protein, 10 aa, Homo Sapiens
ETFSYPDFLR

SEQ ID NO: 56442 - protein, 10 aa, Homo Sapiens
ETFTHHLQRL

SEQ ID NO: 56443 - protein, 10 aa, Homo Sapiens
ETHERGVSIR

SEQ ID NO: 56444 - protein, 10 aa, Homo Sapiens
ETHGNLMTER

SEQ ID NO: 56445 - protein, 10 aa, Homo Sapiens
ETHSHFLARL

SEQ ID NO: 56446 - protein, 10 aa, Homo Sapiens
ETICRVTGGM

SEQ ID NO: 56447 - protein, 10 aa, Homo Sapiens
ETIEGMLLRL

SEQ ID NO: 56448 - protein, 10 aa, Homo Sapiens
ETIFGNRIKR

SEQ ID NO: 56449 - protein, 10 aa, Homo Sapiens
ETIGKKFEKR

SEQ ID NO: 56450 - protein, 10 aa, Homo Sapiens
ETIGTGGFAK

SEQ ID NO: 56451 - protein, 10 aa, Homo Sapiens
ETIKDGVSRF

SEQ ID NO: 56452 - protein, 10 aa, Homo Sapiens
ETIKGHSVRL

SEQ ID NO: 56453 - protein, 10 aa, Homo Sapiens
ETIKSLLIRR

SEQ ID NO: 56454 - protein, 10 aa, Homo Sapiens
ETISLAEQRL

SEQ ID NO: 56455 - protein, 10 aa, Homo Sapiens
ETKDLSMSTR

SEQ ID NO: 56456 - protein, 10 aa, Homo Sapiens
ETLGPKPAAR

SEQ ID NO: 56457 - protein, 10 aa, Homo Sapiens
ETLKHSGIGR

SEQ ID NO: 56458 - protein, 10 aa, Homo Sapiens
ETLPPVGVNR

SEQ ID NO: 56459 - protein, 10 aa, Homo Sapiens
ETLSAVTNNR

SEQ ID NO: 56460 - protein, 10 aa, Homo Sapiens
ETMGHSADRL

SEQ ID NO: 56461 - protein, 10 aa, Homo Sapiens
ETMGTIEVQR

SEQ ID NO: 56462 - protein, 10 aa, Homo Sapiens
ETMSPGVFSR

SEQ ID NO: 56463 - protein, 10 aa, Homo Sapiens
ETNGGQVTYR

SEQ ID NO: 56464 - protein, 10 aa, Homo Sapiens
ETNHTSRPRL

SEQ ID NO: 56465 - protein, 10 aa, Homo Sapiens
ETNMYEGVGR

SEQ ID NO: 56466 - protein, 10 aa, Homo Sapiens
ETPAISPSKR

SEQ ID NO: 56467 - protein, 10 aa, Homo Sapiens
ETPDPSGGFR

SEQ ID NO: 56468 - protein, 10 aa, Homo Sapiens
ETPGHTPSLR

SEQ ID NO: 56469 - protein, 10 aa, Homo Sapiens
ETPNMELSCR

SEQ ID NO: 56470 - protein, 10 aa, Homo Sapiens
ETPSAPLLSR

SEQ ID NO: 56471 - protein, 10 aa, Homo Sapiens
ETQPGRLLGR

SEQ ID NO: 56472 - protein, 10 aa, Homo Sapiens
ETQYSVDTRR

SEQ ID NO: 56473 - protein, 10 aa, Homo Sapiens
ETRDGQVLGR

SEQ ID NO: 56474 - protein, 10 aa, Homo Sapiens
ETSDFLGGLR

SEQ ID NO: 56475 - protein, 10 aa, Homo Sapiens
ETSGISIYRL

SEQ ID NO: 56476 - protein, 10 aa, Homo Sapiens
ETSPLGNARL

SEQ ID NO: 56477 - protein, 10 aa, Homo Sapiens
ETSPLTAEKL

SEQ ID NO: 56478 - protein, 10 aa, Homo Sapiens
ETSQAGLFRL

SEQ ID NO: 56479 - protein, 10 aa, Homo Sapiens
ETSRLTIAFF

SEQ ID NO: 56480 - protein, 10 aa, Homo Sapiens
ETSTEAATRL

SEQ ID NO: 56481 - protein, 10 aa, Homo Sapiens
ETTFGPKSQR

SEQ ID NO: 56482 - protein, 10 aa, Homo Sapiens
ETTPPLSTER

SEQ ID NO: 56483 - protein, 10 aa, Homo Sapiens
ETVGTGIMGR

SEQ ID NO: 56484 - protein, 10 aa, Homo Sapiens
ETVMLHARKL

SEQ ID NO: 56485 - protein, 10 aa, Homo Sapiens
ETVNFSGVKR

SEQ ID NO: 56486 - protein, 10 aa, Homo Sapiens
ETVNLRSLGF

SEQ ID NO: 56487 - protein, 10 aa, Homo Sapiens
ETVPAPSANK

SEQ ID NO: 56488 - protein, 10 aa, Homo Sapiens
ETVPYWTRSR

SEQ ID NO: 56489 - protein, 10 aa, Homo Sapiens
ETVQAQSSRL

SEQ ID NO: 56490 - protein, 10 aa, Homo Sapiens
ETVQLRNPPR

SEQ ID NO: 56491 - protein, 10 aa, Homo Sapiens
ETVRTSEVLR

SEQ ID NO: 56492 - protein, 10 aa, Homo Sapiens
ETVSEASQRL

SEQ ID NO: 56493 - protein, 10 aa, Homo Sapiens
ETVTGGFGAK

SEQ ID NO: 56494 - protein, 10 aa, Homo Sapiens
ETYEGSPVSK

SEQ ID NO: 56495 - protein, 10 aa, Homo Sapiens
ETYETKTALM

SEQ ID NO: 56496 - protein, 10 aa, Homo Sapiens
EVAAMENVHR

SEQ ID NO: 56497 - protein, 10 aa, Homo Sapiens
EVAEGGLPRA

SEQ ID NO: 56498 - protein, 10 aa, Homo Sapiens
EVAERLGVTR

SEQ ID NO: 56499 - protein, 10 aa, Homo Sapiens
EVAGFGESRC

SEQ ID NO: 56500 - protein, 10 aa, Homo Sapiens
EVAGFVLNRL

SEQ ID NO: 56501 - protein, 10 aa, Homo Sapiens
EVAGLRLRPR

SEQ ID NO: 56502 - protein, 10 aa, Homo Sapiens
EVAPCMGDRF

SEQ ID NO: 56503 - protein, 10 aa, Homo Sapiens
EVAPPASGTR

SEQ ID NO: 56504 - protein, 10 aa, Homo Sapiens
EVAPPEYHRK

SEQ ID NO: 56505 - protein, 10 aa, Homo Sapiens
EVAQLIQGGR

SEQ ID NO: 56506 - protein, 10 aa, Homo Sapiens
EVAQPSEVLR

SEQ ID NO: 56507 - protein, 10 aa, Homo Sapiens
EVASAVCLRL

SEQ ID NO: 56508 - protein, 10 aa, Homo Sapiens
EVASDLASSR

SEQ ID NO: 56509 - protein, 10 aa, Homo Sapiens
EVAVETTTPK

SEQ ID NO: 56510 - protein, 10 aa, Homo Sapiens
EVCPLSESRF

SEQ ID NO: 56511 - protein, 10 aa, Homo Sapiens
EVEPGVHLGR

SEQ ID NO: 56512 - protein, 10 aa, Homo Sapiens
EVFDKTYQFL

SEQ ID NO: 56513 - protein, 10 aa, Homo Sapiens
EVFESSVPQR

SEQ ID NO: 56514 - protein, 10 aa, Homo Sapiens
EVFEYSSSTR

SEQ ID NO: 56515 - protein, 10 aa, Homo Sapiens
EVFGTADLYR

SEQ ID NO: 56516 - protein, 10 aa, Homo Sapiens
EVFGVTDNPR

SEQ ID NO: 56517 - protein, 10 aa, Homo Sapiens
EVFLAQGTLR

SEQ ID NO: 56518 - protein, 10 aa, Homo Sapiens
EVFNKFFKER

SEQ ID NO: 56519 - protein, 10 aa, Homo Sapiens
EVFPLAMNYL

SEQ ID NO: 56520 - protein, 10 aa, Homo Sapiens
EVGPDAASLR

SEQ ID NO: 56521 - protein, 10 aa, Homo Sapiens
EVGPEGALGK

SEQ ID NO: 56522 - protein, 10 aa, Homo Sapiens
EVGPREAGLR

SEQ ID NO: 56523 - protein, 10 aa, Homo Sapiens
EVGTASPMAR

SEQ ID NO: 56524 - protein, 10 aa, Homo Sapiens
EVHYHLPVAR

SEQ ID NO: 56525 - protein, 10 aa, Homo Sapiens
EVIEGPQNAR

SEQ ID NO: 56526 - protein, 10 aa, Homo Sapiens
EVIKPWITKR

SEQ ID NO: 56527 - protein, 10 aa, Homo Sapiens
EVILATPYGR

SEQ ID NO: 56528 - protein, 10 aa, Homo Sapiens
EVIPEGAMLR

SEQ ID NO: 56529 - protein, 10 aa, Homo Sapiens
EVIQLQGDQR

SEQ ID NO: 56530 - protein, 10 aa, Homo Sapiens
EVIWPRPHPR

SEQ ID NO: 56531 - protein, 10 aa, Homo Sapiens
EVKNGIPSNR

SEQ ID NO: 56532 - protein, 10 aa, Homo Sapiens
EVKRPGESLR

SEQ ID NO: 56533 - protein, 10 aa, Homo Sapiens
EVLAGPLAQR

SEQ ID NO: 56534 - protein, 10 aa, Homo Sapiens
EVLKTRMALR

SEQ ID NO: 56535 - protein, 10 aa, Homo Sapiens
EVLPSPRGQR

SEQ ID NO: 56536 - protein, 10 aa, Homo Sapiens
EVLSKALSQR

SEQ ID NO: 56537 - protein, 10 aa, Homo Sapiens
EVMEYTTILR

SEQ ID NO: 56538 - protein, 10 aa, Homo Sapiens
EVMIAEPSCR

SEQ ID NO: 56539 - protein, 10 aa, Homo Sapiens
EVNAPIQGSR

SEQ ID NO: 56540 - protein, 10 aa, Homo Sapiens
EVNERHQILR

SEQ ID NO: 56541 - protein, 10 aa, Homo Sapiens
EVNPDCSVSR

SEQ ID NO: 56542 - protein, 10 aa, Homo Sapiens
EVNQETIQRL

SEQ ID NO: 56543 - protein, 10 aa, Homo Sapiens
EVNQPKFNQR

SEQ ID NO: 56544 - protein, 10 aa, Homo Sapiens
EVPLGQSIPR

SEQ ID NO: 56545 - protein, 10 aa, Homo Sapiens
EVPREKLASR

SEQ ID NO: 56546 - protein, 10 aa, Homo Sapiens
EVPSVPTNGM

SEQ ID NO: 56547 - protein, 10 aa, Homo Sapiens
EVQDLHLAQR

SEQ ID NO: 56548 - protein, 10 aa, Homo Sapiens
EVRQPPPRVR

SEQ ID NO: 56549 - protein, 10 aa, Homo Sapiens
EVSDVEIITR

SEQ ID NO: 56550 - protein, 10 aa, Homo Sapiens
EVSPPNLRGR

SEQ ID NO: 56551 - protein, 10 aa, Homo Sapiens
EVTDYAIARR

SEQ ID NO: 56552 - protein, 10 aa, Homo Sapiens
EVTEDVYTSR

SEQ ID NO: 56553 - protein, 10 aa, Homo Sapiens
EVTRILDGKR

SEQ ID NO: 56554 - protein, 10 aa, Homo Sapiens
EVVAGEFGSR

SEQ ID NO: 56555 - protein, 10 aa, Homo Sapiens
EVVDFIQSKI

SEQ ID NO: 56556 - protein, 10 aa, Homo Sapiens
EVVDKSQVSR

SEQ ID NO: 56557 - protein, 10 aa, Homo Sapiens
EVVDSNPYSR

SEQ ID NO: 56558 - protein, 10 aa, Homo Sapiens
EVVDVMVIGR

SEQ ID NO: 56559 - protein, 10 aa, Homo Sapiens
EVVELPVTER

SEQ ID NO: 56560 - protein, 10 aa, Homo Sapiens
EVVGNMAVSR

SEQ ID NO: 56561 - protein, 10 aa, Homo Sapiens
EVVQSSPVER

SEQ ID NO: 56562 - protein, 10 aa, Homo Sapiens
EVVSGSGLTR

SEQ ID NO: 56563 - protein, 10 aa, Homo Sapiens
EVVTGVIGQR

SEQ ID NO: 56564 - protein, 10 aa, Homo Sapiens
EVVTSMGTQR

SEQ ID NO: 56565 - protein, 10 aa, Homo Sapiens
EVWIPKNGTR

SEQ ID NO: 56566 - protein, 10 aa, Homo Sapiens
EVYDGPKNVR

SEQ ID NO: 56567 - protein, 10 aa, Homo Sapiens
EVYDQLFKSR

SEQ ID NO: 56568 - protein, 10 aa, Homo Sapiens
EVYNEFVRKR

SEQ ID NO: 56569 - protein, 10 aa, Homo Sapiens
EVYPFGIVGM

SEQ ID NO: 56570 - protein, 10 aa, Homo Sapiens
FAHHGRSLPR

SEQ ID NO: 56571 - protein, 10 aa, Homo Sapiens
FSFCLPGSVR

SEQ ID NO: 56572 - protein, 10 aa, Homo Sapiens
FSVEGQLEFR

SEQ ID NO: 56573 - protein, 10 aa, Homo Sapiens
FTAPSTVGKR

SEQ ID NO: 56574 - protein, 10 aa, Homo Sapiens
FTASGEAEAR

SEQ ID NO: 56575 - protein, 10 aa, Homo Sapiens
FTFTYVGGPR

SEQ ID NO: 56576 - protein, 10 aa, Homo Sapiens
FTIDDFEIGR

SEQ ID NO: 56577 - protein, 10 aa, Homo Sapiens
FTKFPTKTGR

SEQ ID NO: 56578 - protein, 10 aa, Homo Sapiens
FTKGIPNVLR

SEQ ID NO: 56579 - protein, 10 aa, Homo Sapiens
FTMASSPAQR

SEQ ID NO: 56580 - protein, 10 aa, Homo Sapiens
FTTGTPPAPR

SEQ ID NO: 56581 - protein, 10 aa, Homo Sapiens
FVAPPPKTQR

SEQ ID NO: 56582 - protein, 10 aa, Homo Sapiens
FVGTAGTVGR

SEQ ID NO: 56583 - protein, 10 aa, Homo Sapiens
FVISTDGSVR

SEQ ID NO: 56584 - protein, 10 aa, Homo Sapiens
GTIFIIKGVR

SEQ ID NO: 56585 - protein, 10 aa, Homo Sapiens
GVFEGIPTYR

SEQ ID NO: 56586 - protein, 10 aa, Homo Sapiens
GVPQALFGVR

SEQ ID NO: 56587 - protein, 10 aa, Homo Sapiens
HIIDPATSAR

SEQ ID NO: 56588 - protein, 10 aa, Homo Sapiens
HTIAPMGTRR

SEQ ID NO: 56589 - protein, 10 aa, Homo Sapiens
HTIQLIQHNR

SEQ ID NO: 56590 - protein, 10 aa, Homo Sapiens
HTKDLPFRCK

SEQ ID NO: 56591 - protein, 10 aa, Homo Sapiens
HTNDTIGSVR

SEQ ID NO: 56592 - protein, 10 aa, Homo Sapiens
HTRTPPIIHR

SEQ ID NO: 56593 - protein, 10 aa, Homo Sapiens
HTTEISVSRL

SEQ ID NO: 56594 - protein, 10 aa, Homo Sapiens
HVAESSLSRL

SEQ ID NO: 56595 - protein, 10 aa, Homo Sapiens
HVIIGLKTAK

SEQ ID NO: 56596 - protein, 10 aa, Homo Sapiens
HVIRGYVGNR

SEQ ID NO: 56597 - protein, 10 aa, Homo Sapiens
HVIVMAATNR

SEQ ID NO: 56598 - protein, 10 aa, Homo Sapiens
HVLDLVSHPR

SEQ ID NO: 56599 - protein, 10 aa, Homo Sapiens
HVMGFSVTGR

SEQ ID NO: 56600 - protein, 10 aa, Homo Sapiens
HVPCADSLPR

SEQ ID NO: 56601 - protein, 10 aa, Homo Sapiens
HVPGSPFTAR

SEQ ID NO: 56602 - protein, 10 aa, Homo Sapiens
HVYDGKFLAR

SEQ ID NO: 56603 - protein, 10 aa, Homo Sapiens
IDISDIAEKR

SEQ ID NO: 56604 - protein, 10 aa, Homo Sapiens
IPYDQSPGPK

SEQ ID NO: 56605 - protein, 10 aa, Homo Sapiens
LDTNADKQLS

SEQ ID NO: 56606 - protein, 10 aa, Homo Sapiens
LTAPSTSARL

SEQ ID NO: 56607 - protein, 10 aa, Homo Sapiens
LVAEGLATRR

SEQ ID NO: 56608 - protein, 10 aa, Homo Sapiens
MIREGKIAGR

SEQ ID NO: 56609 - protein, 10 aa, Homo Sapiens
MPIKLKIGLR

SEQ ID NO: 56610 - protein, 10 aa, Homo Sapiens
MTAPSNFLHR

SEQ ID NO: 56611 - protein, 10 aa, Homo Sapiens
MTCGNTKVLR

SEQ ID NO: 56612 - protein, 10 aa, Homo Sapiens
MTNEAGAPRL

SEQ ID NO: 56613 - protein, 10 aa, Homo Sapiens
MTQDAQNALR

SEQ ID NO: 56614 - protein, 10 aa, Homo Sapiens
MVADVFSHRF

SEQ ID NO: 56615 - protein, 10 aa, Homo Sapiens
MVAPGSVTSR

SEQ ID NO: 56616 - protein, 10 aa, Homo Sapiens
MVTGGANLGR

SEQ ID NO: 56617 - protein, 10 aa, Homo Sapiens
NIISGSGRPR

SEQ ID NO: 56618 - protein, 10 aa, Homo Sapiens
NSAGPYFNPR

SEQ ID NO: 56619 - protein, 10 aa, Homo Sapiens
NTFFAKNGYR

SEQ ID NO: 56620 - protein, 10 aa, Homo Sapiens
NTIDQKIVER

SEQ ID NO: 56621 - protein, 10 aa, Homo Sapiens
NVIDWSDVRK

SEQ ID NO: 56622 - protein, 10 aa, Homo Sapiens
NVKDKPTVER

SEQ ID NO: 56623 - protein, 10 aa, Homo Sapiens
PPGLAVKELK

SEQ ID NO: 56624 - protein, 10 aa, Homo Sapiens
QLAQFHFTNR

SEQ ID NO: 56625 - protein, 10 aa, Homo Sapiens
QTIEERKERL

SEQ ID NO: 56626 - protein, 10 aa, Homo Sapiens
QTISGTGALR

SEQ ID NO: 56627 - protein, 10 aa, Homo Sapiens
QTSGLPSSVR

SEQ ID NO: 56628 - protein, 10 aa, Homo Sapiens
QVEPGVHLGR

SEQ ID NO: 56629 - protein, 10 aa, Homo Sapiens
SAAGPGFTSR

SEQ ID NO: 56630 - protein, 10 aa, Homo Sapiens
SDMSLTACKV

SEQ ID NO: 56631 - protein, 10 aa, Homo Sapiens
SHIDRVYTLR

SEQ ID NO: 56632 - protein, 10 aa, Homo Sapiens
SIPGGYNALR

SEQ ID NO: 56633 - protein, 10 aa, Homo Sapiens
SIVEFQPTLR

SEQ ID NO: 56634 - protein, 10 aa, Homo Sapiens
SLSDFSWSQR

SEQ ID NO: 56635 - protein, 10 aa, Homo Sapiens
SPTDWTVSHR

SEQ ID NO: 56636 - protein, 10 aa, Homo Sapiens
SSADPSGAFR

SEQ ID NO: 56637 - protein, 10 aa, Homo Sapiens
SSAGGSFTVR

SEQ ID NO: 56638 - protein, 10 aa, Homo Sapiens
SSVDFSLSGR

SEQ ID NO: 56639 - protein, 10 aa, Homo Sapiens
SSYGQQSSFR

SEQ ID NO: 56640 - protein, 10 aa, Homo Sapiens
STFNFHPNVR

SEQ ID NO: 56641 - protein, 10 aa, Homo Sapiens
STIRLLTSLR

SEQ ID NO: 56642 - protein, 10 aa, Homo Sapiens
STIVPSLKHR

SEQ ID NO: 56643 - protein, 10 aa, Homo Sapiens
STNPFQTNAR

SEQ ID NO: 56644 - protein, 10 aa, Homo Sapiens
STPGYIFGKR

SEQ ID NO: 56645 - protein, 10 aa, Homo Sapiens
STTEVTQPRT

SEQ ID NO: 56646 - protein, 10 aa, Homo Sapiens
STVGGWVSTR

SEQ ID NO: 56647 - protein, 10 aa, Homo Sapiens
STVGIIGLGR

SEQ ID NO: 56648 - protein, 10 aa, Homo Sapiens
STVSFGASTR

SEQ ID NO: 56649 - protein, 10 aa, Homo Sapiens
STYYGSFVTR

SEQ ID NO: 56650 - protein, 10 aa, Homo Sapiens
SVAEMPQNYR

SEQ ID NO: 56651 - protein, 10 aa, Homo Sapiens
SVASTPISQR

SEQ ID NO: 56652 - protein, 10 aa, Homo Sapiens
SVFPQNGAAR

SEQ ID NO: 56653 - protein, 10 aa, Homo Sapiens
SVIDSVTKKR

SEQ ID NO: 56654 - protein, 10 aa, Homo Sapiens
SVIEGVSRSR

SEQ ID NO: 56655 - protein, 10 aa, Homo Sapiens
SVIKEMLNRL

SEQ ID NO: 56656 - protein, 10 aa, Homo Sapiens
SVINPGAIYR

SEQ ID NO: 56657 - protein, 10 aa, Homo Sapiens
SVINSVSTSR

SEQ ID NO: 56658 - protein, 10 aa, Homo Sapiens
SVLEATRVNR

SEQ ID NO: 56659 - protein, 10 aa, Homo Sapiens
SVMGVTVSRL

SEQ ID NO: 56660 - protein, 10 aa, Homo Sapiens
SVQGAGTSYR

SEQ ID NO: 56661 - protein, 10 aa, Homo Sapiens
SVVEGGLRAR

SEQ ID NO: 56662 - protein, 10 aa, Homo Sapiens
SVVEIASLRF

SEQ ID NO: 56663 - protein, 10 aa, Homo Sapiens
SVYDALPLTR

SEQ ID NO: 56664 - protein, 10 aa, Homo Sapiens
TAAAIGATPR

SEQ ID NO: 56665 - protein, 10 aa, Homo Sapiens
TAAGPLFQQR

SEQ ID NO: 56666 - protein, 10 aa, Homo Sapiens
TADGVPVNSR

SEQ ID NO: 56667 - protein, 10 aa, Homo Sapiens
TADGVPVSSR

SEQ ID NO: 56668 - protein, 10 aa, Homo Sapiens
TIIEKPPAER

SEQ ID NO: 56669 - protein, 10 aa, Homo Sapiens
TILEFLPKQR

SEQ ID NO: 56670 - protein, 10 aa, Homo Sapiens
TQADLKSSTF

SEQ ID NO: 56671 - protein, 10 aa, Homo Sapiens
TSAESWGTGR

SEQ ID NO: 56672 - protein, 10 aa, Homo Sapiens
TTFPFDPERR

SEQ ID NO: 56673 - protein, 10 aa, Homo Sapiens
TTISKYFSER

SEQ ID NO: 56674 - protein, 10 aa, Homo Sapiens
TTIWKLDGLR

SEQ ID NO: 56675 - protein, 10 aa, Homo Sapiens
TTKELGTVMR

SEQ ID NO: 56676 - protein, 10 aa, Homo Sapiens
TTKVGPNATY

SEQ ID NO: 56677 - protein, 10 aa, Homo Sapiens
TVAEIKKQYR

SEQ ID NO: 56678 - protein, 10 aa, Homo Sapiens
TVAEKLDWAR

SEQ ID NO: 56679 - protein, 10 aa, Homo Sapiens
TVIDIHTLRI

SEQ ID NO: 56680 - protein, 10 aa, Homo Sapiens
TVIDVSTADR

SEQ ID NO: 56681 - protein, 10 aa, Homo Sapiens
TVVEDVTVGR

SEQ ID NO: 56682 - protein, 10 aa, Homo Sapiens
VFDAKRLIGR

SEQ ID NO: 56683 - protein, 10 aa, Homo Sapiens
VGKDPGLAGR

SEQ ID NO: 56684 - protein, 10 aa, Homo Sapiens
VSAGIQTSFR

SEQ ID NO: 56685 - protein, 10 aa, Homo Sapiens
VVDVRIGMTR

SEQ ID NO: 56686 - protein, 10 aa, Homo Sapiens
WTMSNITAGR

SEQ ID NO: 56687 - protein, 10 aa, Homo Sapiens
WVYDEPLLKR

SEQ ID NO: 56688 - protein, 10 aa, Homo Sapiens
YAFNSGNVER

SEQ ID NO: 56689 - protein, 10 aa, Homo Sapiens
YANEVGEAFR

SEQ ID NO: 56690 - protein, 10 aa, Homo Sapiens
YLITFNPVGR

SEQ ID NO: 56691 - protein, 10 aa, Homo Sapiens
YSFFSPSPAR

SEQ ID NO: 56692 - protein, 10 aa, Homo Sapiens
YSFHRGNSQR

SEQ ID NO: 56693 - protein, 10 aa, Homo Sapiens
YTFYSISQER

SEQ ID NO: 56694 - protein, 10 aa, Homo Sapiens
YTIGTGSYGR

SEQ ID NO: 56695 - protein, 10 aa, Homo Sapiens
YTISDTIARF

SEQ ID NO: 56696 - protein, 10 aa, Homo Sapiens
YTKSGYCVNR

SEQ ID NO: 56697 - protein, 10 aa, Homo Sapiens
YTLDVTTGQR

SEQ ID NO: 56698 - protein, 10 aa, Homo Sapiens
YTNGKCVILR

SEQ ID NO: 56699 - protein, 10 aa, Homo Sapiens
YTSNIYTRRV

SEQ ID NO: 56700 - protein, 10 aa, Homo Sapiens
YVIGGHCGYR

SEQ ID NO: 56701 - protein, 10 aa, Homo Sapiens
YVISQMLSAR

SEQ ID NO: 56702 - protein, 10 aa, Homo Sapiens
YVYDKNVLQR

SEQ ID NO: 56703 - protein, 10 aa, Homo Sapiens
YVYPDKTRPR

SEQ ID NO: 56704 - protein, 11 aa, Homo Sapiens
AAWTPGPASNR

SEQ ID NO: 56705 - protein, 11 aa, Homo Sapiens
AQKAEGAGDAK

SEQ ID NO: 56706 - protein, 11 aa, Homo Sapiens
AVAGQELCQPR

SEQ ID NO: 56707 - protein, 11 aa, Homo Sapiens
AVVDVRIGMTR

SEQ ID NO: 56708 - protein, 11 aa, Homo Sapiens
CVYEPDRNALR

SEQ ID NO: 56709 - protein, 11 aa, Homo Sapiens
DAAHPTNVQRL

SEQ ID NO: 56710 - protein, 11 aa, Homo Sapiens
DAIHSMGLIHR

SEQ ID NO: 56711 - protein, 11 aa, Homo Sapiens
DAILHSEDSLR

SEQ ID NO: 56712 - protein, 11 aa, Homo Sapiens
DANGNSFATRI

SEQ ID NO: 56713 - protein, 11 aa, Homo Sapiens
DHSPRARSVAP

SEQ ID NO: 56714 - protein, 11 aa, Homo Sapiens
DIIQPSSTRAR

SEQ ID NO: 56715 - protein, 11 aa, Homo Sapiens
DIQNPDITSSR

SEQ ID NO: 56716 - protein, 11 aa, Homo Sapiens
DLIPCKEAGIR

SEQ ID NO: 56717 - protein, 11 aa, Homo Sapiens
DPKAPGLGAFR

SEQ ID NO: 56718 - protein, 11 aa, Homo Sapiens
DSFCSNGVTHR

SEQ ID NO: 56719 - protein, 11 aa, Homo Sapiens
DSIDPASIEAR

SEQ ID NO: 56720 - protein, 11 aa, Homo Sapiens
DSIGSTVSSER

SEQ ID NO: 56721 - protein, 11 aa, Homo Sapiens
DSMASGTLHLR

SEQ ID NO: 56722 - protein, 11 aa, Homo Sapiens
DSYASGEGLKR

SEQ ID NO: 56723 - protein, 11 aa, Homo Sapiens
DTAPCPINNER

SEQ ID NO: 56724 - protein, 11 aa, Homo Sapiens
DTAPTGHTLRL

SEQ ID NO: 56725 - protein, 11 aa, Homo Sapiens
DTIDERAINKK

SEQ ID NO: 56726 - protein, 11 aa, Homo Sapiens
DTIDERTINKK

SEQ ID NO: 56727 - protein, 11 aa, Homo Sapiens
DTIGISQPQWR

SEQ ID NO: 56728 - protein, 11 aa, Homo Sapiens
DTILNSNHIGR

SEQ ID NO: 56729 - protein, 11 aa, Homo Sapiens
DTITTDTGFMR

SEQ ID NO: 56730 - protein, 11 aa, Homo Sapiens
DTIVSGTLPQR

SEQ ID NO: 56731 - protein, 11 aa, Homo Sapiens
DTKELEKMTNR

SEQ ID NO: 56732 - protein, 11 aa, Homo Sapiens
DTKENLEGTLR

SEQ ID NO: 56733 - protein, 11 aa, Homo Sapiens
DTKGHSLSVQR

SEQ ID NO: 56734 - protein, 11 aa, Homo Sapiens
DTKRSQIYGSR

SEQ ID NO: 56735 - protein, 11 aa, Homo Sapiens
DTSSETVFGKR

SEQ ID NO: 56736 - protein, 11 aa, Homo Sapiens
DTTSTGLAQRL

SEQ ID NO: 56737 - protein, 11 aa, Homo Sapiens
DTVPSVSSINR

SEQ ID NO: 56738 - protein, 11 aa, Homo Sapiens
DTVWVNVGGLR

SEQ ID NO: 56739 - protein, 11 aa, Homo Sapiens
DTYNTLKYANR

SEQ ID NO: 56740 - protein, 11 aa, Homo Sapiens
DVAQWNIGSLR

SEQ ID NO: 56741 - protein, 11 aa, Homo Sapiens
DVFKSNKEVGR

SEQ ID NO: 56742 - protein, 11 aa, Homo Sapiens
DVFPNQPGGKR

SEQ ID NO: 56743 - protein, 11 aa, Homo Sapiens
DVFVVGTERGR

SEQ ID NO: 56744 - protein, 11 aa, Homo Sapiens
DVISRNEIQGR

SEQ ID NO: 56745 - protein, 11 aa, Homo Sapiens
DVISVEKTVKR

SEQ ID NO: 56746 - protein, 11 aa, Homo Sapiens
DVITIIDRSFR

SEQ ID NO: 56747 - protein, 11 aa, Homo Sapiens
DVKTTDGYLLR

SEQ ID NO: 56748 - protein, 11 aa, Homo Sapiens
DVMTALSQGYR

SEQ ID NO: 56749 - protein, 11 aa, Homo Sapiens
DVNSNNNMSYR

SEQ ID NO: 56750 - protein, 11 aa, Homo Sapiens
DVVKLTKNSKR

SEQ ID NO: 56751 - protein, 11 aa, Homo Sapiens
DVVYALKRQGR

SEQ ID NO: 56752 - protein, 11 aa, Homo Sapiens
DVYSGTPTKVR

SEQ ID NO: 56753 - protein, 11 aa, Homo Sapiens
EAAAAALSVRR

SEQ ID NO: 56754 - protein, 11 aa, Homo Sapiens
EAAFATKDRLR

SEQ ID NO: 56755 - protein, 11 aa, Homo Sapiens
EAGPGPRPLAR

SEQ ID NO: 56756 - protein, 11 aa, Homo Sapiens
EAISQVDKLLR

SEQ ID NO: 56757 - protein, 11 aa, Homo Sapiens
EAKPPTVTMPR

SEQ ID NO: 56758 - protein, 11 aa, Homo Sapiens
EAMDQYSIALR

SEQ ID NO: 56759 - protein, 11 aa, Homo Sapiens
EAMDVTTTSTR

SEQ ID NO: 56760 - protein, 11 aa, Homo Sapiens
EAMQSLVTSSR

SEQ ID NO: 56761 - protein, 11 aa, Homo Sapiens
EASPSPCITER

SEQ ID NO: 56762 - protein, 11 aa, Homo Sapiens
EAVKPTVGMKR

SEQ ID NO: 56763 - protein, 11 aa, Homo Sapiens
EAVTQSLLSSR

SEQ ID NO: 56764 - protein, 11 aa, Homo Sapiens
EAWFPGSGAFR

SEQ ID NO: 56765 - protein, 11 aa, Homo Sapiens
EDVPSGRLHLR

SEQ ID NO: 56766 - protein, 11 aa, Homo Sapiens
EIIAPSPQRSR

SEQ ID NO: 56767 - protein, 11 aa, Homo Sapiens
EIKGTNGQVTR

SEQ ID NO: 56768 - protein, 11 aa, Homo Sapiens
EILDSQNLNSR

SEQ ID NO: 56769 - protein, 11 aa, Homo Sapiens
EILELAGNAAR

SEQ ID NO: 56770 - protein, 11 aa, Homo Sapiens
ESAFLSKRNPR

SEQ ID NO: 56771 - protein, 11 aa, Homo Sapiens
ESFASDPILYR

SEQ ID NO: 56772 - protein, 11 aa, Homo Sapiens
ESFFGERRIPR

SEQ ID NO: 56773 - protein, 11 aa, Homo Sapiens
ESFFPYQVTER

SEQ ID NO: 56774 - protein, 11 aa, Homo Sapiens
ESIDPQFTIRR

SEQ ID NO: 56775 - protein, 11 aa, Homo Sapiens
ESIGNCPFSQR

SEQ ID NO: 56776 - protein, 11 aa, Homo Sapiens
ESIPGGYNALR

SEQ ID NO: 56777 - protein, 11 aa, Homo Sapiens
ESKQAGQSVFR

SEQ ID NO: 56778 - protein, 11 aa, Homo Sapiens
ESSAGGSFTVR

SEQ ID NO: 56779 - protein, 11 aa, Homo Sapiens
ESVSFTDGSVR

SEQ ID NO: 56780 - protein, 11 aa, Homo Sapiens
ESYTPSKISVR

SEQ ID NO: 56781 - protein, 11 aa, Homo Sapiens
ETATTPIFANR

SEQ ID NO: 56782 - protein, 11 aa, Homo Sapiens
ETFRSSDPATR

SEQ ID NO: 56783 - protein, 11 aa, Homo Sapiens
ETHESDINSVR

SEQ ID NO: 56784 - protein, 11 aa, Homo Sapiens
ETIDNGFGHSR

SEQ ID NO: 56785 - protein, 11 aa, Homo Sapiens
ETIDTSRVSLR

SEQ ID NO: 56786 - protein, 11 aa, Homo Sapiens
ETIDVHSGYDI

SEQ ID NO: 56787 - protein, 11 aa, Homo Sapiens
ETIGNELFNCR

SEQ ID NO: 56788 - protein, 11 aa, Homo Sapiens
ETIHADSVAKR

SEQ ID NO: 56789 - protein, 11 aa, Homo Sapiens
ETIHPGNVQSR

SEQ ID NO: 56790 - protein, 11 aa, Homo Sapiens
ETILASSGTDR

SEQ ID NO: 56791 - protein, 11 aa, Homo Sapiens
ETILGDIDRAR

SEQ ID NO: 56792 - protein, 11 aa, Homo Sapiens
ETIMSSSMGKR

SEQ ID NO: 56793 - protein, 11 aa, Homo Sapiens
ETINTGPFVMR

SEQ ID NO: 56794 - protein, 11 aa, Homo Sapiens
ETIPGPDAKVR

SEQ ID NO: 56795 - protein, 11 aa, Homo Sapiens
ETIPLGDLQAR

SEQ ID NO: 56796 - protein, 11 aa, Homo Sapiens
ETISSKNIISR

SEQ ID NO: 56797 - protein, 11 aa, Homo Sapiens
ETKDSGSFLLR

SEQ ID NO: 56798 - protein, 11 aa, Homo Sapiens
ETKSTLLFGQR

SEQ ID NO: 56799 - protein, 11 aa, Homo Sapiens
ETLAFPGHVAA

SEQ ID NO: 56800 - protein, 11 aa, Homo Sapiens
ETLEGWKATRR

SEQ ID NO: 56801 - protein, 11 aa, Homo Sapiens
ETLPDGTKRSR

SEQ ID NO: 56802 - protein, 11 aa, Homo Sapiens
ETPNFIIPAQR

SEQ ID NO: 56803 - protein, 11 aa, Homo Sapiens
ETQVSDFLSGR

SEQ ID NO: 56804 - protein, 11 aa, Homo Sapiens
ETVAVSPTICR

SEQ ID NO: 56805 - protein, 11 aa, Homo Sapiens
ETVPAFSERTC

SEQ ID NO: 56806 - protein, 11 aa, Homo Sapiens
ETVQKETIHPR

SEQ ID NO: 56807 - protein, 11 aa, Homo Sapiens
ETYLNENLRKR

SEQ ID NO: 56808 - protein, 11 aa, Homo Sapiens
ETYRGGMAINR

SEQ ID NO: 56809 - protein, 11 aa, Homo Sapiens
EVAKQALNRLR

SEQ ID NO: 56810 - protein, 11 aa, Homo Sapiens
EVAQVESLRYR

SEQ ID NO: 56811 - protein, 11 aa, Homo Sapiens
EVFIGESLSSR

SEQ ID NO: 56812 - protein, 11 aa, Homo Sapiens
EVFTTLSVTKR

SEQ ID NO: 56813 - protein, 11 aa, Homo Sapiens
EVHAVGLYGAR

SEQ ID NO: 56814 - protein, 11 aa, Homo Sapiens
EVIDQRLIEAR

SEQ ID NO: 56815 - protein, 11 aa, Homo Sapiens
EVIEGYEIACR

SEQ ID NO: 56816 - protein, 11 aa, Homo Sapiens
EVIGSKLNISR

SEQ ID NO: 56817 - protein, 11 aa, Homo Sapiens
EVIHLNVGGKR

SEQ ID NO: 56818 - protein, 11 aa, Homo Sapiens
EVIKTRLQSSR

SEQ ID NO: 56819 - protein, 11 aa, Homo Sapiens
EVINAREVAPR

SEQ ID NO: 56820 - protein, 11 aa, Homo Sapiens
EVINELFYTER

SEQ ID NO: 56821 - protein, 11 aa, Homo Sapiens
EVIPYTPAMQR

SEQ ID NO: 56822 - protein, 11 aa, Homo Sapiens
EVIQNPATITR

SEQ ID NO: 56823 - protein, 11 aa, Homo Sapiens
EVISLSQVTPK

SEQ ID NO: 56824 - protein, 11 aa, Homo Sapiens
EVISTPGVVAR

SEQ ID NO: 56825 - protein, 11 aa, Homo Sapiens
EVIVVVGGCER

SEQ ID NO: 56826 - protein, 11 aa, Homo Sapiens
EVKQVESGTLR

SEQ ID NO: 56827 - protein, 11 aa, Homo Sapiens
EVMRQRGINMR

SEQ ID NO: 56828 - protein, 11 aa, Homo Sapiens
EVQDRVMLTGR

SEQ ID NO: 56829 - protein, 11 aa, Homo Sapiens
EVQQARDLQNR

SEQ ID NO: 56830 - protein, 11 aa, Homo Sapiens
EVQVASQSSQR

SEQ ID NO: 56831 - protein, 11 aa, Homo Sapiens
EVRADTGGLGR

SEQ ID NO: 56832 - protein, 11 aa, Homo Sapiens
EVRAVGQGVLR

SEQ ID NO: 56833 - protein, 11 aa, Homo Sapiens
EVTPVTGASLR

SEQ ID NO: 56834 - protein, 11 aa, Homo Sapiens
EVVDTTASTKR

SEQ ID NO: 56835 - protein, 11 aa, Homo Sapiens
EVVEGMDISTR

SEQ ID NO: 56836 - protein, 11 aa, Homo Sapiens
EVVTGVIGQRM

SEQ ID NO: 56837 - protein, 11 aa, Homo Sapiens
EVVTPNIFNSR

SEQ ID NO: 56838 - protein, 11 aa, Homo Sapiens
EVWIPKNGTRR

SEQ ID NO: 56839 - protein, 11 aa, Homo Sapiens
EVYQGCGTELR

SEQ ID NO: 56840 - protein, 11 aa, Homo Sapiens
FSFSPGAGAFR

SEQ ID NO: 56841 - protein, 11 aa, Homo Sapiens
FSVNASSERLN

SEQ ID NO: 56842 - protein, 11 aa, Homo Sapiens
FTIGTSMTTGR

SEQ ID NO: 56843 - protein, 11 aa, Homo Sapiens
FTLEASEGCYR

SEQ ID NO: 56844 - protein, 11 aa, Homo Sapiens
FTMASSPAQRR

SEQ ID NO: 56845 - protein, 11 aa, Homo Sapiens
FTNEVLTKTYR

SEQ ID NO: 56846 - protein, 11 aa, Homo Sapiens
FTTESRLGGAR

SEQ ID NO: 56847 - protein, 11 aa, Homo Sapiens
FVIDSDHLGHR

SEQ ID NO: 56848 - protein, 11 aa, Homo Sapiens
FVIENESPSGR

SEQ ID NO: 56849 - protein, 11 aa, Homo Sapiens
FVKDSIRLVKR

SEQ ID NO: 56850 - protein, 11 aa, Homo Sapiens
FVSAGIQTSFR

SEQ ID NO: 56851 - protein, 11 aa, Homo Sapiens
FVVEPSEATNR

SEQ ID NO: 56852 - protein, 11 aa, Homo Sapiens
GVYATRSSAVR

SEQ ID NO: 56853 - protein, 11 aa, Homo Sapiens
HIIEKDKITTR

SEQ ID NO: 56854 - protein, 11 aa, Homo Sapiens
HLLDPSSFTGR

SEQ ID NO: 56855 - protein, 11 aa, Homo Sapiens
HSLSLEAPRLH

SEQ ID NO: 56856 - protein, 11 aa, Homo Sapiens
HTLLVTVSGQR

SEQ ID NO: 56857 - protein, 11 aa, Homo Sapiens
HVAESSLSRLR

SEQ ID NO: 56858 - protein, 11 aa, Homo Sapiens
HVKTGGKISLR

SEQ ID NO: 56859 - protein, 11 aa, Homo Sapiens
IVIETGPLKGR

SEQ ID NO: 56860 - protein, 11 aa, Homo Sapiens
LAINGMDVNGR

SEQ ID NO: 56861 - protein, 11 aa, Homo Sapiens
LSFIPPDGNFR

SEQ ID NO: 56862 - protein, 11 aa, Homo Sapiens
LSISSESLQAR

SEQ ID NO: 56863 - protein, 11 aa, Homo Sapiens
LVWKPRPASAR

SEQ ID NO: 56864 - protein, 11 aa, Homo Sapiens
MAAAGAAVARS

SEQ ID NO: 56865 - protein, 11 aa, Homo Sapiens
MTIGTDSALHR

SEQ ID NO: 56866 - protein, 11 aa, Homo Sapiens
MTKGTSSFGKR

SEQ ID NO: 56867 - protein, 11 aa, Homo Sapiens
MTQDAQNALRR

SEQ ID NO: 56868 - protein, 11 aa, Homo Sapiens
MVVDSSNTALR

SEQ ID NO: 56869 - protein, 11 aa, Homo Sapiens
NTMDADSLVSR

SEQ ID NO: 56870 - protein, 11 aa, Homo Sapiens
NVAEVDKVTGR

SEQ ID NO: 56871 - protein, 11 aa, Homo Sapiens
NVIEPSFGLGR

SEQ ID NO: 56872 - protein, 11 aa, Homo Sapiens
NVIESKAYVGR

SEQ ID NO: 56873 - protein, 11 aa, Homo Sapiens
QGYTQPGPGYR

SEQ ID NO: 56874 - protein, 11 aa, Homo Sapiens
QSVTEVSESTV

SEQ ID NO: 56875 - protein, 11 aa, Homo Sapiens
QSYDPNHPSYR

SEQ ID NO: 56876 - protein, 11 aa, Homo Sapiens
QTLQPSDHGSR

SEQ ID NO: 56877 - protein, 11 aa, Homo Sapiens
QTVQSELFRSR

SEQ ID NO: 56878 - protein, 11 aa, Homo Sapiens
QVIGPLTEGQR

SEQ ID NO: 56879 - protein, 11 aa, Homo Sapiens
SAQDPSQLSFR

SEQ ID NO: 56880 - protein, 11 aa, Homo Sapiens
SLSGGGGSRSI

SEQ ID NO: 56881 - protein, 11 aa, Homo Sapiens
STIDCGLVRLR

SEQ ID NO: 56882 - protein, 11 aa, Homo Sapiens
STIGFKLPNHR

SEQ ID NO: 56883 - protein, 11 aa, Homo Sapiens
STIGFKLPSYR

SEQ ID NO: 56884 - protein, 11 aa, Homo Sapiens
STMPHTSGMNR

SEQ ID NO: 56885 - protein, 11 aa, Homo Sapiens
STVNPEQYSKR

SEQ ID NO: 56886 - protein, 11 aa, Homo Sapiens
SVAGLTAAAYR

SEQ ID NO: 56887 - protein, 11 aa, Homo Sapiens
SVISSRNTGQR

SEQ ID NO: 56888 - protein, 11 aa, Homo Sapiens
SVVVPSGQEQR

SEQ ID NO: 56889 - protein, 11 aa, Homo Sapiens
TAIEAQHLLKR

SEQ ID NO: 56890 - protein, 11 aa, Homo Sapiens
TAITSQYLAER

SEQ ID NO: 56891 - protein, 11 aa, Homo Sapiens
TELSVRAKPSA

SEQ ID NO: 56892 - protein, 11 aa, Homo Sapiens
TLIDPETLLPR

SEQ ID NO: 56893 - protein, 11 aa, Homo Sapiens
TSFFPTAGGFR

SEQ ID NO: 56894 - protein, 11 aa, Homo Sapiens
TSFPSGEATPR

SEQ ID NO: 56895 - protein, 11 aa, Homo Sapiens
TTAGAVTQCYR

SEQ ID NO: 56896 - protein, 11 aa, Homo Sapiens
TTVLPSSSSSR

SEQ ID NO: 56897 - protein, 11 aa, Homo Sapiens
TVFDAKRLIGR

SEQ ID NO: 56898 - protein, 11 aa, Homo Sapiens
VDFVVAAASLR

SEQ ID NO: 56899 - protein, 11 aa, Homo Sapiens
WTLDPTSLSTR

SEQ ID NO: 56900 - protein, 11 aa, Homo Sapiens
YTSDADGLCTR

SEQ ID NO: 56901 - protein, 11 aa, Homo Sapiens
YVIDSGKMKEK

SEQ ID NO: 56902 - protein, 8 aa, Homo Sapiens
AEITPKGR

SEQ ID NO: 56903 - protein, 8 aa, Homo Sapiens
APPEYHRK

SEQ ID NO: 56904 - protein, 8 aa, Homo Sapiens
DEPPVFSR

SEQ ID NO: 56905 - protein, 8 aa, Homo Sapiens
EIGPSICR

SEQ ID NO: 56906 - protein, 8 aa, Homo Sapiens
ENAPLAKR

SEQ ID NO: 56907 - protein, 8 aa, Homo Sapiens
FEVDTVAP

SEQ ID NO: 56908 - protein, 8 aa, Homo Sapiens
FNEKSKEL

SEQ ID NO: 56909 - protein, 8 aa, Homo Sapiens
FSPVGSVL

SEQ ID NO: 56910 - protein, 8 aa, Homo Sapiens
IDQKIVER

SEQ ID NO: 56911 - protein, 8 aa, Homo Sapiens
ILIDPFHK

SEQ ID NO: 56912 - protein, 8 aa, Homo Sapiens
LADIMAKR

SEQ ID NO: 56913 - protein, 8 aa, Homo Sapiens
MHKAELVK

SEQ ID NO: 56914 - protein, 8 aa, Homo Sapiens
MVQQLGKA

SEQ ID NO: 56915 - protein, 8 aa, Homo Sapiens
MVVQGKRM

SEQ ID NO: 56916 - protein, 8 aa, Homo Sapiens
PAISPSKR

SEQ ID NO: 56917 - protein, 8 aa, Homo Sapiens
PAKAIGHR

SEQ ID NO: 56918 - protein, 8 aa, Homo Sapiens
PRNPVNKR

SEQ ID NO: 56919 - protein, 8 aa, Homo Sapiens
RVDPVNFK

SEQ ID NO: 56920 - protein, 8 aa, Homo Sapiens
SGPSIVHR

SEQ ID NO: 56921 - protein, 8 aa, Homo Sapiens
SSGAVVHR

SEQ ID NO: 56922 - protein, 8 aa, Homo Sapiens
TADVHFER

SEQ ID NO: 56923 - protein, 8 aa, Homo Sapiens
TFSGVYKK

SEQ ID NO: 56924 - protein, 8 aa, Homo Sapiens
TGNPTVVR

SEQ ID NO: 56925 - protein, 8 aa, Homo Sapiens
TPTISRER

SEQ ID NO: 56926 - protein, 8 aa, Homo Sapiens
VAAVAARR

SEQ ID NO: 56927 - protein, 8 aa, Homo Sapiens
VATLPRGR

SEQ ID NO: 56928 - protein, 8 aa, Homo Sapiens
VFRDPALK

SEQ ID NO: 56929 - protein, 8 aa, Homo Sapiens
VIPQKKGK

SEQ ID NO: 56930 - protein, 9 aa, Homo Sapiens
AAAGAFAGR

SEQ ID NO: 56931 - protein, 9 aa, Homo Sapiens
AAAGLAGPR

SEQ ID NO: 56932 - protein, 9 aa, Homo Sapiens
AALPGIVHR

SEQ ID NO: 56933 - protein, 9 aa, Homo Sapiens
AAVAAVAAR

SEQ ID NO: 56934 - protein, 9 aa, Homo Sapiens
AAVDSSVPR

SEQ ID NO: 56935 - protein, 9 aa, Homo Sapiens
AAVDVVRAR

SEQ ID NO: 56936 - protein, 9 aa, Homo Sapiens
AAVPVAAAR

SEQ ID NO: 56937 - protein, 9 aa, Homo Sapiens
AAVPVIISR

SEQ ID NO: 56938 - protein, 9 aa, Homo Sapiens
AEVDKVTGR

SEQ ID NO: 56939 - protein, 9 aa, Homo Sapiens
AIAAIKTKR

SEQ ID NO: 56940 - protein, 9 aa, Homo Sapiens
AIATIKTKR

SEQ ID NO: 56941 - protein, 9 aa, Homo Sapiens
AIPGFTINR

SEQ ID NO: 56942 - protein, 9 aa, Homo Sapiens
AITQVVVSR

SEQ ID NO: 56943 - protein, 9 aa, Homo Sapiens
AIVDVVANR

SEQ ID NO: 56944 - protein, 9 aa, Homo Sapiens
ASAPVTVKR

SEQ ID NO: 56945 - protein, 9 aa, Homo Sapiens
ASSYIAHLR

SEQ ID NO: 56946 - protein, 9 aa, Homo Sapiens
ATAELIMSR

SEQ ID NO: 56947 - protein, 9 aa, Homo Sapiens
ATIALMIQR

SEQ ID NO: 56948 - protein, 9 aa, Homo Sapiens
ATIQGAYAR

SEQ ID NO: 56949 - protein, 9 aa, Homo Sapiens
ATSGVVAVR

SEQ ID NO: 56950 - protein, 9 aa, Homo Sapiens
ATSPLQENR

SEQ ID NO: 56951 - protein, 9 aa, Homo Sapiens
ATTPIFANR

SEQ ID NO: 56952 - protein, 9 aa, Homo Sapiens
AVAAVAARR

SEQ ID NO: 56953 - protein, 9 aa, Homo Sapiens
AVIDVGINR

SEQ ID NO: 56954 - protein, 9 aa, Homo Sapiens
AVMGNPVTR

SEQ ID NO: 56955 - protein, 9 aa, Homo Sapiens
AVSPTICRR

SEQ ID NO: 56956 - protein, 9 aa, Homo Sapiens
AVTDVEATR

SEQ ID NO: 56957 - protein, 9 aa, Homo Sapiens
AVVALAVGR

SEQ ID NO: 56958 - protein, 9 aa, Homo Sapiens
AVVAVAEKR

SEQ ID NO: 56959 - protein, 9 aa, Homo Sapiens
AVYDFFIGR

SEQ ID NO: 56960 - protein, 9 aa, Homo Sapiens
CAEQVQPPR

SEQ ID NO: 56961 - protein, 9 aa, Homo Sapiens
CAPRRKVAL

SEQ ID NO: 56962 - protein, 9 aa, Homo Sapiens
CIISLVTQR

SEQ ID NO: 56963 - protein, 9 aa, Homo Sapiens
CTALGEIGR

SEQ ID NO: 56964 - protein, 9 aa, Homo Sapiens
CTVANPVSR

SEQ ID NO: 56965 - protein, 9 aa, Homo Sapiens
CVKSFVTKR

SEQ ID NO: 56966 - protein, 9 aa, Homo Sapiens
CVSPTVNQR

SEQ ID NO: 56967 - protein, 9 aa, Homo Sapiens
DAAEPDVQR

SEQ ID NO: 56968 - protein, 9 aa, Homo Sapiens
DAAFNKITR

SEQ ID NO: 56969 - protein, 9 aa, Homo Sapiens
DAAGVFCIR

SEQ ID NO: 56970 - protein, 9 aa, Homo Sapiens
DAAIVGAVR

SEQ ID NO: 56971 - protein, 9 aa, Homo Sapiens
DAAKDSILR

SEQ ID NO: 56972 - protein, 9 aa, Homo Sapiens
DAATEIVER

SEQ ID NO: 56973 - protein, 9 aa, Homo Sapiens
DAEAIYVTR

SEQ ID NO: 56974 - protein, 9 aa, Homo Sapiens
DAQKPSLTR

SEQ ID NO: 56975 - protein, 9 aa, Homo Sapiens
DASRNVFSR

SEQ ID NO: 56976 - protein, 9 aa, Homo Sapiens
DAVDVFETR

SEQ ID NO: 56977 - protein, 9 aa, Homo Sapiens
DAVNLAFGR

SEQ ID NO: 56978 - protein, 9 aa, Homo Sapiens
DAWEPKVLR

SEQ ID NO: 56979 - protein, 9 aa, Homo Sapiens
DAWPGQRER

SEQ ID NO: 56980 - protein, 9 aa, Homo Sapiens
DIFNQVVPR

SEQ ID NO: 56981 - protein, 9 aa, Homo Sapiens
DIFPKVTCR

SEQ ID NO: 56982 - protein, 9 aa, Homo Sapiens
DIFSEVVGR

SEQ ID NO: 56983 - protein, 9 aa, Homo Sapiens
DIIGPMPAK

SEQ ID NO: 56984 - protein, 9 aa, Homo Sapiens
DIIPNPQER

SEQ ID NO: 56985 - protein, 9 aa, Homo Sapiens
DIIQPSSTR

SEQ ID NO: 56986 - protein, 9 aa, Homo Sapiens
DIQGHPFFR

SEQ ID NO: 56987 - protein, 9 aa, Homo Sapiens
DITTGQPPR

SEQ ID NO: 56988 - protein, 9 aa, Homo Sapiens
DIYFNPKTR

SEQ ID NO: 56989 - protein, 9 aa, Homo Sapiens
DLAKIIFKR

SEQ ID NO: 56990 - protein, 9 aa, Homo Sapiens
DLEPPVVKR

SEQ ID NO: 56991 - protein, 9 aa, Homo Sapiens
DLFDFITER

SEQ ID NO: 56992 - protein, 9 aa, Homo Sapiens
DLFYNIATR

SEQ ID NO: 56993 - protein, 9 aa, Homo Sapiens
DLIGCIIGR

SEQ ID NO: 56994 - protein, 9 aa, Homo Sapiens
DMFATPQYR

SEQ ID NO: 56995 - protein, 9 aa, Homo Sapiens
DPAGVHPPR

SEQ ID NO: 56996 - protein, 9 aa, Homo Sapiens
DPFHKAIRR

SEQ ID NO: 56997 - protein, 9 aa, Homo Sapiens
DPTDVAALR

SEQ ID NO: 56998 - protein, 9 aa, Homo Sapiens
DPYSTGHLR

SEQ ID NO: 56999 - protein, 9 aa, Homo Sapiens
DSAPVETPR

SEQ ID NO: 57000 - protein, 9 aa, Homo Sapiens
DSCPNPIQR

SEQ ID NO: 57001 - protein, 9 aa, Homo Sapiens
DSFQKVILR

SEQ ID NO: 57002 - protein, 9 aa, Homo Sapiens
DSFSAGEPR

SEQ ID NO: 57003 - protein, 9 aa, Homo Sapiens
DSFTGPRRR

SEQ ID NO: 57004 - protein, 9 aa, Homo Sapiens
DSMPEPASR

SEQ ID NO: 57005 - protein, 9 aa, Homo Sapiens
DSQYPPVQR

SEQ ID NO: 57006 - protein, 9 aa, Homo Sapiens
DSSGLTVHR

SEQ ID NO: 57007 - protein, 9 aa, Homo Sapiens
DSSQLIHCR

SEQ ID NO: 57008 - protein, 9 aa, Homo Sapiens
DSVFVENCR

SEQ ID NO: 57009 - protein, 9 aa, Homo Sapiens
DSVNIGRKR

SEQ ID NO: 57010 - protein, 9 aa, Homo Sapiens
DTAAQITQR

SEQ ID NO: 57011 - protein, 9 aa, Homo Sapiens
DTHGSFVVR

SEQ ID NO: 57012 - protein, 9 aa, Homo Sapiens
DTIEIITDR

SEQ ID NO: 57013 - protein, 9 aa, Homo Sapiens
DTITETDLR

SEQ ID NO: 57014 - protein, 9 aa, Homo Sapiens
DTMPPKGVR

SEQ ID NO: 57015 - protein, 9 aa, Homo Sapiens
DTPGIQIGR

SEQ ID NO: 57016 - protein, 9 aa, Homo Sapiens
DTQKFSVMR

SEQ ID NO: 57017 - protein, 9 aa, Homo Sapiens
DTVAQITQR

SEQ ID NO: 57018 - protein, 9 aa, Homo Sapiens
DVAAQQSLR

SEQ ID NO: 57019 - protein, 9 aa, Homo Sapiens
DVARLVVER

SEQ ID NO: 57020 - protein, 9 aa, Homo Sapiens
DVASVIVTK

SEQ ID NO: 57021 - protein, 9 aa, Homo Sapiens
DVFIPKPFR

SEQ ID NO: 57022 - protein, 9 aa, Homo Sapiens
DVFPGPSFR

SEQ ID NO: 57023 - protein, 9 aa, Homo Sapiens
DVFVVGTER

SEQ ID NO: 57024 - protein, 9 aa, Homo Sapiens
DVFYLQPER

SEQ ID NO: 57025 - protein, 9 aa, Homo Sapiens
DVIGVTKGK

SEQ ID NO: 57026 - protein, 9 aa, Homo Sapiens
DVNSFVRSR

SEQ ID NO: 57027 - protein, 9 aa, Homo Sapiens
DVPSPFNHR

SEQ ID NO: 57028 - protein, 9 aa, Homo Sapiens
DVSHPIIYR

SEQ ID NO: 57029 - protein, 9 aa, Homo Sapiens
DVSPVVSTY

SEQ ID NO: 57030 - protein, 9 aa, Homo Sapiens
DVTKITKLR

SEQ ID NO: 57031 - protein, 9 aa, Homo Sapiens
DVVYNAVHR

SEQ ID NO: 57032 - protein, 9 aa, Homo Sapiens
DVYENLHTK

SEQ ID NO: 57033 - protein, 9 aa, Homo Sapiens
DVYPEIIER

SEQ ID NO: 57034 - protein, 9 aa, Homo Sapiens
DVYTPKSSR

SEQ ID NO: 57035 - protein, 9 aa, Homo Sapiens
EAAAIIAQR

SEQ ID NO: 57036 - protein, 9 aa, Homo Sapiens
EAAIGVTKR

SEQ ID NO: 57037 - protein, 9 aa, Homo Sapiens
EAAPVVVGH

SEQ ID NO: 57038 - protein, 9 aa, Homo Sapiens
EAAQKFLER

SEQ ID NO: 57039 - protein, 9 aa, Homo Sapiens
EAAYIGSMR

SEQ ID NO: 57040 - protein, 9 aa, Homo Sapiens
EAEVASLNR

SEQ ID NO: 57041 - protein, 9 aa, Homo Sapiens
EAFDFVKQR

SEQ ID NO: 57042 - protein, 9 aa, Homo Sapiens
EAFQTTISK

SEQ ID NO: 57043 - protein, 9 aa, Homo Sapiens
EAGAIISTR

SEQ ID NO: 57044 - protein, 9 aa, Homo Sapiens
EAGAPELQR

SEQ ID NO: 57045 - protein, 9 aa, Homo Sapiens
EAGPSIVHR

SEQ ID NO: 57046 - protein, 9 aa, Homo Sapiens
EAHARIHLR

SEQ ID NO: 57047 - protein, 9 aa, Homo Sapiens
EAHFVPLVK

SEQ ID NO: 57048 - protein, 9 aa, Homo Sapiens
EAIAKGIRR

SEQ ID NO: 57049 - protein, 9 aa, Homo Sapiens
EAIGNEVTR

SEQ ID NO: 57050 - protein, 9 aa, Homo Sapiens
EAIGPSTIR

SEQ ID NO: 57051 - protein, 9 aa, Homo Sapiens
EAIYDICRR

SEQ ID NO: 57052 - protein, 9 aa, Homo Sapiens
EAKFPTMNR

SEQ ID NO: 57053 - protein, 9 aa, Homo Sapiens
EALNQVTQR

SEQ ID NO: 57054 - protein, 9 aa, Homo Sapiens
EATAMAMGR

SEQ ID NO: 57055 - protein, 9 aa, Homo Sapiens
EAVFNPQSR

SEQ ID NO: 57056 - protein, 9 aa, Homo Sapiens
EAVGVTSQR

SEQ ID NO: 57057 - protein, 9 aa, Homo Sapiens
EAVKLIIGR

SEQ ID NO: 57058 - protein, 9 aa, Homo Sapiens
EAVKPFGLK

SEQ ID NO: 57059 - protein, 9 aa, Homo Sapiens
EAYRFVKEK

SEQ ID NO: 57060 - protein, 9 aa, Homo Sapiens
EDFYTATER

SEQ ID NO: 57061 - protein, 9 aa, Homo Sapiens
EGAGILLTR

SEQ ID NO: 57062 - protein, 9 aa, Homo Sapiens
EGIGSTVFR

SEQ ID NO: 57063 - protein, 9 aa, Homo Sapiens
EGTVICVTR

SEQ ID NO: 57064 - protein, 9 aa, Homo Sapiens
EGVGILLTR

SEQ ID NO: 57065 - protein, 9 aa, Homo Sapiens
EIAAVIETV

SEQ ID NO: 57066 - protein, 9 aa, Homo Sapiens
EIAIIPSKK

SEQ ID NO: 57067 - protein, 9 aa, Homo Sapiens
EIAPDIRGR

SEQ ID NO: 57068 - protein, 9 aa, Homo Sapiens
EIEPNVFLR

SEQ ID NO: 57069 - protein, 9 aa, Homo Sapiens
EIEWNPATK

SEQ ID NO: 57070 - protein, 9 aa, Homo Sapiens
EIFDGIQPK

SEQ ID NO: 57071 - protein, 9 aa, Homo Sapiens
EIFGTIGMR

SEQ ID NO: 57072 - protein, 9 aa, Homo Sapiens
EIFQNEVAR

SEQ ID NO: 57073 - protein, 9 aa, Homo Sapiens
EIGPVSSSR

SEQ ID NO: 57074 - protein, 9 aa, Homo Sapiens
EIGWFPCNR

SEQ ID NO: 57075 - protein, 9 aa, Homo Sapiens
EIIAKEEQR

SEQ ID NO: 57076 - protein, 9 aa, Homo Sapiens
EIIEQPKQR

SEQ ID NO: 57077 - protein, 9 aa, Homo Sapiens
EIIEQPRQR

SEQ ID NO: 57078 - protein, 9 aa, Homo Sapiens
EIINIMQDR

SEQ ID NO: 57079 - protein, 9 aa, Homo Sapiens
EIISKLQGR

SEQ ID NO: 57080 - protein, 9 aa, Homo Sapiens
EIKHFVSER

SEQ ID NO: 57081 - protein, 9 aa, Homo Sapiens
EINKLLAHR

SEQ ID NO: 57082 - protein, 9 aa, Homo Sapiens
EIPALSVSR

SEQ ID NO: 57083 - protein, 9 aa, Homo Sapiens
EIPENFTTR

SEQ ID NO: 57084 - protein, 9 aa, Homo Sapiens
EISAPVSER

SEQ ID NO: 57085 - protein, 9 aa, Homo Sapiens
EISGTFTHR

SEQ ID NO: 57086 - protein, 9 aa, Homo Sapiens
EISSPAVER

SEQ ID NO: 57087 - protein, 9 aa, Homo Sapiens
EITPPVVLR

SEQ ID NO: 57088 - protein, 9 aa, Homo Sapiens
EIVDVPVEK

SEQ ID NO: 57089 - protein, 9 aa, Homo Sapiens
EIVGSIKMR

SEQ ID NO: 57090 - protein, 9 aa, Homo Sapiens
EIVKAIKER

SEQ ID NO: 57091 - protein, 9 aa, Homo Sapiens
EIVKPSPKR

SEQ ID NO: 57092 - protein, 9 aa, Homo Sapiens
EIVSRVSKR

SEQ ID NO: 57093 - protein, 9 aa, Homo Sapiens
EIYEYIIFR

SEQ ID NO: 57094 - protein, 9 aa, Homo Sapiens
EIYGVTHTR

SEQ ID NO: 57095 - protein, 9 aa, Homo Sapiens
EIYRPPASR

SEQ ID NO: 57096 - protein, 9 aa, Homo Sapiens
ELAKIMRTR

SEQ ID NO: 57097 - protein, 9 aa, Homo Sapiens
ELAQVIVSR

SEQ ID NO: 57098 - protein, 9 aa, Homo Sapiens
ELFKNVCER

SEQ ID NO: 57099 - protein, 9 aa, Homo Sapiens
ELFPAPILR

SEQ ID NO: 57100 - protein, 9 aa, Homo Sapiens
ELIKIIRRR

SEQ ID NO: 57101 - protein, 9 aa, Homo Sapiens
ELIQDITQR

SEQ ID NO: 57102 - protein, 9 aa, Homo Sapiens
ELIQEITQR

SEQ ID NO: 57103 - protein, 9 aa, Homo Sapiens
ELMGYIMGK

SEQ ID NO: 57104 - protein, 9 aa, Homo Sapiens
ELNPSTGNR

SEQ ID NO: 57105 - protein, 9 aa, Homo Sapiens
ELSDLHAHK

SEQ ID NO: 57106 - protein, 9 aa, Homo Sapiens
ELVPFESPR

SEQ ID NO: 57107 - protein, 9 aa, Homo Sapiens
ELVSITANK

SEQ ID NO: 57108 - protein, 9 aa, Homo Sapiens
ELVSPKLNR

SEQ ID NO: 57109 - protein, 9 aa, Homo Sapiens
ELYNAPEGR

SEQ ID NO: 57110 - protein, 9 aa, Homo Sapiens
EMTGYVVTR

SEQ ID NO: 57111 - protein, 9 aa, Homo Sapiens
ENADVPVVR

SEQ ID NO: 57112 - protein, 9 aa, Homo Sapiens
ENFGNTTPR

SEQ ID NO: 57113 - protein, 9 aa, Homo Sapiens
ENTAITIGR

SEQ ID NO: 57114 - protein, 9 aa, Homo Sapiens
EPAAVIVEK

SEQ ID NO: 57115 - protein, 9 aa, Homo Sapiens
EPSEVFINR

SEQ ID NO: 57116 - protein, 9 aa, Homo Sapiens
EPVEVVAPR

SEQ ID NO: 57117 - protein, 9 aa, Homo Sapiens
EPYANPTKR

SEQ ID NO: 57118 - protein, 9 aa, Homo Sapiens
ESAPKASLR

SEQ ID NO: 57119 - protein, 9 aa, Homo Sapiens
ESAPVHNSF

SEQ ID NO: 57120 - protein, 9 aa, Homo Sapiens
ESAQDFASR

SEQ ID NO: 57121 - protein, 9 aa, Homo Sapiens
ESAYNAFNR

SEQ ID NO: 57122 - protein, 9 aa, Homo Sapiens
ESFCDKVMR

SEQ ID NO: 57123 - protein, 9 aa, Homo Sapiens
ESFGVPKGR

SEQ ID NO: 57124 - protein, 9 aa, Homo Sapiens
ESFKEKFVR

SEQ ID NO: 57125 - protein, 9 aa, Homo Sapiens
ESFPSVNSR

SEQ ID NO: 57126 - protein, 9 aa, Homo Sapiens
ESIDKKISR

SEQ ID NO: 57127 - protein, 9 aa, Homo Sapiens
ESIDQYIER

SEQ ID NO: 57128 - protein, 9 aa, Homo Sapiens
ESIRAAVNR

SEQ ID NO: 57129 - protein, 9 aa, Homo Sapiens
ESQSNPVFR

SEQ ID NO: 57130 - protein, 9 aa, Homo Sapiens
ESTNFATLR

SEQ ID NO: 57131 - protein, 9 aa, Homo Sapiens
ESTPITAVK

SEQ ID NO: 57132 - protein, 9 aa, Homo Sapiens
ETADVIAKV

SEQ ID NO: 57133 - protein, 9 aa, Homo Sapiens
ETAFAFHLR

SEQ ID NO: 57134 - protein, 9 aa, Homo Sapiens
ETAIPFRSR

SEQ ID NO: 57135 - protein, 9 aa, Homo Sapiens
ETAIPSSTR

SEQ ID NO: 57136 - protein, 9 aa, Homo Sapiens
ETAKPIPAR

SEQ ID NO: 57137 - protein, 9 aa, Homo Sapiens
ETDGFQVKR

SEQ ID NO: 57138 - protein, 9 aa, Homo Sapiens
ETEPTIIER

SEQ ID NO: 57139 - protein, 9 aa, Homo Sapiens
ETESVVSLR

SEQ ID NO: 57140 - protein, 9 aa, Homo Sapiens
ETFKSIMKK

SEQ ID NO: 57141 - protein, 9 aa, Homo Sapiens
ETFLAQRQR

SEQ ID NO: 57142 - protein, 9 aa, Homo Sapiens
ETFNSITKR

SEQ ID NO: 57143 - protein, 9 aa, Homo Sapiens
ETFNTPAMY

SEQ ID NO: 57144 - protein, 9 aa, Homo Sapiens
ETFQFILGK

SEQ ID NO: 57145 - protein, 9 aa, Homo Sapiens
ETFSGVYKK

SEQ ID NO: 57146 - protein, 9 aa, Homo Sapiens
ETIDVHSGY

SEQ ID NO: 57147 - protein, 9 aa, Homo Sapiens
ETIGEILKK

SEQ ID NO: 57148 - protein, 9 aa, Homo Sapiens
ETIGKKFEK

SEQ ID NO: 57149 - protein, 9 aa, Homo Sapiens
ETIKQLQER

SEQ ID NO: 57150 - protein, 9 aa, Homo Sapiens
ETILRTNKR

SEQ ID NO: 57151 - protein, 9 aa, Homo Sapiens
ETIPSFTGR

SEQ ID NO: 57152 - protein, 9 aa, Homo Sapiens
ETISTATGR

SEQ ID NO: 57153 - protein, 9 aa, Homo Sapiens
ETLLLQAER

SEQ ID NO: 57154 - protein, 9 aa, Homo Sapiens
ETLMETHER

SEQ ID NO: 57155 - protein, 9 aa, Homo Sapiens
ETLSQSPPK

SEQ ID NO: 57156 - protein, 9 aa, Homo Sapiens
ETMPCVKKK

SEQ ID NO: 57157 - protein, 9 aa, Homo Sapiens
ETMPYVKKK

SEQ ID NO: 57158 - protein, 9 aa, Homo Sapiens
ETNTGEVYR

SEQ ID NO: 57159 - protein, 9 aa, Homo Sapiens
ETNYGIPQR

SEQ ID NO: 57160 - protein, 9 aa, Homo Sapiens
ETPAISPSK

SEQ ID NO: 57161 - protein, 9 aa, Homo Sapiens
ETPITSVPR

SEQ ID NO: 57162 - protein, 9 aa, Homo Sapiens
ETQLPVSFR

SEQ ID NO: 57163 - protein, 9 aa, Homo Sapiens
ETQPPVALK

SEQ ID NO: 57164 - protein, 9 aa, Homo Sapiens
ETREVQNLR

SEQ ID NO: 57165 - protein, 9 aa, Homo Sapiens
ETSGFPSQR

SEQ ID NO: 57166 - protein, 9 aa, Homo Sapiens
ETSGPTYIK

SEQ ID NO: 57167 - protein, 9 aa, Homo Sapiens
ETSNLIIMR

SEQ ID NO: 57168 - protein, 9 aa, Homo Sapiens
ETTVYVIVR

SEQ ID NO: 57169 - protein, 9 aa, Homo Sapiens
ETVEDIAAR

SEQ ID NO: 57170 - protein, 9 aa, Homo Sapiens
ETVEKFRQR

SEQ ID NO: 57171 - protein, 9 aa, Homo Sapiens
ETVGSIFSR

SEQ ID NO: 57172 - protein, 9 aa, Homo Sapiens
ETVPAFSER

SEQ ID NO: 57173 - protein, 9 aa, Homo Sapiens
ETVTSFRKR

SEQ ID NO: 57174 - protein, 9 aa, Homo Sapiens
ETYKYLYGR

SEQ ID NO: 57175 - protein, 9 aa, Homo Sapiens
ETYLHRIGR

SEQ ID NO: 57176 - protein, 9 aa, Homo Sapiens
ETYLNENLR

SEQ ID NO: 57177 - protein, 9 aa, Homo Sapiens
EVADLKIKR

SEQ ID NO: 57178 - protein, 9 aa, Homo Sapiens
EVAGIVAAR

SEQ ID NO: 57179 - protein, 9 aa, Homo Sapiens
EVAGLQVGR

SEQ ID NO: 57180 - protein, 9 aa, Homo Sapiens
EVAGQFVIK

SEQ ID NO: 57181 - protein, 9 aa, Homo Sapiens
EVANIPVAR

SEQ ID NO: 57182 - protein, 9 aa, Homo Sapiens
EVAPDVRLR

SEQ ID NO: 57183 - protein, 9 aa, Homo Sapiens
EVAPPEYHR

SEQ ID NO: 57184 - protein, 9 aa, Homo Sapiens
EVAQFLTGR

SEQ ID NO: 57185 - protein, 9 aa, Homo Sapiens
EVDAAMAAR

SEQ ID NO: 57186 - protein, 9 aa, Homo Sapiens
EVENFSCSR

SEQ ID NO: 57187 - protein, 9 aa, Homo Sapiens
EVESLTAAR

SEQ ID NO: 57188 - protein, 9 aa, Homo Sapiens
EVFAGVTTH

SEQ ID NO: 57189 - protein, 9 aa, Homo Sapiens
EVFDKTYQF

SEQ ID NO: 57190 - protein, 9 aa, Homo Sapiens
EVFEYIIFR

SEQ ID NO: 57191 - protein, 9 aa, Homo Sapiens
EVFGQITER

SEQ ID NO: 57192 - protein, 9 aa, Homo Sapiens
EVFQNANFR

SEQ ID NO: 57193 - protein, 9 aa, Homo Sapiens
EVFSHILKR

SEQ ID NO: 57194 - protein, 9 aa, Homo Sapiens
EVFTPVFER

SEQ ID NO: 57195 - protein, 9 aa, Homo Sapiens
EVFTPVVQR

SEQ ID NO: 57196 - protein, 9 aa, Homo Sapiens
EVFVGKIPR

SEQ ID NO: 57197 - protein, 9 aa, Homo Sapiens
EVGDIVVGR

SEQ ID NO: 57198 - protein, 9 aa, Homo Sapiens
EVHAVVTVR

SEQ ID NO: 57199 - protein, 9 aa, Homo Sapiens
EVIEIMTDR

SEQ ID NO: 57200 - protein, 9 aa, Homo Sapiens
EVIKNRFHR

SEQ ID NO: 57201 - protein, 9 aa, Homo Sapiens
EVIKPWITK

SEQ ID NO: 57202 - protein, 9 aa, Homo Sapiens
EVIKSMKPK

SEQ ID NO: 57203 - protein, 9 aa, Homo Sapiens
EVIKVIHGK

SEQ ID NO: 57204 - protein, 9 aa, Homo Sapiens
EVISLINTR

SEQ ID NO: 57205 - protein, 9 aa, Homo Sapiens
EVKKICMQR

SEQ ID NO: 57206 - protein, 9 aa, Homo Sapiens
EVLPKPRMR

SEQ ID NO: 57207 - protein, 9 aa, Homo Sapiens
EVLSDPQTR

SEQ ID NO: 57208 - protein, 9 aa, Homo Sapiens
EVMGTGAVR

SEQ ID NO: 57209 - protein, 9 aa, Homo Sapiens
EVNIPTDLR

SEQ ID NO: 57210 - protein, 9 aa, Homo Sapiens
EVNQETIQR

SEQ ID NO: 57211 - protein, 9 aa, Homo Sapiens
EVPELYHQR

SEQ ID NO: 57212 - protein, 9 aa, Homo Sapiens
EVPEPCLPR

SEQ ID NO: 57213 - protein, 9 aa, Homo Sapiens
EVPEVTRSR

SEQ ID NO: 57214 - protein, 9 aa, Homo Sapiens
EVPNKIINR

SEQ ID NO: 57215 - protein, 9 aa, Homo Sapiens
EVPSFTMGR

SEQ ID NO: 57216 - protein, 9 aa, Homo Sapiens
EVPSPEAGR

SEQ ID NO: 57217 - protein, 9 aa, Homo Sapiens
EVQRILHQR

SEQ ID NO: 57218 - protein, 9 aa, Homo Sapiens
EVQSNPKIR

SEQ ID NO: 57219 - protein, 9 aa, Homo Sapiens
EVQVVNTER

SEQ ID NO: 57220 - protein, 9 aa, Homo Sapiens
EVRLNVEEK

SEQ ID NO: 57221 - protein, 9 aa, Homo Sapiens
EVSAEVRER

SEQ ID NO: 57222 - protein, 9 aa, Homo Sapiens
EVSGCGSLR

SEQ ID NO: 57223 - protein, 9 aa, Homo Sapiens
EVSSIIKKK

SEQ ID NO: 57224 - protein, 9 aa, Homo Sapiens
EVSSMVLTK

SEQ ID NO: 57225 - protein, 9 aa, Homo Sapiens
EVSSVSPLK

SEQ ID NO: 57226 - protein, 9 aa, Homo Sapiens
EVSTVNVRR

SEQ ID NO: 57227 - protein, 9 aa, Homo Sapiens
EVTCLDPLR

SEQ ID NO: 57228 - protein, 9 aa, Homo Sapiens
EVTDYAIAR

SEQ ID NO: 57229 - protein, 9 aa, Homo Sapiens
EVTDYTTGR

SEQ ID NO: 57230 - protein, 9 aa, Homo Sapiens
EVTETICKR

SEQ ID NO: 57231 - protein, 9 aa, Homo Sapiens
EVTGFGVTR

SEQ ID NO: 57232 - protein, 9 aa, Homo Sapiens
EVTRILDGK

SEQ ID NO: 57233 - protein, 9 aa, Homo Sapiens
EVTTTVLVR

SEQ ID NO: 57234 - protein, 9 aa, Homo Sapiens
EVVAKFLHK

SEQ ID NO: 57235 - protein, 9 aa, Homo Sapiens
EVVEIQIDR

SEQ ID NO: 57236 - protein, 9 aa, Homo Sapiens
EVVEQGITR

SEQ ID NO: 57237 - protein, 9 aa, Homo Sapiens
EVVGIIESR

SEQ ID NO: 57238 - protein, 9 aa, Homo Sapiens
EVVGSVQGK

SEQ ID NO: 57239 - protein, 9 aa, Homo Sapiens
EVVIYVVER

SEQ ID NO: 57240 - protein, 9 aa, Homo Sapiens
EVVNKRFVR

SEQ ID NO: 57241 - protein, 9 aa, Homo Sapiens
EVVPEPVAR

SEQ ID NO: 57242 - protein, 9 aa, Homo Sapiens
EVVPRVTKK

SEQ ID NO: 57243 - protein, 9 aa, Homo Sapiens
EVVRLLVTR

SEQ ID NO: 57244 - protein, 9 aa, Homo Sapiens
EVVRTIKER

SEQ ID NO: 57245 - protein, 9 aa, Homo Sapiens
EVVSGVVSK

SEQ ID NO: 57246 - protein, 9 aa, Homo Sapiens
EVVSLLLDR

SEQ ID NO: 57247 - protein, 9 aa, Homo Sapiens
EVVVSGKLR

SEQ ID NO: 57248 - protein, 9 aa, Homo Sapiens
EVVYRFTAR

SEQ ID NO: 57249 - protein, 9 aa, Homo Sapiens
EVWKGIKKR

SEQ ID NO: 57250 - protein, 9 aa, Homo Sapiens
EVYKELRLR

SEQ ID NO: 57251 - protein, 9 aa, Homo Sapiens
FAAESIIKR

SEQ ID NO: 57252 - protein, 9 aa, Homo Sapiens
FASLPQVER

SEQ ID NO: 57253 - protein, 9 aa, Homo Sapiens
FASPLGAGR

SEQ ID NO: 57254 - protein, 9 aa, Homo Sapiens
FASQGGLAR

SEQ ID NO: 57255 - protein, 9 aa, Homo Sapiens
FDAKRLIGR

SEQ ID NO: 57256 - protein, 9 aa, Homo Sapiens
FEPAKGGEK

SEQ ID NO: 57257 - protein, 9 aa, Homo Sapiens
FIVNTNVPR

SEQ ID NO: 57258 - protein, 9 aa, Homo Sapiens
FLSAVFFAK

SEQ ID NO: 57259 - protein, 9 aa, Homo Sapiens
FSAPENAVR

SEQ ID NO: 57260 - protein, 9 aa, Homo Sapiens
FSAPNYCYR

SEQ ID NO: 57261 - protein, 9 aa, Homo Sapiens
FSFSKTPKR

SEQ ID NO: 57262 - protein, 9 aa, Homo Sapiens
FSGEGQSLR

SEQ ID NO: 57263 - protein, 9 aa, Homo Sapiens
FSIDVGYER

SEQ ID NO: 57264 - protein, 9 aa, Homo Sapiens
FSNDVIRKR

SEQ ID NO: 57265 - protein, 9 aa, Homo Sapiens
FSSSEKIKD

SEQ ID NO: 57266 - protein, 9 aa, Homo Sapiens
FSTTAVSAR

SEQ ID NO: 57267 - protein, 9 aa, Homo Sapiens
FSVPVIYER

SEQ ID NO: 57268 - protein, 9 aa, Homo Sapiens
FTAPSTVGK

SEQ ID NO: 57269 - protein, 9 aa, Homo Sapiens
FTQKPGFPK

SEQ ID NO: 57270 - protein, 9 aa, Homo Sapiens
FTSGYIPAR

SEQ ID NO: 57271 - protein, 9 aa, Homo Sapiens
FTVTVGNNR

SEQ ID NO: 57272 - protein, 9 aa, Homo Sapiens
FTYDPWIGK

SEQ ID NO: 57273 - protein, 9 aa, Homo Sapiens
FTYMNPAQR

SEQ ID NO: 57274 - protein, 9 aa, Homo Sapiens
FVFDRPVHR

SEQ ID NO: 57275 - protein, 9 aa, Homo Sapiens
FVFGLPLER

SEQ ID NO: 57276 - protein, 9 aa, Homo Sapiens
FVFKPNSKK

SEQ ID NO: 57277 - protein, 9 aa, Homo Sapiens
FVIGCYLDR

SEQ ID NO: 57278 - protein, 9 aa, Homo Sapiens
FVTPVTNQR

SEQ ID NO: 57279 - protein, 9 aa, Homo Sapiens
FVVEKVLDR

SEQ ID NO: 57280 - protein, 9 aa, Homo Sapiens
FVYEPKEQK

SEQ ID NO: 57281 - protein, 9 aa, Homo Sapiens
FVYGEPVTR

SEQ ID NO: 57282 - protein, 9 aa, Homo Sapiens
FVYGSGVYR

SEQ ID NO: 57283 - protein, 9 aa, Homo Sapiens
GDEPPVFSR

SEQ ID NO: 57284 - protein, 9 aa, Homo Sapiens
GEDPPVHVR

SEQ ID NO: 57285 - protein, 9 aa, Homo Sapiens
GEEPPIVRR

SEQ ID NO: 57286 - protein, 9 aa, Homo Sapiens
GKDPPVHFR

SEQ ID NO: 57287 - protein, 9 aa, Homo Sapiens
GSSDVIIHR

SEQ ID NO: 57288 - protein, 9 aa, Homo Sapiens
GSSPVFNQR

SEQ ID NO: 57289 - protein, 9 aa, Homo Sapiens
GTADVHFER

SEQ ID NO: 57290 - protein, 9 aa, Homo Sapiens
GTIGKKFAR

SEQ ID NO: 57291 - protein, 9 aa, Homo Sapiens
GTSSVIVSR

SEQ ID NO: 57292 - protein, 9 aa, Homo Sapiens
GTVELGPKR

SEQ ID NO: 57293 - protein, 9 aa, Homo Sapiens
GTYVSSVPR

SEQ ID NO: 57294 - protein, 9 aa, Homo Sapiens
GVAALYKFR

SEQ ID NO: 57295 - protein, 9 aa, Homo Sapiens
GVANALAHR

SEQ ID NO: 57296 - protein, 9 aa, Homo Sapiens
GVAPVFKKR

SEQ ID NO: 57297 - protein, 9 aa, Homo Sapiens
GVARIFNTR

SEQ ID NO: 57298 - protein, 9 aa, Homo Sapiens
GVKVPGEYR

SEQ ID NO: 57299 - protein, 9 aa, Homo Sapiens
GVMPSHFSR

SEQ ID NO: 57300 - protein, 9 aa, Homo Sapiens
GVSPVITVR

SEQ ID NO: 57301 - protein, 9 aa, Homo Sapiens
GVSSVIHPK

SEQ ID NO: 57302 - protein, 9 aa, Homo Sapiens
HAADPIITR

SEQ ID NO: 57303 - protein, 9 aa, Homo Sapiens
HAAVGQLGR

SEQ ID NO: 57304 - protein, 9 aa, Homo Sapiens
HAVGIVVNK

SEQ ID NO: 57305 - protein, 9 aa, Homo Sapiens
HAVVVGVYR

SEQ ID NO: 57306 - protein, 9 aa, Homo Sapiens
HIAVGSPGR

SEQ ID NO: 57307 - protein, 9 aa, Homo Sapiens
HISCVIKER

SEQ ID NO: 57308 - protein, 9 aa, Homo Sapiens
HIVSIEVQR

SEQ ID NO: 57309 - protein, 9 aa, Homo Sapiens
HPAVVIRQR

SEQ ID NO: 57310 - protein, 9 aa, Homo Sapiens
HSADFETVR

SEQ ID NO: 57311 - protein, 9 aa, Homo Sapiens
HSAMAVVSR

SEQ ID NO: 57312 - protein, 9 aa, Homo Sapiens
HSMDFVAYR

SEQ ID NO: 57313 - protein, 9 aa, Homo Sapiens
HSTDFEVHR

SEQ ID NO: 57314 - protein, 9 aa, Homo Sapiens
HTADISSHF

SEQ ID NO: 57315 - protein, 9 aa, Homo Sapiens
HTIPIPVAR

SEQ ID NO: 57316 - protein, 9 aa, Homo Sapiens
HTLEPLIPR

SEQ ID NO: 57317 - protein, 9 aa, Homo Sapiens
HTPENPVIR

SEQ ID NO: 57318 - protein, 9 aa, Homo Sapiens
HVAQIYAIR

SEQ ID NO: 57319 - protein, 9 aa, Homo Sapiens
HVASQPVMR

SEQ ID NO: 57320 - protein, 9 aa, Homo Sapiens
HVHEPNPLR

SEQ ID NO: 57321 - protein, 9 aa, Homo Sapiens
HVHGLPVTR

SEQ ID NO: 57322 - protein, 9 aa, Homo Sapiens
HVIETLIGK

SEQ ID NO: 57323 - protein, 9 aa, Homo Sapiens
HVTLHVHEP

SEQ ID NO: 57324 - protein, 9 aa, Homo Sapiens
HVVAIGRTR

SEQ ID NO: 57325 - protein, 9 aa, Homo Sapiens
HVVDIVALK

SEQ ID NO: 57326 - protein, 9 aa, Homo Sapiens
HVVTIIKGK

SEQ ID NO: 57327 - protein, 9 aa, Homo Sapiens
IASLIPTPR

SEQ ID NO: 57328 - protein, 9 aa, Homo Sapiens
IDERAINKK

SEQ ID NO: 57329 - protein, 9 aa, Homo Sapiens
IDERTINKK

SEQ ID NO: 57330 - protein, 9 aa, Homo Sapiens
IGSPIVSPR

SEQ ID NO: 57331 - protein, 9 aa, Homo Sapiens
IIVDIATKR

SEQ ID NO: 57332 - protein, 9 aa, Homo Sapiens
IPAAIATAK

SEQ ID NO: 57333 - protein, 9 aa, Homo Sapiens
ISSGAVVHR

SEQ ID NO: 57334 - protein, 9 aa, Homo Sapiens
ITPAVVSER

SEQ ID NO: 57335 - protein, 9 aa, Homo Sapiens
ITSPVVTQK

SEQ ID NO: 57336 - protein, 9 aa, Homo Sapiens
ITTGNSPPR

SEQ ID NO: 57337 - protein, 9 aa, Homo Sapiens
IVTEIACGR

SEQ ID NO: 57338 - protein, 9 aa, Homo Sapiens
IVTGTSIQR

SEQ ID NO: 57339 - protein, 9 aa, Homo Sapiens
IVTGVEEGR

SEQ ID NO: 57340 - protein, 9 aa, Homo Sapiens
IVYGQPRTR

SEQ ID NO: 57341 - protein, 9 aa, Homo Sapiens
KAANVLITR

SEQ ID NO: 57342 - protein, 9 aa, Homo Sapiens
LAGDVPAAR

SEQ ID NO: 57343 - protein, 9 aa, Homo Sapiens
LAPERRSTL

SEQ ID NO: 57344 - protein, 9 aa, Homo Sapiens
LAQTGSLGR

SEQ ID NO: 57345 - protein, 9 aa, Homo Sapiens
LPAKAIGHR

SEQ ID NO: 57346 - protein, 9 aa, Homo Sapiens
LPAPAAVGR

SEQ ID NO: 57347 - protein, 9 aa, Homo Sapiens
LPFGSSPHR

SEQ ID NO: 57348 - protein, 9 aa, Homo Sapiens
LPHGNVSAR

SEQ ID NO: 57349 - protein, 9 aa, Homo Sapiens
LPMQGNPPR

SEQ ID NO: 57350 - protein, 9 aa, Homo Sapiens
LPSPLSDPR

SEQ ID NO: 57351 - protein, 9 aa, Homo Sapiens
LPSPVTAQK

SEQ ID NO: 57352 - protein, 9 aa, Homo Sapiens
LSFEGATKR

SEQ ID NO: 57353 - protein, 9 aa, Homo Sapiens
LSNNNQALR

SEQ ID NO: 57354 - protein, 9 aa, Homo Sapiens
LSSGVSEIR

SEQ ID NO: 57355 - protein, 9 aa, Homo Sapiens
LVGPVPAGR

SEQ ID NO: 57356 - protein, 9 aa, Homo Sapiens
LVVENSAQR

SEQ ID NO: 57357 - protein, 9 aa, Homo Sapiens
LVVYPWTQR

SEQ ID NO: 57358 - protein, 9 aa, Homo Sapiens
MAAAAFAEK

SEQ ID NO: 57359 - protein, 9 aa, Homo Sapiens
MAGPGGLAR

SEQ ID NO: 57360 - protein, 9 aa, Homo Sapiens
MPASVVGQR

SEQ ID NO: 57361 - protein, 9 aa, Homo Sapiens
MSHGVPVVR

SEQ ID NO: 57362 - protein, 9 aa, Homo Sapiens
MTEGGVVLR

SEQ ID NO: 57363 - protein, 9 aa, Homo Sapiens
MTNLPAVGR

SEQ ID NO: 57364 - protein, 9 aa, Homo Sapiens
MTNTPVVVR

SEQ ID NO: 57365 - protein, 9 aa, Homo Sapiens
MTPPVNPSR

SEQ ID NO: 57366 - protein, 9 aa, Homo Sapiens
MVAKVDEVK

SEQ ID NO: 57367 - protein, 9 aa, Homo Sapiens
MVGPPGTGK

SEQ ID NO: 57368 - protein, 9 aa, Homo Sapiens
MVTGQTVCK

SEQ ID NO: 57369 - protein, 9 aa, Homo Sapiens
NAAFSANER

SEQ ID NO: 57370 - protein, 9 aa, Homo Sapiens
NAAGLLAAR

SEQ ID NO: 57371 - protein, 9 aa, Homo Sapiens
NAIGGKYNR

SEQ ID NO: 57372 - protein, 9 aa, Homo Sapiens
NANPLIYQR

SEQ ID NO: 57373 - protein, 9 aa, Homo Sapiens
NASQIRELR

SEQ ID NO: 57374 - protein, 9 aa, Homo Sapiens
NASQLITQR

SEQ ID NO: 57375 - protein, 9 aa, Homo Sapiens
NATPLTIER

SEQ ID NO: 57376 - protein, 9 aa, Homo Sapiens
NATYVQPRR

SEQ ID NO: 57377 - protein, 9 aa, Homo Sapiens
NAVDVKQYR

SEQ ID NO: 57378 - protein, 9 aa, Homo Sapiens
NIADIEEKR

SEQ ID NO: 57379 - protein, 9 aa, Homo Sapiens
NIADLAVRR

SEQ ID NO: 57380 - protein, 9 aa, Homo Sapiens
NIIDNPYLR

SEQ ID NO: 57381 - protein, 9 aa, Homo Sapiens
NIQVNNISI

SEQ ID NO: 57382 - protein, 9 aa, Homo Sapiens
NLTDIVAQR

SEQ ID NO: 57383 - protein, 9 aa, Homo Sapiens
NMFDHPIPR

SEQ ID NO: 57384 - protein, 9 aa, Homo Sapiens
NNSPVLSER

SEQ ID NO: 57385 - protein, 9 aa, Homo Sapiens
NSAFVERVR

SEQ ID NO: 57386 - protein, 9 aa, Homo Sapiens
NSISSVVSR

SEQ ID NO: 57387 - protein, 9 aa, Homo Sapiens
NSKESYELR

SEQ ID NO: 57388 - protein, 9 aa, Homo Sapiens
NSMGFGAER

SEQ ID NO: 57389 - protein, 9 aa, Homo Sapiens
NSPDISATR

SEQ ID NO: 57390 - protein, 9 aa, Homo Sapiens
NTAVSQLTK

SEQ ID NO: 57391 - protein, 9 aa, Homo Sapiens
NTIEKPILR

SEQ ID NO: 57392 - protein, 9 aa, Homo Sapiens
NTIKLIVGR

SEQ ID NO: 57393 - protein, 9 aa, Homo Sapiens
NTIPEVHKK

SEQ ID NO: 57394 - protein, 9 aa, Homo Sapiens
NTIQNEAQR

SEQ ID NO: 57395 - protein, 9 aa, Homo Sapiens
NTNDFVTLR

SEQ ID NO: 57396 - protein, 9 aa, Homo Sapiens
NTSTSIVNR

SEQ ID NO: 57397 - protein, 9 aa, Homo Sapiens
NTTSAVTVK

SEQ ID NO: 57398 - protein, 9 aa, Homo Sapiens
NTVGLVVER

SEQ ID NO: 57399 - protein, 9 aa, Homo Sapiens
NTVHDIVNR

SEQ ID NO: 57400 - protein, 9 aa, Homo Sapiens
NTVTPAVGR

SEQ ID NO: 57401 - protein, 9 aa, Homo Sapiens
NVAANVTSR

SEQ ID NO: 57402 - protein, 9 aa, Homo Sapiens
NVADLHEKY

SEQ ID NO: 57403 - protein, 9 aa, Homo Sapiens
NVADLTSLR

SEQ ID NO: 57404 - protein, 9 aa, Homo Sapiens
NVALIRDTK

SEQ ID NO: 57405 - protein, 9 aa, Homo Sapiens
NVHGGTILK

SEQ ID NO: 57406 - protein, 9 aa, Homo Sapiens
NVIRYIVCR

SEQ ID NO: 57407 - protein, 9 aa, Homo Sapiens
NVKFIQEKK

SEQ ID NO: 57408 - protein, 9 aa, Homo Sapiens
NVKGPGLQR

SEQ ID NO: 57409 - protein, 9 aa, Homo Sapiens
NVNEVISNR

SEQ ID NO: 57410 - protein, 9 aa, Homo Sapiens
NVPAVVVGR

SEQ ID NO: 57411 - protein, 9 aa, Homo Sapiens
NVTYVVKER

SEQ ID NO: 57412 - protein, 9 aa, Homo Sapiens
NVVRNISYK

SEQ ID NO: 57413 - protein, 9 aa, Homo Sapiens
PALAPVVSR

SEQ ID NO: 57414 - protein, 9 aa, Homo Sapiens
PASPVVHIR

SEQ ID NO: 57415 - protein, 9 aa, Homo Sapiens
PSSETVICR

SEQ ID NO: 57416 - protein, 9 aa, Homo Sapiens
QANGFSVVR

SEQ ID NO: 57417 - protein, 9 aa, Homo Sapiens
QASAVTVTR

SEQ ID NO: 57418 - protein, 9 aa, Homo Sapiens
QIFSGTSKR

SEQ ID NO: 57419 - protein, 9 aa, Homo Sapiens
QILEQPKQR

SEQ ID NO: 57420 - protein, 9 aa, Homo Sapiens
QISEVVVVK

SEQ ID NO: 57421 - protein, 9 aa, Homo Sapiens
QITAVIINR

SEQ ID NO: 57422 - protein, 9 aa, Homo Sapiens
QPTDVVKVR

SEQ ID NO: 57423 - protein, 9 aa, Homo Sapiens
QSPEFSVTR

SEQ ID NO: 57424 - protein, 9 aa, Homo Sapiens
QSSNLIQHR

SEQ ID NO: 57425 - protein, 9 aa, Homo Sapiens
QTIQGILER

SEQ ID NO: 57426 - protein, 9 aa, Homo Sapiens
QTPNTFPKR

SEQ ID NO: 57427 - protein, 9 aa, Homo Sapiens
QTVRIPSQR

SEQ ID NO: 57428 - protein, 9 aa, Homo Sapiens
QVADVVVSR

SEQ ID NO: 57429 - protein, 9 aa, Homo Sapiens
QVAPPVLKR

SEQ ID NO: 57430 - protein, 9 aa, Homo Sapiens
QVAPTQDLR

SEQ ID NO: 57431 - protein, 9 aa, Homo Sapiens
QVATVIQSR

SEQ ID NO: 57432 - protein, 9 aa, Homo Sapiens
QVFEKSPLR

SEQ ID NO: 57433 - protein, 9 aa, Homo Sapiens
QVFNKLIRR

SEQ ID NO: 57434 - protein, 9 aa, Homo Sapiens
QVVDKVTQR

SEQ ID NO: 57435 - protein, 9 aa, Homo Sapiens
QVVEVNPVR

SEQ ID NO: 57436 - protein, 9 aa, Homo Sapiens
RAAIPIAKR

SEQ ID NO: 57437 - protein, 9 aa, Homo Sapiens
RTSEIYVHR

SEQ ID NO: 57438 - protein, 9 aa, Homo Sapiens
SAAEVGFVR

SEQ ID NO: 57439 - protein, 9 aa, Homo Sapiens
SAALPQSQR

SEQ ID NO: 57440 - protein, 9 aa, Homo Sapiens
SAAPAITCR

SEQ ID NO: 57441 - protein, 9 aa, Homo Sapiens
SAASTALER

SEQ ID NO: 57442 - protein, 9 aa, Homo Sapiens
SAASYFQKR

SEQ ID NO: 57443 - protein, 9 aa, Homo Sapiens
SAFRNVNTR

SEQ ID NO: 57444 - protein, 9 aa, Homo Sapiens
SAHFSPVLR

SEQ ID NO: 57445 - protein, 9 aa, Homo Sapiens
SAIHIRVFR

SEQ ID NO: 57446 - protein, 9 aa, Homo Sapiens
SAIPAYSKR

SEQ ID NO: 57447 - protein, 9 aa, Homo Sapiens
SAISYINQR

SEQ ID NO: 57448 - protein, 9 aa, Homo Sapiens
SASPSVISR

SEQ ID NO: 57449 - protein, 9 aa, Homo Sapiens
SASSVTVTR

SEQ ID NO: 57450 - protein, 9 aa, Homo Sapiens
SDAGIFFTR

SEQ ID NO: 57451 - protein, 9 aa, Homo Sapiens
SIFDKNHER

SEQ ID NO: 57452 - protein, 9 aa, Homo Sapiens
SIIGVTEPR

SEQ ID NO: 57453 - protein, 9 aa, Homo Sapiens
SLADIMAKR

SEQ ID NO: 57454 - protein, 9 aa, Homo Sapiens
SLANIARQR

SEQ ID NO: 57455 - protein, 9 aa, Homo Sapiens
SPASIGQPR

SEQ ID NO: 57456 - protein, 9 aa, Homo Sapiens
SSALPTTGR

SEQ ID NO: 57457 - protein, 9 aa, Homo Sapiens
SSAPVVVTR

SEQ ID NO: 57458 - protein, 9 aa, Homo Sapiens
SSIDISQSR

SEQ ID NO: 57459 - protein, 9 aa, Homo Sapiens
SSIRPISER

SEQ ID NO: 57460 - protein, 9 aa, Homo Sapiens
SSMFGTLPR

SEQ ID NO: 57461 - protein, 9 aa, Homo Sapiens
SSPAPRTAL

SEQ ID NO: 57462 - protein, 9 aa, Homo Sapiens
SSSFVLSHR

SEQ ID NO: 57463 - protein, 9 aa, Homo Sapiens
SSSKTTWPR

SEQ ID NO: 57464 - protein, 9 aa, Homo Sapiens
SSSLIIHQR

SEQ ID NO: 57465 - protein, 9 aa, Homo Sapiens
SSSPVVVQH

SEQ ID NO: 57466 - protein, 9 aa, Homo Sapiens
STADLIRCK

SEQ ID NO: 57467 - protein, 9 aa, Homo Sapiens
STAKIQIVR

SEQ ID NO: 57468 - protein, 9 aa, Homo Sapiens
STANIDDLK

SEQ ID NO: 57469 - protein, 9 aa, Homo Sapiens
STAPAQLGK

SEQ ID NO: 57470 - protein, 9 aa, Homo Sapiens
STARHLYLR

SEQ ID NO: 57471 - protein, 9 aa, Homo Sapiens
STFDTPYCR

SEQ ID NO: 57472 - protein, 9 aa, Homo Sapiens
STFNQVVLK

SEQ ID NO: 57473 - protein, 9 aa, Homo Sapiens
STFRESFKK

SEQ ID NO: 57474 - protein, 9 aa, Homo Sapiens
STIDCGLVR

SEQ ID NO: 57475 - protein, 9 aa, Homo Sapiens
STIEYVIQR

SEQ ID NO: 57476 - protein, 9 aa, Homo Sapiens
STISEVLGR

SEQ ID NO: 57477 - protein, 9 aa, Homo Sapiens
STKFPAYER

SEQ ID NO: 57478 - protein, 9 aa, Homo Sapiens
STPDLAANR

SEQ ID NO: 57479 - protein, 9 aa, Homo Sapiens
STPEIAEQR

SEQ ID NO: 57480 - protein, 9 aa, Homo Sapiens
STSPITVCH

SEQ ID NO: 57481 - protein, 9 aa, Homo Sapiens
STVGSAISR

SEQ ID NO: 57482 - protein, 9 aa, Homo Sapiens
SVAALPVCK

SEQ ID NO: 57483 - protein, 9 aa, Homo Sapiens
SVAALTSKR

SEQ ID NO: 57484 - protein, 9 aa, Homo Sapiens
SVAKIVSDR

SEQ ID NO: 57485 - protein, 9 aa, Homo Sapiens
SVAKTILKR

SEQ ID NO: 57486 - protein, 9 aa, Homo Sapiens
SVARITCVR

SEQ ID NO: 57487 - protein, 9 aa, Homo Sapiens
SVESIISPK

SEQ ID NO: 57488 - protein, 9 aa, Homo Sapiens
SVFLYQSLR

SEQ ID NO: 57489 - protein, 9 aa, Homo Sapiens
SVFNEHPSR

SEQ ID NO: 57490 - protein, 9 aa, Homo Sapiens
SVFQTTDTK

SEQ ID NO: 57491 - protein, 9 aa, Homo Sapiens
SVGPAVQAR

SEQ ID NO: 57492 - protein, 9 aa, Homo Sapiens
SVIGAREER

SEQ ID NO: 57493 - protein, 9 aa, Homo Sapiens
SVIRPILKR

SEQ ID NO: 57494 - protein, 9 aa, Homo Sapiens
SVISGISSR

SEQ ID NO: 57495 - protein, 9 aa, Homo Sapiens
SVLDYFSER

SEQ ID NO: 57496 - protein, 9 aa, Homo Sapiens
SVQGIIIYR

SEQ ID NO: 57497 - protein, 9 aa, Homo Sapiens
SVSDIIRLR

SEQ ID NO: 57498 - protein, 9 aa, Homo Sapiens
SVSDLAPPR

SEQ ID NO: 57499 - protein, 9 aa, Homo Sapiens
SVSEVVVNR

SEQ ID NO: 57500 - protein, 9 aa, Homo Sapiens
SVSGIPNAR

SEQ ID NO: 57501 - protein, 9 aa, Homo Sapiens
SVSNVVITK

SEQ ID NO: 57502 - protein, 9 aa, Homo Sapiens
SVSSLISGR

SEQ ID NO: 57503 - protein, 9 aa, Homo Sapiens
SVTALAVSR

SEQ ID NO: 57504 - protein, 9 aa, Homo Sapiens
SVVGIPVFR

SEQ ID NO: 57505 - protein, 9 aa, Homo Sapiens
TAAAAASIR

SEQ ID NO: 57506 - protein, 9 aa, Homo Sapiens
TAAATVLKR

SEQ ID NO: 57507 - protein, 9 aa, Homo Sapiens
TAAFGHVQR

SEQ ID NO: 57508 - protein, 9 aa, Homo Sapiens
TAAPPSVCR

SEQ ID NO: 57509 - protein, 9 aa, Homo Sapiens
TAATRAALC

SEQ ID NO: 57510 - protein, 9 aa, Homo Sapiens
TALHVACQR

SEQ ID NO: 57511 - protein, 9 aa, Homo Sapiens
TDSPVHVGR

SEQ ID NO: 57512 - protein, 9 aa, Homo Sapiens
TGIFLPILR

SEQ ID NO: 57513 - protein, 9 aa, Homo Sapiens
TIHEIHCQR

SEQ ID NO: 57514 - protein, 9 aa, Homo Sapiens
TIIDIITHR

SEQ ID NO: 57515 - protein, 9 aa, Homo Sapiens
TIVNILTNR

SEQ ID NO: 57516 - protein, 9 aa, Homo Sapiens
TLSNIIEQR

SEQ ID NO: 57517 - protein, 9 aa, Homo Sapiens
TLSPAFSTR

SEQ ID NO: 57518 - protein, 9 aa, Homo Sapiens
TMSNITAGR

SEQ ID NO: 57519 - protein, 9 aa, Homo Sapiens
TNAAVTVLR

SEQ ID NO: 57520 - protein, 9 aa, Homo Sapiens
TPAGGGFPR

SEQ ID NO: 57521 - protein, 9 aa, Homo Sapiens
TSEAPQPPR

SEQ ID NO: 57522 - protein, 9 aa, Homo Sapiens
TSETPQPPR

SEQ ID NO: 57523 - protein, 9 aa, Homo Sapiens
TSSAQIIQR

SEQ ID NO: 57524 - protein, 9 aa, Homo Sapiens
TSSGNPIFR

SEQ ID NO: 57525 - protein, 9 aa, Homo Sapiens
TSSPSSIPR

SEQ ID NO: 57526 - protein, 9 aa, Homo Sapiens
TSTPVIVMR

SEQ ID NO: 57527 - protein, 9 aa, Homo Sapiens
TTAAAPTLR

SEQ ID NO: 57528 - protein, 9 aa, Homo Sapiens
TTAFEVEER

SEQ ID NO: 57529 - protein, 9 aa, Homo Sapiens
TTAPVVSTR

SEQ ID NO: 57530 - protein, 9 aa, Homo Sapiens
TTAQEVLAR

SEQ ID NO: 57531 - protein, 9 aa, Homo Sapiens
TTASVVIIR

SEQ ID NO: 57532 - protein, 9 aa, Homo Sapiens
TTCISAHVR

SEQ ID NO: 57533 - protein, 9 aa, Homo Sapiens
TTFPKIHSR

SEQ ID NO: 57534 - protein, 9 aa, Homo Sapiens
TTFQDQLNR

SEQ ID NO: 57535 - protein, 9 aa, Homo Sapiens
TTGESVITR

SEQ ID NO: 57536 - protein, 9 aa, Homo Sapiens
TTGWGVSPR

SEQ ID NO: 57537 - protein, 9 aa, Homo Sapiens
TTITAPPSR

SEQ ID NO: 57538 - protein, 9 aa, Homo Sapiens
TTNVPEIQR

SEQ ID NO: 57539 - protein, 9 aa, Homo Sapiens
TTPIFANRR

SEQ ID NO: 57540 - protein, 9 aa, Homo Sapiens
TTPNISVKK

SEQ ID NO: 57541 - protein, 9 aa, Homo Sapiens
TTQQADIPR

SEQ ID NO: 57542 - protein, 9 aa, Homo Sapiens
TTSVITIVK

SEQ ID NO: 57543 - protein, 9 aa, Homo Sapiens
TTTEIIKRR

SEQ ID NO: 57544 - protein, 9 aa, Homo Sapiens
TTTSLVLER

SEQ ID NO: 57545 - protein, 9 aa, Homo Sapiens
TTVDIFHKK

SEQ ID NO: 57546 - protein, 9 aa, Homo Sapiens
TTVEGLITR

SEQ ID NO: 57547 - protein, 9 aa, Homo Sapiens
TTVGTLSQR

SEQ ID NO: 57548 - protein, 9 aa, Homo Sapiens
TTVPHVFSK

SEQ ID NO: 57549 - protein, 9 aa, Homo Sapiens
TVAAVFRGR

SEQ ID NO: 57550 - protein, 9 aa, Homo Sapiens
TVATLPRGR

SEQ ID NO: 57551 - protein, 9 aa, Homo Sapiens
TVAVSDIPR

SEQ ID NO: 57552 - protein, 9 aa, Homo Sapiens
TVFESRNLR

SEQ ID NO: 57553 - protein, 9 aa, Homo Sapiens
TVGDIVLLR

SEQ ID NO: 57554 - protein, 9 aa, Homo Sapiens
TVIADICRR

SEQ ID NO: 57555 - protein, 9 aa, Homo Sapiens
TVIFVASQK

SEQ ID NO: 57556 - protein, 9 aa, Homo Sapiens
TVIHFNNPK

SEQ ID NO: 57557 - protein, 9 aa, Homo Sapiens
TVPEVIVAR

SEQ ID NO: 57558 - protein, 9 aa, Homo Sapiens
TVSAAVAER

SEQ ID NO: 57559 - protein, 9 aa, Homo Sapiens
TVSGPGVAR

SEQ ID NO: 57560 - protein, 9 aa, Homo Sapiens
TVVQNLMER

SEQ ID NO: 57561 - protein, 9 aa, Homo Sapiens
TVYHSPVSR

SEQ ID NO: 57562 - protein, 9 aa, Homo Sapiens
VATDITSTR

SEQ ID NO: 57563 - protein, 9 aa, Homo Sapiens
VDVRIGMTR

SEQ ID NO: 57564 - protein, 9 aa, Homo Sapiens
VPIGYHVPR

SEQ ID NO: 57565 - protein, 9 aa, Homo Sapiens
VPKAAIVAR

SEQ ID NO: 57566 - protein, 9 aa, Homo Sapiens
VTIKKDVDG

SEQ ID NO: 57567 - protein, 9 aa, Homo Sapiens
VVAPPGAPK

SEQ ID NO: 57568 - protein, 9 aa, Homo Sapiens
VVFEKAIQR

SEQ ID NO: 57569 - protein, 9 aa, Homo Sapiens
WVIGSVVAR

SEQ ID NO: 57570 - protein, 9 aa, Homo Sapiens
WVSENFQER

SEQ ID NO: 57571 - protein, 9 aa, Homo Sapiens
YAAFVQTHR

SEQ ID NO: 57572 - protein, 9 aa, Homo Sapiens
YAASIIIRR

SEQ ID NO: 57573 - protein, 9 aa, Homo Sapiens
YDAEISRKR

SEQ ID NO: 57574 - protein, 9 aa, Homo Sapiens
YIMPKPARR

SEQ ID NO: 57575 - protein, 9 aa, Homo Sapiens
YPVGIFQKR

SEQ ID NO: 57576 - protein, 9 aa, Homo Sapiens
YSFTTTAER

SEQ ID NO: 57577 - protein, 9 aa, Homo Sapiens
YSPGIVSTR

SEQ ID NO: 57578 - protein, 9 aa, Homo Sapiens
YSSTQVSVR

SEQ ID NO: 57579 - protein, 9 aa, Homo Sapiens
YSSTVVVKR

SEQ ID NO: 57580 - protein, 9 aa, Homo Sapiens
YSVNVDYSK

SEQ ID NO: 57581 - protein, 9 aa, Homo Sapiens
YTPTISRER

SEQ ID NO: 57582 - protein, 9 aa, Homo Sapiens
YVANVGTNR

SEQ ID NO: 57583 - protein, 9 aa, Homo Sapiens
YVFPKPFNR

SEQ ID NO: 57584 - protein, 9 aa, Homo Sapiens
YVFPVSQKR

SEQ ID NO: 57585 - protein, 9 aa, Homo Sapiens
YVIKPGNTK

SEQ ID NO: 57586 - protein, 9 aa, Homo Sapiens
YVMPSSSAR

SEQ ID NO: 57587 - protein, 9 aa, Homo Sapiens
YVNQGEILR

SEQ ID NO: 57588 - protein, 9 aa, Homo Sapiens
YVQRFHYSR

SEQ ID NO: 57589 - protein, 9 aa, Homo Sapiens
YVVEKVLDR

SEQ ID NO: 57590 - protein, 10 aa, Homo Sapiens
ADAPVTQIGF

SEQ ID NO: 57591 - protein, 10 aa, Homo Sapiens
ASADISLERL

SEQ ID NO: 57592 - protein, 10 aa, Homo Sapiens
ATAGIIGVNR

SEQ ID NO: 57593 - protein, 10 aa, Homo Sapiens
ATENIPVVRR

SEQ ID NO: 57594 - protein, 10 aa, Homo Sapiens
ATIDGSVNPK

SEQ ID NO: 57595 - protein, 10 aa, Homo Sapiens
ATSGIDPVVR

SEQ ID NO: 57596 - protein, 10 aa, Homo Sapiens
ATSPIIIHRL

SEQ ID NO: 57597 - protein, 10 aa, Homo Sapiens
AVANIVNSVK

SEQ ID NO: 57598 - protein, 10 aa, Homo Sapiens
AVIPCFPYAR

SEQ ID NO: 57599 - protein, 10 aa, Homo Sapiens
AVPEAIPTPR

SEQ ID NO: 57600 - protein, 10 aa, Homo Sapiens
AVSSVVNNSR

SEQ ID NO: 57601 - protein, 10 aa, Homo Sapiens
AVVPFLPLQR

SEQ ID NO: 57602 - protein, 10 aa, Homo Sapiens
AVYGQKEIHR

SEQ ID NO: 57603 - protein, 10 aa, Homo Sapiens
CIAEQPQPKR

SEQ ID NO: 57604 - protein, 10 aa, Homo Sapiens
CTADWLPAGR

SEQ ID NO: 57605 - protein, 10 aa, Homo Sapiens
CTADWLPIGR

SEQ ID NO: 57606 - protein, 10 aa, Homo Sapiens
CVSPTVNQRL

SEQ ID NO: 57607 - protein, 10 aa, Homo Sapiens
CVTDISHLVR

SEQ ID NO: 57608 - protein, 10 aa, Homo Sapiens
DAAEIRLVSK

SEQ ID NO: 57609 - protein, 10 aa, Homo Sapiens
DAAFIIGSGR

SEQ ID NO: 57610 - protein, 10 aa, Homo Sapiens
DAAGPREAFR

SEQ ID NO: 57611 - protein, 10 aa, Homo Sapiens
DAFGTGIVEK

SEQ ID NO: 57612 - protein, 10 aa, Homo Sapiens
DAGSVPHVNR

SEQ ID NO: 57613 - protein, 10 aa, Homo Sapiens
DAIQDKKNFR

SEQ ID NO: 57614 - protein, 10 aa, Homo Sapiens
DASLGNLFAR

SEQ ID NO: 57615 - protein, 10 aa, Homo Sapiens
DAWLPGEATR

SEQ ID NO: 57616 - protein, 10 aa, Homo Sapiens
DAYGSELVER

SEQ ID NO: 57617 - protein, 10 aa, Homo Sapiens
DAYPKNPHLR

SEQ ID NO: 57618 - protein, 10 aa, Homo Sapiens
DIFQQTPLGR

SEQ ID NO: 57619 - protein, 10 aa, Homo Sapiens
DIYDRKNMPR

SEQ ID NO: 57620 - protein, 10 aa, Homo Sapiens
DIYEFLPSKR

SEQ ID NO: 57621 - protein, 10 aa, Homo Sapiens
DLFPTSDTPR

SEQ ID NO: 57622 - protein, 10 aa, Homo Sapiens
DSAPPSSVAR

SEQ ID NO: 57623 - protein, 10 aa, Homo Sapiens
DSAPPTPVNR

SEQ ID NO: 57624 - protein, 10 aa, Homo Sapiens
DSINVIDVNK

SEQ ID NO: 57625 - protein, 10 aa, Homo Sapiens
DTFSVAFIKK

SEQ ID NO: 57626 - protein, 10 aa, Homo Sapiens
DTGTLRPVRR

SEQ ID NO: 57627 - protein, 10 aa, Homo Sapiens
DTIRPEHVLR

SEQ ID NO: 57628 - protein, 10 aa, Homo Sapiens
DTMKVLGVQR

SEQ ID NO: 57629 - protein, 10 aa, Homo Sapiens
DTPGFIVNRL

SEQ ID NO: 57630 - protein, 10 aa, Homo Sapiens
DTSGGTTALR

SEQ ID NO: 57631 - protein, 10 aa, Homo Sapiens
DTSRLTKITK

SEQ ID NO: 57632 - protein, 10 aa, Homo Sapiens
DTVATLPRGR

SEQ ID NO: 57633 - protein, 10 aa, Homo Sapiens
DTVDLTSVLR

SEQ ID NO: 57634 - protein, 10 aa, Homo Sapiens
DTVSVPYVFR

SEQ ID NO: 57635 - protein, 10 aa, Homo Sapiens
DTVTMQVTAR

SEQ ID NO: 57636 - protein, 10 aa, Homo Sapiens
DVAAVVDGRL

SEQ ID NO: 57637 - protein, 10 aa, Homo Sapiens
DVASVIVTKL

SEQ ID NO: 57638 - protein, 10 aa, Homo Sapiens
DVAYINVETK

SEQ ID NO: 57639 - protein, 10 aa, Homo Sapiens
DVIDGPISQR

SEQ ID NO: 57640 - protein, 10 aa, Homo Sapiens
DVIKPGTVKR

SEQ ID NO: 57641 - protein, 10 aa, Homo Sapiens
DVISNINITR

SEQ ID NO: 57642 - protein, 10 aa, Homo Sapiens
DVMASGTVKR

SEQ ID NO: 57643 - protein, 10 aa, Homo Sapiens
DVMVGPFKLR

SEQ ID NO: 57644 - protein, 10 aa, Homo Sapiens
DVQGALVNLR

SEQ ID NO: 57645 - protein, 10 aa, Homo Sapiens
DVSPVKPLSR

SEQ ID NO: 57646 - protein, 10 aa, Homo Sapiens
DVVGPVSLPR

SEQ ID NO: 57647 - protein, 10 aa, Homo Sapiens
DVVKLTKNSK

SEQ ID NO: 57648 - protein, 10 aa, Homo Sapiens
DVVNVVFVDR

SEQ ID NO: 57649 - protein, 10 aa, Homo Sapiens
DVYDAFPPLR

SEQ ID NO: 57650 - protein, 10 aa, Homo Sapiens
EAAAVHGARF

SEQ ID NO: 57651 - protein, 10 aa, Homo Sapiens
EAAKDLLYRR

SEQ ID NO: 57652 - protein, 10 aa, Homo Sapiens
EAAQLREERL

SEQ ID NO: 57653 - protein, 10 aa, Homo Sapiens
EAAVVAVAEK

SEQ ID NO: 57654 - protein, 10 aa, Homo Sapiens
EAAVVQSCTR

SEQ ID NO: 57655 - protein, 10 aa, Homo Sapiens
EAFEHPNVVR

SEQ ID NO: 57656 - protein, 10 aa, Homo Sapiens
EAFGKIVAER

SEQ ID NO: 57657 - protein, 10 aa, Homo Sapiens
EAFKDIPVQR

SEQ ID NO: 57658 - protein, 10 aa, Homo Sapiens
EAFKPILSTR

SEQ ID NO: 57659 - protein, 10 aa, Homo Sapiens
EAFPSQGTKR

SEQ ID NO: 57660 - protein, 10 aa, Homo Sapiens
EAHFVPLVKR

SEQ ID NO: 57661 - protein, 10 aa, Homo Sapiens
EAIGPVHQNR

SEQ ID NO: 57662 - protein, 10 aa, Homo Sapiens
EAILLEIPRL

SEQ ID NO: 57663 - protein, 10 aa, Homo Sapiens
EAINITNNEK

SEQ ID NO: 57664 - protein, 10 aa, Homo Sapiens
EAKNPADLPK

SEQ ID NO: 57665 - protein, 10 aa, Homo Sapiens
EALGSGLVSR

SEQ ID NO: 57666 - protein, 10 aa, Homo Sapiens
EAMIEVNINK

SEQ ID NO: 57667 - protein, 10 aa, Homo Sapiens
EANSNAVRFR

SEQ ID NO: 57668 - protein, 10 aa, Homo Sapiens
EAPIISNSER

SEQ ID NO: 57669 - protein, 10 aa, Homo Sapiens
EAQKPYLVQR

SEQ ID NO: 57670 - protein, 10 aa, Homo Sapiens
EAVAPEFTNR

SEQ ID NO: 57671 - protein, 10 aa, Homo Sapiens
EAVSVYPEKL

SEQ ID NO: 57672 - protein, 10 aa, Homo Sapiens
EAYFVPLVKR

SEQ ID NO: 57673 - protein, 10 aa, Homo Sapiens
EDFNHEPCQR

SEQ ID NO: 57674 - protein, 10 aa, Homo Sapiens
EDYNLIVIER

SEQ ID NO: 57675 - protein, 10 aa, Homo Sapiens
EIAKLKAAQR

SEQ ID NO: 57676 - protein, 10 aa, Homo Sapiens
EIASVAYRYR

SEQ ID NO: 57677 - protein, 10 aa, Homo Sapiens
EIFYTAIVNR

SEQ ID NO: 57678 - protein, 10 aa, Homo Sapiens
EIIEEHLANR

SEQ ID NO: 57679 - protein, 10 aa, Homo Sapiens
EIINEDIAKR

SEQ ID NO: 57680 - protein, 10 aa, Homo Sapiens
EIIQSTPYGR

SEQ ID NO: 57681 - protein, 10 aa, Homo Sapiens
EIISERTKPR

SEQ ID NO: 57682 - protein, 10 aa, Homo Sapiens
EIIVDIATKR

SEQ ID NO: 57683 - protein, 10 aa, Homo Sapiens
EIKGFYDPPR

SEQ ID NO: 57684 - protein, 10 aa, Homo Sapiens
EIKKPPVSER

SEQ ID NO: 57685 - protein, 10 aa, Homo Sapiens
EIPEHFGAVR

SEQ ID NO: 57686 - protein, 10 aa, Homo Sapiens
EIPQLVPIGK

SEQ ID NO: 57687 - protein, 10 aa, Homo Sapiens
EIPTFQPLLK

SEQ ID NO: 57688 - protein, 10 aa, Homo Sapiens
EIVKDLAKPR

SEQ ID NO: 57689 - protein, 10 aa, Homo Sapiens
EIYDRREYSR

SEQ ID NO: 57690 - protein, 10 aa, Homo Sapiens
EIYGGSDSRF

SEQ ID NO: 57691 - protein, 10 aa, Homo Sapiens
ELALIYGTPR

SEQ ID NO: 57692 - protein, 10 aa, Homo Sapiens
ELFHQQGTPR

SEQ ID NO: 57693 - protein, 10 aa, Homo Sapiens
ELPIVTPALR

SEQ ID NO: 57694 - protein, 10 aa, Homo Sapiens
ELSNVLAAMR

SEQ ID NO: 57695 - protein, 10 aa, Homo Sapiens
ELYAEKVATR

SEQ ID NO: 57696 - protein, 10 aa, Homo Sapiens
EMFDGSLYHK

SEQ ID NO: 57697 - protein, 10 aa, Homo Sapiens
EMFVGVGASR

SEQ ID NO: 57698 - protein, 10 aa, Homo Sapiens
ENSPLGEALR

SEQ ID NO: 57699 - protein, 10 aa, Homo Sapiens
ENYGQKIIKK

SEQ ID NO: 57700 - protein, 10 aa, Homo Sapiens
ESAIAIATGK

SEQ ID NO: 57701 - protein, 10 aa, Homo Sapiens
ESFGPQPISR

SEQ ID NO: 57702 - protein, 10 aa, Homo Sapiens
ESFPGSFRGR

SEQ ID NO: 57703 - protein, 10 aa, Homo Sapiens
ESHYALPLGR

SEQ ID NO: 57704 - protein, 10 aa, Homo Sapiens
ESIDDALNCR

SEQ ID NO: 57705 - protein, 10 aa, Homo Sapiens
ESIDPQFTIR

SEQ ID NO: 57706 - protein, 10 aa, Homo Sapiens
ESMLTPPIAR

SEQ ID NO: 57707 - protein, 10 aa, Homo Sapiens
ESVAAPITVR

SEQ ID NO: 57708 - protein, 10 aa, Homo Sapiens
ESVGGRVAER

SEQ ID NO: 57709 - protein, 10 aa, Homo Sapiens
ESVSEVVVNR

SEQ ID NO: 57710 - protein, 10 aa, Homo Sapiens
ESYQEVTVQR

SEQ ID NO: 57711 - protein, 10 aa, Homo Sapiens
ETAFGYKGLK

SEQ ID NO: 57712 - protein, 10 aa, Homo Sapiens
ETAGSTSIPK

SEQ ID NO: 57713 - protein, 10 aa, Homo Sapiens
ETALIDRTGR

SEQ ID NO: 57714 - protein, 10 aa, Homo Sapiens
ETALNSKAYK

SEQ ID NO: 57715 - protein, 10 aa, Homo Sapiens
ETASNEVVYR

SEQ ID NO: 57716 - protein, 10 aa, Homo Sapiens
ETATPAPVEK

SEQ ID NO: 57717 - protein, 10 aa, Homo Sapiens
ETFDFQAMGR

SEQ ID NO: 57718 - protein, 10 aa, Homo Sapiens
ETFEHPNVVR

SEQ ID NO: 57719 - protein, 10 aa, Homo Sapiens
ETFNSITKRR

SEQ ID NO: 57720 - protein, 10 aa, Homo Sapiens
ETFNYNAIDR

SEQ ID NO: 57721 - protein, 10 aa, Homo Sapiens
ETFSGVYKKL

SEQ ID NO: 57722 - protein, 10 aa, Homo Sapiens
ETFSYPDFLR

SEQ ID NO: 57723 - protein, 10 aa, Homo Sapiens
ETFTPNRVEK

SEQ ID NO: 57724 - protein, 10 aa, Homo Sapiens
ETIGKKFEKR

SEQ ID NO: 57725 - protein, 10 aa, Homo Sapiens
ETIGTGGFAK

SEQ ID NO: 57726 - protein, 10 aa, Homo Sapiens
ETIKSLLIRR

SEQ ID NO: 57727 - protein, 10 aa, Homo Sapiens
ETIPLTAEKL

SEQ ID NO: 57728 - protein, 10 aa, Homo Sapiens
ETLGPKPAAR

SEQ ID NO: 57729 - protein, 10 aa, Homo Sapiens
ETLKHSGIGR

SEQ ID NO: 57730 - protein, 10 aa, Homo Sapiens
ETLPPVGVNR

SEQ ID NO: 57731 - protein, 10 aa, Homo Sapiens
ETLSAVTNNR

SEQ ID NO: 57732 - protein, 10 aa, Homo Sapiens
ETLTRPFSGR

SEQ ID NO: 57733 - protein, 10 aa, Homo Sapiens
ETMGTIEVQR

SEQ ID NO: 57734 - protein, 10 aa, Homo Sapiens
ETMSPGVFSR

SEQ ID NO: 57735 - protein, 10 aa, Homo Sapiens
ETNMYEGVGR

SEQ ID NO: 57736 - protein, 10 aa, Homo Sapiens
ETPAISPSKR

SEQ ID NO: 57737 - protein, 10 aa, Homo Sapiens
ETPDIKLFGK

SEQ ID NO: 57738 - protein, 10 aa, Homo Sapiens
ETPDPSGGFR

SEQ ID NO: 57739 - protein, 10 aa, Homo Sapiens
ETPGHTPSLR

SEQ ID NO: 57740 - protein, 10 aa, Homo Sapiens
ETPQVAVIVR

SEQ ID NO: 57741 - protein, 10 aa, Homo Sapiens
ETPTFAKVQR

SEQ ID NO: 57742 - protein, 10 aa, Homo Sapiens
ETQANNLICR

SEQ ID NO: 57743 - protein, 10 aa, Homo Sapiens
ETQPGRLLGR

SEQ ID NO: 57744 - protein, 10 aa, Homo Sapiens
ETSKMKVLRF

SEQ ID NO: 57745 - protein, 10 aa, Homo Sapiens
ETSPLTAEKL

SEQ ID NO: 57746 - protein, 10 aa, Homo Sapiens
ETSRLNIERM

SEQ ID NO: 57747 - protein, 10 aa, Homo Sapiens
ETSTEAATRL

SEQ ID NO: 57748 - protein, 10 aa, Homo Sapiens
ETTPLTIEKL

SEQ ID NO: 57749 - protein, 10 aa, Homo Sapiens
ETVFESRNLR

SEQ ID NO: 57750 - protein, 10 aa, Homo Sapiens
ETVGTGIMGR

SEQ ID NO: 57751 - protein, 10 aa, Homo Sapiens
ETVGVKINEK

SEQ ID NO: 57752 - protein, 10 aa, Homo Sapiens
ETVKVQIHSR

SEQ ID NO: 57753 - protein, 10 aa, Homo Sapiens
ETVNVEPLTK

SEQ ID NO: 57754 - protein, 10 aa, Homo Sapiens
ETVQLRNPPR

SEQ ID NO: 57755 - protein, 10 aa, Homo Sapiens
ETVTGGFGAK

SEQ ID NO: 57756 - protein, 10 aa, Homo Sapiens
ETYEGSPVSK

SEQ ID NO: 57757 - protein, 10 aa, Homo Sapiens
EVAAMENVHR

SEQ ID NO: 57758 - protein, 10 aa, Homo Sapiens
EVAERLGVTR

SEQ ID NO: 57759 - protein, 10 aa, Homo Sapiens
EVAGIINDAK

SEQ ID NO: 57760 - protein, 10 aa, Homo Sapiens
EVAPCMGDRF

SEQ ID NO: 57761 - protein, 10 aa, Homo Sapiens
EVAPPEYHRK

SEQ ID NO: 57762 - protein, 10 aa, Homo Sapiens
EVAQLIQGGR

SEQ ID NO: 57763 - protein, 10 aa, Homo Sapiens
EVASFVADRL

SEQ ID NO: 57764 - protein, 10 aa, Homo Sapiens
EVASVWVERI

SEQ ID NO: 57765 - protein, 10 aa, Homo Sapiens
EVCGQDITTK

SEQ ID NO: 57766 - protein, 10 aa, Homo Sapiens
EVEPGVHLGR

SEQ ID NO: 57767 - protein, 10 aa, Homo Sapiens
EVESTEYVNR

SEQ ID NO: 57768 - protein, 10 aa, Homo Sapiens
EVFFSEKIYK

SEQ ID NO: 57769 - protein, 10 aa, Homo Sapiens
EVFGVTDNPR

SEQ ID NO: 57770 - protein, 10 aa, Homo Sapiens
EVFLAQGTLR

SEQ ID NO: 57771 - protein, 10 aa, Homo Sapiens
EVFNDPKVLK

SEQ ID NO: 57772 - protein, 10 aa, Homo Sapiens
EVFNKFFKER

SEQ ID NO: 57773 - protein, 10 aa, Homo Sapiens
EVFPLKVFGY

SEQ ID NO: 57774 - protein, 10 aa, Homo Sapiens
EVFRTKIVEK

SEQ ID NO: 57775 - protein, 10 aa, Homo Sapiens
EVGDIVKVTR

SEQ ID NO: 57776 - protein, 10 aa, Homo Sapiens
EVGKAGHIMR

SEQ ID NO: 57777 - protein, 10 aa, Homo Sapiens
EVGPEGALGK

SEQ ID NO: 57778 - protein, 10 aa, Homo Sapiens
EVGPGAVGER

SEQ ID NO: 57779 - protein, 10 aa, Homo Sapiens
EVGTASPMAR

SEQ ID NO: 57780 - protein, 10 aa, Homo Sapiens
EVHYHLPVAR

SEQ ID NO: 57781 - protein, 10 aa, Homo Sapiens
EVIKPWITKR

SEQ ID NO: 57782 - protein, 10 aa, Homo Sapiens
EVILATPYGR

SEQ ID NO: 57783 - protein, 10 aa, Homo Sapiens
EVILIDPFHK

SEQ ID NO: 57784 - protein, 10 aa, Homo Sapiens
EVINKNVTEK

SEQ ID NO: 57785 - protein, 10 aa, Homo Sapiens
EVIQLQGDQR

SEQ ID NO: 57786 - protein, 10 aa, Homo Sapiens
EVIRAYDTTK

SEQ ID NO: 57787 - protein, 10 aa, Homo Sapiens
EVISGQKLTR

SEQ ID NO: 57788 - protein, 10 aa, Homo Sapiens
EVKRPGESLR

SEQ ID NO: 57789 - protein, 10 aa, Homo Sapiens
EVLGAPVKGK

SEQ ID NO: 57790 - protein, 10 aa, Homo Sapiens
EVMIAEPSCR

SEQ ID NO: 57791 - protein, 10 aa, Homo Sapiens
EVNQETIQRL

SEQ ID NO: 57792 - protein, 10 aa, Homo Sapiens
EVNQPKFNQR

SEQ ID NO: 57793 - protein, 10 aa, Homo Sapiens
EVPAAYQTPK

SEQ ID NO: 57794 - protein, 10 aa, Homo Sapiens
EVPEGGLVPK

SEQ ID NO: 57795 - protein, 10 aa, Homo Sapiens
EVPEIVPFRL

SEQ ID NO: 57796 - protein, 10 aa, Homo Sapiens
EVPPNQIVGR

SEQ ID NO: 57797 - protein, 10 aa, Homo Sapiens
EVPQIEVTRF

SEQ ID NO: 57798 - protein, 10 aa, Homo Sapiens
EVPREKLASR

SEQ ID NO: 57799 - protein, 10 aa, Homo Sapiens
EVPSEIEVPR

SEQ ID NO: 57800 - protein, 10 aa, Homo Sapiens
EVPSFLVERM

SEQ ID NO: 57801 - protein, 10 aa, Homo Sapiens
EVQDLHLAQR

SEQ ID NO: 57802 - protein, 10 aa, Homo Sapiens
EVSDVEIITR

SEQ ID NO: 57803 - protein, 10 aa, Homo Sapiens
EVSPITGRSK

SEQ ID NO: 57804 - protein, 10 aa, Homo Sapiens
EVSPMYGVQK

SEQ ID NO: 57805 - protein, 10 aa, Homo Sapiens
EVSSVSPLKN

SEQ ID NO: 57806 - protein, 10 aa, Homo Sapiens
EVSTVNVRRR

SEQ ID NO: 57807 - protein, 10 aa, Homo Sapiens
EVTEEGVRFR

SEQ ID NO: 57808 - protein, 10 aa, Homo Sapiens
EVTEGLDVLR

SEQ ID NO: 57809 - protein, 10 aa, Homo Sapiens
EVTNIKKTLK

SEQ ID NO: 57810 - protein, 10 aa, Homo Sapiens
EVTPAMQIPR

SEQ ID NO: 57811 - protein, 10 aa, Homo Sapiens
EVTQDFMMYR

SEQ ID NO: 57812 - protein, 10 aa, Homo Sapiens
EVVAGEFGSR

SEQ ID NO: 57813 - protein, 10 aa, Homo Sapiens
EVVDKSQVSR

SEQ ID NO: 57814 - protein, 10 aa, Homo Sapiens
EVVDSNPYSR

SEQ ID NO: 57815 - protein, 10 aa, Homo Sapiens
EVVDVMVIGR

SEQ ID NO: 57816 - protein, 10 aa, Homo Sapiens
EVVELPVTER

SEQ ID NO: 57817 - protein, 10 aa, Homo Sapiens
EVVIPQKKGK

SEQ ID NO: 57818 - protein, 10 aa, Homo Sapiens
EVVQSSPVER

SEQ ID NO: 57819 - protein, 10 aa, Homo Sapiens
EVVSGSGLTR

SEQ ID NO: 57820 - protein, 10 aa, Homo Sapiens
EVVSQEAELR

SEQ ID NO: 57821 - protein, 10 aa, Homo Sapiens
EVVTGVIGQR

SEQ ID NO: 57822 - protein, 10 aa, Homo Sapiens
EVVTSMGTQR

SEQ ID NO: 57823 - protein, 10 aa, Homo Sapiens
EVVVAFPAAR

SEQ ID NO: 57824 - protein, 10 aa, Homo Sapiens
EVYDGPKNVR

SEQ ID NO: 57825 - protein, 10 aa, Homo Sapiens
EVYNEFVRKR

SEQ ID NO: 57826 - protein, 10 aa, Homo Sapiens
EVYPFGIVGM

SEQ ID NO: 57827 - protein, 10 aa, Homo Sapiens
EVYVEVAYPR

SEQ ID NO: 57828 - protein, 10 aa, Homo Sapiens
EVYVWDVNSR

SEQ ID NO: 57829 - protein, 10 aa, Homo Sapiens
FAAGILESKR

SEQ ID NO: 57830 - protein, 10 aa, Homo Sapiens
FAFEGILIKK

SEQ ID NO: 57831 - protein, 10 aa, Homo Sapiens
FAIQPNTTGK

SEQ ID NO: 57832 - protein, 10 aa, Homo Sapiens
FEITPPVVLR

SEQ ID NO: 57833 - protein, 10 aa, Homo Sapiens
FIIDDKGILR

SEQ ID NO: 57834 - protein, 10 aa, Homo Sapiens
FIIDGKGVLR

SEQ ID NO: 57835 - protein, 10 aa, Homo Sapiens
FNSDVVIVER

SEQ ID NO: 57836 - protein, 10 aa, Homo Sapiens
FPAGVPVSER

SEQ ID NO: 57837 - protein, 10 aa, Homo Sapiens
FSSGETATYR

SEQ ID NO: 57838 - protein, 10 aa, Homo Sapiens
FSVSDLAPPR

SEQ ID NO: 57839 - protein, 10 aa, Homo Sapiens
FTASGEAEAR

SEQ ID NO: 57840 - protein, 10 aa, Homo Sapiens
FTIDDFEIGR

SEQ ID NO: 57841 - protein, 10 aa, Homo Sapiens
FTMASSPAQR

SEQ ID NO: 57842 - protein, 10 aa, Homo Sapiens
FVSTVPSKLR

SEQ ID NO: 57843 - protein, 10 aa, Homo Sapiens
FVWTEPHSKR

SEQ ID NO: 57844 - protein, 10 aa, Homo Sapiens
FVYEPKEQKK

SEQ ID NO: 57845 - protein, 10 aa, Homo Sapiens
GLSPGVSVRS

SEQ ID NO: 57846 - protein, 10 aa, Homo Sapiens
GTFGEVFKAR

SEQ ID NO: 57847 - protein, 10 aa, Homo Sapiens
GTVFIIQGLR

SEQ ID NO: 57848 - protein, 10 aa, Homo Sapiens
GVFEGIPTYR

SEQ ID NO: 57849 - protein, 10 aa, Homo Sapiens
HAFHFHCISR

SEQ ID NO: 57850 - protein, 10 aa, Homo Sapiens
HAIKSVKIYR

SEQ ID NO: 57851 - protein, 10 aa, Homo Sapiens
HNMDVPNIKR

SEQ ID NO: 57852 - protein, 10 aa, Homo Sapiens
HPSKVVITRL

SEQ ID NO: 57853 - protein, 10 aa, Homo Sapiens
HSAPLTPVAR

SEQ ID NO: 57854 - protein, 10 aa, Homo Sapiens
HSAVGQGVPR

SEQ ID NO: 57855 - protein, 10 aa, Homo Sapiens
HTAQIEIVRL

SEQ ID NO: 57856 - protein, 10 aa, Homo Sapiens
HTGPQQDPRL

SEQ ID NO: 57857 - protein, 10 aa, Homo Sapiens
HTIAPMGTRR

SEQ ID NO: 57858 - protein, 10 aa, Homo Sapiens
HTSISSLFER

SEQ ID NO: 57859 - protein, 10 aa, Homo Sapiens
HTVRDHLVGR

SEQ ID NO: 57860 - protein, 10 aa, Homo Sapiens
HVIRGYVGNR

SEQ ID NO: 57861 - protein, 10 aa, Homo Sapiens
HVSLITPTKR

SEQ ID NO: 57862 - protein, 10 aa, Homo Sapiens
HVYDGKFLAR

SEQ ID NO: 57863 - protein, 10 aa, Homo Sapiens
HVYVGNISKK

SEQ ID NO: 57864 - protein, 10 aa, Homo Sapiens
IAIKPDGVQR

SEQ ID NO: 57865 - protein, 10 aa, Homo Sapiens
IIQNVPVHQR

SEQ ID NO: 57866 - protein, 10 aa, Homo Sapiens
IPAAIATAKR

SEQ ID NO: 57867 - protein, 10 aa, Homo Sapiens
IPFGNNPIFR

SEQ ID NO: 57868 - protein, 10 aa, Homo Sapiens
IPVNGGLAAR

SEQ ID NO: 57869 - protein, 10 aa, Homo Sapiens
ISFSGLPSGR

SEQ ID NO: 57870 - protein, 10 aa, Homo Sapiens
ITAGLDPVGR

SEQ ID NO: 57871 - protein, 10 aa, Homo Sapiens
ITFDVAPSRL

SEQ ID NO: 57872 - protein, 10 aa, Homo Sapiens
ITIEIPEVLK

SEQ ID NO: 57873 - protein, 10 aa, Homo Sapiens
ITNNIDPVGR

SEQ ID NO: 57874 - protein, 10 aa, Homo Sapiens
ITSIVVLVER

SEQ ID NO: 57875 - protein, 10 aa, Homo Sapiens
ITSPPNALPR

SEQ ID NO: 57876 - protein, 10 aa, Homo Sapiens
IVFPETSQPR

SEQ ID NO: 57877 - protein, 10 aa, Homo Sapiens
IVKGPRGTLR

SEQ ID NO: 57878 - protein, 10 aa, Homo Sapiens
IVLVYITYHW

SEQ ID NO: 57879 - protein, 10 aa, Homo Sapiens
IVVDAIDVLK

SEQ ID NO: 57880 - protein, 10 aa, Homo Sapiens
KASAALSVPR

SEQ ID NO: 57881 - protein, 10 aa, Homo Sapiens
LAAGIVGNLR

SEQ ID NO: 57882 - protein, 10 aa, Homo Sapiens
LGGSRGAPGL

SEQ ID NO: 57883 - protein, 10 aa, Homo Sapiens
LPSPSHVGPI

SEQ ID NO: 57884 - protein, 10 aa, Homo Sapiens
LVAEGLATRR

SEQ ID NO: 57885 - protein, 10 aa, Homo Sapiens
LVAEITPKGR

SEQ ID NO: 57886 - protein, 10 aa, Homo Sapiens
LVAEQVTYQR

SEQ ID NO: 57887 - protein, 10 aa, Homo Sapiens
LVFPSEIVGK

SEQ ID NO: 57888 - protein, 10 aa, Homo Sapiens
LVHDGLGDLR

SEQ ID NO: 57889 - protein, 10 aa, Homo Sapiens
LVKGAEITGK

SEQ ID NO: 57890 - protein, 10 aa, Homo Sapiens
LVQEQPLPEP

SEQ ID NO: 57891 - protein, 10 aa, Homo Sapiens
MTKSGYQPPR

SEQ ID NO: 57892 - protein, 10 aa, Homo Sapiens
MTQDAQNALR

SEQ ID NO: 57893 - protein, 10 aa, Homo Sapiens
MTSALPIIQK

SEQ ID NO: 57894 - protein, 10 aa, Homo Sapiens
MVSSQTKTVR

SEQ ID NO: 57895 - protein, 10 aa, Homo Sapiens
MVWEGYNVVR

SEQ ID NO: 57896 - protein, 10 aa, Homo Sapiens
MVYPFTGDHK

SEQ ID NO: 57897 - protein, 10 aa, Homo Sapiens
NAYTGIVLLR

SEQ ID NO: 57898 - protein, 10 aa, Homo Sapiens
NGTSSVIVSR

SEQ ID NO: 57899 - protein, 10 aa, Homo Sapiens
NIISGSGRPR

SEQ ID NO: 57900 - protein, 10 aa, Homo Sapiens
NSAGPYFNPR

SEQ ID NO: 57901 - protein, 10 aa, Homo Sapiens
NSFDPSKITR

SEQ ID NO: 57902 - protein, 10 aa, Homo Sapiens
NTFDFIKVLR

SEQ ID NO: 57903 - protein, 10 aa, Homo Sapiens
NTFLGTPVQK

SEQ ID NO: 57904 - protein, 10 aa, Homo Sapiens
NTFRRDPTAR

SEQ ID NO: 57905 - protein, 10 aa, Homo Sapiens
NTIDQKIVER

SEQ ID NO: 57906 - protein, 10 aa, Homo Sapiens
NTITPVVGKK

SEQ ID NO: 57907 - protein, 10 aa, Homo Sapiens
NTPAIPSFKR

SEQ ID NO: 57908 - protein, 10 aa, Homo Sapiens
NTSNMPVAAR

SEQ ID NO: 57909 - protein, 10 aa, Homo Sapiens
NTSPYSVQQR

SEQ ID NO: 57910 - protein, 10 aa, Homo Sapiens
NTVDEVYVSR

SEQ ID NO: 57911 - protein, 10 aa, Homo Sapiens
NVAEKNWYPR

SEQ ID NO: 57912 - protein, 10 aa, Homo Sapiens
NVAPIAGETK

SEQ ID NO: 57913 - protein, 10 aa, Homo Sapiens
NVAPLKTHFR

SEQ ID NO: 57914 - protein, 10 aa, Homo Sapiens
NVIDWSDVRK

SEQ ID NO: 57915 - protein, 10 aa, Homo Sapiens
NVKDKPTVER

SEQ ID NO: 57916 - protein, 10 aa, Homo Sapiens
NVPNSAIYKR

SEQ ID NO: 57917 - protein, 10 aa, Homo Sapiens
NVTDDTYYYR

SEQ ID NO: 57918 - protein, 10 aa, Homo Sapiens
NVVKFYGHRR

SEQ ID NO: 57919 - protein, 10 aa, Homo Sapiens
NVVNLIEICR

SEQ ID NO: 57920 - protein, 10 aa, Homo Sapiens
NVYPAECRGR

SEQ ID NO: 57921 - protein, 10 aa, Homo Sapiens
NVYPSKPLTK

SEQ ID NO: 57922 - protein, 10 aa, Homo Sapiens
PGEEPPIVRR

SEQ ID NO: 57923 - protein, 10 aa, Homo Sapiens
PRTSEIYVHR

SEQ ID NO: 57924 - protein, 10 aa, Homo Sapiens
QIFPSKPVSR

SEQ ID NO: 57925 - protein, 10 aa, Homo Sapiens
QLAQFHFTNR

SEQ ID NO: 57926 - protein, 10 aa, Homo Sapiens
QTIPPPYVVR

SEQ ID NO: 57927 - protein, 10 aa, Homo Sapiens
QTMSDQIIGR

SEQ ID NO: 57928 - protein, 10 aa, Homo Sapiens
QTQGPPDYPR

SEQ ID NO: 57929 - protein, 10 aa, Homo Sapiens
QTSGLPSSVR

SEQ ID NO: 57930 - protein, 10 aa, Homo Sapiens
QVADVVVSRW

SEQ ID NO: 57931 - protein, 10 aa, Homo Sapiens
QVANSAFVER

SEQ ID NO: 57932 - protein, 10 aa, Homo Sapiens
QVAPAQLVTR

SEQ ID NO: 57933 - protein, 10 aa, Homo Sapiens
QVEPGVHLGR

SEQ ID NO: 57934 - protein, 10 aa, Homo Sapiens
QVFNSKVTSR

SEQ ID NO: 57935 - protein, 10 aa, Homo Sapiens
QVSDVPATSR

SEQ ID NO: 57936 - protein, 10 aa, Homo Sapiens
SAAAVFNDRL

SEQ ID NO: 57937 - protein, 10 aa, Homo Sapiens
SAAAVLSHNR

SEQ ID NO: 57938 - protein, 10 aa, Homo Sapiens
SAAGPVAAPR

SEQ ID NO: 57939 - protein, 10 aa, Homo Sapiens
SAAPGTPLAR

SEQ ID NO: 57940 - protein, 10 aa, Homo Sapiens
SAVDITKVAR

SEQ ID NO: 57941 - protein, 10 aa, Homo Sapiens
SAYDQKNIRR

SEQ ID NO: 57942 - protein, 10 aa, Homo Sapiens
SIFDGRVVAK

SEQ ID NO: 57943 - protein, 10 aa, Homo Sapiens
SLPDFPAAAK

SEQ ID NO: 57944 - protein, 10 aa, Homo Sapiens
SNSGITRVEK

SEQ ID NO: 57945 - protein, 10 aa, Homo Sapiens
SPSPLGGIKR

SEQ ID NO: 57946 - protein, 10 aa, Homo Sapiens
SSAGGSFTVR

SEQ ID NO: 57947 - protein, 10 aa, Homo Sapiens
SSSTVVSTQR

SEQ ID NO: 57948 - protein, 10 aa, Homo Sapiens
STCQTISVDR

SEQ ID NO: 57949 - protein, 10 aa, Homo Sapiens
STFDTQITKK

SEQ ID NO: 57950 - protein, 10 aa, Homo Sapiens
STFNFHPNVR

SEQ ID NO: 57951 - protein, 10 aa, Homo Sapiens
STFNQVVLKR

SEQ ID NO: 57952 - protein, 10 aa, Homo Sapiens
STPSDINSPR

SEQ ID NO: 57953 - protein, 10 aa, Homo Sapiens
STSEAPQPPR

SEQ ID NO: 57954 - protein, 10 aa, Homo Sapiens
STSETPQPPR

SEQ ID NO: 57955 - protein, 10 aa, Homo Sapiens
STTEVTQPRT

SEQ ID NO: 57956 - protein, 10 aa, Homo Sapiens
STVGGWVSTR

SEQ ID NO: 57957 - protein, 10 aa, Homo Sapiens
STWGSPGWVR

SEQ ID NO: 57958 - protein, 10 aa, Homo Sapiens
STYYGSFVTR

SEQ ID NO: 57959 - protein, 10 aa, Homo Sapiens
SVAEMPQNYR

SEQ ID NO: 57960 - protein, 10 aa, Homo Sapiens
SVAGMPATSR

SEQ ID NO: 57961 - protein, 10 aa, Homo Sapiens
SVASTPISQR

SEQ ID NO: 57962 - protein, 10 aa, Homo Sapiens
SVFDAYVLPK

SEQ ID NO: 57963 - protein, 10 aa, Homo Sapiens
SVFEDPVISK

SEQ ID NO: 57964 - protein, 10 aa, Homo Sapiens
SVFEERPERR

SEQ ID NO: 57965 - protein, 10 aa, Homo Sapiens
SVFGSGNTGR

SEQ ID NO: 57966 - protein, 10 aa, Homo Sapiens
SVFNEHPSRR

SEQ ID NO: 57967 - protein, 10 aa, Homo Sapiens
SVFPQNGAAR

SEQ ID NO: 57968 - protein, 10 aa, Homo Sapiens
SVGEITGHNK

SEQ ID NO: 57969 - protein, 10 aa, Homo Sapiens
SVIDSVTKKR

SEQ ID NO: 57970 - protein, 10 aa, Homo Sapiens
SVINPGAIYR

SEQ ID NO: 57971 - protein, 10 aa, Homo Sapiens
SVINSVSTSR

SEQ ID NO: 57972 - protein, 10 aa, Homo Sapiens
SVISGPQNTR

SEQ ID NO: 57973 - protein, 10 aa, Homo Sapiens
SVPPPPAVGR

SEQ ID NO: 57974 - protein, 10 aa, Homo Sapiens
SVSEGLNVPR

SEQ ID NO: 57975 - protein, 10 aa, Homo Sapiens
SVSEVHPSRL

SEQ ID NO: 57976 - protein, 10 aa, Homo Sapiens
SVSPPQEARL

SEQ ID NO: 57977 - protein, 10 aa, Homo Sapiens
SVSSSTHFTR

SEQ ID NO: 57978 - protein, 10 aa, Homo Sapiens
SVTEAIPVSR

SEQ ID NO: 57979 - protein, 10 aa, Homo Sapiens
SVVEGGLRAR

SEQ ID NO: 57980 - protein, 10 aa, Homo Sapiens
SVYGYGVQKR

SEQ ID NO: 57981 - protein, 10 aa, Homo Sapiens
TAAAIGATPR

SEQ ID NO: 57982 - protein, 10 aa, Homo Sapiens
TAADLGSVVR

SEQ ID NO: 57983 - protein, 10 aa, Homo Sapiens
TAAGQGILSR

SEQ ID NO: 57984 - protein, 10 aa, Homo Sapiens
TAAPAYGLPK

SEQ ID NO: 57985 - protein, 10 aa, Homo Sapiens
TADGVPVSSR

SEQ ID NO: 57986 - protein, 10 aa, Homo Sapiens
TAFEEAQLPR

SEQ ID NO: 57987 - protein, 10 aa, Homo Sapiens
TAMDVVYALK

SEQ ID NO: 57988 - protein, 10 aa, Homo Sapiens
TAYGGKYSVK

SEQ ID NO: 57989 - protein, 10 aa, Homo Sapiens
TDLEPPVVKR

SEQ ID NO: 57990 - protein, 10 aa, Homo Sapiens
TDNSLICVAR

SEQ ID NO: 57991 - protein, 10 aa, Homo Sapiens
TIIDLPGITR

SEQ ID NO: 57992 - protein, 10 aa, Homo Sapiens
TIIEKPPAER

SEQ ID NO: 57993 - protein, 10 aa, Homo Sapiens
TIMEDYFAYR

SEQ ID NO: 57994 - protein, 10 aa, Homo Sapiens
TIPQFQNFYR

SEQ ID NO: 57995 - protein, 10 aa, Homo Sapiens
TPFNYNPSPR

SEQ ID NO: 57996 - protein, 10 aa, Homo Sapiens
TSAALPQSQR

SEQ ID NO: 57997 - protein, 10 aa, Homo Sapiens
TSAESWGTGR

SEQ ID NO: 57998 - protein, 10 aa, Homo Sapiens
TSFDGSLIQK

SEQ ID NO: 57999 - protein, 10 aa, Homo Sapiens
TSFPLSGPPR

SEQ ID NO: 58000 - protein, 10 aa, Homo Sapiens
TTARIRDTLR

SEQ ID NO: 58001 - protein, 10 aa, Homo Sapiens
TTFPESHLRT

SEQ ID NO: 58002 - protein, 10 aa, Homo Sapiens
TTFPLPVATR

SEQ ID NO: 58003 - protein, 10 aa, Homo Sapiens
TTFPMSNHTR

SEQ ID NO: 58004 - protein, 10 aa, Homo Sapiens
TTISKYFSER

SEQ ID NO: 58005 - protein, 10 aa, Homo Sapiens
TTISSFPQLK

SEQ ID NO: 58006 - protein, 10 aa, Homo Sapiens
TTLEHQKTFR

SEQ ID NO: 58007 - protein, 10 aa, Homo Sapiens
TTLELLEVRR

SEQ ID NO: 58008 - protein, 10 aa, Homo Sapiens
TTNDIVISKL

SEQ ID NO: 58009 - protein, 10 aa, Homo Sapiens
TTSDPPNICK

SEQ ID NO: 58010 - protein, 10 aa, Homo Sapiens
TTSPSGSLLR

SEQ ID NO: 58011 - protein, 10 aa, Homo Sapiens
TTTGVDPVAK

SEQ ID NO: 58012 - protein, 10 aa, Homo Sapiens
TTTQITKTVK

SEQ ID NO: 58013 - protein, 10 aa, Homo Sapiens
TTVDIFHKKH

SEQ ID NO: 58014 - protein, 10 aa, Homo Sapiens
TTVQVKEVNR

SEQ ID NO: 58015 - protein, 10 aa, Homo Sapiens
TTVTVAPAPR

SEQ ID NO: 58016 - protein, 10 aa, Homo Sapiens
TVAEIKKQYR

SEQ ID NO: 58017 - protein, 10 aa, Homo Sapiens
TVAEKLDWAR

SEQ ID NO: 58018 - protein, 10 aa, Homo Sapiens
TVAPSVGITR

SEQ ID NO: 58019 - protein, 10 aa, Homo Sapiens
TVENFGQLGR

SEQ ID NO: 58020 - protein, 10 aa, Homo Sapiens
TVFNVDLPCR

SEQ ID NO: 58021 - protein, 10 aa, Homo Sapiens
TVFRTPAIKR

SEQ ID NO: 58022 - protein, 10 aa, Homo Sapiens
TVIDVSTADR

SEQ ID NO: 58023 - protein, 10 aa, Homo Sapiens
TVISGPGTGK

SEQ ID NO: 58024 - protein, 10 aa, Homo Sapiens
TVNTSLNVYR

SEQ ID NO: 58025 - protein, 10 aa, Homo Sapiens
TVVDIDPPLR

SEQ ID NO: 58026 - protein, 10 aa, Homo Sapiens
TVVEDVTVGR

SEQ ID NO: 58027 - protein, 10 aa, Homo Sapiens
TVVYFPVRGR

SEQ ID NO: 58028 - protein, 10 aa, Homo Sapiens
VAFINEKMAR

SEQ ID NO: 58029 - protein, 10 aa, Homo Sapiens
VFDAKRLIGR

SEQ ID NO: 58030 - protein, 10 aa, Homo Sapiens
VLTGKMEKGL

SEQ ID NO: 58031 - protein, 10 aa, Homo Sapiens
VTIFIRGGNK

SEQ ID NO: 58032 - protein, 10 aa, Homo Sapiens
WTMSNITAGR

SEQ ID NO: 58033 - protein, 10 aa, Homo Sapiens
YAAISQVDRL

SEQ ID NO: 58034 - protein, 10 aa, Homo Sapiens
YAFNSGNVER

SEQ ID NO: 58035 - protein, 10 aa, Homo Sapiens
YAGGPSGVAR

SEQ ID NO: 58036 - protein, 10 aa, Homo Sapiens
YANEVGEAFR

SEQ ID NO: 58037 - protein, 10 aa, Homo Sapiens
YDPRNPVNKR

SEQ ID NO: 58038 - protein, 10 aa, Homo Sapiens
YIITGGGFLR

SEQ ID NO: 58039 - protein, 10 aa, Homo Sapiens
YLITFNPVGR

SEQ ID NO: 58040 - protein, 10 aa, Homo Sapiens
YTFQDKQVSR

SEQ ID NO: 58041 - protein, 10 aa, Homo Sapiens
YTFYSISQER

SEQ ID NO: 58042 - protein, 10 aa, Homo Sapiens
YTKDAMPINK

SEQ ID NO: 58043 - protein, 10 aa, Homo Sapiens
YTSGIPSSSR

SEQ ID NO: 58044 - protein, 10 aa, Homo Sapiens
YVADLGDILK

SEQ ID NO: 58045 - protein, 10 aa, Homo Sapiens
YVYPDKTRPR

SEQ ID NO: 58046 - protein, 11 aa, Homo Sapiens
AAAAAGAFAGR

SEQ ID NO: 58047 - protein, 11 aa, Homo Sapiens
AMVIVALIDRM

SEQ ID NO: 58048 - protein, 11 aa, Homo Sapiens
ATAGDGLIELR

SEQ ID NO: 58049 - protein, 11 aa, Homo Sapiens
ATIDVEHSHVR

SEQ ID NO: 58050 - protein, 11 aa, Homo Sapiens
AVFPSLLTNPK

SEQ ID NO: 58051 - protein, 11 aa, Homo Sapiens
AVVDFKAVQGR

SEQ ID NO: 58052 - protein, 11 aa, Homo Sapiens
AVVDVRIGMTR

SEQ ID NO: 58053 - protein, 11 aa, Homo Sapiens
CTIKTDPVTGR

SEQ ID NO: 58054 - protein, 11 aa, Homo Sapiens
CVVVVNPQTKR

SEQ ID NO: 58055 - protein, 11 aa, Homo Sapiens
DAAHPTNVQRL

SEQ ID NO: 58056 - protein, 11 aa, Homo Sapiens
DANGNSFATRI

SEQ ID NO: 58057 - protein, 11 aa, Homo Sapiens
DASPASAGICR

SEQ ID NO: 58058 - protein, 11 aa, Homo Sapiens
DAVPCSTTINR

SEQ ID NO: 58059 - protein, 11 aa, Homo Sapiens
DAVQTVTGGLR

SEQ ID NO: 58060 - protein, 11 aa, Homo Sapiens
DIAEPGSVAGR

SEQ ID NO: 58061 - protein, 11 aa, Homo Sapiens
DIYNSDPLICR

SEQ ID NO: 58062 - protein, 11 aa, Homo Sapiens
DLADLSCLVYR

SEQ ID NO: 58063 - protein, 11 aa, Homo Sapiens
DLALSFRVGAR

SEQ ID NO: 58064 - protein, 11 aa, Homo Sapiens
DLFEDGGIIRR

SEQ ID NO: 58065 - protein, 11 aa, Homo Sapiens
DPAGALQAAFR

SEQ ID NO: 58066 - protein, 11 aa, Homo Sapiens
DSFCSNGVTHR

SEQ ID NO: 58067 - protein, 11 aa, Homo Sapiens
DSIGSTVSSER

SEQ ID NO: 58068 - protein, 11 aa, Homo Sapiens
DSMLVDPKHHR

SEQ ID NO: 58069 - protein, 11 aa, Homo Sapiens
DSSSVASKVFR

SEQ ID NO: 58070 - protein, 11 aa, Homo Sapiens
DSVLMEQPPLR

SEQ ID NO: 58071 - protein, 11 aa, Homo Sapiens
DSYASGEGLKR

SEQ ID NO: 58072 - protein, 11 aa, Homo Sapiens
DTAPCPINNER

SEQ ID NO: 58073 - protein, 11 aa, Homo Sapiens
DTIDERAINKK

SEQ ID NO: 58074 - protein, 11 aa, Homo Sapiens
DTIDERTINKK

SEQ ID NO: 58075 - protein, 11 aa, Homo Sapiens
DTISNKKVLPK

SEQ ID NO: 58076 - protein, 11 aa, Homo Sapiens
DTISPYSRMKR

SEQ ID NO: 58077 - protein, 11 aa, Homo Sapiens
DTITTDTGFMR

SEQ ID NO: 58078 - protein, 11 aa, Homo Sapiens
DTIVSGTLPQR

SEQ ID NO: 58079 - protein, 11 aa, Homo Sapiens
DTSSLPTVIMR

SEQ ID NO: 58080 - protein, 11 aa, Homo Sapiens
DTVPSVSSINR

SEQ ID NO: 58081 - protein, 11 aa, Homo Sapiens
DVAALHGPVVR

SEQ ID NO: 58082 - protein, 11 aa, Homo Sapiens
DVFKSNKEVGR

SEQ ID NO: 58083 - protein, 11 aa, Homo Sapiens
DVFSGVKPLTR

SEQ ID NO: 58084 - protein, 11 aa, Homo Sapiens
DVFVVGTERGR

SEQ ID NO: 58085 - protein, 11 aa, Homo Sapiens
DVISVEKTVKR

SEQ ID NO: 58086 - protein, 11 aa, Homo Sapiens
DVITDSPTHKR

SEQ ID NO: 58087 - protein, 11 aa, Homo Sapiens
DVITIIDRSFR

SEQ ID NO: 58088 - protein, 11 aa, Homo Sapiens
DVTPIPSDSTR

SEQ ID NO: 58089 - protein, 11 aa, Homo Sapiens
DVVKLTKNSKR

SEQ ID NO: 58090 - protein, 11 aa, Homo Sapiens
DVVYALKRQGR

SEQ ID NO: 58091 - protein, 11 aa, Homo Sapiens
EAAAISGLQKR

SEQ ID NO: 58092 - protein, 11 aa, Homo Sapiens
EAANKVVLQLK

SEQ ID NO: 58093 - protein, 11 aa, Homo Sapiens
EAANYQDTIGR

SEQ ID NO: 58094 - protein, 11 aa, Homo Sapiens
EAAPDPAGVGR

SEQ ID NO: 58095 - protein, 11 aa, Homo Sapiens
EAAPGALGQVK

SEQ ID NO: 58096 - protein, 11 aa, Homo Sapiens
EAASYLDQISR

SEQ ID NO: 58097 - protein, 11 aa, Homo Sapiens
EAAVAIKAMAK

SEQ ID NO: 58098 - protein, 11 aa, Homo Sapiens
EAAVVAVAEKR

SEQ ID NO: 58099 - protein, 11 aa, Homo Sapiens
EAFEHPNVVRL

SEQ ID NO: 58100 - protein, 11 aa, Homo Sapiens
EAFRNLVPVTR

SEQ ID NO: 58101 - protein, 11 aa, Homo Sapiens
EAFSQFGPIER

SEQ ID NO: 58102 - protein, 11 aa, Homo Sapiens
EAFSTPQQLEK

SEQ ID NO: 58103 - protein, 11 aa, Homo Sapiens
EAFSVFGQVER

SEQ ID NO: 58104 - protein, 11 aa, Homo Sapiens
EAFTSEHWLVR

SEQ ID NO: 58105 - protein, 11 aa, Homo Sapiens
EAGPGPRPLAR

SEQ ID NO: 58106 - protein, 11 aa, Homo Sapiens
EAHQAETEVLR

SEQ ID NO: 58107 - protein, 11 aa, Homo Sapiens
EAICPEGIARL

SEQ ID NO: 58108 - protein, 11 aa, Homo Sapiens
EAISEVLQDLR

SEQ ID NO: 58109 - protein, 11 aa, Homo Sapiens
EALHQKNIVHR

SEQ ID NO: 58110 - protein, 11 aa, Homo Sapiens
EALPHVVPTLR

SEQ ID NO: 58111 - protein, 11 aa, Homo Sapiens
EASEEAVSVQR

SEQ ID NO: 58112 - protein, 11 aa, Homo Sapiens
EAVGSYAENQR

SEQ ID NO: 58113 - protein, 11 aa, Homo Sapiens
EAVKPTVGMKR

SEQ ID NO: 58114 - protein, 11 aa, Homo Sapiens
EAYEVLSDAKK

SEQ ID NO: 58115 - protein, 11 aa, Homo Sapiens
EIADTMVQIFK

SEQ ID NO: 58116 - protein, 11 aa, Homo Sapiens
EIAQNNVEVAR

SEQ ID NO: 58117 - protein, 11 aa, Homo Sapiens
EIARFFKLHER

SEQ ID NO: 58118 - protein, 11 aa, Homo Sapiens
EIARFYKLHER

SEQ ID NO: 58119 - protein, 11 aa, Homo Sapiens
EIASFDKAKLK

SEQ ID NO: 58120 - protein, 11 aa, Homo Sapiens
EIIAPSPQRSR

SEQ ID NO: 58121 - protein, 11 aa, Homo Sapiens
EIKGTNGQVTR

SEQ ID NO: 58122 - protein, 11 aa, Homo Sapiens
EIPDNVGDWLR

SEQ ID NO: 58123 - protein, 11 aa, Homo Sapiens
EIVGNLPSAMR

SEQ ID NO: 58124 - protein, 11 aa, Homo Sapiens
EIVTERSVSSR

SEQ ID NO: 58125 - protein, 11 aa, Homo Sapiens
EIYDRREYSRF

SEQ ID NO: 58126 - protein, 11 aa, Homo Sapiens
ELFEDSQLTTR

SEQ ID NO: 58127 - protein, 11 aa, Homo Sapiens
ELFHVEPGLQR

SEQ ID NO: 58128 - protein, 11 aa, Homo Sapiens
ELFRPKDPQGR

SEQ ID NO: 58129 - protein, 11 aa, Homo Sapiens
ELITQRELVSR

SEQ ID NO: 58130 - protein, 11 aa, Homo Sapiens
ELVEPSSVALR

SEQ ID NO: 58131 - protein, 11 aa, Homo Sapiens
ESAGGLIQTAR

SEQ ID NO: 58132 - protein, 11 aa, Homo Sapiens
ESFASDPILYR

SEQ ID NO: 58133 - protein, 11 aa, Homo Sapiens
ESFFPYQVTER

SEQ ID NO: 58134 - protein, 11 aa, Homo Sapiens
ESFGPQPISRL

SEQ ID NO: 58135 - protein, 11 aa, Homo Sapiens
ESFPELTIITR

SEQ ID NO: 58136 - protein, 11 aa, Homo Sapiens
ESFPSIGPQRL

SEQ ID NO: 58137 - protein, 11 aa, Homo Sapiens
ESFSDYPPLGR

SEQ ID NO: 58138 - protein, 11 aa, Homo Sapiens
ESGGASVISTR

SEQ ID NO: 58139 - protein, 11 aa, Homo Sapiens
ESIDPQFTIRR

SEQ ID NO: 58140 - protein, 11 aa, Homo Sapiens
ESIGNCPFSQR

SEQ ID NO: 58141 - protein, 11 aa, Homo Sapiens
ESLPATHIRGK

SEQ ID NO: 58142 - protein, 11 aa, Homo Sapiens
ESMLTPPIARR

SEQ ID NO: 58143 - protein, 11 aa, Homo Sapiens
ESSAGGSFTVR

SEQ ID NO: 58144 - protein, 11 aa, Homo Sapiens
ESVPPGTTISR

SEQ ID NO: 58145 - protein, 11 aa, Homo Sapiens
ESVSEGLNVPR

SEQ ID NO: 58146 - protein, 11 aa, Homo Sapiens
ESYTPSKISVR

SEQ ID NO: 58147 - protein, 11 aa, Homo Sapiens
ETAGRTPKLAR

SEQ ID NO: 58148 - protein, 11 aa, Homo Sapiens
ETAGSTSIPKR

SEQ ID NO: 58149 - protein, 11 aa, Homo Sapiens
ETALNSKAYKR

SEQ ID NO: 58150 - protein, 11 aa, Homo Sapiens
ETALPGAFKTR

SEQ ID NO: 58151 - protein, 11 aa, Homo Sapiens
ETALYGNLILR

SEQ ID NO: 58152 - protein, 11 aa, Homo Sapiens
ETASNEVVYRF

SEQ ID NO: 58153 - protein, 11 aa, Homo Sapiens
ETATTPIFANR

SEQ ID NO: 58154 - protein, 11 aa, Homo Sapiens
ETFEHPNVVRL

SEQ ID NO: 58155 - protein, 11 aa, Homo Sapiens
ETFKEQGNAYY

SEQ ID NO: 58156 - protein, 11 aa, Homo Sapiens
ETFLTSPEELY

SEQ ID NO: 58157 - protein, 11 aa, Homo Sapiens
ETFRSSDPATR

SEQ ID NO: 58158 - protein, 11 aa, Homo Sapiens
ETFSGVYKKLT

SEQ ID NO: 58159 - protein, 11 aa, Homo Sapiens
ETIDNGFGHSR

SEQ ID NO: 58160 - protein, 11 aa, Homo Sapiens
ETIGNELFNCR

SEQ ID NO: 58161 - protein, 11 aa, Homo Sapiens
ETIHADSVAKR

SEQ ID NO: 58162 - protein, 11 aa, Homo Sapiens
ETILASSGTDR

SEQ ID NO: 58163 - protein, 11 aa, Homo Sapiens
ETIPGPDAKVR

SEQ ID NO: 58164 - protein, 11 aa, Homo Sapiens
ETISSKNIISR

SEQ ID NO: 58165 - protein, 11 aa, Homo Sapiens
ETLKNTKEIQR

SEQ ID NO: 58166 - protein, 11 aa, Homo Sapiens
ETNEIANANSR

SEQ ID NO: 58167 - protein, 11 aa, Homo Sapiens
ETPKPGTCVKR

SEQ ID NO: 58168 - protein, 11 aa, Homo Sapiens
ETQSRTITVTR

SEQ ID NO: 58169 - protein, 11 aa, Homo Sapiens
ETVPKDLRHLR

SEQ ID NO: 58170 - protein, 11 aa, Homo Sapiens
ETVQKETIHPR

SEQ ID NO: 58171 - protein, 11 aa, Homo Sapiens
ETVSEEKRIYR

SEQ ID NO: 58172 - protein, 11 aa, Homo Sapiens
ETVTGGFGAKK

SEQ ID NO: 58173 - protein, 11 aa, Homo Sapiens
ETYEEIYKSTK

SEQ ID NO: 58174 - protein, 11 aa, Homo Sapiens
ETYLNENLRKR

SEQ ID NO: 58175 - protein, 11 aa, Homo Sapiens
ETYTAYLIETR

SEQ ID NO: 58176 - protein, 11 aa, Homo Sapiens
EVAGTVTGQKR

SEQ ID NO: 58177 - protein, 11 aa, Homo Sapiens
EVAPEIKASER

SEQ ID NO: 58178 - protein, 11 aa, Homo Sapiens
EVAPPEYHRKA

SEQ ID NO: 58179 - protein, 11 aa, Homo Sapiens
EVAPPKAHEVR

SEQ ID NO: 58180 - protein, 11 aa, Homo Sapiens
EVEPQGVIVTR

SEQ ID NO: 58181 - protein, 11 aa, Homo Sapiens
EVFFSEKIYKL

SEQ ID NO: 58182 - protein, 11 aa, Homo Sapiens
EVFGAEGFHEK

SEQ ID NO: 58183 - protein, 11 aa, Homo Sapiens
EVFTTLSVTKR

SEQ ID NO: 58184 - protein, 11 aa, Homo Sapiens
EVFTTTEGRTR

SEQ ID NO: 58185 - protein, 11 aa, Homo Sapiens
EVFYPGETVVH

SEQ ID NO: 58186 - protein, 11 aa, Homo Sapiens
EVGICNEAGFR

SEQ ID NO: 58187 - protein, 11 aa, Homo Sapiens
EVGPGPGGITR

SEQ ID NO: 58188 - protein, 11 aa, Homo Sapiens
EVHGEAQRVLR

SEQ ID NO: 58189 - protein, 11 aa, Homo Sapiens
EVIAQLENAAK

SEQ ID NO: 58190 - protein, 11 aa, Homo Sapiens
EVIEGYEIACR

SEQ ID NO: 58191 - protein, 11 aa, Homo Sapiens
EVIGSKLNISR

SEQ ID NO: 58192 - protein, 11 aa, Homo Sapiens
EVIKDGYENAR

SEQ ID NO: 58193 - protein, 11 aa, Homo Sapiens
EVINFGDCLVR

SEQ ID NO: 58194 - protein, 11 aa, Homo Sapiens
EVINTPRVVDR

SEQ ID NO: 58195 - protein, 11 aa, Homo Sapiens
EVIPYTPAMQR

SEQ ID NO: 58196 - protein, 11 aa, Homo Sapiens
EVIQESGTKLK

SEQ ID NO: 58197 - protein, 11 aa, Homo Sapiens
EVIQLIKTNKK

SEQ ID NO: 58198 - protein, 11 aa, Homo Sapiens
EVIQLQGDQRK

SEQ ID NO: 58199 - protein, 11 aa, Homo Sapiens
EVIQNPATITR

SEQ ID NO: 58200 - protein, 11 aa, Homo Sapiens
EVISLGLPFGK

SEQ ID NO: 58201 - protein, 11 aa, Homo Sapiens
EVISLSQVTPK

SEQ ID NO: 58202 - protein, 11 aa, Homo Sapiens
EVISTPGVVAR

SEQ ID NO: 58203 - protein, 11 aa, Homo Sapiens
EVIVVVGGCER

SEQ ID NO: 58204 - protein, 11 aa, Homo Sapiens
EVKRLKVTELR

SEQ ID NO: 58205 - protein, 11 aa, Homo Sapiens
EVLEQSAQTLR

SEQ ID NO: 58206 - protein, 11 aa, Homo Sapiens
EVLHIGSAHNR

SEQ ID NO: 58207 - protein, 11 aa, Homo Sapiens
EVLNDPENMEK

SEQ ID NO: 58208 - protein, 11 aa, Homo Sapiens
EVLNKHSLSGR

SEQ ID NO: 58209 - protein, 11 aa, Homo Sapiens
EVMQWSQSLEK

SEQ ID NO: 58210 - protein, 11 aa, Homo Sapiens
EVMRQRGINMR

SEQ ID NO: 58211 - protein, 11 aa, Homo Sapiens
EVNGAPVYVVR

SEQ ID NO: 58212 - protein, 11 aa, Homo Sapiens
EVPGSPIFVMR

SEQ ID NO: 58213 - protein, 11 aa, Homo Sapiens
EVPHELVAQSR

SEQ ID NO: 58214 - protein, 11 aa, Homo Sapiens
EVPLEENVNRR

SEQ ID NO: 58215 - protein, 11 aa, Homo Sapiens
EVPRTIIVTTR

SEQ ID NO: 58216 - protein, 11 aa, Homo Sapiens
EVQDRVMLTGR

SEQ ID NO: 58217 - protein, 11 aa, Homo Sapiens
EVQQARDLQNR

SEQ ID NO: 58218 - protein, 11 aa, Homo Sapiens
EVRADTGGLGR

SEQ ID NO: 58219 - protein, 11 aa, Homo Sapiens
EVTPVTGASLR

SEQ ID NO: 58220 - protein, 11 aa, Homo Sapiens
EVVCNDRLGKK

SEQ ID NO: 58221 - protein, 11 aa, Homo Sapiens
EVVDTTASTKR

SEQ ID NO: 58222 - protein, 11 aa, Homo Sapiens
EVVEFLKNPQK

SEQ ID NO: 58223 - protein, 11 aa, Homo Sapiens
EVVEGMDISTR

SEQ ID NO: 58224 - protein, 11 aa, Homo Sapiens
EVVKNTENFLK

SEQ ID NO: 58225 - protein, 11 aa, Homo Sapiens
EVVTPNIFNSR

SEQ ID NO: 58226 - protein, 11 aa, Homo Sapiens
EVWIPKNGTRR

SEQ ID NO: 58227 - protein, 11 aa, Homo Sapiens
EVYHNLKNVIK

SEQ ID NO: 58228 - protein, 11 aa, Homo Sapiens
EVYQGCGTELR

SEQ ID NO: 58229 - protein, 11 aa, Homo Sapiens
FAITAIKGVGR

SEQ ID NO: 58230 - protein, 11 aa, Homo Sapiens
FTAFEEAQLPR

SEQ ID NO: 58231 - protein, 11 aa, Homo Sapiens
FTASGEAEARR

SEQ ID NO: 58232 - protein, 11 aa, Homo Sapiens
FTNEVLTKTYR

SEQ ID NO: 58233 - protein, 11 aa, Homo Sapiens
FTNSKKSVTLR

SEQ ID NO: 58234 - protein, 11 aa, Homo Sapiens
FVIDSDHLGHR

SEQ ID NO: 58235 - protein, 11 aa, Homo Sapiens
FVWSGTAEARK

SEQ ID NO: 58236 - protein, 11 aa, Homo Sapiens
GFEITPPVVLR

SEQ ID NO: 58237 - protein, 11 aa, Homo Sapiens
GTFGATSLQQR

SEQ ID NO: 58238 - protein, 11 aa, Homo Sapiens
GYEPLPPTIGR

SEQ ID NO: 58239 - protein, 11 aa, Homo Sapiens
HAVDGNTVELK

SEQ ID NO: 58240 - protein, 11 aa, Homo Sapiens
HAVEISAVHSR

SEQ ID NO: 58241 - protein, 11 aa, Homo Sapiens
HAYPDELIRQR

SEQ ID NO: 58242 - protein, 11 aa, Homo Sapiens
HIIEKDKITTR

SEQ ID NO: 58243 - protein, 11 aa, Homo Sapiens
HSIDGRVVEPK

SEQ ID NO: 58244 - protein, 11 aa, Homo Sapiens
HSLSLEAPRLH

SEQ ID NO: 58245 - protein, 11 aa, Homo Sapiens
HTINGHNAEVR

SEQ ID NO: 58246 - protein, 11 aa, Homo Sapiens
HTPTPGIYMGR

SEQ ID NO: 58247 - protein, 11 aa, Homo Sapiens
HTVNMRDPLNR

SEQ ID NO: 58248 - protein, 11 aa, Homo Sapiens
HVAESSLSRLR

SEQ ID NO: 58249 - protein, 11 aa, Homo Sapiens
HVFESNPSIRK

SEQ ID NO: 58250 - protein, 11 aa, Homo Sapiens
HVFPTDENIKR

SEQ ID NO: 58251 - protein, 11 aa, Homo Sapiens
HVKTGGKISLR

SEQ ID NO: 58252 - protein, 11 aa, Homo Sapiens
HVPEGQTIKGR

SEQ ID NO: 58253 - protein, 11 aa, Homo Sapiens
HVPYGVAQTPR

SEQ ID NO: 58254 - protein, 11 aa, Homo Sapiens
HVYVNQGEILR

SEQ ID NO: 58255 - protein, 11 aa, Homo Sapiens
LGPHERSPALR

SEQ ID NO: 58256 - protein, 11 aa, Homo Sapiens
LPAPTSTSTGR

SEQ ID NO: 58257 - protein, 11 aa, Homo Sapiens
LSFETTDESLR

SEQ ID NO: 58258 - protein, 11 aa, Homo Sapiens
LVAEKVVVITK

SEQ ID NO: 58259 - protein, 11 aa, Homo Sapiens
LVFPSEIVGKR

SEQ ID NO: 58260 - protein, 11 aa, Homo Sapiens
MAAAGAAVARS

SEQ ID NO: 58261 - protein, 11 aa, Homo Sapiens
MAISSGAVVHR

SEQ ID NO: 58262 - protein, 11 aa, Homo Sapiens
MTFGIEPFKTK

SEQ ID NO: 58263 - protein, 11 aa, Homo Sapiens
MTFTSQLIVER

SEQ ID NO: 58264 - protein, 11 aa, Homo Sapiens
MTPELAGVIKR

SEQ ID NO: 58265 - protein, 11 aa, Homo Sapiens
MTQDAQNALRR

SEQ ID NO: 58266 - protein, 11 aa, Homo Sapiens
MTVPPPSVSGR

SEQ ID NO: 58267 - protein, 11 aa, Homo Sapiens
NAFGPGTANER

SEQ ID NO: 58268 - protein, 11 aa, Homo Sapiens
NIASPGTVHKR

SEQ ID NO: 58269 - protein, 11 aa, Homo Sapiens
NLAEKSTVHMR

SEQ ID NO: 58270 - protein, 11 aa, Homo Sapiens
NSASATALVSR

SEQ ID NO: 58271 - protein, 11 aa, Homo Sapiens
NSFDPSKITRK

SEQ ID NO: 58272 - protein, 11 aa, Homo Sapiens
NTFEFAKPVQR

SEQ ID NO: 58273 - protein, 11 aa, Homo Sapiens
NTFGKAGIKTK

SEQ ID NO: 58274 - protein, 11 aa, Homo Sapiens
NTIGKEEIQQR

SEQ ID NO: 58275 - protein, 11 aa, Homo Sapiens
NTKSQSAFDLK

SEQ ID NO: 58276 - protein, 11 aa, Homo Sapiens
NTMDADSLVSR

SEQ ID NO: 58277 - protein, 11 aa, Homo Sapiens
NTPSFGSKIIR

SEQ ID NO: 58278 - protein, 11 aa, Homo Sapiens
NTQTEEAIQTR

SEQ ID NO: 58279 - protein, 11 aa, Homo Sapiens
NTVNTSLNVYR

SEQ ID NO: 58280 - protein, 11 aa, Homo Sapiens
NVAACKENFQR

SEQ ID NO: 58281 - protein, 11 aa, Homo Sapiens
NVAALPGIVHR

SEQ ID NO: 58282 - protein, 11 aa, Homo Sapiens
NVAATFKGIVR

SEQ ID NO: 58283 - protein, 11 aa, Homo Sapiens
NVAELKKSFNR

SEQ ID NO: 58284 - protein, 11 aa, Homo Sapiens
NVAEVDKVTGR

SEQ ID NO: 58285 - protein, 11 aa, Homo Sapiens
NVIEPSFGLGR

SEQ ID NO: 58286 - protein, 11 aa, Homo Sapiens
NVIESKAYVGR

SEQ ID NO: 58287 - protein, 11 aa, Homo Sapiens
NVKNVSVKDVR

SEQ ID NO: 58288 - protein, 11 aa, Homo Sapiens
NVPDSFNEVCR

SEQ ID NO: 58289 - protein, 11 aa, Homo Sapiens
NVVDPRTCLNR

SEQ ID NO: 58290 - protein, 11 aa, Homo Sapiens
NVVEYIPNAER

SEQ ID NO: 58291 - protein, 11 aa, Homo Sapiens
NVYPNFRPTPK

SEQ ID NO: 58292 - protein, 11 aa, Homo Sapiens
QAADKIHSSFR

SEQ ID NO: 58293 - protein, 11 aa, Homo Sapiens
QIAEGMAYIER

SEQ ID NO: 58294 - protein, 11 aa, Homo Sapiens
QIFSDLNATYR

SEQ ID NO: 58295 - protein, 11 aa, Homo Sapiens
QLFDPMTGTFR

SEQ ID NO: 58296 - protein, 11 aa, Homo Sapiens
QTVSEPAVIKR

SEQ ID NO: 58297 - protein, 11 aa, Homo Sapiens
QVANSAFVERL

SEQ ID NO: 58298 - protein, 11 aa, Homo Sapiens
QVFKPPPEGTR

SEQ ID NO: 58299 - protein, 11 aa, Homo Sapiens
QVIGPLTEGQR

SEQ ID NO: 58300 - protein, 11 aa, Homo Sapiens
QVIIFVKSVQR

SEQ ID NO: 58301 - protein, 11 aa, Homo Sapiens
QVVGEATFIAR

SEQ ID NO: 58302 - protein, 11 aa, Homo Sapiens
QVVIFVKSVQR

SEQ ID NO: 58303 - protein, 11 aa, Homo Sapiens
RVFPVRPGSGR

SEQ ID NO: 58304 - protein, 11 aa, Homo Sapiens
SAFATPFLVVR

SEQ ID NO: 58305 - protein, 11 aa, Homo Sapiens
SIFEPAKGGEK

SEQ ID NO: 58306 - protein, 11 aa, Homo Sapiens
SIIDMDAVCKR

SEQ ID NO: 58307 - protein, 11 aa, Homo Sapiens
SPIGASGVAHR

SEQ ID NO: 58308 - protein, 11 aa, Homo Sapiens
SSFNSNTFLTR

SEQ ID NO: 58309 - protein, 11 aa, Homo Sapiens
STASVGRFQER

SEQ ID NO: 58310 - protein, 11 aa, Homo Sapiens
STIALALGVER

SEQ ID NO: 58311 - protein, 11 aa, Homo Sapiens
STIDCGLVRLR

SEQ ID NO: 58312 - protein, 11 aa, Homo Sapiens
STIETVPYWTR

SEQ ID NO: 58313 - protein, 11 aa, Homo Sapiens
STIGFKLPNHR

SEQ ID NO: 58314 - protein, 11 aa, Homo Sapiens
STINGYEGTGR

SEQ ID NO: 58315 - protein, 11 aa, Homo Sapiens
STMPHTSGMNR

SEQ ID NO: 58316 - protein, 11 aa, Homo Sapiens
STPAGVQVILR

SEQ ID NO: 58317 - protein, 11 aa, Homo Sapiens
STVGAGAYAYK

SEQ ID NO: 58318 - protein, 11 aa, Homo Sapiens
STYAAFVQTHR

SEQ ID NO: 58319 - protein, 11 aa, Homo Sapiens
STYATTIRDSK

SEQ ID NO: 58320 - protein, 11 aa, Homo Sapiens
SVAGLTAAAYR

SEQ ID NO: 58321 - protein, 11 aa, Homo Sapiens
SVFPQNGAARR

SEQ ID NO: 58322 - protein, 11 aa, Homo Sapiens
SVFTNERFPLR

SEQ ID NO: 58323 - protein, 11 aa, Homo Sapiens
SVISATSSAGR

SEQ ID NO: 58324 - protein, 11 aa, Homo Sapiens
SVISSRNTGQR

SEQ ID NO: 58325 - protein, 11 aa, Homo Sapiens
SVISVEDPPQR

SEQ ID NO: 58326 - protein, 11 aa, Homo Sapiens
SVLEATRVNRR

SEQ ID NO: 58327 - protein, 11 aa, Homo Sapiens
SVPEFPLSPPK

SEQ ID NO: 58328 - protein, 11 aa, Homo Sapiens
SVPSSETVICR

SEQ ID NO: 58329 - protein, 11 aa, Homo Sapiens
SVPWYIDPSKR

SEQ ID NO: 58330 - protein, 11 aa, Homo Sapiens
SVSEVHPSRLQ

SEQ ID NO: 58331 - protein, 11 aa, Homo Sapiens
SVTPEGVIKQR

SEQ ID NO: 58332 - protein, 11 aa, Homo Sapiens
SVYDHQGIFKR

SEQ ID NO: 58333 - protein, 11 aa, Homo Sapiens
SVYSPSGPVNR

SEQ ID NO: 58334 - protein, 11 aa, Homo Sapiens
TAIEAQHLLKR

SEQ ID NO: 58335 - protein, 11 aa, Homo Sapiens
TAIHIDPATHR

SEQ ID NO: 58336 - protein, 11 aa, Homo Sapiens
TAYDPDKKDLR

SEQ ID NO: 58337 - protein, 11 aa, Homo Sapiens
TAYVMKDPETR

SEQ ID NO: 58338 - protein, 11 aa, Homo Sapiens
TELSVRAKPSA

SEQ ID NO: 58339 - protein, 11 aa, Homo Sapiens
TIFSAPNYCYR

SEQ ID NO: 58340 - protein, 11 aa, Homo Sapiens
TIIEVNGKRVR

SEQ ID NO: 58341 - protein, 11 aa, Homo Sapiens
TLIDPETLLPR

SEQ ID NO: 58342 - protein, 11 aa, Homo Sapiens
TPAGVQVILRR

SEQ ID NO: 58343 - protein, 11 aa, Homo Sapiens
TSFDGSLIQKM

SEQ ID NO: 58344 - protein, 11 aa, Homo Sapiens
TSFPSGEATPR

SEQ ID NO: 58345 - protein, 11 aa, Homo Sapiens
TSSEITTKDLK

SEQ ID NO: 58346 - protein, 11 aa, Homo Sapiens
TTAAGPLFQQR

SEQ ID NO: 58347 - protein, 11 aa, Homo Sapiens
TTADGSSILDR

SEQ ID NO: 58348 - protein, 11 aa, Homo Sapiens
TTAGAVTQCYR

SEQ ID NO: 58349 - protein, 11 aa, Homo Sapiens
TTAQEVLARAR

SEQ ID NO: 58350 - protein, 11 aa, Homo Sapiens
TTFTWNINHAR

SEQ ID NO: 58351 - protein, 11 aa, Homo Sapiens
TTHSMALIHNR

SEQ ID NO: 58352 - protein, 11 aa, Homo Sapiens
TTKVTGSLETK

SEQ ID NO: 58353 - protein, 11 aa, Homo Sapiens
TTVAKTVTVTR

SEQ ID NO: 58354 - protein, 11 aa, Homo Sapiens
TTVDESQVVTR

SEQ ID NO: 58355 - protein, 11 aa, Homo Sapiens
TTVNFINQNLR

SEQ ID NO: 58356 - protein, 11 aa, Homo Sapiens
TTVQPSATLQR

SEQ ID NO: 58357 - protein, 11 aa, Homo Sapiens
TTVTPFTAQQR

SEQ ID NO: 58358 - protein, 11 aa, Homo Sapiens
TVAELKQLVAR

SEQ ID NO: 58359 - protein, 11 aa, Homo Sapiens
TVFDAKRLIGR

SEQ ID NO: 58360 - protein, 11 aa, Homo Sapiens
TVFGATGFLGR

SEQ ID NO: 58361 - protein, 11 aa, Homo Sapiens
TVFNAHEPFRR

SEQ ID NO: 58362 - protein, 11 aa, Homo Sapiens
TVIEKTESWPR

SEQ ID NO: 58363 - protein, 11 aa, Homo Sapiens
TVIPATVVTSR

SEQ ID NO: 58364 - protein, 11 aa, Homo Sapiens
TVIQLQNIAEK

SEQ ID NO: 58365 - protein, 11 aa, Homo Sapiens
TVIRNPNGGFR

SEQ ID NO: 58366 - protein, 11 aa, Homo Sapiens
TVISLKKLIVR

SEQ ID NO: 58367 - protein, 11 aa, Homo Sapiens
TVISQEPFVPK

SEQ ID NO: 58368 - protein, 11 aa, Homo Sapiens
TVSPVSGINTR

SEQ ID NO: 58369 - protein, 11 aa, Homo Sapiens
TVVGENGSVLR

SEQ ID NO: 58370 - protein, 11 aa, Homo Sapiens
TVWSAPNYCYR

SEQ ID NO: 58371 - protein, 11 aa, Homo Sapiens
TVYYSPETIGR

SEQ ID NO: 58372 - protein, 11 aa, Homo Sapiens
VTAGGGQILSR

SEQ ID NO: 58373 - protein, 11 aa, Homo Sapiens
VVAPPGVVVSR

SEQ ID NO: 58374 - protein, 11 aa, Homo Sapiens
WTISNITAGNR

SEQ ID NO: 58375 - protein, 8 aa, Homo Sapiens
ALRYPMAV

SEQ ID NO: 58376 - protein, 8 aa, Homo Sapiens
ARLEALKE

SEQ ID NO: 58377 - protein, 8 aa, Homo Sapiens
ASGLIHRV

SEQ ID NO: 58378 - protein, 8 aa, Homo Sapiens
DVSSALDK

SEQ ID NO: 58379 - protein, 8 aa, Homo Sapiens
EAFPVHGF

SEQ ID NO: 58380 - protein, 8 aa, Homo Sapiens
ESPPEINT

SEQ ID NO: 58381 - protein, 8 aa, Homo Sapiens
FSDIPNPI

SEQ ID NO: 58382 - protein, 8 aa, Homo Sapiens
GEVPLTPT

SEQ ID NO: 58383 - protein, 8 aa, Homo Sapiens
GGGRFGGF

SEQ ID NO: 58384 - protein, 8 aa, Homo Sapiens
HFDPTISL

SEQ ID NO: 58385 - protein, 8 aa, Homo Sapiens
KVPQLEIV

SEQ ID NO: 58386 - protein, 8 aa, Homo Sapiens
LAFSRALE

SEQ ID NO: 58387 - protein, 8 aa, Homo Sapiens
LEEYTKKL

SEQ ID NO: 58388 - protein, 8 aa, Homo Sapiens
LLPGELAK

SEQ ID NO: 58389 - protein, 8 aa, Homo Sapiens
LSDYNIQK

SEQ ID NO: 58390 - protein, 8 aa, Homo Sapiens
LSKEMVSL

SEQ ID NO: 58391 - protein, 8 aa, Homo Sapiens
LSLPVPGA

SEQ ID NO: 58392 - protein, 8 aa, Homo Sapiens
LVNLGGSK

SEQ ID NO: 58393 - protein, 8 aa, Homo Sapiens
NHQPFLER

SEQ ID NO: 58394 - protein, 8 aa, Homo Sapiens
NVKVDPEI

SEQ ID NO: 58395 - protein, 8 aa, Homo Sapiens
NVPGEIVE

SEQ ID NO: 58396 - protein, 8 aa, Homo Sapiens
PLGDLTPT

SEQ ID NO: 58397 - protein, 8 aa, Homo Sapiens
QEPVLGPV

SEQ ID NO: 58398 - protein, 8 aa, Homo Sapiens
REYHTEKL

SEQ ID NO: 58399 - protein, 8 aa, Homo Sapiens
RTLYGFGG

SEQ ID NO: 58400 - protein, 8 aa, Homo Sapiens
SPVVRVAV

SEQ ID NO: 58401 - protein, 8 aa, Homo Sapiens
SSSYSKQF

SEQ ID NO: 58402 - protein, 8 aa, Homo Sapiens
SYSVYVYK

SEQ ID NO: 58403 - protein, 8 aa, Homo Sapiens
TEDELQDK

SEQ ID NO: 58404 - protein, 8 aa, Homo Sapiens
TEELAYLK

SEQ ID NO: 58405 - protein, 8 aa, Homo Sapiens
TYFPHFDL

SEQ ID NO: 58406 - protein, 8 aa, Homo Sapiens
VAPVLPGA

SEQ ID NO: 58407 - protein, 8 aa, Homo Sapiens
VDVVAPTV

SEQ ID NO: 58408 - protein, 8 aa, Homo Sapiens
VETLEKNL

SEQ ID NO: 58409 - protein, 8 aa, Homo Sapiens
VHLTPEEK

SEQ ID NO: 58410 - protein, 8 aa, Homo Sapiens
VNDIFERI

SEQ ID NO: 58411 - protein, 8 aa, Homo Sapiens
VPPFLQPE

SEQ ID NO: 58412 - protein, 8 aa, Homo Sapiens
VVVSTPTP

SEQ ID NO: 58413 - protein, 8 aa, Homo Sapiens
VYPFPGPI

SEQ ID NO: 58414 - protein, 8 aa, Homo Sapiens
WPRGLFRL

SEQ ID NO: 58415 - protein, 9 aa, Homo Sapiens
AAAVGAFLI

SEQ ID NO: 58416 - protein, 9 aa, Homo Sapiens
AATEIVERV

SEQ ID NO: 58417 - protein, 9 aa, Homo Sapiens
AIAPIIAAV

SEQ ID NO: 58418 - protein, 9 aa, Homo Sapiens
ATFFLPYLL

SEQ ID NO: 58419 - protein, 9 aa, Homo Sapiens
ATPRYMTYN

SEQ ID NO: 58420 - protein, 9 aa, Homo Sapiens
AVADILFLL

SEQ ID NO: 58421 - protein, 9 aa, Homo Sapiens
AVANIVNSV

SEQ ID NO: 58422 - protein, 9 aa, Homo Sapiens
AVSDILEKL

SEQ ID NO: 58423 - protein, 9 aa, Homo Sapiens
AVSDVIQQL

SEQ ID NO: 58424 - protein, 9 aa, Homo Sapiens
DAAAVNFQL

SEQ ID NO: 58425 - protein, 9 aa, Homo Sapiens
DAANVLLQL

SEQ ID NO: 58426 - protein, 9 aa, Homo Sapiens
DAANVMVYV

SEQ ID NO: 58427 - protein, 9 aa, Homo Sapiens
DAHTVLALI

SEQ ID NO: 58428 - protein, 9 aa, Homo Sapiens
DATNILNKL

SEQ ID NO: 58429 - protein, 9 aa, Homo Sapiens
DIAGFIHKI

SEQ ID NO: 58430 - protein, 9 aa, Homo Sapiens
DIANFQVLV

SEQ ID NO: 58431 - protein, 9 aa, Homo Sapiens
DIATILSKV

SEQ ID NO: 58432 - protein, 9 aa, Homo Sapiens
DIFDAMFSV

SEQ ID NO: 58433 - protein, 9 aa, Homo Sapiens
DIFRYQDEV

SEQ ID NO: 58434 - protein, 9 aa, Homo Sapiens
DIFSDLYYV

SEQ ID NO: 58435 - protein, 9 aa, Homo Sapiens
DIPHMDIEA

SEQ ID NO: 58436 - protein, 9 aa, Homo Sapiens
DISQLFDFI

SEQ ID NO: 58437 - protein, 9 aa, Homo Sapiens
DISSITEAV

SEQ ID NO: 58438 - protein, 9 aa, Homo Sapiens
DLAAVILHV

SEQ ID NO: 58439 - protein, 9 aa, Homo Sapiens
DLAPINAFI

SEQ ID NO: 58440 - protein, 9 aa, Homo Sapiens
DLILPVPAF

SEQ ID NO: 58441 - protein, 9 aa, Homo Sapiens
DLMAPQPGV

SEQ ID NO: 58442 - protein, 9 aa, Homo Sapiens
DLPSFTQNV

SEQ ID NO: 58443 - protein, 9 aa, Homo Sapiens
DLSNIINKL

SEQ ID NO: 58444 - protein, 9 aa, Homo Sapiens
DLTEFQTNL

SEQ ID NO: 58445 - protein, 9 aa, Homo Sapiens
DNAAIIMKV

SEQ ID NO: 58446 - protein, 9 aa, Homo Sapiens
DPAGIFELV

SEQ ID NO: 58447 - protein, 9 aa, Homo Sapiens
DPEPEDENL

SEQ ID NO: 58448 - protein, 9 aa, Homo Sapiens
DQSYVISFV

SEQ ID NO: 58449 - protein, 9 aa, Homo Sapiens
DQTEYLEER

SEQ ID NO: 58450 - protein, 9 aa, Homo Sapiens
DSINFLDHI

SEQ ID NO: 58451 - protein, 9 aa, Homo Sapiens
DSSEEKFLR

SEQ ID NO: 58452 - protein, 9 aa, Homo Sapiens
DSSEIHFKV

SEQ ID NO: 58453 - protein, 9 aa, Homo Sapiens
DSSNVVQLI

SEQ ID NO: 58454 - protein, 9 aa, Homo Sapiens
DSVLIIETV

SEQ ID NO: 58455 - protein, 9 aa, Homo Sapiens
DTAEIIKTL

SEQ ID NO: 58456 - protein, 9 aa, Homo Sapiens
DTAEILSRL

SEQ ID NO: 58457 - protein, 9 aa, Homo Sapiens
DTAHVLFTL

SEQ ID NO: 58458 - protein, 9 aa, Homo Sapiens
DTAPVIIFV

SEQ ID NO: 58459 - protein, 9 aa, Homo Sapiens
DTFFRPLNV

SEQ ID NO: 58460 - protein, 9 aa, Homo Sapiens
DTFGKINFL

SEQ ID NO: 58461 - protein, 9 aa, Homo Sapiens
DTFPTAMHI

SEQ ID NO: 58462 - protein, 9 aa, Homo Sapiens
DTFRGVAFV

SEQ ID NO: 58463 - protein, 9 aa, Homo Sapiens
DTFSGQFVL

SEQ ID NO: 58464 - protein, 9 aa, Homo Sapiens
DTFSVQVLV

SEQ ID NO: 58465 - protein, 9 aa, Homo Sapiens
DTFSYTVRI

SEQ ID NO: 58466 - protein, 9 aa, Homo Sapiens
DTFVHIWKL

SEQ ID NO: 58467 - protein, 9 aa, Homo Sapiens
DTFVHVTDL

SEQ ID NO: 58468 - protein, 9 aa, Homo Sapiens
DTHHLVNYI

SEQ ID NO: 58469 - protein, 9 aa, Homo Sapiens
DTIGVLVRL

SEQ ID NO: 58470 - protein, 9 aa, Homo Sapiens
DTSDIKELI

SEQ ID NO: 58471 - protein, 9 aa, Homo Sapiens
DTSDVVLEL

SEQ ID NO: 58472 - protein, 9 aa, Homo Sapiens
DTSPVFQRL

SEQ ID NO: 58473 - protein, 9 aa, Homo Sapiens
DTSRIYVAL

SEQ ID NO: 58474 - protein, 9 aa, Homo Sapiens
DTSSLFDKL

SEQ ID NO: 58475 - protein, 9 aa, Homo Sapiens
DTTAIDVQV

SEQ ID NO: 58476 - protein, 9 aa, Homo Sapiens
DTTVIIWQV

SEQ ID NO: 58477 - protein, 9 aa, Homo Sapiens
DTVQFAEYI

SEQ ID NO: 58478 - protein, 9 aa, Homo Sapiens
DVAEFLYQV

SEQ ID NO: 58479 - protein, 9 aa, Homo Sapiens
DVAEVLWEI

SEQ ID NO: 58480 - protein, 9 aa, Homo Sapiens
DVANKIGII

SEQ ID NO: 58481 - protein, 9 aa, Homo Sapiens
DVAPFTTKI

SEQ ID NO: 58482 - protein, 9 aa, Homo Sapiens
DVAQIFNNI

SEQ ID NO: 58483 - protein, 9 aa, Homo Sapiens
DVAQIIIRI

SEQ ID NO: 58484 - protein, 9 aa, Homo Sapiens
DVASFATKL

SEQ ID NO: 58485 - protein, 9 aa, Homo Sapiens
DVASIFLQV

SEQ ID NO: 58486 - protein, 9 aa, Homo Sapiens
DVFGHFILI

SEQ ID NO: 58487 - protein, 9 aa, Homo Sapiens
DVFHMVVEV

SEQ ID NO: 58488 - protein, 9 aa, Homo Sapiens
DVFVHQTAI

SEQ ID NO: 58489 - protein, 9 aa, Homo Sapiens
DVGDIVHSV

SEQ ID NO: 58490 - protein, 9 aa, Homo Sapiens
DVIDIMENL

SEQ ID NO: 58491 - protein, 9 aa, Homo Sapiens
DVIEPSEFV

SEQ ID NO: 58492 - protein, 9 aa, Homo Sapiens
DVIEVIEKA

SEQ ID NO: 58493 - protein, 9 aa, Homo Sapiens
DVINVFHHL

SEQ ID NO: 58494 - protein, 9 aa, Homo Sapiens
DVINVFHRL

SEQ ID NO: 58495 - protein, 9 aa, Homo Sapiens
DVIPPLEQL

SEQ ID NO: 58496 - protein, 9 aa, Homo Sapiens
DVIYPMAVV

SEQ ID NO: 58497 - protein, 9 aa, Homo Sapiens
DVSIINITV

SEQ ID NO: 58498 - protein, 9 aa, Homo Sapiens
DVSKIFQVV

SEQ ID NO: 58499 - protein, 9 aa, Homo Sapiens
DVSNVIEKV

SEQ ID NO: 58500 - protein, 9 aa, Homo Sapiens
DVSSALDKL

SEQ ID NO: 58501 - protein, 9 aa, Homo Sapiens
DVSSILTSI

SEQ ID NO: 58502 - protein, 9 aa, Homo Sapiens
DVTAIIFVV

SEQ ID NO: 58503 - protein, 9 aa, Homo Sapiens
DVTDFISHL

SEQ ID NO: 58504 - protein, 9 aa, Homo Sapiens
DVTQIVEIL

SEQ ID NO: 58505 - protein, 9 aa, Homo Sapiens
DVVNILVYV

SEQ ID NO: 58506 - protein, 9 aa, Homo Sapiens
DVVSLFITV

SEQ ID NO: 58507 - protein, 9 aa, Homo Sapiens
DVYDKVDYL

SEQ ID NO: 58508 - protein, 9 aa, Homo Sapiens
EAAAIHVLV

SEQ ID NO: 58509 - protein, 9 aa, Homo Sapiens
EAAALLIRL

SEQ ID NO: 58510 - protein, 9 aa, Homo Sapiens
EAAAVFKTL

SEQ ID NO: 58511 - protein, 9 aa, Homo Sapiens
EAAAVRALV

SEQ ID NO: 58512 - protein, 9 aa, Homo Sapiens
EAACLIVSV

SEQ ID NO: 58513 - protein, 9 aa, Homo Sapiens
EAADIIQKL

SEQ ID NO: 58514 - protein, 9 aa, Homo Sapiens
EAADIVESL

SEQ ID NO: 58515 - protein, 9 aa, Homo Sapiens
EAADLLQFL

SEQ ID NO: 58516 - protein, 9 aa, Homo Sapiens
EAADVLIKA

SEQ ID NO: 58517 - protein, 9 aa, Homo Sapiens
EAADVWYNL

SEQ ID NO: 58518 - protein, 9 aa, Homo Sapiens
EAAEIHLRL

SEQ ID NO: 58519 - protein, 9 aa, Homo Sapiens
EAAEVILRV

SEQ ID NO: 58520 - protein, 9 aa, Homo Sapiens
EAAFILQNL

SEQ ID NO: 58521 - protein, 9 aa, Homo Sapiens
EAAFPIAVV

SEQ ID NO: 58522 - protein, 9 aa, Homo Sapiens
EAAGIDWGI

SEQ ID NO: 58523 - protein, 9 aa, Homo Sapiens
EAAGIMENI

SEQ ID NO: 58524 - protein, 9 aa, Homo Sapiens
EAAMAFAYL

SEQ ID NO: 58525 - protein, 9 aa, Homo Sapiens
EAANFIMKV

SEQ ID NO: 58526 - protein, 9 aa, Homo Sapiens
EAANLFQFL

SEQ ID NO: 58527 - protein, 9 aa, Homo Sapiens
EAAPLLVHV

SEQ ID NO: 58528 - protein, 9 aa, Homo Sapiens
EAAQILRLL

SEQ ID NO: 58529 - protein, 9 aa, Homo Sapiens
EAASLFNRI

SEQ ID NO: 58530 - protein, 9 aa, Homo Sapiens
EAFDRSFEV

SEQ ID NO: 58531 - protein, 9 aa, Homo Sapiens
EAFFVKEYI

SEQ ID NO: 58532 - protein, 9 aa, Homo Sapiens
EAFGQSFSI

SEQ ID NO: 58533 - protein, 9 aa, Homo Sapiens
EAFHYIFNV

SEQ ID NO: 58534 - protein, 9 aa, Homo Sapiens
EAFVHVVTL

SEQ ID NO: 58535 - protein, 9 aa, Homo Sapiens
EAFYNVITV

SEQ ID NO: 58536 - protein, 9 aa, Homo Sapiens
EAFYYIHNL

SEQ ID NO: 58537 - protein, 9 aa, Homo Sapiens
EAIDFIDSI

SEQ ID NO: 58538 - protein, 9 aa, Homo Sapiens
EAIDRIFAI

SEQ ID NO: 58539 - protein, 9 aa, Homo Sapiens
EAIDWLLGL

SEQ ID NO: 58540 - protein, 9 aa, Homo Sapiens
EAIFILARA

SEQ ID NO: 58541 - protein, 9 aa, Homo Sapiens
EAIGFIDWV

SEQ ID NO: 58542 - protein, 9 aa, Homo Sapiens
EAIHNFVEV

SEQ ID NO: 58543 - protein, 9 aa, Homo Sapiens
EAINIIQGI

SEQ ID NO: 58544 - protein, 9 aa, Homo Sapiens
EAIQLIARI

SEQ ID NO: 58545 - protein, 9 aa, Homo Sapiens
EAMAAIFKI

SEQ ID NO: 58546 - protein, 9 aa, Homo Sapiens
EAMELIVKL

SEQ ID NO: 58547 - protein, 9 aa, Homo Sapiens
EAMKQILGV

SEQ ID NO: 58548 - protein, 9 aa, Homo Sapiens
EAMTQIIRV

SEQ ID NO: 58549 - protein, 9 aa, Homo Sapiens
EASAILVHL

SEQ ID NO: 58550 - protein, 9 aa, Homo Sapiens
EASAVIQGL

SEQ ID NO: 58551 - protein, 9 aa, Homo Sapiens
EASDLIIKL

SEQ ID NO: 58552 - protein, 9 aa, Homo Sapiens
EASDLLERL

SEQ ID NO: 58553 - protein, 9 aa, Homo Sapiens
EASEFIVYV

SEQ ID NO: 58554 - protein, 9 aa, Homo Sapiens
EASFVLHTI

SEQ ID NO: 58555 - protein, 9 aa, Homo Sapiens
EASYLITSV

SEQ ID NO: 58556 - protein, 9 aa, Homo Sapiens
EATDIALLL

SEQ ID NO: 58557 - protein, 9 aa, Homo Sapiens
EATKINLSL

SEQ ID NO: 58558 - protein, 9 aa, Homo Sapiens
EATKIWAEL

SEQ ID NO: 58559 - protein, 9 aa, Homo Sapiens
EAVAVIENI

SEQ ID NO: 58560 - protein, 9 aa, Homo Sapiens
EAVDLITRL

SEQ ID NO: 58561 - protein, 9 aa, Homo Sapiens
EAVEVIHKL

SEQ ID NO: 58562 - protein, 9 aa, Homo Sapiens
EAVSVIQSI

SEQ ID NO: 58563 - protein, 9 aa, Homo Sapiens
EGAAVFWNV

SEQ ID NO: 58564 - protein, 9 aa, Homo Sapiens
EGSPIKVTL

SEQ ID NO: 58565 - protein, 9 aa, Homo Sapiens
EGTDILVYV

SEQ ID NO: 58566 - protein, 9 aa, Homo Sapiens
EGVDIILGV

SEQ ID NO: 58567 - protein, 9 aa, Homo Sapiens
EIAAVIETV

SEQ ID NO: 58568 - protein, 9 aa, Homo Sapiens
EIADFFTEL

SEQ ID NO: 58569 - protein, 9 aa, Homo Sapiens
EIADKIYNL

SEQ ID NO: 58570 - protein, 9 aa, Homo Sapiens
EIADLVTSV

SEQ ID NO: 58571 - protein, 9 aa, Homo Sapiens
EIADVFAQI

SEQ ID NO: 58572 - protein, 9 aa, Homo Sapiens
EIAEIKAQL

SEQ ID NO: 58573 - protein, 9 aa, Homo Sapiens
EIAFIPNDV

SEQ ID NO: 58574 - protein, 9 aa, Homo Sapiens
EIANILQEL

SEQ ID NO: 58575 - protein, 9 aa, Homo Sapiens
EIAPINFKV

SEQ ID NO: 58576 - protein, 9 aa, Homo Sapiens
EIAQMMVYV

SEQ ID NO: 58577 - protein, 9 aa, Homo Sapiens
EIAQVVEKV

SEQ ID NO: 58578 - protein, 9 aa, Homo Sapiens
EIASITEQL

SEQ ID NO: 58579 - protein, 9 aa, Homo Sapiens
EIASLDVKI

SEQ ID NO: 58580 - protein, 9 aa, Homo Sapiens
EIAVPVANL

SEQ ID NO: 58581 - protein, 9 aa, Homo Sapiens
EIFDKIHSL

SEQ ID NO: 58582 - protein, 9 aa, Homo Sapiens
EIFPVSFHV

SEQ ID NO: 58583 - protein, 9 aa, Homo Sapiens
EIFRNLASV

SEQ ID NO: 58584 - protein, 9 aa, Homo Sapiens
EIFSKNYRV

SEQ ID NO: 58585 - protein, 9 aa, Homo Sapiens
EIGHILHHV

SEQ ID NO: 58586 - protein, 9 aa, Homo Sapiens
EIIDFFLGA

SEQ ID NO: 58587 - protein, 9 aa, Homo Sapiens
EIIHDLPVL

SEQ ID NO: 58588 - protein, 9 aa, Homo Sapiens
EIIQRIENV

SEQ ID NO: 58589 - protein, 9 aa, Homo Sapiens
EIPEWVHQL

SEQ ID NO: 58590 - protein, 9 aa, Homo Sapiens
EISAFHTLL

SEQ ID NO: 58591 - protein, 9 aa, Homo Sapiens
EISDIGAKI

SEQ ID NO: 58592 - protein, 9 aa, Homo Sapiens
EISDIHTKL

SEQ ID NO: 58593 - protein, 9 aa, Homo Sapiens
EISGIVEVV

SEQ ID NO: 58594 - protein, 9 aa, Homo Sapiens
EISHIVNRI

SEQ ID NO: 58595 - protein, 9 aa, Homo Sapiens
EISHVLNFL

SEQ ID NO: 58596 - protein, 9 aa, Homo Sapiens
EISPLISYA

SEQ ID NO: 58597 - protein, 9 aa, Homo Sapiens
EISRIFHYI

SEQ ID NO: 58598 - protein, 9 aa, Homo Sapiens
EISSIISKM

SEQ ID NO: 58599 - protein, 9 aa, Homo Sapiens
EISSILQEL

SEQ ID NO: 58600 - protein, 9 aa, Homo Sapiens
EISSVPTFL

SEQ ID NO: 58601 - protein, 9 aa, Homo Sapiens
EISTVLQYV

SEQ ID NO: 58602 - protein, 9 aa, Homo Sapiens
EITDINENI

SEQ ID NO: 58603 - protein, 9 aa, Homo Sapiens
EIVDFAKQV

SEQ ID NO: 58604 - protein, 9 aa, Homo Sapiens
EIVNIARQM

SEQ ID NO: 58605 - protein, 9 aa, Homo Sapiens
EIVTIWDSV

SEQ ID NO: 58606 - protein, 9 aa, Homo Sapiens
EIYKEFFEV

SEQ ID NO: 58607 - protein, 9 aa, Homo Sapiens
EIYRYIHYV

SEQ ID NO: 58608 - protein, 9 aa, Homo Sapiens
ELAALFYSV

SEQ ID NO: 58609 - protein, 9 aa, Homo Sapiens
ELAEIVFKV

SEQ ID NO: 58610 - protein, 9 aa, Homo Sapiens
ELAEIYAKL

SEQ ID NO: 58611 - protein, 9 aa, Homo Sapiens
ELAGIVCTL

SEQ ID NO: 58612 - protein, 9 aa, Homo Sapiens
ELANLYHHV

SEQ ID NO: 58613 - protein, 9 aa, Homo Sapiens
ELARVLVTL

SEQ ID NO: 58614 - protein, 9 aa, Homo Sapiens
ELFAVIAHV

SEQ ID NO: 58615 - protein, 9 aa, Homo Sapiens
ELFGKFDQI

SEQ ID NO: 58616 - protein, 9 aa, Homo Sapiens
ELFPLIFPA

SEQ ID NO: 58617 - protein, 9 aa, Homo Sapiens
ELFPQLISV

SEQ ID NO: 58618 - protein, 9 aa, Homo Sapiens
ELFTGFIKV

SEQ ID NO: 58619 - protein, 9 aa, Homo Sapiens
ELGGIIAEV

SEQ ID NO: 58620 - protein, 9 aa, Homo Sapiens
ELHYIPIRV

SEQ ID NO: 58621 - protein, 9 aa, Homo Sapiens
ELHYLEVYL

SEQ ID NO: 58622 - protein, 9 aa, Homo Sapiens
ELMGYIRNV

SEQ ID NO: 58623 - protein, 9 aa, Homo Sapiens
ELMNILNKV

SEQ ID NO: 58624 - protein, 9 aa, Homo Sapiens
ELQGFIARV

SEQ ID NO: 58625 - protein, 9 aa, Homo Sapiens
ELSDVLIYL

SEQ ID NO: 58626 - protein, 9 aa, Homo Sapiens
ELSEISERL

SEQ ID NO: 58627 - protein, 9 aa, Homo Sapiens
ELSFRISEL

SEQ ID NO: 58628 - protein, 9 aa, Homo Sapiens
ELSHVQIPV

SEQ ID NO: 58629 - protein, 9 aa, Homo Sapiens
ELSKIIQKV

SEQ ID NO: 58630 - protein, 9 aa, Homo Sapiens
ELSNVLAAM

SEQ ID NO: 58631 - protein, 9 aa, Homo Sapiens
ELSPIREEL

SEQ ID NO: 58632 - protein, 9 aa, Homo Sapiens
ELSRIVLEV

SEQ ID NO: 58633 - protein, 9 aa, Homo Sapiens
ELTQIIADV

SEQ ID NO: 58634 - protein, 9 aa, Homo Sapiens
ELVNFIERV

SEQ ID NO: 58635 - protein, 9 aa, Homo Sapiens
ELYPYQERV

SEQ ID NO: 58636 - protein, 9 aa, Homo Sapiens
EMVDIIETV

SEQ ID NO: 58637 - protein, 9 aa, Homo Sapiens
ENTDILIYV

SEQ ID NO: 58638 - protein, 9 aa, Homo Sapiens
EQADIFERV

SEQ ID NO: 58639 - protein, 9 aa, Homo Sapiens
EQASILSLV

SEQ ID NO: 58640 - protein, 9 aa, Homo Sapiens
ESAAINQIL

SEQ ID NO: 58641 - protein, 9 aa, Homo Sapiens
ESADLIHWL

SEQ ID NO: 58642 - protein, 9 aa, Homo Sapiens
ESAPIGIRV

SEQ ID NO: 58643 - protein, 9 aa, Homo Sapiens
ESAWVLTNI

SEQ ID NO: 58644 - protein, 9 aa, Homo Sapiens
ESFGFTADL

SEQ ID NO: 58645 - protein, 9 aa, Homo Sapiens
ESFIKAIGV

SEQ ID NO: 58646 - protein, 9 aa, Homo Sapiens
ESFPHQALL

SEQ ID NO: 58647 - protein, 9 aa, Homo Sapiens
ESFSDYPPL

SEQ ID NO: 58648 - protein, 9 aa, Homo Sapiens
ESFYIQTLL

SEQ ID NO: 58649 - protein, 9 aa, Homo Sapiens
ESIDIITRA

SEQ ID NO: 58650 - protein, 9 aa, Homo Sapiens
ESIDRVYSL

SEQ ID NO: 58651 - protein, 9 aa, Homo Sapiens
ESIHVTLNV

SEQ ID NO: 58652 - protein, 9 aa, Homo Sapiens
ESKFFEHFI

SEQ ID NO: 58653 - protein, 9 aa, Homo Sapiens
ESMDILFRI

SEQ ID NO: 58654 - protein, 9 aa, Homo Sapiens
ESSDVIRLI

SEQ ID NO: 58655 - protein, 9 aa, Homo Sapiens
ESSPFVERL

SEQ ID NO: 58656 - protein, 9 aa, Homo Sapiens
ESSYIFVSV

SEQ ID NO: 58657 - protein, 9 aa, Homo Sapiens
ESSYVFLHV

SEQ ID NO: 58658 - protein, 9 aa, Homo Sapiens
ESTAIIAVV

SEQ ID NO: 58659 - protein, 9 aa, Homo Sapiens
ESVSIFSSA

SEQ ID NO: 58660 - protein, 9 aa, Homo Sapiens
ESVSLLWKV

SEQ ID NO: 58661 - protein, 9 aa, Homo Sapiens
ESYHVPELI

SEQ ID NO: 58662 - protein, 9 aa, Homo Sapiens
ETAAFIERL

SEQ ID NO: 58663 - protein, 9 aa, Homo Sapiens
ETAAIFHYL

SEQ ID NO: 58664 - protein, 9 aa, Homo Sapiens
ETADITHAL

SEQ ID NO: 58665 - protein, 9 aa, Homo Sapiens
ETADVIAKV

SEQ ID NO: 58666 - protein, 9 aa, Homo Sapiens
ETAENILGV

SEQ ID NO: 58667 - protein, 9 aa, Homo Sapiens
ETAFIHYRL

SEQ ID NO: 58668 - protein, 9 aa, Homo Sapiens
ETAFVVDEV

SEQ ID NO: 58669 - protein, 9 aa, Homo Sapiens
ETAHFFEEI

SEQ ID NO: 58670 - protein, 9 aa, Homo Sapiens
ETAKLIEKL

SEQ ID NO: 58671 - protein, 9 aa, Homo Sapiens
ETARLTSFI

SEQ ID NO: 58672 - protein, 9 aa, Homo Sapiens
ETASILMHA

SEQ ID NO: 58673 - protein, 9 aa, Homo Sapiens
ETATMHILV

SEQ ID NO: 58674 - protein, 9 aa, Homo Sapiens
ETAYIRVKV

SEQ ID NO: 58675 - protein, 9 aa, Homo Sapiens
ETFAFIQQL

SEQ ID NO: 58676 - protein, 9 aa, Homo Sapiens
ETFAFQAEI

SEQ ID NO: 58677 - protein, 9 aa, Homo Sapiens
ETFDFVHNV

SEQ ID NO: 58678 - protein, 9 aa, Homo Sapiens
ETFFGVQWV

SEQ ID NO: 58679 - protein, 9 aa, Homo Sapiens
ETFGMKLSV

SEQ ID NO: 58680 - protein, 9 aa, Homo Sapiens
ETFGMVVKM

SEQ ID NO: 58681 - protein, 9 aa, Homo Sapiens
ETFHDIAQV

SEQ ID NO: 58682 - protein, 9 aa, Homo Sapiens
ETFISHLEV

SEQ ID NO: 58683 - protein, 9 aa, Homo Sapiens
ETFISLVSI

SEQ ID NO: 58684 - protein, 9 aa, Homo Sapiens
ETFMNRVEV

SEQ ID NO: 58685 - protein, 9 aa, Homo Sapiens
ETFNDFVRL

SEQ ID NO: 58686 - protein, 9 aa, Homo Sapiens
ETFPANIQV

SEQ ID NO: 58687 - protein, 9 aa, Homo Sapiens
ETFPGVTAL

SEQ ID NO: 58688 - protein, 9 aa, Homo Sapiens
ETFQNSVFV

SEQ ID NO: 58689 - protein, 9 aa, Homo Sapiens
ETFSQHTFL

SEQ ID NO: 58690 - protein, 9 aa, Homo Sapiens
ETFSYPDFL

SEQ ID NO: 58691 - protein, 9 aa, Homo Sapiens
ETFVGDYTL

SEQ ID NO: 58692 - protein, 9 aa, Homo Sapiens
ETFVMRLTV

SEQ ID NO: 58693 - protein, 9 aa, Homo Sapiens
ETFVPHVTL

SEQ ID NO: 58694 - protein, 9 aa, Homo Sapiens
ETFYIGKLI

SEQ ID NO: 58695 - protein, 9 aa, Homo Sapiens
ETGAFFFLI

SEQ ID NO: 58696 - protein, 9 aa, Homo Sapiens
ETHFGFETV

SEQ ID NO: 58697 - protein, 9 aa, Homo Sapiens
ETHFLDEEV

SEQ ID NO: 58698 - protein, 9 aa, Homo Sapiens
ETIAIVEHI

SEQ ID NO: 58699 - protein, 9 aa, Homo Sapiens
ETIALLFEL

SEQ ID NO: 58700 - protein, 9 aa, Homo Sapiens
ETIDLLVQI

SEQ ID NO: 58701 - protein, 9 aa, Homo Sapiens
ETIFGEWTV

SEQ ID NO: 58702 - protein, 9 aa, Homo Sapiens
ETIGVVHLV

SEQ ID NO: 58703 - protein, 9 aa, Homo Sapiens
ETILIIRRL

SEQ ID NO: 58704 - protein, 9 aa, Homo Sapiens
ETIRNIPHL

SEQ ID NO: 58705 - protein, 9 aa, Homo Sapiens
ETMQATIHV

SEQ ID NO: 58706 - protein, 9 aa, Homo Sapiens
ETSALKFEI

SEQ ID NO: 58707 - protein, 9 aa, Homo Sapiens
ETSDILQRV

SEQ ID NO: 58708 - protein, 9 aa, Homo Sapiens
ETSPHTFQL

SEQ ID NO: 58709 - protein, 9 aa, Homo Sapiens
ETSPVLQKL

SEQ ID NO: 58710 - protein, 9 aa, Homo Sapiens
ETSSIMQKL

SEQ ID NO: 58711 - protein, 9 aa, Homo Sapiens
ETSSVVRKI

SEQ ID NO: 58712 - protein, 9 aa, Homo Sapiens
ETTDNVFTL

SEQ ID NO: 58713 - protein, 9 aa, Homo Sapiens
ETTPVHPLL

SEQ ID NO: 58714 - protein, 9 aa, Homo Sapiens
ETTSIDVDL

SEQ ID NO: 58715 - protein, 9 aa, Homo Sapiens
ETVDFKAPL

SEQ ID NO: 58716 - protein, 9 aa, Homo Sapiens
ETVDFWLKV

SEQ ID NO: 58717 - protein, 9 aa, Homo Sapiens
ETVDLIKFI

SEQ ID NO: 58718 - protein, 9 aa, Homo Sapiens
ETVEVVNSL

SEQ ID NO: 58719 - protein, 9 aa, Homo Sapiens
ETVGILHKV

SEQ ID NO: 58720 - protein, 9 aa, Homo Sapiens
ETVHLFMEA

SEQ ID NO: 58721 - protein, 9 aa, Homo Sapiens
ETVIIPEQV

SEQ ID NO: 58722 - protein, 9 aa, Homo Sapiens
ETVIPVDVM

SEQ ID NO: 58723 - protein, 9 aa, Homo Sapiens
ETVLIETQL

SEQ ID NO: 58724 - protein, 9 aa, Homo Sapiens
ETVLILEEL

SEQ ID NO: 58725 - protein, 9 aa, Homo Sapiens
ETVLWVVHV

SEQ ID NO: 58726 - protein, 9 aa, Homo Sapiens
ETVNIWSHL

SEQ ID NO: 58727 - protein, 9 aa, Homo Sapiens
ETVPFIKTI

SEQ ID NO: 58728 - protein, 9 aa, Homo Sapiens
ETVVIFYDV

SEQ ID NO: 58729 - protein, 9 aa, Homo Sapiens
ETWIGIYTV

SEQ ID NO: 58730 - protein, 9 aa, Homo Sapiens
ETYLNISQV

SEQ ID NO: 58731 - protein, 9 aa, Homo Sapiens
ETYPDAVKI

SEQ ID NO: 58732 - protein, 9 aa, Homo Sapiens
ETYPDPVRV

SEQ ID NO: 58733 - protein, 9 aa, Homo Sapiens
EVAALIRSL

SEQ ID NO: 58734 - protein, 9 aa, Homo Sapiens
EVADFLIKA

SEQ ID NO: 58735 - protein, 9 aa, Homo Sapiens
EVADLQPQL

SEQ ID NO: 58736 - protein, 9 aa, Homo Sapiens
EVADVGIEV

SEQ ID NO: 58737 - protein, 9 aa, Homo Sapiens
EVAEFVQSL

SEQ ID NO: 58738 - protein, 9 aa, Homo Sapiens
EVAELFQRL

SEQ ID NO: 58739 - protein, 9 aa, Homo Sapiens
EVAEVLQKL

SEQ ID NO: 58740 - protein, 9 aa, Homo Sapiens
EVAGLWIKI

SEQ ID NO: 58741 - protein, 9 aa, Homo Sapiens
EVAGMLIGL

SEQ ID NO: 58742 - protein, 9 aa, Homo Sapiens
EVAKIIYIV

SEQ ID NO: 58743 - protein, 9 aa, Homo Sapiens
EVAKMIQEV

SEQ ID NO: 58744 - protein, 9 aa, Homo Sapiens
EVAKVIVSM

SEQ ID NO: 58745 - protein, 9 aa, Homo Sapiens
EVANAVAFI

SEQ ID NO: 58746 - protein, 9 aa, Homo Sapiens
EVAPISDII

SEQ ID NO: 58747 - protein, 9 aa, Homo Sapiens
EVAPSFGTL

SEQ ID NO: 58748 - protein, 9 aa, Homo Sapiens
EVAQIIRKL

SEQ ID NO: 58749 - protein, 9 aa, Homo Sapiens
EVFALIHEL

SEQ ID NO: 58750 - protein, 9 aa, Homo Sapiens
EVFDEVVQI

SEQ ID NO: 58751 - protein, 9 aa, Homo Sapiens
EVFDKLARV

SEQ ID NO: 58752 - protein, 9 aa, Homo Sapiens
EVFDKTYQF

SEQ ID NO: 58753 - protein, 9 aa, Homo Sapiens
EVFDVIAEI

SEQ ID NO: 58754 - protein, 9 aa, Homo Sapiens
EVFEDAAEI

SEQ ID NO: 58755 - protein, 9 aa, Homo Sapiens
EVFEFRPEL

SEQ ID NO: 58756 - protein, 9 aa, Homo Sapiens
EVFEKATFI

SEQ ID NO: 58757 - protein, 9 aa, Homo Sapiens
EVFEVVERV

SEQ ID NO: 58758 - protein, 9 aa, Homo Sapiens
EVFFETFNV

SEQ ID NO: 58759 - protein, 9 aa, Homo Sapiens
EVFFKEIFL

SEQ ID NO: 58760 - protein, 9 aa, Homo Sapiens
EVFGFISLL

SEQ ID NO: 58761 - protein, 9 aa, Homo Sapiens
EVFGFVQTL

SEQ ID NO: 58762 - protein, 9 aa, Homo Sapiens
EVFGHAIKA

SEQ ID NO: 58763 - protein, 9 aa, Homo Sapiens
EVFGLVQQL

SEQ ID NO: 58764 - protein, 9 aa, Homo Sapiens
EVFHFFNVL

SEQ ID NO: 58765 - protein, 9 aa, Homo Sapiens
EVFHQAFLL

SEQ ID NO: 58766 - protein, 9 aa, Homo Sapiens
EVFHVPLLL

SEQ ID NO: 58767 - protein, 9 aa, Homo Sapiens
EVFIKFIQV

SEQ ID NO: 58768 - protein, 9 aa, Homo Sapiens
EVFLKAFAV

SEQ ID NO: 58769 - protein, 9 aa, Homo Sapiens
EVFNYIHNI

SEQ ID NO: 58770 - protein, 9 aa, Homo Sapiens
EVFPTQHVV

SEQ ID NO: 58771 - protein, 9 aa, Homo Sapiens
EVFQGVEKL

SEQ ID NO: 58772 - protein, 9 aa, Homo Sapiens
EVFRVVDTL

SEQ ID NO: 58773 - protein, 9 aa, Homo Sapiens
EVFSSFAHA

SEQ ID NO: 58774 - protein, 9 aa, Homo Sapiens
EVFSYHQGL

SEQ ID NO: 58775 - protein, 9 aa, Homo Sapiens
EVGGEALGR

SEQ ID NO: 58776 - protein, 9 aa, Homo Sapiens
EVGPKFRGV

SEQ ID NO: 58777 - protein, 9 aa, Homo Sapiens
EVIAEAVGV

SEQ ID NO: 58778 - protein, 9 aa, Homo Sapiens
EVIALLHSL

SEQ ID NO: 58779 - protein, 9 aa, Homo Sapiens
EVIDFSHGL

SEQ ID NO: 58780 - protein, 9 aa, Homo Sapiens
EVIDLKAEI

SEQ ID NO: 58781 - protein, 9 aa, Homo Sapiens
EVIEGYEIA

SEQ ID NO: 58782 - protein, 9 aa, Homo Sapiens
EVIEKFDYV

SEQ ID NO: 58783 - protein, 9 aa, Homo Sapiens
EVIGKITAL

SEQ ID NO: 58784 - protein, 9 aa, Homo Sapiens
EVIKELAQI

SEQ ID NO: 58785 - protein, 9 aa, Homo Sapiens
EVILRVDNI

SEQ ID NO: 58786 - protein, 9 aa, Homo Sapiens
EVINTVAQV

SEQ ID NO: 58787 - protein, 9 aa, Homo Sapiens
EVIPVPIEV

SEQ ID NO: 58788 - protein, 9 aa, Homo Sapiens
EVIRDVINV

SEQ ID NO: 58789 - protein, 9 aa, Homo Sapiens
EVIRYAVQV

SEQ ID NO: 58790 - protein, 9 aa, Homo Sapiens
EVISKLYAV

SEQ ID NO: 58791 - protein, 9 aa, Homo Sapiens
EVISKTPTL

SEQ ID NO: 58792 - protein, 9 aa, Homo Sapiens
EVITKFINV

SEQ ID NO: 58793 - protein, 9 aa, Homo Sapiens
EVIVGTVTL

SEQ ID NO: 58794 - protein, 9 aa, Homo Sapiens
EVIWLTQHV

SEQ ID NO: 58795 - protein, 9 aa, Homo Sapiens
EVLDFITHL

SEQ ID NO: 58796 - protein, 9 aa, Homo Sapiens
EVLGFVAKL

SEQ ID NO: 58797 - protein, 9 aa, Homo Sapiens
EVLHFSVGV

SEQ ID NO: 58798 - protein, 9 aa, Homo Sapiens
EVLKAVTAL

SEQ ID NO: 58799 - protein, 9 aa, Homo Sapiens
EVMEHRFFL

SEQ ID NO: 58800 - protein, 9 aa, Homo Sapiens
EVMEPTWHI

SEQ ID NO: 58801 - protein, 9 aa, Homo Sapiens
EVMEWMNNV

SEQ ID NO: 58802 - protein, 9 aa, Homo Sapiens
EVMKIKAEI

SEQ ID NO: 58803 - protein, 9 aa, Homo Sapiens
EVMKYITSL

SEQ ID NO: 58804 - protein, 9 aa, Homo Sapiens
EVMMLTERV

SEQ ID NO: 58805 - protein, 9 aa, Homo Sapiens
EVMPFIDEI

SEQ ID NO: 58806 - protein, 9 aa, Homo Sapiens
EVMQAVARL

SEQ ID NO: 58807 - protein, 9 aa, Homo Sapiens
EVMQEVAQL

SEQ ID NO: 58808 - protein, 9 aa, Homo Sapiens
EVMQVLSHV

SEQ ID NO: 58809 - protein, 9 aa, Homo Sapiens
EVMSVIAQV

SEQ ID NO: 58810 - protein, 9 aa, Homo Sapiens
EVPFFPARV

SEQ ID NO: 58811 - protein, 9 aa, Homo Sapiens
EVPHFHHEL

SEQ ID NO: 58812 - protein, 9 aa, Homo Sapiens
EVPPPFTLV

SEQ ID NO: 58813 - protein, 9 aa, Homo Sapiens
EVQAILAFL

SEQ ID NO: 58814 - protein, 9 aa, Homo Sapiens
EVRDIKEFL

SEQ ID NO: 58815 - protein, 9 aa, Homo Sapiens
EVSALINKL

SEQ ID NO: 58816 - protein, 9 aa, Homo Sapiens
EVSDLVEMI

SEQ ID NO: 58817 - protein, 9 aa, Homo Sapiens
EVSEIHIKV

SEQ ID NO: 58818 - protein, 9 aa, Homo Sapiens
EVSEIIDGL

SEQ ID NO: 58819 - protein, 9 aa, Homo Sapiens
EVSFINIKT

SEQ ID NO: 58820 - protein, 9 aa, Homo Sapiens
EVSFIVQLV

SEQ ID NO: 58821 - protein, 9 aa, Homo Sapiens
EVSFVIHNL

SEQ ID NO: 58822 - protein, 9 aa, Homo Sapiens
EVSKAIINI

SEQ ID NO: 58823 - protein, 9 aa, Homo Sapiens
EVSQYIYQV

SEQ ID NO: 58824 - protein, 9 aa, Homo Sapiens
EVSRVLEQV

SEQ ID NO: 58825 - protein, 9 aa, Homo Sapiens
EVSSVVQVL

SEQ ID NO: 58826 - protein, 9 aa, Homo Sapiens
EVTEFFVTL

SEQ ID NO: 58827 - protein, 9 aa, Homo Sapiens
EVTLIHSQV

SEQ ID NO: 58828 - protein, 9 aa, Homo Sapiens
EVTNLRAEL

SEQ ID NO: 58829 - protein, 9 aa, Homo Sapiens
EVTNVWINV

SEQ ID NO: 58830 - protein, 9 aa, Homo Sapiens
EVTSINSFL

SEQ ID NO: 58831 - protein, 9 aa, Homo Sapiens
EVTSLKHLL

SEQ ID NO: 58832 - protein, 9 aa, Homo Sapiens
EVTVINERL

SEQ ID NO: 58833 - protein, 9 aa, Homo Sapiens
EVVAVRQEL

SEQ ID NO: 58834 - protein, 9 aa, Homo Sapiens
EVVDIFQVV

SEQ ID NO: 58835 - protein, 9 aa, Homo Sapiens
EVVGLIFRL

SEQ ID NO: 58836 - protein, 9 aa, Homo Sapiens
EVVILDVRV

SEQ ID NO: 58837 - protein, 9 aa, Homo Sapiens
EVVKFVNFL

SEQ ID NO: 58838 - protein, 9 aa, Homo Sapiens
EVVNIVKHL

SEQ ID NO: 58839 - protein, 9 aa, Homo Sapiens
EVVNVWTHL

SEQ ID NO: 58840 - protein, 9 aa, Homo Sapiens
EVYAQVARL

SEQ ID NO: 58841 - protein, 9 aa, Homo Sapiens
EVYEKPVQV

SEQ ID NO: 58842 - protein, 9 aa, Homo Sapiens
EVYPGQQYL

SEQ ID NO: 58843 - protein, 9 aa, Homo Sapiens
FAADIISVL

SEQ ID NO: 58844 - protein, 9 aa, Homo Sapiens
FAAGIIAHL

SEQ ID NO: 58845 - protein, 9 aa, Homo Sapiens
FASGLIHRV

SEQ ID NO: 58846 - protein, 9 aa, Homo Sapiens
FASTILHLV

SEQ ID NO: 58847 - protein, 9 aa, Homo Sapiens
FATEVRAVI

SEQ ID NO: 58848 - protein, 9 aa, Homo Sapiens
FAVTEYPTL

SEQ ID NO: 58849 - protein, 9 aa, Homo Sapiens
FAVYIHALL

SEQ ID NO: 58850 - protein, 9 aa, Homo Sapiens
FFDTASTGK

SEQ ID NO: 58851 - protein, 9 aa, Homo Sapiens
FIAPSGHGL

SEQ ID NO: 58852 - protein, 9 aa, Homo Sapiens
FISGILAAL

SEQ ID NO: 58853 - protein, 9 aa, Homo Sapiens
FLANVSTVL

SEQ ID NO: 58854 - protein, 9 aa, Homo Sapiens
FLVHNVKEL

SEQ ID NO: 58855 - protein, 9 aa, Homo Sapiens
FNFFAPPEV

SEQ ID NO: 58856 - protein, 9 aa, Homo Sapiens
FPVHGFPTL

SEQ ID NO: 58857 - protein, 9 aa, Homo Sapiens
FRVPTANVS

SEQ ID NO: 58858 - protein, 9 aa, Homo Sapiens
FSAEDIAKI

SEQ ID NO: 58859 - protein, 9 aa, Homo Sapiens
FSAEIIYHL

SEQ ID NO: 58860 - protein, 9 aa, Homo Sapiens
FSHAQTVVL

SEQ ID NO: 58861 - protein, 9 aa, Homo Sapiens
FSPFHASVL

SEQ ID NO: 58862 - protein, 9 aa, Homo Sapiens
FSSHILVVV

SEQ ID NO: 58863 - protein, 9 aa, Homo Sapiens
FSTSLVHSI

SEQ ID NO: 58864 - protein, 9 aa, Homo Sapiens
FSTTVIQNV

SEQ ID NO: 58865 - protein, 9 aa, Homo Sapiens
FSVDINNEV

SEQ ID NO: 58866 - protein, 9 aa, Homo Sapiens
FTAAIISRV

SEQ ID NO: 58867 - protein, 9 aa, Homo Sapiens
FTADFVRQL

SEQ ID NO: 58868 - protein, 9 aa, Homo Sapiens
FTADVRSVL

SEQ ID NO: 58869 - protein, 9 aa, Homo Sapiens
FTAGIVEAV

SEQ ID NO: 58870 - protein, 9 aa, Homo Sapiens
FTAKVFAKL

SEQ ID NO: 58871 - protein, 9 aa, Homo Sapiens
FTAKVNIEV

SEQ ID NO: 58872 - protein, 9 aa, Homo Sapiens
FTAKVWDAV

SEQ ID NO: 58873 - protein, 9 aa, Homo Sapiens
FTAVVITGV

SEQ ID NO: 58874 - protein, 9 aa, Homo Sapiens
FTFGIESHI

SEQ ID NO: 58875 - protein, 9 aa, Homo Sapiens
FTFSGICRV

SEQ ID NO: 58876 - protein, 9 aa, Homo Sapiens
FTIDIKSFL

SEQ ID NO: 58877 - protein, 9 aa, Homo Sapiens
FTIFLPASV

SEQ ID NO: 58878 - protein, 9 aa, Homo Sapiens
FTIFRTISV

SEQ ID NO: 58879 - protein, 9 aa, Homo Sapiens
FTSDIALRL

SEQ ID NO: 58880 - protein, 9 aa, Homo Sapiens
FTSQVIRNL

SEQ ID NO: 58881 - protein, 9 aa, Homo Sapiens
FTTDVQLGI

SEQ ID NO: 58882 - protein, 9 aa, Homo Sapiens
FTTHILEVI

SEQ ID NO: 58883 - protein, 9 aa, Homo Sapiens
FTVSLNHKL

SEQ ID NO: 58884 - protein, 9 aa, Homo Sapiens
FTWEGLYNV

SEQ ID NO: 58885 - protein, 9 aa, Homo Sapiens
FVALPGVAV

SEQ ID NO: 58886 - protein, 9 aa, Homo Sapiens
FVAPPTAAV

SEQ ID NO: 58887 - protein, 9 aa, Homo Sapiens
FVASHPWEV

SEQ ID NO: 58888 - protein, 9 aa, Homo Sapiens
FVEWIPNNV

SEQ ID NO: 58889 - protein, 9 aa, Homo Sapiens
FVGYFPATV

SEQ ID NO: 58890 - protein, 9 aa, Homo Sapiens
FVIHNLPVL

SEQ ID NO: 58891 - protein, 9 aa, Homo Sapiens
FVIRNIVEA

SEQ ID NO: 58892 - protein, 9 aa, Homo Sapiens
FVNDIFERI

SEQ ID NO: 58893 - protein, 9 aa, Homo Sapiens
FVNEIISRI

SEQ ID NO: 58894 - protein, 9 aa, Homo Sapiens
FVSGVIVKI

SEQ ID NO: 58895 - protein, 9 aa, Homo Sapiens
FVVKAYLPV

SEQ ID NO: 58896 - protein, 9 aa, Homo Sapiens
GGPGGVGGL

SEQ ID NO: 58897 - protein, 9 aa, Homo Sapiens
GTAAVFNAV

SEQ ID NO: 58898 - protein, 9 aa, Homo Sapiens
GTIGLIHAV

SEQ ID NO: 58899 - protein, 9 aa, Homo Sapiens
GTVFIIQGL

SEQ ID NO: 58900 - protein, 9 aa, Homo Sapiens
GVVDIFQTV

SEQ ID NO: 58901 - protein, 9 aa, Homo Sapiens
HAAGVLLHV

SEQ ID NO: 58902 - protein, 9 aa, Homo Sapiens
HAAHIISEL

SEQ ID NO: 58903 - protein, 9 aa, Homo Sapiens
HAAKVILQV

SEQ ID NO: 58904 - protein, 9 aa, Homo Sapiens
HAANIVTAI

SEQ ID NO: 58905 - protein, 9 aa, Homo Sapiens
HACGVIATI

SEQ ID NO: 58906 - protein, 9 aa, Homo Sapiens
HIADIVHTL

SEQ ID NO: 58907 - protein, 9 aa, Homo Sapiens
HIPNIFQKI

SEQ ID NO: 58908 - protein, 9 aa, Homo Sapiens
HLANIVERV

SEQ ID NO: 58909 - protein, 9 aa, Homo Sapiens
HLGYLPNQL

SEQ ID NO: 58910 - protein, 9 aa, Homo Sapiens
HNAGISFSV

SEQ ID NO: 58911 - protein, 9 aa, Homo Sapiens
HNALESVPL

SEQ ID NO: 58912 - protein, 9 aa, Homo Sapiens
HNIYVDALL

SEQ ID NO: 58913 - protein, 9 aa, Homo Sapiens
HRHPDEAAF

SEQ ID NO: 58914 - protein, 9 aa, Homo Sapiens
HSAEILAEI

SEQ ID NO: 58915 - protein, 9 aa, Homo Sapiens
HSASIPGIL

SEQ ID NO: 58916 - protein, 9 aa, Homo Sapiens
HSIPVTVEV

SEQ ID NO: 58917 - protein, 9 aa, Homo Sapiens
HSVYIPNKV

SEQ ID NO: 58918 - protein, 9 aa, Homo Sapiens
HTAEILDFA

SEQ ID NO: 58919 - protein, 9 aa, Homo Sapiens
HTANIQTLI

SEQ ID NO: 58920 - protein, 9 aa, Homo Sapiens
HTEFIFTTI

SEQ ID NO: 58921 - protein, 9 aa, Homo Sapiens
HTFSGVASV

SEQ ID NO: 58922 - protein, 9 aa, Homo Sapiens
HTFYNELRV

SEQ ID NO: 58923 - protein, 9 aa, Homo Sapiens
HTIDTILTV

SEQ ID NO: 58924 - protein, 9 aa, Homo Sapiens
HTIFPSEYL

SEQ ID NO: 58925 - protein, 9 aa, Homo Sapiens
HTILIVEKV

SEQ ID NO: 58926 - protein, 9 aa, Homo Sapiens
HTISPLDLA

SEQ ID NO: 58927 - protein, 9 aa, Homo Sapiens
HTISVPYSV

SEQ ID NO: 58928 - protein, 9 aa, Homo Sapiens
HTKFVRDMI

SEQ ID NO: 58929 - protein, 9 aa, Homo Sapiens
HTLFVRAMI

SEQ ID NO: 58930 - protein, 9 aa, Homo Sapiens
HTMDPQLRL

SEQ ID NO: 58931 - protein, 9 aa, Homo Sapiens
HTTDFYFNI

SEQ ID NO: 58932 - protein, 9 aa, Homo Sapiens
HTVGFILQL

SEQ ID NO: 58933 - protein, 9 aa, Homo Sapiens
HTVMIQETV

SEQ ID NO: 58934 - protein, 9 aa, Homo Sapiens
HTYHIKNYI

SEQ ID NO: 58935 - protein, 9 aa, Homo Sapiens
HVALVLFEL

SEQ ID NO: 58936 - protein, 9 aa, Homo Sapiens
HVANIVEKL

SEQ ID NO: 58937 - protein, 9 aa, Homo Sapiens
HVAQFQEFL

SEQ ID NO: 58938 - protein, 9 aa, Homo Sapiens
HVGDIIKEV

SEQ ID NO: 58939 - protein, 9 aa, Homo Sapiens
HVIDVQILI

SEQ ID NO: 58940 - protein, 9 aa, Homo Sapiens
HVIRINKML

SEQ ID NO: 58941 - protein, 9 aa, Homo Sapiens
HVSQIFNMI

SEQ ID NO: 58942 - protein, 9 aa, Homo Sapiens
HVTEILADI

SEQ ID NO: 58943 - protein, 9 aa, Homo Sapiens
HVTMVVAEL

SEQ ID NO: 58944 - protein, 9 aa, Homo Sapiens
HVVDFFNRV

SEQ ID NO: 58945 - protein, 9 aa, Homo Sapiens
HVVDVSVAV

SEQ ID NO: 58946 - protein, 9 aa, Homo Sapiens
HVVEILVET

SEQ ID NO: 58947 - protein, 9 aa, Homo Sapiens
HYGPGWVSM

SEQ ID NO: 58948 - protein, 9 aa, Homo Sapiens
IASPVIAAV

SEQ ID NO: 58949 - protein, 9 aa, Homo Sapiens
IDAPGHRDF

SEQ ID NO: 58950 - protein, 9 aa, Homo Sapiens
IDENNSEIL

SEQ ID NO: 58951 - protein, 9 aa, Homo Sapiens
IIAGVIYQA

SEQ ID NO: 58952 - protein, 9 aa, Homo Sapiens
ILASIFETV

SEQ ID NO: 58953 - protein, 9 aa, Homo Sapiens
IPPLTQTPV

SEQ ID NO: 58954 - protein, 9 aa, Homo Sapiens
IQKEDVPSE

SEQ ID NO: 58955 - protein, 9 aa, Homo Sapiens
IRLENEIQT

SEQ ID NO: 58956 - protein, 9 aa, Homo Sapiens
ISYFVAEFI

SEQ ID NO: 58957 - protein, 9 aa, Homo Sapiens
ITAAVIEHL

SEQ ID NO: 58958 - protein, 9 aa, Homo Sapiens
ITAPIEAQV

SEQ ID NO: 58959 - protein, 9 aa, Homo Sapiens
ITAPPTPGI

SEQ ID NO: 58960 - protein, 9 aa, Homo Sapiens
ITAQIFSYL

SEQ ID NO: 58961 - protein, 9 aa, Homo Sapiens
ITFGRMVQV

SEQ ID NO: 58962 - protein, 9 aa, Homo Sapiens
ITIHLPSPV

SEQ ID NO: 58963 - protein, 9 aa, Homo Sapiens
ITSELVSKI

SEQ ID NO: 58964 - protein, 9 aa, Homo Sapiens
ITSSIHFEA

SEQ ID NO: 58965 - protein, 9 aa, Homo Sapiens
ITTDVLYTI

SEQ ID NO: 58966 - protein, 9 aa, Homo Sapiens
ITTEILKSV

SEQ ID NO: 58967 - protein, 9 aa, Homo Sapiens
IVADVQISV

SEQ ID NO: 58968 - protein, 9 aa, Homo Sapiens
IVAEIIKKV

SEQ ID NO: 58969 - protein, 9 aa, Homo Sapiens
IVSDVIRGI

SEQ ID NO: 58970 - protein, 9 aa, Homo Sapiens
IVSPVVAAV

SEQ ID NO: 58971 - protein, 9 aa, Homo Sapiens
IVTEIISEI

SEQ ID NO: 58972 - protein, 9 aa, Homo Sapiens
IWHHTFYNE

SEQ ID NO: 58973 - protein, 9 aa, Homo Sapiens
KTVYFDFQV

SEQ ID NO: 58974 - protein, 9 aa, Homo Sapiens
KVANIIAEV

SEQ ID NO: 58975 - protein, 9 aa, Homo Sapiens
LAAYHPWVV

SEQ ID NO: 58976 - protein, 9 aa, Homo Sapiens
LATDILMGV

SEQ ID NO: 58977 - protein, 9 aa, Homo Sapiens
LESSVIKLE

SEQ ID NO: 58978 - protein, 9 aa, Homo Sapiens
LEVDIDIKI

SEQ ID NO: 58979 - protein, 9 aa, Homo Sapiens
LLPVLESFK

SEQ ID NO: 58980 - protein, 9 aa, Homo Sapiens
LPAKVYVGV

SEQ ID NO: 58981 - protein, 9 aa, Homo Sapiens
LSADIFQQV

SEQ ID NO: 58982 - protein, 9 aa, Homo Sapiens
LSFFVGYGV

SEQ ID NO: 58983 - protein, 9 aa, Homo Sapiens
LSNFIKAMV

SEQ ID NO: 58984 - protein, 9 aa, Homo Sapiens
LSSDVISNI

SEQ ID NO: 58985 - protein, 9 aa, Homo Sapiens
LSSNVILHV

SEQ ID NO: 58986 - protein, 9 aa, Homo Sapiens
LTADINWAV

SEQ ID NO: 58987 - protein, 9 aa, Homo Sapiens
LTAEITSKI

SEQ ID NO: 58988 - protein, 9 aa, Homo Sapiens
LTIFVSAKL

SEQ ID NO: 58989 - protein, 9 aa, Homo Sapiens
LTRTPIVTL

SEQ ID NO: 58990 - protein, 9 aa, Homo Sapiens
LTSDIIESI

SEQ ID NO: 58991 - protein, 9 aa, Homo Sapiens
LTSELITHI

SEQ ID NO: 58992 - protein, 9 aa, Homo Sapiens
LTSGIVIQV

SEQ ID NO: 58993 - protein, 9 aa, Homo Sapiens
LTSNIIAWL

SEQ ID NO: 58994 - protein, 9 aa, Homo Sapiens
LVADLVQEV

SEQ ID NO: 58995 - protein, 9 aa, Homo Sapiens
LVAEIITHL

SEQ ID NO: 58996 - protein, 9 aa, Homo Sapiens
LVANIIQNV

SEQ ID NO: 58997 - protein, 9 aa, Homo Sapiens
LVAQIVTKV

SEQ ID NO: 58998 - protein, 9 aa, Homo Sapiens
LVASVRVPA

SEQ ID NO: 58999 - protein, 9 aa, Homo Sapiens
LVIDVIHEV

SEQ ID NO: 59000 - protein, 9 aa, Homo Sapiens
LVSNVIELL

SEQ ID NO: 59001 - protein, 9 aa, Homo Sapiens
LVSPVVQNI

SEQ ID NO: 59002 - protein, 9 aa, Homo Sapiens
LVSQYFQTV

SEQ ID NO: 59003 - protein, 9 aa, Homo Sapiens
LVSSLFFHV

SEQ ID NO: 59004 - protein, 9 aa, Homo Sapiens
LVVSIIHHV

SEQ ID NO: 59005 - protein, 9 aa, Homo Sapiens
LVYPFPGPI

SEQ ID NO: 59006 - protein, 9 aa, Homo Sapiens
MAAALFVLL

SEQ ID NO: 59007 - protein, 9 aa, Homo Sapiens
MAARIIAKL

SEQ ID NO: 59008 - protein, 9 aa, Homo Sapiens
MIADIHCMI

SEQ ID NO: 59009 - protein, 9 aa, Homo Sapiens
MLAWINESL

SEQ ID NO: 59010 - protein, 9 aa, Homo Sapiens
MLPGILSQL

SEQ ID NO: 59011 - protein, 9 aa, Homo Sapiens
MPADIATLL

SEQ ID NO: 59012 - protein, 9 aa, Homo Sapiens
MPAFIFEHI

SEQ ID NO: 59013 - protein, 9 aa, Homo Sapiens
MSSSVVVRL

SEQ ID NO: 59014 - protein, 9 aa, Homo Sapiens
MSVHLPFAV

SEQ ID NO: 59015 - protein, 9 aa, Homo Sapiens
MSVPLVHQV

SEQ ID NO: 59016 - protein, 9 aa, Homo Sapiens
MSWIPQETL

SEQ ID NO: 59017 - protein, 9 aa, Homo Sapiens
MSYYFLHVV

SEQ ID NO: 59018 - protein, 9 aa, Homo Sapiens
MTAALQAAL

SEQ ID NO: 59019 - protein, 9 aa, Homo Sapiens
MTADLPNEL

SEQ ID NO: 59020 - protein, 9 aa, Homo Sapiens
MTALVNVAL

SEQ ID NO: 59021 - protein, 9 aa, Homo Sapiens
MTMNVIQTV

SEQ ID NO: 59022 - protein, 9 aa, Homo Sapiens
MTPEIIQKL

SEQ ID NO: 59023 - protein, 9 aa, Homo Sapiens
MTQDKVFRL

SEQ ID NO: 59024 - protein, 9 aa, Homo Sapiens
MTSNIVQCL

SEQ ID NO: 59025 - protein, 9 aa, Homo Sapiens
MTSTIGFRV

SEQ ID NO: 59026 - protein, 9 aa, Homo Sapiens
MTTAFIHAL

SEQ ID NO: 59027 - protein, 9 aa, Homo Sapiens
MTTAILERL

SEQ ID NO: 59028 - protein, 9 aa, Homo Sapiens
MTTEILRSM

SEQ ID NO: 59029 - protein, 9 aa, Homo Sapiens
MTTEVLKSL

SEQ ID NO: 59030 - protein, 9 aa, Homo Sapiens
MTTKLISEL

SEQ ID NO: 59031 - protein, 9 aa, Homo Sapiens
MTVAIVKAL

SEQ ID NO: 59032 - protein, 9 aa, Homo Sapiens
MTVQAQPQI

SEQ ID NO: 59033 - protein, 9 aa, Homo Sapiens
MTVQILLKL

SEQ ID NO: 59034 - protein, 9 aa, Homo Sapiens
MVADKFTEL

SEQ ID NO: 59035 - protein, 9 aa, Homo Sapiens
MVAEILHHL

SEQ ID NO: 59036 - protein, 9 aa, Homo Sapiens
MVAHLAINV

SEQ ID NO: 59037 - protein, 9 aa, Homo Sapiens
MVALPMVLV

SEQ ID NO: 59038 - protein, 9 aa, Homo Sapiens
MVAPAVASV

SEQ ID NO: 59039 - protein, 9 aa, Homo Sapiens
MVAPVWYLV

SEQ ID NO: 59040 - protein, 9 aa, Homo Sapiens
MVSSIIEQL

SEQ ID NO: 59041 - protein, 9 aa, Homo Sapiens
MVVDIVQEL

SEQ ID NO: 59042 - protein, 9 aa, Homo Sapiens
MVVGWVKEI

SEQ ID NO: 59043 - protein, 9 aa, Homo Sapiens
NAANIFERL

SEQ ID NO: 59044 - protein, 9 aa, Homo Sapiens
NASPVISSV

SEQ ID NO: 59045 - protein, 9 aa, Homo Sapiens
NIAPIIQKV

SEQ ID NO: 59046 - protein, 9 aa, Homo Sapiens
NIAQVLAEL

SEQ ID NO: 59047 - protein, 9 aa, Homo Sapiens
NIPSFIVRL

SEQ ID NO: 59048 - protein, 9 aa, Homo Sapiens
NISQVIAVV

SEQ ID NO: 59049 - protein, 9 aa, Homo Sapiens
NIVPVIAKA

SEQ ID NO: 59050 - protein, 9 aa, Homo Sapiens
NLQIDPTIQ

SEQ ID NO: 59051 - protein, 9 aa, Homo Sapiens
NNAAIIMKI

SEQ ID NO: 59052 - protein, 9 aa, Homo Sapiens
NSADISITL

SEQ ID NO: 59053 - protein, 9 aa, Homo Sapiens
NSASIFNTL

SEQ ID NO: 59054 - protein, 9 aa, Homo Sapiens
NSSQVVVAV

SEQ ID NO: 59055 - protein, 9 aa, Homo Sapiens
NSVFVATFL

SEQ ID NO: 59056 - protein, 9 aa, Homo Sapiens
NTATIFHEL

SEQ ID NO: 59057 - protein, 9 aa, Homo Sapiens
NTAYIQAIV

SEQ ID NO: 59058 - protein, 9 aa, Homo Sapiens
NTCPYVHNI

SEQ ID NO: 59059 - protein, 9 aa, Homo Sapiens
NTFFVLVRV

SEQ ID NO: 59060 - protein, 9 aa, Homo Sapiens
NTFGAINYV

SEQ ID NO: 59061 - protein, 9 aa, Homo Sapiens
NTIPLFVQL

SEQ ID NO: 59062 - protein, 9 aa, Homo Sapiens
NTQGLIFVV

SEQ ID NO: 59063 - protein, 9 aa, Homo Sapiens
NTSAIVICI

SEQ ID NO: 59064 - protein, 9 aa, Homo Sapiens
NTSHILEAI

SEQ ID NO: 59065 - protein, 9 aa, Homo Sapiens
NTTDIFQTV

SEQ ID NO: 59066 - protein, 9 aa, Homo Sapiens
NTVDFFNQI

SEQ ID NO: 59067 - protein, 9 aa, Homo Sapiens
NVADVVIKF

SEQ ID NO: 59068 - protein, 9 aa, Homo Sapiens
NVAEIVIHI

SEQ ID NO: 59069 - protein, 9 aa, Homo Sapiens
NVAHILQTL

SEQ ID NO: 59070 - protein, 9 aa, Homo Sapiens
NVAKILELV

SEQ ID NO: 59071 - protein, 9 aa, Homo Sapiens
NVALVLERL

SEQ ID NO: 59072 - protein, 9 aa, Homo Sapiens
NVANLPFPL

SEQ ID NO: 59073 - protein, 9 aa, Homo Sapiens
NVAPIINRV

SEQ ID NO: 59074 - protein, 9 aa, Homo Sapiens
NVAPIISKV

SEQ ID NO: 59075 - protein, 9 aa, Homo Sapiens
NVFDEAVRV

SEQ ID NO: 59076 - protein, 9 aa, Homo Sapiens
NVFEGFYGV

SEQ ID NO: 59077 - protein, 9 aa, Homo Sapiens
NVFFKNYEI

SEQ ID NO: 59078 - protein, 9 aa, Homo Sapiens
NVFGHFILI

SEQ ID NO: 59079 - protein, 9 aa, Homo Sapiens
NVFHLVATV

SEQ ID NO: 59080 - protein, 9 aa, Homo Sapiens
NVFPNHISV

SEQ ID NO: 59081 - protein, 9 aa, Homo Sapiens
NVIEWTVGV

SEQ ID NO: 59082 - protein, 9 aa, Homo Sapiens
NVPGEIVES

SEQ ID NO: 59083 - protein, 9 aa, Homo Sapiens
NVSEIIATI

SEQ ID NO: 59084 - protein, 9 aa, Homo Sapiens
NVTSIMFLV

SEQ ID NO: 59085 - protein, 9 aa, Homo Sapiens
NVTWVIVNL

SEQ ID NO: 59086 - protein, 9 aa, Homo Sapiens
NVVDVFHAV

SEQ ID NO: 59087 - protein, 9 aa, Homo Sapiens
NVVGFVMGL

SEQ ID NO: 59088 - protein, 9 aa, Homo Sapiens
PGHLQEGFG

SEQ ID NO: 59089 - protein, 9 aa, Homo Sapiens
PSVEVDVKA

SEQ ID NO: 59090 - protein, 9 aa, Homo Sapiens
QAADVLELL

SEQ ID NO: 59091 - protein, 9 aa, Homo Sapiens
QIADIVTSV

SEQ ID NO: 59092 - protein, 9 aa, Homo Sapiens
QLDDLKVEL

SEQ ID NO: 59093 - protein, 9 aa, Homo Sapiens
QLVDIIEKV

SEQ ID NO: 59094 - protein, 9 aa, Homo Sapiens
QPEFHIEIL

SEQ ID NO: 59095 - protein, 9 aa, Homo Sapiens
QPHQPLPPT

SEQ ID NO: 59096 - protein, 9 aa, Homo Sapiens
QSAEIWEKL

SEQ ID NO: 59097 - protein, 9 aa, Homo Sapiens
QSANIIELL

SEQ ID NO: 59098 - protein, 9 aa, Homo Sapiens
QSIYIPRGV

SEQ ID NO: 59099 - protein, 9 aa, Homo Sapiens
QSVDLVFPV

SEQ ID NO: 59100 - protein, 9 aa, Homo Sapiens
QTAEIFQAL

SEQ ID NO: 59101 - protein, 9 aa, Homo Sapiens
QTEDELQDK

SEQ ID NO: 59102 - protein, 9 aa, Homo Sapiens
QTHGFIIRV

SEQ ID NO: 59103 - protein, 9 aa, Homo Sapiens
QTHSVFVNV

SEQ ID NO: 59104 - protein, 9 aa, Homo Sapiens
QTIALITYL

SEQ ID NO: 59105 - protein, 9 aa, Homo Sapiens
QTISLLAHL

SEQ ID NO: 59106 - protein, 9 aa, Homo Sapiens
QTSDITEYL

SEQ ID NO: 59107 - protein, 9 aa, Homo Sapiens
QTSQLIIQL

SEQ ID NO: 59108 - protein, 9 aa, Homo Sapiens
QTVDIPENV

SEQ ID NO: 59109 - protein, 9 aa, Homo Sapiens
QTVDIRAQL

SEQ ID NO: 59110 - protein, 9 aa, Homo Sapiens
QTVGVIVRL

SEQ ID NO: 59111 - protein, 9 aa, Homo Sapiens
QTVNVLAQI

SEQ ID NO: 59112 - protein, 9 aa, Homo Sapiens
QTYFFPIHL

SEQ ID NO: 59113 - protein, 9 aa, Homo Sapiens
QVAEIVATL

SEQ ID NO: 59114 - protein, 9 aa, Homo Sapiens
QVANVRFNV

SEQ ID NO: 59115 - protein, 9 aa, Homo Sapiens
QVFDYVTGV

SEQ ID NO: 59116 - protein, 9 aa, Homo Sapiens
QVSQICIQV

SEQ ID NO: 59117 - protein, 9 aa, Homo Sapiens
QVTDIVVLV

SEQ ID NO: 59118 - protein, 9 aa, Homo Sapiens
QVTQIRIMV

SEQ ID NO: 59119 - protein, 9 aa, Homo Sapiens
RTTDIVIRI

SEQ ID NO: 59120 - protein, 9 aa, Homo Sapiens
RVADVIAQV

SEQ ID NO: 59121 - protein, 9 aa, Homo Sapiens
SAADIPINI

SEQ ID NO: 59122 - protein, 9 aa, Homo Sapiens
SAADLQFAL

SEQ ID NO: 59123 - protein, 9 aa, Homo Sapiens
SAAFIFSYI

SEQ ID NO: 59124 - protein, 9 aa, Homo Sapiens
SAAFIISYV

SEQ ID NO: 59125 - protein, 9 aa, Homo Sapiens
SAAFVIAYI

SEQ ID NO: 59126 - protein, 9 aa, Homo Sapiens
SAAGVLIKL

SEQ ID NO: 59127 - protein, 9 aa, Homo Sapiens
SAFGQIYKV

SEQ ID NO: 59128 - protein, 9 aa, Homo Sapiens
SASKIIVFV

SEQ ID NO: 59129 - protein, 9 aa, Homo Sapiens
SASPIFTHV

SEQ ID NO: 59130 - protein, 9 aa, Homo Sapiens
SDYPPLGRF

SEQ ID NO: 59131 - protein, 9 aa, Homo Sapiens
SELQVPLFI

SEQ ID NO: 59132 - protein, 9 aa, Homo Sapiens
SFVNDIFER

SEQ ID NO: 59133 - protein, 9 aa, Homo Sapiens
SIAEVVHQL

SEQ ID NO: 59134 - protein, 9 aa, Homo Sapiens
SIAGIFKEV

SEQ ID NO: 59135 - protein, 9 aa, Homo Sapiens
SIAPIVIFA

SEQ ID NO: 59136 - protein, 9 aa, Homo Sapiens
SIIAEVKAQ

SEQ ID NO: 59137 - protein, 9 aa, Homo Sapiens
SIIGRLLEV

SEQ ID NO: 59138 - protein, 9 aa, Homo Sapiens
SISDVIAQV

SEQ ID NO: 59139 - protein, 9 aa, Homo Sapiens
SLAAVVLGL

SEQ ID NO: 59140 - protein, 9 aa, Homo Sapiens
SLAPIIVHV

SEQ ID NO: 59141 - protein, 9 aa, Homo Sapiens
SLMTSLDIL

SEQ ID NO: 59142 - protein, 9 aa, Homo Sapiens
SLPDIKVYL

SEQ ID NO: 59143 - protein, 9 aa, Homo Sapiens
SLPQNIPPL

SEQ ID NO: 59144 - protein, 9 aa, Homo Sapiens
SLSAIFNNV

SEQ ID NO: 59145 - protein, 9 aa, Homo Sapiens
SNSDVIIYV

SEQ ID NO: 59146 - protein, 9 aa, Homo Sapiens
SSHFVPVFV

SEQ ID NO: 59147 - protein, 9 aa, Homo Sapiens
STASILASV

SEQ ID NO: 59148 - protein, 9 aa, Homo Sapiens
STFFQETNI

SEQ ID NO: 59149 - protein, 9 aa, Homo Sapiens
STFGYVHGV

SEQ ID NO: 59150 - protein, 9 aa, Homo Sapiens
STIAILNSV

SEQ ID NO: 59151 - protein, 9 aa, Homo Sapiens
STIALALGV

SEQ ID NO: 59152 - protein, 9 aa, Homo Sapiens
STIFPLDGV

SEQ ID NO: 59153 - protein, 9 aa, Homo Sapiens
STLFLPHYA

SEQ ID NO: 59154 - protein, 9 aa, Homo Sapiens
STPNFVVEV

SEQ ID NO: 59155 - protein, 9 aa, Homo Sapiens
STSDIITRI

SEQ ID NO: 59156 - protein, 9 aa, Homo Sapiens
STSSVFRLV

SEQ ID NO: 59157 - protein, 9 aa, Homo Sapiens
STVEVIFHV

SEQ ID NO: 59158 - protein, 9 aa, Homo Sapiens
STVHFIIFV

SEQ ID NO: 59159 - protein, 9 aa, Homo Sapiens
STVSIQIKL

SEQ ID NO: 59160 - protein, 9 aa, Homo Sapiens
SVAEINVLI

SEQ ID NO: 59161 - protein, 9 aa, Homo Sapiens
SVALVIHNV

SEQ ID NO: 59162 - protein, 9 aa, Homo Sapiens
SVAQVKAMI

SEQ ID NO: 59163 - protein, 9 aa, Homo Sapiens
SVEDIFSEV

SEQ ID NO: 59164 - protein, 9 aa, Homo Sapiens
SVFGFSFKL

SEQ ID NO: 59165 - protein, 9 aa, Homo Sapiens
SVFTFVAEV

SEQ ID NO: 59166 - protein, 9 aa, Homo Sapiens
SVGEIITNI

SEQ ID NO: 59167 - protein, 9 aa, Homo Sapiens
SVIEQIVYV

SEQ ID NO: 59168 - protein, 9 aa, Homo Sapiens
SVITQVFHV

SEQ ID NO: 59169 - protein, 9 aa, Homo Sapiens
SVPQIHVNL

SEQ ID NO: 59170 - protein, 9 aa, Homo Sapiens
SVSSVVHYL

SEQ ID NO: 59171 - protein, 9 aa, Homo Sapiens
SVTDLAFKV

SEQ ID NO: 59172 - protein, 9 aa, Homo Sapiens
SVTDTNVIL

SEQ ID NO: 59173 - protein, 9 aa, Homo Sapiens
SVTFVAEQV

SEQ ID NO: 59174 - protein, 9 aa, Homo Sapiens
SVTQIYHAV

SEQ ID NO: 59175 - protein, 9 aa, Homo Sapiens
SVTSIIFLV

SEQ ID NO: 59176 - protein, 9 aa, Homo Sapiens
SVTSILKTL

SEQ ID NO: 59177 - protein, 9 aa, Homo Sapiens
SVTSTFSKL

SEQ ID NO: 59178 - protein, 9 aa, Homo Sapiens
SVVADTPEL

SEQ ID NO: 59179 - protein, 9 aa, Homo Sapiens
SVVDVFAQL

SEQ ID NO: 59180 - protein, 9 aa, Homo Sapiens
TASKVIVAV

SEQ ID NO: 59181 - protein, 9 aa, Homo Sapiens
TASPVIKAV

SEQ ID NO: 59182 - protein, 9 aa, Homo Sapiens
TATDIRVTL

SEQ ID NO: 59183 - protein, 9 aa, Homo Sapiens
TATEIAINV

SEQ ID NO: 59184 - protein, 9 aa, Homo Sapiens
TIAQVLVHL

SEQ ID NO: 59185 - protein, 9 aa, Homo Sapiens
TISHVIIGL

SEQ ID NO: 59186 - protein, 9 aa, Homo Sapiens
TITDIISAL

SEQ ID NO: 59187 - protein, 9 aa, Homo Sapiens
TLADLVHHV

SEQ ID NO: 59188 - protein, 9 aa, Homo Sapiens
TLADVLYHV

SEQ ID NO: 59189 - protein, 9 aa, Homo Sapiens
TLASIIKEV

SEQ ID NO: 59190 - protein, 9 aa, Homo Sapiens
TLPYIKQEV

SEQ ID NO: 59191 - protein, 9 aa, Homo Sapiens
TLSDIKALI

SEQ ID NO: 59192 - protein, 9 aa, Homo Sapiens
TNADIIETL

SEQ ID NO: 59193 - protein, 9 aa, Homo Sapiens
TQTPVVVPP

SEQ ID NO: 59194 - protein, 9 aa, Homo Sapiens
TRIPKIQKL

SEQ ID NO: 59195 - protein, 9 aa, Homo Sapiens
TSAAIYHVL

SEQ ID NO: 59196 - protein, 9 aa, Homo Sapiens
TSATIVYHL

SEQ ID NO: 59197 - protein, 9 aa, Homo Sapiens
TSSGVVWEV

SEQ ID NO: 59198 - protein, 9 aa, Homo Sapiens
TTAAFIRVV

SEQ ID NO: 59199 - protein, 9 aa, Homo Sapiens
TTAGILATL

SEQ ID NO: 59200 - protein, 9 aa, Homo Sapiens
TTALAIYHV

SEQ ID NO: 59201 - protein, 9 aa, Homo Sapiens
TTARAFAVV

SEQ ID NO: 59202 - protein, 9 aa, Homo Sapiens
TTFDKEFLL

SEQ ID NO: 59203 - protein, 9 aa, Homo Sapiens
TTFPRPVTV

SEQ ID NO: 59204 - protein, 9 aa, Homo Sapiens
TTIDLVAFL

SEQ ID NO: 59205 - protein, 9 aa, Homo Sapiens
TTKFIKSFL

SEQ ID NO: 59206 - protein, 9 aa, Homo Sapiens
TTSPITYTL

SEQ ID NO: 59207 - protein, 9 aa, Homo Sapiens
TTSVIKIAV

SEQ ID NO: 59208 - protein, 9 aa, Homo Sapiens
TTVDINTQV

SEQ ID NO: 59209 - protein, 9 aa, Homo Sapiens
TTVDLSVHV

SEQ ID NO: 59210 - protein, 9 aa, Homo Sapiens
TTVEIFNKL

SEQ ID NO: 59211 - protein, 9 aa, Homo Sapiens
TTYYIHQLL

SEQ ID NO: 59212 - protein, 9 aa, Homo Sapiens
TVAAILLGL

SEQ ID NO: 59213 - protein, 9 aa, Homo Sapiens
TVADFFIKA

SEQ ID NO: 59214 - protein, 9 aa, Homo Sapiens
TVADMLHVV

SEQ ID NO: 59215 - protein, 9 aa, Homo Sapiens
TVAEISQFL

SEQ ID NO: 59216 - protein, 9 aa, Homo Sapiens
TVAELFTRI

SEQ ID NO: 59217 - protein, 9 aa, Homo Sapiens
TVANIPEKI

SEQ ID NO: 59218 - protein, 9 aa, Homo Sapiens
TVAQIKATV

SEQ ID NO: 59219 - protein, 9 aa, Homo Sapiens
TVDMESTEV

SEQ ID NO: 59220 - protein, 9 aa, Homo Sapiens
TVDQIRAIM

SEQ ID NO: 59221 - protein, 9 aa, Homo Sapiens
TVFEGRIYV

SEQ ID NO: 59222 - protein, 9 aa, Homo Sapiens
TVFEHTFHV

SEQ ID NO: 59223 - protein, 9 aa, Homo Sapiens
TVIRPFPGL

SEQ ID NO: 59224 - protein, 9 aa, Homo Sapiens
TVMGKIFAV

SEQ ID NO: 59225 - protein, 9 aa, Homo Sapiens
TVPELTQQV

SEQ ID NO: 59226 - protein, 9 aa, Homo Sapiens
TVSDVLNSV

SEQ ID NO: 59227 - protein, 9 aa, Homo Sapiens
TVSEVIQGL

SEQ ID NO: 59228 - protein, 9 aa, Homo Sapiens
TVTDVVRFI

SEQ ID NO: 59229 - protein, 9 aa, Homo Sapiens
TVTSVLEYL

SEQ ID NO: 59230 - protein, 9 aa, Homo Sapiens
TVTTVILEV

SEQ ID NO: 59231 - protein, 9 aa, Homo Sapiens
TVVDLHFPL

SEQ ID NO: 59232 - protein, 9 aa, Homo Sapiens
TVVEIILQA

SEQ ID NO: 59233 - protein, 9 aa, Homo Sapiens
TVVNFLIRV

SEQ ID NO: 59234 - protein, 9 aa, Homo Sapiens
VDAVKGEIL

SEQ ID NO: 59235 - protein, 9 aa, Homo Sapiens
VDGEIILHL

SEQ ID NO: 59236 - protein, 9 aa, Homo Sapiens
VEELKPTPE

SEQ ID NO: 59237 - protein, 9 aa, Homo Sapiens
VETGVLKPG

SEQ ID NO: 59238 - protein, 9 aa, Homo Sapiens
VGGSTRIPK

SEQ ID NO: 59239 - protein, 9 aa, Homo Sapiens
VMAPRTLVL

SEQ ID NO: 59240 - protein, 9 aa, Homo Sapiens
VNFTVDQIR

SEQ ID NO: 59241 - protein, 9 aa, Homo Sapiens
VPPFLQPEV

SEQ ID NO: 59242 - protein, 9 aa, Homo Sapiens
VPQLEIVPN

SEQ ID NO: 59243 - protein, 9 aa, Homo Sapiens
VPVHFDASV

SEQ ID NO: 59244 - protein, 9 aa, Homo Sapiens
VSSDIIEAV

SEQ ID NO: 59245 - protein, 9 aa, Homo Sapiens
VTTDIQVKV

SEQ ID NO: 59246 - protein, 9 aa, Homo Sapiens
VTVPVEILS

SEQ ID NO: 59247 - protein, 9 aa, Homo Sapiens
VVPPFLQPE

SEQ ID NO: 59248 - protein, 9 aa, Homo Sapiens
VVPTSQVVT

SEQ ID NO: 59249 - protein, 9 aa, Homo Sapiens
VVTFAPVNV

SEQ ID NO: 59250 - protein, 9 aa, Homo Sapiens
WTSAITVAI

SEQ ID NO: 59251 - protein, 9 aa, Homo Sapiens
WVTEIFSQI

SEQ ID NO: 59252 - protein, 9 aa, Homo Sapiens
YAAELIERV

SEQ ID NO: 59253 - protein, 9 aa, Homo Sapiens
YAARIWDGV

SEQ ID NO: 59254 - protein, 9 aa, Homo Sapiens
YAFNMKATV

SEQ ID NO: 59255 - protein, 9 aa, Homo Sapiens
YAFPKAVSV

SEQ ID NO: 59256 - protein, 9 aa, Homo Sapiens
YASGINVNL

SEQ ID NO: 59257 - protein, 9 aa, Homo Sapiens
YLADIFTKL

SEQ ID NO: 59258 - protein, 9 aa, Homo Sapiens
YLADLYHFV

SEQ ID NO: 59259 - protein, 9 aa, Homo Sapiens
YPASIVHQV

SEQ ID NO: 59260 - protein, 9 aa, Homo Sapiens
YPFPGPIPN

SEQ ID NO: 59261 - protein, 9 aa, Homo Sapiens
YPVEIHEYL

SEQ ID NO: 59262 - protein, 9 aa, Homo Sapiens
YQEPVLGPV

SEQ ID NO: 59263 - protein, 9 aa, Homo Sapiens
YSAPVIHVL

SEQ ID NO: 59264 - protein, 9 aa, Homo Sapiens
YSFHKFHYL

SEQ ID NO: 59265 - protein, 9 aa, Homo Sapiens
YSFTTTAER

SEQ ID NO: 59266 - protein, 9 aa, Homo Sapiens
YSFYLPIAA

SEQ ID NO: 59267 - protein, 9 aa, Homo Sapiens
YSIDLSERV

SEQ ID NO: 59268 - protein, 9 aa, Homo Sapiens
YSKEGWEYV

SEQ ID NO: 59269 - protein, 9 aa, Homo Sapiens
YTAEIKQNL

SEQ ID NO: 59270 - protein, 9 aa, Homo Sapiens
YTFDMVFGA

SEQ ID NO: 59271 - protein, 9 aa, Homo Sapiens
YTFFTPNNI

SEQ ID NO: 59272 - protein, 9 aa, Homo Sapiens
YTFSEPFHL

SEQ ID NO: 59273 - protein, 9 aa, Homo Sapiens
YTGIVNIGV

SEQ ID NO: 59274 - protein, 9 aa, Homo Sapiens
YTIPPGHQV

SEQ ID NO: 59275 - protein, 9 aa, Homo Sapiens
YTLFMIDGY

SEQ ID NO: 59276 - protein, 9 aa, Homo Sapiens
YTLVTYVPV

SEQ ID NO: 59277 - protein, 9 aa, Homo Sapiens
YTSDLHFQV

SEQ ID NO: 59278 - protein, 9 aa, Homo Sapiens
YTSEVQAIL

SEQ ID NO: 59279 - protein, 9 aa, Homo Sapiens
YTSHLHVSL

SEQ ID NO: 59280 - protein, 9 aa, Homo Sapiens
YTSHLRSLV

SEQ ID NO: 59281 - protein, 9 aa, Homo Sapiens
YTSNIPIIL

SEQ ID NO: 59282 - protein, 9 aa, Homo Sapiens
YTSRIVVRL

SEQ ID NO: 59283 - protein, 9 aa, Homo Sapiens
YTTDFIYQL

SEQ ID NO: 59284 - protein, 9 aa, Homo Sapiens
YTTNVLQLL

SEQ ID NO: 59285 - protein, 9 aa, Homo Sapiens
YTVQFTTMV

SEQ ID NO: 59286 - protein, 9 aa, Homo Sapiens
YTYYYPHYL

SEQ ID NO: 59287 - protein, 9 aa, Homo Sapiens
YVNDIVIGI

SEQ ID NO: 59288 - protein, 9 aa, Homo Sapiens
YVNLPTIAL

SEQ ID NO: 59289 - protein, 9 aa, Homo Sapiens
YVPPPFAAA

SEQ ID NO: 59290 - protein, 9 aa, Homo Sapiens
YVSDILNYI

SEQ ID NO: 59291 - protein, 9 aa, Homo Sapiens
YVSEILEKV

SEQ ID NO: 59292 - protein, 9 aa, Homo Sapiens
YVSSIVVSL

SEQ ID NO: 59293 - protein, 9 aa, Homo Sapiens
YVTDVLYRV

SEQ ID NO: 59294 - protein, 9 aa, Homo Sapiens
YVTSILQSL

SEQ ID NO: 59295 - protein, 9 aa, Homo Sapiens
YVTSVILHI

SEQ ID NO: 59296 - protein, 9 aa, Homo Sapiens
YVVPFVAKV

SEQ ID NO: 59297 - protein, 9 aa, Homo Sapiens
YVVSVIEQI

SEQ ID NO: 59298 - protein, 10 aa, Homo Sapiens
AALRPLVKPK

SEQ ID NO: 59299 - protein, 10 aa, Homo Sapiens
ALFPHLLQPV

SEQ ID NO: 59300 - protein, 10 aa, Homo Sapiens
APGNLSLPIP

SEQ ID NO: 59301 - protein, 10 aa, Homo Sapiens
APVNVTTEVK

SEQ ID NO: 59302 - protein, 10 aa, Homo Sapiens
ASLDKFLANV

SEQ ID NO: 59303 - protein, 10 aa, Homo Sapiens
ATVYVDVLKD

SEQ ID NO: 59304 - protein, 10 aa, Homo Sapiens
DAVGQISVHV

SEQ ID NO: 59305 - protein, 10 aa, Homo Sapiens
DESGPSIVHR

SEQ ID NO: 59306 - protein, 10 aa, Homo Sapiens
DIGSESTEDQ

SEQ ID NO: 59307 - protein, 10 aa, Homo Sapiens
DIISQVDAKV

SEQ ID NO: 59308 - protein, 10 aa, Homo Sapiens
DIVNFVHTNL

SEQ ID NO: 59309 - protein, 10 aa, Homo Sapiens
DKTLEQQENF

SEQ ID NO: 59310 - protein, 10 aa, Homo Sapiens
DKVIPLAIPQ

SEQ ID NO: 59311 - protein, 10 aa, Homo Sapiens
DLRGENPTLF

SEQ ID NO: 59312 - protein, 10 aa, Homo Sapiens
DLSAPQIGVV

SEQ ID NO: 59313 - protein, 10 aa, Homo Sapiens
DSSHVSLVQL

SEQ ID NO: 59314 - protein, 10 aa, Homo Sapiens
DTANDGFVRL

SEQ ID NO: 59315 - protein, 10 aa, Homo Sapiens
DTAQIFRVNL

SEQ ID NO: 59316 - protein, 10 aa, Homo Sapiens
DTATAHSWFV

SEQ ID NO: 59317 - protein, 10 aa, Homo Sapiens
DTAWISSILL

SEQ ID NO: 59318 - protein, 10 aa, Homo Sapiens
DTIAGLSVHV

SEQ ID NO: 59319 - protein, 10 aa, Homo Sapiens
DTIPVVHASI

SEQ ID NO: 59320 - protein, 10 aa, Homo Sapiens
DTITPQQVFV

SEQ ID NO: 59321 - protein, 10 aa, Homo Sapiens
DTSNIITVRV

SEQ ID NO: 59322 - protein, 10 aa, Homo Sapiens
DTYGFPVDLT

SEQ ID NO: 59323 - protein, 10 aa, Homo Sapiens
DVAAVVVPIL

SEQ ID NO: 59324 - protein, 10 aa, Homo Sapiens
DVAPISDIIA

SEQ ID NO: 59325 - protein, 10 aa, Homo Sapiens
DVAQIFNNIL

SEQ ID NO: 59326 - protein, 10 aa, Homo Sapiens
DVATITKTVV

SEQ ID NO: 59327 - protein, 10 aa, Homo Sapiens
DVQIGDIVTV

SEQ ID NO: 59328 - protein, 10 aa, Homo Sapiens
DVTDFISHLF

SEQ ID NO: 59329 - protein, 10 aa, Homo Sapiens
DVVGITYDHV

SEQ ID NO: 59330 - protein, 10 aa, Homo Sapiens
EAAFFEGHFL

SEQ ID NO: 59331 - protein, 10 aa, Homo Sapiens
EAFHVFKVFV

SEQ ID NO: 59332 - protein, 10 aa, Homo Sapiens
EAFQGTKVFV

SEQ ID NO: 59333 - protein, 10 aa, Homo Sapiens
EAFVWEPAMV

SEQ ID NO: 59334 - protein, 10 aa, Homo Sapiens
EAIGVIFTHV

SEQ ID NO: 59335 - protein, 10 aa, Homo Sapiens
EASDVVLEVL

SEQ ID NO: 59336 - protein, 10 aa, Homo Sapiens
EASHLVTDRI

SEQ ID NO: 59337 - protein, 10 aa, Homo Sapiens
EASYVNLPTI

SEQ ID NO: 59338 - protein, 10 aa, Homo Sapiens
EATPIVRVAV

SEQ ID NO: 59339 - protein, 10 aa, Homo Sapiens
EAVSVVGFGV

SEQ ID NO: 59340 - protein, 10 aa, Homo Sapiens
EELVRMVLNG

SEQ ID NO: 59341 - protein, 10 aa, Homo Sapiens
EEQLQQIRAE

SEQ ID NO: 59342 - protein, 10 aa, Homo Sapiens
EIAHIALETL

SEQ ID NO: 59343 - protein, 10 aa, Homo Sapiens
EIASFPIYKV

SEQ ID NO: 59344 - protein, 10 aa, Homo Sapiens
EIFDGNVAHI

SEQ ID NO: 59345 - protein, 10 aa, Homo Sapiens
EIFNGTKMFV

SEQ ID NO: 59346 - protein, 10 aa, Homo Sapiens
EIFNLKFAQA

SEQ ID NO: 59347 - protein, 10 aa, Homo Sapiens
EIFQKPFQTL

SEQ ID NO: 59348 - protein, 10 aa, Homo Sapiens
EIFSRGPYSV

SEQ ID NO: 59349 - protein, 10 aa, Homo Sapiens
EIFTEQVVTA

SEQ ID NO: 59350 - protein, 10 aa, Homo Sapiens
EIIEDLEAQV

SEQ ID NO: 59351 - protein, 10 aa, Homo Sapiens
EIPEFLFGEV

SEQ ID NO: 59352 - protein, 10 aa, Homo Sapiens
EISSLVKYFI

SEQ ID NO: 59353 - protein, 10 aa, Homo Sapiens
EIVNISSGYV

SEQ ID NO: 59354 - protein, 10 aa, Homo Sapiens
EIYNGKLFDL

SEQ ID NO: 59355 - protein, 10 aa, Homo Sapiens
EIYQKAFDLI

SEQ ID NO: 59356 - protein, 10 aa, Homo Sapiens
EIYQKPFQTL

SEQ ID NO: 59357 - protein, 10 aa, Homo Sapiens
ELERPGGNEI

SEQ ID NO: 59358 - protein, 10 aa, Homo Sapiens
ELFPAPILRA

SEQ ID NO: 59359 - protein, 10 aa, Homo Sapiens
ELFPENVYSV

SEQ ID NO: 59360 - protein, 10 aa, Homo Sapiens
ELFPIQMEGV

SEQ ID NO: 59361 - protein, 10 aa, Homo Sapiens
ELPDFGGNVL

SEQ ID NO: 59362 - protein, 10 aa, Homo Sapiens
ELPDGQVITI

SEQ ID NO: 59363 - protein, 10 aa, Homo Sapiens
ELSAVARVEL

SEQ ID NO: 59364 - protein, 10 aa, Homo Sapiens
ELYDLRQHFV

SEQ ID NO: 59365 - protein, 10 aa, Homo Sapiens
ENTDVFKFSI

SEQ ID NO: 59366 - protein, 10 aa, Homo Sapiens
ERPGGNEITR

SEQ ID NO: 59367 - protein, 10 aa, Homo Sapiens
ESFGNEIYTV

SEQ ID NO: 59368 - protein, 10 aa, Homo Sapiens
ESFNVPGLYI

SEQ ID NO: 59369 - protein, 10 aa, Homo Sapiens
ESFSDYPPLG

SEQ ID NO: 59370 - protein, 10 aa, Homo Sapiens
ESIFFNSHNV

SEQ ID NO: 59371 - protein, 10 aa, Homo Sapiens
ESSGILNVLI

SEQ ID NO: 59372 - protein, 10 aa, Homo Sapiens
ESSPFVERLL

SEQ ID NO: 59373 - protein, 10 aa, Homo Sapiens
ETAGVVSTNL

SEQ ID NO: 59374 - protein, 10 aa, Homo Sapiens
ETATLSDIKA

SEQ ID NO: 59375 - protein, 10 aa, Homo Sapiens
ETFFLPLVEL

SEQ ID NO: 59376 - protein, 10 aa, Homo Sapiens
ETFGQYPLQV

SEQ ID NO: 59377 - protein, 10 aa, Homo Sapiens
ETFGVTTTKV

SEQ ID NO: 59378 - protein, 10 aa, Homo Sapiens
ETFKNSFVEA

SEQ ID NO: 59379 - protein, 10 aa, Homo Sapiens
ETFLHIYQYV

SEQ ID NO: 59380 - protein, 10 aa, Homo Sapiens
ETFNTPAMYV

SEQ ID NO: 59381 - protein, 10 aa, Homo Sapiens
ETFNVPALFI

SEQ ID NO: 59382 - protein, 10 aa, Homo Sapiens
ETFNVPAMYV

SEQ ID NO: 59383 - protein, 10 aa, Homo Sapiens
ETFPANIQVV

SEQ ID NO: 59384 - protein, 10 aa, Homo Sapiens
ETFPGVTALF

SEQ ID NO: 59385 - protein, 10 aa, Homo Sapiens
ETFPIPKAFV

SEQ ID NO: 59386 - protein, 10 aa, Homo Sapiens
ETFQRPYQYL

SEQ ID NO: 59387 - protein, 10 aa, Homo Sapiens
ETFQVTGQQI

SEQ ID NO: 59388 - protein, 10 aa, Homo Sapiens
ETIGLQHIKV

SEQ ID NO: 59389 - protein, 10 aa, Homo Sapiens
ETIGVVHLVL

SEQ ID NO: 59390 - protein, 10 aa, Homo Sapiens
ETILISNNQV

SEQ ID NO: 59391 - protein, 10 aa, Homo Sapiens
ETINLTHTAL

SEQ ID NO: 59392 - protein, 10 aa, Homo Sapiens
ETIPGPDAKV

SEQ ID NO: 59393 - protein, 10 aa, Homo Sapiens
ETIPLTAEKL

SEQ ID NO: 59394 - protein, 10 aa, Homo Sapiens
ETIQALETLV

SEQ ID NO: 59395 - protein, 10 aa, Homo Sapiens
ETITRVLYEV

SEQ ID NO: 59396 - protein, 10 aa, Homo Sapiens
ETIYIVGGCL

SEQ ID NO: 59397 - protein, 10 aa, Homo Sapiens
ETLFPSKIGV

SEQ ID NO: 59398 - protein, 10 aa, Homo Sapiens
ETSELWQIKL

SEQ ID NO: 59399 - protein, 10 aa, Homo Sapiens
ETSGFVDKLF

SEQ ID NO: 59400 - protein, 10 aa, Homo Sapiens
ETSGIGEARV

SEQ ID NO: 59401 - protein, 10 aa, Homo Sapiens
ETSGISIYRL

SEQ ID NO: 59402 - protein, 10 aa, Homo Sapiens
ETSKLIYDFI

SEQ ID NO: 59403 - protein, 10 aa, Homo Sapiens
ETSPITDTDL

SEQ ID NO: 59404 - protein, 10 aa, Homo Sapiens
ETSPLTAEKL

SEQ ID NO: 59405 - protein, 10 aa, Homo Sapiens
ETSQAGLFRL

SEQ ID NO: 59406 - protein, 10 aa, Homo Sapiens
ETSSLSHTLF

SEQ ID NO: 59407 - protein, 10 aa, Homo Sapiens
ETTPLTIEKL

SEQ ID NO: 59408 - protein, 10 aa, Homo Sapiens
ETTSISKITV

SEQ ID NO: 59409 - protein, 10 aa, Homo Sapiens
ETVAQIKAHV

SEQ ID NO: 59410 - protein, 10 aa, Homo Sapiens
ETVEDIAARL

SEQ ID NO: 59411 - protein, 10 aa, Homo Sapiens
ETVGDLRDFV

SEQ ID NO: 59412 - protein, 10 aa, Homo Sapiens
ETVSGLKGYV

SEQ ID NO: 59413 - protein, 10 aa, Homo Sapiens
ETYHGVFVNI

SEQ ID NO: 59414 - protein, 10 aa, Homo Sapiens
ETYQFSGVYV

SEQ ID NO: 59415 - protein, 10 aa, Homo Sapiens
EVAKQALNRL

SEQ ID NO: 59416 - protein, 10 aa, Homo Sapiens
EVAPPTPLTP

SEQ ID NO: 59417 - protein, 10 aa, Homo Sapiens
EVAPSFGTLL

SEQ ID NO: 59418 - protein, 10 aa, Homo Sapiens
EVAPVAQVAL

SEQ ID NO: 59419 - protein, 10 aa, Homo Sapiens
EVFASLFHKV

SEQ ID NO: 59420 - protein, 10 aa, Homo Sapiens
EVFDKDLSKL

SEQ ID NO: 59421 - protein, 10 aa, Homo Sapiens
EVFDKTYQFL

SEQ ID NO: 59422 - protein, 10 aa, Homo Sapiens
EVFEATDIKI

SEQ ID NO: 59423 - protein, 10 aa, Homo Sapiens
EVFEFRPELV

SEQ ID NO: 59424 - protein, 10 aa, Homo Sapiens
EVFNMKTMRV

SEQ ID NO: 59425 - protein, 10 aa, Homo Sapiens
EVFPDQFIHL

SEQ ID NO: 59426 - protein, 10 aa, Homo Sapiens
EVFPLAMNYL

SEQ ID NO: 59427 - protein, 10 aa, Homo Sapiens
EVFPLGGVGA

SEQ ID NO: 59428 - protein, 10 aa, Homo Sapiens
EVFPPPVAML

SEQ ID NO: 59429 - protein, 10 aa, Homo Sapiens
EVFPVSKTLV

SEQ ID NO: 59430 - protein, 10 aa, Homo Sapiens
EVFQDLFTEL

SEQ ID NO: 59431 - protein, 10 aa, Homo Sapiens
EVFRIGNVEI

SEQ ID NO: 59432 - protein, 10 aa, Homo Sapiens
EVFYPGETVV

SEQ ID NO: 59433 - protein, 10 aa, Homo Sapiens
EVGPPLPPLL

SEQ ID NO: 59434 - protein, 10 aa, Homo Sapiens
EVIGKGPFSV

SEQ ID NO: 59435 - protein, 10 aa, Homo Sapiens
EVIKPGDLGV

SEQ ID NO: 59436 - protein, 10 aa, Homo Sapiens
EVIPNSNFYV

SEQ ID NO: 59437 - protein, 10 aa, Homo Sapiens
EVIRGWEEGV

SEQ ID NO: 59438 - protein, 10 aa, Homo Sapiens
EVISFVPPPL

SEQ ID NO: 59439 - protein, 10 aa, Homo Sapiens
EVISTPGVVA

SEQ ID NO: 59440 - protein, 10 aa, Homo Sapiens
EVLQTHSVFV

SEQ ID NO: 59441 - protein, 10 aa, Homo Sapiens
EVPHFHHELV

SEQ ID NO: 59442 - protein, 10 aa, Homo Sapiens
EVSNIVKEAI

SEQ ID NO: 59443 - protein, 10 aa, Homo Sapiens
EVSPVALQRL

SEQ ID NO: 59444 - protein, 10 aa, Homo Sapiens
EVSPVSFHQV

SEQ ID NO: 59445 - protein, 10 aa, Homo Sapiens
EVSRIINYNV

SEQ ID NO: 59446 - protein, 10 aa, Homo Sapiens
EVSSVVCFLL

SEQ ID NO: 59447 - protein, 10 aa, Homo Sapiens
EVSWISSIML

SEQ ID NO: 59448 - protein, 10 aa, Homo Sapiens
EVTDFAGQYV

SEQ ID NO: 59449 - protein, 10 aa, Homo Sapiens
EVTPVTGASL

SEQ ID NO: 59450 - protein, 10 aa, Homo Sapiens
EVVAGRFIEV

SEQ ID NO: 59451 - protein, 10 aa, Homo Sapiens
EVVDFIQSKI

SEQ ID NO: 59452 - protein, 10 aa, Homo Sapiens
EVVDIIRVNV

SEQ ID NO: 59453 - protein, 10 aa, Homo Sapiens
EVVDIMRVNV

SEQ ID NO: 59454 - protein, 10 aa, Homo Sapiens
EVVGLIFRLT

SEQ ID NO: 59455 - protein, 10 aa, Homo Sapiens
EVVSGVVSKV

SEQ ID NO: 59456 - protein, 10 aa, Homo Sapiens
EVVVGDLVEV

SEQ ID NO: 59457 - protein, 10 aa, Homo Sapiens
EVYAGNFVEV

SEQ ID NO: 59458 - protein, 10 aa, Homo Sapiens
EVYEGEVTEL

SEQ ID NO: 59459 - protein, 10 aa, Homo Sapiens
EVYEHVYETV

SEQ ID NO: 59460 - protein, 10 aa, Homo Sapiens
EVYGGENVEL

SEQ ID NO: 59461 - protein, 10 aa, Homo Sapiens
EVYGSLPAFL

SEQ ID NO: 59462 - protein, 10 aa, Homo Sapiens
EVYPFGIVGM

SEQ ID NO: 59463 - protein, 10 aa, Homo Sapiens
EVYTPKEIFV

SEQ ID NO: 59464 - protein, 10 aa, Homo Sapiens
EYHAKATEHL

SEQ ID NO: 59465 - protein, 10 aa, Homo Sapiens
FAARPQVVAV

SEQ ID NO: 59466 - protein, 10 aa, Homo Sapiens
FEGSALGKQL

SEQ ID NO: 59467 - protein, 10 aa, Homo Sapiens
FITTVKTAWL

SEQ ID NO: 59468 - protein, 10 aa, Homo Sapiens
FLATEGDHLQ

SEQ ID NO: 59469 - protein, 10 aa, Homo Sapiens
FLFDGSPTYV

SEQ ID NO: 59470 - protein, 10 aa, Homo Sapiens
FLSALEEYTK

SEQ ID NO: 59471 - protein, 10 aa, Homo Sapiens
FSFGGKLVTF

SEQ ID NO: 59472 - protein, 10 aa, Homo Sapiens
FSWEGAFQHV

SEQ ID NO: 59473 - protein, 10 aa, Homo Sapiens
FTAGIVEAVL

SEQ ID NO: 59474 - protein, 10 aa, Homo Sapiens
FTFYHQGHEL

SEQ ID NO: 59475 - protein, 10 aa, Homo Sapiens
FTITPGSEQI

SEQ ID NO: 59476 - protein, 10 aa, Homo Sapiens
FTITPPTAQV

SEQ ID NO: 59477 - protein, 10 aa, Homo Sapiens
FTNQGTVIHF

SEQ ID NO: 59478 - protein, 10 aa, Homo Sapiens
FTSDRGFQFV

SEQ ID NO: 59479 - protein, 10 aa, Homo Sapiens
FTVDQIRAIM

SEQ ID NO: 59480 - protein, 10 aa, Homo Sapiens
FVNDIFERIA

SEQ ID NO: 59481 - protein, 10 aa, Homo Sapiens
FVSPVAKAVI

SEQ ID NO: 59482 - protein, 10 aa, Homo Sapiens
FVSSLNKIAM

SEQ ID NO: 59483 - protein, 10 aa, Homo Sapiens
FVYGGPQVQL

SEQ ID NO: 59484 - protein, 10 aa, Homo Sapiens
FVYPLDFART

SEQ ID NO: 59485 - protein, 10 aa, Homo Sapiens
GEFVSETESR

SEQ ID NO: 59486 - protein, 10 aa, Homo Sapiens
GEYGAEALER

SEQ ID NO: 59487 - protein, 10 aa, Homo Sapiens
GGIGTVPVGR

SEQ ID NO: 59488 - protein, 10 aa, Homo Sapiens
GVAALYKFRV

SEQ ID NO: 59489 - protein, 10 aa, Homo Sapiens
HAARIINDLL

SEQ ID NO: 59490 - protein, 10 aa, Homo Sapiens
HAVVTVPAYF

SEQ ID NO: 59491 - protein, 10 aa, Homo Sapiens
HLGYLPNQLF

SEQ ID NO: 59492 - protein, 10 aa, Homo Sapiens
HQPHQPLPPT

SEQ ID NO: 59493 - protein, 10 aa, Homo Sapiens
HRHPDEAAFF

SEQ ID NO: 59494 - protein, 10 aa, Homo Sapiens
HSAPPFPAAV

SEQ ID NO: 59495 - protein, 10 aa, Homo Sapiens
HSASIPGILA

SEQ ID NO: 59496 - protein, 10 aa, Homo Sapiens
HSMSGPLIGV

SEQ ID NO: 59497 - protein, 10 aa, Homo Sapiens
HTAEILDFAL

SEQ ID NO: 59498 - protein, 10 aa, Homo Sapiens
HTALITDIGL

SEQ ID NO: 59499 - protein, 10 aa, Homo Sapiens
HTAWIEHVHV

SEQ ID NO: 59500 - protein, 10 aa, Homo Sapiens
HTSPLTQIRL

SEQ ID NO: 59501 - protein, 10 aa, Homo Sapiens
HTYDRFFLGV

SEQ ID NO: 59502 - protein, 10 aa, Homo Sapiens
HVADPVEAVL

SEQ ID NO: 59503 - protein, 10 aa, Homo Sapiens
HVFDHPWETV

SEQ ID NO: 59504 - protein, 10 aa, Homo Sapiens
HVFTGEKVAV

SEQ ID NO: 59505 - protein, 10 aa, Homo Sapiens
HVYFGDPVSL

SEQ ID NO: 59506 - protein, 10 aa, Homo Sapiens
IADLQPNTEY

SEQ ID NO: 59507 - protein, 10 aa, Homo Sapiens
IEIEVAGLLP

SEQ ID NO: 59508 - protein, 10 aa, Homo Sapiens
ISDTNVILSM

SEQ ID NO: 59509 - protein, 10 aa, Homo Sapiens
IVAEVVSARI

SEQ ID NO: 59510 - protein, 10 aa, Homo Sapiens
IVFNGKLYSV

SEQ ID NO: 59511 - protein, 10 aa, Homo Sapiens
IWHHTFYNEL

SEQ ID NO: 59512 - protein, 10 aa, Homo Sapiens
KSTEILLRKL

SEQ ID NO: 59513 - protein, 10 aa, Homo Sapiens
KVPQLEIVPN

SEQ ID NO: 59514 - protein, 10 aa, Homo Sapiens
LAAESARVTL

SEQ ID NO: 59515 - protein, 10 aa, Homo Sapiens
LLFEGEKITI

SEQ ID NO: 59516 - protein, 10 aa, Homo Sapiens
LPIPDPGVSV

SEQ ID NO: 59517 - protein, 10 aa, Homo Sapiens
LRASGAGKAI

SEQ ID NO: 59518 - protein, 10 aa, Homo Sapiens
LSPDAILDAI

SEQ ID NO: 59519 - protein, 10 aa, Homo Sapiens
LVAASQAALG

SEQ ID NO: 59520 - protein, 10 aa, Homo Sapiens
LVHNVKELEV

SEQ ID NO: 59521 - protein, 10 aa, Homo Sapiens
LVSPITGEKI

SEQ ID NO: 59522 - protein, 10 aa, Homo Sapiens
LVYDGKIYTL

SEQ ID NO: 59523 - protein, 10 aa, Homo Sapiens
LVYQHSIIPL

SEQ ID NO: 59524 - protein, 10 aa, Homo Sapiens
MIFDHEFTKL

SEQ ID NO: 59525 - protein, 10 aa, Homo Sapiens
MIPSIRNGIL

SEQ ID NO: 59526 - protein, 10 aa, Homo Sapiens
MSASIGVVGV

SEQ ID NO: 59527 - protein, 10 aa, Homo Sapiens
MSIYPSPTGV

SEQ ID NO: 59528 - protein, 10 aa, Homo Sapiens
MTAAIKDLQV

SEQ ID NO: 59529 - protein, 10 aa, Homo Sapiens
MTFDPQDILL

SEQ ID NO: 59530 - protein, 10 aa, Homo Sapiens
MVDVLVFASS

SEQ ID NO: 59531 - protein, 10 aa, Homo Sapiens
MVLPFEPVPV

SEQ ID NO: 59532 - protein, 10 aa, Homo Sapiens
MVMEIRNAYV

SEQ ID NO: 59533 - protein, 10 aa, Homo Sapiens
MVSDLSQVTV

SEQ ID NO: 59534 - protein, 10 aa, Homo Sapiens
MVVSDFHVFV

SEQ ID NO: 59535 - protein, 10 aa, Homo Sapiens
NIPPLTQTPV

SEQ ID NO: 59536 - protein, 10 aa, Homo Sapiens
NLEKETEGLR

SEQ ID NO: 59537 - protein, 10 aa, Homo Sapiens
NLPINGNGKQ

SEQ ID NO: 59538 - protein, 10 aa, Homo Sapiens
NTAPLTDYFL

SEQ ID NO: 59539 - protein, 10 aa, Homo Sapiens
NTSDIILVGL

SEQ ID NO: 59540 - protein, 10 aa, Homo Sapiens
NTSELAKDFI

SEQ ID NO: 59541 - protein, 10 aa, Homo Sapiens
NTVFVDRALI

SEQ ID NO: 59542 - protein, 10 aa, Homo Sapiens
NVIGEPFLNV

SEQ ID NO: 59543 - protein, 10 aa, Homo Sapiens
NVIHNLATYV

SEQ ID NO: 59544 - protein, 10 aa, Homo Sapiens
NVPEGLLATV

SEQ ID NO: 59545 - protein, 10 aa, Homo Sapiens
NVPGEIVESL

SEQ ID NO: 59546 - protein, 10 aa, Homo Sapiens
PFPLQVVSVG

SEQ ID NO: 59547 - protein, 10 aa, Homo Sapiens
PPGQVAASPD

SEQ ID NO: 59548 - protein, 10 aa, Homo Sapiens
PVDGVVLVDP

SEQ ID NO: 59549 - protein, 10 aa, Homo Sapiens
QGLLPVLESF

SEQ ID NO: 59550 - protein, 10 aa, Homo Sapiens
QGRTLYGFGG

SEQ ID NO: 59551 - protein, 10 aa, Homo Sapiens
QTISITKAGV

SEQ ID NO: 59552 - protein, 10 aa, Homo Sapiens
QTQISETNVI

SEQ ID NO: 59553 - protein, 10 aa, Homo Sapiens
QVANSAFVER

SEQ ID NO: 59554 - protein, 10 aa, Homo Sapiens
QVFPGLLERV

SEQ ID NO: 59555 - protein, 10 aa, Homo Sapiens
QVIKPPLIFV

SEQ ID NO: 59556 - protein, 10 aa, Homo Sapiens
QVTGVTRVTI

SEQ ID NO: 59557 - protein, 10 aa, Homo Sapiens
REYHTEKLVT

SEQ ID NO: 59558 - protein, 10 aa, Homo Sapiens
RVAPEEHPVL

SEQ ID NO: 59559 - protein, 10 aa, Homo Sapiens
SAADVVLYGV

SEQ ID NO: 59560 - protein, 10 aa, Homo Sapiens
SALEEYTKKL

SEQ ID NO: 59561 - protein, 10 aa, Homo Sapiens
SEDIPLNLSR

SEQ ID NO: 59562 - protein, 10 aa, Homo Sapiens
SFGGSYGGSF

SEQ ID NO: 59563 - protein, 10 aa, Homo Sapiens
SIHSFELDLL

SEQ ID NO: 59564 - protein, 10 aa, Homo Sapiens
SIYGGFLLGV

SEQ ID NO: 59565 - protein, 10 aa, Homo Sapiens
SLENVPNVGV

SEQ ID NO: 59566 - protein, 10 aa, Homo Sapiens
SLPQNIPPLT

SEQ ID NO: 59567 - protein, 10 aa, Homo Sapiens
SLVNLGGSKS

SEQ ID NO: 59568 - protein, 10 aa, Homo Sapiens
SLYQSKYEEL

SEQ ID NO: 59569 - protein, 10 aa, Homo Sapiens
STSAVIGVRV

SEQ ID NO: 59570 - protein, 10 aa, Homo Sapiens
STSDLYNFQV

SEQ ID NO: 59571 - protein, 10 aa, Homo Sapiens
SVFGGKNIHV

SEQ ID NO: 59572 - protein, 10 aa, Homo Sapiens
SVIDIINGEA

SEQ ID NO: 59573 - protein, 10 aa, Homo Sapiens
SVIDPPAVNL

SEQ ID NO: 59574 - protein, 10 aa, Homo Sapiens
SVSDISQYRV

SEQ ID NO: 59575 - protein, 10 aa, Homo Sapiens
SVSPVVRVAV

SEQ ID NO: 59576 - protein, 10 aa, Homo Sapiens
SVYAHFPINV

SEQ ID NO: 59577 - protein, 10 aa, Homo Sapiens
SVYEGGVFFL

SEQ ID NO: 59578 - protein, 10 aa, Homo Sapiens
SYFEKSKEQL

SEQ ID NO: 59579 - protein, 10 aa, Homo Sapiens
SYVGDEAQSK

SEQ ID NO: 59580 - protein, 10 aa, Homo Sapiens
TAVLKFAAEE

SEQ ID NO: 59581 - protein, 10 aa, Homo Sapiens
TFPGFFSPML

SEQ ID NO: 59582 - protein, 10 aa, Homo Sapiens
THLAPYSDEL

SEQ ID NO: 59583 - protein, 10 aa, Homo Sapiens
TIFTGHTAVV

SEQ ID NO: 59584 - protein, 10 aa, Homo Sapiens
TIPDFIFANV

SEQ ID NO: 59585 - protein, 10 aa, Homo Sapiens
TLPHFISPYL

SEQ ID NO: 59586 - protein, 10 aa, Homo Sapiens
TLSEKAKPAL

SEQ ID NO: 59587 - protein, 10 aa, Homo Sapiens
TLTDKSGPEL

SEQ ID NO: 59588 - protein, 10 aa, Homo Sapiens
TPGNRIVYLY

SEQ ID NO: 59589 - protein, 10 aa, Homo Sapiens
TQTPVVVPPF

SEQ ID NO: 59590 - protein, 10 aa, Homo Sapiens
TTAELAVSLL

SEQ ID NO: 59591 - protein, 10 aa, Homo Sapiens
TTAEVVVTEI

SEQ ID NO: 59592 - protein, 10 aa, Homo Sapiens
TTFEHDIQAL

SEQ ID NO: 59593 - protein, 10 aa, Homo Sapiens
TTFESSHYLL

SEQ ID NO: 59594 - protein, 10 aa, Homo Sapiens
TTIENIEITI

SEQ ID NO: 59595 - protein, 10 aa, Homo Sapiens
TTIENISVSV

SEQ ID NO: 59596 - protein, 10 aa, Homo Sapiens
TTSTISHQVL

SEQ ID NO: 59597 - protein, 10 aa, Homo Sapiens
TTVDAMKLGV

SEQ ID NO: 59598 - protein, 10 aa, Homo Sapiens
TTYEGIFKTL

SEQ ID NO: 59599 - protein, 10 aa, Homo Sapiens
TVADVVLWSV

SEQ ID NO: 59600 - protein, 10 aa, Homo Sapiens
TVAEITGHQL

SEQ ID NO: 59601 - protein, 10 aa, Homo Sapiens
TVAEVTEVSV

SEQ ID NO: 59602 - protein, 10 aa, Homo Sapiens
TVAEVTSIQL

SEQ ID NO: 59603 - protein, 10 aa, Homo Sapiens
TVFDEAIRAV

SEQ ID NO: 59604 - protein, 10 aa, Homo Sapiens
TVFPGAVPVL

SEQ ID NO: 59605 - protein, 10 aa, Homo Sapiens
TVFPKEPVEL

SEQ ID NO: 59606 - protein, 10 aa, Homo Sapiens
TVFSHAQTVV

SEQ ID NO: 59607 - protein, 10 aa, Homo Sapiens
TVFSKSFEQV

SEQ ID NO: 59608 - protein, 10 aa, Homo Sapiens
TVFTDHMLTV

SEQ ID NO: 59609 - protein, 10 aa, Homo Sapiens
TVMDSKIVQV

SEQ ID NO: 59610 - protein, 10 aa, Homo Sapiens
TVSEVIQGLL

SEQ ID NO: 59611 - protein, 10 aa, Homo Sapiens
TVSPYTEIHL

SEQ ID NO: 59612 - protein, 10 aa, Homo Sapiens
TVTDLVEYSI

SEQ ID NO: 59613 - protein, 10 aa, Homo Sapiens
TVVEFPIRGL

SEQ ID NO: 59614 - protein, 10 aa, Homo Sapiens
TVYGGYLCSV

SEQ ID NO: 59615 - protein, 10 aa, Homo Sapiens
VAPEEHPVLL

SEQ ID NO: 59616 - protein, 10 aa, Homo Sapiens
VDTLPTVSSV

SEQ ID NO: 59617 - protein, 10 aa, Homo Sapiens
VLSPADKTNV

SEQ ID NO: 59618 - protein, 10 aa, Homo Sapiens
VPQLEIVPNS

SEQ ID NO: 59619 - protein, 10 aa, Homo Sapiens
VTFAPVNVTT

SEQ ID NO: 59620 - protein, 10 aa, Homo Sapiens
VVAPVTHVSV

SEQ ID NO: 59621 - protein, 10 aa, Homo Sapiens
VVGEPLPLPQ

SEQ ID NO: 59622 - protein, 10 aa, Homo Sapiens
VVPPFLQPEV

SEQ ID NO: 59623 - protein, 10 aa, Homo Sapiens
VVVPPFLQPE

SEQ ID NO: 59624 - protein, 10 aa, Homo Sapiens
VYPFPGPIPN

SEQ ID NO: 59625 - protein, 10 aa, Homo Sapiens
YAAPGGLIGV

SEQ ID NO: 59626 - protein, 10 aa, Homo Sapiens
YAAPPSPPLS

SEQ ID NO: 59627 - protein, 10 aa, Homo Sapiens
YDAEISQIHQ

SEQ ID NO: 59628 - protein, 10 aa, Homo Sapiens
YTFSEPFHLI

SEQ ID NO: 59629 - protein, 10 aa, Homo Sapiens
YVPVHFDASV

SEQ ID NO: 59630 - protein, 11 aa, Homo Sapiens
ALDVANKIGII

SEQ ID NO: 59631 - protein, 11 aa, Homo Sapiens
APIRLPEHVTV

SEQ ID NO: 59632 - protein, 11 aa, Homo Sapiens
APPPISGGGYR

SEQ ID NO: 59633 - protein, 11 aa, Homo Sapiens
APSFSDIPNPI

SEQ ID NO: 59634 - protein, 11 aa, Homo Sapiens
AVISPHYDSLL

SEQ ID NO: 59635 - protein, 11 aa, Homo Sapiens
DIFYPGDQQSV

SEQ ID NO: 59636 - protein, 11 aa, Homo Sapiens
DIPDDLNSIRA

SEQ ID NO: 59637 - protein, 11 aa, Homo Sapiens
DISIIPPLFTV

SEQ ID NO: 59638 - protein, 11 aa, Homo Sapiens
DIVDIKGMGTV

SEQ ID NO: 59639 - protein, 11 aa, Homo Sapiens
DSSLPQNQPFV

SEQ ID NO: 59640 - protein, 11 aa, Homo Sapiens
DTFRAGAFDQL

SEQ ID NO: 59641 - protein, 11 aa, Homo Sapiens
DTISTIKDIAV

SEQ ID NO: 59642 - protein, 11 aa, Homo Sapiens
DVAAVVVPILF

SEQ ID NO: 59643 - protein, 11 aa, Homo Sapiens
DVAHSDLILHV

SEQ ID NO: 59644 - protein, 11 aa, Homo Sapiens
DVAPPLIVHNI

SEQ ID NO: 59645 - protein, 11 aa, Homo Sapiens
DVAPQAPVHFL

SEQ ID NO: 59646 - protein, 11 aa, Homo Sapiens
DVAPTHILYAV

SEQ ID NO: 59647 - protein, 11 aa, Homo Sapiens
DVPGDKLLEPV

SEQ ID NO: 59648 - protein, 11 aa, Homo Sapiens
EAFGDTKFSAV

SEQ ID NO: 59649 - protein, 11 aa, Homo Sapiens
EAFPVHGFPTL

SEQ ID NO: 59650 - protein, 11 aa, Homo Sapiens
EAIDPLNLGNI

SEQ ID NO: 59651 - protein, 11 aa, Homo Sapiens
EIAPHALLQAV

SEQ ID NO: 59652 - protein, 11 aa, Homo Sapiens
EIFASKHIIGL

SEQ ID NO: 59653 - protein, 11 aa, Homo Sapiens
EIIDREAIQEL

SEQ ID NO: 59654 - protein, 11 aa, Homo Sapiens
EISTIASNYHL

SEQ ID NO: 59655 - protein, 11 aa, Homo Sapiens
EIVDKSGVVRV

SEQ ID NO: 59656 - protein, 11 aa, Homo Sapiens
EKVLVEGGPAP

SEQ ID NO: 59657 - protein, 11 aa, Homo Sapiens
ELPDFGGNVLL

SEQ ID NO: 59658 - protein, 11 aa, Homo Sapiens
EQFGGNPFASL

SEQ ID NO: 59659 - protein, 11 aa, Homo Sapiens
ESAKIGGIITV

SEQ ID NO: 59660 - protein, 11 aa, Homo Sapiens
ESAPGDFSLSV

SEQ ID NO: 59661 - protein, 11 aa, Homo Sapiens
ETADVIAKVAF

SEQ ID NO: 59662 - protein, 11 aa, Homo Sapiens
ETAGVVSTNLI

SEQ ID NO: 59663 - protein, 11 aa, Homo Sapiens
ETANADIVTLL

SEQ ID NO: 59664 - protein, 11 aa, Homo Sapiens
ETAPAKLIVYL

SEQ ID NO: 59665 - protein, 11 aa, Homo Sapiens
ETAPRTIFQRV

SEQ ID NO: 59666 - protein, 11 aa, Homo Sapiens
ETAQAIKGMHI

SEQ ID NO: 59667 - protein, 11 aa, Homo Sapiens
ETFEKSRLYQL

SEQ ID NO: 59668 - protein, 11 aa, Homo Sapiens
ETFKPPKDIDL

SEQ ID NO: 59669 - protein, 11 aa, Homo Sapiens
ETFTALSVLGV

SEQ ID NO: 59670 - protein, 11 aa, Homo Sapiens
ETIGTGGFAKV

SEQ ID NO: 59671 - protein, 11 aa, Homo Sapiens
ETIHIRGGVFS

SEQ ID NO: 59672 - protein, 11 aa, Homo Sapiens
ETINTRLISGV

SEQ ID NO: 59673 - protein, 11 aa, Homo Sapiens
ETVPSWMVAVI

SEQ ID NO: 59674 - protein, 11 aa, Homo Sapiens
ETVQVIPGSKL

SEQ ID NO: 59675 - protein, 11 aa, Homo Sapiens
ETVSPDKDWYV

SEQ ID NO: 59676 - protein, 11 aa, Homo Sapiens
ETYEAKRNEFL

SEQ ID NO: 59677 - protein, 11 aa, Homo Sapiens
EVAAIGQLAFL

SEQ ID NO: 59678 - protein, 11 aa, Homo Sapiens
EVADEKMLSGL

SEQ ID NO: 59679 - protein, 11 aa, Homo Sapiens
EVAGILEPVGL

SEQ ID NO: 59680 - protein, 11 aa, Homo Sapiens
EVAPPRLLEEV

SEQ ID NO: 59681 - protein, 11 aa, Homo Sapiens
EVAPVVTTEHI

SEQ ID NO: 59682 - protein, 11 aa, Homo Sapiens
EVAYIDGQVLV

SEQ ID NO: 59683 - protein, 11 aa, Homo Sapiens
EVDETYVPKEF

SEQ ID NO: 59684 - protein, 11 aa, Homo Sapiens
EVFAPPAEAYA

SEQ ID NO: 59685 - protein, 11 aa, Homo Sapiens
EVFDPSGVASI

SEQ ID NO: 59686 - protein, 11 aa, Homo Sapiens
EVFEDAAEIRL

SEQ ID NO: 59687 - protein, 11 aa, Homo Sapiens
EVFEKATFIKV

SEQ ID NO: 59688 - protein, 11 aa, Homo Sapiens
EVFFSEKIYKL

SEQ ID NO: 59689 - protein, 11 aa, Homo Sapiens
EVFGTADLYRV

SEQ ID NO: 59690 - protein, 11 aa, Homo Sapiens
EVFPVSKTLVL

SEQ ID NO: 59691 - protein, 11 aa, Homo Sapiens
EVFSSFAHAQV

SEQ ID NO: 59692 - protein, 11 aa, Homo Sapiens
EVGGEALGRLL

SEQ ID NO: 59693 - protein, 11 aa, Homo Sapiens
EVIGGLGAARV

SEQ ID NO: 59694 - protein, 11 aa, Homo Sapiens
EVIHGIFKAYI

SEQ ID NO: 59695 - protein, 11 aa, Homo Sapiens
EVIQSDSLWLV

SEQ ID NO: 59696 - protein, 11 aa, Homo Sapiens
EVIRLAQDAEV

SEQ ID NO: 59697 - protein, 11 aa, Homo Sapiens
EVIRLKGLVSI

SEQ ID NO: 59698 - protein, 11 aa, Homo Sapiens
EVISRQATINI

SEQ ID NO: 59699 - protein, 11 aa, Homo Sapiens
EVKPSLVIDYL

SEQ ID NO: 59700 - protein, 11 aa, Homo Sapiens
EVNEAFAPQYL

SEQ ID NO: 59701 - protein, 11 aa, Homo Sapiens
EVPPGSAIIHI

SEQ ID NO: 59702 - protein, 11 aa, Homo Sapiens
EVSGGTVRELV

SEQ ID NO: 59703 - protein, 11 aa, Homo Sapiens
EVSGNVSPGTR

SEQ ID NO: 59704 - protein, 11 aa, Homo Sapiens
FAIGIVGDAGV

SEQ ID NO: 59705 - protein, 11 aa, Homo Sapiens
FAWGNGEKVNI

SEQ ID NO: 59706 - protein, 11 aa, Homo Sapiens
FPANVAHSVYV

SEQ ID NO: 59707 - protein, 11 aa, Homo Sapiens
FQSSAVMALQE

SEQ ID NO: 59708 - protein, 11 aa, Homo Sapiens
FTAPTFTGSFL

SEQ ID NO: 59709 - protein, 11 aa, Homo Sapiens
FTFPGNLVTSV

SEQ ID NO: 59710 - protein, 11 aa, Homo Sapiens
FTITPPTAQVV

SEQ ID NO: 59711 - protein, 11 aa, Homo Sapiens
FTYRGVDLDQL

SEQ ID NO: 59712 - protein, 11 aa, Homo Sapiens
FVNDIFERIAG

SEQ ID NO: 59713 - protein, 11 aa, Homo Sapiens
FVYEQKLNEYV

SEQ ID NO: 59714 - protein, 11 aa, Homo Sapiens
GALEPHINAQI

SEQ ID NO: 59715 - protein, 11 aa, Homo Sapiens
GEFSITYKPVK

SEQ ID NO: 59716 - protein, 11 aa, Homo Sapiens
GEGMRYIIILD

SEQ ID NO: 59717 - protein, 11 aa, Homo Sapiens
GFEKPSAIQQR

SEQ ID NO: 59718 - protein, 11 aa, Homo Sapiens
GGFGGGSFRGS

SEQ ID NO: 59719 - protein, 11 aa, Homo Sapiens
GHQQLYWSHPR

SEQ ID NO: 59720 - protein, 11 aa, Homo Sapiens
GHYTEGAELVD

SEQ ID NO: 59721 - protein, 11 aa, Homo Sapiens
GLADALGGPLL

SEQ ID NO: 59722 - protein, 11 aa, Homo Sapiens
GPEETLPGQDS

SEQ ID NO: 59723 - protein, 11 aa, Homo Sapiens
GVGEFEAGISK

SEQ ID NO: 59724 - protein, 11 aa, Homo Sapiens
HHPGIAEFPSR

SEQ ID NO: 59725 - protein, 11 aa, Homo Sapiens
HLGYLPNQLFR

SEQ ID NO: 59726 - protein, 11 aa, Homo Sapiens
HRHPDEAAFFD

SEQ ID NO: 59727 - protein, 11 aa, Homo Sapiens
HSFNTDPEVFI

SEQ ID NO: 59728 - protein, 11 aa, Homo Sapiens
HTMSSSHLFYL

SEQ ID NO: 59729 - protein, 11 aa, Homo Sapiens
HVIDSIVGDGI

SEQ ID NO: 59730 - protein, 11 aa, Homo Sapiens
HVYDGKFLARV

SEQ ID NO: 59731 - protein, 11 aa, Homo Sapiens
IIKFPLTTESA

SEQ ID NO: 59732 - protein, 11 aa, Homo Sapiens
ITIHLPSPVTA

SEQ ID NO: 59733 - protein, 11 aa, Homo Sapiens
ITQIEHEVSSS

SEQ ID NO: 59734 - protein, 11 aa, Homo Sapiens
ITTVFSHAQTV

SEQ ID NO: 59735 - protein, 11 aa, Homo Sapiens
IVKDWNDMERI

SEQ ID NO: 59736 - protein, 11 aa, Homo Sapiens
KEDQTEYLEER

SEQ ID NO: 59737 - protein, 11 aa, Homo Sapiens
KNLQTVNVDEN

SEQ ID NO: 59738 - protein, 11 aa, Homo Sapiens
KVPQLEIVPNS

SEQ ID NO: 59739 - protein, 11 aa, Homo Sapiens
LISNASDALDK

SEQ ID NO: 59740 - protein, 11 aa, Homo Sapiens
LSQQDGAAGVP

SEQ ID NO: 59741 - protein, 11 aa, Homo Sapiens
MHQPHQPLPPT

SEQ ID NO: 59742 - protein, 11 aa, Homo Sapiens
MIILPEMVGSM

SEQ ID NO: 59743 - protein, 11 aa, Homo Sapiens
MTAKIVGDVFI

SEQ ID NO: 59744 - protein, 11 aa, Homo Sapiens
MTASVLRSISL

SEQ ID NO: 59745 - protein, 11 aa, Homo Sapiens
MTFDANPYDSV

SEQ ID NO: 59746 - protein, 11 aa, Homo Sapiens
MTFGLTDRPQL

SEQ ID NO: 59747 - protein, 11 aa, Homo Sapiens
MTFPGERIYEV

SEQ ID NO: 59748 - protein, 11 aa, Homo Sapiens
MVFKPSDVMLV

SEQ ID NO: 59749 - protein, 11 aa, Homo Sapiens
NDENEHQLSLR

SEQ ID NO: 59750 - protein, 11 aa, Homo Sapiens
NTIEHLLPLFL

SEQ ID NO: 59751 - protein, 11 aa, Homo Sapiens
NVYETTEFDQL

SEQ ID NO: 59752 - protein, 11 aa, Homo Sapiens
NVYPEEMIVAL

SEQ ID NO: 59753 - protein, 11 aa, Homo Sapiens
PKFEVIEKPQA

SEQ ID NO: 59754 - protein, 11 aa, Homo Sapiens
PMFIVNTNVPR

SEQ ID NO: 59755 - protein, 11 aa, Homo Sapiens
PRIASNAGSIA

SEQ ID NO: 59756 - protein, 11 aa, Homo Sapiens
PVVVPPFLQPE

SEQ ID NO: 59757 - protein, 11 aa, Homo Sapiens
QTAPKIFGGEI

SEQ ID NO: 59758 - protein, 11 aa, Homo Sapiens
QVIILNHPGQI

SEQ ID NO: 59759 - protein, 11 aa, Homo Sapiens
RAADPLVGVFL

SEQ ID NO: 59760 - protein, 11 aa, Homo Sapiens
REYHTEKLVTS

SEQ ID NO: 59761 - protein, 11 aa, Homo Sapiens
SFKKSFKLSGF

SEQ ID NO: 59762 - protein, 11 aa, Homo Sapiens
SFSDYPPLGRF

SEQ ID NO: 59763 - protein, 11 aa, Homo Sapiens
SHFEQWGTLTD

SEQ ID NO: 59764 - protein, 11 aa, Homo Sapiens
SIFGEDALANV

SEQ ID NO: 59765 - protein, 11 aa, Homo Sapiens
SLGGGFGGGSR

SEQ ID NO: 59766 - protein, 11 aa, Homo Sapiens
SLPQNIPPLTQ

SEQ ID NO: 59767 - protein, 11 aa, Homo Sapiens
SSLLEKGLDGA

SEQ ID NO: 59768 - protein, 11 aa, Homo Sapiens
STLSEKAKPAL

SEQ ID NO: 59769 - protein, 11 aa, Homo Sapiens
STTAVVTNPKE

SEQ ID NO: 59770 - protein, 11 aa, Homo Sapiens
SVFDAYVLPKL

SEQ ID NO: 59771 - protein, 11 aa, Homo Sapiens
SVIDHIHLISV

SEQ ID NO: 59772 - protein, 11 aa, Homo Sapiens
SVSPVVRVAVE

SEQ ID NO: 59773 - protein, 11 aa, Homo Sapiens
SVTDTNVILSM

SEQ ID NO: 59774 - protein, 11 aa, Homo Sapiens
TADPLSLLRNV

SEQ ID NO: 59775 - protein, 11 aa, Homo Sapiens
TAQVIILNHPG

SEQ ID NO: 59776 - protein, 11 aa, Homo Sapiens
TDAPSFSDIPN

SEQ ID NO: 59777 - protein, 11 aa, Homo Sapiens
TEELNREVATN

SEQ ID NO: 59778 - protein, 11 aa, Homo Sapiens
TEVLKTHGLLV

SEQ ID NO: 59779 - protein, 11 aa, Homo Sapiens
THAVVTVPAYF

SEQ ID NO: 59780 - protein, 11 aa, Homo Sapiens
TLVTYVPVTTF

SEQ ID NO: 59781 - protein, 11 aa, Homo Sapiens
TSAAVAGIYRV

SEQ ID NO: 59782 - protein, 11 aa, Homo Sapiens
TTFEHAHNMRV

SEQ ID NO: 59783 - protein, 11 aa, Homo Sapiens
TTVLSRAIAEL

SEQ ID NO: 59784 - protein, 11 aa, Homo Sapiens
TVARVHIGQVI

SEQ ID NO: 59785 - protein, 11 aa, Homo Sapiens
TVFAPVIQAGM

SEQ ID NO: 59786 - protein, 11 aa, Homo Sapiens
TVFSHAQTVVL

SEQ ID NO: 59787 - protein, 11 aa, Homo Sapiens
TVIETVADQTV

SEQ ID NO: 59788 - protein, 11 aa, Homo Sapiens
TVKDVNQQEFV

SEQ ID NO: 59789 - protein, 11 aa, Homo Sapiens
TVSSVGALHAL

SEQ ID NO: 59790 - protein, 11 aa, Homo Sapiens
VEALLAFGEGL

SEQ ID NO: 59791 - protein, 11 aa, Homo Sapiens
VHTIVISVQHD

SEQ ID NO: 59792 - protein, 11 aa, Homo Sapiens
VLDIGAGTGIL

SEQ ID NO: 59793 - protein, 11 aa, Homo Sapiens
VLSPADKTNVK

SEQ ID NO: 59794 - protein, 11 aa, Homo Sapiens
VQFLGDAVFIP

SEQ ID NO: 59795 - protein, 11 aa, Homo Sapiens
VTINQSLLTPL

SEQ ID NO: 59796 - protein, 11 aa, Homo Sapiens
VTVNQSLLSPL

SEQ ID NO: 59797 - protein, 11 aa, Homo Sapiens
YARSIFGEDAL

SEQ ID NO: 59798 - protein, 11 aa, Homo Sapiens
YAYNPLAGGLL

SEQ ID NO: 59799 - protein, 11 aa, Homo Sapiens
YDESGPSIVHR

SEQ ID NO: 59800 - protein, 11 aa, Homo Sapiens
YKVPQLEIVPN

SEQ ID NO: 59801 - protein, 11 aa, Homo Sapiens
YTIPPMEKAVV

SEQ ID NO: 59802 - protein, 11 aa, Homo Sapiens
YVFGKPFATPL

SEQ ID NO: 59803 - protein, 11 aa, Homo Sapiens
YVPPPFAAAAI

SEQ ID NO: 59804 - protein, 11 aa, Homo Sapiens
YVSDAFHKAFL

SEQ ID NO: 59805 - protein, 8 aa, Homo Sapiens
AIRHQRAL

SEQ ID NO: 59806 - protein, 8 aa, Homo Sapiens
CVFKKIER

SEQ ID NO: 59807 - protein, 8 aa, Homo Sapiens
EEQLQQIR

SEQ ID NO: 59808 - protein, 8 aa, Homo Sapiens
ITTTINPR

SEQ ID NO: 59809 - protein, 8 aa, Homo Sapiens
KIRVPFLR

SEQ ID NO: 59810 - protein, 8 aa, Homo Sapiens
KKGKPELR

SEQ ID NO: 59811 - protein, 8 aa, Homo Sapiens
KMRIPVAR

SEQ ID NO: 59812 - protein, 8 aa, Homo Sapiens
KTQIPTQR

SEQ ID NO: 59813 - protein, 8 aa, Homo Sapiens
KTWLPSCR

SEQ ID NO: 59814 - protein, 8 aa, Homo Sapiens
KVWVPKQK

SEQ ID NO: 59815 - protein, 8 aa, Homo Sapiens
KWLSLLQR

SEQ ID NO: 59816 - protein, 8 aa, Homo Sapiens
LLCNVILW

SEQ ID NO: 59817 - protein, 8 aa, Homo Sapiens
LSRTARAW

SEQ ID NO: 59818 - protein, 8 aa, Homo Sapiens
MSLTACKV

SEQ ID NO: 59819 - protein, 8 aa, Homo Sapiens
QRSRVAYR

SEQ ID NO: 59820 - protein, 8 aa, Homo Sapiens
RIFVHYPR

SEQ ID NO: 59821 - protein, 8 aa, Homo Sapiens
RIGVITNR

SEQ ID NO: 59822 - protein, 8 aa, Homo Sapiens
RIRAPIMR

SEQ ID NO: 59823 - protein, 8 aa, Homo Sapiens
RISKPHLR

SEQ ID NO: 59824 - protein, 8 aa, Homo Sapiens
RISLQWLR

SEQ ID NO: 59825 - protein, 8 aa, Homo Sapiens
RLKSPVLR

SEQ ID NO: 59826 - protein, 8 aa, Homo Sapiens
RLLLPHNR

SEQ ID NO: 59827 - protein, 8 aa, Homo Sapiens
RLREPLLR

SEQ ID NO: 59828 - protein, 8 aa, Homo Sapiens
RMGLSMER

SEQ ID NO: 59829 - protein, 8 aa, Homo Sapiens
RMGPVMDR

SEQ ID NO: 59830 - protein, 8 aa, Homo Sapiens
RSKQGFPR

SEQ ID NO: 59831 - protein, 8 aa, Homo Sapiens
RTSKPVFR

SEQ ID NO: 59832 - protein, 8 aa, Homo Sapiens
RVFKTVNR

SEQ ID NO: 59833 - protein, 8 aa, Homo Sapiens
RVKESITR

SEQ ID NO: 59834 - protein, 8 aa, Homo Sapiens
RVTKVLGR

SEQ ID NO: 59835 - protein, 8 aa, Homo Sapiens
TVKWFNVR

SEQ ID NO: 59836 - protein, 8 aa, Homo Sapiens
YDRQGIGR

SEQ ID NO: 59837 - protein, 8 aa, Homo Sapiens
YWVPRNAL

SEQ ID NO: 59838 - protein, 9 aa, Homo Sapiens
AGKSVHVLR

SEQ ID NO: 59839 - protein, 9 aa, Homo Sapiens
AIFTKAYQR

SEQ ID NO: 59840 - protein, 9 aa, Homo Sapiens
AIKIQSVYR

SEQ ID NO: 59841 - protein, 9 aa, Homo Sapiens
AIKPFYQKR

SEQ ID NO: 59842 - protein, 9 aa, Homo Sapiens
AIKSVKIYR

SEQ ID NO: 59843 - protein, 9 aa, Homo Sapiens
AINYPTVPR

SEQ ID NO: 59844 - protein, 9 aa, Homo Sapiens
AIQDKKNFR

SEQ ID NO: 59845 - protein, 9 aa, Homo Sapiens
AIREHLCIR

SEQ ID NO: 59846 - protein, 9 aa, Homo Sapiens
AIRQVITTR

SEQ ID NO: 59847 - protein, 9 aa, Homo Sapiens
AIRSSVIPR

SEQ ID NO: 59848 - protein, 9 aa, Homo Sapiens
AIWSGAALR

SEQ ID NO: 59849 - protein, 9 aa, Homo Sapiens
AIYKFQSRR

SEQ ID NO: 59850 - protein, 9 aa, Homo Sapiens
ALAALIFRR

SEQ ID NO: 59851 - protein, 9 aa, Homo Sapiens
ALAEFHVQR

SEQ ID NO: 59852 - protein, 9 aa, Homo Sapiens
ALAEYVIYR

SEQ ID NO: 59853 - protein, 9 aa, Homo Sapiens
ALFAGGKLR

SEQ ID NO: 59854 - protein, 9 aa, Homo Sapiens
ALFGANANR

SEQ ID NO: 59855 - protein, 9 aa, Homo Sapiens
ALFGCPNPR

SEQ ID NO: 59856 - protein, 9 aa, Homo Sapiens
ALFLFQEPR

SEQ ID NO: 59857 - protein, 9 aa, Homo Sapiens
ALFNTRIPR

SEQ ID NO: 59858 - protein, 9 aa, Homo Sapiens
ALKERIELR

SEQ ID NO: 59859 - protein, 9 aa, Homo Sapiens
ALLGVPHCR

SEQ ID NO: 59860 - protein, 9 aa, Homo Sapiens
ALNAHTFLR

SEQ ID NO: 59861 - protein, 9 aa, Homo Sapiens
ALNDVTAAR

SEQ ID NO: 59862 - protein, 9 aa, Homo Sapiens
ALNEEIVNR

SEQ ID NO: 59863 - protein, 9 aa, Homo Sapiens
ALNGKIYFR

SEQ ID NO: 59864 - protein, 9 aa, Homo Sapiens
ALNPINVKR

SEQ ID NO: 59865 - protein, 9 aa, Homo Sapiens
ALNSKAYKR

SEQ ID NO: 59866 - protein, 9 aa, Homo Sapiens
ALNSNNFVR

SEQ ID NO: 59867 - protein, 9 aa, Homo Sapiens
ALNVITKKR

SEQ ID NO: 59868 - protein, 9 aa, Homo Sapiens
ALNVLLFYR

SEQ ID NO: 59869 - protein, 9 aa, Homo Sapiens
ALNVPLHNR

SEQ ID NO: 59870 - protein, 9 aa, Homo Sapiens
ALQSMISSR

SEQ ID NO: 59871 - protein, 9 aa, Homo Sapiens
ALQTRLAKR

SEQ ID NO: 59872 - protein, 9 aa, Homo Sapiens
ALRDTPIPR

SEQ ID NO: 59873 - protein, 9 aa, Homo Sapiens
ALRGKVYQR

SEQ ID NO: 59874 - protein, 9 aa, Homo Sapiens
ALRRSPVPR

SEQ ID NO: 59875 - protein, 9 aa, Homo Sapiens
ALRSGPSLR

SEQ ID NO: 59876 - protein, 9 aa, Homo Sapiens
ALRSPLAQR

SEQ ID NO: 59877 - protein, 9 aa, Homo Sapiens
ALSGFTIFR

SEQ ID NO: 59878 - protein, 9 aa, Homo Sapiens
ALSHHLVAR

SEQ ID NO: 59879 - protein, 9 aa, Homo Sapiens
ALTEKQWLR

SEQ ID NO: 59880 - protein, 9 aa, Homo Sapiens
ALWRWTQVR

SEQ ID NO: 59881 - protein, 9 aa, Homo Sapiens
ALYGDKKPR

SEQ ID NO: 59882 - protein, 9 aa, Homo Sapiens
ALYRGPITR

SEQ ID NO: 59883 - protein, 9 aa, Homo Sapiens
AMGINMPAR

SEQ ID NO: 59884 - protein, 9 aa, Homo Sapiens
AMITVHTPR

SEQ ID NO: 59885 - protein, 9 aa, Homo Sapiens
AMRDSIHAR

SEQ ID NO: 59886 - protein, 9 aa, Homo Sapiens
AMWNRPCQR

SEQ ID NO: 59887 - protein, 9 aa, Homo Sapiens
AMWQKNFKR

SEQ ID NO: 59888 - protein, 9 aa, Homo Sapiens
AQADPLVRR

SEQ ID NO: 59889 - protein, 9 aa, Homo Sapiens
AQIKATVKR

SEQ ID NO: 59890 - protein, 9 aa, Homo Sapiens
AQKKASFLR

SEQ ID NO: 59891 - protein, 9 aa, Homo Sapiens
AQMSSVFQR

SEQ ID NO: 59892 - protein, 9 aa, Homo Sapiens
AQNPSLFVK

SEQ ID NO: 59893 - protein, 9 aa, Homo Sapiens
AQNSGLTLR

SEQ ID NO: 59894 - protein, 9 aa, Homo Sapiens
AQQLITICR

SEQ ID NO: 59895 - protein, 9 aa, Homo Sapiens
AQRDPIIAK

SEQ ID NO: 59896 - protein, 9 aa, Homo Sapiens
AQTGLLWLR

SEQ ID NO: 59897 - protein, 9 aa, Homo Sapiens
AQWQKVLPR

SEQ ID NO: 59898 - protein, 9 aa, Homo Sapiens
ASFGGLASR

SEQ ID NO: 59899 - protein, 9 aa, Homo Sapiens
ASIDWLAQR

SEQ ID NO: 59900 - protein, 9 aa, Homo Sapiens
ASLHWTSER

SEQ ID NO: 59901 - protein, 9 aa, Homo Sapiens
ASNPATFQR

SEQ ID NO: 59902 - protein, 9 aa, Homo Sapiens
ASQAFAAQR

SEQ ID NO: 59903 - protein, 9 aa, Homo Sapiens
ASQGFRFLR

SEQ ID NO: 59904 - protein, 9 aa, Homo Sapiens
ASRIRIALR

SEQ ID NO: 59905 - protein, 9 aa, Homo Sapiens
ASRPPVTLR

SEQ ID NO: 59906 - protein, 9 aa, Homo Sapiens
ASYKWNVSR

SEQ ID NO: 59907 - protein, 9 aa, Homo Sapiens
ASYYKDALR

SEQ ID NO: 59908 - protein, 9 aa, Homo Sapiens
ATAELIMSR

SEQ ID NO: 59909 - protein, 9 aa, Homo Sapiens
ATASLRKLR

SEQ ID NO: 59910 - protein, 9 aa, Homo Sapiens
ATATVYFKR

SEQ ID NO: 59911 - protein, 9 aa, Homo Sapiens
ATELWTYVR

SEQ ID NO: 59912 - protein, 9 aa, Homo Sapiens
ATFLPKWTR

SEQ ID NO: 59913 - protein, 9 aa, Homo Sapiens
ATFPGMWER

SEQ ID NO: 59914 - protein, 9 aa, Homo Sapiens
ATFQFTVER

SEQ ID NO: 59915 - protein, 9 aa, Homo Sapiens
ATIALMIQR

SEQ ID NO: 59916 - protein, 9 aa, Homo Sapiens
ATIQGAYAR

SEQ ID NO: 59917 - protein, 9 aa, Homo Sapiens
ATKFKQLYR

SEQ ID NO: 59918 - protein, 9 aa, Homo Sapiens
ATKILTELR

SEQ ID NO: 59919 - protein, 9 aa, Homo Sapiens
ATKNGILYR

SEQ ID NO: 59920 - protein, 9 aa, Homo Sapiens
ATKQYALGR

SEQ ID NO: 59921 - protein, 9 aa, Homo Sapiens
ATLLRPVLR

SEQ ID NO: 59922 - protein, 9 aa, Homo Sapiens
ATLNVSTTR

SEQ ID NO: 59923 - protein, 9 aa, Homo Sapiens
ATLQYIVGR

SEQ ID NO: 59924 - protein, 9 aa, Homo Sapiens
ATLYLGWNR

SEQ ID NO: 59925 - protein, 9 aa, Homo Sapiens
ATNILTATR

SEQ ID NO: 59926 - protein, 9 aa, Homo Sapiens
ATQSFSTFR

SEQ ID NO: 59927 - protein, 9 aa, Homo Sapiens
ATRAGLQVR

SEQ ID NO: 59928 - protein, 9 aa, Homo Sapiens
ATRGLPAAR

SEQ ID NO: 59929 - protein, 9 aa, Homo Sapiens
ATRKNLFER

SEQ ID NO: 59930 - protein, 9 aa, Homo Sapiens
ATRLGYFGR

SEQ ID NO: 59931 - protein, 9 aa, Homo Sapiens
ATRLLAEKR

SEQ ID NO: 59932 - protein, 9 aa, Homo Sapiens
ATRPVTPPR

SEQ ID NO: 59933 - protein, 9 aa, Homo Sapiens
ATRSFPQLR

SEQ ID NO: 59934 - protein, 9 aa, Homo Sapiens
ATRWPLAVR

SEQ ID NO: 59935 - protein, 9 aa, Homo Sapiens
ATSAVTVTR

SEQ ID NO: 59936 - protein, 9 aa, Homo Sapiens
ATSGVVAVR

SEQ ID NO: 59937 - protein, 9 aa, Homo Sapiens
ATSPALFNR

SEQ ID NO: 59938 - protein, 9 aa, Homo Sapiens
ATSPLQENR

SEQ ID NO: 59939 - protein, 9 aa, Homo Sapiens
ATSPVVYTR

SEQ ID NO: 59940 - protein, 9 aa, Homo Sapiens
ATSRTYLYR

SEQ ID NO: 59941 - protein, 9 aa, Homo Sapiens
ATTPIFANR

SEQ ID NO: 59942 - protein, 9 aa, Homo Sapiens
ATWFNQPAR

SEQ ID NO: 59943 - protein, 9 aa, Homo Sapiens
ATYGKPVHH

SEQ ID NO: 59944 - protein, 9 aa, Homo Sapiens
ATYGLNVER

SEQ ID NO: 59945 - protein, 9 aa, Homo Sapiens
ATYPYQVVR

SEQ ID NO: 59946 - protein, 9 aa, Homo Sapiens
AVAAVAARR

SEQ ID NO: 59947 - protein, 9 aa, Homo Sapiens
AVANFIRQR

SEQ ID NO: 59948 - protein, 9 aa, Homo Sapiens
AVCSIVTQR

SEQ ID NO: 59949 - protein, 9 aa, Homo Sapiens
AVFAGFEGR

SEQ ID NO: 59950 - protein, 9 aa, Homo Sapiens
AVFSRISTR

SEQ ID NO: 59951 - protein, 9 aa, Homo Sapiens
AVFYTFVFR

SEQ ID NO: 59952 - protein, 9 aa, Homo Sapiens
AVGGVYHPR

SEQ ID NO: 59953 - protein, 9 aa, Homo Sapiens
AVHDLLRPR

SEQ ID NO: 59954 - protein, 9 aa, Homo Sapiens
AVKDWANQR

SEQ ID NO: 59955 - protein, 9 aa, Homo Sapiens
AVLKITAQR

SEQ ID NO: 59956 - protein, 9 aa, Homo Sapiens
AVMGNPVTR

SEQ ID NO: 59957 - protein, 9 aa, Homo Sapiens
AVMKNQVAR

SEQ ID NO: 59958 - protein, 9 aa, Homo Sapiens
AVNKFGVGR

SEQ ID NO: 59959 - protein, 9 aa, Homo Sapiens
AVRALVASR

SEQ ID NO: 59960 - protein, 9 aa, Homo Sapiens
AVRPGDRVL

SEQ ID NO: 59961 - protein, 9 aa, Homo Sapiens
AVRPVIEKR

SEQ ID NO: 59962 - protein, 9 aa, Homo Sapiens
AVRQPVFLR

SEQ ID NO: 59963 - protein, 9 aa, Homo Sapiens
AVTAFVTFR

SEQ ID NO: 59964 - protein, 9 aa, Homo Sapiens
AVYDFFIGR

SEQ ID NO: 59965 - protein, 9 aa, Homo Sapiens
AVYEINVLR

SEQ ID NO: 59966 - protein, 9 aa, Homo Sapiens
GLAGVCALR

SEQ ID NO: 59967 - protein, 9 aa, Homo Sapiens
GLFEKRRFR

SEQ ID NO: 59968 - protein, 9 aa, Homo Sapiens
GLFSGLIPR

SEQ ID NO: 59969 - protein, 9 aa, Homo Sapiens
GLFSVCYPR

SEQ ID NO: 59970 - protein, 9 aa, Homo Sapiens
GLGGTLPPR

SEQ ID NO: 59971 - protein, 9 aa, Homo Sapiens
GLKGYVAER

SEQ ID NO: 59972 - protein, 9 aa, Homo Sapiens
GLKQVIIPR

SEQ ID NO: 59973 - protein, 9 aa, Homo Sapiens
GMRPGVAYR

SEQ ID NO: 59974 - protein, 9 aa, Homo Sapiens
GQRPHHFLR

SEQ ID NO: 59975 - protein, 9 aa, Homo Sapiens
GQRVFVVKR

SEQ ID NO: 59976 - protein, 9 aa, Homo Sapiens
GSRSFIINR

SEQ ID NO: 59977 - protein, 9 aa, Homo Sapiens
GSWQGPPPR

SEQ ID NO: 59978 - protein, 9 aa, Homo Sapiens
GSYHPGVFR

SEQ ID NO: 59979 - protein, 9 aa, Homo Sapiens
GSYSKAFAR

SEQ ID NO: 59980 - protein, 9 aa, Homo Sapiens
GTACGKYYR

SEQ ID NO: 59981 - protein, 9 aa, Homo Sapiens
GTADVHFER

SEQ ID NO: 59982 - protein, 9 aa, Homo Sapiens
GTAKWAWLR

SEQ ID NO: 59983 - protein, 9 aa, Homo Sapiens
GTGPNVPPR

SEQ ID NO: 59984 - protein, 9 aa, Homo Sapiens
GTIGKKFAR

SEQ ID NO: 59985 - protein, 9 aa, Homo Sapiens
GTKEICVVR

SEQ ID NO: 59986 - protein, 9 aa, Homo Sapiens
GTQSFVFQR

SEQ ID NO: 59987 - protein, 9 aa, Homo Sapiens
GTRYGASLR

SEQ ID NO: 59988 - protein, 9 aa, Homo Sapiens
GTSQLYVYR

SEQ ID NO: 59989 - protein, 9 aa, Homo Sapiens
GTSSVIVSR

SEQ ID NO: 59990 - protein, 9 aa, Homo Sapiens
GTVKWFNVR

SEQ ID NO: 59991 - protein, 9 aa, Homo Sapiens
GTWNWIWRR

SEQ ID NO: 59992 - protein, 9 aa, Homo Sapiens
GTYPWVVDR

SEQ ID NO: 59993 - protein, 9 aa, Homo Sapiens
GTYTDVTPR

SEQ ID NO: 59994 - protein, 9 aa, Homo Sapiens
GTYVSSVPR

SEQ ID NO: 59995 - protein, 9 aa, Homo Sapiens
GVANALAHR

SEQ ID NO: 59996 - protein, 9 aa, Homo Sapiens
GVMPSHFSR

SEQ ID NO: 59997 - protein, 9 aa, Homo Sapiens
GVNQLKFAR

SEQ ID NO: 59998 - protein, 9 aa, Homo Sapiens
GVRPPVGNR

SEQ ID NO: 59999 - protein, 9 aa, Homo Sapiens
GVRTPVPPR

SEQ ID NO: 60000 - protein, 9 aa, Homo Sapiens
HIHSVIILR

SEQ ID NO: 60001 - protein, 9 aa, Homo Sapiens
HINTVFVLR

SEQ ID NO: 60002 - protein, 9 aa, Homo Sapiens
HIQEIRTLR

SEQ ID NO: 60003 - protein, 9 aa, Homo Sapiens
HIQPGTVNR

SEQ ID NO: 60004 - protein, 9 aa, Homo Sapiens
HLFDHVTVR

SEQ ID NO: 60005 - protein, 9 aa, Homo Sapiens
HLFDHVVNR

SEQ ID NO: 60006 - protein, 9 aa, Homo Sapiens
HLFGGIAER

SEQ ID NO: 60007 - protein, 9 aa, Homo Sapiens
HLFPYVKKR

SEQ ID NO: 60008 - protein, 9 aa, Homo Sapiens
HLFQYPCAR

SEQ ID NO: 60009 - protein, 9 aa, Homo Sapiens
HLKEDLNLR

SEQ ID NO: 60010 - protein, 9 aa, Homo Sapiens
HLKEIISYR

SEQ ID NO: 60011 - protein, 9 aa, Homo Sapiens
HLLADVARF

SEQ ID NO: 60012 - protein, 9 aa, Homo Sapiens
HLNAQQVSR

SEQ ID NO: 60013 - protein, 9 aa, Homo Sapiens
HLNAVRIQR

SEQ ID NO: 60014 - protein, 9 aa, Homo Sapiens
HLNGLTETR

SEQ ID NO: 60015 - protein, 9 aa, Homo Sapiens
HLRDGISAR

SEQ ID NO: 60016 - protein, 9 aa, Homo Sapiens
HLYGFPQPR

SEQ ID NO: 60017 - protein, 9 aa, Homo Sapiens
HQRGLTVLR

SEQ ID NO: 60018 - protein, 9 aa, Homo Sapiens
HQVDFTFDR

SEQ ID NO: 60019 - protein, 9 aa, Homo Sapiens
HSMALIHNR

SEQ ID NO: 60020 - protein, 9 aa, Homo Sapiens
HSMDFVAYR

SEQ ID NO: 60021 - protein, 9 aa, Homo Sapiens
HSYYNVWLR

SEQ ID NO: 60022 - protein, 9 aa, Homo Sapiens
HTFDHINKR

SEQ ID NO: 60023 - protein, 9 aa, Homo Sapiens
HTLEPLIPR

SEQ ID NO: 60024 - protein, 9 aa, Homo Sapiens
HTNAVATVR

SEQ ID NO: 60025 - protein, 9 aa, Homo Sapiens
HTRHYELYR

SEQ ID NO: 60026 - protein, 9 aa, Homo Sapiens
HVHEPNPLR

SEQ ID NO: 60027 - protein, 9 aa, Homo Sapiens
HVRTWSVTR

SEQ ID NO: 60028 - protein, 9 aa, Homo Sapiens
IAPGVTHEL

SEQ ID NO: 60029 - protein, 9 aa, Homo Sapiens
IIAAKKVLR

SEQ ID NO: 60030 - protein, 9 aa, Homo Sapiens
IIFVKSVQR

SEQ ID NO: 60031 - protein, 9 aa, Homo Sapiens
IINKVTRNR

SEQ ID NO: 60032 - protein, 9 aa, Homo Sapiens
IIQKYIRAR

SEQ ID NO: 60033 - protein, 9 aa, Homo Sapiens
IIQSTPYGR

SEQ ID NO: 60034 - protein, 9 aa, Homo Sapiens
ILAPRPWSR

SEQ ID NO: 60035 - protein, 9 aa, Homo Sapiens
ILFGKKYEK

SEQ ID NO: 60036 - protein, 9 aa, Homo Sapiens
ILHFGLPPR

SEQ ID NO: 60037 - protein, 9 aa, Homo Sapiens
ILKAQVAAR

SEQ ID NO: 60038 - protein, 9 aa, Homo Sapiens
ILKTITHPR

SEQ ID NO: 60039 - protein, 9 aa, Homo Sapiens
ILNGGPSKR

SEQ ID NO: 60040 - protein, 9 aa, Homo Sapiens
ILNSNHIGR

SEQ ID NO: 60041 - protein, 9 aa, Homo Sapiens
ILNTWISLK

SEQ ID NO: 60042 - protein, 9 aa, Homo Sapiens
ILQILSLNR

SEQ ID NO: 60043 - protein, 9 aa, Homo Sapiens
ILQQQVNPR

SEQ ID NO: 60044 - protein, 9 aa, Homo Sapiens
ILRDFFELR

SEQ ID NO: 60045 - protein, 9 aa, Homo Sapiens
ILRPVFQQR

SEQ ID NO: 60046 - protein, 9 aa, Homo Sapiens
ILRTEQWPR

SEQ ID NO: 60047 - protein, 9 aa, Homo Sapiens
ILSKPPAER

SEQ ID NO: 60048 - protein, 9 aa, Homo Sapiens
ILYEKPHFR

SEQ ID NO: 60049 - protein, 9 aa, Homo Sapiens
ILYPATTGR

SEQ ID NO: 60050 - protein, 9 aa, Homo Sapiens
IMKVHRIYR

SEQ ID NO: 60051 - protein, 9 aa, Homo Sapiens
IQAGIYATR

SEQ ID NO: 60052 - protein, 9 aa, Homo Sapiens
IQAGYSSPR

SEQ ID NO: 60053 - protein, 9 aa, Homo Sapiens
IQKEQNYQR

SEQ ID NO: 60054 - protein, 9 aa, Homo Sapiens
IQNRFKYAR

SEQ ID NO: 60055 - protein, 9 aa, Homo Sapiens
IQSSFVVER

SEQ ID NO: 60056 - protein, 9 aa, Homo Sapiens
IQVSQIVAR

SEQ ID NO: 60057 - protein, 9 aa, Homo Sapiens
ISHHWPFQR

SEQ ID NO: 60058 - protein, 9 aa, Homo Sapiens
ITQIEHEVS

SEQ ID NO: 60059 - protein, 9 aa, Homo Sapiens
ITRIFGVKR

SEQ ID NO: 60060 - protein, 9 aa, Homo Sapiens
ITYLMEHKR

SEQ ID NO: 60061 - protein, 9 aa, Homo Sapiens
IVHGDLSPR

SEQ ID NO: 60062 - protein, 9 aa, Homo Sapiens
IVHTVTVKR

SEQ ID NO: 60063 - protein, 9 aa, Homo Sapiens
IVKEFQRNR

SEQ ID NO: 60064 - protein, 9 aa, Homo Sapiens
IVKKNFDLR

SEQ ID NO: 60065 - protein, 9 aa, Homo Sapiens
IVKPPASAR

SEQ ID NO: 60066 - protein, 9 aa, Homo Sapiens
IVNENLVER

SEQ ID NO: 60067 - protein, 9 aa, Homo Sapiens
IVPGNVKSL

SEQ ID NO: 60068 - protein, 9 aa, Homo Sapiens
IVQQFGYQR

SEQ ID NO: 60069 - protein, 9 aa, Homo Sapiens
IVRANLARV

SEQ ID NO: 60070 - protein, 9 aa, Homo Sapiens
KAANVLITR

SEQ ID NO: 60071 - protein, 9 aa, Homo Sapiens
KAFDRITTR

SEQ ID NO: 60072 - protein, 9 aa, Homo Sapiens
KAKSIVFHR

SEQ ID NO: 60073 - protein, 9 aa, Homo Sapiens
KAKYPPVNR

SEQ ID NO: 60074 - protein, 9 aa, Homo Sapiens
KAPGSTSNL

SEQ ID NO: 60075 - protein, 9 aa, Homo Sapiens
KAPVTKVAA

SEQ ID NO: 60076 - protein, 9 aa, Homo Sapiens
KIADFGLAR

SEQ ID NO: 60077 - protein, 9 aa, Homo Sapiens
KIAEHIAGR

SEQ ID NO: 60078 - protein, 9 aa, Homo Sapiens
KIALKEITR

SEQ ID NO: 60079 - protein, 9 aa, Homo Sapiens
KIAVHCTVR

SEQ ID NO: 60080 - protein, 9 aa, Homo Sapiens
KICFIPRYR

SEQ ID NO: 60081 - protein, 9 aa, Homo Sapiens
KICGKAFSR

SEQ ID NO: 60082 - protein, 9 aa, Homo Sapiens
KIFAGKVLR

SEQ ID NO: 60083 - protein, 9 aa, Homo Sapiens
KIFGNKEMR

SEQ ID NO: 60084 - protein, 9 aa, Homo Sapiens
KIGSFLSNR

SEQ ID NO: 60085 - protein, 9 aa, Homo Sapiens
KIIAKIQQR

SEQ ID NO: 60086 - protein, 9 aa, Homo Sapiens
KIIEPIQSR

SEQ ID NO: 60087 - protein, 9 aa, Homo Sapiens
KIIVNRLAR

SEQ ID NO: 60088 - protein, 9 aa, Homo Sapiens
KIKDTVLQR

SEQ ID NO: 60089 - protein, 9 aa, Homo Sapiens
KIKELYRRR

SEQ ID NO: 60090 - protein, 9 aa, Homo Sapiens
KIKFPLPHR

SEQ ID NO: 60091 - protein, 9 aa, Homo Sapiens
KIKNYILMR

SEQ ID NO: 60092 - protein, 9 aa, Homo Sapiens
KIKPRNITR

SEQ ID NO: 60093 - protein, 9 aa, Homo Sapiens
KILGPFHKR

SEQ ID NO: 60094 - protein, 9 aa, Homo Sapiens
KILKDIANR

SEQ ID NO: 60095 - protein, 9 aa, Homo Sapiens
KIMLKVYSR

SEQ ID NO: 60096 - protein, 9 aa, Homo Sapiens
KIMLPPRNR

SEQ ID NO: 60097 - protein, 9 aa, Homo Sapiens
KINLIIHQR

SEQ ID NO: 60098 - protein, 9 aa, Homo Sapiens
KINLRIQTR

SEQ ID NO: 60099 - protein, 9 aa, Homo Sapiens
KINPVQQSR

SEQ ID NO: 60100 - protein, 9 aa, Homo Sapiens
KINSLAHLR

SEQ ID NO: 60101 - protein, 9 aa, Homo Sapiens
KIRIEDPPR

SEQ ID NO: 60102 - protein, 9 aa, Homo Sapiens
KIRIFDLGR

SEQ ID NO: 60103 - protein, 9 aa, Homo Sapiens
KIRKTFVQR

SEQ ID NO: 60104 - protein, 9 aa, Homo Sapiens
KISGFPKNR

SEQ ID NO: 60105 - protein, 9 aa, Homo Sapiens
KISSFLRQR

SEQ ID NO: 60106 - protein, 9 aa, Homo Sapiens
KISSPKVGR

SEQ ID NO: 60107 - protein, 9 aa, Homo Sapiens
KISSTAVTR

SEQ ID NO: 60108 - protein, 9 aa, Homo Sapiens
KIWQNLRLK

SEQ ID NO: 60109 - protein, 9 aa, Homo Sapiens
KLAFSKVLR

SEQ ID NO: 60110 - protein, 9 aa, Homo Sapiens
KLALRYAGR

SEQ ID NO: 60111 - protein, 9 aa, Homo Sapiens
KLAPEFAKR

SEQ ID NO: 60112 - protein, 9 aa, Homo Sapiens
KLAPFIAKR

SEQ ID NO: 60113 - protein, 9 aa, Homo Sapiens
KLASDPALR

SEQ ID NO: 60114 - protein, 9 aa, Homo Sapiens
KLASYQAAR

SEQ ID NO: 60115 - protein, 9 aa, Homo Sapiens
KLAVAIALR

SEQ ID NO: 60116 - protein, 9 aa, Homo Sapiens
KLCGYVIFR

SEQ ID NO: 60117 - protein, 9 aa, Homo Sapiens
KLDRPRFER

SEQ ID NO: 60118 - protein, 9 aa, Homo Sapiens
KLDSVRVLR

SEQ ID NO: 60119 - protein, 9 aa, Homo Sapiens
KLFAIIVGR

SEQ ID NO: 60120 - protein, 9 aa, Homo Sapiens
KLFEKSKCR

SEQ ID NO: 60121 - protein, 9 aa, Homo Sapiens
KLFELYTKR

SEQ ID NO: 60122 - protein, 9 aa, Homo Sapiens
KLFNGTFLK

SEQ ID NO: 60123 - protein, 9 aa, Homo Sapiens
KLFQAPCQR

SEQ ID NO: 60124 - protein, 9 aa, Homo Sapiens
KLFSPVIAR

SEQ ID NO: 60125 - protein, 9 aa, Homo Sapiens
KLFSVTRNR

SEQ ID NO: 60126 - protein, 9 aa, Homo Sapiens
KLFVGFLNR

SEQ ID NO: 60127 - protein, 9 aa, Homo Sapiens
KLGKITFIR

SEQ ID NO: 60128 - protein, 9 aa, Homo Sapiens
KLHDMIIKR

SEQ ID NO: 60129 - protein, 9 aa, Homo Sapiens
KLHTSIAGR

SEQ ID NO: 60130 - protein, 9 aa, Homo Sapiens
KLIPVHQVR

SEQ ID NO: 60131 - protein, 9 aa, Homo Sapiens
KLISGWVSR

SEQ ID NO: 60132 - protein, 9 aa, Homo Sapiens
KLKAIVASK

SEQ ID NO: 60133 - protein, 9 aa, Homo Sapiens
KLKEILKER

SEQ ID NO: 60134 - protein, 9 aa, Homo Sapiens
KLKGIGKPR

SEQ ID NO: 60135 - protein, 9 aa, Homo Sapiens
KLKKPEAVR

SEQ ID NO: 60136 - protein, 9 aa, Homo Sapiens
KLKSFESER

SEQ ID NO: 60137 - protein, 9 aa, Homo Sapiens
KLKWIVSGR

SEQ ID NO: 60138 - protein, 9 aa, Homo Sapiens
KLKYLAFLR

SEQ ID NO: 60139 - protein, 9 aa, Homo Sapiens
KLLACIASR

SEQ ID NO: 60140 - protein, 9 aa, Homo Sapiens
KLLESIFHR

SEQ ID NO: 60141 - protein, 9 aa, Homo Sapiens
KLLEVWFSR

SEQ ID NO: 60142 - protein, 9 aa, Homo Sapiens
KLLGGLAVR

SEQ ID NO: 60143 - protein, 9 aa, Homo Sapiens
KLLQPLVPR

SEQ ID NO: 60144 - protein, 9 aa, Homo Sapiens
KLLSTSAKR

SEQ ID NO: 60145 - protein, 9 aa, Homo Sapiens
KLMVHLVER

SEQ ID NO: 60146 - protein, 9 aa, Homo Sapiens
KLNEIWHRR

SEQ ID NO: 60147 - protein, 9 aa, Homo Sapiens
KLNEVIVTR

SEQ ID NO: 60148 - protein, 9 aa, Homo Sapiens
KLNIMAAKR

SEQ ID NO: 60149 - protein, 9 aa, Homo Sapiens
KLNIPAILR

SEQ ID NO: 60150 - protein, 9 aa, Homo Sapiens
KLNIPGCYR

SEQ ID NO: 60151 - protein, 9 aa, Homo Sapiens
KLNIRPLLR

SEQ ID NO: 60152 - protein, 9 aa, Homo Sapiens
KLNPQQFEV

SEQ ID NO: 60153 - protein, 9 aa, Homo Sapiens
KLNPRKIIR

SEQ ID NO: 60154 - protein, 9 aa, Homo Sapiens
KLQDAGVYR

SEQ ID NO: 60155 - protein, 9 aa, Homo Sapiens
KLQDERTVR

SEQ ID NO: 60156 - protein, 9 aa, Homo Sapiens
KLQEAMKLR

SEQ ID NO: 60157 - protein, 9 aa, Homo Sapiens
KLQEMRAQR

SEQ ID NO: 60158 - protein, 9 aa, Homo Sapiens
KLQPPPLGR

SEQ ID NO: 60159 - protein, 9 aa, Homo Sapiens
KLQPPPVGR

SEQ ID NO: 60160 - protein, 9 aa, Homo Sapiens
KLQSGKISR

SEQ ID NO: 60161 - protein, 9 aa, Homo Sapiens
KLRANVNAR

SEQ ID NO: 60162 - protein, 9 aa, Homo Sapiens
KLRDFLLEH

SEQ ID NO: 60163 - protein, 9 aa, Homo Sapiens
KLRDWTPPR

SEQ ID NO: 60164 - protein, 9 aa, Homo Sapiens
KLREQVVKR

SEQ ID NO: 60165 - protein, 9 aa, Homo Sapiens
KLRGIVSEK

SEQ ID NO: 60166 - protein, 9 aa, Homo Sapiens
KLRQPFFQK

SEQ ID NO: 60167 - protein, 9 aa, Homo Sapiens
KLSGLPKHR

SEQ ID NO: 60168 - protein, 9 aa, Homo Sapiens
KLSIFIHKR

SEQ ID NO: 60169 - protein, 9 aa, Homo Sapiens
KLSIVPVRR

SEQ ID NO: 60170 - protein, 9 aa, Homo Sapiens
KLSKIRVVR

SEQ ID NO: 60171 - protein, 9 aa, Homo Sapiens
KLSPCTVTR

SEQ ID NO: 60172 - protein, 9 aa, Homo Sapiens
KLSPSPSLR

SEQ ID NO: 60173 - protein, 9 aa, Homo Sapiens
KLSPSPSSR

SEQ ID NO: 60174 - protein, 9 aa, Homo Sapiens
KLSSSFSSR

SEQ ID NO: 60175 - protein, 9 aa, Homo Sapiens
KLSSVSICR

SEQ ID NO: 60176 - protein, 9 aa, Homo Sapiens
KLSSYPRLR

SEQ ID NO: 60177 - protein, 9 aa, Homo Sapiens
KLSTFPANR

SEQ ID NO: 60178 - protein, 9 aa, Homo Sapiens
KLTDCVVMR

SEQ ID NO: 60179 - protein, 9 aa, Homo Sapiens
KLTFEELER

SEQ ID NO: 60180 - protein, 9 aa, Homo Sapiens
KLWDGSEAR

SEQ ID NO: 60181 - protein, 9 aa, Homo Sapiens
KLWDGVSNR

SEQ ID NO: 60182 - protein, 9 aa, Homo Sapiens
KLWEISTGR

SEQ ID NO: 60183 - protein, 9 aa, Homo Sapiens
KLWVIARER

SEQ ID NO: 60184 - protein, 9 aa, Homo Sapiens
KLYHKKIFR

SEQ ID NO: 60185 - protein, 9 aa, Homo Sapiens
KLYLPTGPR

SEQ ID NO: 60186 - protein, 9 aa, Homo Sapiens
KLYNKITSR

SEQ ID NO: 60187 - protein, 9 aa, Homo Sapiens
KLYPDSRVR

SEQ ID NO: 60188 - protein, 9 aa, Homo Sapiens
KLYPLPSAR

SEQ ID NO: 60189 - protein, 9 aa, Homo Sapiens
KLYPWIHQF

SEQ ID NO: 60190 - protein, 9 aa, Homo Sapiens
KLYSLLFRR

SEQ ID NO: 60191 - protein, 9 aa, Homo Sapiens
KMALSFVQR

SEQ ID NO: 60192 - protein, 9 aa, Homo Sapiens
KMFFTTKHR

SEQ ID NO: 60193 - protein, 9 aa, Homo Sapiens
KMFNALIHR

SEQ ID NO: 60194 - protein, 9 aa, Homo Sapiens
KMHTSQDFR

SEQ ID NO: 60195 - protein, 9 aa, Homo Sapiens
KMKPDVVLR

SEQ ID NO: 60196 - protein, 9 aa, Homo Sapiens
KMVGFIIGR

SEQ ID NO: 60197 - protein, 9 aa, Homo Sapiens
KMYEEHLKR

SEQ ID NO: 60198 - protein, 9 aa, Homo Sapiens
KNLFRTVLR

SEQ ID NO: 60199 - protein, 9 aa, Homo Sapiens
KQATLLLER

SEQ ID NO: 60200 - protein, 9 aa, Homo Sapiens
KQATMKALR

SEQ ID NO: 60201 - protein, 9 aa, Homo Sapiens
KQFFVAVER

SEQ ID NO: 60202 - protein, 9 aa, Homo Sapiens
KQKESWQLR

SEQ ID NO: 60203 - protein, 9 aa, Homo Sapiens
KQKSSLIWR

SEQ ID NO: 60204 - protein, 9 aa, Homo Sapiens
KQLEEEKRR

SEQ ID NO: 60205 - protein, 9 aa, Homo Sapiens
KQLGYSVYR

SEQ ID NO: 60206 - protein, 9 aa, Homo Sapiens
KQMSFLEKR

SEQ ID NO: 60207 - protein, 9 aa, Homo Sapiens
KQNDTKVLR

SEQ ID NO: 60208 - protein, 9 aa, Homo Sapiens
KQNPFWWTH

SEQ ID NO: 60209 - protein, 9 aa, Homo Sapiens
KQNVKIWGR

SEQ ID NO: 60210 - protein, 9 aa, Homo Sapiens
KQQEIVVSR

SEQ ID NO: 60211 - protein, 9 aa, Homo Sapiens
KQQELLRQR

SEQ ID NO: 60212 - protein, 9 aa, Homo Sapiens
KQQGVLALR

SEQ ID NO: 60213 - protein, 9 aa, Homo Sapiens
KQRLFENLR

SEQ ID NO: 60214 - protein, 9 aa, Homo Sapiens
KQRLIYQGR

SEQ ID NO: 60215 - protein, 9 aa, Homo Sapiens
KQWDYYARR

SEQ ID NO: 60216 - protein, 9 aa, Homo Sapiens
KQWKDVVER

SEQ ID NO: 60217 - protein, 9 aa, Homo Sapiens
KQWPKRSLR

SEQ ID NO: 60218 - protein, 9 aa, Homo Sapiens
KQYVTQINR

SEQ ID NO: 60219 - protein, 9 aa, Homo Sapiens
KSANICIGR

SEQ ID NO: 60220 - protein, 9 aa, Homo Sapiens
KSEKRTFLR

SEQ ID NO: 60221 - protein, 9 aa, Homo Sapiens
KSFDKNLYR

SEQ ID NO: 60222 - protein, 9 aa, Homo Sapiens
KSFGCPSVR

SEQ ID NO: 60223 - protein, 9 aa, Homo Sapiens
KSFGDLVSR

SEQ ID NO: 60224 - protein, 9 aa, Homo Sapiens
KSFQKIQVR

SEQ ID NO: 60225 - protein, 9 aa, Homo Sapiens
KSHLIIHQR

SEQ ID NO: 60226 - protein, 9 aa, Homo Sapiens
KSKLIIHQR

SEQ ID NO: 60227 - protein, 9 aa, Homo Sapiens
KSKPGQFIR

SEQ ID NO: 60228 - protein, 9 aa, Homo Sapiens
KSKVPAFVR

SEQ ID NO: 60229 - protein, 9 aa, Homo Sapiens
KSLIKSWKK

SEQ ID NO: 60230 - protein, 9 aa, Homo Sapiens
KSLLKEFKR

SEQ ID NO: 60231 - protein, 9 aa, Homo Sapiens
KSNGSVFVR

SEQ ID NO: 60232 - protein, 9 aa, Homo Sapiens
KSNLIVHQR

SEQ ID NO: 60233 - protein, 9 aa, Homo Sapiens
KSNLIVVQR

SEQ ID NO: 60234 - protein, 9 aa, Homo Sapiens
KSQIVTNVR

SEQ ID NO: 60235 - protein, 9 aa, Homo Sapiens
KSQLIIHQR

SEQ ID NO: 60236 - protein, 9 aa, Homo Sapiens
KSQLIVHQR

SEQ ID NO: 60237 - protein, 9 aa, Homo Sapiens
KSRDPFWNR

SEQ ID NO: 60238 - protein, 9 aa, Homo Sapiens
KSYLIIHQR

SEQ ID NO: 60239 - protein, 9 aa, Homo Sapiens
KTAGINVRK

SEQ ID NO: 60240 - protein, 9 aa, Homo Sapiens
KTAVAPIER

SEQ ID NO: 60241 - protein, 9 aa, Homo Sapiens
KTFEISIGR

SEQ ID NO: 60242 - protein, 9 aa, Homo Sapiens
KTFEKNVVR

SEQ ID NO: 60243 - protein, 9 aa, Homo Sapiens
KTFGQKPVK

SEQ ID NO: 60244 - protein, 9 aa, Homo Sapiens
KTFHGLLTR

SEQ ID NO: 60245 - protein, 9 aa, Homo Sapiens
KTFHRYTVR

SEQ ID NO: 60246 - protein, 9 aa, Homo Sapiens
KTFSEILNR

SEQ ID NO: 60247 - protein, 9 aa, Homo Sapiens
KTFYWREHL

SEQ ID NO: 60248 - protein, 9 aa, Homo Sapiens
KTHAVILSR

SEQ ID NO: 60249 - protein, 9 aa, Homo Sapiens
KTHNLLTTR

SEQ ID NO: 60250 - protein, 9 aa, Homo Sapiens
KTIDIREER

SEQ ID NO: 60251 - protein, 9 aa, Homo Sapiens
KTILKRLFR

SEQ ID NO: 60252 - protein, 9 aa, Homo Sapiens
KTIWSTMLR

SEQ ID NO: 60253 - protein, 9 aa, Homo Sapiens
KTKEGYYYR

SEQ ID NO: 60254 - protein, 9 aa, Homo Sapiens
KTKLPVTLR

SEQ ID NO: 60255 - protein, 9 aa, Homo Sapiens
KTLEGVITR

SEQ ID NO: 60256 - protein, 9 aa, Homo Sapiens
KTLGLAIKR

SEQ ID NO: 60257 - protein, 9 aa, Homo Sapiens
KTLGTVTPR

SEQ ID NO: 60258 - protein, 9 aa, Homo Sapiens
KTLLVNNNR

SEQ ID NO: 60259 - protein, 9 aa, Homo Sapiens
KTLPKIVGR

SEQ ID NO: 60260 - protein, 9 aa, Homo Sapiens
KTLPWGPKR

SEQ ID NO: 60261 - protein, 9 aa, Homo Sapiens
KTLRGINSR

SEQ ID NO: 60262 - protein, 9 aa, Homo Sapiens
KTMPTTFNR

SEQ ID NO: 60263 - protein, 9 aa, Homo Sapiens
KTNFRCALR

SEQ ID NO: 60264 - protein, 9 aa, Homo Sapiens
KTNFRLLKR

SEQ ID NO: 60265 - protein, 9 aa, Homo Sapiens
KTNGKFLIR

SEQ ID NO: 60266 - protein, 9 aa, Homo Sapiens
KTQEPFSVR

SEQ ID NO: 60267 - protein, 9 aa, Homo Sapiens
KTQPPLMKR

SEQ ID NO: 60268 - protein, 9 aa, Homo Sapiens
KTRPFEYLR

SEQ ID NO: 60269 - protein, 9 aa, Homo Sapiens
KTSMHWVVR

SEQ ID NO: 60270 - protein, 9 aa, Homo Sapiens
KTTKKIVLR

SEQ ID NO: 60271 - protein, 9 aa, Homo Sapiens
KTTTVKFNR

SEQ ID NO: 60272 - protein, 9 aa, Homo Sapiens
KTTYWICER

SEQ ID NO: 60273 - protein, 9 aa, Homo Sapiens
KTVRLVIGR

SEQ ID NO: 60274 - protein, 9 aa, Homo Sapiens
KTVSLVLQR

SEQ ID NO: 60275 - protein, 9 aa, Homo Sapiens
KTVYPASYR

SEQ ID NO: 60276 - protein, 9 aa, Homo Sapiens
KVAAIVVKR

SEQ ID NO: 60277 - protein, 9 aa, Homo Sapiens
KVFDVTKGR

SEQ ID NO: 60278 - protein, 9 aa, Homo Sapiens
KVFGGTVHK

SEQ ID NO: 60279 - protein, 9 aa, Homo Sapiens
KVFHRPWRR

SEQ ID NO: 60280 - protein, 9 aa, Homo Sapiens
KVFLFIRNR

SEQ ID NO: 60281 - protein, 9 aa, Homo Sapiens
KVIEKQLER

SEQ ID NO: 60282 - protein, 9 aa, Homo Sapiens
KVIPPIRSR

SEQ ID NO: 60283 - protein, 9 aa, Homo Sapiens
KVKEPPILR

SEQ ID NO: 60284 - protein, 9 aa, Homo Sapiens
KVKGLVSSR

SEQ ID NO: 60285 - protein, 9 aa, Homo Sapiens
KVKGPALSR

SEQ ID NO: 60286 - protein, 9 aa, Homo Sapiens
KVKNELFKR

SEQ ID NO: 60287 - protein, 9 aa, Homo Sapiens
KVLGPIHER

SEQ ID NO: 60288 - protein, 9 aa, Homo Sapiens
KVLRPFLLR

SEQ ID NO: 60289 - protein, 9 aa, Homo Sapiens
KVMGILINR

SEQ ID NO: 60290 - protein, 9 aa, Homo Sapiens
KVMNSAVMR

SEQ ID NO: 60291 - protein, 9 aa, Homo Sapiens
KVNDVEAIR

SEQ ID NO: 60292 - protein, 9 aa, Homo Sapiens
KVNLNTIKR

SEQ ID NO: 60293 - protein, 9 aa, Homo Sapiens
KVQERRFLR

SEQ ID NO: 60294 - protein, 9 aa, Homo Sapiens
KVRNFEVHR

SEQ ID NO: 60295 - protein, 9 aa, Homo Sapiens
KVSDWSYER

SEQ ID NO: 60296 - protein, 9 aa, Homo Sapiens
KVSGDIFSR

SEQ ID NO: 60297 - protein, 9 aa, Homo Sapiens
KVSKKEFLR

SEQ ID NO: 60298 - protein, 9 aa, Homo Sapiens
KVSLVTHQR

SEQ ID NO: 60299 - protein, 9 aa, Homo Sapiens
KVSPVSYLR

SEQ ID NO: 60300 - protein, 9 aa, Homo Sapiens
KVTEKIPVR

SEQ ID NO: 60301 - protein, 9 aa, Homo Sapiens
KVWPLASGR

SEQ ID NO: 60302 - protein, 9 aa, Homo Sapiens
KVWVKLIGR

SEQ ID NO: 60303 - protein, 9 aa, Homo Sapiens
KVYELQASR

SEQ ID NO: 60304 - protein, 9 aa, Homo Sapiens
KVYTPVASR

SEQ ID NO: 60305 - protein, 9 aa, Homo Sapiens
LAMPVMVLR

SEQ ID NO: 60306 - protein, 9 aa, Homo Sapiens
LINEESHFP

SEQ ID NO: 60307 - protein, 9 aa, Homo Sapiens
LINNKIANR

SEQ ID NO: 60308 - protein, 9 aa, Homo Sapiens
LIYNHITTR

SEQ ID NO: 60309 - protein, 9 aa, Homo Sapiens
LLHEKRYLR

SEQ ID NO: 60310 - protein, 9 aa, Homo Sapiens
LLNAVIVQR

SEQ ID NO: 60311 - protein, 9 aa, Homo Sapiens
LLNTGTCPR

SEQ ID NO: 60312 - protein, 9 aa, Homo Sapiens
LLQEHFYLR

SEQ ID NO: 60313 - protein, 9 aa, Homo Sapiens
LLQEKRFLR

SEQ ID NO: 60314 - protein, 9 aa, Homo Sapiens
LLQKSFLRR

SEQ ID NO: 60315 - protein, 9 aa, Homo Sapiens
LLRGGIAER

SEQ ID NO: 60316 - protein, 9 aa, Homo Sapiens
LLWYHTVVR

SEQ ID NO: 60317 - protein, 9 aa, Homo Sapiens
LLYSHPTSR

SEQ ID NO: 60318 - protein, 9 aa, Homo Sapiens
LMFDKTTNR

SEQ ID NO: 60319 - protein, 9 aa, Homo Sapiens
LMQQQKSFR

SEQ ID NO: 60320 - protein, 9 aa, Homo Sapiens
LQAPLPPMR

SEQ ID NO: 60321 - protein, 9 aa, Homo Sapiens
LQNAVIIQR

SEQ ID NO: 60322 - protein, 9 aa, Homo Sapiens
LQNDEVAFR

SEQ ID NO: 60323 - protein, 9 aa, Homo Sapiens
LQNEPIPER

SEQ ID NO: 60324 - protein, 9 aa, Homo Sapiens
LQNPDLALR

SEQ ID NO: 60325 - protein, 9 aa, Homo Sapiens
LQNVNITLR

SEQ ID NO: 60326 - protein, 9 aa, Homo Sapiens
LRLAELARR

SEQ ID NO: 60327 - protein, 9 aa, Homo Sapiens
LRNKTIFLR

SEQ ID NO: 60328 - protein, 9 aa, Homo Sapiens
LSSGLTAAR

SEQ ID NO: 60329 - protein, 9 aa, Homo Sapiens
LSSTVLIVR

SEQ ID NO: 60330 - protein, 9 aa, Homo Sapiens
LTGPVMPVR

SEQ ID NO: 60331 - protein, 9 aa, Homo Sapiens
LVATHDYYR

SEQ ID NO: 60332 - protein, 9 aa, Homo Sapiens
LVREIRQYR

SEQ ID NO: 60333 - protein, 9 aa, Homo Sapiens
LYDRQGIGR

SEQ ID NO: 60334 - protein, 9 aa, Homo Sapiens
MAPLKMLAL

SEQ ID NO: 60335 - protein, 9 aa, Homo Sapiens
MIRTKIAHR

SEQ ID NO: 60336 - protein, 9 aa, Homo Sapiens
MLNISPIGR

SEQ ID NO: 60337 - protein, 9 aa, Homo Sapiens
MLNTVLYAR

SEQ ID NO: 60338 - protein, 9 aa, Homo Sapiens
MLNVSPIGR

SEQ ID NO: 60339 - protein, 9 aa, Homo Sapiens
MLQTFISHR

SEQ ID NO: 60340 - protein, 9 aa, Homo Sapiens
MLWKKLIER

SEQ ID NO: 60341 - protein, 9 aa, Homo Sapiens
MLYGLIHAR

SEQ ID NO: 60342 - protein, 9 aa, Homo Sapiens
MMFSATFPK

SEQ ID NO: 60343 - protein, 9 aa, Homo Sapiens
MMTPYVVTR

SEQ ID NO: 60344 - protein, 9 aa, Homo Sapiens
MQAENIYNR

SEQ ID NO: 60345 - protein, 9 aa, Homo Sapiens
MVLAHVTNR

SEQ ID NO: 60346 - protein, 9 aa, Homo Sapiens
MVQNRVFLR

SEQ ID NO: 60347 - protein, 9 aa, Homo Sapiens
MVQRLTYRR

SEQ ID NO: 60348 - protein, 9 aa, Homo Sapiens
NVPVRDIPA

SEQ ID NO: 60349 - protein, 9 aa, Homo Sapiens
PIRLLAAAA

SEQ ID NO: 60350 - protein, 9 aa, Homo Sapiens
QIFSGTSKR

SEQ ID NO: 60351 - protein, 9 aa, Homo Sapiens
QIKNFLSKR

SEQ ID NO: 60352 - protein, 9 aa, Homo Sapiens
QIQKWIRTR

SEQ ID NO: 60353 - protein, 9 aa, Homo Sapiens
QITAVIINR

SEQ ID NO: 60354 - protein, 9 aa, Homo Sapiens
QLFHKEVLR

SEQ ID NO: 60355 - protein, 9 aa, Homo Sapiens
QLFSHTQLR

SEQ ID NO: 60356 - protein, 9 aa, Homo Sapiens
QLKAPHANR

SEQ ID NO: 60357 - protein, 9 aa, Homo Sapiens
QLMPALVQR

SEQ ID NO: 60358 - protein, 9 aa, Homo Sapiens
QLQDPREPR

SEQ ID NO: 60359 - protein, 9 aa, Homo Sapiens
QLREGICSR

SEQ ID NO: 60360 - protein, 9 aa, Homo Sapiens
QLRNFLAKR

SEQ ID NO: 60361 - protein, 9 aa, Homo Sapiens
QLYDRQLYR

SEQ ID NO: 60362 - protein, 9 aa, Homo Sapiens
QLYEYLQNR

SEQ ID NO: 60363 - protein, 9 aa, Homo Sapiens
QLYHSPARR

SEQ ID NO: 60364 - protein, 9 aa, Homo Sapiens
QLYPRNFLR

SEQ ID NO: 60365 - protein, 9 aa, Homo Sapiens
QMRPFLENR

SEQ ID NO: 60366 - protein, 9 aa, Homo Sapiens
QQLYWSHPR

SEQ ID NO: 60367 - protein, 9 aa, Homo Sapiens
QQNEVRVLR

SEQ ID NO: 60368 - protein, 9 aa, Homo Sapiens
QQNSGHFLR

SEQ ID NO: 60369 - protein, 9 aa, Homo Sapiens
QQQTQLNLR

SEQ ID NO: 60370 - protein, 9 aa, Homo Sapiens
QTCGKQFLR

SEQ ID NO: 60371 - protein, 9 aa, Homo Sapiens
QTFARTVAR

SEQ ID NO: 60372 - protein, 9 aa, Homo Sapiens
QTFYKFMKR

SEQ ID NO: 60373 - protein, 9 aa, Homo Sapiens
QTKPVVVYR

SEQ ID NO: 60374 - protein, 9 aa, Homo Sapiens
QTKPVYVYR

SEQ ID NO: 60375 - protein, 9 aa, Homo Sapiens
QTMFHHFQR

SEQ ID NO: 60376 - protein, 9 aa, Homo Sapiens
QTQSIYIPR

SEQ ID NO: 60377 - protein, 9 aa, Homo Sapiens
QVADVVVSR

SEQ ID NO: 60378 - protein, 9 aa, Homo Sapiens
QVAIKVIPR

SEQ ID NO: 60379 - protein, 9 aa, Homo Sapiens
QVFEKSPLR

SEQ ID NO: 60380 - protein, 9 aa, Homo Sapiens
QVNKAPKMR

SEQ ID NO: 60381 - protein, 9 aa, Homo Sapiens
QVRVWFQNR

SEQ ID NO: 60382 - protein, 9 aa, Homo Sapiens
RAGSRVAYR

SEQ ID NO: 60383 - protein, 9 aa, Homo Sapiens
RANMPLHVR

SEQ ID NO: 60384 - protein, 9 aa, Homo Sapiens
RARLQQFFR

SEQ ID NO: 60385 - protein, 9 aa, Homo Sapiens
RARPGVTLR

SEQ ID NO: 60386 - protein, 9 aa, Homo Sapiens
RASAIIIQR

SEQ ID NO: 60387 - protein, 9 aa, Homo Sapiens
RATEVTVAR

SEQ ID NO: 60388 - protein, 9 aa, Homo Sapiens
RIANGIATR

SEQ ID NO: 60389 - protein, 9 aa, Homo Sapiens
RIAQLICER

SEQ ID NO: 60390 - protein, 9 aa, Homo Sapiens
RICQIVSTR

SEQ ID NO: 60391 - protein, 9 aa, Homo Sapiens
RIFAGFRTR

SEQ ID NO: 60392 - protein, 9 aa, Homo Sapiens
RIFEKMFAM

SEQ ID NO: 60393 - protein, 9 aa, Homo Sapiens
RIFGKKQMR

SEQ ID NO: 60394 - protein, 9 aa, Homo Sapiens
RIFGPIWNR

SEQ ID NO: 60395 - protein, 9 aa, Homo Sapiens
RIFKPTHSR

SEQ ID NO: 60396 - protein, 9 aa, Homo Sapiens
RIFSGAVTR

SEQ ID NO: 60397 - protein, 9 aa, Homo Sapiens
RIFTLKPVR

SEQ ID NO: 60398 - protein, 9 aa, Homo Sapiens
RIFTSVPKR

SEQ ID NO: 60399 - protein, 9 aa, Homo Sapiens
RIGQAIARR

SEQ ID NO: 60400 - protein, 9 aa, Homo Sapiens
RIHSITAER

SEQ ID NO: 60401 - protein, 9 aa, Homo Sapiens
RIIEPLTSR

SEQ ID NO: 60402 - protein, 9 aa, Homo Sapiens
RIKEIFCPK

SEQ ID NO: 60403 - protein, 9 aa, Homo Sapiens
RIKEVLKER

SEQ ID NO: 60404 - protein, 9 aa, Homo Sapiens
RIKPPYANR

SEQ ID NO: 60405 - protein, 9 aa, Homo Sapiens
RILPRLQAR

SEQ ID NO: 60406 - protein, 9 aa, Homo Sapiens
RILPWSTFR

SEQ ID NO: 60407 - protein, 9 aa, Homo Sapiens
RIMAKYYTR

SEQ ID NO: 60408 - protein, 9 aa, Homo Sapiens
RIMKAQALR

SEQ ID NO: 60409 - protein, 9 aa, Homo Sapiens
RINERMPPR

SEQ ID NO: 60410 - protein, 9 aa, Homo Sapiens
RIPPPKVHR

SEQ ID NO: 60411 - protein, 9 aa, Homo Sapiens
RIQEEIAKR

SEQ ID NO: 60412 - protein, 9 aa, Homo Sapiens
RIRDIDLKR

SEQ ID NO: 60413 - protein, 9 aa, Homo Sapiens
RITNHIHVR

SEQ ID NO: 60414 - protein, 9 aa, Homo Sapiens
RITSLLAYR

SEQ ID NO: 60415 - protein, 9 aa, Homo Sapiens
RIYADPTKR

SEQ ID NO: 60416 - protein, 9 aa, Homo Sapiens
RIYEYVESR

SEQ ID NO: 60417 - protein, 9 aa, Homo Sapiens
RIYQYIQSR

SEQ ID NO: 60418 - protein, 9 aa, Homo Sapiens
RIYSKFHQK

SEQ ID NO: 60419 - protein, 9 aa, Homo Sapiens
RIYSYVVSR

SEQ ID NO: 60420 - protein, 9 aa, Homo Sapiens
RKIDTHPSP

SEQ ID NO: 60421 - protein, 9 aa, Homo Sapiens
RLADFAKER

SEQ ID NO: 60422 - protein, 9 aa, Homo Sapiens
RLADVFNQR

SEQ ID NO: 60423 - protein, 9 aa, Homo Sapiens
RLAEVIKNR

SEQ ID NO: 60424 - protein, 9 aa, Homo Sapiens
RLALAPAAR

SEQ ID NO: 60425 - protein, 9 aa, Homo Sapiens
RLAPIPRAR

SEQ ID NO: 60426 - protein, 9 aa, Homo Sapiens
RLAQEKALK

SEQ ID NO: 60427 - protein, 9 aa, Homo Sapiens
RLAQFIGNR

SEQ ID NO: 60428 - protein, 9 aa, Homo Sapiens
RLAQQLRQR

SEQ ID NO: 60429 - protein, 9 aa, Homo Sapiens
RLASNVAKR

SEQ ID NO: 60430 - protein, 9 aa, Homo Sapiens
RLAVRTVIR

SEQ ID NO: 60431 - protein, 9 aa, Homo Sapiens
RLCNWVSRR

SEQ ID NO: 60432 - protein, 9 aa, Homo Sapiens
RLCPHPLLR

SEQ ID NO: 60433 - protein, 9 aa, Homo Sapiens
RLDQMRKFR

SEQ ID NO: 60434 - protein, 9 aa, Homo Sapiens
RLEERYVPR

SEQ ID NO: 60435 - protein, 9 aa, Homo Sapiens
RLFCWIVTR

SEQ ID NO: 60436 - protein, 9 aa, Homo Sapiens
RLFEWVVNR

SEQ ID NO: 60437 - protein, 9 aa, Homo Sapiens
RLFFGPQHR

SEQ ID NO: 60438 - protein, 9 aa, Homo Sapiens
RLFGALLER

SEQ ID NO: 60439 - protein, 9 aa, Homo Sapiens
RLFHLHSQK

SEQ ID NO: 60440 - protein, 9 aa, Homo Sapiens
RLFNAIIHR

SEQ ID NO: 60441 - protein, 9 aa, Homo Sapiens
RLFPGLTSR

SEQ ID NO: 60442 - protein, 9 aa, Homo Sapiens
RLFPPAFRR

SEQ ID NO: 60443 - protein, 9 aa, Homo Sapiens
RLFQCLLHR

SEQ ID NO: 60444 - protein, 9 aa, Homo Sapiens
RLFQTAITR

SEQ ID NO: 60445 - protein, 9 aa, Homo Sapiens
RLFSIVRPR

SEQ ID NO: 60446 - protein, 9 aa, Homo Sapiens
RLFTEKILR

SEQ ID NO: 60447 - protein, 9 aa, Homo Sapiens
RLFVGSIPK

SEQ ID NO: 60448 - protein, 9 aa, Homo Sapiens
RLFVSVHLR

SEQ ID NO: 60449 - protein, 9 aa, Homo Sapiens
RLFWPFSKR

SEQ ID NO: 60450 - protein, 9 aa, Homo Sapiens
RLGEALPGR

SEQ ID NO: 60451 - protein, 9 aa, Homo Sapiens
RLGEKICTR

SEQ ID NO: 60452 - protein, 9 aa, Homo Sapiens
RLGQHSCLR

SEQ ID NO: 60453 - protein, 9 aa, Homo Sapiens
RLGQPLTGR

SEQ ID NO: 60454 - protein, 9 aa, Homo Sapiens
RLGQPPGVR

SEQ ID NO: 60455 - protein, 9 aa, Homo Sapiens
RLGYTPVCR

SEQ ID NO: 60456 - protein, 9 aa, Homo Sapiens
RLHDRIVFR

SEQ ID NO: 60457 - protein, 9 aa, Homo Sapiens
RLHGLEMER

SEQ ID NO: 60458 - protein, 9 aa, Homo Sapiens
RLHLTLRSA

SEQ ID NO: 60459 - protein, 9 aa, Homo Sapiens
RLHPFHVIR

SEQ ID NO: 60460 - protein, 9 aa, Homo Sapiens
RLIAELARR

SEQ ID NO: 60461 - protein, 9 aa, Homo Sapiens
RLIDQKWQR

SEQ ID NO: 60462 - protein, 9 aa, Homo Sapiens
RLIGTKTCR

SEQ ID NO: 60463 - protein, 9 aa, Homo Sapiens
RLIGWGQIR

SEQ ID NO: 60464 - protein, 9 aa, Homo Sapiens
RLIIKPYLR

SEQ ID NO: 60465 - protein, 9 aa, Homo Sapiens
RLISETAQR

SEQ ID NO: 60466 - protein, 9 aa, Homo Sapiens
RLKAAITIR

SEQ ID NO: 60467 - protein, 9 aa, Homo Sapiens
RLKDSWVER

SEQ ID NO: 60468 - protein, 9 aa, Homo Sapiens
RLKEEILNR

SEQ ID NO: 60469 - protein, 9 aa, Homo Sapiens
RLKEKLTSR

SEQ ID NO: 60470 - protein, 9 aa, Homo Sapiens
RLKEVFQTK

SEQ ID NO: 60471 - protein, 9 aa, Homo Sapiens
RLKIGFILR

SEQ ID NO: 60472 - protein, 9 aa, Homo Sapiens
RLKKFITRR

SEQ ID NO: 60473 - protein, 9 aa, Homo Sapiens
RLKLSDVAR

SEQ ID NO: 60474 - protein, 9 aa, Homo Sapiens
RLKMLGQTR

SEQ ID NO: 60475 - protein, 9 aa, Homo Sapiens
RLKPDWVLR

SEQ ID NO: 60476 - protein, 9 aa, Homo Sapiens
RLKTFPCKR

SEQ ID NO: 60477 - protein, 9 aa, Homo Sapiens
RLKYPPFAK

SEQ ID NO: 60478 - protein, 9 aa, Homo Sapiens
RLLDFLQKR

SEQ ID NO: 60479 - protein, 9 aa, Homo Sapiens
RLLDGIKQR

SEQ ID NO: 60480 - protein, 9 aa, Homo Sapiens
RLLEKPYVR

SEQ ID NO: 60481 - protein, 9 aa, Homo Sapiens
RLLHYFRGR

SEQ ID NO: 60482 - protein, 9 aa, Homo Sapiens
RLLKKQFFH

SEQ ID NO: 60483 - protein, 9 aa, Homo Sapiens
RLLSAVTAR

SEQ ID NO: 60484 - protein, 9 aa, Homo Sapiens
RLMKIGIVR

SEQ ID NO: 60485 - protein, 9 aa, Homo Sapiens
RLMKVFVTR

SEQ ID NO: 60486 - protein, 9 aa, Homo Sapiens
RLMMEQRSR

SEQ ID NO: 60487 - protein, 9 aa, Homo Sapiens
RLMQESVRR

SEQ ID NO: 60488 - protein, 9 aa, Homo Sapiens
RLNGLAAQR

SEQ ID NO: 60489 - protein, 9 aa, Homo Sapiens
RLNINARER

SEQ ID NO: 60490 - protein, 9 aa, Homo Sapiens
RLNSKQLNR

SEQ ID NO: 60491 - protein, 9 aa, Homo Sapiens
RLNSKWDLR

SEQ ID NO: 60492 - protein, 9 aa, Homo Sapiens
RLQARIAHR

SEQ ID NO: 60493 - protein, 9 aa, Homo Sapiens
RLQDAAVVR

SEQ ID NO: 60494 - protein, 9 aa, Homo Sapiens
RLQDNRQFR

SEQ ID NO: 60495 - protein, 9 aa, Homo Sapiens
RLQEIERRR

SEQ ID NO: 60496 - protein, 9 aa, Homo Sapiens
RLQEKLTSR

SEQ ID NO: 60497 - protein, 9 aa, Homo Sapiens
RLQHYFMGR

SEQ ID NO: 60498 - protein, 9 aa, Homo Sapiens
RLQKLWVGR

SEQ ID NO: 60499 - protein, 9 aa, Homo Sapiens
RLQPPRDLR

SEQ ID NO: 60500 - protein, 9 aa, Homo Sapiens
RLQQAQMLR

SEQ ID NO: 60501 - protein, 9 aa, Homo Sapiens
RLQQLRELR

SEQ ID NO: 60502 - protein, 9 aa, Homo Sapiens
RLQSIHTMR

SEQ ID NO: 60503 - protein, 9 aa, Homo Sapiens
RLRDDTELR

SEQ ID NO: 60504 - protein, 9 aa, Homo Sapiens
RLREGQTLR

SEQ ID NO: 60505 - protein, 9 aa, Homo Sapiens
RLREMIEKR

SEQ ID NO: 60506 - protein, 9 aa, Homo Sapiens
RLREPLLRR

SEQ ID NO: 60507 - protein, 9 aa, Homo Sapiens
RLRFSAFLR

SEQ ID NO: 60508 - protein, 9 aa, Homo Sapiens
RLRHQELFR

SEQ ID NO: 60509 - protein, 9 aa, Homo Sapiens
RLRQHWKLR

SEQ ID NO: 60510 - protein, 9 aa, Homo Sapiens
RLRREYLYR

SEQ ID NO: 60511 - protein, 9 aa, Homo Sapiens
RLSAKMALR

SEQ ID NO: 60512 - protein, 9 aa, Homo Sapiens
RLSDFQMHR

SEQ ID NO: 60513 - protein, 9 aa, Homo Sapiens
RLSDNPRAR

SEQ ID NO: 60514 - protein, 9 aa, Homo Sapiens
RLSDVTRER

SEQ ID NO: 60515 - protein, 9 aa, Homo Sapiens
RLSENVVNR

SEQ ID NO: 60516 - protein, 9 aa, Homo Sapiens
RLSKIGATR

SEQ ID NO: 60517 - protein, 9 aa, Homo Sapiens
RLSLQVVNR

SEQ ID NO: 60518 - protein, 9 aa, Homo Sapiens
RLSPFLAAR

SEQ ID NO: 60519 - protein, 9 aa, Homo Sapiens
RLSPVPVPR

SEQ ID NO: 60520 - protein, 9 aa, Homo Sapiens
RLSSAINHR

SEQ ID NO: 60521 - protein, 9 aa, Homo Sapiens
RLTNVAVVR

SEQ ID NO: 60522 - protein, 9 aa, Homo Sapiens
RLVESTSLR

SEQ ID NO: 60523 - protein, 9 aa, Homo Sapiens
RLVGIISSR

SEQ ID NO: 60524 - protein, 9 aa, Homo Sapiens
RLVKREYLR

SEQ ID NO: 60525 - protein, 9 aa, Homo Sapiens
RLWDFIENR

SEQ ID NO: 60526 - protein, 9 aa, Homo Sapiens
RLWDLQQLR

SEQ ID NO: 60527 - protein, 9 aa, Homo Sapiens
RLWDRAYVR

SEQ ID NO: 60528 - protein, 9 aa, Homo Sapiens
RLWEVATAR

SEQ ID NO: 60529 - protein, 9 aa, Homo Sapiens
RLWGNHKNR

SEQ ID NO: 60530 - protein, 9 aa, Homo Sapiens
RLWSLSYTK

SEQ ID NO: 60531 - protein, 9 aa, Homo Sapiens
RLYGGMNYR

SEQ ID NO: 60532 - protein, 9 aa, Homo Sapiens
RLYLNVLNR

SEQ ID NO: 60533 - protein, 9 aa, Homo Sapiens
RLYMKLVMR

SEQ ID NO: 60534 - protein, 9 aa, Homo Sapiens
RLYPTPRVR

SEQ ID NO: 60535 - protein, 9 aa, Homo Sapiens
RLYQGHTLR

SEQ ID NO: 60536 - protein, 9 aa, Homo Sapiens
RLYTKFSAR

SEQ ID NO: 60537 - protein, 9 aa, Homo Sapiens
RMAWKSFTR

SEQ ID NO: 60538 - protein, 9 aa, Homo Sapiens
RMFRWLVLR

SEQ ID NO: 60539 - protein, 9 aa, Homo Sapiens
RMHLSQIQR

SEQ ID NO: 60540 - protein, 9 aa, Homo Sapiens
RMISKQFHH

SEQ ID NO: 60541 - protein, 9 aa, Homo Sapiens
RMIVRVTNR

SEQ ID NO: 60542 - protein, 9 aa, Homo Sapiens
RMKEFERER

SEQ ID NO: 60543 - protein, 9 aa, Homo Sapiens
RMLERVIGR

SEQ ID NO: 60544 - protein, 9 aa, Homo Sapiens
RMLPSTSRR

SEQ ID NO: 60545 - protein, 9 aa, Homo Sapiens
RMQEENITR

SEQ ID NO: 60546 - protein, 9 aa, Homo Sapiens
RMTDKCFRK

SEQ ID NO: 60547 - protein, 9 aa, Homo Sapiens
RMVAVLVSR

SEQ ID NO: 60548 - protein, 9 aa, Homo Sapiens
RNTLFQLQR

SEQ ID NO: 60549 - protein, 9 aa, Homo Sapiens
RPVRGPLLR

SEQ ID NO: 60550 - protein, 9 aa, Homo Sapiens
RQAGLSYIR

SEQ ID NO: 60551 - protein, 9 aa, Homo Sapiens
RQASVIIQR

SEQ ID NO: 60552 - protein, 9 aa, Homo Sapiens
RQAVKTPPR

SEQ ID NO: 60553 - protein, 9 aa, Homo Sapiens
RQFFFINRR

SEQ ID NO: 60554 - protein, 9 aa, Homo Sapiens
RQFQARVSR

SEQ ID NO: 60555 - protein, 9 aa, Homo Sapiens
RQFQFKVKR

SEQ ID NO: 60556 - protein, 9 aa, Homo Sapiens
RQFYINVER

SEQ ID NO: 60557 - protein, 9 aa, Homo Sapiens
RQHQRFMAR

SEQ ID NO: 60558 - protein, 9 aa, Homo Sapiens
RQKEIVIDR

SEQ ID NO: 60559 - protein, 9 aa, Homo Sapiens
RQKELACLR

SEQ ID NO: 60560 - protein, 9 aa, Homo Sapiens
RQKEYVAPR

SEQ ID NO: 60561 - protein, 9 aa, Homo Sapiens
RQKFQILGR

SEQ ID NO: 60562 - protein, 9 aa, Homo Sapiens
RQKLEEALR

SEQ ID NO: 60563 - protein, 9 aa, Homo Sapiens
RQKPPIIHR

SEQ ID NO: 60564 - protein, 9 aa, Homo Sapiens
RQKQQLVER

SEQ ID NO: 60565 - protein, 9 aa, Homo Sapiens
RQLFRILFR

SEQ ID NO: 60566 - protein, 9 aa, Homo Sapiens
RQLKHSYYR

SEQ ID NO: 60567 - protein, 9 aa, Homo Sapiens
RQLWRVIER

SEQ ID NO: 60568 - protein, 9 aa, Homo Sapiens
RQMEMKILR

SEQ ID NO: 60569 - protein, 9 aa, Homo Sapiens
RQNLYTKYR

SEQ ID NO: 60570 - protein, 9 aa, Homo Sapiens
RQQASIISR

SEQ ID NO: 60571 - protein, 9 aa, Homo Sapiens
RQRAILYKR

SEQ ID NO: 60572 - protein, 9 aa, Homo Sapiens
RQSLHTYLR

SEQ ID NO: 60573 - protein, 9 aa, Homo Sapiens
RQTGIVLNR

SEQ ID NO: 60574 - protein, 9 aa, Homo Sapiens
RQVGIICER

SEQ ID NO: 60575 - protein, 9 aa, Homo Sapiens
RQVGMICER

SEQ ID NO: 60576 - protein, 9 aa, Homo Sapiens
RQYLDPAQR

SEQ ID NO: 60577 - protein, 9 aa, Homo Sapiens
RRFSLMTLR

SEQ ID NO: 60578 - protein, 9 aa, Homo Sapiens
RRPSFLPPR

SEQ ID NO: 60579 - protein, 9 aa, Homo Sapiens
RSAAKFYRR

SEQ ID NO: 60580 - protein, 9 aa, Homo Sapiens
RSAALSWLR

SEQ ID NO: 60581 - protein, 9 aa, Homo Sapiens
RSFGWKDQR

SEQ ID NO: 60582 - protein, 9 aa, Homo Sapiens
RSFSGLIKR

SEQ ID NO: 60583 - protein, 9 aa, Homo Sapiens
RSFSLGVPR

SEQ ID NO: 60584 - protein, 9 aa, Homo Sapiens
RSGFPRYNR

SEQ ID NO: 60585 - protein, 9 aa, Homo Sapiens
RSHSIFSIR

SEQ ID NO: 60586 - protein, 9 aa, Homo Sapiens
RSIYLQWNR

SEQ ID NO: 60587 - protein, 9 aa, Homo Sapiens
RSNPKIWNV

SEQ ID NO: 60588 - protein, 9 aa, Homo Sapiens
RSRPYAVLR

SEQ ID NO: 60589 - protein, 9 aa, Homo Sapiens
RSVGRIIGR

SEQ ID NO: 60590 - protein, 9 aa, Homo Sapiens
RSYLIIHQR

SEQ ID NO: 60591 - protein, 9 aa, Homo Sapiens
RSYLTVHKR

SEQ ID NO: 60592 - protein, 9 aa, Homo Sapiens
RSYPVTEQR

SEQ ID NO: 60593 - protein, 9 aa, Homo Sapiens
RSYTKAYSR

SEQ ID NO: 60594 - protein, 9 aa, Homo Sapiens
RSYVTTSTR

SEQ ID NO: 60595 - protein, 9 aa, Homo Sapiens
RTAALPTFR

SEQ ID NO: 60596 - protein, 9 aa, Homo Sapiens
RTFLHTVQR

SEQ ID NO: 60597 - protein, 9 aa, Homo Sapiens
RTFLSKTGR

SEQ ID NO: 60598 - protein, 9 aa, Homo Sapiens
RTFTWLVGK

SEQ ID NO: 60599 - protein, 9 aa, Homo Sapiens
RTIAPIIGR

SEQ ID NO: 60600 - protein, 9 aa, Homo Sapiens
RTILFGVKR

SEQ ID NO: 60601 - protein, 9 aa, Homo Sapiens
RTIRYLYRR

SEQ ID NO: 60602 - protein, 9 aa, Homo Sapiens
RTISETIER

SEQ ID NO: 60603 - protein, 9 aa, Homo Sapiens
RTKAPKIQR

SEQ ID NO: 60604 - protein, 9 aa, Homo Sapiens
RTKLSLIMR

SEQ ID NO: 60605 - protein, 9 aa, Homo Sapiens
RTLEKISSR

SEQ ID NO: 60606 - protein, 9 aa, Homo Sapiens
RTLIPRYFR

SEQ ID NO: 60607 - protein, 9 aa, Homo Sapiens
RTLLVADPR

SEQ ID NO: 60608 - protein, 9 aa, Homo Sapiens
RTLQEPVAR

SEQ ID NO: 60609 - protein, 9 aa, Homo Sapiens
RTLTYMSHR

SEQ ID NO: 60610 - protein, 9 aa, Homo Sapiens
RTLVTGALR

SEQ ID NO: 60611 - protein, 9 aa, Homo Sapiens
RTMALPVGR

SEQ ID NO: 60612 - protein, 9 aa, Homo Sapiens
RTNESLIQR

SEQ ID NO: 60613 - protein, 9 aa, Homo Sapiens
RTNHIGWVR

SEQ ID NO: 60614 - protein, 9 aa, Homo Sapiens
RTNILCTVR

SEQ ID NO: 60615 - protein, 9 aa, Homo Sapiens
RTNQFSVTR

SEQ ID NO: 60616 - protein, 9 aa, Homo Sapiens
RTNSCPIVR

SEQ ID NO: 60617 - protein, 9 aa, Homo Sapiens
RTPGPRPPR

SEQ ID NO: 60618 - protein, 9 aa, Homo Sapiens
RTPLMKAAR

SEQ ID NO: 60619 - protein, 9 aa, Homo Sapiens
RTQLLGQLR

SEQ ID NO: 60620 - protein, 9 aa, Homo Sapiens
RTRLAAWAR

SEQ ID NO: 60621 - protein, 9 aa, Homo Sapiens
RTRWSGITR

SEQ ID NO: 60622 - protein, 9 aa, Homo Sapiens
RTSASIILR

SEQ ID NO: 60623 - protein, 9 aa, Homo Sapiens
RTSEIYVHR

SEQ ID NO: 60624 - protein, 9 aa, Homo Sapiens
RTSFFHVKR

SEQ ID NO: 60625 - protein, 9 aa, Homo Sapiens
RTSIFIAHR

SEQ ID NO: 60626 - protein, 9 aa, Homo Sapiens
RTVEDVFLR

SEQ ID NO: 60627 - protein, 9 aa, Homo Sapiens
RTVEKTWKL

SEQ ID NO: 60628 - protein, 9 aa, Homo Sapiens
RTYQSITER

SEQ ID NO: 60629 - protein, 9 aa, Homo Sapiens
RTYYSPVYR

SEQ ID NO: 60630 - protein, 9 aa, Homo Sapiens
RVAAHPILR

SEQ ID NO: 60631 - protein, 9 aa, Homo Sapiens
RVEFPRSGR

SEQ ID NO: 60632 - protein, 9 aa, Homo Sapiens
RVFDMIRRR

SEQ ID NO: 60633 - protein, 9 aa, Homo Sapiens
RVFKTVNRR

SEQ ID NO: 60634 - protein, 9 aa, Homo Sapiens
RVFPHAEFR

SEQ ID NO: 60635 - protein, 9 aa, Homo Sapiens
RVFPMPLPR

SEQ ID NO: 60636 - protein, 9 aa, Homo Sapiens
RVFRNQLPR

SEQ ID NO: 60637 - protein, 9 aa, Homo Sapiens
RVFSLVGKR

SEQ ID NO: 60638 - protein, 9 aa, Homo Sapiens
RVGDVYIPR

SEQ ID NO: 60639 - protein, 9 aa, Homo Sapiens
RVGEFCHNR

SEQ ID NO: 60640 - protein, 9 aa, Homo Sapiens
RVGQAVALR

SEQ ID NO: 60641 - protein, 9 aa, Homo Sapiens
RVHSIFVLR

SEQ ID NO: 60642 - protein, 9 aa, Homo Sapiens
RVIAHTQMR

SEQ ID NO: 60643 - protein, 9 aa, Homo Sapiens
RVIKWLYGL

SEQ ID NO: 60644 - protein, 9 aa, Homo Sapiens
RVILPALSR

SEQ ID NO: 60645 - protein, 9 aa, Homo Sapiens
RVITALVER

SEQ ID NO: 60646 - protein, 9 aa, Homo Sapiens
RVIWGKVTR

SEQ ID NO: 60647 - protein, 9 aa, Homo Sapiens
RVKELEVRK

SEQ ID NO: 60648 - protein, 9 aa, Homo Sapiens
RVKEYFVFR

SEQ ID NO: 60649 - protein, 9 aa, Homo Sapiens
RVKGPGISK

SEQ ID NO: 60650 - protein, 9 aa, Homo Sapiens
RVKGVTIVK

SEQ ID NO: 60651 - protein, 9 aa, Homo Sapiens
RVLDALVAR

SEQ ID NO: 60652 - protein, 9 aa, Homo Sapiens
RVLDFDVKR

SEQ ID NO: 60653 - protein, 9 aa, Homo Sapiens
RVLEDRALK

SEQ ID NO: 60654 - protein, 9 aa, Homo Sapiens
RVLPAPAPR

SEQ ID NO: 60655 - protein, 9 aa, Homo Sapiens
RVLSKAFSR

SEQ ID NO: 60656 - protein, 9 aa, Homo Sapiens
RVLSQPQLR

SEQ ID NO: 60657 - protein, 9 aa, Homo Sapiens
RVLTAPTLR

SEQ ID NO: 60658 - protein, 9 aa, Homo Sapiens
RVMFKITAR

SEQ ID NO: 60659 - protein, 9 aa, Homo Sapiens
RVMGIRVLR

SEQ ID NO: 60660 - protein, 9 aa, Homo Sapiens
RVMKALVNR

SEQ ID NO: 60661 - protein, 9 aa, Homo Sapiens
RVNAELQAR

SEQ ID NO: 60662 - protein, 9 aa, Homo Sapiens
RVNEKEIVR

SEQ ID NO: 60663 - protein, 9 aa, Homo Sapiens
RVNIPKVLR

SEQ ID NO: 60664 - protein, 9 aa, Homo Sapiens
RVNKPPYPK

SEQ ID NO: 60665 - protein, 9 aa, Homo Sapiens
RVNLAKPMR

SEQ ID NO: 60666 - protein, 9 aa, Homo Sapiens
RVNQQIRLR

SEQ ID NO: 60667 - protein, 9 aa, Homo Sapiens
RVNVTGIYR

SEQ ID NO: 60668 - protein, 9 aa, Homo Sapiens
RVQDHIQSR

SEQ ID NO: 60669 - protein, 9 aa, Homo Sapiens
RVQEEVKLR

SEQ ID NO: 60670 - protein, 9 aa, Homo Sapiens
RVQFGVMTR

SEQ ID NO: 60671 - protein, 9 aa, Homo Sapiens
RVQKSPVFR

SEQ ID NO: 60672 - protein, 9 aa, Homo Sapiens
RVQLPKRYR

SEQ ID NO: 60673 - protein, 9 aa, Homo Sapiens
RVQPIKLAR

SEQ ID NO: 60674 - protein, 9 aa, Homo Sapiens
RVQVQVVER

SEQ ID NO: 60675 - protein, 9 aa, Homo Sapiens
RVQVVGTYR

SEQ ID NO: 60676 - protein, 9 aa, Homo Sapiens
RVQVWFQNR

SEQ ID NO: 60677 - protein, 9 aa, Homo Sapiens
RVRDVFEAK

SEQ ID NO: 60678 - protein, 9 aa, Homo Sapiens
RVREKPPWR

SEQ ID NO: 60679 - protein, 9 aa, Homo Sapiens
RVSADSFVR

SEQ ID NO: 60680 - protein, 9 aa, Homo Sapiens
RVSEVLQNR

SEQ ID NO: 60681 - protein, 9 aa, Homo Sapiens
RVSGILVKR

SEQ ID NO: 60682 - protein, 9 aa, Homo Sapiens
RVSGLVPSR

SEQ ID NO: 60683 - protein, 9 aa, Homo Sapiens
RVTGVSSFR

SEQ ID NO: 60684 - protein, 9 aa, Homo Sapiens
RVTLKQYPR

SEQ ID NO: 60685 - protein, 9 aa, Homo Sapiens
RVTNFVAQR

SEQ ID NO: 60686 - protein, 9 aa, Homo Sapiens
RVVGVTQPR

SEQ ID NO: 60687 - protein, 9 aa, Homo Sapiens
RVWDLRTGR

SEQ ID NO: 60688 - protein, 9 aa, Homo Sapiens
RVWKHLTTK

SEQ ID NO: 60689 - protein, 9 aa, Homo Sapiens
RVYHYFQWR

SEQ ID NO: 60690 - protein, 9 aa, Homo Sapiens
RVYNIYIRR

SEQ ID NO: 60691 - protein, 9 aa, Homo Sapiens
RVYNWDVKR

SEQ ID NO: 60692 - protein, 9 aa, Homo Sapiens
RVYQKPPMR

SEQ ID NO: 60693 - protein, 9 aa, Homo Sapiens
RVYRNFHYR

SEQ ID NO: 60694 - protein, 9 aa, Homo Sapiens
RVYTYIQSR

SEQ ID NO: 60695 - protein, 9 aa, Homo Sapiens
SALPWSINR

SEQ ID NO: 60696 - protein, 9 aa, Homo Sapiens
SGPGPAAAL

SEQ ID NO: 60697 - protein, 9 aa, Homo Sapiens
SICGKVFVR

SEQ ID NO: 60698 - protein, 9 aa, Homo Sapiens
SIFSNIKNR

SEQ ID NO: 60699 - protein, 9 aa, Homo Sapiens
SILLWATQR

SEQ ID NO: 60700 - protein, 9 aa, Homo Sapiens
SILSHIHKR

SEQ ID NO: 60701 - protein, 9 aa, Homo Sapiens
SIMKWNRER

SEQ ID NO: 60702 - protein, 9 aa, Homo Sapiens
SINKPTSER

SEQ ID NO: 60703 - protein, 9 aa, Homo Sapiens
SINQVVQLR

SEQ ID NO: 60704 - protein, 9 aa, Homo Sapiens
SINVHLSAR

SEQ ID NO: 60705 - protein, 9 aa, Homo Sapiens
SIQHPGGQR

SEQ ID NO: 60706 - protein, 9 aa, Homo Sapiens
SIQSFFYSR

SEQ ID NO: 60707 - protein, 9 aa, Homo Sapiens
SIRDPVHNR

SEQ ID NO: 60708 - protein, 9 aa, Homo Sapiens
SIREPIANR

SEQ ID NO: 60709 - protein, 9 aa, Homo Sapiens
SIRSFEMNR

SEQ ID NO: 60710 - protein, 9 aa, Homo Sapiens
SISGPFGSR

SEQ ID NO: 60711 - protein, 9 aa, Homo Sapiens
SLADIMAKR

SEQ ID NO: 60712 - protein, 9 aa, Homo Sapiens
SLANIARQR

SEQ ID NO: 60713 - protein, 9 aa, Homo Sapiens
SLAPPPRER

SEQ ID NO: 60714 - protein, 9 aa, Homo Sapiens
SLFAGGMLR

SEQ ID NO: 60715 - protein, 9 aa, Homo Sapiens
SLFKQTFQR

SEQ ID NO: 60716 - protein, 9 aa, Homo Sapiens
SLFQAFVKR

SEQ ID NO: 60717 - protein, 9 aa, Homo Sapiens
SLFRPGGRA

SEQ ID NO: 60718 - protein, 9 aa, Homo Sapiens
SLFSAVVAR

SEQ ID NO: 60719 - protein, 9 aa, Homo Sapiens
SLFSGRLVR

SEQ ID NO: 60720 - protein, 9 aa, Homo Sapiens
SLFTQTHQR

SEQ ID NO: 60721 - protein, 9 aa, Homo Sapiens
SLGPPPYLR

SEQ ID NO: 60722 - protein, 9 aa, Homo Sapiens
SLGSNTYNR

SEQ ID NO: 60723 - protein, 9 aa, Homo Sapiens
SLKAPPARP

SEQ ID NO: 60724 - protein, 9 aa, Homo Sapiens
SLLKKLFCR

SEQ ID NO: 60725 - protein, 9 aa, Homo Sapiens
SLMDKTFER

SEQ ID NO: 60726 - protein, 9 aa, Homo Sapiens
SLMQFSKPR

SEQ ID NO: 60727 - protein, 9 aa, Homo Sapiens
SLMSALAAR

SEQ ID NO: 60728 - protein, 9 aa, Homo Sapiens
SLMSQVSYR

SEQ ID NO: 60729 - protein, 9 aa, Homo Sapiens
SLNLRTFLR

SEQ ID NO: 60730 - protein, 9 aa, Homo Sapiens
SLNNKILNR

SEQ ID NO: 60731 - protein, 9 aa, Homo Sapiens
SLNPKNVNR

SEQ ID NO: 60732 - protein, 9 aa, Homo Sapiens
SLNPKTWGR

SEQ ID NO: 60733 - protein, 9 aa, Homo Sapiens
SLNPTSVAR

SEQ ID NO: 60734 - protein, 9 aa, Homo Sapiens
SLNTPGSFR

SEQ ID NO: 60735 - protein, 9 aa, Homo Sapiens
SLNVALPMR

SEQ ID NO: 60736 - protein, 9 aa, Homo Sapiens
SLQRWEHLK

SEQ ID NO: 60737 - protein, 9 aa, Homo Sapiens
SLQSAQYLR

SEQ ID NO: 60738 - protein, 9 aa, Homo Sapiens
SLRPFVQKR

SEQ ID NO: 60739 - protein, 9 aa, Homo Sapiens
SLRVHITSR

SEQ ID NO: 60740 - protein, 9 aa, Homo Sapiens
SLSSLTYQR

SEQ ID NO: 60741 - protein, 9 aa, Homo Sapiens
SLWKKTVYR

SEQ ID NO: 60742 - protein, 9 aa, Homo Sapiens
SLYGAARYR

SEQ ID NO: 60743 - protein, 9 aa, Homo Sapiens
SLYGPGTNR

SEQ ID NO: 60744 - protein, 9 aa, Homo Sapiens
SLYHQPANR

SEQ ID NO: 60745 - protein, 9 aa, Homo Sapiens
SLYSVVSLR

SEQ ID NO: 60746 - protein, 9 aa, Homo Sapiens
SMFDVHVKR

SEQ ID NO: 60747 - protein, 9 aa, Homo Sapiens
SMFQKIILR

SEQ ID NO: 60748 - protein, 9 aa, Homo Sapiens
SMFRKPYVR

SEQ ID NO: 60749 - protein, 9 aa, Homo Sapiens
SMRDHIDYR

SEQ ID NO: 60750 - protein, 9 aa, Homo Sapiens
SMSSTFFSR

SEQ ID NO: 60751 - protein, 9 aa, Homo Sapiens
SMWKGKTLR

SEQ ID NO: 60752 - protein, 9 aa, Homo Sapiens
SQFQGLPSR

SEQ ID NO: 60753 - protein, 9 aa, Homo Sapiens
SQNSLFTFR

SEQ ID NO: 60754 - protein, 9 aa, Homo Sapiens
SQNSVVIIR

SEQ ID NO: 60755 - protein, 9 aa, Homo Sapiens
SSKKVAFLR

SEQ ID NO: 60756 - protein, 9 aa, Homo Sapiens
SSRKEYFYR

SEQ ID NO: 60757 - protein, 9 aa, Homo Sapiens
SSYFRIHER

SEQ ID NO: 60758 - protein, 9 aa, Homo Sapiens
SSYPKQILR

SEQ ID NO: 60759 - protein, 9 aa, Homo Sapiens
STAKIQIVR

SEQ ID NO: 60760 - protein, 9 aa, Homo Sapiens
STARHLYLR

SEQ ID NO: 60761 - protein, 9 aa, Homo Sapiens
STFDTPYCR

SEQ ID NO: 60762 - protein, 9 aa, Homo Sapiens
STFEWVARR

SEQ ID NO: 60763 - protein, 9 aa, Homo Sapiens
STFTNITYR

SEQ ID NO: 60764 - protein, 9 aa, Homo Sapiens
STIPFHYKR

SEQ ID NO: 60765 - protein, 9 aa, Homo Sapiens
STISQRPYR

SEQ ID NO: 60766 - protein, 9 aa, Homo Sapiens
STKFPAYER

SEQ ID NO: 60767 - protein, 9 aa, Homo Sapiens
STLSPIAPR

SEQ ID NO: 60768 - protein, 9 aa, Homo Sapiens
STMPGLPTR

SEQ ID NO: 60769 - protein, 9 aa, Homo Sapiens
STNFKLIYR

SEQ ID NO: 60770 - protein, 9 aa, Homo Sapiens
STNIVSVCR

SEQ ID NO: 60771 - protein, 9 aa, Homo Sapiens
STNLKTHFR

SEQ ID NO: 60772 - protein, 9 aa, Homo Sapiens
STNPFRPQK

SEQ ID NO: 60773 - protein, 9 aa, Homo Sapiens
STNSHPILR

SEQ ID NO: 60774 - protein, 9 aa, Homo Sapiens
STQLFCSTR

SEQ ID NO: 60775 - protein, 9 aa, Homo Sapiens
STQLTIHQR

SEQ ID NO: 60776 - protein, 9 aa, Homo Sapiens
STREYVMFR

SEQ ID NO: 60777 - protein, 9 aa, Homo Sapiens
STRLFAVLR

SEQ ID NO: 60778 - protein, 9 aa, Homo Sapiens
STRPPSVTR

SEQ ID NO: 60779 - protein, 9 aa, Homo Sapiens
STSKRHWLR

SEQ ID NO: 60780 - protein, 9 aa, Homo Sapiens
STWLKGQVR

SEQ ID NO: 60781 - protein, 9 aa, Homo Sapiens
STYIRLYGR

SEQ ID NO: 60782 - protein, 9 aa, Homo Sapiens
SVARITCVR

SEQ ID NO: 60783 - protein, 9 aa, Homo Sapiens
SVFLYQSLR

SEQ ID NO: 60784 - protein, 9 aa, Homo Sapiens
SVFNEHPSR

SEQ ID NO: 60785 - protein, 9 aa, Homo Sapiens
SVFVATFLR

SEQ ID NO: 60786 - protein, 9 aa, Homo Sapiens
SVKDYCFAR

SEQ ID NO: 60787 - protein, 9 aa, Homo Sapiens
SVKFGATLR

SEQ ID NO: 60788 - protein, 9 aa, Homo Sapiens
SVKSITNPR

SEQ ID NO: 60789 - protein, 9 aa, Homo Sapiens
SVLAYSFSR

SEQ ID NO: 60790 - protein, 9 aa, Homo Sapiens
SVLEQSFLR

SEQ ID NO: 60791 - protein, 9 aa, Homo Sapiens
SVLNFATNR

SEQ ID NO: 60792 - protein, 9 aa, Homo Sapiens
SVNNLMAKR

SEQ ID NO: 60793 - protein, 9 aa, Homo Sapiens
SVNNSIFYR

SEQ ID NO: 60794 - protein, 9 aa, Homo Sapiens
SVNSHIYQR

SEQ ID NO: 60795 - protein, 9 aa, Homo Sapiens
SVNSVAVLR

SEQ ID NO: 60796 - protein, 9 aa, Homo Sapiens
SVQGIIIYR

SEQ ID NO: 60797 - protein, 9 aa, Homo Sapiens
SVRDCAWLR

SEQ ID NO: 60798 - protein, 9 aa, Homo Sapiens
SVRGFNMGR

SEQ ID NO: 60799 - protein, 9 aa, Homo Sapiens
SVSDLAPPR

SEQ ID NO: 60800 - protein, 9 aa, Homo Sapiens
SVSEVVVNR

SEQ ID NO: 60801 - protein, 9 aa, Homo Sapiens
SVSPVVHVR

SEQ ID NO: 60802 - protein, 9 aa, Homo Sapiens
SVWKMYHSR

SEQ ID NO: 60803 - protein, 9 aa, Homo Sapiens
SVWPFLVQR

SEQ ID NO: 60804 - protein, 9 aa, Homo Sapiens
TAPQGNVDL

SEQ ID NO: 60805 - protein, 9 aa, Homo Sapiens
TINDISVLR

SEQ ID NO: 60806 - protein, 9 aa, Homo Sapiens
TIRDRPFER

SEQ ID NO: 60807 - protein, 9 aa, Homo Sapiens
TIRSIYHVR

SEQ ID NO: 60808 - protein, 9 aa, Homo Sapiens
TIVSTRHYR

SEQ ID NO: 60809 - protein, 9 aa, Homo Sapiens
TLACRPWLR

SEQ ID NO: 60810 - protein, 9 aa, Homo Sapiens
TLFKGVITR

SEQ ID NO: 60811 - protein, 9 aa, Homo Sapiens
TLKPDPHLR

SEQ ID NO: 60812 - protein, 9 aa, Homo Sapiens
TLKSGISYR

SEQ ID NO: 60813 - protein, 9 aa, Homo Sapiens
TLLPSHPPR

SEQ ID NO: 60814 - protein, 9 aa, Homo Sapiens
TLMPHNYSR

SEQ ID NO: 60815 - protein, 9 aa, Homo Sapiens
TLRDLIFKR

SEQ ID NO: 60816 - protein, 9 aa, Homo Sapiens
TLRHYGYLR

SEQ ID NO: 60817 - protein, 9 aa, Homo Sapiens
TLRSSCLYR

SEQ ID NO: 60818 - protein, 9 aa, Homo Sapiens
TLSAVTNNR

SEQ ID NO: 60819 - protein, 9 aa, Homo Sapiens
TLSPAFSTR

SEQ ID NO: 60820 - protein, 9 aa, Homo Sapiens
TLYEGTWRR

SEQ ID NO: 60821 - protein, 9 aa, Homo Sapiens
TMNPSVVQR

SEQ ID NO: 60822 - protein, 9 aa, Homo Sapiens
TQHQIIHTR

SEQ ID NO: 60823 - protein, 9 aa, Homo Sapiens
TQLNTTWLR

SEQ ID NO: 60824 - protein, 9 aa, Homo Sapiens
TTFPESHLR

SEQ ID NO: 60825 - protein, 9 aa, Homo Sapiens
TTLTKIALR

SEQ ID NO: 60826 - protein, 9 aa, Homo Sapiens
TVHRGPLPR

SEQ ID NO: 60827 - protein, 9 aa, Homo Sapiens
TVKRGLVLR

SEQ ID NO: 60828 - protein, 9 aa, Homo Sapiens
TVKVQIHSR

SEQ ID NO: 60829 - protein, 9 aa, Homo Sapiens
TVMSVKIIR

SEQ ID NO: 60830 - protein, 9 aa, Homo Sapiens
TVRDAVVGR

SEQ ID NO: 60831 - protein, 9 aa, Homo Sapiens
TVRDHLVGR

SEQ ID NO: 60832 - protein, 9 aa, Homo Sapiens
TVYHSPVSR

SEQ ID NO: 60833 - protein, 9 aa, Homo Sapiens
VARDALLAR

SEQ ID NO: 60834 - protein, 9 aa, Homo Sapiens
VIFVKSVQR

SEQ ID NO: 60835 - protein, 9 aa, Homo Sapiens
VIKDKFIRR

SEQ ID NO: 60836 - protein, 9 aa, Homo Sapiens
VIKEVRINR

SEQ ID NO: 60837 - protein, 9 aa, Homo Sapiens
VIKPWITKR

SEQ ID NO: 60838 - protein, 9 aa, Homo Sapiens
VILPPRPPK

SEQ ID NO: 60839 - protein, 9 aa, Homo Sapiens
VINSVSTSR

SEQ ID NO: 60840 - protein, 9 aa, Homo Sapiens
VIRGYVGNR

SEQ ID NO: 60841 - protein, 9 aa, Homo Sapiens
VISNINITR

SEQ ID NO: 60842 - protein, 9 aa, Homo Sapiens
VKGPRGTLR

SEQ ID NO: 60843 - protein, 9 aa, Homo Sapiens
VKKGKPELR

SEQ ID NO: 60844 - protein, 9 aa, Homo Sapiens
VLAGPLAQR

SEQ ID NO: 60845 - protein, 9 aa, Homo Sapiens
VLAGRYSGR

SEQ ID NO: 60846 - protein, 9 aa, Homo Sapiens
VLGPPPPPR

SEQ ID NO: 60847 - protein, 9 aa, Homo Sapiens
VLGPVPLTR

SEQ ID NO: 60848 - protein, 9 aa, Homo Sapiens
VLKDIVSQR

SEQ ID NO: 60849 - protein, 9 aa, Homo Sapiens
VLKETVSQR

SEQ ID NO: 60850 - protein, 9 aa, Homo Sapiens
VLKEVVRQR

SEQ ID NO: 60851 - protein, 9 aa, Homo Sapiens
VLKHVLTPR

SEQ ID NO: 60852 - protein, 9 aa, Homo Sapiens
VLKSTPQVR

SEQ ID NO: 60853 - protein, 9 aa, Homo Sapiens
VLMEQPPLR

SEQ ID NO: 60854 - protein, 9 aa, Homo Sapiens
VLNGELPLR

SEQ ID NO: 60855 - protein, 9 aa, Homo Sapiens
VLNPTPIKR

SEQ ID NO: 60856 - protein, 9 aa, Homo Sapiens
VLQERVMTR

SEQ ID NO: 60857 - protein, 9 aa, Homo Sapiens
VLQVSAAPR

SEQ ID NO: 60858 - protein, 9 aa, Homo Sapiens
VLRKDIYQR

SEQ ID NO: 60859 - protein, 9 aa, Homo Sapiens
VLRQAIAER

SEQ ID NO: 60860 - protein, 9 aa, Homo Sapiens
VLSPPRWPR

SEQ ID NO: 60861 - protein, 9 aa, Homo Sapiens
VLTGYIYPR

SEQ ID NO: 60862 - protein, 9 aa, Homo Sapiens
VLWDKIVLR

SEQ ID NO: 60863 - protein, 9 aa, Homo Sapiens
VLYNGFTGR

SEQ ID NO: 60864 - protein, 9 aa, Homo Sapiens
VMKDFEEMR

SEQ ID NO: 60865 - protein, 9 aa, Homo Sapiens
VMQKRISFR

SEQ ID NO: 60866 - protein, 9 aa, Homo Sapiens
VMYGIVYTR

SEQ ID NO: 60867 - protein, 9 aa, Homo Sapiens
VMYSTLPGR

SEQ ID NO: 60868 - protein, 9 aa, Homo Sapiens
VQAGIFVER

SEQ ID NO: 60869 - protein, 9 aa, Homo Sapiens
VQGPVITTR

SEQ ID NO: 60870 - protein, 9 aa, Homo Sapiens
VQHEINTLR

SEQ ID NO: 60871 - protein, 9 aa, Homo Sapiens
VQKPSYYVR

SEQ ID NO: 60872 - protein, 9 aa, Homo Sapiens
VQQRYLSYR

SEQ ID NO: 60873 - protein, 9 aa, Homo Sapiens
VQVGPLPSR

SEQ ID NO: 60874 - protein, 9 aa, Homo Sapiens
VSNKWLHER

SEQ ID NO: 60875 - protein, 9 aa, Homo Sapiens
VTFPVRQPR

SEQ ID NO: 60876 - protein, 9 aa, Homo Sapiens
VTNAQAVLR

SEQ ID NO: 60877 - protein, 9 aa, Homo Sapiens
VTNNSVALR

SEQ ID NO: 60878 - protein, 9 aa, Homo Sapiens
VTYTEHAKR

SEQ ID NO: 60879 - protein, 9 aa, Homo Sapiens
VVAPRLNSR

SEQ ID NO: 60880 - protein, 9 aa, Homo Sapiens
VVDPHSFPR

SEQ ID NO: 60881 - protein, 9 aa, Homo Sapiens
VVFDSNTNR

SEQ ID NO: 60882 - protein, 9 aa, Homo Sapiens
VVFQKRQER

SEQ ID NO: 60883 - protein, 9 aa, Homo Sapiens
VVFVYVATR

SEQ ID NO: 60884 - protein, 9 aa, Homo Sapiens
VVNPKVFPH

SEQ ID NO: 60885 - protein, 9 aa, Homo Sapiens
VVQSSPVER

SEQ ID NO: 60886 - protein, 9 aa, Homo Sapiens
VVRSSRWVR

SEQ ID NO: 60887 - protein, 9 aa, Homo Sapiens
VVYPKVIER

SEQ ID NO: 60888 - protein, 9 aa, Homo Sapiens
WVSVVTPAR

SEQ ID NO: 60889 - protein, 9 aa, Homo Sapiens
YQYPSSQPR

SEQ ID NO: 60890 - protein, 9 aa, Homo Sapiens
YTQPGPGYR

SEQ ID NO: 60891 - protein, 9 aa, Homo Sapiens
YVQRFHYSR

SEQ ID NO: 60892 - protein, 10 aa, Homo Sapiens
AALYPPWRGV

SEQ ID NO: 60893 - protein, 10 aa, Homo Sapiens
AGEDPGLARQ

SEQ ID NO: 60894 - protein, 10 aa, Homo Sapiens
AGLQRLSKER

SEQ ID NO: 60895 - protein, 10 aa, Homo Sapiens
AIFKGVFVHR

SEQ ID NO: 60896 - protein, 10 aa, Homo Sapiens
AIMKVHRIYR

SEQ ID NO: 60897 - protein, 10 aa, Homo Sapiens
ALAMGSRALR

SEQ ID NO: 60898 - protein, 10 aa, Homo Sapiens
ALAPGLPTAR

SEQ ID NO: 60899 - protein, 10 aa, Homo Sapiens
ALAPKFPEYR

SEQ ID NO: 60900 - protein, 10 aa, Homo Sapiens
ALFASGLIHR

SEQ ID NO: 60901 - protein, 10 aa, Homo Sapiens
ALGTYYPPPR

SEQ ID NO: 60902 - protein, 10 aa, Homo Sapiens
ALKPGIHVPR

SEQ ID NO: 60903 - protein, 10 aa, Homo Sapiens
ALKQGNAIMR

SEQ ID NO: 60904 - protein, 10 aa, Homo Sapiens
ALMDRDLVHR

SEQ ID NO: 60905 - protein, 10 aa, Homo Sapiens
ALMDRGAIVR

SEQ ID NO: 60906 - protein, 10 aa, Homo Sapiens
ALNDAKRELR

SEQ ID NO: 60907 - protein, 10 aa, Homo Sapiens
ALNSIEGVYR

SEQ ID NO: 60908 - protein, 10 aa, Homo Sapiens
ALQEFSKVYR

SEQ ID NO: 60909 - protein, 10 aa, Homo Sapiens
ALQSHQPVAR

SEQ ID NO: 60910 - protein, 10 aa, Homo Sapiens
ALRHPIQVSR

SEQ ID NO: 60911 - protein, 10 aa, Homo Sapiens
AMFGPKGFGR

SEQ ID NO: 60912 - protein, 10 aa, Homo Sapiens
AMFHKVRVPR

SEQ ID NO: 60913 - protein, 10 aa, Homo Sapiens
AQCPFLGPPR

SEQ ID NO: 60914 - protein, 10 aa, Homo Sapiens
AQHGGIYVKR

SEQ ID NO: 60915 - protein, 10 aa, Homo Sapiens
AQKNYPYSPR

SEQ ID NO: 60916 - protein, 10 aa, Homo Sapiens
AQQNSGHFLR

SEQ ID NO: 60917 - protein, 10 aa, Homo Sapiens
AQWQKVLPRR

SEQ ID NO: 60918 - protein, 10 aa, Homo Sapiens
ARVVIERIAR

SEQ ID NO: 60919 - protein, 10 aa, Homo Sapiens
ASHSRPCVFR

SEQ ID NO: 60920 - protein, 10 aa, Homo Sapiens
ASNPCGNIQR

SEQ ID NO: 60921 - protein, 10 aa, Homo Sapiens
ATAAFGHVQR

SEQ ID NO: 60922 - protein, 10 aa, Homo Sapiens
ATAALAWRPP

SEQ ID NO: 60923 - protein, 10 aa, Homo Sapiens
ATAGIIGVNR

SEQ ID NO: 60924 - protein, 10 aa, Homo Sapiens
ATAYRPDWNR

SEQ ID NO: 60925 - protein, 10 aa, Homo Sapiens
ATFDRQELQR

SEQ ID NO: 60926 - protein, 10 aa, Homo Sapiens
ATNAAVTVLR

SEQ ID NO: 60927 - protein, 10 aa, Homo Sapiens
ATNGREGLLR

SEQ ID NO: 60928 - protein, 10 aa, Homo Sapiens
ATQPWNRIQR

SEQ ID NO: 60929 - protein, 10 aa, Homo Sapiens
ATREFIEMWR

SEQ ID NO: 60930 - protein, 10 aa, Homo Sapiens
AVAKLFWSQR

SEQ ID NO: 60931 - protein, 10 aa, Homo Sapiens
AVFPFKPPQR

SEQ ID NO: 60932 - protein, 10 aa, Homo Sapiens
AVIPCFPYAR

SEQ ID NO: 60933 - protein, 10 aa, Homo Sapiens
AVKQGRFYLR

SEQ ID NO: 60934 - protein, 10 aa, Homo Sapiens
EESNYELEGK

SEQ ID NO: 60935 - protein, 10 aa, Homo Sapiens
FIAILIARQC

SEQ ID NO: 60936 - protein, 10 aa, Homo Sapiens
GIKPPPIIGR

SEQ ID NO: 60937 - protein, 10 aa, Homo Sapiens
GLDKKVGAER

SEQ ID NO: 60938 - protein, 10 aa, Homo Sapiens
GQVITIGNER

SEQ ID NO: 60939 - protein, 10 aa, Homo Sapiens
GQYPIWMNQR

SEQ ID NO: 60940 - protein, 10 aa, Homo Sapiens
GTIAGLNVLR

SEQ ID NO: 60941 - protein, 10 aa, Homo Sapiens
GTLQPPFTAR

SEQ ID NO: 60942 - protein, 10 aa, Homo Sapiens
GTNADTPVLR

SEQ ID NO: 60943 - protein, 10 aa, Homo Sapiens
HLHQKGIIYR

SEQ ID NO: 60944 - protein, 10 aa, Homo Sapiens
HLQTGYKVER

SEQ ID NO: 60945 - protein, 10 aa, Homo Sapiens
HLRDFNFSRL

SEQ ID NO: 60946 - protein, 10 aa, Homo Sapiens
HLYEQPKINR

SEQ ID NO: 60947 - protein, 10 aa, Homo Sapiens
HQQLYWSHPR

SEQ ID NO: 60948 - protein, 10 aa, Homo Sapiens
HSQDLSGRLR

SEQ ID NO: 60949 - protein, 10 aa, Homo Sapiens
HTRTPPIIHR

SEQ ID NO: 60950 - protein, 10 aa, Homo Sapiens
HVYDGKFLAR

SEQ ID NO: 60951 - protein, 10 aa, Homo Sapiens
IANPNVPAYR

SEQ ID NO: 60952 - protein, 10 aa, Homo Sapiens
ILANNCPALR

SEQ ID NO: 60953 - protein, 10 aa, Homo Sapiens
ILKTGGGFQR

SEQ ID NO: 60954 - protein, 10 aa, Homo Sapiens
IQFQGGFSSR

SEQ ID NO: 60955 - protein, 10 aa, Homo Sapiens
IVKGPRGTLR

SEQ ID NO: 60956 - protein, 10 aa, Homo Sapiens
IVNDKSQNLR

SEQ ID NO: 60957 - protein, 10 aa, Homo Sapiens
IVNENLVERF

SEQ ID NO: 60958 - protein, 10 aa, Homo Sapiens
IVRPFSIETK

SEQ ID NO: 60959 - protein, 10 aa, Homo Sapiens
KAKQGYVIYR

SEQ ID NO: 60960 - protein, 10 aa, Homo Sapiens
KASELRIQLR

SEQ ID NO: 60961 - protein, 10 aa, Homo Sapiens
KICAAIPTSR

SEQ ID NO: 60962 - protein, 10 aa, Homo Sapiens
KIFAGKVLRL

SEQ ID NO: 60963 - protein, 10 aa, Homo Sapiens
KIHLQIARQR

SEQ ID NO: 60964 - protein, 10 aa, Homo Sapiens
KIKEGAENLR

SEQ ID NO: 60965 - protein, 10 aa, Homo Sapiens
KIKESVIISR

SEQ ID NO: 60966 - protein, 10 aa, Homo Sapiens
KIKIIAPPER

SEQ ID NO: 60967 - protein, 10 aa, Homo Sapiens
KIKNGTPPMR

SEQ ID NO: 60968 - protein, 10 aa, Homo Sapiens
KILEPGRRER

SEQ ID NO: 60969 - protein, 10 aa, Homo Sapiens
KIMPVQKQTR

SEQ ID NO: 60970 - protein, 10 aa, Homo Sapiens
KINPDWKTHR

SEQ ID NO: 60971 - protein, 10 aa, Homo Sapiens
KIRDLIAIER

SEQ ID NO: 60972 - protein, 10 aa, Homo Sapiens
KIRIEDPPRR

SEQ ID NO: 60973 - protein, 10 aa, Homo Sapiens
KIRPHIATLR

SEQ ID NO: 60974 - protein, 10 aa, Homo Sapiens
KIRPHITTLR

SEQ ID NO: 60975 - protein, 10 aa, Homo Sapiens
KISVVTKRER

SEQ ID NO: 60976 - protein, 10 aa, Homo Sapiens
KLAPGGHVGR

SEQ ID NO: 60977 - protein, 10 aa, Homo Sapiens
KLFEREPTKR

SEQ ID NO: 60978 - protein, 10 aa, Homo Sapiens
KLFQGQLVLR

SEQ ID NO: 60979 - protein, 10 aa, Homo Sapiens
KLFSPNIKFR

SEQ ID NO: 60980 - protein, 10 aa, Homo Sapiens
KLHVDPENFR

SEQ ID NO: 60981 - protein, 10 aa, Homo Sapiens
KLIETGERER

SEQ ID NO: 60982 - protein, 10 aa, Homo Sapiens
KLIEWENNRL

SEQ ID NO: 60983 - protein, 10 aa, Homo Sapiens
KLKEIQLQER

SEQ ID NO: 60984 - protein, 10 aa, Homo Sapiens
KLKTVDVIVR

SEQ ID NO: 60985 - protein, 10 aa, Homo Sapiens
KLLCGLLAER

SEQ ID NO: 60986 - protein, 10 aa, Homo Sapiens
KLLERIGIAR

SEQ ID NO: 60987 - protein, 10 aa, Homo Sapiens
KLLGGLAVRR

SEQ ID NO: 60988 - protein, 10 aa, Homo Sapiens
KLLLHRPFFR

SEQ ID NO: 60989 - protein, 10 aa, Homo Sapiens
KLLPNGFTKR

SEQ ID NO: 60990 - protein, 10 aa, Homo Sapiens
KLLWQDSRYR

SEQ ID NO: 60991 - protein, 10 aa, Homo Sapiens
KLMEMKKLLR

SEQ ID NO: 60992 - protein, 10 aa, Homo Sapiens
KLNAKLAELR

SEQ ID NO: 60993 - protein, 10 aa, Homo Sapiens
KLNPYAKTMR

SEQ ID NO: 60994 - protein, 10 aa, Homo Sapiens
KLNSIHISQR

SEQ ID NO: 60995 - protein, 10 aa, Homo Sapiens
KLQELKAILR

SEQ ID NO: 60996 - protein, 10 aa, Homo Sapiens
KLQEYLGKFR

SEQ ID NO: 60997 - protein, 10 aa, Homo Sapiens
KLQGSKRILR

SEQ ID NO: 60998 - protein, 10 aa, Homo Sapiens
KLREAEEALR

SEQ ID NO: 60999 - protein, 10 aa, Homo Sapiens
KLRQPFFQKR

SEQ ID NO: 61000 - protein, 10 aa, Homo Sapiens
KLTDIARHVR

SEQ ID NO: 61001 - protein, 10 aa, Homo Sapiens
KLTFISGRTK

SEQ ID NO: 61002 - protein, 10 aa, Homo Sapiens
KLVSFGRTLT

SEQ ID NO: 61003 - protein, 10 aa, Homo Sapiens
KLYPGKSLLR

SEQ ID NO: 61004 - protein, 10 aa, Homo Sapiens
KLYSEQRAIR

SEQ ID NO: 61005 - protein, 10 aa, Homo Sapiens
KMKDPKQIIR

SEQ ID NO: 61006 - protein, 10 aa, Homo Sapiens
KMLQTDPTAR

SEQ ID NO: 61007 - protein, 10 aa, Homo Sapiens
KMMADYGIRK

SEQ ID NO: 61008 - protein, 10 aa, Homo Sapiens
KMQEQLERNR

SEQ ID NO: 61009 - protein, 10 aa, Homo Sapiens
KMYEEHLKRM

SEQ ID NO: 61010 - protein, 10 aa, Homo Sapiens
KQFQKSLPPR

SEQ ID NO: 61011 - protein, 10 aa, Homo Sapiens
KQIASVMKHR

SEQ ID NO: 61012 - protein, 10 aa, Homo Sapiens
KQINIDFRTR

SEQ ID NO: 61013 - protein, 10 aa, Homo Sapiens
KQKDLSGFYR

SEQ ID NO: 61014 - protein, 10 aa, Homo Sapiens
KQLLKKEWLR

SEQ ID NO: 61015 - protein, 10 aa, Homo Sapiens
KQLNFVFTGR

SEQ ID NO: 61016 - protein, 10 aa, Homo Sapiens
KQNYVHRIGR

SEQ ID NO: 61017 - protein, 10 aa, Homo Sapiens
KQRDDILINR

SEQ ID NO: 61018 - protein, 10 aa, Homo Sapiens
KQRGEEMIAR

SEQ ID NO: 61019 - protein, 10 aa, Homo Sapiens
KQRHVQLLGR

SEQ ID NO: 61020 - protein, 10 aa, Homo Sapiens
KQSPLQKHLR

SEQ ID NO: 61021 - protein, 10 aa, Homo Sapiens
KQVDPSITRR

SEQ ID NO: 61022 - protein, 10 aa, Homo Sapiens
KQWYGKIVCR

SEQ ID NO: 61023 - protein, 10 aa, Homo Sapiens
KQYEEVMVKR

SEQ ID NO: 61024 - protein, 10 aa, Homo Sapiens
KQYNYLHEFR

SEQ ID NO: 61025 - protein, 10 aa, Homo Sapiens
KSAAWHGILR

SEQ ID NO: 61026 - protein, 10 aa, Homo Sapiens
KSANTEPYYR

SEQ ID NO: 61027 - protein, 10 aa, Homo Sapiens
KSFIRKDHLR

SEQ ID NO: 61028 - protein, 10 aa, Homo Sapiens
KSFLGINKER

SEQ ID NO: 61029 - protein, 10 aa, Homo Sapiens
KSFYQFQHYR

SEQ ID NO: 61030 - protein, 10 aa, Homo Sapiens
KSIWNNRWLR

SEQ ID NO: 61031 - protein, 10 aa, Homo Sapiens
KSKDFVQVMR

SEQ ID NO: 61032 - protein, 10 aa, Homo Sapiens
KSLDQAISRF

SEQ ID NO: 61033 - protein, 10 aa, Homo Sapiens
KSNSIIVSPR

SEQ ID NO: 61034 - protein, 10 aa, Homo Sapiens
KSREHGIAMR

SEQ ID NO: 61035 - protein, 10 aa, Homo Sapiens
KSSDIAKTFR

SEQ ID NO: 61036 - protein, 10 aa, Homo Sapiens
KTAGKRYVYR

SEQ ID NO: 61037 - protein, 10 aa, Homo Sapiens
KTAKLILERF

SEQ ID NO: 61038 - protein, 10 aa, Homo Sapiens
KTFEFNKELR

SEQ ID NO: 61039 - protein, 10 aa, Homo Sapiens
KTFPYQHRYR

SEQ ID NO: 61040 - protein, 10 aa, Homo Sapiens
KTFSDEGRLR

SEQ ID NO: 61041 - protein, 10 aa, Homo Sapiens
KTIDKKTFYK

SEQ ID NO: 61042 - protein, 10 aa, Homo Sapiens
KTIDMELVKR

SEQ ID NO: 61043 - protein, 10 aa, Homo Sapiens
KTIDTKTVCR

SEQ ID NO: 61044 - protein, 10 aa, Homo Sapiens
KTKDIVNGLR

SEQ ID NO: 61045 - protein, 10 aa, Homo Sapiens
KTKDPTAALR

SEQ ID NO: 61046 - protein, 10 aa, Homo Sapiens
KTKQEVEISR

SEQ ID NO: 61047 - protein, 10 aa, Homo Sapiens
KTKTEQFQAR

SEQ ID NO: 61048 - protein, 10 aa, Homo Sapiens
KTLPGPKIAR

SEQ ID NO: 61049 - protein, 10 aa, Homo Sapiens
KTLTGVLPER

SEQ ID NO: 61050 - protein, 10 aa, Homo Sapiens
KTMNEKAWKR

SEQ ID NO: 61051 - protein, 10 aa, Homo Sapiens
KTNAKLYCNR

SEQ ID NO: 61052 - protein, 10 aa, Homo Sapiens
KTQGLKIHQR

SEQ ID NO: 61053 - protein, 10 aa, Homo Sapiens
KTQKENTVFR

SEQ ID NO: 61054 - protein, 10 aa, Homo Sapiens
KTQQTRDVLR

SEQ ID NO: 61055 - protein, 10 aa, Homo Sapiens
KTRDAILQLR

SEQ ID NO: 61056 - protein, 10 aa, Homo Sapiens
KTRGFSFPRQ

SEQ ID NO: 61057 - protein, 10 aa, Homo Sapiens
KTRLGRNVYR

SEQ ID NO: 61058 - protein, 10 aa, Homo Sapiens
KTRPFEYLRL

SEQ ID NO: 61059 - protein, 10 aa, Homo Sapiens
KTRSERQLLR

SEQ ID NO: 61060 - protein, 10 aa, Homo Sapiens
KTSTVPPSLR

SEQ ID NO: 61061 - protein, 10 aa, Homo Sapiens
KTWFVEDINR

SEQ ID NO: 61062 - protein, 10 aa, Homo Sapiens
KVAQPKEVYR

SEQ ID NO: 61063 - protein, 10 aa, Homo Sapiens
KVCDLKWIHR

SEQ ID NO: 61064 - protein, 10 aa, Homo Sapiens
KVFCVQRPDR

SEQ ID NO: 61065 - protein, 10 aa, Homo Sapiens
KVFESWMHHW

SEQ ID NO: 61066 - protein, 10 aa, Homo Sapiens
KVFHAERIVR

SEQ ID NO: 61067 - protein, 10 aa, Homo Sapiens
KVFSIGPVFR

SEQ ID NO: 61068 - protein, 10 aa, Homo Sapiens
KVIERAAFPR

SEQ ID NO: 61069 - protein, 10 aa, Homo Sapiens
KVKAPPSVPR

SEQ ID NO: 61070 - protein, 10 aa, Homo Sapiens
KVKCPVFVVR

SEQ ID NO: 61071 - protein, 10 aa, Homo Sapiens
KVMELHKSYR

SEQ ID NO: 61072 - protein, 10 aa, Homo Sapiens
KVMHFVARVR

SEQ ID NO: 61073 - protein, 10 aa, Homo Sapiens
KVQEGERQLR

SEQ ID NO: 61074 - protein, 10 aa, Homo Sapiens
KVQTFPFLGR

SEQ ID NO: 61075 - protein, 10 aa, Homo Sapiens
KVRKIGELVR

SEQ ID NO: 61076 - protein, 10 aa, Homo Sapiens
LLQDLEKKER

SEQ ID NO: 61077 - protein, 10 aa, Homo Sapiens
LLWEEKFPER

SEQ ID NO: 61078 - protein, 10 aa, Homo Sapiens
LQFPVGRIHR

SEQ ID NO: 61079 - protein, 10 aa, Homo Sapiens
LQFPVGRVHR

SEQ ID NO: 61080 - protein, 10 aa, Homo Sapiens
LQNEPLPERL

SEQ ID NO: 61081 - protein, 10 aa, Homo Sapiens
LVNKRIGLYR

SEQ ID NO: 61082 - protein, 10 aa, Homo Sapiens
MIWRGRSTYR

SEQ ID NO: 61083 - protein, 10 aa, Homo Sapiens
MLAPPLGNTR

SEQ ID NO: 61084 - protein, 10 aa, Homo Sapiens
MLITERKHFR

SEQ ID NO: 61085 - protein, 10 aa, Homo Sapiens
MQYPFKPCMR

SEQ ID NO: 61086 - protein, 10 aa, Homo Sapiens
MTKSGYQPPR

SEQ ID NO: 61087 - protein, 10 aa, Homo Sapiens
NSRSRSPIQR

SEQ ID NO: 61088 - protein, 10 aa, Homo Sapiens
QLAQFHFTNR

SEQ ID NO: 61089 - protein, 10 aa, Homo Sapiens
QLFPGYGNGR

SEQ ID NO: 61090 - protein, 10 aa, Homo Sapiens
QLRQGQLTGR

SEQ ID NO: 61091 - protein, 10 aa, Homo Sapiens
QLYPWKYISR

SEQ ID NO: 61092 - protein, 10 aa, Homo Sapiens
QMYDKGLVYR

SEQ ID NO: 61093 - protein, 10 aa, Homo Sapiens
QTILHFPQNR

SEQ ID NO: 61094 - protein, 10 aa, Homo Sapiens
QTIPPPYVVR

SEQ ID NO: 61095 - protein, 10 aa, Homo Sapiens
QTKAPPFVAR

SEQ ID NO: 61096 - protein, 10 aa, Homo Sapiens
QVANSAFVER

SEQ ID NO: 61097 - protein, 10 aa, Homo Sapiens
QVKSGRPSLR

SEQ ID NO: 61098 - protein, 10 aa, Homo Sapiens
QVQPKPSPPR

SEQ ID NO: 61099 - protein, 10 aa, Homo Sapiens
RAKVEVNIPR

SEQ ID NO: 61100 - protein, 10 aa, Homo Sapiens
RALAMLQRFS

SEQ ID NO: 61101 - protein, 10 aa, Homo Sapiens
RALGVPFVPR

SEQ ID NO: 61102 - protein, 10 aa, Homo Sapiens
RGFRYNWPQR

SEQ ID NO: 61103 - protein, 10 aa, Homo Sapiens
RGSGLQLLPR

SEQ ID NO: 61104 - protein, 10 aa, Homo Sapiens
RHPLADILHR

SEQ ID NO: 61105 - protein, 10 aa, Homo Sapiens
RIAELQQRNR

SEQ ID NO: 61106 - protein, 10 aa, Homo Sapiens
RIAEPSVCGR

SEQ ID NO: 61107 - protein, 10 aa, Homo Sapiens
RIAQLVARQR

SEQ ID NO: 61108 - protein, 10 aa, Homo Sapiens
RIASHPILCR

SEQ ID NO: 61109 - protein, 10 aa, Homo Sapiens
RIGVITNRER

SEQ ID NO: 61110 - protein, 10 aa, Homo Sapiens
RIIPGGIADR

SEQ ID NO: 61111 - protein, 10 aa, Homo Sapiens
RIIPGGVAER

SEQ ID NO: 61112 - protein, 10 aa, Homo Sapiens
RIKDSENFRR

SEQ ID NO: 61113 - protein, 10 aa, Homo Sapiens
RIKLEGIITR

SEQ ID NO: 61114 - protein, 10 aa, Homo Sapiens
RIKRHLLTQR

SEQ ID NO: 61115 - protein, 10 aa, Homo Sapiens
RILKSPEIQR

SEQ ID NO: 61116 - protein, 10 aa, Homo Sapiens
RILNSHCFAR

SEQ ID NO: 61117 - protein, 10 aa, Homo Sapiens
RIMDRFNLPR

SEQ ID NO: 61118 - protein, 10 aa, Homo Sapiens
RIMELEGRVR

SEQ ID NO: 61119 - protein, 10 aa, Homo Sapiens
RINSYSGIKR

SEQ ID NO: 61120 - protein, 10 aa, Homo Sapiens
RIQAGDPVAR

SEQ ID NO: 61121 - protein, 10 aa, Homo Sapiens
RIQELEERRR

SEQ ID NO: 61122 - protein, 10 aa, Homo Sapiens
RIRAPIMRMR

SEQ ID NO: 61123 - protein, 10 aa, Homo Sapiens
RIREAAGLFR

SEQ ID NO: 61124 - protein, 10 aa, Homo Sapiens
RIREIELKNR

SEQ ID NO: 61125 - protein, 10 aa, Homo Sapiens
RIREILKASR

SEQ ID NO: 61126 - protein, 10 aa, Homo Sapiens
RIRPAVGWGR

SEQ ID NO: 61127 - protein, 10 aa, Homo Sapiens
RIYAGGEHYR

SEQ ID NO: 61128 - protein, 10 aa, Homo Sapiens
RIYAQKFIDR

SEQ ID NO: 61129 - protein, 10 aa, Homo Sapiens
RIYEIEDRTR

SEQ ID NO: 61130 - protein, 10 aa, Homo Sapiens
RIYELRNKER

SEQ ID NO: 61131 - protein, 10 aa, Homo Sapiens
RIYNGIGVSR

SEQ ID NO: 61132 - protein, 10 aa, Homo Sapiens
RLAAVVGVER

SEQ ID NO: 61133 - protein, 10 aa, Homo Sapiens
RLADTHFVQR

SEQ ID NO: 61134 - protein, 10 aa, Homo Sapiens
RLAEKLRAQK

SEQ ID NO: 61135 - protein, 10 aa, Homo Sapiens
RLAELARRQR

SEQ ID NO: 61136 - protein, 10 aa, Homo Sapiens
RLAELRQRQR

SEQ ID NO: 61137 - protein, 10 aa, Homo Sapiens
RLAPRFGTER

SEQ ID NO: 61138 - protein, 10 aa, Homo Sapiens
RLAQFIGNRR

SEQ ID NO: 61139 - protein, 10 aa, Homo Sapiens
RLFEWVVNRI

SEQ ID NO: 61140 - protein, 10 aa, Homo Sapiens
RLFNHPNILR

SEQ ID NO: 61141 - protein, 10 aa, Homo Sapiens
RLFPLLPLRP

SEQ ID NO: 61142 - protein, 10 aa, Homo Sapiens
RLFSIKPFYR

SEQ ID NO: 61143 - protein, 10 aa, Homo Sapiens
RLFSIVRPRR

SEQ ID NO: 61144 - protein, 10 aa, Homo Sapiens
RLGAPFTVGR

SEQ ID NO: 61145 - protein, 10 aa, Homo Sapiens
RLGPPKRPPR

SEQ ID NO: 61146 - protein, 10 aa, Homo Sapiens
RLHDSLAIER

SEQ ID NO: 61147 - protein, 10 aa, Homo Sapiens
RLHEEGIIYR

SEQ ID NO: 61148 - protein, 10 aa, Homo Sapiens
RLHELRIARL

SEQ ID NO: 61149 - protein, 10 aa, Homo Sapiens
RLHPRAVNCR

SEQ ID NO: 61150 - protein, 10 aa, Homo Sapiens
RLHQVQRITR

SEQ ID NO: 61151 - protein, 10 aa, Homo Sapiens
RLIGWGQIRR

SEQ ID NO: 61152 - protein, 10 aa, Homo Sapiens
RLIPDFPVAR

SEQ ID NO: 61153 - protein, 10 aa, Homo Sapiens
RLKDKIPNVR

SEQ ID NO: 61154 - protein, 10 aa, Homo Sapiens
RLKDSWVERL

SEQ ID NO: 61155 - protein, 10 aa, Homo Sapiens
RLKEDVLEQR

SEQ ID NO: 61156 - protein, 10 aa, Homo Sapiens
RLKEGININR

SEQ ID NO: 61157 - protein, 10 aa, Homo Sapiens
RLKFGFGFHR

SEQ ID NO: 61158 - protein, 10 aa, Homo Sapiens
RLKPFGVQRF

SEQ ID NO: 61159 - protein, 10 aa, Homo Sapiens
RLKQIKEFHR

SEQ ID NO: 61160 - protein, 10 aa, Homo Sapiens
RLKSRQGLLR

SEQ ID NO: 61161 - protein, 10 aa, Homo Sapiens
RLLEYTPTAR

SEQ ID NO: 61162 - protein, 10 aa, Homo Sapiens
RLLGKGGFAR

SEQ ID NO: 61163 - protein, 10 aa, Homo Sapiens
RLLHGSPNLR

SEQ ID NO: 61164 - protein, 10 aa, Homo Sapiens
RLLHHKRIYK

SEQ ID NO: 61165 - protein, 10 aa, Homo Sapiens
RLLNFQRQLR

SEQ ID NO: 61166 - protein, 10 aa, Homo Sapiens
RLLPPVGTGR

SEQ ID NO: 61167 - protein, 10 aa, Homo Sapiens
RLLQHTPSAR

SEQ ID NO: 61168 - protein, 10 aa, Homo Sapiens
RLLSAFLPAR

SEQ ID NO: 61169 - protein, 10 aa, Homo Sapiens
RLLSIVGRQR

SEQ ID NO: 61170 - protein, 10 aa, Homo Sapiens
RLLSPPLRPR

SEQ ID NO: 61171 - protein, 10 aa, Homo Sapiens
RLNPKNVHQR

SEQ ID NO: 61172 - protein, 10 aa, Homo Sapiens
RLNPQYPMFR

SEQ ID NO: 61173 - protein, 10 aa, Homo Sapiens
RLNSSPITTR

SEQ ID NO: 61174 - protein, 10 aa, Homo Sapiens
RLNTSIPQKR

SEQ ID NO: 61175 - protein, 10 aa, Homo Sapiens
RLPELARVLR

SEQ ID NO: 61176 - protein, 10 aa, Homo Sapiens
RLPTSKRSLR

SEQ ID NO: 61177 - protein, 10 aa, Homo Sapiens
RLQAWERAFR

SEQ ID NO: 61178 - protein, 10 aa, Homo Sapiens
RLQDLKSRFR

SEQ ID NO: 61179 - protein, 10 aa, Homo Sapiens
RLQDPQKVAR

SEQ ID NO: 61180 - protein, 10 aa, Homo Sapiens
RLQNEHRVLR

SEQ ID NO: 61181 - protein, 10 aa, Homo Sapiens
RLQPGPPRGR

SEQ ID NO: 61182 - protein, 10 aa, Homo Sapiens
RLQQAGNVLR

SEQ ID NO: 61183 - protein, 10 aa, Homo Sapiens
RLQQDNIRTR

SEQ ID NO: 61184 - protein, 10 aa, Homo Sapiens
RLRAVDFAER

SEQ ID NO: 61185 - protein, 10 aa, Homo Sapiens
RLRDPAQQVR

SEQ ID NO: 61186 - protein, 10 aa, Homo Sapiens
RLREEVTKLR

SEQ ID NO: 61187 - protein, 10 aa, Homo Sapiens
RLREGANINR

SEQ ID NO: 61188 - protein, 10 aa, Homo Sapiens
RLREKLTLLH

SEQ ID NO: 61189 - protein, 10 aa, Homo Sapiens
RLREPLLRRL

SEQ ID NO: 61190 - protein, 10 aa, Homo Sapiens
RLRFGPPAYR

SEQ ID NO: 61191 - protein, 10 aa, Homo Sapiens
RLRGSANAVR

SEQ ID NO: 61192 - protein, 10 aa, Homo Sapiens
RLRPEREPRL

SEQ ID NO: 61193 - protein, 10 aa, Homo Sapiens
RLRPGDGLLR

SEQ ID NO: 61194 - protein, 10 aa, Homo Sapiens
RLSDVLKRKR

SEQ ID NO: 61195 - protein, 10 aa, Homo Sapiens
RLSFVRNRCR

SEQ ID NO: 61196 - protein, 10 aa, Homo Sapiens
RLSPSPTSQR

SEQ ID NO: 61197 - protein, 10 aa, Homo Sapiens
RLTKHTKFVR

SEQ ID NO: 61198 - protein, 10 aa, Homo Sapiens
RLWDRAYVRL

SEQ ID NO: 61199 - protein, 10 aa, Homo Sapiens
RLYSENDRLR

SEQ ID NO: 61200 - protein, 10 aa, Homo Sapiens
RLYVRVKTER

SEQ ID NO: 61201 - protein, 10 aa, Homo Sapiens
RMFAPTKTWR

SEQ ID NO: 61202 - protein, 10 aa, Homo Sapiens
RMFDQQICHR

SEQ ID NO: 61203 - protein, 10 aa, Homo Sapiens
RMFEFQNFER

SEQ ID NO: 61204 - protein, 10 aa, Homo Sapiens
RMFLSFPTTK

SEQ ID NO: 61205 - protein, 10 aa, Homo Sapiens
RMLELPTIYR

SEQ ID NO: 61206 - protein, 10 aa, Homo Sapiens
RMLTSGVVHR

SEQ ID NO: 61207 - protein, 10 aa, Homo Sapiens
RMMNCPKILR

SEQ ID NO: 61208 - protein, 10 aa, Homo Sapiens
RMQEKHLHLR

SEQ ID NO: 61209 - protein, 10 aa, Homo Sapiens
RMRHLKIVYR

SEQ ID NO: 61210 - protein, 10 aa, Homo Sapiens
RQAEVKRLFR

SEQ ID NO: 61211 - protein, 10 aa, Homo Sapiens
RQAFLSGRSR

SEQ ID NO: 61212 - protein, 10 aa, Homo Sapiens
RQATVAMMNR

SEQ ID NO: 61213 - protein, 10 aa, Homo Sapiens
RQHTFALHQR

SEQ ID NO: 61214 - protein, 10 aa, Homo Sapiens
RQINWTVLYR

SEQ ID NO: 61215 - protein, 10 aa, Homo Sapiens
RQKELESNYR

SEQ ID NO: 61216 - protein, 10 aa, Homo Sapiens
RQKGINGQLR

SEQ ID NO: 61217 - protein, 10 aa, Homo Sapiens
RQNKLTYTMR

SEQ ID NO: 61218 - protein, 10 aa, Homo Sapiens
RQQETEHIPR

SEQ ID NO: 61219 - protein, 10 aa, Homo Sapiens
RQQHPPPPPR

SEQ ID NO: 61220 - protein, 10 aa, Homo Sapiens
RSKDLRHAFR

SEQ ID NO: 61221 - protein, 10 aa, Homo Sapiens
RSNKLHFAFR

SEQ ID NO: 61222 - protein, 10 aa, Homo Sapiens
RSQDWKFALR

SEQ ID NO: 61223 - protein, 10 aa, Homo Sapiens
RSQEYKIVLR

SEQ ID NO: 61224 - protein, 10 aa, Homo Sapiens
RSQKPVMVKR

SEQ ID NO: 61225 - protein, 10 aa, Homo Sapiens
RSYKARLPLR

SEQ ID NO: 61226 - protein, 10 aa, Homo Sapiens
RTAFGAVCRR

SEQ ID NO: 61227 - protein, 10 aa, Homo Sapiens
RTAFLKHTQR

SEQ ID NO: 61228 - protein, 10 aa, Homo Sapiens
RTEGRPTVNR

SEQ ID NO: 61229 - protein, 10 aa, Homo Sapiens
RTFLLQGLLR

SEQ ID NO: 61230 - protein, 10 aa, Homo Sapiens
RTFSRHVVQR

SEQ ID NO: 61231 - protein, 10 aa, Homo Sapiens
RTFSSIPVSR

SEQ ID NO: 61232 - protein, 10 aa, Homo Sapiens
RTGPPMGSRF

SEQ ID NO: 61233 - protein, 10 aa, Homo Sapiens
RTHSLRYFRL

SEQ ID NO: 61234 - protein, 10 aa, Homo Sapiens
RTIAKRLVLR

SEQ ID NO: 61235 - protein, 10 aa, Homo Sapiens
RTINVYPNFR

SEQ ID NO: 61236 - protein, 10 aa, Homo Sapiens
RTITARITGR

SEQ ID NO: 61237 - protein, 10 aa, Homo Sapiens
RTKQEVLSLR

SEQ ID NO: 61238 - protein, 10 aa, Homo Sapiens
RTKTELSQLR

SEQ ID NO: 61239 - protein, 10 aa, Homo Sapiens
RTLEFIPKGR

SEQ ID NO: 61240 - protein, 10 aa, Homo Sapiens
RTLPWSSVLR

SEQ ID NO: 61241 - protein, 10 aa, Homo Sapiens
RTLYERIVSR

SEQ ID NO: 61242 - protein, 10 aa, Homo Sapiens
RTNQFSVTRH

SEQ ID NO: 61243 - protein, 10 aa, Homo Sapiens
RTPGNERPPR

SEQ ID NO: 61244 - protein, 10 aa, Homo Sapiens
RTREEIQEVR

SEQ ID NO: 61245 - protein, 10 aa, Homo Sapiens
RTRKFMTNRL

SEQ ID NO: 61246 - protein, 10 aa, Homo Sapiens
RTSEGVLRNR

SEQ ID NO: 61247 - protein, 10 aa, Homo Sapiens
RTSRPLKILR

SEQ ID NO: 61248 - protein, 10 aa, Homo Sapiens
RTVEGALKER

SEQ ID NO: 61249 - protein, 10 aa, Homo Sapiens
RTYDREGFKK

SEQ ID NO: 61250 - protein, 10 aa, Homo Sapiens
RTYSLGSALR

SEQ ID NO: 61251 - protein, 10 aa, Homo Sapiens
RVAAWGGKLR

SEQ ID NO: 61252 - protein, 10 aa, Homo Sapiens
RVADVYRYCR

SEQ ID NO: 61253 - protein, 10 aa, Homo Sapiens
RVAPSLKSQR

SEQ ID NO: 61254 - protein, 10 aa, Homo Sapiens
RVATVTRILR

SEQ ID NO: 61255 - protein, 10 aa, Homo Sapiens
RVAVVNQIAR

SEQ ID NO: 61256 - protein, 10 aa, Homo Sapiens
RVFIGGKINR

SEQ ID NO: 61257 - protein, 10 aa, Homo Sapiens
RVFQGFFTGR

SEQ ID NO: 61258 - protein, 10 aa, Homo Sapiens
RVFRGRFQGR

SEQ ID NO: 61259 - protein, 10 aa, Homo Sapiens
RVFVVKRQNR

SEQ ID NO: 61260 - protein, 10 aa, Homo Sapiens
RVGDNWREAR

SEQ ID NO: 61261 - protein, 10 aa, Homo Sapiens
RVHLPSSIYR

SEQ ID NO: 61262 - protein, 10 aa, Homo Sapiens
RVHSIFVLRL

SEQ ID NO: 61263 - protein, 10 aa, Homo Sapiens
RVIIEKYYTR

SEQ ID NO: 61264 - protein, 10 aa, Homo Sapiens
RVKDLMVINR

SEQ ID NO: 61265 - protein, 10 aa, Homo Sapiens
RVKLPSGSKK

SEQ ID NO: 61266 - protein, 10 aa, Homo Sapiens
RVKNFGIWLR

SEQ ID NO: 61267 - protein, 10 aa, Homo Sapiens
RVKQLQENRL

SEQ ID NO: 61268 - protein, 10 aa, Homo Sapiens
RVKTVWLVGR

SEQ ID NO: 61269 - protein, 10 aa, Homo Sapiens
RVLDVGFVGR

SEQ ID NO: 61270 - protein, 10 aa, Homo Sapiens
RVLEGFIKGR

SEQ ID NO: 61271 - protein, 10 aa, Homo Sapiens
RVLHLEKRER

SEQ ID NO: 61272 - protein, 10 aa, Homo Sapiens
RVLRQISNNR

SEQ ID NO: 61273 - protein, 10 aa, Homo Sapiens
RVLSKAFSRL

SEQ ID NO: 61274 - protein, 10 aa, Homo Sapiens
RVMFDKITSR

SEQ ID NO: 61275 - protein, 10 aa, Homo Sapiens
RVNGSLAVSR

SEQ ID NO: 61276 - protein, 10 aa, Homo Sapiens
RVNKPPYPKL

SEQ ID NO: 61277 - protein, 10 aa, Homo Sapiens
RVQECNYNRL

SEQ ID NO: 61278 - protein, 10 aa, Homo Sapiens
RVQLHIFTGR

SEQ ID NO: 61279 - protein, 10 aa, Homo Sapiens
RVQPRAPCLR

SEQ ID NO: 61280 - protein, 10 aa, Homo Sapiens
RVQSPKPLFR

SEQ ID NO: 61281 - protein, 10 aa, Homo Sapiens
RVRDIAIATR

SEQ ID NO: 61282 - protein, 10 aa, Homo Sapiens
RVRDIQKQVR

SEQ ID NO: 61283 - protein, 10 aa, Homo Sapiens
RVRQSPLATR

SEQ ID NO: 61284 - protein, 10 aa, Homo Sapiens
RVSEVKPSYR

SEQ ID NO: 61285 - protein, 10 aa, Homo Sapiens
RVSPQPMISR

SEQ ID NO: 61286 - protein, 10 aa, Homo Sapiens
RVSPTSPRLR

SEQ ID NO: 61287 - protein, 10 aa, Homo Sapiens
RVSTSHQPLR

SEQ ID NO: 61288 - protein, 10 aa, Homo Sapiens
RVTPAAANYR

SEQ ID NO: 61289 - protein, 10 aa, Homo Sapiens
RVVLVEGKAR

SEQ ID NO: 61290 - protein, 10 aa, Homo Sapiens
RVWIQGKFQK

SEQ ID NO: 61291 - protein, 10 aa, Homo Sapiens
RVYHYFQWRR

SEQ ID NO: 61292 - protein, 10 aa, Homo Sapiens
RYRPGTVALR

SEQ ID NO: 61293 - protein, 10 aa, Homo Sapiens
SDMSLTACKV

SEQ ID NO: 61294 - protein, 10 aa, Homo Sapiens
SIAGCRIIGR

SEQ ID NO: 61295 - protein, 10 aa, Homo Sapiens
SIMKWNRERR

SEQ ID NO: 61296 - protein, 10 aa, Homo Sapiens
SLAGGIWHGR

SEQ ID NO: 61297 - protein, 10 aa, Homo Sapiens
SLFRGEHHSR

SEQ ID NO: 61298 - protein, 10 aa, Homo Sapiens
SLGTLNFPGR

SEQ ID NO: 61299 - protein, 10 aa, Homo Sapiens
SLKGSFGVTR

SEQ ID NO: 61300 - protein, 10 aa, Homo Sapiens
SLLASGRAPR

SEQ ID NO: 61301 - protein, 10 aa, Homo Sapiens
SLNPKTWGRL

SEQ ID NO: 61302 - protein, 10 aa, Homo Sapiens
SLRDYTPASR

SEQ ID NO: 61303 - protein, 10 aa, Homo Sapiens
SLRSVVGISR

SEQ ID NO: 61304 - protein, 10 aa, Homo Sapiens
SLSDRTNLYR

SEQ ID NO: 61305 - protein, 10 aa, Homo Sapiens
SLSPIYPAAR

SEQ ID NO: 61306 - protein, 10 aa, Homo Sapiens
SLTGHISTVR

SEQ ID NO: 61307 - protein, 10 aa, Homo Sapiens
SMRPPIIIHR

SEQ ID NO: 61308 - protein, 10 aa, Homo Sapiens
SSHKTFRIKR

SEQ ID NO: 61309 - protein, 10 aa, Homo Sapiens
STKKIPTVNR

SEQ ID NO: 61310 - protein, 10 aa, Homo Sapiens
STKPGSYIFR

SEQ ID NO: 61311 - protein, 10 aa, Homo Sapiens
STKSFPPCMR

SEQ ID NO: 61312 - protein, 10 aa, Homo Sapiens
STRGKPNFTR

SEQ ID NO: 61313 - protein, 10 aa, Homo Sapiens
STTGHCVHMR

SEQ ID NO: 61314 - protein, 10 aa, Homo Sapiens
STYYGSFVTR

SEQ ID NO: 61315 - protein, 10 aa, Homo Sapiens
SVASLVGRSK

SEQ ID NO: 61316 - protein, 10 aa, Homo Sapiens
SVIPDREYLR

SEQ ID NO: 61317 - protein, 10 aa, Homo Sapiens
SVLEATRVNR

SEQ ID NO: 61318 - protein, 10 aa, Homo Sapiens
SVMYSTLPGR

SEQ ID NO: 61319 - protein, 10 aa, Homo Sapiens
SVRPKPFLNR

SEQ ID NO: 61320 - protein, 10 aa, Homo Sapiens
TGSRPIPSRP

SEQ ID NO: 61321 - protein, 10 aa, Homo Sapiens
TIMDRSIILR

SEQ ID NO: 61322 - protein, 10 aa, Homo Sapiens
TLLEISKRFR

SEQ ID NO: 61323 - protein, 10 aa, Homo Sapiens
TLREYKVVGR

SEQ ID NO: 61324 - protein, 10 aa, Homo Sapiens
TLRKPPAVGR

SEQ ID NO: 61325 - protein, 10 aa, Homo Sapiens
TMYPGLPSRL

SEQ ID NO: 61326 - protein, 10 aa, Homo Sapiens
TTLSRERWLR

SEQ ID NO: 61327 - protein, 10 aa, Homo Sapiens
TVFPHGLPPR

SEQ ID NO: 61328 - protein, 10 aa, Homo Sapiens
TVKATGPALR

SEQ ID NO: 61329 - protein, 10 aa, Homo Sapiens
TVKKGKPELR

SEQ ID NO: 61330 - protein, 10 aa, Homo Sapiens
TVNTSLNVYR

SEQ ID NO: 61331 - protein, 10 aa, Homo Sapiens
TVQKETIHPR

SEQ ID NO: 61332 - protein, 10 aa, Homo Sapiens
TVVSIQRRYR

SEQ ID NO: 61333 - protein, 10 aa, Homo Sapiens
VIIGGDGRRN

SEQ ID NO: 61334 - protein, 10 aa, Homo Sapiens
VKPDQLIKRR

SEQ ID NO: 61335 - protein, 10 aa, Homo Sapiens
VLNEGMPIYR

SEQ ID NO: 61336 - protein, 10 aa, Homo Sapiens
VLVAVKGAHV

SEQ ID NO: 61337 - protein, 10 aa, Homo Sapiens
VLWRKGDIVR

SEQ ID NO: 61338 - protein, 10 aa, Homo Sapiens
VLYDRQGIGR

SEQ ID NO: 61339 - protein, 10 aa, Homo Sapiens
VQAFVRHMQR

SEQ ID NO: 61340 - protein, 10 aa, Homo Sapiens
VQFPHESSPR

SEQ ID NO: 61341 - protein, 10 aa, Homo Sapiens
VQKPGFGVGR

SEQ ID NO: 61342 - protein, 10 aa, Homo Sapiens
VQKPPLNIQR

SEQ ID NO: 61343 - protein, 10 aa, Homo Sapiens
VVKPQSVTVR

SEQ ID NO: 61344 - protein, 10 aa, Homo Sapiens
VVKVGGPVYR

SEQ ID NO: 61345 - protein, 10 aa, Homo Sapiens
VVQGDPRELR

SEQ ID NO: 61346 - protein, 10 aa, Homo Sapiens
VVQQVKGHYR

SEQ ID NO: 61347 - protein, 10 aa, Homo Sapiens
VVREPSGTLR

SEQ ID NO: 61348 - protein, 10 aa, Homo Sapiens
VVYALKRQGR

SEQ ID NO: 61349 - protein, 10 aa, Homo Sapiens
WSIMKWNRER

SEQ ID NO: 61350 - protein, 11 aa, Homo Sapiens
AIQGKEVRFLR

SEQ ID NO: 61351 - protein, 11 aa, Homo Sapiens
AIWSGAALRAR

SEQ ID NO: 61352 - protein, 11 aa, Homo Sapiens
ALAAEALRVAR

SEQ ID NO: 61353 - protein, 11 aa, Homo Sapiens
ALAKFKSSIYR

SEQ ID NO: 61354 - protein, 11 aa, Homo Sapiens
ALAPAEVQVLR

SEQ ID NO: 61355 - protein, 11 aa, Homo Sapiens
ALFNPDVCWDR

SEQ ID NO: 61356 - protein, 11 aa, Homo Sapiens
ALGTYYPPPRL

SEQ ID NO: 61357 - protein, 11 aa, Homo Sapiens
ALIPHSDQRLR

SEQ ID NO: 61358 - protein, 11 aa, Homo Sapiens
ALKPLRDVFQR

SEQ ID NO: 61359 - protein, 11 aa, Homo Sapiens
ALLGGRWLQPR

SEQ ID NO: 61360 - protein, 11 aa, Homo Sapiens
ALMPMKVKQLR

SEQ ID NO: 61361 - protein, 11 aa, Homo Sapiens
ALRALEGLVYR

SEQ ID NO: 61362 - protein, 11 aa, Homo Sapiens
ALVAGIDRYPR

SEQ ID NO: 61363 - protein, 11 aa, Homo Sapiens
ALWDRYMGTLR

SEQ ID NO: 61364 - protein, 11 aa, Homo Sapiens
AMFQPSSPTRR

SEQ ID NO: 61365 - protein, 11 aa, Homo Sapiens
AMKRGEPAIYR

SEQ ID NO: 61366 - protein, 11 aa, Homo Sapiens
AQFDSPEILRR

SEQ ID NO: 61367 - protein, 11 aa, Homo Sapiens
AQFKPSSQILR

SEQ ID NO: 61368 - protein, 11 aa, Homo Sapiens
AQMDRVLREER

SEQ ID NO: 61369 - protein, 11 aa, Homo Sapiens
ASKMESTIKPR

SEQ ID NO: 61370 - protein, 11 aa, Homo Sapiens
ASMPWGDPNYR

SEQ ID NO: 61371 - protein, 11 aa, Homo Sapiens
ASSPGGVYATR

SEQ ID NO: 61372 - protein, 11 aa, Homo Sapiens
ATAPVVTFSPR

SEQ ID NO: 61373 - protein, 11 aa, Homo Sapiens
ATFFPSSSRNR

SEQ ID NO: 61374 - protein, 11 aa, Homo Sapiens
ATLKDITRRLK

SEQ ID NO: 61375 - protein, 11 aa, Homo Sapiens
ATMVPSVLWPR

SEQ ID NO: 61376 - protein, 11 aa, Homo Sapiens
ATRTDKVRALR

SEQ ID NO: 61377 - protein, 11 aa, Homo Sapiens
ATRWAKKIEAR

SEQ ID NO: 61378 - protein, 11 aa, Homo Sapiens
ATVKKGKPELR

SEQ ID NO: 61379 - protein, 11 aa, Homo Sapiens
ATVQQLEGRWR

SEQ ID NO: 61380 - protein, 11 aa, Homo Sapiens
ATYSLANERLR

SEQ ID NO: 61381 - protein, 11 aa, Homo Sapiens
AVFDRDINCRR

SEQ ID NO: 61382 - protein, 11 aa, Homo Sapiens
AVIGGIDGRLR

SEQ ID NO: 61383 - protein, 11 aa, Homo Sapiens
AVKAPGFGDNR

SEQ ID NO: 61384 - protein, 11 aa, Homo Sapiens
AVLPAGAFARR

SEQ ID NO: 61385 - protein, 11 aa, Homo Sapiens
AVLSNPDKRLR

SEQ ID NO: 61386 - protein, 11 aa, Homo Sapiens
AVLSSGLTAAR

SEQ ID NO: 61387 - protein, 11 aa, Homo Sapiens
AVREVLHGNQR

SEQ ID NO: 61388 - protein, 11 aa, Homo Sapiens
AVRNAGSRFLR

SEQ ID NO: 61389 - protein, 11 aa, Homo Sapiens
GGSTMFRDFGR

SEQ ID NO: 61390 - protein, 11 aa, Homo Sapiens
GIKPEWMMIHR

SEQ ID NO: 61391 - protein, 11 aa, Homo Sapiens
GLANGEVRIYR

SEQ ID NO: 61392 - protein, 11 aa, Homo Sapiens
GLAPMGTLPRR

SEQ ID NO: 61393 - protein, 11 aa, Homo Sapiens
GLWARGPGSCR

SEQ ID NO: 61394 - protein, 11 aa, Homo Sapiens
GMNPREPAVYR

SEQ ID NO: 61395 - protein, 11 aa, Homo Sapiens
GQKPGGSDFLR

SEQ ID NO: 61396 - protein, 11 aa, Homo Sapiens
GTKQQEIVVSR

SEQ ID NO: 61397 - protein, 11 aa, Homo Sapiens
GTLGFGDKFKR

SEQ ID NO: 61398 - protein, 11 aa, Homo Sapiens
GTLREYKVVGR

SEQ ID NO: 61399 - protein, 11 aa, Homo Sapiens
GTMSDVLRAER

SEQ ID NO: 61400 - protein, 11 aa, Homo Sapiens
GTQPTVLRTFR

SEQ ID NO: 61401 - protein, 11 aa, Homo Sapiens
GTSSFKESALR

SEQ ID NO: 61402 - protein, 11 aa, Homo Sapiens
GVVPAGVILER

SEQ ID NO: 61403 - protein, 11 aa, Homo Sapiens
GVYATRSSAVR

SEQ ID NO: 61404 - protein, 11 aa, Homo Sapiens
HIIEKDKITTR

SEQ ID NO: 61405 - protein, 11 aa, Homo Sapiens
HLFQYPCARAK

SEQ ID NO: 61406 - protein, 11 aa, Homo Sapiens
HLNSQFPGTQR

SEQ ID NO: 61407 - protein, 11 aa, Homo Sapiens
HQQSGSELALR

SEQ ID NO: 61408 - protein, 11 aa, Homo Sapiens
HTNDTIGSVRR

SEQ ID NO: 61409 - protein, 11 aa, Homo Sapiens
HVKDAGFYVCR

SEQ ID NO: 61410 - protein, 11 aa, Homo Sapiens
ILAFREKEWQR

SEQ ID NO: 61411 - protein, 11 aa, Homo Sapiens
ILKSPGSVVFR

SEQ ID NO: 61412 - protein, 11 aa, Homo Sapiens
ILNDKRHILTK

SEQ ID NO: 61413 - protein, 11 aa, Homo Sapiens
ILQNEPLPERL

SEQ ID NO: 61414 - protein, 11 aa, Homo Sapiens
IQFEPEEDIKR

SEQ ID NO: 61415 - protein, 11 aa, Homo Sapiens
KAFPYSSHLIR

SEQ ID NO: 61416 - protein, 11 aa, Homo Sapiens
KAWPRNAETQR

SEQ ID NO: 61417 - protein, 11 aa, Homo Sapiens
KIFAKPEEQRK

SEQ ID NO: 61418 - protein, 11 aa, Homo Sapiens
KIIEKQPGHIR

SEQ ID NO: 61419 - protein, 11 aa, Homo Sapiens
KIKDFGEAAKR

SEQ ID NO: 61420 - protein, 11 aa, Homo Sapiens
KIKENRQQIVR

SEQ ID NO: 61421 - protein, 11 aa, Homo Sapiens
KILWFIPFRQR

SEQ ID NO: 61422 - protein, 11 aa, Homo Sapiens
KIQDSLGGRVR

SEQ ID NO: 61423 - protein, 11 aa, Homo Sapiens
KIQKHQEHILR

SEQ ID NO: 61424 - protein, 11 aa, Homo Sapiens
KIRVVRKSIAR

SEQ ID NO: 61425 - protein, 11 aa, Homo Sapiens
KIWSQKSGMER

SEQ ID NO: 61426 - protein, 11 aa, Homo Sapiens
KLADFGLARAK

SEQ ID NO: 61427 - protein, 11 aa, Homo Sapiens
KLFDRPQELKL

SEQ ID NO: 61428 - protein, 11 aa, Homo Sapiens
KLFDWANTSRR

SEQ ID NO: 61429 - protein, 11 aa, Homo Sapiens
KLFKDIGLSPR

SEQ ID NO: 61430 - protein, 11 aa, Homo Sapiens
KLFKPPQPPAR

SEQ ID NO: 61431 - protein, 11 aa, Homo Sapiens
KLFQSNDPTLR

SEQ ID NO: 61432 - protein, 11 aa, Homo Sapiens
KLFRGPLVINR

SEQ ID NO: 61433 - protein, 11 aa, Homo Sapiens
KLFSTPSPVIR

SEQ ID NO: 61434 - protein, 11 aa, Homo Sapiens
KLIDPQTQVTR

SEQ ID NO: 61435 - protein, 11 aa, Homo Sapiens
KLIEQDLCRER

SEQ ID NO: 61436 - protein, 11 aa, Homo Sapiens
KLIGEYGLRNK

SEQ ID NO: 61437 - protein, 11 aa, Homo Sapiens
KLIKEGDIVKR

SEQ ID NO: 61438 - protein, 11 aa, Homo Sapiens
KLINRPIIVFR

SEQ ID NO: 61439 - protein, 11 aa, Homo Sapiens
KLKDASKSLER

SEQ ID NO: 61440 - protein, 11 aa, Homo Sapiens
KLKDIVSLVPR

SEQ ID NO: 61441 - protein, 11 aa, Homo Sapiens
KLKDKNTLFTR

SEQ ID NO: 61442 - protein, 11 aa, Homo Sapiens
KLKDLGNLVLR

SEQ ID NO: 61443 - protein, 11 aa, Homo Sapiens
KLKDQNIFVSR

SEQ ID NO: 61444 - protein, 11 aa, Homo Sapiens
KLKDSEAELQR

SEQ ID NO: 61445 - protein, 11 aa, Homo Sapiens
KLKECVSILPR

SEQ ID NO: 61446 - protein, 11 aa, Homo Sapiens
KLKEGAENLRR

SEQ ID NO: 61447 - protein, 11 aa, Homo Sapiens
KLKETGYVVER

SEQ ID NO: 61448 - protein, 11 aa, Homo Sapiens
KLKETSSFRMR

SEQ ID NO: 61449 - protein, 11 aa, Homo Sapiens
KLKGDDLQAIK

SEQ ID NO: 61450 - protein, 11 aa, Homo Sapiens
KLKYLAFLRKR

SEQ ID NO: 61451 - protein, 11 aa, Homo Sapiens
KLLAELEGKLR

SEQ ID NO: 61452 - protein, 11 aa, Homo Sapiens
KLLDWIEGKER

SEQ ID NO: 61453 - protein, 11 aa, Homo Sapiens
KLLKPISGKLR

SEQ ID NO: 61454 - protein, 11 aa, Homo Sapiens
KLLNSSKARLR

SEQ ID NO: 61455 - protein, 11 aa, Homo Sapiens
KLLTRAGSFSR

SEQ ID NO: 61456 - protein, 11 aa, Homo Sapiens
KLMDGSLQRAR

SEQ ID NO: 61457 - protein, 11 aa, Homo Sapiens
KLMDVGLIAIR

SEQ ID NO: 61458 - protein, 11 aa, Homo Sapiens
KLNAKLAELRR

SEQ ID NO: 61459 - protein, 11 aa, Homo Sapiens
KLNEQQSVLQR

SEQ ID NO: 61460 - protein, 11 aa, Homo Sapiens
KLNPYAKTMRR

SEQ ID NO: 61461 - protein, 11 aa, Homo Sapiens
KLPPVYVRKER

SEQ ID NO: 61462 - protein, 11 aa, Homo Sapiens
KLQGEFQLRLR

SEQ ID NO: 61463 - protein, 11 aa, Homo Sapiens
KLQKLNEVRKR

SEQ ID NO: 61464 - protein, 11 aa, Homo Sapiens
KLQTPNTFPKR

SEQ ID NO: 61465 - protein, 11 aa, Homo Sapiens
KLREAEEALRR

SEQ ID NO: 61466 - protein, 11 aa, Homo Sapiens
KLREELGLCER

SEQ ID NO: 61467 - protein, 11 aa, Homo Sapiens
KLREIEENQKR

SEQ ID NO: 61468 - protein, 11 aa, Homo Sapiens
KLRIQEEIAKR

SEQ ID NO: 61469 - protein, 11 aa, Homo Sapiens
KLRPSADELLR

SEQ ID NO: 61470 - protein, 11 aa, Homo Sapiens
KLRTELPAGAR

SEQ ID NO: 61471 - protein, 11 aa, Homo Sapiens
KLTDSVLRSFR

SEQ ID NO: 61472 - protein, 11 aa, Homo Sapiens
KLWDIRDGMCR

SEQ ID NO: 61473 - protein, 11 aa, Homo Sapiens
KLWDVRDSMCR

SEQ ID NO: 61474 - protein, 11 aa, Homo Sapiens
KLWDVREGMCR

SEQ ID NO: 61475 - protein, 11 aa, Homo Sapiens
KLWERNIKSHL

SEQ ID NO: 61476 - protein, 11 aa, Homo Sapiens
KLWMKELQTQR

SEQ ID NO: 61477 - protein, 11 aa, Homo Sapiens
KLYEAYSKVCR

SEQ ID NO: 61478 - protein, 11 aa, Homo Sapiens
KLYVANVGTNR

SEQ ID NO: 61479 - protein, 11 aa, Homo Sapiens
KMIDMAEPAQR

SEQ ID NO: 61480 - protein, 11 aa, Homo Sapiens
KMKESSPLSSR

SEQ ID NO: 61481 - protein, 11 aa, Homo Sapiens
KMKITDFENRR

SEQ ID NO: 61482 - protein, 11 aa, Homo Sapiens
KMLPERGQRVR

SEQ ID NO: 61483 - protein, 11 aa, Homo Sapiens
KMLQHIDYRMR

SEQ ID NO: 61484 - protein, 11 aa, Homo Sapiens
KMQDVDLFIKR

SEQ ID NO: 61485 - protein, 11 aa, Homo Sapiens
KMRLWDLQQLR

SEQ ID NO: 61486 - protein, 11 aa, Homo Sapiens
KQFEGSTSFVR

SEQ ID NO: 61487 - protein, 11 aa, Homo Sapiens
KQLPLVKPYLR

SEQ ID NO: 61488 - protein, 11 aa, Homo Sapiens
KQLQKDKQVYR

SEQ ID NO: 61489 - protein, 11 aa, Homo Sapiens
KQLYDKGLVYR

SEQ ID NO: 61490 - protein, 11 aa, Homo Sapiens
KQMDLNTGRMR

SEQ ID NO: 61491 - protein, 11 aa, Homo Sapiens
KQNEFRDDACR

SEQ ID NO: 61492 - protein, 11 aa, Homo Sapiens
KQNPFWWTHQR

SEQ ID NO: 61493 - protein, 11 aa, Homo Sapiens
KQRDLEGAVSR

SEQ ID NO: 61494 - protein, 11 aa, Homo Sapiens
KQREQPEMVFR

SEQ ID NO: 61495 - protein, 11 aa, Homo Sapiens
KQSQHMTEVVR

SEQ ID NO: 61496 - protein, 11 aa, Homo Sapiens
KSEEKELRKFR

SEQ ID NO: 61497 - protein, 11 aa, Homo Sapiens
KSLLMGKEFQR

SEQ ID NO: 61498 - protein, 11 aa, Homo Sapiens
KSLPSEVERLR

SEQ ID NO: 61499 - protein, 11 aa, Homo Sapiens
KSQEKVGIVGR

SEQ ID NO: 61500 - protein, 11 aa, Homo Sapiens
KTEEEALKHFR

SEQ ID NO: 61501 - protein, 11 aa, Homo Sapiens
KTFQGKPIMAR

SEQ ID NO: 61502 - protein, 11 aa, Homo Sapiens
KTFSQSSKLIR

SEQ ID NO: 61503 - protein, 11 aa, Homo Sapiens
KTFTGHREWVR

SEQ ID NO: 61504 - protein, 11 aa, Homo Sapiens
KTGESGMIVFR

SEQ ID NO: 61505 - protein, 11 aa, Homo Sapiens
KTIDPKVAFPR

SEQ ID NO: 61506 - protein, 11 aa, Homo Sapiens
KTIPKGFSSSR

SEQ ID NO: 61507 - protein, 11 aa, Homo Sapiens
KTITGKTFSSR

SEQ ID NO: 61508 - protein, 11 aa, Homo Sapiens
KTITQVKKIGR

SEQ ID NO: 61509 - protein, 11 aa, Homo Sapiens
KTKIIAKIQQR

SEQ ID NO: 61510 - protein, 11 aa, Homo Sapiens
KTKKGTDVMVR

SEQ ID NO: 61511 - protein, 11 aa, Homo Sapiens
KTKPIHTIIRK

SEQ ID NO: 61512 - protein, 11 aa, Homo Sapiens
KTLAGDVHIVR

SEQ ID NO: 61513 - protein, 11 aa, Homo Sapiens
KTLDKAGVLHR

SEQ ID NO: 61514 - protein, 11 aa, Homo Sapiens
KTLHGSALFQR

SEQ ID NO: 61515 - protein, 11 aa, Homo Sapiens
KTLLDKALTQR

SEQ ID NO: 61516 - protein, 11 aa, Homo Sapiens
KTLNYTARFSR

SEQ ID NO: 61517 - protein, 11 aa, Homo Sapiens
KTLPPTDCRLR

SEQ ID NO: 61518 - protein, 11 aa, Homo Sapiens
KTLSPDQRVER

SEQ ID NO: 61519 - protein, 11 aa, Homo Sapiens
KTNNSEKFERF

SEQ ID NO: 61520 - protein, 11 aa, Homo Sapiens
KTRVIWGKVTR

SEQ ID NO: 61521 - protein, 11 aa, Homo Sapiens
KTSPKPLPSRF

SEQ ID NO: 61522 - protein, 11 aa, Homo Sapiens
KTYAICGAIRR

SEQ ID NO: 61523 - protein, 11 aa, Homo Sapiens
KTYQVTPMTPR

SEQ ID NO: 61524 - protein, 11 aa, Homo Sapiens
KTYYQDRPFFR

SEQ ID NO: 61525 - protein, 11 aa, Homo Sapiens
KVADGFKVVAR

SEQ ID NO: 61526 - protein, 11 aa, Homo Sapiens
KVAELKGHTSR

SEQ ID NO: 61527 - protein, 11 aa, Homo Sapiens
KVAPSELARSR

SEQ ID NO: 61528 - protein, 11 aa, Homo Sapiens
KVFALAEYRTR

SEQ ID NO: 61529 - protein, 11 aa, Homo Sapiens
KVFERVSRSVR

SEQ ID NO: 61530 - protein, 11 aa, Homo Sapiens
KVFNQPKAKAK

SEQ ID NO: 61531 - protein, 11 aa, Homo Sapiens
KVFPEDMAKYR

SEQ ID NO: 61532 - protein, 11 aa, Homo Sapiens
KVFPSHFTQQR

SEQ ID NO: 61533 - protein, 11 aa, Homo Sapiens
KVFSEASSLRR

SEQ ID NO: 61534 - protein, 11 aa, Homo Sapiens
KVFVKSSDLLK

SEQ ID NO: 61535 - protein, 11 aa, Homo Sapiens
KVIDGERVIGR

SEQ ID NO: 61536 - protein, 11 aa, Homo Sapiens
KVKAEGPGLSR

SEQ ID NO: 61537 - protein, 11 aa, Homo Sapiens
KVKCSGPGLER

SEQ ID NO: 61538 - protein, 11 aa, Homo Sapiens
KVKEWYVGVLR

SEQ ID NO: 61539 - protein, 11 aa, Homo Sapiens
KVKSYIHEVAR

SEQ ID NO: 61540 - protein, 11 aa, Homo Sapiens
KVKTPEMIIQK

SEQ ID NO: 61541 - protein, 11 aa, Homo Sapiens
KVLAKQLVHLR

SEQ ID NO: 61542 - protein, 11 aa, Homo Sapiens
KVLSNRPIMFR

SEQ ID NO: 61543 - protein, 11 aa, Homo Sapiens
KVQFRDPKSQR

SEQ ID NO: 61544 - protein, 11 aa, Homo Sapiens
KVQSSLGGRVR

SEQ ID NO: 61545 - protein, 11 aa, Homo Sapiens
KVRGISEVLAR

SEQ ID NO: 61546 - protein, 11 aa, Homo Sapiens
KVRVSQRELSR

SEQ ID NO: 61547 - protein, 11 aa, Homo Sapiens
KVVEDGILKLR

SEQ ID NO: 61548 - protein, 11 aa, Homo Sapiens
LKLGGRVKTWK

SEQ ID NO: 61549 - protein, 11 aa, Homo Sapiens
LLLPAASRPPR

SEQ ID NO: 61550 - protein, 11 aa, Homo Sapiens
LLNDRKVFVGR

SEQ ID NO: 61551 - protein, 11 aa, Homo Sapiens
LLPGESNKIPR

SEQ ID NO: 61552 - protein, 11 aa, Homo Sapiens
LRQETNRLLEH

SEQ ID NO: 61553 - protein, 11 aa, Homo Sapiens
LSYDQAKRVPR

SEQ ID NO: 61554 - protein, 11 aa, Homo Sapiens
LTREHGRAYLR

SEQ ID NO: 61555 - protein, 11 aa, Homo Sapiens
MDAKSLTAWSR

SEQ ID NO: 61556 - protein, 11 aa, Homo Sapiens
MIKGKTPEEIR

SEQ ID NO: 61557 - protein, 11 aa, Homo Sapiens
MLMSTATAFYR

SEQ ID NO: 61558 - protein, 11 aa, Homo Sapiens
MLWERLSSTKR

SEQ ID NO: 61559 - protein, 11 aa, Homo Sapiens
MQIAWSREFLK

SEQ ID NO: 61560 - protein, 11 aa, Homo Sapiens
MVKPTPGLTPR

SEQ ID NO: 61561 - protein, 11 aa, Homo Sapiens
NVGDWLRGVYR

SEQ ID NO: 61562 - protein, 11 aa, Homo Sapiens
QARLRDDTELR

SEQ ID NO: 61563 - protein, 11 aa, Homo Sapiens
QLFRGSSLLFR

SEQ ID NO: 61564 - protein, 11 aa, Homo Sapiens
QLQRRFKEFLR

SEQ ID NO: 61565 - protein, 11 aa, Homo Sapiens
QLRVGEFCHNR

SEQ ID NO: 61566 - protein, 11 aa, Homo Sapiens
QPKIVKWDRDM

SEQ ID NO: 61567 - protein, 11 aa, Homo Sapiens
QQRQEQSYFVR

SEQ ID NO: 61568 - protein, 11 aa, Homo Sapiens
QTMPTNMPPPR

SEQ ID NO: 61569 - protein, 11 aa, Homo Sapiens
QVKREDTLCVR

SEQ ID NO: 61570 - protein, 11 aa, Homo Sapiens
QVRSIQQTMAR

SEQ ID NO: 61571 - protein, 11 aa, Homo Sapiens
QVVGEATFIAR

SEQ ID NO: 61572 - protein, 11 aa, Homo Sapiens
RARPSLTVTPR

SEQ ID NO: 61573 - protein, 11 aa, Homo Sapiens
RAWDGMKEWSR

SEQ ID NO: 61574 - protein, 11 aa, Homo Sapiens
RGFQRDLSSLR

SEQ ID NO: 61575 - protein, 11 aa, Homo Sapiens
RIAPPDRRFSR

SEQ ID NO: 61576 - protein, 11 aa, Homo Sapiens
RIFPVDKSRSR

SEQ ID NO: 61577 - protein, 11 aa, Homo Sapiens
RIKDDEWNIYR

SEQ ID NO: 61578 - protein, 11 aa, Homo Sapiens
RIKDQYKVSVR

SEQ ID NO: 61579 - protein, 11 aa, Homo Sapiens
RIKRALDLNLK

SEQ ID NO: 61580 - protein, 11 aa, Homo Sapiens
RIKTPIPTSLR

SEQ ID NO: 61581 - protein, 11 aa, Homo Sapiens
RIMAKDLVRTR

SEQ ID NO: 61582 - protein, 11 aa, Homo Sapiens
RIMELEGRVRR

SEQ ID NO: 61583 - protein, 11 aa, Homo Sapiens
RINEILSNALK

SEQ ID NO: 61584 - protein, 11 aa, Homo Sapiens
RINELPSTMQR

SEQ ID NO: 61585 - protein, 11 aa, Homo Sapiens
RIQEAVYKNVR

SEQ ID NO: 61586 - protein, 11 aa, Homo Sapiens
RIQEDYLRILR

SEQ ID NO: 61587 - protein, 11 aa, Homo Sapiens
RIQNPSAYAKR

SEQ ID NO: 61588 - protein, 11 aa, Homo Sapiens
RIQNWLSAKVR

SEQ ID NO: 61589 - protein, 11 aa, Homo Sapiens
RIRDSEYEIQR

SEQ ID NO: 61590 - protein, 11 aa, Homo Sapiens
RIREDIAKYLR

SEQ ID NO: 61591 - protein, 11 aa, Homo Sapiens
RIRTGSALVQR

SEQ ID NO: 61592 - protein, 11 aa, Homo Sapiens
RIWGDCTVRKK

SEQ ID NO: 61593 - protein, 11 aa, Homo Sapiens
RIWQSPRFIAR

SEQ ID NO: 61594 - protein, 11 aa, Homo Sapiens
RLADKSVLVCK

SEQ ID NO: 61595 - protein, 11 aa, Homo Sapiens
RLAEKSCRNLR

SEQ ID NO: 61596 - protein, 11 aa, Homo Sapiens
RLAEVIQKHQR

SEQ ID NO: 61597 - protein, 11 aa, Homo Sapiens
RLASSYIAHLR

SEQ ID NO: 61598 - protein, 11 aa, Homo Sapiens
RLEERSSEFYR

SEQ ID NO: 61599 - protein, 11 aa, Homo Sapiens
RLFANRSSIMR

SEQ ID NO: 61600 - protein, 11 aa, Homo Sapiens
RLFDIKPEQQR

SEQ ID NO: 61601 - protein, 11 aa, Homo Sapiens
RLFEEPELTQR

SEQ ID NO: 61602 - protein, 11 aa, Homo Sapiens
RLFEGTGARLR

SEQ ID NO: 61603 - protein, 11 aa, Homo Sapiens
RLFEMPAVLER

SEQ ID NO: 61604 - protein, 11 aa, Homo Sapiens
RLFGLAQRSAR

SEQ ID NO: 61605 - protein, 11 aa, Homo Sapiens
RLFPSVPLFAR

SEQ ID NO: 61606 - protein, 11 aa, Homo Sapiens
RLFQPNLNMDR

SEQ ID NO: 61607 - protein, 11 aa, Homo Sapiens
RLFQPWGSILR

SEQ ID NO: 61608 - protein, 11 aa, Homo Sapiens
RLFQSNDQTLR

SEQ ID NO: 61609 - protein, 11 aa, Homo Sapiens
RLFSIVRPRRL

SEQ ID NO: 61610 - protein, 11 aa, Homo Sapiens
RLFSKSIETLR

SEQ ID NO: 61611 - protein, 11 aa, Homo Sapiens
RLGSWARALLR

SEQ ID NO: 61612 - protein, 11 aa, Homo Sapiens
RLIAAFEQKER

SEQ ID NO: 61613 - protein, 11 aa, Homo Sapiens
RLIAASTSRTR

SEQ ID NO: 61614 - protein, 11 aa, Homo Sapiens
RLIEKKVHSER

SEQ ID NO: 61615 - protein, 11 aa, Homo Sapiens
RLIGLPEGRAR

SEQ ID NO: 61616 - protein, 11 aa, Homo Sapiens
RLILIESRIHR

SEQ ID NO: 61617 - protein, 11 aa, Homo Sapiens
RLKAACNLLQR

SEQ ID NO: 61618 - protein, 11 aa, Homo Sapiens
RLKAQKSLLYR

SEQ ID NO: 61619 - protein, 11 aa, Homo Sapiens
RLKDENGALIR

SEQ ID NO: 61620 - protein, 11 aa, Homo Sapiens
RLKEAYSVKSR

SEQ ID NO: 61621 - protein, 11 aa, Homo Sapiens
RLKEEYQSLIR

SEQ ID NO: 61622 - protein, 11 aa, Homo Sapiens
RLKEKEDALTR

SEQ ID NO: 61623 - protein, 11 aa, Homo Sapiens
RLKGDAWVYKR

SEQ ID NO: 61624 - protein, 11 aa, Homo Sapiens
RLKINLIIHQR

SEQ ID NO: 61625 - protein, 11 aa, Homo Sapiens
RLKNNQSKFFR

SEQ ID NO: 61626 - protein, 11 aa, Homo Sapiens
RLKPTNPAAQK

SEQ ID NO: 61627 - protein, 11 aa, Homo Sapiens
RLKRIAGQDLR

SEQ ID NO: 61628 - protein, 11 aa, Homo Sapiens
RLLDEEISRVR

SEQ ID NO: 61629 - protein, 11 aa, Homo Sapiens
RLLDQRDRIMR

SEQ ID NO: 61630 - protein, 11 aa, Homo Sapiens
RLLEADSKSMR

SEQ ID NO: 61631 - protein, 11 aa, Homo Sapiens
RLLERFHGASR

SEQ ID NO: 61632 - protein, 11 aa, Homo Sapiens
RLLNFPTIVER

SEQ ID NO: 61633 - protein, 11 aa, Homo Sapiens
RLLPAELPAKR

SEQ ID NO: 61634 - protein, 11 aa, Homo Sapiens
RLLPLAPGRLR

SEQ ID NO: 61635 - protein, 11 aa, Homo Sapiens
RLLPRHDDFAR

SEQ ID NO: 61636 - protein, 11 aa, Homo Sapiens
RLLQDPARTLR

SEQ ID NO: 61637 - protein, 11 aa, Homo Sapiens
RLLQTGQERAR

SEQ ID NO: 61638 - protein, 11 aa, Homo Sapiens
RLLRKGNYAER

SEQ ID NO: 61639 - protein, 11 aa, Homo Sapiens
RLLRKGNYSER

SEQ ID NO: 61640 - protein, 11 aa, Homo Sapiens
RLLVVYPWTQR

SEQ ID NO: 61641 - protein, 11 aa, Homo Sapiens
RLMEEDPAFRR

SEQ ID NO: 61642 - protein, 11 aa, Homo Sapiens
RLMMDFDGKNR

SEQ ID NO: 61643 - protein, 11 aa, Homo Sapiens
RLNARIGKMKR

SEQ ID NO: 61644 - protein, 11 aa, Homo Sapiens
RLNDKEGYVPR

SEQ ID NO: 61645 - protein, 11 aa, Homo Sapiens
RLNHEGKIVLR

SEQ ID NO: 61646 - protein, 11 aa, Homo Sapiens
RLNKRKEYMVR

SEQ ID NO: 61647 - protein, 11 aa, Homo Sapiens
RLPEPTTRLPR

SEQ ID NO: 61648 - protein, 11 aa, Homo Sapiens
RLQAANDSVCR

SEQ ID NO: 61649 - protein, 11 aa, Homo Sapiens
RLQDFKGNILR

SEQ ID NO: 61650 - protein, 11 aa, Homo Sapiens
RLQDNRQFRGR

SEQ ID NO: 61651 - protein, 11 aa, Homo Sapiens
RLQPYNGVALR

SEQ ID NO: 61652 - protein, 11 aa, Homo Sapiens
RLQQLTEVSRR

SEQ ID NO: 61653 - protein, 11 aa, Homo Sapiens
RLQQQLEKKQR

SEQ ID NO: 61654 - protein, 11 aa, Homo Sapiens
RLRAAYNLVKR

SEQ ID NO: 61655 - protein, 11 aa, Homo Sapiens
RLRDDLNVTRL

SEQ ID NO: 61656 - protein, 11 aa, Homo Sapiens
RLRDGQLVSQR

SEQ ID NO: 61657 - protein, 11 aa, Homo Sapiens
RLRDQGGVVLR

SEQ ID NO: 61658 - protein, 11 aa, Homo Sapiens
RLRELMGELQR

SEQ ID NO: 61659 - protein, 11 aa, Homo Sapiens
RLRELTSIVNR

SEQ ID NO: 61660 - protein, 11 aa, Homo Sapiens
RLRELVPGVPR

SEQ ID NO: 61661 - protein, 11 aa, Homo Sapiens
RLREQGGAVLR

SEQ ID NO: 61662 - protein, 11 aa, Homo Sapiens
RLRPFHLAAVR

SEQ ID NO: 61663 - protein, 11 aa, Homo Sapiens
RLRPLERPALR

SEQ ID NO: 61664 - protein, 11 aa, Homo Sapiens
RLRPPIMIMMR

SEQ ID NO: 61665 - protein, 11 aa, Homo Sapiens
RLSEGFSIHTR

SEQ ID NO: 61666 - protein, 11 aa, Homo Sapiens
RLTEGSERLPR

SEQ ID NO: 61667 - protein, 11 aa, Homo Sapiens
RLYDSSPSRQR

SEQ ID NO: 61668 - protein, 11 aa, Homo Sapiens
RLYDVPANSMR

SEQ ID NO: 61669 - protein, 11 aa, Homo Sapiens
RLYHPTVPLAR

SEQ ID NO: 61670 - protein, 11 aa, Homo Sapiens
RMAPPASRAPQ

SEQ ID NO: 61671 - protein, 11 aa, Homo Sapiens
RMEEIEGFRYR

SEQ ID NO: 61672 - protein, 11 aa, Homo Sapiens
RMFAPTKTWRR

SEQ ID NO: 61673 - protein, 11 aa, Homo Sapiens
RMFHIRAVILR

SEQ ID NO: 61674 - protein, 11 aa, Homo Sapiens
RMKSLEQDALR

SEQ ID NO: 61675 - protein, 11 aa, Homo Sapiens
RMLEEGSFRGR

SEQ ID NO: 61676 - protein, 11 aa, Homo Sapiens
RMLFKSKAYER

SEQ ID NO: 61677 - protein, 11 aa, Homo Sapiens
RMLPPLTKNQR

SEQ ID NO: 61678 - protein, 11 aa, Homo Sapiens
RMNPNSPSITY

SEQ ID NO: 61679 - protein, 11 aa, Homo Sapiens
RMRVLSKAFSR

SEQ ID NO: 61680 - protein, 11 aa, Homo Sapiens
RMRYISSQIER

SEQ ID NO: 61681 - protein, 11 aa, Homo Sapiens
RQFADPGALQR

SEQ ID NO: 61682 - protein, 11 aa, Homo Sapiens
RQFWFQGNRYR

SEQ ID NO: 61683 - protein, 11 aa, Homo Sapiens
RQIDQFLVVAR

SEQ ID NO: 61684 - protein, 11 aa, Homo Sapiens
RQINWTVLYRR

SEQ ID NO: 61685 - protein, 11 aa, Homo Sapiens
RQKLQDLNDLR

SEQ ID NO: 61686 - protein, 11 aa, Homo Sapiens
RQMAHVQIFQR

SEQ ID NO: 61687 - protein, 11 aa, Homo Sapiens
RQQLRSDIQKR

SEQ ID NO: 61688 - protein, 11 aa, Homo Sapiens
RQQQEEMRQLR

SEQ ID NO: 61689 - protein, 11 aa, Homo Sapiens
RQTSTKGQVLR

SEQ ID NO: 61690 - protein, 11 aa, Homo Sapiens
RQYQMNKNFER

SEQ ID NO: 61691 - protein, 11 aa, Homo Sapiens
RSAPGGIRETR

SEQ ID NO: 61692 - protein, 11 aa, Homo Sapiens
RSIERHAPWVR

SEQ ID NO: 61693 - protein, 11 aa, Homo Sapiens
RSLDVVGKIRR

SEQ ID NO: 61694 - protein, 11 aa, Homo Sapiens
RSWEAAKLFAR

SEQ ID NO: 61695 - protein, 11 aa, Homo Sapiens
RTAPAANLASR

SEQ ID NO: 61696 - protein, 11 aa, Homo Sapiens
RTFATALDTTR

SEQ ID NO: 61697 - protein, 11 aa, Homo Sapiens
RTFGNDARFIR

SEQ ID NO: 61698 - protein, 11 aa, Homo Sapiens
RTFGNEARFIR

SEQ ID NO: 61699 - protein, 11 aa, Homo Sapiens
RTFNRGSHLTR

SEQ ID NO: 61700 - protein, 11 aa, Homo Sapiens
RTFNRKSGVSR

SEQ ID NO: 61701 - protein, 11 aa, Homo Sapiens
RTIGISVDPRR

SEQ ID NO: 61702 - protein, 11 aa, Homo Sapiens
RTIQAHEGFVR

SEQ ID NO: 61703 - protein, 11 aa, Homo Sapiens
RTIQYNMTRTR

SEQ ID NO: 61704 - protein, 11 aa, Homo Sapiens
RTKRWEGGYER

SEQ ID NO: 61705 - protein, 11 aa, Homo Sapiens
RTLKPEGNILR

SEQ ID NO: 61706 - protein, 11 aa, Homo Sapiens
RTLMGPTRVFR

SEQ ID NO: 61707 - protein, 11 aa, Homo Sapiens
RTLTPISGGQR

SEQ ID NO: 61708 - protein, 11 aa, Homo Sapiens
RTMKYTTATGR

SEQ ID NO: 61709 - protein, 11 aa, Homo Sapiens
RTMPLLSLHSR

SEQ ID NO: 61710 - protein, 11 aa, Homo Sapiens
RTMSCSDKILR

SEQ ID NO: 61711 - protein, 11 aa, Homo Sapiens
RTMVDKLLSSR

SEQ ID NO: 61712 - protein, 11 aa, Homo Sapiens
RTMWFAGGFHR

SEQ ID NO: 61713 - protein, 11 aa, Homo Sapiens
RTNERLKVALR

SEQ ID NO: 61714 - protein, 11 aa, Homo Sapiens
RTQLYEYLQNR

SEQ ID NO: 61715 - protein, 11 aa, Homo Sapiens
RTQNVLGEKGR

SEQ ID NO: 61716 - protein, 11 aa, Homo Sapiens
RTQQRYLKVLR

SEQ ID NO: 61717 - protein, 11 aa, Homo Sapiens
RTRDIINVSNR

SEQ ID NO: 61718 - protein, 11 aa, Homo Sapiens
RTRDYASLPPK

SEQ ID NO: 61719 - protein, 11 aa, Homo Sapiens
RTRPEVGEMLR

SEQ ID NO: 61720 - protein, 11 aa, Homo Sapiens
RTRTGSSFSVR

SEQ ID NO: 61721 - protein, 11 aa, Homo Sapiens
RTYDETYQRYR

SEQ ID NO: 61722 - protein, 11 aa, Homo Sapiens
RVAFRDADMQR

SEQ ID NO: 61723 - protein, 11 aa, Homo Sapiens
RVAKFPENRNR

SEQ ID NO: 61724 - protein, 11 aa, Homo Sapiens
RVANHQKDLFR

SEQ ID NO: 61725 - protein, 11 aa, Homo Sapiens
RVAQKKASFLR

SEQ ID NO: 61726 - protein, 11 aa, Homo Sapiens
RVCQGIGMVNR

SEQ ID NO: 61727 - protein, 11 aa, Homo Sapiens
RVCSNRHGLIR

SEQ ID NO: 61728 - protein, 11 aa, Homo Sapiens
RVETRITARLR

SEQ ID NO: 61729 - protein, 11 aa, Homo Sapiens
RVFAAESIIKR

SEQ ID NO: 61730 - protein, 11 aa, Homo Sapiens
RVFEHHGQVRL

SEQ ID NO: 61731 - protein, 11 aa, Homo Sapiens
RVFPVRPGSGR

SEQ ID NO: 61732 - protein, 11 aa, Homo Sapiens
RVFQGAPKGYR

SEQ ID NO: 61733 - protein, 11 aa, Homo Sapiens
RVIDEAKKWER

SEQ ID NO: 61734 - protein, 11 aa, Homo Sapiens
RVIEDRDSQLR

SEQ ID NO: 61735 - protein, 11 aa, Homo Sapiens
RVIQPMGMSPR

SEQ ID NO: 61736 - protein, 11 aa, Homo Sapiens
RVISGHLGWVR

SEQ ID NO: 61737 - protein, 11 aa, Homo Sapiens
RVKDADGVLCR

SEQ ID NO: 61738 - protein, 11 aa, Homo Sapiens
RVKDLESLFHR

SEQ ID NO: 61739 - protein, 11 aa, Homo Sapiens
RVKEPVKELLR

SEQ ID NO: 61740 - protein, 11 aa, Homo Sapiens
RVKETSNENLR

SEQ ID NO: 61741 - protein, 11 aa, Homo Sapiens
RVKEVEEMCKR

SEQ ID NO: 61742 - protein, 11 aa, Homo Sapiens
RVKIADMGFAR

SEQ ID NO: 61743 - protein, 11 aa, Homo Sapiens
RVKQTFSCLPR

SEQ ID NO: 61744 - protein, 11 aa, Homo Sapiens
RVKTPTSQSYR

SEQ ID NO: 61745 - protein, 11 aa, Homo Sapiens
RVLDALVAREK

SEQ ID NO: 61746 - protein, 11 aa, Homo Sapiens
RVLDERLVRLR

SEQ ID NO: 61747 - protein, 11 aa, Homo Sapiens
RVLDTNDRFLR

SEQ ID NO: 61748 - protein, 11 aa, Homo Sapiens
RVLEKLGVTVR

SEQ ID NO: 61749 - protein, 11 aa, Homo Sapiens
RVLLREAGFKR

SEQ ID NO: 61750 - protein, 11 aa, Homo Sapiens
RVLSGHLMQTR

SEQ ID NO: 61751 - protein, 11 aa, Homo Sapiens
RVMMEVQKRQR

SEQ ID NO: 61752 - protein, 11 aa, Homo Sapiens
RVNEVGVDVNR

SEQ ID NO: 61753 - protein, 11 aa, Homo Sapiens
RVNLSAAQTLR

SEQ ID NO: 61754 - protein, 11 aa, Homo Sapiens
RVQEAVESMVK

SEQ ID NO: 61755 - protein, 11 aa, Homo Sapiens
RVQGEAQKVER

SEQ ID NO: 61756 - protein, 11 aa, Homo Sapiens
RVQIHANCRIR

SEQ ID NO: 61757 - protein, 11 aa, Homo Sapiens
RVRVVCGPGLR

SEQ ID NO: 61758 - protein, 11 aa, Homo Sapiens
RVSYKGSISYR

SEQ ID NO: 61759 - protein, 11 aa, Homo Sapiens
RVVEASDRLQR

SEQ ID NO: 61760 - protein, 11 aa, Homo Sapiens
RVVEGNHMVYR

SEQ ID NO: 61761 - protein, 11 aa, Homo Sapiens
RVVKDITNAFR

SEQ ID NO: 61762 - protein, 11 aa, Homo Sapiens
RVVQQEEGWFR

SEQ ID NO: 61763 - protein, 11 aa, Homo Sapiens
RVWDISGLRKK

SEQ ID NO: 61764 - protein, 11 aa, Homo Sapiens
RVYDPASPQRR

SEQ ID NO: 61765 - protein, 11 aa, Homo Sapiens
RVYNGRLKVQR

SEQ ID NO: 61766 - protein, 11 aa, Homo Sapiens
RVYSPPEWISR

SEQ ID NO: 61767 - protein, 11 aa, Homo Sapiens
SIAPGQCRPPR

SEQ ID NO: 61768 - protein, 11 aa, Homo Sapiens
SIIGGGVKAPR

SEQ ID NO: 61769 - protein, 11 aa, Homo Sapiens
SIMKWNRERRR

SEQ ID NO: 61770 - protein, 11 aa, Homo Sapiens
SIRNAHSIHQR

SEQ ID NO: 61771 - protein, 11 aa, Homo Sapiens
SIRRFTTSVVR

SEQ ID NO: 61772 - protein, 11 aa, Homo Sapiens
SIVGENETYPR

SEQ ID NO: 61773 - protein, 11 aa, Homo Sapiens
SLADGRDRPLR

SEQ ID NO: 61774 - protein, 11 aa, Homo Sapiens
SLFDNPRTFSR

SEQ ID NO: 61775 - protein, 11 aa, Homo Sapiens
SLFGRDCSVQR

SEQ ID NO: 61776 - protein, 11 aa, Homo Sapiens
SLGMVLRMNAQ

SEQ ID NO: 61777 - protein, 11 aa, Homo Sapiens
SLHQRGLTVLR

SEQ ID NO: 61778 - protein, 11 aa, Homo Sapiens
SLKFHNELNLR

SEQ ID NO: 61779 - protein, 11 aa, Homo Sapiens
SLKGVDPKFLR

SEQ ID NO: 61780 - protein, 11 aa, Homo Sapiens
SLKHSTTLTNR

SEQ ID NO: 61781 - protein, 11 aa, Homo Sapiens
SLKSQLIVHQR

SEQ ID NO: 61782 - protein, 11 aa, Homo Sapiens
SLNGNSSIVGR

SEQ ID NO: 61783 - protein, 11 aa, Homo Sapiens
SLSRHAALLYR

SEQ ID NO: 61784 - protein, 11 aa, Homo Sapiens
SQFRKDKIWLR

SEQ ID NO: 61785 - protein, 11 aa, Homo Sapiens
SQFVISPPALR

SEQ ID NO: 61786 - protein, 11 aa, Homo Sapiens
SQYGWSGNMER

SEQ ID NO: 61787 - protein, 11 aa, Homo Sapiens
STFIHAEDFAR

SEQ ID NO: 61788 - protein, 11 aa, Homo Sapiens
STIDADQRVLR

SEQ ID NO: 61789 - protein, 11 aa, Homo Sapiens
STIDWNKLYRR

SEQ ID NO: 61790 - protein, 11 aa, Homo Sapiens
STMPHTSGMNR

SEQ ID NO: 61791 - protein, 11 aa, Homo Sapiens
STMYPGLPSRL

SEQ ID NO: 61792 - protein, 11 aa, Homo Sapiens
STQPAPRSIFR

SEQ ID NO: 61793 - protein, 11 aa, Homo Sapiens
STYGWTANMER

SEQ ID NO: 61794 - protein, 11 aa, Homo Sapiens
SVAGLTAAAYR

SEQ ID NO: 61795 - protein, 11 aa, Homo Sapiens
SVKEISDIVQR

SEQ ID NO: 61796 - protein, 11 aa, Homo Sapiens
SVLRANMPLHV

SEQ ID NO: 61797 - protein, 11 aa, Homo Sapiens
SVMDQEMRVKR

SEQ ID NO: 61798 - protein, 11 aa, Homo Sapiens
SVQPEELIYQR

SEQ ID NO: 61799 - protein, 11 aa, Homo Sapiens
SVQPSSSLSAR

SEQ ID NO: 61800 - protein, 11 aa, Homo Sapiens
SVQTADHRFLR

SEQ ID NO: 61801 - protein, 11 aa, Homo Sapiens
SVREGQGFAFR

SEQ ID NO: 61802 - protein, 11 aa, Homo Sapiens
SVRSGYSHLPR

SEQ ID NO: 61803 - protein, 11 aa, Homo Sapiens
SVTPEGVIKQR

SEQ ID NO: 61804 - protein, 11 aa, Homo Sapiens
SVYSPSGPVNR

SEQ ID NO: 61805 - protein, 11 aa, Homo Sapiens
TIMPKDIQLAR

SEQ ID NO: 61806 - protein, 11 aa, Homo Sapiens
TLKPNLTIHQR

SEQ ID NO: 61807 - protein, 11 aa, Homo Sapiens
TLQGYGFPVNR

SEQ ID NO: 61808 - protein, 11 aa, Homo Sapiens
TMKSANICIGR

SEQ ID NO: 61809 - protein, 11 aa, Homo Sapiens
TTFTWNINHAR

SEQ ID NO: 61810 - protein, 11 aa, Homo Sapiens
TVFDAKRLIGR

SEQ ID NO: 61811 - protein, 11 aa, Homo Sapiens
TVIEKTESWPR

SEQ ID NO: 61812 - protein, 11 aa, Homo Sapiens
TVKDLRLVTNR

SEQ ID NO: 61813 - protein, 11 aa, Homo Sapiens
VIRSAVSVHLR

SEQ ID NO: 61814 - protein, 11 aa, Homo Sapiens
VLKTDEGIAYR

SEQ ID NO: 61815 - protein, 11 aa, Homo Sapiens
VLRQPQLGVLR

SEQ ID NO: 61816 - protein, 11 aa, Homo Sapiens
VTTFEALKARV

SEQ ID NO: 61817 - protein, 11 aa, Homo Sapiens
VVAPPGVVVSR

SEQ ID NO: 61818 - protein, 11 aa, Homo Sapiens
VVFSIICWFKR

SEQ ID NO: 61819 - protein, 11 aa, Homo Sapiens
VVKPDQLIKRR

SEQ ID NO: 61820 - protein, 11 aa, Homo Sapiens
VVLKWYENFQR

SEQ ID NO: 61821 - protein, 11 aa, Homo Sapiens
VVRDPAASQPR

SEQ ID NO: 61822 - protein, 8 aa, Homo Sapiens
AAERRGPL

SEQ ID NO: 61823 - protein, 8 aa, Homo Sapiens
APAAIPAL

SEQ ID NO: 61824 - protein, 8 aa, Homo Sapiens
APALAPTL

SEQ ID NO: 61825 - protein, 8 aa, Homo Sapiens
APAPSPQI

SEQ ID NO: 61826 - protein, 8 aa, Homo Sapiens
APAPVPVL

SEQ ID NO: 61827 - protein, 8 aa, Homo Sapiens
APDGLPAL

SEQ ID NO: 61828 - protein, 8 aa, Homo Sapiens
APEEHPVL

SEQ ID NO: 61829 - protein, 8 aa, Homo Sapiens
APFLRIAF

SEQ ID NO: 61830 - protein, 8 aa, Homo Sapiens
APGPGLGL

SEQ ID NO: 61831 - protein, 8 aa, Homo Sapiens
APGPGLLL

SEQ ID NO: 61832 - protein, 8 aa, Homo Sapiens
APGPVIGL

SEQ ID NO: 61833 - protein, 8 aa, Homo Sapiens
APGQGGIL

SEQ ID NO: 61834 - protein, 8 aa, Homo Sapiens
APLLRWVL

SEQ ID NO: 61835 - protein, 8 aa, Homo Sapiens
APLSGPVL

SEQ ID NO: 61836 - protein, 8 aa, Homo Sapiens
APNIISQL

SEQ ID NO: 61837 - protein, 8 aa, Homo Sapiens
APQLLIVL

SEQ ID NO: 61838 - protein, 8 aa, Homo Sapiens
APSPLPKM

SEQ ID NO: 61839 - protein, 8 aa, Homo Sapiens
APTLLPEL

SEQ ID NO: 61840 - protein, 8 aa, Homo Sapiens
APTPIQAL

SEQ ID NO: 61841 - protein, 8 aa, Homo Sapiens
APTPVPAL

SEQ ID NO: 61842 - protein, 8 aa, Homo Sapiens
APVGGHIL

SEQ ID NO: 61843 - protein, 8 aa, Homo Sapiens
APYGRITL

SEQ ID NO: 61844 - protein, 8 aa, Homo Sapiens
APYPSPVL

SEQ ID NO: 61845 - protein, 8 aa, Homo Sapiens
ETYVPKEF

SEQ ID NO: 61846 - protein, 8 aa, Homo Sapiens
FPAEPLEL

SEQ ID NO: 61847 - protein, 8 aa, Homo Sapiens
FPEKKPRL

SEQ ID NO: 61848 - protein, 8 aa, Homo Sapiens
FPHPLPSL

SEQ ID NO: 61849 - protein, 8 aa, Homo Sapiens
FPKEPVEL

SEQ ID NO: 61850 - protein, 8 aa, Homo Sapiens
IPAVGSSL

SEQ ID NO: 61851 - protein, 8 aa, Homo Sapiens
IPHIHKSL

SEQ ID NO: 61852 - protein, 8 aa, Homo Sapiens
IPTCKITL

SEQ ID NO: 61853 - protein, 8 aa, Homo Sapiens
KPFLGVCL

SEQ ID NO: 61854 - protein, 8 aa, Homo Sapiens
LPAPLPGL

SEQ ID NO: 61855 - protein, 8 aa, Homo Sapiens
LPIVTPAL

SEQ ID NO: 61856 - protein, 8 aa, Homo Sapiens
LPSHPLEL

SEQ ID NO: 61857 - protein, 8 aa, Homo Sapiens
LPSNLPQL

SEQ ID NO: 61858 - protein, 8 aa, Homo Sapiens
LPTGSTPL

SEQ ID NO: 61859 - protein, 8 aa, Homo Sapiens
LQAPVLVA

SEQ ID NO: 61860 - protein, 8 aa, Homo Sapiens
MPDSAAAL

SEQ ID NO: 61861 - protein, 8 aa, Homo Sapiens
MPGALPSL

SEQ ID NO: 61862 - protein, 8 aa, Homo Sapiens
MPRWAERL

SEQ ID NO: 61863 - protein, 8 aa, Homo Sapiens
MPVSGPGL

SEQ ID NO: 61864 - protein, 8 aa, Homo Sapiens
PASKRPPL

SEQ ID NO: 61865 - protein, 8 aa, Homo Sapiens
PAWPHRGL

SEQ ID NO: 61866 - protein, 8 aa, Homo Sapiens
PEAKKPRL

SEQ ID NO: 61867 - protein, 8 aa, Homo Sapiens
PHLVGPHL

SEQ ID NO: 61868 - protein, 8 aa, Homo Sapiens
PKRPPSAF

SEQ ID NO: 61869 - protein, 8 aa, Homo Sapiens
PRPPPKPM

SEQ ID NO: 61870 - protein, 8 aa, Homo Sapiens
PRPVLRAL

SEQ ID NO: 61871 - protein, 8 aa, Homo Sapiens
PSAARHSL

SEQ ID NO: 61872 - protein, 8 aa, Homo Sapiens
QTAAAAAL

SEQ ID NO: 61873 - protein, 8 aa, Homo Sapiens
RPFLLRRI

SEQ ID NO: 61874 - protein, 8 aa, Homo Sapiens
RPQQIPVL

SEQ ID NO: 61875 - protein, 8 aa, Homo Sapiens
RPSLLPLH

SEQ ID NO: 61876 - protein, 8 aa, Homo Sapiens
SLHHPTLI

SEQ ID NO: 61877 - protein, 8 aa, Homo Sapiens
SPAIGAYL

SEQ ID NO: 61878 - protein, 8 aa, Homo Sapiens
SPAILPPL

SEQ ID NO: 61879 - protein, 8 aa, Homo Sapiens
SPAITATL

SEQ ID NO: 61880 - protein, 8 aa, Homo Sapiens
SPAPRTAL

SEQ ID NO: 61881 - protein, 8 aa, Homo Sapiens
SPASLSSL

SEQ ID NO: 61882 - protein, 8 aa, Homo Sapiens
SPAVGSIL

SEQ ID NO: 61883 - protein, 8 aa, Homo Sapiens
SPEAACVI

SEQ ID NO: 61884 - protein, 8 aa, Homo Sapiens
SPFFREAL

SEQ ID NO: 61885 - protein, 8 aa, Homo Sapiens
SPFFRNLL

SEQ ID NO: 61886 - protein, 8 aa, Homo Sapiens
SPGLGGPL

SEQ ID NO: 61887 - protein, 8 aa, Homo Sapiens
SPIIRPLL

SEQ ID NO: 61888 - protein, 8 aa, Homo Sapiens
SPIRPLGL

SEQ ID NO: 61889 - protein, 8 aa, Homo Sapiens
SPLGSPEL

SEQ ID NO: 61890 - protein, 8 aa, Homo Sapiens
SPLPLTAL

SEQ ID NO: 61891 - protein, 8 aa, Homo Sapiens
SPLYRDEL

SEQ ID NO: 61892 - protein, 8 aa, Homo Sapiens
SPMLLVAL

SEQ ID NO: 61893 - protein, 8 aa, Homo Sapiens
SPMSVNAV

SEQ ID NO: 61894 - protein, 8 aa, Homo Sapiens
SPNKLYTL

SEQ ID NO: 61895 - protein, 8 aa, Homo Sapiens
SPQPGSAL

SEQ ID NO: 61896 - protein, 8 aa, Homo Sapiens
SPTIGKQL

SEQ ID NO: 61897 - protein, 8 aa, Homo Sapiens
SPTQLPIL

SEQ ID NO: 61898 - protein, 8 aa, Homo Sapiens
SPVFKTVL

SEQ ID NO: 61899 - protein, 8 aa, Homo Sapiens
SPVLLNCL

SEQ ID NO: 61900 - protein, 8 aa, Homo Sapiens
SPVVHSVL

SEQ ID NO: 61901 - protein, 8 aa, Homo Sapiens
SPVVRVAV

SEQ ID NO: 61902 - protein, 8 aa, Homo Sapiens
SPWPGTTL

SEQ ID NO: 61903 - protein, 8 aa, Homo Sapiens
SPYYRTKL

SEQ ID NO: 61904 - protein, 8 aa, Homo Sapiens
TPAALAAL

SEQ ID NO: 61905 - protein, 8 aa, Homo Sapiens
TPAVGPPL

SEQ ID NO: 61906 - protein, 8 aa, Homo Sapiens
TPLLMQAL

SEQ ID NO: 61907 - protein, 8 aa, Homo Sapiens
TPMLLRAL

SEQ ID NO: 61908 - protein, 8 aa, Homo Sapiens
TPTQGSVL

SEQ ID NO: 61909 - protein, 8 aa, Homo Sapiens
VAVPGQPI

SEQ ID NO: 61910 - protein, 8 aa, Homo Sapiens
VPLGPGQI

SEQ ID NO: 61911 - protein, 8 aa, Homo Sapiens
VPQGGPVL

SEQ ID NO: 61912 - protein, 8 aa, Homo Sapiens
YPNPLPVL

SEQ ID NO: 61913 - protein, 8 aa, Homo Sapiens
YPTSIASL

SEQ ID NO: 61914 - protein, 9 aa, Homo Sapiens
AAAAPSPVL

SEQ ID NO: 61915 - protein, 9 aa, Homo Sapiens
AAAAPSPVM

SEQ ID NO: 61916 - protein, 9 aa, Homo Sapiens
AAAGPGAAL

SEQ ID NO: 61917 - protein, 9 aa, Homo Sapiens
AAMAGRLMI

SEQ ID NO: 61918 - protein, 9 aa, Homo Sapiens
AARPATSTL

SEQ ID NO: 61919 - protein, 9 aa, Homo Sapiens
AARWASAKL

SEQ ID NO: 61920 - protein, 9 aa, Homo Sapiens
AARWVAKSL

SEQ ID NO: 61921 - protein, 9 aa, Homo Sapiens
AAYLRALSL

SEQ ID NO: 61922 - protein, 9 aa, Homo Sapiens
AGTPSPIQL

SEQ ID NO: 61923 - protein, 9 aa, Homo Sapiens
AIIRDRAAL

SEQ ID NO: 61924 - protein, 9 aa, Homo Sapiens
AIRNAMGSL

SEQ ID NO: 61925 - protein, 9 aa, Homo Sapiens
ALAPALSAP

SEQ ID NO: 61926 - protein, 9 aa, Homo Sapiens
APAAAAGLL

SEQ ID NO: 61927 - protein, 9 aa, Homo Sapiens
APAAAGAAL

SEQ ID NO: 61928 - protein, 9 aa, Homo Sapiens
APAAAPSSL

SEQ ID NO: 61929 - protein, 9 aa, Homo Sapiens
APAAATVAV

SEQ ID NO: 61930 - protein, 9 aa, Homo Sapiens
APAAAVPTL

SEQ ID NO: 61931 - protein, 9 aa, Homo Sapiens
APAAPGLSL

SEQ ID NO: 61932 - protein, 9 aa, Homo Sapiens
APAAVALVL

SEQ ID NO: 61933 - protein, 9 aa, Homo Sapiens
APAELKSPF

SEQ ID NO: 61934 - protein, 9 aa, Homo Sapiens
APAERQIDL

SEQ ID NO: 61935 - protein, 9 aa, Homo Sapiens
APAGGAGAL

SEQ ID NO: 61936 - protein, 9 aa, Homo Sapiens
APAGGTLLL

SEQ ID NO: 61937 - protein, 9 aa, Homo Sapiens
APAGSIISL

SEQ ID NO: 61938 - protein, 9 aa, Homo Sapiens
APALLGLAL

SEQ ID NO: 61939 - protein, 9 aa, Homo Sapiens
APALPGPAL

SEQ ID NO: 61940 - protein, 9 aa, Homo Sapiens
APALPGPQF

SEQ ID NO: 61941 - protein, 9 aa, Homo Sapiens
APALSGANL

SEQ ID NO: 61942 - protein, 9 aa, Homo Sapiens
APALVSKKL

SEQ ID NO: 61943 - protein, 9 aa, Homo Sapiens
APAPAAHVA

SEQ ID NO: 61944 - protein, 9 aa, Homo Sapiens
APAPASISL

SEQ ID NO: 61945 - protein, 9 aa, Homo Sapiens
APAPESITL

SEQ ID NO: 61946 - protein, 9 aa, Homo Sapiens
APAPGAPLL

SEQ ID NO: 61947 - protein, 9 aa, Homo Sapiens
APAPGLGAA

SEQ ID NO: 61948 - protein, 9 aa, Homo Sapiens
APAPIHNQF

SEQ ID NO: 61949 - protein, 9 aa, Homo Sapiens
APAPPPEEV

SEQ ID NO: 61950 - protein, 9 aa, Homo Sapiens
APAPPSSGL

SEQ ID NO: 61951 - protein, 9 aa, Homo Sapiens
APAPRPSLL

SEQ ID NO: 61952 - protein, 9 aa, Homo Sapiens
APAPSTVHF

SEQ ID NO: 61953 - protein, 9 aa, Homo Sapiens
APAPTAVVL

SEQ ID NO: 61954 - protein, 9 aa, Homo Sapiens
APAPVQPPM

SEQ ID NO: 61955 - protein, 9 aa, Homo Sapiens
APASAVSGL

SEQ ID NO: 61956 - protein, 9 aa, Homo Sapiens
APASFGKSF

SEQ ID NO: 61957 - protein, 9 aa, Homo Sapiens
APASGYLTF

SEQ ID NO: 61958 - protein, 9 aa, Homo Sapiens
APASPFRQL

SEQ ID NO: 61959 - protein, 9 aa, Homo Sapiens
APASRLLAL

SEQ ID NO: 61960 - protein, 9 aa, Homo Sapiens
APASVHSEI

SEQ ID NO: 61961 - protein, 9 aa, Homo Sapiens
APASWWNHM

SEQ ID NO: 61962 - protein, 9 aa, Homo Sapiens
APATVGLAF

SEQ ID NO: 61963 - protein, 9 aa, Homo Sapiens
APAYLPRSL

SEQ ID NO: 61964 - protein, 9 aa, Homo Sapiens
APDAKLITL

SEQ ID NO: 61965 - protein, 9 aa, Homo Sapiens
APDEAAEAL

SEQ ID NO: 61966 - protein, 9 aa, Homo Sapiens
APDIPTPVL

SEQ ID NO: 61967 - protein, 9 aa, Homo Sapiens
APDSQRLKL

SEQ ID NO: 61968 - protein, 9 aa, Homo Sapiens
APEFRRLGL

SEQ ID NO: 61969 - protein, 9 aa, Homo Sapiens
APELLRALL

SEQ ID NO: 61970 - protein, 9 aa, Homo Sapiens
APELQRHEL

SEQ ID NO: 61971 - protein, 9 aa, Homo Sapiens
APFLRNVEL

SEQ ID NO: 61972 - protein, 9 aa, Homo Sapiens
APFLRQEFI

SEQ ID NO: 61973 - protein, 9 aa, Homo Sapiens
APFTAGTSL

SEQ ID NO: 61974 - protein, 9 aa, Homo Sapiens
APGAFIASL

SEQ ID NO: 61975 - protein, 9 aa, Homo Sapiens
APGEFRAIM

SEQ ID NO: 61976 - protein, 9 aa, Homo Sapiens
APGEPGSAF

SEQ ID NO: 61977 - protein, 9 aa, Homo Sapiens
APGEVGSVL

SEQ ID NO: 61978 - protein, 9 aa, Homo Sapiens
APGGGPGTL

SEQ ID NO: 61979 - protein, 9 aa, Homo Sapiens
APGIRSWSL

SEQ ID NO: 61980 - protein, 9 aa, Homo Sapiens
APGLFGTPL

SEQ ID NO: 61981 - protein, 9 aa, Homo Sapiens
APGLIKTSF

SEQ ID NO: 61982 - protein, 9 aa, Homo Sapiens
APGPGRKEL

SEQ ID NO: 61983 - protein, 9 aa, Homo Sapiens
APGPPSVVV

SEQ ID NO: 61984 - protein, 9 aa, Homo Sapiens
APGPSGQSV

SEQ ID NO: 61985 - protein, 9 aa, Homo Sapiens
APGQPGTIL

SEQ ID NO: 61986 - protein, 9 aa, Homo Sapiens
APGQPSPVL

SEQ ID NO: 61987 - protein, 9 aa, Homo Sapiens
APGQRVGML

SEQ ID NO: 61988 - protein, 9 aa, Homo Sapiens
APGSWSQVL

SEQ ID NO: 61989 - protein, 9 aa, Homo Sapiens
APGVPGHTV

SEQ ID NO: 61990 - protein, 9 aa, Homo Sapiens
APGVRAVEL

SEQ ID NO: 61991 - protein, 9 aa, Homo Sapiens
APGYLPTSL

SEQ ID NO: 61992 - protein, 9 aa, Homo Sapiens
APHDYGLIL

SEQ ID NO: 61993 - protein, 9 aa, Homo Sapiens
APHEILIQI

SEQ ID NO: 61994 - protein, 9 aa, Homo Sapiens
APHLTHHTL

SEQ ID NO: 61995 - protein, 9 aa, Homo Sapiens
APHLVGPHL

SEQ ID NO: 61996 - protein, 9 aa, Homo Sapiens
APHWKRHQL

SEQ ID NO: 61997 - protein, 9 aa, Homo Sapiens
APIAKVGVL

SEQ ID NO: 61998 - protein, 9 aa, Homo Sapiens
APIASIHSF

SEQ ID NO: 61999 - protein, 9 aa, Homo Sapiens
APIMSGQGL

SEQ ID NO: 62000 - protein, 9 aa, Homo Sapiens
APINFTSRL

SEQ ID NO: 62001 - protein, 9 aa, Homo Sapiens
APISDIIAI

SEQ ID NO: 62002 - protein, 9 aa, Homo Sapiens
APITDPQQL

SEQ ID NO: 62003 - protein, 9 aa, Homo Sapiens
APKPGGLSL

SEQ ID NO: 62004 - protein, 9 aa, Homo Sapiens
APKPKWTQL

SEQ ID NO: 62005 - protein, 9 aa, Homo Sapiens
APKRPPLAF

SEQ ID NO: 62006 - protein, 9 aa, Homo Sapiens
APKRPPSAF

SEQ ID NO: 62007 - protein, 9 aa, Homo Sapiens
APLAVFQML

SEQ ID NO: 62008 - protein, 9 aa, Homo Sapiens
APLDSIHSL

SEQ ID NO: 62009 - protein, 9 aa, Homo Sapiens
APLEDEATL

SEQ ID NO: 62010 - protein, 9 aa, Homo Sapiens
APLGGTPTL

SEQ ID NO: 62011 - protein, 9 aa, Homo Sapiens
APLGQFVSL

SEQ ID NO: 62012 - protein, 9 aa, Homo Sapiens
APLGVGLGL

SEQ ID NO: 62013 - protein, 9 aa, Homo Sapiens
APLPGMTSL

SEQ ID NO: 62014 - protein, 9 aa, Homo Sapiens
APLQHRHVL

SEQ ID NO: 62015 - protein, 9 aa, Homo Sapiens
APMDVRQWV

SEQ ID NO: 62016 - protein, 9 aa, Homo Sapiens
APMIKKIAF

SEQ ID NO: 62017 - protein, 9 aa, Homo Sapiens
APMMVSNIL

SEQ ID NO: 62018 - protein, 9 aa, Homo Sapiens
APMSAAHQL

SEQ ID NO: 62019 - protein, 9 aa, Homo Sapiens
APMSPSTAL

SEQ ID NO: 62020 - protein, 9 aa, Homo Sapiens
APNERPYSL

SEQ ID NO: 62021 - protein, 9 aa, Homo Sapiens
APNGAGLVL

SEQ ID NO: 62022 - protein, 9 aa, Homo Sapiens
APNLRGSGV

SEQ ID NO: 62023 - protein, 9 aa, Homo Sapiens
APNYRLKSL

SEQ ID NO: 62024 - protein, 9 aa, Homo Sapiens
APQGGMAAL

SEQ ID NO: 62025 - protein, 9 aa, Homo Sapiens
APQLTASRL

SEQ ID NO: 62026 - protein, 9 aa, Homo Sapiens
APQPAKPRL

SEQ ID NO: 62027 - protein, 9 aa, Homo Sapiens
APQPAQVAL

SEQ ID NO: 62028 - protein, 9 aa, Homo Sapiens
APQRPLSTF

SEQ ID NO: 62029 - protein, 9 aa, Homo Sapiens
APQRVRVTL

SEQ ID NO: 62030 - protein, 9 aa, Homo Sapiens
APQSFRAEL

SEQ ID NO: 62031 - protein, 9 aa, Homo Sapiens
APQTSTPSL

SEQ ID NO: 62032 - protein, 9 aa, Homo Sapiens
APQVHIFSL

SEQ ID NO: 62033 - protein, 9 aa, Homo Sapiens
APRAGTPGF

SEQ ID NO: 62034 - protein, 9 aa, Homo Sapiens
APRDWKATL

SEQ ID NO: 62035 - protein, 9 aa, Homo Sapiens
APRELGLGL

SEQ ID NO: 62036 - protein, 9 aa, Homo Sapiens
APRHGSLGF

SEQ ID NO: 62037 - protein, 9 aa, Homo Sapiens
APRKPDWDL

SEQ ID NO: 62038 - protein, 9 aa, Homo Sapiens
APRLMITHI

SEQ ID NO: 62039 - protein, 9 aa, Homo Sapiens
APRLQSEVA

SEQ ID NO: 62040 - protein, 9 aa, Homo Sapiens
APRPAGSYL

SEQ ID NO: 62041 - protein, 9 aa, Homo Sapiens
APRPPFSTM

SEQ ID NO: 62042 - protein, 9 aa, Homo Sapiens
APRPPPKPM

SEQ ID NO: 62043 - protein, 9 aa, Homo Sapiens
APRPPVSAA

SEQ ID NO: 62044 - protein, 9 aa, Homo Sapiens
APRQPGLMA

SEQ ID NO: 62045 - protein, 9 aa, Homo Sapiens
APRTIFQRV

SEQ ID NO: 62046 - protein, 9 aa, Homo Sapiens
APRTVALTA

SEQ ID NO: 62047 - protein, 9 aa, Homo Sapiens
APRTVLLLL

SEQ ID NO: 62048 - protein, 9 aa, Homo Sapiens
APRVPVQAL

SEQ ID NO: 62049 - protein, 9 aa, Homo Sapiens
APRYSAPVI

SEQ ID NO: 62050 - protein, 9 aa, Homo Sapiens
APSAAPEAL

SEQ ID NO: 62051 - protein, 9 aa, Homo Sapiens
APSAGGCLL

SEQ ID NO: 62052 - protein, 9 aa, Homo Sapiens
APSAPAAAV

SEQ ID NO: 62053 - protein, 9 aa, Homo Sapiens
APSASVVLL

SEQ ID NO: 62054 - protein, 9 aa, Homo Sapiens
APSATMSSF

SEQ ID NO: 62055 - protein, 9 aa, Homo Sapiens
APSEKFLNM

SEQ ID NO: 62056 - protein, 9 aa, Homo Sapiens
APSESFVVL

SEQ ID NO: 62057 - protein, 9 aa, Homo Sapiens
APSGIGSIF

SEQ ID NO: 62058 - protein, 9 aa, Homo Sapiens
APSIQTPSL

SEQ ID NO: 62059 - protein, 9 aa, Homo Sapiens
APSLKNAAF

SEQ ID NO: 62060 - protein, 9 aa, Homo Sapiens
APSLKQFSL

SEQ ID NO: 62061 - protein, 9 aa, Homo Sapiens
APSLVAPAL

SEQ ID NO: 62062 - protein, 9 aa, Homo Sapiens
APSPLQPAL

SEQ ID NO: 62063 - protein, 9 aa, Homo Sapiens
APSPLSSSL

SEQ ID NO: 62064 - protein, 9 aa, Homo Sapiens
APSPPAVDL

SEQ ID NO: 62065 - protein, 9 aa, Homo Sapiens
APSPPLRAL

SEQ ID NO: 62066 - protein, 9 aa, Homo Sapiens
APSPPLSGL

SEQ ID NO: 62067 - protein, 9 aa, Homo Sapiens
APSPRPLSL

SEQ ID NO: 62068 - protein, 9 aa, Homo Sapiens
APSPVIPRL

SEQ ID NO: 62069 - protein, 9 aa, Homo Sapiens
APSQQQPML

SEQ ID NO: 62070 - protein, 9 aa, Homo Sapiens
APSQQRQQI

SEQ ID NO: 62071 - protein, 9 aa, Homo Sapiens
APSRNGMVL

SEQ ID NO: 62072 - protein, 9 aa, Homo Sapiens
APSRSLNEL

SEQ ID NO: 62073 - protein, 9 aa, Homo Sapiens
APSSPGSSW

SEQ ID NO: 62074 - protein, 9 aa, Homo Sapiens
APSSPRPAL

SEQ ID NO: 62075 - protein, 9 aa, Homo Sapiens
APSYLARSL

SEQ ID NO: 62076 - protein, 9 aa, Homo Sapiens
APSYPMASL

SEQ ID NO: 62077 - protein, 9 aa, Homo Sapiens
APTFTGSFL

SEQ ID NO: 62078 - protein, 9 aa, Homo Sapiens
APTPAGLSL

SEQ ID NO: 62079 - protein, 9 aa, Homo Sapiens
APTPAPSTI

SEQ ID NO: 62080 - protein, 9 aa, Homo Sapiens
APTPARPVL

SEQ ID NO: 62081 - protein, 9 aa, Homo Sapiens
APVASPAAL

SEQ ID NO: 62082 - protein, 9 aa, Homo Sapiens
APVAVWAAL

SEQ ID NO: 62083 - protein, 9 aa, Homo Sapiens
APVGGSPGL

SEQ ID NO: 62084 - protein, 9 aa, Homo Sapiens
APVGIRHRL

SEQ ID NO: 62085 - protein, 9 aa, Homo Sapiens
APVGSGSAL

SEQ ID NO: 62086 - protein, 9 aa, Homo Sapiens
APVGVHPSL

SEQ ID NO: 62087 - protein, 9 aa, Homo Sapiens
APVLPHTAV

SEQ ID NO: 62088 - protein, 9 aa, Homo Sapiens
APVNVTTEV

SEQ ID NO: 62089 - protein, 9 aa, Homo Sapiens
APVPPPTSL

SEQ ID NO: 62090 - protein, 9 aa, Homo Sapiens
APVSPRPGL

SEQ ID NO: 62091 - protein, 9 aa, Homo Sapiens
APVYLAAVI

SEQ ID NO: 62092 - protein, 9 aa, Homo Sapiens
APVYMAAVI

SEQ ID NO: 62093 - protein, 9 aa, Homo Sapiens
APWEKRVDL

SEQ ID NO: 62094 - protein, 9 aa, Homo Sapiens
APWHPPTLL

SEQ ID NO: 62095 - protein, 9 aa, Homo Sapiens
APWQVVPEL

SEQ ID NO: 62096 - protein, 9 aa, Homo Sapiens
APYGGPIAL

SEQ ID NO: 62097 - protein, 9 aa, Homo Sapiens
APYQFLTAF

SEQ ID NO: 62098 - protein, 9 aa, Homo Sapiens
APYSRPKQL

SEQ ID NO: 62099 - protein, 9 aa, Homo Sapiens
AVAKHFVAL

SEQ ID NO: 62100 - protein, 9 aa, Homo Sapiens
AVAPVASAL

SEQ ID NO: 62101 - protein, 9 aa, Homo Sapiens
AVEPGRPPL

SEQ ID NO: 62102 - protein, 9 aa, Homo Sapiens
AVRLIMDSL

SEQ ID NO: 62103 - protein, 9 aa, Homo Sapiens
AVRLITSSL

SEQ ID NO: 62104 - protein, 9 aa, Homo Sapiens
DPMKARVVL

SEQ ID NO: 62105 - protein, 9 aa, Homo Sapiens
EPIPKGPVL

SEQ ID NO: 62106 - protein, 9 aa, Homo Sapiens
EPRFVLRAL

SEQ ID NO: 62107 - protein, 9 aa, Homo Sapiens
EPRPPHGEL

SEQ ID NO: 62108 - protein, 9 aa, Homo Sapiens
EPRYPPHSL

SEQ ID NO: 62109 - protein, 9 aa, Homo Sapiens
FPAAPAPKM

SEQ ID NO: 62110 - protein, 9 aa, Homo Sapiens
FPAAPIPTL

SEQ ID NO: 62111 - protein, 9 aa, Homo Sapiens
FPAEDWAGL

SEQ ID NO: 62112 - protein, 9 aa, Homo Sapiens
FPAPILRAV

SEQ ID NO: 62113 - protein, 9 aa, Homo Sapiens
FPELPKSAL

SEQ ID NO: 62114 - protein, 9 aa, Homo Sapiens
FPESERPEM

SEQ ID NO: 62115 - protein, 9 aa, Homo Sapiens
FPHEPWLRL

SEQ ID NO: 62116 - protein, 9 aa, Homo Sapiens
FPHLPGKTF

SEQ ID NO: 62117 - protein, 9 aa, Homo Sapiens
FPHMPCAYL

SEQ ID NO: 62118 - protein, 9 aa, Homo Sapiens
FPHVQTDVL

SEQ ID NO: 62119 - protein, 9 aa, Homo Sapiens
FPIHVQTSL

SEQ ID NO: 62120 - protein, 9 aa, Homo Sapiens
FPKGFSVEL

SEQ ID NO: 62121 - protein, 9 aa, Homo Sapiens
FPKIPPHSL

SEQ ID NO: 62122 - protein, 9 aa, Homo Sapiens
FPMEIRQYL

SEQ ID NO: 62123 - protein, 9 aa, Homo Sapiens
FPMELRQFL

SEQ ID NO: 62124 - protein, 9 aa, Homo Sapiens
FPMSPVTSV

SEQ ID NO: 62125 - protein, 9 aa, Homo Sapiens
FPNIPGKSL

SEQ ID NO: 62126 - protein, 9 aa, Homo Sapiens
FPNKPPLTF

SEQ ID NO: 62127 - protein, 9 aa, Homo Sapiens
FPNKQGYVL

SEQ ID NO: 62128 - protein, 9 aa, Homo Sapiens
FPQVGRTAL

SEQ ID NO: 62129 - protein, 9 aa, Homo Sapiens
FPRDKLAEL

SEQ ID NO: 62130 - protein, 9 aa, Homo Sapiens
FPREPRPKL

SEQ ID NO: 62131 - protein, 9 aa, Homo Sapiens
FPRLPPASV

SEQ ID NO: 62132 - protein, 9 aa, Homo Sapiens
FPRPVTVEP

SEQ ID NO: 62133 - protein, 9 aa, Homo Sapiens
FPVLPGSHL

SEQ ID NO: 62134 - protein, 9 aa, Homo Sapiens
GAFLRHAAL

SEQ ID NO: 62135 - protein, 9 aa, Homo Sapiens
GAMAVRRVL

SEQ ID NO: 62136 - protein, 9 aa, Homo Sapiens
GARPPRLPL

SEQ ID NO: 62137 - protein, 9 aa, Homo Sapiens
GIRPPTRTA

SEQ ID NO: 62138 - protein, 9 aa, Homo Sapiens
GPAGPGASL

SEQ ID NO: 62139 - protein, 9 aa, Homo Sapiens
GPAGPILSL

SEQ ID NO: 62140 - protein, 9 aa, Homo Sapiens
GPALGRSFL

SEQ ID NO: 62141 - protein, 9 aa, Homo Sapiens
GPALSRHLL

SEQ ID NO: 62142 - protein, 9 aa, Homo Sapiens
GPAPVGRFF

SEQ ID NO: 62143 - protein, 9 aa, Homo Sapiens
GPAYAFTAL

SEQ ID NO: 62144 - protein, 9 aa, Homo Sapiens
GPESRPTEL

SEQ ID NO: 62145 - protein, 9 aa, Homo Sapiens
GPESRTISL

SEQ ID NO: 62146 - protein, 9 aa, Homo Sapiens
GPGWRPLLL

SEQ ID NO: 62147 - protein, 9 aa, Homo Sapiens
GPHQRHIAL

SEQ ID NO: 62148 - protein, 9 aa, Homo Sapiens
GPIYPGHGM

SEQ ID NO: 62149 - protein, 9 aa, Homo Sapiens
GPLDKWRAL

SEQ ID NO: 62150 - protein, 9 aa, Homo Sapiens
GPLFRNSQL

SEQ ID NO: 62151 - protein, 9 aa, Homo Sapiens
GPLPPHLAL

SEQ ID NO: 62152 - protein, 9 aa, Homo Sapiens
GPLYKNGSL

SEQ ID NO: 62153 - protein, 9 aa, Homo Sapiens
GPMGGGLTL

SEQ ID NO: 62154 - protein, 9 aa, Homo Sapiens
GPMNLRAAF

SEQ ID NO: 62155 - protein, 9 aa, Homo Sapiens
GPNERIGMV

SEQ ID NO: 62156 - protein, 9 aa, Homo Sapiens
GPNVTKITL

SEQ ID NO: 62157 - protein, 9 aa, Homo Sapiens
GPREAFRQL

SEQ ID NO: 62158 - protein, 9 aa, Homo Sapiens
GPREALSRL

SEQ ID NO: 62159 - protein, 9 aa, Homo Sapiens
GPRLPWTRL

SEQ ID NO: 62160 - protein, 9 aa, Homo Sapiens
GPRPGAERL

SEQ ID NO: 62161 - protein, 9 aa, Homo Sapiens
GPRSSLRVL

SEQ ID NO: 62162 - protein, 9 aa, Homo Sapiens
GPRSWIQKV

SEQ ID NO: 62163 - protein, 9 aa, Homo Sapiens
GPSAPFSTL

SEQ ID NO: 62164 - protein, 9 aa, Homo Sapiens
GPSLAAPAL

SEQ ID NO: 62165 - protein, 9 aa, Homo Sapiens
GPSPNPLIL

SEQ ID NO: 62166 - protein, 9 aa, Homo Sapiens
GPSSPGLTL

SEQ ID NO: 62167 - protein, 9 aa, Homo Sapiens
GPSSPWTQL

SEQ ID NO: 62168 - protein, 9 aa, Homo Sapiens
GPTEGRPQL

SEQ ID NO: 62169 - protein, 9 aa, Homo Sapiens
GPTQPPLSL

SEQ ID NO: 62170 - protein, 9 aa, Homo Sapiens
GVRPSPMQL

SEQ ID NO: 62171 - protein, 9 aa, Homo Sapiens
GVRPVSGDL

SEQ ID NO: 62172 - protein, 9 aa, Homo Sapiens
HAAAYRNAL

SEQ ID NO: 62173 - protein, 9 aa, Homo Sapiens
HPAAKMIVM

SEQ ID NO: 62174 - protein, 9 aa, Homo Sapiens
HPAGPRTVF

SEQ ID NO: 62175 - protein, 9 aa, Homo Sapiens
HPAVHAGIL

SEQ ID NO: 62176 - protein, 9 aa, Homo Sapiens
HPESERISM

SEQ ID NO: 62177 - protein, 9 aa, Homo Sapiens
HPFFKDMSL

SEQ ID NO: 62178 - protein, 9 aa, Homo Sapiens
HPGPVNSEL

SEQ ID NO: 62179 - protein, 9 aa, Homo Sapiens
HPINPRVAL

SEQ ID NO: 62180 - protein, 9 aa, Homo Sapiens
HPIYNIKSL

SEQ ID NO: 62181 - protein, 9 aa, Homo Sapiens
HPLSNPAEL

SEQ ID NO: 62182 - protein, 9 aa, Homo Sapiens
HPMAYQLQL

SEQ ID NO: 62183 - protein, 9 aa, Homo Sapiens
HPMGGLNAM

SEQ ID NO: 62184 - protein, 9 aa, Homo Sapiens
HPMNSISSL

SEQ ID NO: 62185 - protein, 9 aa, Homo Sapiens
HPNGNITEL

SEQ ID NO: 62186 - protein, 9 aa, Homo Sapiens
HPNSNLLDL

SEQ ID NO: 62187 - protein, 9 aa, Homo Sapiens
HPQPGAVEL

SEQ ID NO: 62188 - protein, 9 aa, Homo Sapiens
HPRAYFMQL

SEQ ID NO: 62189 - protein, 9 aa, Homo Sapiens
HPRDFFSRL

SEQ ID NO: 62190 - protein, 9 aa, Homo Sapiens
HPRDPNLLL

SEQ ID NO: 62191 - protein, 9 aa, Homo Sapiens
HPREPALGP

SEQ ID NO: 62192 - protein, 9 aa, Homo Sapiens
HPRIITEGF

SEQ ID NO: 62193 - protein, 9 aa, Homo Sapiens
HPRLVVIVL

SEQ ID NO: 62194 - protein, 9 aa, Homo Sapiens
HPRSPTPTL

SEQ ID NO: 62195 - protein, 9 aa, Homo Sapiens
HPRVGDLIL

SEQ ID NO: 62196 - protein, 9 aa, Homo Sapiens
HPRYFGPNL

SEQ ID NO: 62197 - protein, 9 aa, Homo Sapiens
HPSLPASSL

SEQ ID NO: 62198 - protein, 9 aa, Homo Sapiens
HPTDERVAL

SEQ ID NO: 62199 - protein, 9 aa, Homo Sapiens
HPTSHVSLL

SEQ ID NO: 62200 - protein, 9 aa, Homo Sapiens
IAAPTSSAL

SEQ ID NO: 62201 - protein, 9 aa, Homo Sapiens
IARLPSSTL

SEQ ID NO: 62202 - protein, 9 aa, Homo Sapiens
IINAARESL

SEQ ID NO: 62203 - protein, 9 aa, Homo Sapiens
IIREPLTEL

SEQ ID NO: 62204 - protein, 9 aa, Homo Sapiens
IPAAPVPSL

SEQ ID NO: 62205 - protein, 9 aa, Homo Sapiens
IPAASAAAM

SEQ ID NO: 62206 - protein, 9 aa, Homo Sapiens
IPADTFAAL

SEQ ID NO: 62207 - protein, 9 aa, Homo Sapiens
IPAGGVLTL

SEQ ID NO: 62208 - protein, 9 aa, Homo Sapiens
IPAKKYVKL

SEQ ID NO: 62209 - protein, 9 aa, Homo Sapiens
IPAKPPVSF

SEQ ID NO: 62210 - protein, 9 aa, Homo Sapiens
IPALGGISL

SEQ ID NO: 62211 - protein, 9 aa, Homo Sapiens
IPANPPMAF

SEQ ID NO: 62212 - protein, 9 aa, Homo Sapiens
IPANWKTEL

SEQ ID NO: 62213 - protein, 9 aa, Homo Sapiens
IPASNRLLL

SEQ ID NO: 62214 - protein, 9 aa, Homo Sapiens
IPCPTVVLL

SEQ ID NO: 62215 - protein, 9 aa, Homo Sapiens
IPDHFRPPL

SEQ ID NO: 62216 - protein, 9 aa, Homo Sapiens
IPELHRPVV

SEQ ID NO: 62217 - protein, 9 aa, Homo Sapiens
IPFAAPTAL

SEQ ID NO: 62218 - protein, 9 aa, Homo Sapiens
IPFSGALEL

SEQ ID NO: 62219 - protein, 9 aa, Homo Sapiens
IPFWRNTAV

SEQ ID NO: 62220 - protein, 9 aa, Homo Sapiens
IPGEPGFPL

SEQ ID NO: 62221 - protein, 9 aa, Homo Sapiens
IPHMDIEAL

SEQ ID NO: 62222 - protein, 9 aa, Homo Sapiens
IPIGGGTSV

SEQ ID NO: 62223 - protein, 9 aa, Homo Sapiens
IPISPSTEV

SEQ ID NO: 62224 - protein, 9 aa, Homo Sapiens
IPKNNPPTL

SEQ ID NO: 62225 - protein, 9 aa, Homo Sapiens
IPKPLNPAL

SEQ ID NO: 62226 - protein, 9 aa, Homo Sapiens
IPKSAVGEL

SEQ ID NO: 62227 - protein, 9 aa, Homo Sapiens
IPLAKRVAL

SEQ ID NO: 62228 - protein, 9 aa, Homo Sapiens
IPLKPSNEL

SEQ ID NO: 62229 - protein, 9 aa, Homo Sapiens
IPLLGKSSL

SEQ ID NO: 62230 - protein, 9 aa, Homo Sapiens
IPMNIGTGL

SEQ ID NO: 62231 - protein, 9 aa, Homo Sapiens
IPMSDPQVL

SEQ ID NO: 62232 - protein, 9 aa, Homo Sapiens
IPMTGKPSL

SEQ ID NO: 62233 - protein, 9 aa, Homo Sapiens
IPMTPTSSF

SEQ ID NO: 62234 - protein, 9 aa, Homo Sapiens
IPNEIIHAL

SEQ ID NO: 62235 - protein, 9 aa, Homo Sapiens
IPNERTMQL

SEQ ID NO: 62236 - protein, 9 aa, Homo Sapiens
IPNFPRSTV

SEQ ID NO: 62237 - protein, 9 aa, Homo Sapiens
IPNNVKTAV

SEQ ID NO: 62238 - protein, 9 aa, Homo Sapiens
IPQPPILQL

SEQ ID NO: 62239 - protein, 9 aa, Homo Sapiens
IPQPTPASL

SEQ ID NO: 62240 - protein, 9 aa, Homo Sapiens
IPRILGPGL

SEQ ID NO: 62241 - protein, 9 aa, Homo Sapiens
IPRLIVSQL

SEQ ID NO: 62242 - protein, 9 aa, Homo Sapiens
IPRYIVSQL

SEQ ID NO: 62243 - protein, 9 aa, Homo Sapiens
IPSEWHIEL

SEQ ID NO: 62244 - protein, 9 aa, Homo Sapiens
IPSSHPVSL

SEQ ID NO: 62245 - protein, 9 aa, Homo Sapiens
IPTGEGPPL

SEQ ID NO: 62246 - protein, 9 aa, Homo Sapiens
IPYEGFASL

SEQ ID NO: 62247 - protein, 9 aa, Homo Sapiens
IPYGERITL

SEQ ID NO: 62248 - protein, 9 aa, Homo Sapiens
IPYPRPIHL

SEQ ID NO: 62249 - protein, 9 aa, Homo Sapiens
ITAPPGTAA

SEQ ID NO: 62250 - protein, 9 aa, Homo Sapiens
ITAPPSRVL

SEQ ID NO: 62251 - protein, 9 aa, Homo Sapiens
IVAQSGPAL

SEQ ID NO: 62252 - protein, 9 aa, Homo Sapiens
KAASVRPVL

SEQ ID NO: 62253 - protein, 9 aa, Homo Sapiens
KINKKRIAL

SEQ ID NO: 62254 - protein, 9 aa, Homo Sapiens
KIRDVTKCL

SEQ ID NO: 62255 - protein, 9 aa, Homo Sapiens
KLAPPSSTL

SEQ ID NO: 62256 - protein, 9 aa, Homo Sapiens
KPANVFITA

SEQ ID NO: 62257 - protein, 9 aa, Homo Sapiens
KPASFMTSI

SEQ ID NO: 62258 - protein, 9 aa, Homo Sapiens
KPASVFVQL

SEQ ID NO: 62259 - protein, 9 aa, Homo Sapiens
KPFAEVRIL

SEQ ID NO: 62260 - protein, 9 aa, Homo Sapiens
KPGKFVTTL

SEQ ID NO: 62261 - protein, 9 aa, Homo Sapiens
KPHVNVGTI

SEQ ID NO: 62262 - protein, 9 aa, Homo Sapiens
KPIEQLLGF

SEQ ID NO: 62263 - protein, 9 aa, Homo Sapiens
KPIFSLNTV

SEQ ID NO: 62264 - protein, 9 aa, Homo Sapiens
KPINFSVIL

SEQ ID NO: 62265 - protein, 9 aa, Homo Sapiens
KPKAPPPSL

SEQ ID NO: 62266 - protein, 9 aa, Homo Sapiens
KPKFILSVL

SEQ ID NO: 62267 - protein, 9 aa, Homo Sapiens
KPKIQHVGL

SEQ ID NO: 62268 - protein, 9 aa, Homo Sapiens
KPKMNYEKL

SEQ ID NO: 62269 - protein, 9 aa, Homo Sapiens
KPLDNASKL

SEQ ID NO: 62270 - protein, 9 aa, Homo Sapiens
KPLEKPLKL

SEQ ID NO: 62271 - protein, 9 aa, Homo Sapiens
KPMEGWIAV

SEQ ID NO: 62272 - protein, 9 aa, Homo Sapiens
KPMEKLLGL

SEQ ID NO: 62273 - protein, 9 aa, Homo Sapiens
KPMKSVLVV

SEQ ID NO: 62274 - protein, 9 aa, Homo Sapiens
KPMTLKLIM

SEQ ID NO: 62275 - protein, 9 aa, Homo Sapiens
KPPSPGTVL

SEQ ID NO: 62276 - protein, 9 aa, Homo Sapiens
KPRPIIPML

SEQ ID NO: 62277 - protein, 9 aa, Homo Sapiens
KPRPPLHLL

SEQ ID NO: 62278 - protein, 9 aa, Homo Sapiens
KPRSPPRAL

SEQ ID NO: 62279 - protein, 9 aa, Homo Sapiens
KPSGVSAAL

SEQ ID NO: 62280 - protein, 9 aa, Homo Sapiens
KPSKWWTCF

SEQ ID NO: 62281 - protein, 9 aa, Homo Sapiens
KPSLPFTSL

SEQ ID NO: 62282 - protein, 9 aa, Homo Sapiens
KPSPKTIAF

SEQ ID NO: 62283 - protein, 9 aa, Homo Sapiens
KPSSTTPRL

SEQ ID NO: 62284 - protein, 9 aa, Homo Sapiens
KPSSWLRTL

SEQ ID NO: 62285 - protein, 9 aa, Homo Sapiens
KPTDKLRAL

SEQ ID NO: 62286 - protein, 9 aa, Homo Sapiens
KPTHVVVTL

SEQ ID NO: 62287 - protein, 9 aa, Homo Sapiens
KPTKSITCL

SEQ ID NO: 62288 - protein, 9 aa, Homo Sapiens
KPTRKFAYL

SEQ ID NO: 62289 - protein, 9 aa, Homo Sapiens
KPVAPSNVL

SEQ ID NO: 62290 - protein, 9 aa, Homo Sapiens
KPVIPAAAL

SEQ ID NO: 62291 - protein, 9 aa, Homo Sapiens
KPVSLGQAL

SEQ ID NO: 62292 - protein, 9 aa, Homo Sapiens
KPVYPGQTL

SEQ ID NO: 62293 - protein, 9 aa, Homo Sapiens
KPWEKSPIL

SEQ ID NO: 62294 - protein, 9 aa, Homo Sapiens
KPYLPSRAL

SEQ ID NO: 62295 - protein, 9 aa, Homo Sapiens
KPYSGGLCL

SEQ ID NO: 62296 - protein, 9 aa, Homo Sapiens
KVRAVFDNL

SEQ ID NO: 62297 - protein, 9 aa, Homo Sapiens
KVRDPRPWL

SEQ ID NO: 62298 - protein, 9 aa, Homo Sapiens
KVREEFKEL

SEQ ID NO: 62299 - protein, 9 aa, Homo Sapiens
LDPVLQNPL

SEQ ID NO: 62300 - protein, 9 aa, Homo Sapiens
LIRPVSASF

SEQ ID NO: 62301 - protein, 9 aa, Homo Sapiens
LPAAPASSL

SEQ ID NO: 62302 - protein, 9 aa, Homo Sapiens
LPAAPGKGL

SEQ ID NO: 62303 - protein, 9 aa, Homo Sapiens
LPAEGVKEL

SEQ ID NO: 62304 - protein, 9 aa, Homo Sapiens
LPAGAALCL

SEQ ID NO: 62305 - protein, 9 aa, Homo Sapiens
LPALPLAEL

SEQ ID NO: 62306 - protein, 9 aa, Homo Sapiens
LPALPTQAL

SEQ ID NO: 62307 - protein, 9 aa, Homo Sapiens
LPAPKWTEL

SEQ ID NO: 62308 - protein, 9 aa, Homo Sapiens
LPAPPHIDV

SEQ ID NO: 62309 - protein, 9 aa, Homo Sapiens
LPAPPTQNM

SEQ ID NO: 62310 - protein, 9 aa, Homo Sapiens
LPAPSWNVL

SEQ ID NO: 62311 - protein, 9 aa, Homo Sapiens
LPAQPASTF

SEQ ID NO: 62312 - protein, 9 aa, Homo Sapiens
LPAQSAATL

SEQ ID NO: 62313 - protein, 9 aa, Homo Sapiens
LPARFFSCM

SEQ ID NO: 62314 - protein, 9 aa, Homo Sapiens
LPARFYQAL

SEQ ID NO: 62315 - protein, 9 aa, Homo Sapiens
LPASGQIAL

SEQ ID NO: 62316 - protein, 9 aa, Homo Sapiens
LPASPAHQL

SEQ ID NO: 62317 - protein, 9 aa, Homo Sapiens
LPASVHPQL

SEQ ID NO: 62318 - protein, 9 aa, Homo Sapiens
LPATATMSL

SEQ ID NO: 62319 - protein, 9 aa, Homo Sapiens
LPAWPHRGL

SEQ ID NO: 62320 - protein, 9 aa, Homo Sapiens
LPCGASVIL

SEQ ID NO: 62321 - protein, 9 aa, Homo Sapiens
LPCPGKATL

SEQ ID NO: 62322 - protein, 9 aa, Homo Sapiens
LPDERTISL

SEQ ID NO: 62323 - protein, 9 aa, Homo Sapiens
LPDFERESL

SEQ ID NO: 62324 - protein, 9 aa, Homo Sapiens
LPEAKKPRL

SEQ ID NO: 62325 - protein, 9 aa, Homo Sapiens
LPEKNRQML

SEQ ID NO: 62326 - protein, 9 aa, Homo Sapiens
LPFKYPAVL

SEQ ID NO: 62327 - protein, 9 aa, Homo Sapiens
LPFLRITSL

SEQ ID NO: 62328 - protein, 9 aa, Homo Sapiens
LPGGPTLTF

SEQ ID NO: 62329 - protein, 9 aa, Homo Sapiens
LPGPTGSVV

SEQ ID NO: 62330 - protein, 9 aa, Homo Sapiens
LPGPVTLVM

SEQ ID NO: 62331 - protein, 9 aa, Homo Sapiens
LPGSGKSTL

SEQ ID NO: 62332 - protein, 9 aa, Homo Sapiens
LPHAPGVQM

SEQ ID NO: 62333 - protein, 9 aa, Homo Sapiens
LPHLPSLEI

SEQ ID NO: 62334 - protein, 9 aa, Homo Sapiens
LPHSATVTL

SEQ ID NO: 62335 - protein, 9 aa, Homo Sapiens
LPHVPLGVI

SEQ ID NO: 62336 - protein, 9 aa, Homo Sapiens
LPIAASSSL

SEQ ID NO: 62337 - protein, 9 aa, Homo Sapiens
LPKPPFGML

SEQ ID NO: 62338 - protein, 9 aa, Homo Sapiens
LPKQPPLAL

SEQ ID NO: 62339 - protein, 9 aa, Homo Sapiens
LPKQPPLML

SEQ ID NO: 62340 - protein, 9 aa, Homo Sapiens
LPKVQSIQL

SEQ ID NO: 62341 - protein, 9 aa, Homo Sapiens
LPLAHVLEL

SEQ ID NO: 62342 - protein, 9 aa, Homo Sapiens
LPNDVISSL

SEQ ID NO: 62343 - protein, 9 aa, Homo Sapiens
LPNVPSIAL

SEQ ID NO: 62344 - protein, 9 aa, Homo Sapiens
LPPPPPHAL

SEQ ID NO: 62345 - protein, 9 aa, Homo Sapiens
LPQANRDTL

SEQ ID NO: 62346 - protein, 9 aa, Homo Sapiens
LPQGIVREL

SEQ ID NO: 62347 - protein, 9 aa, Homo Sapiens
LPQKAGGFL

SEQ ID NO: 62348 - protein, 9 aa, Homo Sapiens
LPQKPHLKL

SEQ ID NO: 62349 - protein, 9 aa, Homo Sapiens
LPQLTGPVL

SEQ ID NO: 62350 - protein, 9 aa, Homo Sapiens
LPQPVPLSV

SEQ ID NO: 62351 - protein, 9 aa, Homo Sapiens
LPRELSKQV

SEQ ID NO: 62352 - protein, 9 aa, Homo Sapiens
LPRPPPPEM

SEQ ID NO: 62353 - protein, 9 aa, Homo Sapiens
LPRPVPLVA

SEQ ID NO: 62354 - protein, 9 aa, Homo Sapiens
LPRPVPQNL

SEQ ID NO: 62355 - protein, 9 aa, Homo Sapiens
LPRQPPMSL

SEQ ID NO: 62356 - protein, 9 aa, Homo Sapiens
LPRREGYEF

SEQ ID NO: 62357 - protein, 9 aa, Homo Sapiens
LPSAPGVVL

SEQ ID NO: 62358 - protein, 9 aa, Homo Sapiens
LPSEHQTIL

SEQ ID NO: 62359 - protein, 9 aa, Homo Sapiens
LPSGAILSL

SEQ ID NO: 62360 - protein, 9 aa, Homo Sapiens
LPSGFRKFL

SEQ ID NO: 62361 - protein, 9 aa, Homo Sapiens
LPSKPSSTL

SEQ ID NO: 62362 - protein, 9 aa, Homo Sapiens
LPSKPYSTL

SEQ ID NO: 62363 - protein, 9 aa, Homo Sapiens
LPSLPTAEL

SEQ ID NO: 62364 - protein, 9 aa, Homo Sapiens
LPSMPEPAL

SEQ ID NO: 62365 - protein, 9 aa, Homo Sapiens
LPSPEGLSL

SEQ ID NO: 62366 - protein, 9 aa, Homo Sapiens
LPSPFLRAL

SEQ ID NO: 62367 - protein, 9 aa, Homo Sapiens
LPSPPAVAV

SEQ ID NO: 62368 - protein, 9 aa, Homo Sapiens
LPSQKTASL

SEQ ID NO: 62369 - protein, 9 aa, Homo Sapiens
LPSQVSRVV

SEQ ID NO: 62370 - protein, 9 aa, Homo Sapiens
LPSRKLVAL

SEQ ID NO: 62371 - protein, 9 aa, Homo Sapiens
LPSSPPDAL

SEQ ID NO: 62372 - protein, 9 aa, Homo Sapiens
LPSSVISAI

SEQ ID NO: 62373 - protein, 9 aa, Homo Sapiens
LPSTPGLGM

SEQ ID NO: 62374 - protein, 9 aa, Homo Sapiens
LPSTVKQAV

SEQ ID NO: 62375 - protein, 9 aa, Homo Sapiens
LPSVPSTHL

SEQ ID NO: 62376 - protein, 9 aa, Homo Sapiens
LPSWGRAEL

SEQ ID NO: 62377 - protein, 9 aa, Homo Sapiens
LPTSPGPAL

SEQ ID NO: 62378 - protein, 9 aa, Homo Sapiens
LPTWRPTSM

SEQ ID NO: 62379 - protein, 9 aa, Homo Sapiens
LPVASSSTL

SEQ ID NO: 62380 - protein, 9 aa, Homo Sapiens
LPVGTGTSL

SEQ ID NO: 62381 - protein, 9 aa, Homo Sapiens
LPWASTHSL

SEQ ID NO: 62382 - protein, 9 aa, Homo Sapiens
LPWPARPAL

SEQ ID NO: 62383 - protein, 9 aa, Homo Sapiens
LPYAGDVSM

SEQ ID NO: 62384 - protein, 9 aa, Homo Sapiens
LPYSIRVLL

SEQ ID NO: 62385 - protein, 9 aa, Homo Sapiens
LPYSVGRVL

SEQ ID NO: 62386 - protein, 9 aa, Homo Sapiens
LTRPGSSSL

SEQ ID NO: 62387 - protein, 9 aa, Homo Sapiens
LVMAPRTVL

SEQ ID NO: 62388 - protein, 9 aa, Homo Sapiens
LVRDVVSSL

SEQ ID NO: 62389 - protein, 9 aa, Homo Sapiens
LVRPVFGEL

SEQ ID NO: 62390 - protein, 9 aa, Homo Sapiens
MIRAAPPPL

SEQ ID NO: 62391 - protein, 9 aa, Homo Sapiens
MPAFLRSAL

SEQ ID NO: 62392 - protein, 9 aa, Homo Sapiens
MPAITGTGL

SEQ ID NO: 62393 - protein, 9 aa, Homo Sapiens
MPALRSINL

SEQ ID NO: 62394 - protein, 9 aa, Homo Sapiens
MPANSGLAL

SEQ ID NO: 62395 - protein, 9 aa, Homo Sapiens
MPARWLTHL

SEQ ID NO: 62396 - protein, 9 aa, Homo Sapiens
MPHVPITTL

SEQ ID NO: 62397 - protein, 9 aa, Homo Sapiens
MPKFSVSGL

SEQ ID NO: 62398 - protein, 9 aa, Homo Sapiens
MPKKNRIAI

SEQ ID NO: 62399 - protein, 9 aa, Homo Sapiens
MPKMDQDSL

SEQ ID NO: 62400 - protein, 9 aa, Homo Sapiens
MPLAEAGAL

SEQ ID NO: 62401 - protein, 9 aa, Homo Sapiens
MPLPGTKAL

SEQ ID NO: 62402 - protein, 9 aa, Homo Sapiens
MPQDLRSPA

SEQ ID NO: 62403 - protein, 9 aa, Homo Sapiens
MPRGVVVTL

SEQ ID NO: 62404 - protein, 9 aa, Homo Sapiens
MPSPVSPKL

SEQ ID NO: 62405 - protein, 9 aa, Homo Sapiens
MPSQFRDIL

SEQ ID NO: 62406 - protein, 9 aa, Homo Sapiens
MPSSAVRVL

SEQ ID NO: 62407 - protein, 9 aa, Homo Sapiens
MPTIPALAL

SEQ ID NO: 62408 - protein, 9 aa, Homo Sapiens
MPTMRLLSF

SEQ ID NO: 62409 - protein, 9 aa, Homo Sapiens
MVRRFLVTL

SEQ ID NO: 62410 - protein, 9 aa, Homo Sapiens
NAAERRGPL

SEQ ID NO: 62411 - protein, 9 aa, Homo Sapiens
NIRNIGKTL

SEQ ID NO: 62412 - protein, 9 aa, Homo Sapiens
NPAAAAAAV

SEQ ID NO: 62413 - protein, 9 aa, Homo Sapiens
NPAENFRVL

SEQ ID NO: 62414 - protein, 9 aa, Homo Sapiens
NPAPPIDAV

SEQ ID NO: 62415 - protein, 9 aa, Homo Sapiens
NPASKVIAL

SEQ ID NO: 62416 - protein, 9 aa, Homo Sapiens
NPASPPLSL

SEQ ID NO: 62417 - protein, 9 aa, Homo Sapiens
NPDIMRQTL

SEQ ID NO: 62418 - protein, 9 aa, Homo Sapiens
NPEKRYNVL

SEQ ID NO: 62419 - protein, 9 aa, Homo Sapiens
NPEVRRAVL

SEQ ID NO: 62420 - protein, 9 aa, Homo Sapiens
NPHEPWNRL

SEQ ID NO: 62421 - protein, 9 aa, Homo Sapiens
NPISTVTEL

SEQ ID NO: 62422 - protein, 9 aa, Homo Sapiens
NPKNPGLWL

SEQ ID NO: 62423 - protein, 9 aa, Homo Sapiens
NPMVTGTSV

SEQ ID NO: 62424 - protein, 9 aa, Homo Sapiens
NPMVVANAV

SEQ ID NO: 62425 - protein, 9 aa, Homo Sapiens
NPNHRTPTL

SEQ ID NO: 62426 - protein, 9 aa, Homo Sapiens
NPNLRKNVL

SEQ ID NO: 62427 - protein, 9 aa, Homo Sapiens
NPNMRLSQL

SEQ ID NO: 62428 - protein, 9 aa, Homo Sapiens
NPQERTLTL

SEQ ID NO: 62429 - protein, 9 aa, Homo Sapiens
NPRDLFGSL

SEQ ID NO: 62430 - protein, 9 aa, Homo Sapiens
NPRIPYTEL

SEQ ID NO: 62431 - protein, 9 aa, Homo Sapiens
NPRKYLRSV

SEQ ID NO: 62432 - protein, 9 aa, Homo Sapiens
NPRPTAQDL

SEQ ID NO: 62433 - protein, 9 aa, Homo Sapiens
NPRSVTLLI

SEQ ID NO: 62434 - protein, 9 aa, Homo Sapiens
NPTQVGTAL

SEQ ID NO: 62435 - protein, 9 aa, Homo Sapiens
NVRIATTAL

SEQ ID NO: 62436 - protein, 9 aa, Homo Sapiens
NVRPPNTAL

SEQ ID NO: 62437 - protein, 9 aa, Homo Sapiens
NVRPVPLEL

SEQ ID NO: 62438 - protein, 9 aa, Homo Sapiens
PAYHSSLMD

SEQ ID NO: 62439 - protein, 9 aa, Homo Sapiens
PPEYHRKAV

SEQ ID NO: 62440 - protein, 9 aa, Homo Sapiens
PSIVHRKCF

SEQ ID NO: 62441 - protein, 9 aa, Homo Sapiens
PSRTLFPSL

SEQ ID NO: 62442 - protein, 9 aa, Homo Sapiens
PSSAPAVST

SEQ ID NO: 62443 - protein, 9 aa, Homo Sapiens
QAAAVRHVL

SEQ ID NO: 62444 - protein, 9 aa, Homo Sapiens
QPAEMAAEL

SEQ ID NO: 62445 - protein, 9 aa, Homo Sapiens
QPAQAPGTL

SEQ ID NO: 62446 - protein, 9 aa, Homo Sapiens
QPASFAVSL

SEQ ID NO: 62447 - protein, 9 aa, Homo Sapiens
QPATPGLGM

SEQ ID NO: 62448 - protein, 9 aa, Homo Sapiens
QPESIRSDL

SEQ ID NO: 62449 - protein, 9 aa, Homo Sapiens
QPEWLRAEV

SEQ ID NO: 62450 - protein, 9 aa, Homo Sapiens
QPFGGGSHM

SEQ ID NO: 62451 - protein, 9 aa, Homo Sapiens
QPHLSRQDL

SEQ ID NO: 62452 - protein, 9 aa, Homo Sapiens
QPITPGPSI

SEQ ID NO: 62453 - protein, 9 aa, Homo Sapiens
QPLARPNTL

SEQ ID NO: 62454 - protein, 9 aa, Homo Sapiens
QPNMRLRQL

SEQ ID NO: 62455 - protein, 9 aa, Homo Sapiens
QPNPLPLRL

SEQ ID NO: 62456 - protein, 9 aa, Homo Sapiens
QPPSIRNGL

SEQ ID NO: 62457 - protein, 9 aa, Homo Sapiens
QPQFQRQGL

SEQ ID NO: 62458 - protein, 9 aa, Homo Sapiens
QPQHAFNAL

SEQ ID NO: 62459 - protein, 9 aa, Homo Sapiens
QPQNGRMLV

SEQ ID NO: 62460 - protein, 9 aa, Homo Sapiens
QPSEVLRTV

SEQ ID NO: 62461 - protein, 9 aa, Homo Sapiens
QPSFPTPQL

SEQ ID NO: 62462 - protein, 9 aa, Homo Sapiens
QPTCPGAQL

SEQ ID NO: 62463 - protein, 9 aa, Homo Sapiens
QTAPLRAEL

SEQ ID NO: 62464 - protein, 9 aa, Homo Sapiens
QVQGPRPVL

SEQ ID NO: 62465 - protein, 9 aa, Homo Sapiens
RAAPHRISL

SEQ ID NO: 62466 - protein, 9 aa, Homo Sapiens
RIRAPIMRM

SEQ ID NO: 62467 - protein, 9 aa, Homo Sapiens
RIVPRFSEL

SEQ ID NO: 62468 - protein, 9 aa, Homo Sapiens
RLQAQRNEL

SEQ ID NO: 62469 - protein, 9 aa, Homo Sapiens
RLREVSEKL

SEQ ID NO: 62470 - protein, 9 aa, Homo Sapiens
RPAAIPIEI

SEQ ID NO: 62471 - protein, 9 aa, Homo Sapiens
RPAANFDAI

SEQ ID NO: 62472 - protein, 9 aa, Homo Sapiens
RPAANPIQF

SEQ ID NO: 62473 - protein, 9 aa, Homo Sapiens
RPADYLFML

SEQ ID NO: 62474 - protein, 9 aa, Homo Sapiens
RPAERLDYL

SEQ ID NO: 62475 - protein, 9 aa, Homo Sapiens
RPAFFAERL

SEQ ID NO: 62476 - protein, 9 aa, Homo Sapiens
RPAFFSPSL

SEQ ID NO: 62477 - protein, 9 aa, Homo Sapiens
RPAFPVKKL

SEQ ID NO: 62478 - protein, 9 aa, Homo Sapiens
RPAGLQGAL

SEQ ID NO: 62479 - protein, 9 aa, Homo Sapiens
RPALFANLF

SEQ ID NO: 62480 - protein, 9 aa, Homo Sapiens
RPALPVSYL

SEQ ID NO: 62481 - protein, 9 aa, Homo Sapiens
RPAPARPTM

SEQ ID NO: 62482 - protein, 9 aa, Homo Sapiens
RPAPLSAEL

SEQ ID NO: 62483 - protein, 9 aa, Homo Sapiens
RPAPPPEAL

SEQ ID NO: 62484 - protein, 9 aa, Homo Sapiens
RPAQKHWVL

SEQ ID NO: 62485 - protein, 9 aa, Homo Sapiens
RPAQLHIGF

SEQ ID NO: 62486 - protein, 9 aa, Homo Sapiens
RPARDMWVM

SEQ ID NO: 62487 - protein, 9 aa, Homo Sapiens
RPAVERLEL

SEQ ID NO: 62488 - protein, 9 aa, Homo Sapiens
RPCDISRQL

SEQ ID NO: 62489 - protein, 9 aa, Homo Sapiens
RPDITHQSL

SEQ ID NO: 62490 - protein, 9 aa, Homo Sapiens
RPDLRMAAI

SEQ ID NO: 62491 - protein, 9 aa, Homo Sapiens
RPDSPAHVL

SEQ ID NO: 62492 - protein, 9 aa, Homo Sapiens
RPEDRILVL

SEQ ID NO: 62493 - protein, 9 aa, Homo Sapiens
RPEEGRPVV

SEQ ID NO: 62494 - protein, 9 aa, Homo Sapiens
RPENRSFYL

SEQ ID NO: 62495 - protein, 9 aa, Homo Sapiens
RPENYREAL

SEQ ID NO: 62496 - protein, 9 aa, Homo Sapiens
RPERVKPFM

SEQ ID NO: 62497 - protein, 9 aa, Homo Sapiens
RPFEDQTSL

SEQ ID NO: 62498 - protein, 9 aa, Homo Sapiens
RPFERTITM

SEQ ID NO: 62499 - protein, 9 aa, Homo Sapiens
RPFHGISTV

SEQ ID NO: 62500 - protein, 9 aa, Homo Sapiens
RPFHGWTSL

SEQ ID NO: 62501 - protein, 9 aa, Homo Sapiens
RPFLSRESL

SEQ ID NO: 62502 - protein, 9 aa, Homo Sapiens
RPFPKLRIL

SEQ ID NO: 62503 - protein, 9 aa, Homo Sapiens
RPFPVPSSL

SEQ ID NO: 62504 - protein, 9 aa, Homo Sapiens
RPGHKPSIL

SEQ ID NO: 62505 - protein, 9 aa, Homo Sapiens
RPGNIYSTL

SEQ ID NO: 62506 - protein, 9 aa, Homo Sapiens
RPGYCYTAL

SEQ ID NO: 62507 - protein, 9 aa, Homo Sapiens
RPHAFQVIL

SEQ ID NO: 62508 - protein, 9 aa, Homo Sapiens
RPHHKILDM

SEQ ID NO: 62509 - protein, 9 aa, Homo Sapiens
RPHKPGLYL

SEQ ID NO: 62510 - protein, 9 aa, Homo Sapiens
RPHSSLREL

SEQ ID NO: 62511 - protein, 9 aa, Homo Sapiens
RPHTVLTVI

SEQ ID NO: 62512 - protein, 9 aa, Homo Sapiens
RPHYSLRTL

SEQ ID NO: 62513 - protein, 9 aa, Homo Sapiens
RPILIIVTL

SEQ ID NO: 62514 - protein, 9 aa, Homo Sapiens
RPIMFRGEV

SEQ ID NO: 62515 - protein, 9 aa, Homo Sapiens
RPINALDEL

SEQ ID NO: 62516 - protein, 9 aa, Homo Sapiens
RPIPQWIRM

SEQ ID NO: 62517 - protein, 9 aa, Homo Sapiens
RPIQPIAGL

SEQ ID NO: 62518 - protein, 9 aa, Homo Sapiens
RPIRQILYL

SEQ ID NO: 62519 - protein, 9 aa, Homo Sapiens
RPIWQLSHF

SEQ ID NO: 62520 - protein, 9 aa, Homo Sapiens
RPKALTQVL

SEQ ID NO: 62521 - protein, 9 aa, Homo Sapiens
RPKLIGEEL

SEQ ID NO: 62522 - protein, 9 aa, Homo Sapiens
RPKLNRENF

SEQ ID NO: 62523 - protein, 9 aa, Homo Sapiens
RPKNLMQTL

SEQ ID NO: 62524 - protein, 9 aa, Homo Sapiens
RPKPIITSV

SEQ ID NO: 62525 - protein, 9 aa, Homo Sapiens
RPKTFGMDM

SEQ ID NO: 62526 - protein, 9 aa, Homo Sapiens
RPKTGVRGL

SEQ ID NO: 62527 - protein, 9 aa, Homo Sapiens
RPKYPGIKF

SEQ ID NO: 62528 - protein, 9 aa, Homo Sapiens
RPKYQFLSL

SEQ ID NO: 62529 - protein, 9 aa, Homo Sapiens
RPLLKAITA

SEQ ID NO: 62530 - protein, 9 aa, Homo Sapiens
RPLSKTVRF

SEQ ID NO: 62531 - protein, 9 aa, Homo Sapiens
RPLYKNIVL

SEQ ID NO: 62532 - protein, 9 aa, Homo Sapiens
RPMGAGEAL

SEQ ID NO: 62533 - protein, 9 aa, Homo Sapiens
RPMNENVQM

SEQ ID NO: 62534 - protein, 9 aa, Homo Sapiens
RPNDSRMLV

SEQ ID NO: 62535 - protein, 9 aa, Homo Sapiens
RPNGVITGL

SEQ ID NO: 62536 - protein, 9 aa, Homo Sapiens
RPNNAYTAM

SEQ ID NO: 62537 - protein, 9 aa, Homo Sapiens
RPNPGFSML

SEQ ID NO: 62538 - protein, 9 aa, Homo Sapiens
RPPPIGAEV

SEQ ID NO: 62539 - protein, 9 aa, Homo Sapiens
RPPPPNSVI

SEQ ID NO: 62540 - protein, 9 aa, Homo Sapiens
RPQGGQDIL

SEQ ID NO: 62541 - protein, 9 aa, Homo Sapiens
RPQIHGYDL

SEQ ID NO: 62542 - protein, 9 aa, Homo Sapiens
RPQKPSLEF

SEQ ID NO: 62543 - protein, 9 aa, Homo Sapiens
RPQKVCSFL

SEQ ID NO: 62544 - protein, 9 aa, Homo Sapiens
RPQLKGVVL

SEQ ID NO: 62545 - protein, 9 aa, Homo Sapiens
RPQPVLPLL

SEQ ID NO: 62546 - protein, 9 aa, Homo Sapiens
RPRATVMVM

SEQ ID NO: 62547 - protein, 9 aa, Homo Sapiens
RPRDPTPSF

SEQ ID NO: 62548 - protein, 9 aa, Homo Sapiens
RPRDYTVNL

SEQ ID NO: 62549 - protein, 9 aa, Homo Sapiens
RPREAEVRF

SEQ ID NO: 62550 - protein, 9 aa, Homo Sapiens
RPRIDLIVF

SEQ ID NO: 62551 - protein, 9 aa, Homo Sapiens
RPRPGNILL

SEQ ID NO: 62552 - protein, 9 aa, Homo Sapiens
RPRPPITLL

SEQ ID NO: 62553 - protein, 9 aa, Homo Sapiens
RPSGPGPEL

SEQ ID NO: 62554 - protein, 9 aa, Homo Sapiens
RPSGPSKAL

SEQ ID NO: 62555 - protein, 9 aa, Homo Sapiens
RPSLPLPHF

SEQ ID NO: 62556 - protein, 9 aa, Homo Sapiens
RPSLRLQLL

SEQ ID NO: 62557 - protein, 9 aa, Homo Sapiens
RPSPPVQSV

SEQ ID NO: 62558 - protein, 9 aa, Homo Sapiens
RPSQFPHSL

SEQ ID NO: 62559 - protein, 9 aa, Homo Sapiens
RPSQNLLQL

SEQ ID NO: 62560 - protein, 9 aa, Homo Sapiens
RPSSHPLIF

SEQ ID NO: 62561 - protein, 9 aa, Homo Sapiens
RPSVGVQSL

SEQ ID NO: 62562 - protein, 9 aa, Homo Sapiens
RPTDKPLRL

SEQ ID NO: 62563 - protein, 9 aa, Homo Sapiens
RPTFRQMQL

SEQ ID NO: 62564 - protein, 9 aa, Homo Sapiens
RPTMAFVRL

SEQ ID NO: 62565 - protein, 9 aa, Homo Sapiens
RPVKPELAL

SEQ ID NO: 62566 - protein, 9 aa, Homo Sapiens
RPVPPPPSL

SEQ ID NO: 62567 - protein, 9 aa, Homo Sapiens
RPVTPITNF

SEQ ID NO: 62568 - protein, 9 aa, Homo Sapiens
RPWALSVTM

SEQ ID NO: 62569 - protein, 9 aa, Homo Sapiens
RPWIRELIL

SEQ ID NO: 62570 - protein, 9 aa, Homo Sapiens
RPWLRPAAL

SEQ ID NO: 62571 - protein, 9 aa, Homo Sapiens
RPWSNSRGL

SEQ ID NO: 62572 - protein, 9 aa, Homo Sapiens
RPYEKGRLI

SEQ ID NO: 62573 - protein, 9 aa, Homo Sapiens
RPYEPINSI

SEQ ID NO: 62574 - protein, 9 aa, Homo Sapiens
RPYPVMRKI

SEQ ID NO: 62575 - protein, 9 aa, Homo Sapiens
RPYSFFTKL

SEQ ID NO: 62576 - protein, 9 aa, Homo Sapiens
RPYSNVSNL

SEQ ID NO: 62577 - protein, 9 aa, Homo Sapiens
RPYSQVNVL

SEQ ID NO: 62578 - protein, 9 aa, Homo Sapiens
RTRPPSVQV

SEQ ID NO: 62579 - protein, 9 aa, Homo Sapiens
RVAEFHTEL

SEQ ID NO: 62580 - protein, 9 aa, Homo Sapiens
RVELRPTTL

SEQ ID NO: 62581 - protein, 9 aa, Homo Sapiens
RVKEIGSTM

SEQ ID NO: 62582 - protein, 9 aa, Homo Sapiens
RVMGDRSVL

SEQ ID NO: 62583 - protein, 9 aa, Homo Sapiens
RVMIIRTML

SEQ ID NO: 62584 - protein, 9 aa, Homo Sapiens
RVREITENL

SEQ ID NO: 62585 - protein, 9 aa, Homo Sapiens
RVRPLFCAL

SEQ ID NO: 62586 - protein, 9 aa, Homo Sapiens
RVSPPHLTL

SEQ ID NO: 62587 - protein, 9 aa, Homo Sapiens
SAAFPGASL

SEQ ID NO: 62588 - protein, 9 aa, Homo Sapiens
SAAMPGASL

SEQ ID NO: 62589 - protein, 9 aa, Homo Sapiens
SASPPGPTL

SEQ ID NO: 62590 - protein, 9 aa, Homo Sapiens
SINAQRNAL

SEQ ID NO: 62591 - protein, 9 aa, Homo Sapiens
SIREAGGAF

SEQ ID NO: 62592 - protein, 9 aa, Homo Sapiens
SPAAATTVL

SEQ ID NO: 62593 - protein, 9 aa, Homo Sapiens
SPADRMLTV

SEQ ID NO: 62594 - protein, 9 aa, Homo Sapiens
SPAFRILSV

SEQ ID NO: 62595 - protein, 9 aa, Homo Sapiens
SPAFSTRVL

SEQ ID NO: 62596 - protein, 9 aa, Homo Sapiens
SPAGPGLSL

SEQ ID NO: 62597 - protein, 9 aa, Homo Sapiens
SPAGPILSI

SEQ ID NO: 62598 - protein, 9 aa, Homo Sapiens
SPAGVSATL

SEQ ID NO: 62599 - protein, 9 aa, Homo Sapiens
SPAHAVDAV

SEQ ID NO: 62600 - protein, 9 aa, Homo Sapiens
SPAIQRNTF

SEQ ID NO: 62601 - protein, 9 aa, Homo Sapiens
SPAKNPSSL

SEQ ID NO: 62602 - protein, 9 aa, Homo Sapiens
SPALKTTRL

SEQ ID NO: 62603 - protein, 9 aa, Homo Sapiens
SPALPGLKL

SEQ ID NO: 62604 - protein, 9 aa, Homo Sapiens
SPALPSSGA

SEQ ID NO: 62605 - protein, 9 aa, Homo Sapiens
SPANPAHIL

SEQ ID NO: 62606 - protein, 9 aa, Homo Sapiens
SPAPSKTLM

SEQ ID NO: 62607 - protein, 9 aa, Homo Sapiens
SPAPTHNSL

SEQ ID NO: 62608 - protein, 9 aa, Homo Sapiens
SPAPTITSL

SEQ ID NO: 62609 - protein, 9 aa, Homo Sapiens
SPAQVKTSV

SEQ ID NO: 62610 - protein, 9 aa, Homo Sapiens
SPASPAPDL

SEQ ID NO: 62611 - protein, 9 aa, Homo Sapiens
SPASPKISL

SEQ ID NO: 62612 - protein, 9 aa, Homo Sapiens
SPASPLKEL

SEQ ID NO: 62613 - protein, 9 aa, Homo Sapiens
SPASRSISL

SEQ ID NO: 62614 - protein, 9 aa, Homo Sapiens
SPASTPSCL

SEQ ID NO: 62615 - protein, 9 aa, Homo Sapiens
SPATTGTFL

SEQ ID NO: 62616 - protein, 9 aa, Homo Sapiens
SPAYRDLAA

SEQ ID NO: 62617 - protein, 9 aa, Homo Sapiens
SPCFRDVQI

SEQ ID NO: 62618 - protein, 9 aa, Homo Sapiens
SPCLKVFEL

SEQ ID NO: 62619 - protein, 9 aa, Homo Sapiens
SPDAKIFCL

SEQ ID NO: 62620 - protein, 9 aa, Homo Sapiens
SPDDPAGLL

SEQ ID NO: 62621 - protein, 9 aa, Homo Sapiens
SPDDSIGCL

SEQ ID NO: 62622 - protein, 9 aa, Homo Sapiens
SPDLRLTWL

SEQ ID NO: 62623 - protein, 9 aa, Homo Sapiens
SPDLSSLSL

SEQ ID NO: 62624 - protein, 9 aa, Homo Sapiens
SPDTKKIAL

SEQ ID NO: 62625 - protein, 9 aa, Homo Sapiens
SPDTVSPSL

SEQ ID NO: 62626 - protein, 9 aa, Homo Sapiens
SPEAVGPEL

SEQ ID NO: 62627 - protein, 9 aa, Homo Sapiens
SPEPSKIML

SEQ ID NO: 62628 - protein, 9 aa, Homo Sapiens
SPEQSRNVL

SEQ ID NO: 62629 - protein, 9 aa, Homo Sapiens
SPESLRSKV

SEQ ID NO: 62630 - protein, 9 aa, Homo Sapiens
SPETRENAL

SEQ ID NO: 62631 - protein, 9 aa, Homo Sapiens
SPFARGNVF

SEQ ID NO: 62632 - protein, 9 aa, Homo Sapiens
SPFFERSGL

SEQ ID NO: 62633 - protein, 9 aa, Homo Sapiens
SPFHRNLFL

SEQ ID NO: 62634 - protein, 9 aa, Homo Sapiens
SPFLTITSM

SEQ ID NO: 62635 - protein, 9 aa, Homo Sapiens
SPFPTSTPL

SEQ ID NO: 62636 - protein, 9 aa, Homo Sapiens
SPFSFHHVL

SEQ ID NO: 62637 - protein, 9 aa, Homo Sapiens
SPFSRKLDL

SEQ ID NO: 62638 - protein, 9 aa, Homo Sapiens
SPGARLITI

SEQ ID NO: 62639 - protein, 9 aa, Homo Sapiens
SPGDFSISV

SEQ ID NO: 62640 - protein, 9 aa, Homo Sapiens
SPGGAHGML

SEQ ID NO: 62641 - protein, 9 aa, Homo Sapiens
SPGLGSTPL

SEQ ID NO: 62642 - protein, 9 aa, Homo Sapiens
SPGLRALEA

SEQ ID NO: 62643 - protein, 9 aa, Homo Sapiens
SPGLRDVAL

SEQ ID NO: 62644 - protein, 9 aa, Homo Sapiens
SPGPEKMAL

SEQ ID NO: 62645 - protein, 9 aa, Homo Sapiens
SPGPPAPHM

SEQ ID NO: 62646 - protein, 9 aa, Homo Sapiens
SPGPRPVLL

SEQ ID NO: 62647 - protein, 9 aa, Homo Sapiens
SPGQRAVLL

SEQ ID NO: 62648 - protein, 9 aa, Homo Sapiens
SPGQRSISL

SEQ ID NO: 62649 - protein, 9 aa, Homo Sapiens
SPGSPRPAL

SEQ ID NO: 62650 - protein, 9 aa, Homo Sapiens
SPGSRQIQL

SEQ ID NO: 62651 - protein, 9 aa, Homo Sapiens
SPGVGKTSL

SEQ ID NO: 62652 - protein, 9 aa, Homo Sapiens
SPGVPGSVF

SEQ ID NO: 62653 - protein, 9 aa, Homo Sapiens
SPGWVRLAL

SEQ ID NO: 62654 - protein, 9 aa, Homo Sapiens
SPGYDFSCL

SEQ ID NO: 62655 - protein, 9 aa, Homo Sapiens
SPHATAQGL

SEQ ID NO: 62656 - protein, 9 aa, Homo Sapiens
SPHDISNVL

SEQ ID NO: 62657 - protein, 9 aa, Homo Sapiens
SPHDVSSVL

SEQ ID NO: 62658 - protein, 9 aa, Homo Sapiens
SPHGGALVM

SEQ ID NO: 62659 - protein, 9 aa, Homo Sapiens
SPHGHILVL

SEQ ID NO: 62660 - protein, 9 aa, Homo Sapiens
SPHGPSAKF

SEQ ID NO: 62661 - protein, 9 aa, Homo Sapiens
SPHKDSVFL

SEQ ID NO: 62662 - protein, 9 aa, Homo Sapiens
SPHLPHNSL

SEQ ID NO: 62663 - protein, 9 aa, Homo Sapiens
SPHPAATAL

SEQ ID NO: 62664 - protein, 9 aa, Homo Sapiens
SPHRPLAGL

SEQ ID NO: 62665 - protein, 9 aa, Homo Sapiens
SPHSAAYVL

SEQ ID NO: 62666 - protein, 9 aa, Homo Sapiens
SPHSAYTTL

SEQ ID NO: 62667 - protein, 9 aa, Homo Sapiens
SPHTPNEKF

SEQ ID NO: 62668 - protein, 9 aa, Homo Sapiens
SPIEKSGVL

SEQ ID NO: 62669 - protein, 9 aa, Homo Sapiens
SPIENIQRV

SEQ ID NO: 62670 - protein, 9 aa, Homo Sapiens
SPIGRDGKL

SEQ ID NO: 62671 - protein, 9 aa, Homo Sapiens
SPIITLVAL

SEQ ID NO: 62672 - protein, 9 aa, Homo Sapiens
SPIQKPQGL

SEQ ID NO: 62673 - protein, 9 aa, Homo Sapiens
SPISHFLDL

SEQ ID NO: 62674 - protein, 9 aa, Homo Sapiens
SPISSDQSL

SEQ ID NO: 62675 - protein, 9 aa, Homo Sapiens
SPITGRSKL

SEQ ID NO: 62676 - protein, 9 aa, Homo Sapiens
SPKFSELVM

SEQ ID NO: 62677 - protein, 9 aa, Homo Sapiens
SPKKPVIVF

SEQ ID NO: 62678 - protein, 9 aa, Homo Sapiens
SPKLPVSSL

SEQ ID NO: 62679 - protein, 9 aa, Homo Sapiens
SPKPWIPVL

SEQ ID NO: 62680 - protein, 9 aa, Homo Sapiens
SPKRDLIAL

SEQ ID NO: 62681 - protein, 9 aa, Homo Sapiens
SPKSPTAAL

SEQ ID NO: 62682 - protein, 9 aa, Homo Sapiens
SPLGHRMQL

SEQ ID NO: 62683 - protein, 9 aa, Homo Sapiens
SPLIGRISF

SEQ ID NO: 62684 - protein, 9 aa, Homo Sapiens
SPLKKEQPL

SEQ ID NO: 62685 - protein, 9 aa, Homo Sapiens
SPLLSVTSF

SEQ ID NO: 62686 - protein, 9 aa, Homo Sapiens
SPLNRAGLL

SEQ ID NO: 62687 - protein, 9 aa, Homo Sapiens
SPLNSSSAL

SEQ ID NO: 62688 - protein, 9 aa, Homo Sapiens
SPLPAGNAL

SEQ ID NO: 62689 - protein, 9 aa, Homo Sapiens
SPLPSPSAM

SEQ ID NO: 62690 - protein, 9 aa, Homo Sapiens
SPLQASSAL

SEQ ID NO: 62691 - protein, 9 aa, Homo Sapiens
SPLSAAAAT

SEQ ID NO: 62692 - protein, 9 aa, Homo Sapiens
SPLSPQSSI

SEQ ID NO: 62693 - protein, 9 aa, Homo Sapiens
SPLSSHPVV

SEQ ID NO: 62694 - protein, 9 aa, Homo Sapiens
SPLTKSISL

SEQ ID NO: 62695 - protein, 9 aa, Homo Sapiens
SPLVSRLTL

SEQ ID NO: 62696 - protein, 9 aa, Homo Sapiens
SPMADRSMM

SEQ ID NO: 62697 - protein, 9 aa, Homo Sapiens
SPMAERSMM

SEQ ID NO: 62698 - protein, 9 aa, Homo Sapiens
SPMGSTEDL

SEQ ID NO: 62699 - protein, 9 aa, Homo Sapiens
SPMIPSIVV

SEQ ID NO: 62700 - protein, 9 aa, Homo Sapiens
SPMPGTLTA

SEQ ID NO: 62701 - protein, 9 aa, Homo Sapiens
SPMRDAPCL

SEQ ID NO: 62702 - protein, 9 aa, Homo Sapiens
SPMSVNAVM

SEQ ID NO: 62703 - protein, 9 aa, Homo Sapiens
SPNAEIHIL

SEQ ID NO: 62704 - protein, 9 aa, Homo Sapiens
SPNAIFKAL

SEQ ID NO: 62705 - protein, 9 aa, Homo Sapiens
SPNCKLLIV

SEQ ID NO: 62706 - protein, 9 aa, Homo Sapiens
SPNDFSVSL

SEQ ID NO: 62707 - protein, 9 aa, Homo Sapiens
SPNGHRPQL

SEQ ID NO: 62708 - protein, 9 aa, Homo Sapiens
SPNLRLLDL

SEQ ID NO: 62709 - protein, 9 aa, Homo Sapiens
SPNPEIPAL

SEQ ID NO: 62710 - protein, 9 aa, Homo Sapiens
SPNQKLLAV

SEQ ID NO: 62711 - protein, 9 aa, Homo Sapiens
SPNSKVNTL

SEQ ID NO: 62712 - protein, 9 aa, Homo Sapiens
SPNSYFMDV

SEQ ID NO: 62713 - protein, 9 aa, Homo Sapiens
SPNTDREVL

SEQ ID NO: 62714 - protein, 9 aa, Homo Sapiens
SPNVPSRCL

SEQ ID NO: 62715 - protein, 9 aa, Homo Sapiens
SPNYDHVVL

SEQ ID NO: 62716 - protein, 9 aa, Homo Sapiens
SPPDPARRE

SEQ ID NO: 62717 - protein, 9 aa, Homo Sapiens
SPQAEQPSL

SEQ ID NO: 62718 - protein, 9 aa, Homo Sapiens
SPQAPTHFL

SEQ ID NO: 62719 - protein, 9 aa, Homo Sapiens
SPQAPTLQV

SEQ ID NO: 62720 - protein, 9 aa, Homo Sapiens
SPQASIIAM

SEQ ID NO: 62721 - protein, 9 aa, Homo Sapiens
SPQDFGLVL

SEQ ID NO: 62722 - protein, 9 aa, Homo Sapiens
SPQDSRLYL

SEQ ID NO: 62723 - protein, 9 aa, Homo Sapiens
SPQEARNML

SEQ ID NO: 62724 - protein, 9 aa, Homo Sapiens
SPQEDGVEL

SEQ ID NO: 62725 - protein, 9 aa, Homo Sapiens
SPQEFIHEL

SEQ ID NO: 62726 - protein, 9 aa, Homo Sapiens
SPQGLKPVV

SEQ ID NO: 62727 - protein, 9 aa, Homo Sapiens
SPQGRVMTI

SEQ ID NO: 62728 - protein, 9 aa, Homo Sapiens
SPQKVTLYL

SEQ ID NO: 62729 - protein, 9 aa, Homo Sapiens
SPQNVPEKL

SEQ ID NO: 62730 - protein, 9 aa, Homo Sapiens
SPQPAQQKL

SEQ ID NO: 62731 - protein, 9 aa, Homo Sapiens
SPQPRLIYL

SEQ ID NO: 62732 - protein, 9 aa, Homo Sapiens
SPQQKLVCL

SEQ ID NO: 62733 - protein, 9 aa, Homo Sapiens
SPQQVSAQL

SEQ ID NO: 62734 - protein, 9 aa, Homo Sapiens
SPQSPGDAL

SEQ ID NO: 62735 - protein, 9 aa, Homo Sapiens
SPQSTVTVF

SEQ ID NO: 62736 - protein, 9 aa, Homo Sapiens
SPRAIHSWL

SEQ ID NO: 62737 - protein, 9 aa, Homo Sapiens
SPREAARVL

SEQ ID NO: 62738 - protein, 9 aa, Homo Sapiens
SPREALIRL

SEQ ID NO: 62739 - protein, 9 aa, Homo Sapiens
SPREVFFRV

SEQ ID NO: 62740 - protein, 9 aa, Homo Sapiens
SPRHSFNNL

SEQ ID NO: 62741 - protein, 9 aa, Homo Sapiens
SPRITFPSL

SEQ ID NO: 62742 - protein, 9 aa, Homo Sapiens
SPRLMSNAL

SEQ ID NO: 62743 - protein, 9 aa, Homo Sapiens
SPRLPAREL

SEQ ID NO: 62744 - protein, 9 aa, Homo Sapiens
SPRLPVGGF

SEQ ID NO: 62745 - protein, 9 aa, Homo Sapiens
SPRMPSSGF

SEQ ID NO: 62746 - protein, 9 aa, Homo Sapiens
SPRNEVEAL

SEQ ID NO: 62747 - protein, 9 aa, Homo Sapiens
SPRNLAMEA

SEQ ID NO: 62748 - protein, 9 aa, Homo Sapiens
SPRPDRALV

SEQ ID NO: 62749 - protein, 9 aa, Homo Sapiens
SPRPNHSYI

SEQ ID NO: 62750 - protein, 9 aa, Homo Sapiens
SPRPPIRQW

SEQ ID NO: 62751 - protein, 9 aa, Homo Sapiens
SPRPTGSDL

SEQ ID NO: 62752 - protein, 9 aa, Homo Sapiens
SPRPVVVET

SEQ ID NO: 62753 - protein, 9 aa, Homo Sapiens
SPRSSTVHI

SEQ ID NO: 62754 - protein, 9 aa, Homo Sapiens
SPRVPNSSV

SEQ ID NO: 62755 - protein, 9 aa, Homo Sapiens
SPRVYWLGL

SEQ ID NO: 62756 - protein, 9 aa, Homo Sapiens
SPRYIFTML

SEQ ID NO: 62757 - protein, 9 aa, Homo Sapiens
SPSALIWWL

SEQ ID NO: 62758 - protein, 9 aa, Homo Sapiens
SPSASALTL

SEQ ID NO: 62759 - protein, 9 aa, Homo Sapiens
SPSATASIL

SEQ ID NO: 62760 - protein, 9 aa, Homo Sapiens
SPSATLAAL

SEQ ID NO: 62761 - protein, 9 aa, Homo Sapiens
SPSAYVLEI

SEQ ID NO: 62762 - protein, 9 aa, Homo Sapiens
SPSDPSSSL

SEQ ID NO: 62763 - protein, 9 aa, Homo Sapiens
SPSDRPLSL

SEQ ID NO: 62764 - protein, 9 aa, Homo Sapiens
SPSDSFSVL

SEQ ID NO: 62765 - protein, 9 aa, Homo Sapiens
SPSETVSSL

SEQ ID NO: 62766 - protein, 9 aa, Homo Sapiens
SPSGAMSNL

SEQ ID NO: 62767 - protein, 9 aa, Homo Sapiens
SPSGLHSKL

SEQ ID NO: 62768 - protein, 9 aa, Homo Sapiens
SPSGRLCLL

SEQ ID NO: 62769 - protein, 9 aa, Homo Sapiens
SPSGSKMQL

SEQ ID NO: 62770 - protein, 9 aa, Homo Sapiens
SPSIKDLPA

SEQ ID NO: 62771 - protein, 9 aa, Homo Sapiens
SPSKPNPVF

SEQ ID NO: 62772 - protein, 9 aa, Homo Sapiens
SPSLNREEV

SEQ ID NO: 62773 - protein, 9 aa, Homo Sapiens
SPSLPNITL

SEQ ID NO: 62774 - protein, 9 aa, Homo Sapiens
SPSLPTASL

SEQ ID NO: 62775 - protein, 9 aa, Homo Sapiens
SPSNGVGSL

SEQ ID NO: 62776 - protein, 9 aa, Homo Sapiens
SPSPPSVAV

SEQ ID NO: 62777 - protein, 9 aa, Homo Sapiens
SPSQGSPAL

SEQ ID NO: 62778 - protein, 9 aa, Homo Sapiens
SPSSDSLLF

SEQ ID NO: 62779 - protein, 9 aa, Homo Sapiens
SPSSILSTL

SEQ ID NO: 62780 - protein, 9 aa, Homo Sapiens
SPSSKYVKL

SEQ ID NO: 62781 - protein, 9 aa, Homo Sapiens
SPSSLFSAL

SEQ ID NO: 62782 - protein, 9 aa, Homo Sapiens
SPSSSATSL

SEQ ID NO: 62783 - protein, 9 aa, Homo Sapiens
SPSVKPNEL

SEQ ID NO: 62784 - protein, 9 aa, Homo Sapiens
SPSWRLTGF

SEQ ID NO: 62785 - protein, 9 aa, Homo Sapiens
SPTATPRTL

SEQ ID NO: 62786 - protein, 9 aa, Homo Sapiens
SPTDGLSVM

SEQ ID NO: 62787 - protein, 9 aa, Homo Sapiens
SPTENSFTL

SEQ ID NO: 62788 - protein, 9 aa, Homo Sapiens
SPTHPGEGL

SEQ ID NO: 62789 - protein, 9 aa, Homo Sapiens
SPTQVVSQL

SEQ ID NO: 62790 - protein, 9 aa, Homo Sapiens
SPTTAFTVL

SEQ ID NO: 62791 - protein, 9 aa, Homo Sapiens
SPVADWSEL

SEQ ID NO: 62792 - protein, 9 aa, Homo Sapiens
SPVFRLETL

SEQ ID NO: 62793 - protein, 9 aa, Homo Sapiens
SPVLSLSSL

SEQ ID NO: 62794 - protein, 9 aa, Homo Sapiens
SPVNGKLSV

SEQ ID NO: 62795 - protein, 9 aa, Homo Sapiens
SPVPIPVSL

SEQ ID NO: 62796 - protein, 9 aa, Homo Sapiens
SPVQPSKQL

SEQ ID NO: 62797 - protein, 9 aa, Homo Sapiens
SPVSGGVNL

SEQ ID NO: 62798 - protein, 9 aa, Homo Sapiens
SPVVKGNAL

SEQ ID NO: 62799 - protein, 9 aa, Homo Sapiens
SPWADNTAL

SEQ ID NO: 62800 - protein, 9 aa, Homo Sapiens
SPWKPPTYL

SEQ ID NO: 62801 - protein, 9 aa, Homo Sapiens
SPWLAGNEL

SEQ ID NO: 62802 - protein, 9 aa, Homo Sapiens
SPWLHAPSL

SEQ ID NO: 62803 - protein, 9 aa, Homo Sapiens
SPWLLRVEL

SEQ ID NO: 62804 - protein, 9 aa, Homo Sapiens
SPWSGLMAL

SEQ ID NO: 62805 - protein, 9 aa, Homo Sapiens
SPWSISSTM

SEQ ID NO: 62806 - protein, 9 aa, Homo Sapiens
SPYLRPLTL

SEQ ID NO: 62807 - protein, 9 aa, Homo Sapiens
SPYPEAVEL

SEQ ID NO: 62808 - protein, 9 aa, Homo Sapiens
SPYPESICL

SEQ ID NO: 62809 - protein, 9 aa, Homo Sapiens
SPYPNPSFL

SEQ ID NO: 62810 - protein, 9 aa, Homo Sapiens
SPYQGGVFF

SEQ ID NO: 62811 - protein, 9 aa, Homo Sapiens
SPYQNIKIL

SEQ ID NO: 62812 - protein, 9 aa, Homo Sapiens
SRAKAVRAL

SEQ ID NO: 62813 - protein, 9 aa, Homo Sapiens
SSPRLSSSL

SEQ ID NO: 62814 - protein, 9 aa, Homo Sapiens
SVKPASSSF

SEQ ID NO: 62815 - protein, 9 aa, Homo Sapiens
SVKSPNQSL

SEQ ID NO: 62816 - protein, 9 aa, Homo Sapiens
SVQRWREAL

SEQ ID NO: 62817 - protein, 9 aa, Homo Sapiens
SVRPLVTEL

SEQ ID NO: 62818 - protein, 9 aa, Homo Sapiens
SVRQPSLHM

SEQ ID NO: 62819 - protein, 9 aa, Homo Sapiens
TAAAVGAVF

SEQ ID NO: 62820 - protein, 9 aa, Homo Sapiens
TAAPPAQPL

SEQ ID NO: 62821 - protein, 9 aa, Homo Sapiens
TAAPVPTTL

SEQ ID NO: 62822 - protein, 9 aa, Homo Sapiens
TPADGFTVL

SEQ ID NO: 62823 - protein, 9 aa, Homo Sapiens
TPAEVRQVL

SEQ ID NO: 62824 - protein, 9 aa, Homo Sapiens
TPAGDIMEL

SEQ ID NO: 62825 - protein, 9 aa, Homo Sapiens
TPAGNFVTL

SEQ ID NO: 62826 - protein, 9 aa, Homo Sapiens
TPAGVQVIL

SEQ ID NO: 62827 - protein, 9 aa, Homo Sapiens
TPAKWVTCL

SEQ ID NO: 62828 - protein, 9 aa, Homo Sapiens
TPAPGFSSM

SEQ ID NO: 62829 - protein, 9 aa, Homo Sapiens
TPAPPTHAL

SEQ ID NO: 62830 - protein, 9 aa, Homo Sapiens
TPAPTAGAL

SEQ ID NO: 62831 - protein, 9 aa, Homo Sapiens
TPAPVPTSL

SEQ ID NO: 62832 - protein, 9 aa, Homo Sapiens
TPARKEISL

SEQ ID NO: 62833 - protein, 9 aa, Homo Sapiens
TPASAGHVW

SEQ ID NO: 62834 - protein, 9 aa, Homo Sapiens
TPAVIRISV

SEQ ID NO: 62835 - protein, 9 aa, Homo Sapiens
TPAWVRQVL

SEQ ID NO: 62836 - protein, 9 aa, Homo Sapiens
TPDPSRSVF

SEQ ID NO: 62837 - protein, 9 aa, Homo Sapiens
TPETVRMVL

SEQ ID NO: 62838 - protein, 9 aa, Homo Sapiens
TPFPFRTGL

SEQ ID NO: 62839 - protein, 9 aa, Homo Sapiens
TPGPAGSRL

SEQ ID NO: 62840 - protein, 9 aa, Homo Sapiens
TPGPVGLAL

SEQ ID NO: 62841 - protein, 9 aa, Homo Sapiens
TPHAVGVLL

SEQ ID NO: 62842 - protein, 9 aa, Homo Sapiens
TPHFSGLAA

SEQ ID NO: 62843 - protein, 9 aa, Homo Sapiens
TPHLRNLAV

SEQ ID NO: 62844 - protein, 9 aa, Homo Sapiens
TPHQTFVRL

SEQ ID NO: 62845 - protein, 9 aa, Homo Sapiens
TPHVVGSRF

SEQ ID NO: 62846 - protein, 9 aa, Homo Sapiens
TPIAVGTVI

SEQ ID NO: 62847 - protein, 9 aa, Homo Sapiens
TPINKRPVL

SEQ ID NO: 62848 - protein, 9 aa, Homo Sapiens
TPIPGTIEM

SEQ ID NO: 62849 - protein, 9 aa, Homo Sapiens
TPIQGTSEL

SEQ ID NO: 62850 - protein, 9 aa, Homo Sapiens
TPISQAQKL

SEQ ID NO: 62851 - protein, 9 aa, Homo Sapiens
TPLARIVAF

SEQ ID NO: 62852 - protein, 9 aa, Homo Sapiens
TPLSSTVTL

SEQ ID NO: 62853 - protein, 9 aa, Homo Sapiens
TPLSTGGTL

SEQ ID NO: 62854 - protein, 9 aa, Homo Sapiens
TPLYKKKEL

SEQ ID NO: 62855 - protein, 9 aa, Homo Sapiens
TPMFREYSL

SEQ ID NO: 62856 - protein, 9 aa, Homo Sapiens
TPMGPGRTV

SEQ ID NO: 62857 - protein, 9 aa, Homo Sapiens
TPMQVVTCL

SEQ ID NO: 62858 - protein, 9 aa, Homo Sapiens
TPQAKKIKL

SEQ ID NO: 62859 - protein, 9 aa, Homo Sapiens
TPQDRQCVL

SEQ ID NO: 62860 - protein, 9 aa, Homo Sapiens
TPQGFRSTL

SEQ ID NO: 62861 - protein, 9 aa, Homo Sapiens
TPQSNRPVM

SEQ ID NO: 62862 - protein, 9 aa, Homo Sapiens
TPRLPARLI

SEQ ID NO: 62863 - protein, 9 aa, Homo Sapiens
TPRLPQRNL

SEQ ID NO: 62864 - protein, 9 aa, Homo Sapiens
TPRVPDNSL

SEQ ID NO: 62865 - protein, 9 aa, Homo Sapiens
TPSAGKAML

SEQ ID NO: 62866 - protein, 9 aa, Homo Sapiens
TPSEPHPVL

SEQ ID NO: 62867 - protein, 9 aa, Homo Sapiens
TPSKPPAQL

SEQ ID NO: 62868 - protein, 9 aa, Homo Sapiens
TPSQIGVIL

SEQ ID NO: 62869 - protein, 9 aa, Homo Sapiens
TPVAGSQSL

SEQ ID NO: 62870 - protein, 9 aa, Homo Sapiens
TPVASRQSL

SEQ ID NO: 62871 - protein, 9 aa, Homo Sapiens
TPVIVGSAL

SEQ ID NO: 62872 - protein, 9 aa, Homo Sapiens
TPWQPPTVL

SEQ ID NO: 62873 - protein, 9 aa, Homo Sapiens
TPYNYPVPV

SEQ ID NO: 62874 - protein, 9 aa, Homo Sapiens
TVKPLTLEL

SEQ ID NO: 62875 - protein, 9 aa, Homo Sapiens
TVRKILSRL

SEQ ID NO: 62876 - protein, 9 aa, Homo Sapiens
VAPGALLGL

SEQ ID NO: 62877 - protein, 9 aa, Homo Sapiens
VARPLSTAL

SEQ ID NO: 62878 - protein, 9 aa, Homo Sapiens
VDPNRAVPL

SEQ ID NO: 62879 - protein, 9 aa, Homo Sapiens
VIRELSRAL

SEQ ID NO: 62880 - protein, 9 aa, Homo Sapiens
VPAAVFGSL

SEQ ID NO: 62881 - protein, 9 aa, Homo Sapiens
VPAEHQVAM

SEQ ID NO: 62882 - protein, 9 aa, Homo Sapiens
VPAENKSVL

SEQ ID NO: 62883 - protein, 9 aa, Homo Sapiens
VPAEPKLAF

SEQ ID NO: 62884 - protein, 9 aa, Homo Sapiens
VPAEPSSLL

SEQ ID NO: 62885 - protein, 9 aa, Homo Sapiens
VPAESAAVL

SEQ ID NO: 62886 - protein, 9 aa, Homo Sapiens
VPAGGAVAV

SEQ ID NO: 62887 - protein, 9 aa, Homo Sapiens
VPAPSPLSA

SEQ ID NO: 62888 - protein, 9 aa, Homo Sapiens
VPAQSRPCV

SEQ ID NO: 62889 - protein, 9 aa, Homo Sapiens
VPARPYRVL

SEQ ID NO: 62890 - protein, 9 aa, Homo Sapiens
VPASFRLQM

SEQ ID NO: 62891 - protein, 9 aa, Homo Sapiens
VPASKRPPL

SEQ ID NO: 62892 - protein, 9 aa, Homo Sapiens
VPASLMVSL

SEQ ID NO: 62893 - protein, 9 aa, Homo Sapiens
VPAVPTVGF

SEQ ID NO: 62894 - protein, 9 aa, Homo Sapiens
VPAVTTPVL

SEQ ID NO: 62895 - protein, 9 aa, Homo Sapiens
VPCGNIVGL

SEQ ID NO: 62896 - protein, 9 aa, Homo Sapiens
VPDAKIRIF

SEQ ID NO: 62897 - protein, 9 aa, Homo Sapiens
VPDEHFSTL

SEQ ID NO: 62898 - protein, 9 aa, Homo Sapiens
VPDERRYSL

SEQ ID NO: 62899 - protein, 9 aa, Homo Sapiens
VPDQPHPEI

SEQ ID NO: 62900 - protein, 9 aa, Homo Sapiens
VPDSVKKEL

SEQ ID NO: 62901 - protein, 9 aa, Homo Sapiens
VPEEARPAL

SEQ ID NO: 62902 - protein, 9 aa, Homo Sapiens
VPFERPAVI

SEQ ID NO: 62903 - protein, 9 aa, Homo Sapiens
VPGGRFISM

SEQ ID NO: 62904 - protein, 9 aa, Homo Sapiens
VPGTYRKVV

SEQ ID NO: 62905 - protein, 9 aa, Homo Sapiens
VPHGAGYEL

SEQ ID NO: 62906 - protein, 9 aa, Homo Sapiens
VPHGHITSL

SEQ ID NO: 62907 - protein, 9 aa, Homo Sapiens
VPHKIITHL

SEQ ID NO: 62908 - protein, 9 aa, Homo Sapiens
VPIMVKSKL

SEQ ID NO: 62909 - protein, 9 aa, Homo Sapiens
VPIQSSVVL

SEQ ID NO: 62910 - protein, 9 aa, Homo Sapiens
VPKQPPKTL

SEQ ID NO: 62911 - protein, 9 aa, Homo Sapiens
VPKYWGSGL

SEQ ID NO: 62912 - protein, 9 aa, Homo Sapiens
VPLAQAQAL

SEQ ID NO: 62913 - protein, 9 aa, Homo Sapiens
VPLGAGIAL

SEQ ID NO: 62914 - protein, 9 aa, Homo Sapiens
VPMFRNVSL

SEQ ID NO: 62915 - protein, 9 aa, Homo Sapiens
VPNNKITVV

SEQ ID NO: 62916 - protein, 9 aa, Homo Sapiens
VPNQKRLTL

SEQ ID NO: 62917 - protein, 9 aa, Homo Sapiens
VPNWHRDLV

SEQ ID NO: 62918 - protein, 9 aa, Homo Sapiens
VPPPPHRPL

SEQ ID NO: 62919 - protein, 9 aa, Homo Sapiens
VPQAKPVAV

SEQ ID NO: 62920 - protein, 9 aa, Homo Sapiens
VPQPHPQTL

SEQ ID NO: 62921 - protein, 9 aa, Homo Sapiens
VPQSGVPAL

SEQ ID NO: 62922 - protein, 9 aa, Homo Sapiens
VPQSVTECV

SEQ ID NO: 62923 - protein, 9 aa, Homo Sapiens
VPREPPVSL

SEQ ID NO: 62924 - protein, 9 aa, Homo Sapiens
VPRFYIRIL

SEQ ID NO: 62925 - protein, 9 aa, Homo Sapiens
VPRGQGSQF

SEQ ID NO: 62926 - protein, 9 aa, Homo Sapiens
VPRLPATAA

SEQ ID NO: 62927 - protein, 9 aa, Homo Sapiens
VPRPIFSQL

SEQ ID NO: 62928 - protein, 9 aa, Homo Sapiens
VPRPPQTSL

SEQ ID NO: 62929 - protein, 9 aa, Homo Sapiens
VPRPPSNPP

SEQ ID NO: 62930 - protein, 9 aa, Homo Sapiens
VPRPVLRAL

SEQ ID NO: 62931 - protein, 9 aa, Homo Sapiens
VPRVLGSSV

SEQ ID NO: 62932 - protein, 9 aa, Homo Sapiens
VPSAAGYAL

SEQ ID NO: 62933 - protein, 9 aa, Homo Sapiens
VPSAVALVL

SEQ ID NO: 62934 - protein, 9 aa, Homo Sapiens
VPSEPGGVL

SEQ ID NO: 62935 - protein, 9 aa, Homo Sapiens
VPSKPPMSL

SEQ ID NO: 62936 - protein, 9 aa, Homo Sapiens
VPSPYLSSL

SEQ ID NO: 62937 - protein, 9 aa, Homo Sapiens
VPVAKTAEL

SEQ ID NO: 62938 - protein, 9 aa, Homo Sapiens
VPVGNSPAL

SEQ ID NO: 62939 - protein, 9 aa, Homo Sapiens
VPVPHTTAL

SEQ ID NO: 62940 - protein, 9 aa, Homo Sapiens
VPVPPNVAF

SEQ ID NO: 62941 - protein, 9 aa, Homo Sapiens
VPYGKGPSF

SEQ ID NO: 62942 - protein, 9 aa, Homo Sapiens
VPYGTPLSV

SEQ ID NO: 62943 - protein, 9 aa, Homo Sapiens
VPYSTSASL

SEQ ID NO: 62944 - protein, 9 aa, Homo Sapiens
VVAPAGITL

SEQ ID NO: 62945 - protein, 9 aa, Homo Sapiens
VVKPPGSSL

SEQ ID NO: 62946 - protein, 9 aa, Homo Sapiens
VVRIITSEL

SEQ ID NO: 62947 - protein, 9 aa, Homo Sapiens
WARPLSVSF

SEQ ID NO: 62948 - protein, 9 aa, Homo Sapiens
WPHDTIGSL

SEQ ID NO: 62949 - protein, 9 aa, Homo Sapiens
WVRPDLGEL

SEQ ID NO: 62950 - protein, 9 aa, Homo Sapiens
YLRPPNTSL

SEQ ID NO: 62951 - protein, 9 aa, Homo Sapiens
YPAAKRVKL

SEQ ID NO: 62952 - protein, 9 aa, Homo Sapiens
YPAAVPQAL

SEQ ID NO: 62953 - protein, 9 aa, Homo Sapiens
YPAQITPKM

SEQ ID NO: 62954 - protein, 9 aa, Homo Sapiens
YPAYLGARL

SEQ ID NO: 62955 - protein, 9 aa, Homo Sapiens
YPDEKSVCL

SEQ ID NO: 62956 - protein, 9 aa, Homo Sapiens
YPEELKPVL

SEQ ID NO: 62957 - protein, 9 aa, Homo Sapiens
YPGAERNLL

SEQ ID NO: 62958 - protein, 9 aa, Homo Sapiens
YPGQPHPAL

SEQ ID NO: 62959 - protein, 9 aa, Homo Sapiens
YPHEPTAVF

SEQ ID NO: 62960 - protein, 9 aa, Homo Sapiens
YPHLHNAEL

SEQ ID NO: 62961 - protein, 9 aa, Homo Sapiens
YPKRPLLGL

SEQ ID NO: 62962 - protein, 9 aa, Homo Sapiens
YPLLKNISM

SEQ ID NO: 62963 - protein, 9 aa, Homo Sapiens
YPLRPGPQL

SEQ ID NO: 62964 - protein, 9 aa, Homo Sapiens
YPNERFELL

SEQ ID NO: 62965 - protein, 9 aa, Homo Sapiens
YPRNPTVRW

SEQ ID NO: 62966 - protein, 9 aa, Homo Sapiens
YPRPGTPAA

SEQ ID NO: 62967 - protein, 9 aa, Homo Sapiens
YPRSLFPSL

SEQ ID NO: 62968 - protein, 9 aa, Homo Sapiens
YPSLPTMTV

SEQ ID NO: 62969 - protein, 9 aa, Homo Sapiens
YPSLPTPLL

SEQ ID NO: 62970 - protein, 9 aa, Homo Sapiens
YPYPYPHTL

SEQ ID NO: 62971 - protein, 10 aa, Homo Sapiens
AANPNRFITL

SEQ ID NO: 62972 - protein, 10 aa, Homo Sapiens
AARPVPWNAL

SEQ ID NO: 62973 - protein, 10 aa, Homo Sapiens
AASEKRLHAL

SEQ ID NO: 62974 - protein, 10 aa, Homo Sapiens
APAAPSATAL

SEQ ID NO: 62975 - protein, 10 aa, Homo Sapiens
APAGGSPRML

SEQ ID NO: 62976 - protein, 10 aa, Homo Sapiens
APAPAEKTPV

SEQ ID NO: 62977 - protein, 10 aa, Homo Sapiens
APAPEVGRTL

SEQ ID NO: 62978 - protein, 10 aa, Homo Sapiens
APAPKPYVCL

SEQ ID NO: 62979 - protein, 10 aa, Homo Sapiens
APAPPPEEVL

SEQ ID NO: 62980 - protein, 10 aa, Homo Sapiens
APAPRSGECL

SEQ ID NO: 62981 - protein, 10 aa, Homo Sapiens
APAPSKGQTL

SEQ ID NO: 62982 - protein, 10 aa, Homo Sapiens
APAQPPSQTF

SEQ ID NO: 62983 - protein, 10 aa, Homo Sapiens
APASAFGSSL

SEQ ID NO: 62984 - protein, 10 aa, Homo Sapiens
APAYQRFHAL

SEQ ID NO: 62985 - protein, 10 aa, Homo Sapiens
APDGSQRAVL

SEQ ID NO: 62986 - protein, 10 aa, Homo Sapiens
APDSQRLKLL

SEQ ID NO: 62987 - protein, 10 aa, Homo Sapiens
APEVLPKPRM

SEQ ID NO: 62988 - protein, 10 aa, Homo Sapiens
APFDRRATSL

SEQ ID NO: 62989 - protein, 10 aa, Homo Sapiens
APFGLKPRSV

SEQ ID NO: 62990 - protein, 10 aa, Homo Sapiens
APFQGDQRSL

SEQ ID NO: 62991 - protein, 10 aa, Homo Sapiens
APGAPAAVAL

SEQ ID NO: 62992 - protein, 10 aa, Homo Sapiens
APGDYGRQAL

SEQ ID NO: 62993 - protein, 10 aa, Homo Sapiens
APGGTGIVSA

SEQ ID NO: 62994 - protein, 10 aa, Homo Sapiens
APGIIPRISV

SEQ ID NO: 62995 - protein, 10 aa, Homo Sapiens
APGIRDHESL

SEQ ID NO: 62996 - protein, 10 aa, Homo Sapiens
APHALLQAVL

SEQ ID NO: 62997 - protein, 10 aa, Homo Sapiens
APHARNGLSL

SEQ ID NO: 62998 - protein, 10 aa, Homo Sapiens
APHEPDGVAL

SEQ ID NO: 62999 - protein, 10 aa, Homo Sapiens
APHPSSWETL

SEQ ID NO: 63000 - protein, 10 aa, Homo Sapiens
APIDRVGQTI

SEQ ID NO: 63001 - protein, 10 aa, Homo Sapiens
APIGPHLQSM

SEQ ID NO: 63002 - protein, 10 aa, Homo Sapiens
APIIRVGGAL

SEQ ID NO: 63003 - protein, 10 aa, Homo Sapiens
APINKAGSFL

SEQ ID NO: 63004 - protein, 10 aa, Homo Sapiens
APIQGNREEL

SEQ ID NO: 63005 - protein, 10 aa, Homo Sapiens
APKKPTGVDL

SEQ ID NO: 63006 - protein, 10 aa, Homo Sapiens
APKPSSRPSL

SEQ ID NO: 63007 - protein, 10 aa, Homo Sapiens
APKRPPSAFF

SEQ ID NO: 63008 - protein, 10 aa, Homo Sapiens
APLAAGMIAL

SEQ ID NO: 63009 - protein, 10 aa, Homo Sapiens
APMPCNLIKL

SEQ ID NO: 63010 - protein, 10 aa, Homo Sapiens
APPEYHRKAV

SEQ ID NO: 63011 - protein, 10 aa, Homo Sapiens
APPQEQKQML

SEQ ID NO: 63012 - protein, 10 aa, Homo Sapiens
APPVRPQNSL

SEQ ID NO: 63013 - protein, 10 aa, Homo Sapiens
APQTQHVSPM

SEQ ID NO: 63014 - protein, 10 aa, Homo Sapiens
APRAALVFAL

SEQ ID NO: 63015 - protein, 10 aa, Homo Sapiens
APRAASTESL

SEQ ID NO: 63016 - protein, 10 aa, Homo Sapiens
APRAGPDPRL

SEQ ID NO: 63017 - protein, 10 aa, Homo Sapiens
APRDAYWIAM

SEQ ID NO: 63018 - protein, 10 aa, Homo Sapiens
APREPPPVEL

SEQ ID NO: 63019 - protein, 10 aa, Homo Sapiens
APRGELYKEL

SEQ ID NO: 63020 - protein, 10 aa, Homo Sapiens
APRGTWSTGL

SEQ ID NO: 63021 - protein, 10 aa, Homo Sapiens
APRHPSTNSL

SEQ ID NO: 63022 - protein, 10 aa, Homo Sapiens
APRIALHTAL

SEQ ID NO: 63023 - protein, 10 aa, Homo Sapiens
APRPASGPIR

SEQ ID NO: 63024 - protein, 10 aa, Homo Sapiens
APRTIFQRVL

SEQ ID NO: 63025 - protein, 10 aa, Homo Sapiens
APRTVALTAL

SEQ ID NO: 63026 - protein, 10 aa, Homo Sapiens
APRTVSVQTL

SEQ ID NO: 63027 - protein, 10 aa, Homo Sapiens
APRWGNPRAL

SEQ ID NO: 63028 - protein, 10 aa, Homo Sapiens
APSAARELSL

SEQ ID NO: 63029 - protein, 10 aa, Homo Sapiens
APSDNRVTSF

SEQ ID NO: 63030 - protein, 10 aa, Homo Sapiens
APSGESRKFL

SEQ ID NO: 63031 - protein, 10 aa, Homo Sapiens
APSGGRLLSA

SEQ ID NO: 63032 - protein, 10 aa, Homo Sapiens
APSGSLAVPL

SEQ ID NO: 63033 - protein, 10 aa, Homo Sapiens
APSIFGGTDM

SEQ ID NO: 63034 - protein, 10 aa, Homo Sapiens
APSLFHLNLL

SEQ ID NO: 63035 - protein, 10 aa, Homo Sapiens
APSMDRAAVA

SEQ ID NO: 63036 - protein, 10 aa, Homo Sapiens
APSPAPKQSF

SEQ ID NO: 63037 - protein, 10 aa, Homo Sapiens
APSPTHVAEL

SEQ ID NO: 63038 - protein, 10 aa, Homo Sapiens
APSQQRLVVV

SEQ ID NO: 63039 - protein, 10 aa, Homo Sapiens
APSSETGTSL

SEQ ID NO: 63040 - protein, 10 aa, Homo Sapiens
APSSPRPALP

SEQ ID NO: 63041 - protein, 10 aa, Homo Sapiens
APSSYDPLAL

SEQ ID NO: 63042 - protein, 10 aa, Homo Sapiens
APTIVGKSSL

SEQ ID NO: 63043 - protein, 10 aa, Homo Sapiens
APTPIQALTL

SEQ ID NO: 63044 - protein, 10 aa, Homo Sapiens
APVNAGPSSL

SEQ ID NO: 63045 - protein, 10 aa, Homo Sapiens
APVPTTTLVL

SEQ ID NO: 63046 - protein, 10 aa, Homo Sapiens
APYERRAMEL

SEQ ID NO: 63047 - protein, 10 aa, Homo Sapiens
APYGGPIALL

SEQ ID NO: 63048 - protein, 10 aa, Homo Sapiens
APYRDLPASL

SEQ ID NO: 63049 - protein, 10 aa, Homo Sapiens
ASPKSPTAAL

SEQ ID NO: 63050 - protein, 10 aa, Homo Sapiens
AVDPNRAVPL

SEQ ID NO: 63051 - protein, 10 aa, Homo Sapiens
DALREPGKAL

SEQ ID NO: 63052 - protein, 10 aa, Homo Sapiens
EPAPASVTAL

SEQ ID NO: 63053 - protein, 10 aa, Homo Sapiens
FPAKPGSLTL

SEQ ID NO: 63054 - protein, 10 aa, Homo Sapiens
FPAPGKTVTL

SEQ ID NO: 63055 - protein, 10 aa, Homo Sapiens
FPHPVNQVTF

SEQ ID NO: 63056 - protein, 10 aa, Homo Sapiens
FPRDPKRLTP

SEQ ID NO: 63057 - protein, 10 aa, Homo Sapiens
GPAATSGAVL

SEQ ID NO: 63058 - protein, 10 aa, Homo Sapiens
GPAVGPRGNL

SEQ ID NO: 63059 - protein, 10 aa, Homo Sapiens
GPFPGKFNEV

SEQ ID NO: 63060 - protein, 10 aa, Homo Sapiens
GPIGCGKTSL

SEQ ID NO: 63061 - protein, 10 aa, Homo Sapiens
GPKPGGGPGL

SEQ ID NO: 63062 - protein, 10 aa, Homo Sapiens
GPLPGPGPAL

SEQ ID NO: 63063 - protein, 10 aa, Homo Sapiens
GPMPQTREHL

SEQ ID NO: 63064 - protein, 10 aa, Homo Sapiens
GPNERIGMVV

SEQ ID NO: 63065 - protein, 10 aa, Homo Sapiens
GPNGGIVTSL

SEQ ID NO: 63066 - protein, 10 aa, Homo Sapiens
GPRPITQSEL

SEQ ID NO: 63067 - protein, 10 aa, Homo Sapiens
GPRSPSVIFM

SEQ ID NO: 63068 - protein, 10 aa, Homo Sapiens
GPSIVHRKCF

SEQ ID NO: 63069 - protein, 10 aa, Homo Sapiens
HPHAVNEIAL

SEQ ID NO: 63070 - protein, 10 aa, Homo Sapiens
HPISDHEATL

SEQ ID NO: 63071 - protein, 10 aa, Homo Sapiens
HPKYPDGKTF

SEQ ID NO: 63072 - protein, 10 aa, Homo Sapiens
HPNSNIYNTL

SEQ ID NO: 63073 - protein, 10 aa, Homo Sapiens
HPPMILPLPL

SEQ ID NO: 63074 - protein, 10 aa, Homo Sapiens
HPQPGSANSL

SEQ ID NO: 63075 - protein, 10 aa, Homo Sapiens
HPRSPNVLSV

SEQ ID NO: 63076 - protein, 10 aa, Homo Sapiens
HPRTSITVVL

SEQ ID NO: 63077 - protein, 10 aa, Homo Sapiens
HPRVPSLTTV

SEQ ID NO: 63078 - protein, 10 aa, Homo Sapiens
IPAKVVREVL

SEQ ID NO: 63079 - protein, 10 aa, Homo Sapiens
IPAPGSGVSF

SEQ ID NO: 63080 - protein, 10 aa, Homo Sapiens
IPMPFSSSSL

SEQ ID NO: 63081 - protein, 10 aa, Homo Sapiens
IPQKQREITL

SEQ ID NO: 63082 - protein, 10 aa, Homo Sapiens
IPRDPSQQEL

SEQ ID NO: 63083 - protein, 10 aa, Homo Sapiens
IPRPVDGVEV

SEQ ID NO: 63084 - protein, 10 aa, Homo Sapiens
IPWTPPGTAL

SEQ ID NO: 63085 - protein, 10 aa, Homo Sapiens
IPYTGPFNLL

SEQ ID NO: 63086 - protein, 10 aa, Homo Sapiens
IVDGHERAML

SEQ ID NO: 63087 - protein, 10 aa, Homo Sapiens
IVDGNHRLTL

SEQ ID NO: 63088 - protein, 10 aa, Homo Sapiens
KPAAPSFGVL

SEQ ID NO: 63089 - protein, 10 aa, Homo Sapiens
KPAPPFNVTV

SEQ ID NO: 63090 - protein, 10 aa, Homo Sapiens
KPFGLKVSQL

SEQ ID NO: 63091 - protein, 10 aa, Homo Sapiens
KPHSGFHVAF

SEQ ID NO: 63092 - protein, 10 aa, Homo Sapiens
KPIDVSRLDL

SEQ ID NO: 63093 - protein, 10 aa, Homo Sapiens
KPIFSKIVSL

SEQ ID NO: 63094 - protein, 10 aa, Homo Sapiens
KPKCGRMISF

SEQ ID NO: 63095 - protein, 10 aa, Homo Sapiens
KPKDPLKISL

SEQ ID NO: 63096 - protein, 10 aa, Homo Sapiens
KPKPTNPVEI

SEQ ID NO: 63097 - protein, 10 aa, Homo Sapiens
KPKPVKPVTF

SEQ ID NO: 63098 - protein, 10 aa, Homo Sapiens
KPMEGNFEEI

SEQ ID NO: 63099 - protein, 10 aa, Homo Sapiens
KPNDSRALQL

SEQ ID NO: 63100 - protein, 10 aa, Homo Sapiens
KPNQISGTVF

SEQ ID NO: 63101 - protein, 10 aa, Homo Sapiens
KPRNVQILNM

SEQ ID NO: 63102 - protein, 10 aa, Homo Sapiens
KPRNVVFVDM

SEQ ID NO: 63103 - protein, 10 aa, Homo Sapiens
KPRPDVTNEL

SEQ ID NO: 63104 - protein, 10 aa, Homo Sapiens
KPSEERVREI

SEQ ID NO: 63105 - protein, 10 aa, Homo Sapiens
KPSESIYSAL

SEQ ID NO: 63106 - protein, 10 aa, Homo Sapiens
KPTDEKLREL

SEQ ID NO: 63107 - protein, 10 aa, Homo Sapiens
KVRYPDRITL

SEQ ID NO: 63108 - protein, 10 aa, Homo Sapiens
LGSPAAGTLA

SEQ ID NO: 63109 - protein, 10 aa, Homo Sapiens
LIMGFLVLGL

SEQ ID NO: 63110 - protein, 10 aa, Homo Sapiens
LPAAAMARAM

SEQ ID NO: 63111 - protein, 10 aa, Homo Sapiens
LPAPCTPLSL

SEQ ID NO: 63112 - protein, 10 aa, Homo Sapiens
LPASWRPVTL

SEQ ID NO: 63113 - protein, 10 aa, Homo Sapiens
LPDQDQRSQL

SEQ ID NO: 63114 - protein, 10 aa, Homo Sapiens
LPDSGHLHPL

SEQ ID NO: 63115 - protein, 10 aa, Homo Sapiens
LPKPGGAHSL

SEQ ID NO: 63116 - protein, 10 aa, Homo Sapiens
LPKSPPYTAF

SEQ ID NO: 63117 - protein, 10 aa, Homo Sapiens
LPMKEGCTEV

SEQ ID NO: 63118 - protein, 10 aa, Homo Sapiens
LPPEIVPATL

SEQ ID NO: 63119 - protein, 10 aa, Homo Sapiens
LPPLPKRPAL

SEQ ID NO: 63120 - protein, 10 aa, Homo Sapiens
LPRAVGTQTL

SEQ ID NO: 63121 - protein, 10 aa, Homo Sapiens
LPRGMQPTEF

SEQ ID NO: 63122 - protein, 10 aa, Homo Sapiens
LPRGSIPRSL

SEQ ID NO: 63123 - protein, 10 aa, Homo Sapiens
LPRKPVAGAL

SEQ ID NO: 63124 - protein, 10 aa, Homo Sapiens
LPRPHASIMF

SEQ ID NO: 63125 - protein, 10 aa, Homo Sapiens
LPRRPNDIYV

SEQ ID NO: 63126 - protein, 10 aa, Homo Sapiens
LPSAHRVSGL

SEQ ID NO: 63127 - protein, 10 aa, Homo Sapiens
LPSDLRTISL

SEQ ID NO: 63128 - protein, 10 aa, Homo Sapiens
LPSNTKFVAL

SEQ ID NO: 63129 - protein, 10 aa, Homo Sapiens
LPYLPSGESL

SEQ ID NO: 63130 - protein, 10 aa, Homo Sapiens
MPQSGTGVSV

SEQ ID NO: 63131 - protein, 10 aa, Homo Sapiens
MPRGIYHSAL

SEQ ID NO: 63132 - protein, 10 aa, Homo Sapiens
MPRQPSATRL

SEQ ID NO: 63133 - protein, 10 aa, Homo Sapiens
MPSASRVILL

SEQ ID NO: 63134 - protein, 10 aa, Homo Sapiens
MPSEQIRNQL

SEQ ID NO: 63135 - protein, 10 aa, Homo Sapiens
MPSLKHIVEL

SEQ ID NO: 63136 - protein, 10 aa, Homo Sapiens
MPYDSNRVVL

SEQ ID NO: 63137 - protein, 10 aa, Homo Sapiens
MPYSNGRPAL

SEQ ID NO: 63138 - protein, 10 aa, Homo Sapiens
NPNQNKNVAL

SEQ ID NO: 63139 - protein, 10 aa, Homo Sapiens
NPRDLPLMAL

SEQ ID NO: 63140 - protein, 10 aa, Homo Sapiens
NPRLNILDTL

SEQ ID NO: 63141 - protein, 10 aa, Homo Sapiens
NPRNFSDNQL

SEQ ID NO: 63142 - protein, 10 aa, Homo Sapiens
NPRPVFGICL

SEQ ID NO: 63143 - protein, 10 aa, Homo Sapiens
NPRQINWTVL

SEQ ID NO: 63144 - protein, 10 aa, Homo Sapiens
NPSALRETVV

SEQ ID NO: 63145 - protein, 10 aa, Homo Sapiens
NPSSQRALCL

SEQ ID NO: 63146 - protein, 10 aa, Homo Sapiens
PRPDRLVNRL

SEQ ID NO: 63147 - protein, 10 aa, Homo Sapiens
PRPSTGPHKL

SEQ ID NO: 63148 - protein, 10 aa, Homo Sapiens
QPADVIKTHM

SEQ ID NO: 63149 - protein, 10 aa, Homo Sapiens
QPANKGFRAL

SEQ ID NO: 63150 - protein, 10 aa, Homo Sapiens
QPAPPREAHF

SEQ ID NO: 63151 - protein, 10 aa, Homo Sapiens
QPDQTRIVAL

SEQ ID NO: 63152 - protein, 10 aa, Homo Sapiens
QPDYSERLCL

SEQ ID NO: 63153 - protein, 10 aa, Homo Sapiens
QPHVGDYRQL

SEQ ID NO: 63154 - protein, 10 aa, Homo Sapiens
QPLAPSGLTL

SEQ ID NO: 63155 - protein, 10 aa, Homo Sapiens
QSAQRAKASL

SEQ ID NO: 63156 - protein, 10 aa, Homo Sapiens
QVDPKKRISM

SEQ ID NO: 63157 - protein, 10 aa, Homo Sapiens
QVRLPDGTSL

SEQ ID NO: 63158 - protein, 10 aa, Homo Sapiens
RASPVRLLSL

SEQ ID NO: 63159 - protein, 10 aa, Homo Sapiens
RGPLPPLRPL

SEQ ID NO: 63160 - protein, 10 aa, Homo Sapiens
RIRAAWTRAL

SEQ ID NO: 63161 - protein, 10 aa, Homo Sapiens
RIRMTDGRTL

SEQ ID NO: 63162 - protein, 10 aa, Homo Sapiens
RPAAGFVAGL

SEQ ID NO: 63163 - protein, 10 aa, Homo Sapiens
RPAAPGQTPL

SEQ ID NO: 63164 - protein, 10 aa, Homo Sapiens
RPAEVGGMQL

SEQ ID NO: 63165 - protein, 10 aa, Homo Sapiens
RPANHRQLTF

SEQ ID NO: 63166 - protein, 10 aa, Homo Sapiens
RPAPLPAAVV

SEQ ID NO: 63167 - protein, 10 aa, Homo Sapiens
RPAPPMKGQL

SEQ ID NO: 63168 - protein, 10 aa, Homo Sapiens
RPASYQSVSV

SEQ ID NO: 63169 - protein, 10 aa, Homo Sapiens
RPDDKRILEF

SEQ ID NO: 63170 - protein, 10 aa, Homo Sapiens
RPDERRFAVF

SEQ ID NO: 63171 - protein, 10 aa, Homo Sapiens
RPDKRFRLAL

SEQ ID NO: 63172 - protein, 10 aa, Homo Sapiens
RPDPAGHLTL

SEQ ID NO: 63173 - protein, 10 aa, Homo Sapiens
RPFISEGTTL

SEQ ID NO: 63174 - protein, 10 aa, Homo Sapiens
RPIFPGKHYL

SEQ ID NO: 63175 - protein, 10 aa, Homo Sapiens
RPIGIGVQGL

SEQ ID NO: 63176 - protein, 10 aa, Homo Sapiens
RPKAISPYHL

SEQ ID NO: 63177 - protein, 10 aa, Homo Sapiens
RPKLPEDPLL

SEQ ID NO: 63178 - protein, 10 aa, Homo Sapiens
RPKPPSATSI

SEQ ID NO: 63179 - protein, 10 aa, Homo Sapiens
RPKQPGPVKL

SEQ ID NO: 63180 - protein, 10 aa, Homo Sapiens
RPMAFLREYF

SEQ ID NO: 63181 - protein, 10 aa, Homo Sapiens
RPMPGMQQQM

SEQ ID NO: 63182 - protein, 10 aa, Homo Sapiens
RPMPPEARRL

SEQ ID NO: 63183 - protein, 10 aa, Homo Sapiens
RPMYGAVTSF

SEQ ID NO: 63184 - protein, 10 aa, Homo Sapiens
RPNQHNTVKL

SEQ ID NO: 63185 - protein, 10 aa, Homo Sapiens
RPPLEEKKAL

SEQ ID NO: 63186 - protein, 10 aa, Homo Sapiens
RPPPSPSGTI

SEQ ID NO: 63187 - protein, 10 aa, Homo Sapiens
RPPYYTPNQL

SEQ ID NO: 63188 - protein, 10 aa, Homo Sapiens
RPQAPATVGL

SEQ ID NO: 63189 - protein, 10 aa, Homo Sapiens
RPRDALPRLL

SEQ ID NO: 63190 - protein, 10 aa, Homo Sapiens
RPRDDGLMDL

SEQ ID NO: 63191 - protein, 10 aa, Homo Sapiens
RPREAEVRFL

SEQ ID NO: 63192 - protein, 10 aa, Homo Sapiens
RPRGFAYVQF

SEQ ID NO: 63193 - protein, 10 aa, Homo Sapiens
RPRKAFLLLL

SEQ ID NO: 63194 - protein, 10 aa, Homo Sapiens
RPRPDEERPL

SEQ ID NO: 63195 - protein, 10 aa, Homo Sapiens
RPRPEYVAIF

SEQ ID NO: 63196 - protein, 10 aa, Homo Sapiens
RPRPSEDTFL

SEQ ID NO: 63197 - protein, 10 aa, Homo Sapiens
RPRPSGEEVL

SEQ ID NO: 63198 - protein, 10 aa, Homo Sapiens
RPRSWRELPL

SEQ ID NO: 63199 - protein, 10 aa, Homo Sapiens
RPRTEVSLSA

SEQ ID NO: 63200 - protein, 10 aa, Homo Sapiens
RPSDEVIREL

SEQ ID NO: 63201 - protein, 10 aa, Homo Sapiens
RPSGEAFVEL

SEQ ID NO: 63202 - protein, 10 aa, Homo Sapiens
RPSGSWNGAL

SEQ ID NO: 63203 - protein, 10 aa, Homo Sapiens
RPSPWRPLVL

SEQ ID NO: 63204 - protein, 10 aa, Homo Sapiens
RPSQNNTIGL

SEQ ID NO: 63205 - protein, 10 aa, Homo Sapiens
RPSSQYIVAL

SEQ ID NO: 63206 - protein, 10 aa, Homo Sapiens
RPSTPHTITL

SEQ ID NO: 63207 - protein, 10 aa, Homo Sapiens
RPSTRIQQQL

SEQ ID NO: 63208 - protein, 10 aa, Homo Sapiens
RPVAPSGTAL

SEQ ID NO: 63209 - protein, 10 aa, Homo Sapiens
RPVNLMGTSL

SEQ ID NO: 63210 - protein, 10 aa, Homo Sapiens
RPWLEGRHTL

SEQ ID NO: 63211 - protein, 10 aa, Homo Sapiens
RPYGCVLRAA

SEQ ID NO: 63212 - protein, 10 aa, Homo Sapiens
RVADFGSATF

SEQ ID NO: 63213 - protein, 10 aa, Homo Sapiens
RVAEHHVATL

SEQ ID NO: 63214 - protein, 10 aa, Homo Sapiens
RVREIIINAV

SEQ ID NO: 63215 - protein, 10 aa, Homo Sapiens
RVREITENLM

SEQ ID NO: 63216 - protein, 10 aa, Homo Sapiens
RVRFLEQQTL

SEQ ID NO: 63217 - protein, 10 aa, Homo Sapiens
SIRPVSEVTL

SEQ ID NO: 63218 - protein, 10 aa, Homo Sapiens
SPAAPSPLAL

SEQ ID NO: 63219 - protein, 10 aa, Homo Sapiens
SPAGEWRALL

SEQ ID NO: 63220 - protein, 10 aa, Homo Sapiens
SPAGGGAEAL

SEQ ID NO: 63221 - protein, 10 aa, Homo Sapiens
SPAGNSPAPL

SEQ ID NO: 63222 - protein, 10 aa, Homo Sapiens
SPANTRYLFL

SEQ ID NO: 63223 - protein, 10 aa, Homo Sapiens
SPASIRTTDF

SEQ ID NO: 63224 - protein, 10 aa, Homo Sapiens
SPASRSISLL

SEQ ID NO: 63225 - protein, 10 aa, Homo Sapiens
SPCAAELTAL

SEQ ID NO: 63226 - protein, 10 aa, Homo Sapiens
SPDGSKILAT

SEQ ID NO: 63227 - protein, 10 aa, Homo Sapiens
SPDKIPWSAL

SEQ ID NO: 63228 - protein, 10 aa, Homo Sapiens
SPDQKKIISL

SEQ ID NO: 63229 - protein, 10 aa, Homo Sapiens
SPDTAIRSGL

SEQ ID NO: 63230 - protein, 10 aa, Homo Sapiens
SPEGPSKPSL

SEQ ID NO: 63231 - protein, 10 aa, Homo Sapiens
SPGQHYFSSL

SEQ ID NO: 63232 - protein, 10 aa, Homo Sapiens
SPHLPGTSSA

SEQ ID NO: 63233 - protein, 10 aa, Homo Sapiens
SPHPGLLLDL

SEQ ID NO: 63234 - protein, 10 aa, Homo Sapiens
SPHPPSEVTA

SEQ ID NO: 63235 - protein, 10 aa, Homo Sapiens
SPIGASGVAH

SEQ ID NO: 63236 - protein, 10 aa, Homo Sapiens
SPIGKSPYTL

SEQ ID NO: 63237 - protein, 10 aa, Homo Sapiens
SPIKVTLATL

SEQ ID NO: 63238 - protein, 10 aa, Homo Sapiens
SPIVTSGLIM

SEQ ID NO: 63239 - protein, 10 aa, Homo Sapiens
SPKGCGTVLL

SEQ ID NO: 63240 - protein, 10 aa, Homo Sapiens
SPKPALCVTL

SEQ ID NO: 63241 - protein, 10 aa, Homo Sapiens
SPLAASKECL

SEQ ID NO: 63242 - protein, 10 aa, Homo Sapiens
SPLPVGQNSL

SEQ ID NO: 63243 - protein, 10 aa, Homo Sapiens
SPLSAARAAL

SEQ ID NO: 63244 - protein, 10 aa, Homo Sapiens
SPLSSETTQL

SEQ ID NO: 63245 - protein, 10 aa, Homo Sapiens
SPMAQSTSSL

SEQ ID NO: 63246 - protein, 10 aa, Homo Sapiens
SPMDGTSSAL

SEQ ID NO: 63247 - protein, 10 aa, Homo Sapiens
SPMEGTGISL

SEQ ID NO: 63248 - protein, 10 aa, Homo Sapiens
SPMPGTLTAL

SEQ ID NO: 63249 - protein, 10 aa, Homo Sapiens
SPMPPSEVKL

SEQ ID NO: 63250 - protein, 10 aa, Homo Sapiens
SPMSIPTNTM

SEQ ID NO: 63251 - protein, 10 aa, Homo Sapiens
SPNACGGIAL

SEQ ID NO: 63252 - protein, 10 aa, Homo Sapiens
SPNQSLRLGL

SEQ ID NO: 63253 - protein, 10 aa, Homo Sapiens
SPNSAHAVSL

SEQ ID NO: 63254 - protein, 10 aa, Homo Sapiens
SPNTAGLRSL

SEQ ID NO: 63255 - protein, 10 aa, Homo Sapiens
SPPSAARHSL

SEQ ID NO: 63256 - protein, 10 aa, Homo Sapiens
SPPSQPAVAL

SEQ ID NO: 63257 - protein, 10 aa, Homo Sapiens
SPPTPIRSVL

SEQ ID NO: 63258 - protein, 10 aa, Homo Sapiens
SPQSGNFRQL

SEQ ID NO: 63259 - protein, 10 aa, Homo Sapiens
SPQYRLRIAM

SEQ ID NO: 63260 - protein, 10 aa, Homo Sapiens
SPRDITTIKL

SEQ ID NO: 63261 - protein, 10 aa, Homo Sapiens
SPREEPRAPW

SEQ ID NO: 63262 - protein, 10 aa, Homo Sapiens
SPRLPVGGFR

SEQ ID NO: 63263 - protein, 10 aa, Homo Sapiens
SPRPALPALL

SEQ ID NO: 63264 - protein, 10 aa, Homo Sapiens
SPRPNHSYIF

SEQ ID NO: 63265 - protein, 10 aa, Homo Sapiens
SPRPNIILGL

SEQ ID NO: 63266 - protein, 10 aa, Homo Sapiens
SPRPTQFSCV

SEQ ID NO: 63267 - protein, 10 aa, Homo Sapiens
SPRSPISPEL

SEQ ID NO: 63268 - protein, 10 aa, Homo Sapiens
SPRSPSTTYL

SEQ ID NO: 63269 - protein, 10 aa, Homo Sapiens
SPRSPTQHCL

SEQ ID NO: 63270 - protein, 10 aa, Homo Sapiens
SPRSSDLVKL

SEQ ID NO: 63271 - protein, 10 aa, Homo Sapiens
SPRSSTVHIL

SEQ ID NO: 63272 - protein, 10 aa, Homo Sapiens
SPSLNREEVM

SEQ ID NO: 63273 - protein, 10 aa, Homo Sapiens
SPSPERSLLL

SEQ ID NO: 63274 - protein, 10 aa, Homo Sapiens
SPSPLSGSAL

SEQ ID NO: 63275 - protein, 10 aa, Homo Sapiens
SPSPVLRLVL

SEQ ID NO: 63276 - protein, 10 aa, Homo Sapiens
SPSRNRSLQL

SEQ ID NO: 63277 - protein, 10 aa, Homo Sapiens
SPSSVTGNAL

SEQ ID NO: 63278 - protein, 10 aa, Homo Sapiens
SPTPRIKAEL

SEQ ID NO: 63279 - protein, 10 aa, Homo Sapiens
SPTSAHLLQL

SEQ ID NO: 63280 - protein, 10 aa, Homo Sapiens
SPTSVRQMAL

SEQ ID NO: 63281 - protein, 10 aa, Homo Sapiens
SPVSYLRVSM

SEQ ID NO: 63282 - protein, 10 aa, Homo Sapiens
SPYFQRPLAL

SEQ ID NO: 63283 - protein, 10 aa, Homo Sapiens
SPYPRVKVDF

SEQ ID NO: 63284 - protein, 10 aa, Homo Sapiens
SPYPTKTQTM

SEQ ID NO: 63285 - protein, 10 aa, Homo Sapiens
TPAAVRELVL

SEQ ID NO: 63286 - protein, 10 aa, Homo Sapiens
TPAPSRTASF

SEQ ID NO: 63287 - protein, 10 aa, Homo Sapiens
TPDKFGRTCL

SEQ ID NO: 63288 - protein, 10 aa, Homo Sapiens
TPFGGRLLVL

SEQ ID NO: 63289 - protein, 10 aa, Homo Sapiens
TPLASTSNSL

SEQ ID NO: 63290 - protein, 10 aa, Homo Sapiens
TPLLMQALPM

SEQ ID NO: 63291 - protein, 10 aa, Homo Sapiens
TPQSILRSTL

SEQ ID NO: 63292 - protein, 10 aa, Homo Sapiens
TPRDLVLRSL

SEQ ID NO: 63293 - protein, 10 aa, Homo Sapiens
TPRSYVGVTL

SEQ ID NO: 63294 - protein, 10 aa, Homo Sapiens
TPSKPSGLSL

SEQ ID NO: 63295 - protein, 10 aa, Homo Sapiens
TPSKPTSESF

SEQ ID NO: 63296 - protein, 10 aa, Homo Sapiens
TPSPVRLHAL

SEQ ID NO: 63297 - protein, 10 aa, Homo Sapiens
TPSPYDHDSL

SEQ ID NO: 63298 - protein, 10 aa, Homo Sapiens
TPTSAPRSVM

SEQ ID NO: 63299 - protein, 10 aa, Homo Sapiens
VPAARSILAL

SEQ ID NO: 63300 - protein, 10 aa, Homo Sapiens
VPAKAKLTKL

SEQ ID NO: 63301 - protein, 10 aa, Homo Sapiens
VPAPVPLMSL

SEQ ID NO: 63302 - protein, 10 aa, Homo Sapiens
VPASQKLRQL

SEQ ID NO: 63303 - protein, 10 aa, Homo Sapiens
VPGPPARLGL

SEQ ID NO: 63304 - protein, 10 aa, Homo Sapiens
VPKAPGFAQM

SEQ ID NO: 63305 - protein, 10 aa, Homo Sapiens
VPKPPSIEEF

SEQ ID NO: 63306 - protein, 10 aa, Homo Sapiens
VPNATIRNVL

SEQ ID NO: 63307 - protein, 10 aa, Homo Sapiens
VPNQKRLTLL

SEQ ID NO: 63308 - protein, 10 aa, Homo Sapiens
VPRFLMSSTM

SEQ ID NO: 63309 - protein, 10 aa, Homo Sapiens
VPRPPPLYSH

SEQ ID NO: 63310 - protein, 10 aa, Homo Sapiens
VPRQPTVTSV

SEQ ID NO: 63311 - protein, 10 aa, Homo Sapiens
VPTSPKGRLL

SEQ ID NO: 63312 - protein, 10 aa, Homo Sapiens
WPKDVGIVAL

SEQ ID NO: 63313 - protein, 10 aa, Homo Sapiens
YPARYRPTAL

SEQ ID NO: 63314 - protein, 10 aa, Homo Sapiens
YPFKPPKVAF

SEQ ID NO: 63315 - protein, 10 aa, Homo Sapiens
YPFKPPKVTF

SEQ ID NO: 63316 - protein, 10 aa, Homo Sapiens
YPSEQEKLSL

SEQ ID NO: 63317 - protein, 10 aa, Homo Sapiens
YPYNAPTVKF

SEQ ID NO: 63318 - protein, 11 aa, Homo Sapiens
AALSPSSGQRL

SEQ ID NO: 63319 - protein, 11 aa, Homo Sapiens
AASKERSGVSL

SEQ ID NO: 63320 - protein, 11 aa, Homo Sapiens
APAAYPREVAL

SEQ ID NO: 63321 - protein, 11 aa, Homo Sapiens
APAGTTSSRVL

SEQ ID NO: 63322 - protein, 11 aa, Homo Sapiens
APAPGAPLLPL

SEQ ID NO: 63323 - protein, 11 aa, Homo Sapiens
APAPSRGSVQV

SEQ ID NO: 63324 - protein, 11 aa, Homo Sapiens
APDAAPAPASI

SEQ ID NO: 63325 - protein, 11 aa, Homo Sapiens
APDKHHITPLL

SEQ ID NO: 63326 - protein, 11 aa, Homo Sapiens
APDVGRMGIEI

SEQ ID NO: 63327 - protein, 11 aa, Homo Sapiens
APFEPLASGIL

SEQ ID NO: 63328 - protein, 11 aa, Homo Sapiens
APLSEDQRTAL

SEQ ID NO: 63329 - protein, 11 aa, Homo Sapiens
APNLGRSFHIL

SEQ ID NO: 63330 - protein, 11 aa, Homo Sapiens
APNPYRSENCL

SEQ ID NO: 63331 - protein, 11 aa, Homo Sapiens
APRAPPGPAGL

SEQ ID NO: 63332 - protein, 11 aa, Homo Sapiens
APREALAQTVL

SEQ ID NO: 63333 - protein, 11 aa, Homo Sapiens
APREGISQEAL

SEQ ID NO: 63334 - protein, 11 aa, Homo Sapiens
APRPASGPIRP

SEQ ID NO: 63335 - protein, 11 aa, Homo Sapiens
APRPDRLVNRL

SEQ ID NO: 63336 - protein, 11 aa, Homo Sapiens
APRPLQAGPAM

SEQ ID NO: 63337 - protein, 11 aa, Homo Sapiens
APRPSTGPHKL

SEQ ID NO: 63338 - protein, 11 aa, Homo Sapiens
APRQPGLMAQM

SEQ ID NO: 63339 - protein, 11 aa, Homo Sapiens
APRSFHPPAAM

SEQ ID NO: 63340 - protein, 11 aa, Homo Sapiens
APRTVALTALL

SEQ ID NO: 63341 - protein, 11 aa, Homo Sapiens
APRWLEEEAAL

SEQ ID NO: 63342 - protein, 11 aa, Homo Sapiens
APSDLRTIQTF

SEQ ID NO: 63343 - protein, 11 aa, Homo Sapiens
APSGLRSQVQF

SEQ ID NO: 63344 - protein, 11 aa, Homo Sapiens
APSHLMALLTL

SEQ ID NO: 63345 - protein, 11 aa, Homo Sapiens
APSLINSSSTL

SEQ ID NO: 63346 - protein, 11 aa, Homo Sapiens
APSPVIPRLTL

SEQ ID NO: 63347 - protein, 11 aa, Homo Sapiens
APSSAAWVQTL

SEQ ID NO: 63348 - protein, 11 aa, Homo Sapiens
APTQEKIFAVL

SEQ ID NO: 63349 - protein, 11 aa, Homo Sapiens
APYGKNQVQAL

SEQ ID NO: 63350 - protein, 11 aa, Homo Sapiens
APYMRSMMQSL

SEQ ID NO: 63351 - protein, 11 aa, Homo Sapiens
AVRDISEASVF

SEQ ID NO: 63352 - protein, 11 aa, Homo Sapiens
FPMGDRLYIGL

SEQ ID NO: 63353 - protein, 11 aa, Homo Sapiens
FPRAPSTSDSV

SEQ ID NO: 63354 - protein, 11 aa, Homo Sapiens
FPRSPGQPSSL

SEQ ID NO: 63355 - protein, 11 aa, Homo Sapiens
GPDEAKIKALL

SEQ ID NO: 63356 - protein, 11 aa, Homo Sapiens
GPGLSRTGVEL

SEQ ID NO: 63357 - protein, 11 aa, Homo Sapiens
GPNPKSSRTTL

SEQ ID NO: 63358 - protein, 11 aa, Homo Sapiens
GPRFTLKLRSL

SEQ ID NO: 63359 - protein, 11 aa, Homo Sapiens
HESEQLGSISV

SEQ ID NO: 63360 - protein, 11 aa, Homo Sapiens
HPIQVQPGRIL

SEQ ID NO: 63361 - protein, 11 aa, Homo Sapiens
HPISSEELLSL

SEQ ID NO: 63362 - protein, 11 aa, Homo Sapiens
HPRDPNLLLSV

SEQ ID NO: 63363 - protein, 11 aa, Homo Sapiens
HPYPPGPGVAL

SEQ ID NO: 63364 - protein, 11 aa, Homo Sapiens
INAKSRAEAAL

SEQ ID NO: 63365 - protein, 11 aa, Homo Sapiens
IPMGQAVNSQL

SEQ ID NO: 63366 - protein, 11 aa, Homo Sapiens
IPQGGRGAIQF

SEQ ID NO: 63367 - protein, 11 aa, Homo Sapiens
IPRLPERMTTL

SEQ ID NO: 63368 - protein, 11 aa, Homo Sapiens
IPRRPGALDGL

SEQ ID NO: 63369 - protein, 11 aa, Homo Sapiens
IPRRQEHDISL

SEQ ID NO: 63370 - protein, 11 aa, Homo Sapiens
IPRTPLSPSPM

SEQ ID NO: 63371 - protein, 11 aa, Homo Sapiens
IPYHSEVPVSL

SEQ ID NO: 63372 - protein, 11 aa, Homo Sapiens
KPAGPPGILAL

SEQ ID NO: 63373 - protein, 11 aa, Homo Sapiens
KPFEQVKGITL

SEQ ID NO: 63374 - protein, 11 aa, Homo Sapiens
KPIAVGSMSML

SEQ ID NO: 63375 - protein, 11 aa, Homo Sapiens
KPNANRIALDF

SEQ ID NO: 63376 - protein, 11 aa, Homo Sapiens
KPNDVSVFTTL

SEQ ID NO: 63377 - protein, 11 aa, Homo Sapiens
KPNEFASQINL

SEQ ID NO: 63378 - protein, 11 aa, Homo Sapiens
KPQDYKKRLSV

SEQ ID NO: 63379 - protein, 11 aa, Homo Sapiens
KPVNPSPLSQL

SEQ ID NO: 63380 - protein, 11 aa, Homo Sapiens
KPYQGVGSSSM

SEQ ID NO: 63381 - protein, 11 aa, Homo Sapiens
LPDLQRSKQAL

SEQ ID NO: 63382 - protein, 11 aa, Homo Sapiens
LPDSGHLHPLL

SEQ ID NO: 63383 - protein, 11 aa, Homo Sapiens
LPHGGEGWQQL

SEQ ID NO: 63384 - protein, 11 aa, Homo Sapiens
LPMGALPQGPM

SEQ ID NO: 63385 - protein, 11 aa, Homo Sapiens
LPRSIGNLTQL

SEQ ID NO: 63386 - protein, 11 aa, Homo Sapiens
LPRTIFPTSTI

SEQ ID NO: 63387 - protein, 11 aa, Homo Sapiens
LPRYLMGETQL

SEQ ID NO: 63388 - protein, 11 aa, Homo Sapiens
LPSGDRVAVSV

SEQ ID NO: 63389 - protein, 11 aa, Homo Sapiens
MPAFSKIGGIL

SEQ ID NO: 63390 - protein, 11 aa, Homo Sapiens
MPDSLRSGEYL

SEQ ID NO: 63391 - protein, 11 aa, Homo Sapiens
MPDVGRSMQQL

SEQ ID NO: 63392 - protein, 11 aa, Homo Sapiens
MPFPNIRSAEL

SEQ ID NO: 63393 - protein, 11 aa, Homo Sapiens
MPRPDTCPPEL

SEQ ID NO: 63394 - protein, 11 aa, Homo Sapiens
MPRTGNGPMSV

SEQ ID NO: 63395 - protein, 11 aa, Homo Sapiens
MPSSHRILHKL

SEQ ID NO: 63396 - protein, 11 aa, Homo Sapiens
NPRQPLPASGL

SEQ ID NO: 63397 - protein, 11 aa, Homo Sapiens
NVSRAKAVRAL

SEQ ID NO: 63398 - protein, 11 aa, Homo Sapiens
QPIDNVSRNLL

SEQ ID NO: 63399 - protein, 11 aa, Homo Sapiens
QPSPARAPAEL

SEQ ID NO: 63400 - protein, 11 aa, Homo Sapiens
RPAALRGALLG

SEQ ID NO: 63401 - protein, 11 aa, Homo Sapiens
RPADPEKNQSL

SEQ ID NO: 63402 - protein, 11 aa, Homo Sapiens
RPDDRSQGAII

SEQ ID NO: 63403 - protein, 11 aa, Homo Sapiens
RPDVGRYLREL

SEQ ID NO: 63404 - protein, 11 aa, Homo Sapiens
RPEDRMFHIRA

SEQ ID NO: 63405 - protein, 11 aa, Homo Sapiens
RPFGSISRIYL

SEQ ID NO: 63406 - protein, 11 aa, Homo Sapiens
RPKAKGGLASL

SEQ ID NO: 63407 - protein, 11 aa, Homo Sapiens
RPLEMIEPRTL

SEQ ID NO: 63408 - protein, 11 aa, Homo Sapiens
RPNDSRMLVAL

SEQ ID NO: 63409 - protein, 11 aa, Homo Sapiens
RPNVQAISSRL

SEQ ID NO: 63410 - protein, 11 aa, Homo Sapiens
RPPNYSGTIAL

SEQ ID NO: 63411 - protein, 11 aa, Homo Sapiens
RPPPPGMRGLL

SEQ ID NO: 63412 - protein, 11 aa, Homo Sapiens
RPQCPVGFNTL

SEQ ID NO: 63413 - protein, 11 aa, Homo Sapiens
RPRPGNILLQL

SEQ ID NO: 63414 - protein, 11 aa, Homo Sapiens
RPRPTEATVSL

SEQ ID NO: 63415 - protein, 11 aa, Homo Sapiens
RPRTEVSLSAF

SEQ ID NO: 63416 - protein, 11 aa, Homo Sapiens
RPRTPPEAIAL

SEQ ID NO: 63417 - protein, 11 aa, Homo Sapiens
RPSGLHGDVSL

SEQ ID NO: 63418 - protein, 11 aa, Homo Sapiens
RPTGSQGLSSL

SEQ ID NO: 63419 - protein, 11 aa, Homo Sapiens
RPYAPINANAI

SEQ ID NO: 63420 - protein, 11 aa, Homo Sapiens
SASVQRADTSL

SEQ ID NO: 63421 - protein, 11 aa, Homo Sapiens
SGPSIVHRKCF

SEQ ID NO: 63422 - protein, 11 aa, Homo Sapiens
SPAAKSPSAQL

SEQ ID NO: 63423 - protein, 11 aa, Homo Sapiens
SPAGPGRAASL

SEQ ID NO: 63424 - protein, 11 aa, Homo Sapiens
SPALNKMFCQL

SEQ ID NO: 63425 - protein, 11 aa, Homo Sapiens
SPALYRNVNTL

SEQ ID NO: 63426 - protein, 11 aa, Homo Sapiens
SPANPAHILSL

SEQ ID NO: 63427 - protein, 11 aa, Homo Sapiens
SPASKAARESL

SEQ ID NO: 63428 - protein, 11 aa, Homo Sapiens
SPAVERLISSL

SEQ ID NO: 63429 - protein, 11 aa, Homo Sapiens
SPDLGKNLQTL

SEQ ID NO: 63430 - protein, 11 aa, Homo Sapiens
SPDPHKGLVLL

SEQ ID NO: 63431 - protein, 11 aa, Homo Sapiens
SPFLPGFSQSL

SEQ ID NO: 63432 - protein, 11 aa, Homo Sapiens
SPFSFHHVLSL

SEQ ID NO: 63433 - protein, 11 aa, Homo Sapiens
SPMMPRITSVF

SEQ ID NO: 63434 - protein, 11 aa, Homo Sapiens
SPMSADRVVAF

SEQ ID NO: 63435 - protein, 11 aa, Homo Sapiens
SPMSDVVSREL

SEQ ID NO: 63436 - protein, 11 aa, Homo Sapiens
SPNQARAQAAL

SEQ ID NO: 63437 - protein, 11 aa, Homo Sapiens
SPNQKLLAVSL

SEQ ID NO: 63438 - protein, 11 aa, Homo Sapiens
SPQLGRAVQLL

SEQ ID NO: 63439 - protein, 11 aa, Homo Sapiens
SPRPDRALVQL

SEQ ID NO: 63440 - protein, 11 aa, Homo Sapiens
SPRTAVAPSAV

SEQ ID NO: 63441 - protein, 11 aa, Homo Sapiens
SPSAAHFITRL

SEQ ID NO: 63442 - protein, 11 aa, Homo Sapiens
SPSPINSSQAL

SEQ ID NO: 63443 - protein, 11 aa, Homo Sapiens
SPSPLRAGVDI

SEQ ID NO: 63444 - protein, 11 aa, Homo Sapiens
SPSTNRGPIQM

SEQ ID NO: 63445 - protein, 11 aa, Homo Sapiens
SPTDPFNRQTL

SEQ ID NO: 63446 - protein, 11 aa, Homo Sapiens
SPTDRSMSSSL

SEQ ID NO: 63447 - protein, 11 aa, Homo Sapiens
SPVDPGARQAL

SEQ ID NO: 63448 - protein, 11 aa, Homo Sapiens
SPYGSDRLVQL

SEQ ID NO: 63449 - protein, 11 aa, Homo Sapiens
SPYLPRGDPVL

SEQ ID NO: 63450 - protein, 11 aa, Homo Sapiens
SVDGTRTNVYL

SEQ ID NO: 63451 - protein, 11 aa, Homo Sapiens
TICLAHALTVL

SEQ ID NO: 63452 - protein, 11 aa, Homo Sapiens
TPDTGRILSKL

SEQ ID NO: 63453 - protein, 11 aa, Homo Sapiens
TPDTNHTPVAL

SEQ ID NO: 63454 - protein, 11 aa, Homo Sapiens
TPMPKDVRQSL

SEQ ID NO: 63455 - protein, 11 aa, Homo Sapiens
TPRDLAVPAAL

SEQ ID NO: 63456 - protein, 11 aa, Homo Sapiens
TPRDQQGPGTL

SEQ ID NO: 63457 - protein, 11 aa, Homo Sapiens
TPRGTTKVVSI

SEQ ID NO: 63458 - protein, 11 aa, Homo Sapiens
TPRPGSAESAL

SEQ ID NO: 63459 - protein, 11 aa, Homo Sapiens
TPSLVKSTSQL

SEQ ID NO: 63460 - protein, 11 aa, Homo Sapiens
TVMGAEIRHVL

SEQ ID NO: 63461 - protein, 11 aa, Homo Sapiens
VPDAKKACTYI

SEQ ID NO: 63462 - protein, 11 aa, Homo Sapiens
VPDDDRSLINL

SEQ ID NO: 63463 - protein, 11 aa, Homo Sapiens
VPDSSGPERIL

SEQ ID NO: 63464 - protein, 11 aa, Homo Sapiens
VPDTSRIYVAL

SEQ ID NO: 63465 - protein, 11 aa, Homo Sapiens
VPHPNWPNHTL

SEQ ID NO: 63466 - protein, 11 aa, Homo Sapiens
VPKTTGEGTSL

SEQ ID NO: 63467 - protein, 11 aa, Homo Sapiens
VPNAGRGLVRL

SEQ ID NO: 63468 - protein, 11 aa, Homo Sapiens
VPRASVPDGFL

SEQ ID NO: 63469 - protein, 11 aa, Homo Sapiens
VPRNPTIGDKF

SEQ ID NO: 63470 - protein, 11 aa, Homo Sapiens
VPRPVLRALSF

SEQ ID NO: 63471 - protein, 11 aa, Homo Sapiens
VPRSPFKVKVL

SEQ ID NO: 63472 - protein, 11 aa, Homo Sapiens
YPMDLGGRNFL

SEQ ID NO: 63473 - protein, 11 aa, Homo Sapiens
YPVPASKRPPL

SEQ ID NO: 63474 - protein, 8 aa, Homo Sapiens
APATRAAL

SEQ ID NO: 63475 - protein, 8 aa, Homo Sapiens
APHLLRLF

SEQ ID NO: 63476 - protein, 8 aa, Homo Sapiens
APILKRAL

SEQ ID NO: 63477 - protein, 8 aa, Homo Sapiens
APLALHLL

SEQ ID NO: 63478 - protein, 8 aa, Homo Sapiens
APLLRWVL

SEQ ID NO: 63479 - protein, 8 aa, Homo Sapiens
APQNKPEL

SEQ ID NO: 63480 - protein, 8 aa, Homo Sapiens
APVQRPKL

SEQ ID NO: 63481 - protein, 8 aa, Homo Sapiens
APYNKPSL

SEQ ID NO: 63482 - protein, 8 aa, Homo Sapiens
FPHPPKRL

SEQ ID NO: 63483 - protein, 8 aa, Homo Sapiens
FPKEPVEL

SEQ ID NO: 63484 - protein, 8 aa, Homo Sapiens
GPIKKPVL

SEQ ID NO: 63485 - protein, 8 aa, Homo Sapiens
GVKKPTKA

SEQ ID NO: 63486 - protein, 8 aa, Homo Sapiens
HPKAKLVL

SEQ ID NO: 63487 - protein, 8 aa, Homo Sapiens
HPKYKTEL

SEQ ID NO: 63488 - protein, 8 aa, Homo Sapiens
HPRSPNVL

SEQ ID NO: 63489 - protein, 8 aa, Homo Sapiens
KPISPKLL

SEQ ID NO: 63490 - protein, 8 aa, Homo Sapiens
KPKIPKGV

SEQ ID NO: 63491 - protein, 8 aa, Homo Sapiens
KPVNRISL

SEQ ID NO: 63492 - protein, 8 aa, Homo Sapiens
KPYIRTSL

SEQ ID NO: 63493 - protein, 8 aa, Homo Sapiens
LNPNAKEF

SEQ ID NO: 63494 - protein, 8 aa, Homo Sapiens
LPHLRNKL

SEQ ID NO: 63495 - protein, 8 aa, Homo Sapiens
LPHLTRRL

SEQ ID NO: 63496 - protein, 8 aa, Homo Sapiens
LPKKPVGL

SEQ ID NO: 63497 - protein, 8 aa, Homo Sapiens
LPQRKPSL

SEQ ID NO: 63498 - protein, 8 aa, Homo Sapiens
LPRKFPSL

SEQ ID NO: 63499 - protein, 8 aa, Homo Sapiens
LPWYPKVL

SEQ ID NO: 63500 - protein, 8 aa, Homo Sapiens
MPKMGKTI

SEQ ID NO: 63501 - protein, 8 aa, Homo Sapiens
MPRNGSRL

SEQ ID NO: 63502 - protein, 8 aa, Homo Sapiens
NPKKPLTL

SEQ ID NO: 63503 - protein, 8 aa, Homo Sapiens
PASKRPPL

SEQ ID NO: 63504 - protein, 8 aa, Homo Sapiens
PKAHIRKL

SEQ ID NO: 63505 - protein, 8 aa, Homo Sapiens
PKPKAKTL

SEQ ID NO: 63506 - protein, 8 aa, Homo Sapiens
PKPQGTKI

SEQ ID NO: 63507 - protein, 8 aa, Homo Sapiens
PLSKIKTL

SEQ ID NO: 63508 - protein, 8 aa, Homo Sapiens
PQSNRPVM

SEQ ID NO: 63509 - protein, 8 aa, Homo Sapiens
PRPPPKPM

SEQ ID NO: 63510 - protein, 8 aa, Homo Sapiens
PRSPPRAL

SEQ ID NO: 63511 - protein, 8 aa, Homo Sapiens
PSGSKKVI

SEQ ID NO: 63512 - protein, 8 aa, Homo Sapiens
PYSRPKQL

SEQ ID NO: 63513 - protein, 8 aa, Homo Sapiens
QAPKPRKQ

SEQ ID NO: 63514 - protein, 8 aa, Homo Sapiens
QLMKPKKT

SEQ ID NO: 63515 - protein, 8 aa, Homo Sapiens
QPKQPLRL

SEQ ID NO: 63516 - protein, 8 aa, Homo Sapiens
RLIKPKVM

SEQ ID NO: 63517 - protein, 8 aa, Homo Sapiens
RPFLLRRI

SEQ ID NO: 63518 - protein, 8 aa, Homo Sapiens
RPHLAKVL

SEQ ID NO: 63519 - protein, 8 aa, Homo Sapiens
RPKVLMRL

SEQ ID NO: 63520 - protein, 8 aa, Homo Sapiens
RPNTPKTL

SEQ ID NO: 63521 - protein, 8 aa, Homo Sapiens
RPRKAFLL

SEQ ID NO: 63522 - protein, 8 aa, Homo Sapiens
RPRPGTGL

SEQ ID NO: 63523 - protein, 8 aa, Homo Sapiens
RPRPPRQL

SEQ ID NO: 63524 - protein, 8 aa, Homo Sapiens
RPSERPSL

SEQ ID NO: 63525 - protein, 8 aa, Homo Sapiens
RPTCKAVL

SEQ ID NO: 63526 - protein, 8 aa, Homo Sapiens
RPTPKNSL

SEQ ID NO: 63527 - protein, 8 aa, Homo Sapiens
RPVKKPKI

SEQ ID NO: 63528 - protein, 8 aa, Homo Sapiens
RPYAKHWL

SEQ ID NO: 63529 - protein, 8 aa, Homo Sapiens
SFSKAFGQ

SEQ ID NO: 63530 - protein, 8 aa, Homo Sapiens
SPAKLHEL

SEQ ID NO: 63531 - protein, 8 aa, Homo Sapiens
SPAKPKAV

SEQ ID NO: 63532 - protein, 8 aa, Homo Sapiens
SPAKRPRL

SEQ ID NO: 63533 - protein, 8 aa, Homo Sapiens
SPAVLRPI

SEQ ID NO: 63534 - protein, 8 aa, Homo Sapiens
SPGPRPVL

SEQ ID NO: 63535 - protein, 8 aa, Homo Sapiens
SPGQRAVL

SEQ ID NO: 63536 - protein, 8 aa, Homo Sapiens
SPIIRPLL

SEQ ID NO: 63537 - protein, 8 aa, Homo Sapiens
SPKFGKLV

SEQ ID NO: 63538 - protein, 8 aa, Homo Sapiens
SPKLLHKF

SEQ ID NO: 63539 - protein, 8 aa, Homo Sapiens
SPKVKMAL

SEQ ID NO: 63540 - protein, 8 aa, Homo Sapiens
SPKVPRTL

SEQ ID NO: 63541 - protein, 8 aa, Homo Sapiens
SPNVPKSL

SEQ ID NO: 63542 - protein, 8 aa, Homo Sapiens
SPRKGWSF

SEQ ID NO: 63543 - protein, 8 aa, Homo Sapiens
SPTFLALR

SEQ ID NO: 63544 - protein, 8 aa, Homo Sapiens
SPTIGKQL

SEQ ID NO: 63545 - protein, 8 aa, Homo Sapiens
SPVKKPSL

SEQ ID NO: 63546 - protein, 8 aa, Homo Sapiens
SPYIRTKL

SEQ ID NO: 63547 - protein, 8 aa, Homo Sapiens
SVKRPKLL

SEQ ID NO: 63548 - protein, 8 aa, Homo Sapiens
TPFIRPVM

SEQ ID NO: 63549 - protein, 8 aa, Homo Sapiens
TPFKGGTL

SEQ ID NO: 63550 - protein, 8 aa, Homo Sapiens
TPRPGQEL

SEQ ID NO: 63551 - protein, 8 aa, Homo Sapiens
VKPKPRAL

SEQ ID NO: 63552 - protein, 8 aa, Homo Sapiens
VLENVKEM

SEQ ID NO: 63553 - protein, 8 aa, Homo Sapiens
VPKTHLEL

SEQ ID NO: 63554 - protein, 9 aa, Homo Sapiens
AAKRSGLAV

SEQ ID NO: 63555 - protein, 9 aa, Homo Sapiens
AAMNGRKIL

SEQ ID NO: 63556 - protein, 9 aa, Homo Sapiens
AARAPRKVL

SEQ ID NO: 63557 - protein, 9 aa, Homo Sapiens
AARPATSTL

SEQ ID NO: 63558 - protein, 9 aa, Homo Sapiens
AAVRKPIVL

SEQ ID NO: 63559 - protein, 9 aa, Homo Sapiens
AAWRRRNTL

SEQ ID NO: 63560 - protein, 9 aa, Homo Sapiens
AICPHRPVL

SEQ ID NO: 63561 - protein, 9 aa, Homo Sapiens
AIKNVNTAL

SEQ ID NO: 63562 - protein, 9 aa, Homo Sapiens
ALKRQGRTL

SEQ ID NO: 63563 - protein, 9 aa, Homo Sapiens
APAAAGAAL

SEQ ID NO: 63564 - protein, 9 aa, Homo Sapiens
APAAGSKVL

SEQ ID NO: 63565 - protein, 9 aa, Homo Sapiens
APAAPGLSL

SEQ ID NO: 63566 - protein, 9 aa, Homo Sapiens
APAGRKVGL

SEQ ID NO: 63567 - protein, 9 aa, Homo Sapiens
APALVSKKL

SEQ ID NO: 63568 - protein, 9 aa, Homo Sapiens
APAPPKAEA

SEQ ID NO: 63569 - protein, 9 aa, Homo Sapiens
APAPPSKVI

SEQ ID NO: 63570 - protein, 9 aa, Homo Sapiens
APAPTAVVL

SEQ ID NO: 63571 - protein, 9 aa, Homo Sapiens
APAPVQPPM

SEQ ID NO: 63572 - protein, 9 aa, Homo Sapiens
APASFGKSF

SEQ ID NO: 63573 - protein, 9 aa, Homo Sapiens
APCKQRISV

SEQ ID NO: 63574 - protein, 9 aa, Homo Sapiens
APDCHGPVL

SEQ ID NO: 63575 - protein, 9 aa, Homo Sapiens
APDSQRLKL

SEQ ID NO: 63576 - protein, 9 aa, Homo Sapiens
APEDKKEIL

SEQ ID NO: 63577 - protein, 9 aa, Homo Sapiens
APELPIKIL

SEQ ID NO: 63578 - protein, 9 aa, Homo Sapiens
APELQRHEL

SEQ ID NO: 63579 - protein, 9 aa, Homo Sapiens
APFLRNVEL

SEQ ID NO: 63580 - protein, 9 aa, Homo Sapiens
APGPGRKEL

SEQ ID NO: 63581 - protein, 9 aa, Homo Sapiens
APGSARRPL

SEQ ID NO: 63582 - protein, 9 aa, Homo Sapiens
APHDYGLIL

SEQ ID NO: 63583 - protein, 9 aa, Homo Sapiens
APHEPVKTL

SEQ ID NO: 63584 - protein, 9 aa, Homo Sapiens
APHLVGPHL

SEQ ID NO: 63585 - protein, 9 aa, Homo Sapiens
APHRGRPSL

SEQ ID NO: 63586 - protein, 9 aa, Homo Sapiens
APHWKRHQL

SEQ ID NO: 63587 - protein, 9 aa, Homo Sapiens
APHWRMKQL

SEQ ID NO: 63588 - protein, 9 aa, Homo Sapiens
APIAKVGVL

SEQ ID NO: 63589 - protein, 9 aa, Homo Sapiens
APIERVKLL

SEQ ID NO: 63590 - protein, 9 aa, Homo Sapiens
APKAGPGVV

SEQ ID NO: 63591 - protein, 9 aa, Homo Sapiens
APKEAPKKL

SEQ ID NO: 63592 - protein, 9 aa, Homo Sapiens
APKGSLKDI

SEQ ID NO: 63593 - protein, 9 aa, Homo Sapiens
APKKLIRYI

SEQ ID NO: 63594 - protein, 9 aa, Homo Sapiens
APKPDKKIV

SEQ ID NO: 63595 - protein, 9 aa, Homo Sapiens
APKPKWTQL

SEQ ID NO: 63596 - protein, 9 aa, Homo Sapiens
APKPLHKVV

SEQ ID NO: 63597 - protein, 9 aa, Homo Sapiens
APKPPFQSH

SEQ ID NO: 63598 - protein, 9 aa, Homo Sapiens
APKPQGTKI

SEQ ID NO: 63599 - protein, 9 aa, Homo Sapiens
APKPRLNQL

SEQ ID NO: 63600 - protein, 9 aa, Homo Sapiens
APKPTLLWL

SEQ ID NO: 63601 - protein, 9 aa, Homo Sapiens
APKRPPSAF

SEQ ID NO: 63602 - protein, 9 aa, Homo Sapiens
APKRPPSGF

SEQ ID NO: 63603 - protein, 9 aa, Homo Sapiens
APKSMQSAI

SEQ ID NO: 63604 - protein, 9 aa, Homo Sapiens
APKSPSQDV

SEQ ID NO: 63605 - protein, 9 aa, Homo Sapiens
APKSSKTEL

SEQ ID NO: 63606 - protein, 9 aa, Homo Sapiens
APKSTKPSL

SEQ ID NO: 63607 - protein, 9 aa, Homo Sapiens
APKSVLGKV

SEQ ID NO: 63608 - protein, 9 aa, Homo Sapiens
APKYILEQF

SEQ ID NO: 63609 - protein, 9 aa, Homo Sapiens
APLPSIKEI

SEQ ID NO: 63610 - protein, 9 aa, Homo Sapiens
APLQHRHVL

SEQ ID NO: 63611 - protein, 9 aa, Homo Sapiens
APLQRSQSL

SEQ ID NO: 63612 - protein, 9 aa, Homo Sapiens
APLSGSKEM

SEQ ID NO: 63613 - protein, 9 aa, Homo Sapiens
APMIKKIAF

SEQ ID NO: 63614 - protein, 9 aa, Homo Sapiens
APMKAPKRM

SEQ ID NO: 63615 - protein, 9 aa, Homo Sapiens
APMNVRRGL

SEQ ID NO: 63616 - protein, 9 aa, Homo Sapiens
APMTKIKKL

SEQ ID NO: 63617 - protein, 9 aa, Homo Sapiens
APNAGKSTL

SEQ ID NO: 63618 - protein, 9 aa, Homo Sapiens
APNEKMKQV

SEQ ID NO: 63619 - protein, 9 aa, Homo Sapiens
APNSRPALL

SEQ ID NO: 63620 - protein, 9 aa, Homo Sapiens
APNYRLKSL

SEQ ID NO: 63621 - protein, 9 aa, Homo Sapiens
APQPAKPRL

SEQ ID NO: 63622 - protein, 9 aa, Homo Sapiens
APQRVRVTL

SEQ ID NO: 63623 - protein, 9 aa, Homo Sapiens
APQSFRAEL

SEQ ID NO: 63624 - protein, 9 aa, Homo Sapiens
APQSNKERL

SEQ ID NO: 63625 - protein, 9 aa, Homo Sapiens
APRAALTRL

SEQ ID NO: 63626 - protein, 9 aa, Homo Sapiens
APRAAREAL

SEQ ID NO: 63627 - protein, 9 aa, Homo Sapiens
APRDGRVVF

SEQ ID NO: 63628 - protein, 9 aa, Homo Sapiens
APRDSLRSL

SEQ ID NO: 63629 - protein, 9 aa, Homo Sapiens
APRDTAKAF

SEQ ID NO: 63630 - protein, 9 aa, Homo Sapiens
APRGDKEEL

SEQ ID NO: 63631 - protein, 9 aa, Homo Sapiens
APRGPGAEL

SEQ ID NO: 63632 - protein, 9 aa, Homo Sapiens
APRHGLQSL

SEQ ID NO: 63633 - protein, 9 aa, Homo Sapiens
APRIALHTA

SEQ ID NO: 63634 - protein, 9 aa, Homo Sapiens
APRIESKSM

SEQ ID NO: 63635 - protein, 9 aa, Homo Sapiens
APRKPDWDL

SEQ ID NO: 63636 - protein, 9 aa, Homo Sapiens
APRLETKSL

SEQ ID NO: 63637 - protein, 9 aa, Homo Sapiens
APRLPITGL

SEQ ID NO: 63638 - protein, 9 aa, Homo Sapiens
APRPAGSYL

SEQ ID NO: 63639 - protein, 9 aa, Homo Sapiens
APRPGPRAV

SEQ ID NO: 63640 - protein, 9 aa, Homo Sapiens
APRPPPARL

SEQ ID NO: 63641 - protein, 9 aa, Homo Sapiens
APRPPPKPM

SEQ ID NO: 63642 - protein, 9 aa, Homo Sapiens
APRPPVSAA

SEQ ID NO: 63643 - protein, 9 aa, Homo Sapiens
APRPRLLLL

SEQ ID NO: 63644 - protein, 9 aa, Homo Sapiens
APRPYSKQV

SEQ ID NO: 63645 - protein, 9 aa, Homo Sapiens
APRQPGLMA

SEQ ID NO: 63646 - protein, 9 aa, Homo Sapiens
APRQTHKVI

SEQ ID NO: 63647 - protein, 9 aa, Homo Sapiens
APRSPGQVT

SEQ ID NO: 63648 - protein, 9 aa, Homo Sapiens
APRTFSNSL

SEQ ID NO: 63649 - protein, 9 aa, Homo Sapiens
APRTPTHRL

SEQ ID NO: 63650 - protein, 9 aa, Homo Sapiens
APRTVALTA

SEQ ID NO: 63651 - protein, 9 aa, Homo Sapiens
APRVKEGPL

SEQ ID NO: 63652 - protein, 9 aa, Homo Sapiens
APRVPVQAL

SEQ ID NO: 63653 - protein, 9 aa, Homo Sapiens
APRYSAPVI

SEQ ID NO: 63654 - protein, 9 aa, Homo Sapiens
APSKHVHPL

SEQ ID NO: 63655 - protein, 9 aa, Homo Sapiens
APSNRVKGI

SEQ ID NO: 63656 - protein, 9 aa, Homo Sapiens
APSPRPLSL

SEQ ID NO: 63657 - protein, 9 aa, Homo Sapiens
APSRNGMVL

SEQ ID NO: 63658 - protein, 9 aa, Homo Sapiens
APSSPRPAL

SEQ ID NO: 63659 - protein, 9 aa, Homo Sapiens
APTGAKRTL

SEQ ID NO: 63660 - protein, 9 aa, Homo Sapiens
APTGHLHTV

SEQ ID NO: 63661 - protein, 9 aa, Homo Sapiens
APTGSGKTI

SEQ ID NO: 63662 - protein, 9 aa, Homo Sapiens
APTPARPVL

SEQ ID NO: 63663 - protein, 9 aa, Homo Sapiens
APTSAGKTL

SEQ ID NO: 63664 - protein, 9 aa, Homo Sapiens
APTTKIKKL

SEQ ID NO: 63665 - protein, 9 aa, Homo Sapiens
APTVRSKAL

SEQ ID NO: 63666 - protein, 9 aa, Homo Sapiens
APVCSSKTL

SEQ ID NO: 63667 - protein, 9 aa, Homo Sapiens
APVGIRHRL

SEQ ID NO: 63668 - protein, 9 aa, Homo Sapiens
APVGSGSAL

SEQ ID NO: 63669 - protein, 9 aa, Homo Sapiens
APVSSKSSL

SEQ ID NO: 63670 - protein, 9 aa, Homo Sapiens
APWDRVVDL

SEQ ID NO: 63671 - protein, 9 aa, Homo Sapiens
APWEKRVDL

SEQ ID NO: 63672 - protein, 9 aa, Homo Sapiens
APWKERVEL

SEQ ID NO: 63673 - protein, 9 aa, Homo Sapiens
APYFRLLRL

SEQ ID NO: 63674 - protein, 9 aa, Homo Sapiens
APYGGPIAL

SEQ ID NO: 63675 - protein, 9 aa, Homo Sapiens
APYGNPKNM

SEQ ID NO: 63676 - protein, 9 aa, Homo Sapiens
APYSRPKQL

SEQ ID NO: 63677 - protein, 9 aa, Homo Sapiens
AVKQRGISL

SEQ ID NO: 63678 - protein, 9 aa, Homo Sapiens
AVLPVVKVL

SEQ ID NO: 63679 - protein, 9 aa, Homo Sapiens
AVNQNTKLL

SEQ ID NO: 63680 - protein, 9 aa, Homo Sapiens
AVRAGRLQL

SEQ ID NO: 63681 - protein, 9 aa, Homo Sapiens
AVWDRMKVA

SEQ ID NO: 63682 - protein, 9 aa, Homo Sapiens
DAIKLNPRL

SEQ ID NO: 63683 - protein, 9 aa, Homo Sapiens
EPCGLRGAL

SEQ ID NO: 63684 - protein, 9 aa, Homo Sapiens
EPCNGRTAL

SEQ ID NO: 63685 - protein, 9 aa, Homo Sapiens
EPRPPHGEL

SEQ ID NO: 63686 - protein, 9 aa, Homo Sapiens
EPRYPPHSL

SEQ ID NO: 63687 - protein, 9 aa, Homo Sapiens
EVKRPGESL

SEQ ID NO: 63688 - protein, 9 aa, Homo Sapiens
FAKVPLKCL

SEQ ID NO: 63689 - protein, 9 aa, Homo Sapiens
FPAPDRKKL

SEQ ID NO: 63690 - protein, 9 aa, Homo Sapiens
FPELPKSAL

SEQ ID NO: 63691 - protein, 9 aa, Homo Sapiens
FPEPSRPPL

SEQ ID NO: 63692 - protein, 9 aa, Homo Sapiens
FPHKRLQQL

SEQ ID NO: 63693 - protein, 9 aa, Homo Sapiens
FPKAAIKRL

SEQ ID NO: 63694 - protein, 9 aa, Homo Sapiens
FPKGFSVEL

SEQ ID NO: 63695 - protein, 9 aa, Homo Sapiens
FPKGSRSVV

SEQ ID NO: 63696 - protein, 9 aa, Homo Sapiens
FPKWKPGSL

SEQ ID NO: 63697 - protein, 9 aa, Homo Sapiens
FPNIPGKSL

SEQ ID NO: 63698 - protein, 9 aa, Homo Sapiens
FPQVGRTAL

SEQ ID NO: 63699 - protein, 9 aa, Homo Sapiens
FPRAFPKKL

SEQ ID NO: 63700 - protein, 9 aa, Homo Sapiens
FPREPRPKL

SEQ ID NO: 63701 - protein, 9 aa, Homo Sapiens
FPRFPHRGL

SEQ ID NO: 63702 - protein, 9 aa, Homo Sapiens
FPRKPSAPK

SEQ ID NO: 63703 - protein, 9 aa, Homo Sapiens
FPSNFIKEL

SEQ ID NO: 63704 - protein, 9 aa, Homo Sapiens
FPWEVPKKL

SEQ ID NO: 63705 - protein, 9 aa, Homo Sapiens
FSNGHIKVL

SEQ ID NO: 63706 - protein, 9 aa, Homo Sapiens
GAKPAGSGL

SEQ ID NO: 63707 - protein, 9 aa, Homo Sapiens
GAKPAPRAL

SEQ ID NO: 63708 - protein, 9 aa, Homo Sapiens
GAMAVRRVL

SEQ ID NO: 63709 - protein, 9 aa, Homo Sapiens
GAQGGRPSL

SEQ ID NO: 63710 - protein, 9 aa, Homo Sapiens
GIKRHVKAL

SEQ ID NO: 63711 - protein, 9 aa, Homo Sapiens
GPAPSRPAL

SEQ ID NO: 63712 - protein, 9 aa, Homo Sapiens
GPHQRHIAL

SEQ ID NO: 63713 - protein, 9 aa, Homo Sapiens
GPITKPKKV

SEQ ID NO: 63714 - protein, 9 aa, Homo Sapiens
GPIYPGHGM

SEQ ID NO: 63715 - protein, 9 aa, Homo Sapiens
GPKAHIRKL

SEQ ID NO: 63716 - protein, 9 aa, Homo Sapiens
GPKGHVSSL

SEQ ID NO: 63717 - protein, 9 aa, Homo Sapiens
GPKGTMKML

SEQ ID NO: 63718 - protein, 9 aa, Homo Sapiens
GPKLASRIL

SEQ ID NO: 63719 - protein, 9 aa, Homo Sapiens
GPKPKAHQF

SEQ ID NO: 63720 - protein, 9 aa, Homo Sapiens
GPKPKPLVV

SEQ ID NO: 63721 - protein, 9 aa, Homo Sapiens
GPKPKTFLL

SEQ ID NO: 63722 - protein, 9 aa, Homo Sapiens
GPKPLFRRM

SEQ ID NO: 63723 - protein, 9 aa, Homo Sapiens
GPKQQFSTL

SEQ ID NO: 63724 - protein, 9 aa, Homo Sapiens
GPKSKLKLL

SEQ ID NO: 63725 - protein, 9 aa, Homo Sapiens
GPKSKVLIL

SEQ ID NO: 63726 - protein, 9 aa, Homo Sapiens
GPKSMMKML

SEQ ID NO: 63727 - protein, 9 aa, Homo Sapiens
GPLFRNSQL

SEQ ID NO: 63728 - protein, 9 aa, Homo Sapiens
GPMPKPHSV

SEQ ID NO: 63729 - protein, 9 aa, Homo Sapiens
GPNSNIRTV

SEQ ID NO: 63730 - protein, 9 aa, Homo Sapiens
GPQAVRAAL

SEQ ID NO: 63731 - protein, 9 aa, Homo Sapiens
GPQQTQKVF

SEQ ID NO: 63732 - protein, 9 aa, Homo Sapiens
GPRALRLLL

SEQ ID NO: 63733 - protein, 9 aa, Homo Sapiens
GPRAPGPSL

SEQ ID NO: 63734 - protein, 9 aa, Homo Sapiens
GPREAFRQL

SEQ ID NO: 63735 - protein, 9 aa, Homo Sapiens
GPRKGGRVI

SEQ ID NO: 63736 - protein, 9 aa, Homo Sapiens
GPRNAQRVL

SEQ ID NO: 63737 - protein, 9 aa, Homo Sapiens
GPRSSLRVL

SEQ ID NO: 63738 - protein, 9 aa, Homo Sapiens
GPSAVMPAL

SEQ ID NO: 63739 - protein, 9 aa, Homo Sapiens
GPSNVFKIV

SEQ ID NO: 63740 - protein, 9 aa, Homo Sapiens
GPTEGRPQL

SEQ ID NO: 63741 - protein, 9 aa, Homo Sapiens
GPYPQRKVI

SEQ ID NO: 63742 - protein, 9 aa, Homo Sapiens
GVKKPTKAL

SEQ ID NO: 63743 - protein, 9 aa, Homo Sapiens
GVRPPAPSL

SEQ ID NO: 63744 - protein, 9 aa, Homo Sapiens
HAWDHAKSV

SEQ ID NO: 63745 - protein, 9 aa, Homo Sapiens
HIKPGAKVL

SEQ ID NO: 63746 - protein, 9 aa, Homo Sapiens
HPAGPRTVF

SEQ ID NO: 63747 - protein, 9 aa, Homo Sapiens
HPFFKDMSL

SEQ ID NO: 63748 - protein, 9 aa, Homo Sapiens
HPGPVNSEL

SEQ ID NO: 63749 - protein, 9 aa, Homo Sapiens
HPINPRVAL

SEQ ID NO: 63750 - protein, 9 aa, Homo Sapiens
HPIRLGLAL

SEQ ID NO: 63751 - protein, 9 aa, Homo Sapiens
HPIVQPKQL

SEQ ID NO: 63752 - protein, 9 aa, Homo Sapiens
HPIYNIKSL

SEQ ID NO: 63753 - protein, 9 aa, Homo Sapiens
HPKDNLIKL

SEQ ID NO: 63754 - protein, 9 aa, Homo Sapiens
HPKFVGKTL

SEQ ID NO: 63755 - protein, 9 aa, Homo Sapiens
HPKKPGVGV

SEQ ID NO: 63756 - protein, 9 aa, Homo Sapiens
HPKPEGLAA

SEQ ID NO: 63757 - protein, 9 aa, Homo Sapiens
HPKRPLLAF

SEQ ID NO: 63758 - protein, 9 aa, Homo Sapiens
HPKRPMHIL

SEQ ID NO: 63759 - protein, 9 aa, Homo Sapiens
HPKSVIVGL

SEQ ID NO: 63760 - protein, 9 aa, Homo Sapiens
HPKTGRISV

SEQ ID NO: 63761 - protein, 9 aa, Homo Sapiens
HPKVGRVSI

SEQ ID NO: 63762 - protein, 9 aa, Homo Sapiens
HPKVSGHVI

SEQ ID NO: 63763 - protein, 9 aa, Homo Sapiens
HPMPRVNEI

SEQ ID NO: 63764 - protein, 9 aa, Homo Sapiens
HPNFTEKTI

SEQ ID NO: 63765 - protein, 9 aa, Homo Sapiens
HPNGNITEL

SEQ ID NO: 63766 - protein, 9 aa, Homo Sapiens
HPNLHGPEI

SEQ ID NO: 63767 - protein, 9 aa, Homo Sapiens
HPNSLMKKI

SEQ ID NO: 63768 - protein, 9 aa, Homo Sapiens
HPRAYFMQL

SEQ ID NO: 63769 - protein, 9 aa, Homo Sapiens
HPRDFFSRL

SEQ ID NO: 63770 - protein, 9 aa, Homo Sapiens
HPRDPNLLL

SEQ ID NO: 63771 - protein, 9 aa, Homo Sapiens
HPRMPLQRL

SEQ ID NO: 63772 - protein, 9 aa, Homo Sapiens
HPRSPTPTL

SEQ ID NO: 63773 - protein, 9 aa, Homo Sapiens
HPSFQVKEL

SEQ ID NO: 63774 - protein, 9 aa, Homo Sapiens
HPSNVLHFF

SEQ ID NO: 63775 - protein, 9 aa, Homo Sapiens
HPSSYTKVI

SEQ ID NO: 63776 - protein, 9 aa, Homo Sapiens
HPTAAVKML

SEQ ID NO: 63777 - protein, 9 aa, Homo Sapiens
HPTDERVAL

SEQ ID NO: 63778 - protein, 9 aa, Homo Sapiens
HPTFNLKSL

SEQ ID NO: 63779 - protein, 9 aa, Homo Sapiens
HPTSHVSLL

SEQ ID NO: 63780 - protein, 9 aa, Homo Sapiens
HPVNAFKLM

SEQ ID NO: 63781 - protein, 9 aa, Homo Sapiens
HPVSREWTL

SEQ ID NO: 63782 - protein, 9 aa, Homo Sapiens
HVSANLKTL

SEQ ID NO: 63783 - protein, 9 aa, Homo Sapiens
IAMRDRNAL

SEQ ID NO: 63784 - protein, 9 aa, Homo Sapiens
IARLPSSTL

SEQ ID NO: 63785 - protein, 9 aa, Homo Sapiens
IIQKHLKTM

SEQ ID NO: 63786 - protein, 9 aa, Homo Sapiens
IIQKPKISM

SEQ ID NO: 63787 - protein, 9 aa, Homo Sapiens
IIRNVKGPV

SEQ ID NO: 63788 - protein, 9 aa, Homo Sapiens
IPAEGRVAL

SEQ ID NO: 63789 - protein, 9 aa, Homo Sapiens
IPAKLHNSL

SEQ ID NO: 63790 - protein, 9 aa, Homo Sapiens
IPFEKKPAL

SEQ ID NO: 63791 - protein, 9 aa, Homo Sapiens
IPKEHHRFV

SEQ ID NO: 63792 - protein, 9 aa, Homo Sapiens
IPKGKTGVI

SEQ ID NO: 63793 - protein, 9 aa, Homo Sapiens
IPKKEKPEL

SEQ ID NO: 63794 - protein, 9 aa, Homo Sapiens
IPKKHISQI

SEQ ID NO: 63795 - protein, 9 aa, Homo Sapiens
IPKNNPPTL

SEQ ID NO: 63796 - protein, 9 aa, Homo Sapiens
IPKNSPPTL

SEQ ID NO: 63797 - protein, 9 aa, Homo Sapiens
IPKPLNPAL

SEQ ID NO: 63798 - protein, 9 aa, Homo Sapiens
IPKPVHTRF

SEQ ID NO: 63799 - protein, 9 aa, Homo Sapiens
IPKSAIRVI

SEQ ID NO: 63800 - protein, 9 aa, Homo Sapiens
IPKSAVGEL

SEQ ID NO: 63801 - protein, 9 aa, Homo Sapiens
IPKSKFLAL

SEQ ID NO: 63802 - protein, 9 aa, Homo Sapiens
IPKTSGSEM

SEQ ID NO: 63803 - protein, 9 aa, Homo Sapiens
IPLAKRVAL

SEQ ID NO: 63804 - protein, 9 aa, Homo Sapiens
IPLKEKPVL

SEQ ID NO: 63805 - protein, 9 aa, Homo Sapiens
IPLSGRNPL

SEQ ID NO: 63806 - protein, 9 aa, Homo Sapiens
IPLSKIKTL

SEQ ID NO: 63807 - protein, 9 aa, Homo Sapiens
IPMTGKPSL

SEQ ID NO: 63808 - protein, 9 aa, Homo Sapiens
IPNEIIHAL

SEQ ID NO: 63809 - protein, 9 aa, Homo Sapiens
IPNFPRSTV

SEQ ID NO: 63810 - protein, 9 aa, Homo Sapiens
IPNNVKTAV

SEQ ID NO: 63811 - protein, 9 aa, Homo Sapiens
IPNTQIKAL

SEQ ID NO: 63812 - protein, 9 aa, Homo Sapiens
IPQPSGKVL

SEQ ID NO: 63813 - protein, 9 aa, Homo Sapiens
IPRCPKKSF

SEQ ID NO: 63814 - protein, 9 aa, Homo Sapiens
IPRESIKLV

SEQ ID NO: 63815 - protein, 9 aa, Homo Sapiens
IPRNPPPRL

SEQ ID NO: 63816 - protein, 9 aa, Homo Sapiens
IPSSVNKSM

SEQ ID NO: 63817 - protein, 9 aa, Homo Sapiens
IVKGPRGTL

SEQ ID NO: 63818 - protein, 9 aa, Homo Sapiens
IVKPKPRAL

SEQ ID NO: 63819 - protein, 9 aa, Homo Sapiens
KAASVRPVL

SEQ ID NO: 63820 - protein, 9 aa, Homo Sapiens
KAKAPLREL

SEQ ID NO: 63821 - protein, 9 aa, Homo Sapiens
KAKLHIKKL

SEQ ID NO: 63822 - protein, 9 aa, Homo Sapiens
KAKPVTTNL

SEQ ID NO: 63823 - protein, 9 aa, Homo Sapiens
KATQNFKVM

SEQ ID NO: 63824 - protein, 9 aa, Homo Sapiens
KIRDVTKCL

SEQ ID NO: 63825 - protein, 9 aa, Homo Sapiens
KIREFLKKV

SEQ ID NO: 63826 - protein, 9 aa, Homo Sapiens
KLKPNTKIM

SEQ ID NO: 63827 - protein, 9 aa, Homo Sapiens
KLNPYAKTM

SEQ ID NO: 63828 - protein, 9 aa, Homo Sapiens
KPATKTAEL

SEQ ID NO: 63829 - protein, 9 aa, Homo Sapiens
KPEEQRKTL

SEQ ID NO: 63830 - protein, 9 aa, Homo Sapiens
KPFAGRPMI

SEQ ID NO: 63831 - protein, 9 aa, Homo Sapiens
KPGDFIHTL

SEQ ID NO: 63832 - protein, 9 aa, Homo Sapiens
KPGVATKLL

SEQ ID NO: 63833 - protein, 9 aa, Homo Sapiens
KPHETYRLL

SEQ ID NO: 63834 - protein, 9 aa, Homo Sapiens
KPIDGRKLL

SEQ ID NO: 63835 - protein, 9 aa, Homo Sapiens
KPIEPRREL

SEQ ID NO: 63836 - protein, 9 aa, Homo Sapiens
KPIPSKPQL

SEQ ID NO: 63837 - protein, 9 aa, Homo Sapiens
KPIQPKPTV

SEQ ID NO: 63838 - protein, 9 aa, Homo Sapiens
KPKAPPPSL

SEQ ID NO: 63839 - protein, 9 aa, Homo Sapiens
KPKDKVSLI

SEQ ID NO: 63840 - protein, 9 aa, Homo Sapiens
KPKEPITDV

SEQ ID NO: 63841 - protein, 9 aa, Homo Sapiens
KPKEPQPEV

SEQ ID NO: 63842 - protein, 9 aa, Homo Sapiens
KPKEVKPKI

SEQ ID NO: 63843 - protein, 9 aa, Homo Sapiens
KPKFILSVL

SEQ ID NO: 63844 - protein, 9 aa, Homo Sapiens
KPKGKVTIL

SEQ ID NO: 63845 - protein, 9 aa, Homo Sapiens
KPKIQHVGL

SEQ ID NO: 63846 - protein, 9 aa, Homo Sapiens
KPKITPVTV

SEQ ID NO: 63847 - protein, 9 aa, Homo Sapiens
KPKKPGKYI

SEQ ID NO: 63848 - protein, 9 aa, Homo Sapiens
KPKMNYEKL

SEQ ID NO: 63849 - protein, 9 aa, Homo Sapiens
KPKMVSKKL

SEQ ID NO: 63850 - protein, 9 aa, Homo Sapiens
KPKNAIHTF

SEQ ID NO: 63851 - protein, 9 aa, Homo Sapiens
KPKPGNMPF

SEQ ID NO: 63852 - protein, 9 aa, Homo Sapiens
KPKPIGKLA

SEQ ID NO: 63853 - protein, 9 aa, Homo Sapiens
KPKPKKPTL

SEQ ID NO: 63854 - protein, 9 aa, Homo Sapiens
KPKPNPNLL

SEQ ID NO: 63855 - protein, 9 aa, Homo Sapiens
KPKPTPDYL

SEQ ID NO: 63856 - protein, 9 aa, Homo Sapiens
KPKSLWKSV

SEQ ID NO: 63857 - protein, 9 aa, Homo Sapiens
KPKSYSSSL

SEQ ID NO: 63858 - protein, 9 aa, Homo Sapiens
KPKTGRSLL

SEQ ID NO: 63859 - protein, 9 aa, Homo Sapiens
KPKWNHLVH

SEQ ID NO: 63860 - protein, 9 aa, Homo Sapiens
KPLAGAKIV

SEQ ID NO: 63861 - protein, 9 aa, Homo Sapiens
KPLHIKPRL

SEQ ID NO: 63862 - protein, 9 aa, Homo Sapiens
KPLSIPKRL

SEQ ID NO: 63863 - protein, 9 aa, Homo Sapiens
KPLSNMKIL

SEQ ID NO: 63864 - protein, 9 aa, Homo Sapiens
KPMEKLLGL

SEQ ID NO: 63865 - protein, 9 aa, Homo Sapiens
KPMMKEFRF

SEQ ID NO: 63866 - protein, 9 aa, Homo Sapiens
KPNANRIAL

SEQ ID NO: 63867 - protein, 9 aa, Homo Sapiens
KPNGIYRKL

SEQ ID NO: 63868 - protein, 9 aa, Homo Sapiens
KPNIHKRVL

SEQ ID NO: 63869 - protein, 9 aa, Homo Sapiens
KPNYKKLEL

SEQ ID NO: 63870 - protein, 9 aa, Homo Sapiens
KPQDYKKRL

SEQ ID NO: 63871 - protein, 9 aa, Homo Sapiens
KPQKNKPLL

SEQ ID NO: 63872 - protein, 9 aa, Homo Sapiens
KPQPRPQTL

SEQ ID NO: 63873 - protein, 9 aa, Homo Sapiens
KPQSKELTL

SEQ ID NO: 63874 - protein, 9 aa, Homo Sapiens
KPQTKLLIL

SEQ ID NO: 63875 - protein, 9 aa, Homo Sapiens
KPRGFARGL

SEQ ID NO: 63876 - protein, 9 aa, Homo Sapiens
KPRKLVNTI

SEQ ID NO: 63877 - protein, 9 aa, Homo Sapiens
KPRKPITFV

SEQ ID NO: 63878 - protein, 9 aa, Homo Sapiens
KPRMRGLLA

SEQ ID NO: 63879 - protein, 9 aa, Homo Sapiens
KPRPIIPML

SEQ ID NO: 63880 - protein, 9 aa, Homo Sapiens
KPRPPLHLL

SEQ ID NO: 63881 - protein, 9 aa, Homo Sapiens
KPRPPPSQL

SEQ ID NO: 63882 - protein, 9 aa, Homo Sapiens
KPRQSSPQL

SEQ ID NO: 63883 - protein, 9 aa, Homo Sapiens
KPRSPPRAL

SEQ ID NO: 63884 - protein, 9 aa, Homo Sapiens
KPSATGKVI

SEQ ID NO: 63885 - protein, 9 aa, Homo Sapiens
KPSGVSAAL

SEQ ID NO: 63886 - protein, 9 aa, Homo Sapiens
KPSLPFTSL

SEQ ID NO: 63887 - protein, 9 aa, Homo Sapiens
KPSSWLRTL

SEQ ID NO: 63888 - protein, 9 aa, Homo Sapiens
KPTDKLRAL

SEQ ID NO: 63889 - protein, 9 aa, Homo Sapiens
KPTDWQKKI

SEQ ID NO: 63890 - protein, 9 aa, Homo Sapiens
KPTFGRSIL

SEQ ID NO: 63891 - protein, 9 aa, Homo Sapiens
KPTGTPKAL

SEQ ID NO: 63892 - protein, 9 aa, Homo Sapiens
KPTPPKSQV

SEQ ID NO: 63893 - protein, 9 aa, Homo Sapiens
KPVKPHSSF

SEQ ID NO: 63894 - protein, 9 aa, Homo Sapiens
KPVYPGQTL

SEQ ID NO: 63895 - protein, 9 aa, Homo Sapiens
KPWEKSPIL

SEQ ID NO: 63896 - protein, 9 aa, Homo Sapiens
KPWLRALQL

SEQ ID NO: 63897 - protein, 9 aa, Homo Sapiens
KPYAFDRVF

SEQ ID NO: 63898 - protein, 9 aa, Homo Sapiens
KPYEGRPSF

SEQ ID NO: 63899 - protein, 9 aa, Homo Sapiens
KPYSGGLCL

SEQ ID NO: 63900 - protein, 9 aa, Homo Sapiens
KSKNPGEAL

SEQ ID NO: 63901 - protein, 9 aa, Homo Sapiens
KVRKPGIAM

SEQ ID NO: 63902 - protein, 9 aa, Homo Sapiens
KVRVPRQSL

SEQ ID NO: 63903 - protein, 9 aa, Homo Sapiens
LAKGHIKAL

SEQ ID NO: 63904 - protein, 9 aa, Homo Sapiens
LAKKPHTSL

SEQ ID NO: 63905 - protein, 9 aa, Homo Sapiens
LAKTQGNVF

SEQ ID NO: 63906 - protein, 9 aa, Homo Sapiens
LANKDRPAL

SEQ ID NO: 63907 - protein, 9 aa, Homo Sapiens
LARPASAAL

SEQ ID NO: 63908 - protein, 9 aa, Homo Sapiens
LIRKPLRSL

SEQ ID NO: 63909 - protein, 9 aa, Homo Sapiens
LPAKFKKLL

SEQ ID NO: 63910 - protein, 9 aa, Homo Sapiens
LPAPPKIYF

SEQ ID NO: 63911 - protein, 9 aa, Homo Sapiens
LPCPGKATL

SEQ ID NO: 63912 - protein, 9 aa, Homo Sapiens
LPEAKKPRL

SEQ ID NO: 63913 - protein, 9 aa, Homo Sapiens
LPFKKGEIL

SEQ ID NO: 63914 - protein, 9 aa, Homo Sapiens
LPFLRITSL

SEQ ID NO: 63915 - protein, 9 aa, Homo Sapiens
LPHAPGVQM

SEQ ID NO: 63916 - protein, 9 aa, Homo Sapiens
LPHNRLVSL

SEQ ID NO: 63917 - protein, 9 aa, Homo Sapiens
LPHNTHRVV

SEQ ID NO: 63918 - protein, 9 aa, Homo Sapiens
LPINSRKCL

SEQ ID NO: 63919 - protein, 9 aa, Homo Sapiens
LPISHKRVL

SEQ ID NO: 63920 - protein, 9 aa, Homo Sapiens
LPKAKLKEI

SEQ ID NO: 63921 - protein, 9 aa, Homo Sapiens
LPKATILDL

SEQ ID NO: 63922 - protein, 9 aa, Homo Sapiens
LPKDAVKHL

SEQ ID NO: 63923 - protein, 9 aa, Homo Sapiens
LPKDKPRYL

SEQ ID NO: 63924 - protein, 9 aa, Homo Sapiens
LPKDRLKKF

SEQ ID NO: 63925 - protein, 9 aa, Homo Sapiens
LPKEKRHVL

SEQ ID NO: 63926 - protein, 9 aa, Homo Sapiens
LPKESVKIL

SEQ ID NO: 63927 - protein, 9 aa, Homo Sapiens
LPKGGNKHL

SEQ ID NO: 63928 - protein, 9 aa, Homo Sapiens
LPKHVIKQI

SEQ ID NO: 63929 - protein, 9 aa, Homo Sapiens
LPKKNGLYL

SEQ ID NO: 63930 - protein, 9 aa, Homo Sapiens
LPKKPCKNL

SEQ ID NO: 63931 - protein, 9 aa, Homo Sapiens
LPKLHIVQV

SEQ ID NO: 63932 - protein, 9 aa, Homo Sapiens
LPKNTHPFL

SEQ ID NO: 63933 - protein, 9 aa, Homo Sapiens
LPKPFFRLL

SEQ ID NO: 63934 - protein, 9 aa, Homo Sapiens
LPKPKAKTL

SEQ ID NO: 63935 - protein, 9 aa, Homo Sapiens
LPKPPFGML

SEQ ID NO: 63936 - protein, 9 aa, Homo Sapiens
LPKPPGRGV

SEQ ID NO: 63937 - protein, 9 aa, Homo Sapiens
LPKPSSHGL

SEQ ID NO: 63938 - protein, 9 aa, Homo Sapiens
LPKQPPLAL

SEQ ID NO: 63939 - protein, 9 aa, Homo Sapiens
LPKSPNPSF

SEQ ID NO: 63940 - protein, 9 aa, Homo Sapiens
LPKVPEKKL

SEQ ID NO: 63941 - protein, 9 aa, Homo Sapiens
LPLHKVKSL

SEQ ID NO: 63942 - protein, 9 aa, Homo Sapiens
LPNAKIKEL

SEQ ID NO: 63943 - protein, 9 aa, Homo Sapiens
LPNEQTKTL

SEQ ID NO: 63944 - protein, 9 aa, Homo Sapiens
LPNGRFKEF

SEQ ID NO: 63945 - protein, 9 aa, Homo Sapiens
LPNYKSKIL

SEQ ID NO: 63946 - protein, 9 aa, Homo Sapiens
LPQANRDTL

SEQ ID NO: 63947 - protein, 9 aa, Homo Sapiens
LPQGIVREL

SEQ ID NO: 63948 - protein, 9 aa, Homo Sapiens
LPQKKSKAL

SEQ ID NO: 63949 - protein, 9 aa, Homo Sapiens
LPQKMKGKL

SEQ ID NO: 63950 - protein, 9 aa, Homo Sapiens
LPQYKEREV

SEQ ID NO: 63951 - protein, 9 aa, Homo Sapiens
LPRFQPRVL

SEQ ID NO: 63952 - protein, 9 aa, Homo Sapiens
LPRKQGSIL

SEQ ID NO: 63953 - protein, 9 aa, Homo Sapiens
LPRPPPPEM

SEQ ID NO: 63954 - protein, 9 aa, Homo Sapiens
LPRPVPQNL

SEQ ID NO: 63955 - protein, 9 aa, Homo Sapiens
LPRRPLRAF

SEQ ID NO: 63956 - protein, 9 aa, Homo Sapiens
LPRSVKTVL

SEQ ID NO: 63957 - protein, 9 aa, Homo Sapiens
LPSEHQTIL

SEQ ID NO: 63958 - protein, 9 aa, Homo Sapiens
LPSENHKEM

SEQ ID NO: 63959 - protein, 9 aa, Homo Sapiens
LPSESMKVV

SEQ ID NO: 63960 - protein, 9 aa, Homo Sapiens
LPSGSKKVI

SEQ ID NO: 63961 - protein, 9 aa, Homo Sapiens
LPSKPSSTL

SEQ ID NO: 63962 - protein, 9 aa, Homo Sapiens
LPSPFLRAL

SEQ ID NO: 63963 - protein, 9 aa, Homo Sapiens
LPSSGRSSL

SEQ ID NO: 63964 - protein, 9 aa, Homo Sapiens
LPWPARPAL

SEQ ID NO: 63965 - protein, 9 aa, Homo Sapiens
LVKHGLRAL

SEQ ID NO: 63966 - protein, 9 aa, Homo Sapiens
LVMAPRTVL

SEQ ID NO: 63967 - protein, 9 aa, Homo Sapiens
LVRAKCKEV

SEQ ID NO: 63968 - protein, 9 aa, Homo Sapiens
LVRDVVSSL

SEQ ID NO: 63969 - protein, 9 aa, Homo Sapiens
LVRPVFGEL

SEQ ID NO: 63970 - protein, 9 aa, Homo Sapiens
LVRRHIKVI

SEQ ID NO: 63971 - protein, 9 aa, Homo Sapiens
MPHEKHYTL

SEQ ID NO: 63972 - protein, 9 aa, Homo Sapiens
MPKAEKNAV

SEQ ID NO: 63973 - protein, 9 aa, Homo Sapiens
MPKKDARTL

SEQ ID NO: 63974 - protein, 9 aa, Homo Sapiens
MPKKNRIAI

SEQ ID NO: 63975 - protein, 9 aa, Homo Sapiens
MPKKSIKKL

SEQ ID NO: 63976 - protein, 9 aa, Homo Sapiens
MPKKSSVVL

SEQ ID NO: 63977 - protein, 9 aa, Homo Sapiens
MPKMDQDSL

SEQ ID NO: 63978 - protein, 9 aa, Homo Sapiens
MPKPPNLIM

SEQ ID NO: 63979 - protein, 9 aa, Homo Sapiens
MPKVKTIEL

SEQ ID NO: 63980 - protein, 9 aa, Homo Sapiens
MPLPGTKAL

SEQ ID NO: 63981 - protein, 9 aa, Homo Sapiens
MPQKERESI

SEQ ID NO: 63982 - protein, 9 aa, Homo Sapiens
MPRHFATKL

SEQ ID NO: 63983 - protein, 9 aa, Homo Sapiens
MPSQFRDIL

SEQ ID NO: 63984 - protein, 9 aa, Homo Sapiens
MPSSAVRVL

SEQ ID NO: 63985 - protein, 9 aa, Homo Sapiens
MPTPVIKAF

SEQ ID NO: 63986 - protein, 9 aa, Homo Sapiens
MTQQPRPVL

SEQ ID NO: 63987 - protein, 9 aa, Homo Sapiens
MVLENVKEM

SEQ ID NO: 63988 - protein, 9 aa, Homo Sapiens
NALHNIKTL

SEQ ID NO: 63989 - protein, 9 aa, Homo Sapiens
NLNPNAKEF

SEQ ID NO: 63990 - protein, 9 aa, Homo Sapiens
NPAENFRVL

SEQ ID NO: 63991 - protein, 9 aa, Homo Sapiens
NPEVRRAVL

SEQ ID NO: 63992 - protein, 9 aa, Homo Sapiens
NPHGARLSL

SEQ ID NO: 63993 - protein, 9 aa, Homo Sapiens
NPKEAGQRL

SEQ ID NO: 63994 - protein, 9 aa, Homo Sapiens
NPKKPITEI

SEQ ID NO: 63995 - protein, 9 aa, Homo Sapiens
NPKNPGLWL

SEQ ID NO: 63996 - protein, 9 aa, Homo Sapiens
NPKNVNRVL

SEQ ID NO: 63997 - protein, 9 aa, Homo Sapiens
NPKPKFFVL

SEQ ID NO: 63998 - protein, 9 aa, Homo Sapiens
NPKRQTLVF

SEQ ID NO: 63999 - protein, 9 aa, Homo Sapiens
NPNLRKNVL

SEQ ID NO: 64000 - protein, 9 aa, Homo Sapiens
NPRFGGKEL

SEQ ID NO: 64001 - protein, 9 aa, Homo Sapiens
NPRIPYTEL

SEQ ID NO: 64002 - protein, 9 aa, Homo Sapiens
NPRKHITSL

SEQ ID NO: 64003 - protein, 9 aa, Homo Sapiens
NPRKYLRSV

SEQ ID NO: 64004 - protein, 9 aa, Homo Sapiens
NVRPPNTAL

SEQ ID NO: 64005 - protein, 9 aa, Homo Sapiens
PAVAKLRRL

SEQ ID NO: 64006 - protein, 9 aa, Homo Sapiens
PREKKISIL

SEQ ID NO: 64007 - protein, 9 aa, Homo Sapiens
PSRTLFPSL

SEQ ID NO: 64008 - protein, 9 aa, Homo Sapiens
PSSAPAVST

SEQ ID NO: 64009 - protein, 9 aa, Homo Sapiens
PSSKLIRIL

SEQ ID NO: 64010 - protein, 9 aa, Homo Sapiens
QEQNQEQPI

SEQ ID NO: 64011 - protein, 9 aa, Homo Sapiens
QILRPPKVL

SEQ ID NO: 64012 - protein, 9 aa, Homo Sapiens
QIRPDRQTL

SEQ ID NO: 64013 - protein, 9 aa, Homo Sapiens
QPACKRLTL

SEQ ID NO: 64014 - protein, 9 aa, Homo Sapiens
QPAGHRPAL

SEQ ID NO: 64015 - protein, 9 aa, Homo Sapiens
QPGRPLRVV

SEQ ID NO: 64016 - protein, 9 aa, Homo Sapiens
QPHTILRVV

SEQ ID NO: 64017 - protein, 9 aa, Homo Sapiens
QPKEKISKV

SEQ ID NO: 64018 - protein, 9 aa, Homo Sapiens
QPKLPITVL

SEQ ID NO: 64019 - protein, 9 aa, Homo Sapiens
QPKQRGFRF

SEQ ID NO: 64020 - protein, 9 aa, Homo Sapiens
QPLKAKTSL

SEQ ID NO: 64021 - protein, 9 aa, Homo Sapiens
QPNMRLRQL

SEQ ID NO: 64022 - protein, 9 aa, Homo Sapiens
QPQFQRQGL

SEQ ID NO: 64023 - protein, 9 aa, Homo Sapiens
QPSFSAKKM

SEQ ID NO: 64024 - protein, 9 aa, Homo Sapiens
QPTGGKARL

SEQ ID NO: 64025 - protein, 9 aa, Homo Sapiens
QPYNSRPAV

SEQ ID NO: 64026 - protein, 9 aa, Homo Sapiens
QQMENRPSV

SEQ ID NO: 64027 - protein, 9 aa, Homo Sapiens
QSVKRPKLL

SEQ ID NO: 64028 - protein, 9 aa, Homo Sapiens
QTLNNIKQF

SEQ ID NO: 64029 - protein, 9 aa, Homo Sapiens
QVKSGRPSL

SEQ ID NO: 64030 - protein, 9 aa, Homo Sapiens
QVQGPRPVL

SEQ ID NO: 64031 - protein, 9 aa, Homo Sapiens
QVRLPLGTL

SEQ ID NO: 64032 - protein, 9 aa, Homo Sapiens
RAKAIIVEF

SEQ ID NO: 64033 - protein, 9 aa, Homo Sapiens
RAKFWVKEL

SEQ ID NO: 64034 - protein, 9 aa, Homo Sapiens
RAKNWVKEL

SEQ ID NO: 64035 - protein, 9 aa, Homo Sapiens
RAKTWVKEL

SEQ ID NO: 64036 - protein, 9 aa, Homo Sapiens
RAKVHIKKL

SEQ ID NO: 64037 - protein, 9 aa, Homo Sapiens
RAMDKKKVL

SEQ ID NO: 64038 - protein, 9 aa, Homo Sapiens
RAWKKNEKL

SEQ ID NO: 64039 - protein, 9 aa, Homo Sapiens
RIKLGIKSL

SEQ ID NO: 64040 - protein, 9 aa, Homo Sapiens
RIKQKMKEL

SEQ ID NO: 64041 - protein, 9 aa, Homo Sapiens
RINHYIKTL

SEQ ID NO: 64042 - protein, 9 aa, Homo Sapiens
RLKDHVKQL

SEQ ID NO: 64043 - protein, 9 aa, Homo Sapiens
RLKQKIKVL

SEQ ID NO: 64044 - protein, 9 aa, Homo Sapiens
RLKSLMKIL

SEQ ID NO: 64045 - protein, 9 aa, Homo Sapiens
RLKSSVKAV

SEQ ID NO: 64046 - protein, 9 aa, Homo Sapiens
RLSPNHKVL

SEQ ID NO: 64047 - protein, 9 aa, Homo Sapiens
RPAFPVKKL

SEQ ID NO: 64048 - protein, 9 aa, Homo Sapiens
RPALPRSEL

SEQ ID NO: 64049 - protein, 9 aa, Homo Sapiens
RPAPARPTM

SEQ ID NO: 64050 - protein, 9 aa, Homo Sapiens
RPAPLSAEL

SEQ ID NO: 64051 - protein, 9 aa, Homo Sapiens
RPAPPPEAL

SEQ ID NO: 64052 - protein, 9 aa, Homo Sapiens
RPAPPREEI

SEQ ID NO: 64053 - protein, 9 aa, Homo Sapiens
RPAQVSQPF

SEQ ID NO: 64054 - protein, 9 aa, Homo Sapiens
RPAVGHSGL

SEQ ID NO: 64055 - protein, 9 aa, Homo Sapiens
RPAYRKVFL

SEQ ID NO: 64056 - protein, 9 aa, Homo Sapiens
RPCDISRQL

SEQ ID NO: 64057 - protein, 9 aa, Homo Sapiens
RPDAEKKEM

SEQ ID NO: 64058 - protein, 9 aa, Homo Sapiens
RPDLREKVI

SEQ ID NO: 64059 - protein, 9 aa, Homo Sapiens
RPEEGRPVV

SEQ ID NO: 64060 - protein, 9 aa, Homo Sapiens
RPFDKLEQL

SEQ ID NO: 64061 - protein, 9 aa, Homo Sapiens
RPFERTITM

SEQ ID NO: 64062 - protein, 9 aa, Homo Sapiens
RPFSPREAL

SEQ ID NO: 64063 - protein, 9 aa, Homo Sapiens
RPGELLKTV

SEQ ID NO: 64064 - protein, 9 aa, Homo Sapiens
RPHAPGRPA

SEQ ID NO: 64065 - protein, 9 aa, Homo Sapiens
RPHKPGLYL

SEQ ID NO: 64066 - protein, 9 aa, Homo Sapiens
RPHLSGRKL

SEQ ID NO: 64067 - protein, 9 aa, Homo Sapiens
RPHMFPKML

SEQ ID NO: 64068 - protein, 9 aa, Homo Sapiens
RPHPKPKQF

SEQ ID NO: 64069 - protein, 9 aa, Homo Sapiens
RPHVAQPTL

SEQ ID NO: 64070 - protein, 9 aa, Homo Sapiens
RPHYSLRTL

SEQ ID NO: 64071 - protein, 9 aa, Homo Sapiens
RPIASGPVV

SEQ ID NO: 64072 - protein, 9 aa, Homo Sapiens
RPIMFRGEV

SEQ ID NO: 64073 - protein, 9 aa, Homo Sapiens
RPISGQKEV

SEQ ID NO: 64074 - protein, 9 aa, Homo Sapiens
RPKALTQVL

SEQ ID NO: 64075 - protein, 9 aa, Homo Sapiens
RPKDPNNLL

SEQ ID NO: 64076 - protein, 9 aa, Homo Sapiens
RPKDYANTL

SEQ ID NO: 64077 - protein, 9 aa, Homo Sapiens
RPKEKSLVL

SEQ ID NO: 64078 - protein, 9 aa, Homo Sapiens
RPKFSVCVL

SEQ ID NO: 64079 - protein, 9 aa, Homo Sapiens
RPKGFYVET

SEQ ID NO: 64080 - protein, 9 aa, Homo Sapiens
RPKIKVSLI

SEQ ID NO: 64081 - protein, 9 aa, Homo Sapiens
RPKKPGQSF

SEQ ID NO: 64082 - protein, 9 aa, Homo Sapiens
RPKKVGVRY

SEQ ID NO: 64083 - protein, 9 aa, Homo Sapiens
RPKLIGEEL

SEQ ID NO: 64084 - protein, 9 aa, Homo Sapiens
RPKLNRENF

SEQ ID NO: 64085 - protein, 9 aa, Homo Sapiens
RPKNLMQTL

SEQ ID NO: 64086 - protein, 9 aa, Homo Sapiens
RPKNVVLRL

SEQ ID NO: 64087 - protein, 9 aa, Homo Sapiens
RPKPIITSV

SEQ ID NO: 64088 - protein, 9 aa, Homo Sapiens
RPKPPNVRT

SEQ ID NO: 64089 - protein, 9 aa, Homo Sapiens
RPKRPANQF

SEQ ID NO: 64090 - protein, 9 aa, Homo Sapiens
RPKSAFKVQ

SEQ ID NO: 64091 - protein, 9 aa, Homo Sapiens
RPKTFGMDM

SEQ ID NO: 64092 - protein, 9 aa, Homo Sapiens
RPKTGVRGL

SEQ ID NO: 64093 - protein, 9 aa, Homo Sapiens
RPKTPFKAW

SEQ ID NO: 64094 - protein, 9 aa, Homo Sapiens
RPKYPGIKF

SEQ ID NO: 64095 - protein, 9 aa, Homo Sapiens
RPKYQFLSL

SEQ ID NO: 64096 - protein, 9 aa, Homo Sapiens
RPLKGRINL

SEQ ID NO: 64097 - protein, 9 aa, Homo Sapiens
RPLSKTVRF

SEQ ID NO: 64098 - protein, 9 aa, Homo Sapiens
RPLVKPKIV

SEQ ID NO: 64099 - protein, 9 aa, Homo Sapiens
RPLVVKTSL

SEQ ID NO: 64100 - protein, 9 aa, Homo Sapiens
RPLYKNIVL

SEQ ID NO: 64101 - protein, 9 aa, Homo Sapiens
RPMGAGEAL

SEQ ID NO: 64102 - protein, 9 aa, Homo Sapiens
RPMKVGHVT

SEQ ID NO: 64103 - protein, 9 aa, Homo Sapiens
RPMYSKPSI

SEQ ID NO: 64104 - protein, 9 aa, Homo Sapiens
RPNFNIKGI

SEQ ID NO: 64105 - protein, 9 aa, Homo Sapiens
RPNGGPRAL

SEQ ID NO: 64106 - protein, 9 aa, Homo Sapiens
RPNIAQKRM

SEQ ID NO: 64107 - protein, 9 aa, Homo Sapiens
RPPQRQVVL

SEQ ID NO: 64108 - protein, 9 aa, Homo Sapiens
RPQLKGVVL

SEQ ID NO: 64109 - protein, 9 aa, Homo Sapiens
RPQLLKNAL

SEQ ID NO: 64110 - protein, 9 aa, Homo Sapiens
RPQLQRQVL

SEQ ID NO: 64111 - protein, 9 aa, Homo Sapiens
RPQVAKTLL

SEQ ID NO: 64112 - protein, 9 aa, Homo Sapiens
RPRATVMVM

SEQ ID NO: 64113 - protein, 9 aa, Homo Sapiens
RPRDPTPSF

SEQ ID NO: 64114 - protein, 9 aa, Homo Sapiens
RPRDYTVNL

SEQ ID NO: 64115 - protein, 9 aa, Homo Sapiens
RPREEVRAL

SEQ ID NO: 64116 - protein, 9 aa, Homo Sapiens
RPREVTVSL

SEQ ID NO: 64117 - protein, 9 aa, Homo Sapiens
RPRHQGVMV

SEQ ID NO: 64118 - protein, 9 aa, Homo Sapiens
RPRITRICL

SEQ ID NO: 64119 - protein, 9 aa, Homo Sapiens
RPRPERNIL

SEQ ID NO: 64120 - protein, 9 aa, Homo Sapiens
RPRPGNILL

SEQ ID NO: 64121 - protein, 9 aa, Homo Sapiens
RPRPPITLL

SEQ ID NO: 64122 - protein, 9 aa, Homo Sapiens
RPRPPQKAL

SEQ ID NO: 64123 - protein, 9 aa, Homo Sapiens
RPRPTEATV

SEQ ID NO: 64124 - protein, 9 aa, Homo Sapiens
RPRPVLRSV

SEQ ID NO: 64125 - protein, 9 aa, Homo Sapiens
RPSEWDKRL

SEQ ID NO: 64126 - protein, 9 aa, Homo Sapiens
RPSGPGPEL

SEQ ID NO: 64127 - protein, 9 aa, Homo Sapiens
RPSGPSKAL

SEQ ID NO: 64128 - protein, 9 aa, Homo Sapiens
RPTFFARKF

SEQ ID NO: 64129 - protein, 9 aa, Homo Sapiens
RPTLPVKSL

SEQ ID NO: 64130 - protein, 9 aa, Homo Sapiens
RPVLPRTEA

SEQ ID NO: 64131 - protein, 9 aa, Homo Sapiens
RPVPPPPSL

SEQ ID NO: 64132 - protein, 9 aa, Homo Sapiens
RPWHKTVTI

SEQ ID NO: 64133 - protein, 9 aa, Homo Sapiens
RPWLRPAAL

SEQ ID NO: 64134 - protein, 9 aa, Homo Sapiens
RPWSNSRGL

SEQ ID NO: 64135 - protein, 9 aa, Homo Sapiens
RPYEKGRLI

SEQ ID NO: 64136 - protein, 9 aa, Homo Sapiens
RPYYPRKAL

SEQ ID NO: 64137 - protein, 9 aa, Homo Sapiens
RRPPPPPPP

SEQ ID NO: 64138 - protein, 9 aa, Homo Sapiens
RTAKGKPVL

SEQ ID NO: 64139 - protein, 9 aa, Homo Sapiens
RTKASVHTL

SEQ ID NO: 64140 - protein, 9 aa, Homo Sapiens
RTWKNLKQI

SEQ ID NO: 64141 - protein, 9 aa, Homo Sapiens
RVAGIHKKV

SEQ ID NO: 64142 - protein, 9 aa, Homo Sapiens
RVFGNKKQL

SEQ ID NO: 64143 - protein, 9 aa, Homo Sapiens
RVIEHYKKL

SEQ ID NO: 64144 - protein, 9 aa, Homo Sapiens
RVKAPNKSL

SEQ ID NO: 64145 - protein, 9 aa, Homo Sapiens
RVKDPTKAL

SEQ ID NO: 64146 - protein, 9 aa, Homo Sapiens
RVKEIGSTM

SEQ ID NO: 64147 - protein, 9 aa, Homo Sapiens
RVKEPVKEL

SEQ ID NO: 64148 - protein, 9 aa, Homo Sapiens
RVKLDGSRL

SEQ ID NO: 64149 - protein, 9 aa, Homo Sapiens
RVKLPSKAL

SEQ ID NO: 64150 - protein, 9 aa, Homo Sapiens
RVKLTAKKL

SEQ ID NO: 64151 - protein, 9 aa, Homo Sapiens
RVKNAVKYL

SEQ ID NO: 64152 - protein, 9 aa, Homo Sapiens
RVKYNLNSL

SEQ ID NO: 64153 - protein, 9 aa, Homo Sapiens
RVMGDRSVL

SEQ ID NO: 64154 - protein, 9 aa, Homo Sapiens
RVMNVHKML

SEQ ID NO: 64155 - protein, 9 aa, Homo Sapiens
RVQKIRPSI

SEQ ID NO: 64156 - protein, 9 aa, Homo Sapiens
RVQKSKAVL

SEQ ID NO: 64157 - protein, 9 aa, Homo Sapiens
RVRDIQKQV

SEQ ID NO: 64158 - protein, 9 aa, Homo Sapiens
RVRELERQL

SEQ ID NO: 64159 - protein, 9 aa, Homo Sapiens
RVRPTCKRM

SEQ ID NO: 64160 - protein, 9 aa, Homo Sapiens
RVSLVRKEL

SEQ ID NO: 64161 - protein, 9 aa, Homo Sapiens
RVSSHLKHL

SEQ ID NO: 64162 - protein, 9 aa, Homo Sapiens
RVYSHLKSV

SEQ ID NO: 64163 - protein, 9 aa, Homo Sapiens
SALQNIKRL

SEQ ID NO: 64164 - protein, 9 aa, Homo Sapiens
SPAAEKAQL

SEQ ID NO: 64165 - protein, 9 aa, Homo Sapiens
SPAAGIKTV

SEQ ID NO: 64166 - protein, 9 aa, Homo Sapiens
SPADIVKNL

SEQ ID NO: 64167 - protein, 9 aa, Homo Sapiens
SPADRQLVA

SEQ ID NO: 64168 - protein, 9 aa, Homo Sapiens
SPAFRILSV

SEQ ID NO: 64169 - protein, 9 aa, Homo Sapiens
SPAFSTRVL

SEQ ID NO: 64170 - protein, 9 aa, Homo Sapiens
SPAGKTNAL

SEQ ID NO: 64171 - protein, 9 aa, Homo Sapiens
SPAKPHTTL

SEQ ID NO: 64172 - protein, 9 aa, Homo Sapiens
SPALPGLKL

SEQ ID NO: 64173 - protein, 9 aa, Homo Sapiens
SPANKPKIL

SEQ ID NO: 64174 - protein, 9 aa, Homo Sapiens
SPAPSKTLM

SEQ ID NO: 64175 - protein, 9 aa, Homo Sapiens
SPAPTHNSL

SEQ ID NO: 64176 - protein, 9 aa, Homo Sapiens
SPAQVKTSV

SEQ ID NO: 64177 - protein, 9 aa, Homo Sapiens
SPASPKISL

SEQ ID NO: 64178 - protein, 9 aa, Homo Sapiens
SPASRSISL

SEQ ID NO: 64179 - protein, 9 aa, Homo Sapiens
SPAYRDLAA

SEQ ID NO: 64180 - protein, 9 aa, Homo Sapiens
SPCPSKSGL

SEQ ID NO: 64181 - protein, 9 aa, Homo Sapiens
SPCQDVKQL

SEQ ID NO: 64182 - protein, 9 aa, Homo Sapiens
SPDTKKIAL

SEQ ID NO: 64183 - protein, 9 aa, Homo Sapiens
SPEAQPKTL

SEQ ID NO: 64184 - protein, 9 aa, Homo Sapiens
SPEETRAAL

SEQ ID NO: 64185 - protein, 9 aa, Homo Sapiens
SPEQSRNVL

SEQ ID NO: 64186 - protein, 9 aa, Homo Sapiens
SPFEQAKKV

SEQ ID NO: 64187 - protein, 9 aa, Homo Sapiens
SPFHRNLFL

SEQ ID NO: 64188 - protein, 9 aa, Homo Sapiens
SPFNDRFPL

SEQ ID NO: 64189 - protein, 9 aa, Homo Sapiens
SPFSFHHVL

SEQ ID NO: 64190 - protein, 9 aa, Homo Sapiens
SPGNIGKLL

SEQ ID NO: 64191 - protein, 9 aa, Homo Sapiens
SPGPEKMAL

SEQ ID NO: 64192 - protein, 9 aa, Homo Sapiens
SPGPSRPGL

SEQ ID NO: 64193 - protein, 9 aa, Homo Sapiens
SPGQRSISL

SEQ ID NO: 64194 - protein, 9 aa, Homo Sapiens
SPGSPRPAL

SEQ ID NO: 64195 - protein, 9 aa, Homo Sapiens
SPGSRKMVV

SEQ ID NO: 64196 - protein, 9 aa, Homo Sapiens
SPGSSPKVL

SEQ ID NO: 64197 - protein, 9 aa, Homo Sapiens
SPGWVRLAL

SEQ ID NO: 64198 - protein, 9 aa, Homo Sapiens
SPHFKSGSL

SEQ ID NO: 64199 - protein, 9 aa, Homo Sapiens
SPHGHILVL

SEQ ID NO: 64200 - protein, 9 aa, Homo Sapiens
SPHIPYKLL

SEQ ID NO: 64201 - protein, 9 aa, Homo Sapiens
SPHRPLAGL

SEQ ID NO: 64202 - protein, 9 aa, Homo Sapiens
SPHRQYKGM

SEQ ID NO: 64203 - protein, 9 aa, Homo Sapiens
SPIEKSGVL

SEQ ID NO: 64204 - protein, 9 aa, Homo Sapiens
SPIERNEQL

SEQ ID NO: 64205 - protein, 9 aa, Homo Sapiens
SPIERQKSL

SEQ ID NO: 64206 - protein, 9 aa, Homo Sapiens
SPIGRSCTL

SEQ ID NO: 64207 - protein, 9 aa, Homo Sapiens
SPITGRSKL

SEQ ID NO: 64208 - protein, 9 aa, Homo Sapiens
SPIVKSAKF

SEQ ID NO: 64209 - protein, 9 aa, Homo Sapiens
SPKAALRYA

SEQ ID NO: 64210 - protein, 9 aa, Homo Sapiens
SPKADVKNL

SEQ ID NO: 64211 - protein, 9 aa, Homo Sapiens
SPKDVILKV

SEQ ID NO: 64212 - protein, 9 aa, Homo Sapiens
SPKESRSKF

SEQ ID NO: 64213 - protein, 9 aa, Homo Sapiens
SPKFSELVM

SEQ ID NO: 64214 - protein, 9 aa, Homo Sapiens
SPKGCGTVL

SEQ ID NO: 64215 - protein, 9 aa, Homo Sapiens
SPKGHLTRL

SEQ ID NO: 64216 - protein, 9 aa, Homo Sapiens
SPKGKFSLF

SEQ ID NO: 64217 - protein, 9 aa, Homo Sapiens
SPKIASHQF

SEQ ID NO: 64218 - protein, 9 aa, Homo Sapiens
SPKIHARVF

SEQ ID NO: 64219 - protein, 9 aa, Homo Sapiens
SPKIRSHAV

SEQ ID NO: 64220 - protein, 9 aa, Homo Sapiens
SPKITTSLL

SEQ ID NO: 64221 - protein, 9 aa, Homo Sapiens
SPKKPGREI

SEQ ID NO: 64222 - protein, 9 aa, Homo Sapiens
SPKKPVIVF

SEQ ID NO: 64223 - protein, 9 aa, Homo Sapiens
SPKLHAEAI

SEQ ID NO: 64224 - protein, 9 aa, Homo Sapiens
SPKLPVSSL

SEQ ID NO: 64225 - protein, 9 aa, Homo Sapiens
SPKLSNKEL

SEQ ID NO: 64226 - protein, 9 aa, Homo Sapiens
SPKMPLKTL

SEQ ID NO: 64227 - protein, 9 aa, Homo Sapiens
SPKPAIKSI

SEQ ID NO: 64228 - protein, 9 aa, Homo Sapiens
SPKPDPKTI

SEQ ID NO: 64229 - protein, 9 aa, Homo Sapiens
SPKPNGPVL

SEQ ID NO: 64230 - protein, 9 aa, Homo Sapiens
SPKPPSQQL

SEQ ID NO: 64231 - protein, 9 aa, Homo Sapiens
SPKPPTSMF

SEQ ID NO: 64232 - protein, 9 aa, Homo Sapiens
SPKPWIPVL

SEQ ID NO: 64233 - protein, 9 aa, Homo Sapiens
SPKQILDPA

SEQ ID NO: 64234 - protein, 9 aa, Homo Sapiens
SPKRPRLQL

SEQ ID NO: 64235 - protein, 9 aa, Homo Sapiens
SPKRWQKIF

SEQ ID NO: 64236 - protein, 9 aa, Homo Sapiens
SPKSPGLKA

SEQ ID NO: 64237 - protein, 9 aa, Homo Sapiens
SPKSPTAAL

SEQ ID NO: 64238 - protein, 9 aa, Homo Sapiens
SPKSYLEIL

SEQ ID NO: 64239 - protein, 9 aa, Homo Sapiens
SPKVEPRAL

SEQ ID NO: 64240 - protein, 9 aa, Homo Sapiens
SPKVNKDTL

SEQ ID NO: 64241 - protein, 9 aa, Homo Sapiens
SPKVPRTLL

SEQ ID NO: 64242 - protein, 9 aa, Homo Sapiens
SPKYIQKQI

SEQ ID NO: 64243 - protein, 9 aa, Homo Sapiens
SPLAKKKLL

SEQ ID NO: 64244 - protein, 9 aa, Homo Sapiens
SPLDNSKAV

SEQ ID NO: 64245 - protein, 9 aa, Homo Sapiens
SPLFNTKQY

SEQ ID NO: 64246 - protein, 9 aa, Homo Sapiens
SPLGHRMQL

SEQ ID NO: 64247 - protein, 9 aa, Homo Sapiens
SPLKKEQPL

SEQ ID NO: 64248 - protein, 9 aa, Homo Sapiens
SPLLKQYIL

SEQ ID NO: 64249 - protein, 9 aa, Homo Sapiens
SPLSHHSQL

SEQ ID NO: 64250 - protein, 9 aa, Homo Sapiens
SPLTKSISL

SEQ ID NO: 64251 - protein, 9 aa, Homo Sapiens
SPLYLAHEV

SEQ ID NO: 64252 - protein, 9 aa, Homo Sapiens
SPMADRSMM

SEQ ID NO: 64253 - protein, 9 aa, Homo Sapiens
SPMAERSMM

SEQ ID NO: 64254 - protein, 9 aa, Homo Sapiens
SPMRDAPCL

SEQ ID NO: 64255 - protein, 9 aa, Homo Sapiens
SPMSQRPVL

SEQ ID NO: 64256 - protein, 9 aa, Homo Sapiens
SPNAEIHIL

SEQ ID NO: 64257 - protein, 9 aa, Homo Sapiens
SPNAIFKAL

SEQ ID NO: 64258 - protein, 9 aa, Homo Sapiens
SPNENFKTV

SEQ ID NO: 64259 - protein, 9 aa, Homo Sapiens
SPNGHRPQL

SEQ ID NO: 64260 - protein, 9 aa, Homo Sapiens
SPNKKPFSL

SEQ ID NO: 64261 - protein, 9 aa, Homo Sapiens
SPNLRLLDL

SEQ ID NO: 64262 - protein, 9 aa, Homo Sapiens
SPNMHRRVI

SEQ ID NO: 64263 - protein, 9 aa, Homo Sapiens
SPNQKLLAV

SEQ ID NO: 64264 - protein, 9 aa, Homo Sapiens
SPNSILKAA

SEQ ID NO: 64265 - protein, 9 aa, Homo Sapiens
SPNSKVNTL

SEQ ID NO: 64266 - protein, 9 aa, Homo Sapiens
SPNSSPRTL

SEQ ID NO: 64267 - protein, 9 aa, Homo Sapiens
SPNSVKPEM

SEQ ID NO: 64268 - protein, 9 aa, Homo Sapiens
SPNTDREVL

SEQ ID NO: 64269 - protein, 9 aa, Homo Sapiens
SPQANRTYV

SEQ ID NO: 64270 - protein, 9 aa, Homo Sapiens
SPQDKRTLL

SEQ ID NO: 64271 - protein, 9 aa, Homo Sapiens
SPQEARNML

SEQ ID NO: 64272 - protein, 9 aa, Homo Sapiens
SPQEFIHEL

SEQ ID NO: 64273 - protein, 9 aa, Homo Sapiens
SPQGLKPVV

SEQ ID NO: 64274 - protein, 9 aa, Homo Sapiens
SPQGRVMTI

SEQ ID NO: 64275 - protein, 9 aa, Homo Sapiens
SPQGVSKTL

SEQ ID NO: 64276 - protein, 9 aa, Homo Sapiens
SPQPRLIYL

SEQ ID NO: 64277 - protein, 9 aa, Homo Sapiens
SPQQKLVCL

SEQ ID NO: 64278 - protein, 9 aa, Homo Sapiens
SPQRPRPTL

SEQ ID NO: 64279 - protein, 9 aa, Homo Sapiens
SPQSPGDAL

SEQ ID NO: 64280 - protein, 9 aa, Homo Sapiens
SPQTHWKTV

SEQ ID NO: 64281 - protein, 9 aa, Homo Sapiens
SPQVCLKRL

SEQ ID NO: 64282 - protein, 9 aa, Homo Sapiens
SPQVQRPSF

SEQ ID NO: 64283 - protein, 9 aa, Homo Sapiens
SPRAPVQVI

SEQ ID NO: 64284 - protein, 9 aa, Homo Sapiens
SPRDKIYTI

SEQ ID NO: 64285 - protein, 9 aa, Homo Sapiens
SPRDPVLTL

SEQ ID NO: 64286 - protein, 9 aa, Homo Sapiens
SPREAARVL

SEQ ID NO: 64287 - protein, 9 aa, Homo Sapiens
SPREVFFRV

SEQ ID NO: 64288 - protein, 9 aa, Homo Sapiens
SPRGFPLGL

SEQ ID NO: 64289 - protein, 9 aa, Homo Sapiens
SPRGPGCSL

SEQ ID NO: 64290 - protein, 9 aa, Homo Sapiens
SPRHKMKII

SEQ ID NO: 64291 - protein, 9 aa, Homo Sapiens
SPRHPGVIF

SEQ ID NO: 64292 - protein, 9 aa, Homo Sapiens
SPRHSFNNL

SEQ ID NO: 64293 - protein, 9 aa, Homo Sapiens
SPRKLPTSL

SEQ ID NO: 64294 - protein, 9 aa, Homo Sapiens
SPRKSPRLM

SEQ ID NO: 64295 - protein, 9 aa, Homo Sapiens
SPRLPAREL

SEQ ID NO: 64296 - protein, 9 aa, Homo Sapiens
SPRLPVGGF

SEQ ID NO: 64297 - protein, 9 aa, Homo Sapiens
SPRMPSSGF

SEQ ID NO: 64298 - protein, 9 aa, Homo Sapiens
SPRNEVEAL

SEQ ID NO: 64299 - protein, 9 aa, Homo Sapiens
SPRPDRALV

SEQ ID NO: 64300 - protein, 9 aa, Homo Sapiens
SPRPGGPYL

SEQ ID NO: 64301 - protein, 9 aa, Homo Sapiens
SPRPKMDAI

SEQ ID NO: 64302 - protein, 9 aa, Homo Sapiens
SPRPPAEGF

SEQ ID NO: 64303 - protein, 9 aa, Homo Sapiens
SPRPPLISV

SEQ ID NO: 64304 - protein, 9 aa, Homo Sapiens
SPRPTGSDL

SEQ ID NO: 64305 - protein, 9 aa, Homo Sapiens
SPRVKVKNL

SEQ ID NO: 64306 - protein, 9 aa, Homo Sapiens
SPRVPLSAY

SEQ ID NO: 64307 - protein, 9 aa, Homo Sapiens
SPRVPNSSV

SEQ ID NO: 64308 - protein, 9 aa, Homo Sapiens
SPRVQFQSL

SEQ ID NO: 64309 - protein, 9 aa, Homo Sapiens
SPRVTGRLL

SEQ ID NO: 64310 - protein, 9 aa, Homo Sapiens
SPRVYWLGL

SEQ ID NO: 64311 - protein, 9 aa, Homo Sapiens
SPRYIFTML

SEQ ID NO: 64312 - protein, 9 aa, Homo Sapiens
SPSEIVKQI

SEQ ID NO: 64313 - protein, 9 aa, Homo Sapiens
SPSGDRPAV

SEQ ID NO: 64314 - protein, 9 aa, Homo Sapiens
SPSGSKMQL

SEQ ID NO: 64315 - protein, 9 aa, Homo Sapiens
SPSHNLKSL

SEQ ID NO: 64316 - protein, 9 aa, Homo Sapiens
SPSKPAKSL

SEQ ID NO: 64317 - protein, 9 aa, Homo Sapiens
SPSLPKKSL

SEQ ID NO: 64318 - protein, 9 aa, Homo Sapiens
SPSPRLKSV

SEQ ID NO: 64319 - protein, 9 aa, Homo Sapiens
SPSSPGSSL

SEQ ID NO: 64320 - protein, 9 aa, Homo Sapiens
SPTCTNKEL

SEQ ID NO: 64321 - protein, 9 aa, Homo Sapiens
SPTEERPTV

SEQ ID NO: 64322 - protein, 9 aa, Homo Sapiens
SPTGSGKSL

SEQ ID NO: 64323 - protein, 9 aa, Homo Sapiens
SPTGTGKTL

SEQ ID NO: 64324 - protein, 9 aa, Homo Sapiens
SPTTAFTVL

SEQ ID NO: 64325 - protein, 9 aa, Homo Sapiens
SPVFRLETL

SEQ ID NO: 64326 - protein, 9 aa, Homo Sapiens
SPVNGKLSV

SEQ ID NO: 64327 - protein, 9 aa, Homo Sapiens
SPWKRQIDL

SEQ ID NO: 64328 - protein, 9 aa, Homo Sapiens
SPYKRDNTF

SEQ ID NO: 64329 - protein, 9 aa, Homo Sapiens
SPYLRPLTL

SEQ ID NO: 64330 - protein, 9 aa, Homo Sapiens
SPYQNIKIL

SEQ ID NO: 64331 - protein, 9 aa, Homo Sapiens
SQRQGRPTL

SEQ ID NO: 64332 - protein, 9 aa, Homo Sapiens
SRAKAVRAL

SEQ ID NO: 64333 - protein, 9 aa, Homo Sapiens
SVKGHVKML

SEQ ID NO: 64334 - protein, 9 aa, Homo Sapiens
SVKPASSSF

SEQ ID NO: 64335 - protein, 9 aa, Homo Sapiens
SVKSPNQSL

SEQ ID NO: 64336 - protein, 9 aa, Homo Sapiens
SVKWPNSVM

SEQ ID NO: 64337 - protein, 9 aa, Homo Sapiens
SVQTHIKTL

SEQ ID NO: 64338 - protein, 9 aa, Homo Sapiens
TAKGHIVLL

SEQ ID NO: 64339 - protein, 9 aa, Homo Sapiens
TIKKRFKVL

SEQ ID NO: 64340 - protein, 9 aa, Homo Sapiens
TLNPNAKEF

SEQ ID NO: 64341 - protein, 9 aa, Homo Sapiens
TPAEVRQVL

SEQ ID NO: 64342 - protein, 9 aa, Homo Sapiens
TPAMQRKKL

SEQ ID NO: 64343 - protein, 9 aa, Homo Sapiens
TPAPPTHAL

SEQ ID NO: 64344 - protein, 9 aa, Homo Sapiens
TPAPRRAVL

SEQ ID NO: 64345 - protein, 9 aa, Homo Sapiens
TPASGTKVI

SEQ ID NO: 64346 - protein, 9 aa, Homo Sapiens
TPCKTPKQL

SEQ ID NO: 64347 - protein, 9 aa, Homo Sapiens
TPINKRPVL

SEQ ID NO: 64348 - protein, 9 aa, Homo Sapiens
TPKEAFRQL

SEQ ID NO: 64349 - protein, 9 aa, Homo Sapiens
TPKEEAQSL

SEQ ID NO: 64350 - protein, 9 aa, Homo Sapiens
TPKGETRQL

SEQ ID NO: 64351 - protein, 9 aa, Homo Sapiens
TPKKPVGEV

SEQ ID NO: 64352 - protein, 9 aa, Homo Sapiens
TPKKTTPIL

SEQ ID NO: 64353 - protein, 9 aa, Homo Sapiens
TPKMPGQSV

SEQ ID NO: 64354 - protein, 9 aa, Homo Sapiens
TPKNTSVSL

SEQ ID NO: 64355 - protein, 9 aa, Homo Sapiens
TPKPATEAV

SEQ ID NO: 64356 - protein, 9 aa, Homo Sapiens
TPKPQTKEL

SEQ ID NO: 64357 - protein, 9 aa, Homo Sapiens
TPKPSFFDF

SEQ ID NO: 64358 - protein, 9 aa, Homo Sapiens
TPKSQVGTL

SEQ ID NO: 64359 - protein, 9 aa, Homo Sapiens
TPKWITPVL

SEQ ID NO: 64360 - protein, 9 aa, Homo Sapiens
TPLARHRTL

SEQ ID NO: 64361 - protein, 9 aa, Homo Sapiens
TPLASFKIL

SEQ ID NO: 64362 - protein, 9 aa, Homo Sapiens
TPLCPRPAL

SEQ ID NO: 64363 - protein, 9 aa, Homo Sapiens
TPMFREYSL

SEQ ID NO: 64364 - protein, 9 aa, Homo Sapiens
TPMGPGRTV

SEQ ID NO: 64365 - protein, 9 aa, Homo Sapiens
TPNDGRCHL

SEQ ID NO: 64366 - protein, 9 aa, Homo Sapiens
TPNENRQKL

SEQ ID NO: 64367 - protein, 9 aa, Homo Sapiens
TPNEYIKTL

SEQ ID NO: 64368 - protein, 9 aa, Homo Sapiens
TPNGAKDCL

SEQ ID NO: 64369 - protein, 9 aa, Homo Sapiens
TPNHKKWKV

SEQ ID NO: 64370 - protein, 9 aa, Homo Sapiens
TPQAKKIKL

SEQ ID NO: 64371 - protein, 9 aa, Homo Sapiens
TPQDRQCVL

SEQ ID NO: 64372 - protein, 9 aa, Homo Sapiens
TPQGFRSTL

SEQ ID NO: 64373 - protein, 9 aa, Homo Sapiens
TPQSNRPVM

SEQ ID NO: 64374 - protein, 9 aa, Homo Sapiens
TPRHKQPTL

SEQ ID NO: 64375 - protein, 9 aa, Homo Sapiens
TPRLPQRNL

SEQ ID NO: 64376 - protein, 9 aa, Homo Sapiens
TPRNLNRSL

SEQ ID NO: 64377 - protein, 9 aa, Homo Sapiens
TPRPMTAEL

SEQ ID NO: 64378 - protein, 9 aa, Homo Sapiens
TPRPPGPGL

SEQ ID NO: 64379 - protein, 9 aa, Homo Sapiens
TPRRPAGLL

SEQ ID NO: 64380 - protein, 9 aa, Homo Sapiens
TPRSGGHLM

SEQ ID NO: 64381 - protein, 9 aa, Homo Sapiens
TPSAGKAML

SEQ ID NO: 64382 - protein, 9 aa, Homo Sapiens
TPSDGRPEL

SEQ ID NO: 64383 - protein, 9 aa, Homo Sapiens
TPSEPHPVL

SEQ ID NO: 64384 - protein, 9 aa, Homo Sapiens
TPSSVRKQL

SEQ ID NO: 64385 - protein, 9 aa, Homo Sapiens
TPTEKPKLL

SEQ ID NO: 64386 - protein, 9 aa, Homo Sapiens
TPVASRQSL

SEQ ID NO: 64387 - protein, 9 aa, Homo Sapiens
TPWPRGRLL

SEQ ID NO: 64388 - protein, 9 aa, Homo Sapiens
TRLIKPKVM

SEQ ID NO: 64389 - protein, 9 aa, Homo Sapiens
TVKAHPKYL

SEQ ID NO: 64390 - protein, 9 aa, Homo Sapiens
TVKPLTLEL

SEQ ID NO: 64391 - protein, 9 aa, Homo Sapiens
VARRVLQAL

SEQ ID NO: 64392 - protein, 9 aa, Homo Sapiens
VINGNIKTV

SEQ ID NO: 64393 - protein, 9 aa, Homo Sapiens
VINTHTKVL

SEQ ID NO: 64394 - protein, 9 aa, Homo Sapiens
VPAEPKLAF

SEQ ID NO: 64395 - protein, 9 aa, Homo Sapiens
VPAQSRPCV

SEQ ID NO: 64396 - protein, 9 aa, Homo Sapiens
VPASKRPPL

SEQ ID NO: 64397 - protein, 9 aa, Homo Sapiens
VPEEARPAL

SEQ ID NO: 64398 - protein, 9 aa, Homo Sapiens
VPESHRKPL

SEQ ID NO: 64399 - protein, 9 aa, Homo Sapiens
VPFERPAVI

SEQ ID NO: 64400 - protein, 9 aa, Homo Sapiens
VPFFPARVL

SEQ ID NO: 64401 - protein, 9 aa, Homo Sapiens
VPHGHITSL

SEQ ID NO: 64402 - protein, 9 aa, Homo Sapiens
VPKKAWRKL

SEQ ID NO: 64403 - protein, 9 aa, Homo Sapiens
VPKLKVCAL

SEQ ID NO: 64404 - protein, 9 aa, Homo Sapiens
VPKPFRPIL

SEQ ID NO: 64405 - protein, 9 aa, Homo Sapiens
VPKPRIKII

SEQ ID NO: 64406 - protein, 9 aa, Homo Sapiens
VPKQPPKTL

SEQ ID NO: 64407 - protein, 9 aa, Homo Sapiens
VPKSGTPQL

SEQ ID NO: 64408 - protein, 9 aa, Homo Sapiens
VPLPVKVCF

SEQ ID NO: 64409 - protein, 9 aa, Homo Sapiens
VPMFRNVSL

SEQ ID NO: 64410 - protein, 9 aa, Homo Sapiens
VPMSALKSV

SEQ ID NO: 64411 - protein, 9 aa, Homo Sapiens
VPNAGRGLV

SEQ ID NO: 64412 - protein, 9 aa, Homo Sapiens
VPNPRIKLI

SEQ ID NO: 64413 - protein, 9 aa, Homo Sapiens
VPNPSLKTF

SEQ ID NO: 64414 - protein, 9 aa, Homo Sapiens
VPNQKRLTL

SEQ ID NO: 64415 - protein, 9 aa, Homo Sapiens
VPPPPHRPL

SEQ ID NO: 64416 - protein, 9 aa, Homo Sapiens
VPRFYIRIL

SEQ ID NO: 64417 - protein, 9 aa, Homo Sapiens
VPRGQGSQF

SEQ ID NO: 64418 - protein, 9 aa, Homo Sapiens
VPRPGKAAF

SEQ ID NO: 64419 - protein, 9 aa, Homo Sapiens
VPRPIFSQL

SEQ ID NO: 64420 - protein, 9 aa, Homo Sapiens
VPRPPQTSL

SEQ ID NO: 64421 - protein, 9 aa, Homo Sapiens
VPRPVLRAL

SEQ ID NO: 64422 - protein, 9 aa, Homo Sapiens
VPRQNVPVI

SEQ ID NO: 64423 - protein, 9 aa, Homo Sapiens
VPRTERPAL

SEQ ID NO: 64424 - protein, 9 aa, Homo Sapiens
VPRVPTHTL

SEQ ID NO: 64425 - protein, 9 aa, Homo Sapiens
VPSEGKKSL

SEQ ID NO: 64426 - protein, 9 aa, Homo Sapiens
VPTKHAKVL

SEQ ID NO: 64427 - protein, 9 aa, Homo Sapiens
VPTTKKKML

SEQ ID NO: 64428 - protein, 9 aa, Homo Sapiens
VVKKHIKEL

SEQ ID NO: 64429 - protein, 9 aa, Homo Sapiens
VVKPPGSSL

SEQ ID NO: 64430 - protein, 9 aa, Homo Sapiens
VVPPFLQPE

SEQ ID NO: 64431 - protein, 9 aa, Homo Sapiens
WPQPDKPMF

SEQ ID NO: 64432 - protein, 9 aa, Homo Sapiens
YAKRPGIGL

SEQ ID NO: 64433 - protein, 9 aa, Homo Sapiens
YLRPPNTSL

SEQ ID NO: 64434 - protein, 9 aa, Homo Sapiens
YPAAKRVKL

SEQ ID NO: 64435 - protein, 9 aa, Homo Sapiens
YPGQPHPAL

SEQ ID NO: 64436 - protein, 9 aa, Homo Sapiens
YPHLHNAEL

SEQ ID NO: 64437 - protein, 9 aa, Homo Sapiens
YPKRPLLGL

SEQ ID NO: 64438 - protein, 9 aa, Homo Sapiens
YPLESRPSL

SEQ ID NO: 64439 - protein, 9 aa, Homo Sapiens
YPNRGNTCL

SEQ ID NO: 64440 - protein, 9 aa, Homo Sapiens
YPNVGKSSF

SEQ ID NO: 64441 - protein, 9 aa, Homo Sapiens
YPNVNIHNF

SEQ ID NO: 64442 - protein, 9 aa, Homo Sapiens
YPRKGRIAV

SEQ ID NO: 64443 - protein, 9 aa, Homo Sapiens
YPRSLFPSL

SEQ ID NO: 64444 - protein, 9 aa, Homo Sapiens
YPSAYIKVF

SEQ ID NO: 64445 - protein, 9 aa, Homo Sapiens
YPSEKRGEL

SEQ ID NO: 64446 - protein, 9 aa, Homo Sapiens
YPSSGAKSL

SEQ ID NO: 64447 - protein, 9 aa, Homo Sapiens
YVKSTKLVL

SEQ ID NO: 64448 - protein, 9 aa, Homo Sapiens
YVMDTRPKL

SEQ ID NO: 64449 - protein, 10 aa, Homo Sapiens
AAKPPARKAL

SEQ ID NO: 64450 - protein, 10 aa, Homo Sapiens
AASWEHIKAV

SEQ ID NO: 64451 - protein, 10 aa, Homo Sapiens
AGPLRAPLLL

SEQ ID NO: 64452 - protein, 10 aa, Homo Sapiens
APAAGAGRLL

SEQ ID NO: 64453 - protein, 10 aa, Homo Sapiens
APAGGDKKVI

SEQ ID NO: 64454 - protein, 10 aa, Homo Sapiens
APAGGSPRML

SEQ ID NO: 64455 - protein, 10 aa, Homo Sapiens
APAPAEKTPV

SEQ ID NO: 64456 - protein, 10 aa, Homo Sapiens
APAPRSGECL

SEQ ID NO: 64457 - protein, 10 aa, Homo Sapiens
APAPSKGQTL

SEQ ID NO: 64458 - protein, 10 aa, Homo Sapiens
APDGSQRAVL

SEQ ID NO: 64459 - protein, 10 aa, Homo Sapiens
APDSQRLKLL

SEQ ID NO: 64460 - protein, 10 aa, Homo Sapiens
APFDRRATSL

SEQ ID NO: 64461 - protein, 10 aa, Homo Sapiens
APGASKLRAV

SEQ ID NO: 64462 - protein, 10 aa, Homo Sapiens
APHARNGLSL

SEQ ID NO: 64463 - protein, 10 aa, Homo Sapiens
APHEPDGVAL

SEQ ID NO: 64464 - protein, 10 aa, Homo Sapiens
APIDRVGQTI

SEQ ID NO: 64465 - protein, 10 aa, Homo Sapiens
APIIRVGGAL

SEQ ID NO: 64466 - protein, 10 aa, Homo Sapiens
APINKAGSFL

SEQ ID NO: 64467 - protein, 10 aa, Homo Sapiens
APIQGNREEL

SEQ ID NO: 64468 - protein, 10 aa, Homo Sapiens
APKAVWLPAM

SEQ ID NO: 64469 - protein, 10 aa, Homo Sapiens
APKGPSRESV

SEQ ID NO: 64470 - protein, 10 aa, Homo Sapiens
APKHFLPEML

SEQ ID NO: 64471 - protein, 10 aa, Homo Sapiens
APKKKIQTTL

SEQ ID NO: 64472 - protein, 10 aa, Homo Sapiens
APKKPTGVDL

SEQ ID NO: 64473 - protein, 10 aa, Homo Sapiens
APKPAAPTTL

SEQ ID NO: 64474 - protein, 10 aa, Homo Sapiens
APKPPFQSHF

SEQ ID NO: 64475 - protein, 10 aa, Homo Sapiens
APKPSSRPSL

SEQ ID NO: 64476 - protein, 10 aa, Homo Sapiens
APKRPPSAFF

SEQ ID NO: 64477 - protein, 10 aa, Homo Sapiens
APKSGNTGEL

SEQ ID NO: 64478 - protein, 10 aa, Homo Sapiens
APKSMQSAIM

SEQ ID NO: 64479 - protein, 10 aa, Homo Sapiens
APKYGSYNVF

SEQ ID NO: 64480 - protein, 10 aa, Homo Sapiens
APLAGKGKQL

SEQ ID NO: 64481 - protein, 10 aa, Homo Sapiens
APLLVHVSSF

SEQ ID NO: 64482 - protein, 10 aa, Homo Sapiens
APLNEAMAVL

SEQ ID NO: 64483 - protein, 10 aa, Homo Sapiens
APNASNLKIV

SEQ ID NO: 64484 - protein, 10 aa, Homo Sapiens
APNEKMKQVL

SEQ ID NO: 64485 - protein, 10 aa, Homo Sapiens
APNPQDRKKF

SEQ ID NO: 64486 - protein, 10 aa, Homo Sapiens
APPEYHRKAV

SEQ ID NO: 64487 - protein, 10 aa, Homo Sapiens
APQTQHVSPM

SEQ ID NO: 64488 - protein, 10 aa, Homo Sapiens
APRARHLQSL

SEQ ID NO: 64489 - protein, 10 aa, Homo Sapiens
APRDAYWIAM

SEQ ID NO: 64490 - protein, 10 aa, Homo Sapiens
APREPPPVEL

SEQ ID NO: 64491 - protein, 10 aa, Homo Sapiens
APRGFLKRVF

SEQ ID NO: 64492 - protein, 10 aa, Homo Sapiens
APRHPSTNSL

SEQ ID NO: 64493 - protein, 10 aa, Homo Sapiens
APRIALHTAL

SEQ ID NO: 64494 - protein, 10 aa, Homo Sapiens
APRKVLGSST

SEQ ID NO: 64495 - protein, 10 aa, Homo Sapiens
APRNSNLREL

SEQ ID NO: 64496 - protein, 10 aa, Homo Sapiens
APRPASGPIR

SEQ ID NO: 64497 - protein, 10 aa, Homo Sapiens
APRPNPAQSL

SEQ ID NO: 64498 - protein, 10 aa, Homo Sapiens
APRSVAVSSI

SEQ ID NO: 64499 - protein, 10 aa, Homo Sapiens
APRTIFQRVL

SEQ ID NO: 64500 - protein, 10 aa, Homo Sapiens
APRTVALTAL

SEQ ID NO: 64501 - protein, 10 aa, Homo Sapiens
APRWGNPRAL

SEQ ID NO: 64502 - protein, 10 aa, Homo Sapiens
APSAARELSL

SEQ ID NO: 64503 - protein, 10 aa, Homo Sapiens
APSEDIWKKF

SEQ ID NO: 64504 - protein, 10 aa, Homo Sapiens
APSGGRLLSA

SEQ ID NO: 64505 - protein, 10 aa, Homo Sapiens
APSPADPRVL

SEQ ID NO: 64506 - protein, 10 aa, Homo Sapiens
APSPTHVAEL

SEQ ID NO: 64507 - protein, 10 aa, Homo Sapiens
APSQQRLVVV

SEQ ID NO: 64508 - protein, 10 aa, Homo Sapiens
APSRIFWRTV

SEQ ID NO: 64509 - protein, 10 aa, Homo Sapiens
APSTMKIKII

SEQ ID NO: 64510 - protein, 10 aa, Homo Sapiens
APWGGVAKTL

SEQ ID NO: 64511 - protein, 10 aa, Homo Sapiens
APWSGRFYSL

SEQ ID NO: 64512 - protein, 10 aa, Homo Sapiens
APYERRAMEL

SEQ ID NO: 64513 - protein, 10 aa, Homo Sapiens
ASPKSPTAAL

SEQ ID NO: 64514 - protein, 10 aa, Homo Sapiens
AVAKSKLREL

SEQ ID NO: 64515 - protein, 10 aa, Homo Sapiens
AVRELDGRTL

SEQ ID NO: 64516 - protein, 10 aa, Homo Sapiens
AVSAAIVKEL

SEQ ID NO: 64517 - protein, 10 aa, Homo Sapiens
AVSDGVIKVF

SEQ ID NO: 64518 - protein, 10 aa, Homo Sapiens
EAIKNVNTAL

SEQ ID NO: 64519 - protein, 10 aa, Homo Sapiens
EEQLQQIRAE

SEQ ID NO: 64520 - protein, 10 aa, Homo Sapiens
FPKGYRHPAL

SEQ ID NO: 64521 - protein, 10 aa, Homo Sapiens
FPMLPKQPML

SEQ ID NO: 64522 - protein, 10 aa, Homo Sapiens
FPQKLRPRLL

SEQ ID NO: 64523 - protein, 10 aa, Homo Sapiens
GAAVRIGSVL

SEQ ID NO: 64524 - protein, 10 aa, Homo Sapiens
GPKPGGGPGL

SEQ ID NO: 64525 - protein, 10 aa, Homo Sapiens
GPNERIGMVV

SEQ ID NO: 64526 - protein, 10 aa, Homo Sapiens
GPSIVHRKCF

SEQ ID NO: 64527 - protein, 10 aa, Homo Sapiens
GPSSNKPRVI

SEQ ID NO: 64528 - protein, 10 aa, Homo Sapiens
GPWRDKDPAL

SEQ ID NO: 64529 - protein, 10 aa, Homo Sapiens
GVSSSHVRVL

SEQ ID NO: 64530 - protein, 10 aa, Homo Sapiens
HPFPESKPVL

SEQ ID NO: 64531 - protein, 10 aa, Homo Sapiens
HPKFQKPKQL

SEQ ID NO: 64532 - protein, 10 aa, Homo Sapiens
HPKPSGKPLP

SEQ ID NO: 64533 - protein, 10 aa, Homo Sapiens
HPKTPLPPEL

SEQ ID NO: 64534 - protein, 10 aa, Homo Sapiens
HPMKPHRIRM

SEQ ID NO: 64535 - protein, 10 aa, Homo Sapiens
HPMKPHRLAL

SEQ ID NO: 64536 - protein, 10 aa, Homo Sapiens
HPPNYKKPVL

SEQ ID NO: 64537 - protein, 10 aa, Homo Sapiens
HPREPLPPIQ

SEQ ID NO: 64538 - protein, 10 aa, Homo Sapiens
HPRSPNVLSV

SEQ ID NO: 64539 - protein, 10 aa, Homo Sapiens
HPYHFKPKKI

SEQ ID NO: 64540 - protein, 10 aa, Homo Sapiens
IAKRPPLQSL

SEQ ID NO: 64541 - protein, 10 aa, Homo Sapiens
IPFVIPRPIL

SEQ ID NO: 64542 - protein, 10 aa, Homo Sapiens
IPKKAFLRAL

SEQ ID NO: 64543 - protein, 10 aa, Homo Sapiens
IVSNTLVRAL

SEQ ID NO: 64544 - protein, 10 aa, Homo Sapiens
KPFSQHVRKL

SEQ ID NO: 64545 - protein, 10 aa, Homo Sapiens
KPHSGFHVAF

SEQ ID NO: 64546 - protein, 10 aa, Homo Sapiens
KPIFSKIVSL

SEQ ID NO: 64547 - protein, 10 aa, Homo Sapiens
KPKAAKPKVV

SEQ ID NO: 64548 - protein, 10 aa, Homo Sapiens
KPKDPLKISL

SEQ ID NO: 64549 - protein, 10 aa, Homo Sapiens
KPKEHKKLFL

SEQ ID NO: 64550 - protein, 10 aa, Homo Sapiens
KPKENNFKAV

SEQ ID NO: 64551 - protein, 10 aa, Homo Sapiens
KPKPGHTPIF

SEQ ID NO: 64552 - protein, 10 aa, Homo Sapiens
KPKPTHKPTL

SEQ ID NO: 64553 - protein, 10 aa, Homo Sapiens
KPKPTNPVEI

SEQ ID NO: 64554 - protein, 10 aa, Homo Sapiens
KPKPVKPVTF

SEQ ID NO: 64555 - protein, 10 aa, Homo Sapiens
KPKRDRHIML

SEQ ID NO: 64556 - protein, 10 aa, Homo Sapiens
KPKSEIHVSM

SEQ ID NO: 64557 - protein, 10 aa, Homo Sapiens
KPNDSRALQL

SEQ ID NO: 64558 - protein, 10 aa, Homo Sapiens
KPNKPKPCGL

SEQ ID NO: 64559 - protein, 10 aa, Homo Sapiens
KPNPNQIISV

SEQ ID NO: 64560 - protein, 10 aa, Homo Sapiens
KPQEEQKTSL

SEQ ID NO: 64561 - protein, 10 aa, Homo Sapiens
KPQQKGLRLL

SEQ ID NO: 64562 - protein, 10 aa, Homo Sapiens
KPRVPPATAF

SEQ ID NO: 64563 - protein, 10 aa, Homo Sapiens
KPSEERVREI

SEQ ID NO: 64564 - protein, 10 aa, Homo Sapiens
KPSTAHHRPL

SEQ ID NO: 64565 - protein, 10 aa, Homo Sapiens
KPSTNVKKSI

SEQ ID NO: 64566 - protein, 10 aa, Homo Sapiens
KPTDEKLREL

SEQ ID NO: 64567 - protein, 10 aa, Homo Sapiens
KPTSERKVSL

SEQ ID NO: 64568 - protein, 10 aa, Homo Sapiens
KVPQLEIVPN

SEQ ID NO: 64569 - protein, 10 aa, Homo Sapiens
KVRGQTPKVA

SEQ ID NO: 64570 - protein, 10 aa, Homo Sapiens
LPKDQQITAL

SEQ ID NO: 64571 - protein, 10 aa, Homo Sapiens
LPKIPSNATL

SEQ ID NO: 64572 - protein, 10 aa, Homo Sapiens
LPKKPCKNLL

SEQ ID NO: 64573 - protein, 10 aa, Homo Sapiens
LPKKPCKNLM

SEQ ID NO: 64574 - protein, 10 aa, Homo Sapiens
LPKKPKKVAF

SEQ ID NO: 64575 - protein, 10 aa, Homo Sapiens
LPKPGGAHSL

SEQ ID NO: 64576 - protein, 10 aa, Homo Sapiens
LPKPHGIRAL

SEQ ID NO: 64577 - protein, 10 aa, Homo Sapiens
LPKQEKRHVL

SEQ ID NO: 64578 - protein, 10 aa, Homo Sapiens
LPKSPPYTAF

SEQ ID NO: 64579 - protein, 10 aa, Homo Sapiens
LPPLPKRPAL

SEQ ID NO: 64580 - protein, 10 aa, Homo Sapiens
LPRAVGTQTL

SEQ ID NO: 64581 - protein, 10 aa, Homo Sapiens
LPRGSIPRSL

SEQ ID NO: 64582 - protein, 10 aa, Homo Sapiens
LPSDLRTISL

SEQ ID NO: 64583 - protein, 10 aa, Homo Sapiens
LPSSIRTKAL

SEQ ID NO: 64584 - protein, 10 aa, Homo Sapiens
LPSSKLIRIL

SEQ ID NO: 64585 - protein, 10 aa, Homo Sapiens
MPCSVIRPIL

SEQ ID NO: 64586 - protein, 10 aa, Homo Sapiens
MPHPATGKTV

SEQ ID NO: 64587 - protein, 10 aa, Homo Sapiens
MPKEPHIREM

SEQ ID NO: 64588 - protein, 10 aa, Homo Sapiens
MPKKDARTLL

SEQ ID NO: 64589 - protein, 10 aa, Homo Sapiens
MPRQPSATRL

SEQ ID NO: 64590 - protein, 10 aa, Homo Sapiens
MPSASRVILL

SEQ ID NO: 64591 - protein, 10 aa, Homo Sapiens
MPYSNGRPAL

SEQ ID NO: 64592 - protein, 10 aa, Homo Sapiens
NPKPASPRFL

SEQ ID NO: 64593 - protein, 10 aa, Homo Sapiens
NPMGGYGKTI

SEQ ID NO: 64594 - protein, 10 aa, Homo Sapiens
NPNQNKNVAL

SEQ ID NO: 64595 - protein, 10 aa, Homo Sapiens
NPSPWIYREL

SEQ ID NO: 64596 - protein, 10 aa, Homo Sapiens
QLMKPKKTEI

SEQ ID NO: 64597 - protein, 10 aa, Homo Sapiens
QPAATKIRNL

SEQ ID NO: 64598 - protein, 10 aa, Homo Sapiens
QPANKGFRAL

SEQ ID NO: 64599 - protein, 10 aa, Homo Sapiens
QPDQTRIVAL

SEQ ID NO: 64600 - protein, 10 aa, Homo Sapiens
QPFAWKKKAL

SEQ ID NO: 64601 - protein, 10 aa, Homo Sapiens
QPKKVKGVGF

SEQ ID NO: 64602 - protein, 10 aa, Homo Sapiens
QPKQKIRVAL

SEQ ID NO: 64603 - protein, 10 aa, Homo Sapiens
QPNGKVFKKL

SEQ ID NO: 64604 - protein, 10 aa, Homo Sapiens
QPNRYTNRVV

SEQ ID NO: 64605 - protein, 10 aa, Homo Sapiens
RIKKPIKTKF

SEQ ID NO: 64606 - protein, 10 aa, Homo Sapiens
RPAACGRTSL

SEQ ID NO: 64607 - protein, 10 aa, Homo Sapiens
RPAAPGQTPL

SEQ ID NO: 64608 - protein, 10 aa, Homo Sapiens
RPANHRQLTF

SEQ ID NO: 64609 - protein, 10 aa, Homo Sapiens
RPAPHFERTA

SEQ ID NO: 64610 - protein, 10 aa, Homo Sapiens
RPDPNTGKVH

SEQ ID NO: 64611 - protein, 10 aa, Homo Sapiens
RPFERRLYVL

SEQ ID NO: 64612 - protein, 10 aa, Homo Sapiens
RPFHNGVKCL

SEQ ID NO: 64613 - protein, 10 aa, Homo Sapiens
RPFSGRRLPV

SEQ ID NO: 64614 - protein, 10 aa, Homo Sapiens
RPFVGHTRSV

SEQ ID NO: 64615 - protein, 10 aa, Homo Sapiens
RPHKVDGRVV

SEQ ID NO: 64616 - protein, 10 aa, Homo Sapiens
RPHSIDGRVV

SEQ ID NO: 64617 - protein, 10 aa, Homo Sapiens
RPIGSRKVKL

SEQ ID NO: 64618 - protein, 10 aa, Homo Sapiens
RPIKPPRKDL

SEQ ID NO: 64619 - protein, 10 aa, Homo Sapiens
RPKAISPYHL

SEQ ID NO: 64620 - protein, 10 aa, Homo Sapiens
RPKARNEVRL

SEQ ID NO: 64621 - protein, 10 aa, Homo Sapiens
RPKEDTQKLL

SEQ ID NO: 64622 - protein, 10 aa, Homo Sapiens
RPKEIKVSKM

SEQ ID NO: 64623 - protein, 10 aa, Homo Sapiens
RPKENSMSTL

SEQ ID NO: 64624 - protein, 10 aa, Homo Sapiens
RPKKEKSSFL

SEQ ID NO: 64625 - protein, 10 aa, Homo Sapiens
RPKLPEDPLL

SEQ ID NO: 64626 - protein, 10 aa, Homo Sapiens
RPKNDLGHPF

SEQ ID NO: 64627 - protein, 10 aa, Homo Sapiens
RPKPKTLHEL

SEQ ID NO: 64628 - protein, 10 aa, Homo Sapiens
RPKPPNVRTA

SEQ ID NO: 64629 - protein, 10 aa, Homo Sapiens
RPKPPSATSI

SEQ ID NO: 64630 - protein, 10 aa, Homo Sapiens
RPKPSASEVL

SEQ ID NO: 64631 - protein, 10 aa, Homo Sapiens
RPKQEKAFSL

SEQ ID NO: 64632 - protein, 10 aa, Homo Sapiens
RPKQPGPVKL

SEQ ID NO: 64633 - protein, 10 aa, Homo Sapiens
RPKSFILPKL

SEQ ID NO: 64634 - protein, 10 aa, Homo Sapiens
RPKTVRDTLL

SEQ ID NO: 64635 - protein, 10 aa, Homo Sapiens
RPKVVRSVHY

SEQ ID NO: 64636 - protein, 10 aa, Homo Sapiens
RPLRPKPPLL

SEQ ID NO: 64637 - protein, 10 aa, Homo Sapiens
RPMPPEARRL

SEQ ID NO: 64638 - protein, 10 aa, Homo Sapiens
RPNDSRMLVA

SEQ ID NO: 64639 - protein, 10 aa, Homo Sapiens
RPNGTKVAVL

SEQ ID NO: 64640 - protein, 10 aa, Homo Sapiens
RPNSKIKVKF

SEQ ID NO: 64641 - protein, 10 aa, Homo Sapiens
RPPRGPLAEL

SEQ ID NO: 64642 - protein, 10 aa, Homo Sapiens
RPQASAWKKL

SEQ ID NO: 64643 - protein, 10 aa, Homo Sapiens
RPQLHKNTVL

SEQ ID NO: 64644 - protein, 10 aa, Homo Sapiens
RPQLHQKSIM

SEQ ID NO: 64645 - protein, 10 aa, Homo Sapiens
RPQPQPRPAL

SEQ ID NO: 64646 - protein, 10 aa, Homo Sapiens
RPQSSRPVLL

SEQ ID NO: 64647 - protein, 10 aa, Homo Sapiens
RPRDPFTKKL

SEQ ID NO: 64648 - protein, 10 aa, Homo Sapiens
RPREAEVRFL

SEQ ID NO: 64649 - protein, 10 aa, Homo Sapiens
RPRKAFLLLL

SEQ ID NO: 64650 - protein, 10 aa, Homo Sapiens
RPRKDPLRHL

SEQ ID NO: 64651 - protein, 10 aa, Homo Sapiens
RPRPDEERPL

SEQ ID NO: 64652 - protein, 10 aa, Homo Sapiens
RPRPHSAPSL

SEQ ID NO: 64653 - protein, 10 aa, Homo Sapiens
RPRPNTFIIR

SEQ ID NO: 64654 - protein, 10 aa, Homo Sapiens
RPRPNTFVIR

SEQ ID NO: 64655 - protein, 10 aa, Homo Sapiens
RPSDEVIREL

SEQ ID NO: 64656 - protein, 10 aa, Homo Sapiens
RPSDSQSKRL

SEQ ID NO: 64657 - protein, 10 aa, Homo Sapiens
RPSEKNQHIM

SEQ ID NO: 64658 - protein, 10 aa, Homo Sapiens
RPSLVHSRDM

SEQ ID NO: 64659 - protein, 10 aa, Homo Sapiens
RPSPCNGRKI

SEQ ID NO: 64660 - protein, 10 aa, Homo Sapiens
RPSSKKTYSL

SEQ ID NO: 64661 - protein, 10 aa, Homo Sapiens
RPVAPSGTAL

SEQ ID NO: 64662 - protein, 10 aa, Homo Sapiens
RPWEKNSTTL

SEQ ID NO: 64663 - protein, 10 aa, Homo Sapiens
RPWLEGRHTL

SEQ ID NO: 64664 - protein, 10 aa, Homo Sapiens
RPYAAGGKKL

SEQ ID NO: 64665 - protein, 10 aa, Homo Sapiens
RSFKGHVRKM

SEQ ID NO: 64666 - protein, 10 aa, Homo Sapiens
RTFDRALRAL

SEQ ID NO: 64667 - protein, 10 aa, Homo Sapiens
RVKEPVKELL

SEQ ID NO: 64668 - protein, 10 aa, Homo Sapiens
RVKPPKESAL

SEQ ID NO: 64669 - protein, 10 aa, Homo Sapiens
RVKPYIRTSL

SEQ ID NO: 64670 - protein, 10 aa, Homo Sapiens
RVKVGSRLTL

SEQ ID NO: 64671 - protein, 10 aa, Homo Sapiens
RVRSFLRGLP

SEQ ID NO: 64672 - protein, 10 aa, Homo Sapiens
SPAGSIVHEL

SEQ ID NO: 64673 - protein, 10 aa, Homo Sapiens
SPAIMSPKLF

SEQ ID NO: 64674 - protein, 10 aa, Homo Sapiens
SPAKGQKPAL

SEQ ID NO: 64675 - protein, 10 aa, Homo Sapiens
SPALTISKVL

SEQ ID NO: 64676 - protein, 10 aa, Homo Sapiens
SPATTVVRTL

SEQ ID NO: 64677 - protein, 10 aa, Homo Sapiens
SPCQDFGKRM

SEQ ID NO: 64678 - protein, 10 aa, Homo Sapiens
SPGPTWGRVV

SEQ ID NO: 64679 - protein, 10 aa, Homo Sapiens
SPHAAHLKKL

SEQ ID NO: 64680 - protein, 10 aa, Homo Sapiens
SPHTPRRTSL

SEQ ID NO: 64681 - protein, 10 aa, Homo Sapiens
SPKAALRYAA

SEQ ID NO: 64682 - protein, 10 aa, Homo Sapiens
SPKESRSKFF

SEQ ID NO: 64683 - protein, 10 aa, Homo Sapiens
SPKGCGTVLL

SEQ ID NO: 64684 - protein, 10 aa, Homo Sapiens
SPKKAKSRLI

SEQ ID NO: 64685 - protein, 10 aa, Homo Sapiens
SPKPALCVTL

SEQ ID NO: 64686 - protein, 10 aa, Homo Sapiens
SPKPPSSFKM

SEQ ID NO: 64687 - protein, 10 aa, Homo Sapiens
SPKTPGCSDL

SEQ ID NO: 64688 - protein, 10 aa, Homo Sapiens
SPLKGHERTV

SEQ ID NO: 64689 - protein, 10 aa, Homo Sapiens
SPLPQKKMTM

SEQ ID NO: 64690 - protein, 10 aa, Homo Sapiens
SPLQIERSLS

SEQ ID NO: 64691 - protein, 10 aa, Homo Sapiens
SPMEGTGISL

SEQ ID NO: 64692 - protein, 10 aa, Homo Sapiens
SPMHERVTSF

SEQ ID NO: 64693 - protein, 10 aa, Homo Sapiens
SPNGNLIRML

SEQ ID NO: 64694 - protein, 10 aa, Homo Sapiens
SPNGPKMGLL

SEQ ID NO: 64695 - protein, 10 aa, Homo Sapiens
SPNGTIRNIL

SEQ ID NO: 64696 - protein, 10 aa, Homo Sapiens
SPNPDREAIL

SEQ ID NO: 64697 - protein, 10 aa, Homo Sapiens
SPPELKRPRL

SEQ ID NO: 64698 - protein, 10 aa, Homo Sapiens
SPPSAARHSL

SEQ ID NO: 64699 - protein, 10 aa, Homo Sapiens
SPQEKPLRTL

SEQ ID NO: 64700 - protein, 10 aa, Homo Sapiens
SPQPPKKDSL

SEQ ID NO: 64701 - protein, 10 aa, Homo Sapiens
SPQSGNFRQL

SEQ ID NO: 64702 - protein, 10 aa, Homo Sapiens
SPREEPRAPW

SEQ ID NO: 64703 - protein, 10 aa, Homo Sapiens
SPRKAIHSDF

SEQ ID NO: 64704 - protein, 10 aa, Homo Sapiens
SPRPNHSYIF

SEQ ID NO: 64705 - protein, 10 aa, Homo Sapiens
SPRPPLGSSL

SEQ ID NO: 64706 - protein, 10 aa, Homo Sapiens
SPRSSLNNSL

SEQ ID NO: 64707 - protein, 10 aa, Homo Sapiens
SPSRNRSLQL

SEQ ID NO: 64708 - protein, 10 aa, Homo Sapiens
SPSSVTGNAL

SEQ ID NO: 64709 - protein, 10 aa, Homo Sapiens
SPTFRRPKTL

SEQ ID NO: 64710 - protein, 10 aa, Homo Sapiens
SPTPRIKAEL

SEQ ID NO: 64711 - protein, 10 aa, Homo Sapiens
SPTPVSWHVM

SEQ ID NO: 64712 - protein, 10 aa, Homo Sapiens
SPVSGTPKQL

SEQ ID NO: 64713 - protein, 10 aa, Homo Sapiens
SSPKLPVSSL

SEQ ID NO: 64714 - protein, 10 aa, Homo Sapiens
TAKPQSTTSL

SEQ ID NO: 64715 - protein, 10 aa, Homo Sapiens
TPDQGKARLL

SEQ ID NO: 64716 - protein, 10 aa, Homo Sapiens
TPKPQTKELM

SEQ ID NO: 64717 - protein, 10 aa, Homo Sapiens
TPKQKPKTPF

SEQ ID NO: 64718 - protein, 10 aa, Homo Sapiens
TPKSTPVKTL

SEQ ID NO: 64719 - protein, 10 aa, Homo Sapiens
TPMSSHGRVL

SEQ ID NO: 64720 - protein, 10 aa, Homo Sapiens
TPSGHIKRPM

SEQ ID NO: 64721 - protein, 10 aa, Homo Sapiens
TPTSAPRSVM

SEQ ID NO: 64722 - protein, 10 aa, Homo Sapiens
VPAPQHLKTL

SEQ ID NO: 64723 - protein, 10 aa, Homo Sapiens
VPASQKLRQL

SEQ ID NO: 64724 - protein, 10 aa, Homo Sapiens
VPAYDKIRVL

SEQ ID NO: 64725 - protein, 10 aa, Homo Sapiens
VPKKPGPPVL

SEQ ID NO: 64726 - protein, 10 aa, Homo Sapiens
VPKPGAGSKL

SEQ ID NO: 64727 - protein, 10 aa, Homo Sapiens
VPKPPSIEEF

SEQ ID NO: 64728 - protein, 10 aa, Homo Sapiens
VPNGALKKSL

SEQ ID NO: 64729 - protein, 10 aa, Homo Sapiens
VPRPAARVAL

SEQ ID NO: 64730 - protein, 10 aa, Homo Sapiens
VPRQPTVTSV

SEQ ID NO: 64731 - protein, 10 aa, Homo Sapiens
VSRAKAVRAL

SEQ ID NO: 64732 - protein, 10 aa, Homo Sapiens
VVPPFLQPEV

SEQ ID NO: 64733 - protein, 10 aa, Homo Sapiens
WPKDVGIVAL

SEQ ID NO: 64734 - protein, 10 aa, Homo Sapiens
YPARYRPTAL

SEQ ID NO: 64735 - protein, 10 aa, Homo Sapiens
YPFKPPKVAF

SEQ ID NO: 64736 - protein, 10 aa, Homo Sapiens
YPKKPKDEAF

SEQ ID NO: 64737 - protein, 10 aa, Homo Sapiens
YPMDLGGRNF

SEQ ID NO: 64738 - protein, 10 aa, Homo Sapiens
YPSLPKSLPL

SEQ ID NO: 64739 - protein, 11 aa, Homo Sapiens
AASKERSGVSL

SEQ ID NO: 64740 - protein, 11 aa, Homo Sapiens
AGAAVRIGSVL

SEQ ID NO: 64741 - protein, 11 aa, Homo Sapiens
APAGRKVGLIA

SEQ ID NO: 64742 - protein, 11 aa, Homo Sapiens
APAGTTSSRVL

SEQ ID NO: 64743 - protein, 11 aa, Homo Sapiens
APAIGRYIRTL

SEQ ID NO: 64744 - protein, 11 aa, Homo Sapiens
APALARTLQSL

SEQ ID NO: 64745 - protein, 11 aa, Homo Sapiens
APDAAPAPASI

SEQ ID NO: 64746 - protein, 11 aa, Homo Sapiens
APDLQRVHKRI

SEQ ID NO: 64747 - protein, 11 aa, Homo Sapiens
APKFRLHSATL

SEQ ID NO: 64748 - protein, 11 aa, Homo Sapiens
APKGTKRDPAL

SEQ ID NO: 64749 - protein, 11 aa, Homo Sapiens
APKSRQELIAL

SEQ ID NO: 64750 - protein, 11 aa, Homo Sapiens
APNLGRSFHIL

SEQ ID NO: 64751 - protein, 11 aa, Homo Sapiens
APNPAKATVTA

SEQ ID NO: 64752 - protein, 11 aa, Homo Sapiens
APNPYRSENCL

SEQ ID NO: 64753 - protein, 11 aa, Homo Sapiens
APRADEITRRL

SEQ ID NO: 64754 - protein, 11 aa, Homo Sapiens
APRHPSTNSLL

SEQ ID NO: 64755 - protein, 11 aa, Homo Sapiens
APRPASGPIRP

SEQ ID NO: 64756 - protein, 11 aa, Homo Sapiens
APRPDSRHHSL

SEQ ID NO: 64757 - protein, 11 aa, Homo Sapiens
APRQPGLMAQM

SEQ ID NO: 64758 - protein, 11 aa, Homo Sapiens
APRTVALTALL

SEQ ID NO: 64759 - protein, 11 aa, Homo Sapiens
APSAAKLLVQL

SEQ ID NO: 64760 - protein, 11 aa, Homo Sapiens
APSARRGTLAV

SEQ ID NO: 64761 - protein, 11 aa, Homo Sapiens
APSGQHSQAQL

SEQ ID NO: 64762 - protein, 11 aa, Homo Sapiens
APSSQAAARVV

SEQ ID NO: 64763 - protein, 11 aa, Homo Sapiens
APTQEKIFAVL

SEQ ID NO: 64764 - protein, 11 aa, Homo Sapiens
APYERRAMELL

SEQ ID NO: 64765 - protein, 11 aa, Homo Sapiens
APYMRSMMQSL

SEQ ID NO: 64766 - protein, 11 aa, Homo Sapiens
AVHYDRSGRSL

SEQ ID NO: 64767 - protein, 11 aa, Homo Sapiens
FPAQRPPQRTL

SEQ ID NO: 64768 - protein, 11 aa, Homo Sapiens
GPAGSRSGRLF

SEQ ID NO: 64769 - protein, 11 aa, Homo Sapiens
GPNPKSSRTTL

SEQ ID NO: 64770 - protein, 11 aa, Homo Sapiens
GPSGAAAMRSM

SEQ ID NO: 64771 - protein, 11 aa, Homo Sapiens
HPHSGSGRSVL

SEQ ID NO: 64772 - protein, 11 aa, Homo Sapiens
HPSASLIDRTI

SEQ ID NO: 64773 - protein, 11 aa, Homo Sapiens
HPSETRTLVAV

SEQ ID NO: 64774 - protein, 11 aa, Homo Sapiens
HPSVSRYHAVL

SEQ ID NO: 64775 - protein, 11 aa, Homo Sapiens
IPASSHGKRGL

SEQ ID NO: 64776 - protein, 11 aa, Homo Sapiens
IPDASKLQFIL

SEQ ID NO: 64777 - protein, 11 aa, Homo Sapiens
IPSADRHKSKL

SEQ ID NO: 64778 - protein, 11 aa, Homo Sapiens
KASELHSVRKL

SEQ ID NO: 64779 - protein, 11 aa, Homo Sapiens
KPGAHLTVKKI

SEQ ID NO: 64780 - protein, 11 aa, Homo Sapiens
KPKPNGRTVEV

SEQ ID NO: 64781 - protein, 11 aa, Homo Sapiens
KPNANRIALDF

SEQ ID NO: 64782 - protein, 11 aa, Homo Sapiens
KPNSFVKFRCM

SEQ ID NO: 64783 - protein, 11 aa, Homo Sapiens
KPQDYKKRLSV

SEQ ID NO: 64784 - protein, 11 aa, Homo Sapiens
KPSAVAPQRKM

SEQ ID NO: 64785 - protein, 11 aa, Homo Sapiens
KPSPLLVGREF

SEQ ID NO: 64786 - protein, 11 aa, Homo Sapiens
KPTPVKPNYAL

SEQ ID NO: 64787 - protein, 11 aa, Homo Sapiens
LARQAPKPRKQ

SEQ ID NO: 64788 - protein, 11 aa, Homo Sapiens
LPADHPKGRLL

SEQ ID NO: 64789 - protein, 11 aa, Homo Sapiens
LPDLQRSKQAL

SEQ ID NO: 64790 - protein, 11 aa, Homo Sapiens
LPHIEKTIRQL

SEQ ID NO: 64791 - protein, 11 aa, Homo Sapiens
LPMQEKTYRRL

SEQ ID NO: 64792 - protein, 11 aa, Homo Sapiens
LPNSQKAVKAL

SEQ ID NO: 64793 - protein, 11 aa, Homo Sapiens
LPRKNLPERLL

SEQ ID NO: 64794 - protein, 11 aa, Homo Sapiens
MPSSHRILHKL

SEQ ID NO: 64795 - protein, 11 aa, Homo Sapiens
MPSSSGSARSL

SEQ ID NO: 64796 - protein, 11 aa, Homo Sapiens
MPSSSKTKPVL

SEQ ID NO: 64797 - protein, 11 aa, Homo Sapiens
NVSRAKAVRAL

SEQ ID NO: 64798 - protein, 11 aa, Homo Sapiens
PRPDSRHHSLA

SEQ ID NO: 64799 - protein, 11 aa, Homo Sapiens
QPCPSLAQHSL

SEQ ID NO: 64800 - protein, 11 aa, Homo Sapiens
QPMSFRPRILI

SEQ ID NO: 64801 - protein, 11 aa, Homo Sapiens
RADENHPQRVL

SEQ ID NO: 64802 - protein, 11 aa, Homo Sapiens
RIKLGIKSLVS

SEQ ID NO: 64803 - protein, 11 aa, Homo Sapiens
RIMSEKITRTL

SEQ ID NO: 64804 - protein, 11 aa, Homo Sapiens
RLSQSKASKEL

SEQ ID NO: 64805 - protein, 11 aa, Homo Sapiens
RPALQHVVKVL

SEQ ID NO: 64806 - protein, 11 aa, Homo Sapiens
RPCAGRSRDIL

SEQ ID NO: 64807 - protein, 11 aa, Homo Sapiens
RPDLERICRMV

SEQ ID NO: 64808 - protein, 11 aa, Homo Sapiens
RPDVGRYLREL

SEQ ID NO: 64809 - protein, 11 aa, Homo Sapiens
RPGAHLTVKKI

SEQ ID NO: 64810 - protein, 11 aa, Homo Sapiens
RPHAPHSPIKF

SEQ ID NO: 64811 - protein, 11 aa, Homo Sapiens
RPKAKGGLASL

SEQ ID NO: 64812 - protein, 11 aa, Homo Sapiens
RPKGSEMKYAL

SEQ ID NO: 64813 - protein, 11 aa, Homo Sapiens
RPKLQHSTSIL

SEQ ID NO: 64814 - protein, 11 aa, Homo Sapiens
RPKPSSSPVIF

SEQ ID NO: 64815 - protein, 11 aa, Homo Sapiens
RPKRPPLKEFF

SEQ ID NO: 64816 - protein, 11 aa, Homo Sapiens
RPKSSQIGAVV

SEQ ID NO: 64817 - protein, 11 aa, Homo Sapiens
RPKTVRDTLLA

SEQ ID NO: 64818 - protein, 11 aa, Homo Sapiens
RPLEMIEPRTL

SEQ ID NO: 64819 - protein, 11 aa, Homo Sapiens
RPNDSRMLVAL

SEQ ID NO: 64820 - protein, 11 aa, Homo Sapiens
RPNFNIKGIRF

SEQ ID NO: 64821 - protein, 11 aa, Homo Sapiens
RPNLSHTGRGI

SEQ ID NO: 64822 - protein, 11 aa, Homo Sapiens
RPPGFYPHRVL

SEQ ID NO: 64823 - protein, 11 aa, Homo Sapiens
RPQIDKKGRAV

SEQ ID NO: 64824 - protein, 11 aa, Homo Sapiens
RPQSKAPDSTL

SEQ ID NO: 64825 - protein, 11 aa, Homo Sapiens
RPRLQLKPRTV

SEQ ID NO: 64826 - protein, 11 aa, Homo Sapiens
RPRLTSNEKLM

SEQ ID NO: 64827 - protein, 11 aa, Homo Sapiens
RPRNPAGRTGL

SEQ ID NO: 64828 - protein, 11 aa, Homo Sapiens
RPRPGNILLQL

SEQ ID NO: 64829 - protein, 11 aa, Homo Sapiens
RPRPTEATVSL

SEQ ID NO: 64830 - protein, 11 aa, Homo Sapiens
RPRTPPEAIAL

SEQ ID NO: 64831 - protein, 11 aa, Homo Sapiens
RPSFPKAARQF

SEQ ID NO: 64832 - protein, 11 aa, Homo Sapiens
RPSGLHGDVSL

SEQ ID NO: 64833 - protein, 11 aa, Homo Sapiens
RPSTGLLRHIL

SEQ ID NO: 64834 - protein, 11 aa, Homo Sapiens
RPSYWKFLLRL

SEQ ID NO: 64835 - protein, 11 aa, Homo Sapiens
RPWEKNSTTLP

SEQ ID NO: 64836 - protein, 11 aa, Homo Sapiens
RPWINKKIIEY

SEQ ID NO: 64837 - protein, 11 aa, Homo Sapiens
RPYQEKSLRKM

SEQ ID NO: 64838 - protein, 11 aa, Homo Sapiens
RTACERAKRTL

SEQ ID NO: 64839 - protein, 11 aa, Homo Sapiens
RVFEHHGQVRL

SEQ ID NO: 64840 - protein, 11 aa, Homo Sapiens
RVQGDKRLSSL

SEQ ID NO: 64841 - protein, 11 aa, Homo Sapiens
SADIRKAYRKL

SEQ ID NO: 64842 - protein, 11 aa, Homo Sapiens
SPADLRTNHTL

SEQ ID NO: 64843 - protein, 11 aa, Homo Sapiens
SPALNKMFCQL

SEQ ID NO: 64844 - protein, 11 aa, Homo Sapiens
SPASSTTARVI

SEQ ID NO: 64845 - protein, 11 aa, Homo Sapiens
SPDITHQKRVF

SEQ ID NO: 64846 - protein, 11 aa, Homo Sapiens
SPDPHKGLVLL

SEQ ID NO: 64847 - protein, 11 aa, Homo Sapiens
SPISSNSHRSL

SEQ ID NO: 64848 - protein, 11 aa, Homo Sapiens
SPKKPGREIEL

SEQ ID NO: 64849 - protein, 11 aa, Homo Sapiens
SPKLPVSSLGL

SEQ ID NO: 64850 - protein, 11 aa, Homo Sapiens
SPKPGTGEPVL

SEQ ID NO: 64851 - protein, 11 aa, Homo Sapiens
SPKRPPSPIKF

SEQ ID NO: 64852 - protein, 11 aa, Homo Sapiens
SPKSTGSVRQL

SEQ ID NO: 64853 - protein, 11 aa, Homo Sapiens
SPNGHRPQLRA

SEQ ID NO: 64854 - protein, 11 aa, Homo Sapiens
SPNLSKCGEEL

SEQ ID NO: 64855 - protein, 11 aa, Homo Sapiens
SPNQARAQAAL

SEQ ID NO: 64856 - protein, 11 aa, Homo Sapiens
SPNQRHRDLEL

SEQ ID NO: 64857 - protein, 11 aa, Homo Sapiens
SPRGNLPLRKL

SEQ ID NO: 64858 - protein, 11 aa, Homo Sapiens
SPRPDRALVQL

SEQ ID NO: 64859 - protein, 11 aa, Homo Sapiens
SPRQGNSKNVL

SEQ ID NO: 64860 - protein, 11 aa, Homo Sapiens
SPSIHQSVVAV

SEQ ID NO: 64861 - protein, 11 aa, Homo Sapiens
SPSKTRGQIQV

SEQ ID NO: 64862 - protein, 11 aa, Homo Sapiens
SPVDPGARQAL

SEQ ID NO: 64863 - protein, 11 aa, Homo Sapiens
SVSFSKSGRLL

SEQ ID NO: 64864 - protein, 11 aa, Homo Sapiens
TPARAPGTRTL

SEQ ID NO: 64865 - protein, 11 aa, Homo Sapiens
TPDHGRHRRLL

SEQ ID NO: 64866 - protein, 11 aa, Homo Sapiens
TPKRPSTSQTV

SEQ ID NO: 64867 - protein, 11 aa, Homo Sapiens
TPSLVKSTSQL

SEQ ID NO: 64868 - protein, 11 aa, Homo Sapiens
TPSSPRAGQLL

SEQ ID NO: 64869 - protein, 11 aa, Homo Sapiens
VPAVAKLRRLL

SEQ ID NO: 64870 - protein, 11 aa, Homo Sapiens
VPDSSGPERIL

SEQ ID NO: 64871 - protein, 11 aa, Homo Sapiens
VPDTSRIYVAL

SEQ ID NO: 64872 - protein, 11 aa, Homo Sapiens
VPHPKKPEHTL

SEQ ID NO: 64873 - protein, 11 aa, Homo Sapiens
VPHPKKPGHIL

SEQ ID NO: 64874 - protein, 11 aa, Homo Sapiens
VPHPSKPNHTL

SEQ ID NO: 64875 - protein, 11 aa, Homo Sapiens
VPKPIGGVVVF

SEQ ID NO: 64876 - protein, 11 aa, Homo Sapiens
VPKPRIKIIDF

SEQ ID NO: 64877 - protein, 11 aa, Homo Sapiens
VPKTAENFRAL

SEQ ID NO: 64878 - protein, 11 aa, Homo Sapiens
VPKTTGEGTSL

SEQ ID NO: 64879 - protein, 11 aa, Homo Sapiens
VPNPRIKLIDF

SEQ ID NO: 64880 - protein, 11 aa, Homo Sapiens
VPNSAIYKRVL

SEQ ID NO: 64881 - protein, 11 aa, Homo Sapiens
VPSVSSISRIL

SEQ ID NO: 64882 - protein, 11 aa, Homo Sapiens
VPSWSKVNQGL

SEQ ID NO: 64883 - protein, 11 aa, Homo Sapiens
VVDPKKPFRKL

SEQ ID NO: 64884 - protein, 11 aa, Homo Sapiens
VVDPRRPFRKL

SEQ ID NO: 64885 - protein, 11 aa, Homo Sapiens
YPSSVNSARTV

SEQ ID NO: 64886 - protein, 8 aa, Homo Sapiens
ALIQNKVL

SEQ ID NO: 64887 - protein, 8 aa, Homo Sapiens
ALLIQKAL

SEQ ID NO: 64888 - protein, 8 aa, Homo Sapiens
ALLVKTTL

SEQ ID NO: 64889 - protein, 8 aa, Homo Sapiens
APLLRWVL

SEQ ID NO: 64890 - protein, 8 aa, Homo Sapiens
AQRLKFRL

SEQ ID NO: 64891 - protein, 8 aa, Homo Sapiens
DAFPKRIL

SEQ ID NO: 64892 - protein, 8 aa, Homo Sapiens
DALVHFAL

SEQ ID NO: 64893 - protein, 8 aa, Homo Sapiens
DAQFHFVL

SEQ ID NO: 64894 - protein, 8 aa, Homo Sapiens
DAYIRIVL

SEQ ID NO: 64895 - protein, 8 aa, Homo Sapiens
DFKDKIVL

SEQ ID NO: 64896 - protein, 8 aa, Homo Sapiens
DFLLKPEL

SEQ ID NO: 64897 - protein, 8 aa, Homo Sapiens
DIILKTVL

SEQ ID NO: 64898 - protein, 8 aa, Homo Sapiens
DILLRPEL

SEQ ID NO: 64899 - protein, 8 aa, Homo Sapiens
DILPKKIL

SEQ ID NO: 64900 - protein, 8 aa, Homo Sapiens
DIWKKFEL

SEQ ID NO: 64901 - protein, 8 aa, Homo Sapiens
DLIEKVVI

SEQ ID NO: 64902 - protein, 8 aa, Homo Sapiens
DLLGRFVL

SEQ ID NO: 64903 - protein, 8 aa, Homo Sapiens
DLLKKLEL

SEQ ID NO: 64904 - protein, 8 aa, Homo Sapiens
DLLLHSAL

SEQ ID NO: 64905 - protein, 8 aa, Homo Sapiens
DLLVKYIF

SEQ ID NO: 64906 - protein, 8 aa, Homo Sapiens
DLRIAHML

SEQ ID NO: 64907 - protein, 8 aa, Homo Sapiens
DLRTRVVL

SEQ ID NO: 64908 - protein, 8 aa, Homo Sapiens
DLWTKIIL

SEQ ID NO: 64909 - protein, 8 aa, Homo Sapiens
DLYRKVML

SEQ ID NO: 64910 - protein, 8 aa, Homo Sapiens
DMAPKYIL

SEQ ID NO: 64911 - protein, 8 aa, Homo Sapiens
DMKTKYFF

SEQ ID NO: 64912 - protein, 8 aa, Homo Sapiens
DMLIRQLL

SEQ ID NO: 64913 - protein, 8 aa, Homo Sapiens
DMLLKEYL

SEQ ID NO: 64914 - protein, 8 aa, Homo Sapiens
DVITKFEL

SEQ ID NO: 64915 - protein, 8 aa, Homo Sapiens
EAFAKVDL

SEQ ID NO: 64916 - protein, 8 aa, Homo Sapiens
EAFLKHIL

SEQ ID NO: 64917 - protein, 8 aa, Homo Sapiens
EAFVRAFL

SEQ ID NO: 64918 - protein, 8 aa, Homo Sapiens
EAFVREVL

SEQ ID NO: 64919 - protein, 8 aa, Homo Sapiens
EAFVRHIL

SEQ ID NO: 64920 - protein, 8 aa, Homo Sapiens
EALIRTVF

SEQ ID NO: 64921 - protein, 8 aa, Homo Sapiens
EALKKLIL

SEQ ID NO: 64922 - protein, 8 aa, Homo Sapiens
EALLRYVL

SEQ ID NO: 64923 - protein, 8 aa, Homo Sapiens
EALYKWLL

SEQ ID NO: 64924 - protein, 8 aa, Homo Sapiens
EAYLKAML

SEQ ID NO: 64925 - protein, 8 aa, Homo Sapiens
EGYIKKLL

SEQ ID NO: 64926 - protein, 8 aa, Homo Sapiens
ELLQKIEV

SEQ ID NO: 64927 - protein, 8 aa, Homo Sapiens
ELWQRVSL

SEQ ID NO: 64928 - protein, 8 aa, Homo Sapiens
EMILKVVM

SEQ ID NO: 64929 - protein, 8 aa, Homo Sapiens
EMLIRVNM

SEQ ID NO: 64930 - protein, 8 aa, Homo Sapiens
EPLVRQVL

SEQ ID NO: 64931 - protein, 8 aa, Homo Sapiens
FAKFVVDL

SEQ ID NO: 64932 - protein, 8 aa, Homo Sapiens
FAMIIDKL

SEQ ID NO: 64933 - protein, 8 aa, Homo Sapiens
FAYLRDLL

SEQ ID NO: 64934 - protein, 8 aa, Homo Sapiens
FFYEKAIL

SEQ ID NO: 64935 - protein, 8 aa, Homo Sapiens
FGKEKFEV

SEQ ID NO: 64936 - protein, 8 aa, Homo Sapiens
FGLLKAIL

SEQ ID NO: 64937 - protein, 8 aa, Homo Sapiens
FIKIKMAF

SEQ ID NO: 64938 - protein, 8 aa, Homo Sapiens
FILKKPKL

SEQ ID NO: 64939 - protein, 8 aa, Homo Sapiens
FIYNRVVL

SEQ ID NO: 64940 - protein, 8 aa, Homo Sapiens
FLFPHSVL

SEQ ID NO: 64941 - protein, 8 aa, Homo Sapiens
FLKVSSVF

SEQ ID NO: 64942 - protein, 8 aa, Homo Sapiens
FLPLKTML

SEQ ID NO: 64943 - protein, 8 aa, Homo Sapiens
FLRLITTL

SEQ ID NO: 64944 - protein, 8 aa, Homo Sapiens
FLRYAVVL

SEQ ID NO: 64945 - protein, 8 aa, Homo Sapiens
FLVVRHQL

SEQ ID NO: 64946 - protein, 8 aa, Homo Sapiens
FLWERPTL

SEQ ID NO: 64947 - protein, 8 aa, Homo Sapiens
FLWQHQLL

SEQ ID NO: 64948 - protein, 8 aa, Homo Sapiens
FLWQHVEL

SEQ ID NO: 64949 - protein, 8 aa, Homo Sapiens
FMLKKIVL

SEQ ID NO: 64950 - protein, 8 aa, Homo Sapiens
FNWIKTQL

SEQ ID NO: 64951 - protein, 8 aa, Homo Sapiens
FPDLKERL

SEQ ID NO: 64952 - protein, 8 aa, Homo Sapiens
FPFLKMVL

SEQ ID NO: 64953 - protein, 8 aa, Homo Sapiens
FPFSRPEL

SEQ ID NO: 64954 - protein, 8 aa, Homo Sapiens
FPHIKLTL

SEQ ID NO: 64955 - protein, 8 aa, Homo Sapiens
FPHLTVVL

SEQ ID NO: 64956 - protein, 8 aa, Homo Sapiens
FPIFKACF

SEQ ID NO: 64957 - protein, 8 aa, Homo Sapiens
FPIYKVLF

SEQ ID NO: 64958 - protein, 8 aa, Homo Sapiens
FPKAVSVF

SEQ ID NO: 64959 - protein, 8 aa, Homo Sapiens
FPKEIQML

SEQ ID NO: 64960 - protein, 8 aa, Homo Sapiens
FPLIKEII

SEQ ID NO: 64961 - protein, 8 aa, Homo Sapiens
FPLPHRVL

SEQ ID NO: 64962 - protein, 8 aa, Homo Sapiens
FPLVKSAL

SEQ ID NO: 64963 - protein, 8 aa, Homo Sapiens
FPNLARVL

SEQ ID NO: 64964 - protein, 8 aa, Homo Sapiens
FPPLHYEL

SEQ ID NO: 64965 - protein, 8 aa, Homo Sapiens
FPSIKTEF

SEQ ID NO: 64966 - protein, 8 aa, Homo Sapiens
FQIEHHLF

SEQ ID NO: 64967 - protein, 8 aa, Homo Sapiens
FQKIQVRL

SEQ ID NO: 64968 - protein, 8 aa, Homo Sapiens
FTKVKPLL

SEQ ID NO: 64969 - protein, 8 aa, Homo Sapiens
FVIKKHEL

SEQ ID NO: 64970 - protein, 8 aa, Homo Sapiens
HLFPKLEL

SEQ ID NO: 64971 - protein, 8 aa, Homo Sapiens
HLLIKRSL

SEQ ID NO: 64972 - protein, 8 aa, Homo Sapiens
HNFIKVTL

SEQ ID NO: 64973 - protein, 8 aa, Homo Sapiens
HPHWKVRL

SEQ ID NO: 64974 - protein, 8 aa, Homo Sapiens
HPTLKLIL

SEQ ID NO: 64975 - protein, 8 aa, Homo Sapiens
IAHLRQIL

SEQ ID NO: 64976 - protein, 8 aa, Homo Sapiens
IAKLMVEL

SEQ ID NO: 64977 - protein, 8 aa, Homo Sapiens
IFKDKVVL

SEQ ID NO: 64978 - protein, 8 aa, Homo Sapiens
IIKDKHIL

SEQ ID NO: 64979 - protein, 8 aa, Homo Sapiens
ILKQMQVL

SEQ ID NO: 64980 - protein, 8 aa, Homo Sapiens
IPEIKTIL

SEQ ID NO: 64981 - protein, 8 aa, Homo Sapiens
IPLVKVDM

SEQ ID NO: 64982 - protein, 8 aa, Homo Sapiens
IPMIIHQL

SEQ ID NO: 64983 - protein, 8 aa, Homo Sapiens
IPTLKISL

SEQ ID NO: 64984 - protein, 8 aa, Homo Sapiens
IQNFKRTL

SEQ ID NO: 64985 - protein, 8 aa, Homo Sapiens
ITLNRHVI

SEQ ID NO: 64986 - protein, 8 aa, Homo Sapiens
KPFEKFLL

SEQ ID NO: 64987 - protein, 8 aa, Homo Sapiens
LAIYKQVL

SEQ ID NO: 64988 - protein, 8 aa, Homo Sapiens
LAKLKYQF

SEQ ID NO: 64989 - protein, 8 aa, Homo Sapiens
LALLKVLL

SEQ ID NO: 64990 - protein, 8 aa, Homo Sapiens
LAVLKHVL

SEQ ID NO: 64991 - protein, 8 aa, Homo Sapiens
LFIVKNEL

SEQ ID NO: 64992 - protein, 8 aa, Homo Sapiens
LGHVRYVL

SEQ ID NO: 64993 - protein, 8 aa, Homo Sapiens
LIILKQVM

SEQ ID NO: 64994 - protein, 8 aa, Homo Sapiens
LLHKRVVL

SEQ ID NO: 64995 - protein, 8 aa, Homo Sapiens
LLKSKLYL

SEQ ID NO: 64996 - protein, 8 aa, Homo Sapiens
LLKYKSII

SEQ ID NO: 64997 - protein, 8 aa, Homo Sapiens
LLLKKWSL

SEQ ID NO: 64998 - protein, 8 aa, Homo Sapiens
LPDIREVL

SEQ ID NO: 64999 - protein, 8 aa, Homo Sapiens
LPFKKSLL

SEQ ID NO: 65000 - protein, 8 aa, Homo Sapiens
LPHLRNKL

SEQ ID NO: 65001 - protein, 8 aa, Homo Sapiens
LPHVVPTL

SEQ ID NO: 65002 - protein, 8 aa, Homo Sapiens
LPIVKTEF

SEQ ID NO: 65003 - protein, 8 aa, Homo Sapiens
LPKIKAIP

SEQ ID NO: 65004 - protein, 8 aa, Homo Sapiens
LPKLLVEF

SEQ ID NO: 65005 - protein, 8 aa, Homo Sapiens
LPKLYVKL

SEQ ID NO: 65006 - protein, 8 aa, Homo Sapiens
LPLTHFEL

SEQ ID NO: 65007 - protein, 8 aa, Homo Sapiens
LPLVKPYL

SEQ ID NO: 65008 - protein, 8 aa, Homo Sapiens
LPNIHPEL

SEQ ID NO: 65009 - protein, 8 aa, Homo Sapiens
LPNIQAVL

SEQ ID NO: 65010 - protein, 8 aa, Homo Sapiens
LPTLKPIL

SEQ ID NO: 65011 - protein, 8 aa, Homo Sapiens
LPYIKQEV

SEQ ID NO: 65012 - protein, 8 aa, Homo Sapiens
LPYLKVKL

SEQ ID NO: 65013 - protein, 8 aa, Homo Sapiens
MAFLKTAL

SEQ ID NO: 65014 - protein, 8 aa, Homo Sapiens
MLLCKIML

SEQ ID NO: 65015 - protein, 8 aa, Homo Sapiens
MNKYKVVL

SEQ ID NO: 65016 - protein, 8 aa, Homo Sapiens
MPKVHIEF

SEQ ID NO: 65017 - protein, 8 aa, Homo Sapiens
MPTVHYEF

SEQ ID NO: 65018 - protein, 8 aa, Homo Sapiens
MPVLKVVL

SEQ ID NO: 65019 - protein, 8 aa, Homo Sapiens
NALLRYLL

SEQ ID NO: 65020 - protein, 8 aa, Homo Sapiens
NIKPHWMF

SEQ ID NO: 65021 - protein, 8 aa, Homo Sapiens
NLIKKTVL

SEQ ID NO: 65022 - protein, 8 aa, Homo Sapiens
NLKVKVLF

SEQ ID NO: 65023 - protein, 8 aa, Homo Sapiens
NLLGKFEL

SEQ ID NO: 65024 - protein, 8 aa, Homo Sapiens
NLLLKHLF

SEQ ID NO: 65025 - protein, 8 aa, Homo Sapiens
NPLLRYVF

SEQ ID NO: 65026 - protein, 8 aa, Homo Sapiens
PPFKELLL

SEQ ID NO: 65027 - protein, 8 aa, Homo Sapiens
QAIIKHLL

SEQ ID NO: 65028 - protein, 8 aa, Homo Sapiens
QALLRISL

SEQ ID NO: 65029 - protein, 8 aa, Homo Sapiens
QATLRWLL

SEQ ID NO: 65030 - protein, 8 aa, Homo Sapiens
QFIIKHEL

SEQ ID NO: 65031 - protein, 8 aa, Homo Sapiens
QGYLRSVF

SEQ ID NO: 65032 - protein, 8 aa, Homo Sapiens
QPLLREVL

SEQ ID NO: 65033 - protein, 8 aa, Homo Sapiens
QPYLRELL

SEQ ID NO: 65034 - protein, 8 aa, Homo Sapiens
QPYSRFLL

SEQ ID NO: 65035 - protein, 8 aa, Homo Sapiens
SALIKAEL

SEQ ID NO: 65036 - protein, 8 aa, Homo Sapiens
SLLLKAVV

SEQ ID NO: 65037 - protein, 8 aa, Homo Sapiens
SNKLHFAF

SEQ ID NO: 65038 - protein, 8 aa, Homo Sapiens
SPVFKTVL

SEQ ID NO: 65039 - protein, 8 aa, Homo Sapiens
TAIRHHVL

SEQ ID NO: 65040 - protein, 8 aa, Homo Sapiens
TEKPKFIL

SEQ ID NO: 65041 - protein, 8 aa, Homo Sapiens
TLINHRVL

SEQ ID NO: 65042 - protein, 8 aa, Homo Sapiens
TLLIREIL

SEQ ID NO: 65043 - protein, 8 aa, Homo Sapiens
TPFIRPVM

SEQ ID NO: 65044 - protein, 8 aa, Homo Sapiens
TPFPKNFL

SEQ ID NO: 65045 - protein, 8 aa, Homo Sapiens
TPLKKFLL

SEQ ID NO: 65046 - protein, 8 aa, Homo Sapiens
VLLQKQIL

SEQ ID NO: 65047 - protein, 8 aa, Homo Sapiens
VPFLVSVL

SEQ ID NO: 65048 - protein, 8 aa, Homo Sapiens
VPKTHLEL

SEQ ID NO: 65049 - protein, 8 aa, Homo Sapiens
VPLPKQSL

SEQ ID NO: 65050 - protein, 8 aa, Homo Sapiens
VPSIKFCL

SEQ ID NO: 65051 - protein, 8 aa, Homo Sapiens
VPSPKVVL

SEQ ID NO: 65052 - protein, 8 aa, Homo Sapiens
VPWLKREL

SEQ ID NO: 65053 - protein, 8 aa, Homo Sapiens
VPYFRNIL

SEQ ID NO: 65054 - protein, 8 aa, Homo Sapiens
WIKEKIYV

SEQ ID NO: 65055 - protein, 8 aa, Homo Sapiens
WLTQKQTL

SEQ ID NO: 65056 - protein, 8 aa, Homo Sapiens
WPLLKQVL

SEQ ID NO: 65057 - protein, 8 aa, Homo Sapiens
WPLPKALL

SEQ ID NO: 65058 - protein, 8 aa, Homo Sapiens
YAFLHRTL

SEQ ID NO: 65059 - protein, 8 aa, Homo Sapiens
YAFLREAL

SEQ ID NO: 65060 - protein, 8 aa, Homo Sapiens
YAIIKEEL

SEQ ID NO: 65061 - protein, 8 aa, Homo Sapiens
YAKLIAEL

SEQ ID NO: 65062 - protein, 8 aa, Homo Sapiens
YALPHAIL

SEQ ID NO: 65063 - protein, 8 aa, Homo Sapiens
YFIVKEIL

SEQ ID NO: 65064 - protein, 8 aa, Homo Sapiens
YGMPRQIL

SEQ ID NO: 65065 - protein, 8 aa, Homo Sapiens
YGVLRFIM

SEQ ID NO: 65066 - protein, 8 aa, Homo Sapiens
YIDQKFVL

SEQ ID NO: 65067 - protein, 8 aa, Homo Sapiens
YILPKNVL

SEQ ID NO: 65068 - protein, 8 aa, Homo Sapiens
YIYSKVQL

SEQ ID NO: 65069 - protein, 8 aa, Homo Sapiens
YLFPKFTL

SEQ ID NO: 65070 - protein, 8 aa, Homo Sapiens
YLNYKVCL

SEQ ID NO: 65071 - protein, 8 aa, Homo Sapiens
YLRSVFAL

SEQ ID NO: 65072 - protein, 8 aa, Homo Sapiens
YLWTKQVL

SEQ ID NO: 65073 - protein, 8 aa, Homo Sapiens
YPCSKFII

SEQ ID NO: 65074 - protein, 8 aa, Homo Sapiens
YPFHVPLL

SEQ ID NO: 65075 - protein, 8 aa, Homo Sapiens
YPLWKVTF

SEQ ID NO: 65076 - protein, 8 aa, Homo Sapiens
YPMPRVIF

SEQ ID NO: 65077 - protein, 8 aa, Homo Sapiens
YPWVHVVI

SEQ ID NO: 65078 - protein, 9 aa, Homo Sapiens
AALARLLAA

SEQ ID NO: 65079 - protein, 9 aa, Homo Sapiens
AAMPRIYEL

SEQ ID NO: 65080 - protein, 9 aa, Homo Sapiens
AAYLRALSL

SEQ ID NO: 65081 - protein, 9 aa, Homo Sapiens
AILLKKISL

SEQ ID NO: 65082 - protein, 9 aa, Homo Sapiens
AILRRLVAL

SEQ ID NO: 65083 - protein, 9 aa, Homo Sapiens
ALALRFLAL

SEQ ID NO: 65084 - protein, 9 aa, Homo Sapiens
ALHHRILAL

SEQ ID NO: 65085 - protein, 9 aa, Homo Sapiens
ALKLKQKSL

SEQ ID NO: 65086 - protein, 9 aa, Homo Sapiens
ALLDKLYAL

SEQ ID NO: 65087 - protein, 9 aa, Homo Sapiens
ALLQRLEAL

SEQ ID NO: 65088 - protein, 9 aa, Homo Sapiens
AMLERLLSL

SEQ ID NO: 65089 - protein, 9 aa, Homo Sapiens
ASFIITKAI

SEQ ID NO: 65090 - protein, 9 aa, Homo Sapiens
ASYLRLWAL

SEQ ID NO: 65091 - protein, 9 aa, Homo Sapiens
AVILRALSL

SEQ ID NO: 65092 - protein, 9 aa, Homo Sapiens
CPLLRTLDV

SEQ ID NO: 65093 - protein, 9 aa, Homo Sapiens
CPLPRPWAL

SEQ ID NO: 65094 - protein, 9 aa, Homo Sapiens
DAAIRVWSL

SEQ ID NO: 65095 - protein, 9 aa, Homo Sapiens
DAFVRLIAL

SEQ ID NO: 65096 - protein, 9 aa, Homo Sapiens
DAHIRLWDL

SEQ ID NO: 65097 - protein, 9 aa, Homo Sapiens
DAKIRIFDL

SEQ ID NO: 65098 - protein, 9 aa, Homo Sapiens
DAKQKWLLL

SEQ ID NO: 65099 - protein, 9 aa, Homo Sapiens
DALQRSVQL

SEQ ID NO: 65100 - protein, 9 aa, Homo Sapiens
DATIRIWSV

SEQ ID NO: 65101 - protein, 9 aa, Homo Sapiens
DFKIKTVEL

SEQ ID NO: 65102 - protein, 9 aa, Homo Sapiens
DFKIRTIEL

SEQ ID NO: 65103 - protein, 9 aa, Homo Sapiens
DFKIRTVEI

SEQ ID NO: 65104 - protein, 9 aa, Homo Sapiens
DGLLRVLTV

SEQ ID NO: 65105 - protein, 9 aa, Homo Sapiens
DIHHKVLSL

SEQ ID NO: 65106 - protein, 9 aa, Homo Sapiens
DIIKKPIAL

SEQ ID NO: 65107 - protein, 9 aa, Homo Sapiens
DIITHILAL

SEQ ID NO: 65108 - protein, 9 aa, Homo Sapiens
DIIYKKIAL

SEQ ID NO: 65109 - protein, 9 aa, Homo Sapiens
DIKEKLCYV

SEQ ID NO: 65110 - protein, 9 aa, Homo Sapiens
DIKKILDSV

SEQ ID NO: 65111 - protein, 9 aa, Homo Sapiens
DIKSFITSI

SEQ ID NO: 65112 - protein, 9 aa, Homo Sapiens
DIKSKIRAL

SEQ ID NO: 65113 - protein, 9 aa, Homo Sapiens
DILHRVLCL

SEQ ID NO: 65114 - protein, 9 aa, Homo Sapiens
DILKRLYEL

SEQ ID NO: 65115 - protein, 9 aa, Homo Sapiens
DILNKALEL

SEQ ID NO: 65116 - protein, 9 aa, Homo Sapiens
DILRRVLVL

SEQ ID NO: 65117 - protein, 9 aa, Homo Sapiens
DILSRIHTI

SEQ ID NO: 65118 - protein, 9 aa, Homo Sapiens
DINVRWLAV

SEQ ID NO: 65119 - protein, 9 aa, Homo Sapiens
DIWVKSYSL

SEQ ID NO: 65120 - protein, 9 aa, Homo Sapiens
DIYQRALNL

SEQ ID NO: 65121 - protein, 9 aa, Homo Sapiens
DLFRKALEL

SEQ ID NO: 65122 - protein, 9 aa, Homo Sapiens
DLHEKDFSL

SEQ ID NO: 65123 - protein, 9 aa, Homo Sapiens
DLIGKLTSL

SEQ ID NO: 65124 - protein, 9 aa, Homo Sapiens
DLIIKGISV

SEQ ID NO: 65125 - protein, 9 aa, Homo Sapiens
DLILKWLTL

SEQ ID NO: 65126 - protein, 9 aa, Homo Sapiens
DLIMKVENL

SEQ ID NO: 65127 - protein, 9 aa, Homo Sapiens
DLISRDYSL

SEQ ID NO: 65128 - protein, 9 aa, Homo Sapiens
DLITRQKQL

SEQ ID NO: 65129 - protein, 9 aa, Homo Sapiens
DLKAQILEL

SEQ ID NO: 65130 - protein, 9 aa, Homo Sapiens
DLKAQLREL

SEQ ID NO: 65131 - protein, 9 aa, Homo Sapiens
DLKIKRSKL

SEQ ID NO: 65132 - protein, 9 aa, Homo Sapiens
DLKLRKFVF

SEQ ID NO: 65133 - protein, 9 aa, Homo Sapiens
DLKPKVYNL

SEQ ID NO: 65134 - protein, 9 aa, Homo Sapiens
DLKPRNIFL

SEQ ID NO: 65135 - protein, 9 aa, Homo Sapiens
DLKQKVENL

SEQ ID NO: 65136 - protein, 9 aa, Homo Sapiens
DLKQLQESL

SEQ ID NO: 65137 - protein, 9 aa, Homo Sapiens
DLKTKVLVL

SEQ ID NO: 65138 - protein, 9 aa, Homo Sapiens
DLKVKLTEV

SEQ ID NO: 65139 - protein, 9 aa, Homo Sapiens
DLLARIETL

SEQ ID NO: 65140 - protein, 9 aa, Homo Sapiens
DLLEKSFSL

SEQ ID NO: 65141 - protein, 9 aa, Homo Sapiens
DLLIRAVEA

SEQ ID NO: 65142 - protein, 9 aa, Homo Sapiens
DLLKRILKM

SEQ ID NO: 65143 - protein, 9 aa, Homo Sapiens
DLLKRLEAA

SEQ ID NO: 65144 - protein, 9 aa, Homo Sapiens
DLLLRIREL

SEQ ID NO: 65145 - protein, 9 aa, Homo Sapiens
DLLQRLDAL

SEQ ID NO: 65146 - protein, 9 aa, Homo Sapiens
DLLRKVGAL

SEQ ID NO: 65147 - protein, 9 aa, Homo Sapiens
DLMIRLLEL

SEQ ID NO: 65148 - protein, 9 aa, Homo Sapiens
DLNIRVERL

SEQ ID NO: 65149 - protein, 9 aa, Homo Sapiens
DLNYRWVSL

SEQ ID NO: 65150 - protein, 9 aa, Homo Sapiens
DLQARITSL

SEQ ID NO: 65151 - protein, 9 aa, Homo Sapiens
DLQKRLLAL

SEQ ID NO: 65152 - protein, 9 aa, Homo Sapiens
DLRTKGFSL

SEQ ID NO: 65153 - protein, 9 aa, Homo Sapiens
DLYTRFDTL

SEQ ID NO: 65154 - protein, 9 aa, Homo Sapiens
DMALKSLSL

SEQ ID NO: 65155 - protein, 9 aa, Homo Sapiens
DMFYRNWAL

SEQ ID NO: 65156 - protein, 9 aa, Homo Sapiens
DMIKRALDF

SEQ ID NO: 65157 - protein, 9 aa, Homo Sapiens
DMKIKVTDL

SEQ ID NO: 65158 - protein, 9 aa, Homo Sapiens
DMKIRLFTS

SEQ ID NO: 65159 - protein, 9 aa, Homo Sapiens
DMKTKYFFF

SEQ ID NO: 65160 - protein, 9 aa, Homo Sapiens
DMLLKEYLL

SEQ ID NO: 65161 - protein, 9 aa, Homo Sapiens
DMLLKIKAV

SEQ ID NO: 65162 - protein, 9 aa, Homo Sapiens
DMLVKVNAL

SEQ ID NO: 65163 - protein, 9 aa, Homo Sapiens
DNMPRILSL

SEQ ID NO: 65164 - protein, 9 aa, Homo Sapiens
DPPLKFMSV

SEQ ID NO: 65165 - protein, 9 aa, Homo Sapiens
DPYLKPYAV

SEQ ID NO: 65166 - protein, 9 aa, Homo Sapiens
DQFQKVLSL

SEQ ID NO: 65167 - protein, 9 aa, Homo Sapiens
DSIIRIWSV

SEQ ID NO: 65168 - protein, 9 aa, Homo Sapiens
DVKLKFEEI

SEQ ID NO: 65169 - protein, 9 aa, Homo Sapiens
DVQLRLNSI

SEQ ID NO: 65170 - protein, 9 aa, Homo Sapiens
EAHLKFLAF

SEQ ID NO: 65171 - protein, 9 aa, Homo Sapiens
EALAKLISL

SEQ ID NO: 65172 - protein, 9 aa, Homo Sapiens
EALQRLVNL

SEQ ID NO: 65173 - protein, 9 aa, Homo Sapiens
EALVRTVAL

SEQ ID NO: 65174 - protein, 9 aa, Homo Sapiens
EAQLRQFTL

SEQ ID NO: 65175 - protein, 9 aa, Homo Sapiens
EARPRPLSL

SEQ ID NO: 65176 - protein, 9 aa, Homo Sapiens
EATLRCWAL

SEQ ID NO: 65177 - protein, 9 aa, Homo Sapiens
EGFLKAQAL

SEQ ID NO: 65178 - protein, 9 aa, Homo Sapiens
EGKLRLVEI

SEQ ID NO: 65179 - protein, 9 aa, Homo Sapiens
EGLPKPLTL

SEQ ID NO: 65180 - protein, 9 aa, Homo Sapiens
EIIHRYVEL

SEQ ID NO: 65181 - protein, 9 aa, Homo Sapiens
EIILRQEVL

SEQ ID NO: 65182 - protein, 9 aa, Homo Sapiens
EIKEKLLQL

SEQ ID NO: 65183 - protein, 9 aa, Homo Sapiens
EIKFKVETL

SEQ ID NO: 65184 - protein, 9 aa, Homo Sapiens
EIKLRLLDL

SEQ ID NO: 65185 - protein, 9 aa, Homo Sapiens
EIKTKIKEL

SEQ ID NO: 65186 - protein, 9 aa, Homo Sapiens
EIKVKLIEA

SEQ ID NO: 65187 - protein, 9 aa, Homo Sapiens
EILLRKLPF

SEQ ID NO: 65188 - protein, 9 aa, Homo Sapiens
EILLRVLTL

SEQ ID NO: 65189 - protein, 9 aa, Homo Sapiens
EIRKVVQSL

SEQ ID NO: 65190 - protein, 9 aa, Homo Sapiens
EIRLKIVGT

SEQ ID NO: 65191 - protein, 9 aa, Homo Sapiens
ELDVRITAL

SEQ ID NO: 65192 - protein, 9 aa, Homo Sapiens
ELFLRFISL

SEQ ID NO: 65193 - protein, 9 aa, Homo Sapiens
ELFLRGPAL

SEQ ID NO: 65194 - protein, 9 aa, Homo Sapiens
ELFLRRISL

SEQ ID NO: 65195 - protein, 9 aa, Homo Sapiens
ELFPRYTSL

SEQ ID NO: 65196 - protein, 9 aa, Homo Sapiens
ELITKAVAA

SEQ ID NO: 65197 - protein, 9 aa, Homo Sapiens
ELKIKRSLF

SEQ ID NO: 65198 - protein, 9 aa, Homo Sapiens
ELKLKEIQL

SEQ ID NO: 65199 - protein, 9 aa, Homo Sapiens
ELKLSIICL

SEQ ID NO: 65200 - protein, 9 aa, Homo Sapiens
ELKQRFSVF

SEQ ID NO: 65201 - protein, 9 aa, Homo Sapiens
ELLFRPTAL

SEQ ID NO: 65202 - protein, 9 aa, Homo Sapiens
ELLKKLVGL

SEQ ID NO: 65203 - protein, 9 aa, Homo Sapiens
ELLQKVITL

SEQ ID NO: 65204 - protein, 9 aa, Homo Sapiens
ELLTKALHL

SEQ ID NO: 65205 - protein, 9 aa, Homo Sapiens
ELLTKTYVL

SEQ ID NO: 65206 - protein, 9 aa, Homo Sapiens
ELNPKILAL

SEQ ID NO: 65207 - protein, 9 aa, Homo Sapiens
ELQEKFLSL

SEQ ID NO: 65208 - protein, 9 aa, Homo Sapiens
ELQLRLLAL

SEQ ID NO: 65209 - protein, 9 aa, Homo Sapiens
ELQSRLAAL

SEQ ID NO: 65210 - protein, 9 aa, Homo Sapiens
ELRLKPQLL

SEQ ID NO: 65211 - protein, 9 aa, Homo Sapiens
ELRLKYYGL

SEQ ID NO: 65212 - protein, 9 aa, Homo Sapiens
ELRPLPVSV

SEQ ID NO: 65213 - protein, 9 aa, Homo Sapiens
ELRVKELEV

SEQ ID NO: 65214 - protein, 9 aa, Homo Sapiens
ELWKKVETL

SEQ ID NO: 65215 - protein, 9 aa, Homo Sapiens
ELYQRIYAF

SEQ ID NO: 65216 - protein, 9 aa, Homo Sapiens
EMKLRLLDL

SEQ ID NO: 65217 - protein, 9 aa, Homo Sapiens
EMLKKFLSF

SEQ ID NO: 65218 - protein, 9 aa, Homo Sapiens
EQKLRVELL

SEQ ID NO: 65219 - protein, 9 aa, Homo Sapiens
ERPIRIVAL

SEQ ID NO: 65220 - protein, 9 aa, Homo Sapiens
ETLLRVMTL

SEQ ID NO: 65221 - protein, 9 aa, Homo Sapiens
EVILRAEAV

SEQ ID NO: 65222 - protein, 9 aa, Homo Sapiens
EVISKLYAV

SEQ ID NO: 65223 - protein, 9 aa, Homo Sapiens
EVKTKLFSL

SEQ ID NO: 65224 - protein, 9 aa, Homo Sapiens
EVLQRIESL

SEQ ID NO: 65225 - protein, 9 aa, Homo Sapiens
EVYLKPYFL

SEQ ID NO: 65226 - protein, 9 aa, Homo Sapiens
FAHLRLEVL

SEQ ID NO: 65227 - protein, 9 aa, Homo Sapiens
FAKIYADTF

SEQ ID NO: 65228 - protein, 9 aa, Homo Sapiens
FAKLRELLL

SEQ ID NO: 65229 - protein, 9 aa, Homo Sapiens
FAKVHILYV

SEQ ID NO: 65230 - protein, 9 aa, Homo Sapiens
FALGKILSV

SEQ ID NO: 65231 - protein, 9 aa, Homo Sapiens
FANLKYVSL

SEQ ID NO: 65232 - protein, 9 aa, Homo Sapiens
FFKERVMEI

SEQ ID NO: 65233 - protein, 9 aa, Homo Sapiens
FFMERSWSV

SEQ ID NO: 65234 - protein, 9 aa, Homo Sapiens
FFMLRSLSL

SEQ ID NO: 65235 - protein, 9 aa, Homo Sapiens
FGFERLEVL

SEQ ID NO: 65236 - protein, 9 aa, Homo Sapiens
FGKLRNIEL

SEQ ID NO: 65237 - protein, 9 aa, Homo Sapiens
FGLARAFGV

SEQ ID NO: 65238 - protein, 9 aa, Homo Sapiens
FGLARAFSL

SEQ ID NO: 65239 - protein, 9 aa, Homo Sapiens
FGLARIYSF

SEQ ID NO: 65240 - protein, 9 aa, Homo Sapiens
FGLPRWVTL

SEQ ID NO: 65241 - protein, 9 aa, Homo Sapiens
FIAQKILAL

SEQ ID NO: 65242 - protein, 9 aa, Homo Sapiens
FIFLRLNVL

SEQ ID NO: 65243 - protein, 9 aa, Homo Sapiens
FIFQKVGKL

SEQ ID NO: 65244 - protein, 9 aa, Homo Sapiens
FIHQHFVEV

SEQ ID NO: 65245 - protein, 9 aa, Homo Sapiens
FIISRTQAL

SEQ ID NO: 65246 - protein, 9 aa, Homo Sapiens
FIKRVYVSL

SEQ ID NO: 65247 - protein, 9 aa, Homo Sapiens
FILERRMTL

SEQ ID NO: 65248 - protein, 9 aa, Homo Sapiens
FILERRSLL

SEQ ID NO: 65249 - protein, 9 aa, Homo Sapiens
FILKKLDSI

SEQ ID NO: 65250 - protein, 9 aa, Homo Sapiens
FILPKEIAV

SEQ ID NO: 65251 - protein, 9 aa, Homo Sapiens
FINARNWTL

SEQ ID NO: 65252 - protein, 9 aa, Homo Sapiens
FLAPRLLSL

SEQ ID NO: 65253 - protein, 9 aa, Homo Sapiens
FLAQRAVEL

SEQ ID NO: 65254 - protein, 9 aa, Homo Sapiens
FLEEREIAL

SEQ ID NO: 65255 - protein, 9 aa, Homo Sapiens
FLFSKFIEL

SEQ ID NO: 65256 - protein, 9 aa, Homo Sapiens
FLHIKETVL

SEQ ID NO: 65257 - protein, 9 aa, Homo Sapiens
FLISRLIKL

SEQ ID NO: 65258 - protein, 9 aa, Homo Sapiens
FLKEIVETF

SEQ ID NO: 65259 - protein, 9 aa, Homo Sapiens
FLKIKPVSL

SEQ ID NO: 65260 - protein, 9 aa, Homo Sapiens
FLKQRPTKL

SEQ ID NO: 65261 - protein, 9 aa, Homo Sapiens
FLLDKKIGV

SEQ ID NO: 65262 - protein, 9 aa, Homo Sapiens
FLLEKGYEV

SEQ ID NO: 65263 - protein, 9 aa, Homo Sapiens
FLLEKPFSV

SEQ ID NO: 65264 - protein, 9 aa, Homo Sapiens
FLLGKEVSL

SEQ ID NO: 65265 - protein, 9 aa, Homo Sapiens
FLLPKVQSI

SEQ ID NO: 65266 - protein, 9 aa, Homo Sapiens
FLLQRVHSL

SEQ ID NO: 65267 - protein, 9 aa, Homo Sapiens
FLLRRLVTL

SEQ ID NO: 65268 - protein, 9 aa, Homo Sapiens
FLRELVITI

SEQ ID NO: 65269 - protein, 9 aa, Homo Sapiens
FLREWVESM

SEQ ID NO: 65270 - protein, 9 aa, Homo Sapiens
FLREYFERL

SEQ ID NO: 65271 - protein, 9 aa, Homo Sapiens
FLRLKLNNL

SEQ ID NO: 65272 - protein, 9 aa, Homo Sapiens
FLRTREPAL

SEQ ID NO: 65273 - protein, 9 aa, Homo Sapiens
FLYIRQLAI

SEQ ID NO: 65274 - protein, 9 aa, Homo Sapiens
FLYPFPLAL

SEQ ID NO: 65275 - protein, 9 aa, Homo Sapiens
FMKPGKVVL

SEQ ID NO: 65276 - protein, 9 aa, Homo Sapiens
FMNPHLISV

SEQ ID NO: 65277 - protein, 9 aa, Homo Sapiens
FNFLRNVSL

SEQ ID NO: 65278 - protein, 9 aa, Homo Sapiens
FNRPRIETL

SEQ ID NO: 65279 - protein, 9 aa, Homo Sapiens
FNWGRVVAL

SEQ ID NO: 65280 - protein, 9 aa, Homo Sapiens
FPFERLYDL

SEQ ID NO: 65281 - protein, 9 aa, Homo Sapiens
FPGRNKFFC

SEQ ID NO: 65282 - protein, 9 aa, Homo Sapiens
FPHLREEIL

SEQ ID NO: 65283 - protein, 9 aa, Homo Sapiens
FPHLRVLEA

SEQ ID NO: 65284 - protein, 9 aa, Homo Sapiens
FPHPKYVDL

SEQ ID NO: 65285 - protein, 9 aa, Homo Sapiens
FPKWKPGSL

SEQ ID NO: 65286 - protein, 9 aa, Homo Sapiens
FPKWSVISL

SEQ ID NO: 65287 - protein, 9 aa, Homo Sapiens
FPLNKLTEL

SEQ ID NO: 65288 - protein, 9 aa, Homo Sapiens
FPMAKLLYL

SEQ ID NO: 65289 - protein, 9 aa, Homo Sapiens
FPPKKLFSL

SEQ ID NO: 65290 - protein, 9 aa, Homo Sapiens
FPVCPKLSL

SEQ ID NO: 65291 - protein, 9 aa, Homo Sapiens
FPWEKPTTL

SEQ ID NO: 65292 - protein, 9 aa, Homo Sapiens
FQKVKEWSL

SEQ ID NO: 65293 - protein, 9 aa, Homo Sapiens
FQMKKVLCL

SEQ ID NO: 65294 - protein, 9 aa, Homo Sapiens
FSFVRVISL

SEQ ID NO: 65295 - protein, 9 aa, Homo Sapiens
FSKMKALAV

SEQ ID NO: 65296 - protein, 9 aa, Homo Sapiens
FTIFRTISV

SEQ ID NO: 65297 - protein, 9 aa, Homo Sapiens
FVKILIVEI

SEQ ID NO: 65298 - protein, 9 aa, Homo Sapiens
FVKLRIDLL

SEQ ID NO: 65299 - protein, 9 aa, Homo Sapiens
FVKTKVWSL

SEQ ID NO: 65300 - protein, 9 aa, Homo Sapiens
FVLQRLVFL

SEQ ID NO: 65301 - protein, 9 aa, Homo Sapiens
FVMLRVFQL

SEQ ID NO: 65302 - protein, 9 aa, Homo Sapiens
FVQPRLESL

SEQ ID NO: 65303 - protein, 9 aa, Homo Sapiens
GLCERLVSL

SEQ ID NO: 65304 - protein, 9 aa, Homo Sapiens
GLKVREYEL

SEQ ID NO: 65305 - protein, 9 aa, Homo Sapiens
HAIQKLYSL

SEQ ID NO: 65306 - protein, 9 aa, Homo Sapiens
HALERLFTM

SEQ ID NO: 65307 - protein, 9 aa, Homo Sapiens
HFLQKLYSL

SEQ ID NO: 65308 - protein, 9 aa, Homo Sapiens
HLAVKHFSV

SEQ ID NO: 65309 - protein, 9 aa, Homo Sapiens
HLEIKVLCL

SEQ ID NO: 65310 - protein, 9 aa, Homo Sapiens
HLFQRLAAL

SEQ ID NO: 65311 - protein, 9 aa, Homo Sapiens
HLILRAEGL

SEQ ID NO: 65312 - protein, 9 aa, Homo Sapiens
HLKALTSEL

SEQ ID NO: 65313 - protein, 9 aa, Homo Sapiens
HLKPISREL

SEQ ID NO: 65314 - protein, 9 aa, Homo Sapiens
HLKQHYIDL

SEQ ID NO: 65315 - protein, 9 aa, Homo Sapiens
HLVQKPFSL

SEQ ID NO: 65316 - protein, 9 aa, Homo Sapiens
HLYARQLTL

SEQ ID NO: 65317 - protein, 9 aa, Homo Sapiens
HPYNKLWSL

SEQ ID NO: 65318 - protein, 9 aa, Homo Sapiens
HVITKTMEL

SEQ ID NO: 65319 - protein, 9 aa, Homo Sapiens
HVNIRLVEL

SEQ ID NO: 65320 - protein, 9 aa, Homo Sapiens
IFKSRLVEL

SEQ ID NO: 65321 - protein, 9 aa, Homo Sapiens
IGKMRYVSV

SEQ ID NO: 65322 - protein, 9 aa, Homo Sapiens
ILAIRQNAL

SEQ ID NO: 65323 - protein, 9 aa, Homo Sapiens
ILILRALHV

SEQ ID NO: 65324 - protein, 9 aa, Homo Sapiens
ILIRKVSSL

SEQ ID NO: 65325 - protein, 9 aa, Homo Sapiens
ILKEKWSAL

SEQ ID NO: 65326 - protein, 9 aa, Homo Sapiens
ILKKVLEAL

SEQ ID NO: 65327 - protein, 9 aa, Homo Sapiens
ILLEKILSL

SEQ ID NO: 65328 - protein, 9 aa, Homo Sapiens
ILRAILLSL

SEQ ID NO: 65329 - protein, 9 aa, Homo Sapiens
IPALRDISI

SEQ ID NO: 65330 - protein, 9 aa, Homo Sapiens
IPKSKFLAL

SEQ ID NO: 65331 - protein, 9 aa, Homo Sapiens
IPLAKRVAL

SEQ ID NO: 65332 - protein, 9 aa, Homo Sapiens
IPLHVFVLL

SEQ ID NO: 65333 - protein, 9 aa, Homo Sapiens
IPNEIIHAL

SEQ ID NO: 65334 - protein, 9 aa, Homo Sapiens
IPNVRIQAV

SEQ ID NO: 65335 - protein, 9 aa, Homo Sapiens
IPQLRVSSV

SEQ ID NO: 65336 - protein, 9 aa, Homo Sapiens
IPQVKYICL

SEQ ID NO: 65337 - protein, 9 aa, Homo Sapiens
ISPKVKMAL

SEQ ID NO: 65338 - protein, 9 aa, Homo Sapiens
LAAARLAAA

SEQ ID NO: 65339 - protein, 9 aa, Homo Sapiens
LAMLRSLDL

SEQ ID NO: 65340 - protein, 9 aa, Homo Sapiens
LFNKQLESI

SEQ ID NO: 65341 - protein, 9 aa, Homo Sapiens
LFRDKVVAL

SEQ ID NO: 65342 - protein, 9 aa, Homo Sapiens
LGKERFLEL

SEQ ID NO: 65343 - protein, 9 aa, Homo Sapiens
LIRIKPLKL

SEQ ID NO: 65344 - protein, 9 aa, Homo Sapiens
LLFKKVKAL

SEQ ID NO: 65345 - protein, 9 aa, Homo Sapiens
LLFLRASEL

SEQ ID NO: 65346 - protein, 9 aa, Homo Sapiens
LLILRPEEL

SEQ ID NO: 65347 - protein, 9 aa, Homo Sapiens
LLKEHYVDL

SEQ ID NO: 65348 - protein, 9 aa, Homo Sapiens
LLKIKDTVL

SEQ ID NO: 65349 - protein, 9 aa, Homo Sapiens
LLKSKLLVL

SEQ ID NO: 65350 - protein, 9 aa, Homo Sapiens
LLLDKKYAL

SEQ ID NO: 65351 - protein, 9 aa, Homo Sapiens
LLLERAKEL

SEQ ID NO: 65352 - protein, 9 aa, Homo Sapiens
LLNQKPLSL

SEQ ID NO: 65353 - protein, 9 aa, Homo Sapiens
LLQIRAEAL

SEQ ID NO: 65354 - protein, 9 aa, Homo Sapiens
LLQLKVKCL

SEQ ID NO: 65355 - protein, 9 aa, Homo Sapiens
LLRAHVICL

SEQ ID NO: 65356 - protein, 9 aa, Homo Sapiens
LLREKVEFL

SEQ ID NO: 65357 - protein, 9 aa, Homo Sapiens
LLRIKINEL

SEQ ID NO: 65358 - protein, 9 aa, Homo Sapiens
LLRLFKTAL

SEQ ID NO: 65359 - protein, 9 aa, Homo Sapiens
LLTLKLVSL

SEQ ID NO: 65360 - protein, 9 aa, Homo Sapiens
LLYEKGISL

SEQ ID NO: 65361 - protein, 9 aa, Homo Sapiens
LPALRSIGL

SEQ ID NO: 65362 - protein, 9 aa, Homo Sapiens
LPDERTISL

SEQ ID NO: 65363 - protein, 9 aa, Homo Sapiens
LPDIKVLTL

SEQ ID NO: 65364 - protein, 9 aa, Homo Sapiens
LPFLRITSL

SEQ ID NO: 65365 - protein, 9 aa, Homo Sapiens
LPHHRVIEV

SEQ ID NO: 65366 - protein, 9 aa, Homo Sapiens
LPHNRLVSL

SEQ ID NO: 65367 - protein, 9 aa, Homo Sapiens
LPIKESEII

SEQ ID NO: 65368 - protein, 9 aa, Homo Sapiens
LPKLHIVQV

SEQ ID NO: 65369 - protein, 9 aa, Homo Sapiens
LPLEKVYSL

SEQ ID NO: 65370 - protein, 9 aa, Homo Sapiens
LPLHKVKSL

SEQ ID NO: 65371 - protein, 9 aa, Homo Sapiens
LPLLRVLSI

SEQ ID NO: 65372 - protein, 9 aa, Homo Sapiens
LPLMKFLEV

SEQ ID NO: 65373 - protein, 9 aa, Homo Sapiens
LPQIKIISA

SEQ ID NO: 65374 - protein, 9 aa, Homo Sapiens
LPQYRLISI

SEQ ID NO: 65375 - protein, 9 aa, Homo Sapiens
LPRVRLLPL

SEQ ID NO: 65376 - protein, 9 aa, Homo Sapiens
LPSLKVSCL

SEQ ID NO: 65377 - protein, 9 aa, Homo Sapiens
LPSRKLVAL

SEQ ID NO: 65378 - protein, 9 aa, Homo Sapiens
LPWKRIVAV

SEQ ID NO: 65379 - protein, 9 aa, Homo Sapiens
LQIQRNVTL

SEQ ID NO: 65380 - protein, 9 aa, Homo Sapiens
LQLLQRATL

SEQ ID NO: 65381 - protein, 9 aa, Homo Sapiens
MALVRFVNL

SEQ ID NO: 65382 - protein, 9 aa, Homo Sapiens
MAPLKMLAL

SEQ ID NO: 65383 - protein, 9 aa, Homo Sapiens
MFHIRAVIL

SEQ ID NO: 65384 - protein, 9 aa, Homo Sapiens
MIIIVGTRI

SEQ ID NO: 65385 - protein, 9 aa, Homo Sapiens
MIKEKLCYV

SEQ ID NO: 65386 - protein, 9 aa, Homo Sapiens
MIKPRIVLL

SEQ ID NO: 65387 - protein, 9 aa, Homo Sapiens
MLAARLVCL

SEQ ID NO: 65388 - protein, 9 aa, Homo Sapiens
MLATRVFSL

SEQ ID NO: 65389 - protein, 9 aa, Homo Sapiens
MLLSKINSL

SEQ ID NO: 65390 - protein, 9 aa, Homo Sapiens
MLYPKLISL

SEQ ID NO: 65391 - protein, 9 aa, Homo Sapiens
MMKLIINSL

SEQ ID NO: 65392 - protein, 9 aa, Homo Sapiens
MNILRFLAL

SEQ ID NO: 65393 - protein, 9 aa, Homo Sapiens
MPALRSINL

SEQ ID NO: 65394 - protein, 9 aa, Homo Sapiens
MPAVKAIIY

SEQ ID NO: 65395 - protein, 9 aa, Homo Sapiens
MPGTRFIAF

SEQ ID NO: 65396 - protein, 9 aa, Homo Sapiens
MPSSRLWSL

SEQ ID NO: 65397 - protein, 9 aa, Homo Sapiens
MPTMRLLSF

SEQ ID NO: 65398 - protein, 9 aa, Homo Sapiens
MVLLRKLCL

SEQ ID NO: 65399 - protein, 9 aa, Homo Sapiens
NFIEKVEAL

SEQ ID NO: 65400 - protein, 9 aa, Homo Sapiens
NGYKRVLAL

SEQ ID NO: 65401 - protein, 9 aa, Homo Sapiens
NIKEKLFSL

SEQ ID NO: 65402 - protein, 9 aa, Homo Sapiens
NILDRFLAL

SEQ ID NO: 65403 - protein, 9 aa, Homo Sapiens
NIWIRVASL

SEQ ID NO: 65404 - protein, 9 aa, Homo Sapiens
NLAERIKSL

SEQ ID NO: 65405 - protein, 9 aa, Homo Sapiens
NLFTRPEVL

SEQ ID NO: 65406 - protein, 9 aa, Homo Sapiens
NLHLKFLAL

SEQ ID NO: 65407 - protein, 9 aa, Homo Sapiens
NLKAHVVAV

SEQ ID NO: 65408 - protein, 9 aa, Homo Sapiens
NLKEKIKEL

SEQ ID NO: 65409 - protein, 9 aa, Homo Sapiens
NLKIKWENL

SEQ ID NO: 65410 - protein, 9 aa, Homo Sapiens
NLKLKLHSF

SEQ ID NO: 65411 - protein, 9 aa, Homo Sapiens
NLKLKLHTF

SEQ ID NO: 65412 - protein, 9 aa, Homo Sapiens
NLKLKLTAV

SEQ ID NO: 65413 - protein, 9 aa, Homo Sapiens
NLKLRIYFL

SEQ ID NO: 65414 - protein, 9 aa, Homo Sapiens
NLKSKYFAV

SEQ ID NO: 65415 - protein, 9 aa, Homo Sapiens
NLLKRFLVL

SEQ ID NO: 65416 - protein, 9 aa, Homo Sapiens
NLLPRLAAF

SEQ ID NO: 65417 - protein, 9 aa, Homo Sapiens
NLYRKFWSL

SEQ ID NO: 65418 - protein, 9 aa, Homo Sapiens
NPIWRVISL

SEQ ID NO: 65419 - protein, 9 aa, Homo Sapiens
NPLLRVINL

SEQ ID NO: 65420 - protein, 9 aa, Homo Sapiens
NPYSRLMAL

SEQ ID NO: 65421 - protein, 9 aa, Homo Sapiens
PIATRIFDI

SEQ ID NO: 65422 - protein, 9 aa, Homo Sapiens
QAITRVIPL

SEQ ID NO: 65423 - protein, 9 aa, Homo Sapiens
QANIRLTSL

SEQ ID NO: 65424 - protein, 9 aa, Homo Sapiens
QAWLRLTSL

SEQ ID NO: 65425 - protein, 9 aa, Homo Sapiens
QGFFRSISL

SEQ ID NO: 65426 - protein, 9 aa, Homo Sapiens
QILPKIKAI

SEQ ID NO: 65427 - protein, 9 aa, Homo Sapiens
QIVERLFSL

SEQ ID NO: 65428 - protein, 9 aa, Homo Sapiens
QLELRVEAL

SEQ ID NO: 65429 - protein, 9 aa, Homo Sapiens
QLFQRPNAL

SEQ ID NO: 65430 - protein, 9 aa, Homo Sapiens
QLFQRTNAL

SEQ ID NO: 65431 - protein, 9 aa, Homo Sapiens
QLFVRAQEL

SEQ ID NO: 65432 - protein, 9 aa, Homo Sapiens
QLFVRLLAL

SEQ ID NO: 65433 - protein, 9 aa, Homo Sapiens
QLHIKVTSL

SEQ ID NO: 65434 - protein, 9 aa, Homo Sapiens
QLIEKRLNL

SEQ ID NO: 65435 - protein, 9 aa, Homo Sapiens
QLIQKFISV

SEQ ID NO: 65436 - protein, 9 aa, Homo Sapiens
QLLEKVIEL

SEQ ID NO: 65437 - protein, 9 aa, Homo Sapiens
QLLLKALTL

SEQ ID NO: 65438 - protein, 9 aa, Homo Sapiens
QLLLKKMYL

SEQ ID NO: 65439 - protein, 9 aa, Homo Sapiens
QLSLRTVSL

SEQ ID NO: 65440 - protein, 9 aa, Homo Sapiens
QLYLKLWNL

SEQ ID NO: 65441 - protein, 9 aa, Homo Sapiens
QLYRKYLEL

SEQ ID NO: 65442 - protein, 9 aa, Homo Sapiens
QNLVKIMSL

SEQ ID NO: 65443 - protein, 9 aa, Homo Sapiens
QNMIKGVTL

SEQ ID NO: 65444 - protein, 9 aa, Homo Sapiens
QPIIRIQSI

SEQ ID NO: 65445 - protein, 9 aa, Homo Sapiens
QPILRFLQL

SEQ ID NO: 65446 - protein, 9 aa, Homo Sapiens
QSLERVYSL

SEQ ID NO: 65447 - protein, 9 aa, Homo Sapiens
QSMIRILGL

SEQ ID NO: 65448 - protein, 9 aa, Homo Sapiens
QVIIRVLEL

SEQ ID NO: 65449 - protein, 9 aa, Homo Sapiens
QVLLRCLTL

SEQ ID NO: 65450 - protein, 9 aa, Homo Sapiens
QYHIKPLSL

SEQ ID NO: 65451 - protein, 9 aa, Homo Sapiens
RPKIKVSLI

SEQ ID NO: 65452 - protein, 9 aa, Homo Sapiens
RPKYQFLSL

SEQ ID NO: 65453 - protein, 9 aa, Homo Sapiens
RPWLRPAAL

SEQ ID NO: 65454 - protein, 9 aa, Homo Sapiens
SAFLKTIAL

SEQ ID NO: 65455 - protein, 9 aa, Homo Sapiens
SAGLRVLAL

SEQ ID NO: 65456 - protein, 9 aa, Homo Sapiens
SALERLTTL

SEQ ID NO: 65457 - protein, 9 aa, Homo Sapiens
SAMVRVISV

SEQ ID NO: 65458 - protein, 9 aa, Homo Sapiens
SIIQRLLEV

SEQ ID NO: 65459 - protein, 9 aa, Homo Sapiens
SIKKLITSM

SEQ ID NO: 65460 - protein, 9 aa, Homo Sapiens
SILQRPLSL

SEQ ID NO: 65461 - protein, 9 aa, Homo Sapiens
SKRYLFISI

SEQ ID NO: 65462 - protein, 9 aa, Homo Sapiens
SLAVRVNSL

SEQ ID NO: 65463 - protein, 9 aa, Homo Sapiens
SLFKRLYSL

SEQ ID NO: 65464 - protein, 9 aa, Homo Sapiens
SLITRLLEV

SEQ ID NO: 65465 - protein, 9 aa, Homo Sapiens
SLKERFAFL

SEQ ID NO: 65466 - protein, 9 aa, Homo Sapiens
SLKLKWLAL

SEQ ID NO: 65467 - protein, 9 aa, Homo Sapiens
SLLEKLSAL

SEQ ID NO: 65468 - protein, 9 aa, Homo Sapiens
SMLNRILAV

SEQ ID NO: 65469 - protein, 9 aa, Homo Sapiens
SMLQRVLHL

SEQ ID NO: 65470 - protein, 9 aa, Homo Sapiens
SNKVRILEL

SEQ ID NO: 65471 - protein, 9 aa, Homo Sapiens
SPLTKSISL

SEQ ID NO: 65472 - protein, 9 aa, Homo Sapiens
SPYLRPLTL

SEQ ID NO: 65473 - protein, 9 aa, Homo Sapiens
SQMLRAVSL

SEQ ID NO: 65474 - protein, 9 aa, Homo Sapiens
SRVLKVLSV

SEQ ID NO: 65475 - protein, 9 aa, Homo Sapiens
SVFQRYLAL

SEQ ID NO: 65476 - protein, 9 aa, Homo Sapiens
SVLVRQISL

SEQ ID NO: 65477 - protein, 9 aa, Homo Sapiens
TAKFHFVDL

SEQ ID NO: 65478 - protein, 9 aa, Homo Sapiens
TAKIRPFAV

SEQ ID NO: 65479 - protein, 9 aa, Homo Sapiens
TALLIMRTV

SEQ ID NO: 65480 - protein, 9 aa, Homo Sapiens
TALLKSLSA

SEQ ID NO: 65481 - protein, 9 aa, Homo Sapiens
TALMKLKSL

SEQ ID NO: 65482 - protein, 9 aa, Homo Sapiens
TALPRIFSL

SEQ ID NO: 65483 - protein, 9 aa, Homo Sapiens
TFIQRVQSL

SEQ ID NO: 65484 - protein, 9 aa, Homo Sapiens
TFLQRLISL

SEQ ID NO: 65485 - protein, 9 aa, Homo Sapiens
TGYLKGYTL

SEQ ID NO: 65486 - protein, 9 aa, Homo Sapiens
TIIPKVLAM

SEQ ID NO: 65487 - protein, 9 aa, Homo Sapiens
TIKKRFKVL

SEQ ID NO: 65488 - protein, 9 aa, Homo Sapiens
TIMPKDIQL

SEQ ID NO: 65489 - protein, 9 aa, Homo Sapiens
TLFKKIQAL

SEQ ID NO: 65490 - protein, 9 aa, Homo Sapiens
TLIHKPVSL

SEQ ID NO: 65491 - protein, 9 aa, Homo Sapiens
TLKEYLESL

SEQ ID NO: 65492 - protein, 9 aa, Homo Sapiens
TLKRTIEAL

SEQ ID NO: 65493 - protein, 9 aa, Homo Sapiens
TLLERAFSL

SEQ ID NO: 65494 - protein, 9 aa, Homo Sapiens
TLMIKTITL

SEQ ID NO: 65495 - protein, 9 aa, Homo Sapiens
TLNEKLTAL

SEQ ID NO: 65496 - protein, 9 aa, Homo Sapiens
TLNIKPVSL

SEQ ID NO: 65497 - protein, 9 aa, Homo Sapiens
TLRLKVEEL

SEQ ID NO: 65498 - protein, 9 aa, Homo Sapiens
TLTSKLYSL

SEQ ID NO: 65499 - protein, 9 aa, Homo Sapiens
TNMLKVVAL

SEQ ID NO: 65500 - protein, 9 aa, Homo Sapiens
TNTLRILAL

SEQ ID NO: 65501 - protein, 9 aa, Homo Sapiens
TPHLRNLAV

SEQ ID NO: 65502 - protein, 9 aa, Homo Sapiens
TPILKPVSL

SEQ ID NO: 65503 - protein, 9 aa, Homo Sapiens
TPISRLVAL

SEQ ID NO: 65504 - protein, 9 aa, Homo Sapiens
TPLARIVAF

SEQ ID NO: 65505 - protein, 9 aa, Homo Sapiens
TPMFREYSL

SEQ ID NO: 65506 - protein, 9 aa, Homo Sapiens
TVKVHVVAL

SEQ ID NO: 65507 - protein, 9 aa, Homo Sapiens
VAAKKNVSI

SEQ ID NO: 65508 - protein, 9 aa, Homo Sapiens
VALLRVTPF

SEQ ID NO: 65509 - protein, 9 aa, Homo Sapiens
VGLIRNLAL

SEQ ID NO: 65510 - protein, 9 aa, Homo Sapiens
VGLLRLHSL

SEQ ID NO: 65511 - protein, 9 aa, Homo Sapiens
VIIEKTYSL

SEQ ID NO: 65512 - protein, 9 aa, Homo Sapiens
VLHVKTESL

SEQ ID NO: 65513 - protein, 9 aa, Homo Sapiens
VLMIKALEL

SEQ ID NO: 65514 - protein, 9 aa, Homo Sapiens
VLQQRLIAL

SEQ ID NO: 65515 - protein, 9 aa, Homo Sapiens
VMAPRSLIL

SEQ ID NO: 65516 - protein, 9 aa, Homo Sapiens
VPFERPAVI

SEQ ID NO: 65517 - protein, 9 aa, Homo Sapiens
VPLLKSLEV

SEQ ID NO: 65518 - protein, 9 aa, Homo Sapiens
VPLPRLLEV

SEQ ID NO: 65519 - protein, 9 aa, Homo Sapiens
VPLVREITF

SEQ ID NO: 65520 - protein, 9 aa, Homo Sapiens
VPMFRNVSL

SEQ ID NO: 65521 - protein, 9 aa, Homo Sapiens
VPYEKGFAL

SEQ ID NO: 65522 - protein, 9 aa, Homo Sapiens
VPYLKIFTV

SEQ ID NO: 65523 - protein, 9 aa, Homo Sapiens
WIHVKPERL

SEQ ID NO: 65524 - protein, 9 aa, Homo Sapiens
WIKEKIYVL

SEQ ID NO: 65525 - protein, 9 aa, Homo Sapiens
WLHLIPQTL

SEQ ID NO: 65526 - protein, 9 aa, Homo Sapiens
WLKICRLTA

SEQ ID NO: 65527 - protein, 9 aa, Homo Sapiens
WMHKVPASL

SEQ ID NO: 65528 - protein, 9 aa, Homo Sapiens
WVKEKVVAL

SEQ ID NO: 65529 - protein, 9 aa, Homo Sapiens
YAFPKAVSV

SEQ ID NO: 65530 - protein, 9 aa, Homo Sapiens
YAFVRPVIL

SEQ ID NO: 65531 - protein, 9 aa, Homo Sapiens
YAKIHIPII

SEQ ID NO: 65532 - protein, 9 aa, Homo Sapiens
YAKIVEIPF

SEQ ID NO: 65533 - protein, 9 aa, Homo Sapiens
YALNHTLSV

SEQ ID NO: 65534 - protein, 9 aa, Homo Sapiens
YAQIRTIAI

SEQ ID NO: 65535 - protein, 9 aa, Homo Sapiens
YARLHPRAV

SEQ ID NO: 65536 - protein, 9 aa, Homo Sapiens
YFKIYIDSL

SEQ ID NO: 65537 - protein, 9 aa, Homo Sapiens
YFLSRAQSL

SEQ ID NO: 65538 - protein, 9 aa, Homo Sapiens
YFRVMVDSL

SEQ ID NO: 65539 - protein, 9 aa, Homo Sapiens
YGFEKPSAI

SEQ ID NO: 65540 - protein, 9 aa, Homo Sapiens
YGKIAVMEL

SEQ ID NO: 65541 - protein, 9 aa, Homo Sapiens
YGMERVWCV

SEQ ID NO: 65542 - protein, 9 aa, Homo Sapiens
YGYVRAEVL

SEQ ID NO: 65543 - protein, 9 aa, Homo Sapiens
YIHVHFLEV

SEQ ID NO: 65544 - protein, 9 aa, Homo Sapiens
YIIKDKHIL

SEQ ID NO: 65545 - protein, 9 aa, Homo Sapiens
YIKRLLETL

SEQ ID NO: 65546 - protein, 9 aa, Homo Sapiens
YILGKFFAL

SEQ ID NO: 65547 - protein, 9 aa, Homo Sapiens
YLAIRTAQI

SEQ ID NO: 65548 - protein, 9 aa, Homo Sapiens
YLFERIKEL

SEQ ID NO: 65549 - protein, 9 aa, Homo Sapiens
YLFERTFNL

SEQ ID NO: 65550 - protein, 9 aa, Homo Sapiens
YLGAKPRSL

SEQ ID NO: 65551 - protein, 9 aa, Homo Sapiens
YLKPYFLEA

SEQ ID NO: 65552 - protein, 9 aa, Homo Sapiens
YLKTKFICV

SEQ ID NO: 65553 - protein, 9 aa, Homo Sapiens
YLKVKGNVF

SEQ ID NO: 65554 - protein, 9 aa, Homo Sapiens
YLKVLPQEL

SEQ ID NO: 65555 - protein, 9 aa, Homo Sapiens
YLKVLVDSL

SEQ ID NO: 65556 - protein, 9 aa, Homo Sapiens
YLKVRPDEI

SEQ ID NO: 65557 - protein, 9 aa, Homo Sapiens
YLLEKFVAV

SEQ ID NO: 65558 - protein, 9 aa, Homo Sapiens
YLLEKSRAI

SEQ ID NO: 65559 - protein, 9 aa, Homo Sapiens
YLLEKSRIV

SEQ ID NO: 65560 - protein, 9 aa, Homo Sapiens
YLLEKSRVI

SEQ ID NO: 65561 - protein, 9 aa, Homo Sapiens
YLLLKTHQL

SEQ ID NO: 65562 - protein, 9 aa, Homo Sapiens
YLLQRAVEV

SEQ ID NO: 65563 - protein, 9 aa, Homo Sapiens
YLNVREAVL

SEQ ID NO: 65564 - protein, 9 aa, Homo Sapiens
YLPTRVTAI

SEQ ID NO: 65565 - protein, 9 aa, Homo Sapiens
YLRELLTTM

SEQ ID NO: 65566 - protein, 9 aa, Homo Sapiens
YLRLVETSL

SEQ ID NO: 65567 - protein, 9 aa, Homo Sapiens
YLRNLTWTL

SEQ ID NO: 65568 - protein, 9 aa, Homo Sapiens
YLRQYPFQL

SEQ ID NO: 65569 - protein, 9 aa, Homo Sapiens
YLSPKLWAL

SEQ ID NO: 65570 - protein, 9 aa, Homo Sapiens
YMYQLFRSL

SEQ ID NO: 65571 - protein, 9 aa, Homo Sapiens
YPFQKPVTL

SEQ ID NO: 65572 - protein, 9 aa, Homo Sapiens
YPKLKTDVL

SEQ ID NO: 65573 - protein, 9 aa, Homo Sapiens
YPLLKDPSL

SEQ ID NO: 65574 - protein, 9 aa, Homo Sapiens
YPLLKNISM

SEQ ID NO: 65575 - protein, 9 aa, Homo Sapiens
YPNERFELL

SEQ ID NO: 65576 - protein, 9 aa, Homo Sapiens
YVKLTPVSL

SEQ ID NO: 65577 - protein, 9 aa, Homo Sapiens
YVLLKALAL

SEQ ID NO: 65578 - protein, 10 aa, Homo Sapiens
DIKESHLIEL

SEQ ID NO: 65579 - protein, 10 aa, Homo Sapiens
DLRTKATIEL

SEQ ID NO: 65580 - protein, 10 aa, Homo Sapiens
EAFLKHILSV

SEQ ID NO: 65581 - protein, 10 aa, Homo Sapiens
EAYLKYIEGL

SEQ ID NO: 65582 - protein, 10 aa, Homo Sapiens
FMKEKLLAEL

SEQ ID NO: 65583 - protein, 10 aa, Homo Sapiens
FPLIKEIISI

SEQ ID NO: 65584 - protein, 10 aa, Homo Sapiens
FPTVHAVILL

SEQ ID NO: 65585 - protein, 10 aa, Homo Sapiens
IISPKVKMAL

SEQ ID NO: 65586 - protein, 10 aa, Homo Sapiens
IPIVHRVIKV

SEQ ID NO: 65587 - protein, 10 aa, Homo Sapiens
KVTSLGVLLL

SEQ ID NO: 65588 - protein, 10 aa, Homo Sapiens
LINGRTNLSI

SEQ ID NO: 65589 - protein, 10 aa, Homo Sapiens
LLKIKGVISF

SEQ ID NO: 65590 - protein, 10 aa, Homo Sapiens
LPFQKDGIIF

SEQ ID NO: 65591 - protein, 10 aa, Homo Sapiens
LPHLRNKLVI

SEQ ID NO: 65592 - protein, 10 aa, Homo Sapiens
LSGMLFLNSL

SEQ ID NO: 65593 - protein, 10 aa, Homo Sapiens
MPFIKSQHEL

SEQ ID NO: 65594 - protein, 10 aa, Homo Sapiens
MPSLKHIVEL

SEQ ID NO: 65595 - protein, 10 aa, Homo Sapiens
TIPPMEKAVV

SEQ ID NO: 65596 - protein, 10 aa, Homo Sapiens
VLLKARLVPA

SEQ ID NO: 65597 - protein, 10 aa, Homo Sapiens
WPLIKATVGL

SEQ ID NO: 65598 - protein, 10 aa, Homo Sapiens
YAYLKAIVLF

SEQ ID NO: 65599 - protein, 10 aa, Homo Sapiens
YLFDRNGVCL

SEQ ID NO: 65600 - protein, 11 aa, Homo Sapiens
DIKLKDIEHAL

SEQ ID NO: 65601 - protein, 11 aa, Homo Sapiens
DLRSGLLHVAI

SEQ ID NO: 65602 - protein, 11 aa, Homo Sapiens
FIFEKKLAQAL

SEQ ID NO: 65603 - protein, 11 aa, Homo Sapiens
LPHLRNKLVIK

SEQ ID NO: 65604 - protein, 11 aa, Homo Sapiens
LPRIKTEIEAL

SEQ ID NO: 65605 - protein, 11 aa, Homo Sapiens
SIISPKVKMAL

SEQ ID NO: 65606 - protein, 11 aa, Homo Sapiens
SLFTKELEHAL

SEQ ID NO: 65607 - protein, 11 aa, Homo Sapiens
VPLLKTLDHVL

SEQ ID NO: 65608 - protein, 11 aa, Homo Sapiens
VPNLHKVIVVW

SEQ ID NO: 65609 - protein, 11 aa, Homo Sapiens
VVLLKARLVPA

SEQ ID NO: 65610 - protein, 8 aa, Homo Sapiens
ALAPILDD

SEQ ID NO: 65611 - protein, 8 aa, Homo Sapiens
AQSKDFAV

SEQ ID NO: 65612 - protein, 8 aa, Homo Sapiens
AVDKAYKL

SEQ ID NO: 65613 - protein, 8 aa, Homo Sapiens
GQFKTYAI

SEQ ID NO: 65614 - protein, 8 aa, Homo Sapiens
HQDLSQKI

SEQ ID NO: 65615 - protein, 8 aa, Homo Sapiens
HQTSAESW

SEQ ID NO: 65616 - protein, 8 aa, Homo Sapiens
ILGPTFTL

SEQ ID NO: 65617 - protein, 8 aa, Homo Sapiens
IQGPDYVL

SEQ ID NO: 65618 - protein, 8 aa, Homo Sapiens
ISMGDHLW

SEQ ID NO: 65619 - protein, 8 aa, Homo Sapiens
KLGPEKRI

SEQ ID NO: 65620 - protein, 8 aa, Homo Sapiens
LQKKNHLI

SEQ ID NO: 65621 - protein, 8 aa, Homo Sapiens
LQWLKIII

SEQ ID NO: 65622 - protein, 8 aa, Homo Sapiens
RLAPNFRW

SEQ ID NO: 65623 - protein, 8 aa, Homo Sapiens
RQSLEVKM

SEQ ID NO: 65624 - protein, 8 aa, Homo Sapiens
RQYKDYKI

SEQ ID NO: 65625 - protein, 8 aa, Homo Sapiens
SVCKDFVW

SEQ ID NO: 65626 - protein, 8 aa, Homo Sapiens
VQAPDWHL

SEQ ID NO: 65627 - protein, 8 aa, Homo Sapiens
VQGPDWHL

SEQ ID NO: 65628 - protein, 8 aa, Homo Sapiens
YQDTPKQI

SEQ ID NO: 65629 - protein, 9 aa, Homo Sapiens
AESHIILVL

SEQ ID NO: 65630 - protein, 9 aa, Homo Sapiens
AETAVQLFI

SEQ ID NO: 65631 - protein, 9 aa, Homo Sapiens
AETHIVLLF

SEQ ID NO: 65632 - protein, 9 aa, Homo Sapiens
AGDGTFQKW

SEQ ID NO: 65633 - protein, 9 aa, Homo Sapiens
AGDRTFQKW

SEQ ID NO: 65634 - protein, 9 aa, Homo Sapiens
AIDFSHEEW

SEQ ID NO: 65635 - protein, 9 aa, Homo Sapiens
AIDFTHEEW

SEQ ID NO: 65636 - protein, 9 aa, Homo Sapiens
AIDSIHQLW

SEQ ID NO: 65637 - protein, 9 aa, Homo Sapiens
AIESGQHYW

SEQ ID NO: 65638 - protein, 9 aa, Homo Sapiens
AIHPDMVTI

SEQ ID NO: 65639 - protein, 9 aa, Homo Sapiens
AILELDEHL

SEQ ID NO: 65640 - protein, 9 aa, Homo Sapiens
AISDLQQLW

SEQ ID NO: 65641 - protein, 9 aa, Homo Sapiens
AISSVRLYI

SEQ ID NO: 65642 - protein, 9 aa, Homo Sapiens
AIVKEIVNI

SEQ ID NO: 65643 - protein, 9 aa, Homo Sapiens
AIWKELISL

SEQ ID NO: 65644 - protein, 9 aa, Homo Sapiens
AIYGNEPEI

SEQ ID NO: 65645 - protein, 9 aa, Homo Sapiens
ALAAGEIGF

SEQ ID NO: 65646 - protein, 9 aa, Homo Sapiens
ALAEKEHKL

SEQ ID NO: 65647 - protein, 9 aa, Homo Sapiens
ALAKLVEAI

SEQ ID NO: 65648 - protein, 9 aa, Homo Sapiens
ALAKTEVSL

SEQ ID NO: 65649 - protein, 9 aa, Homo Sapiens
ALAPHEEYI

SEQ ID NO: 65650 - protein, 9 aa, Homo Sapiens
ALAPILDDG

SEQ ID NO: 65651 - protein, 9 aa, Homo Sapiens
ALAPKDKKI

SEQ ID NO: 65652 - protein, 9 aa, Homo Sapiens
ALAPPEVVM

SEQ ID NO: 65653 - protein, 9 aa, Homo Sapiens
ALAPSTMKI

SEQ ID NO: 65654 - protein, 9 aa, Homo Sapiens
ALARLVLRL

SEQ ID NO: 65655 - protein, 9 aa, Homo Sapiens
ALAVLEDRF

SEQ ID NO: 65656 - protein, 9 aa, Homo Sapiens
ALAVRGSDR

SEQ ID NO: 65657 - protein, 9 aa, Homo Sapiens
ALCATDFKF

SEQ ID NO: 65658 - protein, 9 aa, Homo Sapiens
ALCATDYTF

SEQ ID NO: 65659 - protein, 9 aa, Homo Sapiens
ALCGEQVHI

SEQ ID NO: 65660 - protein, 9 aa, Homo Sapiens
ALCNIHENI

SEQ ID NO: 65661 - protein, 9 aa, Homo Sapiens
ALCQEQIGW

SEQ ID NO: 65662 - protein, 9 aa, Homo Sapiens
ALDAHQQSI

SEQ ID NO: 65663 - protein, 9 aa, Homo Sapiens
ALDATHQQL

SEQ ID NO: 65664 - protein, 9 aa, Homo Sapiens
ALDEVVLKF

SEQ ID NO: 65665 - protein, 9 aa, Homo Sapiens
ALDKATVLL

SEQ ID NO: 65666 - protein, 9 aa, Homo Sapiens
ALDKSNTHI

SEQ ID NO: 65667 - protein, 9 aa, Homo Sapiens
ALDNSVYLW

SEQ ID NO: 65668 - protein, 9 aa, Homo Sapiens
ALDPTARKI

SEQ ID NO: 65669 - protein, 9 aa, Homo Sapiens
ALDTKGPEI

SEQ ID NO: 65670 - protein, 9 aa, Homo Sapiens
ALDTTRHEL

SEQ ID NO: 65671 - protein, 9 aa, Homo Sapiens
ALDVSFNKF

SEQ ID NO: 65672 - protein, 9 aa, Homo Sapiens
ALERRIEYI

SEQ ID NO: 65673 - protein, 9 aa, Homo Sapiens
ALERVLQDW

SEQ ID NO: 65674 - protein, 9 aa, Homo Sapiens
ALFNGAQKL

SEQ ID NO: 65675 - protein, 9 aa, Homo Sapiens
ALFNGISKW

SEQ ID NO: 65676 - protein, 9 aa, Homo Sapiens
ALFNPDVCW

SEQ ID NO: 65677 - protein, 9 aa, Homo Sapiens
ALFQIEQGI

SEQ ID NO: 65678 - protein, 9 aa, Homo Sapiens
ALFRELISW

SEQ ID NO: 65679 - protein, 9 aa, Homo Sapiens
ALGECYEKL

SEQ ID NO: 65680 - protein, 9 aa, Homo Sapiens
ALHNLDRKW

SEQ ID NO: 65681 - protein, 9 aa, Homo Sapiens
ALHVGFDNF

SEQ ID NO: 65682 - protein, 9 aa, Homo Sapiens
ALICFEEHI

SEQ ID NO: 65683 - protein, 9 aa, Homo Sapiens
ALIKDKILF

SEQ ID NO: 65684 - protein, 9 aa, Homo Sapiens
ALILGGDRM

SEQ ID NO: 65685 - protein, 9 aa, Homo Sapiens
ALILVDDRF

SEQ ID NO: 65686 - protein, 9 aa, Homo Sapiens
ALIPETTTL

SEQ ID NO: 65687 - protein, 9 aa, Homo Sapiens
ALIRLLESF

SEQ ID NO: 65688 - protein, 9 aa, Homo Sapiens
ALIWDIQQM

SEQ ID NO: 65689 - protein, 9 aa, Homo Sapiens
ALLAEGITW

SEQ ID NO: 65690 - protein, 9 aa, Homo Sapiens
ALLAGSEYL

SEQ ID NO: 65691 - protein, 9 aa, Homo Sapiens
ALLNLAERL

SEQ ID NO: 65692 - protein, 9 aa, Homo Sapiens
ALMAQEQKL

SEQ ID NO: 65693 - protein, 9 aa, Homo Sapiens
ALMEQRLFW

SEQ ID NO: 65694 - protein, 9 aa, Homo Sapiens
ALNIVGDLL

SEQ ID NO: 65695 - protein, 9 aa, Homo Sapiens
ALNQLFEKI

SEQ ID NO: 65696 - protein, 9 aa, Homo Sapiens
ALNSKDAAL

SEQ ID NO: 65697 - protein, 9 aa, Homo Sapiens
ALNSREPHM

SEQ ID NO: 65698 - protein, 9 aa, Homo Sapiens
ALPDQSFLW

SEQ ID NO: 65699 - protein, 9 aa, Homo Sapiens
ALPNVYEVI

SEQ ID NO: 65700 - protein, 9 aa, Homo Sapiens
ALQERDVAI

SEQ ID NO: 65701 - protein, 9 aa, Homo Sapiens
ALQKDALSI

SEQ ID NO: 65702 - protein, 9 aa, Homo Sapiens
ALQLGELKI

SEQ ID NO: 65703 - protein, 9 aa, Homo Sapiens
ALREENEQL

SEQ ID NO: 65704 - protein, 9 aa, Homo Sapiens
ALSCDNLTL

SEQ ID NO: 65705 - protein, 9 aa, Homo Sapiens
ALSDGVHKI

SEQ ID NO: 65706 - protein, 9 aa, Homo Sapiens
ALSDLALHF

SEQ ID NO: 65707 - protein, 9 aa, Homo Sapiens
ALSDYDLVL

SEQ ID NO: 65708 - protein, 9 aa, Homo Sapiens
ALSEMVEYI

SEQ ID NO: 65709 - protein, 9 aa, Homo Sapiens
ALSGCEISI

SEQ ID NO: 65710 - protein, 9 aa, Homo Sapiens
ALSKEIYVI

SEQ ID NO: 65711 - protein, 9 aa, Homo Sapiens
ALSKLREDF

SEQ ID NO: 65712 - protein, 9 aa, Homo Sapiens
ALSLVSCKL

SEQ ID NO: 65713 - protein, 9 aa, Homo Sapiens
ALSNLEVKL

SEQ ID NO: 65714 - protein, 9 aa, Homo Sapiens
ALSPVPSHW

SEQ ID NO: 65715 - protein, 9 aa, Homo Sapiens
ALSRLKLKL

SEQ ID NO: 65716 - protein, 9 aa, Homo Sapiens
ALTPLEPRL

SEQ ID NO: 65717 - protein, 9 aa, Homo Sapiens
ALTSAGDRF

SEQ ID NO: 65718 - protein, 9 aa, Homo Sapiens
ALTSIAQKI

SEQ ID NO: 65719 - protein, 9 aa, Homo Sapiens
ALVALKDLL

SEQ ID NO: 65720 - protein, 9 aa, Homo Sapiens
ALVRDILYV

SEQ ID NO: 65721 - protein, 9 aa, Homo Sapiens
ALVRFVNLI

SEQ ID NO: 65722 - protein, 9 aa, Homo Sapiens
ALYASRLYL

SEQ ID NO: 65723 - protein, 9 aa, Homo Sapiens
ALYGQPLLL

SEQ ID NO: 65724 - protein, 9 aa, Homo Sapiens
AMAKIQAKI

SEQ ID NO: 65725 - protein, 9 aa, Homo Sapiens
AMAPERTGW

SEQ ID NO: 65726 - protein, 9 aa, Homo Sapiens
AMDFTPEEW

SEQ ID NO: 65727 - protein, 9 aa, Homo Sapiens
AMHAQDPQM

SEQ ID NO: 65728 - protein, 9 aa, Homo Sapiens
AMIELVERL

SEQ ID NO: 65729 - protein, 9 aa, Homo Sapiens
AMVAPDVQI

SEQ ID NO: 65730 - protein, 9 aa, Homo Sapiens
AMYPKYDRI

SEQ ID NO: 65731 - protein, 9 aa, Homo Sapiens
AQAADVLEL

SEQ ID NO: 65732 - protein, 9 aa, Homo Sapiens
AQAALAVNI

SEQ ID NO: 65733 - protein, 9 aa, Homo Sapiens
AQAALQSSW

SEQ ID NO: 65734 - protein, 9 aa, Homo Sapiens
AQAAQQLWL

SEQ ID NO: 65735 - protein, 9 aa, Homo Sapiens
AQAAREFIL

SEQ ID NO: 65736 - protein, 9 aa, Homo Sapiens
AQAASQHVF

SEQ ID NO: 65737 - protein, 9 aa, Homo Sapiens
AQAEAADSW

SEQ ID NO: 65738 - protein, 9 aa, Homo Sapiens
AQAEYIEKF

SEQ ID NO: 65739 - protein, 9 aa, Homo Sapiens
AQAFIHNSL

SEQ ID NO: 65740 - protein, 9 aa, Homo Sapiens
AQAGDKCDF

SEQ ID NO: 65741 - protein, 9 aa, Homo Sapiens
AQAIKGMHI

SEQ ID NO: 65742 - protein, 9 aa, Homo Sapiens
AQAKAGNLM

SEQ ID NO: 65743 - protein, 9 aa, Homo Sapiens
AQAKPALKI

SEQ ID NO: 65744 - protein, 9 aa, Homo Sapiens
AQALAKLTI

SEQ ID NO: 65745 - protein, 9 aa, Homo Sapiens
AQALLEYHL

SEQ ID NO: 65746 - protein, 9 aa, Homo Sapiens
AQALVLQVF

SEQ ID NO: 65747 - protein, 9 aa, Homo Sapiens
AQAPPTAQL

SEQ ID NO: 65748 - protein, 9 aa, Homo Sapiens
AQAPSSFQL

SEQ ID NO: 65749 - protein, 9 aa, Homo Sapiens
AQAPVMNTW

SEQ ID NO: 65750 - protein, 9 aa, Homo Sapiens
AQAQEVFFL

SEQ ID NO: 65751 - protein, 9 aa, Homo Sapiens
AQAQIVQSW

SEQ ID NO: 65752 - protein, 9 aa, Homo Sapiens
AQAREFGNL

SEQ ID NO: 65753 - protein, 9 aa, Homo Sapiens
AQARINARL

SEQ ID NO: 65754 - protein, 9 aa, Homo Sapiens
AQATGIESL

SEQ ID NO: 65755 - protein, 9 aa, Homo Sapiens
AQATPDHVL

SEQ ID NO: 65756 - protein, 9 aa, Homo Sapiens
AQAVTTSKW

SEQ ID NO: 65757 - protein, 9 aa, Homo Sapiens
AQCLEHYEF

SEQ ID NO: 65758 - protein, 9 aa, Homo Sapiens
AQCLLRLVL

SEQ ID NO: 65759 - protein, 9 aa, Homo Sapiens
AQCNKAINI

SEQ ID NO: 65760 - protein, 9 aa, Homo Sapiens
AQCPIVERL

SEQ ID NO: 65761 - protein, 9 aa, Homo Sapiens
AQCTLINFL

SEQ ID NO: 65762 - protein, 9 aa, Homo Sapiens
AQCVIYHEL

SEQ ID NO: 65763 - protein, 9 aa, Homo Sapiens
AQDDPDSCL

SEQ ID NO: 65764 - protein, 9 aa, Homo Sapiens
AQDEEIARL

SEQ ID NO: 65765 - protein, 9 aa, Homo Sapiens
AQDEHLITF

SEQ ID NO: 65766 - protein, 9 aa, Homo Sapiens
AQDGKIKVW

SEQ ID NO: 65767 - protein, 9 aa, Homo Sapiens
AQDIERASF

SEQ ID NO: 65768 - protein, 9 aa, Homo Sapiens
AQDKQFGTW

SEQ ID NO: 65769 - protein, 9 aa, Homo Sapiens
AQDLVYSFF

SEQ ID NO: 65770 - protein, 9 aa, Homo Sapiens
AQDNADYRL

SEQ ID NO: 65771 - protein, 9 aa, Homo Sapiens
AQDPEIASL

SEQ ID NO: 65772 - protein, 9 aa, Homo Sapiens
AQDPENQAL

SEQ ID NO: 65773 - protein, 9 aa, Homo Sapiens
AQDPSQLSF

SEQ ID NO: 65774 - protein, 9 aa, Homo Sapiens
AQDPVFQKL

SEQ ID NO: 65775 - protein, 9 aa, Homo Sapiens
AQDRQVCLW

SEQ ID NO: 65776 - protein, 9 aa, Homo Sapiens
AQDSAAVQI

SEQ ID NO: 65777 - protein, 9 aa, Homo Sapiens
AQDVFNHSW

SEQ ID NO: 65778 - protein, 9 aa, Homo Sapiens
AQDYLQCVL

SEQ ID NO: 65779 - protein, 9 aa, Homo Sapiens
AQEDGKVYI

SEQ ID NO: 65780 - protein, 9 aa, Homo Sapiens
AQEFFLHLI

SEQ ID NO: 65781 - protein, 9 aa, Homo Sapiens
AQEIGEERI

SEQ ID NO: 65782 - protein, 9 aa, Homo Sapiens
AQENCFQYL

SEQ ID NO: 65783 - protein, 9 aa, Homo Sapiens
AQEQGQHLI

SEQ ID NO: 65784 - protein, 9 aa, Homo Sapiens
AQERGVRCL

SEQ ID NO: 65785 - protein, 9 aa, Homo Sapiens
AQEVHSTGI

SEQ ID NO: 65786 - protein, 9 aa, Homo Sapiens
AQFEHTILL

SEQ ID NO: 65787 - protein, 9 aa, Homo Sapiens
AQFHPEVGL

SEQ ID NO: 65788 - protein, 9 aa, Homo Sapiens
AQFKGIEKL

SEQ ID NO: 65789 - protein, 9 aa, Homo Sapiens
AQFKGTQSL

SEQ ID NO: 65790 - protein, 9 aa, Homo Sapiens
AQFTTALRL

SEQ ID NO: 65791 - protein, 9 aa, Homo Sapiens
AQGDVRLCL

SEQ ID NO: 65792 - protein, 9 aa, Homo Sapiens
AQGGVLPNI

SEQ ID NO: 65793 - protein, 9 aa, Homo Sapiens
AQGKMKLLI

SEQ ID NO: 65794 - protein, 9 aa, Homo Sapiens
AQGPALDLI

SEQ ID NO: 65795 - protein, 9 aa, Homo Sapiens
AQHDAQEFM

SEQ ID NO: 65796 - protein, 9 aa, Homo Sapiens
AQHDDELTI

SEQ ID NO: 65797 - protein, 9 aa, Homo Sapiens
AQHGQPLNM

SEQ ID NO: 65798 - protein, 9 aa, Homo Sapiens
AQHIVPCTI

SEQ ID NO: 65799 - protein, 9 aa, Homo Sapiens
AQHPSALRF

SEQ ID NO: 65800 - protein, 9 aa, Homo Sapiens
AQHQTKLYL

SEQ ID NO: 65801 - protein, 9 aa, Homo Sapiens
AQHSVPLQL

SEQ ID NO: 65802 - protein, 9 aa, Homo Sapiens
AQHVEVESI

SEQ ID NO: 65803 - protein, 9 aa, Homo Sapiens
AQHYQDTLI

SEQ ID NO: 65804 - protein, 9 aa, Homo Sapiens
AQIKELEEL

SEQ ID NO: 65805 - protein, 9 aa, Homo Sapiens
AQIKEMVEL

SEQ ID NO: 65806 - protein, 9 aa, Homo Sapiens
AQILQSDLL

SEQ ID NO: 65807 - protein, 9 aa, Homo Sapiens
AQIPQKVLW

SEQ ID NO: 65808 - protein, 9 aa, Homo Sapiens
AQIPVVFRL

SEQ ID NO: 65809 - protein, 9 aa, Homo Sapiens
AQIRETETF

SEQ ID NO: 65810 - protein, 9 aa, Homo Sapiens
AQIRTIAII

SEQ ID NO: 65811 - protein, 9 aa, Homo Sapiens
AQITGTEHL

SEQ ID NO: 65812 - protein, 9 aa, Homo Sapiens
AQLAAAEKF

SEQ ID NO: 65813 - protein, 9 aa, Homo Sapiens
AQLEEEWGL

SEQ ID NO: 65814 - protein, 9 aa, Homo Sapiens
AQLNIGNVL

SEQ ID NO: 65815 - protein, 9 aa, Homo Sapiens
AQLPDRCTL

SEQ ID NO: 65816 - protein, 9 aa, Homo Sapiens
AQLPEQVTL

SEQ ID NO: 65817 - protein, 9 aa, Homo Sapiens
AQLPMSIRI

SEQ ID NO: 65818 - protein, 9 aa, Homo Sapiens
AQLRFIQAW

SEQ ID NO: 65819 - protein, 9 aa, Homo Sapiens
AQLRQYHRL

SEQ ID NO: 65820 - protein, 9 aa, Homo Sapiens
AQMDYQLRL

SEQ ID NO: 65821 - protein, 9 aa, Homo Sapiens
AQMFSDMVL

SEQ ID NO: 65822 - protein, 9 aa, Homo Sapiens
AQMGSEAHV

SEQ ID NO: 65823 - protein, 9 aa, Homo Sapiens
AQMLDPYLI

SEQ ID NO: 65824 - protein, 9 aa, Homo Sapiens
AQMVTQAMW

SEQ ID NO: 65825 - protein, 9 aa, Homo Sapiens
AQNGIPLRI

SEQ ID NO: 65826 - protein, 9 aa, Homo Sapiens
AQNGVSQLI

SEQ ID NO: 65827 - protein, 9 aa, Homo Sapiens
AQNKLFNKI

SEQ ID NO: 65828 - protein, 9 aa, Homo Sapiens
AQNQGDIKL

SEQ ID NO: 65829 - protein, 9 aa, Homo Sapiens
AQNRAEIKL

SEQ ID NO: 65830 - protein, 9 aa, Homo Sapiens
AQNRFLLEL

SEQ ID NO: 65831 - protein, 9 aa, Homo Sapiens
AQPKGDPRI

SEQ ID NO: 65832 - protein, 9 aa, Homo Sapiens
AQQELKLLL

SEQ ID NO: 65833 - protein, 9 aa, Homo Sapiens
AQQGKEYEL

SEQ ID NO: 65834 - protein, 9 aa, Homo Sapiens
AQQHREALI

SEQ ID NO: 65835 - protein, 9 aa, Homo Sapiens
AQQKEEAQL

SEQ ID NO: 65836 - protein, 9 aa, Homo Sapiens
AQQLEEARL

SEQ ID NO: 65837 - protein, 9 aa, Homo Sapiens
AQQNLALQL

SEQ ID NO: 65838 - protein, 9 aa, Homo Sapiens
AQQSLQSFW

SEQ ID NO: 65839 - protein, 9 aa, Homo Sapiens
AQREDALEL

SEQ ID NO: 65840 - protein, 9 aa, Homo Sapiens
AQRKEREVL

SEQ ID NO: 65841 - protein, 9 aa, Homo Sapiens
AQRSGLNQI

SEQ ID NO: 65842 - protein, 9 aa, Homo Sapiens
AQSAVEILL

SEQ ID NO: 65843 - protein, 9 aa, Homo Sapiens
AQSDIEHLF

SEQ ID NO: 65844 - protein, 9 aa, Homo Sapiens
AQSDLKEVM

SEQ ID NO: 65845 - protein, 9 aa, Homo Sapiens
AQSFITSSW

SEQ ID NO: 65846 - protein, 9 aa, Homo Sapiens
AQSGHEVTL

SEQ ID NO: 65847 - protein, 9 aa, Homo Sapiens
AQSHPEMGL

SEQ ID NO: 65848 - protein, 9 aa, Homo Sapiens
AQSHVKISF

SEQ ID NO: 65849 - protein, 9 aa, Homo Sapiens
AQSKLALVL

SEQ ID NO: 65850 - protein, 9 aa, Homo Sapiens
AQSLVLDTL

SEQ ID NO: 65851 - protein, 9 aa, Homo Sapiens
AQSQAVTKI

SEQ ID NO: 65852 - protein, 9 aa, Homo Sapiens
AQSRIALAL

SEQ ID NO: 65853 - protein, 9 aa, Homo Sapiens
AQSSLDLFL

SEQ ID NO: 65854 - protein, 9 aa, Homo Sapiens
AQSYIAHNF

SEQ ID NO: 65855 - protein, 9 aa, Homo Sapiens
AQSYIAQNF

SEQ ID NO: 65856 - protein, 9 aa, Homo Sapiens
AQTHVDLSF

SEQ ID NO: 65857 - protein, 9 aa, Homo Sapiens
AQTIHEENI

SEQ ID NO: 65858 - protein, 9 aa, Homo Sapiens
AQTRLGNGW

SEQ ID NO: 65859 - protein, 9 aa, Homo Sapiens
AQTSTLLCF

SEQ ID NO: 65860 - protein, 9 aa, Homo Sapiens
AQTTMEPHL

SEQ ID NO: 65861 - protein, 9 aa, Homo Sapiens
AQTVANFNI

SEQ ID NO: 65862 - protein, 9 aa, Homo Sapiens
AQVAKESVL

SEQ ID NO: 65863 - protein, 9 aa, Homo Sapiens
AQVEDFLQF

SEQ ID NO: 65864 - protein, 9 aa, Homo Sapiens
AQVMWFEKL

SEQ ID NO: 65865 - protein, 9 aa, Homo Sapiens
AQVPFEQIL

SEQ ID NO: 65866 - protein, 9 aa, Homo Sapiens
AQVQKDARI

SEQ ID NO: 65867 - protein, 9 aa, Homo Sapiens
AQVRKENQW

SEQ ID NO: 65868 - protein, 9 aa, Homo Sapiens
AQVVGVLKI

SEQ ID NO: 65869 - protein, 9 aa, Homo Sapiens
AQWADQEQW

SEQ ID NO: 65870 - protein, 9 aa, Homo Sapiens
AQYDRQIRL

SEQ ID NO: 65871 - protein, 9 aa, Homo Sapiens
AQYEHDLEV

SEQ ID NO: 65872 - protein, 9 aa, Homo Sapiens
AQYFEPLTL

SEQ ID NO: 65873 - protein, 9 aa, Homo Sapiens
AQYKEISKF

SEQ ID NO: 65874 - protein, 9 aa, Homo Sapiens
AQYPSEHLI

SEQ ID NO: 65875 - protein, 9 aa, Homo Sapiens
AQYREVAAF

SEQ ID NO: 65876 - protein, 9 aa, Homo Sapiens
ATDGKVLLW

SEQ ID NO: 65877 - protein, 9 aa, Homo Sapiens
AVAGEDARI

SEQ ID NO: 65878 - protein, 9 aa, Homo Sapiens
AVAPPDAGL

SEQ ID NO: 65879 - protein, 9 aa, Homo Sapiens
AVDEVVLKF

SEQ ID NO: 65880 - protein, 9 aa, Homo Sapiens
AVDFTQEEW

SEQ ID NO: 65881 - protein, 9 aa, Homo Sapiens
AVDGISLHL

SEQ ID NO: 65882 - protein, 9 aa, Homo Sapiens
AVDNILLKL

SEQ ID NO: 65883 - protein, 9 aa, Homo Sapiens
AVDPAILLI

SEQ ID NO: 65884 - protein, 9 aa, Homo Sapiens
AVHAEVFTI

SEQ ID NO: 65885 - protein, 9 aa, Homo Sapiens
AVIEAEHTL

SEQ ID NO: 65886 - protein, 9 aa, Homo Sapiens
AVSDILEKL

SEQ ID NO: 65887 - protein, 9 aa, Homo Sapiens
AVSLILEEW

SEQ ID NO: 65888 - protein, 9 aa, Homo Sapiens
AVSNLALQF

SEQ ID NO: 65889 - protein, 9 aa, Homo Sapiens
AVSRILEEW

SEQ ID NO: 65890 - protein, 9 aa, Homo Sapiens
AVSSPDPLL

SEQ ID NO: 65891 - protein, 9 aa, Homo Sapiens
AVTMDDFRW

SEQ ID NO: 65892 - protein, 9 aa, Homo Sapiens
AVVAAGDKW

SEQ ID NO: 65893 - protein, 9 aa, Homo Sapiens
AVVDLIDAI

SEQ ID NO: 65894 - protein, 9 aa, Homo Sapiens
AVVKIVEEW

SEQ ID NO: 65895 - protein, 9 aa, Homo Sapiens
AVVNVADLW

SEQ ID NO: 65896 - protein, 9 aa, Homo Sapiens
DLIGVVEAL

SEQ ID NO: 65897 - protein, 9 aa, Homo Sapiens
EGTVIIPNL

SEQ ID NO: 65898 - protein, 9 aa, Homo Sapiens
EIQRLEGQL

SEQ ID NO: 65899 - protein, 9 aa, Homo Sapiens
EIVRESHSL

SEQ ID NO: 65900 - protein, 9 aa, Homo Sapiens
ELAPYDENW

SEQ ID NO: 65901 - protein, 9 aa, Homo Sapiens
ELQRVLQSL

SEQ ID NO: 65902 - protein, 9 aa, Homo Sapiens
ENRGPTELL

SEQ ID NO: 65903 - protein, 9 aa, Homo Sapiens
EQDQAVHLW

SEQ ID NO: 65904 - protein, 9 aa, Homo Sapiens
EQNRQPLLL

SEQ ID NO: 65905 - protein, 9 aa, Homo Sapiens
ERVSYALLF

SEQ ID NO: 65906 - protein, 9 aa, Homo Sapiens
ESLTANLLI

SEQ ID NO: 65907 - protein, 9 aa, Homo Sapiens
FDPNIRDSR

SEQ ID NO: 65908 - protein, 9 aa, Homo Sapiens
FEAPIKLVF

SEQ ID NO: 65909 - protein, 9 aa, Homo Sapiens
FIDVDDERW

SEQ ID NO: 65910 - protein, 9 aa, Homo Sapiens
FLDDLGLKF

SEQ ID NO: 65911 - protein, 9 aa, Homo Sapiens
FLDENVHFF

SEQ ID NO: 65912 - protein, 9 aa, Homo Sapiens
FLDGNELTL

SEQ ID NO: 65913 - protein, 9 aa, Homo Sapiens
FLDGNEMTL

SEQ ID NO: 65914 - protein, 9 aa, Homo Sapiens
FLDLTEQEF

SEQ ID NO: 65915 - protein, 9 aa, Homo Sapiens
FLDSLRDLI

SEQ ID NO: 65916 - protein, 9 aa, Homo Sapiens
FLEDGIRMW

SEQ ID NO: 65917 - protein, 9 aa, Homo Sapiens
FLHELEEKM

SEQ ID NO: 65918 - protein, 9 aa, Homo Sapiens
FLIRESETL

SEQ ID NO: 65919 - protein, 9 aa, Homo Sapiens
FLLALEPEL

SEQ ID NO: 65920 - protein, 9 aa, Homo Sapiens
FLPREDHLF

SEQ ID NO: 65921 - protein, 9 aa, Homo Sapiens
FLPRTDYSF

SEQ ID NO: 65922 - protein, 9 aa, Homo Sapiens
FLSKVEETF

SEQ ID NO: 65923 - protein, 9 aa, Homo Sapiens
FLSPDKLSL

SEQ ID NO: 65924 - protein, 9 aa, Homo Sapiens
FLSSFEEKI

SEQ ID NO: 65925 - protein, 9 aa, Homo Sapiens
FLSSVIQNL

SEQ ID NO: 65926 - protein, 9 aa, Homo Sapiens
FLVLDEQRF

SEQ ID NO: 65927 - protein, 9 aa, Homo Sapiens
FLVPTFEQL

SEQ ID NO: 65928 - protein, 9 aa, Homo Sapiens
FLWKEPATM

SEQ ID NO: 65929 - protein, 9 aa, Homo Sapiens
FLYQPDWRF

SEQ ID NO: 65930 - protein, 9 aa, Homo Sapiens
FLYSDEVQI

SEQ ID NO: 65931 - protein, 9 aa, Homo Sapiens
FMDESTQCF

SEQ ID NO: 65932 - protein, 9 aa, Homo Sapiens
FMEAYDQKI

SEQ ID NO: 65933 - protein, 9 aa, Homo Sapiens
FMSEISDEF

SEQ ID NO: 65934 - protein, 9 aa, Homo Sapiens
FMTDVKENF

SEQ ID NO: 65935 - protein, 9 aa, Homo Sapiens
FQAEIAQLM

SEQ ID NO: 65936 - protein, 9 aa, Homo Sapiens
FQAHKEENW

SEQ ID NO: 65937 - protein, 9 aa, Homo Sapiens
FQALPHELF

SEQ ID NO: 65938 - protein, 9 aa, Homo Sapiens
FQAPTAKEM

SEQ ID NO: 65939 - protein, 9 aa, Homo Sapiens
FQAWDDARM

SEQ ID NO: 65940 - protein, 9 aa, Homo Sapiens
FQCQTKLEL

SEQ ID NO: 65941 - protein, 9 aa, Homo Sapiens
FQDALEPLL

SEQ ID NO: 65942 - protein, 9 aa, Homo Sapiens
FQDEINWRL

SEQ ID NO: 65943 - protein, 9 aa, Homo Sapiens
FQDGTKATF

SEQ ID NO: 65944 - protein, 9 aa, Homo Sapiens
FQDKRNLYL

SEQ ID NO: 65945 - protein, 9 aa, Homo Sapiens
FQDPVPLTV

SEQ ID NO: 65946 - protein, 9 aa, Homo Sapiens
FQDQVLDLL

SEQ ID NO: 65947 - protein, 9 aa, Homo Sapiens
FQDSGLSRF

SEQ ID NO: 65948 - protein, 9 aa, Homo Sapiens
FQEADSPTL

SEQ ID NO: 65949 - protein, 9 aa, Homo Sapiens
FQEDIISIW

SEQ ID NO: 65950 - protein, 9 aa, Homo Sapiens
FQEDSRSTL

SEQ ID NO: 65951 - protein, 9 aa, Homo Sapiens
FQGDIRLLM

SEQ ID NO: 65952 - protein, 9 aa, Homo Sapiens
FQHALEELM

SEQ ID NO: 65953 - protein, 9 aa, Homo Sapiens
FQHGKVEII

SEQ ID NO: 65954 - protein, 9 aa, Homo Sapiens
FQHWDPDIL

SEQ ID NO: 65955 - protein, 9 aa, Homo Sapiens
FQIGDYLDI

SEQ ID NO: 65956 - protein, 9 aa, Homo Sapiens
FQIGPCEGI

SEQ ID NO: 65957 - protein, 9 aa, Homo Sapiens
FQLIQKELI

SEQ ID NO: 65958 - protein, 9 aa, Homo Sapiens
FQLRDKYMF

SEQ ID NO: 65959 - protein, 9 aa, Homo Sapiens
FQLRSFDQL

SEQ ID NO: 65960 - protein, 9 aa, Homo Sapiens
FQLTQGDQL

SEQ ID NO: 65961 - protein, 9 aa, Homo Sapiens
FQNIRPLFI

SEQ ID NO: 65962 - protein, 9 aa, Homo Sapiens
FQRLAALKL

SEQ ID NO: 65963 - protein, 9 aa, Homo Sapiens
FQSFQDHKL

SEQ ID NO: 65964 - protein, 9 aa, Homo Sapiens
FQSGRDDTW

SEQ ID NO: 65965 - protein, 9 aa, Homo Sapiens
FQSSAVMAL

SEQ ID NO: 65966 - protein, 9 aa, Homo Sapiens
FSAAHEEQW

SEQ ID NO: 65967 - protein, 9 aa, Homo Sapiens
FTAGKDHKI

SEQ ID NO: 65968 - protein, 9 aa, Homo Sapiens
FVDCPDESW

SEQ ID NO: 65969 - protein, 9 aa, Homo Sapiens
FVDDQQTFF

SEQ ID NO: 65970 - protein, 9 aa, Homo Sapiens
FVDSCLQKI

SEQ ID NO: 65971 - protein, 9 aa, Homo Sapiens
FVNDIFERI

SEQ ID NO: 65972 - protein, 9 aa, Homo Sapiens
GIDKPDVRF

SEQ ID NO: 65973 - protein, 9 aa, Homo Sapiens
GIDQSYQLL

SEQ ID NO: 65974 - protein, 9 aa, Homo Sapiens
GIMKKAYEL

SEQ ID NO: 65975 - protein, 9 aa, Homo Sapiens
GISFPDPKM

SEQ ID NO: 65976 - protein, 9 aa, Homo Sapiens
GISMGDHLW

SEQ ID NO: 65977 - protein, 9 aa, Homo Sapiens
GIYPHKLVF

SEQ ID NO: 65978 - protein, 9 aa, Homo Sapiens
GLAPKDPAL

SEQ ID NO: 65979 - protein, 9 aa, Homo Sapiens
GLAPTDPVL

SEQ ID NO: 65980 - protein, 9 aa, Homo Sapiens
GLCDSIITI

SEQ ID NO: 65981 - protein, 9 aa, Homo Sapiens
GLDVEDVKF

SEQ ID NO: 65982 - protein, 9 aa, Homo Sapiens
GLFHGNEML

SEQ ID NO: 65983 - protein, 9 aa, Homo Sapiens
GLFHGTELL

SEQ ID NO: 65984 - protein, 9 aa, Homo Sapiens
GLHSVLEEW

SEQ ID NO: 65985 - protein, 9 aa, Homo Sapiens
GLIKLYENF

SEQ ID NO: 65986 - protein, 9 aa, Homo Sapiens
GLINDMVRF

SEQ ID NO: 65987 - protein, 9 aa, Homo Sapiens
GLSDLRLEL

SEQ ID NO: 65988 - protein, 9 aa, Homo Sapiens
GLSFVRLLL

SEQ ID NO: 65989 - protein, 9 aa, Homo Sapiens
GLSKDITHF

SEQ ID NO: 65990 - protein, 9 aa, Homo Sapiens
GLSNTVMRL

SEQ ID NO: 65991 - protein, 9 aa, Homo Sapiens
GLVDGGDHI

SEQ ID NO: 65992 - protein, 9 aa, Homo Sapiens
GLYPAPLKI

SEQ ID NO: 65993 - protein, 9 aa, Homo Sapiens
GMAAVVDRI

SEQ ID NO: 65994 - protein, 9 aa, Homo Sapiens
GQADVISKL

SEQ ID NO: 65995 - protein, 9 aa, Homo Sapiens
GQAEALDKI

SEQ ID NO: 65996 - protein, 9 aa, Homo Sapiens
GQAEDHLKL

SEQ ID NO: 65997 - protein, 9 aa, Homo Sapiens
GQAGGKLHI

SEQ ID NO: 65998 - protein, 9 aa, Homo Sapiens
GQALDGVSI

SEQ ID NO: 65999 - protein, 9 aa, Homo Sapiens
GQALPEMEI

SEQ ID NO: 66000 - protein, 9 aa, Homo Sapiens
GQAPPGKAL

SEQ ID NO: 66001 - protein, 9 aa, Homo Sapiens
GQARPLEFL

SEQ ID NO: 66002 - protein, 9 aa, Homo Sapiens
GQASLIDLL

SEQ ID NO: 66003 - protein, 9 aa, Homo Sapiens
GQASVSLRL

SEQ ID NO: 66004 - protein, 9 aa, Homo Sapiens
GQATTAYFL

SEQ ID NO: 66005 - protein, 9 aa, Homo Sapiens
GQAVEVVTL

SEQ ID NO: 66006 - protein, 9 aa, Homo Sapiens
GQCGKSFSL

SEQ ID NO: 66007 - protein, 9 aa, Homo Sapiens
GQCGLTFKW

SEQ ID NO: 66008 - protein, 9 aa, Homo Sapiens
GQCGNQIGF

SEQ ID NO: 66009 - protein, 9 aa, Homo Sapiens
GQCIKEAHL

SEQ ID NO: 66010 - protein, 9 aa, Homo Sapiens
GQCRLRVEF

SEQ ID NO: 66011 - protein, 9 aa, Homo Sapiens
GQCSQNEYF

SEQ ID NO: 66012 - protein, 9 aa, Homo Sapiens
GQCVIGLQM

SEQ ID NO: 66013 - protein, 9 aa, Homo Sapiens
GQDAASKAW

SEQ ID NO: 66014 - protein, 9 aa, Homo Sapiens
GQDAHCQLL

SEQ ID NO: 66015 - protein, 9 aa, Homo Sapiens
GQDAVAIEL

SEQ ID NO: 66016 - protein, 9 aa, Homo Sapiens
GQDDLVVCL

SEQ ID NO: 66017 - protein, 9 aa, Homo Sapiens
GQDGSVVQF

SEQ ID NO: 66018 - protein, 9 aa, Homo Sapiens
GQDIEYIEI

SEQ ID NO: 66019 - protein, 9 aa, Homo Sapiens
GQDKIRPLW

SEQ ID NO: 66020 - protein, 9 aa, Homo Sapiens
GQDKLVHLW

SEQ ID NO: 66021 - protein, 9 aa, Homo Sapiens
GQDMLYQSL

SEQ ID NO: 66022 - protein, 9 aa, Homo Sapiens
GQDPDEIGI

SEQ ID NO: 66023 - protein, 9 aa, Homo Sapiens
GQDPGAPQL

SEQ ID NO: 66024 - protein, 9 aa, Homo Sapiens
GQDRILIRF

SEQ ID NO: 66025 - protein, 9 aa, Homo Sapiens
GQDSIVLLI

SEQ ID NO: 66026 - protein, 9 aa, Homo Sapiens
GQDSSEIHF

SEQ ID NO: 66027 - protein, 9 aa, Homo Sapiens
GQDVGRYQV

SEQ ID NO: 66028 - protein, 9 aa, Homo Sapiens
GQDYEHVTM

SEQ ID NO: 66029 - protein, 9 aa, Homo Sapiens
GQEGSIHNL

SEQ ID NO: 66030 - protein, 9 aa, Homo Sapiens
GQFALSGSW

SEQ ID NO: 66031 - protein, 9 aa, Homo Sapiens
GQFCIPEHI

SEQ ID NO: 66032 - protein, 9 aa, Homo Sapiens
GQFDVEFRL

SEQ ID NO: 66033 - protein, 9 aa, Homo Sapiens
GQFIGPHRI

SEQ ID NO: 66034 - protein, 9 aa, Homo Sapiens
GQFLEVITL

SEQ ID NO: 66035 - protein, 9 aa, Homo Sapiens
GQFPGHNEF

SEQ ID NO: 66036 - protein, 9 aa, Homo Sapiens
GQFRDQIKF

SEQ ID NO: 66037 - protein, 9 aa, Homo Sapiens
GQFSKPFSF

SEQ ID NO: 66038 - protein, 9 aa, Homo Sapiens
GQGHFWELW

SEQ ID NO: 66039 - protein, 9 aa, Homo Sapiens
GQHADIYKL

SEQ ID NO: 66040 - protein, 9 aa, Homo Sapiens
GQHAFYQLI

SEQ ID NO: 66041 - protein, 9 aa, Homo Sapiens
GQHAVSAYL

SEQ ID NO: 66042 - protein, 9 aa, Homo Sapiens
GQHPSQHLI

SEQ ID NO: 66043 - protein, 9 aa, Homo Sapiens
GQHSSNVQW

SEQ ID NO: 66044 - protein, 9 aa, Homo Sapiens
GQHVATQHF

SEQ ID NO: 66045 - protein, 9 aa, Homo Sapiens
GQIDLLERL

SEQ ID NO: 66046 - protein, 9 aa, Homo Sapiens
GQIDPEPVM

SEQ ID NO: 66047 - protein, 9 aa, Homo Sapiens
GQIEDELNL

SEQ ID NO: 66048 - protein, 9 aa, Homo Sapiens
GQIFILDCL

SEQ ID NO: 66049 - protein, 9 aa, Homo Sapiens
GQIKEVERI

SEQ ID NO: 66050 - protein, 9 aa, Homo Sapiens
GQIKQIIRI

SEQ ID NO: 66051 - protein, 9 aa, Homo Sapiens
GQIMDSETF

SEQ ID NO: 66052 - protein, 9 aa, Homo Sapiens
GQIVLVDDW

SEQ ID NO: 66053 - protein, 9 aa, Homo Sapiens
GQKEGEPRI

SEQ ID NO: 66054 - protein, 9 aa, Homo Sapiens
GQLAEHESI

SEQ ID NO: 66055 - protein, 9 aa, Homo Sapiens
GQLALDPSL

SEQ ID NO: 66056 - protein, 9 aa, Homo Sapiens
GQLDFSEFL

SEQ ID NO: 66057 - protein, 9 aa, Homo Sapiens
GQLDVRELI

SEQ ID NO: 66058 - protein, 9 aa, Homo Sapiens
GQLLNDPFL

SEQ ID NO: 66059 - protein, 9 aa, Homo Sapiens
GQLVLQDVW

SEQ ID NO: 66060 - protein, 9 aa, Homo Sapiens
GQMAYILQL

SEQ ID NO: 66061 - protein, 9 aa, Homo Sapiens
GQMHGVVFW

SEQ ID NO: 66062 - protein, 9 aa, Homo Sapiens
GQMPSDKTI

SEQ ID NO: 66063 - protein, 9 aa, Homo Sapiens
GQMQMAELL

SEQ ID NO: 66064 - protein, 9 aa, Homo Sapiens
GQNPFELAF

SEQ ID NO: 66065 - protein, 9 aa, Homo Sapiens
GQNPTEAEL

SEQ ID NO: 66066 - protein, 9 aa, Homo Sapiens
GQNRIHLEI

SEQ ID NO: 66067 - protein, 9 aa, Homo Sapiens
GQNSADISI

SEQ ID NO: 66068 - protein, 9 aa, Homo Sapiens
GQNSLCHQI

SEQ ID NO: 66069 - protein, 9 aa, Homo Sapiens
GQQLEIVCL

SEQ ID NO: 66070 - protein, 9 aa, Homo Sapiens
GQQQETETF

SEQ ID NO: 66071 - protein, 9 aa, Homo Sapiens
GQRKEVEVF

SEQ ID NO: 66072 - protein, 9 aa, Homo Sapiens
GQSALPQRL

SEQ ID NO: 66073 - protein, 9 aa, Homo Sapiens
GQSAVASNI

SEQ ID NO: 66074 - protein, 9 aa, Homo Sapiens
GQSELASRL

SEQ ID NO: 66075 - protein, 9 aa, Homo Sapiens
GQSFSEQHI

SEQ ID NO: 66076 - protein, 9 aa, Homo Sapiens
GQSGAGNNW

SEQ ID NO: 66077 - protein, 9 aa, Homo Sapiens
GQSIDKSYL

SEQ ID NO: 66078 - protein, 9 aa, Homo Sapiens
GQSIYGDKF

SEQ ID NO: 66079 - protein, 9 aa, Homo Sapiens
GQSKENNYL

SEQ ID NO: 66080 - protein, 9 aa, Homo Sapiens
GQSKGFAFI

SEQ ID NO: 66081 - protein, 9 aa, Homo Sapiens
GQSKITFLL

SEQ ID NO: 66082 - protein, 9 aa, Homo Sapiens
GQSPVKAEW

SEQ ID NO: 66083 - protein, 9 aa, Homo Sapiens
GQSRAIERL

SEQ ID NO: 66084 - protein, 9 aa, Homo Sapiens
GQSTVNHSL

SEQ ID NO: 66085 - protein, 9 aa, Homo Sapiens
GQSVLRSSW

SEQ ID NO: 66086 - protein, 9 aa, Homo Sapiens
GQSWHPEHF

SEQ ID NO: 66087 - protein, 9 aa, Homo Sapiens
GQSWPESLI

SEQ ID NO: 66088 - protein, 9 aa, Homo Sapiens
GQTAEVPNL

SEQ ID NO: 66089 - protein, 9 aa, Homo Sapiens
GQTAIDAAL

SEQ ID NO: 66090 - protein, 9 aa, Homo Sapiens
GQTKEVLVI

SEQ ID NO: 66091 - protein, 9 aa, Homo Sapiens
GQTREHALL

SEQ ID NO: 66092 - protein, 9 aa, Homo Sapiens
GQTSVIEQI

SEQ ID NO: 66093 - protein, 9 aa, Homo Sapiens
GQTSVVSFL

SEQ ID NO: 66094 - protein, 9 aa, Homo Sapiens
GQVFFVDHI

SEQ ID NO: 66095 - protein, 9 aa, Homo Sapiens
GQVHLFEHI

SEQ ID NO: 66096 - protein, 9 aa, Homo Sapiens
GQVPDTNYI

SEQ ID NO: 66097 - protein, 9 aa, Homo Sapiens
GQVQYLDLI

SEQ ID NO: 66098 - protein, 9 aa, Homo Sapiens
GQVSIHSVW

SEQ ID NO: 66099 - protein, 9 aa, Homo Sapiens
GQVTDPRGI

SEQ ID NO: 66100 - protein, 9 aa, Homo Sapiens
GQWKEEQKL

SEQ ID NO: 66101 - protein, 9 aa, Homo Sapiens
GQWKKGFVL

SEQ ID NO: 66102 - protein, 9 aa, Homo Sapiens
GQWRFVDVL

SEQ ID NO: 66103 - protein, 9 aa, Homo Sapiens
GQYYDLLRL

SEQ ID NO: 66104 - protein, 9 aa, Homo Sapiens
GQYYKPEQF

SEQ ID NO: 66105 - protein, 9 aa, Homo Sapiens
GVCKNDPKL

SEQ ID NO: 66106 - protein, 9 aa, Homo Sapiens
GVFHGIENF

SEQ ID NO: 66107 - protein, 9 aa, Homo Sapiens
GVSHVFEYI

SEQ ID NO: 66108 - protein, 9 aa, Homo Sapiens
GVTKFGDNI

SEQ ID NO: 66109 - protein, 9 aa, Homo Sapiens
GVTVVGDII

SEQ ID NO: 66110 - protein, 9 aa, Homo Sapiens
GVVKEGDQI

SEQ ID NO: 66111 - protein, 9 aa, Homo Sapiens
GVVQSGDHI

SEQ ID NO: 66112 - protein, 9 aa, Homo Sapiens
GVVSKGDKI

SEQ ID NO: 66113 - protein, 9 aa, Homo Sapiens
HAIEDKETI

SEQ ID NO: 66114 - protein, 9 aa, Homo Sapiens
HEGDIILKI

SEQ ID NO: 66115 - protein, 9 aa, Homo Sapiens
HIAKLQELW

SEQ ID NO: 66116 - protein, 9 aa, Homo Sapiens
HIAQRDYSW

SEQ ID NO: 66117 - protein, 9 aa, Homo Sapiens
HIDAVSLLL

SEQ ID NO: 66118 - protein, 9 aa, Homo Sapiens
HIDNNILLI

SEQ ID NO: 66119 - protein, 9 aa, Homo Sapiens
HIFKDKVVL

SEQ ID NO: 66120 - protein, 9 aa, Homo Sapiens
HIIGQESAI

SEQ ID NO: 66121 - protein, 9 aa, Homo Sapiens
HIIHIDFGF

SEQ ID NO: 66122 - protein, 9 aa, Homo Sapiens
HILELVDNW

SEQ ID NO: 66123 - protein, 9 aa, Homo Sapiens
HILRGEPVI

SEQ ID NO: 66124 - protein, 9 aa, Homo Sapiens
HINHDDPSL

SEQ ID NO: 66125 - protein, 9 aa, Homo Sapiens
HITKVEERL

SEQ ID NO: 66126 - protein, 9 aa, Homo Sapiens
HIVSVDEHL

SEQ ID NO: 66127 - protein, 9 aa, Homo Sapiens
HIYHSEYFL

SEQ ID NO: 66128 - protein, 9 aa, Homo Sapiens
HLAGVKDQL

SEQ ID NO: 66129 - protein, 9 aa, Homo Sapiens
HLAKDLLVL

SEQ ID NO: 66130 - protein, 9 aa, Homo Sapiens
HLANIVERL

SEQ ID NO: 66131 - protein, 9 aa, Homo Sapiens
HLAVEHDNI

SEQ ID NO: 66132 - protein, 9 aa, Homo Sapiens
HLAVNDFEL

SEQ ID NO: 66133 - protein, 9 aa, Homo Sapiens
HLAVVELLL

SEQ ID NO: 66134 - protein, 9 aa, Homo Sapiens
HLAWFGDSL

SEQ ID NO: 66135 - protein, 9 aa, Homo Sapiens
HLAWVQEEW

SEQ ID NO: 66136 - protein, 9 aa, Homo Sapiens
HLCSYQHKF

SEQ ID NO: 66137 - protein, 9 aa, Homo Sapiens
HLCTYEKQI

SEQ ID NO: 66138 - protein, 9 aa, Homo Sapiens
HLDATKLLL

SEQ ID NO: 66139 - protein, 9 aa, Homo Sapiens
HLDDIRNDW

SEQ ID NO: 66140 - protein, 9 aa, Homo Sapiens
HLDDIRQDW

SEQ ID NO: 66141 - protein, 9 aa, Homo Sapiens
HLDDQMTLL

SEQ ID NO: 66142 - protein, 9 aa, Homo Sapiens
HLDEAIHVL

SEQ ID NO: 66143 - protein, 9 aa, Homo Sapiens
HLDEARTLL

SEQ ID NO: 66144 - protein, 9 aa, Homo Sapiens
HLDEKSFRW

SEQ ID NO: 66145 - protein, 9 aa, Homo Sapiens
HLDEVFLEL

SEQ ID NO: 66146 - protein, 9 aa, Homo Sapiens
HLDGHHVVF

SEQ ID NO: 66147 - protein, 9 aa, Homo Sapiens
HLDISRDRL

SEQ ID NO: 66148 - protein, 9 aa, Homo Sapiens
HLDKEIEKL

SEQ ID NO: 66149 - protein, 9 aa, Homo Sapiens
HLDKQQVQL

SEQ ID NO: 66150 - protein, 9 aa, Homo Sapiens
HLDMEHERL

SEQ ID NO: 66151 - protein, 9 aa, Homo Sapiens
HLDPNSDCL

SEQ ID NO: 66152 - protein, 9 aa, Homo Sapiens
HLDQSDSDF

SEQ ID NO: 66153 - protein, 9 aa, Homo Sapiens
HLDRIVALF

SEQ ID NO: 66154 - protein, 9 aa, Homo Sapiens
HLDRTMYLL

SEQ ID NO: 66155 - protein, 9 aa, Homo Sapiens
HLDTTQQMI

SEQ ID NO: 66156 - protein, 9 aa, Homo Sapiens
HLEASAEKW

SEQ ID NO: 66157 - protein, 9 aa, Homo Sapiens
HLEDVFQLF

SEQ ID NO: 66158 - protein, 9 aa, Homo Sapiens
HLEKSVEKI

SEQ ID NO: 66159 - protein, 9 aa, Homo Sapiens
HLETGGQKI

SEQ ID NO: 66160 - protein, 9 aa, Homo Sapiens
HLFEDAYLL

SEQ ID NO: 66161 - protein, 9 aa, Homo Sapiens
HLFGECLFI

SEQ ID NO: 66162 - protein, 9 aa, Homo Sapiens
HLGKIEELL

SEQ ID NO: 66163 - protein, 9 aa, Homo Sapiens
HLGSVILIF

SEQ ID NO: 66164 - protein, 9 aa, Homo Sapiens
HLHEWIDLI

SEQ ID NO: 66165 - protein, 9 aa, Homo Sapiens
HLHFPDPSL

SEQ ID NO: 66166 - protein, 9 aa, Homo Sapiens
HLHQTPLHL

SEQ ID NO: 66167 - protein, 9 aa, Homo Sapiens
HLHRDKALL

SEQ ID NO: 66168 - protein, 9 aa, Homo Sapiens
HLIAQHSAI

SEQ ID NO: 66169 - protein, 9 aa, Homo Sapiens
HLINFSETL

SEQ ID NO: 66170 - protein, 9 aa, Homo Sapiens
HLLLEVEVI

SEQ ID NO: 66171 - protein, 9 aa, Homo Sapiens
HLLSDELLL

SEQ ID NO: 66172 - protein, 9 aa, Homo Sapiens
HLMEDRAYM

SEQ ID NO: 66173 - protein, 9 aa, Homo Sapiens
HLNALEERF

SEQ ID NO: 66174 - protein, 9 aa, Homo Sapiens
HLNPETITI

SEQ ID NO: 66175 - protein, 9 aa, Homo Sapiens
HLPSFDAHL

SEQ ID NO: 66176 - protein, 9 aa, Homo Sapiens
HLQQDSLKL

SEQ ID NO: 66177 - protein, 9 aa, Homo Sapiens
HLSDVVLRF

SEQ ID NO: 66178 - protein, 9 aa, Homo Sapiens
HLSEMVMKL

SEQ ID NO: 66179 - protein, 9 aa, Homo Sapiens
HLSEVQAFF

SEQ ID NO: 66180 - protein, 9 aa, Homo Sapiens
HLSGDSLFL

SEQ ID NO: 66181 - protein, 9 aa, Homo Sapiens
HLSIINEYL

SEQ ID NO: 66182 - protein, 9 aa, Homo Sapiens
HLSKIETRI

SEQ ID NO: 66183 - protein, 9 aa, Homo Sapiens
HLSSAHLAF

SEQ ID NO: 66184 - protein, 9 aa, Homo Sapiens
HLSSGHLKW

SEQ ID NO: 66185 - protein, 9 aa, Homo Sapiens
HLSSIEVLI

SEQ ID NO: 66186 - protein, 9 aa, Homo Sapiens
HLSSLIAQL

SEQ ID NO: 66187 - protein, 9 aa, Homo Sapiens
HLSTYSLVW

SEQ ID NO: 66188 - protein, 9 aa, Homo Sapiens
HLSVKDYCF

SEQ ID NO: 66189 - protein, 9 aa, Homo Sapiens
HLTELQEFW

SEQ ID NO: 66190 - protein, 9 aa, Homo Sapiens
HLTTVLDKL

SEQ ID NO: 66191 - protein, 9 aa, Homo Sapiens
HLVDLRISW

SEQ ID NO: 66192 - protein, 9 aa, Homo Sapiens
HLVGVDSLI

SEQ ID NO: 66193 - protein, 9 aa, Homo Sapiens
HLVHLPEEL

SEQ ID NO: 66194 - protein, 9 aa, Homo Sapiens
HLVKIGDLF

SEQ ID NO: 66195 - protein, 9 aa, Homo Sapiens
HLVSEDVKW

SEQ ID NO: 66196 - protein, 9 aa, Homo Sapiens
HLWTGEEQL

SEQ ID NO: 66197 - protein, 9 aa, Homo Sapiens
HLYFETVTI

SEQ ID NO: 66198 - protein, 9 aa, Homo Sapiens
HLYSSIEHL

SEQ ID NO: 66199 - protein, 9 aa, Homo Sapiens
HMAVAREDL

SEQ ID NO: 66200 - protein, 9 aa, Homo Sapiens
HMDGKIRLW

SEQ ID NO: 66201 - protein, 9 aa, Homo Sapiens
HMEFCYQEL

SEQ ID NO: 66202 - protein, 9 aa, Homo Sapiens
HMIRDIQTL

SEQ ID NO: 66203 - protein, 9 aa, Homo Sapiens
HQAAQALHL

SEQ ID NO: 66204 - protein, 9 aa, Homo Sapiens
HQAFVYDHL

SEQ ID NO: 66205 - protein, 9 aa, Homo Sapiens
HQAGISDTL

SEQ ID NO: 66206 - protein, 9 aa, Homo Sapiens
HQAGSDSLL

SEQ ID NO: 66207 - protein, 9 aa, Homo Sapiens
HQAPDTQSI

SEQ ID NO: 66208 - protein, 9 aa, Homo Sapiens
HQAQIDHYL

SEQ ID NO: 66209 - protein, 9 aa, Homo Sapiens
HQDDFNQLL

SEQ ID NO: 66210 - protein, 9 aa, Homo Sapiens
HQDEDKQLI

SEQ ID NO: 66211 - protein, 9 aa, Homo Sapiens
HQDGIHILV

SEQ ID NO: 66212 - protein, 9 aa, Homo Sapiens
HQDITEDSF

SEQ ID NO: 66213 - protein, 9 aa, Homo Sapiens
HQDLHSEAW

SEQ ID NO: 66214 - protein, 9 aa, Homo Sapiens
HQDPADPKM

SEQ ID NO: 66215 - protein, 9 aa, Homo Sapiens
HQDPQQNFL

SEQ ID NO: 66216 - protein, 9 aa, Homo Sapiens
HQDQLQVLL

SEQ ID NO: 66217 - protein, 9 aa, Homo Sapiens
HQDQMVQKI

SEQ ID NO: 66218 - protein, 9 aa, Homo Sapiens
HQDSRAHLL

SEQ ID NO: 66219 - protein, 9 aa, Homo Sapiens
HQDVDLVCI

SEQ ID NO: 66220 - protein, 9 aa, Homo Sapiens
HQEKPERPL

SEQ ID NO: 66221 - protein, 9 aa, Homo Sapiens
HQEQGHQLL

SEQ ID NO: 66222 - protein, 9 aa, Homo Sapiens
HQEVVELLI

SEQ ID NO: 66223 - protein, 9 aa, Homo Sapiens
HQFEKIEQF

SEQ ID NO: 66224 - protein, 9 aa, Homo Sapiens
HQFESSFEL

SEQ ID NO: 66225 - protein, 9 aa, Homo Sapiens
HQHEYFFLI

SEQ ID NO: 66226 - protein, 9 aa, Homo Sapiens
HQHNVSLQL

SEQ ID NO: 66227 - protein, 9 aa, Homo Sapiens
HQIAEEHGL

SEQ ID NO: 66228 - protein, 9 aa, Homo Sapiens
HQIDLIVQL

SEQ ID NO: 66229 - protein, 9 aa, Homo Sapiens
HQIGCQSSI

SEQ ID NO: 66230 - protein, 9 aa, Homo Sapiens
HQIIRDEGI

SEQ ID NO: 66231 - protein, 9 aa, Homo Sapiens
HQILTPFLL

SEQ ID NO: 66232 - protein, 9 aa, Homo Sapiens
HQITEVGTM

SEQ ID NO: 66233 - protein, 9 aa, Homo Sapiens
HQLDEIICW

SEQ ID NO: 66234 - protein, 9 aa, Homo Sapiens
HQLDSIDLW

SEQ ID NO: 66235 - protein, 9 aa, Homo Sapiens
HQLLEKVRI

SEQ ID NO: 66236 - protein, 9 aa, Homo Sapiens
HQNLKEFAL

SEQ ID NO: 66237 - protein, 9 aa, Homo Sapiens
HQNVESHLL

SEQ ID NO: 66238 - protein, 9 aa, Homo Sapiens
HQPSVLLEL

SEQ ID NO: 66239 - protein, 9 aa, Homo Sapiens
HQQLEEAQI

SEQ ID NO: 66240 - protein, 9 aa, Homo Sapiens
HQQLEGWKW

SEQ ID NO: 66241 - protein, 9 aa, Homo Sapiens
HQQLEGWRW

SEQ ID NO: 66242 - protein, 9 aa, Homo Sapiens
HQSALELIM

SEQ ID NO: 66243 - protein, 9 aa, Homo Sapiens
HQSASEHGL

SEQ ID NO: 66244 - protein, 9 aa, Homo Sapiens
HQSEVAQSF

SEQ ID NO: 66245 - protein, 9 aa, Homo Sapiens
HQSIIIERM

SEQ ID NO: 66246 - protein, 9 aa, Homo Sapiens
HQSKEENLI

SEQ ID NO: 66247 - protein, 9 aa, Homo Sapiens
HQSNVFHHI

SEQ ID NO: 66248 - protein, 9 aa, Homo Sapiens
HQSSHGDIF

SEQ ID NO: 66249 - protein, 9 aa, Homo Sapiens
HQTAIPCLL

SEQ ID NO: 66250 - protein, 9 aa, Homo Sapiens
HQTGGEVTI

SEQ ID NO: 66251 - protein, 9 aa, Homo Sapiens
HQTIVMQFI

SEQ ID NO: 66252 - protein, 9 aa, Homo Sapiens
HQTQVSQRL

SEQ ID NO: 66253 - protein, 9 aa, Homo Sapiens
HQTRAEEGL

SEQ ID NO: 66254 - protein, 9 aa, Homo Sapiens
HQVEEDYLF

SEQ ID NO: 66255 - protein, 9 aa, Homo Sapiens
HQVQHEARL

SEQ ID NO: 66256 - protein, 9 aa, Homo Sapiens
HQVRSMDEL

SEQ ID NO: 66257 - protein, 9 aa, Homo Sapiens
HQWLGPEFL

SEQ ID NO: 66258 - protein, 9 aa, Homo Sapiens
HTIGIGDSI

SEQ ID NO: 66259 - protein, 9 aa, Homo Sapiens
HTSPEDPCF

SEQ ID NO: 66260 - protein, 9 aa, Homo Sapiens
HTVFLFALL

SEQ ID NO: 66261 - protein, 9 aa, Homo Sapiens
HVDCVHLLL

SEQ ID NO: 66262 - protein, 9 aa, Homo Sapiens
HVDIVKLLL

SEQ ID NO: 66263 - protein, 9 aa, Homo Sapiens
HVDKVIMKL

SEQ ID NO: 66264 - protein, 9 aa, Homo Sapiens
HVICLAEEF

SEQ ID NO: 66265 - protein, 9 aa, Homo Sapiens
HVIDDFVQF

SEQ ID NO: 66266 - protein, 9 aa, Homo Sapiens
HVIDGEKTI

SEQ ID NO: 66267 - protein, 9 aa, Homo Sapiens
HVQDAEEAW

SEQ ID NO: 66268 - protein, 9 aa, Homo Sapiens
HVSAVPESL

SEQ ID NO: 66269 - protein, 9 aa, Homo Sapiens
HVSCVKLLL

SEQ ID NO: 66270 - protein, 9 aa, Homo Sapiens
HVSDLEYRI

SEQ ID NO: 66271 - protein, 9 aa, Homo Sapiens
HVSLVQLTL

SEQ ID NO: 66272 - protein, 9 aa, Homo Sapiens
HVSNLEFPF

SEQ ID NO: 66273 - protein, 9 aa, Homo Sapiens
IALLKIRSK

SEQ ID NO: 66274 - protein, 9 aa, Homo Sapiens
IIDEQPLIF

SEQ ID NO: 66275 - protein, 9 aa, Homo Sapiens
IIDNSPQAF

SEQ ID NO: 66276 - protein, 9 aa, Homo Sapiens
IIDPVALEI

SEQ ID NO: 66277 - protein, 9 aa, Homo Sapiens
IIISTPEKW

SEQ ID NO: 66278 - protein, 9 aa, Homo Sapiens
ILAAVETRL

SEQ ID NO: 66279 - protein, 9 aa, Homo Sapiens
ILAIAGEDF

SEQ ID NO: 66280 - protein, 9 aa, Homo Sapiens
ILANDGVLL

SEQ ID NO: 66281 - protein, 9 aa, Homo Sapiens
ILANIGDHF

SEQ ID NO: 66282 - protein, 9 aa, Homo Sapiens
ILARDILEI

SEQ ID NO: 66283 - protein, 9 aa, Homo Sapiens
ILATDDPNF

SEQ ID NO: 66284 - protein, 9 aa, Homo Sapiens
ILDDTVQRF

SEQ ID NO: 66285 - protein, 9 aa, Homo Sapiens
ILDGNQLHI

SEQ ID NO: 66286 - protein, 9 aa, Homo Sapiens
ILDKTGDKL

SEQ ID NO: 66287 - protein, 9 aa, Homo Sapiens
ILDPHVVLL

SEQ ID NO: 66288 - protein, 9 aa, Homo Sapiens
ILDPRPTII

SEQ ID NO: 66289 - protein, 9 aa, Homo Sapiens
ILDPSNTEI

SEQ ID NO: 66290 - protein, 9 aa, Homo Sapiens
ILDQREASI

SEQ ID NO: 66291 - protein, 9 aa, Homo Sapiens
ILDQTKTEL

SEQ ID NO: 66292 - protein, 9 aa, Homo Sapiens
ILDSSPEKL

SEQ ID NO: 66293 - protein, 9 aa, Homo Sapiens
ILDTEAVAW

SEQ ID NO: 66294 - protein, 9 aa, Homo Sapiens
ILEKESALF

SEQ ID NO: 66295 - protein, 9 aa, Homo Sapiens
ILEPLNPLL

SEQ ID NO: 66296 - protein, 9 aa, Homo Sapiens
ILIKQDQTL

SEQ ID NO: 66297 - protein, 9 aa, Homo Sapiens
ILNDVQDRF

SEQ ID NO: 66298 - protein, 9 aa, Homo Sapiens
ILNKVEERM

SEQ ID NO: 66299 - protein, 9 aa, Homo Sapiens
ILQDGRIFI

SEQ ID NO: 66300 - protein, 9 aa, Homo Sapiens
ILQEREYRL

SEQ ID NO: 66301 - protein, 9 aa, Homo Sapiens
ILQHLSEAW

SEQ ID NO: 66302 - protein, 9 aa, Homo Sapiens
ILQRVIDYI

SEQ ID NO: 66303 - protein, 9 aa, Homo Sapiens
ILRAILEVL

SEQ ID NO: 66304 - protein, 9 aa, Homo Sapiens
ILSDDKHDW

SEQ ID NO: 66305 - protein, 9 aa, Homo Sapiens
ILSEDKLTI

SEQ ID NO: 66306 - protein, 9 aa, Homo Sapiens
ILSGVVTKM

SEQ ID NO: 66307 - protein, 9 aa, Homo Sapiens
ILSKIPDEI

SEQ ID NO: 66308 - protein, 9 aa, Homo Sapiens
ILSSFESRL

SEQ ID NO: 66309 - protein, 9 aa, Homo Sapiens
ILYHLGEEW

SEQ ID NO: 66310 - protein, 9 aa, Homo Sapiens
ILYSKTEHL

SEQ ID NO: 66311 - protein, 9 aa, Homo Sapiens
IMDSLFQSF

SEQ ID NO: 66312 - protein, 9 aa, Homo Sapiens
IMDVTEEVW

SEQ ID NO: 66313 - protein, 9 aa, Homo Sapiens
IMKDKDNFW

SEQ ID NO: 66314 - protein, 9 aa, Homo Sapiens
IQAGIFQEF

SEQ ID NO: 66315 - protein, 9 aa, Homo Sapiens
IQAKVEPEI

SEQ ID NO: 66316 - protein, 9 aa, Homo Sapiens
IQARLPLLL

SEQ ID NO: 66317 - protein, 9 aa, Homo Sapiens
IQCRADQSF

SEQ ID NO: 66318 - protein, 9 aa, Homo Sapiens
IQDAGRTQI

SEQ ID NO: 66319 - protein, 9 aa, Homo Sapiens
IQDDAVHTL

SEQ ID NO: 66320 - protein, 9 aa, Homo Sapiens
IQDDMHLVI

SEQ ID NO: 66321 - protein, 9 aa, Homo Sapiens
IQDEEFYTL

SEQ ID NO: 66322 - protein, 9 aa, Homo Sapiens
IQDEIRSVI

SEQ ID NO: 66323 - protein, 9 aa, Homo Sapiens
IQDFMFHGI

SEQ ID NO: 66324 - protein, 9 aa, Homo Sapiens
IQDIYENSW

SEQ ID NO: 66325 - protein, 9 aa, Homo Sapiens
IQDKSVSFF

SEQ ID NO: 66326 - protein, 9 aa, Homo Sapiens
IQDPASQRL

SEQ ID NO: 66327 - protein, 9 aa, Homo Sapiens
IQDRGDQAF

SEQ ID NO: 66328 - protein, 9 aa, Homo Sapiens
IQDRVLYVL

SEQ ID NO: 66329 - protein, 9 aa, Homo Sapiens
IQHAEEFLI

SEQ ID NO: 66330 - protein, 9 aa, Homo Sapiens
IQHVVEDSW

SEQ ID NO: 66331 - protein, 9 aa, Homo Sapiens
IQIMKVEEI

SEQ ID NO: 66332 - protein, 9 aa, Homo Sapiens
IQSNYDIAI

SEQ ID NO: 66333 - protein, 9 aa, Homo Sapiens
IQTAVRLLL

SEQ ID NO: 66334 - protein, 9 aa, Homo Sapiens
IQVDLADKL

SEQ ID NO: 66335 - protein, 9 aa, Homo Sapiens
IRHTGEKPF

SEQ ID NO: 66336 - protein, 9 aa, Homo Sapiens
IRLSLEKKL

SEQ ID NO: 66337 - protein, 9 aa, Homo Sapiens
ISSFKDPKI

SEQ ID NO: 66338 - protein, 9 aa, Homo Sapiens
ISTHIGNEL

SEQ ID NO: 66339 - protein, 9 aa, Homo Sapiens
ITHKGEIEI

SEQ ID NO: 66340 - protein, 9 aa, Homo Sapiens
IVDIGRQDW

SEQ ID NO: 66341 - protein, 9 aa, Homo Sapiens
IVQGPDPNL

SEQ ID NO: 66342 - protein, 9 aa, Homo Sapiens
KAHPDVLTI

SEQ ID NO: 66343 - protein, 9 aa, Homo Sapiens
KAPGSTSNL

SEQ ID NO: 66344 - protein, 9 aa, Homo Sapiens
KAPVTKVAA

SEQ ID NO: 66345 - protein, 9 aa, Homo Sapiens
KESEVVMKF

SEQ ID NO: 66346 - protein, 9 aa, Homo Sapiens
KESSAKLYI

SEQ ID NO: 66347 - protein, 9 aa, Homo Sapiens
KESTLHLVL

SEQ ID NO: 66348 - protein, 9 aa, Homo Sapiens
KHLDVVTLL

SEQ ID NO: 66349 - protein, 9 aa, Homo Sapiens
KIAEKEVRI

SEQ ID NO: 66350 - protein, 9 aa, Homo Sapiens
KIAPNTPQL

SEQ ID NO: 66351 - protein, 9 aa, Homo Sapiens
KICDIAINW

SEQ ID NO: 66352 - protein, 9 aa, Homo Sapiens
KIDDILQTL

SEQ ID NO: 66353 - protein, 9 aa, Homo Sapiens
KIDGQQTII

SEQ ID NO: 66354 - protein, 9 aa, Homo Sapiens
KIDRLILEL

SEQ ID NO: 66355 - protein, 9 aa, Homo Sapiens
KIFPMGDRL

SEQ ID NO: 66356 - protein, 9 aa, Homo Sapiens
KIIEQEKEI

SEQ ID NO: 66357 - protein, 9 aa, Homo Sapiens
KIIESEEEL

SEQ ID NO: 66358 - protein, 9 aa, Homo Sapiens
KIIGDLLQF

SEQ ID NO: 66359 - protein, 9 aa, Homo Sapiens
KIIHDFPQF

SEQ ID NO: 66360 - protein, 9 aa, Homo Sapiens
KIMEEKIQI

SEQ ID NO: 66361 - protein, 9 aa, Homo Sapiens
KISEVVELL

SEQ ID NO: 66362 - protein, 9 aa, Homo Sapiens
KISLISEKW

SEQ ID NO: 66363 - protein, 9 aa, Homo Sapiens
KISMPDFDL

SEQ ID NO: 66364 - protein, 9 aa, Homo Sapiens
KISPEDTHL

SEQ ID NO: 66365 - protein, 9 aa, Homo Sapiens
KITDVIIGF

SEQ ID NO: 66366 - protein, 9 aa, Homo Sapiens
KIVEIDAHI

SEQ ID NO: 66367 - protein, 9 aa, Homo Sapiens
KIVIDFDSI

SEQ ID NO: 66368 - protein, 9 aa, Homo Sapiens
KIVPVEITI

SEQ ID NO: 66369 - protein, 9 aa, Homo Sapiens
KLAECQDQL

SEQ ID NO: 66370 - protein, 9 aa, Homo Sapiens
KLAEFIDFL

SEQ ID NO: 66371 - protein, 9 aa, Homo Sapiens
KLAEQYESF

SEQ ID NO: 66372 - protein, 9 aa, Homo Sapiens
KLAPKDIKI

SEQ ID NO: 66373 - protein, 9 aa, Homo Sapiens
KLAPKDVKI

SEQ ID NO: 66374 - protein, 9 aa, Homo Sapiens
KLAPPLVTL

SEQ ID NO: 66375 - protein, 9 aa, Homo Sapiens
KLAPPSSTL

SEQ ID NO: 66376 - protein, 9 aa, Homo Sapiens
KLAQDDLHI

SEQ ID NO: 66377 - protein, 9 aa, Homo Sapiens
KLATGQEEF

SEQ ID NO: 66378 - protein, 9 aa, Homo Sapiens
KLCDVTTGL

SEQ ID NO: 66379 - protein, 9 aa, Homo Sapiens
KLCEEEAVI

SEQ ID NO: 66380 - protein, 9 aa, Homo Sapiens
KLCKLQEAL

SEQ ID NO: 66381 - protein, 9 aa, Homo Sapiens
KLCSSAETL

SEQ ID NO: 66382 - protein, 9 aa, Homo Sapiens
KLCYVALDF

SEQ ID NO: 66383 - protein, 9 aa, Homo Sapiens
KLDAEVSKW

SEQ ID NO: 66384 - protein, 9 aa, Homo Sapiens
KLDDHVKKF

SEQ ID NO: 66385 - protein, 9 aa, Homo Sapiens
KLDDIVQHI

SEQ ID NO: 66386 - protein, 9 aa, Homo Sapiens
KLDEDVKMI

SEQ ID NO: 66387 - protein, 9 aa, Homo Sapiens
KLDELYGTW

SEQ ID NO: 66388 - protein, 9 aa, Homo Sapiens
KLDEREAGI

SEQ ID NO: 66389 - protein, 9 aa, Homo Sapiens
KLDETGNSL

SEQ ID NO: 66390 - protein, 9 aa, Homo Sapiens
KLDGLIHRF

SEQ ID NO: 66391 - protein, 9 aa, Homo Sapiens
KLDHVVTII

SEQ ID NO: 66392 - protein, 9 aa, Homo Sapiens
KLDLERETI

SEQ ID NO: 66393 - protein, 9 aa, Homo Sapiens
KLDPKALEW

SEQ ID NO: 66394 - protein, 9 aa, Homo Sapiens
KLDPSPQTI

SEQ ID NO: 66395 - protein, 9 aa, Homo Sapiens
KLDSSETTM

SEQ ID NO: 66396 - protein, 9 aa, Homo Sapiens
KLDTAYDDL

SEQ ID NO: 66397 - protein, 9 aa, Homo Sapiens
KLDTITWTW

SEQ ID NO: 66398 - protein, 9 aa, Homo Sapiens
KLDWVEVGL

SEQ ID NO: 66399 - protein, 9 aa, Homo Sapiens
KLEAGIRGI

SEQ ID NO: 66400 - protein, 9 aa, Homo Sapiens
KLEDLKLLF

SEQ ID NO: 66401 - protein, 9 aa, Homo Sapiens
KLEDTITLI

SEQ ID NO: 66402 - protein, 9 aa, Homo Sapiens
KLEEGKYLI

SEQ ID NO: 66403 - protein, 9 aa, Homo Sapiens
KLEEHEESL

SEQ ID NO: 66404 - protein, 9 aa, Homo Sapiens
KLEEIIHQI

SEQ ID NO: 66405 - protein, 9 aa, Homo Sapiens
KLEEKEHLL

SEQ ID NO: 66406 - protein, 9 aa, Homo Sapiens
KLEEKERAL

SEQ ID NO: 66407 - protein, 9 aa, Homo Sapiens
KLEEKRAEL

SEQ ID NO: 66408 - protein, 9 aa, Homo Sapiens
KLEGFHTQI

SEQ ID NO: 66409 - protein, 9 aa, Homo Sapiens
KLEGPDVSL

SEQ ID NO: 66410 - protein, 9 aa, Homo Sapiens
KLESIGQRI

SEQ ID NO: 66411 - protein, 9 aa, Homo Sapiens
KLFDQANKL

SEQ ID NO: 66412 - protein, 9 aa, Homo Sapiens
KLFGMIITI

SEQ ID NO: 66413 - protein, 9 aa, Homo Sapiens
KLFKEVASL

SEQ ID NO: 66414 - protein, 9 aa, Homo Sapiens
KLFNDAIRL

SEQ ID NO: 66415 - protein, 9 aa, Homo Sapiens
KLFPYEEHL

SEQ ID NO: 66416 - protein, 9 aa, Homo Sapiens
KLFQGQLVL

SEQ ID NO: 66417 - protein, 9 aa, Homo Sapiens
KLFSLQDLL

SEQ ID NO: 66418 - protein, 9 aa, Homo Sapiens
KLHCEVEVI

SEQ ID NO: 66419 - protein, 9 aa, Homo Sapiens
KLHDVEHVL

SEQ ID NO: 66420 - protein, 9 aa, Homo Sapiens
KLHEEIEHL

SEQ ID NO: 66421 - protein, 9 aa, Homo Sapiens
KLHGKPIRI

SEQ ID NO: 66422 - protein, 9 aa, Homo Sapiens
KLHRGEIKL

SEQ ID NO: 66423 - protein, 9 aa, Homo Sapiens
KLIDDVHRL

SEQ ID NO: 66424 - protein, 9 aa, Homo Sapiens
KLIEFMDTF

SEQ ID NO: 66425 - protein, 9 aa, Homo Sapiens
KLIENNDTI

SEQ ID NO: 66426 - protein, 9 aa, Homo Sapiens
KLIGKEVCF

SEQ ID NO: 66427 - protein, 9 aa, Homo Sapiens
KLIHPDEDI

SEQ ID NO: 66428 - protein, 9 aa, Homo Sapiens
KLIKDGLII

SEQ ID NO: 66429 - protein, 9 aa, Homo Sapiens
KLIKEGDIV

SEQ ID NO: 66430 - protein, 9 aa, Homo Sapiens
KLIKGVERL

SEQ ID NO: 66431 - protein, 9 aa, Homo Sapiens
KLISEEDLL

SEQ ID NO: 66432 - protein, 9 aa, Homo Sapiens
KLKQFEERL

SEQ ID NO: 66433 - protein, 9 aa, Homo Sapiens
KLLDLIEDL

SEQ ID NO: 66434 - protein, 9 aa, Homo Sapiens
KLLEEICNL

SEQ ID NO: 66435 - protein, 9 aa, Homo Sapiens
KLLEVYEQL

SEQ ID NO: 66436 - protein, 9 aa, Homo Sapiens
KLLEYIEEI

SEQ ID NO: 66437 - protein, 9 aa, Homo Sapiens
KLLLDHQCL

SEQ ID NO: 66438 - protein, 9 aa, Homo Sapiens
KLLNLISKL

SEQ ID NO: 66439 - protein, 9 aa, Homo Sapiens
KLLPENNVL

SEQ ID NO: 66440 - protein, 9 aa, Homo Sapiens
KLLPETVTI

SEQ ID NO: 66441 - protein, 9 aa, Homo Sapiens
KLLYLEDFF

SEQ ID NO: 66442 - protein, 9 aa, Homo Sapiens
KLMAIPLVF

SEQ ID NO: 66443 - protein, 9 aa, Homo Sapiens
KLMELLEEI

SEQ ID NO: 66444 - protein, 9 aa, Homo Sapiens
KLMELYERL

SEQ ID NO: 66445 - protein, 9 aa, Homo Sapiens
KLMSELESF

SEQ ID NO: 66446 - protein, 9 aa, Homo Sapiens
KLNDMIDAI

SEQ ID NO: 66447 - protein, 9 aa, Homo Sapiens
KLNEAKEEF

SEQ ID NO: 66448 - protein, 9 aa, Homo Sapiens
KLNEIVDQI

SEQ ID NO: 66449 - protein, 9 aa, Homo Sapiens
KLPNYEEKI

SEQ ID NO: 66450 - protein, 9 aa, Homo Sapiens
KLPPKDLRI

SEQ ID NO: 66451 - protein, 9 aa, Homo Sapiens
KLQDGVHII

SEQ ID NO: 66452 - protein, 9 aa, Homo Sapiens
KLQDVADSF

SEQ ID NO: 66453 - protein, 9 aa, Homo Sapiens
KLQEIENAI

SEQ ID NO: 66454 - protein, 9 aa, Homo Sapiens
KLQEVDSLW

SEQ ID NO: 66455 - protein, 9 aa, Homo Sapiens
KLQEVLDYL

SEQ ID NO: 66456 - protein, 9 aa, Homo Sapiens
KLQNKEHVI

SEQ ID NO: 66457 - protein, 9 aa, Homo Sapiens
KLQYFMEQF

SEQ ID NO: 66458 - protein, 9 aa, Homo Sapiens
KLREDLERL

SEQ ID NO: 66459 - protein, 9 aa, Homo Sapiens
KLSAEKVEI

SEQ ID NO: 66460 - protein, 9 aa, Homo Sapiens
KLSEDLMEF

SEQ ID NO: 66461 - protein, 9 aa, Homo Sapiens
KLSEIPLTL

SEQ ID NO: 66462 - protein, 9 aa, Homo Sapiens
KLSELQLRV

SEQ ID NO: 66463 - protein, 9 aa, Homo Sapiens
KLSETFLHI

SEQ ID NO: 66464 - protein, 9 aa, Homo Sapiens
KLSEYEMSI

SEQ ID NO: 66465 - protein, 9 aa, Homo Sapiens
KLSGEYEKF

SEQ ID NO: 66466 - protein, 9 aa, Homo Sapiens
KLSHETVTI

SEQ ID NO: 66467 - protein, 9 aa, Homo Sapiens
KLSKFKIRI

SEQ ID NO: 66468 - protein, 9 aa, Homo Sapiens
KLSLNMDNL

SEQ ID NO: 66469 - protein, 9 aa, Homo Sapiens
KLSPEELLL

SEQ ID NO: 66470 - protein, 9 aa, Homo Sapiens
KLSPEEYVL

SEQ ID NO: 66471 - protein, 9 aa, Homo Sapiens
KLSQLEEHL

SEQ ID NO: 66472 - protein, 9 aa, Homo Sapiens
KLSSHEEAL

SEQ ID NO: 66473 - protein, 9 aa, Homo Sapiens
KLTEDKETL

SEQ ID NO: 66474 - protein, 9 aa, Homo Sapiens
KLTEENTTL

SEQ ID NO: 66475 - protein, 9 aa, Homo Sapiens
KLTELEQRI

SEQ ID NO: 66476 - protein, 9 aa, Homo Sapiens
KLTIHGDLY

SEQ ID NO: 66477 - protein, 9 aa, Homo Sapiens
KLTKDGNVL

SEQ ID NO: 66478 - protein, 9 aa, Homo Sapiens
KLTKTNERL

SEQ ID NO: 66479 - protein, 9 aa, Homo Sapiens
KLTNIVEKF

SEQ ID NO: 66480 - protein, 9 aa, Homo Sapiens
KLTPIHDRI

SEQ ID NO: 66481 - protein, 9 aa, Homo Sapiens
KLTPVPDSF

SEQ ID NO: 66482 - protein, 9 aa, Homo Sapiens
KLVAGEHGL

SEQ ID NO: 66483 - protein, 9 aa, Homo Sapiens
KLVAIVDVI

SEQ ID NO: 66484 - protein, 9 aa, Homo Sapiens
KLVDDQMNW

SEQ ID NO: 66485 - protein, 9 aa, Homo Sapiens
KLVDEEPQL

SEQ ID NO: 66486 - protein, 9 aa, Homo Sapiens
KLVEEFMLL

SEQ ID NO: 66487 - protein, 9 aa, Homo Sapiens
KLVEGQEKL

SEQ ID NO: 66488 - protein, 9 aa, Homo Sapiens
KLVFIGDTL

SEQ ID NO: 66489 - protein, 9 aa, Homo Sapiens
KLVHPTDKF

SEQ ID NO: 66490 - protein, 9 aa, Homo Sapiens
KLVQIEYAL

SEQ ID NO: 66491 - protein, 9 aa, Homo Sapiens
KLVWFDLDL

SEQ ID NO: 66492 - protein, 9 aa, Homo Sapiens
KLWADRISL

SEQ ID NO: 66493 - protein, 9 aa, Homo Sapiens
KLWEAESKL

SEQ ID NO: 66494 - protein, 9 aa, Homo Sapiens
KLYDDMIRL

SEQ ID NO: 66495 - protein, 9 aa, Homo Sapiens
KLYDGFQYL

SEQ ID NO: 66496 - protein, 9 aa, Homo Sapiens
KLYGKPIRV

SEQ ID NO: 66497 - protein, 9 aa, Homo Sapiens
KLYHNEVEI

SEQ ID NO: 66498 - protein, 9 aa, Homo Sapiens
KLYPLEIVF

SEQ ID NO: 66499 - protein, 9 aa, Homo Sapiens
KLYPWIHQF

SEQ ID NO: 66500 - protein, 9 aa, Homo Sapiens
KLYSEMEQL

SEQ ID NO: 66501 - protein, 9 aa, Homo Sapiens
KMADIEYRL

SEQ ID NO: 66502 - protein, 9 aa, Homo Sapiens
KMCPPDEGW

SEQ ID NO: 66503 - protein, 9 aa, Homo Sapiens
KMDEVLYSI

SEQ ID NO: 66504 - protein, 9 aa, Homo Sapiens
KMDRALLEL

SEQ ID NO: 66505 - protein, 9 aa, Homo Sapiens
KMDRKDKLF

SEQ ID NO: 66506 - protein, 9 aa, Homo Sapiens
KMFFLIEKI

SEQ ID NO: 66507 - protein, 9 aa, Homo Sapiens
KMGGKDFSF

SEQ ID NO: 66508 - protein, 9 aa, Homo Sapiens
KMHARDFTV

SEQ ID NO: 66509 - protein, 9 aa, Homo Sapiens
KMIDSGDKL

SEQ ID NO: 66510 - protein, 9 aa, Homo Sapiens
KMMDVTVTI

SEQ ID NO: 66511 - protein, 9 aa, Homo Sapiens
KMQELEAKL

SEQ ID NO: 66512 - protein, 9 aa, Homo Sapiens
KMSEKILLL

SEQ ID NO: 66513 - protein, 9 aa, Homo Sapiens
KMSSKKLKI

SEQ ID NO: 66514 - protein, 9 aa, Homo Sapiens
KMVRADPSL

SEQ ID NO: 66515 - protein, 9 aa, Homo Sapiens
KMVTEKAGF

SEQ ID NO: 66516 - protein, 9 aa, Homo Sapiens
KMWEEAISL

SEQ ID NO: 66517 - protein, 9 aa, Homo Sapiens
KPERSFEIL

SEQ ID NO: 66518 - protein, 9 aa, Homo Sapiens
KQAADMILL

SEQ ID NO: 66519 - protein, 9 aa, Homo Sapiens
KQAEEYLSF

SEQ ID NO: 66520 - protein, 9 aa, Homo Sapiens
KQAEIVKRL

SEQ ID NO: 66521 - protein, 9 aa, Homo Sapiens
KQAETIEKL

SEQ ID NO: 66522 - protein, 9 aa, Homo Sapiens
KQAEVVGYF

SEQ ID NO: 66523 - protein, 9 aa, Homo Sapiens
KQAGLVVKL

SEQ ID NO: 66524 - protein, 9 aa, Homo Sapiens
KQAHVDVKF

SEQ ID NO: 66525 - protein, 9 aa, Homo Sapiens
KQALDKLKL

SEQ ID NO: 66526 - protein, 9 aa, Homo Sapiens
KQALVNCNW

SEQ ID NO: 66527 - protein, 9 aa, Homo Sapiens
KQAPPLEDI

SEQ ID NO: 66528 - protein, 9 aa, Homo Sapiens
KQAVGHEAI

SEQ ID NO: 66529 - protein, 9 aa, Homo Sapiens
KQAVTKAGW

SEQ ID NO: 66530 - protein, 9 aa, Homo Sapiens
KQCSENVHI

SEQ ID NO: 66531 - protein, 9 aa, Homo Sapiens
KQDETQTKI

SEQ ID NO: 66532 - protein, 9 aa, Homo Sapiens
KQDFSPEVL

SEQ ID NO: 66533 - protein, 9 aa, Homo Sapiens
KQDGSTIHI

SEQ ID NO: 66534 - protein, 9 aa, Homo Sapiens
KQDGTIQNL

SEQ ID NO: 66535 - protein, 9 aa, Homo Sapiens
KQDKACRFL

SEQ ID NO: 66536 - protein, 9 aa, Homo Sapiens
KQDKDAIAI

SEQ ID NO: 66537 - protein, 9 aa, Homo Sapiens
KQDKGGFGF

SEQ ID NO: 66538 - protein, 9 aa, Homo Sapiens
KQDKKEMAI

SEQ ID NO: 66539 - protein, 9 aa, Homo Sapiens
KQDNCVHDL

SEQ ID NO: 66540 - protein, 9 aa, Homo Sapiens
KQDNETFGF

SEQ ID NO: 66541 - protein, 9 aa, Homo Sapiens
KQDQSNVQI

SEQ ID NO: 66542 - protein, 9 aa, Homo Sapiens
KQDRLNQTL

SEQ ID NO: 66543 - protein, 9 aa, Homo Sapiens
KQDWLILHI

SEQ ID NO: 66544 - protein, 9 aa, Homo Sapiens
KQEDCVVVW

SEQ ID NO: 66545 - protein, 9 aa, Homo Sapiens
KQEEQDRLL

SEQ ID NO: 66546 - protein, 9 aa, Homo Sapiens
KQEFLEQKI

SEQ ID NO: 66547 - protein, 9 aa, Homo Sapiens
KQEGAVHVL

SEQ ID NO: 66548 - protein, 9 aa, Homo Sapiens
KQEIGFGNW

SEQ ID NO: 66549 - protein, 9 aa, Homo Sapiens
KQEKPERLL

SEQ ID NO: 66550 - protein, 9 aa, Homo Sapiens
KQELIQAEI

SEQ ID NO: 66551 - protein, 9 aa, Homo Sapiens
KQESIVLKL

SEQ ID NO: 66552 - protein, 9 aa, Homo Sapiens
KQESTVMVL

SEQ ID NO: 66553 - protein, 9 aa, Homo Sapiens
KQFAEENGL

SEQ ID NO: 66554 - protein, 9 aa, Homo Sapiens
KQFAEGSTL

SEQ ID NO: 66555 - protein, 9 aa, Homo Sapiens
KQFAEILHF

SEQ ID NO: 66556 - protein, 9 aa, Homo Sapiens
KQFEGTVEI

SEQ ID NO: 66557 - protein, 9 aa, Homo Sapiens
KQFELALQL

SEQ ID NO: 66558 - protein, 9 aa, Homo Sapiens
KQFFEEVGI

SEQ ID NO: 66559 - protein, 9 aa, Homo Sapiens
KQFGNILIL

SEQ ID NO: 66560 - protein, 9 aa, Homo Sapiens
KQFKYGNQL

SEQ ID NO: 66561 - protein, 9 aa, Homo Sapiens
KQFQFGHAL

SEQ ID NO: 66562 - protein, 9 aa, Homo Sapiens
KQFTVAELF

SEQ ID NO: 66563 - protein, 9 aa, Homo Sapiens
KQFYYRDEF

SEQ ID NO: 66564 - protein, 9 aa, Homo Sapiens
KQHAAELHL

SEQ ID NO: 66565 - protein, 9 aa, Homo Sapiens
KQHIPDAKL

SEQ ID NO: 66566 - protein, 9 aa, Homo Sapiens
KQIAEAVRL

SEQ ID NO: 66567 - protein, 9 aa, Homo Sapiens
KQIDDRKEW

SEQ ID NO: 66568 - protein, 9 aa, Homo Sapiens
KQIDKEPKI

SEQ ID NO: 66569 - protein, 9 aa, Homo Sapiens
KQIDSVNHI

SEQ ID NO: 66570 - protein, 9 aa, Homo Sapiens
KQIFEDHVF

SEQ ID NO: 66571 - protein, 9 aa, Homo Sapiens
KQIMENAEI

SEQ ID NO: 66572 - protein, 9 aa, Homo Sapiens
KQINQEYLI

SEQ ID NO: 66573 - protein, 9 aa, Homo Sapiens
KQIQDMLGL

SEQ ID NO: 66574 - protein, 9 aa, Homo Sapiens
KQIQEDWEL

SEQ ID NO: 66575 - protein, 9 aa, Homo Sapiens
KQLAEDVKL

SEQ ID NO: 66576 - protein, 9 aa, Homo Sapiens
KQLEDGRTL

SEQ ID NO: 66577 - protein, 9 aa, Homo Sapiens
KQLEDILVL

SEQ ID NO: 66578 - protein, 9 aa, Homo Sapiens
KQLFTLVEW

SEQ ID NO: 66579 - protein, 9 aa, Homo Sapiens
KQLKEELRL

SEQ ID NO: 66580 - protein, 9 aa, Homo Sapiens
KQLKLDPSI

SEQ ID NO: 66581 - protein, 9 aa, Homo Sapiens
KQLRDELRL

SEQ ID NO: 66582 - protein, 9 aa, Homo Sapiens
KQMAAEEAM

SEQ ID NO: 66583 - protein, 9 aa, Homo Sapiens
KQMEDGHTL

SEQ ID NO: 66584 - protein, 9 aa, Homo Sapiens
KQMPEEPKL

SEQ ID NO: 66585 - protein, 9 aa, Homo Sapiens
KQMPEPEQL

SEQ ID NO: 66586 - protein, 9 aa, Homo Sapiens
KQMSISTGL

SEQ ID NO: 66587 - protein, 9 aa, Homo Sapiens
KQNHESVQW

SEQ ID NO: 66588 - protein, 9 aa, Homo Sapiens
KQNRPIPQW

SEQ ID NO: 66589 - protein, 9 aa, Homo Sapiens
KQPRQDYQL

SEQ ID NO: 66590 - protein, 9 aa, Homo Sapiens
KQQEYEEQF

SEQ ID NO: 66591 - protein, 9 aa, Homo Sapiens
KQQMLEQHL

SEQ ID NO: 66592 - protein, 9 aa, Homo Sapiens
KQQRNEVSF

SEQ ID NO: 66593 - protein, 9 aa, Homo Sapiens
KQSDSLTRI

SEQ ID NO: 66594 - protein, 9 aa, Homo Sapiens
KQSEDMHAF

SEQ ID NO: 66595 - protein, 9 aa, Homo Sapiens
KQSEEHNML

SEQ ID NO: 66596 - protein, 9 aa, Homo Sapiens
KQSKTVDVL

SEQ ID NO: 66597 - protein, 9 aa, Homo Sapiens
KQSLDVLDL

SEQ ID NO: 66598 - protein, 9 aa, Homo Sapiens
KQSNSYDMF

SEQ ID NO: 66599 - protein, 9 aa, Homo Sapiens
KQSPECENF

SEQ ID NO: 66600 - protein, 9 aa, Homo Sapiens
KQSPPIVKI

SEQ ID NO: 66601 - protein, 9 aa, Homo Sapiens
KQSRDISTL

SEQ ID NO: 66602 - protein, 9 aa, Homo Sapiens
KQSSVMQRL

SEQ ID NO: 66603 - protein, 9 aa, Homo Sapiens
KQTALASRF

SEQ ID NO: 66604 - protein, 9 aa, Homo Sapiens
KQTAVPTIF

SEQ ID NO: 66605 - protein, 9 aa, Homo Sapiens
KQTDFEHRI

SEQ ID NO: 66606 - protein, 9 aa, Homo Sapiens
KQTEIAKRL

SEQ ID NO: 66607 - protein, 9 aa, Homo Sapiens
KQTEVETVM

SEQ ID NO: 66608 - protein, 9 aa, Homo Sapiens
KQTQPERYI

SEQ ID NO: 66609 - protein, 9 aa, Homo Sapiens
KQTTKSELL

SEQ ID NO: 66610 - protein, 9 aa, Homo Sapiens
KQVDLENVW

SEQ ID NO: 66611 - protein, 9 aa, Homo Sapiens
KQVEEIFNL

SEQ ID NO: 66612 - protein, 9 aa, Homo Sapiens
KQVFTSEKF

SEQ ID NO: 66613 - protein, 9 aa, Homo Sapiens
KQVHPDTGI

SEQ ID NO: 66614 - protein, 9 aa, Homo Sapiens
KQVTTAENL

SEQ ID NO: 66615 - protein, 9 aa, Homo Sapiens
KQVVEISSL

SEQ ID NO: 66616 - protein, 9 aa, Homo Sapiens
KQWTEILHF

SEQ ID NO: 66617 - protein, 9 aa, Homo Sapiens
KQYADVEGF

SEQ ID NO: 66618 - protein, 9 aa, Homo Sapiens
KQYGNEVFL

SEQ ID NO: 66619 - protein, 9 aa, Homo Sapiens
KQYNVDYKL

SEQ ID NO: 66620 - protein, 9 aa, Homo Sapiens
KQYPISLVL

SEQ ID NO: 66621 - protein, 9 aa, Homo Sapiens
KQYRGKELL

SEQ ID NO: 66622 - protein, 9 aa, Homo Sapiens
KQYSGEEGF

SEQ ID NO: 66623 - protein, 9 aa, Homo Sapiens
KQYTGINAI

SEQ ID NO: 66624 - protein, 9 aa, Homo Sapiens
KSCDLLLFL

SEQ ID NO: 66625 - protein, 9 aa, Homo Sapiens
KTAPFDSRF

SEQ ID NO: 66626 - protein, 9 aa, Homo Sapiens
KTCSKEFKL

SEQ ID NO: 66627 - protein, 9 aa, Homo Sapiens
KVAELFEKL

SEQ ID NO: 66628 - protein, 9 aa, Homo Sapiens
KVASALEKW

SEQ ID NO: 66629 - protein, 9 aa, Homo Sapiens
KVATAQDDI

SEQ ID NO: 66630 - protein, 9 aa, Homo Sapiens
KVCVEHHTF

SEQ ID NO: 66631 - protein, 9 aa, Homo Sapiens
KVDGSEPKL

SEQ ID NO: 66632 - protein, 9 aa, Homo Sapiens
KVEETFQCI

SEQ ID NO: 66633 - protein, 9 aa, Homo Sapiens
KVHDFDVKI

SEQ ID NO: 66634 - protein, 9 aa, Homo Sapiens
KVIDVDHGI

SEQ ID NO: 66635 - protein, 9 aa, Homo Sapiens
KVIELQEII

SEQ ID NO: 66636 - protein, 9 aa, Homo Sapiens
KVLELFESF

SEQ ID NO: 66637 - protein, 9 aa, Homo Sapiens
KVMCIEHEI

SEQ ID NO: 66638 - protein, 9 aa, Homo Sapiens
KVMEYENRI

SEQ ID NO: 66639 - protein, 9 aa, Homo Sapiens
KVSDILLRL

SEQ ID NO: 66640 - protein, 9 aa, Homo Sapiens
KVSDYEMKL

SEQ ID NO: 66641 - protein, 9 aa, Homo Sapiens
KVSELKEEL

SEQ ID NO: 66642 - protein, 9 aa, Homo Sapiens
KVSSVMDRF

SEQ ID NO: 66643 - protein, 9 aa, Homo Sapiens
KVVDDTLEL

SEQ ID NO: 66644 - protein, 9 aa, Homo Sapiens
KVVGKDYLL

SEQ ID NO: 66645 - protein, 9 aa, Homo Sapiens
KVYEYDTVI

SEQ ID NO: 66646 - protein, 9 aa, Homo Sapiens
LAPILDDGW

SEQ ID NO: 66647 - protein, 9 aa, Homo Sapiens
LEARNKLLL

SEQ ID NO: 66648 - protein, 9 aa, Homo Sapiens
LELARKIIL

SEQ ID NO: 66649 - protein, 9 aa, Homo Sapiens
LEQRFLELL

SEQ ID NO: 66650 - protein, 9 aa, Homo Sapiens
LIDENDNKI

SEQ ID NO: 66651 - protein, 9 aa, Homo Sapiens
LIIWGVLEL

SEQ ID NO: 66652 - protein, 9 aa, Homo Sapiens
LIMVAIPII

SEQ ID NO: 66653 - protein, 9 aa, Homo Sapiens
LISITKLEW

SEQ ID NO: 66654 - protein, 9 aa, Homo Sapiens
LIVDRDEAW

SEQ ID NO: 66655 - protein, 9 aa, Homo Sapiens
LIYSGKLLL

SEQ ID NO: 66656 - protein, 9 aa, Homo Sapiens
LLAEEIEKF

SEQ ID NO: 66657 - protein, 9 aa, Homo Sapiens
LLAEPVPGI

SEQ ID NO: 66658 - protein, 9 aa, Homo Sapiens
LLAHPDAPM

SEQ ID NO: 66659 - protein, 9 aa, Homo Sapiens
LLDATQHTL

SEQ ID NO: 66660 - protein, 9 aa, Homo Sapiens
LLDEVIQEF

SEQ ID NO: 66661 - protein, 9 aa, Homo Sapiens
LLDKAQDLF

SEQ ID NO: 66662 - protein, 9 aa, Homo Sapiens
LLDKKSLKI

SEQ ID NO: 66663 - protein, 9 aa, Homo Sapiens
LLDLKEPTW

SEQ ID NO: 66664 - protein, 9 aa, Homo Sapiens
LLDMSYEQL

SEQ ID NO: 66665 - protein, 9 aa, Homo Sapiens
LLDSQSHHL

SEQ ID NO: 66666 - protein, 9 aa, Homo Sapiens
LLDSSHSEL

SEQ ID NO: 66667 - protein, 9 aa, Homo Sapiens
LLDVTPLSL

SEQ ID NO: 66668 - protein, 9 aa, Homo Sapiens
LLFEGEKKI

SEQ ID NO: 66669 - protein, 9 aa, Homo Sapiens
LLFSHEEEL

SEQ ID NO: 66670 - protein, 9 aa, Homo Sapiens
LLFVDEPKL

SEQ ID NO: 66671 - protein, 9 aa, Homo Sapiens
LLIDDKGTI

SEQ ID NO: 66672 - protein, 9 aa, Homo Sapiens
LLIDFAHSW

SEQ ID NO: 66673 - protein, 9 aa, Homo Sapiens
LLIDPEPQI

SEQ ID NO: 66674 - protein, 9 aa, Homo Sapiens
LLNKAPEYL

SEQ ID NO: 66675 - protein, 9 aa, Homo Sapiens
LLNNAFEEL

SEQ ID NO: 66676 - protein, 9 aa, Homo Sapiens
LLNSKEAAL

SEQ ID NO: 66677 - protein, 9 aa, Homo Sapiens
LLNTVGDLL

SEQ ID NO: 66678 - protein, 9 aa, Homo Sapiens
LLNVINENF

SEQ ID NO: 66679 - protein, 9 aa, Homo Sapiens
LLPADGILI

SEQ ID NO: 66680 - protein, 9 aa, Homo Sapiens
LLQEEFVKW

SEQ ID NO: 66681 - protein, 9 aa, Homo Sapiens
LLQGHERSI

SEQ ID NO: 66682 - protein, 9 aa, Homo Sapiens
LLSDTKLEL

SEQ ID NO: 66683 - protein, 9 aa, Homo Sapiens
LLSDVRFVL

SEQ ID NO: 66684 - protein, 9 aa, Homo Sapiens
LLSEEEYHL

SEQ ID NO: 66685 - protein, 9 aa, Homo Sapiens
LLSEIEEHL

SEQ ID NO: 66686 - protein, 9 aa, Homo Sapiens
LLSHVEQLL

SEQ ID NO: 66687 - protein, 9 aa, Homo Sapiens
LLSIVNPEW

SEQ ID NO: 66688 - protein, 9 aa, Homo Sapiens
LLSLVKEEF

SEQ ID NO: 66689 - protein, 9 aa, Homo Sapiens
LLSPVSVEW

SEQ ID NO: 66690 - protein, 9 aa, Homo Sapiens
LLSQDFVQI

SEQ ID NO: 66691 - protein, 9 aa, Homo Sapiens
LLTEISSSW

SEQ ID NO: 66692 - protein, 9 aa, Homo Sapiens
LLTTMGDRF

SEQ ID NO: 66693 - protein, 9 aa, Homo Sapiens
LLWQENERL

SEQ ID NO: 66694 - protein, 9 aa, Homo Sapiens
LLYLLEHTW

SEQ ID NO: 66695 - protein, 9 aa, Homo Sapiens
LMDESVLKF

SEQ ID NO: 66696 - protein, 9 aa, Homo Sapiens
LMDPDTKLI

SEQ ID NO: 66697 - protein, 9 aa, Homo Sapiens
LMTWVQDQL

SEQ ID NO: 66698 - protein, 9 aa, Homo Sapiens
LQATEDAKL

SEQ ID NO: 66699 - protein, 9 aa, Homo Sapiens
LQDDIPTTF

SEQ ID NO: 66700 - protein, 9 aa, Homo Sapiens
LQDKDTYSW

SEQ ID NO: 66701 - protein, 9 aa, Homo Sapiens
LQDLTPLKL

SEQ ID NO: 66702 - protein, 9 aa, Homo Sapiens
LQDPGNHLI

SEQ ID NO: 66703 - protein, 9 aa, Homo Sapiens
LQDRPIPEW

SEQ ID NO: 66704 - protein, 9 aa, Homo Sapiens
LQDTLIHLI

SEQ ID NO: 66705 - protein, 9 aa, Homo Sapiens
LQDVIDLRL

SEQ ID NO: 66706 - protein, 9 aa, Homo Sapiens
LQEACEAYL

SEQ ID NO: 66707 - protein, 9 aa, Homo Sapiens
LQHGAEPTI

SEQ ID NO: 66708 - protein, 9 aa, Homo Sapiens
LQIGDVVRI

SEQ ID NO: 66709 - protein, 9 aa, Homo Sapiens
LQINDKIAL

SEQ ID NO: 66710 - protein, 9 aa, Homo Sapiens
LQLDKEFQL

SEQ ID NO: 66711 - protein, 9 aa, Homo Sapiens
LQNIGIDKI

SEQ ID NO: 66712 - protein, 9 aa, Homo Sapiens
LQNKLPELW

SEQ ID NO: 66713 - protein, 9 aa, Homo Sapiens
LQNNTILRL

SEQ ID NO: 66714 - protein, 9 aa, Homo Sapiens
LQNPDLVSL

SEQ ID NO: 66715 - protein, 9 aa, Homo Sapiens
LQRANDDRW

SEQ ID NO: 66716 - protein, 9 aa, Homo Sapiens
LQSGADPTL

SEQ ID NO: 66717 - protein, 9 aa, Homo Sapiens
LQSKLKDLF

SEQ ID NO: 66718 - protein, 9 aa, Homo Sapiens
LQSLNFERI

SEQ ID NO: 66719 - protein, 9 aa, Homo Sapiens
LQSRIEDRL

SEQ ID NO: 66720 - protein, 9 aa, Homo Sapiens
LQTSIREEI

SEQ ID NO: 66721 - protein, 9 aa, Homo Sapiens
LQVGKGDEV

SEQ ID NO: 66722 - protein, 9 aa, Homo Sapiens
LQYSFPLQL

SEQ ID NO: 66723 - protein, 9 aa, Homo Sapiens
LSEDKTLLL

SEQ ID NO: 66724 - protein, 9 aa, Homo Sapiens
LTDKSCQSF

SEQ ID NO: 66725 - protein, 9 aa, Homo Sapiens
LVADPDCRW

SEQ ID NO: 66726 - protein, 9 aa, Homo Sapiens
LVQAERTVL

SEQ ID NO: 66727 - protein, 9 aa, Homo Sapiens
MAPLKMLAL

SEQ ID NO: 66728 - protein, 9 aa, Homo Sapiens
MIDDTYQCL

SEQ ID NO: 66729 - protein, 9 aa, Homo Sapiens
MIDNVILLI

SEQ ID NO: 66730 - protein, 9 aa, Homo Sapiens
MIHEPEPHI

SEQ ID NO: 66731 - protein, 9 aa, Homo Sapiens
MIRKEELEI

SEQ ID NO: 66732 - protein, 9 aa, Homo Sapiens
MLDNSFERL

SEQ ID NO: 66733 - protein, 9 aa, Homo Sapiens
MLDPHQTLF

SEQ ID NO: 66734 - protein, 9 aa, Homo Sapiens
MLYPLSHGF

SEQ ID NO: 66735 - protein, 9 aa, Homo Sapiens
MQEPSAHTF

SEQ ID NO: 66736 - protein, 9 aa, Homo Sapiens
MQNPRQYKI

SEQ ID NO: 66737 - protein, 9 aa, Homo Sapiens
MQVKVGNEV

SEQ ID NO: 66738 - protein, 9 aa, Homo Sapiens
MVDGTLLLL

SEQ ID NO: 66739 - protein, 9 aa, Homo Sapiens
NIDDKDFKW

SEQ ID NO: 66740 - protein, 9 aa, Homo Sapiens
NLVQVGDSL

SEQ ID NO: 66741 - protein, 9 aa, Homo Sapiens
NQDHVHAVW

SEQ ID NO: 66742 - protein, 9 aa, Homo Sapiens
NQDLTFQHI

SEQ ID NO: 66743 - protein, 9 aa, Homo Sapiens
NQMVEISAW

SEQ ID NO: 66744 - protein, 9 aa, Homo Sapiens
NQTAVECTW

SEQ ID NO: 66745 - protein, 9 aa, Homo Sapiens
QESNVQLKL

SEQ ID NO: 66746 - protein, 9 aa, Homo Sapiens
QESNVRLKL

SEQ ID NO: 66747 - protein, 9 aa, Homo Sapiens
QIAPPSHLI

SEQ ID NO: 66748 - protein, 9 aa, Homo Sapiens
QIDDVTIKI

SEQ ID NO: 66749 - protein, 9 aa, Homo Sapiens
QIGPPEVHL

SEQ ID NO: 66750 - protein, 9 aa, Homo Sapiens
QIHQGEERL

SEQ ID NO: 66751 - protein, 9 aa, Homo Sapiens
QISAGEEKW

SEQ ID NO: 66752 - protein, 9 aa, Homo Sapiens
QISKEYERF

SEQ ID NO: 66753 - protein, 9 aa, Homo Sapiens
QISQAYEVL

SEQ ID NO: 66754 - protein, 9 aa, Homo Sapiens
QLAEVEEKI

SEQ ID NO: 66755 - protein, 9 aa, Homo Sapiens
QLAFIEELF

SEQ ID NO: 66756 - protein, 9 aa, Homo Sapiens
QLAGFSHQI

SEQ ID NO: 66757 - protein, 9 aa, Homo Sapiens
QLAQHDEDL

SEQ ID NO: 66758 - protein, 9 aa, Homo Sapiens
QLCDLETKL

SEQ ID NO: 66759 - protein, 9 aa, Homo Sapiens
QLCEDIIQL

SEQ ID NO: 66760 - protein, 9 aa, Homo Sapiens
QLDETSHRW

SEQ ID NO: 66761 - protein, 9 aa, Homo Sapiens
QLEKHTRYW

SEQ ID NO: 66762 - protein, 9 aa, Homo Sapiens
QLENKEHLW

SEQ ID NO: 66763 - protein, 9 aa, Homo Sapiens
QLFVGTERI

SEQ ID NO: 66764 - protein, 9 aa, Homo Sapiens
QLIDKVWQL

SEQ ID NO: 66765 - protein, 9 aa, Homo Sapiens
QLIDMEWKF

SEQ ID NO: 66766 - protein, 9 aa, Homo Sapiens
QLLGLHEQL

SEQ ID NO: 66767 - protein, 9 aa, Homo Sapiens
QLSDVAEKL

SEQ ID NO: 66768 - protein, 9 aa, Homo Sapiens
QLSNGDHHF

SEQ ID NO: 66769 - protein, 9 aa, Homo Sapiens
QLSNISCSF

SEQ ID NO: 66770 - protein, 9 aa, Homo Sapiens
QLSPVLLYL

SEQ ID NO: 66771 - protein, 9 aa, Homo Sapiens
QLVDREHKL

SEQ ID NO: 66772 - protein, 9 aa, Homo Sapiens
QLVMEGYKW

SEQ ID NO: 66773 - protein, 9 aa, Homo Sapiens
QLVMEGYNW

SEQ ID NO: 66774 - protein, 9 aa, Homo Sapiens
QLYPLQDIL

SEQ ID NO: 66775 - protein, 9 aa, Homo Sapiens
QMFGEMEVW

SEQ ID NO: 66776 - protein, 9 aa, Homo Sapiens
QMSGAQIKI

SEQ ID NO: 66777 - protein, 9 aa, Homo Sapiens
QQAAIPIQI

SEQ ID NO: 66778 - protein, 9 aa, Homo Sapiens
QQASMEEKF

SEQ ID NO: 66779 - protein, 9 aa, Homo Sapiens
QQAWPLEGF

SEQ ID NO: 66780 - protein, 9 aa, Homo Sapiens
QQCVVANKL

SEQ ID NO: 66781 - protein, 9 aa, Homo Sapiens
QQDAQEFFL

SEQ ID NO: 66782 - protein, 9 aa, Homo Sapiens
QQDDGKMFI

SEQ ID NO: 66783 - protein, 9 aa, Homo Sapiens
QQDKLNTRW

SEQ ID NO: 66784 - protein, 9 aa, Homo Sapiens
QQDQVDRNI

SEQ ID NO: 66785 - protein, 9 aa, Homo Sapiens
QQDRIQQEI

SEQ ID NO: 66786 - protein, 9 aa, Homo Sapiens
QQDSGRLYL

SEQ ID NO: 66787 - protein, 9 aa, Homo Sapiens
QQDWVVQRI

SEQ ID NO: 66788 - protein, 9 aa, Homo Sapiens
QQFPAPLGW

SEQ ID NO: 66789 - protein, 9 aa, Homo Sapiens
QQHEIESRI

SEQ ID NO: 66790 - protein, 9 aa, Homo Sapiens
QQHSGQHLI

SEQ ID NO: 66791 - protein, 9 aa, Homo Sapiens
QQHVIETLI

SEQ ID NO: 66792 - protein, 9 aa, Homo Sapiens
QQIKELEKL

SEQ ID NO: 66793 - protein, 9 aa, Homo Sapiens
QQIKQVEEF

SEQ ID NO: 66794 - protein, 9 aa, Homo Sapiens
QQLEDLCSW

SEQ ID NO: 66795 - protein, 9 aa, Homo Sapiens
QQLPDILKI

SEQ ID NO: 66796 - protein, 9 aa, Homo Sapiens
QQLRQETGL

SEQ ID NO: 66797 - protein, 9 aa, Homo Sapiens
QQNNVEHKV

SEQ ID NO: 66798 - protein, 9 aa, Homo Sapiens
QQSADRCFL

SEQ ID NO: 66799 - protein, 9 aa, Homo Sapiens
QQSNVILLL

SEQ ID NO: 66800 - protein, 9 aa, Homo Sapiens
QQSSLSLRW

SEQ ID NO: 66801 - protein, 9 aa, Homo Sapiens
QQSVIGDYL

SEQ ID NO: 66802 - protein, 9 aa, Homo Sapiens
QQTDIAVNW

SEQ ID NO: 66803 - protein, 9 aa, Homo Sapiens
QQTSEHALF

SEQ ID NO: 66804 - protein, 9 aa, Homo Sapiens
QQVKDVQKL

SEQ ID NO: 66805 - protein, 9 aa, Homo Sapiens
QQWQDLMSI

SEQ ID NO: 66806 - protein, 9 aa, Homo Sapiens
QSESELQKL

SEQ ID NO: 66807 - protein, 9 aa, Homo Sapiens
QTLELKNSI

SEQ ID NO: 66808 - protein, 9 aa, Homo Sapiens
QVDRIILQL

SEQ ID NO: 66809 - protein, 9 aa, Homo Sapiens
QVSSEDVRW

SEQ ID NO: 66810 - protein, 9 aa, Homo Sapiens
RAAVIGDVI

SEQ ID NO: 66811 - protein, 9 aa, Homo Sapiens
RADDTFEAL

SEQ ID NO: 66812 - protein, 9 aa, Homo Sapiens
RADPLFLLI

SEQ ID NO: 66813 - protein, 9 aa, Homo Sapiens
RALIEKVGI

SEQ ID NO: 66814 - protein, 9 aa, Homo Sapiens
RAQEGDWRW

SEQ ID NO: 66815 - protein, 9 aa, Homo Sapiens
RDIFKKQII

SEQ ID NO: 66816 - protein, 9 aa, Homo Sapiens
REAELQMLL

SEQ ID NO: 66817 - protein, 9 aa, Homo Sapiens
REAPIHLDF

SEQ ID NO: 66818 - protein, 9 aa, Homo Sapiens
REASIYTGI

SEQ ID NO: 66819 - protein, 9 aa, Homo Sapiens
RECENQLVL

SEQ ID NO: 66820 - protein, 9 aa, Homo Sapiens
REDKVHLKL

SEQ ID NO: 66821 - protein, 9 aa, Homo Sapiens
REHPLYLRL

SEQ ID NO: 66822 - protein, 9 aa, Homo Sapiens
REHTALLKI

SEQ ID NO: 66823 - protein, 9 aa, Homo Sapiens
RESERQLRL

SEQ ID NO: 66824 - protein, 9 aa, Homo Sapiens
REWSGKEKW

SEQ ID NO: 66825 - protein, 9 aa, Homo Sapiens
RGAQVEEIW

SEQ ID NO: 66826 - protein, 9 aa, Homo Sapiens
RGDDTPLHL

SEQ ID NO: 66827 - protein, 9 aa, Homo Sapiens
RIADFQDVL

SEQ ID NO: 66828 - protein, 9 aa, Homo Sapiens
RIADKEVTI

SEQ ID NO: 66829 - protein, 9 aa, Homo Sapiens
RIADSFQVI

SEQ ID NO: 66830 - protein, 9 aa, Homo Sapiens
RIAEYAFKL

SEQ ID NO: 66831 - protein, 9 aa, Homo Sapiens
RIAGEASRL

SEQ ID NO: 66832 - protein, 9 aa, Homo Sapiens
RIAHIPLYF

SEQ ID NO: 66833 - protein, 9 aa, Homo Sapiens
RIAIYELLF

SEQ ID NO: 66834 - protein, 9 aa, Homo Sapiens
RIAPPDRRF

SEQ ID NO: 66835 - protein, 9 aa, Homo Sapiens
RIAPRPYRL

SEQ ID NO: 66836 - protein, 9 aa, Homo Sapiens
RIAPSGDQW

SEQ ID NO: 66837 - protein, 9 aa, Homo Sapiens
RIAQEVQRF

SEQ ID NO: 66838 - protein, 9 aa, Homo Sapiens
RIAQPGDHV

SEQ ID NO: 66839 - protein, 9 aa, Homo Sapiens
RIASEASRL

SEQ ID NO: 66840 - protein, 9 aa, Homo Sapiens
RIATDRLHI

SEQ ID NO: 66841 - protein, 9 aa, Homo Sapiens
RIATEFNQL

SEQ ID NO: 66842 - protein, 9 aa, Homo Sapiens
RICPIDITL

SEQ ID NO: 66843 - protein, 9 aa, Homo Sapiens
RIDDLEKNI

SEQ ID NO: 66844 - protein, 9 aa, Homo Sapiens
RIDEARQEL

SEQ ID NO: 66845 - protein, 9 aa, Homo Sapiens
RIDGKTYVI

SEQ ID NO: 66846 - protein, 9 aa, Homo Sapiens
RIDGVLIRM

SEQ ID NO: 66847 - protein, 9 aa, Homo Sapiens
RIDGVSLLV

SEQ ID NO: 66848 - protein, 9 aa, Homo Sapiens
RIDPSSLSF

SEQ ID NO: 66849 - protein, 9 aa, Homo Sapiens
RIDQVNQLL

SEQ ID NO: 66850 - protein, 9 aa, Homo Sapiens
RIEDRLERL

SEQ ID NO: 66851 - protein, 9 aa, Homo Sapiens
RIEEGLDQI

SEQ ID NO: 66852 - protein, 9 aa, Homo Sapiens
RIEPPDRRW

SEQ ID NO: 66853 - protein, 9 aa, Homo Sapiens
RIFEKMFAM

SEQ ID NO: 66854 - protein, 9 aa, Homo Sapiens
RIFGESIMI

SEQ ID NO: 66855 - protein, 9 aa, Homo Sapiens
RIFGGLDML

SEQ ID NO: 66856 - protein, 9 aa, Homo Sapiens
RIFPDKFVL

SEQ ID NO: 66857 - protein, 9 aa, Homo Sapiens
RIGKFEARF

SEQ ID NO: 66858 - protein, 9 aa, Homo Sapiens
RIHKGDRVL

SEQ ID NO: 66859 - protein, 9 aa, Homo Sapiens
RIHLRDYVI

SEQ ID NO: 66860 - protein, 9 aa, Homo Sapiens
RIHQDGIHI

SEQ ID NO: 66861 - protein, 9 aa, Homo Sapiens
RIHTGEKPF

SEQ ID NO: 66862 - protein, 9 aa, Homo Sapiens
RIIEREEKI

SEQ ID NO: 66863 - protein, 9 aa, Homo Sapiens
RIIFVDEVF

SEQ ID NO: 66864 - protein, 9 aa, Homo Sapiens
RIIGLKDEF

SEQ ID NO: 66865 - protein, 9 aa, Homo Sapiens
RIIHLVHRF

SEQ ID NO: 66866 - protein, 9 aa, Homo Sapiens
RIIHTGEKF

SEQ ID NO: 66867 - protein, 9 aa, Homo Sapiens
RIIKETQRL

SEQ ID NO: 66868 - protein, 9 aa, Homo Sapiens
RIIQSWEKI

SEQ ID NO: 66869 - protein, 9 aa, Homo Sapiens
RIISHFDIF

SEQ ID NO: 66870 - protein, 9 aa, Homo Sapiens
RIKELEERI

SEQ ID NO: 66871 - protein, 9 aa, Homo Sapiens
RIKELPELW

SEQ ID NO: 66872 - protein, 9 aa, Homo Sapiens
RIKNNDPKL

SEQ ID NO: 66873 - protein, 9 aa, Homo Sapiens
RILDESHSI

SEQ ID NO: 66874 - protein, 9 aa, Homo Sapiens
RILDILEYI

SEQ ID NO: 66875 - protein, 9 aa, Homo Sapiens
RILEFDYEM

SEQ ID NO: 66876 - protein, 9 aa, Homo Sapiens
RILGIIDAI

SEQ ID NO: 66877 - protein, 9 aa, Homo Sapiens
RILIEFDTL

SEQ ID NO: 66878 - protein, 9 aa, Homo Sapiens
RILQDEQYL

SEQ ID NO: 66879 - protein, 9 aa, Homo Sapiens
RILRDIETF

SEQ ID NO: 66880 - protein, 9 aa, Homo Sapiens
RILVDQQVW

SEQ ID NO: 66881 - protein, 9 aa, Homo Sapiens
RIMDPEIAL

SEQ ID NO: 66882 - protein, 9 aa, Homo Sapiens
RIMEIVDAI

SEQ ID NO: 66883 - protein, 9 aa, Homo Sapiens
RIMEVIDAI

SEQ ID NO: 66884 - protein, 9 aa, Homo Sapiens
RIMSEERSL

SEQ ID NO: 66885 - protein, 9 aa, Homo Sapiens
RIMSGESTF

SEQ ID NO: 66886 - protein, 9 aa, Homo Sapiens
RINRQLEAL

SEQ ID NO: 66887 - protein, 9 aa, Homo Sapiens
RIPQIGDKF

SEQ ID NO: 66888 - protein, 9 aa, Homo Sapiens
RIPYKDTFW

SEQ ID NO: 66889 - protein, 9 aa, Homo Sapiens
RIQAGEEKL

SEQ ID NO: 66890 - protein, 9 aa, Homo Sapiens
RIQEFEAAL

SEQ ID NO: 66891 - protein, 9 aa, Homo Sapiens
RIQELEDLL

SEQ ID NO: 66892 - protein, 9 aa, Homo Sapiens
RIQKELAEI

SEQ ID NO: 66893 - protein, 9 aa, Homo Sapiens
RISCKEELL

SEQ ID NO: 66894 - protein, 9 aa, Homo Sapiens
RISDAITHL

SEQ ID NO: 66895 - protein, 9 aa, Homo Sapiens
RISEAKEEL

SEQ ID NO: 66896 - protein, 9 aa, Homo Sapiens
RISEAYESL

SEQ ID NO: 66897 - protein, 9 aa, Homo Sapiens
RISEESTKI

SEQ ID NO: 66898 - protein, 9 aa, Homo Sapiens
RISELRLIL

SEQ ID NO: 66899 - protein, 9 aa, Homo Sapiens
RISEVFDCW

SEQ ID NO: 66900 - protein, 9 aa, Homo Sapiens
RISLEYSEL

SEQ ID NO: 66901 - protein, 9 aa, Homo Sapiens
RISLPLPNF

SEQ ID NO: 66902 - protein, 9 aa, Homo Sapiens
RISPDRVYI

SEQ ID NO: 66903 - protein, 9 aa, Homo Sapiens
RITNVQILI

SEQ ID NO: 66904 - protein, 9 aa, Homo Sapiens
RIVDVYENL

SEQ ID NO: 66905 - protein, 9 aa, Homo Sapiens
RIVEDDASI

SEQ ID NO: 66906 - protein, 9 aa, Homo Sapiens
RIVEPYIAW

SEQ ID NO: 66907 - protein, 9 aa, Homo Sapiens
RIVEPYVTW

SEQ ID NO: 66908 - protein, 9 aa, Homo Sapiens
RIVETEAYL

SEQ ID NO: 66909 - protein, 9 aa, Homo Sapiens
RIYESHVGI

SEQ ID NO: 66910 - protein, 9 aa, Homo Sapiens
RIYFGEVQL

SEQ ID NO: 66911 - protein, 9 aa, Homo Sapiens
RIYNFAHRF

SEQ ID NO: 66912 - protein, 9 aa, Homo Sapiens
RLAACVNLI

SEQ ID NO: 66913 - protein, 9 aa, Homo Sapiens
RLADELSGW

SEQ ID NO: 66914 - protein, 9 aa, Homo Sapiens
RLAEDAPNF

SEQ ID NO: 66915 - protein, 9 aa, Homo Sapiens
RLAEDKAEL

SEQ ID NO: 66916 - protein, 9 aa, Homo Sapiens
RLAEISDVW

SEQ ID NO: 66917 - protein, 9 aa, Homo Sapiens
RLAELERKL

SEQ ID NO: 66918 - protein, 9 aa, Homo Sapiens
RLAELQEQL

SEQ ID NO: 66919 - protein, 9 aa, Homo Sapiens
RLAETQEEI

SEQ ID NO: 66920 - protein, 9 aa, Homo Sapiens
RLAEVEEKL

SEQ ID NO: 66921 - protein, 9 aa, Homo Sapiens
RLAEVKDSL

SEQ ID NO: 66922 - protein, 9 aa, Homo Sapiens
RLAEVVHEL

SEQ ID NO: 66923 - protein, 9 aa, Homo Sapiens
RLAGKELRF

SEQ ID NO: 66924 - protein, 9 aa, Homo Sapiens
RLAHEIEAL

SEQ ID NO: 66925 - protein, 9 aa, Homo Sapiens
RLAHVGPRL

SEQ ID NO: 66926 - protein, 9 aa, Homo Sapiens
RLAHYIDRV

SEQ ID NO: 66927 - protein, 9 aa, Homo Sapiens
RLAKSDPMV

SEQ ID NO: 66928 - protein, 9 aa, Homo Sapiens
RLALKEDKF

SEQ ID NO: 66929 - protein, 9 aa, Homo Sapiens
RLALLQEQW

SEQ ID NO: 66930 - protein, 9 aa, Homo Sapiens
RLALVISEL

SEQ ID NO: 66931 - protein, 9 aa, Homo Sapiens
RLANPDQSL

SEQ ID NO: 66932 - protein, 9 aa, Homo Sapiens
RLAPDYDAL

SEQ ID NO: 66933 - protein, 9 aa, Homo Sapiens
RLAPTLSQL

SEQ ID NO: 66934 - protein, 9 aa, Homo Sapiens
RLAPYIIDL

SEQ ID NO: 66935 - protein, 9 aa, Homo Sapiens
RLAQEAVTL

SEQ ID NO: 66936 - protein, 9 aa, Homo Sapiens
RLAQICSSI

SEQ ID NO: 66937 - protein, 9 aa, Homo Sapiens
RLARQDPQL

SEQ ID NO: 66938 - protein, 9 aa, Homo Sapiens
RLATLNEKL

SEQ ID NO: 66939 - protein, 9 aa, Homo Sapiens
RLAVDTDTF

SEQ ID NO: 66940 - protein, 9 aa, Homo Sapiens
RLAVKAAFF

SEQ ID NO: 66941 - protein, 9 aa, Homo Sapiens
RLAVYIDRV

SEQ ID NO: 66942 - protein, 9 aa, Homo Sapiens
RLCEIFTRM

SEQ ID NO: 66943 - protein, 9 aa, Homo Sapiens
RLCPASSAW

SEQ ID NO: 66944 - protein, 9 aa, Homo Sapiens
RLCPLVEHL

SEQ ID NO: 66945 - protein, 9 aa, Homo Sapiens
RLCVLNEIL

SEQ ID NO: 66946 - protein, 9 aa, Homo Sapiens
RLDASENRL

SEQ ID NO: 66947 - protein, 9 aa, Homo Sapiens
RLDAVLQRI

SEQ ID NO: 66948 - protein, 9 aa, Homo Sapiens
RLDDAIHVL

SEQ ID NO: 66949 - protein, 9 aa, Homo Sapiens
RLDDSLLYL

SEQ ID NO: 66950 - protein, 9 aa, Homo Sapiens
RLDEAAQRL

SEQ ID NO: 66951 - protein, 9 aa, Homo Sapiens
RLDEAFDFV

SEQ ID NO: 66952 - protein, 9 aa, Homo Sapiens
RLDEARQML

SEQ ID NO: 66953 - protein, 9 aa, Homo Sapiens
RLDECEEAF

SEQ ID NO: 66954 - protein, 9 aa, Homo Sapiens
RLDELNLSW

SEQ ID NO: 66955 - protein, 9 aa, Homo Sapiens
RLDETIQAI

SEQ ID NO: 66956 - protein, 9 aa, Homo Sapiens
RLDHKFDLM

SEQ ID NO: 66957 - protein, 9 aa, Homo Sapiens
RLDHLAEKF

SEQ ID NO: 66958 - protein, 9 aa, Homo Sapiens
RLDIDPETI

SEQ ID NO: 66959 - protein, 9 aa, Homo Sapiens
RLDKTEQSL

SEQ ID NO: 66960 - protein, 9 aa, Homo Sapiens
RLDMPEVLW

SEQ ID NO: 66961 - protein, 9 aa, Homo Sapiens
RLDNEKEGF

SEQ ID NO: 66962 - protein, 9 aa, Homo Sapiens
RLDNGQVGL

SEQ ID NO: 66963 - protein, 9 aa, Homo Sapiens
RLDNITQVM

SEQ ID NO: 66964 - protein, 9 aa, Homo Sapiens
RLDPADLQL

SEQ ID NO: 66965 - protein, 9 aa, Homo Sapiens
RLDPAQRKL

SEQ ID NO: 66966 - protein, 9 aa, Homo Sapiens
RLDPHPELL

SEQ ID NO: 66967 - protein, 9 aa, Homo Sapiens
RLDPKGKSL

SEQ ID NO: 66968 - protein, 9 aa, Homo Sapiens
RLDPNVQKW

SEQ ID NO: 66969 - protein, 9 aa, Homo Sapiens
RLDPTAVNI

SEQ ID NO: 66970 - protein, 9 aa, Homo Sapiens
RLDQAEKKL

SEQ ID NO: 66971 - protein, 9 aa, Homo Sapiens
RLDQAVLDL

SEQ ID NO: 66972 - protein, 9 aa, Homo Sapiens
RLDQVEQEL

SEQ ID NO: 66973 - protein, 9 aa, Homo Sapiens
RLDRPVVGW

SEQ ID NO: 66974 - protein, 9 aa, Homo Sapiens
RLDSDEQKI

SEQ ID NO: 66975 - protein, 9 aa, Homo Sapiens
RLDSIDPAL

SEQ ID NO: 66976 - protein, 9 aa, Homo Sapiens
RLDSIEAKL

SEQ ID NO: 66977 - protein, 9 aa, Homo Sapiens
RLDTGPQSL

SEQ ID NO: 66978 - protein, 9 aa, Homo Sapiens
RLDTTLIDF

SEQ ID NO: 66979 - protein, 9 aa, Homo Sapiens
RLDVGNFSW

SEQ ID NO: 66980 - protein, 9 aa, Homo Sapiens
RLDVTSNKL

SEQ ID NO: 66981 - protein, 9 aa, Homo Sapiens
RLDVTVQSF

SEQ ID NO: 66982 - protein, 9 aa, Homo Sapiens
RLDYITAEI

SEQ ID NO: 66983 - protein, 9 aa, Homo Sapiens
RLEALAAEF

SEQ ID NO: 66984 - protein, 9 aa, Homo Sapiens
RLEATETQL

SEQ ID NO: 66985 - protein, 9 aa, Homo Sapiens
RLEAVPLEF

SEQ ID NO: 66986 - protein, 9 aa, Homo Sapiens
RLEDAFIVI

SEQ ID NO: 66987 - protein, 9 aa, Homo Sapiens
RLEDQHRLL

SEQ ID NO: 66988 - protein, 9 aa, Homo Sapiens
RLEDSSQQL

SEQ ID NO: 66989 - protein, 9 aa, Homo Sapiens
RLEEEKRML

SEQ ID NO: 66990 - protein, 9 aa, Homo Sapiens
RLEEEMRKL

SEQ ID NO: 66991 - protein, 9 aa, Homo Sapiens
RLEEGIRFL

SEQ ID NO: 66992 - protein, 9 aa, Homo Sapiens
RLEEMNINI

SEQ ID NO: 66993 - protein, 9 aa, Homo Sapiens
RLEERSSEF

SEQ ID NO: 66994 - protein, 9 aa, Homo Sapiens
RLEERSVLF

SEQ ID NO: 66995 - protein, 9 aa, Homo Sapiens
RLEESRRLW

SEQ ID NO: 66996 - protein, 9 aa, Homo Sapiens
RLEETQALL

SEQ ID NO: 66997 - protein, 9 aa, Homo Sapiens
RLEKSGDLL

SEQ ID NO: 66998 - protein, 9 aa, Homo Sapiens
RLENRYEAL

SEQ ID NO: 66999 - protein, 9 aa, Homo Sapiens
RLENTKQQL

SEQ ID NO: 67000 - protein, 9 aa, Homo Sapiens
RLENTQYLL

SEQ ID NO: 67001 - protein, 9 aa, Homo Sapiens
RLEPLVLFL

SEQ ID NO: 67002 - protein, 9 aa, Homo Sapiens
RLEQDEYAL

SEQ ID NO: 67003 - protein, 9 aa, Homo Sapiens
RLEQNQQHL

SEQ ID NO: 67004 - protein, 9 aa, Homo Sapiens
RLEVGTETI

SEQ ID NO: 67005 - protein, 9 aa, Homo Sapiens
RLFATDERF

SEQ ID NO: 67006 - protein, 9 aa, Homo Sapiens
RLFAVLEQL

SEQ ID NO: 67007 - protein, 9 aa, Homo Sapiens
RLFEGNALL

SEQ ID NO: 67008 - protein, 9 aa, Homo Sapiens
RLFEVPHEL

SEQ ID NO: 67009 - protein, 9 aa, Homo Sapiens
RLFGAVVRW

SEQ ID NO: 67010 - protein, 9 aa, Homo Sapiens
RLFKDQLVY

SEQ ID NO: 67011 - protein, 9 aa, Homo Sapiens
RLFKNDPLF

SEQ ID NO: 67012 - protein, 9 aa, Homo Sapiens
RLFKNQEDL

SEQ ID NO: 67013 - protein, 9 aa, Homo Sapiens
RLFLDGDQL

SEQ ID NO: 67014 - protein, 9 aa, Homo Sapiens
RLFLDSNGL

SEQ ID NO: 67015 - protein, 9 aa, Homo Sapiens
RLFLEQFSI

SEQ ID NO: 67016 - protein, 9 aa, Homo Sapiens
RLFNAVVRW

SEQ ID NO: 67017 - protein, 9 aa, Homo Sapiens
RLFNEQNFF

SEQ ID NO: 67018 - protein, 9 aa, Homo Sapiens
RLFPGSSFL

SEQ ID NO: 67019 - protein, 9 aa, Homo Sapiens
RLFQENSVL

SEQ ID NO: 67020 - protein, 9 aa, Homo Sapiens
RLFQKTLKL

SEQ ID NO: 67021 - protein, 9 aa, Homo Sapiens
RLFQTEEKI

SEQ ID NO: 67022 - protein, 9 aa, Homo Sapiens
RLFRDLVSL

SEQ ID NO: 67023 - protein, 9 aa, Homo Sapiens
RLFSKYQYF

SEQ ID NO: 67024 - protein, 9 aa, Homo Sapiens
RLFVGEPVW

SEQ ID NO: 67025 - protein, 9 aa, Homo Sapiens
RLGPPEPMM

SEQ ID NO: 67026 - protein, 9 aa, Homo Sapiens
RLGPSVVGL

SEQ ID NO: 67027 - protein, 9 aa, Homo Sapiens
RLGSLVDEF

SEQ ID NO: 67028 - protein, 9 aa, Homo Sapiens
RLGTFETQI

SEQ ID NO: 67029 - protein, 9 aa, Homo Sapiens
RLGYFDDAL

SEQ ID NO: 67030 - protein, 9 aa, Homo Sapiens
RLHCESESF

SEQ ID NO: 67031 - protein, 9 aa, Homo Sapiens
RLHEKGVLL

SEQ ID NO: 67032 - protein, 9 aa, Homo Sapiens
RLHEKVNII

SEQ ID NO: 67033 - protein, 9 aa, Homo Sapiens
RLHGLPEQF

SEQ ID NO: 67034 - protein, 9 aa, Homo Sapiens
RLHSGEVKF

SEQ ID NO: 67035 - protein, 9 aa, Homo Sapiens
RLIAKEMNI

SEQ ID NO: 67036 - protein, 9 aa, Homo Sapiens
RLIAQRYLL

SEQ ID NO: 67037 - protein, 9 aa, Homo Sapiens
RLIDHDPCL

SEQ ID NO: 67038 - protein, 9 aa, Homo Sapiens
RLIEDTEDW

SEQ ID NO: 67039 - protein, 9 aa, Homo Sapiens
RLIEEENML

SEQ ID NO: 67040 - protein, 9 aa, Homo Sapiens
RLIEESVTV

SEQ ID NO: 67041 - protein, 9 aa, Homo Sapiens
RLIEETISI

SEQ ID NO: 67042 - protein, 9 aa, Homo Sapiens
RLIELDESF

SEQ ID NO: 67043 - protein, 9 aa, Homo Sapiens
RLIEQEEYL

SEQ ID NO: 67044 - protein, 9 aa, Homo Sapiens
RLIESLFTI

SEQ ID NO: 67045 - protein, 9 aa, Homo Sapiens
RLIGHQEAF

SEQ ID NO: 67046 - protein, 9 aa, Homo Sapiens
RLIKDTLAL

SEQ ID NO: 67047 - protein, 9 aa, Homo Sapiens
RLIKSFEKV

SEQ ID NO: 67048 - protein, 9 aa, Homo Sapiens
RLILIESRI

SEQ ID NO: 67049 - protein, 9 aa, Homo Sapiens
RLINQVLEL

SEQ ID NO: 67050 - protein, 9 aa, Homo Sapiens
RLINTQAIF

SEQ ID NO: 67051 - protein, 9 aa, Homo Sapiens
RLIPERTVW

SEQ ID NO: 67052 - protein, 9 aa, Homo Sapiens
RLIPTLVSI

SEQ ID NO: 67053 - protein, 9 aa, Homo Sapiens
RLIQETEVI

SEQ ID NO: 67054 - protein, 9 aa, Homo Sapiens
RLIRIFEKL

SEQ ID NO: 67055 - protein, 9 aa, Homo Sapiens
RLIVDVIRF

SEQ ID NO: 67056 - protein, 9 aa, Homo Sapiens
RLIVLFSHW

SEQ ID NO: 67057 - protein, 9 aa, Homo Sapiens
RLKEKEDAL

SEQ ID NO: 67058 - protein, 9 aa, Homo Sapiens
RLKQDYLRI

SEQ ID NO: 67059 - protein, 9 aa, Homo Sapiens
RLLDLHQSW

SEQ ID NO: 67060 - protein, 9 aa, Homo Sapiens
RLLDSEIKI

SEQ ID NO: 67061 - protein, 9 aa, Homo Sapiens
RLLDYVVNI

SEQ ID NO: 67062 - protein, 9 aa, Homo Sapiens
RLLEEHAKL

SEQ ID NO: 67063 - protein, 9 aa, Homo Sapiens
RLLEEIHAM

SEQ ID NO: 67064 - protein, 9 aa, Homo Sapiens
RLLEENDQL

SEQ ID NO: 67065 - protein, 9 aa, Homo Sapiens
RLLELIEGF

SEQ ID NO: 67066 - protein, 9 aa, Homo Sapiens
RLLEQEKSL

SEQ ID NO: 67067 - protein, 9 aa, Homo Sapiens
RLLESFETM

SEQ ID NO: 67068 - protein, 9 aa, Homo Sapiens
RLLFLKDVL

SEQ ID NO: 67069 - protein, 9 aa, Homo Sapiens
RLLKSKLYL

SEQ ID NO: 67070 - protein, 9 aa, Homo Sapiens
RLLLDHEAL

SEQ ID NO: 67071 - protein, 9 aa, Homo Sapiens
RLLLLPLLL

SEQ ID NO: 67072 - protein, 9 aa, Homo Sapiens
RLLNFDTEL

SEQ ID NO: 67073 - protein, 9 aa, Homo Sapiens
RLLPEKLTI

SEQ ID NO: 67074 - protein, 9 aa, Homo Sapiens
RLLPESWGF

SEQ ID NO: 67075 - protein, 9 aa, Homo Sapiens
RLLQDKEGL

SEQ ID NO: 67076 - protein, 9 aa, Homo Sapiens
RLLQEQHQL

SEQ ID NO: 67077 - protein, 9 aa, Homo Sapiens
RLLQETLYM

SEQ ID NO: 67078 - protein, 9 aa, Homo Sapiens
RLLQRDVQI

SEQ ID NO: 67079 - protein, 9 aa, Homo Sapiens
RLLSIKEAF

SEQ ID NO: 67080 - protein, 9 aa, Homo Sapiens
RLLSSFDFF

SEQ ID NO: 67081 - protein, 9 aa, Homo Sapiens
RLMEEKEKL

SEQ ID NO: 67082 - protein, 9 aa, Homo Sapiens
RLMEICESL

SEQ ID NO: 67083 - protein, 9 aa, Homo Sapiens
RLMFEYQTL

SEQ ID NO: 67084 - protein, 9 aa, Homo Sapiens
RLMKEKQRL

SEQ ID NO: 67085 - protein, 9 aa, Homo Sapiens
RLMKELEEI

SEQ ID NO: 67086 - protein, 9 aa, Homo Sapiens
RLMQCVSSF

SEQ ID NO: 67087 - protein, 9 aa, Homo Sapiens
RLMQVGEEF

SEQ ID NO: 67088 - protein, 9 aa, Homo Sapiens
RLNDGNEYL

SEQ ID NO: 67089 - protein, 9 aa, Homo Sapiens
RLNEDFDHF

SEQ ID NO: 67090 - protein, 9 aa, Homo Sapiens
RLNELMSQI

SEQ ID NO: 67091 - protein, 9 aa, Homo Sapiens
RLNKHEENL

SEQ ID NO: 67092 - protein, 9 aa, Homo Sapiens
RLNKVISEL

SEQ ID NO: 67093 - protein, 9 aa, Homo Sapiens
RLNPLVLLL

SEQ ID NO: 67094 - protein, 9 aa, Homo Sapiens
RLNRIENAL

SEQ ID NO: 67095 - protein, 9 aa, Homo Sapiens
RLNSAPDMR

SEQ ID NO: 67096 - protein, 9 aa, Homo Sapiens
RLNVEFALI

SEQ ID NO: 67097 - protein, 9 aa, Homo Sapiens
RLNVLREYL

SEQ ID NO: 67098 - protein, 9 aa, Homo Sapiens
RLPCYFENL

SEQ ID NO: 67099 - protein, 9 aa, Homo Sapiens
RLPDMEMVI

SEQ ID NO: 67100 - protein, 9 aa, Homo Sapiens
RLPEEEHEF

SEQ ID NO: 67101 - protein, 9 aa, Homo Sapiens
RLPEEWSQW

SEQ ID NO: 67102 - protein, 9 aa, Homo Sapiens
RLPGEAQKI

SEQ ID NO: 67103 - protein, 9 aa, Homo Sapiens
RLPIEDPYL

SEQ ID NO: 67104 - protein, 9 aa, Homo Sapiens
RLPKDFVDL

SEQ ID NO: 67105 - protein, 9 aa, Homo Sapiens
RLPQYDFVF

SEQ ID NO: 67106 - protein, 9 aa, Homo Sapiens
RLQAEAQEL

SEQ ID NO: 67107 - protein, 9 aa, Homo Sapiens
RLQAEAQQL

SEQ ID NO: 67108 - protein, 9 aa, Homo Sapiens
RLQALDTGW

SEQ ID NO: 67109 - protein, 9 aa, Homo Sapiens
RLQDFKDCI

SEQ ID NO: 67110 - protein, 9 aa, Homo Sapiens
RLQDFKLDF

SEQ ID NO: 67111 - protein, 9 aa, Homo Sapiens
RLQDIEERI

SEQ ID NO: 67112 - protein, 9 aa, Homo Sapiens
RLQDLKDRL

SEQ ID NO: 67113 - protein, 9 aa, Homo Sapiens
RLQEASQTI

SEQ ID NO: 67114 - protein, 9 aa, Homo Sapiens
RLQEESEVL

SEQ ID NO: 67115 - protein, 9 aa, Homo Sapiens
RLQEGNESL

SEQ ID NO: 67116 - protein, 9 aa, Homo Sapiens
RLQESFDTI

SEQ ID NO: 67117 - protein, 9 aa, Homo Sapiens
RLQHLAESW

SEQ ID NO: 67118 - protein, 9 aa, Homo Sapiens
RLQIEIGKL

SEQ ID NO: 67119 - protein, 9 aa, Homo Sapiens
RLQIEKERL

SEQ ID NO: 67120 - protein, 9 aa, Homo Sapiens
RLQIEREKL

SEQ ID NO: 67121 - protein, 9 aa, Homo Sapiens
RLQKEQEKL

SEQ ID NO: 67122 - protein, 9 aa, Homo Sapiens
RLQLEKAAW

SEQ ID NO: 67123 - protein, 9 aa, Homo Sapiens
RLQNIEAHL

SEQ ID NO: 67124 - protein, 9 aa, Homo Sapiens
RLQQDKVLI

SEQ ID NO: 67125 - protein, 9 aa, Homo Sapiens
RLQQEETQL

SEQ ID NO: 67126 - protein, 9 aa, Homo Sapiens
RLQQELMTL

SEQ ID NO: 67127 - protein, 9 aa, Homo Sapiens
RLQQMSERF

SEQ ID NO: 67128 - protein, 9 aa, Homo Sapiens
RLQSGVNTL

SEQ ID NO: 67129 - protein, 9 aa, Homo Sapiens
RLQSKVLKL

SEQ ID NO: 67130 - protein, 9 aa, Homo Sapiens
RLQSTSERL

SEQ ID NO: 67131 - protein, 9 aa, Homo Sapiens
RLQTSEAAL

SEQ ID NO: 67132 - protein, 9 aa, Homo Sapiens
RLQVACDLL

SEQ ID NO: 67133 - protein, 9 aa, Homo Sapiens
RLQVEKERL

SEQ ID NO: 67134 - protein, 9 aa, Homo Sapiens
RLREVSEKL

SEQ ID NO: 67135 - protein, 9 aa, Homo Sapiens
RLRQERESL

SEQ ID NO: 67136 - protein, 9 aa, Homo Sapiens
RLSAQDPVV

SEQ ID NO: 67137 - protein, 9 aa, Homo Sapiens
RLSDLLTDF

SEQ ID NO: 67138 - protein, 9 aa, Homo Sapiens
RLSEEEQRL

SEQ ID NO: 67139 - protein, 9 aa, Homo Sapiens
RLSEVQASL

SEQ ID NO: 67140 - protein, 9 aa, Homo Sapiens
RLSFCQELW

SEQ ID NO: 67141 - protein, 9 aa, Homo Sapiens
RLSFLVSYI

SEQ ID NO: 67142 - protein, 9 aa, Homo Sapiens
RLSGIEERY

SEQ ID NO: 67143 - protein, 9 aa, Homo Sapiens
RLSGKILHI

SEQ ID NO: 67144 - protein, 9 aa, Homo Sapiens
RLSHSQERL

SEQ ID NO: 67145 - protein, 9 aa, Homo Sapiens
RLSITNETF

SEQ ID NO: 67146 - protein, 9 aa, Homo Sapiens
RLSKEETVL

SEQ ID NO: 67147 - protein, 9 aa, Homo Sapiens
RLSKEYDQL

SEQ ID NO: 67148 - protein, 9 aa, Homo Sapiens
RLSLTYERL

SEQ ID NO: 67149 - protein, 9 aa, Homo Sapiens
RLSNKVEAI

SEQ ID NO: 67150 - protein, 9 aa, Homo Sapiens
RLSPIENFL

SEQ ID NO: 67151 - protein, 9 aa, Homo Sapiens
RLSPNEEAF

SEQ ID NO: 67152 - protein, 9 aa, Homo Sapiens
RLSPVSPAL

SEQ ID NO: 67153 - protein, 9 aa, Homo Sapiens
RLSQECEKL

SEQ ID NO: 67154 - protein, 9 aa, Homo Sapiens
RLSQIKEKM

SEQ ID NO: 67155 - protein, 9 aa, Homo Sapiens
RLSQVSDSV

SEQ ID NO: 67156 - protein, 9 aa, Homo Sapiens
RLSSDTTLM

SEQ ID NO: 67157 - protein, 9 aa, Homo Sapiens
RLSSIKTRF

SEQ ID NO: 67158 - protein, 9 aa, Homo Sapiens
RLSTLIEFL

SEQ ID NO: 67159 - protein, 9 aa, Homo Sapiens
RLSTMQDSL

SEQ ID NO: 67160 - protein, 9 aa, Homo Sapiens
RLSVEKATI

SEQ ID NO: 67161 - protein, 9 aa, Homo Sapiens
RLSVLVDEF

SEQ ID NO: 67162 - protein, 9 aa, Homo Sapiens
RLSVSTETL

SEQ ID NO: 67163 - protein, 9 aa, Homo Sapiens
RLSYVGNNF

SEQ ID NO: 67164 - protein, 9 aa, Homo Sapiens
RLTEICTKI

SEQ ID NO: 67165 - protein, 9 aa, Homo Sapiens
RLTEIGPRM

SEQ ID NO: 67166 - protein, 9 aa, Homo Sapiens
RLTGVNDKM

SEQ ID NO: 67167 - protein, 9 aa, Homo Sapiens
RLTHLIDHL

SEQ ID NO: 67168 - protein, 9 aa, Homo Sapiens
RLTKLQDNL

SEQ ID NO: 67169 - protein, 9 aa, Homo Sapiens
RLTNHQELW

SEQ ID NO: 67170 - protein, 9 aa, Homo Sapiens
RLTTSTSTF

SEQ ID NO: 67171 - protein, 9 aa, Homo Sapiens
RLVDTGDKF

SEQ ID NO: 67172 - protein, 9 aa, Homo Sapiens
RLVEGLDQF

SEQ ID NO: 67173 - protein, 9 aa, Homo Sapiens
RLVEREAGL

SEQ ID NO: 67174 - protein, 9 aa, Homo Sapiens
RLVGKETSI

SEQ ID NO: 67175 - protein, 9 aa, Homo Sapiens
RLVGSQEEL

SEQ ID NO: 67176 - protein, 9 aa, Homo Sapiens
RLVHHDDCL

SEQ ID NO: 67177 - protein, 9 aa, Homo Sapiens
RLVKDQEAL

SEQ ID NO: 67178 - protein, 9 aa, Homo Sapiens
RLVKEYTVL

SEQ ID NO: 67179 - protein, 9 aa, Homo Sapiens
RLVLDPYLL

SEQ ID NO: 67180 - protein, 9 aa, Homo Sapiens
RLVNWSCTL

SEQ ID NO: 67181 - protein, 9 aa, Homo Sapiens
RLVRSDVAM

SEQ ID NO: 67182 - protein, 9 aa, Homo Sapiens
RLVSSDPEI

SEQ ID NO: 67183 - protein, 9 aa, Homo Sapiens
RLVSSEQAL

SEQ ID NO: 67184 - protein, 9 aa, Homo Sapiens
RLVSWVNLI

SEQ ID NO: 67185 - protein, 9 aa, Homo Sapiens
RLVVTADDF

SEQ ID NO: 67186 - protein, 9 aa, Homo Sapiens
RLVYLNEAW

SEQ ID NO: 67187 - protein, 9 aa, Homo Sapiens
RLWGLTEMF

SEQ ID NO: 67188 - protein, 9 aa, Homo Sapiens
RLWKDEPTM

SEQ ID NO: 67189 - protein, 9 aa, Homo Sapiens
RLYFAETVL

SEQ ID NO: 67190 - protein, 9 aa, Homo Sapiens
RLYFDEISF

SEQ ID NO: 67191 - protein, 9 aa, Homo Sapiens
RLYHELVGL

SEQ ID NO: 67192 - protein, 9 aa, Homo Sapiens
RLYKDDQLL

SEQ ID NO: 67193 - protein, 9 aa, Homo Sapiens
RLYKYDHNF

SEQ ID NO: 67194 - protein, 9 aa, Homo Sapiens
RLYPLAIQI

SEQ ID NO: 67195 - protein, 9 aa, Homo Sapiens
RLYQECEKL

SEQ ID NO: 67196 - protein, 9 aa, Homo Sapiens
RLYQVEYAF

SEQ ID NO: 67197 - protein, 9 aa, Homo Sapiens
RLYSVSYLL

SEQ ID NO: 67198 - protein, 9 aa, Homo Sapiens
RMADSGESL

SEQ ID NO: 67199 - protein, 9 aa, Homo Sapiens
RMAPDYDHL

SEQ ID NO: 67200 - protein, 9 aa, Homo Sapiens
RMCTLIDKF

SEQ ID NO: 67201 - protein, 9 aa, Homo Sapiens
RMDAGEVTL

SEQ ID NO: 67202 - protein, 9 aa, Homo Sapiens
RMDEEFTKI

SEQ ID NO: 67203 - protein, 9 aa, Homo Sapiens
RMDELFVLI

SEQ ID NO: 67204 - protein, 9 aa, Homo Sapiens
RMDFEDLGL

SEQ ID NO: 67205 - protein, 9 aa, Homo Sapiens
RMDKLGRTI

SEQ ID NO: 67206 - protein, 9 aa, Homo Sapiens
RMDSGLDKF

SEQ ID NO: 67207 - protein, 9 aa, Homo Sapiens
RMDYEDDRL

SEQ ID NO: 67208 - protein, 9 aa, Homo Sapiens
RMEDIKILI

SEQ ID NO: 67209 - protein, 9 aa, Homo Sapiens
RMEDRLDRL

SEQ ID NO: 67210 - protein, 9 aa, Homo Sapiens
RMEEEQHHW

SEQ ID NO: 67211 - protein, 9 aa, Homo Sapiens
RMEKGEPYM

SEQ ID NO: 67212 - protein, 9 aa, Homo Sapiens
RMEKLNQLW

SEQ ID NO: 67213 - protein, 9 aa, Homo Sapiens
RMESSINHI

SEQ ID NO: 67214 - protein, 9 aa, Homo Sapiens
RMFLENETW

SEQ ID NO: 67215 - protein, 9 aa, Homo Sapiens
RMFPGEVAL

SEQ ID NO: 67216 - protein, 9 aa, Homo Sapiens
RMHQAIERF

SEQ ID NO: 67217 - protein, 9 aa, Homo Sapiens
RMIDIQTRM

SEQ ID NO: 67218 - protein, 9 aa, Homo Sapiens
RMIEVEQKL

SEQ ID NO: 67219 - protein, 9 aa, Homo Sapiens
RMIEVQDEL

SEQ ID NO: 67220 - protein, 9 aa, Homo Sapiens
RMIQIQENM

SEQ ID NO: 67221 - protein, 9 aa, Homo Sapiens
RMITETEKF

SEQ ID NO: 67222 - protein, 9 aa, Homo Sapiens
RMLDSVEKL

SEQ ID NO: 67223 - protein, 9 aa, Homo Sapiens
RMLIALDKW

SEQ ID NO: 67224 - protein, 9 aa, Homo Sapiens
RMNALFVQF

SEQ ID NO: 67225 - protein, 9 aa, Homo Sapiens
RMNEVISLW

SEQ ID NO: 67226 - protein, 9 aa, Homo Sapiens
RMNGFIDQI

SEQ ID NO: 67227 - protein, 9 aa, Homo Sapiens
RMNQEIVNL

SEQ ID NO: 67228 - protein, 9 aa, Homo Sapiens
RMNVLADAL

SEQ ID NO: 67229 - protein, 9 aa, Homo Sapiens
RMPEEDNKI

SEQ ID NO: 67230 - protein, 9 aa, Homo Sapiens
RMQGQEAVL

SEQ ID NO: 67231 - protein, 9 aa, Homo Sapiens
RMQKEITAL

SEQ ID NO: 67232 - protein, 9 aa, Homo Sapiens
RMSDDVHSL

SEQ ID NO: 67233 - protein, 9 aa, Homo Sapiens
RMSLVEPQI

SEQ ID NO: 67234 - protein, 9 aa, Homo Sapiens
RMSSFGDFV

SEQ ID NO: 67235 - protein, 9 aa, Homo Sapiens
RMTEDALRL

SEQ ID NO: 67236 - protein, 9 aa, Homo Sapiens
RMVEIGSRW

SEQ ID NO: 67237 - protein, 9 aa, Homo Sapiens
RMVKTYEKL

SEQ ID NO: 67238 - protein, 9 aa, Homo Sapiens
RMVNDAEKF

SEQ ID NO: 67239 - protein, 9 aa, Homo Sapiens
RMVVTGDNV

SEQ ID NO: 67240 - protein, 9 aa, Homo Sapiens
RMYELVHRM

SEQ ID NO: 67241 - protein, 9 aa, Homo Sapiens
RQAAEDKSW

SEQ ID NO: 67242 - protein, 9 aa, Homo Sapiens
RQAAEEIRI

SEQ ID NO: 67243 - protein, 9 aa, Homo Sapiens
RQADCKMKL

SEQ ID NO: 67244 - protein, 9 aa, Homo Sapiens
RQADFVQVL

SEQ ID NO: 67245 - protein, 9 aa, Homo Sapiens
RQADKVWRL

SEQ ID NO: 67246 - protein, 9 aa, Homo Sapiens
RQAEETVDF

SEQ ID NO: 67247 - protein, 9 aa, Homo Sapiens
RQAEMLDDL

SEQ ID NO: 67248 - protein, 9 aa, Homo Sapiens
RQAFHMEQL

SEQ ID NO: 67249 - protein, 9 aa, Homo Sapiens
RQAHMQARF

SEQ ID NO: 67250 - protein, 9 aa, Homo Sapiens
RQAIHEPKL

SEQ ID NO: 67251 - protein, 9 aa, Homo Sapiens
RQAKEERTF

SEQ ID NO: 67252 - protein, 9 aa, Homo Sapiens
RQALATDEL

SEQ ID NO: 67253 - protein, 9 aa, Homo Sapiens
RQALFGDHV

SEQ ID NO: 67254 - protein, 9 aa, Homo Sapiens
RQALGVSLF

SEQ ID NO: 67255 - protein, 9 aa, Homo Sapiens
RQALPQVRL

SEQ ID NO: 67256 - protein, 9 aa, Homo Sapiens
RQANNINML

SEQ ID NO: 67257 - protein, 9 aa, Homo Sapiens
RQAPPHIEL

SEQ ID NO: 67258 - protein, 9 aa, Homo Sapiens
RQAQAEDAL

SEQ ID NO: 67259 - protein, 9 aa, Homo Sapiens
RQAQVAEKL

SEQ ID NO: 67260 - protein, 9 aa, Homo Sapiens
RQASPNIVI

SEQ ID NO: 67261 - protein, 9 aa, Homo Sapiens
RQDALVCFL

SEQ ID NO: 67262 - protein, 9 aa, Homo Sapiens
RQDAQQEDF

SEQ ID NO: 67263 - protein, 9 aa, Homo Sapiens
RQDAVHAIL

SEQ ID NO: 67264 - protein, 9 aa, Homo Sapiens
RQDESIQRI

SEQ ID NO: 67265 - protein, 9 aa, Homo Sapiens
RQDFSPEEL

SEQ ID NO: 67266 - protein, 9 aa, Homo Sapiens
RQDGSVNFF

SEQ ID NO: 67267 - protein, 9 aa, Homo Sapiens
RQDGVLQDW

SEQ ID NO: 67268 - protein, 9 aa, Homo Sapiens
RQDIDQAKI

SEQ ID NO: 67269 - protein, 9 aa, Homo Sapiens
RQDIDTQKI

SEQ ID NO: 67270 - protein, 9 aa, Homo Sapiens
RQDIFQEQL

SEQ ID NO: 67271 - protein, 9 aa, Homo Sapiens
RQDINKEHL

SEQ ID NO: 67272 - protein, 9 aa, Homo Sapiens
RQDISVHKL

SEQ ID NO: 67273 - protein, 9 aa, Homo Sapiens
RQDKLKVHM

SEQ ID NO: 67274 - protein, 9 aa, Homo Sapiens
RQDLERVMI

SEQ ID NO: 67275 - protein, 9 aa, Homo Sapiens
RQDLTQSLI

SEQ ID NO: 67276 - protein, 9 aa, Homo Sapiens
RQDLTTLDV

SEQ ID NO: 67277 - protein, 9 aa, Homo Sapiens
RQDNERVLF

SEQ ID NO: 67278 - protein, 9 aa, Homo Sapiens
RQDNKCLEL

SEQ ID NO: 67279 - protein, 9 aa, Homo Sapiens
RQDNSILKV

SEQ ID NO: 67280 - protein, 9 aa, Homo Sapiens
RQDPDKQLM

SEQ ID NO: 67281 - protein, 9 aa, Homo Sapiens
RQDPFTVHM

SEQ ID NO: 67282 - protein, 9 aa, Homo Sapiens
RQDPGTELL

SEQ ID NO: 67283 - protein, 9 aa, Homo Sapiens
RQDQIHSSI

SEQ ID NO: 67284 - protein, 9 aa, Homo Sapiens
RQDQIQQVV

SEQ ID NO: 67285 - protein, 9 aa, Homo Sapiens
RQDQRVEQL

SEQ ID NO: 67286 - protein, 9 aa, Homo Sapiens
RQDQSIILL

SEQ ID NO: 67287 - protein, 9 aa, Homo Sapiens
RQDRDALHM

SEQ ID NO: 67288 - protein, 9 aa, Homo Sapiens
RQDSINLFL

SEQ ID NO: 67289 - protein, 9 aa, Homo Sapiens
RQDSIPAFL

SEQ ID NO: 67290 - protein, 9 aa, Homo Sapiens
RQDTVRSFL

SEQ ID NO: 67291 - protein, 9 aa, Homo Sapiens
RQDVATNLL

SEQ ID NO: 67292 - protein, 9 aa, Homo Sapiens
RQDVDNASL

SEQ ID NO: 67293 - protein, 9 aa, Homo Sapiens
RQDVESCYF

SEQ ID NO: 67294 - protein, 9 aa, Homo Sapiens
RQEAIDWLL

SEQ ID NO: 67295 - protein, 9 aa, Homo Sapiens
RQEATVNYL

SEQ ID NO: 67296 - protein, 9 aa, Homo Sapiens
RQEAYLEAL

SEQ ID NO: 67297 - protein, 9 aa, Homo Sapiens
RQEDDKLFL

SEQ ID NO: 67298 - protein, 9 aa, Homo Sapiens
RQEDLIMKV

SEQ ID NO: 67299 - protein, 9 aa, Homo Sapiens
RQEEGVFGF

SEQ ID NO: 67300 - protein, 9 aa, Homo Sapiens
RQEELRVYL

SEQ ID NO: 67301 - protein, 9 aa, Homo Sapiens
RQEGAKVSL

SEQ ID NO: 67302 - protein, 9 aa, Homo Sapiens
RQEGHSQGF

SEQ ID NO: 67303 - protein, 9 aa, Homo Sapiens
RQEGVPRTF

SEQ ID NO: 67304 - protein, 9 aa, Homo Sapiens
RQEGWIHHL

SEQ ID NO: 67305 - protein, 9 aa, Homo Sapiens
RQEISFGKL

SEQ ID NO: 67306 - protein, 9 aa, Homo Sapiens
RQEKEITKL

SEQ ID NO: 67307 - protein, 9 aa, Homo Sapiens
RQEKMNEKI

SEQ ID NO: 67308 - protein, 9 aa, Homo Sapiens
RQELTYQEL

SEQ ID NO: 67309 - protein, 9 aa, Homo Sapiens
RQELYVEDF

SEQ ID NO: 67310 - protein, 9 aa, Homo Sapiens
RQENGASVI

SEQ ID NO: 67311 - protein, 9 aa, Homo Sapiens
RQENMVLKL

SEQ ID NO: 67312 - protein, 9 aa, Homo Sapiens
RQEPVQPLL

SEQ ID NO: 67313 - protein, 9 aa, Homo Sapiens
RQESSVRLW

SEQ ID NO: 67314 - protein, 9 aa, Homo Sapiens
RQETKEAQL

SEQ ID NO: 67315 - protein, 9 aa, Homo Sapiens
RQEVDNTFW

SEQ ID NO: 67316 - protein, 9 aa, Homo Sapiens
RQFDVDILI

SEQ ID NO: 67317 - protein, 9 aa, Homo Sapiens
RQFEGLMRF

SEQ ID NO: 67318 - protein, 9 aa, Homo Sapiens
RQFEIERDL

SEQ ID NO: 67319 - protein, 9 aa, Homo Sapiens
RQFGKKHLF

SEQ ID NO: 67320 - protein, 9 aa, Homo Sapiens
RQFKEIAAV

SEQ ID NO: 67321 - protein, 9 aa, Homo Sapiens
RQFLNRDDI

SEQ ID NO: 67322 - protein, 9 aa, Homo Sapiens
RQFMAETQF

SEQ ID NO: 67323 - protein, 9 aa, Homo Sapiens
RQFPFHEMF

SEQ ID NO: 67324 - protein, 9 aa, Homo Sapiens
RQFPGSHRV

SEQ ID NO: 67325 - protein, 9 aa, Homo Sapiens
RQFPTAFEF

SEQ ID NO: 67326 - protein, 9 aa, Homo Sapiens
RQFPVTVHF

SEQ ID NO: 67327 - protein, 9 aa, Homo Sapiens
RQFQELNEL

SEQ ID NO: 67328 - protein, 9 aa, Homo Sapiens
RQFSTPFQL

SEQ ID NO: 67329 - protein, 9 aa, Homo Sapiens
RQFYEEELI

SEQ ID NO: 67330 - protein, 9 aa, Homo Sapiens
RQGDLEPKF

SEQ ID NO: 67331 - protein, 9 aa, Homo Sapiens
RQGDQDVSL

SEQ ID NO: 67332 - protein, 9 aa, Homo Sapiens
RQGEVVQRL

SEQ ID NO: 67333 - protein, 9 aa, Homo Sapiens
RQGIPNESW

SEQ ID NO: 67334 - protein, 9 aa, Homo Sapiens
RQGKAKLVI

SEQ ID NO: 67335 - protein, 9 aa, Homo Sapiens
RQGKVEDKW

SEQ ID NO: 67336 - protein, 9 aa, Homo Sapiens
RQGPEESGL

SEQ ID NO: 67337 - protein, 9 aa, Homo Sapiens
RQGQIEVSI

SEQ ID NO: 67338 - protein, 9 aa, Homo Sapiens
RQGRTLYGF

SEQ ID NO: 67339 - protein, 9 aa, Homo Sapiens
RQHAEHIFL

SEQ ID NO: 67340 - protein, 9 aa, Homo Sapiens
RQHAYEHSL

SEQ ID NO: 67341 - protein, 9 aa, Homo Sapiens
RQHEDFVWL

SEQ ID NO: 67342 - protein, 9 aa, Homo Sapiens
RQHEEPESF

SEQ ID NO: 67343 - protein, 9 aa, Homo Sapiens
RQHEIVLKV

SEQ ID NO: 67344 - protein, 9 aa, Homo Sapiens
RQHEKTHWL

SEQ ID NO: 67345 - protein, 9 aa, Homo Sapiens
RQHFSPLSL

SEQ ID NO: 67346 - protein, 9 aa, Homo Sapiens
RQHLQEVGL

SEQ ID NO: 67347 - protein, 9 aa, Homo Sapiens
RQHNTEIRM

SEQ ID NO: 67348 - protein, 9 aa, Homo Sapiens
RQHNWPLTM

SEQ ID NO: 67349 - protein, 9 aa, Homo Sapiens
RQHNYTEAF

SEQ ID NO: 67350 - protein, 9 aa, Homo Sapiens
RQHSALTRL

SEQ ID NO: 67351 - protein, 9 aa, Homo Sapiens
RQHTQIVRL

SEQ ID NO: 67352 - protein, 9 aa, Homo Sapiens
RQHVEFDML

SEQ ID NO: 67353 - protein, 9 aa, Homo Sapiens
RQHVIDVQI

SEQ ID NO: 67354 - protein, 9 aa, Homo Sapiens
RQHWTMTKI

SEQ ID NO: 67355 - protein, 9 aa, Homo Sapiens
RQIDEQQKL

SEQ ID NO: 67356 - protein, 9 aa, Homo Sapiens
RQIDQFLVV

SEQ ID NO: 67357 - protein, 9 aa, Homo Sapiens
RQIEYEYKL

SEQ ID NO: 67358 - protein, 9 aa, Homo Sapiens
RQIGSVDTF

SEQ ID NO: 67359 - protein, 9 aa, Homo Sapiens
RQIGVEHVV

SEQ ID NO: 67360 - protein, 9 aa, Homo Sapiens
RQIHKFEEL

SEQ ID NO: 67361 - protein, 9 aa, Homo Sapiens
RQIITDHRW

SEQ ID NO: 67362 - protein, 9 aa, Homo Sapiens
RQIKDRVTM

SEQ ID NO: 67363 - protein, 9 aa, Homo Sapiens
RQIKDTVTM

SEQ ID NO: 67364 - protein, 9 aa, Homo Sapiens
RQIKEPVKF

SEQ ID NO: 67365 - protein, 9 aa, Homo Sapiens
RQIKNFHKL

SEQ ID NO: 67366 - protein, 9 aa, Homo Sapiens
RQILEGVHF

SEQ ID NO: 67367 - protein, 9 aa, Homo Sapiens
RQIQESVTF

SEQ ID NO: 67368 - protein, 9 aa, Homo Sapiens
RQIQVMEKL

SEQ ID NO: 67369 - protein, 9 aa, Homo Sapiens
RQISQDVKL

SEQ ID NO: 67370 - protein, 9 aa, Homo Sapiens
RQITQVYGF

SEQ ID NO: 67371 - protein, 9 aa, Homo Sapiens
RQKAIEEFF

SEQ ID NO: 67372 - protein, 9 aa, Homo Sapiens
RQLAEEILM

SEQ ID NO: 67373 - protein, 9 aa, Homo Sapiens
RQLAKIHAI

SEQ ID NO: 67374 - protein, 9 aa, Homo Sapiens
RQLALAEKF

SEQ ID NO: 67375 - protein, 9 aa, Homo Sapiens
RQLDTETNL

SEQ ID NO: 67376 - protein, 9 aa, Homo Sapiens
RQLDTVNFF

SEQ ID NO: 67377 - protein, 9 aa, Homo Sapiens
RQLEAIVRI

SEQ ID NO: 67378 - protein, 9 aa, Homo Sapiens
RQLEEARQI

SEQ ID NO: 67379 - protein, 9 aa, Homo Sapiens
RQLEEEQKL

SEQ ID NO: 67380 - protein, 9 aa, Homo Sapiens
RQLEEKEKL

SEQ ID NO: 67381 - protein, 9 aa, Homo Sapiens
RQLESMIRL

SEQ ID NO: 67382 - protein, 9 aa, Homo Sapiens
RQLFKDYEI

SEQ ID NO: 67383 - protein, 9 aa, Homo Sapiens
RQLIIRDIL

SEQ ID NO: 67384 - protein, 9 aa, Homo Sapiens
RQLIQESKF

SEQ ID NO: 67385 - protein, 9 aa, Homo Sapiens
RQLPSSHAL

SEQ ID NO: 67386 - protein, 9 aa, Homo Sapiens
RQLQDPLVI

SEQ ID NO: 67387 - protein, 9 aa, Homo Sapiens
RQLQVLDLF

SEQ ID NO: 67388 - protein, 9 aa, Homo Sapiens
RQMGYTEAI

SEQ ID NO: 67389 - protein, 9 aa, Homo Sapiens
RQMLEALNF

SEQ ID NO: 67390 - protein, 9 aa, Homo Sapiens
RQMVEHGGF

SEQ ID NO: 67391 - protein, 9 aa, Homo Sapiens
RQNESYLNF

SEQ ID NO: 67392 - protein, 9 aa, Homo Sapiens
RQNGDDPLL

SEQ ID NO: 67393 - protein, 9 aa, Homo Sapiens
RQNHSILKI

SEQ ID NO: 67394 - protein, 9 aa, Homo Sapiens
RQNIEANFI

SEQ ID NO: 67395 - protein, 9 aa, Homo Sapiens
RQNKLTYTM

SEQ ID NO: 67396 - protein, 9 aa, Homo Sapiens
RQNLAEMGL

SEQ ID NO: 67397 - protein, 9 aa, Homo Sapiens
RQPDKEFSF

SEQ ID NO: 67398 - protein, 9 aa, Homo Sapiens
RQPDLVLRL

SEQ ID NO: 67399 - protein, 9 aa, Homo Sapiens
RQPKVVERL

SEQ ID NO: 67400 - protein, 9 aa, Homo Sapiens
RQPMPDPGL

SEQ ID NO: 67401 - protein, 9 aa, Homo Sapiens
RQPNIFEIL

SEQ ID NO: 67402 - protein, 9 aa, Homo Sapiens
RQQEEITHL

SEQ ID NO: 67403 - protein, 9 aa, Homo Sapiens
RQQEGESRL

SEQ ID NO: 67404 - protein, 9 aa, Homo Sapiens
RQQEIEEKL

SEQ ID NO: 67405 - protein, 9 aa, Homo Sapiens
RQQEVETEL

SEQ ID NO: 67406 - protein, 9 aa, Homo Sapiens
RQQEYDFKM

SEQ ID NO: 67407 - protein, 9 aa, Homo Sapiens
RQQEYKEKL

SEQ ID NO: 67408 - protein, 9 aa, Homo Sapiens
RQQFHDAKF

SEQ ID NO: 67409 - protein, 9 aa, Homo Sapiens
RQQKEAACF

SEQ ID NO: 67410 - protein, 9 aa, Homo Sapiens
RQQKEITAL

SEQ ID NO: 67411 - protein, 9 aa, Homo Sapiens
RQQKEVLSW

SEQ ID NO: 67412 - protein, 9 aa, Homo Sapiens
RQQKQRQLL

SEQ ID NO: 67413 - protein, 9 aa, Homo Sapiens
RQQLELIRL

SEQ ID NO: 67414 - protein, 9 aa, Homo Sapiens
RQQLEMYSI

SEQ ID NO: 67415 - protein, 9 aa, Homo Sapiens
RQQLGEMGL

SEQ ID NO: 67416 - protein, 9 aa, Homo Sapiens
RQQLQAHQL

SEQ ID NO: 67417 - protein, 9 aa, Homo Sapiens
RQQQDEAYL

SEQ ID NO: 67418 - protein, 9 aa, Homo Sapiens
RQQQDLVAF

SEQ ID NO: 67419 - protein, 9 aa, Homo Sapiens
RQQSHFAMM

SEQ ID NO: 67420 - protein, 9 aa, Homo Sapiens
RQREMEEQM

SEQ ID NO: 67421 - protein, 9 aa, Homo Sapiens
RQSDLLVKL

SEQ ID NO: 67422 - protein, 9 aa, Homo Sapiens
RQSEDFNSL

SEQ ID NO: 67423 - protein, 9 aa, Homo Sapiens
RQSELEPVV

SEQ ID NO: 67424 - protein, 9 aa, Homo Sapiens
RQSFALEQL

SEQ ID NO: 67425 - protein, 9 aa, Homo Sapiens
RQSGDSVRL

SEQ ID NO: 67426 - protein, 9 aa, Homo Sapiens
RQSIVVSFL

SEQ ID NO: 67427 - protein, 9 aa, Homo Sapiens
RQSKNEALL

SEQ ID NO: 67428 - protein, 9 aa, Homo Sapiens
RQSLREARI

SEQ ID NO: 67429 - protein, 9 aa, Homo Sapiens
RQSLSLPSM

SEQ ID NO: 67430 - protein, 9 aa, Homo Sapiens
RQSPHSNLF

SEQ ID NO: 67431 - protein, 9 aa, Homo Sapiens
RQSTLEKKI

SEQ ID NO: 67432 - protein, 9 aa, Homo Sapiens
RQSVLRELF

SEQ ID NO: 67433 - protein, 9 aa, Homo Sapiens
RQSVYEEKL

SEQ ID NO: 67434 - protein, 9 aa, Homo Sapiens
RQTAEYSAF

SEQ ID NO: 67435 - protein, 9 aa, Homo Sapiens
RQTFVIHKL

SEQ ID NO: 67436 - protein, 9 aa, Homo Sapiens
RQTHTVDSL

SEQ ID NO: 67437 - protein, 9 aa, Homo Sapiens
RQTIINDYI

SEQ ID NO: 67438 - protein, 9 aa, Homo Sapiens
RQTIQVSLM

SEQ ID NO: 67439 - protein, 9 aa, Homo Sapiens
RQTLQEDLL

SEQ ID NO: 67440 - protein, 9 aa, Homo Sapiens
RQTNNQQNW

SEQ ID NO: 67441 - protein, 9 aa, Homo Sapiens
RQTPEPAGL

SEQ ID NO: 67442 - protein, 9 aa, Homo Sapiens
RQTSGEVGL

SEQ ID NO: 67443 - protein, 9 aa, Homo Sapiens
RQTTITSHF

SEQ ID NO: 67444 - protein, 9 aa, Homo Sapiens
RQTVADQVL

SEQ ID NO: 67445 - protein, 9 aa, Homo Sapiens
RQTVAVGVI

SEQ ID NO: 67446 - protein, 9 aa, Homo Sapiens
RQTWDQLLL

SEQ ID NO: 67447 - protein, 9 aa, Homo Sapiens
RQVAEAPGL

SEQ ID NO: 67448 - protein, 9 aa, Homo Sapiens
RQVAKVEKF

SEQ ID NO: 67449 - protein, 9 aa, Homo Sapiens
RQVASHVGL

SEQ ID NO: 67450 - protein, 9 aa, Homo Sapiens
RQVEEAERL

SEQ ID NO: 67451 - protein, 9 aa, Homo Sapiens
RQVETTETL

SEQ ID NO: 67452 - protein, 9 aa, Homo Sapiens
RQVGATVEF

SEQ ID NO: 67453 - protein, 9 aa, Homo Sapiens
RQVGKTLRI

SEQ ID NO: 67454 - protein, 9 aa, Homo Sapiens
RQVGPDGLM

SEQ ID NO: 67455 - protein, 9 aa, Homo Sapiens
RQVGVTEML

SEQ ID NO: 67456 - protein, 9 aa, Homo Sapiens
RQVIAAVKW

SEQ ID NO: 67457 - protein, 9 aa, Homo Sapiens
RQVKGDLAF

SEQ ID NO: 67458 - protein, 9 aa, Homo Sapiens
RQVKVILNI

SEQ ID NO: 67459 - protein, 9 aa, Homo Sapiens
RQVLENFKL

SEQ ID NO: 67460 - protein, 9 aa, Homo Sapiens
RQVLHGEAL

SEQ ID NO: 67461 - protein, 9 aa, Homo Sapiens
RQVTEECQL

SEQ ID NO: 67462 - protein, 9 aa, Homo Sapiens
RQVTKEEGL

SEQ ID NO: 67463 - protein, 9 aa, Homo Sapiens
RQVVHVETL

SEQ ID NO: 67464 - protein, 9 aa, Homo Sapiens
RQWDYTEKL

SEQ ID NO: 67465 - protein, 9 aa, Homo Sapiens
RQWEEQGEL

SEQ ID NO: 67466 - protein, 9 aa, Homo Sapiens
RQWQDVESL

SEQ ID NO: 67467 - protein, 9 aa, Homo Sapiens
RQYAKDIGF

SEQ ID NO: 67468 - protein, 9 aa, Homo Sapiens
RQYFQEIGL

SEQ ID NO: 67469 - protein, 9 aa, Homo Sapiens
RQYGDESTL

SEQ ID NO: 67470 - protein, 9 aa, Homo Sapiens
RQYGEVANL

SEQ ID NO: 67471 - protein, 9 aa, Homo Sapiens
RQYHENIKI

SEQ ID NO: 67472 - protein, 9 aa, Homo Sapiens
RQYLECEVF

SEQ ID NO: 67473 - protein, 9 aa, Homo Sapiens
RQYPEVEIF

SEQ ID NO: 67474 - protein, 9 aa, Homo Sapiens
RQYYTAEKL

SEQ ID NO: 67475 - protein, 9 aa, Homo Sapiens
RSDIGEFEW

SEQ ID NO: 67476 - protein, 9 aa, Homo Sapiens
RSDPGHYSF

SEQ ID NO: 67477 - protein, 9 aa, Homo Sapiens
RSDYEDPAF

SEQ ID NO: 67478 - protein, 9 aa, Homo Sapiens
RSESRPDIL

SEQ ID NO: 67479 - protein, 9 aa, Homo Sapiens
RSFDSEFKL

SEQ ID NO: 67480 - protein, 9 aa, Homo Sapiens
RSFQGKESI

SEQ ID NO: 67481 - protein, 9 aa, Homo Sapiens
RSIDDVVRL

SEQ ID NO: 67482 - protein, 9 aa, Homo Sapiens
RSLDDALKL

SEQ ID NO: 67483 - protein, 9 aa, Homo Sapiens
RSMEDFVTW

SEQ ID NO: 67484 - protein, 9 aa, Homo Sapiens
RSMGLPLQF

SEQ ID NO: 67485 - protein, 9 aa, Homo Sapiens
RSSTPLPTI

SEQ ID NO: 67486 - protein, 9 aa, Homo Sapiens
RSTMVDPAI

SEQ ID NO: 67487 - protein, 9 aa, Homo Sapiens
RTDAGVHAL

SEQ ID NO: 67488 - protein, 9 aa, Homo Sapiens
RTDVVELLL

SEQ ID NO: 67489 - protein, 9 aa, Homo Sapiens
RTDYSFHKF

SEQ ID NO: 67490 - protein, 9 aa, Homo Sapiens
RTFEKDHRL

SEQ ID NO: 67491 - protein, 9 aa, Homo Sapiens
RTFQDEPLI

SEQ ID NO: 67492 - protein, 9 aa, Homo Sapiens
RTIEDFNKF

SEQ ID NO: 67493 - protein, 9 aa, Homo Sapiens
RTLDFDPLL

SEQ ID NO: 67494 - protein, 9 aa, Homo Sapiens
RTLPVDFHI

SEQ ID NO: 67495 - protein, 9 aa, Homo Sapiens
RTMDDKTVF

SEQ ID NO: 67496 - protein, 9 aa, Homo Sapiens
RTNGKEPEL

SEQ ID NO: 67497 - protein, 9 aa, Homo Sapiens
RTVEDFNKF

SEQ ID NO: 67498 - protein, 9 aa, Homo Sapiens
RTVKVGDTL

SEQ ID NO: 67499 - protein, 9 aa, Homo Sapiens
RTVYFSEQW

SEQ ID NO: 67500 - protein, 9 aa, Homo Sapiens
RVAAVLLQF

SEQ ID NO: 67501 - protein, 9 aa, Homo Sapiens
RVAHFGYHW

SEQ ID NO: 67502 - protein, 9 aa, Homo Sapiens
RVANVADVV

SEQ ID NO: 67503 - protein, 9 aa, Homo Sapiens
RVAPEQQMI

SEQ ID NO: 67504 - protein, 9 aa, Homo Sapiens
RVAQLLERW

SEQ ID NO: 67505 - protein, 9 aa, Homo Sapiens
RVCEDFGVI

SEQ ID NO: 67506 - protein, 9 aa, Homo Sapiens
RVCEVDNEL

SEQ ID NO: 67507 - protein, 9 aa, Homo Sapiens
RVCMDFNII

SEQ ID NO: 67508 - protein, 9 aa, Homo Sapiens
RVDDGSQKI

SEQ ID NO: 67509 - protein, 9 aa, Homo Sapiens
RVDDIFSDL

SEQ ID NO: 67510 - protein, 9 aa, Homo Sapiens
RVDEEPTTL

SEQ ID NO: 67511 - protein, 9 aa, Homo Sapiens
RVDGAVSSW

SEQ ID NO: 67512 - protein, 9 aa, Homo Sapiens
RVDITLLGF

SEQ ID NO: 67513 - protein, 9 aa, Homo Sapiens
RVDKNAPTV

SEQ ID NO: 67514 - protein, 9 aa, Homo Sapiens
RVDKSAVGF

SEQ ID NO: 67515 - protein, 9 aa, Homo Sapiens
RVDRIILLF

SEQ ID NO: 67516 - protein, 9 aa, Homo Sapiens
RVDTTLLGF

SEQ ID NO: 67517 - protein, 9 aa, Homo Sapiens
RVECQSHRL

SEQ ID NO: 67518 - protein, 9 aa, Homo Sapiens
RVEGAQQRW

SEQ ID NO: 67519 - protein, 9 aa, Homo Sapiens
RVELECETI

SEQ ID NO: 67520 - protein, 9 aa, Homo Sapiens
RVFAAESII

SEQ ID NO: 67521 - protein, 9 aa, Homo Sapiens
RVFASPLRL

SEQ ID NO: 67522 - protein, 9 aa, Homo Sapiens
RVFPHEVNW

SEQ ID NO: 67523 - protein, 9 aa, Homo Sapiens
RVFQTEAEL

SEQ ID NO: 67524 - protein, 9 aa, Homo Sapiens
RVFQVEYAM

SEQ ID NO: 67525 - protein, 9 aa, Homo Sapiens
RVFREVEML

SEQ ID NO: 67526 - protein, 9 aa, Homo Sapiens
RVFREVETL

SEQ ID NO: 67527 - protein, 9 aa, Homo Sapiens
RVFSLSSEF

SEQ ID NO: 67528 - protein, 9 aa, Homo Sapiens
RVFVDDVTI

SEQ ID NO: 67529 - protein, 9 aa, Homo Sapiens
RVFVGGDDF

SEQ ID NO: 67530 - protein, 9 aa, Homo Sapiens
RVHAFLEQW

SEQ ID NO: 67531 - protein, 9 aa, Homo Sapiens
RVHPETYEW

SEQ ID NO: 67532 - protein, 9 aa, Homo Sapiens
RVIDVGSEW

SEQ ID NO: 67533 - protein, 9 aa, Homo Sapiens
RVIDYAVKI

SEQ ID NO: 67534 - protein, 9 aa, Homo Sapiens
RVIEFAAKF

SEQ ID NO: 67535 - protein, 9 aa, Homo Sapiens
RVIGQDHDF

SEQ ID NO: 67536 - protein, 9 aa, Homo Sapiens
RVINEEYKI

SEQ ID NO: 67537 - protein, 9 aa, Homo Sapiens
RVINKEHVL

SEQ ID NO: 67538 - protein, 9 aa, Homo Sapiens
RVIPSQEHL

SEQ ID NO: 67539 - protein, 9 aa, Homo Sapiens
RVISFEEQV

SEQ ID NO: 67540 - protein, 9 aa, Homo Sapiens
RVLDLVEVL

SEQ ID NO: 67541 - protein, 9 aa, Homo Sapiens
RVLEELETL

SEQ ID NO: 67542 - protein, 9 aa, Homo Sapiens
RVLEGHEEL

SEQ ID NO: 67543 - protein, 9 aa, Homo Sapiens
RVLFIKDVI

SEQ ID NO: 67544 - protein, 9 aa, Homo Sapiens
RVLQQEHRL

SEQ ID NO: 67545 - protein, 9 aa, Homo Sapiens
RVNPVEYSI

SEQ ID NO: 67546 - protein, 9 aa, Homo Sapiens
RVQDLEQKM

SEQ ID NO: 67547 - protein, 9 aa, Homo Sapiens
RVQKEVAGF

SEQ ID NO: 67548 - protein, 9 aa, Homo Sapiens
RVQLDVFTL

SEQ ID NO: 67549 - protein, 9 aa, Homo Sapiens
RVSEIRDAF

SEQ ID NO: 67550 - protein, 9 aa, Homo Sapiens
RVSELHLEV

SEQ ID NO: 67551 - protein, 9 aa, Homo Sapiens
RVSELQVLL

SEQ ID NO: 67552 - protein, 9 aa, Homo Sapiens
RVSHLIEHL

SEQ ID NO: 67553 - protein, 9 aa, Homo Sapiens
RVSINKDEL

SEQ ID NO: 67554 - protein, 9 aa, Homo Sapiens
RVSPEEVTI

SEQ ID NO: 67555 - protein, 9 aa, Homo Sapiens
RVSQLQIQF

SEQ ID NO: 67556 - protein, 9 aa, Homo Sapiens
RVSQTPESL

SEQ ID NO: 67557 - protein, 9 aa, Homo Sapiens
RVTSVVTGF

SEQ ID NO: 67558 - protein, 9 aa, Homo Sapiens
RVVDFDETW

SEQ ID NO: 67559 - protein, 9 aa, Homo Sapiens
RVVDIYSKF

SEQ ID NO: 67560 - protein, 9 aa, Homo Sapiens
RVVDLITNL

SEQ ID NO: 67561 - protein, 9 aa, Homo Sapiens
RVVEEPYTV

SEQ ID NO: 67562 - protein, 9 aa, Homo Sapiens
RVVKLNEVI

SEQ ID NO: 67563 - protein, 9 aa, Homo Sapiens
RVVKNFEHL

SEQ ID NO: 67564 - protein, 9 aa, Homo Sapiens
RVVQQEEGW

SEQ ID NO: 67565 - protein, 9 aa, Homo Sapiens
RVVTEDQLL

SEQ ID NO: 67566 - protein, 9 aa, Homo Sapiens
RVWQWDEKW

SEQ ID NO: 67567 - protein, 9 aa, Homo Sapiens
RVYEFLDKL

SEQ ID NO: 67568 - protein, 9 aa, Homo Sapiens
SHEKLLLQI

SEQ ID NO: 67569 - protein, 9 aa, Homo Sapiens
SIAHIGDVM

SEQ ID NO: 67570 - protein, 9 aa, Homo Sapiens
SIAPEDPFV

SEQ ID NO: 67571 - protein, 9 aa, Homo Sapiens
SIASPDVKL

SEQ ID NO: 67572 - protein, 9 aa, Homo Sapiens
SIDKTEAGI

SEQ ID NO: 67573 - protein, 9 aa, Homo Sapiens
SIDVGYERF

SEQ ID NO: 67574 - protein, 9 aa, Homo Sapiens
SIMHEDWCW

SEQ ID NO: 67575 - protein, 9 aa, Homo Sapiens
SIYEGDESF

SEQ ID NO: 67576 - protein, 9 aa, Homo Sapiens
SIYSGLEAF

SEQ ID NO: 67577 - protein, 9 aa, Homo Sapiens
SLAEDNLKL

SEQ ID NO: 67578 - protein, 9 aa, Homo Sapiens
SLAEEHEGL

SEQ ID NO: 67579 - protein, 9 aa, Homo Sapiens
SLCPDLMEI

SEQ ID NO: 67580 - protein, 9 aa, Homo Sapiens
SLDAHEETI

SEQ ID NO: 67581 - protein, 9 aa, Homo Sapiens
SLDGYFHLW

SEQ ID NO: 67582 - protein, 9 aa, Homo Sapiens
SLDNIVKLW

SEQ ID NO: 67583 - protein, 9 aa, Homo Sapiens
SLDSSTLLF

SEQ ID NO: 67584 - protein, 9 aa, Homo Sapiens
SLFSDKQMI

SEQ ID NO: 67585 - protein, 9 aa, Homo Sapiens
SLHQVSFLF

SEQ ID NO: 67586 - protein, 9 aa, Homo Sapiens
SLIDADPYL

SEQ ID NO: 67587 - protein, 9 aa, Homo Sapiens
SLIELFESF

SEQ ID NO: 67588 - protein, 9 aa, Homo Sapiens
SLSDTHDRL

SEQ ID NO: 67589 - protein, 9 aa, Homo Sapiens
SLSDTVEKL

SEQ ID NO: 67590 - protein, 9 aa, Homo Sapiens
SLSDVLDAF

SEQ ID NO: 67591 - protein, 9 aa, Homo Sapiens
SLSQVFLHL

SEQ ID NO: 67592 - protein, 9 aa, Homo Sapiens
SLSRGEEGF

SEQ ID NO: 67593 - protein, 9 aa, Homo Sapiens
SLSRIGDEL

SEQ ID NO: 67594 - protein, 9 aa, Homo Sapiens
SLSRKDSRW

SEQ ID NO: 67595 - protein, 9 aa, Homo Sapiens
SLVALSEKL

SEQ ID NO: 67596 - protein, 9 aa, Homo Sapiens
SLWYGKEYW

SEQ ID NO: 67597 - protein, 9 aa, Homo Sapiens
SLYDQAEKL

SEQ ID NO: 67598 - protein, 9 aa, Homo Sapiens
SMCGLMLKL

SEQ ID NO: 67599 - protein, 9 aa, Homo Sapiens
SMDKTMILW

SEQ ID NO: 67600 - protein, 9 aa, Homo Sapiens
SMDQTILLW

SEQ ID NO: 67601 - protein, 9 aa, Homo Sapiens
SMMDVDHQI

SEQ ID NO: 67602 - protein, 9 aa, Homo Sapiens
SMSPTGDFL

SEQ ID NO: 67603 - protein, 9 aa, Homo Sapiens
SQAAVSARF

SEQ ID NO: 67604 - protein, 9 aa, Homo Sapiens
SQADCAVLI

SEQ ID NO: 67605 - protein, 9 aa, Homo Sapiens
SQAEIEQKI

SEQ ID NO: 67606 - protein, 9 aa, Homo Sapiens
SQANIAQVL

SEQ ID NO: 67607 - protein, 9 aa, Homo Sapiens
SQANVVVKI

SEQ ID NO: 67608 - protein, 9 aa, Homo Sapiens
SQAPEAWRL

SEQ ID NO: 67609 - protein, 9 aa, Homo Sapiens
SQAPEKVTL

SEQ ID NO: 67610 - protein, 9 aa, Homo Sapiens
SQCAKTFSL

SEQ ID NO: 67611 - protein, 9 aa, Homo Sapiens
SQCGKTFTW

SEQ ID NO: 67612 - protein, 9 aa, Homo Sapiens
SQCPHIVRI

SEQ ID NO: 67613 - protein, 9 aa, Homo Sapiens
SQCVTGLVF

SEQ ID NO: 67614 - protein, 9 aa, Homo Sapiens
SQDGRVFIW

SEQ ID NO: 67615 - protein, 9 aa, Homo Sapiens
SQDGTLQSF

SEQ ID NO: 67616 - protein, 9 aa, Homo Sapiens
SQDIVNQVL

SEQ ID NO: 67617 - protein, 9 aa, Homo Sapiens
SQDLTHLNL

SEQ ID NO: 67618 - protein, 9 aa, Homo Sapiens
SQDPDFLTI

SEQ ID NO: 67619 - protein, 9 aa, Homo Sapiens
SQDPESLLL

SEQ ID NO: 67620 - protein, 9 aa, Homo Sapiens
SQDPFPAAI

SEQ ID NO: 67621 - protein, 9 aa, Homo Sapiens
SQDPGTHVV

SEQ ID NO: 67622 - protein, 9 aa, Homo Sapiens
SQDPNRVEL

SEQ ID NO: 67623 - protein, 9 aa, Homo Sapiens
SQDPPEKSI

SEQ ID NO: 67624 - protein, 9 aa, Homo Sapiens
SQDQVFLRW

SEQ ID NO: 67625 - protein, 9 aa, Homo Sapiens
SQDRHVDVL

SEQ ID NO: 67626 - protein, 9 aa, Homo Sapiens
SQDRTAKLW

SEQ ID NO: 67627 - protein, 9 aa, Homo Sapiens
SQDTGKYCF

SEQ ID NO: 67628 - protein, 9 aa, Homo Sapiens
SQDWRDSEW

SEQ ID NO: 67629 - protein, 9 aa, Homo Sapiens
SQDYGKHLL

SEQ ID NO: 67630 - protein, 9 aa, Homo Sapiens
SQEEKAAYL

SEQ ID NO: 67631 - protein, 9 aa, Homo Sapiens
SQEGASVKI

SEQ ID NO: 67632 - protein, 9 aa, Homo Sapiens
SQENLVVHI

SEQ ID NO: 67633 - protein, 9 aa, Homo Sapiens
SQFASVERI

SEQ ID NO: 67634 - protein, 9 aa, Homo Sapiens
SQFGHCFSW

SEQ ID NO: 67635 - protein, 9 aa, Homo Sapiens
SQFGTEHVL

SEQ ID NO: 67636 - protein, 9 aa, Homo Sapiens
SQFKGYFIF

SEQ ID NO: 67637 - protein, 9 aa, Homo Sapiens
SQFKYALVW

SEQ ID NO: 67638 - protein, 9 aa, Homo Sapiens
SQFSYQHAI

SEQ ID NO: 67639 - protein, 9 aa, Homo Sapiens
SQGSVGFLW

SEQ ID NO: 67640 - protein, 9 aa, Homo Sapiens
SQHGYYEKL

SEQ ID NO: 67641 - protein, 9 aa, Homo Sapiens
SQHQAIERF

SEQ ID NO: 67642 - protein, 9 aa, Homo Sapiens
SQHSVDQSW

SEQ ID NO: 67643 - protein, 9 aa, Homo Sapiens
SQIADVARF

SEQ ID NO: 67644 - protein, 9 aa, Homo Sapiens
SQIALNEKL

SEQ ID NO: 67645 - protein, 9 aa, Homo Sapiens
SQIEADFRL

SEQ ID NO: 67646 - protein, 9 aa, Homo Sapiens
SQIIQKEDL

SEQ ID NO: 67647 - protein, 9 aa, Homo Sapiens
SQIKNEINI

SEQ ID NO: 67648 - protein, 9 aa, Homo Sapiens
SQINRAYQF

SEQ ID NO: 67649 - protein, 9 aa, Homo Sapiens
SQIREMETL

SEQ ID NO: 67650 - protein, 9 aa, Homo Sapiens
SQLIDTHLL

SEQ ID NO: 67651 - protein, 9 aa, Homo Sapiens
SQLPVDHIL

SEQ ID NO: 67652 - protein, 9 aa, Homo Sapiens
SQMGPDAHM

SEQ ID NO: 67653 - protein, 9 aa, Homo Sapiens
SQNAIDHKI

SEQ ID NO: 67654 - protein, 9 aa, Homo Sapiens
SQPERDWVL

SEQ ID NO: 67655 - protein, 9 aa, Homo Sapiens
SQQELEAKL

SEQ ID NO: 67656 - protein, 9 aa, Homo Sapiens
SQQERDWVL

SEQ ID NO: 67657 - protein, 9 aa, Homo Sapiens
SQSATEVRL

SEQ ID NO: 67658 - protein, 9 aa, Homo Sapiens
SQSAVKTKF

SEQ ID NO: 67659 - protein, 9 aa, Homo Sapiens
SQSHAYQQF

SEQ ID NO: 67660 - protein, 9 aa, Homo Sapiens
SQSPKDTSF

SEQ ID NO: 67661 - protein, 9 aa, Homo Sapiens
SQSPMLLEL

SEQ ID NO: 67662 - protein, 9 aa, Homo Sapiens
SQSPVPCKL

SEQ ID NO: 67663 - protein, 9 aa, Homo Sapiens
SQSTVKVLI

SEQ ID NO: 67664 - protein, 9 aa, Homo Sapiens
SQTTVYEKL

SEQ ID NO: 67665 - protein, 9 aa, Homo Sapiens
SQTVVEEYL

SEQ ID NO: 67666 - protein, 9 aa, Homo Sapiens
SQVEGEHQL

SEQ ID NO: 67667 - protein, 9 aa, Homo Sapiens
SQVGVEPSI

SEQ ID NO: 67668 - protein, 9 aa, Homo Sapiens
SQVIPMEEF

SEQ ID NO: 67669 - protein, 9 aa, Homo Sapiens
SQVKLQDFF

SEQ ID NO: 67670 - protein, 9 aa, Homo Sapiens
SQVRDVIGF

SEQ ID NO: 67671 - protein, 9 aa, Homo Sapiens
SQYPFPVTL

SEQ ID NO: 67672 - protein, 9 aa, Homo Sapiens
SSPAPRTAL

SEQ ID NO: 67673 - protein, 9 aa, Homo Sapiens
STTKIGDAI

SEQ ID NO: 67674 - protein, 9 aa, Homo Sapiens
STVGFGDQI

SEQ ID NO: 67675 - protein, 9 aa, Homo Sapiens
SVDETTQAM

SEQ ID NO: 67676 - protein, 9 aa, Homo Sapiens
SVIDSDEKW

SEQ ID NO: 67677 - protein, 9 aa, Homo Sapiens
SVIFGEALW

SEQ ID NO: 67678 - protein, 9 aa, Homo Sapiens
SVMKTEPSI

SEQ ID NO: 67679 - protein, 9 aa, Homo Sapiens
SVQGGETRI

SEQ ID NO: 67680 - protein, 9 aa, Homo Sapiens
SVTEIQEKW

SEQ ID NO: 67681 - protein, 9 aa, Homo Sapiens
SVYDGKLLI

SEQ ID NO: 67682 - protein, 9 aa, Homo Sapiens
TLDPNTREW

SEQ ID NO: 67683 - protein, 9 aa, Homo Sapiens
TLDPVEKAL

SEQ ID NO: 67684 - protein, 9 aa, Homo Sapiens
TLDTIQLAF

SEQ ID NO: 67685 - protein, 9 aa, Homo Sapiens
TLGPKDPGL

SEQ ID NO: 67686 - protein, 9 aa, Homo Sapiens
TLHRYEHAL

SEQ ID NO: 67687 - protein, 9 aa, Homo Sapiens
TLSTFKESW

SEQ ID NO: 67688 - protein, 9 aa, Homo Sapiens
TLSVSGDRL

SEQ ID NO: 67689 - protein, 9 aa, Homo Sapiens
TMVEAFDRW

SEQ ID NO: 67690 - protein, 9 aa, Homo Sapiens
TNSAILPLL

SEQ ID NO: 67691 - protein, 9 aa, Homo Sapiens
TQALEKYNI

SEQ ID NO: 67692 - protein, 9 aa, Homo Sapiens
TQAPVVPYW

SEQ ID NO: 67693 - protein, 9 aa, Homo Sapiens
TQDAVPLTL

SEQ ID NO: 67694 - protein, 9 aa, Homo Sapiens
TQDECILHF

SEQ ID NO: 67695 - protein, 9 aa, Homo Sapiens
TQDGIKLMF

SEQ ID NO: 67696 - protein, 9 aa, Homo Sapiens
TQDNGILTF

SEQ ID NO: 67697 - protein, 9 aa, Homo Sapiens
TQDNITVRW

SEQ ID NO: 67698 - protein, 9 aa, Homo Sapiens
TQDTQPHYI

SEQ ID NO: 67699 - protein, 9 aa, Homo Sapiens
TQESTFQEL

SEQ ID NO: 67700 - protein, 9 aa, Homo Sapiens
TQGPIEVYL

SEQ ID NO: 67701 - protein, 9 aa, Homo Sapiens
TQGQVDEKW

SEQ ID NO: 67702 - protein, 9 aa, Homo Sapiens
TQIITKYLW

SEQ ID NO: 67703 - protein, 9 aa, Homo Sapiens
TQMPDPKTF

SEQ ID NO: 67704 - protein, 9 aa, Homo Sapiens
TQNLDVHFW

SEQ ID NO: 67705 - protein, 9 aa, Homo Sapiens
TQQNWDYRW

SEQ ID NO: 67706 - protein, 9 aa, Homo Sapiens
TQQQHDFTL

SEQ ID NO: 67707 - protein, 9 aa, Homo Sapiens
TQQWEDYRF

SEQ ID NO: 67708 - protein, 9 aa, Homo Sapiens
TQSEVDPHL

SEQ ID NO: 67709 - protein, 9 aa, Homo Sapiens
TQTAVITRI

SEQ ID NO: 67710 - protein, 9 aa, Homo Sapiens
TQTLVREYF

SEQ ID NO: 67711 - protein, 9 aa, Homo Sapiens
TQTTHELTI

SEQ ID NO: 67712 - protein, 9 aa, Homo Sapiens
TQYISEPKL

SEQ ID NO: 67713 - protein, 9 aa, Homo Sapiens
TVTGVGDVF

SEQ ID NO: 67714 - protein, 9 aa, Homo Sapiens
VADLVGFLL

SEQ ID NO: 67715 - protein, 9 aa, Homo Sapiens
VIAPPDFVL

SEQ ID NO: 67716 - protein, 9 aa, Homo Sapiens
VIDDAFALW

SEQ ID NO: 67717 - protein, 9 aa, Homo Sapiens
VIDNIRLCF

SEQ ID NO: 67718 - protein, 9 aa, Homo Sapiens
VIQENEHAL

SEQ ID NO: 67719 - protein, 9 aa, Homo Sapiens
VLAQADHEL

SEQ ID NO: 67720 - protein, 9 aa, Homo Sapiens
VLCALGLVL

SEQ ID NO: 67721 - protein, 9 aa, Homo Sapiens
VLDDKDYFL

SEQ ID NO: 67722 - protein, 9 aa, Homo Sapiens
VLDITRLLL

SEQ ID NO: 67723 - protein, 9 aa, Homo Sapiens
VLDQKEHRL

SEQ ID NO: 67724 - protein, 9 aa, Homo Sapiens
VLFAEEPGL

SEQ ID NO: 67725 - protein, 9 aa, Homo Sapiens
VLFDDELLM

SEQ ID NO: 67726 - protein, 9 aa, Homo Sapiens
VLFPEPLTW

SEQ ID NO: 67727 - protein, 9 aa, Homo Sapiens
VLFPGTDHI

SEQ ID NO: 67728 - protein, 9 aa, Homo Sapiens
VLHFKEWQL

SEQ ID NO: 67729 - protein, 9 aa, Homo Sapiens
VLHPTPELW

SEQ ID NO: 67730 - protein, 9 aa, Homo Sapiens
VLIDIREYW

SEQ ID NO: 67731 - protein, 9 aa, Homo Sapiens
VLQNGGDKL

SEQ ID NO: 67732 - protein, 9 aa, Homo Sapiens
VLQPEEPKI

SEQ ID NO: 67733 - protein, 9 aa, Homo Sapiens
VLQQKEHTI

SEQ ID NO: 67734 - protein, 9 aa, Homo Sapiens
VLSDLDQKW

SEQ ID NO: 67735 - protein, 9 aa, Homo Sapiens
VLSHVVLEF

SEQ ID NO: 67736 - protein, 9 aa, Homo Sapiens
VLTSKGDAW

SEQ ID NO: 67737 - protein, 9 aa, Homo Sapiens
VLVKVFEKF

SEQ ID NO: 67738 - protein, 9 aa, Homo Sapiens
VLYDRPLKI

SEQ ID NO: 67739 - protein, 9 aa, Homo Sapiens
VLYVENERW

SEQ ID NO: 67740 - protein, 9 aa, Homo Sapiens
VMDAALLLI

SEQ ID NO: 67741 - protein, 9 aa, Homo Sapiens
VMDPTKILI

SEQ ID NO: 67742 - protein, 9 aa, Homo Sapiens
VMDQKEHKL

SEQ ID NO: 67743 - protein, 9 aa, Homo Sapiens
VQAGDVITI

SEQ ID NO: 67744 - protein, 9 aa, Homo Sapiens
VQAIKDHAF

SEQ ID NO: 67745 - protein, 9 aa, Homo Sapiens
VQALVSGKL

SEQ ID NO: 67746 - protein, 9 aa, Homo Sapiens
VQAPANDSW

SEQ ID NO: 67747 - protein, 9 aa, Homo Sapiens
VQDESHSEW

SEQ ID NO: 67748 - protein, 9 aa, Homo Sapiens
VQDGATHSL

SEQ ID NO: 67749 - protein, 9 aa, Homo Sapiens
VQDRFEVNI

SEQ ID NO: 67750 - protein, 9 aa, Homo Sapiens
VQGHVEELW

SEQ ID NO: 67751 - protein, 9 aa, Homo Sapiens
VQHNMVDVL

SEQ ID NO: 67752 - protein, 9 aa, Homo Sapiens
VQHQDALQI

SEQ ID NO: 67753 - protein, 9 aa, Homo Sapiens
VQHSDVLFL

SEQ ID NO: 67754 - protein, 9 aa, Homo Sapiens
VQIGEKEGW

SEQ ID NO: 67755 - protein, 9 aa, Homo Sapiens
VQISDKITI

SEQ ID NO: 67756 - protein, 9 aa, Homo Sapiens
VQLKDLEKW

SEQ ID NO: 67757 - protein, 9 aa, Homo Sapiens
VQMQREWSF

SEQ ID NO: 67758 - protein, 9 aa, Homo Sapiens
VQQLEQWEF

SEQ ID NO: 67759 - protein, 9 aa, Homo Sapiens
VQSGLRILL

SEQ ID NO: 67760 - protein, 9 aa, Homo Sapiens
VQYALPLQL

SEQ ID NO: 67761 - protein, 9 aa, Homo Sapiens
VVAPGQEKI

SEQ ID NO: 67762 - protein, 9 aa, Homo Sapiens
VVEDGYEFF

SEQ ID NO: 67763 - protein, 9 aa, Homo Sapiens
WIDKCQNNL

SEQ ID NO: 67764 - protein, 9 aa, Homo Sapiens
WLHGLESQI

SEQ ID NO: 67765 - protein, 9 aa, Homo Sapiens
WLSSVVDHF

SEQ ID NO: 67766 - protein, 9 aa, Homo Sapiens
WLYGEDHQI

SEQ ID NO: 67767 - protein, 9 aa, Homo Sapiens
WQEGSVTRL

SEQ ID NO: 67768 - protein, 9 aa, Homo Sapiens
WQHDEPCYW

SEQ ID NO: 67769 - protein, 9 aa, Homo Sapiens
WSFDGIDRW

SEQ ID NO: 67770 - protein, 9 aa, Homo Sapiens
YIAEEYSRL

SEQ ID NO: 67771 - protein, 9 aa, Homo Sapiens
YIDASCLTW

SEQ ID NO: 67772 - protein, 9 aa, Homo Sapiens
YIFEEPFTI

SEQ ID NO: 67773 - protein, 9 aa, Homo Sapiens
YIIEREPLI

SEQ ID NO: 67774 - protein, 9 aa, Homo Sapiens
YIIKDKHIL

SEQ ID NO: 67775 - protein, 9 aa, Homo Sapiens
YINVEREEW

SEQ ID NO: 67776 - protein, 9 aa, Homo Sapiens
YIVFGEAKI

SEQ ID NO: 67777 - protein, 9 aa, Homo Sapiens
YLAKHIENI

SEQ ID NO: 67778 - protein, 9 aa, Homo Sapiens
YLAQHYDKI

SEQ ID NO: 67779 - protein, 9 aa, Homo Sapiens
YLASEISTW

SEQ ID NO: 67780 - protein, 9 aa, Homo Sapiens
YLCYEVERL

SEQ ID NO: 67781 - protein, 9 aa, Homo Sapiens
YLDPNYQSI

SEQ ID NO: 67782 - protein, 9 aa, Homo Sapiens
YLDQVKLQF

SEQ ID NO: 67783 - protein, 9 aa, Homo Sapiens
YLEDTDRNL

SEQ ID NO: 67784 - protein, 9 aa, Homo Sapiens
YLEGECVEW

SEQ ID NO: 67785 - protein, 9 aa, Homo Sapiens
YLENGKETL

SEQ ID NO: 67786 - protein, 9 aa, Homo Sapiens
YLFKGNNRW

SEQ ID NO: 67787 - protein, 9 aa, Homo Sapiens
YLFPNRLEW

SEQ ID NO: 67788 - protein, 9 aa, Homo Sapiens
YLIEPDVEL

SEQ ID NO: 67789 - protein, 9 aa, Homo Sapiens
YLIKDGKLI

SEQ ID NO: 67790 - protein, 9 aa, Homo Sapiens
YLMAEKLGI

SEQ ID NO: 67791 - protein, 9 aa, Homo Sapiens
YLNDLHEVL

SEQ ID NO: 67792 - protein, 9 aa, Homo Sapiens
YLNQDNCTW

SEQ ID NO: 67793 - protein, 9 aa, Homo Sapiens
YLSDPCPGL

SEQ ID NO: 67794 - protein, 9 aa, Homo Sapiens
YLSLTPEQW

SEQ ID NO: 67795 - protein, 9 aa, Homo Sapiens
YLSNADERL

SEQ ID NO: 67796 - protein, 9 aa, Homo Sapiens
YLSPDLSKI

SEQ ID NO: 67797 - protein, 9 aa, Homo Sapiens
YLTAEILEL

SEQ ID NO: 67798 - protein, 9 aa, Homo Sapiens
YLTELIDRF

SEQ ID NO: 67799 - protein, 9 aa, Homo Sapiens
YLVEDIQHI

SEQ ID NO: 67800 - protein, 9 aa, Homo Sapiens
YLVKIFEEL

SEQ ID NO: 67801 - protein, 9 aa, Homo Sapiens
YLVKREDYL

SEQ ID NO: 67802 - protein, 9 aa, Homo Sapiens
YQAEIPDRL

SEQ ID NO: 67803 - protein, 9 aa, Homo Sapiens
YQAHYGEQL

SEQ ID NO: 67804 - protein, 9 aa, Homo Sapiens
YQARDLMLM

SEQ ID NO: 67805 - protein, 9 aa, Homo Sapiens
YQDEVFGGF

SEQ ID NO: 67806 - protein, 9 aa, Homo Sapiens
YQDLIDRGW

SEQ ID NO: 67807 - protein, 9 aa, Homo Sapiens
YQDLLNVKM

SEQ ID NO: 67808 - protein, 9 aa, Homo Sapiens
YQDVGSLNI

SEQ ID NO: 67809 - protein, 9 aa, Homo Sapiens
YQDVSCLQF

SEQ ID NO: 67810 - protein, 9 aa, Homo Sapiens
YQEKGVRVL

SEQ ID NO: 67811 - protein, 9 aa, Homo Sapiens
YQFGEIRTI

SEQ ID NO: 67812 - protein, 9 aa, Homo Sapiens
YQGEGAHHI

SEQ ID NO: 67813 - protein, 9 aa, Homo Sapiens
YQGFDTDTW

SEQ ID NO: 67814 - protein, 9 aa, Homo Sapiens
YQGNTALHL

SEQ ID NO: 67815 - protein, 9 aa, Homo Sapiens
YQHGIFQSI

SEQ ID NO: 67816 - protein, 9 aa, Homo Sapiens
YQHIDRWLL

SEQ ID NO: 67817 - protein, 9 aa, Homo Sapiens
YQHKEEYQL

SEQ ID NO: 67818 - protein, 9 aa, Homo Sapiens
YQHKLAEKL

SEQ ID NO: 67819 - protein, 9 aa, Homo Sapiens
YQIDPDACF

SEQ ID NO: 67820 - protein, 9 aa, Homo Sapiens
YQLEIPENF

SEQ ID NO: 67821 - protein, 9 aa, Homo Sapiens
YQLSKEYTL

SEQ ID NO: 67822 - protein, 9 aa, Homo Sapiens
YQLTIEPLL

SEQ ID NO: 67823 - protein, 9 aa, Homo Sapiens
YQNLIDVGF

SEQ ID NO: 67824 - protein, 9 aa, Homo Sapiens
YQNMTVDIL

SEQ ID NO: 67825 - protein, 9 aa, Homo Sapiens
YQNQEIHNL

SEQ ID NO: 67826 - protein, 9 aa, Homo Sapiens
YQQELEREL

SEQ ID NO: 67827 - protein, 9 aa, Homo Sapiens
YQQKEIEFL

SEQ ID NO: 67828 - protein, 9 aa, Homo Sapiens
YQQSMDSKL

SEQ ID NO: 67829 - protein, 9 aa, Homo Sapiens
YQSIEFSRL

SEQ ID NO: 67830 - protein, 9 aa, Homo Sapiens
YQSKVRELI

SEQ ID NO: 67831 - protein, 9 aa, Homo Sapiens
YQSLCPTSW

SEQ ID NO: 67832 - protein, 9 aa, Homo Sapiens
YQSPTGDRI

SEQ ID NO: 67833 - protein, 9 aa, Homo Sapiens
YQTEIGQTL

SEQ ID NO: 67834 - protein, 9 aa, Homo Sapiens
YQVEGMEWL

SEQ ID NO: 67835 - protein, 9 aa, Homo Sapiens
YQYPRPLLI

SEQ ID NO: 67836 - protein, 9 aa, Homo Sapiens
YTSESGDRL

SEQ ID NO: 67837 - protein, 9 aa, Homo Sapiens
YVADLGDIL

SEQ ID NO: 67838 - protein, 9 aa, Homo Sapiens
YVSSPDPQL

SEQ ID NO: 67839 - protein, 10 aa, Homo Sapiens
AEIKELFQYI

SEQ ID NO: 67840 - protein, 10 aa, Homo Sapiens
AIFCETRAEW

SEQ ID NO: 67841 - protein, 10 aa, Homo Sapiens
ALAEQKCEEW

SEQ ID NO: 67842 - protein, 10 aa, Homo Sapiens
ALAKTGAESI

SEQ ID NO: 67843 - protein, 10 aa, Homo Sapiens
ALALIYNEAL

SEQ ID NO: 67844 - protein, 10 aa, Homo Sapiens
ALAPAEVQVL

SEQ ID NO: 67845 - protein, 10 aa, Homo Sapiens
ALAPHLDDAL

SEQ ID NO: 67846 - protein, 10 aa, Homo Sapiens
ALAPILDDGW

SEQ ID NO: 67847 - protein, 10 aa, Homo Sapiens
ALAQATPDHF

SEQ ID NO: 67848 - protein, 10 aa, Homo Sapiens
ALASSLLDRF

SEQ ID NO: 67849 - protein, 10 aa, Homo Sapiens
ALCGTVLDHL

SEQ ID NO: 67850 - protein, 10 aa, Homo Sapiens
ALDDSIGDVW

SEQ ID NO: 67851 - protein, 10 aa, Homo Sapiens
ALDFNTKVFW

SEQ ID NO: 67852 - protein, 10 aa, Homo Sapiens
ALDPNAYEAF

SEQ ID NO: 67853 - protein, 10 aa, Homo Sapiens
ALDPSLVPTF

SEQ ID NO: 67854 - protein, 10 aa, Homo Sapiens
ALDSPGTDHF

SEQ ID NO: 67855 - protein, 10 aa, Homo Sapiens
ALEALVPVTI

SEQ ID NO: 67856 - protein, 10 aa, Homo Sapiens
ALESGRYELL

SEQ ID NO: 67857 - protein, 10 aa, Homo Sapiens
ALFLDKMGSL

SEQ ID NO: 67858 - protein, 10 aa, Homo Sapiens
ALFPGDVDRL

SEQ ID NO: 67859 - protein, 10 aa, Homo Sapiens
ALFPKDVDRL

SEQ ID NO: 67860 - protein, 10 aa, Homo Sapiens
ALGPLVGDNF

SEQ ID NO: 67861 - protein, 10 aa, Homo Sapiens
ALHQDVQAMW

SEQ ID NO: 67862 - protein, 10 aa, Homo Sapiens
ALINDELVEW

SEQ ID NO: 67863 - protein, 10 aa, Homo Sapiens
ALMKEEGVKL

SEQ ID NO: 67864 - protein, 10 aa, Homo Sapiens
ALPEFGEVEI

SEQ ID NO: 67865 - protein, 10 aa, Homo Sapiens
ALPGPSLDQW

SEQ ID NO: 67866 - protein, 10 aa, Homo Sapiens
ALQRANDDRW

SEQ ID NO: 67867 - protein, 10 aa, Homo Sapiens
ALSQVGDLAF

SEQ ID NO: 67868 - protein, 10 aa, Homo Sapiens
ALVALTSERF

SEQ ID NO: 67869 - protein, 10 aa, Homo Sapiens
ALVDVIEDKL

SEQ ID NO: 67870 - protein, 10 aa, Homo Sapiens
ALYTEKFEEF

SEQ ID NO: 67871 - protein, 10 aa, Homo Sapiens
AMEEALFQHF

SEQ ID NO: 67872 - protein, 10 aa, Homo Sapiens
AMITDLEERL

SEQ ID NO: 67873 - protein, 10 aa, Homo Sapiens
AMVSLEMEKL

SEQ ID NO: 67874 - protein, 10 aa, Homo Sapiens
AMWPEQSDKW

SEQ ID NO: 67875 - protein, 10 aa, Homo Sapiens
AQAADVLELL

SEQ ID NO: 67876 - protein, 10 aa, Homo Sapiens
AQAAEFREAW

SEQ ID NO: 67877 - protein, 10 aa, Homo Sapiens
AQAEDMNVKL

SEQ ID NO: 67878 - protein, 10 aa, Homo Sapiens
AQAEPERHVW

SEQ ID NO: 67879 - protein, 10 aa, Homo Sapiens
AQAGEFGDRL

SEQ ID NO: 67880 - protein, 10 aa, Homo Sapiens
AQAGPGGDTW

SEQ ID NO: 67881 - protein, 10 aa, Homo Sapiens
AQAGYEVVGL

SEQ ID NO: 67882 - protein, 10 aa, Homo Sapiens
AQAKADKIKL

SEQ ID NO: 67883 - protein, 10 aa, Homo Sapiens
AQAKAESITL

SEQ ID NO: 67884 - protein, 10 aa, Homo Sapiens
AQAKEENVGL

SEQ ID NO: 67885 - protein, 10 aa, Homo Sapiens
AQALEELTGF

SEQ ID NO: 67886 - protein, 10 aa, Homo Sapiens
AQALTDQQQF

SEQ ID NO: 67887 - protein, 10 aa, Homo Sapiens
AQAPSSFQLL

SEQ ID NO: 67888 - protein, 10 aa, Homo Sapiens
AQARDEEQRL

SEQ ID NO: 67889 - protein, 10 aa, Homo Sapiens
AQAWIKKDQF

SEQ ID NO: 67890 - protein, 10 aa, Homo Sapiens
AQCAAIAERL

SEQ ID NO: 67891 - protein, 10 aa, Homo Sapiens
AQCPGLPDLI

SEQ ID NO: 67892 - protein, 10 aa, Homo Sapiens
AQDATKLDTW

SEQ ID NO: 67893 - protein, 10 aa, Homo Sapiens
AQDFKTDLRF

SEQ ID NO: 67894 - protein, 10 aa, Homo Sapiens
AQDFLLKWSF

SEQ ID NO: 67895 - protein, 10 aa, Homo Sapiens
AQDFNTDLRF

SEQ ID NO: 67896 - protein, 10 aa, Homo Sapiens
AQDKEAAEAI

SEQ ID NO: 67897 - protein, 10 aa, Homo Sapiens
AQDLDTMQRL

SEQ ID NO: 67898 - protein, 10 aa, Homo Sapiens
AQDLWSEQSI

SEQ ID NO: 67899 - protein, 10 aa, Homo Sapiens
AQDPQMLDQL

SEQ ID NO: 67900 - protein, 10 aa, Homo Sapiens
AQDVPSAQQW

SEQ ID NO: 67901 - protein, 10 aa, Homo Sapiens
AQDYGGLLLL

SEQ ID NO: 67902 - protein, 10 aa, Homo Sapiens
AQEALTVLSL

SEQ ID NO: 67903 - protein, 10 aa, Homo Sapiens
AQEDVTLEHL

SEQ ID NO: 67904 - protein, 10 aa, Homo Sapiens
AQEEGTSQAL

SEQ ID NO: 67905 - protein, 10 aa, Homo Sapiens
AQEGESSQQL

SEQ ID NO: 67906 - protein, 10 aa, Homo Sapiens
AQENRVVAFF

SEQ ID NO: 67907 - protein, 10 aa, Homo Sapiens
AQESACNNTL

SEQ ID NO: 67908 - protein, 10 aa, Homo Sapiens
AQFHPDGLIF

SEQ ID NO: 67909 - protein, 10 aa, Homo Sapiens
AQFIDKPVCF

SEQ ID NO: 67910 - protein, 10 aa, Homo Sapiens
AQGPAGAEKL

SEQ ID NO: 67911 - protein, 10 aa, Homo Sapiens
AQHKADMQRW

SEQ ID NO: 67912 - protein, 10 aa, Homo Sapiens
AQHLFIQTFW

SEQ ID NO: 67913 - protein, 10 aa, Homo Sapiens
AQHPATTEDI

SEQ ID NO: 67914 - protein, 10 aa, Homo Sapiens
AQHQALVTLW

SEQ ID NO: 67915 - protein, 10 aa, Homo Sapiens
AQIADLQQKL

SEQ ID NO: 67916 - protein, 10 aa, Homo Sapiens
AQIAEGMAYI

SEQ ID NO: 67917 - protein, 10 aa, Homo Sapiens
AQIAELKMQL

SEQ ID NO: 67918 - protein, 10 aa, Homo Sapiens
AQIEDLQVKL

SEQ ID NO: 67919 - protein, 10 aa, Homo Sapiens
AQIKAGYQSL

SEQ ID NO: 67920 - protein, 10 aa, Homo Sapiens
AQIKANYDVL

SEQ ID NO: 67921 - protein, 10 aa, Homo Sapiens
AQIKFLYEEL

SEQ ID NO: 67922 - protein, 10 aa, Homo Sapiens
AQIQEQHVQI

SEQ ID NO: 67923 - protein, 10 aa, Homo Sapiens
AQITEEEAKL

SEQ ID NO: 67924 - protein, 10 aa, Homo Sapiens
AQLEEKNQEL

SEQ ID NO: 67925 - protein, 10 aa, Homo Sapiens
AQLNFTKDQL

SEQ ID NO: 67926 - protein, 10 aa, Homo Sapiens
AQLNIAEQNW

SEQ ID NO: 67927 - protein, 10 aa, Homo Sapiens
AQLQELQVKF

SEQ ID NO: 67928 - protein, 10 aa, Homo Sapiens
AQMEVASFLL

SEQ ID NO: 67929 - protein, 10 aa, Homo Sapiens
AQMSKQLDMF

SEQ ID NO: 67930 - protein, 10 aa, Homo Sapiens
AQQEAERARF

SEQ ID NO: 67931 - protein, 10 aa, Homo Sapiens
AQQPQKEAAL

SEQ ID NO: 67932 - protein, 10 aa, Homo Sapiens
AQRSGCEERW

SEQ ID NO: 67933 - protein, 10 aa, Homo Sapiens
AQSEAEKERI

SEQ ID NO: 67934 - protein, 10 aa, Homo Sapiens
AQSKDFAVGI

SEQ ID NO: 67935 - protein, 10 aa, Homo Sapiens
AQSQIHNTCW

SEQ ID NO: 67936 - protein, 10 aa, Homo Sapiens
AQTVSPAEKW

SEQ ID NO: 67937 - protein, 10 aa, Homo Sapiens
AQVEKEFCQL

SEQ ID NO: 67938 - protein, 10 aa, Homo Sapiens
AQVFVHGESL

SEQ ID NO: 67939 - protein, 10 aa, Homo Sapiens
AQVGPEIEQF

SEQ ID NO: 67940 - protein, 10 aa, Homo Sapiens
AQVKEAGIAW

SEQ ID NO: 67941 - protein, 10 aa, Homo Sapiens
AQVQVAGDML

SEQ ID NO: 67942 - protein, 10 aa, Homo Sapiens
AQVRDLEEKL

SEQ ID NO: 67943 - protein, 10 aa, Homo Sapiens
AQVRLYKEEL

SEQ ID NO: 67944 - protein, 10 aa, Homo Sapiens
AQVYLLPDFL

SEQ ID NO: 67945 - protein, 10 aa, Homo Sapiens
AQYSQDYQQF

SEQ ID NO: 67946 - protein, 10 aa, Homo Sapiens
AVDGLSFQAF

SEQ ID NO: 67947 - protein, 10 aa, Homo Sapiens
AVEAESEQKW

SEQ ID NO: 67948 - protein, 10 aa, Homo Sapiens
AVIEDTWHYF

SEQ ID NO: 67949 - protein, 10 aa, Homo Sapiens
DIQSRSKEQL

SEQ ID NO: 67950 - protein, 10 aa, Homo Sapiens
EARRLNPGAI

SEQ ID NO: 67951 - protein, 10 aa, Homo Sapiens
ELQPSEEVTW

SEQ ID NO: 67952 - protein, 10 aa, Homo Sapiens
ERVQAQEQRI

SEQ ID NO: 67953 - protein, 10 aa, Homo Sapiens
ESQDQVFLRW

SEQ ID NO: 67954 - protein, 10 aa, Homo Sapiens
FLYTGEGDTV

SEQ ID NO: 67955 - protein, 10 aa, Homo Sapiens
FQAKLEHEYI

SEQ ID NO: 67956 - protein, 10 aa, Homo Sapiens
FQDDPDIIAF

SEQ ID NO: 67957 - protein, 10 aa, Homo Sapiens
FQDNFEFVQW

SEQ ID NO: 67958 - protein, 10 aa, Homo Sapiens
FQGRAEVVSL

SEQ ID NO: 67959 - protein, 10 aa, Homo Sapiens
FQIEDVIHKF

SEQ ID NO: 67960 - protein, 10 aa, Homo Sapiens
FQIIEEDAAL

SEQ ID NO: 67961 - protein, 10 aa, Homo Sapiens
FQISKEYERF

SEQ ID NO: 67962 - protein, 10 aa, Homo Sapiens
FQNNEKFVQF

SEQ ID NO: 67963 - protein, 10 aa, Homo Sapiens
FQVKEVDVGL

SEQ ID NO: 67964 - protein, 10 aa, Homo Sapiens
FQYPCYQEGL

SEQ ID NO: 67965 - protein, 10 aa, Homo Sapiens
FSAPTLEDHF

SEQ ID NO: 67966 - protein, 10 aa, Homo Sapiens
FVDCPGHDIL

SEQ ID NO: 67967 - protein, 10 aa, Homo Sapiens
GLIADAKTLI

SEQ ID NO: 67968 - protein, 10 aa, Homo Sapiens
GLIEVKTDEF

SEQ ID NO: 67969 - protein, 10 aa, Homo Sapiens
GLIHGDFNEF

SEQ ID NO: 67970 - protein, 10 aa, Homo Sapiens
GLPNNIVDVW

SEQ ID NO: 67971 - protein, 10 aa, Homo Sapiens
GLQTKEEVSI

SEQ ID NO: 67972 - protein, 10 aa, Homo Sapiens
GLSRELFESW

SEQ ID NO: 67973 - protein, 10 aa, Homo Sapiens
GLVLDPKVGF

SEQ ID NO: 67974 - protein, 10 aa, Homo Sapiens
GLWRGEEVTL

SEQ ID NO: 67975 - protein, 10 aa, Homo Sapiens
GLYGIKDDVF

SEQ ID NO: 67976 - protein, 10 aa, Homo Sapiens
GLYRDEHQDF

SEQ ID NO: 67977 - protein, 10 aa, Homo Sapiens
GQAEPESVLL

SEQ ID NO: 67978 - protein, 10 aa, Homo Sapiens
GQAGAARDAL

SEQ ID NO: 67979 - protein, 10 aa, Homo Sapiens
GQALELPLRI

SEQ ID NO: 67980 - protein, 10 aa, Homo Sapiens
GQAPPDQEAL

SEQ ID NO: 67981 - protein, 10 aa, Homo Sapiens
GQAQPIIDQL

SEQ ID NO: 67982 - protein, 10 aa, Homo Sapiens
GQCRQELARL

SEQ ID NO: 67983 - protein, 10 aa, Homo Sapiens
GQDEPLIHVF

SEQ ID NO: 67984 - protein, 10 aa, Homo Sapiens
GQDPGPEPRL

SEQ ID NO: 67985 - protein, 10 aa, Homo Sapiens
GQDPHSSQAF

SEQ ID NO: 67986 - protein, 10 aa, Homo Sapiens
GQDPKNFSEI

SEQ ID NO: 67987 - protein, 10 aa, Homo Sapiens
GQDPPSGDRL

SEQ ID NO: 67988 - protein, 10 aa, Homo Sapiens
GQDPRINVVL

SEQ ID NO: 67989 - protein, 10 aa, Homo Sapiens
GQEKIPVHKF

SEQ ID NO: 67990 - protein, 10 aa, Homo Sapiens
GQEKNSSNFI

SEQ ID NO: 67991 - protein, 10 aa, Homo Sapiens
GQESAQNTKF

SEQ ID NO: 67992 - protein, 10 aa, Homo Sapiens
GQFEEFGQTF

SEQ ID NO: 67993 - protein, 10 aa, Homo Sapiens
GQFFPDIVEF

SEQ ID NO: 67994 - protein, 10 aa, Homo Sapiens
GQFHDLMELF

SEQ ID NO: 67995 - protein, 10 aa, Homo Sapiens
GQFPGHNEFF

SEQ ID NO: 67996 - protein, 10 aa, Homo Sapiens
GQFQHALEEL

SEQ ID NO: 67997 - protein, 10 aa, Homo Sapiens
GQFYDLKELF

SEQ ID NO: 67998 - protein, 10 aa, Homo Sapiens
GQGILSQDAW

SEQ ID NO: 67999 - protein, 10 aa, Homo Sapiens
GQHLGALDYL

SEQ ID NO: 68000 - protein, 10 aa, Homo Sapiens
GQIPLKEVTF

SEQ ID NO: 68001 - protein, 10 aa, Homo Sapiens
GQIQEAIALI

SEQ ID NO: 68002 - protein, 10 aa, Homo Sapiens
GQIQVNIQEW

SEQ ID NO: 68003 - protein, 10 aa, Homo Sapiens
GQIRDNKIGI

SEQ ID NO: 68004 - protein, 10 aa, Homo Sapiens
GQIYANNDKL

SEQ ID NO: 68005 - protein, 10 aa, Homo Sapiens
GQIYGDVLYF

SEQ ID NO: 68006 - protein, 10 aa, Homo Sapiens
GQLDDARVIL

SEQ ID NO: 68007 - protein, 10 aa, Homo Sapiens
GQLKGEVAQM

SEQ ID NO: 68008 - protein, 10 aa, Homo Sapiens
GQLRAQEAGL

SEQ ID NO: 68009 - protein, 10 aa, Homo Sapiens
GQMSFDHQQL

SEQ ID NO: 68010 - protein, 10 aa, Homo Sapiens
GQMVIDEELL

SEQ ID NO: 68011 - protein, 10 aa, Homo Sapiens
GQPGFHSDTL

SEQ ID NO: 68012 - protein, 10 aa, Homo Sapiens
GQSREELDKF

SEQ ID NO: 68013 - protein, 10 aa, Homo Sapiens
GQVEVTGDEY

SEQ ID NO: 68014 - protein, 10 aa, Homo Sapiens
GQVKILEDSF

SEQ ID NO: 68015 - protein, 10 aa, Homo Sapiens
GQVPCHFEFI

SEQ ID NO: 68016 - protein, 10 aa, Homo Sapiens
GQVPPGTNHI

SEQ ID NO: 68017 - protein, 10 aa, Homo Sapiens
GQWREYFSAL

SEQ ID NO: 68018 - protein, 10 aa, Homo Sapiens
GQYDGKVDIW

SEQ ID NO: 68019 - protein, 10 aa, Homo Sapiens
GQYDGKVDVW

SEQ ID NO: 68020 - protein, 10 aa, Homo Sapiens
GVIDDAFALW

SEQ ID NO: 68021 - protein, 10 aa, Homo Sapiens
HIDPNVDYQF

SEQ ID NO: 68022 - protein, 10 aa, Homo Sapiens
HIIDDALVRL

SEQ ID NO: 68023 - protein, 10 aa, Homo Sapiens
HIQKEDVPSE

SEQ ID NO: 68024 - protein, 10 aa, Homo Sapiens
HIVDEVNGLI

SEQ ID NO: 68025 - protein, 10 aa, Homo Sapiens
HLANEKNLKL

SEQ ID NO: 68026 - protein, 10 aa, Homo Sapiens
HLASGGNDNL

SEQ ID NO: 68027 - protein, 10 aa, Homo Sapiens
HLDGNTEPGL

SEQ ID NO: 68028 - protein, 10 aa, Homo Sapiens
HLDGNVLDHF

SEQ ID NO: 68029 - protein, 10 aa, Homo Sapiens
HLDHCMHDHF

SEQ ID NO: 68030 - protein, 10 aa, Homo Sapiens
HLENAGCNKI

SEQ ID NO: 68031 - protein, 10 aa, Homo Sapiens
HLENSGWQKI

SEQ ID NO: 68032 - protein, 10 aa, Homo Sapiens
HLHNGDLDHF

SEQ ID NO: 68033 - protein, 10 aa, Homo Sapiens
HLIDGDVVLF

SEQ ID NO: 68034 - protein, 10 aa, Homo Sapiens
HLIEDVLNQL

SEQ ID NO: 68035 - protein, 10 aa, Homo Sapiens
HLIEEINDEM

SEQ ID NO: 68036 - protein, 10 aa, Homo Sapiens
HLIGSGSEKM

SEQ ID NO: 68037 - protein, 10 aa, Homo Sapiens
HLINDCSNTF

SEQ ID NO: 68038 - protein, 10 aa, Homo Sapiens
HLINQNSDYL

SEQ ID NO: 68039 - protein, 10 aa, Homo Sapiens
HLISIIKDDL

SEQ ID NO: 68040 - protein, 10 aa, Homo Sapiens
HLIYLINDVL

SEQ ID NO: 68041 - protein, 10 aa, Homo Sapiens
HLLDDRKLEL

SEQ ID NO: 68042 - protein, 10 aa, Homo Sapiens
HLLEDAFNQI

SEQ ID NO: 68043 - protein, 10 aa, Homo Sapiens
HLLEKDIITL

SEQ ID NO: 68044 - protein, 10 aa, Homo Sapiens
HLLNVINENF

SEQ ID NO: 68045 - protein, 10 aa, Homo Sapiens
HLNPSDTEEW

SEQ ID NO: 68046 - protein, 10 aa, Homo Sapiens
HLPASGLDIF

SEQ ID NO: 68047 - protein, 10 aa, Homo Sapiens
HLQRNINENF

SEQ ID NO: 68048 - protein, 10 aa, Homo Sapiens
HLTAITVDVW

SEQ ID NO: 68049 - protein, 10 aa, Homo Sapiens
HLVEMDTDQL

SEQ ID NO: 68050 - protein, 10 aa, Homo Sapiens
HLVKPFADTL

SEQ ID NO: 68051 - protein, 10 aa, Homo Sapiens
HLVSEGVLLF

SEQ ID NO: 68052 - protein, 10 aa, Homo Sapiens
HLWDEDFVQW

SEQ ID NO: 68053 - protein, 10 aa, Homo Sapiens
HLWTGEEQLW

SEQ ID NO: 68054 - protein, 10 aa, Homo Sapiens
HLYEEKFESI

SEQ ID NO: 68055 - protein, 10 aa, Homo Sapiens
HLYRDGEGRI

SEQ ID NO: 68056 - protein, 10 aa, Homo Sapiens
HMISDGFLTI

SEQ ID NO: 68057 - protein, 10 aa, Homo Sapiens
HMVSDEYEQL

SEQ ID NO: 68058 - protein, 10 aa, Homo Sapiens
HQAGISDTLW

SEQ ID NO: 68059 - protein, 10 aa, Homo Sapiens
HQARIEIESF

SEQ ID NO: 68060 - protein, 10 aa, Homo Sapiens
HQASHQPLYL

SEQ ID NO: 68061 - protein, 10 aa, Homo Sapiens
HQDPGQPLYI

SEQ ID NO: 68062 - protein, 10 aa, Homo Sapiens
HQDSRAHLLL

SEQ ID NO: 68063 - protein, 10 aa, Homo Sapiens
HQEGNKNVGL

SEQ ID NO: 68064 - protein, 10 aa, Homo Sapiens
HQEQANNDFF

SEQ ID NO: 68065 - protein, 10 aa, Homo Sapiens
HQFGTDKDVF

SEQ ID NO: 68066 - protein, 10 aa, Homo Sapiens
HQFQNSADSL

SEQ ID NO: 68067 - protein, 10 aa, Homo Sapiens
HQHEPFLDFL

SEQ ID NO: 68068 - protein, 10 aa, Homo Sapiens
HQIGSGKCEI

SEQ ID NO: 68069 - protein, 10 aa, Homo Sapiens
HQISSGLEAM

SEQ ID NO: 68070 - protein, 10 aa, Homo Sapiens
HQLEDLEATF

SEQ ID NO: 68071 - protein, 10 aa, Homo Sapiens
HQLFLEPEVL

SEQ ID NO: 68072 - protein, 10 aa, Homo Sapiens
HQLPSEHQTI

SEQ ID NO: 68073 - protein, 10 aa, Homo Sapiens
HQMDNAQDLL

SEQ ID NO: 68074 - protein, 10 aa, Homo Sapiens
HQNDDAEVSL

SEQ ID NO: 68075 - protein, 10 aa, Homo Sapiens
HQQLEDLCSW

SEQ ID NO: 68076 - protein, 10 aa, Homo Sapiens
HQQNALFQYF

SEQ ID NO: 68077 - protein, 10 aa, Homo Sapiens
HQSGIVQLLW

SEQ ID NO: 68078 - protein, 10 aa, Homo Sapiens
HQSKLTNEDF

SEQ ID NO: 68079 - protein, 10 aa, Homo Sapiens
HQTEGDGDVL

SEQ ID NO: 68080 - protein, 10 aa, Homo Sapiens
HQTQDSQVYW

SEQ ID NO: 68081 - protein, 10 aa, Homo Sapiens
HQVDYILETW

SEQ ID NO: 68082 - protein, 10 aa, Homo Sapiens
HQVKDLLDLI

SEQ ID NO: 68083 - protein, 10 aa, Homo Sapiens
HQVNSDLLGW

SEQ ID NO: 68084 - protein, 10 aa, Homo Sapiens
HQVVEDGYEF

SEQ ID NO: 68085 - protein, 10 aa, Homo Sapiens
HVDGQTHMLF

SEQ ID NO: 68086 - protein, 10 aa, Homo Sapiens
IIDGNPETFW

SEQ ID NO: 68087 - protein, 10 aa, Homo Sapiens
IIDPGDSDII

SEQ ID NO: 68088 - protein, 10 aa, Homo Sapiens
IIDTPGHESF

SEQ ID NO: 68089 - protein, 10 aa, Homo Sapiens
ILDESDHITM

SEQ ID NO: 68090 - protein, 10 aa, Homo Sapiens
ILEDLDLDKF

SEQ ID NO: 68091 - protein, 10 aa, Homo Sapiens
ILIDENDNKI

SEQ ID NO: 68092 - protein, 10 aa, Homo Sapiens
ILIGDPTVRW

SEQ ID NO: 68093 - protein, 10 aa, Homo Sapiens
ILMKDLADEL

SEQ ID NO: 68094 - protein, 10 aa, Homo Sapiens
ILNMEDDQNW

SEQ ID NO: 68095 - protein, 10 aa, Homo Sapiens
ILNSLYNENL

SEQ ID NO: 68096 - protein, 10 aa, Homo Sapiens
ILYDDKGACL

SEQ ID NO: 68097 - protein, 10 aa, Homo Sapiens
IMVAPDKDYF

SEQ ID NO: 68098 - protein, 10 aa, Homo Sapiens
IPAAIIFDIL

SEQ ID NO: 68099 - protein, 10 aa, Homo Sapiens
IPSQPFLTAL

SEQ ID NO: 68100 - protein, 10 aa, Homo Sapiens
IQAGQCGNQI

SEQ ID NO: 68101 - protein, 10 aa, Homo Sapiens
IQDAQDKLYL

SEQ ID NO: 68102 - protein, 10 aa, Homo Sapiens
IQDGKGDVTI

SEQ ID NO: 68103 - protein, 10 aa, Homo Sapiens
IQDKGSIQKF

SEQ ID NO: 68104 - protein, 10 aa, Homo Sapiens
IQDQGGWVRL

SEQ ID NO: 68105 - protein, 10 aa, Homo Sapiens
IQDSTEDHTW

SEQ ID NO: 68106 - protein, 10 aa, Homo Sapiens
IQENTQTPTV

SEQ ID NO: 68107 - protein, 10 aa, Homo Sapiens
IQFADDMQEF

SEQ ID NO: 68108 - protein, 10 aa, Homo Sapiens
IQIGCHTDDL

SEQ ID NO: 68109 - protein, 10 aa, Homo Sapiens
IQINQEEERL

SEQ ID NO: 68110 - protein, 10 aa, Homo Sapiens
IQQRGGEERL

SEQ ID NO: 68111 - protein, 10 aa, Homo Sapiens
IQSISLLDQL

SEQ ID NO: 68112 - protein, 10 aa, Homo Sapiens
IQTVPNLDWL

SEQ ID NO: 68113 - protein, 10 aa, Homo Sapiens
IQVEPVLDYL

SEQ ID NO: 68114 - protein, 10 aa, Homo Sapiens
IVAPDADARW

SEQ ID NO: 68115 - protein, 10 aa, Homo Sapiens
IVDGHSVEEL

SEQ ID NO: 68116 - protein, 10 aa, Homo Sapiens
IVIGDEHISF

SEQ ID NO: 68117 - protein, 10 aa, Homo Sapiens
KEAADIIQKL

SEQ ID NO: 68118 - protein, 10 aa, Homo Sapiens
KIAHVFLDLT

SEQ ID NO: 68119 - protein, 10 aa, Homo Sapiens
KIAKENLDVF

SEQ ID NO: 68120 - protein, 10 aa, Homo Sapiens
KIDGLLIDQI

SEQ ID NO: 68121 - protein, 10 aa, Homo Sapiens
KIDPSTLQMW

SEQ ID NO: 68122 - protein, 10 aa, Homo Sapiens
KIEDIDNEDW

SEQ ID NO: 68123 - protein, 10 aa, Homo Sapiens
KIIDETMAQL

SEQ ID NO: 68124 - protein, 10 aa, Homo Sapiens
KIIEDLGVHF

SEQ ID NO: 68125 - protein, 10 aa, Homo Sapiens
KIIGINGDFF

SEQ ID NO: 68126 - protein, 10 aa, Homo Sapiens
KIQQGALELL

SEQ ID NO: 68127 - protein, 10 aa, Homo Sapiens
KIVEIINEEL

SEQ ID NO: 68128 - protein, 10 aa, Homo Sapiens
KLADIQIEQL

SEQ ID NO: 68129 - protein, 10 aa, Homo Sapiens
KLAEAERVGL

SEQ ID NO: 68130 - protein, 10 aa, Homo Sapiens
KLAELKQECL

SEQ ID NO: 68131 - protein, 10 aa, Homo Sapiens
KLANVFFDTF

SEQ ID NO: 68132 - protein, 10 aa, Homo Sapiens
KLAQENMDLF

SEQ ID NO: 68133 - protein, 10 aa, Homo Sapiens
KLAQTYMDKL

SEQ ID NO: 68134 - protein, 10 aa, Homo Sapiens
KLASSELERL

SEQ ID NO: 68135 - protein, 10 aa, Homo Sapiens
KLCEGFNEVL

SEQ ID NO: 68136 - protein, 10 aa, Homo Sapiens
KLCRPSKDYL

SEQ ID NO: 68137 - protein, 10 aa, Homo Sapiens
KLDDTSLEFL

SEQ ID NO: 68138 - protein, 10 aa, Homo Sapiens
KLDPSIFESL

SEQ ID NO: 68139 - protein, 10 aa, Homo Sapiens
KLDQPFIDCI

SEQ ID NO: 68140 - protein, 10 aa, Homo Sapiens
KLDSGKELHI

SEQ ID NO: 68141 - protein, 10 aa, Homo Sapiens
KLDSGKELKI

SEQ ID NO: 68142 - protein, 10 aa, Homo Sapiens
KLEDIFQQEF

SEQ ID NO: 68143 - protein, 10 aa, Homo Sapiens
KLEDPHVDII

SEQ ID NO: 68144 - protein, 10 aa, Homo Sapiens
KLEEIDWVTF

SEQ ID NO: 68145 - protein, 10 aa, Homo Sapiens
KLEKNLSDRL

SEQ ID NO: 68146 - protein, 10 aa, Homo Sapiens
KLENGEIETI

SEQ ID NO: 68147 - protein, 10 aa, Homo Sapiens
KLFADAVQEL

SEQ ID NO: 68148 - protein, 10 aa, Homo Sapiens
KLFDDCTQQF

SEQ ID NO: 68149 - protein, 10 aa, Homo Sapiens
KLFEDGKTGF

SEQ ID NO: 68150 - protein, 10 aa, Homo Sapiens
KLFEGENEHL

SEQ ID NO: 68151 - protein, 10 aa, Homo Sapiens
KLFGEKSASF

SEQ ID NO: 68152 - protein, 10 aa, Homo Sapiens
KLFSEKRVEL

SEQ ID NO: 68153 - protein, 10 aa, Homo Sapiens
KLFTSEEEHL

SEQ ID NO: 68154 - protein, 10 aa, Homo Sapiens
KLIDDQDISI

SEQ ID NO: 68155 - protein, 10 aa, Homo Sapiens
KLIDDVHRLF

SEQ ID NO: 68156 - protein, 10 aa, Homo Sapiens
KLIDVTNIYW

SEQ ID NO: 68157 - protein, 10 aa, Homo Sapiens
KLIEESCPQL

SEQ ID NO: 68158 - protein, 10 aa, Homo Sapiens
KLIGDPNLEF

SEQ ID NO: 68159 - protein, 10 aa, Homo Sapiens
KLIGLAVDYF

SEQ ID NO: 68160 - protein, 10 aa, Homo Sapiens
KLIGRYFDEI

SEQ ID NO: 68161 - protein, 10 aa, Homo Sapiens
KLISSDGHEF

SEQ ID NO: 68162 - protein, 10 aa, Homo Sapiens
KLLDEKTSKL

SEQ ID NO: 68163 - protein, 10 aa, Homo Sapiens
KLLDLENENM

SEQ ID NO: 68164 - protein, 10 aa, Homo Sapiens
KLLDTMVDTF

SEQ ID NO: 68165 - protein, 10 aa, Homo Sapiens
KLLEDRIAEF

SEQ ID NO: 68166 - protein, 10 aa, Homo Sapiens
KLLEENVSAF

SEQ ID NO: 68167 - protein, 10 aa, Homo Sapiens
KLLEEQGIFL

SEQ ID NO: 68168 - protein, 10 aa, Homo Sapiens
KLLEGEEERL

SEQ ID NO: 68169 - protein, 10 aa, Homo Sapiens
KLLEGEESRI

SEQ ID NO: 68170 - protein, 10 aa, Homo Sapiens
KLLNTVGDLL

SEQ ID NO: 68171 - protein, 10 aa, Homo Sapiens
KLLPGIEVLW

SEQ ID NO: 68172 - protein, 10 aa, Homo Sapiens
KLLQEQDQEL

SEQ ID NO: 68173 - protein, 10 aa, Homo Sapiens
KLLRDDEAHL

SEQ ID NO: 68174 - protein, 10 aa, Homo Sapiens
KLLSQDFVQI

SEQ ID NO: 68175 - protein, 10 aa, Homo Sapiens
KLLTEKDAQI

SEQ ID NO: 68176 - protein, 10 aa, Homo Sapiens
KLMDLDVEQL

SEQ ID NO: 68177 - protein, 10 aa, Homo Sapiens
KLMKEDGTTL

SEQ ID NO: 68178 - protein, 10 aa, Homo Sapiens
KLMPNFSDSF

SEQ ID NO: 68179 - protein, 10 aa, Homo Sapiens
KLNTLETEEW

SEQ ID NO: 68180 - protein, 10 aa, Homo Sapiens
KLPEFYDETL

SEQ ID NO: 68181 - protein, 10 aa, Homo Sapiens
KLPSGEDYNL

SEQ ID NO: 68182 - protein, 10 aa, Homo Sapiens
KLPVHTEISW

SEQ ID NO: 68183 - protein, 10 aa, Homo Sapiens
KLSEELLDKW

SEQ ID NO: 68184 - protein, 10 aa, Homo Sapiens
KLTTAFEEVW

SEQ ID NO: 68185 - protein, 10 aa, Homo Sapiens
KLVNIRNDDI

SEQ ID NO: 68186 - protein, 10 aa, Homo Sapiens
KLVSIEKEKI

SEQ ID NO: 68187 - protein, 10 aa, Homo Sapiens
KLVYQIFDTF

SEQ ID NO: 68188 - protein, 10 aa, Homo Sapiens
KLWEMDNMLI

SEQ ID NO: 68189 - protein, 10 aa, Homo Sapiens
KLWNEVTTSF

SEQ ID NO: 68190 - protein, 10 aa, Homo Sapiens
KLYANMFERL

SEQ ID NO: 68191 - protein, 10 aa, Homo Sapiens
KLYEEINQVF

SEQ ID NO: 68192 - protein, 10 aa, Homo Sapiens
KLYENLGEYF

SEQ ID NO: 68193 - protein, 10 aa, Homo Sapiens
KLYSSEQLLI

SEQ ID NO: 68194 - protein, 10 aa, Homo Sapiens
KMDPSCTVGF

SEQ ID NO: 68195 - protein, 10 aa, Homo Sapiens
KMEDTDFVGW

SEQ ID NO: 68196 - protein, 10 aa, Homo Sapiens
KMIEDLQNEL

SEQ ID NO: 68197 - protein, 10 aa, Homo Sapiens
KMPSGEFARI

SEQ ID NO: 68198 - protein, 10 aa, Homo Sapiens
KMTQIMFETF

SEQ ID NO: 68199 - protein, 10 aa, Homo Sapiens
KMVDERTDYL

SEQ ID NO: 68200 - protein, 10 aa, Homo Sapiens
KMVKDLVASL

SEQ ID NO: 68201 - protein, 10 aa, Homo Sapiens
KQADEEFQIL

SEQ ID NO: 68202 - protein, 10 aa, Homo Sapiens
KQAEEKGVVL

SEQ ID NO: 68203 - protein, 10 aa, Homo Sapiens
KQAFGEKITM

SEQ ID NO: 68204 - protein, 10 aa, Homo Sapiens
KQAPPQKVSF

SEQ ID NO: 68205 - protein, 10 aa, Homo Sapiens
KQDALDYITW

SEQ ID NO: 68206 - protein, 10 aa, Homo Sapiens
KQDAVDYLTW

SEQ ID NO: 68207 - protein, 10 aa, Homo Sapiens
KQDPNYLATM

SEQ ID NO: 68208 - protein, 10 aa, Homo Sapiens
KQDSLKCDSL

SEQ ID NO: 68209 - protein, 10 aa, Homo Sapiens
KQDSLVILTI

SEQ ID NO: 68210 - protein, 10 aa, Homo Sapiens
KQFAPEYEKI

SEQ ID NO: 68211 - protein, 10 aa, Homo Sapiens
KQFDDVLIYL

SEQ ID NO: 68212 - protein, 10 aa, Homo Sapiens
KQFEGLADKL

SEQ ID NO: 68213 - protein, 10 aa, Homo Sapiens
KQFEPNDFYL

SEQ ID NO: 68214 - protein, 10 aa, Homo Sapiens
KQFGIDGESF

SEQ ID NO: 68215 - protein, 10 aa, Homo Sapiens
KQFHDSKIKF

SEQ ID NO: 68216 - protein, 10 aa, Homo Sapiens
KQFLSETEKM

SEQ ID NO: 68217 - protein, 10 aa, Homo Sapiens
KQFRTEMEDL

SEQ ID NO: 68218 - protein, 10 aa, Homo Sapiens
KQIEDQMTRL

SEQ ID NO: 68219 - protein, 10 aa, Homo Sapiens
KQIESDRQNL

SEQ ID NO: 68220 - protein, 10 aa, Homo Sapiens
KQIESLNDKL

SEQ ID NO: 68221 - protein, 10 aa, Homo Sapiens
KQIGVSVDTW

SEQ ID NO: 68222 - protein, 10 aa, Homo Sapiens
KQIKDDNQEI

SEQ ID NO: 68223 - protein, 10 aa, Homo Sapiens
KQILDGVHYL

SEQ ID NO: 68224 - protein, 10 aa, Homo Sapiens
KQILEGVYYL

SEQ ID NO: 68225 - protein, 10 aa, Homo Sapiens
KQIQEKQGQL

SEQ ID NO: 68226 - protein, 10 aa, Homo Sapiens
KQISKILEEF

SEQ ID NO: 68227 - protein, 10 aa, Homo Sapiens
KQISQAYEVL

SEQ ID NO: 68228 - protein, 10 aa, Homo Sapiens
KQITEDTVEF

SEQ ID NO: 68229 - protein, 10 aa, Homo Sapiens
KQITEENFQL

SEQ ID NO: 68230 - protein, 10 aa, Homo Sapiens
KQLAEEETKI

SEQ ID NO: 68231 - protein, 10 aa, Homo Sapiens
KQLDDLKVEL

SEQ ID NO: 68232 - protein, 10 aa, Homo Sapiens
KQLEAINDKL

SEQ ID NO: 68233 - protein, 10 aa, Homo Sapiens
KQLEEQNARL

SEQ ID NO: 68234 - protein, 10 aa, Homo Sapiens
KQLEIAHEKL

SEQ ID NO: 68235 - protein, 10 aa, Homo Sapiens
KQLEKDFSSM

SEQ ID NO: 68236 - protein, 10 aa, Homo Sapiens
KQLKEAQGKI

SEQ ID NO: 68237 - protein, 10 aa, Homo Sapiens
KQLLPVCDTW

SEQ ID NO: 68238 - protein, 10 aa, Homo Sapiens
KQLSGEEVSW

SEQ ID NO: 68239 - protein, 10 aa, Homo Sapiens
KQLSLKVDEL

SEQ ID NO: 68240 - protein, 10 aa, Homo Sapiens
KQMEDGHTLF

SEQ ID NO: 68241 - protein, 10 aa, Homo Sapiens
KQMEQISQFL

SEQ ID NO: 68242 - protein, 10 aa, Homo Sapiens
KQMKSEVATL

SEQ ID NO: 68243 - protein, 10 aa, Homo Sapiens
KQMLPLNTNI

SEQ ID NO: 68244 - protein, 10 aa, Homo Sapiens
KQMPDVNVSW

SEQ ID NO: 68245 - protein, 10 aa, Homo Sapiens
KQMQSDPHKL

SEQ ID NO: 68246 - protein, 10 aa, Homo Sapiens
KQMVEDYQWL

SEQ ID NO: 68247 - protein, 10 aa, Homo Sapiens
KQNAEELQDF

SEQ ID NO: 68248 - protein, 10 aa, Homo Sapiens
KQPEEVFDVL

SEQ ID NO: 68249 - protein, 10 aa, Homo Sapiens
KQQDVIYELI

SEQ ID NO: 68250 - protein, 10 aa, Homo Sapiens
KQQENVTLLL

SEQ ID NO: 68251 - protein, 10 aa, Homo Sapiens
KQTVCGFDLL

SEQ ID NO: 68252 - protein, 10 aa, Homo Sapiens
KQVDDLASVW

SEQ ID NO: 68253 - protein, 10 aa, Homo Sapiens
KQVEDDIQQL

SEQ ID NO: 68254 - protein, 10 aa, Homo Sapiens
KQVEDEKNSF

SEQ ID NO: 68255 - protein, 10 aa, Homo Sapiens
KQVMEGRVTF

SEQ ID NO: 68256 - protein, 10 aa, Homo Sapiens
KQVQADFITL

SEQ ID NO: 68257 - protein, 10 aa, Homo Sapiens
KQVQTLQDEL

SEQ ID NO: 68258 - protein, 10 aa, Homo Sapiens
KQVSDLISVL

SEQ ID NO: 68259 - protein, 10 aa, Homo Sapiens
KQVYDIAAKF

SEQ ID NO: 68260 - protein, 10 aa, Homo Sapiens
KQYEEFYVGL

SEQ ID NO: 68261 - protein, 10 aa, Homo Sapiens
KQYIISEELI

SEQ ID NO: 68262 - protein, 10 aa, Homo Sapiens
KQYKGIVDCI

SEQ ID NO: 68263 - protein, 10 aa, Homo Sapiens
KQYLSENEQW

SEQ ID NO: 68264 - protein, 10 aa, Homo Sapiens
KTDGGDPSGL

SEQ ID NO: 68265 - protein, 10 aa, Homo Sapiens
KTDPTERLTI

SEQ ID NO: 68266 - protein, 10 aa, Homo Sapiens
KTIGGGDDSF

SEQ ID NO: 68267 - protein, 10 aa, Homo Sapiens
KVFELDLVTL

SEQ ID NO: 68268 - protein, 10 aa, Homo Sapiens
KVFNGEGEQI

SEQ ID NO: 68269 - protein, 10 aa, Homo Sapiens
KVIGILQDGF

SEQ ID NO: 68270 - protein, 10 aa, Homo Sapiens
KVPQLEIVPN

SEQ ID NO: 68271 - protein, 10 aa, Homo Sapiens
LDKLSSLNKI

SEQ ID NO: 68272 - protein, 10 aa, Homo Sapiens
LLALVKPEVW

SEQ ID NO: 68273 - protein, 10 aa, Homo Sapiens
LLAPDGHLQF

SEQ ID NO: 68274 - protein, 10 aa, Homo Sapiens
LLAPSDVAGW

SEQ ID NO: 68275 - protein, 10 aa, Homo Sapiens
LLDCGWDEHF

SEQ ID NO: 68276 - protein, 10 aa, Homo Sapiens
LLDPDVVARF

SEQ ID NO: 68277 - protein, 10 aa, Homo Sapiens
LLDPEANECW

SEQ ID NO: 68278 - protein, 10 aa, Homo Sapiens
LLDSRSYETL

SEQ ID NO: 68279 - protein, 10 aa, Homo Sapiens
LLFEADTITL

SEQ ID NO: 68280 - protein, 10 aa, Homo Sapiens
LLFEGEKITI

SEQ ID NO: 68281 - protein, 10 aa, Homo Sapiens
LLFHLGAEEI

SEQ ID NO: 68282 - protein, 10 aa, Homo Sapiens
LLFNSKNEDL

SEQ ID NO: 68283 - protein, 10 aa, Homo Sapiens
LLFWDKETQI

SEQ ID NO: 68284 - protein, 10 aa, Homo Sapiens
LLGRGQEAHL

SEQ ID NO: 68285 - protein, 10 aa, Homo Sapiens
LLHQDVNTAW

SEQ ID NO: 68286 - protein, 10 aa, Homo Sapiens
LLLDDSLVSI

SEQ ID NO: 68287 - protein, 10 aa, Homo Sapiens
LLNPSYLDCF

SEQ ID NO: 68288 - protein, 10 aa, Homo Sapiens
LLQETAYERL

SEQ ID NO: 68289 - protein, 10 aa, Homo Sapiens
LLQFGPTEKF

SEQ ID NO: 68290 - protein, 10 aa, Homo Sapiens
LLSDDSKFGF

SEQ ID NO: 68291 - protein, 10 aa, Homo Sapiens
LLVPALGESW

SEQ ID NO: 68292 - protein, 10 aa, Homo Sapiens
LLYDDKGVGL

SEQ ID NO: 68293 - protein, 10 aa, Homo Sapiens
LMAQHFDEVW

SEQ ID NO: 68294 - protein, 10 aa, Homo Sapiens
LQANISPEFW

SEQ ID NO: 68295 - protein, 10 aa, Homo Sapiens
LQAPLGYDKF

SEQ ID NO: 68296 - protein, 10 aa, Homo Sapiens
LQAPSVKDFL

SEQ ID NO: 68297 - protein, 10 aa, Homo Sapiens
LQDGHEREYI

SEQ ID NO: 68298 - protein, 10 aa, Homo Sapiens
LQDPNNKSNW

SEQ ID NO: 68299 - protein, 10 aa, Homo Sapiens
LQDPTNLDKF

SEQ ID NO: 68300 - protein, 10 aa, Homo Sapiens
LQFDEKCLSI

SEQ ID NO: 68301 - protein, 10 aa, Homo Sapiens
LQIDDVTIKI

SEQ ID NO: 68302 - protein, 10 aa, Homo Sapiens
LQIEDFEARI

SEQ ID NO: 68303 - protein, 10 aa, Homo Sapiens
LQINQTFEEL

SEQ ID NO: 68304 - protein, 10 aa, Homo Sapiens
LQLDKEFQLF

SEQ ID NO: 68305 - protein, 10 aa, Homo Sapiens
LQSLLVEERL

SEQ ID NO: 68306 - protein, 10 aa, Homo Sapiens
LTRHYDPSKI

SEQ ID NO: 68307 - protein, 10 aa, Homo Sapiens
MQCDAKFDFL

SEQ ID NO: 68308 - protein, 10 aa, Homo Sapiens
MQCQAQVDQL

SEQ ID NO: 68309 - protein, 10 aa, Homo Sapiens
NQGSPEICGF

SEQ ID NO: 68310 - protein, 10 aa, Homo Sapiens
QEARNIYQEF

SEQ ID NO: 68311 - protein, 10 aa, Homo Sapiens
QLFQEYDNHI

SEQ ID NO: 68312 - protein, 10 aa, Homo Sapiens
QLHAAESDEF

SEQ ID NO: 68313 - protein, 10 aa, Homo Sapiens
QLIERILEAW

SEQ ID NO: 68314 - protein, 10 aa, Homo Sapiens
QLLKDPQVLF

SEQ ID NO: 68315 - protein, 10 aa, Homo Sapiens
QLQKPDVVGI

SEQ ID NO: 68316 - protein, 10 aa, Homo Sapiens
QQADASKQLW

SEQ ID NO: 68317 - protein, 10 aa, Homo Sapiens
QQAEEGSARL

SEQ ID NO: 68318 - protein, 10 aa, Homo Sapiens
QQARNVMQSW

SEQ ID NO: 68319 - protein, 10 aa, Homo Sapiens
QQDPVIYQRL

SEQ ID NO: 68320 - protein, 10 aa, Homo Sapiens
QQFSKVIDEL

SEQ ID NO: 68321 - protein, 10 aa, Homo Sapiens
QQHQALQTNW

SEQ ID NO: 68322 - protein, 10 aa, Homo Sapiens
QQIAKDMERW

SEQ ID NO: 68323 - protein, 10 aa, Homo Sapiens
QQIEELENHL

SEQ ID NO: 68324 - protein, 10 aa, Homo Sapiens
QQIKDLEQKL

SEQ ID NO: 68325 - protein, 10 aa, Homo Sapiens
QQIQEKVATF

SEQ ID NO: 68326 - protein, 10 aa, Homo Sapiens
QQMEAEHNTL

SEQ ID NO: 68327 - protein, 10 aa, Homo Sapiens
QQNPGKFDEL

SEQ ID NO: 68328 - protein, 10 aa, Homo Sapiens
QQTALCNDYF

SEQ ID NO: 68329 - protein, 10 aa, Homo Sapiens
QRVEEELLAL

SEQ ID NO: 68330 - protein, 10 aa, Homo Sapiens
QVARPGGDTI

SEQ ID NO: 68331 - protein, 10 aa, Homo Sapiens
QVGQLAAAGI

SEQ ID NO: 68332 - protein, 10 aa, Homo Sapiens
QVVEDGYEFF

SEQ ID NO: 68333 - protein, 10 aa, Homo Sapiens
RAGDLVELLL

SEQ ID NO: 68334 - protein, 10 aa, Homo Sapiens
RAIMDKKANI

SEQ ID NO: 68335 - protein, 10 aa, Homo Sapiens
RAVDDGVNTF

SEQ ID NO: 68336 - protein, 10 aa, Homo Sapiens
REACPELDYF

SEQ ID NO: 68337 - protein, 10 aa, Homo Sapiens
REAFLVNSDL

SEQ ID NO: 68338 - protein, 10 aa, Homo Sapiens
REAGNINQSL

SEQ ID NO: 68339 - protein, 10 aa, Homo Sapiens
RESPNITDRW

SEQ ID NO: 68340 - protein, 10 aa, Homo Sapiens
RIADEDRGNW

SEQ ID NO: 68341 - protein, 10 aa, Homo Sapiens
RIAEEVNCLL

SEQ ID NO: 68342 - protein, 10 aa, Homo Sapiens
RIDPFVRTFL

SEQ ID NO: 68343 - protein, 10 aa, Homo Sapiens
RIEENTGHTF

SEQ ID NO: 68344 - protein, 10 aa, Homo Sapiens
RIESVIKELW

SEQ ID NO: 68345 - protein, 10 aa, Homo Sapiens
RIFSGGDQSF

SEQ ID NO: 68346 - protein, 10 aa, Homo Sapiens
RIHNEDNSQF

SEQ ID NO: 68347 - protein, 10 aa, Homo Sapiens
RIIDEVVNKF

SEQ ID NO: 68348 - protein, 10 aa, Homo Sapiens
RIIEAEESRM

SEQ ID NO: 68349 - protein, 10 aa, Homo Sapiens
RIIKDVVLQW

SEQ ID NO: 68350 - protein, 10 aa, Homo Sapiens
RIIKNEVKKL

SEQ ID NO: 68351 - protein, 10 aa, Homo Sapiens
RIIKVGGERF

SEQ ID NO: 68352 - protein, 10 aa, Homo Sapiens
RIINDLLQSL

SEQ ID NO: 68353 - protein, 10 aa, Homo Sapiens
RIIWQEEDTF

SEQ ID NO: 68354 - protein, 10 aa, Homo Sapiens
RIKEDVGDNW

SEQ ID NO: 68355 - protein, 10 aa, Homo Sapiens
RILAAETDRL

SEQ ID NO: 68356 - protein, 10 aa, Homo Sapiens
RILADLEDYL

SEQ ID NO: 68357 - protein, 10 aa, Homo Sapiens
RILATLEDGW

SEQ ID NO: 68358 - protein, 10 aa, Homo Sapiens
RILDLIDDAW

SEQ ID NO: 68359 - protein, 10 aa, Homo Sapiens
RILELDQELI

SEQ ID NO: 68360 - protein, 10 aa, Homo Sapiens
RILGSDTESW

SEQ ID NO: 68361 - protein, 10 aa, Homo Sapiens
RILQDEQYLM

SEQ ID NO: 68362 - protein, 10 aa, Homo Sapiens
RIMKIDIEKF

SEQ ID NO: 68363 - protein, 10 aa, Homo Sapiens
RINEDQKVAL

SEQ ID NO: 68364 - protein, 10 aa, Homo Sapiens
RINNEDNSQF

SEQ ID NO: 68365 - protein, 10 aa, Homo Sapiens
RIQNSGAEAW

SEQ ID NO: 68366 - protein, 10 aa, Homo Sapiens
RIQQESGCKI

SEQ ID NO: 68367 - protein, 10 aa, Homo Sapiens
RISDDKYGRI

SEQ ID NO: 68368 - protein, 10 aa, Homo Sapiens
RISEDVEERL

SEQ ID NO: 68369 - protein, 10 aa, Homo Sapiens
RISKDEHQDL

SEQ ID NO: 68370 - protein, 10 aa, Homo Sapiens
RISKEEAMRW

SEQ ID NO: 68371 - protein, 10 aa, Homo Sapiens
RISPDQGQQF

SEQ ID NO: 68372 - protein, 10 aa, Homo Sapiens
RISVIQKEEF

SEQ ID NO: 68373 - protein, 10 aa, Homo Sapiens
RIVDDCGGAF

SEQ ID NO: 68374 - protein, 10 aa, Homo Sapiens
RIVDDFGTHL

SEQ ID NO: 68375 - protein, 10 aa, Homo Sapiens
RIVKESGGKL

SEQ ID NO: 68376 - protein, 10 aa, Homo Sapiens
RIVKIGDFGL

SEQ ID NO: 68377 - protein, 10 aa, Homo Sapiens
RIWGTEGDSW

SEQ ID NO: 68378 - protein, 10 aa, Homo Sapiens
RIYWDGPLAL

SEQ ID NO: 68379 - protein, 10 aa, Homo Sapiens
RLAALEEQRM

SEQ ID NO: 68380 - protein, 10 aa, Homo Sapiens
RLADDLNEKI

SEQ ID NO: 68381 - protein, 10 aa, Homo Sapiens
RLADEFGVAV

SEQ ID NO: 68382 - protein, 10 aa, Homo Sapiens
RLAEAEKSQL

SEQ ID NO: 68383 - protein, 10 aa, Homo Sapiens
RLAEDVSDQL

SEQ ID NO: 68384 - protein, 10 aa, Homo Sapiens
RLAEERHNRL

SEQ ID NO: 68385 - protein, 10 aa, Homo Sapiens
RLAEEVNDKL

SEQ ID NO: 68386 - protein, 10 aa, Homo Sapiens
RLAEFLGDQM

SEQ ID NO: 68387 - protein, 10 aa, Homo Sapiens
RLAELTVDEF

SEQ ID NO: 68388 - protein, 10 aa, Homo Sapiens
RLAKELLDSF

SEQ ID NO: 68389 - protein, 10 aa, Homo Sapiens
RLALPDYEYL

SEQ ID NO: 68390 - protein, 10 aa, Homo Sapiens
RLANIDEEML

SEQ ID NO: 68391 - protein, 10 aa, Homo Sapiens
RLAQEAASKL

SEQ ID NO: 68392 - protein, 10 aa, Homo Sapiens
RLAQEGIYTL

SEQ ID NO: 68393 - protein, 10 aa, Homo Sapiens
RLAQEGKDCL

SEQ ID NO: 68394 - protein, 10 aa, Homo Sapiens
RLAQTHRDAL

SEQ ID NO: 68395 - protein, 10 aa, Homo Sapiens
RLASLKTDTF

SEQ ID NO: 68396 - protein, 10 aa, Homo Sapiens
RLASLNAEAL

SEQ ID NO: 68397 - protein, 10 aa, Homo Sapiens
RLAVDKSASL

SEQ ID NO: 68398 - protein, 10 aa, Homo Sapiens
RLAYCQSEEL

SEQ ID NO: 68399 - protein, 10 aa, Homo Sapiens
RLAYSEPCGL

SEQ ID NO: 68400 - protein, 10 aa, Homo Sapiens
RLCHEDVEAL

SEQ ID NO: 68401 - protein, 10 aa, Homo Sapiens
RLCPTHADSL

SEQ ID NO: 68402 - protein, 10 aa, Homo Sapiens
RLDDLFLESF

SEQ ID NO: 68403 - protein, 10 aa, Homo Sapiens
RLDDSSFLGL

SEQ ID NO: 68404 - protein, 10 aa, Homo Sapiens
RLDDSVFEGL

SEQ ID NO: 68405 - protein, 10 aa, Homo Sapiens
RLDDTVHVVI

SEQ ID NO: 68406 - protein, 10 aa, Homo Sapiens
RLDGGTDITF

SEQ ID NO: 68407 - protein, 10 aa, Homo Sapiens
RLDGHTISDL

SEQ ID NO: 68408 - protein, 10 aa, Homo Sapiens
RLDQEHSDKF

SEQ ID NO: 68409 - protein, 10 aa, Homo Sapiens
RLDQPKLDEV

SEQ ID NO: 68410 - protein, 10 aa, Homo Sapiens
RLDRTEIITF

SEQ ID NO: 68411 - protein, 10 aa, Homo Sapiens
RLDSDAVNTI

SEQ ID NO: 68412 - protein, 10 aa, Homo Sapiens
RLDSIVGPQL

SEQ ID NO: 68413 - protein, 10 aa, Homo Sapiens
RLDSVACDVL

SEQ ID NO: 68414 - protein, 10 aa, Homo Sapiens
RLEASETESF

SEQ ID NO: 68415 - protein, 10 aa, Homo Sapiens
RLEASSSQSF

SEQ ID NO: 68416 - protein, 10 aa, Homo Sapiens
RLEDTKNNNL

SEQ ID NO: 68417 - protein, 10 aa, Homo Sapiens
RLEEGHRQYL

SEQ ID NO: 68418 - protein, 10 aa, Homo Sapiens
RLEFPSGETI

SEQ ID NO: 68419 - protein, 10 aa, Homo Sapiens
RLEGREFEFL

SEQ ID NO: 68420 - protein, 10 aa, Homo Sapiens
RLEKGVDVKF

SEQ ID NO: 68421 - protein, 10 aa, Homo Sapiens
RLEKNVKEVL

SEQ ID NO: 68422 - protein, 10 aa, Homo Sapiens
RLENDGATAL

SEQ ID NO: 68423 - protein, 10 aa, Homo Sapiens
RLEQEEQQRL

SEQ ID NO: 68424 - protein, 10 aa, Homo Sapiens
RLEQGYELQF

SEQ ID NO: 68425 - protein, 10 aa, Homo Sapiens
RLEQIKKTEL

SEQ ID NO: 68426 - protein, 10 aa, Homo Sapiens
RLERSIRDEI

SEQ ID NO: 68427 - protein, 10 aa, Homo Sapiens
RLESFLHDSW

SEQ ID NO: 68428 - protein, 10 aa, Homo Sapiens
RLFDANKDRF

SEQ ID NO: 68429 - protein, 10 aa, Homo Sapiens
RLFEDTFVNF

SEQ ID NO: 68430 - protein, 10 aa, Homo Sapiens
RLFELAKDYM

SEQ ID NO: 68431 - protein, 10 aa, Homo Sapiens
RLFGDVEASL

SEQ ID NO: 68432 - protein, 10 aa, Homo Sapiens
RLFGGDMEKF

SEQ ID NO: 68433 - protein, 10 aa, Homo Sapiens
RLFHEDGECW

SEQ ID NO: 68434 - protein, 10 aa, Homo Sapiens
RLFIQKEEQL

SEQ ID NO: 68435 - protein, 10 aa, Homo Sapiens
RLFKEGKERM

SEQ ID NO: 68436 - protein, 10 aa, Homo Sapiens
RLFKIDKEYL

SEQ ID NO: 68437 - protein, 10 aa, Homo Sapiens
RLFKNDPLFF

SEQ ID NO: 68438 - protein, 10 aa, Homo Sapiens
RLFNDPVAMV

SEQ ID NO: 68439 - protein, 10 aa, Homo Sapiens
RLFPGLAIKI

SEQ ID NO: 68440 - protein, 10 aa, Homo Sapiens
RLFSEIQTTL

SEQ ID NO: 68441 - protein, 10 aa, Homo Sapiens
RLFSKSIETL

SEQ ID NO: 68442 - protein, 10 aa, Homo Sapiens
RLFTSAEETF

SEQ ID NO: 68443 - protein, 10 aa, Homo Sapiens
RLFYFSNEKY

SEQ ID NO: 68444 - protein, 10 aa, Homo Sapiens
RLGGTKQDYL

SEQ ID NO: 68445 - protein, 10 aa, Homo Sapiens
RLGKNGADEI

SEQ ID NO: 68446 - protein, 10 aa, Homo Sapiens
RLHNVFNDFL

SEQ ID NO: 68447 - protein, 10 aa, Homo Sapiens
RLHQEERMKL

SEQ ID NO: 68448 - protein, 10 aa, Homo Sapiens
RLHSLDRVYF

SEQ ID NO: 68449 - protein, 10 aa, Homo Sapiens
RLHVCEVDSL

SEQ ID NO: 68450 - protein, 10 aa, Homo Sapiens
RLHVTALDYL

SEQ ID NO: 68451 - protein, 10 aa, Homo Sapiens
RLHWIDREKL

SEQ ID NO: 68452 - protein, 10 aa, Homo Sapiens
RLIAEKRSLF

SEQ ID NO: 68453 - protein, 10 aa, Homo Sapiens
RLIDHDPCLF

SEQ ID NO: 68454 - protein, 10 aa, Homo Sapiens
RLIEVTEEEL

SEQ ID NO: 68455 - protein, 10 aa, Homo Sapiens
RLIKEELIRL

SEQ ID NO: 68456 - protein, 10 aa, Homo Sapiens
RLIKEKEEAF

SEQ ID NO: 68457 - protein, 10 aa, Homo Sapiens
RLINLVGESL

SEQ ID NO: 68458 - protein, 10 aa, Homo Sapiens
RLIRDLHQHL

SEQ ID NO: 68459 - protein, 10 aa, Homo Sapiens
RLISQIVSSI

SEQ ID NO: 68460 - protein, 10 aa, Homo Sapiens
RLIYDTKGRF

SEQ ID NO: 68461 - protein, 10 aa, Homo Sapiens
RLKEAEEERL

SEQ ID NO: 68462 - protein, 10 aa, Homo Sapiens
RLKEEGNEQF

SEQ ID NO: 68463 - protein, 10 aa, Homo Sapiens
RLKEIKEELL

SEQ ID NO: 68464 - protein, 10 aa, Homo Sapiens
RLLAEEEQQL

SEQ ID NO: 68465 - protein, 10 aa, Homo Sapiens
RLLAETHYQL

SEQ ID NO: 68466 - protein, 10 aa, Homo Sapiens
RLLDKESSKW

SEQ ID NO: 68467 - protein, 10 aa, Homo Sapiens
RLLDLENSLL

SEQ ID NO: 68468 - protein, 10 aa, Homo Sapiens
RLLEEEGVSL

SEQ ID NO: 68469 - protein, 10 aa, Homo Sapiens
RLLEEEIIAF

SEQ ID NO: 68470 - protein, 10 aa, Homo Sapiens
RLLGEASSNW

SEQ ID NO: 68471 - protein, 10 aa, Homo Sapiens
RLLKDYEDKI

SEQ ID NO: 68472 - protein, 10 aa, Homo Sapiens
RLLLAGYDDF

SEQ ID NO: 68473 - protein, 10 aa, Homo Sapiens
RLLLPVAEYF

SEQ ID NO: 68474 - protein, 10 aa, Homo Sapiens
RLLNNAFEEL

SEQ ID NO: 68475 - protein, 10 aa, Homo Sapiens
RLLPGLVETF

SEQ ID NO: 68476 - protein, 10 aa, Homo Sapiens
RLLPSELTLW

SEQ ID NO: 68477 - protein, 10 aa, Homo Sapiens
RLLQDHPWLL

SEQ ID NO: 68478 - protein, 10 aa, Homo Sapiens
RLLQEKVNQL

SEQ ID NO: 68479 - protein, 10 aa, Homo Sapiens
RLLSLVKEEF

SEQ ID NO: 68480 - protein, 10 aa, Homo Sapiens
RLLSVEHEDF

SEQ ID NO: 68481 - protein, 10 aa, Homo Sapiens
RLLSVGGEAF

SEQ ID NO: 68482 - protein, 10 aa, Homo Sapiens
RLLTEISSSW

SEQ ID NO: 68483 - protein, 10 aa, Homo Sapiens
RLLYPPETGL

SEQ ID NO: 68484 - protein, 10 aa, Homo Sapiens
RLMEIYQEKL

SEQ ID NO: 68485 - protein, 10 aa, Homo Sapiens
RLMGSVKDHL

SEQ ID NO: 68486 - protein, 10 aa, Homo Sapiens
RLMIVKKEKL

SEQ ID NO: 68487 - protein, 10 aa, Homo Sapiens
RLMKELNQKL

SEQ ID NO: 68488 - protein, 10 aa, Homo Sapiens
RLMMDPLTGL

SEQ ID NO: 68489 - protein, 10 aa, Homo Sapiens
RLMQEVNRQL

SEQ ID NO: 68490 - protein, 10 aa, Homo Sapiens
RLMQGDEICL

SEQ ID NO: 68491 - protein, 10 aa, Homo Sapiens
RLMQKKETNL

SEQ ID NO: 68492 - protein, 10 aa, Homo Sapiens
RLMVPVTVVF

SEQ ID NO: 68493 - protein, 10 aa, Homo Sapiens
RLNEKNYELL

SEQ ID NO: 68494 - protein, 10 aa, Homo Sapiens
RLNHEGKIVL

SEQ ID NO: 68495 - protein, 10 aa, Homo Sapiens
RLNKDRCVRL

SEQ ID NO: 68496 - protein, 10 aa, Homo Sapiens
RLNLVECDYF

SEQ ID NO: 68497 - protein, 10 aa, Homo Sapiens
RLNQSQREEL

SEQ ID NO: 68498 - protein, 10 aa, Homo Sapiens
RLNRQLEEKI

SEQ ID NO: 68499 - protein, 10 aa, Homo Sapiens
RLNSELQQQL

SEQ ID NO: 68500 - protein, 10 aa, Homo Sapiens
RLPAEDEVLL

SEQ ID NO: 68501 - protein, 10 aa, Homo Sapiens
RLPDAAEPCL

SEQ ID NO: 68502 - protein, 10 aa, Homo Sapiens
RLPDEKVELF

SEQ ID NO: 68503 - protein, 10 aa, Homo Sapiens
RLPDLIKEVL

SEQ ID NO: 68504 - protein, 10 aa, Homo Sapiens
RLPEEEFGHF

SEQ ID NO: 68505 - protein, 10 aa, Homo Sapiens
RLPEEEHEFF

SEQ ID NO: 68506 - protein, 10 aa, Homo Sapiens
RLPEEVVDFL

SEQ ID NO: 68507 - protein, 10 aa, Homo Sapiens
RLPGGNEIGM

SEQ ID NO: 68508 - protein, 10 aa, Homo Sapiens
RLPGGPTLTF

SEQ ID NO: 68509 - protein, 10 aa, Homo Sapiens
RLPGYAEVLL

SEQ ID NO: 68510 - protein, 10 aa, Homo Sapiens
RLPHSGEAQL

SEQ ID NO: 68511 - protein, 10 aa, Homo Sapiens
RLPKILEDGL

SEQ ID NO: 68512 - protein, 10 aa, Homo Sapiens
RLPTEEEWEF

SEQ ID NO: 68513 - protein, 10 aa, Homo Sapiens
RLQAKKEEII

SEQ ID NO: 68514 - protein, 10 aa, Homo Sapiens
RLQDLGMELL

SEQ ID NO: 68515 - protein, 10 aa, Homo Sapiens
RLQEEFEATL

SEQ ID NO: 68516 - protein, 10 aa, Homo Sapiens
RLQEEKLCKI

SEQ ID NO: 68517 - protein, 10 aa, Homo Sapiens
RLQEETGAKI

SEQ ID NO: 68518 - protein, 10 aa, Homo Sapiens
RLQEPKKDLI

SEQ ID NO: 68519 - protein, 10 aa, Homo Sapiens
RLQQEVEEQL

SEQ ID NO: 68520 - protein, 10 aa, Homo Sapiens
RLSAEERDQL

SEQ ID NO: 68521 - protein, 10 aa, Homo Sapiens
RLSESDYEKL

SEQ ID NO: 68522 - protein, 10 aa, Homo Sapiens
RLSKEDIERM

SEQ ID NO: 68523 - protein, 10 aa, Homo Sapiens
RLSMNVGDQF

SEQ ID NO: 68524 - protein, 10 aa, Homo Sapiens
RLSPSGDSVF

SEQ ID NO: 68525 - protein, 10 aa, Homo Sapiens
RLSQALKEHL

SEQ ID NO: 68526 - protein, 10 aa, Homo Sapiens
RLSQETQQYF

SEQ ID NO: 68527 - protein, 10 aa, Homo Sapiens
RLSRTPGNRI

SEQ ID NO: 68528 - protein, 10 aa, Homo Sapiens
RLSVGTNEKI

SEQ ID NO: 68529 - protein, 10 aa, Homo Sapiens
RLTNAGYDYL

SEQ ID NO: 68530 - protein, 10 aa, Homo Sapiens
RLVAGSTDQL

SEQ ID NO: 68531 - protein, 10 aa, Homo Sapiens
RLVAVEENVW

SEQ ID NO: 68532 - protein, 10 aa, Homo Sapiens
RLVDPHIEMI

SEQ ID NO: 68533 - protein, 10 aa, Homo Sapiens
RLVDTGDKFR

SEQ ID NO: 68534 - protein, 10 aa, Homo Sapiens
RLVEDMENKI

SEQ ID NO: 68535 - protein, 10 aa, Homo Sapiens
RLVEEKVNQL

SEQ ID NO: 68536 - protein, 10 aa, Homo Sapiens
RLVESDPQGL

SEQ ID NO: 68537 - protein, 10 aa, Homo Sapiens
RLVEVNGENV

SEQ ID NO: 68538 - protein, 10 aa, Homo Sapiens
RLVKDQEALM

SEQ ID NO: 68539 - protein, 10 aa, Homo Sapiens
RLVLEVAQHL

SEQ ID NO: 68540 - protein, 10 aa, Homo Sapiens
RLVNQEIEKF

SEQ ID NO: 68541 - protein, 10 aa, Homo Sapiens
RLVPDSDVRF

SEQ ID NO: 68542 - protein, 10 aa, Homo Sapiens
RLVRDLVTGF

SEQ ID NO: 68543 - protein, 10 aa, Homo Sapiens
RLVREIAQDF

SEQ ID NO: 68544 - protein, 10 aa, Homo Sapiens
RLVRELEKKF

SEQ ID NO: 68545 - protein, 10 aa, Homo Sapiens
RLVSLIFNSF

SEQ ID NO: 68546 - protein, 10 aa, Homo Sapiens
RLWKNVYDEL

SEQ ID NO: 68547 - protein, 10 aa, Homo Sapiens
RLWNETVELF

SEQ ID NO: 68548 - protein, 10 aa, Homo Sapiens
RLWNIQTDTL

SEQ ID NO: 68549 - protein, 10 aa, Homo Sapiens
RLYHEDHPQL

SEQ ID NO: 68550 - protein, 10 aa, Homo Sapiens
RLYNKIREDF

SEQ ID NO: 68551 - protein, 10 aa, Homo Sapiens
RLYPEGLAQL

SEQ ID NO: 68552 - protein, 10 aa, Homo Sapiens
RLYYIGGEVF

SEQ ID NO: 68553 - protein, 10 aa, Homo Sapiens
RMCKPPGDRL

SEQ ID NO: 68554 - protein, 10 aa, Homo Sapiens
RMEAPKIDRI

SEQ ID NO: 68555 - protein, 10 aa, Homo Sapiens
RMESVFNQAI

SEQ ID NO: 68556 - protein, 10 aa, Homo Sapiens
RMFADDLHNL

SEQ ID NO: 68557 - protein, 10 aa, Homo Sapiens
RMFNSIAETW

SEQ ID NO: 68558 - protein, 10 aa, Homo Sapiens
RMHDEKVDLW

SEQ ID NO: 68559 - protein, 10 aa, Homo Sapiens
RMHNEKVDLW

SEQ ID NO: 68560 - protein, 10 aa, Homo Sapiens
RMIKEFRATL

SEQ ID NO: 68561 - protein, 10 aa, Homo Sapiens
RMIKQLKEEL

SEQ ID NO: 68562 - protein, 10 aa, Homo Sapiens
RMIMEGQYQF

SEQ ID NO: 68563 - protein, 10 aa, Homo Sapiens
RMKGGEKIGI

SEQ ID NO: 68564 - protein, 10 aa, Homo Sapiens
RMLDSGADYL

SEQ ID NO: 68565 - protein, 10 aa, Homo Sapiens
RMLEESNLSF

SEQ ID NO: 68566 - protein, 10 aa, Homo Sapiens
RMQVANIDKF

SEQ ID NO: 68567 - protein, 10 aa, Homo Sapiens
RMTLADDVTL

SEQ ID NO: 68568 - protein, 10 aa, Homo Sapiens
RMVDENCVGF

SEQ ID NO: 68569 - protein, 10 aa, Homo Sapiens
RMVEEIGVEL

SEQ ID NO: 68570 - protein, 10 aa, Homo Sapiens
RMVQNLLDKL

SEQ ID NO: 68571 - protein, 10 aa, Homo Sapiens
RMVSEAGTGF

SEQ ID NO: 68572 - protein, 10 aa, Homo Sapiens
RMYDERAQEW

SEQ ID NO: 68573 - protein, 10 aa, Homo Sapiens
RQAADFAEQF

SEQ ID NO: 68574 - protein, 10 aa, Homo Sapiens
RQADCHINNL

SEQ ID NO: 68575 - protein, 10 aa, Homo Sapiens
RQADFEAHNI

SEQ ID NO: 68576 - protein, 10 aa, Homo Sapiens
RQAEELFHNL

SEQ ID NO: 68577 - protein, 10 aa, Homo Sapiens
RQAEEQIEHL

SEQ ID NO: 68578 - protein, 10 aa, Homo Sapiens
RQAFPNTNRW

SEQ ID NO: 68579 - protein, 10 aa, Homo Sapiens
RQAHLTNQYM

SEQ ID NO: 68580 - protein, 10 aa, Homo Sapiens
RQAIEELYYF

SEQ ID NO: 68581 - protein, 10 aa, Homo Sapiens
RQAKLDYQRL

SEQ ID NO: 68582 - protein, 10 aa, Homo Sapiens
RQALETAVNL

SEQ ID NO: 68583 - protein, 10 aa, Homo Sapiens
RQANEEYQIL

SEQ ID NO: 68584 - protein, 10 aa, Homo Sapiens
RQAQQERDEL

SEQ ID NO: 68585 - protein, 10 aa, Homo Sapiens
RQAQTDRVSL

SEQ ID NO: 68586 - protein, 10 aa, Homo Sapiens
RQATSTASTF

SEQ ID NO: 68587 - protein, 10 aa, Homo Sapiens
RQAVQILDEL

SEQ ID NO: 68588 - protein, 10 aa, Homo Sapiens
RQAWLGEEVL

SEQ ID NO: 68589 - protein, 10 aa, Homo Sapiens
RQCLHEVHQI

SEQ ID NO: 68590 - protein, 10 aa, Homo Sapiens
RQCPLALDAI

SEQ ID NO: 68591 - protein, 10 aa, Homo Sapiens
RQCQPQVQAF

SEQ ID NO: 68592 - protein, 10 aa, Homo Sapiens
RQCVEKEERF

SEQ ID NO: 68593 - protein, 10 aa, Homo Sapiens
RQDAGGILHI

SEQ ID NO: 68594 - protein, 10 aa, Homo Sapiens
RQDAVMQQVF

SEQ ID NO: 68595 - protein, 10 aa, Homo Sapiens
RQDCVKEIGL

SEQ ID NO: 68596 - protein, 10 aa, Homo Sapiens
RQDDPSYRSF

SEQ ID NO: 68597 - protein, 10 aa, Homo Sapiens
RQDEKCDYYF

SEQ ID NO: 68598 - protein, 10 aa, Homo Sapiens
RQDGGQNESF

SEQ ID NO: 68599 - protein, 10 aa, Homo Sapiens
RQDINKEHLW

SEQ ID NO: 68600 - protein, 10 aa, Homo Sapiens
RQDMLTLQMI

SEQ ID NO: 68601 - protein, 10 aa, Homo Sapiens
RQDNPKLDSM

SEQ ID NO: 68602 - protein, 10 aa, Homo Sapiens
RQDQLILQII

SEQ ID NO: 68603 - protein, 10 aa, Homo Sapiens
RQDWGPITSI

SEQ ID NO: 68604 - protein, 10 aa, Homo Sapiens
RQEDAEYQAF

SEQ ID NO: 68605 - protein, 10 aa, Homo Sapiens
RQEDGIKNFF

SEQ ID NO: 68606 - protein, 10 aa, Homo Sapiens
RQEMIATQKL

SEQ ID NO: 68607 - protein, 10 aa, Homo Sapiens
RQENEQRRLF

SEQ ID NO: 68608 - protein, 10 aa, Homo Sapiens
RQERVMFDKI

SEQ ID NO: 68609 - protein, 10 aa, Homo Sapiens
RQESESVLTL

SEQ ID NO: 68610 - protein, 10 aa, Homo Sapiens
RQESGNNEVI

SEQ ID NO: 68611 - protein, 10 aa, Homo Sapiens
RQESVTKQQW

SEQ ID NO: 68612 - protein, 10 aa, Homo Sapiens
RQETEEKILL

SEQ ID NO: 68613 - protein, 10 aa, Homo Sapiens
RQFEDEKANW

SEQ ID NO: 68614 - protein, 10 aa, Homo Sapiens
RQFEEQKQKL

SEQ ID NO: 68615 - protein, 10 aa, Homo Sapiens
RQFEFSVDSF

SEQ ID NO: 68616 - protein, 10 aa, Homo Sapiens
RQFHEKTSAL

SEQ ID NO: 68617 - protein, 10 aa, Homo Sapiens
RQFKEIAAVI

SEQ ID NO: 68618 - protein, 10 aa, Homo Sapiens
RQFLRGLDFL

SEQ ID NO: 68619 - protein, 10 aa, Homo Sapiens
RQFSGARNQL

SEQ ID NO: 68620 - protein, 10 aa, Homo Sapiens
RQGEAEFNRI

SEQ ID NO: 68621 - protein, 10 aa, Homo Sapiens
RQHALLQEEL

SEQ ID NO: 68622 - protein, 10 aa, Homo Sapiens
RQHFIQEEQI

SEQ ID NO: 68623 - protein, 10 aa, Homo Sapiens
RQHLGKGHLL

SEQ ID NO: 68624 - protein, 10 aa, Homo Sapiens
RQHLQEVGLF

SEQ ID NO: 68625 - protein, 10 aa, Homo Sapiens
RQICPSLAGF

SEQ ID NO: 68626 - protein, 10 aa, Homo Sapiens
RQIDLVDNYF

SEQ ID NO: 68627 - protein, 10 aa, Homo Sapiens
RQIDQMVGLI

SEQ ID NO: 68628 - protein, 10 aa, Homo Sapiens
RQIDRENQRL

SEQ ID NO: 68629 - protein, 10 aa, Homo Sapiens
RQIEETLAHF

SEQ ID NO: 68630 - protein, 10 aa, Homo Sapiens
RQIEKDITSF

SEQ ID NO: 68631 - protein, 10 aa, Homo Sapiens
RQIGDKDQKI

SEQ ID NO: 68632 - protein, 10 aa, Homo Sapiens
RQIGEGQVSL

SEQ ID NO: 68633 - protein, 10 aa, Homo Sapiens
RQIHANHETL

SEQ ID NO: 68634 - protein, 10 aa, Homo Sapiens
RQIKEGAGVW

SEQ ID NO: 68635 - protein, 10 aa, Homo Sapiens
RQIKEQGKTI

SEQ ID NO: 68636 - protein, 10 aa, Homo Sapiens
RQILEGVHFL

SEQ ID NO: 68637 - protein, 10 aa, Homo Sapiens
RQILEGVHYL

SEQ ID NO: 68638 - protein, 10 aa, Homo Sapiens
RQILEKAGGL

SEQ ID NO: 68639 - protein, 10 aa, Homo Sapiens
RQILEKAIQL

SEQ ID NO: 68640 - protein, 10 aa, Homo Sapiens
RQINEDNERW

SEQ ID NO: 68641 - protein, 10 aa, Homo Sapiens
RQIQLIREML

SEQ ID NO: 68642 - protein, 10 aa, Homo Sapiens
RQIRSDFVTL

SEQ ID NO: 68643 - protein, 10 aa, Homo Sapiens
RQISALEDDL

SEQ ID NO: 68644 - protein, 10 aa, Homo Sapiens
RQISQDFSEL

SEQ ID NO: 68645 - protein, 10 aa, Homo Sapiens
RQISSAMEQL

SEQ ID NO: 68646 - protein, 10 aa, Homo Sapiens
RQIYGPECTF

SEQ ID NO: 68647 - protein, 10 aa, Homo Sapiens
RQIYIYNEKI

SEQ ID NO: 68648 - protein, 10 aa, Homo Sapiens
RQKEEEDLKL

SEQ ID NO: 68649 - protein, 10 aa, Homo Sapiens
RQLAQHDEDL

SEQ ID NO: 68650 - protein, 10 aa, Homo Sapiens
RQLDETNALL

SEQ ID NO: 68651 - protein, 10 aa, Homo Sapiens
RQLDVSSNEL

SEQ ID NO: 68652 - protein, 10 aa, Homo Sapiens
RQLEDPNGSF

SEQ ID NO: 68653 - protein, 10 aa, Homo Sapiens
RQLEEEGITF

SEQ ID NO: 68654 - protein, 10 aa, Homo Sapiens
RQLEEKDRVL

SEQ ID NO: 68655 - protein, 10 aa, Homo Sapiens
RQLEEKKAEL

SEQ ID NO: 68656 - protein, 10 aa, Homo Sapiens
RQLEESASHL

SEQ ID NO: 68657 - protein, 10 aa, Homo Sapiens
RQLEIVGEKL

SEQ ID NO: 68658 - protein, 10 aa, Homo Sapiens
RQLENLVQEL

SEQ ID NO: 68659 - protein, 10 aa, Homo Sapiens
RQLEQELHKW

SEQ ID NO: 68660 - protein, 10 aa, Homo Sapiens
RQLESEREAL

SEQ ID NO: 68661 - protein, 10 aa, Homo Sapiens
RQLGEANEEF

SEQ ID NO: 68662 - protein, 10 aa, Homo Sapiens
RQLKIKEVTL

SEQ ID NO: 68663 - protein, 10 aa, Homo Sapiens
RQLKNIKDAF

SEQ ID NO: 68664 - protein, 10 aa, Homo Sapiens
RQLLDHMDSW

SEQ ID NO: 68665 - protein, 10 aa, Homo Sapiens
RQLLDQVEQI

SEQ ID NO: 68666 - protein, 10 aa, Homo Sapiens
RQLNEKLVQL

SEQ ID NO: 68667 - protein, 10 aa, Homo Sapiens
RQLQDPLVIM

SEQ ID NO: 68668 - protein, 10 aa, Homo Sapiens
RQLQEDAARL

SEQ ID NO: 68669 - protein, 10 aa, Homo Sapiens
RQLQESAAKL

SEQ ID NO: 68670 - protein, 10 aa, Homo Sapiens
RQLQESEQQL

SEQ ID NO: 68671 - protein, 10 aa, Homo Sapiens
RQLQIDIDCL

SEQ ID NO: 68672 - protein, 10 aa, Homo Sapiens
RQLQPASELW

SEQ ID NO: 68673 - protein, 10 aa, Homo Sapiens
RQLVDTTVEL

SEQ ID NO: 68674 - protein, 10 aa, Homo Sapiens
RQMDFEFAAW

SEQ ID NO: 68675 - protein, 10 aa, Homo Sapiens
RQMEHFLDSW

SEQ ID NO: 68676 - protein, 10 aa, Homo Sapiens
RQMHLMIDQL

SEQ ID NO: 68677 - protein, 10 aa, Homo Sapiens
RQMKEDAEKF

SEQ ID NO: 68678 - protein, 10 aa, Homo Sapiens
RQMLEALNFL

SEQ ID NO: 68679 - protein, 10 aa, Homo Sapiens
RQMNIDVATW

SEQ ID NO: 68680 - protein, 10 aa, Homo Sapiens
RQMPGKELEW

SEQ ID NO: 68681 - protein, 10 aa, Homo Sapiens
RQMREMEENF

SEQ ID NO: 68682 - protein, 10 aa, Homo Sapiens
RQMSGAQIKI

SEQ ID NO: 68683 - protein, 10 aa, Homo Sapiens
RQMSIHMEEL

SEQ ID NO: 68684 - protein, 10 aa, Homo Sapiens
RQMTDPNVAL

SEQ ID NO: 68685 - protein, 10 aa, Homo Sapiens
RQMVVLEEEF

SEQ ID NO: 68686 - protein, 10 aa, Homo Sapiens
RQNIEDKVHM

SEQ ID NO: 68687 - protein, 10 aa, Homo Sapiens
RQNKELKVKL

SEQ ID NO: 68688 - protein, 10 aa, Homo Sapiens
RQNVGTLESF

SEQ ID NO: 68689 - protein, 10 aa, Homo Sapiens
RQPAEMAAEL

SEQ ID NO: 68690 - protein, 10 aa, Homo Sapiens
RQPDKENVTL

SEQ ID NO: 68691 - protein, 10 aa, Homo Sapiens
RQPIPVKDLL

SEQ ID NO: 68692 - protein, 10 aa, Homo Sapiens
RQPLEGSDLW

SEQ ID NO: 68693 - protein, 10 aa, Homo Sapiens
RQPLITLQYF

SEQ ID NO: 68694 - protein, 10 aa, Homo Sapiens
RQPRDFGDSL

SEQ ID NO: 68695 - protein, 10 aa, Homo Sapiens
RQPSVIYSWI

SEQ ID NO: 68696 - protein, 10 aa, Homo Sapiens
RQQAAPDADL

SEQ ID NO: 68697 - protein, 10 aa, Homo Sapiens
RQQISGPELL

SEQ ID NO: 68698 - protein, 10 aa, Homo Sapiens
RQQNDELTTL

SEQ ID NO: 68699 - protein, 10 aa, Homo Sapiens
RQQPPDLVEF

SEQ ID NO: 68700 - protein, 10 aa, Homo Sapiens
RQQPPSTTTF

SEQ ID NO: 68701 - protein, 10 aa, Homo Sapiens
RQQQLESEQF

SEQ ID NO: 68702 - protein, 10 aa, Homo Sapiens
RQQQPPPETF

SEQ ID NO: 68703 - protein, 10 aa, Homo Sapiens
RQQTDMAVNW

SEQ ID NO: 68704 - protein, 10 aa, Homo Sapiens
RQRDADVEKI

SEQ ID NO: 68705 - protein, 10 aa, Homo Sapiens
RQREELREKL

SEQ ID NO: 68706 - protein, 10 aa, Homo Sapiens
RQSGEAFVEL

SEQ ID NO: 68707 - protein, 10 aa, Homo Sapiens
RQSKISLDNL

SEQ ID NO: 68708 - protein, 10 aa, Homo Sapiens
RQSQLVVDWL

SEQ ID NO: 68709 - protein, 10 aa, Homo Sapiens
RQSVQEHCTF

SEQ ID NO: 68710 - protein, 10 aa, Homo Sapiens
RQTAQGMDYL

SEQ ID NO: 68711 - protein, 10 aa, Homo Sapiens
RQTQALADQF

SEQ ID NO: 68712 - protein, 10 aa, Homo Sapiens
RQVDIATQGW

SEQ ID NO: 68713 - protein, 10 aa, Homo Sapiens
RQVEDLQATF

SEQ ID NO: 68714 - protein, 10 aa, Homo Sapiens
RQVEKVVDKF

SEQ ID NO: 68715 - protein, 10 aa, Homo Sapiens
RQVFEGQNRI

SEQ ID NO: 68716 - protein, 10 aa, Homo Sapiens
RQVGIICERL

SEQ ID NO: 68717 - protein, 10 aa, Homo Sapiens
RQVGMICERL

SEQ ID NO: 68718 - protein, 10 aa, Homo Sapiens
RQVKEMNPAL

SEQ ID NO: 68719 - protein, 10 aa, Homo Sapiens
RQVKGDLAFL

SEQ ID NO: 68720 - protein, 10 aa, Homo Sapiens
RQVLEDFPTI

SEQ ID NO: 68721 - protein, 10 aa, Homo Sapiens
RQVLEIESSW

SEQ ID NO: 68722 - protein, 10 aa, Homo Sapiens
RQVQDLHVKL

SEQ ID NO: 68723 - protein, 10 aa, Homo Sapiens
RQVQSQAHGL

SEQ ID NO: 68724 - protein, 10 aa, Homo Sapiens
RQVRPVTEKL

SEQ ID NO: 68725 - protein, 10 aa, Homo Sapiens
RQVYDGFSFI

SEQ ID NO: 68726 - protein, 10 aa, Homo Sapiens
RQWLEASSQL

SEQ ID NO: 68727 - protein, 10 aa, Homo Sapiens
RQYAACEQRL

SEQ ID NO: 68728 - protein, 10 aa, Homo Sapiens
RQYAKDIGFI

SEQ ID NO: 68729 - protein, 10 aa, Homo Sapiens
RQYEEKNKEF

SEQ ID NO: 68730 - protein, 10 aa, Homo Sapiens
RQYKDYKIHW

SEQ ID NO: 68731 - protein, 10 aa, Homo Sapiens
RQYKGMFDTL

SEQ ID NO: 68732 - protein, 10 aa, Homo Sapiens
RQYLDEEFVL

SEQ ID NO: 68733 - protein, 10 aa, Homo Sapiens
RSIDMDNYML

SEQ ID NO: 68734 - protein, 10 aa, Homo Sapiens
RSIEEVYYLW

SEQ ID NO: 68735 - protein, 10 aa, Homo Sapiens
RSINQGLDRL

SEQ ID NO: 68736 - protein, 10 aa, Homo Sapiens
RSTSVTNDKL

SEQ ID NO: 68737 - protein, 10 aa, Homo Sapiens
RTAPFHLDLW

SEQ ID NO: 68738 - protein, 10 aa, Homo Sapiens
RTDGKVFQFL

SEQ ID NO: 68739 - protein, 10 aa, Homo Sapiens
RTIDEHDAII

SEQ ID NO: 68740 - protein, 10 aa, Homo Sapiens
RTIQGLIDFI

SEQ ID NO: 68741 - protein, 10 aa, Homo Sapiens
RTSPGSLDKI

SEQ ID NO: 68742 - protein, 10 aa, Homo Sapiens
RTVELFYDVL

SEQ ID NO: 68743 - protein, 10 aa, Homo Sapiens
RVADEMDVML

SEQ ID NO: 68744 - protein, 10 aa, Homo Sapiens
RVADTFQDYF

SEQ ID NO: 68745 - protein, 10 aa, Homo Sapiens
RVAEERGAVL

SEQ ID NO: 68746 - protein, 10 aa, Homo Sapiens
RVAIEHLDKI

SEQ ID NO: 68747 - protein, 10 aa, Homo Sapiens
RVANPRLDTF

SEQ ID NO: 68748 - protein, 10 aa, Homo Sapiens
RVCKILGSGI

SEQ ID NO: 68749 - protein, 10 aa, Homo Sapiens
RVDNMIIQSI

SEQ ID NO: 68750 - protein, 10 aa, Homo Sapiens
RVDPDVAQHW

SEQ ID NO: 68751 - protein, 10 aa, Homo Sapiens
RVDPNGSRYL

SEQ ID NO: 68752 - protein, 10 aa, Homo Sapiens
RVEGMTELYF

SEQ ID NO: 68753 - protein, 10 aa, Homo Sapiens
RVESLEMERW

SEQ ID NO: 68754 - protein, 10 aa, Homo Sapiens
RVHNLITDFL

SEQ ID NO: 68755 - protein, 10 aa, Homo Sapiens
RVIEDRDSQL

SEQ ID NO: 68756 - protein, 10 aa, Homo Sapiens
RVIEEAKTAF

SEQ ID NO: 68757 - protein, 10 aa, Homo Sapiens
RVIEGKVDQI

SEQ ID NO: 68758 - protein, 10 aa, Homo Sapiens
RVIKDKQTQL

SEQ ID NO: 68759 - protein, 10 aa, Homo Sapiens
RVIKGNIDKF

SEQ ID NO: 68760 - protein, 10 aa, Homo Sapiens
RVILDEGHAI

SEQ ID NO: 68761 - protein, 10 aa, Homo Sapiens
RVINEEYKIW

SEQ ID NO: 68762 - protein, 10 aa, Homo Sapiens
RVIQKALESI

SEQ ID NO: 68763 - protein, 10 aa, Homo Sapiens
RVIVAEFDSF

SEQ ID NO: 68764 - protein, 10 aa, Homo Sapiens
RVLDERLVRL

SEQ ID NO: 68765 - protein, 10 aa, Homo Sapiens
RVLKEDKERW

SEQ ID NO: 68766 - protein, 10 aa, Homo Sapiens
RVLKGDVEKL

SEQ ID NO: 68767 - protein, 10 aa, Homo Sapiens
RVLQNGGDKL

SEQ ID NO: 68768 - protein, 10 aa, Homo Sapiens
RVLREERAYI

SEQ ID NO: 68769 - protein, 10 aa, Homo Sapiens
RVQGPELISL

SEQ ID NO: 68770 - protein, 10 aa, Homo Sapiens
RVQLGGSDQL

SEQ ID NO: 68771 - protein, 10 aa, Homo Sapiens
RVSAVQMDDW

SEQ ID NO: 68772 - protein, 10 aa, Homo Sapiens
RVSINGYDHF

SEQ ID NO: 68773 - protein, 10 aa, Homo Sapiens
RVSKILKEEW

SEQ ID NO: 68774 - protein, 10 aa, Homo Sapiens
RVSPALGITW

SEQ ID NO: 68775 - protein, 10 aa, Homo Sapiens
RVSQDGLDLL

SEQ ID NO: 68776 - protein, 10 aa, Homo Sapiens
RVSSDEDLKL

SEQ ID NO: 68777 - protein, 10 aa, Homo Sapiens
RVVDTFQDYF

SEQ ID NO: 68778 - protein, 10 aa, Homo Sapiens
RVVKDITNAF

SEQ ID NO: 68779 - protein, 10 aa, Homo Sapiens
RVVKGQVEYL

SEQ ID NO: 68780 - protein, 10 aa, Homo Sapiens
RVVNGKVEYF

SEQ ID NO: 68781 - protein, 10 aa, Homo Sapiens
SIIADDFAAF

SEQ ID NO: 68782 - protein, 10 aa, Homo Sapiens
SLAREVYTEW

SEQ ID NO: 68783 - protein, 10 aa, Homo Sapiens
SLDPSRPVTF

SEQ ID NO: 68784 - protein, 10 aa, Homo Sapiens
SLEKVCADLI

SEQ ID NO: 68785 - protein, 10 aa, Homo Sapiens
SLFDDKAVEI

SEQ ID NO: 68786 - protein, 10 aa, Homo Sapiens
SLFSAVREDF

SEQ ID NO: 68787 - protein, 10 aa, Homo Sapiens
SLGPNGLDKM

SEQ ID NO: 68788 - protein, 10 aa, Homo Sapiens
SLGPVGLDKM

SEQ ID NO: 68789 - protein, 10 aa, Homo Sapiens
SLGTGYTEEF

SEQ ID NO: 68790 - protein, 10 aa, Homo Sapiens
SLISSDYELL

SEQ ID NO: 68791 - protein, 10 aa, Homo Sapiens
SLLDDTTVTL

SEQ ID NO: 68792 - protein, 10 aa, Homo Sapiens
SLSQPKMDEL

SEQ ID NO: 68793 - protein, 10 aa, Homo Sapiens
SLVAAGHDCF

SEQ ID NO: 68794 - protein, 10 aa, Homo Sapiens
SLVEVDREFW

SEQ ID NO: 68795 - protein, 10 aa, Homo Sapiens
SMEKSFSDLF

SEQ ID NO: 68796 - protein, 10 aa, Homo Sapiens
SMGFFTKEEW

SEQ ID NO: 68797 - protein, 10 aa, Homo Sapiens
SQAGITETEW

SEQ ID NO: 68798 - protein, 10 aa, Homo Sapiens
SQCPPDYHHI

SEQ ID NO: 68799 - protein, 10 aa, Homo Sapiens
SQDKNLYHNL

SEQ ID NO: 68800 - protein, 10 aa, Homo Sapiens
SQDPSGDSKL

SEQ ID NO: 68801 - protein, 10 aa, Homo Sapiens
SQDPTKEIRF

SEQ ID NO: 68802 - protein, 10 aa, Homo Sapiens
SQDQFSDMRI

SEQ ID NO: 68803 - protein, 10 aa, Homo Sapiens
SQEMKCILHW

SEQ ID NO: 68804 - protein, 10 aa, Homo Sapiens
SQEQSFSDKL

SEQ ID NO: 68805 - protein, 10 aa, Homo Sapiens
SQFGHVVDIV

SEQ ID NO: 68806 - protein, 10 aa, Homo Sapiens
SQFLADTERF

SEQ ID NO: 68807 - protein, 10 aa, Homo Sapiens
SQFLAKVESF

SEQ ID NO: 68808 - protein, 10 aa, Homo Sapiens
SQFPTPEAVL

SEQ ID NO: 68809 - protein, 10 aa, Homo Sapiens
SQFREEEITL

SEQ ID NO: 68810 - protein, 10 aa, Homo Sapiens
SQGFPDTYRL

SEQ ID NO: 68811 - protein, 10 aa, Homo Sapiens
SQGQPAQDIF

SEQ ID NO: 68812 - protein, 10 aa, Homo Sapiens
SQHNPVPDFI

SEQ ID NO: 68813 - protein, 10 aa, Homo Sapiens
SQIAKDVCTF

SEQ ID NO: 68814 - protein, 10 aa, Homo Sapiens
SQIDAEFEKM

SEQ ID NO: 68815 - protein, 10 aa, Homo Sapiens
SQIDDLYSTI

SEQ ID NO: 68816 - protein, 10 aa, Homo Sapiens
SQIKQEVENF

SEQ ID NO: 68817 - protein, 10 aa, Homo Sapiens
SQIREMETLI

SEQ ID NO: 68818 - protein, 10 aa, Homo Sapiens
SQISAGEEKW

SEQ ID NO: 68819 - protein, 10 aa, Homo Sapiens
SQLDDQYSRF

SEQ ID NO: 68820 - protein, 10 aa, Homo Sapiens
SQLKEHFAQF

SEQ ID NO: 68821 - protein, 10 aa, Homo Sapiens
SQSKDSDVYI

SEQ ID NO: 68822 - protein, 10 aa, Homo Sapiens
SQTQPDLDHL

SEQ ID NO: 68823 - protein, 10 aa, Homo Sapiens
SQVEGEHQLW

SEQ ID NO: 68824 - protein, 10 aa, Homo Sapiens
SQVHIMDEHW

SEQ ID NO: 68825 - protein, 10 aa, Homo Sapiens
SQVPNEKVGW

SEQ ID NO: 68826 - protein, 10 aa, Homo Sapiens
SQYEALKEDW

SEQ ID NO: 68827 - protein, 10 aa, Homo Sapiens
SQYPQSDDKL

SEQ ID NO: 68828 - protein, 10 aa, Homo Sapiens
SSYAHKASSI

SEQ ID NO: 68829 - protein, 10 aa, Homo Sapiens
SVERSLSDLF

SEQ ID NO: 68830 - protein, 10 aa, Homo Sapiens
SVINDTVVRF

SEQ ID NO: 68831 - protein, 10 aa, Homo Sapiens
SVMPAGVDKI

SEQ ID NO: 68832 - protein, 10 aa, Homo Sapiens
TLASAGFDRL

SEQ ID NO: 68833 - protein, 10 aa, Homo Sapiens
TLFKGFGDRL

SEQ ID NO: 68834 - protein, 10 aa, Homo Sapiens
TLIEDEIATI

SEQ ID NO: 68835 - protein, 10 aa, Homo Sapiens
TLQRGKEENI

SEQ ID NO: 68836 - protein, 10 aa, Homo Sapiens
TQEEPYSDII

SEQ ID NO: 68837 - protein, 10 aa, Homo Sapiens
TQIEDAVSLW

SEQ ID NO: 68838 - protein, 10 aa, Homo Sapiens
TQIGGERYNF

SEQ ID NO: 68839 - protein, 10 aa, Homo Sapiens
TQIKQKVDSL

SEQ ID NO: 68840 - protein, 10 aa, Homo Sapiens
TQSCADLDKW

SEQ ID NO: 68841 - protein, 10 aa, Homo Sapiens
TQVPEGAAKW

SEQ ID NO: 68842 - protein, 10 aa, Homo Sapiens
TVARGEPESL

SEQ ID NO: 68843 - protein, 10 aa, Homo Sapiens
VIHQSVYELI

SEQ ID NO: 68844 - protein, 10 aa, Homo Sapiens
VLADVMDDQL

SEQ ID NO: 68845 - protein, 10 aa, Homo Sapiens
VLAPILPDNF

SEQ ID NO: 68846 - protein, 10 aa, Homo Sapiens
VLDPHTSHSW

SEQ ID NO: 68847 - protein, 10 aa, Homo Sapiens
VLDSSLSELF

SEQ ID NO: 68848 - protein, 10 aa, Homo Sapiens
VLDVSGADML

SEQ ID NO: 68849 - protein, 10 aa, Homo Sapiens
VLFAIKEVGF

SEQ ID NO: 68850 - protein, 10 aa, Homo Sapiens
VLFEDAVAHI

SEQ ID NO: 68851 - protein, 10 aa, Homo Sapiens
VLFRFSDDAF

SEQ ID NO: 68852 - protein, 10 aa, Homo Sapiens
VLIGNLGDKL

SEQ ID NO: 68853 - protein, 10 aa, Homo Sapiens
VLLDNQTVTF

SEQ ID NO: 68854 - protein, 10 aa, Homo Sapiens
VMVDDRLVTM

SEQ ID NO: 68855 - protein, 10 aa, Homo Sapiens
VQDKGSIHKF

SEQ ID NO: 68856 - protein, 10 aa, Homo Sapiens
VQDPHSRICF

SEQ ID NO: 68857 - protein, 10 aa, Homo Sapiens
VQDPSQFDVL

SEQ ID NO: 68858 - protein, 10 aa, Homo Sapiens
VQDPSVFVTF

SEQ ID NO: 68859 - protein, 10 aa, Homo Sapiens
VQDVQGDGRW

SEQ ID NO: 68860 - protein, 10 aa, Homo Sapiens
VQENIGPLRI

SEQ ID NO: 68861 - protein, 10 aa, Homo Sapiens
VQIGQVHEEF

SEQ ID NO: 68862 - protein, 10 aa, Homo Sapiens
VQILQEVNDF

SEQ ID NO: 68863 - protein, 10 aa, Homo Sapiens
VQNEAKLDEI

SEQ ID NO: 68864 - protein, 10 aa, Homo Sapiens
VQVQPGVDII

SEQ ID NO: 68865 - protein, 10 aa, Homo Sapiens
VQWDEAEITI

SEQ ID NO: 68866 - protein, 10 aa, Homo Sapiens
WLDPNETNEI

SEQ ID NO: 68867 - protein, 10 aa, Homo Sapiens
WLLDDSKTWW

SEQ ID NO: 68868 - protein, 10 aa, Homo Sapiens
WLVADPDCRW

SEQ ID NO: 68869 - protein, 10 aa, Homo Sapiens
WQEGSVTRLW

SEQ ID NO: 68870 - protein, 10 aa, Homo Sapiens
WQKADINTKW

SEQ ID NO: 68871 - protein, 10 aa, Homo Sapiens
WQVDTKEEVW

SEQ ID NO: 68872 - protein, 10 aa, Homo Sapiens
YILANIGDHF

SEQ ID NO: 68873 - protein, 10 aa, Homo Sapiens
YLASDPDCRW

SEQ ID NO: 68874 - protein, 10 aa, Homo Sapiens
YLAYDIGNHF

SEQ ID NO: 68875 - protein, 10 aa, Homo Sapiens
YLDRKSDERL

SEQ ID NO: 68876 - protein, 10 aa, Homo Sapiens
YLEGECLELL

SEQ ID NO: 68877 - protein, 10 aa, Homo Sapiens
YLEGECVEWL

SEQ ID NO: 68878 - protein, 10 aa, Homo Sapiens
YLESKDNQKL

SEQ ID NO: 68879 - protein, 10 aa, Homo Sapiens
YLHESTQDEL

SEQ ID NO: 68880 - protein, 10 aa, Homo Sapiens
YLINMHVDEF

SEQ ID NO: 68881 - protein, 10 aa, Homo Sapiens
YLIVDRDEAW

SEQ ID NO: 68882 - protein, 10 aa, Homo Sapiens
YLPDGSYEDW

SEQ ID NO: 68883 - protein, 10 aa, Homo Sapiens
YMCVGIMDRF

SEQ ID NO: 68884 - protein, 10 aa, Homo Sapiens
YMFQHIEESF

SEQ ID NO: 68885 - protein, 10 aa, Homo Sapiens
YMIHEPEPHI

SEQ ID NO: 68886 - protein, 10 aa, Homo Sapiens
YMVADKFTEL

SEQ ID NO: 68887 - protein, 10 aa, Homo Sapiens
YMVADRFSEL

SEQ ID NO: 68888 - protein, 10 aa, Homo Sapiens
YQALTVHDNL

SEQ ID NO: 68889 - protein, 10 aa, Homo Sapiens
YQAPDIDVQL

SEQ ID NO: 68890 - protein, 10 aa, Homo Sapiens
YQDMPEYENF

SEQ ID NO: 68891 - protein, 10 aa, Homo Sapiens
YQDPDGTRKL

SEQ ID NO: 68892 - protein, 10 aa, Homo Sapiens
YQDPSNAQFL

SEQ ID NO: 68893 - protein, 10 aa, Homo Sapiens
YQEPIPTAQL

SEQ ID NO: 68894 - protein, 10 aa, Homo Sapiens
YQHGHINSYL

SEQ ID NO: 68895 - protein, 10 aa, Homo Sapiens
YQILDGIHYL

SEQ ID NO: 68896 - protein, 10 aa, Homo Sapiens
YQIPDVRDIF

SEQ ID NO: 68897 - protein, 10 aa, Homo Sapiens
YQMKEEEVQL

SEQ ID NO: 68898 - protein, 10 aa, Homo Sapiens
YQNEDEKVTL

SEQ ID NO: 68899 - protein, 10 aa, Homo Sapiens
YQQELERELF

SEQ ID NO: 68900 - protein, 10 aa, Homo Sapiens
YQQQGRLDKL

SEQ ID NO: 68901 - protein, 10 aa, Homo Sapiens
YQWDDPDPRL

SEQ ID NO: 68902 - protein, 10 aa, Homo Sapiens
YQYLGEPETF

SEQ ID NO: 68903 - protein, 10 aa, Homo Sapiens
YQYQDGCIVW

SEQ ID NO: 68904 - protein, 10 aa, Homo Sapiens
YVDKSRGDKL

SEQ ID NO: 68905 - protein, 10 aa, Homo Sapiens
YVDPSGGDRF

SEQ ID NO: 68906 - protein, 10 aa, Homo Sapiens
YVHKSVMEEL

SEQ ID NO: 68907 - protein, 11 aa, Homo Sapiens
AAPAKKPYRKA

SEQ ID NO: 68908 - protein, 11 aa, Homo Sapiens
AGGVQRQEVVC

SEQ ID NO: 68909 - protein, 11 aa, Homo Sapiens
AIIDPGDSDII

SEQ ID NO: 68910 - protein, 11 aa, Homo Sapiens
AIVDVPVGEEL

SEQ ID NO: 68911 - protein, 11 aa, Homo Sapiens
ALDPNSKGNSL

SEQ ID NO: 68912 - protein, 11 aa, Homo Sapiens
ALDRQTATQLL

SEQ ID NO: 68913 - protein, 11 aa, Homo Sapiens
ALFDKSINEFW

SEQ ID NO: 68914 - protein, 11 aa, Homo Sapiens
ALHIPFSVDEI

SEQ ID NO: 68915 - protein, 11 aa, Homo Sapiens
ALIFEGTDTHW

SEQ ID NO: 68916 - protein, 11 aa, Homo Sapiens
ALLALKEVEEI

SEQ ID NO: 68917 - protein, 11 aa, Homo Sapiens
ALLERLSELAL

SEQ ID NO: 68918 - protein, 11 aa, Homo Sapiens
ALQSFLKAEEL

SEQ ID NO: 68919 - protein, 11 aa, Homo Sapiens
ALQSPFYGDKM

SEQ ID NO: 68920 - protein, 11 aa, Homo Sapiens
ALSEDHAWVVF

SEQ ID NO: 68921 - protein, 11 aa, Homo Sapiens
ALTDDGRVFLW

SEQ ID NO: 68922 - protein, 11 aa, Homo Sapiens
ALVPETIHDEL

SEQ ID NO: 68923 - protein, 11 aa, Homo Sapiens
ALYSHEDVCVF

SEQ ID NO: 68924 - protein, 11 aa, Homo Sapiens
AMPLPGVGEEL

SEQ ID NO: 68925 - protein, 11 aa, Homo Sapiens
ANALGGKGAGF

SEQ ID NO: 68926 - protein, 11 aa, Homo Sapiens
AQAHCGAGDEL

SEQ ID NO: 68927 - protein, 11 aa, Homo Sapiens
AQAPVTKGCYL

SEQ ID NO: 68928 - protein, 11 aa, Homo Sapiens
AQAQDAELVRL

SEQ ID NO: 68929 - protein, 11 aa, Homo Sapiens
AQARVPLGDEM

SEQ ID NO: 68930 - protein, 11 aa, Homo Sapiens
AQDANAAQQEL

SEQ ID NO: 68931 - protein, 11 aa, Homo Sapiens
AQDQTQDTQLI

SEQ ID NO: 68932 - protein, 11 aa, Homo Sapiens
AQDSTDLVAKL

SEQ ID NO: 68933 - protein, 11 aa, Homo Sapiens
AQEARNIYQEF

SEQ ID NO: 68934 - protein, 11 aa, Homo Sapiens
AQEPCNGRTAL

SEQ ID NO: 68935 - protein, 11 aa, Homo Sapiens
AQETVKHSDLF

SEQ ID NO: 68936 - protein, 11 aa, Homo Sapiens
AQFDNHNSQVW

SEQ ID NO: 68937 - protein, 11 aa, Homo Sapiens
AQFEGIVTDLI

SEQ ID NO: 68938 - protein, 11 aa, Homo Sapiens
AQFEPDSTEYI

SEQ ID NO: 68939 - protein, 11 aa, Homo Sapiens
AQHFLPAGDSV

SEQ ID NO: 68940 - protein, 11 aa, Homo Sapiens
AQHKADIEERL

SEQ ID NO: 68941 - protein, 11 aa, Homo Sapiens
AQIDDDVFDKI

SEQ ID NO: 68942 - protein, 11 aa, Homo Sapiens
AQIIEADEVLL

SEQ ID NO: 68943 - protein, 11 aa, Homo Sapiens
AQILLKGAERL

SEQ ID NO: 68944 - protein, 11 aa, Homo Sapiens
AQLDCSKLETL

SEQ ID NO: 68945 - protein, 11 aa, Homo Sapiens
AQLSPLDSETL

SEQ ID NO: 68946 - protein, 11 aa, Homo Sapiens
AQMTPSPSEMF

SEQ ID NO: 68947 - protein, 11 aa, Homo Sapiens
AQNVLSKADVI

SEQ ID NO: 68948 - protein, 11 aa, Homo Sapiens
AQQAEEGSARL

SEQ ID NO: 68949 - protein, 11 aa, Homo Sapiens
AQQASEKIDRF

SEQ ID NO: 68950 - protein, 11 aa, Homo Sapiens
AQQRNCEAETL

SEQ ID NO: 68951 - protein, 11 aa, Homo Sapiens
AQSKKITKEEF

SEQ ID NO: 68952 - protein, 11 aa, Homo Sapiens
AQSQLIKSDEM

SEQ ID NO: 68953 - protein, 11 aa, Homo Sapiens
AQSSKSVKEAW

SEQ ID NO: 68954 - protein, 11 aa, Homo Sapiens
AQSSREICEAF

SEQ ID NO: 68955 - protein, 11 aa, Homo Sapiens
AQTLSLEADKW

SEQ ID NO: 68956 - protein, 11 aa, Homo Sapiens
AQVADAFLSKF

SEQ ID NO: 68957 - protein, 11 aa, Homo Sapiens
AQVADVVVSRW

SEQ ID NO: 68958 - protein, 11 aa, Homo Sapiens
AQVNTKVSDSL

SEQ ID NO: 68959 - protein, 11 aa, Homo Sapiens
AQVPNIDFEGL

SEQ ID NO: 68960 - protein, 11 aa, Homo Sapiens
AQYFLDKIDVI

SEQ ID NO: 68961 - protein, 11 aa, Homo Sapiens
AVIDIPGADTL

SEQ ID NO: 68962 - protein, 11 aa, Homo Sapiens
EGEKHIYSPII

SEQ ID NO: 68963 - protein, 11 aa, Homo Sapiens
ELYMEQKNERL

SEQ ID NO: 68964 - protein, 11 aa, Homo Sapiens
EPFGKIDNIVL

SEQ ID NO: 68965 - protein, 11 aa, Homo Sapiens
FIFDSAGKELF

SEQ ID NO: 68966 - protein, 11 aa, Homo Sapiens
FLDGELKSDVF

SEQ ID NO: 68967 - protein, 11 aa, Homo Sapiens
FLLDPVKGERL

SEQ ID NO: 68968 - protein, 11 aa, Homo Sapiens
FQAVHVQGEDL

SEQ ID NO: 68969 - protein, 11 aa, Homo Sapiens
FQENSTIGQKI

SEQ ID NO: 68970 - protein, 11 aa, Homo Sapiens
GAGFSIRYEIF

SEQ ID NO: 68971 - protein, 11 aa, Homo Sapiens
GLCAIAQAESL

SEQ ID NO: 68972 - protein, 11 aa, Homo Sapiens
GLFADGHLILW

SEQ ID NO: 68973 - protein, 11 aa, Homo Sapiens
GLFEDTNLCAI

SEQ ID NO: 68974 - protein, 11 aa, Homo Sapiens
GLIDDNDLYRW

SEQ ID NO: 68975 - protein, 11 aa, Homo Sapiens
GLIDDYSMVRF

SEQ ID NO: 68976 - protein, 11 aa, Homo Sapiens
GLVPRLLGDIL

SEQ ID NO: 68977 - protein, 11 aa, Homo Sapiens
GMSNDGRFLKF

SEQ ID NO: 68978 - protein, 11 aa, Homo Sapiens
GQAAGVLIHSI

SEQ ID NO: 68979 - protein, 11 aa, Homo Sapiens
GQAGSSIPSTW

SEQ ID NO: 68980 - protein, 11 aa, Homo Sapiens
GQASGELLQQI

SEQ ID NO: 68981 - protein, 11 aa, Homo Sapiens
GQCVAAKPESW

SEQ ID NO: 68982 - protein, 11 aa, Homo Sapiens
GQDAHCQLLRF

SEQ ID NO: 68983 - protein, 11 aa, Homo Sapiens
GQDVGRYQVSW

SEQ ID NO: 68984 - protein, 11 aa, Homo Sapiens
GQDVSQAQRQI

SEQ ID NO: 68985 - protein, 11 aa, Homo Sapiens
GQHTSSTTSAW

SEQ ID NO: 68986 - protein, 11 aa, Homo Sapiens
GQIDDHQSSRL

SEQ ID NO: 68987 - protein, 11 aa, Homo Sapiens
GQLSEGAIAAI

SEQ ID NO: 68988 - protein, 11 aa, Homo Sapiens
GQNPEKIFQNL

SEQ ID NO: 68989 - protein, 11 aa, Homo Sapiens
GQQKPHPGERL

SEQ ID NO: 68990 - protein, 11 aa, Homo Sapiens
GQQSAHLAELI

SEQ ID NO: 68991 - protein, 11 aa, Homo Sapiens
GQSKAVGQDTL

SEQ ID NO: 68992 - protein, 11 aa, Homo Sapiens
GQVEIHLGDSL

SEQ ID NO: 68993 - protein, 11 aa, Homo Sapiens
GQVITIGNERF

SEQ ID NO: 68994 - protein, 11 aa, Homo Sapiens
GQYHGDAGDSL

SEQ ID NO: 68995 - protein, 11 aa, Homo Sapiens
HIIEDTEEARL

SEQ ID NO: 68996 - protein, 11 aa, Homo Sapiens
HIMKSADVEKL

SEQ ID NO: 68997 - protein, 11 aa, Homo Sapiens
HIQAGQCGNQI

SEQ ID NO: 68998 - protein, 11 aa, Homo Sapiens
HLDSNIENQEI

SEQ ID NO: 68999 - protein, 11 aa, Homo Sapiens
HLEEAFTSEHW

SEQ ID NO: 69000 - protein, 11 aa, Homo Sapiens
HLESGSGKVTF

SEQ ID NO: 69001 - protein, 11 aa, Homo Sapiens
HLFKEGIKPMW

SEQ ID NO: 69002 - protein, 11 aa, Homo Sapiens
HLIHEQIPLSL

SEQ ID NO: 69003 - protein, 11 aa, Homo Sapiens
HLIPDGEITSI

SEQ ID NO: 69004 - protein, 11 aa, Homo Sapiens
HLLAEQEKQQF

SEQ ID NO: 69005 - protein, 11 aa, Homo Sapiens
HLLLPSQEESF

SEQ ID NO: 69006 - protein, 11 aa, Homo Sapiens
HLLVEHETQKL

SEQ ID NO: 69007 - protein, 11 aa, Homo Sapiens
HLNQFVDHEKI

SEQ ID NO: 69008 - protein, 11 aa, Homo Sapiens
HLQRIIQQETL

SEQ ID NO: 69009 - protein, 11 aa, Homo Sapiens
HLVPPEIIQSL

SEQ ID NO: 69010 - protein, 11 aa, Homo Sapiens
HLYRDGHEEAL

SEQ ID NO: 69011 - protein, 11 aa, Homo Sapiens
HMESVNAEAKL

SEQ ID NO: 69012 - protein, 11 aa, Homo Sapiens
HQDESSSFHHL

SEQ ID NO: 69013 - protein, 11 aa, Homo Sapiens
HQDTQGTSHRW

SEQ ID NO: 69014 - protein, 11 aa, Homo Sapiens
HQHRSGIESAL

SEQ ID NO: 69015 - protein, 11 aa, Homo Sapiens
HQHVSTHSDIL

SEQ ID NO: 69016 - protein, 11 aa, Homo Sapiens
HQIEAVDGEEL

SEQ ID NO: 69017 - protein, 11 aa, Homo Sapiens
HQIGPGMVQQI

SEQ ID NO: 69018 - protein, 11 aa, Homo Sapiens
HQINDASRGTL

SEQ ID NO: 69019 - protein, 11 aa, Homo Sapiens
HQLDVVIAEKL

SEQ ID NO: 69020 - protein, 11 aa, Homo Sapiens
HVIDSIVGDGI

SEQ ID NO: 69021 - protein, 11 aa, Homo Sapiens
HVVHPPTGEEF

SEQ ID NO: 69022 - protein, 11 aa, Homo Sapiens
IIFEDDRCLAF

SEQ ID NO: 69023 - protein, 11 aa, Homo Sapiens
ILADLHSADQL

SEQ ID NO: 69024 - protein, 11 aa, Homo Sapiens
ILDAGGHNVTI

SEQ ID NO: 69025 - protein, 11 aa, Homo Sapiens
ILDDGGDLTHW

SEQ ID NO: 69026 - protein, 11 aa, Homo Sapiens
ILEGRTISVQF

SEQ ID NO: 69027 - protein, 11 aa, Homo Sapiens
ILILDNDGDRL

SEQ ID NO: 69028 - protein, 11 aa, Homo Sapiens
ILINDAGEVRL

SEQ ID NO: 69029 - protein, 11 aa, Homo Sapiens
ILLDDTGLAYI

SEQ ID NO: 69030 - protein, 11 aa, Homo Sapiens
ILLDERGQIKL

SEQ ID NO: 69031 - protein, 11 aa, Homo Sapiens
ILSSIPEAEKF

SEQ ID NO: 69032 - protein, 11 aa, Homo Sapiens
ILTTEGRNALI

SEQ ID NO: 69033 - protein, 11 aa, Homo Sapiens
ILWSPHYKELI

SEQ ID NO: 69034 - protein, 11 aa, Homo Sapiens
IQALDSEGNTF

SEQ ID NO: 69035 - protein, 11 aa, Homo Sapiens
IQDPASQRLTW

SEQ ID NO: 69036 - protein, 11 aa, Homo Sapiens
IQGPVGLDQRF

SEQ ID NO: 69037 - protein, 11 aa, Homo Sapiens
IQQNNDIVQSL

SEQ ID NO: 69038 - protein, 11 aa, Homo Sapiens
KASGFEESMKW

SEQ ID NO: 69039 - protein, 11 aa, Homo Sapiens
KILAEGGGAKF

SEQ ID NO: 69040 - protein, 11 aa, Homo Sapiens
KIVEIINEELW

SEQ ID NO: 69041 - protein, 11 aa, Homo Sapiens
KLAPITYPQGL

SEQ ID NO: 69042 - protein, 11 aa, Homo Sapiens
KLAVGDNNSKW

SEQ ID NO: 69043 - protein, 11 aa, Homo Sapiens
KLDSSDIYNEL

SEQ ID NO: 69044 - protein, 11 aa, Homo Sapiens
KLEAEADKIGL

SEQ ID NO: 69045 - protein, 11 aa, Homo Sapiens
KLEENNGTDLL

SEQ ID NO: 69046 - protein, 11 aa, Homo Sapiens
KLESIDKIARW

SEQ ID NO: 69047 - protein, 11 aa, Homo Sapiens
KLFADAVQELL

SEQ ID NO: 69048 - protein, 11 aa, Homo Sapiens
KLFDLDEKLML

SEQ ID NO: 69049 - protein, 11 aa, Homo Sapiens
KLFGEKGSDRF

SEQ ID NO: 69050 - protein, 11 aa, Homo Sapiens
KLFNESHGIFL

SEQ ID NO: 69051 - protein, 11 aa, Homo Sapiens
KLFQSDTNAML

SEQ ID NO: 69052 - protein, 11 aa, Homo Sapiens
KLFSEKRVELL

SEQ ID NO: 69053 - protein, 11 aa, Homo Sapiens
KLHIPYAGETL

SEQ ID NO: 69054 - protein, 11 aa, Homo Sapiens
KLHWQKNGDYL

SEQ ID NO: 69055 - protein, 11 aa, Homo Sapiens
KLIADVGLVGF

SEQ ID NO: 69056 - protein, 11 aa, Homo Sapiens
KLIAEKSEAKI

SEQ ID NO: 69057 - protein, 11 aa, Homo Sapiens
KLIDETQDMLL

SEQ ID NO: 69058 - protein, 11 aa, Homo Sapiens
KLIDTIPDDKL

SEQ ID NO: 69059 - protein, 11 aa, Homo Sapiens
KLIECGWKDQL

SEQ ID NO: 69060 - protein, 11 aa, Homo Sapiens
KLIETGERERL

SEQ ID NO: 69061 - protein, 11 aa, Homo Sapiens
KLIGDTPIDTF

SEQ ID NO: 69062 - protein, 11 aa, Homo Sapiens
KLIQEKKDNLL

SEQ ID NO: 69063 - protein, 11 aa, Homo Sapiens
KLIQESPTVEL

SEQ ID NO: 69064 - protein, 11 aa, Homo Sapiens
KLKSNDGEERL

SEQ ID NO: 69065 - protein, 11 aa, Homo Sapiens
KLLPDTILEKL

SEQ ID NO: 69066 - protein, 11 aa, Homo Sapiens
KLLQNIGIDKI

SEQ ID NO: 69067 - protein, 11 aa, Homo Sapiens
KLNENHSGELW

SEQ ID NO: 69068 - protein, 11 aa, Homo Sapiens
KLPSSYELDVL

SEQ ID NO: 69069 - protein, 11 aa, Homo Sapiens
KLQEEKVRAVF

SEQ ID NO: 69070 - protein, 11 aa, Homo Sapiens
KLSEDGTYTGF

SEQ ID NO: 69071 - protein, 11 aa, Homo Sapiens
KLSPEELLLRW

SEQ ID NO: 69072 - protein, 11 aa, Homo Sapiens
KLYEEKTGNAW

SEQ ID NO: 69073 - protein, 11 aa, Homo Sapiens
KLYGSGDQEAW

SEQ ID NO: 69074 - protein, 11 aa, Homo Sapiens
KLYNNITFEEL

SEQ ID NO: 69075 - protein, 11 aa, Homo Sapiens
KMLSCAGADRL

SEQ ID NO: 69076 - protein, 11 aa, Homo Sapiens
KMVNSGMLETI

SEQ ID NO: 69077 - protein, 11 aa, Homo Sapiens
KQADLYISEGL

SEQ ID NO: 69078 - protein, 11 aa, Homo Sapiens
KQAEEPRGSSL

SEQ ID NO: 69079 - protein, 11 aa, Homo Sapiens
KQAHVELAERM

SEQ ID NO: 69080 - protein, 11 aa, Homo Sapiens
KQAPGEKGNIL

SEQ ID NO: 69081 - protein, 11 aa, Homo Sapiens
KQDDSQSSNQF

SEQ ID NO: 69082 - protein, 11 aa, Homo Sapiens
KQDSLGQLVDW

SEQ ID NO: 69083 - protein, 11 aa, Homo Sapiens
KQEGIATSDNF

SEQ ID NO: 69084 - protein, 11 aa, Homo Sapiens
KQENTQTEQKL

SEQ ID NO: 69085 - protein, 11 aa, Homo Sapiens
KQFAAIQKEQL

SEQ ID NO: 69086 - protein, 11 aa, Homo Sapiens
KQFAEENGLLF

SEQ ID NO: 69087 - protein, 11 aa, Homo Sapiens
KQFAEGSTLKL

SEQ ID NO: 69088 - protein, 11 aa, Homo Sapiens
KQFAEMYVAKF

SEQ ID NO: 69089 - protein, 11 aa, Homo Sapiens
KQFAGYSEEVL

SEQ ID NO: 69090 - protein, 11 aa, Homo Sapiens
KQFHSVEVHKW

SEQ ID NO: 69091 - protein, 11 aa, Homo Sapiens
KQFIDGRLDLL

SEQ ID NO: 69092 - protein, 11 aa, Homo Sapiens
KQFYEPKPDLL

SEQ ID NO: 69093 - protein, 11 aa, Homo Sapiens
KQHSWHESDSF

SEQ ID NO: 69094 - protein, 11 aa, Homo Sapiens
KQICVVMLETL

SEQ ID NO: 69095 - protein, 11 aa, Homo Sapiens
KQIDELDILRL

SEQ ID NO: 69096 - protein, 11 aa, Homo Sapiens
KQIESDRQNLL

SEQ ID NO: 69097 - protein, 11 aa, Homo Sapiens
KQLDPGQRDLF

SEQ ID NO: 69098 - protein, 11 aa, Homo Sapiens
KQNELLEPNSF

SEQ ID NO: 69099 - protein, 11 aa, Homo Sapiens
KQSKDGAGFLI

SEQ ID NO: 69100 - protein, 11 aa, Homo Sapiens
KQSVHIVENEI

SEQ ID NO: 69101 - protein, 11 aa, Homo Sapiens
KQVEDDIQQLL

SEQ ID NO: 69102 - protein, 11 aa, Homo Sapiens
KQVKPYVEEGL

SEQ ID NO: 69103 - protein, 11 aa, Homo Sapiens
KQVLNYLGECF

SEQ ID NO: 69104 - protein, 11 aa, Homo Sapiens
KQWKHFSGDHL

SEQ ID NO: 69105 - protein, 11 aa, Homo Sapiens
KQYGDKIIEEL

SEQ ID NO: 69106 - protein, 11 aa, Homo Sapiens
KQYIEFVADRL

SEQ ID NO: 69107 - protein, 11 aa, Homo Sapiens
KVLGNPKSDEM

SEQ ID NO: 69108 - protein, 11 aa, Homo Sapiens
LEQNQLYGEVI

SEQ ID NO: 69109 - protein, 11 aa, Homo Sapiens
LLFEGEKKITI

SEQ ID NO: 69110 - protein, 11 aa, Homo Sapiens
LLHSSHISEEL

SEQ ID NO: 69111 - protein, 11 aa, Homo Sapiens
LLIDDKGTIKL

SEQ ID NO: 69112 - protein, 11 aa, Homo Sapiens
LLIGQTEVDIM

SEQ ID NO: 69113 - protein, 11 aa, Homo Sapiens
LLVENIERETF

SEQ ID NO: 69114 - protein, 11 aa, Homo Sapiens
LQDKEGLSNQL

SEQ ID NO: 69115 - protein, 11 aa, Homo Sapiens
LQDNPASGEKF

SEQ ID NO: 69116 - protein, 11 aa, Homo Sapiens
LQHQEVKPYTL

SEQ ID NO: 69117 - protein, 11 aa, Homo Sapiens
LQIRNDVLDSL

SEQ ID NO: 69118 - protein, 11 aa, Homo Sapiens
LQWLESKEEVL

SEQ ID NO: 69119 - protein, 11 aa, Homo Sapiens
LSSDDANVLVW

SEQ ID NO: 69120 - protein, 11 aa, Homo Sapiens
MIINDPRYSAL

SEQ ID NO: 69121 - protein, 11 aa, Homo Sapiens
QGLNEGVGQGI

SEQ ID NO: 69122 - protein, 11 aa, Homo Sapiens
QIILEDQNCKL

SEQ ID NO: 69123 - protein, 11 aa, Homo Sapiens
QIVTAGLGDHL

SEQ ID NO: 69124 - protein, 11 aa, Homo Sapiens
QLEPEELYQTF

SEQ ID NO: 69125 - protein, 11 aa, Homo Sapiens
QLQDGHEREYI

SEQ ID NO: 69126 - protein, 11 aa, Homo Sapiens
QQAQLAAAEKF

SEQ ID NO: 69127 - protein, 11 aa, Homo Sapiens
QQCHQSILELF

SEQ ID NO: 69128 - protein, 11 aa, Homo Sapiens
RAANILVGENL

SEQ ID NO: 69129 - protein, 11 aa, Homo Sapiens
RAANILVSDTL

SEQ ID NO: 69130 - protein, 11 aa, Homo Sapiens
RAFQAHKEENW

SEQ ID NO: 69131 - protein, 11 aa, Homo Sapiens
RAQAGEFGDRL

SEQ ID NO: 69132 - protein, 11 aa, Homo Sapiens
REVDLKNGHNL

SEQ ID NO: 69133 - protein, 11 aa, Homo Sapiens
RIAEALSKMKL

SEQ ID NO: 69134 - protein, 11 aa, Homo Sapiens
RIAEIIKGELW

SEQ ID NO: 69135 - protein, 11 aa, Homo Sapiens
RIAQGLSSESW

SEQ ID NO: 69136 - protein, 11 aa, Homo Sapiens
RICEVINEAVW

SEQ ID NO: 69137 - protein, 11 aa, Homo Sapiens
RIDQKIYGELW

SEQ ID NO: 69138 - protein, 11 aa, Homo Sapiens
RIEDPQIQAHW

SEQ ID NO: 69139 - protein, 11 aa, Homo Sapiens
RIFNDSDFTGF

SEQ ID NO: 69140 - protein, 11 aa, Homo Sapiens
RIHNELSPLKL

SEQ ID NO: 69141 - protein, 11 aa, Homo Sapiens
RIHSGEKSESI

SEQ ID NO: 69142 - protein, 11 aa, Homo Sapiens
RIIDEEGVESI

SEQ ID NO: 69143 - protein, 11 aa, Homo Sapiens
RIIDNMGQEVI

SEQ ID NO: 69144 - protein, 11 aa, Homo Sapiens
RIIDVIDKELI

SEQ ID NO: 69145 - protein, 11 aa, Homo Sapiens
RIIEENIPELL

SEQ ID NO: 69146 - protein, 11 aa, Homo Sapiens
RIIEETLALKF

SEQ ID NO: 69147 - protein, 11 aa, Homo Sapiens
RIIGAKDHASI

SEQ ID NO: 69148 - protein, 11 aa, Homo Sapiens
RIINEPTAAAI

SEQ ID NO: 69149 - protein, 11 aa, Homo Sapiens
RIKENKGEERL

SEQ ID NO: 69150 - protein, 11 aa, Homo Sapiens
RILDMGFADTM

SEQ ID NO: 69151 - protein, 11 aa, Homo Sapiens
RIMDEKTASEL

SEQ ID NO: 69152 - protein, 11 aa, Homo Sapiens
RIMQDFESDTF

SEQ ID NO: 69153 - protein, 11 aa, Homo Sapiens
RINEDPKDALL

SEQ ID NO: 69154 - protein, 11 aa, Homo Sapiens
RIVDDCGGAFT

SEQ ID NO: 69155 - protein, 11 aa, Homo Sapiens
RIVDDWANDGW

SEQ ID NO: 69156 - protein, 11 aa, Homo Sapiens
RIVPSEVEPFL

SEQ ID NO: 69157 - protein, 11 aa, Homo Sapiens
RIYNDDKNTYI

SEQ ID NO: 69158 - protein, 11 aa, Homo Sapiens
RLAEETGVHII

SEQ ID NO: 69159 - protein, 11 aa, Homo Sapiens
RLAELTVDEFL

SEQ ID NO: 69160 - protein, 11 aa, Homo Sapiens
RLAEYFIGDVF

SEQ ID NO: 69161 - protein, 11 aa, Homo Sapiens
RLALFNPDVCW

SEQ ID NO: 69162 - protein, 11 aa, Homo Sapiens
RLAQDYLQCVL

SEQ ID NO: 69163 - protein, 11 aa, Homo Sapiens
RLCPNSTGAEI

SEQ ID NO: 69164 - protein, 11 aa, Homo Sapiens
RLCQPPVDGDL

SEQ ID NO: 69165 - protein, 11 aa, Homo Sapiens
RLDIDPETITW

SEQ ID NO: 69166 - protein, 11 aa, Homo Sapiens
RLEDELGGQFL

SEQ ID NO: 69167 - protein, 11 aa, Homo Sapiens
RLEEASLLHQF

SEQ ID NO: 69168 - protein, 11 aa, Homo Sapiens
RLEIEAENHYW

SEQ ID NO: 69169 - protein, 11 aa, Homo Sapiens
RLEKPAKYDDI

SEQ ID NO: 69170 - protein, 11 aa, Homo Sapiens
RLESIISGAAL

SEQ ID NO: 69171 - protein, 11 aa, Homo Sapiens
RLESNKEGTRW

SEQ ID NO: 69172 - protein, 11 aa, Homo Sapiens
RLESRTQLVTM

SEQ ID NO: 69173 - protein, 11 aa, Homo Sapiens
RLFDANKAELF

SEQ ID NO: 69174 - protein, 11 aa, Homo Sapiens
RLFDDSTVTTV

SEQ ID NO: 69175 - protein, 11 aa, Homo Sapiens
RLFDEGTISKW

SEQ ID NO: 69176 - protein, 11 aa, Homo Sapiens
RLFDEPQLASL

SEQ ID NO: 69177 - protein, 11 aa, Homo Sapiens
RLFDTQSKEKL

SEQ ID NO: 69178 - protein, 11 aa, Homo Sapiens
RLFEAEAQDLF

SEQ ID NO: 69179 - protein, 11 aa, Homo Sapiens
RLFEMGFAEQL

SEQ ID NO: 69180 - protein, 11 aa, Homo Sapiens
RLFGDEAAEQW

SEQ ID NO: 69181 - protein, 11 aa, Homo Sapiens
RLFGEDEVEVL

SEQ ID NO: 69182 - protein, 11 aa, Homo Sapiens
RLFGPVDSEQL

SEQ ID NO: 69183 - protein, 11 aa, Homo Sapiens
RLFILDEADKL

SEQ ID NO: 69184 - protein, 11 aa, Homo Sapiens
RLFKTALQEEI

SEQ ID NO: 69185 - protein, 11 aa, Homo Sapiens
RLFNDPVAMVL

SEQ ID NO: 69186 - protein, 11 aa, Homo Sapiens
RLFPNSFNDKF

SEQ ID NO: 69187 - protein, 11 aa, Homo Sapiens
RLFRAQDPDQL

SEQ ID NO: 69188 - protein, 11 aa, Homo Sapiens
RLFTEKVNNTF

SEQ ID NO: 69189 - protein, 11 aa, Homo Sapiens
RLHLSERRDSF

SEQ ID NO: 69190 - protein, 11 aa, Homo Sapiens
RLHQEGKFVEL

SEQ ID NO: 69191 - protein, 11 aa, Homo Sapiens
RLIALDAAEEF

SEQ ID NO: 69192 - protein, 11 aa, Homo Sapiens
RLIDDMVAQAM

SEQ ID NO: 69193 - protein, 11 aa, Homo Sapiens
RLIDGREAVTF

SEQ ID NO: 69194 - protein, 11 aa, Homo Sapiens
RLIEAGEQLGF

SEQ ID NO: 69195 - protein, 11 aa, Homo Sapiens
RLIEPPHTDSL

SEQ ID NO: 69196 - protein, 11 aa, Homo Sapiens
RLIFQPIEESF

SEQ ID NO: 69197 - protein, 11 aa, Homo Sapiens
RLIGDAAKNQL

SEQ ID NO: 69198 - protein, 11 aa, Homo Sapiens
RLIHEPSAALL

SEQ ID NO: 69199 - protein, 11 aa, Homo Sapiens
RLIHEQDLEWL

SEQ ID NO: 69200 - protein, 11 aa, Homo Sapiens
RLIKHAVQERL

SEQ ID NO: 69201 - protein, 11 aa, Homo Sapiens
RLILYNDGDSL

SEQ ID NO: 69202 - protein, 11 aa, Homo Sapiens
RLIQQVAQEIW

SEQ ID NO: 69203 - protein, 11 aa, Homo Sapiens
RLISEAQIQEF

SEQ ID NO: 69204 - protein, 11 aa, Homo Sapiens
RLKAAEADSKL

SEQ ID NO: 69205 - protein, 11 aa, Homo Sapiens
RLKSDERPVHI

SEQ ID NO: 69206 - protein, 11 aa, Homo Sapiens
RLLAEEEQQLL

SEQ ID NO: 69207 - protein, 11 aa, Homo Sapiens
RLLAEIGAVTL

SEQ ID NO: 69208 - protein, 11 aa, Homo Sapiens
RLLAGPDTEVL

SEQ ID NO: 69209 - protein, 11 aa, Homo Sapiens
RLLDDRHDSGL

SEQ ID NO: 69210 - protein, 11 aa, Homo Sapiens
RLLDKLVGEFL

SEQ ID NO: 69211 - protein, 11 aa, Homo Sapiens
RLLEDKKITVL

SEQ ID NO: 69212 - protein, 11 aa, Homo Sapiens
RLLEDSALSKY

SEQ ID NO: 69213 - protein, 11 aa, Homo Sapiens
RLLEEKDPVPL

SEQ ID NO: 69214 - protein, 11 aa, Homo Sapiens
RLLFSSDSDLL

SEQ ID NO: 69215 - protein, 11 aa, Homo Sapiens
RLLGTPSQETW

SEQ ID NO: 69216 - protein, 11 aa, Homo Sapiens
RLLHHDDPEVL

SEQ ID NO: 69217 - protein, 11 aa, Homo Sapiens
RLLKGKKGEQM

SEQ ID NO: 69218 - protein, 11 aa, Homo Sapiens
RLLQEDSSPLL

SEQ ID NO: 69219 - protein, 11 aa, Homo Sapiens
RLLSELEYEAW

SEQ ID NO: 69220 - protein, 11 aa, Homo Sapiens
RLLVFTSDDTF

SEQ ID NO: 69221 - protein, 11 aa, Homo Sapiens
RLMDEFKIGEL

SEQ ID NO: 69222 - protein, 11 aa, Homo Sapiens
RLMNDMTAVAL

SEQ ID NO: 69223 - protein, 11 aa, Homo Sapiens
RLMNETTAVAL

SEQ ID NO: 69224 - protein, 11 aa, Homo Sapiens
RLNYEHDNISL

SEQ ID NO: 69225 - protein, 11 aa, Homo Sapiens
RLPAAGVGDMV

SEQ ID NO: 69226 - protein, 11 aa, Homo Sapiens
RLPADTCLLEF

SEQ ID NO: 69227 - protein, 11 aa, Homo Sapiens
RLPDHLIKDLF

SEQ ID NO: 69228 - protein, 11 aa, Homo Sapiens
RLPDNYTQDTW

SEQ ID NO: 69229 - protein, 11 aa, Homo Sapiens
RLPGFSDSNVI

SEQ ID NO: 69230 - protein, 11 aa, Homo Sapiens
RLPPEIFGDAL

SEQ ID NO: 69231 - protein, 11 aa, Homo Sapiens
RLPSSSSGDQL

SEQ ID NO: 69232 - protein, 11 aa, Homo Sapiens
RLPVGGFADLM

SEQ ID NO: 69233 - protein, 11 aa, Homo Sapiens
RLQAEEKAHAF

SEQ ID NO: 69234 - protein, 11 aa, Homo Sapiens
RLQEALDAEML

SEQ ID NO: 69235 - protein, 11 aa, Homo Sapiens
RLQIEDFEARI

SEQ ID NO: 69236 - protein, 11 aa, Homo Sapiens
RLQLEKAAWRW

SEQ ID NO: 69237 - protein, 11 aa, Homo Sapiens
RLQQLFKGSQF

SEQ ID NO: 69238 - protein, 11 aa, Homo Sapiens
RLQYAIISEAW

SEQ ID NO: 69239 - protein, 11 aa, Homo Sapiens
RLREEQQRERL

SEQ ID NO: 69240 - protein, 11 aa, Homo Sapiens
RLRYPVTPELL

SEQ ID NO: 69241 - protein, 11 aa, Homo Sapiens
RLSLPESTESF

SEQ ID NO: 69242 - protein, 11 aa, Homo Sapiens
RLSQATDLEQL

SEQ ID NO: 69243 - protein, 11 aa, Homo Sapiens
RLVAGPRTDTL

SEQ ID NO: 69244 - protein, 11 aa, Homo Sapiens
RLVAGSTDQLL

SEQ ID NO: 69245 - protein, 11 aa, Homo Sapiens
RLVHTTAIEHF

SEQ ID NO: 69246 - protein, 11 aa, Homo Sapiens
RLVPKHEEEAF

SEQ ID NO: 69247 - protein, 11 aa, Homo Sapiens
RLVRDKDTDKF

SEQ ID NO: 69248 - protein, 11 aa, Homo Sapiens
RLWEDSAGEKW

SEQ ID NO: 69249 - protein, 11 aa, Homo Sapiens
RLWGDHGQEAL

SEQ ID NO: 69250 - protein, 11 aa, Homo Sapiens
RLYAESDYDAF

SEQ ID NO: 69251 - protein, 11 aa, Homo Sapiens
RLYAGPEVDIW

SEQ ID NO: 69252 - protein, 11 aa, Homo Sapiens
RLYDLDKDEKI

SEQ ID NO: 69253 - protein, 11 aa, Homo Sapiens
RLYEAYLPETF

SEQ ID NO: 69254 - protein, 11 aa, Homo Sapiens
RLYEDSGYSSF

SEQ ID NO: 69255 - protein, 11 aa, Homo Sapiens
RLYHEADKTYM

SEQ ID NO: 69256 - protein, 11 aa, Homo Sapiens
RLYSENDRLRI

SEQ ID NO: 69257 - protein, 11 aa, Homo Sapiens
RLYTEDEFEKF

SEQ ID NO: 69258 - protein, 11 aa, Homo Sapiens
RLYTEEAFDKL

SEQ ID NO: 69259 - protein, 11 aa, Homo Sapiens
RMAPDHEKACI

SEQ ID NO: 69260 - protein, 11 aa, Homo Sapiens
RMENGVLGNAL

SEQ ID NO: 69261 - protein, 11 aa, Homo Sapiens
RMIHEDTRHLL

SEQ ID NO: 69262 - protein, 11 aa, Homo Sapiens
RMQLSDDEGHF

SEQ ID NO: 69263 - protein, 11 aa, Homo Sapiens
RMSYNEKSDIW

SEQ ID NO: 69264 - protein, 11 aa, Homo Sapiens
RQAAEDKSWRV

SEQ ID NO: 69265 - protein, 11 aa, Homo Sapiens
RQAAGKIFEIF

SEQ ID NO: 69266 - protein, 11 aa, Homo Sapiens
RQAAKTEIEKL

SEQ ID NO: 69267 - protein, 11 aa, Homo Sapiens
RQAATEFGWTL

SEQ ID NO: 69268 - protein, 11 aa, Homo Sapiens
RQADFEAHNIL

SEQ ID NO: 69269 - protein, 11 aa, Homo Sapiens
RQADTKAIQHL

SEQ ID NO: 69270 - protein, 11 aa, Homo Sapiens
RQALEEANAEL

SEQ ID NO: 69271 - protein, 11 aa, Homo Sapiens
RQALMPTLEAL

SEQ ID NO: 69272 - protein, 11 aa, Homo Sapiens
RQALPDSPERF

SEQ ID NO: 69273 - protein, 11 aa, Homo Sapiens
RQALVEFEDVL

SEQ ID NO: 69274 - protein, 11 aa, Homo Sapiens
RQAMPFKCMQL

SEQ ID NO: 69275 - protein, 11 aa, Homo Sapiens
RQAQASFRDGL

SEQ ID NO: 69276 - protein, 11 aa, Homo Sapiens
RQAQENATLLF

SEQ ID NO: 69277 - protein, 11 aa, Homo Sapiens
RQCEVLIRELW

SEQ ID NO: 69278 - protein, 11 aa, Homo Sapiens
RQDKRTVYVYL

SEQ ID NO: 69279 - protein, 11 aa, Homo Sapiens
RQEDVIATANL

SEQ ID NO: 69280 - protein, 11 aa, Homo Sapiens
RQENIELGEKL

SEQ ID NO: 69281 - protein, 11 aa, Homo Sapiens
RQEPYTLPQGF

SEQ ID NO: 69282 - protein, 11 aa, Homo Sapiens
RQETVAQAALL

SEQ ID NO: 69283 - protein, 11 aa, Homo Sapiens
RQFCSGSGHHL

SEQ ID NO: 69284 - protein, 11 aa, Homo Sapiens
RQFDEESLESF

SEQ ID NO: 69285 - protein, 11 aa, Homo Sapiens
RQFFNEPEENF

SEQ ID NO: 69286 - protein, 11 aa, Homo Sapiens
RQFMEIEPEML

SEQ ID NO: 69287 - protein, 11 aa, Homo Sapiens
RQFVEHASEKL

SEQ ID NO: 69288 - protein, 11 aa, Homo Sapiens
RQFVPIKVEQI

SEQ ID NO: 69289 - protein, 11 aa, Homo Sapiens
RQGKFEAAETL

SEQ ID NO: 69290 - protein, 11 aa, Homo Sapiens
RQGSPKILEHL

SEQ ID NO: 69291 - protein, 11 aa, Homo Sapiens
RQHAEHIFLSF

SEQ ID NO: 69292 - protein, 11 aa, Homo Sapiens
RQHEIDGKALF

SEQ ID NO: 69293 - protein, 11 aa, Homo Sapiens
RQHIQVFIDRF

SEQ ID NO: 69294 - protein, 11 aa, Homo Sapiens
RQHLQATGVSL

SEQ ID NO: 69295 - protein, 11 aa, Homo Sapiens
RQHPFEDGAKL

SEQ ID NO: 69296 - protein, 11 aa, Homo Sapiens
RQHQAGSDSLL

SEQ ID NO: 69297 - protein, 11 aa, Homo Sapiens
RQHSLPSSEHL

SEQ ID NO: 69298 - protein, 11 aa, Homo Sapiens
RQIASQLEQEW

SEQ ID NO: 69299 - protein, 11 aa, Homo Sapiens
RQIEEQKALAL

SEQ ID NO: 69300 - protein, 11 aa, Homo Sapiens
RQIEILELEDL

SEQ ID NO: 69301 - protein, 11 aa, Homo Sapiens
RQIIEQDKHAL

SEQ ID NO: 69302 - protein, 11 aa, Homo Sapiens
RQILEKKEGLF

SEQ ID NO: 69303 - protein, 11 aa, Homo Sapiens
RQIPLYIDDTL

SEQ ID NO: 69304 - protein, 11 aa, Homo Sapiens
RQISNIKKEKL

SEQ ID NO: 69305 - protein, 11 aa, Homo Sapiens
RQISTSGELSF

SEQ ID NO: 69306 - protein, 11 aa, Homo Sapiens
RQIYEEANKTM

SEQ ID NO: 69307 - protein, 11 aa, Homo Sapiens
RQLDEGEISTI

SEQ ID NO: 69308 - protein, 11 aa, Homo Sapiens
RQLEALENDNF

SEQ ID NO: 69309 - protein, 11 aa, Homo Sapiens
RQLEEYQGILL

SEQ ID NO: 69310 - protein, 11 aa, Homo Sapiens
RQLKDEAIVYL

SEQ ID NO: 69311 - protein, 11 aa, Homo Sapiens
RQLKKLDEDSL

SEQ ID NO: 69312 - protein, 11 aa, Homo Sapiens
RQLLLYEAEAL

SEQ ID NO: 69313 - protein, 11 aa, Homo Sapiens
RQLNEKLVQLI

SEQ ID NO: 69314 - protein, 11 aa, Homo Sapiens
RQLQQELADTL

SEQ ID NO: 69315 - protein, 11 aa, Homo Sapiens
RQLREQVNDLF

SEQ ID NO: 69316 - protein, 11 aa, Homo Sapiens
RQLSEEERGRL

SEQ ID NO: 69317 - protein, 11 aa, Homo Sapiens
RQLTANTGHTI

SEQ ID NO: 69318 - protein, 11 aa, Homo Sapiens
RQLWDSAVSHF

SEQ ID NO: 69319 - protein, 11 aa, Homo Sapiens
RQMQLEDGGQL

SEQ ID NO: 69320 - protein, 11 aa, Homo Sapiens
RQMQQKMKETL

SEQ ID NO: 69321 - protein, 11 aa, Homo Sapiens
RQNAEQHVTQL

SEQ ID NO: 69322 - protein, 11 aa, Homo Sapiens
RQNKESILEKF

SEQ ID NO: 69323 - protein, 11 aa, Homo Sapiens
RQNKTEAEQQI

SEQ ID NO: 69324 - protein, 11 aa, Homo Sapiens
RQNLDALLNQL

SEQ ID NO: 69325 - protein, 11 aa, Homo Sapiens
RQNLFQEAEEF

SEQ ID NO: 69326 - protein, 11 aa, Homo Sapiens
RQPRNPKTDKL

SEQ ID NO: 69327 - protein, 11 aa, Homo Sapiens
RQQALQHAQTL

SEQ ID NO: 69328 - protein, 11 aa, Homo Sapiens
RQQEQMKQQQW

SEQ ID NO: 69329 - protein, 11 aa, Homo Sapiens
RQQFEVNGHFF

SEQ ID NO: 69330 - protein, 11 aa, Homo Sapiens
RQQGKEVGETL

SEQ ID NO: 69331 - protein, 11 aa, Homo Sapiens
RQQGNEPSQIL

SEQ ID NO: 69332 - protein, 11 aa, Homo Sapiens
RQQHEGAQGAL

SEQ ID NO: 69333 - protein, 11 aa, Homo Sapiens
RQQLPLPYEQL

SEQ ID NO: 69334 - protein, 11 aa, Homo Sapiens
RQQLPTFLQQM

SEQ ID NO: 69335 - protein, 11 aa, Homo Sapiens
RQQLQTTRQEL

SEQ ID NO: 69336 - protein, 11 aa, Homo Sapiens
RQSFGTNSDVL

SEQ ID NO: 69337 - protein, 11 aa, Homo Sapiens
RQSLAESLFAW

SEQ ID NO: 69338 - protein, 11 aa, Homo Sapiens
RQTLSVVFDAF

SEQ ID NO: 69339 - protein, 11 aa, Homo Sapiens
RQTMEDLISLW

SEQ ID NO: 69340 - protein, 11 aa, Homo Sapiens
RQVDAEVAQQW

SEQ ID NO: 69341 - protein, 11 aa, Homo Sapiens
RQVGVGYVDSI

SEQ ID NO: 69342 - protein, 11 aa, Homo Sapiens
RQVTGVTRVTI

SEQ ID NO: 69343 - protein, 11 aa, Homo Sapiens
RQVVESVGNQM

SEQ ID NO: 69344 - protein, 11 aa, Homo Sapiens
RQWADDWLVHL

SEQ ID NO: 69345 - protein, 11 aa, Homo Sapiens
RQWEEQGELLL

SEQ ID NO: 69346 - protein, 11 aa, Homo Sapiens
RQYGDESTLAF

SEQ ID NO: 69347 - protein, 11 aa, Homo Sapiens
RQYGSEGRFTF

SEQ ID NO: 69348 - protein, 11 aa, Homo Sapiens
RQYSDMPPLTL

SEQ ID NO: 69349 - protein, 11 aa, Homo Sapiens
RSDPGLLTNTM

SEQ ID NO: 69350 - protein, 11 aa, Homo Sapiens
RSYQDPSNAQF

SEQ ID NO: 69351 - protein, 11 aa, Homo Sapiens
RTAGTLFGEGF

SEQ ID NO: 69352 - protein, 11 aa, Homo Sapiens
RTFKTVFAEHI

SEQ ID NO: 69353 - protein, 11 aa, Homo Sapiens
RTIADSLINSF

SEQ ID NO: 69354 - protein, 11 aa, Homo Sapiens
RTIAETEAAYL

SEQ ID NO: 69355 - protein, 11 aa, Homo Sapiens
RTILQHLSEAW

SEQ ID NO: 69356 - protein, 11 aa, Homo Sapiens
RVAEETIKDYF

SEQ ID NO: 69357 - protein, 11 aa, Homo Sapiens
RVDPNGSRYLL

SEQ ID NO: 69358 - protein, 11 aa, Homo Sapiens
RVFEDESGKHW

SEQ ID NO: 69359 - protein, 11 aa, Homo Sapiens
RVHDVLFGDVW

SEQ ID NO: 69360 - protein, 11 aa, Homo Sapiens
RVIDDSLVVGV

SEQ ID NO: 69361 - protein, 11 aa, Homo Sapiens
RVIEEAKTAFL

SEQ ID NO: 69362 - protein, 11 aa, Homo Sapiens
RVINEPTAAAL

SEQ ID NO: 69363 - protein, 11 aa, Homo Sapiens
RVISELQEACW

SEQ ID NO: 69364 - protein, 11 aa, Homo Sapiens
RVLPSIVNEVL

SEQ ID NO: 69365 - protein, 11 aa, Homo Sapiens
RVMDASAFEIF

SEQ ID NO: 69366 - protein, 11 aa, Homo Sapiens
RVMSEKDEYQF

SEQ ID NO: 69367 - protein, 11 aa, Homo Sapiens
RVNGQYIMEGL

SEQ ID NO: 69368 - protein, 11 aa, Homo Sapiens
RVREEHQGENL

SEQ ID NO: 69369 - protein, 11 aa, Homo Sapiens
RVVDDDGMTSL

SEQ ID NO: 69370 - protein, 11 aa, Homo Sapiens
RVVDEKTKDLI

SEQ ID NO: 69371 - protein, 11 aa, Homo Sapiens
RVWDVNTGEVL

SEQ ID NO: 69372 - protein, 11 aa, Homo Sapiens
SLAADAGLLQF

SEQ ID NO: 69373 - protein, 11 aa, Homo Sapiens
SLVASGKAELI

SEQ ID NO: 69374 - protein, 11 aa, Homo Sapiens
SLYQDQILEKF

SEQ ID NO: 69375 - protein, 11 aa, Homo Sapiens
SQCGAGVFEYF

SEQ ID NO: 69376 - protein, 11 aa, Homo Sapiens
SQEEPGKGSFW

SEQ ID NO: 69377 - protein, 11 aa, Homo Sapiens
SQEMDAGLQAW

SEQ ID NO: 69378 - protein, 11 aa, Homo Sapiens
SQGFLPHFQHF

SEQ ID NO: 69379 - protein, 11 aa, Homo Sapiens
SQHDGSITASL

SEQ ID NO: 69380 - protein, 11 aa, Homo Sapiens
SQINLSVENAW

SEQ ID NO: 69381 - protein, 11 aa, Homo Sapiens
SQSPALELDKF

SEQ ID NO: 69382 - protein, 11 aa, Homo Sapiens
SQSPGSSENQM

SEQ ID NO: 69383 - protein, 11 aa, Homo Sapiens
SQVALADKELL

SEQ ID NO: 69384 - protein, 11 aa, Homo Sapiens
SQVIIREGELL

SEQ ID NO: 69385 - protein, 11 aa, Homo Sapiens
TLIPHTDGEKL

SEQ ID NO: 69386 - protein, 11 aa, Homo Sapiens
TLQVNGRHEYL

SEQ ID NO: 69387 - protein, 11 aa, Homo Sapiens
TLVEDPAGCVW

SEQ ID NO: 69388 - protein, 11 aa, Homo Sapiens
TQANPGKGEGL

SEQ ID NO: 69389 - protein, 11 aa, Homo Sapiens
TQERGQESNRF

SEQ ID NO: 69390 - protein, 11 aa, Homo Sapiens
TQFFGFDTETF

SEQ ID NO: 69391 - protein, 11 aa, Homo Sapiens
VLLEEGEAQRL

SEQ ID NO: 69392 - protein, 11 aa, Homo Sapiens
VLLNEDGKQLL

SEQ ID NO: 69393 - protein, 11 aa, Homo Sapiens
VLPGFPDADSF

SEQ ID NO: 69394 - protein, 11 aa, Homo Sapiens
VMIDEDMTARI

SEQ ID NO: 69395 - protein, 11 aa, Homo Sapiens
VQEGHTAVVSF

SEQ ID NO: 69396 - protein, 11 aa, Homo Sapiens
VQEGQNLKITI

SEQ ID NO: 69397 - protein, 11 aa, Homo Sapiens
VQFDSGKLEAL

SEQ ID NO: 69398 - protein, 11 aa, Homo Sapiens
VQFPGDQDLRF

SEQ ID NO: 69399 - protein, 11 aa, Homo Sapiens
VQHSNVVINLI

SEQ ID NO: 69400 - protein, 11 aa, Homo Sapiens
VQQDPKHMEAW

SEQ ID NO: 69401 - protein, 11 aa, Homo Sapiens
VSDGNINSDRI

SEQ ID NO: 69402 - protein, 11 aa, Homo Sapiens
VVDRSQAGDRI

SEQ ID NO: 69403 - protein, 11 aa, Homo Sapiens
YEFDEQGHSTW

SEQ ID NO: 69404 - protein, 11 aa, Homo Sapiens
YLAADGKSTTW

SEQ ID NO: 69405 - protein, 11 aa, Homo Sapiens
YLAQPLLREVL

SEQ ID NO: 69406 - protein, 11 aa, Homo Sapiens
YLEKSGVLDTL

SEQ ID NO: 69407 - protein, 11 aa, Homo Sapiens
YLFGSDVVAQF

SEQ ID NO: 69408 - protein, 11 aa, Homo Sapiens
YLINPNGEVQW

SEQ ID NO: 69409 - protein, 11 aa, Homo Sapiens
YLVDDSFSQAL

SEQ ID NO: 69410 - protein, 11 aa, Homo Sapiens
YLVSPITGEKI

SEQ ID NO: 69411 - protein, 11 aa, Homo Sapiens
YLYESGETEKL

SEQ ID NO: 69412 - protein, 11 aa, Homo Sapiens
YMIGSEVGNYL

SEQ ID NO: 69413 - protein, 11 aa, Homo Sapiens
YQAKENDFDRL

SEQ ID NO: 69414 - protein, 11 aa, Homo Sapiens
YQDAAGPREAF

SEQ ID NO: 69415 - protein, 11 aa, Homo Sapiens
YQFIEPFEEKF

SEQ ID NO: 69416 - protein, 11 aa, Homo Sapiens
YQLDLPKANLL

SEQ ID NO: 69417 - protein, 11 aa, Homo Sapiens
YQLFDNDRTQL

SEQ ID NO: 69418 - protein, 11 aa, Homo Sapiens
YQLQTIKPENF

SEQ ID NO: 69419 - protein, 11 aa, Homo Sapiens
YVCDPVLGDKW

SEQ ID NO: 69420 - protein, 8 aa, Homo Sapiens
AQAEALRI

SEQ ID NO: 69421 - protein, 8 aa, Homo Sapiens
AQFKQLLI

SEQ ID NO: 69422 - protein, 8 aa, Homo Sapiens
AQFPSVAV

SEQ ID NO: 69423 - protein, 8 aa, Homo Sapiens
AQIQVQHV

SEQ ID NO: 69424 - protein, 8 aa, Homo Sapiens
AQLAVTKI

SEQ ID NO: 69425 - protein, 8 aa, Homo Sapiens
AQLPAHRV

SEQ ID NO: 69426 - protein, 8 aa, Homo Sapiens
AQQVCHAI

SEQ ID NO: 69427 - protein, 8 aa, Homo Sapiens
AQVLLHNV

SEQ ID NO: 69428 - protein, 8 aa, Homo Sapiens
AQYFLDKI

SEQ ID NO: 69429 - protein, 8 aa, Homo Sapiens
AQYQFTGI

SEQ ID NO: 69430 - protein, 8 aa, Homo Sapiens
FQRIVENV

SEQ ID NO: 69431 - protein, 8 aa, Homo Sapiens
FQTILTEI

SEQ ID NO: 69432 - protein, 8 aa, Homo Sapiens
FQVLQPQV

SEQ ID NO: 69433 - protein, 8 aa, Homo Sapiens
GKDAVEDL

SEQ ID NO: 69434 - protein, 8 aa, Homo Sapiens
GQCTQVRV

SEQ ID NO: 69435 - protein, 8 aa, Homo Sapiens
GQFKTYAI

SEQ ID NO: 69436 - protein, 8 aa, Homo Sapiens
GQIKIWEV

SEQ ID NO: 69437 - protein, 8 aa, Homo Sapiens
GQIVQSKI

SEQ ID NO: 69438 - protein, 8 aa, Homo Sapiens
GQLKGFAV

SEQ ID NO: 69439 - protein, 8 aa, Homo Sapiens
GQLKSVTI

SEQ ID NO: 69440 - protein, 8 aa, Homo Sapiens
GQVCLPVI

SEQ ID NO: 69441 - protein, 8 aa, Homo Sapiens
GQVIIHNI

SEQ ID NO: 69442 - protein, 8 aa, Homo Sapiens
GQWEVKKI

SEQ ID NO: 69443 - protein, 8 aa, Homo Sapiens
GSVVQFKI

SEQ ID NO: 69444 - protein, 8 aa, Homo Sapiens
HIFHAIAV

SEQ ID NO: 69445 - protein, 8 aa, Homo Sapiens
HQIIVQNV

SEQ ID NO: 69446 - protein, 8 aa, Homo Sapiens
HQQSIPAV

SEQ ID NO: 69447 - protein, 8 aa, Homo Sapiens
HQYVVPKI

SEQ ID NO: 69448 - protein, 8 aa, Homo Sapiens
HTICLWDI

SEQ ID NO: 69449 - protein, 8 aa, Homo Sapiens
IFCLQKLI

SEQ ID NO: 69450 - protein, 8 aa, Homo Sapiens
IQFPIQKI

SEQ ID NO: 69451 - protein, 8 aa, Homo Sapiens
IQHLIPKI

SEQ ID NO: 69452 - protein, 8 aa, Homo Sapiens
KGIVLEKV

SEQ ID NO: 69453 - protein, 8 aa, Homo Sapiens
KNICQFLV

SEQ ID NO: 69454 - protein, 8 aa, Homo Sapiens
KQIIHHLV

SEQ ID NO: 69455 - protein, 8 aa, Homo Sapiens
KQLIAKKI

SEQ ID NO: 69456 - protein, 8 aa, Homo Sapiens
KQLKAEVI

SEQ ID NO: 69457 - protein, 8 aa, Homo Sapiens
KQLTMYRV

SEQ ID NO: 69458 - protein, 8 aa, Homo Sapiens
KQLYLERV

SEQ ID NO: 69459 - protein, 8 aa, Homo Sapiens
KQMFVQRV

SEQ ID NO: 69460 - protein, 8 aa, Homo Sapiens
KQVQQPSV

SEQ ID NO: 69461 - protein, 8 aa, Homo Sapiens
KVHPAVVI

SEQ ID NO: 69462 - protein, 8 aa, Homo Sapiens
LQKKAILK

SEQ ID NO: 69463 - protein, 8 aa, Homo Sapiens
LQRVIDYI

SEQ ID NO: 69464 - protein, 8 aa, Homo Sapiens
MQIRIHQI

SEQ ID NO: 69465 - protein, 8 aa, Homo Sapiens
QQIKLWKV

SEQ ID NO: 69466 - protein, 8 aa, Homo Sapiens
QTIPLNKI

SEQ ID NO: 69467 - protein, 8 aa, Homo Sapiens
RCFYGFQI

SEQ ID NO: 69468 - protein, 8 aa, Homo Sapiens
RDYLHYHI

SEQ ID NO: 69469 - protein, 8 aa, Homo Sapiens
RILKSPEI

SEQ ID NO: 69470 - protein, 8 aa, Homo Sapiens
RIMKAQAL

SEQ ID NO: 69471 - protein, 8 aa, Homo Sapiens
RLKEAYSV

SEQ ID NO: 69472 - protein, 8 aa, Homo Sapiens
RLQIHQLI

SEQ ID NO: 69473 - protein, 8 aa, Homo Sapiens
RLQTALLV

SEQ ID NO: 69474 - protein, 8 aa, Homo Sapiens
RQFAAQTV

SEQ ID NO: 69475 - protein, 8 aa, Homo Sapiens
RQFSHRAI

SEQ ID NO: 69476 - protein, 8 aa, Homo Sapiens
RQHPGHLL

SEQ ID NO: 69477 - protein, 8 aa, Homo Sapiens
RQHPQPYI

SEQ ID NO: 69478 - protein, 8 aa, Homo Sapiens
RQHVLTRI

SEQ ID NO: 69479 - protein, 8 aa, Homo Sapiens
RQIDQFLV

SEQ ID NO: 69480 - protein, 8 aa, Homo Sapiens
RQIGQRTI

SEQ ID NO: 69481 - protein, 8 aa, Homo Sapiens
RQIKINEV

SEQ ID NO: 69482 - protein, 8 aa, Homo Sapiens
RQIKSFRV

SEQ ID NO: 69483 - protein, 8 aa, Homo Sapiens
RQISLNKV

SEQ ID NO: 69484 - protein, 8 aa, Homo Sapiens
RQKEIPRV

SEQ ID NO: 69485 - protein, 8 aa, Homo Sapiens
RQKFGYSV

SEQ ID NO: 69486 - protein, 8 aa, Homo Sapiens
RQKLDPKI

SEQ ID NO: 69487 - protein, 8 aa, Homo Sapiens
RQMFVNKV

SEQ ID NO: 69488 - protein, 8 aa, Homo Sapiens
RQMFVQRV

SEQ ID NO: 69489 - protein, 8 aa, Homo Sapiens
RQTVAVGV

SEQ ID NO: 69490 - protein, 8 aa, Homo Sapiens
RQVFQQTI

SEQ ID NO: 69491 - protein, 8 aa, Homo Sapiens
RQWLIEQI

SEQ ID NO: 69492 - protein, 8 aa, Homo Sapiens
RQYKDYKI

SEQ ID NO: 69493 - protein, 8 aa, Homo Sapiens
RSFQTSAI

SEQ ID NO: 69494 - protein, 8 aa, Homo Sapiens
RTFKGFQI

SEQ ID NO: 69495 - protein, 8 aa, Homo Sapiens
RTIKLEHV

SEQ ID NO: 69496 - protein, 8 aa, Homo Sapiens
RTMLVRKI

SEQ ID NO: 69497 - protein, 8 aa, Homo Sapiens
RVLRVYSI

SEQ ID NO: 69498 - protein, 8 aa, Homo Sapiens
RVVKLNEV

SEQ ID NO: 69499 - protein, 8 aa, Homo Sapiens
SQCLSKLV

SEQ ID NO: 69500 - protein, 8 aa, Homo Sapiens
SQFIEPKI

SEQ ID NO: 69501 - protein, 8 aa, Homo Sapiens
SQFLYPKV

SEQ ID NO: 69502 - protein, 8 aa, Homo Sapiens
SQIKLYNI

SEQ ID NO: 69503 - protein, 8 aa, Homo Sapiens
SQLILHLI

SEQ ID NO: 69504 - protein, 8 aa, Homo Sapiens
SQLRVAKV

SEQ ID NO: 69505 - protein, 8 aa, Homo Sapiens
SQSLLPAI

SEQ ID NO: 69506 - protein, 8 aa, Homo Sapiens
SQTIQPKV

SEQ ID NO: 69507 - protein, 8 aa, Homo Sapiens
TQLGAFYI

SEQ ID NO: 69508 - protein, 8 aa, Homo Sapiens
VQIKQETI

SEQ ID NO: 69509 - protein, 8 aa, Homo Sapiens
VQIRIFKI

SEQ ID NO: 69510 - protein, 8 aa, Homo Sapiens
VQLLIPRI

SEQ ID NO: 69511 - protein, 8 aa, Homo Sapiens
VQRLEPVI

SEQ ID NO: 69512 - protein, 8 aa, Homo Sapiens
YLRIADLI

SEQ ID NO: 69513 - protein, 8 aa, Homo Sapiens
YQFRLIVI

SEQ ID NO: 69514 - protein, 8 aa, Homo Sapiens
YQIAVTKV

SEQ ID NO: 69515 - protein, 8 aa, Homo Sapiens
YQIFQELI

SEQ ID NO: 69516 - protein, 8 aa, Homo Sapiens
YQIIMTMI

SEQ ID NO: 69517 - protein, 9 aa, Homo Sapiens
AAFEKALEV

SEQ ID NO: 69518 - protein, 9 aa, Homo Sapiens
AAGAVFLSV

SEQ ID NO: 69519 - protein, 9 aa, Homo Sapiens
AAHQIVQLI

SEQ ID NO: 69520 - protein, 9 aa, Homo Sapiens
AALKLPLLV

SEQ ID NO: 69521 - protein, 9 aa, Homo Sapiens
AAMSVAQRV

SEQ ID NO: 69522 - protein, 9 aa, Homo Sapiens
AASPIITLV

SEQ ID NO: 69523 - protein, 9 aa, Homo Sapiens
AAYKEAFEI

SEQ ID NO: 69524 - protein, 9 aa, Homo Sapiens
AETAVQLFI

SEQ ID NO: 69525 - protein, 9 aa, Homo Sapiens
AETRVFLEV

SEQ ID NO: 69526 - protein, 9 aa, Homo Sapiens
AFSDVILAV

SEQ ID NO: 69527 - protein, 9 aa, Homo Sapiens
AGFAFLTGV

SEQ ID NO: 69528 - protein, 9 aa, Homo Sapiens
AIARICQTV

SEQ ID NO: 69529 - protein, 9 aa, Homo Sapiens
AIFAIPLQI

SEQ ID NO: 69530 - protein, 9 aa, Homo Sapiens
AIFQIIQSI

SEQ ID NO: 69531 - protein, 9 aa, Homo Sapiens
AIFSKVMVI

SEQ ID NO: 69532 - protein, 9 aa, Homo Sapiens
AIINLFHLI

SEQ ID NO: 69533 - protein, 9 aa, Homo Sapiens
AIMDIVIKV

SEQ ID NO: 69534 - protein, 9 aa, Homo Sapiens
AISGMILSI

SEQ ID NO: 69535 - protein, 9 aa, Homo Sapiens
AISSVRLYI

SEQ ID NO: 69536 - protein, 9 aa, Homo Sapiens
AITSVQQRL

SEQ ID NO: 69537 - protein, 9 aa, Homo Sapiens
AIVDCIISI

SEQ ID NO: 69538 - protein, 9 aa, Homo Sapiens
AIYHVIMSV

SEQ ID NO: 69539 - protein, 9 aa, Homo Sapiens
AIYPEPFLI

SEQ ID NO: 69540 - protein, 9 aa, Homo Sapiens
ALAATVFCV

SEQ ID NO: 69541 - protein, 9 aa, Homo Sapiens
ALAKHLIKI

SEQ ID NO: 69542 - protein, 9 aa, Homo Sapiens
ALAKVLLSL

SEQ ID NO: 69543 - protein, 9 aa, Homo Sapiens
ALAPSTMKI

SEQ ID NO: 69544 - protein, 9 aa, Homo Sapiens
ALAQIPQKV

SEQ ID NO: 69545 - protein, 9 aa, Homo Sapiens
ALAQPVTTV

SEQ ID NO: 69546 - protein, 9 aa, Homo Sapiens
ALASEPLKV

SEQ ID NO: 69547 - protein, 9 aa, Homo Sapiens
ALCNIHENI

SEQ ID NO: 69548 - protein, 9 aa, Homo Sapiens
ALCPRIHEV

SEQ ID NO: 69549 - protein, 9 aa, Homo Sapiens
ALCVIRNLI

SEQ ID NO: 69550 - protein, 9 aa, Homo Sapiens
ALCVLAQTV

SEQ ID NO: 69551 - protein, 9 aa, Homo Sapiens
ALDAHQQSI

SEQ ID NO: 69552 - protein, 9 aa, Homo Sapiens
ALFDAQAQV

SEQ ID NO: 69553 - protein, 9 aa, Homo Sapiens
ALFNGAQKL

SEQ ID NO: 69554 - protein, 9 aa, Homo Sapiens
ALFPERITV

SEQ ID NO: 69555 - protein, 9 aa, Homo Sapiens
ALFQRPPLI

SEQ ID NO: 69556 - protein, 9 aa, Homo Sapiens
ALHDILTEI

SEQ ID NO: 69557 - protein, 9 aa, Homo Sapiens
ALIAHYPRI

SEQ ID NO: 69558 - protein, 9 aa, Homo Sapiens
ALIPIPLAV

SEQ ID NO: 69559 - protein, 9 aa, Homo Sapiens
ALKKADIGV

SEQ ID NO: 69560 - protein, 9 aa, Homo Sapiens
ALKKAEIGI

SEQ ID NO: 69561 - protein, 9 aa, Homo Sapiens
ALKNLQDKI

SEQ ID NO: 69562 - protein, 9 aa, Homo Sapiens
ALLAKILQI

SEQ ID NO: 69563 - protein, 9 aa, Homo Sapiens
ALLAYTLGV

SEQ ID NO: 69564 - protein, 9 aa, Homo Sapiens
ALLGILQHV

SEQ ID NO: 69565 - protein, 9 aa, Homo Sapiens
ALLNKTMRI

SEQ ID NO: 69566 - protein, 9 aa, Homo Sapiens
ALLRVTPFI

SEQ ID NO: 69567 - protein, 9 aa, Homo Sapiens
ALLRYVLSI

SEQ ID NO: 69568 - protein, 9 aa, Homo Sapiens
ALNAVRLLV

SEQ ID NO: 69569 - protein, 9 aa, Homo Sapiens
ALNELLQHV

SEQ ID NO: 69570 - protein, 9 aa, Homo Sapiens
ALNRLFQQI

SEQ ID NO: 69571 - protein, 9 aa, Homo Sapiens
ALNRSVQVV

SEQ ID NO: 69572 - protein, 9 aa, Homo Sapiens
ALNSGILTI

SEQ ID NO: 69573 - protein, 9 aa, Homo Sapiens
ALNSKILSV

SEQ ID NO: 69574 - protein, 9 aa, Homo Sapiens
ALNYLQLLV

SEQ ID NO: 69575 - protein, 9 aa, Homo Sapiens
ALPKIILAV

SEQ ID NO: 69576 - protein, 9 aa, Homo Sapiens
ALPNVYEVI

SEQ ID NO: 69577 - protein, 9 aa, Homo Sapiens
ALRALQDQV

SEQ ID NO: 69578 - protein, 9 aa, Homo Sapiens
ALRWSVDSI

SEQ ID NO: 69579 - protein, 9 aa, Homo Sapiens
ALSDIFQAV

SEQ ID NO: 69580 - protein, 9 aa, Homo Sapiens
ALSKVHFTA

SEQ ID NO: 69581 - protein, 9 aa, Homo Sapiens
ALSPSYLTV

SEQ ID NO: 69582 - protein, 9 aa, Homo Sapiens
ALSRLKLKL

SEQ ID NO: 69583 - protein, 9 aa, Homo Sapiens
ALSTLRQKI

SEQ ID NO: 69584 - protein, 9 aa, Homo Sapiens
ALTDVILCV

SEQ ID NO: 69585 - protein, 9 aa, Homo Sapiens
ALTSIAQKI

SEQ ID NO: 69586 - protein, 9 aa, Homo Sapiens
ALVRYYLQV

SEQ ID NO: 69587 - protein, 9 aa, Homo Sapiens
ALYCHQLNI

SEQ ID NO: 69588 - protein, 9 aa, Homo Sapiens
ALYEQSLHI

SEQ ID NO: 69589 - protein, 9 aa, Homo Sapiens
ALYGQPLLL

SEQ ID NO: 69590 - protein, 9 aa, Homo Sapiens
ALYPNVVQV

SEQ ID NO: 69591 - protein, 9 aa, Homo Sapiens
AMAKIQAKI

SEQ ID NO: 69592 - protein, 9 aa, Homo Sapiens
AMAPVTTRI

SEQ ID NO: 69593 - protein, 9 aa, Homo Sapiens
AMFGKLMTI

SEQ ID NO: 69594 - protein, 9 aa, Homo Sapiens
AMKPKPLSV

SEQ ID NO: 69595 - protein, 9 aa, Homo Sapiens
AMYPKYDRI

SEQ ID NO: 69596 - protein, 9 aa, Homo Sapiens
AQAAALYKV

SEQ ID NO: 69597 - protein, 9 aa, Homo Sapiens
AQAALAVNI

SEQ ID NO: 69598 - protein, 9 aa, Homo Sapiens
AQAELAQKL

SEQ ID NO: 69599 - protein, 9 aa, Homo Sapiens
AQAIKGMHI

SEQ ID NO: 69600 - protein, 9 aa, Homo Sapiens
AQAKIYWNL

SEQ ID NO: 69601 - protein, 9 aa, Homo Sapiens
AQAKPALKI

SEQ ID NO: 69602 - protein, 9 aa, Homo Sapiens
AQALAKLTI

SEQ ID NO: 69603 - protein, 9 aa, Homo Sapiens
AQALVKQDL

SEQ ID NO: 69604 - protein, 9 aa, Homo Sapiens
AQAMIFCHT

SEQ ID NO: 69605 - protein, 9 aa, Homo Sapiens
AQAPDLQRV

SEQ ID NO: 69606 - protein, 9 aa, Homo Sapiens
AQAVTQLMV

SEQ ID NO: 69607 - protein, 9 aa, Homo Sapiens
AQCLLRLVL

SEQ ID NO: 69608 - protein, 9 aa, Homo Sapiens
AQCNKAINI

SEQ ID NO: 69609 - protein, 9 aa, Homo Sapiens
AQCPIVERL

SEQ ID NO: 69610 - protein, 9 aa, Homo Sapiens
AQDFRVLYV

SEQ ID NO: 69611 - protein, 9 aa, Homo Sapiens
AQFAARAII

SEQ ID NO: 69612 - protein, 9 aa, Homo Sapiens
AQFEHTILL

SEQ ID NO: 69613 - protein, 9 aa, Homo Sapiens
AQFEHTLLV

SEQ ID NO: 69614 - protein, 9 aa, Homo Sapiens
AQFGYYFRV

SEQ ID NO: 69615 - protein, 9 aa, Homo Sapiens
AQFKGTQSL

SEQ ID NO: 69616 - protein, 9 aa, Homo Sapiens
AQFLYAQKL

SEQ ID NO: 69617 - protein, 9 aa, Homo Sapiens
AQFPESFTV

SEQ ID NO: 69618 - protein, 9 aa, Homo Sapiens
AQFSAQPHV

SEQ ID NO: 69619 - protein, 9 aa, Homo Sapiens
AQFSKSIEV

SEQ ID NO: 69620 - protein, 9 aa, Homo Sapiens
AQFSLPCEV

SEQ ID NO: 69621 - protein, 9 aa, Homo Sapiens
AQFTTALRL

SEQ ID NO: 69622 - protein, 9 aa, Homo Sapiens
AQFVLLTQI

SEQ ID NO: 69623 - protein, 9 aa, Homo Sapiens
AQGATLLHI

SEQ ID NO: 69624 - protein, 9 aa, Homo Sapiens
AQGGVLPNI

SEQ ID NO: 69625 - protein, 9 aa, Homo Sapiens
AQGKMKLLI

SEQ ID NO: 69626 - protein, 9 aa, Homo Sapiens
AQGKVKLVV

SEQ ID NO: 69627 - protein, 9 aa, Homo Sapiens
AQGLFTNCV

SEQ ID NO: 69628 - protein, 9 aa, Homo Sapiens
AQGQQTLKV

SEQ ID NO: 69629 - protein, 9 aa, Homo Sapiens
AQGVFQILI

SEQ ID NO: 69630 - protein, 9 aa, Homo Sapiens
AQHDDELTI

SEQ ID NO: 69631 - protein, 9 aa, Homo Sapiens
AQHGVCSVL

SEQ ID NO: 69632 - protein, 9 aa, Homo Sapiens
AQHIVPCTI

SEQ ID NO: 69633 - protein, 9 aa, Homo Sapiens
AQHKFLVAV

SEQ ID NO: 69634 - protein, 9 aa, Homo Sapiens
AQHKWILQL

SEQ ID NO: 69635 - protein, 9 aa, Homo Sapiens
AQHPNIVTV

SEQ ID NO: 69636 - protein, 9 aa, Homo Sapiens
AQHQTKLYL

SEQ ID NO: 69637 - protein, 9 aa, Homo Sapiens
AQHSIVLPL

SEQ ID NO: 69638 - protein, 9 aa, Homo Sapiens
AQHSVPLQL

SEQ ID NO: 69639 - protein, 9 aa, Homo Sapiens
AQHVEVESI

SEQ ID NO: 69640 - protein, 9 aa, Homo Sapiens
AQIDHYLGL

SEQ ID NO: 69641 - protein, 9 aa, Homo Sapiens
AQIELLQLL

SEQ ID NO: 69642 - protein, 9 aa, Homo Sapiens
AQIHGIVLV

SEQ ID NO: 69643 - protein, 9 aa, Homo Sapiens
AQIHTPVAI

SEQ ID NO: 69644 - protein, 9 aa, Homo Sapiens
AQIKPFYTV

SEQ ID NO: 69645 - protein, 9 aa, Homo Sapiens
AQILGPLSI

SEQ ID NO: 69646 - protein, 9 aa, Homo Sapiens
AQILQILTV

SEQ ID NO: 69647 - protein, 9 aa, Homo Sapiens
AQILRLLHI

SEQ ID NO: 69648 - protein, 9 aa, Homo Sapiens
AQIPLAAVI

SEQ ID NO: 69649 - protein, 9 aa, Homo Sapiens
AQIPSKVSV

SEQ ID NO: 69650 - protein, 9 aa, Homo Sapiens
AQIRTIAII

SEQ ID NO: 69651 - protein, 9 aa, Homo Sapiens
AQIRYLTQV

SEQ ID NO: 69652 - protein, 9 aa, Homo Sapiens
AQITQKIGV

SEQ ID NO: 69653 - protein, 9 aa, Homo Sapiens
AQKEEQLKI

SEQ ID NO: 69654 - protein, 9 aa, Homo Sapiens
AQKPVVHLI

SEQ ID NO: 69655 - protein, 9 aa, Homo Sapiens
AQKRVLLQA

SEQ ID NO: 69656 - protein, 9 aa, Homo Sapiens
AQKTILLQV

SEQ ID NO: 69657 - protein, 9 aa, Homo Sapiens
AQLAAAAEI

SEQ ID NO: 69658 - protein, 9 aa, Homo Sapiens
AQLAEDLKV

SEQ ID NO: 69659 - protein, 9 aa, Homo Sapiens
AQLELISRI

SEQ ID NO: 69660 - protein, 9 aa, Homo Sapiens
AQLGAVVAV

SEQ ID NO: 69661 - protein, 9 aa, Homo Sapiens
AQLKSLELI

SEQ ID NO: 69662 - protein, 9 aa, Homo Sapiens
AQLLKALEV

SEQ ID NO: 69663 - protein, 9 aa, Homo Sapiens
AQLLLPVSI

SEQ ID NO: 69664 - protein, 9 aa, Homo Sapiens
AQLLVACKV

SEQ ID NO: 69665 - protein, 9 aa, Homo Sapiens
AQLPLKVEV

SEQ ID NO: 69666 - protein, 9 aa, Homo Sapiens
AQLPMSIRI

SEQ ID NO: 69667 - protein, 9 aa, Homo Sapiens
AQLPSLLSV

SEQ ID NO: 69668 - protein, 9 aa, Homo Sapiens
AQLPTIVAI

SEQ ID NO: 69669 - protein, 9 aa, Homo Sapiens
AQLSPQLTV

SEQ ID NO: 69670 - protein, 9 aa, Homo Sapiens
AQLSPTHQI

SEQ ID NO: 69671 - protein, 9 aa, Homo Sapiens
AQLTSTPAI

SEQ ID NO: 69672 - protein, 9 aa, Homo Sapiens
AQMDYQLRL

SEQ ID NO: 69673 - protein, 9 aa, Homo Sapiens
AQNARALKI

SEQ ID NO: 69674 - protein, 9 aa, Homo Sapiens
AQNGIPLRI

SEQ ID NO: 69675 - protein, 9 aa, Homo Sapiens
AQNGVSQLI

SEQ ID NO: 69676 - protein, 9 aa, Homo Sapiens
AQNKLFNKI

SEQ ID NO: 69677 - protein, 9 aa, Homo Sapiens
AQNLHQNLI

SEQ ID NO: 69678 - protein, 9 aa, Homo Sapiens
AQNPQIKRI

SEQ ID NO: 69679 - protein, 9 aa, Homo Sapiens
AQNQVLNLI

SEQ ID NO: 69680 - protein, 9 aa, Homo Sapiens
AQNRFLLEL

SEQ ID NO: 69681 - protein, 9 aa, Homo Sapiens
AQNRLHVSI

SEQ ID NO: 69682 - protein, 9 aa, Homo Sapiens
AQNRQEFAV

SEQ ID NO: 69683 - protein, 9 aa, Homo Sapiens
AQPGIQMKV

SEQ ID NO: 69684 - protein, 9 aa, Homo Sapiens
AQPLQPLQV

SEQ ID NO: 69685 - protein, 9 aa, Homo Sapiens
AQQELKLLL

SEQ ID NO: 69686 - protein, 9 aa, Homo Sapiens
AQQIIQLNI

SEQ ID NO: 69687 - protein, 9 aa, Homo Sapiens
AQQPHIAGV

SEQ ID NO: 69688 - protein, 9 aa, Homo Sapiens
AQQPTAVQV

SEQ ID NO: 69689 - protein, 9 aa, Homo Sapiens
AQQVVKQEL

SEQ ID NO: 69690 - protein, 9 aa, Homo Sapiens
AQRAEPMRI

SEQ ID NO: 69691 - protein, 9 aa, Homo Sapiens
AQRAVELFI

SEQ ID NO: 69692 - protein, 9 aa, Homo Sapiens
AQRCKELGI

SEQ ID NO: 69693 - protein, 9 aa, Homo Sapiens
AQSAVEILL

SEQ ID NO: 69694 - protein, 9 aa, Homo Sapiens
AQSESILKV

SEQ ID NO: 69695 - protein, 9 aa, Homo Sapiens
AQSGLIVSI

SEQ ID NO: 69696 - protein, 9 aa, Homo Sapiens
AQSGTIMAV

SEQ ID NO: 69697 - protein, 9 aa, Homo Sapiens
AQSKLALVL

SEQ ID NO: 69698 - protein, 9 aa, Homo Sapiens
AQSQAVTKI

SEQ ID NO: 69699 - protein, 9 aa, Homo Sapiens
AQSRIALAL

SEQ ID NO: 69700 - protein, 9 aa, Homo Sapiens
AQSSLDLFL

SEQ ID NO: 69701 - protein, 9 aa, Homo Sapiens
AQSTSIQRI

SEQ ID NO: 69702 - protein, 9 aa, Homo Sapiens
AQTFIALCA

SEQ ID NO: 69703 - protein, 9 aa, Homo Sapiens
AQTKVTFLI

SEQ ID NO: 69704 - protein, 9 aa, Homo Sapiens
AQTLLTQDV

SEQ ID NO: 69705 - protein, 9 aa, Homo Sapiens
AQTLQQYRV

SEQ ID NO: 69706 - protein, 9 aa, Homo Sapiens
AQTSYIQQI

SEQ ID NO: 69707 - protein, 9 aa, Homo Sapiens
AQTVANFNI

SEQ ID NO: 69708 - protein, 9 aa, Homo Sapiens
AQVALVNEV

SEQ ID NO: 69709 - protein, 9 aa, Homo Sapiens
AQVKAPLVL

SEQ ID NO: 69710 - protein, 9 aa, Homo Sapiens
AQVNLKYLL

SEQ ID NO: 69711 - protein, 9 aa, Homo Sapiens
AQVPIILAV

SEQ ID NO: 69712 - protein, 9 aa, Homo Sapiens
AQVPMNMTI

SEQ ID NO: 69713 - protein, 9 aa, Homo Sapiens
AQVPVFLAL

SEQ ID NO: 69714 - protein, 9 aa, Homo Sapiens
AQVVGVLKI

SEQ ID NO: 69715 - protein, 9 aa, Homo Sapiens
AQWHEQILV

SEQ ID NO: 69716 - protein, 9 aa, Homo Sapiens
AQWLIQRGV

SEQ ID NO: 69717 - protein, 9 aa, Homo Sapiens
AQYDGAYKV

SEQ ID NO: 69718 - protein, 9 aa, Homo Sapiens
AQYDRQIRL

SEQ ID NO: 69719 - protein, 9 aa, Homo Sapiens
AQYEHDLEV

SEQ ID NO: 69720 - protein, 9 aa, Homo Sapiens
AQYENPPHI

SEQ ID NO: 69721 - protein, 9 aa, Homo Sapiens
AQYFEPLTL

SEQ ID NO: 69722 - protein, 9 aa, Homo Sapiens
AQYGKKVMV

SEQ ID NO: 69723 - protein, 9 aa, Homo Sapiens
AQYKFVYQV

SEQ ID NO: 69724 - protein, 9 aa, Homo Sapiens
AQYLINARL

SEQ ID NO: 69725 - protein, 9 aa, Homo Sapiens
AQYLINVRL

SEQ ID NO: 69726 - protein, 9 aa, Homo Sapiens
AQYLLQNSV

SEQ ID NO: 69727 - protein, 9 aa, Homo Sapiens
AQYNFILVV

SEQ ID NO: 69728 - protein, 9 aa, Homo Sapiens
AQYNPKLDV

SEQ ID NO: 69729 - protein, 9 aa, Homo Sapiens
AQYPSEHLI

SEQ ID NO: 69730 - protein, 9 aa, Homo Sapiens
AQYRGILEA

SEQ ID NO: 69731 - protein, 9 aa, Homo Sapiens
AQYRLVTEI

SEQ ID NO: 69732 - protein, 9 aa, Homo Sapiens
ASCDKILVI

SEQ ID NO: 69733 - protein, 9 aa, Homo Sapiens
ASCGAIQYI

SEQ ID NO: 69734 - protein, 9 aa, Homo Sapiens
ASLVFPLLV

SEQ ID NO: 69735 - protein, 9 aa, Homo Sapiens
ASYSGLMRI

SEQ ID NO: 69736 - protein, 9 aa, Homo Sapiens
ATASVNLKV

SEQ ID NO: 69737 - protein, 9 aa, Homo Sapiens
ATCMAILHV

SEQ ID NO: 69738 - protein, 9 aa, Homo Sapiens
ATHLVILLI

SEQ ID NO: 69739 - protein, 9 aa, Homo Sapiens
ATMPVTMLI

SEQ ID NO: 69740 - protein, 9 aa, Homo Sapiens
ATVPIRLII

SEQ ID NO: 69741 - protein, 9 aa, Homo Sapiens
ATVVTQLLV

SEQ ID NO: 69742 - protein, 9 aa, Homo Sapiens
AVADILFLL

SEQ ID NO: 69743 - protein, 9 aa, Homo Sapiens
AVAKHNLNI

SEQ ID NO: 69744 - protein, 9 aa, Homo Sapiens
AVDPAILLI

SEQ ID NO: 69745 - protein, 9 aa, Homo Sapiens
AVHAEVFTI

SEQ ID NO: 69746 - protein, 9 aa, Homo Sapiens
AVHNVPLSV

SEQ ID NO: 69747 - protein, 9 aa, Homo Sapiens
AVSPYQQVI

SEQ ID NO: 69748 - protein, 9 aa, Homo Sapiens
AVSSIAQKI

SEQ ID NO: 69749 - protein, 9 aa, Homo Sapiens
AVTDASFKV

SEQ ID NO: 69750 - protein, 9 aa, Homo Sapiens
AVVDTVLAL

SEQ ID NO: 69751 - protein, 9 aa, Homo Sapiens
AVYRKALVI

SEQ ID NO: 69752 - protein, 9 aa, Homo Sapiens
DIRGKLLQV

SEQ ID NO: 69753 - protein, 9 aa, Homo Sapiens
DLAAVILHV

SEQ ID NO: 69754 - protein, 9 aa, Homo Sapiens
DSQPPVFKV

SEQ ID NO: 69755 - protein, 9 aa, Homo Sapiens
EAAEVILRV

SEQ ID NO: 69756 - protein, 9 aa, Homo Sapiens
EIVRESHSL

SEQ ID NO: 69757 - protein, 9 aa, Homo Sapiens
ELAEIVFKV

SEQ ID NO: 69758 - protein, 9 aa, Homo Sapiens
ELCDIILRV

SEQ ID NO: 69759 - protein, 9 aa, Homo Sapiens
ELFGKFLFI

SEQ ID NO: 69760 - protein, 9 aa, Homo Sapiens
ELLRIGLSV

SEQ ID NO: 69761 - protein, 9 aa, Homo Sapiens
ELSKIIQKV

SEQ ID NO: 69762 - protein, 9 aa, Homo Sapiens
ELSRIVLEV

SEQ ID NO: 69763 - protein, 9 aa, Homo Sapiens
ELYPEPLLV

SEQ ID NO: 69764 - protein, 9 aa, Homo Sapiens
EQAATQLKV

SEQ ID NO: 69765 - protein, 9 aa, Homo Sapiens
EQAQVKLLV

SEQ ID NO: 69766 - protein, 9 aa, Homo Sapiens
EQFHYFILI

SEQ ID NO: 69767 - protein, 9 aa, Homo Sapiens
EQGEIILKV

SEQ ID NO: 69768 - protein, 9 aa, Homo Sapiens
EQGKIQLLI

SEQ ID NO: 69769 - protein, 9 aa, Homo Sapiens
EQHKALLKV

SEQ ID NO: 69770 - protein, 9 aa, Homo Sapiens
EQIRLAQMI

SEQ ID NO: 69771 - protein, 9 aa, Homo Sapiens
EQQSVLQRI

SEQ ID NO: 69772 - protein, 9 aa, Homo Sapiens
EQYKFPVVI

SEQ ID NO: 69773 - protein, 9 aa, Homo Sapiens
ESYGNPLRV

SEQ ID NO: 69774 - protein, 9 aa, Homo Sapiens
FALRVQQLV

SEQ ID NO: 69775 - protein, 9 aa, Homo Sapiens
FASQVEQLI

SEQ ID NO: 69776 - protein, 9 aa, Homo Sapiens
FEFDIHQVI

SEQ ID NO: 69777 - protein, 9 aa, Homo Sapiens
FETIVKQQI

SEQ ID NO: 69778 - protein, 9 aa, Homo Sapiens
FIAPVTLKV

SEQ ID NO: 69779 - protein, 9 aa, Homo Sapiens
FIGDVTQKI

SEQ ID NO: 69780 - protein, 9 aa, Homo Sapiens
FISKEILTI

SEQ ID NO: 69781 - protein, 9 aa, Homo Sapiens
FITNIPFDV

SEQ ID NO: 69782 - protein, 9 aa, Homo Sapiens
FLADIVQKL

SEQ ID NO: 69783 - protein, 9 aa, Homo Sapiens
FLCPFHLSV

SEQ ID NO: 69784 - protein, 9 aa, Homo Sapiens
FLFQEPRSI

SEQ ID NO: 69785 - protein, 9 aa, Homo Sapiens
FLGTFILKV

SEQ ID NO: 69786 - protein, 9 aa, Homo Sapiens
FLHGPDQQV

SEQ ID NO: 69787 - protein, 9 aa, Homo Sapiens
FLLDKALLI

SEQ ID NO: 69788 - protein, 9 aa, Homo Sapiens
FLLEKPFSV

SEQ ID NO: 69789 - protein, 9 aa, Homo Sapiens
FLLHIQQQV

SEQ ID NO: 69790 - protein, 9 aa, Homo Sapiens
FLNEIQQSI

SEQ ID NO: 69791 - protein, 9 aa, Homo Sapiens
FLPRIQQQI

SEQ ID NO: 69792 - protein, 9 aa, Homo Sapiens
FLRNLQDSI

SEQ ID NO: 69793 - protein, 9 aa, Homo Sapiens
FLSSVIQNL

SEQ ID NO: 69794 - protein, 9 aa, Homo Sapiens
FLYSDEVQI

SEQ ID NO: 69795 - protein, 9 aa, Homo Sapiens
FMASQMLKV

SEQ ID NO: 69796 - protein, 9 aa, Homo Sapiens
FMFGQKLNV

SEQ ID NO: 69797 - protein, 9 aa, Homo Sapiens
FQAEIAQLM

SEQ ID NO: 69798 - protein, 9 aa, Homo Sapiens
FQALLPYAV

SEQ ID NO: 69799 - protein, 9 aa, Homo Sapiens
FQDELIRAI

SEQ ID NO: 69800 - protein, 9 aa, Homo Sapiens
FQDPVPLTV

SEQ ID NO: 69801 - protein, 9 aa, Homo Sapiens
FQFGVPQAL

SEQ ID NO: 69802 - protein, 9 aa, Homo Sapiens
FQGDIRLLM

SEQ ID NO: 69803 - protein, 9 aa, Homo Sapiens
FQHGKVEII

SEQ ID NO: 69804 - protein, 9 aa, Homo Sapiens
FQHKLGIAV

SEQ ID NO: 69805 - protein, 9 aa, Homo Sapiens
FQHTGIYSV

SEQ ID NO: 69806 - protein, 9 aa, Homo Sapiens
FQHVAAPYI

SEQ ID NO: 69807 - protein, 9 aa, Homo Sapiens
FQIGPCEGI

SEQ ID NO: 69808 - protein, 9 aa, Homo Sapiens
FQKLYDLYI

SEQ ID NO: 69809 - protein, 9 aa, Homo Sapiens
FQLIQKELI

SEQ ID NO: 69810 - protein, 9 aa, Homo Sapiens
FQNIRPLFI

SEQ ID NO: 69811 - protein, 9 aa, Homo Sapiens
FQNNVQVKV

SEQ ID NO: 69812 - protein, 9 aa, Homo Sapiens
FQNTFPHSI

SEQ ID NO: 69813 - protein, 9 aa, Homo Sapiens
FQQPKPLSV

SEQ ID NO: 69814 - protein, 9 aa, Homo Sapiens
FQRAVKDEL

SEQ ID NO: 69815 - protein, 9 aa, Homo Sapiens
FQSSAVMAL

SEQ ID NO: 69816 - protein, 9 aa, Homo Sapiens
FQSTTGHCV

SEQ ID NO: 69817 - protein, 9 aa, Homo Sapiens
FQTLKYLAI

SEQ ID NO: 69818 - protein, 9 aa, Homo Sapiens
FQVTRDLIV

SEQ ID NO: 69819 - protein, 9 aa, Homo Sapiens
FRVPTANVS

SEQ ID NO: 69820 - protein, 9 aa, Homo Sapiens
FSSDFTLKI

SEQ ID NO: 69821 - protein, 9 aa, Homo Sapiens
FSVPVKQEV

SEQ ID NO: 69822 - protein, 9 aa, Homo Sapiens
FVCDIRPEI

SEQ ID NO: 69823 - protein, 9 aa, Homo Sapiens
FVFKEPQQV

SEQ ID NO: 69824 - protein, 9 aa, Homo Sapiens
FVNDIFERI

SEQ ID NO: 69825 - protein, 9 aa, Homo Sapiens
FVSGVIVKI

SEQ ID NO: 69826 - protein, 9 aa, Homo Sapiens
GAAATHLEV

SEQ ID NO: 69827 - protein, 9 aa, Homo Sapiens
GEHGLIIRV

SEQ ID NO: 69828 - protein, 9 aa, Homo Sapiens
GGFNGSLRV

SEQ ID NO: 69829 - protein, 9 aa, Homo Sapiens
GGIGQPLSL

SEQ ID NO: 69830 - protein, 9 aa, Homo Sapiens
GLAFVPLQI

SEQ ID NO: 69831 - protein, 9 aa, Homo Sapiens
GLAPPQHLI

SEQ ID NO: 69832 - protein, 9 aa, Homo Sapiens
GLCDSIITI

SEQ ID NO: 69833 - protein, 9 aa, Homo Sapiens
GLCQFIQEV

SEQ ID NO: 69834 - protein, 9 aa, Homo Sapiens
GLFAGPCKV

SEQ ID NO: 69835 - protein, 9 aa, Homo Sapiens
GLFRVTPEI

SEQ ID NO: 69836 - protein, 9 aa, Homo Sapiens
GLFSKVTLI

SEQ ID NO: 69837 - protein, 9 aa, Homo Sapiens
GLGKTIQAI

SEQ ID NO: 69838 - protein, 9 aa, Homo Sapiens
GLGKTIQTI

SEQ ID NO: 69839 - protein, 9 aa, Homo Sapiens
GLHNVVYGI

SEQ ID NO: 69840 - protein, 9 aa, Homo Sapiens
GLHRQLLYI

SEQ ID NO: 69841 - protein, 9 aa, Homo Sapiens
GLIHISQVI

SEQ ID NO: 69842 - protein, 9 aa, Homo Sapiens
GLKKVIQKV

SEQ ID NO: 69843 - protein, 9 aa, Homo Sapiens
GLLEALLKI

SEQ ID NO: 69844 - protein, 9 aa, Homo Sapiens
GLLPSPLAV

SEQ ID NO: 69845 - protein, 9 aa, Homo Sapiens
GLNDFIQKI

SEQ ID NO: 69846 - protein, 9 aa, Homo Sapiens
GLNTIPLFV

SEQ ID NO: 69847 - protein, 9 aa, Homo Sapiens
GLSETILAV

SEQ ID NO: 69848 - protein, 9 aa, Homo Sapiens
GLSKCEIKV

SEQ ID NO: 69849 - protein, 9 aa, Homo Sapiens
GLTDIRTLV

SEQ ID NO: 69850 - protein, 9 aa, Homo Sapiens
GLTSAIQAV

SEQ ID NO: 69851 - protein, 9 aa, Homo Sapiens
GLVSTGLKV

SEQ ID NO: 69852 - protein, 9 aa, Homo Sapiens
GLYPAPLKI

SEQ ID NO: 69853 - protein, 9 aa, Homo Sapiens
GMTVVQHCV

SEQ ID NO: 69854 - protein, 9 aa, Homo Sapiens
GMYIFLHTV

SEQ ID NO: 69855 - protein, 9 aa, Homo Sapiens
GQADLATKV

SEQ ID NO: 69856 - protein, 9 aa, Homo Sapiens
GQADPVVAV

SEQ ID NO: 69857 - protein, 9 aa, Homo Sapiens
GQAEALDKI

SEQ ID NO: 69858 - protein, 9 aa, Homo Sapiens
GQAFLYHQV

SEQ ID NO: 69859 - protein, 9 aa, Homo Sapiens
GQAGGKLHI

SEQ ID NO: 69860 - protein, 9 aa, Homo Sapiens
GQAPEGLKV

SEQ ID NO: 69861 - protein, 9 aa, Homo Sapiens
GQASIPTEI

SEQ ID NO: 69862 - protein, 9 aa, Homo Sapiens
GQCGKSFSL

SEQ ID NO: 69863 - protein, 9 aa, Homo Sapiens
GQDSIVLLI

SEQ ID NO: 69864 - protein, 9 aa, Homo Sapiens
GQDVGRYQV

SEQ ID NO: 69865 - protein, 9 aa, Homo Sapiens
GQFCIPEHI

SEQ ID NO: 69866 - protein, 9 aa, Homo Sapiens
GQFDRPAGV

SEQ ID NO: 69867 - protein, 9 aa, Homo Sapiens
GQFGIHNGV

SEQ ID NO: 69868 - protein, 9 aa, Homo Sapiens
GQFIGPHRI

SEQ ID NO: 69869 - protein, 9 aa, Homo Sapiens
GQFILTPHI

SEQ ID NO: 69870 - protein, 9 aa, Homo Sapiens
GQFKGLVKA

SEQ ID NO: 69871 - protein, 9 aa, Homo Sapiens
GQFKKTQIL

SEQ ID NO: 69872 - protein, 9 aa, Homo Sapiens
GQFLTKRGV

SEQ ID NO: 69873 - protein, 9 aa, Homo Sapiens
GQFTGSTGV

SEQ ID NO: 69874 - protein, 9 aa, Homo Sapiens
GQGPSHLSV

SEQ ID NO: 69875 - protein, 9 aa, Homo Sapiens
GQGRIILKA

SEQ ID NO: 69876 - protein, 9 aa, Homo Sapiens
GQHAFYQLI

SEQ ID NO: 69877 - protein, 9 aa, Homo Sapiens
GQHEISFSV

SEQ ID NO: 69878 - protein, 9 aa, Homo Sapiens
GQHFNIPAI

SEQ ID NO: 69879 - protein, 9 aa, Homo Sapiens
GQHMVEQLL

SEQ ID NO: 69880 - protein, 9 aa, Homo Sapiens
GQHPSQHLI

SEQ ID NO: 69881 - protein, 9 aa, Homo Sapiens
GQIELRTYV

SEQ ID NO: 69882 - protein, 9 aa, Homo Sapiens
GQIEVVPEV

SEQ ID NO: 69883 - protein, 9 aa, Homo Sapiens
GQIKEVERI

SEQ ID NO: 69884 - protein, 9 aa, Homo Sapiens
GQIKQIIRI

SEQ ID NO: 69885 - protein, 9 aa, Homo Sapiens
GQILPVPNV

SEQ ID NO: 69886 - protein, 9 aa, Homo Sapiens
GQINQKLGV

SEQ ID NO: 69887 - protein, 9 aa, Homo Sapiens
GQISETLKT

SEQ ID NO: 69888 - protein, 9 aa, Homo Sapiens
GQISEVVVV

SEQ ID NO: 69889 - protein, 9 aa, Homo Sapiens
GQISVHVDI

SEQ ID NO: 69890 - protein, 9 aa, Homo Sapiens
GQKEGEPRI

SEQ ID NO: 69891 - protein, 9 aa, Homo Sapiens
GQKKLVLIL

SEQ ID NO: 69892 - protein, 9 aa, Homo Sapiens
GQKSYLDVI

SEQ ID NO: 69893 - protein, 9 aa, Homo Sapiens
GQLAEHESI

SEQ ID NO: 69894 - protein, 9 aa, Homo Sapiens
GQLDVRELI

SEQ ID NO: 69895 - protein, 9 aa, Homo Sapiens
GQLIEPLQI

SEQ ID NO: 69896 - protein, 9 aa, Homo Sapiens
GQLLVKPTI

SEQ ID NO: 69897 - protein, 9 aa, Homo Sapiens
GQLNLHQRI

SEQ ID NO: 69898 - protein, 9 aa, Homo Sapiens
GQLNQAMKI

SEQ ID NO: 69899 - protein, 9 aa, Homo Sapiens
GQLPEAPVI

SEQ ID NO: 69900 - protein, 9 aa, Homo Sapiens
GQLRLAHGV

SEQ ID NO: 69901 - protein, 9 aa, Homo Sapiens
GQLTLHQRI

SEQ ID NO: 69902 - protein, 9 aa, Homo Sapiens
GQMAYILQL

SEQ ID NO: 69903 - protein, 9 aa, Homo Sapiens
GQMDPSAQI

SEQ ID NO: 69904 - protein, 9 aa, Homo Sapiens
GQMPNNQSI

SEQ ID NO: 69905 - protein, 9 aa, Homo Sapiens
GQMPSDKTI

SEQ ID NO: 69906 - protein, 9 aa, Homo Sapiens
GQMQDARAI

SEQ ID NO: 69907 - protein, 9 aa, Homo Sapiens
GQNESFARI

SEQ ID NO: 69908 - protein, 9 aa, Homo Sapiens
GQNPTNAEV

SEQ ID NO: 69909 - protein, 9 aa, Homo Sapiens
GQNRIHLEI

SEQ ID NO: 69910 - protein, 9 aa, Homo Sapiens
GQNSLCHQI

SEQ ID NO: 69911 - protein, 9 aa, Homo Sapiens
GQPGSVLRV

SEQ ID NO: 69912 - protein, 9 aa, Homo Sapiens
GQPNILICI

SEQ ID NO: 69913 - protein, 9 aa, Homo Sapiens
GQPSIINHI

SEQ ID NO: 69914 - protein, 9 aa, Homo Sapiens
GQQAIVLCI

SEQ ID NO: 69915 - protein, 9 aa, Homo Sapiens
GQQIQIQTV

SEQ ID NO: 69916 - protein, 9 aa, Homo Sapiens
GQQTIIACI

SEQ ID NO: 69917 - protein, 9 aa, Homo Sapiens
GQSFSEQHI

SEQ ID NO: 69918 - protein, 9 aa, Homo Sapiens
GQSKFAPTV

SEQ ID NO: 69919 - protein, 9 aa, Homo Sapiens
GQSKITFLL

SEQ ID NO: 69920 - protein, 9 aa, Homo Sapiens
GQSKVFFRA

SEQ ID NO: 69921 - protein, 9 aa, Homo Sapiens
GQSPVALDI

SEQ ID NO: 69922 - protein, 9 aa, Homo Sapiens
GQSRGVPAV

SEQ ID NO: 69923 - protein, 9 aa, Homo Sapiens
GQSYVVNRV

SEQ ID NO: 69924 - protein, 9 aa, Homo Sapiens
GQTFVFHVV

SEQ ID NO: 69925 - protein, 9 aa, Homo Sapiens
GQTGVIRSV

SEQ ID NO: 69926 - protein, 9 aa, Homo Sapiens
GQTIIHHHI

SEQ ID NO: 69927 - protein, 9 aa, Homo Sapiens
GQTITISRV

SEQ ID NO: 69928 - protein, 9 aa, Homo Sapiens
GQTKEVLVI

SEQ ID NO: 69929 - protein, 9 aa, Homo Sapiens
GQTPFYIRI

SEQ ID NO: 69930 - protein, 9 aa, Homo Sapiens
GQTPKQLFV

SEQ ID NO: 69931 - protein, 9 aa, Homo Sapiens
GQTPLMLAI

SEQ ID NO: 69932 - protein, 9 aa, Homo Sapiens
GQTPSQLLI

SEQ ID NO: 69933 - protein, 9 aa, Homo Sapiens
GQTQVEIKV

SEQ ID NO: 69934 - protein, 9 aa, Homo Sapiens
GQTSVIEQI

SEQ ID NO: 69935 - protein, 9 aa, Homo Sapiens
GQTTVQVRV

SEQ ID NO: 69936 - protein, 9 aa, Homo Sapiens
GQTVNLQAV

SEQ ID NO: 69937 - protein, 9 aa, Homo Sapiens
GQVERAVVI

SEQ ID NO: 69938 - protein, 9 aa, Homo Sapiens
GQVHLFEHI

SEQ ID NO: 69939 - protein, 9 aa, Homo Sapiens
GQVIQKETV

SEQ ID NO: 69940 - protein, 9 aa, Homo Sapiens
GQVKLTKAV

SEQ ID NO: 69941 - protein, 9 aa, Homo Sapiens
GQVKPYSSV

SEQ ID NO: 69942 - protein, 9 aa, Homo Sapiens
GQVLVKPYI

SEQ ID NO: 69943 - protein, 9 aa, Homo Sapiens
GQVPPLQSV

SEQ ID NO: 69944 - protein, 9 aa, Homo Sapiens
GQVTCVVEI

SEQ ID NO: 69945 - protein, 9 aa, Homo Sapiens
GQVVAMKKI

SEQ ID NO: 69946 - protein, 9 aa, Homo Sapiens
GQWASVIRV

SEQ ID NO: 69947 - protein, 9 aa, Homo Sapiens
GQWGRAWEV

SEQ ID NO: 69948 - protein, 9 aa, Homo Sapiens
GQWKEEQKL

SEQ ID NO: 69949 - protein, 9 aa, Homo Sapiens
GQWKKGFVL

SEQ ID NO: 69950 - protein, 9 aa, Homo Sapiens
GQWLGGRQI

SEQ ID NO: 69951 - protein, 9 aa, Homo Sapiens
GQYMGQLKM

SEQ ID NO: 69952 - protein, 9 aa, Homo Sapiens
GQYPRFLRA

SEQ ID NO: 69953 - protein, 9 aa, Homo Sapiens
GQYQECLQL

SEQ ID NO: 69954 - protein, 9 aa, Homo Sapiens
GQYTDLLRL

SEQ ID NO: 69955 - protein, 9 aa, Homo Sapiens
GQYVQPQGV

SEQ ID NO: 69956 - protein, 9 aa, Homo Sapiens
GQYYAIKKI

SEQ ID NO: 69957 - protein, 9 aa, Homo Sapiens
GSFGKVFLV

SEQ ID NO: 69958 - protein, 9 aa, Homo Sapiens
GSPAVTLLI

SEQ ID NO: 69959 - protein, 9 aa, Homo Sapiens
GSWDKMLKI

SEQ ID NO: 69960 - protein, 9 aa, Homo Sapiens
GSYRNALKI

SEQ ID NO: 69961 - protein, 9 aa, Homo Sapiens
GTAPVNLNI

SEQ ID NO: 69962 - protein, 9 aa, Homo Sapiens
GVAIPLPGV

SEQ ID NO: 69963 - protein, 9 aa, Homo Sapiens
GVLRQQLVV

SEQ ID NO: 69964 - protein, 9 aa, Homo Sapiens
GVNKDSYLI

SEQ ID NO: 69965 - protein, 9 aa, Homo Sapiens
GVSDVELRV

SEQ ID NO: 69966 - protein, 9 aa, Homo Sapiens
GVTAIIFCV

SEQ ID NO: 69967 - protein, 9 aa, Homo Sapiens
HAAKVILQV

SEQ ID NO: 69968 - protein, 9 aa, Homo Sapiens
HACGVIATI

SEQ ID NO: 69969 - protein, 9 aa, Homo Sapiens
HAFSFPLLI

SEQ ID NO: 69970 - protein, 9 aa, Homo Sapiens
HEGDIILKI

SEQ ID NO: 69971 - protein, 9 aa, Homo Sapiens
HEIDYILLV

SEQ ID NO: 69972 - protein, 9 aa, Homo Sapiens
HETEVLLKV

SEQ ID NO: 69973 - protein, 9 aa, Homo Sapiens
HGFAGVILI

SEQ ID NO: 69974 - protein, 9 aa, Homo Sapiens
HIAEVSQEV

SEQ ID NO: 69975 - protein, 9 aa, Homo Sapiens
HIDNNILLI

SEQ ID NO: 69976 - protein, 9 aa, Homo Sapiens
HIGQVIMSI

SEQ ID NO: 69977 - protein, 9 aa, Homo Sapiens
HIIENIVAV

SEQ ID NO: 69978 - protein, 9 aa, Homo Sapiens
HIPEVYLIV

SEQ ID NO: 69979 - protein, 9 aa, Homo Sapiens
HIPNIFQKI

SEQ ID NO: 69980 - protein, 9 aa, Homo Sapiens
HISHIAQQV

SEQ ID NO: 69981 - protein, 9 aa, Homo Sapiens
HISMVIQKI

SEQ ID NO: 69982 - protein, 9 aa, Homo Sapiens
HISPVKLHL

SEQ ID NO: 69983 - protein, 9 aa, Homo Sapiens
HITNIPFSI

SEQ ID NO: 69984 - protein, 9 aa, Homo Sapiens
HLAAPKLGV

SEQ ID NO: 69985 - protein, 9 aa, Homo Sapiens
HLAEHSLQV

SEQ ID NO: 69986 - protein, 9 aa, Homo Sapiens
HLAEVSAEV

SEQ ID NO: 69987 - protein, 9 aa, Homo Sapiens
HLANIVERV

SEQ ID NO: 69988 - protein, 9 aa, Homo Sapiens
HLAVVELLL

SEQ ID NO: 69989 - protein, 9 aa, Homo Sapiens
HLDATKLLL

SEQ ID NO: 69990 - protein, 9 aa, Homo Sapiens
HLDTTQQMI

SEQ ID NO: 69991 - protein, 9 aa, Homo Sapiens
HLDVVALLI

SEQ ID NO: 69992 - protein, 9 aa, Homo Sapiens
HLFIEPRTI

SEQ ID NO: 69993 - protein, 9 aa, Homo Sapiens
HLFIPALSV

SEQ ID NO: 69994 - protein, 9 aa, Homo Sapiens
HLFSVAQEL

SEQ ID NO: 69995 - protein, 9 aa, Homo Sapiens
HLGDFPLAV

SEQ ID NO: 69996 - protein, 9 aa, Homo Sapiens
HLIAQHSAI

SEQ ID NO: 69997 - protein, 9 aa, Homo Sapiens
HLIDFMSEI

SEQ ID NO: 69998 - protein, 9 aa, Homo Sapiens
HLITPLVTI

SEQ ID NO: 69999 - protein, 9 aa, Homo Sapiens
HLKNTMETI

SEQ ID NO: 70000 - protein, 9 aa, Homo Sapiens
HLKQYERSI

SEQ ID NO: 70001 - protein, 9 aa, Homo Sapiens
HLLETPLVV

SEQ ID NO: 70002 - protein, 9 aa, Homo Sapiens
HLLLEVEVI

SEQ ID NO: 70003 - protein, 9 aa, Homo Sapiens
HLLPCEVAV

SEQ ID NO: 70004 - protein, 9 aa, Homo Sapiens
HLLPTEQRI

SEQ ID NO: 70005 - protein, 9 aa, Homo Sapiens
HLLPTQLEV

SEQ ID NO: 70006 - protein, 9 aa, Homo Sapiens
HLLQYNHRV

SEQ ID NO: 70007 - protein, 9 aa, Homo Sapiens
HLMHLELDI

SEQ ID NO: 70008 - protein, 9 aa, Homo Sapiens
HLNPDPQLI

SEQ ID NO: 70009 - protein, 9 aa, Homo Sapiens
HLNSEKLII

SEQ ID NO: 70010 - protein, 9 aa, Homo Sapiens
HLPVINVGI

SEQ ID NO: 70011 - protein, 9 aa, Homo Sapiens
HLREYQDLL

SEQ ID NO: 70012 - protein, 9 aa, Homo Sapiens
HLSDTLWLI

SEQ ID NO: 70013 - protein, 9 aa, Homo Sapiens
HLSKIETRI

SEQ ID NO: 70014 - protein, 9 aa, Homo Sapiens
HLTDITLKV

SEQ ID NO: 70015 - protein, 9 aa, Homo Sapiens
HLTEEALKV

SEQ ID NO: 70016 - protein, 9 aa, Homo Sapiens
HLTEMQAKV

SEQ ID NO: 70017 - protein, 9 aa, Homo Sapiens
HLTETQVKI

SEQ ID NO: 70018 - protein, 9 aa, Homo Sapiens
HLTGHTLKI

SEQ ID NO: 70019 - protein, 9 aa, Homo Sapiens
HLTPLPLYV

SEQ ID NO: 70020 - protein, 9 aa, Homo Sapiens
HLTPVTLEL

SEQ ID NO: 70021 - protein, 9 aa, Homo Sapiens
HLYDIHVTV

SEQ ID NO: 70022 - protein, 9 aa, Homo Sapiens
HLYFETVTI

SEQ ID NO: 70023 - protein, 9 aa, Homo Sapiens
HMFGQNLEV

SEQ ID NO: 70024 - protein, 9 aa, Homo Sapiens
HMYPEKLKV

SEQ ID NO: 70025 - protein, 9 aa, Homo Sapiens
HQAAQALHL

SEQ ID NO: 70026 - protein, 9 aa, Homo Sapiens
HQADIGEYV

SEQ ID NO: 70027 - protein, 9 aa, Homo Sapiens
HQAEYELNI

SEQ ID NO: 70028 - protein, 9 aa, Homo Sapiens
HQAGPVIKV

SEQ ID NO: 70029 - protein, 9 aa, Homo Sapiens
HQALHSISV

SEQ ID NO: 70030 - protein, 9 aa, Homo Sapiens
HQAQLISKI

SEQ ID NO: 70031 - protein, 9 aa, Homo Sapiens
HQDQMVQKI

SEQ ID NO: 70032 - protein, 9 aa, Homo Sapiens
HQESYPLSV

SEQ ID NO: 70033 - protein, 9 aa, Homo Sapiens
HQEVVELLI

SEQ ID NO: 70034 - protein, 9 aa, Homo Sapiens
HQFESSFEL

SEQ ID NO: 70035 - protein, 9 aa, Homo Sapiens
HQFQLDITV

SEQ ID NO: 70036 - protein, 9 aa, Homo Sapiens
HQFVECLKL

SEQ ID NO: 70037 - protein, 9 aa, Homo Sapiens
HQGDSKLLI

SEQ ID NO: 70038 - protein, 9 aa, Homo Sapiens
HQGVAVLGI

SEQ ID NO: 70039 - protein, 9 aa, Homo Sapiens
HQHEYFFLI

SEQ ID NO: 70040 - protein, 9 aa, Homo Sapiens
HQHNVSLQL

SEQ ID NO: 70041 - protein, 9 aa, Homo Sapiens
HQHRLGLGV

SEQ ID NO: 70042 - protein, 9 aa, Homo Sapiens
HQIDLIVQL

SEQ ID NO: 70043 - protein, 9 aa, Homo Sapiens
HQIFHVLVV

SEQ ID NO: 70044 - protein, 9 aa, Homo Sapiens
HQIGCQSSI

SEQ ID NO: 70045 - protein, 9 aa, Homo Sapiens
HQIHVEQSI

SEQ ID NO: 70046 - protein, 9 aa, Homo Sapiens
HQIIQQYMV

SEQ ID NO: 70047 - protein, 9 aa, Homo Sapiens
HQILTPFLL

SEQ ID NO: 70048 - protein, 9 aa, Homo Sapiens
HQIQNVVTV

SEQ ID NO: 70049 - protein, 9 aa, Homo Sapiens
HQLFHIFVV

SEQ ID NO: 70050 - protein, 9 aa, Homo Sapiens
HQLNICSKV

SEQ ID NO: 70051 - protein, 9 aa, Homo Sapiens
HQLPLPHNV

SEQ ID NO: 70052 - protein, 9 aa, Homo Sapiens
HQMEFPCNI

SEQ ID NO: 70053 - protein, 9 aa, Homo Sapiens
HQNDKQISI

SEQ ID NO: 70054 - protein, 9 aa, Homo Sapiens
HQNHLIVKV

SEQ ID NO: 70055 - protein, 9 aa, Homo Sapiens
HQPDPAIGV

SEQ ID NO: 70056 - protein, 9 aa, Homo Sapiens
HQPPPAPRV

SEQ ID NO: 70057 - protein, 9 aa, Homo Sapiens
HQPSVLLEL

SEQ ID NO: 70058 - protein, 9 aa, Homo Sapiens
HQQIQAQLV

SEQ ID NO: 70059 - protein, 9 aa, Homo Sapiens
HQREKDFLL

SEQ ID NO: 70060 - protein, 9 aa, Homo Sapiens
HQREREFLL

SEQ ID NO: 70061 - protein, 9 aa, Homo Sapiens
HQRLEPATL

SEQ ID NO: 70062 - protein, 9 aa, Homo Sapiens
HQRSFDIGI

SEQ ID NO: 70063 - protein, 9 aa, Homo Sapiens
HQRTFVLEV

SEQ ID NO: 70064 - protein, 9 aa, Homo Sapiens
HQSALELIM

SEQ ID NO: 70065 - protein, 9 aa, Homo Sapiens
HQSDRYVKI

SEQ ID NO: 70066 - protein, 9 aa, Homo Sapiens
HQSGIVQLL

SEQ ID NO: 70067 - protein, 9 aa, Homo Sapiens
HQSHLILRA

SEQ ID NO: 70068 - protein, 9 aa, Homo Sapiens
HQSTVDWIV

SEQ ID NO: 70069 - protein, 9 aa, Homo Sapiens
HQTITIQEM

SEQ ID NO: 70070 - protein, 9 aa, Homo Sapiens
HQTIVMQFI

SEQ ID NO: 70071 - protein, 9 aa, Homo Sapiens
HQTIVVQLL

SEQ ID NO: 70072 - protein, 9 aa, Homo Sapiens
HQTNLILQT

SEQ ID NO: 70073 - protein, 9 aa, Homo Sapiens
HQTPLHLAV

SEQ ID NO: 70074 - protein, 9 aa, Homo Sapiens
HQTQVSQRL

SEQ ID NO: 70075 - protein, 9 aa, Homo Sapiens
HQVPAVSSV

SEQ ID NO: 70076 - protein, 9 aa, Homo Sapiens
HQWNPPLAV

SEQ ID NO: 70077 - protein, 9 aa, Homo Sapiens
HQYFHICFV

SEQ ID NO: 70078 - protein, 9 aa, Homo Sapiens
HQYINCFTL

SEQ ID NO: 70079 - protein, 9 aa, Homo Sapiens
HSAELALNV

SEQ ID NO: 70080 - protein, 9 aa, Homo Sapiens
HSLPLLLFI

SEQ ID NO: 70081 - protein, 9 aa, Homo Sapiens
HSQNVKLLI

SEQ ID NO: 70082 - protein, 9 aa, Homo Sapiens
HSVDQYLNI

SEQ ID NO: 70083 - protein, 9 aa, Homo Sapiens
HTAAVKLLL

SEQ ID NO: 70084 - protein, 9 aa, Homo Sapiens
HTANIQTLI

SEQ ID NO: 70085 - protein, 9 aa, Homo Sapiens
HTIDTILTV

SEQ ID NO: 70086 - protein, 9 aa, Homo Sapiens
HTQNVPLSV

SEQ ID NO: 70087 - protein, 9 aa, Homo Sapiens
HVASVPTAV

SEQ ID NO: 70088 - protein, 9 aa, Homo Sapiens
HVHGVLNGV

SEQ ID NO: 70089 - protein, 9 aa, Homo Sapiens
HVLSLPLRI

SEQ ID NO: 70090 - protein, 9 aa, Homo Sapiens
HVPDPVISI

SEQ ID NO: 70091 - protein, 9 aa, Homo Sapiens
HVPNVTLLI

SEQ ID NO: 70092 - protein, 9 aa, Homo Sapiens
HVSCVKLLL

SEQ ID NO: 70093 - protein, 9 aa, Homo Sapiens
HVSEVPVSV

SEQ ID NO: 70094 - protein, 9 aa, Homo Sapiens
HVSLVQLTL

SEQ ID NO: 70095 - protein, 9 aa, Homo Sapiens
HVTPLKLMV

SEQ ID NO: 70096 - protein, 9 aa, Homo Sapiens
HVYDGKFLA

SEQ ID NO: 70097 - protein, 9 aa, Homo Sapiens
IANTVELRV

SEQ ID NO: 70098 - protein, 9 aa, Homo Sapiens
IIAHLPLLI

SEQ ID NO: 70099 - protein, 9 aa, Homo Sapiens
IIFETPLRV

SEQ ID NO: 70100 - protein, 9 aa, Homo Sapiens
IISKTKQVI

SEQ ID NO: 70101 - protein, 9 aa, Homo Sapiens
IISQVDAKV

SEQ ID NO: 70102 - protein, 9 aa, Homo Sapiens
IKLDISRTF

SEQ ID NO: 70103 - protein, 9 aa, Homo Sapiens
ILAELLLRV

SEQ ID NO: 70104 - protein, 9 aa, Homo Sapiens
ILAPVVKEI

SEQ ID NO: 70105 - protein, 9 aa, Homo Sapiens
ILAQQPLSV

SEQ ID NO: 70106 - protein, 9 aa, Homo Sapiens
ILCPKPVHV

SEQ ID NO: 70107 - protein, 9 aa, Homo Sapiens
ILDGNQLHI

SEQ ID NO: 70108 - protein, 9 aa, Homo Sapiens
ILFGHENRV

SEQ ID NO: 70109 - protein, 9 aa, Homo Sapiens
ILGDILLKV

SEQ ID NO: 70110 - protein, 9 aa, Homo Sapiens
ILKGFDPLL

SEQ ID NO: 70111 - protein, 9 aa, Homo Sapiens
ILLATGLHV

SEQ ID NO: 70112 - protein, 9 aa, Homo Sapiens
ILLKDILSV

SEQ ID NO: 70113 - protein, 9 aa, Homo Sapiens
ILPALCVLI

SEQ ID NO: 70114 - protein, 9 aa, Homo Sapiens
ILPCIKELV

SEQ ID NO: 70115 - protein, 9 aa, Homo Sapiens
ILPKILQDV

SEQ ID NO: 70116 - protein, 9 aa, Homo Sapiens
ILSEVQQAV

SEQ ID NO: 70117 - protein, 9 aa, Homo Sapiens
ILSPTVVSI

SEQ ID NO: 70118 - protein, 9 aa, Homo Sapiens
ILSSKVLTI

SEQ ID NO: 70119 - protein, 9 aa, Homo Sapiens
ILTKILYLI

SEQ ID NO: 70120 - protein, 9 aa, Homo Sapiens
IQARLPLLL

SEQ ID NO: 70121 - protein, 9 aa, Homo Sapiens
IQFKKPIIV

SEQ ID NO: 70122 - protein, 9 aa, Homo Sapiens
IQHAEEFLI

SEQ ID NO: 70123 - protein, 9 aa, Homo Sapiens
IQHMELQLI

SEQ ID NO: 70124 - protein, 9 aa, Homo Sapiens
IQHVFQNLI

SEQ ID NO: 70125 - protein, 9 aa, Homo Sapiens
IQIMKVEEI

SEQ ID NO: 70126 - protein, 9 aa, Homo Sapiens
IQMKIFPAL

SEQ ID NO: 70127 - protein, 9 aa, Homo Sapiens
IQPNIQLIL

SEQ ID NO: 70128 - protein, 9 aa, Homo Sapiens
IQRGPVRGI

SEQ ID NO: 70129 - protein, 9 aa, Homo Sapiens
IQSQVVAQI

SEQ ID NO: 70130 - protein, 9 aa, Homo Sapiens
IQTAVRLLL

SEQ ID NO: 70131 - protein, 9 aa, Homo Sapiens
IQVQQPQQV

SEQ ID NO: 70132 - protein, 9 aa, Homo Sapiens
IQYIRPVFV

SEQ ID NO: 70133 - protein, 9 aa, Homo Sapiens
IQYQAVPQI

SEQ ID NO: 70134 - protein, 9 aa, Homo Sapiens
ISSHIPLII

SEQ ID NO: 70135 - protein, 9 aa, Homo Sapiens
ISSNTSLKV

SEQ ID NO: 70136 - protein, 9 aa, Homo Sapiens
IVAHIIQKI

SEQ ID NO: 70137 - protein, 9 aa, Homo Sapiens
IVNGHTLLV

SEQ ID NO: 70138 - protein, 9 aa, Homo Sapiens
KAAKTPLKI

SEQ ID NO: 70139 - protein, 9 aa, Homo Sapiens
KAFAEKLSV

SEQ ID NO: 70140 - protein, 9 aa, Homo Sapiens
KATAYILSV

SEQ ID NO: 70141 - protein, 9 aa, Homo Sapiens
KAYHEQLSV

SEQ ID NO: 70142 - protein, 9 aa, Homo Sapiens
KEFEGKTLV

SEQ ID NO: 70143 - protein, 9 aa, Homo Sapiens
KEFIGQQLI

SEQ ID NO: 70144 - protein, 9 aa, Homo Sapiens
KEFKSQLFV

SEQ ID NO: 70145 - protein, 9 aa, Homo Sapiens
KEIFLRELI

SEQ ID NO: 70146 - protein, 9 aa, Homo Sapiens
KETNIQLFV

SEQ ID NO: 70147 - protein, 9 aa, Homo Sapiens
KIAPYSVEI

SEQ ID NO: 70148 - protein, 9 aa, Homo Sapiens
KICDYLFNV

SEQ ID NO: 70149 - protein, 9 aa, Homo Sapiens
KIFQEMLYI

SEQ ID NO: 70150 - protein, 9 aa, Homo Sapiens
KIIDIQEKV

SEQ ID NO: 70151 - protein, 9 aa, Homo Sapiens
KILEKEIRV

SEQ ID NO: 70152 - protein, 9 aa, Homo Sapiens
KINEKPQVI

SEQ ID NO: 70153 - protein, 9 aa, Homo Sapiens
KIPQVPLCV

SEQ ID NO: 70154 - protein, 9 aa, Homo Sapiens
KISKIPFKV

SEQ ID NO: 70155 - protein, 9 aa, Homo Sapiens
KITDLKQKV

SEQ ID NO: 70156 - protein, 9 aa, Homo Sapiens
KITGMLLEI

SEQ ID NO: 70157 - protein, 9 aa, Homo Sapiens
KITTVIQHV

SEQ ID NO: 70158 - protein, 9 aa, Homo Sapiens
KIVEIDAHI

SEQ ID NO: 70159 - protein, 9 aa, Homo Sapiens
KIYAIPIEI

SEQ ID NO: 70160 - protein, 9 aa, Homo Sapiens
KIYEGQVEV

SEQ ID NO: 70161 - protein, 9 aa, Homo Sapiens
KIYEHHIKV

SEQ ID NO: 70162 - protein, 9 aa, Homo Sapiens
KLAEVSQNI

SEQ ID NO: 70163 - protein, 9 aa, Homo Sapiens
KLAKLQAQV

SEQ ID NO: 70164 - protein, 9 aa, Homo Sapiens
KLAPKDIKI

SEQ ID NO: 70165 - protein, 9 aa, Homo Sapiens
KLAPKDVKI

SEQ ID NO: 70166 - protein, 9 aa, Homo Sapiens
KLAPPLVTL

SEQ ID NO: 70167 - protein, 9 aa, Homo Sapiens
KLASKYLHV

SEQ ID NO: 70168 - protein, 9 aa, Homo Sapiens
KLAVRPLSV

SEQ ID NO: 70169 - protein, 9 aa, Homo Sapiens
KLCDIIVHI

SEQ ID NO: 70170 - protein, 9 aa, Homo Sapiens
KLCDVTTGL

SEQ ID NO: 70171 - protein, 9 aa, Homo Sapiens
KLCEGFNEV

SEQ ID NO: 70172 - protein, 9 aa, Homo Sapiens
KLCYVGYNI

SEQ ID NO: 70173 - protein, 9 aa, Homo Sapiens
KLDDIVQHI

SEQ ID NO: 70174 - protein, 9 aa, Homo Sapiens
KLDHVVTII

SEQ ID NO: 70175 - protein, 9 aa, Homo Sapiens
KLDSTPLKA

SEQ ID NO: 70176 - protein, 9 aa, Homo Sapiens
KLEEIRIKV

SEQ ID NO: 70177 - protein, 9 aa, Homo Sapiens
KLFAKHIKV

SEQ ID NO: 70178 - protein, 9 aa, Homo Sapiens
KLFDAPLSI

SEQ ID NO: 70179 - protein, 9 aa, Homo Sapiens
KLFDTQHRV

SEQ ID NO: 70180 - protein, 9 aa, Homo Sapiens
KLFEKKYSV

SEQ ID NO: 70181 - protein, 9 aa, Homo Sapiens
KLFGMIITI

SEQ ID NO: 70182 - protein, 9 aa, Homo Sapiens
KLFIGGLNV

SEQ ID NO: 70183 - protein, 9 aa, Homo Sapiens
KLFQGQLVL

SEQ ID NO: 70184 - protein, 9 aa, Homo Sapiens
KLFRGPLVI

SEQ ID NO: 70185 - protein, 9 aa, Homo Sapiens
KLFSYCVKV

SEQ ID NO: 70186 - protein, 9 aa, Homo Sapiens
KLFVIAQKI

SEQ ID NO: 70187 - protein, 9 aa, Homo Sapiens
KLGEIVTTI

SEQ ID NO: 70188 - protein, 9 aa, Homo Sapiens
KLHGKILVI

SEQ ID NO: 70189 - protein, 9 aa, Homo Sapiens
KLHGKPIRI

SEQ ID NO: 70190 - protein, 9 aa, Homo Sapiens
KLHGVNINV

SEQ ID NO: 70191 - protein, 9 aa, Homo Sapiens
KLHYVVTEV

SEQ ID NO: 70192 - protein, 9 aa, Homo Sapiens
KLIANNTTV

SEQ ID NO: 70193 - protein, 9 aa, Homo Sapiens
KLIENNDTI

SEQ ID NO: 70194 - protein, 9 aa, Homo Sapiens
KLIGQVHEV

SEQ ID NO: 70195 - protein, 9 aa, Homo Sapiens
KLIILPLII

SEQ ID NO: 70196 - protein, 9 aa, Homo Sapiens
KLIKDGLII

SEQ ID NO: 70197 - protein, 9 aa, Homo Sapiens
KLILLITQV

SEQ ID NO: 70198 - protein, 9 aa, Homo Sapiens
KLIPNAIQI

SEQ ID NO: 70199 - protein, 9 aa, Homo Sapiens
KLIQNVFEI

SEQ ID NO: 70200 - protein, 9 aa, Homo Sapiens
KLITKAEKI

SEQ ID NO: 70201 - protein, 9 aa, Homo Sapiens
KLKEIFDKI

SEQ ID NO: 70202 - protein, 9 aa, Homo Sapiens
KLKNVIHKI

SEQ ID NO: 70203 - protein, 9 aa, Homo Sapiens
KLKQFEERL

SEQ ID NO: 70204 - protein, 9 aa, Homo Sapiens
KLLDFILKT

SEQ ID NO: 70205 - protein, 9 aa, Homo Sapiens
KLLEATSAV

SEQ ID NO: 70206 - protein, 9 aa, Homo Sapiens
KLLEKAFSI

SEQ ID NO: 70207 - protein, 9 aa, Homo Sapiens
KLLEPVLLL

SEQ ID NO: 70208 - protein, 9 aa, Homo Sapiens
KLLEQALVI

SEQ ID NO: 70209 - protein, 9 aa, Homo Sapiens
KLLEQTQII

SEQ ID NO: 70210 - protein, 9 aa, Homo Sapiens
KLLEYIEEI

SEQ ID NO: 70211 - protein, 9 aa, Homo Sapiens
KLLFWVTEV

SEQ ID NO: 70212 - protein, 9 aa, Homo Sapiens
KLLKCSRLV

SEQ ID NO: 70213 - protein, 9 aa, Homo Sapiens
KLLKLFQGV

SEQ ID NO: 70214 - protein, 9 aa, Homo Sapiens
KLLKPSLAV

SEQ ID NO: 70215 - protein, 9 aa, Homo Sapiens
KLLNLISKL

SEQ ID NO: 70216 - protein, 9 aa, Homo Sapiens
KLLPEYPGV

SEQ ID NO: 70217 - protein, 9 aa, Homo Sapiens
KLMELLEEI

SEQ ID NO: 70218 - protein, 9 aa, Homo Sapiens
KLMPVIMII

SEQ ID NO: 70219 - protein, 9 aa, Homo Sapiens
KLNELGQRI

SEQ ID NO: 70220 - protein, 9 aa, Homo Sapiens
KLNPQQFEV

SEQ ID NO: 70221 - protein, 9 aa, Homo Sapiens
KLNVAPLAV

SEQ ID NO: 70222 - protein, 9 aa, Homo Sapiens
KLPEAQQRV

SEQ ID NO: 70223 - protein, 9 aa, Homo Sapiens
KLPEAVQLI

SEQ ID NO: 70224 - protein, 9 aa, Homo Sapiens
KLPFAAAQI

SEQ ID NO: 70225 - protein, 9 aa, Homo Sapiens
KLPPKDLRI

SEQ ID NO: 70226 - protein, 9 aa, Homo Sapiens
KLPYEDVAI

SEQ ID NO: 70227 - protein, 9 aa, Homo Sapiens
KLQEIENAI

SEQ ID NO: 70228 - protein, 9 aa, Homo Sapiens
KLQQTTQLI

SEQ ID NO: 70229 - protein, 9 aa, Homo Sapiens
KLRHIVDEV

SEQ ID NO: 70230 - protein, 9 aa, Homo Sapiens
KLSAEKVEI

SEQ ID NO: 70231 - protein, 9 aa, Homo Sapiens
KLSEIPLTL

SEQ ID NO: 70232 - protein, 9 aa, Homo Sapiens
KLSELQLRV

SEQ ID NO: 70233 - protein, 9 aa, Homo Sapiens
KLSETFLHI

SEQ ID NO: 70234 - protein, 9 aa, Homo Sapiens
KLSEYEMSI

SEQ ID NO: 70235 - protein, 9 aa, Homo Sapiens
KLSKFKIRI

SEQ ID NO: 70236 - protein, 9 aa, Homo Sapiens
KLTEIRHEV

SEQ ID NO: 70237 - protein, 9 aa, Homo Sapiens
KLTELEQRI

SEQ ID NO: 70238 - protein, 9 aa, Homo Sapiens
KLTVVLEAV

SEQ ID NO: 70239 - protein, 9 aa, Homo Sapiens
KLTVVVNNI

SEQ ID NO: 70240 - protein, 9 aa, Homo Sapiens
KLVAIVDVI

SEQ ID NO: 70241 - protein, 9 aa, Homo Sapiens
KLVDCIIEV

SEQ ID NO: 70242 - protein, 9 aa, Homo Sapiens
KLVELPYTV

SEQ ID NO: 70243 - protein, 9 aa, Homo Sapiens
KLVGEFLEV

SEQ ID NO: 70244 - protein, 9 aa, Homo Sapiens
KLVKIKQEI

SEQ ID NO: 70245 - protein, 9 aa, Homo Sapiens
KLVKSQISV

SEQ ID NO: 70246 - protein, 9 aa, Homo Sapiens
KLWKGARSV

SEQ ID NO: 70247 - protein, 9 aa, Homo Sapiens
KLWSRSLKL

SEQ ID NO: 70248 - protein, 9 aa, Homo Sapiens
KLYEQHHVV

SEQ ID NO: 70249 - protein, 9 aa, Homo Sapiens
KLYGKPIRV

SEQ ID NO: 70250 - protein, 9 aa, Homo Sapiens
KLYGRPIKI

SEQ ID NO: 70251 - protein, 9 aa, Homo Sapiens
KLYHNEVEI

SEQ ID NO: 70252 - protein, 9 aa, Homo Sapiens
KLYQRDLEV

SEQ ID NO: 70253 - protein, 9 aa, Homo Sapiens
KMAPALRKV

SEQ ID NO: 70254 - protein, 9 aa, Homo Sapiens
KMFEVDMKI

SEQ ID NO: 70255 - protein, 9 aa, Homo Sapiens
KMFFLIEKI

SEQ ID NO: 70256 - protein, 9 aa, Homo Sapiens
KMMDVTVTI

SEQ ID NO: 70257 - protein, 9 aa, Homo Sapiens
KMPDVELFV

SEQ ID NO: 70258 - protein, 9 aa, Homo Sapiens
KMPEINAKV

SEQ ID NO: 70259 - protein, 9 aa, Homo Sapiens
KMSEKILLL

SEQ ID NO: 70260 - protein, 9 aa, Homo Sapiens
KMSSVKLRL

SEQ ID NO: 70261 - protein, 9 aa, Homo Sapiens
KMTPEQLAI

SEQ ID NO: 70262 - protein, 9 aa, Homo Sapiens
KMYAVDTRV

SEQ ID NO: 70263 - protein, 9 aa, Homo Sapiens
KQAAKCLLL

SEQ ID NO: 70264 - protein, 9 aa, Homo Sapiens
KQAFERLEV

SEQ ID NO: 70265 - protein, 9 aa, Homo Sapiens
KQAGLVSKI

SEQ ID NO: 70266 - protein, 9 aa, Homo Sapiens
KQAITQVVV

SEQ ID NO: 70267 - protein, 9 aa, Homo Sapiens
KQAPPLEDI

SEQ ID NO: 70268 - protein, 9 aa, Homo Sapiens
KQAQVPLAA

SEQ ID NO: 70269 - protein, 9 aa, Homo Sapiens
KQCEELVQI

SEQ ID NO: 70270 - protein, 9 aa, Homo Sapiens
KQFDIQLLT

SEQ ID NO: 70271 - protein, 9 aa, Homo Sapiens
KQFEGTVEI

SEQ ID NO: 70272 - protein, 9 aa, Homo Sapiens
KQFEKQVEL

SEQ ID NO: 70273 - protein, 9 aa, Homo Sapiens
KQFELALQL

SEQ ID NO: 70274 - protein, 9 aa, Homo Sapiens
KQFGNILIL

SEQ ID NO: 70275 - protein, 9 aa, Homo Sapiens
KQFHHQLRV

SEQ ID NO: 70276 - protein, 9 aa, Homo Sapiens
KQFLVKVLI

SEQ ID NO: 70277 - protein, 9 aa, Homo Sapiens
KQFVSQELV

SEQ ID NO: 70278 - protein, 9 aa, Homo Sapiens
KQGAFITLV

SEQ ID NO: 70279 - protein, 9 aa, Homo Sapiens
KQGPMTQAI

SEQ ID NO: 70280 - protein, 9 aa, Homo Sapiens
KQGYVIYRI

SEQ ID NO: 70281 - protein, 9 aa, Homo Sapiens
KQHFINQAV

SEQ ID NO: 70282 - protein, 9 aa, Homo Sapiens
KQHGVNVSV

SEQ ID NO: 70283 - protein, 9 aa, Homo Sapiens
KQIDQFLVV

SEQ ID NO: 70284 - protein, 9 aa, Homo Sapiens
KQIDVYRSV

SEQ ID NO: 70285 - protein, 9 aa, Homo Sapiens
KQILQAKRI

SEQ ID NO: 70286 - protein, 9 aa, Homo Sapiens
KQINIDFRT

SEQ ID NO: 70287 - protein, 9 aa, Homo Sapiens
KQINQEYLI

SEQ ID NO: 70288 - protein, 9 aa, Homo Sapiens
KQIPAITCI

SEQ ID NO: 70289 - protein, 9 aa, Homo Sapiens
KQIPLHPVI

SEQ ID NO: 70290 - protein, 9 aa, Homo Sapiens
KQISQAYEV

SEQ ID NO: 70291 - protein, 9 aa, Homo Sapiens
KQLAFQQQL

SEQ ID NO: 70292 - protein, 9 aa, Homo Sapiens
KQLKEKMKI

SEQ ID NO: 70293 - protein, 9 aa, Homo Sapiens
KQLPKFFLI

SEQ ID NO: 70294 - protein, 9 aa, Homo Sapiens
KQLTVKEAV

SEQ ID NO: 70295 - protein, 9 aa, Homo Sapiens
KQMDAILKA

SEQ ID NO: 70296 - protein, 9 aa, Homo Sapiens
KQMLLFTHI

SEQ ID NO: 70297 - protein, 9 aa, Homo Sapiens
KQMSISTGL

SEQ ID NO: 70298 - protein, 9 aa, Homo Sapiens
KQNITTAEI

SEQ ID NO: 70299 - protein, 9 aa, Homo Sapiens
KQPAFTIHV

SEQ ID NO: 70300 - protein, 9 aa, Homo Sapiens
KQPKGTFLI

SEQ ID NO: 70301 - protein, 9 aa, Homo Sapiens
KQPPIDNII

SEQ ID NO: 70302 - protein, 9 aa, Homo Sapiens
KQQLFSYAI

SEQ ID NO: 70303 - protein, 9 aa, Homo Sapiens
KQQQQQQFV

SEQ ID NO: 70304 - protein, 9 aa, Homo Sapiens
KQQQTMLRV

SEQ ID NO: 70305 - protein, 9 aa, Homo Sapiens
KQQVQQLQV

SEQ ID NO: 70306 - protein, 9 aa, Homo Sapiens
KQSNVQILV

SEQ ID NO: 70307 - protein, 9 aa, Homo Sapiens
KQSPPIVKI

SEQ ID NO: 70308 - protein, 9 aa, Homo Sapiens
KQSSVMQRL

SEQ ID NO: 70309 - protein, 9 aa, Homo Sapiens
KQTDFEHRI

SEQ ID NO: 70310 - protein, 9 aa, Homo Sapiens
KQTERIQMI

SEQ ID NO: 70311 - protein, 9 aa, Homo Sapiens
KQTPKVLVV

SEQ ID NO: 70312 - protein, 9 aa, Homo Sapiens
KQTVHKLLI

SEQ ID NO: 70313 - protein, 9 aa, Homo Sapiens
KQVDLIDLV

SEQ ID NO: 70314 - protein, 9 aa, Homo Sapiens
KQVEQDIKV

SEQ ID NO: 70315 - protein, 9 aa, Homo Sapiens
KQVHPDTGI

SEQ ID NO: 70316 - protein, 9 aa, Homo Sapiens
KQVLGQMVI

SEQ ID NO: 70317 - protein, 9 aa, Homo Sapiens
KQVLLREGI

SEQ ID NO: 70318 - protein, 9 aa, Homo Sapiens
KQVNSVICI

SEQ ID NO: 70319 - protein, 9 aa, Homo Sapiens
KQVSDLISV

SEQ ID NO: 70320 - protein, 9 aa, Homo Sapiens
KQYGNEVFL

SEQ ID NO: 70321 - protein, 9 aa, Homo Sapiens
KQYPISLVL

SEQ ID NO: 70322 - protein, 9 aa, Homo Sapiens
KQYTGINAI

SEQ ID NO: 70323 - protein, 9 aa, Homo Sapiens
KSCDLLLFL

SEQ ID NO: 70324 - protein, 9 aa, Homo Sapiens
KSCVIVIRV

SEQ ID NO: 70325 - protein, 9 aa, Homo Sapiens
KSSCVKLQV

SEQ ID NO: 70326 - protein, 9 aa, Homo Sapiens
KSSEIEQAV

SEQ ID NO: 70327 - protein, 9 aa, Homo Sapiens
KSVLVKQTI

SEQ ID NO: 70328 - protein, 9 aa, Homo Sapiens
KSYKGRQII

SEQ ID NO: 70329 - protein, 9 aa, Homo Sapiens
KTASIELRV

SEQ ID NO: 70330 - protein, 9 aa, Homo Sapiens
KTLPVAFKV

SEQ ID NO: 70331 - protein, 9 aa, Homo Sapiens
KTLSAILRI

SEQ ID NO: 70332 - protein, 9 aa, Homo Sapiens
KVADKIQLI

SEQ ID NO: 70333 - protein, 9 aa, Homo Sapiens
KVADTILFL

SEQ ID NO: 70334 - protein, 9 aa, Homo Sapiens
KVFNRYLEV

SEQ ID NO: 70335 - protein, 9 aa, Homo Sapiens
KVFPLLLCI

SEQ ID NO: 70336 - protein, 9 aa, Homo Sapiens
KVGHVILEV

SEQ ID NO: 70337 - protein, 9 aa, Homo Sapiens
KVGSFSQNV

SEQ ID NO: 70338 - protein, 9 aa, Homo Sapiens
KVHHVLLHI

SEQ ID NO: 70339 - protein, 9 aa, Homo Sapiens
KVIDTQQKV

SEQ ID NO: 70340 - protein, 9 aa, Homo Sapiens
KVLDILQHI

SEQ ID NO: 70341 - protein, 9 aa, Homo Sapiens
KVLSTKIEI

SEQ ID NO: 70342 - protein, 9 aa, Homo Sapiens
KVSAAALAV

SEQ ID NO: 70343 - protein, 9 aa, Homo Sapiens
KVVALVHAV

SEQ ID NO: 70344 - protein, 9 aa, Homo Sapiens
KVVNIVPVI

SEQ ID NO: 70345 - protein, 9 aa, Homo Sapiens
KVWKEQFRV

SEQ ID NO: 70346 - protein, 9 aa, Homo Sapiens
LEHKIIIRV

SEQ ID NO: 70347 - protein, 9 aa, Homo Sapiens
LETNVPLLV

SEQ ID NO: 70348 - protein, 9 aa, Homo Sapiens
LIMVAIPII

SEQ ID NO: 70349 - protein, 9 aa, Homo Sapiens
LIPNLPLQI

SEQ ID NO: 70350 - protein, 9 aa, Homo Sapiens
LIYSGKLLL

SEQ ID NO: 70351 - protein, 9 aa, Homo Sapiens
LKKPDGVKI

SEQ ID NO: 70352 - protein, 9 aa, Homo Sapiens
LKLLLPLLL

SEQ ID NO: 70353 - protein, 9 aa, Homo Sapiens
LLADPQQKI

SEQ ID NO: 70354 - protein, 9 aa, Homo Sapiens
LLAEPVPGI

SEQ ID NO: 70355 - protein, 9 aa, Homo Sapiens
LLAPEPLLV

SEQ ID NO: 70356 - protein, 9 aa, Homo Sapiens
LLCSLVKTI

SEQ ID NO: 70357 - protein, 9 aa, Homo Sapiens
LLDKKSLKI

SEQ ID NO: 70358 - protein, 9 aa, Homo Sapiens
LLFDRPMHV

SEQ ID NO: 70359 - protein, 9 aa, Homo Sapiens
LLFEGEKKI

SEQ ID NO: 70360 - protein, 9 aa, Homo Sapiens
LLFKEGVMV

SEQ ID NO: 70361 - protein, 9 aa, Homo Sapiens
LLFPESIRV

SEQ ID NO: 70362 - protein, 9 aa, Homo Sapiens
LLHNVSQNI

SEQ ID NO: 70363 - protein, 9 aa, Homo Sapiens
LLIPIHLEV

SEQ ID NO: 70364 - protein, 9 aa, Homo Sapiens
LLKEREEKV

SEQ ID NO: 70365 - protein, 9 aa, Homo Sapiens
LLNDHIYVV

SEQ ID NO: 70366 - protein, 9 aa, Homo Sapiens
LLNKSIIRV

SEQ ID NO: 70367 - protein, 9 aa, Homo Sapiens
LLPDIVTCV

SEQ ID NO: 70368 - protein, 9 aa, Homo Sapiens
LLPDLIQKV

SEQ ID NO: 70369 - protein, 9 aa, Homo Sapiens
LLPSVRQEV

SEQ ID NO: 70370 - protein, 9 aa, Homo Sapiens
LLQDIILQV

SEQ ID NO: 70371 - protein, 9 aa, Homo Sapiens
LLRDREVGI

SEQ ID NO: 70372 - protein, 9 aa, Homo Sapiens
LLSDTKLEL

SEQ ID NO: 70373 - protein, 9 aa, Homo Sapiens
LLSDVRFVL

SEQ ID NO: 70374 - protein, 9 aa, Homo Sapiens
LLSEAVQKI

SEQ ID NO: 70375 - protein, 9 aa, Homo Sapiens
LLSHVEQLL

SEQ ID NO: 70376 - protein, 9 aa, Homo Sapiens
LLSPVVPQI

SEQ ID NO: 70377 - protein, 9 aa, Homo Sapiens
LLSRVLFAL

SEQ ID NO: 70378 - protein, 9 aa, Homo Sapiens
LLTELHQLI

SEQ ID NO: 70379 - protein, 9 aa, Homo Sapiens
LLVDEFLKV

SEQ ID NO: 70380 - protein, 9 aa, Homo Sapiens
LMKDCEAEV

SEQ ID NO: 70381 - protein, 9 aa, Homo Sapiens
LMNAVVQTV

SEQ ID NO: 70382 - protein, 9 aa, Homo Sapiens
LQALEVLKI

SEQ ID NO: 70383 - protein, 9 aa, Homo Sapiens
LQAPTPLQI

SEQ ID NO: 70384 - protein, 9 aa, Homo Sapiens
LQCQRIFQV

SEQ ID NO: 70385 - protein, 9 aa, Homo Sapiens
LQFDGIHVV

SEQ ID NO: 70386 - protein, 9 aa, Homo Sapiens
LQHEGIFRV

SEQ ID NO: 70387 - protein, 9 aa, Homo Sapiens
LQHEISCKL

SEQ ID NO: 70388 - protein, 9 aa, Homo Sapiens
LQHPVTTDI

SEQ ID NO: 70389 - protein, 9 aa, Homo Sapiens
LQLELAQVL

SEQ ID NO: 70390 - protein, 9 aa, Homo Sapiens
LQNADPLKV

SEQ ID NO: 70391 - protein, 9 aa, Homo Sapiens
LQNAVIYSI

SEQ ID NO: 70392 - protein, 9 aa, Homo Sapiens
LQNGVLLRT

SEQ ID NO: 70393 - protein, 9 aa, Homo Sapiens
LQNQIVWKI

SEQ ID NO: 70394 - protein, 9 aa, Homo Sapiens
LQPEIIVKI

SEQ ID NO: 70395 - protein, 9 aa, Homo Sapiens
LQQDCALRV

SEQ ID NO: 70396 - protein, 9 aa, Homo Sapiens
LQQSKILKV

SEQ ID NO: 70397 - protein, 9 aa, Homo Sapiens
LQRPDEEAI

SEQ ID NO: 70398 - protein, 9 aa, Homo Sapiens
LQRYSEDRI

SEQ ID NO: 70399 - protein, 9 aa, Homo Sapiens
LQSAHPVRV

SEQ ID NO: 70400 - protein, 9 aa, Homo Sapiens
LQTVGIFRV

SEQ ID NO: 70401 - protein, 9 aa, Homo Sapiens
LQVFLPQAI

SEQ ID NO: 70402 - protein, 9 aa, Homo Sapiens
LQVLIKQEI

SEQ ID NO: 70403 - protein, 9 aa, Homo Sapiens
LQWDKVLRL

SEQ ID NO: 70404 - protein, 9 aa, Homo Sapiens
LQYSFPLQL

SEQ ID NO: 70405 - protein, 9 aa, Homo Sapiens
LRLLKTLET

SEQ ID NO: 70406 - protein, 9 aa, Homo Sapiens
LSFKDPFVI

SEQ ID NO: 70407 - protein, 9 aa, Homo Sapiens
LSMGLILRL

SEQ ID NO: 70408 - protein, 9 aa, Homo Sapiens
LTQDIIMKI

SEQ ID NO: 70409 - protein, 9 aa, Homo Sapiens
LTTKIMQLI

SEQ ID NO: 70410 - protein, 9 aa, Homo Sapiens
LVFGKPVRV

SEQ ID NO: 70411 - protein, 9 aa, Homo Sapiens
LVSFIPLNI

SEQ ID NO: 70412 - protein, 9 aa, Homo Sapiens
LVTDLVLHI

SEQ ID NO: 70413 - protein, 9 aa, Homo Sapiens
MIDNVILLI

SEQ ID NO: 70414 - protein, 9 aa, Homo Sapiens
MIRKEELEI

SEQ ID NO: 70415 - protein, 9 aa, Homo Sapiens
MLFGHPLLV

SEQ ID NO: 70416 - protein, 9 aa, Homo Sapiens
MLRIVEPYI

SEQ ID NO: 70417 - protein, 9 aa, Homo Sapiens
MLRIVEPYV

SEQ ID NO: 70418 - protein, 9 aa, Homo Sapiens
MLRLLFTLV

SEQ ID NO: 70419 - protein, 9 aa, Homo Sapiens
MLSRVVLSA

SEQ ID NO: 70420 - protein, 9 aa, Homo Sapiens
MMAKKHLEI

SEQ ID NO: 70421 - protein, 9 aa, Homo Sapiens
MQFSGSLHT

SEQ ID NO: 70422 - protein, 9 aa, Homo Sapiens
MQLPTRQEI

SEQ ID NO: 70423 - protein, 9 aa, Homo Sapiens
MQNPRQYKI

SEQ ID NO: 70424 - protein, 9 aa, Homo Sapiens
MQTKVVERI

SEQ ID NO: 70425 - protein, 9 aa, Homo Sapiens
MQVNQPLQT

SEQ ID NO: 70426 - protein, 9 aa, Homo Sapiens
MSADVPLVV

SEQ ID NO: 70427 - protein, 9 aa, Homo Sapiens
NLANVVLLL

SEQ ID NO: 70428 - protein, 9 aa, Homo Sapiens
NLAPVILQL

SEQ ID NO: 70429 - protein, 9 aa, Homo Sapiens
NLIGLPLLI

SEQ ID NO: 70430 - protein, 9 aa, Homo Sapiens
NLYNHPQLI

SEQ ID NO: 70431 - protein, 9 aa, Homo Sapiens
NQFPGFKEV

SEQ ID NO: 70432 - protein, 9 aa, Homo Sapiens
NQSSVDLKL

SEQ ID NO: 70433 - protein, 9 aa, Homo Sapiens
NQTPVTLQV

SEQ ID NO: 70434 - protein, 9 aa, Homo Sapiens
NQVGIVLNV

SEQ ID NO: 70435 - protein, 9 aa, Homo Sapiens
NQYRLIVNV

SEQ ID NO: 70436 - protein, 9 aa, Homo Sapiens
NVASVELKI

SEQ ID NO: 70437 - protein, 9 aa, Homo Sapiens
PTPPVFQVR

SEQ ID NO: 70438 - protein, 9 aa, Homo Sapiens
QAADFALKV

SEQ ID NO: 70439 - protein, 9 aa, Homo Sapiens
QALSPLLSV

SEQ ID NO: 70440 - protein, 9 aa, Homo Sapiens
QGCGTELRV

SEQ ID NO: 70441 - protein, 9 aa, Homo Sapiens
QIHSVITAI

SEQ ID NO: 70442 - protein, 9 aa, Homo Sapiens
QIQSIQQSI

SEQ ID NO: 70443 - protein, 9 aa, Homo Sapiens
QIRKIVDQI

SEQ ID NO: 70444 - protein, 9 aa, Homo Sapiens
QITQVNQRV

SEQ ID NO: 70445 - protein, 9 aa, Homo Sapiens
QIYAIRQSI

SEQ ID NO: 70446 - protein, 9 aa, Homo Sapiens
QLAPVFQRV

SEQ ID NO: 70447 - protein, 9 aa, Homo Sapiens
QLASGLLLV

SEQ ID NO: 70448 - protein, 9 aa, Homo Sapiens
QLLDTLLAI

SEQ ID NO: 70449 - protein, 9 aa, Homo Sapiens
QLLGLIQRV

SEQ ID NO: 70450 - protein, 9 aa, Homo Sapiens
QLMPLPVKV

SEQ ID NO: 70451 - protein, 9 aa, Homo Sapiens
QLRNLFDSI

SEQ ID NO: 70452 - protein, 9 aa, Homo Sapiens
QLSPVLLYL

SEQ ID NO: 70453 - protein, 9 aa, Homo Sapiens
QLSTVITQV

SEQ ID NO: 70454 - protein, 9 aa, Homo Sapiens
QLTLIKQEI

SEQ ID NO: 70455 - protein, 9 aa, Homo Sapiens
QLTNVILHL

SEQ ID NO: 70456 - protein, 9 aa, Homo Sapiens
QLVDIIEKV

SEQ ID NO: 70457 - protein, 9 aa, Homo Sapiens
QMLDVAIRV

SEQ ID NO: 70458 - protein, 9 aa, Homo Sapiens
QMNHIVMEI

SEQ ID NO: 70459 - protein, 9 aa, Homo Sapiens
QMSDLPVKV

SEQ ID NO: 70460 - protein, 9 aa, Homo Sapiens
QMSGAQIKI

SEQ ID NO: 70461 - protein, 9 aa, Homo Sapiens
QMTNILQQI

SEQ ID NO: 70462 - protein, 9 aa, Homo Sapiens
QMVRMILKI

SEQ ID NO: 70463 - protein, 9 aa, Homo Sapiens
QQAAIPIQI

SEQ ID NO: 70464 - protein, 9 aa, Homo Sapiens
QQADVRLML

SEQ ID NO: 70465 - protein, 9 aa, Homo Sapiens
QQAPAVDVV

SEQ ID NO: 70466 - protein, 9 aa, Homo Sapiens
QQAVARLEI

SEQ ID NO: 70467 - protein, 9 aa, Homo Sapiens
QQCPERLEV

SEQ ID NO: 70468 - protein, 9 aa, Homo Sapiens
QQDQVDRNI

SEQ ID NO: 70469 - protein, 9 aa, Homo Sapiens
QQDRIQQEI

SEQ ID NO: 70470 - protein, 9 aa, Homo Sapiens
QQFNVQALV

SEQ ID NO: 70471 - protein, 9 aa, Homo Sapiens
QQGTTKLSV

SEQ ID NO: 70472 - protein, 9 aa, Homo Sapiens
QQHPLILKV

SEQ ID NO: 70473 - protein, 9 aa, Homo Sapiens
QQHSILLLL

SEQ ID NO: 70474 - protein, 9 aa, Homo Sapiens
QQHSIPVFI

SEQ ID NO: 70475 - protein, 9 aa, Homo Sapiens
QQHVIETLI

SEQ ID NO: 70476 - protein, 9 aa, Homo Sapiens
QQIELDLKA

SEQ ID NO: 70477 - protein, 9 aa, Homo Sapiens
QQIGKVVQV

SEQ ID NO: 70478 - protein, 9 aa, Homo Sapiens
QQISGVQQI

SEQ ID NO: 70479 - protein, 9 aa, Homo Sapiens
QQLCIFWKV

SEQ ID NO: 70480 - protein, 9 aa, Homo Sapiens
QQLGLKQQI

SEQ ID NO: 70481 - protein, 9 aa, Homo Sapiens
QQLPDILKI

SEQ ID NO: 70482 - protein, 9 aa, Homo Sapiens
QQNGSVVRV

SEQ ID NO: 70483 - protein, 9 aa, Homo Sapiens
QQNGTPLKV

SEQ ID NO: 70484 - protein, 9 aa, Homo Sapiens
QQNPLVQRV

SEQ ID NO: 70485 - protein, 9 aa, Homo Sapiens
QQPPVQPQV

SEQ ID NO: 70486 - protein, 9 aa, Homo Sapiens
QQQNQRLLV

SEQ ID NO: 70487 - protein, 9 aa, Homo Sapiens
QQSGVPQQI

SEQ ID NO: 70488 - protein, 9 aa, Homo Sapiens
QQSIERLLV

SEQ ID NO: 70489 - protein, 9 aa, Homo Sapiens
QQTPLHLAV

SEQ ID NO: 70490 - protein, 9 aa, Homo Sapiens
QQVAFQPSI

SEQ ID NO: 70491 - protein, 9 aa, Homo Sapiens
QQVQTQIQV

SEQ ID NO: 70492 - protein, 9 aa, Homo Sapiens
QQYECVAEI

SEQ ID NO: 70493 - protein, 9 aa, Homo Sapiens
QQYQWLEKV

SEQ ID NO: 70494 - protein, 9 aa, Homo Sapiens
QSCGTYLRV

SEQ ID NO: 70495 - protein, 9 aa, Homo Sapiens
QSCVIIIRI

SEQ ID NO: 70496 - protein, 9 aa, Homo Sapiens
QSESELQKL

SEQ ID NO: 70497 - protein, 9 aa, Homo Sapiens
QTSATFLRV

SEQ ID NO: 70498 - protein, 9 aa, Homo Sapiens
QVAAEILEI

SEQ ID NO: 70499 - protein, 9 aa, Homo Sapiens
QVAGTPMFV

SEQ ID NO: 70500 - protein, 9 aa, Homo Sapiens
QVANLQMKI

SEQ ID NO: 70501 - protein, 9 aa, Homo Sapiens
QVANVRFNV

SEQ ID NO: 70502 - protein, 9 aa, Homo Sapiens
QVAPVPLNV

SEQ ID NO: 70503 - protein, 9 aa, Homo Sapiens
QVCAIIERV

SEQ ID NO: 70504 - protein, 9 aa, Homo Sapiens
QVFKGAVKI

SEQ ID NO: 70505 - protein, 9 aa, Homo Sapiens
QVVGTPLLV

SEQ ID NO: 70506 - protein, 9 aa, Homo Sapiens
RAAEFYAKV

SEQ ID NO: 70507 - protein, 9 aa, Homo Sapiens
RAAQLAIRV

SEQ ID NO: 70508 - protein, 9 aa, Homo Sapiens
RAASVFIRV

SEQ ID NO: 70509 - protein, 9 aa, Homo Sapiens
RAATFPLQV

SEQ ID NO: 70510 - protein, 9 aa, Homo Sapiens
RAFGIPIRV

SEQ ID NO: 70511 - protein, 9 aa, Homo Sapiens
RAHNVPLKL

SEQ ID NO: 70512 - protein, 9 aa, Homo Sapiens
RALDYALQI

SEQ ID NO: 70513 - protein, 9 aa, Homo Sapiens
RALKGVLRV

SEQ ID NO: 70514 - protein, 9 aa, Homo Sapiens
RALQQFLYV

SEQ ID NO: 70515 - protein, 9 aa, Homo Sapiens
RALSILQNV

SEQ ID NO: 70516 - protein, 9 aa, Homo Sapiens
RAMSIAQRV

SEQ ID NO: 70517 - protein, 9 aa, Homo Sapiens
RAQGVVLKV

SEQ ID NO: 70518 - protein, 9 aa, Homo Sapiens
RASGIFLRL

SEQ ID NO: 70519 - protein, 9 aa, Homo Sapiens
RATGISFAI

SEQ ID NO: 70520 - protein, 9 aa, Homo Sapiens
RAYIVQLQI

SEQ ID NO: 70521 - protein, 9 aa, Homo Sapiens
REAEIYQTV

SEQ ID NO: 70522 - protein, 9 aa, Homo Sapiens
REHTALLKI

SEQ ID NO: 70523 - protein, 9 aa, Homo Sapiens
REINYILRV

SEQ ID NO: 70524 - protein, 9 aa, Homo Sapiens
REYFHKLLI

SEQ ID NO: 70525 - protein, 9 aa, Homo Sapiens
RGADISLQV

SEQ ID NO: 70526 - protein, 9 aa, Homo Sapiens
RGCDLLQEV

SEQ ID NO: 70527 - protein, 9 aa, Homo Sapiens
RGFDKAYVV

SEQ ID NO: 70528 - protein, 9 aa, Homo Sapiens
RGTKVILHL

SEQ ID NO: 70529 - protein, 9 aa, Homo Sapiens
RHCDLQVRI

SEQ ID NO: 70530 - protein, 9 aa, Homo Sapiens
RIAAQGFTV

SEQ ID NO: 70531 - protein, 9 aa, Homo Sapiens
RIADSFQVI

SEQ ID NO: 70532 - protein, 9 aa, Homo Sapiens
RIAHAKQII

SEQ ID NO: 70533 - protein, 9 aa, Homo Sapiens
RIAQLRFLL

SEQ ID NO: 70534 - protein, 9 aa, Homo Sapiens
RIDGKTYVI

SEQ ID NO: 70535 - protein, 9 aa, Homo Sapiens
RIDGVSLLV

SEQ ID NO: 70536 - protein, 9 aa, Homo Sapiens
RIFGESIMI

SEQ ID NO: 70537 - protein, 9 aa, Homo Sapiens
RIFGETIDI

SEQ ID NO: 70538 - protein, 9 aa, Homo Sapiens
RIFGYPVGI

SEQ ID NO: 70539 - protein, 9 aa, Homo Sapiens
RIFIGTFKA

SEQ ID NO: 70540 - protein, 9 aa, Homo Sapiens
RIFQTLLEV

SEQ ID NO: 70541 - protein, 9 aa, Homo Sapiens
RIFSEVRRI

SEQ ID NO: 70542 - protein, 9 aa, Homo Sapiens
RIFVGLCQV

SEQ ID NO: 70543 - protein, 9 aa, Homo Sapiens
RIHPFHILI

SEQ ID NO: 70544 - protein, 9 aa, Homo Sapiens
RIHPVSTMV

SEQ ID NO: 70545 - protein, 9 aa, Homo Sapiens
RIICEAHKV

SEQ ID NO: 70546 - protein, 9 aa, Homo Sapiens
RIINTFLKT

SEQ ID NO: 70547 - protein, 9 aa, Homo Sapiens
RIKAIVHAV

SEQ ID NO: 70548 - protein, 9 aa, Homo Sapiens
RIKELEERI

SEQ ID NO: 70549 - protein, 9 aa, Homo Sapiens
RIKEYPLYI

SEQ ID NO: 70550 - protein, 9 aa, Homo Sapiens
RIKKPDYKV

SEQ ID NO: 70551 - protein, 9 aa, Homo Sapiens
RIKNNDPKL

SEQ ID NO: 70552 - protein, 9 aa, Homo Sapiens
RIKQITEEV

SEQ ID NO: 70553 - protein, 9 aa, Homo Sapiens
RIKRDIMSI

SEQ ID NO: 70554 - protein, 9 aa, Homo Sapiens
RIKSQELEV

SEQ ID NO: 70555 - protein, 9 aa, Homo Sapiens
RILDGMFAI

SEQ ID NO: 70556 - protein, 9 aa, Homo Sapiens
RILDVAQDL

SEQ ID NO: 70557 - protein, 9 aa, Homo Sapiens
RILGIIDAI

SEQ ID NO: 70558 - protein, 9 aa, Homo Sapiens
RILSLEQRV

SEQ ID NO: 70559 - protein, 9 aa, Homo Sapiens
RIMEIVDAI

SEQ ID NO: 70560 - protein, 9 aa, Homo Sapiens
RIMEVIDAI

SEQ ID NO: 70561 - protein, 9 aa, Homo Sapiens
RINNINILV

SEQ ID NO: 70562 - protein, 9 aa, Homo Sapiens
RIPAYFVTV

SEQ ID NO: 70563 - protein, 9 aa, Homo Sapiens
RIPELVQRI

SEQ ID NO: 70564 - protein, 9 aa, Homo Sapiens
RISDIRLFI

SEQ ID NO: 70565 - protein, 9 aa, Homo Sapiens
RISDVHFSV

SEQ ID NO: 70566 - protein, 9 aa, Homo Sapiens
RISELQWSV

SEQ ID NO: 70567 - protein, 9 aa, Homo Sapiens
RISPPATSV

SEQ ID NO: 70568 - protein, 9 aa, Homo Sapiens
RISPWLLRV

SEQ ID NO: 70569 - protein, 9 aa, Homo Sapiens
RISSKSLKV

SEQ ID NO: 70570 - protein, 9 aa, Homo Sapiens
RITSLIVHV

SEQ ID NO: 70571 - protein, 9 aa, Homo Sapiens
RIVKGEVSV

SEQ ID NO: 70572 - protein, 9 aa, Homo Sapiens
RIYESHVGI

SEQ ID NO: 70573 - protein, 9 aa, Homo Sapiens
RIYKYIHKV

SEQ ID NO: 70574 - protein, 9 aa, Homo Sapiens
RKTEVLLKV

SEQ ID NO: 70575 - protein, 9 aa, Homo Sapiens
RKYPTLLEV

SEQ ID NO: 70576 - protein, 9 aa, Homo Sapiens
RLAACVNLI

SEQ ID NO: 70577 - protein, 9 aa, Homo Sapiens
RLAALEQNV

SEQ ID NO: 70578 - protein, 9 aa, Homo Sapiens
RLAALQHRL

SEQ ID NO: 70579 - protein, 9 aa, Homo Sapiens
RLADKSVLV

SEQ ID NO: 70580 - protein, 9 aa, Homo Sapiens
RLAETQEEI

SEQ ID NO: 70581 - protein, 9 aa, Homo Sapiens
RLAFPVEVV

SEQ ID NO: 70582 - protein, 9 aa, Homo Sapiens
RLAHLGVQV

SEQ ID NO: 70583 - protein, 9 aa, Homo Sapiens
RLAHYIDRV

SEQ ID NO: 70584 - protein, 9 aa, Homo Sapiens
RLAKSDPMV

SEQ ID NO: 70585 - protein, 9 aa, Homo Sapiens
RLAQHITYV

SEQ ID NO: 70586 - protein, 9 aa, Homo Sapiens
RLAQVAKAV

SEQ ID NO: 70587 - protein, 9 aa, Homo Sapiens
RLAVYIDKV

SEQ ID NO: 70588 - protein, 9 aa, Homo Sapiens
RLAVYIDRV

SEQ ID NO: 70589 - protein, 9 aa, Homo Sapiens
RLCEIFTRM

SEQ ID NO: 70590 - protein, 9 aa, Homo Sapiens
RLCSISVTA

SEQ ID NO: 70591 - protein, 9 aa, Homo Sapiens
RLDAVLQRI

SEQ ID NO: 70592 - protein, 9 aa, Homo Sapiens
RLDETIQAI

SEQ ID NO: 70593 - protein, 9 aa, Homo Sapiens
RLFDDVPQV

SEQ ID NO: 70594 - protein, 9 aa, Homo Sapiens
RLFDEPQLA

SEQ ID NO: 70595 - protein, 9 aa, Homo Sapiens
RLFHPKLII

SEQ ID NO: 70596 - protein, 9 aa, Homo Sapiens
RLFIGGKKV

SEQ ID NO: 70597 - protein, 9 aa, Homo Sapiens
RLFQKTLKL

SEQ ID NO: 70598 - protein, 9 aa, Homo Sapiens
RLFQTEEKI

SEQ ID NO: 70599 - protein, 9 aa, Homo Sapiens
RLFSKEEKL

SEQ ID NO: 70600 - protein, 9 aa, Homo Sapiens
RLGCFNLTI

SEQ ID NO: 70601 - protein, 9 aa, Homo Sapiens
RLGCFNLTV

SEQ ID NO: 70602 - protein, 9 aa, Homo Sapiens
RLGKIVSKI

SEQ ID NO: 70603 - protein, 9 aa, Homo Sapiens
RLHDQMVKI

SEQ ID NO: 70604 - protein, 9 aa, Homo Sapiens
RLHEKVNII

SEQ ID NO: 70605 - protein, 9 aa, Homo Sapiens
RLHFLPESV

SEQ ID NO: 70606 - protein, 9 aa, Homo Sapiens
RLHKIKICI

SEQ ID NO: 70607 - protein, 9 aa, Homo Sapiens
RLIAKEMNI

SEQ ID NO: 70608 - protein, 9 aa, Homo Sapiens
RLIAQRYLL

SEQ ID NO: 70609 - protein, 9 aa, Homo Sapiens
RLIDLHTNV

SEQ ID NO: 70610 - protein, 9 aa, Homo Sapiens
RLIEETISI

SEQ ID NO: 70611 - protein, 9 aa, Homo Sapiens
RLIEHCDHI

SEQ ID NO: 70612 - protein, 9 aa, Homo Sapiens
RLIESLFTI

SEQ ID NO: 70613 - protein, 9 aa, Homo Sapiens
RLIILIQQV

SEQ ID NO: 70614 - protein, 9 aa, Homo Sapiens
RLIKSFEKV

SEQ ID NO: 70615 - protein, 9 aa, Homo Sapiens
RLILIESRI

SEQ ID NO: 70616 - protein, 9 aa, Homo Sapiens
RLINQVLEL

SEQ ID NO: 70617 - protein, 9 aa, Homo Sapiens
RLIPNAIQV

SEQ ID NO: 70618 - protein, 9 aa, Homo Sapiens
RLIPTLVSI

SEQ ID NO: 70619 - protein, 9 aa, Homo Sapiens
RLISKFDTV

SEQ ID NO: 70620 - protein, 9 aa, Homo Sapiens
RLKASRETI

SEQ ID NO: 70621 - protein, 9 aa, Homo Sapiens
RLKDLEALL

SEQ ID NO: 70622 - protein, 9 aa, Homo Sapiens
RLKEAFDYI

SEQ ID NO: 70623 - protein, 9 aa, Homo Sapiens
RLKEIEHNL

SEQ ID NO: 70624 - protein, 9 aa, Homo Sapiens
RLKEIKEEL

SEQ ID NO: 70625 - protein, 9 aa, Homo Sapiens
RLKELESQV

SEQ ID NO: 70626 - protein, 9 aa, Homo Sapiens
RLKENQISV

SEQ ID NO: 70627 - protein, 9 aa, Homo Sapiens
RLKEYEKAL

SEQ ID NO: 70628 - protein, 9 aa, Homo Sapiens
RLKFSADKV

SEQ ID NO: 70629 - protein, 9 aa, Homo Sapiens
RLKGKDMVV

SEQ ID NO: 70630 - protein, 9 aa, Homo Sapiens
RLKKPDQAI

SEQ ID NO: 70631 - protein, 9 aa, Homo Sapiens
RLKNLEPKM

SEQ ID NO: 70632 - protein, 9 aa, Homo Sapiens
RLKPEIQCV

SEQ ID NO: 70633 - protein, 9 aa, Homo Sapiens
RLKPPSNVV

SEQ ID NO: 70634 - protein, 9 aa, Homo Sapiens
RLKSKDVKL

SEQ ID NO: 70635 - protein, 9 aa, Homo Sapiens
RLKTLEREI

SEQ ID NO: 70636 - protein, 9 aa, Homo Sapiens
RLLDQRDRI

SEQ ID NO: 70637 - protein, 9 aa, Homo Sapiens
RLLDSEIKI

SEQ ID NO: 70638 - protein, 9 aa, Homo Sapiens
RLLDSVRAI

SEQ ID NO: 70639 - protein, 9 aa, Homo Sapiens
RLLDYVATV

SEQ ID NO: 70640 - protein, 9 aa, Homo Sapiens
RLLDYVVNI

SEQ ID NO: 70641 - protein, 9 aa, Homo Sapiens
RLLEEQRRV

SEQ ID NO: 70642 - protein, 9 aa, Homo Sapiens
RLLEKSQRV

SEQ ID NO: 70643 - protein, 9 aa, Homo Sapiens
RLLENMTEV

SEQ ID NO: 70644 - protein, 9 aa, Homo Sapiens
RLLEQGIRV

SEQ ID NO: 70645 - protein, 9 aa, Homo Sapiens
RLLIPVRTV

SEQ ID NO: 70646 - protein, 9 aa, Homo Sapiens
RLLKHKLKV

SEQ ID NO: 70647 - protein, 9 aa, Homo Sapiens
RLLKSKLYL

SEQ ID NO: 70648 - protein, 9 aa, Homo Sapiens
RLLLLPLLL

SEQ ID NO: 70649 - protein, 9 aa, Homo Sapiens
RLLNILMQL

SEQ ID NO: 70650 - protein, 9 aa, Homo Sapiens
RLLPAFLKV

SEQ ID NO: 70651 - protein, 9 aa, Homo Sapiens
RLLPEKLTI

SEQ ID NO: 70652 - protein, 9 aa, Homo Sapiens
RLLPGNATI

SEQ ID NO: 70653 - protein, 9 aa, Homo Sapiens
RLLPKVQEV

SEQ ID NO: 70654 - protein, 9 aa, Homo Sapiens
RLLQQEEKV

SEQ ID NO: 70655 - protein, 9 aa, Homo Sapiens
RLLQQMIDI

SEQ ID NO: 70656 - protein, 9 aa, Homo Sapiens
RLLQQVSQI

SEQ ID NO: 70657 - protein, 9 aa, Homo Sapiens
RLLQRDVQI

SEQ ID NO: 70658 - protein, 9 aa, Homo Sapiens
RLMDPVKHI

SEQ ID NO: 70659 - protein, 9 aa, Homo Sapiens
RLMNDMTAV

SEQ ID NO: 70660 - protein, 9 aa, Homo Sapiens
RLMNETTAV

SEQ ID NO: 70661 - protein, 9 aa, Homo Sapiens
RLMSGKVKV

SEQ ID NO: 70662 - protein, 9 aa, Homo Sapiens
RLNEAAVTV

SEQ ID NO: 70663 - protein, 9 aa, Homo Sapiens
RLNIPVSQV

SEQ ID NO: 70664 - protein, 9 aa, Homo Sapiens
RLNKVIKSV

SEQ ID NO: 70665 - protein, 9 aa, Homo Sapiens
RLNLVEAFV

SEQ ID NO: 70666 - protein, 9 aa, Homo Sapiens
RLNPEMLQI

SEQ ID NO: 70667 - protein, 9 aa, Homo Sapiens
RLNPLVLLL

SEQ ID NO: 70668 - protein, 9 aa, Homo Sapiens
RLPAWQPIL

SEQ ID NO: 70669 - protein, 9 aa, Homo Sapiens
RLPDVQLWL

SEQ ID NO: 70670 - protein, 9 aa, Homo Sapiens
RLPEAIEEV

SEQ ID NO: 70671 - protein, 9 aa, Homo Sapiens
RLPEIYIQL

SEQ ID NO: 70672 - protein, 9 aa, Homo Sapiens
RLPGEAQKI

SEQ ID NO: 70673 - protein, 9 aa, Homo Sapiens
RLPIEDPYL

SEQ ID NO: 70674 - protein, 9 aa, Homo Sapiens
RLPLVVSFI

SEQ ID NO: 70675 - protein, 9 aa, Homo Sapiens
RLPPEVNRI

SEQ ID NO: 70676 - protein, 9 aa, Homo Sapiens
RLPPPFPGL

SEQ ID NO: 70677 - protein, 9 aa, Homo Sapiens
RLPQYYIVV

SEQ ID NO: 70678 - protein, 9 aa, Homo Sapiens
RLPRPLPAV

SEQ ID NO: 70679 - protein, 9 aa, Homo Sapiens
RLPRSVTTV

SEQ ID NO: 70680 - protein, 9 aa, Homo Sapiens
RLQDAIAKV

SEQ ID NO: 70681 - protein, 9 aa, Homo Sapiens
RLQEASQTI

SEQ ID NO: 70682 - protein, 9 aa, Homo Sapiens
RLQEVTHSV

SEQ ID NO: 70683 - protein, 9 aa, Homo Sapiens
RLQKLHTSI

SEQ ID NO: 70684 - protein, 9 aa, Homo Sapiens
RLQKYPVRV

SEQ ID NO: 70685 - protein, 9 aa, Homo Sapiens
RLQNIRNTI

SEQ ID NO: 70686 - protein, 9 aa, Homo Sapiens
RLQQLQHRV

SEQ ID NO: 70687 - protein, 9 aa, Homo Sapiens
RLQRIHAEI

SEQ ID NO: 70688 - protein, 9 aa, Homo Sapiens
RLQSKTIKV

SEQ ID NO: 70689 - protein, 9 aa, Homo Sapiens
RLRDFQERL

SEQ ID NO: 70690 - protein, 9 aa, Homo Sapiens
RLRPEDPVL

SEQ ID NO: 70691 - protein, 9 aa, Homo Sapiens
RLRSFTTTI

SEQ ID NO: 70692 - protein, 9 aa, Homo Sapiens
RLSCFAQTV

SEQ ID NO: 70693 - protein, 9 aa, Homo Sapiens
RLSEVQASL

SEQ ID NO: 70694 - protein, 9 aa, Homo Sapiens
RLSLHKGKI

SEQ ID NO: 70695 - protein, 9 aa, Homo Sapiens
RLSNKVEAI

SEQ ID NO: 70696 - protein, 9 aa, Homo Sapiens
RLSNRVVRV

SEQ ID NO: 70697 - protein, 9 aa, Homo Sapiens
RLSPKPVRV

SEQ ID NO: 70698 - protein, 9 aa, Homo Sapiens
RLSPVSPAL

SEQ ID NO: 70699 - protein, 9 aa, Homo Sapiens
RLSQTFLQL

SEQ ID NO: 70700 - protein, 9 aa, Homo Sapiens
RLSSVNAEV

SEQ ID NO: 70701 - protein, 9 aa, Homo Sapiens
RLTDTDAAI

SEQ ID NO: 70702 - protein, 9 aa, Homo Sapiens
RLTDYISKV

SEQ ID NO: 70703 - protein, 9 aa, Homo Sapiens
RLTEICTKI

SEQ ID NO: 70704 - protein, 9 aa, Homo Sapiens
RLTKGKFAV

SEQ ID NO: 70705 - protein, 9 aa, Homo Sapiens
RLTPKLMEV

SEQ ID NO: 70706 - protein, 9 aa, Homo Sapiens
RLTPLQLEI

SEQ ID NO: 70707 - protein, 9 aa, Homo Sapiens
RLTPQAVKI

SEQ ID NO: 70708 - protein, 9 aa, Homo Sapiens
RLTQEKITV

SEQ ID NO: 70709 - protein, 9 aa, Homo Sapiens
RLTRLYLKA

SEQ ID NO: 70710 - protein, 9 aa, Homo Sapiens
RLTSFIGAI

SEQ ID NO: 70711 - protein, 9 aa, Homo Sapiens
RLVEIQYEL

SEQ ID NO: 70712 - protein, 9 aa, Homo Sapiens
RLVEVPMEL

SEQ ID NO: 70713 - protein, 9 aa, Homo Sapiens
RLVNWSCTL

SEQ ID NO: 70714 - protein, 9 aa, Homo Sapiens
RLVRVSTSV

SEQ ID NO: 70715 - protein, 9 aa, Homo Sapiens
RLVSSDPEI

SEQ ID NO: 70716 - protein, 9 aa, Homo Sapiens
RLVSWVNLI

SEQ ID NO: 70717 - protein, 9 aa, Homo Sapiens
RLYFGERNV

SEQ ID NO: 70718 - protein, 9 aa, Homo Sapiens
RLYGKLAKV

SEQ ID NO: 70719 - protein, 9 aa, Homo Sapiens
RLYGKVLRA

SEQ ID NO: 70720 - protein, 9 aa, Homo Sapiens
RLYHITDQV

SEQ ID NO: 70721 - protein, 9 aa, Homo Sapiens
RLYNPFLRV

SEQ ID NO: 70722 - protein, 9 aa, Homo Sapiens
RLYPLAIQI

SEQ ID NO: 70723 - protein, 9 aa, Homo Sapiens
RLYQKDLRA

SEQ ID NO: 70724 - protein, 9 aa, Homo Sapiens
RLYSVSYLL

SEQ ID NO: 70725 - protein, 9 aa, Homo Sapiens
RMARTPQTV

SEQ ID NO: 70726 - protein, 9 aa, Homo Sapiens
RMAVLNEQV

SEQ ID NO: 70727 - protein, 9 aa, Homo Sapiens
RMDELFVLI

SEQ ID NO: 70728 - protein, 9 aa, Homo Sapiens
RMDGHIQLI

SEQ ID NO: 70729 - protein, 9 aa, Homo Sapiens
RMEDIKILI

SEQ ID NO: 70730 - protein, 9 aa, Homo Sapiens
RMFDGKFVV

SEQ ID NO: 70731 - protein, 9 aa, Homo Sapiens
RMFFGKNKV

SEQ ID NO: 70732 - protein, 9 aa, Homo Sapiens
RMFFHFSEI

SEQ ID NO: 70733 - protein, 9 aa, Homo Sapiens
RMFGIPVVV

SEQ ID NO: 70734 - protein, 9 aa, Homo Sapiens
RMFHIRAVI

SEQ ID NO: 70735 - protein, 9 aa, Homo Sapiens
RMGPPLHTV

SEQ ID NO: 70736 - protein, 9 aa, Homo Sapiens
RMIDIQTRM

SEQ ID NO: 70737 - protein, 9 aa, Homo Sapiens
RMIEVEQKL

SEQ ID NO: 70738 - protein, 9 aa, Homo Sapiens
RMIGQICEV

SEQ ID NO: 70739 - protein, 9 aa, Homo Sapiens
RMIKLGLGI

SEQ ID NO: 70740 - protein, 9 aa, Homo Sapiens
RMITAMNTI

SEQ ID NO: 70741 - protein, 9 aa, Homo Sapiens
RMLAHPLHV

SEQ ID NO: 70742 - protein, 9 aa, Homo Sapiens
RMLIKLLEV

SEQ ID NO: 70743 - protein, 9 aa, Homo Sapiens
RMLKEILKI

SEQ ID NO: 70744 - protein, 9 aa, Homo Sapiens
RMLPHAPGV

SEQ ID NO: 70745 - protein, 9 aa, Homo Sapiens
RMLYMIEQV

SEQ ID NO: 70746 - protein, 9 aa, Homo Sapiens
RMNPNSPSI

SEQ ID NO: 70747 - protein, 9 aa, Homo Sapiens
RMPKVQQTV

SEQ ID NO: 70748 - protein, 9 aa, Homo Sapiens
RMREEFDKI

SEQ ID NO: 70749 - protein, 9 aa, Homo Sapiens
RMVAEIQNV

SEQ ID NO: 70750 - protein, 9 aa, Homo Sapiens
RQAAFKLYA

SEQ ID NO: 70751 - protein, 9 aa, Homo Sapiens
RQADFVQVL

SEQ ID NO: 70752 - protein, 9 aa, Homo Sapiens
RQADKVWRL

SEQ ID NO: 70753 - protein, 9 aa, Homo Sapiens
RQALAAPRV

SEQ ID NO: 70754 - protein, 9 aa, Homo Sapiens
RQALPQVRL

SEQ ID NO: 70755 - protein, 9 aa, Homo Sapiens
RQAPPHIEL

SEQ ID NO: 70756 - protein, 9 aa, Homo Sapiens
RQAPVLLQT

SEQ ID NO: 70757 - protein, 9 aa, Homo Sapiens
RQATPLKKV

SEQ ID NO: 70758 - protein, 9 aa, Homo Sapiens
RQAYVQFAL

SEQ ID NO: 70759 - protein, 9 aa, Homo Sapiens
RQDESIQRI

SEQ ID NO: 70760 - protein, 9 aa, Homo Sapiens
RQDLTQSLI

SEQ ID NO: 70761 - protein, 9 aa, Homo Sapiens
RQDNSILKV

SEQ ID NO: 70762 - protein, 9 aa, Homo Sapiens
RQDQIQQVV

SEQ ID NO: 70763 - protein, 9 aa, Homo Sapiens
RQEDLIMKV

SEQ ID NO: 70764 - protein, 9 aa, Homo Sapiens
RQFDNFKRV

SEQ ID NO: 70765 - protein, 9 aa, Homo Sapiens
RQFDVDILI

SEQ ID NO: 70766 - protein, 9 aa, Homo Sapiens
RQFGVIAKT

SEQ ID NO: 70767 - protein, 9 aa, Homo Sapiens
RQFIAAIKL

SEQ ID NO: 70768 - protein, 9 aa, Homo Sapiens
RQFKEIAAV

SEQ ID NO: 70769 - protein, 9 aa, Homo Sapiens
RQFLNRDDI

SEQ ID NO: 70770 - protein, 9 aa, Homo Sapiens
RQFPGSHRV

SEQ ID NO: 70771 - protein, 9 aa, Homo Sapiens
RQFPVTVHF

SEQ ID NO: 70772 - protein, 9 aa, Homo Sapiens
RQFSTPFQL

SEQ ID NO: 70773 - protein, 9 aa, Homo Sapiens
RQFVHIKKI

SEQ ID NO: 70774 - protein, 9 aa, Homo Sapiens
RQFVTATDV

SEQ ID NO: 70775 - protein, 9 aa, Homo Sapiens
RQFYEEELI

SEQ ID NO: 70776 - protein, 9 aa, Homo Sapiens
RQGEVVQRL

SEQ ID NO: 70777 - protein, 9 aa, Homo Sapiens
RQGKAKLVI

SEQ ID NO: 70778 - protein, 9 aa, Homo Sapiens
RQGLSMRQI

SEQ ID NO: 70779 - protein, 9 aa, Homo Sapiens
RQGMFAQLV

SEQ ID NO: 70780 - protein, 9 aa, Homo Sapiens
RQGPEGLEV

SEQ ID NO: 70781 - protein, 9 aa, Homo Sapiens
RQGPNANLV

SEQ ID NO: 70782 - protein, 9 aa, Homo Sapiens
RQGPVNQTV

SEQ ID NO: 70783 - protein, 9 aa, Homo Sapiens
RQGQIEVSI

SEQ ID NO: 70784 - protein, 9 aa, Homo Sapiens
RQGTHITVV

SEQ ID NO: 70785 - protein, 9 aa, Homo Sapiens
RQGVLGIKV

SEQ ID NO: 70786 - protein, 9 aa, Homo Sapiens
RQHEIILKA

SEQ ID NO: 70787 - protein, 9 aa, Homo Sapiens
RQHEIVLKV

SEQ ID NO: 70788 - protein, 9 aa, Homo Sapiens
RQHFVYDHV

SEQ ID NO: 70789 - protein, 9 aa, Homo Sapiens
RQHILQQVL

SEQ ID NO: 70790 - protein, 9 aa, Homo Sapiens
RQHLLFRSL

SEQ ID NO: 70791 - protein, 9 aa, Homo Sapiens
RQHLQATGV

SEQ ID NO: 70792 - protein, 9 aa, Homo Sapiens
RQHNWPLTM

SEQ ID NO: 70793 - protein, 9 aa, Homo Sapiens
RQHPFYFKA

SEQ ID NO: 70794 - protein, 9 aa, Homo Sapiens
RQHPLRFIL

SEQ ID NO: 70795 - protein, 9 aa, Homo Sapiens
RQHQQPFQV

SEQ ID NO: 70796 - protein, 9 aa, Homo Sapiens
RQHTQIVRL

SEQ ID NO: 70797 - protein, 9 aa, Homo Sapiens
RQHVIDVQI

SEQ ID NO: 70798 - protein, 9 aa, Homo Sapiens
RQHWTMTKI

SEQ ID NO: 70799 - protein, 9 aa, Homo Sapiens
RQIDQFLVV

SEQ ID NO: 70800 - protein, 9 aa, Homo Sapiens
RQIEREHLI

SEQ ID NO: 70801 - protein, 9 aa, Homo Sapiens
RQIEYEYKL

SEQ ID NO: 70802 - protein, 9 aa, Homo Sapiens
RQIFNGTFV

SEQ ID NO: 70803 - protein, 9 aa, Homo Sapiens
RQIGVEHVV

SEQ ID NO: 70804 - protein, 9 aa, Homo Sapiens
RQIKIKTGV

SEQ ID NO: 70805 - protein, 9 aa, Homo Sapiens
RQILAARAI

SEQ ID NO: 70806 - protein, 9 aa, Homo Sapiens
RQIQVMEKL

SEQ ID NO: 70807 - protein, 9 aa, Homo Sapiens
RQKLQLEKV

SEQ ID NO: 70808 - protein, 9 aa, Homo Sapiens
RQLAKIHAI

SEQ ID NO: 70809 - protein, 9 aa, Homo Sapiens
RQLEAIVRI

SEQ ID NO: 70810 - protein, 9 aa, Homo Sapiens
RQLEEARQI

SEQ ID NO: 70811 - protein, 9 aa, Homo Sapiens
RQLEKIKTI

SEQ ID NO: 70812 - protein, 9 aa, Homo Sapiens
RQLEKLKEV

SEQ ID NO: 70813 - protein, 9 aa, Homo Sapiens
RQLESLIRL

SEQ ID NO: 70814 - protein, 9 aa, Homo Sapiens
RQLESMIRL

SEQ ID NO: 70815 - protein, 9 aa, Homo Sapiens
RQLGHALLV

SEQ ID NO: 70816 - protein, 9 aa, Homo Sapiens
RQLGSKVLL

SEQ ID NO: 70817 - protein, 9 aa, Homo Sapiens
RQLHLNQLI

SEQ ID NO: 70818 - protein, 9 aa, Homo Sapiens
RQLKAFKSV

SEQ ID NO: 70819 - protein, 9 aa, Homo Sapiens
RQLLKSYKI

SEQ ID NO: 70820 - protein, 9 aa, Homo Sapiens
RQLNLENVV

SEQ ID NO: 70821 - protein, 9 aa, Homo Sapiens
RQLPMKIRI

SEQ ID NO: 70822 - protein, 9 aa, Homo Sapiens
RQLPSSHAL

SEQ ID NO: 70823 - protein, 9 aa, Homo Sapiens
RQLRQEVVV

SEQ ID NO: 70824 - protein, 9 aa, Homo Sapiens
RQLSRELRL

SEQ ID NO: 70825 - protein, 9 aa, Homo Sapiens
RQLTEKLTV

SEQ ID NO: 70826 - protein, 9 aa, Homo Sapiens
RQLVAQSGV

SEQ ID NO: 70827 - protein, 9 aa, Homo Sapiens
RQLYEPLVM

SEQ ID NO: 70828 - protein, 9 aa, Homo Sapiens
RQMIMIRSI

SEQ ID NO: 70829 - protein, 9 aa, Homo Sapiens
RQMSVNSSI

SEQ ID NO: 70830 - protein, 9 aa, Homo Sapiens
RQMTVIRKV

SEQ ID NO: 70831 - protein, 9 aa, Homo Sapiens
RQNHSILKI

SEQ ID NO: 70832 - protein, 9 aa, Homo Sapiens
RQNKLTYTM

SEQ ID NO: 70833 - protein, 9 aa, Homo Sapiens
RQNPLVTGI

SEQ ID NO: 70834 - protein, 9 aa, Homo Sapiens
RQNTIVVKV

SEQ ID NO: 70835 - protein, 9 aa, Homo Sapiens
RQPDLVLRL

SEQ ID NO: 70836 - protein, 9 aa, Homo Sapiens
RQPHTILRV

SEQ ID NO: 70837 - protein, 9 aa, Homo Sapiens
RQPPLVTGI

SEQ ID NO: 70838 - protein, 9 aa, Homo Sapiens
RQPYYATRV

SEQ ID NO: 70839 - protein, 9 aa, Homo Sapiens
RQQAHIQVV

SEQ ID NO: 70840 - protein, 9 aa, Homo Sapiens
RQQEKHFEV

SEQ ID NO: 70841 - protein, 9 aa, Homo Sapiens
RQQGPLRSI

SEQ ID NO: 70842 - protein, 9 aa, Homo Sapiens
RQQLVKLEM

SEQ ID NO: 70843 - protein, 9 aa, Homo Sapiens
RQQQKLLKV

SEQ ID NO: 70844 - protein, 9 aa, Homo Sapiens
RQQYLRQEV

SEQ ID NO: 70845 - protein, 9 aa, Homo Sapiens
RQRVIIDEL

SEQ ID NO: 70846 - protein, 9 aa, Homo Sapiens
RQSELEPVV

SEQ ID NO: 70847 - protein, 9 aa, Homo Sapiens
RQSFVFIVT

SEQ ID NO: 70848 - protein, 9 aa, Homo Sapiens
RQSISKALV

SEQ ID NO: 70849 - protein, 9 aa, Homo Sapiens
RQSIVGAEV

SEQ ID NO: 70850 - protein, 9 aa, Homo Sapiens
RQSTAKIQI

SEQ ID NO: 70851 - protein, 9 aa, Homo Sapiens
RQSVNVESI

SEQ ID NO: 70852 - protein, 9 aa, Homo Sapiens
RQTEALKCV

SEQ ID NO: 70853 - protein, 9 aa, Homo Sapiens
RQTFVIHKL

SEQ ID NO: 70854 - protein, 9 aa, Homo Sapiens
RQTGKILKV

SEQ ID NO: 70855 - protein, 9 aa, Homo Sapiens
RQTKTSLEV

SEQ ID NO: 70856 - protein, 9 aa, Homo Sapiens
RQTVAVGVI

SEQ ID NO: 70857 - protein, 9 aa, Homo Sapiens
RQVASHVGL

SEQ ID NO: 70858 - protein, 9 aa, Homo Sapiens
RQVGKTLRI

SEQ ID NO: 70859 - protein, 9 aa, Homo Sapiens
RQVGQIIRV

SEQ ID NO: 70860 - protein, 9 aa, Homo Sapiens
RQVKVILNI

SEQ ID NO: 70861 - protein, 9 aa, Homo Sapiens
RQVPFHLHI

SEQ ID NO: 70862 - protein, 9 aa, Homo Sapiens
RQVQGPVLV

SEQ ID NO: 70863 - protein, 9 aa, Homo Sapiens
RQVSMVQTL

SEQ ID NO: 70864 - protein, 9 aa, Homo Sapiens
RQVTGVTRV

SEQ ID NO: 70865 - protein, 9 aa, Homo Sapiens
RQVVLKYTV

SEQ ID NO: 70866 - protein, 9 aa, Homo Sapiens
RQWADDWLV

SEQ ID NO: 70867 - protein, 9 aa, Homo Sapiens
RQWDYTEKL

SEQ ID NO: 70868 - protein, 9 aa, Homo Sapiens
RQWIGSIEV

SEQ ID NO: 70869 - protein, 9 aa, Homo Sapiens
RQWKKISAI

SEQ ID NO: 70870 - protein, 9 aa, Homo Sapiens
RQWLAIQKL

SEQ ID NO: 70871 - protein, 9 aa, Homo Sapiens
RQWNVNWDI

SEQ ID NO: 70872 - protein, 9 aa, Homo Sapiens
RQWSSCRHI

SEQ ID NO: 70873 - protein, 9 aa, Homo Sapiens
RQYHENIKI

SEQ ID NO: 70874 - protein, 9 aa, Homo Sapiens
RQYLPIFAV

SEQ ID NO: 70875 - protein, 9 aa, Homo Sapiens
RQYTEAISV

SEQ ID NO: 70876 - protein, 9 aa, Homo Sapiens
RSAEVTLEV

SEQ ID NO: 70877 - protein, 9 aa, Homo Sapiens
RSALPTKTV

SEQ ID NO: 70878 - protein, 9 aa, Homo Sapiens
RSAVVEMLI

SEQ ID NO: 70879 - protein, 9 aa, Homo Sapiens
RSGHFEQAI

SEQ ID NO: 70880 - protein, 9 aa, Homo Sapiens
RSHGVLLEV

SEQ ID NO: 70881 - protein, 9 aa, Homo Sapiens
RSIAFHSAV

SEQ ID NO: 70882 - protein, 9 aa, Homo Sapiens
RSIEEVLRI

SEQ ID NO: 70883 - protein, 9 aa, Homo Sapiens
RSITVEQHI

SEQ ID NO: 70884 - protein, 9 aa, Homo Sapiens
RSIVLLLKV

SEQ ID NO: 70885 - protein, 9 aa, Homo Sapiens
RSLEQDLKV

SEQ ID NO: 70886 - protein, 9 aa, Homo Sapiens
RSLGIMQTV

SEQ ID NO: 70887 - protein, 9 aa, Homo Sapiens
RSLPCQVYV

SEQ ID NO: 70888 - protein, 9 aa, Homo Sapiens
RSSGYPLTI

SEQ ID NO: 70889 - protein, 9 aa, Homo Sapiens
RSVDLQTRI

SEQ ID NO: 70890 - protein, 9 aa, Homo Sapiens
RSVLIANTV

SEQ ID NO: 70891 - protein, 9 aa, Homo Sapiens
RSVPVRLHV

SEQ ID NO: 70892 - protein, 9 aa, Homo Sapiens
RSVRTVMRV

SEQ ID NO: 70893 - protein, 9 aa, Homo Sapiens
RSWKEPCQV

SEQ ID NO: 70894 - protein, 9 aa, Homo Sapiens
RTLAEIAKV

SEQ ID NO: 70895 - protein, 9 aa, Homo Sapiens
RTMEIFQLL

SEQ ID NO: 70896 - protein, 9 aa, Homo Sapiens
RTSDKAILV

SEQ ID NO: 70897 - protein, 9 aa, Homo Sapiens
RTSSVQLRV

SEQ ID NO: 70898 - protein, 9 aa, Homo Sapiens
RTTDIVIRI

SEQ ID NO: 70899 - protein, 9 aa, Homo Sapiens
RTTETQVLV

SEQ ID NO: 70900 - protein, 9 aa, Homo Sapiens
RTVDARLKL

SEQ ID NO: 70901 - protein, 9 aa, Homo Sapiens
RTVELFYDV

SEQ ID NO: 70902 - protein, 9 aa, Homo Sapiens
RTYVYVLTV

SEQ ID NO: 70903 - protein, 9 aa, Homo Sapiens
RVAAQGFVV

SEQ ID NO: 70904 - protein, 9 aa, Homo Sapiens
RVANQDLQV

SEQ ID NO: 70905 - protein, 9 aa, Homo Sapiens
RVANVADVV

SEQ ID NO: 70906 - protein, 9 aa, Homo Sapiens
RVAPEQQMI

SEQ ID NO: 70907 - protein, 9 aa, Homo Sapiens
RVCAASLYV

SEQ ID NO: 70908 - protein, 9 aa, Homo Sapiens
RVEEAKLLV

SEQ ID NO: 70909 - protein, 9 aa, Homo Sapiens
RVFASPLRL

SEQ ID NO: 70910 - protein, 9 aa, Homo Sapiens
RVFASSDTI

SEQ ID NO: 70911 - protein, 9 aa, Homo Sapiens
RVFENIVAV

SEQ ID NO: 70912 - protein, 9 aa, Homo Sapiens
RVFPSPMRI

SEQ ID NO: 70913 - protein, 9 aa, Homo Sapiens
RVFTGQAKV

SEQ ID NO: 70914 - protein, 9 aa, Homo Sapiens
RVFVKPLVL

SEQ ID NO: 70915 - protein, 9 aa, Homo Sapiens
RVGDQILRV

SEQ ID NO: 70916 - protein, 9 aa, Homo Sapiens
RVHDYDMRV

SEQ ID NO: 70917 - protein, 9 aa, Homo Sapiens
RVHEIFKRI

SEQ ID NO: 70918 - protein, 9 aa, Homo Sapiens
RVHGLALQI

SEQ ID NO: 70919 - protein, 9 aa, Homo Sapiens
RVHPVSTMI

SEQ ID NO: 70920 - protein, 9 aa, Homo Sapiens
RVIDYAVKI

SEQ ID NO: 70921 - protein, 9 aa, Homo Sapiens
RVIDYILDL

SEQ ID NO: 70922 - protein, 9 aa, Homo Sapiens
RVKFTDDRV

SEQ ID NO: 70923 - protein, 9 aa, Homo Sapiens
RVKLDSVRV

SEQ ID NO: 70924 - protein, 9 aa, Homo Sapiens
RVKPIIDLV

SEQ ID NO: 70925 - protein, 9 aa, Homo Sapiens
RVLDLAEQV

SEQ ID NO: 70926 - protein, 9 aa, Homo Sapiens
RVLFIKDVI

SEQ ID NO: 70927 - protein, 9 aa, Homo Sapiens
RVLQAIDSI

SEQ ID NO: 70928 - protein, 9 aa, Homo Sapiens
RVLQLFTRI

SEQ ID NO: 70929 - protein, 9 aa, Homo Sapiens
RVLQNLLTI

SEQ ID NO: 70930 - protein, 9 aa, Homo Sapiens
RVMELFFTV

SEQ ID NO: 70931 - protein, 9 aa, Homo Sapiens
RVMLYPSRI

SEQ ID NO: 70932 - protein, 9 aa, Homo Sapiens
RVMSGKLTV

SEQ ID NO: 70933 - protein, 9 aa, Homo Sapiens
RVNPVEYSI

SEQ ID NO: 70934 - protein, 9 aa, Homo Sapiens
RVPSINQKI

SEQ ID NO: 70935 - protein, 9 aa, Homo Sapiens
RVSELHLEV

SEQ ID NO: 70936 - protein, 9 aa, Homo Sapiens
RVSPVHLQI

SEQ ID NO: 70937 - protein, 9 aa, Homo Sapiens
RVTDKVLTA

SEQ ID NO: 70938 - protein, 9 aa, Homo Sapiens
RVTFVNFTV

SEQ ID NO: 70939 - protein, 9 aa, Homo Sapiens
RVTTINQEI

SEQ ID NO: 70940 - protein, 9 aa, Homo Sapiens
RVVKLNEVI

SEQ ID NO: 70941 - protein, 9 aa, Homo Sapiens
RVVRNNLRV

SEQ ID NO: 70942 - protein, 9 aa, Homo Sapiens
RVYNGRLKV

SEQ ID NO: 70943 - protein, 9 aa, Homo Sapiens
SAFATPFLV

SEQ ID NO: 70944 - protein, 9 aa, Homo Sapiens
SASRVVQVV

SEQ ID NO: 70945 - protein, 9 aa, Homo Sapiens
SEYPVILSI

SEQ ID NO: 70946 - protein, 9 aa, Homo Sapiens
SGYDTILRV

SEQ ID NO: 70947 - protein, 9 aa, Homo Sapiens
SIATLLLRI

SEQ ID NO: 70948 - protein, 9 aa, Homo Sapiens
SIFGKQLVV

SEQ ID NO: 70949 - protein, 9 aa, Homo Sapiens
SIFKGQQLV

SEQ ID NO: 70950 - protein, 9 aa, Homo Sapiens
SIHDVTFQV

SEQ ID NO: 70951 - protein, 9 aa, Homo Sapiens
SIIDTELKV

SEQ ID NO: 70952 - protein, 9 aa, Homo Sapiens
SISGMLLKV

SEQ ID NO: 70953 - protein, 9 aa, Homo Sapiens
SITANILAV

SEQ ID NO: 70954 - protein, 9 aa, Homo Sapiens
SITSVTVKI

SEQ ID NO: 70955 - protein, 9 aa, Homo Sapiens
SLADIAQKL

SEQ ID NO: 70956 - protein, 9 aa, Homo Sapiens
SLADVHIEV

SEQ ID NO: 70957 - protein, 9 aa, Homo Sapiens
SLALIEQRI

SEQ ID NO: 70958 - protein, 9 aa, Homo Sapiens
SLAPVLCGI

SEQ ID NO: 70959 - protein, 9 aa, Homo Sapiens
SLASLPLRV

SEQ ID NO: 70960 - protein, 9 aa, Homo Sapiens
SLCDIAILV

SEQ ID NO: 70961 - protein, 9 aa, Homo Sapiens
SLFEEMLQV

SEQ ID NO: 70962 - protein, 9 aa, Homo Sapiens
SLFKLIVKV

SEQ ID NO: 70963 - protein, 9 aa, Homo Sapiens
SLFPGKLEV

SEQ ID NO: 70964 - protein, 9 aa, Homo Sapiens
SLFPGQVVI

SEQ ID NO: 70965 - protein, 9 aa, Homo Sapiens
SLFRGSHRV

SEQ ID NO: 70966 - protein, 9 aa, Homo Sapiens
SLHDAIMIV

SEQ ID NO: 70967 - protein, 9 aa, Homo Sapiens
SLHKCFVRV

SEQ ID NO: 70968 - protein, 9 aa, Homo Sapiens
SLIGLHFKI

SEQ ID NO: 70969 - protein, 9 aa, Homo Sapiens
SLINSFLKI

SEQ ID NO: 70970 - protein, 9 aa, Homo Sapiens
SLLHMPFTI

SEQ ID NO: 70971 - protein, 9 aa, Homo Sapiens
SLLHVEQEV

SEQ ID NO: 70972 - protein, 9 aa, Homo Sapiens
SLLKEPQKV

SEQ ID NO: 70973 - protein, 9 aa, Homo Sapiens
SLLPHPIIV

SEQ ID NO: 70974 - protein, 9 aa, Homo Sapiens
SLLPQKQEV

SEQ ID NO: 70975 - protein, 9 aa, Homo Sapiens
SLLRSIFTV

SEQ ID NO: 70976 - protein, 9 aa, Homo Sapiens
SLPSVRQDV

SEQ ID NO: 70977 - protein, 9 aa, Homo Sapiens
SLSGRPLKV

SEQ ID NO: 70978 - protein, 9 aa, Homo Sapiens
SLSQVFLHL

SEQ ID NO: 70979 - protein, 9 aa, Homo Sapiens
SLTSVVLTL

SEQ ID NO: 70980 - protein, 9 aa, Homo Sapiens
SLVEIILHV

SEQ ID NO: 70981 - protein, 9 aa, Homo Sapiens
SLVNIVQHI

SEQ ID NO: 70982 - protein, 9 aa, Homo Sapiens
SLVSIPLVI

SEQ ID NO: 70983 - protein, 9 aa, Homo Sapiens
SLYGGTITI

SEQ ID NO: 70984 - protein, 9 aa, Homo Sapiens
SLYPIAVLI

SEQ ID NO: 70985 - protein, 9 aa, Homo Sapiens
SLYVRPVLI

SEQ ID NO: 70986 - protein, 9 aa, Homo Sapiens
SMCGLMLKL

SEQ ID NO: 70987 - protein, 9 aa, Homo Sapiens
SMFGAGLTV

SEQ ID NO: 70988 - protein, 9 aa, Homo Sapiens
SMPDVDLHV

SEQ ID NO: 70989 - protein, 9 aa, Homo Sapiens
SMTSLAQKI

SEQ ID NO: 70990 - protein, 9 aa, Homo Sapiens
SQAAAKLAL

SEQ ID NO: 70991 - protein, 9 aa, Homo Sapiens
SQAAVPTQV

SEQ ID NO: 70992 - protein, 9 aa, Homo Sapiens
SQADCAVLI

SEQ ID NO: 70993 - protein, 9 aa, Homo Sapiens
SQAEIEQKI

SEQ ID NO: 70994 - protein, 9 aa, Homo Sapiens
SQAIHQLKV

SEQ ID NO: 70995 - protein, 9 aa, Homo Sapiens
SQAIVKVVI

SEQ ID NO: 70996 - protein, 9 aa, Homo Sapiens
SQAMPVTTI

SEQ ID NO: 70997 - protein, 9 aa, Homo Sapiens
SQANIAQVL

SEQ ID NO: 70998 - protein, 9 aa, Homo Sapiens
SQANVVVKI

SEQ ID NO: 70999 - protein, 9 aa, Homo Sapiens
SQAPSTMQV

SEQ ID NO: 71000 - protein, 9 aa, Homo Sapiens
SQARFGQSV

SEQ ID NO: 71001 - protein, 9 aa, Homo Sapiens
SQASVTIRI

SEQ ID NO: 71002 - protein, 9 aa, Homo Sapiens
SQCPHIVRI

SEQ ID NO: 71003 - protein, 9 aa, Homo Sapiens
SQFAFESVV

SEQ ID NO: 71004 - protein, 9 aa, Homo Sapiens
SQFGHVVDI

SEQ ID NO: 71005 - protein, 9 aa, Homo Sapiens
SQFGQILDI

SEQ ID NO: 71006 - protein, 9 aa, Homo Sapiens
SQFPKHLIV

SEQ ID NO: 71007 - protein, 9 aa, Homo Sapiens
SQFPLPLAV

SEQ ID NO: 71008 - protein, 9 aa, Homo Sapiens
SQFPTPEAV

SEQ ID NO: 71009 - protein, 9 aa, Homo Sapiens
SQFSGKITV

SEQ ID NO: 71010 - protein, 9 aa, Homo Sapiens
SQFSYQHAI

SEQ ID NO: 71011 - protein, 9 aa, Homo Sapiens
SQFVPALKI

SEQ ID NO: 71012 - protein, 9 aa, Homo Sapiens
SQFVRPLIA

SEQ ID NO: 71013 - protein, 9 aa, Homo Sapiens
SQGVICLDI

SEQ ID NO: 71014 - protein, 9 aa, Homo Sapiens
SQHDILQMI

SEQ ID NO: 71015 - protein, 9 aa, Homo Sapiens
SQHGVIIQL

SEQ ID NO: 71016 - protein, 9 aa, Homo Sapiens
SQIEADFRL

SEQ ID NO: 71017 - protein, 9 aa, Homo Sapiens
SQIHDIVLV

SEQ ID NO: 71018 - protein, 9 aa, Homo Sapiens
SQIKYAAKV

SEQ ID NO: 71019 - protein, 9 aa, Homo Sapiens
SQINKFLYL

SEQ ID NO: 71020 - protein, 9 aa, Homo Sapiens
SQIPAQPSV

SEQ ID NO: 71021 - protein, 9 aa, Homo Sapiens
SQIYPVVCV

SEQ ID NO: 71022 - protein, 9 aa, Homo Sapiens
SQKAIQDEI

SEQ ID NO: 71023 - protein, 9 aa, Homo Sapiens
SQKDIEQSI

SEQ ID NO: 71024 - protein, 9 aa, Homo Sapiens
SQKHLILLI

SEQ ID NO: 71025 - protein, 9 aa, Homo Sapiens
SQLASLLKV

SEQ ID NO: 71026 - protein, 9 aa, Homo Sapiens
SQLDVPFKV

SEQ ID NO: 71027 - protein, 9 aa, Homo Sapiens
SQLISHHRI

SEQ ID NO: 71028 - protein, 9 aa, Homo Sapiens
SQLIVHQEI

SEQ ID NO: 71029 - protein, 9 aa, Homo Sapiens
SQLIVHQGI

SEQ ID NO: 71030 - protein, 9 aa, Homo Sapiens
SQLIVHQRI

SEQ ID NO: 71031 - protein, 9 aa, Homo Sapiens
SQLKHIFKT

SEQ ID NO: 71032 - protein, 9 aa, Homo Sapiens
SQLPQAQKV

SEQ ID NO: 71033 - protein, 9 aa, Homo Sapiens
SQLQEHQRI

SEQ ID NO: 71034 - protein, 9 aa, Homo Sapiens
SQLQTRQQI

SEQ ID NO: 71035 - protein, 9 aa, Homo Sapiens
SQLTQHQSI

SEQ ID NO: 71036 - protein, 9 aa, Homo Sapiens
SQMPTVIYV

SEQ ID NO: 71037 - protein, 9 aa, Homo Sapiens
SQMPVPVHV

SEQ ID NO: 71038 - protein, 9 aa, Homo Sapiens
SQNGKQYII

SEQ ID NO: 71039 - protein, 9 aa, Homo Sapiens
SQNGVLLGI

SEQ ID NO: 71040 - protein, 9 aa, Homo Sapiens
SQNKSYLAV

SEQ ID NO: 71041 - protein, 9 aa, Homo Sapiens
SQNQKRLYI

SEQ ID NO: 71042 - protein, 9 aa, Homo Sapiens
SQPGIKFTI

SEQ ID NO: 71043 - protein, 9 aa, Homo Sapiens
SQPLGSFLI

SEQ ID NO: 71044 - protein, 9 aa, Homo Sapiens
SQPSKTLFV

SEQ ID NO: 71045 - protein, 9 aa, Homo Sapiens
SQPVLQIFV

SEQ ID NO: 71046 - protein, 9 aa, Homo Sapiens
SQRFIPELI

SEQ ID NO: 71047 - protein, 9 aa, Homo Sapiens
SQSIHQAVI

SEQ ID NO: 71048 - protein, 9 aa, Homo Sapiens
SQSPLPQYV

SEQ ID NO: 71049 - protein, 9 aa, Homo Sapiens
SQSSLIHLV

SEQ ID NO: 71050 - protein, 9 aa, Homo Sapiens
SQSTVKVLI

SEQ ID NO: 71051 - protein, 9 aa, Homo Sapiens
SQTAIALDI

SEQ ID NO: 71052 - protein, 9 aa, Homo Sapiens
SQTDGTLKI

SEQ ID NO: 71053 - protein, 9 aa, Homo Sapiens
SQTFVNPHV

SEQ ID NO: 71054 - protein, 9 aa, Homo Sapiens
SQTIALLNI

SEQ ID NO: 71055 - protein, 9 aa, Homo Sapiens
SQTILIQNI

SEQ ID NO: 71056 - protein, 9 aa, Homo Sapiens
SQTSIGQVI

SEQ ID NO: 71057 - protein, 9 aa, Homo Sapiens
SQTVPSPTI

SEQ ID NO: 71058 - protein, 9 aa, Homo Sapiens
SQVDVAVKI

SEQ ID NO: 71059 - protein, 9 aa, Homo Sapiens
SQVEILQRV

SEQ ID NO: 71060 - protein, 9 aa, Homo Sapiens
SQVEQQQLI

SEQ ID NO: 71061 - protein, 9 aa, Homo Sapiens
SQVKSKLQI

SEQ ID NO: 71062 - protein, 9 aa, Homo Sapiens
SQVNILSKI

SEQ ID NO: 71063 - protein, 9 aa, Homo Sapiens
SQWRAVQGI

SEQ ID NO: 71064 - protein, 9 aa, Homo Sapiens
SQWSLQHEI

SEQ ID NO: 71065 - protein, 9 aa, Homo Sapiens
SQWSPALTI

SEQ ID NO: 71066 - protein, 9 aa, Homo Sapiens
SQYKTTILL

SEQ ID NO: 71067 - protein, 9 aa, Homo Sapiens
SQYPFPVTL

SEQ ID NO: 71068 - protein, 9 aa, Homo Sapiens
SSPPPHPQL

SEQ ID NO: 71069 - protein, 9 aa, Homo Sapiens
SSQFLYPKV

SEQ ID NO: 71070 - protein, 9 aa, Homo Sapiens
SSQTIQPKV

SEQ ID NO: 71071 - protein, 9 aa, Homo Sapiens
SSSAVFLII

SEQ ID NO: 71072 - protein, 9 aa, Homo Sapiens
SSSTVVQEI

SEQ ID NO: 71073 - protein, 9 aa, Homo Sapiens
SSVDQPLKI

SEQ ID NO: 71074 - protein, 9 aa, Homo Sapiens
STAAVIQNV

SEQ ID NO: 71075 - protein, 9 aa, Homo Sapiens
STLAVQQYI

SEQ ID NO: 71076 - protein, 9 aa, Homo Sapiens
STSSLLLRI

SEQ ID NO: 71077 - protein, 9 aa, Homo Sapiens
STYLRPLLV

SEQ ID NO: 71078 - protein, 9 aa, Homo Sapiens
SVCKLQQKV

SEQ ID NO: 71079 - protein, 9 aa, Homo Sapiens
SVHKVTIKI

SEQ ID NO: 71080 - protein, 9 aa, Homo Sapiens
SVNATPLTI

SEQ ID NO: 71081 - protein, 9 aa, Homo Sapiens
SVYDGKLLI

SEQ ID NO: 71082 - protein, 9 aa, Homo Sapiens
TIRYPDPLI

SEQ ID NO: 71083 - protein, 9 aa, Homo Sapiens
TISKVLLSI

SEQ ID NO: 71084 - protein, 9 aa, Homo Sapiens
TLAAVLQRI

SEQ ID NO: 71085 - protein, 9 aa, Homo Sapiens
TLFPSKIGV

SEQ ID NO: 71086 - protein, 9 aa, Homo Sapiens
TLFPVRLLV

SEQ ID NO: 71087 - protein, 9 aa, Homo Sapiens
TLHAAVLQI

SEQ ID NO: 71088 - protein, 9 aa, Homo Sapiens
TLINLLLKV

SEQ ID NO: 71089 - protein, 9 aa, Homo Sapiens
TLKTTEPGV

SEQ ID NO: 71090 - protein, 9 aa, Homo Sapiens
TLMSLPTKI

SEQ ID NO: 71091 - protein, 9 aa, Homo Sapiens
TLPYIKQEV

SEQ ID NO: 71092 - protein, 9 aa, Homo Sapiens
TLSDIKALI

SEQ ID NO: 71093 - protein, 9 aa, Homo Sapiens
TLTDIEQKV

SEQ ID NO: 71094 - protein, 9 aa, Homo Sapiens
TMIDFPQMV

SEQ ID NO: 71095 - protein, 9 aa, Homo Sapiens
TQAHVQTGI

SEQ ID NO: 71096 - protein, 9 aa, Homo Sapiens
TQEQVRLLI

SEQ ID NO: 71097 - protein, 9 aa, Homo Sapiens
TQHAVGIVV

SEQ ID NO: 71098 - protein, 9 aa, Homo Sapiens
TQHHVEALV

SEQ ID NO: 71099 - protein, 9 aa, Homo Sapiens
TQILQTVRI

SEQ ID NO: 71100 - protein, 9 aa, Homo Sapiens
TQKELFDVV

SEQ ID NO: 71101 - protein, 9 aa, Homo Sapiens
TQLPQSMKI

SEQ ID NO: 71102 - protein, 9 aa, Homo Sapiens
TQLTIHQRV

SEQ ID NO: 71103 - protein, 9 aa, Homo Sapiens
TQMIKAWQV

SEQ ID NO: 71104 - protein, 9 aa, Homo Sapiens
TQNFLIQKI

SEQ ID NO: 71105 - protein, 9 aa, Homo Sapiens
TQQDVELHV

SEQ ID NO: 71106 - protein, 9 aa, Homo Sapiens
TQQQLPQKV

SEQ ID NO: 71107 - protein, 9 aa, Homo Sapiens
TQTAVITRI

SEQ ID NO: 71108 - protein, 9 aa, Homo Sapiens
TQTTHELTI

SEQ ID NO: 71109 - protein, 9 aa, Homo Sapiens
TQVGIEWNL

SEQ ID NO: 71110 - protein, 9 aa, Homo Sapiens
TQVGPGPQI

SEQ ID NO: 71111 - protein, 9 aa, Homo Sapiens
TQVKTPVQV

SEQ ID NO: 71112 - protein, 9 aa, Homo Sapiens
TQVVGILKI

SEQ ID NO: 71113 - protein, 9 aa, Homo Sapiens
TSSKVIQSV

SEQ ID NO: 71114 - protein, 9 aa, Homo Sapiens
TVAPTSLVV

SEQ ID NO: 71115 - protein, 9 aa, Homo Sapiens
TVFFHPLLI

SEQ ID NO: 71116 - protein, 9 aa, Homo Sapiens
TVNEIVLKV

SEQ ID NO: 71117 - protein, 9 aa, Homo Sapiens
TVTTVILEV

SEQ ID NO: 71118 - protein, 9 aa, Homo Sapiens
VILDLPLVI

SEQ ID NO: 71119 - protein, 9 aa, Homo Sapiens
VLAEIPQQV

SEQ ID NO: 71120 - protein, 9 aa, Homo Sapiens
VLHDVIYVI

SEQ ID NO: 71121 - protein, 9 aa, Homo Sapiens
VLPAVSLEV

SEQ ID NO: 71122 - protein, 9 aa, Homo Sapiens
VLSQHFQTV

SEQ ID NO: 71123 - protein, 9 aa, Homo Sapiens
VLTPVILQV

SEQ ID NO: 71124 - protein, 9 aa, Homo Sapiens
VLTQIILKT

SEQ ID NO: 71125 - protein, 9 aa, Homo Sapiens
VLYDRPLKI

SEQ ID NO: 71126 - protein, 9 aa, Homo Sapiens
VMDAALLLI

SEQ ID NO: 71127 - protein, 9 aa, Homo Sapiens
VMFKTPVSI

SEQ ID NO: 71128 - protein, 9 aa, Homo Sapiens
VMKHADPRI

SEQ ID NO: 71129 - protein, 9 aa, Homo Sapiens
VQCPHPQIL

SEQ ID NO: 71130 - protein, 9 aa, Homo Sapiens
VQFEDGQKI

SEQ ID NO: 71131 - protein, 9 aa, Homo Sapiens
VQFFSGLEI

SEQ ID NO: 71132 - protein, 9 aa, Homo Sapiens
VQFLVPQSI

SEQ ID NO: 71133 - protein, 9 aa, Homo Sapiens
VQFRLRQVV

SEQ ID NO: 71134 - protein, 9 aa, Homo Sapiens
VQFTVKLRL

SEQ ID NO: 71135 - protein, 9 aa, Homo Sapiens
VQHIPSPKV

SEQ ID NO: 71136 - protein, 9 aa, Homo Sapiens
VQHQDALQI

SEQ ID NO: 71137 - protein, 9 aa, Homo Sapiens
VQIPVFVMI

SEQ ID NO: 71138 - protein, 9 aa, Homo Sapiens
VQMQVVQQL

SEQ ID NO: 71139 - protein, 9 aa, Homo Sapiens
VQNDTLLQV

SEQ ID NO: 71140 - protein, 9 aa, Homo Sapiens
VQNHEFLLV

SEQ ID NO: 71141 - protein, 9 aa, Homo Sapiens
VQNPQAQTI

SEQ ID NO: 71142 - protein, 9 aa, Homo Sapiens
VQRDADIGV

SEQ ID NO: 71143 - protein, 9 aa, Homo Sapiens
VQTAVRLLL

SEQ ID NO: 71144 - protein, 9 aa, Homo Sapiens
VQTSQITKI

SEQ ID NO: 71145 - protein, 9 aa, Homo Sapiens
VQVGETFKV

SEQ ID NO: 71146 - protein, 9 aa, Homo Sapiens
VQVPVPVTV

SEQ ID NO: 71147 - protein, 9 aa, Homo Sapiens
VQYALPLQL

SEQ ID NO: 71148 - protein, 9 aa, Homo Sapiens
VQYAYFKKV

SEQ ID NO: 71149 - protein, 9 aa, Homo Sapiens
VQYKGHVEI

SEQ ID NO: 71150 - protein, 9 aa, Homo Sapiens
VQYNEPLKV

SEQ ID NO: 71151 - protein, 9 aa, Homo Sapiens
VVNKIRLKI

SEQ ID NO: 71152 - protein, 9 aa, Homo Sapiens
VVNKTDLKV

SEQ ID NO: 71153 - protein, 9 aa, Homo Sapiens
VVSDILFKI

SEQ ID NO: 71154 - protein, 9 aa, Homo Sapiens
VVTAVKFTI

SEQ ID NO: 71155 - protein, 9 aa, Homo Sapiens
VVVSVPQRI

SEQ ID NO: 71156 - protein, 9 aa, Homo Sapiens
WQLKVIENV

SEQ ID NO: 71157 - protein, 9 aa, Homo Sapiens
WQNVRALYI

SEQ ID NO: 71158 - protein, 9 aa, Homo Sapiens
WQVVDTPGI

SEQ ID NO: 71159 - protein, 9 aa, Homo Sapiens
WTTSRVLKV

SEQ ID NO: 71160 - protein, 9 aa, Homo Sapiens
YALNHTLSV

SEQ ID NO: 71161 - protein, 9 aa, Homo Sapiens
YIFEEPFTI

SEQ ID NO: 71162 - protein, 9 aa, Homo Sapiens
YLCMKTLLL

SEQ ID NO: 71163 - protein, 9 aa, Homo Sapiens
YLFDLPLKV

SEQ ID NO: 71164 - protein, 9 aa, Homo Sapiens
YLFKCPQSV

SEQ ID NO: 71165 - protein, 9 aa, Homo Sapiens
YLFPGHPPT

SEQ ID NO: 71166 - protein, 9 aa, Homo Sapiens
YLFTSPQRV

SEQ ID NO: 71167 - protein, 9 aa, Homo Sapiens
YLGIVELLV

SEQ ID NO: 71168 - protein, 9 aa, Homo Sapiens
YLKDLIEEV

SEQ ID NO: 71169 - protein, 9 aa, Homo Sapiens
YLLDQHILI

SEQ ID NO: 71170 - protein, 9 aa, Homo Sapiens
YLLPAIVHI

SEQ ID NO: 71171 - protein, 9 aa, Homo Sapiens
YLLSYIQSI

SEQ ID NO: 71172 - protein, 9 aa, Homo Sapiens
YLNKHIQKV

SEQ ID NO: 71173 - protein, 9 aa, Homo Sapiens
YLPPATQVV

SEQ ID NO: 71174 - protein, 9 aa, Homo Sapiens
YLPPTVITI

SEQ ID NO: 71175 - protein, 9 aa, Homo Sapiens
YLTAEILEL

SEQ ID NO: 71176 - protein, 9 aa, Homo Sapiens
YLTEVFLHV

SEQ ID NO: 71177 - protein, 9 aa, Homo Sapiens
YQFGEIRTI

SEQ ID NO: 71178 - protein, 9 aa, Homo Sapiens
YQHGIFQSI

SEQ ID NO: 71179 - protein, 9 aa, Homo Sapiens
YQHKFQLQM

SEQ ID NO: 71180 - protein, 9 aa, Homo Sapiens
YQHLRPQSI

SEQ ID NO: 71181 - protein, 9 aa, Homo Sapiens
YQKSTELLI

SEQ ID NO: 71182 - protein, 9 aa, Homo Sapiens
YQLGELVKV

SEQ ID NO: 71183 - protein, 9 aa, Homo Sapiens
YQLPEILRT

SEQ ID NO: 71184 - protein, 9 aa, Homo Sapiens
YQPFKPLSI

SEQ ID NO: 71185 - protein, 9 aa, Homo Sapiens
YQPKIQQFL

SEQ ID NO: 71186 - protein, 9 aa, Homo Sapiens
YQPWLDLKI

SEQ ID NO: 71187 - protein, 9 aa, Homo Sapiens
YQSKVRELI

SEQ ID NO: 71188 - protein, 9 aa, Homo Sapiens
YQTEIGQTL

SEQ ID NO: 71189 - protein, 9 aa, Homo Sapiens
YQTIPLNKI

SEQ ID NO: 71190 - protein, 9 aa, Homo Sapiens
YQTPLELKL

SEQ ID NO: 71191 - protein, 9 aa, Homo Sapiens
YQTPLHLAV

SEQ ID NO: 71192 - protein, 9 aa, Homo Sapiens
YQTQLIQRV

SEQ ID NO: 71193 - protein, 9 aa, Homo Sapiens
YQTVVTPVI

SEQ ID NO: 71194 - protein, 9 aa, Homo Sapiens
YQVGQLYSV

SEQ ID NO: 71195 - protein, 9 aa, Homo Sapiens
YQVRIQPSI

SEQ ID NO: 71196 - protein, 9 aa, Homo Sapiens
YQYLLVTAL

SEQ ID NO: 71197 - protein, 9 aa, Homo Sapiens
YQYPRPLLI

SEQ ID NO: 71198 - protein, 9 aa, Homo Sapiens
YQYPVIIHL

SEQ ID NO: 71199 - protein, 9 aa, Homo Sapiens
YSPNCKLLI

SEQ ID NO: 71200 - protein, 9 aa, Homo Sapiens
YSSNTRFTI

SEQ ID NO: 71201 - protein, 9 aa, Homo Sapiens
YTDATPLRV

SEQ ID NO: 71202 - protein, 9 aa, Homo Sapiens
YTLGVKQLI

SEQ ID NO: 71203 - protein, 9 aa, Homo Sapiens
YTTDRVMTV

SEQ ID NO: 71204 - protein, 9 aa, Homo Sapiens
YVHMVTHFI

SEQ ID NO: 71205 - protein, 9 aa, Homo Sapiens
YVIELQHVV

SEQ ID NO: 71206 - protein, 9 aa, Homo Sapiens
YVLDLAAKV

SEQ ID NO: 71207 - protein, 9 aa, Homo Sapiens
YVTSVILHI

SEQ ID NO: 71208 - protein, 10 aa, Homo Sapiens
AAGPPISEGK

SEQ ID NO: 71209 - protein, 10 aa, Homo Sapiens
AIIDGKIFCV

SEQ ID NO: 71210 - protein, 10 aa, Homo Sapiens
ALFAGGKLRV

SEQ ID NO: 71211 - protein, 10 aa, Homo Sapiens
ALSPITKLSV

SEQ ID NO: 71212 - protein, 10 aa, Homo Sapiens
AMINSSVHVI

SEQ ID NO: 71213 - protein, 10 aa, Homo Sapiens
AQAELQQHDV

SEQ ID NO: 71214 - protein, 10 aa, Homo Sapiens
AQAQRLMQLI

SEQ ID NO: 71215 - protein, 10 aa, Homo Sapiens
AQCRLQLQVL

SEQ ID NO: 71216 - protein, 10 aa, Homo Sapiens
AQFFIHPLMI

SEQ ID NO: 71217 - protein, 10 aa, Homo Sapiens
AQFKQGVKSV

SEQ ID NO: 71218 - protein, 10 aa, Homo Sapiens
AQFSKSIEVI

SEQ ID NO: 71219 - protein, 10 aa, Homo Sapiens
AQHDPLLTGV

SEQ ID NO: 71220 - protein, 10 aa, Homo Sapiens
AQIELLQLLV

SEQ ID NO: 71221 - protein, 10 aa, Homo Sapiens
AQIYAIRQSI

SEQ ID NO: 71222 - protein, 10 aa, Homo Sapiens
AQLQDFDWQV

SEQ ID NO: 71223 - protein, 10 aa, Homo Sapiens
AQLQIGVIRV

SEQ ID NO: 71224 - protein, 10 aa, Homo Sapiens
AQNPSLFVKI

SEQ ID NO: 71225 - protein, 10 aa, Homo Sapiens
AQQDRIQQEI

SEQ ID NO: 71226 - protein, 10 aa, Homo Sapiens
AQQQDVHLTV

SEQ ID NO: 71227 - protein, 10 aa, Homo Sapiens
AQVAAEILEI

SEQ ID NO: 71228 - protein, 10 aa, Homo Sapiens
AQVCAIIERV

SEQ ID NO: 71229 - protein, 10 aa, Homo Sapiens
AQVEGGVHSL

SEQ ID NO: 71230 - protein, 10 aa, Homo Sapiens
AQVKSLTQKV

SEQ ID NO: 71231 - protein, 10 aa, Homo Sapiens
AQYKFIYVAI

SEQ ID NO: 71232 - protein, 10 aa, Homo Sapiens
AQYSGAQVRV

SEQ ID NO: 71233 - protein, 10 aa, Homo Sapiens
ASQSTVKVLI

SEQ ID NO: 71234 - protein, 10 aa, Homo Sapiens
AVMDAALLLI

SEQ ID NO: 71235 - protein, 10 aa, Homo Sapiens
AVVRNALAHV

SEQ ID NO: 71236 - protein, 10 aa, Homo Sapiens
DGRATQKLIV

SEQ ID NO: 71237 - protein, 10 aa, Homo Sapiens
DTGRPSTTVR

SEQ ID NO: 71238 - protein, 10 aa, Homo Sapiens
FQTEVGKQLI

SEQ ID NO: 71239 - protein, 10 aa, Homo Sapiens
GLPKNPDLRI

SEQ ID NO: 71240 - protein, 10 aa, Homo Sapiens
GLSPVTNLTV

SEQ ID NO: 71241 - protein, 10 aa, Homo Sapiens
GQAALDRLKV

SEQ ID NO: 71242 - protein, 10 aa, Homo Sapiens
GQAGGKLHII

SEQ ID NO: 71243 - protein, 10 aa, Homo Sapiens
GQAHIHVVGV

SEQ ID NO: 71244 - protein, 10 aa, Homo Sapiens
GQALELPLRI

SEQ ID NO: 71245 - protein, 10 aa, Homo Sapiens
GQCHLQFQLI

SEQ ID NO: 71246 - protein, 10 aa, Homo Sapiens
GQDNITVLHV

SEQ ID NO: 71247 - protein, 10 aa, Homo Sapiens
GQFCDVRLQV

SEQ ID NO: 71248 - protein, 10 aa, Homo Sapiens
GQFKDIITKV

SEQ ID NO: 71249 - protein, 10 aa, Homo Sapiens
GQFKKTQILV

SEQ ID NO: 71250 - protein, 10 aa, Homo Sapiens
GQFRGGGVCI

SEQ ID NO: 71251 - protein, 10 aa, Homo Sapiens
GQHGGFVVTV

SEQ ID NO: 71252 - protein, 10 aa, Homo Sapiens
GQHLVQQLVL

SEQ ID NO: 71253 - protein, 10 aa, Homo Sapiens
GQIDKLTLKI

SEQ ID NO: 71254 - protein, 10 aa, Homo Sapiens
GQINKNLLTV

SEQ ID NO: 71255 - protein, 10 aa, Homo Sapiens
GQKPGGSDFL

SEQ ID NO: 71256 - protein, 10 aa, Homo Sapiens
GQLTSNLLLI

SEQ ID NO: 71257 - protein, 10 aa, Homo Sapiens
GQMLTRILVI

SEQ ID NO: 71258 - protein, 10 aa, Homo Sapiens
GQMQNIQVSI

SEQ ID NO: 71259 - protein, 10 aa, Homo Sapiens
GQPNITKLII

SEQ ID NO: 71260 - protein, 10 aa, Homo Sapiens
GQPNTLICLV

SEQ ID NO: 71261 - protein, 10 aa, Homo Sapiens
GQSTPRLFSI

SEQ ID NO: 71262 - protein, 10 aa, Homo Sapiens
GQVPCHFEFI

SEQ ID NO: 71263 - protein, 10 aa, Homo Sapiens
GQVTALLTSI

SEQ ID NO: 71264 - protein, 10 aa, Homo Sapiens
GQYDQPVLAV

SEQ ID NO: 71265 - protein, 10 aa, Homo Sapiens
HLLDFPNIVI

SEQ ID NO: 71266 - protein, 10 aa, Homo Sapiens
HLLSGQLPTI

SEQ ID NO: 71267 - protein, 10 aa, Homo Sapiens
HLPKSIYSQI

SEQ ID NO: 71268 - protein, 10 aa, Homo Sapiens
HLTDITLKVA

SEQ ID NO: 71269 - protein, 10 aa, Homo Sapiens
HLYRDGEGRI

SEQ ID NO: 71270 - protein, 10 aa, Homo Sapiens
HQHQVHNVEI

SEQ ID NO: 71271 - protein, 10 aa, Homo Sapiens
HQHSILACKI

SEQ ID NO: 71272 - protein, 10 aa, Homo Sapiens
HQLENLSNFI

SEQ ID NO: 71273 - protein, 10 aa, Homo Sapiens
HQTNLILQTF

SEQ ID NO: 71274 - protein, 10 aa, Homo Sapiens
HQVKDLLDLI

SEQ ID NO: 71275 - protein, 10 aa, Homo Sapiens
ILFLIAGKIV

SEQ ID NO: 71276 - protein, 10 aa, Homo Sapiens
IQIDLETGKI

SEQ ID NO: 71277 - protein, 10 aa, Homo Sapiens
IQQSIERLLV

SEQ ID NO: 71278 - protein, 10 aa, Homo Sapiens
IQTAVRLLLP

SEQ ID NO: 71279 - protein, 10 aa, Homo Sapiens
KIIYIVHDEV

SEQ ID NO: 71280 - protein, 10 aa, Homo Sapiens
KLAEVTKVVV

SEQ ID NO: 71281 - protein, 10 aa, Homo Sapiens
KLFNGCPLRI

SEQ ID NO: 71282 - protein, 10 aa, Homo Sapiens
KLLEVQILEV

SEQ ID NO: 71283 - protein, 10 aa, Homo Sapiens
KLLNPSLQKV

SEQ ID NO: 71284 - protein, 10 aa, Homo Sapiens
KLLSPVVPQI

SEQ ID NO: 71285 - protein, 10 aa, Homo Sapiens
KLVNIRNDDI

SEQ ID NO: 71286 - protein, 10 aa, Homo Sapiens
KLWEMDNMLI

SEQ ID NO: 71287 - protein, 10 aa, Homo Sapiens
KLYSSEQLLI

SEQ ID NO: 71288 - protein, 10 aa, Homo Sapiens
KMYSEIDIKV

SEQ ID NO: 71289 - protein, 10 aa, Homo Sapiens
KQCDLEIMEI

SEQ ID NO: 71290 - protein, 10 aa, Homo Sapiens
KQDHRGAFLI

SEQ ID NO: 71291 - protein, 10 aa, Homo Sapiens
KQENKTLLKV

SEQ ID NO: 71292 - protein, 10 aa, Homo Sapiens
KQHGDVVSAI

SEQ ID NO: 71293 - protein, 10 aa, Homo Sapiens
KQLAENLVVI

SEQ ID NO: 71294 - protein, 10 aa, Homo Sapiens
KQLASGLLLV

SEQ ID NO: 71295 - protein, 10 aa, Homo Sapiens
KQLDGIHVTI

SEQ ID NO: 71296 - protein, 10 aa, Homo Sapiens
KQLEKTLLEI

SEQ ID NO: 71297 - protein, 10 aa, Homo Sapiens
KQLENGVLQI

SEQ ID NO: 71298 - protein, 10 aa, Homo Sapiens
KQLESQLHRL

SEQ ID NO: 71299 - protein, 10 aa, Homo Sapiens
KQLQQCIQTI

SEQ ID NO: 71300 - protein, 10 aa, Homo Sapiens
KQLQQELLLI

SEQ ID NO: 71301 - protein, 10 aa, Homo Sapiens
KQMKPHIQNI

SEQ ID NO: 71302 - protein, 10 aa, Homo Sapiens
KQMLPLNTNI

SEQ ID NO: 71303 - protein, 10 aa, Homo Sapiens
KQNPEGQWTI

SEQ ID NO: 71304 - protein, 10 aa, Homo Sapiens
KQPSHHPLRI

SEQ ID NO: 71305 - protein, 10 aa, Homo Sapiens
KQQDVIYELI

SEQ ID NO: 71306 - protein, 10 aa, Homo Sapiens
KQQENVTLLL

SEQ ID NO: 71307 - protein, 10 aa, Homo Sapiens
KQVELELQQI

SEQ ID NO: 71308 - protein, 10 aa, Homo Sapiens
KQWKGGPVKI

SEQ ID NO: 71309 - protein, 10 aa, Homo Sapiens
KQYEGGIFKI

SEQ ID NO: 71310 - protein, 10 aa, Homo Sapiens
KVFDGCPLKI

SEQ ID NO: 71311 - protein, 10 aa, Homo Sapiens
KVFNGCPLRI

SEQ ID NO: 71312 - protein, 10 aa, Homo Sapiens
LAEKHLFSTI

SEQ ID NO: 71313 - protein, 10 aa, Homo Sapiens
LLFEGEKITI

SEQ ID NO: 71314 - protein, 10 aa, Homo Sapiens
LQAQIQEQHV

SEQ ID NO: 71315 - protein, 10 aa, Homo Sapiens
QLILDPIFKV

SEQ ID NO: 71316 - protein, 10 aa, Homo Sapiens
QQSCGTYLRV

SEQ ID NO: 71317 - protein, 10 aa, Homo Sapiens
RAFGGKDIKV

SEQ ID NO: 71318 - protein, 10 aa, Homo Sapiens
REFGVNVFIV

SEQ ID NO: 71319 - protein, 10 aa, Homo Sapiens
RGALDAELKA

SEQ ID NO: 71320 - protein, 10 aa, Homo Sapiens
RIADGLPVAV

SEQ ID NO: 71321 - protein, 10 aa, Homo Sapiens
RIFGKKQMRI

SEQ ID NO: 71322 - protein, 10 aa, Homo Sapiens
RIHAVDHMEI

SEQ ID NO: 71323 - protein, 10 aa, Homo Sapiens
RISDVHFSVK

SEQ ID NO: 71324 - protein, 10 aa, Homo Sapiens
RIVATKPLYV

SEQ ID NO: 71325 - protein, 10 aa, Homo Sapiens
RIVENVNVII

SEQ ID NO: 71326 - protein, 10 aa, Homo Sapiens
RIYTGEKLHV

SEQ ID NO: 71327 - protein, 10 aa, Homo Sapiens
RLAAIVAKQV

SEQ ID NO: 71328 - protein, 10 aa, Homo Sapiens
RLADMHSTEI

SEQ ID NO: 71329 - protein, 10 aa, Homo Sapiens
RLAEGTGLQI

SEQ ID NO: 71330 - protein, 10 aa, Homo Sapiens
RLAKVHAYII

SEQ ID NO: 71331 - protein, 10 aa, Homo Sapiens
RLALVTGGEI

SEQ ID NO: 71332 - protein, 10 aa, Homo Sapiens
RLASSGALRV

SEQ ID NO: 71333 - protein, 10 aa, Homo Sapiens
RLCDVLIESI

SEQ ID NO: 71334 - protein, 10 aa, Homo Sapiens
RLCQIGQFTV

SEQ ID NO: 71335 - protein, 10 aa, Homo Sapiens
RLFPGLAIKI

SEQ ID NO: 71336 - protein, 10 aa, Homo Sapiens
RLIAIGGVKI

SEQ ID NO: 71337 - protein, 10 aa, Homo Sapiens
RLIGQIVSSI

SEQ ID NO: 71338 - protein, 10 aa, Homo Sapiens
RLISQIVSSI

SEQ ID NO: 71339 - protein, 10 aa, Homo Sapiens
RLKEIKEELL

SEQ ID NO: 71340 - protein, 10 aa, Homo Sapiens
RLLAEPVPGI

SEQ ID NO: 71341 - protein, 10 aa, Homo Sapiens
RLLDLENIQI

SEQ ID NO: 71342 - protein, 10 aa, Homo Sapiens
RLLEDKKITV

SEQ ID NO: 71343 - protein, 10 aa, Homo Sapiens
RLLENMTEVV

SEQ ID NO: 71344 - protein, 10 aa, Homo Sapiens
RLLGVCYIVV

SEQ ID NO: 71345 - protein, 10 aa, Homo Sapiens
RLLGYQGIAV

SEQ ID NO: 71346 - protein, 10 aa, Homo Sapiens
RLLNKSIIRV

SEQ ID NO: 71347 - protein, 10 aa, Homo Sapiens
RLMPALGVSV

SEQ ID NO: 71348 - protein, 10 aa, Homo Sapiens
RLPSVPFETI

SEQ ID NO: 71349 - protein, 10 aa, Homo Sapiens
RLPVIEPVSI

SEQ ID NO: 71350 - protein, 10 aa, Homo Sapiens
RLQARIAHRI

SEQ ID NO: 71351 - protein, 10 aa, Homo Sapiens
RLQEPKKDLI

SEQ ID NO: 71352 - protein, 10 aa, Homo Sapiens
RLRDPDSHIV

SEQ ID NO: 71353 - protein, 10 aa, Homo Sapiens
RLSETDFKVM

SEQ ID NO: 71354 - protein, 10 aa, Homo Sapiens
RLVEVNGENV

SEQ ID NO: 71355 - protein, 10 aa, Homo Sapiens
RLYDGLFKVI

SEQ ID NO: 71356 - protein, 10 aa, Homo Sapiens
RMFDGKFVVA

SEQ ID NO: 71357 - protein, 10 aa, Homo Sapiens
RMIAGQVLDI

SEQ ID NO: 71358 - protein, 10 aa, Homo Sapiens
RMIKEKLCYV

SEQ ID NO: 71359 - protein, 10 aa, Homo Sapiens
RMKGGEKIGI

SEQ ID NO: 71360 - protein, 10 aa, Homo Sapiens
RMLAHPLHVI

SEQ ID NO: 71361 - protein, 10 aa, Homo Sapiens
RQADFEAHNI

SEQ ID NO: 71362 - protein, 10 aa, Homo Sapiens
RQADITRETV

SEQ ID NO: 71363 - protein, 10 aa, Homo Sapiens
RQADLKNWSL

SEQ ID NO: 71364 - protein, 10 aa, Homo Sapiens
RQAEITRLLL

SEQ ID NO: 71365 - protein, 10 aa, Homo Sapiens
RQAEVTRLLL

SEQ ID NO: 71366 - protein, 10 aa, Homo Sapiens
RQAKLDYQRL

SEQ ID NO: 71367 - protein, 10 aa, Homo Sapiens
RQATINIGTI

SEQ ID NO: 71368 - protein, 10 aa, Homo Sapiens
RQCLHEVHQI

SEQ ID NO: 71369 - protein, 10 aa, Homo Sapiens
RQCPLALDAI

SEQ ID NO: 71370 - protein, 10 aa, Homo Sapiens
RQDAGGILHI

SEQ ID NO: 71371 - protein, 10 aa, Homo Sapiens
RQFGFIVLTT

SEQ ID NO: 71372 - protein, 10 aa, Homo Sapiens
RQFKEIAAVI

SEQ ID NO: 71373 - protein, 10 aa, Homo Sapiens
RQFKPCIKQI

SEQ ID NO: 71374 - protein, 10 aa, Homo Sapiens
RQFQPTQDNV

SEQ ID NO: 71375 - protein, 10 aa, Homo Sapiens
RQFSGARNQL

SEQ ID NO: 71376 - protein, 10 aa, Homo Sapiens
RQGSFSLLMF

SEQ ID NO: 71377 - protein, 10 aa, Homo Sapiens
RQHEIIHTGV

SEQ ID NO: 71378 - protein, 10 aa, Homo Sapiens
RQHEIVLKVA

SEQ ID NO: 71379 - protein, 10 aa, Homo Sapiens
RQHFIQEEQI

SEQ ID NO: 71380 - protein, 10 aa, Homo Sapiens
RQHVLTRIGV

SEQ ID NO: 71381 - protein, 10 aa, Homo Sapiens
RQIAKAYARI

SEQ ID NO: 71382 - protein, 10 aa, Homo Sapiens
RQIDQFLVVA

SEQ ID NO: 71383 - protein, 10 aa, Homo Sapiens
RQIDQMVGLI

SEQ ID NO: 71384 - protein, 10 aa, Homo Sapiens
RQIEGRVVEI

SEQ ID NO: 71385 - protein, 10 aa, Homo Sapiens
RQIKIKTGVV

SEQ ID NO: 71386 - protein, 10 aa, Homo Sapiens
RQILEGVHFL

SEQ ID NO: 71387 - protein, 10 aa, Homo Sapiens
RQIYIYNEKI

SEQ ID NO: 71388 - protein, 10 aa, Homo Sapiens
RQKDMAKVFV

SEQ ID NO: 71389 - protein, 10 aa, Homo Sapiens
RQKDVKIVTV

SEQ ID NO: 71390 - protein, 10 aa, Homo Sapiens
RQKEADMYRI

SEQ ID NO: 71391 - protein, 10 aa, Homo Sapiens
RQKEGIKLTI

SEQ ID NO: 71392 - protein, 10 aa, Homo Sapiens
RQKIAEEIGI

SEQ ID NO: 71393 - protein, 10 aa, Homo Sapiens
RQLKHSYYRI

SEQ ID NO: 71394 - protein, 10 aa, Homo Sapiens
RQLQKMVHDI

SEQ ID NO: 71395 - protein, 10 aa, Homo Sapiens
RQLSHAISVI

SEQ ID NO: 71396 - protein, 10 aa, Homo Sapiens
RQLSSGVSEI

SEQ ID NO: 71397 - protein, 10 aa, Homo Sapiens
RQMDIIVSEV

SEQ ID NO: 71398 - protein, 10 aa, Homo Sapiens
RQMEMKILRA

SEQ ID NO: 71399 - protein, 10 aa, Homo Sapiens
RQMEPFPLRV

SEQ ID NO: 71400 - protein, 10 aa, Homo Sapiens
RQMSGAQIKI

SEQ ID NO: 71401 - protein, 10 aa, Homo Sapiens
RQNFTEPTAI

SEQ ID NO: 71402 - protein, 10 aa, Homo Sapiens
RQPDSGISSI

SEQ ID NO: 71403 - protein, 10 aa, Homo Sapiens
RQPNISDQQV

SEQ ID NO: 71404 - protein, 10 aa, Homo Sapiens
RQPQGHLLLI

SEQ ID NO: 71405 - protein, 10 aa, Homo Sapiens
RQPVMTPCKI

SEQ ID NO: 71406 - protein, 10 aa, Homo Sapiens
RQSGCLPLLI

SEQ ID NO: 71407 - protein, 10 aa, Homo Sapiens
RQSQALILKI

SEQ ID NO: 71408 - protein, 10 aa, Homo Sapiens
RQSSLELTVW

SEQ ID NO: 71409 - protein, 10 aa, Homo Sapiens
RQTEIYQYVL

SEQ ID NO: 71410 - protein, 10 aa, Homo Sapiens
RQTKPLKVQV

SEQ ID NO: 71411 - protein, 10 aa, Homo Sapiens
RQTNIIWAVF

SEQ ID NO: 71412 - protein, 10 aa, Homo Sapiens
RQVEELQLQV

SEQ ID NO: 71413 - protein, 10 aa, Homo Sapiens
RQVGKTLRIQ

SEQ ID NO: 71414 - protein, 10 aa, Homo Sapiens
RQVLEDFPTI

SEQ ID NO: 71415 - protein, 10 aa, Homo Sapiens
RQVRELKTKI

SEQ ID NO: 71416 - protein, 10 aa, Homo Sapiens
RQWEESWQQV

SEQ ID NO: 71417 - protein, 10 aa, Homo Sapiens
RQWQIEGTGI

SEQ ID NO: 71418 - protein, 10 aa, Homo Sapiens
RQYAKDIGFI

SEQ ID NO: 71419 - protein, 10 aa, Homo Sapiens
RQYNIQKKEI

SEQ ID NO: 71420 - protein, 10 aa, Homo Sapiens
RQYPWGTVQV

SEQ ID NO: 71421 - protein, 10 aa, Homo Sapiens
RQYPWGVAEV

SEQ ID NO: 71422 - protein, 10 aa, Homo Sapiens
RQYPWGVVQV

SEQ ID NO: 71423 - protein, 10 aa, Homo Sapiens
RVAQLEQVYI

SEQ ID NO: 71424 - protein, 10 aa, Homo Sapiens
RVAREAIQKV

SEQ ID NO: 71425 - protein, 10 aa, Homo Sapiens
RVCKILGSGI

SEQ ID NO: 71426 - protein, 10 aa, Homo Sapiens
RVGDIHILEV

SEQ ID NO: 71427 - protein, 10 aa, Homo Sapiens
RVLQNVAFSV

SEQ ID NO: 71428 - protein, 10 aa, Homo Sapiens
RVYGGLTTKV

SEQ ID NO: 71429 - protein, 10 aa, Homo Sapiens
SLADLQNDEV

SEQ ID NO: 71430 - protein, 10 aa, Homo Sapiens
SLFAGGMLRV

SEQ ID NO: 71431 - protein, 10 aa, Homo Sapiens
SLFAGQPLTI

SEQ ID NO: 71432 - protein, 10 aa, Homo Sapiens
SLHAAAVLLL

SEQ ID NO: 71433 - protein, 10 aa, Homo Sapiens
SQADCAVLIV

SEQ ID NO: 71434 - protein, 10 aa, Homo Sapiens
SQADLAVLVI

SEQ ID NO: 71435 - protein, 10 aa, Homo Sapiens
SQAKRVLQEV

SEQ ID NO: 71436 - protein, 10 aa, Homo Sapiens
SQIGTGDLKI

SEQ ID NO: 71437 - protein, 10 aa, Homo Sapiens
SQLKQQIQSI

SEQ ID NO: 71438 - protein, 10 aa, Homo Sapiens
SQMEQFPVKV

SEQ ID NO: 71439 - protein, 10 aa, Homo Sapiens
SQQNGTPLKV

SEQ ID NO: 71440 - protein, 10 aa, Homo Sapiens
SQTSVQLIVF

SEQ ID NO: 71441 - protein, 10 aa, Homo Sapiens
SQVAGTPMFV

SEQ ID NO: 71442 - protein, 10 aa, Homo Sapiens
SVFGTMPLKV

SEQ ID NO: 71443 - protein, 10 aa, Homo Sapiens
TLFGKAILRI

SEQ ID NO: 71444 - protein, 10 aa, Homo Sapiens
TQLNLRSLLV

SEQ ID NO: 71445 - protein, 10 aa, Homo Sapiens
TQMNHIVMEI

SEQ ID NO: 71446 - protein, 10 aa, Homo Sapiens
VLISGVVHEI

SEQ ID NO: 71447 - protein, 10 aa, Homo Sapiens
VQAGVTYLFV

SEQ ID NO: 71448 - protein, 10 aa, Homo Sapiens
VQIKDVNLEV

SEQ ID NO: 71449 - protein, 10 aa, Homo Sapiens
VQPHISPLTI

SEQ ID NO: 71450 - protein, 10 aa, Homo Sapiens
VQSQRVLLFV

SEQ ID NO: 71451 - protein, 10 aa, Homo Sapiens
VQVESVNLQV

SEQ ID NO: 71452 - protein, 10 aa, Homo Sapiens
VVPPFLQPEV

SEQ ID NO: 71453 - protein, 10 aa, Homo Sapiens
YAGCVAHLII

SEQ ID NO: 71454 - protein, 10 aa, Homo Sapiens
YDAEISQIHQ

SEQ ID NO: 71455 - protein, 10 aa, Homo Sapiens
YQIDAAIVRI

SEQ ID NO: 71456 - protein, 10 aa, Homo Sapiens
YQILPLHSQI

SEQ ID NO: 71457 - protein, 10 aa, Homo Sapiens
YQKKTQLEHI

SEQ ID NO: 71458 - protein, 10 aa, Homo Sapiens
YQYKNICQQV

SEQ ID NO: 71459 - protein, 11 aa, Homo Sapiens
ALFASGLIHRV

SEQ ID NO: 71460 - protein, 11 aa, Homo Sapiens
ALQEASEAYLV

SEQ ID NO: 71461 - protein, 11 aa, Homo Sapiens
AQAEAEKIRKI

SEQ ID NO: 71462 - protein, 11 aa, Homo Sapiens
AQDYLQCVLQI

SEQ ID NO: 71463 - protein, 11 aa, Homo Sapiens
AQFHPTEDLVV

SEQ ID NO: 71464 - protein, 11 aa, Homo Sapiens
AQFNNLGVLHV

SEQ ID NO: 71465 - protein, 11 aa, Homo Sapiens
AQHSVPLQLEL

SEQ ID NO: 71466 - protein, 11 aa, Homo Sapiens
AQIDSNIAHTV

SEQ ID NO: 71467 - protein, 11 aa, Homo Sapiens
AQLDPEALGNI

SEQ ID NO: 71468 - protein, 11 aa, Homo Sapiens
AQTEQGDIFKI

SEQ ID NO: 71469 - protein, 11 aa, Homo Sapiens
AQYFLDKIDVI

SEQ ID NO: 71470 - protein, 11 aa, Homo Sapiens
AVIKHSLVHKV

SEQ ID NO: 71471 - protein, 11 aa, Homo Sapiens
ERAGGALELLL

SEQ ID NO: 71472 - protein, 11 aa, Homo Sapiens
ETQITQIEHEV

SEQ ID NO: 71473 - protein, 11 aa, Homo Sapiens
GLDPSTPAQVI

SEQ ID NO: 71474 - protein, 11 aa, Homo Sapiens
GQAEEVVQERI

SEQ ID NO: 71475 - protein, 11 aa, Homo Sapiens
GQASGELLQQI

SEQ ID NO: 71476 - protein, 11 aa, Homo Sapiens
GQDGSVVQFKI

SEQ ID NO: 71477 - protein, 11 aa, Homo Sapiens
GQFDHPNIIRL

SEQ ID NO: 71478 - protein, 11 aa, Homo Sapiens
GQFTGSTGVQV

SEQ ID NO: 71479 - protein, 11 aa, Homo Sapiens
GQGSFGKVFLV

SEQ ID NO: 71480 - protein, 11 aa, Homo Sapiens
GQIGPAPPLKV

SEQ ID NO: 71481 - protein, 11 aa, Homo Sapiens
GQIRNLESARV

SEQ ID NO: 71482 - protein, 11 aa, Homo Sapiens
GQLDSPGSLKI

SEQ ID NO: 71483 - protein, 11 aa, Homo Sapiens
GQLDTPGVHNV

SEQ ID NO: 71484 - protein, 11 aa, Homo Sapiens
GQLSEGAIAAI

SEQ ID NO: 71485 - protein, 11 aa, Homo Sapiens
GQMAMGGAMGI

SEQ ID NO: 71486 - protein, 11 aa, Homo Sapiens
GQNESFARIQV

SEQ ID NO: 71487 - protein, 11 aa, Homo Sapiens
GQSELASRLTL

SEQ ID NO: 71488 - protein, 11 aa, Homo Sapiens
GQSELTLLLKI

SEQ ID NO: 71489 - protein, 11 aa, Homo Sapiens
GQSKGFALVGV

SEQ ID NO: 71490 - protein, 11 aa, Homo Sapiens
GQSKGYAEVVV

SEQ ID NO: 71491 - protein, 11 aa, Homo Sapiens
GQSPMAALILV

SEQ ID NO: 71492 - protein, 11 aa, Homo Sapiens
GQVTRADILQV

SEQ ID NO: 71493 - protein, 11 aa, Homo Sapiens
GQWLAHAIQTV

SEQ ID NO: 71494 - protein, 11 aa, Homo Sapiens
GQYAGHVVPTI

SEQ ID NO: 71495 - protein, 11 aa, Homo Sapiens
GQYAMTRAQRV

SEQ ID NO: 71496 - protein, 11 aa, Homo Sapiens
HLASIHGYLGI

SEQ ID NO: 71497 - protein, 11 aa, Homo Sapiens
HQIGPGMVQQI

SEQ ID NO: 71498 - protein, 11 aa, Homo Sapiens
HQQSIPAVLEI

SEQ ID NO: 71499 - protein, 11 aa, Homo Sapiens
IILSILEVIII

SEQ ID NO: 71500 - protein, 11 aa, Homo Sapiens
IQFKKPIIVAV

SEQ ID NO: 71501 - protein, 11 aa, Homo Sapiens
KEIENGHIFTV

SEQ ID NO: 71502 - protein, 11 aa, Homo Sapiens
KIISVDEIFKI

SEQ ID NO: 71503 - protein, 11 aa, Homo Sapiens
KLFADAGLVCI

SEQ ID NO: 71504 - protein, 11 aa, Homo Sapiens
KLFPKGTIFTA

SEQ ID NO: 71505 - protein, 11 aa, Homo Sapiens
KLWDTETGQCI

SEQ ID NO: 71506 - protein, 11 aa, Homo Sapiens
KMWDLSSNQAI

SEQ ID NO: 71507 - protein, 11 aa, Homo Sapiens
KQIDYTVPTVI

SEQ ID NO: 71508 - protein, 11 aa, Homo Sapiens
KQLSDTSIIAV

SEQ ID NO: 71509 - protein, 11 aa, Homo Sapiens
KQSPLQKHLRV

SEQ ID NO: 71510 - protein, 11 aa, Homo Sapiens
LLFEGEKKITI

SEQ ID NO: 71511 - protein, 11 aa, Homo Sapiens
LPAKEENVILV

SEQ ID NO: 71512 - protein, 11 aa, Homo Sapiens
PTSSQFLYPKV

SEQ ID NO: 71513 - protein, 11 aa, Homo Sapiens
RIAEALSKMKL

SEQ ID NO: 71514 - protein, 11 aa, Homo Sapiens
RILDIDIPMSV

SEQ ID NO: 71515 - protein, 11 aa, Homo Sapiens
RLADFGISAQI

SEQ ID NO: 71516 - protein, 11 aa, Homo Sapiens
RLAEAHAKVRL

SEQ ID NO: 71517 - protein, 11 aa, Homo Sapiens
RLAEALPKQSV

SEQ ID NO: 71518 - protein, 11 aa, Homo Sapiens
RLCPNSTGAEI

SEQ ID NO: 71519 - protein, 11 aa, Homo Sapiens
RLDPQSGALYI

SEQ ID NO: 71520 - protein, 11 aa, Homo Sapiens
RLFDDSTVTTV

SEQ ID NO: 71521 - protein, 11 aa, Homo Sapiens
RLFFPEDPVKI

SEQ ID NO: 71522 - protein, 11 aa, Homo Sapiens
RLFHDSAVTSV

SEQ ID NO: 71523 - protein, 11 aa, Homo Sapiens
RLFKIDKEYLL

SEQ ID NO: 71524 - protein, 11 aa, Homo Sapiens
RLFPKALGQLI

SEQ ID NO: 71525 - protein, 11 aa, Homo Sapiens
RLFPVPGSGLV

SEQ ID NO: 71526 - protein, 11 aa, Homo Sapiens
RLIEVNGVDLV

SEQ ID NO: 71527 - protein, 11 aa, Homo Sapiens
RLIGDAAKNQV

SEQ ID NO: 71528 - protein, 11 aa, Homo Sapiens
RLKAAEAESKL

SEQ ID NO: 71529 - protein, 11 aa, Homo Sapiens
RLKFLNDSEQV

SEQ ID NO: 71530 - protein, 11 aa, Homo Sapiens
RLKTQSELDRI

SEQ ID NO: 71531 - protein, 11 aa, Homo Sapiens
RLKYALTGDEV

SEQ ID NO: 71532 - protein, 11 aa, Homo Sapiens
RLLNVEVPQKV

SEQ ID NO: 71533 - protein, 11 aa, Homo Sapiens
RLLPGDIILKV

SEQ ID NO: 71534 - protein, 11 aa, Homo Sapiens
RLLPPGAVVAV

SEQ ID NO: 71535 - protein, 11 aa, Homo Sapiens
RLPAAGVGDMV

SEQ ID NO: 71536 - protein, 11 aa, Homo Sapiens
RLPFLDSQTGV

SEQ ID NO: 71537 - protein, 11 aa, Homo Sapiens
RLPPDTLLQQV

SEQ ID NO: 71538 - protein, 11 aa, Homo Sapiens
RLSASSTFQSI

SEQ ID NO: 71539 - protein, 11 aa, Homo Sapiens
RLSEEASQALI

SEQ ID NO: 71540 - protein, 11 aa, Homo Sapiens
RLSQAGARVKI

SEQ ID NO: 71541 - protein, 11 aa, Homo Sapiens
RMAEAHARIHL

SEQ ID NO: 71542 - protein, 11 aa, Homo Sapiens
RQAAEDKSWRV

SEQ ID NO: 71543 - protein, 11 aa, Homo Sapiens
RQAAGKIFEIF

SEQ ID NO: 71544 - protein, 11 aa, Homo Sapiens
RQAATEFGWTL

SEQ ID NO: 71545 - protein, 11 aa, Homo Sapiens
RQADCILIVGL

SEQ ID NO: 71546 - protein, 11 aa, Homo Sapiens
RQATAASSVMV

SEQ ID NO: 71547 - protein, 11 aa, Homo Sapiens
RQDLTQSLIMI

SEQ ID NO: 71548 - protein, 11 aa, Homo Sapiens
RQFDHPHIVKL

SEQ ID NO: 71549 - protein, 11 aa, Homo Sapiens
RQFESLPATHI

SEQ ID NO: 71550 - protein, 11 aa, Homo Sapiens
RQFKHSEKVHV

SEQ ID NO: 71551 - protein, 11 aa, Homo Sapiens
RQFSTPFQLQC

SEQ ID NO: 71552 - protein, 11 aa, Homo Sapiens
RQFVPIKVEQI

SEQ ID NO: 71553 - protein, 11 aa, Homo Sapiens
RQHEIVLKVAY

SEQ ID NO: 71554 - protein, 11 aa, Homo Sapiens
RQIDVHIFNAV

SEQ ID NO: 71555 - protein, 11 aa, Homo Sapiens
RQILLGPNTGL

SEQ ID NO: 71556 - protein, 11 aa, Homo Sapiens
RQLGSKYILGI

SEQ ID NO: 71557 - protein, 11 aa, Homo Sapiens
RQLKLPQIQKI

SEQ ID NO: 71558 - protein, 11 aa, Homo Sapiens
RQLNEKLVQLI

SEQ ID NO: 71559 - protein, 11 aa, Homo Sapiens
RQLTANTGHTI

SEQ ID NO: 71560 - protein, 11 aa, Homo Sapiens
RQMAEIAVNAV

SEQ ID NO: 71561 - protein, 11 aa, Homo Sapiens
RQSGSAVITFV

SEQ ID NO: 71562 - protein, 11 aa, Homo Sapiens
RQTASVTLQAI

SEQ ID NO: 71563 - protein, 11 aa, Homo Sapiens
RQTKTSLEVSL

SEQ ID NO: 71564 - protein, 11 aa, Homo Sapiens
RQVGQVAKQQV

SEQ ID NO: 71565 - protein, 11 aa, Homo Sapiens
RQVQPEGPYRV

SEQ ID NO: 71566 - protein, 11 aa, Homo Sapiens
RQVTGVTRVTI

SEQ ID NO: 71567 - protein, 11 aa, Homo Sapiens
RQYDGSRNPRI

SEQ ID NO: 71568 - protein, 11 aa, Homo Sapiens
RQYESLPATHI

SEQ ID NO: 71569 - protein, 11 aa, Homo Sapiens
RQYLDPAQRGV

SEQ ID NO: 71570 - protein, 11 aa, Homo Sapiens
RQYLECEVFRV

SEQ ID NO: 71571 - protein, 11 aa, Homo Sapiens
RQYLPGNEQGV

SEQ ID NO: 71572 - protein, 11 aa, Homo Sapiens
RVIDREGVYEI

SEQ ID NO: 71573 - protein, 11 aa, Homo Sapiens
RVLKPGGLLKV

SEQ ID NO: 71574 - protein, 11 aa, Homo Sapiens
SQFKGVDILLT

SEQ ID NO: 71575 - protein, 11 aa, Homo Sapiens
SQHGIHDGLTV

SEQ ID NO: 71576 - protein, 11 aa, Homo Sapiens
SQSQLISQMGI

SEQ ID NO: 71577 - protein, 11 aa, Homo Sapiens
SQVAVAGLLTV

SEQ ID NO: 71578 - protein, 11 aa, Homo Sapiens
SVFPGARLLTI

SEQ ID NO: 71579 - protein, 11 aa, Homo Sapiens
TQDQNSSSWLI

SEQ ID NO: 71580 - protein, 11 aa, Homo Sapiens
VQALVSGKLAL

SEQ ID NO: 71581 - protein, 11 aa, Homo Sapiens
VQFEDGQKIVV

SEQ ID NO: 71582 - protein, 11 aa, Homo Sapiens
VQPTAAPGQKV

SEQ ID NO: 71583 - protein, 11 aa, Homo Sapiens
VTIKKDVDGAY

SEQ ID NO: 71584 - protein, 11 aa, Homo Sapiens
VVVATNGKVLK

SEQ ID NO: 71585 - protein, 11 aa, Homo Sapiens
YQFDKVGILTL

SEQ ID NO: 71586 - protein, 11 aa, Homo Sapiens
YQKPGVGLDAI

SEQ ID NO: 71587 - protein, 11 aa, Homo Sapiens
YQPLFDKRFEI

SEQ ID NO: 71588 - protein, 8 aa, Homo Sapiens
AAERRGPL

SEQ ID NO: 71589 - protein, 8 aa, Homo Sapiens
AEFQHLVL

SEQ ID NO: 71590 - protein, 8 aa, Homo Sapiens
AEVLHTVL

SEQ ID NO: 71591 - protein, 8 aa, Homo Sapiens
AHFPHQVL

SEQ ID NO: 71592 - protein, 8 aa, Homo Sapiens
APFQHSPL

SEQ ID NO: 71593 - protein, 8 aa, Homo Sapiens
APLVHATL

SEQ ID NO: 71594 - protein, 8 aa, Homo Sapiens
AQLAHAVL

SEQ ID NO: 71595 - protein, 8 aa, Homo Sapiens
ARYQGREL

SEQ ID NO: 71596 - protein, 8 aa, Homo Sapiens
CDFVHQAL

SEQ ID NO: 71597 - protein, 8 aa, Homo Sapiens
CHAVHVAL

SEQ ID NO: 71598 - protein, 8 aa, Homo Sapiens
CMRLHLQL

SEQ ID NO: 71599 - protein, 8 aa, Homo Sapiens
CQVEHTSL

SEQ ID NO: 71600 - protein, 8 aa, Homo Sapiens
CRITHKTL

SEQ ID NO: 71601 - protein, 8 aa, Homo Sapiens
CRLEHTTL

SEQ ID NO: 71602 - protein, 8 aa, Homo Sapiens
CRVNHVTL

SEQ ID NO: 71603 - protein, 8 aa, Homo Sapiens
CRYQGPVL

SEQ ID NO: 71604 - protein, 8 aa, Homo Sapiens
DALVHARL

SEQ ID NO: 71605 - protein, 8 aa, Homo Sapiens
DALVHFAL

SEQ ID NO: 71606 - protein, 8 aa, Homo Sapiens
DASVHPTL

SEQ ID NO: 71607 - protein, 8 aa, Homo Sapiens
DAVERHAL

SEQ ID NO: 71608 - protein, 8 aa, Homo Sapiens
DAVTHARF

SEQ ID NO: 71609 - protein, 8 aa, Homo Sapiens
DDMQHQVL

SEQ ID NO: 71610 - protein, 8 aa, Homo Sapiens
DEAIRAVL

SEQ ID NO: 71611 - protein, 8 aa, Homo Sapiens
DEFVKSVL

SEQ ID NO: 71612 - protein, 8 aa, Homo Sapiens
DEGRHLTL

SEQ ID NO: 71613 - protein, 8 aa, Homo Sapiens
DEINHQSL

SEQ ID NO: 71614 - protein, 8 aa, Homo Sapiens
DELNHASI

SEQ ID NO: 71615 - protein, 8 aa, Homo Sapiens
DESIHLQL

SEQ ID NO: 71616 - protein, 8 aa, Homo Sapiens
DEVGHLAL

SEQ ID NO: 71617 - protein, 8 aa, Homo Sapiens
DEVIHGIF

SEQ ID NO: 71618 - protein, 8 aa, Homo Sapiens
DEVKRGVL

SEQ ID NO: 71619 - protein, 8 aa, Homo Sapiens
DFATHGKL

SEQ ID NO: 71620 - protein, 8 aa, Homo Sapiens
DGFLHETL

SEQ ID NO: 71621 - protein, 8 aa, Homo Sapiens
DGFQHGEL

SEQ ID NO: 71622 - protein, 8 aa, Homo Sapiens
DGFRHQAL

SEQ ID NO: 71623 - protein, 8 aa, Homo Sapiens
DGLIHTSL

SEQ ID NO: 71624 - protein, 8 aa, Homo Sapiens
DGVPREGL

SEQ ID NO: 71625 - protein, 8 aa, Homo Sapiens
DGYRHEML

SEQ ID NO: 71626 - protein, 8 aa, Homo Sapiens
DHISHFIL

SEQ ID NO: 71627 - protein, 8 aa, Homo Sapiens
DHWVHVLV

SEQ ID NO: 71628 - protein, 8 aa, Homo Sapiens
DHYEKPEL

SEQ ID NO: 71629 - protein, 8 aa, Homo Sapiens
DIKRALGI

SEQ ID NO: 71630 - protein, 8 aa, Homo Sapiens
DIRVLRIG

SEQ ID NO: 71631 - protein, 8 aa, Homo Sapiens
DKMTHRIL

SEQ ID NO: 71632 - protein, 8 aa, Homo Sapiens
DMYSHYVL

SEQ ID NO: 71633 - protein, 8 aa, Homo Sapiens
DNVAHSSL

SEQ ID NO: 71634 - protein, 8 aa, Homo Sapiens
DNVTHAHL

SEQ ID NO: 71635 - protein, 8 aa, Homo Sapiens
DPVVHSAL

SEQ ID NO: 71636 - protein, 8 aa, Homo Sapiens
DQARHYLL

SEQ ID NO: 71637 - protein, 8 aa, Homo Sapiens
DQAVHAEV

SEQ ID NO: 71638 - protein, 8 aa, Homo Sapiens
DQFLKICL

SEQ ID NO: 71639 - protein, 8 aa, Homo Sapiens
DQFLRDNL

SEQ ID NO: 71640 - protein, 8 aa, Homo Sapiens
DQFLREVL

SEQ ID NO: 71641 - protein, 8 aa, Homo Sapiens
DQIVRHDL

SEQ ID NO: 71642 - protein, 8 aa, Homo Sapiens
DQLRHGGL

SEQ ID NO: 71643 - protein, 8 aa, Homo Sapiens
DQSLHREL

SEQ ID NO: 71644 - protein, 8 aa, Homo Sapiens
DQTKRLEL

SEQ ID NO: 71645 - protein, 8 aa, Homo Sapiens
DQVARTHL

SEQ ID NO: 71646 - protein, 8 aa, Homo Sapiens
DQVLHLSF

SEQ ID NO: 71647 - protein, 8 aa, Homo Sapiens
DQVQHMEL

SEQ ID NO: 71648 - protein, 8 aa, Homo Sapiens
DQVTHIRI

SEQ ID NO: 71649 - protein, 8 aa, Homo Sapiens
DQYSRFSL

SEQ ID NO: 71650 - protein, 8 aa, Homo Sapiens
DRAGSIVL

SEQ ID NO: 71651 - protein, 8 aa, Homo Sapiens
DRAKHLEF

SEQ ID NO: 71652 - protein, 8 aa, Homo Sapiens
DRALHAKL

SEQ ID NO: 71653 - protein, 8 aa, Homo Sapiens
DRALRAAL

SEQ ID NO: 71654 - protein, 8 aa, Homo Sapiens
DRALRSFL

SEQ ID NO: 71655 - protein, 8 aa, Homo Sapiens
DRARYSAF

SEQ ID NO: 71656 - protein, 8 aa, Homo Sapiens
DRAYVRQL

SEQ ID NO: 71657 - protein, 8 aa, Homo Sapiens
DRFKVKEV

SEQ ID NO: 71658 - protein, 8 aa, Homo Sapiens
DRFKVMKA

SEQ ID NO: 71659 - protein, 8 aa, Homo Sapiens
DRFNHFSL

SEQ ID NO: 71660 - protein, 8 aa, Homo Sapiens
DRFRDSIL

SEQ ID NO: 71661 - protein, 8 aa, Homo Sapiens
DRFRNNSL

SEQ ID NO: 71662 - protein, 8 aa, Homo Sapiens
DRFRSQIL

SEQ ID NO: 71663 - protein, 8 aa, Homo Sapiens
DRHMYHSL

SEQ ID NO: 71664 - protein, 8 aa, Homo Sapiens
DRHVGMAV

SEQ ID NO: 71665 - protein, 8 aa, Homo Sapiens
DRIEITSL

SEQ ID NO: 71666 - protein, 8 aa, Homo Sapiens
DRIKRAFL

SEQ ID NO: 71667 - protein, 8 aa, Homo Sapiens
DRILIHSL

SEQ ID NO: 71668 - protein, 8 aa, Homo Sapiens
DRILREEL

SEQ ID NO: 71669 - protein, 8 aa, Homo Sapiens
DRILRPEL

SEQ ID NO: 71670 - protein, 8 aa, Homo Sapiens
DRIVSMTL

SEQ ID NO: 71671 - protein, 8 aa, Homo Sapiens
DRLINSEL

SEQ ID NO: 71672 - protein, 8 aa, Homo Sapiens
DRLIVGTA

SEQ ID NO: 71673 - protein, 8 aa, Homo Sapiens
DRLKPLKM

SEQ ID NO: 71674 - protein, 8 aa, Homo Sapiens
DRLKPLLV

SEQ ID NO: 71675 - protein, 8 aa, Homo Sapiens
DRLKSALL

SEQ ID NO: 71676 - protein, 8 aa, Homo Sapiens
DRLKSLTM

SEQ ID NO: 71677 - protein, 8 aa, Homo Sapiens
DRLQWVTI

SEQ ID NO: 71678 - protein, 8 aa, Homo Sapiens
DRLSASSL

SEQ ID NO: 71679 - protein, 8 aa, Homo Sapiens
DRLYSRKI

SEQ ID NO: 71680 - protein, 8 aa, Homo Sapiens
DRMFHIRA

SEQ ID NO: 71681 - protein, 8 aa, Homo Sapiens
DRMKTVSV

SEQ ID NO: 71682 - protein, 8 aa, Homo Sapiens
DRMLRSAM

SEQ ID NO: 71683 - protein, 8 aa, Homo Sapiens
DRMVGQVL

SEQ ID NO: 71684 - protein, 8 aa, Homo Sapiens
DRMYRSAV

SEQ ID NO: 71685 - protein, 8 aa, Homo Sapiens
DRNQPVTL

SEQ ID NO: 71686 - protein, 8 aa, Homo Sapiens
DRQCARVL

SEQ ID NO: 71687 - protein, 8 aa, Homo Sapiens
DRQKSRIL

SEQ ID NO: 71688 - protein, 8 aa, Homo Sapiens
DRQVVSEL

SEQ ID NO: 71689 - protein, 8 aa, Homo Sapiens
DRRDHPLP

SEQ ID NO: 71690 - protein, 8 aa, Homo Sapiens
DRTGHIKL

SEQ ID NO: 71691 - protein, 8 aa, Homo Sapiens
DRVAHMEF

SEQ ID NO: 71692 - protein, 8 aa, Homo Sapiens
DRVFHESI

SEQ ID NO: 71693 - protein, 8 aa, Homo Sapiens
DRVGRQEL

SEQ ID NO: 71694 - protein, 8 aa, Homo Sapiens
DRVIKASL

SEQ ID NO: 71695 - protein, 8 aa, Homo Sapiens
DRVIKNCI

SEQ ID NO: 71696 - protein, 8 aa, Homo Sapiens
DRVRALEL

SEQ ID NO: 71697 - protein, 8 aa, Homo Sapiens
DRVRHSML

SEQ ID NO: 71698 - protein, 8 aa, Homo Sapiens
DRVTRSTL

SEQ ID NO: 71699 - protein, 8 aa, Homo Sapiens
DRVVIQEM

SEQ ID NO: 71700 - protein, 8 aa, Homo Sapiens
DRVVVIRF

SEQ ID NO: 71701 - protein, 8 aa, Homo Sapiens
DRWWHATL

SEQ ID NO: 71702 - protein, 8 aa, Homo Sapiens
DRYGGQPL

SEQ ID NO: 71703 - protein, 8 aa, Homo Sapiens
DRYIFVSL

SEQ ID NO: 71704 - protein, 8 aa, Homo Sapiens
DRYLPDTL

SEQ ID NO: 71705 - protein, 8 aa, Homo Sapiens
DRYPNQTL

SEQ ID NO: 71706 - protein, 8 aa, Homo Sapiens
DRYYTPTI

SEQ ID NO: 71707 - protein, 8 aa, Homo Sapiens
DSAMHLAL

SEQ ID NO: 71708 - protein, 8 aa, Homo Sapiens
DSPLHKAL

SEQ ID NO: 71709 - protein, 8 aa, Homo Sapiens
DSVVRRQL

SEQ ID NO: 71710 - protein, 8 aa, Homo Sapiens
DTYSHQAL

SEQ ID NO: 71711 - protein, 8 aa, Homo Sapiens
DVAYHNSL

SEQ ID NO: 71712 - protein, 8 aa, Homo Sapiens
DVGVHCVL

SEQ ID NO: 71713 - protein, 8 aa, Homo Sapiens
DVTLHQAL

SEQ ID NO: 71714 - protein, 8 aa, Homo Sapiens
DYLRPIAL

SEQ ID NO: 71715 - protein, 8 aa, Homo Sapiens
EEFTHTTL

SEQ ID NO: 71716 - protein, 8 aa, Homo Sapiens
ENATHTQL

SEQ ID NO: 71717 - protein, 8 aa, Homo Sapiens
ENSLHRAL

SEQ ID NO: 71718 - protein, 8 aa, Homo Sapiens
ENVAHNAL

SEQ ID NO: 71719 - protein, 8 aa, Homo Sapiens
EPATHNAL

SEQ ID NO: 71720 - protein, 8 aa, Homo Sapiens
EQLEHCEL

SEQ ID NO: 71721 - protein, 8 aa, Homo Sapiens
EQTTHPEL

SEQ ID NO: 71722 - protein, 8 aa, Homo Sapiens
EQTYHAKL

SEQ ID NO: 71723 - protein, 8 aa, Homo Sapiens
EQVLHKQL

SEQ ID NO: 71724 - protein, 8 aa, Homo Sapiens
EQYEHASI

SEQ ID NO: 71725 - protein, 8 aa, Homo Sapiens
ERFSHVAM

SEQ ID NO: 71726 - protein, 8 aa, Homo Sapiens
ERIDHIKL

SEQ ID NO: 71727 - protein, 8 aa, Homo Sapiens
ERLEHPVL

SEQ ID NO: 71728 - protein, 8 aa, Homo Sapiens
ERMLRLSL

SEQ ID NO: 71729 - protein, 8 aa, Homo Sapiens
ERSIHDAL

SEQ ID NO: 71730 - protein, 8 aa, Homo Sapiens
ERVVHYEI

SEQ ID NO: 71731 - protein, 8 aa, Homo Sapiens
ERYFHHVL

SEQ ID NO: 71732 - protein, 8 aa, Homo Sapiens
ESTLHLVL

SEQ ID NO: 71733 - protein, 8 aa, Homo Sapiens
EVYAHAVL

SEQ ID NO: 71734 - protein, 8 aa, Homo Sapiens
FEAIHHEL

SEQ ID NO: 71735 - protein, 8 aa, Homo Sapiens
FEFVHALL

SEQ ID NO: 71736 - protein, 8 aa, Homo Sapiens
FEVEHECL

SEQ ID NO: 71737 - protein, 8 aa, Homo Sapiens
FQTIHKTI

SEQ ID NO: 71738 - protein, 8 aa, Homo Sapiens
FQVKRQVL

SEQ ID NO: 71739 - protein, 8 aa, Homo Sapiens
FRQIHKVL

SEQ ID NO: 71740 - protein, 8 aa, Homo Sapiens
FRVLHTAL

SEQ ID NO: 71741 - protein, 8 aa, Homo Sapiens
GRYIRSAL

SEQ ID NO: 71742 - protein, 8 aa, Homo Sapiens
HEIAHAVL

SEQ ID NO: 71743 - protein, 8 aa, Homo Sapiens
HETLHQSL

SEQ ID NO: 71744 - protein, 8 aa, Homo Sapiens
HEVLHHTL

SEQ ID NO: 71745 - protein, 8 aa, Homo Sapiens
HGIIHRDL

SEQ ID NO: 71746 - protein, 8 aa, Homo Sapiens
HGIVHRAL

SEQ ID NO: 71747 - protein, 8 aa, Homo Sapiens
HGIVHSDL

SEQ ID NO: 71748 - protein, 8 aa, Homo Sapiens
HGLIHNVL

SEQ ID NO: 71749 - protein, 8 aa, Homo Sapiens
HGYVHETL

SEQ ID NO: 71750 - protein, 8 aa, Homo Sapiens
HHYLRPSL

SEQ ID NO: 71751 - protein, 8 aa, Homo Sapiens
HMVVHRDL

SEQ ID NO: 71752 - protein, 8 aa, Homo Sapiens
HPAGHLVL

SEQ ID NO: 71753 - protein, 8 aa, Homo Sapiens
HPGSHTVL

SEQ ID NO: 71754 - protein, 8 aa, Homo Sapiens
HPGTHTVL

SEQ ID NO: 71755 - protein, 8 aa, Homo Sapiens
HPNVHFVL

SEQ ID NO: 71756 - protein, 8 aa, Homo Sapiens
HPVPHAAL

SEQ ID NO: 71757 - protein, 8 aa, Homo Sapiens
HQIIHTGL

SEQ ID NO: 71758 - protein, 8 aa, Homo Sapiens
HQVTRAVL

SEQ ID NO: 71759 - protein, 8 aa, Homo Sapiens
HRAFHLAL

SEQ ID NO: 71760 - protein, 8 aa, Homo Sapiens
HRAVREVL

SEQ ID NO: 71761 - protein, 8 aa, Homo Sapiens
HRFGGLVL

SEQ ID NO: 71762 - protein, 8 aa, Homo Sapiens
HRFIVNTL

SEQ ID NO: 71763 - protein, 8 aa, Homo Sapiens
HRGHHTFL

SEQ ID NO: 71764 - protein, 8 aa, Homo Sapiens
HRVIHRDI

SEQ ID NO: 71765 - protein, 8 aa, Homo Sapiens
HRVLHNSL

SEQ ID NO: 71766 - protein, 8 aa, Homo Sapiens
HRYYGKSL

SEQ ID NO: 71767 - protein, 8 aa, Homo Sapiens
HSVLHRAL

SEQ ID NO: 71768 - protein, 8 aa, Homo Sapiens
HSVVHALL

SEQ ID NO: 71769 - protein, 8 aa, Homo Sapiens
HVFHHSVL

SEQ ID NO: 71770 - protein, 8 aa, Homo Sapiens
HVVIHQSL

SEQ ID NO: 71771 - protein, 8 aa, Homo Sapiens
IEFQREAL

SEQ ID NO: 71772 - protein, 8 aa, Homo Sapiens
IEIIHEEL

SEQ ID NO: 71773 - protein, 8 aa, Homo Sapiens
IGTFHTSL

SEQ ID NO: 71774 - protein, 8 aa, Homo Sapiens
IGTTHVTL

SEQ ID NO: 71775 - protein, 8 aa, Homo Sapiens
IGVVHLVL

SEQ ID NO: 71776 - protein, 8 aa, Homo Sapiens
ILTTHTTL

SEQ ID NO: 71777 - protein, 8 aa, Homo Sapiens
IPHIHKSL

SEQ ID NO: 71778 - protein, 8 aa, Homo Sapiens
IPMIHAVL

SEQ ID NO: 71779 - protein, 8 aa, Homo Sapiens
IQAIHSTI

SEQ ID NO: 71780 - protein, 8 aa, Homo Sapiens
IQAVRRSL

SEQ ID NO: 71781 - protein, 8 aa, Homo Sapiens
IQILHQVL

SEQ ID NO: 71782 - protein, 8 aa, Homo Sapiens
IQSIRMGM

SEQ ID NO: 71783 - protein, 8 aa, Homo Sapiens
IQVVREEL

SEQ ID NO: 71784 - protein, 8 aa, Homo Sapiens
IRMTHNLL

SEQ ID NO: 71785 - protein, 8 aa, Homo Sapiens
IRNIGKTL

SEQ ID NO: 71786 - protein, 8 aa, Homo Sapiens
IRQKALKL

SEQ ID NO: 71787 - protein, 8 aa, Homo Sapiens
KEAIHSQL

SEQ ID NO: 71788 - protein, 8 aa, Homo Sapiens
LAITHHVL

SEQ ID NO: 71789 - protein, 8 aa, Homo Sapiens
LATLHTAL

SEQ ID NO: 71790 - protein, 8 aa, Homo Sapiens
LAVLHTVL

SEQ ID NO: 71791 - protein, 8 aa, Homo Sapiens
LDATHQQL

SEQ ID NO: 71792 - protein, 8 aa, Homo Sapiens
LDVIHEVL

SEQ ID NO: 71793 - protein, 8 aa, Homo Sapiens
LEAQHQAL

SEQ ID NO: 71794 - protein, 8 aa, Homo Sapiens
LEAQHRSL

SEQ ID NO: 71795 - protein, 8 aa, Homo Sapiens
LEAVHDLL

SEQ ID NO: 71796 - protein, 8 aa, Homo Sapiens
LEAVHDVL

SEQ ID NO: 71797 - protein, 8 aa, Homo Sapiens
LEETHKAL

SEQ ID NO: 71798 - protein, 8 aa, Homo Sapiens
LEGRHAEL

SEQ ID NO: 71799 - protein, 8 aa, Homo Sapiens
LETGHRAL

SEQ ID NO: 71800 - protein, 8 aa, Homo Sapiens
LGFTHHCL

SEQ ID NO: 71801 - protein, 8 aa, Homo Sapiens
LNVLHSEL

SEQ ID NO: 71802 - protein, 8 aa, Homo Sapiens
LPAEHGVL

SEQ ID NO: 71803 - protein, 8 aa, Homo Sapiens
LPASHMEL

SEQ ID NO: 71804 - protein, 8 aa, Homo Sapiens
LPNIHPEL

SEQ ID NO: 71805 - protein, 8 aa, Homo Sapiens
LPSIHSLL

SEQ ID NO: 71806 - protein, 8 aa, Homo Sapiens
LQAERRAL

SEQ ID NO: 71807 - protein, 8 aa, Homo Sapiens
LQALHDAL

SEQ ID NO: 71808 - protein, 8 aa, Homo Sapiens
LQAQRENL

SEQ ID NO: 71809 - protein, 8 aa, Homo Sapiens
LQASHSEL

SEQ ID NO: 71810 - protein, 8 aa, Homo Sapiens
LQAVRQAL

SEQ ID NO: 71811 - protein, 8 aa, Homo Sapiens
LQHIRNSL

SEQ ID NO: 71812 - protein, 8 aa, Homo Sapiens
LQLWNGLL

SEQ ID NO: 71813 - protein, 8 aa, Homo Sapiens
LQNAHGEL

SEQ ID NO: 71814 - protein, 8 aa, Homo Sapiens
LQNEHRVL

SEQ ID NO: 71815 - protein, 8 aa, Homo Sapiens
LQRIHAEI

SEQ ID NO: 71816 - protein, 8 aa, Homo Sapiens
LQSRHVAL

SEQ ID NO: 71817 - protein, 8 aa, Homo Sapiens
LQVAHEEI

SEQ ID NO: 71818 - protein, 8 aa, Homo Sapiens
LQVLHRKL

SEQ ID NO: 71819 - protein, 8 aa, Homo Sapiens
LRFQSSAV

SEQ ID NO: 71820 - protein, 8 aa, Homo Sapiens
LRHLGRTL

SEQ ID NO: 71821 - protein, 8 aa, Homo Sapiens
LRLAHECL

SEQ ID NO: 71822 - protein, 8 aa, Homo Sapiens
LRLEHTKL

SEQ ID NO: 71823 - protein, 8 aa, Homo Sapiens
LRLPGRKL

SEQ ID NO: 71824 - protein, 8 aa, Homo Sapiens
LRQHIAEL

SEQ ID NO: 71825 - protein, 8 aa, Homo Sapiens
LRTMHHLL

SEQ ID NO: 71826 - protein, 8 aa, Homo Sapiens
LRVEHEKL

SEQ ID NO: 71827 - protein, 8 aa, Homo Sapiens
MEAEHNTL

SEQ ID NO: 71828 - protein, 8 aa, Homo Sapiens
MEALHLHL

SEQ ID NO: 71829 - protein, 8 aa, Homo Sapiens
MEALHYML

SEQ ID NO: 71830 - protein, 8 aa, Homo Sapiens
MENIHSEM

SEQ ID NO: 71831 - protein, 8 aa, Homo Sapiens
MEVVHKEL

SEQ ID NO: 71832 - protein, 8 aa, Homo Sapiens
MKMTHSEL

SEQ ID NO: 71833 - protein, 8 aa, Homo Sapiens
MNGIHSEL

SEQ ID NO: 71834 - protein, 8 aa, Homo Sapiens
MPTVHYEF

SEQ ID NO: 71835 - protein, 8 aa, Homo Sapiens
MQIKHELL

SEQ ID NO: 71836 - protein, 8 aa, Homo Sapiens
MRHLISSL

SEQ ID NO: 71837 - protein, 8 aa, Homo Sapiens
MRLLPRLL

SEQ ID NO: 71838 - protein, 8 aa, Homo Sapiens
MRLTPRAL

SEQ ID NO: 71839 - protein, 8 aa, Homo Sapiens
MRQKAVSL

SEQ ID NO: 71840 - protein, 8 aa, Homo Sapiens
MRVERSTL

SEQ ID NO: 71841 - protein, 8 aa, Homo Sapiens
MRYLGKVL

SEQ ID NO: 71842 - protein, 8 aa, Homo Sapiens
MSARHMAL

SEQ ID NO: 71843 - protein, 8 aa, Homo Sapiens
NALAHHVL

SEQ ID NO: 71844 - protein, 8 aa, Homo Sapiens
NAVLHKVL

SEQ ID NO: 71845 - protein, 8 aa, Homo Sapiens
NDGTHMAL

SEQ ID NO: 71846 - protein, 8 aa, Homo Sapiens
NEFLRSGL

SEQ ID NO: 71847 - protein, 8 aa, Homo Sapiens
NERLHSEL

SEQ ID NO: 71848 - protein, 8 aa, Homo Sapiens
NESTRSVL

SEQ ID NO: 71849 - protein, 8 aa, Homo Sapiens
NETYHLTL

SEQ ID NO: 71850 - protein, 8 aa, Homo Sapiens
NEVLHQEL

SEQ ID NO: 71851 - protein, 8 aa, Homo Sapiens
NEVQRTML

SEQ ID NO: 71852 - protein, 8 aa, Homo Sapiens
NEVVRSDL

SEQ ID NO: 71853 - protein, 8 aa, Homo Sapiens
NGFMHHVL

SEQ ID NO: 71854 - protein, 8 aa, Homo Sapiens
NGSLHQEL

SEQ ID NO: 71855 - protein, 8 aa, Homo Sapiens
NHTTHMSL

SEQ ID NO: 71856 - protein, 8 aa, Homo Sapiens
NKTIHAEL

SEQ ID NO: 71857 - protein, 8 aa, Homo Sapiens
NMTVHSAL

SEQ ID NO: 71858 - protein, 8 aa, Homo Sapiens
NQIIHRDL

SEQ ID NO: 71859 - protein, 8 aa, Homo Sapiens
NQIVHRDI

SEQ ID NO: 71860 - protein, 8 aa, Homo Sapiens
NQLLKPTL

SEQ ID NO: 71861 - protein, 8 aa, Homo Sapiens
NQLTHTDL

SEQ ID NO: 71862 - protein, 8 aa, Homo Sapiens
NQTPHLLL

SEQ ID NO: 71863 - protein, 8 aa, Homo Sapiens
NQTVHRLL

SEQ ID NO: 71864 - protein, 8 aa, Homo Sapiens
NQVAHLEL

SEQ ID NO: 71865 - protein, 8 aa, Homo Sapiens
NQVIHWEI

SEQ ID NO: 71866 - protein, 8 aa, Homo Sapiens
NQYLRVSL

SEQ ID NO: 71867 - protein, 8 aa, Homo Sapiens
NRALRTDL

SEQ ID NO: 71868 - protein, 8 aa, Homo Sapiens
NRAPSLTL

SEQ ID NO: 71869 - protein, 8 aa, Homo Sapiens
NRAVVGVV

SEQ ID NO: 71870 - protein, 8 aa, Homo Sapiens
NRFQIATV

SEQ ID NO: 71871 - protein, 8 aa, Homo Sapiens
NRFVGILM

SEQ ID NO: 71872 - protein, 8 aa, Homo Sapiens
NRFVRTVL

SEQ ID NO: 71873 - protein, 8 aa, Homo Sapiens
NRFYHEEL

SEQ ID NO: 71874 - protein, 8 aa, Homo Sapiens
NRHLHFTL

SEQ ID NO: 71875 - protein, 8 aa, Homo Sapiens
NRIIHRDL

SEQ ID NO: 71876 - protein, 8 aa, Homo Sapiens
NRIVHISV

SEQ ID NO: 71877 - protein, 8 aa, Homo Sapiens
NRIVIRGL

SEQ ID NO: 71878 - protein, 8 aa, Homo Sapiens
NRKEGLRL

SEQ ID NO: 71879 - protein, 8 aa, Homo Sapiens
NRLIGQIV

SEQ ID NO: 71880 - protein, 8 aa, Homo Sapiens
NRLIPTEL

SEQ ID NO: 71881 - protein, 8 aa, Homo Sapiens
NRLISQIV

SEQ ID NO: 71882 - protein, 8 aa, Homo Sapiens
NRLMGRTL

SEQ ID NO: 71883 - protein, 8 aa, Homo Sapiens
NRLQWVQL

SEQ ID NO: 71884 - protein, 8 aa, Homo Sapiens
NRLSVSSL

SEQ ID NO: 71885 - protein, 8 aa, Homo Sapiens
NRLTHRLL

SEQ ID NO: 71886 - protein, 8 aa, Homo Sapiens
NRLTWIVV

SEQ ID NO: 71887 - protein, 8 aa, Homo Sapiens
NRMIKSEL

SEQ ID NO: 71888 - protein, 8 aa, Homo Sapiens
NRMTHKLL

SEQ ID NO: 71889 - protein, 8 aa, Homo Sapiens
NRRYHPAL

SEQ ID NO: 71890 - protein, 8 aa, Homo Sapiens
NRSIHRVF

SEQ ID NO: 71891 - protein, 8 aa, Homo Sapiens
NRVIHRDL

SEQ ID NO: 71892 - protein, 8 aa, Homo Sapiens
NRVKTEAL

SEQ ID NO: 71893 - protein, 8 aa, Homo Sapiens
NRVLHQEL

SEQ ID NO: 71894 - protein, 8 aa, Homo Sapiens
NRVQNMAL

SEQ ID NO: 71895 - protein, 8 aa, Homo Sapiens
NRVRPLVL

SEQ ID NO: 71896 - protein, 8 aa, Homo Sapiens
NRYIANTV

SEQ ID NO: 71897 - protein, 8 aa, Homo Sapiens
NRYPASSL

SEQ ID NO: 71898 - protein, 8 aa, Homo Sapiens
NRYPNIEL

SEQ ID NO: 71899 - protein, 8 aa, Homo Sapiens
NRYSTVSL

SEQ ID NO: 71900 - protein, 8 aa, Homo Sapiens
NRYVGRTF

SEQ ID NO: 71901 - protein, 8 aa, Homo Sapiens
NRYVKPGL

SEQ ID NO: 71902 - protein, 8 aa, Homo Sapiens
NSFTHEAL

SEQ ID NO: 71903 - protein, 8 aa, Homo Sapiens
NSVVHKVL

SEQ ID NO: 71904 - protein, 8 aa, Homo Sapiens
NVAQHTSL

SEQ ID NO: 71905 - protein, 8 aa, Homo Sapiens
NVATHSTL

SEQ ID NO: 71906 - protein, 8 aa, Homo Sapiens
NVTNHGAL

SEQ ID NO: 71907 - protein, 8 aa, Homo Sapiens
PFCHSELI

SEQ ID NO: 71908 - protein, 8 aa, Homo Sapiens
QGVVHRDL

SEQ ID NO: 71909 - protein, 8 aa, Homo Sapiens
QQGAHSAL

SEQ ID NO: 71910 - protein, 8 aa, Homo Sapiens
QQIQRSSL

SEQ ID NO: 71911 - protein, 8 aa, Homo Sapiens
QQQQHQAL

SEQ ID NO: 71912 - protein, 8 aa, Homo Sapiens
QQVVRIAL

SEQ ID NO: 71913 - protein, 8 aa, Homo Sapiens
QRFARMEL

SEQ ID NO: 71914 - protein, 8 aa, Homo Sapiens
QRFSHQTL

SEQ ID NO: 71915 - protein, 8 aa, Homo Sapiens
QRIDRLAL

SEQ ID NO: 71916 - protein, 8 aa, Homo Sapiens
QRIIRNAL

SEQ ID NO: 71917 - protein, 8 aa, Homo Sapiens
RDVVHSTL

SEQ ID NO: 71918 - protein, 8 aa, Homo Sapiens
RPTVHQTL

SEQ ID NO: 71919 - protein, 8 aa, Homo Sapiens
RPYVHKIL

SEQ ID NO: 71920 - protein, 8 aa, Homo Sapiens
RQLERSAL

SEQ ID NO: 71921 - protein, 8 aa, Homo Sapiens
SFSKAFGQ

SEQ ID NO: 71922 - protein, 8 aa, Homo Sapiens
SPAGHSFL

SEQ ID NO: 71923 - protein, 8 aa, Homo Sapiens
SPTVHLGL

SEQ ID NO: 71924 - protein, 8 aa, Homo Sapiens
SPVVHQSL

SEQ ID NO: 71925 - protein, 8 aa, Homo Sapiens
SPVVHSVL

SEQ ID NO: 71926 - protein, 8 aa, Homo Sapiens
SQFSHMSL

SEQ ID NO: 71927 - protein, 8 aa, Homo Sapiens
SQFTRNAL

SEQ ID NO: 71928 - protein, 8 aa, Homo Sapiens
SQHLHEVL

SEQ ID NO: 71929 - protein, 8 aa, Homo Sapiens
SQLRVAKV

SEQ ID NO: 71930 - protein, 8 aa, Homo Sapiens
SRALRQAL

SEQ ID NO: 71931 - protein, 8 aa, Homo Sapiens
SRHLHASL

SEQ ID NO: 71932 - protein, 8 aa, Homo Sapiens
SRICHREL

SEQ ID NO: 71933 - protein, 8 aa, Homo Sapiens
SRNLRSSL

SEQ ID NO: 71934 - protein, 8 aa, Homo Sapiens
SRTNRPPL

SEQ ID NO: 71935 - protein, 8 aa, Homo Sapiens
SRVIRNAL

SEQ ID NO: 71936 - protein, 8 aa, Homo Sapiens
SRVLRTSL

SEQ ID NO: 71937 - protein, 8 aa, Homo Sapiens
SRWAGRAL

SEQ ID NO: 71938 - protein, 8 aa, Homo Sapiens
SRYLRAVL

SEQ ID NO: 71939 - protein, 8 aa, Homo Sapiens
SRYTGASL

SEQ ID NO: 71940 - protein, 8 aa, Homo Sapiens
SSALHQTL

SEQ ID NO: 71941 - protein, 8 aa, Homo Sapiens
SSVSHSVL

SEQ ID NO: 71942 - protein, 8 aa, Homo Sapiens
TAIRHHVL

SEQ ID NO: 71943 - protein, 8 aa, Homo Sapiens
TEAVHTML

SEQ ID NO: 71944 - protein, 8 aa, Homo Sapiens
TEELAYLK

SEQ ID NO: 71945 - protein, 8 aa, Homo Sapiens
TGWVHDVL

SEQ ID NO: 71946 - protein, 8 aa, Homo Sapiens
THTRHYEL

SEQ ID NO: 71947 - protein, 8 aa, Homo Sapiens
TQAIHDVF

SEQ ID NO: 71948 - protein, 8 aa, Homo Sapiens
TQFVHHAL

SEQ ID NO: 71949 - protein, 8 aa, Homo Sapiens
TQQLHPVL

SEQ ID NO: 71950 - protein, 8 aa, Homo Sapiens
TQTAHTEL

SEQ ID NO: 71951 - protein, 8 aa, Homo Sapiens
TQTRHGVL

SEQ ID NO: 71952 - protein, 8 aa, Homo Sapiens
TRAIVRAL

SEQ ID NO: 71953 - protein, 8 aa, Homo Sapiens
TRIIHRLL

SEQ ID NO: 71954 - protein, 8 aa, Homo Sapiens
TRILRQTL

SEQ ID NO: 71955 - protein, 8 aa, Homo Sapiens
TRLKSRVL

SEQ ID NO: 71956 - protein, 8 aa, Homo Sapiens
TRLVRGEL

SEQ ID NO: 71957 - protein, 8 aa, Homo Sapiens
TRRVHPAL

SEQ ID NO: 71958 - protein, 8 aa, Homo Sapiens
TRVPHSKL

SEQ ID NO: 71959 - protein, 8 aa, Homo Sapiens
VAVIHQSL

SEQ ID NO: 71960 - protein, 8 aa, Homo Sapiens
VEALHEVL

SEQ ID NO: 71961 - protein, 8 aa, Homo Sapiens
VEASHLAL

SEQ ID NO: 71962 - protein, 8 aa, Homo Sapiens
VEMHHEAL

SEQ ID NO: 71963 - protein, 8 aa, Homo Sapiens
VPFNHEIL

SEQ ID NO: 71964 - protein, 8 aa, Homo Sapiens
VPHFHHEL

SEQ ID NO: 71965 - protein, 8 aa, Homo Sapiens
VPNVHGAL

SEQ ID NO: 71966 - protein, 8 aa, Homo Sapiens
VQATRTSL

SEQ ID NO: 71967 - protein, 8 aa, Homo Sapiens
VQEIHQVL

SEQ ID NO: 71968 - protein, 8 aa, Homo Sapiens
VQNSHTEL

SEQ ID NO: 71969 - protein, 8 aa, Homo Sapiens
VQVAHEKL

SEQ ID NO: 71970 - protein, 8 aa, Homo Sapiens
VQYERPCL

SEQ ID NO: 71971 - protein, 8 aa, Homo Sapiens
VRFKHRYL

SEQ ID NO: 71972 - protein, 8 aa, Homo Sapiens
VRLIMDSL

SEQ ID NO: 71973 - protein, 8 aa, Homo Sapiens
VRVGHSEL

SEQ ID NO: 71974 - protein, 8 aa, Homo Sapiens
VRVKHKLL

SEQ ID NO: 71975 - protein, 8 aa, Homo Sapiens
VRWFHRDL

SEQ ID NO: 71976 - protein, 8 aa, Homo Sapiens
VRYAHEKL

SEQ ID NO: 71977 - protein, 8 aa, Homo Sapiens
VSPLHRVL

SEQ ID NO: 71978 - protein, 8 aa, Homo Sapiens
YEFVHHAL

SEQ ID NO: 71979 - protein, 8 aa, Homo Sapiens
YEVHHQKL

SEQ ID NO: 71980 - protein, 8 aa, Homo Sapiens
YQAAHCVL

SEQ ID NO: 71981 - protein, 8 aa, Homo Sapiens
YQAQHGAL

SEQ ID NO: 71982 - protein, 8 aa, Homo Sapiens
YQFLHHTL

SEQ ID NO: 71983 - protein, 8 aa, Homo Sapiens
YQILHECL

SEQ ID NO: 71984 - protein, 8 aa, Homo Sapiens
YQVLRSVL

SEQ ID NO: 71985 - protein, 8 aa, Homo Sapiens
YQYMHETI

SEQ ID NO: 71986 - protein, 8 aa, Homo Sapiens
YRATHRLL

SEQ ID NO: 71987 - protein, 8 aa, Homo Sapiens
YRFSRAAL

SEQ ID NO: 71988 - protein, 8 aa, Homo Sapiens
YSVEHNQL

SEQ ID NO: 71989 - protein, 9 aa, Homo Sapiens
AAKNLANTI

SEQ ID NO: 71990 - protein, 9 aa, Homo Sapiens
AAPAYSRAL

SEQ ID NO: 71991 - protein, 9 aa, Homo Sapiens
ADRERKVAL

SEQ ID NO: 71992 - protein, 9 aa, Homo Sapiens
ADYKRSSSL

SEQ ID NO: 71993 - protein, 9 aa, Homo Sapiens
AELERNVAL

SEQ ID NO: 71994 - protein, 9 aa, Homo Sapiens
AIPMIHAVL

SEQ ID NO: 71995 - protein, 9 aa, Homo Sapiens
AIQVVRSAL

SEQ ID NO: 71996 - protein, 9 aa, Homo Sapiens
APFLRNVEL

SEQ ID NO: 71997 - protein, 9 aa, Homo Sapiens
APLQRSQSL

SEQ ID NO: 71998 - protein, 9 aa, Homo Sapiens
ARFSARSSL

SEQ ID NO: 71999 - protein, 9 aa, Homo Sapiens
ARFSGNLLV

SEQ ID NO: 72000 - protein, 9 aa, Homo Sapiens
ARISRSISL

SEQ ID NO: 72001 - protein, 9 aa, Homo Sapiens
ARLDHKFDL

SEQ ID NO: 72002 - protein, 9 aa, Homo Sapiens
ARLEGRSSL

SEQ ID NO: 72003 - protein, 9 aa, Homo Sapiens
ARLQTALLV

SEQ ID NO: 72004 - protein, 9 aa, Homo Sapiens
ARLSRSSAL

SEQ ID NO: 72005 - protein, 9 aa, Homo Sapiens
ARVGSRAAL

SEQ ID NO: 72006 - protein, 9 aa, Homo Sapiens
ARYAVRRSL

SEQ ID NO: 72007 - protein, 9 aa, Homo Sapiens
AVITRAPVL

SEQ ID NO: 72008 - protein, 9 aa, Homo Sapiens
CRFEGQFSI

SEQ ID NO: 72009 - protein, 9 aa, Homo Sapiens
CRLEIRSSL

SEQ ID NO: 72010 - protein, 9 aa, Homo Sapiens
CRLLRIDEL

SEQ ID NO: 72011 - protein, 9 aa, Homo Sapiens
CRVAVRRAL

SEQ ID NO: 72012 - protein, 9 aa, Homo Sapiens
CRYNLPIIL

SEQ ID NO: 72013 - protein, 9 aa, Homo Sapiens
CRYQGPVLL

SEQ ID NO: 72014 - protein, 9 aa, Homo Sapiens
CRYSKGLVL

SEQ ID NO: 72015 - protein, 9 aa, Homo Sapiens
DAAIRVWSL

SEQ ID NO: 72016 - protein, 9 aa, Homo Sapiens
DAFAKSLAL

SEQ ID NO: 72017 - protein, 9 aa, Homo Sapiens
DAFERIDSF

SEQ ID NO: 72018 - protein, 9 aa, Homo Sapiens
DAFVRLIAL

SEQ ID NO: 72019 - protein, 9 aa, Homo Sapiens
DAHLRPTSL

SEQ ID NO: 72020 - protein, 9 aa, Homo Sapiens
DALCRITAL

SEQ ID NO: 72021 - protein, 9 aa, Homo Sapiens
DALQRSVQL

SEQ ID NO: 72022 - protein, 9 aa, Homo Sapiens
DANLRKNEL

SEQ ID NO: 72023 - protein, 9 aa, Homo Sapiens
DAQSRPTSL

SEQ ID NO: 72024 - protein, 9 aa, Homo Sapiens
DAVIRNNTL

SEQ ID NO: 72025 - protein, 9 aa, Homo Sapiens
DAVKREAAL

SEQ ID NO: 72026 - protein, 9 aa, Homo Sapiens
DAYALNHTL

SEQ ID NO: 72027 - protein, 9 aa, Homo Sapiens
DAYELKHAL

SEQ ID NO: 72028 - protein, 9 aa, Homo Sapiens
DAYVRRMAA

SEQ ID NO: 72029 - protein, 9 aa, Homo Sapiens
DCYTRIWSL

SEQ ID NO: 72030 - protein, 9 aa, Homo Sapiens
DDARRLTVM

SEQ ID NO: 72031 - protein, 9 aa, Homo Sapiens
DDFERISEL

SEQ ID NO: 72032 - protein, 9 aa, Homo Sapiens
DDFRRADCL

SEQ ID NO: 72033 - protein, 9 aa, Homo Sapiens
DDLKRATEL

SEQ ID NO: 72034 - protein, 9 aa, Homo Sapiens
DEALRRSDL

SEQ ID NO: 72035 - protein, 9 aa, Homo Sapiens
DEATRLMAL

SEQ ID NO: 72036 - protein, 9 aa, Homo Sapiens
DEFCRKFRL

SEQ ID NO: 72037 - protein, 9 aa, Homo Sapiens
DEFLRISTA

SEQ ID NO: 72038 - protein, 9 aa, Homo Sapiens
DEFQRGDQL

SEQ ID NO: 72039 - protein, 9 aa, Homo Sapiens
DEHAREMCL

SEQ ID NO: 72040 - protein, 9 aa, Homo Sapiens
DEKLRLQQL

SEQ ID NO: 72041 - protein, 9 aa, Homo Sapiens
DELERITKL

SEQ ID NO: 72042 - protein, 9 aa, Homo Sapiens
DELIRSIEL

SEQ ID NO: 72043 - protein, 9 aa, Homo Sapiens
DELKRSVAL

SEQ ID NO: 72044 - protein, 9 aa, Homo Sapiens
DELLRIVSI

SEQ ID NO: 72045 - protein, 9 aa, Homo Sapiens
DELLRVTDL

SEQ ID NO: 72046 - protein, 9 aa, Homo Sapiens
DELRRAGSL

SEQ ID NO: 72047 - protein, 9 aa, Homo Sapiens
DELRRHLEL

SEQ ID NO: 72048 - protein, 9 aa, Homo Sapiens
DEQERCITI

SEQ ID NO: 72049 - protein, 9 aa, Homo Sapiens
DEQVRLYKL

SEQ ID NO: 72050 - protein, 9 aa, Homo Sapiens
DERLRIFAL

SEQ ID NO: 72051 - protein, 9 aa, Homo Sapiens
DERLRINSL

SEQ ID NO: 72052 - protein, 9 aa, Homo Sapiens
DEVERTQTL

SEQ ID NO: 72053 - protein, 9 aa, Homo Sapiens
DEVERVITI

SEQ ID NO: 72054 - protein, 9 aa, Homo Sapiens
DEVLRRVTL

SEQ ID NO: 72055 - protein, 9 aa, Homo Sapiens
DEVQRRLQL

SEQ ID NO: 72056 - protein, 9 aa, Homo Sapiens
DEVTRNLSL

SEQ ID NO: 72057 - protein, 9 aa, Homo Sapiens
DEYEKLQVL

SEQ ID NO: 72058 - protein, 9 aa, Homo Sapiens
DGFLRCLSL

SEQ ID NO: 72059 - protein, 9 aa, Homo Sapiens
DGMERPSSL

SEQ ID NO: 72060 - protein, 9 aa, Homo Sapiens
DGSLRVTAL

SEQ ID NO: 72061 - protein, 9 aa, Homo Sapiens
DGVKRTTPL

SEQ ID NO: 72062 - protein, 9 aa, Homo Sapiens
DGYLKTSAL

SEQ ID NO: 72063 - protein, 9 aa, Homo Sapiens
DGYRRILNL

SEQ ID NO: 72064 - protein, 9 aa, Homo Sapiens
DGYVRIHYF

SEQ ID NO: 72065 - protein, 9 aa, Homo Sapiens
DHFASVHSV

SEQ ID NO: 72066 - protein, 9 aa, Homo Sapiens
DHFIRTLSL

SEQ ID NO: 72067 - protein, 9 aa, Homo Sapiens
DHFSRPVGL

SEQ ID NO: 72068 - protein, 9 aa, Homo Sapiens
DHIQRIMTL

SEQ ID NO: 72069 - protein, 9 aa, Homo Sapiens
DHIRRQTSL

SEQ ID NO: 72070 - protein, 9 aa, Homo Sapiens
DHLKRVKDL

SEQ ID NO: 72071 - protein, 9 aa, Homo Sapiens
DHYQRILQL

SEQ ID NO: 72072 - protein, 9 aa, Homo Sapiens
DHYQRQRVL

SEQ ID NO: 72073 - protein, 9 aa, Homo Sapiens
DKLIRISAL

SEQ ID NO: 72074 - protein, 9 aa, Homo Sapiens
DKLKREIEL

SEQ ID NO: 72075 - protein, 9 aa, Homo Sapiens
DKYERLVKL

SEQ ID NO: 72076 - protein, 9 aa, Homo Sapiens
DKYLHTNCL

SEQ ID NO: 72077 - protein, 9 aa, Homo Sapiens
DLEERKNSL

SEQ ID NO: 72078 - protein, 9 aa, Homo Sapiens
DLYERQVCL

SEQ ID NO: 72079 - protein, 9 aa, Homo Sapiens
DLYTRFDTL

SEQ ID NO: 72080 - protein, 9 aa, Homo Sapiens
DLYTRTTNL

SEQ ID NO: 72081 - protein, 9 aa, Homo Sapiens
DMFYRNWAL

SEQ ID NO: 72082 - protein, 9 aa, Homo Sapiens
DMLERAVSV

SEQ ID NO: 72083 - protein, 9 aa, Homo Sapiens
DMLERECTL

SEQ ID NO: 72084 - protein, 9 aa, Homo Sapiens
DMLVKVNAL

SEQ ID NO: 72085 - protein, 9 aa, Homo Sapiens
DMYLKLVQL

SEQ ID NO: 72086 - protein, 9 aa, Homo Sapiens
DMYNRMTSA

SEQ ID NO: 72087 - protein, 9 aa, Homo Sapiens
DNARRLTGF

SEQ ID NO: 72088 - protein, 9 aa, Homo Sapiens
DNAVRNAAL

SEQ ID NO: 72089 - protein, 9 aa, Homo Sapiens
DNLLRLKEL

SEQ ID NO: 72090 - protein, 9 aa, Homo Sapiens
DNMPRILSL

SEQ ID NO: 72091 - protein, 9 aa, Homo Sapiens
DNQERFNSL

SEQ ID NO: 72092 - protein, 9 aa, Homo Sapiens
DNTVRIISL

SEQ ID NO: 72093 - protein, 9 aa, Homo Sapiens
DNVERADAL

SEQ ID NO: 72094 - protein, 9 aa, Homo Sapiens
DNVIRIYSL

SEQ ID NO: 72095 - protein, 9 aa, Homo Sapiens
DNYVRETKL

SEQ ID NO: 72096 - protein, 9 aa, Homo Sapiens
DNYVRTSEI

SEQ ID NO: 72097 - protein, 9 aa, Homo Sapiens
DPYLRSLEL

SEQ ID NO: 72098 - protein, 9 aa, Homo Sapiens
DQASRLQSL

SEQ ID NO: 72099 - protein, 9 aa, Homo Sapiens
DQAVRTMEI

SEQ ID NO: 72100 - protein, 9 aa, Homo Sapiens
DQDVRHLAL

SEQ ID NO: 72101 - protein, 9 aa, Homo Sapiens
DQFERIKTL

SEQ ID NO: 72102 - protein, 9 aa, Homo Sapiens
DQFQKVLSL

SEQ ID NO: 72103 - protein, 9 aa, Homo Sapiens
DQFVRGEVL

SEQ ID NO: 72104 - protein, 9 aa, Homo Sapiens
DQIIRLEKL

SEQ ID NO: 72105 - protein, 9 aa, Homo Sapiens
DQISHRASL

SEQ ID NO: 72106 - protein, 9 aa, Homo Sapiens
DQKERDVIM

SEQ ID NO: 72107 - protein, 9 aa, Homo Sapiens
DQLLRNNDL

SEQ ID NO: 72108 - protein, 9 aa, Homo Sapiens
DQLMRQLDL

SEQ ID NO: 72109 - protein, 9 aa, Homo Sapiens
DQLVRIAKV

SEQ ID NO: 72110 - protein, 9 aa, Homo Sapiens
DQMMRAIAM

SEQ ID NO: 72111 - protein, 9 aa, Homo Sapiens
DQMQRKLTL

SEQ ID NO: 72112 - protein, 9 aa, Homo Sapiens
DQMSRLAKL

SEQ ID NO: 72113 - protein, 9 aa, Homo Sapiens
DQQVRYNAL

SEQ ID NO: 72114 - protein, 9 aa, Homo Sapiens
DQRERLAPF

SEQ ID NO: 72115 - protein, 9 aa, Homo Sapiens
DQTIRIHGL

SEQ ID NO: 72116 - protein, 9 aa, Homo Sapiens
DQVIHSNPA

SEQ ID NO: 72117 - protein, 9 aa, Homo Sapiens
DQVKRYYSV

SEQ ID NO: 72118 - protein, 9 aa, Homo Sapiens
DQVLRCSKI

SEQ ID NO: 72119 - protein, 9 aa, Homo Sapiens
DQVSRLVTI

SEQ ID NO: 72120 - protein, 9 aa, Homo Sapiens
DQVVKTIGL

SEQ ID NO: 72121 - protein, 9 aa, Homo Sapiens
DQYKRETIL

SEQ ID NO: 72122 - protein, 9 aa, Homo Sapiens
DRAFHFTAM

SEQ ID NO: 72123 - protein, 9 aa, Homo Sapiens
DRAKVILKP

SEQ ID NO: 72124 - protein, 9 aa, Homo Sapiens
DRALRSFKL

SEQ ID NO: 72125 - protein, 9 aa, Homo Sapiens
DRANRFEYL

SEQ ID NO: 72126 - protein, 9 aa, Homo Sapiens
DRAPAQPAM

SEQ ID NO: 72127 - protein, 9 aa, Homo Sapiens
DRCDQPLTL

SEQ ID NO: 72128 - protein, 9 aa, Homo Sapiens
DRCSIHLQL

SEQ ID NO: 72129 - protein, 9 aa, Homo Sapiens
DRDRRGPPL

SEQ ID NO: 72130 - protein, 9 aa, Homo Sapiens
DRDYRREVM

SEQ ID NO: 72131 - protein, 9 aa, Homo Sapiens
DRENRRISI

SEQ ID NO: 72132 - protein, 9 aa, Homo Sapiens
DRFARVLKI

SEQ ID NO: 72133 - protein, 9 aa, Homo Sapiens
DRFDFVHDL

SEQ ID NO: 72134 - protein, 9 aa, Homo Sapiens
DRFDGYIFL

SEQ ID NO: 72135 - protein, 9 aa, Homo Sapiens
DRFDGYVFL

SEQ ID NO: 72136 - protein, 9 aa, Homo Sapiens
DRFDRDRPL

SEQ ID NO: 72137 - protein, 9 aa, Homo Sapiens
DRFEFPEQL

SEQ ID NO: 72138 - protein, 9 aa, Homo Sapiens
DRFEKTNEM

SEQ ID NO: 72139 - protein, 9 aa, Homo Sapiens
DRFENQVDM

SEQ ID NO: 72140 - protein, 9 aa, Homo Sapiens
DRFERDTRV

SEQ ID NO: 72141 - protein, 9 aa, Homo Sapiens
DRFERLVEL

SEQ ID NO: 72142 - protein, 9 aa, Homo Sapiens
DRFGGALDA

SEQ ID NO: 72143 - protein, 9 aa, Homo Sapiens
DRFHKQEEL

SEQ ID NO: 72144 - protein, 9 aa, Homo Sapiens
DRFINGSAL

SEQ ID NO: 72145 - protein, 9 aa, Homo Sapiens
DRFKESLTL

SEQ ID NO: 72146 - protein, 9 aa, Homo Sapiens
DRFKSHPSL

SEQ ID NO: 72147 - protein, 9 aa, Homo Sapiens
DRFLKVYDL

SEQ ID NO: 72148 - protein, 9 aa, Homo Sapiens
DRFLRKITI

SEQ ID NO: 72149 - protein, 9 aa, Homo Sapiens
DRFLRQLDF

SEQ ID NO: 72150 - protein, 9 aa, Homo Sapiens
DRFLSKMKV

SEQ ID NO: 72151 - protein, 9 aa, Homo Sapiens
DRFLSRTFL

SEQ ID NO: 72152 - protein, 9 aa, Homo Sapiens
DRFLSSMSV

SEQ ID NO: 72153 - protein, 9 aa, Homo Sapiens
DRFLWSQQA

SEQ ID NO: 72154 - protein, 9 aa, Homo Sapiens
DRFNGVSEA

SEQ ID NO: 72155 - protein, 9 aa, Homo Sapiens
DRFQAEGSL

SEQ ID NO: 72156 - protein, 9 aa, Homo Sapiens
DRFQAHSKL

SEQ ID NO: 72157 - protein, 9 aa, Homo Sapiens
DRFQPNMTL

SEQ ID NO: 72158 - protein, 9 aa, Homo Sapiens
DRFTKSISI

SEQ ID NO: 72159 - protein, 9 aa, Homo Sapiens
DRHERITKL

SEQ ID NO: 72160 - protein, 9 aa, Homo Sapiens
DRHIWITAA

SEQ ID NO: 72161 - protein, 9 aa, Homo Sapiens
DRHLRTLQI

SEQ ID NO: 72162 - protein, 9 aa, Homo Sapiens
DRIERMLRL

SEQ ID NO: 72163 - protein, 9 aa, Homo Sapiens
DRIIRGNQL

SEQ ID NO: 72164 - protein, 9 aa, Homo Sapiens
DRIISVNSV

SEQ ID NO: 72165 - protein, 9 aa, Homo Sapiens
DRIKARMSL

SEQ ID NO: 72166 - protein, 9 aa, Homo Sapiens
DRIPERDKL

SEQ ID NO: 72167 - protein, 9 aa, Homo Sapiens
DRIRYVQSL

SEQ ID NO: 72168 - protein, 9 aa, Homo Sapiens
DRITGRAGL

SEQ ID NO: 72169 - protein, 9 aa, Homo Sapiens
DRITRYQGV

SEQ ID NO: 72170 - protein, 9 aa, Homo Sapiens
DRIVERCDL

SEQ ID NO: 72171 - protein, 9 aa, Homo Sapiens
DRLARDYAA

SEQ ID NO: 72172 - protein, 9 aa, Homo Sapiens
DRLDREEAF

SEQ ID NO: 72173 - protein, 9 aa, Homo Sapiens
DRLGKKVRV

SEQ ID NO: 72174 - protein, 9 aa, Homo Sapiens
DRLHKVKTV

SEQ ID NO: 72175 - protein, 9 aa, Homo Sapiens
DRLKDGLCL

SEQ ID NO: 72176 - protein, 9 aa, Homo Sapiens
DRLKFFETL

SEQ ID NO: 72177 - protein, 9 aa, Homo Sapiens
DRLKVFKEV

SEQ ID NO: 72178 - protein, 9 aa, Homo Sapiens
DRLKVIPKL

SEQ ID NO: 72179 - protein, 9 aa, Homo Sapiens
DRLLALNSL

SEQ ID NO: 72180 - protein, 9 aa, Homo Sapiens
DRLLRIRAL

SEQ ID NO: 72181 - protein, 9 aa, Homo Sapiens
DRLLRISQL

SEQ ID NO: 72182 - protein, 9 aa, Homo Sapiens
DRLLRTMAF

SEQ ID NO: 72183 - protein, 9 aa, Homo Sapiens
DRLLWARSV

SEQ ID NO: 72184 - protein, 9 aa, Homo Sapiens
DRLNHLLSV

SEQ ID NO: 72185 - protein, 9 aa, Homo Sapiens
DRLNKKVVL

SEQ ID NO: 72186 - protein, 9 aa, Homo Sapiens
DRLNVTEEL

SEQ ID NO: 72187 - protein, 9 aa, Homo Sapiens
DRLPGPRAV

SEQ ID NO: 72188 - protein, 9 aa, Homo Sapiens
DRLPKFLIV

SEQ ID NO: 72189 - protein, 9 aa, Homo Sapiens
DRLQGLSSL

SEQ ID NO: 72190 - protein, 9 aa, Homo Sapiens
DRLRTLLQL

SEQ ID NO: 72191 - protein, 9 aa, Homo Sapiens
DRLRYRNVI

SEQ ID NO: 72192 - protein, 9 aa, Homo Sapiens
DRLTNGNSL

SEQ ID NO: 72193 - protein, 9 aa, Homo Sapiens
DRLTVRCGL

SEQ ID NO: 72194 - protein, 9 aa, Homo Sapiens
DRMFHIRAV

SEQ ID NO: 72195 - protein, 9 aa, Homo Sapiens
DRMKIGASL

SEQ ID NO: 72196 - protein, 9 aa, Homo Sapiens
DRMLRSALL

SEQ ID NO: 72197 - protein, 9 aa, Homo Sapiens
DRMRLSTAL

SEQ ID NO: 72198 - protein, 9 aa, Homo Sapiens
DRMTLLLRL

SEQ ID NO: 72199 - protein, 9 aa, Homo Sapiens
DRNAHLNAL

SEQ ID NO: 72200 - protein, 9 aa, Homo Sapiens
DRNDRAIRV

SEQ ID NO: 72201 - protein, 9 aa, Homo Sapiens
DRNIKKITL

SEQ ID NO: 72202 - protein, 9 aa, Homo Sapiens
DRNIRYVAL

SEQ ID NO: 72203 - protein, 9 aa, Homo Sapiens
DRQIRLWGL

SEQ ID NO: 72204 - protein, 9 aa, Homo Sapiens
DRQWKKISA

SEQ ID NO: 72205 - protein, 9 aa, Homo Sapiens
DRQYKDYKI

SEQ ID NO: 72206 - protein, 9 aa, Homo Sapiens
DRRAFIITI

SEQ ID NO: 72207 - protein, 9 aa, Homo Sapiens
DRRERLRQL

SEQ ID NO: 72208 - protein, 9 aa, Homo Sapiens
DRRERVLKL

SEQ ID NO: 72209 - protein, 9 aa, Homo Sapiens
DRRGRPVGF

SEQ ID NO: 72210 - protein, 9 aa, Homo Sapiens
DRRLRIPEL

SEQ ID NO: 72211 - protein, 9 aa, Homo Sapiens
DRRSRIEAL

SEQ ID NO: 72212 - protein, 9 aa, Homo Sapiens
DRSAHFSTL

SEQ ID NO: 72213 - protein, 9 aa, Homo Sapiens
DRSLRVWSM

SEQ ID NO: 72214 - protein, 9 aa, Homo Sapiens
DRSTREVEL

SEQ ID NO: 72215 - protein, 9 aa, Homo Sapiens
DRTAIHEVM

SEQ ID NO: 72216 - protein, 9 aa, Homo Sapiens
DRTAQLTSL

SEQ ID NO: 72217 - protein, 9 aa, Homo Sapiens
DRTMRQRAL

SEQ ID NO: 72218 - protein, 9 aa, Homo Sapiens
DRTSIHEAM

SEQ ID NO: 72219 - protein, 9 aa, Homo Sapiens
DRTTISRAL

SEQ ID NO: 72220 - protein, 9 aa, Homo Sapiens
DRVAIHEAM

SEQ ID NO: 72221 - protein, 9 aa, Homo Sapiens
DRVALRNLL

SEQ ID NO: 72222 - protein, 9 aa, Homo Sapiens
DRVATQLVV

SEQ ID NO: 72223 - protein, 9 aa, Homo Sapiens
DRVDREITM

SEQ ID NO: 72224 - protein, 9 aa, Homo Sapiens
DRVFRNETL

SEQ ID NO: 72225 - protein, 9 aa, Homo Sapiens
DRVKMGFVM

SEQ ID NO: 72226 - protein, 9 aa, Homo Sapiens
DRVLREERA

SEQ ID NO: 72227 - protein, 9 aa, Homo Sapiens
DRVLRIHRI

SEQ ID NO: 72228 - protein, 9 aa, Homo Sapiens
DRVLRVYSI

SEQ ID NO: 72229 - protein, 9 aa, Homo Sapiens
DRVQRMLEV

SEQ ID NO: 72230 - protein, 9 aa, Homo Sapiens
DRVTITNCL

SEQ ID NO: 72231 - protein, 9 aa, Homo Sapiens
DRVTRLEFL

SEQ ID NO: 72232 - protein, 9 aa, Homo Sapiens
DRYDGLRRL

SEQ ID NO: 72233 - protein, 9 aa, Homo Sapiens
DRYDGMVGF

SEQ ID NO: 72234 - protein, 9 aa, Homo Sapiens
DRYDSFIEL

SEQ ID NO: 72235 - protein, 9 aa, Homo Sapiens
DRYEFSSHI

SEQ ID NO: 72236 - protein, 9 aa, Homo Sapiens
DRYERLTSV

SEQ ID NO: 72237 - protein, 9 aa, Homo Sapiens
DRYFRIQEV

SEQ ID NO: 72238 - protein, 9 aa, Homo Sapiens
DRYGGQPLF

SEQ ID NO: 72239 - protein, 9 aa, Homo Sapiens
DRYHEKLAV

SEQ ID NO: 72240 - protein, 9 aa, Homo Sapiens
DRYHRFKEL

SEQ ID NO: 72241 - protein, 9 aa, Homo Sapiens
DRYIFASNL

SEQ ID NO: 72242 - protein, 9 aa, Homo Sapiens
DRYIFVSLL

SEQ ID NO: 72243 - protein, 9 aa, Homo Sapiens
DRYIQQKRL

SEQ ID NO: 72244 - protein, 9 aa, Homo Sapiens
DRYISKMFL

SEQ ID NO: 72245 - protein, 9 aa, Homo Sapiens
DRYKNLPTA

SEQ ID NO: 72246 - protein, 9 aa, Homo Sapiens
DRYLAIVHA

SEQ ID NO: 72247 - protein, 9 aa, Homo Sapiens
DRYLAVVHA

SEQ ID NO: 72248 - protein, 9 aa, Homo Sapiens
DRYLKSESL

SEQ ID NO: 72249 - protein, 9 aa, Homo Sapiens
DRYLNIVHA

SEQ ID NO: 72250 - protein, 9 aa, Homo Sapiens
DRYLQDNPA

SEQ ID NO: 72251 - protein, 9 aa, Homo Sapiens
DRYLRPHAF

SEQ ID NO: 72252 - protein, 9 aa, Homo Sapiens
DRYLTEQCL

SEQ ID NO: 72253 - protein, 9 aa, Homo Sapiens
DRYNRKYLM

SEQ ID NO: 72254 - protein, 9 aa, Homo Sapiens
DRYPGSTFM

SEQ ID NO: 72255 - protein, 9 aa, Homo Sapiens
DRYPKKLVQ

SEQ ID NO: 72256 - protein, 9 aa, Homo Sapiens
DRYPRKVTA

SEQ ID NO: 72257 - protein, 9 aa, Homo Sapiens
DRYQYPFVL

SEQ ID NO: 72258 - protein, 9 aa, Homo Sapiens
DRYRQDPQL

SEQ ID NO: 72259 - protein, 9 aa, Homo Sapiens
DRYSGNVTI

SEQ ID NO: 72260 - protein, 9 aa, Homo Sapiens
DRYTIHSQL

SEQ ID NO: 72261 - protein, 9 aa, Homo Sapiens
DRYWCPPLL

SEQ ID NO: 72262 - protein, 9 aa, Homo Sapiens
DRYYERNEL

SEQ ID NO: 72263 - protein, 9 aa, Homo Sapiens
DSFARLDAL

SEQ ID NO: 72264 - protein, 9 aa, Homo Sapiens
DSFARLVEL

SEQ ID NO: 72265 - protein, 9 aa, Homo Sapiens
DSFERSNSL

SEQ ID NO: 72266 - protein, 9 aa, Homo Sapiens
DSYRKKVVL

SEQ ID NO: 72267 - protein, 9 aa, Homo Sapiens
DSYSHIMAL

SEQ ID NO: 72268 - protein, 9 aa, Homo Sapiens
DSYVRPCTL

SEQ ID NO: 72269 - protein, 9 aa, Homo Sapiens
DTFIRHIAL

SEQ ID NO: 72270 - protein, 9 aa, Homo Sapiens
DTLQRVNQL

SEQ ID NO: 72271 - protein, 9 aa, Homo Sapiens
DTYPRKWGL

SEQ ID NO: 72272 - protein, 9 aa, Homo Sapiens
DVAPKRQAL

SEQ ID NO: 72273 - protein, 9 aa, Homo Sapiens
DVAQRCKEL

SEQ ID NO: 72274 - protein, 9 aa, Homo Sapiens
DVMIRKEEL

SEQ ID NO: 72275 - protein, 9 aa, Homo Sapiens
DVQLRLNSI

SEQ ID NO: 72276 - protein, 9 aa, Homo Sapiens
DVVKRLLSL

SEQ ID NO: 72277 - protein, 9 aa, Homo Sapiens
DVYERLTNL

SEQ ID NO: 72278 - protein, 9 aa, Homo Sapiens
DVYQRIVWL

SEQ ID NO: 72279 - protein, 9 aa, Homo Sapiens
DVYRKLIEL

SEQ ID NO: 72280 - protein, 9 aa, Homo Sapiens
EALVRTVAL

SEQ ID NO: 72281 - protein, 9 aa, Homo Sapiens
EAVARGCAL

SEQ ID NO: 72282 - protein, 9 aa, Homo Sapiens
EAYEREVSL

SEQ ID NO: 72283 - protein, 9 aa, Homo Sapiens
EDYTRYNQL

SEQ ID NO: 72284 - protein, 9 aa, Homo Sapiens
EEFRRLAAL

SEQ ID NO: 72285 - protein, 9 aa, Homo Sapiens
EELERTAEL

SEQ ID NO: 72286 - protein, 9 aa, Homo Sapiens
EELERVSAL

SEQ ID NO: 72287 - protein, 9 aa, Homo Sapiens
EEWERHEAL

SEQ ID NO: 72288 - protein, 9 aa, Homo Sapiens
EGFDRSTSL

SEQ ID NO: 72289 - protein, 9 aa, Homo Sapiens
ELFLRRISL

SEQ ID NO: 72290 - protein, 9 aa, Homo Sapiens
ENIMRLSSL

SEQ ID NO: 72291 - protein, 9 aa, Homo Sapiens
ENRVLHQEL

SEQ ID NO: 72292 - protein, 9 aa, Homo Sapiens
EQMERLEAL

SEQ ID NO: 72293 - protein, 9 aa, Homo Sapiens
EQVLRWSSL

SEQ ID NO: 72294 - protein, 9 aa, Homo Sapiens
EQYIRRLAA

SEQ ID NO: 72295 - protein, 9 aa, Homo Sapiens
EQYLRIISH

SEQ ID NO: 72296 - protein, 9 aa, Homo Sapiens
ERALRELAL

SEQ ID NO: 72297 - protein, 9 aa, Homo Sapiens
ERCLHGLSL

SEQ ID NO: 72298 - protein, 9 aa, Homo Sapiens
ERFADRSLL

SEQ ID NO: 72299 - protein, 9 aa, Homo Sapiens
ERFARNSTL

SEQ ID NO: 72300 - protein, 9 aa, Homo Sapiens
ERFDGMLLA

SEQ ID NO: 72301 - protein, 9 aa, Homo Sapiens
ERFDSRSNL

SEQ ID NO: 72302 - protein, 9 aa, Homo Sapiens
ERFEKTFQL

SEQ ID NO: 72303 - protein, 9 aa, Homo Sapiens
ERFHHVTVL

SEQ ID NO: 72304 - protein, 9 aa, Homo Sapiens
ERFKNKITV

SEQ ID NO: 72305 - protein, 9 aa, Homo Sapiens
ERFLKGEGL

SEQ ID NO: 72306 - protein, 9 aa, Homo Sapiens
ERFNVPVSL

SEQ ID NO: 72307 - protein, 9 aa, Homo Sapiens
ERFPTHAKL

SEQ ID NO: 72308 - protein, 9 aa, Homo Sapiens
ERFQTTTTL

SEQ ID NO: 72309 - protein, 9 aa, Homo Sapiens
ERFRCPEAI

SEQ ID NO: 72310 - protein, 9 aa, Homo Sapiens
ERHWRIFSL

SEQ ID NO: 72311 - protein, 9 aa, Homo Sapiens
ERIDTRNEL

SEQ ID NO: 72312 - protein, 9 aa, Homo Sapiens
ERIKRLEEL

SEQ ID NO: 72313 - protein, 9 aa, Homo Sapiens
ERIMKAQAL

SEQ ID NO: 72314 - protein, 9 aa, Homo Sapiens
ERIPKALEV

SEQ ID NO: 72315 - protein, 9 aa, Homo Sapiens
ERISRGGSL

SEQ ID NO: 72316 - protein, 9 aa, Homo Sapiens
ERKERLESL

SEQ ID NO: 72317 - protein, 9 aa, Homo Sapiens
ERLAIRAQL

SEQ ID NO: 72318 - protein, 9 aa, Homo Sapiens
ERLERIFQL

SEQ ID NO: 72319 - protein, 9 aa, Homo Sapiens
ERLERQERL

SEQ ID NO: 72320 - protein, 9 aa, Homo Sapiens
ERLGQALEL

SEQ ID NO: 72321 - protein, 9 aa, Homo Sapiens
ERLGQFMTL

SEQ ID NO: 72322 - protein, 9 aa, Homo Sapiens
ERLIRTIAA

SEQ ID NO: 72323 - protein, 9 aa, Homo Sapiens
ERLKIRGSL

SEQ ID NO: 72324 - protein, 9 aa, Homo Sapiens
ERLKREAQL

SEQ ID NO: 72325 - protein, 9 aa, Homo Sapiens
ERLLTYNSL

SEQ ID NO: 72326 - protein, 9 aa, Homo Sapiens
ERLNRLETL

SEQ ID NO: 72327 - protein, 9 aa, Homo Sapiens
ERLPEHCKL

SEQ ID NO: 72328 - protein, 9 aa, Homo Sapiens
ERLQRFQNL

SEQ ID NO: 72329 - protein, 9 aa, Homo Sapiens
ERLSRETAL

SEQ ID NO: 72330 - protein, 9 aa, Homo Sapiens
ERLVRAYEL

SEQ ID NO: 72331 - protein, 9 aa, Homo Sapiens
ERQDRISRL

SEQ ID NO: 72332 - protein, 9 aa, Homo Sapiens
ERWARPPAV

SEQ ID NO: 72333 - protein, 9 aa, Homo Sapiens
ERWSKHRVV

SEQ ID NO: 72334 - protein, 9 aa, Homo Sapiens
ERYAKIVEI

SEQ ID NO: 72335 - protein, 9 aa, Homo Sapiens
ERYELLNVL

SEQ ID NO: 72336 - protein, 9 aa, Homo Sapiens
ERYFISHVL

SEQ ID NO: 72337 - protein, 9 aa, Homo Sapiens
ERYHAGKCL

SEQ ID NO: 72338 - protein, 9 aa, Homo Sapiens
ERYLLTQEL

SEQ ID NO: 72339 - protein, 9 aa, Homo Sapiens
ERYRAITSA

SEQ ID NO: 72340 - protein, 9 aa, Homo Sapiens
ERYSASKPL

SEQ ID NO: 72341 - protein, 9 aa, Homo Sapiens
ESALRKQSL

SEQ ID NO: 72342 - protein, 9 aa, Homo Sapiens
EVLQRGEAL

SEQ ID NO: 72343 - protein, 9 aa, Homo Sapiens
FEMATRAAL

SEQ ID NO: 72344 - protein, 9 aa, Homo Sapiens
FNFLRNVSL

SEQ ID NO: 72345 - protein, 9 aa, Homo Sapiens
FQRQRVDAL

SEQ ID NO: 72346 - protein, 9 aa, Homo Sapiens
FRHDRSLEL

SEQ ID NO: 72347 - protein, 9 aa, Homo Sapiens
FRLPRKEKL

SEQ ID NO: 72348 - protein, 9 aa, Homo Sapiens
FRSGSSRVL

SEQ ID NO: 72349 - protein, 9 aa, Homo Sapiens
FRVPTANVS

SEQ ID NO: 72350 - protein, 9 aa, Homo Sapiens
FRYFRMPEL

SEQ ID NO: 72351 - protein, 9 aa, Homo Sapiens
FRYHGLSSL

SEQ ID NO: 72352 - protein, 9 aa, Homo Sapiens
FRYLMGERL

SEQ ID NO: 72353 - protein, 9 aa, Homo Sapiens
FRYQGHVGA

SEQ ID NO: 72354 - protein, 9 aa, Homo Sapiens
FRYQGYIGA

SEQ ID NO: 72355 - protein, 9 aa, Homo Sapiens
GEELLHSVL

SEQ ID NO: 72356 - protein, 9 aa, Homo Sapiens
GEGLKRSAL

SEQ ID NO: 72357 - protein, 9 aa, Homo Sapiens
GLEFAHMAL

SEQ ID NO: 72358 - protein, 9 aa, Homo Sapiens
GQPMVHGAL

SEQ ID NO: 72359 - protein, 9 aa, Homo Sapiens
GQWKKGFVL

SEQ ID NO: 72360 - protein, 9 aa, Homo Sapiens
GRAFRTVTL

SEQ ID NO: 72361 - protein, 9 aa, Homo Sapiens
GRAGRSVSL

SEQ ID NO: 72362 - protein, 9 aa, Homo Sapiens
GRFDREICL

SEQ ID NO: 72363 - protein, 9 aa, Homo Sapiens
GRFGSRDAL

SEQ ID NO: 72364 - protein, 9 aa, Homo Sapiens
GRLGRSESL

SEQ ID NO: 72365 - protein, 9 aa, Homo Sapiens
GRLVRAQAL

SEQ ID NO: 72366 - protein, 9 aa, Homo Sapiens
GRVAERSQL

SEQ ID NO: 72367 - protein, 9 aa, Homo Sapiens
GRVAPRSGL

SEQ ID NO: 72368 - protein, 9 aa, Homo Sapiens
GRWDRVCSL

SEQ ID NO: 72369 - protein, 9 aa, Homo Sapiens
GRYLRRELL

SEQ ID NO: 72370 - protein, 9 aa, Homo Sapiens
GRYNPRRSL

SEQ ID NO: 72371 - protein, 9 aa, Homo Sapiens
HAALRCESL

SEQ ID NO: 72372 - protein, 9 aa, Homo Sapiens
HCYSRLREL

SEQ ID NO: 72373 - protein, 9 aa, Homo Sapiens
HEAERNIAL

SEQ ID NO: 72374 - protein, 9 aa, Homo Sapiens
HELQRFYSL

SEQ ID NO: 72375 - protein, 9 aa, Homo Sapiens
HGYERYNAM

SEQ ID NO: 72376 - protein, 9 aa, Homo Sapiens
HPYQRIVTA

SEQ ID NO: 72377 - protein, 9 aa, Homo Sapiens
HQFSRDASV

SEQ ID NO: 72378 - protein, 9 aa, Homo Sapiens
HRAVGHFEL

SEQ ID NO: 72379 - protein, 9 aa, Homo Sapiens
HRCPFPHVV

SEQ ID NO: 72380 - protein, 9 aa, Homo Sapiens
HRDQRDVSL

SEQ ID NO: 72381 - protein, 9 aa, Homo Sapiens
HRFPFSSAL

SEQ ID NO: 72382 - protein, 9 aa, Homo Sapiens
HRFYFENAL

SEQ ID NO: 72383 - protein, 9 aa, Homo Sapiens
HRLHHVSSL

SEQ ID NO: 72384 - protein, 9 aa, Homo Sapiens
HRLPHVLLL

SEQ ID NO: 72385 - protein, 9 aa, Homo Sapiens
HRLTDRLQV

SEQ ID NO: 72386 - protein, 9 aa, Homo Sapiens
HRMNREEIL

SEQ ID NO: 72387 - protein, 9 aa, Homo Sapiens
HRQVRKYVM

SEQ ID NO: 72388 - protein, 9 aa, Homo Sapiens
HRWVNYESM

SEQ ID NO: 72389 - protein, 9 aa, Homo Sapiens
HRYEREEAF

SEQ ID NO: 72390 - protein, 9 aa, Homo Sapiens
HYDRSGRSL

SEQ ID NO: 72391 - protein, 9 aa, Homo Sapiens
IAYIRDLAL

SEQ ID NO: 72392 - protein, 9 aa, Homo Sapiens
IDYQRNVPA

SEQ ID NO: 72393 - protein, 9 aa, Homo Sapiens
IEFSRLTSL

SEQ ID NO: 72394 - protein, 9 aa, Homo Sapiens
IEISRNEAL

SEQ ID NO: 72395 - protein, 9 aa, Homo Sapiens
IEYARQLEM

SEQ ID NO: 72396 - protein, 9 aa, Homo Sapiens
IEYEKKQTL

SEQ ID NO: 72397 - protein, 9 aa, Homo Sapiens
IEYIRQGSL

SEQ ID NO: 72398 - protein, 9 aa, Homo Sapiens
IGYARNPSL

SEQ ID NO: 72399 - protein, 9 aa, Homo Sapiens
IHAKRVTIM

SEQ ID NO: 72400 - protein, 9 aa, Homo Sapiens
IKYNRKISA

SEQ ID NO: 72401 - protein, 9 aa, Homo Sapiens
IPLAKRVAL

SEQ ID NO: 72402 - protein, 9 aa, Homo Sapiens
IPYARDAVI

SEQ ID NO: 72403 - protein, 9 aa, Homo Sapiens
IPYKREESL

SEQ ID NO: 72404 - protein, 9 aa, Homo Sapiens
IQQKRTVAF

SEQ ID NO: 72405 - protein, 9 aa, Homo Sapiens
IRAAWTRAL

SEQ ID NO: 72406 - protein, 9 aa, Homo Sapiens
IRAFREEAI

SEQ ID NO: 72407 - protein, 9 aa, Homo Sapiens
IREPRTTAL

SEQ ID NO: 72408 - protein, 9 aa, Homo Sapiens
IRFGGRKEI

SEQ ID NO: 72409 - protein, 9 aa, Homo Sapiens
IRFGRKPSL

SEQ ID NO: 72410 - protein, 9 aa, Homo Sapiens
IRHERNVIL

SEQ ID NO: 72411 - protein, 9 aa, Homo Sapiens
IRKERPISL

SEQ ID NO: 72412 - protein, 9 aa, Homo Sapiens
IRLDKKLSV

SEQ ID NO: 72413 - protein, 9 aa, Homo Sapiens
IRMEHVKIV

SEQ ID NO: 72414 - protein, 9 aa, Homo Sapiens
IRMEREALL

SEQ ID NO: 72415 - protein, 9 aa, Homo Sapiens
IRNHHVASL

SEQ ID NO: 72416 - protein, 9 aa, Homo Sapiens
IRQERDQRL

SEQ ID NO: 72417 - protein, 9 aa, Homo Sapiens
IRQQRLISI

SEQ ID NO: 72418 - protein, 9 aa, Homo Sapiens
IRVIAHTQM

SEQ ID NO: 72419 - protein, 9 aa, Homo Sapiens
IRVLGRKEL

SEQ ID NO: 72420 - protein, 9 aa, Homo Sapiens
IRYDTVLAL

SEQ ID NO: 72421 - protein, 9 aa, Homo Sapiens
IRYFPTQAL

SEQ ID NO: 72422 - protein, 9 aa, Homo Sapiens
IRYIHRPCL

SEQ ID NO: 72423 - protein, 9 aa, Homo Sapiens
IRYPDSHQL

SEQ ID NO: 72424 - protein, 9 aa, Homo Sapiens
IRYVTPRAL

SEQ ID NO: 72425 - protein, 9 aa, Homo Sapiens
KAYERGISL

SEQ ID NO: 72426 - protein, 9 aa, Homo Sapiens
KDMERLTSL

SEQ ID NO: 72427 - protein, 9 aa, Homo Sapiens
KLQNNSLLP

SEQ ID NO: 72428 - protein, 9 aa, Homo Sapiens
KRFSGTVRL

SEQ ID NO: 72429 - protein, 9 aa, Homo Sapiens
KRINWRTVL

SEQ ID NO: 72430 - protein, 9 aa, Homo Sapiens
KRYAGALRA

SEQ ID NO: 72431 - protein, 9 aa, Homo Sapiens
KRYDREFLL

SEQ ID NO: 72432 - protein, 9 aa, Homo Sapiens
KRYSRSLTI

SEQ ID NO: 72433 - protein, 9 aa, Homo Sapiens
LAAARLAAA

SEQ ID NO: 72434 - protein, 9 aa, Homo Sapiens
LAALRLQSL

SEQ ID NO: 72435 - protein, 9 aa, Homo Sapiens
LDLQRTLSL

SEQ ID NO: 72436 - protein, 9 aa, Homo Sapiens
LDRERILSL

SEQ ID NO: 72437 - protein, 9 aa, Homo Sapiens
LEFLRDEEL

SEQ ID NO: 72438 - protein, 9 aa, Homo Sapiens
LELERKQAL

SEQ ID NO: 72439 - protein, 9 aa, Homo Sapiens
LERERAAQL

SEQ ID NO: 72440 - protein, 9 aa, Homo Sapiens
LEVARNVAL

SEQ ID NO: 72441 - protein, 9 aa, Homo Sapiens
LEYERQLVL

SEQ ID NO: 72442 - protein, 9 aa, Homo Sapiens
LPDERTISL

SEQ ID NO: 72443 - protein, 9 aa, Homo Sapiens
LPFLRITSL

SEQ ID NO: 72444 - protein, 9 aa, Homo Sapiens
LPHNRLVSL

SEQ ID NO: 72445 - protein, 9 aa, Homo Sapiens
LPHNRMQAL

SEQ ID NO: 72446 - protein, 9 aa, Homo Sapiens
LPWKRIVAV

SEQ ID NO: 72447 - protein, 9 aa, Homo Sapiens
LQIDNARLA

SEQ ID NO: 72448 - protein, 9 aa, Homo Sapiens
LQIQRNVTL

SEQ ID NO: 72449 - protein, 9 aa, Homo Sapiens
LQLERAQSL

SEQ ID NO: 72450 - protein, 9 aa, Homo Sapiens
LQYNRAQVL

SEQ ID NO: 72451 - protein, 9 aa, Homo Sapiens
LQYSRQEGL

SEQ ID NO: 72452 - protein, 9 aa, Homo Sapiens
LQYTRKAEF

SEQ ID NO: 72453 - protein, 9 aa, Homo Sapiens
LRAVRCHSL

SEQ ID NO: 72454 - protein, 9 aa, Homo Sapiens
LRDDRVLPL

SEQ ID NO: 72455 - protein, 9 aa, Homo Sapiens
LRELEREVL

SEQ ID NO: 72456 - protein, 9 aa, Homo Sapiens
LRFDGALNV

SEQ ID NO: 72457 - protein, 9 aa, Homo Sapiens
LRFDKEVAL

SEQ ID NO: 72458 - protein, 9 aa, Homo Sapiens
LRFGNPLLV

SEQ ID NO: 72459 - protein, 9 aa, Homo Sapiens
LRFKKGHCL

SEQ ID NO: 72460 - protein, 9 aa, Homo Sapiens
LRFKKPQSL

SEQ ID NO: 72461 - protein, 9 aa, Homo Sapiens
LRFLFENKL

SEQ ID NO: 72462 - protein, 9 aa, Homo Sapiens
LRFLHENQL

SEQ ID NO: 72463 - protein, 9 aa, Homo Sapiens
LRFPGQLNA

SEQ ID NO: 72464 - protein, 9 aa, Homo Sapiens
LRFPHHSQL

SEQ ID NO: 72465 - protein, 9 aa, Homo Sapiens
LRFQSSAVM

SEQ ID NO: 72466 - protein, 9 aa, Homo Sapiens
LRHDRPYTL

SEQ ID NO: 72467 - protein, 9 aa, Homo Sapiens
LRHLQTITL

SEQ ID NO: 72468 - protein, 9 aa, Homo Sapiens
LRHNGPPPV

SEQ ID NO: 72469 - protein, 9 aa, Homo Sapiens
LRHPRINVL

SEQ ID NO: 72470 - protein, 9 aa, Homo Sapiens
LRHVGRHCL

SEQ ID NO: 72471 - protein, 9 aa, Homo Sapiens
LRIERESAL

SEQ ID NO: 72472 - protein, 9 aa, Homo Sapiens
LRIQQREQL

SEQ ID NO: 72473 - protein, 9 aa, Homo Sapiens
LRLLIHQSL

SEQ ID NO: 72474 - protein, 9 aa, Homo Sapiens
LRLPRRESL

SEQ ID NO: 72475 - protein, 9 aa, Homo Sapiens
LRMAVRNNL

SEQ ID NO: 72476 - protein, 9 aa, Homo Sapiens
LRPGVRHPL

SEQ ID NO: 72477 - protein, 9 aa, Homo Sapiens
LRRLREQVL

SEQ ID NO: 72478 - protein, 9 aa, Homo Sapiens
LRVVRVVDL

SEQ ID NO: 72479 - protein, 9 aa, Homo Sapiens
LRYAAVRTL

SEQ ID NO: 72480 - protein, 9 aa, Homo Sapiens
LRYDHQQRL

SEQ ID NO: 72481 - protein, 9 aa, Homo Sapiens
LRYDHQSRL

SEQ ID NO: 72482 - protein, 9 aa, Homo Sapiens
LRYGGNLSL

SEQ ID NO: 72483 - protein, 9 aa, Homo Sapiens
LRYLKQSKV

SEQ ID NO: 72484 - protein, 9 aa, Homo Sapiens
LRYLRDDGL

SEQ ID NO: 72485 - protein, 9 aa, Homo Sapiens
LRYPMAVGL

SEQ ID NO: 72486 - protein, 9 aa, Homo Sapiens
LSYLRESSL

SEQ ID NO: 72487 - protein, 9 aa, Homo Sapiens
LSYLRVNVL

SEQ ID NO: 72488 - protein, 9 aa, Homo Sapiens
MAAQRQRAL

SEQ ID NO: 72489 - protein, 9 aa, Homo Sapiens
MEAVRVNPL

SEQ ID NO: 72490 - protein, 9 aa, Homo Sapiens
MEFERQAEI

SEQ ID NO: 72491 - protein, 9 aa, Homo Sapiens
MELCRSLAL

SEQ ID NO: 72492 - protein, 9 aa, Homo Sapiens
MELERIVSA

SEQ ID NO: 72493 - protein, 9 aa, Homo Sapiens
MELERVKAL

SEQ ID NO: 72494 - protein, 9 aa, Homo Sapiens
MELQGERAI

SEQ ID NO: 72495 - protein, 9 aa, Homo Sapiens
MEQLRGEAL

SEQ ID NO: 72496 - protein, 9 aa, Homo Sapiens
MERERKVSM

SEQ ID NO: 72497 - protein, 9 aa, Homo Sapiens
MEYLRFREL

SEQ ID NO: 72498 - protein, 9 aa, Homo Sapiens
MGFSRDQAL

SEQ ID NO: 72499 - protein, 9 aa, Homo Sapiens
MGYEREQVI

SEQ ID NO: 72500 - protein, 9 aa, Homo Sapiens
MGYLRIADL

SEQ ID NO: 72501 - protein, 9 aa, Homo Sapiens
MQAPGRGPL

SEQ ID NO: 72502 - protein, 9 aa, Homo Sapiens
MQYLKENSL

SEQ ID NO: 72503 - protein, 9 aa, Homo Sapiens
MRFDGLLGF

SEQ ID NO: 72504 - protein, 9 aa, Homo Sapiens
MRFDGRLGF

SEQ ID NO: 72505 - protein, 9 aa, Homo Sapiens
MRFLAATFL

SEQ ID NO: 72506 - protein, 9 aa, Homo Sapiens
MRFLIKGSV

SEQ ID NO: 72507 - protein, 9 aa, Homo Sapiens
MRHKLKTAF

SEQ ID NO: 72508 - protein, 9 aa, Homo Sapiens
MRHVVSHAL

SEQ ID NO: 72509 - protein, 9 aa, Homo Sapiens
MRIFRDQSL

SEQ ID NO: 72510 - protein, 9 aa, Homo Sapiens
MRKIREIVL

SEQ ID NO: 72511 - protein, 9 aa, Homo Sapiens
MRKVPRVSL

SEQ ID NO: 72512 - protein, 9 aa, Homo Sapiens
MRLEQRDSL

SEQ ID NO: 72513 - protein, 9 aa, Homo Sapiens
MRLGGRLVL

SEQ ID NO: 72514 - protein, 9 aa, Homo Sapiens
MRLGPRTAA

SEQ ID NO: 72515 - protein, 9 aa, Homo Sapiens
MRLPGGPTL

SEQ ID NO: 72516 - protein, 9 aa, Homo Sapiens
MRLSLPLLL

SEQ ID NO: 72517 - protein, 9 aa, Homo Sapiens
MRLSRELQL

SEQ ID NO: 72518 - protein, 9 aa, Homo Sapiens
MRMATPLLM

SEQ ID NO: 72519 - protein, 9 aa, Homo Sapiens
MRMNRICRM

SEQ ID NO: 72520 - protein, 9 aa, Homo Sapiens
MRMVLNESL

SEQ ID NO: 72521 - protein, 9 aa, Homo Sapiens
MRRDGWPAM

SEQ ID NO: 72522 - protein, 9 aa, Homo Sapiens
MRSLKRAAL

SEQ ID NO: 72523 - protein, 9 aa, Homo Sapiens
MRSLLRTPF

SEQ ID NO: 72524 - protein, 9 aa, Homo Sapiens
MRTVKRETL

SEQ ID NO: 72525 - protein, 9 aa, Homo Sapiens
MRVSDRQQL

SEQ ID NO: 72526 - protein, 9 aa, Homo Sapiens
MRVSNRSLL

SEQ ID NO: 72527 - protein, 9 aa, Homo Sapiens
MRYAVNVAL

SEQ ID NO: 72528 - protein, 9 aa, Homo Sapiens
MRYLHRIYV

SEQ ID NO: 72529 - protein, 9 aa, Homo Sapiens
MRYLLKVQF

SEQ ID NO: 72530 - protein, 9 aa, Homo Sapiens
MRYLLPSVV

SEQ ID NO: 72531 - protein, 9 aa, Homo Sapiens
MRYNLQSAL

SEQ ID NO: 72532 - protein, 9 aa, Homo Sapiens
MRYVASYLL

SEQ ID NO: 72533 - protein, 9 aa, Homo Sapiens
NAAERRGPL

SEQ ID NO: 72534 - protein, 9 aa, Homo Sapiens
NAFRRFSSL

SEQ ID NO: 72535 - protein, 9 aa, Homo Sapiens
NALMRLNQI

SEQ ID NO: 72536 - protein, 9 aa, Homo Sapiens
NEATRQVAL

SEQ ID NO: 72537 - protein, 9 aa, Homo Sapiens
NEFVRDTAL

SEQ ID NO: 72538 - protein, 9 aa, Homo Sapiens
NELERLSNL

SEQ ID NO: 72539 - protein, 9 aa, Homo Sapiens
NELERNITI

SEQ ID NO: 72540 - protein, 9 aa, Homo Sapiens
NELKRLCGL

SEQ ID NO: 72541 - protein, 9 aa, Homo Sapiens
NELQRKDAL

SEQ ID NO: 72542 - protein, 9 aa, Homo Sapiens
NELVRISSM

SEQ ID NO: 72543 - protein, 9 aa, Homo Sapiens
NELVRTKTL

SEQ ID NO: 72544 - protein, 9 aa, Homo Sapiens
NEVERTQAL

SEQ ID NO: 72545 - protein, 9 aa, Homo Sapiens
NGAARLTAL

SEQ ID NO: 72546 - protein, 9 aa, Homo Sapiens
NGATRKLAL

SEQ ID NO: 72547 - protein, 9 aa, Homo Sapiens
NGQPIHAEL

SEQ ID NO: 72548 - protein, 9 aa, Homo Sapiens
NGYKRVLAL

SEQ ID NO: 72549 - protein, 9 aa, Homo Sapiens
NGYLRAAEL

SEQ ID NO: 72550 - protein, 9 aa, Homo Sapiens
NHFDRSVVL

SEQ ID NO: 72551 - protein, 9 aa, Homo Sapiens
NKYERELML

SEQ ID NO: 72552 - protein, 9 aa, Homo Sapiens
NNMQRQLAL

SEQ ID NO: 72553 - protein, 9 aa, Homo Sapiens
NPHDRVVAL

SEQ ID NO: 72554 - protein, 9 aa, Homo Sapiens
NPHKRISAF

SEQ ID NO: 72555 - protein, 9 aa, Homo Sapiens
NPNLRKNVL

SEQ ID NO: 72556 - protein, 9 aa, Homo Sapiens
NPQLRSVAL

SEQ ID NO: 72557 - protein, 9 aa, Homo Sapiens
NPYSRLMAL

SEQ ID NO: 72558 - protein, 9 aa, Homo Sapiens
NQAERRAVL

SEQ ID NO: 72559 - protein, 9 aa, Homo Sapiens
NQIERCNSL

SEQ ID NO: 72560 - protein, 9 aa, Homo Sapiens
NQIIRHNEL

SEQ ID NO: 72561 - protein, 9 aa, Homo Sapiens
NQISDRAAL

SEQ ID NO: 72562 - protein, 9 aa, Homo Sapiens
NQLIRTSGV

SEQ ID NO: 72563 - protein, 9 aa, Homo Sapiens
NQLKRIAKM

SEQ ID NO: 72564 - protein, 9 aa, Homo Sapiens
NQLQRLCVL

SEQ ID NO: 72565 - protein, 9 aa, Homo Sapiens
NQRHRDLEL

SEQ ID NO: 72566 - protein, 9 aa, Homo Sapiens
NQVARFNDL

SEQ ID NO: 72567 - protein, 9 aa, Homo Sapiens
NQVVREAIL

SEQ ID NO: 72568 - protein, 9 aa, Homo Sapiens
NQWSRIASL

SEQ ID NO: 72569 - protein, 9 aa, Homo Sapiens
NRAACHLKL

SEQ ID NO: 72570 - protein, 9 aa, Homo Sapiens
NRALKRFSL

SEQ ID NO: 72571 - protein, 9 aa, Homo Sapiens
NRALRGQSL

SEQ ID NO: 72572 - protein, 9 aa, Homo Sapiens
NRANRAVAI

SEQ ID NO: 72573 - protein, 9 aa, Homo Sapiens
NRAVVGVVA

SEQ ID NO: 72574 - protein, 9 aa, Homo Sapiens
NREARNYTL

SEQ ID NO: 72575 - protein, 9 aa, Homo Sapiens
NREVPREAL

SEQ ID NO: 72576 - protein, 9 aa, Homo Sapiens
NRFDAVQSA

SEQ ID NO: 72577 - protein, 9 aa, Homo Sapiens
NRFEKRINV

SEQ ID NO: 72578 - protein, 9 aa, Homo Sapiens
NRFGGGPAV

SEQ ID NO: 72579 - protein, 9 aa, Homo Sapiens
NRFKLVNSA

SEQ ID NO: 72580 - protein, 9 aa, Homo Sapiens
NRFLHMHEL

SEQ ID NO: 72581 - protein, 9 aa, Homo Sapiens
NRFNYPFEL

SEQ ID NO: 72582 - protein, 9 aa, Homo Sapiens
NRFPAVNSL

SEQ ID NO: 72583 - protein, 9 aa, Homo Sapiens
NRFPWPKVL

SEQ ID NO: 72584 - protein, 9 aa, Homo Sapiens
NRFSDHVAL

SEQ ID NO: 72585 - protein, 9 aa, Homo Sapiens
NRFSPKASL

SEQ ID NO: 72586 - protein, 9 aa, Homo Sapiens
NRFTHVLTA

SEQ ID NO: 72587 - protein, 9 aa, Homo Sapiens
NRFVGILMA

SEQ ID NO: 72588 - protein, 9 aa, Homo Sapiens
NRGDFFMTL

SEQ ID NO: 72589 - protein, 9 aa, Homo Sapiens
NRHAVVMEL

SEQ ID NO: 72590 - protein, 9 aa, Homo Sapiens
NRHLFKDKV

SEQ ID NO: 72591 - protein, 9 aa, Homo Sapiens
NRHLRDEGL

SEQ ID NO: 72592 - protein, 9 aa, Homo Sapiens
NRHPNFLVV

SEQ ID NO: 72593 - protein, 9 aa, Homo Sapiens
NRHYYSITI

SEQ ID NO: 72594 - protein, 9 aa, Homo Sapiens
NRICKVLAV

SEQ ID NO: 72595 - protein, 9 aa, Homo Sapiens
NRIEERLNL

SEQ ID NO: 72596 - protein, 9 aa, Homo Sapiens
NRIEKREVL

SEQ ID NO: 72597 - protein, 9 aa, Homo Sapiens
NRIHHKLVL

SEQ ID NO: 72598 - protein, 9 aa, Homo Sapiens
NRIKGIPKL

SEQ ID NO: 72599 - protein, 9 aa, Homo Sapiens
NRIRVRQDL

SEQ ID NO: 72600 - protein, 9 aa, Homo Sapiens
NRISHHKIL

SEQ ID NO: 72601 - protein, 9 aa, Homo Sapiens
NRIYRMIKL

SEQ ID NO: 72602 - protein, 9 aa, Homo Sapiens
NRLAMATAL

SEQ ID NO: 72603 - protein, 9 aa, Homo Sapiens
NRLDAELQL

SEQ ID NO: 72604 - protein, 9 aa, Homo Sapiens
NRLDRHEQI

SEQ ID NO: 72605 - protein, 9 aa, Homo Sapiens
NRLDYHISV

SEQ ID NO: 72606 - protein, 9 aa, Homo Sapiens
NRLETPMEL

SEQ ID NO: 72607 - protein, 9 aa, Homo Sapiens
NRLGQHSCL

SEQ ID NO: 72608 - protein, 9 aa, Homo Sapiens
NRLHDRIVF

SEQ ID NO: 72609 - protein, 9 aa, Homo Sapiens
NRLKVGLQV

SEQ ID NO: 72610 - protein, 9 aa, Homo Sapiens
NRLLQRKQM

SEQ ID NO: 72611 - protein, 9 aa, Homo Sapiens
NRLPKPVLL

SEQ ID NO: 72612 - protein, 9 aa, Homo Sapiens
NRLPLVVSF

SEQ ID NO: 72613 - protein, 9 aa, Homo Sapiens
NRLPRSVTT

SEQ ID NO: 72614 - protein, 9 aa, Homo Sapiens
NRLPRVLIL

SEQ ID NO: 72615 - protein, 9 aa, Homo Sapiens
NRLQAVEAL

SEQ ID NO: 72616 - protein, 9 aa, Homo Sapiens
NRLTFASTL

SEQ ID NO: 72617 - protein, 9 aa, Homo Sapiens
NRLTKIEGL

SEQ ID NO: 72618 - protein, 9 aa, Homo Sapiens
NRLVRLVCV

SEQ ID NO: 72619 - protein, 9 aa, Homo Sapiens
NRMADAIIL

SEQ ID NO: 72620 - protein, 9 aa, Homo Sapiens
NRMLAQQAV

SEQ ID NO: 72621 - protein, 9 aa, Homo Sapiens
NRNPRNLEL

SEQ ID NO: 72622 - protein, 9 aa, Homo Sapiens
NRQDRYVFL

SEQ ID NO: 72623 - protein, 9 aa, Homo Sapiens
NRRLKKYAL

SEQ ID NO: 72624 - protein, 9 aa, Homo Sapiens
NRTMVQLGI

SEQ ID NO: 72625 - protein, 9 aa, Homo Sapiens
NRVCTTVAI

SEQ ID NO: 72626 - protein, 9 aa, Homo Sapiens
NRVLGPCAL

SEQ ID NO: 72627 - protein, 9 aa, Homo Sapiens
NRVLRISQL

SEQ ID NO: 72628 - protein, 9 aa, Homo Sapiens
NRVNFRGSL

SEQ ID NO: 72629 - protein, 9 aa, Homo Sapiens
NRVQRDSVI

SEQ ID NO: 72630 - protein, 9 aa, Homo Sapiens
NRVSSRLGL

SEQ ID NO: 72631 - protein, 9 aa, Homo Sapiens
NRWKQSVEL

SEQ ID NO: 72632 - protein, 9 aa, Homo Sapiens
NRWLRTISV

SEQ ID NO: 72633 - protein, 9 aa, Homo Sapiens
NRYDGIYKV

SEQ ID NO: 72634 - protein, 9 aa, Homo Sapiens
NRYDGQVAV

SEQ ID NO: 72635 - protein, 9 aa, Homo Sapiens
NRYDKKYSW

SEQ ID NO: 72636 - protein, 9 aa, Homo Sapiens
NRYEDALVL

SEQ ID NO: 72637 - protein, 9 aa, Homo Sapiens
NRYERAIYA

SEQ ID NO: 72638 - protein, 9 aa, Homo Sapiens
NRYGMGTSV

SEQ ID NO: 72639 - protein, 9 aa, Homo Sapiens
NRYGQLTIL

SEQ ID NO: 72640 - protein, 9 aa, Homo Sapiens
NRYHVPVVV

SEQ ID NO: 72641 - protein, 9 aa, Homo Sapiens
NRYIHILMI

SEQ ID NO: 72642 - protein, 9 aa, Homo Sapiens
NRYIMKSFL

SEQ ID NO: 72643 - protein, 9 aa, Homo Sapiens
NRYIPTAAA

SEQ ID NO: 72644 - protein, 9 aa, Homo Sapiens
NRYLPTDTL

SEQ ID NO: 72645 - protein, 9 aa, Homo Sapiens
NRYLYFSST

SEQ ID NO: 72646 - protein, 9 aa, Homo Sapiens
NRYLYLSTM

SEQ ID NO: 72647 - protein, 9 aa, Homo Sapiens
NRYQGGFLI

SEQ ID NO: 72648 - protein, 9 aa, Homo Sapiens
NTLKRVSSL

SEQ ID NO: 72649 - protein, 9 aa, Homo Sapiens
PQYSRQNSL

SEQ ID NO: 72650 - protein, 9 aa, Homo Sapiens
QDAARKEAL

SEQ ID NO: 72651 - protein, 9 aa, Homo Sapiens
QDLRRTNSL

SEQ ID NO: 72652 - protein, 9 aa, Homo Sapiens
QDMQRKVEL

SEQ ID NO: 72653 - protein, 9 aa, Homo Sapiens
QDYKRMNML

SEQ ID NO: 72654 - protein, 9 aa, Homo Sapiens
QEAERKNSL

SEQ ID NO: 72655 - protein, 9 aa, Homo Sapiens
QEAVRNQSL

SEQ ID NO: 72656 - protein, 9 aa, Homo Sapiens
QEVLRTLAL

SEQ ID NO: 72657 - protein, 9 aa, Homo Sapiens
QEYERRAQL

SEQ ID NO: 72658 - protein, 9 aa, Homo Sapiens
QEYQRESML

SEQ ID NO: 72659 - protein, 9 aa, Homo Sapiens
QEYTRVCSL

SEQ ID NO: 72660 - protein, 9 aa, Homo Sapiens
QHATRFIAL

SEQ ID NO: 72661 - protein, 9 aa, Homo Sapiens
QLFQRPNAL

SEQ ID NO: 72662 - protein, 9 aa, Homo Sapiens
QLFQRTNAL

SEQ ID NO: 72663 - protein, 9 aa, Homo Sapiens
QNILALRSI

SEQ ID NO: 72664 - protein, 9 aa, Homo Sapiens
QNLERGTAV

SEQ ID NO: 72665 - protein, 9 aa, Homo Sapiens
QQAVRQNGL

SEQ ID NO: 72666 - protein, 9 aa, Homo Sapiens
QQEQRTNAL

SEQ ID NO: 72667 - protein, 9 aa, Homo Sapiens
QQLQRIAQL

SEQ ID NO: 72668 - protein, 9 aa, Homo Sapiens
QQLQRKTAL

SEQ ID NO: 72669 - protein, 9 aa, Homo Sapiens
QQQARTAAL

SEQ ID NO: 72670 - protein, 9 aa, Homo Sapiens
QQQKRTEAL

SEQ ID NO: 72671 - protein, 9 aa, Homo Sapiens
QQQQRNLSL

SEQ ID NO: 72672 - protein, 9 aa, Homo Sapiens
QQYLRQEVL

SEQ ID NO: 72673 - protein, 9 aa, Homo Sapiens
QQYQRRLAA

SEQ ID NO: 72674 - protein, 9 aa, Homo Sapiens
QRFEGTTSL

SEQ ID NO: 72675 - protein, 9 aa, Homo Sapiens
QRFHFASAL

SEQ ID NO: 72676 - protein, 9 aa, Homo Sapiens
QRKERLYPL

SEQ ID NO: 72677 - protein, 9 aa, Homo Sapiens
QRLIRESAL

SEQ ID NO: 72678 - protein, 9 aa, Homo Sapiens
QRLKFRLNL

SEQ ID NO: 72679 - protein, 9 aa, Homo Sapiens
QRLPRPSSL

SEQ ID NO: 72680 - protein, 9 aa, Homo Sapiens
QRLQRLERL

SEQ ID NO: 72681 - protein, 9 aa, Homo Sapiens
QRLSSHPVL

SEQ ID NO: 72682 - protein, 9 aa, Homo Sapiens
QRLVRVLQI

SEQ ID NO: 72683 - protein, 9 aa, Homo Sapiens
QRVADRLGL

SEQ ID NO: 72684 - protein, 9 aa, Homo Sapiens
QRVFPHAEF

SEQ ID NO: 72685 - protein, 9 aa, Homo Sapiens
QRVPEREAL

SEQ ID NO: 72686 - protein, 9 aa, Homo Sapiens
QRYARPPVL

SEQ ID NO: 72687 - protein, 9 aa, Homo Sapiens
QRYDHYSVL

SEQ ID NO: 72688 - protein, 9 aa, Homo Sapiens
QRYLRSSRF

SEQ ID NO: 72689 - protein, 9 aa, Homo Sapiens
QRYNSFISL

SEQ ID NO: 72690 - protein, 9 aa, Homo Sapiens
RAALRSCSL

SEQ ID NO: 72691 - protein, 9 aa, Homo Sapiens
RFTEKGPLL

SEQ ID NO: 72692 - protein, 9 aa, Homo Sapiens
RPFERTITM

SEQ ID NO: 72693 - protein, 9 aa, Homo Sapiens
RPTARINSI

SEQ ID NO: 72694 - protein, 9 aa, Homo Sapiens
RPWLRPAAL

SEQ ID NO: 72695 - protein, 9 aa, Homo Sapiens
RQVTGVTRV

SEQ ID NO: 72696 - protein, 9 aa, Homo Sapiens
RRFHFSQSL

SEQ ID NO: 72697 - protein, 9 aa, Homo Sapiens
RTLSPRGSL

SEQ ID NO: 72698 - protein, 9 aa, Homo Sapiens
SAYQRYYSL

SEQ ID NO: 72699 - protein, 9 aa, Homo Sapiens
SDLERVTSL

SEQ ID NO: 72700 - protein, 9 aa, Homo Sapiens
SDLLLHSAL

SEQ ID NO: 72701 - protein, 9 aa, Homo Sapiens
SEFERLECL

SEQ ID NO: 72702 - protein, 9 aa, Homo Sapiens
SEFGRNYSL

SEQ ID NO: 72703 - protein, 9 aa, Homo Sapiens
SEYMRLRQL

SEQ ID NO: 72704 - protein, 9 aa, Homo Sapiens
SEYQRFAVM

SEQ ID NO: 72705 - protein, 9 aa, Homo Sapiens
SGYVRGQTL

SEQ ID NO: 72706 - protein, 9 aa, Homo Sapiens
SHYERVQML

SEQ ID NO: 72707 - protein, 9 aa, Homo Sapiens
SLYRREESL

SEQ ID NO: 72708 - protein, 9 aa, Homo Sapiens
SPARTALTG

SEQ ID NO: 72709 - protein, 9 aa, Homo Sapiens
SPASRSISL

SEQ ID NO: 72710 - protein, 9 aa, Homo Sapiens
SPFKRQLSL

SEQ ID NO: 72711 - protein, 9 aa, Homo Sapiens
SPYKRDNTF

SEQ ID NO: 72712 - protein, 9 aa, Homo Sapiens
SPYLRFGCL

SEQ ID NO: 72713 - protein, 9 aa, Homo Sapiens
SPYLRPLTL

SEQ ID NO: 72714 - protein, 9 aa, Homo Sapiens
SPYQRKAGL

SEQ ID NO: 72715 - protein, 9 aa, Homo Sapiens
SQAARLLSL

SEQ ID NO: 72716 - protein, 9 aa, Homo Sapiens
SQAMRYRAL

SEQ ID NO: 72717 - protein, 9 aa, Homo Sapiens
SQFWRMVAL

SEQ ID NO: 72718 - protein, 9 aa, Homo Sapiens
SQLERENTL

SEQ ID NO: 72719 - protein, 9 aa, Homo Sapiens
SQLNRPNSL

SEQ ID NO: 72720 - protein, 9 aa, Homo Sapiens
SQLSGRRVL

SEQ ID NO: 72721 - protein, 9 aa, Homo Sapiens
SQLSRTAAL

SEQ ID NO: 72722 - protein, 9 aa, Homo Sapiens
SQMLRAVSL

SEQ ID NO: 72723 - protein, 9 aa, Homo Sapiens
SQRQGRPTL

SEQ ID NO: 72724 - protein, 9 aa, Homo Sapiens
SQTQRLEAL

SEQ ID NO: 72725 - protein, 9 aa, Homo Sapiens
SQVDRLVAL

SEQ ID NO: 72726 - protein, 9 aa, Homo Sapiens
SQVPRSSSM

SEQ ID NO: 72727 - protein, 9 aa, Homo Sapiens
SQYQRFTYL

SEQ ID NO: 72728 - protein, 9 aa, Homo Sapiens
SQYQRLLCI

SEQ ID NO: 72729 - protein, 9 aa, Homo Sapiens
SRFARLQKL

SEQ ID NO: 72730 - protein, 9 aa, Homo Sapiens
SRFEFNQSL

SEQ ID NO: 72731 - protein, 9 aa, Homo Sapiens
SRFEGLSPL

SEQ ID NO: 72732 - protein, 9 aa, Homo Sapiens
SRFNRYYSL

SEQ ID NO: 72733 - protein, 9 aa, Homo Sapiens
SRFPEALRL

SEQ ID NO: 72734 - protein, 9 aa, Homo Sapiens
SRFPRQGDL

SEQ ID NO: 72735 - protein, 9 aa, Homo Sapiens
SRFQGTLYL

SEQ ID NO: 72736 - protein, 9 aa, Homo Sapiens
SRFSHLTSL

SEQ ID NO: 72737 - protein, 9 aa, Homo Sapiens
SRHPFLTAL

SEQ ID NO: 72738 - protein, 9 aa, Homo Sapiens
SRIARTLGL

SEQ ID NO: 72739 - protein, 9 aa, Homo Sapiens
SRIEDRRIL

SEQ ID NO: 72740 - protein, 9 aa, Homo Sapiens
SRLAGRDAL

SEQ ID NO: 72741 - protein, 9 aa, Homo Sapiens
SRLEERSVL

SEQ ID NO: 72742 - protein, 9 aa, Homo Sapiens
SRLEKRSEF

SEQ ID NO: 72743 - protein, 9 aa, Homo Sapiens
SRLERREQL

SEQ ID NO: 72744 - protein, 9 aa, Homo Sapiens
SRLGSSRVL

SEQ ID NO: 72745 - protein, 9 aa, Homo Sapiens
SRLKMRAEL

SEQ ID NO: 72746 - protein, 9 aa, Homo Sapiens
SRLKSILKL

SEQ ID NO: 72747 - protein, 9 aa, Homo Sapiens
SRLLKGTSL

SEQ ID NO: 72748 - protein, 9 aa, Homo Sapiens
SRLPLRAQI

SEQ ID NO: 72749 - protein, 9 aa, Homo Sapiens
SRLSSTSSL

SEQ ID NO: 72750 - protein, 9 aa, Homo Sapiens
SRLTAREAM

SEQ ID NO: 72751 - protein, 9 aa, Homo Sapiens
SRLVKREYL

SEQ ID NO: 72752 - protein, 9 aa, Homo Sapiens
SRLVVKTAL

SEQ ID NO: 72753 - protein, 9 aa, Homo Sapiens
SRMANRDLL

SEQ ID NO: 72754 - protein, 9 aa, Homo Sapiens
SRMIRKMKL

SEQ ID NO: 72755 - protein, 9 aa, Homo Sapiens
SRMIRWTKL

SEQ ID NO: 72756 - protein, 9 aa, Homo Sapiens
SRMPGELVL

SEQ ID NO: 72757 - protein, 9 aa, Homo Sapiens
SRQQRLSAL

SEQ ID NO: 72758 - protein, 9 aa, Homo Sapiens
SRTPGRSEL

SEQ ID NO: 72759 - protein, 9 aa, Homo Sapiens
SRVAKTNSL

SEQ ID NO: 72760 - protein, 9 aa, Homo Sapiens
SRVEFRLSL

SEQ ID NO: 72761 - protein, 9 aa, Homo Sapiens
SRVIRVSEL

SEQ ID NO: 72762 - protein, 9 aa, Homo Sapiens
SRVLKVLSV

SEQ ID NO: 72763 - protein, 9 aa, Homo Sapiens
SRVNRLSVL

SEQ ID NO: 72764 - protein, 9 aa, Homo Sapiens
SRYDGQIAV

SEQ ID NO: 72765 - protein, 9 aa, Homo Sapiens
SRYEHVMKL

SEQ ID NO: 72766 - protein, 9 aa, Homo Sapiens
SRYFKGPEL

SEQ ID NO: 72767 - protein, 9 aa, Homo Sapiens
SRYFRMSDI

SEQ ID NO: 72768 - protein, 9 aa, Homo Sapiens
SRYGGGPAV

SEQ ID NO: 72769 - protein, 9 aa, Homo Sapiens
SRYGGGPRL

SEQ ID NO: 72770 - protein, 9 aa, Homo Sapiens
SRYLNEKAV

SEQ ID NO: 72771 - protein, 9 aa, Homo Sapiens
SRYLYTLVI

SEQ ID NO: 72772 - protein, 9 aa, Homo Sapiens
SRYMKLTVV

SEQ ID NO: 72773 - protein, 9 aa, Homo Sapiens
SRYMRINSL

SEQ ID NO: 72774 - protein, 9 aa, Homo Sapiens
SRYSFIQAL

SEQ ID NO: 72775 - protein, 9 aa, Homo Sapiens
SRYSMYNSV

SEQ ID NO: 72776 - protein, 9 aa, Homo Sapiens
SRYWRITNA

SEQ ID NO: 72777 - protein, 9 aa, Homo Sapiens
SRYYRAPEI

SEQ ID NO: 72778 - protein, 9 aa, Homo Sapiens
TAFKRNLSL

SEQ ID NO: 72779 - protein, 9 aa, Homo Sapiens
TDYLRQRAL

SEQ ID NO: 72780 - protein, 9 aa, Homo Sapiens
TEFKRGLPL

SEQ ID NO: 72781 - protein, 9 aa, Homo Sapiens
TEMERTLAL

SEQ ID NO: 72782 - protein, 9 aa, Homo Sapiens
TPHLRNLAV

SEQ ID NO: 72783 - protein, 9 aa, Homo Sapiens
TPISRLVAL

SEQ ID NO: 72784 - protein, 9 aa, Homo Sapiens
TQTVRVVAL

SEQ ID NO: 72785 - protein, 9 aa, Homo Sapiens
TQVKRLESL

SEQ ID NO: 72786 - protein, 9 aa, Homo Sapiens
TQYSKVLAL

SEQ ID NO: 72787 - protein, 9 aa, Homo Sapiens
TRCPLVLKL

SEQ ID NO: 72788 - protein, 9 aa, Homo Sapiens
TRFAEVECL

SEQ ID NO: 72789 - protein, 9 aa, Homo Sapiens
TRFSLARQV

SEQ ID NO: 72790 - protein, 9 aa, Homo Sapiens
TRHPFLTAL

SEQ ID NO: 72791 - protein, 9 aa, Homo Sapiens
TRIEQNLVL

SEQ ID NO: 72792 - protein, 9 aa, Homo Sapiens
TRIKKHLSL

SEQ ID NO: 72793 - protein, 9 aa, Homo Sapiens
TRILFKNTL

SEQ ID NO: 72794 - protein, 9 aa, Homo Sapiens
TRILKRITV

SEQ ID NO: 72795 - protein, 9 aa, Homo Sapiens
TRILRSAKL

SEQ ID NO: 72796 - protein, 9 aa, Homo Sapiens
TRIPKIQKL

SEQ ID NO: 72797 - protein, 9 aa, Homo Sapiens
TRLAQRLIM

SEQ ID NO: 72798 - protein, 9 aa, Homo Sapiens
TRLEFQQQL

SEQ ID NO: 72799 - protein, 9 aa, Homo Sapiens
TRLESRTQL

SEQ ID NO: 72800 - protein, 9 aa, Homo Sapiens
TRLPTPVLL

SEQ ID NO: 72801 - protein, 9 aa, Homo Sapiens
TRMPPRSVL

SEQ ID NO: 72802 - protein, 9 aa, Homo Sapiens
TRQERILAL

SEQ ID NO: 72803 - protein, 9 aa, Homo Sapiens
TRQLRNSTL

SEQ ID NO: 72804 - protein, 9 aa, Homo Sapiens
TRTEQTFIL

SEQ ID NO: 72805 - protein, 9 aa, Homo Sapiens
TRVDTILEF

SEQ ID NO: 72806 - protein, 9 aa, Homo Sapiens
TRVIKQSSL

SEQ ID NO: 72807 - protein, 9 aa, Homo Sapiens
TRVKAVRIL

SEQ ID NO: 72808 - protein, 9 aa, Homo Sapiens
TRVQSRLAL

SEQ ID NO: 72809 - protein, 9 aa, Homo Sapiens
TRYDAQLIL

SEQ ID NO: 72810 - protein, 9 aa, Homo Sapiens
TRYETYVQL

SEQ ID NO: 72811 - protein, 9 aa, Homo Sapiens
TRYLKQFHL

SEQ ID NO: 72812 - protein, 9 aa, Homo Sapiens
TRYNHMLSA

SEQ ID NO: 72813 - protein, 9 aa, Homo Sapiens
TRYNKIKAI

SEQ ID NO: 72814 - protein, 9 aa, Homo Sapiens
TVYLRDIAL

SEQ ID NO: 72815 - protein, 9 aa, Homo Sapiens
VDLERTIAL

SEQ ID NO: 72816 - protein, 9 aa, Homo Sapiens
VEFQRAQSL

SEQ ID NO: 72817 - protein, 9 aa, Homo Sapiens
VEFVRFTSL

SEQ ID NO: 72818 - protein, 9 aa, Homo Sapiens
VGLIRNLAL

SEQ ID NO: 72819 - protein, 9 aa, Homo Sapiens
VPFPRLHFF

SEQ ID NO: 72820 - protein, 9 aa, Homo Sapiens
VPMFRNVSL

SEQ ID NO: 72821 - protein, 9 aa, Homo Sapiens
VPYPRKITL

SEQ ID NO: 72822 - protein, 9 aa, Homo Sapiens
VQALRTVSL

SEQ ID NO: 72823 - protein, 9 aa, Homo Sapiens
VQAPRLAAL

SEQ ID NO: 72824 - protein, 9 aa, Homo Sapiens
VQQKRPTAL

SEQ ID NO: 72825 - protein, 9 aa, Homo Sapiens
VQVVREETL

SEQ ID NO: 72826 - protein, 9 aa, Homo Sapiens
VRAKWFPEV

SEQ ID NO: 72827 - protein, 9 aa, Homo Sapiens
VRAPPHVRF

SEQ ID NO: 72828 - protein, 9 aa, Homo Sapiens
VRFHRPYRL

SEQ ID NO: 72829 - protein, 9 aa, Homo Sapiens
VRFLEQQTL

SEQ ID NO: 72830 - protein, 9 aa, Homo Sapiens
VRFTRQDKL

SEQ ID NO: 72831 - protein, 9 aa, Homo Sapiens
VRHGRSLAL

SEQ ID NO: 72832 - protein, 9 aa, Homo Sapiens
VRIKDRNKL

SEQ ID NO: 72833 - protein, 9 aa, Homo Sapiens
VRIYDRRML

SEQ ID NO: 72834 - protein, 9 aa, Homo Sapiens
VRLAGRPQL

SEQ ID NO: 72835 - protein, 9 aa, Homo Sapiens
VRLAHREQV

SEQ ID NO: 72836 - protein, 9 aa, Homo Sapiens
VRLDREHRV

SEQ ID NO: 72837 - protein, 9 aa, Homo Sapiens
VRLHQRLQL

SEQ ID NO: 72838 - protein, 9 aa, Homo Sapiens
VRLPRQDAL

SEQ ID NO: 72839 - protein, 9 aa, Homo Sapiens
VRLWDHATM

SEQ ID NO: 72840 - protein, 9 aa, Homo Sapiens
VRMVRVLTV

SEQ ID NO: 72841 - protein, 9 aa, Homo Sapiens
VRNNLRSAL

SEQ ID NO: 72842 - protein, 9 aa, Homo Sapiens
VRNPRITSL

SEQ ID NO: 72843 - protein, 9 aa, Homo Sapiens
VRSLRTAAL

SEQ ID NO: 72844 - protein, 9 aa, Homo Sapiens
VRTVMRVPL

SEQ ID NO: 72845 - protein, 9 aa, Homo Sapiens
VRVDRDYVL

SEQ ID NO: 72846 - protein, 9 aa, Homo Sapiens
VRVIRLSSL

SEQ ID NO: 72847 - protein, 9 aa, Homo Sapiens
VRYDSSNQV

SEQ ID NO: 72848 - protein, 9 aa, Homo Sapiens
VRYKQVHAL

SEQ ID NO: 72849 - protein, 9 aa, Homo Sapiens
VRYPDRITL

SEQ ID NO: 72850 - protein, 9 aa, Homo Sapiens
VRYPGTTRV

SEQ ID NO: 72851 - protein, 9 aa, Homo Sapiens
VRYVLKEGL

SEQ ID NO: 72852 - protein, 9 aa, Homo Sapiens
VVVDRKHVP

SEQ ID NO: 72853 - protein, 9 aa, Homo Sapiens
VVYKRYASL

SEQ ID NO: 72854 - protein, 9 aa, Homo Sapiens
YDYLRPIAL

SEQ ID NO: 72855 - protein, 9 aa, Homo Sapiens
YEFERTTSI

SEQ ID NO: 72856 - protein, 9 aa, Homo Sapiens
YEMQRNLSL

SEQ ID NO: 72857 - protein, 9 aa, Homo Sapiens
YERERVVAA

SEQ ID NO: 72858 - protein, 9 aa, Homo Sapiens
YEVQRAVSL

SEQ ID NO: 72859 - protein, 9 aa, Homo Sapiens
YPAERKQAL

SEQ ID NO: 72860 - protein, 9 aa, Homo Sapiens
YQLYRNTTL

SEQ ID NO: 72861 - protein, 9 aa, Homo Sapiens
YQMEHRASL

SEQ ID NO: 72862 - protein, 9 aa, Homo Sapiens
YQQPRGVAL

SEQ ID NO: 72863 - protein, 9 aa, Homo Sapiens
YQYLLVTAL

SEQ ID NO: 72864 - protein, 9 aa, Homo Sapiens
YRFETVQKL

SEQ ID NO: 72865 - protein, 9 aa, Homo Sapiens
YRFGDSQQL

SEQ ID NO: 72866 - protein, 9 aa, Homo Sapiens
YRFKKRTEL

SEQ ID NO: 72867 - protein, 9 aa, Homo Sapiens
YRFLFNSNT

SEQ ID NO: 72868 - protein, 9 aa, Homo Sapiens
YRFLQTAEM

SEQ ID NO: 72869 - protein, 9 aa, Homo Sapiens
YRGERINQL

SEQ ID NO: 72870 - protein, 9 aa, Homo Sapiens
YRHQRIHSL

SEQ ID NO: 72871 - protein, 9 aa, Homo Sapiens
YRISRNVRL

SEQ ID NO: 72872 - protein, 9 aa, Homo Sapiens
YRLAVRTVI

SEQ ID NO: 72873 - protein, 9 aa, Homo Sapiens
YRLKAHQRL

SEQ ID NO: 72874 - protein, 9 aa, Homo Sapiens
YRLMRDNNL

SEQ ID NO: 72875 - protein, 9 aa, Homo Sapiens
YRNAYTMVL

SEQ ID NO: 72876 - protein, 9 aa, Homo Sapiens
YRSAVRATL

SEQ ID NO: 72877 - protein, 9 aa, Homo Sapiens
YRVPAKSTL

SEQ ID NO: 72878 - protein, 9 aa, Homo Sapiens
YRYGREEML

SEQ ID NO: 72879 - protein, 9 aa, Homo Sapiens
YRYLNTQFI

SEQ ID NO: 72880 - protein, 9 aa, Homo Sapiens
YRYMNPAIV

SEQ ID NO: 72881 - protein, 9 aa, Homo Sapiens
YRYNPRPRL

SEQ ID NO: 72882 - protein, 9 aa, Homo Sapiens
YRYPRPASV

SEQ ID NO: 72883 - protein, 9 aa, Homo Sapiens
YRYYQQLKL

SEQ ID NO: 72884 - protein, 10 aa, Homo Sapiens
AAGPPISEGK

SEQ ID NO: 72885 - protein, 10 aa, Homo Sapiens
AGAGIALNDH

SEQ ID NO: 72886 - protein, 10 aa, Homo Sapiens
APAYQRFHAL

SEQ ID NO: 72887 - protein, 10 aa, Homo Sapiens
AVSSDTLVAA

SEQ ID NO: 72888 - protein, 10 aa, Homo Sapiens
DPRHGRYLTV

SEQ ID NO: 72889 - protein, 10 aa, Homo Sapiens
DQYARIWNAL

SEQ ID NO: 72890 - protein, 10 aa, Homo Sapiens
DQYMRTGEGF

SEQ ID NO: 72891 - protein, 10 aa, Homo Sapiens
DRAPSRKDSL

SEQ ID NO: 72892 - protein, 10 aa, Homo Sapiens
DRDTRRDVTL

SEQ ID NO: 72893 - protein, 10 aa, Homo Sapiens
DRFHEMHVAL

SEQ ID NO: 72894 - protein, 10 aa, Homo Sapiens
DRFNHFSLTL

SEQ ID NO: 72895 - protein, 10 aa, Homo Sapiens
DRFSDSHNAL

SEQ ID NO: 72896 - protein, 10 aa, Homo Sapiens
DRLAHEIEAL

SEQ ID NO: 72897 - protein, 10 aa, Homo Sapiens
DRLDLARKEL

SEQ ID NO: 72898 - protein, 10 aa, Homo Sapiens
DRLKAIRTTL

SEQ ID NO: 72899 - protein, 10 aa, Homo Sapiens
DRLNKVISEL

SEQ ID NO: 72900 - protein, 10 aa, Homo Sapiens
DRLRTERDSL

SEQ ID NO: 72901 - protein, 10 aa, Homo Sapiens
DRMFHIRAVI

SEQ ID NO: 72902 - protein, 10 aa, Homo Sapiens
DRMLRSAMRL

SEQ ID NO: 72903 - protein, 10 aa, Homo Sapiens
DRMQKEITAL

SEQ ID NO: 72904 - protein, 10 aa, Homo Sapiens
DRYDAPGIAL

SEQ ID NO: 72905 - protein, 10 aa, Homo Sapiens
DRYLQSGGGM

SEQ ID NO: 72906 - protein, 10 aa, Homo Sapiens
DRYMRLKEEL

SEQ ID NO: 72907 - protein, 10 aa, Homo Sapiens
DRYVAIARAL

SEQ ID NO: 72908 - protein, 10 aa, Homo Sapiens
EEQLQQIRAE

SEQ ID NO: 72909 - protein, 10 aa, Homo Sapiens
ENYDRGYSSL

SEQ ID NO: 72910 - protein, 10 aa, Homo Sapiens
ERFDGMLLAM

SEQ ID NO: 72911 - protein, 10 aa, Homo Sapiens
FEAEVLHTVL

SEQ ID NO: 72912 - protein, 10 aa, Homo Sapiens
GELFLRRISL

SEQ ID NO: 72913 - protein, 10 aa, Homo Sapiens
HDKYERLVKL

SEQ ID NO: 72914 - protein, 10 aa, Homo Sapiens
IEYLAHWLYH

SEQ ID NO: 72915 - protein, 10 aa, Homo Sapiens
IRLTGGEPLI

SEQ ID NO: 72916 - protein, 10 aa, Homo Sapiens
IRYERDNNFL

SEQ ID NO: 72917 - protein, 10 aa, Homo Sapiens
IRYSGQYREL

SEQ ID NO: 72918 - protein, 10 aa, Homo Sapiens
LRYADRVKEL

SEQ ID NO: 72919 - protein, 10 aa, Homo Sapiens
MEYERQVASL

SEQ ID NO: 72920 - protein, 10 aa, Homo Sapiens
MRLGPRTAAL

SEQ ID NO: 72921 - protein, 10 aa, Homo Sapiens
NRFAGFGIGL

SEQ ID NO: 72922 - protein, 10 aa, Homo Sapiens
NRLLKQREEL

SEQ ID NO: 72923 - protein, 10 aa, Homo Sapiens
NRYDGIYKVV

SEQ ID NO: 72924 - protein, 10 aa, Homo Sapiens
NRYDGQVAVF

SEQ ID NO: 72925 - protein, 10 aa, Homo Sapiens
NRYDKKIDSL

SEQ ID NO: 72926 - protein, 10 aa, Homo Sapiens
NRYHVPVVVV

SEQ ID NO: 72927 - protein, 10 aa, Homo Sapiens
NRYMNHMQSL

SEQ ID NO: 72928 - protein, 10 aa, Homo Sapiens
NRYPASSLVV

SEQ ID NO: 72929 - protein, 10 aa, Homo Sapiens
RRYSATRAAL

SEQ ID NO: 72930 - protein, 10 aa, Homo Sapiens
SIPYKREESL

SEQ ID NO: 72931 - protein, 10 aa, Homo Sapiens
SMPRINHGVL

SEQ ID NO: 72932 - protein, 10 aa, Homo Sapiens
SRFAGYVTSI

SEQ ID NO: 72933 - protein, 10 aa, Homo Sapiens
SRMSERQLAL

SEQ ID NO: 72934 - protein, 10 aa, Homo Sapiens
SRMSERQVAL

SEQ ID NO: 72935 - protein, 10 aa, Homo Sapiens
SRYQAQHGAL

SEQ ID NO: 72936 - protein, 10 aa, Homo Sapiens
TRFDPTWESL

SEQ ID NO: 72937 - protein, 10 aa, Homo Sapiens
TRYSRNDLHL

SEQ ID NO: 72938 - protein, 10 aa, Homo Sapiens
VHYDRSGRSL

SEQ ID NO: 72939 - protein, 10 aa, Homo Sapiens
VKYVIIQQNL

SEQ ID NO: 72940 - protein, 10 aa, Homo Sapiens
VRFDVHDVTL

SEQ ID NO: 72941 - protein, 10 aa, Homo Sapiens
YRFNGQYSSL

SEQ ID NO: 72942 - protein, 10 aa, Homo Sapiens
YRNESARESL

SEQ ID NO: 72943 - protein, 11 aa, Homo Sapiens
AFEAEVLHTVL

SEQ ID NO: 72944 - protein, 11 aa, Homo Sapiens
APYMRSMMQSL

SEQ ID NO: 72945 - protein, 11 aa, Homo Sapiens
AVHYDRSGRSL

SEQ ID NO: 72946 - protein, 11 aa, Homo Sapiens
CRLPRGLAGAL

SEQ ID NO: 72947 - protein, 11 aa, Homo Sapiens
DAISRRAIWDL

SEQ ID NO: 72948 - protein, 11 aa, Homo Sapiens
DEYVRGLHAQL

SEQ ID NO: 72949 - protein, 11 aa, Homo Sapiens
DHMLRGMPLSL

SEQ ID NO: 72950 - protein, 11 aa, Homo Sapiens
DNYKRVTGTSL

SEQ ID NO: 72951 - protein, 11 aa, Homo Sapiens
DQFSRSVNVSL

SEQ ID NO: 72952 - protein, 11 aa, Homo Sapiens
DQLSRLGSSSL

SEQ ID NO: 72953 - protein, 11 aa, Homo Sapiens
DQYMRTGEGFL

SEQ ID NO: 72954 - protein, 11 aa, Homo Sapiens
DRIQRNKAAAL

SEQ ID NO: 72955 - protein, 11 aa, Homo Sapiens
DRLSKGGRLCL

SEQ ID NO: 72956 - protein, 11 aa, Homo Sapiens
DRYNPENLATL

SEQ ID NO: 72957 - protein, 11 aa, Homo Sapiens
DRYQGNQDRVL

SEQ ID NO: 72958 - protein, 11 aa, Homo Sapiens
GIDRYPRKVTA

SEQ ID NO: 72959 - protein, 11 aa, Homo Sapiens
HHFQRGDGAAL

SEQ ID NO: 72960 - protein, 11 aa, Homo Sapiens
HTSDRALHAKL

SEQ ID NO: 72961 - protein, 11 aa, Homo Sapiens
LKPPHPHHRAL

SEQ ID NO: 72962 - protein, 11 aa, Homo Sapiens
LRYDHQSRLTA

SEQ ID NO: 72963 - protein, 11 aa, Homo Sapiens
MDLELSLTSTY

SEQ ID NO: 72964 - protein, 11 aa, Homo Sapiens
NRLENDGATAL

SEQ ID NO: 72965 - protein, 11 aa, Homo Sapiens
QDNRALRGQSL

SEQ ID NO: 72966 - protein, 11 aa, Homo Sapiens
QRLEKHELIEF

SEQ ID NO: 72967 - protein, 11 aa, Homo Sapiens
SRYLRPPNTSL

SEQ ID NO: 72968 - protein, 11 aa, Homo Sapiens
TASDLLLHSAL

SEQ ID NO: 72969 - protein, 11 aa, Homo Sapiens
TEENRVLHQEL

SEQ ID NO: 72970 - protein, 11 aa, Homo Sapiens
VNDPRPQHKYN

SEQ ID NO: 72971 - protein, 8 aa, Homo Sapiens
ADVQKERY

SEQ ID NO: 72972 - protein, 8 aa, Homo Sapiens
ALQEAHLC

SEQ ID NO: 72973 - protein, 8 aa, Homo Sapiens
ANKLITVY

SEQ ID NO: 72974 - protein, 8 aa, Homo Sapiens
AQAAIVVY

SEQ ID NO: 72975 - protein, 8 aa, Homo Sapiens
AQAAPQTY

SEQ ID NO: 72976 - protein, 8 aa, Homo Sapiens
AQAESLRY

SEQ ID NO: 72977 - protein, 8 aa, Homo Sapiens
AQAVINAY

SEQ ID NO: 72978 - protein, 8 aa, Homo Sapiens
AQIIQRSF

SEQ ID NO: 72979 - protein, 8 aa, Homo Sapiens
AQKEIATL

SEQ ID NO: 72980 - protein, 8 aa, Homo Sapiens
AQKLLEQY

SEQ ID NO: 72981 - protein, 8 aa, Homo Sapiens
AQKQLLEY

SEQ ID NO: 72982 - protein, 8 aa, Homo Sapiens
AQKTSLRY

SEQ ID NO: 72983 - protein, 8 aa, Homo Sapiens
AQKVIYTL

SEQ ID NO: 72984 - protein, 8 aa, Homo Sapiens
AQLLQYRA

SEQ ID NO: 72985 - protein, 8 aa, Homo Sapiens
AQLTHTQF

SEQ ID NO: 72986 - protein, 8 aa, Homo Sapiens
AQMEVASF

SEQ ID NO: 72987 - protein, 8 aa, Homo Sapiens
AQMPTVHY

SEQ ID NO: 72988 - protein, 8 aa, Homo Sapiens
AQQPSYVY

SEQ ID NO: 72989 - protein, 8 aa, Homo Sapiens
AQRASVAF

SEQ ID NO: 72990 - protein, 8 aa, Homo Sapiens
AQRHVLTY

SEQ ID NO: 72991 - protein, 8 aa, Homo Sapiens
AQRIVEKL

SEQ ID NO: 72992 - protein, 8 aa, Homo Sapiens
AQRLIRMY

SEQ ID NO: 72993 - protein, 8 aa, Homo Sapiens
AQRLVRVL

SEQ ID NO: 72994 - protein, 8 aa, Homo Sapiens
AQRPTATY

SEQ ID NO: 72995 - protein, 8 aa, Homo Sapiens
AQTVGNTY

SEQ ID NO: 72996 - protein, 8 aa, Homo Sapiens
AQTVVVEY

SEQ ID NO: 72997 - protein, 8 aa, Homo Sapiens
ARVIIEKY

SEQ ID NO: 72998 - protein, 8 aa, Homo Sapiens
ASKVVTVF

SEQ ID NO: 72999 - protein, 8 aa, Homo Sapiens
AVYKVSEY

SEQ ID NO: 73000 - protein, 8 aa, Homo Sapiens
EEQLQQIR

SEQ ID NO: 73001 - protein, 8 aa, Homo Sapiens
EQRKIVEF

SEQ ID NO: 73002 - protein, 8 aa, Homo Sapiens
FNEKSKEL

SEQ ID NO: 73003 - protein, 8 aa, Homo Sapiens
FQHVGKAF

SEQ ID NO: 73004 - protein, 8 aa, Homo Sapiens
FQKIVVLF

SEQ ID NO: 73005 - protein, 8 aa, Homo Sapiens
FQKPISTL

SEQ ID NO: 73006 - protein, 8 aa, Homo Sapiens
FQKVITEY

SEQ ID NO: 73007 - protein, 8 aa, Homo Sapiens
FQMEQIVY

SEQ ID NO: 73008 - protein, 8 aa, Homo Sapiens
FQNDIHVY

SEQ ID NO: 73009 - protein, 8 aa, Homo Sapiens
FQTTISKY

SEQ ID NO: 73010 - protein, 8 aa, Homo Sapiens
GGKLMITY

SEQ ID NO: 73011 - protein, 8 aa, Homo Sapiens
GQAPGYSY

SEQ ID NO: 73012 - protein, 8 aa, Homo Sapiens
GQFGVGFY

SEQ ID NO: 73013 - protein, 8 aa, Homo Sapiens
GQHPALSY

SEQ ID NO: 73014 - protein, 8 aa, Homo Sapiens
GQIEVVKY

SEQ ID NO: 73015 - protein, 8 aa, Homo Sapiens
GQITHIQY

SEQ ID NO: 73016 - protein, 8 aa, Homo Sapiens
GQKKVEEL

SEQ ID NO: 73017 - protein, 8 aa, Homo Sapiens
GQKSLRSY

SEQ ID NO: 73018 - protein, 8 aa, Homo Sapiens
GQRLVYQF

SEQ ID NO: 73019 - protein, 8 aa, Homo Sapiens
GQRVIGHY

SEQ ID NO: 73020 - protein, 8 aa, Homo Sapiens
GQRVISMY

SEQ ID NO: 73021 - protein, 8 aa, Homo Sapiens
GQTLFAGY

SEQ ID NO: 73022 - protein, 8 aa, Homo Sapiens
GQTSIRPY

SEQ ID NO: 73023 - protein, 8 aa, Homo Sapiens
GQYTGHEY

SEQ ID NO: 73024 - protein, 8 aa, Homo Sapiens
GSIYIHVY

SEQ ID NO: 73025 - protein, 8 aa, Homo Sapiens
GSRVISHY

SEQ ID NO: 73026 - protein, 8 aa, Homo Sapiens
HGHLSAVY

SEQ ID NO: 73027 - protein, 8 aa, Homo Sapiens
HQFLQNEY

SEQ ID NO: 73028 - protein, 8 aa, Homo Sapiens
HQHLAAGY

SEQ ID NO: 73029 - protein, 8 aa, Homo Sapiens
HQHTISTL

SEQ ID NO: 73030 - protein, 8 aa, Homo Sapiens
HQHVPAGY

SEQ ID NO: 73031 - protein, 8 aa, Homo Sapiens
HQKQISSL

SEQ ID NO: 73032 - protein, 8 aa, Homo Sapiens
HQLAVTAY

SEQ ID NO: 73033 - protein, 8 aa, Homo Sapiens
HQNLIATY

SEQ ID NO: 73034 - protein, 8 aa, Homo Sapiens
HQNVSILY

SEQ ID NO: 73035 - protein, 8 aa, Homo Sapiens
HQREIFLF

SEQ ID NO: 73036 - protein, 8 aa, Homo Sapiens
HQREIQVM

SEQ ID NO: 73037 - protein, 8 aa, Homo Sapiens
HQREITSL

SEQ ID NO: 73038 - protein, 8 aa, Homo Sapiens
HQRLIFRL

SEQ ID NO: 73039 - protein, 8 aa, Homo Sapiens
HQVEIKVY

SEQ ID NO: 73040 - protein, 8 aa, Homo Sapiens
HQVVVAKY

SEQ ID NO: 73041 - protein, 8 aa, Homo Sapiens
HQYHIRAY

SEQ ID NO: 73042 - protein, 8 aa, Homo Sapiens
HQYKVRAY

SEQ ID NO: 73043 - protein, 8 aa, Homo Sapiens
HSKVLYVY

SEQ ID NO: 73044 - protein, 8 aa, Homo Sapiens
HSVLIHEY

SEQ ID NO: 73045 - protein, 8 aa, Homo Sapiens
HTFLHTVY

SEQ ID NO: 73046 - protein, 8 aa, Homo Sapiens
IGKVVQVY

SEQ ID NO: 73047 - protein, 8 aa, Homo Sapiens
IKDKQVKY

SEQ ID NO: 73048 - protein, 8 aa, Homo Sapiens
IKVGGERF

SEQ ID NO: 73049 - protein, 8 aa, Homo Sapiens
ILMPNIGY

SEQ ID NO: 73050 - protein, 8 aa, Homo Sapiens
IQHPSNVL

SEQ ID NO: 73051 - protein, 8 aa, Homo Sapiens
IQKIIETL

SEQ ID NO: 73052 - protein, 8 aa, Homo Sapiens
IQKNVQLY

SEQ ID NO: 73053 - protein, 8 aa, Homo Sapiens
IQKQVSVL

SEQ ID NO: 73054 - protein, 8 aa, Homo Sapiens
IQRKVEKL

SEQ ID NO: 73055 - protein, 8 aa, Homo Sapiens
IQTHVLSY

SEQ ID NO: 73056 - protein, 8 aa, Homo Sapiens
ISKALVAY

SEQ ID NO: 73057 - protein, 8 aa, Homo Sapiens
ISRELYEY

SEQ ID NO: 73058 - protein, 8 aa, Homo Sapiens
IVKEVSTY

SEQ ID NO: 73059 - protein, 8 aa, Homo Sapiens
KQFKSEAY

SEQ ID NO: 73060 - protein, 8 aa, Homo Sapiens
KQKLILKY

SEQ ID NO: 73061 - protein, 8 aa, Homo Sapiens
KQRQLTSY

SEQ ID NO: 73062 - protein, 8 aa, Homo Sapiens
KQYKVVVY

SEQ ID NO: 73063 - protein, 8 aa, Homo Sapiens
LAKQITSY

SEQ ID NO: 73064 - protein, 8 aa, Homo Sapiens
LAKQVIEY

SEQ ID NO: 73065 - protein, 8 aa, Homo Sapiens
LIKKDVNY

SEQ ID NO: 73066 - protein, 8 aa, Homo Sapiens
LKEKIAKY

SEQ ID NO: 73067 - protein, 8 aa, Homo Sapiens
LLKGIDRY

SEQ ID NO: 73068 - protein, 8 aa, Homo Sapiens
LNITNVAF

SEQ ID NO: 73069 - protein, 8 aa, Homo Sapiens
LQKLISQL

SEQ ID NO: 73070 - protein, 8 aa, Homo Sapiens
LQKQSVVY

SEQ ID NO: 73071 - protein, 8 aa, Homo Sapiens
LQKVITLY

SEQ ID NO: 73072 - protein, 8 aa, Homo Sapiens
LQNSVKQY

SEQ ID NO: 73073 - protein, 8 aa, Homo Sapiens
LQQAKDEI

SEQ ID NO: 73074 - protein, 8 aa, Homo Sapiens
LSKRQGLF

SEQ ID NO: 73075 - protein, 8 aa, Homo Sapiens
LVHLAIRF

SEQ ID NO: 73076 - protein, 8 aa, Homo Sapiens
LVKAGKVY

SEQ ID NO: 73077 - protein, 8 aa, Homo Sapiens
MQIFVKTL

SEQ ID NO: 73078 - protein, 8 aa, Homo Sapiens
MQKEITAL

SEQ ID NO: 73079 - protein, 8 aa, Homo Sapiens
MQRLIEKY

SEQ ID NO: 73080 - protein, 8 aa, Homo Sapiens
NQIVVSDY

SEQ ID NO: 73081 - protein, 8 aa, Homo Sapiens
NSKVVSQY

SEQ ID NO: 73082 - protein, 8 aa, Homo Sapiens
NTKLPSSF

SEQ ID NO: 73083 - protein, 8 aa, Homo Sapiens
PQMKVNEY

SEQ ID NO: 73084 - protein, 8 aa, Homo Sapiens
QALILKIA

SEQ ID NO: 73085 - protein, 8 aa, Homo Sapiens
QQNEVRVL

SEQ ID NO: 73086 - protein, 8 aa, Homo Sapiens
QQRVVRVY

SEQ ID NO: 73087 - protein, 8 aa, Homo Sapiens
RAKLLQKY

SEQ ID NO: 73088 - protein, 8 aa, Homo Sapiens
RIMKAQAY

SEQ ID NO: 73089 - protein, 8 aa, Homo Sapiens
RQFCTGEF

SEQ ID NO: 73090 - protein, 8 aa, Homo Sapiens
RQIEITIY

SEQ ID NO: 73091 - protein, 8 aa, Homo Sapiens
RQIGSRSY

SEQ ID NO: 73092 - protein, 8 aa, Homo Sapiens
RQKAVSLF

SEQ ID NO: 73093 - protein, 8 aa, Homo Sapiens
RQKQMKVL

SEQ ID NO: 73094 - protein, 8 aa, Homo Sapiens
RQKQVVIL

SEQ ID NO: 73095 - protein, 8 aa, Homo Sapiens
RQLEAARY

SEQ ID NO: 73096 - protein, 8 aa, Homo Sapiens
RQRIVQQY

SEQ ID NO: 73097 - protein, 8 aa, Homo Sapiens
SKEEAEAL

SEQ ID NO: 73098 - protein, 8 aa, Homo Sapiens
SKNLSSIS

SEQ ID NO: 73099 - protein, 8 aa, Homo Sapiens
SQAIIHQY

SEQ ID NO: 73100 - protein, 8 aa, Homo Sapiens
SQALIEAY

SEQ ID NO: 73101 - protein, 8 aa, Homo Sapiens
SQHASETF

SEQ ID NO: 73102 - protein, 8 aa, Homo Sapiens
SQHVVTNY

SEQ ID NO: 73103 - protein, 8 aa, Homo Sapiens
SQIQNREF

SEQ ID NO: 73104 - protein, 8 aa, Homo Sapiens
SQIRLIVY

SEQ ID NO: 73105 - protein, 8 aa, Homo Sapiens
SQKEKLSH

SEQ ID NO: 73106 - protein, 8 aa, Homo Sapiens
SQKEVVLY

SEQ ID NO: 73107 - protein, 8 aa, Homo Sapiens
SQLLVHVL

SEQ ID NO: 73108 - protein, 8 aa, Homo Sapiens
SQMVISFY

SEQ ID NO: 73109 - protein, 8 aa, Homo Sapiens
SQNFHTSY

SEQ ID NO: 73110 - protein, 8 aa, Homo Sapiens
SQNRVAEF

SEQ ID NO: 73111 - protein, 8 aa, Homo Sapiens
SQRAGLQF

SEQ ID NO: 73112 - protein, 8 aa, Homo Sapiens
SQRIFITY

SEQ ID NO: 73113 - protein, 8 aa, Homo Sapiens
SQRMVEGY

SEQ ID NO: 73114 - protein, 8 aa, Homo Sapiens
SQRSVRLY

SEQ ID NO: 73115 - protein, 8 aa, Homo Sapiens
SQYRIKEY

SEQ ID NO: 73116 - protein, 8 aa, Homo Sapiens
SSFKVAQY

SEQ ID NO: 73117 - protein, 8 aa, Homo Sapiens
TEELAYLK

SEQ ID NO: 73118 - protein, 8 aa, Homo Sapiens
TGKLISSY

SEQ ID NO: 73119 - protein, 8 aa, Homo Sapiens
TQKQVLNY

SEQ ID NO: 73120 - protein, 8 aa, Homo Sapiens
TQKVTAGY

SEQ ID NO: 73121 - protein, 8 aa, Homo Sapiens
TQRLISEL

SEQ ID NO: 73122 - protein, 8 aa, Homo Sapiens
TQRLVQVM

SEQ ID NO: 73123 - protein, 8 aa, Homo Sapiens
TQTLVREY

SEQ ID NO: 73124 - protein, 8 aa, Homo Sapiens
TQVILREY

SEQ ID NO: 73125 - protein, 8 aa, Homo Sapiens
TQVLNTHY

SEQ ID NO: 73126 - protein, 8 aa, Homo Sapiens
TQYIIHNY

SEQ ID NO: 73127 - protein, 8 aa, Homo Sapiens
TVGNNKTL

SEQ ID NO: 73128 - protein, 8 aa, Homo Sapiens
VAMYVHAY

SEQ ID NO: 73129 - protein, 8 aa, Homo Sapiens
VQELQNLL

SEQ ID NO: 73130 - protein, 8 aa, Homo Sapiens
VQKAIAHY

SEQ ID NO: 73131 - protein, 8 aa, Homo Sapiens
VQKAIPMY

SEQ ID NO: 73132 - protein, 8 aa, Homo Sapiens
VQKILQDY

SEQ ID NO: 73133 - protein, 8 aa, Homo Sapiens
VQQVAAEY

SEQ ID NO: 73134 - protein, 8 aa, Homo Sapiens
VQRAVCML

SEQ ID NO: 73135 - protein, 8 aa, Homo Sapiens
VQRNVNVF

SEQ ID NO: 73136 - protein, 8 aa, Homo Sapiens
VQRVASVM

SEQ ID NO: 73137 - protein, 8 aa, Homo Sapiens
VQTLVEKY

SEQ ID NO: 73138 - protein, 8 aa, Homo Sapiens
VSAVVHEY

SEQ ID NO: 73139 - protein, 8 aa, Homo Sapiens
VSKCLTEY

SEQ ID NO: 73140 - protein, 8 aa, Homo Sapiens
YHIRNQTY

SEQ ID NO: 73141 - protein, 8 aa, Homo Sapiens
YQKAIEVL

SEQ ID NO: 73142 - protein, 8 aa, Homo Sapiens
YQKEVSHL

SEQ ID NO: 73143 - protein, 8 aa, Homo Sapiens
YQKKLRSM

SEQ ID NO: 73144 - protein, 8 aa, Homo Sapiens
YQKLLKYY

SEQ ID NO: 73145 - protein, 8 aa, Homo Sapiens
YQQIIQTY

SEQ ID NO: 73146 - protein, 8 aa, Homo Sapiens
YQQTIKKY

SEQ ID NO: 73147 - protein, 8 aa, Homo Sapiens
YQSPVRVY

SEQ ID NO: 73148 - protein, 8 aa, Homo Sapiens
YQYTIRAH

SEQ ID NO: 73149 - protein, 8 aa, Homo Sapiens
YSHLVPVY

SEQ ID NO: 73150 - protein, 9 aa, Homo Sapiens
AAAAAAAAY

SEQ ID NO: 73151 - protein, 9 aa, Homo Sapiens
AAAAAAAQY

SEQ ID NO: 73152 - protein, 9 aa, Homo Sapiens
AAAAAQSVY

SEQ ID NO: 73153 - protein, 9 aa, Homo Sapiens
AAANPTLAF

SEQ ID NO: 73154 - protein, 9 aa, Homo Sapiens
AAAPAGTTF

SEQ ID NO: 73155 - protein, 9 aa, Homo Sapiens
AAAPPALCY

SEQ ID NO: 73156 - protein, 9 aa, Homo Sapiens
AAAPVIKAY

SEQ ID NO: 73157 - protein, 9 aa, Homo Sapiens
AAAVPRAAF

SEQ ID NO: 73158 - protein, 9 aa, Homo Sapiens
AAAVPTRSY

SEQ ID NO: 73159 - protein, 9 aa, Homo Sapiens
AACQIARAY

SEQ ID NO: 73160 - protein, 9 aa, Homo Sapiens
AAFPGASLY

SEQ ID NO: 73161 - protein, 9 aa, Homo Sapiens
AAHPSEATF

SEQ ID NO: 73162 - protein, 9 aa, Homo Sapiens
AAHTVTAAY

SEQ ID NO: 73163 - protein, 9 aa, Homo Sapiens
AAIRENPVY

SEQ ID NO: 73164 - protein, 9 aa, Homo Sapiens
AAMPRPVSY

SEQ ID NO: 73165 - protein, 9 aa, Homo Sapiens
AANPAYGRY

SEQ ID NO: 73166 - protein, 9 aa, Homo Sapiens
AANPHSFVF

SEQ ID NO: 73167 - protein, 9 aa, Homo Sapiens
AANPISGHY

SEQ ID NO: 73168 - protein, 9 aa, Homo Sapiens
AARVIIEKY

SEQ ID NO: 73169 - protein, 9 aa, Homo Sapiens
AASRIKTIY

SEQ ID NO: 73170 - protein, 9 aa, Homo Sapiens
AAVGTGSSY

SEQ ID NO: 73171 - protein, 9 aa, Homo Sapiens
AAYGYGIRY

SEQ ID NO: 73172 - protein, 9 aa, Homo Sapiens
AEKECKIEY

SEQ ID NO: 73173 - protein, 9 aa, Homo Sapiens
AERLVEIQY

SEQ ID NO: 73174 - protein, 9 aa, Homo Sapiens
AFIITGQTY

SEQ ID NO: 73175 - protein, 9 aa, Homo Sapiens
AFKKGDRVF

SEQ ID NO: 73176 - protein, 9 aa, Homo Sapiens
AGAPPGTAY

SEQ ID NO: 73177 - protein, 9 aa, Homo Sapiens
AGFAAIVAY

SEQ ID NO: 73178 - protein, 9 aa, Homo Sapiens
AGHAIITNY

SEQ ID NO: 73179 - protein, 9 aa, Homo Sapiens
AGHLSTAQY

SEQ ID NO: 73180 - protein, 9 aa, Homo Sapiens
AGIFPRLSF

SEQ ID NO: 73181 - protein, 9 aa, Homo Sapiens
AGKMITAAY

SEQ ID NO: 73182 - protein, 9 aa, Homo Sapiens
AGKTVVAEY

SEQ ID NO: 73183 - protein, 9 aa, Homo Sapiens
AGQKATAAF

SEQ ID NO: 73184 - protein, 9 aa, Homo Sapiens
AGRLLLENY

SEQ ID NO: 73185 - protein, 9 aa, Homo Sapiens
AIANLQRAY

SEQ ID NO: 73186 - protein, 9 aa, Homo Sapiens
AIAPNVTVM

SEQ ID NO: 73187 - protein, 9 aa, Homo Sapiens
AIATGGAVF

SEQ ID NO: 73188 - protein, 9 aa, Homo Sapiens
AIATLAACY

SEQ ID NO: 73189 - protein, 9 aa, Homo Sapiens
AIFPNGAAY

SEQ ID NO: 73190 - protein, 9 aa, Homo Sapiens
AIFPSPMMY

SEQ ID NO: 73191 - protein, 9 aa, Homo Sapiens
AIFRPGTSF

SEQ ID NO: 73192 - protein, 9 aa, Homo Sapiens
AIFSKNSKY

SEQ ID NO: 73193 - protein, 9 aa, Homo Sapiens
AIHTGEKPY

SEQ ID NO: 73194 - protein, 9 aa, Homo Sapiens
AIIADSSTF

SEQ ID NO: 73195 - protein, 9 aa, Homo Sapiens
AIIAPHAGY

SEQ ID NO: 73196 - protein, 9 aa, Homo Sapiens
AIIDILTHY

SEQ ID NO: 73197 - protein, 9 aa, Homo Sapiens
AIIDTVINY

SEQ ID NO: 73198 - protein, 9 aa, Homo Sapiens
AIIERTASF

SEQ ID NO: 73199 - protein, 9 aa, Homo Sapiens
AIIERVQRY

SEQ ID NO: 73200 - protein, 9 aa, Homo Sapiens
AIIPSHLAY

SEQ ID NO: 73201 - protein, 9 aa, Homo Sapiens
AIITPQTCY

SEQ ID NO: 73202 - protein, 9 aa, Homo Sapiens
AIITTHLQY

SEQ ID NO: 73203 - protein, 9 aa, Homo Sapiens
AIKAFIAVY

SEQ ID NO: 73204 - protein, 9 aa, Homo Sapiens
AIKDKQVKY

SEQ ID NO: 73205 - protein, 9 aa, Homo Sapiens
AIKGVGRRY

SEQ ID NO: 73206 - protein, 9 aa, Homo Sapiens
AIKIEVATY

SEQ ID NO: 73207 - protein, 9 aa, Homo Sapiens
AIKPGTPLY

SEQ ID NO: 73208 - protein, 9 aa, Homo Sapiens
AIKPTSKEF

SEQ ID NO: 73209 - protein, 9 aa, Homo Sapiens
AILDYYKTG

SEQ ID NO: 73210 - protein, 9 aa, Homo Sapiens
AINASTGNY

SEQ ID NO: 73211 - protein, 9 aa, Homo Sapiens
AIQEVMESY

SEQ ID NO: 73212 - protein, 9 aa, Homo Sapiens
AIQPGSINY

SEQ ID NO: 73213 - protein, 9 aa, Homo Sapiens
AIRKELNEF

SEQ ID NO: 73214 - protein, 9 aa, Homo Sapiens
AIRQQIESY

SEQ ID NO: 73215 - protein, 9 aa, Homo Sapiens
AIRVELVQY

SEQ ID NO: 73216 - protein, 9 aa, Homo Sapiens
AISPSSLTY

SEQ ID NO: 73217 - protein, 9 aa, Homo Sapiens
AIYGGSASY

SEQ ID NO: 73218 - protein, 9 aa, Homo Sapiens
AKAPPTACY

SEQ ID NO: 73219 - protein, 9 aa, Homo Sapiens
ALAADHTVY

SEQ ID NO: 73220 - protein, 9 aa, Homo Sapiens
ALAGTFHYY

SEQ ID NO: 73221 - protein, 9 aa, Homo Sapiens
ALAIMCRVY

SEQ ID NO: 73222 - protein, 9 aa, Homo Sapiens
ALAPAGFSY

SEQ ID NO: 73223 - protein, 9 aa, Homo Sapiens
ALAPSFVEF

SEQ ID NO: 73224 - protein, 9 aa, Homo Sapiens
ALASAVSGY

SEQ ID NO: 73225 - protein, 9 aa, Homo Sapiens
ALATALCPH

SEQ ID NO: 73226 - protein, 9 aa, Homo Sapiens
ALAVIITSY

SEQ ID NO: 73227 - protein, 9 aa, Homo Sapiens
ALCDIKQAY

SEQ ID NO: 73228 - protein, 9 aa, Homo Sapiens
ALCKLGVVY

SEQ ID NO: 73229 - protein, 9 aa, Homo Sapiens
ALFASQEKF

SEQ ID NO: 73230 - protein, 9 aa, Homo Sapiens
ALFAVPKNY

SEQ ID NO: 73231 - protein, 9 aa, Homo Sapiens
ALFGGSQKY

SEQ ID NO: 73232 - protein, 9 aa, Homo Sapiens
ALFLEHEGY

SEQ ID NO: 73233 - protein, 9 aa, Homo Sapiens
ALFRHEVGY

SEQ ID NO: 73234 - protein, 9 aa, Homo Sapiens
ALGSFVEEY

SEQ ID NO: 73235 - protein, 9 aa, Homo Sapiens
ALIEGGMKY

SEQ ID NO: 73236 - protein, 9 aa, Homo Sapiens
ALIKDREGY

SEQ ID NO: 73237 - protein, 9 aa, Homo Sapiens
ALIKSGLGF

SEQ ID NO: 73238 - protein, 9 aa, Homo Sapiens
ALIPETTTL

SEQ ID NO: 73239 - protein, 9 aa, Homo Sapiens
ALIQSFSHY

SEQ ID NO: 73240 - protein, 9 aa, Homo Sapiens
ALKECLTAY

SEQ ID NO: 73241 - protein, 9 aa, Homo Sapiens
ALKEDAATF

SEQ ID NO: 73242 - protein, 9 aa, Homo Sapiens
ALKEDMSGY

SEQ ID NO: 73243 - protein, 9 aa, Homo Sapiens
ALKIKEITY

SEQ ID NO: 73244 - protein, 9 aa, Homo Sapiens
ALKNPSEEY

SEQ ID NO: 73245 - protein, 9 aa, Homo Sapiens
ALKNRQELY

SEQ ID NO: 73246 - protein, 9 aa, Homo Sapiens
ALKNVTVSF

SEQ ID NO: 73247 - protein, 9 aa, Homo Sapiens
ALKPGLSAY

SEQ ID NO: 73248 - protein, 9 aa, Homo Sapiens
ALKPSVKVY

SEQ ID NO: 73249 - protein, 9 aa, Homo Sapiens
ALLKIEGVY

SEQ ID NO: 73250 - protein, 9 aa, Homo Sapiens
ALMGEHIHY

SEQ ID NO: 73251 - protein, 9 aa, Homo Sapiens
ALMPPFTAF

SEQ ID NO: 73252 - protein, 9 aa, Homo Sapiens
ALNDKGQVY

SEQ ID NO: 73253 - protein, 9 aa, Homo Sapiens
ALNIATHVL

SEQ ID NO: 73254 - protein, 9 aa, Homo Sapiens
ALNPESEQY

SEQ ID NO: 73255 - protein, 9 aa, Homo Sapiens
ALNPQNTVF

SEQ ID NO: 73256 - protein, 9 aa, Homo Sapiens
ALNSKATFY

SEQ ID NO: 73257 - protein, 9 aa, Homo Sapiens
ALNTIVTVY

SEQ ID NO: 73258 - protein, 9 aa, Homo Sapiens
ALPGHAESY

SEQ ID NO: 73259 - protein, 9 aa, Homo Sapiens
ALPPQQQHY

SEQ ID NO: 73260 - protein, 9 aa, Homo Sapiens
ALQEACEAY

SEQ ID NO: 73261 - protein, 9 aa, Homo Sapiens
ALQEASEAY

SEQ ID NO: 73262 - protein, 9 aa, Homo Sapiens
ALQKFTEAY

SEQ ID NO: 73263 - protein, 9 aa, Homo Sapiens
ALQRASTAL

SEQ ID NO: 73264 - protein, 9 aa, Homo Sapiens
ALRDVRQQY

SEQ ID NO: 73265 - protein, 9 aa, Homo Sapiens
ALREEVESF

SEQ ID NO: 73266 - protein, 9 aa, Homo Sapiens
ALRPGDPGF

SEQ ID NO: 73267 - protein, 9 aa, Homo Sapiens
ALRQMQVLY

SEQ ID NO: 73268 - protein, 9 aa, Homo Sapiens
ALSKGATVY

SEQ ID NO: 73269 - protein, 9 aa, Homo Sapiens
ALSLVRQLY

SEQ ID NO: 73270 - protein, 9 aa, Homo Sapiens
ALSPNAKEF

SEQ ID NO: 73271 - protein, 9 aa, Homo Sapiens
ALSPNHRIY

SEQ ID NO: 73272 - protein, 9 aa, Homo Sapiens
ALSPVRGCY

SEQ ID NO: 73273 - protein, 9 aa, Homo Sapiens
ALSQAVARY

SEQ ID NO: 73274 - protein, 9 aa, Homo Sapiens
ALTETGSVF

SEQ ID NO: 73275 - protein, 9 aa, Homo Sapiens
ALTTIFQKY

SEQ ID NO: 73276 - protein, 9 aa, Homo Sapiens
ALVASKVFY

SEQ ID NO: 73277 - protein, 9 aa, Homo Sapiens
ALVDIIHGY

SEQ ID NO: 73278 - protein, 9 aa, Homo Sapiens
ALVKAGKVY

SEQ ID NO: 73279 - protein, 9 aa, Homo Sapiens
ALVNAAVTY

SEQ ID NO: 73280 - protein, 9 aa, Homo Sapiens
ALVPPSADY

SEQ ID NO: 73281 - protein, 9 aa, Homo Sapiens
ALVSICNKY

SEQ ID NO: 73282 - protein, 9 aa, Homo Sapiens
ALYKKILKY

SEQ ID NO: 73283 - protein, 9 aa, Homo Sapiens
ALYPQTTCF

SEQ ID NO: 73284 - protein, 9 aa, Homo Sapiens
AMAEPNAKF

SEQ ID NO: 73285 - protein, 9 aa, Homo Sapiens
AMHPQVNIY

SEQ ID NO: 73286 - protein, 9 aa, Homo Sapiens
AMHSDSQTF

SEQ ID NO: 73287 - protein, 9 aa, Homo Sapiens
AMIDGQSAF

SEQ ID NO: 73288 - protein, 9 aa, Homo Sapiens
AMIDTGKAF

SEQ ID NO: 73289 - protein, 9 aa, Homo Sapiens
AMKKVFRVY

SEQ ID NO: 73290 - protein, 9 aa, Homo Sapiens
AMKLGEEAF

SEQ ID NO: 73291 - protein, 9 aa, Homo Sapiens
AMKPKPLSV

SEQ ID NO: 73292 - protein, 9 aa, Homo Sapiens
AMLRQLAQY

SEQ ID NO: 73293 - protein, 9 aa, Homo Sapiens
AMMGLAQIY

SEQ ID NO: 73294 - protein, 9 aa, Homo Sapiens
AMMHGGTGF

SEQ ID NO: 73295 - protein, 9 aa, Homo Sapiens
AMNPTNTVF

SEQ ID NO: 73296 - protein, 9 aa, Homo Sapiens
AMQQKPTAY

SEQ ID NO: 73297 - protein, 9 aa, Homo Sapiens
AMRIGAEVY

SEQ ID NO: 73298 - protein, 9 aa, Homo Sapiens
AMRPGLEGY

SEQ ID NO: 73299 - protein, 9 aa, Homo Sapiens
AMRWFQQKY

SEQ ID NO: 73300 - protein, 9 aa, Homo Sapiens
AMVGHQVSF

SEQ ID NO: 73301 - protein, 9 aa, Homo Sapiens
AMYPHIFYF

SEQ ID NO: 73302 - protein, 9 aa, Homo Sapiens
AMYPIRSAY

SEQ ID NO: 73303 - protein, 9 aa, Homo Sapiens
AMYSRKAMY

SEQ ID NO: 73304 - protein, 9 aa, Homo Sapiens
AQAAPKSLF

SEQ ID NO: 73305 - protein, 9 aa, Homo Sapiens
AQAAQQLQY

SEQ ID NO: 73306 - protein, 9 aa, Homo Sapiens
AQAASQHVF

SEQ ID NO: 73307 - protein, 9 aa, Homo Sapiens
AQAEKHFHY

SEQ ID NO: 73308 - protein, 9 aa, Homo Sapiens
AQAELESRY

SEQ ID NO: 73309 - protein, 9 aa, Homo Sapiens
AQAFIHNSL

SEQ ID NO: 73310 - protein, 9 aa, Homo Sapiens
AQAISRFAY

SEQ ID NO: 73311 - protein, 9 aa, Homo Sapiens
AQALVLQVF

SEQ ID NO: 73312 - protein, 9 aa, Homo Sapiens
AQAMYIDSY

SEQ ID NO: 73313 - protein, 9 aa, Homo Sapiens
AQAPAGTSF

SEQ ID NO: 73314 - protein, 9 aa, Homo Sapiens
AQAPAQSQF

SEQ ID NO: 73315 - protein, 9 aa, Homo Sapiens
AQAPIPAWF

SEQ ID NO: 73316 - protein, 9 aa, Homo Sapiens
AQAPPTAQL

SEQ ID NO: 73317 - protein, 9 aa, Homo Sapiens
AQAQIVQSW

SEQ ID NO: 73318 - protein, 9 aa, Homo Sapiens
AQAQLQKRY

SEQ ID NO: 73319 - protein, 9 aa, Homo Sapiens
AQCPIVERL

SEQ ID NO: 73320 - protein, 9 aa, Homo Sapiens
AQDEHLITF

SEQ ID NO: 73321 - protein, 9 aa, Homo Sapiens
AQDGPRVRY

SEQ ID NO: 73322 - protein, 9 aa, Homo Sapiens
AQEIVHCVF

SEQ ID NO: 73323 - protein, 9 aa, Homo Sapiens
AQERSRLTY

SEQ ID NO: 73324 - protein, 9 aa, Homo Sapiens
AQFETKKLY

SEQ ID NO: 73325 - protein, 9 aa, Homo Sapiens
AQFKGTQSL

SEQ ID NO: 73326 - protein, 9 aa, Homo Sapiens
AQFKTSNSY

SEQ ID NO: 73327 - protein, 9 aa, Homo Sapiens
AQFPGACGL

SEQ ID NO: 73328 - protein, 9 aa, Homo Sapiens
AQFPNGPQF

SEQ ID NO: 73329 - protein, 9 aa, Homo Sapiens
AQFPSSGRF

SEQ ID NO: 73330 - protein, 9 aa, Homo Sapiens
AQFRVTEAL

SEQ ID NO: 73331 - protein, 9 aa, Homo Sapiens
AQGVPRYSY

SEQ ID NO: 73332 - protein, 9 aa, Homo Sapiens
AQHGVCSVL

SEQ ID NO: 73333 - protein, 9 aa, Homo Sapiens
AQHIVTIVH

SEQ ID NO: 73334 - protein, 9 aa, Homo Sapiens
AQHLFIQTF

SEQ ID NO: 73335 - protein, 9 aa, Homo Sapiens
AQHLFLQAF

SEQ ID NO: 73336 - protein, 9 aa, Homo Sapiens
AQHLSQLLF

SEQ ID NO: 73337 - protein, 9 aa, Homo Sapiens
AQHLTVSGF

SEQ ID NO: 73338 - protein, 9 aa, Homo Sapiens
AQHPNIVTV

SEQ ID NO: 73339 - protein, 9 aa, Homo Sapiens
AQHPSALRF

SEQ ID NO: 73340 - protein, 9 aa, Homo Sapiens
AQHSYFGSF

SEQ ID NO: 73341 - protein, 9 aa, Homo Sapiens
AQHYTETAL

SEQ ID NO: 73342 - protein, 9 aa, Homo Sapiens
AQIDSNIAH

SEQ ID NO: 73343 - protein, 9 aa, Homo Sapiens
AQIEGVVPF

SEQ ID NO: 73344 - protein, 9 aa, Homo Sapiens
AQIENKEAY

SEQ ID NO: 73345 - protein, 9 aa, Homo Sapiens
AQIFRPLKF

SEQ ID NO: 73346 - protein, 9 aa, Homo Sapiens
AQIKEMVEL

SEQ ID NO: 73347 - protein, 9 aa, Homo Sapiens
AQIKFLNTY

SEQ ID NO: 73348 - protein, 9 aa, Homo Sapiens
AQIKHLARL

SEQ ID NO: 73349 - protein, 9 aa, Homo Sapiens
AQIKVTKEL

SEQ ID NO: 73350 - protein, 9 aa, Homo Sapiens
AQIPPHAVM

SEQ ID NO: 73351 - protein, 9 aa, Homo Sapiens
AQIRETETF

SEQ ID NO: 73352 - protein, 9 aa, Homo Sapiens
AQIVGLNCL

SEQ ID NO: 73353 - protein, 9 aa, Homo Sapiens
AQIVHAISY

SEQ ID NO: 73354 - protein, 9 aa, Homo Sapiens
AQIVSATAI

SEQ ID NO: 73355 - protein, 9 aa, Homo Sapiens
AQIVTRSVL

SEQ ID NO: 73356 - protein, 9 aa, Homo Sapiens
AQIVVPVTF

SEQ ID NO: 73357 - protein, 9 aa, Homo Sapiens
AQIYQLIEY

SEQ ID NO: 73358 - protein, 9 aa, Homo Sapiens
AQKDHLSKL

SEQ ID NO: 73359 - protein, 9 aa, Homo Sapiens
AQKDQEIAF

SEQ ID NO: 73360 - protein, 9 aa, Homo Sapiens
AQKGGAAGF

SEQ ID NO: 73361 - protein, 9 aa, Homo Sapiens
AQKGLQVDL

SEQ ID NO: 73362 - protein, 9 aa, Homo Sapiens
AQKIDLPEY

SEQ ID NO: 73363 - protein, 9 aa, Homo Sapiens
AQKKLISQV

SEQ ID NO: 73364 - protein, 9 aa, Homo Sapiens
AQKKLLSKM

SEQ ID NO: 73365 - protein, 9 aa, Homo Sapiens
AQKLLSEAL

SEQ ID NO: 73366 - protein, 9 aa, Homo Sapiens
AQKMQTVTA

SEQ ID NO: 73367 - protein, 9 aa, Homo Sapiens
AQKNHIPVF

SEQ ID NO: 73368 - protein, 9 aa, Homo Sapiens
AQKPLPQAL

SEQ ID NO: 73369 - protein, 9 aa, Homo Sapiens
AQKPQLLRH

SEQ ID NO: 73370 - protein, 9 aa, Homo Sapiens
AQKSDIVQL

SEQ ID NO: 73371 - protein, 9 aa, Homo Sapiens
AQKSISQHY

SEQ ID NO: 73372 - protein, 9 aa, Homo Sapiens
AQKVAISEF

SEQ ID NO: 73373 - protein, 9 aa, Homo Sapiens
AQKVGAVAA

SEQ ID NO: 73374 - protein, 9 aa, Homo Sapiens
AQKVIAVVM

SEQ ID NO: 73375 - protein, 9 aa, Homo Sapiens
AQKVIKSQL

SEQ ID NO: 73376 - protein, 9 aa, Homo Sapiens
AQKVIYTLM

SEQ ID NO: 73377 - protein, 9 aa, Homo Sapiens
AQKVSSQSF

SEQ ID NO: 73378 - protein, 9 aa, Homo Sapiens
AQLAAAEKF

SEQ ID NO: 73379 - protein, 9 aa, Homo Sapiens
AQLERQLQF

SEQ ID NO: 73380 - protein, 9 aa, Homo Sapiens
AQLGLGHSY

SEQ ID NO: 73381 - protein, 9 aa, Homo Sapiens
AQLKDYITY

SEQ ID NO: 73382 - protein, 9 aa, Homo Sapiens
AQLPEKVEY

SEQ ID NO: 73383 - protein, 9 aa, Homo Sapiens
AQLRNLEAY

SEQ ID NO: 73384 - protein, 9 aa, Homo Sapiens
AQLSKQSSF

SEQ ID NO: 73385 - protein, 9 aa, Homo Sapiens
AQLWTDLQY

SEQ ID NO: 73386 - protein, 9 aa, Homo Sapiens
AQMAQVLQF

SEQ ID NO: 73387 - protein, 9 aa, Homo Sapiens
AQMAYPTAY

SEQ ID NO: 73388 - protein, 9 aa, Homo Sapiens
AQMKPIFSF

SEQ ID NO: 73389 - protein, 9 aa, Homo Sapiens
AQNASRNTF

SEQ ID NO: 73390 - protein, 9 aa, Homo Sapiens
AQNAVRLHY

SEQ ID NO: 73391 - protein, 9 aa, Homo Sapiens
AQNGPNTSL

SEQ ID NO: 73392 - protein, 9 aa, Homo Sapiens
AQNICTSKL

SEQ ID NO: 73393 - protein, 9 aa, Homo Sapiens
AQNLHNSYY

SEQ ID NO: 73394 - protein, 9 aa, Homo Sapiens
AQNLSIIQY

SEQ ID NO: 73395 - protein, 9 aa, Homo Sapiens
AQNPLLCAF

SEQ ID NO: 73396 - protein, 9 aa, Homo Sapiens
AQNPRPTRL

SEQ ID NO: 73397 - protein, 9 aa, Homo Sapiens
AQNRFLLEL

SEQ ID NO: 73398 - protein, 9 aa, Homo Sapiens
AQNRKLIEF

SEQ ID NO: 73399 - protein, 9 aa, Homo Sapiens
AQNVSCASF

SEQ ID NO: 73400 - protein, 9 aa, Homo Sapiens
AQPALKTQF

SEQ ID NO: 73401 - protein, 9 aa, Homo Sapiens
AQPATAAAY

SEQ ID NO: 73402 - protein, 9 aa, Homo Sapiens
AQPEISRAF

SEQ ID NO: 73403 - protein, 9 aa, Homo Sapiens
AQPEPSTGF

SEQ ID NO: 73404 - protein, 9 aa, Homo Sapiens
AQPETRVSY

SEQ ID NO: 73405 - protein, 9 aa, Homo Sapiens
AQPHHGVPY

SEQ ID NO: 73406 - protein, 9 aa, Homo Sapiens
AQPKGVLLY

SEQ ID NO: 73407 - protein, 9 aa, Homo Sapiens
AQPKPATAL

SEQ ID NO: 73408 - protein, 9 aa, Homo Sapiens
AQPPVGAAY

SEQ ID NO: 73409 - protein, 9 aa, Homo Sapiens
AQPPVSTEY

SEQ ID NO: 73410 - protein, 9 aa, Homo Sapiens
AQQDLQSKF

SEQ ID NO: 73411 - protein, 9 aa, Homo Sapiens
AQQEARTEF

SEQ ID NO: 73412 - protein, 9 aa, Homo Sapiens
AQQIQKVVM

SEQ ID NO: 73413 - protein, 9 aa, Homo Sapiens
AQQKAMKSL

SEQ ID NO: 73414 - protein, 9 aa, Homo Sapiens
AQQKKSLSL

SEQ ID NO: 73415 - protein, 9 aa, Homo Sapiens
AQQKNLEGY

SEQ ID NO: 73416 - protein, 9 aa, Homo Sapiens
AQQLQGQQF

SEQ ID NO: 73417 - protein, 9 aa, Homo Sapiens
AQQPCYLLY

SEQ ID NO: 73418 - protein, 9 aa, Homo Sapiens
AQQRYATSF

SEQ ID NO: 73419 - protein, 9 aa, Homo Sapiens
AQQSEPIAY

SEQ ID NO: 73420 - protein, 9 aa, Homo Sapiens
AQQSIREKY

SEQ ID NO: 73421 - protein, 9 aa, Homo Sapiens
AQQVVLSSY

SEQ ID NO: 73422 - protein, 9 aa, Homo Sapiens
AQRAINNEM

SEQ ID NO: 73423 - protein, 9 aa, Homo Sapiens
AQRASSNVF

SEQ ID NO: 73424 - protein, 9 aa, Homo Sapiens
AQRDIIFEL

SEQ ID NO: 73425 - protein, 9 aa, Homo Sapiens
AQREDELTF

SEQ ID NO: 73426 - protein, 9 aa, Homo Sapiens
AQREKQEIL

SEQ ID NO: 73427 - protein, 9 aa, Homo Sapiens
AQRFFAQKF

SEQ ID NO: 73428 - protein, 9 aa, Homo Sapiens
AQRGIGVAA

SEQ ID NO: 73429 - protein, 9 aa, Homo Sapiens
AQRILRVNL

SEQ ID NO: 73430 - protein, 9 aa, Homo Sapiens
AQRIQNGSY

SEQ ID NO: 73431 - protein, 9 aa, Homo Sapiens
AQRKFGVVL

SEQ ID NO: 73432 - protein, 9 aa, Homo Sapiens
AQRKTLSGF

SEQ ID NO: 73433 - protein, 9 aa, Homo Sapiens
AQRLLEVTA

SEQ ID NO: 73434 - protein, 9 aa, Homo Sapiens
AQRPGPMEL

SEQ ID NO: 73435 - protein, 9 aa, Homo Sapiens
AQRPNLIGL

SEQ ID NO: 73436 - protein, 9 aa, Homo Sapiens
AQRPNPVQL

SEQ ID NO: 73437 - protein, 9 aa, Homo Sapiens
AQRPSSPAL

SEQ ID NO: 73438 - protein, 9 aa, Homo Sapiens
AQRPTEQEL

SEQ ID NO: 73439 - protein, 9 aa, Homo Sapiens
AQRRLKAEL

SEQ ID NO: 73440 - protein, 9 aa, Homo Sapiens
AQRTPVQMM

SEQ ID NO: 73441 - protein, 9 aa, Homo Sapiens
AQRVLTQTA

SEQ ID NO: 73442 - protein, 9 aa, Homo Sapiens
AQRYNELSY

SEQ ID NO: 73443 - protein, 9 aa, Homo Sapiens
AQSDFISAF

SEQ ID NO: 73444 - protein, 9 aa, Homo Sapiens
AQSHLVTGY

SEQ ID NO: 73445 - protein, 9 aa, Homo Sapiens
AQSHVKISF

SEQ ID NO: 73446 - protein, 9 aa, Homo Sapiens
AQSPIPNLY

SEQ ID NO: 73447 - protein, 9 aa, Homo Sapiens
AQSPLCRSL

SEQ ID NO: 73448 - protein, 9 aa, Homo Sapiens
AQSRFLSTY

SEQ ID NO: 73449 - protein, 9 aa, Homo Sapiens
AQSSLQEVY

SEQ ID NO: 73450 - protein, 9 aa, Homo Sapiens
AQTPGAHHF

SEQ ID NO: 73451 - protein, 9 aa, Homo Sapiens
AQVDGGANF

SEQ ID NO: 73452 - protein, 9 aa, Homo Sapiens
AQVIVFQTY

SEQ ID NO: 73453 - protein, 9 aa, Homo Sapiens
AQVKKATVF

SEQ ID NO: 73454 - protein, 9 aa, Homo Sapiens
AQVKPDGTY

SEQ ID NO: 73455 - protein, 9 aa, Homo Sapiens
AQVLSVVAH

SEQ ID NO: 73456 - protein, 9 aa, Homo Sapiens
AQVPKSSAL

SEQ ID NO: 73457 - protein, 9 aa, Homo Sapiens
AQVSKVEAL

SEQ ID NO: 73458 - protein, 9 aa, Homo Sapiens
AQVSRRISF

SEQ ID NO: 73459 - protein, 9 aa, Homo Sapiens
AQVVLYRSY

SEQ ID NO: 73460 - protein, 9 aa, Homo Sapiens
AQVVQWVSF

SEQ ID NO: 73461 - protein, 9 aa, Homo Sapiens
AQVWMITRY

SEQ ID NO: 73462 - protein, 9 aa, Homo Sapiens
AQYGKLESL

SEQ ID NO: 73463 - protein, 9 aa, Homo Sapiens
AQYKARVAL

SEQ ID NO: 73464 - protein, 9 aa, Homo Sapiens
AQYKEISKF

SEQ ID NO: 73465 - protein, 9 aa, Homo Sapiens
AQYLINARL

SEQ ID NO: 73466 - protein, 9 aa, Homo Sapiens
AQYLINVRL

SEQ ID NO: 73467 - protein, 9 aa, Homo Sapiens
AQYLPKEQY

SEQ ID NO: 73468 - protein, 9 aa, Homo Sapiens
AQYQSVPVY

SEQ ID NO: 73469 - protein, 9 aa, Homo Sapiens
AQYREVAAF

SEQ ID NO: 73470 - protein, 9 aa, Homo Sapiens
ASAAPHTSF

SEQ ID NO: 73471 - protein, 9 aa, Homo Sapiens
ASIEEKVAY

SEQ ID NO: 73472 - protein, 9 aa, Homo Sapiens
ASKEEATTF

SEQ ID NO: 73473 - protein, 9 aa, Homo Sapiens
ASNPRQAAY

SEQ ID NO: 73474 - protein, 9 aa, Homo Sapiens
ASNPRVTRF

SEQ ID NO: 73475 - protein, 9 aa, Homo Sapiens
ASQAGMTAY

SEQ ID NO: 73476 - protein, 9 aa, Homo Sapiens
ASQAVGETY

SEQ ID NO: 73477 - protein, 9 aa, Homo Sapiens
ASQKGMSVY

SEQ ID NO: 73478 - protein, 9 aa, Homo Sapiens
ASSPAAVSY

SEQ ID NO: 73479 - protein, 9 aa, Homo Sapiens
ASSPPHLQF

SEQ ID NO: 73480 - protein, 9 aa, Homo Sapiens
ASYEVKELY

SEQ ID NO: 73481 - protein, 9 aa, Homo Sapiens
ATAAAAAAY

SEQ ID NO: 73482 - protein, 9 aa, Homo Sapiens
ATAPPAPAY

SEQ ID NO: 73483 - protein, 9 aa, Homo Sapiens
ATGPPNTSY

SEQ ID NO: 73484 - protein, 9 aa, Homo Sapiens
ATHQNLTSY

SEQ ID NO: 73485 - protein, 9 aa, Homo Sapiens
ATPDIKSHY

SEQ ID NO: 73486 - protein, 9 aa, Homo Sapiens
ATSGVHSNF

SEQ ID NO: 73487 - protein, 9 aa, Homo Sapiens
AVAAPSSTF

SEQ ID NO: 73488 - protein, 9 aa, Homo Sapiens
AVAEPVVSY

SEQ ID NO: 73489 - protein, 9 aa, Homo Sapiens
AVAGARDTY

SEQ ID NO: 73490 - protein, 9 aa, Homo Sapiens
AVAGMKMSY

SEQ ID NO: 73491 - protein, 9 aa, Homo Sapiens
AVAKPFITY

SEQ ID NO: 73492 - protein, 9 aa, Homo Sapiens
AVALDNSVY

SEQ ID NO: 73493 - protein, 9 aa, Homo Sapiens
AVAPFFKSY

SEQ ID NO: 73494 - protein, 9 aa, Homo Sapiens
AVAPPGCSH

SEQ ID NO: 73495 - protein, 9 aa, Homo Sapiens
AVAPPSTSA

SEQ ID NO: 73496 - protein, 9 aa, Homo Sapiens
AVAPVASAL

SEQ ID NO: 73497 - protein, 9 aa, Homo Sapiens
AVAPVSAVH

SEQ ID NO: 73498 - protein, 9 aa, Homo Sapiens
AVAVGHRVY

SEQ ID NO: 73499 - protein, 9 aa, Homo Sapiens
AVCDRISRY

SEQ ID NO: 73500 - protein, 9 aa, Homo Sapiens
AVCEVALDY

SEQ ID NO: 73501 - protein, 9 aa, Homo Sapiens
AVCEVVTQF

SEQ ID NO: 73502 - protein, 9 aa, Homo Sapiens
AVFEEIDTY

SEQ ID NO: 73503 - protein, 9 aa, Homo Sapiens
AVFNHTEDY

SEQ ID NO: 73504 - protein, 9 aa, Homo Sapiens
AVGFPTHLY

SEQ ID NO: 73505 - protein, 9 aa, Homo Sapiens
AVGPRVFQY

SEQ ID NO: 73506 - protein, 9 aa, Homo Sapiens
AVHDITVAY

SEQ ID NO: 73507 - protein, 9 aa, Homo Sapiens
AVHPGNMMY

SEQ ID NO: 73508 - protein, 9 aa, Homo Sapiens
AVIAHQDSY

SEQ ID NO: 73509 - protein, 9 aa, Homo Sapiens
AVIAIFKSY

SEQ ID NO: 73510 - protein, 9 aa, Homo Sapiens
AVIAPKSSY

SEQ ID NO: 73511 - protein, 9 aa, Homo Sapiens
AVIEDTWHY

SEQ ID NO: 73512 - protein, 9 aa, Homo Sapiens
AVIKIQSSY

SEQ ID NO: 73513 - protein, 9 aa, Homo Sapiens
AVIKSNHSY

SEQ ID NO: 73514 - protein, 9 aa, Homo Sapiens
AVISSVAHY

SEQ ID NO: 73515 - protein, 9 aa, Homo Sapiens
AVISTILKY

SEQ ID NO: 73516 - protein, 9 aa, Homo Sapiens
AVKAELRQY

SEQ ID NO: 73517 - protein, 9 aa, Homo Sapiens
AVKAIIYQY

SEQ ID NO: 73518 - protein, 9 aa, Homo Sapiens
AVKFPEITY

SEQ ID NO: 73519 - protein, 9 aa, Homo Sapiens
AVKPDQIQY

SEQ ID NO: 73520 - protein, 9 aa, Homo Sapiens
AVKVSPVSY

SEQ ID NO: 73521 - protein, 9 aa, Homo Sapiens
AVNALQSVY

SEQ ID NO: 73522 - protein, 9 aa, Homo Sapiens
AVNEAIKSY

SEQ ID NO: 73523 - protein, 9 aa, Homo Sapiens
AVNGHTNSF

SEQ ID NO: 73524 - protein, 9 aa, Homo Sapiens
AVNKVIKSY

SEQ ID NO: 73525 - protein, 9 aa, Homo Sapiens
AVNSLISKY

SEQ ID NO: 73526 - protein, 9 aa, Homo Sapiens
AVNVGVTAY

SEQ ID NO: 73527 - protein, 9 aa, Homo Sapiens
AVQKAIAHY

SEQ ID NO: 73528 - protein, 9 aa, Homo Sapiens
AVQKAIPMY

SEQ ID NO: 73529 - protein, 9 aa, Homo Sapiens
AVRDHNVEF

SEQ ID NO: 73530 - protein, 9 aa, Homo Sapiens
AVRDYEKVY

SEQ ID NO: 73531 - protein, 9 aa, Homo Sapiens
AVRHTIQVY

SEQ ID NO: 73532 - protein, 9 aa, Homo Sapiens
AVRPFGCSF

SEQ ID NO: 73533 - protein, 9 aa, Homo Sapiens
AVRPGLPAY

SEQ ID NO: 73534 - protein, 9 aa, Homo Sapiens
AVRPLELAY

SEQ ID NO: 73535 - protein, 9 aa, Homo Sapiens
AVRSGIVEY

SEQ ID NO: 73536 - protein, 9 aa, Homo Sapiens
AVRTTGNVY

SEQ ID NO: 73537 - protein, 9 aa, Homo Sapiens
AVSAVVHEY

SEQ ID NO: 73538 - protein, 9 aa, Homo Sapiens
AVSKPGMDY

SEQ ID NO: 73539 - protein, 9 aa, Homo Sapiens
AVSPAVPVY

SEQ ID NO: 73540 - protein, 9 aa, Homo Sapiens
AVSPLARSY

SEQ ID NO: 73541 - protein, 9 aa, Homo Sapiens
AVSPSSVFY

SEQ ID NO: 73542 - protein, 9 aa, Homo Sapiens
AVSQIVTVY

SEQ ID NO: 73543 - protein, 9 aa, Homo Sapiens
AVTASIHVY

SEQ ID NO: 73544 - protein, 9 aa, Homo Sapiens
AVTHIGRVY

SEQ ID NO: 73545 - protein, 9 aa, Homo Sapiens
AVTVSGHVY

SEQ ID NO: 73546 - protein, 9 aa, Homo Sapiens
AVYKEAQYY

SEQ ID NO: 73547 - protein, 9 aa, Homo Sapiens
AVYPVRSAY

SEQ ID NO: 73548 - protein, 9 aa, Homo Sapiens
CAPRRKVAL

SEQ ID NO: 73549 - protein, 9 aa, Homo Sapiens
CVAPTIHVY

SEQ ID NO: 73550 - protein, 9 aa, Homo Sapiens
CVKPDVHVY

SEQ ID NO: 73551 - protein, 9 aa, Homo Sapiens
DRIINTLSI

SEQ ID NO: 73552 - protein, 9 aa, Homo Sapiens
ELKAPGISY

SEQ ID NO: 73553 - protein, 9 aa, Homo Sapiens
EMMKVVQVY

SEQ ID NO: 73554 - protein, 9 aa, Homo Sapiens
EQILATAVY

SEQ ID NO: 73555 - protein, 9 aa, Homo Sapiens
EQRSGDITY

SEQ ID NO: 73556 - protein, 9 aa, Homo Sapiens
EQYEQILAF

SEQ ID NO: 73557 - protein, 9 aa, Homo Sapiens
ESRQITQVY

SEQ ID NO: 73558 - protein, 9 aa, Homo Sapiens
EVAPAGASY

SEQ ID NO: 73559 - protein, 9 aa, Homo Sapiens
EVGDKVVIF

SEQ ID NO: 73560 - protein, 9 aa, Homo Sapiens
FAFEHSEEY

SEQ ID NO: 73561 - protein, 9 aa, Homo Sapiens
FANLPNQVY

SEQ ID NO: 73562 - protein, 9 aa, Homo Sapiens
FEKSTGLPH

SEQ ID NO: 73563 - protein, 9 aa, Homo Sapiens
FFLLAYDLY

SEQ ID NO: 73564 - protein, 9 aa, Homo Sapiens
FGKAPGTPH

SEQ ID NO: 73565 - protein, 9 aa, Homo Sapiens
FGKLIDLAY

SEQ ID NO: 73566 - protein, 9 aa, Homo Sapiens
FIAPTGHSL

SEQ ID NO: 73567 - protein, 9 aa, Homo Sapiens
FIKDGSSTY

SEQ ID NO: 73568 - protein, 9 aa, Homo Sapiens
FIMGKTIEF

SEQ ID NO: 73569 - protein, 9 aa, Homo Sapiens
FIRPVDPEY

SEQ ID NO: 73570 - protein, 9 aa, Homo Sapiens
FLAPLVTEY

SEQ ID NO: 73571 - protein, 9 aa, Homo Sapiens
FLCGVMKTY

SEQ ID NO: 73572 - protein, 9 aa, Homo Sapiens
FLFDGSPTY

SEQ ID NO: 73573 - protein, 9 aa, Homo Sapiens
FLMKNSDLY

SEQ ID NO: 73574 - protein, 9 aa, Homo Sapiens
FLQESNVLY

SEQ ID NO: 73575 - protein, 9 aa, Homo Sapiens
FMKPSHQGY

SEQ ID NO: 73576 - protein, 9 aa, Homo Sapiens
FMQPGGTKY

SEQ ID NO: 73577 - protein, 9 aa, Homo Sapiens
FMSEISDEF

SEQ ID NO: 73578 - protein, 9 aa, Homo Sapiens
FQAMGKTSF

SEQ ID NO: 73579 - protein, 9 aa, Homo Sapiens
FQAPTAKEM

SEQ ID NO: 73580 - protein, 9 aa, Homo Sapiens
FQFIMKQSY

SEQ ID NO: 73581 - protein, 9 aa, Homo Sapiens
FQIMNEIVY

SEQ ID NO: 73582 - protein, 9 aa, Homo Sapiens
FQKILTLTY

SEQ ID NO: 73583 - protein, 9 aa, Homo Sapiens
FQKIVVLFY

SEQ ID NO: 73584 - protein, 9 aa, Homo Sapiens
FQKPSGVSA

SEQ ID NO: 73585 - protein, 9 aa, Homo Sapiens
FQKQLLEDY

SEQ ID NO: 73586 - protein, 9 aa, Homo Sapiens
FQKVILDGY

SEQ ID NO: 73587 - protein, 9 aa, Homo Sapiens
FQKVITEYL

SEQ ID NO: 73588 - protein, 9 aa, Homo Sapiens
FQNNTTNRY

SEQ ID NO: 73589 - protein, 9 aa, Homo Sapiens
FQQDLEAKY

SEQ ID NO: 73590 - protein, 9 aa, Homo Sapiens
FQQIYARQY

SEQ ID NO: 73591 - protein, 9 aa, Homo Sapiens
FQQLIQSSF

SEQ ID NO: 73592 - protein, 9 aa, Homo Sapiens
FQRGYYRYY

SEQ ID NO: 73593 - protein, 9 aa, Homo Sapiens
FQRNIKKEY

SEQ ID NO: 73594 - protein, 9 aa, Homo Sapiens
FQSLPKSAF

SEQ ID NO: 73595 - protein, 9 aa, Homo Sapiens
FQSSAVMAL

SEQ ID NO: 73596 - protein, 9 aa, Homo Sapiens
FQTPEHVCF

SEQ ID NO: 73597 - protein, 9 aa, Homo Sapiens
FQYESKVFY

SEQ ID NO: 73598 - protein, 9 aa, Homo Sapiens
FSKDIVENY

SEQ ID NO: 73599 - protein, 9 aa, Homo Sapiens
FVAEERKHY

SEQ ID NO: 73600 - protein, 9 aa, Homo Sapiens
FVAEERVSF

SEQ ID NO: 73601 - protein, 9 aa, Homo Sapiens
FVAEQKVEY

SEQ ID NO: 73602 - protein, 9 aa, Homo Sapiens
FVEVGRVAY

SEQ ID NO: 73603 - protein, 9 aa, Homo Sapiens
FVIEEKHGF

SEQ ID NO: 73604 - protein, 9 aa, Homo Sapiens
FVKDEKTRF

SEQ ID NO: 73605 - protein, 9 aa, Homo Sapiens
FVKDSGACF

SEQ ID NO: 73606 - protein, 9 aa, Homo Sapiens
FVYKGGKIY

SEQ ID NO: 73607 - protein, 9 aa, Homo Sapiens
GAHLDLSAF

SEQ ID NO: 73608 - protein, 9 aa, Homo Sapiens
GAKISIMTY

SEQ ID NO: 73609 - protein, 9 aa, Homo Sapiens
GANQSGQVF

SEQ ID NO: 73610 - protein, 9 aa, Homo Sapiens
GAYEQVIKY

SEQ ID NO: 73611 - protein, 9 aa, Homo Sapiens
GAYGQAVRY

SEQ ID NO: 73612 - protein, 9 aa, Homo Sapiens
GEMPTSVAY

SEQ ID NO: 73613 - protein, 9 aa, Homo Sapiens
GGPGGVGGL

SEQ ID NO: 73614 - protein, 9 aa, Homo Sapiens
GIARFFTEY

SEQ ID NO: 73615 - protein, 9 aa, Homo Sapiens
GIFGKGSAY

SEQ ID NO: 73616 - protein, 9 aa, Homo Sapiens
GIHPDDLSF

SEQ ID NO: 73617 - protein, 9 aa, Homo Sapiens
GIHSGEKPY

SEQ ID NO: 73618 - protein, 9 aa, Homo Sapiens
GIHTGQFVY

SEQ ID NO: 73619 - protein, 9 aa, Homo Sapiens
GIIPVGGTY

SEQ ID NO: 73620 - protein, 9 aa, Homo Sapiens
GIIRPGTAF

SEQ ID NO: 73621 - protein, 9 aa, Homo Sapiens
GINISGNFY

SEQ ID NO: 73622 - protein, 9 aa, Homo Sapiens
GIREEEVSY

SEQ ID NO: 73623 - protein, 9 aa, Homo Sapiens
GIYPHKLVF

SEQ ID NO: 73624 - protein, 9 aa, Homo Sapiens
GLAYICQTY

SEQ ID NO: 73625 - protein, 9 aa, Homo Sapiens
GLFQGKTPL

SEQ ID NO: 73626 - protein, 9 aa, Homo Sapiens
GLGSGGSIR

SEQ ID NO: 73627 - protein, 9 aa, Homo Sapiens
GLHPERVSY

SEQ ID NO: 73628 - protein, 9 aa, Homo Sapiens
GLHSVDVTY

SEQ ID NO: 73629 - protein, 9 aa, Homo Sapiens
GLKDKETRY

SEQ ID NO: 73630 - protein, 9 aa, Homo Sapiens
GLKPSTSKY

SEQ ID NO: 73631 - protein, 9 aa, Homo Sapiens
GLMKANHVF

SEQ ID NO: 73632 - protein, 9 aa, Homo Sapiens
GLMKGKHYY

SEQ ID NO: 73633 - protein, 9 aa, Homo Sapiens
GLNKVSPVY

SEQ ID NO: 73634 - protein, 9 aa, Homo Sapiens
GLRAPVSAY

SEQ ID NO: 73635 - protein, 9 aa, Homo Sapiens
GLSGLHRTY

SEQ ID NO: 73636 - protein, 9 aa, Homo Sapiens
GLSKPVSSY

SEQ ID NO: 73637 - protein, 9 aa, Homo Sapiens
GLYRTGKSY

SEQ ID NO: 73638 - protein, 9 aa, Homo Sapiens
GMIDAARTY

SEQ ID NO: 73639 - protein, 9 aa, Homo Sapiens
GMQIPSTQF

SEQ ID NO: 73640 - protein, 9 aa, Homo Sapiens
GMYGKIAVM

SEQ ID NO: 73641 - protein, 9 aa, Homo Sapiens
GQADVISKL

SEQ ID NO: 73642 - protein, 9 aa, Homo Sapiens
GQAGMHATY

SEQ ID NO: 73643 - protein, 9 aa, Homo Sapiens
GQANKVMIY

SEQ ID NO: 73644 - protein, 9 aa, Homo Sapiens
GQAPAVRCL

SEQ ID NO: 73645 - protein, 9 aa, Homo Sapiens
GQAPPGKAL

SEQ ID NO: 73646 - protein, 9 aa, Homo Sapiens
GQAPSSSSL

SEQ ID NO: 73647 - protein, 9 aa, Homo Sapiens
GQASGGHYY

SEQ ID NO: 73648 - protein, 9 aa, Homo Sapiens
GQCGNQIGF

SEQ ID NO: 73649 - protein, 9 aa, Homo Sapiens
GQEFIRVGY

SEQ ID NO: 73650 - protein, 9 aa, Homo Sapiens
GQELLRIAL

SEQ ID NO: 73651 - protein, 9 aa, Homo Sapiens
GQFFCGNKY

SEQ ID NO: 73652 - protein, 9 aa, Homo Sapiens
GQFLAPNSH

SEQ ID NO: 73653 - protein, 9 aa, Homo Sapiens
GQFLPQTQF

SEQ ID NO: 73654 - protein, 9 aa, Homo Sapiens
GQFLVRIIY

SEQ ID NO: 73655 - protein, 9 aa, Homo Sapiens
GQFPGHNEF

SEQ ID NO: 73656 - protein, 9 aa, Homo Sapiens
GQFPSPHHH

SEQ ID NO: 73657 - protein, 9 aa, Homo Sapiens
GQFRDQIKF

SEQ ID NO: 73658 - protein, 9 aa, Homo Sapiens
GQFSKPFSF

SEQ ID NO: 73659 - protein, 9 aa, Homo Sapiens
GQFWGQKPW

SEQ ID NO: 73660 - protein, 9 aa, Homo Sapiens
GQGAFGRVY

SEQ ID NO: 73661 - protein, 9 aa, Homo Sapiens
GQGTFGEVF

SEQ ID NO: 73662 - protein, 9 aa, Homo Sapiens
GQHAGLEKY

SEQ ID NO: 73663 - protein, 9 aa, Homo Sapiens
GQHGYSTGY

SEQ ID NO: 73664 - protein, 9 aa, Homo Sapiens
GQHIQLVQY

SEQ ID NO: 73665 - protein, 9 aa, Homo Sapiens
GQHNQSVNY

SEQ ID NO: 73666 - protein, 9 aa, Homo Sapiens
GQHPNIITL

SEQ ID NO: 73667 - protein, 9 aa, Homo Sapiens
GQHSHVVRY

SEQ ID NO: 73668 - protein, 9 aa, Homo Sapiens
GQHVATQHF

SEQ ID NO: 73669 - protein, 9 aa, Homo Sapiens
GQHVTAALY

SEQ ID NO: 73670 - protein, 9 aa, Homo Sapiens
GQIEFLRCY

SEQ ID NO: 73671 - protein, 9 aa, Homo Sapiens
GQIEGVRQM

SEQ ID NO: 73672 - protein, 9 aa, Homo Sapiens
GQIEHKLAF

SEQ ID NO: 73673 - protein, 9 aa, Homo Sapiens
GQIGHGYKY

SEQ ID NO: 73674 - protein, 9 aa, Homo Sapiens
GQIGMIQAL

SEQ ID NO: 73675 - protein, 9 aa, Homo Sapiens
GQIGVRTPL

SEQ ID NO: 73676 - protein, 9 aa, Homo Sapiens
GQIIGEGRY

SEQ ID NO: 73677 - protein, 9 aa, Homo Sapiens
GQILRIIQL

SEQ ID NO: 73678 - protein, 9 aa, Homo Sapiens
GQILSVIKM

SEQ ID NO: 73679 - protein, 9 aa, Homo Sapiens
GQIMDSETF

SEQ ID NO: 73680 - protein, 9 aa, Homo Sapiens
GQIPATALL

SEQ ID NO: 73681 - protein, 9 aa, Homo Sapiens
GQIPEIIFY

SEQ ID NO: 73682 - protein, 9 aa, Homo Sapiens
GQIPQILYY

SEQ ID NO: 73683 - protein, 9 aa, Homo Sapiens
GQIQEKVRY

SEQ ID NO: 73684 - protein, 9 aa, Homo Sapiens
GQIQKVHPA

SEQ ID NO: 73685 - protein, 9 aa, Homo Sapiens
GQISGLNVL

SEQ ID NO: 73686 - protein, 9 aa, Homo Sapiens
GQIVSSQVL

SEQ ID NO: 73687 - protein, 9 aa, Homo Sapiens
GQKAGELSL

SEQ ID NO: 73688 - protein, 9 aa, Homo Sapiens
GQKENVVVY

SEQ ID NO: 73689 - protein, 9 aa, Homo Sapiens
GQKIFYVNY

SEQ ID NO: 73690 - protein, 9 aa, Homo Sapiens
GQKIIKKNL

SEQ ID NO: 73691 - protein, 9 aa, Homo Sapiens
GQKINIHEY

SEQ ID NO: 73692 - protein, 9 aa, Homo Sapiens
GQKIQIVTA

SEQ ID NO: 73693 - protein, 9 aa, Homo Sapiens
GQKISTVAV

SEQ ID NO: 73694 - protein, 9 aa, Homo Sapiens
GQKLAEQMF

SEQ ID NO: 73695 - protein, 9 aa, Homo Sapiens
GQKLGGQSF

SEQ ID NO: 73696 - protein, 9 aa, Homo Sapiens
GQKLILTTL

SEQ ID NO: 73697 - protein, 9 aa, Homo Sapiens
GQKMTTLQH

SEQ ID NO: 73698 - protein, 9 aa, Homo Sapiens
GQKPGGSDF

SEQ ID NO: 73699 - protein, 9 aa, Homo Sapiens
GQKPNPYFY

SEQ ID NO: 73700 - protein, 9 aa, Homo Sapiens
GQKPWSQHY

SEQ ID NO: 73701 - protein, 9 aa, Homo Sapiens
GQKQAQQVM

SEQ ID NO: 73702 - protein, 9 aa, Homo Sapiens
GQKQVIPGL

SEQ ID NO: 73703 - protein, 9 aa, Homo Sapiens
GQKQYNVDY

SEQ ID NO: 73704 - protein, 9 aa, Homo Sapiens
GQKRVVNVY

SEQ ID NO: 73705 - protein, 9 aa, Homo Sapiens
GQKVLVNVL

SEQ ID NO: 73706 - protein, 9 aa, Homo Sapiens
GQKVTDDMY

SEQ ID NO: 73707 - protein, 9 aa, Homo Sapiens
GQKYPVHIY

SEQ ID NO: 73708 - protein, 9 aa, Homo Sapiens
GQLFHIACF

SEQ ID NO: 73709 - protein, 9 aa, Homo Sapiens
GQLGLLARY

SEQ ID NO: 73710 - protein, 9 aa, Homo Sapiens
GQLPGLHEY

SEQ ID NO: 73711 - protein, 9 aa, Homo Sapiens
GQLTGMYRY

SEQ ID NO: 73712 - protein, 9 aa, Homo Sapiens
GQMAQKFSF

SEQ ID NO: 73713 - protein, 9 aa, Homo Sapiens
GQMPHSHQY

SEQ ID NO: 73714 - protein, 9 aa, Homo Sapiens
GQNAQTMAY

SEQ ID NO: 73715 - protein, 9 aa, Homo Sapiens
GQNASVLAY

SEQ ID NO: 73716 - protein, 9 aa, Homo Sapiens
GQNISQQAL

SEQ ID NO: 73717 - protein, 9 aa, Homo Sapiens
GQNKAVKVY

SEQ ID NO: 73718 - protein, 9 aa, Homo Sapiens
GQNKKVMIY

SEQ ID NO: 73719 - protein, 9 aa, Homo Sapiens
GQNPAEGSF

SEQ ID NO: 73720 - protein, 9 aa, Homo Sapiens
GQNPFELAF

SEQ ID NO: 73721 - protein, 9 aa, Homo Sapiens
GQNPTEAEL

SEQ ID NO: 73722 - protein, 9 aa, Homo Sapiens
GQNRDGIVF

SEQ ID NO: 73723 - protein, 9 aa, Homo Sapiens
GQPAFCTSY

SEQ ID NO: 73724 - protein, 9 aa, Homo Sapiens
GQPDISRPF

SEQ ID NO: 73725 - protein, 9 aa, Homo Sapiens
GQPGAFTCY

SEQ ID NO: 73726 - protein, 9 aa, Homo Sapiens
GQPLHASNY

SEQ ID NO: 73727 - protein, 9 aa, Homo Sapiens
GQPLPTSNY

SEQ ID NO: 73728 - protein, 9 aa, Homo Sapiens
GQPQPGFGY

SEQ ID NO: 73729 - protein, 9 aa, Homo Sapiens
GQQEITNRL

SEQ ID NO: 73730 - protein, 9 aa, Homo Sapiens
GQQGSCLVY

SEQ ID NO: 73731 - protein, 9 aa, Homo Sapiens
GQQPSQSAF

SEQ ID NO: 73732 - protein, 9 aa, Homo Sapiens
GQQQNVMVY

SEQ ID NO: 73733 - protein, 9 aa, Homo Sapiens
GQQQPVPSY

SEQ ID NO: 73734 - protein, 9 aa, Homo Sapiens
GQQRCIATY

SEQ ID NO: 73735 - protein, 9 aa, Homo Sapiens
GQQSSYPGY

SEQ ID NO: 73736 - protein, 9 aa, Homo Sapiens
GQQVPMELY

SEQ ID NO: 73737 - protein, 9 aa, Homo Sapiens
GQQVTLTTH

SEQ ID NO: 73738 - protein, 9 aa, Homo Sapiens
GQRAKSMKF

SEQ ID NO: 73739 - protein, 9 aa, Homo Sapiens
GQREGSRGF

SEQ ID NO: 73740 - protein, 9 aa, Homo Sapiens
GQRELIESY

SEQ ID NO: 73741 - protein, 9 aa, Homo Sapiens
GQREVHRLY

SEQ ID NO: 73742 - protein, 9 aa, Homo Sapiens
GQRFLEVQY

SEQ ID NO: 73743 - protein, 9 aa, Homo Sapiens
GQRKEVEVF

SEQ ID NO: 73744 - protein, 9 aa, Homo Sapiens
GQRKNIEKL

SEQ ID NO: 73745 - protein, 9 aa, Homo Sapiens
GQRKPATSY

SEQ ID NO: 73746 - protein, 9 aa, Homo Sapiens
GQRKPVAVL

SEQ ID NO: 73747 - protein, 9 aa, Homo Sapiens
GQRPQLTAA

SEQ ID NO: 73748 - protein, 9 aa, Homo Sapiens
GQRPTQPVY

SEQ ID NO: 73749 - protein, 9 aa, Homo Sapiens
GQRQVGVGY

SEQ ID NO: 73750 - protein, 9 aa, Homo Sapiens
GQRSYLVQY

SEQ ID NO: 73751 - protein, 9 aa, Homo Sapiens
GQRTGQVTV

SEQ ID NO: 73752 - protein, 9 aa, Homo Sapiens
GQSGLFTQY

SEQ ID NO: 73753 - protein, 9 aa, Homo Sapiens
GQSKAVKVY

SEQ ID NO: 73754 - protein, 9 aa, Homo Sapiens
GQSKSVKIY

SEQ ID NO: 73755 - protein, 9 aa, Homo Sapiens
GQSPLSQKY

SEQ ID NO: 73756 - protein, 9 aa, Homo Sapiens
GQSRLIFTY

SEQ ID NO: 73757 - protein, 9 aa, Homo Sapiens
GQTAYATSY

SEQ ID NO: 73758 - protein, 9 aa, Homo Sapiens
GQTGSGKTF

SEQ ID NO: 73759 - protein, 9 aa, Homo Sapiens
GQTGTGKTF

SEQ ID NO: 73760 - protein, 9 aa, Homo Sapiens
GQTGTKSVF

SEQ ID NO: 73761 - protein, 9 aa, Homo Sapiens
GQTGVTTSF

SEQ ID NO: 73762 - protein, 9 aa, Homo Sapiens
GQTKPVVVY

SEQ ID NO: 73763 - protein, 9 aa, Homo Sapiens
GQTKPVYVY

SEQ ID NO: 73764 - protein, 9 aa, Homo Sapiens
GQTKQVTVY

SEQ ID NO: 73765 - protein, 9 aa, Homo Sapiens
GQTPGGAQF

SEQ ID NO: 73766 - protein, 9 aa, Homo Sapiens
GQVAAGGAF

SEQ ID NO: 73767 - protein, 9 aa, Homo Sapiens
GQVALRTSL

SEQ ID NO: 73768 - protein, 9 aa, Homo Sapiens
GQVFLKTAL

SEQ ID NO: 73769 - protein, 9 aa, Homo Sapiens
GQVFPLSSH

SEQ ID NO: 73770 - protein, 9 aa, Homo Sapiens
GQVKAAVKY

SEQ ID NO: 73771 - protein, 9 aa, Homo Sapiens
GQVKTGISM

SEQ ID NO: 73772 - protein, 9 aa, Homo Sapiens
GQVLGVIGY

SEQ ID NO: 73773 - protein, 9 aa, Homo Sapiens
GQVQKIVLY

SEQ ID NO: 73774 - protein, 9 aa, Homo Sapiens
GQVQVRTLY

SEQ ID NO: 73775 - protein, 9 aa, Homo Sapiens
GQVTFLHVF

SEQ ID NO: 73776 - protein, 9 aa, Homo Sapiens
GQWGGGSHY

SEQ ID NO: 73777 - protein, 9 aa, Homo Sapiens
GQYEQVKQL

SEQ ID NO: 73778 - protein, 9 aa, Homo Sapiens
GQYPTQPTY

SEQ ID NO: 73779 - protein, 9 aa, Homo Sapiens
GQYPYPSGF

SEQ ID NO: 73780 - protein, 9 aa, Homo Sapiens
GQYQFDVKY

SEQ ID NO: 73781 - protein, 9 aa, Homo Sapiens
GQYYKPEQF

SEQ ID NO: 73782 - protein, 9 aa, Homo Sapiens
GSFIHREEY

SEQ ID NO: 73783 - protein, 9 aa, Homo Sapiens
GSFQTPSSF

SEQ ID NO: 73784 - protein, 9 aa, Homo Sapiens
GSGPAGYSY

SEQ ID NO: 73785 - protein, 9 aa, Homo Sapiens
GSHLTPLCY

SEQ ID NO: 73786 - protein, 9 aa, Homo Sapiens
GSQRISSIY

SEQ ID NO: 73787 - protein, 9 aa, Homo Sapiens
GSRVISICY

SEQ ID NO: 73788 - protein, 9 aa, Homo Sapiens
GTAMIFTCF

SEQ ID NO: 73789 - protein, 9 aa, Homo Sapiens
GTGFPHMLF

SEQ ID NO: 73790 - protein, 9 aa, Homo Sapiens
GVAPPAGAY

SEQ ID NO: 73791 - protein, 9 aa, Homo Sapiens
GVCHIFASF

SEQ ID NO: 73792 - protein, 9 aa, Homo Sapiens
GVIPSTLAF

SEQ ID NO: 73793 - protein, 9 aa, Homo Sapiens
GVIQPGRGF

SEQ ID NO: 73794 - protein, 9 aa, Homo Sapiens
GVISKTLTY

SEQ ID NO: 73795 - protein, 9 aa, Homo Sapiens
GVKPGVVQY

SEQ ID NO: 73796 - protein, 9 aa, Homo Sapiens
GVKSVGQGY

SEQ ID NO: 73797 - protein, 9 aa, Homo Sapiens
GVMKSGHVF

SEQ ID NO: 73798 - protein, 9 aa, Homo Sapiens
GVTHICPVY

SEQ ID NO: 73799 - protein, 9 aa, Homo Sapiens
HEIVLKVAY

SEQ ID NO: 73800 - protein, 9 aa, Homo Sapiens
HGIDPTGTY

SEQ ID NO: 73801 - protein, 9 aa, Homo Sapiens
HGQVQRVAF

SEQ ID NO: 73802 - protein, 9 aa, Homo Sapiens
HIKAFDRAF

SEQ ID NO: 73803 - protein, 9 aa, Homo Sapiens
HIKTETVTY

SEQ ID NO: 73804 - protein, 9 aa, Homo Sapiens
HINSIKSVF

SEQ ID NO: 73805 - protein, 9 aa, Homo Sapiens
HISPVTSTY

SEQ ID NO: 73806 - protein, 9 aa, Homo Sapiens
HLFDIITQY

SEQ ID NO: 73807 - protein, 9 aa, Homo Sapiens
HLKEDQTEY

SEQ ID NO: 73808 - protein, 9 aa, Homo Sapiens
HLKKLKESY

SEQ ID NO: 73809 - protein, 9 aa, Homo Sapiens
HLQKSLSSY

SEQ ID NO: 73810 - protein, 9 aa, Homo Sapiens
HLRDYFEEY

SEQ ID NO: 73811 - protein, 9 aa, Homo Sapiens
HLRPESHSY

SEQ ID NO: 73812 - protein, 9 aa, Homo Sapiens
HLRPRPRAY

SEQ ID NO: 73813 - protein, 9 aa, Homo Sapiens
HMMEKIKSY

SEQ ID NO: 73814 - protein, 9 aa, Homo Sapiens
HQAIHTIEF

SEQ ID NO: 73815 - protein, 9 aa, Homo Sapiens
HQAIHTIEY

SEQ ID NO: 73816 - protein, 9 aa, Homo Sapiens
HQALPSVSH

SEQ ID NO: 73817 - protein, 9 aa, Homo Sapiens
HQAPRQLFY

SEQ ID NO: 73818 - protein, 9 aa, Homo Sapiens
HQASHQPLY

SEQ ID NO: 73819 - protein, 9 aa, Homo Sapiens
HQEIARSSY

SEQ ID NO: 73820 - protein, 9 aa, Homo Sapiens
HQFEGAEEY

SEQ ID NO: 73821 - protein, 9 aa, Homo Sapiens
HQFEKIEQF

SEQ ID NO: 73822 - protein, 9 aa, Homo Sapiens
HQFYPTVVY

SEQ ID NO: 73823 - protein, 9 aa, Homo Sapiens
HQGCLTSSY

SEQ ID NO: 73824 - protein, 9 aa, Homo Sapiens
HQGPVPLSY

SEQ ID NO: 73825 - protein, 9 aa, Homo Sapiens
HQGYPHRNF

SEQ ID NO: 73826 - protein, 9 aa, Homo Sapiens
HQHLSKESL

SEQ ID NO: 73827 - protein, 9 aa, Homo Sapiens
HQHLSKESM

SEQ ID NO: 73828 - protein, 9 aa, Homo Sapiens
HQIGNLKKY

SEQ ID NO: 73829 - protein, 9 aa, Homo Sapiens
HQITEVGTM

SEQ ID NO: 73830 - protein, 9 aa, Homo Sapiens
HQITVLHVY

SEQ ID NO: 73831 - protein, 9 aa, Homo Sapiens
HQKELAAQL

SEQ ID NO: 73832 - protein, 9 aa, Homo Sapiens
HQKIHTDAF

SEQ ID NO: 73833 - protein, 9 aa, Homo Sapiens
HQKKEFVKY

SEQ ID NO: 73834 - protein, 9 aa, Homo Sapiens
HQKQAPISY

SEQ ID NO: 73835 - protein, 9 aa, Homo Sapiens
HQKSELLEL

SEQ ID NO: 73836 - protein, 9 aa, Homo Sapiens
HQKVEAQVY

SEQ ID NO: 73837 - protein, 9 aa, Homo Sapiens
HQLATDSTF

SEQ ID NO: 73838 - protein, 9 aa, Homo Sapiens
HQLGNNSVF

SEQ ID NO: 73839 - protein, 9 aa, Homo Sapiens
HQMTPSSSY

SEQ ID NO: 73840 - protein, 9 aa, Homo Sapiens
HQNEIVQSL

SEQ ID NO: 73841 - protein, 9 aa, Homo Sapiens
HQNQLLSSL

SEQ ID NO: 73842 - protein, 9 aa, Homo Sapiens
HQNSNIRTY

SEQ ID NO: 73843 - protein, 9 aa, Homo Sapiens
HQQKVLRLY

SEQ ID NO: 73844 - protein, 9 aa, Homo Sapiens
HQQLHNETY

SEQ ID NO: 73845 - protein, 9 aa, Homo Sapiens
HQQPPSQQY

SEQ ID NO: 73846 - protein, 9 aa, Homo Sapiens
HQRIQEEKY

SEQ ID NO: 73847 - protein, 9 aa, Homo Sapiens
HQRLQLCVF

SEQ ID NO: 73848 - protein, 9 aa, Homo Sapiens
HQRRQLVHF

SEQ ID NO: 73849 - protein, 9 aa, Homo Sapiens
HQRSFTETM

SEQ ID NO: 73850 - protein, 9 aa, Homo Sapiens
HQRWVFVCL

SEQ ID NO: 73851 - protein, 9 aa, Homo Sapiens
HQSPATPAF

SEQ ID NO: 73852 - protein, 9 aa, Homo Sapiens
HQVTVAQSY

SEQ ID NO: 73853 - protein, 9 aa, Homo Sapiens
HQYDGLVEL

SEQ ID NO: 73854 - protein, 9 aa, Homo Sapiens
HQYSIQVAF

SEQ ID NO: 73855 - protein, 9 aa, Homo Sapiens
HSAPGGPSY

SEQ ID NO: 73856 - protein, 9 aa, Homo Sapiens
HSIPSGHVY

SEQ ID NO: 73857 - protein, 9 aa, Homo Sapiens
HSRLIVLHY

SEQ ID NO: 73858 - protein, 9 aa, Homo Sapiens
HVAQPDSVY

SEQ ID NO: 73859 - protein, 9 aa, Homo Sapiens
HVGKTPIVG

SEQ ID NO: 73860 - protein, 9 aa, Homo Sapiens
HVIENSNAF

SEQ ID NO: 73861 - protein, 9 aa, Homo Sapiens
HVNGIVQKY

SEQ ID NO: 73862 - protein, 9 aa, Homo Sapiens
HVYEIPVEY

SEQ ID NO: 73863 - protein, 9 aa, Homo Sapiens
ICHVVGITY

SEQ ID NO: 73864 - protein, 9 aa, Homo Sapiens
IEKDPSLVY

SEQ ID NO: 73865 - protein, 9 aa, Homo Sapiens
IEMPSHQTY

SEQ ID NO: 73866 - protein, 9 aa, Homo Sapiens
IIAEPGRYY

SEQ ID NO: 73867 - protein, 9 aa, Homo Sapiens
IIAPCKVYY

SEQ ID NO: 73868 - protein, 9 aa, Homo Sapiens
IIAPPERKY

SEQ ID NO: 73869 - protein, 9 aa, Homo Sapiens
IIFPDDCEF

SEQ ID NO: 73870 - protein, 9 aa, Homo Sapiens
IIHDFPQFY

SEQ ID NO: 73871 - protein, 9 aa, Homo Sapiens
IIHEEVEKY

SEQ ID NO: 73872 - protein, 9 aa, Homo Sapiens
IIHEGSSVY

SEQ ID NO: 73873 - protein, 9 aa, Homo Sapiens
IIHSGEKPY

SEQ ID NO: 73874 - protein, 9 aa, Homo Sapiens
IIHTEEKPY

SEQ ID NO: 73875 - protein, 9 aa, Homo Sapiens
IIHTEGKSY

SEQ ID NO: 73876 - protein, 9 aa, Homo Sapiens
IIHTGEKPY

SEQ ID NO: 73877 - protein, 9 aa, Homo Sapiens
IIHTGENLY

SEQ ID NO: 73878 - protein, 9 aa, Homo Sapiens
IIIDKEYYY

SEQ ID NO: 73879 - protein, 9 aa, Homo Sapiens
IIKEESDSF

SEQ ID NO: 73880 - protein, 9 aa, Homo Sapiens
IIKSGDQTF

SEQ ID NO: 73881 - protein, 9 aa, Homo Sapiens
IIKVGGERF

SEQ ID NO: 73882 - protein, 9 aa, Homo Sapiens
IIMSKSTTY

SEQ ID NO: 73883 - protein, 9 aa, Homo Sapiens
IINNAIVHY

SEQ ID NO: 73884 - protein, 9 aa, Homo Sapiens
IIRENEFSF

SEQ ID NO: 73885 - protein, 9 aa, Homo Sapiens
IISPVGDAY

SEQ ID NO: 73886 - protein, 9 aa, Homo Sapiens
IISSVIQKF

SEQ ID NO: 73887 - protein, 9 aa, Homo Sapiens
IITKGTQTY

SEQ ID NO: 73888 - protein, 9 aa, Homo Sapiens
IIYDRDFSY

SEQ ID NO: 73889 - protein, 9 aa, Homo Sapiens
IIYTGEKPY

SEQ ID NO: 73890 - protein, 9 aa, Homo Sapiens
ILAAANPAY

SEQ ID NO: 73891 - protein, 9 aa, Homo Sapiens
ILADMADVY

SEQ ID NO: 73892 - protein, 9 aa, Homo Sapiens
ILAGHENSY

SEQ ID NO: 73893 - protein, 9 aa, Homo Sapiens
ILAQLNAKY

SEQ ID NO: 73894 - protein, 9 aa, Homo Sapiens
ILARNFVNY

SEQ ID NO: 73895 - protein, 9 aa, Homo Sapiens
ILATAGTHF

SEQ ID NO: 73896 - protein, 9 aa, Homo Sapiens
ILFKGDLNY

SEQ ID NO: 73897 - protein, 9 aa, Homo Sapiens
ILGPPGSVY

SEQ ID NO: 73898 - protein, 9 aa, Homo Sapiens
ILHANVVVY

SEQ ID NO: 73899 - protein, 9 aa, Homo Sapiens
ILHTTGLQY

SEQ ID NO: 73900 - protein, 9 aa, Homo Sapiens
ILIACGTSY

SEQ ID NO: 73901 - protein, 9 aa, Homo Sapiens
ILIGPTFSY

SEQ ID NO: 73902 - protein, 9 aa, Homo Sapiens
ILINSGSRY

SEQ ID NO: 73903 - protein, 9 aa, Homo Sapiens
ILIQIISHY

SEQ ID NO: 73904 - protein, 9 aa, Homo Sapiens
ILKDSISSY

SEQ ID NO: 73905 - protein, 9 aa, Homo Sapiens
ILKEDPFLF

SEQ ID NO: 73906 - protein, 9 aa, Homo Sapiens
ILKEEQELY

SEQ ID NO: 73907 - protein, 9 aa, Homo Sapiens
ILKFPHSAH

SEQ ID NO: 73908 - protein, 9 aa, Homo Sapiens
ILKPDGSLY

SEQ ID NO: 73909 - protein, 9 aa, Homo Sapiens
ILKPGSTAL

SEQ ID NO: 73910 - protein, 9 aa, Homo Sapiens
ILKQEQEEY

SEQ ID NO: 73911 - protein, 9 aa, Homo Sapiens
ILKQKNVSY

SEQ ID NO: 73912 - protein, 9 aa, Homo Sapiens
ILKRNIQQY

SEQ ID NO: 73913 - protein, 9 aa, Homo Sapiens
ILNKPGLKY

SEQ ID NO: 73914 - protein, 9 aa, Homo Sapiens
ILNKSETGY

SEQ ID NO: 73915 - protein, 9 aa, Homo Sapiens
ILNREVVNY

SEQ ID NO: 73916 - protein, 9 aa, Homo Sapiens
ILNSGARGY

SEQ ID NO: 73917 - protein, 9 aa, Homo Sapiens
ILPKCRTSY

SEQ ID NO: 73918 - protein, 9 aa, Homo Sapiens
ILPLIISKY

SEQ ID NO: 73919 - protein, 9 aa, Homo Sapiens
ILPPFFKHF

SEQ ID NO: 73920 - protein, 9 aa, Homo Sapiens
ILQDYTHEF

SEQ ID NO: 73921 - protein, 9 aa, Homo Sapiens
ILQKGQTAY

SEQ ID NO: 73922 - protein, 9 aa, Homo Sapiens
ILRETTVKY

SEQ ID NO: 73923 - protein, 9 aa, Homo Sapiens
ILRPEELGF

SEQ ID NO: 73924 - protein, 9 aa, Homo Sapiens
ILRPGGCLF

SEQ ID NO: 73925 - protein, 9 aa, Homo Sapiens
ILSGVVTKM

SEQ ID NO: 73926 - protein, 9 aa, Homo Sapiens
ILSHINTVF

SEQ ID NO: 73927 - protein, 9 aa, Homo Sapiens
ILTVGGTAY

SEQ ID NO: 73928 - protein, 9 aa, Homo Sapiens
ILYNIKQEY

SEQ ID NO: 73929 - protein, 9 aa, Homo Sapiens
IMCILRELY

SEQ ID NO: 73930 - protein, 9 aa, Homo Sapiens
IMKIDIEKF

SEQ ID NO: 73931 - protein, 9 aa, Homo Sapiens
IMKKIRESY

SEQ ID NO: 73932 - protein, 9 aa, Homo Sapiens
IMKNPEVEF

SEQ ID NO: 73933 - protein, 9 aa, Homo Sapiens
IMNGGCETF

SEQ ID NO: 73934 - protein, 9 aa, Homo Sapiens
IMQSIQSKY

SEQ ID NO: 73935 - protein, 9 aa, Homo Sapiens
IMRAGMSSL

SEQ ID NO: 73936 - protein, 9 aa, Homo Sapiens
IMVKPHEEY

SEQ ID NO: 73937 - protein, 9 aa, Homo Sapiens
IQAGIFQEF

SEQ ID NO: 73938 - protein, 9 aa, Homo Sapiens
IQAPLVYHF

SEQ ID NO: 73939 - protein, 9 aa, Homo Sapiens
IQAQKSSEY

SEQ ID NO: 73940 - protein, 9 aa, Homo Sapiens
IQASTVVTY

SEQ ID NO: 73941 - protein, 9 aa, Homo Sapiens
IQEESLRTY

SEQ ID NO: 73942 - protein, 9 aa, Homo Sapiens
IQFEIAHAY

SEQ ID NO: 73943 - protein, 9 aa, Homo Sapiens
IQFNLRNLY

SEQ ID NO: 73944 - protein, 9 aa, Homo Sapiens
IQGVPKVTY

SEQ ID NO: 73945 - protein, 9 aa, Homo Sapiens
IQHLVPASF

SEQ ID NO: 73946 - protein, 9 aa, Homo Sapiens
IQHPLIKKY

SEQ ID NO: 73947 - protein, 9 aa, Homo Sapiens
IQHSTIIGF

SEQ ID NO: 73948 - protein, 9 aa, Homo Sapiens
IQIGLTREF

SEQ ID NO: 73949 - protein, 9 aa, Homo Sapiens
IQIPGSREF

SEQ ID NO: 73950 - protein, 9 aa, Homo Sapiens
IQKAPGERL

SEQ ID NO: 73951 - protein, 9 aa, Homo Sapiens
IQKDPGESL

SEQ ID NO: 73952 - protein, 9 aa, Homo Sapiens
IQKEATWTM

SEQ ID NO: 73953 - protein, 9 aa, Homo Sapiens
IQKELIEEF

SEQ ID NO: 73954 - protein, 9 aa, Homo Sapiens
IQKENPKVV

SEQ ID NO: 73955 - protein, 9 aa, Homo Sapiens
IQKESTLHL

SEQ ID NO: 73956 - protein, 9 aa, Homo Sapiens
IQKFHSRAL

SEQ ID NO: 73957 - protein, 9 aa, Homo Sapiens
IQKKAVKNF

SEQ ID NO: 73958 - protein, 9 aa, Homo Sapiens
IQKKIREKF

SEQ ID NO: 73959 - protein, 9 aa, Homo Sapiens
IQKPGSNAF

SEQ ID NO: 73960 - protein, 9 aa, Homo Sapiens
IQKQFEELY

SEQ ID NO: 73961 - protein, 9 aa, Homo Sapiens
IQKQISYNY

SEQ ID NO: 73962 - protein, 9 aa, Homo Sapiens
IQKTGGTTF

SEQ ID NO: 73963 - protein, 9 aa, Homo Sapiens
IQLLQKLTY

SEQ ID NO: 73964 - protein, 9 aa, Homo Sapiens
IQLRAQKGY

SEQ ID NO: 73965 - protein, 9 aa, Homo Sapiens
IQMETQSSM

SEQ ID NO: 73966 - protein, 9 aa, Homo Sapiens
IQMRDLEGY

SEQ ID NO: 73967 - protein, 9 aa, Homo Sapiens
IQMTLPKTY

SEQ ID NO: 73968 - protein, 9 aa, Homo Sapiens
IQNDRQLQY

SEQ ID NO: 73969 - protein, 9 aa, Homo Sapiens
IQNNPHASY

SEQ ID NO: 73970 - protein, 9 aa, Homo Sapiens
IQNPDPAVY

SEQ ID NO: 73971 - protein, 9 aa, Homo Sapiens
IQNVSTCRF

SEQ ID NO: 73972 - protein, 9 aa, Homo Sapiens
IQPDVFSHY

SEQ ID NO: 73973 - protein, 9 aa, Homo Sapiens
IQQEVIKAY

SEQ ID NO: 73974 - protein, 9 aa, Homo Sapiens
IQQKRTVAF

SEQ ID NO: 73975 - protein, 9 aa, Homo Sapiens
IQQLVRKSY

SEQ ID NO: 73976 - protein, 9 aa, Homo Sapiens
IQQRPSMQF

SEQ ID NO: 73977 - protein, 9 aa, Homo Sapiens
IQQRVVRVY

SEQ ID NO: 73978 - protein, 9 aa, Homo Sapiens
IQQVGNEAY

SEQ ID NO: 73979 - protein, 9 aa, Homo Sapiens
IQRIFLITL

SEQ ID NO: 73980 - protein, 9 aa, Homo Sapiens
IQRMHLRQY

SEQ ID NO: 73981 - protein, 9 aa, Homo Sapiens
IQRNPEISH

SEQ ID NO: 73982 - protein, 9 aa, Homo Sapiens
IQRQETISL

SEQ ID NO: 73983 - protein, 9 aa, Homo Sapiens
IQRTEAYEY

SEQ ID NO: 73984 - protein, 9 aa, Homo Sapiens
IQRVAAGVL

SEQ ID NO: 73985 - protein, 9 aa, Homo Sapiens
IQSHVIRGY

SEQ ID NO: 73986 - protein, 9 aa, Homo Sapiens
IQSRITKTF

SEQ ID NO: 73987 - protein, 9 aa, Homo Sapiens
IQSTIRTQF

SEQ ID NO: 73988 - protein, 9 aa, Homo Sapiens
IQTKRSFQY

SEQ ID NO: 73989 - protein, 9 aa, Homo Sapiens
IQTSTGKVF

SEQ ID NO: 73990 - protein, 9 aa, Homo Sapiens
IQVDPNYAY

SEQ ID NO: 73991 - protein, 9 aa, Homo Sapiens
IQVKVRDTY

SEQ ID NO: 73992 - protein, 9 aa, Homo Sapiens
IQVVSKNLY

SEQ ID NO: 73993 - protein, 9 aa, Homo Sapiens
IQYDKTNVL

SEQ ID NO: 73994 - protein, 9 aa, Homo Sapiens
IQYGEDLEF

SEQ ID NO: 73995 - protein, 9 aa, Homo Sapiens
IQYKTLRTF

SEQ ID NO: 73996 - protein, 9 aa, Homo Sapiens
IRHTGEKPF

SEQ ID NO: 73997 - protein, 9 aa, Homo Sapiens
IRHTGERPY

SEQ ID NO: 73998 - protein, 9 aa, Homo Sapiens
ISAPHMHAY

SEQ ID NO: 73999 - protein, 9 aa, Homo Sapiens
ISERIQLSI

SEQ ID NO: 74000 - protein, 9 aa, Homo Sapiens
ISGPLSPAY

SEQ ID NO: 74001 - protein, 9 aa, Homo Sapiens
ISHQNYIAY

SEQ ID NO: 74002 - protein, 9 aa, Homo Sapiens
ISIDGSRSY

SEQ ID NO: 74003 - protein, 9 aa, Homo Sapiens
ISKALVAYY

SEQ ID NO: 74004 - protein, 9 aa, Homo Sapiens
ISKSTGQEY

SEQ ID NO: 74005 - protein, 9 aa, Homo Sapiens
ISNGGAQTY

SEQ ID NO: 74006 - protein, 9 aa, Homo Sapiens
ISPFEHQTY

SEQ ID NO: 74007 - protein, 9 aa, Homo Sapiens
ISRETGEPY

SEQ ID NO: 74008 - protein, 9 aa, Homo Sapiens
ISREWTQKY

SEQ ID NO: 74009 - protein, 9 aa, Homo Sapiens
ISSPVVTSL

SEQ ID NO: 74010 - protein, 9 aa, Homo Sapiens
ITAPPGTAA

SEQ ID NO: 74011 - protein, 9 aa, Homo Sapiens
ITAPPSRVL

SEQ ID NO: 74012 - protein, 9 aa, Homo Sapiens
ITFEGKVAF

SEQ ID NO: 74013 - protein, 9 aa, Homo Sapiens
ITKDRPINF

SEQ ID NO: 74014 - protein, 9 aa, Homo Sapiens
ITNDTVQTY

SEQ ID NO: 74015 - protein, 9 aa, Homo Sapiens
ITSPHTTSY

SEQ ID NO: 74016 - protein, 9 aa, Homo Sapiens
ITSSPHPEY

SEQ ID NO: 74017 - protein, 9 aa, Homo Sapiens
IVAKSSLQY

SEQ ID NO: 74018 - protein, 9 aa, Homo Sapiens
IVEGENHTY

SEQ ID NO: 74019 - protein, 9 aa, Homo Sapiens
IVFIERTDF

SEQ ID NO: 74020 - protein, 9 aa, Homo Sapiens
IVGPDGLVY

SEQ ID NO: 74021 - protein, 9 aa, Homo Sapiens
IVKEKGTVY

SEQ ID NO: 74022 - protein, 9 aa, Homo Sapiens
IVKKPGNIY

SEQ ID NO: 74023 - protein, 9 aa, Homo Sapiens
IVKPKPRAL

SEQ ID NO: 74024 - protein, 9 aa, Homo Sapiens
IVVKPNLEY

SEQ ID NO: 74025 - protein, 9 aa, Homo Sapiens
IVYPGIAVF

SEQ ID NO: 74026 - protein, 9 aa, Homo Sapiens
IVYPQKAYY

SEQ ID NO: 74027 - protein, 9 aa, Homo Sapiens
KAFPFHIIF

SEQ ID NO: 74028 - protein, 9 aa, Homo Sapiens
KAIATTVTY

SEQ ID NO: 74029 - protein, 9 aa, Homo Sapiens
KASGTLREY

SEQ ID NO: 74030 - protein, 9 aa, Homo Sapiens
KASNPHASF

SEQ ID NO: 74031 - protein, 9 aa, Homo Sapiens
KAVSLFLCY

SEQ ID NO: 74032 - protein, 9 aa, Homo Sapiens
KAYGENIGY

SEQ ID NO: 74033 - protein, 9 aa, Homo Sapiens
KEIESRVVF

SEQ ID NO: 74034 - protein, 9 aa, Homo Sapiens
KFIDTTSKF

SEQ ID NO: 74035 - protein, 9 aa, Homo Sapiens
KFKEVGEAF

SEQ ID NO: 74036 - protein, 9 aa, Homo Sapiens
KFNEPGSQY

SEQ ID NO: 74037 - protein, 9 aa, Homo Sapiens
KFSPNTSQF

SEQ ID NO: 74038 - protein, 9 aa, Homo Sapiens
KIAEQVASF

SEQ ID NO: 74039 - protein, 9 aa, Homo Sapiens
KIFPSVIKY

SEQ ID NO: 74040 - protein, 9 aa, Homo Sapiens
KIHKPEKAF

SEQ ID NO: 74041 - protein, 9 aa, Homo Sapiens
KIIKEKQAF

SEQ ID NO: 74042 - protein, 9 aa, Homo Sapiens
KIIKNVEKY

SEQ ID NO: 74043 - protein, 9 aa, Homo Sapiens
KIINDNATY

SEQ ID NO: 74044 - protein, 9 aa, Homo Sapiens
KIIRNVGKY

SEQ ID NO: 74045 - protein, 9 aa, Homo Sapiens
KIISDNLTY

SEQ ID NO: 74046 - protein, 9 aa, Homo Sapiens
KIKEYIQKY

SEQ ID NO: 74047 - protein, 9 aa, Homo Sapiens
KIKPVSLTF

SEQ ID NO: 74048 - protein, 9 aa, Homo Sapiens
KIKSFEVVF

SEQ ID NO: 74049 - protein, 9 aa, Homo Sapiens
KIKSFVKVY

SEQ ID NO: 74050 - protein, 9 aa, Homo Sapiens
KIKTIGATY

SEQ ID NO: 74051 - protein, 9 aa, Homo Sapiens
KIKTIGSTY

SEQ ID NO: 74052 - protein, 9 aa, Homo Sapiens
KILDMQQTY

SEQ ID NO: 74053 - protein, 9 aa, Homo Sapiens
KIMDVGQSY

SEQ ID NO: 74054 - protein, 9 aa, Homo Sapiens
KIYPLPHMY

SEQ ID NO: 74055 - protein, 9 aa, Homo Sapiens
KLAEQAERY

SEQ ID NO: 74056 - protein, 9 aa, Homo Sapiens
KLAEQYESF

SEQ ID NO: 74057 - protein, 9 aa, Homo Sapiens
KLAGDHIEY

SEQ ID NO: 74058 - protein, 9 aa, Homo Sapiens
KLANIVERY

SEQ ID NO: 74059 - protein, 9 aa, Homo Sapiens
KLAPPSSTL

SEQ ID NO: 74060 - protein, 9 aa, Homo Sapiens
KLAQIRHIY

SEQ ID NO: 74061 - protein, 9 aa, Homo Sapiens
KLFACEVLY

SEQ ID NO: 74062 - protein, 9 aa, Homo Sapiens
KLFGFTERY

SEQ ID NO: 74063 - protein, 9 aa, Homo Sapiens
KLFIGGLSF

SEQ ID NO: 74064 - protein, 9 aa, Homo Sapiens
KLFLEGMHY

SEQ ID NO: 74065 - protein, 9 aa, Homo Sapiens
KLFPYALAF

SEQ ID NO: 74066 - protein, 9 aa, Homo Sapiens
KLFVGGLNF

SEQ ID NO: 74067 - protein, 9 aa, Homo Sapiens
KLHLQSTDY

SEQ ID NO: 74068 - protein, 9 aa, Homo Sapiens
KLIDSLHSY

SEQ ID NO: 74069 - protein, 9 aa, Homo Sapiens
KLIEFMDTF

SEQ ID NO: 74070 - protein, 9 aa, Homo Sapiens
KLIESTSTM

SEQ ID NO: 74071 - protein, 9 aa, Homo Sapiens
KLIGKEVCF

SEQ ID NO: 74072 - protein, 9 aa, Homo Sapiens
KLIKRHEAF

SEQ ID NO: 74073 - protein, 9 aa, Homo Sapiens
KLISQQKAF

SEQ ID NO: 74074 - protein, 9 aa, Homo Sapiens
KLIWKVTDY

SEQ ID NO: 74075 - protein, 9 aa, Homo Sapiens
KLKDATERY

SEQ ID NO: 74076 - protein, 9 aa, Homo Sapiens
KLKEKFQHY

SEQ ID NO: 74077 - protein, 9 aa, Homo Sapiens
KLKGSGLRY

SEQ ID NO: 74078 - protein, 9 aa, Homo Sapiens
KLKRLDEKF

SEQ ID NO: 74079 - protein, 9 aa, Homo Sapiens
KLMSELESF

SEQ ID NO: 74080 - protein, 9 aa, Homo Sapiens
KLNEGVVEF

SEQ ID NO: 74081 - protein, 9 aa, Homo Sapiens
KLNESVMVF

SEQ ID NO: 74082 - protein, 9 aa, Homo Sapiens
KLNPYAKTM

SEQ ID NO: 74083 - protein, 9 aa, Homo Sapiens
KLPDFESRY

SEQ ID NO: 74084 - protein, 9 aa, Homo Sapiens
KLPDIFQSY

SEQ ID NO: 74085 - protein, 9 aa, Homo Sapiens
KLPDIFSVY

SEQ ID NO: 74086 - protein, 9 aa, Homo Sapiens
KLPDVYGVF

SEQ ID NO: 74087 - protein, 9 aa, Homo Sapiens
KLPEKTQTF

SEQ ID NO: 74088 - protein, 9 aa, Homo Sapiens
KLPKGTVSF

SEQ ID NO: 74089 - protein, 9 aa, Homo Sapiens
KLQDPFSLY

SEQ ID NO: 74090 - protein, 9 aa, Homo Sapiens
KLQEALMHY

SEQ ID NO: 74091 - protein, 9 aa, Homo Sapiens
KLQVQIQAY

SEQ ID NO: 74092 - protein, 9 aa, Homo Sapiens
KLREDLERL

SEQ ID NO: 74093 - protein, 9 aa, Homo Sapiens
KLRVETQKF

SEQ ID NO: 74094 - protein, 9 aa, Homo Sapiens
KLSEIVREF

SEQ ID NO: 74095 - protein, 9 aa, Homo Sapiens
KLSKPRVTF

SEQ ID NO: 74096 - protein, 9 aa, Homo Sapiens
KLSPLKSKF

SEQ ID NO: 74097 - protein, 9 aa, Homo Sapiens
KLTKAVATY

SEQ ID NO: 74098 - protein, 9 aa, Homo Sapiens
KLVELCVQY

SEQ ID NO: 74099 - protein, 9 aa, Homo Sapiens
KLVHPTDKY

SEQ ID NO: 74100 - protein, 9 aa, Homo Sapiens
KLVPPHETF

SEQ ID NO: 74101 - protein, 9 aa, Homo Sapiens
KLVSKIAKY

SEQ ID NO: 74102 - protein, 9 aa, Homo Sapiens
KLYDPGQQY

SEQ ID NO: 74103 - protein, 9 aa, Homo Sapiens
KLYEKFLEF

SEQ ID NO: 74104 - protein, 9 aa, Homo Sapiens
KLYPLEIVF

SEQ ID NO: 74105 - protein, 9 aa, Homo Sapiens
KLYPWIHQF

SEQ ID NO: 74106 - protein, 9 aa, Homo Sapiens
KLYQSIIGY

SEQ ID NO: 74107 - protein, 9 aa, Homo Sapiens
KLYVPVKEY

SEQ ID NO: 74108 - protein, 9 aa, Homo Sapiens
KMIPPGIHF

SEQ ID NO: 74109 - protein, 9 aa, Homo Sapiens
KMKEIAEAY

SEQ ID NO: 74110 - protein, 9 aa, Homo Sapiens
KMKPEVTAL

SEQ ID NO: 74111 - protein, 9 aa, Homo Sapiens
KMMPGCEIY

SEQ ID NO: 74112 - protein, 9 aa, Homo Sapiens
KMNPQSAFF

SEQ ID NO: 74113 - protein, 9 aa, Homo Sapiens
KMQGVGEKF

SEQ ID NO: 74114 - protein, 9 aa, Homo Sapiens
KMRPGEATL

SEQ ID NO: 74115 - protein, 9 aa, Homo Sapiens
KMYTDGSTF

SEQ ID NO: 74116 - protein, 9 aa, Homo Sapiens
KQAEEYLSF

SEQ ID NO: 74117 - protein, 9 aa, Homo Sapiens
KQAKLVEQY

SEQ ID NO: 74118 - protein, 9 aa, Homo Sapiens
KQFEGSTSF

SEQ ID NO: 74119 - protein, 9 aa, Homo Sapiens
KQFEKQVEL

SEQ ID NO: 74120 - protein, 9 aa, Homo Sapiens
KQFGNILIL

SEQ ID NO: 74121 - protein, 9 aa, Homo Sapiens
KQFHRIVTY

SEQ ID NO: 74122 - protein, 9 aa, Homo Sapiens
KQFPEVIKY

SEQ ID NO: 74123 - protein, 9 aa, Homo Sapiens
KQFQFGHAL

SEQ ID NO: 74124 - protein, 9 aa, Homo Sapiens
KQIASVMKH

SEQ ID NO: 74125 - protein, 9 aa, Homo Sapiens
KQIENARMF

SEQ ID NO: 74126 - protein, 9 aa, Homo Sapiens
KQIESKTAF

SEQ ID NO: 74127 - protein, 9 aa, Homo Sapiens
KQIFETIYY

SEQ ID NO: 74128 - protein, 9 aa, Homo Sapiens
KQIFKGKTF

SEQ ID NO: 74129 - protein, 9 aa, Homo Sapiens
KQIHFLYQY

SEQ ID NO: 74130 - protein, 9 aa, Homo Sapiens
KQIIRNIKF

SEQ ID NO: 74131 - protein, 9 aa, Homo Sapiens
KQIKTIERY

SEQ ID NO: 74132 - protein, 9 aa, Homo Sapiens
KQILLENTF

SEQ ID NO: 74133 - protein, 9 aa, Homo Sapiens
KQILSNPKF

SEQ ID NO: 74134 - protein, 9 aa, Homo Sapiens
KQINSVNKF

SEQ ID NO: 74135 - protein, 9 aa, Homo Sapiens
KQIPRILGP

SEQ ID NO: 74136 - protein, 9 aa, Homo Sapiens
KQISAEKQY

SEQ ID NO: 74137 - protein, 9 aa, Homo Sapiens
KQISRVEAM

SEQ ID NO: 74138 - protein, 9 aa, Homo Sapiens
KQISSNKCF

SEQ ID NO: 74139 - protein, 9 aa, Homo Sapiens
KQITADKQY

SEQ ID NO: 74140 - protein, 9 aa, Homo Sapiens
KQIVAGVNY

SEQ ID NO: 74141 - protein, 9 aa, Homo Sapiens
KQIVDRVSY

SEQ ID NO: 74142 - protein, 9 aa, Homo Sapiens
KQIVPKESL

SEQ ID NO: 74143 - protein, 9 aa, Homo Sapiens
KQIYYSDKY

SEQ ID NO: 74144 - protein, 9 aa, Homo Sapiens
KQKALNAGY

SEQ ID NO: 74145 - protein, 9 aa, Homo Sapiens
KQKELLKQY

SEQ ID NO: 74146 - protein, 9 aa, Homo Sapiens
KQKERFAAL

SEQ ID NO: 74147 - protein, 9 aa, Homo Sapiens
KQKEVIEGY

SEQ ID NO: 74148 - protein, 9 aa, Homo Sapiens
KQKISKEEF

SEQ ID NO: 74149 - protein, 9 aa, Homo Sapiens
KQKLTSIQF

SEQ ID NO: 74150 - protein, 9 aa, Homo Sapiens
KQKNTVVRY

SEQ ID NO: 74151 - protein, 9 aa, Homo Sapiens
KQKPMNVGL

SEQ ID NO: 74152 - protein, 9 aa, Homo Sapiens
KQKPVLQKY

SEQ ID NO: 74153 - protein, 9 aa, Homo Sapiens
KQKVDLQSL

SEQ ID NO: 74154 - protein, 9 aa, Homo Sapiens
KQKVPLGTF

SEQ ID NO: 74155 - protein, 9 aa, Homo Sapiens
KQMEQISQF

SEQ ID NO: 74156 - protein, 9 aa, Homo Sapiens
KQMLSALNY

SEQ ID NO: 74157 - protein, 9 aa, Homo Sapiens
KQMSISTGL

SEQ ID NO: 74158 - protein, 9 aa, Homo Sapiens
KQPDNSPEY

SEQ ID NO: 74159 - protein, 9 aa, Homo Sapiens
KQPSILSKF

SEQ ID NO: 74160 - protein, 9 aa, Homo Sapiens
KQPSVLVTF

SEQ ID NO: 74161 - protein, 9 aa, Homo Sapiens
KQQLQTQGY

SEQ ID NO: 74162 - protein, 9 aa, Homo Sapiens
KQQNPRLVY

SEQ ID NO: 74163 - protein, 9 aa, Homo Sapiens
KQQQPPTVY

SEQ ID NO: 74164 - protein, 9 aa, Homo Sapiens
KQRDFNQNF

SEQ ID NO: 74165 - protein, 9 aa, Homo Sapiens
KQRLTPKLF

SEQ ID NO: 74166 - protein, 9 aa, Homo Sapiens
KQRTHVMRF

SEQ ID NO: 74167 - protein, 9 aa, Homo Sapiens
KQTALASRF

SEQ ID NO: 74168 - protein, 9 aa, Homo Sapiens
KQTQIFTTY

SEQ ID NO: 74169 - protein, 9 aa, Homo Sapiens
KQTQTFTTY

SEQ ID NO: 74170 - protein, 9 aa, Homo Sapiens
KQVGSHPSF

SEQ ID NO: 74171 - protein, 9 aa, Homo Sapiens
KQVKYFIHY

SEQ ID NO: 74172 - protein, 9 aa, Homo Sapiens
KQVVPVSSH

SEQ ID NO: 74173 - protein, 9 aa, Homo Sapiens
KQYADKLEF

SEQ ID NO: 74174 - protein, 9 aa, Homo Sapiens
KQYADVEGF

SEQ ID NO: 74175 - protein, 9 aa, Homo Sapiens
KQYGEGLSY

SEQ ID NO: 74176 - protein, 9 aa, Homo Sapiens
KQYIMDTVF

SEQ ID NO: 74177 - protein, 9 aa, Homo Sapiens
KQYLPNIAY

SEQ ID NO: 74178 - protein, 9 aa, Homo Sapiens
KQYPRKNLF

SEQ ID NO: 74179 - protein, 9 aa, Homo Sapiens
KQYPYNNLY

SEQ ID NO: 74180 - protein, 9 aa, Homo Sapiens
KSFPGGKEY

SEQ ID NO: 74181 - protein, 9 aa, Homo Sapiens
KSIDNKALY

SEQ ID NO: 74182 - protein, 9 aa, Homo Sapiens
KSMFQRTTY

SEQ ID NO: 74183 - protein, 9 aa, Homo Sapiens
KSPDASSAF

SEQ ID NO: 74184 - protein, 9 aa, Homo Sapiens
KSSEVFTTF

SEQ ID NO: 74185 - protein, 9 aa, Homo Sapiens
KSVRPGASY

SEQ ID NO: 74186 - protein, 9 aa, Homo Sapiens
KTAPFDSRF

SEQ ID NO: 74187 - protein, 9 aa, Homo Sapiens
KTFPYQHRY

SEQ ID NO: 74188 - protein, 9 aa, Homo Sapiens
KTFVTYTVY

SEQ ID NO: 74189 - protein, 9 aa, Homo Sapiens
KTIDKKTFY

SEQ ID NO: 74190 - protein, 9 aa, Homo Sapiens
KTKEIEQVY

SEQ ID NO: 74191 - protein, 9 aa, Homo Sapiens
KTQIPTQRY

SEQ ID NO: 74192 - protein, 9 aa, Homo Sapiens
KVADMALHY

SEQ ID NO: 74193 - protein, 9 aa, Homo Sapiens
KVADPVVTF

SEQ ID NO: 74194 - protein, 9 aa, Homo Sapiens
KVAGHSLGY

SEQ ID NO: 74195 - protein, 9 aa, Homo Sapiens
KVAMSKEQY

SEQ ID NO: 74196 - protein, 9 aa, Homo Sapiens
KVANIILSY

SEQ ID NO: 74197 - protein, 9 aa, Homo Sapiens
KVAQPKEVY

SEQ ID NO: 74198 - protein, 9 aa, Homo Sapiens
KVCDIYINY

SEQ ID NO: 74199 - protein, 9 aa, Homo Sapiens
KVFERAVQY

SEQ ID NO: 74200 - protein, 9 aa, Homo Sapiens
KVFGATTNY

SEQ ID NO: 74201 - protein, 9 aa, Homo Sapiens
KVFVVGESY

SEQ ID NO: 74202 - protein, 9 aa, Homo Sapiens
KVHVPARPY

SEQ ID NO: 74203 - protein, 9 aa, Homo Sapiens
KVINAAHSF

SEQ ID NO: 74204 - protein, 9 aa, Homo Sapiens
KVIQAQTAF

SEQ ID NO: 74205 - protein, 9 aa, Homo Sapiens
KVIQSVANY

SEQ ID NO: 74206 - protein, 9 aa, Homo Sapiens
KVISSSSSF

SEQ ID NO: 74207 - protein, 9 aa, Homo Sapiens
KVKAKSIVF

SEQ ID NO: 74208 - protein, 9 aa, Homo Sapiens
KVKPDSKAF

SEQ ID NO: 74209 - protein, 9 aa, Homo Sapiens
KVMELHKSY

SEQ ID NO: 74210 - protein, 9 aa, Homo Sapiens
KVMPQNHSF

SEQ ID NO: 74211 - protein, 9 aa, Homo Sapiens
KVNDILELY

SEQ ID NO: 74212 - protein, 9 aa, Homo Sapiens
KVQEESVTF

SEQ ID NO: 74213 - protein, 9 aa, Homo Sapiens
KVRESERAF

SEQ ID NO: 74214 - protein, 9 aa, Homo Sapiens
KVSSINSRF

SEQ ID NO: 74215 - protein, 9 aa, Homo Sapiens
KVTWITKSF

SEQ ID NO: 74216 - protein, 9 aa, Homo Sapiens
KVYDLVKAY

SEQ ID NO: 74217 - protein, 9 aa, Homo Sapiens
KVYDPVSEY

SEQ ID NO: 74218 - protein, 9 aa, Homo Sapiens
KVYQETSEM

SEQ ID NO: 74219 - protein, 9 aa, Homo Sapiens
LAGQATTAY

SEQ ID NO: 74220 - protein, 9 aa, Homo Sapiens
LAKGGTVEY

SEQ ID NO: 74221 - protein, 9 aa, Homo Sapiens
LAQTTRTAY

SEQ ID NO: 74222 - protein, 9 aa, Homo Sapiens
LIAGQINTY

SEQ ID NO: 74223 - protein, 9 aa, Homo Sapiens
LIARSLGKY

SEQ ID NO: 74224 - protein, 9 aa, Homo Sapiens
LIFPQDRVF

SEQ ID NO: 74225 - protein, 9 aa, Homo Sapiens
LIHEGENSY

SEQ ID NO: 74226 - protein, 9 aa, Homo Sapiens
LIHRGVSAY

SEQ ID NO: 74227 - protein, 9 aa, Homo Sapiens
LIIANTMAF

SEQ ID NO: 74228 - protein, 9 aa, Homo Sapiens
LIIGKGAAY

SEQ ID NO: 74229 - protein, 9 aa, Homo Sapiens
LIKEKEEAF

SEQ ID NO: 74230 - protein, 9 aa, Homo Sapiens
LIKETTTGY

SEQ ID NO: 74231 - protein, 9 aa, Homo Sapiens
LIKRNKQTY

SEQ ID NO: 74232 - protein, 9 aa, Homo Sapiens
LIRDNRVVY

SEQ ID NO: 74233 - protein, 9 aa, Homo Sapiens
LIREEKNSY

SEQ ID NO: 74234 - protein, 9 aa, Homo Sapiens
LIREYIVEY

SEQ ID NO: 74235 - protein, 9 aa, Homo Sapiens
LIRKDTPHY

SEQ ID NO: 74236 - protein, 9 aa, Homo Sapiens
LIRPVSASF

SEQ ID NO: 74237 - protein, 9 aa, Homo Sapiens
LISSAHSTF

SEQ ID NO: 74238 - protein, 9 aa, Homo Sapiens
LIYEHLQQY

SEQ ID NO: 74239 - protein, 9 aa, Homo Sapiens
LIYEKAKHY

SEQ ID NO: 74240 - protein, 9 aa, Homo Sapiens
LLADITSKY

SEQ ID NO: 74241 - protein, 9 aa, Homo Sapiens
LLADPTGAF

SEQ ID NO: 74242 - protein, 9 aa, Homo Sapiens
LLAHPDAPM

SEQ ID NO: 74243 - protein, 9 aa, Homo Sapiens
LLAKNRQTF

SEQ ID NO: 74244 - protein, 9 aa, Homo Sapiens
LLFPITEKY

SEQ ID NO: 74245 - protein, 9 aa, Homo Sapiens
LLHEVDTQY

SEQ ID NO: 74246 - protein, 9 aa, Homo Sapiens
LLKDKITQY

SEQ ID NO: 74247 - protein, 9 aa, Homo Sapiens
LLKDSIVQL

SEQ ID NO: 74248 - protein, 9 aa, Homo Sapiens
LLKEDDPSY

SEQ ID NO: 74249 - protein, 9 aa, Homo Sapiens
LLKKGPKVY

SEQ ID NO: 74250 - protein, 9 aa, Homo Sapiens
LLKQIQEAY

SEQ ID NO: 74251 - protein, 9 aa, Homo Sapiens
LLKSEKSSY

SEQ ID NO: 74252 - protein, 9 aa, Homo Sapiens
LLKSPGACF

SEQ ID NO: 74253 - protein, 9 aa, Homo Sapiens
LLMGKEVGF

SEQ ID NO: 74254 - protein, 9 aa, Homo Sapiens
LLMPHSAQF

SEQ ID NO: 74255 - protein, 9 aa, Homo Sapiens
LLNKTNVKF

SEQ ID NO: 74256 - protein, 9 aa, Homo Sapiens
LLNSATTSL

SEQ ID NO: 74257 - protein, 9 aa, Homo Sapiens
LLQNPQLAY

SEQ ID NO: 74258 - protein, 9 aa, Homo Sapiens
LLQNSVKQY

SEQ ID NO: 74259 - protein, 9 aa, Homo Sapiens
LLQTRGDSF

SEQ ID NO: 74260 - protein, 9 aa, Homo Sapiens
LLQTVHAEY

SEQ ID NO: 74261 - protein, 9 aa, Homo Sapiens
LLREEDNKY

SEQ ID NO: 74262 - protein, 9 aa, Homo Sapiens
LLREENEGY

SEQ ID NO: 74263 - protein, 9 aa, Homo Sapiens
LLSKGHSCY

SEQ ID NO: 74264 - protein, 9 aa, Homo Sapiens
LLTKNGHVY

SEQ ID NO: 74265 - protein, 9 aa, Homo Sapiens
LLYESPERY

SEQ ID NO: 74266 - protein, 9 aa, Homo Sapiens
LLYQEKIRY

SEQ ID NO: 74267 - protein, 9 aa, Homo Sapiens
LLYTEVTRY

SEQ ID NO: 74268 - protein, 9 aa, Homo Sapiens
LMKEVMEHY

SEQ ID NO: 74269 - protein, 9 aa, Homo Sapiens
LMVGTSIHY

SEQ ID NO: 74270 - protein, 9 aa, Homo Sapiens
LMVPVTVVF

SEQ ID NO: 74271 - protein, 9 aa, Homo Sapiens
LQAHTQSVY

SEQ ID NO: 74272 - protein, 9 aa, Homo Sapiens
LQAMPRTEF

SEQ ID NO: 74273 - protein, 9 aa, Homo Sapiens
LQAPAFTGY

SEQ ID NO: 74274 - protein, 9 aa, Homo Sapiens
LQAPPLTSL

SEQ ID NO: 74275 - protein, 9 aa, Homo Sapiens
LQAQKLVQY

SEQ ID NO: 74276 - protein, 9 aa, Homo Sapiens
LQEQMRALY

SEQ ID NO: 74277 - protein, 9 aa, Homo Sapiens
LQFGPTEKF

SEQ ID NO: 74278 - protein, 9 aa, Homo Sapiens
LQFPVGRVH

SEQ ID NO: 74279 - protein, 9 aa, Homo Sapiens
LQHDNIVKY

SEQ ID NO: 74280 - protein, 9 aa, Homo Sapiens
LQHLQIFTY

SEQ ID NO: 74281 - protein, 9 aa, Homo Sapiens
LQHPDVAAY

SEQ ID NO: 74282 - protein, 9 aa, Homo Sapiens
LQHPNIVGY

SEQ ID NO: 74283 - protein, 9 aa, Homo Sapiens
LQHPNIVRF

SEQ ID NO: 74284 - protein, 9 aa, Homo Sapiens
LQIATHTAF

SEQ ID NO: 74285 - protein, 9 aa, Homo Sapiens
LQIDNARLA

SEQ ID NO: 74286 - protein, 9 aa, Homo Sapiens
LQIGVIRVY

SEQ ID NO: 74287 - protein, 9 aa, Homo Sapiens
LQIGVKSEF

SEQ ID NO: 74288 - protein, 9 aa, Homo Sapiens
LQIIPTLCH

SEQ ID NO: 74289 - protein, 9 aa, Homo Sapiens
LQINDKIAL

SEQ ID NO: 74290 - protein, 9 aa, Homo Sapiens
LQIQRNVTL

SEQ ID NO: 74291 - protein, 9 aa, Homo Sapiens
LQIQSPDQY

SEQ ID NO: 74292 - protein, 9 aa, Homo Sapiens
LQIVHETGY

SEQ ID NO: 74293 - protein, 9 aa, Homo Sapiens
LQKAQTQEF

SEQ ID NO: 74294 - protein, 9 aa, Homo Sapiens
LQKDLSKSM

SEQ ID NO: 74295 - protein, 9 aa, Homo Sapiens
LQKEDVKPY

SEQ ID NO: 74296 - protein, 9 aa, Homo Sapiens
LQKEGPRAF

SEQ ID NO: 74297 - protein, 9 aa, Homo Sapiens
LQKELQEQM

SEQ ID NO: 74298 - protein, 9 aa, Homo Sapiens
LQKGEANIF

SEQ ID NO: 74299 - protein, 9 aa, Homo Sapiens
LQKIEVPLY

SEQ ID NO: 74300 - protein, 9 aa, Homo Sapiens
LQKKFQKQF

SEQ ID NO: 74301 - protein, 9 aa, Homo Sapiens
LQKNVPILY

SEQ ID NO: 74302 - protein, 9 aa, Homo Sapiens
LQKPGETVF

SEQ ID NO: 74303 - protein, 9 aa, Homo Sapiens
LQKPQPQLY

SEQ ID NO: 74304 - protein, 9 aa, Homo Sapiens
LQKPVLPLY

SEQ ID NO: 74305 - protein, 9 aa, Homo Sapiens
LQKSDLSTL

SEQ ID NO: 74306 - protein, 9 aa, Homo Sapiens
LQKVVLPSY

SEQ ID NO: 74307 - protein, 9 aa, Homo Sapiens
LQKYEKEKF

SEQ ID NO: 74308 - protein, 9 aa, Homo Sapiens
LQMAKQLGY

SEQ ID NO: 74309 - protein, 9 aa, Homo Sapiens
LQNKVSGKF

SEQ ID NO: 74310 - protein, 9 aa, Homo Sapiens
LQNLFEEKY

SEQ ID NO: 74311 - protein, 9 aa, Homo Sapiens
LQNNLVELY

SEQ ID NO: 74312 - protein, 9 aa, Homo Sapiens
LQNPDLVSL

SEQ ID NO: 74313 - protein, 9 aa, Homo Sapiens
LQNPKVTEF

SEQ ID NO: 74314 - protein, 9 aa, Homo Sapiens
LQPEPIKVY

SEQ ID NO: 74315 - protein, 9 aa, Homo Sapiens
LQPERCAVF

SEQ ID NO: 74316 - protein, 9 aa, Homo Sapiens
LQQKISVLY

SEQ ID NO: 74317 - protein, 9 aa, Homo Sapiens
LQQNPVTEY

SEQ ID NO: 74318 - protein, 9 aa, Homo Sapiens
LQQPRSLTY

SEQ ID NO: 74319 - protein, 9 aa, Homo Sapiens
LQRAHEQRF

SEQ ID NO: 74320 - protein, 9 aa, Homo Sapiens
LQRANLLSY

SEQ ID NO: 74321 - protein, 9 aa, Homo Sapiens
LQRATGISF

SEQ ID NO: 74322 - protein, 9 aa, Homo Sapiens
LQRATPEQY

SEQ ID NO: 74323 - protein, 9 aa, Homo Sapiens
LQRDKPIEM

SEQ ID NO: 74324 - protein, 9 aa, Homo Sapiens
LQREEEEAF

SEQ ID NO: 74325 - protein, 9 aa, Homo Sapiens
LQREGVSHY

SEQ ID NO: 74326 - protein, 9 aa, Homo Sapiens
LQRGGLKQL

SEQ ID NO: 74327 - protein, 9 aa, Homo Sapiens
LQRLENTQY

SEQ ID NO: 74328 - protein, 9 aa, Homo Sapiens
LQRMEQQEM

SEQ ID NO: 74329 - protein, 9 aa, Homo Sapiens
LQRMTDKCF

SEQ ID NO: 74330 - protein, 9 aa, Homo Sapiens
LQRPNLQKY

SEQ ID NO: 74331 - protein, 9 aa, Homo Sapiens
LQRQGLVSL

SEQ ID NO: 74332 - protein, 9 aa, Homo Sapiens
LQRSPHQGF

SEQ ID NO: 74333 - protein, 9 aa, Homo Sapiens
LQRTMNEIY

SEQ ID NO: 74334 - protein, 9 aa, Homo Sapiens
LQRVLQSEF

SEQ ID NO: 74335 - protein, 9 aa, Homo Sapiens
LQSLPTRAY

SEQ ID NO: 74336 - protein, 9 aa, Homo Sapiens
LQSPNRVGF

SEQ ID NO: 74337 - protein, 9 aa, Homo Sapiens
LQVVKQLAY

SEQ ID NO: 74338 - protein, 9 aa, Homo Sapiens
LRNQLQSVY

SEQ ID NO: 74339 - protein, 9 aa, Homo Sapiens
LSAGATKVY

SEQ ID NO: 74340 - protein, 9 aa, Homo Sapiens
LSAGATRVY

SEQ ID NO: 74341 - protein, 9 aa, Homo Sapiens
LSDTEVLEY

SEQ ID NO: 74342 - protein, 9 aa, Homo Sapiens
LSHEESVSF

SEQ ID NO: 74343 - protein, 9 aa, Homo Sapiens
LSHLPSHHY

SEQ ID NO: 74344 - protein, 9 aa, Homo Sapiens
LSKELRQKY

SEQ ID NO: 74345 - protein, 9 aa, Homo Sapiens
LSKLTDIQY

SEQ ID NO: 74346 - protein, 9 aa, Homo Sapiens
LSKQLNIAY

SEQ ID NO: 74347 - protein, 9 aa, Homo Sapiens
LSQVPSLSH

SEQ ID NO: 74348 - protein, 9 aa, Homo Sapiens
LVIGAGACY

SEQ ID NO: 74349 - protein, 9 aa, Homo Sapiens
LVINSKNQY

SEQ ID NO: 74350 - protein, 9 aa, Homo Sapiens
LVIQDKNKY

SEQ ID NO: 74351 - protein, 9 aa, Homo Sapiens
LVKREDYLY

SEQ ID NO: 74352 - protein, 9 aa, Homo Sapiens
LVKSQISVY

SEQ ID NO: 74353 - protein, 9 aa, Homo Sapiens
LVRELEKKF

SEQ ID NO: 74354 - protein, 9 aa, Homo Sapiens
LVRPPVQVY

SEQ ID NO: 74355 - protein, 9 aa, Homo Sapiens
LVSGGHMEY

SEQ ID NO: 74356 - protein, 9 aa, Homo Sapiens
LVSKQVKEY

SEQ ID NO: 74357 - protein, 9 aa, Homo Sapiens
LVVDSHVQY

SEQ ID NO: 74358 - protein, 9 aa, Homo Sapiens
LVYNGVYQY

SEQ ID NO: 74359 - protein, 9 aa, Homo Sapiens
MARSPGRAY

SEQ ID NO: 74360 - protein, 9 aa, Homo Sapiens
MEIGKTETF

SEQ ID NO: 74361 - protein, 9 aa, Homo Sapiens
MIIFIHSYY

SEQ ID NO: 74362 - protein, 9 aa, Homo Sapiens
MIIGGGMAF

SEQ ID NO: 74363 - protein, 9 aa, Homo Sapiens
MIKGVTLGF

SEQ ID NO: 74364 - protein, 9 aa, Homo Sapiens
MISEPRISY

SEQ ID NO: 74365 - protein, 9 aa, Homo Sapiens
MLAGATAVY

SEQ ID NO: 74366 - protein, 9 aa, Homo Sapiens
MLAPLSTTY

SEQ ID NO: 74367 - protein, 9 aa, Homo Sapiens
MLAPPRELF

SEQ ID NO: 74368 - protein, 9 aa, Homo Sapiens
MLKIAEMEY

SEQ ID NO: 74369 - protein, 9 aa, Homo Sapiens
MLRDIIREY

SEQ ID NO: 74370 - protein, 9 aa, Homo Sapiens
MLYKGQTAY

SEQ ID NO: 74371 - protein, 9 aa, Homo Sapiens
MMIPSQISY

SEQ ID NO: 74372 - protein, 9 aa, Homo Sapiens
MMKTEGPSY

SEQ ID NO: 74373 - protein, 9 aa, Homo Sapiens
MMNGGHYTY

SEQ ID NO: 74374 - protein, 9 aa, Homo Sapiens
MMYSGELKF

SEQ ID NO: 74375 - protein, 9 aa, Homo Sapiens
MQAQSIETY

SEQ ID NO: 74376 - protein, 9 aa, Homo Sapiens
MQKLPGTSH

SEQ ID NO: 74377 - protein, 9 aa, Homo Sapiens
MQLPNGVTY

SEQ ID NO: 74378 - protein, 9 aa, Homo Sapiens
MQNHIVQAF

SEQ ID NO: 74379 - protein, 9 aa, Homo Sapiens
MQQIQKGSY

SEQ ID NO: 74380 - protein, 9 aa, Homo Sapiens
MQQPQISVY

SEQ ID NO: 74381 - protein, 9 aa, Homo Sapiens
MQREPNQAF

SEQ ID NO: 74382 - protein, 9 aa, Homo Sapiens
MSKAPSNTF

SEQ ID NO: 74383 - protein, 9 aa, Homo Sapiens
MTNPHNHLY

SEQ ID NO: 74384 - protein, 9 aa, Homo Sapiens
MVADRVEVY

SEQ ID NO: 74385 - protein, 9 aa, Homo Sapiens
MVQRGGCVY

SEQ ID NO: 74386 - protein, 9 aa, Homo Sapiens
MVVEERCVY

SEQ ID NO: 74387 - protein, 9 aa, Homo Sapiens
NALECARAI

SEQ ID NO: 74388 - protein, 9 aa, Homo Sapiens
NIHSGDRPY

SEQ ID NO: 74389 - protein, 9 aa, Homo Sapiens
NLKTVQPVL

SEQ ID NO: 74390 - protein, 9 aa, Homo Sapiens
NQIESKAAY

SEQ ID NO: 74391 - protein, 9 aa, Homo Sapiens
NQIKSGTPY

SEQ ID NO: 74392 - protein, 9 aa, Homo Sapiens
NQIPFIIQY

SEQ ID NO: 74393 - protein, 9 aa, Homo Sapiens
NQIRPGLQY

SEQ ID NO: 74394 - protein, 9 aa, Homo Sapiens
NQKPPSAEF

SEQ ID NO: 74395 - protein, 9 aa, Homo Sapiens
NQKPPSAEY

SEQ ID NO: 74396 - protein, 9 aa, Homo Sapiens
NQKQQHLAF

SEQ ID NO: 74397 - protein, 9 aa, Homo Sapiens
NQRVQTVHF

SEQ ID NO: 74398 - protein, 9 aa, Homo Sapiens
NQVQSGRAF

SEQ ID NO: 74399 - protein, 9 aa, Homo Sapiens
NVIRDAVTY

SEQ ID NO: 74400 - protein, 9 aa, Homo Sapiens
PQAPSGPSY

SEQ ID NO: 74401 - protein, 9 aa, Homo Sapiens
PQCPSGRVY

SEQ ID NO: 74402 - protein, 9 aa, Homo Sapiens
PQHQSIQEY

SEQ ID NO: 74403 - protein, 9 aa, Homo Sapiens
PQKIAGELY

SEQ ID NO: 74404 - protein, 9 aa, Homo Sapiens
PQMPTQAMF

SEQ ID NO: 74405 - protein, 9 aa, Homo Sapiens
PQRATSNVF

SEQ ID NO: 74406 - protein, 9 aa, Homo Sapiens
PQYQTWEEF

SEQ ID NO: 74407 - protein, 9 aa, Homo Sapiens
QAIKNGQAL

SEQ ID NO: 74408 - protein, 9 aa, Homo Sapiens
QAYHSPATA

SEQ ID NO: 74409 - protein, 9 aa, Homo Sapiens
QERPSVTSY

SEQ ID NO: 74410 - protein, 9 aa, Homo Sapiens
QIALPSGCY

SEQ ID NO: 74411 - protein, 9 aa, Homo Sapiens
QIIQEKRGY

SEQ ID NO: 74412 - protein, 9 aa, Homo Sapiens
QIKPDMETY

SEQ ID NO: 74413 - protein, 9 aa, Homo Sapiens
QIRDVPVLY

SEQ ID NO: 74414 - protein, 9 aa, Homo Sapiens
QLGPVGGVF

SEQ ID NO: 74415 - protein, 9 aa, Homo Sapiens
QLIDIKVAH

SEQ ID NO: 74416 - protein, 9 aa, Homo Sapiens
QLINHIEQF

SEQ ID NO: 74417 - protein, 9 aa, Homo Sapiens
QLIRCIVEY

SEQ ID NO: 74418 - protein, 9 aa, Homo Sapiens
QLKGGIHKY

SEQ ID NO: 74419 - protein, 9 aa, Homo Sapiens
QLPKPTSTY

SEQ ID NO: 74420 - protein, 9 aa, Homo Sapiens
QLQKDKQVY

SEQ ID NO: 74421 - protein, 9 aa, Homo Sapiens
QLRAQILAY

SEQ ID NO: 74422 - protein, 9 aa, Homo Sapiens
QLRAQIMAY

SEQ ID NO: 74423 - protein, 9 aa, Homo Sapiens
QLSFPVRAY

SEQ ID NO: 74424 - protein, 9 aa, Homo Sapiens
QLVAEQVTY

SEQ ID NO: 74425 - protein, 9 aa, Homo Sapiens
QMAGLRDTY

SEQ ID NO: 74426 - protein, 9 aa, Homo Sapiens
QMSNITVTY

SEQ ID NO: 74427 - protein, 9 aa, Homo Sapiens
QMWISKQEY

SEQ ID NO: 74428 - protein, 9 aa, Homo Sapiens
QQAALASQY

SEQ ID NO: 74429 - protein, 9 aa, Homo Sapiens
QQALHTVQY

SEQ ID NO: 74430 - protein, 9 aa, Homo Sapiens
QQALLRISL

SEQ ID NO: 74431 - protein, 9 aa, Homo Sapiens
QQAQAFYTF

SEQ ID NO: 74432 - protein, 9 aa, Homo Sapiens
QQFLIQQQY

SEQ ID NO: 74433 - protein, 9 aa, Homo Sapiens
QQFPAFNSY

SEQ ID NO: 74434 - protein, 9 aa, Homo Sapiens
QQFRNAPPF

SEQ ID NO: 74435 - protein, 9 aa, Homo Sapiens
QQHFDVQQY

SEQ ID NO: 74436 - protein, 9 aa, Homo Sapiens
QQHSAQAMF

SEQ ID NO: 74437 - protein, 9 aa, Homo Sapiens
QQIDIQTHF

SEQ ID NO: 74438 - protein, 9 aa, Homo Sapiens
QQIPSKVLF

SEQ ID NO: 74439 - protein, 9 aa, Homo Sapiens
QQITPQLAL

SEQ ID NO: 74440 - protein, 9 aa, Homo Sapiens
QQIYARQYY

SEQ ID NO: 74441 - protein, 9 aa, Homo Sapiens
QQLQGQQFY

SEQ ID NO: 74442 - protein, 9 aa, Homo Sapiens
QQLQLFTEY

SEQ ID NO: 74443 - protein, 9 aa, Homo Sapiens
QQMEQFIQY

SEQ ID NO: 74444 - protein, 9 aa, Homo Sapiens
QQNLNTITY

SEQ ID NO: 74445 - protein, 9 aa, Homo Sapiens
QQNNVENVY

SEQ ID NO: 74446 - protein, 9 aa, Homo Sapiens
QQNPKVQKY

SEQ ID NO: 74447 - protein, 9 aa, Homo Sapiens
QQNPQPLIF

SEQ ID NO: 74448 - protein, 9 aa, Homo Sapiens
QQNQYQASY

SEQ ID NO: 74449 - protein, 9 aa, Homo Sapiens
QQPASGVAY

SEQ ID NO: 74450 - protein, 9 aa, Homo Sapiens
QQQAPGKNF

SEQ ID NO: 74451 - protein, 9 aa, Homo Sapiens
QQQIIRETF

SEQ ID NO: 74452 - protein, 9 aa, Homo Sapiens
QQQIVRETF

SEQ ID NO: 74453 - protein, 9 aa, Homo Sapiens
QQQPALVNY

SEQ ID NO: 74454 - protein, 9 aa, Homo Sapiens
QQQQNPQVY

SEQ ID NO: 74455 - protein, 9 aa, Homo Sapiens
QQQQPQHAF

SEQ ID NO: 74456 - protein, 9 aa, Homo Sapiens
QQQQQQQFQ

SEQ ID NO: 74457 - protein, 9 aa, Homo Sapiens
QQQQQTQAF

SEQ ID NO: 74458 - protein, 9 aa, Homo Sapiens
QQRDLTSQF

SEQ ID NO: 74459 - protein, 9 aa, Homo Sapiens
QQRHLFRTY

SEQ ID NO: 74460 - protein, 9 aa, Homo Sapiens
QQRLLQQQM

SEQ ID NO: 74461 - protein, 9 aa, Homo Sapiens
QQRNAYTRF

SEQ ID NO: 74462 - protein, 9 aa, Homo Sapiens
QQSGAHVEL

SEQ ID NO: 74463 - protein, 9 aa, Homo Sapiens
QQSPGSKAF

SEQ ID NO: 74464 - protein, 9 aa, Homo Sapiens
QQTNSIRNY

SEQ ID NO: 74465 - protein, 9 aa, Homo Sapiens
QQVESRWGY

SEQ ID NO: 74466 - protein, 9 aa, Homo Sapiens
QQVPVNQVF

SEQ ID NO: 74467 - protein, 9 aa, Homo Sapiens
QQVPVPHVY

SEQ ID NO: 74468 - protein, 9 aa, Homo Sapiens
QQYNSFVSL

SEQ ID NO: 74469 - protein, 9 aa, Homo Sapiens
QQYPGQQGY

SEQ ID NO: 74470 - protein, 9 aa, Homo Sapiens
QQYVGKVKF

SEQ ID NO: 74471 - protein, 9 aa, Homo Sapiens
QSKTIKVSY

SEQ ID NO: 74472 - protein, 9 aa, Homo Sapiens
QSSKALLQL

SEQ ID NO: 74473 - protein, 9 aa, Homo Sapiens
QTVLESIEY

SEQ ID NO: 74474 - protein, 9 aa, Homo Sapiens
QVADIDGQY

SEQ ID NO: 74475 - protein, 9 aa, Homo Sapiens
QVAEIVSKY

SEQ ID NO: 74476 - protein, 9 aa, Homo Sapiens
QVAPLTHVF

SEQ ID NO: 74477 - protein, 9 aa, Homo Sapiens
QVAPVANSY

SEQ ID NO: 74478 - protein, 9 aa, Homo Sapiens
QVFEGHTHY

SEQ ID NO: 74479 - protein, 9 aa, Homo Sapiens
QVMEGRVTF

SEQ ID NO: 74480 - protein, 9 aa, Homo Sapiens
QVMPGNIVF

SEQ ID NO: 74481 - protein, 9 aa, Homo Sapiens
QVQQVAAEY

SEQ ID NO: 74482 - protein, 9 aa, Homo Sapiens
QVVFSGKAY

SEQ ID NO: 74483 - protein, 9 aa, Homo Sapiens
QVYGGVTYY

SEQ ID NO: 74484 - protein, 9 aa, Homo Sapiens
RAAPFSLEY

SEQ ID NO: 74485 - protein, 9 aa, Homo Sapiens
RAFHPDLEF

SEQ ID NO: 74486 - protein, 9 aa, Homo Sapiens
RAFPNKQGY

SEQ ID NO: 74487 - protein, 9 aa, Homo Sapiens
RAKEIRLSL

SEQ ID NO: 74488 - protein, 9 aa, Homo Sapiens
RANEPCTSF

SEQ ID NO: 74489 - protein, 9 aa, Homo Sapiens
RANPFNTPH

SEQ ID NO: 74490 - protein, 9 aa, Homo Sapiens
RAQILRIQY

SEQ ID NO: 74491 - protein, 9 aa, Homo Sapiens
RAQPRGAVY

SEQ ID NO: 74492 - protein, 9 aa, Homo Sapiens
RARELLVSY

SEQ ID NO: 74493 - protein, 9 aa, Homo Sapiens
RAYAKALHY

SEQ ID NO: 74494 - protein, 9 aa, Homo Sapiens
RAYAKDVKF

SEQ ID NO: 74495 - protein, 9 aa, Homo Sapiens
RAYQQSEAY

SEQ ID NO: 74496 - protein, 9 aa, Homo Sapiens
RECPSVLEY

SEQ ID NO: 74497 - protein, 9 aa, Homo Sapiens
REIESSPQY

SEQ ID NO: 74498 - protein, 9 aa, Homo Sapiens
RENDIKSYF

SEQ ID NO: 74499 - protein, 9 aa, Homo Sapiens
RERELAEKY

SEQ ID NO: 74500 - protein, 9 aa, Homo Sapiens
RFYIESISY

SEQ ID NO: 74501 - protein, 9 aa, Homo Sapiens
RGFAHGSVY

SEQ ID NO: 74502 - protein, 9 aa, Homo Sapiens
RGQQVIVSY

SEQ ID NO: 74503 - protein, 9 aa, Homo Sapiens
RHMEQHVSF

SEQ ID NO: 74504 - protein, 9 aa, Homo Sapiens
RIADISQVY

SEQ ID NO: 74505 - protein, 9 aa, Homo Sapiens
RIADLISSF

SEQ ID NO: 74506 - protein, 9 aa, Homo Sapiens
RIADRGAEY

SEQ ID NO: 74507 - protein, 9 aa, Homo Sapiens
RIAPAFSSM

SEQ ID NO: 74508 - protein, 9 aa, Homo Sapiens
RIAPPDRRF

SEQ ID NO: 74509 - protein, 9 aa, Homo Sapiens
RIATPFQVY

SEQ ID NO: 74510 - protein, 9 aa, Homo Sapiens
RIFANAHTY

SEQ ID NO: 74511 - protein, 9 aa, Homo Sapiens
RIFANTESY

SEQ ID NO: 74512 - protein, 9 aa, Homo Sapiens
RIFEKDSKF

SEQ ID NO: 74513 - protein, 9 aa, Homo Sapiens
RIFGTDSQY

SEQ ID NO: 74514 - protein, 9 aa, Homo Sapiens
RIFPLSEDY

SEQ ID NO: 74515 - protein, 9 aa, Homo Sapiens
RIHTGEKPY

SEQ ID NO: 74516 - protein, 9 aa, Homo Sapiens
RIHTGERPY

SEQ ID NO: 74517 - protein, 9 aa, Homo Sapiens
RIIFVDEVF

SEQ ID NO: 74518 - protein, 9 aa, Homo Sapiens
RIIHTGEKF

SEQ ID NO: 74519 - protein, 9 aa, Homo Sapiens
RIIPRHLQL

SEQ ID NO: 74520 - protein, 9 aa, Homo Sapiens
RIIPRSVLY

SEQ ID NO: 74521 - protein, 9 aa, Homo Sapiens
RIKAQDEAF

SEQ ID NO: 74522 - protein, 9 aa, Homo Sapiens
RIKETKEVY

SEQ ID NO: 74523 - protein, 9 aa, Homo Sapiens
RIKLEAERF

SEQ ID NO: 74524 - protein, 9 aa, Homo Sapiens
RIKLGDYHF

SEQ ID NO: 74525 - protein, 9 aa, Homo Sapiens
RIKNNDPKL

SEQ ID NO: 74526 - protein, 9 aa, Homo Sapiens
RIKPNAITY

SEQ ID NO: 74527 - protein, 9 aa, Homo Sapiens
RIKPRPERF

SEQ ID NO: 74528 - protein, 9 aa, Homo Sapiens
RIKTEEEAF

SEQ ID NO: 74529 - protein, 9 aa, Homo Sapiens
RILGLLQTY

SEQ ID NO: 74530 - protein, 9 aa, Homo Sapiens
RIMKKTSLY

SEQ ID NO: 74531 - protein, 9 aa, Homo Sapiens
RIMSGESTF

SEQ ID NO: 74532 - protein, 9 aa, Homo Sapiens
RINENDPEY

SEQ ID NO: 74533 - protein, 9 aa, Homo Sapiens
RINPQTTEF

SEQ ID NO: 74534 - protein, 9 aa, Homo Sapiens
RIREDIAKY

SEQ ID NO: 74535 - protein, 9 aa, Homo Sapiens
RISDFHETY

SEQ ID NO: 74536 - protein, 9 aa, Homo Sapiens
RISDIMDVY

SEQ ID NO: 74537 - protein, 9 aa, Homo Sapiens
RISGVDRYY

SEQ ID NO: 74538 - protein, 9 aa, Homo Sapiens
RISVIKSVF

SEQ ID NO: 74539 - protein, 9 aa, Homo Sapiens
RITENTSQY

SEQ ID NO: 74540 - protein, 9 aa, Homo Sapiens
RLAEQAERY

SEQ ID NO: 74541 - protein, 9 aa, Homo Sapiens
RLAEQVSSY

SEQ ID NO: 74542 - protein, 9 aa, Homo Sapiens
RLAKGSECY

SEQ ID NO: 74543 - protein, 9 aa, Homo Sapiens
RLAPRGSGY

SEQ ID NO: 74544 - protein, 9 aa, Homo Sapiens
RLAQLLEGY

SEQ ID NO: 74545 - protein, 9 aa, Homo Sapiens
RLATLFESY

SEQ ID NO: 74546 - protein, 9 aa, Homo Sapiens
RLFEKMQAY

SEQ ID NO: 74547 - protein, 9 aa, Homo Sapiens
RLFFHCSQY

SEQ ID NO: 74548 - protein, 9 aa, Homo Sapiens
RLFKDQLVY

SEQ ID NO: 74549 - protein, 9 aa, Homo Sapiens
RLFKIDKEY

SEQ ID NO: 74550 - protein, 9 aa, Homo Sapiens
RLFPLIQAM

SEQ ID NO: 74551 - protein, 9 aa, Homo Sapiens
RLFPLIQTM

SEQ ID NO: 74552 - protein, 9 aa, Homo Sapiens
RLFQDEEIY

SEQ ID NO: 74553 - protein, 9 aa, Homo Sapiens
RLFQENSVL

SEQ ID NO: 74554 - protein, 9 aa, Homo Sapiens
RLFRDATRY

SEQ ID NO: 74555 - protein, 9 aa, Homo Sapiens
RLFSRLYTY

SEQ ID NO: 74556 - protein, 9 aa, Homo Sapiens
RLFVGARIY

SEQ ID NO: 74557 - protein, 9 aa, Homo Sapiens
RLHCESESF

SEQ ID NO: 74558 - protein, 9 aa, Homo Sapiens
RLHSGEVKF

SEQ ID NO: 74559 - protein, 9 aa, Homo Sapiens
RLHSHDVRY

SEQ ID NO: 74560 - protein, 9 aa, Homo Sapiens
RLIGHQEAF

SEQ ID NO: 74561 - protein, 9 aa, Homo Sapiens
RLIGIYKTY

SEQ ID NO: 74562 - protein, 9 aa, Homo Sapiens
RLILDWVPY

SEQ ID NO: 74563 - protein, 9 aa, Homo Sapiens
RLINTQAIF

SEQ ID NO: 74564 - protein, 9 aa, Homo Sapiens
RLIPHVQVF

SEQ ID NO: 74565 - protein, 9 aa, Homo Sapiens
RLIPSLRTY

SEQ ID NO: 74566 - protein, 9 aa, Homo Sapiens
RLISENSVY

SEQ ID NO: 74567 - protein, 9 aa, Homo Sapiens
RLKDGVLAY

SEQ ID NO: 74568 - protein, 9 aa, Homo Sapiens
RLKDVVRAY

SEQ ID NO: 74569 - protein, 9 aa, Homo Sapiens
RLKEFLKNY

SEQ ID NO: 74570 - protein, 9 aa, Homo Sapiens
RLKGKDMVV

SEQ ID NO: 74571 - protein, 9 aa, Homo Sapiens
RLKKLIEQY

SEQ ID NO: 74572 - protein, 9 aa, Homo Sapiens
RLKLEVQKY

SEQ ID NO: 74573 - protein, 9 aa, Homo Sapiens
RLKLQGAKF

SEQ ID NO: 74574 - protein, 9 aa, Homo Sapiens
RLKNERTVF

SEQ ID NO: 74575 - protein, 9 aa, Homo Sapiens
RLKSKDVKL

SEQ ID NO: 74576 - protein, 9 aa, Homo Sapiens
RLKSQDLEL

SEQ ID NO: 74577 - protein, 9 aa, Homo Sapiens
RLKTMTDTY

SEQ ID NO: 74578 - protein, 9 aa, Homo Sapiens
RLKVEGHRF

SEQ ID NO: 74579 - protein, 9 aa, Homo Sapiens
RLLDTTITF

SEQ ID NO: 74580 - protein, 9 aa, Homo Sapiens
RLMKQISSF

SEQ ID NO: 74581 - protein, 9 aa, Homo Sapiens
RLMQCVSSF

SEQ ID NO: 74582 - protein, 9 aa, Homo Sapiens
RLMQVGEEF

SEQ ID NO: 74583 - protein, 9 aa, Homo Sapiens
RLNEAEQKY

SEQ ID NO: 74584 - protein, 9 aa, Homo Sapiens
RLNKVISEL

SEQ ID NO: 74585 - protein, 9 aa, Homo Sapiens
RLNNKINSY

SEQ ID NO: 74586 - protein, 9 aa, Homo Sapiens
RLNSAPDMR

SEQ ID NO: 74587 - protein, 9 aa, Homo Sapiens
RLPAGQATY

SEQ ID NO: 74588 - protein, 9 aa, Homo Sapiens
RLPATRTVY

SEQ ID NO: 74589 - protein, 9 aa, Homo Sapiens
RLPDAHSDY

SEQ ID NO: 74590 - protein, 9 aa, Homo Sapiens
RLQAKVEKY

SEQ ID NO: 74591 - protein, 9 aa, Homo Sapiens
RLQDQHMFY

SEQ ID NO: 74592 - protein, 9 aa, Homo Sapiens
RLQEALNLF

SEQ ID NO: 74593 - protein, 9 aa, Homo Sapiens
RLQEFLTAY

SEQ ID NO: 74594 - protein, 9 aa, Homo Sapiens
RLQEVLNDY

SEQ ID NO: 74595 - protein, 9 aa, Homo Sapiens
RLQKIQNAY

SEQ ID NO: 74596 - protein, 9 aa, Homo Sapiens
RLQPFLQRY

SEQ ID NO: 74597 - protein, 9 aa, Homo Sapiens
RLQSSFTAF

SEQ ID NO: 74598 - protein, 9 aa, Homo Sapiens
RLQVSYEEY

SEQ ID NO: 74599 - protein, 9 aa, Homo Sapiens
RLRDDIKEY

SEQ ID NO: 74600 - protein, 9 aa, Homo Sapiens
RLSLNGVRF

SEQ ID NO: 74601 - protein, 9 aa, Homo Sapiens
RLSPAGAAL

SEQ ID NO: 74602 - protein, 9 aa, Homo Sapiens
RLSPGESAY

SEQ ID NO: 74603 - protein, 9 aa, Homo Sapiens
RLTTSTSTF

SEQ ID NO: 74604 - protein, 9 aa, Homo Sapiens
RLVAIRTEY

SEQ ID NO: 74605 - protein, 9 aa, Homo Sapiens
RLVELLVSY

SEQ ID NO: 74606 - protein, 9 aa, Homo Sapiens
RLVPTGLDF

SEQ ID NO: 74607 - protein, 9 aa, Homo Sapiens
RLVPVLSSY

SEQ ID NO: 74608 - protein, 9 aa, Homo Sapiens
RLVQSPNSY

SEQ ID NO: 74609 - protein, 9 aa, Homo Sapiens
RLYEAMCEF

SEQ ID NO: 74610 - protein, 9 aa, Homo Sapiens
RLYFSQQTY

SEQ ID NO: 74611 - protein, 9 aa, Homo Sapiens
RLYQHAVEY

SEQ ID NO: 74612 - protein, 9 aa, Homo Sapiens
RMHPALSAF

SEQ ID NO: 74613 - protein, 9 aa, Homo Sapiens
RMHQAIERF

SEQ ID NO: 74614 - protein, 9 aa, Homo Sapiens
RMIDIQTRM

SEQ ID NO: 74615 - protein, 9 aa, Homo Sapiens
RMIIAVTSY

SEQ ID NO: 74616 - protein, 9 aa, Homo Sapiens
RMIKEKLCY

SEQ ID NO: 74617 - protein, 9 aa, Homo Sapiens
RMITETEKF

SEQ ID NO: 74618 - protein, 9 aa, Homo Sapiens
RMIYLVTEY

SEQ ID NO: 74619 - protein, 9 aa, Homo Sapiens
RMKDEIREY

SEQ ID NO: 74620 - protein, 9 aa, Homo Sapiens
RMKEVGKVF

SEQ ID NO: 74621 - protein, 9 aa, Homo Sapiens
RMKKLDQQY

SEQ ID NO: 74622 - protein, 9 aa, Homo Sapiens
RMKLKAEAY

SEQ ID NO: 74623 - protein, 9 aa, Homo Sapiens
RMKVTNEDF

SEQ ID NO: 74624 - protein, 9 aa, Homo Sapiens
RMLFKSKAY

SEQ ID NO: 74625 - protein, 9 aa, Homo Sapiens
RMMDSQENY

SEQ ID NO: 74626 - protein, 9 aa, Homo Sapiens
RMNCVLATY

SEQ ID NO: 74627 - protein, 9 aa, Homo Sapiens
RMPPFTQAF

SEQ ID NO: 74628 - protein, 9 aa, Homo Sapiens
RMQDTSVSF

SEQ ID NO: 74629 - protein, 9 aa, Homo Sapiens
RMQEGSEVY

SEQ ID NO: 74630 - protein, 9 aa, Homo Sapiens
RMRHLKIVY

SEQ ID NO: 74631 - protein, 9 aa, Homo Sapiens
RMVEMFLEY

SEQ ID NO: 74632 - protein, 9 aa, Homo Sapiens
RMVLVNAVY

SEQ ID NO: 74633 - protein, 9 aa, Homo Sapiens
RMVQEAEKY

SEQ ID NO: 74634 - protein, 9 aa, Homo Sapiens
RMYPGLQVY

SEQ ID NO: 74635 - protein, 9 aa, Homo Sapiens
RQAAFVDSY

SEQ ID NO: 74636 - protein, 9 aa, Homo Sapiens
RQADFVQVL

SEQ ID NO: 74637 - protein, 9 aa, Homo Sapiens
RQAEMKRLY

SEQ ID NO: 74638 - protein, 9 aa, Homo Sapiens
RQAHLTNQY

SEQ ID NO: 74639 - protein, 9 aa, Homo Sapiens
RQAHMQARF

SEQ ID NO: 74640 - protein, 9 aa, Homo Sapiens
RQAIGLMGY

SEQ ID NO: 74641 - protein, 9 aa, Homo Sapiens
RQALKVIFY

SEQ ID NO: 74642 - protein, 9 aa, Homo Sapiens
RQALLIERY

SEQ ID NO: 74643 - protein, 9 aa, Homo Sapiens
RQALLLLAL

SEQ ID NO: 74644 - protein, 9 aa, Homo Sapiens
RQAMPFKCM

SEQ ID NO: 74645 - protein, 9 aa, Homo Sapiens
RQAPPHIEL

SEQ ID NO: 74646 - protein, 9 aa, Homo Sapiens
RQATVNVSY

SEQ ID NO: 74647 - protein, 9 aa, Homo Sapiens
RQCPLKVSY

SEQ ID NO: 74648 - protein, 9 aa, Homo Sapiens
RQELSHALY

SEQ ID NO: 74649 - protein, 9 aa, Homo Sapiens
RQFCQTVGY

SEQ ID NO: 74650 - protein, 9 aa, Homo Sapiens
RQFDLAWQY

SEQ ID NO: 74651 - protein, 9 aa, Homo Sapiens
RQFEGLMRF

SEQ ID NO: 74652 - protein, 9 aa, Homo Sapiens
RQFEGLQGY

SEQ ID NO: 74653 - protein, 9 aa, Homo Sapiens
RQFGKKHLF

SEQ ID NO: 74654 - protein, 9 aa, Homo Sapiens
RQFMAETQF

SEQ ID NO: 74655 - protein, 9 aa, Homo Sapiens
RQFPFHEMF

SEQ ID NO: 74656 - protein, 9 aa, Homo Sapiens
RQFPGSHRV

SEQ ID NO: 74657 - protein, 9 aa, Homo Sapiens
RQFPTAFEF

SEQ ID NO: 74658 - protein, 9 aa, Homo Sapiens
RQFPVTVHF

SEQ ID NO: 74659 - protein, 9 aa, Homo Sapiens
RQGAHIVGY

SEQ ID NO: 74660 - protein, 9 aa, Homo Sapiens
RQGFVPAAY

SEQ ID NO: 74661 - protein, 9 aa, Homo Sapiens
RQHEEPESF

SEQ ID NO: 74662 - protein, 9 aa, Homo Sapiens
RQHFSPLSL

SEQ ID NO: 74663 - protein, 9 aa, Homo Sapiens
RQHLQATGV

SEQ ID NO: 74664 - protein, 9 aa, Homo Sapiens
RQHNTEIRM

SEQ ID NO: 74665 - protein, 9 aa, Homo Sapiens
RQHNYTEAF

SEQ ID NO: 74666 - protein, 9 aa, Homo Sapiens
RQHPIQVFY

SEQ ID NO: 74667 - protein, 9 aa, Homo Sapiens
RQHRMMILY

SEQ ID NO: 74668 - protein, 9 aa, Homo Sapiens
RQIAKAMEA

SEQ ID NO: 74669 - protein, 9 aa, Homo Sapiens
RQIASNTSL

SEQ ID NO: 74670 - protein, 9 aa, Homo Sapiens
RQIDFVLSY

SEQ ID NO: 74671 - protein, 9 aa, Homo Sapiens
RQIDLVDNY

SEQ ID NO: 74672 - protein, 9 aa, Homo Sapiens
RQIDRQNRL

SEQ ID NO: 74673 - protein, 9 aa, Homo Sapiens
RQIEEQKAL

SEQ ID NO: 74674 - protein, 9 aa, Homo Sapiens
RQIGSVDTF

SEQ ID NO: 74675 - protein, 9 aa, Homo Sapiens
RQIHKFEEL

SEQ ID NO: 74676 - protein, 9 aa, Homo Sapiens
RQIHKVLGM

SEQ ID NO: 74677 - protein, 9 aa, Homo Sapiens
RQIKHMIKY

SEQ ID NO: 74678 - protein, 9 aa, Homo Sapiens
RQINWTVLY

SEQ ID NO: 74679 - protein, 9 aa, Homo Sapiens
RQIQESVTF

SEQ ID NO: 74680 - protein, 9 aa, Homo Sapiens
RQITQVYGF

SEQ ID NO: 74681 - protein, 9 aa, Homo Sapiens
RQIVSAVAY

SEQ ID NO: 74682 - protein, 9 aa, Homo Sapiens
RQIVSAVQY

SEQ ID NO: 74683 - protein, 9 aa, Homo Sapiens
RQIVSGLKY

SEQ ID NO: 74684 - protein, 9 aa, Homo Sapiens
RQKDNLNNY

SEQ ID NO: 74685 - protein, 9 aa, Homo Sapiens
RQKDPVKGM

SEQ ID NO: 74686 - protein, 9 aa, Homo Sapiens
RQKEIPRVL

SEQ ID NO: 74687 - protein, 9 aa, Homo Sapiens
RQKELESNY

SEQ ID NO: 74688 - protein, 9 aa, Homo Sapiens
RQKEVNENF

SEQ ID NO: 74689 - protein, 9 aa, Homo Sapiens
RQKGEQFRL

SEQ ID NO: 74690 - protein, 9 aa, Homo Sapiens
RQKKLEVAM

SEQ ID NO: 74691 - protein, 9 aa, Homo Sapiens
RQKKLFCRY

SEQ ID NO: 74692 - protein, 9 aa, Homo Sapiens
RQKLIAQDY

SEQ ID NO: 74693 - protein, 9 aa, Homo Sapiens
RQKLVRNIY

SEQ ID NO: 74694 - protein, 9 aa, Homo Sapiens
RQKQLQQQF

SEQ ID NO: 74695 - protein, 9 aa, Homo Sapiens
RQKTAVHVL

SEQ ID NO: 74696 - protein, 9 aa, Homo Sapiens
RQKVKNTEF

SEQ ID NO: 74697 - protein, 9 aa, Homo Sapiens
RQKYNVRSM

SEQ ID NO: 74698 - protein, 9 aa, Homo Sapiens
RQLDRNLTF

SEQ ID NO: 74699 - protein, 9 aa, Homo Sapiens
RQLIQESKF

SEQ ID NO: 74700 - protein, 9 aa, Homo Sapiens
RQLLIPCAY

SEQ ID NO: 74701 - protein, 9 aa, Homo Sapiens
RQLLQEDRY

SEQ ID NO: 74702 - protein, 9 aa, Homo Sapiens
RQLLYITAF

SEQ ID NO: 74703 - protein, 9 aa, Homo Sapiens
RQLPCMHEF

SEQ ID NO: 74704 - protein, 9 aa, Homo Sapiens
RQLPSFQTF

SEQ ID NO: 74705 - protein, 9 aa, Homo Sapiens
RQLPSSHAL

SEQ ID NO: 74706 - protein, 9 aa, Homo Sapiens
RQLQQLISF

SEQ ID NO: 74707 - protein, 9 aa, Homo Sapiens
RQMAHVQIF

SEQ ID NO: 74708 - protein, 9 aa, Homo Sapiens
RQMVEHGGF

SEQ ID NO: 74709 - protein, 9 aa, Homo Sapiens
RQNESYLNF

SEQ ID NO: 74710 - protein, 9 aa, Homo Sapiens
RQNIGVATF

SEQ ID NO: 74711 - protein, 9 aa, Homo Sapiens
RQNKLTYTM

SEQ ID NO: 74712 - protein, 9 aa, Homo Sapiens
RQNLLSQSH

SEQ ID NO: 74713 - protein, 9 aa, Homo Sapiens
RQNRVCTTV

SEQ ID NO: 74714 - protein, 9 aa, Homo Sapiens
RQNVAVNEL

SEQ ID NO: 74715 - protein, 9 aa, Homo Sapiens
RQNVKRATF

SEQ ID NO: 74716 - protein, 9 aa, Homo Sapiens
RQPAKVAAL

SEQ ID NO: 74717 - protein, 9 aa, Homo Sapiens
RQPGFASNF

SEQ ID NO: 74718 - protein, 9 aa, Homo Sapiens
RQPGSTAQY

SEQ ID NO: 74719 - protein, 9 aa, Homo Sapiens
RQPLITLQY

SEQ ID NO: 74720 - protein, 9 aa, Homo Sapiens
RQPLKATAY

SEQ ID NO: 74721 - protein, 9 aa, Homo Sapiens
RQPNIKQKF

SEQ ID NO: 74722 - protein, 9 aa, Homo Sapiens
RQPPSTTTF

SEQ ID NO: 74723 - protein, 9 aa, Homo Sapiens
RQPRPSSQY

SEQ ID NO: 74724 - protein, 9 aa, Homo Sapiens
RQPVTKNTF

SEQ ID NO: 74725 - protein, 9 aa, Homo Sapiens
RQQCAFIQF

SEQ ID NO: 74726 - protein, 9 aa, Homo Sapiens
RQQKEAACF

SEQ ID NO: 74727 - protein, 9 aa, Homo Sapiens
RQQQSQTAY

SEQ ID NO: 74728 - protein, 9 aa, Homo Sapiens
RQQSHFAMM

SEQ ID NO: 74729 - protein, 9 aa, Homo Sapiens
RQREIEIRF

SEQ ID NO: 74730 - protein, 9 aa, Homo Sapiens
RQREMEEQM

SEQ ID NO: 74731 - protein, 9 aa, Homo Sapiens
RQRETEAAL

SEQ ID NO: 74732 - protein, 9 aa, Homo Sapiens
RQRGINMRY

SEQ ID NO: 74733 - protein, 9 aa, Homo Sapiens
RQRLQSNAL

SEQ ID NO: 74734 - protein, 9 aa, Homo Sapiens
RQRPYVVTF

SEQ ID NO: 74735 - protein, 9 aa, Homo Sapiens
RQRTEIARL

SEQ ID NO: 74736 - protein, 9 aa, Homo Sapiens
RQSPHSNLF

SEQ ID NO: 74737 - protein, 9 aa, Homo Sapiens
RQSPPRAAL

SEQ ID NO: 74738 - protein, 9 aa, Homo Sapiens
RQSTPRVSF

SEQ ID NO: 74739 - protein, 9 aa, Homo Sapiens
RQTTITSHF

SEQ ID NO: 74740 - protein, 9 aa, Homo Sapiens
RQVAPASGY

SEQ ID NO: 74741 - protein, 9 aa, Homo Sapiens
RQVCQLLGY

SEQ ID NO: 74742 - protein, 9 aa, Homo Sapiens
RQVGATVEF

SEQ ID NO: 74743 - protein, 9 aa, Homo Sapiens
RQVHPFHVY

SEQ ID NO: 74744 - protein, 9 aa, Homo Sapiens
RQVKGDLAF

SEQ ID NO: 74745 - protein, 9 aa, Homo Sapiens
RQVSTLNSY

SEQ ID NO: 74746 - protein, 9 aa, Homo Sapiens
RQVVRSSKF

SEQ ID NO: 74747 - protein, 9 aa, Homo Sapiens
RQVYLPMSY

SEQ ID NO: 74748 - protein, 9 aa, Homo Sapiens
RQYAKDIGF

SEQ ID NO: 74749 - protein, 9 aa, Homo Sapiens
RQYHLQQLF

SEQ ID NO: 74750 - protein, 9 aa, Homo Sapiens
RQYLECEVF

SEQ ID NO: 74751 - protein, 9 aa, Homo Sapiens
RQYLEEVGY

SEQ ID NO: 74752 - protein, 9 aa, Homo Sapiens
RQYPEVIKY

SEQ ID NO: 74753 - protein, 9 aa, Homo Sapiens
RQYVVRKPL

SEQ ID NO: 74754 - protein, 9 aa, Homo Sapiens
RSFPGFQAF

SEQ ID NO: 74755 - protein, 9 aa, Homo Sapiens
RSIPAITRY

SEQ ID NO: 74756 - protein, 9 aa, Homo Sapiens
RSIQQNIQY

SEQ ID NO: 74757 - protein, 9 aa, Homo Sapiens
RSKPQLARY

SEQ ID NO: 74758 - protein, 9 aa, Homo Sapiens
RSLQENIAY

SEQ ID NO: 74759 - protein, 9 aa, Homo Sapiens
RSNTGGQAF

SEQ ID NO: 74760 - protein, 9 aa, Homo Sapiens
RSPDFASSF

SEQ ID NO: 74761 - protein, 9 aa, Homo Sapiens
RSSPPGHYY

SEQ ID NO: 74762 - protein, 9 aa, Homo Sapiens
RSSPPSSQF

SEQ ID NO: 74763 - protein, 9 aa, Homo Sapiens
RTAGPHTQF

SEQ ID NO: 74764 - protein, 9 aa, Homo Sapiens
RTAPSGSEY

SEQ ID NO: 74765 - protein, 9 aa, Homo Sapiens
RTAQEVETY

SEQ ID NO: 74766 - protein, 9 aa, Homo Sapiens
RTHLPGRTY

SEQ ID NO: 74767 - protein, 9 aa, Homo Sapiens
RTHTGERPF

SEQ ID NO: 74768 - protein, 9 aa, Homo Sapiens
RTMDDKTVF

SEQ ID NO: 74769 - protein, 9 aa, Homo Sapiens
RTMEIESTF

SEQ ID NO: 74770 - protein, 9 aa, Homo Sapiens
RTMPSNACF

SEQ ID NO: 74771 - protein, 9 aa, Homo Sapiens
RTSPFFSVY

SEQ ID NO: 74772 - protein, 9 aa, Homo Sapiens
RTSTSQAVF

SEQ ID NO: 74773 - protein, 9 aa, Homo Sapiens
RTVPFCSTF

SEQ ID NO: 74774 - protein, 9 aa, Homo Sapiens
RTYDMIQYY

SEQ ID NO: 74775 - protein, 9 aa, Homo Sapiens
RTYGVVAQY

SEQ ID NO: 74776 - protein, 9 aa, Homo Sapiens
RVADFTEQY

SEQ ID NO: 74777 - protein, 9 aa, Homo Sapiens
RVADLTEQY

SEQ ID NO: 74778 - protein, 9 aa, Homo Sapiens
RVADTFQDY

SEQ ID NO: 74779 - protein, 9 aa, Homo Sapiens
RVAMYVHAY

SEQ ID NO: 74780 - protein, 9 aa, Homo Sapiens
RVAPKQKEF

SEQ ID NO: 74781 - protein, 9 aa, Homo Sapiens
RVAPTANIF

SEQ ID NO: 74782 - protein, 9 aa, Homo Sapiens
RVAQLEQVY

SEQ ID NO: 74783 - protein, 9 aa, Homo Sapiens
RVASVMQEY

SEQ ID NO: 74784 - protein, 9 aa, Homo Sapiens
RVFFVHEGY

SEQ ID NO: 74785 - protein, 9 aa, Homo Sapiens
RVFPYISVM

SEQ ID NO: 74786 - protein, 9 aa, Homo Sapiens
RVFQECLTY

SEQ ID NO: 74787 - protein, 9 aa, Homo Sapiens
RVFSLSSEF

SEQ ID NO: 74788 - protein, 9 aa, Homo Sapiens
RVGPVAATY

SEQ ID NO: 74789 - protein, 9 aa, Homo Sapiens
RVHLPSSIY

SEQ ID NO: 74790 - protein, 9 aa, Homo Sapiens
RVHSGERPF

SEQ ID NO: 74791 - protein, 9 aa, Homo Sapiens
RVHTGERPF

SEQ ID NO: 74792 - protein, 9 aa, Homo Sapiens
RVIDVGSEW

SEQ ID NO: 74793 - protein, 9 aa, Homo Sapiens
RVIELAVKY

SEQ ID NO: 74794 - protein, 9 aa, Homo Sapiens
RVIELVQKY

SEQ ID NO: 74795 - protein, 9 aa, Homo Sapiens
RVINLHEVY

SEQ ID NO: 74796 - protein, 9 aa, Homo Sapiens
RVIQCYIQY

SEQ ID NO: 74797 - protein, 9 aa, Homo Sapiens
RVIQSVTSY

SEQ ID NO: 74798 - protein, 9 aa, Homo Sapiens
RVISKASAY

SEQ ID NO: 74799 - protein, 9 aa, Homo Sapiens
RVIVVSMNY

SEQ ID NO: 74800 - protein, 9 aa, Homo Sapiens
RVKAWTSRY

SEQ ID NO: 74801 - protein, 9 aa, Homo Sapiens
RVKDLESLF

SEQ ID NO: 74802 - protein, 9 aa, Homo Sapiens
RVKEIGSTM

SEQ ID NO: 74803 - protein, 9 aa, Homo Sapiens
RVKEKEAEL

SEQ ID NO: 74804 - protein, 9 aa, Homo Sapiens
RVKEKEAIL

SEQ ID NO: 74805 - protein, 9 aa, Homo Sapiens
RVKLPSKAL

SEQ ID NO: 74806 - protein, 9 aa, Homo Sapiens
RVKNPDKRF

SEQ ID NO: 74807 - protein, 9 aa, Homo Sapiens
RVKPGDVAV

SEQ ID NO: 74808 - protein, 9 aa, Homo Sapiens
RVKPNIFSY

SEQ ID NO: 74809 - protein, 9 aa, Homo Sapiens
RVKQEEQRY

SEQ ID NO: 74810 - protein, 9 aa, Homo Sapiens
RVNKEMARY

SEQ ID NO: 74811 - protein, 9 aa, Homo Sapiens
RVPKTGSAY

SEQ ID NO: 74812 - protein, 9 aa, Homo Sapiens
RVQEGNESY

SEQ ID NO: 74813 - protein, 9 aa, Homo Sapiens
RVQGFQVEY

SEQ ID NO: 74814 - protein, 9 aa, Homo Sapiens
RVQLERVAF

SEQ ID NO: 74815 - protein, 9 aa, Homo Sapiens
RVSHINSNY

SEQ ID NO: 74816 - protein, 9 aa, Homo Sapiens
RVSNIRQVF

SEQ ID NO: 74817 - protein, 9 aa, Homo Sapiens
RVSNVKSVY

SEQ ID NO: 74818 - protein, 9 aa, Homo Sapiens
RVSPDGTAF

SEQ ID NO: 74819 - protein, 9 aa, Homo Sapiens
RVSPPHLTL

SEQ ID NO: 74820 - protein, 9 aa, Homo Sapiens
RVVDIYSKF

SEQ ID NO: 74821 - protein, 9 aa, Homo Sapiens
RVVKGEKSF

SEQ ID NO: 74822 - protein, 9 aa, Homo Sapiens
RVVKGQVEY

SEQ ID NO: 74823 - protein, 9 aa, Homo Sapiens
RVVPHGQSF

SEQ ID NO: 74824 - protein, 9 aa, Homo Sapiens
RVVPQFVVF

SEQ ID NO: 74825 - protein, 9 aa, Homo Sapiens
RVYESKAEF

SEQ ID NO: 74826 - protein, 9 aa, Homo Sapiens
RVYIGRLSY

SEQ ID NO: 74827 - protein, 9 aa, Homo Sapiens
RVYPELQRF

SEQ ID NO: 74828 - protein, 9 aa, Homo Sapiens
RVYPQAVYF

SEQ ID NO: 74829 - protein, 9 aa, Homo Sapiens
RVYVDITTY

SEQ ID NO: 74830 - protein, 9 aa, Homo Sapiens
RVYVGSIYY

SEQ ID NO: 74831 - protein, 9 aa, Homo Sapiens
SAAQPGVAF

SEQ ID NO: 74832 - protein, 9 aa, Homo Sapiens
SAKLERSHY

SEQ ID NO: 74833 - protein, 9 aa, Homo Sapiens
SANVSKVSF

SEQ ID NO: 74834 - protein, 9 aa, Homo Sapiens
SARAGETRF

SEQ ID NO: 74835 - protein, 9 aa, Homo Sapiens
SARLEKLGY

SEQ ID NO: 74836 - protein, 9 aa, Homo Sapiens
SAYGSVKAY

SEQ ID NO: 74837 - protein, 9 aa, Homo Sapiens
SEFPGAQHY

SEQ ID NO: 74838 - protein, 9 aa, Homo Sapiens
SGFENKISY

SEQ ID NO: 74839 - protein, 9 aa, Homo Sapiens
SGKLVQIEY

SEQ ID NO: 74840 - protein, 9 aa, Homo Sapiens
SGKPQEAVY

SEQ ID NO: 74841 - protein, 9 aa, Homo Sapiens
SGRMQKVSY

SEQ ID NO: 74842 - protein, 9 aa, Homo Sapiens
SIAPFHICY

SEQ ID NO: 74843 - protein, 9 aa, Homo Sapiens
SIFGLGLAY

SEQ ID NO: 74844 - protein, 9 aa, Homo Sapiens
SIIPGSAAY

SEQ ID NO: 74845 - protein, 9 aa, Homo Sapiens
SIKETVEAY

SEQ ID NO: 74846 - protein, 9 aa, Homo Sapiens
SIPDIKTAF

SEQ ID NO: 74847 - protein, 9 aa, Homo Sapiens
SIRDGVRAY

SEQ ID NO: 74848 - protein, 9 aa, Homo Sapiens
SIREAGGAF

SEQ ID NO: 74849 - protein, 9 aa, Homo Sapiens
SISGVTAAY

SEQ ID NO: 74850 - protein, 9 aa, Homo Sapiens
SISKALVAY

SEQ ID NO: 74851 - protein, 9 aa, Homo Sapiens
SIYPLHDVF

SEQ ID NO: 74852 - protein, 9 aa, Homo Sapiens
SIYWTAVTY

SEQ ID NO: 74853 - protein, 9 aa, Homo Sapiens
SLATPATHY

SEQ ID NO: 74854 - protein, 9 aa, Homo Sapiens
SLAYLVNTY

SEQ ID NO: 74855 - protein, 9 aa, Homo Sapiens
SLDAPHSTY

SEQ ID NO: 74856 - protein, 9 aa, Homo Sapiens
SLFDNPRTF

SEQ ID NO: 74857 - protein, 9 aa, Homo Sapiens
SLFHAQLAY

SEQ ID NO: 74858 - protein, 9 aa, Homo Sapiens
SLFKSLSRY

SEQ ID NO: 74859 - protein, 9 aa, Homo Sapiens
SLFLPRTDY

SEQ ID NO: 74860 - protein, 9 aa, Homo Sapiens
SLFPHHGTF

SEQ ID NO: 74861 - protein, 9 aa, Homo Sapiens
SLFRKVSVY

SEQ ID NO: 74862 - protein, 9 aa, Homo Sapiens
SLFVGHMDY

SEQ ID NO: 74863 - protein, 9 aa, Homo Sapiens
SLFVSNHAY

SEQ ID NO: 74864 - protein, 9 aa, Homo Sapiens
SLGQPHIAY

SEQ ID NO: 74865 - protein, 9 aa, Homo Sapiens
SLHPGSSAL

SEQ ID NO: 74866 - protein, 9 aa, Homo Sapiens
SLIDTVRSY

SEQ ID NO: 74867 - protein, 9 aa, Homo Sapiens
SLKDPSNNF

SEQ ID NO: 74868 - protein, 9 aa, Homo Sapiens
SLKGLTNSY

SEQ ID NO: 74869 - protein, 9 aa, Homo Sapiens
SLKGVDPKF

SEQ ID NO: 74870 - protein, 9 aa, Homo Sapiens
SLKKQVQSY

SEQ ID NO: 74871 - protein, 9 aa, Homo Sapiens
SLKQEVESF

SEQ ID NO: 74872 - protein, 9 aa, Homo Sapiens
SLMALQNAY

SEQ ID NO: 74873 - protein, 9 aa, Homo Sapiens
SLMHPSISF

SEQ ID NO: 74874 - protein, 9 aa, Homo Sapiens
SLNAGKQRY

SEQ ID NO: 74875 - protein, 9 aa, Homo Sapiens
SLPDFGISY

SEQ ID NO: 74876 - protein, 9 aa, Homo Sapiens
SLREDQQSF

SEQ ID NO: 74877 - protein, 9 aa, Homo Sapiens
SLRFIDVEF

SEQ ID NO: 74878 - protein, 9 aa, Homo Sapiens
SLSDRTNLY

SEQ ID NO: 74879 - protein, 9 aa, Homo Sapiens
SLVGITSAY

SEQ ID NO: 74880 - protein, 9 aa, Homo Sapiens
SLVGPTQSF

SEQ ID NO: 74881 - protein, 9 aa, Homo Sapiens
SMARETVGY

SEQ ID NO: 74882 - protein, 9 aa, Homo Sapiens
SMHLQLTCF

SEQ ID NO: 74883 - protein, 9 aa, Homo Sapiens
SMIIFIHSY

SEQ ID NO: 74884 - protein, 9 aa, Homo Sapiens
SMILNVLEY

SEQ ID NO: 74885 - protein, 9 aa, Homo Sapiens
SMKAKITAY

SEQ ID NO: 74886 - protein, 9 aa, Homo Sapiens
SMKGDPVNY

SEQ ID NO: 74887 - protein, 9 aa, Homo Sapiens
SMKPGEYSY

SEQ ID NO: 74888 - protein, 9 aa, Homo Sapiens
SMQNGVKVY

SEQ ID NO: 74889 - protein, 9 aa, Homo Sapiens
SMRKTFARY

SEQ ID NO: 74890 - protein, 9 aa, Homo Sapiens
SMSDPGVSY

SEQ ID NO: 74891 - protein, 9 aa, Homo Sapiens
SQAAVSARF

SEQ ID NO: 74892 - protein, 9 aa, Homo Sapiens
SQADIKKAY

SEQ ID NO: 74893 - protein, 9 aa, Homo Sapiens
SQAEDVATY

SEQ ID NO: 74894 - protein, 9 aa, Homo Sapiens
SQAESKVFY

SEQ ID NO: 74895 - protein, 9 aa, Homo Sapiens
SQAKALVYY

SEQ ID NO: 74896 - protein, 9 aa, Homo Sapiens
SQALAIRSY

SEQ ID NO: 74897 - protein, 9 aa, Homo Sapiens
SQANIAQVL

SEQ ID NO: 74898 - protein, 9 aa, Homo Sapiens
SQAPQRLSF

SEQ ID NO: 74899 - protein, 9 aa, Homo Sapiens
SQARLLTSF

SEQ ID NO: 74900 - protein, 9 aa, Homo Sapiens
SQARTLITF

SEQ ID NO: 74901 - protein, 9 aa, Homo Sapiens
SQATPHSSY

SEQ ID NO: 74902 - protein, 9 aa, Homo Sapiens
SQCVTGLVF

SEQ ID NO: 74903 - protein, 9 aa, Homo Sapiens
SQEKPSTTY

SEQ ID NO: 74904 - protein, 9 aa, Homo Sapiens
SQFDSTTGF

SEQ ID NO: 74905 - protein, 9 aa, Homo Sapiens
SQFGGGSQY

SEQ ID NO: 74906 - protein, 9 aa, Homo Sapiens
SQFGTVTRF

SEQ ID NO: 74907 - protein, 9 aa, Homo Sapiens
SQFHGLITH

SEQ ID NO: 74908 - protein, 9 aa, Homo Sapiens
SQFIFEHSY

SEQ ID NO: 74909 - protein, 9 aa, Homo Sapiens
SQFKGYFIF

SEQ ID NO: 74910 - protein, 9 aa, Homo Sapiens
SQFPQPQHF

SEQ ID NO: 74911 - protein, 9 aa, Homo Sapiens
SQFSAPRDY

SEQ ID NO: 74912 - protein, 9 aa, Homo Sapiens
SQFSVPSSY

SEQ ID NO: 74913 - protein, 9 aa, Homo Sapiens
SQGLPASRY

SEQ ID NO: 74914 - protein, 9 aa, Homo Sapiens
SQGPVKHVY

SEQ ID NO: 74915 - protein, 9 aa, Homo Sapiens
SQGRPSSMY

SEQ ID NO: 74916 - protein, 9 aa, Homo Sapiens
SQGVHISVY

SEQ ID NO: 74917 - protein, 9 aa, Homo Sapiens
SQHIADTHF

SEQ ID NO: 74918 - protein, 9 aa, Homo Sapiens
SQHPQQTSF

SEQ ID NO: 74919 - protein, 9 aa, Homo Sapiens
SQHQAIERF

SEQ ID NO: 74920 - protein, 9 aa, Homo Sapiens
SQHQETPVY

SEQ ID NO: 74921 - protein, 9 aa, Homo Sapiens
SQHQVKEAL

SEQ ID NO: 74922 - protein, 9 aa, Homo Sapiens
SQHYHQGYY

SEQ ID NO: 74923 - protein, 9 aa, Homo Sapiens
SQIADVARF

SEQ ID NO: 74924 - protein, 9 aa, Homo Sapiens
SQIDNNEPY

SEQ ID NO: 74925 - protein, 9 aa, Homo Sapiens
SQIDNRAVL

SEQ ID NO: 74926 - protein, 9 aa, Homo Sapiens
SQIEEHKVF

SEQ ID NO: 74927 - protein, 9 aa, Homo Sapiens
SQIFIGPTY

SEQ ID NO: 74928 - protein, 9 aa, Homo Sapiens
SQIFISRTY

SEQ ID NO: 74929 - protein, 9 aa, Homo Sapiens
SQIFQLCQF

SEQ ID NO: 74930 - protein, 9 aa, Homo Sapiens
SQIGAVVSH

SEQ ID NO: 74931 - protein, 9 aa, Homo Sapiens
SQIGNCALY

SEQ ID NO: 74932 - protein, 9 aa, Homo Sapiens
SQIISLQTL

SEQ ID NO: 74933 - protein, 9 aa, Homo Sapiens
SQIKAVENY

SEQ ID NO: 74934 - protein, 9 aa, Homo Sapiens
SQILPTEEY

SEQ ID NO: 74935 - protein, 9 aa, Homo Sapiens
SQILSVESY

SEQ ID NO: 74936 - protein, 9 aa, Homo Sapiens
SQINRAYQF

SEQ ID NO: 74937 - protein, 9 aa, Homo Sapiens
SQIQPKLIF

SEQ ID NO: 74938 - protein, 9 aa, Homo Sapiens
SQIRMQNHF

SEQ ID NO: 74939 - protein, 9 aa, Homo Sapiens
SQISKVELF

SEQ ID NO: 74940 - protein, 9 aa, Homo Sapiens
SQIYQSIEF

SEQ ID NO: 74941 - protein, 9 aa, Homo Sapiens
SQKAFCGIY

SEQ ID NO: 74942 - protein, 9 aa, Homo Sapiens
SQKALMLEL

SEQ ID NO: 74943 - protein, 9 aa, Homo Sapiens
SQKDKVRQF

SEQ ID NO: 74944 - protein, 9 aa, Homo Sapiens
SQKENINVL

SEQ ID NO: 74945 - protein, 9 aa, Homo Sapiens
SQKENVLQY

SEQ ID NO: 74946 - protein, 9 aa, Homo Sapiens
SQKGSLISH

SEQ ID NO: 74947 - protein, 9 aa, Homo Sapiens
SQKIALNAH

SEQ ID NO: 74948 - protein, 9 aa, Homo Sapiens
SQKIETMQF

SEQ ID NO: 74949 - protein, 9 aa, Homo Sapiens
SQKIPGMTL

SEQ ID NO: 74950 - protein, 9 aa, Homo Sapiens
SQKIPKVDF

SEQ ID NO: 74951 - protein, 9 aa, Homo Sapiens
SQKKDSLSM

SEQ ID NO: 74952 - protein, 9 aa, Homo Sapiens
SQKKPTVTL

SEQ ID NO: 74953 - protein, 9 aa, Homo Sapiens
SQKNINLIF

SEQ ID NO: 74954 - protein, 9 aa, Homo Sapiens
SQKPGVLTH

SEQ ID NO: 74955 - protein, 9 aa, Homo Sapiens
SQKQIEEHF

SEQ ID NO: 74956 - protein, 9 aa, Homo Sapiens
SQKQISIQH

SEQ ID NO: 74957 - protein, 9 aa, Homo Sapiens
SQKSGLIEH

SEQ ID NO: 74958 - protein, 9 aa, Homo Sapiens
SQKVIGTPH

SEQ ID NO: 74959 - protein, 9 aa, Homo Sapiens
SQKVSGPQY

SEQ ID NO: 74960 - protein, 9 aa, Homo Sapiens
SQKVTFCSH

SEQ ID NO: 74961 - protein, 9 aa, Homo Sapiens
SQLHARPSY

SEQ ID NO: 74962 - protein, 9 aa, Homo Sapiens
SQLKGVSTF

SEQ ID NO: 74963 - protein, 9 aa, Homo Sapiens
SQLPEKVEY

SEQ ID NO: 74964 - protein, 9 aa, Homo Sapiens
SQLPLKVEF

SEQ ID NO: 74965 - protein, 9 aa, Homo Sapiens
SQLVAGVAF

SEQ ID NO: 74966 - protein, 9 aa, Homo Sapiens
SQMGNLHAF

SEQ ID NO: 74967 - protein, 9 aa, Homo Sapiens
SQMKSYQSF

SEQ ID NO: 74968 - protein, 9 aa, Homo Sapiens
SQMPKLEAF

SEQ ID NO: 74969 - protein, 9 aa, Homo Sapiens
SQNKSVHSF

SEQ ID NO: 74970 - protein, 9 aa, Homo Sapiens
SQNMNTKYY

SEQ ID NO: 74971 - protein, 9 aa, Homo Sapiens
SQNNLRVHY

SEQ ID NO: 74972 - protein, 9 aa, Homo Sapiens
SQPASGNTF

SEQ ID NO: 74973 - protein, 9 aa, Homo Sapiens
SQPAVATSF

SEQ ID NO: 74974 - protein, 9 aa, Homo Sapiens
SQPYGQQSY

SEQ ID NO: 74975 - protein, 9 aa, Homo Sapiens
SQQAAIQAY

SEQ ID NO: 74976 - protein, 9 aa, Homo Sapiens
SQQAYQEAF

SEQ ID NO: 74977 - protein, 9 aa, Homo Sapiens
SQQMVMVKY

SEQ ID NO: 74978 - protein, 9 aa, Homo Sapiens
SQQPGHQDF

SEQ ID NO: 74979 - protein, 9 aa, Homo Sapiens
SQQSGEKAF

SEQ ID NO: 74980 - protein, 9 aa, Homo Sapiens
SQQSKISGY

SEQ ID NO: 74981 - protein, 9 aa, Homo Sapiens
SQRAVLVQF

SEQ ID NO: 74982 - protein, 9 aa, Homo Sapiens
SQRDYTQYY

SEQ ID NO: 74983 - protein, 9 aa, Homo Sapiens
SQRFKSSVY

SEQ ID NO: 74984 - protein, 9 aa, Homo Sapiens
SQRIIRNAL

SEQ ID NO: 74985 - protein, 9 aa, Homo Sapiens
SQRIPAHRF

SEQ ID NO: 74986 - protein, 9 aa, Homo Sapiens
SQRLGSQKF

SEQ ID NO: 74987 - protein, 9 aa, Homo Sapiens
SQRLVEERY

SEQ ID NO: 74988 - protein, 9 aa, Homo Sapiens
SQRPAARAF

SEQ ID NO: 74989 - protein, 9 aa, Homo Sapiens
SQRPGAQAL

SEQ ID NO: 74990 - protein, 9 aa, Homo Sapiens
SQRPTVEEL

SEQ ID NO: 74991 - protein, 9 aa, Homo Sapiens
SQRQGRISF

SEQ ID NO: 74992 - protein, 9 aa, Homo Sapiens
SQRSPSELF

SEQ ID NO: 74993 - protein, 9 aa, Homo Sapiens
SQRSTATMY

SEQ ID NO: 74994 - protein, 9 aa, Homo Sapiens
SQRVLYIRY

SEQ ID NO: 74995 - protein, 9 aa, Homo Sapiens
SQSAVKTKF

SEQ ID NO: 74996 - protein, 9 aa, Homo Sapiens
SQSGYSQSY

SEQ ID NO: 74997 - protein, 9 aa, Homo Sapiens
SQSIQNTVY

SEQ ID NO: 74998 - protein, 9 aa, Homo Sapiens
SQSLSHNVF

SEQ ID NO: 74999 - protein, 9 aa, Homo Sapiens
SQSPQGRVM

SEQ ID NO: 75000 - protein, 9 aa, Homo Sapiens
SQTEVSSEY

SEQ ID NO: 75001 - protein, 9 aa, Homo Sapiens
SQTLPTSNY

SEQ ID NO: 75002 - protein, 9 aa, Homo Sapiens
SQVDRLVAL

SEQ ID NO: 75003 - protein, 9 aa, Homo Sapiens
SQVDSKSTF

SEQ ID NO: 75004 - protein, 9 aa, Homo Sapiens
SQVLGLHCY

SEQ ID NO: 75005 - protein, 9 aa, Homo Sapiens
SQVLNRLTF

SEQ ID NO: 75006 - protein, 9 aa, Homo Sapiens
SQVPFPSRL

SEQ ID NO: 75007 - protein, 9 aa, Homo Sapiens
SQVPQQSHF

SEQ ID NO: 75008 - protein, 9 aa, Homo Sapiens
SQVPRSSSM

SEQ ID NO: 75009 - protein, 9 aa, Homo Sapiens
SQVPTQMSF

SEQ ID NO: 75010 - protein, 9 aa, Homo Sapiens
SQVPVKHVY

SEQ ID NO: 75011 - protein, 9 aa, Homo Sapiens
SQVQGTYKY

SEQ ID NO: 75012 - protein, 9 aa, Homo Sapiens
SQVRDVIGF

SEQ ID NO: 75013 - protein, 9 aa, Homo Sapiens
SQVTKSVDF

SEQ ID NO: 75014 - protein, 9 aa, Homo Sapiens
SQVVAGTNY

SEQ ID NO: 75015 - protein, 9 aa, Homo Sapiens
SQVVTRYAY

SEQ ID NO: 75016 - protein, 9 aa, Homo Sapiens
SQYDPKIVY

SEQ ID NO: 75017 - protein, 9 aa, Homo Sapiens
SQYGSQVGY

SEQ ID NO: 75018 - protein, 9 aa, Homo Sapiens
SQYPFPVTL

SEQ ID NO: 75019 - protein, 9 aa, Homo Sapiens
SQYQGVVVY

SEQ ID NO: 75020 - protein, 9 aa, Homo Sapiens
SSHVTNVSF

SEQ ID NO: 75021 - protein, 9 aa, Homo Sapiens
SSKEGGVTF

SEQ ID NO: 75022 - protein, 9 aa, Homo Sapiens
SSMKPTLSH

SEQ ID NO: 75023 - protein, 9 aa, Homo Sapiens
SSNPSVTRY

SEQ ID NO: 75024 - protein, 9 aa, Homo Sapiens
STAPHETSF

SEQ ID NO: 75025 - protein, 9 aa, Homo Sapiens
STHVTISTY

SEQ ID NO: 75026 - protein, 9 aa, Homo Sapiens
STKEDAVSF

SEQ ID NO: 75027 - protein, 9 aa, Homo Sapiens
STKPADMKY

SEQ ID NO: 75028 - protein, 9 aa, Homo Sapiens
STYPRPHEY

SEQ ID NO: 75029 - protein, 9 aa, Homo Sapiens
STYQGERAY

SEQ ID NO: 75030 - protein, 9 aa, Homo Sapiens
SVADIRNAY

SEQ ID NO: 75031 - protein, 9 aa, Homo Sapiens
SVAGHVEVY

SEQ ID NO: 75032 - protein, 9 aa, Homo Sapiens
SVAPGQQVY

SEQ ID NO: 75033 - protein, 9 aa, Homo Sapiens
SVFPERLGF

SEQ ID NO: 75034 - protein, 9 aa, Homo Sapiens
SVHNAGISF

SEQ ID NO: 75035 - protein, 9 aa, Homo Sapiens
SVHQPGSHY

SEQ ID NO: 75036 - protein, 9 aa, Homo Sapiens
SVHSGERPF

SEQ ID NO: 75037 - protein, 9 aa, Homo Sapiens
SVIATIQEY

SEQ ID NO: 75038 - protein, 9 aa, Homo Sapiens
SVIDIINKY

SEQ ID NO: 75039 - protein, 9 aa, Homo Sapiens
SVIDYSNAF

SEQ ID NO: 75040 - protein, 9 aa, Homo Sapiens
SVIESHTEF

SEQ ID NO: 75041 - protein, 9 aa, Homo Sapiens
SVIGASSQF

SEQ ID NO: 75042 - protein, 9 aa, Homo Sapiens
SVIKQTSAF

SEQ ID NO: 75043 - protein, 9 aa, Homo Sapiens
SVINPGAIY

SEQ ID NO: 75044 - protein, 9 aa, Homo Sapiens
SVKASSVVY

SEQ ID NO: 75045 - protein, 9 aa, Homo Sapiens
SVKDGAICY

SEQ ID NO: 75046 - protein, 9 aa, Homo Sapiens
SVKEMRERY

SEQ ID NO: 75047 - protein, 9 aa, Homo Sapiens
SVKEWTITY

SEQ ID NO: 75048 - protein, 9 aa, Homo Sapiens
SVKPASSSF

SEQ ID NO: 75049 - protein, 9 aa, Homo Sapiens
SVKRHEVQF

SEQ ID NO: 75050 - protein, 9 aa, Homo Sapiens
SVMRLTISY

SEQ ID NO: 75051 - protein, 9 aa, Homo Sapiens
SVMTLVSTY

SEQ ID NO: 75052 - protein, 9 aa, Homo Sapiens
SVNLQVATY

SEQ ID NO: 75053 - protein, 9 aa, Homo Sapiens
SVNTPTKTY

SEQ ID NO: 75054 - protein, 9 aa, Homo Sapiens
SVQGAGTSY

SEQ ID NO: 75055 - protein, 9 aa, Homo Sapiens
SVRKDIESY

SEQ ID NO: 75056 - protein, 9 aa, Homo Sapiens
SVSPAGDLF

SEQ ID NO: 75057 - protein, 9 aa, Homo Sapiens
SVVDISQQY

SEQ ID NO: 75058 - protein, 9 aa, Homo Sapiens
SVVGAISSY

SEQ ID NO: 75059 - protein, 9 aa, Homo Sapiens
SVVKELSSF

SEQ ID NO: 75060 - protein, 9 aa, Homo Sapiens
SVYRTVIEY

SEQ ID NO: 75061 - protein, 9 aa, Homo Sapiens
TAAAVGAVF

SEQ ID NO: 75062 - protein, 9 aa, Homo Sapiens
TAKGGDISV

SEQ ID NO: 75063 - protein, 9 aa, Homo Sapiens
TAKSVTCTY

SEQ ID NO: 75064 - protein, 9 aa, Homo Sapiens
TAYPGQTQY

SEQ ID NO: 75065 - protein, 9 aa, Homo Sapiens
TIHTGEKPY

SEQ ID NO: 75066 - protein, 9 aa, Homo Sapiens
TIKSATISY

SEQ ID NO: 75067 - protein, 9 aa, Homo Sapiens
TIMQNPRQY

SEQ ID NO: 75068 - protein, 9 aa, Homo Sapiens
TINAAHVEY

SEQ ID NO: 75069 - protein, 9 aa, Homo Sapiens
TLAFPSEHF

SEQ ID NO: 75070 - protein, 9 aa, Homo Sapiens
TLFPEKQIY

SEQ ID NO: 75071 - protein, 9 aa, Homo Sapiens
TLHERFTKY

SEQ ID NO: 75072 - protein, 9 aa, Homo Sapiens
TLHGLQQYY

SEQ ID NO: 75073 - protein, 9 aa, Homo Sapiens
TLIDSSSSF

SEQ ID NO: 75074 - protein, 9 aa, Homo Sapiens
TLISPSFCY

SEQ ID NO: 75075 - protein, 9 aa, Homo Sapiens
TLITGLEEY

SEQ ID NO: 75076 - protein, 9 aa, Homo Sapiens
TLKDRELSF

SEQ ID NO: 75077 - protein, 9 aa, Homo Sapiens
TLKGPDSHY

SEQ ID NO: 75078 - protein, 9 aa, Homo Sapiens
TLKGVTQYY

SEQ ID NO: 75079 - protein, 9 aa, Homo Sapiens
TLKKAAVHY

SEQ ID NO: 75080 - protein, 9 aa, Homo Sapiens
TLKPSNKAF

SEQ ID NO: 75081 - protein, 9 aa, Homo Sapiens
TLKTPGKSF

SEQ ID NO: 75082 - protein, 9 aa, Homo Sapiens
TLMGPTRVF

SEQ ID NO: 75083 - protein, 9 aa, Homo Sapiens
TLMKQYIEF

SEQ ID NO: 75084 - protein, 9 aa, Homo Sapiens
TLMLEHQAF

SEQ ID NO: 75085 - protein, 9 aa, Homo Sapiens
TLNERFTSY

SEQ ID NO: 75086 - protein, 9 aa, Homo Sapiens
TLNPNAKEF

SEQ ID NO: 75087 - protein, 9 aa, Homo Sapiens
TLNVSTTRY

SEQ ID NO: 75088 - protein, 9 aa, Homo Sapiens
TLQKQCVPF

SEQ ID NO: 75089 - protein, 9 aa, Homo Sapiens
TLQKQSVVY

SEQ ID NO: 75090 - protein, 9 aa, Homo Sapiens
TLQVVTAHY

SEQ ID NO: 75091 - protein, 9 aa, Homo Sapiens
TLRQKIRKY

SEQ ID NO: 75092 - protein, 9 aa, Homo Sapiens
TLSSIRSKY

SEQ ID NO: 75093 - protein, 9 aa, Homo Sapiens
TLTPIIQEY

SEQ ID NO: 75094 - protein, 9 aa, Homo Sapiens
TLTPISAAY

SEQ ID NO: 75095 - protein, 9 aa, Homo Sapiens
TMAPPVMAY

SEQ ID NO: 75096 - protein, 9 aa, Homo Sapiens
TMCPHILRY

SEQ ID NO: 75097 - protein, 9 aa, Homo Sapiens
TMFVQRQVF

SEQ ID NO: 75098 - protein, 9 aa, Homo Sapiens
TMKDFNHSY

SEQ ID NO: 75099 - protein, 9 aa, Homo Sapiens
TMKPMNVEY

SEQ ID NO: 75100 - protein, 9 aa, Homo Sapiens
TMKPSETSF

SEQ ID NO: 75101 - protein, 9 aa, Homo Sapiens
TMMQSGGTF

SEQ ID NO: 75102 - protein, 9 aa, Homo Sapiens
TMRCLFEAY

SEQ ID NO: 75103 - protein, 9 aa, Homo Sapiens
TMRPLATAY

SEQ ID NO: 75104 - protein, 9 aa, Homo Sapiens
TMVGKTFTY

SEQ ID NO: 75105 - protein, 9 aa, Homo Sapiens
TQAAPALDF

SEQ ID NO: 75106 - protein, 9 aa, Homo Sapiens
TQAPIFISF

SEQ ID NO: 75107 - protein, 9 aa, Homo Sapiens
TQAQIKAAY

SEQ ID NO: 75108 - protein, 9 aa, Homo Sapiens
TQAQTTATY

SEQ ID NO: 75109 - protein, 9 aa, Homo Sapiens
TQAYGQQSY

SEQ ID NO: 75110 - protein, 9 aa, Homo Sapiens
TQFGGKRPF

SEQ ID NO: 75111 - protein, 9 aa, Homo Sapiens
TQFVSGSKY

SEQ ID NO: 75112 - protein, 9 aa, Homo Sapiens
TQHPTLRLY

SEQ ID NO: 75113 - protein, 9 aa, Homo Sapiens
TQIPTETTY

SEQ ID NO: 75114 - protein, 9 aa, Homo Sapiens
TQIQPQPGF

SEQ ID NO: 75115 - protein, 9 aa, Homo Sapiens
TQIRVVNAF

SEQ ID NO: 75116 - protein, 9 aa, Homo Sapiens
TQKDNYRVY

SEQ ID NO: 75117 - protein, 9 aa, Homo Sapiens
TQKEHLLKY

SEQ ID NO: 75118 - protein, 9 aa, Homo Sapiens
TQKENLRKF

SEQ ID NO: 75119 - protein, 9 aa, Homo Sapiens
TQKIGVHAF

SEQ ID NO: 75120 - protein, 9 aa, Homo Sapiens
TQKPLPVSL

SEQ ID NO: 75121 - protein, 9 aa, Homo Sapiens
TQKSVTVAF

SEQ ID NO: 75122 - protein, 9 aa, Homo Sapiens
TQKTISLDY

SEQ ID NO: 75123 - protein, 9 aa, Homo Sapiens
TQMPDPKTF

SEQ ID NO: 75124 - protein, 9 aa, Homo Sapiens
TQNGMVQEY

SEQ ID NO: 75125 - protein, 9 aa, Homo Sapiens
TQNKDINQY

SEQ ID NO: 75126 - protein, 9 aa, Homo Sapiens
TQPAPRSIF

SEQ ID NO: 75127 - protein, 9 aa, Homo Sapiens
TQPHPNTVY

SEQ ID NO: 75128 - protein, 9 aa, Homo Sapiens
TQQIKSHEY

SEQ ID NO: 75129 - protein, 9 aa, Homo Sapiens
TQQLLKTAL

SEQ ID NO: 75130 - protein, 9 aa, Homo Sapiens
TQQLQTTCH

SEQ ID NO: 75131 - protein, 9 aa, Homo Sapiens
TQRDFMLSF

SEQ ID NO: 75132 - protein, 9 aa, Homo Sapiens
TQREFMLSF

SEQ ID NO: 75133 - protein, 9 aa, Homo Sapiens
TQREGVSSL

SEQ ID NO: 75134 - protein, 9 aa, Homo Sapiens
TQREVIQAL

SEQ ID NO: 75135 - protein, 9 aa, Homo Sapiens
TQRFMNICF

SEQ ID NO: 75136 - protein, 9 aa, Homo Sapiens
TQRGLKTVF

SEQ ID NO: 75137 - protein, 9 aa, Homo Sapiens
TQRGSIPTY

SEQ ID NO: 75138 - protein, 9 aa, Homo Sapiens
TQRLKIMEY

SEQ ID NO: 75139 - protein, 9 aa, Homo Sapiens
TQRMFEIDY

SEQ ID NO: 75140 - protein, 9 aa, Homo Sapiens
TQRPADVIF

SEQ ID NO: 75141 - protein, 9 aa, Homo Sapiens
TQRPNLIGL

SEQ ID NO: 75142 - protein, 9 aa, Homo Sapiens
TQRSQQLEF

SEQ ID NO: 75143 - protein, 9 aa, Homo Sapiens
TQSGGVRPF

SEQ ID NO: 75144 - protein, 9 aa, Homo Sapiens
TQSGINGTY

SEQ ID NO: 75145 - protein, 9 aa, Homo Sapiens
TQTNKTSSF

SEQ ID NO: 75146 - protein, 9 aa, Homo Sapiens
TQVIHSIEY

SEQ ID NO: 75147 - protein, 9 aa, Homo Sapiens
TQVPPKHVY

SEQ ID NO: 75148 - protein, 9 aa, Homo Sapiens
TQVQGLQHY

SEQ ID NO: 75149 - protein, 9 aa, Homo Sapiens
TQYESKVFY

SEQ ID NO: 75150 - protein, 9 aa, Homo Sapiens
TQYTKPNQY

SEQ ID NO: 75151 - protein, 9 aa, Homo Sapiens
TSAPTGHTF

SEQ ID NO: 75152 - protein, 9 aa, Homo Sapiens
TSFPHESTF

SEQ ID NO: 75153 - protein, 9 aa, Homo Sapiens
TSRIQKLCY

SEQ ID NO: 75154 - protein, 9 aa, Homo Sapiens
TTFPKDPVY

SEQ ID NO: 75155 - protein, 9 aa, Homo Sapiens
TTGKPHVAY

SEQ ID NO: 75156 - protein, 9 aa, Homo Sapiens
TTIDVRTTF

SEQ ID NO: 75157 - protein, 9 aa, Homo Sapiens
TVFSRSQVY

SEQ ID NO: 75158 - protein, 9 aa, Homo Sapiens
TVHGVTQAF

SEQ ID NO: 75159 - protein, 9 aa, Homo Sapiens
TVHTGDRPY

SEQ ID NO: 75160 - protein, 9 aa, Homo Sapiens
TVIDSQTHY

SEQ ID NO: 75161 - protein, 9 aa, Homo Sapiens
TVIPNSHVY

SEQ ID NO: 75162 - protein, 9 aa, Homo Sapiens
TVKDGVTLY

SEQ ID NO: 75163 - protein, 9 aa, Homo Sapiens
TVKDSRTVY

SEQ ID NO: 75164 - protein, 9 aa, Homo Sapiens
TVKVEDLTF

SEQ ID NO: 75165 - protein, 9 aa, Homo Sapiens
TVSPAHTSY

SEQ ID NO: 75166 - protein, 9 aa, Homo Sapiens
TVYMGKVTF

SEQ ID NO: 75167 - protein, 9 aa, Homo Sapiens
VAFPSSSVY

SEQ ID NO: 75168 - protein, 9 aa, Homo Sapiens
VAKEKDIVY

SEQ ID NO: 75169 - protein, 9 aa, Homo Sapiens
VAKTNTVSY

SEQ ID NO: 75170 - protein, 9 aa, Homo Sapiens
VANPNSAIF

SEQ ID NO: 75171 - protein, 9 aa, Homo Sapiens
VAPGKDLTK

SEQ ID NO: 75172 - protein, 9 aa, Homo Sapiens
VEKAPQETY

SEQ ID NO: 75173 - protein, 9 aa, Homo Sapiens
VEKGDHVAY

SEQ ID NO: 75174 - protein, 9 aa, Homo Sapiens
VGIDLGTTY

SEQ ID NO: 75175 - protein, 9 aa, Homo Sapiens
VGVKPVGSD

SEQ ID NO: 75176 - protein, 9 aa, Homo Sapiens
VGYPGRQYY

SEQ ID NO: 75177 - protein, 9 aa, Homo Sapiens
VIAPIISNF

SEQ ID NO: 75178 - protein, 9 aa, Homo Sapiens
VIASIISRY

SEQ ID NO: 75179 - protein, 9 aa, Homo Sapiens
VIFAGGQAY

SEQ ID NO: 75180 - protein, 9 aa, Homo Sapiens
VIFGGLTGY

SEQ ID NO: 75181 - protein, 9 aa, Homo Sapiens
VIFPEGTRY

SEQ ID NO: 75182 - protein, 9 aa, Homo Sapiens
VIIDDRHVY

SEQ ID NO: 75183 - protein, 9 aa, Homo Sapiens
VIIKGTQIY

SEQ ID NO: 75184 - protein, 9 aa, Homo Sapiens
VIIKGTQVY

SEQ ID NO: 75185 - protein, 9 aa, Homo Sapiens
VIKETQERY

SEQ ID NO: 75186 - protein, 9 aa, Homo Sapiens
VILPPLSPY

SEQ ID NO: 75187 - protein, 9 aa, Homo Sapiens
VIRDEVEKY

SEQ ID NO: 75188 - protein, 9 aa, Homo Sapiens
VIRDVEQQF

SEQ ID NO: 75189 - protein, 9 aa, Homo Sapiens
VIRELKEQY

SEQ ID NO: 75190 - protein, 9 aa, Homo Sapiens
VIRQQCVEY

SEQ ID NO: 75191 - protein, 9 aa, Homo Sapiens
VIVGGSSEY

SEQ ID NO: 75192 - protein, 9 aa, Homo Sapiens
VIYPQSASY

SEQ ID NO: 75193 - protein, 9 aa, Homo Sapiens
VLAEKAAAY

SEQ ID NO: 75194 - protein, 9 aa, Homo Sapiens
VLAEVAQHY

SEQ ID NO: 75195 - protein, 9 aa, Homo Sapiens
VLAGHGHLY

SEQ ID NO: 75196 - protein, 9 aa, Homo Sapiens
VLFEHAVGY

SEQ ID NO: 75197 - protein, 9 aa, Homo Sapiens
VLFPLKSEF

SEQ ID NO: 75198 - protein, 9 aa, Homo Sapiens
VLIDVGTGY

SEQ ID NO: 75199 - protein, 9 aa, Homo Sapiens
VLKAAAHHY

SEQ ID NO: 75200 - protein, 9 aa, Homo Sapiens
VLKEEGVSF

SEQ ID NO: 75201 - protein, 9 aa, Homo Sapiens
VLKEKIAKY

SEQ ID NO: 75202 - protein, 9 aa, Homo Sapiens
VLKHPDKKF

SEQ ID NO: 75203 - protein, 9 aa, Homo Sapiens
VLKKLDEQY

SEQ ID NO: 75204 - protein, 9 aa, Homo Sapiens
VLKLTPVAY

SEQ ID NO: 75205 - protein, 9 aa, Homo Sapiens
VLKLVDISY

SEQ ID NO: 75206 - protein, 9 aa, Homo Sapiens
VLKNQEVEF

SEQ ID NO: 75207 - protein, 9 aa, Homo Sapiens
VLKPNIISY

SEQ ID NO: 75208 - protein, 9 aa, Homo Sapiens
VLKQEQEEY

SEQ ID NO: 75209 - protein, 9 aa, Homo Sapiens
VLMKKSETY

SEQ ID NO: 75210 - protein, 9 aa, Homo Sapiens
VLMPKVMHY

SEQ ID NO: 75211 - protein, 9 aa, Homo Sapiens
VLNKVITVY

SEQ ID NO: 75212 - protein, 9 aa, Homo Sapiens
VLNQPNSVF

SEQ ID NO: 75213 - protein, 9 aa, Homo Sapiens
VLQITKIIY

SEQ ID NO: 75214 - protein, 9 aa, Homo Sapiens
VLREESREY

SEQ ID NO: 75215 - protein, 9 aa, Homo Sapiens
VLREIAEEY

SEQ ID NO: 75216 - protein, 9 aa, Homo Sapiens
VLRPFPASY

SEQ ID NO: 75217 - protein, 9 aa, Homo Sapiens
VLRQETEFF

SEQ ID NO: 75218 - protein, 9 aa, Homo Sapiens
VLSPVGKQY

SEQ ID NO: 75219 - protein, 9 aa, Homo Sapiens
VLYLEGVKF

SEQ ID NO: 75220 - protein, 9 aa, Homo Sapiens
VLYPHLSTY

SEQ ID NO: 75221 - protein, 9 aa, Homo Sapiens
VMHQIISKY

SEQ ID NO: 75222 - protein, 9 aa, Homo Sapiens
VMIIRTMLY

SEQ ID NO: 75223 - protein, 9 aa, Homo Sapiens
VMINKATPY

SEQ ID NO: 75224 - protein, 9 aa, Homo Sapiens
VMIRDILMY

SEQ ID NO: 75225 - protein, 9 aa, Homo Sapiens
VMKSLTQTF

SEQ ID NO: 75226 - protein, 9 aa, Homo Sapiens
VMRAYLQQL

SEQ ID NO: 75227 - protein, 9 aa, Homo Sapiens
VMRKLQKTY

SEQ ID NO: 75228 - protein, 9 aa, Homo Sapiens
VQAGNSSLY

SEQ ID NO: 75229 - protein, 9 aa, Homo Sapiens
VQCPHPQIL

SEQ ID NO: 75230 - protein, 9 aa, Homo Sapiens
VQFKLPDVY

SEQ ID NO: 75231 - protein, 9 aa, Homo Sapiens
VQFSNHTGY

SEQ ID NO: 75232 - protein, 9 aa, Homo Sapiens
VQGIFVEKY

SEQ ID NO: 75233 - protein, 9 aa, Homo Sapiens
VQGLLSETY

SEQ ID NO: 75234 - protein, 9 aa, Homo Sapiens
VQGPVGTDF

SEQ ID NO: 75235 - protein, 9 aa, Homo Sapiens
VQGRPGAPF

SEQ ID NO: 75236 - protein, 9 aa, Homo Sapiens
VQHCQSRVF

SEQ ID NO: 75237 - protein, 9 aa, Homo Sapiens
VQHKTTEAL

SEQ ID NO: 75238 - protein, 9 aa, Homo Sapiens
VQIDITRVF

SEQ ID NO: 75239 - protein, 9 aa, Homo Sapiens
VQIEHISSL

SEQ ID NO: 75240 - protein, 9 aa, Homo Sapiens
VQIFERSVY

SEQ ID NO: 75241 - protein, 9 aa, Homo Sapiens
VQINVPITF

SEQ ID NO: 75242 - protein, 9 aa, Homo Sapiens
VQIPPSTTY

SEQ ID NO: 75243 - protein, 9 aa, Homo Sapiens
VQISPMSAF

SEQ ID NO: 75244 - protein, 9 aa, Homo Sapiens
VQITEARCF

SEQ ID NO: 75245 - protein, 9 aa, Homo Sapiens
VQKEDIEVY

SEQ ID NO: 75246 - protein, 9 aa, Homo Sapiens
VQKEGKISY

SEQ ID NO: 75247 - protein, 9 aa, Homo Sapiens
VQKEGPTAL

SEQ ID NO: 75248 - protein, 9 aa, Homo Sapiens
VQKHNIQAL

SEQ ID NO: 75249 - protein, 9 aa, Homo Sapiens
VQKKLRSSL

SEQ ID NO: 75250 - protein, 9 aa, Homo Sapiens
VQKLLEQGL

SEQ ID NO: 75251 - protein, 9 aa, Homo Sapiens
VQKPDAANY

SEQ ID NO: 75252 - protein, 9 aa, Homo Sapiens
VQKRKQLEL

SEQ ID NO: 75253 - protein, 9 aa, Homo Sapiens
VQKVDQYLY

SEQ ID NO: 75254 - protein, 9 aa, Homo Sapiens
VQLEQLRPF

SEQ ID NO: 75255 - protein, 9 aa, Homo Sapiens
VQMKIKELY

SEQ ID NO: 75256 - protein, 9 aa, Homo Sapiens
VQNKLGVVF

SEQ ID NO: 75257 - protein, 9 aa, Homo Sapiens
VQNKNSSYF

SEQ ID NO: 75258 - protein, 9 aa, Homo Sapiens
VQNMKPEEY

SEQ ID NO: 75259 - protein, 9 aa, Homo Sapiens
VQNPALTAL

SEQ ID NO: 75260 - protein, 9 aa, Homo Sapiens
VQPKLWARY

SEQ ID NO: 75261 - protein, 9 aa, Homo Sapiens
VQPPKQQPM

SEQ ID NO: 75262 - protein, 9 aa, Homo Sapiens
VQPSKFNSY

SEQ ID NO: 75263 - protein, 9 aa, Homo Sapiens
VQPSKQLEY

SEQ ID NO: 75264 - protein, 9 aa, Homo Sapiens
VQQLQRLSF

SEQ ID NO: 75265 - protein, 9 aa, Homo Sapiens
VQQNNTESF

SEQ ID NO: 75266 - protein, 9 aa, Homo Sapiens
VQQPGQTNF

SEQ ID NO: 75267 - protein, 9 aa, Homo Sapiens
VQQVHVATY

SEQ ID NO: 75268 - protein, 9 aa, Homo Sapiens
VQQVQRLPF

SEQ ID NO: 75269 - protein, 9 aa, Homo Sapiens
VQQVQVSCF

SEQ ID NO: 75270 - protein, 9 aa, Homo Sapiens
VQRARQIAA

SEQ ID NO: 75271 - protein, 9 aa, Homo Sapiens
VQREYNLNF

SEQ ID NO: 75272 - protein, 9 aa, Homo Sapiens
VQRGGIKLH

SEQ ID NO: 75273 - protein, 9 aa, Homo Sapiens
VQRGIGTAY

SEQ ID NO: 75274 - protein, 9 aa, Homo Sapiens
VQRILRERF

SEQ ID NO: 75275 - protein, 9 aa, Homo Sapiens
VQRITQETF

SEQ ID NO: 75276 - protein, 9 aa, Homo Sapiens
VQRKLGFAL

SEQ ID NO: 75277 - protein, 9 aa, Homo Sapiens
VQRNHETAF

SEQ ID NO: 75278 - protein, 9 aa, Homo Sapiens
VQRPEFHAL

SEQ ID NO: 75279 - protein, 9 aa, Homo Sapiens
VQRPQVVEY

SEQ ID NO: 75280 - protein, 9 aa, Homo Sapiens
VQRRPGQSF

SEQ ID NO: 75281 - protein, 9 aa, Homo Sapiens
VQRTQAPAV

SEQ ID NO: 75282 - protein, 9 aa, Homo Sapiens
VQRVETISL

SEQ ID NO: 75283 - protein, 9 aa, Homo Sapiens
VQRYSQDSF

SEQ ID NO: 75284 - protein, 9 aa, Homo Sapiens
VQSPACTSY

SEQ ID NO: 75285 - protein, 9 aa, Homo Sapiens
VQSSIASAF

SEQ ID NO: 75286 - protein, 9 aa, Homo Sapiens
VQSSTSIRY

SEQ ID NO: 75287 - protein, 9 aa, Homo Sapiens
VQVKRIHEY

SEQ ID NO: 75288 - protein, 9 aa, Homo Sapiens
VQYRYFKGY

SEQ ID NO: 75289 - protein, 9 aa, Homo Sapiens
VQYVHTQRF

SEQ ID NO: 75290 - protein, 9 aa, Homo Sapiens
VSHIMLESY

SEQ ID NO: 75291 - protein, 9 aa, Homo Sapiens
VSHLIATEY

SEQ ID NO: 75292 - protein, 9 aa, Homo Sapiens
VSHWQQQSY

SEQ ID NO: 75293 - protein, 9 aa, Homo Sapiens
VSKPCFTAY

SEQ ID NO: 75294 - protein, 9 aa, Homo Sapiens
VSKPDLITF

SEQ ID NO: 75295 - protein, 9 aa, Homo Sapiens
VSYKGSISY

SEQ ID NO: 75296 - protein, 9 aa, Homo Sapiens
VTKALEHAF

SEQ ID NO: 75297 - protein, 9 aa, Homo Sapiens
VTKPEGKDY

SEQ ID NO: 75298 - protein, 9 aa, Homo Sapiens
VTKPVGGNY

SEQ ID NO: 75299 - protein, 9 aa, Homo Sapiens
VTNPNNTFY

SEQ ID NO: 75300 - protein, 9 aa, Homo Sapiens
VTRPTGVSF

SEQ ID NO: 75301 - protein, 9 aa, Homo Sapiens
VTSPIRASY

SEQ ID NO: 75302 - protein, 9 aa, Homo Sapiens
VVAGDIAVY

SEQ ID NO: 75303 - protein, 9 aa, Homo Sapiens
VVAGIKEYF

SEQ ID NO: 75304 - protein, 9 aa, Homo Sapiens
VVAGSVVSY

SEQ ID NO: 75305 - protein, 9 aa, Homo Sapiens
VVAPAGITL

SEQ ID NO: 75306 - protein, 9 aa, Homo Sapiens
VVAPAGVTL

SEQ ID NO: 75307 - protein, 9 aa, Homo Sapiens
VVAPITTGY

SEQ ID NO: 75308 - protein, 9 aa, Homo Sapiens
VVEGNHTVY

SEQ ID NO: 75309 - protein, 9 aa, Homo Sapiens
VVFPNGKSH

SEQ ID NO: 75310 - protein, 9 aa, Homo Sapiens
VVGPNHAAF

SEQ ID NO: 75311 - protein, 9 aa, Homo Sapiens
VVIDLGEAF

SEQ ID NO: 75312 - protein, 9 aa, Homo Sapiens
VVIGSHAAF

SEQ ID NO: 75313 - protein, 9 aa, Homo Sapiens
VVISSDGQF

SEQ ID NO: 75314 - protein, 9 aa, Homo Sapiens
VVKEPETRY

SEQ ID NO: 75315 - protein, 9 aa, Homo Sapiens
VVKMPSGEF

SEQ ID NO: 75316 - protein, 9 aa, Homo Sapiens
VVKPPGSSL

SEQ ID NO: 75317 - protein, 9 aa, Homo Sapiens
VVKPSDEEL

SEQ ID NO: 75318 - protein, 9 aa, Homo Sapiens
VVNSPHRQY

SEQ ID NO: 75319 - protein, 9 aa, Homo Sapiens
VVQEPGQVF

SEQ ID NO: 75320 - protein, 9 aa, Homo Sapiens
VVREMTEGY

SEQ ID NO: 75321 - protein, 9 aa, Homo Sapiens
VVRKEVIRF

SEQ ID NO: 75322 - protein, 9 aa, Homo Sapiens
VVYKNPSEY

SEQ ID NO: 75323 - protein, 9 aa, Homo Sapiens
VVYPSEICF

SEQ ID NO: 75324 - protein, 9 aa, Homo Sapiens
WQKGIGEFF

SEQ ID NO: 75325 - protein, 9 aa, Homo Sapiens
WQTVVGKTY

SEQ ID NO: 75326 - protein, 9 aa, Homo Sapiens
YAFDFARQS

SEQ ID NO: 75327 - protein, 9 aa, Homo Sapiens
YANEVGEAF

SEQ ID NO: 75328 - protein, 9 aa, Homo Sapiens
YIFKERESF

SEQ ID NO: 75329 - protein, 9 aa, Homo Sapiens
YIQKNVQLY

SEQ ID NO: 75330 - protein, 9 aa, Homo Sapiens
YIRGSTIKY

SEQ ID NO: 75331 - protein, 9 aa, Homo Sapiens
YIRQGEQSL

SEQ ID NO: 75332 - protein, 9 aa, Homo Sapiens
YISFRHHVY

SEQ ID NO: 75333 - protein, 9 aa, Homo Sapiens
YLGEFSITY

SEQ ID NO: 75334 - protein, 9 aa, Homo Sapiens
YLIDRDPTY

SEQ ID NO: 75335 - protein, 9 aa, Homo Sapiens
YLKIRHSSY

SEQ ID NO: 75336 - protein, 9 aa, Homo Sapiens
YLLPDTKAY

SEQ ID NO: 75337 - protein, 9 aa, Homo Sapiens
YLNEKAVSY

SEQ ID NO: 75338 - protein, 9 aa, Homo Sapiens
YLNQTSRSF

SEQ ID NO: 75339 - protein, 9 aa, Homo Sapiens
YLYPDGRSY

SEQ ID NO: 75340 - protein, 9 aa, Homo Sapiens
YLYPDQTHF

SEQ ID NO: 75341 - protein, 9 aa, Homo Sapiens
YMFVDENTF

SEQ ID NO: 75342 - protein, 9 aa, Homo Sapiens
YMIAHITGL

SEQ ID NO: 75343 - protein, 9 aa, Homo Sapiens
YMKSEDPLF

SEQ ID NO: 75344 - protein, 9 aa, Homo Sapiens
YMRDPDDQY

SEQ ID NO: 75345 - protein, 9 aa, Homo Sapiens
YMSGYHTGY

SEQ ID NO: 75346 - protein, 9 aa, Homo Sapiens
YQAEAREAL

SEQ ID NO: 75347 - protein, 9 aa, Homo Sapiens
YQASYNQSF

SEQ ID NO: 75348 - protein, 9 aa, Homo Sapiens
YQFTGIKKY

SEQ ID NO: 75349 - protein, 9 aa, Homo Sapiens
YQHGHINSY

SEQ ID NO: 75350 - protein, 9 aa, Homo Sapiens
YQIDPDACF

SEQ ID NO: 75351 - protein, 9 aa, Homo Sapiens
YQIEPVKKM

SEQ ID NO: 75352 - protein, 9 aa, Homo Sapiens
YQIHRIRHF

SEQ ID NO: 75353 - protein, 9 aa, Homo Sapiens
YQIKVHRKY

SEQ ID NO: 75354 - protein, 9 aa, Homo Sapiens
YQILQGIVF

SEQ ID NO: 75355 - protein, 9 aa, Homo Sapiens
YQILQNYQF

SEQ ID NO: 75356 - protein, 9 aa, Homo Sapiens
YQKQPKIGY

SEQ ID NO: 75357 - protein, 9 aa, Homo Sapiens
YQLIDCAQY

SEQ ID NO: 75358 - protein, 9 aa, Homo Sapiens
YQLVKTYEY

SEQ ID NO: 75359 - protein, 9 aa, Homo Sapiens
YQNVCTQSY

SEQ ID NO: 75360 - protein, 9 aa, Homo Sapiens
YQPAPPSGY

SEQ ID NO: 75361 - protein, 9 aa, Homo Sapiens
YQPETNSSF

SEQ ID NO: 75362 - protein, 9 aa, Homo Sapiens
YQPLQIETY

SEQ ID NO: 75363 - protein, 9 aa, Homo Sapiens
YQPTPTAGY

SEQ ID NO: 75364 - protein, 9 aa, Homo Sapiens
YQQQQQSEL

SEQ ID NO: 75365 - protein, 9 aa, Homo Sapiens
YQRDGPMCM

SEQ ID NO: 75366 - protein, 9 aa, Homo Sapiens
YQRDLEVAL

SEQ ID NO: 75367 - protein, 9 aa, Homo Sapiens
YQRHETEQF

SEQ ID NO: 75368 - protein, 9 aa, Homo Sapiens
YQSDPSGNY

SEQ ID NO: 75369 - protein, 9 aa, Homo Sapiens
YQSHGRSAF

SEQ ID NO: 75370 - protein, 9 aa, Homo Sapiens
YQTAISENY

SEQ ID NO: 75371 - protein, 9 aa, Homo Sapiens
YQTAPKAGY

SEQ ID NO: 75372 - protein, 9 aa, Homo Sapiens
YQTDPSGTY

SEQ ID NO: 75373 - protein, 9 aa, Homo Sapiens
YQVGINQRF

SEQ ID NO: 75374 - protein, 9 aa, Homo Sapiens
YQYLEQSKY

SEQ ID NO: 75375 - protein, 9 aa, Homo Sapiens
YQYLLVTAL

SEQ ID NO: 75376 - protein, 9 aa, Homo Sapiens
YQYPVIIHL

SEQ ID NO: 75377 - protein, 9 aa, Homo Sapiens
YSFGGCHRY

SEQ ID NO: 75378 - protein, 9 aa, Homo Sapiens
YSHLVSVGY

SEQ ID NO: 75379 - protein, 9 aa, Homo Sapiens
YSKKLEAKY

SEQ ID NO: 75380 - protein, 9 aa, Homo Sapiens
YSMPSTHAM

SEQ ID NO: 75381 - protein, 9 aa, Homo Sapiens
YSNGFCTVY

SEQ ID NO: 75382 - protein, 9 aa, Homo Sapiens
YSQEQRQAF

SEQ ID NO: 75383 - protein, 9 aa, Homo Sapiens
YTAQPTQGY

SEQ ID NO: 75384 - protein, 9 aa, Homo Sapiens
YTGPSHHSY

SEQ ID NO: 75385 - protein, 9 aa, Homo Sapiens
YTQQATQSY

SEQ ID NO: 75386 - protein, 9 aa, Homo Sapiens
YVAPAYGVY

SEQ ID NO: 75387 - protein, 9 aa, Homo Sapiens
YVIGGHCGY

SEQ ID NO: 75388 - protein, 9 aa, Homo Sapiens
YVKDDKASF

SEQ ID NO: 75389 - protein, 9 aa, Homo Sapiens
YVNLPTIAL

SEQ ID NO: 75390 - protein, 9 aa, Homo Sapiens
YVTTSTRTY

SEQ ID NO: 75391 - protein, 10 aa, Homo Sapiens
AAAAAAPPDP

SEQ ID NO: 75392 - protein, 10 aa, Homo Sapiens
AAAAAAQSVY

SEQ ID NO: 75393 - protein, 10 aa, Homo Sapiens
AAGPPISEGK

SEQ ID NO: 75394 - protein, 10 aa, Homo Sapiens
AAYGGYPTAH

SEQ ID NO: 75395 - protein, 10 aa, Homo Sapiens
AEKAPTNIVY

SEQ ID NO: 75396 - protein, 10 aa, Homo Sapiens
AIAKAGIPVY

SEQ ID NO: 75397 - protein, 10 aa, Homo Sapiens
AIFGPPNTYY

SEQ ID NO: 75398 - protein, 10 aa, Homo Sapiens
AIKADHVSTY

SEQ ID NO: 75399 - protein, 10 aa, Homo Sapiens
AIKPGTSVEY

SEQ ID NO: 75400 - protein, 10 aa, Homo Sapiens
AIVKEKGTVY

SEQ ID NO: 75401 - protein, 10 aa, Homo Sapiens
ALAEAGVAVF

SEQ ID NO: 75402 - protein, 10 aa, Homo Sapiens
ALAPALVETY

SEQ ID NO: 75403 - protein, 10 aa, Homo Sapiens
ALGPPLNIHY

SEQ ID NO: 75404 - protein, 10 aa, Homo Sapiens
ALIARSLGKY

SEQ ID NO: 75405 - protein, 10 aa, Homo Sapiens
ALIEFIRSEY

SEQ ID NO: 75406 - protein, 10 aa, Homo Sapiens
ALKPPPIKLY

SEQ ID NO: 75407 - protein, 10 aa, Homo Sapiens
ALKRQGRTLY

SEQ ID NO: 75408 - protein, 10 aa, Homo Sapiens
ALPDTLKVTY

SEQ ID NO: 75409 - protein, 10 aa, Homo Sapiens
ALPPGSVISY

SEQ ID NO: 75410 - protein, 10 aa, Homo Sapiens
ALPQHKLTCF

SEQ ID NO: 75411 - protein, 10 aa, Homo Sapiens
ALQEALTEHY

SEQ ID NO: 75412 - protein, 10 aa, Homo Sapiens
ALRASVETGF

SEQ ID NO: 75413 - protein, 10 aa, Homo Sapiens
ALRDNSTMGY

SEQ ID NO: 75414 - protein, 10 aa, Homo Sapiens
ALRKSEIEYY

SEQ ID NO: 75415 - protein, 10 aa, Homo Sapiens
ALRPLDHESY

SEQ ID NO: 75416 - protein, 10 aa, Homo Sapiens
AMLAGATAVY

SEQ ID NO: 75417 - protein, 10 aa, Homo Sapiens
AMYLHRPEEY

SEQ ID NO: 75418 - protein, 10 aa, Homo Sapiens
ANAGAILSQF

SEQ ID NO: 75419 - protein, 10 aa, Homo Sapiens
AQAEAAGAAF

SEQ ID NO: 75420 - protein, 10 aa, Homo Sapiens
AQAEAQQPTF

SEQ ID NO: 75421 - protein, 10 aa, Homo Sapiens
AQAFIHNSLY

SEQ ID NO: 75422 - protein, 10 aa, Homo Sapiens
AQAGWLQHDF

SEQ ID NO: 75423 - protein, 10 aa, Homo Sapiens
AQAGWLQHDY

SEQ ID NO: 75424 - protein, 10 aa, Homo Sapiens
AQAHFNNGEY

SEQ ID NO: 75425 - protein, 10 aa, Homo Sapiens
AQAIEDMVGY

SEQ ID NO: 75426 - protein, 10 aa, Homo Sapiens
AQAPCGQAAY

SEQ ID NO: 75427 - protein, 10 aa, Homo Sapiens
AQAPVTKGCY

SEQ ID NO: 75428 - protein, 10 aa, Homo Sapiens
AQAQKCFALY

SEQ ID NO: 75429 - protein, 10 aa, Homo Sapiens
AQCDKPNKEF

SEQ ID NO: 75430 - protein, 10 aa, Homo Sapiens
AQEPNVKETY

SEQ ID NO: 75431 - protein, 10 aa, Homo Sapiens
AQFEPDSTEY

SEQ ID NO: 75432 - protein, 10 aa, Homo Sapiens
AQFHPDGLIF

SEQ ID NO: 75433 - protein, 10 aa, Homo Sapiens
AQFIDKPVCF

SEQ ID NO: 75434 - protein, 10 aa, Homo Sapiens
AQFRDPCRSY

SEQ ID NO: 75435 - protein, 10 aa, Homo Sapiens
AQFTAQVHHF

SEQ ID NO: 75436 - protein, 10 aa, Homo Sapiens
AQHEDQVEQY

SEQ ID NO: 75437 - protein, 10 aa, Homo Sapiens
AQHLQAAVAF

SEQ ID NO: 75438 - protein, 10 aa, Homo Sapiens
AQICSSIRTH

SEQ ID NO: 75439 - protein, 10 aa, Homo Sapiens
AQIKEKLERY

SEQ ID NO: 75440 - protein, 10 aa, Homo Sapiens
AQILDKATEY

SEQ ID NO: 75441 - protein, 10 aa, Homo Sapiens
AQILKVIEAY

SEQ ID NO: 75442 - protein, 10 aa, Homo Sapiens
AQINELHLAY

SEQ ID NO: 75443 - protein, 10 aa, Homo Sapiens
AQINSVFNKY

SEQ ID NO: 75444 - protein, 10 aa, Homo Sapiens
AQIPVDLSEL

SEQ ID NO: 75445 - protein, 10 aa, Homo Sapiens
AQIRYEGILY

SEQ ID NO: 75446 - protein, 10 aa, Homo Sapiens
AQITQKIGVH

SEQ ID NO: 75447 - protein, 10 aa, Homo Sapiens
AQKAASKVTL

SEQ ID NO: 75448 - protein, 10 aa, Homo Sapiens
AQKAVGKDNF

SEQ ID NO: 75449 - protein, 10 aa, Homo Sapiens
AQKEPHPLQF

SEQ ID NO: 75450 - protein, 10 aa, Homo Sapiens
AQKQIFDVVY

SEQ ID NO: 75451 - protein, 10 aa, Homo Sapiens
AQKRLSENAF

SEQ ID NO: 75452 - protein, 10 aa, Homo Sapiens
AQKSGDGVQF

SEQ ID NO: 75453 - protein, 10 aa, Homo Sapiens
AQKSSELEQY

SEQ ID NO: 75454 - protein, 10 aa, Homo Sapiens
AQKTIVKETY

SEQ ID NO: 75455 - protein, 10 aa, Homo Sapiens
AQKYHEYSHY

SEQ ID NO: 75456 - protein, 10 aa, Homo Sapiens
AQLDPSLVAF

SEQ ID NO: 75457 - protein, 10 aa, Homo Sapiens
AQLGPVGGVF

SEQ ID NO: 75458 - protein, 10 aa, Homo Sapiens
AQLPKPTSTY

SEQ ID NO: 75459 - protein, 10 aa, Homo Sapiens
AQMPTVHYEF

SEQ ID NO: 75460 - protein, 10 aa, Homo Sapiens
AQNAVQRAAY

SEQ ID NO: 75461 - protein, 10 aa, Homo Sapiens
AQNEGKAMSY

SEQ ID NO: 75462 - protein, 10 aa, Homo Sapiens
AQNPANMSKY

SEQ ID NO: 75463 - protein, 10 aa, Homo Sapiens
AQNPSGETAF

SEQ ID NO: 75464 - protein, 10 aa, Homo Sapiens
AQNRFEVLTF

SEQ ID NO: 75465 - protein, 10 aa, Homo Sapiens
AQPGSEPTPM

SEQ ID NO: 75466 - protein, 10 aa, Homo Sapiens
AQPLESGTHF

SEQ ID NO: 75467 - protein, 10 aa, Homo Sapiens
AQPLNVGVAH

SEQ ID NO: 75468 - protein, 10 aa, Homo Sapiens
AQPLQPLQVY

SEQ ID NO: 75469 - protein, 10 aa, Homo Sapiens
AQQDVLKKSY

SEQ ID NO: 75470 - protein, 10 aa, Homo Sapiens
AQQEAERARF

SEQ ID NO: 75471 - protein, 10 aa, Homo Sapiens
AQQEAQRAQF

SEQ ID NO: 75472 - protein, 10 aa, Homo Sapiens
AQQPALIHGY

SEQ ID NO: 75473 - protein, 10 aa, Homo Sapiens
AQQPHIAGVF

SEQ ID NO: 75474 - protein, 10 aa, Homo Sapiens
AQQPLSVTCF

SEQ ID NO: 75475 - protein, 10 aa, Homo Sapiens
AQRAPGGLSY

SEQ ID NO: 75476 - protein, 10 aa, Homo Sapiens
AQRDVMLENY

SEQ ID NO: 75477 - protein, 10 aa, Homo Sapiens
AQRENLSAAF

SEQ ID NO: 75478 - protein, 10 aa, Homo Sapiens
AQREPLSSAF

SEQ ID NO: 75479 - protein, 10 aa, Homo Sapiens
AQRPDNPREF

SEQ ID NO: 75480 - protein, 10 aa, Homo Sapiens
AQRQDIAFAY

SEQ ID NO: 75481 - protein, 10 aa, Homo Sapiens
AQRQEIRTAY

SEQ ID NO: 75482 - protein, 10 aa, Homo Sapiens
AQRQPMKPTY

SEQ ID NO: 75483 - protein, 10 aa, Homo Sapiens
AQRRDPSIHY

SEQ ID NO: 75484 - protein, 10 aa, Homo Sapiens
AQRSTETALY

SEQ ID NO: 75485 - protein, 10 aa, Homo Sapiens
AQRTPVQMMY

SEQ ID NO: 75486 - protein, 10 aa, Homo Sapiens
AQSGTQLATY

SEQ ID NO: 75487 - protein, 10 aa, Homo Sapiens
AQTPAHIAAF

SEQ ID NO: 75488 - protein, 10 aa, Homo Sapiens
AQVLAELKEY

SEQ ID NO: 75489 - protein, 10 aa, Homo Sapiens
AQVQYPLQTF

SEQ ID NO: 75490 - protein, 10 aa, Homo Sapiens
AQYDQASTKY

SEQ ID NO: 75491 - protein, 10 aa, Homo Sapiens
AQYENPPHIY

SEQ ID NO: 75492 - protein, 10 aa, Homo Sapiens
AQYPSQPQRF

SEQ ID NO: 75493 - protein, 10 aa, Homo Sapiens
AQYRISMAAY

SEQ ID NO: 75494 - protein, 10 aa, Homo Sapiens
AQYSQDYQQF

SEQ ID NO: 75495 - protein, 10 aa, Homo Sapiens
ASFDGRISVY

SEQ ID NO: 75496 - protein, 10 aa, Homo Sapiens
ATNPESKVFY

SEQ ID NO: 75497 - protein, 10 aa, Homo Sapiens
AVASFRSKAY

SEQ ID NO: 75498 - protein, 10 aa, Homo Sapiens
AVAYVHSQGY

SEQ ID NO: 75499 - protein, 10 aa, Homo Sapiens
AVFQGKKITF

SEQ ID NO: 75500 - protein, 10 aa, Homo Sapiens
AVIGDVIRVY

SEQ ID NO: 75501 - protein, 10 aa, Homo Sapiens
AVILPPLSPY

SEQ ID NO: 75502 - protein, 10 aa, Homo Sapiens
AVIQVGKEKY

SEQ ID NO: 75503 - protein, 10 aa, Homo Sapiens
AVKNDYEMTF

SEQ ID NO: 75504 - protein, 10 aa, Homo Sapiens
AVMKSLTQTF

SEQ ID NO: 75505 - protein, 10 aa, Homo Sapiens
AVNGAVGTTF

SEQ ID NO: 75506 - protein, 10 aa, Homo Sapiens
AVQGRCTVEY

SEQ ID NO: 75507 - protein, 10 aa, Homo Sapiens
AVVQTVKASY

SEQ ID NO: 75508 - protein, 10 aa, Homo Sapiens
AVYPQATQTY

SEQ ID NO: 75509 - protein, 10 aa, Homo Sapiens
DQLEYQEELR

SEQ ID NO: 75510 - protein, 10 aa, Homo Sapiens
DSQRVLYIRY

SEQ ID NO: 75511 - protein, 10 aa, Homo Sapiens
DTGRPSTTVR

SEQ ID NO: 75512 - protein, 10 aa, Homo Sapiens
EEQLQQIRAE

SEQ ID NO: 75513 - protein, 10 aa, Homo Sapiens
FIIDTRDAGY

SEQ ID NO: 75514 - protein, 10 aa, Homo Sapiens
FLIKRNKQTY

SEQ ID NO: 75515 - protein, 10 aa, Homo Sapiens
FQIEVQKGRY

SEQ ID NO: 75516 - protein, 10 aa, Homo Sapiens
FQIGQAKNTY

SEQ ID NO: 75517 - protein, 10 aa, Homo Sapiens
FQISKEYERF

SEQ ID NO: 75518 - protein, 10 aa, Homo Sapiens
FQKADGVPVY

SEQ ID NO: 75519 - protein, 10 aa, Homo Sapiens
FQKGESPVDY

SEQ ID NO: 75520 - protein, 10 aa, Homo Sapiens
FQKLPSKVQY

SEQ ID NO: 75521 - protein, 10 aa, Homo Sapiens
FQLPGGHLEF

SEQ ID NO: 75522 - protein, 10 aa, Homo Sapiens
FQYDDSGNTF

SEQ ID NO: 75523 - protein, 10 aa, Homo Sapiens
FQYDSTHGKF

SEQ ID NO: 75524 - protein, 10 aa, Homo Sapiens
GASQAGMTGY

SEQ ID NO: 75525 - protein, 10 aa, Homo Sapiens
GGGLSVSSSR

SEQ ID NO: 75526 - protein, 10 aa, Homo Sapiens
GIFPAKTITY

SEQ ID NO: 75527 - protein, 10 aa, Homo Sapiens
GLARHAMAVY

SEQ ID NO: 75528 - protein, 10 aa, Homo Sapiens
GLFPGSNATF

SEQ ID NO: 75529 - protein, 10 aa, Homo Sapiens
GLFQHICTAY

SEQ ID NO: 75530 - protein, 10 aa, Homo Sapiens
GLKPVVGEVY

SEQ ID NO: 75531 - protein, 10 aa, Homo Sapiens
GLYSPQYISY

SEQ ID NO: 75532 - protein, 10 aa, Homo Sapiens
GMAAMPQTVY

SEQ ID NO: 75533 - protein, 10 aa, Homo Sapiens
GMAGSGKTTF

SEQ ID NO: 75534 - protein, 10 aa, Homo Sapiens
GMFDQKSSSH

SEQ ID NO: 75535 - protein, 10 aa, Homo Sapiens
GMKDGQKITF

SEQ ID NO: 75536 - protein, 10 aa, Homo Sapiens
GMNPREPAVY

SEQ ID NO: 75537 - protein, 10 aa, Homo Sapiens
GMNRFNSRTY

SEQ ID NO: 75538 - protein, 10 aa, Homo Sapiens
GMQRATNVTY

SEQ ID NO: 75539 - protein, 10 aa, Homo Sapiens
GQAGMHATYY

SEQ ID NO: 75540 - protein, 10 aa, Homo Sapiens
GQAPINNTGF

SEQ ID NO: 75541 - protein, 10 aa, Homo Sapiens
GQAYIVSSGF

SEQ ID NO: 75542 - protein, 10 aa, Homo Sapiens
GQAYTIQGQY

SEQ ID NO: 75543 - protein, 10 aa, Homo Sapiens
GQCTQVRVEF

SEQ ID NO: 75544 - protein, 10 aa, Homo Sapiens
GQDPHSSQAF

SEQ ID NO: 75545 - protein, 10 aa, Homo Sapiens
GQERPSVTSY

SEQ ID NO: 75546 - protein, 10 aa, Homo Sapiens
GQFEEFGQTF

SEQ ID NO: 75547 - protein, 10 aa, Homo Sapiens
GQFPGHNEFF

SEQ ID NO: 75548 - protein, 10 aa, Homo Sapiens
GQHPKQCAYF

SEQ ID NO: 75549 - protein, 10 aa, Homo Sapiens
GQIEHKLAFL

SEQ ID NO: 75550 - protein, 10 aa, Homo Sapiens
GQIELTGKRY

SEQ ID NO: 75551 - protein, 10 aa, Homo Sapiens
GQIHTGMGSY

SEQ ID NO: 75552 - protein, 10 aa, Homo Sapiens
GQILMPNIGY

SEQ ID NO: 75553 - protein, 10 aa, Homo Sapiens
GQISDPSRSY

SEQ ID NO: 75554 - protein, 10 aa, Homo Sapiens
GQKCEFQDAY

SEQ ID NO: 75555 - protein, 10 aa, Homo Sapiens
GQKGTCGIQY

SEQ ID NO: 75556 - protein, 10 aa, Homo Sapiens
GQKPNEYQEY

SEQ ID NO: 75557 - protein, 10 aa, Homo Sapiens
GQLSWHQKTY

SEQ ID NO: 75558 - protein, 10 aa, Homo Sapiens
GQLVFKSDAY

SEQ ID NO: 75559 - protein, 10 aa, Homo Sapiens
GQNAAVVHRF

SEQ ID NO: 75560 - protein, 10 aa, Homo Sapiens
GQNDPLKDSY

SEQ ID NO: 75561 - protein, 10 aa, Homo Sapiens
GQNGQQILSA

SEQ ID NO: 75562 - protein, 10 aa, Homo Sapiens
GQNNSVFTLY

SEQ ID NO: 75563 - protein, 10 aa, Homo Sapiens
GQNPTNAEVL

SEQ ID NO: 75564 - protein, 10 aa, Homo Sapiens
GQNVADYMRY

SEQ ID NO: 75565 - protein, 10 aa, Homo Sapiens
GQPAKADQCY

SEQ ID NO: 75566 - protein, 10 aa, Homo Sapiens
GQPLRPQANY

SEQ ID NO: 75567 - protein, 10 aa, Homo Sapiens
GQPPFASRSF

SEQ ID NO: 75568 - protein, 10 aa, Homo Sapiens
GQPQAPMGSY

SEQ ID NO: 75569 - protein, 10 aa, Homo Sapiens
GQPVKVRVSY

SEQ ID NO: 75570 - protein, 10 aa, Homo Sapiens
GQQAALASQY

SEQ ID NO: 75571 - protein, 10 aa, Homo Sapiens
GQRKGAGSVF

SEQ ID NO: 75572 - protein, 10 aa, Homo Sapiens
GQRRHFIIQY

SEQ ID NO: 75573 - protein, 10 aa, Homo Sapiens
GQSPTGSVCY

SEQ ID NO: 75574 - protein, 10 aa, Homo Sapiens
GQTEPHTVLF

SEQ ID NO: 75575 - protein, 10 aa, Homo Sapiens
GQVEVTGDEY

SEQ ID NO: 75576 - protein, 10 aa, Homo Sapiens
GQVKFKSSNY

SEQ ID NO: 75577 - protein, 10 aa, Homo Sapiens
GQVPHSLETL

SEQ ID NO: 75578 - protein, 10 aa, Homo Sapiens
GQYGNPLNKY

SEQ ID NO: 75579 - protein, 10 aa, Homo Sapiens
GQYPLQVNGY

SEQ ID NO: 75580 - protein, 10 aa, Homo Sapiens
GQYSTGKTTF

SEQ ID NO: 75581 - protein, 10 aa, Homo Sapiens
GTGGIVSTAF

SEQ ID NO: 75582 - protein, 10 aa, Homo Sapiens
GVFQSTDTCY

SEQ ID NO: 75583 - protein, 10 aa, Homo Sapiens
GVIEKLLTSY

SEQ ID NO: 75584 - protein, 10 aa, Homo Sapiens
GVNPHVNHLY

SEQ ID NO: 75585 - protein, 10 aa, Homo Sapiens
GVNPRVNHLY

SEQ ID NO: 75586 - protein, 10 aa, Homo Sapiens
HLPLLPNVSY

SEQ ID NO: 75587 - protein, 10 aa, Homo Sapiens
HLYPNTPYAY

SEQ ID NO: 75588 - protein, 10 aa, Homo Sapiens
HQFPELMGVF

SEQ ID NO: 75589 - protein, 10 aa, Homo Sapiens
HQGPATTVAF

SEQ ID NO: 75590 - protein, 10 aa, Homo Sapiens
HQLRAQILAY

SEQ ID NO: 75591 - protein, 10 aa, Homo Sapiens
HQLRAQIMAY

SEQ ID NO: 75592 - protein, 10 aa, Homo Sapiens
HQPDNIKALF

SEQ ID NO: 75593 - protein, 10 aa, Homo Sapiens
HQPLHVTKGY

SEQ ID NO: 75594 - protein, 10 aa, Homo Sapiens
HQRPDKQNLF

SEQ ID NO: 75595 - protein, 10 aa, Homo Sapiens
HQVAPSPAGY

SEQ ID NO: 75596 - protein, 10 aa, Homo Sapiens
HQVPFAPIVF

SEQ ID NO: 75597 - protein, 10 aa, Homo Sapiens
HSRNEGVATY

SEQ ID NO: 75598 - protein, 10 aa, Homo Sapiens
HVASCGVNLY

SEQ ID NO: 75599 - protein, 10 aa, Homo Sapiens
IGQSKSVKIY

SEQ ID NO: 75600 - protein, 10 aa, Homo Sapiens
IIAEVAKNEF

SEQ ID NO: 75601 - protein, 10 aa, Homo Sapiens
IIAPHAGYTY

SEQ ID NO: 75602 - protein, 10 aa, Homo Sapiens
IIAQSAKFSG

SEQ ID NO: 75603 - protein, 10 aa, Homo Sapiens
IIIDGGNSEY

SEQ ID NO: 75604 - protein, 10 aa, Homo Sapiens
IIIETDHNAY

SEQ ID NO: 75605 - protein, 10 aa, Homo Sapiens
IIIGDNKTQY

SEQ ID NO: 75606 - protein, 10 aa, Homo Sapiens
IIIGQESITY

SEQ ID NO: 75607 - protein, 10 aa, Homo Sapiens
ILAEGGGAKF

SEQ ID NO: 75608 - protein, 10 aa, Homo Sapiens
ILIGNPGCTY

SEQ ID NO: 75609 - protein, 10 aa, Homo Sapiens
ILKDMGITEY

SEQ ID NO: 75610 - protein, 10 aa, Homo Sapiens
ILKSPGSVVF

SEQ ID NO: 75611 - protein, 10 aa, Homo Sapiens
ILNGSHPVSF

SEQ ID NO: 75612 - protein, 10 aa, Homo Sapiens
ILNPEEIEKY

SEQ ID NO: 75613 - protein, 10 aa, Homo Sapiens
ILPPPVHVDY

SEQ ID NO: 75614 - protein, 10 aa, Homo Sapiens
ILSKLTDIQY

SEQ ID NO: 75615 - protein, 10 aa, Homo Sapiens
ILTSNDALLF

SEQ ID NO: 75616 - protein, 10 aa, Homo Sapiens
IMIRESGQLF

SEQ ID NO: 75617 - protein, 10 aa, Homo Sapiens
IMQDFESDTF

SEQ ID NO: 75618 - protein, 10 aa, Homo Sapiens
IMRECQEESF

SEQ ID NO: 75619 - protein, 10 aa, Homo Sapiens
IQAQMVTTDF

SEQ ID NO: 75620 - protein, 10 aa, Homo Sapiens
IQFADDMQEF

SEQ ID NO: 75621 - protein, 10 aa, Homo Sapiens
IQIALPSGCY

SEQ ID NO: 75622 - protein, 10 aa, Homo Sapiens
IQIKDAIGRY

SEQ ID NO: 75623 - protein, 10 aa, Homo Sapiens
IQIKQQSTSY

SEQ ID NO: 75624 - protein, 10 aa, Homo Sapiens
IQKDNPKIVH

SEQ ID NO: 75625 - protein, 10 aa, Homo Sapiens
IQKEQDYQRY

SEQ ID NO: 75626 - protein, 10 aa, Homo Sapiens
IQKESQYIKY

SEQ ID NO: 75627 - protein, 10 aa, Homo Sapiens
IQKGQALITF

SEQ ID NO: 75628 - protein, 10 aa, Homo Sapiens
IQNGAQGIRF

SEQ ID NO: 75629 - protein, 10 aa, Homo Sapiens
IQNGTSGIRF

SEQ ID NO: 75630 - protein, 10 aa, Homo Sapiens
IQNKKTCVEY

SEQ ID NO: 75631 - protein, 10 aa, Homo Sapiens
IQNPDLWNSY

SEQ ID NO: 75632 - protein, 10 aa, Homo Sapiens
IQNQAEPREF

SEQ ID NO: 75633 - protein, 10 aa, Homo Sapiens
IQPGEQKYEY

SEQ ID NO: 75634 - protein, 10 aa, Homo Sapiens
IQPGRGFVLY

SEQ ID NO: 75635 - protein, 10 aa, Homo Sapiens
IQPPKGVLLY

SEQ ID NO: 75636 - protein, 10 aa, Homo Sapiens
IQPPKGVLMY

SEQ ID NO: 75637 - protein, 10 aa, Homo Sapiens
IQRLIEQEEY

SEQ ID NO: 75638 - protein, 10 aa, Homo Sapiens
IQRPDKHESF

SEQ ID NO: 75639 - protein, 10 aa, Homo Sapiens
IQRTPKIQVY

SEQ ID NO: 75640 - protein, 10 aa, Homo Sapiens
IQYSGEVRRF

SEQ ID NO: 75641 - protein, 10 aa, Homo Sapiens
IRLENEIQTY

SEQ ID NO: 75642 - protein, 10 aa, Homo Sapiens
ISKSGGDYAY

SEQ ID NO: 75643 - protein, 10 aa, Homo Sapiens
ITINAAHVEY

SEQ ID NO: 75644 - protein, 10 aa, Homo Sapiens
ITKPPDGSAF

SEQ ID NO: 75645 - protein, 10 aa, Homo Sapiens
IVFVGTGQTY

SEQ ID NO: 75646 - protein, 10 aa, Homo Sapiens
IVGPTLKATF

SEQ ID NO: 75647 - protein, 10 aa, Homo Sapiens
IVIEEKDVVY

SEQ ID NO: 75648 - protein, 10 aa, Homo Sapiens
IVIGDEHISF

SEQ ID NO: 75649 - protein, 10 aa, Homo Sapiens
KAFDCPETEY

SEQ ID NO: 75650 - protein, 10 aa, Homo Sapiens
KAFDLTEQRY

SEQ ID NO: 75651 - protein, 10 aa, Homo Sapiens
KANPFGGASH

SEQ ID NO: 75652 - protein, 10 aa, Homo Sapiens
KEKPVCGTTY

SEQ ID NO: 75653 - protein, 10 aa, Homo Sapiens
KIADMGHLKY

SEQ ID NO: 75654 - protein, 10 aa, Homo Sapiens
KIIETTGVHF

SEQ ID NO: 75655 - protein, 10 aa, Homo Sapiens
KIIHTGEKPY

SEQ ID NO: 75656 - protein, 10 aa, Homo Sapiens
KIRPGEQEQY

SEQ ID NO: 75657 - protein, 10 aa, Homo Sapiens
KISPFEHQTY

SEQ ID NO: 75658 - protein, 10 aa, Homo Sapiens
KIYDREQTRY

SEQ ID NO: 75659 - protein, 10 aa, Homo Sapiens
KIYPGHGRRY

SEQ ID NO: 75660 - protein, 10 aa, Homo Sapiens
KLADQIFAYY

SEQ ID NO: 75661 - protein, 10 aa, Homo Sapiens
KLAPAQYIRY

SEQ ID NO: 75662 - protein, 10 aa, Homo Sapiens
KLASTGTSEY

SEQ ID NO: 75663 - protein, 10 aa, Homo Sapiens
KLDPHNHVLY

SEQ ID NO: 75664 - protein, 10 aa, Homo Sapiens
KLFDATLTQY

SEQ ID NO: 75665 - protein, 10 aa, Homo Sapiens
KLFDDCTQQF

SEQ ID NO: 75666 - protein, 10 aa, Homo Sapiens
KLFDDCTQQY

SEQ ID NO: 75667 - protein, 10 aa, Homo Sapiens
KLFDDLTSSY

SEQ ID NO: 75668 - protein, 10 aa, Homo Sapiens
KLFDHAVSKF

SEQ ID NO: 75669 - protein, 10 aa, Homo Sapiens
KLFEDGKTGF

SEQ ID NO: 75670 - protein, 10 aa, Homo Sapiens
KLFGEKSASF

SEQ ID NO: 75671 - protein, 10 aa, Homo Sapiens
KLFPDIPIGY

SEQ ID NO: 75672 - protein, 10 aa, Homo Sapiens
KLFPGSPAIY

SEQ ID NO: 75673 - protein, 10 aa, Homo Sapiens
KLIDLSQVMY

SEQ ID NO: 75674 - protein, 10 aa, Homo Sapiens
KLIEGCFEGY

SEQ ID NO: 75675 - protein, 10 aa, Homo Sapiens
KLIYEKAKHY

SEQ ID NO: 75676 - protein, 10 aa, Homo Sapiens
KLKEVDRTAM

SEQ ID NO: 75677 - protein, 10 aa, Homo Sapiens
KLNPRLAILY

SEQ ID NO: 75678 - protein, 10 aa, Homo Sapiens
KLNVAPLAVF

SEQ ID NO: 75679 - protein, 10 aa, Homo Sapiens
KLPEFTKSEY

SEQ ID NO: 75680 - protein, 10 aa, Homo Sapiens
KLPNFGFVVF

SEQ ID NO: 75681 - protein, 10 aa, Homo Sapiens
KLSEGVTISY

SEQ ID NO: 75682 - protein, 10 aa, Homo Sapiens
KLSEPSSLQY

SEQ ID NO: 75683 - protein, 10 aa, Homo Sapiens
KLVEAIRTNY

SEQ ID NO: 75684 - protein, 10 aa, Homo Sapiens
KLVSEKLASY

SEQ ID NO: 75685 - protein, 10 aa, Homo Sapiens
KLYDVVDVKY

SEQ ID NO: 75686 - protein, 10 aa, Homo Sapiens
KLYQDTHQEY

SEQ ID NO: 75687 - protein, 10 aa, Homo Sapiens
KLYQFNPAFF

SEQ ID NO: 75688 - protein, 10 aa, Homo Sapiens
KLYRPGSVAY

SEQ ID NO: 75689 - protein, 10 aa, Homo Sapiens
KLYSPSSQQY

SEQ ID NO: 75690 - protein, 10 aa, Homo Sapiens
KMFNALIHRY

SEQ ID NO: 75691 - protein, 10 aa, Homo Sapiens
KMLPDKDCRY

SEQ ID NO: 75692 - protein, 10 aa, Homo Sapiens
KMPEVRQSSF

SEQ ID NO: 75693 - protein, 10 aa, Homo Sapiens
KMRGGSILSH

SEQ ID NO: 75694 - protein, 10 aa, Homo Sapiens
KQAPPQKVSF

SEQ ID NO: 75695 - protein, 10 aa, Homo Sapiens
KQFDAGTVNY

SEQ ID NO: 75696 - protein, 10 aa, Homo Sapiens
KQFEKQVELY

SEQ ID NO: 75697 - protein, 10 aa, Homo Sapiens
KQFQKVITEY

SEQ ID NO: 75698 - protein, 10 aa, Homo Sapiens
KQFRPPMGGY

SEQ ID NO: 75699 - protein, 10 aa, Homo Sapiens
KQFSKRYLKY

SEQ ID NO: 75700 - protein, 10 aa, Homo Sapiens
KQHNHLERAF

SEQ ID NO: 75701 - protein, 10 aa, Homo Sapiens
KQIANSQDGY

SEQ ID NO: 75702 - protein, 10 aa, Homo Sapiens
KQIDPVLQVY

SEQ ID NO: 75703 - protein, 10 aa, Homo Sapiens
KQIDRQLTAY

SEQ ID NO: 75704 - protein, 10 aa, Homo Sapiens
KQIEERASHY

SEQ ID NO: 75705 - protein, 10 aa, Homo Sapiens
KQIEERMLSH

SEQ ID NO: 75706 - protein, 10 aa, Homo Sapiens
KQIEGTGISM

SEQ ID NO: 75707 - protein, 10 aa, Homo Sapiens
KQIIVDPLSF

SEQ ID NO: 75708 - protein, 10 aa, Homo Sapiens
KQIKPDMETY

SEQ ID NO: 75709 - protein, 10 aa, Homo Sapiens
KQILTEGERY

SEQ ID NO: 75710 - protein, 10 aa, Homo Sapiens
KQISVGFIGY

SEQ ID NO: 75711 - protein, 10 aa, Homo Sapiens
KQIVEILTAY

SEQ ID NO: 75712 - protein, 10 aa, Homo Sapiens
KQIYTAEEKY

SEQ ID NO: 75713 - protein, 10 aa, Homo Sapiens
KQKDIVSIHY

SEQ ID NO: 75714 - protein, 10 aa, Homo Sapiens
KQKGDRVVLF

SEQ ID NO: 75715 - protein, 10 aa, Homo Sapiens
KQKVTSKIDY

SEQ ID NO: 75716 - protein, 10 aa, Homo Sapiens
KQLQKDKQVY

SEQ ID NO: 75717 - protein, 10 aa, Homo Sapiens
KQLVAEQVTY

SEQ ID NO: 75718 - protein, 10 aa, Homo Sapiens
KQMEDGHTLF

SEQ ID NO: 75719 - protein, 10 aa, Homo Sapiens
KQMENDIQLY

SEQ ID NO: 75720 - protein, 10 aa, Homo Sapiens
KQMTFEAQAF

SEQ ID NO: 75721 - protein, 10 aa, Homo Sapiens
KQNPKDIHTL

SEQ ID NO: 75722 - protein, 10 aa, Homo Sapiens
KQNPLLAEAY

SEQ ID NO: 75723 - protein, 10 aa, Homo Sapiens
KQQHFDVQQY

SEQ ID NO: 75724 - protein, 10 aa, Homo Sapiens
KQQNQYQASY

SEQ ID NO: 75725 - protein, 10 aa, Homo Sapiens
KQRDVDFKAF

SEQ ID NO: 75726 - protein, 10 aa, Homo Sapiens
KQRPTKLKSL

SEQ ID NO: 75727 - protein, 10 aa, Homo Sapiens
KQVMEGRVTF

SEQ ID NO: 75728 - protein, 10 aa, Homo Sapiens
KQYERSIVDY

SEQ ID NO: 75729 - protein, 10 aa, Homo Sapiens
KQYEVEIQTY

SEQ ID NO: 75730 - protein, 10 aa, Homo Sapiens
KQYISAVQMY

SEQ ID NO: 75731 - protein, 10 aa, Homo Sapiens
KQYSPLLAAF

SEQ ID NO: 75732 - protein, 10 aa, Homo Sapiens
KQYYALEVSY

SEQ ID NO: 75733 - protein, 10 aa, Homo Sapiens
KSFSESGINY

SEQ ID NO: 75734 - protein, 10 aa, Homo Sapiens
KVADWTGATY

SEQ ID NO: 75735 - protein, 10 aa, Homo Sapiens
KVFDGIPPPY

SEQ ID NO: 75736 - protein, 10 aa, Homo Sapiens
KVFGPTIVAH

SEQ ID NO: 75737 - protein, 10 aa, Homo Sapiens
KVFPEDMAKY

SEQ ID NO: 75738 - protein, 10 aa, Homo Sapiens
KVNTPTTTVY

SEQ ID NO: 75739 - protein, 10 aa, Homo Sapiens
KVQKEGKISY

SEQ ID NO: 75740 - protein, 10 aa, Homo Sapiens
KVSEVSSTCY

SEQ ID NO: 75741 - protein, 10 aa, Homo Sapiens
LIFDNKHTNY

SEQ ID NO: 75742 - protein, 10 aa, Homo Sapiens
LIFPDRATLY

SEQ ID NO: 75743 - protein, 10 aa, Homo Sapiens
LLAGQATTAY

SEQ ID NO: 75744 - protein, 10 aa, Homo Sapiens
LLHGNPGSTY

SEQ ID NO: 75745 - protein, 10 aa, Homo Sapiens
LLHQTGLSLY

SEQ ID NO: 75746 - protein, 10 aa, Homo Sapiens
LLIAGQINTY

SEQ ID NO: 75747 - protein, 10 aa, Homo Sapiens
LLIPGLATAY

SEQ ID NO: 75748 - protein, 10 aa, Homo Sapiens
LLKDGKTQDY

SEQ ID NO: 75749 - protein, 10 aa, Homo Sapiens
LLKPGGVLTY

SEQ ID NO: 75750 - protein, 10 aa, Homo Sapiens
LLKPNTSVQF

SEQ ID NO: 75751 - protein, 10 aa, Homo Sapiens
LLNGQVREEY

SEQ ID NO: 75752 - protein, 10 aa, Homo Sapiens
LLYPYEQAQY

SEQ ID NO: 75753 - protein, 10 aa, Homo Sapiens
LMIDVTKSYY

SEQ ID NO: 75754 - protein, 10 aa, Homo Sapiens
LMKAIDFEYY

SEQ ID NO: 75755 - protein, 10 aa, Homo Sapiens
LMPEFQFGTY

SEQ ID NO: 75756 - protein, 10 aa, Homo Sapiens
LMPQFSTIEY

SEQ ID NO: 75757 - protein, 10 aa, Homo Sapiens
LQFNPKFMTF

SEQ ID NO: 75758 - protein, 10 aa, Homo Sapiens
LQHDNIIAYY

SEQ ID NO: 75759 - protein, 10 aa, Homo Sapiens
LQHLQLFTEY

SEQ ID NO: 75760 - protein, 10 aa, Homo Sapiens
LQKTGHRVTY

SEQ ID NO: 75761 - protein, 10 aa, Homo Sapiens
LQLPARNLTY

SEQ ID NO: 75762 - protein, 10 aa, Homo Sapiens
LQNADPLKVY

SEQ ID NO: 75763 - protein, 10 aa, Homo Sapiens
LQNHENESVY

SEQ ID NO: 75764 - protein, 10 aa, Homo Sapiens
LQNIAEKGSY

SEQ ID NO: 75765 - protein, 10 aa, Homo Sapiens
LQQEGLLSRY

SEQ ID NO: 75766 - protein, 10 aa, Homo Sapiens
LQQGHLNQAF

SEQ ID NO: 75767 - protein, 10 aa, Homo Sapiens
LQQRHQLESY

SEQ ID NO: 75768 - protein, 10 aa, Homo Sapiens
LQREIQEGAY

SEQ ID NO: 75769 - protein, 10 aa, Homo Sapiens
LQRVFPHAEF

SEQ ID NO: 75770 - protein, 10 aa, Homo Sapiens
LQRVPSYDSF

SEQ ID NO: 75771 - protein, 10 aa, Homo Sapiens
LQSQVGTKTY

SEQ ID NO: 75772 - protein, 10 aa, Homo Sapiens
LQVEGHSNVY

SEQ ID NO: 75773 - protein, 10 aa, Homo Sapiens
LSKPVPESEF

SEQ ID NO: 75774 - protein, 10 aa, Homo Sapiens
LVFKEDGQEY

SEQ ID NO: 75775 - protein, 10 aa, Homo Sapiens
LVYRADTQTY

SEQ ID NO: 75776 - protein, 10 aa, Homo Sapiens
MIIGPPRTNY

SEQ ID NO: 75777 - protein, 10 aa, Homo Sapiens
MLAKTGVHHY

SEQ ID NO: 75778 - protein, 10 aa, Homo Sapiens
MQHSLAGQTY

SEQ ID NO: 75779 - protein, 10 aa, Homo Sapiens
MQKAFNSSSF

SEQ ID NO: 75780 - protein, 10 aa, Homo Sapiens
MQKPFEDASF

SEQ ID NO: 75781 - protein, 10 aa, Homo Sapiens
MQYPGRSLVF

SEQ ID NO: 75782 - protein, 10 aa, Homo Sapiens
QAGPATGQAY

SEQ ID NO: 75783 - protein, 10 aa, Homo Sapiens
QMPPWNQTEF

SEQ ID NO: 75784 - protein, 10 aa, Homo Sapiens
QQHDFTSQIF

SEQ ID NO: 75785 - protein, 10 aa, Homo Sapiens
QQHPQAAASY

SEQ ID NO: 75786 - protein, 10 aa, Homo Sapiens
QQHSPQQIAY

SEQ ID NO: 75787 - protein, 10 aa, Homo Sapiens
QQIAPDVDTY

SEQ ID NO: 75788 - protein, 10 aa, Homo Sapiens
QQIEIERSLY

SEQ ID NO: 75789 - protein, 10 aa, Homo Sapiens
QQIGKVVQVY

SEQ ID NO: 75790 - protein, 10 aa, Homo Sapiens
QQIQEKVATF

SEQ ID NO: 75791 - protein, 10 aa, Homo Sapiens
QQMNSFLSRY

SEQ ID NO: 75792 - protein, 10 aa, Homo Sapiens
QQMWISKQEY

SEQ ID NO: 75793 - protein, 10 aa, Homo Sapiens
QQNKELENKY

SEQ ID NO: 75794 - protein, 10 aa, Homo Sapiens
QQNVSFVTGY

SEQ ID NO: 75795 - protein, 10 aa, Homo Sapiens
QQQQPALVNY

SEQ ID NO: 75796 - protein, 10 aa, Homo Sapiens
QQVQQVAAEY

SEQ ID NO: 75797 - protein, 10 aa, Homo Sapiens
RAAQLEPITY

SEQ ID NO: 75798 - protein, 10 aa, Homo Sapiens
RAATFIQSTF

SEQ ID NO: 75799 - protein, 10 aa, Homo Sapiens
RAFALVSQAY

SEQ ID NO: 75800 - protein, 10 aa, Homo Sapiens
RAFIITGQTY

SEQ ID NO: 75801 - protein, 10 aa, Homo Sapiens
RAFKEVGIEF

SEQ ID NO: 75802 - protein, 10 aa, Homo Sapiens
RAFPYGNVAF

SEQ ID NO: 75803 - protein, 10 aa, Homo Sapiens
RANPQVGVAF

SEQ ID NO: 75804 - protein, 10 aa, Homo Sapiens
RAYPHNLMTF

SEQ ID NO: 75805 - protein, 10 aa, Homo Sapiens
RAYPVGGLCY

SEQ ID NO: 75806 - protein, 10 aa, Homo Sapiens
RIFDRAVAAY

SEQ ID NO: 75807 - protein, 10 aa, Homo Sapiens
RIHNEDNSQF

SEQ ID NO: 75808 - protein, 10 aa, Homo Sapiens
RIIAEPGRYY

SEQ ID NO: 75809 - protein, 10 aa, Homo Sapiens
RIITKGTQTY

SEQ ID NO: 75810 - protein, 10 aa, Homo Sapiens
RILDGKRIQY

SEQ ID NO: 75811 - protein, 10 aa, Homo Sapiens
RILPKCRTSY

SEQ ID NO: 75812 - protein, 10 aa, Homo Sapiens
RIMDSSQNAY

SEQ ID NO: 75813 - protein, 10 aa, Homo Sapiens
RINNEDNSQF

SEQ ID NO: 75814 - protein, 10 aa, Homo Sapiens
RIQESSQVLY

SEQ ID NO: 75815 - protein, 10 aa, Homo Sapiens
RIQGVPKVTY

SEQ ID NO: 75816 - protein, 10 aa, Homo Sapiens
RIYNDDKNTY

SEQ ID NO: 75817 - protein, 10 aa, Homo Sapiens
RIYPYAAISY

SEQ ID NO: 75818 - protein, 10 aa, Homo Sapiens
RLAEAQSNSF

SEQ ID NO: 75819 - protein, 10 aa, Homo Sapiens
RLAHEVGWKY

SEQ ID NO: 75820 - protein, 10 aa, Homo Sapiens
RLFKQEGTCY

SEQ ID NO: 75821 - protein, 10 aa, Homo Sapiens
RLFNLVHQAY

SEQ ID NO: 75822 - protein, 10 aa, Homo Sapiens
RLFPRPVVAF

SEQ ID NO: 75823 - protein, 10 aa, Homo Sapiens
RLFSHEGSSF

SEQ ID NO: 75824 - protein, 10 aa, Homo Sapiens
RLFTSAEETF

SEQ ID NO: 75825 - protein, 10 aa, Homo Sapiens
RLFYFSNEKY

SEQ ID NO: 75826 - protein, 10 aa, Homo Sapiens
RLIDKTKVTY

SEQ ID NO: 75827 - protein, 10 aa, Homo Sapiens
RLISGVVQSY

SEQ ID NO: 75828 - protein, 10 aa, Homo Sapiens
RLKEEGNEQF

SEQ ID NO: 75829 - protein, 10 aa, Homo Sapiens
RLKPDFIDGY

SEQ ID NO: 75830 - protein, 10 aa, Homo Sapiens
RLKPTRKFAY

SEQ ID NO: 75831 - protein, 10 aa, Homo Sapiens
RLMAEDEEGY

SEQ ID NO: 75832 - protein, 10 aa, Homo Sapiens
RLPETELGEY

SEQ ID NO: 75833 - protein, 10 aa, Homo Sapiens
RLPSETIQTY

SEQ ID NO: 75834 - protein, 10 aa, Homo Sapiens
RLQDQGLILY

SEQ ID NO: 75835 - protein, 10 aa, Homo Sapiens
RLQGISFGMY

SEQ ID NO: 75836 - protein, 10 aa, Homo Sapiens
RLQPLTQAAY

SEQ ID NO: 75837 - protein, 10 aa, Homo Sapiens
RLQPYNGVAL

SEQ ID NO: 75838 - protein, 10 aa, Homo Sapiens
RLRDENGRPY

SEQ ID NO: 75839 - protein, 10 aa, Homo Sapiens
RLRISPDRVY

SEQ ID NO: 75840 - protein, 10 aa, Homo Sapiens
RLRVSSEIRY

SEQ ID NO: 75841 - protein, 10 aa, Homo Sapiens
RLSTPSASTY

SEQ ID NO: 75842 - protein, 10 aa, Homo Sapiens
RLVGLKKSFY

SEQ ID NO: 75843 - protein, 10 aa, Homo Sapiens
RLVPGAYLEY

SEQ ID NO: 75844 - protein, 10 aa, Homo Sapiens
RLYGKDYNVY

SEQ ID NO: 75845 - protein, 10 aa, Homo Sapiens
RLYGPSSVSF

SEQ ID NO: 75846 - protein, 10 aa, Homo Sapiens
RLYHEADKTY

SEQ ID NO: 75847 - protein, 10 aa, Homo Sapiens
RLYQLDKSTF

SEQ ID NO: 75848 - protein, 10 aa, Homo Sapiens
RLYTQGYISY

SEQ ID NO: 75849 - protein, 10 aa, Homo Sapiens
RMFNGEKINY

SEQ ID NO: 75850 - protein, 10 aa, Homo Sapiens
RMHPHLSKGY

SEQ ID NO: 75851 - protein, 10 aa, Homo Sapiens
RMIAILTENY

SEQ ID NO: 75852 - protein, 10 aa, Homo Sapiens
RMIDFAHSTF

SEQ ID NO: 75853 - protein, 10 aa, Homo Sapiens
RMKETQKSIY

SEQ ID NO: 75854 - protein, 10 aa, Homo Sapiens
RMKKEASVKF

SEQ ID NO: 75855 - protein, 10 aa, Homo Sapiens
RMKTGNKIRY

SEQ ID NO: 75856 - protein, 10 aa, Homo Sapiens
RMMNAIKESY

SEQ ID NO: 75857 - protein, 10 aa, Homo Sapiens
RMSDVVKGVY

SEQ ID NO: 75858 - protein, 10 aa, Homo Sapiens
RMSPATTGTF

SEQ ID NO: 75859 - protein, 10 aa, Homo Sapiens
RMSPFPLTSM

SEQ ID NO: 75860 - protein, 10 aa, Homo Sapiens
RMVSEAGTGF

SEQ ID NO: 75861 - protein, 10 aa, Homo Sapiens
RQAFFLHTTY

SEQ ID NO: 75862 - protein, 10 aa, Homo Sapiens
RQAGLSYIRY

SEQ ID NO: 75863 - protein, 10 aa, Homo Sapiens
RQALPQVRLY

SEQ ID NO: 75864 - protein, 10 aa, Homo Sapiens
RQAPQPQSSL

SEQ ID NO: 75865 - protein, 10 aa, Homo Sapiens
RQAPVLLQTY

SEQ ID NO: 75866 - protein, 10 aa, Homo Sapiens
RQATAASSVM

SEQ ID NO: 75867 - protein, 10 aa, Homo Sapiens
RQATSTASTF

SEQ ID NO: 75868 - protein, 10 aa, Homo Sapiens
RQEDDRGITY

SEQ ID NO: 75869 - protein, 10 aa, Homo Sapiens
RQFDPQPLAM

SEQ ID NO: 75870 - protein, 10 aa, Homo Sapiens
RQFSEQQPAF

SEQ ID NO: 75871 - protein, 10 aa, Homo Sapiens
RQFWFQGNRY

SEQ ID NO: 75872 - protein, 10 aa, Homo Sapiens
RQHPHCYVQY

SEQ ID NO: 75873 - protein, 10 aa, Homo Sapiens
RQHSIYKNGY

SEQ ID NO: 75874 - protein, 10 aa, Homo Sapiens
RQICPSLAGF

SEQ ID NO: 75875 - protein, 10 aa, Homo Sapiens
RQIDATFVRF

SEQ ID NO: 75876 - protein, 10 aa, Homo Sapiens
RQIDLVDNYF

SEQ ID NO: 75877 - protein, 10 aa, Homo Sapiens
RQIEETLAHF

SEQ ID NO: 75878 - protein, 10 aa, Homo Sapiens
RQIEKDITSF

SEQ ID NO: 75879 - protein, 10 aa, Homo Sapiens
RQIEPANREF

SEQ ID NO: 75880 - protein, 10 aa, Homo Sapiens
RQIHANHETL

SEQ ID NO: 75881 - protein, 10 aa, Homo Sapiens
RQIIGPFQRF

SEQ ID NO: 75882 - protein, 10 aa, Homo Sapiens
RQIPQATASM

SEQ ID NO: 75883 - protein, 10 aa, Homo Sapiens
RQIPYTMMKF

SEQ ID NO: 75884 - protein, 10 aa, Homo Sapiens
RQITDKAREF

SEQ ID NO: 75885 - protein, 10 aa, Homo Sapiens
RQIYGPECTF

SEQ ID NO: 75886 - protein, 10 aa, Homo Sapiens
RQKPVDLLKY

SEQ ID NO: 75887 - protein, 10 aa, Homo Sapiens
RQKQGVVLKY

SEQ ID NO: 75888 - protein, 10 aa, Homo Sapiens
RQKVGTSSRY

SEQ ID NO: 75889 - protein, 10 aa, Homo Sapiens
RQLDNAVSAF

SEQ ID NO: 75890 - protein, 10 aa, Homo Sapiens
RQLEDILSTY

SEQ ID NO: 75891 - protein, 10 aa, Homo Sapiens
RQLEEEGITF

SEQ ID NO: 75892 - protein, 10 aa, Homo Sapiens
RQLGIIVSDF

SEQ ID NO: 75893 - protein, 10 aa, Homo Sapiens
RQLGLEHTRY

SEQ ID NO: 75894 - protein, 10 aa, Homo Sapiens
RQLPEPLISF

SEQ ID NO: 75895 - protein, 10 aa, Homo Sapiens
RQNALGHVRY

SEQ ID NO: 75896 - protein, 10 aa, Homo Sapiens
RQNEHCLTNF

SEQ ID NO: 75897 - protein, 10 aa, Homo Sapiens
RQNPHHVHEW

SEQ ID NO: 75898 - protein, 10 aa, Homo Sapiens
RQNVGTLESF

SEQ ID NO: 75899 - protein, 10 aa, Homo Sapiens
RQPDNAKALY

SEQ ID NO: 75900 - protein, 10 aa, Homo Sapiens
RQPDSPTALY

SEQ ID NO: 75901 - protein, 10 aa, Homo Sapiens
RQPLALNVAY

SEQ ID NO: 75902 - protein, 10 aa, Homo Sapiens
RQQPMEGATY

SEQ ID NO: 75903 - protein, 10 aa, Homo Sapiens
RQQPPSTTTF

SEQ ID NO: 75904 - protein, 10 aa, Homo Sapiens
RQRDSKIDSL

SEQ ID NO: 75905 - protein, 10 aa, Homo Sapiens
RQRDYKLAAL

SEQ ID NO: 75906 - protein, 10 aa, Homo Sapiens
RQRQEVCQSY

SEQ ID NO: 75907 - protein, 10 aa, Homo Sapiens
RQSVQEHCTF

SEQ ID NO: 75908 - protein, 10 aa, Homo Sapiens
RQVDLSVHAY

SEQ ID NO: 75909 - protein, 10 aa, Homo Sapiens
RQVEDLQATF

SEQ ID NO: 75910 - protein, 10 aa, Homo Sapiens
RQVSHKHIVY

SEQ ID NO: 75911 - protein, 10 aa, Homo Sapiens
RQYDKFLTHF

SEQ ID NO: 75912 - protein, 10 aa, Homo Sapiens
RQYEGHVNEY

SEQ ID NO: 75913 - protein, 10 aa, Homo Sapiens
RQYHLQQLFY

SEQ ID NO: 75914 - protein, 10 aa, Homo Sapiens
RQYNRDWQSY

SEQ ID NO: 75915 - protein, 10 aa, Homo Sapiens
RQYPDLETKY

SEQ ID NO: 75916 - protein, 10 aa, Homo Sapiens
RQYPWGTVQV

SEQ ID NO: 75917 - protein, 10 aa, Homo Sapiens
RQYPWGVAEV

SEQ ID NO: 75918 - protein, 10 aa, Homo Sapiens
RQYPWGVVQV

SEQ ID NO: 75919 - protein, 10 aa, Homo Sapiens
RSFAGNLNTY

SEQ ID NO: 75920 - protein, 10 aa, Homo Sapiens
RSKNPSKESF

SEQ ID NO: 75921 - protein, 10 aa, Homo Sapiens
RTFDETVSTY

SEQ ID NO: 75922 - protein, 10 aa, Homo Sapiens
RTFDLTVVSY

SEQ ID NO: 75923 - protein, 10 aa, Homo Sapiens
RVADFGSATF

SEQ ID NO: 75924 - protein, 10 aa, Homo Sapiens
RVADNAQQQY

SEQ ID NO: 75925 - protein, 10 aa, Homo Sapiens
RVAELDKITY

SEQ ID NO: 75926 - protein, 10 aa, Homo Sapiens
RVFDHKQGTY

SEQ ID NO: 75927 - protein, 10 aa, Homo Sapiens
RVFDKDGNGY

SEQ ID NO: 75928 - protein, 10 aa, Homo Sapiens
RVFKSGETTY

SEQ ID NO: 75929 - protein, 10 aa, Homo Sapiens
RVFPDKGYSF

SEQ ID NO: 75930 - protein, 10 aa, Homo Sapiens
RVFPEKGYSF

SEQ ID NO: 75931 - protein, 10 aa, Homo Sapiens
RVFQGAPKGY

SEQ ID NO: 75932 - protein, 10 aa, Homo Sapiens
RVGPIEATSF

SEQ ID NO: 75933 - protein, 10 aa, Homo Sapiens
RVIEEAKTAF

SEQ ID NO: 75934 - protein, 10 aa, Homo Sapiens
RVITISKSEY

SEQ ID NO: 75935 - protein, 10 aa, Homo Sapiens
RVIVGGSSEY

SEQ ID NO: 75936 - protein, 10 aa, Homo Sapiens
RVKGPGISKF

SEQ ID NO: 75937 - protein, 10 aa, Homo Sapiens
RVPECQVTTY

SEQ ID NO: 75938 - protein, 10 aa, Homo Sapiens
RVREAENVAF

SEQ ID NO: 75939 - protein, 10 aa, Homo Sapiens
RVSNFKPGVY

SEQ ID NO: 75940 - protein, 10 aa, Homo Sapiens
RVSSQQTVSY

SEQ ID NO: 75941 - protein, 10 aa, Homo Sapiens
RVVEGNHTVY

SEQ ID NO: 75942 - protein, 10 aa, Homo Sapiens
RVVEGNHVVY

SEQ ID NO: 75943 - protein, 10 aa, Homo Sapiens
RVYPERSTSY

SEQ ID NO: 75944 - protein, 10 aa, Homo Sapiens
SEPSFITESY

SEQ ID NO: 75945 - protein, 10 aa, Homo Sapiens
SGSQRISSIY

SEQ ID NO: 75946 - protein, 10 aa, Homo Sapiens
SINPDEAVAY

SEQ ID NO: 75947 - protein, 10 aa, Homo Sapiens
SIRPDNMSEY

SEQ ID NO: 75948 - protein, 10 aa, Homo Sapiens
SIYRGPSHTY

SEQ ID NO: 75949 - protein, 10 aa, Homo Sapiens
SLAKIGFHLY

SEQ ID NO: 75950 - protein, 10 aa, Homo Sapiens
SLARTSSAEY

SEQ ID NO: 75951 - protein, 10 aa, Homo Sapiens
SLFGSSRVQY

SEQ ID NO: 75952 - protein, 10 aa, Homo Sapiens
SLFHGGKSHY

SEQ ID NO: 75953 - protein, 10 aa, Homo Sapiens
SLHDNKYIRY

SEQ ID NO: 75954 - protein, 10 aa, Homo Sapiens
SLHPHERLSY

SEQ ID NO: 75955 - protein, 10 aa, Homo Sapiens
SLIKETTTGY

SEQ ID NO: 75956 - protein, 10 aa, Homo Sapiens
SLNSKVVSQY

SEQ ID NO: 75957 - protein, 10 aa, Homo Sapiens
SLPNFKQNEF

SEQ ID NO: 75958 - protein, 10 aa, Homo Sapiens
SLPPGVHISY

SEQ ID NO: 75959 - protein, 10 aa, Homo Sapiens
SLPSHLNISY

SEQ ID NO: 75960 - protein, 10 aa, Homo Sapiens
SMFTEKTTTY

SEQ ID NO: 75961 - protein, 10 aa, Homo Sapiens
SQATPNQQTY

SEQ ID NO: 75962 - protein, 10 aa, Homo Sapiens
SQCGKAFTHY

SEQ ID NO: 75963 - protein, 10 aa, Homo Sapiens
SQFHGLITHY

SEQ ID NO: 75964 - protein, 10 aa, Homo Sapiens
SQFLQAAERY

SEQ ID NO: 75965 - protein, 10 aa, Homo Sapiens
SQFPTQPGQY

SEQ ID NO: 75966 - protein, 10 aa, Homo Sapiens
SQFTDGQQLY

SEQ ID NO: 75967 - protein, 10 aa, Homo Sapiens
SQGPASHSRF

SEQ ID NO: 75968 - protein, 10 aa, Homo Sapiens
SQHAKYTCSF

SEQ ID NO: 75969 - protein, 10 aa, Homo Sapiens
SQHDEKMTTF

SEQ ID NO: 75970 - protein, 10 aa, Homo Sapiens
SQHGLSKVVY

SEQ ID NO: 75971 - protein, 10 aa, Homo Sapiens
SQHGPSVCSF

SEQ ID NO: 75972 - protein, 10 aa, Homo Sapiens
SQHIGTGNLY

SEQ ID NO: 75973 - protein, 10 aa, Homo Sapiens
SQIAKDVCTF

SEQ ID NO: 75974 - protein, 10 aa, Homo Sapiens
SQIFIGPTYY

SEQ ID NO: 75975 - protein, 10 aa, Homo Sapiens
SQIPGPTAAY

SEQ ID NO: 75976 - protein, 10 aa, Homo Sapiens
SQISEALSRY

SEQ ID NO: 75977 - protein, 10 aa, Homo Sapiens
SQISILKELY

SEQ ID NO: 75978 - protein, 10 aa, Homo Sapiens
SQKVIAHSEY

SEQ ID NO: 75979 - protein, 10 aa, Homo Sapiens
SQLEHLQSKY

SEQ ID NO: 75980 - protein, 10 aa, Homo Sapiens
SQNRPPPNAY

SEQ ID NO: 75981 - protein, 10 aa, Homo Sapiens
SQPQSSTGGY

SEQ ID NO: 75982 - protein, 10 aa, Homo Sapiens
SQQPASGVAY

SEQ ID NO: 75983 - protein, 10 aa, Homo Sapiens
SQRDPPHNNF

SEQ ID NO: 75984 - protein, 10 aa, Homo Sapiens
SQRNAVDLVY

SEQ ID NO: 75985 - protein, 10 aa, Homo Sapiens
SQRPGAHLTV

SEQ ID NO: 75986 - protein, 10 aa, Homo Sapiens
SQRPPTRETF

SEQ ID NO: 75987 - protein, 10 aa, Homo Sapiens
SQRQAKIQRY

SEQ ID NO: 75988 - protein, 10 aa, Homo Sapiens
SQRYQVGVHY

SEQ ID NO: 75989 - protein, 10 aa, Homo Sapiens
SQSPAYNSQY

SEQ ID NO: 75990 - protein, 10 aa, Homo Sapiens
SQTPNNTVTY

SEQ ID NO: 75991 - protein, 10 aa, Homo Sapiens
SQVSHTHLAF

SEQ ID NO: 75992 - protein, 10 aa, Homo Sapiens
SQVVFSGKAY

SEQ ID NO: 75993 - protein, 10 aa, Homo Sapiens
SQYGELIEKY

SEQ ID NO: 75994 - protein, 10 aa, Homo Sapiens
SQYNIRGVTY

SEQ ID NO: 75995 - protein, 10 aa, Homo Sapiens
SQYPFPVTLY

SEQ ID NO: 75996 - protein, 10 aa, Homo Sapiens
SQYPGGQPTY

SEQ ID NO: 75997 - protein, 10 aa, Homo Sapiens
SQYPNQPTRF

SEQ ID NO: 75998 - protein, 10 aa, Homo Sapiens
SQYSQQSSSY

SEQ ID NO: 75999 - protein, 10 aa, Homo Sapiens
SSKPWPDATY

SEQ ID NO: 76000 - protein, 10 aa, Homo Sapiens
SSQFGGGSQY

SEQ ID NO: 76001 - protein, 10 aa, Homo Sapiens
SSYAHKASSI

SEQ ID NO: 76002 - protein, 10 aa, Homo Sapiens
SVAKTNTVSY

SEQ ID NO: 76003 - protein, 10 aa, Homo Sapiens
SVFPGHPVQF

SEQ ID NO: 76004 - protein, 10 aa, Homo Sapiens
SVIRELKEQY

SEQ ID NO: 76005 - protein, 10 aa, Homo Sapiens
SVKQPDLVSY

SEQ ID NO: 76006 - protein, 10 aa, Homo Sapiens
SVNGERLGTY

SEQ ID NO: 76007 - protein, 10 aa, Homo Sapiens
SVSGAGCTTY

SEQ ID NO: 76008 - protein, 10 aa, Homo Sapiens
SYGGGSGGGF

SEQ ID NO: 76009 - protein, 10 aa, Homo Sapiens
TIHGAAGTVY

SEQ ID NO: 76010 - protein, 10 aa, Homo Sapiens
TKTGMLSRAT

SEQ ID NO: 76011 - protein, 10 aa, Homo Sapiens
TLARNCFQLY

SEQ ID NO: 76012 - protein, 10 aa, Homo Sapiens
TLFKEDFINY

SEQ ID NO: 76013 - protein, 10 aa, Homo Sapiens
TLKSGDGITF

SEQ ID NO: 76014 - protein, 10 aa, Homo Sapiens
TLNQKEAVAY

SEQ ID NO: 76015 - protein, 10 aa, Homo Sapiens
TLNREGTETF

SEQ ID NO: 76016 - protein, 10 aa, Homo Sapiens
TLPGHIQAVY

SEQ ID NO: 76017 - protein, 10 aa, Homo Sapiens
TLQRATGISF

SEQ ID NO: 76018 - protein, 10 aa, Homo Sapiens
TLRSEGFDTY

SEQ ID NO: 76019 - protein, 10 aa, Homo Sapiens
TLVHADLSEY

SEQ ID NO: 76020 - protein, 10 aa, Homo Sapiens
TMQSATGIQY

SEQ ID NO: 76021 - protein, 10 aa, Homo Sapiens
TQAQIKAAYY

SEQ ID NO: 76022 - protein, 10 aa, Homo Sapiens
TQARHALCQF

SEQ ID NO: 76023 - protein, 10 aa, Homo Sapiens
TQIGGERYNF

SEQ ID NO: 76024 - protein, 10 aa, Homo Sapiens
TQKAAVETSF

SEQ ID NO: 76025 - protein, 10 aa, Homo Sapiens
TQKGGTISCY

SEQ ID NO: 76026 - protein, 10 aa, Homo Sapiens
TQKGPENLHY

SEQ ID NO: 76027 - protein, 10 aa, Homo Sapiens
TQKIPDQDFY

SEQ ID NO: 76028 - protein, 10 aa, Homo Sapiens
TQNNAMKISF

SEQ ID NO: 76029 - protein, 10 aa, Homo Sapiens
TQNPYHQQAL

SEQ ID NO: 76030 - protein, 10 aa, Homo Sapiens
TQPDLPATTY

SEQ ID NO: 76031 - protein, 10 aa, Homo Sapiens
TQPDWIAICY

SEQ ID NO: 76032 - protein, 10 aa, Homo Sapiens
TQQGAALQNY

SEQ ID NO: 76033 - protein, 10 aa, Homo Sapiens
TQQIPSKVLF

SEQ ID NO: 76034 - protein, 10 aa, Homo Sapiens
TQQPFDVSAF

SEQ ID NO: 76035 - protein, 10 aa, Homo Sapiens
TQRPIALELY

SEQ ID NO: 76036 - protein, 10 aa, Homo Sapiens
TQRSHLTQEY

SEQ ID NO: 76037 - protein, 10 aa, Homo Sapiens
TQSPVSSEEY

SEQ ID NO: 76038 - protein, 10 aa, Homo Sapiens
TSQYQGVVVY

SEQ ID NO: 76039 - protein, 10 aa, Homo Sapiens
TTKSADRVTY

SEQ ID NO: 76040 - protein, 10 aa, Homo Sapiens
TVEKGDHVAY

SEQ ID NO: 76041 - protein, 10 aa, Homo Sapiens
TVIPNSHVYY

SEQ ID NO: 76042 - protein, 10 aa, Homo Sapiens
TVKGVSLSSY

SEQ ID NO: 76043 - protein, 10 aa, Homo Sapiens
VASQKGMSVY

SEQ ID NO: 76044 - protein, 10 aa, Homo Sapiens
VINPKDNNQF

SEQ ID NO: 76045 - protein, 10 aa, Homo Sapiens
VINSKASLTY

SEQ ID NO: 76046 - protein, 10 aa, Homo Sapiens
VIVPSSEITY

SEQ ID NO: 76047 - protein, 10 aa, Homo Sapiens
VLAPHLTRAY

SEQ ID NO: 76048 - protein, 10 aa, Homo Sapiens
VLHQDSGLGY

SEQ ID NO: 76049 - protein, 10 aa, Homo Sapiens
VLKADEGISF

SEQ ID NO: 76050 - protein, 10 aa, Homo Sapiens
VLKPGMVVTF

SEQ ID NO: 76051 - protein, 10 aa, Homo Sapiens
VLKTDEGIAY

SEQ ID NO: 76052 - protein, 10 aa, Homo Sapiens
VLNPLCQVDY

SEQ ID NO: 76053 - protein, 10 aa, Homo Sapiens
VLSAADKGNV

SEQ ID NO: 76054 - protein, 10 aa, Homo Sapiens
VLVQHNLVSY

SEQ ID NO: 76055 - protein, 10 aa, Homo Sapiens
VMFPGNSPSY

SEQ ID NO: 76056 - protein, 10 aa, Homo Sapiens
VMMIPSQISY

SEQ ID NO: 76057 - protein, 10 aa, Homo Sapiens
VQADVQKERY

SEQ ID NO: 76058 - protein, 10 aa, Homo Sapiens
VQAVHKNTTY

SEQ ID NO: 76059 - protein, 10 aa, Homo Sapiens
VQEGNVESAY

SEQ ID NO: 76060 - protein, 10 aa, Homo Sapiens
VQFDGTNSAF

SEQ ID NO: 76061 - protein, 10 aa, Homo Sapiens
VQFGANKNQY

SEQ ID NO: 76062 - protein, 10 aa, Homo Sapiens
VQFGANKSQY

SEQ ID NO: 76063 - protein, 10 aa, Homo Sapiens
VQFIGRESKY

SEQ ID NO: 76064 - protein, 10 aa, Homo Sapiens
VQFQGKKTKF

SEQ ID NO: 76065 - protein, 10 aa, Homo Sapiens
VQFVGREAKY

SEQ ID NO: 76066 - protein, 10 aa, Homo Sapiens
VQHGVEGLTY

SEQ ID NO: 76067 - protein, 10 aa, Homo Sapiens
VQIGQVHEEF

SEQ ID NO: 76068 - protein, 10 aa, Homo Sapiens
VQITEARCFY

SEQ ID NO: 76069 - protein, 10 aa, Homo Sapiens
VQIVSKKVSY

SEQ ID NO: 76070 - protein, 10 aa, Homo Sapiens
VQKEDISVVF

SEQ ID NO: 76071 - protein, 10 aa, Homo Sapiens
VQKGMPHKCY

SEQ ID NO: 76072 - protein, 10 aa, Homo Sapiens
VQKKDTGHIY

SEQ ID NO: 76073 - protein, 10 aa, Homo Sapiens
VQKNDVNVEF

SEQ ID NO: 76074 - protein, 10 aa, Homo Sapiens
VQKPDAANYY

SEQ ID NO: 76075 - protein, 10 aa, Homo Sapiens
VQPKHVKEAF

SEQ ID NO: 76076 - protein, 10 aa, Homo Sapiens
VQPTFTASQY

SEQ ID NO: 76077 - protein, 10 aa, Homo Sapiens
VQQKESGLKY

SEQ ID NO: 76078 - protein, 10 aa, Homo Sapiens
VQQPGQTNFY

SEQ ID NO: 76079 - protein, 10 aa, Homo Sapiens
VQRGGTPSAF

SEQ ID NO: 76080 - protein, 10 aa, Homo Sapiens
VQRIQESTCF

SEQ ID NO: 76081 - protein, 10 aa, Homo Sapiens
VQRLNESTSY

SEQ ID NO: 76082 - protein, 10 aa, Homo Sapiens
VQRLPVGAAF

SEQ ID NO: 76083 - protein, 10 aa, Homo Sapiens
VQSPNCNQRY

SEQ ID NO: 76084 - protein, 10 aa, Homo Sapiens
VQVDGKIGLF

SEQ ID NO: 76085 - protein, 10 aa, Homo Sapiens
VRDEESHEFV

SEQ ID NO: 76086 - protein, 10 aa, Homo Sapiens
VTAVAGLTSY

SEQ ID NO: 76087 - protein, 10 aa, Homo Sapiens
VTIKKDVDGA

SEQ ID NO: 76088 - protein, 10 aa, Homo Sapiens
VVCPVSDILY

SEQ ID NO: 76089 - protein, 10 aa, Homo Sapiens
VVGPSSVLTY

SEQ ID NO: 76090 - protein, 10 aa, Homo Sapiens
VVQGLLSETY

SEQ ID NO: 76091 - protein, 10 aa, Homo Sapiens
VVRDEESHEF

SEQ ID NO: 76092 - protein, 10 aa, Homo Sapiens
VVRDENSSVY

SEQ ID NO: 76093 - protein, 10 aa, Homo Sapiens
VVVAVGRALY

SEQ ID NO: 76094 - protein, 10 aa, Homo Sapiens
YAQDEHLITF

SEQ ID NO: 76095 - protein, 10 aa, Homo Sapiens
YDAEISQIHQ

SEQ ID NO: 76096 - protein, 10 aa, Homo Sapiens
YLFQGRQECY

SEQ ID NO: 76097 - protein, 10 aa, Homo Sapiens
YLMEEDEDAY

SEQ ID NO: 76098 - protein, 10 aa, Homo Sapiens
YLNEQGDRVY

SEQ ID NO: 76099 - protein, 10 aa, Homo Sapiens
YLPQHTIETY

SEQ ID NO: 76100 - protein, 10 aa, Homo Sapiens
YMIDPSGVSY

SEQ ID NO: 76101 - protein, 10 aa, Homo Sapiens
YQHDDGRVSY

SEQ ID NO: 76102 - protein, 10 aa, Homo Sapiens
YQIGDVFISH

SEQ ID NO: 76103 - protein, 10 aa, Homo Sapiens
YQKPIIQSEY

SEQ ID NO: 76104 - protein, 10 aa, Homo Sapiens
YQNNIKNDKY

SEQ ID NO: 76105 - protein, 10 aa, Homo Sapiens
YQPEQPNLVY

SEQ ID NO: 76106 - protein, 10 aa, Homo Sapiens
YQPEVHGVSY

SEQ ID NO: 76107 - protein, 10 aa, Homo Sapiens
YQPSPSPQSY

SEQ ID NO: 76108 - protein, 10 aa, Homo Sapiens
YQTIGNHASY

SEQ ID NO: 76109 - protein, 10 aa, Homo Sapiens
YQYSDQGIDY

SEQ ID NO: 76110 - protein, 10 aa, Homo Sapiens
YVHDDGRVSY

SEQ ID NO: 76111 - protein, 11 aa, Homo Sapiens
AAAAAAAGSPY

SEQ ID NO: 76112 - protein, 11 aa, Homo Sapiens
AEQNRKDAEAW

SEQ ID NO: 76113 - protein, 11 aa, Homo Sapiens
AEQRGELAIKD

SEQ ID NO: 76114 - protein, 11 aa, Homo Sapiens
AEVNADRITWL

SEQ ID NO: 76115 - protein, 11 aa, Homo Sapiens
AGGYFTSPGGY

SEQ ID NO: 76116 - protein, 11 aa, Homo Sapiens
AIKKPSGDDRY

SEQ ID NO: 76117 - protein, 11 aa, Homo Sapiens
ALAGLKTVSSY

SEQ ID NO: 76118 - protein, 11 aa, Homo Sapiens
ALISGGKDSCY

SEQ ID NO: 76119 - protein, 11 aa, Homo Sapiens
ALQNHENESVY

SEQ ID NO: 76120 - protein, 11 aa, Homo Sapiens
ALRPSTSRSLY

SEQ ID NO: 76121 - protein, 11 aa, Homo Sapiens
AMFDQSQIQEF

SEQ ID NO: 76122 - protein, 11 aa, Homo Sapiens
ANALGGKGAGF

SEQ ID NO: 76123 - protein, 11 aa, Homo Sapiens
AQAAPQTYAEY

SEQ ID NO: 76124 - protein, 11 aa, Homo Sapiens
AQAGHAIITNY

SEQ ID NO: 76125 - protein, 11 aa, Homo Sapiens
AQAQLRNLEAY

SEQ ID NO: 76126 - protein, 11 aa, Homo Sapiens
AQCSHAAVSAY

SEQ ID NO: 76127 - protein, 11 aa, Homo Sapiens
AQFGHTSIVAY

SEQ ID NO: 76128 - protein, 11 aa, Homo Sapiens
AQFPGACGLRY

SEQ ID NO: 76129 - protein, 11 aa, Homo Sapiens
AQHDAQEFMAF

SEQ ID NO: 76130 - protein, 11 aa, Homo Sapiens
AQHNTRMLATY

SEQ ID NO: 76131 - protein, 11 aa, Homo Sapiens
AQKFATDGEGY

SEQ ID NO: 76132 - protein, 11 aa, Homo Sapiens
AQKKPFTPVKY

SEQ ID NO: 76133 - protein, 11 aa, Homo Sapiens
AQKPGAPLQAF

SEQ ID NO: 76134 - protein, 11 aa, Homo Sapiens
AQKPSVPRSNF

SEQ ID NO: 76135 - protein, 11 aa, Homo Sapiens
AQLILKAISSY

SEQ ID NO: 76136 - protein, 11 aa, Homo Sapiens
AQLNRDMIVSF

SEQ ID NO: 76137 - protein, 11 aa, Homo Sapiens
AQNLGNFIVRY

SEQ ID NO: 76138 - protein, 11 aa, Homo Sapiens
AQQHPQAAASY

SEQ ID NO: 76139 - protein, 11 aa, Homo Sapiens
AQQVQQVAAEY

SEQ ID NO: 76140 - protein, 11 aa, Homo Sapiens
AQRALDEATKY

SEQ ID NO: 76141 - protein, 11 aa, Homo Sapiens
AQREAAEVCEY

SEQ ID NO: 76142 - protein, 11 aa, Homo Sapiens
AQRIVRVPILY

SEQ ID NO: 76143 - protein, 11 aa, Homo Sapiens
AQRLGVSQSTH

SEQ ID NO: 76144 - protein, 11 aa, Homo Sapiens
AQRSARALLDY

SEQ ID NO: 76145 - protein, 11 aa, Homo Sapiens
AQSGTGKTATF

SEQ ID NO: 76146 - protein, 11 aa, Homo Sapiens
AQSSIALHHQY

SEQ ID NO: 76147 - protein, 11 aa, Homo Sapiens
AQVKADGHKVY

SEQ ID NO: 76148 - protein, 11 aa, Homo Sapiens
AQYAQRASVAF

SEQ ID NO: 76149 - protein, 11 aa, Homo Sapiens
AQYLPKEQYLY

SEQ ID NO: 76150 - protein, 11 aa, Homo Sapiens
AQYQFTGIKKY

SEQ ID NO: 76151 - protein, 11 aa, Homo Sapiens
AVNPSILPTAF

SEQ ID NO: 76152 - protein, 11 aa, Homo Sapiens
AVRDISEASVF

SEQ ID NO: 76153 - protein, 11 aa, Homo Sapiens
EQFLDTNETPY

SEQ ID NO: 76154 - protein, 11 aa, Homo Sapiens
EQIYPVNAISF

SEQ ID NO: 76155 - protein, 11 aa, Homo Sapiens
ETQITQIEHEV

SEQ ID NO: 76156 - protein, 11 aa, Homo Sapiens
FEIDGRKNKSY

SEQ ID NO: 76157 - protein, 11 aa, Homo Sapiens
FIFREGDGVYY

SEQ ID NO: 76158 - protein, 11 aa, Homo Sapiens
FMKDTDSINLY

SEQ ID NO: 76159 - protein, 11 aa, Homo Sapiens
FQKEDSPATFY

SEQ ID NO: 76160 - protein, 11 aa, Homo Sapiens
GAIKADHVSTY

SEQ ID NO: 76161 - protein, 11 aa, Homo Sapiens
GIIHLGATSCY

SEQ ID NO: 76162 - protein, 11 aa, Homo Sapiens
GLGSGGSIRSS

SEQ ID NO: 76163 - protein, 11 aa, Homo Sapiens
GQFGVGFYSAY

SEQ ID NO: 76164 - protein, 11 aa, Homo Sapiens
GQHFPIEVRHY

SEQ ID NO: 76165 - protein, 11 aa, Homo Sapiens
GQHRSTIITLY

SEQ ID NO: 76166 - protein, 11 aa, Homo Sapiens
GQHSQGLGGHY

SEQ ID NO: 76167 - protein, 11 aa, Homo Sapiens
GQIDKEAVQKY

SEQ ID NO: 76168 - protein, 11 aa, Homo Sapiens
GQIKTVYPASY

SEQ ID NO: 76169 - protein, 11 aa, Homo Sapiens
GQIVQSKINSF

SEQ ID NO: 76170 - protein, 11 aa, Homo Sapiens
GQIYDRQGATY

SEQ ID NO: 76171 - protein, 11 aa, Homo Sapiens
GQKLPKSRTAY

SEQ ID NO: 76172 - protein, 11 aa, Homo Sapiens
GQLDAAQRTLY

SEQ ID NO: 76173 - protein, 11 aa, Homo Sapiens
GQNGKDEVVAY

SEQ ID NO: 76174 - protein, 11 aa, Homo Sapiens
GQPAQDIFSVY

SEQ ID NO: 76175 - protein, 11 aa, Homo Sapiens
GQPERKFMQTF

SEQ ID NO: 76176 - protein, 11 aa, Homo Sapiens
GQPGQKQSTTF

SEQ ID NO: 76177 - protein, 11 aa, Homo Sapiens
GQQIGKVVQVY

SEQ ID NO: 76178 - protein, 11 aa, Homo Sapiens
GQQVHNLLLTY

SEQ ID NO: 76179 - protein, 11 aa, Homo Sapiens
GQYSPPPYSEY

SEQ ID NO: 76180 - protein, 11 aa, Homo Sapiens
GVAGVGAGLAY

SEQ ID NO: 76181 - protein, 11 aa, Homo Sapiens
GVFEPNNPVCF

SEQ ID NO: 76182 - protein, 11 aa, Homo Sapiens
HQYNPKFQTLF

SEQ ID NO: 76183 - protein, 11 aa, Homo Sapiens
HQYPNFKDIRY

SEQ ID NO: 76184 - protein, 11 aa, Homo Sapiens
IARDEGGKAFF

SEQ ID NO: 76185 - protein, 11 aa, Homo Sapiens
IEYPTGSGNVY

SEQ ID NO: 76186 - protein, 11 aa, Homo Sapiens
IIISGGPNSVY

SEQ ID NO: 76187 - protein, 11 aa, Homo Sapiens
IIYPLCENNVY

SEQ ID NO: 76188 - protein, 11 aa, Homo Sapiens
ILFPVSGVGSY

SEQ ID NO: 76189 - protein, 11 aa, Homo Sapiens
ILGPSHPDTSY

SEQ ID NO: 76190 - protein, 11 aa, Homo Sapiens
ILKEADQKEQF

SEQ ID NO: 76191 - protein, 11 aa, Homo Sapiens
ILKEDPANTVY

SEQ ID NO: 76192 - protein, 11 aa, Homo Sapiens
ILREDPAYLHY

SEQ ID NO: 76193 - protein, 11 aa, Homo Sapiens
ILSDPKKKTRY

SEQ ID NO: 76194 - protein, 11 aa, Homo Sapiens
IMFDVTSRVTY

SEQ ID NO: 76195 - protein, 11 aa, Homo Sapiens
IMKSIGEAIQY

SEQ ID NO: 76196 - protein, 11 aa, Homo Sapiens
IQFRLPDGSSF

SEQ ID NO: 76197 - protein, 11 aa, Homo Sapiens
IQINPQNKADF

SEQ ID NO: 76198 - protein, 11 aa, Homo Sapiens
IQKFPYDDPTY

SEQ ID NO: 76199 - protein, 11 aa, Homo Sapiens
IQKQEQIPLTY

SEQ ID NO: 76200 - protein, 11 aa, Homo Sapiens
IQLEPDQIIHY

SEQ ID NO: 76201 - protein, 11 aa, Homo Sapiens
IQMKPGSKIRY

SEQ ID NO: 76202 - protein, 11 aa, Homo Sapiens
IQNPDITSSRY

SEQ ID NO: 76203 - protein, 11 aa, Homo Sapiens
IQPEKDIIVEF

SEQ ID NO: 76204 - protein, 11 aa, Homo Sapiens
IQPHPRTGNKY

SEQ ID NO: 76205 - protein, 11 aa, Homo Sapiens
IQPNTTGKQLF

SEQ ID NO: 76206 - protein, 11 aa, Homo Sapiens
IQQHFSATLAY

SEQ ID NO: 76207 - protein, 11 aa, Homo Sapiens
ITKPQNLNDAY

SEQ ID NO: 76208 - protein, 11 aa, Homo Sapiens
IVFVSENVTQY

SEQ ID NO: 76209 - protein, 11 aa, Homo Sapiens
KITDSAGHILY

SEQ ID NO: 76210 - protein, 11 aa, Homo Sapiens
KLFGPFTRNYY

SEQ ID NO: 76211 - protein, 11 aa, Homo Sapiens
KLHVSGESSVF

SEQ ID NO: 76212 - protein, 11 aa, Homo Sapiens
KLIHPTENITF

SEQ ID NO: 76213 - protein, 11 aa, Homo Sapiens
KLKEAETRAEF

SEQ ID NO: 76214 - protein, 11 aa, Homo Sapiens
KLKGTVGEPTY

SEQ ID NO: 76215 - protein, 11 aa, Homo Sapiens
KLKPTSKDQVL

SEQ ID NO: 76216 - protein, 11 aa, Homo Sapiens
KLKTEQGGAHF

SEQ ID NO: 76217 - protein, 11 aa, Homo Sapiens
KLYEGKTKEVY

SEQ ID NO: 76218 - protein, 11 aa, Homo Sapiens
KMKENGREGCF

SEQ ID NO: 76219 - protein, 11 aa, Homo Sapiens
KMKQDAQVVLY

SEQ ID NO: 76220 - protein, 11 aa, Homo Sapiens
KMYSTDDGVQF

SEQ ID NO: 76221 - protein, 11 aa, Homo Sapiens
KQAEWSSKTSY

SEQ ID NO: 76222 - protein, 11 aa, Homo Sapiens
KQASVVIQQQY

SEQ ID NO: 76223 - protein, 11 aa, Homo Sapiens
KQFFQDKARFY

SEQ ID NO: 76224 - protein, 11 aa, Homo Sapiens
KQIDNTGSSTY

SEQ ID NO: 76225 - protein, 11 aa, Homo Sapiens
KQIDPEMLNSF

SEQ ID NO: 76226 - protein, 11 aa, Homo Sapiens
KQIGGGDIAVF

SEQ ID NO: 76227 - protein, 11 aa, Homo Sapiens
KQIVPKESLVY

SEQ ID NO: 76228 - protein, 11 aa, Homo Sapiens
KQKAAGVRDVF

SEQ ID NO: 76229 - protein, 11 aa, Homo Sapiens
KQLNIAYDVTY

SEQ ID NO: 76230 - protein, 11 aa, Homo Sapiens
KQNELLEPNSF

SEQ ID NO: 76231 - protein, 11 aa, Homo Sapiens
KQNLRAIYQCF

SEQ ID NO: 76232 - protein, 11 aa, Homo Sapiens
KQNPAANKTNY

SEQ ID NO: 76233 - protein, 11 aa, Homo Sapiens
KQNPTVGFELY

SEQ ID NO: 76234 - protein, 11 aa, Homo Sapiens
KQPAIMPGQSY

SEQ ID NO: 76235 - protein, 11 aa, Homo Sapiens
KQSVQGAGTSY

SEQ ID NO: 76236 - protein, 11 aa, Homo Sapiens
KQYPPNTSKVY

SEQ ID NO: 76237 - protein, 11 aa, Homo Sapiens
KQYYALEVSYF

SEQ ID NO: 76238 - protein, 11 aa, Homo Sapiens
KVASQKGMSVY

SEQ ID NO: 76239 - protein, 11 aa, Homo Sapiens
KVFDPSCGLPY

SEQ ID NO: 76240 - protein, 11 aa, Homo Sapiens
LLARPSSTITY

SEQ ID NO: 76241 - protein, 11 aa, Homo Sapiens
LLNPSKECEPY

SEQ ID NO: 76242 - protein, 11 aa, Homo Sapiens
LLYPTEDYKVY

SEQ ID NO: 76243 - protein, 11 aa, Homo Sapiens
LMIKENPSSQY

SEQ ID NO: 76244 - protein, 11 aa, Homo Sapiens
LQHDYGHLSVY

SEQ ID NO: 76245 - protein, 11 aa, Homo Sapiens
LQIGADDVEAF

SEQ ID NO: 76246 - protein, 11 aa, Homo Sapiens
LQIHPVVITSF

SEQ ID NO: 76247 - protein, 11 aa, Homo Sapiens
LQKGVNILTSY

SEQ ID NO: 76248 - protein, 11 aa, Homo Sapiens
LQKISGQNGTF

SEQ ID NO: 76249 - protein, 11 aa, Homo Sapiens
LQPLLDNQVGF

SEQ ID NO: 76250 - protein, 11 aa, Homo Sapiens
LQREAQTLQQY

SEQ ID NO: 76251 - protein, 11 aa, Homo Sapiens
LQYLSQGNVVF

SEQ ID NO: 76252 - protein, 11 aa, Homo Sapiens
NTSQYQGVVVY

SEQ ID NO: 76253 - protein, 11 aa, Homo Sapiens
QPSSQYRIKEY

SEQ ID NO: 76254 - protein, 11 aa, Homo Sapiens
QQFYQPKIQQF

SEQ ID NO: 76255 - protein, 11 aa, Homo Sapiens
QQGPVGVNVTY

SEQ ID NO: 76256 - protein, 11 aa, Homo Sapiens
QQIPASDTQQL

SEQ ID NO: 76257 - protein, 11 aa, Homo Sapiens
QQLDPDEKIAY

SEQ ID NO: 76258 - protein, 11 aa, Homo Sapiens
QQLDPDEKITY

SEQ ID NO: 76259 - protein, 11 aa, Homo Sapiens
QQLDPEQKITY

SEQ ID NO: 76260 - protein, 11 aa, Homo Sapiens
QQPNGAGFAAF

SEQ ID NO: 76261 - protein, 11 aa, Homo Sapiens
QQQHSPQQIAY

SEQ ID NO: 76262 - protein, 11 aa, Homo Sapiens
QQYYPDGNSQY

SEQ ID NO: 76263 - protein, 11 aa, Homo Sapiens
RAFDQGADAIY

SEQ ID NO: 76264 - protein, 11 aa, Homo Sapiens
RAFDSQNNTVY

SEQ ID NO: 76265 - protein, 11 aa, Homo Sapiens
RAKPEYISKTY

SEQ ID NO: 76266 - protein, 11 aa, Homo Sapiens
RIFPSHISSRY

SEQ ID NO: 76267 - protein, 11 aa, Homo Sapiens
RIKKPDYKVAY

SEQ ID NO: 76268 - protein, 11 aa, Homo Sapiens
RIMDPDVITGY

SEQ ID NO: 76269 - protein, 11 aa, Homo Sapiens
RLFDANKAELF

SEQ ID NO: 76270 - protein, 11 aa, Homo Sapiens
RLFPSAAQVTF

SEQ ID NO: 76271 - protein, 11 aa, Homo Sapiens
RLFSTAEAAVY

SEQ ID NO: 76272 - protein, 11 aa, Homo Sapiens
RLFTEKVNNTF

SEQ ID NO: 76273 - protein, 11 aa, Homo Sapiens
RLGGGTYGEVF

SEQ ID NO: 76274 - protein, 11 aa, Homo Sapiens
RLHEAFSPVSY

SEQ ID NO: 76275 - protein, 11 aa, Homo Sapiens
RLIAQRYLLQY

SEQ ID NO: 76276 - protein, 11 aa, Homo Sapiens
RLIHPKSGRSY

SEQ ID NO: 76277 - protein, 11 aa, Homo Sapiens
RLIPDGCGVKY

SEQ ID NO: 76278 - protein, 11 aa, Homo Sapiens
RLKENNIEQIY

SEQ ID NO: 76279 - protein, 11 aa, Homo Sapiens
RLLKPGGVLTY

SEQ ID NO: 76280 - protein, 11 aa, Homo Sapiens
RLMVVEERCVY

SEQ ID NO: 76281 - protein, 11 aa, Homo Sapiens
RLNFSHGTHEY

SEQ ID NO: 76282 - protein, 11 aa, Homo Sapiens
RLNLESSNSKY

SEQ ID NO: 76283 - protein, 11 aa, Homo Sapiens
RLNVSQDDVLY

SEQ ID NO: 76284 - protein, 11 aa, Homo Sapiens
RLQSKTIKVSY

SEQ ID NO: 76285 - protein, 11 aa, Homo Sapiens
RLYEDSGYSSF

SEQ ID NO: 76286 - protein, 11 aa, Homo Sapiens
RLYKEELEQTY

SEQ ID NO: 76287 - protein, 11 aa, Homo Sapiens
RMKETQKSIYY

SEQ ID NO: 76288 - protein, 11 aa, Homo Sapiens
RMNPNSPSITY

SEQ ID NO: 76289 - protein, 11 aa, Homo Sapiens
RMQDTSVSFGY

SEQ ID NO: 76290 - protein, 11 aa, Homo Sapiens
RMQHSLAGQTY

SEQ ID NO: 76291 - protein, 11 aa, Homo Sapiens
RQADCHINNLY

SEQ ID NO: 76292 - protein, 11 aa, Homo Sapiens
RQALAYLEQSY

SEQ ID NO: 76293 - protein, 11 aa, Homo Sapiens
RQALQDLLSEY

SEQ ID NO: 76294 - protein, 11 aa, Homo Sapiens
RQGPEGLEVSF

SEQ ID NO: 76295 - protein, 11 aa, Homo Sapiens
RQHEIDGKALF

SEQ ID NO: 76296 - protein, 11 aa, Homo Sapiens
RQHEIVLKVAY

SEQ ID NO: 76297 - protein, 11 aa, Homo Sapiens
RQIGVEHVVVY

SEQ ID NO: 76298 - protein, 11 aa, Homo Sapiens
RQISTSGELSF

SEQ ID NO: 76299 - protein, 11 aa, Homo Sapiens
RQKAVSLFLCY

SEQ ID NO: 76300 - protein, 11 aa, Homo Sapiens
RQNGDDPLLTY

SEQ ID NO: 76301 - protein, 11 aa, Homo Sapiens
RQNLLSQSHAY

SEQ ID NO: 76302 - protein, 11 aa, Homo Sapiens
RQPAAFIVTQY

SEQ ID NO: 76303 - protein, 11 aa, Homo Sapiens
RQRPSVGVQSL

SEQ ID NO: 76304 - protein, 11 aa, Homo Sapiens
RQSISKALVAY

SEQ ID NO: 76305 - protein, 11 aa, Homo Sapiens
RQYGDESTLAF

SEQ ID NO: 76306 - protein, 11 aa, Homo Sapiens
RQYGSEGRFTF

SEQ ID NO: 76307 - protein, 11 aa, Homo Sapiens
RQYSRNEPLTF

SEQ ID NO: 76308 - protein, 11 aa, Homo Sapiens
RSYAGKNAVAY

SEQ ID NO: 76309 - protein, 11 aa, Homo Sapiens
RTKADSVPGTY

SEQ ID NO: 76310 - protein, 11 aa, Homo Sapiens
RVIGEDGQSVY

SEQ ID NO: 76311 - protein, 11 aa, Homo Sapiens
RVIVPSSEITY

SEQ ID NO: 76312 - protein, 11 aa, Homo Sapiens
RVYWNDGLDQY

SEQ ID NO: 76313 - protein, 11 aa, Homo Sapiens
SINPLGGFVHY

SEQ ID NO: 76314 - protein, 11 aa, Homo Sapiens
SIYPGNSDTRY

SEQ ID NO: 76315 - protein, 11 aa, Homo Sapiens
SLGGGFGGGSR

SEQ ID NO: 76316 - protein, 11 aa, Homo Sapiens
SLIGAARTKTY

SEQ ID NO: 76317 - protein, 11 aa, Homo Sapiens
SLYASSPGGVY

SEQ ID NO: 76318 - protein, 11 aa, Homo Sapiens
SMFDQSQIQEF

SEQ ID NO: 76319 - protein, 11 aa, Homo Sapiens
SQFGGGSQYAY

SEQ ID NO: 76320 - protein, 11 aa, Homo Sapiens
SQFIGYPITLY

SEQ ID NO: 76321 - protein, 11 aa, Homo Sapiens
SQHSASSANVF

SEQ ID NO: 76322 - protein, 11 aa, Homo Sapiens
SQHSPSKKALY

SEQ ID NO: 76323 - protein, 11 aa, Homo Sapiens
SQIGDDRPISY

SEQ ID NO: 76324 - protein, 11 aa, Homo Sapiens
SQIPAAVKLTY

SEQ ID NO: 76325 - protein, 11 aa, Homo Sapiens
SQIVPKVAVFY

SEQ ID NO: 76326 - protein, 11 aa, Homo Sapiens
SQPDWPGGSRY

SEQ ID NO: 76327 - protein, 11 aa, Homo Sapiens
SQRAVTNHSVY

SEQ ID NO: 76328 - protein, 11 aa, Homo Sapiens
SQRDPPHNNFF

SEQ ID NO: 76329 - protein, 11 aa, Homo Sapiens
SQRDTVLSTLY

SEQ ID NO: 76330 - protein, 11 aa, Homo Sapiens
SQYPVPDVSTY

SEQ ID NO: 76331 - protein, 11 aa, Homo Sapiens
SVIDSAELQAY

SEQ ID NO: 76332 - protein, 11 aa, Homo Sapiens
SVINSKASLTY

SEQ ID NO: 76333 - protein, 11 aa, Homo Sapiens
SVKSAAKESLY

SEQ ID NO: 76334 - protein, 11 aa, Homo Sapiens
SVNSHAATTQY

SEQ ID NO: 76335 - protein, 11 aa, Homo Sapiens
TEELNREVATN

SEQ ID NO: 76336 - protein, 11 aa, Homo Sapiens
TLIHSDLTSVY

SEQ ID NO: 76337 - protein, 11 aa, Homo Sapiens
TLQDSRTNTAY

SEQ ID NO: 76338 - protein, 11 aa, Homo Sapiens
TMILTVGGTAY

SEQ ID NO: 76339 - protein, 11 aa, Homo Sapiens
TQFINPETPGY

SEQ ID NO: 76340 - protein, 11 aa, Homo Sapiens
TQFPSTVSTVY

SEQ ID NO: 76341 - protein, 11 aa, Homo Sapiens
TQISKTNTQTY

SEQ ID NO: 76342 - protein, 11 aa, Homo Sapiens
TQNQRSESNRF

SEQ ID NO: 76343 - protein, 11 aa, Homo Sapiens
TQRNGICEVLY

SEQ ID NO: 76344 - protein, 11 aa, Homo Sapiens
TQRRGNMVTTY

SEQ ID NO: 76345 - protein, 11 aa, Homo Sapiens
TVKDDLSFAGY

SEQ ID NO: 76346 - protein, 11 aa, Homo Sapiens
VGTHLAYAAAF

SEQ ID NO: 76347 - protein, 11 aa, Homo Sapiens
VIKDDVASEVY

SEQ ID NO: 76348 - protein, 11 aa, Homo Sapiens
VIKQEKLGTVY

SEQ ID NO: 76349 - protein, 11 aa, Homo Sapiens
VLQLPARNLTY

SEQ ID NO: 76350 - protein, 11 aa, Homo Sapiens
VLSAADKGNVK

SEQ ID NO: 76351 - protein, 11 aa, Homo Sapiens
VLYDQPRHVQY

SEQ ID NO: 76352 - protein, 11 aa, Homo Sapiens
VLYPHEPTAVF

SEQ ID NO: 76353 - protein, 11 aa, Homo Sapiens
VMMDPNSTQRY

SEQ ID NO: 76354 - protein, 11 aa, Homo Sapiens
VMYNSSDHDVY

SEQ ID NO: 76355 - protein, 11 aa, Homo Sapiens
VQADSKGTVSF

SEQ ID NO: 76356 - protein, 11 aa, Homo Sapiens
VQKAAPGSQRY

SEQ ID NO: 76357 - protein, 11 aa, Homo Sapiens
VQKDGVGMVEY

SEQ ID NO: 76358 - protein, 11 aa, Homo Sapiens
VQKKPAELQGF

SEQ ID NO: 76359 - protein, 11 aa, Homo Sapiens
VQKYQSPVRVY

SEQ ID NO: 76360 - protein, 11 aa, Homo Sapiens
VQPEAAGSVAM

SEQ ID NO: 76361 - protein, 11 aa, Homo Sapiens
VQRVASVMQEY

SEQ ID NO: 76362 - protein, 11 aa, Homo Sapiens
VQVAAQDLTDY

SEQ ID NO: 76363 - protein, 11 aa, Homo Sapiens
VQYQDPAAVSF

SEQ ID NO: 76364 - protein, 11 aa, Homo Sapiens
VSGSQRISSIY

SEQ ID NO: 76365 - protein, 11 aa, Homo Sapiens
VVYLQKLDTAY

SEQ ID NO: 76366 - protein, 11 aa, Homo Sapiens
YAGQRLPQHGY

SEQ ID NO: 76367 - protein, 11 aa, Homo Sapiens
YAKSSVGETVY

SEQ ID NO: 76368 - protein, 11 aa, Homo Sapiens
YIRPEGQDSAF

SEQ ID NO: 76369 - protein, 11 aa, Homo Sapiens
YLFEPHSGEDY

SEQ ID NO: 76370 - protein, 11 aa, Homo Sapiens
YLFEPHSGEEY

SEQ ID NO: 76371 - protein, 11 aa, Homo Sapiens
YQIDITTENQY

SEQ ID NO: 76372 - protein, 11 aa, Homo Sapiens
YQLKVVNPQEY

SEQ ID NO: 76373 - protein, 11 aa, Homo Sapiens
YQTDNKKAITY

SEQ ID NO: 76374 - protein, 11 aa, Homo Sapiens
YSFDSRHKPAF

SEQ ID NO: 76375 - protein, 11 aa, Homo Sapiens
YSLDGRLLSTY

SEQ ID NO: 76376 - protein, 11 aa, Homo Sapiens
YSVMINKATPY

SEQ ID NO: 76377 - protein, 11 aa, Homo Sapiens
YSVNGERLGTY

SEQ ID NO: 76378 - protein, 11 aa, Homo Sapiens
YVIDQGETDVY

SEQ ID NO: 76379 - protein, 8 aa, Homo Sapiens
ARAGETRF

SEQ ID NO: 76380 - protein, 8 aa, Homo Sapiens
AVYKVSEY

SEQ ID NO: 76381 - protein, 8 aa, Homo Sapiens
DAFAPVAY

SEQ ID NO: 76382 - protein, 8 aa, Homo Sapiens
DAFKASVY

SEQ ID NO: 76383 - protein, 8 aa, Homo Sapiens
DALVITHY

SEQ ID NO: 76384 - protein, 8 aa, Homo Sapiens
DAYAINSY

SEQ ID NO: 76385 - protein, 8 aa, Homo Sapiens
DFFQHVEM

SEQ ID NO: 76386 - protein, 8 aa, Homo Sapiens
DFLAALEY

SEQ ID NO: 76387 - protein, 8 aa, Homo Sapiens
DFLLSRQM

SEQ ID NO: 76388 - protein, 8 aa, Homo Sapiens
DGRTIVCY

SEQ ID NO: 76389 - protein, 8 aa, Homo Sapiens
DIAKHLTY

SEQ ID NO: 76390 - protein, 8 aa, Homo Sapiens
DIHRSIKY

SEQ ID NO: 76391 - protein, 8 aa, Homo Sapiens
DIMKIREY

SEQ ID NO: 76392 - protein, 8 aa, Homo Sapiens
DLLLVRQY

SEQ ID NO: 76393 - protein, 8 aa, Homo Sapiens
DLLQHSEY

SEQ ID NO: 76394 - protein, 8 aa, Homo Sapiens
DLLVHVEY

SEQ ID NO: 76395 - protein, 8 aa, Homo Sapiens
DLRKSPVF

SEQ ID NO: 76396 - protein, 8 aa, Homo Sapiens
DLRRDIAY

SEQ ID NO: 76397 - protein, 8 aa, Homo Sapiens
DLWPAKQY

SEQ ID NO: 76398 - protein, 8 aa, Homo Sapiens
DLYSAYDY

SEQ ID NO: 76399 - protein, 8 aa, Homo Sapiens
DMARVSTY

SEQ ID NO: 76400 - protein, 8 aa, Homo Sapiens
DMFKILTY

SEQ ID NO: 76401 - protein, 8 aa, Homo Sapiens
DMKKAITY

SEQ ID NO: 76402 - protein, 8 aa, Homo Sapiens
DPYQVHVC

SEQ ID NO: 76403 - protein, 8 aa, Homo Sapiens
DQKIHRPM

SEQ ID NO: 76404 - protein, 8 aa, Homo Sapiens
DQRVIYYY

SEQ ID NO: 76405 - protein, 8 aa, Homo Sapiens
DSYKVTHY

SEQ ID NO: 76406 - protein, 8 aa, Homo Sapiens
DTYKAITY

SEQ ID NO: 76407 - protein, 8 aa, Homo Sapiens
DVHQVACY

SEQ ID NO: 76408 - protein, 8 aa, Homo Sapiens
DVLKALQM

SEQ ID NO: 76409 - protein, 8 aa, Homo Sapiens
DVNKVVEY

SEQ ID NO: 76410 - protein, 8 aa, Homo Sapiens
DVPLVVEY

SEQ ID NO: 76411 - protein, 8 aa, Homo Sapiens
DVVAHEVY

SEQ ID NO: 76412 - protein, 8 aa, Homo Sapiens
EAFLVPAY

SEQ ID NO: 76413 - protein, 8 aa, Homo Sapiens
EFRKVVEY

SEQ ID NO: 76414 - protein, 8 aa, Homo Sapiens
EQHESIVM

SEQ ID NO: 76415 - protein, 8 aa, Homo Sapiens
ESYSIYVY

SEQ ID NO: 76416 - protein, 8 aa, Homo Sapiens
EVILHHEY

SEQ ID NO: 76417 - protein, 8 aa, Homo Sapiens
EVLISRVY

SEQ ID NO: 76418 - protein, 8 aa, Homo Sapiens
EVYQVTVY

SEQ ID NO: 76419 - protein, 8 aa, Homo Sapiens
FALVSQAY

SEQ ID NO: 76420 - protein, 8 aa, Homo Sapiens
FDRLVLQY

SEQ ID NO: 76421 - protein, 8 aa, Homo Sapiens
FLALGNSF

SEQ ID NO: 76422 - protein, 8 aa, Homo Sapiens
FLYLSAEY

SEQ ID NO: 76423 - protein, 8 aa, Homo Sapiens
FNEKSKEL

SEQ ID NO: 76424 - protein, 8 aa, Homo Sapiens
FPHTTPSM

SEQ ID NO: 76425 - protein, 8 aa, Homo Sapiens
FPLKALQY

SEQ ID NO: 76426 - protein, 8 aa, Homo Sapiens
FPLLATAY

SEQ ID NO: 76427 - protein, 8 aa, Homo Sapiens
FPMEIRQY

SEQ ID NO: 76428 - protein, 8 aa, Homo Sapiens
FPTISLEF

SEQ ID NO: 76429 - protein, 8 aa, Homo Sapiens
FPYLSESY

SEQ ID NO: 76430 - protein, 8 aa, Homo Sapiens
FQKVITEY

SEQ ID NO: 76431 - protein, 8 aa, Homo Sapiens
FQYLSKTY

SEQ ID NO: 76432 - protein, 8 aa, Homo Sapiens
HALLVNHY

SEQ ID NO: 76433 - protein, 8 aa, Homo Sapiens
HAVVVGVY

SEQ ID NO: 76434 - protein, 8 aa, Homo Sapiens
HFYQGLVY

SEQ ID NO: 76435 - protein, 8 aa, Homo Sapiens
HIGIPLTY

SEQ ID NO: 76436 - protein, 8 aa, Homo Sapiens
HQREIQVM

SEQ ID NO: 76437 - protein, 8 aa, Homo Sapiens
HQYHIRAY

SEQ ID NO: 76438 - protein, 8 aa, Homo Sapiens
HQYKVRAY

SEQ ID NO: 76439 - protein, 8 aa, Homo Sapiens
HVIIQAEF

SEQ ID NO: 76440 - protein, 8 aa, Homo Sapiens
IPREVVAY

SEQ ID NO: 76441 - protein, 8 aa, Homo Sapiens
IPRITIEM

SEQ ID NO: 76442 - protein, 8 aa, Homo Sapiens
IQRLITEM

SEQ ID NO: 76443 - protein, 8 aa, Homo Sapiens
LAYLVNTY

SEQ ID NO: 76444 - protein, 8 aa, Homo Sapiens
LEQQNQVL

SEQ ID NO: 76445 - protein, 8 aa, Homo Sapiens
LIKKDVNY

SEQ ID NO: 76446 - protein, 8 aa, Homo Sapiens
LPFTPLSY

SEQ ID NO: 76447 - protein, 8 aa, Homo Sapiens
LPLVSSTY

SEQ ID NO: 76448 - protein, 8 aa, Homo Sapiens
LPYESQVY

SEQ ID NO: 76449 - protein, 8 aa, Homo Sapiens
LPYQVNQM

SEQ ID NO: 76450 - protein, 8 aa, Homo Sapiens
LQQAKEDL

SEQ ID NO: 76451 - protein, 8 aa, Homo Sapiens
LQRLVNLY

SEQ ID NO: 76452 - protein, 8 aa, Homo Sapiens
LTTKQSSY

SEQ ID NO: 76453 - protein, 8 aa, Homo Sapiens
MAFQNDVY

SEQ ID NO: 76454 - protein, 8 aa, Homo Sapiens
MINKATPY

SEQ ID NO: 76455 - protein, 8 aa, Homo Sapiens
MPKVHIEF

SEQ ID NO: 76456 - protein, 8 aa, Homo Sapiens
MPTVHYEF

SEQ ID NO: 76457 - protein, 8 aa, Homo Sapiens
MQRLIEKY

SEQ ID NO: 76458 - protein, 8 aa, Homo Sapiens
NFLLSHEY

SEQ ID NO: 76459 - protein, 8 aa, Homo Sapiens
NLLRISVY

SEQ ID NO: 76460 - protein, 8 aa, Homo Sapiens
NVIKVSVY

SEQ ID NO: 76461 - protein, 8 aa, Homo Sapiens
PIYIITEY

SEQ ID NO: 76462 - protein, 8 aa, Homo Sapiens
QQIPDHPK

SEQ ID NO: 76463 - protein, 8 aa, Homo Sapiens
QQRVVRVY

SEQ ID NO: 76464 - protein, 8 aa, Homo Sapiens
QYEQILAF

SEQ ID NO: 76465 - protein, 8 aa, Homo Sapiens
SALPALVM

SEQ ID NO: 76466 - protein, 8 aa, Homo Sapiens
SDRTITEY

SEQ ID NO: 76467 - protein, 8 aa, Homo Sapiens
SDRVVVTY

SEQ ID NO: 76468 - protein, 8 aa, Homo Sapiens
SQRIFITY

SEQ ID NO: 76469 - protein, 8 aa, Homo Sapiens
SQYRIKEY

SEQ ID NO: 76470 - protein, 8 aa, Homo Sapiens
SVYKAFVM

SEQ ID NO: 76471 - protein, 8 aa, Homo Sapiens
TQRLVQVM

SEQ ID NO: 76472 - protein, 8 aa, Homo Sapiens
TQTLVREY

SEQ ID NO: 76473 - protein, 8 aa, Homo Sapiens
TVGNNKTL

SEQ ID NO: 76474 - protein, 8 aa, Homo Sapiens
TVIEHPEY

SEQ ID NO: 76475 - protein, 8 aa, Homo Sapiens
VAVAHAVY

SEQ ID NO: 76476 - protein, 8 aa, Homo Sapiens
VHFPMVVY

SEQ ID NO: 76477 - protein, 8 aa, Homo Sapiens
VPYRIFPY

SEQ ID NO: 76478 - protein, 8 aa, Homo Sapiens
YALQVHCY

SEQ ID NO: 76479 - protein, 8 aa, Homo Sapiens
YATVHQSY

SEQ ID NO: 76480 - protein, 8 aa, Homo Sapiens
YPVEIHEY

SEQ ID NO: 76481 - protein, 8 aa, Homo Sapiens
YPYAAISY

SEQ ID NO: 76482 - protein, 8 aa, Homo Sapiens
YPYTITEY

SEQ ID NO: 76483 - protein, 8 aa, Homo Sapiens
YQRLIASY

SEQ ID NO: 76484 - protein, 9 aa, Homo Sapiens
AAAPAGTTF

SEQ ID NO: 76485 - protein, 9 aa, Homo Sapiens
ACYSPHAAY

SEQ ID NO: 76486 - protein, 9 aa, Homo Sapiens
AFYEHAQTY

SEQ ID NO: 76487 - protein, 9 aa, Homo Sapiens
AIRQQIESY

SEQ ID NO: 76488 - protein, 9 aa, Homo Sapiens
AIYGGSASY

SEQ ID NO: 76489 - protein, 9 aa, Homo Sapiens
ALAADHTVY

SEQ ID NO: 76490 - protein, 9 aa, Homo Sapiens
ALAPAGFSY

SEQ ID NO: 76491 - protein, 9 aa, Homo Sapiens
ALCDIKQAY

SEQ ID NO: 76492 - protein, 9 aa, Homo Sapiens
ALQEASEAY

SEQ ID NO: 76493 - protein, 9 aa, Homo Sapiens
ALVKAGKVY

SEQ ID NO: 76494 - protein, 9 aa, Homo Sapiens
ALWIGTTSF

SEQ ID NO: 76495 - protein, 9 aa, Homo Sapiens
ALWKQFQSF

SEQ ID NO: 76496 - protein, 9 aa, Homo Sapiens
ALYPQTTCF

SEQ ID NO: 76497 - protein, 9 aa, Homo Sapiens
AMNPTNTVF

SEQ ID NO: 76498 - protein, 9 aa, Homo Sapiens
APAPPASQY

SEQ ID NO: 76499 - protein, 9 aa, Homo Sapiens
APYQFLTAF

SEQ ID NO: 76500 - protein, 9 aa, Homo Sapiens
AQHLFLQAF

SEQ ID NO: 76501 - protein, 9 aa, Homo Sapiens
ARAGETRFT

SEQ ID NO: 76502 - protein, 9 aa, Homo Sapiens
ATAQPPAPL

SEQ ID NO: 76503 - protein, 9 aa, Homo Sapiens
AVAPFFKSY

SEQ ID NO: 76504 - protein, 9 aa, Homo Sapiens
AVHDITVAY

SEQ ID NO: 76505 - protein, 9 aa, Homo Sapiens
AVRDYEKVY

SEQ ID NO: 76506 - protein, 9 aa, Homo Sapiens
AVRPLELAY

SEQ ID NO: 76507 - protein, 9 aa, Homo Sapiens
AVRTTGNVY

SEQ ID NO: 76508 - protein, 9 aa, Homo Sapiens
AVSAVVHEY

SEQ ID NO: 76509 - protein, 9 aa, Homo Sapiens
CFYQHKEEY

SEQ ID NO: 76510 - protein, 9 aa, Homo Sapiens
CIHDVSSTY

SEQ ID NO: 76511 - protein, 9 aa, Homo Sapiens
CLADGALIY

SEQ ID NO: 76512 - protein, 9 aa, Homo Sapiens
CLARLFTAY

SEQ ID NO: 76513 - protein, 9 aa, Homo Sapiens
CLIEAVQVY

SEQ ID NO: 76514 - protein, 9 aa, Homo Sapiens
CLNSLIQVF

SEQ ID NO: 76515 - protein, 9 aa, Homo Sapiens
CQHDFQAPY

SEQ ID NO: 76516 - protein, 9 aa, Homo Sapiens
CQYFRALLY

SEQ ID NO: 76517 - protein, 9 aa, Homo Sapiens
CVAPTIHVY

SEQ ID NO: 76518 - protein, 9 aa, Homo Sapiens
CVAPTNPRF

SEQ ID NO: 76519 - protein, 9 aa, Homo Sapiens
DAFEFHEAF

SEQ ID NO: 76520 - protein, 9 aa, Homo Sapiens
DAGPPTHAF

SEQ ID NO: 76521 - protein, 9 aa, Homo Sapiens
DAWKLTTQY

SEQ ID NO: 76522 - protein, 9 aa, Homo Sapiens
DAYELKHAL

SEQ ID NO: 76523 - protein, 9 aa, Homo Sapiens
DAYPQRIKF

SEQ ID NO: 76524 - protein, 9 aa, Homo Sapiens
DAYTHLETF

SEQ ID NO: 76525 - protein, 9 aa, Homo Sapiens
DAYTLAKAY

SEQ ID NO: 76526 - protein, 9 aa, Homo Sapiens
DAYTSRLGY

SEQ ID NO: 76527 - protein, 9 aa, Homo Sapiens
DFESHITSY

SEQ ID NO: 76528 - protein, 9 aa, Homo Sapiens
DFFAQQTRF

SEQ ID NO: 76529 - protein, 9 aa, Homo Sapiens
DFFKERTSF

SEQ ID NO: 76530 - protein, 9 aa, Homo Sapiens
DFREQKHSY

SEQ ID NO: 76531 - protein, 9 aa, Homo Sapiens
DFYEQNSRY

SEQ ID NO: 76532 - protein, 9 aa, Homo Sapiens
DGHLFQVEY

SEQ ID NO: 76533 - protein, 9 aa, Homo Sapiens
DGRVFQVEY

SEQ ID NO: 76534 - protein, 9 aa, Homo Sapiens
DHALHTISY

SEQ ID NO: 76535 - protein, 9 aa, Homo Sapiens
DIADPFFAY

SEQ ID NO: 76536 - protein, 9 aa, Homo Sapiens
DIAPPLIAF

SEQ ID NO: 76537 - protein, 9 aa, Homo Sapiens
DIIKDQKAY

SEQ ID NO: 76538 - protein, 9 aa, Homo Sapiens
DIKKTGVVF

SEQ ID NO: 76539 - protein, 9 aa, Homo Sapiens
DILFVRTSY

SEQ ID NO: 76540 - protein, 9 aa, Homo Sapiens
DIREEAEKY

SEQ ID NO: 76541 - protein, 9 aa, Homo Sapiens
DIREEKASW

SEQ ID NO: 76542 - protein, 9 aa, Homo Sapiens
DIREEKTSW

SEQ ID NO: 76543 - protein, 9 aa, Homo Sapiens
DIRKELEKY

SEQ ID NO: 76544 - protein, 9 aa, Homo Sapiens
DIRQERTAW

SEQ ID NO: 76545 - protein, 9 aa, Homo Sapiens
DIYDHAVLF

SEQ ID NO: 76546 - protein, 9 aa, Homo Sapiens
DIYIQSAKY

SEQ ID NO: 76547 - protein, 9 aa, Homo Sapiens
DIYKILTSY

SEQ ID NO: 76548 - protein, 9 aa, Homo Sapiens
DIYRELYAF

SEQ ID NO: 76549 - protein, 9 aa, Homo Sapiens
DLANIRSEY

SEQ ID NO: 76550 - protein, 9 aa, Homo Sapiens
DLAVPHTSY

SEQ ID NO: 76551 - protein, 9 aa, Homo Sapiens
DLDSRVLYY

SEQ ID NO: 76552 - protein, 9 aa, Homo Sapiens
DLFEQKVVF

SEQ ID NO: 76553 - protein, 9 aa, Homo Sapiens
DLFGRDLSY

SEQ ID NO: 76554 - protein, 9 aa, Homo Sapiens
DLFKVVPEM

SEQ ID NO: 76555 - protein, 9 aa, Homo Sapiens
DLIGHIVEF

SEQ ID NO: 76556 - protein, 9 aa, Homo Sapiens
DLKETNISY

SEQ ID NO: 76557 - protein, 9 aa, Homo Sapiens
DLLGVGAEY

SEQ ID NO: 76558 - protein, 9 aa, Homo Sapiens
DLLPSFHPY

SEQ ID NO: 76559 - protein, 9 aa, Homo Sapiens
DLPKAHTAF

SEQ ID NO: 76560 - protein, 9 aa, Homo Sapiens
DLRFIDAVY

SEQ ID NO: 76561 - protein, 9 aa, Homo Sapiens
DLRHFDPEF

SEQ ID NO: 76562 - protein, 9 aa, Homo Sapiens
DLRKEDVAM

SEQ ID NO: 76563 - protein, 9 aa, Homo Sapiens
DLRKNYTAY

SEQ ID NO: 76564 - protein, 9 aa, Homo Sapiens
DLRPDEEVF

SEQ ID NO: 76565 - protein, 9 aa, Homo Sapiens
DLRQELLAF

SEQ ID NO: 76566 - protein, 9 aa, Homo Sapiens
DLRSEQPCF

SEQ ID NO: 76567 - protein, 9 aa, Homo Sapiens
DLRTKEVVF

SEQ ID NO: 76568 - protein, 9 aa, Homo Sapiens
DLWLEREVF

SEQ ID NO: 76569 - protein, 9 aa, Homo Sapiens
DLYAVINHY

SEQ ID NO: 76570 - protein, 9 aa, Homo Sapiens
DLYKGSVAL

SEQ ID NO: 76571 - protein, 9 aa, Homo Sapiens
DLYPHVVGF

SEQ ID NO: 76572 - protein, 9 aa, Homo Sapiens
DLYQVIHKM

SEQ ID NO: 76573 - protein, 9 aa, Homo Sapiens
DLYRIFSKY

SEQ ID NO: 76574 - protein, 9 aa, Homo Sapiens
DLYVLRYEY

SEQ ID NO: 76575 - protein, 9 aa, Homo Sapiens
DLYYGGEAF

SEQ ID NO: 76576 - protein, 9 aa, Homo Sapiens
DMAKVFVEY

SEQ ID NO: 76577 - protein, 9 aa, Homo Sapiens
DMFAHPYQY

SEQ ID NO: 76578 - protein, 9 aa, Homo Sapiens
DMFEILTRY

SEQ ID NO: 76579 - protein, 9 aa, Homo Sapiens
DMHIQITDF

SEQ ID NO: 76580 - protein, 9 aa, Homo Sapiens
DMKAFVENY

SEQ ID NO: 76581 - protein, 9 aa, Homo Sapiens
DMMGHGSDY

SEQ ID NO: 76582 - protein, 9 aa, Homo Sapiens
DMNRHLHEY

SEQ ID NO: 76583 - protein, 9 aa, Homo Sapiens
DPYEVGHSM

SEQ ID NO: 76584 - protein, 9 aa, Homo Sapiens
DQAFGLPRL

SEQ ID NO: 76585 - protein, 9 aa, Homo Sapiens
DQFLQLSQY

SEQ ID NO: 76586 - protein, 9 aa, Homo Sapiens
DQGPAHPPG

SEQ ID NO: 76587 - protein, 9 aa, Homo Sapiens
DQKVHNVSF

SEQ ID NO: 76588 - protein, 9 aa, Homo Sapiens
DQMAKVLQF

SEQ ID NO: 76589 - protein, 9 aa, Homo Sapiens
DQMISRIEY

SEQ ID NO: 76590 - protein, 9 aa, Homo Sapiens
DQMVYTVRY

SEQ ID NO: 76591 - protein, 9 aa, Homo Sapiens
DQQQFNTMY

SEQ ID NO: 76592 - protein, 9 aa, Homo Sapiens
DQRDYICEY

SEQ ID NO: 76593 - protein, 9 aa, Homo Sapiens
DQREGGQVY

SEQ ID NO: 76594 - protein, 9 aa, Homo Sapiens
DQVAIHEAM

SEQ ID NO: 76595 - protein, 9 aa, Homo Sapiens
DQVIHTSSF

SEQ ID NO: 76596 - protein, 9 aa, Homo Sapiens
DSYKPIVEY

SEQ ID NO: 76597 - protein, 9 aa, Homo Sapiens
DTYEITKSY

SEQ ID NO: 76598 - protein, 9 aa, Homo Sapiens
DVAPTHILY

SEQ ID NO: 76599 - protein, 9 aa, Homo Sapiens
DVFSVKTEM

SEQ ID NO: 76600 - protein, 9 aa, Homo Sapiens
DVIQAGKEY

SEQ ID NO: 76601 - protein, 9 aa, Homo Sapiens
DVKVERIEY

SEQ ID NO: 76602 - protein, 9 aa, Homo Sapiens
DVRSQVTHY

SEQ ID NO: 76603 - protein, 9 aa, Homo Sapiens
DVSPVVSTY

SEQ ID NO: 76604 - protein, 9 aa, Homo Sapiens
DVYALKKPY

SEQ ID NO: 76605 - protein, 9 aa, Homo Sapiens
DVYGGTNRY

SEQ ID NO: 76606 - protein, 9 aa, Homo Sapiens
DVYLLHESY

SEQ ID NO: 76607 - protein, 9 aa, Homo Sapiens
DVYNHFLLY

SEQ ID NO: 76608 - protein, 9 aa, Homo Sapiens
EAAKPSPAM

SEQ ID NO: 76609 - protein, 9 aa, Homo Sapiens
EAAPPGELY

SEQ ID NO: 76610 - protein, 9 aa, Homo Sapiens
EAIIPGSVY

SEQ ID NO: 76611 - protein, 9 aa, Homo Sapiens
EAWRLLSTY

SEQ ID NO: 76612 - protein, 9 aa, Homo Sapiens
EAYHSVIKY

SEQ ID NO: 76613 - protein, 9 aa, Homo Sapiens
EAYNAVVRY

SEQ ID NO: 76614 - protein, 9 aa, Homo Sapiens
EAYVHVNQY

SEQ ID NO: 76615 - protein, 9 aa, Homo Sapiens
EFFRVVSEY

SEQ ID NO: 76616 - protein, 9 aa, Homo Sapiens
EIASSGTSY

SEQ ID NO: 76617 - protein, 9 aa, Homo Sapiens
EIFQHLMAY

SEQ ID NO: 76618 - protein, 9 aa, Homo Sapiens
EIREAANAM

SEQ ID NO: 76619 - protein, 9 aa, Homo Sapiens
EIREELEQY

SEQ ID NO: 76620 - protein, 9 aa, Homo Sapiens
EIRKDISAM

SEQ ID NO: 76621 - protein, 9 aa, Homo Sapiens
EIYPQSHSY

SEQ ID NO: 76622 - protein, 9 aa, Homo Sapiens
ELADIKQAY

SEQ ID NO: 76623 - protein, 9 aa, Homo Sapiens
ELAKQITSY

SEQ ID NO: 76624 - protein, 9 aa, Homo Sapiens
ELAKQVIEY

SEQ ID NO: 76625 - protein, 9 aa, Homo Sapiens
ELAPKFLAM

SEQ ID NO: 76626 - protein, 9 aa, Homo Sapiens
ELAPNFQVF

SEQ ID NO: 76627 - protein, 9 aa, Homo Sapiens
ELAPSLPSY

SEQ ID NO: 76628 - protein, 9 aa, Homo Sapiens
ELASWGHEY

SEQ ID NO: 76629 - protein, 9 aa, Homo Sapiens
ELDPESREY

SEQ ID NO: 76630 - protein, 9 aa, Homo Sapiens
ELESTNRRY

SEQ ID NO: 76631 - protein, 9 aa, Homo Sapiens
ELFDTVQVY

SEQ ID NO: 76632 - protein, 9 aa, Homo Sapiens
ELFKEARKY

SEQ ID NO: 76633 - protein, 9 aa, Homo Sapiens
ELFSSRSKY

SEQ ID NO: 76634 - protein, 9 aa, Homo Sapiens
ELIPLVTTY

SEQ ID NO: 76635 - protein, 9 aa, Homo Sapiens
ELKAPGISY

SEQ ID NO: 76636 - protein, 9 aa, Homo Sapiens
ELNPKILAL

SEQ ID NO: 76637 - protein, 9 aa, Homo Sapiens
ELRAKFEEY

SEQ ID NO: 76638 - protein, 9 aa, Homo Sapiens
ELREGFVEY

SEQ ID NO: 76639 - protein, 9 aa, Homo Sapiens
ELREQTVHY

SEQ ID NO: 76640 - protein, 9 aa, Homo Sapiens
ELRNASAVM

SEQ ID NO: 76641 - protein, 9 aa, Homo Sapiens
ELRTECNHY

SEQ ID NO: 76642 - protein, 9 aa, Homo Sapiens
ELSSVKLEY

SEQ ID NO: 76643 - protein, 9 aa, Homo Sapiens
ELVKLQQTY

SEQ ID NO: 76644 - protein, 9 aa, Homo Sapiens
ELVKSHSSY

SEQ ID NO: 76645 - protein, 9 aa, Homo Sapiens
ELVPESQAY

SEQ ID NO: 76646 - protein, 9 aa, Homo Sapiens
ELWKNPTAF

SEQ ID NO: 76647 - protein, 9 aa, Homo Sapiens
ELYHQSVVY

SEQ ID NO: 76648 - protein, 9 aa, Homo Sapiens
ELYNTIRDY

SEQ ID NO: 76649 - protein, 9 aa, Homo Sapiens
ELYQRIYAF

SEQ ID NO: 76650 - protein, 9 aa, Homo Sapiens
ELYRATREF

SEQ ID NO: 76651 - protein, 9 aa, Homo Sapiens
ELYRVTREY

SEQ ID NO: 76652 - protein, 9 aa, Homo Sapiens
EMARHLREY

SEQ ID NO: 76653 - protein, 9 aa, Homo Sapiens
EMIAQQREY

SEQ ID NO: 76654 - protein, 9 aa, Homo Sapiens
EMMKVVQVY

SEQ ID NO: 76655 - protein, 9 aa, Homo Sapiens
EMRKIVAEY

SEQ ID NO: 76656 - protein, 9 aa, Homo Sapiens
EMVDKTPVM

SEQ ID NO: 76657 - protein, 9 aa, Homo Sapiens
EPRKGEPAY

SEQ ID NO: 76658 - protein, 9 aa, Homo Sapiens
EQAPPVIYY

SEQ ID NO: 76659 - protein, 9 aa, Homo Sapiens
EQILATAVY

SEQ ID NO: 76660 - protein, 9 aa, Homo Sapiens
EQLTPGVVY

SEQ ID NO: 76661 - protein, 9 aa, Homo Sapiens
EQRAHVQEF

SEQ ID NO: 76662 - protein, 9 aa, Homo Sapiens
EQRFPVATM

SEQ ID NO: 76663 - protein, 9 aa, Homo Sapiens
EQVPQQPTY

SEQ ID NO: 76664 - protein, 9 aa, Homo Sapiens
EQWKSHRSY

SEQ ID NO: 76665 - protein, 9 aa, Homo Sapiens
EQYDAFVKF

SEQ ID NO: 76666 - protein, 9 aa, Homo Sapiens
EQYEQILAF

SEQ ID NO: 76667 - protein, 9 aa, Homo Sapiens
EQYESFVKF

SEQ ID NO: 76668 - protein, 9 aa, Homo Sapiens
EQYQKTEAY

SEQ ID NO: 76669 - protein, 9 aa, Homo Sapiens
EQYTPKAKY

SEQ ID NO: 76670 - protein, 9 aa, Homo Sapiens
ESAPVHNSF

SEQ ID NO: 76671 - protein, 9 aa, Homo Sapiens
ESRQITQVY

SEQ ID NO: 76672 - protein, 9 aa, Homo Sapiens
ESYENKEAY

SEQ ID NO: 76673 - protein, 9 aa, Homo Sapiens
EVAPAGASY

SEQ ID NO: 76674 - protein, 9 aa, Homo Sapiens
EVAPALSVF

SEQ ID NO: 76675 - protein, 9 aa, Homo Sapiens
EVAPPRLVM

SEQ ID NO: 76676 - protein, 9 aa, Homo Sapiens
EVFKERIGY

SEQ ID NO: 76677 - protein, 9 aa, Homo Sapiens
EVGPAGSQF

SEQ ID NO: 76678 - protein, 9 aa, Homo Sapiens
EVIKSQEVF

SEQ ID NO: 76679 - protein, 9 aa, Homo Sapiens
EVIPPMKEF

SEQ ID NO: 76680 - protein, 9 aa, Homo Sapiens
EVIPTHTVY

SEQ ID NO: 76681 - protein, 9 aa, Homo Sapiens
EVIPYTPAM

SEQ ID NO: 76682 - protein, 9 aa, Homo Sapiens
EVLGLILRY

SEQ ID NO: 76683 - protein, 9 aa, Homo Sapiens
EVLIHGVSY

SEQ ID NO: 76684 - protein, 9 aa, Homo Sapiens
EVLPINTQY

SEQ ID NO: 76685 - protein, 9 aa, Homo Sapiens
EVLPPIHAY

SEQ ID NO: 76686 - protein, 9 aa, Homo Sapiens
EVMPAQWEF

SEQ ID NO: 76687 - protein, 9 aa, Homo Sapiens
EVNPNTRVM

SEQ ID NO: 76688 - protein, 9 aa, Homo Sapiens
EVRKEEQRY

SEQ ID NO: 76689 - protein, 9 aa, Homo Sapiens
EVSKNLVAM

SEQ ID NO: 76690 - protein, 9 aa, Homo Sapiens
EVYAGSHQY

SEQ ID NO: 76691 - protein, 9 aa, Homo Sapiens
EVYHKSMTL

SEQ ID NO: 76692 - protein, 9 aa, Homo Sapiens
EVYVPHTVY

SEQ ID NO: 76693 - protein, 9 aa, Homo Sapiens
FAFEHSEEY

SEQ ID NO: 76694 - protein, 9 aa, Homo Sapiens
FIAPTGHSL

SEQ ID NO: 76695 - protein, 9 aa, Homo Sapiens
FIDASRLVY

SEQ ID NO: 76696 - protein, 9 aa, Homo Sapiens
FIGEFTTSY

SEQ ID NO: 76697 - protein, 9 aa, Homo Sapiens
FIGKPDMAY

SEQ ID NO: 76698 - protein, 9 aa, Homo Sapiens
FIKDGSSTY

SEQ ID NO: 76699 - protein, 9 aa, Homo Sapiens
FIMGKTIEF

SEQ ID NO: 76700 - protein, 9 aa, Homo Sapiens
FINPKPITY

SEQ ID NO: 76701 - protein, 9 aa, Homo Sapiens
FINQNLRTY

SEQ ID NO: 76702 - protein, 9 aa, Homo Sapiens
FIRGSVVRY

SEQ ID NO: 76703 - protein, 9 aa, Homo Sapiens
FIRPVDPEY

SEQ ID NO: 76704 - protein, 9 aa, Homo Sapiens
FIRVVGSEF

SEQ ID NO: 76705 - protein, 9 aa, Homo Sapiens
FIVDARPAM

SEQ ID NO: 76706 - protein, 9 aa, Homo Sapiens
FIYDSVKVY

SEQ ID NO: 76707 - protein, 9 aa, Homo Sapiens
FIYQNPHIF

SEQ ID NO: 76708 - protein, 9 aa, Homo Sapiens
FLADPVSNM

SEQ ID NO: 76709 - protein, 9 aa, Homo Sapiens
FLAPLVTEY

SEQ ID NO: 76710 - protein, 9 aa, Homo Sapiens
FLAQHGSEY

SEQ ID NO: 76711 - protein, 9 aa, Homo Sapiens
FLCESVFSY

SEQ ID NO: 76712 - protein, 9 aa, Homo Sapiens
FLCGVMKTY

SEQ ID NO: 76713 - protein, 9 aa, Homo Sapiens
FLDPRQPSY

SEQ ID NO: 76714 - protein, 9 aa, Homo Sapiens
FLEETNRLY

SEQ ID NO: 76715 - protein, 9 aa, Homo Sapiens
FLFDGSPTY

SEQ ID NO: 76716 - protein, 9 aa, Homo Sapiens
FLGPLHPSF

SEQ ID NO: 76717 - protein, 9 aa, Homo Sapiens
FLHEHKIVY

SEQ ID NO: 76718 - protein, 9 aa, Homo Sapiens
FLHESLVEY

SEQ ID NO: 76719 - protein, 9 aa, Homo Sapiens
FLIDLKTRY

SEQ ID NO: 76720 - protein, 9 aa, Homo Sapiens
FLIDRSPEY

SEQ ID NO: 76721 - protein, 9 aa, Homo Sapiens
FLKPGEKTY

SEQ ID NO: 76722 - protein, 9 aa, Homo Sapiens
FLLESGAAY

SEQ ID NO: 76723 - protein, 9 aa, Homo Sapiens
FLLNHSLEY

SEQ ID NO: 76724 - protein, 9 aa, Homo Sapiens
FLLPVINEM

SEQ ID NO: 76725 - protein, 9 aa, Homo Sapiens
FLNDSYLKY

SEQ ID NO: 76726 - protein, 9 aa, Homo Sapiens
FLNKASAVY

SEQ ID NO: 76727 - protein, 9 aa, Homo Sapiens
FLNPLISKY

SEQ ID NO: 76728 - protein, 9 aa, Homo Sapiens
FLQESNVLY

SEQ ID NO: 76729 - protein, 9 aa, Homo Sapiens
FLRTREPAL

SEQ ID NO: 76730 - protein, 9 aa, Homo Sapiens
FLRVDDESM

SEQ ID NO: 76731 - protein, 9 aa, Homo Sapiens
FLTEVTDVY

SEQ ID NO: 76732 - protein, 9 aa, Homo Sapiens
FLWCEVEKY

SEQ ID NO: 76733 - protein, 9 aa, Homo Sapiens
FLYDKALTF

SEQ ID NO: 76734 - protein, 9 aa, Homo Sapiens
FLYPFPLAL

SEQ ID NO: 76735 - protein, 9 aa, Homo Sapiens
FLYTGGIGF

SEQ ID NO: 76736 - protein, 9 aa, Homo Sapiens
FPALPGSSY

SEQ ID NO: 76737 - protein, 9 aa, Homo Sapiens
FPHKFEISF

SEQ ID NO: 76738 - protein, 9 aa, Homo Sapiens
FPHPHIHEY

SEQ ID NO: 76739 - protein, 9 aa, Homo Sapiens
FPHSAHQKY

SEQ ID NO: 76740 - protein, 9 aa, Homo Sapiens
FPSLQRLVY

SEQ ID NO: 76741 - protein, 9 aa, Homo Sapiens
FPVEIKSFY

SEQ ID NO: 76742 - protein, 9 aa, Homo Sapiens
FPYEEHLEM

SEQ ID NO: 76743 - protein, 9 aa, Homo Sapiens
FPYGTTVTY

SEQ ID NO: 76744 - protein, 9 aa, Homo Sapiens
FPYPFQVVY

SEQ ID NO: 76745 - protein, 9 aa, Homo Sapiens
FQAPTAKEM

SEQ ID NO: 76746 - protein, 9 aa, Homo Sapiens
FQFIMKQSY

SEQ ID NO: 76747 - protein, 9 aa, Homo Sapiens
FQMGPTQAY

SEQ ID NO: 76748 - protein, 9 aa, Homo Sapiens
FQTHTTPVL

SEQ ID NO: 76749 - protein, 9 aa, Homo Sapiens
FQYESKVFY

SEQ ID NO: 76750 - protein, 9 aa, Homo Sapiens
FQYSKSPSL

SEQ ID NO: 76751 - protein, 9 aa, Homo Sapiens
FVAEERVSF

SEQ ID NO: 76752 - protein, 9 aa, Homo Sapiens
FVAEQKVEY

SEQ ID NO: 76753 - protein, 9 aa, Homo Sapiens
FVAPATGAH

SEQ ID NO: 76754 - protein, 9 aa, Homo Sapiens
FVAPEIVNY

SEQ ID NO: 76755 - protein, 9 aa, Homo Sapiens
FVEVGRVAY

SEQ ID NO: 76756 - protein, 9 aa, Homo Sapiens
FVKDSGACF

SEQ ID NO: 76757 - protein, 9 aa, Homo Sapiens
FVLKEGVEY

SEQ ID NO: 76758 - protein, 9 aa, Homo Sapiens
FVNPGVVEF

SEQ ID NO: 76759 - protein, 9 aa, Homo Sapiens
FVNPHVSSF

SEQ ID NO: 76760 - protein, 9 aa, Homo Sapiens
FVRDDGSSM

SEQ ID NO: 76761 - protein, 9 aa, Homo Sapiens
FVYITDNAY

SEQ ID NO: 76762 - protein, 9 aa, Homo Sapiens
FVYKEEHPF

SEQ ID NO: 76763 - protein, 9 aa, Homo Sapiens
FVYKGGKIY

SEQ ID NO: 76764 - protein, 9 aa, Homo Sapiens
GLAAASVVM

SEQ ID NO: 76765 - protein, 9 aa, Homo Sapiens
GLASPHSQY

SEQ ID NO: 76766 - protein, 9 aa, Homo Sapiens
GLFQHQTTY

SEQ ID NO: 76767 - protein, 9 aa, Homo Sapiens
GLGPPATVM

SEQ ID NO: 76768 - protein, 9 aa, Homo Sapiens
GLNKVSPVY

SEQ ID NO: 76769 - protein, 9 aa, Homo Sapiens
GLSKPVSSY

SEQ ID NO: 76770 - protein, 9 aa, Homo Sapiens
GMYGKIAVM

SEQ ID NO: 76771 - protein, 9 aa, Homo Sapiens
GQRPTQPVY

SEQ ID NO: 76772 - protein, 9 aa, Homo Sapiens
GVAPESFEY

SEQ ID NO: 76773 - protein, 9 aa, Homo Sapiens
HAADVFEAY

SEQ ID NO: 76774 - protein, 9 aa, Homo Sapiens
HAALHLMAF

SEQ ID NO: 76775 - protein, 9 aa, Homo Sapiens
HAGPPHNEY

SEQ ID NO: 76776 - protein, 9 aa, Homo Sapiens
HAIMRSPQM

SEQ ID NO: 76777 - protein, 9 aa, Homo Sapiens
HAIPPTLAM

SEQ ID NO: 76778 - protein, 9 aa, Homo Sapiens
HAVGPSTAM

SEQ ID NO: 76779 - protein, 9 aa, Homo Sapiens
HAYIHSVQF

SEQ ID NO: 76780 - protein, 9 aa, Homo Sapiens
HCLEHLVQY

SEQ ID NO: 76781 - protein, 9 aa, Homo Sapiens
HFIRPGNAL

SEQ ID NO: 76782 - protein, 9 aa, Homo Sapiens
HGIDPTGTY

SEQ ID NO: 76783 - protein, 9 aa, Homo Sapiens
HIAENILSY

SEQ ID NO: 76784 - protein, 9 aa, Homo Sapiens
HIAIPQEAY

SEQ ID NO: 76785 - protein, 9 aa, Homo Sapiens
HIASFLSVF

SEQ ID NO: 76786 - protein, 9 aa, Homo Sapiens
HICAVVVEY

SEQ ID NO: 76787 - protein, 9 aa, Homo Sapiens
HIITGVAVF

SEQ ID NO: 76788 - protein, 9 aa, Homo Sapiens
HIKNPDWRY

SEQ ID NO: 76789 - protein, 9 aa, Homo Sapiens
HIKTETVTY

SEQ ID NO: 76790 - protein, 9 aa, Homo Sapiens
HIMEIFSTY

SEQ ID NO: 76791 - protein, 9 aa, Homo Sapiens
HIMPPQQHY

SEQ ID NO: 76792 - protein, 9 aa, Homo Sapiens
HINSIKSVF

SEQ ID NO: 76793 - protein, 9 aa, Homo Sapiens
HIRENSYSY

SEQ ID NO: 76794 - protein, 9 aa, Homo Sapiens
HIRFDEISF

SEQ ID NO: 76795 - protein, 9 aa, Homo Sapiens
HIRQELAVF

SEQ ID NO: 76796 - protein, 9 aa, Homo Sapiens
HISPVTSTY

SEQ ID NO: 76797 - protein, 9 aa, Homo Sapiens
HIYDMSTVM

SEQ ID NO: 76798 - protein, 9 aa, Homo Sapiens
HLAAHIEEY

SEQ ID NO: 76799 - protein, 9 aa, Homo Sapiens
HLAFFHQGY

SEQ ID NO: 76800 - protein, 9 aa, Homo Sapiens
HLAGTHTSL

SEQ ID NO: 76801 - protein, 9 aa, Homo Sapiens
HLANEMETY

SEQ ID NO: 76802 - protein, 9 aa, Homo Sapiens
HLAPPPLKY

SEQ ID NO: 76803 - protein, 9 aa, Homo Sapiens
HLEGKPRIL

SEQ ID NO: 76804 - protein, 9 aa, Homo Sapiens
HLFDIITQY

SEQ ID NO: 76805 - protein, 9 aa, Homo Sapiens
HLFSPGTSF

SEQ ID NO: 76806 - protein, 9 aa, Homo Sapiens
HLGDFHRTY

SEQ ID NO: 76807 - protein, 9 aa, Homo Sapiens
HLGEFVNVF

SEQ ID NO: 76808 - protein, 9 aa, Homo Sapiens
HLGVFPSYY

SEQ ID NO: 76809 - protein, 9 aa, Homo Sapiens
HLHASTTVL

SEQ ID NO: 76810 - protein, 9 aa, Homo Sapiens
HLHHGKTCF

SEQ ID NO: 76811 - protein, 9 aa, Homo Sapiens
HLHHPSVAY

SEQ ID NO: 76812 - protein, 9 aa, Homo Sapiens
HLHMETSDF

SEQ ID NO: 76813 - protein, 9 aa, Homo Sapiens
HLIERSQVF

SEQ ID NO: 76814 - protein, 9 aa, Homo Sapiens
HLIPAGSQL

SEQ ID NO: 76815 - protein, 9 aa, Homo Sapiens
HLKEDQTEY

SEQ ID NO: 76816 - protein, 9 aa, Homo Sapiens
HLKFEINAY

SEQ ID NO: 76817 - protein, 9 aa, Homo Sapiens
HLKKHGLTY

SEQ ID NO: 76818 - protein, 9 aa, Homo Sapiens
HLLEKSNIY

SEQ ID NO: 76819 - protein, 9 aa, Homo Sapiens
HLLLKSLTY

SEQ ID NO: 76820 - protein, 9 aa, Homo Sapiens
HLLPEEQVY

SEQ ID NO: 76821 - protein, 9 aa, Homo Sapiens
HLLPIQSTY

SEQ ID NO: 76822 - protein, 9 aa, Homo Sapiens
HLNPGLQLY

SEQ ID NO: 76823 - protein, 9 aa, Homo Sapiens
HLNYEHRVF

SEQ ID NO: 76824 - protein, 9 aa, Homo Sapiens
HLPPPSVAY

SEQ ID NO: 76825 - protein, 9 aa, Homo Sapiens
HLQFPGAVY

SEQ ID NO: 76826 - protein, 9 aa, Homo Sapiens
HLRDPELAL

SEQ ID NO: 76827 - protein, 9 aa, Homo Sapiens
HLRDYFEEY

SEQ ID NO: 76828 - protein, 9 aa, Homo Sapiens
HLRDYFEQY

SEQ ID NO: 76829 - protein, 9 aa, Homo Sapiens
HLRETQAQY

SEQ ID NO: 76830 - protein, 9 aa, Homo Sapiens
HLRGNEVLY

SEQ ID NO: 76831 - protein, 9 aa, Homo Sapiens
HLRNPSAAF

SEQ ID NO: 76832 - protein, 9 aa, Homo Sapiens
HLRPESHSY

SEQ ID NO: 76833 - protein, 9 aa, Homo Sapiens
HLRPRPRAY

SEQ ID NO: 76834 - protein, 9 aa, Homo Sapiens
HLSDSKNVF

SEQ ID NO: 76835 - protein, 9 aa, Homo Sapiens
HLSNDHICY

SEQ ID NO: 76836 - protein, 9 aa, Homo Sapiens
HLSSAHLAF

SEQ ID NO: 76837 - protein, 9 aa, Homo Sapiens
HLTVDARVY

SEQ ID NO: 76838 - protein, 9 aa, Homo Sapiens
HLTVHNIAY

SEQ ID NO: 76839 - protein, 9 aa, Homo Sapiens
HLVAVFNEY

SEQ ID NO: 76840 - protein, 9 aa, Homo Sapiens
HLVKLGKAY

SEQ ID NO: 76841 - protein, 9 aa, Homo Sapiens
HLVSPLTTY

SEQ ID NO: 76842 - protein, 9 aa, Homo Sapiens
HLWDWRTGY

SEQ ID NO: 76843 - protein, 9 aa, Homo Sapiens
HLYARQLTL

SEQ ID NO: 76844 - protein, 9 aa, Homo Sapiens
HLYEGDNLY

SEQ ID NO: 76845 - protein, 9 aa, Homo Sapiens
HLYETQRKY

SEQ ID NO: 76846 - protein, 9 aa, Homo Sapiens
HLYGSLLYY

SEQ ID NO: 76847 - protein, 9 aa, Homo Sapiens
HLYQNTRSY

SEQ ID NO: 76848 - protein, 9 aa, Homo Sapiens
HLYSTHAAL

SEQ ID NO: 76849 - protein, 9 aa, Homo Sapiens
HMFEAHSDY

SEQ ID NO: 76850 - protein, 9 aa, Homo Sapiens
HMHNRFVVY

SEQ ID NO: 76851 - protein, 9 aa, Homo Sapiens
HPAPPPSNY

SEQ ID NO: 76852 - protein, 9 aa, Homo Sapiens
HPILNDPIY

SEQ ID NO: 76853 - protein, 9 aa, Homo Sapiens
HPIQTQAQY

SEQ ID NO: 76854 - protein, 9 aa, Homo Sapiens
HPLTPGSHY

SEQ ID NO: 76855 - protein, 9 aa, Homo Sapiens
HPTSVISGY

SEQ ID NO: 76856 - protein, 9 aa, Homo Sapiens
HPTVVISAY

SEQ ID NO: 76857 - protein, 9 aa, Homo Sapiens
HPWGSSSSF

SEQ ID NO: 76858 - protein, 9 aa, Homo Sapiens
HQAIHTIEF

SEQ ID NO: 76859 - protein, 9 aa, Homo Sapiens
HQAIHTIEY

SEQ ID NO: 76860 - protein, 9 aa, Homo Sapiens
HQASHQPLY

SEQ ID NO: 76861 - protein, 9 aa, Homo Sapiens
HQHLSKESM

SEQ ID NO: 76862 - protein, 9 aa, Homo Sapiens
HQITVLHVY

SEQ ID NO: 76863 - protein, 9 aa, Homo Sapiens
HQMTPSSSY

SEQ ID NO: 76864 - protein, 9 aa, Homo Sapiens
HQQPPSQQY

SEQ ID NO: 76865 - protein, 9 aa, Homo Sapiens
HQYFSYNQM

SEQ ID NO: 76866 - protein, 9 aa, Homo Sapiens
HQYSIQVAF

SEQ ID NO: 76867 - protein, 9 aa, Homo Sapiens
HSAPGGPSY

SEQ ID NO: 76868 - protein, 9 aa, Homo Sapiens
HSIPSGHVY

SEQ ID NO: 76869 - protein, 9 aa, Homo Sapiens
HVANTLSVY

SEQ ID NO: 76870 - protein, 9 aa, Homo Sapiens
HVAPQQNAL

SEQ ID NO: 76871 - protein, 9 aa, Homo Sapiens
HVAPVAGQL

SEQ ID NO: 76872 - protein, 9 aa, Homo Sapiens
HVAQPDSVY

SEQ ID NO: 76873 - protein, 9 aa, Homo Sapiens
HVASVTDSF

SEQ ID NO: 76874 - protein, 9 aa, Homo Sapiens
HVCDEVNVY

SEQ ID NO: 76875 - protein, 9 aa, Homo Sapiens
HVFIGGTPL

SEQ ID NO: 76876 - protein, 9 aa, Homo Sapiens
HVGLPSVSY

SEQ ID NO: 76877 - protein, 9 aa, Homo Sapiens
HVGPFIDSY

SEQ ID NO: 76878 - protein, 9 aa, Homo Sapiens
HVGPGVLSM

SEQ ID NO: 76879 - protein, 9 aa, Homo Sapiens
HVGQAGVQM

SEQ ID NO: 76880 - protein, 9 aa, Homo Sapiens
HVHHLINEY

SEQ ID NO: 76881 - protein, 9 aa, Homo Sapiens
HVIANSGQF

SEQ ID NO: 76882 - protein, 9 aa, Homo Sapiens
HVIDVKFLY

SEQ ID NO: 76883 - protein, 9 aa, Homo Sapiens
HVIENSNAF

SEQ ID NO: 76884 - protein, 9 aa, Homo Sapiens
HVINTGNSM

SEQ ID NO: 76885 - protein, 9 aa, Homo Sapiens
HVMEHICKL

SEQ ID NO: 76886 - protein, 9 aa, Homo Sapiens
HVNGIVQKY

SEQ ID NO: 76887 - protein, 9 aa, Homo Sapiens
HVRDCVQTY

SEQ ID NO: 76888 - protein, 9 aa, Homo Sapiens
HVSGESSVF

SEQ ID NO: 76889 - protein, 9 aa, Homo Sapiens
HVSPDFKTY

SEQ ID NO: 76890 - protein, 9 aa, Homo Sapiens
HVSTVNPNY

SEQ ID NO: 76891 - protein, 9 aa, Homo Sapiens
HVTSNHVSY

SEQ ID NO: 76892 - protein, 9 aa, Homo Sapiens
HVVAASKAM

SEQ ID NO: 76893 - protein, 9 aa, Homo Sapiens
HVVAGTAGY

SEQ ID NO: 76894 - protein, 9 aa, Homo Sapiens
HVYEIPVEY

SEQ ID NO: 76895 - protein, 9 aa, Homo Sapiens
HVYHHASML

SEQ ID NO: 76896 - protein, 9 aa, Homo Sapiens
HVYPAQVQY

SEQ ID NO: 76897 - protein, 9 aa, Homo Sapiens
ICHVVGITY

SEQ ID NO: 76898 - protein, 9 aa, Homo Sapiens
IIHEGSSVY

SEQ ID NO: 76899 - protein, 9 aa, Homo Sapiens
IIREKDTEY

SEQ ID NO: 76900 - protein, 9 aa, Homo Sapiens
IIRENEFSF

SEQ ID NO: 76901 - protein, 9 aa, Homo Sapiens
IIRTGEKPY

SEQ ID NO: 76902 - protein, 9 aa, Homo Sapiens
ILAAANPAY

SEQ ID NO: 76903 - protein, 9 aa, Homo Sapiens
ILAARSPVF

SEQ ID NO: 76904 - protein, 9 aa, Homo Sapiens
ILGPPGSVY

SEQ ID NO: 76905 - protein, 9 aa, Homo Sapiens
ILHANVVVY

SEQ ID NO: 76906 - protein, 9 aa, Homo Sapiens
ILIACGTSY

SEQ ID NO: 76907 - protein, 9 aa, Homo Sapiens
ILINSGSRY

SEQ ID NO: 76908 - protein, 9 aa, Homo Sapiens
ILKPDGSLY

SEQ ID NO: 76909 - protein, 9 aa, Homo Sapiens
ILMDPSPEY

SEQ ID NO: 76910 - protein, 9 aa, Homo Sapiens
ILNPHGIPL

SEQ ID NO: 76911 - protein, 9 aa, Homo Sapiens
ILRDKEPKM

SEQ ID NO: 76912 - protein, 9 aa, Homo Sapiens
ILRETTVKY

SEQ ID NO: 76913 - protein, 9 aa, Homo Sapiens
ILRLGGIAY

SEQ ID NO: 76914 - protein, 9 aa, Homo Sapiens
ILRPEELGF

SEQ ID NO: 76915 - protein, 9 aa, Homo Sapiens
ILRPGGCLF

SEQ ID NO: 76916 - protein, 9 aa, Homo Sapiens
ILRTDNISF

SEQ ID NO: 76917 - protein, 9 aa, Homo Sapiens
ILTVGGTAY

SEQ ID NO: 76918 - protein, 9 aa, Homo Sapiens
IMKNPEVEF

SEQ ID NO: 76919 - protein, 9 aa, Homo Sapiens
IMVKPHEEY

SEQ ID NO: 76920 - protein, 9 aa, Homo Sapiens
IPAATTIAY

SEQ ID NO: 76921 - protein, 9 aa, Homo Sapiens
IPFRPSIQF

SEQ ID NO: 76922 - protein, 9 aa, Homo Sapiens
IPMTPTSSF

SEQ ID NO: 76923 - protein, 9 aa, Homo Sapiens
IPYQDRESY

SEQ ID NO: 76924 - protein, 9 aa, Homo Sapiens
IQEESLRTY

SEQ ID NO: 76925 - protein, 9 aa, Homo Sapiens
IQFEIAHAY

SEQ ID NO: 76926 - protein, 9 aa, Homo Sapiens
IQKQFEELY

SEQ ID NO: 76927 - protein, 9 aa, Homo Sapiens
IQQIFHTTY

SEQ ID NO: 76928 - protein, 9 aa, Homo Sapiens
ITARDPAIM

SEQ ID NO: 76929 - protein, 9 aa, Homo Sapiens
IVAKSSLQY

SEQ ID NO: 76930 - protein, 9 aa, Homo Sapiens
IVKKPGNIY

SEQ ID NO: 76931 - protein, 9 aa, Homo Sapiens
IVRTGESSY

SEQ ID NO: 76932 - protein, 9 aa, Homo Sapiens
IVYPGIAVF

SEQ ID NO: 76933 - protein, 9 aa, Homo Sapiens
IVYPQKAYY

SEQ ID NO: 76934 - protein, 9 aa, Homo Sapiens
KAPGSTSNL

SEQ ID NO: 76935 - protein, 9 aa, Homo Sapiens
KVRESERAF

SEQ ID NO: 76936 - protein, 9 aa, Homo Sapiens
LAYLQRIAL

SEQ ID NO: 76937 - protein, 9 aa, Homo Sapiens
LIKEKEEAF

SEQ ID NO: 76938 - protein, 9 aa, Homo Sapiens
LIKYLDPEY

SEQ ID NO: 76939 - protein, 9 aa, Homo Sapiens
LIRDKEVEF

SEQ ID NO: 76940 - protein, 9 aa, Homo Sapiens
LIRDNRVVY

SEQ ID NO: 76941 - protein, 9 aa, Homo Sapiens
LIREEKNSY

SEQ ID NO: 76942 - protein, 9 aa, Homo Sapiens
LIRPVSASF

SEQ ID NO: 76943 - protein, 9 aa, Homo Sapiens
LIYDGKVEM

SEQ ID NO: 76944 - protein, 9 aa, Homo Sapiens
LIYEHLQQY

SEQ ID NO: 76945 - protein, 9 aa, Homo Sapiens
LLADITSKY

SEQ ID NO: 76946 - protein, 9 aa, Homo Sapiens
LLADPTGAF

SEQ ID NO: 76947 - protein, 9 aa, Homo Sapiens
LLAHPDAPM

SEQ ID NO: 76948 - protein, 9 aa, Homo Sapiens
LLDDSVRVY

SEQ ID NO: 76949 - protein, 9 aa, Homo Sapiens
LLETVVRVY

SEQ ID NO: 76950 - protein, 9 aa, Homo Sapiens
LLHAFQATF

SEQ ID NO: 76951 - protein, 9 aa, Homo Sapiens
LLHASLSEY

SEQ ID NO: 76952 - protein, 9 aa, Homo Sapiens
LLKSEKSSY

SEQ ID NO: 76953 - protein, 9 aa, Homo Sapiens
LLKSPGACF

SEQ ID NO: 76954 - protein, 9 aa, Homo Sapiens
LLREEDNKY

SEQ ID NO: 76955 - protein, 9 aa, Homo Sapiens
LLREELQAY

SEQ ID NO: 76956 - protein, 9 aa, Homo Sapiens
LLREENEGY

SEQ ID NO: 76957 - protein, 9 aa, Homo Sapiens
LLRFADNTF

SEQ ID NO: 76958 - protein, 9 aa, Homo Sapiens
LLTDIIAAY

SEQ ID NO: 76959 - protein, 9 aa, Homo Sapiens
LLTKNGHVY

SEQ ID NO: 76960 - protein, 9 aa, Homo Sapiens
LLYDTQQSF

SEQ ID NO: 76961 - protein, 9 aa, Homo Sapiens
LLYTTPTTY

SEQ ID NO: 76962 - protein, 9 aa, Homo Sapiens
LPFDKETGF

SEQ ID NO: 76963 - protein, 9 aa, Homo Sapiens
LPFEGKCYY

SEQ ID NO: 76964 - protein, 9 aa, Homo Sapiens
LPREGEQNF

SEQ ID NO: 76965 - protein, 9 aa, Homo Sapiens
LPYAGDVSM

SEQ ID NO: 76966 - protein, 9 aa, Homo Sapiens
LPYNHQHEY

SEQ ID NO: 76967 - protein, 9 aa, Homo Sapiens
LPYQGHNSF

SEQ ID NO: 76968 - protein, 9 aa, Homo Sapiens
LPYTVVIHY

SEQ ID NO: 76969 - protein, 9 aa, Homo Sapiens
LQALFKEAY

SEQ ID NO: 76970 - protein, 9 aa, Homo Sapiens
LQAVFVQSY

SEQ ID NO: 76971 - protein, 9 aa, Homo Sapiens
LQQVDTSTR

SEQ ID NO: 76972 - protein, 9 aa, Homo Sapiens
LQRLENTQY

SEQ ID NO: 76973 - protein, 9 aa, Homo Sapiens
LQYSGKTTF

SEQ ID NO: 76974 - protein, 9 aa, Homo Sapiens
LSGNNVVEY

SEQ ID NO: 76975 - protein, 9 aa, Homo Sapiens
LSVGSPSVL

SEQ ID NO: 76976 - protein, 9 aa, Homo Sapiens
LTVGNNKTL

SEQ ID NO: 76977 - protein, 9 aa, Homo Sapiens
LVRELEKKF

SEQ ID NO: 76978 - protein, 9 aa, Homo Sapiens
LVYNGVYQY

SEQ ID NO: 76979 - protein, 9 aa, Homo Sapiens
MAAMPQTVY

SEQ ID NO: 76980 - protein, 9 aa, Homo Sapiens
MAHSFGESY

SEQ ID NO: 76981 - protein, 9 aa, Homo Sapiens
MARDEKNYY

SEQ ID NO: 76982 - protein, 9 aa, Homo Sapiens
MARSPGRAY

SEQ ID NO: 76983 - protein, 9 aa, Homo Sapiens
MARYEREQY

SEQ ID NO: 76984 - protein, 9 aa, Homo Sapiens
MAWLVDHVY

SEQ ID NO: 76985 - protein, 9 aa, Homo Sapiens
MAYETLEQY

SEQ ID NO: 76986 - protein, 9 aa, Homo Sapiens
MIAEPAHFY

SEQ ID NO: 76987 - protein, 9 aa, Homo Sapiens
MIASHLLAY

SEQ ID NO: 76988 - protein, 9 aa, Homo Sapiens
MLAETSTVF

SEQ ID NO: 76989 - protein, 9 aa, Homo Sapiens
MLAGATAVY

SEQ ID NO: 76990 - protein, 9 aa, Homo Sapiens
MLAPLSTTY

SEQ ID NO: 76991 - protein, 9 aa, Homo Sapiens
MLAPPRELF

SEQ ID NO: 76992 - protein, 9 aa, Homo Sapiens
MLFNLGSAY

SEQ ID NO: 76993 - protein, 9 aa, Homo Sapiens
MLKIAEMEY

SEQ ID NO: 76994 - protein, 9 aa, Homo Sapiens
MLLDPVRSY

SEQ ID NO: 76995 - protein, 9 aa, Homo Sapiens
MLRATGKAY

SEQ ID NO: 76996 - protein, 9 aa, Homo Sapiens
MLRDIIREY

SEQ ID NO: 76997 - protein, 9 aa, Homo Sapiens
MLYDTSILY

SEQ ID NO: 76998 - protein, 9 aa, Homo Sapiens
MLYGTITEF

SEQ ID NO: 76999 - protein, 9 aa, Homo Sapiens
MLYKGQTAY

SEQ ID NO: 77000 - protein, 9 aa, Homo Sapiens
MLYPLSHGF

SEQ ID NO: 77001 - protein, 9 aa, Homo Sapiens
MLYTIHNTY

SEQ ID NO: 77002 - protein, 9 aa, Homo Sapiens
MLYYQTEKY

SEQ ID NO: 77003 - protein, 9 aa, Homo Sapiens
MMAGPMAAF

SEQ ID NO: 77004 - protein, 9 aa, Homo Sapiens
MMDQARSAF

SEQ ID NO: 77005 - protein, 9 aa, Homo Sapiens
MMIPSQISY

SEQ ID NO: 77006 - protein, 9 aa, Homo Sapiens
MMKTEGPSY

SEQ ID NO: 77007 - protein, 9 aa, Homo Sapiens
MMYSGELKF

SEQ ID NO: 77008 - protein, 9 aa, Homo Sapiens
MPAAGGVLY

SEQ ID NO: 77009 - protein, 9 aa, Homo Sapiens
MPAPEIVSY

SEQ ID NO: 77010 - protein, 9 aa, Homo Sapiens
MPAVKAIIY

SEQ ID NO: 77011 - protein, 9 aa, Homo Sapiens
MPEPASRCL

SEQ ID NO: 77012 - protein, 9 aa, Homo Sapiens
MPFPAHLTY

SEQ ID NO: 77013 - protein, 9 aa, Homo Sapiens
MPHNYSRCY

SEQ ID NO: 77014 - protein, 9 aa, Homo Sapiens
MPMGPDQKY

SEQ ID NO: 77015 - protein, 9 aa, Homo Sapiens
MPQFSTIEY

SEQ ID NO: 77016 - protein, 9 aa, Homo Sapiens
MPRLEVQSF

SEQ ID NO: 77017 - protein, 9 aa, Homo Sapiens
MPRVQTQQY

SEQ ID NO: 77018 - protein, 9 aa, Homo Sapiens
MPYLEHESF

SEQ ID NO: 77019 - protein, 9 aa, Homo Sapiens
MPYNHQHKY

SEQ ID NO: 77020 - protein, 9 aa, Homo Sapiens
MPYSHPSSY

SEQ ID NO: 77021 - protein, 9 aa, Homo Sapiens
MQHIFLNNY

SEQ ID NO: 77022 - protein, 9 aa, Homo Sapiens
MQIVHKITL

SEQ ID NO: 77023 - protein, 9 aa, Homo Sapiens
MQLPNGVTY

SEQ ID NO: 77024 - protein, 9 aa, Homo Sapiens
MQNPNAIIL

SEQ ID NO: 77025 - protein, 9 aa, Homo Sapiens
MQREPNQAF

SEQ ID NO: 77026 - protein, 9 aa, Homo Sapiens
MVADRVEVY

SEQ ID NO: 77027 - protein, 9 aa, Homo Sapiens
MVAKVGVSM

SEQ ID NO: 77028 - protein, 9 aa, Homo Sapiens
MVASMRLAY

SEQ ID NO: 77029 - protein, 9 aa, Homo Sapiens
MVHSEVAAY

SEQ ID NO: 77030 - protein, 9 aa, Homo Sapiens
MVIRPHKSF

SEQ ID NO: 77031 - protein, 9 aa, Homo Sapiens
MVMEIRNAY

SEQ ID NO: 77032 - protein, 9 aa, Homo Sapiens
MVRFGEYQF

SEQ ID NO: 77033 - protein, 9 aa, Homo Sapiens
MVSEAGTGF

SEQ ID NO: 77034 - protein, 9 aa, Homo Sapiens
MVTKPVQEY

SEQ ID NO: 77035 - protein, 9 aa, Homo Sapiens
MVVEERCVY

SEQ ID NO: 77036 - protein, 9 aa, Homo Sapiens
MVVGTGTSL

SEQ ID NO: 77037 - protein, 9 aa, Homo Sapiens
NAAFPFLAY

SEQ ID NO: 77038 - protein, 9 aa, Homo Sapiens
NAAPPPVTY

SEQ ID NO: 77039 - protein, 9 aa, Homo Sapiens
NAAPSHTKF

SEQ ID NO: 77040 - protein, 9 aa, Homo Sapiens
NAFEELVAF

SEQ ID NO: 77041 - protein, 9 aa, Homo Sapiens
NAHEFITSF

SEQ ID NO: 77042 - protein, 9 aa, Homo Sapiens
NAISVTTSY

SEQ ID NO: 77043 - protein, 9 aa, Homo Sapiens
NIAGDGSVF

SEQ ID NO: 77044 - protein, 9 aa, Homo Sapiens
NIEEAVRLY

SEQ ID NO: 77045 - protein, 9 aa, Homo Sapiens
NIFSEVRVY

SEQ ID NO: 77046 - protein, 9 aa, Homo Sapiens
NIHSGDRPY

SEQ ID NO: 77047 - protein, 9 aa, Homo Sapiens
NIKTGGRVY

SEQ ID NO: 77048 - protein, 9 aa, Homo Sapiens
NINVPSSVY

SEQ ID NO: 77049 - protein, 9 aa, Homo Sapiens
NIRDIDKAL

SEQ ID NO: 77050 - protein, 9 aa, Homo Sapiens
NIREIEIDY

SEQ ID NO: 77051 - protein, 9 aa, Homo Sapiens
NIREVGFEY

SEQ ID NO: 77052 - protein, 9 aa, Homo Sapiens
NIRPADSRW

SEQ ID NO: 77053 - protein, 9 aa, Homo Sapiens
NIVDKTASF

SEQ ID NO: 77054 - protein, 9 aa, Homo Sapiens
NIVHATQLY

SEQ ID NO: 77055 - protein, 9 aa, Homo Sapiens
NIYKEIENY

SEQ ID NO: 77056 - protein, 9 aa, Homo Sapiens
NLAEALLTY

SEQ ID NO: 77057 - protein, 9 aa, Homo Sapiens
NLAPKSTAM

SEQ ID NO: 77058 - protein, 9 aa, Homo Sapiens
NLAVHQECY

SEQ ID NO: 77059 - protein, 9 aa, Homo Sapiens
NLAVSNHVF

SEQ ID NO: 77060 - protein, 9 aa, Homo Sapiens
NLCTEIVEY

SEQ ID NO: 77061 - protein, 9 aa, Homo Sapiens
NLFKTNHVF

SEQ ID NO: 77062 - protein, 9 aa, Homo Sapiens
NLHSGARPY

SEQ ID NO: 77063 - protein, 9 aa, Homo Sapiens
NLHSSSSTF

SEQ ID NO: 77064 - protein, 9 aa, Homo Sapiens
NLIGPGHSF

SEQ ID NO: 77065 - protein, 9 aa, Homo Sapiens
NLKAPSRHY

SEQ ID NO: 77066 - protein, 9 aa, Homo Sapiens
NLKKSDRYY

SEQ ID NO: 77067 - protein, 9 aa, Homo Sapiens
NLLDPGSSY

SEQ ID NO: 77068 - protein, 9 aa, Homo Sapiens
NLLEKQLEY

SEQ ID NO: 77069 - protein, 9 aa, Homo Sapiens
NLLKEVRIY

SEQ ID NO: 77070 - protein, 9 aa, Homo Sapiens
NLLSQSHAY

SEQ ID NO: 77071 - protein, 9 aa, Homo Sapiens
NLMELTQIY

SEQ ID NO: 77072 - protein, 9 aa, Homo Sapiens
NLPEETNEM

SEQ ID NO: 77073 - protein, 9 aa, Homo Sapiens
NLRHLDLAY

SEQ ID NO: 77074 - protein, 9 aa, Homo Sapiens
NLRPVGEDF

SEQ ID NO: 77075 - protein, 9 aa, Homo Sapiens
NLSEIHVAF

SEQ ID NO: 77076 - protein, 9 aa, Homo Sapiens
NLVKHAEVY

SEQ ID NO: 77077 - protein, 9 aa, Homo Sapiens
NLVVSGKVY

SEQ ID NO: 77078 - protein, 9 aa, Homo Sapiens
NLYDHELVF

SEQ ID NO: 77079 - protein, 9 aa, Homo Sapiens
NLYPGNEGY

SEQ ID NO: 77080 - protein, 9 aa, Homo Sapiens
NLYPHRTAF

SEQ ID NO: 77081 - protein, 9 aa, Homo Sapiens
NLYQNCIRY

SEQ ID NO: 77082 - protein, 9 aa, Homo Sapiens
NLYRQLISY

SEQ ID NO: 77083 - protein, 9 aa, Homo Sapiens
NMANIREYY

SEQ ID NO: 77084 - protein, 9 aa, Homo Sapiens
NMNDLVSEY

SEQ ID NO: 77085 - protein, 9 aa, Homo Sapiens
NMWNTGSTY

SEQ ID NO: 77086 - protein, 9 aa, Homo Sapiens
NMYKGGQYY

SEQ ID NO: 77087 - protein, 9 aa, Homo Sapiens
NMYSSILTM

SEQ ID NO: 77088 - protein, 9 aa, Homo Sapiens
NPNSPSITY

SEQ ID NO: 77089 - protein, 9 aa, Homo Sapiens
NPYDRGSAF

SEQ ID NO: 77090 - protein, 9 aa, Homo Sapiens
NQHAYPTAY

SEQ ID NO: 77091 - protein, 9 aa, Homo Sapiens
NQHGIILKY

SEQ ID NO: 77092 - protein, 9 aa, Homo Sapiens
NQIESKAAY

SEQ ID NO: 77093 - protein, 9 aa, Homo Sapiens
NQIPFIIQY

SEQ ID NO: 77094 - protein, 9 aa, Homo Sapiens
NQIRPGLQY

SEQ ID NO: 77095 - protein, 9 aa, Homo Sapiens
NQKPPSAEF

SEQ ID NO: 77096 - protein, 9 aa, Homo Sapiens
NQKPPSAEY

SEQ ID NO: 77097 - protein, 9 aa, Homo Sapiens
NQLKPGLQY

SEQ ID NO: 77098 - protein, 9 aa, Homo Sapiens
NQRLAYVTY

SEQ ID NO: 77099 - protein, 9 aa, Homo Sapiens
NQVIFPVSY

SEQ ID NO: 77100 - protein, 9 aa, Homo Sapiens
NQVQSGRAF

SEQ ID NO: 77101 - protein, 9 aa, Homo Sapiens
NQWEALTEY

SEQ ID NO: 77102 - protein, 9 aa, Homo Sapiens
NQYISQQEY

SEQ ID NO: 77103 - protein, 9 aa, Homo Sapiens
NSAPEHISY

SEQ ID NO: 77104 - protein, 9 aa, Homo Sapiens
NTHRHLTEF

SEQ ID NO: 77105 - protein, 9 aa, Homo Sapiens
NTIDPSHPM

SEQ ID NO: 77106 - protein, 9 aa, Homo Sapiens
NVACPGTAL

SEQ ID NO: 77107 - protein, 9 aa, Homo Sapiens
NVADLHEKY

SEQ ID NO: 77108 - protein, 9 aa, Homo Sapiens
NVAEKGPAY

SEQ ID NO: 77109 - protein, 9 aa, Homo Sapiens
NVAPYDPHF

SEQ ID NO: 77110 - protein, 9 aa, Homo Sapiens
NVAVPSHLY

SEQ ID NO: 77111 - protein, 9 aa, Homo Sapiens
NVFGVCHIF

SEQ ID NO: 77112 - protein, 9 aa, Homo Sapiens
NVHSFFSAF

SEQ ID NO: 77113 - protein, 9 aa, Homo Sapiens
NVIATETSY

SEQ ID NO: 77114 - protein, 9 aa, Homo Sapiens
NVIHNLATY

SEQ ID NO: 77115 - protein, 9 aa, Homo Sapiens
NVIRDAVTY

SEQ ID NO: 77116 - protein, 9 aa, Homo Sapiens
NVRCESEVF

SEQ ID NO: 77117 - protein, 9 aa, Homo Sapiens
NVRSEEQVF

SEQ ID NO: 77118 - protein, 9 aa, Homo Sapiens
NVSSPHREF

SEQ ID NO: 77119 - protein, 9 aa, Homo Sapiens
NVVKTGRVM

SEQ ID NO: 77120 - protein, 9 aa, Homo Sapiens
NVYCGVHRY

SEQ ID NO: 77121 - protein, 9 aa, Homo Sapiens
NVYDFKTTY

SEQ ID NO: 77122 - protein, 9 aa, Homo Sapiens
QARIEIESF

SEQ ID NO: 77123 - protein, 9 aa, Homo Sapiens
QERPSVTSY

SEQ ID NO: 77124 - protein, 9 aa, Homo Sapiens
QIAEFKEAF

SEQ ID NO: 77125 - protein, 9 aa, Homo Sapiens
QIALPSGCY

SEQ ID NO: 77126 - protein, 9 aa, Homo Sapiens
QIGPVAGVM

SEQ ID NO: 77127 - protein, 9 aa, Homo Sapiens
QIRELEAEF

SEQ ID NO: 77128 - protein, 9 aa, Homo Sapiens
QIYQQLSRY

SEQ ID NO: 77129 - protein, 9 aa, Homo Sapiens
QLGPVGGVF

SEQ ID NO: 77130 - protein, 9 aa, Homo Sapiens
QLIDLAEEY

SEQ ID NO: 77131 - protein, 9 aa, Homo Sapiens
QLIRCIVEY

SEQ ID NO: 77132 - protein, 9 aa, Homo Sapiens
QLPKPTSTY

SEQ ID NO: 77133 - protein, 9 aa, Homo Sapiens
QLRAQILAY

SEQ ID NO: 77134 - protein, 9 aa, Homo Sapiens
QLRPEFEAM

SEQ ID NO: 77135 - protein, 9 aa, Homo Sapiens
QLTGQTPVF

SEQ ID NO: 77136 - protein, 9 aa, Homo Sapiens
QLVTGGESF

SEQ ID NO: 77137 - protein, 9 aa, Homo Sapiens
QLYEGKEQM

SEQ ID NO: 77138 - protein, 9 aa, Homo Sapiens
QLYEQVVKF

SEQ ID NO: 77139 - protein, 9 aa, Homo Sapiens
QLYKMRNGY

SEQ ID NO: 77140 - protein, 9 aa, Homo Sapiens
QLYQQSRAY

SEQ ID NO: 77141 - protein, 9 aa, Homo Sapiens
QMWISKQEY

SEQ ID NO: 77142 - protein, 9 aa, Homo Sapiens
QMYRTEIRM

SEQ ID NO: 77143 - protein, 9 aa, Homo Sapiens
QPIVWITPY

SEQ ID NO: 77144 - protein, 9 aa, Homo Sapiens
QQALHTVQY

SEQ ID NO: 77145 - protein, 9 aa, Homo Sapiens
QQEERKRLY

SEQ ID NO: 77146 - protein, 9 aa, Homo Sapiens
QQNDQQLVY

SEQ ID NO: 77147 - protein, 9 aa, Homo Sapiens
QQNPQPLIF

SEQ ID NO: 77148 - protein, 9 aa, Homo Sapiens
QVAPLTHVF

SEQ ID NO: 77149 - protein, 9 aa, Homo Sapiens
QVAPSLSAL

SEQ ID NO: 77150 - protein, 9 aa, Homo Sapiens
QVAPVANSY

SEQ ID NO: 77151 - protein, 9 aa, Homo Sapiens
QVFEGHTHY

SEQ ID NO: 77152 - protein, 9 aa, Homo Sapiens
QVKPNDQHF

SEQ ID NO: 77153 - protein, 9 aa, Homo Sapiens
QVSPATQQM

SEQ ID NO: 77154 - protein, 9 aa, Homo Sapiens
QVVFSGKAY

SEQ ID NO: 77155 - protein, 9 aa, Homo Sapiens
QVVLLNTSY

SEQ ID NO: 77156 - protein, 9 aa, Homo Sapiens
QVVPAGLAF

SEQ ID NO: 77157 - protein, 9 aa, Homo Sapiens
QVYEGERAM

SEQ ID NO: 77158 - protein, 9 aa, Homo Sapiens
QVYETLLTY

SEQ ID NO: 77159 - protein, 9 aa, Homo Sapiens
QVYGGVTYY

SEQ ID NO: 77160 - protein, 9 aa, Homo Sapiens
RAYQQSEAY

SEQ ID NO: 77161 - protein, 9 aa, Homo Sapiens
RIAPAFSSM

SEQ ID NO: 77162 - protein, 9 aa, Homo Sapiens
RLKDRDPEF

SEQ ID NO: 77163 - protein, 9 aa, Homo Sapiens
RLQEFLTAY

SEQ ID NO: 77164 - protein, 9 aa, Homo Sapiens
RLYFSQQTY

SEQ ID NO: 77165 - protein, 9 aa, Homo Sapiens
RPREIINTY

SEQ ID NO: 77166 - protein, 9 aa, Homo Sapiens
RVAPAHGLF

SEQ ID NO: 77167 - protein, 9 aa, Homo Sapiens
SAAQPGVAF

SEQ ID NO: 77168 - protein, 9 aa, Homo Sapiens
SALEHSIQY

SEQ ID NO: 77169 - protein, 9 aa, Homo Sapiens
SALPTVVAY

SEQ ID NO: 77170 - protein, 9 aa, Homo Sapiens
SARAGETRF

SEQ ID NO: 77171 - protein, 9 aa, Homo Sapiens
SAYAQIVQF

SEQ ID NO: 77172 - protein, 9 aa, Homo Sapiens
SAYGSVKAY

SEQ ID NO: 77173 - protein, 9 aa, Homo Sapiens
SHLTHSSTF

SEQ ID NO: 77174 - protein, 9 aa, Homo Sapiens
SIAHGTPVM

SEQ ID NO: 77175 - protein, 9 aa, Homo Sapiens
SIAPFHICY

SEQ ID NO: 77176 - protein, 9 aa, Homo Sapiens
SIFEHKIVF

SEQ ID NO: 77177 - protein, 9 aa, Homo Sapiens
SIFKHEIPY

SEQ ID NO: 77178 - protein, 9 aa, Homo Sapiens
SILEKTSAY

SEQ ID NO: 77179 - protein, 9 aa, Homo Sapiens
SIMEHNVAY

SEQ ID NO: 77180 - protein, 9 aa, Homo Sapiens
SIMEHNVSY

SEQ ID NO: 77181 - protein, 9 aa, Homo Sapiens
SIRDGVRAY

SEQ ID NO: 77182 - protein, 9 aa, Homo Sapiens
SIREAGGAF

SEQ ID NO: 77183 - protein, 9 aa, Homo Sapiens
SISGVTAAY

SEQ ID NO: 77184 - protein, 9 aa, Homo Sapiens
SISKALVAY

SEQ ID NO: 77185 - protein, 9 aa, Homo Sapiens
SIYEASSLY

SEQ ID NO: 77186 - protein, 9 aa, Homo Sapiens
SIYEGDESF

SEQ ID NO: 77187 - protein, 9 aa, Homo Sapiens
SIYWTAVTY

SEQ ID NO: 77188 - protein, 9 aa, Homo Sapiens
SLADLKSLY

SEQ ID NO: 77189 - protein, 9 aa, Homo Sapiens
SLAEPGSAY

SEQ ID NO: 77190 - protein, 9 aa, Homo Sapiens
SLAGPVVSM

SEQ ID NO: 77191 - protein, 9 aa, Homo Sapiens
SLAHAGVAL

SEQ ID NO: 77192 - protein, 9 aa, Homo Sapiens
SLAPPHHPM

SEQ ID NO: 77193 - protein, 9 aa, Homo Sapiens
SLARPGHPM

SEQ ID NO: 77194 - protein, 9 aa, Homo Sapiens
SLATPATHY

SEQ ID NO: 77195 - protein, 9 aa, Homo Sapiens
SLAYLVNTY

SEQ ID NO: 77196 - protein, 9 aa, Homo Sapiens
SLCTKSVSY

SEQ ID NO: 77197 - protein, 9 aa, Homo Sapiens
SLDAPHSTY

SEQ ID NO: 77198 - protein, 9 aa, Homo Sapiens
SLDIKSVSY

SEQ ID NO: 77199 - protein, 9 aa, Homo Sapiens
SLELLSSHY

SEQ ID NO: 77200 - protein, 9 aa, Homo Sapiens
SLFASRTLF

SEQ ID NO: 77201 - protein, 9 aa, Homo Sapiens
SLFDNPRTF

SEQ ID NO: 77202 - protein, 9 aa, Homo Sapiens
SLFHAQLAY

SEQ ID NO: 77203 - protein, 9 aa, Homo Sapiens
SLFINTSSY

SEQ ID NO: 77204 - protein, 9 aa, Homo Sapiens
SLFKSLSRY

SEQ ID NO: 77205 - protein, 9 aa, Homo Sapiens
SLFPHHGTF

SEQ ID NO: 77206 - protein, 9 aa, Homo Sapiens
SLFVPFTVY

SEQ ID NO: 77207 - protein, 9 aa, Homo Sapiens
SLFVSNHAY

SEQ ID NO: 77208 - protein, 9 aa, Homo Sapiens
SLGQPHIAY

SEQ ID NO: 77209 - protein, 9 aa, Homo Sapiens
SLHDISTEM

SEQ ID NO: 77210 - protein, 9 aa, Homo Sapiens
SLIQAGQQF

SEQ ID NO: 77211 - protein, 9 aa, Homo Sapiens
SLKGVDPKF

SEQ ID NO: 77212 - protein, 9 aa, Homo Sapiens
SLLEHIMIY

SEQ ID NO: 77213 - protein, 9 aa, Homo Sapiens
SLLERLLTY

SEQ ID NO: 77214 - protein, 9 aa, Homo Sapiens
SLLRPGHSF

SEQ ID NO: 77215 - protein, 9 aa, Homo Sapiens
SLLVSVLEY

SEQ ID NO: 77216 - protein, 9 aa, Homo Sapiens
SLRDKDLEM

SEQ ID NO: 77217 - protein, 9 aa, Homo Sapiens
SLREDQQSF

SEQ ID NO: 77218 - protein, 9 aa, Homo Sapiens
SLRERDAAL

SEQ ID NO: 77219 - protein, 9 aa, Homo Sapiens
SLRFIDVEF

SEQ ID NO: 77220 - protein, 9 aa, Homo Sapiens
SLRHVDASF

SEQ ID NO: 77221 - protein, 9 aa, Homo Sapiens
SLRKELSHY

SEQ ID NO: 77222 - protein, 9 aa, Homo Sapiens
SLRPLDIEF

SEQ ID NO: 77223 - protein, 9 aa, Homo Sapiens
SLRQVVNVY

SEQ ID NO: 77224 - protein, 9 aa, Homo Sapiens
SLSPFAITY

SEQ ID NO: 77225 - protein, 9 aa, Homo Sapiens
SLSVKSSVY

SEQ ID NO: 77226 - protein, 9 aa, Homo Sapiens
SLVEVNPAY

SEQ ID NO: 77227 - protein, 9 aa, Homo Sapiens
SLVGITSAY

SEQ ID NO: 77228 - protein, 9 aa, Homo Sapiens
SLVGPTQSF

SEQ ID NO: 77229 - protein, 9 aa, Homo Sapiens
SLVKPSVDY

SEQ ID NO: 77230 - protein, 9 aa, Homo Sapiens
SLVQPQSQY

SEQ ID NO: 77231 - protein, 9 aa, Homo Sapiens
SLYDRIVLF

SEQ ID NO: 77232 - protein, 9 aa, Homo Sapiens
SLYEDDITF

SEQ ID NO: 77233 - protein, 9 aa, Homo Sapiens
SLYIANHAY

SEQ ID NO: 77234 - protein, 9 aa, Homo Sapiens
SLYKTHPQY

SEQ ID NO: 77235 - protein, 9 aa, Homo Sapiens
SLYSKGLVF

SEQ ID NO: 77236 - protein, 9 aa, Homo Sapiens
SMHLQLTCF

SEQ ID NO: 77237 - protein, 9 aa, Homo Sapiens
SMRKTFARY

SEQ ID NO: 77238 - protein, 9 aa, Homo Sapiens
SMRQPDLKY

SEQ ID NO: 77239 - protein, 9 aa, Homo Sapiens
SMRSPELAL

SEQ ID NO: 77240 - protein, 9 aa, Homo Sapiens
SMSDPGVSY

SEQ ID NO: 77241 - protein, 9 aa, Homo Sapiens
SMYDKVLML

SEQ ID NO: 77242 - protein, 9 aa, Homo Sapiens
SPFLTITSM

SEQ ID NO: 77243 - protein, 9 aa, Homo Sapiens
SPFQPHVPY

SEQ ID NO: 77244 - protein, 9 aa, Homo Sapiens
SQARLLTSF

SEQ ID NO: 77245 - protein, 9 aa, Homo Sapiens
SQATPHSSY

SEQ ID NO: 77246 - protein, 9 aa, Homo Sapiens
SQFGGGSQY

SEQ ID NO: 77247 - protein, 9 aa, Homo Sapiens
SQFGTVTRF

SEQ ID NO: 77248 - protein, 9 aa, Homo Sapiens
SQFIFEHSY

SEQ ID NO: 77249 - protein, 9 aa, Homo Sapiens
SQFKGYFIF

SEQ ID NO: 77250 - protein, 9 aa, Homo Sapiens
SQHQETPVY

SEQ ID NO: 77251 - protein, 9 aa, Homo Sapiens
SQIEEHKVF

SEQ ID NO: 77252 - protein, 9 aa, Homo Sapiens
SQKVSGPQY

SEQ ID NO: 77253 - protein, 9 aa, Homo Sapiens
SQLHARPSY

SEQ ID NO: 77254 - protein, 9 aa, Homo Sapiens
SQLPPLTAF

SEQ ID NO: 77255 - protein, 9 aa, Homo Sapiens
SQLVAGVAF

SEQ ID NO: 77256 - protein, 9 aa, Homo Sapiens
SQRLESVSF

SEQ ID NO: 77257 - protein, 9 aa, Homo Sapiens
SQRPAARAF

SEQ ID NO: 77258 - protein, 9 aa, Homo Sapiens
SQTEVSSEY

SEQ ID NO: 77259 - protein, 9 aa, Homo Sapiens
SQTNPGSQF

SEQ ID NO: 77260 - protein, 9 aa, Homo Sapiens
SQVPRSSSM

SEQ ID NO: 77261 - protein, 9 aa, Homo Sapiens
SQYDNCLTY

SEQ ID NO: 77262 - protein, 9 aa, Homo Sapiens
SQYPFPVTL

SEQ ID NO: 77263 - protein, 9 aa, Homo Sapiens
SQYQGVVVY

SEQ ID NO: 77264 - protein, 9 aa, Homo Sapiens
STKPADMKY

SEQ ID NO: 77265 - protein, 9 aa, Homo Sapiens
SVADIRNAY

SEQ ID NO: 77266 - protein, 9 aa, Homo Sapiens
SVAGHVEVY

SEQ ID NO: 77267 - protein, 9 aa, Homo Sapiens
SVAKESIPL

SEQ ID NO: 77268 - protein, 9 aa, Homo Sapiens
SVFCGTSTY

SEQ ID NO: 77269 - protein, 9 aa, Homo Sapiens
SVFGTHQAF

SEQ ID NO: 77270 - protein, 9 aa, Homo Sapiens
SVHNAGISF

SEQ ID NO: 77271 - protein, 9 aa, Homo Sapiens
SVHQPGSHY

SEQ ID NO: 77272 - protein, 9 aa, Homo Sapiens
SVHSPSTSM

SEQ ID NO: 77273 - protein, 9 aa, Homo Sapiens
SVIATIQEY

SEQ ID NO: 77274 - protein, 9 aa, Homo Sapiens
SVIEQILHY

SEQ ID NO: 77275 - protein, 9 aa, Homo Sapiens
SVIESHTEF

SEQ ID NO: 77276 - protein, 9 aa, Homo Sapiens
SVIGASSQF

SEQ ID NO: 77277 - protein, 9 aa, Homo Sapiens
SVINPGAIY

SEQ ID NO: 77278 - protein, 9 aa, Homo Sapiens
SVKASSVVY

SEQ ID NO: 77279 - protein, 9 aa, Homo Sapiens
SVKDGAICY

SEQ ID NO: 77280 - protein, 9 aa, Homo Sapiens
SVKDPSPLY

SEQ ID NO: 77281 - protein, 9 aa, Homo Sapiens
SVKPASSSF

SEQ ID NO: 77282 - protein, 9 aa, Homo Sapiens
SVMTLVSTY

SEQ ID NO: 77283 - protein, 9 aa, Homo Sapiens
SVNTPTKTY

SEQ ID NO: 77284 - protein, 9 aa, Homo Sapiens
SVQGAGTSY

SEQ ID NO: 77285 - protein, 9 aa, Homo Sapiens
SVREWEMQF

SEQ ID NO: 77286 - protein, 9 aa, Homo Sapiens
SVRIADKKY

SEQ ID NO: 77287 - protein, 9 aa, Homo Sapiens
SVRKDIESY

SEQ ID NO: 77288 - protein, 9 aa, Homo Sapiens
SVSHPMPTM

SEQ ID NO: 77289 - protein, 9 aa, Homo Sapiens
SVVDISQQY

SEQ ID NO: 77290 - protein, 9 aa, Homo Sapiens
SVVGAISSY

SEQ ID NO: 77291 - protein, 9 aa, Homo Sapiens
SVVSTGTSF

SEQ ID NO: 77292 - protein, 9 aa, Homo Sapiens
SVYDGAVGY

SEQ ID NO: 77293 - protein, 9 aa, Homo Sapiens
SVYDHQGIF

SEQ ID NO: 77294 - protein, 9 aa, Homo Sapiens
SVYEGGVFF

SEQ ID NO: 77295 - protein, 9 aa, Homo Sapiens
SVYETQTKY

SEQ ID NO: 77296 - protein, 9 aa, Homo Sapiens
SVYHPQLAY

SEQ ID NO: 77297 - protein, 9 aa, Homo Sapiens
SVYLHPNSY

SEQ ID NO: 77298 - protein, 9 aa, Homo Sapiens
SVYRTVIEY

SEQ ID NO: 77299 - protein, 9 aa, Homo Sapiens
TAAAVGAVF

SEQ ID NO: 77300 - protein, 9 aa, Homo Sapiens
TAAPPAQPL

SEQ ID NO: 77301 - protein, 9 aa, Homo Sapiens
TAHIHATEY

SEQ ID NO: 77302 - protein, 9 aa, Homo Sapiens
TAHLNVNSF

SEQ ID NO: 77303 - protein, 9 aa, Homo Sapiens
TALPTRIAY

SEQ ID NO: 77304 - protein, 9 aa, Homo Sapiens
TARVITNQY

SEQ ID NO: 77305 - protein, 9 aa, Homo Sapiens
TAWEVRAVY

SEQ ID NO: 77306 - protein, 9 aa, Homo Sapiens
TAYPGQTQY

SEQ ID NO: 77307 - protein, 9 aa, Homo Sapiens
TCNVHKSAF

SEQ ID NO: 77308 - protein, 9 aa, Homo Sapiens
TEREPDQTF

SEQ ID NO: 77309 - protein, 9 aa, Homo Sapiens
TFMDHVLRY

SEQ ID NO: 77310 - protein, 9 aa, Homo Sapiens
TFMEQKITY

SEQ ID NO: 77311 - protein, 9 aa, Homo Sapiens
TFNEPGSEY

SEQ ID NO: 77312 - protein, 9 aa, Homo Sapiens
THLNELLMA

SEQ ID NO: 77313 - protein, 9 aa, Homo Sapiens
THYQLGLAY

SEQ ID NO: 77314 - protein, 9 aa, Homo Sapiens
TIAKPTTHF

SEQ ID NO: 77315 - protein, 9 aa, Homo Sapiens
TIAPCQKAM

SEQ ID NO: 77316 - protein, 9 aa, Homo Sapiens
TIAPRTHPY

SEQ ID NO: 77317 - protein, 9 aa, Homo Sapiens
TIDPNTRTL

SEQ ID NO: 77318 - protein, 9 aa, Homo Sapiens
TIIPKVLAM

SEQ ID NO: 77319 - protein, 9 aa, Homo Sapiens
TIKETDPDY

SEQ ID NO: 77320 - protein, 9 aa, Homo Sapiens
TILDDAKIY

SEQ ID NO: 77321 - protein, 9 aa, Homo Sapiens
TILHSTGQY

SEQ ID NO: 77322 - protein, 9 aa, Homo Sapiens
TIMAHVTEF

SEQ ID NO: 77323 - protein, 9 aa, Homo Sapiens
TINAAHVEY

SEQ ID NO: 77324 - protein, 9 aa, Homo Sapiens
TIRPEETAW

SEQ ID NO: 77325 - protein, 9 aa, Homo Sapiens
TIRQEEGVF

SEQ ID NO: 77326 - protein, 9 aa, Homo Sapiens
TIRYPDPLI

SEQ ID NO: 77327 - protein, 9 aa, Homo Sapiens
TISPKSTVY

SEQ ID NO: 77328 - protein, 9 aa, Homo Sapiens
TIVKAGPEY

SEQ ID NO: 77329 - protein, 9 aa, Homo Sapiens
TIVPKVLVM

SEQ ID NO: 77330 - protein, 9 aa, Homo Sapiens
TLADIICEY

SEQ ID NO: 77331 - protein, 9 aa, Homo Sapiens
TLADVKHVF

SEQ ID NO: 77332 - protein, 9 aa, Homo Sapiens
TLAFPSEHF

SEQ ID NO: 77333 - protein, 9 aa, Homo Sapiens
TLANIHKIY

SEQ ID NO: 77334 - protein, 9 aa, Homo Sapiens
TLAPASSSA

SEQ ID NO: 77335 - protein, 9 aa, Homo Sapiens
TLAPAVERM

SEQ ID NO: 77336 - protein, 9 aa, Homo Sapiens
TLAPGSRGY

SEQ ID NO: 77337 - protein, 9 aa, Homo Sapiens
TLAPLNQVF

SEQ ID NO: 77338 - protein, 9 aa, Homo Sapiens
TLAPSLGCF

SEQ ID NO: 77339 - protein, 9 aa, Homo Sapiens
TLAPVQMTF

SEQ ID NO: 77340 - protein, 9 aa, Homo Sapiens
TLAQLQQEF

SEQ ID NO: 77341 - protein, 9 aa, Homo Sapiens
TLDASTKIY

SEQ ID NO: 77342 - protein, 9 aa, Homo Sapiens
TLFETDERY

SEQ ID NO: 77343 - protein, 9 aa, Homo Sapiens
TLFHFGNCF

SEQ ID NO: 77344 - protein, 9 aa, Homo Sapiens
TLFPEKQIY

SEQ ID NO: 77345 - protein, 9 aa, Homo Sapiens
TLGDFAAEY

SEQ ID NO: 77346 - protein, 9 aa, Homo Sapiens
TLGPVSRSY

SEQ ID NO: 77347 - protein, 9 aa, Homo Sapiens
TLHDTRTHF

SEQ ID NO: 77348 - protein, 9 aa, Homo Sapiens
TLHERFTKY

SEQ ID NO: 77349 - protein, 9 aa, Homo Sapiens
TLHKPTQVM

SEQ ID NO: 77350 - protein, 9 aa, Homo Sapiens
TLIDSSSSF

SEQ ID NO: 77351 - protein, 9 aa, Homo Sapiens
TLIEQQFTY

SEQ ID NO: 77352 - protein, 9 aa, Homo Sapiens
TLIQSGPAL

SEQ ID NO: 77353 - protein, 9 aa, Homo Sapiens
TLISCQSQF

SEQ ID NO: 77354 - protein, 9 aa, Homo Sapiens
TLISPSFCY

SEQ ID NO: 77355 - protein, 9 aa, Homo Sapiens
TLITGLEEY

SEQ ID NO: 77356 - protein, 9 aa, Homo Sapiens
TLITQFLVY

SEQ ID NO: 77357 - protein, 9 aa, Homo Sapiens
TLKDRELSF

SEQ ID NO: 77358 - protein, 9 aa, Homo Sapiens
TLKEEWIAY

SEQ ID NO: 77359 - protein, 9 aa, Homo Sapiens
TLKGPDSHY

SEQ ID NO: 77360 - protein, 9 aa, Homo Sapiens
TLKQQEEVF

SEQ ID NO: 77361 - protein, 9 aa, Homo Sapiens
TLKTPGKSF

SEQ ID NO: 77362 - protein, 9 aa, Homo Sapiens
TLLAELREY

SEQ ID NO: 77363 - protein, 9 aa, Homo Sapiens
TLLASNEAF

SEQ ID NO: 77364 - protein, 9 aa, Homo Sapiens
TLLEKQLEY

SEQ ID NO: 77365 - protein, 9 aa, Homo Sapiens
TLLESYQVY

SEQ ID NO: 77366 - protein, 9 aa, Homo Sapiens
TLLFPGREF

SEQ ID NO: 77367 - protein, 9 aa, Homo Sapiens
TLLLKIQEY

SEQ ID NO: 77368 - protein, 9 aa, Homo Sapiens
TLLPGCRVM

SEQ ID NO: 77369 - protein, 9 aa, Homo Sapiens
TLLQSIISY

SEQ ID NO: 77370 - protein, 9 aa, Homo Sapiens
TLLQSVHIY

SEQ ID NO: 77371 - protein, 9 aa, Homo Sapiens
TLLSHVALY

SEQ ID NO: 77372 - protein, 9 aa, Homo Sapiens
TLLSSLSRY

SEQ ID NO: 77373 - protein, 9 aa, Homo Sapiens
TLLWPGHEY

SEQ ID NO: 77374 - protein, 9 aa, Homo Sapiens
TLMGPTRVF

SEQ ID NO: 77375 - protein, 9 aa, Homo Sapiens
TLMKQYIEF

SEQ ID NO: 77376 - protein, 9 aa, Homo Sapiens
TLMLEHQAF

SEQ ID NO: 77377 - protein, 9 aa, Homo Sapiens
TLNARTSIL

SEQ ID NO: 77378 - protein, 9 aa, Homo Sapiens
TLNERFTSY

SEQ ID NO: 77379 - protein, 9 aa, Homo Sapiens
TLNNSTQTY

SEQ ID NO: 77380 - protein, 9 aa, Homo Sapiens
TLNPNAKEF

SEQ ID NO: 77381 - protein, 9 aa, Homo Sapiens
TLNVSTTRY

SEQ ID NO: 77382 - protein, 9 aa, Homo Sapiens
TLPDDHSSY

SEQ ID NO: 77383 - protein, 9 aa, Homo Sapiens
TLPFHSVIY

SEQ ID NO: 77384 - protein, 9 aa, Homo Sapiens
TLQKQCVPF

SEQ ID NO: 77385 - protein, 9 aa, Homo Sapiens
TLQKQSVVY

SEQ ID NO: 77386 - protein, 9 aa, Homo Sapiens
TLRAAGKTY

SEQ ID NO: 77387 - protein, 9 aa, Homo Sapiens
TLRAVELLY

SEQ ID NO: 77388 - protein, 9 aa, Homo Sapiens
TLRDIETFY

SEQ ID NO: 77389 - protein, 9 aa, Homo Sapiens
TLRDPGSQL

SEQ ID NO: 77390 - protein, 9 aa, Homo Sapiens
TLRDSMLKY

SEQ ID NO: 77391 - protein, 9 aa, Homo Sapiens
TLRKDYARY

SEQ ID NO: 77392 - protein, 9 aa, Homo Sapiens
TLRKPSPVY

SEQ ID NO: 77393 - protein, 9 aa, Homo Sapiens
TLRPYFQVY

SEQ ID NO: 77394 - protein, 9 aa, Homo Sapiens
TLRQTITTF

SEQ ID NO: 77395 - protein, 9 aa, Homo Sapiens
TLSPTGDVY

SEQ ID NO: 77396 - protein, 9 aa, Homo Sapiens
TLSRETIEY

SEQ ID NO: 77397 - protein, 9 aa, Homo Sapiens
TLTAPSLSY

SEQ ID NO: 77398 - protein, 9 aa, Homo Sapiens
TLTDVAHEY

SEQ ID NO: 77399 - protein, 9 aa, Homo Sapiens
TLTPIIQEY

SEQ ID NO: 77400 - protein, 9 aa, Homo Sapiens
TLTPISAAY

SEQ ID NO: 77401 - protein, 9 aa, Homo Sapiens
TLTQGGVTY

SEQ ID NO: 77402 - protein, 9 aa, Homo Sapiens
TLVDNISTM

SEQ ID NO: 77403 - protein, 9 aa, Homo Sapiens
TLYETIIGY

SEQ ID NO: 77404 - protein, 9 aa, Homo Sapiens
TLYFSYTHM

SEQ ID NO: 77405 - protein, 9 aa, Homo Sapiens
TLYKAILEY

SEQ ID NO: 77406 - protein, 9 aa, Homo Sapiens
TLYPLHILF

SEQ ID NO: 77407 - protein, 9 aa, Homo Sapiens
TLYVGNLSF

SEQ ID NO: 77408 - protein, 9 aa, Homo Sapiens
TMADKIIMY

SEQ ID NO: 77409 - protein, 9 aa, Homo Sapiens
TMAPPVMAY

SEQ ID NO: 77410 - protein, 9 aa, Homo Sapiens
TMCGHELTY

SEQ ID NO: 77411 - protein, 9 aa, Homo Sapiens
TMCPHILRY

SEQ ID NO: 77412 - protein, 9 aa, Homo Sapiens
TMFSSEVQF

SEQ ID NO: 77413 - protein, 9 aa, Homo Sapiens
TMFVQRQVF

SEQ ID NO: 77414 - protein, 9 aa, Homo Sapiens
TMHASILAY

SEQ ID NO: 77415 - protein, 9 aa, Homo Sapiens
TMKDFNHSY

SEQ ID NO: 77416 - protein, 9 aa, Homo Sapiens
TMKPSETSF

SEQ ID NO: 77417 - protein, 9 aa, Homo Sapiens
TMMEDFRKY

SEQ ID NO: 77418 - protein, 9 aa, Homo Sapiens
TMMQSGGTF

SEQ ID NO: 77419 - protein, 9 aa, Homo Sapiens
TMRPLATAY

SEQ ID NO: 77420 - protein, 9 aa, Homo Sapiens
TMRQPSVIY

SEQ ID NO: 77421 - protein, 9 aa, Homo Sapiens
TMTSSVQVY

SEQ ID NO: 77422 - protein, 9 aa, Homo Sapiens
TMVGKTFTY

SEQ ID NO: 77423 - protein, 9 aa, Homo Sapiens
TMVNSENTY

SEQ ID NO: 77424 - protein, 9 aa, Homo Sapiens
TPAPGGSPY

SEQ ID NO: 77425 - protein, 9 aa, Homo Sapiens
TPYEGQRSY

SEQ ID NO: 77426 - protein, 9 aa, Homo Sapiens
TQAGEGRVY

SEQ ID NO: 77427 - protein, 9 aa, Homo Sapiens
TQAIHNTVF

SEQ ID NO: 77428 - protein, 9 aa, Homo Sapiens
TQALASVAY

SEQ ID NO: 77429 - protein, 9 aa, Homo Sapiens
TQAPIFISF

SEQ ID NO: 77430 - protein, 9 aa, Homo Sapiens
TQAQIKAAY

SEQ ID NO: 77431 - protein, 9 aa, Homo Sapiens
TQAQTTATY

SEQ ID NO: 77432 - protein, 9 aa, Homo Sapiens
TQAYGQQSY

SEQ ID NO: 77433 - protein, 9 aa, Homo Sapiens
TQFGGKRPF

SEQ ID NO: 77434 - protein, 9 aa, Homo Sapiens
TQFVSGSKY

SEQ ID NO: 77435 - protein, 9 aa, Homo Sapiens
TQILQSPAF

SEQ ID NO: 77436 - protein, 9 aa, Homo Sapiens
TQKEHLLKY

SEQ ID NO: 77437 - protein, 9 aa, Homo Sapiens
TQPLHEVVY

SEQ ID NO: 77438 - protein, 9 aa, Homo Sapiens
TQRDFMLSF

SEQ ID NO: 77439 - protein, 9 aa, Homo Sapiens
TQREFMLSF

SEQ ID NO: 77440 - protein, 9 aa, Homo Sapiens
TQRLKIMEY

SEQ ID NO: 77441 - protein, 9 aa, Homo Sapiens
TQRMFEIDY

SEQ ID NO: 77442 - protein, 9 aa, Homo Sapiens
TQRSQQLEF

SEQ ID NO: 77443 - protein, 9 aa, Homo Sapiens
TQVIHSIEY

SEQ ID NO: 77444 - protein, 9 aa, Homo Sapiens
TQYESKVFY

SEQ ID NO: 77445 - protein, 9 aa, Homo Sapiens
TSAPTGHTF

SEQ ID NO: 77446 - protein, 9 aa, Homo Sapiens
TTAPSHAKF

SEQ ID NO: 77447 - protein, 9 aa, Homo Sapiens
TTEEVCRIY

SEQ ID NO: 77448 - protein, 9 aa, Homo Sapiens
TTKDGDTVF

SEQ ID NO: 77449 - protein, 9 aa, Homo Sapiens
TVAPAQVAL

SEQ ID NO: 77450 - protein, 9 aa, Homo Sapiens
TVETASREY

SEQ ID NO: 77451 - protein, 9 aa, Homo Sapiens
TVFSRSQVF

SEQ ID NO: 77452 - protein, 9 aa, Homo Sapiens
TVFSRSQVY

SEQ ID NO: 77453 - protein, 9 aa, Homo Sapiens
TVHGVTQAF

SEQ ID NO: 77454 - protein, 9 aa, Homo Sapiens
TVHQVTEAF

SEQ ID NO: 77455 - protein, 9 aa, Homo Sapiens
TVIDSQTHY

SEQ ID NO: 77456 - protein, 9 aa, Homo Sapiens
TVIEPLKGY

SEQ ID NO: 77457 - protein, 9 aa, Homo Sapiens
TVIPNSHVY

SEQ ID NO: 77458 - protein, 9 aa, Homo Sapiens
TVIPRVYTY

SEQ ID NO: 77459 - protein, 9 aa, Homo Sapiens
TVKDSRTVY

SEQ ID NO: 77460 - protein, 9 aa, Homo Sapiens
TVKPEDLEL

SEQ ID NO: 77461 - protein, 9 aa, Homo Sapiens
TVKQEDSLF

SEQ ID NO: 77462 - protein, 9 aa, Homo Sapiens
TVKVEDLTF

SEQ ID NO: 77463 - protein, 9 aa, Homo Sapiens
TVKVFNTVY

SEQ ID NO: 77464 - protein, 9 aa, Homo Sapiens
TVLPFSQEF

SEQ ID NO: 77465 - protein, 9 aa, Homo Sapiens
TVLQAVSAF

SEQ ID NO: 77466 - protein, 9 aa, Homo Sapiens
TVMGTSTEY

SEQ ID NO: 77467 - protein, 9 aa, Homo Sapiens
TVNQFLTQY

SEQ ID NO: 77468 - protein, 9 aa, Homo Sapiens
TVRAEDQVY

SEQ ID NO: 77469 - protein, 9 aa, Homo Sapiens
TVRDSDSGL

SEQ ID NO: 77470 - protein, 9 aa, Homo Sapiens
TVRDYEHQF

SEQ ID NO: 77471 - protein, 9 aa, Homo Sapiens
TVREEFIIF

SEQ ID NO: 77472 - protein, 9 aa, Homo Sapiens
TVRETQTMY

SEQ ID NO: 77473 - protein, 9 aa, Homo Sapiens
TVRHGTVRY

SEQ ID NO: 77474 - protein, 9 aa, Homo Sapiens
TVRNEDNSL

SEQ ID NO: 77475 - protein, 9 aa, Homo Sapiens
TVRSDLSTF

SEQ ID NO: 77476 - protein, 9 aa, Homo Sapiens
TVSDAILRY

SEQ ID NO: 77477 - protein, 9 aa, Homo Sapiens
TVSEEKRIY

SEQ ID NO: 77478 - protein, 9 aa, Homo Sapiens
TVSPAHTSY

SEQ ID NO: 77479 - protein, 9 aa, Homo Sapiens
TVSQPNLKY

SEQ ID NO: 77480 - protein, 9 aa, Homo Sapiens
TVTEVLLKY

SEQ ID NO: 77481 - protein, 9 aa, Homo Sapiens
TVTIPSAVY

SEQ ID NO: 77482 - protein, 9 aa, Homo Sapiens
TVVDVLTSY

SEQ ID NO: 77483 - protein, 9 aa, Homo Sapiens
TVYDKPASF

SEQ ID NO: 77484 - protein, 9 aa, Homo Sapiens
TVYMGKVTF

SEQ ID NO: 77485 - protein, 9 aa, Homo Sapiens
TVYPVAIKY

SEQ ID NO: 77486 - protein, 9 aa, Homo Sapiens
VIFAGGQAY

SEQ ID NO: 77487 - protein, 9 aa, Homo Sapiens
VILPPLSPY

SEQ ID NO: 77488 - protein, 9 aa, Homo Sapiens
VIRQQCVEY

SEQ ID NO: 77489 - protein, 9 aa, Homo Sapiens
VLFEGDEVY

SEQ ID NO: 77490 - protein, 9 aa, Homo Sapiens
VLFEHAVGY

SEQ ID NO: 77491 - protein, 9 aa, Homo Sapiens
VLIDVGTGY

SEQ ID NO: 77492 - protein, 9 aa, Homo Sapiens
VLYDRVLKY

SEQ ID NO: 77493 - protein, 9 aa, Homo Sapiens
VLYPHLSTY

SEQ ID NO: 77494 - protein, 9 aa, Homo Sapiens
VPAEHQVAM

SEQ ID NO: 77495 - protein, 9 aa, Homo Sapiens
VPRIQLEEY

SEQ ID NO: 77496 - protein, 9 aa, Homo Sapiens
VPRSGDRVY

SEQ ID NO: 77497 - protein, 9 aa, Homo Sapiens
VPYCSVVCF

SEQ ID NO: 77498 - protein, 9 aa, Homo Sapiens
VQYEMRTLY

SEQ ID NO: 77499 - protein, 9 aa, Homo Sapiens
VTIKKDVDG

SEQ ID NO: 77500 - protein, 9 aa, Homo Sapiens
VVAPITTGY

SEQ ID NO: 77501 - protein, 9 aa, Homo Sapiens
WLHETERVY

SEQ ID NO: 77502 - protein, 9 aa, Homo Sapiens
WVLETKEVY

SEQ ID NO: 77503 - protein, 9 aa, Homo Sapiens
YFYVIGSSY

SEQ ID NO: 77504 - protein, 9 aa, Homo Sapiens
YIFKERESF

SEQ ID NO: 77505 - protein, 9 aa, Homo Sapiens
YILDQTNVY

SEQ ID NO: 77506 - protein, 9 aa, Homo Sapiens
YIRDLALEY

SEQ ID NO: 77507 - protein, 9 aa, Homo Sapiens
YIRGSTIKY

SEQ ID NO: 77508 - protein, 9 aa, Homo Sapiens
YIRQGEQSL

SEQ ID NO: 77509 - protein, 9 aa, Homo Sapiens
YISFRHHVY

SEQ ID NO: 77510 - protein, 9 aa, Homo Sapiens
YIYPKHLKY

SEQ ID NO: 77511 - protein, 9 aa, Homo Sapiens
YIYTTKTLY

SEQ ID NO: 77512 - protein, 9 aa, Homo Sapiens
YLAVVHAVY

SEQ ID NO: 77513 - protein, 9 aa, Homo Sapiens
YLFAHAVDF

SEQ ID NO: 77514 - protein, 9 aa, Homo Sapiens
YLFEWRTQY

SEQ ID NO: 77515 - protein, 9 aa, Homo Sapiens
YLGEFSITY

SEQ ID NO: 77516 - protein, 9 aa, Homo Sapiens
YLIDRDPTY

SEQ ID NO: 77517 - protein, 9 aa, Homo Sapiens
YLISGGTSY

SEQ ID NO: 77518 - protein, 9 aa, Homo Sapiens
YLLPDTKAY

SEQ ID NO: 77519 - protein, 9 aa, Homo Sapiens
YLLPHILVY

SEQ ID NO: 77520 - protein, 9 aa, Homo Sapiens
YLNEKAVSY

SEQ ID NO: 77521 - protein, 9 aa, Homo Sapiens
YLNQTSRSF

SEQ ID NO: 77522 - protein, 9 aa, Homo Sapiens
YLREEVKTF

SEQ ID NO: 77523 - protein, 9 aa, Homo Sapiens
YLRELLTTM

SEQ ID NO: 77524 - protein, 9 aa, Homo Sapiens
YLRKEDMEY

SEQ ID NO: 77525 - protein, 9 aa, Homo Sapiens
YLVKKGSVF

SEQ ID NO: 77526 - protein, 9 aa, Homo Sapiens
YLYGQTTTY

SEQ ID NO: 77527 - protein, 9 aa, Homo Sapiens
YLYLRGLVY

SEQ ID NO: 77528 - protein, 9 aa, Homo Sapiens
YLYPDGRSY

SEQ ID NO: 77529 - protein, 9 aa, Homo Sapiens
YLYPDQTHF

SEQ ID NO: 77530 - protein, 9 aa, Homo Sapiens
YMFVDENTF

SEQ ID NO: 77531 - protein, 9 aa, Homo Sapiens
YMKSEDPLF

SEQ ID NO: 77532 - protein, 9 aa, Homo Sapiens
YMRDPDDQY

SEQ ID NO: 77533 - protein, 9 aa, Homo Sapiens
YMYRHKGTY

SEQ ID NO: 77534 - protein, 9 aa, Homo Sapiens
YPHDRPTLY

SEQ ID NO: 77535 - protein, 9 aa, Homo Sapiens
YPHEPTAVF

SEQ ID NO: 77536 - protein, 9 aa, Homo Sapiens
YPKANIVAY

SEQ ID NO: 77537 - protein, 9 aa, Homo Sapiens
YPRPRDTSF

SEQ ID NO: 77538 - protein, 9 aa, Homo Sapiens
YPSIHITAY

SEQ ID NO: 77539 - protein, 9 aa, Homo Sapiens
YPTQPGQGY

SEQ ID NO: 77540 - protein, 9 aa, Homo Sapiens
YPWSQRVSF

SEQ ID NO: 77541 - protein, 9 aa, Homo Sapiens
YPYPYPHTL

SEQ ID NO: 77542 - protein, 9 aa, Homo Sapiens
YQEKGVRVL

SEQ ID NO: 77543 - protein, 9 aa, Homo Sapiens
YQHGHINSY

SEQ ID NO: 77544 - protein, 9 aa, Homo Sapiens
YQRDLEVAL

SEQ ID NO: 77545 - protein, 9 aa, Homo Sapiens
YTAQPTQGY

SEQ ID NO: 77546 - protein, 9 aa, Homo Sapiens
YTGPSHHSY

SEQ ID NO: 77547 - protein, 9 aa, Homo Sapiens
YVAPAYGVY

SEQ ID NO: 77548 - protein, 9 aa, Homo Sapiens
YVAPEILSY

SEQ ID NO: 77549 - protein, 9 aa, Homo Sapiens
YVFQSENTF

SEQ ID NO: 77550 - protein, 9 aa, Homo Sapiens
YVHETLTVY

SEQ ID NO: 77551 - protein, 9 aa, Homo Sapiens
YVHTTVNEM

SEQ ID NO: 77552 - protein, 9 aa, Homo Sapiens
YVNSPGEKY

SEQ ID NO: 77553 - protein, 9 aa, Homo Sapiens
YVRDSKIRY

SEQ ID NO: 77554 - protein, 9 aa, Homo Sapiens
YVRPAEPAF

SEQ ID NO: 77555 - protein, 9 aa, Homo Sapiens
YVTTSTRTY

SEQ ID NO: 77556 - protein, 9 aa, Homo Sapiens
YVYPKYLKY

SEQ ID NO: 77557 - protein, 9 aa, Homo Sapiens
YVYPLQLKY

SEQ ID NO: 77558 - protein, 9 aa, Homo Sapiens
YVYSHFLQF

SEQ ID NO: 77559 - protein, 10 aa, Homo Sapiens
AAGPPISEGK

SEQ ID NO: 77560 - protein, 10 aa, Homo Sapiens
AGHINPLIIY

SEQ ID NO: 77561 - protein, 10 aa, Homo Sapiens
ALAPALVETY

SEQ ID NO: 77562 - protein, 10 aa, Homo Sapiens
ANAGAILSQF

SEQ ID NO: 77563 - protein, 10 aa, Homo Sapiens
AVDSRTGKLT

SEQ ID NO: 77564 - protein, 10 aa, Homo Sapiens
DIAAVPATAM

SEQ ID NO: 77565 - protein, 10 aa, Homo Sapiens
DMHSGHFVTY

SEQ ID NO: 77566 - protein, 10 aa, Homo Sapiens
DPYGSGGQKF

SEQ ID NO: 77567 - protein, 10 aa, Homo Sapiens
DQVKELLTSF

SEQ ID NO: 77568 - protein, 10 aa, Homo Sapiens
DQYLGHLQQY

SEQ ID NO: 77569 - protein, 10 aa, Homo Sapiens
DTGRPSTTVR

SEQ ID NO: 77570 - protein, 10 aa, Homo Sapiens
DVYCPVQWEY

SEQ ID NO: 77571 - protein, 10 aa, Homo Sapiens
EEPIYIITEY

SEQ ID NO: 77572 - protein, 10 aa, Homo Sapiens
EFMPASRSEY

SEQ ID NO: 77573 - protein, 10 aa, Homo Sapiens
EHVVVPIVAF

SEQ ID NO: 77574 - protein, 10 aa, Homo Sapiens
EIYGGSDSRF

SEQ ID NO: 77575 - protein, 10 aa, Homo Sapiens
ELAPTLLTAM

SEQ ID NO: 77576 - protein, 10 aa, Homo Sapiens
ELAQTTRTAY

SEQ ID NO: 77577 - protein, 10 aa, Homo Sapiens
ELFMSSFQSY

SEQ ID NO: 77578 - protein, 10 aa, Homo Sapiens
ELRDNDKTRY

SEQ ID NO: 77579 - protein, 10 aa, Homo Sapiens
ELYYGGHLCY

SEQ ID NO: 77580 - protein, 10 aa, Homo Sapiens
EMYNRPVEVY

SEQ ID NO: 77581 - protein, 10 aa, Homo Sapiens
EQAPAPARPY

SEQ ID NO: 77582 - protein, 10 aa, Homo Sapiens
EQIRNQLTAM

SEQ ID NO: 77583 - protein, 10 aa, Homo Sapiens
EVAPVISSAY

SEQ ID NO: 77584 - protein, 10 aa, Homo Sapiens
EVFMHVSTAY

SEQ ID NO: 77585 - protein, 10 aa, Homo Sapiens
EVRLQNETSY

SEQ ID NO: 77586 - protein, 10 aa, Homo Sapiens
FLHPFPSESY

SEQ ID NO: 77587 - protein, 10 aa, Homo Sapiens
FLWAGGRASY

SEQ ID NO: 77588 - protein, 10 aa, Homo Sapiens
FLWQEGHSAF

SEQ ID NO: 77589 - protein, 10 aa, Homo Sapiens
FMRQAGEVTY

SEQ ID NO: 77590 - protein, 10 aa, Homo Sapiens
FPHNFQETTY

SEQ ID NO: 77591 - protein, 10 aa, Homo Sapiens
FPYDYSASEY

SEQ ID NO: 77592 - protein, 10 aa, Homo Sapiens
FQYDDSGNTF

SEQ ID NO: 77593 - protein, 10 aa, Homo Sapiens
FVYEVTSTKY

SEQ ID NO: 77594 - protein, 10 aa, Homo Sapiens
GAGGGFGSRS

SEQ ID NO: 77595 - protein, 10 aa, Homo Sapiens
GGGLSVSSSR

SEQ ID NO: 77596 - protein, 10 aa, Homo Sapiens
GLFQHICTAY

SEQ ID NO: 77597 - protein, 10 aa, Homo Sapiens
HAFGGNKASY

SEQ ID NO: 77598 - protein, 10 aa, Homo Sapiens
HIAEEADRKY

SEQ ID NO: 77599 - protein, 10 aa, Homo Sapiens
HIKPGAKVLY

SEQ ID NO: 77600 - protein, 10 aa, Homo Sapiens
HIYDKTSVLF

SEQ ID NO: 77601 - protein, 10 aa, Homo Sapiens
HIYTFPHASF

SEQ ID NO: 77602 - protein, 10 aa, Homo Sapiens
HLAEDCMKHY

SEQ ID NO: 77603 - protein, 10 aa, Homo Sapiens
HLDPNSGRCF

SEQ ID NO: 77604 - protein, 10 aa, Homo Sapiens
HLFEHILNGY

SEQ ID NO: 77605 - protein, 10 aa, Homo Sapiens
HLFGQPNSAY

SEQ ID NO: 77606 - protein, 10 aa, Homo Sapiens
HLIDDYGNTY

SEQ ID NO: 77607 - protein, 10 aa, Homo Sapiens
HLIEAHKECM

SEQ ID NO: 77608 - protein, 10 aa, Homo Sapiens
HLITFETEVY

SEQ ID NO: 77609 - protein, 10 aa, Homo Sapiens
HLLAGGFAEF

SEQ ID NO: 77610 - protein, 10 aa, Homo Sapiens
HLLDSVGSCY

SEQ ID NO: 77611 - protein, 10 aa, Homo Sapiens
HLLPYNMTVY

SEQ ID NO: 77612 - protein, 10 aa, Homo Sapiens
HLPAYLVAAF

SEQ ID NO: 77613 - protein, 10 aa, Homo Sapiens
HLPLLPNVSY

SEQ ID NO: 77614 - protein, 10 aa, Homo Sapiens
HLRDERDICF

SEQ ID NO: 77615 - protein, 10 aa, Homo Sapiens
HLYDTPGSTY

SEQ ID NO: 77616 - protein, 10 aa, Homo Sapiens
HLYPNTPYAY

SEQ ID NO: 77617 - protein, 10 aa, Homo Sapiens
HMREAGDVCY

SEQ ID NO: 77618 - protein, 10 aa, Homo Sapiens
HPIEGSTTVF

SEQ ID NO: 77619 - protein, 10 aa, Homo Sapiens
HQAACLIQAY

SEQ ID NO: 77620 - protein, 10 aa, Homo Sapiens
HQLRAQILAY

SEQ ID NO: 77621 - protein, 10 aa, Homo Sapiens
HQLRAQIMAY

SEQ ID NO: 77622 - protein, 10 aa, Homo Sapiens
HQPLHVTKGY

SEQ ID NO: 77623 - protein, 10 aa, Homo Sapiens
HVAPVTSVEW

SEQ ID NO: 77624 - protein, 10 aa, Homo Sapiens
HVASCGVNLY

SEQ ID NO: 77625 - protein, 10 aa, Homo Sapiens
HVKDANGNSF

SEQ ID NO: 77626 - protein, 10 aa, Homo Sapiens
HVNPYIGLFF

SEQ ID NO: 77627 - protein, 10 aa, Homo Sapiens
HVYPAGSQVM

SEQ ID NO: 77628 - protein, 10 aa, Homo Sapiens
IGQSKSVKIY

SEQ ID NO: 77629 - protein, 10 aa, Homo Sapiens
IMRECQEESF

SEQ ID NO: 77630 - protein, 10 aa, Homo Sapiens
LLYPYEQAQY

SEQ ID NO: 77631 - protein, 10 aa, Homo Sapiens
LPFPGRSASY

SEQ ID NO: 77632 - protein, 10 aa, Homo Sapiens
MAYGASFLSF

SEQ ID NO: 77633 - protein, 10 aa, Homo Sapiens
MILTVGGTAY

SEQ ID NO: 77634 - protein, 10 aa, Homo Sapiens
MLIHEPFKKY

SEQ ID NO: 77635 - protein, 10 aa, Homo Sapiens
MLPHYEPIPF

SEQ ID NO: 77636 - protein, 10 aa, Homo Sapiens
MQKPFEDASF

SEQ ID NO: 77637 - protein, 10 aa, Homo Sapiens
MQYPGRSLVF

SEQ ID NO: 77638 - protein, 10 aa, Homo Sapiens
MVKVDPETRY

SEQ ID NO: 77639 - protein, 10 aa, Homo Sapiens
MVNPFAYEEY

SEQ ID NO: 77640 - protein, 10 aa, Homo Sapiens
NIKNDPDKEY

SEQ ID NO: 77641 - protein, 10 aa, Homo Sapiens
NIRNEIGVFY

SEQ ID NO: 77642 - protein, 10 aa, Homo Sapiens
NLFGGEPLSY

SEQ ID NO: 77643 - protein, 10 aa, Homo Sapiens
NLKDADSTEF

SEQ ID NO: 77644 - protein, 10 aa, Homo Sapiens
NLPDEIYHVY

SEQ ID NO: 77645 - protein, 10 aa, Homo Sapiens
NLPVPSGVAF

SEQ ID NO: 77646 - protein, 10 aa, Homo Sapiens
NMQLPNGVTY

SEQ ID NO: 77647 - protein, 10 aa, Homo Sapiens
NQRTDLGTSY

SEQ ID NO: 77648 - protein, 10 aa, Homo Sapiens
NVVQPMKELY

SEQ ID NO: 77649 - protein, 10 aa, Homo Sapiens
NVYTHSFLCY

SEQ ID NO: 77650 - protein, 10 aa, Homo Sapiens
PHIHARVYNY

SEQ ID NO: 77651 - protein, 10 aa, Homo Sapiens
QAGPATGQAY

SEQ ID NO: 77652 - protein, 10 aa, Homo Sapiens
QCFPFETSSY

SEQ ID NO: 77653 - protein, 10 aa, Homo Sapiens
QFYDNKGITY

SEQ ID NO: 77654 - protein, 10 aa, Homo Sapiens
QLYDKQREEY

SEQ ID NO: 77655 - protein, 10 aa, Homo Sapiens
QLYQENKREY

SEQ ID NO: 77656 - protein, 10 aa, Homo Sapiens
QMPPWNQTEF

SEQ ID NO: 77657 - protein, 10 aa, Homo Sapiens
QVAENPHSEY

SEQ ID NO: 77658 - protein, 10 aa, Homo Sapiens
RQGVDADING

SEQ ID NO: 77659 - protein, 10 aa, Homo Sapiens
SIAPGLSVTY

SEQ ID NO: 77660 - protein, 10 aa, Homo Sapiens
SIRPDNMSEY

SEQ ID NO: 77661 - protein, 10 aa, Homo Sapiens
SLFGSSRVQY

SEQ ID NO: 77662 - protein, 10 aa, Homo Sapiens
SLFHGGKSHY

SEQ ID NO: 77663 - protein, 10 aa, Homo Sapiens
SLLEGQKIAF

SEQ ID NO: 77664 - protein, 10 aa, Homo Sapiens
SLPDYRAATY

SEQ ID NO: 77665 - protein, 10 aa, Homo Sapiens
SLPNFKQNEF

SEQ ID NO: 77666 - protein, 10 aa, Homo Sapiens
SLPPGVHISY

SEQ ID NO: 77667 - protein, 10 aa, Homo Sapiens
SLPQYSPVTF

SEQ ID NO: 77668 - protein, 10 aa, Homo Sapiens
SLPSHLNISY

SEQ ID NO: 77669 - protein, 10 aa, Homo Sapiens
SLRDEKGALF

SEQ ID NO: 77670 - protein, 10 aa, Homo Sapiens
SLRDSRSLSY

SEQ ID NO: 77671 - protein, 10 aa, Homo Sapiens
SLRGTSDHEY

SEQ ID NO: 77672 - protein, 10 aa, Homo Sapiens
SLRKAIETVY

SEQ ID NO: 77673 - protein, 10 aa, Homo Sapiens
SLRPIDSNTF

SEQ ID NO: 77674 - protein, 10 aa, Homo Sapiens
SLTEYPRETF

SEQ ID NO: 77675 - protein, 10 aa, Homo Sapiens
SLYECRYSVF

SEQ ID NO: 77676 - protein, 10 aa, Homo Sapiens
SMAYPSLVAM

SEQ ID NO: 77677 - protein, 10 aa, Homo Sapiens
SQLEHLQSKY

SEQ ID NO: 77678 - protein, 10 aa, Homo Sapiens
SQQPASGVAY

SEQ ID NO: 77679 - protein, 10 aa, Homo Sapiens
SQRPPTRETF

SEQ ID NO: 77680 - protein, 10 aa, Homo Sapiens
SQVDPPTTTM

SEQ ID NO: 77681 - protein, 10 aa, Homo Sapiens
SQYNIRGVTY

SEQ ID NO: 77682 - protein, 10 aa, Homo Sapiens
SQYPFPVTLY

SEQ ID NO: 77683 - protein, 10 aa, Homo Sapiens
SSKPWPDATY

SEQ ID NO: 77684 - protein, 10 aa, Homo Sapiens
SVAEITNACF

SEQ ID NO: 77685 - protein, 10 aa, Homo Sapiens
SVMINKATPY

SEQ ID NO: 77686 - protein, 10 aa, Homo Sapiens
SYGGGSGGGF

SEQ ID NO: 77687 - protein, 10 aa, Homo Sapiens
TCVTTSGSTY

SEQ ID NO: 77688 - protein, 10 aa, Homo Sapiens
TFARVPVATY

SEQ ID NO: 77689 - protein, 10 aa, Homo Sapiens
TILGPPGSVY

SEQ ID NO: 77690 - protein, 10 aa, Homo Sapiens
TIRREDLISF

SEQ ID NO: 77691 - protein, 10 aa, Homo Sapiens
TISDHGTVTY

SEQ ID NO: 77692 - protein, 10 aa, Homo Sapiens
TITDVPVTVY

SEQ ID NO: 77693 - protein, 10 aa, Homo Sapiens
TIYESKMIEY

SEQ ID NO: 77694 - protein, 10 aa, Homo Sapiens
TLFDSRHLLY

SEQ ID NO: 77695 - protein, 10 aa, Homo Sapiens
TLFELHRTTF

SEQ ID NO: 77696 - protein, 10 aa, Homo Sapiens
TLKSGDGITF

SEQ ID NO: 77697 - protein, 10 aa, Homo Sapiens
TLPGHIQAVY

SEQ ID NO: 77698 - protein, 10 aa, Homo Sapiens
TLPTLPAKVY

SEQ ID NO: 77699 - protein, 10 aa, Homo Sapiens
TLQRATGISF

SEQ ID NO: 77700 - protein, 10 aa, Homo Sapiens
TLRSEGFDTY

SEQ ID NO: 77701 - protein, 10 aa, Homo Sapiens
TLYQPSATSY

SEQ ID NO: 77702 - protein, 10 aa, Homo Sapiens
TQPDWIAICY

SEQ ID NO: 77703 - protein, 10 aa, Homo Sapiens
TVCPEGARVY

SEQ ID NO: 77704 - protein, 10 aa, Homo Sapiens
TVIPNSHVYY

SEQ ID NO: 77705 - protein, 10 aa, Homo Sapiens
TVKGVSLSSY

SEQ ID NO: 77706 - protein, 10 aa, Homo Sapiens
TVLRLPVEAF

SEQ ID NO: 77707 - protein, 10 aa, Homo Sapiens
TVRGPPDSDF

SEQ ID NO: 77708 - protein, 10 aa, Homo Sapiens
TVVEPYNATL

SEQ ID NO: 77709 - protein, 10 aa, Homo Sapiens
VLPAALAVYM

SEQ ID NO: 77710 - protein, 10 aa, Homo Sapiens
VTIKKDVDGA

SEQ ID NO: 77711 - protein, 10 aa, Homo Sapiens
YDAEISQIHQ

SEQ ID NO: 77712 - protein, 10 aa, Homo Sapiens
YIFPSSISAM

SEQ ID NO: 77713 - protein, 10 aa, Homo Sapiens
YINPAKLTPY

SEQ ID NO: 77714 - protein, 10 aa, Homo Sapiens
YINPYQPNEY

SEQ ID NO: 77715 - protein, 10 aa, Homo Sapiens
YLFQGRQECY

SEQ ID NO: 77716 - protein, 10 aa, Homo Sapiens
YLRESSLLAY

SEQ ID NO: 77717 - protein, 10 aa, Homo Sapiens
YLRPGQAAAF

SEQ ID NO: 77718 - protein, 10 aa, Homo Sapiens
YMIDPSGVSY

SEQ ID NO: 77719 - protein, 10 aa, Homo Sapiens
YMIERPEPEF

SEQ ID NO: 77720 - protein, 10 aa, Homo Sapiens
YMNPYQLNAY

SEQ ID NO: 77721 - protein, 10 aa, Homo Sapiens
YPYPYPHTLY

SEQ ID NO: 77722 - protein, 10 aa, Homo Sapiens
YVHDDGRVSY

SEQ ID NO: 77723 - protein, 10 aa, Homo Sapiens
YVNCGHVTAY

SEQ ID NO: 77724 - protein, 11 aa, Homo Sapiens
DLRRERDSASF

SEQ ID NO: 77725 - protein, 11 aa, Homo Sapiens
ELRAPCLPVTY

SEQ ID NO: 77726 - protein, 11 aa, Homo Sapiens
ELRAPVAGTCY

SEQ ID NO: 77727 - protein, 11 aa, Homo Sapiens
EQIYPVNAISF

SEQ ID NO: 77728 - protein, 11 aa, Homo Sapiens
EVLMLLPPAHY

SEQ ID NO: 77729 - protein, 11 aa, Homo Sapiens
FIFREGDGVYY

SEQ ID NO: 77730 - protein, 11 aa, Homo Sapiens
FLTAAKKARAG

SEQ ID NO: 77731 - protein, 11 aa, Homo Sapiens
FVAPSRPFVVY

SEQ ID NO: 77732 - protein, 11 aa, Homo Sapiens
GLGSGGSIRSS

SEQ ID NO: 77733 - protein, 11 aa, Homo Sapiens
HLYGLGSGSSY

SEQ ID NO: 77734 - protein, 11 aa, Homo Sapiens
HVRAELPSSHY

SEQ ID NO: 77735 - protein, 11 aa, Homo Sapiens
HVRPVTQGDVY

SEQ ID NO: 77736 - protein, 11 aa, Homo Sapiens
IAKNRKDIENQ

SEQ ID NO: 77737 - protein, 11 aa, Homo Sapiens
LQHDFGHLSVF

SEQ ID NO: 77738 - protein, 11 aa, Homo Sapiens
NIFHPTDPVAY

SEQ ID NO: 77739 - protein, 11 aa, Homo Sapiens
NIYHPLDPVAY

SEQ ID NO: 77740 - protein, 11 aa, Homo Sapiens
NLRGTTEGVYY

SEQ ID NO: 77741 - protein, 11 aa, Homo Sapiens
NLRSPNNFLSY

SEQ ID NO: 77742 - protein, 11 aa, Homo Sapiens
REEPIYIITEY

SEQ ID NO: 77743 - protein, 11 aa, Homo Sapiens
RQGVDADINGL

SEQ ID NO: 77744 - protein, 11 aa, Homo Sapiens
SEHVHSQGRVM

SEQ ID NO: 77745 - protein, 11 aa, Homo Sapiens
SINPLGGFVHY

SEQ ID NO: 77746 - protein, 11 aa, Homo Sapiens
SIYPGNSDTRY

SEQ ID NO: 77747 - protein, 11 aa, Homo Sapiens
SLYASSPGGVY

SEQ ID NO: 77748 - protein, 11 aa, Homo Sapiens
SQRAVTNHSVY

SEQ ID NO: 77749 - protein, 11 aa, Homo Sapiens
TLFGNNKLTTF

SEQ ID NO: 77750 - protein, 11 aa, Homo Sapiens
TLKEEVNELQY

SEQ ID NO: 77751 - protein, 11 aa, Homo Sapiens
TLQDSRTNTAY

SEQ ID NO: 77752 - protein, 11 aa, Homo Sapiens
TLWVDPYEVSY

SEQ ID NO: 77753 - protein, 11 aa, Homo Sapiens
TLYPGQGNNSY

SEQ ID NO: 77754 - protein, 11 aa, Homo Sapiens
TQFINPETPGY

SEQ ID NO: 77755 - protein, 11 aa, Homo Sapiens
TQYERFIPSAY

SEQ ID NO: 77756 - protein, 11 aa, Homo Sapiens
TVAPPVPATPY

SEQ ID NO: 77757 - protein, 11 aa, Homo Sapiens
VTIKKDVDGAY

SEQ ID NO: 77758 - protein, 11 aa, Homo Sapiens
YDKKGPAAIQK

SEQ ID NO: 77759 - protein, 11 aa, Homo Sapiens
YIRPEGQDSAF

SEQ ID NO: 77760 - protein, 11 aa, Homo Sapiens
YLFEPHSGEEY

SEQ ID NO: 77761 - protein, 11 aa, Homo Sapiens
YMCPNSSTVEY

SEQ ID NO: 77762 - protein, 11 aa, Homo Sapiens
YQAELSQMQTQ

SEQ ID NO: 77763 - protein, 8 aa, Homo Sapiens
AGYTARVY

SEQ ID NO: 77764 - protein, 8 aa, Homo Sapiens
AKANPQVL

SEQ ID NO: 77765 - protein, 8 aa, Homo Sapiens
AKAPSRMY

SEQ ID NO: 77766 - protein, 8 aa, Homo Sapiens
AKFKSSIY

SEQ ID NO: 77767 - protein, 8 aa, Homo Sapiens
AKFVTKAY

SEQ ID NO: 77768 - protein, 8 aa, Homo Sapiens
AKGWAPTF

SEQ ID NO: 77769 - protein, 8 aa, Homo Sapiens
AKHIFKTY

SEQ ID NO: 77770 - protein, 8 aa, Homo Sapiens
AKIKPNIF

SEQ ID NO: 77771 - protein, 8 aa, Homo Sapiens
AKILPIMF

SEQ ID NO: 77772 - protein, 8 aa, Homo Sapiens
AKSVTCTY

SEQ ID NO: 77773 - protein, 8 aa, Homo Sapiens
AKTNTVSY

SEQ ID NO: 77774 - protein, 8 aa, Homo Sapiens
AQFLFGHY

SEQ ID NO: 77775 - protein, 8 aa, Homo Sapiens
AQGVILVY

SEQ ID NO: 77776 - protein, 8 aa, Homo Sapiens
AQILLKAL

SEQ ID NO: 77777 - protein, 8 aa, Homo Sapiens
AQKTSLRY

SEQ ID NO: 77778 - protein, 8 aa, Homo Sapiens
AQRASVAF

SEQ ID NO: 77779 - protein, 8 aa, Homo Sapiens
AQRHVLTY

SEQ ID NO: 77780 - protein, 8 aa, Homo Sapiens
AQRKFRPY

SEQ ID NO: 77781 - protein, 8 aa, Homo Sapiens
AQRLVRVL

SEQ ID NO: 77782 - protein, 8 aa, Homo Sapiens
AQRPTATY

SEQ ID NO: 77783 - protein, 8 aa, Homo Sapiens
AQRQDIAF

SEQ ID NO: 77784 - protein, 8 aa, Homo Sapiens
AQVKLLEF

SEQ ID NO: 77785 - protein, 8 aa, Homo Sapiens
EEQLQQIR

SEQ ID NO: 77786 - protein, 8 aa, Homo Sapiens
FKIHPMAY

SEQ ID NO: 77787 - protein, 8 aa, Homo Sapiens
FKKGDRVF

SEQ ID NO: 77788 - protein, 8 aa, Homo Sapiens
FKVKSHVY

SEQ ID NO: 77789 - protein, 8 aa, Homo Sapiens
FQFLPHAY

SEQ ID NO: 77790 - protein, 8 aa, Homo Sapiens
FQHVGKAF

SEQ ID NO: 77791 - protein, 8 aa, Homo Sapiens
FQKVITEY

SEQ ID NO: 77792 - protein, 8 aa, Homo Sapiens
FQMEQIVY

SEQ ID NO: 77793 - protein, 8 aa, Homo Sapiens
FQTTISKY

SEQ ID NO: 77794 - protein, 8 aa, Homo Sapiens
FQYLSKTY

SEQ ID NO: 77795 - protein, 8 aa, Homo Sapiens
GAEAKPAE

SEQ ID NO: 77796 - protein, 8 aa, Homo Sapiens
GKIRHLCF

SEQ ID NO: 77797 - protein, 8 aa, Homo Sapiens
GKLISVEY

SEQ ID NO: 77798 - protein, 8 aa, Homo Sapiens
GKLVQIEY

SEQ ID NO: 77799 - protein, 8 aa, Homo Sapiens
GKSKGIAY

SEQ ID NO: 77800 - protein, 8 aa, Homo Sapiens
GKWMGIAF

SEQ ID NO: 77801 - protein, 8 aa, Homo Sapiens
GQGFALVY

SEQ ID NO: 77802 - protein, 8 aa, Homo Sapiens
GQHPALSY

SEQ ID NO: 77803 - protein, 8 aa, Homo Sapiens
GQHVFLVY

SEQ ID NO: 77804 - protein, 8 aa, Homo Sapiens
GQITHIQY

SEQ ID NO: 77805 - protein, 8 aa, Homo Sapiens
GQRVIGHY

SEQ ID NO: 77806 - protein, 8 aa, Homo Sapiens
GQRVISMY

SEQ ID NO: 77807 - protein, 8 aa, Homo Sapiens
GQRYIQFY

SEQ ID NO: 77808 - protein, 8 aa, Homo Sapiens
GQTLFAGY

SEQ ID NO: 77809 - protein, 8 aa, Homo Sapiens
GQYLFCRY

SEQ ID NO: 77810 - protein, 8 aa, Homo Sapiens
GQYTGHEY

SEQ ID NO: 77811 - protein, 8 aa, Homo Sapiens
HGHLSAVY

SEQ ID NO: 77812 - protein, 8 aa, Homo Sapiens
HHLVARVY

SEQ ID NO: 77813 - protein, 8 aa, Homo Sapiens
HHYLISIY

SEQ ID NO: 77814 - protein, 8 aa, Homo Sapiens
HKVSPMLY

SEQ ID NO: 77815 - protein, 8 aa, Homo Sapiens
HQFLQNEY

SEQ ID NO: 77816 - protein, 8 aa, Homo Sapiens
HQKLGIAY

SEQ ID NO: 77817 - protein, 8 aa, Homo Sapiens
HQLAVTAY

SEQ ID NO: 77818 - protein, 8 aa, Homo Sapiens
HQREIQVM

SEQ ID NO: 77819 - protein, 8 aa, Homo Sapiens
HQVVVAKY

SEQ ID NO: 77820 - protein, 8 aa, Homo Sapiens
HQYHIRAY

SEQ ID NO: 77821 - protein, 8 aa, Homo Sapiens
HQYKVRAY

SEQ ID NO: 77822 - protein, 8 aa, Homo Sapiens
IKADHVST

SEQ ID NO: 77823 - protein, 8 aa, Homo Sapiens
IKAIQLEY

SEQ ID NO: 77824 - protein, 8 aa, Homo Sapiens
IQHPSNVL

SEQ ID NO: 77825 - protein, 8 aa, Homo Sapiens
IQRLQLCY

SEQ ID NO: 77826 - protein, 8 aa, Homo Sapiens
IQTRGGTF

SEQ ID NO: 77827 - protein, 8 aa, Homo Sapiens
IQYLFLEY

SEQ ID NO: 77828 - protein, 8 aa, Homo Sapiens
KGFAFVEY

SEQ ID NO: 77829 - protein, 8 aa, Homo Sapiens
KGFAFVQY

SEQ ID NO: 77830 - protein, 8 aa, Homo Sapiens
KGLKVREY

SEQ ID NO: 77831 - protein, 8 aa, Homo Sapiens
KGYAFIEY

SEQ ID NO: 77832 - protein, 8 aa, Homo Sapiens
KGYAFVQY

SEQ ID NO: 77833 - protein, 8 aa, Homo Sapiens
KKFKNLKY

SEQ ID NO: 77834 - protein, 8 aa, Homo Sapiens
KKNVSVQY

SEQ ID NO: 77835 - protein, 8 aa, Homo Sapiens
KKVLQSEF

SEQ ID NO: 77836 - protein, 8 aa, Homo Sapiens
KKVTSVVF

SEQ ID NO: 77837 - protein, 8 aa, Homo Sapiens
KQFKSEAY

SEQ ID NO: 77838 - protein, 8 aa, Homo Sapiens
KQGVVLKY

SEQ ID NO: 77839 - protein, 8 aa, Homo Sapiens
KQIEPSLY

SEQ ID NO: 77840 - protein, 8 aa, Homo Sapiens
KQRLQQLF

SEQ ID NO: 77841 - protein, 8 aa, Homo Sapiens
KQRQLTSY

SEQ ID NO: 77842 - protein, 8 aa, Homo Sapiens
KQYKVVVY

SEQ ID NO: 77843 - protein, 8 aa, Homo Sapiens
KQYLAVVF

SEQ ID NO: 77844 - protein, 8 aa, Homo Sapiens
LKVKGNVF

SEQ ID NO: 77845 - protein, 8 aa, Homo Sapiens
LKYLTKKY

SEQ ID NO: 77846 - protein, 8 aa, Homo Sapiens
LQHASAVL

SEQ ID NO: 77847 - protein, 8 aa, Homo Sapiens
LQRLVEGY

SEQ ID NO: 77848 - protein, 8 aa, Homo Sapiens
LQRLVNLY

SEQ ID NO: 77849 - protein, 8 aa, Homo Sapiens
LQTVHAEY

SEQ ID NO: 77850 - protein, 8 aa, Homo Sapiens
MQWRALVL

SEQ ID NO: 77851 - protein, 8 aa, Homo Sapiens
PLRNPIIY

SEQ ID NO: 77852 - protein, 8 aa, Homo Sapiens
QQRVVRVY

SEQ ID NO: 77853 - protein, 8 aa, Homo Sapiens
QQVVLSSY

SEQ ID NO: 77854 - protein, 8 aa, Homo Sapiens
RAFVSMVY

SEQ ID NO: 77855 - protein, 8 aa, Homo Sapiens
RGFCFITY

SEQ ID NO: 77856 - protein, 8 aa, Homo Sapiens
RGHLAKIY

SEQ ID NO: 77857 - protein, 8 aa, Homo Sapiens
RKAVLTEY

SEQ ID NO: 77858 - protein, 8 aa, Homo Sapiens
RKAVSKLY

SEQ ID NO: 77859 - protein, 8 aa, Homo Sapiens
RKFVNKSY

SEQ ID NO: 77860 - protein, 8 aa, Homo Sapiens
RKGQAVTL

SEQ ID NO: 77861 - protein, 8 aa, Homo Sapiens
RKIGARIY

SEQ ID NO: 77862 - protein, 8 aa, Homo Sapiens
RKIGARVY

SEQ ID NO: 77863 - protein, 8 aa, Homo Sapiens
RKILSRLF

SEQ ID NO: 77864 - protein, 8 aa, Homo Sapiens
RKSIARVL

SEQ ID NO: 77865 - protein, 8 aa, Homo Sapiens
RKTIPIKY

SEQ ID NO: 77866 - protein, 8 aa, Homo Sapiens
RQFCTGEF

SEQ ID NO: 77867 - protein, 8 aa, Homo Sapiens
RQIGSRSY

SEQ ID NO: 77868 - protein, 8 aa, Homo Sapiens
RQKQSLEY

SEQ ID NO: 77869 - protein, 8 aa, Homo Sapiens
RQLEAARY

SEQ ID NO: 77870 - protein, 8 aa, Homo Sapiens
RQRIVQQY

SEQ ID NO: 77871 - protein, 8 aa, Homo Sapiens
RQVLTSSF

SEQ ID NO: 77872 - protein, 8 aa, Homo Sapiens
RQYEQQTY

SEQ ID NO: 77873 - protein, 8 aa, Homo Sapiens
RQYMFSSL

SEQ ID NO: 77874 - protein, 8 aa, Homo Sapiens
RQYRAVVY

SEQ ID NO: 77875 - protein, 8 aa, Homo Sapiens
SGYEAAVY

SEQ ID NO: 77876 - protein, 8 aa, Homo Sapiens
SKAKPSVL

SEQ ID NO: 77877 - protein, 8 aa, Homo Sapiens
SKAPAPTF

SEQ ID NO: 77878 - protein, 8 aa, Homo Sapiens
SKAPHLAY

SEQ ID NO: 77879 - protein, 8 aa, Homo Sapiens
SKAPVLTY

SEQ ID NO: 77880 - protein, 8 aa, Homo Sapiens
SKIPAVTY

SEQ ID NO: 77881 - protein, 8 aa, Homo Sapiens
SKIPHRVF

SEQ ID NO: 77882 - protein, 8 aa, Homo Sapiens
SKMNSIVY

SEQ ID NO: 77883 - protein, 8 aa, Homo Sapiens
SKYLHVGY

SEQ ID NO: 77884 - protein, 8 aa, Homo Sapiens
SQRAGLQF

SEQ ID NO: 77885 - protein, 8 aa, Homo Sapiens
SQRIFITY

SEQ ID NO: 77886 - protein, 8 aa, Homo Sapiens
SQRSVRLY

SEQ ID NO: 77887 - protein, 8 aa, Homo Sapiens
SQYRIKEY

SEQ ID NO: 77888 - protein, 8 aa, Homo Sapiens
TEELAYLK

SEQ ID NO: 77889 - protein, 8 aa, Homo Sapiens
TKHIGLVY

SEQ ID NO: 77890 - protein, 8 aa, Homo Sapiens
TKYQVTWY

SEQ ID NO: 77891 - protein, 8 aa, Homo Sapiens
TQRLVQVM

SEQ ID NO: 77892 - protein, 8 aa, Homo Sapiens
TQTLVREY

SEQ ID NO: 77893 - protein, 8 aa, Homo Sapiens
TQVILREY

SEQ ID NO: 77894 - protein, 8 aa, Homo Sapiens
TQYIIHNY

SEQ ID NO: 77895 - protein, 8 aa, Homo Sapiens
VKAELRQY

SEQ ID NO: 77896 - protein, 8 aa, Homo Sapiens
VKAKSIVF

SEQ ID NO: 77897 - protein, 8 aa, Homo Sapiens
VKHFHVEY

SEQ ID NO: 77898 - protein, 8 aa, Homo Sapiens
VKVVPTVY

SEQ ID NO: 77899 - protein, 8 aa, Homo Sapiens
VQLILHEY

SEQ ID NO: 77900 - protein, 8 aa, Homo Sapiens
VQQVAAEY

SEQ ID NO: 77901 - protein, 8 aa, Homo Sapiens
VQRVASVM

SEQ ID NO: 77902 - protein, 8 aa, Homo Sapiens
YKFKVIAY

SEQ ID NO: 77903 - protein, 8 aa, Homo Sapiens
YKIDPSTL

SEQ ID NO: 77904 - protein, 8 aa, Homo Sapiens
YKIMPLEL

SEQ ID NO: 77905 - protein, 8 aa, Homo Sapiens
YKVETKKY

SEQ ID NO: 77906 - protein, 8 aa, Homo Sapiens
YKVVGRCL

SEQ ID NO: 77907 - protein, 8 aa, Homo Sapiens
YQRFTDCY

SEQ ID NO: 77908 - protein, 8 aa, Homo Sapiens
YQRLIASY

SEQ ID NO: 77909 - protein, 8 aa, Homo Sapiens
YQSPVRVY

SEQ ID NO: 77910 - protein, 8 aa, Homo Sapiens
YQYTIRAH

SEQ ID NO: 77911 - protein, 9 aa, Homo Sapiens
AAAAAQSVY

SEQ ID NO: 77912 - protein, 9 aa, Homo Sapiens
AAANPTLAF

SEQ ID NO: 77913 - protein, 9 aa, Homo Sapiens
AAAPAGTTF

SEQ ID NO: 77914 - protein, 9 aa, Homo Sapiens
AAAPVIKAY

SEQ ID NO: 77915 - protein, 9 aa, Homo Sapiens
AAESPAGRA

SEQ ID NO: 77916 - protein, 9 aa, Homo Sapiens
AAFTLRTQY

SEQ ID NO: 77917 - protein, 9 aa, Homo Sapiens
AAIRENPVY

SEQ ID NO: 77918 - protein, 9 aa, Homo Sapiens
AANLFAQTY

SEQ ID NO: 77919 - protein, 9 aa, Homo Sapiens
AANPHSFVF

SEQ ID NO: 77920 - protein, 9 aa, Homo Sapiens
AARICANKY

SEQ ID NO: 77921 - protein, 9 aa, Homo Sapiens
AAVGTGSSY

SEQ ID NO: 77922 - protein, 9 aa, Homo Sapiens
AAYKWLVCY

SEQ ID NO: 77923 - protein, 9 aa, Homo Sapiens
AAYLQHLCY

SEQ ID NO: 77924 - protein, 9 aa, Homo Sapiens
AEWSSKTSY

SEQ ID NO: 77925 - protein, 9 aa, Homo Sapiens
AEYQFTGTY

SEQ ID NO: 77926 - protein, 9 aa, Homo Sapiens
AGAPPGTAY

SEQ ID NO: 77927 - protein, 9 aa, Homo Sapiens
AGFAAIVAY

SEQ ID NO: 77928 - protein, 9 aa, Homo Sapiens
AGFAFRQTY

SEQ ID NO: 77929 - protein, 9 aa, Homo Sapiens
AGHLSTAQY

SEQ ID NO: 77930 - protein, 9 aa, Homo Sapiens
AGYLGFKAY

SEQ ID NO: 77931 - protein, 9 aa, Homo Sapiens
AHAHPQEVY

SEQ ID NO: 77932 - protein, 9 aa, Homo Sapiens
AHFAKSISL

SEQ ID NO: 77933 - protein, 9 aa, Homo Sapiens
AHIKVGETY

SEQ ID NO: 77934 - protein, 9 aa, Homo Sapiens
AHIVSRLFY

SEQ ID NO: 77935 - protein, 9 aa, Homo Sapiens
AHKANTLVY

SEQ ID NO: 77936 - protein, 9 aa, Homo Sapiens
AHNMRVMKF

SEQ ID NO: 77937 - protein, 9 aa, Homo Sapiens
AHNPQQIYF

SEQ ID NO: 77938 - protein, 9 aa, Homo Sapiens
AHQGNPAVY

SEQ ID NO: 77939 - protein, 9 aa, Homo Sapiens
AHRNPKIGY

SEQ ID NO: 77940 - protein, 9 aa, Homo Sapiens
AHSGVLLQY

SEQ ID NO: 77941 - protein, 9 aa, Homo Sapiens
AHSLVGTPY

SEQ ID NO: 77942 - protein, 9 aa, Homo Sapiens
AHSVPSPAF

SEQ ID NO: 77943 - protein, 9 aa, Homo Sapiens
AHWVTHTSY

SEQ ID NO: 77944 - protein, 9 aa, Homo Sapiens
AHYNLQNAF

SEQ ID NO: 77945 - protein, 9 aa, Homo Sapiens
AHYPSQPVF

SEQ ID NO: 77946 - protein, 9 aa, Homo Sapiens
AIYGGSASY

SEQ ID NO: 77947 - protein, 9 aa, Homo Sapiens
AKAFLSTLF

SEQ ID NO: 77948 - protein, 9 aa, Homo Sapiens
AKAGILTTL

SEQ ID NO: 77949 - protein, 9 aa, Homo Sapiens
AKAGITTTL

SEQ ID NO: 77950 - protein, 9 aa, Homo Sapiens
AKAISKNVL

SEQ ID NO: 77951 - protein, 9 aa, Homo Sapiens
AKAKPEASF

SEQ ID NO: 77952 - protein, 9 aa, Homo Sapiens
AKAPPPVFY

SEQ ID NO: 77953 - protein, 9 aa, Homo Sapiens
AKAPPTACY

SEQ ID NO: 77954 - protein, 9 aa, Homo Sapiens
AKAPVGPVT

SEQ ID NO: 77955 - protein, 9 aa, Homo Sapiens
AKAPYLAKF

SEQ ID NO: 77956 - protein, 9 aa, Homo Sapiens
AKAQALVQY

SEQ ID NO: 77957 - protein, 9 aa, Homo Sapiens
AKAQSGLAF

SEQ ID NO: 77958 - protein, 9 aa, Homo Sapiens
AKASKIEVY

SEQ ID NO: 77959 - protein, 9 aa, Homo Sapiens
AKAYPPTSM

SEQ ID NO: 77960 - protein, 9 aa, Homo Sapiens
AKCALAYFY

SEQ ID NO: 77961 - protein, 9 aa, Homo Sapiens
AKCGLPLFY

SEQ ID NO: 77962 - protein, 9 aa, Homo Sapiens
AKDPRYARY

SEQ ID NO: 77963 - protein, 9 aa, Homo Sapiens
AKDPTAVIF

SEQ ID NO: 77964 - protein, 9 aa, Homo Sapiens
AKDQSVRIW

SEQ ID NO: 77965 - protein, 9 aa, Homo Sapiens
AKEEHLRQY

SEQ ID NO: 77966 - protein, 9 aa, Homo Sapiens
AKEFNPRSF

SEQ ID NO: 77967 - protein, 9 aa, Homo Sapiens
AKFAYKDEY

SEQ ID NO: 77968 - protein, 9 aa, Homo Sapiens
AKFENLCKL

SEQ ID NO: 77969 - protein, 9 aa, Homo Sapiens
AKFFTESRL

SEQ ID NO: 77970 - protein, 9 aa, Homo Sapiens
AKFIASTGM

SEQ ID NO: 77971 - protein, 9 aa, Homo Sapiens
AKFIEGVVL

SEQ ID NO: 77972 - protein, 9 aa, Homo Sapiens
AKFKDFYQF

SEQ ID NO: 77973 - protein, 9 aa, Homo Sapiens
AKFLGFVAF

SEQ ID NO: 77974 - protein, 9 aa, Homo Sapiens
AKFPLCMVF

SEQ ID NO: 77975 - protein, 9 aa, Homo Sapiens
AKFQPPPEY

SEQ ID NO: 77976 - protein, 9 aa, Homo Sapiens
AKFRSNLPA

SEQ ID NO: 77977 - protein, 9 aa, Homo Sapiens
AKFSATPRY

SEQ ID NO: 77978 - protein, 9 aa, Homo Sapiens
AKFSLPVSL

SEQ ID NO: 77979 - protein, 9 aa, Homo Sapiens
AKFSRPAQL

SEQ ID NO: 77980 - protein, 9 aa, Homo Sapiens
AKFVDGEWY

SEQ ID NO: 77981 - protein, 9 aa, Homo Sapiens
AKFYCRLYY

SEQ ID NO: 77982 - protein, 9 aa, Homo Sapiens
AKGIRNVPY

SEQ ID NO: 77983 - protein, 9 aa, Homo Sapiens
AKGPTLTVY

SEQ ID NO: 77984 - protein, 9 aa, Homo Sapiens
AKGSFVCIY

SEQ ID NO: 77985 - protein, 9 aa, Homo Sapiens
AKHIFKTYL

SEQ ID NO: 77986 - protein, 9 aa, Homo Sapiens
AKHIFPVTF

SEQ ID NO: 77987 - protein, 9 aa, Homo Sapiens
AKHPGLGEY

SEQ ID NO: 77988 - protein, 9 aa, Homo Sapiens
AKIAVVEKY

SEQ ID NO: 77989 - protein, 9 aa, Homo Sapiens
AKICFHHHF

SEQ ID NO: 77990 - protein, 9 aa, Homo Sapiens
AKICHQIEY

SEQ ID NO: 77991 - protein, 9 aa, Homo Sapiens
AKIDSKLGH

SEQ ID NO: 77992 - protein, 9 aa, Homo Sapiens
AKIERFEFY

SEQ ID NO: 77993 - protein, 9 aa, Homo Sapiens
AKIFGIQSF

SEQ ID NO: 77994 - protein, 9 aa, Homo Sapiens
AKIFRGQVY

SEQ ID NO: 77995 - protein, 9 aa, Homo Sapiens
AKIKGKNSF

SEQ ID NO: 77996 - protein, 9 aa, Homo Sapiens
AKIKSLTEY

SEQ ID NO: 77997 - protein, 9 aa, Homo Sapiens
AKILLDPYY

SEQ ID NO: 77998 - protein, 9 aa, Homo Sapiens
AKINEIRQM

SEQ ID NO: 77999 - protein, 9 aa, Homo Sapiens
AKINETDTF

SEQ ID NO: 78000 - protein, 9 aa, Homo Sapiens
AKINSGSSL

SEQ ID NO: 78001 - protein, 9 aa, Homo Sapiens
AKIPFSACL

SEQ ID NO: 78002 - protein, 9 aa, Homo Sapiens
AKIPGTGAL

SEQ ID NO: 78003 - protein, 9 aa, Homo Sapiens
AKIPLGFYY

SEQ ID NO: 78004 - protein, 9 aa, Homo Sapiens
AKIPSVIEY

SEQ ID NO: 78005 - protein, 9 aa, Homo Sapiens
AKIQKAVEY

SEQ ID NO: 78006 - protein, 9 aa, Homo Sapiens
AKISTLPQL

SEQ ID NO: 78007 - protein, 9 aa, Homo Sapiens
AKITAQEAV

SEQ ID NO: 78008 - protein, 9 aa, Homo Sapiens
AKIVPKISY

SEQ ID NO: 78009 - protein, 9 aa, Homo Sapiens
AKIVRLTEY

SEQ ID NO: 78010 - protein, 9 aa, Homo Sapiens
AKIYPDPEL

SEQ ID NO: 78011 - protein, 9 aa, Homo Sapiens
AKKDFEKKF

SEQ ID NO: 78012 - protein, 9 aa, Homo Sapiens
AKKDYNEAY

SEQ ID NO: 78013 - protein, 9 aa, Homo Sapiens
AKKFEASGF

SEQ ID NO: 78014 - protein, 9 aa, Homo Sapiens
AKKGEEALF

SEQ ID NO: 78015 - protein, 9 aa, Homo Sapiens
AKKGIDYDF

SEQ ID NO: 78016 - protein, 9 aa, Homo Sapiens
AKKISQLGY

SEQ ID NO: 78017 - protein, 9 aa, Homo Sapiens
AKKLFGSTF

SEQ ID NO: 78018 - protein, 9 aa, Homo Sapiens
AKKYIDQKF

SEQ ID NO: 78019 - protein, 9 aa, Homo Sapiens
AKLAKTCTL

SEQ ID NO: 78020 - protein, 9 aa, Homo Sapiens
AKLASYVKF

SEQ ID NO: 78021 - protein, 9 aa, Homo Sapiens
AKLDSLQTL

SEQ ID NO: 78022 - protein, 9 aa, Homo Sapiens
AKLDVFQSY

SEQ ID NO: 78023 - protein, 9 aa, Homo Sapiens
AKLEERTGY

SEQ ID NO: 78024 - protein, 9 aa, Homo Sapiens
AKLESMETY

SEQ ID NO: 78025 - protein, 9 aa, Homo Sapiens
AKLFFHTEY

SEQ ID NO: 78026 - protein, 9 aa, Homo Sapiens
AKLIAVEIY

SEQ ID NO: 78027 - protein, 9 aa, Homo Sapiens
AKLIQCIVF

SEQ ID NO: 78028 - protein, 9 aa, Homo Sapiens
AKLKGIGEY

SEQ ID NO: 78029 - protein, 9 aa, Homo Sapiens
AKLKKFIAY

SEQ ID NO: 78030 - protein, 9 aa, Homo Sapiens
AKLLHTDSY

SEQ ID NO: 78031 - protein, 9 aa, Homo Sapiens
AKLNNQARF

SEQ ID NO: 78032 - protein, 9 aa, Homo Sapiens
AKLNPGIAY

SEQ ID NO: 78033 - protein, 9 aa, Homo Sapiens
AKLPEIEEY

SEQ ID NO: 78034 - protein, 9 aa, Homo Sapiens
AKLPIEPRF

SEQ ID NO: 78035 - protein, 9 aa, Homo Sapiens
AKLPKQFKF

SEQ ID NO: 78036 - protein, 9 aa, Homo Sapiens
AKLPSETIF

SEQ ID NO: 78037 - protein, 9 aa, Homo Sapiens
AKLPTGTTL

SEQ ID NO: 78038 - protein, 9 aa, Homo Sapiens
AKLQQTTQL

SEQ ID NO: 78039 - protein, 9 aa, Homo Sapiens
AKLRLLSSF

SEQ ID NO: 78040 - protein, 9 aa, Homo Sapiens
AKLTISPDY

SEQ ID NO: 78041 - protein, 9 aa, Homo Sapiens
AKMATGNYF

SEQ ID NO: 78042 - protein, 9 aa, Homo Sapiens
AKMKGFDVF

SEQ ID NO: 78043 - protein, 9 aa, Homo Sapiens
AKMKTPVQY

SEQ ID NO: 78044 - protein, 9 aa, Homo Sapiens
AKMVVDAVM

SEQ ID NO: 78045 - protein, 9 aa, Homo Sapiens
AKNLFPNTY

SEQ ID NO: 78046 - protein, 9 aa, Homo Sapiens
AKNNGIVSY

SEQ ID NO: 78047 - protein, 9 aa, Homo Sapiens
AKNNVVINY

SEQ ID NO: 78048 - protein, 9 aa, Homo Sapiens
AKNPKIAVS

SEQ ID NO: 78049 - protein, 9 aa, Homo Sapiens
AKNPRINQL

SEQ ID NO: 78050 - protein, 9 aa, Homo Sapiens
AKPFSVVVF

SEQ ID NO: 78051 - protein, 9 aa, Homo Sapiens
AKPKIEHTY

SEQ ID NO: 78052 - protein, 9 aa, Homo Sapiens
AKPLKLYVY

SEQ ID NO: 78053 - protein, 9 aa, Homo Sapiens
AKPTLQLVY

SEQ ID NO: 78054 - protein, 9 aa, Homo Sapiens
AKPTRLNVF

SEQ ID NO: 78055 - protein, 9 aa, Homo Sapiens
AKQDVVLNY

SEQ ID NO: 78056 - protein, 9 aa, Homo Sapiens
AKQIHAVRY

SEQ ID NO: 78057 - protein, 9 aa, Homo Sapiens
AKQLSAQSY

SEQ ID NO: 78058 - protein, 9 aa, Homo Sapiens
AKQPHVGDY

SEQ ID NO: 78059 - protein, 9 aa, Homo Sapiens
AKQRLQQLF

SEQ ID NO: 78060 - protein, 9 aa, Homo Sapiens
AKQRLTPKL

SEQ ID NO: 78061 - protein, 9 aa, Homo Sapiens
AKRFDVSGY

SEQ ID NO: 78062 - protein, 9 aa, Homo Sapiens
AKRIGEVQV

SEQ ID NO: 78063 - protein, 9 aa, Homo Sapiens
AKRLLINLY

SEQ ID NO: 78064 - protein, 9 aa, Homo Sapiens
AKRLREERL

SEQ ID NO: 78065 - protein, 9 aa, Homo Sapiens
AKRLWGDIY

SEQ ID NO: 78066 - protein, 9 aa, Homo Sapiens
AKRMVEHKF

SEQ ID NO: 78067 - protein, 9 aa, Homo Sapiens
AKRPELRNY

SEQ ID NO: 78068 - protein, 9 aa, Homo Sapiens
AKRPSDIKF

SEQ ID NO: 78069 - protein, 9 aa, Homo Sapiens
AKRSDELSF

SEQ ID NO: 78070 - protein, 9 aa, Homo Sapiens
AKRYEKLDF

SEQ ID NO: 78071 - protein, 9 aa, Homo Sapiens
AKSGVGTAL

SEQ ID NO: 78072 - protein, 9 aa, Homo Sapiens
AKSPPHCEL

SEQ ID NO: 78073 - protein, 9 aa, Homo Sapiens
AKSTLRVLY

SEQ ID NO: 78074 - protein, 9 aa, Homo Sapiens
AKSVGPLQY

SEQ ID NO: 78075 - protein, 9 aa, Homo Sapiens
AKSVPSHTY

SEQ ID NO: 78076 - protein, 9 aa, Homo Sapiens
AKSVPTKTY

SEQ ID NO: 78077 - protein, 9 aa, Homo Sapiens
AKTEVSLTL

SEQ ID NO: 78078 - protein, 9 aa, Homo Sapiens
AKTGLTPLM

SEQ ID NO: 78079 - protein, 9 aa, Homo Sapiens
AKTVLAIRY

SEQ ID NO: 78080 - protein, 9 aa, Homo Sapiens
AKVANASYY

SEQ ID NO: 78081 - protein, 9 aa, Homo Sapiens
AKVATGRVL

SEQ ID NO: 78082 - protein, 9 aa, Homo Sapiens
AKVDATADY

SEQ ID NO: 78083 - protein, 9 aa, Homo Sapiens
AKVDLVSAY

SEQ ID NO: 78084 - protein, 9 aa, Homo Sapiens
AKVDRLEAF

SEQ ID NO: 78085 - protein, 9 aa, Homo Sapiens
AKVGKAHVY

SEQ ID NO: 78086 - protein, 9 aa, Homo Sapiens
AKVGSLECL

SEQ ID NO: 78087 - protein, 9 aa, Homo Sapiens
AKVGTRLMF

SEQ ID NO: 78088 - protein, 9 aa, Homo Sapiens
AKVGTRLVF

SEQ ID NO: 78089 - protein, 9 aa, Homo Sapiens
AKVILLTGY

SEQ ID NO: 78090 - protein, 9 aa, Homo Sapiens
AKVKATTSL

SEQ ID NO: 78091 - protein, 9 aa, Homo Sapiens
AKVKFEERY

SEQ ID NO: 78092 - protein, 9 aa, Homo Sapiens
AKVKNSTEF

SEQ ID NO: 78093 - protein, 9 aa, Homo Sapiens
AKVKQRIDY

SEQ ID NO: 78094 - protein, 9 aa, Homo Sapiens
AKVLHGEQY

SEQ ID NO: 78095 - protein, 9 aa, Homo Sapiens
AKVLKTVTF

SEQ ID NO: 78096 - protein, 9 aa, Homo Sapiens
AKVMNLIVF

SEQ ID NO: 78097 - protein, 9 aa, Homo Sapiens
AKVSGGPSL

SEQ ID NO: 78098 - protein, 9 aa, Homo Sapiens
AKVVDKSEY

SEQ ID NO: 78099 - protein, 9 aa, Homo Sapiens
AKVYLTTGY

SEQ ID NO: 78100 - protein, 9 aa, Homo Sapiens
AKWLQDEMF

SEQ ID NO: 78101 - protein, 9 aa, Homo Sapiens
AKWSVESIF

SEQ ID NO: 78102 - protein, 9 aa, Homo Sapiens
AKYDWEQKY

SEQ ID NO: 78103 - protein, 9 aa, Homo Sapiens
AKYEDLYAF

SEQ ID NO: 78104 - protein, 9 aa, Homo Sapiens
AKYESQTSF

SEQ ID NO: 78105 - protein, 9 aa, Homo Sapiens
AKYFIRDEF

SEQ ID NO: 78106 - protein, 9 aa, Homo Sapiens
AKYGIPLAY

SEQ ID NO: 78107 - protein, 9 aa, Homo Sapiens
AKYGYKLCL

SEQ ID NO: 78108 - protein, 9 aa, Homo Sapiens
AKYIETSEL

SEQ ID NO: 78109 - protein, 9 aa, Homo Sapiens
AKYIPELAY

SEQ ID NO: 78110 - protein, 9 aa, Homo Sapiens
AKYITEPEM

SEQ ID NO: 78111 - protein, 9 aa, Homo Sapiens
AKYIVSVGY

SEQ ID NO: 78112 - protein, 9 aa, Homo Sapiens
AKYPAPERL

SEQ ID NO: 78113 - protein, 9 aa, Homo Sapiens
AKYPEIKSL

SEQ ID NO: 78114 - protein, 9 aa, Homo Sapiens
AKYPHVEDY

SEQ ID NO: 78115 - protein, 9 aa, Homo Sapiens
AKYPIKQSL

SEQ ID NO: 78116 - protein, 9 aa, Homo Sapiens
AKYRKIHLF

SEQ ID NO: 78117 - protein, 9 aa, Homo Sapiens
AKYSTPATL

SEQ ID NO: 78118 - protein, 9 aa, Homo Sapiens
AKYYTRITM

SEQ ID NO: 78119 - protein, 9 aa, Homo Sapiens
ALAPAGFSY

SEQ ID NO: 78120 - protein, 9 aa, Homo Sapiens
ALFRTIITY

SEQ ID NO: 78121 - protein, 9 aa, Homo Sapiens
ALLKTGAAY

SEQ ID NO: 78122 - protein, 9 aa, Homo Sapiens
ALMPPFTAF

SEQ ID NO: 78123 - protein, 9 aa, Homo Sapiens
ALWIGTTSF

SEQ ID NO: 78124 - protein, 9 aa, Homo Sapiens
ALWKQFQSF

SEQ ID NO: 78125 - protein, 9 aa, Homo Sapiens
ALYPQTTCF

SEQ ID NO: 78126 - protein, 9 aa, Homo Sapiens
AMHPQVNIY

SEQ ID NO: 78127 - protein, 9 aa, Homo Sapiens
AMIARELLY

SEQ ID NO: 78128 - protein, 9 aa, Homo Sapiens
AMIDGQSAF

SEQ ID NO: 78129 - protein, 9 aa, Homo Sapiens
AMIDTGKAF

SEQ ID NO: 78130 - protein, 9 aa, Homo Sapiens
AMLRQLAQY

SEQ ID NO: 78131 - protein, 9 aa, Homo Sapiens
AMMHGGTGF

SEQ ID NO: 78132 - protein, 9 aa, Homo Sapiens
AMNPTNTVF

SEQ ID NO: 78133 - protein, 9 aa, Homo Sapiens
AMRIGAEVY

SEQ ID NO: 78134 - protein, 9 aa, Homo Sapiens
AMRWFQQKY

SEQ ID NO: 78135 - protein, 9 aa, Homo Sapiens
AMVGHQVSF

SEQ ID NO: 78136 - protein, 9 aa, Homo Sapiens
AMYPHIFYF

SEQ ID NO: 78137 - protein, 9 aa, Homo Sapiens
AMYSRKAMY

SEQ ID NO: 78138 - protein, 9 aa, Homo Sapiens
AQAAPSSSF

SEQ ID NO: 78139 - protein, 9 aa, Homo Sapiens
AQAASQHVF

SEQ ID NO: 78140 - protein, 9 aa, Homo Sapiens
AQAELESRY

SEQ ID NO: 78141 - protein, 9 aa, Homo Sapiens
AQAISRFAY

SEQ ID NO: 78142 - protein, 9 aa, Homo Sapiens
AQAMFNLGY

SEQ ID NO: 78143 - protein, 9 aa, Homo Sapiens
AQAPAGTSF

SEQ ID NO: 78144 - protein, 9 aa, Homo Sapiens
AQAPAQSQF

SEQ ID NO: 78145 - protein, 9 aa, Homo Sapiens
AQAPIAAVL

SEQ ID NO: 78146 - protein, 9 aa, Homo Sapiens
AQAPPTAQL

SEQ ID NO: 78147 - protein, 9 aa, Homo Sapiens
AQAQLQKRY

SEQ ID NO: 78148 - protein, 9 aa, Homo Sapiens
AQARWWATF

SEQ ID NO: 78149 - protein, 9 aa, Homo Sapiens
AQDAGYRMY

SEQ ID NO: 78150 - protein, 9 aa, Homo Sapiens
AQDEHLITF

SEQ ID NO: 78151 - protein, 9 aa, Homo Sapiens
AQEDAQRLY

SEQ ID NO: 78152 - protein, 9 aa, Homo Sapiens
AQEQDSPAF

SEQ ID NO: 78153 - protein, 9 aa, Homo Sapiens
AQERSRLTY

SEQ ID NO: 78154 - protein, 9 aa, Homo Sapiens
AQFETKKLY

SEQ ID NO: 78155 - protein, 9 aa, Homo Sapiens
AQFKGTQSL

SEQ ID NO: 78156 - protein, 9 aa, Homo Sapiens
AQFKTSNSY

SEQ ID NO: 78157 - protein, 9 aa, Homo Sapiens
AQFPFHELF

SEQ ID NO: 78158 - protein, 9 aa, Homo Sapiens
AQFPNGPQF

SEQ ID NO: 78159 - protein, 9 aa, Homo Sapiens
AQFPSSGRF

SEQ ID NO: 78160 - protein, 9 aa, Homo Sapiens
AQHGVCSVL

SEQ ID NO: 78161 - protein, 9 aa, Homo Sapiens
AQHKFLVAV

SEQ ID NO: 78162 - protein, 9 aa, Homo Sapiens
AQHLFIQTF

SEQ ID NO: 78163 - protein, 9 aa, Homo Sapiens
AQHLFLQAF

SEQ ID NO: 78164 - protein, 9 aa, Homo Sapiens
AQHLSQLLF

SEQ ID NO: 78165 - protein, 9 aa, Homo Sapiens
AQHLTVSGF

SEQ ID NO: 78166 - protein, 9 aa, Homo Sapiens
AQHPSALRF

SEQ ID NO: 78167 - protein, 9 aa, Homo Sapiens
AQHSYFGSF

SEQ ID NO: 78168 - protein, 9 aa, Homo Sapiens
AQHVFKVSL

SEQ ID NO: 78169 - protein, 9 aa, Homo Sapiens
AQHYTETAL

SEQ ID NO: 78170 - protein, 9 aa, Homo Sapiens
AQIEGVVPF

SEQ ID NO: 78171 - protein, 9 aa, Homo Sapiens
AQIFRPLKF

SEQ ID NO: 78172 - protein, 9 aa, Homo Sapiens
AQIKFLNTY

SEQ ID NO: 78173 - protein, 9 aa, Homo Sapiens
AQIPPHAVM

SEQ ID NO: 78174 - protein, 9 aa, Homo Sapiens
AQIVHAISY

SEQ ID NO: 78175 - protein, 9 aa, Homo Sapiens
AQIYQLIEY

SEQ ID NO: 78176 - protein, 9 aa, Homo Sapiens
AQKDQEIAF

SEQ ID NO: 78177 - protein, 9 aa, Homo Sapiens
AQKIDLPEY

SEQ ID NO: 78178 - protein, 9 aa, Homo Sapiens
AQKSISQHY

SEQ ID NO: 78179 - protein, 9 aa, Homo Sapiens
AQLAAAEKF

SEQ ID NO: 78180 - protein, 9 aa, Homo Sapiens
AQLERQLQF

SEQ ID NO: 78181 - protein, 9 aa, Homo Sapiens
AQLGLGHSY

SEQ ID NO: 78182 - protein, 9 aa, Homo Sapiens
AQLIASAKY

SEQ ID NO: 78183 - protein, 9 aa, Homo Sapiens
AQLKDYITY

SEQ ID NO: 78184 - protein, 9 aa, Homo Sapiens
AQLPEKVEY

SEQ ID NO: 78185 - protein, 9 aa, Homo Sapiens
AQLRNLEAY

SEQ ID NO: 78186 - protein, 9 aa, Homo Sapiens
AQLSKQSSF

SEQ ID NO: 78187 - protein, 9 aa, Homo Sapiens
AQLWTDLQY

SEQ ID NO: 78188 - protein, 9 aa, Homo Sapiens
AQMAQVLQF

SEQ ID NO: 78189 - protein, 9 aa, Homo Sapiens
AQNAVRLHY

SEQ ID NO: 78190 - protein, 9 aa, Homo Sapiens
AQNLSIIQY

SEQ ID NO: 78191 - protein, 9 aa, Homo Sapiens
AQNVSCASF

SEQ ID NO: 78192 - protein, 9 aa, Homo Sapiens
AQPALKTQF

SEQ ID NO: 78193 - protein, 9 aa, Homo Sapiens
AQPEPSTGF

SEQ ID NO: 78194 - protein, 9 aa, Homo Sapiens
AQPETRVSY

SEQ ID NO: 78195 - protein, 9 aa, Homo Sapiens
AQPHHGVPY

SEQ ID NO: 78196 - protein, 9 aa, Homo Sapiens
AQPPVGAAY

SEQ ID NO: 78197 - protein, 9 aa, Homo Sapiens
AQQEARTEF

SEQ ID NO: 78198 - protein, 9 aa, Homo Sapiens
AQQVVLSSY

SEQ ID NO: 78199 - protein, 9 aa, Homo Sapiens
AQRAFILTV

SEQ ID NO: 78200 - protein, 9 aa, Homo Sapiens
AQRASSNVF

SEQ ID NO: 78201 - protein, 9 aa, Homo Sapiens
AQREDELTF

SEQ ID NO: 78202 - protein, 9 aa, Homo Sapiens
AQRIQKLSF

SEQ ID NO: 78203 - protein, 9 aa, Homo Sapiens
AQRIQNGSY

SEQ ID NO: 78204 - protein, 9 aa, Homo Sapiens
AQRKTLSGF

SEQ ID NO: 78205 - protein, 9 aa, Homo Sapiens
AQRPTEQEL

SEQ ID NO: 78206 - protein, 9 aa, Homo Sapiens
AQRQFVVAA

SEQ ID NO: 78207 - protein, 9 aa, Homo Sapiens
AQRSTETAL

SEQ ID NO: 78208 - protein, 9 aa, Homo Sapiens
AQRYNELSY

SEQ ID NO: 78209 - protein, 9 aa, Homo Sapiens
AQSDFISAF

SEQ ID NO: 78210 - protein, 9 aa, Homo Sapiens
AQSHVKISF

SEQ ID NO: 78211 - protein, 9 aa, Homo Sapiens
AQSPELRTY

SEQ ID NO: 78212 - protein, 9 aa, Homo Sapiens
AQSRFLSTY

SEQ ID NO: 78213 - protein, 9 aa, Homo Sapiens
AQVDPLSAL

SEQ ID NO: 78214 - protein, 9 aa, Homo Sapiens
AQVIVFQTY

SEQ ID NO: 78215 - protein, 9 aa, Homo Sapiens
AQVKKATVF

SEQ ID NO: 78216 - protein, 9 aa, Homo Sapiens
AQVKPDGTY

SEQ ID NO: 78217 - protein, 9 aa, Homo Sapiens
AQVLSVVAH

SEQ ID NO: 78218 - protein, 9 aa, Homo Sapiens
AQVPKSSAL

SEQ ID NO: 78219 - protein, 9 aa, Homo Sapiens
AQVSPRITF

SEQ ID NO: 78220 - protein, 9 aa, Homo Sapiens
AQVSRRISF

SEQ ID NO: 78221 - protein, 9 aa, Homo Sapiens
AQVVLYRSY

SEQ ID NO: 78222 - protein, 9 aa, Homo Sapiens
AQVVQWVSF

SEQ ID NO: 78223 - protein, 9 aa, Homo Sapiens
AQVWMITRY

SEQ ID NO: 78224 - protein, 9 aa, Homo Sapiens
AQWAIHPTF

SEQ ID NO: 78225 - protein, 9 aa, Homo Sapiens
AQWEETVTY

SEQ ID NO: 78226 - protein, 9 aa, Homo Sapiens
AQWKHAVKF

SEQ ID NO: 78227 - protein, 9 aa, Homo Sapiens
AQYDGAYKV

SEQ ID NO: 78228 - protein, 9 aa, Homo Sapiens
AQYDRQIRL

SEQ ID NO: 78229 - protein, 9 aa, Homo Sapiens
AQYEHDLEV

SEQ ID NO: 78230 - protein, 9 aa, Homo Sapiens
AQYKARVAL

SEQ ID NO: 78231 - protein, 9 aa, Homo Sapiens
AQYKEISKF

SEQ ID NO: 78232 - protein, 9 aa, Homo Sapiens
AQYLPKEQY

SEQ ID NO: 78233 - protein, 9 aa, Homo Sapiens
AQYQSVPVY

SEQ ID NO: 78234 - protein, 9 aa, Homo Sapiens
AQYREVAAF

SEQ ID NO: 78235 - protein, 9 aa, Homo Sapiens
ARFKERVGY

SEQ ID NO: 78236 - protein, 9 aa, Homo Sapiens
ARIYHTIAY

SEQ ID NO: 78237 - protein, 9 aa, Homo Sapiens
ASYEVKELY

SEQ ID NO: 78238 - protein, 9 aa, Homo Sapiens
EKAPTNIVY

SEQ ID NO: 78239 - protein, 9 aa, Homo Sapiens
EKVFPLAEY

SEQ ID NO: 78240 - protein, 9 aa, Homo Sapiens
EQYEQILAF

SEQ ID NO: 78241 - protein, 9 aa, Homo Sapiens
EQYESFVKF

SEQ ID NO: 78242 - protein, 9 aa, Homo Sapiens
FAFEHSEEY

SEQ ID NO: 78243 - protein, 9 aa, Homo Sapiens
FHLEAREVY

SEQ ID NO: 78244 - protein, 9 aa, Homo Sapiens
FKALIAAQY

SEQ ID NO: 78245 - protein, 9 aa, Homo Sapiens
FKAPITSEF

SEQ ID NO: 78246 - protein, 9 aa, Homo Sapiens
FKEAEVRVY

SEQ ID NO: 78247 - protein, 9 aa, Homo Sapiens
FKEGKERMY

SEQ ID NO: 78248 - protein, 9 aa, Homo Sapiens
FKFGKELTF

SEQ ID NO: 78249 - protein, 9 aa, Homo Sapiens
FKFMPPPTY

SEQ ID NO: 78250 - protein, 9 aa, Homo Sapiens
FKFSSKNQL

SEQ ID NO: 78251 - protein, 9 aa, Homo Sapiens
FKFVEQQSY

SEQ ID NO: 78252 - protein, 9 aa, Homo Sapiens
FKGELIHVF

SEQ ID NO: 78253 - protein, 9 aa, Homo Sapiens
FKIEPPGLF

SEQ ID NO: 78254 - protein, 9 aa, Homo Sapiens
FKIKITSEL

SEQ ID NO: 78255 - protein, 9 aa, Homo Sapiens
FKIPSNTTL

SEQ ID NO: 78256 - protein, 9 aa, Homo Sapiens
FKKLHEAHF

SEQ ID NO: 78257 - protein, 9 aa, Homo Sapiens
FKKPGSKNF

SEQ ID NO: 78258 - protein, 9 aa, Homo Sapiens
FKKYLQETY

SEQ ID NO: 78259 - protein, 9 aa, Homo Sapiens
FKLEPLQAY

SEQ ID NO: 78260 - protein, 9 aa, Homo Sapiens
FKLLPQLTY

SEQ ID NO: 78261 - protein, 9 aa, Homo Sapiens
FKPETISAF

SEQ ID NO: 78262 - protein, 9 aa, Homo Sapiens
FKPKGGVIF

SEQ ID NO: 78263 - protein, 9 aa, Homo Sapiens
FKPNQTRTY

SEQ ID NO: 78264 - protein, 9 aa, Homo Sapiens
FKRKYGKSL

SEQ ID NO: 78265 - protein, 9 aa, Homo Sapiens
FKSNVTKTM

SEQ ID NO: 78266 - protein, 9 aa, Homo Sapiens
FKSPAASSF

SEQ ID NO: 78267 - protein, 9 aa, Homo Sapiens
FKSQANQNY

SEQ ID NO: 78268 - protein, 9 aa, Homo Sapiens
FKVALLDVF

SEQ ID NO: 78269 - protein, 9 aa, Homo Sapiens
FKVLHIVNF

SEQ ID NO: 78270 - protein, 9 aa, Homo Sapiens
FKVNKKITF

SEQ ID NO: 78271 - protein, 9 aa, Homo Sapiens
FKVSDEVGF

SEQ ID NO: 78272 - protein, 9 aa, Homo Sapiens
FKYNKPAFL

SEQ ID NO: 78273 - protein, 9 aa, Homo Sapiens
FLEETNRLY

SEQ ID NO: 78274 - protein, 9 aa, Homo Sapiens
FLFDGSPTY

SEQ ID NO: 78275 - protein, 9 aa, Homo Sapiens
FQAILDHTY

SEQ ID NO: 78276 - protein, 9 aa, Homo Sapiens
FQAMGKTSF

SEQ ID NO: 78277 - protein, 9 aa, Homo Sapiens
FQAPTAKEM

SEQ ID NO: 78278 - protein, 9 aa, Homo Sapiens
FQFDVQRKY

SEQ ID NO: 78279 - protein, 9 aa, Homo Sapiens
FQFIMKQSY

SEQ ID NO: 78280 - protein, 9 aa, Homo Sapiens
FQFLPHAYY

SEQ ID NO: 78281 - protein, 9 aa, Homo Sapiens
FQKPSGVSA

SEQ ID NO: 78282 - protein, 9 aa, Homo Sapiens
FQLGESVKY

SEQ ID NO: 78283 - protein, 9 aa, Homo Sapiens
FQLGSKLVY

SEQ ID NO: 78284 - protein, 9 aa, Homo Sapiens
FQNNTTNRY

SEQ ID NO: 78285 - protein, 9 aa, Homo Sapiens
FQRGYYRYY

SEQ ID NO: 78286 - protein, 9 aa, Homo Sapiens
FQSLPKSAF

SEQ ID NO: 78287 - protein, 9 aa, Homo Sapiens
FQYESKVFY

SEQ ID NO: 78288 - protein, 9 aa, Homo Sapiens
FQYSKSPSL

SEQ ID NO: 78289 - protein, 9 aa, Homo Sapiens
FSYGTKILY

SEQ ID NO: 78290 - protein, 9 aa, Homo Sapiens
GADVNRVTY

SEQ ID NO: 78291 - protein, 9 aa, Homo Sapiens
GARPVELGF

SEQ ID NO: 78292 - protein, 9 aa, Homo Sapiens
GAYEQVIKY

SEQ ID NO: 78293 - protein, 9 aa, Homo Sapiens
GAYGQAVRY

SEQ ID NO: 78294 - protein, 9 aa, Homo Sapiens
GAYVSLLEY

SEQ ID NO: 78295 - protein, 9 aa, Homo Sapiens
GGPGGVGGL

SEQ ID NO: 78296 - protein, 9 aa, Homo Sapiens
GHYPRHIVF

SEQ ID NO: 78297 - protein, 9 aa, Homo Sapiens
GKAAAAVAF

SEQ ID NO: 78298 - protein, 9 aa, Homo Sapiens
GKAEIARAY

SEQ ID NO: 78299 - protein, 9 aa, Homo Sapiens
GKAFFLSSY

SEQ ID NO: 78300 - protein, 9 aa, Homo Sapiens
GKAFGDSSY

SEQ ID NO: 78301 - protein, 9 aa, Homo Sapiens
GKAFIFPSF

SEQ ID NO: 78302 - protein, 9 aa, Homo Sapiens
GKAFIRSSY

SEQ ID NO: 78303 - protein, 9 aa, Homo Sapiens
GKAFNGKAY

SEQ ID NO: 78304 - protein, 9 aa, Homo Sapiens
GKAFNRNSY

SEQ ID NO: 78305 - protein, 9 aa, Homo Sapiens
GKAFNRSSY

SEQ ID NO: 78306 - protein, 9 aa, Homo Sapiens
GKAFNSRSY

SEQ ID NO: 78307 - protein, 9 aa, Homo Sapiens
GKAFNSSSY

SEQ ID NO: 78308 - protein, 9 aa, Homo Sapiens
GKAFRCSSY

SEQ ID NO: 78309 - protein, 9 aa, Homo Sapiens
GKAFSCSKY

SEQ ID NO: 78310 - protein, 9 aa, Homo Sapiens
GKAFSCSSY

SEQ ID NO: 78311 - protein, 9 aa, Homo Sapiens
GKAFSHSSY

SEQ ID NO: 78312 - protein, 9 aa, Homo Sapiens
GKAFSLRSY

SEQ ID NO: 78313 - protein, 9 aa, Homo Sapiens
GKAFSQKQY

SEQ ID NO: 78314 - protein, 9 aa, Homo Sapiens
GKAFSQSAY

SEQ ID NO: 78315 - protein, 9 aa, Homo Sapiens
GKAFSQSSY

SEQ ID NO: 78316 - protein, 9 aa, Homo Sapiens
GKAFSRISY

SEQ ID NO: 78317 - protein, 9 aa, Homo Sapiens
GKAFSRMSY

SEQ ID NO: 78318 - protein, 9 aa, Homo Sapiens
GKAFSRSSF

SEQ ID NO: 78319 - protein, 9 aa, Homo Sapiens
GKAFSRSSY

SEQ ID NO: 78320 - protein, 9 aa, Homo Sapiens
GKAFSRSTY

SEQ ID NO: 78321 - protein, 9 aa, Homo Sapiens
GKAFSSHAY

SEQ ID NO: 78322 - protein, 9 aa, Homo Sapiens
GKAFSSKSY

SEQ ID NO: 78323 - protein, 9 aa, Homo Sapiens
GKAFSYRSA

SEQ ID NO: 78324 - protein, 9 aa, Homo Sapiens
GKAFSYRSY

SEQ ID NO: 78325 - protein, 9 aa, Homo Sapiens
GKAFTCSSY

SEQ ID NO: 78326 - protein, 9 aa, Homo Sapiens
GKAFTHSRF

SEQ ID NO: 78327 - protein, 9 aa, Homo Sapiens
GKAFTQSAY

SEQ ID NO: 78328 - protein, 9 aa, Homo Sapiens
GKAFTRVNY

SEQ ID NO: 78329 - protein, 9 aa, Homo Sapiens
GKAIVSRQF

SEQ ID NO: 78330 - protein, 9 aa, Homo Sapiens
GKALEVAEY

SEQ ID NO: 78331 - protein, 9 aa, Homo Sapiens
GKANIIFSY

SEQ ID NO: 78332 - protein, 9 aa, Homo Sapiens
GKAPGAEEY

SEQ ID NO: 78333 - protein, 9 aa, Homo Sapiens
GKAPHGPSF

SEQ ID NO: 78334 - protein, 9 aa, Homo Sapiens
GKAPLNVQF

SEQ ID NO: 78335 - protein, 9 aa, Homo Sapiens
GKAPNILLY

SEQ ID NO: 78336 - protein, 9 aa, Homo Sapiens
GKARHRLSF

SEQ ID NO: 78337 - protein, 9 aa, Homo Sapiens
GKASPSPSL

SEQ ID NO: 78338 - protein, 9 aa, Homo Sapiens
GKAWGILTF

SEQ ID NO: 78339 - protein, 9 aa, Homo Sapiens
GKAYHPHCF

SEQ ID NO: 78340 - protein, 9 aa, Homo Sapiens
GKCFSVLGF

SEQ ID NO: 78341 - protein, 9 aa, Homo Sapiens
GKCSGPRAF

SEQ ID NO: 78342 - protein, 9 aa, Homo Sapiens
GKEETRRFY

SEQ ID NO: 78343 - protein, 9 aa, Homo Sapiens
GKEKLPRYY

SEQ ID NO: 78344 - protein, 9 aa, Homo Sapiens
GKFASVFVY

SEQ ID NO: 78345 - protein, 9 aa, Homo Sapiens
GKFDGDSAY

SEQ ID NO: 78346 - protein, 9 aa, Homo Sapiens
GKFDWRQQY

SEQ ID NO: 78347 - protein, 9 aa, Homo Sapiens
GKFFHRSCF

SEQ ID NO: 78348 - protein, 9 aa, Homo Sapiens
GKFFRYSSY

SEQ ID NO: 78349 - protein, 9 aa, Homo Sapiens
GKFFSQKSY

SEQ ID NO: 78350 - protein, 9 aa, Homo Sapiens
GKFFSQMSY

SEQ ID NO: 78351 - protein, 9 aa, Homo Sapiens
GKFFSQSSH

SEQ ID NO: 78352 - protein, 9 aa, Homo Sapiens
GKFFSRLSY

SEQ ID NO: 78353 - protein, 9 aa, Homo Sapiens
GKFFSRVSY

SEQ ID NO: 78354 - protein, 9 aa, Homo Sapiens
GKFHQESKF

SEQ ID NO: 78355 - protein, 9 aa, Homo Sapiens
GKFHSIVRL

SEQ ID NO: 78356 - protein, 9 aa, Homo Sapiens
GKFILSIAY

SEQ ID NO: 78357 - protein, 9 aa, Homo Sapiens
GKFLGLRAY

SEQ ID NO: 78358 - protein, 9 aa, Homo Sapiens
GKFLQGDSF

SEQ ID NO: 78359 - protein, 9 aa, Homo Sapiens
GKFPSLLTH

SEQ ID NO: 78360 - protein, 9 aa, Homo Sapiens
GKFQDNFEF

SEQ ID NO: 78361 - protein, 9 aa, Homo Sapiens
GKFTKTHKF

SEQ ID NO: 78362 - protein, 9 aa, Homo Sapiens
GKGFTRISY

SEQ ID NO: 78363 - protein, 9 aa, Homo Sapiens
GKGFTRTSY

SEQ ID NO: 78364 - protein, 9 aa, Homo Sapiens
GKGGFGTVF

SEQ ID NO: 78365 - protein, 9 aa, Homo Sapiens
GKGKFGNVY

SEQ ID NO: 78366 - protein, 9 aa, Homo Sapiens
GKGNFGEVY

SEQ ID NO: 78367 - protein, 9 aa, Homo Sapiens
GKGSFGEVF

SEQ ID NO: 78368 - protein, 9 aa, Homo Sapiens
GKGSFGEVY

SEQ ID NO: 78369 - protein, 9 aa, Homo Sapiens
GKHFSGESY

SEQ ID NO: 78370 - protein, 9 aa, Homo Sapiens
GKHVPRAVF

SEQ ID NO: 78371 - protein, 9 aa, Homo Sapiens
GKIAVMELF

SEQ ID NO: 78372 - protein, 9 aa, Homo Sapiens
GKIEFISTM

SEQ ID NO: 78373 - protein, 9 aa, Homo Sapiens
GKIERAIGL

SEQ ID NO: 78374 - protein, 9 aa, Homo Sapiens
GKIETIEVM

SEQ ID NO: 78375 - protein, 9 aa, Homo Sapiens
GKIFTFGSY

SEQ ID NO: 78376 - protein, 9 aa, Homo Sapiens
GKIGTVMTF

SEQ ID NO: 78377 - protein, 9 aa, Homo Sapiens
GKIGYYLVL

SEQ ID NO: 78378 - protein, 9 aa, Homo Sapiens
GKIIKPLQY

SEQ ID NO: 78379 - protein, 9 aa, Homo Sapiens
GKINETINY

SEQ ID NO: 78380 - protein, 9 aa, Homo Sapiens
GKINVVPQF

SEQ ID NO: 78381 - protein, 9 aa, Homo Sapiens
GKIPVSRGF

SEQ ID NO: 78382 - protein, 9 aa, Homo Sapiens
GKIQFGYVY

SEQ ID NO: 78383 - protein, 9 aa, Homo Sapiens
GKIRKDLKY

SEQ ID NO: 78384 - protein, 9 aa, Homo Sapiens
GKISDARVV

SEQ ID NO: 78385 - protein, 9 aa, Homo Sapiens
GKISKEKSF

SEQ ID NO: 78386 - protein, 9 aa, Homo Sapiens
GKITDFIKF

SEQ ID NO: 78387 - protein, 9 aa, Homo Sapiens
GKKENDIDY

SEQ ID NO: 78388 - protein, 9 aa, Homo Sapiens
GKKGHVLSY

SEQ ID NO: 78389 - protein, 9 aa, Homo Sapiens
GKKKYETEF

SEQ ID NO: 78390 - protein, 9 aa, Homo Sapiens
GKKLEERGF

SEQ ID NO: 78391 - protein, 9 aa, Homo Sapiens
GKKLFGEGY

SEQ ID NO: 78392 - protein, 9 aa, Homo Sapiens
GKKLTELSM

SEQ ID NO: 78393 - protein, 9 aa, Homo Sapiens
GKLFNRIAY

SEQ ID NO: 78394 - protein, 9 aa, Homo Sapiens
GKLFPLPGY

SEQ ID NO: 78395 - protein, 9 aa, Homo Sapiens
GKLFSQLSY

SEQ ID NO: 78396 - protein, 9 aa, Homo Sapiens
GKLFTQNSH

SEQ ID NO: 78397 - protein, 9 aa, Homo Sapiens
GKLGFLASY

SEQ ID NO: 78398 - protein, 9 aa, Homo Sapiens
GKLGGQDSF

SEQ ID NO: 78399 - protein, 9 aa, Homo Sapiens
GKLIIWDSY

SEQ ID NO: 78400 - protein, 9 aa, Homo Sapiens
GKLKALKTY

SEQ ID NO: 78401 - protein, 9 aa, Homo Sapiens
GKLKDLSRF

SEQ ID NO: 78402 - protein, 9 aa, Homo Sapiens
GKLKGEATV

SEQ ID NO: 78403 - protein, 9 aa, Homo Sapiens
GKLKPTMAF

SEQ ID NO: 78404 - protein, 9 aa, Homo Sapiens
GKLKQFDAY

SEQ ID NO: 78405 - protein, 9 aa, Homo Sapiens
GKLLIGTLY

SEQ ID NO: 78406 - protein, 9 aa, Homo Sapiens
GKLLRDLEY

SEQ ID NO: 78407 - protein, 9 aa, Homo Sapiens
GKLLRTILF

SEQ ID NO: 78408 - protein, 9 aa, Homo Sapiens
GKLQKTVSY

SEQ ID NO: 78409 - protein, 9 aa, Homo Sapiens
GKLQYELQY

SEQ ID NO: 78410 - protein, 9 aa, Homo Sapiens
GKLVALHTF

SEQ ID NO: 78411 - protein, 9 aa, Homo Sapiens
GKLWNLNNY

SEQ ID NO: 78412 - protein, 9 aa, Homo Sapiens
GKMEIFTLF

SEQ ID NO: 78413 - protein, 9 aa, Homo Sapiens
GKMGKGVSF

SEQ ID NO: 78414 - protein, 9 aa, Homo Sapiens
GKMGTLVSL

SEQ ID NO: 78415 - protein, 9 aa, Homo Sapiens
GKMKIFVKY

SEQ ID NO: 78416 - protein, 9 aa, Homo Sapiens
GKMNPQSAF

SEQ ID NO: 78417 - protein, 9 aa, Homo Sapiens
GKNDPSSTF

SEQ ID NO: 78418 - protein, 9 aa, Homo Sapiens
GKNITQLSY

SEQ ID NO: 78419 - protein, 9 aa, Homo Sapiens
GKNLYTNEY

SEQ ID NO: 78420 - protein, 9 aa, Homo Sapiens
GKNPDEVSY

SEQ ID NO: 78421 - protein, 9 aa, Homo Sapiens
GKPEPKVVY

SEQ ID NO: 78422 - protein, 9 aa, Homo Sapiens
GKPFRQPCY

SEQ ID NO: 78423 - protein, 9 aa, Homo Sapiens
GKPGHLQFY

SEQ ID NO: 78424 - protein, 9 aa, Homo Sapiens
GKPLKLMVY

SEQ ID NO: 78425 - protein, 9 aa, Homo Sapiens
GKPNTLVCF

SEQ ID NO: 78426 - protein, 9 aa, Homo Sapiens
GKPTHFTVY

SEQ ID NO: 78427 - protein, 9 aa, Homo Sapiens
GKPVVNVSY

SEQ ID NO: 78428 - protein, 9 aa, Homo Sapiens
GKPWHKNCF

SEQ ID NO: 78429 - protein, 9 aa, Homo Sapiens
GKQQWQQLY

SEQ ID NO: 78430 - protein, 9 aa, Homo Sapiens
GKRFEIACY

SEQ ID NO: 78431 - protein, 9 aa, Homo Sapiens
GKRKEIYKY

SEQ ID NO: 78432 - protein, 9 aa, Homo Sapiens
GKRLDVTGF

SEQ ID NO: 78433 - protein, 9 aa, Homo Sapiens
GKRLNTREF

SEQ ID NO: 78434 - protein, 9 aa, Homo Sapiens
GKRPFGVSL

SEQ ID NO: 78435 - protein, 9 aa, Homo Sapiens
GKRPPGVLH

SEQ ID NO: 78436 - protein, 9 aa, Homo Sapiens
GKRTDEAAF

SEQ ID NO: 78437 - protein, 9 aa, Homo Sapiens
GKSDPFLEF

SEQ ID NO: 78438 - protein, 9 aa, Homo Sapiens
GKSEVTSSF

SEQ ID NO: 78439 - protein, 9 aa, Homo Sapiens
GKSFASKEY

SEQ ID NO: 78440 - protein, 9 aa, Homo Sapiens
GKSFGTSSY

SEQ ID NO: 78441 - protein, 9 aa, Homo Sapiens
GKSFSRSAY

SEQ ID NO: 78442 - protein, 9 aa, Homo Sapiens
GKSFSRSSF

SEQ ID NO: 78443 - protein, 9 aa, Homo Sapiens
GKSFTSNSY

SEQ ID NO: 78444 - protein, 9 aa, Homo Sapiens
GKSGHILSY

SEQ ID NO: 78445 - protein, 9 aa, Homo Sapiens
GKSHIGLVY

SEQ ID NO: 78446 - protein, 9 aa, Homo Sapiens
GKSSVINAM

SEQ ID NO: 78447 - protein, 9 aa, Homo Sapiens
GKSSVIQVF

SEQ ID NO: 78448 - protein, 9 aa, Homo Sapiens
GKSTSIQSF

SEQ ID NO: 78449 - protein, 9 aa, Homo Sapiens
GKSTVINAM

SEQ ID NO: 78450 - protein, 9 aa, Homo Sapiens
GKSYSVALY

SEQ ID NO: 78451 - protein, 9 aa, Homo Sapiens
GKTAVDTVF

SEQ ID NO: 78452 - protein, 9 aa, Homo Sapiens
GKTCLLISY

SEQ ID NO: 78453 - protein, 9 aa, Homo Sapiens
GKTDPGTVF

SEQ ID NO: 78454 - protein, 9 aa, Homo Sapiens
GKTFSKSTY

SEQ ID NO: 78455 - protein, 9 aa, Homo Sapiens
GKTFSNSSY

SEQ ID NO: 78456 - protein, 9 aa, Homo Sapiens
GKTFSQTSY

SEQ ID NO: 78457 - protein, 9 aa, Homo Sapiens
GKTFSQTYY

SEQ ID NO: 78458 - protein, 9 aa, Homo Sapiens
GKTIQTISF

SEQ ID NO: 78459 - protein, 9 aa, Homo Sapiens
GKTSLITRF

SEQ ID NO: 78460 - protein, 9 aa, Homo Sapiens
GKTSLVQRY

SEQ ID NO: 78461 - protein, 9 aa, Homo Sapiens
GKTTQVTQF

SEQ ID NO: 78462 - protein, 9 aa, Homo Sapiens
GKTVQIPVY

SEQ ID NO: 78463 - protein, 9 aa, Homo Sapiens
GKVAVVAGY

SEQ ID NO: 78464 - protein, 9 aa, Homo Sapiens
GKVFATTGY

SEQ ID NO: 78465 - protein, 9 aa, Homo Sapiens
GKVFFTEKF

SEQ ID NO: 78466 - protein, 9 aa, Homo Sapiens
GKVFKHRSY

SEQ ID NO: 78467 - protein, 9 aa, Homo Sapiens
GKVFRHNSY

SEQ ID NO: 78468 - protein, 9 aa, Homo Sapiens
GKVFSNNSY

SEQ ID NO: 78469 - protein, 9 aa, Homo Sapiens
GKVFSQNAY

SEQ ID NO: 78470 - protein, 9 aa, Homo Sapiens
GKVFSRITY

SEQ ID NO: 78471 - protein, 9 aa, Homo Sapiens
GKVFSRNSY

SEQ ID NO: 78472 - protein, 9 aa, Homo Sapiens
GKVGSQSSF

SEQ ID NO: 78473 - protein, 9 aa, Homo Sapiens
GKVIGIAIM

SEQ ID NO: 78474 - protein, 9 aa, Homo Sapiens
GKVKLVVRY

SEQ ID NO: 78475 - protein, 9 aa, Homo Sapiens
GKVLTDEQY

SEQ ID NO: 78476 - protein, 9 aa, Homo Sapiens
GKVMGKVFF

SEQ ID NO: 78477 - protein, 9 aa, Homo Sapiens
GKVPQPAIL

SEQ ID NO: 78478 - protein, 9 aa, Homo Sapiens
GKVPVVVSY

SEQ ID NO: 78479 - protein, 9 aa, Homo Sapiens
GKVQENSAY

SEQ ID NO: 78480 - protein, 9 aa, Homo Sapiens
GKVRPYSVY

SEQ ID NO: 78481 - protein, 9 aa, Homo Sapiens
GKVTGDTVY

SEQ ID NO: 78482 - protein, 9 aa, Homo Sapiens
GKVTSIMQF

SEQ ID NO: 78483 - protein, 9 aa, Homo Sapiens
GKVVKVTIM

SEQ ID NO: 78484 - protein, 9 aa, Homo Sapiens
GKVVVGHAL

SEQ ID NO: 78485 - protein, 9 aa, Homo Sapiens
GKVYSSSSY

SEQ ID NO: 78486 - protein, 9 aa, Homo Sapiens
GKWFTPTEF

SEQ ID NO: 78487 - protein, 9 aa, Homo Sapiens
GKWKQISKY

SEQ ID NO: 78488 - protein, 9 aa, Homo Sapiens
GKWNLKQQY

SEQ ID NO: 78489 - protein, 9 aa, Homo Sapiens
GKWPQIMIF

SEQ ID NO: 78490 - protein, 9 aa, Homo Sapiens
GKYASIILF

SEQ ID NO: 78491 - protein, 9 aa, Homo Sapiens
GKYASPDVF

SEQ ID NO: 78492 - protein, 9 aa, Homo Sapiens
GKYAVIGTY

SEQ ID NO: 78493 - protein, 9 aa, Homo Sapiens
GKYEAVERY

SEQ ID NO: 78494 - protein, 9 aa, Homo Sapiens
GKYEEVEYY

SEQ ID NO: 78495 - protein, 9 aa, Homo Sapiens
GKYFDKASY

SEQ ID NO: 78496 - protein, 9 aa, Homo Sapiens
GKYFEPEAY

SEQ ID NO: 78497 - protein, 9 aa, Homo Sapiens
GKYFSLEGY

SEQ ID NO: 78498 - protein, 9 aa, Homo Sapiens
GKYGFVIAV

SEQ ID NO: 78499 - protein, 9 aa, Homo Sapiens
GKYGGMQMF

SEQ ID NO: 78500 - protein, 9 aa, Homo Sapiens
GKYGSSLEF

SEQ ID NO: 78501 - protein, 9 aa, Homo Sapiens
GKYGTLQEF

SEQ ID NO: 78502 - protein, 9 aa, Homo Sapiens
GKYIPKQSF

SEQ ID NO: 78503 - protein, 9 aa, Homo Sapiens
GKYKFLQKY

SEQ ID NO: 78504 - protein, 9 aa, Homo Sapiens
GKYKSVSAF

SEQ ID NO: 78505 - protein, 9 aa, Homo Sapiens
GKYLELLGY

SEQ ID NO: 78506 - protein, 9 aa, Homo Sapiens
GKYNQILAF

SEQ ID NO: 78507 - protein, 9 aa, Homo Sapiens
GKYPSWTFY

SEQ ID NO: 78508 - protein, 9 aa, Homo Sapiens
GKYQEALSY

SEQ ID NO: 78509 - protein, 9 aa, Homo Sapiens
GKYVSVGAF

SEQ ID NO: 78510 - protein, 9 aa, Homo Sapiens
GKYYFYDNY

SEQ ID NO: 78511 - protein, 9 aa, Homo Sapiens
GKYYRVCTL

SEQ ID NO: 78512 - protein, 9 aa, Homo Sapiens
GMWKGGRSH

SEQ ID NO: 78513 - protein, 9 aa, Homo Sapiens
GMYGKIAVM

SEQ ID NO: 78514 - protein, 9 aa, Homo Sapiens
GNYATVISH

SEQ ID NO: 78515 - protein, 9 aa, Homo Sapiens
GQAGMHATY

SEQ ID NO: 78516 - protein, 9 aa, Homo Sapiens
GQAPPGKAL

SEQ ID NO: 78517 - protein, 9 aa, Homo Sapiens
GQCRLRVEF

SEQ ID NO: 78518 - protein, 9 aa, Homo Sapiens
GQEGKYRVY

SEQ ID NO: 78519 - protein, 9 aa, Homo Sapiens
GQEVSPKVY

SEQ ID NO: 78520 - protein, 9 aa, Homo Sapiens
GQFASDVQF

SEQ ID NO: 78521 - protein, 9 aa, Homo Sapiens
GQFGTINNF

SEQ ID NO: 78522 - protein, 9 aa, Homo Sapiens
GQFLAPNSH

SEQ ID NO: 78523 - protein, 9 aa, Homo Sapiens
GQFLVRIIY

SEQ ID NO: 78524 - protein, 9 aa, Homo Sapiens
GQFPGHNEF

SEQ ID NO: 78525 - protein, 9 aa, Homo Sapiens
GQFSKPFSF

SEQ ID NO: 78526 - protein, 9 aa, Homo Sapiens
GQHGYSTGY

SEQ ID NO: 78527 - protein, 9 aa, Homo Sapiens
GQHIQLVQY

SEQ ID NO: 78528 - protein, 9 aa, Homo Sapiens
GQHNQSVNY

SEQ ID NO: 78529 - protein, 9 aa, Homo Sapiens
GQHSHVVRY

SEQ ID NO: 78530 - protein, 9 aa, Homo Sapiens
GQHVTAALY

SEQ ID NO: 78531 - protein, 9 aa, Homo Sapiens
GQIEFLRCY

SEQ ID NO: 78532 - protein, 9 aa, Homo Sapiens
GQIEHKLAF

SEQ ID NO: 78533 - protein, 9 aa, Homo Sapiens
GQIPQILYY

SEQ ID NO: 78534 - protein, 9 aa, Homo Sapiens
GQKIFYVNY

SEQ ID NO: 78535 - protein, 9 aa, Homo Sapiens
GQKLAEQMF

SEQ ID NO: 78536 - protein, 9 aa, Homo Sapiens
GQKLGGQSF

SEQ ID NO: 78537 - protein, 9 aa, Homo Sapiens
GQKPGGSDF

SEQ ID NO: 78538 - protein, 9 aa, Homo Sapiens
GQKPWSQHY

SEQ ID NO: 78539 - protein, 9 aa, Homo Sapiens
GQKQYNVDY

SEQ ID NO: 78540 - protein, 9 aa, Homo Sapiens
GQLFHIACF

SEQ ID NO: 78541 - protein, 9 aa, Homo Sapiens
GQLGFHVKY

SEQ ID NO: 78542 - protein, 9 aa, Homo Sapiens
GQLGFHVNY

SEQ ID NO: 78543 - protein, 9 aa, Homo Sapiens
GQLGLLARY

SEQ ID NO: 78544 - protein, 9 aa, Homo Sapiens
GQLGTHAEY

SEQ ID NO: 78545 - protein, 9 aa, Homo Sapiens
GQLMFMNKY

SEQ ID NO: 78546 - protein, 9 aa, Homo Sapiens
GQLPGLHEY

SEQ ID NO: 78547 - protein, 9 aa, Homo Sapiens
GQLVKMLLY

SEQ ID NO: 78548 - protein, 9 aa, Homo Sapiens
GQLVRSILY

SEQ ID NO: 78549 - protein, 9 aa, Homo Sapiens
GQMIFAQAL

SEQ ID NO: 78550 - protein, 9 aa, Homo Sapiens
GQNAQTMAY

SEQ ID NO: 78551 - protein, 9 aa, Homo Sapiens
GQNASVLAY

SEQ ID NO: 78552 - protein, 9 aa, Homo Sapiens
GQNKKVMIY

SEQ ID NO: 78553 - protein, 9 aa, Homo Sapiens
GQNPFELAF

SEQ ID NO: 78554 - protein, 9 aa, Homo Sapiens
GQPGAFTCY

SEQ ID NO: 78555 - protein, 9 aa, Homo Sapiens
GQQGSCLVY

SEQ ID NO: 78556 - protein, 9 aa, Homo Sapiens
GQQRCIATY

SEQ ID NO: 78557 - protein, 9 aa, Homo Sapiens
GQRAKSMKF

SEQ ID NO: 78558 - protein, 9 aa, Homo Sapiens
GQREGSRGF

SEQ ID NO: 78559 - protein, 9 aa, Homo Sapiens
GQRGSGSSF

SEQ ID NO: 78560 - protein, 9 aa, Homo Sapiens
GQRKEVEVF

SEQ ID NO: 78561 - protein, 9 aa, Homo Sapiens
GQRKPATSY

SEQ ID NO: 78562 - protein, 9 aa, Homo Sapiens
GQRPTQPVY

SEQ ID NO: 78563 - protein, 9 aa, Homo Sapiens
GQRQVGVGY

SEQ ID NO: 78564 - protein, 9 aa, Homo Sapiens
GQRSYLVQY

SEQ ID NO: 78565 - protein, 9 aa, Homo Sapiens
GQRTFGENY

SEQ ID NO: 78566 - protein, 9 aa, Homo Sapiens
GQSKDKVIY

SEQ ID NO: 78567 - protein, 9 aa, Homo Sapiens
GQSRLIFTY

SEQ ID NO: 78568 - protein, 9 aa, Homo Sapiens
GQTAYATSY

SEQ ID NO: 78569 - protein, 9 aa, Homo Sapiens
GQTGTGKTF

SEQ ID NO: 78570 - protein, 9 aa, Homo Sapiens
GQTGTKSVF

SEQ ID NO: 78571 - protein, 9 aa, Homo Sapiens
GQTKPVVVY

SEQ ID NO: 78572 - protein, 9 aa, Homo Sapiens
GQTKPVYVY

SEQ ID NO: 78573 - protein, 9 aa, Homo Sapiens
GQTKQVTVY

SEQ ID NO: 78574 - protein, 9 aa, Homo Sapiens
GQVAAGGAF

SEQ ID NO: 78575 - protein, 9 aa, Homo Sapiens
GQVKAAVKY

SEQ ID NO: 78576 - protein, 9 aa, Homo Sapiens
GQVKTGISM

SEQ ID NO: 78577 - protein, 9 aa, Homo Sapiens
GQVQKIVLY

SEQ ID NO: 78578 - protein, 9 aa, Homo Sapiens
GQVQLPSPH

SEQ ID NO: 78579 - protein, 9 aa, Homo Sapiens
GQVQVRTLY

SEQ ID NO: 78580 - protein, 9 aa, Homo Sapiens
GQVTFLHVF

SEQ ID NO: 78581 - protein, 9 aa, Homo Sapiens
GQVYSELKY

SEQ ID NO: 78582 - protein, 9 aa, Homo Sapiens
GQWGGGSHY

SEQ ID NO: 78583 - protein, 9 aa, Homo Sapiens
GQYKGPIQY

SEQ ID NO: 78584 - protein, 9 aa, Homo Sapiens
GQYPTQPTY

SEQ ID NO: 78585 - protein, 9 aa, Homo Sapiens
GQYPVFNQY

SEQ ID NO: 78586 - protein, 9 aa, Homo Sapiens
GQYPYPSGF

SEQ ID NO: 78587 - protein, 9 aa, Homo Sapiens
GQYQFDVKY

SEQ ID NO: 78588 - protein, 9 aa, Homo Sapiens
GQYYKPEQF

SEQ ID NO: 78589 - protein, 9 aa, Homo Sapiens
HERTFLLEY

SEQ ID NO: 78590 - protein, 9 aa, Homo Sapiens
HGIDPTGTY

SEQ ID NO: 78591 - protein, 9 aa, Homo Sapiens
HHFLQVLTY

SEQ ID NO: 78592 - protein, 9 aa, Homo Sapiens
HHGPMAVAF

SEQ ID NO: 78593 - protein, 9 aa, Homo Sapiens
HHIPDVITY

SEQ ID NO: 78594 - protein, 9 aa, Homo Sapiens
HHVIARHEY

SEQ ID NO: 78595 - protein, 9 aa, Homo Sapiens
HKFPDEDSY

SEQ ID NO: 78596 - protein, 9 aa, Homo Sapiens
HKGKFGHEF

SEQ ID NO: 78597 - protein, 9 aa, Homo Sapiens
HKIDKSHEF

SEQ ID NO: 78598 - protein, 9 aa, Homo Sapiens
HKIEAGNEF

SEQ ID NO: 78599 - protein, 9 aa, Homo Sapiens
HKKPFLAKY

SEQ ID NO: 78600 - protein, 9 aa, Homo Sapiens
HKLDISDEF

SEQ ID NO: 78601 - protein, 9 aa, Homo Sapiens
HKLGNSCEF

SEQ ID NO: 78602 - protein, 9 aa, Homo Sapiens
HKLWDPNEF

SEQ ID NO: 78603 - protein, 9 aa, Homo Sapiens
HKMVVESAY

SEQ ID NO: 78604 - protein, 9 aa, Homo Sapiens
HKPDFISLF

SEQ ID NO: 78605 - protein, 9 aa, Homo Sapiens
HKRIHGVGF

SEQ ID NO: 78606 - protein, 9 aa, Homo Sapiens
HKRLPDVRF

SEQ ID NO: 78607 - protein, 9 aa, Homo Sapiens
HKVANTSSF

SEQ ID NO: 78608 - protein, 9 aa, Homo Sapiens
HKVISGTTL

SEQ ID NO: 78609 - protein, 9 aa, Homo Sapiens
HKYLTVKDY

SEQ ID NO: 78610 - protein, 9 aa, Homo Sapiens
HQAIHTIEF

SEQ ID NO: 78611 - protein, 9 aa, Homo Sapiens
HQAIHTIEY

SEQ ID NO: 78612 - protein, 9 aa, Homo Sapiens
HQALPSVSH

SEQ ID NO: 78613 - protein, 9 aa, Homo Sapiens
HQAPRQLFY

SEQ ID NO: 78614 - protein, 9 aa, Homo Sapiens
HQASHQPLY

SEQ ID NO: 78615 - protein, 9 aa, Homo Sapiens
HQHLSKESM

SEQ ID NO: 78616 - protein, 9 aa, Homo Sapiens
HQITVLHVY

SEQ ID NO: 78617 - protein, 9 aa, Homo Sapiens
HQKKEFVKY

SEQ ID NO: 78618 - protein, 9 aa, Homo Sapiens
HQLATDSTF

SEQ ID NO: 78619 - protein, 9 aa, Homo Sapiens
HQLEFIQKF

SEQ ID NO: 78620 - protein, 9 aa, Homo Sapiens
HQLGNNSVF

SEQ ID NO: 78621 - protein, 9 aa, Homo Sapiens
HQMTPSSSY

SEQ ID NO: 78622 - protein, 9 aa, Homo Sapiens
HQNSNIRTY

SEQ ID NO: 78623 - protein, 9 aa, Homo Sapiens
HQQPPSQQY

SEQ ID NO: 78624 - protein, 9 aa, Homo Sapiens
HQRLQLCVF

SEQ ID NO: 78625 - protein, 9 aa, Homo Sapiens
HQRQNINKF

SEQ ID NO: 78626 - protein, 9 aa, Homo Sapiens
HQRSFTETM

SEQ ID NO: 78627 - protein, 9 aa, Homo Sapiens
HQVLIMTCY

SEQ ID NO: 78628 - protein, 9 aa, Homo Sapiens
HQVSLLARF

SEQ ID NO: 78629 - protein, 9 aa, Homo Sapiens
HQYFSYNQM

SEQ ID NO: 78630 - protein, 9 aa, Homo Sapiens
HQYSIQVAF

SEQ ID NO: 78631 - protein, 9 aa, Homo Sapiens
HSWLTRAMY

SEQ ID NO: 78632 - protein, 9 aa, Homo Sapiens
HVGKTPIVG

SEQ ID NO: 78633 - protein, 9 aa, Homo Sapiens
IHCDMVITY

SEQ ID NO: 78634 - protein, 9 aa, Homo Sapiens
IHFISPNIY

SEQ ID NO: 78635 - protein, 9 aa, Homo Sapiens
IHNPTGRSY

SEQ ID NO: 78636 - protein, 9 aa, Homo Sapiens
IHYQMVYSY

SEQ ID NO: 78637 - protein, 9 aa, Homo Sapiens
IILMILLLI

SEQ ID NO: 78638 - protein, 9 aa, Homo Sapiens
IILPFLILL

SEQ ID NO: 78639 - protein, 9 aa, Homo Sapiens
IKAAFKTSY

SEQ ID NO: 78640 - protein, 9 aa, Homo Sapiens
IKADHVSTY

SEQ ID NO: 78641 - protein, 9 aa, Homo Sapiens
IKAPTPTCF

SEQ ID NO: 78642 - protein, 9 aa, Homo Sapiens
IKDNVVIVY

SEQ ID NO: 78643 - protein, 9 aa, Homo Sapiens
IKDPKEREF

SEQ ID NO: 78644 - protein, 9 aa, Homo Sapiens
IKENPSSQY

SEQ ID NO: 78645 - protein, 9 aa, Homo Sapiens
IKFFTGDVF

SEQ ID NO: 78646 - protein, 9 aa, Homo Sapiens
IKFSEEQRF

SEQ ID NO: 78647 - protein, 9 aa, Homo Sapiens
IKHPNLVRY

SEQ ID NO: 78648 - protein, 9 aa, Homo Sapiens
IKISNPTEF

SEQ ID NO: 78649 - protein, 9 aa, Homo Sapiens
IKKDSGKEF

SEQ ID NO: 78650 - protein, 9 aa, Homo Sapiens
IKKEFDKKY

SEQ ID NO: 78651 - protein, 9 aa, Homo Sapiens
IKKIADDKY

SEQ ID NO: 78652 - protein, 9 aa, Homo Sapiens
IKKKPGTSL

SEQ ID NO: 78653 - protein, 9 aa, Homo Sapiens
IKLLETESF

SEQ ID NO: 78654 - protein, 9 aa, Homo Sapiens
IKLPSVTSF

SEQ ID NO: 78655 - protein, 9 aa, Homo Sapiens
IKMGLLSSF

SEQ ID NO: 78656 - protein, 9 aa, Homo Sapiens
IKNQLIEQF

SEQ ID NO: 78657 - protein, 9 aa, Homo Sapiens
IKPDGLLEF

SEQ ID NO: 78658 - protein, 9 aa, Homo Sapiens
IKPEQTTEY

SEQ ID NO: 78659 - protein, 9 aa, Homo Sapiens
IKPETILYY

SEQ ID NO: 78660 - protein, 9 aa, Homo Sapiens
IKPGTSVEY

SEQ ID NO: 78661 - protein, 9 aa, Homo Sapiens
IKVIPTLAL

SEQ ID NO: 78662 - protein, 9 aa, Homo Sapiens
IKVPDFSEY

SEQ ID NO: 78663 - protein, 9 aa, Homo Sapiens
IKYNTIETF

SEQ ID NO: 78664 - protein, 9 aa, Homo Sapiens
ILAARSPVF

SEQ ID NO: 78665 - protein, 9 aa, Homo Sapiens
ILGPPGSVY

SEQ ID NO: 78666 - protein, 9 aa, Homo Sapiens
ILIACGTSY

SEQ ID NO: 78667 - protein, 9 aa, Homo Sapiens
ILKPDGSLY

SEQ ID NO: 78668 - protein, 9 aa, Homo Sapiens
ILRPGGCLF

SEQ ID NO: 78669 - protein, 9 aa, Homo Sapiens
ILTVGGTAY

SEQ ID NO: 78670 - protein, 9 aa, Homo Sapiens
ILYNIKQEY

SEQ ID NO: 78671 - protein, 9 aa, Homo Sapiens
IMEHRFKTY

SEQ ID NO: 78672 - protein, 9 aa, Homo Sapiens
IMKIDIEKF

SEQ ID NO: 78673 - protein, 9 aa, Homo Sapiens
IMKNPEVEF

SEQ ID NO: 78674 - protein, 9 aa, Homo Sapiens
IMVKPHEEY

SEQ ID NO: 78675 - protein, 9 aa, Homo Sapiens
IQAGIFQEF

SEQ ID NO: 78676 - protein, 9 aa, Homo Sapiens
IQASTVVTY

SEQ ID NO: 78677 - protein, 9 aa, Homo Sapiens
IQEEFYRVY

SEQ ID NO: 78678 - protein, 9 aa, Homo Sapiens
IQEESLRTY

SEQ ID NO: 78679 - protein, 9 aa, Homo Sapiens
IQFEIAHAY

SEQ ID NO: 78680 - protein, 9 aa, Homo Sapiens
IQFKLHESY

SEQ ID NO: 78681 - protein, 9 aa, Homo Sapiens
IQFNLRNLY

SEQ ID NO: 78682 - protein, 9 aa, Homo Sapiens
IQHSTIIGF

SEQ ID NO: 78683 - protein, 9 aa, Homo Sapiens
IQKPGSNAF

SEQ ID NO: 78684 - protein, 9 aa, Homo Sapiens
IQKQFEELY

SEQ ID NO: 78685 - protein, 9 aa, Homo Sapiens
IQLLQKLTY

SEQ ID NO: 78686 - protein, 9 aa, Homo Sapiens
IQNDRQLQY

SEQ ID NO: 78687 - protein, 9 aa, Homo Sapiens
IQNNPHASY

SEQ ID NO: 78688 - protein, 9 aa, Homo Sapiens
IQNPDPAVY

SEQ ID NO: 78689 - protein, 9 aa, Homo Sapiens
IQRQETISL

SEQ ID NO: 78690 - protein, 9 aa, Homo Sapiens
IQRTEAYEY

SEQ ID NO: 78691 - protein, 9 aa, Homo Sapiens
IQVDPNYAY

SEQ ID NO: 78692 - protein, 9 aa, Homo Sapiens
IQVKVRDTY

SEQ ID NO: 78693 - protein, 9 aa, Homo Sapiens
IQVVSKNLY

SEQ ID NO: 78694 - protein, 9 aa, Homo Sapiens
IQYDKTNVL

SEQ ID NO: 78695 - protein, 9 aa, Homo Sapiens
IQYKTLRTF

SEQ ID NO: 78696 - protein, 9 aa, Homo Sapiens
ISRETGEPY

SEQ ID NO: 78697 - protein, 9 aa, Homo Sapiens
KAFDFPSSF

SEQ ID NO: 78698 - protein, 9 aa, Homo Sapiens
KALSRLISF

SEQ ID NO: 78699 - protein, 9 aa, Homo Sapiens
KAVLDSYEY

SEQ ID NO: 78700 - protein, 9 aa, Homo Sapiens
KAYGASKTF

SEQ ID NO: 78701 - protein, 9 aa, Homo Sapiens
KEYEKALKY

SEQ ID NO: 78702 - protein, 9 aa, Homo Sapiens
KEYERFSKY

SEQ ID NO: 78703 - protein, 9 aa, Homo Sapiens
KGRVFEVSL

SEQ ID NO: 78704 - protein, 9 aa, Homo Sapiens
KHFEVLISY

SEQ ID NO: 78705 - protein, 9 aa, Homo Sapiens
KHFGTILNY

SEQ ID NO: 78706 - protein, 9 aa, Homo Sapiens
KHKTFVEKY

SEQ ID NO: 78707 - protein, 9 aa, Homo Sapiens
KHLDKFSSY

SEQ ID NO: 78708 - protein, 9 aa, Homo Sapiens
KHQEHILRF

SEQ ID NO: 78709 - protein, 9 aa, Homo Sapiens
KIRGGKQFI

SEQ ID NO: 78710 - protein, 9 aa, Homo Sapiens
KKADCTITM

SEQ ID NO: 78711 - protein, 9 aa, Homo Sapiens
KKADIGVAM

SEQ ID NO: 78712 - protein, 9 aa, Homo Sapiens
KKADLILSY

SEQ ID NO: 78713 - protein, 9 aa, Homo Sapiens
KKAEIGIAM

SEQ ID NO: 78714 - protein, 9 aa, Homo Sapiens
KKAHLGTAL

SEQ ID NO: 78715 - protein, 9 aa, Homo Sapiens
KKAIATLCF

SEQ ID NO: 78716 - protein, 9 aa, Homo Sapiens
KKAIQDPAF

SEQ ID NO: 78717 - protein, 9 aa, Homo Sapiens
KKALAAAGY

SEQ ID NO: 78718 - protein, 9 aa, Homo Sapiens
KKALAAGGY

SEQ ID NO: 78719 - protein, 9 aa, Homo Sapiens
KKAMPGAEY

SEQ ID NO: 78720 - protein, 9 aa, Homo Sapiens
KKAMTVGEY

SEQ ID NO: 78721 - protein, 9 aa, Homo Sapiens
KKANITFEY

SEQ ID NO: 78722 - protein, 9 aa, Homo Sapiens
KKAPAGPSL

SEQ ID NO: 78723 - protein, 9 aa, Homo Sapiens
KKAPDFVFY

SEQ ID NO: 78724 - protein, 9 aa, Homo Sapiens
KKAPLLLHY

SEQ ID NO: 78725 - protein, 9 aa, Homo Sapiens
KKASIGYTY

SEQ ID NO: 78726 - protein, 9 aa, Homo Sapiens
KKAVGGVAL

SEQ ID NO: 78727 - protein, 9 aa, Homo Sapiens
KKCDISLQF

SEQ ID NO: 78728 - protein, 9 aa, Homo Sapiens
KKDPVKKIF

SEQ ID NO: 78729 - protein, 9 aa, Homo Sapiens
KKELTGRTL

SEQ ID NO: 78730 - protein, 9 aa, Homo Sapiens
KKFASFNAY

SEQ ID NO: 78731 - protein, 9 aa, Homo Sapiens
KKFENTEMF

SEQ ID NO: 78732 - protein, 9 aa, Homo Sapiens
KKFGDFITL

SEQ ID NO: 78733 - protein, 9 aa, Homo Sapiens
KKFKDIIHY

SEQ ID NO: 78734 - protein, 9 aa, Homo Sapiens
KKFKGDLAY

SEQ ID NO: 78735 - protein, 9 aa, Homo Sapiens
KKFKIVRTF

SEQ ID NO: 78736 - protein, 9 aa, Homo Sapiens
KKFLEPYIY

SEQ ID NO: 78737 - protein, 9 aa, Homo Sapiens
KKFPQMTSY

SEQ ID NO: 78738 - protein, 9 aa, Homo Sapiens
KKFQRPHDY

SEQ ID NO: 78739 - protein, 9 aa, Homo Sapiens
KKFQSFQDH

SEQ ID NO: 78740 - protein, 9 aa, Homo Sapiens
KKFQSFQEH

SEQ ID NO: 78741 - protein, 9 aa, Homo Sapiens
KKFSAMHEF

SEQ ID NO: 78742 - protein, 9 aa, Homo Sapiens
KKFSFKKPF

SEQ ID NO: 78743 - protein, 9 aa, Homo Sapiens
KKFSIEKRF

SEQ ID NO: 78744 - protein, 9 aa, Homo Sapiens
KKFSLPLYF

SEQ ID NO: 78745 - protein, 9 aa, Homo Sapiens
KKFVIDVGY

SEQ ID NO: 78746 - protein, 9 aa, Homo Sapiens
KKFVTQQQY

SEQ ID NO: 78747 - protein, 9 aa, Homo Sapiens
KKGFTAVGY

SEQ ID NO: 78748 - protein, 9 aa, Homo Sapiens
KKGILLQLF

SEQ ID NO: 78749 - protein, 9 aa, Homo Sapiens
KKGPSGYGF

SEQ ID NO: 78750 - protein, 9 aa, Homo Sapiens
KKHILVMSF

SEQ ID NO: 78751 - protein, 9 aa, Homo Sapiens
KKHLVSAGY

SEQ ID NO: 78752 - protein, 9 aa, Homo Sapiens
KKHPSLIPL

SEQ ID NO: 78753 - protein, 9 aa, Homo Sapiens
KKHSQFIGY

SEQ ID NO: 78754 - protein, 9 aa, Homo Sapiens
KKIAIGVIF

SEQ ID NO: 78755 - protein, 9 aa, Homo Sapiens
KKIDSQRDF

SEQ ID NO: 78756 - protein, 9 aa, Homo Sapiens
KKIEDLIKY

SEQ ID NO: 78757 - protein, 9 aa, Homo Sapiens
KKIEDNNTL

SEQ ID NO: 78758 - protein, 9 aa, Homo Sapiens
KKIEFGVVY

SEQ ID NO: 78759 - protein, 9 aa, Homo Sapiens
KKIEHDVVM

SEQ ID NO: 78760 - protein, 9 aa, Homo Sapiens
KKIEKLEEY

SEQ ID NO: 78761 - protein, 9 aa, Homo Sapiens
KKIELDVKY

SEQ ID NO: 78762 - protein, 9 aa, Homo Sapiens
KKIEMVRAY

SEQ ID NO: 78763 - protein, 9 aa, Homo Sapiens
KKIENLEAL

SEQ ID NO: 78764 - protein, 9 aa, Homo Sapiens
KKIEQQGGF

SEQ ID NO: 78765 - protein, 9 aa, Homo Sapiens
KKIPGGKKF

SEQ ID NO: 78766 - protein, 9 aa, Homo Sapiens
KKIPSTVEF

SEQ ID NO: 78767 - protein, 9 aa, Homo Sapiens
KKIRTSPTF

SEQ ID NO: 78768 - protein, 9 aa, Homo Sapiens
KKISELDAF

SEQ ID NO: 78769 - protein, 9 aa, Homo Sapiens
KKISSKINY

SEQ ID NO: 78770 - protein, 9 aa, Homo Sapiens
KKITNNIVY

SEQ ID NO: 78771 - protein, 9 aa, Homo Sapiens
KKIYLQDEF

SEQ ID NO: 78772 - protein, 9 aa, Homo Sapiens
KKKAEGTVF

SEQ ID NO: 78773 - protein, 9 aa, Homo Sapiens
KKKDFDTAL

SEQ ID NO: 78774 - protein, 9 aa, Homo Sapiens
KKKEPEPNF

SEQ ID NO: 78775 - protein, 9 aa, Homo Sapiens
KKKIPSLSF

SEQ ID NO: 78776 - protein, 9 aa, Homo Sapiens
KKKPKDLDF

SEQ ID NO: 78777 - protein, 9 aa, Homo Sapiens
KKKPVVTIY

SEQ ID NO: 78778 - protein, 9 aa, Homo Sapiens
KKKQIEQKF

SEQ ID NO: 78779 - protein, 9 aa, Homo Sapiens
KKKVERLTM

SEQ ID NO: 78780 - protein, 9 aa, Homo Sapiens
KKLANKVVY

SEQ ID NO: 78781 - protein, 9 aa, Homo Sapiens
KKLDLISEL

SEQ ID NO: 78782 - protein, 9 aa, Homo Sapiens
KKLDSQISL

SEQ ID NO: 78783 - protein, 9 aa, Homo Sapiens
KKLELSHEY

SEQ ID NO: 78784 - protein, 9 aa, Homo Sapiens
KKLLSLLTF

SEQ ID NO: 78785 - protein, 9 aa, Homo Sapiens
KKLPIVACF

SEQ ID NO: 78786 - protein, 9 aa, Homo Sapiens
KKLQKAALL

SEQ ID NO: 78787 - protein, 9 aa, Homo Sapiens
KKLQQTQEY

SEQ ID NO: 78788 - protein, 9 aa, Homo Sapiens
KKLSSAVVF

SEQ ID NO: 78789 - protein, 9 aa, Homo Sapiens
KKLSSPSNY

SEQ ID NO: 78790 - protein, 9 aa, Homo Sapiens
KKMELLQKY

SEQ ID NO: 78791 - protein, 9 aa, Homo Sapiens
KKMKLQGQF

SEQ ID NO: 78792 - protein, 9 aa, Homo Sapiens
KKMPKIPVL

SEQ ID NO: 78793 - protein, 9 aa, Homo Sapiens
KKMPSKTSL

SEQ ID NO: 78794 - protein, 9 aa, Homo Sapiens
KKMTLQTGF

SEQ ID NO: 78795 - protein, 9 aa, Homo Sapiens
KKMVSKYKY

SEQ ID NO: 78796 - protein, 9 aa, Homo Sapiens
KKNELIEAF

SEQ ID NO: 78797 - protein, 9 aa, Homo Sapiens
KKNLVTISY

SEQ ID NO: 78798 - protein, 9 aa, Homo Sapiens
KKNPFHLEL

SEQ ID NO: 78799 - protein, 9 aa, Homo Sapiens
KKNPNIKSL

SEQ ID NO: 78800 - protein, 9 aa, Homo Sapiens
KKPDYKVAY

SEQ ID NO: 78801 - protein, 9 aa, Homo Sapiens
KKPELVISY

SEQ ID NO: 78802 - protein, 9 aa, Homo Sapiens
KKPLSTPSM

SEQ ID NO: 78803 - protein, 9 aa, Homo Sapiens
KKPTGLVTF

SEQ ID NO: 78804 - protein, 9 aa, Homo Sapiens
KKPTVTLTY

SEQ ID NO: 78805 - protein, 9 aa, Homo Sapiens
KKQDPDVPF

SEQ ID NO: 78806 - protein, 9 aa, Homo Sapiens
KKRERDLEL

SEQ ID NO: 78807 - protein, 9 aa, Homo Sapiens
KKRLETVAL

SEQ ID NO: 78808 - protein, 9 aa, Homo Sapiens
KKRPPLQEY

SEQ ID NO: 78809 - protein, 9 aa, Homo Sapiens
KKSDPVVSY

SEQ ID NO: 78810 - protein, 9 aa, Homo Sapiens
KKSDVEAIF

SEQ ID NO: 78811 - protein, 9 aa, Homo Sapiens
KKSDVETIF

SEQ ID NO: 78812 - protein, 9 aa, Homo Sapiens
KKSEPEPVY

SEQ ID NO: 78813 - protein, 9 aa, Homo Sapiens
KKSKENVLY

SEQ ID NO: 78814 - protein, 9 aa, Homo Sapiens
KKTFSYAGF

SEQ ID NO: 78815 - protein, 9 aa, Homo Sapiens
KKVAPAPAV

SEQ ID NO: 78816 - protein, 9 aa, Homo Sapiens
KKVAVATPA

SEQ ID NO: 78817 - protein, 9 aa, Homo Sapiens
KKVEKSKIF

SEQ ID NO: 78818 - protein, 9 aa, Homo Sapiens
KKVEQTIQY

SEQ ID NO: 78819 - protein, 9 aa, Homo Sapiens
KKVERQTEL

SEQ ID NO: 78820 - protein, 9 aa, Homo Sapiens
KKVGIVGKY

SEQ ID NO: 78821 - protein, 9 aa, Homo Sapiens
KKVNVQVSF

SEQ ID NO: 78822 - protein, 9 aa, Homo Sapiens
KKVPHNINF

SEQ ID NO: 78823 - protein, 9 aa, Homo Sapiens
KKVQPNSSY

SEQ ID NO: 78824 - protein, 9 aa, Homo Sapiens
KKVSKAAIL

SEQ ID NO: 78825 - protein, 9 aa, Homo Sapiens
KKVTGELAF

SEQ ID NO: 78826 - protein, 9 aa, Homo Sapiens
KKVTNIISF

SEQ ID NO: 78827 - protein, 9 aa, Homo Sapiens
KKVWKPQLF

SEQ ID NO: 78828 - protein, 9 aa, Homo Sapiens
KKWATKTRL

SEQ ID NO: 78829 - protein, 9 aa, Homo Sapiens
KKWFSDHRY

SEQ ID NO: 78830 - protein, 9 aa, Homo Sapiens
KKWFSDTRY

SEQ ID NO: 78831 - protein, 9 aa, Homo Sapiens
KKWISLTNF

SEQ ID NO: 78832 - protein, 9 aa, Homo Sapiens
KKWNLPVYF

SEQ ID NO: 78833 - protein, 9 aa, Homo Sapiens
KKWQKSLQY

SEQ ID NO: 78834 - protein, 9 aa, Homo Sapiens
KKWVNEVRY

SEQ ID NO: 78835 - protein, 9 aa, Homo Sapiens
KKYAEALDY

SEQ ID NO: 78836 - protein, 9 aa, Homo Sapiens
KKYAEVLRY

SEQ ID NO: 78837 - protein, 9 aa, Homo Sapiens
KKYEQLKAM

SEQ ID NO: 78838 - protein, 9 aa, Homo Sapiens
KKYFETEQM

SEQ ID NO: 78839 - protein, 9 aa, Homo Sapiens
KKYLMIEEY

SEQ ID NO: 78840 - protein, 9 aa, Homo Sapiens
KKYNMKLVY

SEQ ID NO: 78841 - protein, 9 aa, Homo Sapiens
KKYPEKLYF

SEQ ID NO: 78842 - protein, 9 aa, Homo Sapiens
KKYPFILEV

SEQ ID NO: 78843 - protein, 9 aa, Homo Sapiens
KKYQLTNAF

SEQ ID NO: 78844 - protein, 9 aa, Homo Sapiens
KLFACEVLY

SEQ ID NO: 78845 - protein, 9 aa, Homo Sapiens
KLFIGGLSF

SEQ ID NO: 78846 - protein, 9 aa, Homo Sapiens
KLFLTGESY

SEQ ID NO: 78847 - protein, 9 aa, Homo Sapiens
KLPDIFSVY

SEQ ID NO: 78848 - protein, 9 aa, Homo Sapiens
KLTEPHQVY

SEQ ID NO: 78849 - protein, 9 aa, Homo Sapiens
KLYEKFLEF

SEQ ID NO: 78850 - protein, 9 aa, Homo Sapiens
KLYQSIIGY

SEQ ID NO: 78851 - protein, 9 aa, Homo Sapiens
KMHQSRISY

SEQ ID NO: 78852 - protein, 9 aa, Homo Sapiens
KMKEIAEAY

SEQ ID NO: 78853 - protein, 9 aa, Homo Sapiens
KMRPGEATL

SEQ ID NO: 78854 - protein, 9 aa, Homo Sapiens
KMYTDGSTF

SEQ ID NO: 78855 - protein, 9 aa, Homo Sapiens
KNHEFIATF

SEQ ID NO: 78856 - protein, 9 aa, Homo Sapiens
KQADPFASL

SEQ ID NO: 78857 - protein, 9 aa, Homo Sapiens
KQAKLVEQY

SEQ ID NO: 78858 - protein, 9 aa, Homo Sapiens
KQCGRAFTY

SEQ ID NO: 78859 - protein, 9 aa, Homo Sapiens
KQDTVRVAF

SEQ ID NO: 78860 - protein, 9 aa, Homo Sapiens
KQFEGSTSF

SEQ ID NO: 78861 - protein, 9 aa, Homo Sapiens
KQFFGIVGF

SEQ ID NO: 78862 - protein, 9 aa, Homo Sapiens
KQFGNILIL

SEQ ID NO: 78863 - protein, 9 aa, Homo Sapiens
KQFHRIVTY

SEQ ID NO: 78864 - protein, 9 aa, Homo Sapiens
KQFPEVIKY

SEQ ID NO: 78865 - protein, 9 aa, Homo Sapiens
KQFQFGHAL

SEQ ID NO: 78866 - protein, 9 aa, Homo Sapiens
KQHYGFVLY

SEQ ID NO: 78867 - protein, 9 aa, Homo Sapiens
KQIAMCVLY

SEQ ID NO: 78868 - protein, 9 aa, Homo Sapiens
KQIENARMF

SEQ ID NO: 78869 - protein, 9 aa, Homo Sapiens
KQIESKTAF

SEQ ID NO: 78870 - protein, 9 aa, Homo Sapiens
KQIFETIYY

SEQ ID NO: 78871 - protein, 9 aa, Homo Sapiens
KQIHFLYQY

SEQ ID NO: 78872 - protein, 9 aa, Homo Sapiens
KQIKTIERY

SEQ ID NO: 78873 - protein, 9 aa, Homo Sapiens
KQILLENTF

SEQ ID NO: 78874 - protein, 9 aa, Homo Sapiens
KQISSNKCF

SEQ ID NO: 78875 - protein, 9 aa, Homo Sapiens
KQIVDRVSY

SEQ ID NO: 78876 - protein, 9 aa, Homo Sapiens
KQKNTVVRY

SEQ ID NO: 78877 - protein, 9 aa, Homo Sapiens
KQLEDGRTL

SEQ ID NO: 78878 - protein, 9 aa, Homo Sapiens
KQLEHVMHF

SEQ ID NO: 78879 - protein, 9 aa, Homo Sapiens
KQLPDQISF

SEQ ID NO: 78880 - protein, 9 aa, Homo Sapiens
KQLPGFTTL

SEQ ID NO: 78881 - protein, 9 aa, Homo Sapiens
KQMEQISQF

SEQ ID NO: 78882 - protein, 9 aa, Homo Sapiens
KQMLSALNY

SEQ ID NO: 78883 - protein, 9 aa, Homo Sapiens
KQPDNSPEY

SEQ ID NO: 78884 - protein, 9 aa, Homo Sapiens
KQQNPRLVY

SEQ ID NO: 78885 - protein, 9 aa, Homo Sapiens
KQQQPPTVY

SEQ ID NO: 78886 - protein, 9 aa, Homo Sapiens
KQREFESRL

SEQ ID NO: 78887 - protein, 9 aa, Homo Sapiens
KQRKPRILF

SEQ ID NO: 78888 - protein, 9 aa, Homo Sapiens
KQRLFIINF

SEQ ID NO: 78889 - protein, 9 aa, Homo Sapiens
KQRTHVMRF

SEQ ID NO: 78890 - protein, 9 aa, Homo Sapiens
KQSQELSQY

SEQ ID NO: 78891 - protein, 9 aa, Homo Sapiens
KQSQILLVY

SEQ ID NO: 78892 - protein, 9 aa, Homo Sapiens
KQTQIFTTY

SEQ ID NO: 78893 - protein, 9 aa, Homo Sapiens
KQTQTFTTY

SEQ ID NO: 78894 - protein, 9 aa, Homo Sapiens
KQVASSTGF

SEQ ID NO: 78895 - protein, 9 aa, Homo Sapiens
KQVKYFIHY

SEQ ID NO: 78896 - protein, 9 aa, Homo Sapiens
KQYADVEGF

SEQ ID NO: 78897 - protein, 9 aa, Homo Sapiens
KQYEKSSRF

SEQ ID NO: 78898 - protein, 9 aa, Homo Sapiens
KQYGEGLSY

SEQ ID NO: 78899 - protein, 9 aa, Homo Sapiens
KQYGFFSYL

SEQ ID NO: 78900 - protein, 9 aa, Homo Sapiens
KQYIMDTVF

SEQ ID NO: 78901 - protein, 9 aa, Homo Sapiens
KQYLPNIAY

SEQ ID NO: 78902 - protein, 9 aa, Homo Sapiens
KQYPISLVL

SEQ ID NO: 78903 - protein, 9 aa, Homo Sapiens
KQYPYNNLY

SEQ ID NO: 78904 - protein, 9 aa, Homo Sapiens
KSFPGGKEY

SEQ ID NO: 78905 - protein, 9 aa, Homo Sapiens
KSQVGTLLF

SEQ ID NO: 78906 - protein, 9 aa, Homo Sapiens
KSYSVGVAY

SEQ ID NO: 78907 - protein, 9 aa, Homo Sapiens
LAGDKSRPF

SEQ ID NO: 78908 - protein, 9 aa, Homo Sapiens
LAPLKYLAL

SEQ ID NO: 78909 - protein, 9 aa, Homo Sapiens
LHYMGTSTF

SEQ ID NO: 78910 - protein, 9 aa, Homo Sapiens
LKAEVGNSM

SEQ ID NO: 78911 - protein, 9 aa, Homo Sapiens
LKALLLSSY

SEQ ID NO: 78912 - protein, 9 aa, Homo Sapiens
LKAMLSTGF

SEQ ID NO: 78913 - protein, 9 aa, Homo Sapiens
LKAPALPLL

SEQ ID NO: 78914 - protein, 9 aa, Homo Sapiens
LKEEKPKMY

SEQ ID NO: 78915 - protein, 9 aa, Homo Sapiens
LKEGGHRVL

SEQ ID NO: 78916 - protein, 9 aa, Homo Sapiens
LKEGHKKIY

SEQ ID NO: 78917 - protein, 9 aa, Homo Sapiens
LKFIPHKDY

SEQ ID NO: 78918 - protein, 9 aa, Homo Sapiens
LKFNGALTM

SEQ ID NO: 78919 - protein, 9 aa, Homo Sapiens
LKHIFKTSL

SEQ ID NO: 78920 - protein, 9 aa, Homo Sapiens
LKHKFITRY

SEQ ID NO: 78921 - protein, 9 aa, Homo Sapiens
LKHQMETHY

SEQ ID NO: 78922 - protein, 9 aa, Homo Sapiens
LKIGDTVSF

SEQ ID NO: 78923 - protein, 9 aa, Homo Sapiens
LKKDDSVGY

SEQ ID NO: 78924 - protein, 9 aa, Homo Sapiens
LKKTEVSRY

SEQ ID NO: 78925 - protein, 9 aa, Homo Sapiens
LKLDSKNAL

SEQ ID NO: 78926 - protein, 9 aa, Homo Sapiens
LKLGYVSRY

SEQ ID NO: 78927 - protein, 9 aa, Homo Sapiens
LKLPGGSCM

SEQ ID NO: 78928 - protein, 9 aa, Homo Sapiens
LKMIPRIDY

SEQ ID NO: 78929 - protein, 9 aa, Homo Sapiens
LKMPSVAQF

SEQ ID NO: 78930 - protein, 9 aa, Homo Sapiens
LKNGALVVY

SEQ ID NO: 78931 - protein, 9 aa, Homo Sapiens
LKNPNAPML

SEQ ID NO: 78932 - protein, 9 aa, Homo Sapiens
LKPEGVLVY

SEQ ID NO: 78933 - protein, 9 aa, Homo Sapiens
LKPGGVLTY

SEQ ID NO: 78934 - protein, 9 aa, Homo Sapiens
LKPGMVVTF

SEQ ID NO: 78935 - protein, 9 aa, Homo Sapiens
LKPNTSVQF

SEQ ID NO: 78936 - protein, 9 aa, Homo Sapiens
LKPQVSSIF

SEQ ID NO: 78937 - protein, 9 aa, Homo Sapiens
LKPVVGEVY

SEQ ID NO: 78938 - protein, 9 aa, Homo Sapiens
LKPYFLEAY

SEQ ID NO: 78939 - protein, 9 aa, Homo Sapiens
LKRLEEHRY

SEQ ID NO: 78940 - protein, 9 aa, Homo Sapiens
LKRPLEATF

SEQ ID NO: 78941 - protein, 9 aa, Homo Sapiens
LKRQGRTLY

SEQ ID NO: 78942 - protein, 9 aa, Homo Sapiens
LKSGGVNQY

SEQ ID NO: 78943 - protein, 9 aa, Homo Sapiens
LKSPGSVVF

SEQ ID NO: 78944 - protein, 9 aa, Homo Sapiens
LKTGISDVF

SEQ ID NO: 78945 - protein, 9 aa, Homo Sapiens
LKTYGQSTY

SEQ ID NO: 78946 - protein, 9 aa, Homo Sapiens
LKVKDLRQY

SEQ ID NO: 78947 - protein, 9 aa, Homo Sapiens
LKWIIKSNY

SEQ ID NO: 78948 - protein, 9 aa, Homo Sapiens
LKYGKPLQL

SEQ ID NO: 78949 - protein, 9 aa, Homo Sapiens
LKYHPRVLY

SEQ ID NO: 78950 - protein, 9 aa, Homo Sapiens
LKYHQRVLY

SEQ ID NO: 78951 - protein, 9 aa, Homo Sapiens
LLADPTGAF

SEQ ID NO: 78952 - protein, 9 aa, Homo Sapiens
LLAVFVTPL

SEQ ID NO: 78953 - protein, 9 aa, Homo Sapiens
LLDDSVRVY

SEQ ID NO: 78954 - protein, 9 aa, Homo Sapiens
LLYESPERY

SEQ ID NO: 78955 - protein, 9 aa, Homo Sapiens
LMVGTSIHY

SEQ ID NO: 78956 - protein, 9 aa, Homo Sapiens
LMYVGRVVF

SEQ ID NO: 78957 - protein, 9 aa, Homo Sapiens
LQAMPRTEF

SEQ ID NO: 78958 - protein, 9 aa, Homo Sapiens
LQAPAFTGY

SEQ ID NO: 78959 - protein, 9 aa, Homo Sapiens
LQAPPLTSL

SEQ ID NO: 78960 - protein, 9 aa, Homo Sapiens
LQAVFVQSY

SEQ ID NO: 78961 - protein, 9 aa, Homo Sapiens
LQHDNIIAY

SEQ ID NO: 78962 - protein, 9 aa, Homo Sapiens
LQHPDVAAY

SEQ ID NO: 78963 - protein, 9 aa, Homo Sapiens
LQHPNIVGY

SEQ ID NO: 78964 - protein, 9 aa, Homo Sapiens
LQIATHTAF

SEQ ID NO: 78965 - protein, 9 aa, Homo Sapiens
LQIDNARLA

SEQ ID NO: 78966 - protein, 9 aa, Homo Sapiens
LQIGVIRVY

SEQ ID NO: 78967 - protein, 9 aa, Homo Sapiens
LQIVHETGY

SEQ ID NO: 78968 - protein, 9 aa, Homo Sapiens
LQKAQTQEF

SEQ ID NO: 78969 - protein, 9 aa, Homo Sapiens
LQKPGETVF

SEQ ID NO: 78970 - protein, 9 aa, Homo Sapiens
LQLDRISVY

SEQ ID NO: 78971 - protein, 9 aa, Homo Sapiens
LQNLFEEKY

SEQ ID NO: 78972 - protein, 9 aa, Homo Sapiens
LQQPRSLTY

SEQ ID NO: 78973 - protein, 9 aa, Homo Sapiens
LQRATGISF

SEQ ID NO: 78974 - protein, 9 aa, Homo Sapiens
LQREEEEAF

SEQ ID NO: 78975 - protein, 9 aa, Homo Sapiens
LQREGVSHY

SEQ ID NO: 78976 - protein, 9 aa, Homo Sapiens
LQRFPNKPY

SEQ ID NO: 78977 - protein, 9 aa, Homo Sapiens
LQRLENTQY

SEQ ID NO: 78978 - protein, 9 aa, Homo Sapiens
LQRMTDKCF

SEQ ID NO: 78979 - protein, 9 aa, Homo Sapiens
LQRVGAGTY

SEQ ID NO: 78980 - protein, 9 aa, Homo Sapiens
LQRVLQSEF

SEQ ID NO: 78981 - protein, 9 aa, Homo Sapiens
LQRVSYLVF

SEQ ID NO: 78982 - protein, 9 aa, Homo Sapiens
LQSLPTRAY

SEQ ID NO: 78983 - protein, 9 aa, Homo Sapiens
LQYSGKTTF

SEQ ID NO: 78984 - protein, 9 aa, Homo Sapiens
MAPLKMLAL

SEQ ID NO: 78985 - protein, 9 aa, Homo Sapiens
MKAAFQSQY

SEQ ID NO: 78986 - protein, 9 aa, Homo Sapiens
MKARVVLKY

SEQ ID NO: 78987 - protein, 9 aa, Homo Sapiens
MKCYTPLVY

SEQ ID NO: 78988 - protein, 9 aa, Homo Sapiens
MKFMTQSAF

SEQ ID NO: 78989 - protein, 9 aa, Homo Sapiens
MKHGQRITF

SEQ ID NO: 78990 - protein, 9 aa, Homo Sapiens
MKILTERGY

SEQ ID NO: 78991 - protein, 9 aa, Homo Sapiens
MKIPTGQEY

SEQ ID NO: 78992 - protein, 9 aa, Homo Sapiens
MKKEFTLEF

SEQ ID NO: 78993 - protein, 9 aa, Homo Sapiens
MKKIENCNY

SEQ ID NO: 78994 - protein, 9 aa, Homo Sapiens
MKKLWGDRY

SEQ ID NO: 78995 - protein, 9 aa, Homo Sapiens
MKLSLVAAM

SEQ ID NO: 78996 - protein, 9 aa, Homo Sapiens
MKQDRITRY

SEQ ID NO: 78997 - protein, 9 aa, Homo Sapiens
MKSPFGSSF

SEQ ID NO: 78998 - protein, 9 aa, Homo Sapiens
MKVLLAAAL

SEQ ID NO: 78999 - protein, 9 aa, Homo Sapiens
MKYEDAVQF

SEQ ID NO: 79000 - protein, 9 aa, Homo Sapiens
MKYPKVKKY

SEQ ID NO: 79001 - protein, 9 aa, Homo Sapiens
MLYKGQTAY

SEQ ID NO: 79002 - protein, 9 aa, Homo Sapiens
MMAGPMAAF

SEQ ID NO: 79003 - protein, 9 aa, Homo Sapiens
MMDQARSAF

SEQ ID NO: 79004 - protein, 9 aa, Homo Sapiens
MMIPSQISY

SEQ ID NO: 79005 - protein, 9 aa, Homo Sapiens
MMYSGELKF

SEQ ID NO: 79006 - protein, 9 aa, Homo Sapiens
MPYLEHESF

SEQ ID NO: 79007 - protein, 9 aa, Homo Sapiens
MQHIFLNNY

SEQ ID NO: 79008 - protein, 9 aa, Homo Sapiens
MQHRYIELF

SEQ ID NO: 79009 - protein, 9 aa, Homo Sapiens
MQHRYVELF

SEQ ID NO: 79010 - protein, 9 aa, Homo Sapiens
MQLPNGVTY

SEQ ID NO: 79011 - protein, 9 aa, Homo Sapiens
MQREPNQAF

SEQ ID NO: 79012 - protein, 9 aa, Homo Sapiens
NGAVLMIVI

SEQ ID NO: 79013 - protein, 9 aa, Homo Sapiens
NKADVILKY

SEQ ID NO: 79014 - protein, 9 aa, Homo Sapiens
NKAEVHESY

SEQ ID NO: 79015 - protein, 9 aa, Homo Sapiens
NKFYSGTGY

SEQ ID NO: 79016 - protein, 9 aa, Homo Sapiens
NKIFLPTIY

SEQ ID NO: 79017 - protein, 9 aa, Homo Sapiens
NKLPTGGCY

SEQ ID NO: 79018 - protein, 9 aa, Homo Sapiens
NKVISSVSY

SEQ ID NO: 79019 - protein, 9 aa, Homo Sapiens
NKYLTAEAF

SEQ ID NO: 79020 - protein, 9 aa, Homo Sapiens
NKYMGLTQF

SEQ ID NO: 79021 - protein, 9 aa, Homo Sapiens
NQIPFIIQY

SEQ ID NO: 79022 - protein, 9 aa, Homo Sapiens
NQKPPSAEY

SEQ ID NO: 79023 - protein, 9 aa, Homo Sapiens
NQRLAYVTY

SEQ ID NO: 79024 - protein, 9 aa, Homo Sapiens
NQVIFPVSY

SEQ ID NO: 79025 - protein, 9 aa, Homo Sapiens
NQWEALTEY

SEQ ID NO: 79026 - protein, 9 aa, Homo Sapiens
NQYISQQEY

SEQ ID NO: 79027 - protein, 9 aa, Homo Sapiens
PAYHSSLMD

SEQ ID NO: 79028 - protein, 9 aa, Homo Sapiens
PHVSPRHSF

SEQ ID NO: 79029 - protein, 9 aa, Homo Sapiens
PIRLLAAAA

SEQ ID NO: 79030 - protein, 9 aa, Homo Sapiens
PPHPPPPPP

SEQ ID NO: 79031 - protein, 9 aa, Homo Sapiens
PQAPSGPSY

SEQ ID NO: 79032 - protein, 9 aa, Homo Sapiens
PQRATSNVF

SEQ ID NO: 79033 - protein, 9 aa, Homo Sapiens
PQVSLSKLF

SEQ ID NO: 79034 - protein, 9 aa, Homo Sapiens
PQYQTWEEF

SEQ ID NO: 79035 - protein, 9 aa, Homo Sapiens
PSIVHRKCF

SEQ ID NO: 79036 - protein, 9 aa, Homo Sapiens
QAYHSPATA

SEQ ID NO: 79037 - protein, 9 aa, Homo Sapiens
QKAFNSSSF

SEQ ID NO: 79038 - protein, 9 aa, Homo Sapiens
QKCEFQDAY

SEQ ID NO: 79039 - protein, 9 aa, Homo Sapiens
QKCELPVSY

SEQ ID NO: 79040 - protein, 9 aa, Homo Sapiens
QKFGERVAY

SEQ ID NO: 79041 - protein, 9 aa, Homo Sapiens
QKIDVQESF

SEQ ID NO: 79042 - protein, 9 aa, Homo Sapiens
QKLPVANEY

SEQ ID NO: 79043 - protein, 9 aa, Homo Sapiens
QKRPQGLSF

SEQ ID NO: 79044 - protein, 9 aa, Homo Sapiens
QKTIVKETY

SEQ ID NO: 79045 - protein, 9 aa, Homo Sapiens
QKVIAHSEY

SEQ ID NO: 79046 - protein, 9 aa, Homo Sapiens
QKVKLFTAH

SEQ ID NO: 79047 - protein, 9 aa, Homo Sapiens
QKYPTKVSF

SEQ ID NO: 79048 - protein, 9 aa, Homo Sapiens
QMWISKQEY

SEQ ID NO: 79049 - protein, 9 aa, Homo Sapiens
QMYRTEIRM

SEQ ID NO: 79050 - protein, 9 aa, Homo Sapiens
QQEERKRLY

SEQ ID NO: 79051 - protein, 9 aa, Homo Sapiens
QQFLIQQQY

SEQ ID NO: 79052 - protein, 9 aa, Homo Sapiens
QQFPAFNSY

SEQ ID NO: 79053 - protein, 9 aa, Homo Sapiens
QQFRNAPPF

SEQ ID NO: 79054 - protein, 9 aa, Homo Sapiens
QQIEPLFQF

SEQ ID NO: 79055 - protein, 9 aa, Homo Sapiens
QQLQLFTEY

SEQ ID NO: 79056 - protein, 9 aa, Homo Sapiens
QQNLNTITY

SEQ ID NO: 79057 - protein, 9 aa, Homo Sapiens
QQNPQPLIF

SEQ ID NO: 79058 - protein, 9 aa, Homo Sapiens
QQSPDVLVY

SEQ ID NO: 79059 - protein, 9 aa, Homo Sapiens
QQVPVNQVF

SEQ ID NO: 79060 - protein, 9 aa, Homo Sapiens
QQVSRIAAY

SEQ ID NO: 79061 - protein, 9 aa, Homo Sapiens
QQYNSFVSL

SEQ ID NO: 79062 - protein, 9 aa, Homo Sapiens
QQYQQQAGY

SEQ ID NO: 79063 - protein, 9 aa, Homo Sapiens
QQYVGKVKF

SEQ ID NO: 79064 - protein, 9 aa, Homo Sapiens
RAAPFSLEY

SEQ ID NO: 79065 - protein, 9 aa, Homo Sapiens
RAFPNKQGY

SEQ ID NO: 79066 - protein, 9 aa, Homo Sapiens
RANPFNTPH

SEQ ID NO: 79067 - protein, 9 aa, Homo Sapiens
RAQPRGAVY

SEQ ID NO: 79068 - protein, 9 aa, Homo Sapiens
RARELLVSY

SEQ ID NO: 79069 - protein, 9 aa, Homo Sapiens
RAYAKALHY

SEQ ID NO: 79070 - protein, 9 aa, Homo Sapiens
RAYFELSEY

SEQ ID NO: 79071 - protein, 9 aa, Homo Sapiens
RAYLVRWEY

SEQ ID NO: 79072 - protein, 9 aa, Homo Sapiens
RAYQQSEAY

SEQ ID NO: 79073 - protein, 9 aa, Homo Sapiens
RECPSVLEY

SEQ ID NO: 79074 - protein, 9 aa, Homo Sapiens
REIESSPQY

SEQ ID NO: 79075 - protein, 9 aa, Homo Sapiens
REVAPRLAF

SEQ ID NO: 79076 - protein, 9 aa, Homo Sapiens
RGFAHGSVY

SEQ ID NO: 79077 - protein, 9 aa, Homo Sapiens
RGFLAREQY

SEQ ID NO: 79078 - protein, 9 aa, Homo Sapiens
RGFYSVETF

SEQ ID NO: 79079 - protein, 9 aa, Homo Sapiens
RGWDGFVEF

SEQ ID NO: 79080 - protein, 9 aa, Homo Sapiens
RGWKLQVSY

SEQ ID NO: 79081 - protein, 9 aa, Homo Sapiens
RGYLARKAF

SEQ ID NO: 79082 - protein, 9 aa, Homo Sapiens
RGYYSLETF

SEQ ID NO: 79083 - protein, 9 aa, Homo Sapiens
RHFGTILNY

SEQ ID NO: 79084 - protein, 9 aa, Homo Sapiens
RHGPPMHSY

SEQ ID NO: 79085 - protein, 9 aa, Homo Sapiens
RHIDCAHVY

SEQ ID NO: 79086 - protein, 9 aa, Homo Sapiens
RHLEPALAF

SEQ ID NO: 79087 - protein, 9 aa, Homo Sapiens
RHLLFLLEY

SEQ ID NO: 79088 - protein, 9 aa, Homo Sapiens
RHMEQHVSF

SEQ ID NO: 79089 - protein, 9 aa, Homo Sapiens
RHMSLLTAF

SEQ ID NO: 79090 - protein, 9 aa, Homo Sapiens
RHNLSLNRY

SEQ ID NO: 79091 - protein, 9 aa, Homo Sapiens
RHQYHIRAY

SEQ ID NO: 79092 - protein, 9 aa, Homo Sapiens
RHRCIGENF

SEQ ID NO: 79093 - protein, 9 aa, Homo Sapiens
RHREHLINY

SEQ ID NO: 79094 - protein, 9 aa, Homo Sapiens
RHRPELIEY

SEQ ID NO: 79095 - protein, 9 aa, Homo Sapiens
RHSDIVVLY

SEQ ID NO: 79096 - protein, 9 aa, Homo Sapiens
RHSLPKVSY

SEQ ID NO: 79097 - protein, 9 aa, Homo Sapiens
RHSLPLQSF

SEQ ID NO: 79098 - protein, 9 aa, Homo Sapiens
RHVDAMNEY

SEQ ID NO: 79099 - protein, 9 aa, Homo Sapiens
RHWGGQADF

SEQ ID NO: 79100 - protein, 9 aa, Homo Sapiens
RKAALKNAF

SEQ ID NO: 79101 - protein, 9 aa, Homo Sapiens
RKADALKAM

SEQ ID NO: 79102 - protein, 9 aa, Homo Sapiens
RKAEAAVVA

SEQ ID NO: 79103 - protein, 9 aa, Homo Sapiens
RKAHLTNQY

SEQ ID NO: 79104 - protein, 9 aa, Homo Sapiens
RKAIDYIKY

SEQ ID NO: 79105 - protein, 9 aa, Homo Sapiens
RKAIDYIRF

SEQ ID NO: 79106 - protein, 9 aa, Homo Sapiens
RKAISRELY

SEQ ID NO: 79107 - protein, 9 aa, Homo Sapiens
RKAKQKLGF

SEQ ID NO: 79108 - protein, 9 aa, Homo Sapiens
RKALERELY

SEQ ID NO: 79109 - protein, 9 aa, Homo Sapiens
RKAQPPQAF

SEQ ID NO: 79110 - protein, 9 aa, Homo Sapiens
RKAVSYAKF

SEQ ID NO: 79111 - protein, 9 aa, Homo Sapiens
RKAVTVVKF

SEQ ID NO: 79112 - protein, 9 aa, Homo Sapiens
RKAYSTTSI

SEQ ID NO: 79113 - protein, 9 aa, Homo Sapiens
RKCVDTYKY

SEQ ID NO: 79114 - protein, 9 aa, Homo Sapiens
RKDDPRLSF

SEQ ID NO: 79115 - protein, 9 aa, Homo Sapiens
RKDKSLRVM

SEQ ID NO: 79116 - protein, 9 aa, Homo Sapiens
RKDLFIATY

SEQ ID NO: 79117 - protein, 9 aa, Homo Sapiens
RKDPNKLVL

SEQ ID NO: 79118 - protein, 9 aa, Homo Sapiens
RKDPRQIFF

SEQ ID NO: 79119 - protein, 9 aa, Homo Sapiens
RKEDCQRFY

SEQ ID NO: 79120 - protein, 9 aa, Homo Sapiens
RKEERRITY

SEQ ID NO: 79121 - protein, 9 aa, Homo Sapiens
RKEETVTVY

SEQ ID NO: 79122 - protein, 9 aa, Homo Sapiens
RKELESRAL

SEQ ID NO: 79123 - protein, 9 aa, Homo Sapiens
RKENLTRLF

SEQ ID NO: 79124 - protein, 9 aa, Homo Sapiens
RKEPAALQY

SEQ ID NO: 79125 - protein, 9 aa, Homo Sapiens
RKEPGQRLL

SEQ ID NO: 79126 - protein, 9 aa, Homo Sapiens
RKFDAIYKY

SEQ ID NO: 79127 - protein, 9 aa, Homo Sapiens
RKFHGYNSL

SEQ ID NO: 79128 - protein, 9 aa, Homo Sapiens
RKFINLNEF

SEQ ID NO: 79129 - protein, 9 aa, Homo Sapiens
RKFKHFQEF

SEQ ID NO: 79130 - protein, 9 aa, Homo Sapiens
RKFKWGKGF

SEQ ID NO: 79131 - protein, 9 aa, Homo Sapiens
RKFLDTSHY

SEQ ID NO: 79132 - protein, 9 aa, Homo Sapiens
RKFLEKEVF

SEQ ID NO: 79133 - protein, 9 aa, Homo Sapiens
RKFMTNRLL

SEQ ID NO: 79134 - protein, 9 aa, Homo Sapiens
RKFPSLRAV

SEQ ID NO: 79135 - protein, 9 aa, Homo Sapiens
RKFPYPLQW

SEQ ID NO: 79136 - protein, 9 aa, Homo Sapiens
RKFSLKTVL

SEQ ID NO: 79137 - protein, 9 aa, Homo Sapiens
RKFSTKVTL

SEQ ID NO: 79138 - protein, 9 aa, Homo Sapiens
RKFTQLREY

SEQ ID NO: 79139 - protein, 9 aa, Homo Sapiens
RKFVADGIF

SEQ ID NO: 79140 - protein, 9 aa, Homo Sapiens
RKFYKGKKY

SEQ ID NO: 79141 - protein, 9 aa, Homo Sapiens
RKGEFETGF

SEQ ID NO: 79142 - protein, 9 aa, Homo Sapiens
RKGEFVNEY

SEQ ID NO: 79143 - protein, 9 aa, Homo Sapiens
RKHEHVGSF

SEQ ID NO: 79144 - protein, 9 aa, Homo Sapiens
RKHGLEVIY

SEQ ID NO: 79145 - protein, 9 aa, Homo Sapiens
RKHNQRPTF

SEQ ID NO: 79146 - protein, 9 aa, Homo Sapiens
RKIASRNEF

SEQ ID NO: 79147 - protein, 9 aa, Homo Sapiens
RKIEARVSA

SEQ ID NO: 79148 - protein, 9 aa, Homo Sapiens
RKIEEIKDF

SEQ ID NO: 79149 - protein, 9 aa, Homo Sapiens
RKIEEKIIY

SEQ ID NO: 79150 - protein, 9 aa, Homo Sapiens
RKIEVEHIF

SEQ ID NO: 79151 - protein, 9 aa, Homo Sapiens
RKIGELVRY

SEQ ID NO: 79152 - protein, 9 aa, Homo Sapiens
RKIHTGENL

SEQ ID NO: 79153 - protein, 9 aa, Homo Sapiens
RKIIGGVDY

SEQ ID NO: 79154 - protein, 9 aa, Homo Sapiens
RKIKVSNTL

SEQ ID NO: 79155 - protein, 9 aa, Homo Sapiens
RKILPRSDY

SEQ ID NO: 79156 - protein, 9 aa, Homo Sapiens
RKINCRLSY

SEQ ID NO: 79157 - protein, 9 aa, Homo Sapiens
RKINLNISY

SEQ ID NO: 79158 - protein, 9 aa, Homo Sapiens
RKIPTGAEA

SEQ ID NO: 79159 - protein, 9 aa, Homo Sapiens
RKISAIRSY

SEQ ID NO: 79160 - protein, 9 aa, Homo Sapiens
RKITLRQVF

SEQ ID NO: 79161 - protein, 9 aa, Homo Sapiens
RKITTYVSF

SEQ ID NO: 79162 - protein, 9 aa, Homo Sapiens
RKKAYADFY

SEQ ID NO: 79163 - protein, 9 aa, Homo Sapiens
RKKDWKTLY

SEQ ID NO: 79164 - protein, 9 aa, Homo Sapiens
RKKPPMNSM

SEQ ID NO: 79165 - protein, 9 aa, Homo Sapiens
RKKPTTEGF

SEQ ID NO: 79166 - protein, 9 aa, Homo Sapiens
RKKSTTIRF

SEQ ID NO: 79167 - protein, 9 aa, Homo Sapiens
RKKTERLAF

SEQ ID NO: 79168 - protein, 9 aa, Homo Sapiens
RKLDEQQEF

SEQ ID NO: 79169 - protein, 9 aa, Homo Sapiens
RKLDKLTVL

SEQ ID NO: 79170 - protein, 9 aa, Homo Sapiens
RKLDQVSQF

SEQ ID NO: 79171 - protein, 9 aa, Homo Sapiens
RKLDVVVRF

SEQ ID NO: 79172 - protein, 9 aa, Homo Sapiens
RKLENKNAF

SEQ ID NO: 79173 - protein, 9 aa, Homo Sapiens
RKLKIQQSY

SEQ ID NO: 79174 - protein, 9 aa, Homo Sapiens
RKLLEKCAM

SEQ ID NO: 79175 - protein, 9 aa, Homo Sapiens
RKLNNFNSY

SEQ ID NO: 79176 - protein, 9 aa, Homo Sapiens
RKLPCSHEY

SEQ ID NO: 79177 - protein, 9 aa, Homo Sapiens
RKLPPRVCV

SEQ ID NO: 79178 - protein, 9 aa, Homo Sapiens
RKLQWQTTL

SEQ ID NO: 79179 - protein, 9 aa, Homo Sapiens
RKLTPKEAF

SEQ ID NO: 79180 - protein, 9 aa, Homo Sapiens
RKLTQETTY

SEQ ID NO: 79181 - protein, 9 aa, Homo Sapiens
RKMDKIKTF

SEQ ID NO: 79182 - protein, 9 aa, Homo Sapiens
RKMEIYRPH

SEQ ID NO: 79183 - protein, 9 aa, Homo Sapiens
RKMEPSTAA

SEQ ID NO: 79184 - protein, 9 aa, Homo Sapiens
RKMPLPLKL

SEQ ID NO: 79185 - protein, 9 aa, Homo Sapiens
RKMVGSRMF

SEQ ID NO: 79186 - protein, 9 aa, Homo Sapiens
RKNLPSTAL

SEQ ID NO: 79187 - protein, 9 aa, Homo Sapiens
RKNLSIQRY

SEQ ID NO: 79188 - protein, 9 aa, Homo Sapiens
RKNPSDPKL

SEQ ID NO: 79189 - protein, 9 aa, Homo Sapiens
RKNPVTSTY

SEQ ID NO: 79190 - protein, 9 aa, Homo Sapiens
RKPEGGPSF

SEQ ID NO: 79191 - protein, 9 aa, Homo Sapiens
RKPFGSKMY

SEQ ID NO: 79192 - protein, 9 aa, Homo Sapiens
RKPLPKTVY

SEQ ID NO: 79193 - protein, 9 aa, Homo Sapiens
RKPLTTSGF

SEQ ID NO: 79194 - protein, 9 aa, Homo Sapiens
RKPSIVTKY

SEQ ID NO: 79195 - protein, 9 aa, Homo Sapiens
RKQANRMSF

SEQ ID NO: 79196 - protein, 9 aa, Homo Sapiens
RKQIFILLF

SEQ ID NO: 79197 - protein, 9 aa, Homo Sapiens
RKQLHKLRY

SEQ ID NO: 79198 - protein, 9 aa, Homo Sapiens
RKQPMSATL

SEQ ID NO: 79199 - protein, 9 aa, Homo Sapiens
RKQPVKVVY

SEQ ID NO: 79200 - protein, 9 aa, Homo Sapiens
RKRLEAQGY

SEQ ID NO: 79201 - protein, 9 aa, Homo Sapiens
RKSDITSEL

SEQ ID NO: 79202 - protein, 9 aa, Homo Sapiens
RKSEVSPRI

SEQ ID NO: 79203 - protein, 9 aa, Homo Sapiens
RKSFYSSHY

SEQ ID NO: 79204 - protein, 9 aa, Homo Sapiens
RKSGVGNIF

SEQ ID NO: 79205 - protein, 9 aa, Homo Sapiens
RKSQVSIRY

SEQ ID NO: 79206 - protein, 9 aa, Homo Sapiens
RKSTSFRVY

SEQ ID NO: 79207 - protein, 9 aa, Homo Sapiens
RKTDQLVSF

SEQ ID NO: 79208 - protein, 9 aa, Homo Sapiens
RKTEPATGF

SEQ ID NO: 79209 - protein, 9 aa, Homo Sapiens
RKTFLKLAF

SEQ ID NO: 79210 - protein, 9 aa, Homo Sapiens
RKTFSQSTY

SEQ ID NO: 79211 - protein, 9 aa, Homo Sapiens
RKTYSTEEY

SEQ ID NO: 79212 - protein, 9 aa, Homo Sapiens
RKVDKQTAL

SEQ ID NO: 79213 - protein, 9 aa, Homo Sapiens
RKVDTKALY

SEQ ID NO: 79214 - protein, 9 aa, Homo Sapiens
RKVDVEEEF

SEQ ID NO: 79215 - protein, 9 aa, Homo Sapiens
RKVKIDKRF

SEQ ID NO: 79216 - protein, 9 aa, Homo Sapiens
RKVPDNQQF

SEQ ID NO: 79217 - protein, 9 aa, Homo Sapiens
RKVPFGKTY

SEQ ID NO: 79218 - protein, 9 aa, Homo Sapiens
RKVPYCVKF

SEQ ID NO: 79219 - protein, 9 aa, Homo Sapiens
RKVQPPQNY

SEQ ID NO: 79220 - protein, 9 aa, Homo Sapiens
RKVYSILSL

SEQ ID NO: 79221 - protein, 9 aa, Homo Sapiens
RKWFEPSQF

SEQ ID NO: 79222 - protein, 9 aa, Homo Sapiens
RKWSSEKRF

SEQ ID NO: 79223 - protein, 9 aa, Homo Sapiens
RKYAFELKM

SEQ ID NO: 79224 - protein, 9 aa, Homo Sapiens
RKYDEVLHM

SEQ ID NO: 79225 - protein, 9 aa, Homo Sapiens
RKYEKPQEL

SEQ ID NO: 79226 - protein, 9 aa, Homo Sapiens
RKYESVLQL

SEQ ID NO: 79227 - protein, 9 aa, Homo Sapiens
RKYGGRLVT

SEQ ID NO: 79228 - protein, 9 aa, Homo Sapiens
RKYHQRPTF

SEQ ID NO: 79229 - protein, 9 aa, Homo Sapiens
RKYLGQLHY

SEQ ID NO: 79230 - protein, 9 aa, Homo Sapiens
RKYNWSAKA

SEQ ID NO: 79231 - protein, 9 aa, Homo Sapiens
RKYPENDLF

SEQ ID NO: 79232 - protein, 9 aa, Homo Sapiens
RKYSSVHTI

SEQ ID NO: 79233 - protein, 9 aa, Homo Sapiens
RKYVNGSTY

SEQ ID NO: 79234 - protein, 9 aa, Homo Sapiens
RKYWKNLTF

SEQ ID NO: 79235 - protein, 9 aa, Homo Sapiens
RLFATDERF

SEQ ID NO: 79236 - protein, 9 aa, Homo Sapiens
RLFFHCSQY

SEQ ID NO: 79237 - protein, 9 aa, Homo Sapiens
RLFKDQLVY

SEQ ID NO: 79238 - protein, 9 aa, Homo Sapiens
RLINTQAIF

SEQ ID NO: 79239 - protein, 9 aa, Homo Sapiens
RLIPHVQVF

SEQ ID NO: 79240 - protein, 9 aa, Homo Sapiens
RLLDTTITF

SEQ ID NO: 79241 - protein, 9 aa, Homo Sapiens
RLQEFLTAY

SEQ ID NO: 79242 - protein, 9 aa, Homo Sapiens
RLSLNGVRF

SEQ ID NO: 79243 - protein, 9 aa, Homo Sapiens
RLVELLVSY

SEQ ID NO: 79244 - protein, 9 aa, Homo Sapiens
RLWEQLVHF

SEQ ID NO: 79245 - protein, 9 aa, Homo Sapiens
RLWISVARY

SEQ ID NO: 79246 - protein, 9 aa, Homo Sapiens
RLYFSQQTY

SEQ ID NO: 79247 - protein, 9 aa, Homo Sapiens
RLYQHAVEY

SEQ ID NO: 79248 - protein, 9 aa, Homo Sapiens
RMHQAIERF

SEQ ID NO: 79249 - protein, 9 aa, Homo Sapiens
RMIDLLEEY

SEQ ID NO: 79250 - protein, 9 aa, Homo Sapiens
RMIKEKLCY

SEQ ID NO: 79251 - protein, 9 aa, Homo Sapiens
RMIYLVTEY

SEQ ID NO: 79252 - protein, 9 aa, Homo Sapiens
RMLFKSKAY

SEQ ID NO: 79253 - protein, 9 aa, Homo Sapiens
RMVEMFLEY

SEQ ID NO: 79254 - protein, 9 aa, Homo Sapiens
RMVLVNAVY

SEQ ID NO: 79255 - protein, 9 aa, Homo Sapiens
RMWKTLTFF

SEQ ID NO: 79256 - protein, 9 aa, Homo Sapiens
RMYPGLQVY

SEQ ID NO: 79257 - protein, 9 aa, Homo Sapiens
RPIVWGLAF

SEQ ID NO: 79258 - protein, 9 aa, Homo Sapiens
RPVPKGATY

SEQ ID NO: 79259 - protein, 9 aa, Homo Sapiens
RQAEMKRLY

SEQ ID NO: 79260 - protein, 9 aa, Homo Sapiens
RQAHLTNQY

SEQ ID NO: 79261 - protein, 9 aa, Homo Sapiens
RQAHMQARF

SEQ ID NO: 79262 - protein, 9 aa, Homo Sapiens
RQAIGLMGY

SEQ ID NO: 79263 - protein, 9 aa, Homo Sapiens
RQAKEERTF

SEQ ID NO: 79264 - protein, 9 aa, Homo Sapiens
RQALLIERY

SEQ ID NO: 79265 - protein, 9 aa, Homo Sapiens
RQALLLLAL

SEQ ID NO: 79266 - protein, 9 aa, Homo Sapiens
RQALLTQHY

SEQ ID NO: 79267 - protein, 9 aa, Homo Sapiens
RQAMGMLAF

SEQ ID NO: 79268 - protein, 9 aa, Homo Sapiens
RQAMPFKCM

SEQ ID NO: 79269 - protein, 9 aa, Homo Sapiens
RQAPPHIEL

SEQ ID NO: 79270 - protein, 9 aa, Homo Sapiens
RQAPVAAVF

SEQ ID NO: 79271 - protein, 9 aa, Homo Sapiens
RQATVNVSY

SEQ ID NO: 79272 - protein, 9 aa, Homo Sapiens
RQAVFTAKY

SEQ ID NO: 79273 - protein, 9 aa, Homo Sapiens
RQCPLKVSY

SEQ ID NO: 79274 - protein, 9 aa, Homo Sapiens
RQEGVPRTF

SEQ ID NO: 79275 - protein, 9 aa, Homo Sapiens
RQEQTKRML

SEQ ID NO: 79276 - protein, 9 aa, Homo Sapiens
RQESSVRLW

SEQ ID NO: 79277 - protein, 9 aa, Homo Sapiens
RQFCQTVGY

SEQ ID NO: 79278 - protein, 9 aa, Homo Sapiens
RQFDLAWQY

SEQ ID NO: 79279 - protein, 9 aa, Homo Sapiens
RQFEGLMRF

SEQ ID NO: 79280 - protein, 9 aa, Homo Sapiens
RQFEGLQGY

SEQ ID NO: 79281 - protein, 9 aa, Homo Sapiens
RQFGKKHLF

SEQ ID NO: 79282 - protein, 9 aa, Homo Sapiens
RQFMAETQF

SEQ ID NO: 79283 - protein, 9 aa, Homo Sapiens
RQFPFHEMF

SEQ ID NO: 79284 - protein, 9 aa, Homo Sapiens
RQFPFSSAL

SEQ ID NO: 79285 - protein, 9 aa, Homo Sapiens
RQFPTAFEF

SEQ ID NO: 79286 - protein, 9 aa, Homo Sapiens
RQFPVTVHF

SEQ ID NO: 79287 - protein, 9 aa, Homo Sapiens
RQFVKRIGY

SEQ ID NO: 79288 - protein, 9 aa, Homo Sapiens
RQGTPLIAF

SEQ ID NO: 79289 - protein, 9 aa, Homo Sapiens
RQHNYTEAF

SEQ ID NO: 79290 - protein, 9 aa, Homo Sapiens
RQHRMMILY

SEQ ID NO: 79291 - protein, 9 aa, Homo Sapiens
RQIDFVLSY

SEQ ID NO: 79292 - protein, 9 aa, Homo Sapiens
RQIDQFLVV

SEQ ID NO: 79293 - protein, 9 aa, Homo Sapiens
RQIKHMIKY

SEQ ID NO: 79294 - protein, 9 aa, Homo Sapiens
RQINWTVLY

SEQ ID NO: 79295 - protein, 9 aa, Homo Sapiens
RQIQESVTF

SEQ ID NO: 79296 - protein, 9 aa, Homo Sapiens
RQISREVTY

SEQ ID NO: 79297 - protein, 9 aa, Homo Sapiens
RQIVSAVAY

SEQ ID NO: 79298 - protein, 9 aa, Homo Sapiens
RQKELESNY

SEQ ID NO: 79299 - protein, 9 aa, Homo Sapiens
RQKKLFCRY

SEQ ID NO: 79300 - protein, 9 aa, Homo Sapiens
RQKLVRNIY

SEQ ID NO: 79301 - protein, 9 aa, Homo Sapiens
RQLAHIYHY

SEQ ID NO: 79302 - protein, 9 aa, Homo Sapiens
RQLCFKSQY

SEQ ID NO: 79303 - protein, 9 aa, Homo Sapiens
RQLDRNLTF

SEQ ID NO: 79304 - protein, 9 aa, Homo Sapiens
RQLGSLSKY

SEQ ID NO: 79305 - protein, 9 aa, Homo Sapiens
RQLLIPCAY

SEQ ID NO: 79306 - protein, 9 aa, Homo Sapiens
RQLLYITAF

SEQ ID NO: 79307 - protein, 9 aa, Homo Sapiens
RQLPCMHEF

SEQ ID NO: 79308 - protein, 9 aa, Homo Sapiens
RQLPRFSMY

SEQ ID NO: 79309 - protein, 9 aa, Homo Sapiens
RQLPSFQTF

SEQ ID NO: 79310 - protein, 9 aa, Homo Sapiens
RQLPSSHAL

SEQ ID NO: 79311 - protein, 9 aa, Homo Sapiens
RQLQQLISF

SEQ ID NO: 79312 - protein, 9 aa, Homo Sapiens
RQLSSSSSY

SEQ ID NO: 79313 - protein, 9 aa, Homo Sapiens
RQMAHVQIF

SEQ ID NO: 79314 - protein, 9 aa, Homo Sapiens
RQPLITLQY

SEQ ID NO: 79315 - protein, 9 aa, Homo Sapiens
RQPPSTTTF

SEQ ID NO: 79316 - protein, 9 aa, Homo Sapiens
RQQKEAACF

SEQ ID NO: 79317 - protein, 9 aa, Homo Sapiens
RQQQSQTAY

SEQ ID NO: 79318 - protein, 9 aa, Homo Sapiens
RQREIEIRF

SEQ ID NO: 79319 - protein, 9 aa, Homo Sapiens
RQREMEEQM

SEQ ID NO: 79320 - protein, 9 aa, Homo Sapiens
RQRFRQFGY

SEQ ID NO: 79321 - protein, 9 aa, Homo Sapiens
RQRLQSNAL

SEQ ID NO: 79322 - protein, 9 aa, Homo Sapiens
RQSPHSNLF

SEQ ID NO: 79323 - protein, 9 aa, Homo Sapiens
RQSPPRAAL

SEQ ID NO: 79324 - protein, 9 aa, Homo Sapiens
RQSTPRVSF

SEQ ID NO: 79325 - protein, 9 aa, Homo Sapiens
RQTIFNISL

SEQ ID NO: 79326 - protein, 9 aa, Homo Sapiens
RQVAPASGY

SEQ ID NO: 79327 - protein, 9 aa, Homo Sapiens
RQVCQLLGY

SEQ ID NO: 79328 - protein, 9 aa, Homo Sapiens
RQVGATVEF

SEQ ID NO: 79329 - protein, 9 aa, Homo Sapiens
RQVKGDLAF

SEQ ID NO: 79330 - protein, 9 aa, Homo Sapiens
RQVSTLNSY

SEQ ID NO: 79331 - protein, 9 aa, Homo Sapiens
RQVVRSSKF

SEQ ID NO: 79332 - protein, 9 aa, Homo Sapiens
RQVYLPMSY

SEQ ID NO: 79333 - protein, 9 aa, Homo Sapiens
RQWKPQLGF

SEQ ID NO: 79334 - protein, 9 aa, Homo Sapiens
RQWLIDTLY

SEQ ID NO: 79335 - protein, 9 aa, Homo Sapiens
RQYAKDIGF

SEQ ID NO: 79336 - protein, 9 aa, Homo Sapiens
RQYDKFLTH

SEQ ID NO: 79337 - protein, 9 aa, Homo Sapiens
RQYHLQQLF

SEQ ID NO: 79338 - protein, 9 aa, Homo Sapiens
RQYLDQQQY

SEQ ID NO: 79339 - protein, 9 aa, Homo Sapiens
RQYLECEVF

SEQ ID NO: 79340 - protein, 9 aa, Homo Sapiens
RQYLEEVGY

SEQ ID NO: 79341 - protein, 9 aa, Homo Sapiens
RQYLQEVGY

SEQ ID NO: 79342 - protein, 9 aa, Homo Sapiens
RQYPEVIKY

SEQ ID NO: 79343 - protein, 9 aa, Homo Sapiens
RQYPTPFQL

SEQ ID NO: 79344 - protein, 9 aa, Homo Sapiens
RSAIFSITY

SEQ ID NO: 79345 - protein, 9 aa, Homo Sapiens
RSAVFSVTY

SEQ ID NO: 79346 - protein, 9 aa, Homo Sapiens
RSFPGFQAF

SEQ ID NO: 79347 - protein, 9 aa, Homo Sapiens
RTAPSGSEY

SEQ ID NO: 79348 - protein, 9 aa, Homo Sapiens
SAAQPGVAF

SEQ ID NO: 79349 - protein, 9 aa, Homo Sapiens
SARAGETRF

SEQ ID NO: 79350 - protein, 9 aa, Homo Sapiens
SAYAQIVQF

SEQ ID NO: 79351 - protein, 9 aa, Homo Sapiens
SAYGSVKAY

SEQ ID NO: 79352 - protein, 9 aa, Homo Sapiens
SGFENKISY

SEQ ID NO: 79353 - protein, 9 aa, Homo Sapiens
SGRMQKVSY

SEQ ID NO: 79354 - protein, 9 aa, Homo Sapiens
SHAISMSAY

SEQ ID NO: 79355 - protein, 9 aa, Homo Sapiens
SHHLVARVY

SEQ ID NO: 79356 - protein, 9 aa, Homo Sapiens
SHIPQSSSY

SEQ ID NO: 79357 - protein, 9 aa, Homo Sapiens
SHLFVTSSF

SEQ ID NO: 79358 - protein, 9 aa, Homo Sapiens
SHLGESSSY

SEQ ID NO: 79359 - protein, 9 aa, Homo Sapiens
SHMEFYNQY

SEQ ID NO: 79360 - protein, 9 aa, Homo Sapiens
SHRAFVVKY

SEQ ID NO: 79361 - protein, 9 aa, Homo Sapiens
SHYPFFSTF

SEQ ID NO: 79362 - protein, 9 aa, Homo Sapiens
SHYVAFVKY

SEQ ID NO: 79363 - protein, 9 aa, Homo Sapiens
SIVNRTVTF

SEQ ID NO: 79364 - protein, 9 aa, Homo Sapiens
SKAAPSRLF

SEQ ID NO: 79365 - protein, 9 aa, Homo Sapiens
SKACVGNAY

SEQ ID NO: 79366 - protein, 9 aa, Homo Sapiens
SKALPASSF

SEQ ID NO: 79367 - protein, 9 aa, Homo Sapiens
SKAPAGSSL

SEQ ID NO: 79368 - protein, 9 aa, Homo Sapiens
SKAPAPVTY

SEQ ID NO: 79369 - protein, 9 aa, Homo Sapiens
SKAPGMNSL

SEQ ID NO: 79370 - protein, 9 aa, Homo Sapiens
SKAPGPAMY

SEQ ID NO: 79371 - protein, 9 aa, Homo Sapiens
SKASQFTGY

SEQ ID NO: 79372 - protein, 9 aa, Homo Sapiens
SKAVAVTSM

SEQ ID NO: 79373 - protein, 9 aa, Homo Sapiens
SKCEFAVGY

SEQ ID NO: 79374 - protein, 9 aa, Homo Sapiens
SKCFGFVSY

SEQ ID NO: 79375 - protein, 9 aa, Homo Sapiens
SKCGKSFRY

SEQ ID NO: 79376 - protein, 9 aa, Homo Sapiens
SKCSRGALY

SEQ ID NO: 79377 - protein, 9 aa, Homo Sapiens
SKDKRALKF

SEQ ID NO: 79378 - protein, 9 aa, Homo Sapiens
SKDKRDVYY

SEQ ID NO: 79379 - protein, 9 aa, Homo Sapiens
SKEDDVRQY

SEQ ID NO: 79380 - protein, 9 aa, Homo Sapiens
SKEEAMRWF

SEQ ID NO: 79381 - protein, 9 aa, Homo Sapiens
SKEPSARLL

SEQ ID NO: 79382 - protein, 9 aa, Homo Sapiens
SKFDGTRLY

SEQ ID NO: 79383 - protein, 9 aa, Homo Sapiens
SKFGTGNKY

SEQ ID NO: 79384 - protein, 9 aa, Homo Sapiens
SKFIIHNVY

SEQ ID NO: 79385 - protein, 9 aa, Homo Sapiens
SKFILIAAY

SEQ ID NO: 79386 - protein, 9 aa, Homo Sapiens
SKFPTQISL

SEQ ID NO: 79387 - protein, 9 aa, Homo Sapiens
SKFSNPRAL

SEQ ID NO: 79388 - protein, 9 aa, Homo Sapiens
SKFSQKIRY

SEQ ID NO: 79389 - protein, 9 aa, Homo Sapiens
SKFSQQQSF

SEQ ID NO: 79390 - protein, 9 aa, Homo Sapiens
SKFSSASKY

SEQ ID NO: 79391 - protein, 9 aa, Homo Sapiens
SKGIVVTAY

SEQ ID NO: 79392 - protein, 9 aa, Homo Sapiens
SKHDAATCF

SEQ ID NO: 79393 - protein, 9 aa, Homo Sapiens
SKHRAQVIY

SEQ ID NO: 79394 - protein, 9 aa, Homo Sapiens
SKIAGILHY

SEQ ID NO: 79395 - protein, 9 aa, Homo Sapiens
SKIDYFLEY

SEQ ID NO: 79396 - protein, 9 aa, Homo Sapiens
SKINPNTAY

SEQ ID NO: 79397 - protein, 9 aa, Homo Sapiens
SKIRAPTTM

SEQ ID NO: 79398 - protein, 9 aa, Homo Sapiens
SKIRVPVRY

SEQ ID NO: 79399 - protein, 9 aa, Homo Sapiens
SKITMPIAF

SEQ ID NO: 79400 - protein, 9 aa, Homo Sapiens
SKIYKPLLF

SEQ ID NO: 79401 - protein, 9 aa, Homo Sapiens
SKKFGDMSY

SEQ ID NO: 79402 - protein, 9 aa, Homo Sapiens
SKKHLETKF

SEQ ID NO: 79403 - protein, 9 aa, Homo Sapiens
SKKIDRHMY

SEQ ID NO: 79404 - protein, 9 aa, Homo Sapiens
SKKPESTSF

SEQ ID NO: 79405 - protein, 9 aa, Homo Sapiens
SKKPLILVY

SEQ ID NO: 79406 - protein, 9 aa, Homo Sapiens
SKKWGFTKF

SEQ ID NO: 79407 - protein, 9 aa, Homo Sapiens
SKLFSSVTF

SEQ ID NO: 79408 - protein, 9 aa, Homo Sapiens
SKLGKHAHF

SEQ ID NO: 79409 - protein, 9 aa, Homo Sapiens
SKLGPGEKY

SEQ ID NO: 79410 - protein, 9 aa, Homo Sapiens
SKLKETSPL

SEQ ID NO: 79411 - protein, 9 aa, Homo Sapiens
SKLLANMVY

SEQ ID NO: 79412 - protein, 9 aa, Homo Sapiens
SKLLLPITY

SEQ ID NO: 79413 - protein, 9 aa, Homo Sapiens
SKLPKDTAL

SEQ ID NO: 79414 - protein, 9 aa, Homo Sapiens
SKLPSSIEY

SEQ ID NO: 79415 - protein, 9 aa, Homo Sapiens
SKLPVITCY

SEQ ID NO: 79416 - protein, 9 aa, Homo Sapiens
SKLQNNNVY

SEQ ID NO: 79417 - protein, 9 aa, Homo Sapiens
SKLQWVSVF

SEQ ID NO: 79418 - protein, 9 aa, Homo Sapiens
SKLSFSQVF

SEQ ID NO: 79419 - protein, 9 aa, Homo Sapiens
SKLTQILSY

SEQ ID NO: 79420 - protein, 9 aa, Homo Sapiens
SKLWIIMEY

SEQ ID NO: 79421 - protein, 9 aa, Homo Sapiens
SKMDLIEHY

SEQ ID NO: 79422 - protein, 9 aa, Homo Sapiens
SKMFHPNVY

SEQ ID NO: 79423 - protein, 9 aa, Homo Sapiens
SKMGKQLTY

SEQ ID NO: 79424 - protein, 9 aa, Homo Sapiens
SKMHTSQDF

SEQ ID NO: 79425 - protein, 9 aa, Homo Sapiens
SKMLQHIDY

SEQ ID NO: 79426 - protein, 9 aa, Homo Sapiens
SKMSELQTY

SEQ ID NO: 79427 - protein, 9 aa, Homo Sapiens
SKNDLAVAY

SEQ ID NO: 79428 - protein, 9 aa, Homo Sapiens
SKNKSIICY

SEQ ID NO: 79429 - protein, 9 aa, Homo Sapiens
SKNPHIVSF

SEQ ID NO: 79430 - protein, 9 aa, Homo Sapiens
SKNPSKESF

SEQ ID NO: 79431 - protein, 9 aa, Homo Sapiens
SKNVSGISF

SEQ ID NO: 79432 - protein, 9 aa, Homo Sapiens
SKPASNPKF

SEQ ID NO: 79433 - protein, 9 aa, Homo Sapiens
SKPGVSLVY

SEQ ID NO: 79434 - protein, 9 aa, Homo Sapiens
SKPKEKLVY

SEQ ID NO: 79435 - protein, 9 aa, Homo Sapiens
SKPSTICKY

SEQ ID NO: 79436 - protein, 9 aa, Homo Sapiens
SKQAGQSVF

SEQ ID NO: 79437 - protein, 9 aa, Homo Sapiens
SKQASTVVF

SEQ ID NO: 79438 - protein, 9 aa, Homo Sapiens
SKQETGTEF

SEQ ID NO: 79439 - protein, 9 aa, Homo Sapiens
SKQLFMTAY

SEQ ID NO: 79440 - protein, 9 aa, Homo Sapiens
SKRIAQETF

SEQ ID NO: 79441 - protein, 9 aa, Homo Sapiens
SKRISKLAY

SEQ ID NO: 79442 - protein, 9 aa, Homo Sapiens
SKRIWGELY

SEQ ID NO: 79443 - protein, 9 aa, Homo Sapiens
SKSIPHNCY

SEQ ID NO: 79444 - protein, 9 aa, Homo Sapiens
SKSPDLLMY

SEQ ID NO: 79445 - protein, 9 aa, Homo Sapiens
SKSQALAVY

SEQ ID NO: 79446 - protein, 9 aa, Homo Sapiens
SKTETNVYF

SEQ ID NO: 79447 - protein, 9 aa, Homo Sapiens
SKTQVTVQY

SEQ ID NO: 79448 - protein, 9 aa, Homo Sapiens
SKTSEVNCY

SEQ ID NO: 79449 - protein, 9 aa, Homo Sapiens
SKVANTILF

SEQ ID NO: 79450 - protein, 9 aa, Homo Sapiens
SKVCMYFTY

SEQ ID NO: 79451 - protein, 9 aa, Homo Sapiens
SKVDGKLSF

SEQ ID NO: 79452 - protein, 9 aa, Homo Sapiens
SKVGSRLGY

SEQ ID NO: 79453 - protein, 9 aa, Homo Sapiens
SKVIEDVAF

SEQ ID NO: 79454 - protein, 9 aa, Homo Sapiens
SKVLLPLTY

SEQ ID NO: 79455 - protein, 9 aa, Homo Sapiens
SKVMNIVSY

SEQ ID NO: 79456 - protein, 9 aa, Homo Sapiens
SKVPLKHEY

SEQ ID NO: 79457 - protein, 9 aa, Homo Sapiens
SKVPSAPHF

SEQ ID NO: 79458 - protein, 9 aa, Homo Sapiens
SKVQTAVTM

SEQ ID NO: 79459 - protein, 9 aa, Homo Sapiens
SKVVPFSHY

SEQ ID NO: 79460 - protein, 9 aa, Homo Sapiens
SKWLKHQAF

SEQ ID NO: 79461 - protein, 9 aa, Homo Sapiens
SKWNTRESY

SEQ ID NO: 79462 - protein, 9 aa, Homo Sapiens
SKYATGIRY

SEQ ID NO: 79463 - protein, 9 aa, Homo Sapiens
SKYEALQTF

SEQ ID NO: 79464 - protein, 9 aa, Homo Sapiens
SKYEKLAKI

SEQ ID NO: 79465 - protein, 9 aa, Homo Sapiens
SKYFERHGY

SEQ ID NO: 79466 - protein, 9 aa, Homo Sapiens
SKYNFENKY

SEQ ID NO: 79467 - protein, 9 aa, Homo Sapiens
SKYQTVEKL

SEQ ID NO: 79468 - protein, 9 aa, Homo Sapiens
SLFVSNHAY

SEQ ID NO: 79469 - protein, 9 aa, Homo Sapiens
SMHLQLTCF

SEQ ID NO: 79470 - protein, 9 aa, Homo Sapiens
SMRKTFARY

SEQ ID NO: 79471 - protein, 9 aa, Homo Sapiens
SMSDPGVSY

SEQ ID NO: 79472 - protein, 9 aa, Homo Sapiens
SMWIERTSF

SEQ ID NO: 79473 - protein, 9 aa, Homo Sapiens
SNYHFGVTY

SEQ ID NO: 79474 - protein, 9 aa, Homo Sapiens
SQADIKKAY

SEQ ID NO: 79475 - protein, 9 aa, Homo Sapiens
SQALAIRSY

SEQ ID NO: 79476 - protein, 9 aa, Homo Sapiens
SQARLLTSF

SEQ ID NO: 79477 - protein, 9 aa, Homo Sapiens
SQARTLITF

SEQ ID NO: 79478 - protein, 9 aa, Homo Sapiens
SQATPHSSY

SEQ ID NO: 79479 - protein, 9 aa, Homo Sapiens
SQDPGTHVV

SEQ ID NO: 79480 - protein, 9 aa, Homo Sapiens
SQDTFKVHY

SEQ ID NO: 79481 - protein, 9 aa, Homo Sapiens
SQFASSYVF

SEQ ID NO: 79482 - protein, 9 aa, Homo Sapiens
SQFDSTTGF

SEQ ID NO: 79483 - protein, 9 aa, Homo Sapiens
SQFGGGSQY

SEQ ID NO: 79484 - protein, 9 aa, Homo Sapiens
SQFGTVTRF

SEQ ID NO: 79485 - protein, 9 aa, Homo Sapiens
SQFIFEHSY

SEQ ID NO: 79486 - protein, 9 aa, Homo Sapiens
SQFINFPIY

SEQ ID NO: 79487 - protein, 9 aa, Homo Sapiens
SQFKGYFIF

SEQ ID NO: 79488 - protein, 9 aa, Homo Sapiens
SQFPQPQHF

SEQ ID NO: 79489 - protein, 9 aa, Homo Sapiens
SQFSVPSSY

SEQ ID NO: 79490 - protein, 9 aa, Homo Sapiens
SQGPVKHVY

SEQ ID NO: 79491 - protein, 9 aa, Homo Sapiens
SQGSFPEHY

SEQ ID NO: 79492 - protein, 9 aa, Homo Sapiens
SQHPQQTSF

SEQ ID NO: 79493 - protein, 9 aa, Homo Sapiens
SQHQAIERF

SEQ ID NO: 79494 - protein, 9 aa, Homo Sapiens
SQHQETPVY

SEQ ID NO: 79495 - protein, 9 aa, Homo Sapiens
SQIDNNEPY

SEQ ID NO: 79496 - protein, 9 aa, Homo Sapiens
SQIEEHKVF

SEQ ID NO: 79497 - protein, 9 aa, Homo Sapiens
SQIFISRTY

SEQ ID NO: 79498 - protein, 9 aa, Homo Sapiens
SQIYQSIEF

SEQ ID NO: 79499 - protein, 9 aa, Homo Sapiens
SQKVSGPQY

SEQ ID NO: 79500 - protein, 9 aa, Homo Sapiens
SQLKGVSTF

SEQ ID NO: 79501 - protein, 9 aa, Homo Sapiens
SQLPEKVEY

SEQ ID NO: 79502 - protein, 9 aa, Homo Sapiens
SQLPPLTAF

SEQ ID NO: 79503 - protein, 9 aa, Homo Sapiens
SQLVAGVAF

SEQ ID NO: 79504 - protein, 9 aa, Homo Sapiens
SQMKSYQSF

SEQ ID NO: 79505 - protein, 9 aa, Homo Sapiens
SQRDYTQYY

SEQ ID NO: 79506 - protein, 9 aa, Homo Sapiens
SQRFKSSVY

SEQ ID NO: 79507 - protein, 9 aa, Homo Sapiens
SQRLESVSF

SEQ ID NO: 79508 - protein, 9 aa, Homo Sapiens
SQRLGSQKF

SEQ ID NO: 79509 - protein, 9 aa, Homo Sapiens
SQRPAARAF

SEQ ID NO: 79510 - protein, 9 aa, Homo Sapiens
SQRSPSELF

SEQ ID NO: 79511 - protein, 9 aa, Homo Sapiens
SQRSTATMY

SEQ ID NO: 79512 - protein, 9 aa, Homo Sapiens
SQRVLYIRY

SEQ ID NO: 79513 - protein, 9 aa, Homo Sapiens
SQTEVSSEY

SEQ ID NO: 79514 - protein, 9 aa, Homo Sapiens
SQTNPGSQF

SEQ ID NO: 79515 - protein, 9 aa, Homo Sapiens
SQVDSKSTF

SEQ ID NO: 79516 - protein, 9 aa, Homo Sapiens
SQVKPLFQF

SEQ ID NO: 79517 - protein, 9 aa, Homo Sapiens
SQVLGLHCY

SEQ ID NO: 79518 - protein, 9 aa, Homo Sapiens
SQVLLLKSF

SEQ ID NO: 79519 - protein, 9 aa, Homo Sapiens
SQVPQQSHF

SEQ ID NO: 79520 - protein, 9 aa, Homo Sapiens
SQVPRSSSM

SEQ ID NO: 79521 - protein, 9 aa, Homo Sapiens
SQVPTQMSF

SEQ ID NO: 79522 - protein, 9 aa, Homo Sapiens
SQVPVKHVY

SEQ ID NO: 79523 - protein, 9 aa, Homo Sapiens
SQYCGRLEY

SEQ ID NO: 79524 - protein, 9 aa, Homo Sapiens
SQYGSQVGY

SEQ ID NO: 79525 - protein, 9 aa, Homo Sapiens
SQYLTRITI

SEQ ID NO: 79526 - protein, 9 aa, Homo Sapiens
SQYPFPVTL

SEQ ID NO: 79527 - protein, 9 aa, Homo Sapiens
SQYQGVVVY

SEQ ID NO: 79528 - protein, 9 aa, Homo Sapiens
TAYPGQTQY

SEQ ID NO: 79529 - protein, 9 aa, Homo Sapiens
THAANTVVY

SEQ ID NO: 79530 - protein, 9 aa, Homo Sapiens
THLKPGTLY

SEQ ID NO: 79531 - protein, 9 aa, Homo Sapiens
THYIQHLSF

SEQ ID NO: 79532 - protein, 9 aa, Homo Sapiens
THYQLGLAY

SEQ ID NO: 79533 - protein, 9 aa, Homo Sapiens
TKADHMGSY

SEQ ID NO: 79534 - protein, 9 aa, Homo Sapiens
TKAEPSISY

SEQ ID NO: 79535 - protein, 9 aa, Homo Sapiens
TKAGVLARY

SEQ ID NO: 79536 - protein, 9 aa, Homo Sapiens
TKAVSSVKF

SEQ ID NO: 79537 - protein, 9 aa, Homo Sapiens
TKDGVREVF

SEQ ID NO: 79538 - protein, 9 aa, Homo Sapiens
TKDSTRLKY

SEQ ID NO: 79539 - protein, 9 aa, Homo Sapiens
TKFPAEQYY

SEQ ID NO: 79540 - protein, 9 aa, Homo Sapiens
TKFQAGVRF

SEQ ID NO: 79541 - protein, 9 aa, Homo Sapiens
TKFQEAVTF

SEQ ID NO: 79542 - protein, 9 aa, Homo Sapiens
TKIDVSYEY

SEQ ID NO: 79543 - protein, 9 aa, Homo Sapiens
TKIQHILTY

SEQ ID NO: 79544 - protein, 9 aa, Homo Sapiens
TKISTHVSF

SEQ ID NO: 79545 - protein, 9 aa, Homo Sapiens
TKISTQLDF

SEQ ID NO: 79546 - protein, 9 aa, Homo Sapiens
TKKGIGPVY

SEQ ID NO: 79547 - protein, 9 aa, Homo Sapiens
TKKVTSVVF

SEQ ID NO: 79548 - protein, 9 aa, Homo Sapiens
TKLEGGVAY

SEQ ID NO: 79549 - protein, 9 aa, Homo Sapiens
TKLGKPFKY

SEQ ID NO: 79550 - protein, 9 aa, Homo Sapiens
TKLPFIVVM

SEQ ID NO: 79551 - protein, 9 aa, Homo Sapiens
TKNISAISY

SEQ ID NO: 79552 - protein, 9 aa, Homo Sapiens
TKPGLYTAY

SEQ ID NO: 79553 - protein, 9 aa, Homo Sapiens
TKQPIPAAY

SEQ ID NO: 79554 - protein, 9 aa, Homo Sapiens
TKVDIKETY

SEQ ID NO: 79555 - protein, 9 aa, Homo Sapiens
TKVGPNATY

SEQ ID NO: 79556 - protein, 9 aa, Homo Sapiens
TKVVQNDAY

SEQ ID NO: 79557 - protein, 9 aa, Homo Sapiens
TKVYTQVEF

SEQ ID NO: 79558 - protein, 9 aa, Homo Sapiens
TKYHGPKAL

SEQ ID NO: 79559 - protein, 9 aa, Homo Sapiens
TKYLENQAF

SEQ ID NO: 79560 - protein, 9 aa, Homo Sapiens
TKYMRDPTF

SEQ ID NO: 79561 - protein, 9 aa, Homo Sapiens
TLYETIIGY

SEQ ID NO: 79562 - protein, 9 aa, Homo Sapiens
TMCPHILRY

SEQ ID NO: 79563 - protein, 9 aa, Homo Sapiens
TMFVQRQVF

SEQ ID NO: 79564 - protein, 9 aa, Homo Sapiens
TMKPSETSF

SEQ ID NO: 79565 - protein, 9 aa, Homo Sapiens
TQAPIFISF

SEQ ID NO: 79566 - protein, 9 aa, Homo Sapiens
TQAQIKAAY

SEQ ID NO: 79567 - protein, 9 aa, Homo Sapiens
TQAQTTATY

SEQ ID NO: 79568 - protein, 9 aa, Homo Sapiens
TQFGGKRPF

SEQ ID NO: 79569 - protein, 9 aa, Homo Sapiens
TQFVSGSKY

SEQ ID NO: 79570 - protein, 9 aa, Homo Sapiens
TQHPTLRLY

SEQ ID NO: 79571 - protein, 9 aa, Homo Sapiens
TQILQSPAF

SEQ ID NO: 79572 - protein, 9 aa, Homo Sapiens
TQIPRKVVY

SEQ ID NO: 79573 - protein, 9 aa, Homo Sapiens
TQIPTETTY

SEQ ID NO: 79574 - protein, 9 aa, Homo Sapiens
TQKEHLLKY

SEQ ID NO: 79575 - protein, 9 aa, Homo Sapiens
TQMDVKLVF

SEQ ID NO: 79576 - protein, 9 aa, Homo Sapiens
TQMPDPKTF

SEQ ID NO: 79577 - protein, 9 aa, Homo Sapiens
TQRDFMLSF

SEQ ID NO: 79578 - protein, 9 aa, Homo Sapiens
TQREFMLSF

SEQ ID NO: 79579 - protein, 9 aa, Homo Sapiens
TQRLKIMEY

SEQ ID NO: 79580 - protein, 9 aa, Homo Sapiens
TQRMFEIDY

SEQ ID NO: 79581 - protein, 9 aa, Homo Sapiens
TQRSQQLEF

SEQ ID NO: 79582 - protein, 9 aa, Homo Sapiens
TQVIHSIEY

SEQ ID NO: 79583 - protein, 9 aa, Homo Sapiens
TQYESKVFY

SEQ ID NO: 79584 - protein, 9 aa, Homo Sapiens
TQYTKPNQY

SEQ ID NO: 79585 - protein, 9 aa, Homo Sapiens
VAYDSKQYY

SEQ ID NO: 79586 - protein, 9 aa, Homo Sapiens
VEWEGTTPY

SEQ ID NO: 79587 - protein, 9 aa, Homo Sapiens
VHFVQTNSF

SEQ ID NO: 79588 - protein, 9 aa, Homo Sapiens
VHLPSCTVF

SEQ ID NO: 79589 - protein, 9 aa, Homo Sapiens
VHNPDVITY

SEQ ID NO: 79590 - protein, 9 aa, Homo Sapiens
VHPPPTTTY

SEQ ID NO: 79591 - protein, 9 aa, Homo Sapiens
VHRATGHEF

SEQ ID NO: 79592 - protein, 9 aa, Homo Sapiens
VHRQFAIVF

SEQ ID NO: 79593 - protein, 9 aa, Homo Sapiens
VKADGHKVY

SEQ ID NO: 79594 - protein, 9 aa, Homo Sapiens
VKAEIRQQF

SEQ ID NO: 79595 - protein, 9 aa, Homo Sapiens
VKAELRQYF

SEQ ID NO: 79596 - protein, 9 aa, Homo Sapiens
VKAEMLHMY

SEQ ID NO: 79597 - protein, 9 aa, Homo Sapiens
VKALMRFAF

SEQ ID NO: 79598 - protein, 9 aa, Homo Sapiens
VKAPGKSSF

SEQ ID NO: 79599 - protein, 9 aa, Homo Sapiens
VKAPPQTRL

SEQ ID NO: 79600 - protein, 9 aa, Homo Sapiens
VKATTKIKY

SEQ ID NO: 79601 - protein, 9 aa, Homo Sapiens
VKAVLAESY

SEQ ID NO: 79602 - protein, 9 aa, Homo Sapiens
VKDAKIAVY

SEQ ID NO: 79603 - protein, 9 aa, Homo Sapiens
VKDDIFRIY

SEQ ID NO: 79604 - protein, 9 aa, Homo Sapiens
VKEGVSAAF

SEQ ID NO: 79605 - protein, 9 aa, Homo Sapiens
VKFDAVIGY

SEQ ID NO: 79606 - protein, 9 aa, Homo Sapiens
VKFNPIETF

SEQ ID NO: 79607 - protein, 9 aa, Homo Sapiens
VKFPSKSAL

SEQ ID NO: 79608 - protein, 9 aa, Homo Sapiens
VKFSPSSRY

SEQ ID NO: 79609 - protein, 9 aa, Homo Sapiens
VKHIHVKAF

SEQ ID NO: 79610 - protein, 9 aa, Homo Sapiens
VKHPPSVKY

SEQ ID NO: 79611 - protein, 9 aa, Homo Sapiens
VKIGALEGY

SEQ ID NO: 79612 - protein, 9 aa, Homo Sapiens
VKIKTKLFY

SEQ ID NO: 79613 - protein, 9 aa, Homo Sapiens
VKIQKHVTF

SEQ ID NO: 79614 - protein, 9 aa, Homo Sapiens
VKKIDKYLY

SEQ ID NO: 79615 - protein, 9 aa, Homo Sapiens
VKLDPRPEY

SEQ ID NO: 79616 - protein, 9 aa, Homo Sapiens
VKLPSGEDY

SEQ ID NO: 79617 - protein, 9 aa, Homo Sapiens
VKNIERTLY

SEQ ID NO: 79618 - protein, 9 aa, Homo Sapiens
VKNIKQAEF

SEQ ID NO: 79619 - protein, 9 aa, Homo Sapiens
VKNKDIRKF

SEQ ID NO: 79620 - protein, 9 aa, Homo Sapiens
VKNKIASKY

SEQ ID NO: 79621 - protein, 9 aa, Homo Sapiens
VKNWVPTAY

SEQ ID NO: 79622 - protein, 9 aa, Homo Sapiens
VKPQSGSPY

SEQ ID NO: 79623 - protein, 9 aa, Homo Sapiens
VKPQTSPEY

SEQ ID NO: 79624 - protein, 9 aa, Homo Sapiens
VKRKQFEKY

SEQ ID NO: 79625 - protein, 9 aa, Homo Sapiens
VKRSAAEMY

SEQ ID NO: 79626 - protein, 9 aa, Homo Sapiens
VKSKIASKY

SEQ ID NO: 79627 - protein, 9 aa, Homo Sapiens
VKTGTITTF

SEQ ID NO: 79628 - protein, 9 aa, Homo Sapiens
VKVDLSEKY

SEQ ID NO: 79629 - protein, 9 aa, Homo Sapiens
VKVIDRILY

SEQ ID NO: 79630 - protein, 9 aa, Homo Sapiens
VKVIQQESY

SEQ ID NO: 79631 - protein, 9 aa, Homo Sapiens
VKVKDSTEY

SEQ ID NO: 79632 - protein, 9 aa, Homo Sapiens
VKWKGSLFF

SEQ ID NO: 79633 - protein, 9 aa, Homo Sapiens
VKYERQPEY

SEQ ID NO: 79634 - protein, 9 aa, Homo Sapiens
VKYIQQENF

SEQ ID NO: 79635 - protein, 9 aa, Homo Sapiens
VKYIQTDGY

SEQ ID NO: 79636 - protein, 9 aa, Homo Sapiens
VKYTNNEAY

SEQ ID NO: 79637 - protein, 9 aa, Homo Sapiens
VKYTQRVDY

SEQ ID NO: 79638 - protein, 9 aa, Homo Sapiens
VKYYQSHHY

SEQ ID NO: 79639 - protein, 9 aa, Homo Sapiens
VLFEHAVGY

SEQ ID NO: 79640 - protein, 9 aa, Homo Sapiens
VLYPHLSTY

SEQ ID NO: 79641 - protein, 9 aa, Homo Sapiens
VMINKATPY

SEQ ID NO: 79642 - protein, 9 aa, Homo Sapiens
VMLPTGAAF

SEQ ID NO: 79643 - protein, 9 aa, Homo Sapiens
VPNLFSLQL

SEQ ID NO: 79644 - protein, 9 aa, Homo Sapiens
VQCPHPQIL

SEQ ID NO: 79645 - protein, 9 aa, Homo Sapiens
VQENGQRKY

SEQ ID NO: 79646 - protein, 9 aa, Homo Sapiens
VQGIFVEKY

SEQ ID NO: 79647 - protein, 9 aa, Homo Sapiens
VQGLLSETY

SEQ ID NO: 79648 - protein, 9 aa, Homo Sapiens
VQGPVGTDF

SEQ ID NO: 79649 - protein, 9 aa, Homo Sapiens
VQHCQSRVF

SEQ ID NO: 79650 - protein, 9 aa, Homo Sapiens
VQIPPSTTY

SEQ ID NO: 79651 - protein, 9 aa, Homo Sapiens
VQISPMSAF

SEQ ID NO: 79652 - protein, 9 aa, Homo Sapiens
VQKEDIEVY

SEQ ID NO: 79653 - protein, 9 aa, Homo Sapiens
VQKEGKISY

SEQ ID NO: 79654 - protein, 9 aa, Homo Sapiens
VQPSKFNSY

SEQ ID NO: 79655 - protein, 9 aa, Homo Sapiens
VQQLQRLSF

SEQ ID NO: 79656 - protein, 9 aa, Homo Sapiens
VQQVHVATY

SEQ ID NO: 79657 - protein, 9 aa, Homo Sapiens
VQQVQRLPF

SEQ ID NO: 79658 - protein, 9 aa, Homo Sapiens
VQRGIGTAY

SEQ ID NO: 79659 - protein, 9 aa, Homo Sapiens
VQRITQETF

SEQ ID NO: 79660 - protein, 9 aa, Homo Sapiens
VQRNHETAF

SEQ ID NO: 79661 - protein, 9 aa, Homo Sapiens
VQRPQVVEY

SEQ ID NO: 79662 - protein, 9 aa, Homo Sapiens
VQRVETISL

SEQ ID NO: 79663 - protein, 9 aa, Homo Sapiens
VQVKRIHEY

SEQ ID NO: 79664 - protein, 9 aa, Homo Sapiens
VQYRYFKGY

SEQ ID NO: 79665 - protein, 9 aa, Homo Sapiens
VQYVHTQRF

SEQ ID NO: 79666 - protein, 9 aa, Homo Sapiens
VSYKGSISY

SEQ ID NO: 79667 - protein, 9 aa, Homo Sapiens
WHAPPVTTY

SEQ ID NO: 79668 - protein, 9 aa, Homo Sapiens
WKHAGKQDY

SEQ ID NO: 79669 - protein, 9 aa, Homo Sapiens
WQTVVGKTY

SEQ ID NO: 79670 - protein, 9 aa, Homo Sapiens
YHGKTGRVY

SEQ ID NO: 79671 - protein, 9 aa, Homo Sapiens
YHIGIPLTY

SEQ ID NO: 79672 - protein, 9 aa, Homo Sapiens
YHLGVVEAY

SEQ ID NO: 79673 - protein, 9 aa, Homo Sapiens
YHSFVSSVF

SEQ ID NO: 79674 - protein, 9 aa, Homo Sapiens
YKAFVMETF

SEQ ID NO: 79675 - protein, 9 aa, Homo Sapiens
YKALESIEY

SEQ ID NO: 79676 - protein, 9 aa, Homo Sapiens
YKAPILLAL

SEQ ID NO: 79677 - protein, 9 aa, Homo Sapiens
YKAPITNEF

SEQ ID NO: 79678 - protein, 9 aa, Homo Sapiens
YKAQPVIEF

SEQ ID NO: 79679 - protein, 9 aa, Homo Sapiens
YKAWSSIVY

SEQ ID NO: 79680 - protein, 9 aa, Homo Sapiens
YKAYLESFY

SEQ ID NO: 79681 - protein, 9 aa, Homo Sapiens
YKFDFPVSY

SEQ ID NO: 79682 - protein, 9 aa, Homo Sapiens
YKIAFPYLY

SEQ ID NO: 79683 - protein, 9 aa, Homo Sapiens
YKIDGSLEV

SEQ ID NO: 79684 - protein, 9 aa, Homo Sapiens
YKIGDLTGY

SEQ ID NO: 79685 - protein, 9 aa, Homo Sapiens
YKIGLVEAL

SEQ ID NO: 79686 - protein, 9 aa, Homo Sapiens
YKIKYPENF

SEQ ID NO: 79687 - protein, 9 aa, Homo Sapiens
YKILGGSVL

SEQ ID NO: 79688 - protein, 9 aa, Homo Sapiens
YKIPYTTVL

SEQ ID NO: 79689 - protein, 9 aa, Homo Sapiens
YKITAEEMY

SEQ ID NO: 79690 - protein, 9 aa, Homo Sapiens
YKKDVGKTL

SEQ ID NO: 79691 - protein, 9 aa, Homo Sapiens
YKKELEKTY

SEQ ID NO: 79692 - protein, 9 aa, Homo Sapiens
YKKGKDSLY

SEQ ID NO: 79693 - protein, 9 aa, Homo Sapiens
YKKPPMTCL

SEQ ID NO: 79694 - protein, 9 aa, Homo Sapiens
YKKSGKLVF

SEQ ID NO: 79695 - protein, 9 aa, Homo Sapiens
YKKTKEAVL

SEQ ID NO: 79696 - protein, 9 aa, Homo Sapiens
YKLDKQHTF

SEQ ID NO: 79697 - protein, 9 aa, Homo Sapiens
YKLDPDRQY

SEQ ID NO: 79698 - protein, 9 aa, Homo Sapiens
YKLELEQTY

SEQ ID NO: 79699 - protein, 9 aa, Homo Sapiens
YKLLGGLAV

SEQ ID NO: 79700 - protein, 9 aa, Homo Sapiens
YKLLPHSEY

SEQ ID NO: 79701 - protein, 9 aa, Homo Sapiens
YKLPDNVTF

SEQ ID NO: 79702 - protein, 9 aa, Homo Sapiens
YKLRAAEQY

SEQ ID NO: 79703 - protein, 9 aa, Homo Sapiens
YKMDPTKQY

SEQ ID NO: 79704 - protein, 9 aa, Homo Sapiens
YKMRNGYEL

SEQ ID NO: 79705 - protein, 9 aa, Homo Sapiens
YKNIPQMSF

SEQ ID NO: 79706 - protein, 9 aa, Homo Sapiens
YKNRTILGY

SEQ ID NO: 79707 - protein, 9 aa, Homo Sapiens
YKPDVKIEY

SEQ ID NO: 79708 - protein, 9 aa, Homo Sapiens
YKPPPQHMF

SEQ ID NO: 79709 - protein, 9 aa, Homo Sapiens
YKPVANHQY

SEQ ID NO: 79710 - protein, 9 aa, Homo Sapiens
YKQLGYSVY

SEQ ID NO: 79711 - protein, 9 aa, Homo Sapiens
YKRDFEAKL

SEQ ID NO: 79712 - protein, 9 aa, Homo Sapiens
YKRDPSKQY

SEQ ID NO: 79713 - protein, 9 aa, Homo Sapiens
YKRISRVEF

SEQ ID NO: 79714 - protein, 9 aa, Homo Sapiens
YKRQGAARF

SEQ ID NO: 79715 - protein, 9 aa, Homo Sapiens
YKRVTGTSL

SEQ ID NO: 79716 - protein, 9 aa, Homo Sapiens
YKSPASDTY

SEQ ID NO: 79717 - protein, 9 aa, Homo Sapiens
YKTPHRVAF

SEQ ID NO: 79718 - protein, 9 aa, Homo Sapiens
YKVDLESKL

SEQ ID NO: 79719 - protein, 9 aa, Homo Sapiens
YKVDNLEEF

SEQ ID NO: 79720 - protein, 9 aa, Homo Sapiens
YKVEYPIMY

SEQ ID NO: 79721 - protein, 9 aa, Homo Sapiens
YKVFKEEKY

SEQ ID NO: 79722 - protein, 9 aa, Homo Sapiens
YKVFREEKY

SEQ ID NO: 79723 - protein, 9 aa, Homo Sapiens
YKVPAGVSL

SEQ ID NO: 79724 - protein, 9 aa, Homo Sapiens
YKVPHPLEH

SEQ ID NO: 79725 - protein, 9 aa, Homo Sapiens
YKVTTQTSL

SEQ ID NO: 79726 - protein, 9 aa, Homo Sapiens
YKWSNKLQY

SEQ ID NO: 79727 - protein, 9 aa, Homo Sapiens
YKYEDLVRM

SEQ ID NO: 79728 - protein, 9 aa, Homo Sapiens
YKYPSDISY

SEQ ID NO: 79729 - protein, 9 aa, Homo Sapiens
YKYSGRDSL

SEQ ID NO: 79730 - protein, 9 aa, Homo Sapiens
YLLPDTKAY

SEQ ID NO: 79731 - protein, 9 aa, Homo Sapiens
YLRKEDMEY

SEQ ID NO: 79732 - protein, 9 aa, Homo Sapiens
YLYGQTTTY

SEQ ID NO: 79733 - protein, 9 aa, Homo Sapiens
YMRDPDDQY

SEQ ID NO: 79734 - protein, 9 aa, Homo Sapiens
YMYRHKGTY

SEQ ID NO: 79735 - protein, 9 aa, Homo Sapiens
YQADIERMY

SEQ ID NO: 79736 - protein, 9 aa, Homo Sapiens
YQEKGVRVL

SEQ ID NO: 79737 - protein, 9 aa, Homo Sapiens
YQFTGIKKY

SEQ ID NO: 79738 - protein, 9 aa, Homo Sapiens
YQHGHINSY

SEQ ID NO: 79739 - protein, 9 aa, Homo Sapiens
YQIDPDACF

SEQ ID NO: 79740 - protein, 9 aa, Homo Sapiens
YQIKVHRKY

SEQ ID NO: 79741 - protein, 9 aa, Homo Sapiens
YQKQPKIGY

SEQ ID NO: 79742 - protein, 9 aa, Homo Sapiens
YQLVKTYEY

SEQ ID NO: 79743 - protein, 9 aa, Homo Sapiens
YQPIQSPTF

SEQ ID NO: 79744 - protein, 9 aa, Homo Sapiens
YQQIFLHEF

SEQ ID NO: 79745 - protein, 9 aa, Homo Sapiens
YQRDLEVAL

SEQ ID NO: 79746 - protein, 9 aa, Homo Sapiens
YQTAISENY

SEQ ID NO: 79747 - protein, 9 aa, Homo Sapiens
YQTAPKAGY

SEQ ID NO: 79748 - protein, 9 aa, Homo Sapiens
YQYLEQSKY

SEQ ID NO: 79749 - protein, 9 aa, Homo Sapiens
YQYLLVTAL

SEQ ID NO: 79750 - protein, 9 aa, Homo Sapiens
YQYPRPLLI

SEQ ID NO: 79751 - protein, 9 aa, Homo Sapiens
YVPPLAPHP

SEQ ID NO: 79752 - protein, 10 aa, Homo Sapiens
AAAAAAPPDP

SEQ ID NO: 79753 - protein, 10 aa, Homo Sapiens
AKAAEEAKKF

SEQ ID NO: 79754 - protein, 10 aa, Homo Sapiens
AKAAGPLQVY

SEQ ID NO: 79755 - protein, 10 aa, Homo Sapiens
AKAGGFVVGY

SEQ ID NO: 79756 - protein, 10 aa, Homo Sapiens
AKAIATTVTY

SEQ ID NO: 79757 - protein, 10 aa, Homo Sapiens
AKANPQYTVY

SEQ ID NO: 79758 - protein, 10 aa, Homo Sapiens
AKAPFAAHGY

SEQ ID NO: 79759 - protein, 10 aa, Homo Sapiens
AKAPGAIGPY

SEQ ID NO: 79760 - protein, 10 aa, Homo Sapiens
AKAPVGPVTM

SEQ ID NO: 79761 - protein, 10 aa, Homo Sapiens
AKASPTQNLF

SEQ ID NO: 79762 - protein, 10 aa, Homo Sapiens
AKATILCTSY

SEQ ID NO: 79763 - protein, 10 aa, Homo Sapiens
AKCQQLQQEY

SEQ ID NO: 79764 - protein, 10 aa, Homo Sapiens
AKDPANGRQF

SEQ ID NO: 79765 - protein, 10 aa, Homo Sapiens
AKDPSVSIRY

SEQ ID NO: 79766 - protein, 10 aa, Homo Sapiens
AKFAEEFYSF

SEQ ID NO: 79767 - protein, 10 aa, Homo Sapiens
AKFNKKAERF

SEQ ID NO: 79768 - protein, 10 aa, Homo Sapiens
AKFPLPMEVF

SEQ ID NO: 79769 - protein, 10 aa, Homo Sapiens
AKFQYECGNY

SEQ ID NO: 79770 - protein, 10 aa, Homo Sapiens
AKFREIAEAY

SEQ ID NO: 79771 - protein, 10 aa, Homo Sapiens
AKGNIPAESY

SEQ ID NO: 79772 - protein, 10 aa, Homo Sapiens
AKIAEQVASF

SEQ ID NO: 79773 - protein, 10 aa, Homo Sapiens
AKIALMNSVF

SEQ ID NO: 79774 - protein, 10 aa, Homo Sapiens
AKIGGIITVF

SEQ ID NO: 79775 - protein, 10 aa, Homo Sapiens
AKIGSEIGCY

SEQ ID NO: 79776 - protein, 10 aa, Homo Sapiens
AKIKQKCPLY

SEQ ID NO: 79777 - protein, 10 aa, Homo Sapiens
AKILNHPRVY

SEQ ID NO: 79778 - protein, 10 aa, Homo Sapiens
AKKGFTAVGY

SEQ ID NO: 79779 - protein, 10 aa, Homo Sapiens
AKKRDIYDKY

SEQ ID NO: 79780 - protein, 10 aa, Homo Sapiens
AKLAGDHIEY

SEQ ID NO: 79781 - protein, 10 aa, Homo Sapiens
AKLDELKLKY

SEQ ID NO: 79782 - protein, 10 aa, Homo Sapiens
AKLGKEIEEY

SEQ ID NO: 79783 - protein, 10 aa, Homo Sapiens
AKLPDFESRY

SEQ ID NO: 79784 - protein, 10 aa, Homo Sapiens
AKLPFTPLSY

SEQ ID NO: 79785 - protein, 10 aa, Homo Sapiens
AKLPGGVQNF

SEQ ID NO: 79786 - protein, 10 aa, Homo Sapiens
AKLQDPFSLY

SEQ ID NO: 79787 - protein, 10 aa, Homo Sapiens
AKMMPGCEIY

SEQ ID NO: 79788 - protein, 10 aa, Homo Sapiens
AKNPQEQKSF

SEQ ID NO: 79789 - protein, 10 aa, Homo Sapiens
AKPAGGPKPP

SEQ ID NO: 79790 - protein, 10 aa, Homo Sapiens
AKPDSTLHTY

SEQ ID NO: 79791 - protein, 10 aa, Homo Sapiens
AKPEYISKTY

SEQ ID NO: 79792 - protein, 10 aa, Homo Sapiens
AKPHGPRTLY

SEQ ID NO: 79793 - protein, 10 aa, Homo Sapiens
AKPLAALVTY

SEQ ID NO: 79794 - protein, 10 aa, Homo Sapiens
AKPNGLILQY

SEQ ID NO: 79795 - protein, 10 aa, Homo Sapiens
AKPQHVTETF

SEQ ID NO: 79796 - protein, 10 aa, Homo Sapiens
AKPRSLQTGF

SEQ ID NO: 79797 - protein, 10 aa, Homo Sapiens
AKRADLQSTF

SEQ ID NO: 79798 - protein, 10 aa, Homo Sapiens
AKRPELRNYF

SEQ ID NO: 79799 - protein, 10 aa, Homo Sapiens
AKRPKFLTTY

SEQ ID NO: 79800 - protein, 10 aa, Homo Sapiens
AKSNELFTTF

SEQ ID NO: 79801 - protein, 10 aa, Homo Sapiens
AKSSTTVSSF

SEQ ID NO: 79802 - protein, 10 aa, Homo Sapiens
AKSSVGETVY

SEQ ID NO: 79803 - protein, 10 aa, Homo Sapiens
AKTPQKSVSF

SEQ ID NO: 79804 - protein, 10 aa, Homo Sapiens
AKVDENHSEF

SEQ ID NO: 79805 - protein, 10 aa, Homo Sapiens
AKVDLNSNGF

SEQ ID NO: 79806 - protein, 10 aa, Homo Sapiens
AKVDQNRVRY

SEQ ID NO: 79807 - protein, 10 aa, Homo Sapiens
AKVDTDGNGY

SEQ ID NO: 79808 - protein, 10 aa, Homo Sapiens
AKVFGATTNY

SEQ ID NO: 79809 - protein, 10 aa, Homo Sapiens
AKVFITKQGY

SEQ ID NO: 79810 - protein, 10 aa, Homo Sapiens
AKVINDGLFY

SEQ ID NO: 79811 - protein, 10 aa, Homo Sapiens
AKVKDKVYGC

SEQ ID NO: 79812 - protein, 10 aa, Homo Sapiens
AKVSSNKTGF

SEQ ID NO: 79813 - protein, 10 aa, Homo Sapiens
AKVTFTYTEF

SEQ ID NO: 79814 - protein, 10 aa, Homo Sapiens
AKYFIRDEFL

SEQ ID NO: 79815 - protein, 10 aa, Homo Sapiens
AKYIPELAYY

SEQ ID NO: 79816 - protein, 10 aa, Homo Sapiens
AKYLDEDTIY

SEQ ID NO: 79817 - protein, 10 aa, Homo Sapiens
AKYLSGIAHF

SEQ ID NO: 79818 - protein, 10 aa, Homo Sapiens
AKYMAEVKKY

SEQ ID NO: 79819 - protein, 10 aa, Homo Sapiens
AKYMKDLISY

SEQ ID NO: 79820 - protein, 10 aa, Homo Sapiens
AKYNACILEY

SEQ ID NO: 79821 - protein, 10 aa, Homo Sapiens
AKYNKILNKY

SEQ ID NO: 79822 - protein, 10 aa, Homo Sapiens
AKYPAESPDY

SEQ ID NO: 79823 - protein, 10 aa, Homo Sapiens
AQAFIHNSLY

SEQ ID NO: 79824 - protein, 10 aa, Homo Sapiens
AQAGWLQHDY

SEQ ID NO: 79825 - protein, 10 aa, Homo Sapiens
AQAHFNNGEY

SEQ ID NO: 79826 - protein, 10 aa, Homo Sapiens
AQAPCGQAAY

SEQ ID NO: 79827 - protein, 10 aa, Homo Sapiens
AQFHPDGLIF

SEQ ID NO: 79828 - protein, 10 aa, Homo Sapiens
AQFIDKPVCF

SEQ ID NO: 79829 - protein, 10 aa, Homo Sapiens
AQHEGESVSY

SEQ ID NO: 79830 - protein, 10 aa, Homo Sapiens
AQLDPSLVAF

SEQ ID NO: 79831 - protein, 10 aa, Homo Sapiens
AQLPKPTSTY

SEQ ID NO: 79832 - protein, 10 aa, Homo Sapiens
AQNPANMSKY

SEQ ID NO: 79833 - protein, 10 aa, Homo Sapiens
AQNPSGETAF

SEQ ID NO: 79834 - protein, 10 aa, Homo Sapiens
AQRAPGGLSY

SEQ ID NO: 79835 - protein, 10 aa, Homo Sapiens
AQRPDNPREF

SEQ ID NO: 79836 - protein, 10 aa, Homo Sapiens
AQRQDIAFAY

SEQ ID NO: 79837 - protein, 10 aa, Homo Sapiens
AQRQEIRTAY

SEQ ID NO: 79838 - protein, 10 aa, Homo Sapiens
AQRQEISAAF

SEQ ID NO: 79839 - protein, 10 aa, Homo Sapiens
AQRRDPSIHY

SEQ ID NO: 79840 - protein, 10 aa, Homo Sapiens
AQRSTETALY

SEQ ID NO: 79841 - protein, 10 aa, Homo Sapiens
AQVQYPLQTF

SEQ ID NO: 79842 - protein, 10 aa, Homo Sapiens
AQYDQASTKY

SEQ ID NO: 79843 - protein, 10 aa, Homo Sapiens
AQYPSQPQRF

SEQ ID NO: 79844 - protein, 10 aa, Homo Sapiens
AQYQREYSEF

SEQ ID NO: 79845 - protein, 10 aa, Homo Sapiens
AQYSQDYQQF

SEQ ID NO: 79846 - protein, 10 aa, Homo Sapiens
FKGPELLVDY

SEQ ID NO: 79847 - protein, 10 aa, Homo Sapiens
FKIDDQRRTH

SEQ ID NO: 79848 - protein, 10 aa, Homo Sapiens
FKLGGVTASF

SEQ ID NO: 79849 - protein, 10 aa, Homo Sapiens
FKPEEIQTVY

SEQ ID NO: 79850 - protein, 10 aa, Homo Sapiens
FKSGSPVATF

SEQ ID NO: 79851 - protein, 10 aa, Homo Sapiens
FKVDAGKLHY

SEQ ID NO: 79852 - protein, 10 aa, Homo Sapiens
FKVSASPLLY

SEQ ID NO: 79853 - protein, 10 aa, Homo Sapiens
FKYPNFDVEY

SEQ ID NO: 79854 - protein, 10 aa, Homo Sapiens
FQLPGGHLEF

SEQ ID NO: 79855 - protein, 10 aa, Homo Sapiens
FQYDDSGNTF

SEQ ID NO: 79856 - protein, 10 aa, Homo Sapiens
FQYDSTHGKF

SEQ ID NO: 79857 - protein, 10 aa, Homo Sapiens
GASQFMGNVY

SEQ ID NO: 79858 - protein, 10 aa, Homo Sapiens
GKADGQQSSF

SEQ ID NO: 79859 - protein, 10 aa, Homo Sapiens
GKAEVAVTLY

SEQ ID NO: 79860 - protein, 10 aa, Homo Sapiens
GKAFSCSSSF

SEQ ID NO: 79861 - protein, 10 aa, Homo Sapiens
GKAFTHYSTY

SEQ ID NO: 79862 - protein, 10 aa, Homo Sapiens
GKAITFVTQY

SEQ ID NO: 79863 - protein, 10 aa, Homo Sapiens
GKDIGRGIGY

SEQ ID NO: 79864 - protein, 10 aa, Homo Sapiens
GKFAGNPWYY

SEQ ID NO: 79865 - protein, 10 aa, Homo Sapiens
GKFCMISATF

SEQ ID NO: 79866 - protein, 10 aa, Homo Sapiens
GKFDHADRTF

SEQ ID NO: 79867 - protein, 10 aa, Homo Sapiens
GKFGGDFLVY

SEQ ID NO: 79868 - protein, 10 aa, Homo Sapiens
GKFGHEFLEF

SEQ ID NO: 79869 - protein, 10 aa, Homo Sapiens
GKFKGVGRSY

SEQ ID NO: 79870 - protein, 10 aa, Homo Sapiens
GKFKPNSVTY

SEQ ID NO: 79871 - protein, 10 aa, Homo Sapiens
GKFKQAETLY

SEQ ID NO: 79872 - protein, 10 aa, Homo Sapiens
GKFNVLLTTY

SEQ ID NO: 79873 - protein, 10 aa, Homo Sapiens
GKFQEEANIY

SEQ ID NO: 79874 - protein, 10 aa, Homo Sapiens
GKFQGLIEKF

SEQ ID NO: 79875 - protein, 10 aa, Homo Sapiens
GKFTEGNITY

SEQ ID NO: 79876 - protein, 10 aa, Homo Sapiens
GKHFGTILNY

SEQ ID NO: 79877 - protein, 10 aa, Homo Sapiens
GKIADRFLLY

SEQ ID NO: 79878 - protein, 10 aa, Homo Sapiens
GKIEGLTAEF

SEQ ID NO: 79879 - protein, 10 aa, Homo Sapiens
GKIISDNLTY

SEQ ID NO: 79880 - protein, 10 aa, Homo Sapiens
GKINILLQTY

SEQ ID NO: 79881 - protein, 10 aa, Homo Sapiens
GKIQGIIAEY

SEQ ID NO: 79882 - protein, 10 aa, Homo Sapiens
GKLDERHRLF

SEQ ID NO: 79883 - protein, 10 aa, Homo Sapiens
GKLEDIPAFF

SEQ ID NO: 79884 - protein, 10 aa, Homo Sapiens
GKLGKGFGAF

SEQ ID NO: 79885 - protein, 10 aa, Homo Sapiens
GKLGNESVTF

SEQ ID NO: 79886 - protein, 10 aa, Homo Sapiens
GKLIWKVTDY

SEQ ID NO: 79887 - protein, 10 aa, Homo Sapiens
GKLPAGGVLY

SEQ ID NO: 79888 - protein, 10 aa, Homo Sapiens
GKLYLEREEY

SEQ ID NO: 79889 - protein, 10 aa, Homo Sapiens
GKMNPQSAFF

SEQ ID NO: 79890 - protein, 10 aa, Homo Sapiens
GKNPFLGIAY

SEQ ID NO: 79891 - protein, 10 aa, Homo Sapiens
GKPEKPSVTY

SEQ ID NO: 79892 - protein, 10 aa, Homo Sapiens
GKPLGPRTLY

SEQ ID NO: 79893 - protein, 10 aa, Homo Sapiens
GKPPFEANTY

SEQ ID NO: 79894 - protein, 10 aa, Homo Sapiens
GKPQNAPEGY

SEQ ID NO: 79895 - protein, 10 aa, Homo Sapiens
GKPRFQQTSF

SEQ ID NO: 79896 - protein, 10 aa, Homo Sapiens
GKQFHRIVTY

SEQ ID NO: 79897 - protein, 10 aa, Homo Sapiens
GKREGIDQSY

SEQ ID NO: 79898 - protein, 10 aa, Homo Sapiens
GKRPEEENVY

SEQ ID NO: 79899 - protein, 10 aa, Homo Sapiens
GKTSFGMSVF

SEQ ID NO: 79900 - protein, 10 aa, Homo Sapiens
GKVFTGGALY

SEQ ID NO: 79901 - protein, 10 aa, Homo Sapiens
GKVGPMIGQY

SEQ ID NO: 79902 - protein, 10 aa, Homo Sapiens
GKVISSSSSF

SEQ ID NO: 79903 - protein, 10 aa, Homo Sapiens
GKVITSSSSF

SEQ ID NO: 79904 - protein, 10 aa, Homo Sapiens
GKVQDAFISY

SEQ ID NO: 79905 - protein, 10 aa, Homo Sapiens
GKVRDINRTY

SEQ ID NO: 79906 - protein, 10 aa, Homo Sapiens
GKYDSELMCY

SEQ ID NO: 79907 - protein, 10 aa, Homo Sapiens
GKYEAVERYY

SEQ ID NO: 79908 - protein, 10 aa, Homo Sapiens
GKYEEVEYYY

SEQ ID NO: 79909 - protein, 10 aa, Homo Sapiens
GKYEQAIQCY

SEQ ID NO: 79910 - protein, 10 aa, Homo Sapiens
GKYFGGVLEY

SEQ ID NO: 79911 - protein, 10 aa, Homo Sapiens
GKYKNSEINF

SEQ ID NO: 79912 - protein, 10 aa, Homo Sapiens
GKYKQALLQY

SEQ ID NO: 79913 - protein, 10 aa, Homo Sapiens
GKYLASCVQY

SEQ ID NO: 79914 - protein, 10 aa, Homo Sapiens
GKYMQAVIQY

SEQ ID NO: 79915 - protein, 10 aa, Homo Sapiens
GKYRDAVSRY

SEQ ID NO: 79916 - protein, 10 aa, Homo Sapiens
GKYREFHRMY

SEQ ID NO: 79917 - protein, 10 aa, Homo Sapiens
GMAAMPQTVY

SEQ ID NO: 79918 - protein, 10 aa, Homo Sapiens
GQDPHSSQAF

SEQ ID NO: 79919 - protein, 10 aa, Homo Sapiens
GQFPGHNEFF

SEQ ID NO: 79920 - protein, 10 aa, Homo Sapiens
GQILMPNIGY

SEQ ID NO: 79921 - protein, 10 aa, Homo Sapiens
GQKGTCGIQY

SEQ ID NO: 79922 - protein, 10 aa, Homo Sapiens
GQRKGAGSVF

SEQ ID NO: 79923 - protein, 10 aa, Homo Sapiens
GQYGNPLNKY

SEQ ID NO: 79924 - protein, 10 aa, Homo Sapiens
GQYSTGKTTF

SEQ ID NO: 79925 - protein, 10 aa, Homo Sapiens
GRIKAIQLEY

SEQ ID NO: 79926 - protein, 10 aa, Homo Sapiens
HKAPASGICF

SEQ ID NO: 79927 - protein, 10 aa, Homo Sapiens
HKFAKDFMTY

SEQ ID NO: 79928 - protein, 10 aa, Homo Sapiens
HKKQDPDVPF

SEQ ID NO: 79929 - protein, 10 aa, Homo Sapiens
HKVDLPFQEY

SEQ ID NO: 79930 - protein, 10 aa, Homo Sapiens
HKVETFSGVY

SEQ ID NO: 79931 - protein, 10 aa, Homo Sapiens
HQAACLIQAY

SEQ ID NO: 79932 - protein, 10 aa, Homo Sapiens
HQLRAQILAY

SEQ ID NO: 79933 - protein, 10 aa, Homo Sapiens
HQLRAQIMAY

SEQ ID NO: 79934 - protein, 10 aa, Homo Sapiens
HQRPDKQNLF

SEQ ID NO: 79935 - protein, 10 aa, Homo Sapiens
HQVAPSPAGY

SEQ ID NO: 79936 - protein, 10 aa, Homo Sapiens
IGHYTLKIEI

SEQ ID NO: 79937 - protein, 10 aa, Homo Sapiens
IGQSKSVKIY

SEQ ID NO: 79938 - protein, 10 aa, Homo Sapiens
IKAIFPNGQF

SEQ ID NO: 79939 - protein, 10 aa, Homo Sapiens
IKDPGPTRTF

SEQ ID NO: 79940 - protein, 10 aa, Homo Sapiens
IKKPDYKVAY

SEQ ID NO: 79941 - protein, 10 aa, Homo Sapiens
IKKSDPVVSY

SEQ ID NO: 79942 - protein, 10 aa, Homo Sapiens
IKMDASLGNL

SEQ ID NO: 79943 - protein, 10 aa, Homo Sapiens
IKPGEHGSTY

SEQ ID NO: 79944 - protein, 10 aa, Homo Sapiens
IKVWDTCTTY

SEQ ID NO: 79945 - protein, 10 aa, Homo Sapiens
IKYDLKGSTY

SEQ ID NO: 79946 - protein, 10 aa, Homo Sapiens
IKYDPSIGIY

SEQ ID NO: 79947 - protein, 10 aa, Homo Sapiens
IKYKERFLVY

SEQ ID NO: 79948 - protein, 10 aa, Homo Sapiens
IMRECQEESF

SEQ ID NO: 79949 - protein, 10 aa, Homo Sapiens
IQIALPSGCY

SEQ ID NO: 79950 - protein, 10 aa, Homo Sapiens
IQQLATIFTH

SEQ ID NO: 79951 - protein, 10 aa, Homo Sapiens
KGYLVSVDGY

SEQ ID NO: 79952 - protein, 10 aa, Homo Sapiens
KGYPSEFATY

SEQ ID NO: 79953 - protein, 10 aa, Homo Sapiens
KGYPSEFSTY

SEQ ID NO: 79954 - protein, 10 aa, Homo Sapiens
KHADPRIQGY

SEQ ID NO: 79955 - protein, 10 aa, Homo Sapiens
KHLPASNVSF

SEQ ID NO: 79956 - protein, 10 aa, Homo Sapiens
KHYEDNCISY

SEQ ID NO: 79957 - protein, 10 aa, Homo Sapiens
KKAACIAEQY

SEQ ID NO: 79958 - protein, 10 aa, Homo Sapiens
KKAPAQKVPA

SEQ ID NO: 79959 - protein, 10 aa, Homo Sapiens
KKAPGSGAVF

SEQ ID NO: 79960 - protein, 10 aa, Homo Sapiens
KKAQNIMESF

SEQ ID NO: 79961 - protein, 10 aa, Homo Sapiens
KKAVPKEDIY

SEQ ID NO: 79962 - protein, 10 aa, Homo Sapiens
KKCDISLQFF

SEQ ID NO: 79963 - protein, 10 aa, Homo Sapiens
KKFAFVHISF

SEQ ID NO: 79964 - protein, 10 aa, Homo Sapiens
KKFEASGFCY

SEQ ID NO: 79965 - protein, 10 aa, Homo Sapiens
KKFFGEFTGF

SEQ ID NO: 79966 - protein, 10 aa, Homo Sapiens
KKFNEPGSQY

SEQ ID NO: 79967 - protein, 10 aa, Homo Sapiens
KKFNSSVLSF

SEQ ID NO: 79968 - protein, 10 aa, Homo Sapiens
KKFSGKHVVF

SEQ ID NO: 79969 - protein, 10 aa, Homo Sapiens
KKHYAPLQAY

SEQ ID NO: 79970 - protein, 10 aa, Homo Sapiens
KKIADFLNSF

SEQ ID NO: 79971 - protein, 10 aa, Homo Sapiens
KKIDASQTEF

SEQ ID NO: 79972 - protein, 10 aa, Homo Sapiens
KKIEEFLSSF

SEQ ID NO: 79973 - protein, 10 aa, Homo Sapiens
KKIESSGVTY

SEQ ID NO: 79974 - protein, 10 aa, Homo Sapiens
KKIEVLDVSY

SEQ ID NO: 79975 - protein, 10 aa, Homo Sapiens
KKIKQDIYCY

SEQ ID NO: 79976 - protein, 10 aa, Homo Sapiens
KKKEEMLKKF

SEQ ID NO: 79977 - protein, 10 aa, Homo Sapiens
KKKTVIEIEF

SEQ ID NO: 79978 - protein, 10 aa, Homo Sapiens
KKLDEQYQKY

SEQ ID NO: 79979 - protein, 10 aa, Homo Sapiens
KKLDNLQCLY

SEQ ID NO: 79980 - protein, 10 aa, Homo Sapiens
KKLEDIRTRY

SEQ ID NO: 79981 - protein, 10 aa, Homo Sapiens
KKLEELEQKY

SEQ ID NO: 79982 - protein, 10 aa, Homo Sapiens
KKLEKETTMY

SEQ ID NO: 79983 - protein, 10 aa, Homo Sapiens
KKLPCQITSY

SEQ ID NO: 79984 - protein, 10 aa, Homo Sapiens
KKLPKGTVSF

SEQ ID NO: 79985 - protein, 10 aa, Homo Sapiens
KKLQGEVEKY

SEQ ID NO: 79986 - protein, 10 aa, Homo Sapiens
KKMETNYQRF

SEQ ID NO: 79987 - protein, 10 aa, Homo Sapiens
KKPAFNLSAF

SEQ ID NO: 79988 - protein, 10 aa, Homo Sapiens
KKPDLPQTNF

SEQ ID NO: 79989 - protein, 10 aa, Homo Sapiens
KKPDQHFKPY

SEQ ID NO: 79990 - protein, 10 aa, Homo Sapiens
KKPESFFTQF

SEQ ID NO: 79991 - protein, 10 aa, Homo Sapiens
KKPGHVAEVY

SEQ ID NO: 79992 - protein, 10 aa, Homo Sapiens
KKPPGAQLGF

SEQ ID NO: 79993 - protein, 10 aa, Homo Sapiens
KKQKPSRVLY

SEQ ID NO: 79994 - protein, 10 aa, Homo Sapiens
KKQPSVLVTF

SEQ ID NO: 79995 - protein, 10 aa, Homo Sapiens
KKRPGIETLF

SEQ ID NO: 79996 - protein, 10 aa, Homo Sapiens
KKSEASGFCY

SEQ ID NO: 79997 - protein, 10 aa, Homo Sapiens
KKVAPQNDSF

SEQ ID NO: 79998 - protein, 10 aa, Homo Sapiens
KKVDGSVNAY

SEQ ID NO: 79999 - protein, 10 aa, Homo Sapiens
KKVENFTVSF

SEQ ID NO: 80000 - protein, 10 aa, Homo Sapiens
KKVFLGRDTY

SEQ ID NO: 80001 - protein, 10 aa, Homo Sapiens
KKWEQDPETF

SEQ ID NO: 80002 - protein, 10 aa, Homo Sapiens
KKWVELPITF

SEQ ID NO: 80003 - protein, 10 aa, Homo Sapiens
KKYAEDRERF

SEQ ID NO: 80004 - protein, 10 aa, Homo Sapiens
KKYAGGVAEY

SEQ ID NO: 80005 - protein, 10 aa, Homo Sapiens
KKYDEAIKCY

SEQ ID NO: 80006 - protein, 10 aa, Homo Sapiens
KKYDKSLRKY

SEQ ID NO: 80007 - protein, 10 aa, Homo Sapiens
KKYGAAMVVM

SEQ ID NO: 80008 - protein, 10 aa, Homo Sapiens
KKYGVDLIRY

SEQ ID NO: 80009 - protein, 10 aa, Homo Sapiens
KKYLDAEQSY

SEQ ID NO: 80010 - protein, 10 aa, Homo Sapiens
KKYNMRVEDY

SEQ ID NO: 80011 - protein, 10 aa, Homo Sapiens
KKYPFILEVY

SEQ ID NO: 80012 - protein, 10 aa, Homo Sapiens
KKYPKALVKY

SEQ ID NO: 80013 - protein, 10 aa, Homo Sapiens
KKYTEITATY

SEQ ID NO: 80014 - protein, 10 aa, Homo Sapiens
KLFPGSPAIY

SEQ ID NO: 80015 - protein, 10 aa, Homo Sapiens
KLYRPGSVAY

SEQ ID NO: 80016 - protein, 10 aa, Homo Sapiens
KMLPDKDCRY

SEQ ID NO: 80017 - protein, 10 aa, Homo Sapiens
KMYDAAKLLY

SEQ ID NO: 80018 - protein, 10 aa, Homo Sapiens
KQAPPQKVSF

SEQ ID NO: 80019 - protein, 10 aa, Homo Sapiens
KQEEERGRVY

SEQ ID NO: 80020 - protein, 10 aa, Homo Sapiens
KQFDAGTVNY

SEQ ID NO: 80021 - protein, 10 aa, Homo Sapiens
KQFDRKHHTY

SEQ ID NO: 80022 - protein, 10 aa, Homo Sapiens
KQFEKQVELY

SEQ ID NO: 80023 - protein, 10 aa, Homo Sapiens
KQFQKVITEY

SEQ ID NO: 80024 - protein, 10 aa, Homo Sapiens
KQFRPPMGGY

SEQ ID NO: 80025 - protein, 10 aa, Homo Sapiens
KQIDPVLQVY

SEQ ID NO: 80026 - protein, 10 aa, Homo Sapiens
KQIDRQLTAY

SEQ ID NO: 80027 - protein, 10 aa, Homo Sapiens
KQISVGFIGY

SEQ ID NO: 80028 - protein, 10 aa, Homo Sapiens
KQIVEILTAY

SEQ ID NO: 80029 - protein, 10 aa, Homo Sapiens
KQKDIVSIHY

SEQ ID NO: 80030 - protein, 10 aa, Homo Sapiens
KQLKEAQVQY

SEQ ID NO: 80031 - protein, 10 aa, Homo Sapiens
KQLQKDKQVY

SEQ ID NO: 80032 - protein, 10 aa, Homo Sapiens
KQLVAEQVTY

SEQ ID NO: 80033 - protein, 10 aa, Homo Sapiens
KQMTFEAQAF

SEQ ID NO: 80034 - protein, 10 aa, Homo Sapiens
KQNPLLAEAY

SEQ ID NO: 80035 - protein, 10 aa, Homo Sapiens
KQVMEGRVTF

SEQ ID NO: 80036 - protein, 10 aa, Homo Sapiens
KQWLSKKSTY

SEQ ID NO: 80037 - protein, 10 aa, Homo Sapiens
KQYEVEIQTY

SEQ ID NO: 80038 - protein, 10 aa, Homo Sapiens
KQYISAVQMY

SEQ ID NO: 80039 - protein, 10 aa, Homo Sapiens
KQYYALEVSY

SEQ ID NO: 80040 - protein, 10 aa, Homo Sapiens
KRFEPGTQRF

SEQ ID NO: 80041 - protein, 10 aa, Homo Sapiens
LKAPGTNVAM

SEQ ID NO: 80042 - protein, 10 aa, Homo Sapiens
LKDEVRTLTY

SEQ ID NO: 80043 - protein, 10 aa, Homo Sapiens
LKFDSKYMNF

SEQ ID NO: 80044 - protein, 10 aa, Homo Sapiens
LKYEHKEIEY

SEQ ID NO: 80045 - protein, 10 aa, Homo Sapiens
LKYEPTNVRY

SEQ ID NO: 80046 - protein, 10 aa, Homo Sapiens
LMIDVTKSYY

SEQ ID NO: 80047 - protein, 10 aa, Homo Sapiens
LQFNPKFMTF

SEQ ID NO: 80048 - protein, 10 aa, Homo Sapiens
LQLPARNLTY

SEQ ID NO: 80049 - protein, 10 aa, Homo Sapiens
LQVEGHSNVY

SEQ ID NO: 80050 - protein, 10 aa, Homo Sapiens
LSDIKGLIKY

SEQ ID NO: 80051 - protein, 10 aa, Homo Sapiens
LSVKEKNISI

SEQ ID NO: 80052 - protein, 10 aa, Homo Sapiens
MKIWTSEHVF

SEQ ID NO: 80053 - protein, 10 aa, Homo Sapiens
MKYKSEGKCF

SEQ ID NO: 80054 - protein, 10 aa, Homo Sapiens
MQYPGRSLVF

SEQ ID NO: 80055 - protein, 10 aa, Homo Sapiens
NSKLPSSIEY

SEQ ID NO: 80056 - protein, 10 aa, Homo Sapiens
PLMTGISSLY

SEQ ID NO: 80057 - protein, 10 aa, Homo Sapiens
QKIQGEGNPY

SEQ ID NO: 80058 - protein, 10 aa, Homo Sapiens
QKNVECARVY

SEQ ID NO: 80059 - protein, 10 aa, Homo Sapiens
QKYQPRIAVF

SEQ ID NO: 80060 - protein, 10 aa, Homo Sapiens
QKYQSPVRVY

SEQ ID NO: 80061 - protein, 10 aa, Homo Sapiens
QQHDFTSQIF

SEQ ID NO: 80062 - protein, 10 aa, Homo Sapiens
QQIGKVVQVY

SEQ ID NO: 80063 - protein, 10 aa, Homo Sapiens
QQKYPTKVSF

SEQ ID NO: 80064 - protein, 10 aa, Homo Sapiens
QQMWISKQEY

SEQ ID NO: 80065 - protein, 10 aa, Homo Sapiens
QSQFIFEHSY

SEQ ID NO: 80066 - protein, 10 aa, Homo Sapiens
RAFPYGNVAF

SEQ ID NO: 80067 - protein, 10 aa, Homo Sapiens
RANPQVGVAF

SEQ ID NO: 80068 - protein, 10 aa, Homo Sapiens
RHLHPIQTSF

SEQ ID NO: 80069 - protein, 10 aa, Homo Sapiens
RHSGPLRVAM

SEQ ID NO: 80070 - protein, 10 aa, Homo Sapiens
RHYVGSAAAF

SEQ ID NO: 80071 - protein, 10 aa, Homo Sapiens
RHYYSITINY

SEQ ID NO: 80072 - protein, 10 aa, Homo Sapiens
RISQFSGVTF

SEQ ID NO: 80073 - protein, 10 aa, Homo Sapiens
RKAAITMQRY

SEQ ID NO: 80074 - protein, 10 aa, Homo Sapiens
RKAASLKSNY

SEQ ID NO: 80075 - protein, 10 aa, Homo Sapiens
RKANILTNRY

SEQ ID NO: 80076 - protein, 10 aa, Homo Sapiens
RKAQSVYSSY

SEQ ID NO: 80077 - protein, 10 aa, Homo Sapiens
RKDGSFIVRY

SEQ ID NO: 80078 - protein, 10 aa, Homo Sapiens
RKDPHGFFAF

SEQ ID NO: 80079 - protein, 10 aa, Homo Sapiens
RKFAYLGRLA

SEQ ID NO: 80080 - protein, 10 aa, Homo Sapiens
RKFEPGTQRF

SEQ ID NO: 80081 - protein, 10 aa, Homo Sapiens
RKFGSDKGVF

SEQ ID NO: 80082 - protein, 10 aa, Homo Sapiens
RKFIEAAQRY

SEQ ID NO: 80083 - protein, 10 aa, Homo Sapiens
RKFKEAERLF

SEQ ID NO: 80084 - protein, 10 aa, Homo Sapiens
RKFKQVAEAY

SEQ ID NO: 80085 - protein, 10 aa, Homo Sapiens
RKFLESTDSF

SEQ ID NO: 80086 - protein, 10 aa, Homo Sapiens
RKFPAGKVPA

SEQ ID NO: 80087 - protein, 10 aa, Homo Sapiens
RKFQEQNETF

SEQ ID NO: 80088 - protein, 10 aa, Homo Sapiens
RKFRHDKRVY

SEQ ID NO: 80089 - protein, 10 aa, Homo Sapiens
RKFSENPHVY

SEQ ID NO: 80090 - protein, 10 aa, Homo Sapiens
RKGINTLVTY

SEQ ID NO: 80091 - protein, 10 aa, Homo Sapiens
RKHQINIEKY

SEQ ID NO: 80092 - protein, 10 aa, Homo Sapiens
RKIAVAKQNY

SEQ ID NO: 80093 - protein, 10 aa, Homo Sapiens
RKIDAAKNTF

SEQ ID NO: 80094 - protein, 10 aa, Homo Sapiens
RKIDEQNKEF

SEQ ID NO: 80095 - protein, 10 aa, Homo Sapiens
RKIEAEIVRI

SEQ ID NO: 80096 - protein, 10 aa, Homo Sapiens
RKIEDNEFHY

SEQ ID NO: 80097 - protein, 10 aa, Homo Sapiens
RKIETFLNHY

SEQ ID NO: 80098 - protein, 10 aa, Homo Sapiens
RKIFPSVIKY

SEQ ID NO: 80099 - protein, 10 aa, Homo Sapiens
RKIFTSSSNF

SEQ ID NO: 80100 - protein, 10 aa, Homo Sapiens
RKIGDTSVSY

SEQ ID NO: 80101 - protein, 10 aa, Homo Sapiens
RKILATGENY

SEQ ID NO: 80102 - protein, 10 aa, Homo Sapiens
RKILEAQETF

SEQ ID NO: 80103 - protein, 10 aa, Homo Sapiens
RKIPGVPIMY

SEQ ID NO: 80104 - protein, 10 aa, Homo Sapiens
RKIPVPANRY

SEQ ID NO: 80105 - protein, 10 aa, Homo Sapiens
RKISGLKTSM

SEQ ID NO: 80106 - protein, 10 aa, Homo Sapiens
RKKINSTTLY

SEQ ID NO: 80107 - protein, 10 aa, Homo Sapiens
RKKLPVDSVF

SEQ ID NO: 80108 - protein, 10 aa, Homo Sapiens
RKKLYYDTDY

SEQ ID NO: 80109 - protein, 10 aa, Homo Sapiens
RKKPGLAITF

SEQ ID NO: 80110 - protein, 10 aa, Homo Sapiens
RKKQSDVMRF

SEQ ID NO: 80111 - protein, 10 aa, Homo Sapiens
RKLDEMTASY

SEQ ID NO: 80112 - protein, 10 aa, Homo Sapiens
RKLDFPSASF

SEQ ID NO: 80113 - protein, 10 aa, Homo Sapiens
RKLFGFTERY

SEQ ID NO: 80114 - protein, 10 aa, Homo Sapiens
RKLFIGGLSF

SEQ ID NO: 80115 - protein, 10 aa, Homo Sapiens
RKLPEKTQTF

SEQ ID NO: 80116 - protein, 10 aa, Homo Sapiens
RKLSTFRESF

SEQ ID NO: 80117 - protein, 10 aa, Homo Sapiens
RKLVTTSETY

SEQ ID NO: 80118 - protein, 10 aa, Homo Sapiens
RKMEHDGSLF

SEQ ID NO: 80119 - protein, 10 aa, Homo Sapiens
RKNPAERMSY

SEQ ID NO: 80120 - protein, 10 aa, Homo Sapiens
RKNPEFRVQF

SEQ ID NO: 80121 - protein, 10 aa, Homo Sapiens
RKNPQHKIEY

SEQ ID NO: 80122 - protein, 10 aa, Homo Sapiens
RKNPVQEQTY

SEQ ID NO: 80123 - protein, 10 aa, Homo Sapiens
RKPDEDMKLY

SEQ ID NO: 80124 - protein, 10 aa, Homo Sapiens
RKPDFRNPLY

SEQ ID NO: 80125 - protein, 10 aa, Homo Sapiens
RKPDQVFQSY

SEQ ID NO: 80126 - protein, 10 aa, Homo Sapiens
RKPPAPKSTY

SEQ ID NO: 80127 - protein, 10 aa, Homo Sapiens
RKPQSSLLRY

SEQ ID NO: 80128 - protein, 10 aa, Homo Sapiens
RKPSEEFNGY

SEQ ID NO: 80129 - protein, 10 aa, Homo Sapiens
RKPTVTHVHY

SEQ ID NO: 80130 - protein, 10 aa, Homo Sapiens
RKQDYEQAVF

SEQ ID NO: 80131 - protein, 10 aa, Homo Sapiens
RKREEIPLDF

SEQ ID NO: 80132 - protein, 10 aa, Homo Sapiens
RKRYDAATTY

SEQ ID NO: 80133 - protein, 10 aa, Homo Sapiens
RKTEYISTEF

SEQ ID NO: 80134 - protein, 10 aa, Homo Sapiens
RKVATEFESF

SEQ ID NO: 80135 - protein, 10 aa, Homo Sapiens
RKVDVEEEFF

SEQ ID NO: 80136 - protein, 10 aa, Homo Sapiens
RKVEDLFLTF

SEQ ID NO: 80137 - protein, 10 aa, Homo Sapiens
RKVEQLQQEY

SEQ ID NO: 80138 - protein, 10 aa, Homo Sapiens
RKVKFTQQNY

SEQ ID NO: 80139 - protein, 10 aa, Homo Sapiens
RKVKNSQSFF

SEQ ID NO: 80140 - protein, 10 aa, Homo Sapiens
RKVLPLEEAY

SEQ ID NO: 80141 - protein, 10 aa, Homo Sapiens
RKVLVKVDEY

SEQ ID NO: 80142 - protein, 10 aa, Homo Sapiens
RKVQPPQQNY

SEQ ID NO: 80143 - protein, 10 aa, Homo Sapiens
RKVWAEAVHY

SEQ ID NO: 80144 - protein, 10 aa, Homo Sapiens
RKWDDDYVRY

SEQ ID NO: 80145 - protein, 10 aa, Homo Sapiens
RKYDAKFTDF

SEQ ID NO: 80146 - protein, 10 aa, Homo Sapiens
RKYEAFLQRY

SEQ ID NO: 80147 - protein, 10 aa, Homo Sapiens
RKYEAIQLTF

SEQ ID NO: 80148 - protein, 10 aa, Homo Sapiens
RKYHKLGTGF

SEQ ID NO: 80149 - protein, 10 aa, Homo Sapiens
RKYIGYARQY

SEQ ID NO: 80150 - protein, 10 aa, Homo Sapiens
RKYPEAAACY

SEQ ID NO: 80151 - protein, 10 aa, Homo Sapiens
RLRDENGRPY

SEQ ID NO: 80152 - protein, 10 aa, Homo Sapiens
RLYGKDYNVY

SEQ ID NO: 80153 - protein, 10 aa, Homo Sapiens
RLYGPSSVSF

SEQ ID NO: 80154 - protein, 10 aa, Homo Sapiens
RLYTQGYISY

SEQ ID NO: 80155 - protein, 10 aa, Homo Sapiens
RMKTGNKIRY

SEQ ID NO: 80156 - protein, 10 aa, Homo Sapiens
RQAGLSYIRY

SEQ ID NO: 80157 - protein, 10 aa, Homo Sapiens
RQAPVLLQTY

SEQ ID NO: 80158 - protein, 10 aa, Homo Sapiens
RQATSTASTF

SEQ ID NO: 80159 - protein, 10 aa, Homo Sapiens
RQFCSKLGKY

SEQ ID NO: 80160 - protein, 10 aa, Homo Sapiens
RQFWFQGNRY

SEQ ID NO: 80161 - protein, 10 aa, Homo Sapiens
RQHPHCYVQY

SEQ ID NO: 80162 - protein, 10 aa, Homo Sapiens
RQHSIYKNGY

SEQ ID NO: 80163 - protein, 10 aa, Homo Sapiens
RQICPSLAGF

SEQ ID NO: 80164 - protein, 10 aa, Homo Sapiens
RQIDLVDNYF

SEQ ID NO: 80165 - protein, 10 aa, Homo Sapiens
RQIPYTMMKF

SEQ ID NO: 80166 - protein, 10 aa, Homo Sapiens
RQKQGVVLKY

SEQ ID NO: 80167 - protein, 10 aa, Homo Sapiens
RQLEDILSTY

SEQ ID NO: 80168 - protein, 10 aa, Homo Sapiens
RQLEEEGITF

SEQ ID NO: 80169 - protein, 10 aa, Homo Sapiens
RQLGLEHTRY

SEQ ID NO: 80170 - protein, 10 aa, Homo Sapiens
RQLPEPLISF

SEQ ID NO: 80171 - protein, 10 aa, Homo Sapiens
RQLSFTGVTF

SEQ ID NO: 80172 - protein, 10 aa, Homo Sapiens
RQPDSPTALY

SEQ ID NO: 80173 - protein, 10 aa, Homo Sapiens
RQQEERKRLY

SEQ ID NO: 80174 - protein, 10 aa, Homo Sapiens
RQQPPSTTTF

SEQ ID NO: 80175 - protein, 10 aa, Homo Sapiens
RQREEQLVSF

SEQ ID NO: 80176 - protein, 10 aa, Homo Sapiens
RQRQEVCQSY

SEQ ID NO: 80177 - protein, 10 aa, Homo Sapiens
RQVEDLQATF

SEQ ID NO: 80178 - protein, 10 aa, Homo Sapiens
RQYDGIFYEF

SEQ ID NO: 80179 - protein, 10 aa, Homo Sapiens
RQYDKFLTHF

SEQ ID NO: 80180 - protein, 10 aa, Homo Sapiens
RQYEGHVNEY

SEQ ID NO: 80181 - protein, 10 aa, Homo Sapiens
RQYGQTVATY

SEQ ID NO: 80182 - protein, 10 aa, Homo Sapiens
RQYHLQQLFY

SEQ ID NO: 80183 - protein, 10 aa, Homo Sapiens
RQYNRDWQSY

SEQ ID NO: 80184 - protein, 10 aa, Homo Sapiens
RQYPWGTVQV

SEQ ID NO: 80185 - protein, 10 aa, Homo Sapiens
RQYPWGVVQV

SEQ ID NO: 80186 - protein, 10 aa, Homo Sapiens
RVYPERSTSY

SEQ ID NO: 80187 - protein, 10 aa, Homo Sapiens
SGSQFEFTQF

SEQ ID NO: 80188 - protein, 10 aa, Homo Sapiens
SGSQRISSIY

SEQ ID NO: 80189 - protein, 10 aa, Homo Sapiens
SKAFPFYSSY

SEQ ID NO: 80190 - protein, 10 aa, Homo Sapiens
SKFLAPYTTF

SEQ ID NO: 80191 - protein, 10 aa, Homo Sapiens
SKHPGHYAVY

SEQ ID NO: 80192 - protein, 10 aa, Homo Sapiens
SKIETRGTRY

SEQ ID NO: 80193 - protein, 10 aa, Homo Sapiens
SKINHEPTTF

SEQ ID NO: 80194 - protein, 10 aa, Homo Sapiens
SKIYPSREEY

SEQ ID NO: 80195 - protein, 10 aa, Homo Sapiens
SKLEHTAQTY

SEQ ID NO: 80196 - protein, 10 aa, Homo Sapiens
SKMDPTDAKY

SEQ ID NO: 80197 - protein, 10 aa, Homo Sapiens
SKPAYGNSPY

SEQ ID NO: 80198 - protein, 10 aa, Homo Sapiens
SKPRNVPAAY

SEQ ID NO: 80199 - protein, 10 aa, Homo Sapiens
SKRLESGVQF

SEQ ID NO: 80200 - protein, 10 aa, Homo Sapiens
SKTGSVTTTY

SEQ ID NO: 80201 - protein, 10 aa, Homo Sapiens
SKVRALKTAY

SEQ ID NO: 80202 - protein, 10 aa, Homo Sapiens
SKYAADRNHY

SEQ ID NO: 80203 - protein, 10 aa, Homo Sapiens
SKYGRDWERY

SEQ ID NO: 80204 - protein, 10 aa, Homo Sapiens
SKYPASSSVF

SEQ ID NO: 80205 - protein, 10 aa, Homo Sapiens
SKYVSLITSY

SEQ ID NO: 80206 - protein, 10 aa, Homo Sapiens
SQFHGLITHY

SEQ ID NO: 80207 - protein, 10 aa, Homo Sapiens
SQHAKYTCSF

SEQ ID NO: 80208 - protein, 10 aa, Homo Sapiens
SQHIGTGNLY

SEQ ID NO: 80209 - protein, 10 aa, Homo Sapiens
SQQPASGVAY

SEQ ID NO: 80210 - protein, 10 aa, Homo Sapiens
SQRDPPHNNF

SEQ ID NO: 80211 - protein, 10 aa, Homo Sapiens
SQRPPTRETF

SEQ ID NO: 80212 - protein, 10 aa, Homo Sapiens
SQYNIRGVTY

SEQ ID NO: 80213 - protein, 10 aa, Homo Sapiens
SQYPFPVTLY

SEQ ID NO: 80214 - protein, 10 aa, Homo Sapiens
SQYPGGQPTY

SEQ ID NO: 80215 - protein, 10 aa, Homo Sapiens
SQYPNQPTRF

SEQ ID NO: 80216 - protein, 10 aa, Homo Sapiens
SSQFGGGSQY

SEQ ID NO: 80217 - protein, 10 aa, Homo Sapiens
STINPDHLSY

SEQ ID NO: 80218 - protein, 10 aa, Homo Sapiens
TKFSQDFSTF

SEQ ID NO: 80219 - protein, 10 aa, Homo Sapiens
TKIKTIGSTY

SEQ ID NO: 80220 - protein, 10 aa, Homo Sapiens
TKLKNTLIQY

SEQ ID NO: 80221 - protein, 10 aa, Homo Sapiens
TKLQAQHVSY

SEQ ID NO: 80222 - protein, 10 aa, Homo Sapiens
TKRPGLMTKY

SEQ ID NO: 80223 - protein, 10 aa, Homo Sapiens
TKWPGDILAY

SEQ ID NO: 80224 - protein, 10 aa, Homo Sapiens
TPICPHSLSF

SEQ ID NO: 80225 - protein, 10 aa, Homo Sapiens
TTAPTHVLAM

SEQ ID NO: 80226 - protein, 10 aa, Homo Sapiens
VHAPPMQLGF

SEQ ID NO: 80227 - protein, 10 aa, Homo Sapiens
VKEKATGRYY

SEQ ID NO: 80228 - protein, 10 aa, Homo Sapiens
VKFGGQLLSF

SEQ ID NO: 80229 - protein, 10 aa, Homo Sapiens
VKIINDNATY

SEQ ID NO: 80230 - protein, 10 aa, Homo Sapiens
VKVLITSQGY

SEQ ID NO: 80231 - protein, 10 aa, Homo Sapiens
VKVNIIQEEY

SEQ ID NO: 80232 - protein, 10 aa, Homo Sapiens
VKVPTTLAEY

SEQ ID NO: 80233 - protein, 10 aa, Homo Sapiens
VKYNGPESQY

SEQ ID NO: 80234 - protein, 10 aa, Homo Sapiens
VLSAADKGNV

SEQ ID NO: 80235 - protein, 10 aa, Homo Sapiens
VMFPGNSPSY

SEQ ID NO: 80236 - protein, 10 aa, Homo Sapiens
VQADVQKERY

SEQ ID NO: 80237 - protein, 10 aa, Homo Sapiens
VQFDGTNSAF

SEQ ID NO: 80238 - protein, 10 aa, Homo Sapiens
VQFGANKSQY

SEQ ID NO: 80239 - protein, 10 aa, Homo Sapiens
VQFIGRESKY

SEQ ID NO: 80240 - protein, 10 aa, Homo Sapiens
VQRGGTPSAF

SEQ ID NO: 80241 - protein, 10 aa, Homo Sapiens
VQRLPVGAAF

SEQ ID NO: 80242 - protein, 10 aa, Homo Sapiens
VQVDDIKRVY

SEQ ID NO: 80243 - protein, 10 aa, Homo Sapiens
VQVTPLSSGY

SEQ ID NO: 80244 - protein, 10 aa, Homo Sapiens
VVGEHKDKVI

SEQ ID NO: 80245 - protein, 10 aa, Homo Sapiens
YAKLNPGIAY

SEQ ID NO: 80246 - protein, 10 aa, Homo Sapiens
YGSKPLNIAY

SEQ ID NO: 80247 - protein, 10 aa, Homo Sapiens
YKAKQGYVIY

SEQ ID NO: 80248 - protein, 10 aa, Homo Sapiens
YKAKYPIVGY

SEQ ID NO: 80249 - protein, 10 aa, Homo Sapiens
YKALLPQQSY

SEQ ID NO: 80250 - protein, 10 aa, Homo Sapiens
YKASSEMALY

SEQ ID NO: 80251 - protein, 10 aa, Homo Sapiens
YKFEEHGKAF

SEQ ID NO: 80252 - protein, 10 aa, Homo Sapiens
YKFYSVNVDY

SEQ ID NO: 80253 - protein, 10 aa, Homo Sapiens
YKHFNRHGKF

SEQ ID NO: 80254 - protein, 10 aa, Homo Sapiens
YKIDEDGKKF

SEQ ID NO: 80255 - protein, 10 aa, Homo Sapiens
YKIKTLIKKY

SEQ ID NO: 80256 - protein, 10 aa, Homo Sapiens
YKIKYPENFF

SEQ ID NO: 80257 - protein, 10 aa, Homo Sapiens
YKKGENPVSY

SEQ ID NO: 80258 - protein, 10 aa, Homo Sapiens
YKRPQELETF

SEQ ID NO: 80259 - protein, 10 aa, Homo Sapiens
YKVETVGDKY

SEQ ID NO: 80260 - protein, 10 aa, Homo Sapiens
YKVFVVGESY

SEQ ID NO: 80261 - protein, 10 aa, Homo Sapiens
YKVPDGMVGF

SEQ ID NO: 80262 - protein, 10 aa, Homo Sapiens
YKVSEYARRF

SEQ ID NO: 80263 - protein, 10 aa, Homo Sapiens
YKYEAPWTVY

SEQ ID NO: 80264 - protein, 10 aa, Homo Sapiens
YKYEGVRGLY

SEQ ID NO: 80265 - protein, 10 aa, Homo Sapiens
YKYTDKIMTY

SEQ ID NO: 80266 - protein, 10 aa, Homo Sapiens
YMIDPSGVSY

SEQ ID NO: 80267 - protein, 10 aa, Homo Sapiens
YMIERPEPEF

SEQ ID NO: 80268 - protein, 10 aa, Homo Sapiens
YQHDDGRVSY

SEQ ID NO: 80269 - protein, 10 aa, Homo Sapiens
YQYSDQGIDY

SEQ ID NO: 80270 - protein, 11 aa, Homo Sapiens
AGGYFTSPGGY

SEQ ID NO: 80271 - protein, 11 aa, Homo Sapiens
AGSKQLFMTAY

SEQ ID NO: 80272 - protein, 11 aa, Homo Sapiens
AKAAEAAASAY

SEQ ID NO: 80273 - protein, 11 aa, Homo Sapiens
AKAGTEEAIVY

SEQ ID NO: 80274 - protein, 11 aa, Homo Sapiens
AKASLNGADIY

SEQ ID NO: 80275 - protein, 11 aa, Homo Sapiens
AKFLDPITGTF

SEQ ID NO: 80276 - protein, 11 aa, Homo Sapiens
AKFRENVEDVF

SEQ ID NO: 80277 - protein, 11 aa, Homo Sapiens
AKFSPVATASY

SEQ ID NO: 80278 - protein, 11 aa, Homo Sapiens
AKIENVQKTGF

SEQ ID NO: 80279 - protein, 11 aa, Homo Sapiens
AKILADQQDKY

SEQ ID NO: 80280 - protein, 11 aa, Homo Sapiens
AKINFDSNSAY

SEQ ID NO: 80281 - protein, 11 aa, Homo Sapiens
AKIPVTIITGY

SEQ ID NO: 80282 - protein, 11 aa, Homo Sapiens
AKIYQQNPEAY

SEQ ID NO: 80283 - protein, 11 aa, Homo Sapiens
AKKSEASGFCY

SEQ ID NO: 80284 - protein, 11 aa, Homo Sapiens
AKLDHVNIVHY

SEQ ID NO: 80285 - protein, 11 aa, Homo Sapiens
AKLFPGSPAIY

SEQ ID NO: 80286 - protein, 11 aa, Homo Sapiens
AKLPSRPADNY

SEQ ID NO: 80287 - protein, 11 aa, Homo Sapiens
AKLVSEKLASY

SEQ ID NO: 80288 - protein, 11 aa, Homo Sapiens
AKMDPSCTVGF

SEQ ID NO: 80289 - protein, 11 aa, Homo Sapiens
AKNPSWASITY

SEQ ID NO: 80290 - protein, 11 aa, Homo Sapiens
AKRDVPALDRY

SEQ ID NO: 80291 - protein, 11 aa, Homo Sapiens
AKRGAFGHERY

SEQ ID NO: 80292 - protein, 11 aa, Homo Sapiens
AKVINDGLFYY

SEQ ID NO: 80293 - protein, 11 aa, Homo Sapiens
AKWNPTAGVAF

SEQ ID NO: 80294 - protein, 11 aa, Homo Sapiens
AKYATGENTVF

SEQ ID NO: 80295 - protein, 11 aa, Homo Sapiens
AKYLPHSAGRY

SEQ ID NO: 80296 - protein, 11 aa, Homo Sapiens
AKYPASTVQIL

SEQ ID NO: 80297 - protein, 11 aa, Homo Sapiens
AKYQIDPDACF

SEQ ID NO: 80298 - protein, 11 aa, Homo Sapiens
AKYVQGDAIGY

SEQ ID NO: 80299 - protein, 11 aa, Homo Sapiens
AQCSHAAVSAY

SEQ ID NO: 80300 - protein, 11 aa, Homo Sapiens
AQFGHTSIVAY

SEQ ID NO: 80301 - protein, 11 aa, Homo Sapiens
AQFPGACGLRY

SEQ ID NO: 80302 - protein, 11 aa, Homo Sapiens
AQYAQRASVAF

SEQ ID NO: 80303 - protein, 11 aa, Homo Sapiens
AQYLPKEQYLY

SEQ ID NO: 80304 - protein, 11 aa, Homo Sapiens
AQYSQDYQQFY

SEQ ID NO: 80305 - protein, 11 aa, Homo Sapiens
FKINQKEGISY

SEQ ID NO: 80306 - protein, 11 aa, Homo Sapiens
FKPDFGAESIY

SEQ ID NO: 80307 - protein, 11 aa, Homo Sapiens
FKRDLEWVERL

SEQ ID NO: 80308 - protein, 11 aa, Homo Sapiens
FKYDDAERRFY

SEQ ID NO: 80309 - protein, 11 aa, Homo Sapiens
GHFGPINSVAF

SEQ ID NO: 80310 - protein, 11 aa, Homo Sapiens
GHYLGEFSITY

SEQ ID NO: 80311 - protein, 11 aa, Homo Sapiens
GKFDQIYDVGY

SEQ ID NO: 80312 - protein, 11 aa, Homo Sapiens
GKFHYKKEGTY

SEQ ID NO: 80313 - protein, 11 aa, Homo Sapiens
GKFNPHVHVEY

SEQ ID NO: 80314 - protein, 11 aa, Homo Sapiens
GKFYPELKLAY

SEQ ID NO: 80315 - protein, 11 aa, Homo Sapiens
GKHFSHAGALF

SEQ ID NO: 80316 - protein, 11 aa, Homo Sapiens
GKHQPHKVTQY

SEQ ID NO: 80317 - protein, 11 aa, Homo Sapiens
GKIGGAQNRSY

SEQ ID NO: 80318 - protein, 11 aa, Homo Sapiens
GKIPSPLSSSY

SEQ ID NO: 80319 - protein, 11 aa, Homo Sapiens
GKISETTARTY

SEQ ID NO: 80320 - protein, 11 aa, Homo Sapiens
GKLDQPDRFSF

SEQ ID NO: 80321 - protein, 11 aa, Homo Sapiens
GKLGNESVTFY

SEQ ID NO: 80322 - protein, 11 aa, Homo Sapiens
GKLKDPANFQY

SEQ ID NO: 80323 - protein, 11 aa, Homo Sapiens
GKLPNFGFVVF

SEQ ID NO: 80324 - protein, 11 aa, Homo Sapiens
GKPYVAMVTTY

SEQ ID NO: 80325 - protein, 11 aa, Homo Sapiens
GKSKGFGFVSF

SEQ ID NO: 80326 - protein, 11 aa, Homo Sapiens
GKVGNVGQTNY

SEQ ID NO: 80327 - protein, 11 aa, Homo Sapiens
GKVRAVIGSTY

SEQ ID NO: 80328 - protein, 11 aa, Homo Sapiens
GKYAERDIVQF

SEQ ID NO: 80329 - protein, 11 aa, Homo Sapiens
GKYENNYNAVF

SEQ ID NO: 80330 - protein, 11 aa, Homo Sapiens
GKYFSLIPTGF

SEQ ID NO: 80331 - protein, 11 aa, Homo Sapiens
GKYGFSDPLTF

SEQ ID NO: 80332 - protein, 11 aa, Homo Sapiens
GKYKDNEAIEF

SEQ ID NO: 80333 - protein, 11 aa, Homo Sapiens
GKYLGINKELY

SEQ ID NO: 80334 - protein, 11 aa, Homo Sapiens
GQFYDNKGITY

SEQ ID NO: 80335 - protein, 11 aa, Homo Sapiens
GQHRSTIITLY

SEQ ID NO: 80336 - protein, 11 aa, Homo Sapiens
GQIKTVYPASY

SEQ ID NO: 80337 - protein, 11 aa, Homo Sapiens
GQYSPPPYSEY

SEQ ID NO: 80338 - protein, 11 aa, Homo Sapiens
GRSKGFGFVCF

SEQ ID NO: 80339 - protein, 11 aa, Homo Sapiens
GRSKGYGFITF

SEQ ID NO: 80340 - protein, 11 aa, Homo Sapiens
HKYSGKEGDKF

SEQ ID NO: 80341 - protein, 11 aa, Homo Sapiens
HQYNPKFQTLF

SEQ ID NO: 80342 - protein, 11 aa, Homo Sapiens
HYLKGLKIEKM

SEQ ID NO: 80343 - protein, 11 aa, Homo Sapiens
IKHSTPSPTKY

SEQ ID NO: 80344 - protein, 11 aa, Homo Sapiens
IKHSTPSPTRY

SEQ ID NO: 80345 - protein, 11 aa, Homo Sapiens
IKLDPHNHVLY

SEQ ID NO: 80346 - protein, 11 aa, Homo Sapiens
IMFDVTSRVTY

SEQ ID NO: 80347 - protein, 11 aa, Homo Sapiens
IQWHQDSGCLY

SEQ ID NO: 80348 - protein, 11 aa, Homo Sapiens
KKADVDAIHEY

SEQ ID NO: 80349 - protein, 11 aa, Homo Sapiens
KKFLPGMAIGY

SEQ ID NO: 80350 - protein, 11 aa, Homo Sapiens
KKFNEPGSQYF

SEQ ID NO: 80351 - protein, 11 aa, Homo Sapiens
KKFSDSVKSTF

SEQ ID NO: 80352 - protein, 11 aa, Homo Sapiens
KKFSNPYSIEY

SEQ ID NO: 80353 - protein, 11 aa, Homo Sapiens
KKFVETPGQKY

SEQ ID NO: 80354 - protein, 11 aa, Homo Sapiens
KKFWPNPCSTF

SEQ ID NO: 80355 - protein, 11 aa, Homo Sapiens
KKIEDNNTLVF

SEQ ID NO: 80356 - protein, 11 aa, Homo Sapiens
KKIEISQHAKY

SEQ ID NO: 80357 - protein, 11 aa, Homo Sapiens
KKILQKGQTAY

SEQ ID NO: 80358 - protein, 11 aa, Homo Sapiens
KKIYDREQTRY

SEQ ID NO: 80359 - protein, 11 aa, Homo Sapiens
KKLGQSIESSY

SEQ ID NO: 80360 - protein, 11 aa, Homo Sapiens
KKLSEPSSLQY

SEQ ID NO: 80361 - protein, 11 aa, Homo Sapiens
KKPITTGGVTY

SEQ ID NO: 80362 - protein, 11 aa, Homo Sapiens
KKPKNENPVDY

SEQ ID NO: 80363 - protein, 11 aa, Homo Sapiens
KKRFTEEATKY

SEQ ID NO: 80364 - protein, 11 aa, Homo Sapiens
KKRPETVATQF

SEQ ID NO: 80365 - protein, 11 aa, Homo Sapiens
KKYDGRTKPIP

SEQ ID NO: 80366 - protein, 11 aa, Homo Sapiens
KKYEDICPSTH

SEQ ID NO: 80367 - protein, 11 aa, Homo Sapiens
KKYLTEGLLQF

SEQ ID NO: 80368 - protein, 11 aa, Homo Sapiens
KKYPFILEVYY

SEQ ID NO: 80369 - protein, 11 aa, Homo Sapiens
KKYYPTAEEVY

SEQ ID NO: 80370 - protein, 11 aa, Homo Sapiens
KMYSTDDGVQF

SEQ ID NO: 80371 - protein, 11 aa, Homo Sapiens
KQAEWSSKTSY

SEQ ID NO: 80372 - protein, 11 aa, Homo Sapiens
KQIDNTGSSTY

SEQ ID NO: 80373 - protein, 11 aa, Homo Sapiens
KQRPIFIITEY

SEQ ID NO: 80374 - protein, 11 aa, Homo Sapiens
LKFPHSAHQKY

SEQ ID NO: 80375 - protein, 11 aa, Homo Sapiens
LKIEPEEPITF

SEQ ID NO: 80376 - protein, 11 aa, Homo Sapiens
LKYDAQDKALY

SEQ ID NO: 80377 - protein, 11 aa, Homo Sapiens
LQHDFGHLSVF

SEQ ID NO: 80378 - protein, 11 aa, Homo Sapiens
LQHDYGHLSVY

SEQ ID NO: 80379 - protein, 11 aa, Homo Sapiens
LQWSPTENTVF

SEQ ID NO: 80380 - protein, 11 aa, Homo Sapiens
LQYLSQGNVVF

SEQ ID NO: 80381 - protein, 11 aa, Homo Sapiens
MKFKPNQTRTY

SEQ ID NO: 80382 - protein, 11 aa, Homo Sapiens
MKYNARDTVFY

SEQ ID NO: 80383 - protein, 11 aa, Homo Sapiens
QKIQDAQDKLY

SEQ ID NO: 80384 - protein, 11 aa, Homo Sapiens
QPSSQYRIKEY

SEQ ID NO: 80385 - protein, 11 aa, Homo Sapiens
QQLDPEQKITY

SEQ ID NO: 80386 - protein, 11 aa, Homo Sapiens
RAFDQGADAIY

SEQ ID NO: 80387 - protein, 11 aa, Homo Sapiens
RHAECLKALGY

SEQ ID NO: 80388 - protein, 11 aa, Homo Sapiens
RKAAITIQSSY

SEQ ID NO: 80389 - protein, 11 aa, Homo Sapiens
RKAPQHTAVGF

SEQ ID NO: 80390 - protein, 11 aa, Homo Sapiens
RKEQETALRVY

SEQ ID NO: 80391 - protein, 11 aa, Homo Sapiens
RKFGEAIGMGF

SEQ ID NO: 80392 - protein, 11 aa, Homo Sapiens
RKFPAGKVPAF

SEQ ID NO: 80393 - protein, 11 aa, Homo Sapiens
RKFPGRPEEEY

SEQ ID NO: 80394 - protein, 11 aa, Homo Sapiens
RKFPVPKPIDY

SEQ ID NO: 80395 - protein, 11 aa, Homo Sapiens
RKFQPYKPFYY

SEQ ID NO: 80396 - protein, 11 aa, Homo Sapiens
RKHGGEKGVPF

SEQ ID NO: 80397 - protein, 11 aa, Homo Sapiens
RKHGVVPLATY

SEQ ID NO: 80398 - protein, 11 aa, Homo Sapiens
RKIQEESLRTY

SEQ ID NO: 80399 - protein, 11 aa, Homo Sapiens
RKKAACIAEQY

SEQ ID NO: 80400 - protein, 11 aa, Homo Sapiens
RKKNEELEQLY

SEQ ID NO: 80401 - protein, 11 aa, Homo Sapiens
RKLDPPGGQFY

SEQ ID NO: 80402 - protein, 11 aa, Homo Sapiens
RKLDRSVFTAY

SEQ ID NO: 80403 - protein, 11 aa, Homo Sapiens
RKLEAAEDIAY

SEQ ID NO: 80404 - protein, 11 aa, Homo Sapiens
RKLQDVFEFRY

SEQ ID NO: 80405 - protein, 11 aa, Homo Sapiens
RKLTDDELFQY

SEQ ID NO: 80406 - protein, 11 aa, Homo Sapiens
RKLTSNLRIGF

SEQ ID NO: 80407 - protein, 11 aa, Homo Sapiens
RKMDVSKITRY

SEQ ID NO: 80408 - protein, 11 aa, Homo Sapiens
RKMNVSPDVNY

SEQ ID NO: 80409 - protein, 11 aa, Homo Sapiens
RKQEEERGRVY

SEQ ID NO: 80410 - protein, 11 aa, Homo Sapiens
RKRDFELAQAY

SEQ ID NO: 80411 - protein, 11 aa, Homo Sapiens
RKRGWDENVYY

SEQ ID NO: 80412 - protein, 11 aa, Homo Sapiens
RKRPVPKGATY

SEQ ID NO: 80413 - protein, 11 aa, Homo Sapiens
RKTGQAPGYSY

SEQ ID NO: 80414 - protein, 11 aa, Homo Sapiens
RKTVTAMDVVY

SEQ ID NO: 80415 - protein, 11 aa, Homo Sapiens
RKVDPEALQVF

SEQ ID NO: 80416 - protein, 11 aa, Homo Sapiens
RKVDPMAIVVF

SEQ ID NO: 80417 - protein, 11 aa, Homo Sapiens
RKWAPPKFLPH

SEQ ID NO: 80418 - protein, 11 aa, Homo Sapiens
RKWQQLQAKRY

SEQ ID NO: 80419 - protein, 11 aa, Homo Sapiens
RKYGNANVWKY

SEQ ID NO: 80420 - protein, 11 aa, Homo Sapiens
RKYGSVTVWRY

SEQ ID NO: 80421 - protein, 11 aa, Homo Sapiens
RMKETQKSIYY

SEQ ID NO: 80422 - protein, 11 aa, Homo Sapiens
RMNPNSPSITY

SEQ ID NO: 80423 - protein, 11 aa, Homo Sapiens
RNMQLPNGVTY

SEQ ID NO: 80424 - protein, 11 aa, Homo Sapiens
RQIGVEHVVVY

SEQ ID NO: 80425 - protein, 11 aa, Homo Sapiens
RQRPQMKVNEY

SEQ ID NO: 80426 - protein, 11 aa, Homo Sapiens
RQYGSEGRFTF

SEQ ID NO: 80427 - protein, 11 aa, Homo Sapiens
RQYSRNEPLTF

SEQ ID NO: 80428 - protein, 11 aa, Homo Sapiens
SGPSIVHRKCF

SEQ ID NO: 80429 - protein, 11 aa, Homo Sapiens
SKFDEQRTATY

SEQ ID NO: 80430 - protein, 11 aa, Homo Sapiens
SKFQPQSPDFL

SEQ ID NO: 80431 - protein, 11 aa, Homo Sapiens
SKIHFISPNIY

SEQ ID NO: 80432 - protein, 11 aa, Homo Sapiens
SKLPGSIQHVY

SEQ ID NO: 80433 - protein, 11 aa, Homo Sapiens
SKRPPSVGDVF

SEQ ID NO: 80434 - protein, 11 aa, Homo Sapiens
SKYAPAEGNRY

SEQ ID NO: 80435 - protein, 11 aa, Homo Sapiens
SKYAPEEGNRY

SEQ ID NO: 80436 - protein, 11 aa, Homo Sapiens
SKYDPEEPIYF

SEQ ID NO: 80437 - protein, 11 aa, Homo Sapiens
SKYSNSDVIIY

SEQ ID NO: 80438 - protein, 11 aa, Homo Sapiens
SQRAVTNHSVY

SEQ ID NO: 80439 - protein, 11 aa, Homo Sapiens
THRPVNVVNVY

SEQ ID NO: 80440 - protein, 11 aa, Homo Sapiens
TQFINPETPGY

SEQ ID NO: 80441 - protein, 11 aa, Homo Sapiens
TQFPSTVSTVY

SEQ ID NO: 80442 - protein, 11 aa, Homo Sapiens
VKFDAVSGDYY

SEQ ID NO: 80443 - protein, 11 aa, Homo Sapiens
VKYTPRGAGSY

SEQ ID NO: 80444 - protein, 11 aa, Homo Sapiens
VKYTQSNSVCY

SEQ ID NO: 80445 - protein, 11 aa, Homo Sapiens
VQRVASVMQEY

SEQ ID NO: 80446 - protein, 11 aa, Homo Sapiens
VQYQDPAAVSF

SEQ ID NO: 80447 - protein, 11 aa, Homo Sapiens
VSGSQRISSIY

SEQ ID NO: 80448 - protein, 11 aa, Homo Sapiens
VVSEVDIAKAD

SEQ ID NO: 80449 - protein, 11 aa, Homo Sapiens
YGQTGAGKTYT

SEQ ID NO: 80450 - protein, 11 aa, Homo Sapiens
YKEEGSKVTTY

SEQ ID NO: 80451 - protein, 11 aa, Homo Sapiens
YKFYPPKVELF

SEQ ID NO: 80452 - protein, 11 aa, Homo Sapiens
YKHFEETQHTY

SEQ ID NO: 80453 - protein, 11 aa, Homo Sapiens
YKIYPGHGRRY

SEQ ID NO: 80454 - protein, 11 aa, Homo Sapiens
YKLSLEFPSGY

SEQ ID NO: 80455 - protein, 11 aa, Homo Sapiens
YKYKDFGQMGF

SEQ ID NO: 80456 - protein, 11 aa, Homo Sapiens
YKYLNQTSRSF

SEQ ID NO: 80457 - protein, 11 aa, Homo Sapiens
YLFEPHSGEEY

SEQ ID NO: 80458 - protein, 11 aa, Homo Sapiens
YSLDGRLLSTY

SEQ ID NO: 80459 - protein, 8 aa, Homo Sapiens
AHAKAIEM

SEQ ID NO: 80460 - protein, 8 aa, Homo Sapiens
AHGTSFLL

SEQ ID NO: 80461 - protein, 8 aa, Homo Sapiens
AHHAGPEL

SEQ ID NO: 80462 - protein, 8 aa, Homo Sapiens
AHMPAAAL

SEQ ID NO: 80463 - protein, 8 aa, Homo Sapiens
AHSLSPTL

SEQ ID NO: 80464 - protein, 8 aa, Homo Sapiens
AHVSGAVL

SEQ ID NO: 80465 - protein, 8 aa, Homo Sapiens
AHWKGQVL

SEQ ID NO: 80466 - protein, 8 aa, Homo Sapiens
CHGVSVAL

SEQ ID NO: 80467 - protein, 8 aa, Homo Sapiens
DHCVAHKL

SEQ ID NO: 80468 - protein, 8 aa, Homo Sapiens
DHILKWEL

SEQ ID NO: 80469 - protein, 8 aa, Homo Sapiens
DHLRQTLL

SEQ ID NO: 80470 - protein, 8 aa, Homo Sapiens
DHSQAVTL

SEQ ID NO: 80471 - protein, 8 aa, Homo Sapiens
DHTQAIVL

SEQ ID NO: 80472 - protein, 8 aa, Homo Sapiens
DHTVGFIL

SEQ ID NO: 80473 - protein, 8 aa, Homo Sapiens
DHVTATQL

SEQ ID NO: 80474 - protein, 8 aa, Homo Sapiens
EHGPNPIL

SEQ ID NO: 80475 - protein, 8 aa, Homo Sapiens
EHGSQPEL

SEQ ID NO: 80476 - protein, 8 aa, Homo Sapiens
EHSKPVVL

SEQ ID NO: 80477 - protein, 8 aa, Homo Sapiens
EHVAAAEL

SEQ ID NO: 80478 - protein, 8 aa, Homo Sapiens
EHYVAVQL

SEQ ID NO: 80479 - protein, 8 aa, Homo Sapiens
FEHLAPVL

SEQ ID NO: 80480 - protein, 8 aa, Homo Sapiens
FHAFGRVL

SEQ ID NO: 80481 - protein, 8 aa, Homo Sapiens
FHFQAPTM

SEQ ID NO: 80482 - protein, 8 aa, Homo Sapiens
FHGDCLTL

SEQ ID NO: 80483 - protein, 8 aa, Homo Sapiens
FHHVSAVL

SEQ ID NO: 80484 - protein, 8 aa, Homo Sapiens
FHIQAQKL

SEQ ID NO: 80485 - protein, 8 aa, Homo Sapiens
FHIRAVIL

SEQ ID NO: 80486 - protein, 8 aa, Homo Sapiens
FHLKGRKL

SEQ ID NO: 80487 - protein, 8 aa, Homo Sapiens
FHQLGRKL

SEQ ID NO: 80488 - protein, 8 aa, Homo Sapiens
FHQRGIAL

SEQ ID NO: 80489 - protein, 8 aa, Homo Sapiens
FHSIGLIL

SEQ ID NO: 80490 - protein, 8 aa, Homo Sapiens
FHTGLKLL

SEQ ID NO: 80491 - protein, 8 aa, Homo Sapiens
FQHVGQTL

SEQ ID NO: 80492 - protein, 8 aa, Homo Sapiens
GHEIGRML

SEQ ID NO: 80493 - protein, 8 aa, Homo Sapiens
HAAHQAIL

SEQ ID NO: 80494 - protein, 8 aa, Homo Sapiens
HCSRNPVL

SEQ ID NO: 80495 - protein, 8 aa, Homo Sapiens
HEPEPHIL

SEQ ID NO: 80496 - protein, 8 aa, Homo Sapiens
HFAKSISL

SEQ ID NO: 80497 - protein, 8 aa, Homo Sapiens
HFASSHAL

SEQ ID NO: 80498 - protein, 8 aa, Homo Sapiens
HHAISAKL

SEQ ID NO: 80499 - protein, 8 aa, Homo Sapiens
HHANPILL

SEQ ID NO: 80500 - protein, 8 aa, Homo Sapiens
HHDDPEVL

SEQ ID NO: 80501 - protein, 8 aa, Homo Sapiens
HHDLAPAL

SEQ ID NO: 80502 - protein, 8 aa, Homo Sapiens
HHFEAIAL

SEQ ID NO: 80503 - protein, 8 aa, Homo Sapiens
HHFVAVAL

SEQ ID NO: 80504 - protein, 8 aa, Homo Sapiens
HHFVAVIL

SEQ ID NO: 80505 - protein, 8 aa, Homo Sapiens
HHGISRTL

SEQ ID NO: 80506 - protein, 8 aa, Homo Sapiens
HHGPPAVL

SEQ ID NO: 80507 - protein, 8 aa, Homo Sapiens
HHHLGYSL

SEQ ID NO: 80508 - protein, 8 aa, Homo Sapiens
HHIQGQGL

SEQ ID NO: 80509 - protein, 8 aa, Homo Sapiens
HHIVSIEV

SEQ ID NO: 80510 - protein, 8 aa, Homo Sapiens
HHLIQAVL

SEQ ID NO: 80511 - protein, 8 aa, Homo Sapiens
HHNWPSLL

SEQ ID NO: 80512 - protein, 8 aa, Homo Sapiens
HHSLASSL

SEQ ID NO: 80513 - protein, 8 aa, Homo Sapiens
HHSVGTEL

SEQ ID NO: 80514 - protein, 8 aa, Homo Sapiens
HHTVGLKL

SEQ ID NO: 80515 - protein, 8 aa, Homo Sapiens
HQAVAVIL

SEQ ID NO: 80516 - protein, 8 aa, Homo Sapiens
HQGPARAL

SEQ ID NO: 80517 - protein, 8 aa, Homo Sapiens
HQLRAQIL

SEQ ID NO: 80518 - protein, 8 aa, Homo Sapiens
HSINALLI

SEQ ID NO: 80519 - protein, 8 aa, Homo Sapiens
HVGKTPIV

SEQ ID NO: 80520 - protein, 8 aa, Homo Sapiens
HYSHPPLL

SEQ ID NO: 80521 - protein, 8 aa, Homo Sapiens
IHAAAVLL

SEQ ID NO: 80522 - protein, 8 aa, Homo Sapiens
IHFLDKEL

SEQ ID NO: 80523 - protein, 8 aa, Homo Sapiens
IHGPFLII

SEQ ID NO: 80524 - protein, 8 aa, Homo Sapiens
IHGPFLVI

SEQ ID NO: 80525 - protein, 8 aa, Homo Sapiens
IHGPPLII

SEQ ID NO: 80526 - protein, 8 aa, Homo Sapiens
IHGRAMLL

SEQ ID NO: 80527 - protein, 8 aa, Homo Sapiens
IHHLGNQL

SEQ ID NO: 80528 - protein, 8 aa, Homo Sapiens
IHLPAAVL

SEQ ID NO: 80529 - protein, 8 aa, Homo Sapiens
IHSSSTVL

SEQ ID NO: 80530 - protein, 8 aa, Homo Sapiens
ILEDEKRL

SEQ ID NO: 80531 - protein, 8 aa, Homo Sapiens
IQHPSNVL

SEQ ID NO: 80532 - protein, 8 aa, Homo Sapiens
LHGPQETL

SEQ ID NO: 80533 - protein, 8 aa, Homo Sapiens
LHGWAFTL

SEQ ID NO: 80534 - protein, 8 aa, Homo Sapiens
LHHKGFKL

SEQ ID NO: 80535 - protein, 8 aa, Homo Sapiens
LHITGREL

SEQ ID NO: 80536 - protein, 8 aa, Homo Sapiens
LHSFGKVL

SEQ ID NO: 80537 - protein, 8 aa, Homo Sapiens
LHSNGFSL

SEQ ID NO: 80538 - protein, 8 aa, Homo Sapiens
LHYTSRQL

SEQ ID NO: 80539 - protein, 8 aa, Homo Sapiens
LLYSYERA

SEQ ID NO: 80540 - protein, 8 aa, Homo Sapiens
LSHLALGL

SEQ ID NO: 80541 - protein, 8 aa, Homo Sapiens
MHAGSLLL

SEQ ID NO: 80542 - protein, 8 aa, Homo Sapiens
MHAPGKGL

SEQ ID NO: 80543 - protein, 8 aa, Homo Sapiens
MHAQSAEL

SEQ ID NO: 80544 - protein, 8 aa, Homo Sapiens
MHGFSVTL

SEQ ID NO: 80545 - protein, 8 aa, Homo Sapiens
MHGISQIL

SEQ ID NO: 80546 - protein, 8 aa, Homo Sapiens
MHIKSIIL

SEQ ID NO: 80547 - protein, 8 aa, Homo Sapiens
MHLRQYEL

SEQ ID NO: 80548 - protein, 8 aa, Homo Sapiens
MHTIAAQL

SEQ ID NO: 80549 - protein, 8 aa, Homo Sapiens
MHVPSVAL

SEQ ID NO: 80550 - protein, 8 aa, Homo Sapiens
MQAKGILL

SEQ ID NO: 80551 - protein, 8 aa, Homo Sapiens
MQIFVKTL

SEQ ID NO: 80552 - protein, 8 aa, Homo Sapiens
MQWRALVL

SEQ ID NO: 80553 - protein, 8 aa, Homo Sapiens
MQYPGRSL

SEQ ID NO: 80554 - protein, 8 aa, Homo Sapiens
NHANGLTL

SEQ ID NO: 80555 - protein, 8 aa, Homo Sapiens
NHGITLPL

SEQ ID NO: 80556 - protein, 8 aa, Homo Sapiens
NHGPGMAM

SEQ ID NO: 80557 - protein, 8 aa, Homo Sapiens
NHHSAMVL

SEQ ID NO: 80558 - protein, 8 aa, Homo Sapiens
NHHVAAAL

SEQ ID NO: 80559 - protein, 8 aa, Homo Sapiens
NHVISPLL

SEQ ID NO: 80560 - protein, 8 aa, Homo Sapiens
PYPEPSKL

SEQ ID NO: 80561 - protein, 8 aa, Homo Sapiens
QEKGVRVL

SEQ ID NO: 80562 - protein, 8 aa, Homo Sapiens
QHAVGIVV

SEQ ID NO: 80563 - protein, 8 aa, Homo Sapiens
QHDFPRAL

SEQ ID NO: 80564 - protein, 8 aa, Homo Sapiens
QHEFGRLL

SEQ ID NO: 80565 - protein, 8 aa, Homo Sapiens
QHFLEKVL

SEQ ID NO: 80566 - protein, 8 aa, Homo Sapiens
QHGPDKVL

SEQ ID NO: 80567 - protein, 8 aa, Homo Sapiens
QHGVCSVL

SEQ ID NO: 80568 - protein, 8 aa, Homo Sapiens
QHHTQPVL

SEQ ID NO: 80569 - protein, 8 aa, Homo Sapiens
QHILQQVL

SEQ ID NO: 80570 - protein, 8 aa, Homo Sapiens
QHLKAIDL

SEQ ID NO: 80571 - protein, 8 aa, Homo Sapiens
QHPQAASI

SEQ ID NO: 80572 - protein, 8 aa, Homo Sapiens
QHQGAVEL

SEQ ID NO: 80573 - protein, 8 aa, Homo Sapiens
QHTESMVL

SEQ ID NO: 80574 - protein, 8 aa, Homo Sapiens
QQGPQPTL

SEQ ID NO: 80575 - protein, 8 aa, Homo Sapiens
RHVVAVVL

SEQ ID NO: 80576 - protein, 8 aa, Homo Sapiens
SAHHSISL

SEQ ID NO: 80577 - protein, 8 aa, Homo Sapiens
SHAKGIVL

SEQ ID NO: 80578 - protein, 8 aa, Homo Sapiens
SHAQTVVL

SEQ ID NO: 80579 - protein, 8 aa, Homo Sapiens
SHGPIAVL

SEQ ID NO: 80580 - protein, 8 aa, Homo Sapiens
SHHPSFTL

SEQ ID NO: 80581 - protein, 8 aa, Homo Sapiens
SHIRGLGL

SEQ ID NO: 80582 - protein, 8 aa, Homo Sapiens
SHLLAIGL

SEQ ID NO: 80583 - protein, 8 aa, Homo Sapiens
SHSHSPTL

SEQ ID NO: 80584 - protein, 8 aa, Homo Sapiens
SHVVQRVL

SEQ ID NO: 80585 - protein, 8 aa, Homo Sapiens
SHYGQPVL

SEQ ID NO: 80586 - protein, 8 aa, Homo Sapiens
THAFSRQL

SEQ ID NO: 80587 - protein, 8 aa, Homo Sapiens
THGPPVQL

SEQ ID NO: 80588 - protein, 8 aa, Homo Sapiens
THIDAIIL

SEQ ID NO: 80589 - protein, 8 aa, Homo Sapiens
THILGFEL

SEQ ID NO: 80590 - protein, 8 aa, Homo Sapiens
THLLGVAL

SEQ ID NO: 80591 - protein, 8 aa, Homo Sapiens
THLLQQEL

SEQ ID NO: 80592 - protein, 8 aa, Homo Sapiens
THSLPLLL

SEQ ID NO: 80593 - protein, 8 aa, Homo Sapiens
THSVSAVL

SEQ ID NO: 80594 - protein, 8 aa, Homo Sapiens
VHIGQVIM

SEQ ID NO: 80595 - protein, 8 aa, Homo Sapiens
WHAKPLTL

SEQ ID NO: 80596 - protein, 8 aa, Homo Sapiens
WHGPLLAL

SEQ ID NO: 80597 - protein, 8 aa, Homo Sapiens
WHLRAQDL

SEQ ID NO: 80598 - protein, 8 aa, Homo Sapiens
YHASGAEL

SEQ ID NO: 80599 - protein, 8 aa, Homo Sapiens
YHGAAFQL

SEQ ID NO: 80600 - protein, 8 aa, Homo Sapiens
YHGLTVPL

SEQ ID NO: 80601 - protein, 8 aa, Homo Sapiens
YHGPGYRL

SEQ ID NO: 80602 - protein, 8 aa, Homo Sapiens
YHHVGKLL

SEQ ID NO: 80603 - protein, 8 aa, Homo Sapiens
YHIKPLSL

SEQ ID NO: 80604 - protein, 8 aa, Homo Sapiens
YHKLARKL

SEQ ID NO: 80605 - protein, 8 aa, Homo Sapiens
YHNGDKYL

SEQ ID NO: 80606 - protein, 8 aa, Homo Sapiens
YHQTASIL

SEQ ID NO: 80607 - protein, 8 aa, Homo Sapiens
YPGPAVVL

SEQ ID NO: 80608 - protein, 8 aa, Homo Sapiens
YQAAAPVL

SEQ ID NO: 80609 - protein, 8 aa, Homo Sapiens
YQHTGAVL

SEQ ID NO: 80610 - protein, 9 aa, Homo Sapiens
AHAAQVTCV

SEQ ID NO: 80611 - protein, 9 aa, Homo Sapiens
AHACNPSTL

SEQ ID NO: 80612 - protein, 9 aa, Homo Sapiens
AHAEHGGVL

SEQ ID NO: 80613 - protein, 9 aa, Homo Sapiens
AHAFHQPHV

SEQ ID NO: 80614 - protein, 9 aa, Homo Sapiens
AHAFPQDEL

SEQ ID NO: 80615 - protein, 9 aa, Homo Sapiens
AHAHDAIRL

SEQ ID NO: 80616 - protein, 9 aa, Homo Sapiens
AHAHPQEVY

SEQ ID NO: 80617 - protein, 9 aa, Homo Sapiens
AHAHRVAEL

SEQ ID NO: 80618 - protein, 9 aa, Homo Sapiens
AHAKEMEAL

SEQ ID NO: 80619 - protein, 9 aa, Homo Sapiens
AHAKSSVAL

SEQ ID NO: 80620 - protein, 9 aa, Homo Sapiens
AHAPHPNVM

SEQ ID NO: 80621 - protein, 9 aa, Homo Sapiens
AHAQPQTTM

SEQ ID NO: 80622 - protein, 9 aa, Homo Sapiens
AHAVYQAVL

SEQ ID NO: 80623 - protein, 9 aa, Homo Sapiens
AHCAHVFTT

SEQ ID NO: 80624 - protein, 9 aa, Homo Sapiens
AHCGAGDEL

SEQ ID NO: 80625 - protein, 9 aa, Homo Sapiens
AHCGDPVSL

SEQ ID NO: 80626 - protein, 9 aa, Homo Sapiens
AHCPELVTL

SEQ ID NO: 80627 - protein, 9 aa, Homo Sapiens
AHCPGIKVV

SEQ ID NO: 80628 - protein, 9 aa, Homo Sapiens
AHCPKAEVL

SEQ ID NO: 80629 - protein, 9 aa, Homo Sapiens
AHCWVVVRL

SEQ ID NO: 80630 - protein, 9 aa, Homo Sapiens
AHDDGRWSL

SEQ ID NO: 80631 - protein, 9 aa, Homo Sapiens
AHDDSVMYL

SEQ ID NO: 80632 - protein, 9 aa, Homo Sapiens
AHDLAVRLL

SEQ ID NO: 80633 - protein, 9 aa, Homo Sapiens
AHDPISPVL

SEQ ID NO: 80634 - protein, 9 aa, Homo Sapiens
AHDQAVRTL

SEQ ID NO: 80635 - protein, 9 aa, Homo Sapiens
AHDSAIKAL

SEQ ID NO: 80636 - protein, 9 aa, Homo Sapiens
AHDVDPIEL

SEQ ID NO: 80637 - protein, 9 aa, Homo Sapiens
AHEENVRFI

SEQ ID NO: 80638 - protein, 9 aa, Homo Sapiens
AHEENVRFV

SEQ ID NO: 80639 - protein, 9 aa, Homo Sapiens
AHEIYQKIL

SEQ ID NO: 80640 - protein, 9 aa, Homo Sapiens
AHEVHQKIL

SEQ ID NO: 80641 - protein, 9 aa, Homo Sapiens
AHFAKSISL

SEQ ID NO: 80642 - protein, 9 aa, Homo Sapiens
AHFDGLIFV

SEQ ID NO: 80643 - protein, 9 aa, Homo Sapiens
AHFERSWVL

SEQ ID NO: 80644 - protein, 9 aa, Homo Sapiens
AHFGFDEQL

SEQ ID NO: 80645 - protein, 9 aa, Homo Sapiens
AHFGYHWSL

SEQ ID NO: 80646 - protein, 9 aa, Homo Sapiens
AHFKETLAL

SEQ ID NO: 80647 - protein, 9 aa, Homo Sapiens
AHFPINVVI

SEQ ID NO: 80648 - protein, 9 aa, Homo Sapiens
AHFQKSYTL

SEQ ID NO: 80649 - protein, 9 aa, Homo Sapiens
AHFQQPPTL

SEQ ID NO: 80650 - protein, 9 aa, Homo Sapiens
AHGPPVTCL

SEQ ID NO: 80651 - protein, 9 aa, Homo Sapiens
AHGYPRQAL

SEQ ID NO: 80652 - protein, 9 aa, Homo Sapiens
AHHFPGPLL

SEQ ID NO: 80653 - protein, 9 aa, Homo Sapiens
AHHGISRTL

SEQ ID NO: 80654 - protein, 9 aa, Homo Sapiens
AHIEGNMKL

SEQ ID NO: 80655 - protein, 9 aa, Homo Sapiens
AHIGPVLSL

SEQ ID NO: 80656 - protein, 9 aa, Homo Sapiens
AHIIALESI

SEQ ID NO: 80657 - protein, 9 aa, Homo Sapiens
AHIIQKILL

SEQ ID NO: 80658 - protein, 9 aa, Homo Sapiens
AHIISELIL

SEQ ID NO: 80659 - protein, 9 aa, Homo Sapiens
AHIKDAVAL

SEQ ID NO: 80660 - protein, 9 aa, Homo Sapiens
AHIKPNALL

SEQ ID NO: 80661 - protein, 9 aa, Homo Sapiens
AHINTDMTL

SEQ ID NO: 80662 - protein, 9 aa, Homo Sapiens
AHIPKSDAL

SEQ ID NO: 80663 - protein, 9 aa, Homo Sapiens
AHIQASGHL

SEQ ID NO: 80664 - protein, 9 aa, Homo Sapiens
AHISEQAVW

SEQ ID NO: 80665 - protein, 9 aa, Homo Sapiens
AHISGATSV

SEQ ID NO: 80666 - protein, 9 aa, Homo Sapiens
AHITGGGLL

SEQ ID NO: 80667 - protein, 9 aa, Homo Sapiens
AHKEICAVL

SEQ ID NO: 80668 - protein, 9 aa, Homo Sapiens
AHKQVAAEL

SEQ ID NO: 80669 - protein, 9 aa, Homo Sapiens
AHLDAILIL

SEQ ID NO: 80670 - protein, 9 aa, Homo Sapiens
AHLDATTVL

SEQ ID NO: 80671 - protein, 9 aa, Homo Sapiens
AHLDRPVVL

SEQ ID NO: 80672 - protein, 9 aa, Homo Sapiens
AHLDRTMYL

SEQ ID NO: 80673 - protein, 9 aa, Homo Sapiens
AHLGSALVL

SEQ ID NO: 80674 - protein, 9 aa, Homo Sapiens
AHLQSSVVV

SEQ ID NO: 80675 - protein, 9 aa, Homo Sapiens
AHMDIFQNL

SEQ ID NO: 80676 - protein, 9 aa, Homo Sapiens
AHMDTVRTL

SEQ ID NO: 80677 - protein, 9 aa, Homo Sapiens
AHNLCYTTL

SEQ ID NO: 80678 - protein, 9 aa, Homo Sapiens
AHNMRVMKF

SEQ ID NO: 80679 - protein, 9 aa, Homo Sapiens
AHNPNMTHL

SEQ ID NO: 80680 - protein, 9 aa, Homo Sapiens
AHNVKAMVL

SEQ ID NO: 80681 - protein, 9 aa, Homo Sapiens
AHQAPEAAL

SEQ ID NO: 80682 - protein, 9 aa, Homo Sapiens
AHQETFPAL

SEQ ID NO: 80683 - protein, 9 aa, Homo Sapiens
AHQKFALRL

SEQ ID NO: 80684 - protein, 9 aa, Homo Sapiens
AHQPHIAGL

SEQ ID NO: 80685 - protein, 9 aa, Homo Sapiens
AHSDPVSAV

SEQ ID NO: 80686 - protein, 9 aa, Homo Sapiens
AHSEQTLSL

SEQ ID NO: 80687 - protein, 9 aa, Homo Sapiens
AHSIQIMKV

SEQ ID NO: 80688 - protein, 9 aa, Homo Sapiens
AHSKGVTCL

SEQ ID NO: 80689 - protein, 9 aa, Homo Sapiens
AHSLPMSVV

SEQ ID NO: 80690 - protein, 9 aa, Homo Sapiens
AHSNLASVL

SEQ ID NO: 80691 - protein, 9 aa, Homo Sapiens
AHSPASLSF

SEQ ID NO: 80692 - protein, 9 aa, Homo Sapiens
AHSPLAAQL

SEQ ID NO: 80693 - protein, 9 aa, Homo Sapiens
AHSPSLQSL

SEQ ID NO: 80694 - protein, 9 aa, Homo Sapiens
AHSSFQMAL

SEQ ID NO: 80695 - protein, 9 aa, Homo Sapiens
AHSSLQIVL

SEQ ID NO: 80696 - protein, 9 aa, Homo Sapiens
AHSSPVQSL

SEQ ID NO: 80697 - protein, 9 aa, Homo Sapiens
AHSSPWPAF

SEQ ID NO: 80698 - protein, 9 aa, Homo Sapiens
AHSTIMPRL

SEQ ID NO: 80699 - protein, 9 aa, Homo Sapiens
AHSVPSPAF

SEQ ID NO: 80700 - protein, 9 aa, Homo Sapiens
AHTKPRPAL

SEQ ID NO: 80701 - protein, 9 aa, Homo Sapiens
AHTQATLLL

SEQ ID NO: 80702 - protein, 9 aa, Homo Sapiens
AHTRTVTTL

SEQ ID NO: 80703 - protein, 9 aa, Homo Sapiens
AHTYQSPLL

SEQ ID NO: 80704 - protein, 9 aa, Homo Sapiens
AHVASQPVM

SEQ ID NO: 80705 - protein, 9 aa, Homo Sapiens
AHVNSRISV

SEQ ID NO: 80706 - protein, 9 aa, Homo Sapiens
AHVPTLQVL

SEQ ID NO: 80707 - protein, 9 aa, Homo Sapiens
AHVQNGIAL

SEQ ID NO: 80708 - protein, 9 aa, Homo Sapiens
AHVQTGITA

SEQ ID NO: 80709 - protein, 9 aa, Homo Sapiens
AHVVSQTAV

SEQ ID NO: 80710 - protein, 9 aa, Homo Sapiens
AHWHKGTTL

SEQ ID NO: 80711 - protein, 9 aa, Homo Sapiens
AHYADVLGL

SEQ ID NO: 80712 - protein, 9 aa, Homo Sapiens
AHYARPRAV

SEQ ID NO: 80713 - protein, 9 aa, Homo Sapiens
AHYFTAILL

SEQ ID NO: 80714 - protein, 9 aa, Homo Sapiens
AHYPSQPVF

SEQ ID NO: 80715 - protein, 9 aa, Homo Sapiens
AHYSAVTSL

SEQ ID NO: 80716 - protein, 9 aa, Homo Sapiens
APAPTAVVL

SEQ ID NO: 80717 - protein, 9 aa, Homo Sapiens
AQAPIAAVL

SEQ ID NO: 80718 - protein, 9 aa, Homo Sapiens
AQAPPTAQL

SEQ ID NO: 80719 - protein, 9 aa, Homo Sapiens
AQAPVAAVL

SEQ ID NO: 80720 - protein, 9 aa, Homo Sapiens
AQGPVAAVL

SEQ ID NO: 80721 - protein, 9 aa, Homo Sapiens
AQVPKSSAL

SEQ ID NO: 80722 - protein, 9 aa, Homo Sapiens
ARDPGARVL

SEQ ID NO: 80723 - protein, 9 aa, Homo Sapiens
CHALTFPSL

SEQ ID NO: 80724 - protein, 9 aa, Homo Sapiens
CHLKNSSQL

SEQ ID NO: 80725 - protein, 9 aa, Homo Sapiens
CHLKTISSL

SEQ ID NO: 80726 - protein, 9 aa, Homo Sapiens
CHNAQTFNL

SEQ ID NO: 80727 - protein, 9 aa, Homo Sapiens
DHARGNPEL

SEQ ID NO: 80728 - protein, 9 aa, Homo Sapiens
DHEPNKRIL

SEQ ID NO: 80729 - protein, 9 aa, Homo Sapiens
DHFSKSLFL

SEQ ID NO: 80730 - protein, 9 aa, Homo Sapiens
DHIAHIIEL

SEQ ID NO: 80731 - protein, 9 aa, Homo Sapiens
DHILARESL

SEQ ID NO: 80732 - protein, 9 aa, Homo Sapiens
DHIRFISEL

SEQ ID NO: 80733 - protein, 9 aa, Homo Sapiens
DHMRFISEL

SEQ ID NO: 80734 - protein, 9 aa, Homo Sapiens
DHQQNSPTL

SEQ ID NO: 80735 - protein, 9 aa, Homo Sapiens
DHYQRILQL

SEQ ID NO: 80736 - protein, 9 aa, Homo Sapiens
EHAGLFLVM

SEQ ID NO: 80737 - protein, 9 aa, Homo Sapiens
EHAGVISVL

SEQ ID NO: 80738 - protein, 9 aa, Homo Sapiens
EHAHNMRVM

SEQ ID NO: 80739 - protein, 9 aa, Homo Sapiens
EHAPAPQEV

SEQ ID NO: 80740 - protein, 9 aa, Homo Sapiens
EHAPIRSSL

SEQ ID NO: 80741 - protein, 9 aa, Homo Sapiens
EHAPSIIFM

SEQ ID NO: 80742 - protein, 9 aa, Homo Sapiens
EHAPSIVFI

SEQ ID NO: 80743 - protein, 9 aa, Homo Sapiens
EHAQARLTL

SEQ ID NO: 80744 - protein, 9 aa, Homo Sapiens
EHARPQTTL

SEQ ID NO: 80745 - protein, 9 aa, Homo Sapiens
EHDPSSIYL

SEQ ID NO: 80746 - protein, 9 aa, Homo Sapiens
EHEESKRVL

SEQ ID NO: 80747 - protein, 9 aa, Homo Sapiens
EHEKALHIL

SEQ ID NO: 80748 - protein, 9 aa, Homo Sapiens
EHEPETHTL

SEQ ID NO: 80749 - protein, 9 aa, Homo Sapiens
EHEREVRAL

SEQ ID NO: 80750 - protein, 9 aa, Homo Sapiens
EHESLCHIL

SEQ ID NO: 80751 - protein, 9 aa, Homo Sapiens
EHFDRILEM

SEQ ID NO: 80752 - protein, 9 aa, Homo Sapiens
EHFEKAIEL

SEQ ID NO: 80753 - protein, 9 aa, Homo Sapiens
EHFFHSLML

SEQ ID NO: 80754 - protein, 9 aa, Homo Sapiens
EHFKTSPKI

SEQ ID NO: 80755 - protein, 9 aa, Homo Sapiens
EHFNGVAEL

SEQ ID NO: 80756 - protein, 9 aa, Homo Sapiens
EHHEAVEAL

SEQ ID NO: 80757 - protein, 9 aa, Homo Sapiens
EHHLSEVAL

SEQ ID NO: 80758 - protein, 9 aa, Homo Sapiens
EHIDISTVL

SEQ ID NO: 80759 - protein, 9 aa, Homo Sapiens
EHILYNLVL

SEQ ID NO: 80760 - protein, 9 aa, Homo Sapiens
EHINAGRTV

SEQ ID NO: 80761 - protein, 9 aa, Homo Sapiens
EHINSVSAM

SEQ ID NO: 80762 - protein, 9 aa, Homo Sapiens
EHIPESPYL

SEQ ID NO: 80763 - protein, 9 aa, Homo Sapiens
EHIQNIMTL

SEQ ID NO: 80764 - protein, 9 aa, Homo Sapiens
EHIVPNAEL

SEQ ID NO: 80765 - protein, 9 aa, Homo Sapiens
EHKYSSSPL

SEQ ID NO: 80766 - protein, 9 aa, Homo Sapiens
EHLPVSAEI

SEQ ID NO: 80767 - protein, 9 aa, Homo Sapiens
EHMATIEAL

SEQ ID NO: 80768 - protein, 9 aa, Homo Sapiens
EHMKEIVVL

SEQ ID NO: 80769 - protein, 9 aa, Homo Sapiens
EHMPSGESL

SEQ ID NO: 80770 - protein, 9 aa, Homo Sapiens
EHMQGSGSL

SEQ ID NO: 80771 - protein, 9 aa, Homo Sapiens
EHMSSSSSL

SEQ ID NO: 80772 - protein, 9 aa, Homo Sapiens
EHQDRALTL

SEQ ID NO: 80773 - protein, 9 aa, Homo Sapiens
EHSAPAKVV

SEQ ID NO: 80774 - protein, 9 aa, Homo Sapiens
EHSKVRLVI

SEQ ID NO: 80775 - protein, 9 aa, Homo Sapiens
EHSLPTLGL

SEQ ID NO: 80776 - protein, 9 aa, Homo Sapiens
EHSYAVSSV

SEQ ID NO: 80777 - protein, 9 aa, Homo Sapiens
EHVASSPAL

SEQ ID NO: 80778 - protein, 9 aa, Homo Sapiens
EHVDKAIAL

SEQ ID NO: 80779 - protein, 9 aa, Homo Sapiens
EHVFWVVSL

SEQ ID NO: 80780 - protein, 9 aa, Homo Sapiens
EHVLLVSIL

SEQ ID NO: 80781 - protein, 9 aa, Homo Sapiens
EHVPNSVRL

SEQ ID NO: 80782 - protein, 9 aa, Homo Sapiens
EHYHLTEAL

SEQ ID NO: 80783 - protein, 9 aa, Homo Sapiens
EHYLPSAIL

SEQ ID NO: 80784 - protein, 9 aa, Homo Sapiens
EHYRHALRL

SEQ ID NO: 80785 - protein, 9 aa, Homo Sapiens
EHYSTCIKL

SEQ ID NO: 80786 - protein, 9 aa, Homo Sapiens
EHYYNAISV

SEQ ID NO: 80787 - protein, 9 aa, Homo Sapiens
ELYATPATL

SEQ ID NO: 80788 - protein, 9 aa, Homo Sapiens
ERYSASKPL

SEQ ID NO: 80789 - protein, 9 aa, Homo Sapiens
FHAAWSSVL

SEQ ID NO: 80790 - protein, 9 aa, Homo Sapiens
FHAETLTAL

SEQ ID NO: 80791 - protein, 9 aa, Homo Sapiens
FHAGFGVVL

SEQ ID NO: 80792 - protein, 9 aa, Homo Sapiens
FHAGKSQGL

SEQ ID NO: 80793 - protein, 9 aa, Homo Sapiens
FHAVMGRTL

SEQ ID NO: 80794 - protein, 9 aa, Homo Sapiens
FHDATRVYL

SEQ ID NO: 80795 - protein, 9 aa, Homo Sapiens
FHDGSVHIV

SEQ ID NO: 80796 - protein, 9 aa, Homo Sapiens
FHDLPKAVL

SEQ ID NO: 80797 - protein, 9 aa, Homo Sapiens
FHDMGGVQL

SEQ ID NO: 80798 - protein, 9 aa, Homo Sapiens
FHDMMPKYL

SEQ ID NO: 80799 - protein, 9 aa, Homo Sapiens
FHDPDSAVV

SEQ ID NO: 80800 - protein, 9 aa, Homo Sapiens
FHEEHSRVL

SEQ ID NO: 80801 - protein, 9 aa, Homo Sapiens
FHEFHSPAL

SEQ ID NO: 80802 - protein, 9 aa, Homo Sapiens
FHFAGDGKL

SEQ ID NO: 80803 - protein, 9 aa, Homo Sapiens
FHFEPNEYF

SEQ ID NO: 80804 - protein, 9 aa, Homo Sapiens
FHGPPEPVL

SEQ ID NO: 80805 - protein, 9 aa, Homo Sapiens
FHHEGGVDV

SEQ ID NO: 80806 - protein, 9 aa, Homo Sapiens
FHHEYPWIL

SEQ ID NO: 80807 - protein, 9 aa, Homo Sapiens
FHHGAQAGL

SEQ ID NO: 80808 - protein, 9 aa, Homo Sapiens
FHHHPSTAL

SEQ ID NO: 80809 - protein, 9 aa, Homo Sapiens
FHHPNILEL

SEQ ID NO: 80810 - protein, 9 aa, Homo Sapiens
FHHPSAVRL

SEQ ID NO: 80811 - protein, 9 aa, Homo Sapiens
FHHTPISSM

SEQ ID NO: 80812 - protein, 9 aa, Homo Sapiens
FHHVGQAGL

SEQ ID NO: 80813 - protein, 9 aa, Homo Sapiens
FHIAGAYLL

SEQ ID NO: 80814 - protein, 9 aa, Homo Sapiens
FHIALGGLL

SEQ ID NO: 80815 - protein, 9 aa, Homo Sapiens
FHIDFGHFL

SEQ ID NO: 80816 - protein, 9 aa, Homo Sapiens
FHIDFGHIL

SEQ ID NO: 80817 - protein, 9 aa, Homo Sapiens
FHIEKPKAV

SEQ ID NO: 80818 - protein, 9 aa, Homo Sapiens
FHITVGKAI

SEQ ID NO: 80819 - protein, 9 aa, Homo Sapiens
FHLALGQVL

SEQ ID NO: 80820 - protein, 9 aa, Homo Sapiens
FHLEHAANL

SEQ ID NO: 80821 - protein, 9 aa, Homo Sapiens
FHLGHAAML

SEQ ID NO: 80822 - protein, 9 aa, Homo Sapiens
FHLHSQKCL

SEQ ID NO: 80823 - protein, 9 aa, Homo Sapiens
FHMDPSGTF

SEQ ID NO: 80824 - protein, 9 aa, Homo Sapiens
FHMGGNMEL

SEQ ID NO: 80825 - protein, 9 aa, Homo Sapiens
FHMPITSAM

SEQ ID NO: 80826 - protein, 9 aa, Homo Sapiens
FHNFIKVTL

SEQ ID NO: 80827 - protein, 9 aa, Homo Sapiens
FHNGSTPTL

SEQ ID NO: 80828 - protein, 9 aa, Homo Sapiens
FHNGVAAGL

SEQ ID NO: 80829 - protein, 9 aa, Homo Sapiens
FHNLPSLTL

SEQ ID NO: 80830 - protein, 9 aa, Homo Sapiens
FHNQGPVIK

SEQ ID NO: 80831 - protein, 9 aa, Homo Sapiens
FHQPDSVIL

SEQ ID NO: 80832 - protein, 9 aa, Homo Sapiens
FHQPTQPVA

SEQ ID NO: 80833 - protein, 9 aa, Homo Sapiens
FHSGGKFIL

SEQ ID NO: 80834 - protein, 9 aa, Homo Sapiens
FHSGHARAL

SEQ ID NO: 80835 - protein, 9 aa, Homo Sapiens
FHSHDGPSL

SEQ ID NO: 80836 - protein, 9 aa, Homo Sapiens
FHSKESIVA

SEQ ID NO: 80837 - protein, 9 aa, Homo Sapiens
FHSNDVATL

SEQ ID NO: 80838 - protein, 9 aa, Homo Sapiens
FHSPPQEAL

SEQ ID NO: 80839 - protein, 9 aa, Homo Sapiens
FHSPYCKLV

SEQ ID NO: 80840 - protein, 9 aa, Homo Sapiens
FHTEALTAL

SEQ ID NO: 80841 - protein, 9 aa, Homo Sapiens
FHTPKNTSV

SEQ ID NO: 80842 - protein, 9 aa, Homo Sapiens
FHTTPNTSL

SEQ ID NO: 80843 - protein, 9 aa, Homo Sapiens
FHVGKTPIV

SEQ ID NO: 80844 - protein, 9 aa, Homo Sapiens
FHVGLPGAL

SEQ ID NO: 80845 - protein, 9 aa, Homo Sapiens
FHVPAGQPL

SEQ ID NO: 80846 - protein, 9 aa, Homo Sapiens
FHYGIKQLL

SEQ ID NO: 80847 - protein, 9 aa, Homo Sapiens
FHYIFNVQL

SEQ ID NO: 80848 - protein, 9 aa, Homo Sapiens
FHYPGVQNL

SEQ ID NO: 80849 - protein, 9 aa, Homo Sapiens
FIADHCPTL

SEQ ID NO: 80850 - protein, 9 aa, Homo Sapiens
FQAPTAKEM

SEQ ID NO: 80851 - protein, 9 aa, Homo Sapiens
FQEADSPTL

SEQ ID NO: 80852 - protein, 9 aa, Homo Sapiens
FQSAAIGAL

SEQ ID NO: 80853 - protein, 9 aa, Homo Sapiens
FQTIARNAL

SEQ ID NO: 80854 - protein, 9 aa, Homo Sapiens
FQYSKSPSL

SEQ ID NO: 80855 - protein, 9 aa, Homo Sapiens
GGHGPSFPL

SEQ ID NO: 80856 - protein, 9 aa, Homo Sapiens
GHAAPTNVV

SEQ ID NO: 80857 - protein, 9 aa, Homo Sapiens
GHAASSPEI

SEQ ID NO: 80858 - protein, 9 aa, Homo Sapiens
GHADVAQLL

SEQ ID NO: 80859 - protein, 9 aa, Homo Sapiens
GHAMPIRSL

SEQ ID NO: 80860 - protein, 9 aa, Homo Sapiens
GHAPYSRTL

SEQ ID NO: 80861 - protein, 9 aa, Homo Sapiens
GHASENPKL

SEQ ID NO: 80862 - protein, 9 aa, Homo Sapiens
GHASHQPAI

SEQ ID NO: 80863 - protein, 9 aa, Homo Sapiens
GHASPCPPL

SEQ ID NO: 80864 - protein, 9 aa, Homo Sapiens
GHATPVSSL

SEQ ID NO: 80865 - protein, 9 aa, Homo Sapiens
GHDASQITL

SEQ ID NO: 80866 - protein, 9 aa, Homo Sapiens
GHDNRVSCL

SEQ ID NO: 80867 - protein, 9 aa, Homo Sapiens
GHENRVSTL

SEQ ID NO: 80868 - protein, 9 aa, Homo Sapiens
GHEPMPPTL

SEQ ID NO: 80869 - protein, 9 aa, Homo Sapiens
GHFEKPLFL

SEQ ID NO: 80870 - protein, 9 aa, Homo Sapiens
GHFKDPKRL

SEQ ID NO: 80871 - protein, 9 aa, Homo Sapiens
GHFPLSITL

SEQ ID NO: 80872 - protein, 9 aa, Homo Sapiens
GHFPSPIRL

SEQ ID NO: 80873 - protein, 9 aa, Homo Sapiens
GHFQGEIKL

SEQ ID NO: 80874 - protein, 9 aa, Homo Sapiens
GHFQGGIQV

SEQ ID NO: 80875 - protein, 9 aa, Homo Sapiens
GHFQKMLVV

SEQ ID NO: 80876 - protein, 9 aa, Homo Sapiens
GHFQRAAQL

SEQ ID NO: 80877 - protein, 9 aa, Homo Sapiens
GHFSKALEL

SEQ ID NO: 80878 - protein, 9 aa, Homo Sapiens
GHGSPFPSL

SEQ ID NO: 80879 - protein, 9 aa, Homo Sapiens
GHHAQPLAL

SEQ ID NO: 80880 - protein, 9 aa, Homo Sapiens
GHHLPQQSL

SEQ ID NO: 80881 - protein, 9 aa, Homo Sapiens
GHHQPITAM

SEQ ID NO: 80882 - protein, 9 aa, Homo Sapiens
GHIAKALAL

SEQ ID NO: 80883 - protein, 9 aa, Homo Sapiens
GHIDHPVMV

SEQ ID NO: 80884 - protein, 9 aa, Homo Sapiens
GHIDVVQVL

SEQ ID NO: 80885 - protein, 9 aa, Homo Sapiens
GHIESSALL

SEQ ID NO: 80886 - protein, 9 aa, Homo Sapiens
GHIPSAIVL

SEQ ID NO: 80887 - protein, 9 aa, Homo Sapiens
GHIPWGTVF

SEQ ID NO: 80888 - protein, 9 aa, Homo Sapiens
GHLEKAVVL

SEQ ID NO: 80889 - protein, 9 aa, Homo Sapiens
GHLENNPAL

SEQ ID NO: 80890 - protein, 9 aa, Homo Sapiens
GHMEAVSSV

SEQ ID NO: 80891 - protein, 9 aa, Homo Sapiens
GHMFPSHLL

SEQ ID NO: 80892 - protein, 9 aa, Homo Sapiens
GHMPPLTSA

SEQ ID NO: 80893 - protein, 9 aa, Homo Sapiens
GHMPTVELL

SEQ ID NO: 80894 - protein, 9 aa, Homo Sapiens
GHNGWVTQI

SEQ ID NO: 80895 - protein, 9 aa, Homo Sapiens
GHNLQTVQL

SEQ ID NO: 80896 - protein, 9 aa, Homo Sapiens
GHRANSPSL

SEQ ID NO: 80897 - protein, 9 aa, Homo Sapiens
GHSAHIVTL

SEQ ID NO: 80898 - protein, 9 aa, Homo Sapiens
GHSDIHSLL

SEQ ID NO: 80899 - protein, 9 aa, Homo Sapiens
GHSDLVRCL

SEQ ID NO: 80900 - protein, 9 aa, Homo Sapiens
GHSEAVISV

SEQ ID NO: 80901 - protein, 9 aa, Homo Sapiens
GHSEVSTAI

SEQ ID NO: 80902 - protein, 9 aa, Homo Sapiens
GHSEVVAIL

SEQ ID NO: 80903 - protein, 9 aa, Homo Sapiens
GHSGAVMEL

SEQ ID NO: 80904 - protein, 9 aa, Homo Sapiens
GHSIVVSSL

SEQ ID NO: 80905 - protein, 9 aa, Homo Sapiens
GHSKRVVAL

SEQ ID NO: 80906 - protein, 9 aa, Homo Sapiens
GHSPPSSSL

SEQ ID NO: 80907 - protein, 9 aa, Homo Sapiens
GHSPPTSSL

SEQ ID NO: 80908 - protein, 9 aa, Homo Sapiens
GHTPYSSML

SEQ ID NO: 80909 - protein, 9 aa, Homo Sapiens
GHTSRVLSL

SEQ ID NO: 80910 - protein, 9 aa, Homo Sapiens
GHVEQARAL

SEQ ID NO: 80911 - protein, 9 aa, Homo Sapiens
GHVEVARVL

SEQ ID NO: 80912 - protein, 9 aa, Homo Sapiens
GHVPGVSAL

SEQ ID NO: 80913 - protein, 9 aa, Homo Sapiens
GHVTGQAVV

SEQ ID NO: 80914 - protein, 9 aa, Homo Sapiens
GHVVKALAL

SEQ ID NO: 80915 - protein, 9 aa, Homo Sapiens
GHYAASIII

SEQ ID NO: 80916 - protein, 9 aa, Homo Sapiens
GHYEVAELL

SEQ ID NO: 80917 - protein, 9 aa, Homo Sapiens
GHYLDQKRL

SEQ ID NO: 80918 - protein, 9 aa, Homo Sapiens
GHYPEILVV

SEQ ID NO: 80919 - protein, 9 aa, Homo Sapiens
GHYPRHIVF

SEQ ID NO: 80920 - protein, 9 aa, Homo Sapiens
GHYQNALYL

SEQ ID NO: 80921 - protein, 9 aa, Homo Sapiens
GHYSTTEVL

SEQ ID NO: 80922 - protein, 9 aa, Homo Sapiens
GHYTASVKV

SEQ ID NO: 80923 - protein, 9 aa, Homo Sapiens
GHYTEGAEL

SEQ ID NO: 80924 - protein, 9 aa, Homo Sapiens
GQAPPGKAL

SEQ ID NO: 80925 - protein, 9 aa, Homo Sapiens
GQGPPGPIL

SEQ ID NO: 80926 - protein, 9 aa, Homo Sapiens
HGYDKDPVL

SEQ ID NO: 80927 - protein, 9 aa, Homo Sapiens
HHADKALTM

SEQ ID NO: 80928 - protein, 9 aa, Homo Sapiens
HHAEPPPAL

SEQ ID NO: 80929 - protein, 9 aa, Homo Sapiens
HHAFQPSKL

SEQ ID NO: 80930 - protein, 9 aa, Homo Sapiens
HHANPAIGF

SEQ ID NO: 80931 - protein, 9 aa, Homo Sapiens
HHANPILLL

SEQ ID NO: 80932 - protein, 9 aa, Homo Sapiens
HHAPLPSHL

SEQ ID NO: 80933 - protein, 9 aa, Homo Sapiens
HHAPLVNSL

SEQ ID NO: 80934 - protein, 9 aa, Homo Sapiens
HHARSICHL

SEQ ID NO: 80935 - protein, 9 aa, Homo Sapiens
HHDPFLRSM

SEQ ID NO: 80936 - protein, 9 aa, Homo Sapiens
HHDQPVKPL

SEQ ID NO: 80937 - protein, 9 aa, Homo Sapiens
HHDSRRIFV

SEQ ID NO: 80938 - protein, 9 aa, Homo Sapiens
HHEAGVTAL

SEQ ID NO: 80939 - protein, 9 aa, Homo Sapiens
HHELHAAHL

SEQ ID NO: 80940 - protein, 9 aa, Homo Sapiens
HHELVALLL

SEQ ID NO: 80941 - protein, 9 aa, Homo Sapiens
HHEPESPQL

SEQ ID NO: 80942 - protein, 9 aa, Homo Sapiens
HHFDRIAQM

SEQ ID NO: 80943 - protein, 9 aa, Homo Sapiens
HHFEGAQIL

SEQ ID NO: 80944 - protein, 9 aa, Homo Sapiens
HHFEKAVTL

SEQ ID NO: 80945 - protein, 9 aa, Homo Sapiens
HHFEQMLKL

SEQ ID NO: 80946 - protein, 9 aa, Homo Sapiens
HHFKYPCVL

SEQ ID NO: 80947 - protein, 9 aa, Homo Sapiens
HHFLELVTL

SEQ ID NO: 80948 - protein, 9 aa, Homo Sapiens
HHFPGPLLV

SEQ ID NO: 80949 - protein, 9 aa, Homo Sapiens
HHGPMAVAF

SEQ ID NO: 80950 - protein, 9 aa, Homo Sapiens
HHGPPGPTF

SEQ ID NO: 80951 - protein, 9 aa, Homo Sapiens
HHGPPRFGL

SEQ ID NO: 80952 - protein, 9 aa, Homo Sapiens
HHGPQTLYL

SEQ ID NO: 80953 - protein, 9 aa, Homo Sapiens
HHGTSILTL

SEQ ID NO: 80954 - protein, 9 aa, Homo Sapiens
HHHALQQQL

SEQ ID NO: 80955 - protein, 9 aa, Homo Sapiens
HHHDYHHIL

SEQ ID NO: 80956 - protein, 9 aa, Homo Sapiens
HHHHHPPMI

SEQ ID NO: 80957 - protein, 9 aa, Homo Sapiens
HHHLGSVIL

SEQ ID NO: 80958 - protein, 9 aa, Homo Sapiens
HHHLPTEAL

SEQ ID NO: 80959 - protein, 9 aa, Homo Sapiens
HHHLQNNEL

SEQ ID NO: 80960 - protein, 9 aa, Homo Sapiens
HHHPPMIAL

SEQ ID NO: 80961 - protein, 9 aa, Homo Sapiens
HHHVPNATL

SEQ ID NO: 80962 - protein, 9 aa, Homo Sapiens
HHIANANLM

SEQ ID NO: 80963 - protein, 9 aa, Homo Sapiens
HHIASVEKL

SEQ ID NO: 80964 - protein, 9 aa, Homo Sapiens
HHIATVEKL

SEQ ID NO: 80965 - protein, 9 aa, Homo Sapiens
HHIDSANAL

SEQ ID NO: 80966 - protein, 9 aa, Homo Sapiens
HHIEAQQRL

SEQ ID NO: 80967 - protein, 9 aa, Homo Sapiens
HHIEPFCKL

SEQ ID NO: 80968 - protein, 9 aa, Homo Sapiens
HHILADVSL

SEQ ID NO: 80969 - protein, 9 aa, Homo Sapiens
HHILKSDDL

SEQ ID NO: 80970 - protein, 9 aa, Homo Sapiens
HHIPDVITY

SEQ ID NO: 80971 - protein, 9 aa, Homo Sapiens
HHISLASCL

SEQ ID NO: 80972 - protein, 9 aa, Homo Sapiens
HHITGSQNI

SEQ ID NO: 80973 - protein, 9 aa, Homo Sapiens
HHITPLLSA

SEQ ID NO: 80974 - protein, 9 aa, Homo Sapiens
HHIYHTVAI

SEQ ID NO: 80975 - protein, 9 aa, Homo Sapiens
HHKDIALSL

SEQ ID NO: 80976 - protein, 9 aa, Homo Sapiens
HHLIQAVLL

SEQ ID NO: 80977 - protein, 9 aa, Homo Sapiens
HHLIVITSL

SEQ ID NO: 80978 - protein, 9 aa, Homo Sapiens
HHLLVTNEL

SEQ ID NO: 80979 - protein, 9 aa, Homo Sapiens
HHLPRVPAL

SEQ ID NO: 80980 - protein, 9 aa, Homo Sapiens
HHLVIPSVL

SEQ ID NO: 80981 - protein, 9 aa, Homo Sapiens
HHMGGMAGL

SEQ ID NO: 80982 - protein, 9 aa, Homo Sapiens
HHMGISHVL

SEQ ID NO: 80983 - protein, 9 aa, Homo Sapiens
HHNALGVIL

SEQ ID NO: 80984 - protein, 9 aa, Homo Sapiens
HHNEAVLHL

SEQ ID NO: 80985 - protein, 9 aa, Homo Sapiens
HHNILPKTL

SEQ ID NO: 80986 - protein, 9 aa, Homo Sapiens
HHNPPTIEL

SEQ ID NO: 80987 - protein, 9 aa, Homo Sapiens
HHNRAITHL

SEQ ID NO: 80988 - protein, 9 aa, Homo Sapiens
HHQHNPVQV

SEQ ID NO: 80989 - protein, 9 aa, Homo Sapiens
HHQSKVITL

SEQ ID NO: 80990 - protein, 9 aa, Homo Sapiens
HHQTAYNAL

SEQ ID NO: 80991 - protein, 9 aa, Homo Sapiens
HHSALLILL

SEQ ID NO: 80992 - protein, 9 aa, Homo Sapiens
HHSDGSVSL

SEQ ID NO: 80993 - protein, 9 aa, Homo Sapiens
HHSGAKVVL

SEQ ID NO: 80994 - protein, 9 aa, Homo Sapiens
HHSGILPIL

SEQ ID NO: 80995 - protein, 9 aa, Homo Sapiens
HHSLALTSF

SEQ ID NO: 80996 - protein, 9 aa, Homo Sapiens
HHSMSQPIM

SEQ ID NO: 80997 - protein, 9 aa, Homo Sapiens
HHSNIPMSL

SEQ ID NO: 80998 - protein, 9 aa, Homo Sapiens
HHSQSFQLL

SEQ ID NO: 80999 - protein, 9 aa, Homo Sapiens
HHSSVQDAV

SEQ ID NO: 81000 - protein, 9 aa, Homo Sapiens
HHSVKSPEL

SEQ ID NO: 81001 - protein, 9 aa, Homo Sapiens
HHTQQSQML

SEQ ID NO: 81002 - protein, 9 aa, Homo Sapiens
HHTQVDPAM

SEQ ID NO: 81003 - protein, 9 aa, Homo Sapiens
HHTTQQTFL

SEQ ID NO: 81004 - protein, 9 aa, Homo Sapiens
HHVARNVAL

SEQ ID NO: 81005 - protein, 9 aa, Homo Sapiens
HHVEDPASV

SEQ ID NO: 81006 - protein, 9 aa, Homo Sapiens
HHVIPMPLL

SEQ ID NO: 81007 - protein, 9 aa, Homo Sapiens
HHVLHSLLL

SEQ ID NO: 81008 - protein, 9 aa, Homo Sapiens
HHVLKNDVL

SEQ ID NO: 81009 - protein, 9 aa, Homo Sapiens
HHVLQNDVL

SEQ ID NO: 81010 - protein, 9 aa, Homo Sapiens
HHVNVNPNF

SEQ ID NO: 81011 - protein, 9 aa, Homo Sapiens
HHVSVTKQL

SEQ ID NO: 81012 - protein, 9 aa, Homo Sapiens
HHVYSGKDL

SEQ ID NO: 81013 - protein, 9 aa, Homo Sapiens
HHVYVTAAL

SEQ ID NO: 81014 - protein, 9 aa, Homo Sapiens
HHWPFQRAL

SEQ ID NO: 81015 - protein, 9 aa, Homo Sapiens
HHYEGAVVI

SEQ ID NO: 81016 - protein, 9 aa, Homo Sapiens
HHYELPAIL

SEQ ID NO: 81017 - protein, 9 aa, Homo Sapiens
HHYIPHVVL

SEQ ID NO: 81018 - protein, 9 aa, Homo Sapiens
HHYTGLLKL

SEQ ID NO: 81019 - protein, 9 aa, Homo Sapiens
HHYTTKQVI

SEQ ID NO: 81020 - protein, 9 aa, Homo Sapiens
HQAGQAPHL

SEQ ID NO: 81021 - protein, 9 aa, Homo Sapiens
HQDSRAHLL

SEQ ID NO: 81022 - protein, 9 aa, Homo Sapiens
HQFESSFEL

SEQ ID NO: 81023 - protein, 9 aa, Homo Sapiens
HQHLSKESL

SEQ ID NO: 81024 - protein, 9 aa, Homo Sapiens
HQINSSGVL

SEQ ID NO: 81025 - protein, 9 aa, Homo Sapiens
HQQSIPAVL

SEQ ID NO: 81026 - protein, 9 aa, Homo Sapiens
HRFPFSSAL

SEQ ID NO: 81027 - protein, 9 aa, Homo Sapiens
HRLSHQTVL

SEQ ID NO: 81028 - protein, 9 aa, Homo Sapiens
HRTDLNPIL

SEQ ID NO: 81029 - protein, 9 aa, Homo Sapiens
HSGSQGPLL

SEQ ID NO: 81030 - protein, 9 aa, Homo Sapiens
HTLLNSISI

SEQ ID NO: 81031 - protein, 9 aa, Homo Sapiens
IEYGKQAVL

SEQ ID NO: 81032 - protein, 9 aa, Homo Sapiens
IHAEIKNSL

SEQ ID NO: 81033 - protein, 9 aa, Homo Sapiens
IHANVAAAL

SEQ ID NO: 81034 - protein, 9 aa, Homo Sapiens
IHAVGAPSV

SEQ ID NO: 81035 - protein, 9 aa, Homo Sapiens
IHCNTPSLL

SEQ ID NO: 81036 - protein, 9 aa, Homo Sapiens
IHDFQPHVI

SEQ ID NO: 81037 - protein, 9 aa, Homo Sapiens
IHDGMNLEL

SEQ ID NO: 81038 - protein, 9 aa, Homo Sapiens
IHDGTVHTI

SEQ ID NO: 81039 - protein, 9 aa, Homo Sapiens
IHDHNIPTL

SEQ ID NO: 81040 - protein, 9 aa, Homo Sapiens
IHDSQAPSL

SEQ ID NO: 81041 - protein, 9 aa, Homo Sapiens
IHEDTRHLL

SEQ ID NO: 81042 - protein, 9 aa, Homo Sapiens
IHEPEPHIL

SEQ ID NO: 81043 - protein, 9 aa, Homo Sapiens
IHEPSAALL

SEQ ID NO: 81044 - protein, 9 aa, Homo Sapiens
IHESPQPLL

SEQ ID NO: 81045 - protein, 9 aa, Homo Sapiens
IHFKETEIL

SEQ ID NO: 81046 - protein, 9 aa, Homo Sapiens
IHHNWPSLL

SEQ ID NO: 81047 - protein, 9 aa, Homo Sapiens
IHHPTPIQI

SEQ ID NO: 81048 - protein, 9 aa, Homo Sapiens
IHHRMPAIL

SEQ ID NO: 81049 - protein, 9 aa, Homo Sapiens
IHIITGVAV

SEQ ID NO: 81050 - protein, 9 aa, Homo Sapiens
IHIKPGAKV

SEQ ID NO: 81051 - protein, 9 aa, Homo Sapiens
IHILDVLVL

SEQ ID NO: 81052 - protein, 9 aa, Homo Sapiens
IHISSGNTM

SEQ ID NO: 81053 - protein, 9 aa, Homo Sapiens
IHLGHILFL

SEQ ID NO: 81054 - protein, 9 aa, Homo Sapiens
IHLPHFISL

SEQ ID NO: 81055 - protein, 9 aa, Homo Sapiens
IHLPLSRTL

SEQ ID NO: 81056 - protein, 9 aa, Homo Sapiens
IHLPVSRLL

SEQ ID NO: 81057 - protein, 9 aa, Homo Sapiens
IHNDVKVLL

SEQ ID NO: 81058 - protein, 9 aa, Homo Sapiens
IHNEPFLTL

SEQ ID NO: 81059 - protein, 9 aa, Homo Sapiens
IHQDGIHIL

SEQ ID NO: 81060 - protein, 9 aa, Homo Sapiens
IHQETATVL

SEQ ID NO: 81061 - protein, 9 aa, Homo Sapiens
IHRSGAPVL

SEQ ID NO: 81062 - protein, 9 aa, Homo Sapiens
IHSANVRTV

SEQ ID NO: 81063 - protein, 9 aa, Homo Sapiens
IHSDKAPVL

SEQ ID NO: 81064 - protein, 9 aa, Homo Sapiens
IHSENFQTL

SEQ ID NO: 81065 - protein, 9 aa, Homo Sapiens
IHSGNSVSL

SEQ ID NO: 81066 - protein, 9 aa, Homo Sapiens
IHSLPSTSV

SEQ ID NO: 81067 - protein, 9 aa, Homo Sapiens
IHSPKSESV

SEQ ID NO: 81068 - protein, 9 aa, Homo Sapiens
IHSPVVNEL

SEQ ID NO: 81069 - protein, 9 aa, Homo Sapiens
IHSQPQPAL

SEQ ID NO: 81070 - protein, 9 aa, Homo Sapiens
IHSQVSQQL

SEQ ID NO: 81071 - protein, 9 aa, Homo Sapiens
IHSSIVSTL

SEQ ID NO: 81072 - protein, 9 aa, Homo Sapiens
IHSSQPLTL

SEQ ID NO: 81073 - protein, 9 aa, Homo Sapiens
IHSTPSTVL

SEQ ID NO: 81074 - protein, 9 aa, Homo Sapiens
IHTPAGAAV

SEQ ID NO: 81075 - protein, 9 aa, Homo Sapiens
IHTPENPVI

SEQ ID NO: 81076 - protein, 9 aa, Homo Sapiens
IHVDFPVIL

SEQ ID NO: 81077 - protein, 9 aa, Homo Sapiens
IHVDPVSQL

SEQ ID NO: 81078 - protein, 9 aa, Homo Sapiens
IHVDSQKAL

SEQ ID NO: 81079 - protein, 9 aa, Homo Sapiens
IHVEQSISL

SEQ ID NO: 81080 - protein, 9 aa, Homo Sapiens
IHVPTTPAL

SEQ ID NO: 81081 - protein, 9 aa, Homo Sapiens
IHVRDTKTV

SEQ ID NO: 81082 - protein, 9 aa, Homo Sapiens
IHYDRITSL

SEQ ID NO: 81083 - protein, 9 aa, Homo Sapiens
IHYGQTVKL

SEQ ID NO: 81084 - protein, 9 aa, Homo Sapiens
ILANPSPVL

SEQ ID NO: 81085 - protein, 9 aa, Homo Sapiens
ILDPHVVLL

SEQ ID NO: 81086 - protein, 9 aa, Homo Sapiens
IPAPPSSPL

SEQ ID NO: 81087 - protein, 9 aa, Homo Sapiens
IPIGIDKAL

SEQ ID NO: 81088 - protein, 9 aa, Homo Sapiens
IQAEPSRCL

SEQ ID NO: 81089 - protein, 9 aa, Homo Sapiens
IQAPSGTQL

SEQ ID NO: 81090 - protein, 9 aa, Homo Sapiens
IQCAKTLIL

SEQ ID NO: 81091 - protein, 9 aa, Homo Sapiens
IQSPHVAVL

SEQ ID NO: 81092 - protein, 9 aa, Homo Sapiens
IQSPVTTPL

SEQ ID NO: 81093 - protein, 9 aa, Homo Sapiens
IQYDKTNVL

SEQ ID NO: 81094 - protein, 9 aa, Homo Sapiens
IQYPDSDVL

SEQ ID NO: 81095 - protein, 9 aa, Homo Sapiens
KHIDAAMVL

SEQ ID NO: 81096 - protein, 9 aa, Homo Sapiens
KHIGVCISV

SEQ ID NO: 81097 - protein, 9 aa, Homo Sapiens
KHVNPVQAL

SEQ ID NO: 81098 - protein, 9 aa, Homo Sapiens
LHAAHQAIL

SEQ ID NO: 81099 - protein, 9 aa, Homo Sapiens
LHADPEPSV

SEQ ID NO: 81100 - protein, 9 aa, Homo Sapiens
LHAFIAQAL

SEQ ID NO: 81101 - protein, 9 aa, Homo Sapiens
LHAGVVHCL

SEQ ID NO: 81102 - protein, 9 aa, Homo Sapiens
LHANLARAL

SEQ ID NO: 81103 - protein, 9 aa, Homo Sapiens
LHANLPPTL

SEQ ID NO: 81104 - protein, 9 aa, Homo Sapiens
LHAQPIISI

SEQ ID NO: 81105 - protein, 9 aa, Homo Sapiens
LHASGSRPL

SEQ ID NO: 81106 - protein, 9 aa, Homo Sapiens
LHATATRAL

SEQ ID NO: 81107 - protein, 9 aa, Homo Sapiens
LHATSQQPL

SEQ ID NO: 81108 - protein, 9 aa, Homo Sapiens
LHATVMNTL

SEQ ID NO: 81109 - protein, 9 aa, Homo Sapiens
LHDAASKLL

SEQ ID NO: 81110 - protein, 9 aa, Homo Sapiens
LHDDRGPVL

SEQ ID NO: 81111 - protein, 9 aa, Homo Sapiens
LHDEAVRLL

SEQ ID NO: 81112 - protein, 9 aa, Homo Sapiens
LHDQFQHQL

SEQ ID NO: 81113 - protein, 9 aa, Homo Sapiens
LHDTRTHFL

SEQ ID NO: 81114 - protein, 9 aa, Homo Sapiens
LHEATVRLM

SEQ ID NO: 81115 - protein, 9 aa, Homo Sapiens
LHEDLSTVI

SEQ ID NO: 81116 - protein, 9 aa, Homo Sapiens
LHEDRGPVL

SEQ ID NO: 81117 - protein, 9 aa, Homo Sapiens
LHEEVKRTL

SEQ ID NO: 81118 - protein, 9 aa, Homo Sapiens
LHFKESSEL

SEQ ID NO: 81119 - protein, 9 aa, Homo Sapiens
LHFRNAITL

SEQ ID NO: 81120 - protein, 9 aa, Homo Sapiens
LHGPLPLCL

SEQ ID NO: 81121 - protein, 9 aa, Homo Sapiens
LHGWAGTGK

SEQ ID NO: 81122 - protein, 9 aa, Homo Sapiens
LHHDDPEVL

SEQ ID NO: 81123 - protein, 9 aa, Homo Sapiens
LHHLQVIIL

SEQ ID NO: 81124 - protein, 9 aa, Homo Sapiens
LHHPNNQTL

SEQ ID NO: 81125 - protein, 9 aa, Homo Sapiens
LHHPQPLGL

SEQ ID NO: 81126 - protein, 9 aa, Homo Sapiens
LHHSEAPEL

SEQ ID NO: 81127 - protein, 9 aa, Homo Sapiens
LHICHDLTL

SEQ ID NO: 81128 - protein, 9 aa, Homo Sapiens
LHIDQRLVF

SEQ ID NO: 81129 - protein, 9 aa, Homo Sapiens
LHIFHAIAV

SEQ ID NO: 81130 - protein, 9 aa, Homo Sapiens
LHIGKGVQL

SEQ ID NO: 81131 - protein, 9 aa, Homo Sapiens
LHIGSVITL

SEQ ID NO: 81132 - protein, 9 aa, Homo Sapiens
LHIKVIPTL

SEQ ID NO: 81133 - protein, 9 aa, Homo Sapiens
LHLAVVPVL

SEQ ID NO: 81134 - protein, 9 aa, Homo Sapiens
LHLGHTFSL

SEQ ID NO: 81135 - protein, 9 aa, Homo Sapiens
LHLPQQPLL

SEQ ID NO: 81136 - protein, 9 aa, Homo Sapiens
LHLPVSTTL

SEQ ID NO: 81137 - protein, 9 aa, Homo Sapiens
LHLYHTIIL

SEQ ID NO: 81138 - protein, 9 aa, Homo Sapiens
LHMESPTCL

SEQ ID NO: 81139 - protein, 9 aa, Homo Sapiens
LHNAHKVLL

SEQ ID NO: 81140 - protein, 9 aa, Homo Sapiens
LHNCPAISL

SEQ ID NO: 81141 - protein, 9 aa, Homo Sapiens
LHNMPPSAL

SEQ ID NO: 81142 - protein, 9 aa, Homo Sapiens
LHNPVTLKL

SEQ ID NO: 81143 - protein, 9 aa, Homo Sapiens
LHNQAKNLL

SEQ ID NO: 81144 - protein, 9 aa, Homo Sapiens
LHQAVAVIL

SEQ ID NO: 81145 - protein, 9 aa, Homo Sapiens
LHQDPGQPL

SEQ ID NO: 81146 - protein, 9 aa, Homo Sapiens
LHQHTISTL

SEQ ID NO: 81147 - protein, 9 aa, Homo Sapiens
LHSDNTAAL

SEQ ID NO: 81148 - protein, 9 aa, Homo Sapiens
LHSDVTEAM

SEQ ID NO: 81149 - protein, 9 aa, Homo Sapiens
LHSESSMSL

SEQ ID NO: 81150 - protein, 9 aa, Homo Sapiens
LHSFASRQL

SEQ ID NO: 81151 - protein, 9 aa, Homo Sapiens
LHSHVTNAM

SEQ ID NO: 81152 - protein, 9 aa, Homo Sapiens
LHSKASNLL

SEQ ID NO: 81153 - protein, 9 aa, Homo Sapiens
LHSLPIVSM

SEQ ID NO: 81154 - protein, 9 aa, Homo Sapiens
LHSMPSNSV

SEQ ID NO: 81155 - protein, 9 aa, Homo Sapiens
LHSRVKLIL

SEQ ID NO: 81156 - protein, 9 aa, Homo Sapiens
LHSSHTPSL

SEQ ID NO: 81157 - protein, 9 aa, Homo Sapiens
LHTARVLVL

SEQ ID NO: 81158 - protein, 9 aa, Homo Sapiens
LHTEEAPAL

SEQ ID NO: 81159 - protein, 9 aa, Homo Sapiens
LHTTVGSLL

SEQ ID NO: 81160 - protein, 9 aa, Homo Sapiens
LHYAVPVVL

SEQ ID NO: 81161 - protein, 9 aa, Homo Sapiens
LHYFKNVVL

SEQ ID NO: 81162 - protein, 9 aa, Homo Sapiens
LHYGLPVVV

SEQ ID NO: 81163 - protein, 9 aa, Homo Sapiens
LHYGSVLLI

SEQ ID NO: 81164 - protein, 9 aa, Homo Sapiens
LHYLRPVVV

SEQ ID NO: 81165 - protein, 9 aa, Homo Sapiens
LHYPSTTAL

SEQ ID NO: 81166 - protein, 9 aa, Homo Sapiens
LHYQPAAEL

SEQ ID NO: 81167 - protein, 9 aa, Homo Sapiens
LLAHPDAPM

SEQ ID NO: 81168 - protein, 9 aa, Homo Sapiens
LLSPHNPAL

SEQ ID NO: 81169 - protein, 9 aa, Homo Sapiens
LPALPTQAL

SEQ ID NO: 81170 - protein, 9 aa, Homo Sapiens
LPIAASSSL

SEQ ID NO: 81171 - protein, 9 aa, Homo Sapiens
LPIDCSPAL

SEQ ID NO: 81172 - protein, 9 aa, Homo Sapiens
LPYAGDVSM

SEQ ID NO: 81173 - protein, 9 aa, Homo Sapiens
LQAPPLTSL

SEQ ID NO: 81174 - protein, 9 aa, Homo Sapiens
LVFHSKPPS

SEQ ID NO: 81175 - protein, 9 aa, Homo Sapiens
LVTDIQPVL

SEQ ID NO: 81176 - protein, 9 aa, Homo Sapiens
MEEETKRQL

SEQ ID NO: 81177 - protein, 9 aa, Homo Sapiens
MHAGSSDLL

SEQ ID NO: 81178 - protein, 9 aa, Homo Sapiens
MHALLAIAL

SEQ ID NO: 81179 - protein, 9 aa, Homo Sapiens
MHAQDPQML

SEQ ID NO: 81180 - protein, 9 aa, Homo Sapiens
MHDCVVKLL

SEQ ID NO: 81181 - protein, 9 aa, Homo Sapiens
MHFESGSTL

SEQ ID NO: 81182 - protein, 9 aa, Homo Sapiens
MHGQPSPSL

SEQ ID NO: 81183 - protein, 9 aa, Homo Sapiens
MHIDSHEAL

SEQ ID NO: 81184 - protein, 9 aa, Homo Sapiens
MHKDYAVVL

SEQ ID NO: 81185 - protein, 9 aa, Homo Sapiens
MHLATSPIL

SEQ ID NO: 81186 - protein, 9 aa, Homo Sapiens
MHSALDPVL

SEQ ID NO: 81187 - protein, 9 aa, Homo Sapiens
MHSGDIMIM

SEQ ID NO: 81188 - protein, 9 aa, Homo Sapiens
MHSGPVVAM

SEQ ID NO: 81189 - protein, 9 aa, Homo Sapiens
MHSMPAVTL

SEQ ID NO: 81190 - protein, 9 aa, Homo Sapiens
MHSNAIAAM

SEQ ID NO: 81191 - protein, 9 aa, Homo Sapiens
MHSPAGRSV

SEQ ID NO: 81192 - protein, 9 aa, Homo Sapiens
MHSPNIEVV

SEQ ID NO: 81193 - protein, 9 aa, Homo Sapiens
MHSQFHAPL

SEQ ID NO: 81194 - protein, 9 aa, Homo Sapiens
MHVKSEASL

SEQ ID NO: 81195 - protein, 9 aa, Homo Sapiens
MHVLTAPLL

SEQ ID NO: 81196 - protein, 9 aa, Homo Sapiens
MHYPNGHAI

SEQ ID NO: 81197 - protein, 9 aa, Homo Sapiens
MHYPTALLF

SEQ ID NO: 81198 - protein, 9 aa, Homo Sapiens
MPEPASRCL

SEQ ID NO: 81199 - protein, 9 aa, Homo Sapiens
MQALPMGAL

SEQ ID NO: 81200 - protein, 9 aa, Homo Sapiens
MQDPNFHTM

SEQ ID NO: 81201 - protein, 9 aa, Homo Sapiens
MQEKTYRRL

SEQ ID NO: 81202 - protein, 9 aa, Homo Sapiens
NEYAYAAEL

SEQ ID NO: 81203 - protein, 9 aa, Homo Sapiens
NHADIVSCV

SEQ ID NO: 81204 - protein, 9 aa, Homo Sapiens
NHADPNSGL

SEQ ID NO: 81205 - protein, 9 aa, Homo Sapiens
NHADSRASL

SEQ ID NO: 81206 - protein, 9 aa, Homo Sapiens
NHAEKPVTL

SEQ ID NO: 81207 - protein, 9 aa, Homo Sapiens
NHAIVSTSV

SEQ ID NO: 81208 - protein, 9 aa, Homo Sapiens
NHAQSRIAL

SEQ ID NO: 81209 - protein, 9 aa, Homo Sapiens
NHASLISAL

SEQ ID NO: 81210 - protein, 9 aa, Homo Sapiens
NHCMEVIRL

SEQ ID NO: 81211 - protein, 9 aa, Homo Sapiens
NHDIWIKTL

SEQ ID NO: 81212 - protein, 9 aa, Homo Sapiens
NHDTGEYVL

SEQ ID NO: 81213 - protein, 9 aa, Homo Sapiens
NHEDKIRVV

SEQ ID NO: 81214 - protein, 9 aa, Homo Sapiens
NHEDKMRVV

SEQ ID NO: 81215 - protein, 9 aa, Homo Sapiens
NHEKALRLL

SEQ ID NO: 81216 - protein, 9 aa, Homo Sapiens
NHFDRSVVL

SEQ ID NO: 81217 - protein, 9 aa, Homo Sapiens
NHFEKARTL

SEQ ID NO: 81218 - protein, 9 aa, Homo Sapiens
NHFGSSYSV

SEQ ID NO: 81219 - protein, 9 aa, Homo Sapiens
NHFPGSFQI

SEQ ID NO: 81220 - protein, 9 aa, Homo Sapiens
NHHMPKSSL

SEQ ID NO: 81221 - protein, 9 aa, Homo Sapiens
NHIFHTSCL

SEQ ID NO: 81222 - protein, 9 aa, Homo Sapiens
NHIGHTGYL

SEQ ID NO: 81223 - protein, 9 aa, Homo Sapiens
NHIKSSCSL

SEQ ID NO: 81224 - protein, 9 aa, Homo Sapiens
NHIQLSSNL

SEQ ID NO: 81225 - protein, 9 aa, Homo Sapiens
NHISPNSLL

SEQ ID NO: 81226 - protein, 9 aa, Homo Sapiens
NHLDSHILL

SEQ ID NO: 81227 - protein, 9 aa, Homo Sapiens
NHLEKFFTL

SEQ ID NO: 81228 - protein, 9 aa, Homo Sapiens
NHLLDSPSL

SEQ ID NO: 81229 - protein, 9 aa, Homo Sapiens
NHLLHQPTL

SEQ ID NO: 81230 - protein, 9 aa, Homo Sapiens
NHMAVAFVL

SEQ ID NO: 81231 - protein, 9 aa, Homo Sapiens
NHMGSVLAV

SEQ ID NO: 81232 - protein, 9 aa, Homo Sapiens
NHNFSQQCL

SEQ ID NO: 81233 - protein, 9 aa, Homo Sapiens
NHNKITQSL

SEQ ID NO: 81234 - protein, 9 aa, Homo Sapiens
NHQGGSVQL

SEQ ID NO: 81235 - protein, 9 aa, Homo Sapiens
NHQHSPLVL

SEQ ID NO: 81236 - protein, 9 aa, Homo Sapiens
NHSEPRPGL

SEQ ID NO: 81237 - protein, 9 aa, Homo Sapiens
NHSFSSSSL

SEQ ID NO: 81238 - protein, 9 aa, Homo Sapiens
NHSHDQLVL

SEQ ID NO: 81239 - protein, 9 aa, Homo Sapiens
NHSHQTMEL

SEQ ID NO: 81240 - protein, 9 aa, Homo Sapiens
NHTERDPVL

SEQ ID NO: 81241 - protein, 9 aa, Homo Sapiens
NHTIPASSL

SEQ ID NO: 81242 - protein, 9 aa, Homo Sapiens
NHVHVARSL

SEQ ID NO: 81243 - protein, 9 aa, Homo Sapiens
NHVNSGCQL

SEQ ID NO: 81244 - protein, 9 aa, Homo Sapiens
NHVPVITTL

SEQ ID NO: 81245 - protein, 9 aa, Homo Sapiens
NHVRNNQVL

SEQ ID NO: 81246 - protein, 9 aa, Homo Sapiens
NHVSHGEVL

SEQ ID NO: 81247 - protein, 9 aa, Homo Sapiens
NHVTSSPVA

SEQ ID NO: 81248 - protein, 9 aa, Homo Sapiens
NHYNMQYAL

SEQ ID NO: 81249 - protein, 9 aa, Homo Sapiens
NHYNNIMAL

SEQ ID NO: 81250 - protein, 9 aa, Homo Sapiens
NHYQKQLEI

SEQ ID NO: 81251 - protein, 9 aa, Homo Sapiens
NHYSESTEL

SEQ ID NO: 81252 - protein, 9 aa, Homo Sapiens
NQAPSGPVA

SEQ ID NO: 81253 - protein, 9 aa, Homo Sapiens
NQARAQAAL

SEQ ID NO: 81254 - protein, 9 aa, Homo Sapiens
NQQAGAAAL

SEQ ID NO: 81255 - protein, 9 aa, Homo Sapiens
NQSISSPVL

SEQ ID NO: 81256 - protein, 9 aa, Homo Sapiens
NQSKPLIPL

SEQ ID NO: 81257 - protein, 9 aa, Homo Sapiens
NQYYNSKAL

SEQ ID NO: 81258 - protein, 9 aa, Homo Sapiens
NRAPNTAEL

SEQ ID NO: 81259 - protein, 9 aa, Homo Sapiens
NRYDGQVAV

SEQ ID NO: 81260 - protein, 9 aa, Homo Sapiens
PHCSRNPVL

SEQ ID NO: 81261 - protein, 9 aa, Homo Sapiens
QHAASILVL

SEQ ID NO: 81262 - protein, 9 aa, Homo Sapiens
QHAAVSEKL

SEQ ID NO: 81263 - protein, 9 aa, Homo Sapiens
QHADVGKEL

SEQ ID NO: 81264 - protein, 9 aa, Homo Sapiens
QHAERVAAL

SEQ ID NO: 81265 - protein, 9 aa, Homo Sapiens
QHAITGRAL

SEQ ID NO: 81266 - protein, 9 aa, Homo Sapiens
QHALLQEEL

SEQ ID NO: 81267 - protein, 9 aa, Homo Sapiens
QHANLAGTL

SEQ ID NO: 81268 - protein, 9 aa, Homo Sapiens
QHAPKLSAL

SEQ ID NO: 81269 - protein, 9 aa, Homo Sapiens
QHATRFIAL

SEQ ID NO: 81270 - protein, 9 aa, Homo Sapiens
QHAVEAISL

SEQ ID NO: 81271 - protein, 9 aa, Homo Sapiens
QHDAACRVI

SEQ ID NO: 81272 - protein, 9 aa, Homo Sapiens
QHDFQAPYL

SEQ ID NO: 81273 - protein, 9 aa, Homo Sapiens
QHDIHNAKL

SEQ ID NO: 81274 - protein, 9 aa, Homo Sapiens
QHDITGRAL

SEQ ID NO: 81275 - protein, 9 aa, Homo Sapiens
QHDPSAVAV

SEQ ID NO: 81276 - protein, 9 aa, Homo Sapiens
QHDPYITSI

SEQ ID NO: 81277 - protein, 9 aa, Homo Sapiens
QHDYGHLSV

SEQ ID NO: 81278 - protein, 9 aa, Homo Sapiens
QHEESIRKP

SEQ ID NO: 81279 - protein, 9 aa, Homo Sapiens
QHEIESRIL

SEQ ID NO: 81280 - protein, 9 aa, Homo Sapiens
QHEPRTPAL

SEQ ID NO: 81281 - protein, 9 aa, Homo Sapiens
QHETSSPAL

SEQ ID NO: 81282 - protein, 9 aa, Homo Sapiens
QHFDKSKAL

SEQ ID NO: 81283 - protein, 9 aa, Homo Sapiens
QHFDPVIQL

SEQ ID NO: 81284 - protein, 9 aa, Homo Sapiens
QHFDSVMQL

SEQ ID NO: 81285 - protein, 9 aa, Homo Sapiens
QHFNGLLEI

SEQ ID NO: 81286 - protein, 9 aa, Homo Sapiens
QHFNQRIQL

SEQ ID NO: 81287 - protein, 9 aa, Homo Sapiens
QHFPATPLL

SEQ ID NO: 81288 - protein, 9 aa, Homo Sapiens
QHFPEQMKL

SEQ ID NO: 81289 - protein, 9 aa, Homo Sapiens
QHGDVVSAI

SEQ ID NO: 81290 - protein, 9 aa, Homo Sapiens
QHGPLLLTL

SEQ ID NO: 81291 - protein, 9 aa, Homo Sapiens
QHHAKPNIF

SEQ ID NO: 81292 - protein, 9 aa, Homo Sapiens
QHHLPVRAV

SEQ ID NO: 81293 - protein, 9 aa, Homo Sapiens
QHHRPVIAV

SEQ ID NO: 81294 - protein, 9 aa, Homo Sapiens
QHIAQDSSL

SEQ ID NO: 81295 - protein, 9 aa, Homo Sapiens
QHIATVPSL

SEQ ID NO: 81296 - protein, 9 aa, Homo Sapiens
QHICTAYEL

SEQ ID NO: 81297 - protein, 9 aa, Homo Sapiens
QHIDAVARF

SEQ ID NO: 81298 - protein, 9 aa, Homo Sapiens
QHIEESRQL

SEQ ID NO: 81299 - protein, 9 aa, Homo Sapiens
QHIETFLIL

SEQ ID NO: 81300 - protein, 9 aa, Homo Sapiens
QHIGKPSTI

SEQ ID NO: 81301 - protein, 9 aa, Homo Sapiens
QHIGTSAIM

SEQ ID NO: 81302 - protein, 9 aa, Homo Sapiens
QHIIPISAV

SEQ ID NO: 81303 - protein, 9 aa, Homo Sapiens
QHIKSDVHL

SEQ ID NO: 81304 - protein, 9 aa, Homo Sapiens
QHILNPAFL

SEQ ID NO: 81305 - protein, 9 aa, Homo Sapiens
QHISDSPII

SEQ ID NO: 81306 - protein, 9 aa, Homo Sapiens
QHLACARCL

SEQ ID NO: 81307 - protein, 9 aa, Homo Sapiens
QHLACNVRM

SEQ ID NO: 81308 - protein, 9 aa, Homo Sapiens
QHLEKSAVL

SEQ ID NO: 81309 - protein, 9 aa, Homo Sapiens
QHLLSIISL

SEQ ID NO: 81310 - protein, 9 aa, Homo Sapiens
QHLPYIQIL

SEQ ID NO: 81311 - protein, 9 aa, Homo Sapiens
QHLSPLLSL

SEQ ID NO: 81312 - protein, 9 aa, Homo Sapiens
QHLVQQLVL

SEQ ID NO: 81313 - protein, 9 aa, Homo Sapiens
QHMIPENAL

SEQ ID NO: 81314 - protein, 9 aa, Homo Sapiens
QHMMPSQAF

SEQ ID NO: 81315 - protein, 9 aa, Homo Sapiens
QHNIPFPCL

SEQ ID NO: 81316 - protein, 9 aa, Homo Sapiens
QHNYPGIKL

SEQ ID NO: 81317 - protein, 9 aa, Homo Sapiens
QHQESIIQL

SEQ ID NO: 81318 - protein, 9 aa, Homo Sapiens
QHQETINTL

SEQ ID NO: 81319 - protein, 9 aa, Homo Sapiens
QHQETPVYL

SEQ ID NO: 81320 - protein, 9 aa, Homo Sapiens
QHQGVSLTM

SEQ ID NO: 81321 - protein, 9 aa, Homo Sapiens
QHQLQQQQL

SEQ ID NO: 81322 - protein, 9 aa, Homo Sapiens
QHQLSSRRL

SEQ ID NO: 81323 - protein, 9 aa, Homo Sapiens
QHQQTASVL

SEQ ID NO: 81324 - protein, 9 aa, Homo Sapiens
QHQSGIVQL

SEQ ID NO: 81325 - protein, 9 aa, Homo Sapiens
QHSAAGATI

SEQ ID NO: 81326 - protein, 9 aa, Homo Sapiens
QHSAVDPLL

SEQ ID NO: 81327 - protein, 9 aa, Homo Sapiens
QHSDKIIRL

SEQ ID NO: 81328 - protein, 9 aa, Homo Sapiens
QHSIPAVEL

SEQ ID NO: 81329 - protein, 9 aa, Homo Sapiens
QHSLLGPIL

SEQ ID NO: 81330 - protein, 9 aa, Homo Sapiens
QHSPALKAI

SEQ ID NO: 81331 - protein, 9 aa, Homo Sapiens
QHSQAMRCL

SEQ ID NO: 81332 - protein, 9 aa, Homo Sapiens
QHTPTSITL

SEQ ID NO: 81333 - protein, 9 aa, Homo Sapiens
QHVAPVTSV

SEQ ID NO: 81334 - protein, 9 aa, Homo Sapiens
QHVASSPIP

SEQ ID NO: 81335 - protein, 9 aa, Homo Sapiens
QHVFQNLIL

SEQ ID NO: 81336 - protein, 9 aa, Homo Sapiens
QHVGTHSSL

SEQ ID NO: 81337 - protein, 9 aa, Homo Sapiens
QHVSASRVF

SEQ ID NO: 81338 - protein, 9 aa, Homo Sapiens
QHVTTQLVL

SEQ ID NO: 81339 - protein, 9 aa, Homo Sapiens
QHVYPFSSL

SEQ ID NO: 81340 - protein, 9 aa, Homo Sapiens
QQFAHPPLL

SEQ ID NO: 81341 - protein, 9 aa, Homo Sapiens
QQSFTNPTL

SEQ ID NO: 81342 - protein, 9 aa, Homo Sapiens
QQVNPTKAL

SEQ ID NO: 81343 - protein, 9 aa, Homo Sapiens
RHAEPGFSL

SEQ ID NO: 81344 - protein, 9 aa, Homo Sapiens
RHCGALRVL

SEQ ID NO: 81345 - protein, 9 aa, Homo Sapiens
RHDDRPQVL

SEQ ID NO: 81346 - protein, 9 aa, Homo Sapiens
RHETQVRML

SEQ ID NO: 81347 - protein, 9 aa, Homo Sapiens
RHETRIHIL

SEQ ID NO: 81348 - protein, 9 aa, Homo Sapiens
RHFAESETL

SEQ ID NO: 81349 - protein, 9 aa, Homo Sapiens
RHHPTTLAV

SEQ ID NO: 81350 - protein, 9 aa, Homo Sapiens
RHIDPSGKL

SEQ ID NO: 81351 - protein, 9 aa, Homo Sapiens
RHIEIFTDL

SEQ ID NO: 81352 - protein, 9 aa, Homo Sapiens
RHIEWESVL

SEQ ID NO: 81353 - protein, 9 aa, Homo Sapiens
RHKSDSISL

SEQ ID NO: 81354 - protein, 9 aa, Homo Sapiens
RHLDISREL

SEQ ID NO: 81355 - protein, 9 aa, Homo Sapiens
RHMQQQPVV

SEQ ID NO: 81356 - protein, 9 aa, Homo Sapiens
RHVAPGLHL

SEQ ID NO: 81357 - protein, 9 aa, Homo Sapiens
RHVDAHATL

SEQ ID NO: 81358 - protein, 9 aa, Homo Sapiens
RHVLPTTSL

SEQ ID NO: 81359 - protein, 9 aa, Homo Sapiens
RPITDSPVL

SEQ ID NO: 81360 - protein, 9 aa, Homo Sapiens
RPSGPGPEL

SEQ ID NO: 81361 - protein, 9 aa, Homo Sapiens
SHAHEQEEF

SEQ ID NO: 81362 - protein, 9 aa, Homo Sapiens
SHAHPAPPV

SEQ ID NO: 81363 - protein, 9 aa, Homo Sapiens
SHAIEALIL

SEQ ID NO: 81364 - protein, 9 aa, Homo Sapiens
SHAISVICV

SEQ ID NO: 81365 - protein, 9 aa, Homo Sapiens
SHANSAVVL

SEQ ID NO: 81366 - protein, 9 aa, Homo Sapiens
SHAPPAETI

SEQ ID NO: 81367 - protein, 9 aa, Homo Sapiens
SHAPYQPSA

SEQ ID NO: 81368 - protein, 9 aa, Homo Sapiens
SHASPSPVA

SEQ ID NO: 81369 - protein, 9 aa, Homo Sapiens
SHAVAQSVL

SEQ ID NO: 81370 - protein, 9 aa, Homo Sapiens
SHAVFQIIL

SEQ ID NO: 81371 - protein, 9 aa, Homo Sapiens
SHAVQHPVL

SEQ ID NO: 81372 - protein, 9 aa, Homo Sapiens
SHAVSTAAM

SEQ ID NO: 81373 - protein, 9 aa, Homo Sapiens
SHCAQPLAL

SEQ ID NO: 81374 - protein, 9 aa, Homo Sapiens
SHCFTQAML

SEQ ID NO: 81375 - protein, 9 aa, Homo Sapiens
SHDARLVLL

SEQ ID NO: 81376 - protein, 9 aa, Homo Sapiens
SHDAVVREM

SEQ ID NO: 81377 - protein, 9 aa, Homo Sapiens
SHDERFIRL

SEQ ID NO: 81378 - protein, 9 aa, Homo Sapiens
SHDFYSHEL

SEQ ID NO: 81379 - protein, 9 aa, Homo Sapiens
SHDNPSNSL

SEQ ID NO: 81380 - protein, 9 aa, Homo Sapiens
SHEAREKLL

SEQ ID NO: 81381 - protein, 9 aa, Homo Sapiens
SHEEVVQTL

SEQ ID NO: 81382 - protein, 9 aa, Homo Sapiens
SHEGKPLKL

SEQ ID NO: 81383 - protein, 9 aa, Homo Sapiens
SHEINPRKV

SEQ ID NO: 81384 - protein, 9 aa, Homo Sapiens
SHEPKSPSL

SEQ ID NO: 81385 - protein, 9 aa, Homo Sapiens
SHEQAAAAL

SEQ ID NO: 81386 - protein, 9 aa, Homo Sapiens
SHFASSHAL

SEQ ID NO: 81387 - protein, 9 aa, Homo Sapiens
SHFCRSPFL

SEQ ID NO: 81388 - protein, 9 aa, Homo Sapiens
SHFDGIRAL

SEQ ID NO: 81389 - protein, 9 aa, Homo Sapiens
SHFDGVRAL

SEQ ID NO: 81390 - protein, 9 aa, Homo Sapiens
SHFGPGPTL

SEQ ID NO: 81391 - protein, 9 aa, Homo Sapiens
SHFKDYRKL

SEQ ID NO: 81392 - protein, 9 aa, Homo Sapiens
SHFQSISVL

SEQ ID NO: 81393 - protein, 9 aa, Homo Sapiens
SHFSLQPVL

SEQ ID NO: 81394 - protein, 9 aa, Homo Sapiens
SHGGPALSL

SEQ ID NO: 81395 - protein, 9 aa, Homo Sapiens
SHGLPQSTL

SEQ ID NO: 81396 - protein, 9 aa, Homo Sapiens
SHGPAIAAV

SEQ ID NO: 81397 - protein, 9 aa, Homo Sapiens
SHGPPTHRL

SEQ ID NO: 81398 - protein, 9 aa, Homo Sapiens
SHGPVTDAL

SEQ ID NO: 81399 - protein, 9 aa, Homo Sapiens
SHGYPREAL

SEQ ID NO: 81400 - protein, 9 aa, Homo Sapiens
SHHDLAPAL

SEQ ID NO: 81401 - protein, 9 aa, Homo Sapiens
SHHEACVRL

SEQ ID NO: 81402 - protein, 9 aa, Homo Sapiens
SHHLPTSPL

SEQ ID NO: 81403 - protein, 9 aa, Homo Sapiens
SHHPSLVAV

SEQ ID NO: 81404 - protein, 9 aa, Homo Sapiens
SHHSLASSL

SEQ ID NO: 81405 - protein, 9 aa, Homo Sapiens
SHHVKQVLV

SEQ ID NO: 81406 - protein, 9 aa, Homo Sapiens
SHIDKAVLL

SEQ ID NO: 81407 - protein, 9 aa, Homo Sapiens
SHIDKSAWL

SEQ ID NO: 81408 - protein, 9 aa, Homo Sapiens
SHIDRVYTL

SEQ ID NO: 81409 - protein, 9 aa, Homo Sapiens
SHIETKAAV

SEQ ID NO: 81410 - protein, 9 aa, Homo Sapiens
SHIFEVQAL

SEQ ID NO: 81411 - protein, 9 aa, Homo Sapiens
SHIGDAVVI

SEQ ID NO: 81412 - protein, 9 aa, Homo Sapiens
SHIITGNKI

SEQ ID NO: 81413 - protein, 9 aa, Homo Sapiens
SHIKASLAA

SEQ ID NO: 81414 - protein, 9 aa, Homo Sapiens
SHIKKDVTL

SEQ ID NO: 81415 - protein, 9 aa, Homo Sapiens
SHILASNTM

SEQ ID NO: 81416 - protein, 9 aa, Homo Sapiens
SHILPSAAV

SEQ ID NO: 81417 - protein, 9 aa, Homo Sapiens
SHIMAAKAV

SEQ ID NO: 81418 - protein, 9 aa, Homo Sapiens
SHINMKSVV

SEQ ID NO: 81419 - protein, 9 aa, Homo Sapiens
SHINTVFVL

SEQ ID NO: 81420 - protein, 9 aa, Homo Sapiens
SHIPEASFL

SEQ ID NO: 81421 - protein, 9 aa, Homo Sapiens
SHIQESRFL

SEQ ID NO: 81422 - protein, 9 aa, Homo Sapiens
SHISTAGTL

SEQ ID NO: 81423 - protein, 9 aa, Homo Sapiens
SHITPTQGF

SEQ ID NO: 81424 - protein, 9 aa, Homo Sapiens
SHITRAFTV

SEQ ID NO: 81425 - protein, 9 aa, Homo Sapiens
SHKPSGLVM

SEQ ID NO: 81426 - protein, 9 aa, Homo Sapiens
SHKWYAICL

SEQ ID NO: 81427 - protein, 9 aa, Homo Sapiens
SHLDKASVM

SEQ ID NO: 81428 - protein, 9 aa, Homo Sapiens
SHLDRCLLL

SEQ ID NO: 81429 - protein, 9 aa, Homo Sapiens
SHLDYDITL

SEQ ID NO: 81430 - protein, 9 aa, Homo Sapiens
SHLERGVVL

SEQ ID NO: 81431 - protein, 9 aa, Homo Sapiens
SHLPHTVTL

SEQ ID NO: 81432 - protein, 9 aa, Homo Sapiens
SHLPSSPAA

SEQ ID NO: 81433 - protein, 9 aa, Homo Sapiens
SHLSPGKSV

SEQ ID NO: 81434 - protein, 9 aa, Homo Sapiens
SHLSPRPPL

SEQ ID NO: 81435 - protein, 9 aa, Homo Sapiens
SHLTASPKL

SEQ ID NO: 81436 - protein, 9 aa, Homo Sapiens
SHMEPQVCL

SEQ ID NO: 81437 - protein, 9 aa, Homo Sapiens
SHMETTMKL

SEQ ID NO: 81438 - protein, 9 aa, Homo Sapiens
SHMLNNPEL

SEQ ID NO: 81439 - protein, 9 aa, Homo Sapiens
SHMPSRPEL

SEQ ID NO: 81440 - protein, 9 aa, Homo Sapiens
SHMTSTNSV

SEQ ID NO: 81441 - protein, 9 aa, Homo Sapiens
SHMVKSYSL

SEQ ID NO: 81442 - protein, 9 aa, Homo Sapiens
SHMYSASLL

SEQ ID NO: 81443 - protein, 9 aa, Homo Sapiens
SHNERVVAV

SEQ ID NO: 81444 - protein, 9 aa, Homo Sapiens
SHNIKNVVL

SEQ ID NO: 81445 - protein, 9 aa, Homo Sapiens
SHNISSLSM

SEQ ID NO: 81446 - protein, 9 aa, Homo Sapiens
SHNPLANIL

SEQ ID NO: 81447 - protein, 9 aa, Homo Sapiens
SHQARIATL

SEQ ID NO: 81448 - protein, 9 aa, Homo Sapiens
SHQESLSVL

SEQ ID NO: 81449 - protein, 9 aa, Homo Sapiens
SHQGDYAVL

SEQ ID NO: 81450 - protein, 9 aa, Homo Sapiens
SHQIRSLIL

SEQ ID NO: 81451 - protein, 9 aa, Homo Sapiens
SHQPYQTSL

SEQ ID NO: 81452 - protein, 9 aa, Homo Sapiens
SHQSSMTSL

SEQ ID NO: 81453 - protein, 9 aa, Homo Sapiens
SHQTGVVAL

SEQ ID NO: 81454 - protein, 9 aa, Homo Sapiens
SHRPDSPAL

SEQ ID NO: 81455 - protein, 9 aa, Homo Sapiens
SHSASSLSL

SEQ ID NO: 81456 - protein, 9 aa, Homo Sapiens
SHSEAVQEV

SEQ ID NO: 81457 - protein, 9 aa, Homo Sapiens
SHSELIHNL

SEQ ID NO: 81458 - protein, 9 aa, Homo Sapiens
SHSENAISV

SEQ ID NO: 81459 - protein, 9 aa, Homo Sapiens
SHSEWVSCV

SEQ ID NO: 81460 - protein, 9 aa, Homo Sapiens
SHSFVVNIL

SEQ ID NO: 81461 - protein, 9 aa, Homo Sapiens
SHSGPIHVL

SEQ ID NO: 81462 - protein, 9 aa, Homo Sapiens
SHSGPRPGL

SEQ ID NO: 81463 - protein, 9 aa, Homo Sapiens
SHSHEEPAM

SEQ ID NO: 81464 - protein, 9 aa, Homo Sapiens
SHSHVGYTL

SEQ ID NO: 81465 - protein, 9 aa, Homo Sapiens
SHSLAWTAL

SEQ ID NO: 81466 - protein, 9 aa, Homo Sapiens
SHSNSPTAL

SEQ ID NO: 81467 - protein, 9 aa, Homo Sapiens
SHSPAKPVL

SEQ ID NO: 81468 - protein, 9 aa, Homo Sapiens
SHSQRQPLL

SEQ ID NO: 81469 - protein, 9 aa, Homo Sapiens
SHSSFQASL

SEQ ID NO: 81470 - protein, 9 aa, Homo Sapiens
SHSSKIIIV

SEQ ID NO: 81471 - protein, 9 aa, Homo Sapiens
SHSSPSLYL

SEQ ID NO: 81472 - protein, 9 aa, Homo Sapiens
SHSSSFLSL

SEQ ID NO: 81473 - protein, 9 aa, Homo Sapiens
SHSSSVSPL

SEQ ID NO: 81474 - protein, 9 aa, Homo Sapiens
SHSSVILKM

SEQ ID NO: 81475 - protein, 9 aa, Homo Sapiens
SHSSVSSCL

SEQ ID NO: 81476 - protein, 9 aa, Homo Sapiens
SHSTPSSSI

SEQ ID NO: 81477 - protein, 9 aa, Homo Sapiens
SHSVTASAL

SEQ ID NO: 81478 - protein, 9 aa, Homo Sapiens
SHTDCILAV

SEQ ID NO: 81479 - protein, 9 aa, Homo Sapiens
SHTDVVPVF

SEQ ID NO: 81480 - protein, 9 aa, Homo Sapiens
SHTEYIIRV

SEQ ID NO: 81481 - protein, 9 aa, Homo Sapiens
SHTHVSVVI

SEQ ID NO: 81482 - protein, 9 aa, Homo Sapiens
SHTPWIVII

SEQ ID NO: 81483 - protein, 9 aa, Homo Sapiens
SHTSVGNIL

SEQ ID NO: 81484 - protein, 9 aa, Homo Sapiens
SHVAKAPSL

SEQ ID NO: 81485 - protein, 9 aa, Homo Sapiens
SHVLQNSTL

SEQ ID NO: 81486 - protein, 9 aa, Homo Sapiens
SHVNSGCQL

SEQ ID NO: 81487 - protein, 9 aa, Homo Sapiens
SHVPYPVAL

SEQ ID NO: 81488 - protein, 9 aa, Homo Sapiens
SHVRVTRAL

SEQ ID NO: 81489 - protein, 9 aa, Homo Sapiens
SHVSGTTTL

SEQ ID NO: 81490 - protein, 9 aa, Homo Sapiens
SHVTNAMVL

SEQ ID NO: 81491 - protein, 9 aa, Homo Sapiens
SHYDGIRSL

SEQ ID NO: 81492 - protein, 9 aa, Homo Sapiens
SHYEEAMGL

SEQ ID NO: 81493 - protein, 9 aa, Homo Sapiens
SHYERVQML

SEQ ID NO: 81494 - protein, 9 aa, Homo Sapiens
SHYFQSLEV

SEQ ID NO: 81495 - protein, 9 aa, Homo Sapiens
SHYIGTKSM

SEQ ID NO: 81496 - protein, 9 aa, Homo Sapiens
SHYLESRSI

SEQ ID NO: 81497 - protein, 9 aa, Homo Sapiens
SHYLFSEEI

SEQ ID NO: 81498 - protein, 9 aa, Homo Sapiens
SHYLGTLKV

SEQ ID NO: 81499 - protein, 9 aa, Homo Sapiens
SHYPPSIIL

SEQ ID NO: 81500 - protein, 9 aa, Homo Sapiens
SHYPYAEEV

SEQ ID NO: 81501 - protein, 9 aa, Homo Sapiens
SHYQYHLRL

SEQ ID NO: 81502 - protein, 9 aa, Homo Sapiens
SHYTTPMVL

SEQ ID NO: 81503 - protein, 9 aa, Homo Sapiens
SPIEKSGVL

SEQ ID NO: 81504 - protein, 9 aa, Homo Sapiens
SQAGGAPTL

SEQ ID NO: 81505 - protein, 9 aa, Homo Sapiens
SQDPGTHVV

SEQ ID NO: 81506 - protein, 9 aa, Homo Sapiens
SQDYGKHLL

SEQ ID NO: 81507 - protein, 9 aa, Homo Sapiens
SQSPPSPEL

SEQ ID NO: 81508 - protein, 9 aa, Homo Sapiens
SQTRNAPEL

SEQ ID NO: 81509 - protein, 9 aa, Homo Sapiens
SQYPFPVTL

SEQ ID NO: 81510 - protein, 9 aa, Homo Sapiens
SRISSSPTL

SEQ ID NO: 81511 - protein, 9 aa, Homo Sapiens
SRVGSDPVL

SEQ ID NO: 81512 - protein, 9 aa, Homo Sapiens
SRYDGQIAV

SEQ ID NO: 81513 - protein, 9 aa, Homo Sapiens
SRYYRAPEI

SEQ ID NO: 81514 - protein, 9 aa, Homo Sapiens
TDAHTVLAL

SEQ ID NO: 81515 - protein, 9 aa, Homo Sapiens
TEIERSPLL

SEQ ID NO: 81516 - protein, 9 aa, Homo Sapiens
THAAQQILL

SEQ ID NO: 81517 - protein, 9 aa, Homo Sapiens
THAAQQLKL

SEQ ID NO: 81518 - protein, 9 aa, Homo Sapiens
THADYVLEM

SEQ ID NO: 81519 - protein, 9 aa, Homo Sapiens
THAEAVKAL

SEQ ID NO: 81520 - protein, 9 aa, Homo Sapiens
THAEVHQSL

SEQ ID NO: 81521 - protein, 9 aa, Homo Sapiens
THAGAHLDL

SEQ ID NO: 81522 - protein, 9 aa, Homo Sapiens
THALEWPSL

SEQ ID NO: 81523 - protein, 9 aa, Homo Sapiens
THALLSVLL

SEQ ID NO: 81524 - protein, 9 aa, Homo Sapiens
THALPIPVI

SEQ ID NO: 81525 - protein, 9 aa, Homo Sapiens
THALQWPSL

SEQ ID NO: 81526 - protein, 9 aa, Homo Sapiens
THAMTFTAV

SEQ ID NO: 81527 - protein, 9 aa, Homo Sapiens
THANALTVM

SEQ ID NO: 81528 - protein, 9 aa, Homo Sapiens
THANDASAL

SEQ ID NO: 81529 - protein, 9 aa, Homo Sapiens
THANYKVTL

SEQ ID NO: 81530 - protein, 9 aa, Homo Sapiens
THAPATLEA

SEQ ID NO: 81531 - protein, 9 aa, Homo Sapiens
THAYSRVVL

SEQ ID NO: 81532 - protein, 9 aa, Homo Sapiens
THCLWTDQL

SEQ ID NO: 81533 - protein, 9 aa, Homo Sapiens
THCPDTPLL

SEQ ID NO: 81534 - protein, 9 aa, Homo Sapiens
THDGARVAM

SEQ ID NO: 81535 - protein, 9 aa, Homo Sapiens
THDGSILIV

SEQ ID NO: 81536 - protein, 9 aa, Homo Sapiens
THDIHALIL

SEQ ID NO: 81537 - protein, 9 aa, Homo Sapiens
THDLRIHQL

SEQ ID NO: 81538 - protein, 9 aa, Homo Sapiens
THDLVGPEL

SEQ ID NO: 81539 - protein, 9 aa, Homo Sapiens
THDPRTVTL

SEQ ID NO: 81540 - protein, 9 aa, Homo Sapiens
THEAGVHSV

SEQ ID NO: 81541 - protein, 9 aa, Homo Sapiens
THEDAVAAM

SEQ ID NO: 81542 - protein, 9 aa, Homo Sapiens
THEDPVIAV

SEQ ID NO: 81543 - protein, 9 aa, Homo Sapiens
THFESKTEL

SEQ ID NO: 81544 - protein, 9 aa, Homo Sapiens
THFFKVLIL

SEQ ID NO: 81545 - protein, 9 aa, Homo Sapiens
THFIQAGLL

SEQ ID NO: 81546 - protein, 9 aa, Homo Sapiens
THFLKAARL

SEQ ID NO: 81547 - protein, 9 aa, Homo Sapiens
THFLQPIYL

SEQ ID NO: 81548 - protein, 9 aa, Homo Sapiens
THFPFAIRV

SEQ ID NO: 81549 - protein, 9 aa, Homo Sapiens
THFPRVYGV

SEQ ID NO: 81550 - protein, 9 aa, Homo Sapiens
THFQLAYRL

SEQ ID NO: 81551 - protein, 9 aa, Homo Sapiens
THFSFPLRL

SEQ ID NO: 81552 - protein, 9 aa, Homo Sapiens
THFVDSEKL

SEQ ID NO: 81553 - protein, 9 aa, Homo Sapiens
THGHVGADL

SEQ ID NO: 81554 - protein, 9 aa, Homo Sapiens
THGPENPKL

SEQ ID NO: 81555 - protein, 9 aa, Homo Sapiens
THGPFEAVM

SEQ ID NO: 81556 - protein, 9 aa, Homo Sapiens
THGRVRLLL

SEQ ID NO: 81557 - protein, 9 aa, Homo Sapiens
THGTPADVL

SEQ ID NO: 81558 - protein, 9 aa, Homo Sapiens
THHAARVSL

SEQ ID NO: 81559 - protein, 9 aa, Homo Sapiens
THHLTAAAL

SEQ ID NO: 81560 - protein, 9 aa, Homo Sapiens
THIESCRQL

SEQ ID NO: 81561 - protein, 9 aa, Homo Sapiens
THILASNTM

SEQ ID NO: 81562 - protein, 9 aa, Homo Sapiens
THILRATKL

SEQ ID NO: 81563 - protein, 9 aa, Homo Sapiens
THIMKSADV

SEQ ID NO: 81564 - protein, 9 aa, Homo Sapiens
THINGESVL

SEQ ID NO: 81565 - protein, 9 aa, Homo Sapiens
THIPSGKCL

SEQ ID NO: 81566 - protein, 9 aa, Homo Sapiens
THISPNAIF

SEQ ID NO: 81567 - protein, 9 aa, Homo Sapiens
THITAQTAV

SEQ ID NO: 81568 - protein, 9 aa, Homo Sapiens
THIVVGHPL

SEQ ID NO: 81569 - protein, 9 aa, Homo Sapiens
THKFLAQIL

SEQ ID NO: 81570 - protein, 9 aa, Homo Sapiens
THLGGQPTL

SEQ ID NO: 81571 - protein, 9 aa, Homo Sapiens
THLIGSPFL

SEQ ID NO: 81572 - protein, 9 aa, Homo Sapiens
THLKQQLAL

SEQ ID NO: 81573 - protein, 9 aa, Homo Sapiens
THLLRLLVL

SEQ ID NO: 81574 - protein, 9 aa, Homo Sapiens
THLLRNPHL

SEQ ID NO: 81575 - protein, 9 aa, Homo Sapiens
THLPESPKL

SEQ ID NO: 81576 - protein, 9 aa, Homo Sapiens
THLPQTLTI

SEQ ID NO: 81577 - protein, 9 aa, Homo Sapiens
THLQTAPEL

SEQ ID NO: 81578 - protein, 9 aa, Homo Sapiens
THMELYSQL

SEQ ID NO: 81579 - protein, 9 aa, Homo Sapiens
THMENQAVV

SEQ ID NO: 81580 - protein, 9 aa, Homo Sapiens
THMNSSEKL

SEQ ID NO: 81581 - protein, 9 aa, Homo Sapiens
THMPSVVGV

SEQ ID NO: 81582 - protein, 9 aa, Homo Sapiens
THMSPSWTL

SEQ ID NO: 81583 - protein, 9 aa, Homo Sapiens
THMTAIVGM

SEQ ID NO: 81584 - protein, 9 aa, Homo Sapiens
THMVCRTAL

SEQ ID NO: 81585 - protein, 9 aa, Homo Sapiens
THNDSVVIV

SEQ ID NO: 81586 - protein, 9 aa, Homo Sapiens
THNEPGVRL

SEQ ID NO: 81587 - protein, 9 aa, Homo Sapiens
THNESVSAL

SEQ ID NO: 81588 - protein, 9 aa, Homo Sapiens
THNLGIPVL

SEQ ID NO: 81589 - protein, 9 aa, Homo Sapiens
THNPHQLHV

SEQ ID NO: 81590 - protein, 9 aa, Homo Sapiens
THNPQAPVL

SEQ ID NO: 81591 - protein, 9 aa, Homo Sapiens
THNPTNATL

SEQ ID NO: 81592 - protein, 9 aa, Homo Sapiens
THQAAHIQL

SEQ ID NO: 81593 - protein, 9 aa, Homo Sapiens
THQEAVSAL

SEQ ID NO: 81594 - protein, 9 aa, Homo Sapiens
THQKQISSL

SEQ ID NO: 81595 - protein, 9 aa, Homo Sapiens
THQPARYSL

SEQ ID NO: 81596 - protein, 9 aa, Homo Sapiens
THQPWFQVL

SEQ ID NO: 81597 - protein, 9 aa, Homo Sapiens
THQQGQPAL

SEQ ID NO: 81598 - protein, 9 aa, Homo Sapiens
THQQKVLRL

SEQ ID NO: 81599 - protein, 9 aa, Homo Sapiens
THQSGSLAL

SEQ ID NO: 81600 - protein, 9 aa, Homo Sapiens
THREDSVSL

SEQ ID NO: 81601 - protein, 9 aa, Homo Sapiens
THSDIQVKL

SEQ ID NO: 81602 - protein, 9 aa, Homo Sapiens
THSDQFLVA

SEQ ID NO: 81603 - protein, 9 aa, Homo Sapiens
THSEPLSTI

SEQ ID NO: 81604 - protein, 9 aa, Homo Sapiens
THSKAVEAL

SEQ ID NO: 81605 - protein, 9 aa, Homo Sapiens
THSLETQEL

SEQ ID NO: 81606 - protein, 9 aa, Homo Sapiens
THSLFFRSL

SEQ ID NO: 81607 - protein, 9 aa, Homo Sapiens
THSLPVVVI

SEQ ID NO: 81608 - protein, 9 aa, Homo Sapiens
THSLTTPVV

SEQ ID NO: 81609 - protein, 9 aa, Homo Sapiens
THSNMANAL

SEQ ID NO: 81610 - protein, 9 aa, Homo Sapiens
THSPAGTSV

SEQ ID NO: 81611 - protein, 9 aa, Homo Sapiens
THSPSNAQF

SEQ ID NO: 81612 - protein, 9 aa, Homo Sapiens
THSPSSSSI

SEQ ID NO: 81613 - protein, 9 aa, Homo Sapiens
THSPWFTSL

SEQ ID NO: 81614 - protein, 9 aa, Homo Sapiens
THSPYVAQI

SEQ ID NO: 81615 - protein, 9 aa, Homo Sapiens
THSSPSFNL

SEQ ID NO: 81616 - protein, 9 aa, Homo Sapiens
THSSVNRVL

SEQ ID NO: 81617 - protein, 9 aa, Homo Sapiens
THSTVRVSV

SEQ ID NO: 81618 - protein, 9 aa, Homo Sapiens
THTAQQAEL

SEQ ID NO: 81619 - protein, 9 aa, Homo Sapiens
THTDPVSQV

SEQ ID NO: 81620 - protein, 9 aa, Homo Sapiens
THTETGKVL

SEQ ID NO: 81621 - protein, 9 aa, Homo Sapiens
THTPSGLTV

SEQ ID NO: 81622 - protein, 9 aa, Homo Sapiens
THTQPGVQL

SEQ ID NO: 81623 - protein, 9 aa, Homo Sapiens
THTTVIHQL

SEQ ID NO: 81624 - protein, 9 aa, Homo Sapiens
THVERVLSL

SEQ ID NO: 81625 - protein, 9 aa, Homo Sapiens
THVFVIAEL

SEQ ID NO: 81626 - protein, 9 aa, Homo Sapiens
THVGPTPAI

SEQ ID NO: 81627 - protein, 9 aa, Homo Sapiens
THVGSAAAL

SEQ ID NO: 81628 - protein, 9 aa, Homo Sapiens
THVNTGRNL

SEQ ID NO: 81629 - protein, 9 aa, Homo Sapiens
THVSNGCQL

SEQ ID NO: 81630 - protein, 9 aa, Homo Sapiens
THYDPPRKL

SEQ ID NO: 81631 - protein, 9 aa, Homo Sapiens
THYFSCTML

SEQ ID NO: 81632 - protein, 9 aa, Homo Sapiens
THYGKVYLL

SEQ ID NO: 81633 - protein, 9 aa, Homo Sapiens
THYHLSSQV

SEQ ID NO: 81634 - protein, 9 aa, Homo Sapiens
TQAPGNPVL

SEQ ID NO: 81635 - protein, 9 aa, Homo Sapiens
TQAPPNVVL

SEQ ID NO: 81636 - protein, 9 aa, Homo Sapiens
TQAPPSVIL

SEQ ID NO: 81637 - protein, 9 aa, Homo Sapiens
TQEEKTRLL

SEQ ID NO: 81638 - protein, 9 aa, Homo Sapiens
TQMPDPKTF

SEQ ID NO: 81639 - protein, 9 aa, Homo Sapiens
TQMPHYSVL

SEQ ID NO: 81640 - protein, 9 aa, Homo Sapiens
TQYSKVLAL

SEQ ID NO: 81641 - protein, 9 aa, Homo Sapiens
TRAPPSAVA

SEQ ID NO: 81642 - protein, 9 aa, Homo Sapiens
TREAGVRSL

SEQ ID NO: 81643 - protein, 9 aa, Homo Sapiens
TRIEQNLVL

SEQ ID NO: 81644 - protein, 9 aa, Homo Sapiens
TRIGLAPVL

SEQ ID NO: 81645 - protein, 9 aa, Homo Sapiens
TRISNDLEL

SEQ ID NO: 81646 - protein, 9 aa, Homo Sapiens
TRLQHQTEL

SEQ ID NO: 81647 - protein, 9 aa, Homo Sapiens
VHAQIVSTL

SEQ ID NO: 81648 - protein, 9 aa, Homo Sapiens
VHAYIISSL

SEQ ID NO: 81649 - protein, 9 aa, Homo Sapiens
VHDLPAAVL

SEQ ID NO: 81650 - protein, 9 aa, Homo Sapiens
VHEEHVRMV

SEQ ID NO: 81651 - protein, 9 aa, Homo Sapiens
VHFEESSKL

SEQ ID NO: 81652 - protein, 9 aa, Homo Sapiens
VHFHPSVAL

SEQ ID NO: 81653 - protein, 9 aa, Homo Sapiens
VHFIDAPSL

SEQ ID NO: 81654 - protein, 9 aa, Homo Sapiens
VHFIKPLLL

SEQ ID NO: 81655 - protein, 9 aa, Homo Sapiens
VHFSGKLLL

SEQ ID NO: 81656 - protein, 9 aa, Homo Sapiens
VHFSKVRSL

SEQ ID NO: 81657 - protein, 9 aa, Homo Sapiens
VHHVQLESL

SEQ ID NO: 81658 - protein, 9 aa, Homo Sapiens
VHIHPSSAL

SEQ ID NO: 81659 - protein, 9 aa, Homo Sapiens
VHINHQPFL

SEQ ID NO: 81660 - protein, 9 aa, Homo Sapiens
VHINHQPYL

SEQ ID NO: 81661 - protein, 9 aa, Homo Sapiens
VHIPGARCL

SEQ ID NO: 81662 - protein, 9 aa, Homo Sapiens
VHISRVKSV

SEQ ID NO: 81663 - protein, 9 aa, Homo Sapiens
VHIVRSTSL

SEQ ID NO: 81664 - protein, 9 aa, Homo Sapiens
VHKPGPIVL

SEQ ID NO: 81665 - protein, 9 aa, Homo Sapiens
VHLERTPKL

SEQ ID NO: 81666 - protein, 9 aa, Homo Sapiens
VHLKFSAKL

SEQ ID NO: 81667 - protein, 9 aa, Homo Sapiens
VHMDVVELL

SEQ ID NO: 81668 - protein, 9 aa, Homo Sapiens
VHMPKHPEL

SEQ ID NO: 81669 - protein, 9 aa, Homo Sapiens
VHQPWASLL

SEQ ID NO: 81670 - protein, 9 aa, Homo Sapiens
VHSAERLAL

SEQ ID NO: 81671 - protein, 9 aa, Homo Sapiens
VHSEQVFAL

SEQ ID NO: 81672 - protein, 9 aa, Homo Sapiens
VHSPHAIVV

SEQ ID NO: 81673 - protein, 9 aa, Homo Sapiens
VHSPTFCQL

SEQ ID NO: 81674 - protein, 9 aa, Homo Sapiens
VHSPYMQCL

SEQ ID NO: 81675 - protein, 9 aa, Homo Sapiens
VHSSLSSVL

SEQ ID NO: 81676 - protein, 9 aa, Homo Sapiens
VHTDKSLTL

SEQ ID NO: 81677 - protein, 9 aa, Homo Sapiens
VHVNTSAVL

SEQ ID NO: 81678 - protein, 9 aa, Homo Sapiens
VHYGHSNQL

SEQ ID NO: 81679 - protein, 9 aa, Homo Sapiens
VHYHPSKVA

SEQ ID NO: 81680 - protein, 9 aa, Homo Sapiens
VHYKYTVVM

SEQ ID NO: 81681 - protein, 9 aa, Homo Sapiens
VHYTLPASL

SEQ ID NO: 81682 - protein, 9 aa, Homo Sapiens
WHAPPVTTY

SEQ ID NO: 81683 - protein, 9 aa, Homo Sapiens
WHDGKQVHL

SEQ ID NO: 81684 - protein, 9 aa, Homo Sapiens
WHEEVLRQL

SEQ ID NO: 81685 - protein, 9 aa, Homo Sapiens
WHHGPPAVL

SEQ ID NO: 81686 - protein, 9 aa, Homo Sapiens
WHIDTILHV

SEQ ID NO: 81687 - protein, 9 aa, Homo Sapiens
WHNHLNPEV

SEQ ID NO: 81688 - protein, 9 aa, Homo Sapiens
WHNRVGQIL

SEQ ID NO: 81689 - protein, 9 aa, Homo Sapiens
WHQLTLQVL

SEQ ID NO: 81690 - protein, 9 aa, Homo Sapiens
WHSFTQPRL

SEQ ID NO: 81691 - protein, 9 aa, Homo Sapiens
WHVPEHAVV

SEQ ID NO: 81692 - protein, 9 aa, Homo Sapiens
WHWDTTQSL

SEQ ID NO: 81693 - protein, 9 aa, Homo Sapiens
WHYSHPPLL

SEQ ID NO: 81694 - protein, 9 aa, Homo Sapiens
WPHQPIENL

SEQ ID NO: 81695 - protein, 9 aa, Homo Sapiens
WQYRQLSAL

SEQ ID NO: 81696 - protein, 9 aa, Homo Sapiens
WRDPDEPVL

SEQ ID NO: 81697 - protein, 9 aa, Homo Sapiens
YHADIYDKV

SEQ ID NO: 81698 - protein, 9 aa, Homo Sapiens
YHAETIKNV

SEQ ID NO: 81699 - protein, 9 aa, Homo Sapiens
YHAGKCLSL

SEQ ID NO: 81700 - protein, 9 aa, Homo Sapiens
YHAHFVSML

SEQ ID NO: 81701 - protein, 9 aa, Homo Sapiens
YHAIPSMSH

SEQ ID NO: 81702 - protein, 9 aa, Homo Sapiens
YHALASFVF

SEQ ID NO: 81703 - protein, 9 aa, Homo Sapiens
YHALPATVW

SEQ ID NO: 81704 - protein, 9 aa, Homo Sapiens
YHANPRLWL

SEQ ID NO: 81705 - protein, 9 aa, Homo Sapiens
YHAPPLSAI

SEQ ID NO: 81706 - protein, 9 aa, Homo Sapiens
YHASLNRAL

SEQ ID NO: 81707 - protein, 9 aa, Homo Sapiens
YHDINVYSL

SEQ ID NO: 81708 - protein, 9 aa, Homo Sapiens
YHDKNIVLL

SEQ ID NO: 81709 - protein, 9 aa, Homo Sapiens
YHDSRIHVC

SEQ ID NO: 81710 - protein, 9 aa, Homo Sapiens
YHDYGHLEL

SEQ ID NO: 81711 - protein, 9 aa, Homo Sapiens
YHEEKERLM

SEQ ID NO: 81712 - protein, 9 aa, Homo Sapiens
YHEGSAPAL

SEQ ID NO: 81713 - protein, 9 aa, Homo Sapiens
YHESGHAII

SEQ ID NO: 81714 - protein, 9 aa, Homo Sapiens
YHFIGSLAV

SEQ ID NO: 81715 - protein, 9 aa, Homo Sapiens
YHFPDQQEL

SEQ ID NO: 81716 - protein, 9 aa, Homo Sapiens
YHFQKTFTV

SEQ ID NO: 81717 - protein, 9 aa, Homo Sapiens
YHGDAGDSL

SEQ ID NO: 81718 - protein, 9 aa, Homo Sapiens
YHGDSDLQL

SEQ ID NO: 81719 - protein, 9 aa, Homo Sapiens
YHGDSVASL

SEQ ID NO: 81720 - protein, 9 aa, Homo Sapiens
YHGNTNPEL

SEQ ID NO: 81721 - protein, 9 aa, Homo Sapiens
YHGPKALKV

SEQ ID NO: 81722 - protein, 9 aa, Homo Sapiens
YHHGEQALM

SEQ ID NO: 81723 - protein, 9 aa, Homo Sapiens
YHHRFPQAL

SEQ ID NO: 81724 - protein, 9 aa, Homo Sapiens
YHIDGARFL

SEQ ID NO: 81725 - protein, 9 aa, Homo Sapiens
YHIDLDPHF

SEQ ID NO: 81726 - protein, 9 aa, Homo Sapiens
YHIGHFSLV

SEQ ID NO: 81727 - protein, 9 aa, Homo Sapiens
YHILNDPEL

SEQ ID NO: 81728 - protein, 9 aa, Homo Sapiens
YHILRDPEL

SEQ ID NO: 81729 - protein, 9 aa, Homo Sapiens
YHIPQNSSL

SEQ ID NO: 81730 - protein, 9 aa, Homo Sapiens
YHIQQNEAL

SEQ ID NO: 81731 - protein, 9 aa, Homo Sapiens
YHIQRTIHL

SEQ ID NO: 81732 - protein, 9 aa, Homo Sapiens
YHISVQNMM

SEQ ID NO: 81733 - protein, 9 aa, Homo Sapiens
YHKEQAAQL

SEQ ID NO: 81734 - protein, 9 aa, Homo Sapiens
YHLLHIIII

SEQ ID NO: 81735 - protein, 9 aa, Homo Sapiens
YHMDALIGV

SEQ ID NO: 81736 - protein, 9 aa, Homo Sapiens
YHMDHHRYL

SEQ ID NO: 81737 - protein, 9 aa, Homo Sapiens
YHMNYFLVL

SEQ ID NO: 81738 - protein, 9 aa, Homo Sapiens
YHNPKIALL

SEQ ID NO: 81739 - protein, 9 aa, Homo Sapiens
YHNQSQGLL

SEQ ID NO: 81740 - protein, 9 aa, Homo Sapiens
YHNVKPAAL

SEQ ID NO: 81741 - protein, 9 aa, Homo Sapiens
YHQDAFMQL

SEQ ID NO: 81742 - protein, 9 aa, Homo Sapiens
YHQGKISSL

SEQ ID NO: 81743 - protein, 9 aa, Homo Sapiens
YHQHFAAHL

SEQ ID NO: 81744 - protein, 9 aa, Homo Sapiens
YHQHFDSVM

SEQ ID NO: 81745 - protein, 9 aa, Homo Sapiens
YHQKSVLIM

SEQ ID NO: 81746 - protein, 9 aa, Homo Sapiens
YHQSEALAL

SEQ ID NO: 81747 - protein, 9 aa, Homo Sapiens
YHQVTRAVL

SEQ ID NO: 81748 - protein, 9 aa, Homo Sapiens
YHSENPRAL

SEQ ID NO: 81749 - protein, 9 aa, Homo Sapiens
YHSEVPVSL

SEQ ID NO: 81750 - protein, 9 aa, Homo Sapiens
YHSEYFLAL

SEQ ID NO: 81751 - protein, 9 aa, Homo Sapiens
YHSFVSSVF

SEQ ID NO: 81752 - protein, 9 aa, Homo Sapiens
YHSNQVVRM

SEQ ID NO: 81753 - protein, 9 aa, Homo Sapiens
YHSPADRVM

SEQ ID NO: 81754 - protein, 9 aa, Homo Sapiens
YHSVGDSVL

SEQ ID NO: 81755 - protein, 9 aa, Homo Sapiens
YHTFRPAVL

SEQ ID NO: 81756 - protein, 9 aa, Homo Sapiens
YHTQTTPLI

SEQ ID NO: 81757 - protein, 9 aa, Homo Sapiens
YHTVAGNDI

SEQ ID NO: 81758 - protein, 9 aa, Homo Sapiens
YHVDSLLQL

SEQ ID NO: 81759 - protein, 9 aa, Homo Sapiens
YHVPSGKIL

SEQ ID NO: 81760 - protein, 9 aa, Homo Sapiens
YHYFSKMKA

SEQ ID NO: 81761 - protein, 9 aa, Homo Sapiens
YHYGTLSLL

SEQ ID NO: 81762 - protein, 9 aa, Homo Sapiens
YHYKSKVRV

SEQ ID NO: 81763 - protein, 9 aa, Homo Sapiens
YHYLLDPKI

SEQ ID NO: 81764 - protein, 9 aa, Homo Sapiens
YHYQKVAVH

SEQ ID NO: 81765 - protein, 9 aa, Homo Sapiens
YPYPYPHTL

SEQ ID NO: 81766 - protein, 9 aa, Homo Sapiens
YQAEAREAL

SEQ ID NO: 81767 - protein, 9 aa, Homo Sapiens
YQEKGVRVL

SEQ ID NO: 81768 - protein, 9 aa, Homo Sapiens
YQSKRQPIL

SEQ ID NO: 81769 - protein, 9 aa, Homo Sapiens
YQYLLVTAL

SEQ ID NO: 81770 - protein, 9 aa, Homo Sapiens
YRAPASAAA

SEQ ID NO: 81771 - protein, 10 aa, Homo Sapiens
AHADPTELAL

SEQ ID NO: 81772 - protein, 10 aa, Homo Sapiens
AHALPAQVAF

SEQ ID NO: 81773 - protein, 10 aa, Homo Sapiens
AHAPLTNIPL

SEQ ID NO: 81774 - protein, 10 aa, Homo Sapiens
AHCAHVFTTV

SEQ ID NO: 81775 - protein, 10 aa, Homo Sapiens
AHCHQHGLVL

SEQ ID NO: 81776 - protein, 10 aa, Homo Sapiens
AHFPGLASEL

SEQ ID NO: 81777 - protein, 10 aa, Homo Sapiens
AHIDGDHLTL

SEQ ID NO: 81778 - protein, 10 aa, Homo Sapiens
AHIDSGKTTL

SEQ ID NO: 81779 - protein, 10 aa, Homo Sapiens
AHIEKDFIAF

SEQ ID NO: 81780 - protein, 10 aa, Homo Sapiens
AHISSSAVAM

SEQ ID NO: 81781 - protein, 10 aa, Homo Sapiens
AHQQSIPAVL

SEQ ID NO: 81782 - protein, 10 aa, Homo Sapiens
AHSGFPEIAF

SEQ ID NO: 81783 - protein, 10 aa, Homo Sapiens
AHYQRADFVL

SEQ ID NO: 81784 - protein, 10 aa, Homo Sapiens
APAPAEKTPV

SEQ ID NO: 81785 - protein, 10 aa, Homo Sapiens
DHIRPGPCRL

SEQ ID NO: 81786 - protein, 10 aa, Homo Sapiens
DHNKNDKILP

SEQ ID NO: 81787 - protein, 10 aa, Homo Sapiens
FHARPGLSTL

SEQ ID NO: 81788 - protein, 10 aa, Homo Sapiens
FHGPPEPVLL

SEQ ID NO: 81789 - protein, 10 aa, Homo Sapiens
FHHEASGVTV

SEQ ID NO: 81790 - protein, 10 aa, Homo Sapiens
FHIAGDNNPL

SEQ ID NO: 81791 - protein, 10 aa, Homo Sapiens
FHIQAQKLGL

SEQ ID NO: 81792 - protein, 10 aa, Homo Sapiens
FHITVGKAIP

SEQ ID NO: 81793 - protein, 10 aa, Homo Sapiens
FHMDPSGTFV

SEQ ID NO: 81794 - protein, 10 aa, Homo Sapiens
FHNPHVNPLP

SEQ ID NO: 81795 - protein, 10 aa, Homo Sapiens
FHVEPGLQRL

SEQ ID NO: 81796 - protein, 10 aa, Homo Sapiens
FHVINTGNSM

SEQ ID NO: 81797 - protein, 10 aa, Homo Sapiens
GAHHGPGVLG

SEQ ID NO: 81798 - protein, 10 aa, Homo Sapiens
GHAPFTATSL

SEQ ID NO: 81799 - protein, 10 aa, Homo Sapiens
GHDPRAQGTL

SEQ ID NO: 81800 - protein, 10 aa, Homo Sapiens
GHDPRTAVQL

SEQ ID NO: 81801 - protein, 10 aa, Homo Sapiens
GHIDSGKTAL

SEQ ID NO: 81802 - protein, 10 aa, Homo Sapiens
GHMSTTGCVL

SEQ ID NO: 81803 - protein, 10 aa, Homo Sapiens
GHVDAGKSTI

SEQ ID NO: 81804 - protein, 10 aa, Homo Sapiens
GPYGGGGQYF

SEQ ID NO: 81805 - protein, 10 aa, Homo Sapiens
GRSPSPKTSL

SEQ ID NO: 81806 - protein, 10 aa, Homo Sapiens
HHAAAPAVSL

SEQ ID NO: 81807 - protein, 10 aa, Homo Sapiens
HHADDSFLVL

SEQ ID NO: 81808 - protein, 10 aa, Homo Sapiens
HHANFPQYVM

SEQ ID NO: 81809 - protein, 10 aa, Homo Sapiens
HHASLKGHAL

SEQ ID NO: 81810 - protein, 10 aa, Homo Sapiens
HHCPDVPILL

SEQ ID NO: 81811 - protein, 10 aa, Homo Sapiens
HHCPHTPILL

SEQ ID NO: 81812 - protein, 10 aa, Homo Sapiens
HHCPNTPIIL

SEQ ID NO: 81813 - protein, 10 aa, Homo Sapiens
HHCPSTPIIL

SEQ ID NO: 81814 - protein, 10 aa, Homo Sapiens
HHDSHSSVIL

SEQ ID NO: 81815 - protein, 10 aa, Homo Sapiens
HHEDNLLRQL

SEQ ID NO: 81816 - protein, 10 aa, Homo Sapiens
HHELHAAHLL

SEQ ID NO: 81817 - protein, 10 aa, Homo Sapiens
HHFGSSGMTL

SEQ ID NO: 81818 - protein, 10 aa, Homo Sapiens
HHHHPPMIAL

SEQ ID NO: 81819 - protein, 10 aa, Homo Sapiens
HHIETGGGQL

SEQ ID NO: 81820 - protein, 10 aa, Homo Sapiens
HHIIENNHIL

SEQ ID NO: 81821 - protein, 10 aa, Homo Sapiens
HHIPDVITYL

SEQ ID NO: 81822 - protein, 10 aa, Homo Sapiens
HHIPEQTTQL

SEQ ID NO: 81823 - protein, 10 aa, Homo Sapiens
HHMPGQPPYM

SEQ ID NO: 81824 - protein, 10 aa, Homo Sapiens
HHSPGQTPTL

SEQ ID NO: 81825 - protein, 10 aa, Homo Sapiens
HHSPVGTRVM

SEQ ID NO: 81826 - protein, 10 aa, Homo Sapiens
HHVENKGATL

SEQ ID NO: 81827 - protein, 10 aa, Homo Sapiens
HHVVPTEPLP

SEQ ID NO: 81828 - protein, 10 aa, Homo Sapiens
HHYEGAVVIL

SEQ ID NO: 81829 - protein, 10 aa, Homo Sapiens
HHYKPTPLYF

SEQ ID NO: 81830 - protein, 10 aa, Homo Sapiens
HHYPGPGNHF

SEQ ID NO: 81831 - protein, 10 aa, Homo Sapiens
HHYSGNNIEL

SEQ ID NO: 81832 - protein, 10 aa, Homo Sapiens
HLTLDGLPPL

SEQ ID NO: 81833 - protein, 10 aa, Homo Sapiens
IHDPGRGAPL

SEQ ID NO: 81834 - protein, 10 aa, Homo Sapiens
IHHSGAKVVL

SEQ ID NO: 81835 - protein, 10 aa, Homo Sapiens
IHIKPGAKVL

SEQ ID NO: 81836 - protein, 10 aa, Homo Sapiens
IHINIGALEL

SEQ ID NO: 81837 - protein, 10 aa, Homo Sapiens
IHIPFISKEL

SEQ ID NO: 81838 - protein, 10 aa, Homo Sapiens
IHSPLPSAVL

SEQ ID NO: 81839 - protein, 10 aa, Homo Sapiens
IHSQHPETQL

SEQ ID NO: 81840 - protein, 10 aa, Homo Sapiens
IHVGQAGVQI

SEQ ID NO: 81841 - protein, 10 aa, Homo Sapiens
LHDPALHRTL

SEQ ID NO: 81842 - protein, 10 aa, Homo Sapiens
LHIDPNFASL

SEQ ID NO: 81843 - protein, 10 aa, Homo Sapiens
LPEEEQQRVL

SEQ ID NO: 81844 - protein, 10 aa, Homo Sapiens
LYKEAMKNLL

SEQ ID NO: 81845 - protein, 10 aa, Homo Sapiens
MHLLSVGSIL

SEQ ID NO: 81846 - protein, 10 aa, Homo Sapiens
MHQHKSITTL

SEQ ID NO: 81847 - protein, 10 aa, Homo Sapiens
MHSPAGRSVF

SEQ ID NO: 81848 - protein, 10 aa, Homo Sapiens
MHVPAPKLAL

SEQ ID NO: 81849 - protein, 10 aa, Homo Sapiens
NHAVGPSTAM

SEQ ID NO: 81850 - protein, 10 aa, Homo Sapiens
NHAVGPSTSL

SEQ ID NO: 81851 - protein, 10 aa, Homo Sapiens
NHDPNTHHCL

SEQ ID NO: 81852 - protein, 10 aa, Homo Sapiens
NHIEPLKIQL

SEQ ID NO: 81853 - protein, 10 aa, Homo Sapiens
NHIGISIAGL

SEQ ID NO: 81854 - protein, 10 aa, Homo Sapiens
NHSAASAMAL

SEQ ID NO: 81855 - protein, 10 aa, Homo Sapiens
NHVTPPNVSL

SEQ ID NO: 81856 - protein, 10 aa, Homo Sapiens
NPFGGASHAK

SEQ ID NO: 81857 - protein, 10 aa, Homo Sapiens
QHADPPVQIL

SEQ ID NO: 81858 - protein, 10 aa, Homo Sapiens
QHFEHLAPVL

SEQ ID NO: 81859 - protein, 10 aa, Homo Sapiens
QHFTGLHASL

SEQ ID NO: 81860 - protein, 10 aa, Homo Sapiens
QHIGKPSTIR

SEQ ID NO: 81861 - protein, 10 aa, Homo Sapiens
QHLQATGVSL

SEQ ID NO: 81862 - protein, 10 aa, Homo Sapiens
QQVKYPVNSL

SEQ ID NO: 81863 - protein, 10 aa, Homo Sapiens
RHSGPLRVAM

SEQ ID NO: 81864 - protein, 10 aa, Homo Sapiens
SHAGALQESL

SEQ ID NO: 81865 - protein, 10 aa, Homo Sapiens
SHCTFVIEAL

SEQ ID NO: 81866 - protein, 10 aa, Homo Sapiens
SHEKGCFRTL

SEQ ID NO: 81867 - protein, 10 aa, Homo Sapiens
SHLESVLHNT

SEQ ID NO: 81868 - protein, 10 aa, Homo Sapiens
SHYGQSGISM

SEQ ID NO: 81869 - protein, 10 aa, Homo Sapiens
SHYQPRGQLL

SEQ ID NO: 81870 - protein, 10 aa, Homo Sapiens
THALTSASTL

SEQ ID NO: 81871 - protein, 10 aa, Homo Sapiens
THDDSHLVSL

SEQ ID NO: 81872 - protein, 10 aa, Homo Sapiens
THDNREHLAM

SEQ ID NO: 81873 - protein, 10 aa, Homo Sapiens
THIQTSQQAL

SEQ ID NO: 81874 - protein, 10 aa, Homo Sapiens
THIRVGVVGL

SEQ ID NO: 81875 - protein, 10 aa, Homo Sapiens
THISSQNSEL

SEQ ID NO: 81876 - protein, 10 aa, Homo Sapiens
THISSSGQNL

SEQ ID NO: 81877 - protein, 10 aa, Homo Sapiens
THMSPSWTLL

SEQ ID NO: 81878 - protein, 10 aa, Homo Sapiens
THNPQAPVLL

SEQ ID NO: 81879 - protein, 10 aa, Homo Sapiens
THRTDLNPIL

SEQ ID NO: 81880 - protein, 10 aa, Homo Sapiens
THYDHVLIEL

SEQ ID NO: 81881 - protein, 10 aa, Homo Sapiens
TQNPYHQQAL

SEQ ID NO: 81882 - protein, 10 aa, Homo Sapiens
VHAGVPASYL

SEQ ID NO: 81883 - protein, 10 aa, Homo Sapiens
VHAPPMQLGF

SEQ ID NO: 81884 - protein, 10 aa, Homo Sapiens
VHEWHKRVAL

SEQ ID NO: 81885 - protein, 10 aa, Homo Sapiens
VHYDRSGRSL

SEQ ID NO: 81886 - protein, 10 aa, Homo Sapiens
WHAKGFGMTL

SEQ ID NO: 81887 - protein, 10 aa, Homo Sapiens
YHAETIKNVR

SEQ ID NO: 81888 - protein, 10 aa, Homo Sapiens
YHAPGKKREF

SEQ ID NO: 81889 - protein, 10 aa, Homo Sapiens
YHAPPRLHHL

SEQ ID NO: 81890 - protein, 10 aa, Homo Sapiens
YHDSRIHVCL

SEQ ID NO: 81891 - protein, 10 aa, Homo Sapiens
YHDTRIHACL

SEQ ID NO: 81892 - protein, 10 aa, Homo Sapiens
YHDTRIHVCL

SEQ ID NO: 81893 - protein, 10 aa, Homo Sapiens
YHETSKMKVL

SEQ ID NO: 81894 - protein, 10 aa, Homo Sapiens
YHFYQGLVYL

SEQ ID NO: 81895 - protein, 10 aa, Homo Sapiens
YHHEAGVTAL

SEQ ID NO: 81896 - protein, 10 aa, Homo Sapiens
YHIDVGTQTF

SEQ ID NO: 81897 - protein, 10 aa, Homo Sapiens
YHIEGSRQAL

SEQ ID NO: 81898 - protein, 10 aa, Homo Sapiens
YHISLEHEIL

SEQ ID NO: 81899 - protein, 10 aa, Homo Sapiens
YHLETRKPVL

SEQ ID NO: 81900 - protein, 10 aa, Homo Sapiens
YHQPAPIAQL

SEQ ID NO: 81901 - protein, 10 aa, Homo Sapiens
YHVDPAQRSL

SEQ ID NO: 81902 - protein, 10 aa, Homo Sapiens
YHYDMNTASL

SEQ ID NO: 81903 - protein, 10 aa, Homo Sapiens
YHYFSKMKAL

SEQ ID NO: 81904 - protein, 10 aa, Homo Sapiens
YHYPYTYSTL

SEQ ID NO: 81905 - protein, 10 aa, Homo Sapiens
YQDPSFHLSL

SEQ ID NO: 81906 - protein, 11 aa, Homo Sapiens
AHEEANAARKL

SEQ ID NO: 81907 - protein, 11 aa, Homo Sapiens
FHHESKENFAL

SEQ ID NO: 81908 - protein, 11 aa, Homo Sapiens
GGASHAKGIVL

SEQ ID NO: 81909 - protein, 11 aa, Homo Sapiens
HFDLSHGSAQV

SEQ ID NO: 81910 - protein, 11 aa, Homo Sapiens
HHAESKNGWTL

SEQ ID NO: 81911 - protein, 11 aa, Homo Sapiens
HHCPSTPIILV

SEQ ID NO: 81912 - protein, 11 aa, Homo Sapiens
HHFNSGAQSVL

SEQ ID NO: 81913 - protein, 11 aa, Homo Sapiens
HHIETGGGQLP

SEQ ID NO: 81914 - protein, 11 aa, Homo Sapiens
HHIMPTVHTVL

SEQ ID NO: 81915 - protein, 11 aa, Homo Sapiens
HHNPNLVYALL

SEQ ID NO: 81916 - protein, 11 aa, Homo Sapiens
HHQYPSRSSGL

SEQ ID NO: 81917 - protein, 11 aa, Homo Sapiens
HHYPNQSNTTL

SEQ ID NO: 81918 - protein, 11 aa, Homo Sapiens
HLALDPHHQLL

SEQ ID NO: 81919 - protein, 11 aa, Homo Sapiens
IHEDSTNRRRL

SEQ ID NO: 81920 - protein, 11 aa, Homo Sapiens
ISDHYPVEVML

SEQ ID NO: 81921 - protein, 11 aa, Homo Sapiens
ISGHYDRSKSL

SEQ ID NO: 81922 - protein, 11 aa, Homo Sapiens
LHIDPKTGVAV

SEQ ID NO: 81923 - protein, 11 aa, Homo Sapiens
LHYDPNKRISA

SEQ ID NO: 81924 - protein, 11 aa, Homo Sapiens
LPEDEGHTRTL

SEQ ID NO: 81925 - protein, 11 aa, Homo Sapiens
QHINPLLPACL

SEQ ID NO: 81926 - protein, 11 aa, Homo Sapiens
SHEYNERVRTL

SEQ ID NO: 81927 - protein, 11 aa, Homo Sapiens
SHFDSQQPAVL

SEQ ID NO: 81928 - protein, 11 aa, Homo Sapiens
SHITPSTQQHL

SEQ ID NO: 81929 - protein, 11 aa, Homo Sapiens
SHTTNPEQTLP

SEQ ID NO: 81930 - protein, 11 aa, Homo Sapiens
THAPTHSDYTM

SEQ ID NO: 81931 - protein, 11 aa, Homo Sapiens
THIKPTKIVSL

SEQ ID NO: 81932 - protein, 11 aa, Homo Sapiens
THMTAIVGMAL

SEQ ID NO: 81933 - protein, 11 aa, Homo Sapiens
THQDVHLGETL

SEQ ID NO: 81934 - protein, 11 aa, Homo Sapiens
THVDSHGHNVF

SEQ ID NO: 81935 - protein, 11 aa, Homo Sapiens
VHFSLPVLHPL

SEQ ID NO: 81936 - protein, 11 aa, Homo Sapiens
YHAPPLSAITF

SEQ ID NO: 81937 - protein, 11 aa, Homo Sapiens
YHFVPGTTAVL

SEQ ID NO: 81938 - protein, 11 aa, Homo Sapiens
YHQHFDSVMQL

SEQ ID NO: 81939 - protein, 11 aa, Homo Sapiens
YHVESTVNSEL

SEQ ID NO: 81940 - protein, 11 aa, Homo Sapiens
YHVKDSSRHVI

SEQ ID NO: 81941 - protein, 8 aa, Homo Sapiens
AAAKALRI

SEQ ID NO: 81942 - protein, 8 aa, Homo Sapiens
AIYHVLHF

SEQ ID NO: 81943 - protein, 8 aa, Homo Sapiens
ASFKPLGL

SEQ ID NO: 81944 - protein, 8 aa, Homo Sapiens
ATTEALKL

SEQ ID NO: 81945 - protein, 8 aa, Homo Sapiens
ESFKALLI

SEQ ID NO: 81946 - protein, 8 aa, Homo Sapiens
FAYPAIRY

SEQ ID NO: 81947 - protein, 8 aa, Homo Sapiens
FGYKGLKI

SEQ ID NO: 81948 - protein, 8 aa, Homo Sapiens
FSMEALEL

SEQ ID NO: 81949 - protein, 8 aa, Homo Sapiens
FSSPPLSL

SEQ ID NO: 81950 - protein, 8 aa, Homo Sapiens
FSVEPLLI

SEQ ID NO: 81951 - protein, 8 aa, Homo Sapiens
FSYKTIVM

SEQ ID NO: 81952 - protein, 8 aa, Homo Sapiens
FTADPLSL

SEQ ID NO: 81953 - protein, 8 aa, Homo Sapiens
FTANALAL

SEQ ID NO: 81954 - protein, 8 aa, Homo Sapiens
FTHEALTL

SEQ ID NO: 81955 - protein, 8 aa, Homo Sapiens
GSGKTLAY

SEQ ID NO: 81956 - protein, 8 aa, Homo Sapiens
GSGKTLSY

SEQ ID NO: 81957 - protein, 8 aa, Homo Sapiens
GTGKTLSL

SEQ ID NO: 81958 - protein, 8 aa, Homo Sapiens
HSWKALVY

SEQ ID NO: 81959 - protein, 8 aa, Homo Sapiens
HSYRVLYL

SEQ ID NO: 81960 - protein, 8 aa, Homo Sapiens
IATIALMI

SEQ ID NO: 81961 - protein, 8 aa, Homo Sapiens
ISAKPLEM

SEQ ID NO: 81962 - protein, 8 aa, Homo Sapiens
ISHTALVL

SEQ ID NO: 81963 - protein, 8 aa, Homo Sapiens
ISVHPLTL

SEQ ID NO: 81964 - protein, 8 aa, Homo Sapiens
ITFLPLLL

SEQ ID NO: 81965 - protein, 8 aa, Homo Sapiens
ITRYPLLI

SEQ ID NO: 81966 - protein, 8 aa, Homo Sapiens
KAGKALVI

SEQ ID NO: 81967 - protein, 8 aa, Homo Sapiens
KAWKALEI

SEQ ID NO: 81968 - protein, 8 aa, Homo Sapiens
KAYKALKM

SEQ ID NO: 81969 - protein, 8 aa, Homo Sapiens
KDWVLKIL

SEQ ID NO: 81970 - protein, 8 aa, Homo Sapiens
KSITPLML

SEQ ID NO: 81971 - protein, 8 aa, Homo Sapiens
KSLQAIKI

SEQ ID NO: 81972 - protein, 8 aa, Homo Sapiens
KSWTALRL

SEQ ID NO: 81973 - protein, 8 aa, Homo Sapiens
KTFEALKF

SEQ ID NO: 81974 - protein, 8 aa, Homo Sapiens
KTVKPLSL

SEQ ID NO: 81975 - protein, 8 aa, Homo Sapiens
KTYKPMGF

SEQ ID NO: 81976 - protein, 8 aa, Homo Sapiens
LSQGVIAF

SEQ ID NO: 81977 - protein, 8 aa, Homo Sapiens
LSSKALKI

SEQ ID NO: 81978 - protein, 8 aa, Homo Sapiens
LSTAIALI

SEQ ID NO: 81979 - protein, 8 aa, Homo Sapiens
LSTIALAL

SEQ ID NO: 81980 - protein, 8 aa, Homo Sapiens
LTAEVLEL

SEQ ID NO: 81981 - protein, 8 aa, Homo Sapiens
LTGKTITL

SEQ ID NO: 81982 - protein, 8 aa, Homo Sapiens
LTGPALQW

SEQ ID NO: 81983 - protein, 8 aa, Homo Sapiens
LTGPVLEL

SEQ ID NO: 81984 - protein, 8 aa, Homo Sapiens
LTLRAIKL

SEQ ID NO: 81985 - protein, 8 aa, Homo Sapiens
LTYKVLTL

SEQ ID NO: 81986 - protein, 8 aa, Homo Sapiens
LVYPALKW

SEQ ID NO: 81987 - protein, 8 aa, Homo Sapiens
MGFKPLVL

SEQ ID NO: 81988 - protein, 8 aa, Homo Sapiens
MTLSPLLL

SEQ ID NO: 81989 - protein, 8 aa, Homo Sapiens
QTFKGLKI

SEQ ID NO: 81990 - protein, 8 aa, Homo Sapiens
QTMKTLRL

SEQ ID NO: 81991 - protein, 8 aa, Homo Sapiens
QTVKPLTL

SEQ ID NO: 81992 - protein, 8 aa, Homo Sapiens
RAYHTLRL

SEQ ID NO: 81993 - protein, 8 aa, Homo Sapiens
RMWKTLTF

SEQ ID NO: 81994 - protein, 8 aa, Homo Sapiens
RSAEALAF

SEQ ID NO: 81995 - protein, 8 aa, Homo Sapiens
RSFRPLLF

SEQ ID NO: 81996 - protein, 8 aa, Homo Sapiens
RSVRPLRL

SEQ ID NO: 81997 - protein, 8 aa, Homo Sapiens
RTFHTIGF

SEQ ID NO: 81998 - protein, 8 aa, Homo Sapiens
RTSRPLKI

SEQ ID NO: 81999 - protein, 8 aa, Homo Sapiens
RTVKALEF

SEQ ID NO: 82000 - protein, 8 aa, Homo Sapiens
RTYRAAKL

SEQ ID NO: 82001 - protein, 8 aa, Homo Sapiens
RVYKSLKV

SEQ ID NO: 82002 - protein, 8 aa, Homo Sapiens
SAWKPLLL

SEQ ID NO: 82003 - protein, 8 aa, Homo Sapiens
SAYVALAL

SEQ ID NO: 82004 - protein, 8 aa, Homo Sapiens
SFKKPFKL

SEQ ID NO: 82005 - protein, 8 aa, Homo Sapiens
SLPKVLRF

SEQ ID NO: 82006 - protein, 8 aa, Homo Sapiens
SLQHKLLL

SEQ ID NO: 82007 - protein, 8 aa, Homo Sapiens
SQDKTLKI

SEQ ID NO: 82008 - protein, 8 aa, Homo Sapiens
SSLHTLKF

SEQ ID NO: 82009 - protein, 8 aa, Homo Sapiens
SSNHKLVF

SEQ ID NO: 82010 - protein, 8 aa, Homo Sapiens
STYHALGF

SEQ ID NO: 82011 - protein, 8 aa, Homo Sapiens
SVDKVLEL

SEQ ID NO: 82012 - protein, 8 aa, Homo Sapiens
SVPKPLKF

SEQ ID NO: 82013 - protein, 8 aa, Homo Sapiens
SWDGTLRL

SEQ ID NO: 82014 - protein, 8 aa, Homo Sapiens
SYQKLLKY

SEQ ID NO: 82015 - protein, 8 aa, Homo Sapiens
TAPRTVLL

SEQ ID NO: 82016 - protein, 8 aa, Homo Sapiens
THSLVLHY

SEQ ID NO: 82017 - protein, 8 aa, Homo Sapiens
TKHGTLKY

SEQ ID NO: 82018 - protein, 8 aa, Homo Sapiens
TLHLVLRL

SEQ ID NO: 82019 - protein, 8 aa, Homo Sapiens
TSWKPLWL

SEQ ID NO: 82020 - protein, 8 aa, Homo Sapiens
TTKAISRW

SEQ ID NO: 82021 - protein, 8 aa, Homo Sapiens
TTLHNLLL

SEQ ID NO: 82022 - protein, 8 aa, Homo Sapiens
TTLRALYL

SEQ ID NO: 82023 - protein, 8 aa, Homo Sapiens
TYRGPKAF

SEQ ID NO: 82024 - protein, 8 aa, Homo Sapiens
VHLTPEEK

SEQ ID NO: 82025 - protein, 8 aa, Homo Sapiens
VSGKPLLI

SEQ ID NO: 82026 - protein, 8 aa, Homo Sapiens
VSLTACKV

SEQ ID NO: 82027 - protein, 8 aa, Homo Sapiens
VTFKSILF

SEQ ID NO: 82028 - protein, 8 aa, Homo Sapiens
YFFAYHVL

SEQ ID NO: 82029 - protein, 8 aa, Homo Sapiens
YSFMPLVI

SEQ ID NO: 82030 - protein, 8 aa, Homo Sapiens
YSGIALLI

SEQ ID NO: 82031 - protein, 8 aa, Homo Sapiens
YSMCKKVL

SEQ ID NO: 82032 - protein, 8 aa, Homo Sapiens
YTVKAILI

SEQ ID NO: 82033 - protein, 9 aa, Homo Sapiens
AAAPAGTTF

SEQ ID NO: 82034 - protein, 9 aa, Homo Sapiens
AAAPAIMSY

SEQ ID NO: 82035 - protein, 9 aa, Homo Sapiens
AAAPVIKAY

SEQ ID NO: 82036 - protein, 9 aa, Homo Sapiens
AAHSVVLGY

SEQ ID NO: 82037 - protein, 9 aa, Homo Sapiens
AAIKAIKFY

SEQ ID NO: 82038 - protein, 9 aa, Homo Sapiens
AAIYHVLHF

SEQ ID NO: 82039 - protein, 9 aa, Homo Sapiens
AALEQLLKF

SEQ ID NO: 82040 - protein, 9 aa, Homo Sapiens
AALRQALTL

SEQ ID NO: 82041 - protein, 9 aa, Homo Sapiens
AASARTLQL

SEQ ID NO: 82042 - protein, 9 aa, Homo Sapiens
AAVRHVLAL

SEQ ID NO: 82043 - protein, 9 aa, Homo Sapiens
AAYAGGLVL

SEQ ID NO: 82044 - protein, 9 aa, Homo Sapiens
AAYDRYLKL

SEQ ID NO: 82045 - protein, 9 aa, Homo Sapiens
AAYLQHLCY

SEQ ID NO: 82046 - protein, 9 aa, Homo Sapiens
AAYLRALSL

SEQ ID NO: 82047 - protein, 9 aa, Homo Sapiens
AAYQLAFRY

SEQ ID NO: 82048 - protein, 9 aa, Homo Sapiens
AGLEYVLHF

SEQ ID NO: 82049 - protein, 9 aa, Homo Sapiens
AIIERTASF

SEQ ID NO: 82050 - protein, 9 aa, Homo Sapiens
AILKKVIQW

SEQ ID NO: 82051 - protein, 9 aa, Homo Sapiens
AIYKRVLKL

SEQ ID NO: 82052 - protein, 9 aa, Homo Sapiens
ALYKKILKY

SEQ ID NO: 82053 - protein, 9 aa, Homo Sapiens
ALYKRVLQL

SEQ ID NO: 82054 - protein, 9 aa, Homo Sapiens
ASCDKILVI

SEQ ID NO: 82055 - protein, 9 aa, Homo Sapiens
ASDDKTLKI

SEQ ID NO: 82056 - protein, 9 aa, Homo Sapiens
ASFDGTFLW

SEQ ID NO: 82057 - protein, 9 aa, Homo Sapiens
ASFDKSIKL

SEQ ID NO: 82058 - protein, 9 aa, Homo Sapiens
ASFLARLGY

SEQ ID NO: 82059 - protein, 9 aa, Homo Sapiens
ASGPGLSSY

SEQ ID NO: 82060 - protein, 9 aa, Homo Sapiens
ASGPPVSEL

SEQ ID NO: 82061 - protein, 9 aa, Homo Sapiens
ASHDSTLSL

SEQ ID NO: 82062 - protein, 9 aa, Homo Sapiens
ASHYLKTEY

SEQ ID NO: 82063 - protein, 9 aa, Homo Sapiens
ASIDQRLTF

SEQ ID NO: 82064 - protein, 9 aa, Homo Sapiens
ASIGNAQKL

SEQ ID NO: 82065 - protein, 9 aa, Homo Sapiens
ASINRIYGF

SEQ ID NO: 82066 - protein, 9 aa, Homo Sapiens
ASIPGILAL

SEQ ID NO: 82067 - protein, 9 aa, Homo Sapiens
ASIQQTLKL

SEQ ID NO: 82068 - protein, 9 aa, Homo Sapiens
ASISHFMQF

SEQ ID NO: 82069 - protein, 9 aa, Homo Sapiens
ASITRVPFY

SEQ ID NO: 82070 - protein, 9 aa, Homo Sapiens
ASIVAPLLL

SEQ ID NO: 82071 - protein, 9 aa, Homo Sapiens
ASKPWDISL

SEQ ID NO: 82072 - protein, 9 aa, Homo Sapiens
ASLDKEIYY

SEQ ID NO: 82073 - protein, 9 aa, Homo Sapiens
ASLDNTIKL

SEQ ID NO: 82074 - protein, 9 aa, Homo Sapiens
ASLEEQLKL

SEQ ID NO: 82075 - protein, 9 aa, Homo Sapiens
ASLENCMKL

SEQ ID NO: 82076 - protein, 9 aa, Homo Sapiens
ASLEQHLRL

SEQ ID NO: 82077 - protein, 9 aa, Homo Sapiens
ASLERFSTY

SEQ ID NO: 82078 - protein, 9 aa, Homo Sapiens
ASLISVRNL

SEQ ID NO: 82079 - protein, 9 aa, Homo Sapiens
ASLKEALKI

SEQ ID NO: 82080 - protein, 9 aa, Homo Sapiens
ASLKSTSTL

SEQ ID NO: 82081 - protein, 9 aa, Homo Sapiens
ASLMHSFIL

SEQ ID NO: 82082 - protein, 9 aa, Homo Sapiens
ASLNFQSTF

SEQ ID NO: 82083 - protein, 9 aa, Homo Sapiens
ASLPKVLRF

SEQ ID NO: 82084 - protein, 9 aa, Homo Sapiens
ASLPLERTL

SEQ ID NO: 82085 - protein, 9 aa, Homo Sapiens
ASLPSILQY

SEQ ID NO: 82086 - protein, 9 aa, Homo Sapiens
ASLSRPLNY

SEQ ID NO: 82087 - protein, 9 aa, Homo Sapiens
ASLTKILVI

SEQ ID NO: 82088 - protein, 9 aa, Homo Sapiens
ASMQCVLTF

SEQ ID NO: 82089 - protein, 9 aa, Homo Sapiens
ASMSVVLKL

SEQ ID NO: 82090 - protein, 9 aa, Homo Sapiens
ASNLQDLVY

SEQ ID NO: 82091 - protein, 9 aa, Homo Sapiens
ASNPAMLLY

SEQ ID NO: 82092 - protein, 9 aa, Homo Sapiens
ASNPKILSL

SEQ ID NO: 82093 - protein, 9 aa, Homo Sapiens
ASNPRVTRF

SEQ ID NO: 82094 - protein, 9 aa, Homo Sapiens
ASNYFRAMF

SEQ ID NO: 82095 - protein, 9 aa, Homo Sapiens
ASSLHTLKF

SEQ ID NO: 82096 - protein, 9 aa, Homo Sapiens
ASSRIILRL

SEQ ID NO: 82097 - protein, 9 aa, Homo Sapiens
ASTARHLYL

SEQ ID NO: 82098 - protein, 9 aa, Homo Sapiens
ASVDKVLEL

SEQ ID NO: 82099 - protein, 9 aa, Homo Sapiens
ASWDKTVRL

SEQ ID NO: 82100 - protein, 9 aa, Homo Sapiens
ASYARQMMF

SEQ ID NO: 82101 - protein, 9 aa, Homo Sapiens
ASYAVQAKY

SEQ ID NO: 82102 - protein, 9 aa, Homo Sapiens
ASYAVQSKY

SEQ ID NO: 82103 - protein, 9 aa, Homo Sapiens
ASYEFVQRL

SEQ ID NO: 82104 - protein, 9 aa, Homo Sapiens
ASYEKMLKL

SEQ ID NO: 82105 - protein, 9 aa, Homo Sapiens
ASYHSNQTL

SEQ ID NO: 82106 - protein, 9 aa, Homo Sapiens
ASYKHTTSI

SEQ ID NO: 82107 - protein, 9 aa, Homo Sapiens
ASYKKAIIL

SEQ ID NO: 82108 - protein, 9 aa, Homo Sapiens
ASYLQMVHI

SEQ ID NO: 82109 - protein, 9 aa, Homo Sapiens
ASYNVKTAY

SEQ ID NO: 82110 - protein, 9 aa, Homo Sapiens
ASYPHCLQF

SEQ ID NO: 82111 - protein, 9 aa, Homo Sapiens
ASYRQVASF

SEQ ID NO: 82112 - protein, 9 aa, Homo Sapiens
ASYSGLMRI

SEQ ID NO: 82113 - protein, 9 aa, Homo Sapiens
ASYSVHLLL

SEQ ID NO: 82114 - protein, 9 aa, Homo Sapiens
ASYTKALKL

SEQ ID NO: 82115 - protein, 9 aa, Homo Sapiens
ASYVASTKY

SEQ ID NO: 82116 - protein, 9 aa, Homo Sapiens
ATAKNVLKL

SEQ ID NO: 82117 - protein, 9 aa, Homo Sapiens
ATAPPAPAY

SEQ ID NO: 82118 - protein, 9 aa, Homo Sapiens
ATAPVVALF

SEQ ID NO: 82119 - protein, 9 aa, Homo Sapiens
ATAVVQLYL

SEQ ID NO: 82120 - protein, 9 aa, Homo Sapiens
ATDPHPKEI

SEQ ID NO: 82121 - protein, 9 aa, Homo Sapiens
ATFAKVMML

SEQ ID NO: 82122 - protein, 9 aa, Homo Sapiens
ATFAQALQF

SEQ ID NO: 82123 - protein, 9 aa, Homo Sapiens
ATFPVAPRY

SEQ ID NO: 82124 - protein, 9 aa, Homo Sapiens
ATFQRQFVL

SEQ ID NO: 82125 - protein, 9 aa, Homo Sapiens
ATGKRTLLI

SEQ ID NO: 82126 - protein, 9 aa, Homo Sapiens
ATHFSQLSL

SEQ ID NO: 82127 - protein, 9 aa, Homo Sapiens
ATHGRFLEI

SEQ ID NO: 82128 - protein, 9 aa, Homo Sapiens
ATIAEGLTL

SEQ ID NO: 82129 - protein, 9 aa, Homo Sapiens
ATIDKVVKI

SEQ ID NO: 82130 - protein, 9 aa, Homo Sapiens
ATIEKIIRF

SEQ ID NO: 82131 - protein, 9 aa, Homo Sapiens
ATIFHELVY

SEQ ID NO: 82132 - protein, 9 aa, Homo Sapiens
ATILTKSTL

SEQ ID NO: 82133 - protein, 9 aa, Homo Sapiens
ATIPPISSL

SEQ ID NO: 82134 - protein, 9 aa, Homo Sapiens
ATIRKALRL

SEQ ID NO: 82135 - protein, 9 aa, Homo Sapiens
ATISSPLEL

SEQ ID NO: 82136 - protein, 9 aa, Homo Sapiens
ATIVGKLMF

SEQ ID NO: 82137 - protein, 9 aa, Homo Sapiens
ATLDNTLKL

SEQ ID NO: 82138 - protein, 9 aa, Homo Sapiens
ATLEKVIEI

SEQ ID NO: 82139 - protein, 9 aa, Homo Sapiens
ATLETLLRF

SEQ ID NO: 82140 - protein, 9 aa, Homo Sapiens
ATLGATLKL

SEQ ID NO: 82141 - protein, 9 aa, Homo Sapiens
ATLHLLLTL

SEQ ID NO: 82142 - protein, 9 aa, Homo Sapiens
ATLNWFRLY

SEQ ID NO: 82143 - protein, 9 aa, Homo Sapiens
ATLQLSLKL

SEQ ID NO: 82144 - protein, 9 aa, Homo Sapiens
ATLQRLLAI

SEQ ID NO: 82145 - protein, 9 aa, Homo Sapiens
ATLTRPLAL

SEQ ID NO: 82146 - protein, 9 aa, Homo Sapiens
ATMKRMLSL

SEQ ID NO: 82147 - protein, 9 aa, Homo Sapiens
ATMPDGKLY

SEQ ID NO: 82148 - protein, 9 aa, Homo Sapiens
ATMPVTMLI

SEQ ID NO: 82149 - protein, 9 aa, Homo Sapiens
ATMYNLLAY

SEQ ID NO: 82150 - protein, 9 aa, Homo Sapiens
ATNHKVLLF

SEQ ID NO: 82151 - protein, 9 aa, Homo Sapiens
ATNHRVLLF

SEQ ID NO: 82152 - protein, 9 aa, Homo Sapiens
ATSKVALVY

SEQ ID NO: 82153 - protein, 9 aa, Homo Sapiens
ATTPPISSI

SEQ ID NO: 82154 - protein, 9 aa, Homo Sapiens
ATVAPMSVY

SEQ ID NO: 82155 - protein, 9 aa, Homo Sapiens
ATVDWFRRY

SEQ ID NO: 82156 - protein, 9 aa, Homo Sapiens
ATVKAHPKY

SEQ ID NO: 82157 - protein, 9 aa, Homo Sapiens
ATVLQKTSF

SEQ ID NO: 82158 - protein, 9 aa, Homo Sapiens
ATVNFITSY

SEQ ID NO: 82159 - protein, 9 aa, Homo Sapiens
ATVPIRLII

SEQ ID NO: 82160 - protein, 9 aa, Homo Sapiens
ATVPNALEF

SEQ ID NO: 82161 - protein, 9 aa, Homo Sapiens
ATVTSYLKL

SEQ ID NO: 82162 - protein, 9 aa, Homo Sapiens
ATYEDIVTL

SEQ ID NO: 82163 - protein, 9 aa, Homo Sapiens
ATYERMFRW

SEQ ID NO: 82164 - protein, 9 aa, Homo Sapiens
ATYHHIIRL

SEQ ID NO: 82165 - protein, 9 aa, Homo Sapiens
ATYHRAIKV

SEQ ID NO: 82166 - protein, 9 aa, Homo Sapiens
ATYIFLQTF

SEQ ID NO: 82167 - protein, 9 aa, Homo Sapiens
ATYLLKPLF

SEQ ID NO: 82168 - protein, 9 aa, Homo Sapiens
ATYLRQPTY

SEQ ID NO: 82169 - protein, 9 aa, Homo Sapiens
ATYNFSQSL

SEQ ID NO: 82170 - protein, 9 aa, Homo Sapiens
ATYTSARTL

SEQ ID NO: 82171 - protein, 9 aa, Homo Sapiens
ATYVFLHTV

SEQ ID NO: 82172 - protein, 9 aa, Homo Sapiens
AVDPKTRLL

SEQ ID NO: 82173 - protein, 9 aa, Homo Sapiens
AVISTILKY

SEQ ID NO: 82174 - protein, 9 aa, Homo Sapiens
AVLASGATF

SEQ ID NO: 82175 - protein, 9 aa, Homo Sapiens
AVLPYELRF

SEQ ID NO: 82176 - protein, 9 aa, Homo Sapiens
AVVDKTLLL

SEQ ID NO: 82177 - protein, 9 aa, Homo Sapiens
AVYARLLAL

SEQ ID NO: 82178 - protein, 9 aa, Homo Sapiens
AVYDRILDL

SEQ ID NO: 82179 - protein, 9 aa, Homo Sapiens
AVYERVTTI

SEQ ID NO: 82180 - protein, 9 aa, Homo Sapiens
AVYRKALVI

SEQ ID NO: 82181 - protein, 9 aa, Homo Sapiens
AVYSRTFTW

SEQ ID NO: 82182 - protein, 9 aa, Homo Sapiens
AVYTIALRY

SEQ ID NO: 82183 - protein, 9 aa, Homo Sapiens
CALGLVLGL

SEQ ID NO: 82184 - protein, 9 aa, Homo Sapiens
CSSPIVVKF

SEQ ID NO: 82185 - protein, 9 aa, Homo Sapiens
CTYGKPVTF

SEQ ID NO: 82186 - protein, 9 aa, Homo Sapiens
CVISKVLTF

SEQ ID NO: 82187 - protein, 9 aa, Homo Sapiens
ESCDVQLYI

SEQ ID NO: 82188 - protein, 9 aa, Homo Sapiens
ESFQKALLL

SEQ ID NO: 82189 - protein, 9 aa, Homo Sapiens
ESLGYVLMY

SEQ ID NO: 82190 - protein, 9 aa, Homo Sapiens
ESMKETLRI

SEQ ID NO: 82191 - protein, 9 aa, Homo Sapiens
ESWDKILAL

SEQ ID NO: 82192 - protein, 9 aa, Homo Sapiens
ETVRSILKI

SEQ ID NO: 82193 - protein, 9 aa, Homo Sapiens
FSAPGVMNF

SEQ ID NO: 82194 - protein, 9 aa, Homo Sapiens
FSAPGVTSW

SEQ ID NO: 82195 - protein, 9 aa, Homo Sapiens
FSCNKVLVI

SEQ ID NO: 82196 - protein, 9 aa, Homo Sapiens
FSDENVRAI

SEQ ID NO: 82197 - protein, 9 aa, Homo Sapiens
FSFHHVLSL

SEQ ID NO: 82198 - protein, 9 aa, Homo Sapiens
FSFKKPFKL

SEQ ID NO: 82199 - protein, 9 aa, Homo Sapiens
FSFKKSFKL

SEQ ID NO: 82200 - protein, 9 aa, Homo Sapiens
FSGPAISRI

SEQ ID NO: 82201 - protein, 9 aa, Homo Sapiens
FSIPDSLLI

SEQ ID NO: 82202 - protein, 9 aa, Homo Sapiens
FSITPLSEL

SEQ ID NO: 82203 - protein, 9 aa, Homo Sapiens
FSLEEVLRL

SEQ ID NO: 82204 - protein, 9 aa, Homo Sapiens
FSLPAQPLW

SEQ ID NO: 82205 - protein, 9 aa, Homo Sapiens
FSMGKTLLV

SEQ ID NO: 82206 - protein, 9 aa, Homo Sapiens
FSNPRALYL

SEQ ID NO: 82207 - protein, 9 aa, Homo Sapiens
FSSAPGATY

SEQ ID NO: 82208 - protein, 9 aa, Homo Sapiens
FSSDFTLKI

SEQ ID NO: 82209 - protein, 9 aa, Homo Sapiens
FSSNLDLRY

SEQ ID NO: 82210 - protein, 9 aa, Homo Sapiens
FSSPVCMAF

SEQ ID NO: 82211 - protein, 9 aa, Homo Sapiens
FSTDKQMGY

SEQ ID NO: 82212 - protein, 9 aa, Homo Sapiens
FSVLFLPKY

SEQ ID NO: 82213 - protein, 9 aa, Homo Sapiens
FSVVSPSSF

SEQ ID NO: 82214 - protein, 9 aa, Homo Sapiens
FSYAFPKEF

SEQ ID NO: 82215 - protein, 9 aa, Homo Sapiens
FSYEHFYVI

SEQ ID NO: 82216 - protein, 9 aa, Homo Sapiens
FSYGTKILY

SEQ ID NO: 82217 - protein, 9 aa, Homo Sapiens
FSYSSNLKL

SEQ ID NO: 82218 - protein, 9 aa, Homo Sapiens
FTAEFSSRY

SEQ ID NO: 82219 - protein, 9 aa, Homo Sapiens
FTAGAKLLF

SEQ ID NO: 82220 - protein, 9 aa, Homo Sapiens
FTCQRILFL

SEQ ID NO: 82221 - protein, 9 aa, Homo Sapiens
FTIDGPLCL

SEQ ID NO: 82222 - protein, 9 aa, Homo Sapiens
FTKEDLTEI

SEQ ID NO: 82223 - protein, 9 aa, Homo Sapiens
FTKPPIGTW

SEQ ID NO: 82224 - protein, 9 aa, Homo Sapiens
FTLKKLLLL

SEQ ID NO: 82225 - protein, 9 aa, Homo Sapiens
FTLNETLKI

SEQ ID NO: 82226 - protein, 9 aa, Homo Sapiens
FTLSHITQL

SEQ ID NO: 82227 - protein, 9 aa, Homo Sapiens
FTMKTVLML

SEQ ID NO: 82228 - protein, 9 aa, Homo Sapiens
FTSAKILQI

SEQ ID NO: 82229 - protein, 9 aa, Homo Sapiens
FTSDIALRL

SEQ ID NO: 82230 - protein, 9 aa, Homo Sapiens
FTVTFNPKY

SEQ ID NO: 82231 - protein, 9 aa, Homo Sapiens
FTYGLHMIL

SEQ ID NO: 82232 - protein, 9 aa, Homo Sapiens
FTYHHIQEI

SEQ ID NO: 82233 - protein, 9 aa, Homo Sapiens
FTYRSNFVL

SEQ ID NO: 82234 - protein, 9 aa, Homo Sapiens
FTYTAKLMI

SEQ ID NO: 82235 - protein, 9 aa, Homo Sapiens
FVCERTLKY

SEQ ID NO: 82236 - protein, 9 aa, Homo Sapiens
FVTIKKDVD

SEQ ID NO: 82237 - protein, 9 aa, Homo Sapiens
GAYAKALEI

SEQ ID NO: 82238 - protein, 9 aa, Homo Sapiens
GAYTVTIKY

SEQ ID NO: 82239 - protein, 9 aa, Homo Sapiens
GIYPHKLVF

SEQ ID NO: 82240 - protein, 9 aa, Homo Sapiens
GSATTISHY

SEQ ID NO: 82241 - protein, 9 aa, Homo Sapiens
GSCDHPLLL

SEQ ID NO: 82242 - protein, 9 aa, Homo Sapiens
GSCGIALAL

SEQ ID NO: 82243 - protein, 9 aa, Homo Sapiens
GSFPMTPSI

SEQ ID NO: 82244 - protein, 9 aa, Homo Sapiens
GSIPVTLTF

SEQ ID NO: 82245 - protein, 9 aa, Homo Sapiens
GSLDKTIRL

SEQ ID NO: 82246 - protein, 9 aa, Homo Sapiens
GSLKPTSTI

SEQ ID NO: 82247 - protein, 9 aa, Homo Sapiens
GSLSTTSHF

SEQ ID NO: 82248 - protein, 9 aa, Homo Sapiens
GSLVRILFL

SEQ ID NO: 82249 - protein, 9 aa, Homo Sapiens
GSNSKTLRV

SEQ ID NO: 82250 - protein, 9 aa, Homo Sapiens
GSRDKTIKL

SEQ ID NO: 82251 - protein, 9 aa, Homo Sapiens
GSSDGTIRL

SEQ ID NO: 82252 - protein, 9 aa, Homo Sapiens
GSSPPVKNI

SEQ ID NO: 82253 - protein, 9 aa, Homo Sapiens
GSTDRQVTI

SEQ ID NO: 82254 - protein, 9 aa, Homo Sapiens
GSVVRALLL

SEQ ID NO: 82255 - protein, 9 aa, Homo Sapiens
GSWDGTLRL

SEQ ID NO: 82256 - protein, 9 aa, Homo Sapiens
GSWDHTLRV

SEQ ID NO: 82257 - protein, 9 aa, Homo Sapiens
GSWDKMLKI

SEQ ID NO: 82258 - protein, 9 aa, Homo Sapiens
GSWDKTLKF

SEQ ID NO: 82259 - protein, 9 aa, Homo Sapiens
GSYAKVLLV

SEQ ID NO: 82260 - protein, 9 aa, Homo Sapiens
GSYDKTSRI

SEQ ID NO: 82261 - protein, 9 aa, Homo Sapiens
GSYDSKLVW

SEQ ID NO: 82262 - protein, 9 aa, Homo Sapiens
GSYGRSLGL

SEQ ID NO: 82263 - protein, 9 aa, Homo Sapiens
GSYGSLARF

SEQ ID NO: 82264 - protein, 9 aa, Homo Sapiens
GSYNQPLGL

SEQ ID NO: 82265 - protein, 9 aa, Homo Sapiens
GSYRNALKI

SEQ ID NO: 82266 - protein, 9 aa, Homo Sapiens
GSYSIKSRF

SEQ ID NO: 82267 - protein, 9 aa, Homo Sapiens
GTADITLRF

SEQ ID NO: 82268 - protein, 9 aa, Homo Sapiens
GTATKHLTY

SEQ ID NO: 82269 - protein, 9 aa, Homo Sapiens
GTCTGQLKL

SEQ ID NO: 82270 - protein, 9 aa, Homo Sapiens
GTFPKALSI

SEQ ID NO: 82271 - protein, 9 aa, Homo Sapiens
GTIKKFLSL

SEQ ID NO: 82272 - protein, 9 aa, Homo Sapiens
GTIPWFMEI

SEQ ID NO: 82273 - protein, 9 aa, Homo Sapiens
GTIYPGLMI

SEQ ID NO: 82274 - protein, 9 aa, Homo Sapiens
GTLDSVLRY

SEQ ID NO: 82275 - protein, 9 aa, Homo Sapiens
GTLEKVLCL

SEQ ID NO: 82276 - protein, 9 aa, Homo Sapiens
GTLKKILAL

SEQ ID NO: 82277 - protein, 9 aa, Homo Sapiens
GTLQPALVL

SEQ ID NO: 82278 - protein, 9 aa, Homo Sapiens
GTMNRQLKL

SEQ ID NO: 82279 - protein, 9 aa, Homo Sapiens
GTMVHTLAW

SEQ ID NO: 82280 - protein, 9 aa, Homo Sapiens
GTMYPMSVY

SEQ ID NO: 82281 - protein, 9 aa, Homo Sapiens
GTQHPTLRL

SEQ ID NO: 82282 - protein, 9 aa, Homo Sapiens
GTTKDTPKL

SEQ ID NO: 82283 - protein, 9 aa, Homo Sapiens
GTVYEDLRY

SEQ ID NO: 82284 - protein, 9 aa, Homo Sapiens
GTYIRTLCV

SEQ ID NO: 82285 - protein, 9 aa, Homo Sapiens
GTYSLNVTY

SEQ ID NO: 82286 - protein, 9 aa, Homo Sapiens
GTYYPPPRL

SEQ ID NO: 82287 - protein, 9 aa, Homo Sapiens
HAGPIVSVW

SEQ ID NO: 82288 - protein, 9 aa, Homo Sapiens
HAHEIMLKY

SEQ ID NO: 82289 - protein, 9 aa, Homo Sapiens
HAIHKVLQL

SEQ ID NO: 82290 - protein, 9 aa, Homo Sapiens
HAVSPIAKY

SEQ ID NO: 82291 - protein, 9 aa, Homo Sapiens
HGIDPTGTY

SEQ ID NO: 82292 - protein, 9 aa, Homo Sapiens
HLYARQLTL

SEQ ID NO: 82293 - protein, 9 aa, Homo Sapiens
HPTNLLATI

SEQ ID NO: 82294 - protein, 9 aa, Homo Sapiens
HSFGKVLGF

SEQ ID NO: 82295 - protein, 9 aa, Homo Sapiens
HSFLKALYY

SEQ ID NO: 82296 - protein, 9 aa, Homo Sapiens
HSFPLQFTL

SEQ ID NO: 82297 - protein, 9 aa, Homo Sapiens
HSHHPTLKL

SEQ ID NO: 82298 - protein, 9 aa, Homo Sapiens
HSLDHLLKL

SEQ ID NO: 82299 - protein, 9 aa, Homo Sapiens
HSLIKVLRL

SEQ ID NO: 82300 - protein, 9 aa, Homo Sapiens
HSLPDTLSI

SEQ ID NO: 82301 - protein, 9 aa, Homo Sapiens
HSLQQQLKL

SEQ ID NO: 82302 - protein, 9 aa, Homo Sapiens
HSVPLQLEL

SEQ ID NO: 82303 - protein, 9 aa, Homo Sapiens
HSYFWPLEW

SEQ ID NO: 82304 - protein, 9 aa, Homo Sapiens
HSYRGHLWL

SEQ ID NO: 82305 - protein, 9 aa, Homo Sapiens
HTAAVKLLL

SEQ ID NO: 82306 - protein, 9 aa, Homo Sapiens
HTAPNVPHY

SEQ ID NO: 82307 - protein, 9 aa, Homo Sapiens
HTFTNHMVF

SEQ ID NO: 82308 - protein, 9 aa, Homo Sapiens
HTFYTQLVL

SEQ ID NO: 82309 - protein, 9 aa, Homo Sapiens
HTLPDSLVY

SEQ ID NO: 82310 - protein, 9 aa, Homo Sapiens
HTMDPQLRL

SEQ ID NO: 82311 - protein, 9 aa, Homo Sapiens
HTYQSPLLY

SEQ ID NO: 82312 - protein, 9 aa, Homo Sapiens
IAAKKVLRL

SEQ ID NO: 82313 - protein, 9 aa, Homo Sapiens
IAIGKVLKL

SEQ ID NO: 82314 - protein, 9 aa, Homo Sapiens
IAISRTPVL

SEQ ID NO: 82315 - protein, 9 aa, Homo Sapiens
IANQVQLFY

SEQ ID NO: 82316 - protein, 9 aa, Homo Sapiens
IAVEPVKTY

SEQ ID NO: 82317 - protein, 9 aa, Homo Sapiens
IIYENILKY

SEQ ID NO: 82318 - protein, 9 aa, Homo Sapiens
ILGPPGSVY

SEQ ID NO: 82319 - protein, 9 aa, Homo Sapiens
ILYPKTLFL

SEQ ID NO: 82320 - protein, 9 aa, Homo Sapiens
IQDTTISFL

SEQ ID NO: 82321 - protein, 9 aa, Homo Sapiens
ISAPLVKTL

SEQ ID NO: 82322 - protein, 9 aa, Homo Sapiens
ISCKEELLL

SEQ ID NO: 82323 - protein, 9 aa, Homo Sapiens
ISCQHAALL

SEQ ID NO: 82324 - protein, 9 aa, Homo Sapiens
ISELPVRTW

SEQ ID NO: 82325 - protein, 9 aa, Homo Sapiens
ISEQFTAMF

SEQ ID NO: 82326 - protein, 9 aa, Homo Sapiens
ISFLKTLSL

SEQ ID NO: 82327 - protein, 9 aa, Homo Sapiens
ISFPDPKML

SEQ ID NO: 82328 - protein, 9 aa, Homo Sapiens
ISGVPVLGF

SEQ ID NO: 82329 - protein, 9 aa, Homo Sapiens
ISIHRPLAY

SEQ ID NO: 82330 - protein, 9 aa, Homo Sapiens
ISILQQIEL

SEQ ID NO: 82331 - protein, 9 aa, Homo Sapiens
ISKYPTLKL

SEQ ID NO: 82332 - protein, 9 aa, Homo Sapiens
ISLEHEILL

SEQ ID NO: 82333 - protein, 9 aa, Homo Sapiens
ISLPEAMQL

SEQ ID NO: 82334 - protein, 9 aa, Homo Sapiens
ISLPKAIKL

SEQ ID NO: 82335 - protein, 9 aa, Homo Sapiens
ISLPKSATI

SEQ ID NO: 82336 - protein, 9 aa, Homo Sapiens
ISLQHALYL

SEQ ID NO: 82337 - protein, 9 aa, Homo Sapiens
ISLQQRLEY

SEQ ID NO: 82338 - protein, 9 aa, Homo Sapiens
ISNFHVLLL

SEQ ID NO: 82339 - protein, 9 aa, Homo Sapiens
ISNLIVLHL

SEQ ID NO: 82340 - protein, 9 aa, Homo Sapiens
ISNPKTAEF

SEQ ID NO: 82341 - protein, 9 aa, Homo Sapiens
ISNSHPLSL

SEQ ID NO: 82342 - protein, 9 aa, Homo Sapiens
ISQPRILLY

SEQ ID NO: 82343 - protein, 9 aa, Homo Sapiens
ISREGTLMI

SEQ ID NO: 82344 - protein, 9 aa, Homo Sapiens
ISRETGEPY

SEQ ID NO: 82345 - protein, 9 aa, Homo Sapiens
ISRHQEQFI

SEQ ID NO: 82346 - protein, 9 aa, Homo Sapiens
ISSPVILQF

SEQ ID NO: 82347 - protein, 9 aa, Homo Sapiens
ISSPVVTSL

SEQ ID NO: 82348 - protein, 9 aa, Homo Sapiens
ISSSMHSLY

SEQ ID NO: 82349 - protein, 9 aa, Homo Sapiens
ISTEVNPKL

SEQ ID NO: 82350 - protein, 9 aa, Homo Sapiens
ISVLMVSKY

SEQ ID NO: 82351 - protein, 9 aa, Homo Sapiens
ISVVQKLVL

SEQ ID NO: 82352 - protein, 9 aa, Homo Sapiens
ISWLGQPKL

SEQ ID NO: 82353 - protein, 9 aa, Homo Sapiens
ISYDRTLVI

SEQ ID NO: 82354 - protein, 9 aa, Homo Sapiens
ISYEITPRI

SEQ ID NO: 82355 - protein, 9 aa, Homo Sapiens
ISYKGTPAM

SEQ ID NO: 82356 - protein, 9 aa, Homo Sapiens
ITAHVEPLL

SEQ ID NO: 82357 - protein, 9 aa, Homo Sapiens
ITAKAVLKL

SEQ ID NO: 82358 - protein, 9 aa, Homo Sapiens
ITAKGQMAY

SEQ ID NO: 82359 - protein, 9 aa, Homo Sapiens
ITALAPSTM

SEQ ID NO: 82360 - protein, 9 aa, Homo Sapiens
ITAPTVRQY

SEQ ID NO: 82361 - protein, 9 aa, Homo Sapiens
ITAVGPAHF

SEQ ID NO: 82362 - protein, 9 aa, Homo Sapiens
ITEDFIATY

SEQ ID NO: 82363 - protein, 9 aa, Homo Sapiens
ITFEGKVAF

SEQ ID NO: 82364 - protein, 9 aa, Homo Sapiens
ITHFGPTTL

SEQ ID NO: 82365 - protein, 9 aa, Homo Sapiens
ITHQSLLML

SEQ ID NO: 82366 - protein, 9 aa, Homo Sapiens
ITIKPVLSL

SEQ ID NO: 82367 - protein, 9 aa, Homo Sapiens
ITIPKDLKL

SEQ ID NO: 82368 - protein, 9 aa, Homo Sapiens
ITIVRHLQY

SEQ ID NO: 82369 - protein, 9 aa, Homo Sapiens
ITKAKSLRI

SEQ ID NO: 82370 - protein, 9 aa, Homo Sapiens
ITKEGMLHY

SEQ ID NO: 82371 - protein, 9 aa, Homo Sapiens
ITLIPTCKF

SEQ ID NO: 82372 - protein, 9 aa, Homo Sapiens
ITLWHNLNY

SEQ ID NO: 82373 - protein, 9 aa, Homo Sapiens
ITNANELKY

SEQ ID NO: 82374 - protein, 9 aa, Homo Sapiens
ITNDTVQTY

SEQ ID NO: 82375 - protein, 9 aa, Homo Sapiens
ITNELILRL

SEQ ID NO: 82376 - protein, 9 aa, Homo Sapiens
ITNEQDLKM

SEQ ID NO: 82377 - protein, 9 aa, Homo Sapiens
ITNKYQLVF

SEQ ID NO: 82378 - protein, 9 aa, Homo Sapiens
ITNLQLLKI

SEQ ID NO: 82379 - protein, 9 aa, Homo Sapiens
ITNPKSLLY

SEQ ID NO: 82380 - protein, 9 aa, Homo Sapiens
ITNTRPLSY

SEQ ID NO: 82381 - protein, 9 aa, Homo Sapiens
ITNTVGSSI

SEQ ID NO: 82382 - protein, 9 aa, Homo Sapiens
ITPPVVLRL

SEQ ID NO: 82383 - protein, 9 aa, Homo Sapiens
ITQGTPLKY

SEQ ID NO: 82384 - protein, 9 aa, Homo Sapiens
ITRPNGERY

SEQ ID NO: 82385 - protein, 9 aa, Homo Sapiens
ITRQKQLFY

SEQ ID NO: 82386 - protein, 9 aa, Homo Sapiens
ITSAKTLEL

SEQ ID NO: 82387 - protein, 9 aa, Homo Sapiens
ITSELVSKI

SEQ ID NO: 82388 - protein, 9 aa, Homo Sapiens
ITSPTGETW

SEQ ID NO: 82389 - protein, 9 aa, Homo Sapiens
ITSSNFLHY

SEQ ID NO: 82390 - protein, 9 aa, Homo Sapiens
ITSTGPSLF

SEQ ID NO: 82391 - protein, 9 aa, Homo Sapiens
ITTDVNPYY

SEQ ID NO: 82392 - protein, 9 aa, Homo Sapiens
ITTHPALVL

SEQ ID NO: 82393 - protein, 9 aa, Homo Sapiens
ITTKAISRW

SEQ ID NO: 82394 - protein, 9 aa, Homo Sapiens
ITTLHNLLL

SEQ ID NO: 82395 - protein, 9 aa, Homo Sapiens
ITTTINPRF

SEQ ID NO: 82396 - protein, 9 aa, Homo Sapiens
ITVEKALAI

SEQ ID NO: 82397 - protein, 9 aa, Homo Sapiens
ITVEKIIKI

SEQ ID NO: 82398 - protein, 9 aa, Homo Sapiens
ITVHRHLML

SEQ ID NO: 82399 - protein, 9 aa, Homo Sapiens
ITVIFHPLL

SEQ ID NO: 82400 - protein, 9 aa, Homo Sapiens
ITVKDGKTL

SEQ ID NO: 82401 - protein, 9 aa, Homo Sapiens
ITVKRPLRF

SEQ ID NO: 82402 - protein, 9 aa, Homo Sapiens
ITWNRVVLL

SEQ ID NO: 82403 - protein, 9 aa, Homo Sapiens
ITYEGRQKM

SEQ ID NO: 82404 - protein, 9 aa, Homo Sapiens
ITYGKQPHL

SEQ ID NO: 82405 - protein, 9 aa, Homo Sapiens
ITYHSWLTF

SEQ ID NO: 82406 - protein, 9 aa, Homo Sapiens
ITYNKVLHF

SEQ ID NO: 82407 - protein, 9 aa, Homo Sapiens
ITYPMLFKL

SEQ ID NO: 82408 - protein, 9 aa, Homo Sapiens
ITYPQGLAL

SEQ ID NO: 82409 - protein, 9 aa, Homo Sapiens
ITYTFHSTW

SEQ ID NO: 82410 - protein, 9 aa, Homo Sapiens
IVMPNILVL

SEQ ID NO: 82411 - protein, 9 aa, Homo Sapiens
IVNGHTLLV

SEQ ID NO: 82412 - protein, 9 aa, Homo Sapiens
KAIEVLLTL

SEQ ID NO: 82413 - protein, 9 aa, Homo Sapiens
KAINPINTF

SEQ ID NO: 82414 - protein, 9 aa, Homo Sapiens
KALEQILEY

SEQ ID NO: 82415 - protein, 9 aa, Homo Sapiens
KALEVFPEF

SEQ ID NO: 82416 - protein, 9 aa, Homo Sapiens
KALEYVFKF

SEQ ID NO: 82417 - protein, 9 aa, Homo Sapiens
KAMPITLHL

SEQ ID NO: 82418 - protein, 9 aa, Homo Sapiens
KAVSLFLCY

SEQ ID NO: 82419 - protein, 9 aa, Homo Sapiens
KAYELALYL

SEQ ID NO: 82420 - protein, 9 aa, Homo Sapiens
KAYRLTPKL

SEQ ID NO: 82421 - protein, 9 aa, Homo Sapiens
KIFPAALQL

SEQ ID NO: 82422 - protein, 9 aa, Homo Sapiens
KIIEKMATF

SEQ ID NO: 82423 - protein, 9 aa, Homo Sapiens
KIIPKTLTW

SEQ ID NO: 82424 - protein, 9 aa, Homo Sapiens
KLCDVTLKI

SEQ ID NO: 82425 - protein, 9 aa, Homo Sapiens
KLFPYALAF

SEQ ID NO: 82426 - protein, 9 aa, Homo Sapiens
KLYEKFLEF

SEQ ID NO: 82427 - protein, 9 aa, Homo Sapiens
KQYDKALEI

SEQ ID NO: 82428 - protein, 9 aa, Homo Sapiens
KSANRVLRI

SEQ ID NO: 82429 - protein, 9 aa, Homo Sapiens
KSANSTLRL

SEQ ID NO: 82430 - protein, 9 aa, Homo Sapiens
KSAVSPSTF

SEQ ID NO: 82431 - protein, 9 aa, Homo Sapiens
KSCDLLLFL

SEQ ID NO: 82432 - protein, 9 aa, Homo Sapiens
KSCVIVLRI

SEQ ID NO: 82433 - protein, 9 aa, Homo Sapiens
KSDSHVRML

SEQ ID NO: 82434 - protein, 9 aa, Homo Sapiens
KSFAHILEL

SEQ ID NO: 82435 - protein, 9 aa, Homo Sapiens
KSFDFHFGF

SEQ ID NO: 82436 - protein, 9 aa, Homo Sapiens
KSFEGLFYF

SEQ ID NO: 82437 - protein, 9 aa, Homo Sapiens
KSFEKLMKI

SEQ ID NO: 82438 - protein, 9 aa, Homo Sapiens
KSFLFSALY

SEQ ID NO: 82439 - protein, 9 aa, Homo Sapiens
KSFNRHLHF

SEQ ID NO: 82440 - protein, 9 aa, Homo Sapiens
KSFSKLLEL

SEQ ID NO: 82441 - protein, 9 aa, Homo Sapiens
KSHLLVTGF

SEQ ID NO: 82442 - protein, 9 aa, Homo Sapiens
KSIARVLTV

SEQ ID NO: 82443 - protein, 9 aa, Homo Sapiens
KSIDNKALY

SEQ ID NO: 82444 - protein, 9 aa, Homo Sapiens
KSIDRVLDI

SEQ ID NO: 82445 - protein, 9 aa, Homo Sapiens
KSIEPVSSW

SEQ ID NO: 82446 - protein, 9 aa, Homo Sapiens
KSIYPTLEI

SEQ ID NO: 82447 - protein, 9 aa, Homo Sapiens
KSLAKALMI

SEQ ID NO: 82448 - protein, 9 aa, Homo Sapiens
KSLALLLGY

SEQ ID NO: 82449 - protein, 9 aa, Homo Sapiens
KSLCLKLLL

SEQ ID NO: 82450 - protein, 9 aa, Homo Sapiens
KSLDFVLGW

SEQ ID NO: 82451 - protein, 9 aa, Homo Sapiens
KSLDTTLQF

SEQ ID NO: 82452 - protein, 9 aa, Homo Sapiens
KSLEAFFLY

SEQ ID NO: 82453 - protein, 9 aa, Homo Sapiens
KSLEDTKKL

SEQ ID NO: 82454 - protein, 9 aa, Homo Sapiens
KSLENAIEW

SEQ ID NO: 82455 - protein, 9 aa, Homo Sapiens
KSLENILTL

SEQ ID NO: 82456 - protein, 9 aa, Homo Sapiens
KSLERATQL

SEQ ID NO: 82457 - protein, 9 aa, Homo Sapiens
KSLESKLIL

SEQ ID NO: 82458 - protein, 9 aa, Homo Sapiens
KSLGVTTKF

SEQ ID NO: 82459 - protein, 9 aa, Homo Sapiens
KSLLFVNTL

SEQ ID NO: 82460 - protein, 9 aa, Homo Sapiens
KSLPASLSF

SEQ ID NO: 82461 - protein, 9 aa, Homo Sapiens
KSLPSVLVI

SEQ ID NO: 82462 - protein, 9 aa, Homo Sapiens
KSLTGTLYL

SEQ ID NO: 82463 - protein, 9 aa, Homo Sapiens
KSLWYTLHF

SEQ ID NO: 82464 - protein, 9 aa, Homo Sapiens
KSMEPSLKY

SEQ ID NO: 82465 - protein, 9 aa, Homo Sapiens
KSMFQRTTY

SEQ ID NO: 82466 - protein, 9 aa, Homo Sapiens
KSNPKPLVL

SEQ ID NO: 82467 - protein, 9 aa, Homo Sapiens
KSNTWSPKY

SEQ ID NO: 82468 - protein, 9 aa, Homo Sapiens
KSQDKTLKI

SEQ ID NO: 82469 - protein, 9 aa, Homo Sapiens
KSSAISLHY

SEQ ID NO: 82470 - protein, 9 aa, Homo Sapiens
KSSATRLLY

SEQ ID NO: 82471 - protein, 9 aa, Homo Sapiens
KSSDKQLRI

SEQ ID NO: 82472 - protein, 9 aa, Homo Sapiens
KSVDWLLVF

SEQ ID NO: 82473 - protein, 9 aa, Homo Sapiens
KSVENQMRY

SEQ ID NO: 82474 - protein, 9 aa, Homo Sapiens
KSVQRCMAL

SEQ ID NO: 82475 - protein, 9 aa, Homo Sapiens
KSVRPGASY

SEQ ID NO: 82476 - protein, 9 aa, Homo Sapiens
KSYAGYQTL

SEQ ID NO: 82477 - protein, 9 aa, Homo Sapiens
KSYDRNYRL

SEQ ID NO: 82478 - protein, 9 aa, Homo Sapiens
KSYEAKLRL

SEQ ID NO: 82479 - protein, 9 aa, Homo Sapiens
KSYEVLLSF

SEQ ID NO: 82480 - protein, 9 aa, Homo Sapiens
KSYLRCITF

SEQ ID NO: 82481 - protein, 9 aa, Homo Sapiens
KSYQSFQTF

SEQ ID NO: 82482 - protein, 9 aa, Homo Sapiens
KSYSKAFTL

SEQ ID NO: 82483 - protein, 9 aa, Homo Sapiens
KSYVQGVTW

SEQ ID NO: 82484 - protein, 9 aa, Homo Sapiens
KSYYHVYKL

SEQ ID NO: 82485 - protein, 9 aa, Homo Sapiens
KSYYLRNTF

SEQ ID NO: 82486 - protein, 9 aa, Homo Sapiens
KTAEAQLAY

SEQ ID NO: 82487 - protein, 9 aa, Homo Sapiens
KTAEFLSKL

SEQ ID NO: 82488 - protein, 9 aa, Homo Sapiens
KTAERLLRF

SEQ ID NO: 82489 - protein, 9 aa, Homo Sapiens
KTAIGALKL

SEQ ID NO: 82490 - protein, 9 aa, Homo Sapiens
KTAQNHPML

SEQ ID NO: 82491 - protein, 9 aa, Homo Sapiens
KTAVVVGTI

SEQ ID NO: 82492 - protein, 9 aa, Homo Sapiens
KTFARYLSF

SEQ ID NO: 82493 - protein, 9 aa, Homo Sapiens
KTFERAMKL

SEQ ID NO: 82494 - protein, 9 aa, Homo Sapiens
KTFIFHSSI

SEQ ID NO: 82495 - protein, 9 aa, Homo Sapiens
KTFKRILVL

SEQ ID NO: 82496 - protein, 9 aa, Homo Sapiens
KTFLFSATM

SEQ ID NO: 82497 - protein, 9 aa, Homo Sapiens
KTFNQQLTL

SEQ ID NO: 82498 - protein, 9 aa, Homo Sapiens
KTFPFHFMF

SEQ ID NO: 82499 - protein, 9 aa, Homo Sapiens
KTFVQKQTL

SEQ ID NO: 82500 - protein, 9 aa, Homo Sapiens
KTFVQKSTL

SEQ ID NO: 82501 - protein, 9 aa, Homo Sapiens
KTFVTYTVY

SEQ ID NO: 82502 - protein, 9 aa, Homo Sapiens
KTHLQHLRW

SEQ ID NO: 82503 - protein, 9 aa, Homo Sapiens
KTHLYTLIL

SEQ ID NO: 82504 - protein, 9 aa, Homo Sapiens
KTIDGILLL

SEQ ID NO: 82505 - protein, 9 aa, Homo Sapiens
KTIETSPSL

SEQ ID NO: 82506 - protein, 9 aa, Homo Sapiens
KTIIKKLFF

SEQ ID NO: 82507 - protein, 9 aa, Homo Sapiens
KTILDPLTL

SEQ ID NO: 82508 - protein, 9 aa, Homo Sapiens
KTIQKAALL

SEQ ID NO: 82509 - protein, 9 aa, Homo Sapiens
KTIQQTLIL

SEQ ID NO: 82510 - protein, 9 aa, Homo Sapiens
KTISVVLQL

SEQ ID NO: 82511 - protein, 9 aa, Homo Sapiens
KTIVMGASF

SEQ ID NO: 82512 - protein, 9 aa, Homo Sapiens
KTKEIEQVY

SEQ ID NO: 82513 - protein, 9 aa, Homo Sapiens
KTLARALGL

SEQ ID NO: 82514 - protein, 9 aa, Homo Sapiens
KTLEMELKL

SEQ ID NO: 82515 - protein, 9 aa, Homo Sapiens
KTLEQALQL

SEQ ID NO: 82516 - protein, 9 aa, Homo Sapiens
KTLERSYLL

SEQ ID NO: 82517 - protein, 9 aa, Homo Sapiens
KTLESMSSY

SEQ ID NO: 82518 - protein, 9 aa, Homo Sapiens
KTLILCLTF

SEQ ID NO: 82519 - protein, 9 aa, Homo Sapiens
KTLNYTARF

SEQ ID NO: 82520 - protein, 9 aa, Homo Sapiens
KTLPSMLIL

SEQ ID NO: 82521 - protein, 9 aa, Homo Sapiens
KTLRFVAHY

SEQ ID NO: 82522 - protein, 9 aa, Homo Sapiens
KTLSAILRI

SEQ ID NO: 82523 - protein, 9 aa, Homo Sapiens
KTMKQQLQF

SEQ ID NO: 82524 - protein, 9 aa, Homo Sapiens
KTNEMLLNF

SEQ ID NO: 82525 - protein, 9 aa, Homo Sapiens
KTNVFNATF

SEQ ID NO: 82526 - protein, 9 aa, Homo Sapiens
KTPEVHLKY

SEQ ID NO: 82527 - protein, 9 aa, Homo Sapiens
KTRQIISTI

SEQ ID NO: 82528 - protein, 9 aa, Homo Sapiens
KTSDRCLAW

SEQ ID NO: 82529 - protein, 9 aa, Homo Sapiens
KTSPKALVI

SEQ ID NO: 82530 - protein, 9 aa, Homo Sapiens
KTVDQHMKL

SEQ ID NO: 82531 - protein, 9 aa, Homo Sapiens
KTVDVLLKL

SEQ ID NO: 82532 - protein, 9 aa, Homo Sapiens
KTVEEALTI

SEQ ID NO: 82533 - protein, 9 aa, Homo Sapiens
KTVEQHLRL

SEQ ID NO: 82534 - protein, 9 aa, Homo Sapiens
KTVNKILQI

SEQ ID NO: 82535 - protein, 9 aa, Homo Sapiens
KTWDKVAVL

SEQ ID NO: 82536 - protein, 9 aa, Homo Sapiens
KTYDKTVAL

SEQ ID NO: 82537 - protein, 9 aa, Homo Sapiens
KTYDLLFKL

SEQ ID NO: 82538 - protein, 9 aa, Homo Sapiens
KTYDYLFKL

SEQ ID NO: 82539 - protein, 9 aa, Homo Sapiens
KTYGNVLVL

SEQ ID NO: 82540 - protein, 9 aa, Homo Sapiens
KTYIPILAF

SEQ ID NO: 82541 - protein, 9 aa, Homo Sapiens
KTYKQISTL

SEQ ID NO: 82542 - protein, 9 aa, Homo Sapiens
KTYQETPEI

SEQ ID NO: 82543 - protein, 9 aa, Homo Sapiens
KTYVLKSKL

SEQ ID NO: 82544 - protein, 9 aa, Homo Sapiens
KTYVTQTLL

SEQ ID NO: 82545 - protein, 9 aa, Homo Sapiens
KVADMALHY

SEQ ID NO: 82546 - protein, 9 aa, Homo Sapiens
KVADPVVTF

SEQ ID NO: 82547 - protein, 9 aa, Homo Sapiens
KVAPVVITY

SEQ ID NO: 82548 - protein, 9 aa, Homo Sapiens
KVFERQLQL

SEQ ID NO: 82549 - protein, 9 aa, Homo Sapiens
KVIEINPYL

SEQ ID NO: 82550 - protein, 9 aa, Homo Sapiens
KVISKDLVI

SEQ ID NO: 82551 - protein, 9 aa, Homo Sapiens
KVKETELEL

SEQ ID NO: 82552 - protein, 9 aa, Homo Sapiens
KVLDKLLLY

SEQ ID NO: 82553 - protein, 9 aa, Homo Sapiens
KVLEHVPLL

SEQ ID NO: 82554 - protein, 9 aa, Homo Sapiens
KVLGKALSL

SEQ ID NO: 82555 - protein, 9 aa, Homo Sapiens
KVLNKVLAI

SEQ ID NO: 82556 - protein, 9 aa, Homo Sapiens
KVLPRDLQL

SEQ ID NO: 82557 - protein, 9 aa, Homo Sapiens
KVLQNALLL

SEQ ID NO: 82558 - protein, 9 aa, Homo Sapiens
KVLSGALKL

SEQ ID NO: 82559 - protein, 9 aa, Homo Sapiens
KVMEHLLKL

SEQ ID NO: 82560 - protein, 9 aa, Homo Sapiens
KVYEKLMKI

SEQ ID NO: 82561 - protein, 9 aa, Homo Sapiens
KVYENYPTY

SEQ ID NO: 82562 - protein, 9 aa, Homo Sapiens
KVYNIQIRY

SEQ ID NO: 82563 - protein, 9 aa, Homo Sapiens
KVYTRTPTL

SEQ ID NO: 82564 - protein, 9 aa, Homo Sapiens
LAAPVISVL

SEQ ID NO: 82565 - protein, 9 aa, Homo Sapiens
LACGRNLKL

SEQ ID NO: 82566 - protein, 9 aa, Homo Sapiens
LAFSRALEL

SEQ ID NO: 82567 - protein, 9 aa, Homo Sapiens
LAIAGTLKF

SEQ ID NO: 82568 - protein, 9 aa, Homo Sapiens
LAWLRVLRL

SEQ ID NO: 82569 - protein, 9 aa, Homo Sapiens
LAYDTQLVL

SEQ ID NO: 82570 - protein, 9 aa, Homo Sapiens
LIYSGKLLL

SEQ ID NO: 82571 - protein, 9 aa, Homo Sapiens
LQMAKQLGY

SEQ ID NO: 82572 - protein, 9 aa, Homo Sapiens
LQWDKVLRL

SEQ ID NO: 82573 - protein, 9 aa, Homo Sapiens
LRLSYPLEL

SEQ ID NO: 82574 - protein, 9 aa, Homo Sapiens
LRLTALLLR

SEQ ID NO: 82575 - protein, 9 aa, Homo Sapiens
LSACKILKL

SEQ ID NO: 82576 - protein, 9 aa, Homo Sapiens
LSADPRSVY

SEQ ID NO: 82577 - protein, 9 aa, Homo Sapiens
LSAIPVSAF

SEQ ID NO: 82578 - protein, 9 aa, Homo Sapiens
LSAIYGGTY

SEQ ID NO: 82579 - protein, 9 aa, Homo Sapiens
LSALKTLSL

SEQ ID NO: 82580 - protein, 9 aa, Homo Sapiens
LSAPDALKI

SEQ ID NO: 82581 - protein, 9 aa, Homo Sapiens
LSAPIMSRF

SEQ ID NO: 82582 - protein, 9 aa, Homo Sapiens
LSAPLIGAL

SEQ ID NO: 82583 - protein, 9 aa, Homo Sapiens
LSAPNLNSW

SEQ ID NO: 82584 - protein, 9 aa, Homo Sapiens
LSAVHSPTF

SEQ ID NO: 82585 - protein, 9 aa, Homo Sapiens
LSAVPLRTY

SEQ ID NO: 82586 - protein, 9 aa, Homo Sapiens
LSDDHVLIL

SEQ ID NO: 82587 - protein, 9 aa, Homo Sapiens
LSDEYKQIL

SEQ ID NO: 82588 - protein, 9 aa, Homo Sapiens
LSEEQCREL

SEQ ID NO: 82589 - protein, 9 aa, Homo Sapiens
LSEPDLASY

SEQ ID NO: 82590 - protein, 9 aa, Homo Sapiens
LSFKDPFVI

SEQ ID NO: 82591 - protein, 9 aa, Homo Sapiens
LSFPTTKTY

SEQ ID NO: 82592 - protein, 9 aa, Homo Sapiens
LSFSQVFKL

SEQ ID NO: 82593 - protein, 9 aa, Homo Sapiens
LSFTHPISF

SEQ ID NO: 82594 - protein, 9 aa, Homo Sapiens
LSHAITLEF

SEQ ID NO: 82595 - protein, 9 aa, Homo Sapiens
LSHSLLVTL

SEQ ID NO: 82596 - protein, 9 aa, Homo Sapiens
LSIEKALDL

SEQ ID NO: 82597 - protein, 9 aa, Homo Sapiens
LSIKDPKLY

SEQ ID NO: 82598 - protein, 9 aa, Homo Sapiens
LSIPYRLIF

SEQ ID NO: 82599 - protein, 9 aa, Homo Sapiens
LSIVDRTTI

SEQ ID NO: 82600 - protein, 9 aa, Homo Sapiens
LSKDSILSL

SEQ ID NO: 82601 - protein, 9 aa, Homo Sapiens
LSLADTLRY

SEQ ID NO: 82602 - protein, 9 aa, Homo Sapiens
LSLEEILRL

SEQ ID NO: 82603 - protein, 9 aa, Homo Sapiens
LSLEFPSGY

SEQ ID NO: 82604 - protein, 9 aa, Homo Sapiens
LSLEKPLLL

SEQ ID NO: 82605 - protein, 9 aa, Homo Sapiens
LSLENVLYY

SEQ ID NO: 82606 - protein, 9 aa, Homo Sapiens
LSLISIMKY

SEQ ID NO: 82607 - protein, 9 aa, Homo Sapiens
LSLLGILKY

SEQ ID NO: 82608 - protein, 9 aa, Homo Sapiens
LSLLQKLIL

SEQ ID NO: 82609 - protein, 9 aa, Homo Sapiens
LSLPGILHF

SEQ ID NO: 82610 - protein, 9 aa, Homo Sapiens
LSLPKQLVL

SEQ ID NO: 82611 - protein, 9 aa, Homo Sapiens
LSLSRSLVL

SEQ ID NO: 82612 - protein, 9 aa, Homo Sapiens
LSNDHICYF

SEQ ID NO: 82613 - protein, 9 aa, Homo Sapiens
LSNEQVLKF

SEQ ID NO: 82614 - protein, 9 aa, Homo Sapiens
LSNISHLNY

SEQ ID NO: 82615 - protein, 9 aa, Homo Sapiens
LSNMKILTL

SEQ ID NO: 82616 - protein, 9 aa, Homo Sapiens
LSNSRQLKW

SEQ ID NO: 82617 - protein, 9 aa, Homo Sapiens
LSNTVMPRF

SEQ ID NO: 82618 - protein, 9 aa, Homo Sapiens
LSNTWNEKY

SEQ ID NO: 82619 - protein, 9 aa, Homo Sapiens
LSNVQRLTF

SEQ ID NO: 82620 - protein, 9 aa, Homo Sapiens
LSSPLNPKL

SEQ ID NO: 82621 - protein, 9 aa, Homo Sapiens
LSSPRHLKF

SEQ ID NO: 82622 - protein, 9 aa, Homo Sapiens
LSSTEILKW

SEQ ID NO: 82623 - protein, 9 aa, Homo Sapiens
LSSVTQLHL

SEQ ID NO: 82624 - protein, 9 aa, Homo Sapiens
LSTIKQLLW

SEQ ID NO: 82625 - protein, 9 aa, Homo Sapiens
LSTKPPGTF

SEQ ID NO: 82626 - protein, 9 aa, Homo Sapiens
LSTLVRPVF

SEQ ID NO: 82627 - protein, 9 aa, Homo Sapiens
LSTRLTLLL

SEQ ID NO: 82628 - protein, 9 aa, Homo Sapiens
LSVKFGATL

SEQ ID NO: 82629 - protein, 9 aa, Homo Sapiens
LSVLKVLVL

SEQ ID NO: 82630 - protein, 9 aa, Homo Sapiens
LSVPAGFLL

SEQ ID NO: 82631 - protein, 9 aa, Homo Sapiens
LSYDGRLVI

SEQ ID NO: 82632 - protein, 9 aa, Homo Sapiens
LSYGPGPSL

SEQ ID NO: 82633 - protein, 9 aa, Homo Sapiens
LSYGVASSY

SEQ ID NO: 82634 - protein, 9 aa, Homo Sapiens
LSYKSVISF

SEQ ID NO: 82635 - protein, 9 aa, Homo Sapiens
LSYLGFETY

SEQ ID NO: 82636 - protein, 9 aa, Homo Sapiens
LSYNLPLEL

SEQ ID NO: 82637 - protein, 9 aa, Homo Sapiens
LSYSEILRL

SEQ ID NO: 82638 - protein, 9 aa, Homo Sapiens
LSYTEILKI

SEQ ID NO: 82639 - protein, 9 aa, Homo Sapiens
LTADSHPSY

SEQ ID NO: 82640 - protein, 9 aa, Homo Sapiens
LTALGKLLY

SEQ ID NO: 82641 - protein, 9 aa, Homo Sapiens
LTANTGHTI

SEQ ID NO: 82642 - protein, 9 aa, Homo Sapiens
LTAPVIGYI

SEQ ID NO: 82643 - protein, 9 aa, Homo Sapiens
LTCTFNLKI

SEQ ID NO: 82644 - protein, 9 aa, Homo Sapiens
LTEPIISRF

SEQ ID NO: 82645 - protein, 9 aa, Homo Sapiens
LTFVRQLEI

SEQ ID NO: 82646 - protein, 9 aa, Homo Sapiens
LTHASSLGY

SEQ ID NO: 82647 - protein, 9 aa, Homo Sapiens
LTHDVELNL

SEQ ID NO: 82648 - protein, 9 aa, Homo Sapiens
LTHEQQLIL

SEQ ID NO: 82649 - protein, 9 aa, Homo Sapiens
LTHEVPLSL

SEQ ID NO: 82650 - protein, 9 aa, Homo Sapiens
LTHKGVKEF

SEQ ID NO: 82651 - protein, 9 aa, Homo Sapiens
LTHKRILKF

SEQ ID NO: 82652 - protein, 9 aa, Homo Sapiens
LTHSLVLHY

SEQ ID NO: 82653 - protein, 9 aa, Homo Sapiens
LTHSSRLKL

SEQ ID NO: 82654 - protein, 9 aa, Homo Sapiens
LTHWEQLDY

SEQ ID NO: 82655 - protein, 9 aa, Homo Sapiens
LTIDHVPIW

SEQ ID NO: 82656 - protein, 9 aa, Homo Sapiens
LTIKNFLEF

SEQ ID NO: 82657 - protein, 9 aa, Homo Sapiens
LTIVDTPGF

SEQ ID NO: 82658 - protein, 9 aa, Homo Sapiens
LTKAKEALI

SEQ ID NO: 82659 - protein, 9 aa, Homo Sapiens
LTKLITLQI

SEQ ID NO: 82660 - protein, 9 aa, Homo Sapiens
LTKLRTLLL

SEQ ID NO: 82661 - protein, 9 aa, Homo Sapiens
LTKQEFQTL

SEQ ID NO: 82662 - protein, 9 aa, Homo Sapiens
LTLEGIRQF

SEQ ID NO: 82663 - protein, 9 aa, Homo Sapiens
LTLEGVARY

SEQ ID NO: 82664 - protein, 9 aa, Homo Sapiens
LTLGHQFRL

SEQ ID NO: 82665 - protein, 9 aa, Homo Sapiens
LTLPRSLLL

SEQ ID NO: 82666 - protein, 9 aa, Homo Sapiens
LTLPSALHF

SEQ ID NO: 82667 - protein, 9 aa, Homo Sapiens
LTMPDTPRL

SEQ ID NO: 82668 - protein, 9 aa, Homo Sapiens
LTMTRNAVW

SEQ ID NO: 82669 - protein, 9 aa, Homo Sapiens
LTNKVQYVI

SEQ ID NO: 82670 - protein, 9 aa, Homo Sapiens
LTNPRTLKI

SEQ ID NO: 82671 - protein, 9 aa, Homo Sapiens
LTREDGLKY

SEQ ID NO: 82672 - protein, 9 aa, Homo Sapiens
LTRPGSSYF

SEQ ID NO: 82673 - protein, 9 aa, Homo Sapiens
LTRVPTSQL

SEQ ID NO: 82674 - protein, 9 aa, Homo Sapiens
LTSAKCLTY

SEQ ID NO: 82675 - protein, 9 aa, Homo Sapiens
LTSEQRLLI

SEQ ID NO: 82676 - protein, 9 aa, Homo Sapiens
LTSEWFAKY

SEQ ID NO: 82677 - protein, 9 aa, Homo Sapiens
LTSKFMTTF

SEQ ID NO: 82678 - protein, 9 aa, Homo Sapiens
LTSRGSQQY

SEQ ID NO: 82679 - protein, 9 aa, Homo Sapiens
LTSRMKITL

SEQ ID NO: 82680 - protein, 9 aa, Homo Sapiens
LTSSHTVMI

SEQ ID NO: 82681 - protein, 9 aa, Homo Sapiens
LTTEVHPEL

SEQ ID NO: 82682 - protein, 9 aa, Homo Sapiens
LTTGGTLKI

SEQ ID NO: 82683 - protein, 9 aa, Homo Sapiens
LTTLRALYL

SEQ ID NO: 82684 - protein, 9 aa, Homo Sapiens
LTTSRQLTL

SEQ ID NO: 82685 - protein, 9 aa, Homo Sapiens
LTVIDTPGF

SEQ ID NO: 82686 - protein, 9 aa, Homo Sapiens
LTVRNLPQY

SEQ ID NO: 82687 - protein, 9 aa, Homo Sapiens
LTVSNIESF

SEQ ID NO: 82688 - protein, 9 aa, Homo Sapiens
LTVVQPLTL

SEQ ID NO: 82689 - protein, 9 aa, Homo Sapiens
LTWERMLGL

SEQ ID NO: 82690 - protein, 9 aa, Homo Sapiens
LTWGGHWLY

SEQ ID NO: 82691 - protein, 9 aa, Homo Sapiens
LTWKKIIKF

SEQ ID NO: 82692 - protein, 9 aa, Homo Sapiens
LTYASPPLI

SEQ ID NO: 82693 - protein, 9 aa, Homo Sapiens
LTYDFVHVI

SEQ ID NO: 82694 - protein, 9 aa, Homo Sapiens
LTYHGHLYL

SEQ ID NO: 82695 - protein, 9 aa, Homo Sapiens
LTYISKVSI

SEQ ID NO: 82696 - protein, 9 aa, Homo Sapiens
LTYLGCMKV

SEQ ID NO: 82697 - protein, 9 aa, Homo Sapiens
LTYLLQNSL

SEQ ID NO: 82698 - protein, 9 aa, Homo Sapiens
LTYMPSVSL

SEQ ID NO: 82699 - protein, 9 aa, Homo Sapiens
LTYNVKIFY

SEQ ID NO: 82700 - protein, 9 aa, Homo Sapiens
LTYVPLLGL

SEQ ID NO: 82701 - protein, 9 aa, Homo Sapiens
LVIGRVLEL

SEQ ID NO: 82702 - protein, 9 aa, Homo Sapiens
LVNDQLLGF

SEQ ID NO: 82703 - protein, 9 aa, Homo Sapiens
LVNSETLKI

SEQ ID NO: 82704 - protein, 9 aa, Homo Sapiens
MAYARQIYI

SEQ ID NO: 82705 - protein, 9 aa, Homo Sapiens
MAYGGKLKY

SEQ ID NO: 82706 - protein, 9 aa, Homo Sapiens
MGYNKALEL

SEQ ID NO: 82707 - protein, 9 aa, Homo Sapiens
MILNKALLL

SEQ ID NO: 82708 - protein, 9 aa, Homo Sapiens
MIYRKALRL

SEQ ID NO: 82709 - protein, 9 aa, Homo Sapiens
MMYSGELKF

SEQ ID NO: 82710 - protein, 9 aa, Homo Sapiens
MSHKRIMLF

SEQ ID NO: 82711 - protein, 9 aa, Homo Sapiens
MSLKWMSVF

SEQ ID NO: 82712 - protein, 9 aa, Homo Sapiens
MSLPYRLVF

SEQ ID NO: 82713 - protein, 9 aa, Homo Sapiens
MSMVANLLY

SEQ ID NO: 82714 - protein, 9 aa, Homo Sapiens
MSNTPTHSI

SEQ ID NO: 82715 - protein, 9 aa, Homo Sapiens
MSQLNPLKI

SEQ ID NO: 82716 - protein, 9 aa, Homo Sapiens
MSVEVRQTL

SEQ ID NO: 82717 - protein, 9 aa, Homo Sapiens
MSVQPTVSL

SEQ ID NO: 82718 - protein, 9 aa, Homo Sapiens
MSYAEVMRL

SEQ ID NO: 82719 - protein, 9 aa, Homo Sapiens
MSYEQLMQL

SEQ ID NO: 82720 - protein, 9 aa, Homo Sapiens
MSYPAKVTL

SEQ ID NO: 82721 - protein, 9 aa, Homo Sapiens
MTAPLKLTY

SEQ ID NO: 82722 - protein, 9 aa, Homo Sapiens
MTHCGVLEF

SEQ ID NO: 82723 - protein, 9 aa, Homo Sapiens
MTHDGYLKL

SEQ ID NO: 82724 - protein, 9 aa, Homo Sapiens
MTHNLLLNY

SEQ ID NO: 82725 - protein, 9 aa, Homo Sapiens
MTILGSAVL

SEQ ID NO: 82726 - protein, 9 aa, Homo Sapiens
MTIRFDSSF

SEQ ID NO: 82727 - protein, 9 aa, Homo Sapiens
MTKEECLQF

SEQ ID NO: 82728 - protein, 9 aa, Homo Sapiens
MTKKKELTL

SEQ ID NO: 82729 - protein, 9 aa, Homo Sapiens
MTKKPGMFF

SEQ ID NO: 82730 - protein, 9 aa, Homo Sapiens
MTLKSALAL

SEQ ID NO: 82731 - protein, 9 aa, Homo Sapiens
MTNGFHMTW

SEQ ID NO: 82732 - protein, 9 aa, Homo Sapiens
MTNPHNHLY

SEQ ID NO: 82733 - protein, 9 aa, Homo Sapiens
MTQTPALKF

SEQ ID NO: 82734 - protein, 9 aa, Homo Sapiens
MTSDHSPVF

SEQ ID NO: 82735 - protein, 9 aa, Homo Sapiens
MTSPLNLSY

SEQ ID NO: 82736 - protein, 9 aa, Homo Sapiens
MTTLQVLTL

SEQ ID NO: 82737 - protein, 9 aa, Homo Sapiens
MTTPQVLKL

SEQ ID NO: 82738 - protein, 9 aa, Homo Sapiens
MTVPGALRL

SEQ ID NO: 82739 - protein, 9 aa, Homo Sapiens
MTVQILLKL

SEQ ID NO: 82740 - protein, 9 aa, Homo Sapiens
MTYERILYI

SEQ ID NO: 82741 - protein, 9 aa, Homo Sapiens
MVLLRVLIL

SEQ ID NO: 82742 - protein, 9 aa, Homo Sapiens
MVVDRALYL

SEQ ID NO: 82743 - protein, 9 aa, Homo Sapiens
NAIEHTLQW

SEQ ID NO: 82744 - protein, 9 aa, Homo Sapiens
NSFIHVIMY

SEQ ID NO: 82745 - protein, 9 aa, Homo Sapiens
NTYPIKLFY

SEQ ID NO: 82746 - protein, 9 aa, Homo Sapiens
QAFFLHTTY

SEQ ID NO: 82747 - protein, 9 aa, Homo Sapiens
QAHSQLLQY

SEQ ID NO: 82748 - protein, 9 aa, Homo Sapiens
QAIGPTLLL

SEQ ID NO: 82749 - protein, 9 aa, Homo Sapiens
QAIQWILHY

SEQ ID NO: 82750 - protein, 9 aa, Homo Sapiens
QALEKILQL

SEQ ID NO: 82751 - protein, 9 aa, Homo Sapiens
QSAQHALRL

SEQ ID NO: 82752 - protein, 9 aa, Homo Sapiens
QSAVMSATF

SEQ ID NO: 82753 - protein, 9 aa, Homo Sapiens
QSCNFALRF

SEQ ID NO: 82754 - protein, 9 aa, Homo Sapiens
QSFPEPLII

SEQ ID NO: 82755 - protein, 9 aa, Homo Sapiens
QSIAFISRL

SEQ ID NO: 82756 - protein, 9 aa, Homo Sapiens
QSIEWPLKF

SEQ ID NO: 82757 - protein, 9 aa, Homo Sapiens
QSIPAVLEI

SEQ ID NO: 82758 - protein, 9 aa, Homo Sapiens
QSIQQALRY

SEQ ID NO: 82759 - protein, 9 aa, Homo Sapiens
QSISPGSRL

SEQ ID NO: 82760 - protein, 9 aa, Homo Sapiens
QSIVPALEI

SEQ ID NO: 82761 - protein, 9 aa, Homo Sapiens
QSKSPGSSW

SEQ ID NO: 82762 - protein, 9 aa, Homo Sapiens
QSLEIISRY

SEQ ID NO: 82763 - protein, 9 aa, Homo Sapiens
QSLGKPLVL

SEQ ID NO: 82764 - protein, 9 aa, Homo Sapiens
QSLHPPLKI

SEQ ID NO: 82765 - protein, 9 aa, Homo Sapiens
QSLILDLKY

SEQ ID NO: 82766 - protein, 9 aa, Homo Sapiens
QSLQHYLEL

SEQ ID NO: 82767 - protein, 9 aa, Homo Sapiens
QSLSNPLSI

SEQ ID NO: 82768 - protein, 9 aa, Homo Sapiens
QSLVKSLLL

SEQ ID NO: 82769 - protein, 9 aa, Homo Sapiens
QSMIRILGL

SEQ ID NO: 82770 - protein, 9 aa, Homo Sapiens
QSQSHTLAI

SEQ ID NO: 82771 - protein, 9 aa, Homo Sapiens
QSVASVLLY

SEQ ID NO: 82772 - protein, 9 aa, Homo Sapiens
QSYIFPSSI

SEQ ID NO: 82773 - protein, 9 aa, Homo Sapiens
QSYNKSFCY

SEQ ID NO: 82774 - protein, 9 aa, Homo Sapiens
QSYQGHPAL

SEQ ID NO: 82775 - protein, 9 aa, Homo Sapiens
QSYSWRSTL

SEQ ID NO: 82776 - protein, 9 aa, Homo Sapiens
QSYWNHREL

SEQ ID NO: 82777 - protein, 9 aa, Homo Sapiens
QTAEFKEAF

SEQ ID NO: 82778 - protein, 9 aa, Homo Sapiens
QTAFPALQL

SEQ ID NO: 82779 - protein, 9 aa, Homo Sapiens
QTAIHRVTL

SEQ ID NO: 82780 - protein, 9 aa, Homo Sapiens
QTALYTLKL

SEQ ID NO: 82781 - protein, 9 aa, Homo Sapiens
QTATQLLKL

SEQ ID NO: 82782 - protein, 9 aa, Homo Sapiens
QTCRLLLSY

SEQ ID NO: 82783 - protein, 9 aa, Homo Sapiens
QTCSRVLVF

SEQ ID NO: 82784 - protein, 9 aa, Homo Sapiens
QTFLKALLF

SEQ ID NO: 82785 - protein, 9 aa, Homo Sapiens
QTHENMSQL

SEQ ID NO: 82786 - protein, 9 aa, Homo Sapiens
QTIGNHASY

SEQ ID NO: 82787 - protein, 9 aa, Homo Sapiens
QTIGYQIRL

SEQ ID NO: 82788 - protein, 9 aa, Homo Sapiens
QTIINNASY

SEQ ID NO: 82789 - protein, 9 aa, Homo Sapiens
QTISPLSTY

SEQ ID NO: 82790 - protein, 9 aa, Homo Sapiens
QTKAEGPTI

SEQ ID NO: 82791 - protein, 9 aa, Homo Sapiens
QTLARQMQL

SEQ ID NO: 82792 - protein, 9 aa, Homo Sapiens
QTLENISNI

SEQ ID NO: 82793 - protein, 9 aa, Homo Sapiens
QTLGKPLLI

SEQ ID NO: 82794 - protein, 9 aa, Homo Sapiens
QTLIKTLIF

SEQ ID NO: 82795 - protein, 9 aa, Homo Sapiens
QTLLKTLEL

SEQ ID NO: 82796 - protein, 9 aa, Homo Sapiens
QTLQRSISF

SEQ ID NO: 82797 - protein, 9 aa, Homo Sapiens
QTLRFLGLY

SEQ ID NO: 82798 - protein, 9 aa, Homo Sapiens
QTLVNLDTY

SEQ ID NO: 82799 - protein, 9 aa, Homo Sapiens
QTMDNHMQL

SEQ ID NO: 82800 - protein, 9 aa, Homo Sapiens
QTNDVLLTF

SEQ ID NO: 82801 - protein, 9 aa, Homo Sapiens
QTNIQHFLF

SEQ ID NO: 82802 - protein, 9 aa, Homo Sapiens
QTNQNQLHL

SEQ ID NO: 82803 - protein, 9 aa, Homo Sapiens
QTSSSTLKF

SEQ ID NO: 82804 - protein, 9 aa, Homo Sapiens
QTTDWRATL

SEQ ID NO: 82805 - protein, 9 aa, Homo Sapiens
QTTSHELTI

SEQ ID NO: 82806 - protein, 9 aa, Homo Sapiens
QTVAQRLKF

SEQ ID NO: 82807 - protein, 9 aa, Homo Sapiens
QTVQDGRQF

SEQ ID NO: 82808 - protein, 9 aa, Homo Sapiens
QTVQSILRF

SEQ ID NO: 82809 - protein, 9 aa, Homo Sapiens
QTVRGTLAY

SEQ ID NO: 82810 - protein, 9 aa, Homo Sapiens
QTVSPAEKW

SEQ ID NO: 82811 - protein, 9 aa, Homo Sapiens
QTYFFPIHL

SEQ ID NO: 82812 - protein, 9 aa, Homo Sapiens
QTYGSTLKV

SEQ ID NO: 82813 - protein, 9 aa, Homo Sapiens
QTYPQALTL

SEQ ID NO: 82814 - protein, 9 aa, Homo Sapiens
QTYSEELCY

SEQ ID NO: 82815 - protein, 9 aa, Homo Sapiens
QTYSGVPII

SEQ ID NO: 82816 - protein, 9 aa, Homo Sapiens
QTYYRIFTW

SEQ ID NO: 82817 - protein, 9 aa, Homo Sapiens
QVAQMQLKY

SEQ ID NO: 82818 - protein, 9 aa, Homo Sapiens
QVCKNTLRL

SEQ ID NO: 82819 - protein, 9 aa, Homo Sapiens
QVHNLLLTY

SEQ ID NO: 82820 - protein, 9 aa, Homo Sapiens
QVLEHQVKY

SEQ ID NO: 82821 - protein, 9 aa, Homo Sapiens
QVLGRVLQL

SEQ ID NO: 82822 - protein, 9 aa, Homo Sapiens
QVLQLCLRY

SEQ ID NO: 82823 - protein, 9 aa, Homo Sapiens
QVYETLLTY

SEQ ID NO: 82824 - protein, 9 aa, Homo Sapiens
QVYIRQLRL

SEQ ID NO: 82825 - protein, 9 aa, Homo Sapiens
QVYLKALLL

SEQ ID NO: 82826 - protein, 9 aa, Homo Sapiens
RAAERALQL

SEQ ID NO: 82827 - protein, 9 aa, Homo Sapiens
RAAPFSLEY

SEQ ID NO: 82828 - protein, 9 aa, Homo Sapiens
RACHNLLTF

SEQ ID NO: 82829 - protein, 9 aa, Homo Sapiens
RAEPTVTNI

SEQ ID NO: 82830 - protein, 9 aa, Homo Sapiens
RAFDQKLIF

SEQ ID NO: 82831 - protein, 9 aa, Homo Sapiens
RAFHPDLEF

SEQ ID NO: 82832 - protein, 9 aa, Homo Sapiens
RAHEVALRL

SEQ ID NO: 82833 - protein, 9 aa, Homo Sapiens
RAHNVPLKL

SEQ ID NO: 82834 - protein, 9 aa, Homo Sapiens
RAIENIDTL

SEQ ID NO: 82835 - protein, 9 aa, Homo Sapiens
RAIQFYLEF

SEQ ID NO: 82836 - protein, 9 aa, Homo Sapiens
RAIVWLAGY

SEQ ID NO: 82837 - protein, 9 aa, Homo Sapiens
RALDHYLTL

SEQ ID NO: 82838 - protein, 9 aa, Homo Sapiens
RALDYALQI

SEQ ID NO: 82839 - protein, 9 aa, Homo Sapiens
RALHWYAKY

SEQ ID NO: 82840 - protein, 9 aa, Homo Sapiens
RALQFSLML

SEQ ID NO: 82841 - protein, 9 aa, Homo Sapiens
RASPFLLQY

SEQ ID NO: 82842 - protein, 9 aa, Homo Sapiens
RASPRTLNL

SEQ ID NO: 82843 - protein, 9 aa, Homo Sapiens
RAVEPAQQY

SEQ ID NO: 82844 - protein, 9 aa, Homo Sapiens
RAVEYNALF

SEQ ID NO: 82845 - protein, 9 aa, Homo Sapiens
RAYAKALHY

SEQ ID NO: 82846 - protein, 9 aa, Homo Sapiens
RAYDGTTYL

SEQ ID NO: 82847 - protein, 9 aa, Homo Sapiens
RAYELMLGF

SEQ ID NO: 82848 - protein, 9 aa, Homo Sapiens
RAYIVQLQI

SEQ ID NO: 82849 - protein, 9 aa, Homo Sapiens
RAYPAAITI

SEQ ID NO: 82850 - protein, 9 aa, Homo Sapiens
RAYQRQLVM

SEQ ID NO: 82851 - protein, 9 aa, Homo Sapiens
RAYVPALQM

SEQ ID NO: 82852 - protein, 9 aa, Homo Sapiens
RICEILLQY

SEQ ID NO: 82853 - protein, 9 aa, Homo Sapiens
RIIPRHLQL

SEQ ID NO: 82854 - protein, 9 aa, Homo Sapiens
RITPRHLQL

SEQ ID NO: 82855 - protein, 9 aa, Homo Sapiens
RIYAGGEHY

SEQ ID NO: 82856 - protein, 9 aa, Homo Sapiens
RIYHKLKHF

SEQ ID NO: 82857 - protein, 9 aa, Homo Sapiens
RIYPHGLVL

SEQ ID NO: 82858 - protein, 9 aa, Homo Sapiens
RMVEMFLEY

SEQ ID NO: 82859 - protein, 9 aa, Homo Sapiens
RMYEKALQI

SEQ ID NO: 82860 - protein, 9 aa, Homo Sapiens
RMYPGLQVY

SEQ ID NO: 82861 - protein, 9 aa, Homo Sapiens
RPYGRRPQY

SEQ ID NO: 82862 - protein, 9 aa, Homo Sapiens
RSADHPPKL

SEQ ID NO: 82863 - protein, 9 aa, Homo Sapiens
RSADWLGLF

SEQ ID NO: 82864 - protein, 9 aa, Homo Sapiens
RSAEVTLEV

SEQ ID NO: 82865 - protein, 9 aa, Homo Sapiens
RSAKASLVY

SEQ ID NO: 82866 - protein, 9 aa, Homo Sapiens
RSATICLAY

SEQ ID NO: 82867 - protein, 9 aa, Homo Sapiens
RSAVFSVTY

SEQ ID NO: 82868 - protein, 9 aa, Homo Sapiens
RSCLLHLTL

SEQ ID NO: 82869 - protein, 9 aa, Homo Sapiens
RSDPGHYSF

SEQ ID NO: 82870 - protein, 9 aa, Homo Sapiens
RSEKPLRSI

SEQ ID NO: 82871 - protein, 9 aa, Homo Sapiens
RSFEHALML

SEQ ID NO: 82872 - protein, 9 aa, Homo Sapiens
RSFEPILRL

SEQ ID NO: 82873 - protein, 9 aa, Homo Sapiens
RSFFGSLML

SEQ ID NO: 82874 - protein, 9 aa, Homo Sapiens
RSFFHQHYL

SEQ ID NO: 82875 - protein, 9 aa, Homo Sapiens
RSFHRTLQT

SEQ ID NO: 82876 - protein, 9 aa, Homo Sapiens
RSFQRALEL

SEQ ID NO: 82877 - protein, 9 aa, Homo Sapiens
RSFTLMLRY

SEQ ID NO: 82878 - protein, 9 aa, Homo Sapiens
RSFTNQIIL

SEQ ID NO: 82879 - protein, 9 aa, Homo Sapiens
RSHPPLHEY

SEQ ID NO: 82880 - protein, 9 aa, Homo Sapiens
RSHYSPIYL

SEQ ID NO: 82881 - protein, 9 aa, Homo Sapiens
RSIDKPFRL

SEQ ID NO: 82882 - protein, 9 aa, Homo Sapiens
RSIDLTVKL

SEQ ID NO: 82883 - protein, 9 aa, Homo Sapiens
RSIEEVLRI

SEQ ID NO: 82884 - protein, 9 aa, Homo Sapiens
RSIETSSTL

SEQ ID NO: 82885 - protein, 9 aa, Homo Sapiens
RSINKLIRI

SEQ ID NO: 82886 - protein, 9 aa, Homo Sapiens
RSIPAITRY

SEQ ID NO: 82887 - protein, 9 aa, Homo Sapiens
RSIQKNMVY

SEQ ID NO: 82888 - protein, 9 aa, Homo Sapiens
RSIVFDSEY

SEQ ID NO: 82889 - protein, 9 aa, Homo Sapiens
RSLDDALKL

SEQ ID NO: 82890 - protein, 9 aa, Homo Sapiens
RSLDQQMYL

SEQ ID NO: 82891 - protein, 9 aa, Homo Sapiens
RSLDYVAQL

SEQ ID NO: 82892 - protein, 9 aa, Homo Sapiens
RSLEFSVSY

SEQ ID NO: 82893 - protein, 9 aa, Homo Sapiens
RSLEISQSY

SEQ ID NO: 82894 - protein, 9 aa, Homo Sapiens
RSLEQNIQL

SEQ ID NO: 82895 - protein, 9 aa, Homo Sapiens
RSLFRNPHL

SEQ ID NO: 82896 - protein, 9 aa, Homo Sapiens
RSLGVHLSF

SEQ ID NO: 82897 - protein, 9 aa, Homo Sapiens
RSLHDAIMI

SEQ ID NO: 82898 - protein, 9 aa, Homo Sapiens
RSLHMLLML

SEQ ID NO: 82899 - protein, 9 aa, Homo Sapiens
RSLKSVQLY

SEQ ID NO: 82900 - protein, 9 aa, Homo Sapiens
RSLLHTLEI

SEQ ID NO: 82901 - protein, 9 aa, Homo Sapiens
RSLNPPLTI

SEQ ID NO: 82902 - protein, 9 aa, Homo Sapiens
RSLNSQLVY

SEQ ID NO: 82903 - protein, 9 aa, Homo Sapiens
RSLPSSSQL

SEQ ID NO: 82904 - protein, 9 aa, Homo Sapiens
RSLQLHLVF

SEQ ID NO: 82905 - protein, 9 aa, Homo Sapiens
RSLQLSLVM

SEQ ID NO: 82906 - protein, 9 aa, Homo Sapiens
RSLSTTNVF

SEQ ID NO: 82907 - protein, 9 aa, Homo Sapiens
RSMEDFVTW

SEQ ID NO: 82908 - protein, 9 aa, Homo Sapiens
RSMGLPLQF

SEQ ID NO: 82909 - protein, 9 aa, Homo Sapiens
RSMKAILSF

SEQ ID NO: 82910 - protein, 9 aa, Homo Sapiens
RSMNGALAF

SEQ ID NO: 82911 - protein, 9 aa, Homo Sapiens
RSNILTLMY

SEQ ID NO: 82912 - protein, 9 aa, Homo Sapiens
RSNSFNSTF

SEQ ID NO: 82913 - protein, 9 aa, Homo Sapiens
RSRDTCIVI

SEQ ID NO: 82914 - protein, 9 aa, Homo Sapiens
RSRTIVHTL

SEQ ID NO: 82915 - protein, 9 aa, Homo Sapiens
RSSPCALRL

SEQ ID NO: 82916 - protein, 9 aa, Homo Sapiens
RSSPLKLEF

SEQ ID NO: 82917 - protein, 9 aa, Homo Sapiens
RSSPPGHYY

SEQ ID NO: 82918 - protein, 9 aa, Homo Sapiens
RSSSWHARY

SEQ ID NO: 82919 - protein, 9 aa, Homo Sapiens
RSSVILLTY

SEQ ID NO: 82920 - protein, 9 aa, Homo Sapiens
RSTDRVLQW

SEQ ID NO: 82921 - protein, 9 aa, Homo Sapiens
RSTDWSSQY

SEQ ID NO: 82922 - protein, 9 aa, Homo Sapiens
RSTSQTFIY

SEQ ID NO: 82923 - protein, 9 aa, Homo Sapiens
RSVDETLRL

SEQ ID NO: 82924 - protein, 9 aa, Homo Sapiens
RSVDRSLLL

SEQ ID NO: 82925 - protein, 9 aa, Homo Sapiens
RSVDRSLMY

SEQ ID NO: 82926 - protein, 9 aa, Homo Sapiens
RSVEETLRL

SEQ ID NO: 82927 - protein, 9 aa, Homo Sapiens
RSVEFSKSY

SEQ ID NO: 82928 - protein, 9 aa, Homo Sapiens
RSVQKQMKI

SEQ ID NO: 82929 - protein, 9 aa, Homo Sapiens
RSVVKVLSL

SEQ ID NO: 82930 - protein, 9 aa, Homo Sapiens
RSWDQQIKL

SEQ ID NO: 82931 - protein, 9 aa, Homo Sapiens
RSYARGLRL

SEQ ID NO: 82932 - protein, 9 aa, Homo Sapiens
RSYDEQLRL

SEQ ID NO: 82933 - protein, 9 aa, Homo Sapiens
RSYDYQFRY

SEQ ID NO: 82934 - protein, 9 aa, Homo Sapiens
RSYESQMVI

SEQ ID NO: 82935 - protein, 9 aa, Homo Sapiens
RSYETVLSF

SEQ ID NO: 82936 - protein, 9 aa, Homo Sapiens
RSYHSSLRL

SEQ ID NO: 82937 - protein, 9 aa, Homo Sapiens
RSYKARLPL

SEQ ID NO: 82938 - protein, 9 aa, Homo Sapiens
RSYSQQLFL

SEQ ID NO: 82939 - protein, 9 aa, Homo Sapiens
RSYTMESTL

SEQ ID NO: 82940 - protein, 9 aa, Homo Sapiens
RSYTYPLIF

SEQ ID NO: 82941 - protein, 9 aa, Homo Sapiens
RSYVDLLKL

SEQ ID NO: 82942 - protein, 9 aa, Homo Sapiens
RSYWKEVLL

SEQ ID NO: 82943 - protein, 9 aa, Homo Sapiens
RTAHVILRY

SEQ ID NO: 82944 - protein, 9 aa, Homo Sapiens
RTAPLLLSY

SEQ ID NO: 82945 - protein, 9 aa, Homo Sapiens
RTAPSGSEY

SEQ ID NO: 82946 - protein, 9 aa, Homo Sapiens
RTDAKQKWL

SEQ ID NO: 82947 - protein, 9 aa, Homo Sapiens
RTEDPLLSW

SEQ ID NO: 82948 - protein, 9 aa, Homo Sapiens
RTFEAFMYL

SEQ ID NO: 82949 - protein, 9 aa, Homo Sapiens
RTFGHLLRY

SEQ ID NO: 82950 - protein, 9 aa, Homo Sapiens
RTFPFSLQY

SEQ ID NO: 82951 - protein, 9 aa, Homo Sapiens
RTFPVLLRL

SEQ ID NO: 82952 - protein, 9 aa, Homo Sapiens
RTFWHKISY

SEQ ID NO: 82953 - protein, 9 aa, Homo Sapiens
RTHFVISTY

SEQ ID NO: 82954 - protein, 9 aa, Homo Sapiens
RTHLPGRTY

SEQ ID NO: 82955 - protein, 9 aa, Homo Sapiens
RTHSLLLLL

SEQ ID NO: 82956 - protein, 9 aa, Homo Sapiens
RTIAKRLVL

SEQ ID NO: 82957 - protein, 9 aa, Homo Sapiens
RTIARTIVL

SEQ ID NO: 82958 - protein, 9 aa, Homo Sapiens
RTIATALEY

SEQ ID NO: 82959 - protein, 9 aa, Homo Sapiens
RTIFPTSTI

SEQ ID NO: 82960 - protein, 9 aa, Homo Sapiens
RTIMKPLEY

SEQ ID NO: 82961 - protein, 9 aa, Homo Sapiens
RTIPQPPIL

SEQ ID NO: 82962 - protein, 9 aa, Homo Sapiens
RTIQMFLVY

SEQ ID NO: 82963 - protein, 9 aa, Homo Sapiens
RTIRMGTTL

SEQ ID NO: 82964 - protein, 9 aa, Homo Sapiens
RTIRNAMKI

SEQ ID NO: 82965 - protein, 9 aa, Homo Sapiens
RTIVNQISY

SEQ ID NO: 82966 - protein, 9 aa, Homo Sapiens
RTKDTPLSL

SEQ ID NO: 82967 - protein, 9 aa, Homo Sapiens
RTKEGELRI

SEQ ID NO: 82968 - protein, 9 aa, Homo Sapiens
RTLCRALRF

SEQ ID NO: 82969 - protein, 9 aa, Homo Sapiens
RTLDFDPLL

SEQ ID NO: 82970 - protein, 9 aa, Homo Sapiens
RTLDNQLFF

SEQ ID NO: 82971 - protein, 9 aa, Homo Sapiens
RTLDSLMQF

SEQ ID NO: 82972 - protein, 9 aa, Homo Sapiens
RTLDSVSQI

SEQ ID NO: 82973 - protein, 9 aa, Homo Sapiens
RTLETLIRL

SEQ ID NO: 82974 - protein, 9 aa, Homo Sapiens
RTLIYITLY

SEQ ID NO: 82975 - protein, 9 aa, Homo Sapiens
RTLKEILRY

SEQ ID NO: 82976 - protein, 9 aa, Homo Sapiens
RTLKHVLYY

SEQ ID NO: 82977 - protein, 9 aa, Homo Sapiens
RTLLAILRL

SEQ ID NO: 82978 - protein, 9 aa, Homo Sapiens
RTLNRILTM

SEQ ID NO: 82979 - protein, 9 aa, Homo Sapiens
RTLPEPLEL

SEQ ID NO: 82980 - protein, 9 aa, Homo Sapiens
RTLPNVLAL

SEQ ID NO: 82981 - protein, 9 aa, Homo Sapiens
RTLPQASLL

SEQ ID NO: 82982 - protein, 9 aa, Homo Sapiens
RTLPVLLLY

SEQ ID NO: 82983 - protein, 9 aa, Homo Sapiens
RTLPWASVL

SEQ ID NO: 82984 - protein, 9 aa, Homo Sapiens
RTLPWSSVL

SEQ ID NO: 82985 - protein, 9 aa, Homo Sapiens
RTLQHGLYY

SEQ ID NO: 82986 - protein, 9 aa, Homo Sapiens
RTLQNTPSL

SEQ ID NO: 82987 - protein, 9 aa, Homo Sapiens
RTLTKVLAL

SEQ ID NO: 82988 - protein, 9 aa, Homo Sapiens
RTLVNVVKY

SEQ ID NO: 82989 - protein, 9 aa, Homo Sapiens
RTMEWVQTI

SEQ ID NO: 82990 - protein, 9 aa, Homo Sapiens
RTMPRIPTL

SEQ ID NO: 82991 - protein, 9 aa, Homo Sapiens
RTMQVALGL

SEQ ID NO: 82992 - protein, 9 aa, Homo Sapiens
RTMTAISRY

SEQ ID NO: 82993 - protein, 9 aa, Homo Sapiens
RTMVKTLEY

SEQ ID NO: 82994 - protein, 9 aa, Homo Sapiens
RTNNIELHY

SEQ ID NO: 82995 - protein, 9 aa, Homo Sapiens
RTSDKELYF

SEQ ID NO: 82996 - protein, 9 aa, Homo Sapiens
RTSPFFSVY

SEQ ID NO: 82997 - protein, 9 aa, Homo Sapiens
RTSPINLGL

SEQ ID NO: 82998 - protein, 9 aa, Homo Sapiens
RTSPPVRAF

SEQ ID NO: 82999 - protein, 9 aa, Homo Sapiens
RTTAHALKY

SEQ ID NO: 83000 - protein, 9 aa, Homo Sapiens
RTTDIVIRI

SEQ ID NO: 83001 - protein, 9 aa, Homo Sapiens
RTTSHLLRY

SEQ ID NO: 83002 - protein, 9 aa, Homo Sapiens
RTVDARLKL

SEQ ID NO: 83003 - protein, 9 aa, Homo Sapiens
RTVDLFPVL

SEQ ID NO: 83004 - protein, 9 aa, Homo Sapiens
RTVEKPPKF

SEQ ID NO: 83005 - protein, 9 aa, Homo Sapiens
RTVEMHNKI

SEQ ID NO: 83006 - protein, 9 aa, Homo Sapiens
RTVIFSAMF

SEQ ID NO: 83007 - protein, 9 aa, Homo Sapiens
RTVPFCSTF

SEQ ID NO: 83008 - protein, 9 aa, Homo Sapiens
RTVTQKLGF

SEQ ID NO: 83009 - protein, 9 aa, Homo Sapiens
RTVVNISSL

SEQ ID NO: 83010 - protein, 9 aa, Homo Sapiens
RTWKPTLVI

SEQ ID NO: 83011 - protein, 9 aa, Homo Sapiens
RTWLLKTHW

SEQ ID NO: 83012 - protein, 9 aa, Homo Sapiens
RTYDKDITF

SEQ ID NO: 83013 - protein, 9 aa, Homo Sapiens
RTYDLYITY

SEQ ID NO: 83014 - protein, 9 aa, Homo Sapiens
RTYDMIQYY

SEQ ID NO: 83015 - protein, 9 aa, Homo Sapiens
RTYEGGNAL

SEQ ID NO: 83016 - protein, 9 aa, Homo Sapiens
RTYEHEAMW

SEQ ID NO: 83017 - protein, 9 aa, Homo Sapiens
RTYEKFFGL

SEQ ID NO: 83018 - protein, 9 aa, Homo Sapiens
RTYGVVAQY

SEQ ID NO: 83019 - protein, 9 aa, Homo Sapiens
RTYITFQTW

SEQ ID NO: 83020 - protein, 9 aa, Homo Sapiens
RTYKQRLLF

SEQ ID NO: 83021 - protein, 9 aa, Homo Sapiens
RTYLGMSTL

SEQ ID NO: 83022 - protein, 9 aa, Homo Sapiens
RTYNNIFQF

SEQ ID NO: 83023 - protein, 9 aa, Homo Sapiens
RTYPVEILY

SEQ ID NO: 83024 - protein, 9 aa, Homo Sapiens
RTYSLGSAL

SEQ ID NO: 83025 - protein, 9 aa, Homo Sapiens
RTYTGLSGL

SEQ ID NO: 83026 - protein, 9 aa, Homo Sapiens
RTYVSTIRI

SEQ ID NO: 83027 - protein, 9 aa, Homo Sapiens
RVATVTLML

SEQ ID NO: 83028 - protein, 9 aa, Homo Sapiens
RVEPKVTVY

SEQ ID NO: 83029 - protein, 9 aa, Homo Sapiens
RVFASPLRL

SEQ ID NO: 83030 - protein, 9 aa, Homo Sapiens
RVFQECLTY

SEQ ID NO: 83031 - protein, 9 aa, Homo Sapiens
RVFVKPLVL

SEQ ID NO: 83032 - protein, 9 aa, Homo Sapiens
RVHGLALQI

SEQ ID NO: 83033 - protein, 9 aa, Homo Sapiens
RVHQGWLQY

SEQ ID NO: 83034 - protein, 9 aa, Homo Sapiens
RVIDVGSEW

SEQ ID NO: 83035 - protein, 9 aa, Homo Sapiens
RVIDYAVKI

SEQ ID NO: 83036 - protein, 9 aa, Homo Sapiens
RVIDYILDL

SEQ ID NO: 83037 - protein, 9 aa, Homo Sapiens
RVIEFAAKF

SEQ ID NO: 83038 - protein, 9 aa, Homo Sapiens
RVIHRDLKL

SEQ ID NO: 83039 - protein, 9 aa, Homo Sapiens
RVIPVLLQL

SEQ ID NO: 83040 - protein, 9 aa, Homo Sapiens
RVKEKEAEL

SEQ ID NO: 83041 - protein, 9 aa, Homo Sapiens
RVKEKEAIL

SEQ ID NO: 83042 - protein, 9 aa, Homo Sapiens
RVLGKPLGL

SEQ ID NO: 83043 - protein, 9 aa, Homo Sapiens
RVLPASLVI

SEQ ID NO: 83044 - protein, 9 aa, Homo Sapiens
RVLQWVLVL

SEQ ID NO: 83045 - protein, 9 aa, Homo Sapiens
RVVDQPLKL

SEQ ID NO: 83046 - protein, 9 aa, Homo Sapiens
RVVEKFLKI

SEQ ID NO: 83047 - protein, 9 aa, Homo Sapiens
RVYESKAEF

SEQ ID NO: 83048 - protein, 9 aa, Homo Sapiens
RVYGGCLCY

SEQ ID NO: 83049 - protein, 9 aa, Homo Sapiens
RVYIGRLSY

SEQ ID NO: 83050 - protein, 9 aa, Homo Sapiens
RVYLGALKY

SEQ ID NO: 83051 - protein, 9 aa, Homo Sapiens
RVYPQAVYF

SEQ ID NO: 83052 - protein, 9 aa, Homo Sapiens
RVYVGSIYY

SEQ ID NO: 83053 - protein, 9 aa, Homo Sapiens
SACGHTAVL

SEQ ID NO: 83054 - protein, 9 aa, Homo Sapiens
SADEVQRFF

SEQ ID NO: 83055 - protein, 9 aa, Homo Sapiens
SAFRGVGLL

SEQ ID NO: 83056 - protein, 9 aa, Homo Sapiens
SAIGKILKF

SEQ ID NO: 83057 - protein, 9 aa, Homo Sapiens
SAISTTLKL

SEQ ID NO: 83058 - protein, 9 aa, Homo Sapiens
SALFKVLAF

SEQ ID NO: 83059 - protein, 9 aa, Homo Sapiens
SALGRVLLF

SEQ ID NO: 83060 - protein, 9 aa, Homo Sapiens
SALNRLLVL

SEQ ID NO: 83061 - protein, 9 aa, Homo Sapiens
SALVALPLL

SEQ ID NO: 83062 - protein, 9 aa, Homo Sapiens
SANHNILQI

SEQ ID NO: 83063 - protein, 9 aa, Homo Sapiens
SASTTTLRY

SEQ ID NO: 83064 - protein, 9 aa, Homo Sapiens
SAWERNLVY

SEQ ID NO: 83065 - protein, 9 aa, Homo Sapiens
SAYQHPASF

SEQ ID NO: 83066 - protein, 9 aa, Homo Sapiens
SAYQNHLIL

SEQ ID NO: 83067 - protein, 9 aa, Homo Sapiens
SGVTTCLRF

SEQ ID NO: 83068 - protein, 9 aa, Homo Sapiens
SILQKVLKL

SEQ ID NO: 83069 - protein, 9 aa, Homo Sapiens
SLLKRYLLK

SEQ ID NO: 83070 - protein, 9 aa, Homo Sapiens
SMYDKVLML

SEQ ID NO: 83071 - protein, 9 aa, Homo Sapiens
SQLPGLLEL

SEQ ID NO: 83072 - protein, 9 aa, Homo Sapiens
SSAKTILKY

SEQ ID NO: 83073 - protein, 9 aa, Homo Sapiens
SSCTHLLGF

SEQ ID NO: 83074 - protein, 9 aa, Homo Sapiens
SSFAHCLEL

SEQ ID NO: 83075 - protein, 9 aa, Homo Sapiens
SSFFKSLVI

SEQ ID NO: 83076 - protein, 9 aa, Homo Sapiens
SSFQKVLEL

SEQ ID NO: 83077 - protein, 9 aa, Homo Sapiens
SSHKGCLQL

SEQ ID NO: 83078 - protein, 9 aa, Homo Sapiens
SSHTRTLHL

SEQ ID NO: 83079 - protein, 9 aa, Homo Sapiens
SSIKDPLQF

SEQ ID NO: 83080 - protein, 9 aa, Homo Sapiens
SSISKSPLL

SEQ ID NO: 83081 - protein, 9 aa, Homo Sapiens
SSITASLRF

SEQ ID NO: 83082 - protein, 9 aa, Homo Sapiens
SSLDSTLRL

SEQ ID NO: 83083 - protein, 9 aa, Homo Sapiens
SSLHKLLTL

SEQ ID NO: 83084 - protein, 9 aa, Homo Sapiens
SSLPSALAL

SEQ ID NO: 83085 - protein, 9 aa, Homo Sapiens
SSLQRILEI

SEQ ID NO: 83086 - protein, 9 aa, Homo Sapiens
SSLSDALVL

SEQ ID NO: 83087 - protein, 9 aa, Homo Sapiens
SSLSHILQM

SEQ ID NO: 83088 - protein, 9 aa, Homo Sapiens
SSSAKTLAF

SEQ ID NO: 83089 - protein, 9 aa, Homo Sapiens
SSSPRNLGF

SEQ ID NO: 83090 - protein, 9 aa, Homo Sapiens
SSVDQPLKI

SEQ ID NO: 83091 - protein, 9 aa, Homo Sapiens
SSVLKPLLI

SEQ ID NO: 83092 - protein, 9 aa, Homo Sapiens
SSVPGVRLL

SEQ ID NO: 83093 - protein, 9 aa, Homo Sapiens
SSVRKNLKL

SEQ ID NO: 83094 - protein, 9 aa, Homo Sapiens
SSVTKVLLL

SEQ ID NO: 83095 - protein, 9 aa, Homo Sapiens
SSYDKPITF

SEQ ID NO: 83096 - protein, 9 aa, Homo Sapiens
SSYGKLLLI

SEQ ID NO: 83097 - protein, 9 aa, Homo Sapiens
SSYIRVLGI

SEQ ID NO: 83098 - protein, 9 aa, Homo Sapiens
SSYLRGLLL

SEQ ID NO: 83099 - protein, 9 aa, Homo Sapiens
SSYPIKLFY

SEQ ID NO: 83100 - protein, 9 aa, Homo Sapiens
SSYSIHLLL

SEQ ID NO: 83101 - protein, 9 aa, Homo Sapiens
SSYSRALEM

SEQ ID NO: 83102 - protein, 9 aa, Homo Sapiens
STAEKVLVL

SEQ ID NO: 83103 - protein, 9 aa, Homo Sapiens
STFEAVLKW

SEQ ID NO: 83104 - protein, 9 aa, Homo Sapiens
STFKDTFTL

SEQ ID NO: 83105 - protein, 9 aa, Homo Sapiens
STFLSQTTY

SEQ ID NO: 83106 - protein, 9 aa, Homo Sapiens
STFSPSLAL

SEQ ID NO: 83107 - protein, 9 aa, Homo Sapiens
STFTLCLHY

SEQ ID NO: 83108 - protein, 9 aa, Homo Sapiens
STHLLLTLY

SEQ ID NO: 83109 - protein, 9 aa, Homo Sapiens
STHVTISTY

SEQ ID NO: 83110 - protein, 9 aa, Homo Sapiens
STICHILNL

SEQ ID NO: 83111 - protein, 9 aa, Homo Sapiens
STIDWNKLY

SEQ ID NO: 83112 - protein, 9 aa, Homo Sapiens
STIPKVLQY

SEQ ID NO: 83113 - protein, 9 aa, Homo Sapiens
STIQFVSTL

SEQ ID NO: 83114 - protein, 9 aa, Homo Sapiens
STKVKTLLL

SEQ ID NO: 83115 - protein, 9 aa, Homo Sapiens
STLALHLRI

SEQ ID NO: 83116 - protein, 9 aa, Homo Sapiens
STLGRVLRL

SEQ ID NO: 83117 - protein, 9 aa, Homo Sapiens
STLGYDLTF

SEQ ID NO: 83118 - protein, 9 aa, Homo Sapiens
STLHLVLRL

SEQ ID NO: 83119 - protein, 9 aa, Homo Sapiens
STLKKQMKY

SEQ ID NO: 83120 - protein, 9 aa, Homo Sapiens
STLKKSLEI

SEQ ID NO: 83121 - protein, 9 aa, Homo Sapiens
STLKNHLRL

SEQ ID NO: 83122 - protein, 9 aa, Homo Sapiens
STLPKSLSL

SEQ ID NO: 83123 - protein, 9 aa, Homo Sapiens
STMWTTLKL

SEQ ID NO: 83124 - protein, 9 aa, Homo Sapiens
STNDKTIKL

SEQ ID NO: 83125 - protein, 9 aa, Homo Sapiens
STNTRVLYF

SEQ ID NO: 83126 - protein, 9 aa, Homo Sapiens
STTTGHLIY

SEQ ID NO: 83127 - protein, 9 aa, Homo Sapiens
STVSRFFLY

SEQ ID NO: 83128 - protein, 9 aa, Homo Sapiens
STWGGALRY

SEQ ID NO: 83129 - protein, 9 aa, Homo Sapiens
STYEKALGY

SEQ ID NO: 83130 - protein, 9 aa, Homo Sapiens
STYHRFLTW

SEQ ID NO: 83131 - protein, 9 aa, Homo Sapiens
STYIKKIGY

SEQ ID NO: 83132 - protein, 9 aa, Homo Sapiens
STYLHQLTL

SEQ ID NO: 83133 - protein, 9 aa, Homo Sapiens
STYPSTVEI

SEQ ID NO: 83134 - protein, 9 aa, Homo Sapiens
STYRLESTL

SEQ ID NO: 83135 - protein, 9 aa, Homo Sapiens
SVFGRVMQI

SEQ ID NO: 83136 - protein, 9 aa, Homo Sapiens
SVFKGCLTL

SEQ ID NO: 83137 - protein, 9 aa, Homo Sapiens
SVIEQILHY

SEQ ID NO: 83138 - protein, 9 aa, Homo Sapiens
SVIGRALGI

SEQ ID NO: 83139 - protein, 9 aa, Homo Sapiens
SVLKKALEI

SEQ ID NO: 83140 - protein, 9 aa, Homo Sapiens
SVLPRALSL

SEQ ID NO: 83141 - protein, 9 aa, Homo Sapiens
SVLPRALVL

SEQ ID NO: 83142 - protein, 9 aa, Homo Sapiens
SVTEVQLRF

SEQ ID NO: 83143 - protein, 9 aa, Homo Sapiens
SVYDGKLLI

SEQ ID NO: 83144 - protein, 9 aa, Homo Sapiens
SVYHPQLAY

SEQ ID NO: 83145 - protein, 9 aa, Homo Sapiens
SVYSGCLHL

SEQ ID NO: 83146 - protein, 9 aa, Homo Sapiens
SVYSIRLAY

SEQ ID NO: 83147 - protein, 9 aa, Homo Sapiens
TAAPTGTTI

SEQ ID NO: 83148 - protein, 9 aa, Homo Sapiens
TAAPTIGVL

SEQ ID NO: 83149 - protein, 9 aa, Homo Sapiens
TAFGGFLKY

SEQ ID NO: 83150 - protein, 9 aa, Homo Sapiens
TALKYTLGF

SEQ ID NO: 83151 - protein, 9 aa, Homo Sapiens
TALRKVLSL

SEQ ID NO: 83152 - protein, 9 aa, Homo Sapiens
TILRHTLQL

SEQ ID NO: 83153 - protein, 9 aa, Homo Sapiens
TLAPSTMKI

SEQ ID NO: 83154 - protein, 9 aa, Homo Sapiens
TLTKTLTLL

SEQ ID NO: 83155 - protein, 9 aa, Homo Sapiens
TMCPHILRY

SEQ ID NO: 83156 - protein, 9 aa, Homo Sapiens
TQIILKTIF

SEQ ID NO: 83157 - protein, 9 aa, Homo Sapiens
TSCTHILVF

SEQ ID NO: 83158 - protein, 9 aa, Homo Sapiens
TSFERALSL

SEQ ID NO: 83159 - protein, 9 aa, Homo Sapiens
TSFHTALEL

SEQ ID NO: 83160 - protein, 9 aa, Homo Sapiens
TSIAECLTY

SEQ ID NO: 83161 - protein, 9 aa, Homo Sapiens
TSKWVADAL

SEQ ID NO: 83162 - protein, 9 aa, Homo Sapiens
TSLEKALGI

SEQ ID NO: 83163 - protein, 9 aa, Homo Sapiens
TSLPEPLRI

SEQ ID NO: 83164 - protein, 9 aa, Homo Sapiens
TSLPRALHF

SEQ ID NO: 83165 - protein, 9 aa, Homo Sapiens
TSLVKVLEF

SEQ ID NO: 83166 - protein, 9 aa, Homo Sapiens
TSMPGTLVL

SEQ ID NO: 83167 - protein, 9 aa, Homo Sapiens
TSMVTALQL

SEQ ID NO: 83168 - protein, 9 aa, Homo Sapiens
TSSDILLCY

SEQ ID NO: 83169 - protein, 9 aa, Homo Sapiens
TSSQKALML

SEQ ID NO: 83170 - protein, 9 aa, Homo Sapiens
TSSSHTLTY

SEQ ID NO: 83171 - protein, 9 aa, Homo Sapiens
TSVPKPLKF

SEQ ID NO: 83172 - protein, 9 aa, Homo Sapiens
TSVRKTLLL

SEQ ID NO: 83173 - protein, 9 aa, Homo Sapiens
TSWDRSLLL

SEQ ID NO: 83174 - protein, 9 aa, Homo Sapiens
TSYKKSLRL

SEQ ID NO: 83175 - protein, 9 aa, Homo Sapiens
TTFVKQLKL

SEQ ID NO: 83176 - protein, 9 aa, Homo Sapiens
TTIKCMQTI

SEQ ID NO: 83177 - protein, 9 aa, Homo Sapiens
TTIQRGLVL

SEQ ID NO: 83178 - protein, 9 aa, Homo Sapiens
TTLQPTLKF

SEQ ID NO: 83179 - protein, 9 aa, Homo Sapiens
TVSDAILRY

SEQ ID NO: 83180 - protein, 9 aa, Homo Sapiens
TVTEVLLKY

SEQ ID NO: 83181 - protein, 9 aa, Homo Sapiens
TVYDKPASF

SEQ ID NO: 83182 - protein, 9 aa, Homo Sapiens
TVYHIMLQI

SEQ ID NO: 83183 - protein, 9 aa, Homo Sapiens
VAGPNIAAI

SEQ ID NO: 83184 - protein, 9 aa, Homo Sapiens
VAIESTPMI

SEQ ID NO: 83185 - protein, 9 aa, Homo Sapiens
VALARALFI

SEQ ID NO: 83186 - protein, 9 aa, Homo Sapiens
VAYPCAILY

SEQ ID NO: 83187 - protein, 9 aa, Homo Sapiens
VGGEALELR

SEQ ID NO: 83188 - protein, 9 aa, Homo Sapiens
VGLGPALEF

SEQ ID NO: 83189 - protein, 9 aa, Homo Sapiens
VIIPHVARF

SEQ ID NO: 83190 - protein, 9 aa, Homo Sapiens
VLYDRPLKI

SEQ ID NO: 83191 - protein, 9 aa, Homo Sapiens
VLYDRVLKY

SEQ ID NO: 83192 - protein, 9 aa, Homo Sapiens
VSFHPCIRF

SEQ ID NO: 83193 - protein, 9 aa, Homo Sapiens
VSFKRSMVL

SEQ ID NO: 83194 - protein, 9 aa, Homo Sapiens
VSHGRPLAL

SEQ ID NO: 83195 - protein, 9 aa, Homo Sapiens
VSHLIATEY

SEQ ID NO: 83196 - protein, 9 aa, Homo Sapiens
VSIKRQIIL

SEQ ID NO: 83197 - protein, 9 aa, Homo Sapiens
VSLEKVLGI

SEQ ID NO: 83198 - protein, 9 aa, Homo Sapiens
VSLKKPLVI

SEQ ID NO: 83199 - protein, 9 aa, Homo Sapiens
VSLPSHLNI

SEQ ID NO: 83200 - protein, 9 aa, Homo Sapiens
VSNDWYATL

SEQ ID NO: 83201 - protein, 9 aa, Homo Sapiens
VSNLQEFRY

SEQ ID NO: 83202 - protein, 9 aa, Homo Sapiens
VSQDKQMLY

SEQ ID NO: 83203 - protein, 9 aa, Homo Sapiens
VSRKQGAQF

SEQ ID NO: 83204 - protein, 9 aa, Homo Sapiens
VSTVLTSKY

SEQ ID NO: 83205 - protein, 9 aa, Homo Sapiens
VSVAHALSL

SEQ ID NO: 83206 - protein, 9 aa, Homo Sapiens
VSVAKTPVL

SEQ ID NO: 83207 - protein, 9 aa, Homo Sapiens
VSVDERLIY

SEQ ID NO: 83208 - protein, 9 aa, Homo Sapiens
VSVEDLLKF

SEQ ID NO: 83209 - protein, 9 aa, Homo Sapiens
VSWDKSLCI

SEQ ID NO: 83210 - protein, 9 aa, Homo Sapiens
VSYFIITRY

SEQ ID NO: 83211 - protein, 9 aa, Homo Sapiens
VSYGSIVTY

SEQ ID NO: 83212 - protein, 9 aa, Homo Sapiens
VSYKGSISY

SEQ ID NO: 83213 - protein, 9 aa, Homo Sapiens
VSYKYTSRY

SEQ ID NO: 83214 - protein, 9 aa, Homo Sapiens
VSYPGKNKI

SEQ ID NO: 83215 - protein, 9 aa, Homo Sapiens
VSYQKLLKY

SEQ ID NO: 83216 - protein, 9 aa, Homo Sapiens
VSYYYFLRF

SEQ ID NO: 83217 - protein, 9 aa, Homo Sapiens
VTAPRTVLL

SEQ ID NO: 83218 - protein, 9 aa, Homo Sapiens
VTASRALLL

SEQ ID NO: 83219 - protein, 9 aa, Homo Sapiens
VTATRQLLL

SEQ ID NO: 83220 - protein, 9 aa, Homo Sapiens
VTDIHQLSF

SEQ ID NO: 83221 - protein, 9 aa, Homo Sapiens
VTFEKQWFY

SEQ ID NO: 83222 - protein, 9 aa, Homo Sapiens
VTFPEFLRY

SEQ ID NO: 83223 - protein, 9 aa, Homo Sapiens
VTFSGQYNI

SEQ ID NO: 83224 - protein, 9 aa, Homo Sapiens
VTGVTRVTI

SEQ ID NO: 83225 - protein, 9 aa, Homo Sapiens
VTHDLRLRL

SEQ ID NO: 83226 - protein, 9 aa, Homo Sapiens
VTHNEQLCY

SEQ ID NO: 83227 - protein, 9 aa, Homo Sapiens
VTIARAIEL

SEQ ID NO: 83228 - protein, 9 aa, Homo Sapiens
VTIEGPSHY

SEQ ID NO: 83229 - protein, 9 aa, Homo Sapiens
VTIENHPHL

SEQ ID NO: 83230 - protein, 9 aa, Homo Sapiens
VTIGHIALL

SEQ ID NO: 83231 - protein, 9 aa, Homo Sapiens
VTIKEGSQL

SEQ ID NO: 83232 - protein, 9 aa, Homo Sapiens
VTIKKALTL

SEQ ID NO: 83233 - protein, 9 aa, Homo Sapiens
VTIPSGSTL

SEQ ID NO: 83234 - protein, 9 aa, Homo Sapiens
VTIVKPIVY

SEQ ID NO: 83235 - protein, 9 aa, Homo Sapiens
VTKPVGGNY

SEQ ID NO: 83236 - protein, 9 aa, Homo Sapiens
VTLAELLVL

SEQ ID NO: 83237 - protein, 9 aa, Homo Sapiens
VTLDEILRL

SEQ ID NO: 83238 - protein, 9 aa, Homo Sapiens
VTLEKVLGI

SEQ ID NO: 83239 - protein, 9 aa, Homo Sapiens
VTMPAILKL

SEQ ID NO: 83240 - protein, 9 aa, Homo Sapiens
VTMPWFQHY

SEQ ID NO: 83241 - protein, 9 aa, Homo Sapiens
VTNPHSSQW

SEQ ID NO: 83242 - protein, 9 aa, Homo Sapiens
VTNSQKLQL

SEQ ID NO: 83243 - protein, 9 aa, Homo Sapiens
VTRLQHVTI

SEQ ID NO: 83244 - protein, 9 aa, Homo Sapiens
VTTENQLKY

SEQ ID NO: 83245 - protein, 9 aa, Homo Sapiens
VTTVVNPKY

SEQ ID NO: 83246 - protein, 9 aa, Homo Sapiens
VTVAIPLKY

SEQ ID NO: 83247 - protein, 9 aa, Homo Sapiens
VTVEKVIKI

SEQ ID NO: 83248 - protein, 9 aa, Homo Sapiens
VTYGHELIW

SEQ ID NO: 83249 - protein, 9 aa, Homo Sapiens
VTYIFHQLL

SEQ ID NO: 83250 - protein, 9 aa, Homo Sapiens
VTYKNVPNW

SEQ ID NO: 83251 - protein, 9 aa, Homo Sapiens
VTYMNNLKL

SEQ ID NO: 83252 - protein, 9 aa, Homo Sapiens
VTYNKVLHF

SEQ ID NO: 83253 - protein, 9 aa, Homo Sapiens
VTYNYPVHY

SEQ ID NO: 83254 - protein, 9 aa, Homo Sapiens
VTYPGELLL

SEQ ID NO: 83255 - protein, 9 aa, Homo Sapiens
VTYSFRQSF

SEQ ID NO: 83256 - protein, 9 aa, Homo Sapiens
VTYVGTKQL

SEQ ID NO: 83257 - protein, 9 aa, Homo Sapiens
VTYVPVTTF

SEQ ID NO: 83258 - protein, 9 aa, Homo Sapiens
VVLAKQLLL

SEQ ID NO: 83259 - protein, 9 aa, Homo Sapiens
VVNGRVLEL

SEQ ID NO: 83260 - protein, 9 aa, Homo Sapiens
VVYEKQMLY

SEQ ID NO: 83261 - protein, 9 aa, Homo Sapiens
VVYGGKSTI

SEQ ID NO: 83262 - protein, 9 aa, Homo Sapiens
VVYPWTQRF

SEQ ID NO: 83263 - protein, 9 aa, Homo Sapiens
WSLGSPLHF

SEQ ID NO: 83264 - protein, 9 aa, Homo Sapiens
WSLPATATM

SEQ ID NO: 83265 - protein, 9 aa, Homo Sapiens
WTVVDAKTL

SEQ ID NO: 83266 - protein, 9 aa, Homo Sapiens
YAANPGQLF

SEQ ID NO: 83267 - protein, 9 aa, Homo Sapiens
YAFDFARQS

SEQ ID NO: 83268 - protein, 9 aa, Homo Sapiens
YAIDNPLHY

SEQ ID NO: 83269 - protein, 9 aa, Homo Sapiens
YAITRVLRL

SEQ ID NO: 83270 - protein, 9 aa, Homo Sapiens
YALNHTLSV

SEQ ID NO: 83271 - protein, 9 aa, Homo Sapiens
YASSPGGVY

SEQ ID NO: 83272 - protein, 9 aa, Homo Sapiens
YAYTGRLEL

SEQ ID NO: 83273 - protein, 9 aa, Homo Sapiens
YGYEHILTL

SEQ ID NO: 83274 - protein, 9 aa, Homo Sapiens
YIYPKHLKY

SEQ ID NO: 83275 - protein, 9 aa, Homo Sapiens
YQYPRPLLI

SEQ ID NO: 83276 - protein, 9 aa, Homo Sapiens
YSAEPLPEL

SEQ ID NO: 83277 - protein, 9 aa, Homo Sapiens
YSAPVIHVL

SEQ ID NO: 83278 - protein, 9 aa, Homo Sapiens
YSAVPVRHF

SEQ ID NO: 83279 - protein, 9 aa, Homo Sapiens
YSCDHNTSL

SEQ ID NO: 83280 - protein, 9 aa, Homo Sapiens
YSDAPRGTW

SEQ ID NO: 83281 - protein, 9 aa, Homo Sapiens
YSEKPPVSI

SEQ ID NO: 83282 - protein, 9 aa, Homo Sapiens
YSFDPVGSY

SEQ ID NO: 83283 - protein, 9 aa, Homo Sapiens
YSFGGCHRY

SEQ ID NO: 83284 - protein, 9 aa, Homo Sapiens
YSFSELLRL

SEQ ID NO: 83285 - protein, 9 aa, Homo Sapiens
YSFYNQQTL

SEQ ID NO: 83286 - protein, 9 aa, Homo Sapiens
YSHFQHLLY

SEQ ID NO: 83287 - protein, 9 aa, Homo Sapiens
YSHKKILQL

SEQ ID NO: 83288 - protein, 9 aa, Homo Sapiens
YSIDKPPFI

SEQ ID NO: 83289 - protein, 9 aa, Homo Sapiens
YSIDPVTRY

SEQ ID NO: 83290 - protein, 9 aa, Homo Sapiens
YSIEKPLKF

SEQ ID NO: 83291 - protein, 9 aa, Homo Sapiens
YSIRGQLSW

SEQ ID NO: 83292 - protein, 9 aa, Homo Sapiens
YSKAFTLTI

SEQ ID NO: 83293 - protein, 9 aa, Homo Sapiens
YSLAFNARF

SEQ ID NO: 83294 - protein, 9 aa, Homo Sapiens
YSLDGILVF

SEQ ID NO: 83295 - protein, 9 aa, Homo Sapiens
YSLDHISSL

SEQ ID NO: 83296 - protein, 9 aa, Homo Sapiens
YSLEHTVQF

SEQ ID NO: 83297 - protein, 9 aa, Homo Sapiens
YSLEKVFGI

SEQ ID NO: 83298 - protein, 9 aa, Homo Sapiens
YSLIFVNSY

SEQ ID NO: 83299 - protein, 9 aa, Homo Sapiens
YSLKNTSQL

SEQ ID NO: 83300 - protein, 9 aa, Homo Sapiens
YSLLKHLKL

SEQ ID NO: 83301 - protein, 9 aa, Homo Sapiens
YSLPGILHF

SEQ ID NO: 83302 - protein, 9 aa, Homo Sapiens
YSLPNAPTL

SEQ ID NO: 83303 - protein, 9 aa, Homo Sapiens
YSLPQLLHI

SEQ ID NO: 83304 - protein, 9 aa, Homo Sapiens
YSLQHKLLL

SEQ ID NO: 83305 - protein, 9 aa, Homo Sapiens
YSLQRQSLL

SEQ ID NO: 83306 - protein, 9 aa, Homo Sapiens
YSQEPIKTF

SEQ ID NO: 83307 - protein, 9 aa, Homo Sapiens
YSQKDPLIL

SEQ ID NO: 83308 - protein, 9 aa, Homo Sapiens
YSQSPALEL

SEQ ID NO: 83309 - protein, 9 aa, Homo Sapiens
YSSENISNF

SEQ ID NO: 83310 - protein, 9 aa, Homo Sapiens
YSSNHKLVF

SEQ ID NO: 83311 - protein, 9 aa, Homo Sapiens
YSSPFDPVL

SEQ ID NO: 83312 - protein, 9 aa, Homo Sapiens
YSSSRTLLF

SEQ ID NO: 83313 - protein, 9 aa, Homo Sapiens
YSTEPINTF

SEQ ID NO: 83314 - protein, 9 aa, Homo Sapiens
YSVRMNNTL

SEQ ID NO: 83315 - protein, 9 aa, Homo Sapiens
YSYFSPRTM

SEQ ID NO: 83316 - protein, 9 aa, Homo Sapiens
YSYGACVAF

SEQ ID NO: 83317 - protein, 9 aa, Homo Sapiens
YSYKEALKL

SEQ ID NO: 83318 - protein, 9 aa, Homo Sapiens
YSYLLKNHL

SEQ ID NO: 83319 - protein, 9 aa, Homo Sapiens
YSYLLTSQL

SEQ ID NO: 83320 - protein, 9 aa, Homo Sapiens
YSYNIRHSF

SEQ ID NO: 83321 - protein, 9 aa, Homo Sapiens
YSYYGPLNL

SEQ ID NO: 83322 - protein, 9 aa, Homo Sapiens
YTAQFEHTI

SEQ ID NO: 83323 - protein, 9 aa, Homo Sapiens
YTAQPTQGY

SEQ ID NO: 83324 - protein, 9 aa, Homo Sapiens
YTAVVPLVY

SEQ ID NO: 83325 - protein, 9 aa, Homo Sapiens
YTESYISTI

SEQ ID NO: 83326 - protein, 9 aa, Homo Sapiens
YTFNKVLML

SEQ ID NO: 83327 - protein, 9 aa, Homo Sapiens
YTFSEPFHL

SEQ ID NO: 83328 - protein, 9 aa, Homo Sapiens
YTHEVVTLW

SEQ ID NO: 83329 - protein, 9 aa, Homo Sapiens
YTIATILHY

SEQ ID NO: 83330 - protein, 9 aa, Homo Sapiens
YTIEFLRHL

SEQ ID NO: 83331 - protein, 9 aa, Homo Sapiens
YTIENPRHF

SEQ ID NO: 83332 - protein, 9 aa, Homo Sapiens
YTIIPLNKI

SEQ ID NO: 83333 - protein, 9 aa, Homo Sapiens
YTIPLAIKL

SEQ ID NO: 83334 - protein, 9 aa, Homo Sapiens
YTKAWEEYY

SEQ ID NO: 83335 - protein, 9 aa, Homo Sapiens
YTKENGRTL

SEQ ID NO: 83336 - protein, 9 aa, Homo Sapiens
YTKENGTIR

SEQ ID NO: 83337 - protein, 9 aa, Homo Sapiens
YTKHGTLKY

SEQ ID NO: 83338 - protein, 9 aa, Homo Sapiens
YTLPDGRII

SEQ ID NO: 83339 - protein, 9 aa, Homo Sapiens
YTLPDGSTL

SEQ ID NO: 83340 - protein, 9 aa, Homo Sapiens
YTNGKCVIL

SEQ ID NO: 83341 - protein, 9 aa, Homo Sapiens
YTSDSPGSY

SEQ ID NO: 83342 - protein, 9 aa, Homo Sapiens
YTSPGTQKY

SEQ ID NO: 83343 - protein, 9 aa, Homo Sapiens
YTVAAASTF

SEQ ID NO: 83344 - protein, 9 aa, Homo Sapiens
YTVKAILIL

SEQ ID NO: 83345 - protein, 9 aa, Homo Sapiens
YTYESKMAF

SEQ ID NO: 83346 - protein, 9 aa, Homo Sapiens
YTYKKQVKI

SEQ ID NO: 83347 - protein, 9 aa, Homo Sapiens
YTYRGPKAF

SEQ ID NO: 83348 - protein, 9 aa, Homo Sapiens
YVYPKYLKY

SEQ ID NO: 83349 - protein, 9 aa, Homo Sapiens
YVYPLQLKY

SEQ ID NO: 83350 - protein, 9 aa, Homo Sapiens
YVYSHFLQF

SEQ ID NO: 83351 - protein, 10 aa, Homo Sapiens
AISGVPVLGF

SEQ ID NO: 83352 - protein, 10 aa, Homo Sapiens
AIYAASKLSY

SEQ ID NO: 83353 - protein, 10 aa, Homo Sapiens
ASFDGRISVY

SEQ ID NO: 83354 - protein, 10 aa, Homo Sapiens
ASFNRPNLYY

SEQ ID NO: 83355 - protein, 10 aa, Homo Sapiens
ASYPGGQLVF

SEQ ID NO: 83356 - protein, 10 aa, Homo Sapiens
ASYPHCLQFY

SEQ ID NO: 83357 - protein, 10 aa, Homo Sapiens
ATLKDRELSF

SEQ ID NO: 83358 - protein, 10 aa, Homo Sapiens
ATLTHQVSSI

SEQ ID NO: 83359 - protein, 10 aa, Homo Sapiens
ATYGDAGLTY

SEQ ID NO: 83360 - protein, 10 aa, Homo Sapiens
DNITTDKILI

SEQ ID NO: 83361 - protein, 10 aa, Homo Sapiens
FSLDAPHSTY

SEQ ID NO: 83362 - protein, 10 aa, Homo Sapiens
FTEQERGVGI

SEQ ID NO: 83363 - protein, 10 aa, Homo Sapiens
FTHEALTLKY

SEQ ID NO: 83364 - protein, 10 aa, Homo Sapiens
FTYDLKGSTY

SEQ ID NO: 83365 - protein, 10 aa, Homo Sapiens
FTYDPWIGKL

SEQ ID NO: 83366 - protein, 10 aa, Homo Sapiens
GSWDKTLKFW

SEQ ID NO: 83367 - protein, 10 aa, Homo Sapiens
GSYGPRPEEY

SEQ ID NO: 83368 - protein, 10 aa, Homo Sapiens
GTFFSEKLVL

SEQ ID NO: 83369 - protein, 10 aa, Homo Sapiens
GTVTEVLLKY

SEQ ID NO: 83370 - protein, 10 aa, Homo Sapiens
HSYINFELRY

SEQ ID NO: 83371 - protein, 10 aa, Homo Sapiens
IPAKMGALLL

SEQ ID NO: 83372 - protein, 10 aa, Homo Sapiens
ISIIQKGLQY

SEQ ID NO: 83373 - protein, 10 aa, Homo Sapiens
ISIPDVGLHL

SEQ ID NO: 83374 - protein, 10 aa, Homo Sapiens
ISIPSKCLLL

SEQ ID NO: 83375 - protein, 10 aa, Homo Sapiens
ISISVDGLKF

SEQ ID NO: 83376 - protein, 10 aa, Homo Sapiens
ISKKPESTSF

SEQ ID NO: 83377 - protein, 10 aa, Homo Sapiens
ISMDETGLTI

SEQ ID NO: 83378 - protein, 10 aa, Homo Sapiens
ISQPASGNTF

SEQ ID NO: 83379 - protein, 10 aa, Homo Sapiens
ISYRNTELEL

SEQ ID NO: 83380 - protein, 10 aa, Homo Sapiens
ITADGAHFEL

SEQ ID NO: 83381 - protein, 10 aa, Homo Sapiens
ITAEDRQVSI

SEQ ID NO: 83382 - protein, 10 aa, Homo Sapiens
ITAENMKSSL

SEQ ID NO: 83383 - protein, 10 aa, Homo Sapiens
ITIMQPILRF

SEQ ID NO: 83384 - protein, 10 aa, Homo Sapiens
ITKLMEKTKY

SEQ ID NO: 83385 - protein, 10 aa, Homo Sapiens
ITSKSGEILY

SEQ ID NO: 83386 - protein, 10 aa, Homo Sapiens
ITYNKVLHFF

SEQ ID NO: 83387 - protein, 10 aa, Homo Sapiens
KAIPDTRLTI

SEQ ID NO: 83388 - protein, 10 aa, Homo Sapiens
KFLLEKLGES

SEQ ID NO: 83389 - protein, 10 aa, Homo Sapiens
KIADMGHLKY

SEQ ID NO: 83390 - protein, 10 aa, Homo Sapiens
KIFFPGVSEF

SEQ ID NO: 83391 - protein, 10 aa, Homo Sapiens
KMYDAAKLLY

SEQ ID NO: 83392 - protein, 10 aa, Homo Sapiens
KSAPSDSLTY

SEQ ID NO: 83393 - protein, 10 aa, Homo Sapiens
KSFRGETLGY

SEQ ID NO: 83394 - protein, 10 aa, Homo Sapiens
KSFYGSTLFL

SEQ ID NO: 83395 - protein, 10 aa, Homo Sapiens
KSIGDIFLKY

SEQ ID NO: 83396 - protein, 10 aa, Homo Sapiens
KSYDGRAYVI

SEQ ID NO: 83397 - protein, 10 aa, Homo Sapiens
KTINKVLLQY

SEQ ID NO: 83398 - protein, 10 aa, Homo Sapiens
KTLQETNMMY

SEQ ID NO: 83399 - protein, 10 aa, Homo Sapiens
KTLTGKTITL

SEQ ID NO: 83400 - protein, 10 aa, Homo Sapiens
KTYDRCPLEL

SEQ ID NO: 83401 - protein, 10 aa, Homo Sapiens
KTYDTSFLDF

SEQ ID NO: 83402 - protein, 10 aa, Homo Sapiens
KTYVGGILLL

SEQ ID NO: 83403 - protein, 10 aa, Homo Sapiens
KVADWTGATY

SEQ ID NO: 83404 - protein, 10 aa, Homo Sapiens
KVFDGCPLKI

SEQ ID NO: 83405 - protein, 10 aa, Homo Sapiens
LSAQDHQTFF

SEQ ID NO: 83406 - protein, 10 aa, Homo Sapiens
LSFAARSFYY

SEQ ID NO: 83407 - protein, 10 aa, Homo Sapiens
LSFKGKSLKL

SEQ ID NO: 83408 - protein, 10 aa, Homo Sapiens
LSHAITLEFY

SEQ ID NO: 83409 - protein, 10 aa, Homo Sapiens
LSKDSILSLY

SEQ ID NO: 83410 - protein, 10 aa, Homo Sapiens
LSKQETGTEF

SEQ ID NO: 83411 - protein, 10 aa, Homo Sapiens
LSLDKESGLL

SEQ ID NO: 83412 - protein, 10 aa, Homo Sapiens
LSMPASLGRM

SEQ ID NO: 83413 - protein, 10 aa, Homo Sapiens
LSTDHIPILY

SEQ ID NO: 83414 - protein, 10 aa, Homo Sapiens
LSWEGGGLKI

SEQ ID NO: 83415 - protein, 10 aa, Homo Sapiens
LSYISRTNQL

SEQ ID NO: 83416 - protein, 10 aa, Homo Sapiens
LTIAADKGHY

SEQ ID NO: 83417 - protein, 10 aa, Homo Sapiens
LTIFTARLYY

SEQ ID NO: 83418 - protein, 10 aa, Homo Sapiens
LTIPDGGVHI

SEQ ID NO: 83419 - protein, 10 aa, Homo Sapiens
LTIRTQGLEY

SEQ ID NO: 83420 - protein, 10 aa, Homo Sapiens
LTYEDTYNTL

SEQ ID NO: 83421 - protein, 10 aa, Homo Sapiens
LTYLDNGVVF

SEQ ID NO: 83422 - protein, 10 aa, Homo Sapiens
LTYPEDKLVY

SEQ ID NO: 83423 - protein, 10 aa, Homo Sapiens
LVLDPYLLKY

SEQ ID NO: 83424 - protein, 10 aa, Homo Sapiens
LVYPGDPLRF

SEQ ID NO: 83425 - protein, 10 aa, Homo Sapiens
MQYPGRSLVF

SEQ ID NO: 83426 - protein, 10 aa, Homo Sapiens
MSEMSSFLHI

SEQ ID NO: 83427 - protein, 10 aa, Homo Sapiens
MSIKERLALL

SEQ ID NO: 83428 - protein, 10 aa, Homo Sapiens
MSYDHVELTF

SEQ ID NO: 83429 - protein, 10 aa, Homo Sapiens
MSYEQLMQLY

SEQ ID NO: 83430 - protein, 10 aa, Homo Sapiens
MTLHERFTKY

SEQ ID NO: 83431 - protein, 10 aa, Homo Sapiens
MTLKGLPSTY

SEQ ID NO: 83432 - protein, 10 aa, Homo Sapiens
MTLNERFTSY

SEQ ID NO: 83433 - protein, 10 aa, Homo Sapiens
MTVSDAILRY

SEQ ID NO: 83434 - protein, 10 aa, Homo Sapiens
QSLPDFGISY

SEQ ID NO: 83435 - protein, 10 aa, Homo Sapiens
QTIEACIANF

SEQ ID NO: 83436 - protein, 10 aa, Homo Sapiens
QTLPTSVVTI

SEQ ID NO: 83437 - protein, 10 aa, Homo Sapiens
QTLRDSMLKY

SEQ ID NO: 83438 - protein, 10 aa, Homo Sapiens
QTMCPHILRY

SEQ ID NO: 83439 - protein, 10 aa, Homo Sapiens
QTMVNSENTY

SEQ ID NO: 83440 - protein, 10 aa, Homo Sapiens
QTVKDSRTVY

SEQ ID NO: 83441 - protein, 10 aa, Homo Sapiens
QTWGPGTLRL

SEQ ID NO: 83442 - protein, 10 aa, Homo Sapiens
QTWWHGVLAW

SEQ ID NO: 83443 - protein, 10 aa, Homo Sapiens
QTYVSGTLRF

SEQ ID NO: 83444 - protein, 10 aa, Homo Sapiens
RAFDGERLRL

SEQ ID NO: 83445 - protein, 10 aa, Homo Sapiens
RAIEDPILAY

SEQ ID NO: 83446 - protein, 10 aa, Homo Sapiens
RAYEPLGLQW

SEQ ID NO: 83447 - protein, 10 aa, Homo Sapiens
RAYPHNLMTF

SEQ ID NO: 83448 - protein, 10 aa, Homo Sapiens
RAYPVGGLCY

SEQ ID NO: 83449 - protein, 10 aa, Homo Sapiens
RIAIQNLLYY

SEQ ID NO: 83450 - protein, 10 aa, Homo Sapiens
RSAPSQASSF

SEQ ID NO: 83451 - protein, 10 aa, Homo Sapiens
RSATICLAYL

SEQ ID NO: 83452 - protein, 10 aa, Homo Sapiens
RSFAPGMSTF

SEQ ID NO: 83453 - protein, 10 aa, Homo Sapiens
RSFEHALMLF

SEQ ID NO: 83454 - protein, 10 aa, Homo Sapiens
RSIEEVYYLW

SEQ ID NO: 83455 - protein, 10 aa, Homo Sapiens
RSIKAQLQNF

SEQ ID NO: 83456 - protein, 10 aa, Homo Sapiens
RSIQADGLVW

SEQ ID NO: 83457 - protein, 10 aa, Homo Sapiens
RSLINSNVGF

SEQ ID NO: 83458 - protein, 10 aa, Homo Sapiens
RSLPLCLQLY

SEQ ID NO: 83459 - protein, 10 aa, Homo Sapiens
RSMDTIVGML

SEQ ID NO: 83460 - protein, 10 aa, Homo Sapiens
RSVDVTNTTF

SEQ ID NO: 83461 - protein, 10 aa, Homo Sapiens
RSYDEAILRL

SEQ ID NO: 83462 - protein, 10 aa, Homo Sapiens
RSYKNNTLKL

SEQ ID NO: 83463 - protein, 10 aa, Homo Sapiens
RSYSDPPLKF

SEQ ID NO: 83464 - protein, 10 aa, Homo Sapiens
RSYVGIATLI

SEQ ID NO: 83465 - protein, 10 aa, Homo Sapiens
RTCEWTGLKF

SEQ ID NO: 83466 - protein, 10 aa, Homo Sapiens
RTFDETVSTY

SEQ ID NO: 83467 - protein, 10 aa, Homo Sapiens
RTFSNTTLLF

SEQ ID NO: 83468 - protein, 10 aa, Homo Sapiens
RTFTDHVMLF

SEQ ID NO: 83469 - protein, 10 aa, Homo Sapiens
RTHVPKDMKL

SEQ ID NO: 83470 - protein, 10 aa, Homo Sapiens
RTIDEHDAII

SEQ ID NO: 83471 - protein, 10 aa, Homo Sapiens
RTKDIEDVFY

SEQ ID NO: 83472 - protein, 10 aa, Homo Sapiens
RTLDKIMILF

SEQ ID NO: 83473 - protein, 10 aa, Homo Sapiens
RTLDNQLFFF

SEQ ID NO: 83474 - protein, 10 aa, Homo Sapiens
RTLESKLVLF

SEQ ID NO: 83475 - protein, 10 aa, Homo Sapiens
RTSGSVYITL

SEQ ID NO: 83476 - protein, 10 aa, Homo Sapiens
RTYDETYQRY

SEQ ID NO: 83477 - protein, 10 aa, Homo Sapiens
RTYEAKLLAF

SEQ ID NO: 83478 - protein, 10 aa, Homo Sapiens
RTYGVVAQYY

SEQ ID NO: 83479 - protein, 10 aa, Homo Sapiens
RTYPAVKMKY

SEQ ID NO: 83480 - protein, 10 aa, Homo Sapiens
RTYSKKHFRI

SEQ ID NO: 83481 - protein, 10 aa, Homo Sapiens
RTYSSGHNRL

SEQ ID NO: 83482 - protein, 10 aa, Homo Sapiens
RTYTYEKLLW

SEQ ID NO: 83483 - protein, 10 aa, Homo Sapiens
SDIDDAVRKL

SEQ ID NO: 83484 - protein, 10 aa, Homo Sapiens
SSLSGPRLLF

SEQ ID NO: 83485 - protein, 10 aa, Homo Sapiens
SSYHHGEMSL

SEQ ID NO: 83486 - protein, 10 aa, Homo Sapiens
STMEGGTLKY

SEQ ID NO: 83487 - protein, 10 aa, Homo Sapiens
STYDGFGLAW

SEQ ID NO: 83488 - protein, 10 aa, Homo Sapiens
STYQRWQFTL

SEQ ID NO: 83489 - protein, 10 aa, Homo Sapiens
SVYQDTWMKY

SEQ ID NO: 83490 - protein, 10 aa, Homo Sapiens
TLFDSRHLLY

SEQ ID NO: 83491 - protein, 10 aa, Homo Sapiens
TTYEGIFKTL

SEQ ID NO: 83492 - protein, 10 aa, Homo Sapiens
VAIKDKQVKY

SEQ ID NO: 83493 - protein, 10 aa, Homo Sapiens
VSEDSSRGAF

SEQ ID NO: 83494 - protein, 10 aa, Homo Sapiens
VSHHPPISAF

SEQ ID NO: 83495 - protein, 10 aa, Homo Sapiens
VSISSPVLSL

SEQ ID NO: 83496 - protein, 10 aa, Homo Sapiens
VSVPASRLTY

SEQ ID NO: 83497 - protein, 10 aa, Homo Sapiens
VSYGGLLMRL

SEQ ID NO: 83498 - protein, 10 aa, Homo Sapiens
VSYQKLLKYY

SEQ ID NO: 83499 - protein, 10 aa, Homo Sapiens
VSYSRVYLLY

SEQ ID NO: 83500 - protein, 10 aa, Homo Sapiens
VTAPRTVLLL

SEQ ID NO: 83501 - protein, 10 aa, Homo Sapiens
VTFPGIKLIY

SEQ ID NO: 83502 - protein, 10 aa, Homo Sapiens
VTRPDSGHLY

SEQ ID NO: 83503 - protein, 10 aa, Homo Sapiens
VTVVDRAVTI

SEQ ID NO: 83504 - protein, 10 aa, Homo Sapiens
VTYGKGKLLM

SEQ ID NO: 83505 - protein, 10 aa, Homo Sapiens
VTYNKVLHFY

SEQ ID NO: 83506 - protein, 10 aa, Homo Sapiens
YALPHAILRL

SEQ ID NO: 83507 - protein, 10 aa, Homo Sapiens
YSIEKPLKFF

SEQ ID NO: 83508 - protein, 10 aa, Homo Sapiens
YSISSLKTLF

SEQ ID NO: 83509 - protein, 10 aa, Homo Sapiens
YSKPETGLTL

SEQ ID NO: 83510 - protein, 10 aa, Homo Sapiens
YSLDHISSLF

SEQ ID NO: 83511 - protein, 10 aa, Homo Sapiens
YSLEYGFLRL

SEQ ID NO: 83512 - protein, 10 aa, Homo Sapiens
YSLVDREVGY

SEQ ID NO: 83513 - protein, 10 aa, Homo Sapiens
YSYAGGRGSY

SEQ ID NO: 83514 - protein, 10 aa, Homo Sapiens
YTDFDGTRVY

SEQ ID NO: 83515 - protein, 10 aa, Homo Sapiens
YTISDTIARF

SEQ ID NO: 83516 - protein, 10 aa, Homo Sapiens
YTLKDNKVYI

SEQ ID NO: 83517 - protein, 10 aa, Homo Sapiens
YTVKVEDLTF

SEQ ID NO: 83518 - protein, 10 aa, Homo Sapiens
YTVNGDERQL

SEQ ID NO: 83519 - protein, 10 aa, Homo Sapiens
YTYESKMAFL

SEQ ID NO: 83520 - protein, 11 aa, Homo Sapiens
AEQRGELAIKD

SEQ ID NO: 83521 - protein, 11 aa, Homo Sapiens
AQFPGACGLRY

SEQ ID NO: 83522 - protein, 11 aa, Homo Sapiens
ASDEQDSVRLL

SEQ ID NO: 83523 - protein, 11 aa, Homo Sapiens
ASLPSELIVHI

SEQ ID NO: 83524 - protein, 11 aa, Homo Sapiens
ASNQREEYLLL

SEQ ID NO: 83525 - protein, 11 aa, Homo Sapiens
ASYNAQPSASY

SEQ ID NO: 83526 - protein, 11 aa, Homo Sapiens
ASYRAQPSVSL

SEQ ID NO: 83527 - protein, 11 aa, Homo Sapiens
ATHVHSRPLLL

SEQ ID NO: 83528 - protein, 11 aa, Homo Sapiens
ATNGREGLLRF

SEQ ID NO: 83529 - protein, 11 aa, Homo Sapiens
ATSKEEALMEL

SEQ ID NO: 83530 - protein, 11 aa, Homo Sapiens
ATSKTGGYLVY

SEQ ID NO: 83531 - protein, 11 aa, Homo Sapiens
ATYQSLYPLTL

SEQ ID NO: 83532 - protein, 11 aa, Homo Sapiens
AVEAKKTYVRD

SEQ ID NO: 83533 - protein, 11 aa, Homo Sapiens
FALPSELERSY

SEQ ID NO: 83534 - protein, 11 aa, Homo Sapiens
FAYDGKDYLTL

SEQ ID NO: 83535 - protein, 11 aa, Homo Sapiens
FTLKEEKPKMY

SEQ ID NO: 83536 - protein, 11 aa, Homo Sapiens
GTIAGLNVLRI

SEQ ID NO: 83537 - protein, 11 aa, Homo Sapiens
GTSSVTGLLSY

SEQ ID NO: 83538 - protein, 11 aa, Homo Sapiens
GTYHGDSDLQL

SEQ ID NO: 83539 - protein, 11 aa, Homo Sapiens
HAVSSHIASML

SEQ ID NO: 83540 - protein, 11 aa, Homo Sapiens
HSFGGGTGSGF

SEQ ID NO: 83541 - protein, 11 aa, Homo Sapiens
ISDIDDAVRKL

SEQ ID NO: 83542 - protein, 11 aa, Homo Sapiens
ISFHPKRPMHI

SEQ ID NO: 83543 - protein, 11 aa, Homo Sapiens
ISFIPHESQVY

SEQ ID NO: 83544 - protein, 11 aa, Homo Sapiens
ISLPDDVRRRL

SEQ ID NO: 83545 - protein, 11 aa, Homo Sapiens
ISNPHGCRLFY

SEQ ID NO: 83546 - protein, 11 aa, Homo Sapiens
ISSDSTGQLHL

SEQ ID NO: 83547 - protein, 11 aa, Homo Sapiens
ISYIYGSKFQL

SEQ ID NO: 83548 - protein, 11 aa, Homo Sapiens
ISYVDPQFLTY

SEQ ID NO: 83549 - protein, 11 aa, Homo Sapiens
ITDSTGTHLVL

SEQ ID NO: 83550 - protein, 11 aa, Homo Sapiens
ITFDKGGTWEF

SEQ ID NO: 83551 - protein, 11 aa, Homo Sapiens
ITLDDASAPRL

SEQ ID NO: 83552 - protein, 11 aa, Homo Sapiens
ITYEQLKRLQI

SEQ ID NO: 83553 - protein, 11 aa, Homo Sapiens
ITYPQLEGFKF

SEQ ID NO: 83554 - protein, 11 aa, Homo Sapiens
ITYQHIDRWLL

SEQ ID NO: 83555 - protein, 11 aa, Homo Sapiens
IVSERDVYLTY

SEQ ID NO: 83556 - protein, 11 aa, Homo Sapiens
KAFPHSSSLRY

SEQ ID NO: 83557 - protein, 11 aa, Homo Sapiens
KSFEGNVFMYY

SEQ ID NO: 83558 - protein, 11 aa, Homo Sapiens
KSFKGSSGLRY

SEQ ID NO: 83559 - protein, 11 aa, Homo Sapiens
KSLGVQDLLQF

SEQ ID NO: 83560 - protein, 11 aa, Homo Sapiens
KSLLGKDVLFL

SEQ ID NO: 83561 - protein, 11 aa, Homo Sapiens
KSLQWDKVLRL

SEQ ID NO: 83562 - protein, 11 aa, Homo Sapiens
KTAVETAVLLL

SEQ ID NO: 83563 - protein, 11 aa, Homo Sapiens
KTLQHDKLVRL

SEQ ID NO: 83564 - protein, 11 aa, Homo Sapiens
KTPLGGQKRSF

SEQ ID NO: 83565 - protein, 11 aa, Homo Sapiens
KTSARDAALAY

SEQ ID NO: 83566 - protein, 11 aa, Homo Sapiens
KVYDSQGLLIF

SEQ ID NO: 83567 - protein, 11 aa, Homo Sapiens
LESRIRDVHEL

SEQ ID NO: 83568 - protein, 11 aa, Homo Sapiens
LSCPHYRFSLL

SEQ ID NO: 83569 - protein, 11 aa, Homo Sapiens
LSFDAPGRLLW

SEQ ID NO: 83570 - protein, 11 aa, Homo Sapiens
LSIPTSPTSKY

SEQ ID NO: 83571 - protein, 11 aa, Homo Sapiens
LTFPSLQRLVY

SEQ ID NO: 83572 - protein, 11 aa, Homo Sapiens
LTIPSSCPRSF

SEQ ID NO: 83573 - protein, 11 aa, Homo Sapiens
LTLDEDSRRKY

SEQ ID NO: 83574 - protein, 11 aa, Homo Sapiens
LTSVVSGHLDY

SEQ ID NO: 83575 - protein, 11 aa, Homo Sapiens
LTYETPQGLRI

SEQ ID NO: 83576 - protein, 11 aa, Homo Sapiens
LTYKPDVYTYL

SEQ ID NO: 83577 - protein, 11 aa, Homo Sapiens
MTINANNRLLL

SEQ ID NO: 83578 - protein, 11 aa, Homo Sapiens
MTLEESAMLRY

SEQ ID NO: 83579 - protein, 11 aa, Homo Sapiens
MTLPGIHPPTL

SEQ ID NO: 83580 - protein, 11 aa, Homo Sapiens
MTVDASHARHI

SEQ ID NO: 83581 - protein, 11 aa, Homo Sapiens
QAIENAHVLLY

SEQ ID NO: 83582 - protein, 11 aa, Homo Sapiens
QSISKALVAYY

SEQ ID NO: 83583 - protein, 11 aa, Homo Sapiens
QSLAADQLLKL

SEQ ID NO: 83584 - protein, 11 aa, Homo Sapiens
QSLPAGTLLHL

SEQ ID NO: 83585 - protein, 11 aa, Homo Sapiens
QSMDSKLSGRY

SEQ ID NO: 83586 - protein, 11 aa, Homo Sapiens
QSSTSSTHLQL

SEQ ID NO: 83587 - protein, 11 aa, Homo Sapiens
QSYEDMRGILY

SEQ ID NO: 83588 - protein, 11 aa, Homo Sapiens
QSYGPEHLLTF

SEQ ID NO: 83589 - protein, 11 aa, Homo Sapiens
QTMSDQIIGRI

SEQ ID NO: 83590 - protein, 11 aa, Homo Sapiens
QTWAGSHSLKY

SEQ ID NO: 83591 - protein, 11 aa, Homo Sapiens
QTYLQKETSTL

SEQ ID NO: 83592 - protein, 11 aa, Homo Sapiens
RALGEEALLRY

SEQ ID NO: 83593 - protein, 11 aa, Homo Sapiens
RALSAVHSPTF

SEQ ID NO: 83594 - protein, 11 aa, Homo Sapiens
RGFGGGGYGGF

SEQ ID NO: 83595 - protein, 11 aa, Homo Sapiens
RIIEETLALKF

SEQ ID NO: 83596 - protein, 11 aa, Homo Sapiens
RILPEEKVLRL

SEQ ID NO: 83597 - protein, 11 aa, Homo Sapiens
RILPQDVILKF

SEQ ID NO: 83598 - protein, 11 aa, Homo Sapiens
RSFIPDQHMVF

SEQ ID NO: 83599 - protein, 11 aa, Homo Sapiens
RSLDHPNVLKF

SEQ ID NO: 83600 - protein, 11 aa, Homo Sapiens
RSLDPEKTLGL

SEQ ID NO: 83601 - protein, 11 aa, Homo Sapiens
RSLDVEHTTLY

SEQ ID NO: 83602 - protein, 11 aa, Homo Sapiens
RSLEVLIGSGY

SEQ ID NO: 83603 - protein, 11 aa, Homo Sapiens
RSSRESGVLVL

SEQ ID NO: 83604 - protein, 11 aa, Homo Sapiens
RSYAGKNAVAY

SEQ ID NO: 83605 - protein, 11 aa, Homo Sapiens
RTFTHPSRLTY

SEQ ID NO: 83606 - protein, 11 aa, Homo Sapiens
RTIKPEKHLRF

SEQ ID NO: 83607 - protein, 11 aa, Homo Sapiens
RTLGEIPTLVF

SEQ ID NO: 83608 - protein, 11 aa, Homo Sapiens
RTLKYSTKMTY

SEQ ID NO: 83609 - protein, 11 aa, Homo Sapiens
RTNSTFNQVVL

SEQ ID NO: 83610 - protein, 11 aa, Homo Sapiens
RVLDPSKFLKI

SEQ ID NO: 83611 - protein, 11 aa, Homo Sapiens
RVLPGSSVLFL

SEQ ID NO: 83612 - protein, 11 aa, Homo Sapiens
SALPDIKVLTL

SEQ ID NO: 83613 - protein, 11 aa, Homo Sapiens
SAVQSSIASAF

SEQ ID NO: 83614 - protein, 11 aa, Homo Sapiens
SIFSGAASLGY

SEQ ID NO: 83615 - protein, 11 aa, Homo Sapiens
STEPAHIVASF

SEQ ID NO: 83616 - protein, 11 aa, Homo Sapiens
STIASDIVSRF

SEQ ID NO: 83617 - protein, 11 aa, Homo Sapiens
TSAPGGGPGTL

SEQ ID NO: 83618 - protein, 11 aa, Homo Sapiens
TTIPTKQTQTF

SEQ ID NO: 83619 - protein, 11 aa, Homo Sapiens
TVVGPSSVLTY

SEQ ID NO: 83620 - protein, 11 aa, Homo Sapiens
VAYWRQAGLSY

SEQ ID NO: 83621 - protein, 11 aa, Homo Sapiens
VSLPSHLNISY

SEQ ID NO: 83622 - protein, 11 aa, Homo Sapiens
VSMDNRLMELF

SEQ ID NO: 83623 - protein, 11 aa, Homo Sapiens
VSSLTSGLLTI

SEQ ID NO: 83624 - protein, 11 aa, Homo Sapiens
VSSVSTAKLTL

SEQ ID NO: 83625 - protein, 11 aa, Homo Sapiens
VSYFPDKVALL

SEQ ID NO: 83626 - protein, 11 aa, Homo Sapiens
VVSSVSSFLKY

SEQ ID NO: 83627 - protein, 11 aa, Homo Sapiens
YSLDGRLLSTY

SEQ ID NO: 83628 - protein, 11 aa, Homo Sapiens
YSLPTPKGGKY

SEQ ID NO: 83629 - protein, 11 aa, Homo Sapiens
YSVNGERLGTY

SEQ ID NO: 83630 - protein, 11 aa, Homo Sapiens
YSYDLSHSLQY

SEQ ID NO: 83631 - protein, 11 aa, Homo Sapiens
YTADGKEVLEY

SEQ ID NO: 83632 - protein, 11 aa, Homo Sapiens
YTSDSSGKLVF

SEQ ID NO: 83633 - protein, 8 aa, Homo Sapiens
AEALAHAY

SEQ ID NO: 83634 - protein, 8 aa, Homo Sapiens
AEALARVY

SEQ ID NO: 83635 - protein, 8 aa, Homo Sapiens
AEEKIELL

SEQ ID NO: 83636 - protein, 8 aa, Homo Sapiens
AEHLRYVF

SEQ ID NO: 83637 - protein, 8 aa, Homo Sapiens
AEILRKAM

SEQ ID NO: 83638 - protein, 8 aa, Homo Sapiens
AEILRSEF

SEQ ID NO: 83639 - protein, 8 aa, Homo Sapiens
AEILRSEY

SEQ ID NO: 83640 - protein, 8 aa, Homo Sapiens
AELIASTF

SEQ ID NO: 83641 - protein, 8 aa, Homo Sapiens
AEMVRHAL

SEQ ID NO: 83642 - protein, 8 aa, Homo Sapiens
AEMYVAKF

SEQ ID NO: 83643 - protein, 8 aa, Homo Sapiens
AEQLIRVY

SEQ ID NO: 83644 - protein, 8 aa, Homo Sapiens
AEQLRFLF

SEQ ID NO: 83645 - protein, 8 aa, Homo Sapiens
AERVVNQY

SEQ ID NO: 83646 - protein, 8 aa, Homo Sapiens
AEYPAVKF

SEQ ID NO: 83647 - protein, 8 aa, Homo Sapiens
CEAQAKAF

SEQ ID NO: 83648 - protein, 8 aa, Homo Sapiens
CEHLQYLF

SEQ ID NO: 83649 - protein, 8 aa, Homo Sapiens
CEIKQPVF

SEQ ID NO: 83650 - protein, 8 aa, Homo Sapiens
CEIQVQAL

SEQ ID NO: 83651 - protein, 8 aa, Homo Sapiens
CEITTREY

SEQ ID NO: 83652 - protein, 8 aa, Homo Sapiens
CEKTAVEF

SEQ ID NO: 83653 - protein, 8 aa, Homo Sapiens
CELLAQQF

SEQ ID NO: 83654 - protein, 8 aa, Homo Sapiens
CEQIRAAL

SEQ ID NO: 83655 - protein, 8 aa, Homo Sapiens
CERTVFQF

SEQ ID NO: 83656 - protein, 8 aa, Homo Sapiens
CEVQVEGY

SEQ ID NO: 83657 - protein, 8 aa, Homo Sapiens
DALAKAVY

SEQ ID NO: 83658 - protein, 8 aa, Homo Sapiens
DALVITHY

SEQ ID NO: 83659 - protein, 8 aa, Homo Sapiens
DDFKAEDF

SEQ ID NO: 83660 - protein, 8 aa, Homo Sapiens
DDFRVVSL

SEQ ID NO: 83661 - protein, 8 aa, Homo Sapiens
DDIAALVV

SEQ ID NO: 83662 - protein, 8 aa, Homo Sapiens
DDIKICTL

SEQ ID NO: 83663 - protein, 8 aa, Homo Sapiens
DDILIVKL

SEQ ID NO: 83664 - protein, 8 aa, Homo Sapiens
DDIQTPKF

SEQ ID NO: 83665 - protein, 8 aa, Homo Sapiens
DDIRAITF

SEQ ID NO: 83666 - protein, 8 aa, Homo Sapiens
DDIRVSRV

SEQ ID NO: 83667 - protein, 8 aa, Homo Sapiens
DDITQEEY

SEQ ID NO: 83668 - protein, 8 aa, Homo Sapiens
DDIYDPTY

SEQ ID NO: 83669 - protein, 8 aa, Homo Sapiens
DDLEVPAY

SEQ ID NO: 83670 - protein, 8 aa, Homo Sapiens
DDRIVHEL

SEQ ID NO: 83671 - protein, 8 aa, Homo Sapiens
DDRVVVEY

SEQ ID NO: 83672 - protein, 8 aa, Homo Sapiens
DDSLVSIF

SEQ ID NO: 83673 - protein, 8 aa, Homo Sapiens
DDVAILTY

SEQ ID NO: 83674 - protein, 8 aa, Homo Sapiens
DDVAVHYY

SEQ ID NO: 83675 - protein, 8 aa, Homo Sapiens
DDVFVNTH

SEQ ID NO: 83676 - protein, 8 aa, Homo Sapiens
DDVKVERI

SEQ ID NO: 83677 - protein, 8 aa, Homo Sapiens
DDVNAVAF

SEQ ID NO: 83678 - protein, 8 aa, Homo Sapiens
DDVPVQGF

SEQ ID NO: 83679 - protein, 8 aa, Homo Sapiens
DDVRVQEV

SEQ ID NO: 83680 - protein, 8 aa, Homo Sapiens
DDVSAVEF

SEQ ID NO: 83681 - protein, 8 aa, Homo Sapiens
DDVTSVLF

SEQ ID NO: 83682 - protein, 8 aa, Homo Sapiens
DEAAAVAL

SEQ ID NO: 83683 - protein, 8 aa, Homo Sapiens
DEAELQRL

SEQ ID NO: 83684 - protein, 8 aa, Homo Sapiens
DEAIRAVL

SEQ ID NO: 83685 - protein, 8 aa, Homo Sapiens
DEAKAEVL

SEQ ID NO: 83686 - protein, 8 aa, Homo Sapiens
DEAKFPTM

SEQ ID NO: 83687 - protein, 8 aa, Homo Sapiens
DEAKRHLL

SEQ ID NO: 83688 - protein, 8 aa, Homo Sapiens
DEALAILA

SEQ ID NO: 83689 - protein, 8 aa, Homo Sapiens
DEALQHPY

SEQ ID NO: 83690 - protein, 8 aa, Homo Sapiens
DEAQAFRA

SEQ ID NO: 83691 - protein, 8 aa, Homo Sapiens
DEAQKVIY

SEQ ID NO: 83692 - protein, 8 aa, Homo Sapiens
DEARFAGH

SEQ ID NO: 83693 - protein, 8 aa, Homo Sapiens
DEARFSEF

SEQ ID NO: 83694 - protein, 8 aa, Homo Sapiens
DEATVSVL

SEQ ID NO: 83695 - protein, 8 aa, Homo Sapiens
DEAVAYGA

SEQ ID NO: 83696 - protein, 8 aa, Homo Sapiens
DEAVIASL

SEQ ID NO: 83697 - protein, 8 aa, Homo Sapiens
DEAVWRPY

SEQ ID NO: 83698 - protein, 8 aa, Homo Sapiens
DEDIKKAY

SEQ ID NO: 83699 - protein, 8 aa, Homo Sapiens
DEDQLEKI

SEQ ID NO: 83700 - protein, 8 aa, Homo Sapiens
DEEFARTL

SEQ ID NO: 83701 - protein, 8 aa, Homo Sapiens
DEEMAVKY

SEQ ID NO: 83702 - protein, 8 aa, Homo Sapiens
DEEQIAKY

SEQ ID NO: 83703 - protein, 8 aa, Homo Sapiens
DEERLLAH

SEQ ID NO: 83704 - protein, 8 aa, Homo Sapiens
DEFFTSGY

SEQ ID NO: 83705 - protein, 8 aa, Homo Sapiens
DEFHFVAD

SEQ ID NO: 83706 - protein, 8 aa, Homo Sapiens
DEFIAHRL

SEQ ID NO: 83707 - protein, 8 aa, Homo Sapiens
DEFIIKTV

SEQ ID NO: 83708 - protein, 8 aa, Homo Sapiens
DEFKELVY

SEQ ID NO: 83709 - protein, 8 aa, Homo Sapiens
DEFKIGEL

SEQ ID NO: 83710 - protein, 8 aa, Homo Sapiens
DEFKSFCH

SEQ ID NO: 83711 - protein, 8 aa, Homo Sapiens
DEFKVVVV

SEQ ID NO: 83712 - protein, 8 aa, Homo Sapiens
DEFLASGF

SEQ ID NO: 83713 - protein, 8 aa, Homo Sapiens
DEFNIKVL

SEQ ID NO: 83714 - protein, 8 aa, Homo Sapiens
DEFNIQVL

SEQ ID NO: 83715 - protein, 8 aa, Homo Sapiens
DEFNLQKM

SEQ ID NO: 83716 - protein, 8 aa, Homo Sapiens
DEFPHPPK

SEQ ID NO: 83717 - protein, 8 aa, Homo Sapiens
DEFQEYTM

SEQ ID NO: 83718 - protein, 8 aa, Homo Sapiens
DEFQIATM

SEQ ID NO: 83719 - protein, 8 aa, Homo Sapiens
DEFRMPYL

SEQ ID NO: 83720 - protein, 8 aa, Homo Sapiens
DEFTTKLL

SEQ ID NO: 83721 - protein, 8 aa, Homo Sapiens
DEFVKSVL

SEQ ID NO: 83722 - protein, 8 aa, Homo Sapiens
DEFVTHNL

SEQ ID NO: 83723 - protein, 8 aa, Homo Sapiens
DEFVVYKT

SEQ ID NO: 83724 - protein, 8 aa, Homo Sapiens
DEFYQTTY

SEQ ID NO: 83725 - protein, 8 aa, Homo Sapiens
DEFYRSGW

SEQ ID NO: 83726 - protein, 8 aa, Homo Sapiens
DEGHSFEL

SEQ ID NO: 83727 - protein, 8 aa, Homo Sapiens
DEGIAYLV

SEQ ID NO: 83728 - protein, 8 aa, Homo Sapiens
DEGKLHVL

SEQ ID NO: 83729 - protein, 8 aa, Homo Sapiens
DEGKVIRF

SEQ ID NO: 83730 - protein, 8 aa, Homo Sapiens
DEGVGLVH

SEQ ID NO: 83731 - protein, 8 aa, Homo Sapiens
DEHEGPAL

SEQ ID NO: 83732 - protein, 8 aa, Homo Sapiens
DEHHFVAV

SEQ ID NO: 83733 - protein, 8 aa, Homo Sapiens
DEHHSVNF

SEQ ID NO: 83734 - protein, 8 aa, Homo Sapiens
DEHINVAF

SEQ ID NO: 83735 - protein, 8 aa, Homo Sapiens
DEHIQVQL

SEQ ID NO: 83736 - protein, 8 aa, Homo Sapiens
DEHISYVA

SEQ ID NO: 83737 - protein, 8 aa, Homo Sapiens
DEHLITFF

SEQ ID NO: 83738 - protein, 8 aa, Homo Sapiens
DEHLLQAI

SEQ ID NO: 83739 - protein, 8 aa, Homo Sapiens
DEHLVQSV

SEQ ID NO: 83740 - protein, 8 aa, Homo Sapiens
DEHLYVAF

SEQ ID NO: 83741 - protein, 8 aa, Homo Sapiens
DEHNIQNY

SEQ ID NO: 83742 - protein, 8 aa, Homo Sapiens
DEHSVMTY

SEQ ID NO: 83743 - protein, 8 aa, Homo Sapiens
DEHYILTF

SEQ ID NO: 83744 - protein, 8 aa, Homo Sapiens
DEIAQHAL

SEQ ID NO: 83745 - protein, 8 aa, Homo Sapiens
DEIENPHY

SEQ ID NO: 83746 - protein, 8 aa, Homo Sapiens
DEIEREVL

SEQ ID NO: 83747 - protein, 8 aa, Homo Sapiens
DEIKKYTT

SEQ ID NO: 83748 - protein, 8 aa, Homo Sapiens
DEILAQAY

SEQ ID NO: 83749 - protein, 8 aa, Homo Sapiens
DEIMLPSF

SEQ ID NO: 83750 - protein, 8 aa, Homo Sapiens
DEIMRAGM

SEQ ID NO: 83751 - protein, 8 aa, Homo Sapiens
DEINKKEL

SEQ ID NO: 83752 - protein, 8 aa, Homo Sapiens
DEIQVPVL

SEQ ID NO: 83753 - protein, 8 aa, Homo Sapiens
DEIRLKIV

SEQ ID NO: 83754 - protein, 8 aa, Homo Sapiens
DEISFVNF

SEQ ID NO: 83755 - protein, 8 aa, Homo Sapiens
DEIVALGY

SEQ ID NO: 83756 - protein, 8 aa, Homo Sapiens
DEIVVSTY

SEQ ID NO: 83757 - protein, 8 aa, Homo Sapiens
DEKAIMTY

SEQ ID NO: 83758 - protein, 8 aa, Homo Sapiens
DEKAVDKL

SEQ ID NO: 83759 - protein, 8 aa, Homo Sapiens
DEKDFYLY

SEQ ID NO: 83760 - protein, 8 aa, Homo Sapiens
DEKEFIHF

SEQ ID NO: 83761 - protein, 8 aa, Homo Sapiens
DEKFQAAY

SEQ ID NO: 83762 - protein, 8 aa, Homo Sapiens
DEKIATKY

SEQ ID NO: 83763 - protein, 8 aa, Homo Sapiens
DEKIAWAL

SEQ ID NO: 83764 - protein, 8 aa, Homo Sapiens
DEKILIQH

SEQ ID NO: 83765 - protein, 8 aa, Homo Sapiens
DEKKMANF

SEQ ID NO: 83766 - protein, 8 aa, Homo Sapiens
DEKKMEKL

SEQ ID NO: 83767 - protein, 8 aa, Homo Sapiens
DEKLVEHF

SEQ ID NO: 83768 - protein, 8 aa, Homo Sapiens
DEKPISQY

SEQ ID NO: 83769 - protein, 8 aa, Homo Sapiens
DEKRVEEF

SEQ ID NO: 83770 - protein, 8 aa, Homo Sapiens
DEKSVITY

SEQ ID NO: 83771 - protein, 8 aa, Homo Sapiens
DEKTRFSL

SEQ ID NO: 83772 - protein, 8 aa, Homo Sapiens
DEKTVVRL

SEQ ID NO: 83773 - protein, 8 aa, Homo Sapiens
DEKVVITY

SEQ ID NO: 83774 - protein, 8 aa, Homo Sapiens
DEKYFISH

SEQ ID NO: 83775 - protein, 8 aa, Homo Sapiens
DELEIKAY

SEQ ID NO: 83776 - protein, 8 aa, Homo Sapiens
DELEKEML

SEQ ID NO: 83777 - protein, 8 aa, Homo Sapiens
DELGKKQF

SEQ ID NO: 83778 - protein, 8 aa, Homo Sapiens
DELHIVEA

SEQ ID NO: 83779 - protein, 8 aa, Homo Sapiens
DELIAYEL

SEQ ID NO: 83780 - protein, 8 aa, Homo Sapiens
DELIVQHY

SEQ ID NO: 83781 - protein, 8 aa, Homo Sapiens
DELKKVNL

SEQ ID NO: 83782 - protein, 8 aa, Homo Sapiens
DELKLKQL

SEQ ID NO: 83783 - protein, 8 aa, Homo Sapiens
DELKMPCL

SEQ ID NO: 83784 - protein, 8 aa, Homo Sapiens
DELKTFRL

SEQ ID NO: 83785 - protein, 8 aa, Homo Sapiens
DELLASKY

SEQ ID NO: 83786 - protein, 8 aa, Homo Sapiens
DELLKRVY

SEQ ID NO: 83787 - protein, 8 aa, Homo Sapiens
DELPHYAL

SEQ ID NO: 83788 - protein, 8 aa, Homo Sapiens
DELQRIKL

SEQ ID NO: 83789 - protein, 8 aa, Homo Sapiens
DELRAVMF

SEQ ID NO: 83790 - protein, 8 aa, Homo Sapiens
DELRHQVM

SEQ ID NO: 83791 - protein, 8 aa, Homo Sapiens
DELRVNQL

SEQ ID NO: 83792 - protein, 8 aa, Homo Sapiens
DELSLRAL

SEQ ID NO: 83793 - protein, 8 aa, Homo Sapiens
DELVKQEM

SEQ ID NO: 83794 - protein, 8 aa, Homo Sapiens
DELVKQKI

SEQ ID NO: 83795 - protein, 8 aa, Homo Sapiens
DELVLQQL

SEQ ID NO: 83796 - protein, 8 aa, Homo Sapiens
DELYRQSL

SEQ ID NO: 83797 - protein, 8 aa, Homo Sapiens
DEMIFVAK

SEQ ID NO: 83798 - protein, 8 aa, Homo Sapiens
DEMKVLVL

SEQ ID NO: 83799 - protein, 8 aa, Homo Sapiens
DEMKVSDL

SEQ ID NO: 83800 - protein, 8 aa, Homo Sapiens
DEMLSRGF

SEQ ID NO: 83801 - protein, 8 aa, Homo Sapiens
DEMNVKVL

SEQ ID NO: 83802 - protein, 8 aa, Homo Sapiens
DEMPIFKL

SEQ ID NO: 83803 - protein, 8 aa, Homo Sapiens
DEMPKTLY

SEQ ID NO: 83804 - protein, 8 aa, Homo Sapiens
DEMTGYVA

SEQ ID NO: 83805 - protein, 8 aa, Homo Sapiens
DEMVVELI

SEQ ID NO: 83806 - protein, 8 aa, Homo Sapiens
DENEIEKL

SEQ ID NO: 83807 - protein, 8 aa, Homo Sapiens
DENFILKH

SEQ ID NO: 83808 - protein, 8 aa, Homo Sapiens
DENIRIIL

SEQ ID NO: 83809 - protein, 8 aa, Homo Sapiens
DENKVPYF

SEQ ID NO: 83810 - protein, 8 aa, Homo Sapiens
DENPGVRY

SEQ ID NO: 83811 - protein, 8 aa, Homo Sapiens
DENRKVAL

SEQ ID NO: 83812 - protein, 8 aa, Homo Sapiens
DENRVPDL

SEQ ID NO: 83813 - protein, 8 aa, Homo Sapiens
DENVAHVL

SEQ ID NO: 83814 - protein, 8 aa, Homo Sapiens
DENYFVNY

SEQ ID NO: 83815 - protein, 8 aa, Homo Sapiens
DENYSAEL

SEQ ID NO: 83816 - protein, 8 aa, Homo Sapiens
DEPLIHVF

SEQ ID NO: 83817 - protein, 8 aa, Homo Sapiens
DEPLVYFY

SEQ ID NO: 83818 - protein, 8 aa, Homo Sapiens
DEPQVQKY

SEQ ID NO: 83819 - protein, 8 aa, Homo Sapiens
DEPSVKTM

SEQ ID NO: 83820 - protein, 8 aa, Homo Sapiens
DEQHGFVF

SEQ ID NO: 83821 - protein, 8 aa, Homo Sapiens
DEQKFHCL

SEQ ID NO: 83822 - protein, 8 aa, Homo Sapiens
DEQRAVKY

SEQ ID NO: 83823 - protein, 8 aa, Homo Sapiens
DERAIDAL

SEQ ID NO: 83824 - protein, 8 aa, Homo Sapiens
DERAIEAL

SEQ ID NO: 83825 - protein, 8 aa, Homo Sapiens
DERAIEMF

SEQ ID NO: 83826 - protein, 8 aa, Homo Sapiens
DERAIEMY

SEQ ID NO: 83827 - protein, 8 aa, Homo Sapiens
DEREVVRM

SEQ ID NO: 83828 - protein, 8 aa, Homo Sapiens
DERIREYF

SEQ ID NO: 83829 - protein, 8 aa, Homo Sapiens
DERIVVVA

SEQ ID NO: 83830 - protein, 8 aa, Homo Sapiens
DERIYVKM

SEQ ID NO: 83831 - protein, 8 aa, Homo Sapiens
DERKLRTF

SEQ ID NO: 83832 - protein, 8 aa, Homo Sapiens
DERKVNEL

SEQ ID NO: 83833 - protein, 8 aa, Homo Sapiens
DERLITRL

SEQ ID NO: 83834 - protein, 8 aa, Homo Sapiens
DERLKDLF

SEQ ID NO: 83835 - protein, 8 aa, Homo Sapiens
DERLQPLL

SEQ ID NO: 83836 - protein, 8 aa, Homo Sapiens
DERLVQVL

SEQ ID NO: 83837 - protein, 8 aa, Homo Sapiens
DERLVTCL

SEQ ID NO: 83838 - protein, 8 aa, Homo Sapiens
DERPTEQY

SEQ ID NO: 83839 - protein, 8 aa, Homo Sapiens
DERVLQAL

SEQ ID NO: 83840 - protein, 8 aa, Homo Sapiens
DERVLVAF

SEQ ID NO: 83841 - protein, 8 aa, Homo Sapiens
DERVREYY

SEQ ID NO: 83842 - protein, 8 aa, Homo Sapiens
DERVSPAL

SEQ ID NO: 83843 - protein, 8 aa, Homo Sapiens
DERYFNEM

SEQ ID NO: 83844 - protein, 8 aa, Homo Sapiens
DESFAVKH

SEQ ID NO: 83845 - protein, 8 aa, Homo Sapiens
DESIFSAF

SEQ ID NO: 83846 - protein, 8 aa, Homo Sapiens
DESIRTCL

SEQ ID NO: 83847 - protein, 8 aa, Homo Sapiens
DESKFCSY

SEQ ID NO: 83848 - protein, 8 aa, Homo Sapiens
DESLRSHF

SEQ ID NO: 83849 - protein, 8 aa, Homo Sapiens
DESPRSVL

SEQ ID NO: 83850 - protein, 8 aa, Homo Sapiens
DESYIEKF

SEQ ID NO: 83851 - protein, 8 aa, Homo Sapiens
DETEARKY

SEQ ID NO: 83852 - protein, 8 aa, Homo Sapiens
DETEFRNF

SEQ ID NO: 83853 - protein, 8 aa, Homo Sapiens
DETFTHHL

SEQ ID NO: 83854 - protein, 8 aa, Homo Sapiens
DETGAYLI

SEQ ID NO: 83855 - protein, 8 aa, Homo Sapiens
DETHSHIY

SEQ ID NO: 83856 - protein, 8 aa, Homo Sapiens
DETLIHSH

SEQ ID NO: 83857 - protein, 8 aa, Homo Sapiens
DETLMCSF

SEQ ID NO: 83858 - protein, 8 aa, Homo Sapiens
DETQIFSY

SEQ ID NO: 83859 - protein, 8 aa, Homo Sapiens
DETRVFRL

SEQ ID NO: 83860 - protein, 8 aa, Homo Sapiens
DETTVRKL

SEQ ID NO: 83861 - protein, 8 aa, Homo Sapiens
DETVVNRI

SEQ ID NO: 83862 - protein, 8 aa, Homo Sapiens
DEVAFRKF

SEQ ID NO: 83863 - protein, 8 aa, Homo Sapiens
DEVELARI

SEQ ID NO: 83864 - protein, 8 aa, Homo Sapiens
DEVELIHF

SEQ ID NO: 83865 - protein, 8 aa, Homo Sapiens
DEVERVIT

SEQ ID NO: 83866 - protein, 8 aa, Homo Sapiens
DEVFFHRY

SEQ ID NO: 83867 - protein, 8 aa, Homo Sapiens
DEVFSHIL

SEQ ID NO: 83868 - protein, 8 aa, Homo Sapiens
DEVFVNKL

SEQ ID NO: 83869 - protein, 8 aa, Homo Sapiens
DEVGGEAL

SEQ ID NO: 83870 - protein, 8 aa, Homo Sapiens
DEVHAVGL

SEQ ID NO: 83871 - protein, 8 aa, Homo Sapiens
DEVHIEVH

SEQ ID NO: 83872 - protein, 8 aa, Homo Sapiens
DEVHLEEL

SEQ ID NO: 83873 - protein, 8 aa, Homo Sapiens
DEVIGQVL

SEQ ID NO: 83874 - protein, 8 aa, Homo Sapiens
DEVIHGIF

SEQ ID NO: 83875 - protein, 8 aa, Homo Sapiens
DEVIIEQF

SEQ ID NO: 83876 - protein, 8 aa, Homo Sapiens
DEVIITGY

SEQ ID NO: 83877 - protein, 8 aa, Homo Sapiens
DEVKAHLL

SEQ ID NO: 83878 - protein, 8 aa, Homo Sapiens
DEVKFKSF

SEQ ID NO: 83879 - protein, 8 aa, Homo Sapiens
DEVKFKSY

SEQ ID NO: 83880 - protein, 8 aa, Homo Sapiens
DEVKISSA

SEQ ID NO: 83881 - protein, 8 aa, Homo Sapiens
DEVKKICM

SEQ ID NO: 83882 - protein, 8 aa, Homo Sapiens
DEVKVNQI

SEQ ID NO: 83883 - protein, 8 aa, Homo Sapiens
DEVLFKVY

SEQ ID NO: 83884 - protein, 8 aa, Homo Sapiens
DEVLFTGV

SEQ ID NO: 83885 - protein, 8 aa, Homo Sapiens
DEVLLQKL

SEQ ID NO: 83886 - protein, 8 aa, Homo Sapiens
DEVLNAAF

SEQ ID NO: 83887 - protein, 8 aa, Homo Sapiens
DEVLVAGF

SEQ ID NO: 83888 - protein, 8 aa, Homo Sapiens
DEVLVNHF

SEQ ID NO: 83889 - protein, 8 aa, Homo Sapiens
DEVMRAYL

SEQ ID NO: 83890 - protein, 8 aa, Homo Sapiens
DEVPVATV

SEQ ID NO: 83891 - protein, 8 aa, Homo Sapiens
DEVPVPSF

SEQ ID NO: 83892 - protein, 8 aa, Homo Sapiens
DEVQILEM

SEQ ID NO: 83893 - protein, 8 aa, Homo Sapiens
DEVRAWTI

SEQ ID NO: 83894 - protein, 8 aa, Homo Sapiens
DEVRLLKY

SEQ ID NO: 83895 - protein, 8 aa, Homo Sapiens
DEVRTGTY

SEQ ID NO: 83896 - protein, 8 aa, Homo Sapiens
DEVRTLTY

SEQ ID NO: 83897 - protein, 8 aa, Homo Sapiens
DEVTVTAL

SEQ ID NO: 83898 - protein, 8 aa, Homo Sapiens
DEVVRNAP
